United States Patent 11,421,016 (CANCER NEOEPITOPES) - sequence listing, part 9

SEQ ID NO: 370015 - protein, 9 aa, Homo Sapiens
PLSRPGSGP

SEQ ID NO: 370016 - protein, 9 aa, Homo Sapiens
DKLFNLKMS

SEQ ID NO: 370017 - protein, 9 aa, Homo Sapiens
NVARHSVVL

SEQ ID NO: 370018 - protein, 9 aa, Homo Sapiens
FVTTQEQRL

SEQ ID NO: 370019 - protein, 9 aa, Homo Sapiens
DKKRYLCLL

SEQ ID NO: 370020 - protein, 9 aa, Homo Sapiens
WDMACRNIL

SEQ ID NO: 370021 - protein, 9 aa, Homo Sapiens
PLMATDVKL

SEQ ID NO: 370022 - protein, 9 aa, Homo Sapiens
NGGHVVASM

SEQ ID NO: 370023 - protein, 9 aa, Homo Sapiens
QACNSAMKK

SEQ ID NO: 370024 - protein, 9 aa, Homo Sapiens
LYQRWIYCV

SEQ ID NO: 370025 - protein, 9 aa, Homo Sapiens
TDMLLEIDN

SEQ ID NO: 370026 - protein, 9 aa, Homo Sapiens
TDDCEEEEN

SEQ ID NO: 370027 - protein, 9 aa, Homo Sapiens
SSAASTPPC

SEQ ID NO: 370028 - protein, 9 aa, Homo Sapiens
EWVHMVRPN

SEQ ID NO: 370029 - protein, 9 aa, Homo Sapiens
NLYRKVMFG

SEQ ID NO: 370030 - protein, 9 aa, Homo Sapiens
SAQMEICDI

SEQ ID NO: 370031 - protein, 9 aa, Homo Sapiens
HGGRELSDW

SEQ ID NO: 370032 - protein, 9 aa, Homo Sapiens
INPTNVKNV

SEQ ID NO: 370033 - protein, 9 aa, Homo Sapiens
PQPQRRGTG

SEQ ID NO: 370034 - protein, 9 aa, Homo Sapiens
APGWPPLLL

SEQ ID NO: 370035 - protein, 9 aa, Homo Sapiens
SGGREIFKP

SEQ ID NO: 370036 - protein, 9 aa, Homo Sapiens
LPSTSTLAN

SEQ ID NO: 370037 - protein, 9 aa, Homo Sapiens
NSFLCFFYL

SEQ ID NO: 370038 - protein, 9 aa, Homo Sapiens
ASGFAVGTW

SEQ ID NO: 370039 - protein, 9 aa, Homo Sapiens
AWADSTKNW

SEQ ID NO: 370040 - protein, 9 aa, Homo Sapiens
PLAWHRTLT

SEQ ID NO: 370041 - protein, 9 aa, Homo Sapiens
GPGSTGGAD

SEQ ID NO: 370042 - protein, 9 aa, Homo Sapiens
RHPAARGGV

SEQ ID NO: 370043 - protein, 9 aa, Homo Sapiens
VGAKKEGRS

SEQ ID NO: 370044 - protein, 9 aa, Homo Sapiens
KNRIEEQSQ

SEQ ID NO: 370045 - protein, 9 aa, Homo Sapiens
YERQYHTSA

SEQ ID NO: 370046 - protein, 9 aa, Homo Sapiens
SELALVHWL

SEQ ID NO: 370047 - protein, 9 aa, Homo Sapiens
PSPAEGASL

SEQ ID NO: 370048 - protein, 9 aa, Homo Sapiens
AGQPGQPRQ

SEQ ID NO: 370049 - protein, 9 aa, Homo Sapiens
RKSTLTIFR

SEQ ID NO: 370050 - protein, 9 aa, Homo Sapiens
SSPATMWPN

SEQ ID NO: 370051 - protein, 9 aa, Homo Sapiens
PEPAVTLCE

SEQ ID NO: 370052 - protein, 9 aa, Homo Sapiens
GGRMGFIHN

SEQ ID NO: 370053 - protein, 9 aa, Homo Sapiens
ASRVLWPCS

SEQ ID NO: 370054 - protein, 9 aa, Homo Sapiens
RSPALRARW

SEQ ID NO: 370055 - protein, 9 aa, Homo Sapiens
ESSPIEPRD

SEQ ID NO: 370056 - protein, 9 aa, Homo Sapiens
GPPPACRTG

SEQ ID NO: 370057 - protein, 9 aa, Homo Sapiens
RSVPVAKAK

SEQ ID NO: 370058 - protein, 9 aa, Homo Sapiens
FECKGCGKS

SEQ ID NO: 370059 - protein, 9 aa, Homo Sapiens
SVKDHRTSQ

SEQ ID NO: 370060 - protein, 9 aa, Homo Sapiens
VDIRILAAQ

SEQ ID NO: 370061 - protein, 9 aa, Homo Sapiens
KKGSEERRP

SEQ ID NO: 370062 - protein, 9 aa, Homo Sapiens
SGEALSIGP

SEQ ID NO: 370063 - protein, 9 aa, Homo Sapiens
LSCSSCRSF

SEQ ID NO: 370064 - protein, 9 aa, Homo Sapiens
IDGQIADFL

SEQ ID NO: 370065 - protein, 9 aa, Homo Sapiens
NNFPTITDY

SEQ ID NO: 370066 - protein, 9 aa, Homo Sapiens
PHSLPTQTS

SEQ ID NO: 370067 - protein, 9 aa, Homo Sapiens
ASLWEEGFI

SEQ ID NO: 370068 - protein, 9 aa, Homo Sapiens
LQLRLNPRR

SEQ ID NO: 370069 - protein, 9 aa, Homo Sapiens
VAGLGAQHV

SEQ ID NO: 370070 - protein, 9 aa, Homo Sapiens
KIGKTCWRP

SEQ ID NO: 370071 - protein, 9 aa, Homo Sapiens
RLLPGRLLQ

SEQ ID NO: 370072 - protein, 9 aa, Homo Sapiens
HCLQTRDAF

SEQ ID NO: 370073 - protein, 9 aa, Homo Sapiens
NGAAWEPRR

SEQ ID NO: 370074 - protein, 9 aa, Homo Sapiens
RQETQAQPG

SEQ ID NO: 370075 - protein, 9 aa, Homo Sapiens
AAIEKMVVL

SEQ ID NO: 370076 - protein, 9 aa, Homo Sapiens
LRKRSVPVA

SEQ ID NO: 370077 - protein, 9 aa, Homo Sapiens
SSLCPQGLS

SEQ ID NO: 370078 - protein, 9 aa, Homo Sapiens
ADGTPLLED

SEQ ID NO: 370079 - protein, 9 aa, Homo Sapiens
CAHLAHQQC

SEQ ID NO: 370080 - protein, 9 aa, Homo Sapiens
EENLVDLQK

SEQ ID NO: 370081 - protein, 9 aa, Homo Sapiens
KLQQHQLIT

SEQ ID NO: 370082 - protein, 9 aa, Homo Sapiens
QPRIWVLFE

SEQ ID NO: 370083 - protein, 9 aa, Homo Sapiens
VESGQVPKA

SEQ ID NO: 370084 - protein, 9 aa, Homo Sapiens
AVLNSTNAD

SEQ ID NO: 370085 - protein, 9 aa, Homo Sapiens
PQASSTRSS

SEQ ID NO: 370086 - protein, 9 aa, Homo Sapiens
ASLKKQYPK

SEQ ID NO: 370087 - protein, 9 aa, Homo Sapiens
CNQSVREFL

SEQ ID NO: 370088 - protein, 9 aa, Homo Sapiens
WSSPTGRRA

SEQ ID NO: 370089 - protein, 9 aa, Homo Sapiens
GPRHSHFFL

SEQ ID NO: 370090 - protein, 9 aa, Homo Sapiens
LAWADSTKN

SEQ ID NO: 370091 - protein, 9 aa, Homo Sapiens
CPAGCTPPV

SEQ ID NO: 370092 - protein, 9 aa, Homo Sapiens
LLAACSQQE

SEQ ID NO: 370093 - protein, 9 aa, Homo Sapiens
MFAKPEATE

SEQ ID NO: 370094 - protein, 9 aa, Homo Sapiens
IRHGSGSGH

SEQ ID NO: 370095 - protein, 9 aa, Homo Sapiens
NRLVSGGSD

SEQ ID NO: 370096 - protein, 9 aa, Homo Sapiens
KNITNNILF

SEQ ID NO: 370097 - protein, 9 aa, Homo Sapiens
SGGSDCQVK

SEQ ID NO: 370098 - protein, 9 aa, Homo Sapiens
EKYRKIKMQ

SEQ ID NO: 370099 - protein, 9 aa, Homo Sapiens
AARGGVGAQ

SEQ ID NO: 370100 - protein, 9 aa, Homo Sapiens
SGLMAPPGM

SEQ ID NO: 370101 - protein, 9 aa, Homo Sapiens
LKCFLKTRG

SEQ ID NO: 370102 - protein, 9 aa, Homo Sapiens
GRWCRLSSD

SEQ ID NO: 370103 - protein, 9 aa, Homo Sapiens
AYECHGVCN

SEQ ID NO: 370104 - protein, 9 aa, Homo Sapiens
GFSRLRKIS

SEQ ID NO: 370105 - protein, 9 aa, Homo Sapiens
LKLLFEMRD

SEQ ID NO: 370106 - protein, 9 aa, Homo Sapiens
SSSLDNTEV

SEQ ID NO: 370107 - protein, 9 aa, Homo Sapiens
GVGEHGQQV

SEQ ID NO: 370108 - protein, 9 aa, Homo Sapiens
NQSSEDILQ

SEQ ID NO: 370109 - protein, 9 aa, Homo Sapiens
ASRCQKAFS

SEQ ID NO: 370110 - protein, 9 aa, Homo Sapiens
AAASWPVRA

SEQ ID NO: 370111 - protein, 9 aa, Homo Sapiens
VPVAKAKPK

SEQ ID NO: 370112 - protein, 9 aa, Homo Sapiens
AQMEICDIQ

SEQ ID NO: 370113 - protein, 9 aa, Homo Sapiens
LTKANIARS

SEQ ID NO: 370114 - protein, 9 aa, Homo Sapiens
WPQPCCISS

SEQ ID NO: 370115 - protein, 9 aa, Homo Sapiens
SQKKLSIKL

SEQ ID NO: 370116 - protein, 9 aa, Homo Sapiens
LLRLQSLLS

SEQ ID NO: 370117 - protein, 9 aa, Homo Sapiens
RAPGSRGGR

SEQ ID NO: 370118 - protein, 9 aa, Homo Sapiens
MGIEEQSLW

SEQ ID NO: 370119 - protein, 9 aa, Homo Sapiens
GNTDTPVSK

SEQ ID NO: 370120 - protein, 9 aa, Homo Sapiens
TKKNSNLSH

SEQ ID NO: 370121 - protein, 9 aa, Homo Sapiens
QEHGLGLEN

SEQ ID NO: 370122 - protein, 9 aa, Homo Sapiens
VIQKKNITN

SEQ ID NO: 370123 - protein, 9 aa, Homo Sapiens
NKEKKESSP

SEQ ID NO: 370124 - protein, 9 aa, Homo Sapiens
SCWSPRPPG

SEQ ID NO: 370125 - protein, 9 aa, Homo Sapiens
CRTGSHAPG

SEQ ID NO: 370126 - protein, 9 aa, Homo Sapiens
QPPSRHVHH

SEQ ID NO: 370127 - protein, 9 aa, Homo Sapiens
AVLCWFAER

SEQ ID NO: 370128 - protein, 9 aa, Homo Sapiens
LAVSTRGAS

SEQ ID NO: 370129 - protein, 9 aa, Homo Sapiens
AASWPVRAS

SEQ ID NO: 370130 - protein, 9 aa, Homo Sapiens
TPALVCAPN

SEQ ID NO: 370131 - protein, 9 aa, Homo Sapiens
GNVGSALRL

SEQ ID NO: 370132 - protein, 9 aa, Homo Sapiens
RRNEMAAKH

SEQ ID NO: 370133 - protein, 9 aa, Homo Sapiens
VEQIENLEV

SEQ ID NO: 370134 - protein, 9 aa, Homo Sapiens
SMTQFTLKH

SEQ ID NO: 370135 - protein, 9 aa, Homo Sapiens
YTYLCIPEY

SEQ ID NO: 370136 - protein, 9 aa, Homo Sapiens
QTFVTTQEQ

SEQ ID NO: 370137 - protein, 9 aa, Homo Sapiens
MDHNREAEM

SEQ ID NO: 370138 - protein, 9 aa, Homo Sapiens
SENPELWAT

SEQ ID NO: 370139 - protein, 9 aa, Homo Sapiens
TSGVEQPST

SEQ ID NO: 370140 - protein, 9 aa, Homo Sapiens
ASWDSSEMG

SEQ ID NO: 370141 - protein, 9 aa, Homo Sapiens
HRVPKSRPR

SEQ ID NO: 370142 - protein, 9 aa, Homo Sapiens
GTYRVVDLQ

SEQ ID NO: 370143 - protein, 9 aa, Homo Sapiens
FNGSWMVQG

SEQ ID NO: 370144 - protein, 9 aa, Homo Sapiens
APKKEKSVK

SEQ ID NO: 370145 - protein, 9 aa, Homo Sapiens
FRVGKKLDV

SEQ ID NO: 370146 - protein, 9 aa, Homo Sapiens
SSKKNKEKK

SEQ ID NO: 370147 - protein, 9 aa, Homo Sapiens
HPVRLRSFD

SEQ ID NO: 370148 - protein, 9 aa, Homo Sapiens
DTVGSDAYC

SEQ ID NO: 370149 - protein, 9 aa, Homo Sapiens
RMVAAGALA

SEQ ID NO: 370150 - protein, 9 aa, Homo Sapiens
PYILMRFLT

SEQ ID NO: 370151 - protein, 9 aa, Homo Sapiens
LLPRAPPEA

SEQ ID NO: 370152 - protein, 9 aa, Homo Sapiens
QPGVRALGK

SEQ ID NO: 370153 - protein, 9 aa, Homo Sapiens
RGNSRMNST

SEQ ID NO: 370154 - protein, 9 aa, Homo Sapiens
VHLSKQVWD

SEQ ID NO: 370155 - protein, 9 aa, Homo Sapiens
NHSHKPPCL

SEQ ID NO: 370156 - protein, 9 aa, Homo Sapiens
PCSIPLSTA

SEQ ID NO: 370157 - protein, 9 aa, Homo Sapiens
TWKQCLNKL

SEQ ID NO: 370158 - protein, 9 aa, Homo Sapiens
CVCAVGACT

SEQ ID NO: 370159 - protein, 9 aa, Homo Sapiens
PCLRLLPGR

SEQ ID NO: 370160 - protein, 9 aa, Homo Sapiens
APPRAPAAG

SEQ ID NO: 370161 - protein, 9 aa, Homo Sapiens
TCKAVGSIS

SEQ ID NO: 370162 - protein, 9 aa, Homo Sapiens
SQISEIIDS

SEQ ID NO: 370163 - protein, 9 aa, Homo Sapiens
KWITEENLL

SEQ ID NO: 370164 - protein, 9 aa, Homo Sapiens
NVKNVAKPL

SEQ ID NO: 370165 - protein, 9 aa, Homo Sapiens
AIPQEQLTM

SEQ ID NO: 370166 - protein, 9 aa, Homo Sapiens
FICTASSTR

SEQ ID NO: 370167 - protein, 9 aa, Homo Sapiens
RKPQEIYFI

SEQ ID NO: 370168 - protein, 9 aa, Homo Sapiens
PYMHTLAAA

SEQ ID NO: 370169 - protein, 9 aa, Homo Sapiens
SRGGNMAPM

SEQ ID NO: 370170 - protein, 9 aa, Homo Sapiens
SVAIWKEGV

SEQ ID NO: 370171 - protein, 9 aa, Homo Sapiens
ATNCATHAF

SEQ ID NO: 370172 - protein, 9 aa, Homo Sapiens
IPYQVLNSQ

SEQ ID NO: 370173 - protein, 9 aa, Homo Sapiens
SKPREPGKR

SEQ ID NO: 370174 - protein, 9 aa, Homo Sapiens
VLESLLEHS

SEQ ID NO: 370175 - protein, 9 aa, Homo Sapiens
KKLSPPVME

SEQ ID NO: 370176 - protein, 9 aa, Homo Sapiens
TAREPSAAC

SEQ ID NO: 370177 - protein, 9 aa, Homo Sapiens
AVKFMLKTT

SEQ ID NO: 370178 - protein, 9 aa, Homo Sapiens
GDSALNEQK

SEQ ID NO: 370179 - protein, 9 aa, Homo Sapiens
LGISICGGA

SEQ ID NO: 370180 - protein, 9 aa, Homo Sapiens
FLKMLYMEE

SEQ ID NO: 370181 - protein, 9 aa, Homo Sapiens
LARCFKVFH

SEQ ID NO: 370182 - protein, 9 aa, Homo Sapiens
RWSTSFCLA

SEQ ID NO: 370183 - protein, 9 aa, Homo Sapiens
ELPPYLECV

SEQ ID NO: 370184 - protein, 9 aa, Homo Sapiens
LYFLLTTEK

SEQ ID NO: 370185 - protein, 9 aa, Homo Sapiens
RARAGARAR

SEQ ID NO: 370186 - protein, 9 aa, Homo Sapiens
GEEGSATPD

SEQ ID NO: 370187 - protein, 9 aa, Homo Sapiens
QINFTMAID

SEQ ID NO: 370188 - protein, 9 aa, Homo Sapiens
CNKNRIEEQ

SEQ ID NO: 370189 - protein, 9 aa, Homo Sapiens
QEYLDPRIA

SEQ ID NO: 370190 - protein, 9 aa, Homo Sapiens
EVWTLYANL

SEQ ID NO: 370191 - protein, 9 aa, Homo Sapiens
SRKAVYVVI

SEQ ID NO: 370192 - protein, 9 aa, Homo Sapiens
ASMAAPGSG

SEQ ID NO: 370193 - protein, 9 aa, Homo Sapiens
MTSTWVWSR

SEQ ID NO: 370194 - protein, 9 aa, Homo Sapiens
VRALGKWLQ

SEQ ID NO: 370195 - protein, 9 aa, Homo Sapiens
TFSANKLLQ

SEQ ID NO: 370196 - protein, 9 aa, Homo Sapiens
QHFKEALQD

SEQ ID NO: 370197 - protein, 9 aa, Homo Sapiens
AIVNASNAS

SEQ ID NO: 370198 - protein, 9 aa, Homo Sapiens
ITNMSLDRS

SEQ ID NO: 370199 - protein, 9 aa, Homo Sapiens
KQGKVPESP

SEQ ID NO: 370200 - protein, 9 aa, Homo Sapiens
SRVLWPCSA

SEQ ID NO: 370201 - protein, 9 aa, Homo Sapiens
VNDNPPVLT

SEQ ID NO: 370202 - protein, 9 aa, Homo Sapiens
SLPPCSIPL

SEQ ID NO: 370203 - protein, 9 aa, Homo Sapiens
AAASLALGR

SEQ ID NO: 370204 - protein, 9 aa, Homo Sapiens
VNFIKKITS

SEQ ID NO: 370205 - protein, 9 aa, Homo Sapiens
LLAMLGCSI

SEQ ID NO: 370206 - protein, 9 aa, Homo Sapiens
RGPRGSRSQ

SEQ ID NO: 370207 - protein, 9 aa, Homo Sapiens
DGETPGQAA

SEQ ID NO: 370208 - protein, 9 aa, Homo Sapiens
KKIQDQDQE

SEQ ID NO: 370209 - protein, 9 aa, Homo Sapiens
SLGHVSGPW

SEQ ID NO: 370210 - protein, 9 aa, Homo Sapiens
DLTPPRPLP

SEQ ID NO: 370211 - protein, 9 aa, Homo Sapiens
TSKPIVHAK

SEQ ID NO: 370212 - protein, 9 aa, Homo Sapiens
LPVAFFFSG

SEQ ID NO: 370213 - protein, 9 aa, Homo Sapiens
GPPTHRFQP

SEQ ID NO: 370214 - protein, 9 aa, Homo Sapiens
ASPTSSTKP

SEQ ID NO: 370215 - protein, 9 aa, Homo Sapiens
QRAEYILKN

SEQ ID NO: 370216 - protein, 9 aa, Homo Sapiens
PYRSEFYSL

SEQ ID NO: 370217 - protein, 9 aa, Homo Sapiens
SPTEPNVVS

SEQ ID NO: 370218 - protein, 9 aa, Homo Sapiens
AKKHVFDVN

SEQ ID NO: 370219 - protein, 9 aa, Homo Sapiens
QPWRLRLPD

SEQ ID NO: 370220 - protein, 9 aa, Homo Sapiens
ARPVSPAPS

SEQ ID NO: 370221 - protein, 9 aa, Homo Sapiens
LQYSADADA

SEQ ID NO: 370222 - protein, 9 aa, Homo Sapiens
SGSEATSQY

SEQ ID NO: 370223 - protein, 9 aa, Homo Sapiens
SKLLAAGFG

SEQ ID NO: 370224 - protein, 9 aa, Homo Sapiens
PGLPRRDPS

SEQ ID NO: 370225 - protein, 9 aa, Homo Sapiens
PKRVMDQAR

SEQ ID NO: 370226 - protein, 9 aa, Homo Sapiens
DILQDAQVA

SEQ ID NO: 370227 - protein, 9 aa, Homo Sapiens
RAPIICILG

SEQ ID NO: 370228 - protein, 9 aa, Homo Sapiens
GNEDEEGQQ

SEQ ID NO: 370229 - protein, 9 aa, Homo Sapiens
DQSIIIKRK

SEQ ID NO: 370230 - protein, 9 aa, Homo Sapiens
EIDHLLQST

SEQ ID NO: 370231 - protein, 9 aa, Homo Sapiens
SCVTCFRAA

SEQ ID NO: 370232 - protein, 9 aa, Homo Sapiens
PPTQQPQTP

SEQ ID NO: 370233 - protein, 9 aa, Homo Sapiens
RIASSVSPP

SEQ ID NO: 370234 - protein, 9 aa, Homo Sapiens
QKLFQWKQL

SEQ ID NO: 370235 - protein, 9 aa, Homo Sapiens
QCKKRKNYC

SEQ ID NO: 370236 - protein, 9 aa, Homo Sapiens
DTLYFPVLI

SEQ ID NO: 370237 - protein, 9 aa, Homo Sapiens
IYTYLCIPE

SEQ ID NO: 370238 - protein, 9 aa, Homo Sapiens
KENRDLEKI

SEQ ID NO: 370239 - protein, 9 aa, Homo Sapiens
LLEDCRLGV

SEQ ID NO: 370240 - protein, 9 aa, Homo Sapiens
PAVVVVHEV

SEQ ID NO: 370241 - protein, 9 aa, Homo Sapiens
TVWYLQYTD

SEQ ID NO: 370242 - protein, 9 aa, Homo Sapiens
KGGPLLDTR

SEQ ID NO: 370243 - protein, 9 aa, Homo Sapiens
CRPAGRCAC

SEQ ID NO: 370244 - protein, 9 aa, Homo Sapiens
LTEELAVAD

SEQ ID NO: 370245 - protein, 9 aa, Homo Sapiens
YLKERESYD

SEQ ID NO: 370246 - protein, 9 aa, Homo Sapiens
VLLPGDMGC

SEQ ID NO: 370247 - protein, 9 aa, Homo Sapiens
SNYTGCCHA

SEQ ID NO: 370248 - protein, 9 aa, Homo Sapiens
TRRRCYRHS

SEQ ID NO: 370249 - protein, 9 aa, Homo Sapiens
ISIATNPES

SEQ ID NO: 370250 - protein, 9 aa, Homo Sapiens
LRACANSWS

SEQ ID NO: 370251 - protein, 9 aa, Homo Sapiens
FGLIFLTFI

SEQ ID NO: 370252 - protein, 9 aa, Homo Sapiens
DLATTDDIR

SEQ ID NO: 370253 - protein, 9 aa, Homo Sapiens
PPPVWAVLA

SEQ ID NO: 370254 - protein, 9 aa, Homo Sapiens
AKLQQHQLI

SEQ ID NO: 370255 - protein, 9 aa, Homo Sapiens
WQKKHDKQN

SEQ ID NO: 370256 - protein, 9 aa, Homo Sapiens
KLKSPMRLN

SEQ ID NO: 370257 - protein, 9 aa, Homo Sapiens
RIRSKKRKL

SEQ ID NO: 370258 - protein, 9 aa, Homo Sapiens
VGVFQHDKV

SEQ ID NO: 370259 - protein, 9 aa, Homo Sapiens
PKPPPQKER

SEQ ID NO: 370260 - protein, 9 aa, Homo Sapiens
RPAAPTRRL

SEQ ID NO: 370261 - protein, 9 aa, Homo Sapiens
HDIPMLLHV

SEQ ID NO: 370262 - protein, 9 aa, Homo Sapiens
GRGYGGTKI

SEQ ID NO: 370263 - protein, 9 aa, Homo Sapiens
IHVLWNHAV

SEQ ID NO: 370264 - protein, 9 aa, Homo Sapiens
EQREQETSD

SEQ ID NO: 370265 - protein, 9 aa, Homo Sapiens
LPPQTRMLH

SEQ ID NO: 370266 - protein, 9 aa, Homo Sapiens
YPRHFGPAP

SEQ ID NO: 370267 - protein, 9 aa, Homo Sapiens
SDAYCLSVS

SEQ ID NO: 370268 - protein, 9 aa, Homo Sapiens
ELEAIESWL

SEQ ID NO: 370269 - protein, 9 aa, Homo Sapiens
LFEMRDISL

SEQ ID NO: 370270 - protein, 9 aa, Homo Sapiens
CTPVPVACP

SEQ ID NO: 370271 - protein, 9 aa, Homo Sapiens
KWLQWPHPD

SEQ ID NO: 370272 - protein, 9 aa, Homo Sapiens
PQNAAAASW

SEQ ID NO: 370273 - protein, 9 aa, Homo Sapiens
ALGKWLQWP

SEQ ID NO: 370274 - protein, 9 aa, Homo Sapiens
HSKLKEVVE

SEQ ID NO: 370275 - protein, 9 aa, Homo Sapiens
VESTTEQAQ

SEQ ID NO: 370276 - protein, 9 aa, Homo Sapiens
EARIVGGPL

SEQ ID NO: 370277 - protein, 9 aa, Homo Sapiens
PAPGKPPTS

SEQ ID NO: 370278 - protein, 9 aa, Homo Sapiens
QPYRSEFYS

SEQ ID NO: 370279 - protein, 9 aa, Homo Sapiens
PHTTEAYQK

SEQ ID NO: 370280 - protein, 9 aa, Homo Sapiens
PEPPPAHPR

SEQ ID NO: 370281 - protein, 9 aa, Homo Sapiens
LPWMVPWGM

SEQ ID NO: 370282 - protein, 9 aa, Homo Sapiens
CCDCWEPAP

SEQ ID NO: 370283 - protein, 9 aa, Homo Sapiens
ARARQGAAA

SEQ ID NO: 370284 - protein, 9 aa, Homo Sapiens
TICGHLPKI

SEQ ID NO: 370285 - protein, 9 aa, Homo Sapiens
RRSCPTLRA

SEQ ID NO: 370286 - protein, 9 aa, Homo Sapiens
ALVTAVGSA

SEQ ID NO: 370287 - protein, 9 aa, Homo Sapiens
HYLVEDSLY

SEQ ID NO: 370288 - protein, 9 aa, Homo Sapiens
GSTVGPSGT

SEQ ID NO: 370289 - protein, 9 aa, Homo Sapiens
ESFMPQLLA

SEQ ID NO: 370290 - protein, 9 aa, Homo Sapiens
GALATGSSR

SEQ ID NO: 370291 - protein, 9 aa, Homo Sapiens
SGGSGKAWG

SEQ ID NO: 370292 - protein, 9 aa, Homo Sapiens
ADRPERAAR

SEQ ID NO: 370293 - protein, 9 aa, Homo Sapiens
QVGLPAPLH

SEQ ID NO: 370294 - protein, 9 aa, Homo Sapiens
TAEQNVLQQ

SEQ ID NO: 370295 - protein, 9 aa, Homo Sapiens
GADRGCGPG

SEQ ID NO: 370296 - protein, 9 aa, Homo Sapiens
WATGPSVPS

SEQ ID NO: 370297 - protein, 9 aa, Homo Sapiens
SVMREWRHL

SEQ ID NO: 370298 - protein, 9 aa, Homo Sapiens
CNKYGKAFA

SEQ ID NO: 370299 - protein, 9 aa, Homo Sapiens
ELLDEKLLV

SEQ ID NO: 370300 - protein, 9 aa, Homo Sapiens
RRPPRWTAM

SEQ ID NO: 370301 - protein, 9 aa, Homo Sapiens
GLAREEAGA

SEQ ID NO: 370302 - protein, 9 aa, Homo Sapiens
AGVHDSMDN

SEQ ID NO: 370303 - protein, 9 aa, Homo Sapiens
VMHPKGNGR

SEQ ID NO: 370304 - protein, 9 aa, Homo Sapiens
IVVVVWDRP

SEQ ID NO: 370305 - protein, 9 aa, Homo Sapiens
SKDKALSSA

SEQ ID NO: 370306 - protein, 9 aa, Homo Sapiens
LRSLQRSPA

SEQ ID NO: 370307 - protein, 9 aa, Homo Sapiens
PDDMDLRVY

SEQ ID NO: 370308 - protein, 9 aa, Homo Sapiens
RKRCVTTHW

SEQ ID NO: 370309 - protein, 9 aa, Homo Sapiens
WNPTRMLQS

SEQ ID NO: 370310 - protein, 9 aa, Homo Sapiens
FISLDHYLA

SEQ ID NO: 370311 - protein, 9 aa, Homo Sapiens
SLDHYLAIV

SEQ ID NO: 370312 - protein, 9 aa, Homo Sapiens
EYPDCIMNT

SEQ ID NO: 370313 - protein, 9 aa, Homo Sapiens
TQAQPGRWC

SEQ ID NO: 370314 - protein, 9 aa, Homo Sapiens
GMRLGAVAL

SEQ ID NO: 370315 - protein, 9 aa, Homo Sapiens
KERRRRNDY

SEQ ID NO: 370316 - protein, 9 aa, Homo Sapiens
QQQQRRPPE

SEQ ID NO: 370317 - protein, 9 aa, Homo Sapiens
AFLQPDDKN

SEQ ID NO: 370318 - protein, 9 aa, Homo Sapiens
RLSWEYWQD

SEQ ID NO: 370319 - protein, 9 aa, Homo Sapiens
QKKDYVQTC

SEQ ID NO: 370320 - protein, 9 aa, Homo Sapiens
LEGMDHLVQ

SEQ ID NO: 370321 - protein, 9 aa, Homo Sapiens
TSWHTLHHE

SEQ ID NO: 370322 - protein, 9 aa, Homo Sapiens
SSSGRAPIK

SEQ ID NO: 370323 - protein, 9 aa, Homo Sapiens
RMTPSGQQQ

SEQ ID NO: 370324 - protein, 9 aa, Homo Sapiens
KKHDKQNSR

SEQ ID NO: 370325 - protein, 9 aa, Homo Sapiens
SPPSSASAT

SEQ ID NO: 370326 - protein, 9 aa, Homo Sapiens
SLKMNSSKC

SEQ ID NO: 370327 - protein, 9 aa, Homo Sapiens
LPKQGGKVD

SEQ ID NO: 370328 - protein, 9 aa, Homo Sapiens
EYLPTALEP

SEQ ID NO: 370329 - protein, 9 aa, Homo Sapiens
PVRASSVAS

SEQ ID NO: 370330 - protein, 9 aa, Homo Sapiens
QRVPKGGPL

SEQ ID NO: 370331 - protein, 9 aa, Homo Sapiens
ERYASCRSE

SEQ ID NO: 370332 - protein, 9 aa, Homo Sapiens
YLVRMAMVP

SEQ ID NO: 370333 - protein, 9 aa, Homo Sapiens
GVGAKKEGR

SEQ ID NO: 370334 - protein, 9 aa, Homo Sapiens
TFGTSITSV

SEQ ID NO: 370335 - protein, 9 aa, Homo Sapiens
VEALDHEEE

SEQ ID NO: 370336 - protein, 9 aa, Homo Sapiens
GGDCGSCCP

SEQ ID NO: 370337 - protein, 9 aa, Homo Sapiens
CCQEHGLGL

SEQ ID NO: 370338 - protein, 9 aa, Homo Sapiens
LYHAMKDHI

SEQ ID NO: 370339 - protein, 9 aa, Homo Sapiens
VRDSLWRRN

SEQ ID NO: 370340 - protein, 9 aa, Homo Sapiens
EDLTATSVT

SEQ ID NO: 370341 - protein, 9 aa, Homo Sapiens
DLENLGFTH

SEQ ID NO: 370342 - protein, 9 aa, Homo Sapiens
HVSRLYRQK

SEQ ID NO: 370343 - protein, 9 aa, Homo Sapiens
RWTTNYDFS

SEQ ID NO: 370344 - protein, 9 aa, Homo Sapiens
EEIMKKAAE

SEQ ID NO: 370345 - protein, 9 aa, Homo Sapiens
SKIVSLMLD

SEQ ID NO: 370346 - protein, 9 aa, Homo Sapiens
LPRRDPSGS

SEQ ID NO: 370347 - protein, 9 aa, Homo Sapiens
GQQVGLPAP

SEQ ID NO: 370348 - protein, 9 aa, Homo Sapiens
LRDHCLQTR

SEQ ID NO: 370349 - protein, 9 aa, Homo Sapiens
HLAKGAQLN

SEQ ID NO: 370350 - protein, 9 aa, Homo Sapiens
PVSGSWCGT

SEQ ID NO: 370351 - protein, 9 aa, Homo Sapiens
FVGGCPTTP

SEQ ID NO: 370352 - protein, 9 aa, Homo Sapiens
LERNPTNVK

SEQ ID NO: 370353 - protein, 9 aa, Homo Sapiens
KLWRMMTLN

SEQ ID NO: 370354 - protein, 9 aa, Homo Sapiens
TLFLQTLFQ

SEQ ID NO: 370355 - protein, 9 aa, Homo Sapiens
PQDTPGGRP

SEQ ID NO: 370356 - protein, 9 aa, Homo Sapiens
CTGRHQWHP

SEQ ID NO: 370357 - protein, 9 aa, Homo Sapiens
FSPLMATDV

SEQ ID NO: 370358 - protein, 9 aa, Homo Sapiens
VDAAELPHE

SEQ ID NO: 370359 - protein, 9 aa, Homo Sapiens
LGMMLVEQP

SEQ ID NO: 370360 - protein, 9 aa, Homo Sapiens
GRHRCSPHS

SEQ ID NO: 370361 - protein, 9 aa, Homo Sapiens
PLILLRHVG

SEQ ID NO: 370362 - protein, 9 aa, Homo Sapiens
NRWEGPGKQ

SEQ ID NO: 370363 - protein, 9 aa, Homo Sapiens
ARDARRTVT

SEQ ID NO: 370364 - protein, 9 aa, Homo Sapiens
SKAIEIDNE

SEQ ID NO: 370365 - protein, 9 aa, Homo Sapiens
RLNVSITNA

SEQ ID NO: 370366 - protein, 9 aa, Homo Sapiens
ILEMDDHRA

SEQ ID NO: 370367 - protein, 9 aa, Homo Sapiens
ELELEDLYA

SEQ ID NO: 370368 - protein, 9 aa, Homo Sapiens
HEIFISDSS

SEQ ID NO: 370369 - protein, 9 aa, Homo Sapiens
YGICKVYLA

SEQ ID NO: 370370 - protein, 9 aa, Homo Sapiens
LLEGMDHLV

SEQ ID NO: 370371 - protein, 9 aa, Homo Sapiens
RNKSFYMHR

SEQ ID NO: 370372 - protein, 9 aa, Homo Sapiens
CASTSRSSA

SEQ ID NO: 370373 - protein, 9 aa, Homo Sapiens
NIRRNEMAA

SEQ ID NO: 370374 - protein, 9 aa, Homo Sapiens
DINNQIYTV

SEQ ID NO: 370375 - protein, 9 aa, Homo Sapiens
EYILKNLQQ

SEQ ID NO: 370376 - protein, 9 aa, Homo Sapiens
INRRAMRTF

SEQ ID NO: 370377 - protein, 9 aa, Homo Sapiens
IIPQVLADL

SEQ ID NO: 370378 - protein, 9 aa, Homo Sapiens
CLNKLEEQL

SEQ ID NO: 370379 - protein, 9 aa, Homo Sapiens
EGPGKQLYN

SEQ ID NO: 370380 - protein, 9 aa, Homo Sapiens
MPPPGLRPC

SEQ ID NO: 370381 - protein, 9 aa, Homo Sapiens
EDPREQLRA

SEQ ID NO: 370382 - protein, 9 aa, Homo Sapiens
NVLRHRKNE

SEQ ID NO: 370383 - protein, 9 aa, Homo Sapiens
KCLSASSTG

SEQ ID NO: 370384 - protein, 9 aa, Homo Sapiens
RTHTNFTGW

SEQ ID NO: 370385 - protein, 9 aa, Homo Sapiens
RAKQPSRLP

SEQ ID NO: 370386 - protein, 9 aa, Homo Sapiens
TTASRVLWP

SEQ ID NO: 370387 - protein, 9 aa, Homo Sapiens
YRSEFYSLQ

SEQ ID NO: 370388 - protein, 9 aa, Homo Sapiens
YQRWIYCVD

SEQ ID NO: 370389 - protein, 9 aa, Homo Sapiens
EGSQQSRGG

SEQ ID NO: 370390 - protein, 9 aa, Homo Sapiens
EGNSSFHSP

SEQ ID NO: 370391 - protein, 9 aa, Homo Sapiens
AEREHHSCT

SEQ ID NO: 370392 - protein, 9 aa, Homo Sapiens
WISGSEATS

SEQ ID NO: 370393 - protein, 9 aa, Homo Sapiens
LEDLYAKLI

SEQ ID NO: 370394 - protein, 9 aa, Homo Sapiens
GSEERRPHK

SEQ ID NO: 370395 - protein, 9 aa, Homo Sapiens
ATSGVEQPS

SEQ ID NO: 370396 - protein, 9 aa, Homo Sapiens
MLQDHKWEL

SEQ ID NO: 370397 - protein, 9 aa, Homo Sapiens
MVEKLKTLV

SEQ ID NO: 370398 - protein, 9 aa, Homo Sapiens
KMQNKVFQE

SEQ ID NO: 370399 - protein, 9 aa, Homo Sapiens
VLPGDGVEG

SEQ ID NO: 370400 - protein, 9 aa, Homo Sapiens
SVPVESGDI

SEQ ID NO: 370401 - protein, 9 aa, Homo Sapiens
LAYWKAGSV

SEQ ID NO: 370402 - protein, 9 aa, Homo Sapiens
ATSASGSGC

SEQ ID NO: 370403 - protein, 9 aa, Homo Sapiens
FHQKNWYHI

SEQ ID NO: 370404 - protein, 9 aa, Homo Sapiens
STPIFGPGI

SEQ ID NO: 370405 - protein, 9 aa, Homo Sapiens
FNSLQLKVF

SEQ ID NO: 370406 - protein, 9 aa, Homo Sapiens
PERRCSRRA

SEQ ID NO: 370407 - protein, 9 aa, Homo Sapiens
VRDEIDHLL

SEQ ID NO: 370408 - protein, 9 aa, Homo Sapiens
SFVSGGGGL

SEQ ID NO: 370409 - protein, 9 aa, Homo Sapiens
PGEHCPSAP

SEQ ID NO: 370410 - protein, 9 aa, Homo Sapiens
SSASATSAS

SEQ ID NO: 370411 - protein, 9 aa, Homo Sapiens
SASRCQKAF

SEQ ID NO: 370412 - protein, 9 aa, Homo Sapiens
YSQNSAGLR

SEQ ID NO: 370413 - protein, 9 aa, Homo Sapiens
FAEWKLSVF

SEQ ID NO: 370414 - protein, 9 aa, Homo Sapiens
CRGTARCAR

SEQ ID NO: 370415 - protein, 9 aa, Homo Sapiens
FWSISSGPW

SEQ ID NO: 370416 - protein, 9 aa, Homo Sapiens
FTIMRDFFP

SEQ ID NO: 370417 - protein, 9 aa, Homo Sapiens
PTDPTNAAT

SEQ ID NO: 370418 - protein, 9 aa, Homo Sapiens
ETREEHMER

SEQ ID NO: 370419 - protein, 9 aa, Homo Sapiens
ARSWCESRA

SEQ ID NO: 370420 - protein, 9 aa, Homo Sapiens
TPVPVACPD

SEQ ID NO: 370421 - protein, 9 aa, Homo Sapiens
RLASAVSSP

SEQ ID NO: 370422 - protein, 9 aa, Homo Sapiens
LTEEFPGQS

SEQ ID NO: 370423 - protein, 9 aa, Homo Sapiens
FSPYILMRF

SEQ ID NO: 370424 - protein, 9 aa, Homo Sapiens
RHQWHPDPV

SEQ ID NO: 370425 - protein, 9 aa, Homo Sapiens
WPCSATVLS

SEQ ID NO: 370426 - protein, 9 aa, Homo Sapiens
VLFEDPYSS

SEQ ID NO: 370427 - protein, 9 aa, Homo Sapiens
LEASGMPPS

SEQ ID NO: 370428 - protein, 9 aa, Homo Sapiens
GALAAAGTN

SEQ ID NO: 370429 - protein, 9 aa, Homo Sapiens
DPREVRHRA

SEQ ID NO: 370430 - protein, 9 aa, Homo Sapiens
SARPSPSHG

SEQ ID NO: 370431 - protein, 9 aa, Homo Sapiens
SLQRSSCFG

SEQ ID NO: 370432 - protein, 9 aa, Homo Sapiens
MAYPKIKET

SEQ ID NO: 370433 - protein, 9 aa, Homo Sapiens
CANSWSTWL

SEQ ID NO: 370434 - protein, 9 aa, Homo Sapiens
NAGCDSPAG

SEQ ID NO: 370435 - protein, 9 aa, Homo Sapiens
LTQTPAKPT

SEQ ID NO: 370436 - protein, 9 aa, Homo Sapiens
HSCTPVPVA

SEQ ID NO: 370437 - protein, 9 aa, Homo Sapiens
GQPGQPRQP

SEQ ID NO: 370438 - protein, 9 aa, Homo Sapiens
NVKNVTKPL

SEQ ID NO: 370439 - protein, 9 aa, Homo Sapiens
VHTQEPLYQ

SEQ ID NO: 370440 - protein, 9 aa, Homo Sapiens
VAVHVQELQ

SEQ ID NO: 370441 - protein, 9 aa, Homo Sapiens
RTWAGWGPG

SEQ ID NO: 370442 - protein, 9 aa, Homo Sapiens
ELATVLLQS

SEQ ID NO: 370443 - protein, 9 aa, Homo Sapiens
VCRAVASGM

SEQ ID NO: 370444 - protein, 9 aa, Homo Sapiens
GLGGSRGLR

SEQ ID NO: 370445 - protein, 9 aa, Homo Sapiens
EERLTEEFP

SEQ ID NO: 370446 - protein, 9 aa, Homo Sapiens
PDDGGPGVG

SEQ ID NO: 370447 - protein, 9 aa, Homo Sapiens
ITDYFPGTH

SEQ ID NO: 370448 - protein, 9 aa, Homo Sapiens
WRGQPGPAA

SEQ ID NO: 370449 - protein, 9 aa, Homo Sapiens
KKTRFLPTG

SEQ ID NO: 370450 - protein, 9 aa, Homo Sapiens
SGPLEKGQV

SEQ ID NO: 370451 - protein, 9 aa, Homo Sapiens
MRCMYGSMT

SEQ ID NO: 370452 - protein, 9 aa, Homo Sapiens
KTEYLPTAL

SEQ ID NO: 370453 - protein, 9 aa, Homo Sapiens
ILFCVCAVG

SEQ ID NO: 370454 - protein, 9 aa, Homo Sapiens
EQLRALVTP

SEQ ID NO: 370455 - protein, 9 aa, Homo Sapiens
IAMVQAATT

SEQ ID NO: 370456 - protein, 9 aa, Homo Sapiens
NSIKNSFLC

SEQ ID NO: 370457 - protein, 9 aa, Homo Sapiens
KLNISDTRG

SEQ ID NO: 370458 - protein, 9 aa, Homo Sapiens
SVASQKWGP

SEQ ID NO: 370459 - protein, 9 aa, Homo Sapiens
GSGAGTGTA

SEQ ID NO: 370460 - protein, 9 aa, Homo Sapiens
GGASKLNGA

SEQ ID NO: 370461 - protein, 9 aa, Homo Sapiens
TEELFLLVS

SEQ ID NO: 370462 - protein, 9 aa, Homo Sapiens
HRTKSAEEE

SEQ ID NO: 370463 - protein, 9 aa, Homo Sapiens
AVQYQVNQA

SEQ ID NO: 370464 - protein, 9 aa, Homo Sapiens
RLANVVHQV

SEQ ID NO: 370465 - protein, 9 aa, Homo Sapiens
AACQNEHLL

SEQ ID NO: 370466 - protein, 9 aa, Homo Sapiens
EEVLEVDKR

SEQ ID NO: 370467 - protein, 9 aa, Homo Sapiens
TGPFFRYCT

SEQ ID NO: 370468 - protein, 9 aa, Homo Sapiens
LRKHYLVED

SEQ ID NO: 370469 - protein, 9 aa, Homo Sapiens
KKRGKSQGG

SEQ ID NO: 370470 - protein, 9 aa, Homo Sapiens
HLSQALQAV

SEQ ID NO: 370471 - protein, 9 aa, Homo Sapiens
LPGGLKLSS

SEQ ID NO: 370472 - protein, 9 aa, Homo Sapiens
FKLELSCLA

SEQ ID NO: 370473 - protein, 9 aa, Homo Sapiens
SLVNIILLL

SEQ ID NO: 370474 - protein, 9 aa, Homo Sapiens
AVRDEIDHL

SEQ ID NO: 370475 - protein, 9 aa, Homo Sapiens
QQVKTNNSE

SEQ ID NO: 370476 - protein, 9 aa, Homo Sapiens
NIELLLNEG

SEQ ID NO: 370477 - protein, 9 aa, Homo Sapiens
HQLATSYFI

SEQ ID NO: 370478 - protein, 9 aa, Homo Sapiens
SCSAPIKLL

SEQ ID NO: 370479 - protein, 9 aa, Homo Sapiens
DHLLQSTGQ

SEQ ID NO: 370480 - protein, 9 aa, Homo Sapiens
DIKVQGFRI

SEQ ID NO: 370481 - protein, 9 aa, Homo Sapiens
PCPAAPRLA

SEQ ID NO: 370482 - protein, 9 aa, Homo Sapiens
KWGPLGQPW

SEQ ID NO: 370483 - protein, 9 aa, Homo Sapiens
DPANAPCRC

SEQ ID NO: 370484 - protein, 9 aa, Homo Sapiens
GRQERQQQQ

SEQ ID NO: 370485 - protein, 9 aa, Homo Sapiens
KKIGKTCWR

SEQ ID NO: 370486 - protein, 9 aa, Homo Sapiens
QQKTELLVT

SEQ ID NO: 370487 - protein, 9 aa, Homo Sapiens
TSVFTLKKG

SEQ ID NO: 370488 - protein, 9 aa, Homo Sapiens
HTTEAYQKY

SEQ ID NO: 370489 - protein, 9 aa, Homo Sapiens
PHLGRVCLD

SEQ ID NO: 370490 - protein, 9 aa, Homo Sapiens
EPQIRPVYV

SEQ ID NO: 370491 - protein, 9 aa, Homo Sapiens
IQEEKKIKY

SEQ ID NO: 370492 - protein, 9 aa, Homo Sapiens
TIAWVRIYR

SEQ ID NO: 370493 - protein, 9 aa, Homo Sapiens
APASTPRPS

SEQ ID NO: 370494 - protein, 9 aa, Homo Sapiens
GASPEPPHR

SEQ ID NO: 370495 - protein, 9 aa, Homo Sapiens
DQDQELATV

SEQ ID NO: 370496 - protein, 9 aa, Homo Sapiens
ALRLSPSGS

SEQ ID NO: 370497 - protein, 9 aa, Homo Sapiens
GMQHHLQAL

SEQ ID NO: 370498 - protein, 9 aa, Homo Sapiens
ALGQAADGT

SEQ ID NO: 370499 - protein, 9 aa, Homo Sapiens
EGGSLQVPQ

SEQ ID NO: 370500 - protein, 9 aa, Homo Sapiens
GSYRFSPLL

SEQ ID NO: 370501 - protein, 9 aa, Homo Sapiens
HDPDPTAPP

SEQ ID NO: 370502 - protein, 9 aa, Homo Sapiens
DVVQQTEAL

SEQ ID NO: 370503 - protein, 9 aa, Homo Sapiens
FAAETDMYP

SEQ ID NO: 370504 - protein, 9 aa, Homo Sapiens
VTTQEQRLT

SEQ ID NO: 370505 - protein, 9 aa, Homo Sapiens
MVPWGMEAL

SEQ ID NO: 370506 - protein, 9 aa, Homo Sapiens
TPTCHLLGE

SEQ ID NO: 370507 - protein, 9 aa, Homo Sapiens
HGPGDFDVP

SEQ ID NO: 370508 - protein, 9 aa, Homo Sapiens
RTNGASQTT

SEQ ID NO: 370509 - protein, 9 aa, Homo Sapiens
RNSGTVLRL

SEQ ID NO: 370510 - protein, 9 aa, Homo Sapiens
LGLALLQHH

SEQ ID NO: 370511 - protein, 9 aa, Homo Sapiens
VTGGREGRD

SEQ ID NO: 370512 - protein, 9 aa, Homo Sapiens
LKLPEKGPL

SEQ ID NO: 370513 - protein, 9 aa, Homo Sapiens
TVCLTAGTS

SEQ ID NO: 370514 - protein, 9 aa, Homo Sapiens
PWKMSLLIP

SEQ ID NO: 370515 - protein, 9 aa, Homo Sapiens
LWLLGSRMA

SEQ ID NO: 370516 - protein, 9 aa, Homo Sapiens
VSGPTAGGS

SEQ ID NO: 370517 - protein, 9 aa, Homo Sapiens
FPCLRLLPG

SEQ ID NO: 370518 - protein, 9 aa, Homo Sapiens
GEELVVPET

SEQ ID NO: 370519 - protein, 9 aa, Homo Sapiens
GSLMVEKLK

SEQ ID NO: 370520 - protein, 9 aa, Homo Sapiens
HAMIGNNMI

SEQ ID NO: 370521 - protein, 9 aa, Homo Sapiens
SQQSRGGNM

SEQ ID NO: 370522 - protein, 9 aa, Homo Sapiens
HVYLPLYHE

SEQ ID NO: 370523 - protein, 9 aa, Homo Sapiens
ASSTRVPLW

SEQ ID NO: 370524 - protein, 9 aa, Homo Sapiens
LPQVQREHL

SEQ ID NO: 370525 - protein, 9 aa, Homo Sapiens
GGSLADWPS

SEQ ID NO: 370526 - protein, 9 aa, Homo Sapiens
IWDFLCQLF

SEQ ID NO: 370527 - protein, 9 aa, Homo Sapiens
MRKSTLTIF

SEQ ID NO: 370528 - protein, 9 aa, Homo Sapiens
RGSSGSGRA

SEQ ID NO: 370529 - protein, 9 aa, Homo Sapiens
QLKTRSWQS

SEQ ID NO: 370530 - protein, 9 aa, Homo Sapiens
ANVVHQVQT

SEQ ID NO: 370531 - protein, 9 aa, Homo Sapiens
GIGSEAEKT

SEQ ID NO: 370532 - protein, 9 aa, Homo Sapiens
NKEPQNIRR

SEQ ID NO: 370533 - protein, 9 aa, Homo Sapiens
ICREVLQNQ

SEQ ID NO: 370534 - protein, 9 aa, Homo Sapiens
QCFSRLPSK

SEQ ID NO: 370535 - protein, 9 aa, Homo Sapiens
PAAVTAPPS

SEQ ID NO: 370536 - protein, 9 aa, Homo Sapiens
AFYRLISGP

SEQ ID NO: 370537 - protein, 9 aa, Homo Sapiens
AQCGKDFRC

SEQ ID NO: 370538 - protein, 9 aa, Homo Sapiens
LPGRLLQSC

SEQ ID NO: 370539 - protein, 9 aa, Homo Sapiens
CRKCRKCYE

SEQ ID NO: 370540 - protein, 9 aa, Homo Sapiens
EVDGDQDAV

SEQ ID NO: 370541 - protein, 9 aa, Homo Sapiens
CGHLPKILY

SEQ ID NO: 370542 - protein, 9 aa, Homo Sapiens
RGQAVSLVS

SEQ ID NO: 370543 - protein, 9 aa, Homo Sapiens
NLLRQFLPA

SEQ ID NO: 370544 - protein, 9 aa, Homo Sapiens
FMHRNLKQK

SEQ ID NO: 370545 - protein, 9 aa, Homo Sapiens
NVLSHLPSH

SEQ ID NO: 370546 - protein, 9 aa, Homo Sapiens
PKTTDTSFK

SEQ ID NO: 370547 - protein, 9 aa, Homo Sapiens
LPDDICREV

SEQ ID NO: 370548 - protein, 9 aa, Homo Sapiens
GKKLDVAIL

SEQ ID NO: 370549 - protein, 9 aa, Homo Sapiens
GLMAPPGMQ

SEQ ID NO: 370550 - protein, 9 aa, Homo Sapiens
KLSPPVMET

SEQ ID NO: 370551 - protein, 9 aa, Homo Sapiens
NSSACDGLL

SEQ ID NO: 370552 - protein, 9 aa, Homo Sapiens
SKALNVNCV

SEQ ID NO: 370553 - protein, 9 aa, Homo Sapiens
KKLVKISEI

SEQ ID NO: 370554 - protein, 9 aa, Homo Sapiens
AARAPWRTS

SEQ ID NO: 370555 - protein, 9 aa, Homo Sapiens
PGYEAYECH

SEQ ID NO: 370556 - protein, 9 aa, Homo Sapiens
VLNEHKKFI

SEQ ID NO: 370557 - protein, 9 aa, Homo Sapiens
SRARRTNGA

SEQ ID NO: 370558 - protein, 9 aa, Homo Sapiens
SSGSGRARG

SEQ ID NO: 370559 - protein, 9 aa, Homo Sapiens
LSSDPSRSP

SEQ ID NO: 370560 - protein, 9 aa, Homo Sapiens
ASAWWAAGT

SEQ ID NO: 370561 - protein, 9 aa, Homo Sapiens
KYGQGQLNY

SEQ ID NO: 370562 - protein, 9 aa, Homo Sapiens
RVGCRIKRV

SEQ ID NO: 370563 - protein, 9 aa, Homo Sapiens
GVVQFAVLL

SEQ ID NO: 370564 - protein, 9 aa, Homo Sapiens
GLELAITFE

SEQ ID NO: 370565 - protein, 9 aa, Homo Sapiens
AWQPSLKDH

SEQ ID NO: 370566 - protein, 9 aa, Homo Sapiens
KNTAFTKLA

SEQ ID NO: 370567 - protein, 9 aa, Homo Sapiens
LEVIQDDKV

SEQ ID NO: 370568 - protein, 9 aa, Homo Sapiens
KNSSHTHDL

SEQ ID NO: 370569 - protein, 9 aa, Homo Sapiens
WGVKKHWID

SEQ ID NO: 370570 - protein, 9 aa, Homo Sapiens
QDIKGLVDF

SEQ ID NO: 370571 - protein, 9 aa, Homo Sapiens
DIGWRVEFQ

SEQ ID NO: 370572 - protein, 9 aa, Homo Sapiens
PVARDALWA

SEQ ID NO: 370573 - protein, 9 aa, Homo Sapiens
SERGGRGYG

SEQ ID NO: 370574 - protein, 9 aa, Homo Sapiens
PPYLECVKQ

SEQ ID NO: 370575 - protein, 9 aa, Homo Sapiens
AGTGTASGG

SEQ ID NO: 370576 - protein, 9 aa, Homo Sapiens
AGVAEKFAI

SEQ ID NO: 370577 - protein, 9 aa, Homo Sapiens
QSPTLLKTR

SEQ ID NO: 370578 - protein, 9 aa, Homo Sapiens
ETSLASCSR

SEQ ID NO: 370579 - protein, 9 aa, Homo Sapiens
EHDPDPTAP

SEQ ID NO: 370580 - protein, 9 aa, Homo Sapiens
HPLKIVLLG

SEQ ID NO: 370581 - protein, 9 aa, Homo Sapiens
VQAIKDHTF

SEQ ID NO: 370582 - protein, 9 aa, Homo Sapiens
SPICRTGSH

SEQ ID NO: 370583 - protein, 9 aa, Homo Sapiens
VGAEVNTKG

SEQ ID NO: 370584 - protein, 9 aa, Homo Sapiens
PWKTSCTTF

SEQ ID NO: 370585 - protein, 9 aa, Homo Sapiens
QDQDQELAT

SEQ ID NO: 370586 - protein, 9 aa, Homo Sapiens
ACAHLAHQQ

SEQ ID NO: 370587 - protein, 9 aa, Homo Sapiens
AFVPHPNGA

SEQ ID NO: 370588 - protein, 9 aa, Homo Sapiens
RERKRCVTT

SEQ ID NO: 370589 - protein, 9 aa, Homo Sapiens
SRAAAVAPL

SEQ ID NO: 370590 - protein, 9 aa, Homo Sapiens
NLFEEALER

SEQ ID NO: 370591 - protein, 9 aa, Homo Sapiens
ITNCRGNLR

SEQ ID NO: 370592 - protein, 9 aa, Homo Sapiens
PGTACVFMT

SEQ ID NO: 370593 - protein, 9 aa, Homo Sapiens
KNCTLTPLP

SEQ ID NO: 370594 - protein, 9 aa, Homo Sapiens
NAHLVRHQK

SEQ ID NO: 370595 - protein, 9 aa, Homo Sapiens
LCKDGMWTT

SEQ ID NO: 370596 - protein, 9 aa, Homo Sapiens
SDFTRSSPQ

SEQ ID NO: 370597 - protein, 9 aa, Homo Sapiens
EPPPAHPRP

SEQ ID NO: 370598 - protein, 9 aa, Homo Sapiens
FNQINVKTS

SEQ ID NO: 370599 - protein, 9 aa, Homo Sapiens
STTLVQHRH

SEQ ID NO: 370600 - protein, 9 aa, Homo Sapiens
ADADAAAAG

SEQ ID NO: 370601 - protein, 9 aa, Homo Sapiens
EVDIQVCGP

SEQ ID NO: 370602 - protein, 9 aa, Homo Sapiens
NRPNHSPHP

SEQ ID NO: 370603 - protein, 9 aa, Homo Sapiens
TLLEFLERI

SEQ ID NO: 370604 - protein, 9 aa, Homo Sapiens
CLLEIHKIM

SEQ ID NO: 370605 - protein, 9 aa, Homo Sapiens
PSLKDHRIS

SEQ ID NO: 370606 - protein, 9 aa, Homo Sapiens
YEHATNCAT

SEQ ID NO: 370607 - protein, 9 aa, Homo Sapiens
AAAASWPVR

SEQ ID NO: 370608 - protein, 9 aa, Homo Sapiens
NFTMAIDFT

SEQ ID NO: 370609 - protein, 9 aa, Homo Sapiens
TSSSGTSRA

SEQ ID NO: 370610 - protein, 9 aa, Homo Sapiens
YKYEVGEIR

SEQ ID NO: 370611 - protein, 9 aa, Homo Sapiens
SLYGKKAII

SEQ ID NO: 370612 - protein, 9 aa, Homo Sapiens
QQYLKERES

SEQ ID NO: 370613 - protein, 9 aa, Homo Sapiens
LPHECDPGG

SEQ ID NO: 370614 - protein, 9 aa, Homo Sapiens
TTPKPKPSN

SEQ ID NO: 370615 - protein, 9 aa, Homo Sapiens
GAKKEGRSS

SEQ ID NO: 370616 - protein, 9 aa, Homo Sapiens
ASPEPPHRT

SEQ ID NO: 370617 - protein, 9 aa, Homo Sapiens
ALSCRVLTD

SEQ ID NO: 370618 - protein, 9 aa, Homo Sapiens
RYLCLLEIH

SEQ ID NO: 370619 - protein, 9 aa, Homo Sapiens
HEFCINMRQ

SEQ ID NO: 370620 - protein, 9 aa, Homo Sapiens
LSKNPKIFM

SEQ ID NO: 370621 - protein, 9 aa, Homo Sapiens
KSQISEIID

SEQ ID NO: 370622 - protein, 9 aa, Homo Sapiens
LQPSMTVDG

SEQ ID NO: 370623 - protein, 9 aa, Homo Sapiens
EEEGVVAAM

SEQ ID NO: 370624 - protein, 9 aa, Homo Sapiens
RGKRRRRNP

SEQ ID NO: 370625 - protein, 9 aa, Homo Sapiens
FRESCCCQY

SEQ ID NO: 370626 - protein, 9 aa, Homo Sapiens
MVRGAEGGR

SEQ ID NO: 370627 - protein, 9 aa, Homo Sapiens
SIWLYTFVR

SEQ ID NO: 370628 - protein, 9 aa, Homo Sapiens
PQAKAIGSA

SEQ ID NO: 370629 - protein, 9 aa, Homo Sapiens
AHDKKAVSR

SEQ ID NO: 370630 - protein, 9 aa, Homo Sapiens
PDVSLRNSV

SEQ ID NO: 370631 - protein, 9 aa, Homo Sapiens
GGHVVASMD

SEQ ID NO: 370632 - protein, 9 aa, Homo Sapiens
EGASEENLV

SEQ ID NO: 370633 - protein, 9 aa, Homo Sapiens
GRIKPKPVD

SEQ ID NO: 370634 - protein, 9 aa, Homo Sapiens
WEERLLGDR

SEQ ID NO: 370635 - protein, 9 aa, Homo Sapiens
LIRDEIYGA

SEQ ID NO: 370636 - protein, 9 aa, Homo Sapiens
EQAQRDLSS

SEQ ID NO: 370637 - protein, 9 aa, Homo Sapiens
PSMASLCWS

SEQ ID NO: 370638 - protein, 9 aa, Homo Sapiens
AIKKKDYVP

SEQ ID NO: 370639 - protein, 9 aa, Homo Sapiens
HVCLPNSKK

SEQ ID NO: 370640 - protein, 9 aa, Homo Sapiens
SPSRSPFGS

SEQ ID NO: 370641 - protein, 9 aa, Homo Sapiens
KKKKLKKRK

SEQ ID NO: 370642 - protein, 9 aa, Homo Sapiens
VEVSSLKYV

SEQ ID NO: 370643 - protein, 9 aa, Homo Sapiens
NFQGTRRRC

SEQ ID NO: 370644 - protein, 9 aa, Homo Sapiens
LADWPSNGG

SEQ ID NO: 370645 - protein, 9 aa, Homo Sapiens
NKKATNIIA

SEQ ID NO: 370646 - protein, 9 aa, Homo Sapiens
AAFSWLLNP

SEQ ID NO: 370647 - protein, 9 aa, Homo Sapiens
SEGEHMVDV

SEQ ID NO: 370648 - protein, 9 aa, Homo Sapiens
PDLESLTII

SEQ ID NO: 370649 - protein, 9 aa, Homo Sapiens
TLAAAASSK

SEQ ID NO: 370650 - protein, 9 aa, Homo Sapiens
TSITLSTIV

SEQ ID NO: 370651 - protein, 9 aa, Homo Sapiens
EATSQYYFR

SEQ ID NO: 370652 - protein, 9 aa, Homo Sapiens
TAVTPRRSP

SEQ ID NO: 370653 - protein, 9 aa, Homo Sapiens
EDRAKNTQA

SEQ ID NO: 370654 - protein, 9 aa, Homo Sapiens
NLCNKPVAQ

SEQ ID NO: 370655 - protein, 9 aa, Homo Sapiens
LYETQDKAC

SEQ ID NO: 370656 - protein, 9 aa, Homo Sapiens
AWVCDWLAT

SEQ ID NO: 370657 - protein, 9 aa, Homo Sapiens
THTNFTGWQ

SEQ ID NO: 370658 - protein, 9 aa, Homo Sapiens
LKQKWHLGI

SEQ ID NO: 370659 - protein, 9 aa, Homo Sapiens
RPRLTWCPW

SEQ ID NO: 370660 - protein, 9 aa, Homo Sapiens
VAQTPSPVS

SEQ ID NO: 370661 - protein, 9 aa, Homo Sapiens
PTNVKNVAK

SEQ ID NO: 370662 - protein, 9 aa, Homo Sapiens
YLSCSSCRS

SEQ ID NO: 370663 - protein, 9 aa, Homo Sapiens
FLLTLPPWA

SEQ ID NO: 370664 - protein, 9 aa, Homo Sapiens
MHMRETSVF

SEQ ID NO: 370665 - protein, 9 aa, Homo Sapiens
IGSMDVFQI

SEQ ID NO: 370666 - protein, 9 aa, Homo Sapiens
PAVLCWFAE

SEQ ID NO: 370667 - protein, 9 aa, Homo Sapiens
WITEENLLF

SEQ ID NO: 370668 - protein, 9 aa, Homo Sapiens
TNLILFCVC

SEQ ID NO: 370669 - protein, 9 aa, Homo Sapiens
SRPLPLQPS

SEQ ID NO: 370670 - protein, 9 aa, Homo Sapiens
KILPNQKPT

SEQ ID NO: 370671 - protein, 9 aa, Homo Sapiens
PRRSCPTLR

SEQ ID NO: 370672 - protein, 9 aa, Homo Sapiens
NSIGSYGLQ

SEQ ID NO: 370673 - protein, 9 aa, Homo Sapiens
PEPQCPRNR

SEQ ID NO: 370674 - protein, 9 aa, Homo Sapiens
ARINDISLG

SEQ ID NO: 370675 - protein, 9 aa, Homo Sapiens
LENEKSLLQ

SEQ ID NO: 370676 - protein, 9 aa, Homo Sapiens
GWISGSEAT

SEQ ID NO: 370677 - protein, 9 aa, Homo Sapiens
PSHGSMLAA

SEQ ID NO: 370678 - protein, 9 aa, Homo Sapiens
QIGVNIRKF

SEQ ID NO: 370679 - protein, 9 aa, Homo Sapiens
EGPKLPTKR

SEQ ID NO: 370680 - protein, 9 aa, Homo Sapiens
DYWKNGYNL

SEQ ID NO: 370681 - protein, 9 aa, Homo Sapiens
LMQRTVGTW

SEQ ID NO: 370682 - protein, 9 aa, Homo Sapiens
LNFRKPQEI

SEQ ID NO: 370683 - protein, 9 aa, Homo Sapiens
RDIQEQNQG

SEQ ID NO: 370684 - protein, 9 aa, Homo Sapiens
PIGKCVWSA

SEQ ID NO: 370685 - protein, 9 aa, Homo Sapiens
YEVLRNSGT

SEQ ID NO: 370686 - protein, 9 aa, Homo Sapiens
LESGGASRA

SEQ ID NO: 370687 - protein, 9 aa, Homo Sapiens
RCSASPTEG

SEQ ID NO: 370688 - protein, 9 aa, Homo Sapiens
TLGNCGPYC

SEQ ID NO: 370689 - protein, 9 aa, Homo Sapiens
GNGGDGCRG

SEQ ID NO: 370690 - protein, 9 aa, Homo Sapiens
LLCQCDKKR

SEQ ID NO: 370691 - protein, 9 aa, Homo Sapiens
PATRFYRTW

SEQ ID NO: 370692 - protein, 9 aa, Homo Sapiens
MDWHGEQSL

SEQ ID NO: 370693 - protein, 9 aa, Homo Sapiens
SSSDGSSDS

SEQ ID NO: 370694 - protein, 9 aa, Homo Sapiens
RETFHMGCG

SEQ ID NO: 370695 - protein, 9 aa, Homo Sapiens
NNILFPWKM

SEQ ID NO: 370696 - protein, 9 aa, Homo Sapiens
SYLISLKMN

SEQ ID NO: 370697 - protein, 9 aa, Homo Sapiens
INSYTDIEC

SEQ ID NO: 370698 - protein, 9 aa, Homo Sapiens
QVRLLPPTQ

SEQ ID NO: 370699 - protein, 9 aa, Homo Sapiens
LLFLSWIAI

SEQ ID NO: 370700 - protein, 9 aa, Homo Sapiens
APSRRLSLW

SEQ ID NO: 370701 - protein, 9 aa, Homo Sapiens
ATRLLCLHS

SEQ ID NO: 370702 - protein, 9 aa, Homo Sapiens
QLWKEVAKH

SEQ ID NO: 370703 - protein, 9 aa, Homo Sapiens
SRAPKHCEL

SEQ ID NO: 370704 - protein, 9 aa, Homo Sapiens
APSTEWWTM

SEQ ID NO: 370705 - protein, 9 aa, Homo Sapiens
NPRRSCPTL

SEQ ID NO: 370706 - protein, 9 aa, Homo Sapiens
YRDIWDFLC

SEQ ID NO: 370707 - protein, 9 aa, Homo Sapiens
DGKDGLLAY

SEQ ID NO: 370708 - protein, 9 aa, Homo Sapiens
GMRTKQLQE

SEQ ID NO: 370709 - protein, 9 aa, Homo Sapiens
STSAAADPL

SEQ ID NO: 370710 - protein, 9 aa, Homo Sapiens
SFNDSSTLM

SEQ ID NO: 370711 - protein, 9 aa, Homo Sapiens
GEGTPGLAR

SEQ ID NO: 370712 - protein, 9 aa, Homo Sapiens
PAASAAVTQ

SEQ ID NO: 370713 - protein, 9 aa, Homo Sapiens
LKEHDPDPT

SEQ ID NO: 370714 - protein, 9 aa, Homo Sapiens
SRSSARSRR

SEQ ID NO: 370715 - protein, 9 aa, Homo Sapiens
PLNPPIKNQ

SEQ ID NO: 370716 - protein, 9 aa, Homo Sapiens
VPEVDGDQD

SEQ ID NO: 370717 - protein, 9 aa, Homo Sapiens
IECQKSLLS

SEQ ID NO: 370718 - protein, 9 aa, Homo Sapiens
DGAWLLALP

SEQ ID NO: 370719 - protein, 9 aa, Homo Sapiens
ELDASNPFY

SEQ ID NO: 370720 - protein, 9 aa, Homo Sapiens
KEAINVLSH

SEQ ID NO: 370721 - protein, 9 aa, Homo Sapiens
QVDAAELPH

SEQ ID NO: 370722 - protein, 9 aa, Homo Sapiens
GARRTAKPL

SEQ ID NO: 370723 - protein, 9 aa, Homo Sapiens
GQAADGTPL

SEQ ID NO: 370724 - protein, 9 aa, Homo Sapiens
RSQGTGSFF

SEQ ID NO: 370725 - protein, 9 aa, Homo Sapiens
TLVTRGTSR

SEQ ID NO: 370726 - protein, 9 aa, Homo Sapiens
VWDRPFQRT

SEQ ID NO: 370727 - protein, 9 aa, Homo Sapiens
HQQLHFLSV

SEQ ID NO: 370728 - protein, 9 aa, Homo Sapiens
HSLKARGAL

SEQ ID NO: 370729 - protein, 9 aa, Homo Sapiens
YNSQQFPGQ

SEQ ID NO: 370730 - protein, 9 aa, Homo Sapiens
GGRPPSPLS

SEQ ID NO: 370731 - protein, 9 aa, Homo Sapiens
NFIKKITSE

SEQ ID NO: 370732 - protein, 9 aa, Homo Sapiens
QVLENNEVR

SEQ ID NO: 370733 - protein, 9 aa, Homo Sapiens
SCFSRIVQI

SEQ ID NO: 370734 - protein, 9 aa, Homo Sapiens
PKGNGRSGF

SEQ ID NO: 370735 - protein, 9 aa, Homo Sapiens
ARSGDAAQG

SEQ ID NO: 370736 - protein, 9 aa, Homo Sapiens
QTCIMNNGV

SEQ ID NO: 370737 - protein, 9 aa, Homo Sapiens
LPIDWDILN

SEQ ID NO: 370738 - protein, 9 aa, Homo Sapiens
EAEKTLGDF

SEQ ID NO: 370739 - protein, 9 aa, Homo Sapiens
LECVKQQAN

SEQ ID NO: 370740 - protein, 9 aa, Homo Sapiens
SLDEAQQKI

SEQ ID NO: 370741 - protein, 9 aa, Homo Sapiens
GFNKKRKKM

SEQ ID NO: 370742 - protein, 9 aa, Homo Sapiens
MECTDITMK

SEQ ID NO: 370743 - protein, 9 aa, Homo Sapiens
CVVRGCSFQ

SEQ ID NO: 370744 - protein, 9 aa, Homo Sapiens
PYFVPNTPT

SEQ ID NO: 370745 - protein, 9 aa, Homo Sapiens
SSTRSSVTG

SEQ ID NO: 370746 - protein, 9 aa, Homo Sapiens
IATNPESST

SEQ ID NO: 370747 - protein, 9 aa, Homo Sapiens
PMRLNLTKW

SEQ ID NO: 370748 - protein, 9 aa, Homo Sapiens
PIVPLAAKV

SEQ ID NO: 370749 - protein, 9 aa, Homo Sapiens
LSTKASNTI

SEQ ID NO: 370750 - protein, 9 aa, Homo Sapiens
ELLYCQNGG

SEQ ID NO: 370751 - protein, 9 aa, Homo Sapiens
ALVCAPNKD

SEQ ID NO: 370752 - protein, 9 aa, Homo Sapiens
GMKFRLQLP

SEQ ID NO: 370753 - protein, 9 aa, Homo Sapiens
SCPTLRACA

SEQ ID NO: 370754 - protein, 9 aa, Homo Sapiens
SMAAPGSGR

SEQ ID NO: 370755 - protein, 9 aa, Homo Sapiens
TGGADRGCG

SEQ ID NO: 370756 - protein, 9 aa, Homo Sapiens
GFNQINVKT

SEQ ID NO: 370757 - protein, 9 aa, Homo Sapiens
ALLAGMRNH

SEQ ID NO: 370758 - protein, 9 aa, Homo Sapiens
SGKAWGWEA

SEQ ID NO: 370759 - protein, 9 aa, Homo Sapiens
HRVGVLQGQ

SEQ ID NO: 370760 - protein, 9 aa, Homo Sapiens
RELWNTSLL

SEQ ID NO: 370761 - protein, 9 aa, Homo Sapiens
CYIRRLRAI

SEQ ID NO: 370762 - protein, 9 aa, Homo Sapiens
PSLMAERPT

SEQ ID NO: 370763 - protein, 9 aa, Homo Sapiens
RQWSLWVLP

SEQ ID NO: 370764 - protein, 9 aa, Homo Sapiens
TVLGQPGVR

SEQ ID NO: 370765 - protein, 9 aa, Homo Sapiens
RPAADRTFQ

SEQ ID NO: 370766 - protein, 9 aa, Homo Sapiens
QKATVIIMV

SEQ ID NO: 370767 - protein, 9 aa, Homo Sapiens
EFGIRFFLV

SEQ ID NO: 370768 - protein, 9 aa, Homo Sapiens
HPEIIECRV

SEQ ID NO: 370769 - protein, 9 aa, Homo Sapiens
IRDMKVKGE

SEQ ID NO: 370770 - protein, 9 aa, Homo Sapiens
HDLGTKREN

SEQ ID NO: 370771 - protein, 9 aa, Homo Sapiens
PTLRACANS

SEQ ID NO: 370772 - protein, 9 aa, Homo Sapiens
ANLTLGSLL

SEQ ID NO: 370773 - protein, 9 aa, Homo Sapiens
TEAYQKYNS

SEQ ID NO: 370774 - protein, 9 aa, Homo Sapiens
HTQILHRVP

SEQ ID NO: 370775 - protein, 9 aa, Homo Sapiens
KRKKLNRLG

SEQ ID NO: 370776 - protein, 9 aa, Homo Sapiens
VCTGRHQWH

SEQ ID NO: 370777 - protein, 9 aa, Homo Sapiens
LKIYKAKPV

SEQ ID NO: 370778 - protein, 9 aa, Homo Sapiens
LFHSFFVDN

SEQ ID NO: 370779 - protein, 9 aa, Homo Sapiens
DPSGSPCVW

SEQ ID NO: 370780 - protein, 9 aa, Homo Sapiens
SKKSKTLLE

SEQ ID NO: 370781 - protein, 9 aa, Homo Sapiens
IDFLKMLYM

SEQ ID NO: 370782 - protein, 9 aa, Homo Sapiens
EKLREKQSS

SEQ ID NO: 370783 - protein, 9 aa, Homo Sapiens
GKKRRGKSE

SEQ ID NO: 370784 - protein, 9 aa, Homo Sapiens
AAHGDGSTC

SEQ ID NO: 370785 - protein, 9 aa, Homo Sapiens
ALLGCFTLL

SEQ ID NO: 370786 - protein, 9 aa, Homo Sapiens
AAPRVLFHC

SEQ ID NO: 370787 - protein, 9 aa, Homo Sapiens
SRSQGTGSF

SEQ ID NO: 370788 - protein, 9 aa, Homo Sapiens
YHEIMERSE

SEQ ID NO: 370789 - protein, 9 aa, Homo Sapiens
YAKTTPKPK

SEQ ID NO: 370790 - protein, 9 aa, Homo Sapiens
SPAEGASLW

SEQ ID NO: 370791 - protein, 9 aa, Homo Sapiens
MPGLPCPSR

SEQ ID NO: 370792 - protein, 9 aa, Homo Sapiens
RGRVGGPGA

SEQ ID NO: 370793 - protein, 9 aa, Homo Sapiens
SRNGCDACR

SEQ ID NO: 370794 - protein, 9 aa, Homo Sapiens
LQSSGVPEV

SEQ ID NO: 370795 - protein, 9 aa, Homo Sapiens
HFKEALQDP

SEQ ID NO: 370796 - protein, 9 aa, Homo Sapiens
NFRVGKKLD

SEQ ID NO: 370797 - protein, 9 aa, Homo Sapiens
KKLNRLGLA

SEQ ID NO: 370798 - protein, 9 aa, Homo Sapiens
HTPCAETPA

SEQ ID NO: 370799 - protein, 9 aa, Homo Sapiens
TMNLNIAKV

SEQ ID NO: 370800 - protein, 9 aa, Homo Sapiens
LPGPILRTL

SEQ ID NO: 370801 - protein, 9 aa, Homo Sapiens
REAWAGRTG

SEQ ID NO: 370802 - protein, 9 aa, Homo Sapiens
ILDEADVDN

SEQ ID NO: 370803 - protein, 9 aa, Homo Sapiens
YDKLKSQIS

SEQ ID NO: 370804 - protein, 9 aa, Homo Sapiens
LSTVCRAVA

SEQ ID NO: 370805 - protein, 9 aa, Homo Sapiens
SLLQTQELR

SEQ ID NO: 370806 - protein, 9 aa, Homo Sapiens
AAIKKVDQG

SEQ ID NO: 370807 - protein, 9 aa, Homo Sapiens
LSDSPWRAL

SEQ ID NO: 370808 - protein, 9 aa, Homo Sapiens
AQNRLNVSI

SEQ ID NO: 370809 - protein, 9 aa, Homo Sapiens
DQWLEKKCK

SEQ ID NO: 370810 - protein, 9 aa, Homo Sapiens
PTSPATRFY

SEQ ID NO: 370811 - protein, 9 aa, Homo Sapiens
SWDSSEMGA

SEQ ID NO: 370812 - protein, 9 aa, Homo Sapiens
LCRWVWNPT

SEQ ID NO: 370813 - protein, 9 aa, Homo Sapiens
SPATRFYRT

SEQ ID NO: 370814 - protein, 9 aa, Homo Sapiens
GQDGIGSEA

SEQ ID NO: 370815 - protein, 9 aa, Homo Sapiens
KTELLVTEN

SEQ ID NO: 370816 - protein, 9 aa, Homo Sapiens
GDFDVPGLP

SEQ ID NO: 370817 - protein, 9 aa, Homo Sapiens
QCPRNRPYF

SEQ ID NO: 370818 - protein, 9 aa, Homo Sapiens
GPPTALWEG

SEQ ID NO: 370819 - protein, 9 aa, Homo Sapiens
GKCVWSAGY

SEQ ID NO: 370820 - protein, 9 aa, Homo Sapiens
ERLTEEFPG

SEQ ID NO: 370821 - protein, 9 aa, Homo Sapiens
SPKFGEKDK

SEQ ID NO: 370822 - protein, 9 aa, Homo Sapiens
SALDCIFGV

SEQ ID NO: 370823 - protein, 9 aa, Homo Sapiens
PGKNCTLTP

SEQ ID NO: 370824 - protein, 9 aa, Homo Sapiens
TADEQGEFD

SEQ ID NO: 370825 - protein, 9 aa, Homo Sapiens
RSPSRSPFG

SEQ ID NO: 370826 - protein, 9 aa, Homo Sapiens
VTLIVGCGM

SEQ ID NO: 370827 - protein, 9 aa, Homo Sapiens
RKKLPWKLK

SEQ ID NO: 370828 - protein, 9 aa, Homo Sapiens
PLTPREQTW

SEQ ID NO: 370829 - protein, 9 aa, Homo Sapiens
GVEGLRGQG

SEQ ID NO: 370830 - protein, 9 aa, Homo Sapiens
RKSDIYVCV

SEQ ID NO: 370831 - protein, 9 aa, Homo Sapiens
CVGVFQHDK

SEQ ID NO: 370832 - protein, 9 aa, Homo Sapiens
TTAAAAAEP

SEQ ID NO: 370833 - protein, 9 aa, Homo Sapiens
FETELSPVE

SEQ ID NO: 370834 - protein, 9 aa, Homo Sapiens
MNILFSSWV

SEQ ID NO: 370835 - protein, 9 aa, Homo Sapiens
CGPPSVCDL

SEQ ID NO: 370836 - protein, 9 aa, Homo Sapiens
GPQIGVNIR

SEQ ID NO: 370837 - protein, 9 aa, Homo Sapiens
ARRTPTDPT

SEQ ID NO: 370838 - protein, 9 aa, Homo Sapiens
EQFTVLETR

SEQ ID NO: 370839 - protein, 9 aa, Homo Sapiens
WRHLCFQLV

SEQ ID NO: 370840 - protein, 9 aa, Homo Sapiens
LVILTVLTS

SEQ ID NO: 370841 - protein, 9 aa, Homo Sapiens
GGASNFGLI

SEQ ID NO: 370842 - protein, 9 aa, Homo Sapiens
SRDIKVQGF

SEQ ID NO: 370843 - protein, 9 aa, Homo Sapiens
TNPASPDVG

SEQ ID NO: 370844 - protein, 9 aa, Homo Sapiens
ASKLNGAIN

SEQ ID NO: 370845 - protein, 9 aa, Homo Sapiens
DSMDSVSRV

SEQ ID NO: 370846 - protein, 9 aa, Homo Sapiens
LSGLMAPPG

SEQ ID NO: 370847 - protein, 9 aa, Homo Sapiens
VFPKHYRPP

SEQ ID NO: 370848 - protein, 9 aa, Homo Sapiens
RSLAGVSFS

SEQ ID NO: 370849 - protein, 9 aa, Homo Sapiens
LETGDPPPP

SEQ ID NO: 370850 - protein, 9 aa, Homo Sapiens
PQPRPSTPA

SEQ ID NO: 370851 - protein, 9 aa, Homo Sapiens
RVTPAPPPC

SEQ ID NO: 370852 - protein, 9 aa, Homo Sapiens
CLALLGCFT

SEQ ID NO: 370853 - protein, 9 aa, Homo Sapiens
SIYSSGNED

SEQ ID NO: 370854 - protein, 9 aa, Homo Sapiens
ERGGRGYGG

SEQ ID NO: 370855 - protein, 9 aa, Homo Sapiens
LLQSALDCI

SEQ ID NO: 370856 - protein, 9 aa, Homo Sapiens
PTSEGASEE

SEQ ID NO: 370857 - protein, 9 aa, Homo Sapiens
FQTQIIRSC

SEQ ID NO: 370858 - protein, 9 aa, Homo Sapiens
YVQTCIMNN

SEQ ID NO: 370859 - protein, 9 aa, Homo Sapiens
TVRETKSQT

SEQ ID NO: 370860 - protein, 9 aa, Homo Sapiens
RLASICITS

SEQ ID NO: 370861 - protein, 9 aa, Homo Sapiens
IEYPYSVKR

SEQ ID NO: 370862 - protein, 9 aa, Homo Sapiens
PAATSSLEA

SEQ ID NO: 370863 - protein, 9 aa, Homo Sapiens
AYAFPPGPG

SEQ ID NO: 370864 - protein, 9 aa, Homo Sapiens
AQPGRWCRL

SEQ ID NO: 370865 - protein, 9 aa, Homo Sapiens
GLTFITPML

SEQ ID NO: 370866 - protein, 9 aa, Homo Sapiens
RLGVEPASN

SEQ ID NO: 370867 - protein, 9 aa, Homo Sapiens
NHSKCITEC

SEQ ID NO: 370868 - protein, 9 aa, Homo Sapiens
PTVILCLFV

SEQ ID NO: 370869 - protein, 9 aa, Homo Sapiens
KFVDWVRRQ

SEQ ID NO: 370870 - protein, 9 aa, Homo Sapiens
TPYFILWTK

SEQ ID NO: 370871 - protein, 9 aa, Homo Sapiens
IAAQAVTNN

SEQ ID NO: 370872 - protein, 9 aa, Homo Sapiens
ALVINMRVC

SEQ ID NO: 370873 - protein, 9 aa, Homo Sapiens
YRLVLKELR

SEQ ID NO: 370874 - protein, 9 aa, Homo Sapiens
VLKKILPNQ

SEQ ID NO: 370875 - protein, 9 aa, Homo Sapiens
NTQELGPEV

SEQ ID NO: 370876 - protein, 9 aa, Homo Sapiens
PVAPDGPVK

SEQ ID NO: 370877 - protein, 9 aa, Homo Sapiens
SLGALEPSG

SEQ ID NO: 370878 - protein, 9 aa, Homo Sapiens
CSLADIIKY

SEQ ID NO: 370879 - protein, 9 aa, Homo Sapiens
MAPPGMQGD

SEQ ID NO: 370880 - protein, 9 aa, Homo Sapiens
KISVKEEHV

SEQ ID NO: 370881 - protein, 9 aa, Homo Sapiens
FALCLLWEA

SEQ ID NO: 370882 - protein, 9 aa, Homo Sapiens
QCGRDDYDP

SEQ ID NO: 370883 - protein, 9 aa, Homo Sapiens
WNADGLAKH

SEQ ID NO: 370884 - protein, 9 aa, Homo Sapiens
PPPCRPRVT

SEQ ID NO: 370885 - protein, 9 aa, Homo Sapiens
GRTGAGQPG

SEQ ID NO: 370886 - protein, 9 aa, Homo Sapiens
LTATSVTIF

SEQ ID NO: 370887 - protein, 9 aa, Homo Sapiens
ENLLAWADS

SEQ ID NO: 370888 - protein, 9 aa, Homo Sapiens
FAQWCEQML

SEQ ID NO: 370889 - protein, 9 aa, Homo Sapiens
YSTRSSSGR

SEQ ID NO: 370890 - protein, 9 aa, Homo Sapiens
KIYKAKPVI

SEQ ID NO: 370891 - protein, 9 aa, Homo Sapiens
TGDSGAPPC

SEQ ID NO: 370892 - protein, 9 aa, Homo Sapiens
ECFHQKNWY

SEQ ID NO: 370893 - protein, 9 aa, Homo Sapiens
GAVLCLRLW

SEQ ID NO: 370894 - protein, 9 aa, Homo Sapiens
DSRALVGQS

SEQ ID NO: 370895 - protein, 9 aa, Homo Sapiens
NPRAKQPSR

SEQ ID NO: 370896 - protein, 9 aa, Homo Sapiens
CCWKRGSRS

SEQ ID NO: 370897 - protein, 9 aa, Homo Sapiens
VGARINDIS

SEQ ID NO: 370898 - protein, 9 aa, Homo Sapiens
MSPPASRWN

SEQ ID NO: 370899 - protein, 9 aa, Homo Sapiens
QPVFRQETQ

SEQ ID NO: 370900 - protein, 9 aa, Homo Sapiens
KDSNAGCDS

SEQ ID NO: 370901 - protein, 9 aa, Homo Sapiens
TRETLESGG

SEQ ID NO: 370902 - protein, 9 aa, Homo Sapiens
APVLLEASI

SEQ ID NO: 370903 - protein, 9 aa, Homo Sapiens
LETLHQLAT

SEQ ID NO: 370904 - protein, 9 aa, Homo Sapiens
EDQSIIIKR

SEQ ID NO: 370905 - protein, 9 aa, Homo Sapiens
LAAAGTNYS

SEQ ID NO: 370906 - protein, 9 aa, Homo Sapiens
SSVSSIVRD

SEQ ID NO: 370907 - protein, 9 aa, Homo Sapiens
NLKMSLMSG

SEQ ID NO: 370908 - protein, 9 aa, Homo Sapiens
RAGAGAGPR

SEQ ID NO: 370909 - protein, 9 aa, Homo Sapiens
FTLLWCVYK

SEQ ID NO: 370910 - protein, 9 aa, Homo Sapiens
QQYRALTMP

SEQ ID NO: 370911 - protein, 9 aa, Homo Sapiens
TAEKRIKMS

SEQ ID NO: 370912 - protein, 9 aa, Homo Sapiens
ATTLCQVSG

SEQ ID NO: 370913 - protein, 9 aa, Homo Sapiens
FLKTTSSSL

SEQ ID NO: 370914 - protein, 9 aa, Homo Sapiens
IIFSHFPFI

SEQ ID NO: 370915 - protein, 9 aa, Homo Sapiens
YKICIDMPT

SEQ ID NO: 370916 - protein, 9 aa, Homo Sapiens
DSLDEAQQK

SEQ ID NO: 370917 - protein, 9 aa, Homo Sapiens
FVWGVKKHW

SEQ ID NO: 370918 - protein, 9 aa, Homo Sapiens
PQLYLRPHK

SEQ ID NO: 370919 - protein, 9 aa, Homo Sapiens
ELAAIKKKD

SEQ ID NO: 370920 - protein, 9 aa, Homo Sapiens
SGRNVNVHV

SEQ ID NO: 370921 - protein, 9 aa, Homo Sapiens
VNESACYVE

SEQ ID NO: 370922 - protein, 9 aa, Homo Sapiens
QDLPIVPLA

SEQ ID NO: 370923 - protein, 9 aa, Homo Sapiens
RSNYAAEEI

SEQ ID NO: 370924 - protein, 9 aa, Homo Sapiens
RIRQALFPS

SEQ ID NO: 370925 - protein, 9 aa, Homo Sapiens
HENIIQKSS

SEQ ID NO: 370926 - protein, 9 aa, Homo Sapiens
YHTSAERMA

SEQ ID NO: 370927 - protein, 9 aa, Homo Sapiens
IFTAFTCLS

SEQ ID NO: 370928 - protein, 9 aa, Homo Sapiens
GSLHQTYEL

SEQ ID NO: 370929 - protein, 9 aa, Homo Sapiens
DVGLWKGRY

SEQ ID NO: 370930 - protein, 9 aa, Homo Sapiens
QDGFAQWCE

SEQ ID NO: 370931 - protein, 9 aa, Homo Sapiens
YTGCCHAAT

SEQ ID NO: 370932 - protein, 9 aa, Homo Sapiens
ICSFVWGVK

SEQ ID NO: 370933 - protein, 9 aa, Homo Sapiens
FAVGTWEFN

SEQ ID NO: 370934 - protein, 9 aa, Homo Sapiens
KEEKESRME

SEQ ID NO: 370935 - protein, 9 aa, Homo Sapiens
SPKPGDGEY

SEQ ID NO: 370936 - protein, 9 aa, Homo Sapiens
IGTTHSSIV

SEQ ID NO: 370937 - protein, 9 aa, Homo Sapiens
WLATCTPPA

SEQ ID NO: 370938 - protein, 9 aa, Homo Sapiens
WAWGCPAGC

SEQ ID NO: 370939 - protein, 9 aa, Homo Sapiens
RNLLRLQSL

SEQ ID NO: 370940 - protein, 9 aa, Homo Sapiens
EAINVLSHL

SEQ ID NO: 370941 - protein, 9 aa, Homo Sapiens
LCYHWLGHR

SEQ ID NO: 370942 - protein, 9 aa, Homo Sapiens
LPHSSGLAL

SEQ ID NO: 370943 - protein, 9 aa, Homo Sapiens
LRPPQKKSV

SEQ ID NO: 370944 - protein, 9 aa, Homo Sapiens
RHFGPAPPS

SEQ ID NO: 370945 - protein, 9 aa, Homo Sapiens
EATARLNMF

SEQ ID NO: 370946 - protein, 9 aa, Homo Sapiens
RGASGPDGV

SEQ ID NO: 370947 - protein, 9 aa, Homo Sapiens
EGQQKIREE

SEQ ID NO: 370948 - protein, 9 aa, Homo Sapiens
DGLEEKDSN

SEQ ID NO: 370949 - protein, 9 aa, Homo Sapiens
QFVFLRKHY

SEQ ID NO: 370950 - protein, 9 aa, Homo Sapiens
HHLQALLSL

SEQ ID NO: 370951 - protein, 9 aa, Homo Sapiens
IQVCMKWCA

SEQ ID NO: 370952 - protein, 9 aa, Homo Sapiens
GASRALFTS

SEQ ID NO: 370953 - protein, 9 aa, Homo Sapiens
VLTDLSSTN

SEQ ID NO: 370954 - protein, 9 aa, Homo Sapiens
LPTKRPCLL

SEQ ID NO: 370955 - protein, 9 aa, Homo Sapiens
LLAGMRNHE

SEQ ID NO: 370956 - protein, 9 aa, Homo Sapiens
PPALSLRSL

SEQ ID NO: 370957 - protein, 9 aa, Homo Sapiens
PEERLTEEF

SEQ ID NO: 370958 - protein, 9 aa, Homo Sapiens
SHIRHGSGS

SEQ ID NO: 370959 - protein, 9 aa, Homo Sapiens
SCRCYIRRL

SEQ ID NO: 370960 - protein, 9 aa, Homo Sapiens
KSQGGRILL

SEQ ID NO: 370961 - protein, 9 aa, Homo Sapiens
SSLTKQVIH

SEQ ID NO: 370962 - protein, 9 aa, Homo Sapiens
PPSSPSMAS

SEQ ID NO: 370963 - protein, 9 aa, Homo Sapiens
VLQDYELQA

SEQ ID NO: 370964 - protein, 9 aa, Homo Sapiens
LFTRFACFT

SEQ ID NO: 370965 - protein, 9 aa, Homo Sapiens
PGDGEYKFG

SEQ ID NO: 370966 - protein, 9 aa, Homo Sapiens
FTPLAWHRT

SEQ ID NO: 370967 - protein, 9 aa, Homo Sapiens
KEKKESSPI

SEQ ID NO: 370968 - protein, 9 aa, Homo Sapiens
RARNLLLTD

SEQ ID NO: 370969 - protein, 9 aa, Homo Sapiens
NPLRRTRAL

SEQ ID NO: 370970 - protein, 9 aa, Homo Sapiens
HLLLLCNLS

SEQ ID NO: 370971 - protein, 9 aa, Homo Sapiens
RFACFTWRT

SEQ ID NO: 370972 - protein, 9 aa, Homo Sapiens
RYGKDFTDI

SEQ ID NO: 370973 - protein, 9 aa, Homo Sapiens
LLGCFTLLW

SEQ ID NO: 370974 - protein, 9 aa, Homo Sapiens
LRQFLPALQ

SEQ ID NO: 370975 - protein, 9 aa, Homo Sapiens
WVRVKMDAT

SEQ ID NO: 370976 - protein, 9 aa, Homo Sapiens
TGRRASPGA

SEQ ID NO: 370977 - protein, 9 aa, Homo Sapiens
RRTVTETSL

SEQ ID NO: 370978 - protein, 9 aa, Homo Sapiens
DEQGEFDEE

SEQ ID NO: 370979 - protein, 9 aa, Homo Sapiens
PTKRPCLLE

SEQ ID NO: 370980 - protein, 9 aa, Homo Sapiens
DHRAVGKKL

SEQ ID NO: 370981 - protein, 9 aa, Homo Sapiens
APKHCELVV

SEQ ID NO: 370982 - protein, 9 aa, Homo Sapiens
KRGKRRRRN

SEQ ID NO: 370983 - protein, 9 aa, Homo Sapiens
GRMGFIHNF

SEQ ID NO: 370984 - protein, 9 aa, Homo Sapiens
DLEKIIAEK

SEQ ID NO: 370985 - protein, 9 aa, Homo Sapiens
KDFILSRAT

SEQ ID NO: 370986 - protein, 9 aa, Homo Sapiens
PSHREAWAG

SEQ ID NO: 370987 - protein, 9 aa, Homo Sapiens
AAPASTPRP

SEQ ID NO: 370988 - protein, 9 aa, Homo Sapiens
QAEAAREKQ

SEQ ID NO: 370989 - protein, 9 aa, Homo Sapiens
ISFNGSWMV

SEQ ID NO: 370990 - protein, 9 aa, Homo Sapiens
DFLCQLFVP

SEQ ID NO: 370991 - protein, 9 aa, Homo Sapiens
ISEHVCWNV

SEQ ID NO: 370992 - protein, 9 aa, Homo Sapiens
LQKLKELQA

SEQ ID NO: 370993 - protein, 9 aa, Homo Sapiens
CPTLRACAN

SEQ ID NO: 370994 - protein, 9 aa, Homo Sapiens
ELKFVDWVR

SEQ ID NO: 370995 - protein, 9 aa, Homo Sapiens
TPVTKAMPV

SEQ ID NO: 370996 - protein, 9 aa, Homo Sapiens
KKKASSPAT

SEQ ID NO: 370997 - protein, 9 aa, Homo Sapiens
IIVYISANV

SEQ ID NO: 370998 - protein, 9 aa, Homo Sapiens
PVLPGDGVE

SEQ ID NO: 370999 - protein, 9 aa, Homo Sapiens
YGKAFAKKT

SEQ ID NO: 371000 - protein, 9 aa, Homo Sapiens
DIETCHRYL

SEQ ID NO: 371001 - protein, 9 aa, Homo Sapiens
RTLGNCGPY

SEQ ID NO: 371002 - protein, 9 aa, Homo Sapiens
RAKESKPRE

SEQ ID NO: 371003 - protein, 9 aa, Homo Sapiens
DKWKGPQEE

SEQ ID NO: 371004 - protein, 9 aa, Homo Sapiens
QNSKDKALS

SEQ ID NO: 371005 - protein, 9 aa, Homo Sapiens
SFVWGVKKH

SEQ ID NO: 371006 - protein, 9 aa, Homo Sapiens
INNQIYTVK

SEQ ID NO: 371007 - protein, 9 aa, Homo Sapiens
ECKGCGKSF

SEQ ID NO: 371008 - protein, 9 aa, Homo Sapiens
FSVPNGLTQ

SEQ ID NO: 371009 - protein, 9 aa, Homo Sapiens
TVGLTFITP

SEQ ID NO: 371010 - protein, 9 aa, Homo Sapiens
KEGRSSTNA

SEQ ID NO: 371011 - protein, 9 aa, Homo Sapiens
CCTPASSQC

SEQ ID NO: 371012 - protein, 9 aa, Homo Sapiens
MQHHLQALL

SEQ ID NO: 371013 - protein, 9 aa, Homo Sapiens
VTHSPMMQV

SEQ ID NO: 371014 - protein, 9 aa, Homo Sapiens
TVSFVGQIS

SEQ ID NO: 371015 - protein, 9 aa, Homo Sapiens
EQLWKEVAK

SEQ ID NO: 371016 - protein, 9 aa, Homo Sapiens
IFYDVVHVV

SEQ ID NO: 371017 - protein, 9 aa, Homo Sapiens
AKNGRETII

SEQ ID NO: 371018 - protein, 9 aa, Homo Sapiens
NFSTYAEFS

SEQ ID NO: 371019 - protein, 9 aa, Homo Sapiens
GSSYRCTCA

SEQ ID NO: 371020 - protein, 9 aa, Homo Sapiens
NDYFLFFGT

SEQ ID NO: 371021 - protein, 9 aa, Homo Sapiens
QGGRILLQR

SEQ ID NO: 371022 - protein, 9 aa, Homo Sapiens
APANQPRTE

SEQ ID NO: 371023 - protein, 9 aa, Homo Sapiens
RFAAGVAEK

SEQ ID NO: 371024 - protein, 9 aa, Homo Sapiens
EPWEDGFET

SEQ ID NO: 371025 - protein, 9 aa, Homo Sapiens
LHRCNKYGK

SEQ ID NO: 371026 - protein, 9 aa, Homo Sapiens
SCTPVPVAC

SEQ ID NO: 371027 - protein, 9 aa, Homo Sapiens
KPSLSLSRI

SEQ ID NO: 371028 - protein, 9 aa, Homo Sapiens
GCLCLRWIT

SEQ ID NO: 371029 - protein, 9 aa, Homo Sapiens
RRSHMLEEG

SEQ ID NO: 371030 - protein, 9 aa, Homo Sapiens
TLCTRGGTG

SEQ ID NO: 371031 - protein, 9 aa, Homo Sapiens
HKLYLEISH

SEQ ID NO: 371032 - protein, 9 aa, Homo Sapiens
LQAKIKAVQ

SEQ ID NO: 371033 - protein, 9 aa, Homo Sapiens
GGSGGVAAG

SEQ ID NO: 371034 - protein, 9 aa, Homo Sapiens
LESLTIIFN

SEQ ID NO: 371035 - protein, 9 aa, Homo Sapiens
DNKYTILQK

SEQ ID NO: 371036 - protein, 9 aa, Homo Sapiens
EVVMSGVHC

SEQ ID NO: 371037 - protein, 9 aa, Homo Sapiens
KELQALIEE

SEQ ID NO: 371038 - protein, 9 aa, Homo Sapiens
TSIAFSTSI

SEQ ID NO: 371039 - protein, 9 aa, Homo Sapiens
VLLGVTNDQ

SEQ ID NO: 371040 - protein, 9 aa, Homo Sapiens
HTSAERMAE

SEQ ID NO: 371041 - protein, 9 aa, Homo Sapiens
EKLGSCPQF

SEQ ID NO: 371042 - protein, 9 aa, Homo Sapiens
RLKKIGKTC

SEQ ID NO: 371043 - protein, 9 aa, Homo Sapiens
LLAAGFGNS

SEQ ID NO: 371044 - protein, 9 aa, Homo Sapiens
PHKTAHVPF

SEQ ID NO: 371045 - protein, 9 aa, Homo Sapiens
TEWDYIKHL

SEQ ID NO: 371046 - protein, 9 aa, Homo Sapiens
ADEFTRLEF

SEQ ID NO: 371047 - protein, 9 aa, Homo Sapiens
PAWQPSLKD

SEQ ID NO: 371048 - protein, 9 aa, Homo Sapiens
QVFWERLVH

SEQ ID NO: 371049 - protein, 9 aa, Homo Sapiens
GQQALWQGR

SEQ ID NO: 371050 - protein, 9 aa, Homo Sapiens
SRDSRSFFT

SEQ ID NO: 371051 - protein, 9 aa, Homo Sapiens
HYCCIVQHV

SEQ ID NO: 371052 - protein, 9 aa, Homo Sapiens
SLDNTEVKK

SEQ ID NO: 371053 - protein, 9 aa, Homo Sapiens
TRRPTMEAP

SEQ ID NO: 371054 - protein, 9 aa, Homo Sapiens
HCACSPAPT

SEQ ID NO: 371055 - protein, 9 aa, Homo Sapiens
QEEPTIGSI

SEQ ID NO: 371056 - protein, 9 aa, Homo Sapiens
CVKRGKPCL

SEQ ID NO: 371057 - protein, 9 aa, Homo Sapiens
GTTHSSIVD

SEQ ID NO: 371058 - protein, 9 aa, Homo Sapiens
FSIDRNMGE

SEQ ID NO: 371059 - protein, 9 aa, Homo Sapiens
VVTCFPPVP

SEQ ID NO: 371060 - protein, 9 aa, Homo Sapiens
PAAAAPRVL

SEQ ID NO: 371061 - protein, 9 aa, Homo Sapiens
AAVRDEIDH

SEQ ID NO: 371062 - protein, 9 aa, Homo Sapiens
DSAIHLHVS

SEQ ID NO: 371063 - protein, 9 aa, Homo Sapiens
CGPYCTSKA

SEQ ID NO: 371064 - protein, 9 aa, Homo Sapiens
TMAIDFTAS

SEQ ID NO: 371065 - protein, 9 aa, Homo Sapiens
DNGLMGIEE

SEQ ID NO: 371066 - protein, 9 aa, Homo Sapiens
SDRQHTTFS

SEQ ID NO: 371067 - protein, 9 aa, Homo Sapiens
HPSRPCRMR

SEQ ID NO: 371068 - protein, 9 aa, Homo Sapiens
QVEASQAEA

SEQ ID NO: 371069 - protein, 9 aa, Homo Sapiens
MGLLDMTKQ

SEQ ID NO: 371070 - protein, 9 aa, Homo Sapiens
CIMNTFSVV

SEQ ID NO: 371071 - protein, 9 aa, Homo Sapiens
VLLVDALLF

SEQ ID NO: 371072 - protein, 9 aa, Homo Sapiens
SRMNSTGMK

SEQ ID NO: 371073 - protein, 9 aa, Homo Sapiens
AQDEALRAR

SEQ ID NO: 371074 - protein, 9 aa, Homo Sapiens
SPPTQQPQT

SEQ ID NO: 371075 - protein, 9 aa, Homo Sapiens
TSSFCCCTQ

SEQ ID NO: 371076 - protein, 9 aa, Homo Sapiens
VKCLNFRKP

SEQ ID NO: 371077 - protein, 9 aa, Homo Sapiens
FLVKRNLIQ

SEQ ID NO: 371078 - protein, 9 aa, Homo Sapiens
RPPGASSGW

SEQ ID NO: 371079 - protein, 9 aa, Homo Sapiens
MFKWQIIQR

SEQ ID NO: 371080 - protein, 9 aa, Homo Sapiens
DRVTEEAKN

SEQ ID NO: 371081 - protein, 9 aa, Homo Sapiens
FWMEMRCMY

SEQ ID NO: 371082 - protein, 9 aa, Homo Sapiens
TSRDIKVQG

SEQ ID NO: 371083 - protein, 9 aa, Homo Sapiens
SEECSYFYR

SEQ ID NO: 371084 - protein, 9 aa, Homo Sapiens
HPPPAAPEH

SEQ ID NO: 371085 - protein, 9 aa, Homo Sapiens
QDHKWELLG

SEQ ID NO: 371086 - protein, 9 aa, Homo Sapiens
IFGVEEMAT

SEQ ID NO: 371087 - protein, 9 aa, Homo Sapiens
RKQHLPPPC

SEQ ID NO: 371088 - protein, 9 aa, Homo Sapiens
GASNFGLIF

SEQ ID NO: 371089 - protein, 9 aa, Homo Sapiens
QPHSLPTQT

SEQ ID NO: 371090 - protein, 9 aa, Homo Sapiens
LVEKDATKE

SEQ ID NO: 371091 - protein, 9 aa, Homo Sapiens
KTAATTAAA

SEQ ID NO: 371092 - protein, 9 aa, Homo Sapiens
LQMECVGAR

SEQ ID NO: 371093 - protein, 9 aa, Homo Sapiens
AERAEQQCI

SEQ ID NO: 371094 - protein, 9 aa, Homo Sapiens
NRGQCVENE

SEQ ID NO: 371095 - protein, 9 aa, Homo Sapiens
QQHQLITVT

SEQ ID NO: 371096 - protein, 9 aa, Homo Sapiens
GGSYRFSPL

SEQ ID NO: 371097 - protein, 9 aa, Homo Sapiens
GLLPKGPAR

SEQ ID NO: 371098 - protein, 9 aa, Homo Sapiens
DPTNAATAP

SEQ ID NO: 371099 - protein, 9 aa, Homo Sapiens
VGSFLLHGA

SEQ ID NO: 371100 - protein, 9 aa, Homo Sapiens
CGHRTFSTT

SEQ ID NO: 371101 - protein, 9 aa, Homo Sapiens
VSLRICISG

SEQ ID NO: 371102 - protein, 9 aa, Homo Sapiens
LNAPRPWAP

SEQ ID NO: 371103 - protein, 9 aa, Homo Sapiens
NPSPAEGAS

SEQ ID NO: 371104 - protein, 9 aa, Homo Sapiens
PCRPRVTPA

SEQ ID NO: 371105 - protein, 9 aa, Homo Sapiens
GLCVKRGKP

SEQ ID NO: 371106 - protein, 9 aa, Homo Sapiens
TDLSSTNMP

SEQ ID NO: 371107 - protein, 9 aa, Homo Sapiens
SCYALFPQR

SEQ ID NO: 371108 - protein, 9 aa, Homo Sapiens
WPPPAPVLL

SEQ ID NO: 371109 - protein, 9 aa, Homo Sapiens
GFGNSCIKL

SEQ ID NO: 371110 - protein, 9 aa, Homo Sapiens
GLWGTRGGA

SEQ ID NO: 371111 - protein, 9 aa, Homo Sapiens
ESRAAAVAP

SEQ ID NO: 371112 - protein, 9 aa, Homo Sapiens
NSSHTHDLG

SEQ ID NO: 371113 - protein, 9 aa, Homo Sapiens
DRQHTTFSA

SEQ ID NO: 371114 - protein, 9 aa, Homo Sapiens
PYTCAQCGK

SEQ ID NO: 371115 - protein, 9 aa, Homo Sapiens
VWSAGYEER

SEQ ID NO: 371116 - protein, 9 aa, Homo Sapiens
PCIGPVSTM

SEQ ID NO: 371117 - protein, 9 aa, Homo Sapiens
PGMEHISPV

SEQ ID NO: 371118 - protein, 9 aa, Homo Sapiens
CRKCYEPVP

SEQ ID NO: 371119 - protein, 9 aa, Homo Sapiens
PVMETLPTV

SEQ ID NO: 371120 - protein, 9 aa, Homo Sapiens
PLAELCNQS

SEQ ID NO: 371121 - protein, 9 aa, Homo Sapiens
NDNPPVLTQ

SEQ ID NO: 371122 - protein, 9 aa, Homo Sapiens
SSGPLEKGQ

SEQ ID NO: 371123 - protein, 9 aa, Homo Sapiens
YCLSVSRAL

SEQ ID NO: 371124 - protein, 9 aa, Homo Sapiens
SVKEEHVCL

SEQ ID NO: 371125 - protein, 9 aa, Homo Sapiens
VIAFVLWCD

SEQ ID NO: 371126 - protein, 9 aa, Homo Sapiens
TGCCHAATL

SEQ ID NO: 371127 - protein, 9 aa, Homo Sapiens
LTKWQKHHP

SEQ ID NO: 371128 - protein, 9 aa, Homo Sapiens
FIVQINPTN

SEQ ID NO: 371129 - protein, 9 aa, Homo Sapiens
KKMSPPASR

SEQ ID NO: 371130 - protein, 9 aa, Homo Sapiens
RRASLWLCR

SEQ ID NO: 371131 - protein, 9 aa, Homo Sapiens
LTDLSSTNM

SEQ ID NO: 371132 - protein, 9 aa, Homo Sapiens
SASAEIQAG

SEQ ID NO: 371133 - protein, 9 aa, Homo Sapiens
GVCAHFPAS

SEQ ID NO: 371134 - protein, 9 aa, Homo Sapiens
AAQEEKQKQ

SEQ ID NO: 371135 - protein, 9 aa, Homo Sapiens
PIFGPGISA

SEQ ID NO: 371136 - protein, 9 aa, Homo Sapiens
RGTSIAFST

SEQ ID NO: 371137 - protein, 9 aa, Homo Sapiens
CGGSRMTDL

SEQ ID NO: 371138 - protein, 9 aa, Homo Sapiens
CVWTPRAGS

SEQ ID NO: 371139 - protein, 9 aa, Homo Sapiens
LVDGSSRCA

SEQ ID NO: 371140 - protein, 9 aa, Homo Sapiens
VIDPQAIHP

SEQ ID NO: 371141 - protein, 9 aa, Homo Sapiens
GTRFSNRSH

SEQ ID NO: 371142 - protein, 9 aa, Homo Sapiens
LCSPRFHRR

SEQ ID NO: 371143 - protein, 9 aa, Homo Sapiens
PSAACGPPS

SEQ ID NO: 371144 - protein, 9 aa, Homo Sapiens
IPSIAAYSK

SEQ ID NO: 371145 - protein, 9 aa, Homo Sapiens
PEALAAEDR

SEQ ID NO: 371146 - protein, 9 aa, Homo Sapiens
NANIVFQYK

SEQ ID NO: 371147 - protein, 9 aa, Homo Sapiens
LRAPIICIL

SEQ ID NO: 371148 - protein, 9 aa, Homo Sapiens
AKNTQALPL

SEQ ID NO: 371149 - protein, 9 aa, Homo Sapiens
VSSSLTKQV

SEQ ID NO: 371150 - protein, 9 aa, Homo Sapiens
TQQLRRSMQ

SEQ ID NO: 371151 - protein, 9 aa, Homo Sapiens
TRFLPTGGW

SEQ ID NO: 371152 - protein, 9 aa, Homo Sapiens
GALQPVMQA

SEQ ID NO: 371153 - protein, 9 aa, Homo Sapiens
QVDVENGNS

SEQ ID NO: 371154 - protein, 9 aa, Homo Sapiens
LEEEKRKKL

SEQ ID NO: 371155 - protein, 9 aa, Homo Sapiens
RRCSRRAGC

SEQ ID NO: 371156 - protein, 9 aa, Homo Sapiens
DPPPPPPPV

SEQ ID NO: 371157 - protein, 9 aa, Homo Sapiens
ALRMMRRQW

SEQ ID NO: 371158 - protein, 9 aa, Homo Sapiens
LPPPVWAVL

SEQ ID NO: 371159 - protein, 9 aa, Homo Sapiens
RVHQETQHR

SEQ ID NO: 371160 - protein, 9 aa, Homo Sapiens
FESIWLPGC

SEQ ID NO: 371161 - protein, 9 aa, Homo Sapiens
PQTPQDSRQ

SEQ ID NO: 371162 - protein, 9 aa, Homo Sapiens
AHLAKGAQL

SEQ ID NO: 371163 - protein, 9 aa, Homo Sapiens
KHPFIRNQP

SEQ ID NO: 371164 - protein, 9 aa, Homo Sapiens
DELIQWKRQ

SEQ ID NO: 371165 - protein, 9 aa, Homo Sapiens
TMDWHGEQS

SEQ ID NO: 371166 - protein, 9 aa, Homo Sapiens
PAPESPDSR

SEQ ID NO: 371167 - protein, 9 aa, Homo Sapiens
LSCLAKEGD

SEQ ID NO: 371168 - protein, 9 aa, Homo Sapiens
LIRAPGSRG

SEQ ID NO: 371169 - protein, 9 aa, Homo Sapiens
CGPGACPQV

SEQ ID NO: 371170 - protein, 9 aa, Homo Sapiens
RCVTTHWLN

SEQ ID NO: 371171 - protein, 9 aa, Homo Sapiens
RDTQQLRRS

SEQ ID NO: 371172 - protein, 9 aa, Homo Sapiens
FLCSPRFHR

SEQ ID NO: 371173 - protein, 9 aa, Homo Sapiens
ILRTLRCPR

SEQ ID NO: 371174 - protein, 9 aa, Homo Sapiens
PPCLRLRRA

SEQ ID NO: 371175 - protein, 9 aa, Homo Sapiens
QMQVNLHPD

SEQ ID NO: 371176 - protein, 9 aa, Homo Sapiens
LEVEPSDII

SEQ ID NO: 371177 - protein, 9 aa, Homo Sapiens
NARSATVCL

SEQ ID NO: 371178 - protein, 9 aa, Homo Sapiens
AFPRCPTHP

SEQ ID NO: 371179 - protein, 9 aa, Homo Sapiens
RSSPPATSR

SEQ ID NO: 371180 - protein, 9 aa, Homo Sapiens
RICISGRNV

SEQ ID NO: 371181 - protein, 9 aa, Homo Sapiens
SHGSMLAAR

SEQ ID NO: 371182 - protein, 9 aa, Homo Sapiens
RAPAAGWAA

SEQ ID NO: 371183 - protein, 9 aa, Homo Sapiens
KRGKPCLKI

SEQ ID NO: 371184 - protein, 9 aa, Homo Sapiens
GGGGLGRSW

SEQ ID NO: 371185 - protein, 9 aa, Homo Sapiens
LALGRFCMI

SEQ ID NO: 371186 - protein, 9 aa, Homo Sapiens
VTTTLHQMT

SEQ ID NO: 371187 - protein, 9 aa, Homo Sapiens
QVSQKKLSI

SEQ ID NO: 371188 - protein, 9 aa, Homo Sapiens
HGDGSTCPC

SEQ ID NO: 371189 - protein, 9 aa, Homo Sapiens
SRERIPPQR

SEQ ID NO: 371190 - protein, 9 aa, Homo Sapiens
DRTPFNART

SEQ ID NO: 371191 - protein, 9 aa, Homo Sapiens
GLPAPLHGR

SEQ ID NO: 371192 - protein, 9 aa, Homo Sapiens
ASSPATMWP

SEQ ID NO: 371193 - protein, 9 aa, Homo Sapiens
MPTEPAASA

SEQ ID NO: 371194 - protein, 9 aa, Homo Sapiens
IWGKIVGSL

SEQ ID NO: 371195 - protein, 9 aa, Homo Sapiens
DNLARQMIT

SEQ ID NO: 371196 - protein, 9 aa, Homo Sapiens
SINQVFLRC

SEQ ID NO: 371197 - protein, 9 aa, Homo Sapiens
IQKSSAKYS

SEQ ID NO: 371198 - protein, 9 aa, Homo Sapiens
GLKNILIMT

SEQ ID NO: 371199 - protein, 9 aa, Homo Sapiens
VIHNRGKEG

SEQ ID NO: 371200 - protein, 9 aa, Homo Sapiens
FSDLDQSFS

SEQ ID NO: 371201 - protein, 9 aa, Homo Sapiens
TLEVEQCLR

SEQ ID NO: 371202 - protein, 9 aa, Homo Sapiens
CKKRKNYCE

SEQ ID NO: 371203 - protein, 9 aa, Homo Sapiens
QSPSHIRHG

SEQ ID NO: 371204 - protein, 9 aa, Homo Sapiens
LLESLSLSA

SEQ ID NO: 371205 - protein, 9 aa, Homo Sapiens
GASKLNGAI

SEQ ID NO: 371206 - protein, 9 aa, Homo Sapiens
MNCPAALHQ

SEQ ID NO: 371207 - protein, 9 aa, Homo Sapiens
ERLGISICG

SEQ ID NO: 371208 - protein, 9 aa, Homo Sapiens
GHTAREKES

SEQ ID NO: 371209 - protein, 9 aa, Homo Sapiens
NTQALPLPL

SEQ ID NO: 371210 - protein, 9 aa, Homo Sapiens
TSDFTRSSP

SEQ ID NO: 371211 - protein, 9 aa, Homo Sapiens
EGWRSPCTH

SEQ ID NO: 371212 - protein, 9 aa, Homo Sapiens
SGRARGTSI

SEQ ID NO: 371213 - protein, 9 aa, Homo Sapiens
LDLATTDDI

SEQ ID NO: 371214 - protein, 9 aa, Homo Sapiens
PCLYRWLSA

SEQ ID NO: 371215 - protein, 9 aa, Homo Sapiens
HLKFIGNWI

SEQ ID NO: 371216 - protein, 9 aa, Homo Sapiens
GASSSTSRD

SEQ ID NO: 371217 - protein, 9 aa, Homo Sapiens
ERIPPQRAG

SEQ ID NO: 371218 - protein, 9 aa, Homo Sapiens
QPMEVQLTD

SEQ ID NO: 371219 - protein, 9 aa, Homo Sapiens
HLRACKGHQ

SEQ ID NO: 371220 - protein, 9 aa, Homo Sapiens
DKVKPQKLF

SEQ ID NO: 371221 - protein, 9 aa, Homo Sapiens
PVSARRTQM

SEQ ID NO: 371222 - protein, 9 aa, Homo Sapiens
CYCLISVEQ

SEQ ID NO: 371223 - protein, 9 aa, Homo Sapiens
TNARSATVC

SEQ ID NO: 371224 - protein, 9 aa, Homo Sapiens
SPALGLAVP

SEQ ID NO: 371225 - protein, 9 aa, Homo Sapiens
GLTLGAPLP

SEQ ID NO: 371226 - protein, 9 aa, Homo Sapiens
REVIRNTCK

SEQ ID NO: 371227 - protein, 9 aa, Homo Sapiens
TFFRPGAAG

SEQ ID NO: 371228 - protein, 9 aa, Homo Sapiens
RWVWNPTRM

SEQ ID NO: 371229 - protein, 9 aa, Homo Sapiens
TLGAPLPWM

SEQ ID NO: 371230 - protein, 9 aa, Homo Sapiens
VVHEVPHAQ

SEQ ID NO: 371231 - protein, 9 aa, Homo Sapiens
EDILQDAQV

SEQ ID NO: 371232 - protein, 9 aa, Homo Sapiens
RFNGMRLGA

SEQ ID NO: 371233 - protein, 9 aa, Homo Sapiens
PVKAKNGRE

SEQ ID NO: 371234 - protein, 9 aa, Homo Sapiens
FLQTLFQTQ

SEQ ID NO: 371235 - protein, 9 aa, Homo Sapiens
KKCSLYGKK

SEQ ID NO: 371236 - protein, 9 aa, Homo Sapiens
MKVSAEIKK

SEQ ID NO: 371237 - protein, 9 aa, Homo Sapiens
CVTTHWLNT

SEQ ID NO: 371238 - protein, 9 aa, Homo Sapiens
ADNKYTILQ

SEQ ID NO: 371239 - protein, 9 aa, Homo Sapiens
LGAHPACHP

SEQ ID NO: 371240 - protein, 9 aa, Homo Sapiens
QGTFSGREH

SEQ ID NO: 371241 - protein, 9 aa, Homo Sapiens
PAPVLLEAS

SEQ ID NO: 371242 - protein, 9 aa, Homo Sapiens
EHMVDVVVE

SEQ ID NO: 371243 - protein, 9 aa, Homo Sapiens
LRVHTQEPL

SEQ ID NO: 371244 - protein, 9 aa, Homo Sapiens
ITFEHFYQH

SEQ ID NO: 371245 - protein, 9 aa, Homo Sapiens
SSLCWNLSL

SEQ ID NO: 371246 - protein, 9 aa, Homo Sapiens
PPCQPKCPL

SEQ ID NO: 371247 - protein, 9 aa, Homo Sapiens
LEDPREQLR

SEQ ID NO: 371248 - protein, 9 aa, Homo Sapiens
ASFDCTRPR

SEQ ID NO: 371249 - protein, 9 aa, Homo Sapiens
LALVTAVGS

SEQ ID NO: 371250 - protein, 9 aa, Homo Sapiens
SNYAAEEIS

SEQ ID NO: 371251 - protein, 9 aa, Homo Sapiens
RRCYRHSLL

SEQ ID NO: 371252 - protein, 9 aa, Homo Sapiens
TKVYFMYLT

SEQ ID NO: 371253 - protein, 9 aa, Homo Sapiens
VSRPTPVTK

SEQ ID NO: 371254 - protein, 9 aa, Homo Sapiens
LLFLAVGGP

SEQ ID NO: 371255 - protein, 9 aa, Homo Sapiens
HNEVSAQME

SEQ ID NO: 371256 - protein, 9 aa, Homo Sapiens
IWQGCSAKS

SEQ ID NO: 371257 - protein, 9 aa, Homo Sapiens
LRWITPTCR

SEQ ID NO: 371258 - protein, 9 aa, Homo Sapiens
CWSPRPPGA

SEQ ID NO: 371259 - protein, 9 aa, Homo Sapiens
PLPVVLGLR

SEQ ID NO: 371260 - protein, 9 aa, Homo Sapiens
NEILSTEWD

SEQ ID NO: 371261 - protein, 9 aa, Homo Sapiens
HPKGNGRSG

SEQ ID NO: 371262 - protein, 9 aa, Homo Sapiens
RCCVPPGEH

SEQ ID NO: 371263 - protein, 9 aa, Homo Sapiens
SSRGTSITL

SEQ ID NO: 371264 - protein, 9 aa, Homo Sapiens
PGSQGACAH

SEQ ID NO: 371265 - protein, 9 aa, Homo Sapiens
VGCRIKRVS

SEQ ID NO: 371266 - protein, 9 aa, Homo Sapiens
TAPSSPPSS

SEQ ID NO: 371267 - protein, 9 aa, Homo Sapiens
AVTHSPMMQ

SEQ ID NO: 371268 - protein, 9 aa, Homo Sapiens
HIRHGSGSG

SEQ ID NO: 371269 - protein, 9 aa, Homo Sapiens
VPGETGLLP

SEQ ID NO: 371270 - protein, 9 aa, Homo Sapiens
CVTCLANPS

SEQ ID NO: 371271 - protein, 9 aa, Homo Sapiens
PEAPLTPRE

SEQ ID NO: 371272 - protein, 9 aa, Homo Sapiens
FTRRPTMEA

SEQ ID NO: 371273 - protein, 9 aa, Homo Sapiens
SAACQNEHL

SEQ ID NO: 371274 - protein, 9 aa, Homo Sapiens
NIVIQKKNI

SEQ ID NO: 371275 - protein, 9 aa, Homo Sapiens
CRCSAPANQ

SEQ ID NO: 371276 - protein, 9 aa, Homo Sapiens
MSSLTLLML

SEQ ID NO: 371277 - protein, 9 aa, Homo Sapiens
ENVDVCVVR

SEQ ID NO: 371278 - protein, 9 aa, Homo Sapiens
SSHLRACKG

SEQ ID NO: 371279 - protein, 9 aa, Homo Sapiens
AATSSLEAS

SEQ ID NO: 371280 - protein, 9 aa, Homo Sapiens
MPEYFLEAC

SEQ ID NO: 371281 - protein, 9 aa, Homo Sapiens
ADIIKYLKE

SEQ ID NO: 371282 - protein, 9 aa, Homo Sapiens
KGPLSLWRL

SEQ ID NO: 371283 - protein, 9 aa, Homo Sapiens
PPRLKKIGK

SEQ ID NO: 371284 - protein, 9 aa, Homo Sapiens
HQHLARAAK

SEQ ID NO: 371285 - protein, 9 aa, Homo Sapiens
ESEKMVQVA

SEQ ID NO: 371286 - protein, 9 aa, Homo Sapiens
NNQPTMETH

SEQ ID NO: 371287 - protein, 9 aa, Homo Sapiens
GLEVFAQAR

SEQ ID NO: 371288 - protein, 9 aa, Homo Sapiens
LPPRLKKIG

SEQ ID NO: 371289 - protein, 9 aa, Homo Sapiens
GHVVASMDK

SEQ ID NO: 371290 - protein, 9 aa, Homo Sapiens
VRVQVDAAE

SEQ ID NO: 371291 - protein, 9 aa, Homo Sapiens
PVMQALALG

SEQ ID NO: 371292 - protein, 9 aa, Homo Sapiens
CFSIANSNS

SEQ ID NO: 371293 - protein, 9 aa, Homo Sapiens
AGSGAGTGT

SEQ ID NO: 371294 - protein, 9 aa, Homo Sapiens
AFYKGTVPH

SEQ ID NO: 371295 - protein, 9 aa, Homo Sapiens
EGLEVFAQA

SEQ ID NO: 371296 - protein, 9 aa, Homo Sapiens
KDLRDGCML

SEQ ID NO: 371297 - protein, 9 aa, Homo Sapiens
APPAGRSVA

SEQ ID NO: 371298 - protein, 9 aa, Homo Sapiens
VYISANVGD

SEQ ID NO: 371299 - protein, 9 aa, Homo Sapiens
DCGTRFSNR

SEQ ID NO: 371300 - protein, 9 aa, Homo Sapiens
SRNTLFTRF

SEQ ID NO: 371301 - protein, 9 aa, Homo Sapiens
ISDTRGVGI

SEQ ID NO: 371302 - protein, 9 aa, Homo Sapiens
FGPAPPSQG

SEQ ID NO: 371303 - protein, 9 aa, Homo Sapiens
LVTENVQTI

SEQ ID NO: 371304 - protein, 9 aa, Homo Sapiens
QKERRRRND

SEQ ID NO: 371305 - protein, 9 aa, Homo Sapiens
KQPSRLPKT

SEQ ID NO: 371306 - protein, 9 aa, Homo Sapiens
QRTVGTWRI

SEQ ID NO: 371307 - protein, 9 aa, Homo Sapiens
ILHRVPKSR

SEQ ID NO: 371308 - protein, 9 aa, Homo Sapiens
AIEIDNECD

SEQ ID NO: 371309 - protein, 9 aa, Homo Sapiens
LLEDPREQL

SEQ ID NO: 371310 - protein, 9 aa, Homo Sapiens
APPSSSDGS

SEQ ID NO: 371311 - protein, 9 aa, Homo Sapiens
IWDINNQIY

SEQ ID NO: 371312 - protein, 9 aa, Homo Sapiens
HRTPWPLPM

SEQ ID NO: 371313 - protein, 9 aa, Homo Sapiens
PHSSVHSEC

SEQ ID NO: 371314 - protein, 9 aa, Homo Sapiens
GGPGVGSFL

SEQ ID NO: 371315 - protein, 9 aa, Homo Sapiens
SHLLLLCNL

SEQ ID NO: 371316 - protein, 9 aa, Homo Sapiens
NSSFHSPDS

SEQ ID NO: 371317 - protein, 9 aa, Homo Sapiens
EEGVVAAMG

SEQ ID NO: 371318 - protein, 9 aa, Homo Sapiens
GSFLVKRNL

SEQ ID NO: 371319 - protein, 9 aa, Homo Sapiens
EKKCKEIKT

SEQ ID NO: 371320 - protein, 9 aa, Homo Sapiens
CSSSVSSIV

SEQ ID NO: 371321 - protein, 9 aa, Homo Sapiens
KNKEQREQE

SEQ ID NO: 371322 - protein, 9 aa, Homo Sapiens
QQPQTPQDS

SEQ ID NO: 371323 - protein, 9 aa, Homo Sapiens
LAAGFGNSC

SEQ ID NO: 371324 - protein, 9 aa, Homo Sapiens
KSHQAVSRV

SEQ ID NO: 371325 - protein, 9 aa, Homo Sapiens
KKETKKNSN

SEQ ID NO: 371326 - protein, 9 aa, Homo Sapiens
KKISLEKEI

SEQ ID NO: 371327 - protein, 9 aa, Homo Sapiens
ARWSTSFCL

SEQ ID NO: 371328 - protein, 9 aa, Homo Sapiens
EEDSEDEQA

SEQ ID NO: 371329 - protein, 9 aa, Homo Sapiens
ASFSPYILM

SEQ ID NO: 371330 - protein, 9 aa, Homo Sapiens
SWVVVLMVM

SEQ ID NO: 371331 - protein, 9 aa, Homo Sapiens
NEVRVQVDA

SEQ ID NO: 371332 - protein, 9 aa, Homo Sapiens
QSALDCIFG

SEQ ID NO: 371333 - protein, 9 aa, Homo Sapiens
MASNYTGCC

SEQ ID NO: 371334 - protein, 9 aa, Homo Sapiens
SRVKAQAEA

SEQ ID NO: 371335 - protein, 9 aa, Homo Sapiens
LENLENLLH

SEQ ID NO: 371336 - protein, 9 aa, Homo Sapiens
FLVASADRP

SEQ ID NO: 371337 - protein, 9 aa, Homo Sapiens
ELNKQLTAP

SEQ ID NO: 371338 - protein, 9 aa, Homo Sapiens
ACRNILPPE

SEQ ID NO: 371339 - protein, 9 aa, Homo Sapiens
ATSYFIDRD

SEQ ID NO: 371340 - protein, 9 aa, Homo Sapiens
NMRVCGFPS

SEQ ID NO: 371341 - protein, 9 aa, Homo Sapiens
CRIKRVSGT

SEQ ID NO: 371342 - protein, 9 aa, Homo Sapiens
SGPWGMKFR

SEQ ID NO: 371343 - protein, 9 aa, Homo Sapiens
PPQRAGSRE

SEQ ID NO: 371344 - protein, 9 aa, Homo Sapiens
LAFLCGPRH

SEQ ID NO: 371345 - protein, 9 aa, Homo Sapiens
TRKGLSSHT

SEQ ID NO: 371346 - protein, 9 aa, Homo Sapiens
GSISEEEMC

SEQ ID NO: 371347 - protein, 9 aa, Homo Sapiens
PGTLSSGGG

SEQ ID NO: 371348 - protein, 9 aa, Homo Sapiens
DTESEKMVQ

SEQ ID NO: 371349 - protein, 9 aa, Homo Sapiens
QATITNCRG

SEQ ID NO: 371350 - protein, 9 aa, Homo Sapiens
LATDDYAVP

SEQ ID NO: 371351 - protein, 9 aa, Homo Sapiens
KMAVGPPTA

SEQ ID NO: 371352 - protein, 9 aa, Homo Sapiens
AVGSAQPRS

SEQ ID NO: 371353 - protein, 9 aa, Homo Sapiens
LTVLGQPGV

SEQ ID NO: 371354 - protein, 9 aa, Homo Sapiens
AKRGKRRRR

SEQ ID NO: 371355 - protein, 9 aa, Homo Sapiens
RGLCCWKRG

SEQ ID NO: 371356 - protein, 9 aa, Homo Sapiens
QEVDIQVCG

SEQ ID NO: 371357 - protein, 9 aa, Homo Sapiens
KSSLDGETP

SEQ ID NO: 371358 - protein, 9 aa, Homo Sapiens
GGSWSSASG

SEQ ID NO: 371359 - protein, 9 aa, Homo Sapiens
FGLATEKSR

SEQ ID NO: 371360 - protein, 9 aa, Homo Sapiens
TEDKKNGIW

SEQ ID NO: 371361 - protein, 9 aa, Homo Sapiens
MFEPKMTHS

SEQ ID NO: 371362 - protein, 9 aa, Homo Sapiens
RLNMFAKPE

SEQ ID NO: 371363 - protein, 9 aa, Homo Sapiens
CPRNRPYFQ

SEQ ID NO: 371364 - protein, 9 aa, Homo Sapiens
ATARLNMFA

SEQ ID NO: 371365 - protein, 9 aa, Homo Sapiens
VRIYRPGLV

SEQ ID NO: 371366 - protein, 9 aa, Homo Sapiens
MSTELKTYL

SEQ ID NO: 371367 - protein, 9 aa, Homo Sapiens
RHTHTGEKP

SEQ ID NO: 371368 - protein, 9 aa, Homo Sapiens
DDTLSTWSL

SEQ ID NO: 371369 - protein, 9 aa, Homo Sapiens
CGLLTLHWE

SEQ ID NO: 371370 - protein, 9 aa, Homo Sapiens
PTCHLLGEV

SEQ ID NO: 371371 - protein, 9 aa, Homo Sapiens
ASYLVRMAM

SEQ ID NO: 371372 - protein, 9 aa, Homo Sapiens
IVEQIENLE

SEQ ID NO: 371373 - protein, 9 aa, Homo Sapiens
PFAAETDMY

SEQ ID NO: 371374 - protein, 9 aa, Homo Sapiens
HVPLGNLSP

SEQ ID NO: 371375 - protein, 9 aa, Homo Sapiens
DVAGLGAQH

SEQ ID NO: 371376 - protein, 9 aa, Homo Sapiens
TNVKNVTKP

SEQ ID NO: 371377 - protein, 9 aa, Homo Sapiens
GLLLRHPAA

SEQ ID NO: 371378 - protein, 9 aa, Homo Sapiens
RSLKLLFEM

SEQ ID NO: 371379 - protein, 9 aa, Homo Sapiens
WAPVPARLA

SEQ ID NO: 371380 - protein, 9 aa, Homo Sapiens
TPKQAAQEE

SEQ ID NO: 371381 - protein, 9 aa, Homo Sapiens
YECHGVCNY

SEQ ID NO: 371382 - protein, 9 aa, Homo Sapiens
LFVFFSMMR

SEQ ID NO: 371383 - protein, 9 aa, Homo Sapiens
RYVEFYSHE

SEQ ID NO: 371384 - protein, 9 aa, Homo Sapiens
LIDDFSNQE

SEQ ID NO: 371385 - protein, 9 aa, Homo Sapiens
SLNLTQKLA

SEQ ID NO: 371386 - protein, 9 aa, Homo Sapiens
AYNNQPTME

SEQ ID NO: 371387 - protein, 9 aa, Homo Sapiens
RPNHSPHPQ

SEQ ID NO: 371388 - protein, 9 aa, Homo Sapiens
MRASELRGP

SEQ ID NO: 371389 - protein, 9 aa, Homo Sapiens
VQHRHTHTG

SEQ ID NO: 371390 - protein, 9 aa, Homo Sapiens
GSWLKGVLS

SEQ ID NO: 371391 - protein, 9 aa, Homo Sapiens
ERAEQQCIR

SEQ ID NO: 371392 - protein, 9 aa, Homo Sapiens
KHGNLDQKK

SEQ ID NO: 371393 - protein, 9 aa, Homo Sapiens
KNSFLCSPR

SEQ ID NO: 371394 - protein, 9 aa, Homo Sapiens
MTLNLKDQK

SEQ ID NO: 371395 - protein, 9 aa, Homo Sapiens
NITEELFLL

SEQ ID NO: 371396 - protein, 9 aa, Homo Sapiens
TPPVAARAC

SEQ ID NO: 371397 - protein, 9 aa, Homo Sapiens
EALRARNLL

SEQ ID NO: 371398 - protein, 9 aa, Homo Sapiens
ACFTWRTSR

SEQ ID NO: 371399 - protein, 9 aa, Homo Sapiens
AAGTTFTLV

SEQ ID NO: 371400 - protein, 9 aa, Homo Sapiens
RLRSFDVGY

SEQ ID NO: 371401 - protein, 9 aa, Homo Sapiens
LGTHSYVRI

SEQ ID NO: 371402 - protein, 9 aa, Homo Sapiens
TECVRTALN

SEQ ID NO: 371403 - protein, 9 aa, Homo Sapiens
WGMKFRLQL

SEQ ID NO: 371404 - protein, 9 aa, Homo Sapiens
ANAPCRCSA

SEQ ID NO: 371405 - protein, 9 aa, Homo Sapiens
DFLKTTSSS

SEQ ID NO: 371406 - protein, 9 aa, Homo Sapiens
AIKDHTFVT

SEQ ID NO: 371407 - protein, 9 aa, Homo Sapiens
VEFYSHEAI

SEQ ID NO: 371408 - protein, 9 aa, Homo Sapiens
TEIQLTMND

SEQ ID NO: 371409 - protein, 9 aa, Homo Sapiens
ICNNFPTIT

SEQ ID NO: 371410 - protein, 9 aa, Homo Sapiens
FVDWVRRQF

SEQ ID NO: 371411 - protein, 9 aa, Homo Sapiens
PYNSQQFPG

SEQ ID NO: 371412 - protein, 9 aa, Homo Sapiens
DFSNQEHLK

SEQ ID NO: 371413 - protein, 9 aa, Homo Sapiens
AGIQEMEMG

SEQ ID NO: 371414 - protein, 9 aa, Homo Sapiens
EEGQQKIRE

SEQ ID NO: 371415 - protein, 9 aa, Homo Sapiens
TEEEELDAS

SEQ ID NO: 371416 - protein, 9 aa, Homo Sapiens
DSVSRVRPC

SEQ ID NO: 371417 - protein, 9 aa, Homo Sapiens
FLPTGGWGC

SEQ ID NO: 371418 - protein, 9 aa, Homo Sapiens
STPYFILWT

SEQ ID NO: 371419 - protein, 9 aa, Homo Sapiens
FLAVGGPWA

SEQ ID NO: 371420 - protein, 9 aa, Homo Sapiens
VEGLRGQGG

SEQ ID NO: 371421 - protein, 9 aa, Homo Sapiens
MQATGLPQH

SEQ ID NO: 371422 - protein, 9 aa, Homo Sapiens
GTSRTRGTL

SEQ ID NO: 371423 - protein, 9 aa, Homo Sapiens
QTARARAGA

SEQ ID NO: 371424 - protein, 9 aa, Homo Sapiens
GGTRLTTVS

SEQ ID NO: 371425 - protein, 9 aa, Homo Sapiens
LDGETPGQA

SEQ ID NO: 371426 - protein, 9 aa, Homo Sapiens
SQGAPRAGL

SEQ ID NO: 371427 - protein, 9 aa, Homo Sapiens
LNISDTRGV

SEQ ID NO: 371428 - protein, 9 aa, Homo Sapiens
LRLYHAHPY

SEQ ID NO: 371429 - protein, 9 aa, Homo Sapiens
VGSAQPRSA

SEQ ID NO: 371430 - protein, 9 aa, Homo Sapiens
QWKRQQQLA

SEQ ID NO: 371431 - protein, 9 aa, Homo Sapiens
PPCSIPLST

SEQ ID NO: 371432 - protein, 9 aa, Homo Sapiens
AISLDLRSQ

SEQ ID NO: 371433 - protein, 9 aa, Homo Sapiens
PRGSRSQGT

SEQ ID NO: 371434 - protein, 9 aa, Homo Sapiens
MVPGETGLL

SEQ ID NO: 371435 - protein, 9 aa, Homo Sapiens
MDKWKGPQE

SEQ ID NO: 371436 - protein, 9 aa, Homo Sapiens
GMEALGSWG

SEQ ID NO: 371437 - protein, 9 aa, Homo Sapiens
IKGEQFTVL

SEQ ID NO: 371438 - protein, 9 aa, Homo Sapiens
QLYHLVSDD

SEQ ID NO: 371439 - protein, 9 aa, Homo Sapiens
ALLMPPPGL

SEQ ID NO: 371440 - protein, 9 aa, Homo Sapiens
PVDVQVVTH

SEQ ID NO: 371441 - protein, 9 aa, Homo Sapiens
GHDGARGPV

SEQ ID NO: 371442 - protein, 9 aa, Homo Sapiens
RNTLFTRFA

SEQ ID NO: 371443 - protein, 9 aa, Homo Sapiens
SRPGSGPPT

SEQ ID NO: 371444 - protein, 9 aa, Homo Sapiens
DKACISQAM

SEQ ID NO: 371445 - protein, 9 aa, Homo Sapiens
QSSTLAHFN

SEQ ID NO: 371446 - protein, 9 aa, Homo Sapiens
QCIRNEREK

SEQ ID NO: 371447 - protein, 9 aa, Homo Sapiens
QVPQVLENN

SEQ ID NO: 371448 - protein, 9 aa, Homo Sapiens
TGSSRGTSI

SEQ ID NO: 371449 - protein, 9 aa, Homo Sapiens
RTRALRGPP

SEQ ID NO: 371450 - protein, 9 aa, Homo Sapiens
MEKMKTTIQ

SEQ ID NO: 371451 - protein, 9 aa, Homo Sapiens
RHFSVPNGL

SEQ ID NO: 371452 - protein, 9 aa, Homo Sapiens
SPAPSRRLS

SEQ ID NO: 371453 - protein, 9 aa, Homo Sapiens
WVVVLMVMG

SEQ ID NO: 371454 - protein, 9 aa, Homo Sapiens
RPPSSCWSP

SEQ ID NO: 371455 - protein, 9 aa, Homo Sapiens
LTMSPNSAG

SEQ ID NO: 371456 - protein, 9 aa, Homo Sapiens
PGPRGGHPQ

SEQ ID NO: 371457 - protein, 9 aa, Homo Sapiens
YAFPPGPGI

SEQ ID NO: 371458 - protein, 9 aa, Homo Sapiens
LVMRRMSSH

SEQ ID NO: 371459 - protein, 9 aa, Homo Sapiens
DPLTASTAN

SEQ ID NO: 371460 - protein, 9 aa, Homo Sapiens
ISHQLIMAY

SEQ ID NO: 371461 - protein, 9 aa, Homo Sapiens
DGFETELSP

SEQ ID NO: 371462 - protein, 9 aa, Homo Sapiens
EREREREQT

SEQ ID NO: 371463 - protein, 9 aa, Homo Sapiens
ELLKTLNMI

SEQ ID NO: 371464 - protein, 9 aa, Homo Sapiens
STNARSATV

SEQ ID NO: 371465 - protein, 9 aa, Homo Sapiens
LGNYPEVLQ

SEQ ID NO: 371466 - protein, 9 aa, Homo Sapiens
ILFPWKMSL

SEQ ID NO: 371467 - protein, 9 aa, Homo Sapiens
MAPMSTELK

SEQ ID NO: 371468 - protein, 9 aa, Homo Sapiens
VNASNASLL

SEQ ID NO: 371469 - protein, 9 aa, Homo Sapiens
MLAARLHWL

SEQ ID NO: 371470 - protein, 9 aa, Homo Sapiens
TTQEQRLTY

SEQ ID NO: 371471 - protein, 9 aa, Homo Sapiens
LTRMRKSTL

SEQ ID NO: 371472 - protein, 9 aa, Homo Sapiens
TTSFWSISS

SEQ ID NO: 371473 - protein, 9 aa, Homo Sapiens
EEDQSIIIK

SEQ ID NO: 371474 - protein, 9 aa, Homo Sapiens
SITLSTIVA

SEQ ID NO: 371475 - protein, 9 aa, Homo Sapiens
CSYFYRLYA

SEQ ID NO: 371476 - protein, 9 aa, Homo Sapiens
PLIMDTGGL

SEQ ID NO: 371477 - protein, 9 aa, Homo Sapiens
VCGGSRMTD

SEQ ID NO: 371478 - protein, 9 aa, Homo Sapiens
TNGVLVSQQ

SEQ ID NO: 371479 - protein, 9 aa, Homo Sapiens
FSTRLAVST

SEQ ID NO: 371480 - protein, 9 aa, Homo Sapiens
GPWATGPSV

SEQ ID NO: 371481 - protein, 9 aa, Homo Sapiens
PGSTGGADR

SEQ ID NO: 371482 - protein, 9 aa, Homo Sapiens
AATAPSPFP

SEQ ID NO: 371483 - protein, 9 aa, Homo Sapiens
PYHDQKPGR

SEQ ID NO: 371484 - protein, 9 aa, Homo Sapiens
TRVPLWPKK

SEQ ID NO: 371485 - protein, 9 aa, Homo Sapiens
DDETVDSSG

SEQ ID NO: 371486 - protein, 9 aa, Homo Sapiens
MAVGPPTAL

SEQ ID NO: 371487 - protein, 9 aa, Homo Sapiens
ASNFGLIFL

SEQ ID NO: 371488 - protein, 9 aa, Homo Sapiens
LDRKKKSRT

SEQ ID NO: 371489 - protein, 9 aa, Homo Sapiens
MQVNLHPDV

SEQ ID NO: 371490 - protein, 9 aa, Homo Sapiens
YIWEEWSLL

SEQ ID NO: 371491 - protein, 9 aa, Homo Sapiens
LPSSWDHSF

SEQ ID NO: 371492 - protein, 9 aa, Homo Sapiens
PEDVENFYL

SEQ ID NO: 371493 - protein, 9 aa, Homo Sapiens
VPHAATASP

SEQ ID NO: 371494 - protein, 9 aa, Homo Sapiens
DDHRAVGKK

SEQ ID NO: 371495 - protein, 9 aa, Homo Sapiens
DSKHKLESP

SEQ ID NO: 371496 - protein, 9 aa, Homo Sapiens
FQTEIAQLM

SEQ ID NO: 371497 - protein, 9 aa, Homo Sapiens
QREHLDIRE

SEQ ID NO: 371498 - protein, 9 aa, Homo Sapiens
PRPAARAPW

SEQ ID NO: 371499 - protein, 9 aa, Homo Sapiens
HQLIMAYPK

SEQ ID NO: 371500 - protein, 9 aa, Homo Sapiens
LCNLSPGGL

SEQ ID NO: 371501 - protein, 9 aa, Homo Sapiens
KRPCLLEAC

SEQ ID NO: 371502 - protein, 9 aa, Homo Sapiens
SGTSRTRGT

SEQ ID NO: 371503 - protein, 9 aa, Homo Sapiens
ENPELWATM

SEQ ID NO: 371504 - protein, 9 aa, Homo Sapiens
AFQTEIAQL

SEQ ID NO: 371505 - protein, 9 aa, Homo Sapiens
GGDAAAGAA

SEQ ID NO: 371506 - protein, 9 aa, Homo Sapiens
VDNPFQKEC

SEQ ID NO: 371507 - protein, 9 aa, Homo Sapiens
LYGKKLVKI

SEQ ID NO: 371508 - protein, 9 aa, Homo Sapiens
TRPEGWRSP

SEQ ID NO: 371509 - protein, 9 aa, Homo Sapiens
QQMQVNLHP

SEQ ID NO: 371510 - protein, 9 aa, Homo Sapiens
DILNRQFMN

SEQ ID NO: 371511 - protein, 9 aa, Homo Sapiens
IPYNSQQFP

SEQ ID NO: 371512 - protein, 9 aa, Homo Sapiens
SQDKLDKDG

SEQ ID NO: 371513 - protein, 9 aa, Homo Sapiens
VLLLQPSMI

SEQ ID NO: 371514 - protein, 9 aa, Homo Sapiens
SQLEKDKMI

SEQ ID NO: 371515 - protein, 9 aa, Homo Sapiens
DTQQLRRSM

SEQ ID NO: 371516 - protein, 9 aa, Homo Sapiens
SQDPREVRH

SEQ ID NO: 371517 - protein, 9 aa, Homo Sapiens
EAHLAKGAQ

SEQ ID NO: 371518 - protein, 9 aa, Homo Sapiens
GFIHNFQES

SEQ ID NO: 371519 - protein, 9 aa, Homo Sapiens
TVCWPCSSS

SEQ ID NO: 371520 - protein, 9 aa, Homo Sapiens
RRWSSPTGR

SEQ ID NO: 371521 - protein, 9 aa, Homo Sapiens
LALLALNHM

SEQ ID NO: 371522 - protein, 9 aa, Homo Sapiens
WCEYCKKGF

SEQ ID NO: 371523 - protein, 9 aa, Homo Sapiens
TGNLSPTRW

SEQ ID NO: 371524 - protein, 9 aa, Homo Sapiens
RPQDGFAQW

SEQ ID NO: 371525 - protein, 9 aa, Homo Sapiens
ETLHQLATS

SEQ ID NO: 371526 - protein, 9 aa, Homo Sapiens
PPATSRPPP

SEQ ID NO: 371527 - protein, 9 aa, Homo Sapiens
GGKVDIHLL

SEQ ID NO: 371528 - protein, 9 aa, Homo Sapiens
YTCAQCGKD

SEQ ID NO: 371529 - protein, 9 aa, Homo Sapiens
EDQWLEKKC

SEQ ID NO: 371530 - protein, 9 aa, Homo Sapiens
NKWITEENL

SEQ ID NO: 371531 - protein, 9 aa, Homo Sapiens
EEKYRKIKM

SEQ ID NO: 371532 - protein, 9 aa, Homo Sapiens
SITNMSLDR

SEQ ID NO: 371533 - protein, 9 aa, Homo Sapiens
NSGTVLRLS

SEQ ID NO: 371534 - protein, 9 aa, Homo Sapiens
IIVPIDGQI

SEQ ID NO: 371535 - protein, 9 aa, Homo Sapiens
GQCVENECV

SEQ ID NO: 371536 - protein, 9 aa, Homo Sapiens
DYRLPPPMN

SEQ ID NO: 371537 - protein, 9 aa, Homo Sapiens
GYFQQDIKG

SEQ ID NO: 371538 - protein, 9 aa, Homo Sapiens
VDVCVVRGC

SEQ ID NO: 371539 - protein, 9 aa, Homo Sapiens
RPLAELCNQ

SEQ ID NO: 371540 - protein, 9 aa, Homo Sapiens
DMELRLVDG

SEQ ID NO: 371541 - protein, 9 aa, Homo Sapiens
CPKVPEEGS

SEQ ID NO: 371542 - protein, 9 aa, Homo Sapiens
SWCESRAAA

SEQ ID NO: 371543 - protein, 9 aa, Homo Sapiens
LPTQTSHYL

SEQ ID NO: 371544 - protein, 9 aa, Homo Sapiens
HPFIRNQPN

SEQ ID NO: 371545 - protein, 9 aa, Homo Sapiens
VAIQNFSTY

SEQ ID NO: 371546 - protein, 9 aa, Homo Sapiens
LWGWNADGL

SEQ ID NO: 371547 - protein, 9 aa, Homo Sapiens
MPVCCGNEV

SEQ ID NO: 371548 - protein, 9 aa, Homo Sapiens
DPANDRQFS

SEQ ID NO: 371549 - protein, 9 aa, Homo Sapiens
QALPLPLSG

SEQ ID NO: 371550 - protein, 9 aa, Homo Sapiens
GICKVYLAR

SEQ ID NO: 371551 - protein, 9 aa, Homo Sapiens
TFAFQTEIA

SEQ ID NO: 371552 - protein, 9 aa, Homo Sapiens
PVTIWGKIV

SEQ ID NO: 371553 - protein, 9 aa, Homo Sapiens
SRWNPLRRT

SEQ ID NO: 371554 - protein, 9 aa, Homo Sapiens
LMGIEEQSL

SEQ ID NO: 371555 - protein, 9 aa, Homo Sapiens
QMTSRRASL

SEQ ID NO: 371556 - protein, 9 aa, Homo Sapiens
GAAQLNVFI

SEQ ID NO: 371557 - protein, 9 aa, Homo Sapiens
ETCHRYLNI

SEQ ID NO: 371558 - protein, 9 aa, Homo Sapiens
MTRERMEDR

SEQ ID NO: 371559 - protein, 9 aa, Homo Sapiens
AAFHAAWMV

SEQ ID NO: 371560 - protein, 9 aa, Homo Sapiens
GTPGLAREE

SEQ ID NO: 371561 - protein, 9 aa, Homo Sapiens
SEKMVQVAL

SEQ ID NO: 371562 - protein, 9 aa, Homo Sapiens
ERLYRCREC

SEQ ID NO: 371563 - protein, 9 aa, Homo Sapiens
AVLTKANIA

SEQ ID NO: 371564 - protein, 9 aa, Homo Sapiens
PGLFQEILH

SEQ ID NO: 371565 - protein, 9 aa, Homo Sapiens
LYLEISHQL

SEQ ID NO: 371566 - protein, 9 aa, Homo Sapiens
AVRRPAAPT

SEQ ID NO: 371567 - protein, 9 aa, Homo Sapiens
LLVTGASVA

SEQ ID NO: 371568 - protein, 9 aa, Homo Sapiens
TKPGEDMLC

SEQ ID NO: 371569 - protein, 9 aa, Homo Sapiens
PSLGTHSYV

SEQ ID NO: 371570 - protein, 9 aa, Homo Sapiens
RASSVASQK

SEQ ID NO: 371571 - protein, 9 aa, Homo Sapiens
AGTAGGGGS

SEQ ID NO: 371572 - protein, 9 aa, Homo Sapiens
DMIARPQQP

SEQ ID NO: 371573 - protein, 9 aa, Homo Sapiens
GVVTDLFPV

SEQ ID NO: 371574 - protein, 9 aa, Homo Sapiens
SSVLLRAPP

SEQ ID NO: 371575 - protein, 9 aa, Homo Sapiens
GYTTIHDIP

SEQ ID NO: 371576 - protein, 9 aa, Homo Sapiens
ECQKSLLSL

SEQ ID NO: 371577 - protein, 9 aa, Homo Sapiens
FYSTAKNVK

SEQ ID NO: 371578 - protein, 9 aa, Homo Sapiens
NVELKFVDW

SEQ ID NO: 371579 - protein, 9 aa, Homo Sapiens
SILPSCRCY

SEQ ID NO: 371580 - protein, 9 aa, Homo Sapiens
RVNTSLFLA

SEQ ID NO: 371581 - protein, 9 aa, Homo Sapiens
RWSSPTGRR

SEQ ID NO: 371582 - protein, 9 aa, Homo Sapiens
KAWGWEAAA

SEQ ID NO: 371583 - protein, 9 aa, Homo Sapiens
TPSPVSGSW

SEQ ID NO: 371584 - protein, 9 aa, Homo Sapiens
DWPSNGGHV

SEQ ID NO: 371585 - protein, 9 aa, Homo Sapiens
TRCLMVLGL

SEQ ID NO: 371586 - protein, 9 aa, Homo Sapiens
ISICGGARG

SEQ ID NO: 371587 - protein, 9 aa, Homo Sapiens
RRVGCRIKR

SEQ ID NO: 371588 - protein, 9 aa, Homo Sapiens
AVPPRQLSR

SEQ ID NO: 371589 - protein, 9 aa, Homo Sapiens
KCIGLIYVN

SEQ ID NO: 371590 - protein, 9 aa, Homo Sapiens
ARAGAGAGP

SEQ ID NO: 371591 - protein, 9 aa, Homo Sapiens
PEHKPLGTA

SEQ ID NO: 371592 - protein, 9 aa, Homo Sapiens
IYCVDPTRV

SEQ ID NO: 371593 - protein, 9 aa, Homo Sapiens
RDPSGSPCV

SEQ ID NO: 371594 - protein, 9 aa, Homo Sapiens
SPSSAASTP

SEQ ID NO: 371595 - protein, 9 aa, Homo Sapiens
SARSASALP

SEQ ID NO: 371596 - protein, 9 aa, Homo Sapiens
TMSPNSAGI

SEQ ID NO: 371597 - protein, 9 aa, Homo Sapiens
VLRNSGTVL

SEQ ID NO: 371598 - protein, 9 aa, Homo Sapiens
QAQTVFWGQ

SEQ ID NO: 371599 - protein, 9 aa, Homo Sapiens
CPTTPPTPA

SEQ ID NO: 371600 - protein, 9 aa, Homo Sapiens
FDIETCHRY

SEQ ID NO: 371601 - protein, 9 aa, Homo Sapiens
AAPEHKPLG

SEQ ID NO: 371602 - protein, 9 aa, Homo Sapiens
FASSVLGAI

SEQ ID NO: 371603 - protein, 9 aa, Homo Sapiens
AGGGNGSAG

SEQ ID NO: 371604 - protein, 9 aa, Homo Sapiens
VMTYWTTFC

SEQ ID NO: 371605 - protein, 9 aa, Homo Sapiens
HSDDDDDPP

SEQ ID NO: 371606 - protein, 9 aa, Homo Sapiens
PRPPGASSG

SEQ ID NO: 371607 - protein, 9 aa, Homo Sapiens
LINEGRLLY

SEQ ID NO: 371608 - protein, 9 aa, Homo Sapiens
RVPLWPKKI

SEQ ID NO: 371609 - protein, 9 aa, Homo Sapiens
GETGLLPEC

SEQ ID NO: 371610 - protein, 9 aa, Homo Sapiens
IRRNEMAAK

SEQ ID NO: 371611 - protein, 9 aa, Homo Sapiens
LIYVNGRMR

SEQ ID NO: 371612 - protein, 9 aa, Homo Sapiens
LRHPAARGG

SEQ ID NO: 371613 - protein, 9 aa, Homo Sapiens
DKKAVSRSA

SEQ ID NO: 371614 - protein, 9 aa, Homo Sapiens
LVTRGTSRA

SEQ ID NO: 371615 - protein, 9 aa, Homo Sapiens
FLKHDLNSP

SEQ ID NO: 371616 - protein, 9 aa, Homo Sapiens
KIIVEQIEN

SEQ ID NO: 371617 - protein, 9 aa, Homo Sapiens
SLAAGGSLA

SEQ ID NO: 371618 - protein, 9 aa, Homo Sapiens
ELASRVKAQ

SEQ ID NO: 371619 - protein, 9 aa, Homo Sapiens
ASLALGRFC

SEQ ID NO: 371620 - protein, 9 aa, Homo Sapiens
CWRWSCGAL

SEQ ID NO: 371621 - protein, 9 aa, Homo Sapiens
ARLNMFAKP

SEQ ID NO: 371622 - protein, 9 aa, Homo Sapiens
SLFLSPAIR

SEQ ID NO: 371623 - protein, 9 aa, Homo Sapiens
APGQASPTS

SEQ ID NO: 371624 - protein, 9 aa, Homo Sapiens
VLNSQEKKR

SEQ ID NO: 371625 - protein, 9 aa, Homo Sapiens
HRTFSTTAL

SEQ ID NO: 371626 - protein, 9 aa, Homo Sapiens
TRSSVTGIF

SEQ ID NO: 371627 - protein, 9 aa, Homo Sapiens
QDDKVVAIL

SEQ ID NO: 371628 - protein, 9 aa, Homo Sapiens
LGLWGTRGG

SEQ ID NO: 371629 - protein, 9 aa, Homo Sapiens
QACRFMECL

SEQ ID NO: 371630 - protein, 9 aa, Homo Sapiens
MIARPQQPV

SEQ ID NO: 371631 - protein, 9 aa, Homo Sapiens
RPSRCRYWD

SEQ ID NO: 371632 - protein, 9 aa, Homo Sapiens
TVILCLFVF

SEQ ID NO: 371633 - protein, 9 aa, Homo Sapiens
HRSRHQQSA

SEQ ID NO: 371634 - protein, 9 aa, Homo Sapiens
AEQNVLQQS

SEQ ID NO: 371635 - protein, 9 aa, Homo Sapiens
ASNTIAPST

SEQ ID NO: 371636 - protein, 9 aa, Homo Sapiens
QPELVRPAL

SEQ ID NO: 371637 - protein, 9 aa, Homo Sapiens
QSSEDILQD

SEQ ID NO: 371638 - protein, 9 aa, Homo Sapiens
RSRRRWSSP

SEQ ID NO: 371639 - protein, 9 aa, Homo Sapiens
CCVPPGEHC

SEQ ID NO: 371640 - protein, 9 aa, Homo Sapiens
DCPVPFCAS

SEQ ID NO: 371641 - protein, 9 aa, Homo Sapiens
NVVSVSALR

SEQ ID NO: 371642 - protein, 9 aa, Homo Sapiens
LLSTPIFGP

SEQ ID NO: 371643 - protein, 9 aa, Homo Sapiens
HHDPLGKPL

SEQ ID NO: 371644 - protein, 9 aa, Homo Sapiens
ESKPREPGK

SEQ ID NO: 371645 - protein, 9 aa, Homo Sapiens
GNWILKQFL

SEQ ID NO: 371646 - protein, 9 aa, Homo Sapiens
RALTMPELT

SEQ ID NO: 371647 - protein, 9 aa, Homo Sapiens
NFLKHDLNS

SEQ ID NO: 371648 - protein, 9 aa, Homo Sapiens
WRMMTLNLK

SEQ ID NO: 371649 - protein, 9 aa, Homo Sapiens
RGYTTIHDI

SEQ ID NO: 371650 - protein, 9 aa, Homo Sapiens
CRGNGGQRR

SEQ ID NO: 371651 - protein, 9 aa, Homo Sapiens
ATTLLSDAS

SEQ ID NO: 371652 - protein, 9 aa, Homo Sapiens
PEVPPRPAS

SEQ ID NO: 371653 - protein, 9 aa, Homo Sapiens
EEKESRMEI

SEQ ID NO: 371654 - protein, 9 aa, Homo Sapiens
ILKNHPPMP

SEQ ID NO: 371655 - protein, 9 aa, Homo Sapiens
HFYWKHLKF

SEQ ID NO: 371656 - protein, 9 aa, Homo Sapiens
HVNESACYV

SEQ ID NO: 371657 - protein, 9 aa, Homo Sapiens
QSIIIKRKR

SEQ ID NO: 371658 - protein, 9 aa, Homo Sapiens
IFVGGCPTT

SEQ ID NO: 371659 - protein, 9 aa, Homo Sapiens
GWCMPGLPC

SEQ ID NO: 371660 - protein, 9 aa, Homo Sapiens
MEICDIQQD

SEQ ID NO: 371661 - protein, 9 aa, Homo Sapiens
REPMLCKVL

SEQ ID NO: 371662 - protein, 9 aa, Homo Sapiens
LQVPQNAAA

SEQ ID NO: 371663 - protein, 9 aa, Homo Sapiens
RGFLAAFHA

SEQ ID NO: 371664 - protein, 9 aa, Homo Sapiens
AISTFGTSI

SEQ ID NO: 371665 - protein, 9 aa, Homo Sapiens
TDHRIRQAL

SEQ ID NO: 371666 - protein, 9 aa, Homo Sapiens
PKGPARIPI

SEQ ID NO: 371667 - protein, 9 aa, Homo Sapiens
LTRIWQGCS

SEQ ID NO: 371668 - protein, 9 aa, Homo Sapiens
QQRLASRWH

SEQ ID NO: 371669 - protein, 9 aa, Homo Sapiens
QFYHEDTPL

SEQ ID NO: 371670 - protein, 9 aa, Homo Sapiens
DKRVVLHRG

SEQ ID NO: 371671 - protein, 9 aa, Homo Sapiens
NECDFAYET

SEQ ID NO: 371672 - protein, 9 aa, Homo Sapiens
KTTSFWSIS

SEQ ID NO: 371673 - protein, 9 aa, Homo Sapiens
PAPPSQGRG

SEQ ID NO: 371674 - protein, 9 aa, Homo Sapiens
LLPKGPARI

SEQ ID NO: 371675 - protein, 9 aa, Homo Sapiens
DVEDVLPSS

SEQ ID NO: 371676 - protein, 9 aa, Homo Sapiens
SWEYWQDFV

SEQ ID NO: 371677 - protein, 9 aa, Homo Sapiens
TIFRFCGPL

SEQ ID NO: 371678 - protein, 9 aa, Homo Sapiens
EAAAEDDIA

SEQ ID NO: 371679 - protein, 9 aa, Homo Sapiens
GKTFSRMSS

SEQ ID NO: 371680 - protein, 9 aa, Homo Sapiens
IKTLTQRKK

SEQ ID NO: 371681 - protein, 9 aa, Homo Sapiens
IKRVSGTIP

SEQ ID NO: 371682 - protein, 9 aa, Homo Sapiens
PCMLISLLA

SEQ ID NO: 371683 - protein, 9 aa, Homo Sapiens
NLVVILIRD

SEQ ID NO: 371684 - protein, 9 aa, Homo Sapiens
DSNAGCDSP

SEQ ID NO: 371685 - protein, 9 aa, Homo Sapiens
LLEFLERIH

SEQ ID NO: 371686 - protein, 9 aa, Homo Sapiens
QFYSTAKNV

SEQ ID NO: 371687 - protein, 9 aa, Homo Sapiens
LKEKKTRKH

SEQ ID NO: 371688 - protein, 9 aa, Homo Sapiens
AEQQCIRNE

SEQ ID NO: 371689 - protein, 9 aa, Homo Sapiens
GVPEVDGDQ

SEQ ID NO: 371690 - protein, 9 aa, Homo Sapiens
PHWCEYCKK

SEQ ID NO: 371691 - protein, 9 aa, Homo Sapiens
DWLATCTPP

SEQ ID NO: 371692 - protein, 9 aa, Homo Sapiens
TTLHQMTRE

SEQ ID NO: 371693 - protein, 9 aa, Homo Sapiens
SSHSLRAVS

SEQ ID NO: 371694 - protein, 9 aa, Homo Sapiens
CWMTWRASA

SEQ ID NO: 371695 - protein, 9 aa, Homo Sapiens
SCICGKTKP

SEQ ID NO: 371696 - protein, 9 aa, Homo Sapiens
SERNLKCFL

SEQ ID NO: 371697 - protein, 9 aa, Homo Sapiens
NTENVDVCV

SEQ ID NO: 371698 - protein, 9 aa, Homo Sapiens
SPTEGACTA

SEQ ID NO: 371699 - protein, 9 aa, Homo Sapiens
RAVASGMAL

SEQ ID NO: 371700 - protein, 9 aa, Homo Sapiens
VSLVESGQV

SEQ ID NO: 371701 - protein, 9 aa, Homo Sapiens
AQEVDIQVC

SEQ ID NO: 371702 - protein, 9 aa, Homo Sapiens
SGGTTSSSG

SEQ ID NO: 371703 - protein, 9 aa, Homo Sapiens
DVHSRASWD

SEQ ID NO: 371704 - protein, 9 aa, Homo Sapiens
LTITGNGVI

SEQ ID NO: 371705 - protein, 9 aa, Homo Sapiens
LSPICRTGS

SEQ ID NO: 371706 - protein, 9 aa, Homo Sapiens
FGNALVILT

SEQ ID NO: 371707 - protein, 9 aa, Homo Sapiens
QDTPGGRPP

SEQ ID NO: 371708 - protein, 9 aa, Homo Sapiens
SSTPSLPPC

SEQ ID NO: 371709 - protein, 9 aa, Homo Sapiens
RPPEKRFGH

SEQ ID NO: 371710 - protein, 9 aa, Homo Sapiens
TGEKPYTCA

SEQ ID NO: 371711 - protein, 9 aa, Homo Sapiens
DGGLERVPV

SEQ ID NO: 371712 - protein, 9 aa, Homo Sapiens
SGTSRARGP

SEQ ID NO: 371713 - protein, 9 aa, Homo Sapiens
QEVWTLYAN

SEQ ID NO: 371714 - protein, 9 aa, Homo Sapiens
LHTLLSIKE

SEQ ID NO: 371715 - protein, 9 aa, Homo Sapiens
QKSSAKYSA

SEQ ID NO: 371716 - protein, 9 aa, Homo Sapiens
LDVSSISHW

SEQ ID NO: 371717 - protein, 9 aa, Homo Sapiens
WGWNADGLA

SEQ ID NO: 371718 - protein, 9 aa, Homo Sapiens
SWSTWLSLW

SEQ ID NO: 371719 - protein, 9 aa, Homo Sapiens
SPGRSASRT

SEQ ID NO: 371720 - protein, 9 aa, Homo Sapiens
NLLRLQSLL

SEQ ID NO: 371721 - protein, 9 aa, Homo Sapiens
TMVCNLALR

SEQ ID NO: 371722 - protein, 9 aa, Homo Sapiens
KWKGPQEEP

SEQ ID NO: 371723 - protein, 9 aa, Homo Sapiens
AELPHECDP

SEQ ID NO: 371724 - protein, 9 aa, Homo Sapiens
TEEFPGQSQ

SEQ ID NO: 371725 - protein, 9 aa, Homo Sapiens
SRPPTVRRD

SEQ ID NO: 371726 - protein, 9 aa, Homo Sapiens
QDEGWGPAP

SEQ ID NO: 371727 - protein, 9 aa, Homo Sapiens
PRAPACGLS

SEQ ID NO: 371728 - protein, 9 aa, Homo Sapiens
EKMVQVALD

SEQ ID NO: 371729 - protein, 9 aa, Homo Sapiens
ELFLLVSLA

SEQ ID NO: 371730 - protein, 9 aa, Homo Sapiens
AAGAALGQA

SEQ ID NO: 371731 - protein, 9 aa, Homo Sapiens
GVFQHDKVE

SEQ ID NO: 371732 - protein, 9 aa, Homo Sapiens
TNMPTEPAA

SEQ ID NO: 371733 - protein, 9 aa, Homo Sapiens
RDIWDFLCQ

SEQ ID NO: 371734 - protein, 9 aa, Homo Sapiens
LTVVTFTMH

SEQ ID NO: 371735 - protein, 9 aa, Homo Sapiens
PPSSASATS

SEQ ID NO: 371736 - protein, 9 aa, Homo Sapiens
AINVLSHLP

SEQ ID NO: 371737 - protein, 9 aa, Homo Sapiens
YFLFFGTRP

SEQ ID NO: 371738 - protein, 9 aa, Homo Sapiens
KEKIIVEQI

SEQ ID NO: 371739 - protein, 9 aa, Homo Sapiens
DKQNSRSAS

SEQ ID NO: 371740 - protein, 9 aa, Homo Sapiens
DIIKYLKEF

SEQ ID NO: 371741 - protein, 9 aa, Homo Sapiens
CLLDRSFAN

SEQ ID NO: 371742 - protein, 9 aa, Homo Sapiens
SVASFQMPG

SEQ ID NO: 371743 - protein, 9 aa, Homo Sapiens
LADEFTRLE

SEQ ID NO: 371744 - protein, 9 aa, Homo Sapiens
KQSSHSLRA

SEQ ID NO: 371745 - protein, 9 aa, Homo Sapiens
HEIMERSEA

SEQ ID NO: 371746 - protein, 9 aa, Homo Sapiens
KAVQYQVNQ

SEQ ID NO: 371747 - protein, 9 aa, Homo Sapiens
RWETPYMHT

SEQ ID NO: 371748 - protein, 9 aa, Homo Sapiens
PSAPGSARS

SEQ ID NO: 371749 - protein, 9 aa, Homo Sapiens
GERLGISIC

SEQ ID NO: 371750 - protein, 9 aa, Homo Sapiens
TQEPLYQCQ

SEQ ID NO: 371751 - protein, 9 aa, Homo Sapiens
LDDAIHVLW

SEQ ID NO: 371752 - protein, 9 aa, Homo Sapiens
LKTLNMIQV

SEQ ID NO: 371753 - protein, 9 aa, Homo Sapiens
VSTSSHLIL

SEQ ID NO: 371754 - protein, 9 aa, Homo Sapiens
SINSYTDIE

SEQ ID NO: 371755 - protein, 9 aa, Homo Sapiens
MQQYLKERE

SEQ ID NO: 371756 - protein, 9 aa, Homo Sapiens
STTEQAQRD

SEQ ID NO: 371757 - protein, 9 aa, Homo Sapiens
SRTRETLES

SEQ ID NO: 371758 - protein, 9 aa, Homo Sapiens
PCSSSVSSI

SEQ ID NO: 371759 - protein, 9 aa, Homo Sapiens
SSTKPSPSS

SEQ ID NO: 371760 - protein, 9 aa, Homo Sapiens
TLRFNGMRL

SEQ ID NO: 371761 - protein, 9 aa, Homo Sapiens
EQKATVIIM

SEQ ID NO: 371762 - protein, 9 aa, Homo Sapiens
GETFHALQP

SEQ ID NO: 371763 - protein, 9 aa, Homo Sapiens
PALSLRSLQ

SEQ ID NO: 371764 - protein, 9 aa, Homo Sapiens
DGLEKEKKD

SEQ ID NO: 371765 - protein, 9 aa, Homo Sapiens
TNSAGMRYS

SEQ ID NO: 371766 - protein, 9 aa, Homo Sapiens
FFVRRVNGT

SEQ ID NO: 371767 - protein, 9 aa, Homo Sapiens
QHQLITVTM

SEQ ID NO: 371768 - protein, 9 aa, Homo Sapiens
FQQDIKGLV

SEQ ID NO: 371769 - protein, 9 aa, Homo Sapiens
MQRFSRKAV

SEQ ID NO: 371770 - protein, 9 aa, Homo Sapiens
EREHHSCTP

SEQ ID NO: 371771 - protein, 9 aa, Homo Sapiens
AACQATVRE

SEQ ID NO: 371772 - protein, 9 aa, Homo Sapiens
ISSLCPQGL

SEQ ID NO: 371773 - protein, 9 aa, Homo Sapiens
KLSIKLHLL

SEQ ID NO: 371774 - protein, 9 aa, Homo Sapiens
SLGAPKKEK

SEQ ID NO: 371775 - protein, 9 aa, Homo Sapiens
AKPLDGPQI

SEQ ID NO: 371776 - protein, 9 aa, Homo Sapiens
SPPVMETLP

SEQ ID NO: 371777 - protein, 9 aa, Homo Sapiens
NILFPWKMS

SEQ ID NO: 371778 - protein, 9 aa, Homo Sapiens
ARSATVCLT

SEQ ID NO: 371779 - protein, 9 aa, Homo Sapiens
AEIQAGEEL

SEQ ID NO: 371780 - protein, 9 aa, Homo Sapiens
TARLNMFAK

SEQ ID NO: 371781 - protein, 9 aa, Homo Sapiens
SSTNRYSQP

SEQ ID NO: 371782 - protein, 9 aa, Homo Sapiens
LGHMWTYRE

SEQ ID NO: 371783 - protein, 9 aa, Homo Sapiens
AIIFNGCMT

SEQ ID NO: 371784 - protein, 9 aa, Homo Sapiens
GSEAEKTLG

SEQ ID NO: 371785 - protein, 9 aa, Homo Sapiens
ESIWLPGCP

SEQ ID NO: 371786 - protein, 9 aa, Homo Sapiens
LSWEYWQDF

SEQ ID NO: 371787 - protein, 9 aa, Homo Sapiens
LEGCISVKD

SEQ ID NO: 371788 - protein, 9 aa, Homo Sapiens
LARQMITKD

SEQ ID NO: 371789 - protein, 9 aa, Homo Sapiens
RAGAPAEGA

SEQ ID NO: 371790 - protein, 9 aa, Homo Sapiens
QRWIYCVDP

SEQ ID NO: 371791 - protein, 9 aa, Homo Sapiens
QGAEQQQHH

SEQ ID NO: 371792 - protein, 9 aa, Homo Sapiens
NGATSSTNR

SEQ ID NO: 371793 - protein, 9 aa, Homo Sapiens
SKRRCPFQK

SEQ ID NO: 371794 - protein, 9 aa, Homo Sapiens
LCGHRTFST

SEQ ID NO: 371795 - protein, 9 aa, Homo Sapiens
APEHKPLGT

SEQ ID NO: 371796 - protein, 9 aa, Homo Sapiens
DMFKWQIIQ

SEQ ID NO: 371797 - protein, 9 aa, Homo Sapiens
WETPYMHTL

SEQ ID NO: 371798 - protein, 9 aa, Homo Sapiens
RSHTSYESI

SEQ ID NO: 371799 - protein, 9 aa, Homo Sapiens
DCGSCCPGG

SEQ ID NO: 371800 - protein, 9 aa, Homo Sapiens
CYNRGQCVE

SEQ ID NO: 371801 - protein, 9 aa, Homo Sapiens
GLALCGIVS

SEQ ID NO: 371802 - protein, 9 aa, Homo Sapiens
SGPPTHRFQ

SEQ ID NO: 371803 - protein, 9 aa, Homo Sapiens
AEGEIRVCP

SEQ ID NO: 371804 - protein, 9 aa, Homo Sapiens
NASIDKILE

SEQ ID NO: 371805 - protein, 9 aa, Homo Sapiens
VASQKWGPL

SEQ ID NO: 371806 - protein, 9 aa, Homo Sapiens
NKDRDKEQE

SEQ ID NO: 371807 - protein, 9 aa, Homo Sapiens
PQPPQPQRR

SEQ ID NO: 371808 - protein, 9 aa, Homo Sapiens
VPPGEHCPS

SEQ ID NO: 371809 - protein, 9 aa, Homo Sapiens
RAEYILKNL

SEQ ID NO: 371810 - protein, 9 aa, Homo Sapiens
MTSRRASLW

SEQ ID NO: 371811 - protein, 9 aa, Homo Sapiens
FEEDSEDEQ

SEQ ID NO: 371812 - protein, 9 aa, Homo Sapiens
PIPSLMAER

SEQ ID NO: 371813 - protein, 9 aa, Homo Sapiens
VLTKANIAR

SEQ ID NO: 371814 - protein, 9 aa, Homo Sapiens
VTRGTSRAR

SEQ ID NO: 371815 - protein, 9 aa, Homo Sapiens
TRTMKSHQA

SEQ ID NO: 371816 - protein, 9 aa, Homo Sapiens
GAQAPPGPP

SEQ ID NO: 371817 - protein, 9 aa, Homo Sapiens
KAKNGRETI

SEQ ID NO: 371818 - protein, 9 aa, Homo Sapiens
EECGKSFND

SEQ ID NO: 371819 - protein, 9 aa, Homo Sapiens
ATEKSRWSG

SEQ ID NO: 371820 - protein, 9 aa, Homo Sapiens
ARRTVTETS

SEQ ID NO: 371821 - protein, 9 aa, Homo Sapiens
LGNLSPGVV

SEQ ID NO: 371822 - protein, 9 aa, Homo Sapiens
KKTLLKRMH

SEQ ID NO: 371823 - protein, 9 aa, Homo Sapiens
RLLCLHSLL

SEQ ID NO: 371824 - protein, 9 aa, Homo Sapiens
FTRFACFTW

SEQ ID NO: 371825 - protein, 9 aa, Homo Sapiens
VSRTKSPGP

SEQ ID NO: 371826 - protein, 9 aa, Homo Sapiens
DFRESCCCQ

SEQ ID NO: 371827 - protein, 9 aa, Homo Sapiens
CYEPVPADK

SEQ ID NO: 371828 - protein, 9 aa, Homo Sapiens
STAKNVKMK

SEQ ID NO: 371829 - protein, 9 aa, Homo Sapiens
KEPKLLMSI

SEQ ID NO: 371830 - protein, 9 aa, Homo Sapiens
VIENPAVFT

SEQ ID NO: 371831 - protein, 9 aa, Homo Sapiens
ESGGASRAL

SEQ ID NO: 371832 - protein, 9 aa, Homo Sapiens
RRRAVQGSP

SEQ ID NO: 371833 - protein, 9 aa, Homo Sapiens
CRGPLPCPL

SEQ ID NO: 371834 - protein, 9 aa, Homo Sapiens
PTVPPIFTG

SEQ ID NO: 371835 - protein, 9 aa, Homo Sapiens
PPPYHDTLY

SEQ ID NO: 371836 - protein, 9 aa, Homo Sapiens
HRRQRRSHM

SEQ ID NO: 371837 - protein, 9 aa, Homo Sapiens
DGIGSEAEK

SEQ ID NO: 371838 - protein, 9 aa, Homo Sapiens
DDIADPFFA

SEQ ID NO: 371839 - protein, 9 aa, Homo Sapiens
EFQPMEVQL

SEQ ID NO: 371840 - protein, 9 aa, Homo Sapiens
DSEDEQAAK

SEQ ID NO: 371841 - protein, 9 aa, Homo Sapiens
KKRSKAKVE

SEQ ID NO: 371842 - protein, 9 aa, Homo Sapiens
RSFFTSAHP

SEQ ID NO: 371843 - protein, 9 aa, Homo Sapiens
RAVQGSPER

SEQ ID NO: 371844 - protein, 9 aa, Homo Sapiens
VLRHRKNES

SEQ ID NO: 371845 - protein, 9 aa, Homo Sapiens
PPQPQRRGT

SEQ ID NO: 371846 - protein, 9 aa, Homo Sapiens
QPGRWCRLS

SEQ ID NO: 371847 - protein, 9 aa, Homo Sapiens
SANVGDPSK

SEQ ID NO: 371848 - protein, 9 aa, Homo Sapiens
ISLEKEIKS

SEQ ID NO: 371849 - protein, 9 aa, Homo Sapiens
RQEREHTPC

SEQ ID NO: 371850 - protein, 9 aa, Homo Sapiens
ISVKEEHVC

SEQ ID NO: 371851 - protein, 9 aa, Homo Sapiens
IQVCGPGAC

SEQ ID NO: 371852 - protein, 9 aa, Homo Sapiens
YTVKDIKAE

SEQ ID NO: 371853 - protein, 9 aa, Homo Sapiens
RAGARARQG

SEQ ID NO: 371854 - protein, 9 aa, Homo Sapiens
RPAGRCACS

SEQ ID NO: 371855 - protein, 9 aa, Homo Sapiens
MHEIFISDS

SEQ ID NO: 371856 - protein, 9 aa, Homo Sapiens
LGLAVPPRQ

SEQ ID NO: 371857 - protein, 9 aa, Homo Sapiens
YHAHPYQHL

SEQ ID NO: 371858 - protein, 9 aa, Homo Sapiens
LKSQISEII

SEQ ID NO: 371859 - protein, 9 aa, Homo Sapiens
RREELLKKC

SEQ ID NO: 371860 - protein, 9 aa, Homo Sapiens
QAFVPHPNG

SEQ ID NO: 371861 - protein, 9 aa, Homo Sapiens
SHRPPSSCW

SEQ ID NO: 371862 - protein, 9 aa, Homo Sapiens
CTRPRLTWC

SEQ ID NO: 371863 - protein, 9 aa, Homo Sapiens
RPPALSLRS

SEQ ID NO: 371864 - protein, 9 aa, Homo Sapiens
LRPHKTAHV

SEQ ID NO: 371865 - protein, 9 aa, Homo Sapiens
LFPQRRTFL

SEQ ID NO: 371866 - protein, 9 aa, Homo Sapiens
KITDMLLEI

SEQ ID NO: 371867 - protein, 9 aa, Homo Sapiens
QEHLKEKLD

SEQ ID NO: 371868 - protein, 9 aa, Homo Sapiens
AHIYSLFLS

SEQ ID NO: 371869 - protein, 9 aa, Homo Sapiens
SEQRLWHGG

SEQ ID NO: 371870 - protein, 9 aa, Homo Sapiens
KKITSERDF

SEQ ID NO: 371871 - protein, 9 aa, Homo Sapiens
GPARIPIPS

SEQ ID NO: 371872 - protein, 9 aa, Homo Sapiens
PINIELLLN

SEQ ID NO: 371873 - protein, 9 aa, Homo Sapiens
CRLGVEPAS

SEQ ID NO: 371874 - protein, 9 aa, Homo Sapiens
CLAKEGDPK

SEQ ID NO: 371875 - protein, 9 aa, Homo Sapiens
GLAVPPRQL

SEQ ID NO: 371876 - protein, 9 aa, Homo Sapiens
PRQRAAAPH

SEQ ID NO: 371877 - protein, 9 aa, Homo Sapiens
RACAATRPE

SEQ ID NO: 371878 - protein, 9 aa, Homo Sapiens
GGPGGPAGS

SEQ ID NO: 371879 - protein, 9 aa, Homo Sapiens
FVSGGGGLG

SEQ ID NO: 371880 - protein, 9 aa, Homo Sapiens
QAQRDLSSD

SEQ ID NO: 371881 - protein, 9 aa, Homo Sapiens
SLGGGPSCR

SEQ ID NO: 371882 - protein, 9 aa, Homo Sapiens
NNCYNRGQC

SEQ ID NO: 371883 - protein, 9 aa, Homo Sapiens
KGIQVCMKW

SEQ ID NO: 371884 - protein, 9 aa, Homo Sapiens
DYGLVKMHE

SEQ ID NO: 371885 - protein, 9 aa, Homo Sapiens
AGFGNSCIK

SEQ ID NO: 371886 - protein, 9 aa, Homo Sapiens
DMLAALKKE

SEQ ID NO: 371887 - protein, 9 aa, Homo Sapiens
LRLVDGSSR

SEQ ID NO: 371888 - protein, 9 aa, Homo Sapiens
RSSKKNKEK

SEQ ID NO: 371889 - protein, 9 aa, Homo Sapiens
SPQRRPPRW

SEQ ID NO: 371890 - protein, 9 aa, Homo Sapiens
IRVCPKKTT

SEQ ID NO: 371891 - protein, 9 aa, Homo Sapiens
TASSTRVPL

SEQ ID NO: 371892 - protein, 9 aa, Homo Sapiens
QPERGRVGG

SEQ ID NO: 371893 - protein, 9 aa, Homo Sapiens
ANQPRTESP

SEQ ID NO: 371894 - protein, 9 aa, Homo Sapiens
PKIFMHRNL

SEQ ID NO: 371895 - protein, 9 aa, Homo Sapiens
VDGLYKMDF

SEQ ID NO: 371896 - protein, 9 aa, Homo Sapiens
WLEKKCKEI

SEQ ID NO: 371897 - protein, 9 aa, Homo Sapiens
ALCGIVSTS

SEQ ID NO: 371898 - protein, 9 aa, Homo Sapiens
NMFAKPEAT

SEQ ID NO: 371899 - protein, 9 aa, Homo Sapiens
RRIIETPHT

SEQ ID NO: 371900 - protein, 9 aa, Homo Sapiens
SPASAPTRW

SEQ ID NO: 371901 - protein, 9 aa, Homo Sapiens
AGTNYSQMP

SEQ ID NO: 371902 - protein, 9 aa, Homo Sapiens
VCVVRGCSF

SEQ ID NO: 371903 - protein, 9 aa, Homo Sapiens
SQGGRILLQ

SEQ ID NO: 371904 - protein, 9 aa, Homo Sapiens
KPGAPPPAG

SEQ ID NO: 371905 - protein, 9 aa, Homo Sapiens
PLYQCQRCQ

SEQ ID NO: 371906 - protein, 9 aa, Homo Sapiens
RTPKIPPQL

SEQ ID NO: 371907 - protein, 9 aa, Homo Sapiens
TKYSVYLTK

SEQ ID NO: 371908 - protein, 9 aa, Homo Sapiens
CSVPVESGD

SEQ ID NO: 371909 - protein, 9 aa, Homo Sapiens
AMGGQASWS

SEQ ID NO: 371910 - protein, 9 aa, Homo Sapiens
QLRALVTPD

SEQ ID NO: 371911 - protein, 9 aa, Homo Sapiens
KKKKKLKKR

SEQ ID NO: 371912 - protein, 9 aa, Homo Sapiens
VCPKKTTKK

SEQ ID NO: 371913 - protein, 9 aa, Homo Sapiens
YGMRTKQLQ

SEQ ID NO: 371914 - protein, 9 aa, Homo Sapiens
VTLCEQCDV

SEQ ID NO: 371915 - protein, 9 aa, Homo Sapiens
SPLSRPGSG

SEQ ID NO: 371916 - protein, 9 aa, Homo Sapiens
NPFIYSQNS

SEQ ID NO: 371917 - protein, 9 aa, Homo Sapiens
AKSKNLLAW

SEQ ID NO: 371918 - protein, 9 aa, Homo Sapiens
KWEMECTDI

SEQ ID NO: 371919 - protein, 9 aa, Homo Sapiens
RFSRKAVYV

SEQ ID NO: 371920 - protein, 9 aa, Homo Sapiens
GPGQQALWQ

SEQ ID NO: 371921 - protein, 9 aa, Homo Sapiens
CLWEERLLG

SEQ ID NO: 371922 - protein, 9 aa, Homo Sapiens
STRSSSGRA

SEQ ID NO: 371923 - protein, 9 aa, Homo Sapiens
QRGLQVPQP

SEQ ID NO: 371924 - protein, 9 aa, Homo Sapiens
VFLRKHYLV

SEQ ID NO: 371925 - protein, 9 aa, Homo Sapiens
SSVLEWCRH

SEQ ID NO: 371926 - protein, 9 aa, Homo Sapiens
LSELALVHW

SEQ ID NO: 371927 - protein, 9 aa, Homo Sapiens
HMERKRREK

SEQ ID NO: 371928 - protein, 9 aa, Homo Sapiens
PLPLQPSRP

SEQ ID NO: 371929 - protein, 9 aa, Homo Sapiens
HVNQAVCDM

SEQ ID NO: 371930 - protein, 9 aa, Homo Sapiens
NCDRYSMGL

SEQ ID NO: 371931 - protein, 9 aa, Homo Sapiens
IQDDKVVAI

SEQ ID NO: 371932 - protein, 9 aa, Homo Sapiens
FLRISTATS

SEQ ID NO: 371933 - protein, 9 aa, Homo Sapiens
TMEAPQRWT

SEQ ID NO: 371934 - protein, 9 aa, Homo Sapiens
MLGCSIIVQ

SEQ ID NO: 371935 - protein, 9 aa, Homo Sapiens
GKSRRRRRK

SEQ ID NO: 371936 - protein, 9 aa, Homo Sapiens
RTEPEVPPR

SEQ ID NO: 371937 - protein, 9 aa, Homo Sapiens
VGGPGAGPR

SEQ ID NO: 371938 - protein, 9 aa, Homo Sapiens
HLHVSRLYR

SEQ ID NO: 371939 - protein, 9 aa, Homo Sapiens
FLKTRGQIL

SEQ ID NO: 371940 - protein, 9 aa, Homo Sapiens
RFFLVSITC

SEQ ID NO: 371941 - protein, 9 aa, Homo Sapiens
VELGHDGAR

SEQ ID NO: 371942 - protein, 9 aa, Homo Sapiens
GKKAIIFNG

SEQ ID NO: 371943 - protein, 9 aa, Homo Sapiens
KQNSRSASA

SEQ ID NO: 371944 - protein, 9 aa, Homo Sapiens
DVDMALDQC

SEQ ID NO: 371945 - protein, 9 aa, Homo Sapiens
GKPTSQLVN

SEQ ID NO: 371946 - protein, 9 aa, Homo Sapiens
KTLNMIQVL

SEQ ID NO: 371947 - protein, 9 aa, Homo Sapiens
HTYDRFLLG

SEQ ID NO: 371948 - protein, 9 aa, Homo Sapiens
RVVDLQTLS

SEQ ID NO: 371949 - protein, 9 aa, Homo Sapiens
YYSTANFVK

SEQ ID NO: 371950 - protein, 9 aa, Homo Sapiens
ILCLFVFFS

SEQ ID NO: 371951 - protein, 9 aa, Homo Sapiens
GDSMDSVSR

SEQ ID NO: 371952 - protein, 9 aa, Homo Sapiens
VLPLLRAGF

SEQ ID NO: 371953 - protein, 9 aa, Homo Sapiens
PTTPPTPAC

SEQ ID NO: 371954 - protein, 9 aa, Homo Sapiens
RVKMDATRA

SEQ ID NO: 371955 - protein, 9 aa, Homo Sapiens
PPPCVDEPE

SEQ ID NO: 371956 - protein, 9 aa, Homo Sapiens
LKHDLNSPG

SEQ ID NO: 371957 - protein, 9 aa, Homo Sapiens
GSDAYCLSV

SEQ ID NO: 371958 - protein, 9 aa, Homo Sapiens
RFCMISATF

SEQ ID NO: 371959 - protein, 9 aa, Homo Sapiens
LLQSCILST

SEQ ID NO: 371960 - protein, 9 aa, Homo Sapiens
EALSIGPAL

SEQ ID NO: 371961 - protein, 9 aa, Homo Sapiens
QAQLPQASS

SEQ ID NO: 371962 - protein, 9 aa, Homo Sapiens
PVLLEASIN

SEQ ID NO: 371963 - protein, 9 aa, Homo Sapiens
LQNIGCSVS

SEQ ID NO: 371964 - protein, 9 aa, Homo Sapiens
SATFSANKL

SEQ ID NO: 371965 - protein, 9 aa, Homo Sapiens
VLGLLCMQL

SEQ ID NO: 371966 - protein, 9 aa, Homo Sapiens
CQVSGMPAM

SEQ ID NO: 371967 - protein, 9 aa, Homo Sapiens
HENANIVFQ

SEQ ID NO: 371968 - protein, 9 aa, Homo Sapiens
VRMAMVPGA

SEQ ID NO: 371969 - protein, 9 aa, Homo Sapiens
ANINESTPY

SEQ ID NO: 371970 - protein, 9 aa, Homo Sapiens
ICSLADIIK

SEQ ID NO: 371971 - protein, 9 aa, Homo Sapiens
YIGNVVRNI

SEQ ID NO: 371972 - protein, 9 aa, Homo Sapiens
AGPAATSSL

SEQ ID NO: 371973 - protein, 9 aa, Homo Sapiens
SSPPSSASA

SEQ ID NO: 371974 - protein, 9 aa, Homo Sapiens
PTRRLLVVG

SEQ ID NO: 371975 - protein, 9 aa, Homo Sapiens
GPAGSGGAC

SEQ ID NO: 371976 - protein, 9 aa, Homo Sapiens
EWSLLIEDG

SEQ ID NO: 371977 - protein, 9 aa, Homo Sapiens
TEELAVADN

SEQ ID NO: 371978 - protein, 9 aa, Homo Sapiens
APTRRLLVV

SEQ ID NO: 371979 - protein, 9 aa, Homo Sapiens
NAKLQQHQL

SEQ ID NO: 371980 - protein, 9 aa, Homo Sapiens
PTAVTPRRS

SEQ ID NO: 371981 - protein, 9 aa, Homo Sapiens
AFNSLQLKV

SEQ ID NO: 371982 - protein, 9 aa, Homo Sapiens
NKPLYFADK

SEQ ID NO: 371983 - protein, 9 aa, Homo Sapiens
LVHWLQESR

SEQ ID NO: 371984 - protein, 9 aa, Homo Sapiens
GRPGMEHIS

SEQ ID NO: 371985 - protein, 9 aa, Homo Sapiens
ETFAFQTEI

SEQ ID NO: 371986 - protein, 9 aa, Homo Sapiens
RPSPSHGSM

SEQ ID NO: 371987 - protein, 9 aa, Homo Sapiens
QRRSHMLEE

SEQ ID NO: 371988 - protein, 9 aa, Homo Sapiens
RKCRKCYEP

SEQ ID NO: 371989 - protein, 9 aa, Homo Sapiens
VQSDTCRSV

SEQ ID NO: 371990 - protein, 9 aa, Homo Sapiens
TRMLHLQDN

SEQ ID NO: 371991 - protein, 9 aa, Homo Sapiens
LSGEALSIG

SEQ ID NO: 371992 - protein, 9 aa, Homo Sapiens
VIWIYRSAL

SEQ ID NO: 371993 - protein, 9 aa, Homo Sapiens
NSWSTWLSL

SEQ ID NO: 371994 - protein, 9 aa, Homo Sapiens
YQFYHEDTP

SEQ ID NO: 371995 - protein, 9 aa, Homo Sapiens
HDKKAVSRS

SEQ ID NO: 371996 - protein, 9 aa, Homo Sapiens
QCCIIFSHF

SEQ ID NO: 371997 - protein, 9 aa, Homo Sapiens
PNSAGIQEM

SEQ ID NO: 371998 - protein, 9 aa, Homo Sapiens
CFRHAPPPR

SEQ ID NO: 371999 - protein, 9 aa, Homo Sapiens
TSSTNRYSQ

SEQ ID NO: 372000 - protein, 9 aa, Homo Sapiens
TNGASQTTD

SEQ ID NO: 372001 - protein, 9 aa, Homo Sapiens
HGGVKRISG

SEQ ID NO: 372002 - protein, 9 aa, Homo Sapiens
FSANKLLQN

SEQ ID NO: 372003 - protein, 9 aa, Homo Sapiens
PHRTPWPLP

SEQ ID NO: 372004 - protein, 9 aa, Homo Sapiens
NPPVLTQAV

SEQ ID NO: 372005 - protein, 9 aa, Homo Sapiens
MDNDCEVLG

SEQ ID NO: 372006 - protein, 9 aa, Homo Sapiens
SVSHFSDLD

SEQ ID NO: 372007 - protein, 9 aa, Homo Sapiens
EESKALNVN

SEQ ID NO: 372008 - protein, 9 aa, Homo Sapiens
HTKDYPHWC

SEQ ID NO: 372009 - protein, 9 aa, Homo Sapiens
PRTLEGCIS

SEQ ID NO: 372010 - protein, 9 aa, Homo Sapiens
CLLTVERDP

SEQ ID NO: 372011 - protein, 9 aa, Homo Sapiens
FGTSITSVT

SEQ ID NO: 372012 - protein, 9 aa, Homo Sapiens
TPLWSSSTP

SEQ ID NO: 372013 - protein, 9 aa, Homo Sapiens
EELLKKCSL

SEQ ID NO: 372014 - protein, 9 aa, Homo Sapiens
INQVFLRCH

SEQ ID NO: 372015 - protein, 9 aa, Homo Sapiens
YGVCAHFPA

SEQ ID NO: 372016 - protein, 9 aa, Homo Sapiens
ENANIVFQY

SEQ ID NO: 372017 - protein, 9 aa, Homo Sapiens
NFRKPQEIY

SEQ ID NO: 372018 - protein, 9 aa, Homo Sapiens
PEVDGDQDA

SEQ ID NO: 372019 - protein, 9 aa, Homo Sapiens
EHVCLPNSK

SEQ ID NO: 372020 - protein, 9 aa, Homo Sapiens
AKTLCHMPV

SEQ ID NO: 372021 - protein, 9 aa, Homo Sapiens
PGQQALWQG

SEQ ID NO: 372022 - protein, 9 aa, Homo Sapiens
VVVGHGSRM

SEQ ID NO: 372023 - protein, 9 aa, Homo Sapiens
STSFCLAPK

SEQ ID NO: 372024 - protein, 9 aa, Homo Sapiens
NTSLFLASV

SEQ ID NO: 372025 - protein, 9 aa, Homo Sapiens
QRDLSSDER

SEQ ID NO: 372026 - protein, 9 aa, Homo Sapiens
VENFYLMTN

SEQ ID NO: 372027 - protein, 9 aa, Homo Sapiens
DVTSTMPQQ

SEQ ID NO: 372028 - protein, 9 aa, Homo Sapiens
CDWLATCTP

SEQ ID NO: 372029 - protein, 9 aa, Homo Sapiens
VTDLFPVLS

SEQ ID NO: 372030 - protein, 9 aa, Homo Sapiens
RPVYVPVPK

SEQ ID NO: 372031 - protein, 9 aa, Homo Sapiens
GQGCVPEQL

SEQ ID NO: 372032 - protein, 9 aa, Homo Sapiens
TTAGAGVPF

SEQ ID NO: 372033 - protein, 9 aa, Homo Sapiens
GRGQQDQQT

SEQ ID NO: 372034 - protein, 9 aa, Homo Sapiens
PWRALGPPA

SEQ ID NO: 372035 - protein, 9 aa, Homo Sapiens
SGTVLRLSP

SEQ ID NO: 372036 - protein, 9 aa, Homo Sapiens
CVTCFRAAL

SEQ ID NO: 372037 - protein, 9 aa, Homo Sapiens
TRGTSRARR

SEQ ID NO: 372038 - protein, 9 aa, Homo Sapiens
ILHPEIIEC

SEQ ID NO: 372039 - protein, 9 aa, Homo Sapiens
SAADFSHYE

SEQ ID NO: 372040 - protein, 9 aa, Homo Sapiens
QHRHTHTGE

SEQ ID NO: 372041 - protein, 9 aa, Homo Sapiens
KKKSYRLVL

SEQ ID NO: 372042 - protein, 9 aa, Homo Sapiens
CVPPGEHCP

SEQ ID NO: 372043 - protein, 9 aa, Homo Sapiens
TKVSRTKSP

SEQ ID NO: 372044 - protein, 9 aa, Homo Sapiens
LRRTRALRG

SEQ ID NO: 372045 - protein, 9 aa, Homo Sapiens
VVVHEVPHA

SEQ ID NO: 372046 - protein, 9 aa, Homo Sapiens
LFQKKDYVQ

SEQ ID NO: 372047 - protein, 9 aa, Homo Sapiens
CHQSPTLLK

SEQ ID NO: 372048 - protein, 9 aa, Homo Sapiens
QNSAGLRRK

SEQ ID NO: 372049 - protein, 9 aa, Homo Sapiens
TGKVWDEVN

SEQ ID NO: 372050 - protein, 9 aa, Homo Sapiens
LDCIFGVEE

SEQ ID NO: 372051 - protein, 9 aa, Homo Sapiens
PTVGLCLEY

SEQ ID NO: 372052 - protein, 9 aa, Homo Sapiens
TTFTRHSLK

SEQ ID NO: 372053 - protein, 9 aa, Homo Sapiens
PQQPVAQWH

SEQ ID NO: 372054 - protein, 9 aa, Homo Sapiens
LPPWAVYTA

SEQ ID NO: 372055 - protein, 9 aa, Homo Sapiens
MSGVHCTGT

SEQ ID NO: 372056 - protein, 9 aa, Homo Sapiens
WTKLEYARG

SEQ ID NO: 372057 - protein, 9 aa, Homo Sapiens
IPMLLHVRK

SEQ ID NO: 372058 - protein, 9 aa, Homo Sapiens
QTPAKPTKG

SEQ ID NO: 372059 - protein, 9 aa, Homo Sapiens
QAVTNNCQK

SEQ ID NO: 372060 - protein, 9 aa, Homo Sapiens
MMKEKASHG

SEQ ID NO: 372061 - protein, 9 aa, Homo Sapiens
TRLAAFIGS

SEQ ID NO: 372062 - protein, 9 aa, Homo Sapiens
GRHQWHPDP

SEQ ID NO: 372063 - protein, 9 aa, Homo Sapiens
VGTWEFNAL

SEQ ID NO: 372064 - protein, 9 aa, Homo Sapiens
YAVSLVNII

SEQ ID NO: 372065 - protein, 9 aa, Homo Sapiens
TEKQEEDRV

SEQ ID NO: 372066 - protein, 9 aa, Homo Sapiens
LTLLQESCL

SEQ ID NO: 372067 - protein, 9 aa, Homo Sapiens
GDCGSCCPG

SEQ ID NO: 372068 - protein, 9 aa, Homo Sapiens
VLLKTKVYF

SEQ ID NO: 372069 - protein, 9 aa, Homo Sapiens
LQLKAVVDS

SEQ ID NO: 372070 - protein, 9 aa, Homo Sapiens
TSARPSPSH

SEQ ID NO: 372071 - protein, 9 aa, Homo Sapiens
QQVSQKKLS

SEQ ID NO: 372072 - protein, 9 aa, Homo Sapiens
QQQLAGNGG

SEQ ID NO: 372073 - protein, 9 aa, Homo Sapiens
EMECTDITM

SEQ ID NO: 372074 - protein, 9 aa, Homo Sapiens
CFRSNSNHR

SEQ ID NO: 372075 - protein, 9 aa, Homo Sapiens
GGAAQLNVF

SEQ ID NO: 372076 - protein, 9 aa, Homo Sapiens
DLRDGCMLI

SEQ ID NO: 372077 - protein, 9 aa, Homo Sapiens
WKAGSVQLH

SEQ ID NO: 372078 - protein, 9 aa, Homo Sapiens
SVTLRPWKT

SEQ ID NO: 372079 - protein, 9 aa, Homo Sapiens
GLPGGLKLS

SEQ ID NO: 372080 - protein, 9 aa, Homo Sapiens
LKLKSPMRL

SEQ ID NO: 372081 - protein, 9 aa, Homo Sapiens
EVLKKILPN

SEQ ID NO: 372082 - protein, 9 aa, Homo Sapiens
NSENPELWA

SEQ ID NO: 372083 - protein, 9 aa, Homo Sapiens
KLVCMVKIM

SEQ ID NO: 372084 - protein, 9 aa, Homo Sapiens
DKIVVVVWD

SEQ ID NO: 372085 - protein, 9 aa, Homo Sapiens
EHTPCAETP

SEQ ID NO: 372086 - protein, 9 aa, Homo Sapiens
PDDKNLCNK

SEQ ID NO: 372087 - protein, 9 aa, Homo Sapiens
GGHPQPRPS

SEQ ID NO: 372088 - protein, 9 aa, Homo Sapiens
LESLQLKAV

SEQ ID NO: 372089 - protein, 9 aa, Homo Sapiens
VQAATTLLS

SEQ ID NO: 372090 - protein, 9 aa, Homo Sapiens
TDTPVSKFM

SEQ ID NO: 372091 - protein, 9 aa, Homo Sapiens
GFETELSPV

SEQ ID NO: 372092 - protein, 9 aa, Homo Sapiens
EEALERYGK

SEQ ID NO: 372093 - protein, 9 aa, Homo Sapiens
ATRFYRTWP

SEQ ID NO: 372094 - protein, 9 aa, Homo Sapiens
ISTFGTSIT

SEQ ID NO: 372095 - protein, 9 aa, Homo Sapiens
TYLFKQLSC

SEQ ID NO: 372096 - protein, 9 aa, Homo Sapiens
PSNGGHVVA

SEQ ID NO: 372097 - protein, 9 aa, Homo Sapiens
KVVAILGKG

SEQ ID NO: 372098 - protein, 9 aa, Homo Sapiens
PTYLISEAM

SEQ ID NO: 372099 - protein, 9 aa, Homo Sapiens
YLPLYHEIM

SEQ ID NO: 372100 - protein, 9 aa, Homo Sapiens
EGMDHLVQQ

SEQ ID NO: 372101 - protein, 9 aa, Homo Sapiens
KITSERDFH

SEQ ID NO: 372102 - protein, 9 aa, Homo Sapiens
KDYVPPKDL

SEQ ID NO: 372103 - protein, 9 aa, Homo Sapiens
GCQHCVQRC

SEQ ID NO: 372104 - protein, 9 aa, Homo Sapiens
GRNKWITEE

SEQ ID NO: 372105 - protein, 9 aa, Homo Sapiens
STSRSSARS

SEQ ID NO: 372106 - protein, 9 aa, Homo Sapiens
PTGGWGCYR

SEQ ID NO: 372107 - protein, 9 aa, Homo Sapiens
APGFQTFVT

SEQ ID NO: 372108 - protein, 9 aa, Homo Sapiens
SNFGLIFLT

SEQ ID NO: 372109 - protein, 9 aa, Homo Sapiens
ILWTKLEYA

SEQ ID NO: 372110 - protein, 9 aa, Homo Sapiens
EPTIGSIMG

SEQ ID NO: 372111 - protein, 9 aa, Homo Sapiens
NLATDDYAV

SEQ ID NO: 372112 - protein, 9 aa, Homo Sapiens
VEGLMAADV

SEQ ID NO: 372113 - protein, 9 aa, Homo Sapiens
MTGDEASTI

SEQ ID NO: 372114 - protein, 9 aa, Homo Sapiens
VAAGDQGRF

SEQ ID NO: 372115 - protein, 9 aa, Homo Sapiens
HAPGTACVF

SEQ ID NO: 372116 - protein, 9 aa, Homo Sapiens
IRAPGSRGG

SEQ ID NO: 372117 - protein, 9 aa, Homo Sapiens
NLTQKLAQQ

SEQ ID NO: 372118 - protein, 9 aa, Homo Sapiens
KASRAGGTR

SEQ ID NO: 372119 - protein, 9 aa, Homo Sapiens
ALPTAVTPR

SEQ ID NO: 372120 - protein, 9 aa, Homo Sapiens
PKHCELVVD

SEQ ID NO: 372121 - protein, 9 aa, Homo Sapiens
LDGAWLLAL

SEQ ID NO: 372122 - protein, 9 aa, Homo Sapiens
CRNEHAMIG

SEQ ID NO: 372123 - protein, 9 aa, Homo Sapiens
GKILEMDDH

SEQ ID NO: 372124 - protein, 9 aa, Homo Sapiens
LRLSPSGSS

SEQ ID NO: 372125 - protein, 9 aa, Homo Sapiens
VHVIQQVKT

SEQ ID NO: 372126 - protein, 9 aa, Homo Sapiens
LTEDKKNGI

SEQ ID NO: 372127 - protein, 9 aa, Homo Sapiens
VNCRNEHAM

SEQ ID NO: 372128 - protein, 9 aa, Homo Sapiens
SLEVIQDDK

SEQ ID NO: 372129 - protein, 9 aa, Homo Sapiens
RKSKGKKRR

SEQ ID NO: 372130 - protein, 9 aa, Homo Sapiens
STATPDRTH

SEQ ID NO: 372131 - protein, 9 aa, Homo Sapiens
KPLYFADKL

SEQ ID NO: 372132 - protein, 9 aa, Homo Sapiens
LALRAWWLP

SEQ ID NO: 372133 - protein, 9 aa, Homo Sapiens
AQAEAAREK

SEQ ID NO: 372134 - protein, 9 aa, Homo Sapiens
DAAELPHEC

SEQ ID NO: 372135 - protein, 9 aa, Homo Sapiens
QLPIDWDIL

SEQ ID NO: 372136 - protein, 9 aa, Homo Sapiens
AEGEELVVP

SEQ ID NO: 372137 - protein, 9 aa, Homo Sapiens
HHRPWLHAY

SEQ ID NO: 372138 - protein, 9 aa, Homo Sapiens
SCSTKKRTT

SEQ ID NO: 372139 - protein, 9 aa, Homo Sapiens
RGKPCLKIQ

SEQ ID NO: 372140 - protein, 9 aa, Homo Sapiens
NQEHLKEKL

SEQ ID NO: 372141 - protein, 9 aa, Homo Sapiens
RQQYQRDTQ

SEQ ID NO: 372142 - protein, 9 aa, Homo Sapiens
QRAKELNKQ

SEQ ID NO: 372143 - protein, 9 aa, Homo Sapiens
MRNHENSSP

SEQ ID NO: 372144 - protein, 9 aa, Homo Sapiens
MSWWPQPCC

SEQ ID NO: 372145 - protein, 9 aa, Homo Sapiens
VLSGLELAI

SEQ ID NO: 372146 - protein, 9 aa, Homo Sapiens
VYYSTANFV

SEQ ID NO: 372147 - protein, 9 aa, Homo Sapiens
YPELLADEF

SEQ ID NO: 372148 - protein, 9 aa, Homo Sapiens
YWMVGSPQR

SEQ ID NO: 372149 - protein, 9 aa, Homo Sapiens
VEVNCRNEH

SEQ ID NO: 372150 - protein, 9 aa, Homo Sapiens
LCWSTVAQT

SEQ ID NO: 372151 - protein, 9 aa, Homo Sapiens
ALVILTVLT

SEQ ID NO: 372152 - protein, 9 aa, Homo Sapiens
HATNCATHA

SEQ ID NO: 372153 - protein, 9 aa, Homo Sapiens
RPPSASSPV

SEQ ID NO: 372154 - protein, 9 aa, Homo Sapiens
TRIWQGCSA

SEQ ID NO: 372155 - protein, 9 aa, Homo Sapiens
HDSMDNDCE

SEQ ID NO: 372156 - protein, 9 aa, Homo Sapiens
HLLIKGHQV

SEQ ID NO: 372157 - protein, 9 aa, Homo Sapiens
PGETGLLPE

SEQ ID NO: 372158 - protein, 9 aa, Homo Sapiens
PPSSSDGSS

SEQ ID NO: 372159 - protein, 9 aa, Homo Sapiens
IVRCLALLA

SEQ ID NO: 372160 - protein, 9 aa, Homo Sapiens
TLILVEVSS

SEQ ID NO: 372161 - protein, 9 aa, Homo Sapiens
PCPSSKWTR

SEQ ID NO: 372162 - protein, 9 aa, Homo Sapiens
KHPLKIVLL

SEQ ID NO: 372163 - protein, 9 aa, Homo Sapiens
LVLLSGLLF

SEQ ID NO: 372164 - protein, 9 aa, Homo Sapiens
PGIQNNRNV

SEQ ID NO: 372165 - protein, 9 aa, Homo Sapiens
IRESVMREW

SEQ ID NO: 372166 - protein, 9 aa, Homo Sapiens
STPTDSLVC

SEQ ID NO: 372167 - protein, 9 aa, Homo Sapiens
SMASLCWST

SEQ ID NO: 372168 - protein, 9 aa, Homo Sapiens
EEEELDASN

SEQ ID NO: 372169 - protein, 9 aa, Homo Sapiens
DMYERVVLR

SEQ ID NO: 372170 - protein, 9 aa, Homo Sapiens
FLLVSLAMF

SEQ ID NO: 372171 - protein, 9 aa, Homo Sapiens
QKENECLGN

SEQ ID NO: 372172 - protein, 9 aa, Homo Sapiens
LEEKDSNAG

SEQ ID NO: 372173 - protein, 9 aa, Homo Sapiens
LSQALQAVL

SEQ ID NO: 372174 - protein, 9 aa, Homo Sapiens
HIKKFLDKL

SEQ ID NO: 372175 - protein, 9 aa, Homo Sapiens
ESRMEIAKQ

SEQ ID NO: 372176 - protein, 9 aa, Homo Sapiens
WLSLWSHRP

SEQ ID NO: 372177 - protein, 9 aa, Homo Sapiens
GSNCCNLNS

SEQ ID NO: 372178 - protein, 9 aa, Homo Sapiens
KAMQLEQMK

SEQ ID NO: 372179 - protein, 9 aa, Homo Sapiens
SRCRKCRKC

SEQ ID NO: 372180 - protein, 9 aa, Homo Sapiens
RAGSGRAAA

SEQ ID NO: 372181 - protein, 9 aa, Homo Sapiens
SNSLNHVKS

SEQ ID NO: 372182 - protein, 9 aa, Homo Sapiens
ATVRETKSQ

SEQ ID NO: 372183 - protein, 9 aa, Homo Sapiens
ATLLWGLTK

SEQ ID NO: 372184 - protein, 9 aa, Homo Sapiens
VCLKFHTSR

SEQ ID NO: 372185 - protein, 9 aa, Homo Sapiens
IRMVAAGAL

SEQ ID NO: 372186 - protein, 9 aa, Homo Sapiens
GPWRGQPGP

SEQ ID NO: 372187 - protein, 9 aa, Homo Sapiens
ISTATSDGK

SEQ ID NO: 372188 - protein, 9 aa, Homo Sapiens
NERLKEHDP

SEQ ID NO: 372189 - protein, 9 aa, Homo Sapiens
LVINMRVCG

SEQ ID NO: 372190 - protein, 9 aa, Homo Sapiens
GSARSASAL

SEQ ID NO: 372191 - protein, 9 aa, Homo Sapiens
HKWELLGSP

SEQ ID NO: 372192 - protein, 9 aa, Homo Sapiens
IKCFLTMNL

SEQ ID NO: 372193 - protein, 9 aa, Homo Sapiens
FQSMQSVFN

SEQ ID NO: 372194 - protein, 9 aa, Homo Sapiens
LHPEIIECR

SEQ ID NO: 372195 - protein, 9 aa, Homo Sapiens
EAEGEIRVC

SEQ ID NO: 372196 - protein, 9 aa, Homo Sapiens
GFLHDRELQ

SEQ ID NO: 372197 - protein, 9 aa, Homo Sapiens
WKGPQEEPT

SEQ ID NO: 372198 - protein, 9 aa, Homo Sapiens
SQQEGGSLQ

SEQ ID NO: 372199 - protein, 9 aa, Homo Sapiens
TPEKRAKKI

SEQ ID NO: 372200 - protein, 9 aa, Homo Sapiens
KKATNIIAK

SEQ ID NO: 372201 - protein, 9 aa, Homo Sapiens
CCQYEMGEC

SEQ ID NO: 372202 - protein, 9 aa, Homo Sapiens
VWNPTRMLQ

SEQ ID NO: 372203 - protein, 9 aa, Homo Sapiens
AATTLLSDA

SEQ ID NO: 372204 - protein, 9 aa, Homo Sapiens
MEPLIMDTG

SEQ ID NO: 372205 - protein, 9 aa, Homo Sapiens
SVFTLKKGR

SEQ ID NO: 372206 - protein, 9 aa, Homo Sapiens
FCAKIRILS

SEQ ID NO: 372207 - protein, 9 aa, Homo Sapiens
EGEIRVCPK

SEQ ID NO: 372208 - protein, 9 aa, Homo Sapiens
GQKRPFKKW

SEQ ID NO: 372209 - protein, 9 aa, Homo Sapiens
AGSGRAAAA

SEQ ID NO: 372210 - protein, 9 aa, Homo Sapiens
AQWCEQMLH

SEQ ID NO: 372211 - protein, 9 aa, Homo Sapiens
STSDRQHTT

SEQ ID NO: 372212 - protein, 9 aa, Homo Sapiens
KPLNPPIKN

SEQ ID NO: 372213 - protein, 9 aa, Homo Sapiens
RAPWRTSTP

SEQ ID NO: 372214 - protein, 9 aa, Homo Sapiens
PRKTAATTA

SEQ ID NO: 372215 - protein, 9 aa, Homo Sapiens
MDRVYDKPR

SEQ ID NO: 372216 - protein, 9 aa, Homo Sapiens
DAIFARRAI

SEQ ID NO: 372217 - protein, 9 aa, Homo Sapiens
HPFSPTVGL

SEQ ID NO: 372218 - protein, 9 aa, Homo Sapiens
LWSHRPPSS

SEQ ID NO: 372219 - protein, 9 aa, Homo Sapiens
EASVLPLLR

SEQ ID NO: 372220 - protein, 9 aa, Homo Sapiens
TRPLFVEST

SEQ ID NO: 372221 - protein, 9 aa, Homo Sapiens
YLEISHQLI

SEQ ID NO: 372222 - protein, 9 aa, Homo Sapiens
PEKRFGHIQ

SEQ ID NO: 372223 - protein, 9 aa, Homo Sapiens
VKNKPLYFA

SEQ ID NO: 372224 - protein, 9 aa, Homo Sapiens
RIPPQRAGS

SEQ ID NO: 372225 - protein, 9 aa, Homo Sapiens
INMRVCGFP

SEQ ID NO: 372226 - protein, 9 aa, Homo Sapiens
WNPLRRTRA

SEQ ID NO: 372227 - protein, 9 aa, Homo Sapiens
SLTIIFNFL

SEQ ID NO: 372228 - protein, 9 aa, Homo Sapiens
LGGSRGLRL

SEQ ID NO: 372229 - protein, 9 aa, Homo Sapiens
AATKERTEP

SEQ ID NO: 372230 - protein, 9 aa, Homo Sapiens
FYDVVHVVE

SEQ ID NO: 372231 - protein, 9 aa, Homo Sapiens
SEFTRRPTM

SEQ ID NO: 372232 - protein, 9 aa, Homo Sapiens
PSWSPDISG

SEQ ID NO: 372233 - protein, 9 aa, Homo Sapiens
VTLHLFPGK

SEQ ID NO: 372234 - protein, 9 aa, Homo Sapiens
TDPTNAATA

SEQ ID NO: 372235 - protein, 9 aa, Homo Sapiens
QVKTNNSEK

SEQ ID NO: 372236 - protein, 9 aa, Homo Sapiens
SLSLSRIKK

SEQ ID NO: 372237 - protein, 9 aa, Homo Sapiens
FSRIVQISA

SEQ ID NO: 372238 - protein, 9 aa, Homo Sapiens
KTLLKRMHF

SEQ ID NO: 372239 - protein, 9 aa, Homo Sapiens
IYVNGRMRN

SEQ ID NO: 372240 - protein, 9 aa, Homo Sapiens
FFVSRAPKH

SEQ ID NO: 372241 - protein, 9 aa, Homo Sapiens
RHVSLRICI

SEQ ID NO: 372242 - protein, 9 aa, Homo Sapiens
QYHTSAERM

SEQ ID NO: 372243 - protein, 9 aa, Homo Sapiens
LLHHDPLGK

SEQ ID NO: 372244 - protein, 9 aa, Homo Sapiens
GHLPKILYL

SEQ ID NO: 372245 - protein, 9 aa, Homo Sapiens
YTCSMTSTW

SEQ ID NO: 372246 - protein, 9 aa, Homo Sapiens
RPDCTSLAE

SEQ ID NO: 372247 - protein, 9 aa, Homo Sapiens
NLDVTSTMP

SEQ ID NO: 372248 - protein, 9 aa, Homo Sapiens
CIVQHVGLA

SEQ ID NO: 372249 - protein, 9 aa, Homo Sapiens
EGLRGQGGD

SEQ ID NO: 372250 - protein, 9 aa, Homo Sapiens
RSSVTGIFG

SEQ ID NO: 372251 - protein, 9 aa, Homo Sapiens
ICRTGSHAP

SEQ ID NO: 372252 - protein, 9 aa, Homo Sapiens
WRISNAENK

SEQ ID NO: 372253 - protein, 9 aa, Homo Sapiens
PPPRMAARY

SEQ ID NO: 372254 - protein, 9 aa, Homo Sapiens
GQERAVEDV

SEQ ID NO: 372255 - protein, 9 aa, Homo Sapiens
WQSSTLAHF

SEQ ID NO: 372256 - protein, 9 aa, Homo Sapiens
KMEEIMKKA

SEQ ID NO: 372257 - protein, 9 aa, Homo Sapiens
AVGGPWATG

SEQ ID NO: 372258 - protein, 9 aa, Homo Sapiens
NCLQQFWVY

SEQ ID NO: 372259 - protein, 9 aa, Homo Sapiens
HSSGLALCG

SEQ ID NO: 372260 - protein, 9 aa, Homo Sapiens
SSPGERHRS

SEQ ID NO: 372261 - protein, 9 aa, Homo Sapiens
PTVRRDGGE

SEQ ID NO: 372262 - protein, 9 aa, Homo Sapiens
ARQMITKDK

SEQ ID NO: 372263 - protein, 9 aa, Homo Sapiens
AFALCLLWE

SEQ ID NO: 372264 - protein, 9 aa, Homo Sapiens
IAFSTSITR

SEQ ID NO: 372265 - protein, 9 aa, Homo Sapiens
DKAIELLKR

SEQ ID NO: 372266 - protein, 9 aa, Homo Sapiens
PSLPPCSIP

SEQ ID NO: 372267 - protein, 9 aa, Homo Sapiens
SPSGSSYRC

SEQ ID NO: 372268 - protein, 9 aa, Homo Sapiens
MLHLQDNQI

SEQ ID NO: 372269 - protein, 9 aa, Homo Sapiens
LFDIETCHR

SEQ ID NO: 372270 - protein, 9 aa, Homo Sapiens
IVQHVGLAQ

SEQ ID NO: 372271 - protein, 9 aa, Homo Sapiens
LHQRADPVY

SEQ ID NO: 372272 - protein, 9 aa, Homo Sapiens
LWKEVAKHW

SEQ ID NO: 372273 - protein, 9 aa, Homo Sapiens
LKVFPKHYR

SEQ ID NO: 372274 - protein, 9 aa, Homo Sapiens
RLTWCPWAS

SEQ ID NO: 372275 - protein, 9 aa, Homo Sapiens
GGADRGCGP

SEQ ID NO: 372276 - protein, 9 aa, Homo Sapiens
SSCWSPRPP

SEQ ID NO: 372277 - protein, 9 aa, Homo Sapiens
LTSTSDRQH

SEQ ID NO: 372278 - protein, 9 aa, Homo Sapiens
AGIPSIAAY

SEQ ID NO: 372279 - protein, 9 aa, Homo Sapiens
ATYQAFPRC

SEQ ID NO: 372280 - protein, 9 aa, Homo Sapiens
NEHAMIGNN

SEQ ID NO: 372281 - protein, 9 aa, Homo Sapiens
ILDRKKKSR

SEQ ID NO: 372282 - protein, 9 aa, Homo Sapiens
WMEMRCMYG

SEQ ID NO: 372283 - protein, 9 aa, Homo Sapiens
RALVTPDPA

SEQ ID NO: 372284 - protein, 9 aa, Homo Sapiens
ASAEIQAGE

SEQ ID NO: 372285 - protein, 9 aa, Homo Sapiens
AIHVLWNHA

SEQ ID NO: 372286 - protein, 9 aa, Homo Sapiens
PVICSLADI

SEQ ID NO: 372287 - protein, 9 aa, Homo Sapiens
VEEKQPLVS

SEQ ID NO: 372288 - protein, 9 aa, Homo Sapiens
LKKKKTRFL

SEQ ID NO: 372289 - protein, 9 aa, Homo Sapiens
LNGAINHVL

SEQ ID NO: 372290 - protein, 9 aa, Homo Sapiens
AGWAARWQR

SEQ ID NO: 372291 - protein, 9 aa, Homo Sapiens
FCLAPKRPL

SEQ ID NO: 372292 - protein, 9 aa, Homo Sapiens
EIIECRVFK

SEQ ID NO: 372293 - protein, 9 aa, Homo Sapiens
RSSPGERHR

SEQ ID NO: 372294 - protein, 9 aa, Homo Sapiens
VAIPQEQLT

SEQ ID NO: 372295 - protein, 9 aa, Homo Sapiens
PSGTSRTRG

SEQ ID NO: 372296 - protein, 9 aa, Homo Sapiens
VKEEHVCLP

SEQ ID NO: 372297 - protein, 9 aa, Homo Sapiens
MASLCWSTV

SEQ ID NO: 372298 - protein, 9 aa, Homo Sapiens
PGRSASRTS

SEQ ID NO: 372299 - protein, 9 aa, Homo Sapiens
NDYTHALLH

SEQ ID NO: 372300 - protein, 9 aa, Homo Sapiens
LNVSITNAK

SEQ ID NO: 372301 - protein, 9 aa, Homo Sapiens
RKFIVQINP

SEQ ID NO: 372302 - protein, 9 aa, Homo Sapiens
PSIPSPIGA

SEQ ID NO: 372303 - protein, 9 aa, Homo Sapiens
LVLDVSSIS

SEQ ID NO: 372304 - protein, 9 aa, Homo Sapiens
GDGCRGNGG

SEQ ID NO: 372305 - protein, 9 aa, Homo Sapiens
WQPSLKDHR

SEQ ID NO: 372306 - protein, 9 aa, Homo Sapiens
VTGIFGNVG

SEQ ID NO: 372307 - protein, 9 aa, Homo Sapiens
EHGLGLENR

SEQ ID NO: 372308 - protein, 9 aa, Homo Sapiens
RETSLASCS

SEQ ID NO: 372309 - protein, 9 aa, Homo Sapiens
AGDSMDSVS

SEQ ID NO: 372310 - protein, 9 aa, Homo Sapiens
GEHGQQVGL

SEQ ID NO: 372311 - protein, 9 aa, Homo Sapiens
PCVWTPRAG

SEQ ID NO: 372312 - protein, 9 aa, Homo Sapiens
LGQPWLSPI

SEQ ID NO: 372313 - protein, 9 aa, Homo Sapiens
DGLCVKRGK

SEQ ID NO: 372314 - protein, 9 aa, Homo Sapiens
RPPTVRRDG

SEQ ID NO: 372315 - protein, 9 aa, Homo Sapiens
SRTLGNCGP

SEQ ID NO: 372316 - protein, 9 aa, Homo Sapiens
SLTGSNCCN

SEQ ID NO: 372317 - protein, 9 aa, Homo Sapiens
TSCTTFTRH

SEQ ID NO: 372318 - protein, 9 aa, Homo Sapiens
SCSRGARGA

SEQ ID NO: 372319 - protein, 9 aa, Homo Sapiens
DPIDYWKNG

SEQ ID NO: 372320 - protein, 9 aa, Homo Sapiens
SRTSNISKA

SEQ ID NO: 372321 - protein, 9 aa, Homo Sapiens
AHFPASSSL

SEQ ID NO: 372322 - protein, 9 aa, Homo Sapiens
PYFILWTKL

SEQ ID NO: 372323 - protein, 9 aa, Homo Sapiens
MEALGSWGQ

SEQ ID NO: 372324 - protein, 9 aa, Homo Sapiens
LVVGCILQP

SEQ ID NO: 372325 - protein, 9 aa, Homo Sapiens
PKKRIAIEY

SEQ ID NO: 372326 - protein, 9 aa, Homo Sapiens
DVSDVGLWK

SEQ ID NO: 372327 - protein, 9 aa, Homo Sapiens
KNQAPQCPP

SEQ ID NO: 372328 - protein, 9 aa, Homo Sapiens
MRRMSSHLR

SEQ ID NO: 372329 - protein, 9 aa, Homo Sapiens
LSAPEKDNF

SEQ ID NO: 372330 - protein, 9 aa, Homo Sapiens
MAHDGKEHH

SEQ ID NO: 372331 - protein, 9 aa, Homo Sapiens
STEWDYIKH

SEQ ID NO: 372332 - protein, 9 aa, Homo Sapiens
NGSWMVQGI

SEQ ID NO: 372333 - protein, 9 aa, Homo Sapiens
GSWGQTDLT

SEQ ID NO: 372334 - protein, 9 aa, Homo Sapiens
SNVRNKSFY

SEQ ID NO: 372335 - protein, 9 aa, Homo Sapiens
QDQQTIHSE

SEQ ID NO: 372336 - protein, 9 aa, Homo Sapiens
ICGHLPKIL

SEQ ID NO: 372337 - protein, 9 aa, Homo Sapiens
KNILIMTGD

SEQ ID NO: 372338 - protein, 9 aa, Homo Sapiens
EVEQCLRVL

SEQ ID NO: 372339 - protein, 9 aa, Homo Sapiens
TDYFPGTHN

SEQ ID NO: 372340 - protein, 9 aa, Homo Sapiens
WRVERDVVQ

SEQ ID NO: 372341 - protein, 9 aa, Homo Sapiens
SDPSRSPSV

SEQ ID NO: 372342 - protein, 9 aa, Homo Sapiens
AVSLVNIIL

SEQ ID NO: 372343 - protein, 9 aa, Homo Sapiens
RRQWSLWVL

SEQ ID NO: 372344 - protein, 9 aa, Homo Sapiens
SKPYWMVGS

SEQ ID NO: 372345 - protein, 9 aa, Homo Sapiens
WESRSHTSY

SEQ ID NO: 372346 - protein, 9 aa, Homo Sapiens
ASLCWSTVA

SEQ ID NO: 372347 - protein, 9 aa, Homo Sapiens
NKLLQNLAQ

SEQ ID NO: 372348 - protein, 9 aa, Homo Sapiens
RVKAQAEAA

SEQ ID NO: 372349 - protein, 9 aa, Homo Sapiens
VKTNNSEKF

SEQ ID NO: 372350 - protein, 9 aa, Homo Sapiens
RRQRRSHML

SEQ ID NO: 372351 - protein, 9 aa, Homo Sapiens
PTPACASTS

SEQ ID NO: 372352 - protein, 9 aa, Homo Sapiens
CGPSSEGVC

SEQ ID NO: 372353 - protein, 9 aa, Homo Sapiens
SKEEKESRM

SEQ ID NO: 372354 - protein, 9 aa, Homo Sapiens
IFMHRNLKQ

SEQ ID NO: 372355 - protein, 9 aa, Homo Sapiens
ACPKVPEEG

SEQ ID NO: 372356 - protein, 9 aa, Homo Sapiens
PPAGCLRQR

SEQ ID NO: 372357 - protein, 9 aa, Homo Sapiens
TPREQTWLD

SEQ ID NO: 372358 - protein, 9 aa, Homo Sapiens
SMFVSLLFL

SEQ ID NO: 372359 - protein, 9 aa, Homo Sapiens
LQLFMHLRQ

SEQ ID NO: 372360 - protein, 9 aa, Homo Sapiens
QGCSAKSKN

SEQ ID NO: 372361 - protein, 9 aa, Homo Sapiens
RRKDLTPPR

SEQ ID NO: 372362 - protein, 9 aa, Homo Sapiens
FLLGVNVVI

SEQ ID NO: 372363 - protein, 9 aa, Homo Sapiens
VKGEEGSAT

SEQ ID NO: 372364 - protein, 9 aa, Homo Sapiens
RETLESGGA

SEQ ID NO: 372365 - protein, 9 aa, Homo Sapiens
CLNFRKPQE

SEQ ID NO: 372366 - protein, 9 aa, Homo Sapiens
ETICGHLPK

SEQ ID NO: 372367 - protein, 9 aa, Homo Sapiens
GCVPEQLPQ

SEQ ID NO: 372368 - protein, 9 aa, Homo Sapiens
LKTRGQILF

SEQ ID NO: 372369 - protein, 9 aa, Homo Sapiens
TPPTPACAS

SEQ ID NO: 372370 - protein, 9 aa, Homo Sapiens
GLLGPLFNN

SEQ ID NO: 372371 - protein, 9 aa, Homo Sapiens
AKESKPREP

SEQ ID NO: 372372 - protein, 9 aa, Homo Sapiens
GCKRRRTHT

SEQ ID NO: 372373 - protein, 9 aa, Homo Sapiens
NSSKCSVLG

SEQ ID NO: 372374 - protein, 9 aa, Homo Sapiens
QEKDREKDK

SEQ ID NO: 372375 - protein, 9 aa, Homo Sapiens
NSMMMECMT

SEQ ID NO: 372376 - protein, 9 aa, Homo Sapiens
NRLNVSITN

SEQ ID NO: 372377 - protein, 9 aa, Homo Sapiens
PLFNNSSVG

SEQ ID NO: 372378 - protein, 9 aa, Homo Sapiens
LAGWCMPGL

SEQ ID NO: 372379 - protein, 9 aa, Homo Sapiens
ELELNGTET

SEQ ID NO: 372380 - protein, 9 aa, Homo Sapiens
RRTHTNFTG

SEQ ID NO: 372381 - protein, 9 aa, Homo Sapiens
SMGLLDMTK

SEQ ID NO: 372382 - protein, 9 aa, Homo Sapiens
SCPQFFKVL

SEQ ID NO: 372383 - protein, 9 aa, Homo Sapiens
QHREARAFM

SEQ ID NO: 372384 - protein, 9 aa, Homo Sapiens
WDEVNLRAQ

SEQ ID NO: 372385 - protein, 9 aa, Homo Sapiens
LARCRPPWA

SEQ ID NO: 372386 - protein, 9 aa, Homo Sapiens
AVGTWEFNA

SEQ ID NO: 372387 - protein, 9 aa, Homo Sapiens
NTCKAVGSI

SEQ ID NO: 372388 - protein, 9 aa, Homo Sapiens
GGGGSSSGN

SEQ ID NO: 372389 - protein, 9 aa, Homo Sapiens
LLRHVGLLL

SEQ ID NO: 372390 - protein, 9 aa, Homo Sapiens
GTRGGAPPA

SEQ ID NO: 372391 - protein, 9 aa, Homo Sapiens
HNREAEMEL

SEQ ID NO: 372392 - protein, 9 aa, Homo Sapiens
ICEFGIRFF

SEQ ID NO: 372393 - protein, 9 aa, Homo Sapiens
PDGVRGPNG

SEQ ID NO: 372394 - protein, 9 aa, Homo Sapiens
NLKDQKILG

SEQ ID NO: 372395 - protein, 9 aa, Homo Sapiens
AMNYGICKV

SEQ ID NO: 372396 - protein, 9 aa, Homo Sapiens
LDPVTPYRL

SEQ ID NO: 372397 - protein, 9 aa, Homo Sapiens
TSASGSGCA

SEQ ID NO: 372398 - protein, 9 aa, Homo Sapiens
SCLAKEGDP

SEQ ID NO: 372399 - protein, 9 aa, Homo Sapiens
RAARLFTHF

SEQ ID NO: 372400 - protein, 9 aa, Homo Sapiens
VTEPPDVYS

SEQ ID NO: 372401 - protein, 9 aa, Homo Sapiens
WQGLTLGAP

SEQ ID NO: 372402 - protein, 9 aa, Homo Sapiens
VNLHPDVAR

SEQ ID NO: 372403 - protein, 9 aa, Homo Sapiens
CLTMSPNSA

SEQ ID NO: 372404 - protein, 9 aa, Homo Sapiens
QKELRLLGG

SEQ ID NO: 372405 - protein, 9 aa, Homo Sapiens
TTALSCRVL

SEQ ID NO: 372406 - protein, 9 aa, Homo Sapiens
DDQGGAAQL

SEQ ID NO: 372407 - protein, 9 aa, Homo Sapiens
FRYCTYLDW

SEQ ID NO: 372408 - protein, 9 aa, Homo Sapiens
SRVRPCASF

SEQ ID NO: 372409 - protein, 9 aa, Homo Sapiens
VIQQVKTNN

SEQ ID NO: 372410 - protein, 9 aa, Homo Sapiens
ERGRVGGPG

SEQ ID NO: 372411 - protein, 9 aa, Homo Sapiens
ARPITPRLS

SEQ ID NO: 372412 - protein, 9 aa, Homo Sapiens
DSSPHCPMV

SEQ ID NO: 372413 - protein, 9 aa, Homo Sapiens
GSRSQGTGS

SEQ ID NO: 372414 - protein, 9 aa, Homo Sapiens
GLCLEYADR

SEQ ID NO: 372415 - protein, 9 aa, Homo Sapiens
HSRASWDSS

SEQ ID NO: 372416 - protein, 9 aa, Homo Sapiens
MIPPSSKPY

SEQ ID NO: 372417 - protein, 9 aa, Homo Sapiens
EHHSCTPVP

SEQ ID NO: 372418 - protein, 9 aa, Homo Sapiens
AAWEPRRTL

SEQ ID NO: 372419 - protein, 9 aa, Homo Sapiens
RVLTDLSST

SEQ ID NO: 372420 - protein, 9 aa, Homo Sapiens
KPTVPPIFT

SEQ ID NO: 372421 - protein, 9 aa, Homo Sapiens
WEEWSLLIE

SEQ ID NO: 372422 - protein, 9 aa, Homo Sapiens
LQDAQVANK

SEQ ID NO: 372423 - protein, 9 aa, Homo Sapiens
AGGARETFH

SEQ ID NO: 372424 - protein, 9 aa, Homo Sapiens
AQLLPKIVL

SEQ ID NO: 372425 - protein, 9 aa, Homo Sapiens
GVDRRWYFY

SEQ ID NO: 372426 - protein, 9 aa, Homo Sapiens
GCTPPVAAR

SEQ ID NO: 372427 - protein, 9 aa, Homo Sapiens
PGQPRQPGP

SEQ ID NO: 372428 - protein, 9 aa, Homo Sapiens
DSKNGFIFG

SEQ ID NO: 372429 - protein, 9 aa, Homo Sapiens
TPLTIGEKT

SEQ ID NO: 372430 - protein, 9 aa, Homo Sapiens
VSSGLFFIA

SEQ ID NO: 372431 - protein, 9 aa, Homo Sapiens
LEGQERAVE

SEQ ID NO: 372432 - protein, 9 aa, Homo Sapiens
NCVMPEDVE

SEQ ID NO: 372433 - protein, 9 aa, Homo Sapiens
LQHRVQDPI

SEQ ID NO: 372434 - protein, 9 aa, Homo Sapiens
PRTPKIPPQ

SEQ ID NO: 372435 - protein, 9 aa, Homo Sapiens
KKFILERNP

SEQ ID NO: 372436 - protein, 9 aa, Homo Sapiens
PFIRNQPNE

SEQ ID NO: 372437 - protein, 9 aa, Homo Sapiens
GWPPLLLLL

SEQ ID NO: 372438 - protein, 9 aa, Homo Sapiens
NCCNLNSSF

SEQ ID NO: 372439 - protein, 9 aa, Homo Sapiens
MVKRAYETT

SEQ ID NO: 372440 - protein, 9 aa, Homo Sapiens
RVEGLMAAD

SEQ ID NO: 372441 - protein, 9 aa, Homo Sapiens
KKKDFDIAL

SEQ ID NO: 372442 - protein, 9 aa, Homo Sapiens
CAFDLTQVV

SEQ ID NO: 372443 - protein, 9 aa, Homo Sapiens
APLTPREQT

SEQ ID NO: 372444 - protein, 9 aa, Homo Sapiens
LAKSIDDTL

SEQ ID NO: 372445 - protein, 9 aa, Homo Sapiens
IDNECDFAY

SEQ ID NO: 372446 - protein, 9 aa, Homo Sapiens
NFSTLHQRA

SEQ ID NO: 372447 - protein, 9 aa, Homo Sapiens
FTWRTSRTR

SEQ ID NO: 372448 - protein, 9 aa, Homo Sapiens
EAYECHGVC

SEQ ID NO: 372449 - protein, 9 aa, Homo Sapiens
RVGGPGAGP

SEQ ID NO: 372450 - protein, 9 aa, Homo Sapiens
VCDIEHLTS

SEQ ID NO: 372451 - protein, 9 aa, Homo Sapiens
GEFDEEEGE

SEQ ID NO: 372452 - protein, 9 aa, Homo Sapiens
RNILPPEKE

SEQ ID NO: 372453 - protein, 9 aa, Homo Sapiens
IQEQNQGLA

SEQ ID NO: 372454 - protein, 9 aa, Homo Sapiens
AVCDMEDLL

SEQ ID NO: 372455 - protein, 9 aa, Homo Sapiens
SLQLKAVVD

SEQ ID NO: 372456 - protein, 9 aa, Homo Sapiens
EQQQHHVFI

SEQ ID NO: 372457 - protein, 9 aa, Homo Sapiens
NIYTYLCIP

SEQ ID NO: 372458 - protein, 9 aa, Homo Sapiens
NIAKVLLKT

SEQ ID NO: 372459 - protein, 9 aa, Homo Sapiens
TAFTKLAPT

SEQ ID NO: 372460 - protein, 9 aa, Homo Sapiens
DSHPQAKAI

SEQ ID NO: 372461 - protein, 9 aa, Homo Sapiens
QDKLDKDGL

SEQ ID NO: 372462 - protein, 9 aa, Homo Sapiens
AMVQAATTL

SEQ ID NO: 372463 - protein, 9 aa, Homo Sapiens
LGQPGVRAL

SEQ ID NO: 372464 - protein, 9 aa, Homo Sapiens
CDRYSMGLL

SEQ ID NO: 372465 - protein, 9 aa, Homo Sapiens
PTEYEHATN

SEQ ID NO: 372466 - protein, 9 aa, Homo Sapiens
QPGQPRQPG

SEQ ID NO: 372467 - protein, 9 aa, Homo Sapiens
GAQHVGQVP

SEQ ID NO: 372468 - protein, 9 aa, Homo Sapiens
KKRKNYCEF

SEQ ID NO: 372469 - protein, 9 aa, Homo Sapiens
EQCGRDDYD

SEQ ID NO: 372470 - protein, 9 aa, Homo Sapiens
HPAAPASTP

SEQ ID NO: 372471 - protein, 9 aa, Homo Sapiens
RFESIWLPG

SEQ ID NO: 372472 - protein, 9 aa, Homo Sapiens
EVAVHVQEL

SEQ ID NO: 372473 - protein, 9 aa, Homo Sapiens
GAEVSKKKS

SEQ ID NO: 372474 - protein, 9 aa, Homo Sapiens
GLPPAKRGK

SEQ ID NO: 372475 - protein, 9 aa, Homo Sapiens
KHVFDVNRP

SEQ ID NO: 372476 - protein, 9 aa, Homo Sapiens
LSILPSCRC

SEQ ID NO: 372477 - protein, 9 aa, Homo Sapiens
GSWAGADGQ

SEQ ID NO: 372478 - protein, 9 aa, Homo Sapiens
SAGIQEMEM

SEQ ID NO: 372479 - protein, 9 aa, Homo Sapiens
ITYVCLKFH

SEQ ID NO: 372480 - protein, 9 aa, Homo Sapiens
QGAPPSHRE

SEQ ID NO: 372481 - protein, 9 aa, Homo Sapiens
DKKIQDQDQ

SEQ ID NO: 372482 - protein, 9 aa, Homo Sapiens
SWQSSTPSL

SEQ ID NO: 372483 - protein, 9 aa, Homo Sapiens
GPKLPTKRP

SEQ ID NO: 372484 - protein, 9 aa, Homo Sapiens
ATTASRVLW

SEQ ID NO: 372485 - protein, 9 aa, Homo Sapiens
LCGPRHSHF

SEQ ID NO: 372486 - protein, 9 aa, Homo Sapiens
HGKSTPTDS

SEQ ID NO: 372487 - protein, 9 aa, Homo Sapiens
PSQPRAPAC

SEQ ID NO: 372488 - protein, 9 aa, Homo Sapiens
DSLTDDCEE

SEQ ID NO: 372489 - protein, 9 aa, Homo Sapiens
WGPLGQPWL

SEQ ID NO: 372490 - protein, 9 aa, Homo Sapiens
TCDLSSQSP

SEQ ID NO: 372491 - protein, 9 aa, Homo Sapiens
IFGPGISAH

SEQ ID NO: 372492 - protein, 9 aa, Homo Sapiens
KSTLTIFRF

SEQ ID NO: 372493 - protein, 9 aa, Homo Sapiens
SLASCSRGA

SEQ ID NO: 372494 - protein, 9 aa, Homo Sapiens
ASKASRAGG

SEQ ID NO: 372495 - protein, 9 aa, Homo Sapiens
SQQMQVNLH

SEQ ID NO: 372496 - protein, 9 aa, Homo Sapiens
LEVEQCLRV

SEQ ID NO: 372497 - protein, 9 aa, Homo Sapiens
PLTASTANL

SEQ ID NO: 372498 - protein, 9 aa, Homo Sapiens
NCGPYCTSK

SEQ ID NO: 372499 - protein, 9 aa, Homo Sapiens
SIGPALQLK

SEQ ID NO: 372500 - protein, 9 aa, Homo Sapiens
RRGKSERGG

SEQ ID NO: 372501 - protein, 9 aa, Homo Sapiens
KKRKKKKKL

SEQ ID NO: 372502 - protein, 9 aa, Homo Sapiens
QRKKLPWKL

SEQ ID NO: 372503 - protein, 9 aa, Homo Sapiens
VGSPQRRPP

SEQ ID NO: 372504 - protein, 9 aa, Homo Sapiens
AGVSFSQLE

SEQ ID NO: 372505 - protein, 9 aa, Homo Sapiens
EVETFAFQT

SEQ ID NO: 372506 - protein, 9 aa, Homo Sapiens
NEHKKFILE

SEQ ID NO: 372507 - protein, 9 aa, Homo Sapiens
PIECQKSLL

SEQ ID NO: 372508 - protein, 9 aa, Homo Sapiens
GLLTLHWEP

SEQ ID NO: 372509 - protein, 9 aa, Homo Sapiens
NVAKPLDGP

SEQ ID NO: 372510 - protein, 9 aa, Homo Sapiens
IARLTVNTD

SEQ ID NO: 372511 - protein, 9 aa, Homo Sapiens
IQWKRQQQL

SEQ ID NO: 372512 - protein, 9 aa, Homo Sapiens
ARARAGAGA

SEQ ID NO: 372513 - protein, 9 aa, Homo Sapiens
FFWMEMRCM

SEQ ID NO: 372514 - protein, 9 aa, Homo Sapiens
ERRRRNDYF

SEQ ID NO: 372515 - protein, 9 aa, Homo Sapiens
CRLGPCIGP

SEQ ID NO: 372516 - protein, 9 aa, Homo Sapiens
LLYFLLTTE

SEQ ID NO: 372517 - protein, 9 aa, Homo Sapiens
ELQALIEEL

SEQ ID NO: 372518 - protein, 9 aa, Homo Sapiens
CSPRFHRRK

SEQ ID NO: 372519 - protein, 9 aa, Homo Sapiens
GQVPQVLEN

SEQ ID NO: 372520 - protein, 9 aa, Homo Sapiens
LGSQLQKLK

SEQ ID NO: 372521 - protein, 9 aa, Homo Sapiens
PPQAAGAER

SEQ ID NO: 372522 - protein, 9 aa, Homo Sapiens
STFGTSITS

SEQ ID NO: 372523 - protein, 9 aa, Homo Sapiens
DVQVVTHHM

SEQ ID NO: 372524 - protein, 9 aa, Homo Sapiens
LAEWVIENP

SEQ ID NO: 372525 - protein, 9 aa, Homo Sapiens
GSQGACAHL

SEQ ID NO: 372526 - protein, 9 aa, Homo Sapiens
VMLDVPKRL

SEQ ID NO: 372527 - protein, 9 aa, Homo Sapiens
SLALGRFCM

SEQ ID NO: 372528 - protein, 9 aa, Homo Sapiens
QCRLFEEPE

SEQ ID NO: 372529 - protein, 9 aa, Homo Sapiens
KLPEKGPLS

SEQ ID NO: 372530 - protein, 9 aa, Homo Sapiens
LLAGWCMPG

SEQ ID NO: 372531 - protein, 9 aa, Homo Sapiens
KKLLQLKIL

SEQ ID NO: 372532 - protein, 9 aa, Homo Sapiens
MSIYSSGNE

SEQ ID NO: 372533 - protein, 9 aa, Homo Sapiens
TVPHAATAS

SEQ ID NO: 372534 - protein, 9 aa, Homo Sapiens
FTGFGKKLA

SEQ ID NO: 372535 - protein, 9 aa, Homo Sapiens
LTWDMACRN

SEQ ID NO: 372536 - protein, 9 aa, Homo Sapiens
VTLLTMDWH

SEQ ID NO: 372537 - protein, 9 aa, Homo Sapiens
VEACLRTHG

SEQ ID NO: 372538 - protein, 9 aa, Homo Sapiens
WQPRIWVLF

SEQ ID NO: 372539 - protein, 9 aa, Homo Sapiens
PQDNRSLGA

SEQ ID NO: 372540 - protein, 9 aa, Homo Sapiens
QAVVMAVCG

SEQ ID NO: 372541 - protein, 9 aa, Homo Sapiens
IWLPGCPRG

SEQ ID NO: 372542 - protein, 9 aa, Homo Sapiens
ILPSCRCYI

SEQ ID NO: 372543 - protein, 9 aa, Homo Sapiens
ELAQNRLNV

SEQ ID NO: 372544 - protein, 9 aa, Homo Sapiens
GMWTTVLVD

SEQ ID NO: 372545 - protein, 9 aa, Homo Sapiens
SHQLIMAYP

SEQ ID NO: 372546 - protein, 9 aa, Homo Sapiens
SPPDLESLT

SEQ ID NO: 372547 - protein, 9 aa, Homo Sapiens
LADNKYTIL

SEQ ID NO: 372548 - protein, 9 aa, Homo Sapiens
VQYQVNQAA

SEQ ID NO: 372549 - protein, 9 aa, Homo Sapiens
GLEKEKKDK

SEQ ID NO: 372550 - protein, 9 aa, Homo Sapiens
NYDKLKSQI

SEQ ID NO: 372551 - protein, 9 aa, Homo Sapiens
LFHCSECGK

SEQ ID NO: 372552 - protein, 9 aa, Homo Sapiens
PTDDLQSKT

SEQ ID NO: 372553 - protein, 9 aa, Homo Sapiens
SYERQYHTS

SEQ ID NO: 372554 - protein, 9 aa, Homo Sapiens
SSGLFFIAF

SEQ ID NO: 372555 - protein, 9 aa, Homo Sapiens
EEHMERKRR

SEQ ID NO: 372556 - protein, 9 aa, Homo Sapiens
PAPPPCRPR

SEQ ID NO: 372557 - protein, 9 aa, Homo Sapiens
PSCRGPLPC

SEQ ID NO: 372558 - protein, 9 aa, Homo Sapiens
CYALFPQRR

SEQ ID NO: 372559 - protein, 9 aa, Homo Sapiens
VVQFAVLLV

SEQ ID NO: 372560 - protein, 9 aa, Homo Sapiens
TIAPSTEWW

SEQ ID NO: 372561 - protein, 9 aa, Homo Sapiens
AKDKNRWEG

SEQ ID NO: 372562 - protein, 9 aa, Homo Sapiens
SHQAVSRVS

SEQ ID NO: 372563 - protein, 9 aa, Homo Sapiens
LAVGGPWAT

SEQ ID NO: 372564 - protein, 9 aa, Homo Sapiens
VKIMQATGL

SEQ ID NO: 372565 - protein, 9 aa, Homo Sapiens
STPASPGNR

SEQ ID NO: 372566 - protein, 9 aa, Homo Sapiens
VHQETQHRE

SEQ ID NO: 372567 - protein, 9 aa, Homo Sapiens
PSPALGLAV

SEQ ID NO: 372568 - protein, 9 aa, Homo Sapiens
ASGMPPSSP

SEQ ID NO: 372569 - protein, 9 aa, Homo Sapiens
FQKECFHQK

SEQ ID NO: 372570 - protein, 9 aa, Homo Sapiens
FYKNKEQRE

SEQ ID NO: 372571 - protein, 9 aa, Homo Sapiens
LISGPHASI

SEQ ID NO: 372572 - protein, 9 aa, Homo Sapiens
HVVASMDKW

SEQ ID NO: 372573 - protein, 9 aa, Homo Sapiens
APRVLFHCS

SEQ ID NO: 372574 - protein, 9 aa, Homo Sapiens
GEALSIGPA

SEQ ID NO: 372575 - protein, 9 aa, Homo Sapiens
SSGLALCGI

SEQ ID NO: 372576 - protein, 9 aa, Homo Sapiens
HMVRPNQDG

SEQ ID NO: 372577 - protein, 9 aa, Homo Sapiens
LLIPSKMRE

SEQ ID NO: 372578 - protein, 9 aa, Homo Sapiens
PAVTLCEQC

SEQ ID NO: 372579 - protein, 9 aa, Homo Sapiens
KNSNLSHMM

SEQ ID NO: 372580 - protein, 9 aa, Homo Sapiens
KMHEIFISD

SEQ ID NO: 372581 - protein, 9 aa, Homo Sapiens
LGSQTDGFA

SEQ ID NO: 372582 - protein, 9 aa, Homo Sapiens
ESGDIIHLE

SEQ ID NO: 372583 - protein, 9 aa, Homo Sapiens
ALEYAKTTP

SEQ ID NO: 372584 - protein, 9 aa, Homo Sapiens
ACQATVRET

SEQ ID NO: 372585 - protein, 9 aa, Homo Sapiens
ETIAWVRIY

SEQ ID NO: 372586 - protein, 9 aa, Homo Sapiens
LCNKPVAQL

SEQ ID NO: 372587 - protein, 9 aa, Homo Sapiens
TPGCRSLFS

SEQ ID NO: 372588 - protein, 9 aa, Homo Sapiens
KDAVRARCL

SEQ ID NO: 372589 - protein, 9 aa, Homo Sapiens
SVSRVRPCA

SEQ ID NO: 372590 - protein, 9 aa, Homo Sapiens
KDRTPFNAR

SEQ ID NO: 372591 - protein, 9 aa, Homo Sapiens
VQNQFIHPQ

SEQ ID NO: 372592 - protein, 9 aa, Homo Sapiens
QGQDEGWGP

SEQ ID NO: 372593 - protein, 9 aa, Homo Sapiens
EWKLSVFAE

SEQ ID NO: 372594 - protein, 9 aa, Homo Sapiens
AKVSRNTLF

SEQ ID NO: 372595 - protein, 9 aa, Homo Sapiens
PPPARAVLN

SEQ ID NO: 372596 - protein, 9 aa, Homo Sapiens
VEMLQDHKW

SEQ ID NO: 372597 - protein, 9 aa, Homo Sapiens
PGCRLGPCI

SEQ ID NO: 372598 - protein, 9 aa, Homo Sapiens
EKDKMIHQK

SEQ ID NO: 372599 - protein, 9 aa, Homo Sapiens
PKRPLLPRA

SEQ ID NO: 372600 - protein, 9 aa, Homo Sapiens
WDHSFVSGG

SEQ ID NO: 372601 - protein, 9 aa, Homo Sapiens
SPKDSEKST

SEQ ID NO: 372602 - protein, 9 aa, Homo Sapiens
TITGNGVIA

SEQ ID NO: 372603 - protein, 9 aa, Homo Sapiens
RQGAAAEEG

SEQ ID NO: 372604 - protein, 9 aa, Homo Sapiens
NSTGMKSKE

SEQ ID NO: 372605 - protein, 9 aa, Homo Sapiens
APGKPPTSP

SEQ ID NO: 372606 - protein, 9 aa, Homo Sapiens
MSSEGNTDT

SEQ ID NO: 372607 - protein, 9 aa, Homo Sapiens
ELRLVDGSS

SEQ ID NO: 372608 - protein, 9 aa, Homo Sapiens
QGTGSFFSA

SEQ ID NO: 372609 - protein, 9 aa, Homo Sapiens
IGEGTPGLA

SEQ ID NO: 372610 - protein, 9 aa, Homo Sapiens
RMLHLQDNQ

SEQ ID NO: 372611 - protein, 9 aa, Homo Sapiens
KVEREASPA

SEQ ID NO: 372612 - protein, 9 aa, Homo Sapiens
TNYSQMPAG

SEQ ID NO: 372613 - protein, 9 aa, Homo Sapiens
LRFNGMRLG

SEQ ID NO: 372614 - protein, 9 aa, Homo Sapiens
GSPQRRPPR

SEQ ID NO: 372615 - protein, 9 aa, Homo Sapiens
QPCPSSKWT

SEQ ID NO: 372616 - protein, 9 aa, Homo Sapiens
ASRWHSDDD

SEQ ID NO: 372617 - protein, 9 aa, Homo Sapiens
SAEIQAGEE

SEQ ID NO: 372618 - protein, 9 aa, Homo Sapiens
RRRRNDYFL

SEQ ID NO: 372619 - protein, 9 aa, Homo Sapiens
SLSDESEER

SEQ ID NO: 372620 - protein, 9 aa, Homo Sapiens
EQQCIRNER

SEQ ID NO: 372621 - protein, 9 aa, Homo Sapiens
LSCRVLTDL

SEQ ID NO: 372622 - protein, 9 aa, Homo Sapiens
ALEGQERAV

SEQ ID NO: 372623 - protein, 9 aa, Homo Sapiens
KFAITEATL

SEQ ID NO: 372624 - protein, 9 aa, Homo Sapiens
PWRTSTPST

SEQ ID NO: 372625 - protein, 9 aa, Homo Sapiens
IARQLYHLV

SEQ ID NO: 372626 - protein, 9 aa, Homo Sapiens
LLFEMRDIS

SEQ ID NO: 372627 - protein, 9 aa, Homo Sapiens
LTIFRFCGP

SEQ ID NO: 372628 - protein, 9 aa, Homo Sapiens
TGTLCTRGG

SEQ ID NO: 372629 - protein, 9 aa, Homo Sapiens
LPAHIPYQV

SEQ ID NO: 372630 - protein, 9 aa, Homo Sapiens
TLPPAWQPS

SEQ ID NO: 372631 - protein, 9 aa, Homo Sapiens
SKKLNKKAT

SEQ ID NO: 372632 - protein, 9 aa, Homo Sapiens
APMSTELKT

SEQ ID NO: 372633 - protein, 9 aa, Homo Sapiens
RCSRRAGCL

SEQ ID NO: 372634 - protein, 9 aa, Homo Sapiens
PAAPEHKPL

SEQ ID NO: 372635 - protein, 9 aa, Homo Sapiens
ENIIQKSSA

SEQ ID NO: 372636 - protein, 9 aa, Homo Sapiens
IRAHTPTCH

SEQ ID NO: 372637 - protein, 9 aa, Homo Sapiens
RCSPHSSVH

SEQ ID NO: 372638 - protein, 9 aa, Homo Sapiens
VLHTLLSIK

SEQ ID NO: 372639 - protein, 9 aa, Homo Sapiens
APTDDLQSK

SEQ ID NO: 372640 - protein, 9 aa, Homo Sapiens
KKVDQGKVK

SEQ ID NO: 372641 - protein, 9 aa, Homo Sapiens
KETICGHLP

SEQ ID NO: 372642 - protein, 9 aa, Homo Sapiens
LTRLAAFIG

SEQ ID NO: 372643 - protein, 9 aa, Homo Sapiens
MAEGEELVV

SEQ ID NO: 372644 - protein, 9 aa, Homo Sapiens
EVIQDDKVV

SEQ ID NO: 372645 - protein, 9 aa, Homo Sapiens
PCASFDCTR

SEQ ID NO: 372646 - protein, 9 aa, Homo Sapiens
DPSLGTHSY

SEQ ID NO: 372647 - protein, 9 aa, Homo Sapiens
YWKHLKFIG

SEQ ID NO: 372648 - protein, 9 aa, Homo Sapiens
VQVDAAELP

SEQ ID NO: 372649 - protein, 9 aa, Homo Sapiens
PALEGQERA

SEQ ID NO: 372650 - protein, 9 aa, Homo Sapiens
SQTDGFAGI

SEQ ID NO: 372651 - protein, 9 aa, Homo Sapiens
EGSATPDQH

SEQ ID NO: 372652 - protein, 9 aa, Homo Sapiens
ETLLNAPRP

SEQ ID NO: 372653 - protein, 9 aa, Homo Sapiens
SRMEIAKQE

SEQ ID NO: 372654 - protein, 9 aa, Homo Sapiens
LLTLHWEPV

SEQ ID NO: 372655 - protein, 9 aa, Homo Sapiens
MTKRPPSEA

SEQ ID NO: 372656 - protein, 9 aa, Homo Sapiens
QGLTLGAPL

SEQ ID NO: 372657 - protein, 9 aa, Homo Sapiens
ATAAEEPRR

SEQ ID NO: 372658 - protein, 9 aa, Homo Sapiens
RIWVLFEDP

SEQ ID NO: 372659 - protein, 9 aa, Homo Sapiens
VRYVEFYSH

SEQ ID NO: 372660 - protein, 9 aa, Homo Sapiens
PSTEWWTMV

SEQ ID NO: 372661 - protein, 9 aa, Homo Sapiens
AKVEREASP

SEQ ID NO: 372662 - protein, 9 aa, Homo Sapiens
LESLSLSAQ

SEQ ID NO: 372663 - protein, 9 aa, Homo Sapiens
ALCLQGKPT

SEQ ID NO: 372664 - protein, 9 aa, Homo Sapiens
MHENANIVF

SEQ ID NO: 372665 - protein, 9 aa, Homo Sapiens
DGQASGGSM

SEQ ID NO: 372666 - protein, 9 aa, Homo Sapiens
PNWRISNAE

SEQ ID NO: 372667 - protein, 9 aa, Homo Sapiens
WVRIYRPGL

SEQ ID NO: 372668 - protein, 9 aa, Homo Sapiens
PLLPRAPPE

SEQ ID NO: 372669 - protein, 9 aa, Homo Sapiens
RSSSGRAPI

SEQ ID NO: 372670 - protein, 9 aa, Homo Sapiens
MRLGAVALY

SEQ ID NO: 372671 - protein, 9 aa, Homo Sapiens
CDMEDLLRL

SEQ ID NO: 372672 - protein, 9 aa, Homo Sapiens
AVQSDTCRS

SEQ ID NO: 372673 - protein, 9 aa, Homo Sapiens
LPRAPPEAP

SEQ ID NO: 372674 - protein, 9 aa, Homo Sapiens
TRGASKASR

SEQ ID NO: 372675 - protein, 9 aa, Homo Sapiens
VIEGNSSFH

SEQ ID NO: 372676 - protein, 9 aa, Homo Sapiens
GARGAKVSR

SEQ ID NO: 372677 - protein, 9 aa, Homo Sapiens
PTSQLVNLQ

SEQ ID NO: 372678 - protein, 9 aa, Homo Sapiens
WDIDVESLE

SEQ ID NO: 372679 - protein, 9 aa, Homo Sapiens
EVLGHGALV

SEQ ID NO: 372680 - protein, 9 aa, Homo Sapiens
ALSLRSLQR

SEQ ID NO: 372681 - protein, 9 aa, Homo Sapiens
LKELRNPLK

SEQ ID NO: 372682 - protein, 9 aa, Homo Sapiens
RSPASAPTR

SEQ ID NO: 372683 - protein, 9 aa, Homo Sapiens
HQGQDEGWG

SEQ ID NO: 372684 - protein, 9 aa, Homo Sapiens
GPSSEGVCF

SEQ ID NO: 372685 - protein, 9 aa, Homo Sapiens
ALFYPKRVM

SEQ ID NO: 372686 - protein, 9 aa, Homo Sapiens
DFPAVLCWF

SEQ ID NO: 372687 - protein, 9 aa, Homo Sapiens
ENLLHNRNF

SEQ ID NO: 372688 - protein, 9 aa, Homo Sapiens
RLRKISMRH

SEQ ID NO: 372689 - protein, 9 aa, Homo Sapiens
HPCAVRRPA

SEQ ID NO: 372690 - protein, 9 aa, Homo Sapiens
AGAEREHHS

SEQ ID NO: 372691 - protein, 9 aa, Homo Sapiens
KRYLGDLTL

SEQ ID NO: 372692 - protein, 9 aa, Homo Sapiens
DSLWRRNPA

SEQ ID NO: 372693 - protein, 9 aa, Homo Sapiens
RKKMFLIQR

SEQ ID NO: 372694 - protein, 9 aa, Homo Sapiens
SATPDQHTH

SEQ ID NO: 372695 - protein, 9 aa, Homo Sapiens
VPQPPQPQR

SEQ ID NO: 372696 - protein, 9 aa, Homo Sapiens
PQEVAVHVQ

SEQ ID NO: 372697 - protein, 9 aa, Homo Sapiens
LHQMTRERM

SEQ ID NO: 372698 - protein, 9 aa, Homo Sapiens
PPASRWNPL

SEQ ID NO: 372699 - protein, 9 aa, Homo Sapiens
PPGGCLLTV

SEQ ID NO: 372700 - protein, 9 aa, Homo Sapiens
DDAIHVLWN

SEQ ID NO: 372701 - protein, 9 aa, Homo Sapiens
GLQEVLGHG

SEQ ID NO: 372702 - protein, 9 aa, Homo Sapiens
NTPEKRAKK

SEQ ID NO: 372703 - protein, 9 aa, Homo Sapiens
FSEHVGIIY

SEQ ID NO: 372704 - protein, 9 aa, Homo Sapiens
VTTHWLNTV

SEQ ID NO: 372705 - protein, 9 aa, Homo Sapiens
ETSVFTLKK

SEQ ID NO: 372706 - protein, 9 aa, Homo Sapiens
SVQLHYSIP

SEQ ID NO: 372707 - protein, 9 aa, Homo Sapiens
LVQHRHTHT

SEQ ID NO: 372708 - protein, 9 aa, Homo Sapiens
NLSNFNPGT

SEQ ID NO: 372709 - protein, 9 aa, Homo Sapiens
QETQAQPGR

SEQ ID NO: 372710 - protein, 9 aa, Homo Sapiens
SANDRPDFL

SEQ ID NO: 372711 - protein, 9 aa, Homo Sapiens
FEDFQAFVP

SEQ ID NO: 372712 - protein, 9 aa, Homo Sapiens
SSLTGSNCC

SEQ ID NO: 372713 - protein, 9 aa, Homo Sapiens
ELKPTVPPI

SEQ ID NO: 372714 - protein, 9 aa, Homo Sapiens
EKEKIIVEQ

SEQ ID NO: 372715 - protein, 9 aa, Homo Sapiens
QFSEHVGII

SEQ ID NO: 372716 - protein, 9 aa, Homo Sapiens
PSRSPSVAS

SEQ ID NO: 372717 - protein, 9 aa, Homo Sapiens
RLGRRTCWM

SEQ ID NO: 372718 - protein, 9 aa, Homo Sapiens
REREREQTA

SEQ ID NO: 372719 - protein, 9 aa, Homo Sapiens
NYPEVLQEI

SEQ ID NO: 372720 - protein, 9 aa, Homo Sapiens
TSVTLRPWK

SEQ ID NO: 372721 - protein, 9 aa, Homo Sapiens
KSVKEIKCF

SEQ ID NO: 372722 - protein, 9 aa, Homo Sapiens
ASMASLKKQ

SEQ ID NO: 372723 - protein, 9 aa, Homo Sapiens
GKNSSHTHD

SEQ ID NO: 372724 - protein, 9 aa, Homo Sapiens
VVIRTANTQ

SEQ ID NO: 372725 - protein, 9 aa, Homo Sapiens
SNHRDWIAT

SEQ ID NO: 372726 - protein, 9 aa, Homo Sapiens
ESTTEQAQR

SEQ ID NO: 372727 - protein, 9 aa, Homo Sapiens
ERYLWQENH

SEQ ID NO: 372728 - protein, 9 aa, Homo Sapiens
AQYGIGYKQ

SEQ ID NO: 372729 - protein, 9 aa, Homo Sapiens
SSSGTSRAA

SEQ ID NO: 372730 - protein, 9 aa, Homo Sapiens
VVDSWNAIV

SEQ ID NO: 372731 - protein, 9 aa, Homo Sapiens
AHFENLLAW

SEQ ID NO: 372732 - protein, 9 aa, Homo Sapiens
PGFQTFVTT

SEQ ID NO: 372733 - protein, 9 aa, Homo Sapiens
HSHKPPCLT

SEQ ID NO: 372734 - protein, 9 aa, Homo Sapiens
ARPSQPRAP

SEQ ID NO: 372735 - protein, 9 aa, Homo Sapiens
NAAAASWPV

SEQ ID NO: 372736 - protein, 9 aa, Homo Sapiens
PPTHRFQPL

SEQ ID NO: 372737 - protein, 9 aa, Homo Sapiens
KALEYAKTT

SEQ ID NO: 372738 - protein, 9 aa, Homo Sapiens
HFPASSSLV

SEQ ID NO: 372739 - protein, 9 aa, Homo Sapiens
STATSDGKH

SEQ ID NO: 372740 - protein, 9 aa, Homo Sapiens
YCTSKAYNN

SEQ ID NO: 372741 - protein, 9 aa, Homo Sapiens
ATNPESSTT

SEQ ID NO: 372742 - protein, 9 aa, Homo Sapiens
LVSGGSDCQ

SEQ ID NO: 372743 - protein, 9 aa, Homo Sapiens
AARSWCESR

SEQ ID NO: 372744 - protein, 9 aa, Homo Sapiens
RGAKVSRNT

SEQ ID NO: 372745 - protein, 9 aa, Homo Sapiens
SDKTHTRET

SEQ ID NO: 372746 - protein, 9 aa, Homo Sapiens
QAFPRCPTH

SEQ ID NO: 372747 - protein, 9 aa, Homo Sapiens
AALYLAEWV

SEQ ID NO: 372748 - protein, 9 aa, Homo Sapiens
PWRGQPGPA

SEQ ID NO: 372749 - protein, 9 aa, Homo Sapiens
KDRDKEQEK

SEQ ID NO: 372750 - protein, 9 aa, Homo Sapiens
WPRLASICI

SEQ ID NO: 372751 - protein, 9 aa, Homo Sapiens
HQLKTRSWQ

SEQ ID NO: 372752 - protein, 9 aa, Homo Sapiens
ILYLHHCQR

SEQ ID NO: 372753 - protein, 9 aa, Homo Sapiens
CCPQCKKRK

SEQ ID NO: 372754 - protein, 9 aa, Homo Sapiens
WMSIWLYTF

SEQ ID NO: 372755 - protein, 9 aa, Homo Sapiens
SESWQAQLP

SEQ ID NO: 372756 - protein, 9 aa, Homo Sapiens
LELSCLAKE

SEQ ID NO: 372757 - protein, 9 aa, Homo Sapiens
ATPDRTHFP

SEQ ID NO: 372758 - protein, 9 aa, Homo Sapiens
LFPGKNCTL

SEQ ID NO: 372759 - protein, 9 aa, Homo Sapiens
RLSPSGSSY

SEQ ID NO: 372760 - protein, 9 aa, Homo Sapiens
HSFNNFRLQ

SEQ ID NO: 372761 - protein, 9 aa, Homo Sapiens
APSPFPSLQ

SEQ ID NO: 372762 - protein, 9 aa, Homo Sapiens
PYVNLTPGC

SEQ ID NO: 372763 - protein, 9 aa, Homo Sapiens
CILGHVDTG

SEQ ID NO: 372764 - protein, 9 aa, Homo Sapiens
SSPNVTSME

SEQ ID NO: 372765 - protein, 9 aa, Homo Sapiens
TEQYYSFFW

SEQ ID NO: 372766 - protein, 9 aa, Homo Sapiens
SLFLASVTI

SEQ ID NO: 372767 - protein, 9 aa, Homo Sapiens
KPQKLFQWK

SEQ ID NO: 372768 - protein, 9 aa, Homo Sapiens
STLANLTLG

SEQ ID NO: 372769 - protein, 9 aa, Homo Sapiens
RWIYCVDPT

SEQ ID NO: 372770 - protein, 9 aa, Homo Sapiens
SSPTGRRAS

SEQ ID NO: 372771 - protein, 9 aa, Homo Sapiens
GGGGSWSSA

SEQ ID NO: 372772 - protein, 9 aa, Homo Sapiens
MECVGARIN

SEQ ID NO: 372773 - protein, 9 aa, Homo Sapiens
APRPWAPVP

SEQ ID NO: 372774 - protein, 9 aa, Homo Sapiens
DIIISLIIL

SEQ ID NO: 372775 - protein, 9 aa, Homo Sapiens
LQLKVFPKH

SEQ ID NO: 372776 - protein, 9 aa, Homo Sapiens
CDIEHLTSL

SEQ ID NO: 372777 - protein, 9 aa, Homo Sapiens
PARAVLNST

SEQ ID NO: 372778 - protein, 9 aa, Homo Sapiens
SLLFLSWIA

SEQ ID NO: 372779 - protein, 9 aa, Homo Sapiens
RSATVCLTA

SEQ ID NO: 372780 - protein, 9 aa, Homo Sapiens
GQGQLNYPL

SEQ ID NO: 372781 - protein, 9 aa, Homo Sapiens
LQWPHPDPA

SEQ ID NO: 372782 - protein, 9 aa, Homo Sapiens
EKMVVLLLQ

SEQ ID NO: 372783 - protein, 9 aa, Homo Sapiens
SLGLWGTRG

SEQ ID NO: 372784 - protein, 9 aa, Homo Sapiens
PKRKHRTKS

SEQ ID NO: 372785 - protein, 9 aa, Homo Sapiens
PCAVRRPAA

SEQ ID NO: 372786 - protein, 9 aa, Homo Sapiens
GQASWSHAT

SEQ ID NO: 372787 - protein, 9 aa, Homo Sapiens
ARHSVVLHT

SEQ ID NO: 372788 - protein, 9 aa, Homo Sapiens
LYRWLSAAD

SEQ ID NO: 372789 - protein, 9 aa, Homo Sapiens
PNCLQQFWV

SEQ ID NO: 372790 - protein, 9 aa, Homo Sapiens
RNEHAMIGN

SEQ ID NO: 372791 - protein, 9 aa, Homo Sapiens
GIFGNVGSA

SEQ ID NO: 372792 - protein, 9 aa, Homo Sapiens
ILTVGGWSV

SEQ ID NO: 372793 - protein, 9 aa, Homo Sapiens
MSIWLYTFV

SEQ ID NO: 372794 - protein, 9 aa, Homo Sapiens
ALVTPDPAV

SEQ ID NO: 372795 - protein, 9 aa, Homo Sapiens
MMMECMTTD

SEQ ID NO: 372796 - protein, 9 aa, Homo Sapiens
DPDPTAPPY

SEQ ID NO: 372797 - protein, 9 aa, Homo Sapiens
GHITFGGLS

SEQ ID NO: 372798 - protein, 9 aa, Homo Sapiens
ILIMTGDEA

SEQ ID NO: 372799 - protein, 9 aa, Homo Sapiens
MECMTTDIN

SEQ ID NO: 372800 - protein, 9 aa, Homo Sapiens
VTSIVSGAL

SEQ ID NO: 372801 - protein, 9 aa, Homo Sapiens
KPVTVSRPT

SEQ ID NO: 372802 - protein, 9 aa, Homo Sapiens
NPTNVKNVT

SEQ ID NO: 372803 - protein, 9 aa, Homo Sapiens
ELPHECDPG

SEQ ID NO: 372804 - protein, 9 aa, Homo Sapiens
NMSLDRSGS

SEQ ID NO: 372805 - protein, 9 aa, Homo Sapiens
RQAQTVFWG

SEQ ID NO: 372806 - protein, 9 aa, Homo Sapiens
LLALVTAVG

SEQ ID NO: 372807 - protein, 9 aa, Homo Sapiens
NPTNVKNVA

SEQ ID NO: 372808 - protein, 9 aa, Homo Sapiens
KTEIQLTMN

SEQ ID NO: 372809 - protein, 9 aa, Homo Sapiens
PDRTHFPRG

SEQ ID NO: 372810 - protein, 9 aa, Homo Sapiens
VKRGKPCLK

SEQ ID NO: 372811 - protein, 9 aa, Homo Sapiens
CTRGGTGVT

SEQ ID NO: 372812 - protein, 9 aa, Homo Sapiens
ALNHMGRRI

SEQ ID NO: 372813 - protein, 9 aa, Homo Sapiens
VLSHLPSHH

SEQ ID NO: 372814 - protein, 9 aa, Homo Sapiens
RHRAADWAE

SEQ ID NO: 372815 - protein, 9 aa, Homo Sapiens
YFYRLYAVS

SEQ ID NO: 372816 - protein, 9 aa, Homo Sapiens
LRVHQETQH

SEQ ID NO: 372817 - protein, 9 aa, Homo Sapiens
REAPAEGKC

SEQ ID NO: 372818 - protein, 9 aa, Homo Sapiens
CYHWLGHRV

SEQ ID NO: 372819 - protein, 9 aa, Homo Sapiens
VGHGSRMVA

SEQ ID NO: 372820 - protein, 9 aa, Homo Sapiens
GIGYKQVFW

SEQ ID NO: 372821 - protein, 9 aa, Homo Sapiens
PGGLGGSRG

SEQ ID NO: 372822 - protein, 9 aa, Homo Sapiens
EREQTARAR

SEQ ID NO: 372823 - protein, 9 aa, Homo Sapiens
MNSTGMKSK

SEQ ID NO: 372824 - protein, 9 aa, Homo Sapiens
TSQNHSKCI

SEQ ID NO: 372825 - protein, 9 aa, Homo Sapiens
RGQQDQQTI

SEQ ID NO: 372826 - protein, 9 aa, Homo Sapiens
SETLRKCMQ

SEQ ID NO: 372827 - protein, 9 aa, Homo Sapiens
PRLASICIT

SEQ ID NO: 372828 - protein, 9 aa, Homo Sapiens
SKNPKIFMH

SEQ ID NO: 372829 - protein, 9 aa, Homo Sapiens
KARGALATG

SEQ ID NO: 372830 - protein, 9 aa, Homo Sapiens
NINESTPYF

SEQ ID NO: 372831 - protein, 9 aa, Homo Sapiens
LATEKSRWS

SEQ ID NO: 372832 - protein, 9 aa, Homo Sapiens
RAPKHCELV

SEQ ID NO: 372833 - protein, 9 aa, Homo Sapiens
CISVKDHRT

SEQ ID NO: 372834 - protein, 9 aa, Homo Sapiens
CRPRVTPAP

SEQ ID NO: 372835 - protein, 9 aa, Homo Sapiens
PSRSPFGSC

SEQ ID NO: 372836 - protein, 9 aa, Homo Sapiens
NKQLTAPPA

SEQ ID NO: 372837 - protein, 9 aa, Homo Sapiens
RNDYFLFFG

SEQ ID NO: 372838 - protein, 9 aa, Homo Sapiens
SGISIATNP

SEQ ID NO: 372839 - protein, 9 aa, Homo Sapiens
HRCSPHSSV

SEQ ID NO: 372840 - protein, 9 aa, Homo Sapiens
LKNILIMTG

SEQ ID NO: 372841 - protein, 9 aa, Homo Sapiens
VHCTGTELS

SEQ ID NO: 372842 - protein, 9 aa, Homo Sapiens
DTPLWSSST

SEQ ID NO: 372843 - protein, 9 aa, Homo Sapiens
LARDARRTV

SEQ ID NO: 372844 - protein, 9 aa, Homo Sapiens
GAVQSDTCR

SEQ ID NO: 372845 - protein, 9 aa, Homo Sapiens
SLRICISGR

SEQ ID NO: 372846 - protein, 9 aa, Homo Sapiens
SHGFLHDRE

SEQ ID NO: 372847 - protein, 9 aa, Homo Sapiens
DRQEIRQQI

SEQ ID NO: 372848 - protein, 9 aa, Homo Sapiens
FILWTKLEY

SEQ ID NO: 372849 - protein, 9 aa, Homo Sapiens
LLCNLSPGG

SEQ ID NO: 372850 - protein, 9 aa, Homo Sapiens
KRGSRSRPQ

SEQ ID NO: 372851 - protein, 9 aa, Homo Sapiens
ALERYGKDF

SEQ ID NO: 372852 - protein, 9 aa, Homo Sapiens
CSAKSKNLL

SEQ ID NO: 372853 - protein, 9 aa, Homo Sapiens
IELLLNEGI

SEQ ID NO: 372854 - protein, 9 aa, Homo Sapiens
LKFVDWVRR

SEQ ID NO: 372855 - protein, 9 aa, Homo Sapiens
SDGLCVKRG

SEQ ID NO: 372856 - protein, 9 aa, Homo Sapiens
YNCKEAINV

SEQ ID NO: 372857 - protein, 9 aa, Homo Sapiens
AGCTPPVAA

SEQ ID NO: 372858 - protein, 9 aa, Homo Sapiens
PLVKGVLER

SEQ ID NO: 372859 - protein, 9 aa, Homo Sapiens
VPHAQRHEL

SEQ ID NO: 372860 - protein, 9 aa, Homo Sapiens
ELAITFEHF

SEQ ID NO: 372861 - protein, 9 aa, Homo Sapiens
ICACPPCLR

SEQ ID NO: 372862 - protein, 9 aa, Homo Sapiens
EYAKTTPKP

SEQ ID NO: 372863 - protein, 9 aa, Homo Sapiens
MLGSHSVTQ

SEQ ID NO: 372864 - protein, 9 aa, Homo Sapiens
RRLSKGCWR

SEQ ID NO: 372865 - protein, 9 aa, Homo Sapiens
GARPSQPRA

SEQ ID NO: 372866 - protein, 9 aa, Homo Sapiens
KKDYVQTCI

SEQ ID NO: 372867 - protein, 9 aa, Homo Sapiens
EDKKIQDQD

SEQ ID NO: 372868 - protein, 9 aa, Homo Sapiens
ITFGGLSSS

SEQ ID NO: 372869 - protein, 9 aa, Homo Sapiens
NIFTAFTCL

SEQ ID NO: 372870 - protein, 9 aa, Homo Sapiens
IGWRVEFQP

SEQ ID NO: 372871 - protein, 9 aa, Homo Sapiens
RTFSTTALS

SEQ ID NO: 372872 - protein, 9 aa, Homo Sapiens
VSRNTLFTR

SEQ ID NO: 372873 - protein, 9 aa, Homo Sapiens
ENLENLLHN

SEQ ID NO: 372874 - protein, 9 aa, Homo Sapiens
QKELQRRLK

SEQ ID NO: 372875 - protein, 9 aa, Homo Sapiens
PLIRAPGSR

SEQ ID NO: 372876 - protein, 9 aa, Homo Sapiens
GRIQGRFSL

SEQ ID NO: 372877 - protein, 9 aa, Homo Sapiens
KYLGMMLVE

SEQ ID NO: 372878 - protein, 9 aa, Homo Sapiens
CIFGVEEMA

SEQ ID NO: 372879 - protein, 9 aa, Homo Sapiens
GAGTGTASG

SEQ ID NO: 372880 - protein, 9 aa, Homo Sapiens
LPTALEPKS

SEQ ID NO: 372881 - protein, 9 aa, Homo Sapiens
AANSINQVF

SEQ ID NO: 372882 - protein, 9 aa, Homo Sapiens
VFKGSKKTL

SEQ ID NO: 372883 - protein, 9 aa, Homo Sapiens
SHQRAEYIL

SEQ ID NO: 372884 - protein, 9 aa, Homo Sapiens
IETCHRYLN

SEQ ID NO: 372885 - protein, 9 aa, Homo Sapiens
ESCCCQYEM

SEQ ID NO: 372886 - protein, 9 aa, Homo Sapiens
PANQPRTES

SEQ ID NO: 372887 - protein, 9 aa, Homo Sapiens
STPRPSTAG

SEQ ID NO: 372888 - protein, 9 aa, Homo Sapiens
KFGSSWHMV

SEQ ID NO: 372889 - protein, 9 aa, Homo Sapiens
WAARSWCES

SEQ ID NO: 372890 - protein, 9 aa, Homo Sapiens
CSITVSFVG

SEQ ID NO: 372891 - protein, 9 aa, Homo Sapiens
CSRRAGCLC

SEQ ID NO: 372892 - protein, 9 aa, Homo Sapiens
AWTSTPRTP

SEQ ID NO: 372893 - protein, 9 aa, Homo Sapiens
ASMFVSLLF

SEQ ID NO: 372894 - protein, 9 aa, Homo Sapiens
SGALERSKN

SEQ ID NO: 372895 - protein, 9 aa, Homo Sapiens
TNENRGGSW

SEQ ID NO: 372896 - protein, 9 aa, Homo Sapiens
IEIDNECDF

SEQ ID NO: 372897 - protein, 9 aa, Homo Sapiens
RKRALPQLG

SEQ ID NO: 372898 - protein, 9 aa, Homo Sapiens
TFHQPELVR

SEQ ID NO: 372899 - protein, 9 aa, Homo Sapiens
MEMRCMYGS

SEQ ID NO: 372900 - protein, 9 aa, Homo Sapiens
IRFFLVSIT

SEQ ID NO: 372901 - protein, 9 aa, Homo Sapiens
STNMPTEPA

SEQ ID NO: 372902 - protein, 9 aa, Homo Sapiens
VRCLALLAL

SEQ ID NO: 372903 - protein, 9 aa, Homo Sapiens
LPKGPARIP

SEQ ID NO: 372904 - protein, 9 aa, Homo Sapiens
RTCWMTWRA

SEQ ID NO: 372905 - protein, 9 aa, Homo Sapiens
LRLQSLLSL

SEQ ID NO: 372906 - protein, 9 aa, Homo Sapiens
VMPEDVENF

SEQ ID NO: 372907 - protein, 9 aa, Homo Sapiens
TTHSSIVDC

SEQ ID NO: 372908 - protein, 9 aa, Homo Sapiens
ARPARAESL

SEQ ID NO: 372909 - protein, 9 aa, Homo Sapiens
THWLNTVLK

SEQ ID NO: 372910 - protein, 9 aa, Homo Sapiens
ETKKNSNLS

SEQ ID NO: 372911 - protein, 9 aa, Homo Sapiens
QRGAVLCLR

SEQ ID NO: 372912 - protein, 9 aa, Homo Sapiens
RIVHPAACS

SEQ ID NO: 372913 - protein, 9 aa, Homo Sapiens
KGCGKSFNR

SEQ ID NO: 372914 - protein, 9 aa, Homo Sapiens
WIYRSALNS

SEQ ID NO: 372915 - protein, 9 aa, Homo Sapiens
DCDNKKISL

SEQ ID NO: 372916 - protein, 9 aa, Homo Sapiens
GVVAAMGQD

SEQ ID NO: 372917 - protein, 9 aa, Homo Sapiens
FRKPQEIYF

SEQ ID NO: 372918 - protein, 9 aa, Homo Sapiens
PTITDYFPG

SEQ ID NO: 372919 - protein, 9 aa, Homo Sapiens
PELLADEFT

SEQ ID NO: 372920 - protein, 9 aa, Homo Sapiens
HDVDVEDVL

SEQ ID NO: 372921 - protein, 9 aa, Homo Sapiens
LGAQHVGQV

SEQ ID NO: 372922 - protein, 9 aa, Homo Sapiens
GTLCTRGGT

SEQ ID NO: 372923 - protein, 9 aa, Homo Sapiens
CPMVVQARL

SEQ ID NO: 372924 - protein, 9 aa, Homo Sapiens
EKRKKLNRL

SEQ ID NO: 372925 - protein, 9 aa, Homo Sapiens
SKAKVEREA

SEQ ID NO: 372926 - protein, 9 aa, Homo Sapiens
VSSASEAQS

SEQ ID NO: 372927 - protein, 9 aa, Homo Sapiens
GKTCWRPDC

SEQ ID NO: 372928 - protein, 9 aa, Homo Sapiens
ARLAALLAL

SEQ ID NO: 372929 - protein, 9 aa, Homo Sapiens
IASLIGMEG

SEQ ID NO: 372930 - protein, 9 aa, Homo Sapiens
DNEYEDEDQ

SEQ ID NO: 372931 - protein, 9 aa, Homo Sapiens
RSHFQHVKR

SEQ ID NO: 372932 - protein, 9 aa, Homo Sapiens
VPWGMEALG

SEQ ID NO: 372933 - protein, 9 aa, Homo Sapiens
PLAACQATV

SEQ ID NO: 372934 - protein, 9 aa, Homo Sapiens
SIMGSWLKG

SEQ ID NO: 372935 - protein, 9 aa, Homo Sapiens
GCRIKRVSG

SEQ ID NO: 372936 - protein, 9 aa, Homo Sapiens
HCNRSEDLG

SEQ ID NO: 372937 - protein, 9 aa, Homo Sapiens
VPNGLTQMP

SEQ ID NO: 372938 - protein, 9 aa, Homo Sapiens
VHHEKLQSH

SEQ ID NO: 372939 - protein, 9 aa, Homo Sapiens
ASQTTDAIF

SEQ ID NO: 372940 - protein, 9 aa, Homo Sapiens
PITVIEGNS

SEQ ID NO: 372941 - protein, 9 aa, Homo Sapiens
TQHREARAF

SEQ ID NO: 372942 - protein, 9 aa, Homo Sapiens
QISTLVLDV

SEQ ID NO: 372943 - protein, 9 aa, Homo Sapiens
LASAVSSPT

SEQ ID NO: 372944 - protein, 9 aa, Homo Sapiens
SFCLAPKRP

SEQ ID NO: 372945 - protein, 9 aa, Homo Sapiens
ENGYTPALV

SEQ ID NO: 372946 - protein, 9 aa, Homo Sapiens
GTETKLVRK

SEQ ID NO: 372947 - protein, 9 aa, Homo Sapiens
VPARLALRA

SEQ ID NO: 372948 - protein, 9 aa, Homo Sapiens
PMNCPAALH

SEQ ID NO: 372949 - protein, 9 aa, Homo Sapiens
PATMWPNST

SEQ ID NO: 372950 - protein, 9 aa, Homo Sapiens
IQNNQKTRK

SEQ ID NO: 372951 - protein, 9 aa, Homo Sapiens
INEGRLLYH

SEQ ID NO: 372952 - protein, 9 aa, Homo Sapiens
KMFLIQREL

SEQ ID NO: 372953 - protein, 9 aa, Homo Sapiens
PTLLKTRCL

SEQ ID NO: 372954 - protein, 9 aa, Homo Sapiens
PKPSLSLSR

SEQ ID NO: 372955 - protein, 9 aa, Homo Sapiens
DNRIITLQE

SEQ ID NO: 372956 - protein, 9 aa, Homo Sapiens
HNYDKLKSQ

SEQ ID NO: 372957 - protein, 9 aa, Homo Sapiens
QEKEKIIVE

SEQ ID NO: 372958 - protein, 9 aa, Homo Sapiens
GSGGVAAGD

SEQ ID NO: 372959 - protein, 9 aa, Homo Sapiens
NFRLQVGLN

SEQ ID NO: 372960 - protein, 9 aa, Homo Sapiens
PWKLKLKLP

SEQ ID NO: 372961 - protein, 9 aa, Homo Sapiens
KMLEESKAL

SEQ ID NO: 372962 - protein, 9 aa, Homo Sapiens
ERQQQQQRR

SEQ ID NO: 372963 - protein, 9 aa, Homo Sapiens
TSIVSGALE

SEQ ID NO: 372964 - protein, 9 aa, Homo Sapiens
QEFAVNPEK

SEQ ID NO: 372965 - protein, 9 aa, Homo Sapiens
HIRAHTPTC

SEQ ID NO: 372966 - protein, 9 aa, Homo Sapiens
AKDPANDRQ

SEQ ID NO: 372967 - protein, 9 aa, Homo Sapiens
EKQEEDRVT

SEQ ID NO: 372968 - protein, 9 aa, Homo Sapiens
EHAMIGNNM

SEQ ID NO: 372969 - protein, 9 aa, Homo Sapiens
NQFFHDVDV

SEQ ID NO: 372970 - protein, 9 aa, Homo Sapiens
QATRLLCLH

SEQ ID NO: 372971 - protein, 9 aa, Homo Sapiens
PPTALWEGR

SEQ ID NO: 372972 - protein, 9 aa, Homo Sapiens
VSFVGQIST

SEQ ID NO: 372973 - protein, 9 aa, Homo Sapiens
GKCFLLAVD

SEQ ID NO: 372974 - protein, 9 aa, Homo Sapiens
HVHHEKLQS

SEQ ID NO: 372975 - protein, 9 aa, Homo Sapiens
KSKIVSLML

SEQ ID NO: 372976 - protein, 9 aa, Homo Sapiens
PAKRGKRRR

SEQ ID NO: 372977 - protein, 9 aa, Homo Sapiens
GFTIMRDFF

SEQ ID NO: 372978 - protein, 9 aa, Homo Sapiens
EDKKNGIWE

SEQ ID NO: 372979 - protein, 9 aa, Homo Sapiens
RWNPLRRTR

SEQ ID NO: 372980 - protein, 9 aa, Homo Sapiens
HVGQVPQVL

SEQ ID NO: 372981 - protein, 9 aa, Homo Sapiens
TITDYFPGT

SEQ ID NO: 372982 - protein, 9 aa, Homo Sapiens
LLLLLGAPG

SEQ ID NO: 372983 - protein, 9 aa, Homo Sapiens
DTGSNDAHD

SEQ ID NO: 372984 - protein, 9 aa, Homo Sapiens
AAPGWPPLL

SEQ ID NO: 372985 - protein, 9 aa, Homo Sapiens
SPHSSVHSE

SEQ ID NO: 372986 - protein, 9 aa, Homo Sapiens
VGSDAYCLS

SEQ ID NO: 372987 - protein, 9 aa, Homo Sapiens
YILMRFLTY

SEQ ID NO: 372988 - protein, 9 aa, Homo Sapiens
QPWLSPICR

SEQ ID NO: 372989 - protein, 9 aa, Homo Sapiens
DVYSYFAQD

SEQ ID NO: 372990 - protein, 9 aa, Homo Sapiens
RPLPLQPSR

SEQ ID NO: 372991 - protein, 9 aa, Homo Sapiens
APAEGKCLS

SEQ ID NO: 372992 - protein, 9 aa, Homo Sapiens
RCPTHPGPP

SEQ ID NO: 372993 - protein, 9 aa, Homo Sapiens
CFGQTSISV

SEQ ID NO: 372994 - protein, 9 aa, Homo Sapiens
ENNVLRHRK

SEQ ID NO: 372995 - protein, 9 aa, Homo Sapiens
HLRHTQILH

SEQ ID NO: 372996 - protein, 9 aa, Homo Sapiens
GDPCLYRWL

SEQ ID NO: 372997 - protein, 9 aa, Homo Sapiens
SFLCFFYLL

SEQ ID NO: 372998 - protein, 9 aa, Homo Sapiens
SGVEQPSTQ

SEQ ID NO: 372999 - protein, 9 aa, Homo Sapiens
LNPPIKNQN

SEQ ID NO: 373000 - protein, 9 aa, Homo Sapiens
VLGHGALVD

SEQ ID NO: 373001 - protein, 9 aa, Homo Sapiens
VSRVRPCAS

SEQ ID NO: 373002 - protein, 9 aa, Homo Sapiens
RIEEQSQTV

SEQ ID NO: 373003 - protein, 9 aa, Homo Sapiens
FVSRAPKHC

SEQ ID NO: 373004 - protein, 9 aa, Homo Sapiens
LFLKDNGLM

SEQ ID NO: 373005 - protein, 9 aa, Homo Sapiens
LLDPYVNLT

SEQ ID NO: 373006 - protein, 9 aa, Homo Sapiens
FPAVLCWFA

SEQ ID NO: 373007 - protein, 9 aa, Homo Sapiens
WWNVLPLSC

SEQ ID NO: 373008 - protein, 9 aa, Homo Sapiens
FISFNGSWM

SEQ ID NO: 373009 - protein, 9 aa, Homo Sapiens
DEKLLVRGT

SEQ ID NO: 373010 - protein, 9 aa, Homo Sapiens
TLLNAPRPW

SEQ ID NO: 373011 - protein, 9 aa, Homo Sapiens
ANIARSGDA

SEQ ID NO: 373012 - protein, 9 aa, Homo Sapiens
DWCSVPVES

SEQ ID NO: 373013 - protein, 9 aa, Homo Sapiens
ISGRNVNVH

SEQ ID NO: 373014 - protein, 9 aa, Homo Sapiens
LRARWSTSF

SEQ ID NO: 373015 - protein, 9 aa, Homo Sapiens
RTRETLESG

SEQ ID NO: 373016 - protein, 9 aa, Homo Sapiens
KALNVNCVD

SEQ ID NO: 373017 - protein, 9 aa, Homo Sapiens
ALDQCFSRL

SEQ ID NO: 373018 - protein, 9 aa, Homo Sapiens
YCLISVEQE

SEQ ID NO: 373019 - protein, 9 aa, Homo Sapiens
KALLVLLSG

SEQ ID NO: 373020 - protein, 9 aa, Homo Sapiens
VDSSGPLEK

SEQ ID NO: 373021 - protein, 9 aa, Homo Sapiens
KNGFIFGHA

SEQ ID NO: 373022 - protein, 9 aa, Homo Sapiens
SFINSLASH

SEQ ID NO: 373023 - protein, 9 aa, Homo Sapiens
QEEDQSIII

SEQ ID NO: 373024 - protein, 9 aa, Homo Sapiens
KKNGIWEVM

SEQ ID NO: 373025 - protein, 9 aa, Homo Sapiens
PNGLTQMPP

SEQ ID NO: 373026 - protein, 9 aa, Homo Sapiens
STSSHLILL

SEQ ID NO: 373027 - protein, 9 aa, Homo Sapiens
YRPGLVIGP

SEQ ID NO: 373028 - protein, 9 aa, Homo Sapiens
RHVGLLLRR

SEQ ID NO: 373029 - protein, 9 aa, Homo Sapiens
GDKIVVVVW

SEQ ID NO: 373030 - protein, 9 aa, Homo Sapiens
ALTITGNGV

SEQ ID NO: 373031 - protein, 9 aa, Homo Sapiens
GMRNHENSS

SEQ ID NO: 373032 - protein, 9 aa, Homo Sapiens
LLLRHPAAR

SEQ ID NO: 373033 - protein, 9 aa, Homo Sapiens
VGALAAAGT

SEQ ID NO: 373034 - protein, 9 aa, Homo Sapiens
HLTVVTFTM

SEQ ID NO: 373035 - protein, 9 aa, Homo Sapiens
LMPPPGLRP

SEQ ID NO: 373036 - protein, 9 aa, Homo Sapiens
EKENRDLEK

SEQ ID NO: 373037 - protein, 9 aa, Homo Sapiens
CRNILPPEK

SEQ ID NO: 373038 - protein, 9 aa, Homo Sapiens
KVDNVEALD

SEQ ID NO: 373039 - protein, 9 aa, Homo Sapiens
KQAAQEEKQ

SEQ ID NO: 373040 - protein, 9 aa, Homo Sapiens
KHIQEEKKI

SEQ ID NO: 373041 - protein, 9 aa, Homo Sapiens
LHSLLDPSP

SEQ ID NO: 373042 - protein, 9 aa, Homo Sapiens
YEILPCGVD

SEQ ID NO: 373043 - protein, 9 aa, Homo Sapiens
PERGRVGGP

SEQ ID NO: 373044 - protein, 9 aa, Homo Sapiens
EEPTIGSIM

SEQ ID NO: 373045 - protein, 9 aa, Homo Sapiens
LCLRWITPT

SEQ ID NO: 373046 - protein, 9 aa, Homo Sapiens
RLALRAWWL

SEQ ID NO: 373047 - protein, 9 aa, Homo Sapiens
TWVRYVEFY

SEQ ID NO: 373048 - protein, 9 aa, Homo Sapiens
IGANGFTGL

SEQ ID NO: 373049 - protein, 9 aa, Homo Sapiens
WNTSLLQTQ

SEQ ID NO: 373050 - protein, 9 aa, Homo Sapiens
VVGHGSRMV

SEQ ID NO: 373051 - protein, 9 aa, Homo Sapiens
WEQKATVII

SEQ ID NO: 373052 - protein, 9 aa, Homo Sapiens
VQNIARQLY

SEQ ID NO: 373053 - protein, 9 aa, Homo Sapiens
LACSITVSF

SEQ ID NO: 373054 - protein, 9 aa, Homo Sapiens
VRLSWEYWQ

SEQ ID NO: 373055 - protein, 9 aa, Homo Sapiens
SSEGVCFLN

SEQ ID NO: 373056 - protein, 9 aa, Homo Sapiens
GLATEKSRW

SEQ ID NO: 373057 - protein, 9 aa, Homo Sapiens
AEDDIADPF

SEQ ID NO: 373058 - protein, 9 aa, Homo Sapiens
PGERHRSRH

SEQ ID NO: 373059 - protein, 9 aa, Homo Sapiens
AAGTSARPS

SEQ ID NO: 373060 - protein, 9 aa, Homo Sapiens
CVATNSAGM

SEQ ID NO: 373061 - protein, 9 aa, Homo Sapiens
MDHLVQQGI

SEQ ID NO: 373062 - protein, 9 aa, Homo Sapiens
SISEHVCWN

SEQ ID NO: 373063 - protein, 9 aa, Homo Sapiens
VGSALRLSP

SEQ ID NO: 373064 - protein, 9 aa, Homo Sapiens
SPSVASFQM

SEQ ID NO: 373065 - protein, 9 aa, Homo Sapiens
KCKEIKTTS

SEQ ID NO: 373066 - protein, 9 aa, Homo Sapiens
VDNVEALDH

SEQ ID NO: 373067 - protein, 9 aa, Homo Sapiens
IWVLFEDPY

SEQ ID NO: 373068 - protein, 9 aa, Homo Sapiens
LSCVTCFRA

SEQ ID NO: 373069 - protein, 9 aa, Homo Sapiens
LWRRNPAGL

SEQ ID NO: 373070 - protein, 9 aa, Homo Sapiens
QSAKSPTVT

SEQ ID NO: 373071 - protein, 9 aa, Homo Sapiens
CRPRVTPGP

SEQ ID NO: 373072 - protein, 9 aa, Homo Sapiens
LPGPHAWTS

SEQ ID NO: 373073 - protein, 9 aa, Homo Sapiens
HITAFTEVT

SEQ ID NO: 373074 - protein, 9 aa, Homo Sapiens
GGREGRDCS

SEQ ID NO: 373075 - protein, 9 aa, Homo Sapiens
LLGVNVVIG

SEQ ID NO: 373076 - protein, 9 aa, Homo Sapiens
SSYRCTCAR

SEQ ID NO: 373077 - protein, 9 aa, Homo Sapiens
PAAGWAARW

SEQ ID NO: 373078 - protein, 9 aa, Homo Sapiens
NEIRMVAAG

SEQ ID NO: 373079 - protein, 9 aa, Homo Sapiens
LPERRCSRR

SEQ ID NO: 373080 - protein, 9 aa, Homo Sapiens
ISGPHASIN

SEQ ID NO: 373081 - protein, 9 aa, Homo Sapiens
LMKHPFIRN

SEQ ID NO: 373082 - protein, 9 aa, Homo Sapiens
NEIKGEQFT

SEQ ID NO: 373083 - protein, 9 aa, Homo Sapiens
QSRGGNMAP

SEQ ID NO: 373084 - protein, 9 aa, Homo Sapiens
QDQELATVL

SEQ ID NO: 373085 - protein, 9 aa, Homo Sapiens
WNHAVGPST

SEQ ID NO: 373086 - protein, 9 aa, Homo Sapiens
GITFFRPGA

SEQ ID NO: 373087 - protein, 9 aa, Homo Sapiens
RPWWNVLPL

SEQ ID NO: 373088 - protein, 9 aa, Homo Sapiens
WEPRRTLSR

SEQ ID NO: 373089 - protein, 9 aa, Homo Sapiens
RGGHPQPRP

SEQ ID NO: 373090 - protein, 9 aa, Homo Sapiens
APPSAPGSA

SEQ ID NO: 373091 - protein, 9 aa, Homo Sapiens
SQTTDAIFA

SEQ ID NO: 373092 - protein, 9 aa, Homo Sapiens
VDVEDVLPS

SEQ ID NO: 373093 - protein, 9 aa, Homo Sapiens
ILGLPGGLK

SEQ ID NO: 373094 - protein, 9 aa, Homo Sapiens
MGQDCYTRI

SEQ ID NO: 373095 - protein, 9 aa, Homo Sapiens
PICRTGSHA

SEQ ID NO: 373096 - protein, 9 aa, Homo Sapiens
ATTDDIRAL

SEQ ID NO: 373097 - protein, 9 aa, Homo Sapiens
HHEKLQSHV

SEQ ID NO: 373098 - protein, 9 aa, Homo Sapiens
ERYGKDFTD

SEQ ID NO: 373099 - protein, 9 aa, Homo Sapiens
VPVAPDGPV

SEQ ID NO: 373100 - protein, 9 aa, Homo Sapiens
RPTMEAPQR

SEQ ID NO: 373101 - protein, 9 aa, Homo Sapiens
LPLINSSAC

SEQ ID NO: 373102 - protein, 9 aa, Homo Sapiens
EDQVLDADC

SEQ ID NO: 373103 - protein, 9 aa, Homo Sapiens
SGLLLRHPA

SEQ ID NO: 373104 - protein, 9 aa, Homo Sapiens
PKPGDGEYK

SEQ ID NO: 373105 - protein, 9 aa, Homo Sapiens
ATVCWPCSS

SEQ ID NO: 373106 - protein, 9 aa, Homo Sapiens
ATRPEGWRS

SEQ ID NO: 373107 - protein, 9 aa, Homo Sapiens
FGNSCIKLW

SEQ ID NO: 373108 - protein, 9 aa, Homo Sapiens
SRRKQHLPP

SEQ ID NO: 373109 - protein, 9 aa, Homo Sapiens
GAPGQASPT

SEQ ID NO: 373110 - protein, 9 aa, Homo Sapiens
KCITECVRT

SEQ ID NO: 373111 - protein, 9 aa, Homo Sapiens
NRSLGALEP

SEQ ID NO: 373112 - protein, 9 aa, Homo Sapiens
HQRPWWNVL

SEQ ID NO: 373113 - protein, 9 aa, Homo Sapiens
SPWLTGLLP

SEQ ID NO: 373114 - protein, 9 aa, Homo Sapiens
SKLNGAINH

SEQ ID NO: 373115 - protein, 9 aa, Homo Sapiens
STWLSLWSH

SEQ ID NO: 373116 - protein, 9 aa, Homo Sapiens
KRIAIEYPY

SEQ ID NO: 373117 - protein, 9 aa, Homo Sapiens
RWHSDDDDD

SEQ ID NO: 373118 - protein, 9 aa, Homo Sapiens
TKRPPSEAA

SEQ ID NO: 373119 - protein, 9 aa, Homo Sapiens
NGGQRRESG

SEQ ID NO: 373120 - protein, 9 aa, Homo Sapiens
LKTRSWQSS

SEQ ID NO: 373121 - protein, 9 aa, Homo Sapiens
LYKDLRDGC

SEQ ID NO: 373122 - protein, 9 aa, Homo Sapiens
NTILHPEII

SEQ ID NO: 373123 - protein, 9 aa, Homo Sapiens
GAHVYSQVT

SEQ ID NO: 373124 - protein, 9 aa, Homo Sapiens
QPLVSSRDY

SEQ ID NO: 373125 - protein, 9 aa, Homo Sapiens
GREGRDCSD

SEQ ID NO: 373126 - protein, 9 aa, Homo Sapiens
LGPCIGPVS

SEQ ID NO: 373127 - protein, 9 aa, Homo Sapiens
LSLKQGKVP

SEQ ID NO: 373128 - protein, 9 aa, Homo Sapiens
FMKAMQLEQ

SEQ ID NO: 373129 - protein, 9 aa, Homo Sapiens
PAGRSVARQ

SEQ ID NO: 373130 - protein, 9 aa, Homo Sapiens
SDLEKKKER

SEQ ID NO: 373131 - protein, 9 aa, Homo Sapiens
LCFLLTLPP

SEQ ID NO: 373132 - protein, 9 aa, Homo Sapiens
RHRGLVDGW

SEQ ID NO: 373133 - protein, 9 aa, Homo Sapiens
RHTQILHRV

SEQ ID NO: 373134 - protein, 9 aa, Homo Sapiens
CLAASMAAP

SEQ ID NO: 373135 - protein, 9 aa, Homo Sapiens
ILLQRNLLR

SEQ ID NO: 373136 - protein, 9 aa, Homo Sapiens
RNAHLVRHQ

SEQ ID NO: 373137 - protein, 9 aa, Homo Sapiens
EKIIVEQIE

SEQ ID NO: 373138 - protein, 9 aa, Homo Sapiens
YGLQEKSVA

SEQ ID NO: 373139 - protein, 9 aa, Homo Sapiens
DPNLLRQFL

SEQ ID NO: 373140 - protein, 9 aa, Homo Sapiens
TDFRESCCC

SEQ ID NO: 373141 - protein, 9 aa, Homo Sapiens
LEKDKMIHQ

SEQ ID NO: 373142 - protein, 9 aa, Homo Sapiens
EDSYTPEAL

SEQ ID NO: 373143 - protein, 9 aa, Homo Sapiens
IFRFCGPLV

SEQ ID NO: 373144 - protein, 9 aa, Homo Sapiens
SWPQRLLWQ

SEQ ID NO: 373145 - protein, 9 aa, Homo Sapiens
DWHGEQSLY

SEQ ID NO: 373146 - protein, 9 aa, Homo Sapiens
NILPPEKEL

SEQ ID NO: 373147 - protein, 9 aa, Homo Sapiens
MQVRALLLA

SEQ ID NO: 373148 - protein, 9 aa, Homo Sapiens
EISHQLIMA

SEQ ID NO: 373149 - protein, 9 aa, Homo Sapiens
PAACSLDLH

SEQ ID NO: 373150 - protein, 9 aa, Homo Sapiens
CQATVRETK

SEQ ID NO: 373151 - protein, 9 aa, Homo Sapiens
GSLGHITFG

SEQ ID NO: 373152 - protein, 9 aa, Homo Sapiens
MDLRVYGPA

SEQ ID NO: 373153 - protein, 9 aa, Homo Sapiens
SFVGQISTL

SEQ ID NO: 373154 - protein, 9 aa, Homo Sapiens
ACHQSPTLL

SEQ ID NO: 373155 - protein, 9 aa, Homo Sapiens
KKMFLIQRE

SEQ ID NO: 373156 - protein, 9 aa, Homo Sapiens
VVIEFDQNI

SEQ ID NO: 373157 - protein, 9 aa, Homo Sapiens
NLKCFLKTR

SEQ ID NO: 373158 - protein, 9 aa, Homo Sapiens
RRRWSSPTG

SEQ ID NO: 373159 - protein, 9 aa, Homo Sapiens
IPCPPQSTS

SEQ ID NO: 373160 - protein, 9 aa, Homo Sapiens
TVAVADIIP

SEQ ID NO: 373161 - protein, 9 aa, Homo Sapiens
EQRLWHGGR

SEQ ID NO: 373162 - protein, 9 aa, Homo Sapiens
KPREPGKRR

SEQ ID NO: 373163 - protein, 9 aa, Homo Sapiens
RYSMGLLDM

SEQ ID NO: 373164 - protein, 9 aa, Homo Sapiens
DPYVNLTPG

SEQ ID NO: 373165 - protein, 9 aa, Homo Sapiens
EGLMRKETV

SEQ ID NO: 373166 - protein, 9 aa, Homo Sapiens
HSFVSGGGG

SEQ ID NO: 373167 - protein, 9 aa, Homo Sapiens
AQEEKQKQR

SEQ ID NO: 373168 - protein, 9 aa, Homo Sapiens
RNLKCFLKT

SEQ ID NO: 373169 - protein, 9 aa, Homo Sapiens
VAAMGQDCY

SEQ ID NO: 373170 - protein, 9 aa, Homo Sapiens
IPRPQDGFA

SEQ ID NO: 373171 - protein, 9 aa, Homo Sapiens
AKKIWKYFG

SEQ ID NO: 373172 - protein, 9 aa, Homo Sapiens
RGKSQGGRI

SEQ ID NO: 373173 - protein, 9 aa, Homo Sapiens
TFTMHLLST

SEQ ID NO: 373174 - protein, 9 aa, Homo Sapiens
ASWPQRLLW

SEQ ID NO: 373175 - protein, 9 aa, Homo Sapiens
EESKKNPSP

SEQ ID NO: 373176 - protein, 9 aa, Homo Sapiens
RSSARSRRR

SEQ ID NO: 373177 - protein, 9 aa, Homo Sapiens
CGFPSEKDF

SEQ ID NO: 373178 - protein, 9 aa, Homo Sapiens
SDPSLGTHS

SEQ ID NO: 373179 - protein, 9 aa, Homo Sapiens
CCIVQHVGL

SEQ ID NO: 373180 - protein, 9 aa, Homo Sapiens
MSSHLRACK

SEQ ID NO: 373181 - protein, 9 aa, Homo Sapiens
DNDCEVLGE

SEQ ID NO: 373182 - protein, 9 aa, Homo Sapiens
PIEPRDHNE

SEQ ID NO: 373183 - protein, 9 aa, Homo Sapiens
LENNEVRVQ

SEQ ID NO: 373184 - protein, 9 aa, Homo Sapiens
RAAGTTFTL

SEQ ID NO: 373185 - protein, 9 aa, Homo Sapiens
SGWISGSEA

SEQ ID NO: 373186 - protein, 9 aa, Homo Sapiens
TPKPKPSNL

SEQ ID NO: 373187 - protein, 9 aa, Homo Sapiens
RVLWPCSAT

SEQ ID NO: 373188 - protein, 9 aa, Homo Sapiens
KAKVEREAS

SEQ ID NO: 373189 - protein, 9 aa, Homo Sapiens
RSEFYSLQE

SEQ ID NO: 373190 - protein, 9 aa, Homo Sapiens
FQKKDYVQT

SEQ ID NO: 373191 - protein, 9 aa, Homo Sapiens
GVEPASNGL

SEQ ID NO: 373192 - protein, 9 aa, Homo Sapiens
IRELWNTSL

SEQ ID NO: 373193 - protein, 9 aa, Homo Sapiens
CRLSSDPSR

SEQ ID NO: 373194 - protein, 9 aa, Homo Sapiens
PSTSTLANL

SEQ ID NO: 373195 - protein, 9 aa, Homo Sapiens
STEWWTMVC

SEQ ID NO: 373196 - protein, 9 aa, Homo Sapiens
DLDQSFSFH

SEQ ID NO: 373197 - protein, 9 aa, Homo Sapiens
KGSKKTLLK

SEQ ID NO: 373198 - protein, 9 aa, Homo Sapiens
SSTRVPLWP

SEQ ID NO: 373199 - protein, 9 aa, Homo Sapiens
PGPILRTLR

SEQ ID NO: 373200 - protein, 9 aa, Homo Sapiens
RGLPLPPPV

SEQ ID NO: 373201 - protein, 9 aa, Homo Sapiens
VVVIRTANT

SEQ ID NO: 373202 - protein, 9 aa, Homo Sapiens
EHVPLGNLS

SEQ ID NO: 373203 - protein, 9 aa, Homo Sapiens
RIAAQAVTN

SEQ ID NO: 373204 - protein, 9 aa, Homo Sapiens
EDVENFYLM

SEQ ID NO: 373205 - protein, 9 aa, Homo Sapiens
NLSHMMIRF

SEQ ID NO: 373206 - protein, 9 aa, Homo Sapiens
PLLRAGFNR

SEQ ID NO: 373207 - protein, 9 aa, Homo Sapiens
DKNLCNKPV

SEQ ID NO: 373208 - protein, 9 aa, Homo Sapiens
WRLRLPDCS

SEQ ID NO: 373209 - protein, 9 aa, Homo Sapiens
ANKLLQNLA

SEQ ID NO: 373210 - protein, 9 aa, Homo Sapiens
PRVTPAPPP

SEQ ID NO: 373211 - protein, 9 aa, Homo Sapiens
GTSDFTRSS

SEQ ID NO: 373212 - protein, 9 aa, Homo Sapiens
LTASTANLS

SEQ ID NO: 373213 - protein, 9 aa, Homo Sapiens
TCPCRWTAP

SEQ ID NO: 373214 - protein, 9 aa, Homo Sapiens
SACDGLLSR

SEQ ID NO: 373215 - protein, 9 aa, Homo Sapiens
IIMVTRCEE

SEQ ID NO: 373216 - protein, 9 aa, Homo Sapiens
EEQSQTVKC

SEQ ID NO: 373217 - protein, 9 aa, Homo Sapiens
LVDGWRGWT

SEQ ID NO: 373218 - protein, 9 aa, Homo Sapiens
MTIIVPIDG

SEQ ID NO: 373219 - protein, 9 aa, Homo Sapiens
VARQAQTVF

SEQ ID NO: 373220 - protein, 9 aa, Homo Sapiens
TGTASGGTE

SEQ ID NO: 373221 - protein, 9 aa, Homo Sapiens
WEPVPLKSI

SEQ ID NO: 373222 - protein, 9 aa, Homo Sapiens
FKNKMAEGE

SEQ ID NO: 373223 - protein, 9 aa, Homo Sapiens
PPGASSGWA

SEQ ID NO: 373224 - protein, 9 aa, Homo Sapiens
STCPCRWTA

SEQ ID NO: 373225 - protein, 9 aa, Homo Sapiens
RRTNGASQT

SEQ ID NO: 373226 - protein, 9 aa, Homo Sapiens
KPVDVQVVT

SEQ ID NO: 373227 - protein, 9 aa, Homo Sapiens
SDGSSDSSS

SEQ ID NO: 373228 - protein, 9 aa, Homo Sapiens
IPQEQLTMS

SEQ ID NO: 373229 - protein, 9 aa, Homo Sapiens
RHIKKFLDK

SEQ ID NO: 373230 - protein, 9 aa, Homo Sapiens
PWAVYTAME

SEQ ID NO: 373231 - protein, 9 aa, Homo Sapiens
PLAPWAWGC

SEQ ID NO: 373232 - protein, 9 aa, Homo Sapiens
GGKLSTVCR

SEQ ID NO: 373233 - protein, 9 aa, Homo Sapiens
VWYTCSMTS

SEQ ID NO: 373234 - protein, 9 aa, Homo Sapiens
CPPQSTSNI

SEQ ID NO: 373235 - protein, 9 aa, Homo Sapiens
TVSGGTTSS

SEQ ID NO: 373236 - protein, 9 aa, Homo Sapiens
SGSCSAPIK

SEQ ID NO: 373237 - protein, 9 aa, Homo Sapiens
WTAPSSPPS

SEQ ID NO: 373238 - protein, 9 aa, Homo Sapiens
LDVDTLILV

SEQ ID NO: 373239 - protein, 9 aa, Homo Sapiens
AVSLVSGPT

SEQ ID NO: 373240 - protein, 9 aa, Homo Sapiens
SASATSASG

SEQ ID NO: 373241 - protein, 9 aa, Homo Sapiens
QKGRPLPEN

SEQ ID NO: 373242 - protein, 9 aa, Homo Sapiens
TMKLNISDT

SEQ ID NO: 373243 - protein, 9 aa, Homo Sapiens
DFGFVEIGS

SEQ ID NO: 373244 - protein, 9 aa, Homo Sapiens
AEWKLSVFA

SEQ ID NO: 373245 - protein, 9 aa, Homo Sapiens
RAPPEAPLT

SEQ ID NO: 373246 - protein, 9 aa, Homo Sapiens
TSNFGFSRL

SEQ ID NO: 373247 - protein, 9 aa, Homo Sapiens
DFGLATEKS

SEQ ID NO: 373248 - protein, 9 aa, Homo Sapiens
QLLEGMDHL

SEQ ID NO: 373249 - protein, 9 aa, Homo Sapiens
CCHAATLAR

SEQ ID NO: 373250 - protein, 9 aa, Homo Sapiens
THFPRGSSS

SEQ ID NO: 373251 - protein, 9 aa, Homo Sapiens
LTKEASVDL

SEQ ID NO: 373252 - protein, 9 aa, Homo Sapiens
FSWLLNPER

SEQ ID NO: 373253 - protein, 9 aa, Homo Sapiens
PGIDLSPVY

SEQ ID NO: 373254 - protein, 9 aa, Homo Sapiens
DKLKSQISE

SEQ ID NO: 373255 - protein, 9 aa, Homo Sapiens
YALFPQRRT

SEQ ID NO: 373256 - protein, 9 aa, Homo Sapiens
SRSPFGSCW

SEQ ID NO: 373257 - protein, 9 aa, Homo Sapiens
GVAEKFAIT

SEQ ID NO: 373258 - protein, 9 aa, Homo Sapiens
LSGLELAIT

SEQ ID NO: 373259 - protein, 9 aa, Homo Sapiens
LAELCNQSV

SEQ ID NO: 373260 - protein, 9 aa, Homo Sapiens
GARPACPKV

SEQ ID NO: 373261 - protein, 9 aa, Homo Sapiens
HPVTIWGKI

SEQ ID NO: 373262 - protein, 9 aa, Homo Sapiens
FAFSTRLAV

SEQ ID NO: 373263 - protein, 9 aa, Homo Sapiens
KMLYMEEIQ

SEQ ID NO: 373264 - protein, 9 aa, Homo Sapiens
GGLGGSRGL

SEQ ID NO: 373265 - protein, 9 aa, Homo Sapiens
ANVGDPSKS

SEQ ID NO: 373266 - protein, 9 aa, Homo Sapiens
GPGDFDVPG

SEQ ID NO: 373267 - protein, 9 aa, Homo Sapiens
SGQQQQQQQ

SEQ ID NO: 373268 - protein, 9 aa, Homo Sapiens
NGAEVSKKK

SEQ ID NO: 373269 - protein, 9 aa, Homo Sapiens
DYFLFFGTR

SEQ ID NO: 373270 - protein, 9 aa, Homo Sapiens
TDDLQSKTN

SEQ ID NO: 373271 - protein, 9 aa, Homo Sapiens
VESGDIIHL

SEQ ID NO: 373272 - protein, 9 aa, Homo Sapiens
QTGVGAKKE

SEQ ID NO: 373273 - protein, 9 aa, Homo Sapiens
VCNLALRMM

SEQ ID NO: 373274 - protein, 9 aa, Homo Sapiens
PWEDGFETE

SEQ ID NO: 373275 - protein, 9 aa, Homo Sapiens
KVVTCFPPV

SEQ ID NO: 373276 - protein, 9 aa, Homo Sapiens
ITRFAFSTR

SEQ ID NO: 373277 - protein, 9 aa, Homo Sapiens
VREEYPDCI

SEQ ID NO: 373278 - protein, 9 aa, Homo Sapiens
LNPRRSCPT

SEQ ID NO: 373279 - protein, 9 aa, Homo Sapiens
HLMEKMKTT

SEQ ID NO: 373280 - protein, 9 aa, Homo Sapiens
APPGPPQQQ

SEQ ID NO: 373281 - protein, 9 aa, Homo Sapiens
KNLCNKPVA

SEQ ID NO: 373282 - protein, 9 aa, Homo Sapiens
RSCLWEERL

SEQ ID NO: 373283 - protein, 9 aa, Homo Sapiens
FYQPPRAQN

SEQ ID NO: 373284 - protein, 9 aa, Homo Sapiens
RTDEDRQEI

SEQ ID NO: 373285 - protein, 9 aa, Homo Sapiens
GCPTTPPTP

SEQ ID NO: 373286 - protein, 9 aa, Homo Sapiens
LLVRGTMQP

SEQ ID NO: 373287 - protein, 9 aa, Homo Sapiens
LGSPPDLES

SEQ ID NO: 373288 - protein, 9 aa, Homo Sapiens
HEVPHAQRH

SEQ ID NO: 373289 - protein, 9 aa, Homo Sapiens
ECGKTFSRM

SEQ ID NO: 373290 - protein, 9 aa, Homo Sapiens
LSAQYGIGY

SEQ ID NO: 373291 - protein, 9 aa, Homo Sapiens
RMMTLNLKD

SEQ ID NO: 373292 - protein, 9 aa, Homo Sapiens
ADNRIITLQ

SEQ ID NO: 373293 - protein, 9 aa, Homo Sapiens
QQEGGSLQV

SEQ ID NO: 373294 - protein, 9 aa, Homo Sapiens
KEIKCFLTM

SEQ ID NO: 373295 - protein, 9 aa, Homo Sapiens
REEYPDCIM

SEQ ID NO: 373296 - protein, 9 aa, Homo Sapiens
KGEQFTVLE

SEQ ID NO: 373297 - protein, 9 aa, Homo Sapiens
QALWQGRAL

SEQ ID NO: 373298 - protein, 9 aa, Homo Sapiens
LTGLLPKGP

SEQ ID NO: 373299 - protein, 9 aa, Homo Sapiens
IVPLAAKVN

SEQ ID NO: 373300 - protein, 9 aa, Homo Sapiens
ETERTENRE

SEQ ID NO: 373301 - protein, 9 aa, Homo Sapiens
ENRDLEKII

SEQ ID NO: 373302 - protein, 9 aa, Homo Sapiens
PGVGSFLLH

SEQ ID NO: 373303 - protein, 9 aa, Homo Sapiens
VYLTKGHSH

SEQ ID NO: 373304 - protein, 9 aa, Homo Sapiens
DKSMTVGLT

SEQ ID NO: 373305 - protein, 9 aa, Homo Sapiens
DLCQPYRSE

SEQ ID NO: 373306 - protein, 9 aa, Homo Sapiens
HECDPGGVG

SEQ ID NO: 373307 - protein, 9 aa, Homo Sapiens
GCWRWSCGA

SEQ ID NO: 373308 - protein, 9 aa, Homo Sapiens
KQLTAPPAA

SEQ ID NO: 373309 - protein, 9 aa, Homo Sapiens
EGIGEELVI

SEQ ID NO: 373310 - protein, 9 aa, Homo Sapiens
RLHWLPCAQ

SEQ ID NO: 373311 - protein, 9 aa, Homo Sapiens
TPGLAREEA

SEQ ID NO: 373312 - protein, 9 aa, Homo Sapiens
HLDIREAAQ

SEQ ID NO: 373313 - protein, 9 aa, Homo Sapiens
FGFSRLRKI

SEQ ID NO: 373314 - protein, 9 aa, Homo Sapiens
NAPRPWAPV

SEQ ID NO: 373315 - protein, 9 aa, Homo Sapiens
GKADPKRDR

SEQ ID NO: 373316 - protein, 9 aa, Homo Sapiens
LCLFVFFSM

SEQ ID NO: 373317 - protein, 9 aa, Homo Sapiens
LANVVHQVQ

SEQ ID NO: 373318 - protein, 9 aa, Homo Sapiens
SGDIIHLEG

SEQ ID NO: 373319 - protein, 9 aa, Homo Sapiens
LFTHFAEAG

SEQ ID NO: 373320 - protein, 9 aa, Homo Sapiens
LNLTKWQKH

SEQ ID NO: 373321 - protein, 9 aa, Homo Sapiens
CSPAPTPRT

SEQ ID NO: 373322 - protein, 9 aa, Homo Sapiens
AMITLNNSI

SEQ ID NO: 373323 - protein, 9 aa, Homo Sapiens
KDATKEFST

SEQ ID NO: 373324 - protein, 9 aa, Homo Sapiens
GLGLENRQD

SEQ ID NO: 373325 - protein, 9 aa, Homo Sapiens
GKELLARSN

SEQ ID NO: 373326 - protein, 9 aa, Homo Sapiens
QPRTESPPP

SEQ ID NO: 373327 - protein, 9 aa, Homo Sapiens
LVESGQVPK

SEQ ID NO: 373328 - protein, 9 aa, Homo Sapiens
GGTTSSSGT

SEQ ID NO: 373329 - protein, 9 aa, Homo Sapiens
AAPFQSMQS

SEQ ID NO: 373330 - protein, 9 aa, Homo Sapiens
VVVLMVMGI

SEQ ID NO: 373331 - protein, 9 aa, Homo Sapiens
NEGRLLYHA

SEQ ID NO: 373332 - protein, 9 aa, Homo Sapiens
VCKVMHPKG

SEQ ID NO: 373333 - protein, 9 aa, Homo Sapiens
GRHVSLRIC

SEQ ID NO: 373334 - protein, 9 aa, Homo Sapiens
ADAAAAGFP

SEQ ID NO: 373335 - protein, 9 aa, Homo Sapiens
DMPTIYQKN

SEQ ID NO: 373336 - protein, 9 aa, Homo Sapiens
AIASLIGME

SEQ ID NO: 373337 - protein, 9 aa, Homo Sapiens
VDTLILVEV

SEQ ID NO: 373338 - protein, 9 aa, Homo Sapiens
ISYLISLKM

SEQ ID NO: 373339 - protein, 9 aa, Homo Sapiens
KFRLQLPID

SEQ ID NO: 373340 - protein, 9 aa, Homo Sapiens
VEVNFIKKI

SEQ ID NO: 373341 - protein, 9 aa, Homo Sapiens
RCACSHPCA

SEQ ID NO: 373342 - protein, 9 aa, Homo Sapiens
FFMKAMQLE

SEQ ID NO: 373343 - protein, 9 aa, Homo Sapiens
ENLVDLQKK

SEQ ID NO: 373344 - protein, 9 aa, Homo Sapiens
LFKQLSCST

SEQ ID NO: 373345 - protein, 9 aa, Homo Sapiens
ALHVPDVSL

SEQ ID NO: 373346 - protein, 9 aa, Homo Sapiens
PSMIQEVWT

SEQ ID NO: 373347 - protein, 9 aa, Homo Sapiens
YLISLKMNS

SEQ ID NO: 373348 - protein, 9 aa, Homo Sapiens
LWHGGRELS

SEQ ID NO: 373349 - protein, 9 aa, Homo Sapiens
SQCRLFEEP

SEQ ID NO: 373350 - protein, 9 aa, Homo Sapiens
AMGQDCYTR

SEQ ID NO: 373351 - protein, 9 aa, Homo Sapiens
PPSASSPVS

SEQ ID NO: 373352 - protein, 9 aa, Homo Sapiens
CVDPTRVNE

SEQ ID NO: 373353 - protein, 9 aa, Homo Sapiens
KTLLEFLER

SEQ ID NO: 373354 - protein, 9 aa, Homo Sapiens
PPEKRFGHI

SEQ ID NO: 373355 - protein, 9 aa, Homo Sapiens
LVTGASVAP

SEQ ID NO: 373356 - protein, 9 aa, Homo Sapiens
AFPDDMDLR

SEQ ID NO: 373357 - protein, 9 aa, Homo Sapiens
HDQKPGRNK

SEQ ID NO: 373358 - protein, 9 aa, Homo Sapiens
QRLASRWHS

SEQ ID NO: 373359 - protein, 9 aa, Homo Sapiens
LPLSGEALS

SEQ ID NO: 373360 - protein, 9 aa, Homo Sapiens
GWNADGLAK

SEQ ID NO: 373361 - protein, 9 aa, Homo Sapiens
KMHTGERLY

SEQ ID NO: 373362 - protein, 9 aa, Homo Sapiens
TPTCRSPSR

SEQ ID NO: 373363 - protein, 9 aa, Homo Sapiens
KDGLLAYAF

SEQ ID NO: 373364 - protein, 9 aa, Homo Sapiens
ALGSWGQTD

SEQ ID NO: 373365 - protein, 9 aa, Homo Sapiens
VGSISEEEM

SEQ ID NO: 373366 - protein, 9 aa, Homo Sapiens
GNSCIKLWS

SEQ ID NO: 373367 - protein, 9 aa, Homo Sapiens
DGSRPEPQC

SEQ ID NO: 373368 - protein, 9 aa, Homo Sapiens
SLYGKKLVK

SEQ ID NO: 373369 - protein, 9 aa, Homo Sapiens
RTGAGQPGQ

SEQ ID NO: 373370 - protein, 9 aa, Homo Sapiens
SADRPERAA

SEQ ID NO: 373371 - protein, 9 aa, Homo Sapiens
LEKKCKEIK

SEQ ID NO: 373372 - protein, 9 aa, Homo Sapiens
SKERVLLPG

SEQ ID NO: 373373 - protein, 9 aa, Homo Sapiens
NIVFQYKET

SEQ ID NO: 373374 - protein, 9 aa, Homo Sapiens
SLAKSIDDT

SEQ ID NO: 373375 - protein, 9 aa, Homo Sapiens
ILPNFLKHD

SEQ ID NO: 373376 - protein, 9 aa, Homo Sapiens
PASPPTQQP

SEQ ID NO: 373377 - protein, 9 aa, Homo Sapiens
EFDQNIFTA

SEQ ID NO: 373378 - protein, 9 aa, Homo Sapiens
HKKFILERN

SEQ ID NO: 373379 - protein, 9 aa, Homo Sapiens
SHSDKTHTR

SEQ ID NO: 373380 - protein, 9 aa, Homo Sapiens
VTSMESFPP

SEQ ID NO: 373381 - protein, 9 aa, Homo Sapiens
YSTANFVKD

SEQ ID NO: 373382 - protein, 9 aa, Homo Sapiens
TYLISEAMR

SEQ ID NO: 373383 - protein, 9 aa, Homo Sapiens
RFMECLKVG

SEQ ID NO: 373384 - protein, 9 aa, Homo Sapiens
RRVWYTCSM

SEQ ID NO: 373385 - protein, 9 aa, Homo Sapiens
LVRMAMVPG

SEQ ID NO: 373386 - protein, 9 aa, Homo Sapiens
TGTQHFKEA

SEQ ID NO: 373387 - protein, 9 aa, Homo Sapiens
RLVLKELRN

SEQ ID NO: 373388 - protein, 9 aa, Homo Sapiens
LGAIPLSGI

SEQ ID NO: 373389 - protein, 9 aa, Homo Sapiens
HDTLYFPVL

SEQ ID NO: 373390 - protein, 9 aa, Homo Sapiens
RTWPLPGPH

SEQ ID NO: 373391 - protein, 9 aa, Homo Sapiens
DIWDFLCQL

SEQ ID NO: 373392 - protein, 9 aa, Homo Sapiens
VFRQETQAQ

SEQ ID NO: 373393 - protein, 9 aa, Homo Sapiens
LYHAHPYQH

SEQ ID NO: 373394 - protein, 9 aa, Homo Sapiens
AYETTAGAG

SEQ ID NO: 373395 - protein, 9 aa, Homo Sapiens
FVRRVNGTF

SEQ ID NO: 373396 - protein, 9 aa, Homo Sapiens
GTNYSQMPA

SEQ ID NO: 373397 - protein, 9 aa, Homo Sapiens
HLPKILYLH

SEQ ID NO: 373398 - protein, 9 aa, Homo Sapiens
MQLGPGPKG

SEQ ID NO: 373399 - protein, 9 aa, Homo Sapiens
QRGNGGDGC

SEQ ID NO: 373400 - protein, 9 aa, Homo Sapiens
ARWQRGLQV

SEQ ID NO: 373401 - protein, 9 aa, Homo Sapiens
VHHIGREPM

SEQ ID NO: 373402 - protein, 9 aa, Homo Sapiens
SVKEIKCFL

SEQ ID NO: 373403 - protein, 9 aa, Homo Sapiens
VELPPYLEC

SEQ ID NO: 373404 - protein, 9 aa, Homo Sapiens
ERVPVAPDG

SEQ ID NO: 373405 - protein, 9 aa, Homo Sapiens
AAVLGLLCM

SEQ ID NO: 373406 - protein, 9 aa, Homo Sapiens
LPWKLKLKL

SEQ ID NO: 373407 - protein, 9 aa, Homo Sapiens
RSHQRAEYI

SEQ ID NO: 373408 - protein, 9 aa, Homo Sapiens
LLKTRCLMV

SEQ ID NO: 373409 - protein, 9 aa, Homo Sapiens
QHPAAPAST

SEQ ID NO: 373410 - protein, 9 aa, Homo Sapiens
TPTDPTNAA

SEQ ID NO: 373411 - protein, 9 aa, Homo Sapiens
GQDEGWGPA

SEQ ID NO: 373412 - protein, 9 aa, Homo Sapiens
AVSTRGASK

SEQ ID NO: 373413 - protein, 9 aa, Homo Sapiens
KRGKSQGGR

SEQ ID NO: 373414 - protein, 9 aa, Homo Sapiens
DIQEQNQGL

SEQ ID NO: 373415 - protein, 9 aa, Homo Sapiens
SLWSHRPPS

SEQ ID NO: 373416 - protein, 9 aa, Homo Sapiens
DIQDKVKPQ

SEQ ID NO: 373417 - protein, 9 aa, Homo Sapiens
PMSLACSIT

SEQ ID NO: 373418 - protein, 9 aa, Homo Sapiens
VSFSQLELR

SEQ ID NO: 373419 - protein, 9 aa, Homo Sapiens
LAKTLCHMP

SEQ ID NO: 373420 - protein, 9 aa, Homo Sapiens
YLYQRWIYC

SEQ ID NO: 373421 - protein, 9 aa, Homo Sapiens
DRVYDKPRT

SEQ ID NO: 373422 - protein, 9 aa, Homo Sapiens
TKDKNWHDK

SEQ ID NO: 373423 - protein, 9 aa, Homo Sapiens
CIGLIYVNG

SEQ ID NO: 373424 - protein, 9 aa, Homo Sapiens
VNQPFLIKN

SEQ ID NO: 373425 - protein, 9 aa, Homo Sapiens
RRRRRKDLT

SEQ ID NO: 373426 - protein, 9 aa, Homo Sapiens
KNPKIFMHR

SEQ ID NO: 373427 - protein, 9 aa, Homo Sapiens
KASNTIAPS

SEQ ID NO: 373428 - protein, 9 aa, Homo Sapiens
PLYFADKLY

SEQ ID NO: 373429 - protein, 9 aa, Homo Sapiens
STANFVKDT

SEQ ID NO: 373430 - protein, 9 aa, Homo Sapiens
MDSVSRVRP

SEQ ID NO: 373431 - protein, 9 aa, Homo Sapiens
RRKQHLPPP

SEQ ID NO: 373432 - protein, 9 aa, Homo Sapiens
ITFFVRRVN

SEQ ID NO: 373433 - protein, 9 aa, Homo Sapiens
QWPQQGAPP

SEQ ID NO: 373434 - protein, 9 aa, Homo Sapiens
MLLGTYRVV

SEQ ID NO: 373435 - protein, 9 aa, Homo Sapiens
NLVTGTQHF

SEQ ID NO: 373436 - protein, 9 aa, Homo Sapiens
HNRNFWILR

SEQ ID NO: 373437 - protein, 9 aa, Homo Sapiens
IALKHYDKA

SEQ ID NO: 373438 - protein, 9 aa, Homo Sapiens
DHSFVSGGG

SEQ ID NO: 373439 - protein, 9 aa, Homo Sapiens
MDLSPWLTG

SEQ ID NO: 373440 - protein, 9 aa, Homo Sapiens
LIDKRSMPE

SEQ ID NO: 373441 - protein, 9 aa, Homo Sapiens
QNSRSASAE

SEQ ID NO: 373442 - protein, 9 aa, Homo Sapiens
QSQLKRVFF

SEQ ID NO: 373443 - protein, 9 aa, Homo Sapiens
VCFLNHHRR

SEQ ID NO: 373444 - protein, 9 aa, Homo Sapiens
AYWKAGSVQ

SEQ ID NO: 373445 - protein, 9 aa, Homo Sapiens
ELLDVDTLI

SEQ ID NO: 373446 - protein, 9 aa, Homo Sapiens
SSWHMVIGE

SEQ ID NO: 373447 - protein, 9 aa, Homo Sapiens
LKKRKKKKK

SEQ ID NO: 373448 - protein, 9 aa, Homo Sapiens
FQPMEVQLT

SEQ ID NO: 373449 - protein, 9 aa, Homo Sapiens
ADPKRDRRS

SEQ ID NO: 373450 - protein, 9 aa, Homo Sapiens
AGEELQSSG

SEQ ID NO: 373451 - protein, 9 aa, Homo Sapiens
VVRKLIQKM

SEQ ID NO: 373452 - protein, 9 aa, Homo Sapiens
PALKQVSPA

SEQ ID NO: 373453 - protein, 9 aa, Homo Sapiens
VGKKLDVAI

SEQ ID NO: 373454 - protein, 9 aa, Homo Sapiens
PVFRQETQA

SEQ ID NO: 373455 - protein, 9 aa, Homo Sapiens
QFLHKLYLE

SEQ ID NO: 373456 - protein, 9 aa, Homo Sapiens
LAWHRTLTA

SEQ ID NO: 373457 - protein, 9 aa, Homo Sapiens
NVGSALRLS

SEQ ID NO: 373458 - protein, 9 aa, Homo Sapiens
VRRVNGTFG

SEQ ID NO: 373459 - protein, 9 aa, Homo Sapiens
KMSLMSGQK

SEQ ID NO: 373460 - protein, 9 aa, Homo Sapiens
QVPKASSRA

SEQ ID NO: 373461 - protein, 9 aa, Homo Sapiens
LGHRVGVLQ

SEQ ID NO: 373462 - protein, 9 aa, Homo Sapiens
PSSKPYWMV

SEQ ID NO: 373463 - protein, 9 aa, Homo Sapiens
NKKISLEKE

SEQ ID NO: 373464 - protein, 9 aa, Homo Sapiens
TGGASKLNG

SEQ ID NO: 373465 - protein, 9 aa, Homo Sapiens
SPRPGPRGG

SEQ ID NO: 373466 - protein, 9 aa, Homo Sapiens
KLESPALKQ

SEQ ID NO: 373467 - protein, 9 aa, Homo Sapiens
FLSWIAISR

SEQ ID NO: 373468 - protein, 9 aa, Homo Sapiens
KQNSIGSYG

SEQ ID NO: 373469 - protein, 9 aa, Homo Sapiens
SPPPLPADL

SEQ ID NO: 373470 - protein, 9 aa, Homo Sapiens
TLHQMTRER

SEQ ID NO: 373471 - protein, 9 aa, Homo Sapiens
SYRCTCARR

SEQ ID NO: 373472 - protein, 9 aa, Homo Sapiens
VASFQMPGL

SEQ ID NO: 373473 - protein, 9 aa, Homo Sapiens
LPYNLATDD

SEQ ID NO: 373474 - protein, 9 aa, Homo Sapiens
SVTGIFGNV

SEQ ID NO: 373475 - protein, 9 aa, Homo Sapiens
DNQKGRPLP

SEQ ID NO: 373476 - protein, 9 aa, Homo Sapiens
GLTKEASVD

SEQ ID NO: 373477 - protein, 9 aa, Homo Sapiens
SSHLILLWL

SEQ ID NO: 373478 - protein, 9 aa, Homo Sapiens
ALLALGTGD

SEQ ID NO: 373479 - protein, 9 aa, Homo Sapiens
ELLADEFTR

SEQ ID NO: 373480 - protein, 9 aa, Homo Sapiens
VKRAYETTA

SEQ ID NO: 373481 - protein, 9 aa, Homo Sapiens
DQQTIHSED

SEQ ID NO: 373482 - protein, 9 aa, Homo Sapiens
WNVLPLSCF

SEQ ID NO: 373483 - protein, 9 aa, Homo Sapiens
TNCRGNLRG

SEQ ID NO: 373484 - protein, 9 aa, Homo Sapiens
ARGFLAAFH

SEQ ID NO: 373485 - protein, 9 aa, Homo Sapiens
VGGCPTTPP

SEQ ID NO: 373486 - protein, 9 aa, Homo Sapiens
ESEDSYTPE

SEQ ID NO: 373487 - protein, 9 aa, Homo Sapiens
LIMAYPKIK

SEQ ID NO: 373488 - protein, 9 aa, Homo Sapiens
ALQAVLQDY

SEQ ID NO: 373489 - protein, 9 aa, Homo Sapiens
LLCMQLGPG

SEQ ID NO: 373490 - protein, 9 aa, Homo Sapiens
SWDHSFVSG

SEQ ID NO: 373491 - protein, 9 aa, Homo Sapiens
RHELVPALE

SEQ ID NO: 373492 - protein, 9 aa, Homo Sapiens
CPDDQGGAA

SEQ ID NO: 373493 - protein, 9 aa, Homo Sapiens
RAESLAAGG

SEQ ID NO: 373494 - protein, 9 aa, Homo Sapiens
QEQLTMSDK

SEQ ID NO: 373495 - protein, 9 aa, Homo Sapiens
IAIEYPYSV

SEQ ID NO: 373496 - protein, 9 aa, Homo Sapiens
LHHDPLGKP

SEQ ID NO: 373497 - protein, 9 aa, Homo Sapiens
DGSSDSSSD

SEQ ID NO: 373498 - protein, 9 aa, Homo Sapiens
ELLVTENVQ

SEQ ID NO: 373499 - protein, 9 aa, Homo Sapiens
QSPPSPAGS

SEQ ID NO: 373500 - protein, 9 aa, Homo Sapiens
IDYWKNGYN

SEQ ID NO: 373501 - protein, 9 aa, Homo Sapiens
LEMDDHRAV

SEQ ID NO: 373502 - protein, 9 aa, Homo Sapiens
GQILFPCLR

SEQ ID NO: 373503 - protein, 9 aa, Homo Sapiens
VLLPVLPGD

SEQ ID NO: 373504 - protein, 9 aa, Homo Sapiens
LHAYVLWAG

SEQ ID NO: 373505 - protein, 9 aa, Homo Sapiens
INSSACDGL

SEQ ID NO: 373506 - protein, 9 aa, Homo Sapiens
PPLILLRHV

SEQ ID NO: 373507 - protein, 9 aa, Homo Sapiens
ALQVEASQA

SEQ ID NO: 373508 - protein, 9 aa, Homo Sapiens
SPTSSTKPS

SEQ ID NO: 373509 - protein, 9 aa, Homo Sapiens
SKTLLEFLE

SEQ ID NO: 373510 - protein, 9 aa, Homo Sapiens
HKPPCLTRM

SEQ ID NO: 373511 - protein, 9 aa, Homo Sapiens
ICISGRNVN

SEQ ID NO: 373512 - protein, 9 aa, Homo Sapiens
GQPWLSPIC

SEQ ID NO: 373513 - protein, 9 aa, Homo Sapiens
LCLLEIHKI

SEQ ID NO: 373514 - protein, 9 aa, Homo Sapiens
EEYPDCIMN

SEQ ID NO: 373515 - protein, 9 aa, Homo Sapiens
PANDRQFSS

SEQ ID NO: 373516 - protein, 9 aa, Homo Sapiens
PNHSPHPQP

SEQ ID NO: 373517 - protein, 9 aa, Homo Sapiens
IKKFLDKLS

SEQ ID NO: 373518 - protein, 9 aa, Homo Sapiens
EELDASNPF

SEQ ID NO: 373519 - protein, 9 aa, Homo Sapiens
SRSPSVASF

SEQ ID NO: 373520 - protein, 9 aa, Homo Sapiens
PYHDTLYFP

SEQ ID NO: 373521 - protein, 9 aa, Homo Sapiens
MYFLLANLT

SEQ ID NO: 373522 - protein, 9 aa, Homo Sapiens
IVSGALERS

SEQ ID NO: 373523 - protein, 9 aa, Homo Sapiens
IGEELVIHN

SEQ ID NO: 373524 - protein, 9 aa, Homo Sapiens
TLNNSIYWQ

SEQ ID NO: 373525 - protein, 9 aa, Homo Sapiens
TSAAADPLL

SEQ ID NO: 373526 - protein, 9 aa, Homo Sapiens
SENVQCCII

SEQ ID NO: 373527 - protein, 9 aa, Homo Sapiens
DPKRDRRSM

SEQ ID NO: 373528 - protein, 9 aa, Homo Sapiens
SKASRAGGT

SEQ ID NO: 373529 - protein, 9 aa, Homo Sapiens
PCRPRVTPG

SEQ ID NO: 373530 - protein, 9 aa, Homo Sapiens
LRLLGGKTI

SEQ ID NO: 373531 - protein, 9 aa, Homo Sapiens
TNPESSTTS

SEQ ID NO: 373532 - protein, 9 aa, Homo Sapiens
SPDYFVDCP

SEQ ID NO: 373533 - protein, 9 aa, Homo Sapiens
KNRLVSGGS

SEQ ID NO: 373534 - protein, 9 aa, Homo Sapiens
PVPVACPDD

SEQ ID NO: 373535 - protein, 9 aa, Homo Sapiens
REHLDIREA

SEQ ID NO: 373536 - protein, 9 aa, Homo Sapiens
MVFSVILSL

SEQ ID NO: 373537 - protein, 9 aa, Homo Sapiens
GVEGLARVR

SEQ ID NO: 373538 - protein, 9 aa, Homo Sapiens
PPAWQPSLK

SEQ ID NO: 373539 - protein, 9 aa, Homo Sapiens
SHFSDLDQS

SEQ ID NO: 373540 - protein, 9 aa, Homo Sapiens
AGRMGRPEE

SEQ ID NO: 373541 - protein, 9 aa, Homo Sapiens
KRYLCLLEI

SEQ ID NO: 373542 - protein, 9 aa, Homo Sapiens
PPTVRRDGG

SEQ ID NO: 373543 - protein, 9 aa, Homo Sapiens
VDWVRRQFE

SEQ ID NO: 373544 - protein, 9 aa, Homo Sapiens
LVTPDPAVV

SEQ ID NO: 373545 - protein, 9 aa, Homo Sapiens
QPVMQALAL

SEQ ID NO: 373546 - protein, 9 aa, Homo Sapiens
SSSGNGGGG

SEQ ID NO: 373547 - protein, 9 aa, Homo Sapiens
TSSLEASGM

SEQ ID NO: 373548 - protein, 9 aa, Homo Sapiens
MVQGILAMS

SEQ ID NO: 373549 - protein, 9 aa, Homo Sapiens
GKVPESPEA

SEQ ID NO: 373550 - protein, 9 aa, Homo Sapiens
NYDKWEMEC

SEQ ID NO: 373551 - protein, 9 aa, Homo Sapiens
CARRTPTDP

SEQ ID NO: 373552 - protein, 9 aa, Homo Sapiens
ENVQCCIIF

SEQ ID NO: 373553 - protein, 9 aa, Homo Sapiens
RYASCRSET

SEQ ID NO: 373554 - protein, 9 aa, Homo Sapiens
KFGEKDKKE

SEQ ID NO: 373555 - protein, 9 aa, Homo Sapiens
CQHCVQRCP

SEQ ID NO: 373556 - protein, 9 aa, Homo Sapiens
IYKAKPVIF

SEQ ID NO: 373557 - protein, 9 aa, Homo Sapiens
LAACQATVR

SEQ ID NO: 373558 - protein, 9 aa, Homo Sapiens
CACPPCLRW

SEQ ID NO: 373559 - protein, 9 aa, Homo Sapiens
EGEHMVDVV

SEQ ID NO: 373560 - protein, 9 aa, Homo Sapiens
RDAFLIVFS

SEQ ID NO: 373561 - protein, 9 aa, Homo Sapiens
FFRYCTYLD

SEQ ID NO: 373562 - protein, 9 aa, Homo Sapiens
DTRGVGIHV

SEQ ID NO: 373563 - protein, 9 aa, Homo Sapiens
PPGEHCPSA

SEQ ID NO: 373564 - protein, 9 aa, Homo Sapiens
WTSTPRTPT

SEQ ID NO: 373565 - protein, 9 aa, Homo Sapiens
TATLKEKKT

SEQ ID NO: 373566 - protein, 9 aa, Homo Sapiens
RRLLVVGCI

SEQ ID NO: 373567 - protein, 9 aa, Homo Sapiens
CWNLSLEGL

SEQ ID NO: 373568 - protein, 9 aa, Homo Sapiens
KPPKPSLSL

SEQ ID NO: 373569 - protein, 9 aa, Homo Sapiens
GQVRADPLT

SEQ ID NO: 373570 - protein, 9 aa, Homo Sapiens
GVLVSQQVS

SEQ ID NO: 373571 - protein, 9 aa, Homo Sapiens
CSTKKRTTP

SEQ ID NO: 373572 - protein, 9 aa, Homo Sapiens
PWAWGCPAG

SEQ ID NO: 373573 - protein, 9 aa, Homo Sapiens
RRRCYRHSL

SEQ ID NO: 373574 - protein, 9 aa, Homo Sapiens
MHLLSTPIF

SEQ ID NO: 373575 - protein, 9 aa, Homo Sapiens
CDGLLSRPI

SEQ ID NO: 373576 - protein, 9 aa, Homo Sapiens
GRRTCWMTW

SEQ ID NO: 373577 - protein, 9 aa, Homo Sapiens
GLLPECFRH

SEQ ID NO: 373578 - protein, 9 aa, Homo Sapiens
GSTCPCRWT

SEQ ID NO: 373579 - protein, 9 aa, Homo Sapiens
LHVSRLYRQ

SEQ ID NO: 373580 - protein, 9 aa, Homo Sapiens
SSQLDDNSN

SEQ ID NO: 373581 - protein, 9 aa, Homo Sapiens
YETQDKACI

SEQ ID NO: 373582 - protein, 9 aa, Homo Sapiens
HMVDVVVEN

SEQ ID NO: 373583 - protein, 9 aa, Homo Sapiens
VHKIGVFSC

SEQ ID NO: 373584 - protein, 9 aa, Homo Sapiens
VNTDVGYYS

SEQ ID NO: 373585 - protein, 9 aa, Homo Sapiens
MSPNSAGIQ

SEQ ID NO: 373586 - protein, 9 aa, Homo Sapiens
QNIFTAFTC

SEQ ID NO: 373587 - protein, 9 aa, Homo Sapiens
LQEVLGHGA

SEQ ID NO: 373588 - protein, 9 aa, Homo Sapiens
SDMELRLVD

SEQ ID NO: 373589 - protein, 9 aa, Homo Sapiens
EVRVQVDAA

SEQ ID NO: 373590 - protein, 9 aa, Homo Sapiens
EIQNNQKTR

SEQ ID NO: 373591 - protein, 9 aa, Homo Sapiens
DLPHSSGLA

SEQ ID NO: 373592 - protein, 9 aa, Homo Sapiens
TTEQAQRDL

SEQ ID NO: 373593 - protein, 9 aa, Homo Sapiens
LAARLHWLP

SEQ ID NO: 373594 - protein, 9 aa, Homo Sapiens
GEIRVCPKK

SEQ ID NO: 373595 - protein, 9 aa, Homo Sapiens
CKGCGKSFN

SEQ ID NO: 373596 - protein, 9 aa, Homo Sapiens
QNHITAFTE

SEQ ID NO: 373597 - protein, 9 aa, Homo Sapiens
PVGQGCVPE

SEQ ID NO: 373598 - protein, 9 aa, Homo Sapiens
TRSSSGRAP

SEQ ID NO: 373599 - protein, 9 aa, Homo Sapiens
EVRHRAADW

SEQ ID NO: 373600 - protein, 9 aa, Homo Sapiens
EPVGPGQQA

SEQ ID NO: 373601 - protein, 9 aa, Homo Sapiens
ASHGFLHDR

SEQ ID NO: 373602 - protein, 9 aa, Homo Sapiens
IRNTCKAVG

SEQ ID NO: 373603 - protein, 9 aa, Homo Sapiens
SLEASGMPP

SEQ ID NO: 373604 - protein, 9 aa, Homo Sapiens
FDEEEGEDE

SEQ ID NO: 373605 - protein, 9 aa, Homo Sapiens
TEARIVGGP

SEQ ID NO: 373606 - protein, 9 aa, Homo Sapiens
RASWDSSEM

SEQ ID NO: 373607 - protein, 9 aa, Homo Sapiens
LKDNGLMGI

SEQ ID NO: 373608 - protein, 9 aa, Homo Sapiens
PAGRCACSH

SEQ ID NO: 373609 - protein, 9 aa, Homo Sapiens
VSLNLTQKL

SEQ ID NO: 373610 - protein, 9 aa, Homo Sapiens
KVQGFRIPK

SEQ ID NO: 373611 - protein, 9 aa, Homo Sapiens
IFLNSCFSR

SEQ ID NO: 373612 - protein, 9 aa, Homo Sapiens
DTLSTWSLK

SEQ ID NO: 373613 - protein, 9 aa, Homo Sapiens
TLIVGCGMS

SEQ ID NO: 373614 - protein, 9 aa, Homo Sapiens
NIGCSVSKT

SEQ ID NO: 373615 - protein, 9 aa, Homo Sapiens
GGRILLQRN

SEQ ID NO: 373616 - protein, 9 aa, Homo Sapiens
KDDETVDSS

SEQ ID NO: 373617 - protein, 9 aa, Homo Sapiens
EKDNFFAYL

SEQ ID NO: 373618 - protein, 9 aa, Homo Sapiens
QTIHSEDKN

SEQ ID NO: 373619 - protein, 9 aa, Homo Sapiens
ALLHHDPLG

SEQ ID NO: 373620 - protein, 9 aa, Homo Sapiens
AVTAPPSAP

SEQ ID NO: 373621 - protein, 9 aa, Homo Sapiens
DIPMLLHVR

SEQ ID NO: 373622 - protein, 9 aa, Homo Sapiens
SICGGARGH

SEQ ID NO: 373623 - protein, 9 aa, Homo Sapiens
WKDMIARPQ

SEQ ID NO: 373624 - protein, 9 aa, Homo Sapiens
MKPLPVVLG

SEQ ID NO: 373625 - protein, 9 aa, Homo Sapiens
RDRMTPSGQ

SEQ ID NO: 373626 - protein, 9 aa, Homo Sapiens
GPFFRYCTY

SEQ ID NO: 373627 - protein, 9 aa, Homo Sapiens
NSRMNSTGM

SEQ ID NO: 373628 - protein, 9 aa, Homo Sapiens
LIYFASSVL

SEQ ID NO: 373629 - protein, 9 aa, Homo Sapiens
LYCQNGGTC

SEQ ID NO: 373630 - protein, 9 aa, Homo Sapiens
CLAPKRPLL

SEQ ID NO: 373631 - protein, 9 aa, Homo Sapiens
SNCCNLNSS

SEQ ID NO: 373632 - protein, 9 aa, Homo Sapiens
NNQIYTVKD

SEQ ID NO: 373633 - protein, 9 aa, Homo Sapiens
KRFGHIQQQ

SEQ ID NO: 373634 - protein, 9 aa, Homo Sapiens
IPPSSKPYW

SEQ ID NO: 373635 - protein, 9 aa, Homo Sapiens
KVREEYPDC

SEQ ID NO: 373636 - protein, 9 aa, Homo Sapiens
TQEIDFLKM

SEQ ID NO: 373637 - protein, 9 aa, Homo Sapiens
NLGFTHLIG

SEQ ID NO: 373638 - protein, 9 aa, Homo Sapiens
TILQKLANV

SEQ ID NO: 373639 - protein, 9 aa, Homo Sapiens
SAVTHSPMM

SEQ ID NO: 373640 - protein, 9 aa, Homo Sapiens
RCLQHFYII

SEQ ID NO: 373641 - protein, 9 aa, Homo Sapiens
VTGASVAPS

SEQ ID NO: 373642 - protein, 9 aa, Homo Sapiens
HATTASRVL

SEQ ID NO: 373643 - protein, 9 aa, Homo Sapiens
AIQNFSTYA

SEQ ID NO: 373644 - protein, 9 aa, Homo Sapiens
VDAIVNASN

SEQ ID NO: 373645 - protein, 9 aa, Homo Sapiens
VCNLLLPCM

SEQ ID NO: 373646 - protein, 9 aa, Homo Sapiens
ADEQGEFDE

SEQ ID NO: 373647 - protein, 9 aa, Homo Sapiens
NLSPGGLSY

SEQ ID NO: 373648 - protein, 9 aa, Homo Sapiens
VTQCRPAGR

SEQ ID NO: 373649 - protein, 9 aa, Homo Sapiens
NCRNEHAMI

SEQ ID NO: 373650 - protein, 9 aa, Homo Sapiens
HLILLWLLG

SEQ ID NO: 373651 - protein, 9 aa, Homo Sapiens
LHRVPKSRP

SEQ ID NO: 373652 - protein, 9 aa, Homo Sapiens
TKQLQERIW

SEQ ID NO: 373653 - protein, 9 aa, Homo Sapiens
SVSKEEKES

SEQ ID NO: 373654 - protein, 9 aa, Homo Sapiens
PGRRVDCGP

SEQ ID NO: 373655 - protein, 9 aa, Homo Sapiens
HTGERLYRC

SEQ ID NO: 373656 - protein, 9 aa, Homo Sapiens
VPLWPKKII

SEQ ID NO: 373657 - protein, 9 aa, Homo Sapiens
IVLKLKSPM

SEQ ID NO: 373658 - protein, 9 aa, Homo Sapiens
CGKTFSRMS

SEQ ID NO: 373659 - protein, 9 aa, Homo Sapiens
PRPSTPASP

SEQ ID NO: 373660 - protein, 9 aa, Homo Sapiens
MAAPGSGRV

SEQ ID NO: 373661 - protein, 9 aa, Homo Sapiens
NHFNVEEDM

SEQ ID NO: 373662 - protein, 9 aa, Homo Sapiens
ALGRFCMIS

SEQ ID NO: 373663 - protein, 9 aa, Homo Sapiens
IIVEQIENL

SEQ ID NO: 373664 - protein, 9 aa, Homo Sapiens
GRLLQSCIL

SEQ ID NO: 373665 - protein, 9 aa, Homo Sapiens
HTQEPLYQC

SEQ ID NO: 373666 - protein, 9 aa, Homo Sapiens
GQAVSLVSG

SEQ ID NO: 373667 - protein, 9 aa, Homo Sapiens
GRLLYHAMK

SEQ ID NO: 373668 - protein, 9 aa, Homo Sapiens
TFGMEQCGR

SEQ ID NO: 373669 - protein, 9 aa, Homo Sapiens
TSRAAGTTF

SEQ ID NO: 373670 - protein, 9 aa, Homo Sapiens
PSRLPKTWN

SEQ ID NO: 373671 - protein, 9 aa, Homo Sapiens
RKMHTGERL

SEQ ID NO: 373672 - protein, 9 aa, Homo Sapiens
KGGDRVPVD

SEQ ID NO: 373673 - protein, 9 aa, Homo Sapiens
SNFGFSRLR

SEQ ID NO: 373674 - protein, 9 aa, Homo Sapiens
ILFSSWVVV

SEQ ID NO: 373675 - protein, 9 aa, Homo Sapiens
QHRVQDPIH

SEQ ID NO: 373676 - protein, 9 aa, Homo Sapiens
NIARSGDAA

SEQ ID NO: 373677 - protein, 9 aa, Homo Sapiens
MGFIHNFQE

SEQ ID NO: 373678 - protein, 9 aa, Homo Sapiens
ETPYMHTLA

SEQ ID NO: 373679 - protein, 9 aa, Homo Sapiens
EESDLEKKK

SEQ ID NO: 373680 - protein, 9 aa, Homo Sapiens
FHDVDVEDV

SEQ ID NO: 373681 - protein, 9 aa, Homo Sapiens
RPWAPVPAR

SEQ ID NO: 373682 - protein, 9 aa, Homo Sapiens
LEDCRLGVE

SEQ ID NO: 373683 - protein, 9 aa, Homo Sapiens
ASSVASQKW

SEQ ID NO: 373684 - protein, 9 aa, Homo Sapiens
RDARRTVTE

SEQ ID NO: 373685 - protein, 9 aa, Homo Sapiens
FRHAPPPRM

SEQ ID NO: 373686 - protein, 9 aa, Homo Sapiens
ICGKTKPGE

SEQ ID NO: 373687 - protein, 9 aa, Homo Sapiens
GALQVEASQ

SEQ ID NO: 373688 - protein, 9 aa, Homo Sapiens
WAARWQRGL

SEQ ID NO: 373689 - protein, 9 aa, Homo Sapiens
RGTSITLST

SEQ ID NO: 373690 - protein, 9 aa, Homo Sapiens
SIPSPIGAN

SEQ ID NO: 373691 - protein, 9 aa, Homo Sapiens
SGAPPCRPR

SEQ ID NO: 373692 - protein, 9 aa, Homo Sapiens
SSKWTRMLR

SEQ ID NO: 373693 - protein, 9 aa, Homo Sapiens
KPLDGPQIG

SEQ ID NO: 373694 - protein, 9 aa, Homo Sapiens
QVSGMPAMT

SEQ ID NO: 373695 - protein, 9 aa, Homo Sapiens
LPCPAAPRL

SEQ ID NO: 373696 - protein, 9 aa, Homo Sapiens
VIRTANTQE

SEQ ID NO: 373697 - protein, 9 aa, Homo Sapiens
LFPWKMSLL

SEQ ID NO: 373698 - protein, 9 aa, Homo Sapiens
LGAPLPWMV

SEQ ID NO: 373699 - protein, 9 aa, Homo Sapiens
PRVLFHCSE

SEQ ID NO: 373700 - protein, 9 aa, Homo Sapiens
TRLAVSTRG

SEQ ID NO: 373701 - protein, 9 aa, Homo Sapiens
LCNQSVREF

SEQ ID NO: 373702 - protein, 9 aa, Homo Sapiens
LTLGAPLPW

SEQ ID NO: 373703 - protein, 9 aa, Homo Sapiens
ARAGARARQ

SEQ ID NO: 373704 - protein, 9 aa, Homo Sapiens
DKPRTTEGL

SEQ ID NO: 373705 - protein, 9 aa, Homo Sapiens
LTVLTSRSL

SEQ ID NO: 373706 - protein, 9 aa, Homo Sapiens
AVVMTYWTT

SEQ ID NO: 373707 - protein, 9 aa, Homo Sapiens
YPGRRVDCG

SEQ ID NO: 373708 - protein, 9 aa, Homo Sapiens
LFPVLSTSS

SEQ ID NO: 373709 - protein, 9 aa, Homo Sapiens
AEVSKKKSY

SEQ ID NO: 373710 - protein, 9 aa, Homo Sapiens
VPDSLTDDC

SEQ ID NO: 373711 - protein, 9 aa, Homo Sapiens
ARAVLNSTN

SEQ ID NO: 373712 - protein, 9 aa, Homo Sapiens
NGLMGIEEQ

SEQ ID NO: 373713 - protein, 9 aa, Homo Sapiens
LVCMVKIMQ

SEQ ID NO: 373714 - protein, 9 aa, Homo Sapiens
KPPTSPATR

SEQ ID NO: 373715 - protein, 9 aa, Homo Sapiens
DEDEEGPRS

SEQ ID NO: 373716 - protein, 9 aa, Homo Sapiens
KRPFKKWNY

SEQ ID NO: 373717 - protein, 9 aa, Homo Sapiens
ATITNCRGN

SEQ ID NO: 373718 - protein, 9 aa, Homo Sapiens
DHTFVTSSF

SEQ ID NO: 373719 - protein, 9 aa, Homo Sapiens
SPTRSSPPA

SEQ ID NO: 373720 - protein, 9 aa, Homo Sapiens
TLVQHRHTH

SEQ ID NO: 373721 - protein, 9 aa, Homo Sapiens
LLVVGCILQ

SEQ ID NO: 373722 - protein, 9 aa, Homo Sapiens
PKVDNVEAL

SEQ ID NO: 373723 - protein, 9 aa, Homo Sapiens
WLTGLLPKG

SEQ ID NO: 373724 - protein, 9 aa, Homo Sapiens
QQGAPPRAP

SEQ ID NO: 373725 - protein, 9 aa, Homo Sapiens
VFQHDKVEI

SEQ ID NO: 373726 - protein, 9 aa, Homo Sapiens
LNLTQKLAQ

SEQ ID NO: 373727 - protein, 9 aa, Homo Sapiens
GSRQSPSHI

SEQ ID NO: 373728 - protein, 9 aa, Homo Sapiens
PRAPPEAPL

SEQ ID NO: 373729 - protein, 9 aa, Homo Sapiens
GADGQASGG

SEQ ID NO: 373730 - protein, 9 aa, Homo Sapiens
VCMKWCATC

SEQ ID NO: 373731 - protein, 9 aa, Homo Sapiens
GPAATSSLE

SEQ ID NO: 373732 - protein, 9 aa, Homo Sapiens
VAPDGPVKE

SEQ ID NO: 373733 - protein, 9 aa, Homo Sapiens
HFNVEEDMT

SEQ ID NO: 373734 - protein, 9 aa, Homo Sapiens
HFGPAPPSQ

SEQ ID NO: 373735 - protein, 9 aa, Homo Sapiens
DCVTCLANP

SEQ ID NO: 373736 - protein, 9 aa, Homo Sapiens
IHDIPMLLH

SEQ ID NO: 373737 - protein, 9 aa, Homo Sapiens
ATNIIAKLW

SEQ ID NO: 373738 - protein, 9 aa, Homo Sapiens
GACFGQTSI

SEQ ID NO: 373739 - protein, 9 aa, Homo Sapiens
VEREASPAD

SEQ ID NO: 373740 - protein, 9 aa, Homo Sapiens
NSKDKALSS

SEQ ID NO: 373741 - protein, 9 aa, Homo Sapiens
RRGTGRGRQ

SEQ ID NO: 373742 - protein, 9 aa, Homo Sapiens
EWRHLCFQL

SEQ ID NO: 373743 - protein, 9 aa, Homo Sapiens
RDSLWRRNP

SEQ ID NO: 373744 - protein, 9 aa, Homo Sapiens
TFSRMSSLT

SEQ ID NO: 373745 - protein, 9 aa, Homo Sapiens
YLCIPEYEE

SEQ ID NO: 373746 - protein, 9 aa, Homo Sapiens
PQRRGTGRG

SEQ ID NO: 373747 - protein, 9 aa, Homo Sapiens
CLRTHGCSG

SEQ ID NO: 373748 - protein, 9 aa, Homo Sapiens
LEVDKRVVL

SEQ ID NO: 373749 - protein, 9 aa, Homo Sapiens
VIIMVTRCE

SEQ ID NO: 373750 - protein, 9 aa, Homo Sapiens
QKKHDKQNS

SEQ ID NO: 373751 - protein, 9 aa, Homo Sapiens
IMGSWLKGV

SEQ ID NO: 373752 - protein, 9 aa, Homo Sapiens
SLYSVAVWP

SEQ ID NO: 373753 - protein, 9 aa, Homo Sapiens
AIEKMVVLL

SEQ ID NO: 373754 - protein, 9 aa, Homo Sapiens
GHGALVDEV

SEQ ID NO: 373755 - protein, 9 aa, Homo Sapiens
DATRAGDKE

SEQ ID NO: 373756 - protein, 9 aa, Homo Sapiens
TPDPAVVVV

SEQ ID NO: 373757 - protein, 9 aa, Homo Sapiens
LAACSQQEQ

SEQ ID NO: 373758 - protein, 9 aa, Homo Sapiens
EQPSTQRSL

SEQ ID NO: 373759 - protein, 9 aa, Homo Sapiens
VLQNSKDKA

SEQ ID NO: 373760 - protein, 9 aa, Homo Sapiens
LQSLPKQGG

SEQ ID NO: 373761 - protein, 9 aa, Homo Sapiens
GWAARWQRG

SEQ ID NO: 373762 - protein, 9 aa, Homo Sapiens
YKFFMKAMQ

SEQ ID NO: 373763 - protein, 9 aa, Homo Sapiens
EELVVPETS

SEQ ID NO: 373764 - protein, 9 aa, Homo Sapiens
GLLVTGASV

SEQ ID NO: 373765 - protein, 9 aa, Homo Sapiens
VEFQPMEVQ

SEQ ID NO: 373766 - protein, 9 aa, Homo Sapiens
NIWTDHRIR

SEQ ID NO: 373767 - protein, 9 aa, Homo Sapiens
FGQTSISVG

SEQ ID NO: 373768 - protein, 9 aa, Homo Sapiens
NQKGRPLPE

SEQ ID NO: 373769 - protein, 9 aa, Homo Sapiens
EVSKKKSYR

SEQ ID NO: 373770 - protein, 9 aa, Homo Sapiens
QRLGKSRRR

SEQ ID NO: 373771 - protein, 9 aa, Homo Sapiens
TARARAGAG

SEQ ID NO: 373772 - protein, 9 aa, Homo Sapiens
LLTNWMSIW

SEQ ID NO: 373773 - protein, 9 aa, Homo Sapiens
RVIEVQLLD

SEQ ID NO: 373774 - protein, 9 aa, Homo Sapiens
PGPPPCRPR

SEQ ID NO: 373775 - protein, 9 aa, Homo Sapiens
CTCARRTPT

SEQ ID NO: 373776 - protein, 9 aa, Homo Sapiens
WLSPICRTG

SEQ ID NO: 373777 - protein, 9 aa, Homo Sapiens
DEVNLRAQE

SEQ ID NO: 373778 - protein, 9 aa, Homo Sapiens
ASQKWGPLG

SEQ ID NO: 373779 - protein, 9 aa, Homo Sapiens
GVCFLNHHR

SEQ ID NO: 373780 - protein, 9 aa, Homo Sapiens
SQPKPPPQK

SEQ ID NO: 373781 - protein, 9 aa, Homo Sapiens
VIEVQLLDD

SEQ ID NO: 373782 - protein, 9 aa, Homo Sapiens
ADRGCGPGR

SEQ ID NO: 373783 - protein, 9 aa, Homo Sapiens
ACAATRPEG

SEQ ID NO: 373784 - protein, 9 aa, Homo Sapiens
NLSPGVVTD

SEQ ID NO: 373785 - protein, 9 aa, Homo Sapiens
AMDLSPWLT

SEQ ID NO: 373786 - protein, 9 aa, Homo Sapiens
ECDFAYETM

SEQ ID NO: 373787 - protein, 9 aa, Homo Sapiens
LSPAIRLLP

SEQ ID NO: 373788 - protein, 9 aa, Homo Sapiens
LLQLLEGMD

SEQ ID NO: 373789 - protein, 9 aa, Homo Sapiens
IGNVVRNIL

SEQ ID NO: 373790 - protein, 9 aa, Homo Sapiens
FLSVQNQFI

SEQ ID NO: 373791 - protein, 9 aa, Homo Sapiens
DIKGLVDFR

SEQ ID NO: 373792 - protein, 9 aa, Homo Sapiens
YKQVFWERL

SEQ ID NO: 373793 - protein, 9 aa, Homo Sapiens
WCESRAAAV

SEQ ID NO: 373794 - protein, 9 aa, Homo Sapiens
GGSLQVPQN

SEQ ID NO: 373795 - protein, 9 aa, Homo Sapiens
SQSPPSPAG

SEQ ID NO: 373796 - protein, 9 aa, Homo Sapiens
LFNLKMSLM

SEQ ID NO: 373797 - protein, 9 aa, Homo Sapiens
SQQYRALTM

SEQ ID NO: 373798 - protein, 9 aa, Homo Sapiens
ALNEQKELQ

SEQ ID NO: 373799 - protein, 9 aa, Homo Sapiens
PRCPTHPGP

SEQ ID NO: 373800 - protein, 9 aa, Homo Sapiens
KHIKHFLKL

SEQ ID NO: 373801 - protein, 9 aa, Homo Sapiens
SRRAGCLCL

SEQ ID NO: 373802 - protein, 9 aa, Homo Sapiens
NIIQKSSAK

SEQ ID NO: 373803 - protein, 9 aa, Homo Sapiens
SKPIVHAKK

SEQ ID NO: 373804 - protein, 9 aa, Homo Sapiens
VTPRRSPAS

SEQ ID NO: 373805 - protein, 9 aa, Homo Sapiens
LDQSFSFHS

SEQ ID NO: 373806 - protein, 9 aa, Homo Sapiens
VGLPAPLHG

SEQ ID NO: 373807 - protein, 9 aa, Homo Sapiens
NNSIYWQEF

SEQ ID NO: 373808 - protein, 9 aa, Homo Sapiens
AGPRAGAPA

SEQ ID NO: 373809 - protein, 9 aa, Homo Sapiens
PEIQNNQKT

SEQ ID NO: 373810 - protein, 9 aa, Homo Sapiens
HCDQEEDCA

SEQ ID NO: 373811 - protein, 9 aa, Homo Sapiens
PRRSPASAP

SEQ ID NO: 373812 - protein, 9 aa, Homo Sapiens
QEIDFLKML

SEQ ID NO: 373813 - protein, 9 aa, Homo Sapiens
PTPGCRLGP

SEQ ID NO: 373814 - protein, 9 aa, Homo Sapiens
QVPQNAAAA

SEQ ID NO: 373815 - protein, 9 aa, Homo Sapiens
AEEPRRPRP

SEQ ID NO: 373816 - protein, 9 aa, Homo Sapiens
GQRGNGGDG

SEQ ID NO: 373817 - protein, 9 aa, Homo Sapiens
PAAPTRRLL

SEQ ID NO: 373818 - protein, 9 aa, Homo Sapiens
KHCELVVDL

SEQ ID NO: 373819 - protein, 9 aa, Homo Sapiens
MRDFFPTVF

SEQ ID NO: 373820 - protein, 9 aa, Homo Sapiens
GMEGGNATR

SEQ ID NO: 373821 - protein, 9 aa, Homo Sapiens
QKRPFKKWN

SEQ ID NO: 373822 - protein, 9 aa, Homo Sapiens
LGGGPSCRG

SEQ ID NO: 373823 - protein, 9 aa, Homo Sapiens
LLNPERSLE

SEQ ID NO: 373824 - protein, 9 aa, Homo Sapiens
SGPTAGGSR

SEQ ID NO: 373825 - protein, 9 aa, Homo Sapiens
NNFRLQVGL

SEQ ID NO: 373826 - protein, 9 aa, Homo Sapiens
STKYSVYLT

SEQ ID NO: 373827 - protein, 9 aa, Homo Sapiens
GKAWGWEAA

SEQ ID NO: 373828 - protein, 9 aa, Homo Sapiens
EGGPWRGQP

SEQ ID NO: 373829 - protein, 9 aa, Homo Sapiens
RARQGAAAE

SEQ ID NO: 373830 - protein, 9 aa, Homo Sapiens
DDKVVAILG

SEQ ID NO: 373831 - protein, 9 aa, Homo Sapiens
GKSQGGRIL

SEQ ID NO: 373832 - protein, 9 aa, Homo Sapiens
MTAEQNVLQ

SEQ ID NO: 373833 - protein, 9 aa, Homo Sapiens
AAAGTNYSQ

SEQ ID NO: 373834 - protein, 9 aa, Homo Sapiens
PPAPVLLEA

SEQ ID NO: 373835 - protein, 9 aa, Homo Sapiens
IGKCVWSAG

SEQ ID NO: 373836 - protein, 9 aa, Homo Sapiens
TQVVAVFEG

SEQ ID NO: 373837 - protein, 9 aa, Homo Sapiens
VSEECSYFY

SEQ ID NO: 373838 - protein, 9 aa, Homo Sapiens
VKNVTKPLN

SEQ ID NO: 373839 - protein, 9 aa, Homo Sapiens
RTVGTWRIL

SEQ ID NO: 373840 - protein, 9 aa, Homo Sapiens
PAGSALGGG

SEQ ID NO: 373841 - protein, 9 aa, Homo Sapiens
TSPATRFYR

SEQ ID NO: 373842 - protein, 9 aa, Homo Sapiens
ETGDPPPPP

SEQ ID NO: 373843 - protein, 9 aa, Homo Sapiens
ERKRCVTTH

SEQ ID NO: 373844 - protein, 9 aa, Homo Sapiens
WKTSCTTFT

SEQ ID NO: 373845 - protein, 9 aa, Homo Sapiens
MDFGFVEIG

SEQ ID NO: 373846 - protein, 9 aa, Homo Sapiens
AAQAVTNNC

SEQ ID NO: 373847 - protein, 9 aa, Homo Sapiens
TVEPTGKCF

SEQ ID NO: 373848 - protein, 9 aa, Homo Sapiens
YTILQKLAN

SEQ ID NO: 373849 - protein, 9 aa, Homo Sapiens
NGGDGCRGN

SEQ ID NO: 373850 - protein, 9 aa, Homo Sapiens
LAALLALLA

SEQ ID NO: 373851 - protein, 9 aa, Homo Sapiens
PDVGFPFVS

SEQ ID NO: 373852 - protein, 9 aa, Homo Sapiens
GQLRERVRE

SEQ ID NO: 373853 - protein, 9 aa, Homo Sapiens
ALSIGPALQ

SEQ ID NO: 373854 - protein, 9 aa, Homo Sapiens
NWILKQFLH

SEQ ID NO: 373855 - protein, 9 aa, Homo Sapiens
PDDQGGAAQ

SEQ ID NO: 373856 - protein, 9 aa, Homo Sapiens
VDKRVVLHR

SEQ ID NO: 373857 - protein, 9 aa, Homo Sapiens
QCDKKRGAS

SEQ ID NO: 373858 - protein, 9 aa, Homo Sapiens
PKIKETICG

SEQ ID NO: 373859 - protein, 9 aa, Homo Sapiens
FGVEEMATK

SEQ ID NO: 373860 - protein, 9 aa, Homo Sapiens
RNMGEIVIR

SEQ ID NO: 373861 - protein, 9 aa, Homo Sapiens
KPSPSSAAS

SEQ ID NO: 373862 - protein, 9 aa, Homo Sapiens
TCFRAALSD

SEQ ID NO: 373863 - protein, 9 aa, Homo Sapiens
LGSPKPGDG

SEQ ID NO: 373864 - protein, 9 aa, Homo Sapiens
NGTETKLVR

SEQ ID NO: 373865 - protein, 9 aa, Homo Sapiens
GNSLSDESE

SEQ ID NO: 373866 - protein, 9 aa, Homo Sapiens
GMEHISPVP

SEQ ID NO: 373867 - protein, 9 aa, Homo Sapiens
PTNAATAPS

SEQ ID NO: 373868 - protein, 9 aa, Homo Sapiens
LWKGRYYSV

SEQ ID NO: 373869 - protein, 9 aa, Homo Sapiens
DRPDFLKTT

SEQ ID NO: 373870 - protein, 9 aa, Homo Sapiens
QRRPPEKRF

SEQ ID NO: 373871 - protein, 9 aa, Homo Sapiens
VVLHTLLSI

SEQ ID NO: 373872 - protein, 9 aa, Homo Sapiens
VRHFSVPNG

SEQ ID NO: 373873 - protein, 9 aa, Homo Sapiens
RWLSAADRE

SEQ ID NO: 373874 - protein, 9 aa, Homo Sapiens
NHSPHPQPR

SEQ ID NO: 373875 - protein, 9 aa, Homo Sapiens
DGCMLIKLL

SEQ ID NO: 373876 - protein, 9 aa, Homo Sapiens
TDDIRALLI

SEQ ID NO: 373877 - protein, 9 aa, Homo Sapiens
EEGAHVYSQ

SEQ ID NO: 373878 - protein, 9 aa, Homo Sapiens
CWPCSSSVS

SEQ ID NO: 373879 - protein, 9 aa, Homo Sapiens
TAGGGGSWS

SEQ ID NO: 373880 - protein, 9 aa, Homo Sapiens
AEQQQHHVF

SEQ ID NO: 373881 - protein, 9 aa, Homo Sapiens
GDMHPVTIW

SEQ ID NO: 373882 - protein, 9 aa, Homo Sapiens
EGLARVRSR

SEQ ID NO: 373883 - protein, 9 aa, Homo Sapiens
LRMMRRQWS

SEQ ID NO: 373884 - protein, 9 aa, Homo Sapiens
RQRRLSKGC

SEQ ID NO: 373885 - protein, 9 aa, Homo Sapiens
KTEEEELDA

SEQ ID NO: 373886 - protein, 9 aa, Homo Sapiens
CACSPAPTP

SEQ ID NO: 373887 - protein, 9 aa, Homo Sapiens
MMRRQWSLW

SEQ ID NO: 373888 - protein, 9 aa, Homo Sapiens
PHQGQDEGW

SEQ ID NO: 373889 - protein, 9 aa, Homo Sapiens
NSLQLKVFP

SEQ ID NO: 373890 - protein, 9 aa, Homo Sapiens
DQEEIQEAA

SEQ ID NO: 373891 - protein, 9 aa, Homo Sapiens
QAQPGRWCR

SEQ ID NO: 373892 - protein, 9 aa, Homo Sapiens
LLRHPAARG

SEQ ID NO: 373893 - protein, 9 aa, Homo Sapiens
DAVRARCLL

SEQ ID NO: 373894 - protein, 9 aa, Homo Sapiens
SKKNKEKKE

SEQ ID NO: 373895 - protein, 9 aa, Homo Sapiens
EIQAGEELQ

SEQ ID NO: 373896 - protein, 9 aa, Homo Sapiens
RCRKCRKCY

SEQ ID NO: 373897 - protein, 9 aa, Homo Sapiens
YYSAMNYGI

SEQ ID NO: 373898 - protein, 9 aa, Homo Sapiens
LMEKMKTTI

SEQ ID NO: 373899 - protein, 9 aa, Homo Sapiens
LWSTFHQPE

SEQ ID NO: 373900 - protein, 9 aa, Homo Sapiens
VCDNELLYC

SEQ ID NO: 373901 - protein, 9 aa, Homo Sapiens
PPAPGKPPT

SEQ ID NO: 373902 - protein, 9 aa, Homo Sapiens
EMDDHRAVG

SEQ ID NO: 373903 - protein, 9 aa, Homo Sapiens
WCRLSSDPS

SEQ ID NO: 373904 - protein, 9 aa, Homo Sapiens
PDLIDKRSM

SEQ ID NO: 373905 - protein, 9 aa, Homo Sapiens
HTLHHELIS

SEQ ID NO: 373906 - protein, 9 aa, Homo Sapiens
SSCYALFPQ

SEQ ID NO: 373907 - protein, 9 aa, Homo Sapiens
GNMAPMSTE

SEQ ID NO: 373908 - protein, 9 aa, Homo Sapiens
DFVHVIQQV

SEQ ID NO: 373909 - protein, 9 aa, Homo Sapiens
YNFTPLAWH

SEQ ID NO: 373910 - protein, 9 aa, Homo Sapiens
HAQRHELVP

SEQ ID NO: 373911 - protein, 9 aa, Homo Sapiens
GPGKQLYNV

SEQ ID NO: 373912 - protein, 9 aa, Homo Sapiens
PKVPEEGSE

SEQ ID NO: 373913 - protein, 9 aa, Homo Sapiens
AVAPLAPWA

SEQ ID NO: 373914 - protein, 9 aa, Homo Sapiens
IEKMVVLLL

SEQ ID NO: 373915 - protein, 9 aa, Homo Sapiens
ALGGGAPRA

SEQ ID NO: 373916 - protein, 9 aa, Homo Sapiens
DEQAAKQEL

SEQ ID NO: 373917 - protein, 9 aa, Homo Sapiens
ELKTYLCRW

SEQ ID NO: 373918 - protein, 9 aa, Homo Sapiens
FHVKRVIEV

SEQ ID NO: 373919 - protein, 9 aa, Homo Sapiens
TVDSSGPLE

SEQ ID NO: 373920 - protein, 9 aa, Homo Sapiens
CNLLLPCML

SEQ ID NO: 373921 - protein, 9 aa, Homo Sapiens
KKEKSVKEI

SEQ ID NO: 373922 - protein, 9 aa, Homo Sapiens
AGAGPRAGA

SEQ ID NO: 373923 - protein, 9 aa, Homo Sapiens
LQVEASQAE

SEQ ID NO: 373924 - protein, 9 aa, Homo Sapiens
TGDEASTIA

SEQ ID NO: 373925 - protein, 9 aa, Homo Sapiens
MVKIMQATG

SEQ ID NO: 373926 - protein, 9 aa, Homo Sapiens
RSDGGAGRM

SEQ ID NO: 373927 - protein, 9 aa, Homo Sapiens
YETALKGFP

SEQ ID NO: 373928 - protein, 9 aa, Homo Sapiens
WYLQYTDWP

SEQ ID NO: 373929 - protein, 9 aa, Homo Sapiens
LEVFAQARG

SEQ ID NO: 373930 - protein, 9 aa, Homo Sapiens
IKTTSFWSI

SEQ ID NO: 373931 - protein, 9 aa, Homo Sapiens
VPNTPTARA

SEQ ID NO: 373932 - protein, 9 aa, Homo Sapiens
TLLWCVYKK

SEQ ID NO: 373933 - protein, 9 aa, Homo Sapiens
RLQLPIDWD

SEQ ID NO: 373934 - protein, 9 aa, Homo Sapiens
QREQETSDP

SEQ ID NO: 373935 - protein, 9 aa, Homo Sapiens
MNSACHQSP

SEQ ID NO: 373936 - protein, 9 aa, Homo Sapiens
SAHQLKTRS

SEQ ID NO: 373937 - protein, 9 aa, Homo Sapiens
VGEHGQQVG

SEQ ID NO: 373938 - protein, 9 aa, Homo Sapiens
VVLGLRSVQ

SEQ ID NO: 373939 - protein, 9 aa, Homo Sapiens
SISVGKANK

SEQ ID NO: 373940 - protein, 9 aa, Homo Sapiens
SPMRLNLTK

SEQ ID NO: 373941 - protein, 9 aa, Homo Sapiens
VGETFHALQ

SEQ ID NO: 373942 - protein, 9 aa, Homo Sapiens
HRGLVDGWR

SEQ ID NO: 373943 - protein, 9 aa, Homo Sapiens
GGVGAQAPP

SEQ ID NO: 373944 - protein, 9 aa, Homo Sapiens
PWAPVPARL

SEQ ID NO: 373945 - protein, 9 aa, Homo Sapiens
FYRLISGPH

SEQ ID NO: 373946 - protein, 9 aa, Homo Sapiens
VSPEEGAHV

SEQ ID NO: 373947 - protein, 9 aa, Homo Sapiens
CGGARGHAG

SEQ ID NO: 373948 - protein, 9 aa, Homo Sapiens
EPMLCKVLN

SEQ ID NO: 373949 - protein, 9 aa, Homo Sapiens
PVLTQAVFE

SEQ ID NO: 373950 - protein, 9 aa, Homo Sapiens
ELRLLGGKT

SEQ ID NO: 373951 - protein, 9 aa, Homo Sapiens
GAPKKEKSV

SEQ ID NO: 373952 - protein, 9 aa, Homo Sapiens
MLISLLAPL

SEQ ID NO: 373953 - protein, 9 aa, Homo Sapiens
ACANSWSTW

SEQ ID NO: 373954 - protein, 9 aa, Homo Sapiens
KMHTARVCD

SEQ ID NO: 373955 - protein, 9 aa, Homo Sapiens
YSVYLTKGH

SEQ ID NO: 373956 - protein, 9 aa, Homo Sapiens
WDSSEMGAV

SEQ ID NO: 373957 - protein, 9 aa, Homo Sapiens
ARLTVNTDV

SEQ ID NO: 373958 - protein, 9 aa, Homo Sapiens
RVYDKPRTT

SEQ ID NO: 373959 - protein, 9 aa, Homo Sapiens
ISGSEATSQ

SEQ ID NO: 373960 - protein, 9 aa, Homo Sapiens
WLSAADRER

SEQ ID NO: 373961 - protein, 9 aa, Homo Sapiens
RGPSPWASA

SEQ ID NO: 373962 - protein, 9 aa, Homo Sapiens
RATGRHVSL

SEQ ID NO: 373963 - protein, 9 aa, Homo Sapiens
VRHRAADWA

SEQ ID NO: 373964 - protein, 9 aa, Homo Sapiens
LQEVHPQVH

SEQ ID NO: 373965 - protein, 9 aa, Homo Sapiens
RGTGRGRQE

SEQ ID NO: 373966 - protein, 9 aa, Homo Sapiens
RIKPKPVDV

SEQ ID NO: 373967 - protein, 9 aa, Homo Sapiens
YCVDPTRVN

SEQ ID NO: 373968 - protein, 9 aa, Homo Sapiens
PPSSKPYWM

SEQ ID NO: 373969 - protein, 9 aa, Homo Sapiens
CSALATVCW

SEQ ID NO: 373970 - protein, 9 aa, Homo Sapiens
NPGTLSSGG

SEQ ID NO: 373971 - protein, 9 aa, Homo Sapiens
SLSKNPKIF

SEQ ID NO: 373972 - protein, 9 aa, Homo Sapiens
VMIITRTLV

SEQ ID NO: 373973 - protein, 9 aa, Homo Sapiens
APRALQAGG

SEQ ID NO: 373974 - protein, 9 aa, Homo Sapiens
KGSEERRPH

SEQ ID NO: 373975 - protein, 9 aa, Homo Sapiens
EKRFGHIQQ

SEQ ID NO: 373976 - protein, 9 aa, Homo Sapiens
LIQKMYPED

SEQ ID NO: 373977 - protein, 9 aa, Homo Sapiens
FNKKRKKMF

SEQ ID NO: 373978 - protein, 9 aa, Homo Sapiens
CLRLRRASG

SEQ ID NO: 373979 - protein, 9 aa, Homo Sapiens
AACSQQEQA

SEQ ID NO: 373980 - protein, 9 aa, Homo Sapiens
VGQGCVPEQ

SEQ ID NO: 373981 - protein, 9 aa, Homo Sapiens
PPPLPADLP

SEQ ID NO: 373982 - protein, 9 aa, Homo Sapiens
GPLSLWRLE

SEQ ID NO: 373983 - protein, 9 aa, Homo Sapiens
RYSQPCPSS

SEQ ID NO: 373984 - protein, 9 aa, Homo Sapiens
RPWLHAYVL

SEQ ID NO: 373985 - protein, 9 aa, Homo Sapiens
ACSQQEQAL

SEQ ID NO: 373986 - protein, 9 aa, Homo Sapiens
ECVGARIND

SEQ ID NO: 373987 - protein, 9 aa, Homo Sapiens
PLPCPAAPR

SEQ ID NO: 373988 - protein, 9 aa, Homo Sapiens
LLYCQNGGT

SEQ ID NO: 373989 - protein, 9 aa, Homo Sapiens
SVINHFNVE

SEQ ID NO: 373990 - protein, 9 aa, Homo Sapiens
EDGFETELS

SEQ ID NO: 373991 - protein, 9 aa, Homo Sapiens
LLDEKLLVR

SEQ ID NO: 373992 - protein, 9 aa, Homo Sapiens
ARGALATGS

SEQ ID NO: 373993 - protein, 9 aa, Homo Sapiens
QLATSYFID

SEQ ID NO: 373994 - protein, 9 aa, Homo Sapiens
GAPPCRPRV

SEQ ID NO: 373995 - protein, 9 aa, Homo Sapiens
GIHGARPSQ

SEQ ID NO: 373996 - protein, 9 aa, Homo Sapiens
MVAAGALAS

SEQ ID NO: 373997 - protein, 9 aa, Homo Sapiens
VNLRAQELA

SEQ ID NO: 373998 - protein, 9 aa, Homo Sapiens
HFQATITNC

SEQ ID NO: 373999 - protein, 9 aa, Homo Sapiens
DMLLEIDNS

SEQ ID NO: 374000 - protein, 9 aa, Homo Sapiens
AFDLTQVVA

SEQ ID NO: 374001 - protein, 9 aa, Homo Sapiens
HKKPRTPKI

SEQ ID NO: 374002 - protein, 9 aa, Homo Sapiens
TPGPPPCRP

SEQ ID NO: 374003 - protein, 9 aa, Homo Sapiens
VVAAMGQDC

SEQ ID NO: 374004 - protein, 9 aa, Homo Sapiens
NQPRTESPP

SEQ ID NO: 374005 - protein, 9 aa, Homo Sapiens
EIKGEQFTV

SEQ ID NO: 374006 - protein, 9 aa, Homo Sapiens
LVQKVVTCF

SEQ ID NO: 374007 - protein, 9 aa, Homo Sapiens
LMRFLTYSY

SEQ ID NO: 374008 - protein, 9 aa, Homo Sapiens
ALFTSLASG

SEQ ID NO: 374009 - protein, 9 aa, Homo Sapiens
LNPLMFVPA

SEQ ID NO: 374010 - protein, 9 aa, Homo Sapiens
EIDFLKMLY

SEQ ID NO: 374011 - protein, 9 aa, Homo Sapiens
TVNTDVGYY

SEQ ID NO: 374012 - protein, 9 aa, Homo Sapiens
PESSTTSSG

SEQ ID NO: 374013 - protein, 9 aa, Homo Sapiens
RISNAENKH

SEQ ID NO: 374014 - protein, 9 aa, Homo Sapiens
FFVPMSLAC

SEQ ID NO: 374015 - protein, 9 aa, Homo Sapiens
WGLTKEASV

SEQ ID NO: 374016 - protein, 9 aa, Homo Sapiens
TGSHAPGTA

SEQ ID NO: 374017 - protein, 9 aa, Homo Sapiens
NGVIAFVLW

SEQ ID NO: 374018 - protein, 9 aa, Homo Sapiens
LRHVGLLLR

SEQ ID NO: 374019 - protein, 9 aa, Homo Sapiens
ASSVSPPQA

SEQ ID NO: 374020 - protein, 9 aa, Homo Sapiens
SRPTPVTKA

SEQ ID NO: 374021 - protein, 9 aa, Homo Sapiens
FIKKITSER

SEQ ID NO: 374022 - protein, 9 aa, Homo Sapiens
VLCWFAERV

SEQ ID NO: 374023 - protein, 9 aa, Homo Sapiens
IGCSVSKTP

SEQ ID NO: 374024 - protein, 9 aa, Homo Sapiens
PLSGEALSI

SEQ ID NO: 374025 - protein, 9 aa, Homo Sapiens
RTPTDPTNA

SEQ ID NO: 374026 - protein, 9 aa, Homo Sapiens
LKKILPNQK

SEQ ID NO: 374027 - protein, 9 aa, Homo Sapiens
ELVIHNRGK

SEQ ID NO: 374028 - protein, 9 aa, Homo Sapiens
EELARDARR

SEQ ID NO: 374029 - protein, 9 aa, Homo Sapiens
SWCGTWTAW

SEQ ID NO: 374030 - protein, 9 aa, Homo Sapiens
IQAGEELQS

SEQ ID NO: 374031 - protein, 9 aa, Homo Sapiens
TDLFPVLST

SEQ ID NO: 374032 - protein, 9 aa, Homo Sapiens
LRCLQHFYI

SEQ ID NO: 374033 - protein, 9 aa, Homo Sapiens
AHIRAHTPT

SEQ ID NO: 374034 - protein, 9 aa, Homo Sapiens
GTSRAAGTT

SEQ ID NO: 374035 - protein, 9 aa, Homo Sapiens
MRETSVFTL

SEQ ID NO: 374036 - protein, 9 aa, Homo Sapiens
PKQGGKVDI

SEQ ID NO: 374037 - protein, 9 aa, Homo Sapiens
RFLLGVNVV

SEQ ID NO: 374038 - protein, 9 aa, Homo Sapiens
AEKLGSCPQ

SEQ ID NO: 374039 - protein, 9 aa, Homo Sapiens
TEPEVPPRP

SEQ ID NO: 374040 - protein, 9 aa, Homo Sapiens
FLCFFYLLY

SEQ ID NO: 374041 - protein, 9 aa, Homo Sapiens
GFIFGHAAN

SEQ ID NO: 374042 - protein, 9 aa, Homo Sapiens
SDLDQSFSF

SEQ ID NO: 374043 - protein, 9 aa, Homo Sapiens
ESLGLWGTR

SEQ ID NO: 374044 - protein, 9 aa, Homo Sapiens
NKSFYMHRN

SEQ ID NO: 374045 - protein, 9 aa, Homo Sapiens
IVYISANVG

SEQ ID NO: 374046 - protein, 9 aa, Homo Sapiens
CSVSKTPDE

SEQ ID NO: 374047 - protein, 9 aa, Homo Sapiens
QTPLDLATT

SEQ ID NO: 374048 - protein, 9 aa, Homo Sapiens
APSSPPSSA

SEQ ID NO: 374049 - protein, 9 aa, Homo Sapiens
AEAEAGQLR

SEQ ID NO: 374050 - protein, 9 aa, Homo Sapiens
REVRHRAAD

SEQ ID NO: 374051 - protein, 9 aa, Homo Sapiens
LGRIQGRFS

SEQ ID NO: 374052 - protein, 9 aa, Homo Sapiens
LNSCFSRIV

SEQ ID NO: 374053 - protein, 9 aa, Homo Sapiens
ACSLDLHFG

SEQ ID NO: 374054 - protein, 9 aa, Homo Sapiens
CYVEVCVWR

SEQ ID NO: 374055 - protein, 9 aa, Homo Sapiens
IEEQSQTVK

SEQ ID NO: 374056 - protein, 9 aa, Homo Sapiens
YGLVKMHEI

SEQ ID NO: 374057 - protein, 9 aa, Homo Sapiens
IKKVDQGKV

SEQ ID NO: 374058 - protein, 9 aa, Homo Sapiens
PPSPLSRPG

SEQ ID NO: 374059 - protein, 9 aa, Homo Sapiens
DKPLKKKKT

SEQ ID NO: 374060 - protein, 9 aa, Homo Sapiens
ILERNPTNV

SEQ ID NO: 374061 - protein, 9 aa, Homo Sapiens
RGSLGHITF

SEQ ID NO: 374062 - protein, 9 aa, Homo Sapiens
QDPNLLRQF

SEQ ID NO: 374063 - protein, 9 aa, Homo Sapiens
AVTLCEQCD

SEQ ID NO: 374064 - protein, 9 aa, Homo Sapiens
RRTPTDPTN

SEQ ID NO: 374065 - protein, 9 aa, Homo Sapiens
CGALHVPDV

SEQ ID NO: 374066 - protein, 9 aa, Homo Sapiens
WKHLKFIGN

SEQ ID NO: 374067 - protein, 9 aa, Homo Sapiens
EPELSPTYL

SEQ ID NO: 374068 - protein, 9 aa, Homo Sapiens
PIAMVQAAT

SEQ ID NO: 374069 - protein, 9 aa, Homo Sapiens
AGTSARPSP

SEQ ID NO: 374070 - protein, 9 aa, Homo Sapiens
LLALGTGDP

SEQ ID NO: 374071 - protein, 9 aa, Homo Sapiens
FYWKHLKFI

SEQ ID NO: 374072 - protein, 9 aa, Homo Sapiens
YASCRSETL

SEQ ID NO: 374073 - protein, 9 aa, Homo Sapiens
EGRSSTNAR

SEQ ID NO: 374074 - protein, 9 aa, Homo Sapiens
APLHGRVPV

SEQ ID NO: 374075 - protein, 9 aa, Homo Sapiens
PRDHNEPSI

SEQ ID NO: 374076 - protein, 9 aa, Homo Sapiens
GTACVFMTT

SEQ ID NO: 374077 - protein, 9 aa, Homo Sapiens
LKGVLSPRI

SEQ ID NO: 374078 - protein, 9 aa, Homo Sapiens
GRVPVGQGC

SEQ ID NO: 374079 - protein, 9 aa, Homo Sapiens
ERVVLRKPQ

SEQ ID NO: 374080 - protein, 9 aa, Homo Sapiens
ARCRPPWAA

SEQ ID NO: 374081 - protein, 9 aa, Homo Sapiens
AHVYSQVTV

SEQ ID NO: 374082 - protein, 9 aa, Homo Sapiens
DPSRSPSVA

SEQ ID NO: 374083 - protein, 9 aa, Homo Sapiens
KLREKQSSH

SEQ ID NO: 374084 - protein, 9 aa, Homo Sapiens
ASPDVGFPF

SEQ ID NO: 374085 - protein, 9 aa, Homo Sapiens
RIPIPSLMA

SEQ ID NO: 374086 - protein, 9 aa, Homo Sapiens
VVMAVCGGS

SEQ ID NO: 374087 - protein, 9 aa, Homo Sapiens
TVSRPTPVT

SEQ ID NO: 374088 - protein, 9 aa, Homo Sapiens
VLDADCVTC

SEQ ID NO: 374089 - protein, 9 aa, Homo Sapiens
ARRAISTFG

SEQ ID NO: 374090 - protein, 9 aa, Homo Sapiens
ITEHVPLGN

SEQ ID NO: 374091 - protein, 9 aa, Homo Sapiens
SMMMECMTT

SEQ ID NO: 374092 - protein, 9 aa, Homo Sapiens
TRMLRATTL

SEQ ID NO: 374093 - protein, 9 aa, Homo Sapiens
NEYEDEDQW

SEQ ID NO: 374094 - protein, 9 aa, Homo Sapiens
QPLNNSQGT

SEQ ID NO: 374095 - protein, 9 aa, Homo Sapiens
MTGPFFRYC

SEQ ID NO: 374096 - protein, 9 aa, Homo Sapiens
TALRCSASP

SEQ ID NO: 374097 - protein, 9 aa, Homo Sapiens
ILLWLLGSR

SEQ ID NO: 374098 - protein, 9 aa, Homo Sapiens
IQDKVKPQK

SEQ ID NO: 374099 - protein, 9 aa, Homo Sapiens
KHKHFYWKH

SEQ ID NO: 374100 - protein, 9 aa, Homo Sapiens
GNPVAAPTD

SEQ ID NO: 374101 - protein, 9 aa, Homo Sapiens
YERVVLRKP

SEQ ID NO: 374102 - protein, 9 aa, Homo Sapiens
ITVIEGNSS

SEQ ID NO: 374103 - protein, 9 aa, Homo Sapiens
TPSLPPCSI

SEQ ID NO: 374104 - protein, 9 aa, Homo Sapiens
EVNFIKKIT

SEQ ID NO: 374105 - protein, 9 aa, Homo Sapiens
YIPYNSQQF

SEQ ID NO: 374106 - protein, 9 aa, Homo Sapiens
CLQHFYIIG

SEQ ID NO: 374107 - protein, 9 aa, Homo Sapiens
HSHFFLPVS

SEQ ID NO: 374108 - protein, 9 aa, Homo Sapiens
ASLKLPQDQ

SEQ ID NO: 374109 - protein, 9 aa, Homo Sapiens
ERIMQRFSR

SEQ ID NO: 374110 - protein, 9 aa, Homo Sapiens
KYGKAFAKK

SEQ ID NO: 374111 - protein, 9 aa, Homo Sapiens
VKAKNGRET

SEQ ID NO: 374112 - protein, 9 aa, Homo Sapiens
AVHVQELQK

SEQ ID NO: 374113 - protein, 9 aa, Homo Sapiens
EKQSSHSLR

SEQ ID NO: 374114 - protein, 9 aa, Homo Sapiens
GDVSDVGLW

SEQ ID NO: 374115 - protein, 9 aa, Homo Sapiens
RQYHTSAER

SEQ ID NO: 374116 - protein, 9 aa, Homo Sapiens
AFSTRLAVS

SEQ ID NO: 374117 - protein, 9 aa, Homo Sapiens
LRALVTPDP

SEQ ID NO: 374118 - protein, 9 aa, Homo Sapiens
HRPPSSCWS

SEQ ID NO: 374119 - protein, 9 aa, Homo Sapiens
KERTEPEVP

SEQ ID NO: 374120 - protein, 9 aa, Homo Sapiens
MIQVLMSVV

SEQ ID NO: 374121 - protein, 9 aa, Homo Sapiens
PWLHAYVLW

SEQ ID NO: 374122 - protein, 9 aa, Homo Sapiens
KKASSPATM

SEQ ID NO: 374123 - protein, 9 aa, Homo Sapiens
DKDGLEKEK

SEQ ID NO: 374124 - protein, 9 aa, Homo Sapiens
NSNSLNHVK

SEQ ID NO: 374125 - protein, 9 aa, Homo Sapiens
AVGPPTALW

SEQ ID NO: 374126 - protein, 9 aa, Homo Sapiens
GDPKAPHTT

SEQ ID NO: 374127 - protein, 9 aa, Homo Sapiens
PSPFPSLQN

SEQ ID NO: 374128 - protein, 9 aa, Homo Sapiens
TKASNTIAP

SEQ ID NO: 374129 - protein, 9 aa, Homo Sapiens
SPNVTSMES

SEQ ID NO: 374130 - protein, 9 aa, Homo Sapiens
IIVTNGAAW

SEQ ID NO: 374131 - protein, 9 aa, Homo Sapiens
MKLNISDTR

SEQ ID NO: 374132 - protein, 9 aa, Homo Sapiens
SSKCSVLGR

SEQ ID NO: 374133 - protein, 9 aa, Homo Sapiens
MMIRFFWME

SEQ ID NO: 374134 - protein, 9 aa, Homo Sapiens
LRAWWLPER

SEQ ID NO: 374135 - protein, 9 aa, Homo Sapiens
GGSGKAWGW

SEQ ID NO: 374136 - protein, 9 aa, Homo Sapiens
SEGSFLVKR

SEQ ID NO: 374137 - protein, 9 aa, Homo Sapiens
KNVAKPLDG

SEQ ID NO: 374138 - protein, 9 aa, Homo Sapiens
LFNNSSVGP

SEQ ID NO: 374139 - protein, 9 aa, Homo Sapiens
GLQVPQPPQ

SEQ ID NO: 374140 - protein, 9 aa, Homo Sapiens
SSSSGYLCI

SEQ ID NO: 374141 - protein, 9 aa, Homo Sapiens
YRWLSAADR

SEQ ID NO: 374142 - protein, 9 aa, Homo Sapiens
LSLRSLQRS

SEQ ID NO: 374143 - protein, 9 aa, Homo Sapiens
EVLEVDKRV

SEQ ID NO: 374144 - protein, 9 aa, Homo Sapiens
SQALQAVLQ

SEQ ID NO: 374145 - protein, 9 aa, Homo Sapiens
RDEIDHLLQ

SEQ ID NO: 374146 - protein, 9 aa, Homo Sapiens
SGSGRARGT

SEQ ID NO: 374147 - protein, 9 aa, Homo Sapiens
SLEKEIKSQ

SEQ ID NO: 374148 - protein, 9 aa, Homo Sapiens
PSGSSYRCT

SEQ ID NO: 374149 - protein, 9 aa, Homo Sapiens
TACVFMTTF

SEQ ID NO: 374150 - protein, 9 aa, Homo Sapiens
PSHIRHGSG

SEQ ID NO: 374151 - protein, 9 aa, Homo Sapiens
LLALNHMGR

SEQ ID NO: 374152 - protein, 9 aa, Homo Sapiens
ECTPRGWHC

SEQ ID NO: 374153 - protein, 9 aa, Homo Sapiens
KKIWKYFGK

SEQ ID NO: 374154 - protein, 9 aa, Homo Sapiens
WDRPFQRTV

SEQ ID NO: 374155 - protein, 9 aa, Homo Sapiens
LGDLTLLQE

SEQ ID NO: 374156 - protein, 9 aa, Homo Sapiens
AIHLHVSRL

SEQ ID NO: 374157 - protein, 9 aa, Homo Sapiens
PLYHEIMER

SEQ ID NO: 374158 - protein, 9 aa, Homo Sapiens
LGLENRQDP

SEQ ID NO: 374159 - protein, 9 aa, Homo Sapiens
VGACFGQTS

SEQ ID NO: 374160 - protein, 9 aa, Homo Sapiens
ILPCGVDRR

SEQ ID NO: 374161 - protein, 9 aa, Homo Sapiens
WVCDWLATC

SEQ ID NO: 374162 - protein, 9 aa, Homo Sapiens
HTHTGEKPY

SEQ ID NO: 374163 - protein, 9 aa, Homo Sapiens
RKHRTKSAE

SEQ ID NO: 374164 - protein, 9 aa, Homo Sapiens
QCCPQCKKR

SEQ ID NO: 374165 - protein, 9 aa, Homo Sapiens
PAGCTPPVA

SEQ ID NO: 374166 - protein, 9 aa, Homo Sapiens
NVSSASEAQ

SEQ ID NO: 374167 - protein, 9 aa, Homo Sapiens
RQQQQQRRP

SEQ ID NO: 374168 - protein, 9 aa, Homo Sapiens
LQPSMIQEV

SEQ ID NO: 374169 - protein, 9 aa, Homo Sapiens
EREHTPCAE

SEQ ID NO: 374170 - protein, 9 aa, Homo Sapiens
PQEQLTMSD

SEQ ID NO: 374171 - protein, 9 aa, Homo Sapiens
KESRMEIAK

SEQ ID NO: 374172 - protein, 9 aa, Homo Sapiens
EALGSWGQT

SEQ ID NO: 374173 - protein, 9 aa, Homo Sapiens
IKLSLKQGK

SEQ ID NO: 374174 - protein, 9 aa, Homo Sapiens
LQSALDCIF

SEQ ID NO: 374175 - protein, 9 aa, Homo Sapiens
VRLCKDGMW

SEQ ID NO: 374176 - protein, 9 aa, Homo Sapiens
SWLEKTEFT

SEQ ID NO: 374177 - protein, 9 aa, Homo Sapiens
LNRLGLALL

SEQ ID NO: 374178 - protein, 9 aa, Homo Sapiens
RVGETFHAL

SEQ ID NO: 374179 - protein, 9 aa, Homo Sapiens
PILRTLRCP

SEQ ID NO: 374180 - protein, 9 aa, Homo Sapiens
GQVDVENGN

SEQ ID NO: 374181 - protein, 9 aa, Homo Sapiens
ELSPTYLIS

SEQ ID NO: 374182 - protein, 9 aa, Homo Sapiens
LFLASVTII

SEQ ID NO: 374183 - protein, 9 aa, Homo Sapiens
AASAAVTQC

SEQ ID NO: 374184 - protein, 9 aa, Homo Sapiens
RIHPLPGPI

SEQ ID NO: 374185 - protein, 9 aa, Homo Sapiens
KVYFMYLTS

SEQ ID NO: 374186 - protein, 9 aa, Homo Sapiens
PSVASFQMP

SEQ ID NO: 374187 - protein, 9 aa, Homo Sapiens
HAPPPRMAA

SEQ ID NO: 374188 - protein, 9 aa, Homo Sapiens
NKYTILQKL

SEQ ID NO: 374189 - protein, 9 aa, Homo Sapiens
FGQAISLDL

SEQ ID NO: 374190 - protein, 9 aa, Homo Sapiens
EVGEIRWGA

SEQ ID NO: 374191 - protein, 9 aa, Homo Sapiens
LNMFAKPEA

SEQ ID NO: 374192 - protein, 9 aa, Homo Sapiens
LFTSLASGT

SEQ ID NO: 374193 - protein, 9 aa, Homo Sapiens
PSRCRYWDL

SEQ ID NO: 374194 - protein, 9 aa, Homo Sapiens
HLLSTPIFG

SEQ ID NO: 374195 - protein, 9 aa, Homo Sapiens
IQLTMNDSK

SEQ ID NO: 374196 - protein, 9 aa, Homo Sapiens
LLFSTFCDS

SEQ ID NO: 374197 - protein, 9 aa, Homo Sapiens
GAPPSHREA

SEQ ID NO: 374198 - protein, 9 aa, Homo Sapiens
GLGAQHVGQ

SEQ ID NO: 374199 - protein, 9 aa, Homo Sapiens
LGCQHCVQR

SEQ ID NO: 374200 - protein, 9 aa, Homo Sapiens
SAKSPTVTF

SEQ ID NO: 374201 - protein, 9 aa, Homo Sapiens
MVVLLLQPS

SEQ ID NO: 374202 - protein, 9 aa, Homo Sapiens
KVYVDPIDY

SEQ ID NO: 374203 - protein, 9 aa, Homo Sapiens
EADVDNEYE

SEQ ID NO: 374204 - protein, 9 aa, Homo Sapiens
PVWAVLAWA

SEQ ID NO: 374205 - protein, 9 aa, Homo Sapiens
SLWRRNPAG

SEQ ID NO: 374206 - protein, 9 aa, Homo Sapiens
ECVKQQANE

SEQ ID NO: 374207 - protein, 9 aa, Homo Sapiens
PPWAARSWC

SEQ ID NO: 374208 - protein, 9 aa, Homo Sapiens
QDKVKPQKL

SEQ ID NO: 374209 - protein, 9 aa, Homo Sapiens
SIIIKRKRG

SEQ ID NO: 374210 - protein, 9 aa, Homo Sapiens
SRSHQRAEY

SEQ ID NO: 374211 - protein, 9 aa, Homo Sapiens
NAQCCDCWE

SEQ ID NO: 374212 - protein, 9 aa, Homo Sapiens
VQFAVLLVD

SEQ ID NO: 374213 - protein, 9 aa, Homo Sapiens
FGNYRNLVF

SEQ ID NO: 374214 - protein, 9 aa, Homo Sapiens
AGSGGACSM

SEQ ID NO: 374215 - protein, 9 aa, Homo Sapiens
IPPQRAGSR

SEQ ID NO: 374216 - protein, 9 aa, Homo Sapiens
ALLALLALG

SEQ ID NO: 374217 - protein, 9 aa, Homo Sapiens
PKGGPLLDT

SEQ ID NO: 374218 - protein, 9 aa, Homo Sapiens
GGNGSAGTP

SEQ ID NO: 374219 - protein, 9 aa, Homo Sapiens
KMNSSKCSV

SEQ ID NO: 374220 - protein, 9 aa, Homo Sapiens
QMECVGARI

SEQ ID NO: 374221 - protein, 9 aa, Homo Sapiens
WVLFEDPYS

SEQ ID NO: 374222 - protein, 9 aa, Homo Sapiens
LWEDRAKNT

SEQ ID NO: 374223 - protein, 9 aa, Homo Sapiens
GPWRPELLP

SEQ ID NO: 374224 - protein, 9 aa, Homo Sapiens
GSSRGTSIT

SEQ ID NO: 374225 - protein, 9 aa, Homo Sapiens
LKTTSSSLC

SEQ ID NO: 374226 - protein, 9 aa, Homo Sapiens
VKKHWIDYQ

SEQ ID NO: 374227 - protein, 9 aa, Homo Sapiens
TEYEHATNC

SEQ ID NO: 374228 - protein, 9 aa, Homo Sapiens
IKELQALIE

SEQ ID NO: 374229 - protein, 9 aa, Homo Sapiens
PLINSSACD

SEQ ID NO: 374230 - protein, 9 aa, Homo Sapiens
ATRAGDKEL

SEQ ID NO: 374231 - protein, 9 aa, Homo Sapiens
EDSKNGFIF

SEQ ID NO: 374232 - protein, 9 aa, Homo Sapiens
YHVNESACY

SEQ ID NO: 374233 - protein, 9 aa, Homo Sapiens
QTVFWGQEW

SEQ ID NO: 374234 - protein, 9 aa, Homo Sapiens
KRKNYCEFR

SEQ ID NO: 374235 - protein, 9 aa, Homo Sapiens
LQSNVEHLM

SEQ ID NO: 374236 - protein, 9 aa, Homo Sapiens
TTSSSGTSR

SEQ ID NO: 374237 - protein, 9 aa, Homo Sapiens
SEDSYTPEA

SEQ ID NO: 374238 - protein, 9 aa, Homo Sapiens
EWWTMVCNL

SEQ ID NO: 374239 - protein, 9 aa, Homo Sapiens
CSATVLSLM

SEQ ID NO: 374240 - protein, 9 aa, Homo Sapiens
TWAGWGPGS

SEQ ID NO: 374241 - protein, 9 aa, Homo Sapiens
SSDPSRSPS

SEQ ID NO: 374242 - protein, 9 aa, Homo Sapiens
QRPWWNVLP

SEQ ID NO: 374243 - protein, 9 aa, Homo Sapiens
LSAQPWRLR

SEQ ID NO: 374244 - protein, 9 aa, Homo Sapiens
FEPKMTHSK

SEQ ID NO: 374245 - protein, 9 aa, Homo Sapiens
ASCSRGARG

SEQ ID NO: 374246 - protein, 9 aa, Homo Sapiens
SKAYNNQPT

SEQ ID NO: 374247 - protein, 9 aa, Homo Sapiens
LSPTYLISE

SEQ ID NO: 374248 - protein, 9 aa, Homo Sapiens
RESGLLLRH

SEQ ID NO: 374249 - protein, 9 aa, Homo Sapiens
FEEALERYG

SEQ ID NO: 374250 - protein, 9 aa, Homo Sapiens
LNSPGSMVI

SEQ ID NO: 374251 - protein, 9 aa, Homo Sapiens
LKMLYMEEI

SEQ ID NO: 374252 - protein, 9 aa, Homo Sapiens
YFVPNTPTA

SEQ ID NO: 374253 - protein, 9 aa, Homo Sapiens
AMKPLPVVL

SEQ ID NO: 374254 - protein, 9 aa, Homo Sapiens
RSMPEYFLE

SEQ ID NO: 374255 - protein, 9 aa, Homo Sapiens
NISDTRGVG

SEQ ID NO: 374256 - protein, 9 aa, Homo Sapiens
NIARQLYHL

SEQ ID NO: 374257 - protein, 9 aa, Homo Sapiens
LGSHSVTQA

SEQ ID NO: 374258 - protein, 9 aa, Homo Sapiens
YPVEDLTAT

SEQ ID NO: 374259 - protein, 9 aa, Homo Sapiens
ISTHLTVVT

SEQ ID NO: 374260 - protein, 9 aa, Homo Sapiens
CLQTRDAFL

SEQ ID NO: 374261 - protein, 9 aa, Homo Sapiens
FAVLLVDAL

SEQ ID NO: 374262 - protein, 9 aa, Homo Sapiens
PWASGRRVW

SEQ ID NO: 374263 - protein, 9 aa, Homo Sapiens
SRGTSITLS

SEQ ID NO: 374264 - protein, 9 aa, Homo Sapiens
NRQFMNSAC

SEQ ID NO: 374265 - protein, 9 aa, Homo Sapiens
ICSALATVC

SEQ ID NO: 374266 - protein, 9 aa, Homo Sapiens
RARAGAGAG

SEQ ID NO: 374267 - protein, 9 aa, Homo Sapiens
CNRSEDLGH

SEQ ID NO: 374268 - protein, 9 aa, Homo Sapiens
FQTFVTTQE

SEQ ID NO: 374269 - protein, 9 aa, Homo Sapiens
RHAPPPRMA

SEQ ID NO: 374270 - protein, 9 aa, Homo Sapiens
VYNVRLSWE

SEQ ID NO: 374271 - protein, 9 aa, Homo Sapiens
TFSTTALSC

SEQ ID NO: 374272 - protein, 9 aa, Homo Sapiens
PLGNLSPGV

SEQ ID NO: 374273 - protein, 9 aa, Homo Sapiens
APLAPWAWG

SEQ ID NO: 374274 - protein, 9 aa, Homo Sapiens
SSGRTPLTQ

SEQ ID NO: 374275 - protein, 9 aa, Homo Sapiens
CLGNYPEVL

SEQ ID NO: 374276 - protein, 9 aa, Homo Sapiens
SPDSRALVG

SEQ ID NO: 374277 - protein, 9 aa, Homo Sapiens
LLWEALWPG

SEQ ID NO: 374278 - protein, 9 aa, Homo Sapiens
DLNPLMFVP

SEQ ID NO: 374279 - protein, 9 aa, Homo Sapiens
SPALRARWS

SEQ ID NO: 374280 - protein, 9 aa, Homo Sapiens
HWLQESRRS

SEQ ID NO: 374281 - protein, 9 aa, Homo Sapiens
FTLEVEQCL

SEQ ID NO: 374282 - protein, 9 aa, Homo Sapiens
TQCRPAGRC

SEQ ID NO: 374283 - protein, 9 aa, Homo Sapiens
GGSRGLRLL

SEQ ID NO: 374284 - protein, 9 aa, Homo Sapiens
LSKGCWRWS

SEQ ID NO: 374285 - protein, 9 aa, Homo Sapiens
SPWASAWWA

SEQ ID NO: 374286 - protein, 9 aa, Homo Sapiens
KTHTRETTY

SEQ ID NO: 374287 - protein, 9 aa, Homo Sapiens
EVFAQARGF

SEQ ID NO: 374288 - protein, 9 aa, Homo Sapiens
DGLYKMDFG

SEQ ID NO: 374289 - protein, 9 aa, Homo Sapiens
VCWPCSSSV

SEQ ID NO: 374290 - protein, 9 aa, Homo Sapiens
MELRLVDGS

SEQ ID NO: 374291 - protein, 9 aa, Homo Sapiens
QGKPTSQLV

SEQ ID NO: 374292 - protein, 9 aa, Homo Sapiens
EQSQTVKCS

SEQ ID NO: 374293 - protein, 9 aa, Homo Sapiens
DLPIVPLAA

SEQ ID NO: 374294 - protein, 9 aa, Homo Sapiens
SVLLRAPPG

SEQ ID NO: 374295 - protein, 9 aa, Homo Sapiens
STKASNTIA

SEQ ID NO: 374296 - protein, 9 aa, Homo Sapiens
SCRSFRSGD

SEQ ID NO: 374297 - protein, 9 aa, Homo Sapiens
IVPIDGQIA

SEQ ID NO: 374298 - protein, 9 aa, Homo Sapiens
RAYETTAGA

SEQ ID NO: 374299 - protein, 9 aa, Homo Sapiens
NEKSLLQMV

SEQ ID NO: 374300 - protein, 9 aa, Homo Sapiens
AVWGGGRPG

SEQ ID NO: 374301 - protein, 9 aa, Homo Sapiens
PIGANGFTG

SEQ ID NO: 374302 - protein, 9 aa, Homo Sapiens
EKKESSPIE

SEQ ID NO: 374303 - protein, 9 aa, Homo Sapiens
ECMFPKTTD

SEQ ID NO: 374304 - protein, 9 aa, Homo Sapiens
HVPDVSLRN

SEQ ID NO: 374305 - protein, 9 aa, Homo Sapiens
LTQRKKLPW

SEQ ID NO: 374306 - protein, 9 aa, Homo Sapiens
TSMHKKPRT

SEQ ID NO: 374307 - protein, 9 aa, Homo Sapiens
DWVRRQFEF

SEQ ID NO: 374308 - protein, 9 aa, Homo Sapiens
PPTSPATRF

SEQ ID NO: 374309 - protein, 9 aa, Homo Sapiens
SHMMIRFFW

SEQ ID NO: 374310 - protein, 9 aa, Homo Sapiens
LFVESTTEQ

SEQ ID NO: 374311 - protein, 9 aa, Homo Sapiens
FWGQEWHCG

SEQ ID NO: 374312 - protein, 9 aa, Homo Sapiens
YPCHDCGTR

SEQ ID NO: 374313 - protein, 9 aa, Homo Sapiens
IFARRAIST

SEQ ID NO: 374314 - protein, 9 aa, Homo Sapiens
EEPRRPRPA

SEQ ID NO: 374315 - protein, 9 aa, Homo Sapiens
PANAPCRCS

SEQ ID NO: 374316 - protein, 9 aa, Homo Sapiens
SIVRDSLWR

SEQ ID NO: 374317 - protein, 9 aa, Homo Sapiens
EVRHFSVPN

SEQ ID NO: 374318 - protein, 9 aa, Homo Sapiens
KLNRLGLAL

SEQ ID NO: 374319 - protein, 9 aa, Homo Sapiens
PGASSGWAG

SEQ ID NO: 374320 - protein, 9 aa, Homo Sapiens
VPALEGQER

SEQ ID NO: 374321 - protein, 9 aa, Homo Sapiens
AGCLCLRWI

SEQ ID NO: 374322 - protein, 9 aa, Homo Sapiens
PKLPTKRPC

SEQ ID NO: 374323 - protein, 9 aa, Homo Sapiens
SPPSPAGSS

SEQ ID NO: 374324 - protein, 9 aa, Homo Sapiens
RDHCLQTRD

SEQ ID NO: 374325 - protein, 9 aa, Homo Sapiens
LNMIQVLMS

SEQ ID NO: 374326 - protein, 9 aa, Homo Sapiens
AMLGCSIIV

SEQ ID NO: 374327 - protein, 9 aa, Homo Sapiens
GMPPSSPSM

SEQ ID NO: 374328 - protein, 9 aa, Homo Sapiens
SEDSKNGFI

SEQ ID NO: 374329 - protein, 9 aa, Homo Sapiens
ATVPGTSDF

SEQ ID NO: 374330 - protein, 9 aa, Homo Sapiens
GETERTENR

SEQ ID NO: 374331 - protein, 9 aa, Homo Sapiens
LLTKKKASS

SEQ ID NO: 374332 - protein, 9 aa, Homo Sapiens
VPKASSRAL

SEQ ID NO: 374333 - protein, 9 aa, Homo Sapiens
QTLFQTQII

SEQ ID NO: 374334 - protein, 9 aa, Homo Sapiens
NESTPYFIL

SEQ ID NO: 374335 - protein, 9 aa, Homo Sapiens
ISQLEKDKM

SEQ ID NO: 374336 - protein, 9 aa, Homo Sapiens
ALSELALVH

SEQ ID NO: 374337 - protein, 9 aa, Homo Sapiens
VTKPLNNFR

SEQ ID NO: 374338 - protein, 9 aa, Homo Sapiens
VLRIPSASR

SEQ ID NO: 374339 - protein, 9 aa, Homo Sapiens
VVERWQKKH

SEQ ID NO: 374340 - protein, 9 aa, Homo Sapiens
IAKVLLKTK

SEQ ID NO: 374341 - protein, 9 aa, Homo Sapiens
VAFFFSGWI

SEQ ID NO: 374342 - protein, 9 aa, Homo Sapiens
DPAVVVVHE

SEQ ID NO: 374343 - protein, 9 aa, Homo Sapiens
QKTELLVTE

SEQ ID NO: 374344 - protein, 9 aa, Homo Sapiens
REREREREQ

SEQ ID NO: 374345 - protein, 9 aa, Homo Sapiens
WAESLSPIR

SEQ ID NO: 374346 - protein, 9 aa, Homo Sapiens
QISRDIQEQ

SEQ ID NO: 374347 - protein, 9 aa, Homo Sapiens
PEQLPQVQR

SEQ ID NO: 374348 - protein, 9 aa, Homo Sapiens
SPSRLWGWN

SEQ ID NO: 374349 - protein, 9 aa, Homo Sapiens
APGTACVFM

SEQ ID NO: 374350 - protein, 9 aa, Homo Sapiens
PTRWTTNYD

SEQ ID NO: 374351 - protein, 9 aa, Homo Sapiens
YVDPIDYWK

SEQ ID NO: 374352 - protein, 9 aa, Homo Sapiens
KHFLKLMKT

SEQ ID NO: 374353 - protein, 9 aa, Homo Sapiens
QQRIRSKKR

SEQ ID NO: 374354 - protein, 9 aa, Homo Sapiens
LLMPPPGLR

SEQ ID NO: 374355 - protein, 9 aa, Homo Sapiens
GSGRARGTS

SEQ ID NO: 374356 - protein, 9 aa, Homo Sapiens
ASLIGMEGG

SEQ ID NO: 374357 - protein, 9 aa, Homo Sapiens
YPGIDLSPV

SEQ ID NO: 374358 - protein, 9 aa, Homo Sapiens
TPRTASASR

SEQ ID NO: 374359 - protein, 9 aa, Homo Sapiens
LLLALGHMW

SEQ ID NO: 374360 - protein, 9 aa, Homo Sapiens
WSLLIEDGL

SEQ ID NO: 374361 - protein, 9 aa, Homo Sapiens
LRAARLFTH

SEQ ID NO: 374362 - protein, 9 aa, Homo Sapiens
ARGTSIAFS

SEQ ID NO: 374363 - protein, 9 aa, Homo Sapiens
GAMDLSPWL

SEQ ID NO: 374364 - protein, 9 aa, Homo Sapiens
RRRNDYFLF

SEQ ID NO: 374365 - protein, 9 aa, Homo Sapiens
VGPGQQALW

SEQ ID NO: 374366 - protein, 9 aa, Homo Sapiens
AGAGAGPRA

SEQ ID NO: 374367 - protein, 9 aa, Homo Sapiens
WEALWPGPG

SEQ ID NO: 374368 - protein, 9 aa, Homo Sapiens
RATTLCQVS

SEQ ID NO: 374369 - protein, 9 aa, Homo Sapiens
LQVGLNHGP

SEQ ID NO: 374370 - protein, 9 aa, Homo Sapiens
YRKVMFGNY

SEQ ID NO: 374371 - protein, 9 aa, Homo Sapiens
SSGVPEVDG

SEQ ID NO: 374372 - protein, 9 aa, Homo Sapiens
LTMDWHGEQ

SEQ ID NO: 374373 - protein, 9 aa, Homo Sapiens
GPAAVTAPP

SEQ ID NO: 374374 - protein, 9 aa, Homo Sapiens
CHMPVPVTV

SEQ ID NO: 374375 - protein, 9 aa, Homo Sapiens
TPTARADLA

SEQ ID NO: 374376 - protein, 9 aa, Homo Sapiens
LPPPCVDEP

SEQ ID NO: 374377 - protein, 9 aa, Homo Sapiens
PRISSLCPQ

SEQ ID NO: 374378 - protein, 9 aa, Homo Sapiens
MVISYLISL

SEQ ID NO: 374379 - protein, 9 aa, Homo Sapiens
GPRGGHPQP

SEQ ID NO: 374380 - protein, 9 aa, Homo Sapiens
TTDTSFKNK

SEQ ID NO: 374381 - protein, 9 aa, Homo Sapiens
PPSAPGSAR

SEQ ID NO: 374382 - protein, 9 aa, Homo Sapiens
TRHSLKARG

SEQ ID NO: 374383 - protein, 9 aa, Homo Sapiens
INGVEKDRT

SEQ ID NO: 374384 - protein, 9 aa, Homo Sapiens
GPDGVRGPN

SEQ ID NO: 374385 - protein, 9 aa, Homo Sapiens
SLVQKVVTC

SEQ ID NO: 374386 - protein, 9 aa, Homo Sapiens
LCLHSLLDP

SEQ ID NO: 374387 - protein, 9 aa, Homo Sapiens
SAWWAAGTS

SEQ ID NO: 374388 - protein, 9 aa, Homo Sapiens
RLKEHDPDP

SEQ ID NO: 374389 - protein, 9 aa, Homo Sapiens
CLRRAQDHL

SEQ ID NO: 374390 - protein, 9 aa, Homo Sapiens
ILRHRGLVD

SEQ ID NO: 374391 - protein, 9 aa, Homo Sapiens
QARQEREHT

SEQ ID NO: 374392 - protein, 9 aa, Homo Sapiens
FNGMRLGAV

SEQ ID NO: 374393 - protein, 9 aa, Homo Sapiens
EACLRTHGC

SEQ ID NO: 374394 - protein, 9 aa, Homo Sapiens
LNGTETKLV

SEQ ID NO: 374395 - protein, 9 aa, Homo Sapiens
PGSRGGRNP

SEQ ID NO: 374396 - protein, 9 aa, Homo Sapiens
TKPLNNFRS

SEQ ID NO: 374397 - protein, 9 aa, Homo Sapiens
FRQETQAQP

SEQ ID NO: 374398 - protein, 9 aa, Homo Sapiens
LPKTWNAGL

SEQ ID NO: 374399 - protein, 9 aa, Homo Sapiens
RLSKGCWRW

SEQ ID NO: 374400 - protein, 9 aa, Homo Sapiens
GTPLLEDPR

SEQ ID NO: 374401 - protein, 9 aa, Homo Sapiens
PGSMVISYL

SEQ ID NO: 374402 - protein, 9 aa, Homo Sapiens
PRTESPPPL

SEQ ID NO: 374403 - protein, 9 aa, Homo Sapiens
ATLRFNGMR

SEQ ID NO: 374404 - protein, 9 aa, Homo Sapiens
RRWQPRIWV

SEQ ID NO: 374405 - protein, 9 aa, Homo Sapiens
GSPERGLRP

SEQ ID NO: 374406 - protein, 9 aa, Homo Sapiens
TYLCRWVWN

SEQ ID NO: 374407 - protein, 9 aa, Homo Sapiens
GSCWPPWPR

SEQ ID NO: 374408 - protein, 9 aa, Homo Sapiens
FFTSAHPSR

SEQ ID NO: 374409 - protein, 9 aa, Homo Sapiens
QCLNKLEEQ

SEQ ID NO: 374410 - protein, 9 aa, Homo Sapiens
QQQQQRRPP

SEQ ID NO: 374411 - protein, 9 aa, Homo Sapiens
NTSLLQTQE

SEQ ID NO: 374412 - protein, 9 aa, Homo Sapiens
QHLPPPCVD

SEQ ID NO: 374413 - protein, 9 aa, Homo Sapiens
RLGISICGG

SEQ ID NO: 374414 - protein, 9 aa, Homo Sapiens
EFKMEEIMK

SEQ ID NO: 374415 - protein, 9 aa, Homo Sapiens
TSNISKASS

SEQ ID NO: 374416 - protein, 9 aa, Homo Sapiens
DRTHFPRGS

SEQ ID NO: 374417 - protein, 9 aa, Homo Sapiens
LLSQCRLFE

SEQ ID NO: 374418 - protein, 9 aa, Homo Sapiens
QVHKIGVFS

SEQ ID NO: 374419 - protein, 9 aa, Homo Sapiens
FPTITDYFP

SEQ ID NO: 374420 - protein, 9 aa, Homo Sapiens
SAPANQPRT

SEQ ID NO: 374421 - protein, 9 aa, Homo Sapiens
TCFPPVPQQ

SEQ ID NO: 374422 - protein, 9 aa, Homo Sapiens
IESWLEKTE

SEQ ID NO: 374423 - protein, 9 aa, Homo Sapiens
TCRSVLTVR

SEQ ID NO: 374424 - protein, 9 aa, Homo Sapiens
LPPAKRGKR

SEQ ID NO: 374425 - protein, 9 aa, Homo Sapiens
PGRRRAVQG

SEQ ID NO: 374426 - protein, 9 aa, Homo Sapiens
GMEQCGRDD

SEQ ID NO: 374427 - protein, 9 aa, Homo Sapiens
TVFKGSKKT

SEQ ID NO: 374428 - protein, 9 aa, Homo Sapiens
ITKDKNWHD

SEQ ID NO: 374429 - protein, 9 aa, Homo Sapiens
ESVMREWRH

SEQ ID NO: 374430 - protein, 9 aa, Homo Sapiens
GAAWEPRRT

SEQ ID NO: 374431 - protein, 9 aa, Homo Sapiens
KPKPVDVQV

SEQ ID NO: 374432 - protein, 9 aa, Homo Sapiens
NWRISNAEN

SEQ ID NO: 374433 - protein, 9 aa, Homo Sapiens
THDLGTKRE

SEQ ID NO: 374434 - protein, 9 aa, Homo Sapiens
CRVLTDLSS

SEQ ID NO: 374435 - protein, 9 aa, Homo Sapiens
CFHQKNWYH

SEQ ID NO: 374436 - protein, 9 aa, Homo Sapiens
CRPPWAARS

SEQ ID NO: 374437 - protein, 9 aa, Homo Sapiens
EFSPLMATD

SEQ ID NO: 374438 - protein, 9 aa, Homo Sapiens
AQCCDCWEP

SEQ ID NO: 374439 - protein, 9 aa, Homo Sapiens
FVPHPNGAT

SEQ ID NO: 374440 - protein, 9 aa, Homo Sapiens
RRNDYFLFF

SEQ ID NO: 374441 - protein, 9 aa, Homo Sapiens
WADSTKNWT

SEQ ID NO: 374442 - protein, 9 aa, Homo Sapiens
QGQLNYPLP

SEQ ID NO: 374443 - protein, 9 aa, Homo Sapiens
IGPALQLKV

SEQ ID NO: 374444 - protein, 9 aa, Homo Sapiens
KASHGFLHD

SEQ ID NO: 374445 - protein, 9 aa, Homo Sapiens
VCGALHVPD

SEQ ID NO: 374446 - protein, 9 aa, Homo Sapiens
KVPESPEAR

SEQ ID NO: 374447 - protein, 9 aa, Homo Sapiens
GPGGPAGSG

SEQ ID NO: 374448 - protein, 9 aa, Homo Sapiens
AAAGAALGQ

SEQ ID NO: 374449 - protein, 9 aa, Homo Sapiens
NSQQFPGQP

SEQ ID NO: 374450 - protein, 9 aa, Homo Sapiens
DEADVDNEY

SEQ ID NO: 374451 - protein, 9 aa, Homo Sapiens
LKSPMRLNL

SEQ ID NO: 374452 - protein, 9 aa, Homo Sapiens
SQGTFSGRE

SEQ ID NO: 374453 - protein, 9 aa, Homo Sapiens
KGLSSHTRS

SEQ ID NO: 374454 - protein, 9 aa, Homo Sapiens
ILTVLTSRS

SEQ ID NO: 374455 - protein, 9 aa, Homo Sapiens
CNKPVAQLL

SEQ ID NO: 374456 - protein, 9 aa, Homo Sapiens
VSGPWRPEL

SEQ ID NO: 374457 - protein, 9 aa, Homo Sapiens
HQSPTLLKT

SEQ ID NO: 374458 - protein, 9 aa, Homo Sapiens
MKHPFIRNQ

SEQ ID NO: 374459 - protein, 9 aa, Homo Sapiens
SLDGETPGQ

SEQ ID NO: 374460 - protein, 9 aa, Homo Sapiens
WVHMVRPNQ

SEQ ID NO: 374461 - protein, 9 aa, Homo Sapiens
PHECDPGGV

SEQ ID NO: 374462 - protein, 9 aa, Homo Sapiens
RHSLKARGA

SEQ ID NO: 374463 - protein, 9 aa, Homo Sapiens
KTYLCRWVW

SEQ ID NO: 374464 - protein, 9 aa, Homo Sapiens
KLNGAINHV

SEQ ID NO: 374465 - protein, 9 aa, Homo Sapiens
CISQAMRCF

SEQ ID NO: 374466 - protein, 9 aa, Homo Sapiens
GNGSAGTPL

SEQ ID NO: 374467 - protein, 9 aa, Homo Sapiens
APFYGFTIM

SEQ ID NO: 374468 - protein, 9 aa, Homo Sapiens
LIMTGDEAS

SEQ ID NO: 374469 - protein, 9 aa, Homo Sapiens
KTRCLMVLG

SEQ ID NO: 374470 - protein, 9 aa, Homo Sapiens
PTTDAVWGG

SEQ ID NO: 374471 - protein, 9 aa, Homo Sapiens
RSASALPTA

SEQ ID NO: 374472 - protein, 9 aa, Homo Sapiens
IDDTLSTWS

SEQ ID NO: 374473 - protein, 9 aa, Homo Sapiens
GLPLPPPVW

SEQ ID NO: 374474 - protein, 9 aa, Homo Sapiens
DKVVAILGK

SEQ ID NO: 374475 - protein, 9 aa, Homo Sapiens
SLPSSWDHS

SEQ ID NO: 374476 - protein, 9 aa, Homo Sapiens
LEYAKTTPK

SEQ ID NO: 374477 - protein, 9 aa, Homo Sapiens
PVSTMIPPS

SEQ ID NO: 374478 - protein, 9 aa, Homo Sapiens
SVQNQFIHP

SEQ ID NO: 374479 - protein, 9 aa, Homo Sapiens
ALIEELEEE

SEQ ID NO: 374480 - protein, 9 aa, Homo Sapiens
GIVSTSSHL

SEQ ID NO: 374481 - protein, 9 aa, Homo Sapiens
CWRPDCTSL

SEQ ID NO: 374482 - protein, 9 aa, Homo Sapiens
CHGVCNYPL

SEQ ID NO: 374483 - protein, 9 aa, Homo Sapiens
QRRPPRWTA

SEQ ID NO: 374484 - protein, 9 aa, Homo Sapiens
RSEEEGETE

SEQ ID NO: 374485 - protein, 9 aa, Homo Sapiens
HGVCNYPLA

SEQ ID NO: 374486 - protein, 9 aa, Homo Sapiens
WPHPDPAGS

SEQ ID NO: 374487 - protein, 9 aa, Homo Sapiens
KKLNKKATN

SEQ ID NO: 374488 - protein, 9 aa, Homo Sapiens
GFGKKLAHL

SEQ ID NO: 374489 - protein, 9 aa, Homo Sapiens
GNGGQRRES

SEQ ID NO: 374490 - protein, 9 aa, Homo Sapiens
GKNCTLTPL

SEQ ID NO: 374491 - protein, 9 aa, Homo Sapiens
SSGRAPIKA

SEQ ID NO: 374492 - protein, 9 aa, Homo Sapiens
PVPARLALR

SEQ ID NO: 374493 - protein, 9 aa, Homo Sapiens
PHPDPAGSP

SEQ ID NO: 374494 - protein, 9 aa, Homo Sapiens
GPTTDAVWG

SEQ ID NO: 374495 - protein, 9 aa, Homo Sapiens
SIVCTGRHQ

SEQ ID NO: 374496 - protein, 9 aa, Homo Sapiens
GRFCMISAT

SEQ ID NO: 374497 - protein, 9 aa, Homo Sapiens
SPIEPRDHN

SEQ ID NO: 374498 - protein, 9 aa, Homo Sapiens
HIKHFLKLM

SEQ ID NO: 374499 - protein, 9 aa, Homo Sapiens
ARSASALPT

SEQ ID NO: 374500 - protein, 9 aa, Homo Sapiens
AWGWEAAAG

SEQ ID NO: 374501 - protein, 9 aa, Homo Sapiens
FGMEQCGRD

SEQ ID NO: 374502 - protein, 9 aa, Homo Sapiens
VLLRAPPGC

SEQ ID NO: 374503 - protein, 9 aa, Homo Sapiens
TANFVKDTY

SEQ ID NO: 374504 - protein, 9 aa, Homo Sapiens
ASPGAMDLS

SEQ ID NO: 374505 - protein, 9 aa, Homo Sapiens
ACLRTHGCS

SEQ ID NO: 374506 - protein, 9 aa, Homo Sapiens
KTAEKRIKM

SEQ ID NO: 374507 - protein, 9 aa, Homo Sapiens
KQEEDRVTE

SEQ ID NO: 374508 - protein, 9 aa, Homo Sapiens
MRVCGFPSE

SEQ ID NO: 374509 - protein, 9 aa, Homo Sapiens
YSLFLSPAI

SEQ ID NO: 374510 - protein, 9 aa, Homo Sapiens
RLGLALLQH

SEQ ID NO: 374511 - protein, 9 aa, Homo Sapiens
NQFAEWKLS

SEQ ID NO: 374512 - protein, 9 aa, Homo Sapiens
GSWRSPTSK

SEQ ID NO: 374513 - protein, 9 aa, Homo Sapiens
PASPDVGFP

SEQ ID NO: 374514 - protein, 9 aa, Homo Sapiens
LDNTEVKKV

SEQ ID NO: 374515 - protein, 9 aa, Homo Sapiens
PPPMNCPAA

SEQ ID NO: 374516 - protein, 9 aa, Homo Sapiens
KLDKDGLEK

SEQ ID NO: 374517 - protein, 9 aa, Homo Sapiens
VLDVSSISH

SEQ ID NO: 374518 - protein, 9 aa, Homo Sapiens
ALATGSSRG

SEQ ID NO: 374519 - protein, 9 aa, Homo Sapiens
KDFDIALKH

SEQ ID NO: 374520 - protein, 9 aa, Homo Sapiens
QAISLDLRS

SEQ ID NO: 374521 - protein, 9 aa, Homo Sapiens
GHRVGVLQG

SEQ ID NO: 374522 - protein, 9 aa, Homo Sapiens
VASADRPER

SEQ ID NO: 374523 - protein, 9 aa, Homo Sapiens
CDNKKISLE

SEQ ID NO: 374524 - protein, 9 aa, Homo Sapiens
DRNMGEIVI

SEQ ID NO: 374525 - protein, 9 aa, Homo Sapiens
RERYLWQEN

SEQ ID NO: 374526 - protein, 9 aa, Homo Sapiens
ALRARNLLL

SEQ ID NO: 374527 - protein, 9 aa, Homo Sapiens
SSPHCPMVV

SEQ ID NO: 374528 - protein, 9 aa, Homo Sapiens
ALDTESEKM

SEQ ID NO: 374529 - protein, 9 aa, Homo Sapiens
SNGGHVVAS

SEQ ID NO: 374530 - protein, 9 aa, Homo Sapiens
GCLLTVERD

SEQ ID NO: 374531 - protein, 9 aa, Homo Sapiens
LHFLSVQNQ

SEQ ID NO: 374532 - protein, 9 aa, Homo Sapiens
FQAFVPHPN

SEQ ID NO: 374533 - protein, 9 aa, Homo Sapiens
DAHDKKAVS

SEQ ID NO: 374534 - protein, 9 aa, Homo Sapiens
GLLLGGGQR

SEQ ID NO: 374535 - protein, 9 aa, Homo Sapiens
LVTGTQHFK

SEQ ID NO: 374536 - protein, 9 aa, Homo Sapiens
GRARGTSIA

SEQ ID NO: 374537 - protein, 9 aa, Homo Sapiens
DMALDQCFS

SEQ ID NO: 374538 - protein, 9 aa, Homo Sapiens
ATSRPPPGS

SEQ ID NO: 374539 - protein, 9 aa, Homo Sapiens
YKMDFGFVE

SEQ ID NO: 374540 - protein, 9 aa, Homo Sapiens
GKCLSASST

SEQ ID NO: 374541 - protein, 9 aa, Homo Sapiens
AVQGSPERG

SEQ ID NO: 374542 - protein, 9 aa, Homo Sapiens
CQCDKKRGA

SEQ ID NO: 374543 - protein, 9 aa, Homo Sapiens
SHKPPCLTR

SEQ ID NO: 374544 - protein, 9 aa, Homo Sapiens
RALRGPPRQ

SEQ ID NO: 374545 - protein, 9 aa, Homo Sapiens
NSQGTFSGR

SEQ ID NO: 374546 - protein, 9 aa, Homo Sapiens
NSLSDESEE

SEQ ID NO: 374547 - protein, 9 aa, Homo Sapiens
FVDCPVPFC

SEQ ID NO: 374548 - protein, 9 aa, Homo Sapiens
ELGHDGARG

SEQ ID NO: 374549 - protein, 9 aa, Homo Sapiens
QVCGPGACP

SEQ ID NO: 374550 - protein, 9 aa, Homo Sapiens
HFLSVQNQF

SEQ ID NO: 374551 - protein, 9 aa, Homo Sapiens
VPGLPDSHA

SEQ ID NO: 374552 - protein, 9 aa, Homo Sapiens
YMHTLAAAA

SEQ ID NO: 374553 - protein, 9 aa, Homo Sapiens
FSLKYLGMM

SEQ ID NO: 374554 - protein, 9 aa, Homo Sapiens
DSGAPPCRP

SEQ ID NO: 374555 - protein, 9 aa, Homo Sapiens
RRRTHTNFT

SEQ ID NO: 374556 - protein, 9 aa, Homo Sapiens
MPEDVENFY

SEQ ID NO: 374557 - protein, 9 aa, Homo Sapiens
VSDVGLWKG

SEQ ID NO: 374558 - protein, 9 aa, Homo Sapiens
QSSHSLRAV

SEQ ID NO: 374559 - protein, 9 aa, Homo Sapiens
DKWEMECTD

SEQ ID NO: 374560 - protein, 9 aa, Homo Sapiens
ALGLAVPPR

SEQ ID NO: 374561 - protein, 9 aa, Homo Sapiens
GAPRAGLAK

SEQ ID NO: 374562 - protein, 9 aa, Homo Sapiens
VRALLLAAL

SEQ ID NO: 374563 - protein, 9 aa, Homo Sapiens
ARETSLASC

SEQ ID NO: 374564 - protein, 9 aa, Homo Sapiens
GSAAGDWDI

SEQ ID NO: 374565 - protein, 9 aa, Homo Sapiens
EQLPQVQRE

SEQ ID NO: 374566 - protein, 9 aa, Homo Sapiens
NSACHQSPT

SEQ ID NO: 374567 - protein, 9 aa, Homo Sapiens
RTAKPLGAD

SEQ ID NO: 374568 - protein, 9 aa, Homo Sapiens
MSLMSGQKR

SEQ ID NO: 374569 - protein, 9 aa, Homo Sapiens
ELLKKCSLY

SEQ ID NO: 374570 - protein, 9 aa, Homo Sapiens
IKPKPVDVQ

SEQ ID NO: 374571 - protein, 9 aa, Homo Sapiens
QQDQQTIHS

SEQ ID NO: 374572 - protein, 9 aa, Homo Sapiens
TEIAQLMSL

SEQ ID NO: 374573 - protein, 9 aa, Homo Sapiens
WKEVAKHWG

SEQ ID NO: 374574 - protein, 9 aa, Homo Sapiens
PIDYWKNGY

SEQ ID NO: 374575 - protein, 9 aa, Homo Sapiens
SVVLHTLLS

SEQ ID NO: 374576 - protein, 9 aa, Homo Sapiens
GKVDIHLLR

SEQ ID NO: 374577 - protein, 9 aa, Homo Sapiens
CLLWEALWP

SEQ ID NO: 374578 - protein, 9 aa, Homo Sapiens
TLSTWSLKT

SEQ ID NO: 374579 - protein, 9 aa, Homo Sapiens
FLFFGTRPL

SEQ ID NO: 374580 - protein, 9 aa, Homo Sapiens
RRAVQGSPE

SEQ ID NO: 374581 - protein, 9 aa, Homo Sapiens
DNRSLGALE

SEQ ID NO: 374582 - protein, 9 aa, Homo Sapiens
AWWAAGTSA

SEQ ID NO: 374583 - protein, 9 aa, Homo Sapiens
IAIALFEIG

SEQ ID NO: 374584 - protein, 9 aa, Homo Sapiens
TELKTYLCR

SEQ ID NO: 374585 - protein, 9 aa, Homo Sapiens
LAFISLDHY

SEQ ID NO: 374586 - protein, 9 aa, Homo Sapiens
WCGTWTAWM

SEQ ID NO: 374587 - protein, 9 aa, Homo Sapiens
RVGKKLDVA

SEQ ID NO: 374588 - protein, 9 aa, Homo Sapiens
QALQAVLQD

SEQ ID NO: 374589 - protein, 9 aa, Homo Sapiens
QLKVFPKHY

SEQ ID NO: 374590 - protein, 9 aa, Homo Sapiens
SQIFDIIIS

SEQ ID NO: 374591 - protein, 9 aa, Homo Sapiens
AATAAEEPR

SEQ ID NO: 374592 - protein, 9 aa, Homo Sapiens
SPDISGGRE

SEQ ID NO: 374593 - protein, 9 aa, Homo Sapiens
PHPTVSTGR

SEQ ID NO: 374594 - protein, 9 aa, Homo Sapiens
KTKVYFMYL

SEQ ID NO: 374595 - protein, 9 aa, Homo Sapiens
KTSCTTFTR

SEQ ID NO: 374596 - protein, 9 aa, Homo Sapiens
AAVAPLAPW

SEQ ID NO: 374597 - protein, 9 aa, Homo Sapiens
PWPPPAPVL

SEQ ID NO: 374598 - protein, 9 aa, Homo Sapiens
ERDVVQQTE

SEQ ID NO: 374599 - protein, 9 aa, Homo Sapiens
VGLTFITPM

SEQ ID NO: 374600 - protein, 9 aa, Homo Sapiens
ECLGNYPEV

SEQ ID NO: 374601 - protein, 9 aa, Homo Sapiens
PKNTSTYHV

SEQ ID NO: 374602 - protein, 9 aa, Homo Sapiens
GALERSKNK

SEQ ID NO: 374603 - protein, 9 aa, Homo Sapiens
MAIDFTASN

SEQ ID NO: 374604 - protein, 9 aa, Homo Sapiens
AKIRILSLE

SEQ ID NO: 374605 - protein, 9 aa, Homo Sapiens
AIKKVDQGK

SEQ ID NO: 374606 - protein, 9 aa, Homo Sapiens
LPTAVTPRR

SEQ ID NO: 374607 - protein, 9 aa, Homo Sapiens
PAKKHVFDV

SEQ ID NO: 374608 - protein, 9 aa, Homo Sapiens
LPPCSIPLS

SEQ ID NO: 374609 - protein, 9 aa, Homo Sapiens
RRASPGAMD

SEQ ID NO: 374610 - protein, 9 aa, Homo Sapiens
GDRVPVDIR

SEQ ID NO: 374611 - protein, 9 aa, Homo Sapiens
SRSASAEIQ

SEQ ID NO: 374612 - protein, 9 aa, Homo Sapiens
EEWSLLIED

SEQ ID NO: 374613 - protein, 9 aa, Homo Sapiens
RHRCSPHSS

SEQ ID NO: 374614 - protein, 9 aa, Homo Sapiens
YLDPRIAIA

SEQ ID NO: 374615 - protein, 9 aa, Homo Sapiens
IRPVYVPVP

SEQ ID NO: 374616 - protein, 9 aa, Homo Sapiens
PVSEQRLWH

SEQ ID NO: 374617 - protein, 9 aa, Homo Sapiens
ARETFHMGC

SEQ ID NO: 374618 - protein, 9 aa, Homo Sapiens
QDPREVRHR

SEQ ID NO: 374619 - protein, 9 aa, Homo Sapiens
RWQKKHDKQ

SEQ ID NO: 374620 - protein, 9 aa, Homo Sapiens
NSNHRDWIA

SEQ ID NO: 374621 - protein, 9 aa, Homo Sapiens
LTQKLAQQL

SEQ ID NO: 374622 - protein, 9 aa, Homo Sapiens
RNKWITEEN

SEQ ID NO: 374623 - protein, 9 aa, Homo Sapiens
REKQSSHSL

SEQ ID NO: 374624 - protein, 9 aa, Homo Sapiens
QQALWQGRA

SEQ ID NO: 374625 - protein, 9 aa, Homo Sapiens
KKRKKMFLI

SEQ ID NO: 374626 - protein, 9 aa, Homo Sapiens
VRGTMQPFN

SEQ ID NO: 374627 - protein, 9 aa, Homo Sapiens
TSISVGKAN

SEQ ID NO: 374628 - protein, 9 aa, Homo Sapiens
GSGGACSMG

SEQ ID NO: 374629 - protein, 9 aa, Homo Sapiens
TFVTSSFPV

SEQ ID NO: 374630 - protein, 9 aa, Homo Sapiens
PLPMCCTPA

SEQ ID NO: 374631 - protein, 9 aa, Homo Sapiens
GLTRIWQGC

SEQ ID NO: 374632 - protein, 9 aa, Homo Sapiens
YETTAGAGV

SEQ ID NO: 374633 - protein, 9 aa, Homo Sapiens
PKIPPQLFI

SEQ ID NO: 374634 - protein, 9 aa, Homo Sapiens
DQNIFTAFT

SEQ ID NO: 374635 - protein, 9 aa, Homo Sapiens
CKDGMWTTV

SEQ ID NO: 374636 - protein, 9 aa, Homo Sapiens
PAGLCGHRT

SEQ ID NO: 374637 - protein, 9 aa, Homo Sapiens
SEDILQDAQ

SEQ ID NO: 374638 - protein, 9 aa, Homo Sapiens
SPGAMDLSP

SEQ ID NO: 374639 - protein, 9 aa, Homo Sapiens
PIVHAKKNT

SEQ ID NO: 374640 - protein, 9 aa, Homo Sapiens
YEAYECHGV

SEQ ID NO: 374641 - protein, 9 aa, Homo Sapiens
VVQAIKDHT

SEQ ID NO: 374642 - protein, 9 aa, Homo Sapiens
KLAHLTWKQ

SEQ ID NO: 374643 - protein, 9 aa, Homo Sapiens
PLRKRSVPV

SEQ ID NO: 374644 - protein, 9 aa, Homo Sapiens
LQNSKDKAL

SEQ ID NO: 374645 - protein, 9 aa, Homo Sapiens
SEGVCFLNH

SEQ ID NO: 374646 - protein, 9 aa, Homo Sapiens
GPSPWASAW

SEQ ID NO: 374647 - protein, 9 aa, Homo Sapiens
PSPVSGSWC

SEQ ID NO: 374648 - protein, 9 aa, Homo Sapiens
FDIALKHYD

SEQ ID NO: 374649 - protein, 9 aa, Homo Sapiens
FQAVVMAVC

SEQ ID NO: 374650 - protein, 9 aa, Homo Sapiens
LSRATGRHV

SEQ ID NO: 374651 - protein, 9 aa, Homo Sapiens
VKMDATRAG

SEQ ID NO: 374652 - protein, 9 aa, Homo Sapiens
KIMQATGLP

SEQ ID NO: 374653 - protein, 9 aa, Homo Sapiens
AQRDLSSDE

SEQ ID NO: 374654 - protein, 9 aa, Homo Sapiens
VMPRTLEGC

SEQ ID NO: 374655 - protein, 9 aa, Homo Sapiens
LAGGGNGSA

SEQ ID NO: 374656 - protein, 9 aa, Homo Sapiens
YSADADAAA

SEQ ID NO: 374657 - protein, 9 aa, Homo Sapiens
IILTVGGWS

SEQ ID NO: 374658 - protein, 9 aa, Homo Sapiens
SPAPTPRTA

SEQ ID NO: 374659 - protein, 9 aa, Homo Sapiens
LGGGAPRAL

SEQ ID NO: 374660 - protein, 9 aa, Homo Sapiens
MHTGERLYR

SEQ ID NO: 374661 - protein, 9 aa, Homo Sapiens
AGRSVARQA

SEQ ID NO: 374662 - protein, 9 aa, Homo Sapiens
GAGQPGQPR

SEQ ID NO: 374663 - protein, 9 aa, Homo Sapiens
RFFWMEMRC

SEQ ID NO: 374664 - protein, 9 aa, Homo Sapiens
AKAIGSAGT

SEQ ID NO: 374665 - protein, 9 aa, Homo Sapiens
RRPRPAARA

SEQ ID NO: 374666 - protein, 9 aa, Homo Sapiens
LSLSAQYGI

SEQ ID NO: 374667 - protein, 9 aa, Homo Sapiens
QGGKVDIHL

SEQ ID NO: 374668 - protein, 9 aa, Homo Sapiens
LNIAKVLLK

SEQ ID NO: 374669 - protein, 9 aa, Homo Sapiens
IKKKDYVPP

SEQ ID NO: 374670 - protein, 9 aa, Homo Sapiens
WHGEQSLYS

SEQ ID NO: 374671 - protein, 9 aa, Homo Sapiens
MRKLRPPQK

SEQ ID NO: 374672 - protein, 9 aa, Homo Sapiens
GHFQATITN

SEQ ID NO: 374673 - protein, 9 aa, Homo Sapiens
RNLLLTDKM

SEQ ID NO: 374674 - protein, 9 aa, Homo Sapiens
QYRALTMPE

SEQ ID NO: 374675 - protein, 9 aa, Homo Sapiens
IQQVSQKKL

SEQ ID NO: 374676 - protein, 9 aa, Homo Sapiens
LSSTNMPTE

SEQ ID NO: 374677 - protein, 9 aa, Homo Sapiens
VLNSTNADG

SEQ ID NO: 374678 - protein, 9 aa, Homo Sapiens
YKAKPVIFK

SEQ ID NO: 374679 - protein, 9 aa, Homo Sapiens
LHQTYELND

SEQ ID NO: 374680 - protein, 9 aa, Homo Sapiens
HRPSRCRYW

SEQ ID NO: 374681 - protein, 9 aa, Homo Sapiens
GGPSCRGPL

SEQ ID NO: 374682 - protein, 9 aa, Homo Sapiens
SMTSTWVWS

SEQ ID NO: 374683 - protein, 9 aa, Homo Sapiens
TVVTFTMHL

SEQ ID NO: 374684 - protein, 9 aa, Homo Sapiens
MLVEQPKGE

SEQ ID NO: 374685 - protein, 9 aa, Homo Sapiens
QFFHDVDVE

SEQ ID NO: 374686 - protein, 9 aa, Homo Sapiens
SVPVAKAKP

SEQ ID NO: 374687 - protein, 9 aa, Homo Sapiens
ASRALFTSL

SEQ ID NO: 374688 - protein, 9 aa, Homo Sapiens
IGSYGLQEK

SEQ ID NO: 374689 - protein, 9 aa, Homo Sapiens
WERLVHLSK

SEQ ID NO: 374690 - protein, 9 aa, Homo Sapiens
SKGKKRRGK

SEQ ID NO: 374691 - protein, 9 aa, Homo Sapiens
SVSSIVRDS

SEQ ID NO: 374692 - protein, 9 aa, Homo Sapiens
SSHSDKTHT

SEQ ID NO: 374693 - protein, 9 aa, Homo Sapiens
LCLLWEALW

SEQ ID NO: 374694 - protein, 9 aa, Homo Sapiens
LLHNRNFWI

SEQ ID NO: 374695 - protein, 9 aa, Homo Sapiens
GVNIRKFIV

SEQ ID NO: 374696 - protein, 9 aa, Homo Sapiens
SWHTLHHEL

SEQ ID NO: 374697 - protein, 9 aa, Homo Sapiens
GHRTFSTTA

SEQ ID NO: 374698 - protein, 9 aa, Homo Sapiens
EKLLVRGTM

SEQ ID NO: 374699 - protein, 9 aa, Homo Sapiens
SPIGANGFT

SEQ ID NO: 374700 - protein, 9 aa, Homo Sapiens
QSQTVKCSC

SEQ ID NO: 374701 - protein, 9 aa, Homo Sapiens
HLPPQTRML

SEQ ID NO: 374702 - protein, 9 aa, Homo Sapiens
RESCCCQYE

SEQ ID NO: 374703 - protein, 9 aa, Homo Sapiens
HSDKTHTRE

SEQ ID NO: 374704 - protein, 9 aa, Homo Sapiens
TNCATHAFW

SEQ ID NO: 374705 - protein, 9 aa, Homo Sapiens
WPPWPRLAS

SEQ ID NO: 374706 - protein, 9 aa, Homo Sapiens
HLLQSTGQK

SEQ ID NO: 374707 - protein, 9 aa, Homo Sapiens
DGGAGRMGR

SEQ ID NO: 374708 - protein, 9 aa, Homo Sapiens
RARGTSIAF

SEQ ID NO: 374709 - protein, 9 aa, Homo Sapiens
PTRMLQSLP

SEQ ID NO: 374710 - protein, 9 aa, Homo Sapiens
GPLFNNSSV

SEQ ID NO: 374711 - protein, 9 aa, Homo Sapiens
LLVDALLFV

SEQ ID NO: 374712 - protein, 9 aa, Homo Sapiens
AAAPRVLFH

SEQ ID NO: 374713 - protein, 9 aa, Homo Sapiens
IKRDINRRA

SEQ ID NO: 374714 - protein, 9 aa, Homo Sapiens
LNNSIYWQE

SEQ ID NO: 374715 - protein, 9 aa, Homo Sapiens
LKQGKVPES

SEQ ID NO: 374716 - protein, 9 aa, Homo Sapiens
LPPGGCLLT

SEQ ID NO: 374717 - protein, 9 aa, Homo Sapiens
PQRLGKSRR

SEQ ID NO: 374718 - protein, 9 aa, Homo Sapiens
LGSRMAHPR

SEQ ID NO: 374719 - protein, 9 aa, Homo Sapiens
YQAFPRCPT

SEQ ID NO: 374720 - protein, 9 aa, Homo Sapiens
CCIIFSHFP

SEQ ID NO: 374721 - protein, 9 aa, Homo Sapiens
GEKLFECKG

SEQ ID NO: 374722 - protein, 9 aa, Homo Sapiens
ASPTEGACT

SEQ ID NO: 374723 - protein, 9 aa, Homo Sapiens
CFLKTRGQI

SEQ ID NO: 374724 - protein, 9 aa, Homo Sapiens
KVKPQKLFQ

SEQ ID NO: 374725 - protein, 9 aa, Homo Sapiens
RRDSAADFS

SEQ ID NO: 374726 - protein, 9 aa, Homo Sapiens
CLAKTLCHM

SEQ ID NO: 374727 - protein, 9 aa, Homo Sapiens
MPEVLESLL

SEQ ID NO: 374728 - protein, 9 aa, Homo Sapiens
HVVEALHQK

SEQ ID NO: 374729 - protein, 9 aa, Homo Sapiens
HGFLHDREL

SEQ ID NO: 374730 - protein, 9 aa, Homo Sapiens
EGETERTEN

SEQ ID NO: 374731 - protein, 9 aa, Homo Sapiens
VSRNGCDAC

SEQ ID NO: 374732 - protein, 9 aa, Homo Sapiens
EEMCEKLKG

SEQ ID NO: 374733 - protein, 9 aa, Homo Sapiens
LQRNLLRLQ

SEQ ID NO: 374734 - protein, 9 aa, Homo Sapiens
KTSESWQAQ

SEQ ID NO: 374735 - protein, 9 aa, Homo Sapiens
WKRGSRSRP

SEQ ID NO: 374736 - protein, 9 aa, Homo Sapiens
PIRDMKVKG

SEQ ID NO: 374737 - protein, 9 aa, Homo Sapiens
PPAGRSVAR

SEQ ID NO: 374738 - protein, 9 aa, Homo Sapiens
KKKDYVPPK

SEQ ID NO: 374739 - protein, 9 aa, Homo Sapiens
HSLPTQTSH

SEQ ID NO: 374740 - protein, 9 aa, Homo Sapiens
LIRELWNTS

SEQ ID NO: 374741 - protein, 9 aa, Homo Sapiens
APPPRMAAR

SEQ ID NO: 374742 - protein, 9 aa, Homo Sapiens
PCRCSAPAN

SEQ ID NO: 374743 - protein, 9 aa, Homo Sapiens
SHATTASRV

SEQ ID NO: 374744 - protein, 9 aa, Homo Sapiens
TRSWQSSTP

SEQ ID NO: 374745 - protein, 9 aa, Homo Sapiens
VLIDDFSNQ

SEQ ID NO: 374746 - protein, 9 aa, Homo Sapiens
AYKKKDFDI

SEQ ID NO: 374747 - protein, 9 aa, Homo Sapiens
PKILYLHHC

SEQ ID NO: 374748 - protein, 9 aa, Homo Sapiens
PLKIVLLGV

SEQ ID NO: 374749 - protein, 9 aa, Homo Sapiens
WPVRASSVA

SEQ ID NO: 374750 - protein, 9 aa, Homo Sapiens
QGEFDEEEG

SEQ ID NO: 374751 - protein, 9 aa, Homo Sapiens
DATKEFSTY

SEQ ID NO: 374752 - protein, 9 aa, Homo Sapiens
NPKIFMHRN

SEQ ID NO: 374753 - protein, 9 aa, Homo Sapiens
PWLTGLLPK

SEQ ID NO: 374754 - protein, 9 aa, Homo Sapiens
TNRYSQPCP

SEQ ID NO: 374755 - protein, 9 aa, Homo Sapiens
QQLHFLSVQ

SEQ ID NO: 374756 - protein, 9 aa, Homo Sapiens
ISKKLNKKA

SEQ ID NO: 374757 - protein, 9 aa, Homo Sapiens
IEFSPLMAT

SEQ ID NO: 374758 - protein, 9 aa, Homo Sapiens
AAEAEAGQL

SEQ ID NO: 374759 - protein, 9 aa, Homo Sapiens
GGRGYGGTK

SEQ ID NO: 374760 - protein, 9 aa, Homo Sapiens
YTDIECSIL

SEQ ID NO: 374761 - protein, 9 aa, Homo Sapiens
AEESKKNPS

SEQ ID NO: 374762 - protein, 9 aa, Homo Sapiens
AGAALGQAA

SEQ ID NO: 374763 - protein, 9 aa, Homo Sapiens
NENRGGSWR

SEQ ID NO: 374764 - protein, 9 aa, Homo Sapiens
LPPAWQPSL

SEQ ID NO: 374765 - protein, 9 aa, Homo Sapiens
ESGLLLRHP

SEQ ID NO: 374766 - protein, 9 aa, Homo Sapiens
SIATNPESS

SEQ ID NO: 374767 - protein, 9 aa, Homo Sapiens
QQQRRPPEK

SEQ ID NO: 374768 - protein, 9 aa, Homo Sapiens
EELAVADNR

SEQ ID NO: 374769 - protein, 9 aa, Homo Sapiens
GGGNGSAGT

SEQ ID NO: 374770 - protein, 9 aa, Homo Sapiens
QRDTQQLRR

SEQ ID NO: 374771 - protein, 9 aa, Homo Sapiens
KRALPQLGA

SEQ ID NO: 374772 - protein, 9 aa, Homo Sapiens
EGAHVYSQV

SEQ ID NO: 374773 - protein, 9 aa, Homo Sapiens
VSATSGVEQ

SEQ ID NO: 374774 - protein, 9 aa, Homo Sapiens
SEPGLARCF

SEQ ID NO: 374775 - protein, 9 aa, Homo Sapiens
NQPNERQVR

SEQ ID NO: 374776 - protein, 9 aa, Homo Sapiens
LPGDGVEGL

SEQ ID NO: 374777 - protein, 9 aa, Homo Sapiens
HFRLRCLQH

SEQ ID NO: 374778 - protein, 9 aa, Homo Sapiens
GGAGRMGRP

SEQ ID NO: 374779 - protein, 9 aa, Homo Sapiens
PWASAWWAA

SEQ ID NO: 374780 - protein, 9 aa, Homo Sapiens
QERQQQQQR

SEQ ID NO: 374781 - protein, 9 aa, Homo Sapiens
NKEQREQET

SEQ ID NO: 374782 - protein, 9 aa, Homo Sapiens
RNTCKAVGS

SEQ ID NO: 374783 - protein, 9 aa, Homo Sapiens
EKPYTCAQC

SEQ ID NO: 374784 - protein, 9 aa, Homo Sapiens
NTDTPVSKF

SEQ ID NO: 374785 - protein, 9 aa, Homo Sapiens
VIFYDVVHV

SEQ ID NO: 374786 - protein, 9 aa, Homo Sapiens
KERVLLPGD

SEQ ID NO: 374787 - protein, 9 aa, Homo Sapiens
IVHAKKNTA

SEQ ID NO: 374788 - protein, 9 aa, Homo Sapiens
QGKVPESPE

SEQ ID NO: 374789 - protein, 9 aa, Homo Sapiens
TLYANLFHS

SEQ ID NO: 374790 - protein, 9 aa, Homo Sapiens
SNGIENNVL

SEQ ID NO: 374791 - protein, 9 aa, Homo Sapiens
EARPLAELC

SEQ ID NO: 374792 - protein, 9 aa, Homo Sapiens
APEKDNFFA

SEQ ID NO: 374793 - protein, 9 aa, Homo Sapiens
CGKTKPGED

SEQ ID NO: 374794 - protein, 9 aa, Homo Sapiens
GAGGDCGSC

SEQ ID NO: 374795 - protein, 9 aa, Homo Sapiens
FAFQTEIAQ

SEQ ID NO: 374796 - protein, 9 aa, Homo Sapiens
PPPTKKRGK

SEQ ID NO: 374797 - protein, 9 aa, Homo Sapiens
QQDIKGLVD

SEQ ID NO: 374798 - protein, 9 aa, Homo Sapiens
GGGSSSGNG

SEQ ID NO: 374799 - protein, 9 aa, Homo Sapiens
HGLTRIWQG

SEQ ID NO: 374800 - protein, 9 aa, Homo Sapiens
HVIQQVKTN

SEQ ID NO: 374801 - protein, 9 aa, Homo Sapiens
RSWQSSTPS

SEQ ID NO: 374802 - protein, 9 aa, Homo Sapiens
LKMAVGPPT

SEQ ID NO: 374803 - protein, 9 aa, Homo Sapiens
LPSCRCYIR

SEQ ID NO: 374804 - protein, 9 aa, Homo Sapiens
LNSTNADGI

SEQ ID NO: 374805 - protein, 9 aa, Homo Sapiens
MMECMTTDI

SEQ ID NO: 374806 - protein, 9 aa, Homo Sapiens
SDTRGVGIH

SEQ ID NO: 374807 - protein, 9 aa, Homo Sapiens
VDGSSRCAG

SEQ ID NO: 374808 - protein, 9 aa, Homo Sapiens
GCFTLLWCV

SEQ ID NO: 374809 - protein, 9 aa, Homo Sapiens
NGSAGTPLQ

SEQ ID NO: 374810 - protein, 9 aa, Homo Sapiens
HWLGHRVGV

SEQ ID NO: 374811 - protein, 9 aa, Homo Sapiens
IRKFIVQIN

SEQ ID NO: 374812 - protein, 9 aa, Homo Sapiens
DVDVEDVLP

SEQ ID NO: 374813 - protein, 9 aa, Homo Sapiens
RPARAESLA

SEQ ID NO: 374814 - protein, 9 aa, Homo Sapiens
MFGNYRNLV

SEQ ID NO: 374815 - protein, 9 aa, Homo Sapiens
TRRLLVVGC

SEQ ID NO: 374816 - protein, 9 aa, Homo Sapiens
LVTAVGSAQ

SEQ ID NO: 374817 - protein, 9 aa, Homo Sapiens
KELRLLGGK

SEQ ID NO: 374818 - protein, 9 aa, Homo Sapiens
KHDKQNSRS

SEQ ID NO: 374819 - protein, 9 aa, Homo Sapiens
MNSFLCFFY

SEQ ID NO: 374820 - protein, 9 aa, Homo Sapiens
PTLAGKITD

SEQ ID NO: 374821 - protein, 9 aa, Homo Sapiens
KDTTTSSPK

SEQ ID NO: 374822 - protein, 9 aa, Homo Sapiens
VPDNLLKIY

SEQ ID NO: 374823 - protein, 9 aa, Homo Sapiens
RSLGALEPS

SEQ ID NO: 374824 - protein, 9 aa, Homo Sapiens
VHVQELQKL

SEQ ID NO: 374825 - protein, 9 aa, Homo Sapiens
NIQQVSQKK

SEQ ID NO: 374826 - protein, 9 aa, Homo Sapiens
LPAPLHGRV

SEQ ID NO: 374827 - protein, 9 aa, Homo Sapiens
VMSGVHCTG

SEQ ID NO: 374828 - protein, 9 aa, Homo Sapiens
SSQSPPSPA

SEQ ID NO: 374829 - protein, 9 aa, Homo Sapiens
DDFSNQEHL

SEQ ID NO: 374830 - protein, 9 aa, Homo Sapiens
ERAVEDVAG

SEQ ID NO: 374831 - protein, 9 aa, Homo Sapiens
RVSSSLTKQ

SEQ ID NO: 374832 - protein, 9 aa, Homo Sapiens
SPGERHRSR

SEQ ID NO: 374833 - protein, 9 aa, Homo Sapiens
DVGFPFVSR

SEQ ID NO: 374834 - protein, 9 aa, Homo Sapiens
SLLSLYSVA

SEQ ID NO: 374835 - protein, 9 aa, Homo Sapiens
SRAKESKPR

SEQ ID NO: 374836 - protein, 9 aa, Homo Sapiens
LPKILYLHH

SEQ ID NO: 374837 - protein, 9 aa, Homo Sapiens
SLLIEDGLQ

SEQ ID NO: 374838 - protein, 9 aa, Homo Sapiens
PPGPPQQQW

SEQ ID NO: 374839 - protein, 9 aa, Homo Sapiens
TEPPDVYSY

SEQ ID NO: 374840 - protein, 9 aa, Homo Sapiens
FKMEEIMKK

SEQ ID NO: 374841 - protein, 9 aa, Homo Sapiens
HTHERERYL

SEQ ID NO: 374842 - protein, 9 aa, Homo Sapiens
RQRRSHMLE

SEQ ID NO: 374843 - protein, 9 aa, Homo Sapiens
MKAMQLEQM

SEQ ID NO: 374844 - protein, 9 aa, Homo Sapiens
KRLANVVHQ

SEQ ID NO: 374845 - protein, 9 aa, Homo Sapiens
QASSTRSSV

SEQ ID NO: 374846 - protein, 9 aa, Homo Sapiens
TIHDIPMLL

SEQ ID NO: 374847 - protein, 9 aa, Homo Sapiens
KESKPREPG

SEQ ID NO: 374848 - protein, 9 aa, Homo Sapiens
IRILSLETY

SEQ ID NO: 374849 - protein, 9 aa, Homo Sapiens
FAAGVAEKF

SEQ ID NO: 374850 - protein, 9 aa, Homo Sapiens
PPVWAVLAW

SEQ ID NO: 374851 - protein, 9 aa, Homo Sapiens
PGAMDLSPW

SEQ ID NO: 374852 - protein, 9 aa, Homo Sapiens
HKHFYWKHL

SEQ ID NO: 374853 - protein, 9 aa, Homo Sapiens
VWSRPPSAS

SEQ ID NO: 374854 - protein, 9 aa, Homo Sapiens
DICREVLQN

SEQ ID NO: 374855 - protein, 9 aa, Homo Sapiens
ALLALNHMG

SEQ ID NO: 374856 - protein, 9 aa, Homo Sapiens
KLNKKATNI

SEQ ID NO: 374857 - protein, 9 aa, Homo Sapiens
LPAPAAPGW

SEQ ID NO: 374858 - protein, 9 aa, Homo Sapiens
RPRVTPAPP

SEQ ID NO: 374859 - protein, 9 aa, Homo Sapiens
KEGSTVPHA

SEQ ID NO: 374860 - protein, 9 aa, Homo Sapiens
WLHAYVLWA

SEQ ID NO: 374861 - protein, 9 aa, Homo Sapiens
APWRTSTPS

SEQ ID NO: 374862 - protein, 9 aa, Homo Sapiens
CMPGLPCPS

SEQ ID NO: 374863 - protein, 9 aa, Homo Sapiens
YVEFYSHEA

SEQ ID NO: 374864 - protein, 9 aa, Homo Sapiens
KKHVFDVNR

SEQ ID NO: 374865 - protein, 9 aa, Homo Sapiens
HVSLRICIS

SEQ ID NO: 374866 - protein, 9 aa, Homo Sapiens
SCSSCRSFR

SEQ ID NO: 374867 - protein, 9 aa, Homo Sapiens
SSSTSRDSR

SEQ ID NO: 374868 - protein, 9 aa, Homo Sapiens
SGGASRALF

SEQ ID NO: 374869 - protein, 9 aa, Homo Sapiens
APKYGQGQL

SEQ ID NO: 374870 - protein, 9 aa, Homo Sapiens
PQQQWPQQG

SEQ ID NO: 374871 - protein, 9 aa, Homo Sapiens
FAPFFVPMS

SEQ ID NO: 374872 - protein, 9 aa, Homo Sapiens
FTSLASGTS

SEQ ID NO: 374873 - protein, 9 aa, Homo Sapiens
RAKNTQALP

SEQ ID NO: 374874 - protein, 9 aa, Homo Sapiens
VQINPTNVK

SEQ ID NO: 374875 - protein, 9 aa, Homo Sapiens
GRETIIKTL

SEQ ID NO: 374876 - protein, 9 aa, Homo Sapiens
RDVRFESIW

SEQ ID NO: 374877 - protein, 9 aa, Homo Sapiens
SVPNGLTQM

SEQ ID NO: 374878 - protein, 9 aa, Homo Sapiens
DSSGPLEKG

SEQ ID NO: 374879 - protein, 9 aa, Homo Sapiens
EFDEEEGED

SEQ ID NO: 374880 - protein, 9 aa, Homo Sapiens
EDFQNRKLR

SEQ ID NO: 374881 - protein, 9 aa, Homo Sapiens
NPSDLPDSP

SEQ ID NO: 374882 - protein, 9 aa, Homo Sapiens
TYYNVQIFI

SEQ ID NO: 374883 - protein, 9 aa, Homo Sapiens
KKITAFLPN

SEQ ID NO: 374884 - protein, 9 aa, Homo Sapiens
SVTSSYSNV

SEQ ID NO: 374885 - protein, 9 aa, Homo Sapiens
YSVWEGATL

SEQ ID NO: 374886 - protein, 9 aa, Homo Sapiens
LSGCAMFVS

SEQ ID NO: 374887 - protein, 9 aa, Homo Sapiens
VSKDQRLQA

SEQ ID NO: 374888 - protein, 9 aa, Homo Sapiens
HHGGWKTKM

SEQ ID NO: 374889 - protein, 9 aa, Homo Sapiens
PVSIPRQRY

SEQ ID NO: 374890 - protein, 9 aa, Homo Sapiens
SMLSKSNQL

SEQ ID NO: 374891 - protein, 9 aa, Homo Sapiens
FQTLDSAAL

SEQ ID NO: 374892 - protein, 9 aa, Homo Sapiens
KAYRRRSSL

SEQ ID NO: 374893 - protein, 9 aa, Homo Sapiens
RVHTYATIR

SEQ ID NO: 374894 - protein, 9 aa, Homo Sapiens
VDMGLSTTI

SEQ ID NO: 374895 - protein, 9 aa, Homo Sapiens
DSSLPIGFA

SEQ ID NO: 374896 - protein, 9 aa, Homo Sapiens
YNPVSIPRQ

SEQ ID NO: 374897 - protein, 9 aa, Homo Sapiens
IGEFIYKSW

SEQ ID NO: 374898 - protein, 9 aa, Homo Sapiens
IDSSLPIGF

SEQ ID NO: 374899 - protein, 9 aa, Homo Sapiens
EKSSNESML

SEQ ID NO: 374900 - protein, 9 aa, Homo Sapiens
GKKITAFLP

SEQ ID NO: 374901 - protein, 9 aa, Homo Sapiens
PSVHKPVLF

SEQ ID NO: 374902 - protein, 9 aa, Homo Sapiens
VGACGVGKS

SEQ ID NO: 374903 - protein, 9 aa, Homo Sapiens
TKATSQFKA

SEQ ID NO: 374904 - protein, 9 aa, Homo Sapiens
ETRKVKTKA

SEQ ID NO: 374905 - protein, 9 aa, Homo Sapiens
IGCWLGGLD

SEQ ID NO: 374906 - protein, 9 aa, Homo Sapiens
WENWPMEKG

SEQ ID NO: 374907 - protein, 9 aa, Homo Sapiens
SNVNQNATV

SEQ ID NO: 374908 - protein, 9 aa, Homo Sapiens
CISPDGKVL

SEQ ID NO: 374909 - protein, 9 aa, Homo Sapiens
QGCRTSLEK

SEQ ID NO: 374910 - protein, 9 aa, Homo Sapiens
WADLRAVNI

SEQ ID NO: 374911 - protein, 9 aa, Homo Sapiens
DFQNRKLRS

SEQ ID NO: 374912 - protein, 9 aa, Homo Sapiens
LIGLYIFER

SEQ ID NO: 374913 - protein, 9 aa, Homo Sapiens
SLSQRQRLT

SEQ ID NO: 374914 - protein, 9 aa, Homo Sapiens
VTFAGYGFA

SEQ ID NO: 374915 - protein, 9 aa, Homo Sapiens
LDLRNTGFQ

SEQ ID NO: 374916 - protein, 9 aa, Homo Sapiens
SGCAMFVSL

SEQ ID NO: 374917 - protein, 9 aa, Homo Sapiens
LAARTVNQF

SEQ ID NO: 374918 - protein, 9 aa, Homo Sapiens
FDLAARTVN

SEQ ID NO: 374919 - protein, 9 aa, Homo Sapiens
ISPDGKVLL

SEQ ID NO: 374920 - protein, 9 aa, Homo Sapiens
TYATIRNTE

SEQ ID NO: 374921 - protein, 9 aa, Homo Sapiens
FLQIYQYVS

SEQ ID NO: 374922 - protein, 9 aa, Homo Sapiens
DRDSGPNSY

SEQ ID NO: 374923 - protein, 9 aa, Homo Sapiens
KTKMDWIFH

SEQ ID NO: 374924 - protein, 9 aa, Homo Sapiens
LRNTGFQTL

SEQ ID NO: 374925 - protein, 9 aa, Homo Sapiens
HGGWKTKMD

SEQ ID NO: 374926 - protein, 9 aa, Homo Sapiens
LEKSSNESM

SEQ ID NO: 374927 - protein, 9 aa, Homo Sapiens
DLRNTGFQT

SEQ ID NO: 374928 - protein, 9 aa, Homo Sapiens
NGDHYFKGI

SEQ ID NO: 374929 - protein, 9 aa, Homo Sapiens
KKIHNGEEP

SEQ ID NO: 374930 - protein, 9 aa, Homo Sapiens
RERPFVCSE

SEQ ID NO: 374931 - protein, 9 aa, Homo Sapiens
VSGIINPSD

SEQ ID NO: 374932 - protein, 9 aa, Homo Sapiens
WKTKMDWIF

SEQ ID NO: 374933 - protein, 9 aa, Homo Sapiens
DEIPCQRMR

SEQ ID NO: 374934 - protein, 9 aa, Homo Sapiens
ALLMLIENS

SEQ ID NO: 374935 - protein, 9 aa, Homo Sapiens
STQNNRCVL

SEQ ID NO: 374936 - protein, 9 aa, Homo Sapiens
YDLLGRVCT

SEQ ID NO: 374937 - protein, 9 aa, Homo Sapiens
LPIGFASPT

SEQ ID NO: 374938 - protein, 9 aa, Homo Sapiens
MLIENSLIT

SEQ ID NO: 374939 - protein, 9 aa, Homo Sapiens
LQIYQYVSK

SEQ ID NO: 374940 - protein, 9 aa, Homo Sapiens
ATPSVHKPV

SEQ ID NO: 374941 - protein, 9 aa, Homo Sapiens
QGGASEHIT

SEQ ID NO: 374942 - protein, 9 aa, Homo Sapiens
HKPVLFQTA

SEQ ID NO: 374943 - protein, 9 aa, Homo Sapiens
DAHHGGWKT

SEQ ID NO: 374944 - protein, 9 aa, Homo Sapiens
EKGVFIAYD

SEQ ID NO: 374945 - protein, 9 aa, Homo Sapiens
GGLDGPVVE

SEQ ID NO: 374946 - protein, 9 aa, Homo Sapiens
NPVSIPRQR

SEQ ID NO: 374947 - protein, 9 aa, Homo Sapiens
GTFMGNIAE

SEQ ID NO: 374948 - protein, 9 aa, Homo Sapiens
LKHCPSVTS

SEQ ID NO: 374949 - protein, 9 aa, Homo Sapiens
VRFYRNGDH

SEQ ID NO: 374950 - protein, 9 aa, Homo Sapiens
DRLTLLGRT

SEQ ID NO: 374951 - protein, 9 aa, Homo Sapiens
WSNSICLKL

SEQ ID NO: 374952 - protein, 9 aa, Homo Sapiens
LDGPVVEIS

SEQ ID NO: 374953 - protein, 9 aa, Homo Sapiens
VCRKDSICP

SEQ ID NO: 374954 - protein, 9 aa, Homo Sapiens
DEQRGEMAL

SEQ ID NO: 374955 - protein, 9 aa, Homo Sapiens
MTLSVDRLT

SEQ ID NO: 374956 - protein, 9 aa, Homo Sapiens
SNSICLKLA

SEQ ID NO: 374957 - protein, 9 aa, Homo Sapiens
QSKFERLSY

SEQ ID NO: 374958 - protein, 9 aa, Homo Sapiens
VYESFSLPH

SEQ ID NO: 374959 - protein, 9 aa, Homo Sapiens
SQLFLKCIV

SEQ ID NO: 374960 - protein, 9 aa, Homo Sapiens
KLVVVGACG

SEQ ID NO: 374961 - protein, 9 aa, Homo Sapiens
LSCVSAQRS

SEQ ID NO: 374962 - protein, 9 aa, Homo Sapiens
KITAFLPND

SEQ ID NO: 374963 - protein, 9 aa, Homo Sapiens
MIKLDFFAI

SEQ ID NO: 374964 - protein, 9 aa, Homo Sapiens
HITLNHEEA

SEQ ID NO: 374965 - protein, 9 aa, Homo Sapiens
NESMLSKSN

SEQ ID NO: 374966 - protein, 9 aa, Homo Sapiens
TFMGNIAED

SEQ ID NO: 374967 - protein, 9 aa, Homo Sapiens
SICPYKKHL

SEQ ID NO: 374968 - protein, 9 aa, Homo Sapiens
PVYESFSLP

SEQ ID NO: 374969 - protein, 9 aa, Homo Sapiens
FSAFGKIIS

SEQ ID NO: 374970 - protein, 9 aa, Homo Sapiens
ATSQFKAYR

SEQ ID NO: 374971 - protein, 9 aa, Homo Sapiens
DLAARTVNQ

SEQ ID NO: 374972 - protein, 9 aa, Homo Sapiens
DQSQVTFAG

SEQ ID NO: 374973 - protein, 9 aa, Homo Sapiens
IGLYIFERF

SEQ ID NO: 374974 - protein, 9 aa, Homo Sapiens
YRNGDHYFK

SEQ ID NO: 374975 - protein, 9 aa, Homo Sapiens
LQAEDCSIV

SEQ ID NO: 374976 - protein, 9 aa, Homo Sapiens
IISSKVMSD

SEQ ID NO: 374977 - protein, 9 aa, Homo Sapiens
LSWADLRAV

SEQ ID NO: 374978 - protein, 9 aa, Homo Sapiens
MGLSTTIIP

SEQ ID NO: 374979 - protein, 9 aa, Homo Sapiens
PIGFASPTN

SEQ ID NO: 374980 - protein, 9 aa, Homo Sapiens
TFDLAARTV

SEQ ID NO: 374981 - protein, 9 aa, Homo Sapiens
MFVSLQGIF

SEQ ID NO: 374982 - protein, 9 aa, Homo Sapiens
ISSKVMSDD

SEQ ID NO: 374983 - protein, 9 aa, Homo Sapiens
GLDGPVVEI

SEQ ID NO: 374984 - protein, 9 aa, Homo Sapiens
LPGTPLSWA

SEQ ID NO: 374985 - protein, 9 aa, Homo Sapiens
DCSIVCLPR

SEQ ID NO: 374986 - protein, 9 aa, Homo Sapiens
IPRQRYSWY

SEQ ID NO: 374987 - protein, 9 aa, Homo Sapiens
EFIYKSWKN

SEQ ID NO: 374988 - protein, 9 aa, Homo Sapiens
QAEDCSIVC

SEQ ID NO: 374989 - protein, 9 aa, Homo Sapiens
YVSKDQRLQ

SEQ ID NO: 374990 - protein, 9 aa, Homo Sapiens
TEHQRTHTR

SEQ ID NO: 374991 - protein, 9 aa, Homo Sapiens
NWSNSICLK

SEQ ID NO: 374992 - protein, 9 aa, Homo Sapiens
TQSKFERLS

SEQ ID NO: 374993 - protein, 9 aa, Homo Sapiens
CRKDSICPY

SEQ ID NO: 374994 - protein, 9 aa, Homo Sapiens
VWEGATLCT

SEQ ID NO: 374995 - protein, 9 aa, Homo Sapiens
GFQTLDSAA

SEQ ID NO: 374996 - protein, 9 aa, Homo Sapiens
VLIGLYIFE

SEQ ID NO: 374997 - protein, 9 aa, Homo Sapiens
RFLHDSMRI

SEQ ID NO: 374998 - protein, 9 aa, Homo Sapiens
TFAGYGFAF

SEQ ID NO: 374999 - protein, 9 aa, Homo Sapiens
EHQRTHTRE

SEQ ID NO: 375000 - protein, 9 aa, Homo Sapiens
NVNQNATVE

SEQ ID NO: 375001 - protein, 9 aa, Homo Sapiens
SVWEGATLC

SEQ ID NO: 375002 - protein, 9 aa, Homo Sapiens
LSVDRLTLL

SEQ ID NO: 375003 - protein, 9 aa, Homo Sapiens
KVLLSAGRT

SEQ ID NO: 375004 - protein, 9 aa, Homo Sapiens
KVKTKALTH

SEQ ID NO: 375005 - protein, 9 aa, Homo Sapiens
SLITQSRLM

SEQ ID NO: 375006 - protein, 9 aa, Homo Sapiens
YSVPLKPLD

SEQ ID NO: 375007 - protein, 9 aa, Homo Sapiens
GYSVPLKPL

SEQ ID NO: 375008 - protein, 9 aa, Homo Sapiens
LVCDAMEET

SEQ ID NO: 375009 - protein, 9 aa, Homo Sapiens
QFRVHITLN

SEQ ID NO: 375010 - protein, 9 aa, Homo Sapiens
WEGATLCTC

SEQ ID NO: 375011 - protein, 9 aa, Homo Sapiens
GCRTSLEKF

SEQ ID NO: 375012 - protein, 9 aa, Homo Sapiens
VLLSAGRTI

SEQ ID NO: 375013 - protein, 9 aa, Homo Sapiens
NGKKITAFL

SEQ ID NO: 375014 - protein, 9 aa, Homo Sapiens
FILKHCPSV

SEQ ID NO: 375015 - protein, 9 aa, Homo Sapiens
DPLKLVCDA

SEQ ID NO: 375016 - protein, 9 aa, Homo Sapiens
LSTTIIPKI

SEQ ID NO: 375017 - protein, 9 aa, Homo Sapiens
AEARLSADV

SEQ ID NO: 375018 - protein, 9 aa, Homo Sapiens
ESFSLPHLT

SEQ ID NO: 375019 - protein, 9 aa, Homo Sapiens
VLVQGGASE

SEQ ID NO: 375020 - protein, 9 aa, Homo Sapiens
VHKPVLFQT

SEQ ID NO: 375021 - protein, 9 aa, Homo Sapiens
VTSSYSNVY

SEQ ID NO: 375022 - protein, 9 aa, Homo Sapiens
LGGLDGPVV

SEQ ID NO: 375023 - protein, 9 aa, Homo Sapiens
MLSKSNQLS

SEQ ID NO: 375024 - protein, 9 aa, Homo Sapiens
AFGKIISSK

SEQ ID NO: 375025 - protein, 9 aa, Homo Sapiens
PQMIKLDFF

SEQ ID NO: 375026 - protein, 9 aa, Homo Sapiens
GEETRKVKT

SEQ ID NO: 375027 - protein, 9 aa, Homo Sapiens
SQVTFAGYG

SEQ ID NO: 375028 - protein, 9 aa, Homo Sapiens
NGEEPYKFE

SEQ ID NO: 375029 - protein, 9 aa, Homo Sapiens
FIRFLHDSM

SEQ ID NO: 375030 - protein, 9 aa, Homo Sapiens
DSVYDLLGR

SEQ ID NO: 375031 - protein, 9 aa, Homo Sapiens
TSQFKAYRR

SEQ ID NO: 375032 - protein, 9 aa, Homo Sapiens
ICPVYESFS

SEQ ID NO: 375033 - protein, 9 aa, Homo Sapiens
IGFASPTNE

SEQ ID NO: 375034 - protein, 9 aa, Homo Sapiens
THICPVYES

SEQ ID NO: 375035 - protein, 9 aa, Homo Sapiens
FGKIISSKV

SEQ ID NO: 375036 - protein, 9 aa, Homo Sapiens
EDQSQVTFA

SEQ ID NO: 375037 - protein, 9 aa, Homo Sapiens
GKDDEIPCQ

SEQ ID NO: 375038 - protein, 9 aa, Homo Sapiens
VGYSVPLKP

SEQ ID NO: 375039 - protein, 9 aa, Homo Sapiens
GKVLLSAGR

SEQ ID NO: 375040 - protein, 9 aa, Homo Sapiens
ILGRNPVSG

SEQ ID NO: 375041 - protein, 9 aa, Homo Sapiens
CWLGGLDGP

SEQ ID NO: 375042 - protein, 9 aa, Homo Sapiens
AFLPNDGCL

SEQ ID NO: 375043 - protein, 9 aa, Homo Sapiens
VVVGACGVG

SEQ ID NO: 375044 - protein, 9 aa, Homo Sapiens
NRCVLAPDL

SEQ ID NO: 375045 - protein, 9 aa, Homo Sapiens
EGATLCTCD

SEQ ID NO: 375046 - protein, 9 aa, Homo Sapiens
QIFILLGQL

SEQ ID NO: 375047 - protein, 9 aa, Homo Sapiens
VQIFILLGQ

SEQ ID NO: 375048 - protein, 9 aa, Homo Sapiens
LGRNPVSGR

SEQ ID NO: 375049 - protein, 9 aa, Homo Sapiens
DSMRIKKDP

SEQ ID NO: 375050 - protein, 9 aa, Homo Sapiens
LDFFAIEML

SEQ ID NO: 375051 - protein, 9 aa, Homo Sapiens
KDSICPYKK

SEQ ID NO: 375052 - protein, 9 aa, Homo Sapiens
KDDEIPCQR

SEQ ID NO: 375053 - protein, 9 aa, Homo Sapiens
QRSKWNPAS

SEQ ID NO: 375054 - protein, 9 aa, Homo Sapiens
HDSMRIKKD

SEQ ID NO: 375055 - protein, 9 aa, Homo Sapiens
LVQGGASEH

SEQ ID NO: 375056 - protein, 9 aa, Homo Sapiens
LYIFERFPT

SEQ ID NO: 375057 - protein, 9 aa, Homo Sapiens
SICLKLAVS

SEQ ID NO: 375058 - protein, 9 aa, Homo Sapiens
VVGACGVGK

SEQ ID NO: 375059 - protein, 9 aa, Homo Sapiens
EETRKVKTK

SEQ ID NO: 375060 - protein, 9 aa, Homo Sapiens
GSLSQRQRL

SEQ ID NO: 375061 - protein, 9 aa, Homo Sapiens
KHPQMIKLD

SEQ ID NO: 375062 - protein, 9 aa, Homo Sapiens
HTYATIRNT

SEQ ID NO: 375063 - protein, 9 aa, Homo Sapiens
RNTGFQTLD

SEQ ID NO: 375064 - protein, 9 aa, Homo Sapiens
LKPLDSSRQ

SEQ ID NO: 375065 - protein, 9 aa, Homo Sapiens
QEHGTFMGN

SEQ ID NO: 375066 - protein, 9 aa, Homo Sapiens
ITLNHEEAN

SEQ ID NO: 375067 - protein, 9 aa, Homo Sapiens
NPVSGRNVG

SEQ ID NO: 375068 - protein, 9 aa, Homo Sapiens
NVQIFILLG

SEQ ID NO: 375069 - protein, 9 aa, Homo Sapiens
YATIRNTEF

SEQ ID NO: 375070 - protein, 9 aa, Homo Sapiens
CDAMEETTD

SEQ ID NO: 375071 - protein, 9 aa, Homo Sapiens
TGVGYETFD

SEQ ID NO: 375072 - protein, 9 aa, Homo Sapiens
SGRNVGSPF

SEQ ID NO: 375073 - protein, 9 aa, Homo Sapiens
STTIIPKIL

SEQ ID NO: 375074 - protein, 9 aa, Homo Sapiens
FRVHITLNH

SEQ ID NO: 375075 - protein, 9 aa, Homo Sapiens
LQTAIAEDE

SEQ ID NO: 375076 - protein, 9 aa, Homo Sapiens
LGLLSNVNQ

SEQ ID NO: 375077 - protein, 9 aa, Homo Sapiens
CAMFVSLQG

SEQ ID NO: 375078 - protein, 9 aa, Homo Sapiens
VQGGASEHI

SEQ ID NO: 375079 - protein, 9 aa, Homo Sapiens
HFSAFGKII

SEQ ID NO: 375080 - protein, 9 aa, Homo Sapiens
ERLSYLSSK

SEQ ID NO: 375081 - protein, 9 aa, Homo Sapiens
LCMVDMGLS

SEQ ID NO: 375082 - protein, 9 aa, Homo Sapiens
FVSLQGIFG

SEQ ID NO: 375083 - protein, 9 aa, Homo Sapiens
RLSYLSSKW

SEQ ID NO: 375084 - protein, 9 aa, Homo Sapiens
HYFKGIVYA

SEQ ID NO: 375085 - protein, 9 aa, Homo Sapiens
SIDSSLPIG

SEQ ID NO: 375086 - protein, 9 aa, Homo Sapiens
FQNRKLRST

SEQ ID NO: 375087 - protein, 9 aa, Homo Sapiens
QRMRSGSYI

SEQ ID NO: 375088 - protein, 9 aa, Homo Sapiens
AVLIGLYIF

SEQ ID NO: 375089 - protein, 9 aa, Homo Sapiens
RDSVYDLLG

SEQ ID NO: 375090 - protein, 9 aa, Homo Sapiens
ILKHCPSVT

SEQ ID NO: 375091 - protein, 9 aa, Homo Sapiens
ESMLSKSNQ

SEQ ID NO: 375092 - protein, 9 aa, Homo Sapiens
VATPSVHKP

SEQ ID NO: 375093 - protein, 9 aa, Homo Sapiens
LGRVCTHLQ

SEQ ID NO: 375094 - protein, 9 aa, Homo Sapiens
CGVGKSALT

SEQ ID NO: 375095 - protein, 9 aa, Homo Sapiens
IYQYVSKDQ

SEQ ID NO: 375096 - protein, 9 aa, Homo Sapiens
KAQATDRDS

SEQ ID NO: 375097 - protein, 9 aa, Homo Sapiens
LTRHKKIHN

SEQ ID NO: 375098 - protein, 9 aa, Homo Sapiens
LVVLVQGGA

SEQ ID NO: 375099 - protein, 9 aa, Homo Sapiens
RKDSICPYK

SEQ ID NO: 375100 - protein, 9 aa, Homo Sapiens
VSGRNVGSP

SEQ ID NO: 375101 - protein, 9 aa, Homo Sapiens
LHDSMRIKK

SEQ ID NO: 375102 - protein, 9 aa, Homo Sapiens
GMVSGIINP

SEQ ID NO: 375103 - protein, 9 aa, Homo Sapiens
LNHEEANND

SEQ ID NO: 375104 - protein, 9 aa, Homo Sapiens
SGMVSGIIN

SEQ ID NO: 375105 - protein, 9 aa, Homo Sapiens
TAIAEDEQR

SEQ ID NO: 375106 - protein, 9 aa, Homo Sapiens
FILLGQLLK

SEQ ID NO: 375107 - protein, 9 aa, Homo Sapiens
VSIPRQRYS

SEQ ID NO: 375108 - protein, 9 aa, Homo Sapiens
YKSWKNNDI

SEQ ID NO: 375109 - protein, 9 aa, Homo Sapiens
HICPVYESF

SEQ ID NO: 375110 - protein, 9 aa, Homo Sapiens
VHTYATIRN

SEQ ID NO: 375111 - protein, 9 aa, Homo Sapiens
KQFNDYTSK

SEQ ID NO: 375112 - protein, 9 aa, Homo Sapiens
SGIINPSDL

SEQ ID NO: 375113 - protein, 9 aa, Homo Sapiens
YNVQIFILL

SEQ ID NO: 375114 - protein, 9 aa, Homo Sapiens
TAVLIGLYI

SEQ ID NO: 375115 - protein, 9 aa, Homo Sapiens
GCAMFVSLQ

SEQ ID NO: 375116 - protein, 9 aa, Homo Sapiens
AQRSKWNPA

SEQ ID NO: 375117 - protein, 9 aa, Homo Sapiens
SIPRQRYSW

SEQ ID NO: 375118 - protein, 9 aa, Homo Sapiens
MMDWKKQFN

SEQ ID NO: 375119 - protein, 9 aa, Homo Sapiens
SEQGCRTSL

SEQ ID NO: 375120 - protein, 9 aa, Homo Sapiens
RKLRSTGFT

SEQ ID NO: 375121 - protein, 9 aa, Homo Sapiens
TRERPFVCS

SEQ ID NO: 375122 - protein, 9 aa, Homo Sapiens
DAEARLSAD

SEQ ID NO: 375123 - protein, 9 aa, Homo Sapiens
PMEKGVFIA

SEQ ID NO: 375124 - protein, 9 aa, Homo Sapiens
TGFQTLDSA

SEQ ID NO: 375125 - protein, 9 aa, Homo Sapiens
RLTLLGRTH

SEQ ID NO: 375126 - protein, 9 aa, Homo Sapiens
MVDMGLSTT

SEQ ID NO: 375127 - protein, 9 aa, Homo Sapiens
IAEDEQRGE

SEQ ID NO: 375128 - protein, 9 aa, Homo Sapiens
TRHKKIHNG

SEQ ID NO: 375129 - protein, 9 aa, Homo Sapiens
GIINPSDLP

SEQ ID NO: 375130 - protein, 9 aa, Homo Sapiens
ATVCRKDSI

SEQ ID NO: 375131 - protein, 9 aa, Homo Sapiens
FMGNIAEDL

SEQ ID NO: 375132 - protein, 9 aa, Homo Sapiens
SQRQRLTST

SEQ ID NO: 375133 - protein, 9 aa, Homo Sapiens
WKKQFNDYT

SEQ ID NO: 375134 - protein, 9 aa, Homo Sapiens
ICLKLAVSS

SEQ ID NO: 375135 - protein, 9 aa, Homo Sapiens
SSLPIGFAS

SEQ ID NO: 375136 - protein, 9 aa, Homo Sapiens
NDAHHGGWK

SEQ ID NO: 375137 - protein, 9 aa, Homo Sapiens
LLMLIENSL

SEQ ID NO: 375138 - protein, 9 aa, Homo Sapiens
TQNNRCVLA

SEQ ID NO: 375139 - protein, 9 aa, Homo Sapiens
SVHKPVLFQ

SEQ ID NO: 375140 - protein, 9 aa, Homo Sapiens
GLYIFERFP

SEQ ID NO: 375141 - protein, 9 aa, Homo Sapiens
VCDAMEETT

SEQ ID NO: 375142 - protein, 9 aa, Homo Sapiens
FAGYGFAFR

SEQ ID NO: 375143 - protein, 9 aa, Homo Sapiens
LIENSLITQ

SEQ ID NO: 375144 - protein, 9 aa, Homo Sapiens
RLTSTPNVH

SEQ ID NO: 375145 - protein, 9 aa, Homo Sapiens
LSQRQRLTS

SEQ ID NO: 375146 - protein, 9 aa, Homo Sapiens
NYMMDWKKQ

SEQ ID NO: 375147 - protein, 9 aa, Homo Sapiens
PLKPLDSSR

SEQ ID NO: 375148 - protein, 9 aa, Homo Sapiens
LMLIENSLI

SEQ ID NO: 375149 - protein, 9 aa, Homo Sapiens
VVLVQGGAS

SEQ ID NO: 375150 - protein, 9 aa, Homo Sapiens
NQNATVEMT

SEQ ID NO: 375151 - protein, 9 aa, Homo Sapiens
AARTVNQFL

SEQ ID NO: 375152 - protein, 9 aa, Homo Sapiens
LTFDLAART

SEQ ID NO: 375153 - protein, 9 aa, Homo Sapiens
PVGYSVPLK

SEQ ID NO: 375154 - protein, 9 aa, Homo Sapiens
TLCTCDRGF

SEQ ID NO: 375155 - protein, 9 aa, Homo Sapiens
EQGCRTSLE

SEQ ID NO: 375156 - protein, 9 aa, Homo Sapiens
NNRCVLAPD

SEQ ID NO: 375157 - protein, 9 aa, Homo Sapiens
LLGRVCTHL

SEQ ID NO: 375158 - protein, 9 aa, Homo Sapiens
MEKGVFIAY

SEQ ID NO: 375159 - protein, 9 aa, Homo Sapiens
RNGDHYFKG

SEQ ID NO: 375160 - protein, 9 aa, Homo Sapiens
TDRDSGPNS

SEQ ID NO: 375161 - protein, 9 aa, Homo Sapiens
SAFGKIISS

SEQ ID NO: 375162 - protein, 9 aa, Homo Sapiens
ENSLITQSR

SEQ ID NO: 375163 - protein, 9 aa, Homo Sapiens
ILNSTGVGY

SEQ ID NO: 375164 - protein, 9 aa, Homo Sapiens
HPQMIKLDF

SEQ ID NO: 375165 - protein, 9 aa, Homo Sapiens
VLAPDLTIE

SEQ ID NO: 375166 - protein, 9 aa, Homo Sapiens
LTLLGRTHS

SEQ ID NO: 375167 - protein, 9 aa, Homo Sapiens
DDEIPCQRM

SEQ ID NO: 375168 - protein, 9 aa, Homo Sapiens
RKVKTKALT

SEQ ID NO: 375169 - protein, 9 aa, Homo Sapiens
IKLDFFAIE

SEQ ID NO: 375170 - protein, 9 aa, Homo Sapiens
ILPGTPLSW

SEQ ID NO: 375171 - protein, 9 aa, Homo Sapiens
GEFIYKSWK

SEQ ID NO: 375172 - protein, 9 aa, Homo Sapiens
SKDQRLQAI

SEQ ID NO: 375173 - protein, 9 aa, Homo Sapiens
ELKNWSNSI

SEQ ID NO: 375174 - protein, 9 aa, Homo Sapiens
LTSTPNVHM

SEQ ID NO: 375175 - protein, 9 aa, Homo Sapiens
IYKSWKNND

SEQ ID NO: 375176 - protein, 9 aa, Homo Sapiens
EEQEHGTFM

SEQ ID NO: 375177 - protein, 9 aa, Homo Sapiens
FIYKSWKNN

SEQ ID NO: 375178 - protein, 9 aa, Homo Sapiens
QNRKLRSTG

SEQ ID NO: 375179 - protein, 9 aa, Homo Sapiens
NTGFQTLDS

SEQ ID NO: 375180 - protein, 9 aa, Homo Sapiens
SVDRLTLLG

SEQ ID NO: 375181 - protein, 9 aa, Homo Sapiens
PRQRYSWYL

SEQ ID NO: 375182 - protein, 9 aa, Homo Sapiens
TPLSWADLR

SEQ ID NO: 375183 - protein, 9 aa, Homo Sapiens
VEDLVVLVQ

SEQ ID NO: 375184 - protein, 9 aa, Homo Sapiens
QNATVEMTR

SEQ ID NO: 375185 - protein, 9 aa, Homo Sapiens
MVSGIINPS

SEQ ID NO: 375186 - protein, 9 aa, Homo Sapiens
KPESEQGCR

SEQ ID NO: 375187 - protein, 9 aa, Homo Sapiens
QTAIAEDEQ

SEQ ID NO: 375188 - protein, 9 aa, Homo Sapiens
QNNRCVLAP

SEQ ID NO: 375189 - protein, 9 aa, Homo Sapiens
GTPLSWADL

SEQ ID NO: 375190 - protein, 9 aa, Homo Sapiens
KKQFNDYTS

SEQ ID NO: 375191 - protein, 9 aa, Homo Sapiens
KATSQFKAY

SEQ ID NO: 375192 - protein, 9 aa, Homo Sapiens
LIDEDFQNR

SEQ ID NO: 375193 - protein, 9 aa, Homo Sapiens
DHYFKGIVY

SEQ ID NO: 375194 - protein, 9 aa, Homo Sapiens
IVCLPRNHD

SEQ ID NO: 375195 - protein, 9 aa, Homo Sapiens
AQATDRDSG

SEQ ID NO: 375196 - protein, 9 aa, Homo Sapiens
KKPESEQGC

SEQ ID NO: 375197 - protein, 9 aa, Homo Sapiens
QIYQYVSKD

SEQ ID NO: 375198 - protein, 9 aa, Homo Sapiens
PSVTSSYSN

SEQ ID NO: 375199 - protein, 9 aa, Homo Sapiens
KIHNGEEPY

SEQ ID NO: 375200 - protein, 9 aa, Homo Sapiens
RSKWNPASG

SEQ ID NO: 375201 - protein, 9 aa, Homo Sapiens
DWKKQFNDY

SEQ ID NO: 375202 - protein, 9 aa, Homo Sapiens
AKHPQMIKL

SEQ ID NO: 375203 - protein, 9 aa, Homo Sapiens
TLNHEEANN

SEQ ID NO: 375204 - protein, 9 aa, Homo Sapiens
TPSVHKPVL

SEQ ID NO: 375205 - protein, 9 aa, Homo Sapiens
QVTFAGYGF

SEQ ID NO: 375206 - protein, 9 aa, Homo Sapiens
RTVNQFLTQ

SEQ ID NO: 375207 - protein, 9 aa, Homo Sapiens
GRVCTHLQP

SEQ ID NO: 375208 - protein, 9 aa, Homo Sapiens
RCVLAPDLT

SEQ ID NO: 375209 - protein, 9 aa, Homo Sapiens
HCPSVTSSY

SEQ ID NO: 375210 - protein, 9 aa, Homo Sapiens
DEDFQNRKL

SEQ ID NO: 375211 - protein, 9 aa, Homo Sapiens
YIFERFPTS

SEQ ID NO: 375212 - protein, 9 aa, Homo Sapiens
GRNVGSPFV

SEQ ID NO: 375213 - protein, 9 aa, Homo Sapiens
PDGKVLLSA

SEQ ID NO: 375214 - protein, 9 aa, Homo Sapiens
NSLITQSRL

SEQ ID NO: 375215 - protein, 9 aa, Homo Sapiens
EDLVVLVQG

SEQ ID NO: 375216 - protein, 9 aa, Homo Sapiens
VSLQGIFGI

SEQ ID NO: 375217 - protein, 9 aa, Homo Sapiens
AIAEDEQRG

SEQ ID NO: 375218 - protein, 9 aa, Homo Sapiens
RQRYSWYLC

SEQ ID NO: 375219 - protein, 9 aa, Homo Sapiens
KHCPSVTSS

SEQ ID NO: 375220 - protein, 9 aa, Homo Sapiens
ARTVNQFLT

SEQ ID NO: 375221 - protein, 9 aa, Homo Sapiens
MDWKKQFND

SEQ ID NO: 375222 - protein, 9 aa, Homo Sapiens
DMGLSTTII

SEQ ID NO: 375223 - protein, 9 aa, Homo Sapiens
PVSGRNVGS

SEQ ID NO: 375224 - protein, 9 aa, Homo Sapiens
PGTPLSWAD

SEQ ID NO: 375225 - protein, 9 aa, Homo Sapiens
SCVSAQRSK

SEQ ID NO: 375226 - protein, 9 aa, Homo Sapiens
VNQNATVEM

SEQ ID NO: 375227 - protein, 9 aa, Homo Sapiens
GLLSNVNQN

SEQ ID NO: 375228 - protein, 9 aa, Homo Sapiens
QYVSKDQRL

SEQ ID NO: 375229 - protein, 9 aa, Homo Sapiens
HGTFMGNIA

SEQ ID NO: 375230 - protein, 9 aa, Homo Sapiens
LKNWSNSIC

SEQ ID NO: 375231 - protein, 9 aa, Homo Sapiens
KIISSKVMS

SEQ ID NO: 375232 - protein, 9 aa, Homo Sapiens
GCWLGGLDG

SEQ ID NO: 375233 - protein, 9 aa, Homo Sapiens
ITAFLPNDG

SEQ ID NO: 375234 - protein, 9 aa, Homo Sapiens
KFERLSYLS

SEQ ID NO: 375235 - protein, 9 aa, Homo Sapiens
VGYETFDIL

SEQ ID NO: 375236 - protein, 9 aa, Homo Sapiens
GYETFDILE

SEQ ID NO: 375237 - protein, 9 aa, Homo Sapiens
HNGEEPYKF

SEQ ID NO: 375238 - protein, 9 aa, Homo Sapiens
QMIKLDFFA

SEQ ID NO: 375239 - protein, 9 aa, Homo Sapiens
YRVHTYATI

SEQ ID NO: 375240 - protein, 9 aa, Homo Sapiens
SVPLKPLDS

SEQ ID NO: 375241 - protein, 9 aa, Homo Sapiens
RTQSKFERL

SEQ ID NO: 375242 - protein, 9 aa, Homo Sapiens
WYRVHTYAT

SEQ ID NO: 375243 - protein, 9 aa, Homo Sapiens
MGNIAEDLG

SEQ ID NO: 375244 - protein, 9 aa, Homo Sapiens
SDPLKLVCD

SEQ ID NO: 375245 - protein, 9 aa, Homo Sapiens
VSAQRSKWN

SEQ ID NO: 375246 - protein, 9 aa, Homo Sapiens
LLSNVNQNA

SEQ ID NO: 375247 - protein, 9 aa, Homo Sapiens
EILNSTGVG

SEQ ID NO: 375248 - protein, 9 aa, Homo Sapiens
EIPCQRMRS

SEQ ID NO: 375249 - protein, 9 aa, Homo Sapiens
FERLSYLSS

SEQ ID NO: 375250 - protein, 9 aa, Homo Sapiens
FKAQATDRD

SEQ ID NO: 375251 - protein, 9 aa, Homo Sapiens
FLPNDGCLN

SEQ ID NO: 375252 - protein, 9 aa, Homo Sapiens
NWPMEKGVF

SEQ ID NO: 375253 - protein, 9 aa, Homo Sapiens
GSDPLKLVC

SEQ ID NO: 375254 - protein, 9 aa, Homo Sapiens
NNYMMDWKK

SEQ ID NO: 375255 - protein, 9 aa, Homo Sapiens
YLDLRNTGF

SEQ ID NO: 375256 - protein, 9 aa, Homo Sapiens
AYNPVSIPR

SEQ ID NO: 375257 - protein, 9 aa, Homo Sapiens
SWKNNDIEQ

SEQ ID NO: 375258 - protein, 9 aa, Homo Sapiens
ILLGQLLKS

SEQ ID NO: 375259 - protein, 9 aa, Homo Sapiens
VPLKPLDSS

SEQ ID NO: 375260 - protein, 9 aa, Homo Sapiens
PLSWADLRA

SEQ ID NO: 375261 - protein, 9 aa, Homo Sapiens
TAFLPNDGC

SEQ ID NO: 375262 - protein, 9 aa, Homo Sapiens
CSIVCLPRN

SEQ ID NO: 375263 - protein, 9 aa, Homo Sapiens
SFSLPHLTR

SEQ ID NO: 375264 - protein, 9 aa, Homo Sapiens
SVYDLLGRV

SEQ ID NO: 375265 - protein, 9 aa, Homo Sapiens
MGEETRKVK

SEQ ID NO: 375266 - protein, 9 aa, Homo Sapiens
DGKVLLSAG

SEQ ID NO: 375267 - protein, 9 aa, Homo Sapiens
QATDRDSGP

SEQ ID NO: 375268 - protein, 9 aa, Homo Sapiens
LNSTGVGYE

SEQ ID NO: 375269 - protein, 9 aa, Homo Sapiens
GATLCTCDR

SEQ ID NO: 375270 - protein, 9 aa, Homo Sapiens
NRKLRSTGF

SEQ ID NO: 375271 - protein, 9 aa, Homo Sapiens
DGPVVEISL

SEQ ID NO: 375272 - protein, 9 aa, Homo Sapiens
SKFERLSYL

SEQ ID NO: 375273 - protein, 9 aa, Homo Sapiens
DQWYRVHTY

SEQ ID NO: 375274 - protein, 9 aa, Homo Sapiens
RHKKIHNGE

SEQ ID NO: 375275 - protein, 9 aa, Homo Sapiens
WKNNDIEQA

SEQ ID NO: 375276 - protein, 9 aa, Homo Sapiens
SLPIGFASP

SEQ ID NO: 375277 - protein, 9 aa, Homo Sapiens
VFKAQATDR

SEQ ID NO: 375278 - protein, 9 aa, Homo Sapiens
AEDCSIVCL

SEQ ID NO: 375279 - protein, 9 aa, Homo Sapiens
SAQRSKWNP

SEQ ID NO: 375280 - protein, 9 aa, Homo Sapiens
GGWKTKMDW

SEQ ID NO: 375281 - protein, 9 aa, Homo Sapiens
CPSVTSSYS

SEQ ID NO: 375282 - protein, 9 aa, Homo Sapiens
TLLGRTHSV

SEQ ID NO: 375283 - protein, 9 aa, Homo Sapiens
SQFKAYRRR

SEQ ID NO: 375284 - protein, 9 aa, Homo Sapiens
SMRIKKDPE

SEQ ID NO: 375285 - protein, 9 aa, Homo Sapiens
FKAYRRRSS

SEQ ID NO: 375286 - protein, 9 aa, Homo Sapiens
DVATPSVHK

SEQ ID NO: 375287 - protein, 9 aa, Homo Sapiens
INPSDLPDS

SEQ ID NO: 375288 - protein, 9 aa, Homo Sapiens
VCLPRNHDK

SEQ ID NO: 375289 - protein, 9 aa, Homo Sapiens
QRQRLTSTP

SEQ ID NO: 375290 - protein, 9 aa, Homo Sapiens
RVHITLNHE

SEQ ID NO: 375291 - protein, 9 aa, Homo Sapiens
YQYVSKDQR

SEQ ID NO: 375292 - protein, 9 aa, Homo Sapiens
DLVVLVQGG

SEQ ID NO: 375293 - protein, 9 aa, Homo Sapiens
ACGVGKSAL

SEQ ID NO: 375294 - protein, 9 aa, Homo Sapiens
KSWKNNDIE

SEQ ID NO: 375295 - protein, 9 aa, Homo Sapiens
KPVLFQTAR

SEQ ID NO: 375296 - protein, 9 aa, Homo Sapiens
ATLCTCDRG

SEQ ID NO: 375297 - protein, 9 aa, Homo Sapiens
IRFLHDSMR

SEQ ID NO: 375298 - protein, 9 aa, Homo Sapiens
ICPYKKHLE

SEQ ID NO: 375299 - protein, 9 aa, Homo Sapiens
KNWSNSICL

SEQ ID NO: 375300 - protein, 9 aa, Homo Sapiens
QWYRVHTYA

SEQ ID NO: 375301 - protein, 9 aa, Homo Sapiens
KLVCDAMEE

SEQ ID NO: 375302 - protein, 9 aa, Homo Sapiens
CPVYESFSL

SEQ ID NO: 375303 - protein, 9 aa, Homo Sapiens
TVCRKDSIC

SEQ ID NO: 375304 - protein, 9 aa, Homo Sapiens
GWKTKMDWI

SEQ ID NO: 375305 - protein, 9 aa, Homo Sapiens
RQRLTSTPN

SEQ ID NO: 375306 - protein, 9 aa, Homo Sapiens
KLDFFAIEM

SEQ ID NO: 375307 - protein, 9 aa, Homo Sapiens
EQEHGTFMG

SEQ ID NO: 375308 - protein, 9 aa, Homo Sapiens
VLTFDLAAR

SEQ ID NO: 375309 - protein, 9 aa, Homo Sapiens
QRLTSTPNV

SEQ ID NO: 375310 - protein, 9 aa, Homo Sapiens
KSSNESMLS

SEQ ID NO: 375311 - protein, 9 aa, Homo Sapiens
IENSLITQS

SEQ ID NO: 375312 - protein, 9 aa, Homo Sapiens
NLQTAIAED

SEQ ID NO: 375313 - protein, 9 aa, Homo Sapiens
LKLVCDAME

SEQ ID NO: 375314 - protein, 9 aa, Homo Sapiens
ENWPMEKGV

SEQ ID NO: 375315 - protein, 9 aa, Homo Sapiens
IPCQRMRSG

SEQ ID NO: 375316 - protein, 9 aa, Homo Sapiens
AMFVSLQGI

SEQ ID NO: 375317 - protein, 9 aa, Homo Sapiens
QFKAYRRRS

SEQ ID NO: 375318 - protein, 9 aa, Homo Sapiens
LSYLSSKWA

SEQ ID NO: 375319 - protein, 9 aa, Homo Sapiens
SIVCLPRNH

SEQ ID NO: 375320 - protein, 9 aa, Homo Sapiens
VKTKALTHF

SEQ ID NO: 375321 - protein, 9 aa, Homo Sapiens
PEDQSQVTF

SEQ ID NO: 375322 - protein, 9 aa, Homo Sapiens
PESEQGCRT

SEQ ID NO: 375323 - protein, 9 aa, Homo Sapiens
VYDLLGRVC

SEQ ID NO: 375324 - protein, 9 aa, Homo Sapiens
MRIKKDPEL

SEQ ID NO: 375325 - protein, 9 aa, Homo Sapiens
IHNGEEPYK

SEQ ID NO: 375326 - protein, 9 aa, Homo Sapiens
AEDEQRGEM

SEQ ID NO: 375327 - protein, 9 aa, Homo Sapiens
LSNVNQNAT

SEQ ID NO: 375328 - protein, 9 aa, Homo Sapiens
IINPSDLPD

SEQ ID NO: 375329 - protein, 9 aa, Homo Sapiens
EHGTFMGNI

SEQ ID NO: 375330 - protein, 9 aa, Homo Sapiens
RDSGPNSYI

SEQ ID NO: 375331 - protein, 9 aa, Homo Sapiens
SSNESMLSK

SEQ ID NO: 375332 - protein, 9 aa, Homo Sapiens
GVGYETFDI

SEQ ID NO: 375333 - protein, 9 aa, Homo Sapiens
TLSVDRLTL

SEQ ID NO: 375334 - protein, 9 aa, Homo Sapiens
TRKVKTKAL

SEQ ID NO: 375335 - protein, 9 aa, Homo Sapiens
LCISPDGKV

SEQ ID NO: 375336 - protein, 9 aa, Homo Sapiens
FYRNGDHYF

SEQ ID NO: 375337 - protein, 9 aa, Homo Sapiens
CRTSLEKFT

SEQ ID NO: 375338 - protein, 9 aa, Homo Sapiens
ESEQGCRTS

SEQ ID NO: 375339 - protein, 9 aa, Homo Sapiens
FLHDSMRIK

SEQ ID NO: 375340 - protein, 9 aa, Homo Sapiens
NSICLKLAV

SEQ ID NO: 375341 - protein, 9 aa, Homo Sapiens
DLLGRVCTH

SEQ ID NO: 375342 - protein, 9 aa, Homo Sapiens
LWENWPMEK

SEQ ID NO: 375343 - protein, 9 aa, Homo Sapiens
VHITLNHEE

SEQ ID NO: 375344 - protein, 9 aa, Homo Sapiens
IFILLGQLL

SEQ ID NO: 375345 - protein, 9 aa, Homo Sapiens
FMGEETRKV

SEQ ID NO: 375346 - protein, 9 aa, Homo Sapiens
VLWENWPME

SEQ ID NO: 375347 - protein, 9 aa, Homo Sapiens
CVLAPDLTI

SEQ ID NO: 375348 - protein, 9 aa, Homo Sapiens
ILSGCAMFV

SEQ ID NO: 375349 - protein, 9 aa, Homo Sapiens
QRTHTRERP

SEQ ID NO: 375350 - protein, 9 aa, Homo Sapiens
QLSCVSAQR

SEQ ID NO: 375351 - protein, 9 aa, Homo Sapiens
TPVGYSVPL

SEQ ID NO: 375352 - protein, 9 aa, Homo Sapiens
CMVDMGLST

SEQ ID NO: 375353 - protein, 9 aa, Homo Sapiens
EDEQRGEMA

SEQ ID NO: 375354 - protein, 9 aa, Homo Sapiens
AHHGGWKTK

SEQ ID NO: 375355 - protein, 9 aa, Homo Sapiens
PLKLVCDAM

SEQ ID NO: 375356 - protein, 9 aa, Homo Sapiens
LSIDSSLPI

SEQ ID NO: 375357 - protein, 9 aa, Homo Sapiens
SPDGKVLLS

SEQ ID NO: 375358 - protein, 9 aa, Homo Sapiens
LAPDLTIEK

SEQ ID NO: 375359 - protein, 9 aa, Homo Sapiens
VDRLTLLGR

SEQ ID NO: 375360 - protein, 9 aa, Homo Sapiens
NHEEANNDI

SEQ ID NO: 375361 - protein, 9 aa, Homo Sapiens
IDEDFQNRK

SEQ ID NO: 375362 - protein, 9 aa, Homo Sapiens
LPNDGCLNF

SEQ ID NO: 375363 - protein, 9 aa, Homo Sapiens
EDCSIVCLP

SEQ ID NO: 375364 - protein, 9 aa, Homo Sapiens
STGVGYETF

SEQ ID NO: 375365 - protein, 9 aa, Homo Sapiens
NSTGVGYET

SEQ ID NO: 375366 - protein, 9 aa, Homo Sapiens
PCQRMRSGS

SEQ ID NO: 375367 - protein, 9 aa, Homo Sapiens
AYRRRSSLN

SEQ ID NO: 375368 - protein, 9 aa, Homo Sapiens
SWADLRAVN

SEQ ID NO: 375369 - protein, 9 aa, Homo Sapiens
GRNPVSGRN

SEQ ID NO: 375370 - protein, 9 aa, Homo Sapiens
SNESMLSKS

SEQ ID NO: 375371 - protein, 9 aa, Homo Sapiens
IFERFPTSM

SEQ ID NO: 375372 - protein, 9 aa, Homo Sapiens
WLGGLDGPV

SEQ ID NO: 375373 - protein, 9 aa, Homo Sapiens
RNPVSGRNV

SEQ ID NO: 375374 - protein, 9 aa, Homo Sapiens
GLSTTIIPK

SEQ ID NO: 375375 - protein, 9 aa, Homo Sapiens
QSQVTFAGY

SEQ ID NO: 375376 - protein, 9 aa, Homo Sapiens
RFYRNGDHY

SEQ ID NO: 375377 - protein, 9 aa, Homo Sapiens
YMMDWKKQF

SEQ ID NO: 375378 - protein, 9 aa, Homo Sapiens
WPMEKGVFI

SEQ ID NO: 375379 - protein, 9 aa, Homo Sapiens
YYNVQIFIL

SEQ ID NO: 375380 - protein, 9 aa, Homo Sapiens
GDHYFKGIV

SEQ ID NO: 375381 - protein, 9 aa, Homo Sapiens
CQRMRSGSY

SEQ ID NO: 375382 - protein, 9 aa, Homo Sapiens
GACGVGKSA

SEQ ID NO: 375383 - protein, 9 aa, Homo Sapiens
GKIISSKVM

SEQ ID NO: 375384 - protein, 9 aa, Homo Sapiens
RTHTRERPF

SEQ ID NO: 375385 - protein, 9 aa, Homo Sapiens
LCTCDRGFF

SEQ ID NO: 375386 - protein, 9 aa, Homo Sapiens
YESFSLPHL

SEQ ID NO: 375387 - protein, 9 aa, Homo Sapiens
HQRTHTRER

SEQ ID NO: 375388 - protein, 9 aa, Homo Sapiens
YKLVVVGAC

SEQ ID NO: 375389 - protein, 9 aa, Homo Sapiens
CVSAQRSKW

SEQ ID NO: 375390 - protein, 9 aa, Homo Sapiens
HKKIHNGEE

SEQ ID NO: 375391 - protein, 9 aa, Homo Sapiens
DSICPYKKH

SEQ ID NO: 375392 - protein, 9 aa, Homo Sapiens
LVVVGACGV

SEQ ID NO: 375393 - protein, 9 aa, Homo Sapiens
KLAGLLMVH

SEQ ID NO: 375394 - protein, 9 aa, Homo Sapiens
QAHRPHPPP

SEQ ID NO: 375395 - protein, 9 aa, Homo Sapiens
YQTSEDCSG

SEQ ID NO: 375396 - protein, 9 aa, Homo Sapiens
CSDEECRQV

SEQ ID NO: 375397 - protein, 9 aa, Homo Sapiens
TQMYLLSKN

SEQ ID NO: 375398 - protein, 9 aa, Homo Sapiens
APARSATVA

SEQ ID NO: 375399 - protein, 9 aa, Homo Sapiens
VTEVTEEMV

SEQ ID NO: 375400 - protein, 9 aa, Homo Sapiens
YNAWLLYEL

SEQ ID NO: 375401 - protein, 9 aa, Homo Sapiens
ELLPPLPQA

SEQ ID NO: 375402 - protein, 9 aa, Homo Sapiens
PSPVGGDSN

SEQ ID NO: 375403 - protein, 9 aa, Homo Sapiens
INDEMKCSG

SEQ ID NO: 375404 - protein, 9 aa, Homo Sapiens
GLYIFCNER

SEQ ID NO: 375405 - protein, 9 aa, Homo Sapiens
TWKPTAEQP

SEQ ID NO: 375406 - protein, 9 aa, Homo Sapiens
TEEMVNLAW

SEQ ID NO: 375407 - protein, 9 aa, Homo Sapiens
ASSAQRTST

SEQ ID NO: 375408 - protein, 9 aa, Homo Sapiens
ASDSSVCVL

SEQ ID NO: 375409 - protein, 9 aa, Homo Sapiens
TDVKSVEML

SEQ ID NO: 375410 - protein, 9 aa, Homo Sapiens
SSHQAWTGS

SEQ ID NO: 375411 - protein, 9 aa, Homo Sapiens
LCSRGTRTK

SEQ ID NO: 375412 - protein, 9 aa, Homo Sapiens
RDVVKHYLS

SEQ ID NO: 375413 - protein, 9 aa, Homo Sapiens
LRTWKPTAE

SEQ ID NO: 375414 - protein, 9 aa, Homo Sapiens
HSQPRGTFT

SEQ ID NO: 375415 - protein, 9 aa, Homo Sapiens
GQHLLRATT

SEQ ID NO: 375416 - protein, 9 aa, Homo Sapiens
TCTNAPNGG

SEQ ID NO: 375417 - protein, 9 aa, Homo Sapiens
VASVLEAVY

SEQ ID NO: 375418 - protein, 9 aa, Homo Sapiens
NVTTRESIH

SEQ ID NO: 375419 - protein, 9 aa, Homo Sapiens
CPGGCGTRE

SEQ ID NO: 375420 - protein, 9 aa, Homo Sapiens
EYRQVPGRD

SEQ ID NO: 375421 - protein, 9 aa, Homo Sapiens
HMTEVVRHC

SEQ ID NO: 375422 - protein, 9 aa, Homo Sapiens
SGPLHTRRG

SEQ ID NO: 375423 - protein, 9 aa, Homo Sapiens
NLSEEFKQM

SEQ ID NO: 375424 - protein, 9 aa, Homo Sapiens
VREQLSGLK

SEQ ID NO: 375425 - protein, 9 aa, Homo Sapiens
QPRKERLKS

SEQ ID NO: 375426 - protein, 9 aa, Homo Sapiens
LKKSPSAGN

SEQ ID NO: 375427 - protein, 9 aa, Homo Sapiens
SLILGQFRV

SEQ ID NO: 375428 - protein, 9 aa, Homo Sapiens
LVMTARDGG

SEQ ID NO: 375429 - protein, 9 aa, Homo Sapiens
ASITLPSLF

SEQ ID NO: 375430 - protein, 9 aa, Homo Sapiens
ELMEAVLRY

SEQ ID NO: 375431 - protein, 9 aa, Homo Sapiens
VAPRPTPGW

SEQ ID NO: 375432 - protein, 9 aa, Homo Sapiens
ITSAIVQAR

SEQ ID NO: 375433 - protein, 9 aa, Homo Sapiens
ARPQLEFVL

SEQ ID NO: 375434 - protein, 9 aa, Homo Sapiens
LPPAPPLDN

SEQ ID NO: 375435 - protein, 9 aa, Homo Sapiens
KGARKAGKT

SEQ ID NO: 375436 - protein, 9 aa, Homo Sapiens
GWRIPLSEM

SEQ ID NO: 375437 - protein, 9 aa, Homo Sapiens
MFRQFYLWK

SEQ ID NO: 375438 - protein, 9 aa, Homo Sapiens
EGGLGSGME

SEQ ID NO: 375439 - protein, 9 aa, Homo Sapiens
RVRAAVSRQ

SEQ ID NO: 375440 - protein, 9 aa, Homo Sapiens
NHQPMDPEV

SEQ ID NO: 375441 - protein, 9 aa, Homo Sapiens
PPGCINLSE

SEQ ID NO: 375442 - protein, 9 aa, Homo Sapiens
HGQGLCFAA

SEQ ID NO: 375443 - protein, 9 aa, Homo Sapiens
AVPQPAAGI

SEQ ID NO: 375444 - protein, 9 aa, Homo Sapiens
TDDELWTNI

SEQ ID NO: 375445 - protein, 9 aa, Homo Sapiens
SSGLYIFCN

SEQ ID NO: 375446 - protein, 9 aa, Homo Sapiens
NLGLIIFGD

SEQ ID NO: 375447 - protein, 9 aa, Homo Sapiens
AVKLSEGGL

SEQ ID NO: 375448 - protein, 9 aa, Homo Sapiens
EPRELLTNV

SEQ ID NO: 375449 - protein, 9 aa, Homo Sapiens
SAMNVAKGT

SEQ ID NO: 375450 - protein, 9 aa, Homo Sapiens
TQASLRSLS

SEQ ID NO: 375451 - protein, 9 aa, Homo Sapiens
KITFQYGIT

SEQ ID NO: 375452 - protein, 9 aa, Homo Sapiens
IRHPDIEVD

SEQ ID NO: 375453 - protein, 9 aa, Homo Sapiens
AAPTTAANW

SEQ ID NO: 375454 - protein, 9 aa, Homo Sapiens
ATLGQDPPQ

SEQ ID NO: 375455 - protein, 9 aa, Homo Sapiens
YVSYGPVME

SEQ ID NO: 375456 - protein, 9 aa, Homo Sapiens
TNVWVQEHY

SEQ ID NO: 375457 - protein, 9 aa, Homo Sapiens
QCANIQLCS

SEQ ID NO: 375458 - protein, 9 aa, Homo Sapiens
IICPENSHY

SEQ ID NO: 375459 - protein, 9 aa, Homo Sapiens
PQPAAGIAH

SEQ ID NO: 375460 - protein, 9 aa, Homo Sapiens
VCSGVTSAM

SEQ ID NO: 375461 - protein, 9 aa, Homo Sapiens
RILDTHRKL

SEQ ID NO: 375462 - protein, 9 aa, Homo Sapiens
TPCRFLKTT

SEQ ID NO: 375463 - protein, 9 aa, Homo Sapiens
NVEHYEELK

SEQ ID NO: 375464 - protein, 9 aa, Homo Sapiens
RHGQGLCFA

SEQ ID NO: 375465 - protein, 9 aa, Homo Sapiens
PSLEDSIGL

SEQ ID NO: 375466 - protein, 9 aa, Homo Sapiens
REQLSGLKE

SEQ ID NO: 375467 - protein, 9 aa, Homo Sapiens
LPPLPQAFL

SEQ ID NO: 375468 - protein, 9 aa, Homo Sapiens
NKYIEHLVT

SEQ ID NO: 375469 - protein, 9 aa, Homo Sapiens
LSEGGLGSG

SEQ ID NO: 375470 - protein, 9 aa, Homo Sapiens
VPLLHGASH

SEQ ID NO: 375471 - protein, 9 aa, Homo Sapiens
TSLSTVRKP

SEQ ID NO: 375472 - protein, 9 aa, Homo Sapiens
TFEYICHKV

SEQ ID NO: 375473 - protein, 9 aa, Homo Sapiens
TATAGWTCR

SEQ ID NO: 375474 - protein, 9 aa, Homo Sapiens
PKPTCSRAR

SEQ ID NO: 375475 - protein, 9 aa, Homo Sapiens
RTSTRWTLP

SEQ ID NO: 375476 - protein, 9 aa, Homo Sapiens
RHQEWNMMA

SEQ ID NO: 375477 - protein, 9 aa, Homo Sapiens
RKARNRHQE

SEQ ID NO: 375478 - protein, 9 aa, Homo Sapiens
ANIQLCSDE

SEQ ID NO: 375479 - protein, 9 aa, Homo Sapiens
MMLGHKNRS

SEQ ID NO: 375480 - protein, 9 aa, Homo Sapiens
RHTAVMKLR

SEQ ID NO: 375481 - protein, 9 aa, Homo Sapiens
LNLSNNKIK

SEQ ID NO: 375482 - protein, 9 aa, Homo Sapiens
HSVPSTPPR

SEQ ID NO: 375483 - protein, 9 aa, Homo Sapiens
MTARDGGSP

SEQ ID NO: 375484 - protein, 9 aa, Homo Sapiens
GTRELCRAG

SEQ ID NO: 375485 - protein, 9 aa, Homo Sapiens
CYDMDTGRE

SEQ ID NO: 375486 - protein, 9 aa, Homo Sapiens
HAALLCNYF

SEQ ID NO: 375487 - protein, 9 aa, Homo Sapiens
SACPGGCGT

SEQ ID NO: 375488 - protein, 9 aa, Homo Sapiens
WCTDVKSVE

SEQ ID NO: 375489 - protein, 9 aa, Homo Sapiens
QLEFVLPRS

SEQ ID NO: 375490 - protein, 9 aa, Homo Sapiens
AFLLLLLLP

SEQ ID NO: 375491 - protein, 9 aa, Homo Sapiens
ISESDMHVL

SEQ ID NO: 375492 - protein, 9 aa, Homo Sapiens
AHEGTCNNL

SEQ ID NO: 375493 - protein, 9 aa, Homo Sapiens
EQINDEMKC

SEQ ID NO: 375494 - protein, 9 aa, Homo Sapiens
GSGQRSEEI

SEQ ID NO: 375495 - protein, 9 aa, Homo Sapiens
KEKAEPPRL

SEQ ID NO: 375496 - protein, 9 aa, Homo Sapiens
GQMSWKPCG

SEQ ID NO: 375497 - protein, 9 aa, Homo Sapiens
RPQLEFVLP

SEQ ID NO: 375498 - protein, 9 aa, Homo Sapiens
SIRHPDIEV

SEQ ID NO: 375499 - protein, 9 aa, Homo Sapiens
GYPYIDLDF

SEQ ID NO: 375500 - protein, 9 aa, Homo Sapiens
EELNHLGMM

SEQ ID NO: 375501 - protein, 9 aa, Homo Sapiens
ILTSTTLNV

SEQ ID NO: 375502 - protein, 9 aa, Homo Sapiens
ASGPLHTRR

SEQ ID NO: 375503 - protein, 9 aa, Homo Sapiens
KQMRIENSP

SEQ ID NO: 375504 - protein, 9 aa, Homo Sapiens
VRHCPHHER

SEQ ID NO: 375505 - protein, 9 aa, Homo Sapiens
RYPGLLGLQ

SEQ ID NO: 375506 - protein, 9 aa, Homo Sapiens
YTIILIGVQ

SEQ ID NO: 375507 - protein, 9 aa, Homo Sapiens
FLHNRELQC

SEQ ID NO: 375508 - protein, 9 aa, Homo Sapiens
PFSSSAPSS

SEQ ID NO: 375509 - protein, 9 aa, Homo Sapiens
GDQVVRYGC

SEQ ID NO: 375510 - protein, 9 aa, Homo Sapiens
VQHLTDNPC

SEQ ID NO: 375511 - protein, 9 aa, Homo Sapiens
TGLEAHTHI

SEQ ID NO: 375512 - protein, 9 aa, Homo Sapiens
SITLPSLFG

SEQ ID NO: 375513 - protein, 9 aa, Homo Sapiens
KYHGYPYID

SEQ ID NO: 375514 - protein, 9 aa, Homo Sapiens
DFVQPRKER

SEQ ID NO: 375515 - protein, 9 aa, Homo Sapiens
SRAAAPTTA

SEQ ID NO: 375516 - protein, 9 aa, Homo Sapiens
DGTPLSTIT

SEQ ID NO: 375517 - protein, 9 aa, Homo Sapiens
CFAAGELIT

SEQ ID NO: 375518 - protein, 9 aa, Homo Sapiens
DHVNLTTTW

SEQ ID NO: 375519 - protein, 9 aa, Homo Sapiens
ADDMDRIMM

SEQ ID NO: 375520 - protein, 9 aa, Homo Sapiens
TKWQALLGR

SEQ ID NO: 375521 - protein, 9 aa, Homo Sapiens
HNRELQCSV

SEQ ID NO: 375522 - protein, 9 aa, Homo Sapiens
EYEKITFQY

SEQ ID NO: 375523 - protein, 9 aa, Homo Sapiens
RSNQNREWC

SEQ ID NO: 375524 - protein, 9 aa, Homo Sapiens
EMVNLAWDN

SEQ ID NO: 375525 - protein, 9 aa, Homo Sapiens
PFPAVPQPA

SEQ ID NO: 375526 - protein, 9 aa, Homo Sapiens
HRWDPCMPS

SEQ ID NO: 375527 - protein, 9 aa, Homo Sapiens
AGNVHILTG

SEQ ID NO: 375528 - protein, 9 aa, Homo Sapiens
LCYDMDTGR

SEQ ID NO: 375529 - protein, 9 aa, Homo Sapiens
RPHPPPPKP

SEQ ID NO: 375530 - protein, 9 aa, Homo Sapiens
TKFIHIKAN

SEQ ID NO: 375531 - protein, 9 aa, Homo Sapiens
GKVLHKTGL

SEQ ID NO: 375532 - protein, 9 aa, Homo Sapiens
TSTTLNVIR

SEQ ID NO: 375533 - protein, 9 aa, Homo Sapiens
MNRPHCGVP

SEQ ID NO: 375534 - protein, 9 aa, Homo Sapiens
DFCFQRNQF

SEQ ID NO: 375535 - protein, 9 aa, Homo Sapiens
CMPSCHSPR

SEQ ID NO: 375536 - protein, 9 aa, Homo Sapiens
QPSTSQITY

SEQ ID NO: 375537 - protein, 9 aa, Homo Sapiens
HVNLTTTWQ

SEQ ID NO: 375538 - protein, 9 aa, Homo Sapiens
TLPSLFGWA

SEQ ID NO: 375539 - protein, 9 aa, Homo Sapiens
SDMHVLQMA

SEQ ID NO: 375540 - protein, 9 aa, Homo Sapiens
RSATVAPRP

SEQ ID NO: 375541 - protein, 9 aa, Homo Sapiens
PAHFQLLQQ

SEQ ID NO: 375542 - protein, 9 aa, Homo Sapiens
MPKREMKPE

SEQ ID NO: 375543 - protein, 9 aa, Homo Sapiens
EKKKGREKE

SEQ ID NO: 375544 - protein, 9 aa, Homo Sapiens
FWCTDVKSV

SEQ ID NO: 375545 - protein, 9 aa, Homo Sapiens
PILTSTTLN

SEQ ID NO: 375546 - protein, 9 aa, Homo Sapiens
SSAKHQKHC

SEQ ID NO: 375547 - protein, 9 aa, Homo Sapiens
SPFSSSAPS

SEQ ID NO: 375548 - protein, 9 aa, Homo Sapiens
NHLGMMIDL

SEQ ID NO: 375549 - protein, 9 aa, Homo Sapiens
EGAAINQIL

SEQ ID NO: 375550 - protein, 9 aa, Homo Sapiens
DRVRAAVSR

SEQ ID NO: 375551 - protein, 9 aa, Homo Sapiens
TDEDLRTAI

SEQ ID NO: 375552 - protein, 9 aa, Homo Sapiens
FCNEREEEK

SEQ ID NO: 375553 - protein, 9 aa, Homo Sapiens
PLRTWKPTA

SEQ ID NO: 375554 - protein, 9 aa, Homo Sapiens
AKLWACDFC

SEQ ID NO: 375555 - protein, 9 aa, Homo Sapiens
FRGPDRVRA

SEQ ID NO: 375556 - protein, 9 aa, Homo Sapiens
SSHCSQRHQ

SEQ ID NO: 375557 - protein, 9 aa, Homo Sapiens
MTLCVFWLM

SEQ ID NO: 375558 - protein, 9 aa, Homo Sapiens
RLLAHLCRL

SEQ ID NO: 375559 - protein, 9 aa, Homo Sapiens
NQSPSSHCS

SEQ ID NO: 375560 - protein, 9 aa, Homo Sapiens
VRTGERGAG

SEQ ID NO: 375561 - protein, 9 aa, Homo Sapiens
ASGGCLYIS

SEQ ID NO: 375562 - protein, 9 aa, Homo Sapiens
KYIEHLVTQ

SEQ ID NO: 375563 - protein, 9 aa, Homo Sapiens
RNGKQHQDD

SEQ ID NO: 375564 - protein, 9 aa, Homo Sapiens
SAQRTSTRW

SEQ ID NO: 375565 - protein, 9 aa, Homo Sapiens
DQPSTSQIT

SEQ ID NO: 375566 - protein, 9 aa, Homo Sapiens
VPGRDPACY

SEQ ID NO: 375567 - protein, 9 aa, Homo Sapiens
ILPPSTLDG

SEQ ID NO: 375568 - protein, 9 aa, Homo Sapiens
DEEEHAALL

SEQ ID NO: 375569 - protein, 9 aa, Homo Sapiens
SASITLPSL

SEQ ID NO: 375570 - protein, 9 aa, Homo Sapiens
SWVRTGERG

SEQ ID NO: 375571 - protein, 9 aa, Homo Sapiens
KEKEVNFQA

SEQ ID NO: 375572 - protein, 9 aa, Homo Sapiens
LRWGPAAPS

SEQ ID NO: 375573 - protein, 9 aa, Homo Sapiens
QNQSPSSHC

SEQ ID NO: 375574 - protein, 9 aa, Homo Sapiens
SMYLQLPSP

SEQ ID NO: 375575 - protein, 9 aa, Homo Sapiens
SLEDSIGLF

SEQ ID NO: 375576 - protein, 9 aa, Homo Sapiens
SVCMPVSCR

SEQ ID NO: 375577 - protein, 9 aa, Homo Sapiens
RSTQPTQQF

SEQ ID NO: 375578 - protein, 9 aa, Homo Sapiens
YLWKCLASG

SEQ ID NO: 375579 - protein, 9 aa, Homo Sapiens
AKHQKHCQP

SEQ ID NO: 375580 - protein, 9 aa, Homo Sapiens
LWKCLASGI

SEQ ID NO: 375581 - protein, 9 aa, Homo Sapiens
GLCFAAGEL

SEQ ID NO: 375582 - protein, 9 aa, Homo Sapiens
WTCRATTTR

SEQ ID NO: 375583 - protein, 9 aa, Homo Sapiens
LPPSTLDGA

SEQ ID NO: 375584 - protein, 9 aa, Homo Sapiens
TSAIVQARS

SEQ ID NO: 375585 - protein, 9 aa, Homo Sapiens
AMNRPHCGV

SEQ ID NO: 375586 - protein, 9 aa, Homo Sapiens
HYLSKSDLL

SEQ ID NO: 375587 - protein, 9 aa, Homo Sapiens
DTHRKLEES

SEQ ID NO: 375588 - protein, 9 aa, Homo Sapiens
SKSFNNHQP

SEQ ID NO: 375589 - protein, 9 aa, Homo Sapiens
ATAGWTCRA

SEQ ID NO: 375590 - protein, 9 aa, Homo Sapiens
EPADPEGAA

SEQ ID NO: 375591 - protein, 9 aa, Homo Sapiens
SGRACVEDF

SEQ ID NO: 375592 - protein, 9 aa, Homo Sapiens
PSAGNVHIL

SEQ ID NO: 375593 - protein, 9 aa, Homo Sapiens
INTFENVDE

SEQ ID NO: 375594 - protein, 9 aa, Homo Sapiens
RAAAPTTAA

SEQ ID NO: 375595 - protein, 9 aa, Homo Sapiens
TSSGLYIFC

SEQ ID NO: 375596 - protein, 9 aa, Homo Sapiens
GRNLADLRH

SEQ ID NO: 375597 - protein, 9 aa, Homo Sapiens
GVTSAMNVA

SEQ ID NO: 375598 - protein, 9 aa, Homo Sapiens
GWPRHTAVM

SEQ ID NO: 375599 - protein, 9 aa, Homo Sapiens
PSSLRSSSW

SEQ ID NO: 375600 - protein, 9 aa, Homo Sapiens
MSPKSRHPE

SEQ ID NO: 375601 - protein, 9 aa, Homo Sapiens
LSVYELVMT

SEQ ID NO: 375602 - protein, 9 aa, Homo Sapiens
IPIFSANAW

SEQ ID NO: 375603 - protein, 9 aa, Homo Sapiens
HSIRHPDIE

SEQ ID NO: 375604 - protein, 9 aa, Homo Sapiens
QGTATSWVR

SEQ ID NO: 375605 - protein, 9 aa, Homo Sapiens
ASASDSSVC

SEQ ID NO: 375606 - protein, 9 aa, Homo Sapiens
ESDSLKPTV

SEQ ID NO: 375607 - protein, 9 aa, Homo Sapiens
LAAMNRPHC

SEQ ID NO: 375608 - protein, 9 aa, Homo Sapiens
PGEENLRWG

SEQ ID NO: 375609 - protein, 9 aa, Homo Sapiens
SDHVVEGQW

SEQ ID NO: 375610 - protein, 9 aa, Homo Sapiens
RRRHSTESW

SEQ ID NO: 375611 - protein, 9 aa, Homo Sapiens
HKTGLLMTF

SEQ ID NO: 375612 - protein, 9 aa, Homo Sapiens
RNGGTCTNA

SEQ ID NO: 375613 - protein, 9 aa, Homo Sapiens
LEFVLPRSE

SEQ ID NO: 375614 - protein, 9 aa, Homo Sapiens
LLSSAKHQK

SEQ ID NO: 375615 - protein, 9 aa, Homo Sapiens
WKCLASGII

SEQ ID NO: 375616 - protein, 9 aa, Homo Sapiens
RIMMLGHKN

SEQ ID NO: 375617 - protein, 9 aa, Homo Sapiens
TDNPCQNQS

SEQ ID NO: 375618 - protein, 9 aa, Homo Sapiens
WDPCMPSCH

SEQ ID NO: 375619 - protein, 9 aa, Homo Sapiens
CGTRELCRA

SEQ ID NO: 375620 - protein, 9 aa, Homo Sapiens
QLCSDEECR

SEQ ID NO: 375621 - protein, 9 aa, Homo Sapiens
KENPNQMAV

SEQ ID NO: 375622 - protein, 9 aa, Homo Sapiens
SFGDKDFQT

SEQ ID NO: 375623 - protein, 9 aa, Homo Sapiens
SLRLLLKLT

SEQ ID NO: 375624 - protein, 9 aa, Homo Sapiens
KHAKKITSA

SEQ ID NO: 375625 - protein, 9 aa, Homo Sapiens
DNTVVGQMS

SEQ ID NO: 375626 - protein, 9 aa, Homo Sapiens
TAANWSTQA

SEQ ID NO: 375627 - protein, 9 aa, Homo Sapiens
LWACDFCFQ

SEQ ID NO: 375628 - protein, 9 aa, Homo Sapiens
SLWHHCEHQ

SEQ ID NO: 375629 - protein, 9 aa, Homo Sapiens
GLSDHVVEG

SEQ ID NO: 375630 - protein, 9 aa, Homo Sapiens
KYFKHFSAL

SEQ ID NO: 375631 - protein, 9 aa, Homo Sapiens
CTDVKSVEM

SEQ ID NO: 375632 - protein, 9 aa, Homo Sapiens
VMTARDGGS

SEQ ID NO: 375633 - protein, 9 aa, Homo Sapiens
YRQVPGRDP

SEQ ID NO: 375634 - protein, 9 aa, Homo Sapiens
EKIQSIIKE

SEQ ID NO: 375635 - protein, 9 aa, Homo Sapiens
VIDPKKGHG

SEQ ID NO: 375636 - protein, 9 aa, Homo Sapiens
QHLLRATTD

SEQ ID NO: 375637 - protein, 9 aa, Homo Sapiens
HMRSKRIYY

SEQ ID NO: 375638 - protein, 9 aa, Homo Sapiens
SVEMLVEHQ

SEQ ID NO: 375639 - protein, 9 aa, Homo Sapiens
IKIHGVDAS

SEQ ID NO: 375640 - protein, 9 aa, Homo Sapiens
EENLRWGSE

SEQ ID NO: 375641 - protein, 9 aa, Homo Sapiens
GKYFKHFSA

SEQ ID NO: 375642 - protein, 9 aa, Homo Sapiens
IEVDGFSEL

SEQ ID NO: 375643 - protein, 9 aa, Homo Sapiens
SASDSSVCV

SEQ ID NO: 375644 - protein, 9 aa, Homo Sapiens
PRELLTNVW

SEQ ID NO: 375645 - protein, 9 aa, Homo Sapiens
KKKGREKER

SEQ ID NO: 375646 - protein, 9 aa, Homo Sapiens
VGKVLHKTG

SEQ ID NO: 375647 - protein, 9 aa, Homo Sapiens
DDFVQPRKE

SEQ ID NO: 375648 - protein, 9 aa, Homo Sapiens
LHKTGLLMT

SEQ ID NO: 375649 - protein, 9 aa, Homo Sapiens
SDSDPKEKE

SEQ ID NO: 375650 - protein, 9 aa, Homo Sapiens
VRSGRACVE

SEQ ID NO: 375651 - protein, 9 aa, Homo Sapiens
GCEIICPEN

SEQ ID NO: 375652 - protein, 9 aa, Homo Sapiens
MVNLAWDNE

SEQ ID NO: 375653 - protein, 9 aa, Homo Sapiens
LCWIPIFSA

SEQ ID NO: 375654 - protein, 9 aa, Homo Sapiens
SHCSQRHQK

SEQ ID NO: 375655 - protein, 9 aa, Homo Sapiens
VGQMSWKPC

SEQ ID NO: 375656 - protein, 9 aa, Homo Sapiens
GVDASISVK

SEQ ID NO: 375657 - protein, 9 aa, Homo Sapiens
IADIKIHGV

SEQ ID NO: 375658 - protein, 9 aa, Homo Sapiens
LTLRGLSRR

SEQ ID NO: 375659 - protein, 9 aa, Homo Sapiens
VLPEKLCEE

SEQ ID NO: 375660 - protein, 9 aa, Homo Sapiens
ALLCNYFLS

SEQ ID NO: 375661 - protein, 9 aa, Homo Sapiens
ECTLKEGAA

SEQ ID NO: 375662 - protein, 9 aa, Homo Sapiens
VYKYVSYGP

SEQ ID NO: 375663 - protein, 9 aa, Homo Sapiens
EKITFQYGI

SEQ ID NO: 375664 - protein, 9 aa, Homo Sapiens
TFENVDEVS

SEQ ID NO: 375665 - protein, 9 aa, Homo Sapiens
TTRESIHMY

SEQ ID NO: 375666 - protein, 9 aa, Homo Sapiens
KEKEKKKGR

SEQ ID NO: 375667 - protein, 9 aa, Homo Sapiens
YFMKQINDA

SEQ ID NO: 375668 - protein, 9 aa, Homo Sapiens
EDCSGMPSF

SEQ ID NO: 375669 - protein, 9 aa, Homo Sapiens
STSQITYTS

SEQ ID NO: 375670 - protein, 9 aa, Homo Sapiens
LSKNSLWLS

SEQ ID NO: 375671 - protein, 9 aa, Homo Sapiens
PSAAAPARS

SEQ ID NO: 375672 - protein, 9 aa, Homo Sapiens
KVRKARNRH

SEQ ID NO: 375673 - protein, 9 aa, Homo Sapiens
EHYEELKKM

SEQ ID NO: 375674 - protein, 9 aa, Homo Sapiens
YEEGPGEEN

SEQ ID NO: 375675 - protein, 9 aa, Homo Sapiens
VVVGAVGVG

SEQ ID NO: 375676 - protein, 9 aa, Homo Sapiens
KIVELAKMF

SEQ ID NO: 375677 - protein, 9 aa, Homo Sapiens
FVDPEDGTP

SEQ ID NO: 375678 - protein, 9 aa, Homo Sapiens
GWLRWGPAA

SEQ ID NO: 375679 - protein, 9 aa, Homo Sapiens
KKGHGYEEG

SEQ ID NO: 375680 - protein, 9 aa, Homo Sapiens
EIQERNGKQ

SEQ ID NO: 375681 - protein, 9 aa, Homo Sapiens
TAGQEYYDR

SEQ ID NO: 375682 - protein, 9 aa, Homo Sapiens
VQPRKERLK

SEQ ID NO: 375683 - protein, 9 aa, Homo Sapiens
MRIENSPLF

SEQ ID NO: 375684 - protein, 9 aa, Homo Sapiens
EVTEEMVNL

SEQ ID NO: 375685 - protein, 9 aa, Homo Sapiens
STRWTLPSA

SEQ ID NO: 375686 - protein, 9 aa, Homo Sapiens
LCEEKEKVK

SEQ ID NO: 375687 - protein, 9 aa, Homo Sapiens
LLETNEVKC

SEQ ID NO: 375688 - protein, 9 aa, Homo Sapiens
CRATTTRAS

SEQ ID NO: 375689 - protein, 9 aa, Homo Sapiens
SLSTSPFSS

SEQ ID NO: 375690 - protein, 9 aa, Homo Sapiens
LTNVWVQEH

SEQ ID NO: 375691 - protein, 9 aa, Homo Sapiens
SQITYTSLS

SEQ ID NO: 375692 - protein, 9 aa, Homo Sapiens
LYIFCNERE

SEQ ID NO: 375693 - protein, 9 aa, Homo Sapiens
AFRGPDRVR

SEQ ID NO: 375694 - protein, 9 aa, Homo Sapiens
GEHSGQSQA

SEQ ID NO: 375695 - protein, 9 aa, Homo Sapiens
ESDMHVLQM

SEQ ID NO: 375696 - protein, 9 aa, Homo Sapiens
GRVYLCYDM

SEQ ID NO: 375697 - protein, 9 aa, Homo Sapiens
LCFAAGELI

SEQ ID NO: 375698 - protein, 9 aa, Homo Sapiens
IKANRFEEV

SEQ ID NO: 375699 - protein, 9 aa, Homo Sapiens
ERKGARKAG

SEQ ID NO: 375700 - protein, 9 aa, Homo Sapiens
RSKRIYYNL

SEQ ID NO: 375701 - protein, 9 aa, Homo Sapiens
PRHTAVMKL

SEQ ID NO: 375702 - protein, 9 aa, Homo Sapiens
WGPAAPSSP

SEQ ID NO: 375703 - protein, 9 aa, Homo Sapiens
KPTCSRARL

SEQ ID NO: 375704 - protein, 9 aa, Homo Sapiens
APPLDNGSQ

SEQ ID NO: 375705 - protein, 9 aa, Homo Sapiens
AAATTALTG

SEQ ID NO: 375706 - protein, 9 aa, Homo Sapiens
GARKAGKTT

SEQ ID NO: 375707 - protein, 9 aa, Homo Sapiens
CVEDFYTVE

SEQ ID NO: 375708 - protein, 9 aa, Homo Sapiens
RIMEIPETV

SEQ ID NO: 375709 - protein, 9 aa, Homo Sapiens
SYGPVMEVL

SEQ ID NO: 375710 - protein, 9 aa, Homo Sapiens
MKQINDAHH

SEQ ID NO: 375711 - protein, 9 aa, Homo Sapiens
ASESSHQAW

SEQ ID NO: 375712 - protein, 9 aa, Homo Sapiens
CSGQLGIQE

SEQ ID NO: 375713 - protein, 9 aa, Homo Sapiens
VVRHCPHHE

SEQ ID NO: 375714 - protein, 9 aa, Homo Sapiens
LLSKNSLWL

SEQ ID NO: 375715 - protein, 9 aa, Homo Sapiens
HQKCTPCRF

SEQ ID NO: 375716 - protein, 9 aa, Homo Sapiens
RKLEESEDP

SEQ ID NO: 375717 - protein, 9 aa, Homo Sapiens
YLQLPSPSS

SEQ ID NO: 375718 - protein, 9 aa, Homo Sapiens
LQCANIQLC

SEQ ID NO: 375719 - protein, 9 aa, Homo Sapiens
LTSTTLNVI

SEQ ID NO: 375720 - protein, 9 aa, Homo Sapiens
HRPHPPPPK

SEQ ID NO: 375721 - protein, 9 aa, Homo Sapiens
EHLVTQLEE

SEQ ID NO: 375722 - protein, 9 aa, Homo Sapiens
PPLDNGSQP

SEQ ID NO: 375723 - protein, 9 aa, Homo Sapiens
SGIASGGCL

SEQ ID NO: 375724 - protein, 9 aa, Homo Sapiens
VPEKIQSII

SEQ ID NO: 375725 - protein, 9 aa, Homo Sapiens
SQQKLAGLL

SEQ ID NO: 375726 - protein, 9 aa, Homo Sapiens
TNEVKCKIG

SEQ ID NO: 375727 - protein, 9 aa, Homo Sapiens
PAFRGPDRV

SEQ ID NO: 375728 - protein, 9 aa, Homo Sapiens
IIFGDQVVR

SEQ ID NO: 375729 - protein, 9 aa, Homo Sapiens
NTVVGQMSW

SEQ ID NO: 375730 - protein, 9 aa, Homo Sapiens
FGDQVVRYG

SEQ ID NO: 375731 - protein, 9 aa, Homo Sapiens
CQNQSPSSH

SEQ ID NO: 375732 - protein, 9 aa, Homo Sapiens
VDPEDGTPL

SEQ ID NO: 375733 - protein, 9 aa, Homo Sapiens
QNREWCLEE

SEQ ID NO: 375734 - protein, 9 aa, Homo Sapiens
SQRHQKCTP

SEQ ID NO: 375735 - protein, 9 aa, Homo Sapiens
EEMVNLAWD

SEQ ID NO: 375736 - protein, 9 aa, Homo Sapiens
CLYISRMMH

SEQ ID NO: 375737 - protein, 9 aa, Homo Sapiens
NSSVIMRVR

SEQ ID NO: 375738 - protein, 9 aa, Homo Sapiens
VGASASDSS

SEQ ID NO: 375739 - protein, 9 aa, Homo Sapiens
LRHSQPRGT

SEQ ID NO: 375740 - protein, 9 aa, Homo Sapiens
PSSHCSQRH

SEQ ID NO: 375741 - protein, 9 aa, Homo Sapiens
QILKPAETK

SEQ ID NO: 375742 - protein, 9 aa, Homo Sapiens
TNGTFEYIC

SEQ ID NO: 375743 - protein, 9 aa, Homo Sapiens
RKGARKAGK

SEQ ID NO: 375744 - protein, 9 aa, Homo Sapiens
PSSPESTAT

SEQ ID NO: 375745 - protein, 9 aa, Homo Sapiens
PERTPESFL

SEQ ID NO: 375746 - protein, 9 aa, Homo Sapiens
LNQEVAGHT

SEQ ID NO: 375747 - protein, 9 aa, Homo Sapiens
SAGNVHILT

SEQ ID NO: 375748 - protein, 9 aa, Homo Sapiens
LEACGLGSS

SEQ ID NO: 375749 - protein, 9 aa, Homo Sapiens
TRELCRAGQ

SEQ ID NO: 375750 - protein, 9 aa, Homo Sapiens
FDEFPESDS

SEQ ID NO: 375751 - protein, 9 aa, Homo Sapiens
ADRLKFFES

SEQ ID NO: 375752 - protein, 9 aa, Homo Sapiens
KKSPSAGNV

SEQ ID NO: 375753 - protein, 9 aa, Homo Sapiens
PESDSLKPT

SEQ ID NO: 375754 - protein, 9 aa, Homo Sapiens
LTRATLGQD

SEQ ID NO: 375755 - protein, 9 aa, Homo Sapiens
EHQETYQKL

SEQ ID NO: 375756 - protein, 9 aa, Homo Sapiens
FRVAGVGSS

SEQ ID NO: 375757 - protein, 9 aa, Homo Sapiens
LWHHCEHQE

SEQ ID NO: 375758 - protein, 9 aa, Homo Sapiens
YRAKLWACD

SEQ ID NO: 375759 - protein, 9 aa, Homo Sapiens
KERLKSIEE

SEQ ID NO: 375760 - protein, 9 aa, Homo Sapiens
TYMSPKSRH

SEQ ID NO: 375761 - protein, 9 aa, Homo Sapiens
ELQQALSAV

SEQ ID NO: 375762 - protein, 9 aa, Homo Sapiens
FFIGLSDHV

SEQ ID NO: 375763 - protein, 9 aa, Homo Sapiens
LKKNIEYVA

SEQ ID NO: 375764 - protein, 9 aa, Homo Sapiens
SPSSHCSQR

SEQ ID NO: 375765 - protein, 9 aa, Homo Sapiens
HLGMMIDLS

SEQ ID NO: 375766 - protein, 9 aa, Homo Sapiens
NLRKLNLSN

SEQ ID NO: 375767 - protein, 9 aa, Homo Sapiens
LLASEHNTP

SEQ ID NO: 375768 - protein, 9 aa, Homo Sapiens
LEFAQGHPL

SEQ ID NO: 375769 - protein, 9 aa, Homo Sapiens
LSEEFKQMR

SEQ ID NO: 375770 - protein, 9 aa, Homo Sapiens
RPTPGWSRA

SEQ ID NO: 375771 - protein, 9 aa, Homo Sapiens
AQVGCEIIC

SEQ ID NO: 375772 - protein, 9 aa, Homo Sapiens
LSDHVVEGQ

SEQ ID NO: 375773 - protein, 9 aa, Homo Sapiens
QPSVCMPVS

SEQ ID NO: 375774 - protein, 9 aa, Homo Sapiens
TIILIGVQC

SEQ ID NO: 375775 - protein, 9 aa, Homo Sapiens
RQVPGRDPA

SEQ ID NO: 375776 - protein, 9 aa, Homo Sapiens
HTRRGRVRQ

SEQ ID NO: 375777 - protein, 9 aa, Homo Sapiens
NRHQEWNMM

SEQ ID NO: 375778 - protein, 9 aa, Homo Sapiens
HGASHCLSL

SEQ ID NO: 375779 - protein, 9 aa, Homo Sapiens
KFIHIKANR

SEQ ID NO: 375780 - protein, 9 aa, Homo Sapiens
AGQEYYDRL

SEQ ID NO: 375781 - protein, 9 aa, Homo Sapiens
GTQHEAFHA

SEQ ID NO: 375782 - protein, 9 aa, Homo Sapiens
FEEWRDELS

SEQ ID NO: 375783 - protein, 9 aa, Homo Sapiens
KERQKIVEL

SEQ ID NO: 375784 - protein, 9 aa, Homo Sapiens
GGLGSGMEN

SEQ ID NO: 375785 - protein, 9 aa, Homo Sapiens
PPRGDHRSN

SEQ ID NO: 375786 - protein, 9 aa, Homo Sapiens
VCMPVSCRP

SEQ ID NO: 375787 - protein, 9 aa, Homo Sapiens
DDELWTNID

SEQ ID NO: 375788 - protein, 9 aa, Homo Sapiens
LADLRHSQP

SEQ ID NO: 375789 - protein, 9 aa, Homo Sapiens
TLPSAAAPA

SEQ ID NO: 375790 - protein, 9 aa, Homo Sapiens
FAGELQQAL

SEQ ID NO: 375791 - protein, 9 aa, Homo Sapiens
TLDGAGTQP

SEQ ID NO: 375792 - protein, 9 aa, Homo Sapiens
AALLLPPPG

SEQ ID NO: 375793 - protein, 9 aa, Homo Sapiens
RRRLEACGL

SEQ ID NO: 375794 - protein, 9 aa, Homo Sapiens
PCQNQSPSS

SEQ ID NO: 375795 - protein, 9 aa, Homo Sapiens
QITYTSLSL

SEQ ID NO: 375796 - protein, 9 aa, Homo Sapiens
VAQASLAHW

SEQ ID NO: 375797 - protein, 9 aa, Homo Sapiens
QPFPAVPQP

SEQ ID NO: 375798 - protein, 9 aa, Homo Sapiens
VDHVNLTTT

SEQ ID NO: 375799 - protein, 9 aa, Homo Sapiens
HCPHHERCS

SEQ ID NO: 375800 - protein, 9 aa, Homo Sapiens
ILLLLLAGG

SEQ ID NO: 375801 - protein, 9 aa, Homo Sapiens
GKMCIHCLE

SEQ ID NO: 375802 - protein, 9 aa, Homo Sapiens
EKLCEEKEK

SEQ ID NO: 375803 - protein, 9 aa, Homo Sapiens
LHDIHSTHS

SEQ ID NO: 375804 - protein, 9 aa, Homo Sapiens
GCINLSEAG

SEQ ID NO: 375805 - protein, 9 aa, Homo Sapiens
QASLRSLST

SEQ ID NO: 375806 - protein, 9 aa, Homo Sapiens
MTEVVRHCP

SEQ ID NO: 375807 - protein, 9 aa, Homo Sapiens
QFYLWKCLA

SEQ ID NO: 375808 - protein, 9 aa, Homo Sapiens
NLLETNEVK

SEQ ID NO: 375809 - protein, 9 aa, Homo Sapiens
KERKGARKA

SEQ ID NO: 375810 - protein, 9 aa, Homo Sapiens
CLAQSALQI

SEQ ID NO: 375811 - protein, 9 aa, Homo Sapiens
NNHQPMDPE

SEQ ID NO: 375812 - protein, 9 aa, Homo Sapiens
KKENPNQMA

SEQ ID NO: 375813 - protein, 9 aa, Homo Sapiens
LPEKLCEEK

SEQ ID NO: 375814 - protein, 9 aa, Homo Sapiens
SVPSTPPRG

SEQ ID NO: 375815 - protein, 9 aa, Homo Sapiens
LHTRRGRVR

SEQ ID NO: 375816 - protein, 9 aa, Homo Sapiens
APSSPESTA

SEQ ID NO: 375817 - protein, 9 aa, Homo Sapiens
GVQCRSSSG

SEQ ID NO: 375818 - protein, 9 aa, Homo Sapiens
FWIWVSMTL

SEQ ID NO: 375819 - protein, 9 aa, Homo Sapiens
CLTLRGLSR

SEQ ID NO: 375820 - protein, 9 aa, Homo Sapiens
HYDSSNQVK

SEQ ID NO: 375821 - protein, 9 aa, Homo Sapiens
KLNLSNNKI

SEQ ID NO: 375822 - protein, 9 aa, Homo Sapiens
GTFEYICHK

SEQ ID NO: 375823 - protein, 9 aa, Homo Sapiens
TVCLTLRGL

SEQ ID NO: 375824 - protein, 9 aa, Homo Sapiens
QHQDDEPVN

SEQ ID NO: 375825 - protein, 9 aa, Homo Sapiens
EEGSGQRSE

SEQ ID NO: 375826 - protein, 9 aa, Homo Sapiens
PSTPPRGDH

SEQ ID NO: 375827 - protein, 9 aa, Homo Sapiens
SRQRVHYDS

SEQ ID NO: 375828 - protein, 9 aa, Homo Sapiens
GILPPSTLD

SEQ ID NO: 375829 - protein, 9 aa, Homo Sapiens
RVRSGRACV

SEQ ID NO: 375830 - protein, 9 aa, Homo Sapiens
SYPFSSPVS

SEQ ID NO: 375831 - protein, 9 aa, Homo Sapiens
MSWKPCGPN

SEQ ID NO: 375832 - protein, 9 aa, Homo Sapiens
RLKFFESLR

SEQ ID NO: 375833 - protein, 9 aa, Homo Sapiens
PAAPSSPES

SEQ ID NO: 375834 - protein, 9 aa, Homo Sapiens
RQFYLWKCL

SEQ ID NO: 375835 - protein, 9 aa, Homo Sapiens
TKKPNATRP

SEQ ID NO: 375836 - protein, 9 aa, Homo Sapiens
CTNAPNGGF

SEQ ID NO: 375837 - protein, 9 aa, Homo Sapiens
LHRWDPCMP

SEQ ID NO: 375838 - protein, 9 aa, Homo Sapiens
TALTGLEAH

SEQ ID NO: 375839 - protein, 9 aa, Homo Sapiens
LTDNPCQNQ

SEQ ID NO: 375840 - protein, 9 aa, Homo Sapiens
EYVASVLEA

SEQ ID NO: 375841 - protein, 9 aa, Homo Sapiens
GNEYDLTSL

SEQ ID NO: 375842 - protein, 9 aa, Homo Sapiens
NPCQNQSPS

SEQ ID NO: 375843 - protein, 9 aa, Homo Sapiens
NVWVQEHYL

SEQ ID NO: 375844 - protein, 9 aa, Homo Sapiens
YHICLAQSA

SEQ ID NO: 375845 - protein, 9 aa, Homo Sapiens
QILTRATLG

SEQ ID NO: 375846 - protein, 9 aa, Homo Sapiens
PRRRHSTES

SEQ ID NO: 375847 - protein, 9 aa, Homo Sapiens
QMYLLSKNS

SEQ ID NO: 375848 - protein, 9 aa, Homo Sapiens
GPSLEDSIG

SEQ ID NO: 375849 - protein, 9 aa, Homo Sapiens
QHLTDNPCQ

SEQ ID NO: 375850 - protein, 9 aa, Homo Sapiens
TCRATTTRA

SEQ ID NO: 375851 - protein, 9 aa, Homo Sapiens
VGVGKSALT

SEQ ID NO: 375852 - protein, 9 aa, Homo Sapiens
HAKKITSAI

SEQ ID NO: 375853 - protein, 9 aa, Homo Sapiens
HPDIEVDGF

SEQ ID NO: 375854 - protein, 9 aa, Homo Sapiens
ICPENSHYE

SEQ ID NO: 375855 - protein, 9 aa, Homo Sapiens
ADIKIHGVD

SEQ ID NO: 375856 - protein, 9 aa, Homo Sapiens
RLAAKGWRI

SEQ ID NO: 375857 - protein, 9 aa, Homo Sapiens
TSYPFSSPV

SEQ ID NO: 375858 - protein, 9 aa, Homo Sapiens
DTKFIHIKA

SEQ ID NO: 375859 - protein, 9 aa, Homo Sapiens
KCSGQLGIQ

SEQ ID NO: 375860 - protein, 9 aa, Homo Sapiens
YLCYDMDTG

SEQ ID NO: 375861 - protein, 9 aa, Homo Sapiens
CSQRHQKCT

SEQ ID NO: 375862 - protein, 9 aa, Homo Sapiens
KVNAPILTS

SEQ ID NO: 375863 - protein, 9 aa, Homo Sapiens
RVAQASLAH

SEQ ID NO: 375864 - protein, 9 aa, Homo Sapiens
VAECTLKEG

SEQ ID NO: 375865 - protein, 9 aa, Homo Sapiens
NRGLKKKKQ

SEQ ID NO: 375866 - protein, 9 aa, Homo Sapiens
PPPKPTCSR

SEQ ID NO: 375867 - protein, 9 aa, Homo Sapiens
TVAPRPTPG

SEQ ID NO: 375868 - protein, 9 aa, Homo Sapiens
LINLLETNE

SEQ ID NO: 375869 - protein, 9 aa, Homo Sapiens
DNGSQPSQG

SEQ ID NO: 375870 - protein, 9 aa, Homo Sapiens
GGGVVVAWR

SEQ ID NO: 375871 - protein, 9 aa, Homo Sapiens
IMEIPETVS

SEQ ID NO: 375872 - protein, 9 aa, Homo Sapiens
LRGLSRRQM

SEQ ID NO: 375873 - protein, 9 aa, Homo Sapiens
DNPCQNQSP

SEQ ID NO: 375874 - protein, 9 aa, Homo Sapiens
ILGQFRVAG

SEQ ID NO: 375875 - protein, 9 aa, Homo Sapiens
STHSKERLN

SEQ ID NO: 375876 - protein, 9 aa, Homo Sapiens
PSTLDGAGT

SEQ ID NO: 375877 - protein, 9 aa, Homo Sapiens
ANWSTQASL

SEQ ID NO: 375878 - protein, 9 aa, Homo Sapiens
EDSIGLFLS

SEQ ID NO: 375879 - protein, 9 aa, Homo Sapiens
VLFFLCWIP

SEQ ID NO: 375880 - protein, 9 aa, Homo Sapiens
DPKEKEVNF

SEQ ID NO: 375881 - protein, 9 aa, Homo Sapiens
PLDNGSQPS

SEQ ID NO: 375882 - protein, 9 aa, Homo Sapiens
MAVIKPFPK

SEQ ID NO: 375883 - protein, 9 aa, Homo Sapiens
TYTSLSLPH

SEQ ID NO: 375884 - protein, 9 aa, Homo Sapiens
AHWRSCGQQ

SEQ ID NO: 375885 - protein, 9 aa, Homo Sapiens
ILDTHRKLE

SEQ ID NO: 375886 - protein, 9 aa, Homo Sapiens
QVGCEIICP

SEQ ID NO: 375887 - protein, 9 aa, Homo Sapiens
HVLQMAISF

SEQ ID NO: 375888 - protein, 9 aa, Homo Sapiens
CDFCFQRNQ

SEQ ID NO: 375889 - protein, 9 aa, Homo Sapiens
HSKERLNAY

SEQ ID NO: 375890 - protein, 9 aa, Homo Sapiens
ESTATAGWT

SEQ ID NO: 375891 - protein, 9 aa, Homo Sapiens
YHGYPYIDL

SEQ ID NO: 375892 - protein, 9 aa, Homo Sapiens
CWIPIFSAN

SEQ ID NO: 375893 - protein, 9 aa, Homo Sapiens
QKLAGLLMV

SEQ ID NO: 375894 - protein, 9 aa, Homo Sapiens
QKIVELAKM

SEQ ID NO: 375895 - protein, 9 aa, Homo Sapiens
CGKYFKHFS

SEQ ID NO: 375896 - protein, 9 aa, Homo Sapiens
EHSGQSQAH

SEQ ID NO: 375897 - protein, 9 aa, Homo Sapiens
IHIKANRFE

SEQ ID NO: 375898 - protein, 9 aa, Homo Sapiens
VYLCYDMDT

SEQ ID NO: 375899 - protein, 9 aa, Homo Sapiens
ALEYFMKQI

SEQ ID NO: 375900 - protein, 9 aa, Homo Sapiens
PVYKYVSYG

SEQ ID NO: 375901 - protein, 9 aa, Homo Sapiens
NAPILTSTT

SEQ ID NO: 375902 - protein, 9 aa, Homo Sapiens
ASHRFLHNR

SEQ ID NO: 375903 - protein, 9 aa, Homo Sapiens
LPNLRKLNL

SEQ ID NO: 375904 - protein, 9 aa, Homo Sapiens
SHQAWTGSS

SEQ ID NO: 375905 - protein, 9 aa, Homo Sapiens
NLSEAGISC

SEQ ID NO: 375906 - protein, 9 aa, Homo Sapiens
TAISMYLQL

SEQ ID NO: 375907 - protein, 9 aa, Homo Sapiens
HVVEGQWQW

SEQ ID NO: 375908 - protein, 9 aa, Homo Sapiens
VVGQMSWKP

SEQ ID NO: 375909 - protein, 9 aa, Homo Sapiens
RATLGQDPP

SEQ ID NO: 375910 - protein, 9 aa, Homo Sapiens
EYICHKVLY

SEQ ID NO: 375911 - protein, 9 aa, Homo Sapiens
GRVIDPKKG

SEQ ID NO: 375912 - protein, 9 aa, Homo Sapiens
LLLAGGGVV

SEQ ID NO: 375913 - protein, 9 aa, Homo Sapiens
KHQKHCQPA

SEQ ID NO: 375914 - protein, 9 aa, Homo Sapiens
AGWTCRATT

SEQ ID NO: 375915 - protein, 9 aa, Homo Sapiens
RGLKKKKQY

SEQ ID NO: 375916 - protein, 9 aa, Homo Sapiens
QINDEMKCS

SEQ ID NO: 375917 - protein, 9 aa, Homo Sapiens
TPPRGDHRS

SEQ ID NO: 375918 - protein, 9 aa, Homo Sapiens
HQKHCQPAP

SEQ ID NO: 375919 - protein, 9 aa, Homo Sapiens
SSLRSSSWA

SEQ ID NO: 375920 - protein, 9 aa, Homo Sapiens
AISMYLQLP

SEQ ID NO: 375921 - protein, 9 aa, Homo Sapiens
PCRFLKTTQ

SEQ ID NO: 375922 - protein, 9 aa, Homo Sapiens
RVHYDSSNQ

SEQ ID NO: 375923 - protein, 9 aa, Homo Sapiens
PGCINLSEA

SEQ ID NO: 375924 - protein, 9 aa, Homo Sapiens
TQPTQQFYQ

SEQ ID NO: 375925 - protein, 9 aa, Homo Sapiens
FTEVPEVRE

SEQ ID NO: 375926 - protein, 9 aa, Homo Sapiens
SHRFLHNRE

SEQ ID NO: 375927 - protein, 9 aa, Homo Sapiens
RASGPLHTR

SEQ ID NO: 375928 - protein, 9 aa, Homo Sapiens
IFCNEREEE

SEQ ID NO: 375929 - protein, 9 aa, Homo Sapiens
LEDSIGLFL

SEQ ID NO: 375930 - protein, 9 aa, Homo Sapiens
HLTDNPCQN

SEQ ID NO: 375931 - protein, 9 aa, Homo Sapiens
SVIMRVRLS

SEQ ID NO: 375932 - protein, 9 aa, Homo Sapiens
LLTNVWVQE

SEQ ID NO: 375933 - protein, 9 aa, Homo Sapiens
SPKSRHPEE

SEQ ID NO: 375934 - protein, 9 aa, Homo Sapiens
THRKLEESE

SEQ ID NO: 375935 - protein, 9 aa, Homo Sapiens
LVVVGAVGV

SEQ ID NO: 375936 - protein, 9 aa, Homo Sapiens
QSQAHRPHP

SEQ ID NO: 375937 - protein, 9 aa, Homo Sapiens
DRLKFFESL

SEQ ID NO: 375938 - protein, 9 aa, Homo Sapiens
QRLAAKGWR

SEQ ID NO: 375939 - protein, 9 aa, Homo Sapiens
DISSGAKKV

SEQ ID NO: 375940 - protein, 9 aa, Homo Sapiens
LKPAETKKP

SEQ ID NO: 375941 - protein, 9 aa, Homo Sapiens
HRKLEESED

SEQ ID NO: 375942 - protein, 9 aa, Homo Sapiens
EGSGQRSEE

SEQ ID NO: 375943 - protein, 9 aa, Homo Sapiens
LTGLEAHTH

SEQ ID NO: 375944 - protein, 9 aa, Homo Sapiens
SESSHQAWT

SEQ ID NO: 375945 - protein, 9 aa, Homo Sapiens
KSRQRVHYD

SEQ ID NO: 375946 - protein, 9 aa, Homo Sapiens
GAALLLPPP

SEQ ID NO: 375947 - protein, 9 aa, Homo Sapiens
QSIIKEGIE

SEQ ID NO: 375948 - protein, 9 aa, Homo Sapiens
KKLPNLRKL

SEQ ID NO: 375949 - protein, 9 aa, Homo Sapiens
LCVFWLMCM

SEQ ID NO: 375950 - protein, 9 aa, Homo Sapiens
EFAQGHPLG

SEQ ID NO: 375951 - protein, 9 aa, Homo Sapiens
VSYGPVMEV

SEQ ID NO: 375952 - protein, 9 aa, Homo Sapiens
EAGISCRST

SEQ ID NO: 375953 - protein, 9 aa, Homo Sapiens
QQALSAVST

SEQ ID NO: 375954 - protein, 9 aa, Homo Sapiens
IASGGCLYI

SEQ ID NO: 375955 - protein, 9 aa, Homo Sapiens
EAPLRTWKP

SEQ ID NO: 375956 - protein, 9 aa, Homo Sapiens
TATSWVRTG

SEQ ID NO: 375957 - protein, 9 aa, Homo Sapiens
GEENLRWGS

SEQ ID NO: 375958 - protein, 9 aa, Homo Sapiens
WACDFCFQR

SEQ ID NO: 375959 - protein, 9 aa, Homo Sapiens
IYYNLPEVK

SEQ ID NO: 375960 - protein, 9 aa, Homo Sapiens
LTTTWQRPT

SEQ ID NO: 375961 - protein, 9 aa, Homo Sapiens
MHVLQMAIS

SEQ ID NO: 375962 - protein, 9 aa, Homo Sapiens
GQEYYDRLR

SEQ ID NO: 375963 - protein, 9 aa, Homo Sapiens
VKLSEGGLG

SEQ ID NO: 375964 - protein, 9 aa, Homo Sapiens
THSKERLNA

SEQ ID NO: 375965 - protein, 9 aa, Homo Sapiens
LENVEHYEE

SEQ ID NO: 375966 - protein, 9 aa, Homo Sapiens
YYDRLRPLS

SEQ ID NO: 375967 - protein, 9 aa, Homo Sapiens
SSAPSSLRS

SEQ ID NO: 375968 - protein, 9 aa, Homo Sapiens
EGILPPSTL

SEQ ID NO: 375969 - protein, 9 aa, Homo Sapiens
PQDTKFIHI

SEQ ID NO: 375970 - protein, 9 aa, Homo Sapiens
NVQHLTDNP

SEQ ID NO: 375971 - protein, 9 aa, Homo Sapiens
HGYEEGPGE

SEQ ID NO: 375972 - protein, 9 aa, Homo Sapiens
SLKPTVATS

SEQ ID NO: 375973 - protein, 9 aa, Homo Sapiens
NGGTCTNAP

SEQ ID NO: 375974 - protein, 9 aa, Homo Sapiens
KGHGYEEGP

SEQ ID NO: 375975 - protein, 9 aa, Homo Sapiens
FRQFYLWKC

SEQ ID NO: 375976 - protein, 9 aa, Homo Sapiens
VDASISVKP

SEQ ID NO: 375977 - protein, 9 aa, Homo Sapiens
PRLLAHLCR

SEQ ID NO: 375978 - protein, 9 aa, Homo Sapiens
SEAGISCRS

SEQ ID NO: 375979 - protein, 9 aa, Homo Sapiens
SPAIDYHIC

SEQ ID NO: 375980 - protein, 9 aa, Homo Sapiens
AETKKPNAT

SEQ ID NO: 375981 - protein, 9 aa, Homo Sapiens
PEGAALLLP

SEQ ID NO: 375982 - protein, 9 aa, Homo Sapiens
VEELNHLGM

SEQ ID NO: 375983 - protein, 9 aa, Homo Sapiens
GHGYEEGPG

SEQ ID NO: 375984 - protein, 9 aa, Homo Sapiens
ICLAQSALQ

SEQ ID NO: 375985 - protein, 9 aa, Homo Sapiens
ACQILTRAT

SEQ ID NO: 375986 - protein, 9 aa, Homo Sapiens
PQAFLLLLL

SEQ ID NO: 375987 - protein, 9 aa, Homo Sapiens
KLSEGGLGS

SEQ ID NO: 375988 - protein, 9 aa, Homo Sapiens
YMSPKSRHP

SEQ ID NO: 375989 - protein, 9 aa, Homo Sapiens
VCLTLRGLS

SEQ ID NO: 375990 - protein, 9 aa, Homo Sapiens
LKEGAAINQ

SEQ ID NO: 375991 - protein, 9 aa, Homo Sapiens
GPGEENLRW

SEQ ID NO: 375992 - protein, 9 aa, Homo Sapiens
LILGQFRVA

SEQ ID NO: 375993 - protein, 9 aa, Homo Sapiens
EELKKMVQQ

SEQ ID NO: 375994 - protein, 9 aa, Homo Sapiens
VVTEVTEEM

SEQ ID NO: 375995 - protein, 9 aa, Homo Sapiens
EKEKKKGRE

SEQ ID NO: 375996 - protein, 9 aa, Homo Sapiens
EWRDELSER

SEQ ID NO: 375997 - protein, 9 aa, Homo Sapiens
DIEVDGFSE

SEQ ID NO: 375998 - protein, 9 aa, Homo Sapiens
EETTDDELW

SEQ ID NO: 375999 - protein, 9 aa, Homo Sapiens
IILIGVQCR

SEQ ID NO: 376000 - protein, 9 aa, Homo Sapiens
VLCSRGTRT

SEQ ID NO: 376001 - protein, 9 aa, Homo Sapiens
GPLHTRRGR

SEQ ID NO: 376002 - protein, 9 aa, Homo Sapiens
KQINDAHHG

SEQ ID NO: 376003 - protein, 9 aa, Homo Sapiens
GREKERKGA

SEQ ID NO: 376004 - protein, 9 aa, Homo Sapiens
ASLRSLSTS

SEQ ID NO: 376005 - protein, 9 aa, Homo Sapiens
TTRASSAQR

SEQ ID NO: 376006 - protein, 9 aa, Homo Sapiens
NWSTQASLR

SEQ ID NO: 376007 - protein, 9 aa, Homo Sapiens
ELWTNIDTM

SEQ ID NO: 376008 - protein, 9 aa, Homo Sapiens
ELVMTARDG

SEQ ID NO: 376009 - protein, 9 aa, Homo Sapiens
PAETKKPNA

SEQ ID NO: 376010 - protein, 9 aa, Homo Sapiens
DMDRIMMLG

SEQ ID NO: 376011 - protein, 9 aa, Homo Sapiens
GDKDFQTGL

SEQ ID NO: 376012 - protein, 9 aa, Homo Sapiens
GGVVVAWRP

SEQ ID NO: 376013 - protein, 9 aa, Homo Sapiens
SDLEVSFNS

SEQ ID NO: 376014 - protein, 9 aa, Homo Sapiens
WVRTGERGA

SEQ ID NO: 376015 - protein, 9 aa, Homo Sapiens
TTDEDLRTA

SEQ ID NO: 376016 - protein, 9 aa, Homo Sapiens
TVVGQMSWK

SEQ ID NO: 376017 - protein, 9 aa, Homo Sapiens
SDSSVCVLD

SEQ ID NO: 376018 - protein, 9 aa, Homo Sapiens
SKYHGYPYI

SEQ ID NO: 376019 - protein, 9 aa, Homo Sapiens
PLPQAFLLL

SEQ ID NO: 376020 - protein, 9 aa, Homo Sapiens
SAKHQKHCQ

SEQ ID NO: 376021 - protein, 9 aa, Homo Sapiens
PEKLCEEKE

SEQ ID NO: 376022 - protein, 9 aa, Homo Sapiens
VEMLVEHQA

SEQ ID NO: 376023 - protein, 9 aa, Homo Sapiens
HPPPPKPTC

SEQ ID NO: 376024 - protein, 9 aa, Homo Sapiens
RHCPHHERC

SEQ ID NO: 376025 - protein, 9 aa, Homo Sapiens
NRDTAQQSQ

SEQ ID NO: 376026 - protein, 9 aa, Homo Sapiens
SKRIYYNLP

SEQ ID NO: 376027 - protein, 9 aa, Homo Sapiens
AATTALTGL

SEQ ID NO: 376028 - protein, 9 aa, Homo Sapiens
ETKKPNATR

SEQ ID NO: 376029 - protein, 9 aa, Homo Sapiens
PEVREQLSG

SEQ ID NO: 376030 - protein, 9 aa, Homo Sapiens
RESARPQLE

SEQ ID NO: 376031 - protein, 9 aa, Homo Sapiens
DPEGAALLL

SEQ ID NO: 376032 - protein, 9 aa, Homo Sapiens
NQMAVIKPF

SEQ ID NO: 376033 - protein, 9 aa, Homo Sapiens
MRRIMEIPE

SEQ ID NO: 376034 - protein, 9 aa, Homo Sapiens
PARSATVAP

SEQ ID NO: 376035 - protein, 9 aa, Homo Sapiens
TTAANWSTQ

SEQ ID NO: 376036 - protein, 9 aa, Homo Sapiens
QLPSPSSKD

SEQ ID NO: 376037 - protein, 9 aa, Homo Sapiens
GQPRRSTQP

SEQ ID NO: 376038 - protein, 9 aa, Homo Sapiens
GSAIVTYMS

SEQ ID NO: 376039 - protein, 9 aa, Homo Sapiens
MCIHCLENV

SEQ ID NO: 376040 - protein, 9 aa, Homo Sapiens
EEGPGEENL

SEQ ID NO: 376041 - protein, 9 aa, Homo Sapiens
GTPLSTITR

SEQ ID NO: 376042 - protein, 9 aa, Homo Sapiens
DMHVLQMAI

SEQ ID NO: 376043 - protein, 9 aa, Homo Sapiens
YIEHLVTQL

SEQ ID NO: 376044 - protein, 9 aa, Homo Sapiens
GTRTKWQAL

SEQ ID NO: 376045 - protein, 9 aa, Homo Sapiens
QKCTPCRFL

SEQ ID NO: 376046 - protein, 9 aa, Homo Sapiens
EACGLGSSC

SEQ ID NO: 376047 - protein, 9 aa, Homo Sapiens
RRSTQPTQQ

SEQ ID NO: 376048 - protein, 9 aa, Homo Sapiens
WRDELSERL

SEQ ID NO: 376049 - protein, 9 aa, Homo Sapiens
RVIDPKKGH

SEQ ID NO: 376050 - protein, 9 aa, Homo Sapiens
TNVQHLTDN

SEQ ID NO: 376051 - protein, 9 aa, Homo Sapiens
IGLFLSAFL

SEQ ID NO: 376052 - protein, 9 aa, Homo Sapiens
SGQRSEEIP

SEQ ID NO: 376053 - protein, 9 aa, Homo Sapiens
QQKLAGLLM

SEQ ID NO: 376054 - protein, 9 aa, Homo Sapiens
LWDTAGQEY

SEQ ID NO: 376055 - protein, 9 aa, Homo Sapiens
IQLCSDEEC

SEQ ID NO: 376056 - protein, 9 aa, Homo Sapiens
LLAGGGVVV

SEQ ID NO: 376057 - protein, 9 aa, Homo Sapiens
TKGKMCIHC

SEQ ID NO: 376058 - protein, 9 aa, Homo Sapiens
GPDRVRAAV

SEQ ID NO: 376059 - protein, 9 aa, Homo Sapiens
EVREQLSGL

SEQ ID NO: 376060 - protein, 9 aa, Homo Sapiens
PPKPTCSRA

SEQ ID NO: 376061 - protein, 9 aa, Homo Sapiens
CHKVLYVFL

SEQ ID NO: 376062 - protein, 9 aa, Homo Sapiens
LSSAKHQKH

SEQ ID NO: 376063 - protein, 9 aa, Homo Sapiens
AKYRAHEGT

SEQ ID NO: 376064 - protein, 9 aa, Homo Sapiens
HRSNQNREW

SEQ ID NO: 376065 - protein, 9 aa, Homo Sapiens
AAPSSPEST

SEQ ID NO: 376066 - protein, 9 aa, Homo Sapiens
EVSFNSGER

SEQ ID NO: 376067 - protein, 9 aa, Homo Sapiens
YPGLLGLQR

SEQ ID NO: 376068 - protein, 9 aa, Homo Sapiens
GHSIRHPDI

SEQ ID NO: 376069 - protein, 9 aa, Homo Sapiens
HSGQSQAHR

SEQ ID NO: 376070 - protein, 9 aa, Homo Sapiens
ESARPQLEF

SEQ ID NO: 376071 - protein, 9 aa, Homo Sapiens
IDYHICLAQ

SEQ ID NO: 376072 - protein, 9 aa, Homo Sapiens
GHPLGPHGL

SEQ ID NO: 376073 - protein, 9 aa, Homo Sapiens
AGNEYDLTS

SEQ ID NO: 376074 - protein, 9 aa, Homo Sapiens
LGSGMENGR

SEQ ID NO: 376075 - protein, 9 aa, Homo Sapiens
RLEACGLGS

SEQ ID NO: 376076 - protein, 9 aa, Homo Sapiens
GLGSGMENG

SEQ ID NO: 376077 - protein, 9 aa, Homo Sapiens
LLLGTQHEA

SEQ ID NO: 376078 - protein, 9 aa, Homo Sapiens
SGQSQAHRP

SEQ ID NO: 376079 - protein, 9 aa, Homo Sapiens
CNEREEEKE

SEQ ID NO: 376080 - protein, 9 aa, Homo Sapiens
RAQVGCEII

SEQ ID NO: 376081 - protein, 9 aa, Homo Sapiens
CTPCRFLKT

SEQ ID NO: 376082 - protein, 9 aa, Homo Sapiens
DVKSVEMLV

SEQ ID NO: 376083 - protein, 9 aa, Homo Sapiens
QGLCFAAGE

SEQ ID NO: 376084 - protein, 9 aa, Homo Sapiens
REKERKGAR

SEQ ID NO: 376085 - protein, 9 aa, Homo Sapiens
MYLLSKNSL

SEQ ID NO: 376086 - protein, 9 aa, Homo Sapiens
VLRYPGLLG

SEQ ID NO: 376087 - protein, 9 aa, Homo Sapiens
QINDAHHGG

SEQ ID NO: 376088 - protein, 9 aa, Homo Sapiens
RASSAQRTS

SEQ ID NO: 376089 - protein, 9 aa, Homo Sapiens
ALLEFAQGH

SEQ ID NO: 376090 - protein, 9 aa, Homo Sapiens
AKGWRIPLS

SEQ ID NO: 376091 - protein, 9 aa, Homo Sapiens
SGGCLYISR

SEQ ID NO: 376092 - protein, 9 aa, Homo Sapiens
GAAINQILG

SEQ ID NO: 376093 - protein, 9 aa, Homo Sapiens
ETTDDELWT

SEQ ID NO: 376094 - protein, 9 aa, Homo Sapiens
MNKSRQRVH

SEQ ID NO: 376095 - protein, 9 aa, Homo Sapiens
DSIGLFLSA

SEQ ID NO: 376096 - protein, 9 aa, Homo Sapiens
ESFLLASEH

SEQ ID NO: 376097 - protein, 9 aa, Homo Sapiens
MDRIMMLGH

SEQ ID NO: 376098 - protein, 9 aa, Homo Sapiens
DRIMMLGHK

SEQ ID NO: 376099 - protein, 9 aa, Homo Sapiens
STATAGWTC

SEQ ID NO: 376100 - protein, 9 aa, Homo Sapiens
TRPRRRHST

SEQ ID NO: 376101 - protein, 9 aa, Homo Sapiens
LLEFAQGHP

SEQ ID NO: 376102 - protein, 9 aa, Homo Sapiens
IHVGKVLHK

SEQ ID NO: 376103 - protein, 9 aa, Homo Sapiens
GEEGSGQRS

SEQ ID NO: 376104 - protein, 9 aa, Homo Sapiens
RRIMEIPET

SEQ ID NO: 376105 - protein, 9 aa, Homo Sapiens
NEYDLTSLS

SEQ ID NO: 376106 - protein, 9 aa, Homo Sapiens
YICHKVLYV

SEQ ID NO: 376107 - protein, 9 aa, Homo Sapiens
DPKKGHGYE

SEQ ID NO: 376108 - protein, 9 aa, Homo Sapiens
MYLQLPSPS

SEQ ID NO: 376109 - protein, 9 aa, Homo Sapiens
REALGWPRH

SEQ ID NO: 376110 - protein, 9 aa, Homo Sapiens
HQAWTGSSQ

SEQ ID NO: 376111 - protein, 9 aa, Homo Sapiens
PPPPKPTCS

SEQ ID NO: 376112 - protein, 9 aa, Homo Sapiens
EEEHAALLC

SEQ ID NO: 376113 - protein, 9 aa, Homo Sapiens
PPAPPLDNG

SEQ ID NO: 376114 - protein, 9 aa, Homo Sapiens
EFPESDSLK

SEQ ID NO: 376115 - protein, 9 aa, Homo Sapiens
PPSPVGGDS

SEQ ID NO: 376116 - protein, 9 aa, Homo Sapiens
VDSDSDPKE

SEQ ID NO: 376117 - protein, 9 aa, Homo Sapiens
QDTKFIHIK

SEQ ID NO: 376118 - protein, 9 aa, Homo Sapiens
LAHWRSCGQ

SEQ ID NO: 376119 - protein, 9 aa, Homo Sapiens
SAPSSLRSS

SEQ ID NO: 376120 - protein, 9 aa, Homo Sapiens
RQRVHYDSS

SEQ ID NO: 376121 - protein, 9 aa, Homo Sapiens
STQPTQQFY

SEQ ID NO: 376122 - protein, 9 aa, Homo Sapiens
KYVSYGPVM

SEQ ID NO: 376123 - protein, 9 aa, Homo Sapiens
IMMLGHKNR

SEQ ID NO: 376124 - protein, 9 aa, Homo Sapiens
GCLYISRMM

SEQ ID NO: 376125 - protein, 9 aa, Homo Sapiens
RSIMRRIME

SEQ ID NO: 376126 - protein, 9 aa, Homo Sapiens
VRKARNRHQ

SEQ ID NO: 376127 - protein, 9 aa, Homo Sapiens
QITVPEKIQ

SEQ ID NO: 376128 - protein, 9 aa, Homo Sapiens
NSLWLSDGS

SEQ ID NO: 376129 - protein, 9 aa, Homo Sapiens
DIKIHGVDA

SEQ ID NO: 376130 - protein, 9 aa, Homo Sapiens
EHAALLCNY

SEQ ID NO: 376131 - protein, 9 aa, Homo Sapiens
INDAHHGGW

SEQ ID NO: 376132 - protein, 9 aa, Homo Sapiens
DTAGQEYYD

SEQ ID NO: 376133 - protein, 9 aa, Homo Sapiens
VVGAVGVGK

SEQ ID NO: 376134 - protein, 9 aa, Homo Sapiens
RHQKCTPCR

SEQ ID NO: 376135 - protein, 9 aa, Homo Sapiens
QRHQKCTPC

SEQ ID NO: 376136 - protein, 9 aa, Homo Sapiens
RKERLKSIE

SEQ ID NO: 376137 - protein, 9 aa, Homo Sapiens
LKFFESLRL

SEQ ID NO: 376138 - protein, 9 aa, Homo Sapiens
RATTTRASS

SEQ ID NO: 376139 - protein, 9 aa, Homo Sapiens
NAWLLYELQ

SEQ ID NO: 376140 - protein, 9 aa, Homo Sapiens
HLLRATTDE

SEQ ID NO: 376141 - protein, 9 aa, Homo Sapiens
WDTAGQEYY

SEQ ID NO: 376142 - protein, 9 aa, Homo Sapiens
PLLHGASHC

SEQ ID NO: 376143 - protein, 9 aa, Homo Sapiens
QSPSSHCSQ

SEQ ID NO: 376144 - protein, 9 aa, Homo Sapiens
EVVRHCPHH

SEQ ID NO: 376145 - protein, 9 aa, Homo Sapiens
RTPESFLLA

SEQ ID NO: 376146 - protein, 9 aa, Homo Sapiens
KKITSAIVQ

SEQ ID NO: 376147 - protein, 9 aa, Homo Sapiens
IKKGNVTTR

SEQ ID NO: 376148 - protein, 9 aa, Homo Sapiens
PEKIQSIIK

SEQ ID NO: 376149 - protein, 9 aa, Homo Sapiens
KSPSAGNVH

SEQ ID NO: 376150 - protein, 9 aa, Homo Sapiens
TEVPEVREQ

SEQ ID NO: 376151 - protein, 9 aa, Homo Sapiens
VKSVEMLVE

SEQ ID NO: 376152 - protein, 9 aa, Homo Sapiens
WRIPLSEMM

SEQ ID NO: 376153 - protein, 9 aa, Homo Sapiens
HYEELKKMV

SEQ ID NO: 376154 - protein, 9 aa, Homo Sapiens
RELLTNVWV

SEQ ID NO: 376155 - protein, 9 aa, Homo Sapiens
KGKMCIHCL

SEQ ID NO: 376156 - protein, 9 aa, Homo Sapiens
CIHCLENVD

SEQ ID NO: 376157 - protein, 9 aa, Homo Sapiens
LAFVDPEDG

SEQ ID NO: 376158 - protein, 9 aa, Homo Sapiens
QEVAGHTEQ

SEQ ID NO: 376159 - protein, 9 aa, Homo Sapiens
KEGILPPST

SEQ ID NO: 376160 - protein, 9 aa, Homo Sapiens
QALSAVSTW

SEQ ID NO: 376161 - protein, 9 aa, Homo Sapiens
GQGLCFAAG

SEQ ID NO: 376162 - protein, 9 aa, Homo Sapiens
VHEAPLRTW

SEQ ID NO: 376163 - protein, 9 aa, Homo Sapiens
EGTCNNLQQ

SEQ ID NO: 376164 - protein, 9 aa, Homo Sapiens
EASESSHQA

SEQ ID NO: 376165 - protein, 9 aa, Homo Sapiens
RRESARPQL

SEQ ID NO: 376166 - protein, 9 aa, Homo Sapiens
EELNQEVAG

SEQ ID NO: 376167 - protein, 9 aa, Homo Sapiens
LTSLSTVRK

SEQ ID NO: 376168 - protein, 9 aa, Homo Sapiens
VPQPAAGIA

SEQ ID NO: 376169 - protein, 9 aa, Homo Sapiens
DSDSDPKEK

SEQ ID NO: 376170 - protein, 9 aa, Homo Sapiens
IEYVASVLE

SEQ ID NO: 376171 - protein, 9 aa, Homo Sapiens
YLLSKNSLW

SEQ ID NO: 376172 - protein, 9 aa, Homo Sapiens
CEECGKYFK

SEQ ID NO: 376173 - protein, 9 aa, Homo Sapiens
RATTDEDLR

SEQ ID NO: 376174 - protein, 9 aa, Homo Sapiens
RKLNLSNNK

SEQ ID NO: 376175 - protein, 9 aa, Homo Sapiens
TLAAMNRPH

SEQ ID NO: 376176 - protein, 9 aa, Homo Sapiens
PKEKEVNFQ

SEQ ID NO: 376177 - protein, 9 aa, Homo Sapiens
MLGHKNRSV

SEQ ID NO: 376178 - protein, 9 aa, Homo Sapiens
APLRTWKPT

SEQ ID NO: 376179 - protein, 9 aa, Homo Sapiens
PRKERLKSI

SEQ ID NO: 376180 - protein, 9 aa, Homo Sapiens
FPESDSLKP

SEQ ID NO: 376181 - protein, 9 aa, Homo Sapiens
RSGRACVED

SEQ ID NO: 376182 - protein, 9 aa, Homo Sapiens
RAHEGTCNN

SEQ ID NO: 376183 - protein, 9 aa, Homo Sapiens
RFLHNRELQ

SEQ ID NO: 376184 - protein, 9 aa, Homo Sapiens
TLRGLSRRQ

SEQ ID NO: 376185 - protein, 9 aa, Homo Sapiens
NTVCLTLRG

SEQ ID NO: 376186 - protein, 9 aa, Homo Sapiens
PSFSPPSPV

SEQ ID NO: 376187 - protein, 9 aa, Homo Sapiens
WLLYELQPG

SEQ ID NO: 376188 - protein, 9 aa, Homo Sapiens
KVVEELNHL

SEQ ID NO: 376189 - protein, 9 aa, Homo Sapiens
VTYMSPKSR

SEQ ID NO: 376190 - protein, 9 aa, Homo Sapiens
VRAAVSRQP

SEQ ID NO: 376191 - protein, 9 aa, Homo Sapiens
YLSKSDLLA

SEQ ID NO: 376192 - protein, 9 aa, Homo Sapiens
ITLPSLFGW

SEQ ID NO: 376193 - protein, 9 aa, Homo Sapiens
ACGLGSSCS

SEQ ID NO: 376194 - protein, 9 aa, Homo Sapiens
FIHIKANRF

SEQ ID NO: 376195 - protein, 9 aa, Homo Sapiens
KSFNNHQPM

SEQ ID NO: 376196 - protein, 9 aa, Homo Sapiens
ARNRHQEWN

SEQ ID NO: 376197 - protein, 9 aa, Homo Sapiens
VGAVGVGKS

SEQ ID NO: 376198 - protein, 9 aa, Homo Sapiens
CTLKEGAAI

SEQ ID NO: 376199 - protein, 9 aa, Homo Sapiens
TSWLEENRD

SEQ ID NO: 376200 - protein, 9 aa, Homo Sapiens
RVAGVGSSP

SEQ ID NO: 376201 - protein, 9 aa, Homo Sapiens
VVLFFLCWI

SEQ ID NO: 376202 - protein, 9 aa, Homo Sapiens
PRPTPGWSR

SEQ ID NO: 376203 - protein, 9 aa, Homo Sapiens
GCGTRELCR

SEQ ID NO: 376204 - protein, 9 aa, Homo Sapiens
FHAKYRAHE

SEQ ID NO: 376205 - protein, 9 aa, Homo Sapiens
RSFGDKDFQ

SEQ ID NO: 376206 - protein, 9 aa, Homo Sapiens
CQRLAAKGW

SEQ ID NO: 376207 - protein, 9 aa, Homo Sapiens
SGPSLEDSI

SEQ ID NO: 376208 - protein, 9 aa, Homo Sapiens
PLHTRRGRV

SEQ ID NO: 376209 - protein, 9 aa, Homo Sapiens
KVLHKTGLL

SEQ ID NO: 376210 - protein, 9 aa, Homo Sapiens
GRACVEDFY

SEQ ID NO: 376211 - protein, 9 aa, Homo Sapiens
KDFQTGLEN

SEQ ID NO: 376212 - protein, 9 aa, Homo Sapiens
QPTQQFYQP

SEQ ID NO: 376213 - protein, 9 aa, Homo Sapiens
STTLNVIRL

SEQ ID NO: 376214 - protein, 9 aa, Homo Sapiens
PHCGVPDMR

SEQ ID NO: 376215 - protein, 9 aa, Homo Sapiens
EVPEVREQL

SEQ ID NO: 376216 - protein, 9 aa, Homo Sapiens
GIASGGCLY

SEQ ID NO: 376217 - protein, 9 aa, Homo Sapiens
KLPNLRKLN

SEQ ID NO: 376218 - protein, 9 aa, Homo Sapiens
GQFRVAGVG

SEQ ID NO: 376219 - protein, 9 aa, Homo Sapiens
TSPFSSSAP

SEQ ID NO: 376220 - protein, 9 aa, Homo Sapiens
STQASLRSL

SEQ ID NO: 376221 - protein, 9 aa, Homo Sapiens
LAGGGVVVA

SEQ ID NO: 376222 - protein, 9 aa, Homo Sapiens
QETYQKLLE

SEQ ID NO: 376223 - protein, 9 aa, Homo Sapiens
FFESLRLLL

SEQ ID NO: 376224 - protein, 9 aa, Homo Sapiens
FMKQINDAH

SEQ ID NO: 376225 - protein, 9 aa, Homo Sapiens
CKCEECGKY

SEQ ID NO: 376226 - protein, 9 aa, Homo Sapiens
PPQPSYLGA

SEQ ID NO: 376227 - protein, 9 aa, Homo Sapiens
EMKCSGQLG

SEQ ID NO: 376228 - protein, 9 aa, Homo Sapiens
KNIEYVASV

SEQ ID NO: 376229 - protein, 9 aa, Homo Sapiens
KEGAAINQI

SEQ ID NO: 376230 - protein, 9 aa, Homo Sapiens
DSDLEVSFN

SEQ ID NO: 376231 - protein, 9 aa, Homo Sapiens
TEVVRHCPH

SEQ ID NO: 376232 - protein, 9 aa, Homo Sapiens
TAGWTCRAT

SEQ ID NO: 376233 - protein, 9 aa, Homo Sapiens
MDTSQQKLA

SEQ ID NO: 376234 - protein, 9 aa, Homo Sapiens
ARASGPLHT

SEQ ID NO: 376235 - protein, 9 aa, Homo Sapiens
APTTAANWS

SEQ ID NO: 376236 - protein, 9 aa, Homo Sapiens
AQGHPLGPH

SEQ ID NO: 376237 - protein, 9 aa, Homo Sapiens
AHFQLLQQQ

SEQ ID NO: 376238 - protein, 9 aa, Homo Sapiens
LSTSPFSSS

SEQ ID NO: 376239 - protein, 9 aa, Homo Sapiens
WPRHTAVMK

SEQ ID NO: 376240 - protein, 9 aa, Homo Sapiens
YNLPEVKKK

SEQ ID NO: 376241 - protein, 9 aa, Homo Sapiens
PGRDPACYE

SEQ ID NO: 376242 - protein, 9 aa, Homo Sapiens
HEAPLRTWK

SEQ ID NO: 376243 - protein, 9 aa, Homo Sapiens
SFLLASEHN

SEQ ID NO: 376244 - protein, 9 aa, Homo Sapiens
TLGQDPPQR

SEQ ID NO: 376245 - protein, 9 aa, Homo Sapiens
LPSLFGWAQ

SEQ ID NO: 376246 - protein, 9 aa, Homo Sapiens
LLYELQPGT

SEQ ID NO: 376247 - protein, 9 aa, Homo Sapiens
SMTLCVFWL

SEQ ID NO: 376248 - protein, 9 aa, Homo Sapiens
ETNEVKCKI

SEQ ID NO: 376249 - protein, 9 aa, Homo Sapiens
YPVYKYVSY

SEQ ID NO: 376250 - protein, 9 aa, Homo Sapiens
DELWTNIDT

SEQ ID NO: 376251 - protein, 9 aa, Homo Sapiens
NQEVAGHTE

SEQ ID NO: 376252 - protein, 9 aa, Homo Sapiens
QIAEIKDWN

SEQ ID NO: 376253 - protein, 9 aa, Homo Sapiens
LEYRQVPGR

SEQ ID NO: 376254 - protein, 9 aa, Homo Sapiens
MKCSGQLGI

SEQ ID NO: 376255 - protein, 9 aa, Homo Sapiens
KKGREKERK

SEQ ID NO: 376256 - protein, 9 aa, Homo Sapiens
HCGVPDMRP

SEQ ID NO: 376257 - protein, 9 aa, Homo Sapiens
CANIQLCSD

SEQ ID NO: 376258 - protein, 9 aa, Homo Sapiens
TEELNQEVA

SEQ ID NO: 376259 - protein, 9 aa, Homo Sapiens
LGTQHEAFH

SEQ ID NO: 376260 - protein, 9 aa, Homo Sapiens
NPNQMAVIK

SEQ ID NO: 376261 - protein, 9 aa, Homo Sapiens
TTTRASSAQ

SEQ ID NO: 376262 - protein, 9 aa, Homo Sapiens
CMPVSCRPI

SEQ ID NO: 376263 - protein, 9 aa, Homo Sapiens
SATVAPRPT

SEQ ID NO: 376264 - protein, 9 aa, Homo Sapiens
TSRTEELNQ

SEQ ID NO: 376265 - protein, 9 aa, Homo Sapiens
RTRPRRRHS

SEQ ID NO: 376266 - protein, 9 aa, Homo Sapiens
LQLPSPSSK

SEQ ID NO: 376267 - protein, 9 aa, Homo Sapiens
WTNIDTMAI

SEQ ID NO: 376268 - protein, 9 aa, Homo Sapiens
TTDDELWTN

SEQ ID NO: 376269 - protein, 9 aa, Homo Sapiens
TRTKWQALL

SEQ ID NO: 376270 - protein, 9 aa, Homo Sapiens
HEGTCNNLQ

SEQ ID NO: 376271 - protein, 9 aa, Homo Sapiens
FLCWIPIFS

SEQ ID NO: 376272 - protein, 9 aa, Homo Sapiens
ARTSYPFSS

SEQ ID NO: 376273 - protein, 9 aa, Homo Sapiens
ANTVCLTLR

SEQ ID NO: 376274 - protein, 9 aa, Homo Sapiens
RRHSTESWI

SEQ ID NO: 376275 - protein, 9 aa, Homo Sapiens
VVEELNHLG

SEQ ID NO: 376276 - protein, 9 aa, Homo Sapiens
PADPEGAAL

SEQ ID NO: 376277 - protein, 9 aa, Homo Sapiens
QVPGRDPAC

SEQ ID NO: 376278 - protein, 9 aa, Homo Sapiens
ILKPAETKK

SEQ ID NO: 376279 - protein, 9 aa, Homo Sapiens
SLPPAPPLD

SEQ ID NO: 376280 - protein, 9 aa, Homo Sapiens
YEKITFQYG

SEQ ID NO: 376281 - protein, 9 aa, Homo Sapiens
LSASITLPS

SEQ ID NO: 376282 - protein, 9 aa, Homo Sapiens
KLCEEKEKV

SEQ ID NO: 376283 - protein, 9 aa, Homo Sapiens
LLLLGTQHE

SEQ ID NO: 376284 - protein, 9 aa, Homo Sapiens
FSPPSPVGG

SEQ ID NO: 376285 - protein, 9 aa, Homo Sapiens
SRTEELNQE

SEQ ID NO: 376286 - protein, 9 aa, Homo Sapiens
CRNGGTCTN

SEQ ID NO: 376287 - protein, 9 aa, Homo Sapiens
KARNRHQEW

SEQ ID NO: 376288 - protein, 9 aa, Homo Sapiens
YELVMTARD

SEQ ID NO: 376289 - protein, 9 aa, Homo Sapiens
AIDYHICLA

SEQ ID NO: 376290 - protein, 9 aa, Homo Sapiens
RIYYNLPEV

SEQ ID NO: 376291 - protein, 9 aa, Homo Sapiens
GTATSWVRT

SEQ ID NO: 376292 - protein, 9 aa, Homo Sapiens
IGVQCRSSS

SEQ ID NO: 376293 - protein, 9 aa, Homo Sapiens
RTSYPFSSP

SEQ ID NO: 376294 - protein, 9 aa, Homo Sapiens
KRIYYNLPE

SEQ ID NO: 376295 - protein, 9 aa, Homo Sapiens
SGLYIFCNE

SEQ ID NO: 376296 - protein, 9 aa, Homo Sapiens
LDNGSQPSQ

SEQ ID NO: 376297 - protein, 9 aa, Homo Sapiens
HIKANRFEE

SEQ ID NO: 376298 - protein, 9 aa, Homo Sapiens
DHVVEGQWQ

SEQ ID NO: 376299 - protein, 9 aa, Homo Sapiens
IVTYMSPKS

SEQ ID NO: 376300 - protein, 9 aa, Homo Sapiens
LCSDEECRQ

SEQ ID NO: 376301 - protein, 9 aa, Homo Sapiens
GLIIFGDQV

SEQ ID NO: 376302 - protein, 9 aa, Homo Sapiens
SKNSLWLSD

SEQ ID NO: 376303 - protein, 9 aa, Homo Sapiens
QPAAGIAHL

SEQ ID NO: 376304 - protein, 9 aa, Homo Sapiens
SAIVTYMSP

SEQ ID NO: 376305 - protein, 9 aa, Homo Sapiens
HCEHQETYQ

SEQ ID NO: 376306 - protein, 9 aa, Homo Sapiens
TSTRWTLPS

SEQ ID NO: 376307 - protein, 9 aa, Homo Sapiens
RHPDIEVDG

SEQ ID NO: 376308 - protein, 9 aa, Homo Sapiens
TVPEKIQSI

SEQ ID NO: 376309 - protein, 9 aa, Homo Sapiens
TFQYGITDL

SEQ ID NO: 376310 - protein, 9 aa, Homo Sapiens
SDSDLEVSF

SEQ ID NO: 376311 - protein, 9 aa, Homo Sapiens
LLLLAGGGV

SEQ ID NO: 376312 - protein, 9 aa, Homo Sapiens
NDEMKCSGQ

SEQ ID NO: 376313 - protein, 9 aa, Homo Sapiens
HQEWNMMAY

SEQ ID NO: 376314 - protein, 9 aa, Homo Sapiens
SHARTSYPF

SEQ ID NO: 376315 - protein, 9 aa, Homo Sapiens
PPSTLDGAG

SEQ ID NO: 376316 - protein, 9 aa, Homo Sapiens
QERNGKQHQ

SEQ ID NO: 376317 - protein, 9 aa, Homo Sapiens
TRATLGQDP

SEQ ID NO: 376318 - protein, 9 aa, Homo Sapiens
VTSAMNVAK

SEQ ID NO: 376319 - protein, 9 aa, Homo Sapiens
DVINTFENV

SEQ ID NO: 376320 - protein, 9 aa, Homo Sapiens
SSVIMRVRL

SEQ ID NO: 376321 - protein, 9 aa, Homo Sapiens
SLRSLSTSP

SEQ ID NO: 376322 - protein, 9 aa, Homo Sapiens
GQRSEEIPM

SEQ ID NO: 376323 - protein, 9 aa, Homo Sapiens
ALTGLEAHT

SEQ ID NO: 376324 - protein, 9 aa, Homo Sapiens
KITSAIVQA

SEQ ID NO: 376325 - protein, 9 aa, Homo Sapiens
SLSTVRKPW

SEQ ID NO: 376326 - protein, 9 aa, Homo Sapiens
VLQMAISFL

SEQ ID NO: 376327 - protein, 9 aa, Homo Sapiens
TLKEGAAIN

SEQ ID NO: 376328 - protein, 9 aa, Homo Sapiens
SQAHRPHPP

SEQ ID NO: 376329 - protein, 9 aa, Homo Sapiens
SASWTTRGS

SEQ ID NO: 376330 - protein, 9 aa, Homo Sapiens
LSEAGISCR

SEQ ID NO: 376331 - protein, 9 aa, Homo Sapiens
TSAMNVAKG

SEQ ID NO: 376332 - protein, 9 aa, Homo Sapiens
RGDHRSNQN

SEQ ID NO: 376333 - protein, 9 aa, Homo Sapiens
RPHCGVPDM

SEQ ID NO: 376334 - protein, 9 aa, Homo Sapiens
QRVHYDSSN

SEQ ID NO: 376335 - protein, 9 aa, Homo Sapiens
GQGTATSWV

SEQ ID NO: 376336 - protein, 9 aa, Homo Sapiens
FGDKDFQTG

SEQ ID NO: 376337 - protein, 9 aa, Homo Sapiens
LHGASHCLS

SEQ ID NO: 376338 - protein, 9 aa, Homo Sapiens
CSGVTSAMN

SEQ ID NO: 376339 - protein, 9 aa, Homo Sapiens
LQIAEIKDW

SEQ ID NO: 376340 - protein, 9 aa, Homo Sapiens
VNAPILTST

SEQ ID NO: 376341 - protein, 9 aa, Homo Sapiens
QFRVAGVGS

SEQ ID NO: 376342 - protein, 9 aa, Homo Sapiens
DTSQQKLAG

SEQ ID NO: 376343 - protein, 9 aa, Homo Sapiens
PKPTKGKMC

SEQ ID NO: 376344 - protein, 9 aa, Homo Sapiens
KSVEMLVEH

SEQ ID NO: 376345 - protein, 9 aa, Homo Sapiens
QPRRSTQPT

SEQ ID NO: 376346 - protein, 9 aa, Homo Sapiens
SFNNHQPMD

SEQ ID NO: 376347 - protein, 9 aa, Homo Sapiens
RGTRTKWQA

SEQ ID NO: 376348 - protein, 9 aa, Homo Sapiens
PRGDHRSNQ

SEQ ID NO: 376349 - protein, 9 aa, Homo Sapiens
SEDCSGMPS

SEQ ID NO: 376350 - protein, 9 aa, Homo Sapiens
QTGLENGIL

SEQ ID NO: 376351 - protein, 9 aa, Homo Sapiens
AKKITSAIV

SEQ ID NO: 376352 - protein, 9 aa, Homo Sapiens
GGCGTRELC

SEQ ID NO: 376353 - protein, 9 aa, Homo Sapiens
SLRSSSWAL

SEQ ID NO: 376354 - protein, 9 aa, Homo Sapiens
KGNVTTRES

SEQ ID NO: 376355 - protein, 9 aa, Homo Sapiens
LSGIASGGC

SEQ ID NO: 376356 - protein, 9 aa, Homo Sapiens
AHRPHPPPP

SEQ ID NO: 376357 - protein, 9 aa, Homo Sapiens
VAGVGSSPG

SEQ ID NO: 376358 - protein, 9 aa, Homo Sapiens
DCSGMPSFL

SEQ ID NO: 376359 - protein, 9 aa, Homo Sapiens
GEPRELLTN

SEQ ID NO: 376360 - protein, 9 aa, Homo Sapiens
HARTSYPFS

SEQ ID NO: 376361 - protein, 9 aa, Homo Sapiens
LPAKERQKI

SEQ ID NO: 376362 - protein, 9 aa, Homo Sapiens
FPAVPQPAA

SEQ ID NO: 376363 - protein, 9 aa, Homo Sapiens
EKVVEELNH

SEQ ID NO: 376364 - protein, 9 aa, Homo Sapiens
DSLKPTVAT

SEQ ID NO: 376365 - protein, 9 aa, Homo Sapiens
DEASESSHQ

SEQ ID NO: 376366 - protein, 9 aa, Homo Sapiens
EIICPENSH

SEQ ID NO: 376367 - protein, 9 aa, Homo Sapiens
FEYICHKVL

SEQ ID NO: 376368 - protein, 9 aa, Homo Sapiens
SDEASESSH

SEQ ID NO: 376369 - protein, 9 aa, Homo Sapiens
RGPDRVRAA

SEQ ID NO: 376370 - protein, 9 aa, Homo Sapiens
AFVDPEDGT

SEQ ID NO: 376371 - protein, 9 aa, Homo Sapiens
PNLRKLNLS

SEQ ID NO: 376372 - protein, 9 aa, Homo Sapiens
KLWACDFCF

SEQ ID NO: 376373 - protein, 9 aa, Homo Sapiens
HFQLLQQQQ

SEQ ID NO: 376374 - protein, 9 aa, Homo Sapiens
LLAHLCRLR

SEQ ID NO: 376375 - protein, 9 aa, Homo Sapiens
LGLIIFGDQ

SEQ ID NO: 376376 - protein, 9 aa, Homo Sapiens
DLRHSQPRG

SEQ ID NO: 376377 - protein, 9 aa, Homo Sapiens
AAAPARSAT

SEQ ID NO: 376378 - protein, 9 aa, Homo Sapiens
TPESFLLAS

SEQ ID NO: 376379 - protein, 9 aa, Homo Sapiens
DHRSNQNRE

SEQ ID NO: 376380 - protein, 9 aa, Homo Sapiens
EALGWPRHT

SEQ ID NO: 376381 - protein, 9 aa, Homo Sapiens
CCRICFEEW

SEQ ID NO: 376382 - protein, 9 aa, Homo Sapiens
TPAHFQLLQ

SEQ ID NO: 376383 - protein, 9 aa, Homo Sapiens
AANWSTQAS

SEQ ID NO: 376384 - protein, 9 aa, Homo Sapiens
ENRDTAQQS

SEQ ID NO: 376385 - protein, 9 aa, Homo Sapiens
GYEEGPGEE

SEQ ID NO: 376386 - protein, 9 aa, Homo Sapiens
EEHAALLCN

SEQ ID NO: 376387 - protein, 9 aa, Homo Sapiens
TIPRCCPAL

SEQ ID NO: 376388 - protein, 9 aa, Homo Sapiens
CSRGTRTKW

SEQ ID NO: 376389 - protein, 9 aa, Homo Sapiens
RSEEIPMDL

SEQ ID NO: 376390 - protein, 9 aa, Homo Sapiens
GLGSSCSSE

SEQ ID NO: 376391 - protein, 9 aa, Homo Sapiens
PTKGKMCIH

SEQ ID NO: 376392 - protein, 9 aa, Homo Sapiens
STSPFSSSA

SEQ ID NO: 376393 - protein, 9 aa, Homo Sapiens
SLFGWAQNV

SEQ ID NO: 376394 - protein, 9 aa, Homo Sapiens
LPSAAAPAR

SEQ ID NO: 376395 - protein, 9 aa, Homo Sapiens
WIPIFSANA

SEQ ID NO: 376396 - protein, 9 aa, Homo Sapiens
IWVSMTLCV

SEQ ID NO: 376397 - protein, 9 aa, Homo Sapiens
KCTPCRFLK

SEQ ID NO: 376398 - protein, 9 aa, Homo Sapiens
LEYFMKQIN

SEQ ID NO: 376399 - protein, 9 aa, Homo Sapiens
ALGWPRHTA

SEQ ID NO: 376400 - protein, 9 aa, Homo Sapiens
VPSTPPRGD

SEQ ID NO: 376401 - protein, 9 aa, Homo Sapiens
PKREMKPES

SEQ ID NO: 376402 - protein, 9 aa, Homo Sapiens
AAKGWRIPL

SEQ ID NO: 376403 - protein, 9 aa, Homo Sapiens
NEVKCKIGS

SEQ ID NO: 376404 - protein, 9 aa, Homo Sapiens
PTTAANWST

SEQ ID NO: 376405 - protein, 9 aa, Homo Sapiens
TSWVRTGER

SEQ ID NO: 376406 - protein, 9 aa, Homo Sapiens
DFQTGLENG

SEQ ID NO: 376407 - protein, 9 aa, Homo Sapiens
LWTNIDTMA

SEQ ID NO: 376408 - protein, 9 aa, Homo Sapiens
VLHKTGLLM

SEQ ID NO: 376409 - protein, 9 aa, Homo Sapiens
VTNSSVIMR

SEQ ID NO: 376410 - protein, 9 aa, Homo Sapiens
LYELQPGTG

SEQ ID NO: 376411 - protein, 9 aa, Homo Sapiens
ERLKSIEER

SEQ ID NO: 376412 - protein, 9 aa, Homo Sapiens
WHFAGELQQ

SEQ ID NO: 376413 - protein, 9 aa, Homo Sapiens
INLSEAGIS

SEQ ID NO: 376414 - protein, 9 aa, Homo Sapiens
GRSIMRRIM

SEQ ID NO: 376415 - protein, 9 aa, Homo Sapiens
IEHLVTQLE

SEQ ID NO: 376416 - protein, 9 aa, Homo Sapiens
SAAAPARSA

SEQ ID NO: 376417 - protein, 9 aa, Homo Sapiens
RSKSFNNHQ

SEQ ID NO: 376418 - protein, 9 aa, Homo Sapiens
LLHGASHCL

SEQ ID NO: 376419 - protein, 9 aa, Homo Sapiens
EPPRLLAHL

SEQ ID NO: 376420 - protein, 9 aa, Homo Sapiens
VQCRSSSGS

SEQ ID NO: 376421 - protein, 9 aa, Homo Sapiens
NKKENPNQM

SEQ ID NO: 376422 - protein, 9 aa, Homo Sapiens
ILTRATLGQ

SEQ ID NO: 376423 - protein, 9 aa, Homo Sapiens
RRLEACGLG

SEQ ID NO: 376424 - protein, 9 aa, Homo Sapiens
RHSTESWIE

SEQ ID NO: 376425 - protein, 9 aa, Homo Sapiens
LMEAVLRYP

SEQ ID NO: 376426 - protein, 9 aa, Homo Sapiens
KYRAHEGTC

SEQ ID NO: 376427 - protein, 9 aa, Homo Sapiens
ACDFCFQRN

SEQ ID NO: 376428 - protein, 9 aa, Homo Sapiens
AAPARSATV

SEQ ID NO: 376429 - protein, 9 aa, Homo Sapiens
ERTPESFLL

SEQ ID NO: 376430 - protein, 9 aa, Homo Sapiens
MRSKRIYYN

SEQ ID NO: 376431 - protein, 9 aa, Homo Sapiens
YRAHEGTCN

SEQ ID NO: 376432 - protein, 9 aa, Homo Sapiens
TEVTEEMVN

SEQ ID NO: 376433 - protein, 9 aa, Homo Sapiens
TSQITYTSL

SEQ ID NO: 376434 - protein, 9 aa, Homo Sapiens
APRPTPGWS

SEQ ID NO: 376435 - protein, 9 aa, Homo Sapiens
QHEAFHAMA

SEQ ID NO: 376436 - protein, 9 aa, Homo Sapiens
YDLTSLSTV

SEQ ID NO: 376437 - protein, 9 aa, Homo Sapiens
ITYTSLSLP

SEQ ID NO: 376438 - protein, 9 aa, Homo Sapiens
KKNIEYVAS

SEQ ID NO: 376439 - protein, 9 aa, Homo Sapiens
PISDSDLEV

SEQ ID NO: 376440 - protein, 9 aa, Homo Sapiens
SEEIPMDLT

SEQ ID NO: 376441 - protein, 9 aa, Homo Sapiens
PVGGDSNRC

SEQ ID NO: 376442 - protein, 9 aa, Homo Sapiens
GWSRAAAPT

SEQ ID NO: 376443 - protein, 9 aa, Homo Sapiens
AEPPRLLAH

SEQ ID NO: 376444 - protein, 9 aa, Homo Sapiens
EGAALLLPP

SEQ ID NO: 376445 - protein, 9 aa, Homo Sapiens
WHHCEHQET

SEQ ID NO: 376446 - protein, 9 aa, Homo Sapiens
ATTALTGLE

SEQ ID NO: 376447 - protein, 9 aa, Homo Sapiens
CEEKEKVKE

SEQ ID NO: 376448 - protein, 9 aa, Homo Sapiens
SRGTRTKWQ

SEQ ID NO: 376449 - protein, 9 aa, Homo Sapiens
TLQIAEIKD

SEQ ID NO: 376450 - protein, 9 aa, Homo Sapiens
ENLRWGSES

SEQ ID NO: 376451 - protein, 9 aa, Homo Sapiens
EYYDRLRPL

SEQ ID NO: 376452 - protein, 9 aa, Homo Sapiens
ICHKVLYVF

SEQ ID NO: 376453 - protein, 9 aa, Homo Sapiens
STLDGAGTQ

SEQ ID NO: 376454 - protein, 9 aa, Homo Sapiens
SCQPSVCMP

SEQ ID NO: 376455 - protein, 9 aa, Homo Sapiens
AQRTSTRWT

SEQ ID NO: 376456 - protein, 9 aa, Homo Sapiens
PSVCMPVSC

SEQ ID NO: 376457 - protein, 9 aa, Homo Sapiens
FKQMRIENS

SEQ ID NO: 376458 - protein, 9 aa, Homo Sapiens
RHSQPRGTF

SEQ ID NO: 376459 - protein, 9 aa, Homo Sapiens
NGTFEYICH

SEQ ID NO: 376460 - protein, 9 aa, Homo Sapiens
QARASGPLH

SEQ ID NO: 376461 - protein, 9 aa, Homo Sapiens
LEENRDTAQ

SEQ ID NO: 376462 - protein, 9 aa, Homo Sapiens
GAAATTALT

SEQ ID NO: 376463 - protein, 9 aa, Homo Sapiens
ADPEGAALL

SEQ ID NO: 376464 - protein, 9 aa, Homo Sapiens
DVVKHYLSK

SEQ ID NO: 376465 - protein, 9 aa, Homo Sapiens
KGWRIPLSE

SEQ ID NO: 376466 - protein, 9 aa, Homo Sapiens
SEYEKITFQ

SEQ ID NO: 376467 - protein, 9 aa, Homo Sapiens
LVDSDSDPK

SEQ ID NO: 376468 - protein, 9 aa, Homo Sapiens
LLGTQHEAF

SEQ ID NO: 376469 - protein, 9 aa, Homo Sapiens
ESSHQAWTG

SEQ ID NO: 376470 - protein, 9 aa, Homo Sapiens
HICLAQSAL

SEQ ID NO: 376471 - protein, 9 aa, Homo Sapiens
AGDEEEHAA

SEQ ID NO: 376472 - protein, 9 aa, Homo Sapiens
NLTTTWQRP

SEQ ID NO: 376473 - protein, 9 aa, Homo Sapiens
ATTTRASSA

SEQ ID NO: 376474 - protein, 9 aa, Homo Sapiens
TRASSAQRT

SEQ ID NO: 376475 - protein, 9 aa, Homo Sapiens
DKDFQTGLE

SEQ ID NO: 376476 - protein, 9 aa, Homo Sapiens
QRTSTRWTL

SEQ ID NO: 376477 - protein, 9 aa, Homo Sapiens
YDVINTFEN

SEQ ID NO: 376478 - protein, 9 aa, Homo Sapiens
SVSHARTSY

SEQ ID NO: 376479 - protein, 9 aa, Homo Sapiens
NIQLCSDEE

SEQ ID NO: 376480 - protein, 9 aa, Homo Sapiens
EECGKYFKH

SEQ ID NO: 376481 - protein, 9 aa, Homo Sapiens
PQLEFVLPR

SEQ ID NO: 376482 - protein, 9 aa, Homo Sapiens
DDMDRIMML

SEQ ID NO: 376483 - protein, 9 aa, Homo Sapiens
RGLSRRQME

SEQ ID NO: 376484 - protein, 9 aa, Homo Sapiens
LEVSFNSGE

SEQ ID NO: 376485 - protein, 9 aa, Homo Sapiens
TLCVFWLMC

SEQ ID NO: 376486 - protein, 9 aa, Homo Sapiens
FVQPRKERL

SEQ ID NO: 376487 - protein, 9 aa, Homo Sapiens
SGYNAWLLY

SEQ ID NO: 376488 - protein, 9 aa, Homo Sapiens
YVDHVNLTT

SEQ ID NO: 376489 - protein, 9 aa, Homo Sapiens
LNHLGMMID

SEQ ID NO: 376490 - protein, 9 aa, Homo Sapiens
EGPGEENLR

SEQ ID NO: 376491 - protein, 9 aa, Homo Sapiens
QAFLLLLLL

SEQ ID NO: 376492 - protein, 9 aa, Homo Sapiens
GYNAWLLYE

SEQ ID NO: 376493 - protein, 9 aa, Homo Sapiens
GPAAPSSPE

SEQ ID NO: 376494 - protein, 9 aa, Homo Sapiens
DPCMPSCHS

SEQ ID NO: 376495 - protein, 9 aa, Homo Sapiens
SPVGGDSNR

SEQ ID NO: 376496 - protein, 9 aa, Homo Sapiens
LLPPLPQAF

SEQ ID NO: 376497 - protein, 9 aa, Homo Sapiens
LNRGLKKKK

SEQ ID NO: 376498 - protein, 9 aa, Homo Sapiens
RKAGKTTYS

SEQ ID NO: 376499 - protein, 9 aa, Homo Sapiens
PAKERQKIV

SEQ ID NO: 376500 - protein, 9 aa, Homo Sapiens
GERHGQGLC

SEQ ID NO: 376501 - protein, 9 aa, Homo Sapiens
VSMTLCVFW

SEQ ID NO: 376502 - protein, 9 aa, Homo Sapiens
HTAVMKLRV

SEQ ID NO: 376503 - protein, 9 aa, Homo Sapiens
ECGKYFKHF

SEQ ID NO: 376504 - protein, 9 aa, Homo Sapiens
REIKKGNVT

SEQ ID NO: 376505 - protein, 9 aa, Homo Sapiens
SNQNREWCL

SEQ ID NO: 376506 - protein, 9 aa, Homo Sapiens
FIGLSDHVV

SEQ ID NO: 376507 - protein, 9 aa, Homo Sapiens
HQPMDPEVI

SEQ ID NO: 376508 - protein, 9 aa, Homo Sapiens
SESDMHVLQ

SEQ ID NO: 376509 - protein, 9 aa, Homo Sapiens
ELNHLGMMI

SEQ ID NO: 376510 - protein, 9 aa, Homo Sapiens
ICFEEWRDE

SEQ ID NO: 376511 - protein, 9 aa, Homo Sapiens
HWRSCGQQG

SEQ ID NO: 376512 - protein, 9 aa, Homo Sapiens
QGHPLGPHG

SEQ ID NO: 376513 - protein, 9 aa, Homo Sapiens
DLKKNIEYV

SEQ ID NO: 376514 - protein, 9 aa, Homo Sapiens
PAPPLDNGS

SEQ ID NO: 376515 - protein, 9 aa, Homo Sapiens
AVHEAPLRT

SEQ ID NO: 376516 - protein, 9 aa, Homo Sapiens
QMRIENSPL

SEQ ID NO: 376517 - protein, 9 aa, Homo Sapiens
SPPSPVGGD

SEQ ID NO: 376518 - protein, 9 aa, Homo Sapiens
NTFENVDEV

SEQ ID NO: 376519 - protein, 9 aa, Homo Sapiens
INLLETNEV

SEQ ID NO: 376520 - protein, 9 aa, Homo Sapiens
HCSQRHQKC

SEQ ID NO: 376521 - protein, 9 aa, Homo Sapiens
DEFPESDSL

SEQ ID NO: 376522 - protein, 9 aa, Homo Sapiens
IMDTSQQKL

SEQ ID NO: 376523 - protein, 9 aa, Homo Sapiens
YNLGLIIFG

SEQ ID NO: 376524 - protein, 9 aa, Homo Sapiens
ILIGVQCRS

SEQ ID NO: 376525 - protein, 9 aa, Homo Sapiens
EEFKQMRIE

SEQ ID NO: 376526 - protein, 9 aa, Homo Sapiens
RTKWQALLG

SEQ ID NO: 376527 - protein, 9 aa, Homo Sapiens
KASHRFLHN

SEQ ID NO: 376528 - protein, 9 aa, Homo Sapiens
PVLPEKLCE

SEQ ID NO: 376529 - protein, 9 aa, Homo Sapiens
RWTLPSAAA

SEQ ID NO: 376530 - protein, 9 aa, Homo Sapiens
RACVEDFYT

SEQ ID NO: 376531 - protein, 9 aa, Homo Sapiens
GKQHQDDEP

SEQ ID NO: 376532 - protein, 9 aa, Homo Sapiens
HRFLHNREL

SEQ ID NO: 376533 - protein, 9 aa, Homo Sapiens
RTWKPTAEQ

SEQ ID NO: 376534 - protein, 9 aa, Homo Sapiens
NIEYVASVL

SEQ ID NO: 376535 - protein, 9 aa, Homo Sapiens
ENPNQMAVI

SEQ ID NO: 376536 - protein, 9 aa, Homo Sapiens
HSTESWIER

SEQ ID NO: 376537 - protein, 9 aa, Homo Sapiens
YEELKKMVQ

SEQ ID NO: 376538 - protein, 9 aa, Homo Sapiens
PRRSTQPTQ

SEQ ID NO: 376539 - protein, 9 aa, Homo Sapiens
RPRRRHSTE

SEQ ID NO: 376540 - protein, 9 aa, Homo Sapiens
HLPAKERQK

SEQ ID NO: 376541 - protein, 9 aa, Homo Sapiens
SNKYIEHLV

SEQ ID NO: 376542 - protein, 9 aa, Homo Sapiens
VLENVEHYE

SEQ ID NO: 376543 - protein, 9 aa, Homo Sapiens
MKTIPRCCP

SEQ ID NO: 376544 - protein, 9 aa, Homo Sapiens
LIGVQCRSS

SEQ ID NO: 376545 - protein, 9 aa, Homo Sapiens
RAKLWACDF

SEQ ID NO: 376546 - protein, 9 aa, Homo Sapiens
WSTQASLRS

SEQ ID NO: 376547 - protein, 9 aa, Homo Sapiens
PTPGWSRAA

SEQ ID NO: 376548 - protein, 9 aa, Homo Sapiens
TQHEAFHAM

SEQ ID NO: 376549 - protein, 9 aa, Homo Sapiens
VINTFENVD

SEQ ID NO: 376550 - protein, 9 aa, Homo Sapiens
ATSWVRTGE

SEQ ID NO: 376551 - protein, 9 aa, Homo Sapiens
GASASDSSV

SEQ ID NO: 376552 - protein, 9 aa, Homo Sapiens
ARKAGKTTY

SEQ ID NO: 376553 - protein, 9 aa, Homo Sapiens
NQNREWCLE

SEQ ID NO: 376554 - protein, 9 aa, Homo Sapiens
PSCQPSVCM

SEQ ID NO: 376555 - protein, 9 aa, Homo Sapiens
PSTSQITYT

SEQ ID NO: 376556 - protein, 9 aa, Homo Sapiens
QPMDPEVIA

SEQ ID NO: 376557 - protein, 9 aa, Homo Sapiens
DYHICLAQS

SEQ ID NO: 376558 - protein, 9 aa, Homo Sapiens
DSGYNAWLL

SEQ ID NO: 376559 - protein, 9 aa, Homo Sapiens
ETSWLEENR

SEQ ID NO: 376560 - protein, 9 aa, Homo Sapiens
GDEEEHAAL

SEQ ID NO: 376561 - protein, 9 aa, Homo Sapiens
KIHGVDASI

SEQ ID NO: 376562 - protein, 9 aa, Homo Sapiens
HPLGPHGLD

SEQ ID NO: 376563 - protein, 9 aa, Homo Sapiens
VPEVREQLS

SEQ ID NO: 376564 - protein, 9 aa, Homo Sapiens
KPSEYEKIT

SEQ ID NO: 376565 - protein, 9 aa, Homo Sapiens
SDPKEKEVN

SEQ ID NO: 376566 - protein, 9 aa, Homo Sapiens
AECTLKEGA

SEQ ID NO: 376567 - protein, 9 aa, Homo Sapiens
LGSSCSSEE

SEQ ID NO: 376568 - protein, 9 aa, Homo Sapiens
ESLRLLLKL

SEQ ID NO: 376569 - protein, 9 aa, Homo Sapiens
ISSGAKKVP

SEQ ID NO: 376570 - protein, 9 aa, Homo Sapiens
KCLASGIIL

SEQ ID NO: 376571 - protein, 9 aa, Homo Sapiens
LRSLSTSPF

SEQ ID NO: 376572 - protein, 9 aa, Homo Sapiens
SLSVYELVM

SEQ ID NO: 376573 - protein, 9 aa, Homo Sapiens
PNQMAVIKP

SEQ ID NO: 376574 - protein, 9 aa, Homo Sapiens
ACPGGCGTR

SEQ ID NO: 376575 - protein, 9 aa, Homo Sapiens
VEHYEELKK

SEQ ID NO: 376576 - protein, 9 aa, Homo Sapiens
IHGVDASIS

SEQ ID NO: 376577 - protein, 9 aa, Homo Sapiens
EDGTPLSTI

SEQ ID NO: 376578 - protein, 9 aa, Homo Sapiens
SEEFKQMRI

SEQ ID NO: 376579 - protein, 9 aa, Homo Sapiens
PAVPQPAAG

SEQ ID NO: 376580 - protein, 9 aa, Homo Sapiens
LRILDTHRK

SEQ ID NO: 376581 - protein, 9 aa, Homo Sapiens
WLEENRDTA

SEQ ID NO: 376582 - protein, 9 aa, Homo Sapiens
SIGLFLSAF

SEQ ID NO: 376583 - protein, 9 aa, Homo Sapiens
QEYYDRLRP

SEQ ID NO: 376584 - protein, 9 aa, Homo Sapiens
DGQPRRSTQ

SEQ ID NO: 376585 - protein, 9 aa, Homo Sapiens
YMPPQPSYL

SEQ ID NO: 376586 - protein, 9 aa, Homo Sapiens
QASLAHWRS

SEQ ID NO: 376587 - protein, 9 aa, Homo Sapiens
IQERNGKQH

SEQ ID NO: 376588 - protein, 9 aa, Homo Sapiens
SEGGLGSGM

SEQ ID NO: 376589 - protein, 9 aa, Homo Sapiens
ITVPEKIQS

SEQ ID NO: 376590 - protein, 9 aa, Homo Sapiens
ERHGQGLCF

SEQ ID NO: 376591 - protein, 9 aa, Homo Sapiens
GYPVYKYVS

SEQ ID NO: 376592 - protein, 9 aa, Homo Sapiens
PCMPSCHSP

SEQ ID NO: 376593 - protein, 9 aa, Homo Sapiens
KIQSIIKEG

SEQ ID NO: 376594 - protein, 9 aa, Homo Sapiens
DIHSTHSKE

SEQ ID NO: 376595 - protein, 9 aa, Homo Sapiens
MPPQPSYLG

SEQ ID NO: 376596 - protein, 9 aa, Homo Sapiens
ITFQYGITD

SEQ ID NO: 376597 - protein, 9 aa, Homo Sapiens
LVTQLEEQH

SEQ ID NO: 376598 - protein, 9 aa, Homo Sapiens
VTTRESIHM

SEQ ID NO: 376599 - protein, 9 aa, Homo Sapiens
KLEESEDPE

SEQ ID NO: 376600 - protein, 9 aa, Homo Sapiens
GASHCLSLT

SEQ ID NO: 376601 - protein, 9 aa, Homo Sapiens
MPVSCRPII

SEQ ID NO: 376602 - protein, 9 aa, Homo Sapiens
YPYIDLDFE

SEQ ID NO: 376603 - protein, 9 aa, Homo Sapiens
ISMYLQLPS

SEQ ID NO: 376604 - protein, 9 aa, Homo Sapiens
PSEYEKITF

SEQ ID NO: 376605 - protein, 9 aa, Homo Sapiens
YPFSSPVSD

SEQ ID NO: 376606 - protein, 9 aa, Homo Sapiens
GDHRSNQNR

SEQ ID NO: 376607 - protein, 9 aa, Homo Sapiens
YDMDTGREL

SEQ ID NO: 376608 - protein, 9 aa, Homo Sapiens
SSPESTATA

SEQ ID NO: 376609 - protein, 9 aa, Homo Sapiens
ELNQEVAGH

SEQ ID NO: 376610 - protein, 9 aa, Homo Sapiens
KGREKERKG

SEQ ID NO: 376611 - protein, 9 aa, Homo Sapiens
KKGNVTTRE

SEQ ID NO: 376612 - protein, 9 aa, Homo Sapiens
WSRAAAPTT

SEQ ID NO: 376613 - protein, 9 aa, Homo Sapiens
WVSMTLCVF

SEQ ID NO: 376614 - protein, 9 aa, Homo Sapiens
AGELQQALS

SEQ ID NO: 376615 - protein, 9 aa, Homo Sapiens
TSQQKLAGL

SEQ ID NO: 376616 - protein, 9 aa, Homo Sapiens
ATTDEDLRT

SEQ ID NO: 376617 - protein, 9 aa, Homo Sapiens
LPVLPEKLC

SEQ ID NO: 376618 - protein, 9 aa, Homo Sapiens
AKERQKIVE

SEQ ID NO: 376619 - protein, 9 aa, Homo Sapiens
LETNEVKCK

SEQ ID NO: 376620 - protein, 9 aa, Homo Sapiens
SGVTSAMNV

SEQ ID NO: 376621 - protein, 9 aa, Homo Sapiens
KPAETKKPN

SEQ ID NO: 376622 - protein, 9 aa, Homo Sapiens
YKYVSYGPV

SEQ ID NO: 376623 - protein, 9 aa, Homo Sapiens
RDPACYEFL

SEQ ID NO: 376624 - protein, 9 aa, Homo Sapiens
GGCLYISRM

SEQ ID NO: 376625 - protein, 9 aa, Homo Sapiens
DPEDGTPLS

SEQ ID NO: 376626 - protein, 9 aa, Homo Sapiens
EKAEPPRLL

SEQ ID NO: 376627 - protein, 9 aa, Homo Sapiens
VTRDVVKHY

SEQ ID NO: 376628 - protein, 9 aa, Homo Sapiens
RQKIVELAK

SEQ ID NO: 376629 - protein, 9 aa, Homo Sapiens
YFKHFSALR

SEQ ID NO: 376630 - protein, 9 aa, Homo Sapiens
KPTKGKMCI

SEQ ID NO: 376631 - protein, 9 aa, Homo Sapiens
FYVDHVNLT

SEQ ID NO: 376632 - protein, 9 aa, Homo Sapiens
LAGLLMVHT

SEQ ID NO: 376633 - protein, 9 aa, Homo Sapiens
KHYLSKSDL

SEQ ID NO: 376634 - protein, 9 aa, Homo Sapiens
GRDPACYEF

SEQ ID NO: 376635 - protein, 9 aa, Homo Sapiens
CGLGSSCSS

SEQ ID NO: 376636 - protein, 9 aa, Homo Sapiens
FLLASEHNT

SEQ ID NO: 376637 - protein, 9 aa, Homo Sapiens
AVLRYPGLL

SEQ ID NO: 376638 - protein, 9 aa, Homo Sapiens
HDIHSTHSK

SEQ ID NO: 376639 - protein, 9 aa, Homo Sapiens
GAVGVGKSA

SEQ ID NO: 376640 - protein, 9 aa, Homo Sapiens
VHYDSSNQV

SEQ ID NO: 376641 - protein, 9 aa, Homo Sapiens
LAAKGWRIP

SEQ ID NO: 376642 - protein, 9 aa, Homo Sapiens
HAKYRAHEG

SEQ ID NO: 376643 - protein, 9 aa, Homo Sapiens
TTALTGLEA

SEQ ID NO: 376644 - protein, 9 aa, Homo Sapiens
PKKGHGYEE

SEQ ID NO: 376645 - protein, 9 aa, Homo Sapiens
LLLSSAKHQ

SEQ ID NO: 376646 - protein, 9 aa, Homo Sapiens
TNAPNGGFR

SEQ ID NO: 376647 - protein, 9 aa, Homo Sapiens
IDPKKGHGY

SEQ ID NO: 376648 - protein, 9 aa, Homo Sapiens
SWLEENRDT

SEQ ID NO: 376649 - protein, 9 aa, Homo Sapiens
VGGDSNRCL

SEQ ID NO: 376650 - protein, 9 aa, Homo Sapiens
LGQFRVAGV

SEQ ID NO: 376651 - protein, 9 aa, Homo Sapiens
AAMNRPHCG

SEQ ID NO: 376652 - protein, 9 aa, Homo Sapiens
GGTCTNAPN

SEQ ID NO: 376653 - protein, 9 aa, Homo Sapiens
QHMTEVVRH

SEQ ID NO: 376654 - protein, 9 aa, Homo Sapiens
KAEPPRLLA

SEQ ID NO: 376655 - protein, 9 aa, Homo Sapiens
MPSCHSPRP

SEQ ID NO: 376656 - protein, 9 aa, Homo Sapiens
NRPHCGVPD

SEQ ID NO: 376657 - protein, 9 aa, Homo Sapiens
DLLLSSAKH

SEQ ID NO: 376658 - protein, 9 aa, Homo Sapiens
FYLWKCLAS

SEQ ID NO: 376659 - protein, 9 aa, Homo Sapiens
PESTATAGW

SEQ ID NO: 376660 - protein, 9 aa, Homo Sapiens
STPPRGDHR

SEQ ID NO: 376661 - protein, 9 aa, Homo Sapiens
LQQALSAVS

SEQ ID NO: 376662 - protein, 9 aa, Homo Sapiens
NAPNGGFRC

SEQ ID NO: 376663 - protein, 9 aa, Homo Sapiens
RWDPCMPSC

SEQ ID NO: 376664 - protein, 9 aa, Homo Sapiens
LHNRELQCS

SEQ ID NO: 376665 - protein, 9 aa, Homo Sapiens
SVYELVMTA

SEQ ID NO: 376666 - protein, 9 aa, Homo Sapiens
MDTGRELAS

SEQ ID NO: 376667 - protein, 9 aa, Homo Sapiens
VVKHYLSKS

SEQ ID NO: 376668 - protein, 9 aa, Homo Sapiens
FSSSAPSSL

SEQ ID NO: 376669 - protein, 9 aa, Homo Sapiens
LDTHRKLEE

SEQ ID NO: 376670 - protein, 9 aa, Homo Sapiens
VFYVDHVNL

SEQ ID NO: 376671 - protein, 9 aa, Homo Sapiens
MEAVLRYPG

SEQ ID NO: 376672 - protein, 9 aa, Homo Sapiens
FQLLQQQQQ

SEQ ID NO: 376673 - protein, 9 aa, Homo Sapiens
QMSWKPCGP

SEQ ID NO: 376674 - protein, 9 aa, Homo Sapiens
LPQAFLLLL

SEQ ID NO: 376675 - protein, 9 aa, Homo Sapiens
QLHRWDPCM

SEQ ID NO: 376676 - protein, 9 aa, Homo Sapiens
PPRLLAHLC

SEQ ID NO: 376677 - protein, 9 aa, Homo Sapiens
DLTSLSTVR

SEQ ID NO: 376678 - protein, 9 aa, Homo Sapiens
EKERKGARK

SEQ ID NO: 376679 - protein, 9 aa, Homo Sapiens
EFTEVPEVR

SEQ ID NO: 376680 - protein, 9 aa, Homo Sapiens
RIHVGKVLH

SEQ ID NO: 376681 - protein, 9 aa, Homo Sapiens
IFGDQVVRY

SEQ ID NO: 376682 - protein, 9 aa, Homo Sapiens
FQILKPAET

SEQ ID NO: 376683 - protein, 9 aa, Homo Sapiens
FFLCWIPIF

SEQ ID NO: 376684 - protein, 9 aa, Homo Sapiens
LRYPGLLGL

SEQ ID NO: 376685 - protein, 9 aa, Homo Sapiens
PAIDYHICL

SEQ ID NO: 376686 - protein, 9 aa, Homo Sapiens
PPLPQAFLL

SEQ ID NO: 376687 - protein, 9 aa, Homo Sapiens
WIWVSMTLC

SEQ ID NO: 376688 - protein, 9 aa, Homo Sapiens
HLVTQLEEQ

SEQ ID NO: 376689 - protein, 9 aa, Homo Sapiens
QTSEDCSGM

SEQ ID NO: 376690 - protein, 9 aa, Homo Sapiens
HGVDASISV

SEQ ID NO: 376691 - protein, 9 aa, Homo Sapiens
KQHQDDEPV

SEQ ID NO: 376692 - protein, 9 aa, Homo Sapiens
FQPFPAVPQ

SEQ ID NO: 376693 - protein, 9 aa, Homo Sapiens
HEAFHAMAA

SEQ ID NO: 376694 - protein, 9 aa, Homo Sapiens
HFAGELQQA

SEQ ID NO: 376695 - protein, 9 aa, Homo Sapiens
LIIFGDQVV

SEQ ID NO: 376696 - protein, 9 aa, Homo Sapiens
AAAPTTAAN

SEQ ID NO: 376697 - protein, 9 aa, Homo Sapiens
SLAHWRSCG

SEQ ID NO: 376698 - protein, 9 aa, Homo Sapiens
IMRRIMEIP

SEQ ID NO: 376699 - protein, 9 aa, Homo Sapiens
LPYDVINTF

SEQ ID NO: 376700 - protein, 9 aa, Homo Sapiens
GQSQAHRPH

SEQ ID NO: 376701 - protein, 9 aa, Homo Sapiens
AVGVGKSAL

SEQ ID NO: 376702 - protein, 9 aa, Homo Sapiens
AQASLAHWR

SEQ ID NO: 376703 - protein, 9 aa, Homo Sapiens
RNRHQEWNM

SEQ ID NO: 376704 - protein, 9 aa, Homo Sapiens
KTIPRCCPA

SEQ ID NO: 376705 - protein, 9 aa, Homo Sapiens
ERQKIVELA

SEQ ID NO: 376706 - protein, 9 aa, Homo Sapiens
CSASWTTRG

SEQ ID NO: 376707 - protein, 9 aa, Homo Sapiens
ADLRHSQPR

SEQ ID NO: 376708 - protein, 9 aa, Homo Sapiens
SARPQLEFV

SEQ ID NO: 376709 - protein, 9 aa, Homo Sapiens
ELHDIHSTH

SEQ ID NO: 376710 - protein, 9 aa, Homo Sapiens
ELLTNVWVQ

SEQ ID NO: 376711 - protein, 9 aa, Homo Sapiens
PTCSRARLT

SEQ ID NO: 376712 - protein, 9 aa, Homo Sapiens
TNSSVIMRV

SEQ ID NO: 376713 - protein, 9 aa, Homo Sapiens
TPGWSRAAA

SEQ ID NO: 376714 - protein, 9 aa, Homo Sapiens
LQMAISFLT

SEQ ID NO: 376715 - protein, 9 aa, Homo Sapiens
VSHARTSYP

SEQ ID NO: 376716 - protein, 9 aa, Homo Sapiens
EYFMKQIND

SEQ ID NO: 376717 - protein, 9 aa, Homo Sapiens
CLPYDVINT

SEQ ID NO: 376718 - protein, 9 aa, Homo Sapiens
VTEEMVNLA

SEQ ID NO: 376719 - protein, 9 aa, Homo Sapiens
IQSIIKEGI

SEQ ID NO: 376720 - protein, 9 aa, Homo Sapiens
DSDPKEKEV

SEQ ID NO: 376721 - protein, 9 aa, Homo Sapiens
EKHAKKITS

SEQ ID NO: 376722 - protein, 9 aa, Homo Sapiens
DSSVCVLDL

SEQ ID NO: 376723 - protein, 9 aa, Homo Sapiens
ASLAHWRSC

SEQ ID NO: 376724 - protein, 9 aa, Homo Sapiens
DEMKCSGQL

SEQ ID NO: 376725 - protein, 9 aa, Homo Sapiens
SRVRSGRAC

SEQ ID NO: 376726 - protein, 9 aa, Homo Sapiens
RVTNSSVIM

SEQ ID NO: 376727 - protein, 9 aa, Homo Sapiens
SSVCVLDLR

SEQ ID NO: 376728 - protein, 9 aa, Homo Sapiens
VKHYLSKSD

SEQ ID NO: 376729 - protein, 9 aa, Homo Sapiens
RDTAQQSQC

SEQ ID NO: 376730 - protein, 9 aa, Homo Sapiens
APSSLRSSS

SEQ ID NO: 376731 - protein, 9 aa, Homo Sapiens
HGYPYIDLD

SEQ ID NO: 376732 - protein, 9 aa, Homo Sapiens
PGWSRAAAP

SEQ ID NO: 376733 - protein, 9 aa, Homo Sapiens
KVGASASDS

SEQ ID NO: 376734 - protein, 9 aa, Homo Sapiens
PESFLLASE

SEQ ID NO: 376735 - protein, 9 aa, Homo Sapiens
EENRDTAQQ

SEQ ID NO: 376736 - protein, 9 aa, Homo Sapiens
FNNHQPMDP

SEQ ID NO: 376737 - protein, 9 aa, Homo Sapiens
GTCTNAPNG

SEQ ID NO: 376738 - protein, 9 aa, Homo Sapiens
GWTCRATTT

SEQ ID NO: 376739 - protein, 9 aa, Homo Sapiens
WTLPSAAAP

SEQ ID NO: 376740 - protein, 9 aa, Homo Sapiens
CQILTRATL

SEQ ID NO: 376741 - protein, 9 aa, Homo Sapiens
VSFNSGERL

SEQ ID NO: 376742 - protein, 9 aa, Homo Sapiens
LPSPSSKDR

SEQ ID NO: 376743 - protein, 9 aa, Homo Sapiens
SFSPPSPVG

SEQ ID NO: 376744 - protein, 9 aa, Homo Sapiens
NVHILTGFA

SEQ ID NO: 376745 - protein, 9 aa, Homo Sapiens
PHPPPPKPT

SEQ ID NO: 376746 - protein, 9 aa, Homo Sapiens
DMDTGRELA

SEQ ID NO: 376747 - protein, 9 aa, Homo Sapiens
PSLFGWAQN

SEQ ID NO: 376748 - protein, 9 aa, Homo Sapiens
CLLLLGTQH

SEQ ID NO: 376749 - protein, 9 aa, Homo Sapiens
QRSEEIPMD

SEQ ID NO: 376750 - protein, 9 aa, Homo Sapiens
EEWRDELSE

SEQ ID NO: 376751 - protein, 9 aa, Homo Sapiens
SDSLKPTVA

SEQ ID NO: 376752 - protein, 9 aa, Homo Sapiens
LLLLLAGGG

SEQ ID NO: 376753 - protein, 9 aa, Homo Sapiens
VGCEIICPE

SEQ ID NO: 376754 - protein, 9 aa, Homo Sapiens
LGWPRHTAV

SEQ ID NO: 376755 - protein, 9 aa, Homo Sapiens
DLEVSFNSG

SEQ ID NO: 376756 - protein, 9 aa, Homo Sapiens
RWGPAAPSS

SEQ ID NO: 376757 - protein, 9 aa, Homo Sapiens
PDRVRAAVS

SEQ ID NO: 376758 - protein, 9 aa, Homo Sapiens
KLVVVGAVG

SEQ ID NO: 376759 - protein, 9 aa, Homo Sapiens
EFFIGLSDH

SEQ ID NO: 376760 - protein, 9 aa, Homo Sapiens
YYNLPEVKK

SEQ ID NO: 376761 - protein, 9 aa, Homo Sapiens
YVASVLEAV

SEQ ID NO: 376762 - protein, 9 aa, Homo Sapiens
MEIPETVSR

SEQ ID NO: 376763 - protein, 9 aa, Homo Sapiens
ARSATVAPR

SEQ ID NO: 376764 - protein, 9 aa, Homo Sapiens
TRDVVKHYL

SEQ ID NO: 376765 - protein, 9 aa, Homo Sapiens
QMAVIKPFP

SEQ ID NO: 376766 - protein, 9 aa, Homo Sapiens
CEIICPENS

SEQ ID NO: 376767 - protein, 9 aa, Homo Sapiens
CQPSVCMPV

SEQ ID NO: 376768 - protein, 9 aa, Homo Sapiens
RTEELNQEV

SEQ ID NO: 376769 - protein, 9 aa, Homo Sapiens
EYDLTSLST

SEQ ID NO: 376770 - protein, 9 aa, Homo Sapiens
SPSAGNVHI

SEQ ID NO: 376771 - protein, 9 aa, Homo Sapiens
AIVTYMSPK

SEQ ID NO: 376772 - protein, 9 aa, Homo Sapiens
NKSRQRVHY

SEQ ID NO: 376773 - protein, 9 aa, Homo Sapiens
ATVAPRPTP

SEQ ID NO: 376774 - protein, 9 aa, Homo Sapiens
AWLLYELQP

SEQ ID NO: 376775 - protein, 9 aa, Homo Sapiens
GNVTTRESI

SEQ ID NO: 376776 - protein, 9 aa, Homo Sapiens
GELQQALSA

SEQ ID NO: 376777 - protein, 9 aa, Homo Sapiens
AGGGVVVAW

SEQ ID NO: 376778 - protein, 9 aa, Homo Sapiens
PEDGTPLST

SEQ ID NO: 376779 - protein, 9 aa, Homo Sapiens
AALLCNYFL

SEQ ID NO: 376780 - protein, 9 aa, Homo Sapiens
FQTGLENGI

SEQ ID NO: 376781 - protein, 9 aa, Homo Sapiens
APILTSTTL

SEQ ID NO: 376782 - protein, 9 aa, Homo Sapiens
SIMRRIMEI

SEQ ID NO: 376783 - protein, 9 aa, Homo Sapiens
EEKHAKKIT

SEQ ID NO: 376784 - protein, 9 aa, Homo Sapiens
FESLRLLLK

SEQ ID NO: 376785 - protein, 9 aa, Homo Sapiens
CFEEWRDEL

SEQ ID NO: 376786 - protein, 9 aa, Homo Sapiens
TRWTLPSAA

SEQ ID NO: 376787 - protein, 9 aa, Homo Sapiens
ACVEDFYTV

SEQ ID NO: 376788 - protein, 9 aa, Homo Sapiens
KFFESLRLL

SEQ ID NO: 376789 - protein, 9 aa, Homo Sapiens
VTQLEEQHR

SEQ ID NO: 376790 - protein, 9 aa, Homo Sapiens
HQETYQKLL

SEQ ID NO: 376791 - protein, 9 aa, Homo Sapiens
HSTHSKERL

SEQ ID NO: 376792 - protein, 9 aa, Homo Sapiens
CRICFEEWR

SEQ ID NO: 376793 - protein, 9 aa, Homo Sapiens
QCRSSSGSS

SEQ ID NO: 376794 - protein, 9 aa, Homo Sapiens
EIKKGNVTT

SEQ ID NO: 376795 - protein, 9 aa, Homo Sapiens
PDIEVDGFS

SEQ ID NO: 376796 - protein, 9 aa, Homo Sapiens
VNLTTTWQR

SEQ ID NO: 376797 - protein, 9 aa, Homo Sapiens
IHSTHSKER

SEQ ID NO: 376798 - protein, 9 aa, Homo Sapiens
SPESTATAG

SEQ ID NO: 376799 - protein, 9 aa, Homo Sapiens
RSLSTSPFS

SEQ ID NO: 376800 - protein, 9 aa, Homo Sapiens
NGKQHQDDE

SEQ ID NO: 376801 - protein, 9 aa, Homo Sapiens
LFFLCWIPI

SEQ ID NO: 376802 - protein, 9 aa, Homo Sapiens
HHCEHQETY

SEQ ID NO: 376803 - protein, 9 aa, Homo Sapiens
HVGKVLHKT

SEQ ID NO: 376804 - protein, 9 aa, Homo Sapiens
KMCIHCLEN

SEQ ID NO: 376805 - protein, 9 aa, Homo Sapiens
TSEDCSGMP

SEQ ID NO: 376806 - protein, 9 aa, Homo Sapiens
LDNTVVGQM

SEQ ID NO: 376807 - protein, 9 aa, Homo Sapiens
KEKKKGREK

SEQ ID NO: 376808 - protein, 9 aa, Homo Sapiens
FAQGHPLGP

SEQ ID NO: 376809 - protein, 9 aa, Homo Sapiens
RVYLCYDMD

SEQ ID NO: 376810 - protein, 9 aa, Homo Sapiens
KNSLWLSDG

SEQ ID NO: 376811 - protein, 9 aa, Homo Sapiens
GNVHILTGF

SEQ ID NO: 376812 - protein, 9 aa, Homo Sapiens
ERNGKQHQD

SEQ ID NO: 376813 - protein, 9 aa, Homo Sapiens
RICFEEWRD

SEQ ID NO: 376814 - protein, 9 aa, Homo Sapiens
PGGCGTREL

SEQ ID NO: 376815 - protein, 9 aa, Homo Sapiens
VYELVMTAR

SEQ ID NO: 376816 - protein, 9 aa, Homo Sapiens
ALLLPPPGG

SEQ ID NO: 376817 - protein, 9 aa, Homo Sapiens
CINLSEAGI

SEQ ID NO: 376818 - protein, 9 aa, Homo Sapiens
CEHQETYQK

SEQ ID NO: 376819 - protein, 9 aa, Homo Sapiens
ISDSDLEVS

SEQ ID NO: 376820 - protein, 9 aa, Homo Sapiens
WLRWGPAAP

SEQ ID NO: 376821 - protein, 9 aa, Homo Sapiens
YIFCNEREE

SEQ ID NO: 376822 - protein, 9 aa, Homo Sapiens
IGLSDHVVE

SEQ ID NO: 376823 - protein, 9 aa, Homo Sapiens
NRELQCSVL

SEQ ID NO: 376824 - protein, 9 aa, Homo Sapiens
PYDVINTFE

SEQ ID NO: 376825 - protein, 9 aa, Homo Sapiens
SSSAPSSLR

SEQ ID NO: 376826 - protein, 9 aa, Homo Sapiens
KCEECGKYF

SEQ ID NO: 376827 - protein, 9 aa, Homo Sapiens
RNLADLRHS

SEQ ID NO: 376828 - protein, 9 aa, Homo Sapiens
NLADLRHSQ

SEQ ID NO: 376829 - protein, 9 aa, Homo Sapiens
VLINLLETN

SEQ ID NO: 376830 - protein, 9 aa, Homo Sapiens
EAVLRYPGL

SEQ ID NO: 376831 - protein, 9 aa, Homo Sapiens
EFKQMRIEN

SEQ ID NO: 376832 - protein, 9 aa, Homo Sapiens
ENVEHYEEL

SEQ ID NO: 376833 - protein, 9 aa, Homo Sapiens
SSAQRTSTR

SEQ ID NO: 376834 - protein, 9 aa, Homo Sapiens
DRTRPRRRH

SEQ ID NO: 376835 - protein, 9 aa, Homo Sapiens
YKLVVVGAV

SEQ ID NO: 376836 - protein, 9 aa, Homo Sapiens
IEIHNFWCE

SEQ ID NO: 376837 - protein, 9 aa, Homo Sapiens
GSNVEAAMY

SEQ ID NO: 376838 - protein, 9 aa, Homo Sapiens
YFTEVKVDI

SEQ ID NO: 376839 - protein, 9 aa, Homo Sapiens
SMEDMMNDS

SEQ ID NO: 376840 - protein, 9 aa, Homo Sapiens
AIPTRAASD

SEQ ID NO: 376841 - protein, 9 aa, Homo Sapiens
TLMIPIQDL

SEQ ID NO: 376842 - protein, 9 aa, Homo Sapiens
AMKVDNFKT

SEQ ID NO: 376843 - protein, 9 aa, Homo Sapiens
GLSGFPGAK

SEQ ID NO: 376844 - protein, 9 aa, Homo Sapiens
TSGSMWLTA

SEQ ID NO: 376845 - protein, 9 aa, Homo Sapiens
WKKYHTFWK

SEQ ID NO: 376846 - protein, 9 aa, Homo Sapiens
VAAVNEAGV

SEQ ID NO: 376847 - protein, 9 aa, Homo Sapiens
SSDKSLTPL

SEQ ID NO: 376848 - protein, 9 aa, Homo Sapiens
LDEQQQKRL

SEQ ID NO: 376849 - protein, 9 aa, Homo Sapiens
LQKINTRTG

SEQ ID NO: 376850 - protein, 9 aa, Homo Sapiens
QSFSRYVSF

SEQ ID NO: 376851 - protein, 9 aa, Homo Sapiens
DMEKLQCLE

SEQ ID NO: 376852 - protein, 9 aa, Homo Sapiens
RVLDTNYRF

SEQ ID NO: 376853 - protein, 9 aa, Homo Sapiens
ACMRTSVSG

SEQ ID NO: 376854 - protein, 9 aa, Homo Sapiens
CGVRSITEE

SEQ ID NO: 376855 - protein, 9 aa, Homo Sapiens
DVMLDTYSN

SEQ ID NO: 376856 - protein, 9 aa, Homo Sapiens
LLFIFCFIV

SEQ ID NO: 376857 - protein, 9 aa, Homo Sapiens
AIKRYCCNG

SEQ ID NO: 376858 - protein, 9 aa, Homo Sapiens
DGQPQWEVE

SEQ ID NO: 376859 - protein, 9 aa, Homo Sapiens
LATGLYVLF

SEQ ID NO: 376860 - protein, 9 aa, Homo Sapiens
GKCIDQFVY

SEQ ID NO: 376861 - protein, 9 aa, Homo Sapiens
IKLTDYFTE

SEQ ID NO: 376862 - protein, 9 aa, Homo Sapiens
IVVCLHWFP

SEQ ID NO: 376863 - protein, 9 aa, Homo Sapiens
RMHEITHTG

SEQ ID NO: 376864 - protein, 9 aa, Homo Sapiens
CRTLPSAED

SEQ ID NO: 376865 - protein, 9 aa, Homo Sapiens
KKLNKVWTM

SEQ ID NO: 376866 - protein, 9 aa, Homo Sapiens
DVLKDDFEG

SEQ ID NO: 376867 - protein, 9 aa, Homo Sapiens
LIQGFREMS

SEQ ID NO: 376868 - protein, 9 aa, Homo Sapiens
PVGPESRAA

SEQ ID NO: 376869 - protein, 9 aa, Homo Sapiens
DNEILTAEE

SEQ ID NO: 376870 - protein, 9 aa, Homo Sapiens
GQDNPPDHD

SEQ ID NO: 376871 - protein, 9 aa, Homo Sapiens
NTLKGQGEK

SEQ ID NO: 376872 - protein, 9 aa, Homo Sapiens
SSSNAEESN

SEQ ID NO: 376873 - protein, 9 aa, Homo Sapiens
RPSNNSHPV

SEQ ID NO: 376874 - protein, 9 aa, Homo Sapiens
NNCFPEILK

SEQ ID NO: 376875 - protein, 9 aa, Homo Sapiens
QRLWWYYLL

SEQ ID NO: 376876 - protein, 9 aa, Homo Sapiens
LHAAAPAVA

SEQ ID NO: 376877 - protein, 9 aa, Homo Sapiens
AVYLNKNTY

SEQ ID NO: 376878 - protein, 9 aa, Homo Sapiens
AINNLRENK

SEQ ID NO: 376879 - protein, 9 aa, Homo Sapiens
YYWTLGKNK

SEQ ID NO: 376880 - protein, 9 aa, Homo Sapiens
PPIFRPIKR

SEQ ID NO: 376881 - protein, 9 aa, Homo Sapiens
ILFIFQMLV

SEQ ID NO: 376882 - protein, 9 aa, Homo Sapiens
YEKECSLSL

SEQ ID NO: 376883 - protein, 9 aa, Homo Sapiens
QKEAEKLLP

SEQ ID NO: 376884 - protein, 9 aa, Homo Sapiens
MIRAHEAQD

SEQ ID NO: 376885 - protein, 9 aa, Homo Sapiens
QVLDSNNFK

SEQ ID NO: 376886 - protein, 9 aa, Homo Sapiens
SNINNVVLD

SEQ ID NO: 376887 - protein, 9 aa, Homo Sapiens
SGFIKPTKN

SEQ ID NO: 376888 - protein, 9 aa, Homo Sapiens
GIKKAIAAN

SEQ ID NO: 376889 - protein, 9 aa, Homo Sapiens
NGINSSAKN

SEQ ID NO: 376890 - protein, 9 aa, Homo Sapiens
CRCYYGSDT

SEQ ID NO: 376891 - protein, 9 aa, Homo Sapiens
YWKLSMQCK

SEQ ID NO: 376892 - protein, 9 aa, Homo Sapiens
RGATRGVCG

SEQ ID NO: 376893 - protein, 9 aa, Homo Sapiens
EGFQTFSKK

SEQ ID NO: 376894 - protein, 9 aa, Homo Sapiens
RLQQNVASL

SEQ ID NO: 376895 - protein, 9 aa, Homo Sapiens
SPGRTYFRR

SEQ ID NO: 376896 - protein, 9 aa, Homo Sapiens
FLSFLSLTG

SEQ ID NO: 376897 - protein, 9 aa, Homo Sapiens
KLLKLPNLS

SEQ ID NO: 376898 - protein, 9 aa, Homo Sapiens
VFVGSAMHS

SEQ ID NO: 376899 - protein, 9 aa, Homo Sapiens
SDQLVPDIN

SEQ ID NO: 376900 - protein, 9 aa, Homo Sapiens
EHKIIHTRE

SEQ ID NO: 376901 - protein, 9 aa, Homo Sapiens
CISQRHQTK

SEQ ID NO: 376902 - protein, 9 aa, Homo Sapiens
GLSISETGS

SEQ ID NO: 376903 - protein, 9 aa, Homo Sapiens
AYAAHATRI

SEQ ID NO: 376904 - protein, 9 aa, Homo Sapiens
AISYVHILC

SEQ ID NO: 376905 - protein, 9 aa, Homo Sapiens
STSYWRRWT

SEQ ID NO: 376906 - protein, 9 aa, Homo Sapiens
QLNLKVIQL

SEQ ID NO: 376907 - protein, 9 aa, Homo Sapiens
AIVSISALS

SEQ ID NO: 376908 - protein, 9 aa, Homo Sapiens
YIRVSSELQ

SEQ ID NO: 376909 - protein, 9 aa, Homo Sapiens
YIIFSLEIR

SEQ ID NO: 376910 - protein, 9 aa, Homo Sapiens
TVAAVNEAG

SEQ ID NO: 376911 - protein, 9 aa, Homo Sapiens
LWQEGFLTD

SEQ ID NO: 376912 - protein, 9 aa, Homo Sapiens
GKPESKLFL

SEQ ID NO: 376913 - protein, 9 aa, Homo Sapiens
PGHHVEEST

SEQ ID NO: 376914 - protein, 9 aa, Homo Sapiens
LFSSFEIQA

SEQ ID NO: 376915 - protein, 9 aa, Homo Sapiens
FIENSKLFE

SEQ ID NO: 376916 - protein, 9 aa, Homo Sapiens
TKSVGPWKM

SEQ ID NO: 376917 - protein, 9 aa, Homo Sapiens
AFSVGLQNC

SEQ ID NO: 376918 - protein, 9 aa, Homo Sapiens
KELFAELDK

SEQ ID NO: 376919 - protein, 9 aa, Homo Sapiens
WHHYKCPGM

SEQ ID NO: 376920 - protein, 9 aa, Homo Sapiens
PACCKPVCC

SEQ ID NO: 376921 - protein, 9 aa, Homo Sapiens
DFIDAYTSL

SEQ ID NO: 376922 - protein, 9 aa, Homo Sapiens
SGKGYALGE

SEQ ID NO: 376923 - protein, 9 aa, Homo Sapiens
LPLSLIFLL

SEQ ID NO: 376924 - protein, 9 aa, Homo Sapiens
VMREDLFII

SEQ ID NO: 376925 - protein, 9 aa, Homo Sapiens
VMFFIVLFA

SEQ ID NO: 376926 - protein, 9 aa, Homo Sapiens
TPVWYGLRL

SEQ ID NO: 376927 - protein, 9 aa, Homo Sapiens
SPRITTLCL

SEQ ID NO: 376928 - protein, 9 aa, Homo Sapiens
MLVASWYVD

SEQ ID NO: 376929 - protein, 9 aa, Homo Sapiens
ARSWKTSQR

SEQ ID NO: 376930 - protein, 9 aa, Homo Sapiens
QNEEEEEAI

SEQ ID NO: 376931 - protein, 9 aa, Homo Sapiens
VQRKYIQIP

SEQ ID NO: 376932 - protein, 9 aa, Homo Sapiens
VGFISMINR

SEQ ID NO: 376933 - protein, 9 aa, Homo Sapiens
ELMSCHDES

SEQ ID NO: 376934 - protein, 9 aa, Homo Sapiens
KPSVNYFIS

SEQ ID NO: 376935 - protein, 9 aa, Homo Sapiens
PDGVFMYFE

SEQ ID NO: 376936 - protein, 9 aa, Homo Sapiens
ALRFFDYEQ

SEQ ID NO: 376937 - protein, 9 aa, Homo Sapiens
RRNQDKFSS

SEQ ID NO: 376938 - protein, 9 aa, Homo Sapiens
CFLFETENV

SEQ ID NO: 376939 - protein, 9 aa, Homo Sapiens
SLKPLKLKR

SEQ ID NO: 376940 - protein, 9 aa, Homo Sapiens
LKHRLQQNV

SEQ ID NO: 376941 - protein, 9 aa, Homo Sapiens
EKVTEMNNS

SEQ ID NO: 376942 - protein, 9 aa, Homo Sapiens
QDKFSSISL

SEQ ID NO: 376943 - protein, 9 aa, Homo Sapiens
AQECSSNLT

SEQ ID NO: 376944 - protein, 9 aa, Homo Sapiens
GIAWAKTYA

SEQ ID NO: 376945 - protein, 9 aa, Homo Sapiens
QLTLSPAAI

SEQ ID NO: 376946 - protein, 9 aa, Homo Sapiens
YINNPYNIF

SEQ ID NO: 376947 - protein, 9 aa, Homo Sapiens
YEKESKFIE

SEQ ID NO: 376948 - protein, 9 aa, Homo Sapiens
APSWDMYSH

SEQ ID NO: 376949 - protein, 9 aa, Homo Sapiens
NSFNTDKNI

SEQ ID NO: 376950 - protein, 9 aa, Homo Sapiens
KHGKDWQNH

SEQ ID NO: 376951 - protein, 9 aa, Homo Sapiens
EGYWLPPPM

SEQ ID NO: 376952 - protein, 9 aa, Homo Sapiens
IQVRAASAP

SEQ ID NO: 376953 - protein, 9 aa, Homo Sapiens
ALWMVFMCA

SEQ ID NO: 376954 - protein, 9 aa, Homo Sapiens
NLMEHKIIH

SEQ ID NO: 376955 - protein, 9 aa, Homo Sapiens
KTLIIQDMD

SEQ ID NO: 376956 - protein, 9 aa, Homo Sapiens
VLLGLSFRR

SEQ ID NO: 376957 - protein, 9 aa, Homo Sapiens
DPQVWMDAD

SEQ ID NO: 376958 - protein, 9 aa, Homo Sapiens
IITVIDTKT

SEQ ID NO: 376959 - protein, 9 aa, Homo Sapiens
NQAFYLPPG

SEQ ID NO: 376960 - protein, 9 aa, Homo Sapiens
DNRQSLISF

SEQ ID NO: 376961 - protein, 9 aa, Homo Sapiens
VEFLSLINV

SEQ ID NO: 376962 - protein, 9 aa, Homo Sapiens
PTLEVGSDC

SEQ ID NO: 376963 - protein, 9 aa, Homo Sapiens
NMHDSSLVA

SEQ ID NO: 376964 - protein, 9 aa, Homo Sapiens
HKQYYEGSD

SEQ ID NO: 376965 - protein, 9 aa, Homo Sapiens
NATGDGKCI

SEQ ID NO: 376966 - protein, 9 aa, Homo Sapiens
ITMIPTDEE

SEQ ID NO: 376967 - protein, 9 aa, Homo Sapiens
TGVLYALRF

SEQ ID NO: 376968 - protein, 9 aa, Homo Sapiens
GHILDRERF

SEQ ID NO: 376969 - protein, 9 aa, Homo Sapiens
KHGDFHFTD

SEQ ID NO: 376970 - protein, 9 aa, Homo Sapiens
SFEYVIFNE

SEQ ID NO: 376971 - protein, 9 aa, Homo Sapiens
PATQIRTKQ

SEQ ID NO: 376972 - protein, 9 aa, Homo Sapiens
QIHTSEGRH

SEQ ID NO: 376973 - protein, 9 aa, Homo Sapiens
MNNVFAHLP

SEQ ID NO: 376974 - protein, 9 aa, Homo Sapiens
SSTQLLMSV

SEQ ID NO: 376975 - protein, 9 aa, Homo Sapiens
HFFCKIPPL

SEQ ID NO: 376976 - protein, 9 aa, Homo Sapiens
GHQHCQKYY

SEQ ID NO: 376977 - protein, 9 aa, Homo Sapiens
NLIVHKIIH

SEQ ID NO: 376978 - protein, 9 aa, Homo Sapiens
ANKNDGYVD

SEQ ID NO: 376979 - protein, 9 aa, Homo Sapiens
PAAIPTRAA

SEQ ID NO: 376980 - protein, 9 aa, Homo Sapiens
LRALTEANK

SEQ ID NO: 376981 - protein, 9 aa, Homo Sapiens
LSDPFYPPI

SEQ ID NO: 376982 - protein, 9 aa, Homo Sapiens
IIYACARWF

SEQ ID NO: 376983 - protein, 9 aa, Homo Sapiens
YEGSDIVVA

SEQ ID NO: 376984 - protein, 9 aa, Homo Sapiens
LWDKPFISS

SEQ ID NO: 376985 - protein, 9 aa, Homo Sapiens
GNQNGYRGH

SEQ ID NO: 376986 - protein, 9 aa, Homo Sapiens
TFLQHSEIN

SEQ ID NO: 376987 - protein, 9 aa, Homo Sapiens
LPRKKSTII

SEQ ID NO: 376988 - protein, 9 aa, Homo Sapiens
FAVNLFVGA

SEQ ID NO: 376989 - protein, 9 aa, Homo Sapiens
EIFNKYNND

SEQ ID NO: 376990 - protein, 9 aa, Homo Sapiens
SRTLRTNKL

SEQ ID NO: 376991 - protein, 9 aa, Homo Sapiens
SFNKTAPIK

SEQ ID NO: 376992 - protein, 9 aa, Homo Sapiens
HPDITCGDP

SEQ ID NO: 376993 - protein, 9 aa, Homo Sapiens
TPINKQEAK

SEQ ID NO: 376994 - protein, 9 aa, Homo Sapiens
DQAVNEWGR

SEQ ID NO: 376995 - protein, 9 aa, Homo Sapiens
HTKEQPYTC

SEQ ID NO: 376996 - protein, 9 aa, Homo Sapiens
IELWENKVL

SEQ ID NO: 376997 - protein, 9 aa, Homo Sapiens
RDLMEAVFK

SEQ ID NO: 376998 - protein, 9 aa, Homo Sapiens
GAAPATPAD

SEQ ID NO: 376999 - protein, 9 aa, Homo Sapiens
QNNLYRDVM

SEQ ID NO: 377000 - protein, 9 aa, Homo Sapiens
TNVKKLNPN

SEQ ID NO: 377001 - protein, 9 aa, Homo Sapiens
TEHKIIHTR

SEQ ID NO: 377002 - protein, 9 aa, Homo Sapiens
GINMAAVRH

SEQ ID NO: 377003 - protein, 9 aa, Homo Sapiens
PRPSLSSDS

SEQ ID NO: 377004 - protein, 9 aa, Homo Sapiens
SIMPIVVCL

SEQ ID NO: 377005 - protein, 9 aa, Homo Sapiens
QNYKACMRT

SEQ ID NO: 377006 - protein, 9 aa, Homo Sapiens
FGGDDYCSL

SEQ ID NO: 377007 - protein, 9 aa, Homo Sapiens
SKMEYMTDY

SEQ ID NO: 377008 - protein, 9 aa, Homo Sapiens
IKENSLPKP

SEQ ID NO: 377009 - protein, 9 aa, Homo Sapiens
NSASPPADT

SEQ ID NO: 377010 - protein, 9 aa, Homo Sapiens
EKKKLQTIL

SEQ ID NO: 377011 - protein, 9 aa, Homo Sapiens
HNNQFLDIW

SEQ ID NO: 377012 - protein, 9 aa, Homo Sapiens
ELEDERKQW

SEQ ID NO: 377013 - protein, 9 aa, Homo Sapiens
RAFMGVNNW

SEQ ID NO: 377014 - protein, 9 aa, Homo Sapiens
ANFISNSKG

SEQ ID NO: 377015 - protein, 9 aa, Homo Sapiens
NLMRHRIIH

SEQ ID NO: 377016 - protein, 9 aa, Homo Sapiens
LKTKQEERE

SEQ ID NO: 377017 - protein, 9 aa, Homo Sapiens
EGSRAPHSN

SEQ ID NO: 377018 - protein, 9 aa, Homo Sapiens
RNELKSCRS

SEQ ID NO: 377019 - protein, 9 aa, Homo Sapiens
VSQKKKQNN

SEQ ID NO: 377020 - protein, 9 aa, Homo Sapiens
TILWHQGCK

SEQ ID NO: 377021 - protein, 9 aa, Homo Sapiens
KLCITGGIT

SEQ ID NO: 377022 - protein, 9 aa, Homo Sapiens
IKAIEEGYW

SEQ ID NO: 377023 - protein, 9 aa, Homo Sapiens
HQKEGKEQL

SEQ ID NO: 377024 - protein, 9 aa, Homo Sapiens
MASMGQHSS

SEQ ID NO: 377025 - protein, 9 aa, Homo Sapiens
ASNADKMVY

SEQ ID NO: 377026 - protein, 9 aa, Homo Sapiens
RSWKTSQRD

SEQ ID NO: 377027 - protein, 9 aa, Homo Sapiens
VWELFEELD

SEQ ID NO: 377028 - protein, 9 aa, Homo Sapiens
ISSNQLHRV

SEQ ID NO: 377029 - protein, 9 aa, Homo Sapiens
TIHSLHDFG

SEQ ID NO: 377030 - protein, 9 aa, Homo Sapiens
ICKQEDKLG

SEQ ID NO: 377031 - protein, 9 aa, Homo Sapiens
ILSLLRLIS

SEQ ID NO: 377032 - protein, 9 aa, Homo Sapiens
WIPQLVDSG

SEQ ID NO: 377033 - protein, 9 aa, Homo Sapiens
FFNLETVQV

SEQ ID NO: 377034 - protein, 9 aa, Homo Sapiens
EKYISDNSS

SEQ ID NO: 377035 - protein, 9 aa, Homo Sapiens
LWENKVLRL

SEQ ID NO: 377036 - protein, 9 aa, Homo Sapiens
SKTFTSSDK

SEQ ID NO: 377037 - protein, 9 aa, Homo Sapiens
NRVDISISQ

SEQ ID NO: 377038 - protein, 9 aa, Homo Sapiens
VGPWKMVVW

SEQ ID NO: 377039 - protein, 9 aa, Homo Sapiens
RAQMGPTKE

SEQ ID NO: 377040 - protein, 9 aa, Homo Sapiens
GLWGPPGPP

SEQ ID NO: 377041 - protein, 9 aa, Homo Sapiens
LSKEQKELF

SEQ ID NO: 377042 - protein, 9 aa, Homo Sapiens
MFILNHLLW

SEQ ID NO: 377043 - protein, 9 aa, Homo Sapiens
FIITFSYGN

SEQ ID NO: 377044 - protein, 9 aa, Homo Sapiens
YHWPSLVQE

SEQ ID NO: 377045 - protein, 9 aa, Homo Sapiens
SSAWKHNFN

SEQ ID NO: 377046 - protein, 9 aa, Homo Sapiens
LTNQKDYLG

SEQ ID NO: 377047 - protein, 9 aa, Homo Sapiens
GLGDIQPGV

SEQ ID NO: 377048 - protein, 9 aa, Homo Sapiens
EKQRLWWYY

SEQ ID NO: 377049 - protein, 9 aa, Homo Sapiens
KAVAFTSKE

SEQ ID NO: 377050 - protein, 9 aa, Homo Sapiens
KIPPLLALS

SEQ ID NO: 377051 - protein, 9 aa, Homo Sapiens
FELLNLLAE

SEQ ID NO: 377052 - protein, 9 aa, Homo Sapiens
ANRARNINN

SEQ ID NO: 377053 - protein, 9 aa, Homo Sapiens
PSLITQERD

SEQ ID NO: 377054 - protein, 9 aa, Homo Sapiens
PLQFELCHQ

SEQ ID NO: 377055 - protein, 9 aa, Homo Sapiens
EQQAQFIWK

SEQ ID NO: 377056 - protein, 9 aa, Homo Sapiens
VWMAPEVIK

SEQ ID NO: 377057 - protein, 9 aa, Homo Sapiens
SGFWRSDDM

SEQ ID NO: 377058 - protein, 9 aa, Homo Sapiens
GNSHSGHFA

SEQ ID NO: 377059 - protein, 9 aa, Homo Sapiens
FPTQEEIEN

SEQ ID NO: 377060 - protein, 9 aa, Homo Sapiens
RMSRPLMNL

SEQ ID NO: 377061 - protein, 9 aa, Homo Sapiens
SISKNFPNN

SEQ ID NO: 377062 - protein, 9 aa, Homo Sapiens
QENKQKMDK

SEQ ID NO: 377063 - protein, 9 aa, Homo Sapiens
IRSQINYLV

SEQ ID NO: 377064 - protein, 9 aa, Homo Sapiens
ISETGSTIS

SEQ ID NO: 377065 - protein, 9 aa, Homo Sapiens
SFVGICFSG

SEQ ID NO: 377066 - protein, 9 aa, Homo Sapiens
LVSIEKEKS

SEQ ID NO: 377067 - protein, 9 aa, Homo Sapiens
HYLTEVKYN

SEQ ID NO: 377068 - protein, 9 aa, Homo Sapiens
QNGTLMIPI

SEQ ID NO: 377069 - protein, 9 aa, Homo Sapiens
SGKPEVQLR

SEQ ID NO: 377070 - protein, 9 aa, Homo Sapiens
CRCSFQARP

SEQ ID NO: 377071 - protein, 9 aa, Homo Sapiens
LEESDKFYV

SEQ ID NO: 377072 - protein, 9 aa, Homo Sapiens
LVSFVGICF

SEQ ID NO: 377073 - protein, 9 aa, Homo Sapiens
STAEVKYNK

SEQ ID NO: 377074 - protein, 9 aa, Homo Sapiens
SAIPTAINF

SEQ ID NO: 377075 - protein, 9 aa, Homo Sapiens
LISVYENKL

SEQ ID NO: 377076 - protein, 9 aa, Homo Sapiens
SSYSLTIYP

SEQ ID NO: 377077 - protein, 9 aa, Homo Sapiens
SERSSASGG

SEQ ID NO: 377078 - protein, 9 aa, Homo Sapiens
VASWYVDDL

SEQ ID NO: 377079 - protein, 9 aa, Homo Sapiens
VRILSKYHR

SEQ ID NO: 377080 - protein, 9 aa, Homo Sapiens
TEDKNFYLN

SEQ ID NO: 377081 - protein, 9 aa, Homo Sapiens
ILHTGVKPY

SEQ ID NO: 377082 - protein, 9 aa, Homo Sapiens
IIRLQAVLD

SEQ ID NO: 377083 - protein, 9 aa, Homo Sapiens
GRKIIELEV

SEQ ID NO: 377084 - protein, 9 aa, Homo Sapiens
LFMNVYIED

SEQ ID NO: 377085 - protein, 9 aa, Homo Sapiens
VGGTNQEFG

SEQ ID NO: 377086 - protein, 9 aa, Homo Sapiens
KEAFNYIKQ

SEQ ID NO: 377087 - protein, 9 aa, Homo Sapiens
GYINNPYNI

SEQ ID NO: 377088 - protein, 9 aa, Homo Sapiens
KKMSFQKII

SEQ ID NO: 377089 - protein, 9 aa, Homo Sapiens
EEEIDPFNV

SEQ ID NO: 377090 - protein, 9 aa, Homo Sapiens
KHNFNSPDC

SEQ ID NO: 377091 - protein, 9 aa, Homo Sapiens
GAILFTLFA

SEQ ID NO: 377092 - protein, 9 aa, Homo Sapiens
VTVPNMLLS

SEQ ID NO: 377093 - protein, 9 aa, Homo Sapiens
LYAIDWNPA

SEQ ID NO: 377094 - protein, 9 aa, Homo Sapiens
NNPTKRFRC

SEQ ID NO: 377095 - protein, 9 aa, Homo Sapiens
IWLSKNPYL

SEQ ID NO: 377096 - protein, 9 aa, Homo Sapiens
CWSVLKQKK

SEQ ID NO: 377097 - protein, 9 aa, Homo Sapiens
EIWLSKNPY

SEQ ID NO: 377098 - protein, 9 aa, Homo Sapiens
ITTLCLMFI

SEQ ID NO: 377099 - protein, 9 aa, Homo Sapiens
VFMYFEGYN

SEQ ID NO: 377100 - protein, 9 aa, Homo Sapiens
VFLHINRFL

SEQ ID NO: 377101 - protein, 9 aa, Homo Sapiens
RCDVQLVTN

SEQ ID NO: 377102 - protein, 9 aa, Homo Sapiens
SSNGIISSL

SEQ ID NO: 377103 - protein, 9 aa, Homo Sapiens
LGATIPLVG

SEQ ID NO: 377104 - protein, 9 aa, Homo Sapiens
KLPRKKSTI

SEQ ID NO: 377105 - protein, 9 aa, Homo Sapiens
QTCIGTPYY

SEQ ID NO: 377106 - protein, 9 aa, Homo Sapiens
GATQIPAVK

SEQ ID NO: 377107 - protein, 9 aa, Homo Sapiens
YVELAVLPK

SEQ ID NO: 377108 - protein, 9 aa, Homo Sapiens
SLEDFQNSC

SEQ ID NO: 377109 - protein, 9 aa, Homo Sapiens
MAGKGYETG

SEQ ID NO: 377110 - protein, 9 aa, Homo Sapiens
IMQKKYWKT

SEQ ID NO: 377111 - protein, 9 aa, Homo Sapiens
LLCVHGDAR

SEQ ID NO: 377112 - protein, 9 aa, Homo Sapiens
FPDIMADIS

SEQ ID NO: 377113 - protein, 9 aa, Homo Sapiens
QHCYHQFST

SEQ ID NO: 377114 - protein, 9 aa, Homo Sapiens
SAIVSISAL

SEQ ID NO: 377115 - protein, 9 aa, Homo Sapiens
RGRLNSELR

SEQ ID NO: 377116 - protein, 9 aa, Homo Sapiens
AILNNSRFA

SEQ ID NO: 377117 - protein, 9 aa, Homo Sapiens
KNFLGASPP

SEQ ID NO: 377118 - protein, 9 aa, Homo Sapiens
GTIYYTIIN

SEQ ID NO: 377119 - protein, 9 aa, Homo Sapiens
KLSLPESLK

SEQ ID NO: 377120 - protein, 9 aa, Homo Sapiens
VSIVCSILQ

SEQ ID NO: 377121 - protein, 9 aa, Homo Sapiens
IWEKLTGEP

SEQ ID NO: 377122 - protein, 9 aa, Homo Sapiens
GEFKKDGEL

SEQ ID NO: 377123 - protein, 9 aa, Homo Sapiens
QSRRSVWRA

SEQ ID NO: 377124 - protein, 9 aa, Homo Sapiens
NNNIAIVGL

SEQ ID NO: 377125 - protein, 9 aa, Homo Sapiens
LVWVVDVND

SEQ ID NO: 377126 - protein, 9 aa, Homo Sapiens
NILSLLRLI

SEQ ID NO: 377127 - protein, 9 aa, Homo Sapiens
KKTKGHKGK

SEQ ID NO: 377128 - protein, 9 aa, Homo Sapiens
SGKMWALSF

SEQ ID NO: 377129 - protein, 9 aa, Homo Sapiens
LGLWTLIIM

SEQ ID NO: 377130 - protein, 9 aa, Homo Sapiens
PAVFGVLGA

SEQ ID NO: 377131 - protein, 9 aa, Homo Sapiens
HVNNDQPIN

SEQ ID NO: 377132 - protein, 9 aa, Homo Sapiens
CALNKLVSR

SEQ ID NO: 377133 - protein, 9 aa, Homo Sapiens
LLDPGESGK

SEQ ID NO: 377134 - protein, 9 aa, Homo Sapiens
TEDYIHIKI

SEQ ID NO: 377135 - protein, 9 aa, Homo Sapiens
PIFKTNDGK

SEQ ID NO: 377136 - protein, 9 aa, Homo Sapiens
YRTLKGHWW

SEQ ID NO: 377137 - protein, 9 aa, Homo Sapiens
LLFSVRNNF

SEQ ID NO: 377138 - protein, 9 aa, Homo Sapiens
IGKNAALWE

SEQ ID NO: 377139 - protein, 9 aa, Homo Sapiens
FHALFLLFV

SEQ ID NO: 377140 - protein, 9 aa, Homo Sapiens
QILHRREKP

SEQ ID NO: 377141 - protein, 9 aa, Homo Sapiens
QSEHGPQTL

SEQ ID NO: 377142 - protein, 9 aa, Homo Sapiens
NKNTYLTVI

SEQ ID NO: 377143 - protein, 9 aa, Homo Sapiens
IPAIPSIIW

SEQ ID NO: 377144 - protein, 9 aa, Homo Sapiens
GLCIVELTL

SEQ ID NO: 377145 - protein, 9 aa, Homo Sapiens
GVQIQIIFF

SEQ ID NO: 377146 - protein, 9 aa, Homo Sapiens
EASEEAASV

SEQ ID NO: 377147 - protein, 9 aa, Homo Sapiens
NSLSLDKSE

SEQ ID NO: 377148 - protein, 9 aa, Homo Sapiens
GNQSSVWTL

SEQ ID NO: 377149 - protein, 9 aa, Homo Sapiens
GRPLSPLDK

SEQ ID NO: 377150 - protein, 9 aa, Homo Sapiens
LCLVEAAEA

SEQ ID NO: 377151 - protein, 9 aa, Homo Sapiens
IPTRAASDS

SEQ ID NO: 377152 - protein, 9 aa, Homo Sapiens
YFVIPSESD

SEQ ID NO: 377153 - protein, 9 aa, Homo Sapiens
AEDIKALKV

SEQ ID NO: 377154 - protein, 9 aa, Homo Sapiens
IRLQAVLDI

SEQ ID NO: 377155 - protein, 9 aa, Homo Sapiens
VIELWENKV

SEQ ID NO: 377156 - protein, 9 aa, Homo Sapiens
LSTANKNDG

SEQ ID NO: 377157 - protein, 9 aa, Homo Sapiens
DSHAEALCV

SEQ ID NO: 377158 - protein, 9 aa, Homo Sapiens
DYLGDIDSE

SEQ ID NO: 377159 - protein, 9 aa, Homo Sapiens
FGISSKELM

SEQ ID NO: 377160 - protein, 9 aa, Homo Sapiens
AKTGIEVSQ

SEQ ID NO: 377161 - protein, 9 aa, Homo Sapiens
LDPVQRNVY

SEQ ID NO: 377162 - protein, 9 aa, Homo Sapiens
ADKPYTCPK

SEQ ID NO: 377163 - protein, 9 aa, Homo Sapiens
IQKGQDEKD

SEQ ID NO: 377164 - protein, 9 aa, Homo Sapiens
REELNLMTL

SEQ ID NO: 377165 - protein, 9 aa, Homo Sapiens
SPAAIPTRA

SEQ ID NO: 377166 - protein, 9 aa, Homo Sapiens
VKVGNEFIT

SEQ ID NO: 377167 - protein, 9 aa, Homo Sapiens
VYNFRAKVC

SEQ ID NO: 377168 - protein, 9 aa, Homo Sapiens
RRWTYGFIQ

SEQ ID NO: 377169 - protein, 9 aa, Homo Sapiens
LEKQICIPR

SEQ ID NO: 377170 - protein, 9 aa, Homo Sapiens
GLAPGRKYV

SEQ ID NO: 377171 - protein, 9 aa, Homo Sapiens
PPFHLNKYS

SEQ ID NO: 377172 - protein, 9 aa, Homo Sapiens
WIFCPFLCH

SEQ ID NO: 377173 - protein, 9 aa, Homo Sapiens
IKLNCLNGI

SEQ ID NO: 377174 - protein, 9 aa, Homo Sapiens
IHNFWCEAM

SEQ ID NO: 377175 - protein, 9 aa, Homo Sapiens
LLLKRSQQN

SEQ ID NO: 377176 - protein, 9 aa, Homo Sapiens
QNSCQTTTY

SEQ ID NO: 377177 - protein, 9 aa, Homo Sapiens
TVIDTKTVG

SEQ ID NO: 377178 - protein, 9 aa, Homo Sapiens
LTETTSSPK

SEQ ID NO: 377179 - protein, 9 aa, Homo Sapiens
IEAKENEIK

SEQ ID NO: 377180 - protein, 9 aa, Homo Sapiens
TSIIDLRDK

SEQ ID NO: 377181 - protein, 9 aa, Homo Sapiens
MTIHQFVLL

SEQ ID NO: 377182 - protein, 9 aa, Homo Sapiens
WAQDNKLIL

SEQ ID NO: 377183 - protein, 9 aa, Homo Sapiens
LELDEQQQK

SEQ ID NO: 377184 - protein, 9 aa, Homo Sapiens
RDVMLDTYS

SEQ ID NO: 377185 - protein, 9 aa, Homo Sapiens
KRFYTRYSL

SEQ ID NO: 377186 - protein, 9 aa, Homo Sapiens
QRWIRRNQD

SEQ ID NO: 377187 - protein, 9 aa, Homo Sapiens
LYTHTACDA

SEQ ID NO: 377188 - protein, 9 aa, Homo Sapiens
PSCTYYMSE

SEQ ID NO: 377189 - protein, 9 aa, Homo Sapiens
QELVLLKIE

SEQ ID NO: 377190 - protein, 9 aa, Homo Sapiens
DLAAQNILL

SEQ ID NO: 377191 - protein, 9 aa, Homo Sapiens
MQTHTGEKP

SEQ ID NO: 377192 - protein, 9 aa, Homo Sapiens
SLPESLKAY

SEQ ID NO: 377193 - protein, 9 aa, Homo Sapiens
LESPVVYLK

SEQ ID NO: 377194 - protein, 9 aa, Homo Sapiens
LPLALTSSD

SEQ ID NO: 377195 - protein, 9 aa, Homo Sapiens
LLDSLWQEG

SEQ ID NO: 377196 - protein, 9 aa, Homo Sapiens
VGERGRLNS

SEQ ID NO: 377197 - protein, 9 aa, Homo Sapiens
EIASLIWNK

SEQ ID NO: 377198 - protein, 9 aa, Homo Sapiens
EVEQEVQQI

SEQ ID NO: 377199 - protein, 9 aa, Homo Sapiens
QNQVLDSNN

SEQ ID NO: 377200 - protein, 9 aa, Homo Sapiens
ELERQHILQ

SEQ ID NO: 377201 - protein, 9 aa, Homo Sapiens
KNILEMEII

SEQ ID NO: 377202 - protein, 9 aa, Homo Sapiens
PLLSLCHPN

SEQ ID NO: 377203 - protein, 9 aa, Homo Sapiens
RLWRLISYI

SEQ ID NO: 377204 - protein, 9 aa, Homo Sapiens
LEDDVIDGC

SEQ ID NO: 377205 - protein, 9 aa, Homo Sapiens
WSLFAVNLF

SEQ ID NO: 377206 - protein, 9 aa, Homo Sapiens
SSILVWVVD

SEQ ID NO: 377207 - protein, 9 aa, Homo Sapiens
IQWCQKEMG

SEQ ID NO: 377208 - protein, 9 aa, Homo Sapiens
SRHQILHTG

SEQ ID NO: 377209 - protein, 9 aa, Homo Sapiens
NTSMPTSTY

SEQ ID NO: 377210 - protein, 9 aa, Homo Sapiens
KLVERLKFK

SEQ ID NO: 377211 - protein, 9 aa, Homo Sapiens
SAFGERDTS

SEQ ID NO: 377212 - protein, 9 aa, Homo Sapiens
GVSQIIKLN

SEQ ID NO: 377213 - protein, 9 aa, Homo Sapiens
DLLSSEELD

SEQ ID NO: 377214 - protein, 9 aa, Homo Sapiens
ERGRLNSEL

SEQ ID NO: 377215 - protein, 9 aa, Homo Sapiens
AFVQKSAAQ

SEQ ID NO: 377216 - protein, 9 aa, Homo Sapiens
IIWQLGTLI

SEQ ID NO: 377217 - protein, 9 aa, Homo Sapiens
HLALSMMRL

SEQ ID NO: 377218 - protein, 9 aa, Homo Sapiens
LHIRKARVE

SEQ ID NO: 377219 - protein, 9 aa, Homo Sapiens
LTGSHKHCW

SEQ ID NO: 377220 - protein, 9 aa, Homo Sapiens
QKAASQTLC

SEQ ID NO: 377221 - protein, 9 aa, Homo Sapiens
KFHALFLLF

SEQ ID NO: 377222 - protein, 9 aa, Homo Sapiens
GSHKHCWCK

SEQ ID NO: 377223 - protein, 9 aa, Homo Sapiens
FNEDCQTSR

SEQ ID NO: 377224 - protein, 9 aa, Homo Sapiens
MEGQAATLK

SEQ ID NO: 377225 - protein, 9 aa, Homo Sapiens
YRNAQRKDS

SEQ ID NO: 377226 - protein, 9 aa, Homo Sapiens
NNQFLDIWQ

SEQ ID NO: 377227 - protein, 9 aa, Homo Sapiens
VQDRLMDLS

SEQ ID NO: 377228 - protein, 9 aa, Homo Sapiens
SLLCPGGSP

SEQ ID NO: 377229 - protein, 9 aa, Homo Sapiens
LEYLHSQRI

SEQ ID NO: 377230 - protein, 9 aa, Homo Sapiens
FLSQEEGAL

SEQ ID NO: 377231 - protein, 9 aa, Homo Sapiens
IKIDQAWKI

SEQ ID NO: 377232 - protein, 9 aa, Homo Sapiens
RDFIQDSGV

SEQ ID NO: 377233 - protein, 9 aa, Homo Sapiens
SFQKIIPDR

SEQ ID NO: 377234 - protein, 9 aa, Homo Sapiens
EAADNQRVE

SEQ ID NO: 377235 - protein, 9 aa, Homo Sapiens
GKYIIKHLI

SEQ ID NO: 377236 - protein, 9 aa, Homo Sapiens
KIWFQQKVM

SEQ ID NO: 377237 - protein, 9 aa, Homo Sapiens
LNSVINDIV

SEQ ID NO: 377238 - protein, 9 aa, Homo Sapiens
PINNLYATQ

SEQ ID NO: 377239 - protein, 9 aa, Homo Sapiens
RSESYTWLL

SEQ ID NO: 377240 - protein, 9 aa, Homo Sapiens
SYLTKEWAQ

SEQ ID NO: 377241 - protein, 9 aa, Homo Sapiens
QGLAPGRKY

SEQ ID NO: 377242 - protein, 9 aa, Homo Sapiens
EKENKKEPE

SEQ ID NO: 377243 - protein, 9 aa, Homo Sapiens
HAWAVMNFK

SEQ ID NO: 377244 - protein, 9 aa, Homo Sapiens
KKFPCTHPP

SEQ ID NO: 377245 - protein, 9 aa, Homo Sapiens
REKQFNLCL

SEQ ID NO: 377246 - protein, 9 aa, Homo Sapiens
KYNNDKKVR

SEQ ID NO: 377247 - protein, 9 aa, Homo Sapiens
KEGILQLRH

SEQ ID NO: 377248 - protein, 9 aa, Homo Sapiens
PAYTPNWDL

SEQ ID NO: 377249 - protein, 9 aa, Homo Sapiens
AIQNAGIVL

SEQ ID NO: 377250 - protein, 9 aa, Homo Sapiens
KKLPSNTEK

SEQ ID NO: 377251 - protein, 9 aa, Homo Sapiens
VWSGGSTDS

SEQ ID NO: 377252 - protein, 9 aa, Homo Sapiens
LCPGGSPAV

SEQ ID NO: 377253 - protein, 9 aa, Homo Sapiens
ACDVRCCCA

SEQ ID NO: 377254 - protein, 9 aa, Homo Sapiens
NKLILRLLS

SEQ ID NO: 377255 - protein, 9 aa, Homo Sapiens
YICDEGKDC

SEQ ID NO: 377256 - protein, 9 aa, Homo Sapiens
VSSQKKTAL

SEQ ID NO: 377257 - protein, 9 aa, Homo Sapiens
PSRGKDDGE

SEQ ID NO: 377258 - protein, 9 aa, Homo Sapiens
KDQLYLFIN

SEQ ID NO: 377259 - protein, 9 aa, Homo Sapiens
RHIWLSFDE

SEQ ID NO: 377260 - protein, 9 aa, Homo Sapiens
DTNELQLEA

SEQ ID NO: 377261 - protein, 9 aa, Homo Sapiens
GGEMTVIQS

SEQ ID NO: 377262 - protein, 9 aa, Homo Sapiens
SRRREQLIR

SEQ ID NO: 377263 - protein, 9 aa, Homo Sapiens
KIRKQEKRQ

SEQ ID NO: 377264 - protein, 9 aa, Homo Sapiens
VEHCLHMFN

SEQ ID NO: 377265 - protein, 9 aa, Homo Sapiens
PEERVSVTY

SEQ ID NO: 377266 - protein, 9 aa, Homo Sapiens
LHCRCSFQA

SEQ ID NO: 377267 - protein, 9 aa, Homo Sapiens
QNPGPQVAD

SEQ ID NO: 377268 - protein, 9 aa, Homo Sapiens
PRTIIQVVA

SEQ ID NO: 377269 - protein, 9 aa, Homo Sapiens
ASRVLQDFQ

SEQ ID NO: 377270 - protein, 9 aa, Homo Sapiens
LLTNMEVPD

SEQ ID NO: 377271 - protein, 9 aa, Homo Sapiens
SSFRLRSTS

SEQ ID NO: 377272 - protein, 9 aa, Homo Sapiens
SDLLRHHII

SEQ ID NO: 377273 - protein, 9 aa, Homo Sapiens
HLCSPFTSQ

SEQ ID NO: 377274 - protein, 9 aa, Homo Sapiens
RSYARNNPT

SEQ ID NO: 377275 - protein, 9 aa, Homo Sapiens
LLQGAIKSV

SEQ ID NO: 377276 - protein, 9 aa, Homo Sapiens
QCTKSVGPW

SEQ ID NO: 377277 - protein, 9 aa, Homo Sapiens
ETLQHIFWV

SEQ ID NO: 377278 - protein, 9 aa, Homo Sapiens
TIVASMTVW

SEQ ID NO: 377279 - protein, 9 aa, Homo Sapiens
CGHGECVSG

SEQ ID NO: 377280 - protein, 9 aa, Homo Sapiens
IIFAWGTLL

SEQ ID NO: 377281 - protein, 9 aa, Homo Sapiens
SVLDNEILT

SEQ ID NO: 377282 - protein, 9 aa, Homo Sapiens
DKEGRLFVL

SEQ ID NO: 377283 - protein, 9 aa, Homo Sapiens
AIKYASHSR

SEQ ID NO: 377284 - protein, 9 aa, Homo Sapiens
QGQDNPPDH

SEQ ID NO: 377285 - protein, 9 aa, Homo Sapiens
HLILYAIDW

SEQ ID NO: 377286 - protein, 9 aa, Homo Sapiens
NEYLFDRNR

SEQ ID NO: 377287 - protein, 9 aa, Homo Sapiens
TVLIEGKNI

SEQ ID NO: 377288 - protein, 9 aa, Homo Sapiens
IMLMVRLTW

SEQ ID NO: 377289 - protein, 9 aa, Homo Sapiens
NYRKALKFY

SEQ ID NO: 377290 - protein, 9 aa, Homo Sapiens
ISFTQCCVN

SEQ ID NO: 377291 - protein, 9 aa, Homo Sapiens
DTYSNLVFV

SEQ ID NO: 377292 - protein, 9 aa, Homo Sapiens
AHKEMEEGE

SEQ ID NO: 377293 - protein, 9 aa, Homo Sapiens
QVSQKKKQN

SEQ ID NO: 377294 - protein, 9 aa, Homo Sapiens
LDQVFSQSV

SEQ ID NO: 377295 - protein, 9 aa, Homo Sapiens
PDGRPELCW

SEQ ID NO: 377296 - protein, 9 aa, Homo Sapiens
TVYVIPGLK

SEQ ID NO: 377297 - protein, 9 aa, Homo Sapiens
YKEERKNIR

SEQ ID NO: 377298 - protein, 9 aa, Homo Sapiens
KKAIAANIS

SEQ ID NO: 377299 - protein, 9 aa, Homo Sapiens
WCKLQWSQS

SEQ ID NO: 377300 - protein, 9 aa, Homo Sapiens
LSLPESLKA

SEQ ID NO: 377301 - protein, 9 aa, Homo Sapiens
QRETTVIWE

SEQ ID NO: 377302 - protein, 9 aa, Homo Sapiens
RLGRRSSPS

SEQ ID NO: 377303 - protein, 9 aa, Homo Sapiens
KTGIDPYLS

SEQ ID NO: 377304 - protein, 9 aa, Homo Sapiens
LENYRNLVL

SEQ ID NO: 377305 - protein, 9 aa, Homo Sapiens
RQSLISFFQ

SEQ ID NO: 377306 - protein, 9 aa, Homo Sapiens
YLNLINDLQ

SEQ ID NO: 377307 - protein, 9 aa, Homo Sapiens
CTQLFGEPS

SEQ ID NO: 377308 - protein, 9 aa, Homo Sapiens
VGGVIGFLF

SEQ ID NO: 377309 - protein, 9 aa, Homo Sapiens
YRCDVQLVT

SEQ ID NO: 377310 - protein, 9 aa, Homo Sapiens
YLSPSSRPA

SEQ ID NO: 377311 - protein, 9 aa, Homo Sapiens
NHFFCKIPP

SEQ ID NO: 377312 - protein, 9 aa, Homo Sapiens
NCQTEKEKT

SEQ ID NO: 377313 - protein, 9 aa, Homo Sapiens
ANNFPAHIF

SEQ ID NO: 377314 - protein, 9 aa, Homo Sapiens
LGRKIIELE

SEQ ID NO: 377315 - protein, 9 aa, Homo Sapiens
SWKTSQRDT

SEQ ID NO: 377316 - protein, 9 aa, Homo Sapiens
EAVTALNRL

SEQ ID NO: 377317 - protein, 9 aa, Homo Sapiens
HLSRHQILH

SEQ ID NO: 377318 - protein, 9 aa, Homo Sapiens
VESFSQSPP

SEQ ID NO: 377319 - protein, 9 aa, Homo Sapiens
LLMARFSED

SEQ ID NO: 377320 - protein, 9 aa, Homo Sapiens
APTFGFGKP

SEQ ID NO: 377321 - protein, 9 aa, Homo Sapiens
MEAFQQELV

SEQ ID NO: 377322 - protein, 9 aa, Homo Sapiens
MLSVVTEDD

SEQ ID NO: 377323 - protein, 9 aa, Homo Sapiens
MVRLTWASH

SEQ ID NO: 377324 - protein, 9 aa, Homo Sapiens
HTFPTQEEI

SEQ ID NO: 377325 - protein, 9 aa, Homo Sapiens
VEKATVPAG

SEQ ID NO: 377326 - protein, 9 aa, Homo Sapiens
DMMNDSNEK

SEQ ID NO: 377327 - protein, 9 aa, Homo Sapiens
PPECVVAVV

SEQ ID NO: 377328 - protein, 9 aa, Homo Sapiens
PSLKHRLQQ

SEQ ID NO: 377329 - protein, 9 aa, Homo Sapiens
SEHIHEERK

SEQ ID NO: 377330 - protein, 9 aa, Homo Sapiens
YIYYGKNSE

SEQ ID NO: 377331 - protein, 9 aa, Homo Sapiens
FQQELVLLK

SEQ ID NO: 377332 - protein, 9 aa, Homo Sapiens
HMASMGQHS

SEQ ID NO: 377333 - protein, 9 aa, Homo Sapiens
EKTFWKKYH

SEQ ID NO: 377334 - protein, 9 aa, Homo Sapiens
LHINRFLEE

SEQ ID NO: 377335 - protein, 9 aa, Homo Sapiens
WGPGRPPFQ

SEQ ID NO: 377336 - protein, 9 aa, Homo Sapiens
SSQNYLDYF

SEQ ID NO: 377337 - protein, 9 aa, Homo Sapiens
NKQKMDKLL

SEQ ID NO: 377338 - protein, 9 aa, Homo Sapiens
SGTWCKLQW

SEQ ID NO: 377339 - protein, 9 aa, Homo Sapiens
YILDSWNKH

SEQ ID NO: 377340 - protein, 9 aa, Homo Sapiens
DNLLMGKEV

SEQ ID NO: 377341 - protein, 9 aa, Homo Sapiens
DMSQYWPIL

SEQ ID NO: 377342 - protein, 9 aa, Homo Sapiens
KNFYLNLGL

SEQ ID NO: 377343 - protein, 9 aa, Homo Sapiens
VEKYISDNS

SEQ ID NO: 377344 - protein, 9 aa, Homo Sapiens
GGNYAVKLV

SEQ ID NO: 377345 - protein, 9 aa, Homo Sapiens
INNLRENKN

SEQ ID NO: 377346 - protein, 9 aa, Homo Sapiens
VTEIISFTQ

SEQ ID NO: 377347 - protein, 9 aa, Homo Sapiens
DIKKHLMLL

SEQ ID NO: 377348 - protein, 9 aa, Homo Sapiens
EDMEEWITT

SEQ ID NO: 377349 - protein, 9 aa, Homo Sapiens
EVAKKICEL

SEQ ID NO: 377350 - protein, 9 aa, Homo Sapiens
NLAYAELEL

SEQ ID NO: 377351 - protein, 9 aa, Homo Sapiens
PRATHFLLG

SEQ ID NO: 377352 - protein, 9 aa, Homo Sapiens
KHKEEDKHS

SEQ ID NO: 377353 - protein, 9 aa, Homo Sapiens
KKHDYHIAL

SEQ ID NO: 377354 - protein, 9 aa, Homo Sapiens
DYRVNIFLC

SEQ ID NO: 377355 - protein, 9 aa, Homo Sapiens
ATPQIAKAE

SEQ ID NO: 377356 - protein, 9 aa, Homo Sapiens
YVEMKYLEV

SEQ ID NO: 377357 - protein, 9 aa, Homo Sapiens
HSESTAAAE

SEQ ID NO: 377358 - protein, 9 aa, Homo Sapiens
LIIQDMDGV

SEQ ID NO: 377359 - protein, 9 aa, Homo Sapiens
TVKDSLIKL

SEQ ID NO: 377360 - protein, 9 aa, Homo Sapiens
DRHIKLYDN

SEQ ID NO: 377361 - protein, 9 aa, Homo Sapiens
HGMDQTYCS

SEQ ID NO: 377362 - protein, 9 aa, Homo Sapiens
VKKGSQIYL

SEQ ID NO: 377363 - protein, 9 aa, Homo Sapiens
NQKDYLGDI

SEQ ID NO: 377364 - protein, 9 aa, Homo Sapiens
TQIRTKQLQ

SEQ ID NO: 377365 - protein, 9 aa, Homo Sapiens
EEKVGIPAS

SEQ ID NO: 377366 - protein, 9 aa, Homo Sapiens
HVEKYISDN

SEQ ID NO: 377367 - protein, 9 aa, Homo Sapiens
LHFLQILRM

SEQ ID NO: 377368 - protein, 9 aa, Homo Sapiens
FLGWAVPGS

SEQ ID NO: 377369 - protein, 9 aa, Homo Sapiens
NNFPGEMVV

SEQ ID NO: 377370 - protein, 9 aa, Homo Sapiens
ELKSCRSAL

SEQ ID NO: 377371 - protein, 9 aa, Homo Sapiens
QDNPWDCTC

SEQ ID NO: 377372 - protein, 9 aa, Homo Sapiens
IRYILDSIS

SEQ ID NO: 377373 - protein, 9 aa, Homo Sapiens
IKDEQNNLK

SEQ ID NO: 377374 - protein, 9 aa, Homo Sapiens
ICFSGRAGW

SEQ ID NO: 377375 - protein, 9 aa, Homo Sapiens
GVVINFEKN

SEQ ID NO: 377376 - protein, 9 aa, Homo Sapiens
KTANKIALE

SEQ ID NO: 377377 - protein, 9 aa, Homo Sapiens
HQGCKTEVN

SEQ ID NO: 377378 - protein, 9 aa, Homo Sapiens
KDKEKPESV

SEQ ID NO: 377379 - protein, 9 aa, Homo Sapiens
KCNLLQEVP

SEQ ID NO: 377380 - protein, 9 aa, Homo Sapiens
HGDSIVTET

SEQ ID NO: 377381 - protein, 9 aa, Homo Sapiens
ALDIWRRAL

SEQ ID NO: 377382 - protein, 9 aa, Homo Sapiens
TSPIHLALS

SEQ ID NO: 377383 - protein, 9 aa, Homo Sapiens
IFWKLCDFN

SEQ ID NO: 377384 - protein, 9 aa, Homo Sapiens
DYSQRKLYK

SEQ ID NO: 377385 - protein, 9 aa, Homo Sapiens
SSNLVQHQI

SEQ ID NO: 377386 - protein, 9 aa, Homo Sapiens
ISFFQKRIY

SEQ ID NO: 377387 - protein, 9 aa, Homo Sapiens
GCEGIGNFV

SEQ ID NO: 377388 - protein, 9 aa, Homo Sapiens
RIFHVLKLA

SEQ ID NO: 377389 - protein, 9 aa, Homo Sapiens
ARNNPTKRF

SEQ ID NO: 377390 - protein, 9 aa, Homo Sapiens
EEYIKDEQN

SEQ ID NO: 377391 - protein, 9 aa, Homo Sapiens
RLSTYAKLL

SEQ ID NO: 377392 - protein, 9 aa, Homo Sapiens
DDISGNLAS

SEQ ID NO: 377393 - protein, 9 aa, Homo Sapiens
FQMLVLGVA

SEQ ID NO: 377394 - protein, 9 aa, Homo Sapiens
KKLARPAAG

SEQ ID NO: 377395 - protein, 9 aa, Homo Sapiens
EDKLGFLVA

SEQ ID NO: 377396 - protein, 9 aa, Homo Sapiens
ENFEYQLVA

SEQ ID NO: 377397 - protein, 9 aa, Homo Sapiens
LEPRASDTK

SEQ ID NO: 377398 - protein, 9 aa, Homo Sapiens
SWCPQYRSS

SEQ ID NO: 377399 - protein, 9 aa, Homo Sapiens
CLEEERQIN

SEQ ID NO: 377400 - protein, 9 aa, Homo Sapiens
YWTLGKNKS

SEQ ID NO: 377401 - protein, 9 aa, Homo Sapiens
GLSRGAVPP

SEQ ID NO: 377402 - protein, 9 aa, Homo Sapiens
EGWVPASYL

SEQ ID NO: 377403 - protein, 9 aa, Homo Sapiens
LQEESKAAD

SEQ ID NO: 377404 - protein, 9 aa, Homo Sapiens
ASNINNVVL

SEQ ID NO: 377405 - protein, 9 aa, Homo Sapiens
DSMRNEYLF

SEQ ID NO: 377406 - protein, 9 aa, Homo Sapiens
GCKHVEKYI

SEQ ID NO: 377407 - protein, 9 aa, Homo Sapiens
ERQHILQEM

SEQ ID NO: 377408 - protein, 9 aa, Homo Sapiens
EKDEELWRM

SEQ ID NO: 377409 - protein, 9 aa, Homo Sapiens
KYVHFTIVT

SEQ ID NO: 377410 - protein, 9 aa, Homo Sapiens
ESLNGIYVG

SEQ ID NO: 377411 - protein, 9 aa, Homo Sapiens
NYLDEQEGV

SEQ ID NO: 377412 - protein, 9 aa, Homo Sapiens
IIWYLYLQN

SEQ ID NO: 377413 - protein, 9 aa, Homo Sapiens
IQIDLQDNP

SEQ ID NO: 377414 - protein, 9 aa, Homo Sapiens
TSTYNILTF

SEQ ID NO: 377415 - protein, 9 aa, Homo Sapiens
KVGSCSRTC

SEQ ID NO: 377416 - protein, 9 aa, Homo Sapiens
QNRSACTYL

SEQ ID NO: 377417 - protein, 9 aa, Homo Sapiens
TVRTIQLIK

SEQ ID NO: 377418 - protein, 9 aa, Homo Sapiens
LAVISELNA

SEQ ID NO: 377419 - protein, 9 aa, Homo Sapiens
QTHLSEDDS

SEQ ID NO: 377420 - protein, 9 aa, Homo Sapiens
QGCKTEVNI

SEQ ID NO: 377421 - protein, 9 aa, Homo Sapiens
SFQDWGPEE

SEQ ID NO: 377422 - protein, 9 aa, Homo Sapiens
GCPVKKGTN

SEQ ID NO: 377423 - protein, 9 aa, Homo Sapiens
WLLFIFCFI

SEQ ID NO: 377424 - protein, 9 aa, Homo Sapiens
FKGPSYSLH

SEQ ID NO: 377425 - protein, 9 aa, Homo Sapiens
ELCHQKDLD

SEQ ID NO: 377426 - protein, 9 aa, Homo Sapiens
DVVWGITRQ

SEQ ID NO: 377427 - protein, 9 aa, Homo Sapiens
PTDFAPGIW

SEQ ID NO: 377428 - protein, 9 aa, Homo Sapiens
NSFCKILGP

SEQ ID NO: 377429 - protein, 9 aa, Homo Sapiens
WLPQLHIGD

SEQ ID NO: 377430 - protein, 9 aa, Homo Sapiens
NSLIVIILI

SEQ ID NO: 377431 - protein, 9 aa, Homo Sapiens
GQPPGVWSG

SEQ ID NO: 377432 - protein, 9 aa, Homo Sapiens
QHHIALDLI

SEQ ID NO: 377433 - protein, 9 aa, Homo Sapiens
KLHKVFCEI

SEQ ID NO: 377434 - protein, 9 aa, Homo Sapiens
ASFEYLSPS

SEQ ID NO: 377435 - protein, 9 aa, Homo Sapiens
SLRSLHFLQ

SEQ ID NO: 377436 - protein, 9 aa, Homo Sapiens
GTSIAWNYP

SEQ ID NO: 377437 - protein, 9 aa, Homo Sapiens
FKELTQNDW

SEQ ID NO: 377438 - protein, 9 aa, Homo Sapiens
LLYYVLAAK

SEQ ID NO: 377439 - protein, 9 aa, Homo Sapiens
PSSGQPCCP

SEQ ID NO: 377440 - protein, 9 aa, Homo Sapiens
VKISIAIEE

SEQ ID NO: 377441 - protein, 9 aa, Homo Sapiens
RQVQRGPAQ

SEQ ID NO: 377442 - protein, 9 aa, Homo Sapiens
PGFLVKHIC

SEQ ID NO: 377443 - protein, 9 aa, Homo Sapiens
NLIKCSTSS

SEQ ID NO: 377444 - protein, 9 aa, Homo Sapiens
PVNTNNQAV

SEQ ID NO: 377445 - protein, 9 aa, Homo Sapiens
KIGQNYKAC

SEQ ID NO: 377446 - protein, 9 aa, Homo Sapiens
AASSSLVPI

SEQ ID NO: 377447 - protein, 9 aa, Homo Sapiens
VTPIFKTND

SEQ ID NO: 377448 - protein, 9 aa, Homo Sapiens
QLELIIKHN

SEQ ID NO: 377449 - protein, 9 aa, Homo Sapiens
LQQKAAKMY

SEQ ID NO: 377450 - protein, 9 aa, Homo Sapiens
QENVRKLLK

SEQ ID NO: 377451 - protein, 9 aa, Homo Sapiens
INQLRGELD

SEQ ID NO: 377452 - protein, 9 aa, Homo Sapiens
YLGTGCGKN

SEQ ID NO: 377453 - protein, 9 aa, Homo Sapiens
AKIWFQQKV

SEQ ID NO: 377454 - protein, 9 aa, Homo Sapiens
SVTYYKRLL

SEQ ID NO: 377455 - protein, 9 aa, Homo Sapiens
VSLGLTVYK

SEQ ID NO: 377456 - protein, 9 aa, Homo Sapiens
REEPVRILS

SEQ ID NO: 377457 - protein, 9 aa, Homo Sapiens
LADQAVNEW

SEQ ID NO: 377458 - protein, 9 aa, Homo Sapiens
EDKNFYLNL

SEQ ID NO: 377459 - protein, 9 aa, Homo Sapiens
VFRLMRIFH

SEQ ID NO: 377460 - protein, 9 aa, Homo Sapiens
YVMGLFMIS

SEQ ID NO: 377461 - protein, 9 aa, Homo Sapiens
YLQQKAAKM

SEQ ID NO: 377462 - protein, 9 aa, Homo Sapiens
KASKGEREL

SEQ ID NO: 377463 - protein, 9 aa, Homo Sapiens
ATPGGKDHL

SEQ ID NO: 377464 - protein, 9 aa, Homo Sapiens
RTSEGFQTF

SEQ ID NO: 377465 - protein, 9 aa, Homo Sapiens
DPGKPESKL

SEQ ID NO: 377466 - protein, 9 aa, Homo Sapiens
QLAEDIKAL

SEQ ID NO: 377467 - protein, 9 aa, Homo Sapiens
NKYNNDKKV

SEQ ID NO: 377468 - protein, 9 aa, Homo Sapiens
DYLNSSQNY

SEQ ID NO: 377469 - protein, 9 aa, Homo Sapiens
KCPVDGKVL

SEQ ID NO: 377470 - protein, 9 aa, Homo Sapiens
IIKHNNQFL

SEQ ID NO: 377471 - protein, 9 aa, Homo Sapiens
KSKKTKGHK

SEQ ID NO: 377472 - protein, 9 aa, Homo Sapiens
VGPTDFAPG

SEQ ID NO: 377473 - protein, 9 aa, Homo Sapiens
LMDLSVLSM

SEQ ID NO: 377474 - protein, 9 aa, Homo Sapiens
MDLSVLSMD

SEQ ID NO: 377475 - protein, 9 aa, Homo Sapiens
KMNKSNLNY

SEQ ID NO: 377476 - protein, 9 aa, Homo Sapiens
NKEGIEKII

SEQ ID NO: 377477 - protein, 9 aa, Homo Sapiens
NTRFLSDIP

SEQ ID NO: 377478 - protein, 9 aa, Homo Sapiens
NSLPGHSVV

SEQ ID NO: 377479 - protein, 9 aa, Homo Sapiens
GSSPTTADN

SEQ ID NO: 377480 - protein, 9 aa, Homo Sapiens
LQQNVASLA

SEQ ID NO: 377481 - protein, 9 aa, Homo Sapiens
MTVIQSGIA

SEQ ID NO: 377482 - protein, 9 aa, Homo Sapiens
IESLNCQTI

SEQ ID NO: 377483 - protein, 9 aa, Homo Sapiens
ALAFLMTYK

SEQ ID NO: 377484 - protein, 9 aa, Homo Sapiens
FICCFIRLE

SEQ ID NO: 377485 - protein, 9 aa, Homo Sapiens
DLETLINII

SEQ ID NO: 377486 - protein, 9 aa, Homo Sapiens
FDLQEMLFH

SEQ ID NO: 377487 - protein, 9 aa, Homo Sapiens
INSVAFKFK

SEQ ID NO: 377488 - protein, 9 aa, Homo Sapiens
VKDSLIKLK

SEQ ID NO: 377489 - protein, 9 aa, Homo Sapiens
IYSELEDRS

SEQ ID NO: 377490 - protein, 9 aa, Homo Sapiens
LFSVRNNFP

SEQ ID NO: 377491 - protein, 9 aa, Homo Sapiens
NGYRGHDHE

SEQ ID NO: 377492 - protein, 9 aa, Homo Sapiens
SVGPWKMVV

SEQ ID NO: 377493 - protein, 9 aa, Homo Sapiens
YWLPPPMDC

SEQ ID NO: 377494 - protein, 9 aa, Homo Sapiens
KKKHDLRYI

SEQ ID NO: 377495 - protein, 9 aa, Homo Sapiens
RILFIKIFI

SEQ ID NO: 377496 - protein, 9 aa, Homo Sapiens
ADNIHNTYS

SEQ ID NO: 377497 - protein, 9 aa, Homo Sapiens
FVITFYEEV

SEQ ID NO: 377498 - protein, 9 aa, Homo Sapiens
KNIQDIFWH

SEQ ID NO: 377499 - protein, 9 aa, Homo Sapiens
RILIYLATG

SEQ ID NO: 377500 - protein, 9 aa, Homo Sapiens
KYHTFWKED

SEQ ID NO: 377501 - protein, 9 aa, Homo Sapiens
KNKWEEPGH

SEQ ID NO: 377502 - protein, 9 aa, Homo Sapiens
TDAVYNHTA

SEQ ID NO: 377503 - protein, 9 aa, Homo Sapiens
SFLHTVILC

SEQ ID NO: 377504 - protein, 9 aa, Homo Sapiens
LLLNHKTPS

SEQ ID NO: 377505 - protein, 9 aa, Homo Sapiens
RKALALDKT

SEQ ID NO: 377506 - protein, 9 aa, Homo Sapiens
HSFYVLGVR

SEQ ID NO: 377507 - protein, 9 aa, Homo Sapiens
LEESASFEY

SEQ ID NO: 377508 - protein, 9 aa, Homo Sapiens
DEYFTQNNV

SEQ ID NO: 377509 - protein, 9 aa, Homo Sapiens
TALKATSDE

SEQ ID NO: 377510 - protein, 9 aa, Homo Sapiens
YLLDGLGPL

SEQ ID NO: 377511 - protein, 9 aa, Homo Sapiens
VKTPINKQE

SEQ ID NO: 377512 - protein, 9 aa, Homo Sapiens
GWPMYRNTP

SEQ ID NO: 377513 - protein, 9 aa, Homo Sapiens
ASSNETFAG

SEQ ID NO: 377514 - protein, 9 aa, Homo Sapiens
GKNKENAKA

SEQ ID NO: 377515 - protein, 9 aa, Homo Sapiens
HHERAITFI

SEQ ID NO: 377516 - protein, 9 aa, Homo Sapiens
LARPAAGVG

SEQ ID NO: 377517 - protein, 9 aa, Homo Sapiens
CACRLKTIK

SEQ ID NO: 377518 - protein, 9 aa, Homo Sapiens
GPGQFFFFF

SEQ ID NO: 377519 - protein, 9 aa, Homo Sapiens
LSMIRAHEA

SEQ ID NO: 377520 - protein, 9 aa, Homo Sapiens
NKIALEASF

SEQ ID NO: 377521 - protein, 9 aa, Homo Sapiens
RECGRRFWD

SEQ ID NO: 377522 - protein, 9 aa, Homo Sapiens
FLGWPMYRN

SEQ ID NO: 377523 - protein, 9 aa, Homo Sapiens
SLFLDVVYK

SEQ ID NO: 377524 - protein, 9 aa, Homo Sapiens
HFPRASSEA

SEQ ID NO: 377525 - protein, 9 aa, Homo Sapiens
ERHTLFQTC

SEQ ID NO: 377526 - protein, 9 aa, Homo Sapiens
RKQWALAVA

SEQ ID NO: 377527 - protein, 9 aa, Homo Sapiens
LSVLSMDLS

SEQ ID NO: 377528 - protein, 9 aa, Homo Sapiens
NNDFSIILQ

SEQ ID NO: 377529 - protein, 9 aa, Homo Sapiens
CFLPRLGRR

SEQ ID NO: 377530 - protein, 9 aa, Homo Sapiens
KIDDTKVFK

SEQ ID NO: 377531 - protein, 9 aa, Homo Sapiens
VVSFLHTVI

SEQ ID NO: 377532 - protein, 9 aa, Homo Sapiens
VGICFSGRA

SEQ ID NO: 377533 - protein, 9 aa, Homo Sapiens
SETKCGEGM

SEQ ID NO: 377534 - protein, 9 aa, Homo Sapiens
DDGLFVPHG

SEQ ID NO: 377535 - protein, 9 aa, Homo Sapiens
ELDGKKSKL

SEQ ID NO: 377536 - protein, 9 aa, Homo Sapiens
QHKQKTSQK

SEQ ID NO: 377537 - protein, 9 aa, Homo Sapiens
FLPRLGRRS

SEQ ID NO: 377538 - protein, 9 aa, Homo Sapiens
LSPAAIPTR

SEQ ID NO: 377539 - protein, 9 aa, Homo Sapiens
EVINLQNEK

SEQ ID NO: 377540 - protein, 9 aa, Homo Sapiens
NYFNQYINE

SEQ ID NO: 377541 - protein, 9 aa, Homo Sapiens
NHSSQKTLH

SEQ ID NO: 377542 - protein, 9 aa, Homo Sapiens
DVSKEINLR

SEQ ID NO: 377543 - protein, 9 aa, Homo Sapiens
SSPLADAKI

SEQ ID NO: 377544 - protein, 9 aa, Homo Sapiens
DQLVPDINM

SEQ ID NO: 377545 - protein, 9 aa, Homo Sapiens
KEGKEQLSE

SEQ ID NO: 377546 - protein, 9 aa, Homo Sapiens
TTQISEVTA

SEQ ID NO: 377547 - protein, 9 aa, Homo Sapiens
AGRYFFCME

SEQ ID NO: 377548 - protein, 9 aa, Homo Sapiens
HVPSSNGII

SEQ ID NO: 377549 - protein, 9 aa, Homo Sapiens
NVPIDILSE

SEQ ID NO: 377550 - protein, 9 aa, Homo Sapiens
KKQKCETQT

SEQ ID NO: 377551 - protein, 9 aa, Homo Sapiens
THKAYWQVH

SEQ ID NO: 377552 - protein, 9 aa, Homo Sapiens
TPADPDSGA

SEQ ID NO: 377553 - protein, 9 aa, Homo Sapiens
PQMDLLALS

SEQ ID NO: 377554 - protein, 9 aa, Homo Sapiens
LEDNPSICA

SEQ ID NO: 377555 - protein, 9 aa, Homo Sapiens
DPNSVFQCV

SEQ ID NO: 377556 - protein, 9 aa, Homo Sapiens
NFISNSKGQ

SEQ ID NO: 377557 - protein, 9 aa, Homo Sapiens
GVLESLRNN

SEQ ID NO: 377558 - protein, 9 aa, Homo Sapiens
EVGEEEFLE

SEQ ID NO: 377559 - protein, 9 aa, Homo Sapiens
SSNQLHRVL

SEQ ID NO: 377560 - protein, 9 aa, Homo Sapiens
GNYSAIPPS

SEQ ID NO: 377561 - protein, 9 aa, Homo Sapiens
KRLHQLKMQ

SEQ ID NO: 377562 - protein, 9 aa, Homo Sapiens
LGKEGWVPA

SEQ ID NO: 377563 - protein, 9 aa, Homo Sapiens
KTNDGKRES

SEQ ID NO: 377564 - protein, 9 aa, Homo Sapiens
AFYLPPGHA

SEQ ID NO: 377565 - protein, 9 aa, Homo Sapiens
VCMANISNY

SEQ ID NO: 377566 - protein, 9 aa, Homo Sapiens
LFVGAAGAS

SEQ ID NO: 377567 - protein, 9 aa, Homo Sapiens
LSYLKYVFN

SEQ ID NO: 377568 - protein, 9 aa, Homo Sapiens
YGDQHYYSF

SEQ ID NO: 377569 - protein, 9 aa, Homo Sapiens
LLLSAIVSI

SEQ ID NO: 377570 - protein, 9 aa, Homo Sapiens
GIYVGSYSG

SEQ ID NO: 377571 - protein, 9 aa, Homo Sapiens
ENSKPSVNY

SEQ ID NO: 377572 - protein, 9 aa, Homo Sapiens
TLHRLRMVL

SEQ ID NO: 377573 - protein, 9 aa, Homo Sapiens
SLPEINQSA

SEQ ID NO: 377574 - protein, 9 aa, Homo Sapiens
STLKSHMQT

SEQ ID NO: 377575 - protein, 9 aa, Homo Sapiens
VIILALVLR

SEQ ID NO: 377576 - protein, 9 aa, Homo Sapiens
GKAFKEEQE

SEQ ID NO: 377577 - protein, 9 aa, Homo Sapiens
KVSSSTGEM

SEQ ID NO: 377578 - protein, 9 aa, Homo Sapiens
QDRLMDLSV

SEQ ID NO: 377579 - protein, 9 aa, Homo Sapiens
MCVESFSQS

SEQ ID NO: 377580 - protein, 9 aa, Homo Sapiens
LNYYTNGAY

SEQ ID NO: 377581 - protein, 9 aa, Homo Sapiens
EKNRMSVSN

SEQ ID NO: 377582 - protein, 9 aa, Homo Sapiens
QKNILEMEI

SEQ ID NO: 377583 - protein, 9 aa, Homo Sapiens
HGHCTNTKG

SEQ ID NO: 377584 - protein, 9 aa, Homo Sapiens
EDLFARTLV

SEQ ID NO: 377585 - protein, 9 aa, Homo Sapiens
NMSLESYGK

SEQ ID NO: 377586 - protein, 9 aa, Homo Sapiens
DNSTGCTGR

SEQ ID NO: 377587 - protein, 9 aa, Homo Sapiens
GIASRVLQD

SEQ ID NO: 377588 - protein, 9 aa, Homo Sapiens
VLWLSYLKY

SEQ ID NO: 377589 - protein, 9 aa, Homo Sapiens
SFLPLLAFA

SEQ ID NO: 377590 - protein, 9 aa, Homo Sapiens
AVCLIIYAC

SEQ ID NO: 377591 - protein, 9 aa, Homo Sapiens
TRFLSDIPS

SEQ ID NO: 377592 - protein, 9 aa, Homo Sapiens
DGSDKGILA

SEQ ID NO: 377593 - protein, 9 aa, Homo Sapiens
QKLVLPEYS

SEQ ID NO: 377594 - protein, 9 aa, Homo Sapiens
DKIQEWEEK

SEQ ID NO: 377595 - protein, 9 aa, Homo Sapiens
QQILAVISE

SEQ ID NO: 377596 - protein, 9 aa, Homo Sapiens
LLGHPHHNT

SEQ ID NO: 377597 - protein, 9 aa, Homo Sapiens
SLYYFSDHY

SEQ ID NO: 377598 - protein, 9 aa, Homo Sapiens
NSKPSVNYF

SEQ ID NO: 377599 - protein, 9 aa, Homo Sapiens
RLMRIFHVL

SEQ ID NO: 377600 - protein, 9 aa, Homo Sapiens
HILDRERFT

SEQ ID NO: 377601 - protein, 9 aa, Homo Sapiens
DLIDINTVA

SEQ ID NO: 377602 - protein, 9 aa, Homo Sapiens
VTSTAEVKY

SEQ ID NO: 377603 - protein, 9 aa, Homo Sapiens
GKQTAIIKV

SEQ ID NO: 377604 - protein, 9 aa, Homo Sapiens
GNLIKCSTS

SEQ ID NO: 377605 - protein, 9 aa, Homo Sapiens
KTSRTLRTN

SEQ ID NO: 377606 - protein, 9 aa, Homo Sapiens
DIKALKVQF

SEQ ID NO: 377607 - protein, 9 aa, Homo Sapiens
IHESCMRQI

SEQ ID NO: 377608 - protein, 9 aa, Homo Sapiens
RTLPSAEDS

SEQ ID NO: 377609 - protein, 9 aa, Homo Sapiens
VGRLEGTGQ

SEQ ID NO: 377610 - protein, 9 aa, Homo Sapiens
EEGVWEDNT

SEQ ID NO: 377611 - protein, 9 aa, Homo Sapiens
IGNFVELLG

SEQ ID NO: 377612 - protein, 9 aa, Homo Sapiens
EVVLQESAS

SEQ ID NO: 377613 - protein, 9 aa, Homo Sapiens
WAVPGSAEA

SEQ ID NO: 377614 - protein, 9 aa, Homo Sapiens
HEIIHTGER

SEQ ID NO: 377615 - protein, 9 aa, Homo Sapiens
LDSWNKHDS

SEQ ID NO: 377616 - protein, 9 aa, Homo Sapiens
LLKLPNLSP

SEQ ID NO: 377617 - protein, 9 aa, Homo Sapiens
IYYGKNSEG

SEQ ID NO: 377618 - protein, 9 aa, Homo Sapiens
NTKGSFRCS

SEQ ID NO: 377619 - protein, 9 aa, Homo Sapiens
MSRNLTQSL

SEQ ID NO: 377620 - protein, 9 aa, Homo Sapiens
KKTSICKQQ

SEQ ID NO: 377621 - protein, 9 aa, Homo Sapiens
DSQHRATIN

SEQ ID NO: 377622 - protein, 9 aa, Homo Sapiens
NIKYSFQKV

SEQ ID NO: 377623 - protein, 9 aa, Homo Sapiens
AKKICELMA

SEQ ID NO: 377624 - protein, 9 aa, Homo Sapiens
IHIQNHTGE

SEQ ID NO: 377625 - protein, 9 aa, Homo Sapiens
EEEDKLSRV

SEQ ID NO: 377626 - protein, 9 aa, Homo Sapiens
YPNKILLAY

SEQ ID NO: 377627 - protein, 9 aa, Homo Sapiens
EWITTLEKR

SEQ ID NO: 377628 - protein, 9 aa, Homo Sapiens
HHEHLVDSS

SEQ ID NO: 377629 - protein, 9 aa, Homo Sapiens
RVSVIFDRI

SEQ ID NO: 377630 - protein, 9 aa, Homo Sapiens
STIFNCRME

SEQ ID NO: 377631 - protein, 9 aa, Homo Sapiens
YRIEEEDKL

SEQ ID NO: 377632 - protein, 9 aa, Homo Sapiens
LFDDSLRVN

SEQ ID NO: 377633 - protein, 9 aa, Homo Sapiens
HTLFSTHYH

SEQ ID NO: 377634 - protein, 9 aa, Homo Sapiens
ICERELCVF

SEQ ID NO: 377635 - protein, 9 aa, Homo Sapiens
TRAVAMKVD

SEQ ID NO: 377636 - protein, 9 aa, Homo Sapiens
CCFLPRLGR

SEQ ID NO: 377637 - protein, 9 aa, Homo Sapiens
ERICFLLQK

SEQ ID NO: 377638 - protein, 9 aa, Homo Sapiens
KLPSNTEKE

SEQ ID NO: 377639 - protein, 9 aa, Homo Sapiens
LHLCSPFTS

SEQ ID NO: 377640 - protein, 9 aa, Homo Sapiens
TLPSAEDST

SEQ ID NO: 377641 - protein, 9 aa, Homo Sapiens
RALKTVYVI

SEQ ID NO: 377642 - protein, 9 aa, Homo Sapiens
LKLKLPRKK

SEQ ID NO: 377643 - protein, 9 aa, Homo Sapiens
EVYFADRMK

SEQ ID NO: 377644 - protein, 9 aa, Homo Sapiens
ASNDNEGNR

SEQ ID NO: 377645 - protein, 9 aa, Homo Sapiens
GHDHEYTDH

SEQ ID NO: 377646 - protein, 9 aa, Homo Sapiens
QDDYPNKIL

SEQ ID NO: 377647 - protein, 9 aa, Homo Sapiens
WDKMATQEV

SEQ ID NO: 377648 - protein, 9 aa, Homo Sapiens
LCHCKSSQK

SEQ ID NO: 377649 - protein, 9 aa, Homo Sapiens
KGHWWKKGA

SEQ ID NO: 377650 - protein, 9 aa, Homo Sapiens
TRMHLKSEV

SEQ ID NO: 377651 - protein, 9 aa, Homo Sapiens
NSEHIHEER

SEQ ID NO: 377652 - protein, 9 aa, Homo Sapiens
SFEYLSPSS

SEQ ID NO: 377653 - protein, 9 aa, Homo Sapiens
PKVWHHLNH

SEQ ID NO: 377654 - protein, 9 aa, Homo Sapiens
QLFGEPSRH

SEQ ID NO: 377655 - protein, 9 aa, Homo Sapiens
GSYHMPYED

SEQ ID NO: 377656 - protein, 9 aa, Homo Sapiens
NCVIYWLVS

SEQ ID NO: 377657 - protein, 9 aa, Homo Sapiens
ALVSFVGIC

SEQ ID NO: 377658 - protein, 9 aa, Homo Sapiens
QSPASRVPG

SEQ ID NO: 377659 - protein, 9 aa, Homo Sapiens
PTICERELC

SEQ ID NO: 377660 - protein, 9 aa, Homo Sapiens
RAEARWDAA

SEQ ID NO: 377661 - protein, 9 aa, Homo Sapiens
QFENMKSSL

SEQ ID NO: 377662 - protein, 9 aa, Homo Sapiens
NIGALRNPK

SEQ ID NO: 377663 - protein, 9 aa, Homo Sapiens
AEFVNVEFL

SEQ ID NO: 377664 - protein, 9 aa, Homo Sapiens
FQVCDHYQR

SEQ ID NO: 377665 - protein, 9 aa, Homo Sapiens
NKLPAGIKR

SEQ ID NO: 377666 - protein, 9 aa, Homo Sapiens
LNYLDEQEG

SEQ ID NO: 377667 - protein, 9 aa, Homo Sapiens
QFYMFTWTH

SEQ ID NO: 377668 - protein, 9 aa, Homo Sapiens
NQQQKNLGG

SEQ ID NO: 377669 - protein, 9 aa, Homo Sapiens
YNGEDRAKG

SEQ ID NO: 377670 - protein, 9 aa, Homo Sapiens
CRLGEEIKI

SEQ ID NO: 377671 - protein, 9 aa, Homo Sapiens
DPQMDLLAL

SEQ ID NO: 377672 - protein, 9 aa, Homo Sapiens
PWTIYDFGF

SEQ ID NO: 377673 - protein, 9 aa, Homo Sapiens
QQMKIDREF

SEQ ID NO: 377674 - protein, 9 aa, Homo Sapiens
GERGRLNSE

SEQ ID NO: 377675 - protein, 9 aa, Homo Sapiens
WNKFGSADN

SEQ ID NO: 377676 - protein, 9 aa, Homo Sapiens
INFEKNRTR

SEQ ID NO: 377677 - protein, 9 aa, Homo Sapiens
LMSCHDESS

SEQ ID NO: 377678 - protein, 9 aa, Homo Sapiens
QKYYVPLCI

SEQ ID NO: 377679 - protein, 9 aa, Homo Sapiens
RKKKSLKRK

SEQ ID NO: 377680 - protein, 9 aa, Homo Sapiens
TFNWPIYLR

SEQ ID NO: 377681 - protein, 9 aa, Homo Sapiens
GEMTVIQSG

SEQ ID NO: 377682 - protein, 9 aa, Homo Sapiens
LLCLLFMAA

SEQ ID NO: 377683 - protein, 9 aa, Homo Sapiens
SHFITHQQI

SEQ ID NO: 377684 - protein, 9 aa, Homo Sapiens
NIVPNKPPL

SEQ ID NO: 377685 - protein, 9 aa, Homo Sapiens
GFVITFYEE

SEQ ID NO: 377686 - protein, 9 aa, Homo Sapiens
AHEDRHIKL

SEQ ID NO: 377687 - protein, 9 aa, Homo Sapiens
YQWAINMNK

SEQ ID NO: 377688 - protein, 9 aa, Homo Sapiens
KAVGNLIKC

SEQ ID NO: 377689 - protein, 9 aa, Homo Sapiens
GCDLETLIN

SEQ ID NO: 377690 - protein, 9 aa, Homo Sapiens
FPFFFLRRS

SEQ ID NO: 377691 - protein, 9 aa, Homo Sapiens
LSQIKCVEI

SEQ ID NO: 377692 - protein, 9 aa, Homo Sapiens
SMELAQTCI

SEQ ID NO: 377693 - protein, 9 aa, Homo Sapiens
GLGGSPGLP

SEQ ID NO: 377694 - protein, 9 aa, Homo Sapiens
LRPPNRNDL

SEQ ID NO: 377695 - protein, 9 aa, Homo Sapiens
YMFTWTHVT

SEQ ID NO: 377696 - protein, 9 aa, Homo Sapiens
ELVLLKIED

SEQ ID NO: 377697 - protein, 9 aa, Homo Sapiens
YVLLCFGVL

SEQ ID NO: 377698 - protein, 9 aa, Homo Sapiens
WVKPIIIGC

SEQ ID NO: 377699 - protein, 9 aa, Homo Sapiens
NKFKKTSIC

SEQ ID NO: 377700 - protein, 9 aa, Homo Sapiens
CMANISNYH

SEQ ID NO: 377701 - protein, 9 aa, Homo Sapiens
GGKCPVDGK

SEQ ID NO: 377702 - protein, 9 aa, Homo Sapiens
LFGVGSVMR

SEQ ID NO: 377703 - protein, 9 aa, Homo Sapiens
LTIYPQHSA

SEQ ID NO: 377704 - protein, 9 aa, Homo Sapiens
KGNFFLSQE

SEQ ID NO: 377705 - protein, 9 aa, Homo Sapiens
SHAFFPACY

SEQ ID NO: 377706 - protein, 9 aa, Homo Sapiens
STKNPDVLK

SEQ ID NO: 377707 - protein, 9 aa, Homo Sapiens
YLTKEWAQT

SEQ ID NO: 377708 - protein, 9 aa, Homo Sapiens
FDTTPNKLV

SEQ ID NO: 377709 - protein, 9 aa, Homo Sapiens
EKTLLENLQ

SEQ ID NO: 377710 - protein, 9 aa, Homo Sapiens
PEINQSASF

SEQ ID NO: 377711 - protein, 9 aa, Homo Sapiens
VKEANQSML

SEQ ID NO: 377712 - protein, 9 aa, Homo Sapiens
NQIYRIFEQ

SEQ ID NO: 377713 - protein, 9 aa, Homo Sapiens
VEESTPMGF

SEQ ID NO: 377714 - protein, 9 aa, Homo Sapiens
HMTEDNKYL

SEQ ID NO: 377715 - protein, 9 aa, Homo Sapiens
THPSPHPPA

SEQ ID NO: 377716 - protein, 9 aa, Homo Sapiens
QDGQPQWEV

SEQ ID NO: 377717 - protein, 9 aa, Homo Sapiens
SESEEKVGI

SEQ ID NO: 377718 - protein, 9 aa, Homo Sapiens
AALLCLLFM

SEQ ID NO: 377719 - protein, 9 aa, Homo Sapiens
QEHVRCLEE

SEQ ID NO: 377720 - protein, 9 aa, Homo Sapiens
RRFLAWGVQ

SEQ ID NO: 377721 - protein, 9 aa, Homo Sapiens
VNGKYIIKH

SEQ ID NO: 377722 - protein, 9 aa, Homo Sapiens
LLQKLVLPE

SEQ ID NO: 377723 - protein, 9 aa, Homo Sapiens
QHCQKYYVP

SEQ ID NO: 377724 - protein, 9 aa, Homo Sapiens
EVQYQIILN

SEQ ID NO: 377725 - protein, 9 aa, Homo Sapiens
QNGYRGHDH

SEQ ID NO: 377726 - protein, 9 aa, Homo Sapiens
EEQNLVWKF

SEQ ID NO: 377727 - protein, 9 aa, Homo Sapiens
KAARETKII

SEQ ID NO: 377728 - protein, 9 aa, Homo Sapiens
LKLCDGFSL

SEQ ID NO: 377729 - protein, 9 aa, Homo Sapiens
SPLADAKII

SEQ ID NO: 377730 - protein, 9 aa, Homo Sapiens
ELWENKVLR

SEQ ID NO: 377731 - protein, 9 aa, Homo Sapiens
PRRKRRRLS

SEQ ID NO: 377732 - protein, 9 aa, Homo Sapiens
GHWWKKGAF

SEQ ID NO: 377733 - protein, 9 aa, Homo Sapiens
ITTQSLGVM

SEQ ID NO: 377734 - protein, 9 aa, Homo Sapiens
DEAHRINNE

SEQ ID NO: 377735 - protein, 9 aa, Homo Sapiens
QGVYIIFSL

SEQ ID NO: 377736 - protein, 9 aa, Homo Sapiens
GPHFPRASS

SEQ ID NO: 377737 - protein, 9 aa, Homo Sapiens
IHEQIHTGE

SEQ ID NO: 377738 - protein, 9 aa, Homo Sapiens
RDDYFQEIR

SEQ ID NO: 377739 - protein, 9 aa, Homo Sapiens
DTSGSMWLT

SEQ ID NO: 377740 - protein, 9 aa, Homo Sapiens
VIDGCPVKK

SEQ ID NO: 377741 - protein, 9 aa, Homo Sapiens
AKHRLNPVK

SEQ ID NO: 377742 - protein, 9 aa, Homo Sapiens
HAILQNSAE

SEQ ID NO: 377743 - protein, 9 aa, Homo Sapiens
QQFFFFFFP

SEQ ID NO: 377744 - protein, 9 aa, Homo Sapiens
LRVNYFNQY

SEQ ID NO: 377745 - protein, 9 aa, Homo Sapiens
FDEDCIIEI

SEQ ID NO: 377746 - protein, 9 aa, Homo Sapiens
EKIIQVRAA

SEQ ID NO: 377747 - protein, 9 aa, Homo Sapiens
GSHLILYAI

SEQ ID NO: 377748 - protein, 9 aa, Homo Sapiens
PMLRPTICE

SEQ ID NO: 377749 - protein, 9 aa, Homo Sapiens
TRTPINNLY

SEQ ID NO: 377750 - protein, 9 aa, Homo Sapiens
GKFIITFSY

SEQ ID NO: 377751 - protein, 9 aa, Homo Sapiens
AKIIPSIVS

SEQ ID NO: 377752 - protein, 9 aa, Homo Sapiens
SNTLKGQGE

SEQ ID NO: 377753 - protein, 9 aa, Homo Sapiens
SKKARRIVE

SEQ ID NO: 377754 - protein, 9 aa, Homo Sapiens
FIQIDLQDN

SEQ ID NO: 377755 - protein, 9 aa, Homo Sapiens
ASNNDFSII

SEQ ID NO: 377756 - protein, 9 aa, Homo Sapiens
IGRHYARTD

SEQ ID NO: 377757 - protein, 9 aa, Homo Sapiens
GTHELIMHK

SEQ ID NO: 377758 - protein, 9 aa, Homo Sapiens
SERQKALWM

SEQ ID NO: 377759 - protein, 9 aa, Homo Sapiens
GVGLSRGAV

SEQ ID NO: 377760 - protein, 9 aa, Homo Sapiens
EKLINDTFE

SEQ ID NO: 377761 - protein, 9 aa, Homo Sapiens
SRQQILAVI

SEQ ID NO: 377762 - protein, 9 aa, Homo Sapiens
IKLVERLKF

SEQ ID NO: 377763 - protein, 9 aa, Homo Sapiens
EKQFNLCLE

SEQ ID NO: 377764 - protein, 9 aa, Homo Sapiens
RPYPCQLCG

SEQ ID NO: 377765 - protein, 9 aa, Homo Sapiens
RHPQISLGR

SEQ ID NO: 377766 - protein, 9 aa, Homo Sapiens
DDGLDELSD

SEQ ID NO: 377767 - protein, 9 aa, Homo Sapiens
LEASFSSSE

SEQ ID NO: 377768 - protein, 9 aa, Homo Sapiens
SKIVCVLNL

SEQ ID NO: 377769 - protein, 9 aa, Homo Sapiens
YDISFNVYM

SEQ ID NO: 377770 - protein, 9 aa, Homo Sapiens
HQELLVIFW

SEQ ID NO: 377771 - protein, 9 aa, Homo Sapiens
KIAKAGRLF

SEQ ID NO: 377772 - protein, 9 aa, Homo Sapiens
GPYILQNQD

SEQ ID NO: 377773 - protein, 9 aa, Homo Sapiens
YSGILKTLF

SEQ ID NO: 377774 - protein, 9 aa, Homo Sapiens
GGKDHLVWQ

SEQ ID NO: 377775 - protein, 9 aa, Homo Sapiens
AVGNLIKCS

SEQ ID NO: 377776 - protein, 9 aa, Homo Sapiens
DLAKSLHKT

SEQ ID NO: 377777 - protein, 9 aa, Homo Sapiens
NHNYTGGEP

SEQ ID NO: 377778 - protein, 9 aa, Homo Sapiens
SPAADHKGW

SEQ ID NO: 377779 - protein, 9 aa, Homo Sapiens
LVDSSGHSG

SEQ ID NO: 377780 - protein, 9 aa, Homo Sapiens
LKTQIVPDS

SEQ ID NO: 377781 - protein, 9 aa, Homo Sapiens
DNTPPLGPL

SEQ ID NO: 377782 - protein, 9 aa, Homo Sapiens
RFCINSVAF

SEQ ID NO: 377783 - protein, 9 aa, Homo Sapiens
KKMATPVEV

SEQ ID NO: 377784 - protein, 9 aa, Homo Sapiens
FGYINNPYN

SEQ ID NO: 377785 - protein, 9 aa, Homo Sapiens
NKRLKKYPN

SEQ ID NO: 377786 - protein, 9 aa, Homo Sapiens
WLNNGVPLS

SEQ ID NO: 377787 - protein, 9 aa, Homo Sapiens
TDESTQSIQ

SEQ ID NO: 377788 - protein, 9 aa, Homo Sapiens
PSFTQDHKA

SEQ ID NO: 377789 - protein, 9 aa, Homo Sapiens
LELVQLNNL

SEQ ID NO: 377790 - protein, 9 aa, Homo Sapiens
KTLLENLQN

SEQ ID NO: 377791 - protein, 9 aa, Homo Sapiens
ADNLLMGKE

SEQ ID NO: 377792 - protein, 9 aa, Homo Sapiens
CNLLQEVPH

SEQ ID NO: 377793 - protein, 9 aa, Homo Sapiens
LRHHIIHSG

SEQ ID NO: 377794 - protein, 9 aa, Homo Sapiens
SFIENSKLF

SEQ ID NO: 377795 - protein, 9 aa, Homo Sapiens
TARSQNTPD

SEQ ID NO: 377796 - protein, 9 aa, Homo Sapiens
VPSVSSISH

SEQ ID NO: 377797 - protein, 9 aa, Homo Sapiens
SSSLNEHKI

SEQ ID NO: 377798 - protein, 9 aa, Homo Sapiens
KIKIIQFGF

SEQ ID NO: 377799 - protein, 9 aa, Homo Sapiens
HLKGVNGKY

SEQ ID NO: 377800 - protein, 9 aa, Homo Sapiens
LCGKRFHQK

SEQ ID NO: 377801 - protein, 9 aa, Homo Sapiens
CHSDTLECL

SEQ ID NO: 377802 - protein, 9 aa, Homo Sapiens
SAWKHNFNS

SEQ ID NO: 377803 - protein, 9 aa, Homo Sapiens
LFTISDGNM

SEQ ID NO: 377804 - protein, 9 aa, Homo Sapiens
VITFLFLIK

SEQ ID NO: 377805 - protein, 9 aa, Homo Sapiens
GVIHDWRKF

SEQ ID NO: 377806 - protein, 9 aa, Homo Sapiens
MAAVRHFQA

SEQ ID NO: 377807 - protein, 9 aa, Homo Sapiens
KEGIEKIIT

SEQ ID NO: 377808 - protein, 9 aa, Homo Sapiens
ETIMCYKNK

SEQ ID NO: 377809 - protein, 9 aa, Homo Sapiens
SRHQADNLL

SEQ ID NO: 377810 - protein, 9 aa, Homo Sapiens
VIFNEDCQT

SEQ ID NO: 377811 - protein, 9 aa, Homo Sapiens
AEESNTGDE

SEQ ID NO: 377812 - protein, 9 aa, Homo Sapiens
TRHKKIHIR

SEQ ID NO: 377813 - protein, 9 aa, Homo Sapiens
FFFPFFFLR

SEQ ID NO: 377814 - protein, 9 aa, Homo Sapiens
SEKKMATPV

SEQ ID NO: 377815 - protein, 9 aa, Homo Sapiens
EFIKYDISF

SEQ ID NO: 377816 - protein, 9 aa, Homo Sapiens
YGKYIRPEM

SEQ ID NO: 377817 - protein, 9 aa, Homo Sapiens
DGKVPQHAG

SEQ ID NO: 377818 - protein, 9 aa, Homo Sapiens
KGYALGETS

SEQ ID NO: 377819 - protein, 9 aa, Homo Sapiens
YYVLAAKTG

SEQ ID NO: 377820 - protein, 9 aa, Homo Sapiens
TIYGDQHYY

SEQ ID NO: 377821 - protein, 9 aa, Homo Sapiens
SLIGLENEL

SEQ ID NO: 377822 - protein, 9 aa, Homo Sapiens
GSDIVVAGR

SEQ ID NO: 377823 - protein, 9 aa, Homo Sapiens
VKEKIMGAP

SEQ ID NO: 377824 - protein, 9 aa, Homo Sapiens
AARQTKRIQ

SEQ ID NO: 377825 - protein, 9 aa, Homo Sapiens
WKIKIIQFG

SEQ ID NO: 377826 - protein, 9 aa, Homo Sapiens
FSVGLQNCD

SEQ ID NO: 377827 - protein, 9 aa, Homo Sapiens
EHCLHMFNR

SEQ ID NO: 377828 - protein, 9 aa, Homo Sapiens
HVHQQYHHN

SEQ ID NO: 377829 - protein, 9 aa, Homo Sapiens
PGVVLLNNN

SEQ ID NO: 377830 - protein, 9 aa, Homo Sapiens
HHYIKPSNI

SEQ ID NO: 377831 - protein, 9 aa, Homo Sapiens
INIIQGRPL

SEQ ID NO: 377832 - protein, 9 aa, Homo Sapiens
LPQLHIGDW

SEQ ID NO: 377833 - protein, 9 aa, Homo Sapiens
LIMHKCEEN

SEQ ID NO: 377834 - protein, 9 aa, Homo Sapiens
KQELNKLHE

SEQ ID NO: 377835 - protein, 9 aa, Homo Sapiens
ELERKKQHL

SEQ ID NO: 377836 - protein, 9 aa, Homo Sapiens
LLVKKIDDA

SEQ ID NO: 377837 - protein, 9 aa, Homo Sapiens
DKPFISSRT

SEQ ID NO: 377838 - protein, 9 aa, Homo Sapiens
RSERTCSLN

SEQ ID NO: 377839 - protein, 9 aa, Homo Sapiens
NNGVPLSPQ

SEQ ID NO: 377840 - protein, 9 aa, Homo Sapiens
QDNSLEICK

SEQ ID NO: 377841 - protein, 9 aa, Homo Sapiens
GFIKPTKNS

SEQ ID NO: 377842 - protein, 9 aa, Homo Sapiens
NSSQNYLDY

SEQ ID NO: 377843 - protein, 9 aa, Homo Sapiens
NKLHEELCI

SEQ ID NO: 377844 - protein, 9 aa, Homo Sapiens
NKWSHMFLL

SEQ ID NO: 377845 - protein, 9 aa, Homo Sapiens
SNGIISSLP

SEQ ID NO: 377846 - protein, 9 aa, Homo Sapiens
IDAVTSSGT

SEQ ID NO: 377847 - protein, 9 aa, Homo Sapiens
INSSAKNNS

SEQ ID NO: 377848 - protein, 9 aa, Homo Sapiens
GGQAHKDLL

SEQ ID NO: 377849 - protein, 9 aa, Homo Sapiens
SLSSVTVPN

SEQ ID NO: 377850 - protein, 9 aa, Homo Sapiens
GSSTQLLMS

SEQ ID NO: 377851 - protein, 9 aa, Homo Sapiens
LEKGQDGQP

SEQ ID NO: 377852 - protein, 9 aa, Homo Sapiens
ASGGYIFYT

SEQ ID NO: 377853 - protein, 9 aa, Homo Sapiens
DSLWQEGFL

SEQ ID NO: 377854 - protein, 9 aa, Homo Sapiens
NPRADNIHN

SEQ ID NO: 377855 - protein, 9 aa, Homo Sapiens
RPVTGEPGQ

SEQ ID NO: 377856 - protein, 9 aa, Homo Sapiens
KNIDKYNYT

SEQ ID NO: 377857 - protein, 9 aa, Homo Sapiens
EDLQKKKHD

SEQ ID NO: 377858 - protein, 9 aa, Homo Sapiens
AAENGQANT

SEQ ID NO: 377859 - protein, 9 aa, Homo Sapiens
SVLKQKKTT

SEQ ID NO: 377860 - protein, 9 aa, Homo Sapiens
GTTPVWYGL

SEQ ID NO: 377861 - protein, 9 aa, Homo Sapiens
DELSDALNC

SEQ ID NO: 377862 - protein, 9 aa, Homo Sapiens
AELNSVIND

SEQ ID NO: 377863 - protein, 9 aa, Homo Sapiens
EGATAPATP

SEQ ID NO: 377864 - protein, 9 aa, Homo Sapiens
THQKELDTL

SEQ ID NO: 377865 - protein, 9 aa, Homo Sapiens
LGGVGLPVI

SEQ ID NO: 377866 - protein, 9 aa, Homo Sapiens
GKILLTNME

SEQ ID NO: 377867 - protein, 9 aa, Homo Sapiens
FIVLFAYAQ

SEQ ID NO: 377868 - protein, 9 aa, Homo Sapiens
WCQFADMEK

SEQ ID NO: 377869 - protein, 9 aa, Homo Sapiens
LIWLLASLI

SEQ ID NO: 377870 - protein, 9 aa, Homo Sapiens
RRRITYSDT

SEQ ID NO: 377871 - protein, 9 aa, Homo Sapiens
TKYLGCQWR

SEQ ID NO: 377872 - protein, 9 aa, Homo Sapiens
ELVCRLKLC

SEQ ID NO: 377873 - protein, 9 aa, Homo Sapiens
VTLRYGHIL

SEQ ID NO: 377874 - protein, 9 aa, Homo Sapiens
ETSTKTRQR

SEQ ID NO: 377875 - protein, 9 aa, Homo Sapiens
LFRMHEITH

SEQ ID NO: 377876 - protein, 9 aa, Homo Sapiens
GHSVVLCLA

SEQ ID NO: 377877 - protein, 9 aa, Homo Sapiens
EISTQRMWI

SEQ ID NO: 377878 - protein, 9 aa, Homo Sapiens
SHYPQLHIR

SEQ ID NO: 377879 - protein, 9 aa, Homo Sapiens
IFNRVDISI

SEQ ID NO: 377880 - protein, 9 aa, Homo Sapiens
KVKLDHPDI

SEQ ID NO: 377881 - protein, 9 aa, Homo Sapiens
DEQQQKRLE

SEQ ID NO: 377882 - protein, 9 aa, Homo Sapiens
RNHQRTHTG

SEQ ID NO: 377883 - protein, 9 aa, Homo Sapiens
QQRMSRPLM

SEQ ID NO: 377884 - protein, 9 aa, Homo Sapiens
LESQTTIGC

SEQ ID NO: 377885 - protein, 9 aa, Homo Sapiens
DTIKNVKAK

SEQ ID NO: 377886 - protein, 9 aa, Homo Sapiens
LIIFAWGTL

SEQ ID NO: 377887 - protein, 9 aa, Homo Sapiens
VWLPGVVLL

SEQ ID NO: 377888 - protein, 9 aa, Homo Sapiens
VSFVGICFS

SEQ ID NO: 377889 - protein, 9 aa, Homo Sapiens
YYNGEDRAK

SEQ ID NO: 377890 - protein, 9 aa, Homo Sapiens
PLREINKIV

SEQ ID NO: 377891 - protein, 9 aa, Homo Sapiens
APVDLCETD

SEQ ID NO: 377892 - protein, 9 aa, Homo Sapiens
ESKQSTPSD

SEQ ID NO: 377893 - protein, 9 aa, Homo Sapiens
VHVNSVNHN

SEQ ID NO: 377894 - protein, 9 aa, Homo Sapiens
KTFTSSDKS

SEQ ID NO: 377895 - protein, 9 aa, Homo Sapiens
ITYSLAKDT

SEQ ID NO: 377896 - protein, 9 aa, Homo Sapiens
SKKVIHHYI

SEQ ID NO: 377897 - protein, 9 aa, Homo Sapiens
ASTIFNCRM

SEQ ID NO: 377898 - protein, 9 aa, Homo Sapiens
TNELQLEAA

SEQ ID NO: 377899 - protein, 9 aa, Homo Sapiens
LKTVAVITL

SEQ ID NO: 377900 - protein, 9 aa, Homo Sapiens
SAGVGSWLL

SEQ ID NO: 377901 - protein, 9 aa, Homo Sapiens
AFNIGALRN

SEQ ID NO: 377902 - protein, 9 aa, Homo Sapiens
PSLFRMHEI

SEQ ID NO: 377903 - protein, 9 aa, Homo Sapiens
QKFIKIDQA

SEQ ID NO: 377904 - protein, 9 aa, Homo Sapiens
VNNWPWMKL

SEQ ID NO: 377905 - protein, 9 aa, Homo Sapiens
IDGCPVKKG

SEQ ID NO: 377906 - protein, 9 aa, Homo Sapiens
VIVGGVIGF

SEQ ID NO: 377907 - protein, 9 aa, Homo Sapiens
RGPLFTVDT

SEQ ID NO: 377908 - protein, 9 aa, Homo Sapiens
HLNYVKEVD

SEQ ID NO: 377909 - protein, 9 aa, Homo Sapiens
VCGKIGLIE

SEQ ID NO: 377910 - protein, 9 aa, Homo Sapiens
REVYQEHVR

SEQ ID NO: 377911 - protein, 9 aa, Homo Sapiens
SAKNNSNWT

SEQ ID NO: 377912 - protein, 9 aa, Homo Sapiens
NYKACMRTS

SEQ ID NO: 377913 - protein, 9 aa, Homo Sapiens
LKYVFNPIV

SEQ ID NO: 377914 - protein, 9 aa, Homo Sapiens
IVASMTVWE

SEQ ID NO: 377915 - protein, 9 aa, Homo Sapiens
GALTRVSQI

SEQ ID NO: 377916 - protein, 9 aa, Homo Sapiens
VFELQPGAL

SEQ ID NO: 377917 - protein, 9 aa, Homo Sapiens
TQGISNVHK

SEQ ID NO: 377918 - protein, 9 aa, Homo Sapiens
WIRRNQDKF

SEQ ID NO: 377919 - protein, 9 aa, Homo Sapiens
YNPDDLTSN

SEQ ID NO: 377920 - protein, 9 aa, Homo Sapiens
GTGQQVCWA

SEQ ID NO: 377921 - protein, 9 aa, Homo Sapiens
VAAGGDIKK

SEQ ID NO: 377922 - protein, 9 aa, Homo Sapiens
ANKIALEAS

SEQ ID NO: 377923 - protein, 9 aa, Homo Sapiens
DPFYPPISG

SEQ ID NO: 377924 - protein, 9 aa, Homo Sapiens
DADTQIFFS

SEQ ID NO: 377925 - protein, 9 aa, Homo Sapiens
KQMRDFLCE

SEQ ID NO: 377926 - protein, 9 aa, Homo Sapiens
QRMWIPQLV

SEQ ID NO: 377927 - protein, 9 aa, Homo Sapiens
YVLFGVGSV

SEQ ID NO: 377928 - protein, 9 aa, Homo Sapiens
CHQKDLDLA

SEQ ID NO: 377929 - protein, 9 aa, Homo Sapiens
LRALKTVYV

SEQ ID NO: 377930 - protein, 9 aa, Homo Sapiens
KDSLIKLKE

SEQ ID NO: 377931 - protein, 9 aa, Homo Sapiens
LDALQLPTS

SEQ ID NO: 377932 - protein, 9 aa, Homo Sapiens
EEEEEDTSN

SEQ ID NO: 377933 - protein, 9 aa, Homo Sapiens
YRKALKFYQ

SEQ ID NO: 377934 - protein, 9 aa, Homo Sapiens
IASLIWNKF

SEQ ID NO: 377935 - protein, 9 aa, Homo Sapiens
DINTVAVQS

SEQ ID NO: 377936 - protein, 9 aa, Homo Sapiens
LDNEILTAE

SEQ ID NO: 377937 - protein, 9 aa, Homo Sapiens
EYEKECSLS

SEQ ID NO: 377938 - protein, 9 aa, Homo Sapiens
CLLMAEECT

SEQ ID NO: 377939 - protein, 9 aa, Homo Sapiens
SGQICLYCV

SEQ ID NO: 377940 - protein, 9 aa, Homo Sapiens
TNTKGSFRC

SEQ ID NO: 377941 - protein, 9 aa, Homo Sapiens
GSQSPEECQ

SEQ ID NO: 377942 - protein, 9 aa, Homo Sapiens
MEVCKFSLY

SEQ ID NO: 377943 - protein, 9 aa, Homo Sapiens
FDDSLRVNY

SEQ ID NO: 377944 - protein, 9 aa, Homo Sapiens
LVCLCGCLA

SEQ ID NO: 377945 - protein, 9 aa, Homo Sapiens
TFAGLDCPA

SEQ ID NO: 377946 - protein, 9 aa, Homo Sapiens
LNRLFDNVT

SEQ ID NO: 377947 - protein, 9 aa, Homo Sapiens
ISNILSLLR

SEQ ID NO: 377948 - protein, 9 aa, Homo Sapiens
IFVLLLSAI

SEQ ID NO: 377949 - protein, 9 aa, Homo Sapiens
LVMAVLTNP

SEQ ID NO: 377950 - protein, 9 aa, Homo Sapiens
LEDPREKQF

SEQ ID NO: 377951 - protein, 9 aa, Homo Sapiens
VDFSKWYMD

SEQ ID NO: 377952 - protein, 9 aa, Homo Sapiens
PSDTIKNVK

SEQ ID NO: 377953 - protein, 9 aa, Homo Sapiens
HLTQHQRSH

SEQ ID NO: 377954 - protein, 9 aa, Homo Sapiens
NEFLLFICK

SEQ ID NO: 377955 - protein, 9 aa, Homo Sapiens
GESKEVIPD

SEQ ID NO: 377956 - protein, 9 aa, Homo Sapiens
RNKLIGKEV

SEQ ID NO: 377957 - protein, 9 aa, Homo Sapiens
RPYGRQPQY

SEQ ID NO: 377958 - protein, 9 aa, Homo Sapiens
ESQTTIGCG

SEQ ID NO: 377959 - protein, 9 aa, Homo Sapiens
SVSDDLGCR

SEQ ID NO: 377960 - protein, 9 aa, Homo Sapiens
PLSPLDKQQ

SEQ ID NO: 377961 - protein, 9 aa, Homo Sapiens
VKLHCPKCN

SEQ ID NO: 377962 - protein, 9 aa, Homo Sapiens
LMEDAEIQL

SEQ ID NO: 377963 - protein, 9 aa, Homo Sapiens
DDVIDGCPV

SEQ ID NO: 377964 - protein, 9 aa, Homo Sapiens
HFLQILRML

SEQ ID NO: 377965 - protein, 9 aa, Homo Sapiens
ENYRIEEED

SEQ ID NO: 377966 - protein, 9 aa, Homo Sapiens
ADEDINTRF

SEQ ID NO: 377967 - protein, 9 aa, Homo Sapiens
FSYRRYSPF

SEQ ID NO: 377968 - protein, 9 aa, Homo Sapiens
SLGLTVYKP

SEQ ID NO: 377969 - protein, 9 aa, Homo Sapiens
LILYAIDWN

SEQ ID NO: 377970 - protein, 9 aa, Homo Sapiens
NNVFAHLPQ

SEQ ID NO: 377971 - protein, 9 aa, Homo Sapiens
YHGNVLYGK

SEQ ID NO: 377972 - protein, 9 aa, Homo Sapiens
NLQNEKEEL

SEQ ID NO: 377973 - protein, 9 aa, Homo Sapiens
KKQNNGKKH

SEQ ID NO: 377974 - protein, 9 aa, Homo Sapiens
EYLFDRNRP

SEQ ID NO: 377975 - protein, 9 aa, Homo Sapiens
YVLAAKTGI

SEQ ID NO: 377976 - protein, 9 aa, Homo Sapiens
TEANKLASA

SEQ ID NO: 377977 - protein, 9 aa, Homo Sapiens
VSLENVNKK

SEQ ID NO: 377978 - protein, 9 aa, Homo Sapiens
CIDQFVYST

SEQ ID NO: 377979 - protein, 9 aa, Homo Sapiens
QTRQPVSVQ

SEQ ID NO: 377980 - protein, 9 aa, Homo Sapiens
LEPTQKDIA

SEQ ID NO: 377981 - protein, 9 aa, Homo Sapiens
VFSIEATMK

SEQ ID NO: 377982 - protein, 9 aa, Homo Sapiens
RPHIAGITA

SEQ ID NO: 377983 - protein, 9 aa, Homo Sapiens
KEKPESVGK

SEQ ID NO: 377984 - protein, 9 aa, Homo Sapiens
KSLKRKHKK

SEQ ID NO: 377985 - protein, 9 aa, Homo Sapiens
HTGPKGVIH

SEQ ID NO: 377986 - protein, 9 aa, Homo Sapiens
QLSKEQKEL

SEQ ID NO: 377987 - protein, 9 aa, Homo Sapiens
RHEVVDGEV

SEQ ID NO: 377988 - protein, 9 aa, Homo Sapiens
IRKALALDK

SEQ ID NO: 377989 - protein, 9 aa, Homo Sapiens
EDNQSVVRI

SEQ ID NO: 377990 - protein, 9 aa, Homo Sapiens
IKIQQRNGR

SEQ ID NO: 377991 - protein, 9 aa, Homo Sapiens
VICPEMLHV

SEQ ID NO: 377992 - protein, 9 aa, Homo Sapiens
EARYLQQKA

SEQ ID NO: 377993 - protein, 9 aa, Homo Sapiens
LFTFFVRAV

SEQ ID NO: 377994 - protein, 9 aa, Homo Sapiens
KDGTIGGNN

SEQ ID NO: 377995 - protein, 9 aa, Homo Sapiens
IMHKCEENT

SEQ ID NO: 377996 - protein, 9 aa, Homo Sapiens
CEGDDKDTA

SEQ ID NO: 377997 - protein, 9 aa, Homo Sapiens
QSTPSDTQT

SEQ ID NO: 377998 - protein, 9 aa, Homo Sapiens
VIPLNKRLK

SEQ ID NO: 377999 - protein, 9 aa, Homo Sapiens
SYARNNPTK

SEQ ID NO: 378000 - protein, 9 aa, Homo Sapiens
FIEAKASTI

SEQ ID NO: 378001 - protein, 9 aa, Homo Sapiens
KMRVLQENK

SEQ ID NO: 378002 - protein, 9 aa, Homo Sapiens
GAGTSFLID

SEQ ID NO: 378003 - protein, 9 aa, Homo Sapiens
LQENKQKMD

SEQ ID NO: 378004 - protein, 9 aa, Homo Sapiens
FILNHLLWN

SEQ ID NO: 378005 - protein, 9 aa, Homo Sapiens
VASETKCGE

SEQ ID NO: 378006 - protein, 9 aa, Homo Sapiens
NDILEALQI

SEQ ID NO: 378007 - protein, 9 aa, Homo Sapiens
HSRKLILAQ

SEQ ID NO: 378008 - protein, 9 aa, Homo Sapiens
SVNHNYTGG

SEQ ID NO: 378009 - protein, 9 aa, Homo Sapiens
LAATYIALN

SEQ ID NO: 378010 - protein, 9 aa, Homo Sapiens
RARNINNKV

SEQ ID NO: 378011 - protein, 9 aa, Homo Sapiens
KVFCEITQH

SEQ ID NO: 378012 - protein, 9 aa, Homo Sapiens
KYLEVRSPE

SEQ ID NO: 378013 - protein, 9 aa, Homo Sapiens
CEEKMESGK

SEQ ID NO: 378014 - protein, 9 aa, Homo Sapiens
AFFSTAISY

SEQ ID NO: 378015 - protein, 9 aa, Homo Sapiens
SRLLEEKVC

SEQ ID NO: 378016 - protein, 9 aa, Homo Sapiens
FWCEAMKKL

SEQ ID NO: 378017 - protein, 9 aa, Homo Sapiens
MSGQSRGRK

SEQ ID NO: 378018 - protein, 9 aa, Homo Sapiens
GVNLYYVGG

SEQ ID NO: 378019 - protein, 9 aa, Homo Sapiens
TLIIMVFFK

SEQ ID NO: 378020 - protein, 9 aa, Homo Sapiens
IQKQFFHSV

SEQ ID NO: 378021 - protein, 9 aa, Homo Sapiens
LFTLFAKGE

SEQ ID NO: 378022 - protein, 9 aa, Homo Sapiens
VAQNRSACT

SEQ ID NO: 378023 - protein, 9 aa, Homo Sapiens
FKEADDLFT

SEQ ID NO: 378024 - protein, 9 aa, Homo Sapiens
KVHVNSVNH

SEQ ID NO: 378025 - protein, 9 aa, Homo Sapiens
YLEVIRKWA

SEQ ID NO: 378026 - protein, 9 aa, Homo Sapiens
TACPLCHKL

SEQ ID NO: 378027 - protein, 9 aa, Homo Sapiens
DKFMKCLHN

SEQ ID NO: 378028 - protein, 9 aa, Homo Sapiens
KSSILVWVV

SEQ ID NO: 378029 - protein, 9 aa, Homo Sapiens
LQTRQPVSV

SEQ ID NO: 378030 - protein, 9 aa, Homo Sapiens
CITDAVYNH

SEQ ID NO: 378031 - protein, 9 aa, Homo Sapiens
LCEVGEEEF

SEQ ID NO: 378032 - protein, 9 aa, Homo Sapiens
DSTIHVDEN

SEQ ID NO: 378033 - protein, 9 aa, Homo Sapiens
QFNLCLEER

SEQ ID NO: 378034 - protein, 9 aa, Homo Sapiens
SKMKMGRYW

SEQ ID NO: 378035 - protein, 9 aa, Homo Sapiens
GGNNNIAIV

SEQ ID NO: 378036 - protein, 9 aa, Homo Sapiens
FNKYNNDKK

SEQ ID NO: 378037 - protein, 9 aa, Homo Sapiens
MLPLLAQLC

SEQ ID NO: 378038 - protein, 9 aa, Homo Sapiens
MGLFMISTS

SEQ ID NO: 378039 - protein, 9 aa, Homo Sapiens
NDIQVVENK

SEQ ID NO: 378040 - protein, 9 aa, Homo Sapiens
VGIAWAKTY

SEQ ID NO: 378041 - protein, 9 aa, Homo Sapiens
PLAPSRGKD

SEQ ID NO: 378042 - protein, 9 aa, Homo Sapiens
KANMDMCCA

SEQ ID NO: 378043 - protein, 9 aa, Homo Sapiens
EHAKKMDNL

SEQ ID NO: 378044 - protein, 9 aa, Homo Sapiens
YRNTPVSKR

SEQ ID NO: 378045 - protein, 9 aa, Homo Sapiens
LCCNCPSGG

SEQ ID NO: 378046 - protein, 9 aa, Homo Sapiens
KIVQKSHNN

SEQ ID NO: 378047 - protein, 9 aa, Homo Sapiens
NIDDKEPLI

SEQ ID NO: 378048 - protein, 9 aa, Homo Sapiens
FTSQDIQHL

SEQ ID NO: 378049 - protein, 9 aa, Homo Sapiens
YLEKAREKK

SEQ ID NO: 378050 - protein, 9 aa, Homo Sapiens
GLCLEKLSI

SEQ ID NO: 378051 - protein, 9 aa, Homo Sapiens
QHTHKLLVM

SEQ ID NO: 378052 - protein, 9 aa, Homo Sapiens
KYISDNSSV

SEQ ID NO: 378053 - protein, 9 aa, Homo Sapiens
QVHPGMDLS

SEQ ID NO: 378054 - protein, 9 aa, Homo Sapiens
YLKVKLDHP

SEQ ID NO: 378055 - protein, 9 aa, Homo Sapiens
KPSFTQDHK

SEQ ID NO: 378056 - protein, 9 aa, Homo Sapiens
AFQNPGPQV

SEQ ID NO: 378057 - protein, 9 aa, Homo Sapiens
DYWKLSMQC

SEQ ID NO: 378058 - protein, 9 aa, Homo Sapiens
NIPIVITTK

SEQ ID NO: 378059 - protein, 9 aa, Homo Sapiens
RSIQIGKIL

SEQ ID NO: 378060 - protein, 9 aa, Homo Sapiens
VSVQLLQGV

SEQ ID NO: 378061 - protein, 9 aa, Homo Sapiens
AERGPHFPR

SEQ ID NO: 378062 - protein, 9 aa, Homo Sapiens
FDFPCPEKC

SEQ ID NO: 378063 - protein, 9 aa, Homo Sapiens
VNGCPEFRV

SEQ ID NO: 378064 - protein, 9 aa, Homo Sapiens
VYIIFSLEI

SEQ ID NO: 378065 - protein, 9 aa, Homo Sapiens
KIWRLMGKP

SEQ ID NO: 378066 - protein, 9 aa, Homo Sapiens
SPTAGMVTI

SEQ ID NO: 378067 - protein, 9 aa, Homo Sapiens
YRLQFYMFT

SEQ ID NO: 378068 - protein, 9 aa, Homo Sapiens
NMMSKTSLG

SEQ ID NO: 378069 - protein, 9 aa, Homo Sapiens
VDEVKALAF

SEQ ID NO: 378070 - protein, 9 aa, Homo Sapiens
ELDTLSGKL

SEQ ID NO: 378071 - protein, 9 aa, Homo Sapiens
PELTQGISN

SEQ ID NO: 378072 - protein, 9 aa, Homo Sapiens
FYDLLSGYL

SEQ ID NO: 378073 - protein, 9 aa, Homo Sapiens
TIYPQHSAV

SEQ ID NO: 378074 - protein, 9 aa, Homo Sapiens
QTEKEKTTL

SEQ ID NO: 378075 - protein, 9 aa, Homo Sapiens
NNLKKEFLH

SEQ ID NO: 378076 - protein, 9 aa, Homo Sapiens
GHLSGKEAD

SEQ ID NO: 378077 - protein, 9 aa, Homo Sapiens
CRKKLARPA

SEQ ID NO: 378078 - protein, 9 aa, Homo Sapiens
YLHYRSTLD

SEQ ID NO: 378079 - protein, 9 aa, Homo Sapiens
GSQIYLEGK

SEQ ID NO: 378080 - protein, 9 aa, Homo Sapiens
LPVIMGCKS

SEQ ID NO: 378081 - protein, 9 aa, Homo Sapiens
IHHYIKPSN

SEQ ID NO: 378082 - protein, 9 aa, Homo Sapiens
YLSAHATAM

SEQ ID NO: 378083 - protein, 9 aa, Homo Sapiens
FADMEKLQC

SEQ ID NO: 378084 - protein, 9 aa, Homo Sapiens
VASLFLDVV

SEQ ID NO: 378085 - protein, 9 aa, Homo Sapiens
NKFFPKGAT

SEQ ID NO: 378086 - protein, 9 aa, Homo Sapiens
FQGLAPGRK

SEQ ID NO: 378087 - protein, 9 aa, Homo Sapiens
LIKLKESSA

SEQ ID NO: 378088 - protein, 9 aa, Homo Sapiens
GPFGYINNP

SEQ ID NO: 378089 - protein, 9 aa, Homo Sapiens
LACVDTYVM

SEQ ID NO: 378090 - protein, 9 aa, Homo Sapiens
IELEVICPE

SEQ ID NO: 378091 - protein, 9 aa, Homo Sapiens
SMLENFLER

SEQ ID NO: 378092 - protein, 9 aa, Homo Sapiens
HVLVCLCGC

SEQ ID NO: 378093 - protein, 9 aa, Homo Sapiens
LAKLLTRMH

SEQ ID NO: 378094 - protein, 9 aa, Homo Sapiens
HTLDGRNIN

SEQ ID NO: 378095 - protein, 9 aa, Homo Sapiens
GCTVIPLNK

SEQ ID NO: 378096 - protein, 9 aa, Homo Sapiens
PGEDVLINI

SEQ ID NO: 378097 - protein, 9 aa, Homo Sapiens
LMELRLRDA

SEQ ID NO: 378098 - protein, 9 aa, Homo Sapiens
LWTLIIMVF

SEQ ID NO: 378099 - protein, 9 aa, Homo Sapiens
IPFIETSTK

SEQ ID NO: 378100 - protein, 9 aa, Homo Sapiens
VLDPMLDLY

SEQ ID NO: 378101 - protein, 9 aa, Homo Sapiens
KYPGKMSPE

SEQ ID NO: 378102 - protein, 9 aa, Homo Sapiens
KKRRKKKSL

SEQ ID NO: 378103 - protein, 9 aa, Homo Sapiens
VKEVDQLRL

SEQ ID NO: 378104 - protein, 9 aa, Homo Sapiens
CVESFSQSP

SEQ ID NO: 378105 - protein, 9 aa, Homo Sapiens
RSKLVYHQI

SEQ ID NO: 378106 - protein, 9 aa, Homo Sapiens
TLSKTSHLR

SEQ ID NO: 378107 - protein, 9 aa, Homo Sapiens
RHHIIHSGE

SEQ ID NO: 378108 - protein, 9 aa, Homo Sapiens
GRLLKKTNK

SEQ ID NO: 378109 - protein, 9 aa, Homo Sapiens
LMSQVQTRM

SEQ ID NO: 378110 - protein, 9 aa, Homo Sapiens
NKEMGNSMK

SEQ ID NO: 378111 - protein, 9 aa, Homo Sapiens
PVKLDPFGA

SEQ ID NO: 378112 - protein, 9 aa, Homo Sapiens
TQICPAFFL

SEQ ID NO: 378113 - protein, 9 aa, Homo Sapiens
MMNENNLEK

SEQ ID NO: 378114 - protein, 9 aa, Homo Sapiens
MGGRPLSPL

SEQ ID NO: 378115 - protein, 9 aa, Homo Sapiens
QEKKLQMDL

SEQ ID NO: 378116 - protein, 9 aa, Homo Sapiens
RQENDKDNL

SEQ ID NO: 378117 - protein, 9 aa, Homo Sapiens
PCCKRLWRL

SEQ ID NO: 378118 - protein, 9 aa, Homo Sapiens
SFSQSPPLG

SEQ ID NO: 378119 - protein, 9 aa, Homo Sapiens
EKLLDPAIW

SEQ ID NO: 378120 - protein, 9 aa, Homo Sapiens
NKYLIQGKD

SEQ ID NO: 378121 - protein, 9 aa, Homo Sapiens
LGDIQPGVN

SEQ ID NO: 378122 - protein, 9 aa, Homo Sapiens
VQIQIIFFN

SEQ ID NO: 378123 - protein, 9 aa, Homo Sapiens
TPNKLVQLN

SEQ ID NO: 378124 - protein, 9 aa, Homo Sapiens
APGRKYVLW

SEQ ID NO: 378125 - protein, 9 aa, Homo Sapiens
SKKHDQQLA

SEQ ID NO: 378126 - protein, 9 aa, Homo Sapiens
AIHTFPTQE

SEQ ID NO: 378127 - protein, 9 aa, Homo Sapiens
WTKIDDTKV

SEQ ID NO: 378128 - protein, 9 aa, Homo Sapiens
DHLVWQILA

SEQ ID NO: 378129 - protein, 9 aa, Homo Sapiens
VTAAFLVSL

SEQ ID NO: 378130 - protein, 9 aa, Homo Sapiens
RKDSEIKMI

SEQ ID NO: 378131 - protein, 9 aa, Homo Sapiens
DIQVVENKN

SEQ ID NO: 378132 - protein, 9 aa, Homo Sapiens
WELFEELDR

SEQ ID NO: 378133 - protein, 9 aa, Homo Sapiens
DSISALRKE

SEQ ID NO: 378134 - protein, 9 aa, Homo Sapiens
RSPIKLDFL

SEQ ID NO: 378135 - protein, 9 aa, Homo Sapiens
GARRRPWRC

SEQ ID NO: 378136 - protein, 9 aa, Homo Sapiens
PKRSERTCS

SEQ ID NO: 378137 - protein, 9 aa, Homo Sapiens
FEVPCRDLG

SEQ ID NO: 378138 - protein, 9 aa, Homo Sapiens
MSKRKNNYP

SEQ ID NO: 378139 - protein, 9 aa, Homo Sapiens
LCIIEPIMA

SEQ ID NO: 378140 - protein, 9 aa, Homo Sapiens
AGEIDAVTS

SEQ ID NO: 378141 - protein, 9 aa, Homo Sapiens
QGKTKKLNK

SEQ ID NO: 378142 - protein, 9 aa, Homo Sapiens
RKKTVLVGR

SEQ ID NO: 378143 - protein, 9 aa, Homo Sapiens
RPPGHHVEE

SEQ ID NO: 378144 - protein, 9 aa, Homo Sapiens
KLSDLVSRA

SEQ ID NO: 378145 - protein, 9 aa, Homo Sapiens
QLKLNIGKA

SEQ ID NO: 378146 - protein, 9 aa, Homo Sapiens
IILQNVSSE

SEQ ID NO: 378147 - protein, 9 aa, Homo Sapiens
GVNNWPWMK

SEQ ID NO: 378148 - protein, 9 aa, Homo Sapiens
FLSLTGICF

SEQ ID NO: 378149 - protein, 9 aa, Homo Sapiens
RQLKCLAFQ

SEQ ID NO: 378150 - protein, 9 aa, Homo Sapiens
KTLFRCRNE

SEQ ID NO: 378151 - protein, 9 aa, Homo Sapiens
AIFQTDSSP

SEQ ID NO: 378152 - protein, 9 aa, Homo Sapiens
KVDFIDAYT

SEQ ID NO: 378153 - protein, 9 aa, Homo Sapiens
IFDKPRKQK

SEQ ID NO: 378154 - protein, 9 aa, Homo Sapiens
IQVVARDDD

SEQ ID NO: 378155 - protein, 9 aa, Homo Sapiens
GSRQQILAV

SEQ ID NO: 378156 - protein, 9 aa, Homo Sapiens
IIKDSEFET

SEQ ID NO: 378157 - protein, 9 aa, Homo Sapiens
SVIHSFISG

SEQ ID NO: 378158 - protein, 9 aa, Homo Sapiens
MCKSFSQPG

SEQ ID NO: 378159 - protein, 9 aa, Homo Sapiens
RAPLQKVEV

SEQ ID NO: 378160 - protein, 9 aa, Homo Sapiens
LDSISALRK

SEQ ID NO: 378161 - protein, 9 aa, Homo Sapiens
HLQNDNQET

SEQ ID NO: 378162 - protein, 9 aa, Homo Sapiens
NNEKSKLSE

SEQ ID NO: 378163 - protein, 9 aa, Homo Sapiens
ADKLLTEKG

SEQ ID NO: 378164 - protein, 9 aa, Homo Sapiens
AVAPLPCWW

SEQ ID NO: 378165 - protein, 9 aa, Homo Sapiens
TLFEYYIYW

SEQ ID NO: 378166 - protein, 9 aa, Homo Sapiens
GKAYNDASN

SEQ ID NO: 378167 - protein, 9 aa, Homo Sapiens
VRSKFHALF

SEQ ID NO: 378168 - protein, 9 aa, Homo Sapiens
LGLTVYKPE

SEQ ID NO: 378169 - protein, 9 aa, Homo Sapiens
PHTLSVFRV

SEQ ID NO: 378170 - protein, 9 aa, Homo Sapiens
SQEERHTLF

SEQ ID NO: 378171 - protein, 9 aa, Homo Sapiens
SSDLLRHHI

SEQ ID NO: 378172 - protein, 9 aa, Homo Sapiens
QMLSVVTED

SEQ ID NO: 378173 - protein, 9 aa, Homo Sapiens
VKLSSPKSQ

SEQ ID NO: 378174 - protein, 9 aa, Homo Sapiens
EQEKKLQMD

SEQ ID NO: 378175 - protein, 9 aa, Homo Sapiens
EKNQYNIDY

SEQ ID NO: 378176 - protein, 9 aa, Homo Sapiens
FILGLALMA

SEQ ID NO: 378177 - protein, 9 aa, Homo Sapiens
DVPFNLPEI

SEQ ID NO: 378178 - protein, 9 aa, Homo Sapiens
SAPFIKCHG

SEQ ID NO: 378179 - protein, 9 aa, Homo Sapiens
DEDDGLFVP

SEQ ID NO: 378180 - protein, 9 aa, Homo Sapiens
IIEPIMAVE

SEQ ID NO: 378181 - protein, 9 aa, Homo Sapiens
DILEALQII

SEQ ID NO: 378182 - protein, 9 aa, Homo Sapiens
YRGAIARKQ

SEQ ID NO: 378183 - protein, 9 aa, Homo Sapiens
PIHLALSMM

SEQ ID NO: 378184 - protein, 9 aa, Homo Sapiens
INLTKGKSD

SEQ ID NO: 378185 - protein, 9 aa, Homo Sapiens
KVDNFKTSE

SEQ ID NO: 378186 - protein, 9 aa, Homo Sapiens
STSIIDLRD

SEQ ID NO: 378187 - protein, 9 aa, Homo Sapiens
ICDEGKDCC

SEQ ID NO: 378188 - protein, 9 aa, Homo Sapiens
QKALWMVFM

SEQ ID NO: 378189 - protein, 9 aa, Homo Sapiens
NKNDGYVDM

SEQ ID NO: 378190 - protein, 9 aa, Homo Sapiens
RISTSIIDL

SEQ ID NO: 378191 - protein, 9 aa, Homo Sapiens
DIELYKARV

SEQ ID NO: 378192 - protein, 9 aa, Homo Sapiens
NIDSNNLKT

SEQ ID NO: 378193 - protein, 9 aa, Homo Sapiens
GLDHPPLTA

SEQ ID NO: 378194 - protein, 9 aa, Homo Sapiens
SGQSRGRKS

SEQ ID NO: 378195 - protein, 9 aa, Homo Sapiens
ISERQKALW

SEQ ID NO: 378196 - protein, 9 aa, Homo Sapiens
CYAIHTFPT

SEQ ID NO: 378197 - protein, 9 aa, Homo Sapiens
VYFKRFYTR

SEQ ID NO: 378198 - protein, 9 aa, Homo Sapiens
FNWPIYLRK

SEQ ID NO: 378199 - protein, 9 aa, Homo Sapiens
QNQGSEPKY

SEQ ID NO: 378200 - protein, 9 aa, Homo Sapiens
VNNDQPINL

SEQ ID NO: 378201 - protein, 9 aa, Homo Sapiens
DDVQQLCEV

SEQ ID NO: 378202 - protein, 9 aa, Homo Sapiens
YTLMHKDSF

SEQ ID NO: 378203 - protein, 9 aa, Homo Sapiens
QIAKAEQHN

SEQ ID NO: 378204 - protein, 9 aa, Homo Sapiens
PPRKKTVLV

SEQ ID NO: 378205 - protein, 9 aa, Homo Sapiens
FNYVMHFLT

SEQ ID NO: 378206 - protein, 9 aa, Homo Sapiens
PQIAKAEQH

SEQ ID NO: 378207 - protein, 9 aa, Homo Sapiens
LRNAKFDNK

SEQ ID NO: 378208 - protein, 9 aa, Homo Sapiens
FLQHSEINQ

SEQ ID NO: 378209 - protein, 9 aa, Homo Sapiens
STPQYPTAQ

SEQ ID NO: 378210 - protein, 9 aa, Homo Sapiens
GFVSEDKYL

SEQ ID NO: 378211 - protein, 9 aa, Homo Sapiens
SSTLNKHKI

SEQ ID NO: 378212 - protein, 9 aa, Homo Sapiens
TAAFLVSLM

SEQ ID NO: 378213 - protein, 9 aa, Homo Sapiens
HTNSAKPSP

SEQ ID NO: 378214 - protein, 9 aa, Homo Sapiens
SLWQEGFLT

SEQ ID NO: 378215 - protein, 9 aa, Homo Sapiens
SDPFYPPIS

SEQ ID NO: 378216 - protein, 9 aa, Homo Sapiens
EELDQVFSQ

SEQ ID NO: 378217 - protein, 9 aa, Homo Sapiens
PIKRITWNT

SEQ ID NO: 378218 - protein, 9 aa, Homo Sapiens
CNPLKYSII

SEQ ID NO: 378219 - protein, 9 aa, Homo Sapiens
KVIHHYIKP

SEQ ID NO: 378220 - protein, 9 aa, Homo Sapiens
WCKEGYQGV

SEQ ID NO: 378221 - protein, 9 aa, Homo Sapiens
RGHDHEYTD

SEQ ID NO: 378222 - protein, 9 aa, Homo Sapiens
HVNSVNHNY

SEQ ID NO: 378223 - protein, 9 aa, Homo Sapiens
LCQKWNDPR

SEQ ID NO: 378224 - protein, 9 aa, Homo Sapiens
VNYFISAQK

SEQ ID NO: 378225 - protein, 9 aa, Homo Sapiens
FYPPISGSL

SEQ ID NO: 378226 - protein, 9 aa, Homo Sapiens
SGYLEVIRK

SEQ ID NO: 378227 - protein, 9 aa, Homo Sapiens
SQLQTHQII

SEQ ID NO: 378228 - protein, 9 aa, Homo Sapiens
LDPMLDLYS

SEQ ID NO: 378229 - protein, 9 aa, Homo Sapiens
LAMFILNHL

SEQ ID NO: 378230 - protein, 9 aa, Homo Sapiens
LDSNNFKSV

SEQ ID NO: 378231 - protein, 9 aa, Homo Sapiens
LLSAIVSIS

SEQ ID NO: 378232 - protein, 9 aa, Homo Sapiens
NSMELAQTC

SEQ ID NO: 378233 - protein, 9 aa, Homo Sapiens
KICELMADS

SEQ ID NO: 378234 - protein, 9 aa, Homo Sapiens
GLKAAMIKL

SEQ ID NO: 378235 - protein, 9 aa, Homo Sapiens
NKLELAWEL

SEQ ID NO: 378236 - protein, 9 aa, Homo Sapiens
TSGSHKPTR

SEQ ID NO: 378237 - protein, 9 aa, Homo Sapiens
DFIAKAFKI

SEQ ID NO: 378238 - protein, 9 aa, Homo Sapiens
ELDQVFSQS

SEQ ID NO: 378239 - protein, 9 aa, Homo Sapiens
AWTGGLLHY

SEQ ID NO: 378240 - protein, 9 aa, Homo Sapiens
TEFWLENEK

SEQ ID NO: 378241 - protein, 9 aa, Homo Sapiens
GIITVIDTK

SEQ ID NO: 378242 - protein, 9 aa, Homo Sapiens
FVGICFSGR

SEQ ID NO: 378243 - protein, 9 aa, Homo Sapiens
HVLKLARHS

SEQ ID NO: 378244 - protein, 9 aa, Homo Sapiens
SEDKYLEIQ

SEQ ID NO: 378245 - protein, 9 aa, Homo Sapiens
NVYIHENAT

SEQ ID NO: 378246 - protein, 9 aa, Homo Sapiens
SISETGSTI

SEQ ID NO: 378247 - protein, 9 aa, Homo Sapiens
LANESLKPL

SEQ ID NO: 378248 - protein, 9 aa, Homo Sapiens
LNMMSKTSL

SEQ ID NO: 378249 - protein, 9 aa, Homo Sapiens
TIYYTIINK

SEQ ID NO: 378250 - protein, 9 aa, Homo Sapiens
VNVPIDILS

SEQ ID NO: 378251 - protein, 9 aa, Homo Sapiens
KYDISFNVY

SEQ ID NO: 378252 - protein, 9 aa, Homo Sapiens
NIESLRAIR

SEQ ID NO: 378253 - protein, 9 aa, Homo Sapiens
TGSHKHCWC

SEQ ID NO: 378254 - protein, 9 aa, Homo Sapiens
NKAKREEKK

SEQ ID NO: 378255 - protein, 9 aa, Homo Sapiens
IKDQLYLFI

SEQ ID NO: 378256 - protein, 9 aa, Homo Sapiens
LLAQLCLVP

SEQ ID NO: 378257 - protein, 9 aa, Homo Sapiens
VCSILQIHT

SEQ ID NO: 378258 - protein, 9 aa, Homo Sapiens
RLLKKTNKQ

SEQ ID NO: 378259 - protein, 9 aa, Homo Sapiens
DYHIALFGG

SEQ ID NO: 378260 - protein, 9 aa, Homo Sapiens
RVNYFNQYI

SEQ ID NO: 378261 - protein, 9 aa, Homo Sapiens
QAPSHMASM

SEQ ID NO: 378262 - protein, 9 aa, Homo Sapiens
QGNYSAIPP

SEQ ID NO: 378263 - protein, 9 aa, Homo Sapiens
QLLMSVEPE

SEQ ID NO: 378264 - protein, 9 aa, Homo Sapiens
NNIAIVGLI

SEQ ID NO: 378265 - protein, 9 aa, Homo Sapiens
HKVVLDAIM

SEQ ID NO: 378266 - protein, 9 aa, Homo Sapiens
QKSHNNCFP

SEQ ID NO: 378267 - protein, 9 aa, Homo Sapiens
ISTKNPDVL

SEQ ID NO: 378268 - protein, 9 aa, Homo Sapiens
CNSMVSCYA

SEQ ID NO: 378269 - protein, 9 aa, Homo Sapiens
CLYCVTVPK

SEQ ID NO: 378270 - protein, 9 aa, Homo Sapiens
ALERWKIKI

SEQ ID NO: 378271 - protein, 9 aa, Homo Sapiens
PCLRVFAFQ

SEQ ID NO: 378272 - protein, 9 aa, Homo Sapiens
AFQQELVLL

SEQ ID NO: 378273 - protein, 9 aa, Homo Sapiens
ESLRNNDLN

SEQ ID NO: 378274 - protein, 9 aa, Homo Sapiens
HCYHQFSTP

SEQ ID NO: 378275 - protein, 9 aa, Homo Sapiens
SGKSSILVW

SEQ ID NO: 378276 - protein, 9 aa, Homo Sapiens
QIQTQPGYA

SEQ ID NO: 378277 - protein, 9 aa, Homo Sapiens
DGRNINPKP

SEQ ID NO: 378278 - protein, 9 aa, Homo Sapiens
KYRPDLIDI

SEQ ID NO: 378279 - protein, 9 aa, Homo Sapiens
QVQSPSINM

SEQ ID NO: 378280 - protein, 9 aa, Homo Sapiens
VHQQYHHNM

SEQ ID NO: 378281 - protein, 9 aa, Homo Sapiens
EGLSRHQAD

SEQ ID NO: 378282 - protein, 9 aa, Homo Sapiens
HGDSQHRAT

SEQ ID NO: 378283 - protein, 9 aa, Homo Sapiens
NSVAFKFKP

SEQ ID NO: 378284 - protein, 9 aa, Homo Sapiens
PGVPGPPGL

SEQ ID NO: 378285 - protein, 9 aa, Homo Sapiens
MQGPPWTIY

SEQ ID NO: 378286 - protein, 9 aa, Homo Sapiens
PFVGTIPNQ

SEQ ID NO: 378287 - protein, 9 aa, Homo Sapiens
GSPGIEWSN

SEQ ID NO: 378288 - protein, 9 aa, Homo Sapiens
DISISQLID

SEQ ID NO: 378289 - protein, 9 aa, Homo Sapiens
SSSLESPVV

SEQ ID NO: 378290 - protein, 9 aa, Homo Sapiens
SFICCFIRL

SEQ ID NO: 378291 - protein, 9 aa, Homo Sapiens
VNKLPAGIK

SEQ ID NO: 378292 - protein, 9 aa, Homo Sapiens
KIDQAWKIL

SEQ ID NO: 378293 - protein, 9 aa, Homo Sapiens
IHIKIQQRN

SEQ ID NO: 378294 - protein, 9 aa, Homo Sapiens
MEHKIIHTG

SEQ ID NO: 378295 - protein, 9 aa, Homo Sapiens
SWTKVGSCS

SEQ ID NO: 378296 - protein, 9 aa, Homo Sapiens
QHLKELLGH

SEQ ID NO: 378297 - protein, 9 aa, Homo Sapiens
SICHNLSLH

SEQ ID NO: 378298 - protein, 9 aa, Homo Sapiens
SWYVDDLMS

SEQ ID NO: 378299 - protein, 9 aa, Homo Sapiens
FLCQKWNDP

SEQ ID NO: 378300 - protein, 9 aa, Homo Sapiens
NELKSCRSA

SEQ ID NO: 378301 - protein, 9 aa, Homo Sapiens
CFLLQKLVL

SEQ ID NO: 378302 - protein, 9 aa, Homo Sapiens
KWFNVRMGV

SEQ ID NO: 378303 - protein, 9 aa, Homo Sapiens
LNYLYELLA

SEQ ID NO: 378304 - protein, 9 aa, Homo Sapiens
SSVVGITTQ

SEQ ID NO: 378305 - protein, 9 aa, Homo Sapiens
EVTDHIASL

SEQ ID NO: 378306 - protein, 9 aa, Homo Sapiens
NADKMVYNK

SEQ ID NO: 378307 - protein, 9 aa, Homo Sapiens
IIKLTDYFT

SEQ ID NO: 378308 - protein, 9 aa, Homo Sapiens
LHDYREVYQ

SEQ ID NO: 378309 - protein, 9 aa, Homo Sapiens
MEAFNLLVL

SEQ ID NO: 378310 - protein, 9 aa, Homo Sapiens
PAVAPLPCW

SEQ ID NO: 378311 - protein, 9 aa, Homo Sapiens
ARETKIILD

SEQ ID NO: 378312 - protein, 9 aa, Homo Sapiens
NFIQWCQKE

SEQ ID NO: 378313 - protein, 9 aa, Homo Sapiens
LELIIKHNN

SEQ ID NO: 378314 - protein, 9 aa, Homo Sapiens
AASSAWKHN

SEQ ID NO: 378315 - protein, 9 aa, Homo Sapiens
KPYTCPKCG

SEQ ID NO: 378316 - protein, 9 aa, Homo Sapiens
ILPLRFVEF

SEQ ID NO: 378317 - protein, 9 aa, Homo Sapiens
VLAAKTGIE

SEQ ID NO: 378318 - protein, 9 aa, Homo Sapiens
ACTDKDYLY

SEQ ID NO: 378319 - protein, 9 aa, Homo Sapiens
TYLHSLSNC

SEQ ID NO: 378320 - protein, 9 aa, Homo Sapiens
ELELDEQQQ

SEQ ID NO: 378321 - protein, 9 aa, Homo Sapiens
QDSGVVSLI

SEQ ID NO: 378322 - protein, 9 aa, Homo Sapiens
FRFKLGGGV

SEQ ID NO: 378323 - protein, 9 aa, Homo Sapiens
TILKDADIS

SEQ ID NO: 378324 - protein, 9 aa, Homo Sapiens
LDYHLNYVK

SEQ ID NO: 378325 - protein, 9 aa, Homo Sapiens
INTVAVQSN

SEQ ID NO: 378326 - protein, 9 aa, Homo Sapiens
NHLQNDNQE

SEQ ID NO: 378327 - protein, 9 aa, Homo Sapiens
VLGISTVNR

SEQ ID NO: 378328 - protein, 9 aa, Homo Sapiens
GRRGKAGLW

SEQ ID NO: 378329 - protein, 9 aa, Homo Sapiens
IANEDTAHG

SEQ ID NO: 378330 - protein, 9 aa, Homo Sapiens
QNATGDGKC

SEQ ID NO: 378331 - protein, 9 aa, Homo Sapiens
ATPRRFLAW

SEQ ID NO: 378332 - protein, 9 aa, Homo Sapiens
TLIIQDMDG

SEQ ID NO: 378333 - protein, 9 aa, Homo Sapiens
NLIDDISGN

SEQ ID NO: 378334 - protein, 9 aa, Homo Sapiens
NVKKLNPNL

SEQ ID NO: 378335 - protein, 9 aa, Homo Sapiens
INQSASFST

SEQ ID NO: 378336 - protein, 9 aa, Homo Sapiens
TFSYNFYIR

SEQ ID NO: 378337 - protein, 9 aa, Homo Sapiens
DQIRMATIS

SEQ ID NO: 378338 - protein, 9 aa, Homo Sapiens
QAMDDPASA

SEQ ID NO: 378339 - protein, 9 aa, Homo Sapiens
AVKELSWQK

SEQ ID NO: 378340 - protein, 9 aa, Homo Sapiens
KEYSHIIVG

SEQ ID NO: 378341 - protein, 9 aa, Homo Sapiens
MKNAMFNTY

SEQ ID NO: 378342 - protein, 9 aa, Homo Sapiens
YSSNLFLNH

SEQ ID NO: 378343 - protein, 9 aa, Homo Sapiens
RKYIQIPMS

SEQ ID NO: 378344 - protein, 9 aa, Homo Sapiens
ELAETIKCH

SEQ ID NO: 378345 - protein, 9 aa, Homo Sapiens
NTRTGQGVP

SEQ ID NO: 378346 - protein, 9 aa, Homo Sapiens
RLTAIKLFD

SEQ ID NO: 378347 - protein, 9 aa, Homo Sapiens
ALTSSDPPQ

SEQ ID NO: 378348 - protein, 9 aa, Homo Sapiens
TSSVVGITT

SEQ ID NO: 378349 - protein, 9 aa, Homo Sapiens
ETLINIIQG

SEQ ID NO: 378350 - protein, 9 aa, Homo Sapiens
PFGYINNPY

SEQ ID NO: 378351 - protein, 9 aa, Homo Sapiens
EMTVIQSGI

SEQ ID NO: 378352 - protein, 9 aa, Homo Sapiens
VGISVKGLW

SEQ ID NO: 378353 - protein, 9 aa, Homo Sapiens
NNLRENKNN

SEQ ID NO: 378354 - protein, 9 aa, Homo Sapiens
DNMNLANNF

SEQ ID NO: 378355 - protein, 9 aa, Homo Sapiens
REIKASKGE

SEQ ID NO: 378356 - protein, 9 aa, Homo Sapiens
SRCVVCIMS

SEQ ID NO: 378357 - protein, 9 aa, Homo Sapiens
AKVCGKIGL

SEQ ID NO: 378358 - protein, 9 aa, Homo Sapiens
GFDLYLTYV

SEQ ID NO: 378359 - protein, 9 aa, Homo Sapiens
FAVMFFIVL

SEQ ID NO: 378360 - protein, 9 aa, Homo Sapiens
GARWDSEAF

SEQ ID NO: 378361 - protein, 9 aa, Homo Sapiens
PVLYRSGIT

SEQ ID NO: 378362 - protein, 9 aa, Homo Sapiens
ISAELNSVI

SEQ ID NO: 378363 - protein, 9 aa, Homo Sapiens
AGDKVKVGD

SEQ ID NO: 378364 - protein, 9 aa, Homo Sapiens
RSSASGGYI

SEQ ID NO: 378365 - protein, 9 aa, Homo Sapiens
SPASRVPGP

SEQ ID NO: 378366 - protein, 9 aa, Homo Sapiens
SPSAITLSY

SEQ ID NO: 378367 - protein, 9 aa, Homo Sapiens
SQEEGALWH

SEQ ID NO: 378368 - protein, 9 aa, Homo Sapiens
GPVLSKHQN

SEQ ID NO: 378369 - protein, 9 aa, Homo Sapiens
PLSLIFLLA

SEQ ID NO: 378370 - protein, 9 aa, Homo Sapiens
LDPSQNNLY

SEQ ID NO: 378371 - protein, 9 aa, Homo Sapiens
LDKSEDSLS

SEQ ID NO: 378372 - protein, 9 aa, Homo Sapiens
GTQDLGENT

SEQ ID NO: 378373 - protein, 9 aa, Homo Sapiens
IEEGYWLPP

SEQ ID NO: 378374 - protein, 9 aa, Homo Sapiens
HVFQSRNDC

SEQ ID NO: 378375 - protein, 9 aa, Homo Sapiens
RKNNYPDPV

SEQ ID NO: 378376 - protein, 9 aa, Homo Sapiens
WSQSRRSVW

SEQ ID NO: 378377 - protein, 9 aa, Homo Sapiens
QSWAQDNKL

SEQ ID NO: 378378 - protein, 9 aa, Homo Sapiens
KEKSDEKSE

SEQ ID NO: 378379 - protein, 9 aa, Homo Sapiens
DGNQSSVWT

SEQ ID NO: 378380 - protein, 9 aa, Homo Sapiens
GEQYEIYFK

SEQ ID NO: 378381 - protein, 9 aa, Homo Sapiens
KKCQDRSNL

SEQ ID NO: 378382 - protein, 9 aa, Homo Sapiens
FNLTDFYCE

SEQ ID NO: 378383 - protein, 9 aa, Homo Sapiens
MAHVGSCKR

SEQ ID NO: 378384 - protein, 9 aa, Homo Sapiens
GSFFAPSWD

SEQ ID NO: 378385 - protein, 9 aa, Homo Sapiens
WPMYRNTPV

SEQ ID NO: 378386 - protein, 9 aa, Homo Sapiens
DSFICCFIR

SEQ ID NO: 378387 - protein, 9 aa, Homo Sapiens
QEERHTLFQ

SEQ ID NO: 378388 - protein, 9 aa, Homo Sapiens
TYYKRLLDS

SEQ ID NO: 378389 - protein, 9 aa, Homo Sapiens
GIGNFVELL

SEQ ID NO: 378390 - protein, 9 aa, Homo Sapiens
SVINDIVKI

SEQ ID NO: 378391 - protein, 9 aa, Homo Sapiens
RTSSCPKQN

SEQ ID NO: 378392 - protein, 9 aa, Homo Sapiens
PFSGKGYAL

SEQ ID NO: 378393 - protein, 9 aa, Homo Sapiens
QDWGPEEQL

SEQ ID NO: 378394 - protein, 9 aa, Homo Sapiens
DTMSKMKMG

SEQ ID NO: 378395 - protein, 9 aa, Homo Sapiens
GGSHLILYA

SEQ ID NO: 378396 - protein, 9 aa, Homo Sapiens
RLLVKKIDD

SEQ ID NO: 378397 - protein, 9 aa, Homo Sapiens
RELFVDDFE

SEQ ID NO: 378398 - protein, 9 aa, Homo Sapiens
ELETIILSE

SEQ ID NO: 378399 - protein, 9 aa, Homo Sapiens
YREVYQEHV

SEQ ID NO: 378400 - protein, 9 aa, Homo Sapiens
AGLWGPPGP

SEQ ID NO: 378401 - protein, 9 aa, Homo Sapiens
DDYFQEIRA

SEQ ID NO: 378402 - protein, 9 aa, Homo Sapiens
QILAVISEL

SEQ ID NO: 378403 - protein, 9 aa, Homo Sapiens
QQNKLAELH

SEQ ID NO: 378404 - protein, 9 aa, Homo Sapiens
TICQHCYHQ

SEQ ID NO: 378405 - protein, 9 aa, Homo Sapiens
QSDLGYAPA

SEQ ID NO: 378406 - protein, 9 aa, Homo Sapiens
GKYVHFTIV

SEQ ID NO: 378407 - protein, 9 aa, Homo Sapiens
KILLAYRVC

SEQ ID NO: 378408 - protein, 9 aa, Homo Sapiens
SEDKSKIVC

SEQ ID NO: 378409 - protein, 9 aa, Homo Sapiens
GFILGLWTL

SEQ ID NO: 378410 - protein, 9 aa, Homo Sapiens
YNRSYARNN

SEQ ID NO: 378411 - protein, 9 aa, Homo Sapiens
LNIGKAFKE

SEQ ID NO: 378412 - protein, 9 aa, Homo Sapiens
QVCYGQKPE

SEQ ID NO: 378413 - protein, 9 aa, Homo Sapiens
WRRWTYGFI

SEQ ID NO: 378414 - protein, 9 aa, Homo Sapiens
HLEKVVNAQ

SEQ ID NO: 378415 - protein, 9 aa, Homo Sapiens
MAEECTTII

SEQ ID NO: 378416 - protein, 9 aa, Homo Sapiens
QFIFQTDTR

SEQ ID NO: 378417 - protein, 9 aa, Homo Sapiens
FQTHAAFEG

SEQ ID NO: 378418 - protein, 9 aa, Homo Sapiens
SRGKDDGES

SEQ ID NO: 378419 - protein, 9 aa, Homo Sapiens
YLYELLAAL

SEQ ID NO: 378420 - protein, 9 aa, Homo Sapiens
DSSGDRDNN

SEQ ID NO: 378421 - protein, 9 aa, Homo Sapiens
DINSFCKIL

SEQ ID NO: 378422 - protein, 9 aa, Homo Sapiens
YPCQLCGKR

SEQ ID NO: 378423 - protein, 9 aa, Homo Sapiens
LFAPLLPVG

SEQ ID NO: 378424 - protein, 9 aa, Homo Sapiens
GSHAFFPAC

SEQ ID NO: 378425 - protein, 9 aa, Homo Sapiens
ARITYSLAK

SEQ ID NO: 378426 - protein, 9 aa, Homo Sapiens
GKTKKLNKV

SEQ ID NO: 378427 - protein, 9 aa, Homo Sapiens
DLLQHINFM

SEQ ID NO: 378428 - protein, 9 aa, Homo Sapiens
IFKEMNNVF

SEQ ID NO: 378429 - protein, 9 aa, Homo Sapiens
LPIYSELED

SEQ ID NO: 378430 - protein, 9 aa, Homo Sapiens
PCHTQTLPL

SEQ ID NO: 378431 - protein, 9 aa, Homo Sapiens
KEVIKRANS

SEQ ID NO: 378432 - protein, 9 aa, Homo Sapiens
PNKPPLLDR

SEQ ID NO: 378433 - protein, 9 aa, Homo Sapiens
YVFNPIVYC

SEQ ID NO: 378434 - protein, 9 aa, Homo Sapiens
PGSLQIYLL

SEQ ID NO: 378435 - protein, 9 aa, Homo Sapiens
NFKAVLHYK

SEQ ID NO: 378436 - protein, 9 aa, Homo Sapiens
VISEDYVVK

SEQ ID NO: 378437 - protein, 9 aa, Homo Sapiens
PQYPTAQPL

SEQ ID NO: 378438 - protein, 9 aa, Homo Sapiens
RALAPWAWR

SEQ ID NO: 378439 - protein, 9 aa, Homo Sapiens
EFKNDYWKL

SEQ ID NO: 378440 - protein, 9 aa, Homo Sapiens
RALDIWRRA

SEQ ID NO: 378441 - protein, 9 aa, Homo Sapiens
SHLEDLFAR

SEQ ID NO: 378442 - protein, 9 aa, Homo Sapiens
LNHKTPSGE

SEQ ID NO: 378443 - protein, 9 aa, Homo Sapiens
GKNKEMGNS

SEQ ID NO: 378444 - protein, 9 aa, Homo Sapiens
LHLEKVVNA

SEQ ID NO: 378445 - protein, 9 aa, Homo Sapiens
QGISNVHKK

SEQ ID NO: 378446 - protein, 9 aa, Homo Sapiens
PTGAVRGAQ

SEQ ID NO: 378447 - protein, 9 aa, Homo Sapiens
ETTVIWEKL

SEQ ID NO: 378448 - protein, 9 aa, Homo Sapiens
TKKLNKVWT

SEQ ID NO: 378449 - protein, 9 aa, Homo Sapiens
DIQPGVNRC

SEQ ID NO: 378450 - protein, 9 aa, Homo Sapiens
LISFFQKRI

SEQ ID NO: 378451 - protein, 9 aa, Homo Sapiens
CHAYGDQYR

SEQ ID NO: 378452 - protein, 9 aa, Homo Sapiens
VVVDCLFYE

SEQ ID NO: 378453 - protein, 9 aa, Homo Sapiens
YPGKMSPEC

SEQ ID NO: 378454 - protein, 9 aa, Homo Sapiens
KAIEEGYWL

SEQ ID NO: 378455 - protein, 9 aa, Homo Sapiens
LLHLSQHKI

SEQ ID NO: 378456 - protein, 9 aa, Homo Sapiens
KEADDLFTS

SEQ ID NO: 378457 - protein, 9 aa, Homo Sapiens
SCPKQNAIS

SEQ ID NO: 378458 - protein, 9 aa, Homo Sapiens
LLKCSSLVT

SEQ ID NO: 378459 - protein, 9 aa, Homo Sapiens
LPLAIQNAG

SEQ ID NO: 378460 - protein, 9 aa, Homo Sapiens
ITFSYGNHK

SEQ ID NO: 378461 - protein, 9 aa, Homo Sapiens
YVCSDCGQS

SEQ ID NO: 378462 - protein, 9 aa, Homo Sapiens
LRLRDALTQ

SEQ ID NO: 378463 - protein, 9 aa, Homo Sapiens
FILGLWTLI

SEQ ID NO: 378464 - protein, 9 aa, Homo Sapiens
VYIHENATF

SEQ ID NO: 378465 - protein, 9 aa, Homo Sapiens
KLDFLSGIQ

SEQ ID NO: 378466 - protein, 9 aa, Homo Sapiens
KHNNQFLDI

SEQ ID NO: 378467 - protein, 9 aa, Homo Sapiens
YCQAIFQTD

SEQ ID NO: 378468 - protein, 9 aa, Homo Sapiens
DDYPNKILL

SEQ ID NO: 378469 - protein, 9 aa, Homo Sapiens
TKTRQRVED

SEQ ID NO: 378470 - protein, 9 aa, Homo Sapiens
YPQHSAVDP

SEQ ID NO: 378471 - protein, 9 aa, Homo Sapiens
EQNIKYSFQ

SEQ ID NO: 378472 - protein, 9 aa, Homo Sapiens
RRPMCKSFS

SEQ ID NO: 378473 - protein, 9 aa, Homo Sapiens
VSDDLGCRR

SEQ ID NO: 378474 - protein, 9 aa, Homo Sapiens
LSAIVSISA

SEQ ID NO: 378475 - protein, 9 aa, Homo Sapiens
AEVKYNKAI

SEQ ID NO: 378476 - protein, 9 aa, Homo Sapiens
TMEWFEPQI

SEQ ID NO: 378477 - protein, 9 aa, Homo Sapiens
AGQSLTETT

SEQ ID NO: 378478 - protein, 9 aa, Homo Sapiens
PDMSQYWPI

SEQ ID NO: 378479 - protein, 9 aa, Homo Sapiens
SVSTPGPRR

SEQ ID NO: 378480 - protein, 9 aa, Homo Sapiens
QIIICSLEG

SEQ ID NO: 378481 - protein, 9 aa, Homo Sapiens
SAKHRLNPV

SEQ ID NO: 378482 - protein, 9 aa, Homo Sapiens
LHVTIITDD

SEQ ID NO: 378483 - protein, 9 aa, Homo Sapiens
LSSRVQFQN

SEQ ID NO: 378484 - protein, 9 aa, Homo Sapiens
MRVLQENKQ

SEQ ID NO: 378485 - protein, 9 aa, Homo Sapiens
GDHQTLVHR

SEQ ID NO: 378486 - protein, 9 aa, Homo Sapiens
LRTNKLFHE

SEQ ID NO: 378487 - protein, 9 aa, Homo Sapiens
IIFETDEST

SEQ ID NO: 378488 - protein, 9 aa, Homo Sapiens
KEINLRLST

SEQ ID NO: 378489 - protein, 9 aa, Homo Sapiens
QMLVLGVAA

SEQ ID NO: 378490 - protein, 9 aa, Homo Sapiens
QILHTGVKP

SEQ ID NO: 378491 - protein, 9 aa, Homo Sapiens
IKIFIIYSI

SEQ ID NO: 378492 - protein, 9 aa, Homo Sapiens
EKLSISSST

SEQ ID NO: 378493 - protein, 9 aa, Homo Sapiens
PLFTVDTRG

SEQ ID NO: 378494 - protein, 9 aa, Homo Sapiens
SMLVASWYV

SEQ ID NO: 378495 - protein, 9 aa, Homo Sapiens
GLSQSCNQA

SEQ ID NO: 378496 - protein, 9 aa, Homo Sapiens
FFCMEKGNI

SEQ ID NO: 378497 - protein, 9 aa, Homo Sapiens
SSPTTADNT

SEQ ID NO: 378498 - protein, 9 aa, Homo Sapiens
RTRARRDNL

SEQ ID NO: 378499 - protein, 9 aa, Homo Sapiens
EKAREKKAL

SEQ ID NO: 378500 - protein, 9 aa, Homo Sapiens
LRYGHILDR

SEQ ID NO: 378501 - protein, 9 aa, Homo Sapiens
PADTELQAM

SEQ ID NO: 378502 - protein, 9 aa, Homo Sapiens
VNLPKVTQQ

SEQ ID NO: 378503 - protein, 9 aa, Homo Sapiens
SVVRIMQKK

SEQ ID NO: 378504 - protein, 9 aa, Homo Sapiens
DKIFHNTLN

SEQ ID NO: 378505 - protein, 9 aa, Homo Sapiens
LMSVEPEEL

SEQ ID NO: 378506 - protein, 9 aa, Homo Sapiens
FELQPGALV

SEQ ID NO: 378507 - protein, 9 aa, Homo Sapiens
LLSLHFLFA

SEQ ID NO: 378508 - protein, 9 aa, Homo Sapiens
IEKEKSDEK

SEQ ID NO: 378509 - protein, 9 aa, Homo Sapiens
THLLLHTEV

SEQ ID NO: 378510 - protein, 9 aa, Homo Sapiens
RRKKKSLKR

SEQ ID NO: 378511 - protein, 9 aa, Homo Sapiens
YTKPSFTQD

SEQ ID NO: 378512 - protein, 9 aa, Homo Sapiens
TKLNMMSKT

SEQ ID NO: 378513 - protein, 9 aa, Homo Sapiens
NLGVLVPLL

SEQ ID NO: 378514 - protein, 9 aa, Homo Sapiens
KIQMSVPVK

SEQ ID NO: 378515 - protein, 9 aa, Homo Sapiens
FHLNKYSVA

SEQ ID NO: 378516 - protein, 9 aa, Homo Sapiens
YVKAVGNLI

SEQ ID NO: 378517 - protein, 9 aa, Homo Sapiens
IIHYIFNRD

SEQ ID NO: 378518 - protein, 9 aa, Homo Sapiens
LNHSSQKTL

SEQ ID NO: 378519 - protein, 9 aa, Homo Sapiens
SSSIIIFWT

SEQ ID NO: 378520 - protein, 9 aa, Homo Sapiens
ATHATYTYH

SEQ ID NO: 378521 - protein, 9 aa, Homo Sapiens
ENINLQPGS

SEQ ID NO: 378522 - protein, 9 aa, Homo Sapiens
TAQPLVQAQ

SEQ ID NO: 378523 - protein, 9 aa, Homo Sapiens
DRDNNKWSH

SEQ ID NO: 378524 - protein, 9 aa, Homo Sapiens
SWKSILNYL

SEQ ID NO: 378525 - protein, 9 aa, Homo Sapiens
AYKNNKWYI

SEQ ID NO: 378526 - protein, 9 aa, Homo Sapiens
LDKVRPHIA

SEQ ID NO: 378527 - protein, 9 aa, Homo Sapiens
LNGIYVGSY

SEQ ID NO: 378528 - protein, 9 aa, Homo Sapiens
DRLMDLSVL

SEQ ID NO: 378529 - protein, 9 aa, Homo Sapiens
KDDGESFYT

SEQ ID NO: 378530 - protein, 9 aa, Homo Sapiens
ADDLFTSLG

SEQ ID NO: 378531 - protein, 9 aa, Homo Sapiens
KEMNNVFAH

SEQ ID NO: 378532 - protein, 9 aa, Homo Sapiens
EKKLPSNTE

SEQ ID NO: 378533 - protein, 9 aa, Homo Sapiens
GVVLLNNND

SEQ ID NO: 378534 - protein, 9 aa, Homo Sapiens
FAHKEMEEG

SEQ ID NO: 378535 - protein, 9 aa, Homo Sapiens
TDEADPRWI

SEQ ID NO: 378536 - protein, 9 aa, Homo Sapiens
QNDWITNMI

SEQ ID NO: 378537 - protein, 9 aa, Homo Sapiens
HEERKEFVC

SEQ ID NO: 378538 - protein, 9 aa, Homo Sapiens
TKSKKTKGH

SEQ ID NO: 378539 - protein, 9 aa, Homo Sapiens
VPSVTLVDP

SEQ ID NO: 378540 - protein, 9 aa, Homo Sapiens
IQLFVLEIL

SEQ ID NO: 378541 - protein, 9 aa, Homo Sapiens
TRMQKMKDD

SEQ ID NO: 378542 - protein, 9 aa, Homo Sapiens
DDNVFNSNL

SEQ ID NO: 378543 - protein, 9 aa, Homo Sapiens
SSDLLMLLQ

SEQ ID NO: 378544 - protein, 9 aa, Homo Sapiens
GKNRSWGTL

SEQ ID NO: 378545 - protein, 9 aa, Homo Sapiens
LAFVQKSAA

SEQ ID NO: 378546 - protein, 9 aa, Homo Sapiens
IATVVPGKE

SEQ ID NO: 378547 - protein, 9 aa, Homo Sapiens
FSTAISYVH

SEQ ID NO: 378548 - protein, 9 aa, Homo Sapiens
SKKTKGHKG

SEQ ID NO: 378549 - protein, 9 aa, Homo Sapiens
AAPAVAPLP

SEQ ID NO: 378550 - protein, 9 aa, Homo Sapiens
ASGKPEVQL

SEQ ID NO: 378551 - protein, 9 aa, Homo Sapiens
PAAPGKNKE

SEQ ID NO: 378552 - protein, 9 aa, Homo Sapiens
TRKNEFLIL

SEQ ID NO: 378553 - protein, 9 aa, Homo Sapiens
NATLCIIEP

SEQ ID NO: 378554 - protein, 9 aa, Homo Sapiens
HKDSFPRFL

SEQ ID NO: 378555 - protein, 9 aa, Homo Sapiens
SEHGPQTLD

SEQ ID NO: 378556 - protein, 9 aa, Homo Sapiens
VWYGLRLNM

SEQ ID NO: 378557 - protein, 9 aa, Homo Sapiens
LNKLHEELC

SEQ ID NO: 378558 - protein, 9 aa, Homo Sapiens
KKMDNLLRG

SEQ ID NO: 378559 - protein, 9 aa, Homo Sapiens
LDTNYRFLR

SEQ ID NO: 378560 - protein, 9 aa, Homo Sapiens
NNFKSVKRK

SEQ ID NO: 378561 - protein, 9 aa, Homo Sapiens
ICNPLKYSI

SEQ ID NO: 378562 - protein, 9 aa, Homo Sapiens
SGDNGQGLV

SEQ ID NO: 378563 - protein, 9 aa, Homo Sapiens
PFSNYVELA

SEQ ID NO: 378564 - protein, 9 aa, Homo Sapiens
SNRLLENVE

SEQ ID NO: 378565 - protein, 9 aa, Homo Sapiens
QNLDKELDA

SEQ ID NO: 378566 - protein, 9 aa, Homo Sapiens
NVYRDVMLE

SEQ ID NO: 378567 - protein, 9 aa, Homo Sapiens
AFRRSSALI

SEQ ID NO: 378568 - protein, 9 aa, Homo Sapiens
FTISGNEYV

SEQ ID NO: 378569 - protein, 9 aa, Homo Sapiens
GEIDAVTSS

SEQ ID NO: 378570 - protein, 9 aa, Homo Sapiens
SASFEYLSP

SEQ ID NO: 378571 - protein, 9 aa, Homo Sapiens
KKSLKRKHK

SEQ ID NO: 378572 - protein, 9 aa, Homo Sapiens
RLMDLSVLS

SEQ ID NO: 378573 - protein, 9 aa, Homo Sapiens
DSESGSSSY

SEQ ID NO: 378574 - protein, 9 aa, Homo Sapiens
VCFMPGEGH

SEQ ID NO: 378575 - protein, 9 aa, Homo Sapiens
SYCYRYRCT

SEQ ID NO: 378576 - protein, 9 aa, Homo Sapiens
KQKTSQKPR

SEQ ID NO: 378577 - protein, 9 aa, Homo Sapiens
HSLLSAALQ

SEQ ID NO: 378578 - protein, 9 aa, Homo Sapiens
ILQNSAEVL

SEQ ID NO: 378579 - protein, 9 aa, Homo Sapiens
WEHAGRCRC

SEQ ID NO: 378580 - protein, 9 aa, Homo Sapiens
RAKLDAFFT

SEQ ID NO: 378581 - protein, 9 aa, Homo Sapiens
NKLLNLTVR

SEQ ID NO: 378582 - protein, 9 aa, Homo Sapiens
GEMFTTSNR

SEQ ID NO: 378583 - protein, 9 aa, Homo Sapiens
IDPQEKYPG

SEQ ID NO: 378584 - protein, 9 aa, Homo Sapiens
GLYVLFGVG

SEQ ID NO: 378585 - protein, 9 aa, Homo Sapiens
ILNHSSQKT

SEQ ID NO: 378586 - protein, 9 aa, Homo Sapiens
SVDTGCKTG

SEQ ID NO: 378587 - protein, 9 aa, Homo Sapiens
ENKNNQVKK

SEQ ID NO: 378588 - protein, 9 aa, Homo Sapiens
DMDSISKNF

SEQ ID NO: 378589 - protein, 9 aa, Homo Sapiens
KVEMMNENN

SEQ ID NO: 378590 - protein, 9 aa, Homo Sapiens
LLAFAYTSV

SEQ ID NO: 378591 - protein, 9 aa, Homo Sapiens
HNNCFPEIL

SEQ ID NO: 378592 - protein, 9 aa, Homo Sapiens
EYIRVSSEL

SEQ ID NO: 378593 - protein, 9 aa, Homo Sapiens
ELIEIHNFW

SEQ ID NO: 378594 - protein, 9 aa, Homo Sapiens
TVQRKYIQI

SEQ ID NO: 378595 - protein, 9 aa, Homo Sapiens
FRSAPFIKC

SEQ ID NO: 378596 - protein, 9 aa, Homo Sapiens
FYVLLCFGV

SEQ ID NO: 378597 - protein, 9 aa, Homo Sapiens
EEDKHSERI

SEQ ID NO: 378598 - protein, 9 aa, Homo Sapiens
MLDTYSNLV

SEQ ID NO: 378599 - protein, 9 aa, Homo Sapiens
AFRYHPSLI

SEQ ID NO: 378600 - protein, 9 aa, Homo Sapiens
SPEQNIKYS

SEQ ID NO: 378601 - protein, 9 aa, Homo Sapiens
LTQNDWITN

SEQ ID NO: 378602 - protein, 9 aa, Homo Sapiens
MIHAGQLKH

SEQ ID NO: 378603 - protein, 9 aa, Homo Sapiens
TAEVKYNKA

SEQ ID NO: 378604 - protein, 9 aa, Homo Sapiens
DCGVDNVQG

SEQ ID NO: 378605 - protein, 9 aa, Homo Sapiens
TAINFTLWR

SEQ ID NO: 378606 - protein, 9 aa, Homo Sapiens
SSYCRKHEI

SEQ ID NO: 378607 - protein, 9 aa, Homo Sapiens
CTARSQNTP

SEQ ID NO: 378608 - protein, 9 aa, Homo Sapiens
WGHQITHTG

SEQ ID NO: 378609 - protein, 9 aa, Homo Sapiens
EELVCRLKL

SEQ ID NO: 378610 - protein, 9 aa, Homo Sapiens
KSHSQIKHQ

SEQ ID NO: 378611 - protein, 9 aa, Homo Sapiens
KLFEMTGEC

SEQ ID NO: 378612 - protein, 9 aa, Homo Sapiens
VAQEKLIND

SEQ ID NO: 378613 - protein, 9 aa, Homo Sapiens
IFQTDTRIY

SEQ ID NO: 378614 - protein, 9 aa, Homo Sapiens
KIVCVLNLW

SEQ ID NO: 378615 - protein, 9 aa, Homo Sapiens
ELKLLLLDP

SEQ ID NO: 378616 - protein, 9 aa, Homo Sapiens
AQPSTTGIW

SEQ ID NO: 378617 - protein, 9 aa, Homo Sapiens
ALALDKTEQ

SEQ ID NO: 378618 - protein, 9 aa, Homo Sapiens
KALWMVFMC

SEQ ID NO: 378619 - protein, 9 aa, Homo Sapiens
DKNIDKYNY

SEQ ID NO: 378620 - protein, 9 aa, Homo Sapiens
LQHSEINQS

SEQ ID NO: 378621 - protein, 9 aa, Homo Sapiens
GTWCKLQWS

SEQ ID NO: 378622 - protein, 9 aa, Homo Sapiens
MISYCACRL

SEQ ID NO: 378623 - protein, 9 aa, Homo Sapiens
AQKEDMEEW

SEQ ID NO: 378624 - protein, 9 aa, Homo Sapiens
NPKPCTPRG

SEQ ID NO: 378625 - protein, 9 aa, Homo Sapiens
DSEAFQLAE

SEQ ID NO: 378626 - protein, 9 aa, Homo Sapiens
QSIIHQDET

SEQ ID NO: 378627 - protein, 9 aa, Homo Sapiens
SQIKCVEIV

SEQ ID NO: 378628 - protein, 9 aa, Homo Sapiens
FQMQGPPWT

SEQ ID NO: 378629 - protein, 9 aa, Homo Sapiens
VHGDSIVTE

SEQ ID NO: 378630 - protein, 9 aa, Homo Sapiens
AVQNIWVVG

SEQ ID NO: 378631 - protein, 9 aa, Homo Sapiens
LYRTLKGHW

SEQ ID NO: 378632 - protein, 9 aa, Homo Sapiens
AAMYLQLPE

SEQ ID NO: 378633 - protein, 9 aa, Homo Sapiens
ARRQRNSAG

SEQ ID NO: 378634 - protein, 9 aa, Homo Sapiens
VDVPFNLPE

SEQ ID NO: 378635 - protein, 9 aa, Homo Sapiens
RSNSFNTDK

SEQ ID NO: 378636 - protein, 9 aa, Homo Sapiens
CPPHTVKQA

SEQ ID NO: 378637 - protein, 9 aa, Homo Sapiens
NKGESKEVI

SEQ ID NO: 378638 - protein, 9 aa, Homo Sapiens
FCELCLLMA

SEQ ID NO: 378639 - protein, 9 aa, Homo Sapiens
KFDTTPNKL

SEQ ID NO: 378640 - protein, 9 aa, Homo Sapiens
AAILNNSRF

SEQ ID NO: 378641 - protein, 9 aa, Homo Sapiens
LPNINLVND

SEQ ID NO: 378642 - protein, 9 aa, Homo Sapiens
HPDGVFMYF

SEQ ID NO: 378643 - protein, 9 aa, Homo Sapiens
DLLRHHIIH

SEQ ID NO: 378644 - protein, 9 aa, Homo Sapiens
EKRNYRKAL

SEQ ID NO: 378645 - protein, 9 aa, Homo Sapiens
MKSPRITTL

SEQ ID NO: 378646 - protein, 9 aa, Homo Sapiens
IYLATGHRE

SEQ ID NO: 378647 - protein, 9 aa, Homo Sapiens
EGPFSNYVE

SEQ ID NO: 378648 - protein, 9 aa, Homo Sapiens
CMEKLLDPA

SEQ ID NO: 378649 - protein, 9 aa, Homo Sapiens
VSPYSYLTK

SEQ ID NO: 378650 - protein, 9 aa, Homo Sapiens
NENNLEKGL

SEQ ID NO: 378651 - protein, 9 aa, Homo Sapiens
QLEKFDINS

SEQ ID NO: 378652 - protein, 9 aa, Homo Sapiens
LFLNHKRVH

SEQ ID NO: 378653 - protein, 9 aa, Homo Sapiens
LLNHKTPSG

SEQ ID NO: 378654 - protein, 9 aa, Homo Sapiens
AFKFKPRKH

SEQ ID NO: 378655 - protein, 9 aa, Homo Sapiens
LCHPNIIRS

SEQ ID NO: 378656 - protein, 9 aa, Homo Sapiens
QHSPRHTPN

SEQ ID NO: 378657 - protein, 9 aa, Homo Sapiens
GQPQWEVEG

SEQ ID NO: 378658 - protein, 9 aa, Homo Sapiens
NVFNQPTLN

SEQ ID NO: 378659 - protein, 9 aa, Homo Sapiens
EMNNSLNYF

SEQ ID NO: 378660 - protein, 9 aa, Homo Sapiens
LKHIRSQIN

SEQ ID NO: 378661 - protein, 9 aa, Homo Sapiens
VIGENCRLE

SEQ ID NO: 378662 - protein, 9 aa, Homo Sapiens
PECVVAVVG

SEQ ID NO: 378663 - protein, 9 aa, Homo Sapiens
GERDTSGSM

SEQ ID NO: 378664 - protein, 9 aa, Homo Sapiens
KCQDRSNLS

SEQ ID NO: 378665 - protein, 9 aa, Homo Sapiens
LSGKEADKL

SEQ ID NO: 378666 - protein, 9 aa, Homo Sapiens
DSGAAPATP

SEQ ID NO: 378667 - protein, 9 aa, Homo Sapiens
ATVISEDYV

SEQ ID NO: 378668 - protein, 9 aa, Homo Sapiens
GECRLGEEI

SEQ ID NO: 378669 - protein, 9 aa, Homo Sapiens
KGVNLYYVG

SEQ ID NO: 378670 - protein, 9 aa, Homo Sapiens
EERLIFLNS

SEQ ID NO: 378671 - protein, 9 aa, Homo Sapiens
CVQKFIKID

SEQ ID NO: 378672 - protein, 9 aa, Homo Sapiens
HKEMEEGEF

SEQ ID NO: 378673 - protein, 9 aa, Homo Sapiens
LNGKCDPEK

SEQ ID NO: 378674 - protein, 9 aa, Homo Sapiens
VENEADWFI

SEQ ID NO: 378675 - protein, 9 aa, Homo Sapiens
KMEDIFAHK

SEQ ID NO: 378676 - protein, 9 aa, Homo Sapiens
EMHIRYLYK

SEQ ID NO: 378677 - protein, 9 aa, Homo Sapiens
DIVVAGRIA

SEQ ID NO: 378678 - protein, 9 aa, Homo Sapiens
LCSPFTSQD

SEQ ID NO: 378679 - protein, 9 aa, Homo Sapiens
EADPRWIFC

SEQ ID NO: 378680 - protein, 9 aa, Homo Sapiens
FLAMLAATY

SEQ ID NO: 378681 - protein, 9 aa, Homo Sapiens
VCELQLPNI

SEQ ID NO: 378682 - protein, 9 aa, Homo Sapiens
HKAYWQVHL

SEQ ID NO: 378683 - protein, 9 aa, Homo Sapiens
SSGDNGQGL

SEQ ID NO: 378684 - protein, 9 aa, Homo Sapiens
TATPRRFLA

SEQ ID NO: 378685 - protein, 9 aa, Homo Sapiens
TRDFIQDSG

SEQ ID NO: 378686 - protein, 9 aa, Homo Sapiens
GKNKNSCLA

SEQ ID NO: 378687 - protein, 9 aa, Homo Sapiens
NNLSPKENI

SEQ ID NO: 378688 - protein, 9 aa, Homo Sapiens
VSKIIQSII

SEQ ID NO: 378689 - protein, 9 aa, Homo Sapiens
NVLYGKYIR

SEQ ID NO: 378690 - protein, 9 aa, Homo Sapiens
LLTRMHLKS

SEQ ID NO: 378691 - protein, 9 aa, Homo Sapiens
CKDCGKTFG

SEQ ID NO: 378692 - protein, 9 aa, Homo Sapiens
FLNSIKSKS

SEQ ID NO: 378693 - protein, 9 aa, Homo Sapiens
TLTKHLITH

SEQ ID NO: 378694 - protein, 9 aa, Homo Sapiens
PPGLSGFPG

SEQ ID NO: 378695 - protein, 9 aa, Homo Sapiens
TNGTCIIWD

SEQ ID NO: 378696 - protein, 9 aa, Homo Sapiens
FKQCKMLQE

SEQ ID NO: 378697 - protein, 9 aa, Homo Sapiens
PPSEPKSGT

SEQ ID NO: 378698 - protein, 9 aa, Homo Sapiens
GFPKRSERT

SEQ ID NO: 378699 - protein, 9 aa, Homo Sapiens
NILGRKIIE

SEQ ID NO: 378700 - protein, 9 aa, Homo Sapiens
VFAFQETRE

SEQ ID NO: 378701 - protein, 9 aa, Homo Sapiens
HPGMDLSKV

SEQ ID NO: 378702 - protein, 9 aa, Homo Sapiens
VTNLRLVKR

SEQ ID NO: 378703 - protein, 9 aa, Homo Sapiens
RNDLLNTSK

SEQ ID NO: 378704 - protein, 9 aa, Homo Sapiens
KYGTQICPA

SEQ ID NO: 378705 - protein, 9 aa, Homo Sapiens
VQTRMQKMK

SEQ ID NO: 378706 - protein, 9 aa, Homo Sapiens
VKDAKMKAP

SEQ ID NO: 378707 - protein, 9 aa, Homo Sapiens
AKSRCVVCI

SEQ ID NO: 378708 - protein, 9 aa, Homo Sapiens
PSNNSHPVQ

SEQ ID NO: 378709 - protein, 9 aa, Homo Sapiens
CSSCGTNLV

SEQ ID NO: 378710 - protein, 9 aa, Homo Sapiens
HKEEDKHSE

SEQ ID NO: 378711 - protein, 9 aa, Homo Sapiens
STIDVVWGI

SEQ ID NO: 378712 - protein, 9 aa, Homo Sapiens
VSFIENSKL

SEQ ID NO: 378713 - protein, 9 aa, Homo Sapiens
SQKKTALKA

SEQ ID NO: 378714 - protein, 9 aa, Homo Sapiens
AAASSAWKH

SEQ ID NO: 378715 - protein, 9 aa, Homo Sapiens
QKGQDEKDL

SEQ ID NO: 378716 - protein, 9 aa, Homo Sapiens
DLQKKKHDL

SEQ ID NO: 378717 - protein, 9 aa, Homo Sapiens
RSHNGEKPF

SEQ ID NO: 378718 - protein, 9 aa, Homo Sapiens
MYTTDQEQL

SEQ ID NO: 378719 - protein, 9 aa, Homo Sapiens
TYVIYHDAL

SEQ ID NO: 378720 - protein, 9 aa, Homo Sapiens
LFQHHPDKH

SEQ ID NO: 378721 - protein, 9 aa, Homo Sapiens
ILGLWTLII

SEQ ID NO: 378722 - protein, 9 aa, Homo Sapiens
LKLNIGKAF

SEQ ID NO: 378723 - protein, 9 aa, Homo Sapiens
NDVAGEIDA

SEQ ID NO: 378724 - protein, 9 aa, Homo Sapiens
ITGTRVVTV

SEQ ID NO: 378725 - protein, 9 aa, Homo Sapiens
MEAVFKFLQ

SEQ ID NO: 378726 - protein, 9 aa, Homo Sapiens
LFEMTGECR

SEQ ID NO: 378727 - protein, 9 aa, Homo Sapiens
EKEFKNDYW

SEQ ID NO: 378728 - protein, 9 aa, Homo Sapiens
SDLLMLLQQ

SEQ ID NO: 378729 - protein, 9 aa, Homo Sapiens
FITKGQTVQ

SEQ ID NO: 378730 - protein, 9 aa, Homo Sapiens
VCKFSLYLE

SEQ ID NO: 378731 - protein, 9 aa, Homo Sapiens
GSAFEYFSR

SEQ ID NO: 378732 - protein, 9 aa, Homo Sapiens
CHNLSLHSK

SEQ ID NO: 378733 - protein, 9 aa, Homo Sapiens
KNSLIVIIL

SEQ ID NO: 378734 - protein, 9 aa, Homo Sapiens
IIKVVSQLW

SEQ ID NO: 378735 - protein, 9 aa, Homo Sapiens
SLLALGSSL

SEQ ID NO: 378736 - protein, 9 aa, Homo Sapiens
LCGISACTS

SEQ ID NO: 378737 - protein, 9 aa, Homo Sapiens
SELWVLSIA

SEQ ID NO: 378738 - protein, 9 aa, Homo Sapiens
QNLLLSGAQ

SEQ ID NO: 378739 - protein, 9 aa, Homo Sapiens
SLNEHKIIH

SEQ ID NO: 378740 - protein, 9 aa, Homo Sapiens
VVYYWTLGK

SEQ ID NO: 378741 - protein, 9 aa, Homo Sapiens
QIIWQRDFP

SEQ ID NO: 378742 - protein, 9 aa, Homo Sapiens
PNTLEDFRV

SEQ ID NO: 378743 - protein, 9 aa, Homo Sapiens
PQISLGRQP

SEQ ID NO: 378744 - protein, 9 aa, Homo Sapiens
TSASHPQAI

SEQ ID NO: 378745 - protein, 9 aa, Homo Sapiens
KLARPAAGV

SEQ ID NO: 378746 - protein, 9 aa, Homo Sapiens
QDEKDLEFL

SEQ ID NO: 378747 - protein, 9 aa, Homo Sapiens
DNKLILRLL

SEQ ID NO: 378748 - protein, 9 aa, Homo Sapiens
IMQELERKH

SEQ ID NO: 378749 - protein, 9 aa, Homo Sapiens
KNPDVLKDD

SEQ ID NO: 378750 - protein, 9 aa, Homo Sapiens
YHQFSTPFQ

SEQ ID NO: 378751 - protein, 9 aa, Homo Sapiens
TTPNKLVQL

SEQ ID NO: 378752 - protein, 9 aa, Homo Sapiens
VLKDDFEGQ

SEQ ID NO: 378753 - protein, 9 aa, Homo Sapiens
AMFILNHLL

SEQ ID NO: 378754 - protein, 9 aa, Homo Sapiens
QTKRIQKQF

SEQ ID NO: 378755 - protein, 9 aa, Homo Sapiens
QDYTSPETQ

SEQ ID NO: 378756 - protein, 9 aa, Homo Sapiens
LRRCGLTYL

SEQ ID NO: 378757 - protein, 9 aa, Homo Sapiens
KLHCPKCNL

SEQ ID NO: 378758 - protein, 9 aa, Homo Sapiens
PRRKKHDYH

SEQ ID NO: 378759 - protein, 9 aa, Homo Sapiens
QQSPTPHGL

SEQ ID NO: 378760 - protein, 9 aa, Homo Sapiens
RCCCAQECS

SEQ ID NO: 378761 - protein, 9 aa, Homo Sapiens
ATLRKRLRK

SEQ ID NO: 378762 - protein, 9 aa, Homo Sapiens
DMEEWITTL

SEQ ID NO: 378763 - protein, 9 aa, Homo Sapiens
NMKHIHPHI

SEQ ID NO: 378764 - protein, 9 aa, Homo Sapiens
EQQQKRLEA

SEQ ID NO: 378765 - protein, 9 aa, Homo Sapiens
YYAVWPNPD

SEQ ID NO: 378766 - protein, 9 aa, Homo Sapiens
QISLGRQPP

SEQ ID NO: 378767 - protein, 9 aa, Homo Sapiens
IVPNKPPLL

SEQ ID NO: 378768 - protein, 9 aa, Homo Sapiens
GRRAKSRCV

SEQ ID NO: 378769 - protein, 9 aa, Homo Sapiens
SNAEESNTG

SEQ ID NO: 378770 - protein, 9 aa, Homo Sapiens
SPIQMKNAM

SEQ ID NO: 378771 - protein, 9 aa, Homo Sapiens
ERQINKEAL

SEQ ID NO: 378772 - protein, 9 aa, Homo Sapiens
IEVVEVVHI

SEQ ID NO: 378773 - protein, 9 aa, Homo Sapiens
KLHVLVCLC

SEQ ID NO: 378774 - protein, 9 aa, Homo Sapiens
FSIEATMKI

SEQ ID NO: 378775 - protein, 9 aa, Homo Sapiens
ALVEDPQLN

SEQ ID NO: 378776 - protein, 9 aa, Homo Sapiens
WGRAKALVQ

SEQ ID NO: 378777 - protein, 9 aa, Homo Sapiens
QGKYYGQFG

SEQ ID NO: 378778 - protein, 9 aa, Homo Sapiens
GKCPVDGKV

SEQ ID NO: 378779 - protein, 9 aa, Homo Sapiens
EKLEEKIQK

SEQ ID NO: 378780 - protein, 9 aa, Homo Sapiens
VDTYVMGLF

SEQ ID NO: 378781 - protein, 9 aa, Homo Sapiens
NVRKLLKLP

SEQ ID NO: 378782 - protein, 9 aa, Homo Sapiens
TPSGEKQVP

SEQ ID NO: 378783 - protein, 9 aa, Homo Sapiens
VLNNKLCIT

SEQ ID NO: 378784 - protein, 9 aa, Homo Sapiens
HGECVSGPP

SEQ ID NO: 378785 - protein, 9 aa, Homo Sapiens
ALPFQIIIC

SEQ ID NO: 378786 - protein, 9 aa, Homo Sapiens
VQGEVPHTL

SEQ ID NO: 378787 - protein, 9 aa, Homo Sapiens
WPLLDYSQR

SEQ ID NO: 378788 - protein, 9 aa, Homo Sapiens
KAGLWGPPG

SEQ ID NO: 378789 - protein, 9 aa, Homo Sapiens
ISSKELMSC

SEQ ID NO: 378790 - protein, 9 aa, Homo Sapiens
SLTRHKIIH

SEQ ID NO: 378791 - protein, 9 aa, Homo Sapiens
KPKGEGSRA

SEQ ID NO: 378792 - protein, 9 aa, Homo Sapiens
QDIFWHTIN

SEQ ID NO: 378793 - protein, 9 aa, Homo Sapiens
HTICQHCYH

SEQ ID NO: 378794 - protein, 9 aa, Homo Sapiens
KHIHPHINM

SEQ ID NO: 378795 - protein, 9 aa, Homo Sapiens
QNNFNNLYG

SEQ ID NO: 378796 - protein, 9 aa, Homo Sapiens
VSEFIKYDI

SEQ ID NO: 378797 - protein, 9 aa, Homo Sapiens
DWGPEEQLR

SEQ ID NO: 378798 - protein, 9 aa, Homo Sapiens
GVWEDNTPP

SEQ ID NO: 378799 - protein, 9 aa, Homo Sapiens
SSTGEMFTT

SEQ ID NO: 378800 - protein, 9 aa, Homo Sapiens
ASAIPTAIN

SEQ ID NO: 378801 - protein, 9 aa, Homo Sapiens
MGNHIEDLQ

SEQ ID NO: 378802 - protein, 9 aa, Homo Sapiens
PESSSPSAA

SEQ ID NO: 378803 - protein, 9 aa, Homo Sapiens
EDVKLESMG

SEQ ID NO: 378804 - protein, 9 aa, Homo Sapiens
TNLRLVKRL

SEQ ID NO: 378805 - protein, 9 aa, Homo Sapiens
GISSKELMS

SEQ ID NO: 378806 - protein, 9 aa, Homo Sapiens
LNYFKPYLG

SEQ ID NO: 378807 - protein, 9 aa, Homo Sapiens
ISHILRNKI

SEQ ID NO: 378808 - protein, 9 aa, Homo Sapiens
DGQWNGRNC

SEQ ID NO: 378809 - protein, 9 aa, Homo Sapiens
LSPRWGRQA

SEQ ID NO: 378810 - protein, 9 aa, Homo Sapiens
LFLDVVYKV

SEQ ID NO: 378811 - protein, 9 aa, Homo Sapiens
ITHQQIHLG

SEQ ID NO: 378812 - protein, 9 aa, Homo Sapiens
SQCNCINLS

SEQ ID NO: 378813 - protein, 9 aa, Homo Sapiens
VSVIFDRIR

SEQ ID NO: 378814 - protein, 9 aa, Homo Sapiens
FIQWCQKEM

SEQ ID NO: 378815 - protein, 9 aa, Homo Sapiens
CHTLFSTHY

SEQ ID NO: 378816 - protein, 9 aa, Homo Sapiens
FDRHGNIAD

SEQ ID NO: 378817 - protein, 9 aa, Homo Sapiens
EKIITMIPT

SEQ ID NO: 378818 - protein, 9 aa, Homo Sapiens
SELREKKLK

SEQ ID NO: 378819 - protein, 9 aa, Homo Sapiens
PFSCSSCGT

SEQ ID NO: 378820 - protein, 9 aa, Homo Sapiens
QYVKKGSQI

SEQ ID NO: 378821 - protein, 9 aa, Homo Sapiens
LLDFTEIRA

SEQ ID NO: 378822 - protein, 9 aa, Homo Sapiens
KYSPGRTYF

SEQ ID NO: 378823 - protein, 9 aa, Homo Sapiens
KVGYTEKQM

SEQ ID NO: 378824 - protein, 9 aa, Homo Sapiens
LKALSDTTE

SEQ ID NO: 378825 - protein, 9 aa, Homo Sapiens
KFIITFSYG

SEQ ID NO: 378826 - protein, 9 aa, Homo Sapiens
ILNNSRFAQ

SEQ ID NO: 378827 - protein, 9 aa, Homo Sapiens
KPLKTQIVP

SEQ ID NO: 378828 - protein, 9 aa, Homo Sapiens
LLCCNCPSG

SEQ ID NO: 378829 - protein, 9 aa, Homo Sapiens
DNAGLSISE

SEQ ID NO: 378830 - protein, 9 aa, Homo Sapiens
DDSFNKTAP

SEQ ID NO: 378831 - protein, 9 aa, Homo Sapiens
YGRQPQYSN

SEQ ID NO: 378832 - protein, 9 aa, Homo Sapiens
AFMGVNNWP

SEQ ID NO: 378833 - protein, 9 aa, Homo Sapiens
YFKVWMCGG

SEQ ID NO: 378834 - protein, 9 aa, Homo Sapiens
EAVFKFLQQ

SEQ ID NO: 378835 - protein, 9 aa, Homo Sapiens
PTHQQFPFL

SEQ ID NO: 378836 - protein, 9 aa, Homo Sapiens
KGNTTLNYF

SEQ ID NO: 378837 - protein, 9 aa, Homo Sapiens
INHFFCKIP

SEQ ID NO: 378838 - protein, 9 aa, Homo Sapiens
IALEASFSS

SEQ ID NO: 378839 - protein, 9 aa, Homo Sapiens
LITHTGEKP

SEQ ID NO: 378840 - protein, 9 aa, Homo Sapiens
GIWHSVIHS

SEQ ID NO: 378841 - protein, 9 aa, Homo Sapiens
TRDGFDLYL

SEQ ID NO: 378842 - protein, 9 aa, Homo Sapiens
EEMEHQKEG

SEQ ID NO: 378843 - protein, 9 aa, Homo Sapiens
TLDGRNINP

SEQ ID NO: 378844 - protein, 9 aa, Homo Sapiens
SRIYFREAT

SEQ ID NO: 378845 - protein, 9 aa, Homo Sapiens
VSMLVASWY

SEQ ID NO: 378846 - protein, 9 aa, Homo Sapiens
TGSAKHRLN

SEQ ID NO: 378847 - protein, 9 aa, Homo Sapiens
KIITMIPTD

SEQ ID NO: 378848 - protein, 9 aa, Homo Sapiens
FKAVLHYKH

SEQ ID NO: 378849 - protein, 9 aa, Homo Sapiens
LIQYYNGED

SEQ ID NO: 378850 - protein, 9 aa, Homo Sapiens
FTSQSAASD

SEQ ID NO: 378851 - protein, 9 aa, Homo Sapiens
GVGFISMIN

SEQ ID NO: 378852 - protein, 9 aa, Homo Sapiens
SASNDNEGN

SEQ ID NO: 378853 - protein, 9 aa, Homo Sapiens
KHSERITVK

SEQ ID NO: 378854 - protein, 9 aa, Homo Sapiens
INIDDKEPL

SEQ ID NO: 378855 - protein, 9 aa, Homo Sapiens
REDLFIISK

SEQ ID NO: 378856 - protein, 9 aa, Homo Sapiens
STANKNDGY

SEQ ID NO: 378857 - protein, 9 aa, Homo Sapiens
ASHPQAIVS

SEQ ID NO: 378858 - protein, 9 aa, Homo Sapiens
SRKKKIIWQ

SEQ ID NO: 378859 - protein, 9 aa, Homo Sapiens
SVTVPNMLL

SEQ ID NO: 378860 - protein, 9 aa, Homo Sapiens
YFQMLPISN

SEQ ID NO: 378861 - protein, 9 aa, Homo Sapiens
EILTAEEMD

SEQ ID NO: 378862 - protein, 9 aa, Homo Sapiens
LKLPRKKST

SEQ ID NO: 378863 - protein, 9 aa, Homo Sapiens
LARHQIIHT

SEQ ID NO: 378864 - protein, 9 aa, Homo Sapiens
TGICFTTSV

SEQ ID NO: 378865 - protein, 9 aa, Homo Sapiens
SLLLDFVAA

SEQ ID NO: 378866 - protein, 9 aa, Homo Sapiens
IYLRKHMRT

SEQ ID NO: 378867 - protein, 9 aa, Homo Sapiens
CAITLGHGH

SEQ ID NO: 378868 - protein, 9 aa, Homo Sapiens
MARFSEDTA

SEQ ID NO: 378869 - protein, 9 aa, Homo Sapiens
VSPLENDIQ

SEQ ID NO: 378870 - protein, 9 aa, Homo Sapiens
IEGKNIESL

SEQ ID NO: 378871 - protein, 9 aa, Homo Sapiens
FTRDFIQDS

SEQ ID NO: 378872 - protein, 9 aa, Homo Sapiens
QFDAYPNTL

SEQ ID NO: 378873 - protein, 9 aa, Homo Sapiens
KWQMFLLQY

SEQ ID NO: 378874 - protein, 9 aa, Homo Sapiens
DAEIQLFVL

SEQ ID NO: 378875 - protein, 9 aa, Homo Sapiens
LIYLATGHR

SEQ ID NO: 378876 - protein, 9 aa, Homo Sapiens
DQLYLFINN

SEQ ID NO: 378877 - protein, 9 aa, Homo Sapiens
VEAYLNLLK

SEQ ID NO: 378878 - protein, 9 aa, Homo Sapiens
FSEDDEIST

SEQ ID NO: 378879 - protein, 9 aa, Homo Sapiens
DVLINIDDK

SEQ ID NO: 378880 - protein, 9 aa, Homo Sapiens
PQNLLLSGA

SEQ ID NO: 378881 - protein, 9 aa, Homo Sapiens
GVLYALRFF

SEQ ID NO: 378882 - protein, 9 aa, Homo Sapiens
LSVVTEDDC

SEQ ID NO: 378883 - protein, 9 aa, Homo Sapiens
YSLAKDTFQ

SEQ ID NO: 378884 - protein, 9 aa, Homo Sapiens
LAQLCLVPL

SEQ ID NO: 378885 - protein, 9 aa, Homo Sapiens
AKAFKIIKD

SEQ ID NO: 378886 - protein, 9 aa, Homo Sapiens
DLTSNDTFE

SEQ ID NO: 378887 - protein, 9 aa, Homo Sapiens
TINTYCSLA

SEQ ID NO: 378888 - protein, 9 aa, Homo Sapiens
IVLDPMLDL

SEQ ID NO: 378889 - protein, 9 aa, Homo Sapiens
MSRPLMNLS

SEQ ID NO: 378890 - protein, 9 aa, Homo Sapiens
VQIQTQPGY

SEQ ID NO: 378891 - protein, 9 aa, Homo Sapiens
WAVMNFKAV

SEQ ID NO: 378892 - protein, 9 aa, Homo Sapiens
ERLGATIPL

SEQ ID NO: 378893 - protein, 9 aa, Homo Sapiens
GYHHEHLVD

SEQ ID NO: 378894 - protein, 9 aa, Homo Sapiens
RNPTYQEAP

SEQ ID NO: 378895 - protein, 9 aa, Homo Sapiens
LMRIFHVLK

SEQ ID NO: 378896 - protein, 9 aa, Homo Sapiens
TIELDGKKS

SEQ ID NO: 378897 - protein, 9 aa, Homo Sapiens
PMYRNTPVS

SEQ ID NO: 378898 - protein, 9 aa, Homo Sapiens
SVKGLWDDL

SEQ ID NO: 378899 - protein, 9 aa, Homo Sapiens
VGKYGTQIC

SEQ ID NO: 378900 - protein, 9 aa, Homo Sapiens
LAVCLIIYA

SEQ ID NO: 378901 - protein, 9 aa, Homo Sapiens
RKKKIIWQL

SEQ ID NO: 378902 - protein, 9 aa, Homo Sapiens
LHLSQHKII

SEQ ID NO: 378903 - protein, 9 aa, Homo Sapiens
KEVEQEVQQ

SEQ ID NO: 378904 - protein, 9 aa, Homo Sapiens
NYPSTSPGF

SEQ ID NO: 378905 - protein, 9 aa, Homo Sapiens
SKSQEESRI

SEQ ID NO: 378906 - protein, 9 aa, Homo Sapiens
ALMEDAEIQ

SEQ ID NO: 378907 - protein, 9 aa, Homo Sapiens
FAPSWDMYS

SEQ ID NO: 378908 - protein, 9 aa, Homo Sapiens
GDKVKVGDS

SEQ ID NO: 378909 - protein, 9 aa, Homo Sapiens
NGQGLVTSA

SEQ ID NO: 378910 - protein, 9 aa, Homo Sapiens
LIVIILIWL

SEQ ID NO: 378911 - protein, 9 aa, Homo Sapiens
QFPFLEMKI

SEQ ID NO: 378912 - protein, 9 aa, Homo Sapiens
WSVGQIIWQ

SEQ ID NO: 378913 - protein, 9 aa, Homo Sapiens
IDILSEEIR

SEQ ID NO: 378914 - protein, 9 aa, Homo Sapiens
IRHIWLSFD

SEQ ID NO: 378915 - protein, 9 aa, Homo Sapiens
YHQINHTGE

SEQ ID NO: 378916 - protein, 9 aa, Homo Sapiens
ANMDMCCAA

SEQ ID NO: 378917 - protein, 9 aa, Homo Sapiens
NNLLSMIRA

SEQ ID NO: 378918 - protein, 9 aa, Homo Sapiens
ICQHCYHQF

SEQ ID NO: 378919 - protein, 9 aa, Homo Sapiens
EENLAYAEL

SEQ ID NO: 378920 - protein, 9 aa, Homo Sapiens
EMMNENNLE

SEQ ID NO: 378921 - protein, 9 aa, Homo Sapiens
ACADLLVGV

SEQ ID NO: 378922 - protein, 9 aa, Homo Sapiens
YIRPILSRR

SEQ ID NO: 378923 - protein, 9 aa, Homo Sapiens
FWVYRSSFT

SEQ ID NO: 378924 - protein, 9 aa, Homo Sapiens
QIHEITHTG

SEQ ID NO: 378925 - protein, 9 aa, Homo Sapiens
LNKNTYLTV

SEQ ID NO: 378926 - protein, 9 aa, Homo Sapiens
GEDVLINID

SEQ ID NO: 378927 - protein, 9 aa, Homo Sapiens
LPKVTQQDA

SEQ ID NO: 378928 - protein, 9 aa, Homo Sapiens
IGKIYHYDI

SEQ ID NO: 378929 - protein, 9 aa, Homo Sapiens
QQQKRLEAF

SEQ ID NO: 378930 - protein, 9 aa, Homo Sapiens
ERPSNNSHP

SEQ ID NO: 378931 - protein, 9 aa, Homo Sapiens
AYLNLLKSE

SEQ ID NO: 378932 - protein, 9 aa, Homo Sapiens
RRFNLIDDI

SEQ ID NO: 378933 - protein, 9 aa, Homo Sapiens
AVKLVNDSL

SEQ ID NO: 378934 - protein, 9 aa, Homo Sapiens
INNKVVVNQ

SEQ ID NO: 378935 - protein, 9 aa, Homo Sapiens
KKYHYVPHR

SEQ ID NO: 378936 - protein, 9 aa, Homo Sapiens
KLELAWELG

SEQ ID NO: 378937 - protein, 9 aa, Homo Sapiens
RRMGKRRAN

SEQ ID NO: 378938 - protein, 9 aa, Homo Sapiens
LACRDDYFQ

SEQ ID NO: 378939 - protein, 9 aa, Homo Sapiens
FVFCIFATY

SEQ ID NO: 378940 - protein, 9 aa, Homo Sapiens
ELWRMQEML

SEQ ID NO: 378941 - protein, 9 aa, Homo Sapiens
TSAACICLI

SEQ ID NO: 378942 - protein, 9 aa, Homo Sapiens
LSLTGICFT

SEQ ID NO: 378943 - protein, 9 aa, Homo Sapiens
ENEKIHLIS

SEQ ID NO: 378944 - protein, 9 aa, Homo Sapiens
VSPAYTPNW

SEQ ID NO: 378945 - protein, 9 aa, Homo Sapiens
MKGLTLEKN

SEQ ID NO: 378946 - protein, 9 aa, Homo Sapiens
ENVLKKIAK

SEQ ID NO: 378947 - protein, 9 aa, Homo Sapiens
IYACARWFM

SEQ ID NO: 378948 - protein, 9 aa, Homo Sapiens
YFTTFVLFM

SEQ ID NO: 378949 - protein, 9 aa, Homo Sapiens
ERQKALWMV

SEQ ID NO: 378950 - protein, 9 aa, Homo Sapiens
LSLHFLFAR

SEQ ID NO: 378951 - protein, 9 aa, Homo Sapiens
EAEKKLPSN

SEQ ID NO: 378952 - protein, 9 aa, Homo Sapiens
YETVKISIA

SEQ ID NO: 378953 - protein, 9 aa, Homo Sapiens
VYKEERKNI

SEQ ID NO: 378954 - protein, 9 aa, Homo Sapiens
DTAHGIASE

SEQ ID NO: 378955 - protein, 9 aa, Homo Sapiens
QNSLYYFSD

SEQ ID NO: 378956 - protein, 9 aa, Homo Sapiens
LADHGVSFD

SEQ ID NO: 378957 - protein, 9 aa, Homo Sapiens
EPRASDTKN

SEQ ID NO: 378958 - protein, 9 aa, Homo Sapiens
IIFEMLVGQ

SEQ ID NO: 378959 - protein, 9 aa, Homo Sapiens
LSLPFDEDC

SEQ ID NO: 378960 - protein, 9 aa, Homo Sapiens
INMSLESYG

SEQ ID NO: 378961 - protein, 9 aa, Homo Sapiens
LLNTSKVIL

SEQ ID NO: 378962 - protein, 9 aa, Homo Sapiens
RAKSRCVVC

SEQ ID NO: 378963 - protein, 9 aa, Homo Sapiens
WTKLGKVYI

SEQ ID NO: 378964 - protein, 9 aa, Homo Sapiens
RLGATIPLV

SEQ ID NO: 378965 - protein, 9 aa, Homo Sapiens
IETSTKTRQ

SEQ ID NO: 378966 - protein, 9 aa, Homo Sapiens
EMNNVFAHL

SEQ ID NO: 378967 - protein, 9 aa, Homo Sapiens
YNKEMPKEP

SEQ ID NO: 378968 - protein, 9 aa, Homo Sapiens
FCKIPPLLA

SEQ ID NO: 378969 - protein, 9 aa, Homo Sapiens
IASRVLQDF

SEQ ID NO: 378970 - protein, 9 aa, Homo Sapiens
HESCMRQIG

SEQ ID NO: 378971 - protein, 9 aa, Homo Sapiens
SASPPADTE

SEQ ID NO: 378972 - protein, 9 aa, Homo Sapiens
DTTPNKLVQ

SEQ ID NO: 378973 - protein, 9 aa, Homo Sapiens
DFQNSCQTT

SEQ ID NO: 378974 - protein, 9 aa, Homo Sapiens
DVDNILLIT

SEQ ID NO: 378975 - protein, 9 aa, Homo Sapiens
LYVWTLVVP

SEQ ID NO: 378976 - protein, 9 aa, Homo Sapiens
ITVIDTKTV

SEQ ID NO: 378977 - protein, 9 aa, Homo Sapiens
LALTSSDPP

SEQ ID NO: 378978 - protein, 9 aa, Homo Sapiens
NVFNSNLPS

SEQ ID NO: 378979 - protein, 9 aa, Homo Sapiens
FCIFATYDE

SEQ ID NO: 378980 - protein, 9 aa, Homo Sapiens
FIQDSGVVS

SEQ ID NO: 378981 - protein, 9 aa, Homo Sapiens
CTSDVDYRL

SEQ ID NO: 378982 - protein, 9 aa, Homo Sapiens
GDWTKLGKV

SEQ ID NO: 378983 - protein, 9 aa, Homo Sapiens
GQFFFFFEA

SEQ ID NO: 378984 - protein, 9 aa, Homo Sapiens
QNKKMSPNN

SEQ ID NO: 378985 - protein, 9 aa, Homo Sapiens
TISDGNMDS

SEQ ID NO: 378986 - protein, 9 aa, Homo Sapiens
ASRVPGPSQ

SEQ ID NO: 378987 - protein, 9 aa, Homo Sapiens
AARKCQKII

SEQ ID NO: 378988 - protein, 9 aa, Homo Sapiens
YNNHAWYFP

SEQ ID NO: 378989 - protein, 9 aa, Homo Sapiens
RQIGWNRII

SEQ ID NO: 378990 - protein, 9 aa, Homo Sapiens
ALQLPTSWL

SEQ ID NO: 378991 - protein, 9 aa, Homo Sapiens
LQHDQKTQP

SEQ ID NO: 378992 - protein, 9 aa, Homo Sapiens
ILQNQDDRE

SEQ ID NO: 378993 - protein, 9 aa, Homo Sapiens
LIEGKNIES

SEQ ID NO: 378994 - protein, 9 aa, Homo Sapiens
IHENATFQK

SEQ ID NO: 378995 - protein, 9 aa, Homo Sapiens
LFTVDTRGP

SEQ ID NO: 378996 - protein, 9 aa, Homo Sapiens
FCINSVAFK

SEQ ID NO: 378997 - protein, 9 aa, Homo Sapiens
HSKKVIHHY

SEQ ID NO: 378998 - protein, 9 aa, Homo Sapiens
TSTDHFNLR

SEQ ID NO: 378999 - protein, 9 aa, Homo Sapiens
SLPGHSVVL

SEQ ID NO: 379000 - protein, 9 aa, Homo Sapiens
LQFYMFTWT

SEQ ID NO: 379001 - protein, 9 aa, Homo Sapiens
DNESSEQGE

SEQ ID NO: 379002 - protein, 9 aa, Homo Sapiens
QGPPWTIYD

SEQ ID NO: 379003 - protein, 9 aa, Homo Sapiens
KACVKAHNP

SEQ ID NO: 379004 - protein, 9 aa, Homo Sapiens
EFLLFICKV

SEQ ID NO: 379005 - protein, 9 aa, Homo Sapiens
LREKIMKLS

SEQ ID NO: 379006 - protein, 9 aa, Homo Sapiens
SGAELERQH

SEQ ID NO: 379007 - protein, 9 aa, Homo Sapiens
SSLTRHKII

SEQ ID NO: 379008 - protein, 9 aa, Homo Sapiens
KLPLKFHDA

SEQ ID NO: 379009 - protein, 9 aa, Homo Sapiens
PLFQTHAAF

SEQ ID NO: 379010 - protein, 9 aa, Homo Sapiens
KLGKVYINV

SEQ ID NO: 379011 - protein, 9 aa, Homo Sapiens
STQSIQELS

SEQ ID NO: 379012 - protein, 9 aa, Homo Sapiens
PHIAGITAM

SEQ ID NO: 379013 - protein, 9 aa, Homo Sapiens
MEEKVTEMN

SEQ ID NO: 379014 - protein, 9 aa, Homo Sapiens
PCYPFWDKM

SEQ ID NO: 379015 - protein, 9 aa, Homo Sapiens
KIFDKPRKQ

SEQ ID NO: 379016 - protein, 9 aa, Homo Sapiens
AEASEEAAS

SEQ ID NO: 379017 - protein, 9 aa, Homo Sapiens
YQEHVRCLE

SEQ ID NO: 379018 - protein, 9 aa, Homo Sapiens
HSHYPQLHI

SEQ ID NO: 379019 - protein, 9 aa, Homo Sapiens
LRNSPVNTN

SEQ ID NO: 379020 - protein, 9 aa, Homo Sapiens
KSKRSMNEP

SEQ ID NO: 379021 - protein, 9 aa, Homo Sapiens
GLVASETKC

SEQ ID NO: 379022 - protein, 9 aa, Homo Sapiens
VINCREVME

SEQ ID NO: 379023 - protein, 9 aa, Homo Sapiens
NNKLCITGG

SEQ ID NO: 379024 - protein, 9 aa, Homo Sapiens
MYRNTPVSK

SEQ ID NO: 379025 - protein, 9 aa, Homo Sapiens
SWKDLFQHH

SEQ ID NO: 379026 - protein, 9 aa, Homo Sapiens
KQCKMLQEL

SEQ ID NO: 379027 - protein, 9 aa, Homo Sapiens
MVTITSGIQ

SEQ ID NO: 379028 - protein, 9 aa, Homo Sapiens
RKLIGSFQE

SEQ ID NO: 379029 - protein, 9 aa, Homo Sapiens
VKLDPFGAA

SEQ ID NO: 379030 - protein, 9 aa, Homo Sapiens
RCTARSQNT

SEQ ID NO: 379031 - protein, 9 aa, Homo Sapiens
IHYVLPDGK

SEQ ID NO: 379032 - protein, 9 aa, Homo Sapiens
KQVHPGMDL

SEQ ID NO: 379033 - protein, 9 aa, Homo Sapiens
VQGITGLCI

SEQ ID NO: 379034 - protein, 9 aa, Homo Sapiens
TSSSPSAIT

SEQ ID NO: 379035 - protein, 9 aa, Homo Sapiens
DYVNFNLTD

SEQ ID NO: 379036 - protein, 9 aa, Homo Sapiens
PSVTLVDPA

SEQ ID NO: 379037 - protein, 9 aa, Homo Sapiens
TSEHFCIDG

SEQ ID NO: 379038 - protein, 9 aa, Homo Sapiens
ATYIALNTC

SEQ ID NO: 379039 - protein, 9 aa, Homo Sapiens
ESKEVIPDS

SEQ ID NO: 379040 - protein, 9 aa, Homo Sapiens
TQRMWIPQL

SEQ ID NO: 379041 - protein, 9 aa, Homo Sapiens
LSATPGGKD

SEQ ID NO: 379042 - protein, 9 aa, Homo Sapiens
TLEVGSDCG

SEQ ID NO: 379043 - protein, 9 aa, Homo Sapiens
SCHAINLYG

SEQ ID NO: 379044 - protein, 9 aa, Homo Sapiens
SPGFLVKHI

SEQ ID NO: 379045 - protein, 9 aa, Homo Sapiens
DSIVTETYG

SEQ ID NO: 379046 - protein, 9 aa, Homo Sapiens
LEKDVGLKQ

SEQ ID NO: 379047 - protein, 9 aa, Homo Sapiens
LEDERKQWA

SEQ ID NO: 379048 - protein, 9 aa, Homo Sapiens
PSVRSKFHA

SEQ ID NO: 379049 - protein, 9 aa, Homo Sapiens
AAFEGPYAA

SEQ ID NO: 379050 - protein, 9 aa, Homo Sapiens
AIEEGYWLP

SEQ ID NO: 379051 - protein, 9 aa, Homo Sapiens
KTKKLNKVW

SEQ ID NO: 379052 - protein, 9 aa, Homo Sapiens
LSRHQILHT

SEQ ID NO: 379053 - protein, 9 aa, Homo Sapiens
PYGTIYYTI

SEQ ID NO: 379054 - protein, 9 aa, Homo Sapiens
ASWYVDDLM

SEQ ID NO: 379055 - protein, 9 aa, Homo Sapiens
MAALIYLHY

SEQ ID NO: 379056 - protein, 9 aa, Homo Sapiens
PVVLAVKEL

SEQ ID NO: 379057 - protein, 9 aa, Homo Sapiens
YIQIPMSFK

SEQ ID NO: 379058 - protein, 9 aa, Homo Sapiens
GDDSFNKTA

SEQ ID NO: 379059 - protein, 9 aa, Homo Sapiens
SGFNSLSLD

SEQ ID NO: 379060 - protein, 9 aa, Homo Sapiens
ECSLSLVLE

SEQ ID NO: 379061 - protein, 9 aa, Homo Sapiens
TIGCGVRSI

SEQ ID NO: 379062 - protein, 9 aa, Homo Sapiens
WVYRSSFTR

SEQ ID NO: 379063 - protein, 9 aa, Homo Sapiens
NSVNHNYTG

SEQ ID NO: 379064 - protein, 9 aa, Homo Sapiens
SIKEVIKRA

SEQ ID NO: 379065 - protein, 9 aa, Homo Sapiens
SSLSVLHSF

SEQ ID NO: 379066 - protein, 9 aa, Homo Sapiens
ITQERDHTG

SEQ ID NO: 379067 - protein, 9 aa, Homo Sapiens
YTSLGQAYR

SEQ ID NO: 379068 - protein, 9 aa, Homo Sapiens
KVPQHAGKK

SEQ ID NO: 379069 - protein, 9 aa, Homo Sapiens
GREAVCFMP

SEQ ID NO: 379070 - protein, 9 aa, Homo Sapiens
FTKETTQNN

SEQ ID NO: 379071 - protein, 9 aa, Homo Sapiens
TTKLPLKFH

SEQ ID NO: 379072 - protein, 9 aa, Homo Sapiens
PLLVTFVAQ

SEQ ID NO: 379073 - protein, 9 aa, Homo Sapiens
KTSQRDTSD

SEQ ID NO: 379074 - protein, 9 aa, Homo Sapiens
LREINKIVG

SEQ ID NO: 379075 - protein, 9 aa, Homo Sapiens
LFTSLGLLP

SEQ ID NO: 379076 - protein, 9 aa, Homo Sapiens
YLNLLKSEG

SEQ ID NO: 379077 - protein, 9 aa, Homo Sapiens
KKQHLAQIR

SEQ ID NO: 379078 - protein, 9 aa, Homo Sapiens
NHFLEAHSS

SEQ ID NO: 379079 - protein, 9 aa, Homo Sapiens
ENTFEGDIQ

SEQ ID NO: 379080 - protein, 9 aa, Homo Sapiens
IYHDALQNY

SEQ ID NO: 379081 - protein, 9 aa, Homo Sapiens
LMTLGEVEQ

SEQ ID NO: 379082 - protein, 9 aa, Homo Sapiens
ELSLLCPGG

SEQ ID NO: 379083 - protein, 9 aa, Homo Sapiens
KTGIEVSQT

SEQ ID NO: 379084 - protein, 9 aa, Homo Sapiens
NKSNLNYLD

SEQ ID NO: 379085 - protein, 9 aa, Homo Sapiens
DMVHCSYIC

SEQ ID NO: 379086 - protein, 9 aa, Homo Sapiens
KDEQNNLKK

SEQ ID NO: 379087 - protein, 9 aa, Homo Sapiens
PSTTGIWKQ

SEQ ID NO: 379088 - protein, 9 aa, Homo Sapiens
SNLNYLDEQ

SEQ ID NO: 379089 - protein, 9 aa, Homo Sapiens
DVQLVTNLR

SEQ ID NO: 379090 - protein, 9 aa, Homo Sapiens
PKVTQQDAV

SEQ ID NO: 379091 - protein, 9 aa, Homo Sapiens
QVWMDADTQ

SEQ ID NO: 379092 - protein, 9 aa, Homo Sapiens
LSLGVGSST

SEQ ID NO: 379093 - protein, 9 aa, Homo Sapiens
QVYKEERKN

SEQ ID NO: 379094 - protein, 9 aa, Homo Sapiens
ALCSRSCNS

SEQ ID NO: 379095 - protein, 9 aa, Homo Sapiens
LLDKVRPHI

SEQ ID NO: 379096 - protein, 9 aa, Homo Sapiens
DNYSNEVFP

SEQ ID NO: 379097 - protein, 9 aa, Homo Sapiens
NLDKELDAL

SEQ ID NO: 379098 - protein, 9 aa, Homo Sapiens
DNPPDHDPI

SEQ ID NO: 379099 - protein, 9 aa, Homo Sapiens
NIQDIFWHT

SEQ ID NO: 379100 - protein, 9 aa, Homo Sapiens
IIDLRDKFN

SEQ ID NO: 379101 - protein, 9 aa, Homo Sapiens
GGTNQEFGV

SEQ ID NO: 379102 - protein, 9 aa, Homo Sapiens
LSEEIRFYQ

SEQ ID NO: 379103 - protein, 9 aa, Homo Sapiens
FSYNFYIRP

SEQ ID NO: 379104 - protein, 9 aa, Homo Sapiens
QEDKIQEWE

SEQ ID NO: 379105 - protein, 9 aa, Homo Sapiens
IGGNNNIAI

SEQ ID NO: 379106 - protein, 9 aa, Homo Sapiens
AQGKTKKLN

SEQ ID NO: 379107 - protein, 9 aa, Homo Sapiens
IFHVLKLAR

SEQ ID NO: 379108 - protein, 9 aa, Homo Sapiens
LVYHQINHT

SEQ ID NO: 379109 - protein, 9 aa, Homo Sapiens
KLDHPDITC

SEQ ID NO: 379110 - protein, 9 aa, Homo Sapiens
RHYARTDEI

SEQ ID NO: 379111 - protein, 9 aa, Homo Sapiens
MCYKNKWEE

SEQ ID NO: 379112 - protein, 9 aa, Homo Sapiens
VIRLPKGKQ

SEQ ID NO: 379113 - protein, 9 aa, Homo Sapiens
DESTQSIQE

SEQ ID NO: 379114 - protein, 9 aa, Homo Sapiens
LAYAELELI

SEQ ID NO: 379115 - protein, 9 aa, Homo Sapiens
SRFGKFIHI

SEQ ID NO: 379116 - protein, 9 aa, Homo Sapiens
IPVASLFLD

SEQ ID NO: 379117 - protein, 9 aa, Homo Sapiens
IVRSCRKKL

SEQ ID NO: 379118 - protein, 9 aa, Homo Sapiens
SVLSMDLST

SEQ ID NO: 379119 - protein, 9 aa, Homo Sapiens
IISKVWPTF

SEQ ID NO: 379120 - protein, 9 aa, Homo Sapiens
AHNPGVYTR

SEQ ID NO: 379121 - protein, 9 aa, Homo Sapiens
WDLAKSLHK

SEQ ID NO: 379122 - protein, 9 aa, Homo Sapiens
RTPLAFVQK

SEQ ID NO: 379123 - protein, 9 aa, Homo Sapiens
TMKIIAYGF

SEQ ID NO: 379124 - protein, 9 aa, Homo Sapiens
SEELDQVFS

SEQ ID NO: 379125 - protein, 9 aa, Homo Sapiens
KGESKEVIP

SEQ ID NO: 379126 - protein, 9 aa, Homo Sapiens
NSICHNLSL

SEQ ID NO: 379127 - protein, 9 aa, Homo Sapiens
QVILEKQIC

SEQ ID NO: 379128 - protein, 9 aa, Homo Sapiens
DKSLTPLQW

SEQ ID NO: 379129 - protein, 9 aa, Homo Sapiens
PRAMAGKGY

SEQ ID NO: 379130 - protein, 9 aa, Homo Sapiens
VACPCHTQT

SEQ ID NO: 379131 - protein, 9 aa, Homo Sapiens
KIMGAPSLE

SEQ ID NO: 379132 - protein, 9 aa, Homo Sapiens
PASSPLTRL

SEQ ID NO: 379133 - protein, 9 aa, Homo Sapiens
ANATLCIIE

SEQ ID NO: 379134 - protein, 9 aa, Homo Sapiens
LGYAPAIQG

SEQ ID NO: 379135 - protein, 9 aa, Homo Sapiens
FIQAKQFIC

SEQ ID NO: 379136 - protein, 9 aa, Homo Sapiens
SSLNEHKII

SEQ ID NO: 379137 - protein, 9 aa, Homo Sapiens
EHTIHYVLP

SEQ ID NO: 379138 - protein, 9 aa, Homo Sapiens
LKYSIIMNR

SEQ ID NO: 379139 - protein, 9 aa, Homo Sapiens
VVHIGHLYI

SEQ ID NO: 379140 - protein, 9 aa, Homo Sapiens
RKKHDYHIA

SEQ ID NO: 379141 - protein, 9 aa, Homo Sapiens
VTGEPGQLL

SEQ ID NO: 379142 - protein, 9 aa, Homo Sapiens
HAGQSLTET

SEQ ID NO: 379143 - protein, 9 aa, Homo Sapiens
EQNLVWKFR

SEQ ID NO: 379144 - protein, 9 aa, Homo Sapiens
IIHTREKTY

SEQ ID NO: 379145 - protein, 9 aa, Homo Sapiens
GNPRADNIH

SEQ ID NO: 379146 - protein, 9 aa, Homo Sapiens
IRYVRSPLL

SEQ ID NO: 379147 - protein, 9 aa, Homo Sapiens
IEEEDKLSR

SEQ ID NO: 379148 - protein, 9 aa, Homo Sapiens
YGHILDRER

SEQ ID NO: 379149 - protein, 9 aa, Homo Sapiens
GKIYHYDIR

SEQ ID NO: 379150 - protein, 9 aa, Homo Sapiens
KKSKRSMNE

SEQ ID NO: 379151 - protein, 9 aa, Homo Sapiens
RFNLIDDIS

SEQ ID NO: 379152 - protein, 9 aa, Homo Sapiens
NELQLEAAN

SEQ ID NO: 379153 - protein, 9 aa, Homo Sapiens
SLIVIILIW

SEQ ID NO: 379154 - protein, 9 aa, Homo Sapiens
FNSLSLDKS

SEQ ID NO: 379155 - protein, 9 aa, Homo Sapiens
DFAPGIWLG

SEQ ID NO: 379156 - protein, 9 aa, Homo Sapiens
DERKQWALA

SEQ ID NO: 379157 - protein, 9 aa, Homo Sapiens
ATRIPLGLS

SEQ ID NO: 379158 - protein, 9 aa, Homo Sapiens
PQTLDNLIN

SEQ ID NO: 379159 - protein, 9 aa, Homo Sapiens
TLTQNQAFY

SEQ ID NO: 379160 - protein, 9 aa, Homo Sapiens
SLIFLLAMG

SEQ ID NO: 379161 - protein, 9 aa, Homo Sapiens
EINKIVGQL

SEQ ID NO: 379162 - protein, 9 aa, Homo Sapiens
RKREEKLCK

SEQ ID NO: 379163 - protein, 9 aa, Homo Sapiens
VTFVAQNRS

SEQ ID NO: 379164 - protein, 9 aa, Homo Sapiens
SIIIFWTPP

SEQ ID NO: 379165 - protein, 9 aa, Homo Sapiens
PEFRVRATA

SEQ ID NO: 379166 - protein, 9 aa, Homo Sapiens
NCDADLNEW

SEQ ID NO: 379167 - protein, 9 aa, Homo Sapiens
KEHLQKTVN

SEQ ID NO: 379168 - protein, 9 aa, Homo Sapiens
LQPGALVFV

SEQ ID NO: 379169 - protein, 9 aa, Homo Sapiens
MNKSNLNYL

SEQ ID NO: 379170 - protein, 9 aa, Homo Sapiens
PIRSPIKLD

SEQ ID NO: 379171 - protein, 9 aa, Homo Sapiens
APIRGPLFT

SEQ ID NO: 379172 - protein, 9 aa, Homo Sapiens
IVGGVIGFL

SEQ ID NO: 379173 - protein, 9 aa, Homo Sapiens
PGIWLGLEL

SEQ ID NO: 379174 - protein, 9 aa, Homo Sapiens
DGTHELIMH

SEQ ID NO: 379175 - protein, 9 aa, Homo Sapiens
RSPRPSLSS

SEQ ID NO: 379176 - protein, 9 aa, Homo Sapiens
ELQPGALVF

SEQ ID NO: 379177 - protein, 9 aa, Homo Sapiens
GFIQAKQFI

SEQ ID NO: 379178 - protein, 9 aa, Homo Sapiens
TSICKQQTN

SEQ ID NO: 379179 - protein, 9 aa, Homo Sapiens
LLAVCLIIY

SEQ ID NO: 379180 - protein, 9 aa, Homo Sapiens
TGECRLGEE

SEQ ID NO: 379181 - protein, 9 aa, Homo Sapiens
YLNSSQNYL

SEQ ID NO: 379182 - protein, 9 aa, Homo Sapiens
PGIDPQEKY

SEQ ID NO: 379183 - protein, 9 aa, Homo Sapiens
LLQFIFQTD

SEQ ID NO: 379184 - protein, 9 aa, Homo Sapiens
RPIKRITWN

SEQ ID NO: 379185 - protein, 9 aa, Homo Sapiens
ERSSASGGY

SEQ ID NO: 379186 - protein, 9 aa, Homo Sapiens
NYNRSYARN

SEQ ID NO: 379187 - protein, 9 aa, Homo Sapiens
NWPIYLRKH

SEQ ID NO: 379188 - protein, 9 aa, Homo Sapiens
ISVYENKLL

SEQ ID NO: 379189 - protein, 9 aa, Homo Sapiens
AYEYIRVSS

SEQ ID NO: 379190 - protein, 9 aa, Homo Sapiens
ASFLPLLAF

SEQ ID NO: 379191 - protein, 9 aa, Homo Sapiens
TSTKTRQRV

SEQ ID NO: 379192 - protein, 9 aa, Homo Sapiens
NRNDLLNTS

SEQ ID NO: 379193 - protein, 9 aa, Homo Sapiens
QPGALVFVN

SEQ ID NO: 379194 - protein, 9 aa, Homo Sapiens
MEKLLDPAI

SEQ ID NO: 379195 - protein, 9 aa, Homo Sapiens
VQTASKECQ

SEQ ID NO: 379196 - protein, 9 aa, Homo Sapiens
PVRRPMCKS

SEQ ID NO: 379197 - protein, 9 aa, Homo Sapiens
LKHLRASMN

SEQ ID NO: 379198 - protein, 9 aa, Homo Sapiens
DKYLEIQGI

SEQ ID NO: 379199 - protein, 9 aa, Homo Sapiens
LNEHQILHR

SEQ ID NO: 379200 - protein, 9 aa, Homo Sapiens
LCVHGDARQ

SEQ ID NO: 379201 - protein, 9 aa, Homo Sapiens
EAHRINNEK

SEQ ID NO: 379202 - protein, 9 aa, Homo Sapiens
EHGRNLAEV

SEQ ID NO: 379203 - protein, 9 aa, Homo Sapiens
RAPTHQQFP

SEQ ID NO: 379204 - protein, 9 aa, Homo Sapiens
QYEIYFKVW

SEQ ID NO: 379205 - protein, 9 aa, Homo Sapiens
VFKFLQQEQ

SEQ ID NO: 379206 - protein, 9 aa, Homo Sapiens
PSYSLHSTT

SEQ ID NO: 379207 - protein, 9 aa, Homo Sapiens
INKQEAKKK

SEQ ID NO: 379208 - protein, 9 aa, Homo Sapiens
ERRIRFWRF

SEQ ID NO: 379209 - protein, 9 aa, Homo Sapiens
DEVAKKICE

SEQ ID NO: 379210 - protein, 9 aa, Homo Sapiens
LGKDTIVFT

SEQ ID NO: 379211 - protein, 9 aa, Homo Sapiens
RFLAWGVQT

SEQ ID NO: 379212 - protein, 9 aa, Homo Sapiens
SPIKLDFLS

SEQ ID NO: 379213 - protein, 9 aa, Homo Sapiens
GKGYALGET

SEQ ID NO: 379214 - protein, 9 aa, Homo Sapiens
ICCFIRLEG

SEQ ID NO: 379215 - protein, 9 aa, Homo Sapiens
EAKASTIFN

SEQ ID NO: 379216 - protein, 9 aa, Homo Sapiens
LSVLHSFYV

SEQ ID NO: 379217 - protein, 9 aa, Homo Sapiens
FRRSSALIQ

SEQ ID NO: 379218 - protein, 9 aa, Homo Sapiens
AVISELNAG

SEQ ID NO: 379219 - protein, 9 aa, Homo Sapiens
LSMMRLYSS

SEQ ID NO: 379220 - protein, 9 aa, Homo Sapiens
FLHTVILCD

SEQ ID NO: 379221 - protein, 9 aa, Homo Sapiens
AVIVGGVIG

SEQ ID NO: 379222 - protein, 9 aa, Homo Sapiens
QSLNYYTNG

SEQ ID NO: 379223 - protein, 9 aa, Homo Sapiens
RSNLSISPV

SEQ ID NO: 379224 - protein, 9 aa, Homo Sapiens
RAIQFTGSG

SEQ ID NO: 379225 - protein, 9 aa, Homo Sapiens
LQNASSRER

SEQ ID NO: 379226 - protein, 9 aa, Homo Sapiens
INVKKCRHE

SEQ ID NO: 379227 - protein, 9 aa, Homo Sapiens
DDLFTSLGL

SEQ ID NO: 379228 - protein, 9 aa, Homo Sapiens
SVNYFISAQ

SEQ ID NO: 379229 - protein, 9 aa, Homo Sapiens
LLSGYLEVI

SEQ ID NO: 379230 - protein, 9 aa, Homo Sapiens
YQYVKKGSQ

SEQ ID NO: 379231 - protein, 9 aa, Homo Sapiens
LYSHTMIHR

SEQ ID NO: 379232 - protein, 9 aa, Homo Sapiens
QQHKQKTSQ

SEQ ID NO: 379233 - protein, 9 aa, Homo Sapiens
YWSMSLGIK

SEQ ID NO: 379234 - protein, 9 aa, Homo Sapiens
NFMKTSDSY

SEQ ID NO: 379235 - protein, 9 aa, Homo Sapiens
SESYTWLLF

SEQ ID NO: 379236 - protein, 9 aa, Homo Sapiens
EAPELTQGI

SEQ ID NO: 379237 - protein, 9 aa, Homo Sapiens
MSVEPEELG

SEQ ID NO: 379238 - protein, 9 aa, Homo Sapiens
NKYKGQKGL

SEQ ID NO: 379239 - protein, 9 aa, Homo Sapiens
EQLKLNIGK

SEQ ID NO: 379240 - protein, 9 aa, Homo Sapiens
FVIILALVL

SEQ ID NO: 379241 - protein, 9 aa, Homo Sapiens
TVWTKIDDT

SEQ ID NO: 379242 - protein, 9 aa, Homo Sapiens
AMHSESTAA

SEQ ID NO: 379243 - protein, 9 aa, Homo Sapiens
QSQPVKLDP

SEQ ID NO: 379244 - protein, 9 aa, Homo Sapiens
SHEEDNESS

SEQ ID NO: 379245 - protein, 9 aa, Homo Sapiens
DLFIISKVW

SEQ ID NO: 379246 - protein, 9 aa, Homo Sapiens
CLEKLSISS

SEQ ID NO: 379247 - protein, 9 aa, Homo Sapiens
IPEDTTYNK

SEQ ID NO: 379248 - protein, 9 aa, Homo Sapiens
HIHPHINMD

SEQ ID NO: 379249 - protein, 9 aa, Homo Sapiens
DNQSVVRIM

SEQ ID NO: 379250 - protein, 9 aa, Homo Sapiens
TYRWLNNGV

SEQ ID NO: 379251 - protein, 9 aa, Homo Sapiens
EVAAAVGSQ

SEQ ID NO: 379252 - protein, 9 aa, Homo Sapiens
RMQKMKDDH

SEQ ID NO: 379253 - protein, 9 aa, Homo Sapiens
DDMVHCSYI

SEQ ID NO: 379254 - protein, 9 aa, Homo Sapiens
LSKHQNVFN

SEQ ID NO: 379255 - protein, 9 aa, Homo Sapiens
AYNDASNLS

SEQ ID NO: 379256 - protein, 9 aa, Homo Sapiens
VDSGTWCKL

SEQ ID NO: 379257 - protein, 9 aa, Homo Sapiens
TSLPIRHIW

SEQ ID NO: 379258 - protein, 9 aa, Homo Sapiens
NDSNEKMEK

SEQ ID NO: 379259 - protein, 9 aa, Homo Sapiens
DNKIMQKTN

SEQ ID NO: 379260 - protein, 9 aa, Homo Sapiens
MGNSHSGHF

SEQ ID NO: 379261 - protein, 9 aa, Homo Sapiens
TKEQPYTCK

SEQ ID NO: 379262 - protein, 9 aa, Homo Sapiens
KPYLGRIEI

SEQ ID NO: 379263 - protein, 9 aa, Homo Sapiens
KKLKLTDIR

SEQ ID NO: 379264 - protein, 9 aa, Homo Sapiens
AKNFLGASP

SEQ ID NO: 379265 - protein, 9 aa, Homo Sapiens
LALACRDDY

SEQ ID NO: 379266 - protein, 9 aa, Homo Sapiens
RRILFIKIF

SEQ ID NO: 379267 - protein, 9 aa, Homo Sapiens
DAGWYTVAA

SEQ ID NO: 379268 - protein, 9 aa, Homo Sapiens
INCREVMEA

SEQ ID NO: 379269 - protein, 9 aa, Homo Sapiens
QPWPGHANL

SEQ ID NO: 379270 - protein, 9 aa, Homo Sapiens
DAVYLNKNT

SEQ ID NO: 379271 - protein, 9 aa, Homo Sapiens
KSHTFDLEA

SEQ ID NO: 379272 - protein, 9 aa, Homo Sapiens
ESASFEYLS

SEQ ID NO: 379273 - protein, 9 aa, Homo Sapiens
VSVSCRYLN

SEQ ID NO: 379274 - protein, 9 aa, Homo Sapiens
LFDNVTNKD

SEQ ID NO: 379275 - protein, 9 aa, Homo Sapiens
FNKHKTKFG

SEQ ID NO: 379276 - protein, 9 aa, Homo Sapiens
VKAHNPGVY

SEQ ID NO: 379277 - protein, 9 aa, Homo Sapiens
QRNVYRDVM

SEQ ID NO: 379278 - protein, 9 aa, Homo Sapiens
IFAHKEMEE

SEQ ID NO: 379279 - protein, 9 aa, Homo Sapiens
AMAGKGYET

SEQ ID NO: 379280 - protein, 9 aa, Homo Sapiens
DKLRAAFFA

SEQ ID NO: 379281 - protein, 9 aa, Homo Sapiens
SSKLKLKLP

SEQ ID NO: 379282 - protein, 9 aa, Homo Sapiens
SSLESPVVY

SEQ ID NO: 379283 - protein, 9 aa, Homo Sapiens
KIMSYELLR

SEQ ID NO: 379284 - protein, 9 aa, Homo Sapiens
SGSHKPTRK

SEQ ID NO: 379285 - protein, 9 aa, Homo Sapiens
EECREELDA

SEQ ID NO: 379286 - protein, 9 aa, Homo Sapiens
TPGGKDHLV

SEQ ID NO: 379287 - protein, 9 aa, Homo Sapiens
NLMTLGEVE

SEQ ID NO: 379288 - protein, 9 aa, Homo Sapiens
ESNSESEEK

SEQ ID NO: 379289 - protein, 9 aa, Homo Sapiens
HIASLEQRV

SEQ ID NO: 379290 - protein, 9 aa, Homo Sapiens
YNKVVFRKY

SEQ ID NO: 379291 - protein, 9 aa, Homo Sapiens
DDDNVFNSN

SEQ ID NO: 379292 - protein, 9 aa, Homo Sapiens
CPEFRVRAT

SEQ ID NO: 379293 - protein, 9 aa, Homo Sapiens
SPDPQMDLL

SEQ ID NO: 379294 - protein, 9 aa, Homo Sapiens
MGPTKEPTV

SEQ ID NO: 379295 - protein, 9 aa, Homo Sapiens
YVKDAKMKA

SEQ ID NO: 379296 - protein, 9 aa, Homo Sapiens
DLKDVDNIL

SEQ ID NO: 379297 - protein, 9 aa, Homo Sapiens
FVLFMFFIL

SEQ ID NO: 379298 - protein, 9 aa, Homo Sapiens
PTAGMVTIT

SEQ ID NO: 379299 - protein, 9 aa, Homo Sapiens
QINYLVQTE

SEQ ID NO: 379300 - protein, 9 aa, Homo Sapiens
VQKAASQTL

SEQ ID NO: 379301 - protein, 9 aa, Homo Sapiens
CQPACCVPA

SEQ ID NO: 379302 - protein, 9 aa, Homo Sapiens
ALLQGAIKS

SEQ ID NO: 379303 - protein, 9 aa, Homo Sapiens
SFQARPAPS

SEQ ID NO: 379304 - protein, 9 aa, Homo Sapiens
ALSIPAEQF

SEQ ID NO: 379305 - protein, 9 aa, Homo Sapiens
KRSQQNKKM

SEQ ID NO: 379306 - protein, 9 aa, Homo Sapiens
PRGATRGVC

SEQ ID NO: 379307 - protein, 9 aa, Homo Sapiens
SILSGFSGS

SEQ ID NO: 379308 - protein, 9 aa, Homo Sapiens
LLRPATQIR

SEQ ID NO: 379309 - protein, 9 aa, Homo Sapiens
EQEVQQILL

SEQ ID NO: 379310 - protein, 9 aa, Homo Sapiens
WGSWTKVGS

SEQ ID NO: 379311 - protein, 9 aa, Homo Sapiens
KYLGCQWRK

SEQ ID NO: 379312 - protein, 9 aa, Homo Sapiens
SEFIKYDIS

SEQ ID NO: 379313 - protein, 9 aa, Homo Sapiens
NIHLFSMAF

SEQ ID NO: 379314 - protein, 9 aa, Homo Sapiens
EHLVDSSGH

SEQ ID NO: 379315 - protein, 9 aa, Homo Sapiens
YENNYWSMS

SEQ ID NO: 379316 - protein, 9 aa, Homo Sapiens
LANKYKGQK

SEQ ID NO: 379317 - protein, 9 aa, Homo Sapiens
GRLTAIKLF

SEQ ID NO: 379318 - protein, 9 aa, Homo Sapiens
LANATLCII

SEQ ID NO: 379319 - protein, 9 aa, Homo Sapiens
EEGALWHHY

SEQ ID NO: 379320 - protein, 9 aa, Homo Sapiens
IWSVGQIIW

SEQ ID NO: 379321 - protein, 9 aa, Homo Sapiens
KSLHKTIQA

SEQ ID NO: 379322 - protein, 9 aa, Homo Sapiens
INNPYNIFD

SEQ ID NO: 379323 - protein, 9 aa, Homo Sapiens
TGSSGYTAL

SEQ ID NO: 379324 - protein, 9 aa, Homo Sapiens
PSIIWYLYL

SEQ ID NO: 379325 - protein, 9 aa, Homo Sapiens
GKRKQNEDD

SEQ ID NO: 379326 - protein, 9 aa, Homo Sapiens
QINKEALVS

SEQ ID NO: 379327 - protein, 9 aa, Homo Sapiens
LIFLNSIKS

SEQ ID NO: 379328 - protein, 9 aa, Homo Sapiens
AQVAKIWFQ

SEQ ID NO: 379329 - protein, 9 aa, Homo Sapiens
EMKYLEVRS

SEQ ID NO: 379330 - protein, 9 aa, Homo Sapiens
NMGKFIITF

SEQ ID NO: 379331 - protein, 9 aa, Homo Sapiens
LSVVTSEIN

SEQ ID NO: 379332 - protein, 9 aa, Homo Sapiens
SSQSEESYL

SEQ ID NO: 379333 - protein, 9 aa, Homo Sapiens
HVTIITDDM

SEQ ID NO: 379334 - protein, 9 aa, Homo Sapiens
SLANKYKGQ

SEQ ID NO: 379335 - protein, 9 aa, Homo Sapiens
YIALNTCIL

SEQ ID NO: 379336 - protein, 9 aa, Homo Sapiens
WFQQKVMEK

SEQ ID NO: 379337 - protein, 9 aa, Homo Sapiens
VCEDKSSHL

SEQ ID NO: 379338 - protein, 9 aa, Homo Sapiens
KHEITHTIN

SEQ ID NO: 379339 - protein, 9 aa, Homo Sapiens
YAWMAPKVI

SEQ ID NO: 379340 - protein, 9 aa, Homo Sapiens
RSACTYKEL

SEQ ID NO: 379341 - protein, 9 aa, Homo Sapiens
VWEDNTPPL

SEQ ID NO: 379342 - protein, 9 aa, Homo Sapiens
TMEYKQELN

SEQ ID NO: 379343 - protein, 9 aa, Homo Sapiens
YDYENNYWS

SEQ ID NO: 379344 - protein, 9 aa, Homo Sapiens
LTLFEYYIY

SEQ ID NO: 379345 - protein, 9 aa, Homo Sapiens
SGDRDNNKW

SEQ ID NO: 379346 - protein, 9 aa, Homo Sapiens
LGEARHPQI

SEQ ID NO: 379347 - protein, 9 aa, Homo Sapiens
KVYINVKMG

SEQ ID NO: 379348 - protein, 9 aa, Homo Sapiens
QKAQSAACM

SEQ ID NO: 379349 - protein, 9 aa, Homo Sapiens
EFGRETNNL

SEQ ID NO: 379350 - protein, 9 aa, Homo Sapiens
GDIVSPIHD

SEQ ID NO: 379351 - protein, 9 aa, Homo Sapiens
RLNPVKPMN

SEQ ID NO: 379352 - protein, 9 aa, Homo Sapiens
HTTQTSIAQ

SEQ ID NO: 379353 - protein, 9 aa, Homo Sapiens
CKPKGEGSR

SEQ ID NO: 379354 - protein, 9 aa, Homo Sapiens
SGAAPATPA

SEQ ID NO: 379355 - protein, 9 aa, Homo Sapiens
ADNRIHTST

SEQ ID NO: 379356 - protein, 9 aa, Homo Sapiens
VCALNKLVS

SEQ ID NO: 379357 - protein, 9 aa, Homo Sapiens
PLNKRLKKY

SEQ ID NO: 379358 - protein, 9 aa, Homo Sapiens
SLHFLQILR

SEQ ID NO: 379359 - protein, 9 aa, Homo Sapiens
QIYRIFEQG

SEQ ID NO: 379360 - protein, 9 aa, Homo Sapiens
TFGISSKEL

SEQ ID NO: 379361 - protein, 9 aa, Homo Sapiens
YTTAEVVYY

SEQ ID NO: 379362 - protein, 9 aa, Homo Sapiens
YGENFEYQL

SEQ ID NO: 379363 - protein, 9 aa, Homo Sapiens
NDKDNLNLE

SEQ ID NO: 379364 - protein, 9 aa, Homo Sapiens
TKNVQDNSL

SEQ ID NO: 379365 - protein, 9 aa, Homo Sapiens
EEMKKTVIR

SEQ ID NO: 379366 - protein, 9 aa, Homo Sapiens
VQQILLELD

SEQ ID NO: 379367 - protein, 9 aa, Homo Sapiens
ITIHSLHDF

SEQ ID NO: 379368 - protein, 9 aa, Homo Sapiens
EERKEFVCH

SEQ ID NO: 379369 - protein, 9 aa, Homo Sapiens
IYFKALWDK

SEQ ID NO: 379370 - protein, 9 aa, Homo Sapiens
LFARRNQGA

SEQ ID NO: 379371 - protein, 9 aa, Homo Sapiens
PEDTTYNKV

SEQ ID NO: 379372 - protein, 9 aa, Homo Sapiens
IFNDAEVKP

SEQ ID NO: 379373 - protein, 9 aa, Homo Sapiens
TATPQIAKA

SEQ ID NO: 379374 - protein, 9 aa, Homo Sapiens
VEWERLGAT

SEQ ID NO: 379375 - protein, 9 aa, Homo Sapiens
HFLLGVSMA

SEQ ID NO: 379376 - protein, 9 aa, Homo Sapiens
MHSESTAAA

SEQ ID NO: 379377 - protein, 9 aa, Homo Sapiens
PNMLLSMQT

SEQ ID NO: 379378 - protein, 9 aa, Homo Sapiens
TSPGFLVKH

SEQ ID NO: 379379 - protein, 9 aa, Homo Sapiens
LLHTEVRWL

SEQ ID NO: 379380 - protein, 9 aa, Homo Sapiens
LKPLKLKRH

SEQ ID NO: 379381 - protein, 9 aa, Homo Sapiens
VVLCLAVAF

SEQ ID NO: 379382 - protein, 9 aa, Homo Sapiens
YAIDWNPAT

SEQ ID NO: 379383 - protein, 9 aa, Homo Sapiens
GPQDFNYFV

SEQ ID NO: 379384 - protein, 9 aa, Homo Sapiens
QMGPTKEPT

SEQ ID NO: 379385 - protein, 9 aa, Homo Sapiens
QTRMQKMKD

SEQ ID NO: 379386 - protein, 9 aa, Homo Sapiens
RAIIQLPAN

SEQ ID NO: 379387 - protein, 9 aa, Homo Sapiens
WSRKKKIIW

SEQ ID NO: 379388 - protein, 9 aa, Homo Sapiens
AGTYVWMAP

SEQ ID NO: 379389 - protein, 9 aa, Homo Sapiens
PLLAFAYTS

SEQ ID NO: 379390 - protein, 9 aa, Homo Sapiens
TEIISFTQC

SEQ ID NO: 379391 - protein, 9 aa, Homo Sapiens
QTKYLGCQW

SEQ ID NO: 379392 - protein, 9 aa, Homo Sapiens
VLYFDAYLE

SEQ ID NO: 379393 - protein, 9 aa, Homo Sapiens
VPKMLDKEG

SEQ ID NO: 379394 - protein, 9 aa, Homo Sapiens
NLVFTPNKP

SEQ ID NO: 379395 - protein, 9 aa, Homo Sapiens
NQLEKFDIN

SEQ ID NO: 379396 - protein, 9 aa, Homo Sapiens
LDEVAKKIC

SEQ ID NO: 379397 - protein, 9 aa, Homo Sapiens
PIIKLTDYF

SEQ ID NO: 379398 - protein, 9 aa, Homo Sapiens
SPSCSGPNT

SEQ ID NO: 379399 - protein, 9 aa, Homo Sapiens
GQSLTETTS

SEQ ID NO: 379400 - protein, 9 aa, Homo Sapiens
QHLAQIREE

SEQ ID NO: 379401 - protein, 9 aa, Homo Sapiens
EKLTGEPLY

SEQ ID NO: 379402 - protein, 9 aa, Homo Sapiens
SCMRQIGWN

SEQ ID NO: 379403 - protein, 9 aa, Homo Sapiens
FQEIVTALV

SEQ ID NO: 379404 - protein, 9 aa, Homo Sapiens
NKVWTMLMA

SEQ ID NO: 379405 - protein, 9 aa, Homo Sapiens
NGVSQIIKL

SEQ ID NO: 379406 - protein, 9 aa, Homo Sapiens
VMNFKAVLH

SEQ ID NO: 379407 - protein, 9 aa, Homo Sapiens
LQKKKHDLR

SEQ ID NO: 379408 - protein, 9 aa, Homo Sapiens
SQIIKLNCL

SEQ ID NO: 379409 - protein, 9 aa, Homo Sapiens
KYHRCVKLS

SEQ ID NO: 379410 - protein, 9 aa, Homo Sapiens
LCHQKDLDL

SEQ ID NO: 379411 - protein, 9 aa, Homo Sapiens
VAYLFSGQA

SEQ ID NO: 379412 - protein, 9 aa, Homo Sapiens
SHILRNKIG

SEQ ID NO: 379413 - protein, 9 aa, Homo Sapiens
AVTALNRLF

SEQ ID NO: 379414 - protein, 9 aa, Homo Sapiens
PNKGESKEV

SEQ ID NO: 379415 - protein, 9 aa, Homo Sapiens
NHAWYFPSE

SEQ ID NO: 379416 - protein, 9 aa, Homo Sapiens
YLSFKVLKH

SEQ ID NO: 379417 - protein, 9 aa, Homo Sapiens
ITHGKKYHY

SEQ ID NO: 379418 - protein, 9 aa, Homo Sapiens
TISESNINL

SEQ ID NO: 379419 - protein, 9 aa, Homo Sapiens
DKVRPHIAG

SEQ ID NO: 379420 - protein, 9 aa, Homo Sapiens
EEAADNQRV

SEQ ID NO: 379421 - protein, 9 aa, Homo Sapiens
RPSLSSDSD

SEQ ID NO: 379422 - protein, 9 aa, Homo Sapiens
PGQLLELSK

SEQ ID NO: 379423 - protein, 9 aa, Homo Sapiens
MASPTAGMV

SEQ ID NO: 379424 - protein, 9 aa, Homo Sapiens
YFKALWDKP

SEQ ID NO: 379425 - protein, 9 aa, Homo Sapiens
INLRLSTYA

SEQ ID NO: 379426 - protein, 9 aa, Homo Sapiens
VISELNAGK

SEQ ID NO: 379427 - protein, 9 aa, Homo Sapiens
VLLLSAIVS

SEQ ID NO: 379428 - protein, 9 aa, Homo Sapiens
LVFTPNKPL

SEQ ID NO: 379429 - protein, 9 aa, Homo Sapiens
PAWYRFLLM

SEQ ID NO: 379430 - protein, 9 aa, Homo Sapiens
AFIQIDLQD

SEQ ID NO: 379431 - protein, 9 aa, Homo Sapiens
DCGKTFGSG

SEQ ID NO: 379432 - protein, 9 aa, Homo Sapiens
MPIVVCLHW

SEQ ID NO: 379433 - protein, 9 aa, Homo Sapiens
STYNILTFL

SEQ ID NO: 379434 - protein, 9 aa, Homo Sapiens
PTAINFTLW

SEQ ID NO: 379435 - protein, 9 aa, Homo Sapiens
PILKFKSIK

SEQ ID NO: 379436 - protein, 9 aa, Homo Sapiens
IISFTQCCV

SEQ ID NO: 379437 - protein, 9 aa, Homo Sapiens
MDNSTGCTG

SEQ ID NO: 379438 - protein, 9 aa, Homo Sapiens
KLPSCFNYV

SEQ ID NO: 379439 - protein, 9 aa, Homo Sapiens
HCQKYYVPL

SEQ ID NO: 379440 - protein, 9 aa, Homo Sapiens
PFDEDCIIE

SEQ ID NO: 379441 - protein, 9 aa, Homo Sapiens
HFTISGNEY

SEQ ID NO: 379442 - protein, 9 aa, Homo Sapiens
EGVWEDNTP

SEQ ID NO: 379443 - protein, 9 aa, Homo Sapiens
DADEYEETK

SEQ ID NO: 379444 - protein, 9 aa, Homo Sapiens
QEIFNKYNN

SEQ ID NO: 379445 - protein, 9 aa, Homo Sapiens
SELEDRSRR

SEQ ID NO: 379446 - protein, 9 aa, Homo Sapiens
RHPPRKKTV

SEQ ID NO: 379447 - protein, 9 aa, Homo Sapiens
GAIKSVKAV

SEQ ID NO: 379448 - protein, 9 aa, Homo Sapiens
RILNGQEQQ

SEQ ID NO: 379449 - protein, 9 aa, Homo Sapiens
ARYLQQKAA

SEQ ID NO: 379450 - protein, 9 aa, Homo Sapiens
IRSPIKLDF

SEQ ID NO: 379451 - protein, 9 aa, Homo Sapiens
HSQIKHQNL

SEQ ID NO: 379452 - protein, 9 aa, Homo Sapiens
ILSELWVLS

SEQ ID NO: 379453 - protein, 9 aa, Homo Sapiens
LHDIELYKA

SEQ ID NO: 379454 - protein, 9 aa, Homo Sapiens
IQGKYYGQF

SEQ ID NO: 379455 - protein, 9 aa, Homo Sapiens
PLSEHTIHY

SEQ ID NO: 379456 - protein, 9 aa, Homo Sapiens
AQRKDSEIK

SEQ ID NO: 379457 - protein, 9 aa, Homo Sapiens
STLNKHKII

SEQ ID NO: 379458 - protein, 9 aa, Homo Sapiens
KMLQELPDK

SEQ ID NO: 379459 - protein, 9 aa, Homo Sapiens
DEALQEESK

SEQ ID NO: 379460 - protein, 9 aa, Homo Sapiens
SGIQYLHEN

SEQ ID NO: 379461 - protein, 9 aa, Homo Sapiens
ESVGKAKGE

SEQ ID NO: 379462 - protein, 9 aa, Homo Sapiens
VVEVVHIGH

SEQ ID NO: 379463 - protein, 9 aa, Homo Sapiens
TKHLITHTG

SEQ ID NO: 379464 - protein, 9 aa, Homo Sapiens
RRKRRRLSN

SEQ ID NO: 379465 - protein, 9 aa, Homo Sapiens
YLTEVKYNG

SEQ ID NO: 379466 - protein, 9 aa, Homo Sapiens
GQSFSRYVS

SEQ ID NO: 379467 - protein, 9 aa, Homo Sapiens
VVFDRHGNI

SEQ ID NO: 379468 - protein, 9 aa, Homo Sapiens
RNSPVNTNN

SEQ ID NO: 379469 - protein, 9 aa, Homo Sapiens
EIEARYLQQ

SEQ ID NO: 379470 - protein, 9 aa, Homo Sapiens
EFRVRATAK

SEQ ID NO: 379471 - protein, 9 aa, Homo Sapiens
NRDSTMNVS

SEQ ID NO: 379472 - protein, 9 aa, Homo Sapiens
GVCGPGAQG

SEQ ID NO: 379473 - protein, 9 aa, Homo Sapiens
SHLSRHQIL

SEQ ID NO: 379474 - protein, 9 aa, Homo Sapiens
SVWLPGVVL

SEQ ID NO: 379475 - protein, 9 aa, Homo Sapiens
VCRLKLCDG

SEQ ID NO: 379476 - protein, 9 aa, Homo Sapiens
PGPPGLSGF

SEQ ID NO: 379477 - protein, 9 aa, Homo Sapiens
CGKAYNDAS

SEQ ID NO: 379478 - protein, 9 aa, Homo Sapiens
CDEYFTQNN

SEQ ID NO: 379479 - protein, 9 aa, Homo Sapiens
NCTGSSGYT

SEQ ID NO: 379480 - protein, 9 aa, Homo Sapiens
VPLVLTSRD

SEQ ID NO: 379481 - protein, 9 aa, Homo Sapiens
ELIMHKCEE

SEQ ID NO: 379482 - protein, 9 aa, Homo Sapiens
AERSACTYK

SEQ ID NO: 379483 - protein, 9 aa, Homo Sapiens
LFNKHKTKF

SEQ ID NO: 379484 - protein, 9 aa, Homo Sapiens
KFKKTSICK

SEQ ID NO: 379485 - protein, 9 aa, Homo Sapiens
SREQTHLSE

SEQ ID NO: 379486 - protein, 9 aa, Homo Sapiens
LLCPGGSPA

SEQ ID NO: 379487 - protein, 9 aa, Homo Sapiens
KALALDKTE

SEQ ID NO: 379488 - protein, 9 aa, Homo Sapiens
PLAIQNAGI

SEQ ID NO: 379489 - protein, 9 aa, Homo Sapiens
FMNVYIEDS

SEQ ID NO: 379490 - protein, 9 aa, Homo Sapiens
DPRWIFCPF

SEQ ID NO: 379491 - protein, 9 aa, Homo Sapiens
YKQELNKLH

SEQ ID NO: 379492 - protein, 9 aa, Homo Sapiens
KWIFYVLLC

SEQ ID NO: 379493 - protein, 9 aa, Homo Sapiens
RHQTKINSY

SEQ ID NO: 379494 - protein, 9 aa, Homo Sapiens
FTDTNELQL

SEQ ID NO: 379495 - protein, 9 aa, Homo Sapiens
ELYKARVEE

SEQ ID NO: 379496 - protein, 9 aa, Homo Sapiens
ACPLCHKLR

SEQ ID NO: 379497 - protein, 9 aa, Homo Sapiens
GTGCGKNKE

SEQ ID NO: 379498 - protein, 9 aa, Homo Sapiens
PEKCAKHKR

SEQ ID NO: 379499 - protein, 9 aa, Homo Sapiens
EPQAMDDPA

SEQ ID NO: 379500 - protein, 9 aa, Homo Sapiens
ITKGQTVQQ

SEQ ID NO: 379501 - protein, 9 aa, Homo Sapiens
LRNKLIGKE

SEQ ID NO: 379502 - protein, 9 aa, Homo Sapiens
YHAKNFLGA

SEQ ID NO: 379503 - protein, 9 aa, Homo Sapiens
ASETKCGEG

SEQ ID NO: 379504 - protein, 9 aa, Homo Sapiens
YLGKEGWVP

SEQ ID NO: 379505 - protein, 9 aa, Homo Sapiens
QGFREMSRN

SEQ ID NO: 379506 - protein, 9 aa, Homo Sapiens
LSRHQADNL

SEQ ID NO: 379507 - protein, 9 aa, Homo Sapiens
TDPNSVFQC

SEQ ID NO: 379508 - protein, 9 aa, Homo Sapiens
LGWAVPGSA

SEQ ID NO: 379509 - protein, 9 aa, Homo Sapiens
QMSAAGTYV

SEQ ID NO: 379510 - protein, 9 aa, Homo Sapiens
RTFLGWAVP

SEQ ID NO: 379511 - protein, 9 aa, Homo Sapiens
VRTIELEVI

SEQ ID NO: 379512 - protein, 9 aa, Homo Sapiens
PYSYLTKEW

SEQ ID NO: 379513 - protein, 9 aa, Homo Sapiens
SNLMRHRII

SEQ ID NO: 379514 - protein, 9 aa, Homo Sapiens
QSGIAYILH

SEQ ID NO: 379515 - protein, 9 aa, Homo Sapiens
SIVCSILQI

SEQ ID NO: 379516 - protein, 9 aa, Homo Sapiens
SCNSMVSCY

SEQ ID NO: 379517 - protein, 9 aa, Homo Sapiens
IYHYDIRLP

SEQ ID NO: 379518 - protein, 9 aa, Homo Sapiens
DKKATVDEV

SEQ ID NO: 379519 - protein, 9 aa, Homo Sapiens
LKCSSLVTL

SEQ ID NO: 379520 - protein, 9 aa, Homo Sapiens
PVPATKLNM

SEQ ID NO: 379521 - protein, 9 aa, Homo Sapiens
YEEQNLVWK

SEQ ID NO: 379522 - protein, 9 aa, Homo Sapiens
LCITGGITS

SEQ ID NO: 379523 - protein, 9 aa, Homo Sapiens
TQTLPLMWT

SEQ ID NO: 379524 - protein, 9 aa, Homo Sapiens
KVCGKIGLI

SEQ ID NO: 379525 - protein, 9 aa, Homo Sapiens
PIYLRKHMR

SEQ ID NO: 379526 - protein, 9 aa, Homo Sapiens
APLQKVEVP

SEQ ID NO: 379527 - protein, 9 aa, Homo Sapiens
WALAVASKK

SEQ ID NO: 379528 - protein, 9 aa, Homo Sapiens
DPQNLLLSG

SEQ ID NO: 379529 - protein, 9 aa, Homo Sapiens
HILRNKIGS

SEQ ID NO: 379530 - protein, 9 aa, Homo Sapiens
AQGIANEDT

SEQ ID NO: 379531 - protein, 9 aa, Homo Sapiens
KDQHHIALD

SEQ ID NO: 379532 - protein, 9 aa, Homo Sapiens
TSAASSSLV

SEQ ID NO: 379533 - protein, 9 aa, Homo Sapiens
KRKQNEDDE

SEQ ID NO: 379534 - protein, 9 aa, Homo Sapiens
RRQRNSAGG

SEQ ID NO: 379535 - protein, 9 aa, Homo Sapiens
DVGLKQFFP

SEQ ID NO: 379536 - protein, 9 aa, Homo Sapiens
NIINHFFCK

SEQ ID NO: 379537 - protein, 9 aa, Homo Sapiens
LYCVTVPKD

SEQ ID NO: 379538 - protein, 9 aa, Homo Sapiens
AFCTLHVTI

SEQ ID NO: 379539 - protein, 9 aa, Homo Sapiens
LCLLMAEEC

SEQ ID NO: 379540 - protein, 9 aa, Homo Sapiens
SESTPICTS

SEQ ID NO: 379541 - protein, 9 aa, Homo Sapiens
LRMEEMGNH

SEQ ID NO: 379542 - protein, 9 aa, Homo Sapiens
EKDVGLKQF

SEQ ID NO: 379543 - protein, 9 aa, Homo Sapiens
WIFYVLLCF

SEQ ID NO: 379544 - protein, 9 aa, Homo Sapiens
IPNQLDPGT

SEQ ID NO: 379545 - protein, 9 aa, Homo Sapiens
AMLAATYIA

SEQ ID NO: 379546 - protein, 9 aa, Homo Sapiens
EDIKALKVQ

SEQ ID NO: 379547 - protein, 9 aa, Homo Sapiens
CSDCGQSFS

SEQ ID NO: 379548 - protein, 9 aa, Homo Sapiens
KQFNLCLEE

SEQ ID NO: 379549 - protein, 9 aa, Homo Sapiens
SSERSSASG

SEQ ID NO: 379550 - protein, 9 aa, Homo Sapiens
YVAICNPLK

SEQ ID NO: 379551 - protein, 9 aa, Homo Sapiens
LGGSPGLPG

SEQ ID NO: 379552 - protein, 9 aa, Homo Sapiens
SEHFCIDGP

SEQ ID NO: 379553 - protein, 9 aa, Homo Sapiens
GALVFVNVT

SEQ ID NO: 379554 - protein, 9 aa, Homo Sapiens
CLSKIMSYE

SEQ ID NO: 379555 - protein, 9 aa, Homo Sapiens
MYTDGQWNG

SEQ ID NO: 379556 - protein, 9 aa, Homo Sapiens
YRCTARSQN

SEQ ID NO: 379557 - protein, 9 aa, Homo Sapiens
HIRSQINYL

SEQ ID NO: 379558 - protein, 9 aa, Homo Sapiens
NGTLMIPIQ

SEQ ID NO: 379559 - protein, 9 aa, Homo Sapiens
AWAVMNFKA

SEQ ID NO: 379560 - protein, 9 aa, Homo Sapiens
AYTSLGQAY

SEQ ID NO: 379561 - protein, 9 aa, Homo Sapiens
DIMADISPI

SEQ ID NO: 379562 - protein, 9 aa, Homo Sapiens
LQLPTSWLN

SEQ ID NO: 379563 - protein, 9 aa, Homo Sapiens
WRLMGKPRR

SEQ ID NO: 379564 - protein, 9 aa, Homo Sapiens
EKIMKLSLP

SEQ ID NO: 379565 - protein, 9 aa, Homo Sapiens
RWKIKIIQF

SEQ ID NO: 379566 - protein, 9 aa, Homo Sapiens
SLKRKHKKY

SEQ ID NO: 379567 - protein, 9 aa, Homo Sapiens
FEMTGECRL

SEQ ID NO: 379568 - protein, 9 aa, Homo Sapiens
TLQCTKSVG

SEQ ID NO: 379569 - protein, 9 aa, Homo Sapiens
LQTHQIIHT

SEQ ID NO: 379570 - protein, 9 aa, Homo Sapiens
DTFSYNFYI

SEQ ID NO: 379571 - protein, 9 aa, Homo Sapiens
VVLVQLCQI

SEQ ID NO: 379572 - protein, 9 aa, Homo Sapiens
MEYKQELNK

SEQ ID NO: 379573 - protein, 9 aa, Homo Sapiens
NTPVSKRSF

SEQ ID NO: 379574 - protein, 9 aa, Homo Sapiens
EDIFAHKEM

SEQ ID NO: 379575 - protein, 9 aa, Homo Sapiens
MSWCPQYRS

SEQ ID NO: 379576 - protein, 9 aa, Homo Sapiens
ISQRHQTKI

SEQ ID NO: 379577 - protein, 9 aa, Homo Sapiens
ETDESTQSI

SEQ ID NO: 379578 - protein, 9 aa, Homo Sapiens
AELERQHIL

SEQ ID NO: 379579 - protein, 9 aa, Homo Sapiens
KHDLRYIEM

SEQ ID NO: 379580 - protein, 9 aa, Homo Sapiens
AASVQRSMQ

SEQ ID NO: 379581 - protein, 9 aa, Homo Sapiens
NGTCIIWDL

SEQ ID NO: 379582 - protein, 9 aa, Homo Sapiens
SPGEDVLIN

SEQ ID NO: 379583 - protein, 9 aa, Homo Sapiens
HYSREELNL

SEQ ID NO: 379584 - protein, 9 aa, Homo Sapiens
RWDSEAFQL

SEQ ID NO: 379585 - protein, 9 aa, Homo Sapiens
KKHDQQLAD

SEQ ID NO: 379586 - protein, 9 aa, Homo Sapiens
IDAYTSLGQ

SEQ ID NO: 379587 - protein, 9 aa, Homo Sapiens
QAFNIGALR

SEQ ID NO: 379588 - protein, 9 aa, Homo Sapiens
IIFSLEIRA

SEQ ID NO: 379589 - protein, 9 aa, Homo Sapiens
VNTNNQAVK

SEQ ID NO: 379590 - protein, 9 aa, Homo Sapiens
DVIDGCPVK

SEQ ID NO: 379591 - protein, 9 aa, Homo Sapiens
ICTSDVDYR

SEQ ID NO: 379592 - protein, 9 aa, Homo Sapiens
RLLNLGVLV

SEQ ID NO: 379593 - protein, 9 aa, Homo Sapiens
DGCPVKKGT

SEQ ID NO: 379594 - protein, 9 aa, Homo Sapiens
AGACRTLPS

SEQ ID NO: 379595 - protein, 9 aa, Homo Sapiens
ASCTAGSAD

SEQ ID NO: 379596 - protein, 9 aa, Homo Sapiens
QHKIIHIRE

SEQ ID NO: 379597 - protein, 9 aa, Homo Sapiens
SATLRKRLR

SEQ ID NO: 379598 - protein, 9 aa, Homo Sapiens
TFSKKFLQV

SEQ ID NO: 379599 - protein, 9 aa, Homo Sapiens
AEVVLQESA

SEQ ID NO: 379600 - protein, 9 aa, Homo Sapiens
QIQTLFQRS

SEQ ID NO: 379601 - protein, 9 aa, Homo Sapiens
QIKHQNLAA

SEQ ID NO: 379602 - protein, 9 aa, Homo Sapiens
FQGFIQGKY

SEQ ID NO: 379603 - protein, 9 aa, Homo Sapiens
KKYHTFWKE

SEQ ID NO: 379604 - protein, 9 aa, Homo Sapiens
GGYVKDAKM

SEQ ID NO: 379605 - protein, 9 aa, Homo Sapiens
SLADQAVNE

SEQ ID NO: 379606 - protein, 9 aa, Homo Sapiens
CELCLLMAE

SEQ ID NO: 379607 - protein, 9 aa, Homo Sapiens
LQINGINVK

SEQ ID NO: 379608 - protein, 9 aa, Homo Sapiens
IIIGCHAYG

SEQ ID NO: 379609 - protein, 9 aa, Homo Sapiens
VIQSGIAYI

SEQ ID NO: 379610 - protein, 9 aa, Homo Sapiens
EGINLVMAV

SEQ ID NO: 379611 - protein, 9 aa, Homo Sapiens
NKKEPEPNF

SEQ ID NO: 379612 - protein, 9 aa, Homo Sapiens
KAYEYIRVS

SEQ ID NO: 379613 - protein, 9 aa, Homo Sapiens
CKQEDKLGF

SEQ ID NO: 379614 - protein, 9 aa, Homo Sapiens
RVLQENKQK

SEQ ID NO: 379615 - protein, 9 aa, Homo Sapiens
VPNMLLSMQ

SEQ ID NO: 379616 - protein, 9 aa, Homo Sapiens
DLEFLKRAE

SEQ ID NO: 379617 - protein, 9 aa, Homo Sapiens
IPDRMKAAR

SEQ ID NO: 379618 - protein, 9 aa, Homo Sapiens
GPLFTVDTR

SEQ ID NO: 379619 - protein, 9 aa, Homo Sapiens
KNFPNNMSL

SEQ ID NO: 379620 - protein, 9 aa, Homo Sapiens
HATRIPLGL

SEQ ID NO: 379621 - protein, 9 aa, Homo Sapiens
KLELTFRKL

SEQ ID NO: 379622 - protein, 9 aa, Homo Sapiens
LGEPPKEIW

SEQ ID NO: 379623 - protein, 9 aa, Homo Sapiens
FKNDYWKLS

SEQ ID NO: 379624 - protein, 9 aa, Homo Sapiens
TTAEVVYYW

SEQ ID NO: 379625 - protein, 9 aa, Homo Sapiens
EEQGQDNPP

SEQ ID NO: 379626 - protein, 9 aa, Homo Sapiens
GYAPAIQGA

SEQ ID NO: 379627 - protein, 9 aa, Homo Sapiens
SLSLVLEEP

SEQ ID NO: 379628 - protein, 9 aa, Homo Sapiens
EGAGTSFLI

SEQ ID NO: 379629 - protein, 9 aa, Homo Sapiens
FKKDGELSV

SEQ ID NO: 379630 - protein, 9 aa, Homo Sapiens
QTDSATTQI

SEQ ID NO: 379631 - protein, 9 aa, Homo Sapiens
FLHINRFLE

SEQ ID NO: 379632 - protein, 9 aa, Homo Sapiens
KWYIFNDAE

SEQ ID NO: 379633 - protein, 9 aa, Homo Sapiens
RECVFLHIN

SEQ ID NO: 379634 - protein, 9 aa, Homo Sapiens
HIQNHTGEK

SEQ ID NO: 379635 - protein, 9 aa, Homo Sapiens
LKSCRSALM

SEQ ID NO: 379636 - protein, 9 aa, Homo Sapiens
NQEFGVEIG

SEQ ID NO: 379637 - protein, 9 aa, Homo Sapiens
NRWFDTSFN

SEQ ID NO: 379638 - protein, 9 aa, Homo Sapiens
LFMFFILLN

SEQ ID NO: 379639 - protein, 9 aa, Homo Sapiens
TERPSNNSH

SEQ ID NO: 379640 - protein, 9 aa, Homo Sapiens
HQQIHLGDR

SEQ ID NO: 379641 - protein, 9 aa, Homo Sapiens
SNETFAGLD

SEQ ID NO: 379642 - protein, 9 aa, Homo Sapiens
HLLWNPDIA

SEQ ID NO: 379643 - protein, 9 aa, Homo Sapiens
PTAQPLVQA

SEQ ID NO: 379644 - protein, 9 aa, Homo Sapiens
YPTEDINDR

SEQ ID NO: 379645 - protein, 9 aa, Homo Sapiens
CIIEIKPFS

SEQ ID NO: 379646 - protein, 9 aa, Homo Sapiens
TNNQAVKER

SEQ ID NO: 379647 - protein, 9 aa, Homo Sapiens
RIYFREATM

SEQ ID NO: 379648 - protein, 9 aa, Homo Sapiens
AVSEFIKYD

SEQ ID NO: 379649 - protein, 9 aa, Homo Sapiens
GTQICPAFF

SEQ ID NO: 379650 - protein, 9 aa, Homo Sapiens
CCPCLCPDD

SEQ ID NO: 379651 - protein, 9 aa, Homo Sapiens
MANISNYHW

SEQ ID NO: 379652 - protein, 9 aa, Homo Sapiens
GATRGVCGP

SEQ ID NO: 379653 - protein, 9 aa, Homo Sapiens
TTSAACICL

SEQ ID NO: 379654 - protein, 9 aa, Homo Sapiens
IKINEAREC

SEQ ID NO: 379655 - protein, 9 aa, Homo Sapiens
DLLMLLQQS

SEQ ID NO: 379656 - protein, 9 aa, Homo Sapiens
IWTLLKQVH

SEQ ID NO: 379657 - protein, 9 aa, Homo Sapiens
QLISVYENK

SEQ ID NO: 379658 - protein, 9 aa, Homo Sapiens
KPVIGENCR

SEQ ID NO: 379659 - protein, 9 aa, Homo Sapiens
VYLNKNTYL

SEQ ID NO: 379660 - protein, 9 aa, Homo Sapiens
IIHAGEKPF

SEQ ID NO: 379661 - protein, 9 aa, Homo Sapiens
DIDLKDVDN

SEQ ID NO: 379662 - protein, 9 aa, Homo Sapiens
KPIIIGCHA

SEQ ID NO: 379663 - protein, 9 aa, Homo Sapiens
WRALAPWAW

SEQ ID NO: 379664 - protein, 9 aa, Homo Sapiens
LGLNNCQTE

SEQ ID NO: 379665 - protein, 9 aa, Homo Sapiens
IQNAGIVLG

SEQ ID NO: 379666 - protein, 9 aa, Homo Sapiens
CFAVPVSPA

SEQ ID NO: 379667 - protein, 9 aa, Homo Sapiens
FTQNNVTEI

SEQ ID NO: 379668 - protein, 9 aa, Homo Sapiens
ADLLQHINF

SEQ ID NO: 379669 - protein, 9 aa, Homo Sapiens
GYNAFPVGY

SEQ ID NO: 379670 - protein, 9 aa, Homo Sapiens
LATSLRSLH

SEQ ID NO: 379671 - protein, 9 aa, Homo Sapiens
EERVSVTYY

SEQ ID NO: 379672 - protein, 9 aa, Homo Sapiens
WYTVAAVNE

SEQ ID NO: 379673 - protein, 9 aa, Homo Sapiens
YAHISRETF

SEQ ID NO: 379674 - protein, 9 aa, Homo Sapiens
NYLEKAREK

SEQ ID NO: 379675 - protein, 9 aa, Homo Sapiens
TLKPLKTQI

SEQ ID NO: 379676 - protein, 9 aa, Homo Sapiens
LRSTSVDTG

SEQ ID NO: 379677 - protein, 9 aa, Homo Sapiens
TSQSDLGYA

SEQ ID NO: 379678 - protein, 9 aa, Homo Sapiens
LSKTSHLRA

SEQ ID NO: 379679 - protein, 9 aa, Homo Sapiens
AWRNQGAGA

SEQ ID NO: 379680 - protein, 9 aa, Homo Sapiens
QRRRITYSD

SEQ ID NO: 379681 - protein, 9 aa, Homo Sapiens
KGKTGVSFV

SEQ ID NO: 379682 - protein, 9 aa, Homo Sapiens
VEDPQLNLK

SEQ ID NO: 379683 - protein, 9 aa, Homo Sapiens
VGDHQTLVH

SEQ ID NO: 379684 - protein, 9 aa, Homo Sapiens
VTLVDPAAI

SEQ ID NO: 379685 - protein, 9 aa, Homo Sapiens
TIKNVKAKI

SEQ ID NO: 379686 - protein, 9 aa, Homo Sapiens
PRNPTYQEA

SEQ ID NO: 379687 - protein, 9 aa, Homo Sapiens
APTHQQFPF

SEQ ID NO: 379688 - protein, 9 aa, Homo Sapiens
NMNLANNFP

SEQ ID NO: 379689 - protein, 9 aa, Homo Sapiens
DEKDLEFLK

SEQ ID NO: 379690 - protein, 9 aa, Homo Sapiens
DEVKALAFL

SEQ ID NO: 379691 - protein, 9 aa, Homo Sapiens
IMCYKNKWE

SEQ ID NO: 379692 - protein, 9 aa, Homo Sapiens
QQMYTTDQE

SEQ ID NO: 379693 - protein, 9 aa, Homo Sapiens
TSINVYSLS

SEQ ID NO: 379694 - protein, 9 aa, Homo Sapiens
NYRFLRKIT

SEQ ID NO: 379695 - protein, 9 aa, Homo Sapiens
TNYRFLRKI

SEQ ID NO: 379696 - protein, 9 aa, Homo Sapiens
EESGDIVSP

SEQ ID NO: 379697 - protein, 9 aa, Homo Sapiens
DLFARTLVP

SEQ ID NO: 379698 - protein, 9 aa, Homo Sapiens
SLPLSLIFL

SEQ ID NO: 379699 - protein, 9 aa, Homo Sapiens
RGAVPPPPR

SEQ ID NO: 379700 - protein, 9 aa, Homo Sapiens
PKTNVKKLN

SEQ ID NO: 379701 - protein, 9 aa, Homo Sapiens
AAVRHFQAQ

SEQ ID NO: 379702 - protein, 9 aa, Homo Sapiens
TLINIIQGR

SEQ ID NO: 379703 - protein, 9 aa, Homo Sapiens
LKRKHKKYS

SEQ ID NO: 379704 - protein, 9 aa, Homo Sapiens
STQLLMSVE

SEQ ID NO: 379705 - protein, 9 aa, Homo Sapiens
ELFTFFVRA

SEQ ID NO: 379706 - protein, 9 aa, Homo Sapiens
PESVGKAKG

SEQ ID NO: 379707 - protein, 9 aa, Homo Sapiens
RQAEVEILE

SEQ ID NO: 379708 - protein, 9 aa, Homo Sapiens
TFPRKLWQP

SEQ ID NO: 379709 - protein, 9 aa, Homo Sapiens
VMGLFMIST

SEQ ID NO: 379710 - protein, 9 aa, Homo Sapiens
IKASKGERE

SEQ ID NO: 379711 - protein, 9 aa, Homo Sapiens
EKKEEKENK

SEQ ID NO: 379712 - protein, 9 aa, Homo Sapiens
LKGQGEKIA

SEQ ID NO: 379713 - protein, 9 aa, Homo Sapiens
GALHLCSPF

SEQ ID NO: 379714 - protein, 9 aa, Homo Sapiens
CLSRAEARW

SEQ ID NO: 379715 - protein, 9 aa, Homo Sapiens
AINLYGEDR

SEQ ID NO: 379716 - protein, 9 aa, Homo Sapiens
EKQMRDFLC

SEQ ID NO: 379717 - protein, 9 aa, Homo Sapiens
KRRKKKSLK

SEQ ID NO: 379718 - protein, 9 aa, Homo Sapiens
KTFWKKYHT

SEQ ID NO: 379719 - protein, 9 aa, Homo Sapiens
RHQILHTGV

SEQ ID NO: 379720 - protein, 9 aa, Homo Sapiens
GVFMYFEGY

SEQ ID NO: 379721 - protein, 9 aa, Homo Sapiens
EEKLCKREQ

SEQ ID NO: 379722 - protein, 9 aa, Homo Sapiens
QSLISFFQK

SEQ ID NO: 379723 - protein, 9 aa, Homo Sapiens
NLARHQIIH

SEQ ID NO: 379724 - protein, 9 aa, Homo Sapiens
ERLIFLNSI

SEQ ID NO: 379725 - protein, 9 aa, Homo Sapiens
NIGKAFKEE

SEQ ID NO: 379726 - protein, 9 aa, Homo Sapiens
MLQELPDKI

SEQ ID NO: 379727 - protein, 9 aa, Homo Sapiens
CKHGKDWQN

SEQ ID NO: 379728 - protein, 9 aa, Homo Sapiens
DTYVMGLFM

SEQ ID NO: 379729 - protein, 9 aa, Homo Sapiens
CSRSCNSMV

SEQ ID NO: 379730 - protein, 9 aa, Homo Sapiens
SRSCNSMVS

SEQ ID NO: 379731 - protein, 9 aa, Homo Sapiens
LLKQVHPGM

SEQ ID NO: 379732 - protein, 9 aa, Homo Sapiens
PDNMNLANN

SEQ ID NO: 379733 - protein, 9 aa, Homo Sapiens
KVRPHIAGI

SEQ ID NO: 379734 - protein, 9 aa, Homo Sapiens
NLQNASSRE

SEQ ID NO: 379735 - protein, 9 aa, Homo Sapiens
SGSIGRHYA

SEQ ID NO: 379736 - protein, 9 aa, Homo Sapiens
SSSERSSAS

SEQ ID NO: 379737 - protein, 9 aa, Homo Sapiens
QRKDSEIKM

SEQ ID NO: 379738 - protein, 9 aa, Homo Sapiens
KIIGKNAAL

SEQ ID NO: 379739 - protein, 9 aa, Homo Sapiens
IIKLNCLNG

SEQ ID NO: 379740 - protein, 9 aa, Homo Sapiens
YISDNSSVS

SEQ ID NO: 379741 - protein, 9 aa, Homo Sapiens
VVDFSKWYM

SEQ ID NO: 379742 - protein, 9 aa, Homo Sapiens
FLLMARFSE

SEQ ID NO: 379743 - protein, 9 aa, Homo Sapiens
CRYLNNSLH

SEQ ID NO: 379744 - protein, 9 aa, Homo Sapiens
LLDYSQRKL

SEQ ID NO: 379745 - protein, 9 aa, Homo Sapiens
IKKHLMLLS

SEQ ID NO: 379746 - protein, 9 aa, Homo Sapiens
FIHINFDVN

SEQ ID NO: 379747 - protein, 9 aa, Homo Sapiens
NNDLNYFFY

SEQ ID NO: 379748 - protein, 9 aa, Homo Sapiens
RPDLIDINT

SEQ ID NO: 379749 - protein, 9 aa, Homo Sapiens
IFIIYSIRG

SEQ ID NO: 379750 - protein, 9 aa, Homo Sapiens
QIKKKKQLG

SEQ ID NO: 379751 - protein, 9 aa, Homo Sapiens
SEAFQLAES

SEQ ID NO: 379752 - protein, 9 aa, Homo Sapiens
LRNHQRTHT

SEQ ID NO: 379753 - protein, 9 aa, Homo Sapiens
HIGHLYILV

SEQ ID NO: 379754 - protein, 9 aa, Homo Sapiens
SNYVELAVL

SEQ ID NO: 379755 - protein, 9 aa, Homo Sapiens
GNWGSWTKV

SEQ ID NO: 379756 - protein, 9 aa, Homo Sapiens
QAVNEWGRS

SEQ ID NO: 379757 - protein, 9 aa, Homo Sapiens
SRLLDSLWQ

SEQ ID NO: 379758 - protein, 9 aa, Homo Sapiens
LKRSQQNKK

SEQ ID NO: 379759 - protein, 9 aa, Homo Sapiens
YLNLGLLDF

SEQ ID NO: 379760 - protein, 9 aa, Homo Sapiens
DVAGEIDAV

SEQ ID NO: 379761 - protein, 9 aa, Homo Sapiens
DNNKWSHMF

SEQ ID NO: 379762 - protein, 9 aa, Homo Sapiens
IMPIVVCLH

SEQ ID NO: 379763 - protein, 9 aa, Homo Sapiens
EVNLPKVTQ

SEQ ID NO: 379764 - protein, 9 aa, Homo Sapiens
CKQQTNNQT

SEQ ID NO: 379765 - protein, 9 aa, Homo Sapiens
GTIPNQLDP

SEQ ID NO: 379766 - protein, 9 aa, Homo Sapiens
EFRSAPFIK

SEQ ID NO: 379767 - protein, 9 aa, Homo Sapiens
SHIIVGLED

SEQ ID NO: 379768 - protein, 9 aa, Homo Sapiens
ACRDDYFQE

SEQ ID NO: 379769 - protein, 9 aa, Homo Sapiens
KTVNKLPAG

SEQ ID NO: 379770 - protein, 9 aa, Homo Sapiens
AAAVGSQSP

SEQ ID NO: 379771 - protein, 9 aa, Homo Sapiens
IEASNINNV

SEQ ID NO: 379772 - protein, 9 aa, Homo Sapiens
PSSNGIISS

SEQ ID NO: 379773 - protein, 9 aa, Homo Sapiens
PGVTTIDMM

SEQ ID NO: 379774 - protein, 9 aa, Homo Sapiens
MWALSFKTG

SEQ ID NO: 379775 - protein, 9 aa, Homo Sapiens
HAAFEGPYA

SEQ ID NO: 379776 - protein, 9 aa, Homo Sapiens
NVEAAMYLQ

SEQ ID NO: 379777 - protein, 9 aa, Homo Sapiens
PGHSVVLCL

SEQ ID NO: 379778 - protein, 9 aa, Homo Sapiens
LLFMNVYIE

SEQ ID NO: 379779 - protein, 9 aa, Homo Sapiens
HEFCKKEGY

SEQ ID NO: 379780 - protein, 9 aa, Homo Sapiens
DKEKPESVG

SEQ ID NO: 379781 - protein, 9 aa, Homo Sapiens
GLAYLYSHT

SEQ ID NO: 379782 - protein, 9 aa, Homo Sapiens
FLPLLAFAY

SEQ ID NO: 379783 - protein, 9 aa, Homo Sapiens
QIIISERSD

SEQ ID NO: 379784 - protein, 9 aa, Homo Sapiens
EVRKTEVLL

SEQ ID NO: 379785 - protein, 9 aa, Homo Sapiens
LSISSSTSN

SEQ ID NO: 379786 - protein, 9 aa, Homo Sapiens
SYNNHAWYF

SEQ ID NO: 379787 - protein, 9 aa, Homo Sapiens
ALACRDDYF

SEQ ID NO: 379788 - protein, 9 aa, Homo Sapiens
LFAVNLFVG

SEQ ID NO: 379789 - protein, 9 aa, Homo Sapiens
LTQGISNVH

SEQ ID NO: 379790 - protein, 9 aa, Homo Sapiens
SISALRKET

SEQ ID NO: 379791 - protein, 9 aa, Homo Sapiens
DIITNETAG

SEQ ID NO: 379792 - protein, 9 aa, Homo Sapiens
SNLSISPVS

SEQ ID NO: 379793 - protein, 9 aa, Homo Sapiens
GGSPAVAAA

SEQ ID NO: 379794 - protein, 9 aa, Homo Sapiens
VELETIILS

SEQ ID NO: 379795 - protein, 9 aa, Homo Sapiens
SHLILYAID

SEQ ID NO: 379796 - protein, 9 aa, Homo Sapiens
SKIMSYELL

SEQ ID NO: 379797 - protein, 9 aa, Homo Sapiens
SSCGTNLVL

SEQ ID NO: 379798 - protein, 9 aa, Homo Sapiens
YLDYFISGR

SEQ ID NO: 379799 - protein, 9 aa, Homo Sapiens
QFFFFFEAE

SEQ ID NO: 379800 - protein, 9 aa, Homo Sapiens
PSTIDVVWG

SEQ ID NO: 379801 - protein, 9 aa, Homo Sapiens
CKSFKDKFM

SEQ ID NO: 379802 - protein, 9 aa, Homo Sapiens
RRSSALIQH

SEQ ID NO: 379803 - protein, 9 aa, Homo Sapiens
QKKPPSSQT

SEQ ID NO: 379804 - protein, 9 aa, Homo Sapiens
SQSWAQDNK

SEQ ID NO: 379805 - protein, 9 aa, Homo Sapiens
PIQMKNAMF

SEQ ID NO: 379806 - protein, 9 aa, Homo Sapiens
LTSSDPPQA

SEQ ID NO: 379807 - protein, 9 aa, Homo Sapiens
SSGDRDNNK

SEQ ID NO: 379808 - protein, 9 aa, Homo Sapiens
QFVFCIFAT

SEQ ID NO: 379809 - protein, 9 aa, Homo Sapiens
EVEPSDTIK

SEQ ID NO: 379810 - protein, 9 aa, Homo Sapiens
ECGKTLSKT

SEQ ID NO: 379811 - protein, 9 aa, Homo Sapiens
ELEDRSRRK

SEQ ID NO: 379812 - protein, 9 aa, Homo Sapiens
GFIQGKYYG

SEQ ID NO: 379813 - protein, 9 aa, Homo Sapiens
THPPCTGVV

SEQ ID NO: 379814 - protein, 9 aa, Homo Sapiens
PVIMGCKSA

SEQ ID NO: 379815 - protein, 9 aa, Homo Sapiens
HEQIHTGEK

SEQ ID NO: 379816 - protein, 9 aa, Homo Sapiens
SSSSIIIFW

SEQ ID NO: 379817 - protein, 9 aa, Homo Sapiens
ELLNLLAEN

SEQ ID NO: 379818 - protein, 9 aa, Homo Sapiens
RWIRRNQDK

SEQ ID NO: 379819 - protein, 9 aa, Homo Sapiens
IREKDEELW

SEQ ID NO: 379820 - protein, 9 aa, Homo Sapiens
CKLQWSQSR

SEQ ID NO: 379821 - protein, 9 aa, Homo Sapiens
KATVDEVIY

SEQ ID NO: 379822 - protein, 9 aa, Homo Sapiens
NRSYARNNP

SEQ ID NO: 379823 - protein, 9 aa, Homo Sapiens
LKTLFRCRN

SEQ ID NO: 379824 - protein, 9 aa, Homo Sapiens
GSAMHSEST

SEQ ID NO: 379825 - protein, 9 aa, Homo Sapiens
CPGGSPAVA

SEQ ID NO: 379826 - protein, 9 aa, Homo Sapiens
ISANVMYKI

SEQ ID NO: 379827 - protein, 9 aa, Homo Sapiens
DMDGVEPVL

SEQ ID NO: 379828 - protein, 9 aa, Homo Sapiens
HSLPRNPTY

SEQ ID NO: 379829 - protein, 9 aa, Homo Sapiens
KIQQRNGRK

SEQ ID NO: 379830 - protein, 9 aa, Homo Sapiens
ALVFVNVTD

SEQ ID NO: 379831 - protein, 9 aa, Homo Sapiens
SPRWGRQAG

SEQ ID NO: 379832 - protein, 9 aa, Homo Sapiens
KQWALAVAS

SEQ ID NO: 379833 - protein, 9 aa, Homo Sapiens
SAVTMEWFE

SEQ ID NO: 379834 - protein, 9 aa, Homo Sapiens
KMLKNHLQN

SEQ ID NO: 379835 - protein, 9 aa, Homo Sapiens
YSAKAYEYI

SEQ ID NO: 379836 - protein, 9 aa, Homo Sapiens
ELRLRDALT

SEQ ID NO: 379837 - protein, 9 aa, Homo Sapiens
RQEEEKIRK

SEQ ID NO: 379838 - protein, 9 aa, Homo Sapiens
LLAYRVCMT

SEQ ID NO: 379839 - protein, 9 aa, Homo Sapiens
EADDLFTSL

SEQ ID NO: 379840 - protein, 9 aa, Homo Sapiens
TKLPLKFHD

SEQ ID NO: 379841 - protein, 9 aa, Homo Sapiens
TYAWMAPKV

SEQ ID NO: 379842 - protein, 9 aa, Homo Sapiens
CPALYQNEE

SEQ ID NO: 379843 - protein, 9 aa, Homo Sapiens
IWRLMGKPR

SEQ ID NO: 379844 - protein, 9 aa, Homo Sapiens
AWAKTYATD

SEQ ID NO: 379845 - protein, 9 aa, Homo Sapiens
IDVNNISIG

SEQ ID NO: 379846 - protein, 9 aa, Homo Sapiens
GKYGTQICP

SEQ ID NO: 379847 - protein, 9 aa, Homo Sapiens
AALVSFVGI

SEQ ID NO: 379848 - protein, 9 aa, Homo Sapiens
FSCSSCGTN

SEQ ID NO: 379849 - protein, 9 aa, Homo Sapiens
FAPGIWLGL

SEQ ID NO: 379850 - protein, 9 aa, Homo Sapiens
FLCYFFFLF

SEQ ID NO: 379851 - protein, 9 aa, Homo Sapiens
QRTTKSKKT

SEQ ID NO: 379852 - protein, 9 aa, Homo Sapiens
AMERVSVIF

SEQ ID NO: 379853 - protein, 9 aa, Homo Sapiens
RNNDLNYFF

SEQ ID NO: 379854 - protein, 9 aa, Homo Sapiens
GSGFGRSSS

SEQ ID NO: 379855 - protein, 9 aa, Homo Sapiens
ELSQIKCVE

SEQ ID NO: 379856 - protein, 9 aa, Homo Sapiens
GISVKGLWD

SEQ ID NO: 379857 - protein, 9 aa, Homo Sapiens
EVCKFSLYL

SEQ ID NO: 379858 - protein, 9 aa, Homo Sapiens
FKPYLGRIE

SEQ ID NO: 379859 - protein, 9 aa, Homo Sapiens
SQIYLEGKI

SEQ ID NO: 379860 - protein, 9 aa, Homo Sapiens
SFKDKFMKC

SEQ ID NO: 379861 - protein, 9 aa, Homo Sapiens
HLKSEVIGD

SEQ ID NO: 379862 - protein, 9 aa, Homo Sapiens
LREERAGAP

SEQ ID NO: 379863 - protein, 9 aa, Homo Sapiens
MVNMGKFII

SEQ ID NO: 379864 - protein, 9 aa, Homo Sapiens
EDGFGIASR

SEQ ID NO: 379865 - protein, 9 aa, Homo Sapiens
DTQIFFSFA

SEQ ID NO: 379866 - protein, 9 aa, Homo Sapiens
KIFIIYSIR

SEQ ID NO: 379867 - protein, 9 aa, Homo Sapiens
NQRVEAPAD

SEQ ID NO: 379868 - protein, 9 aa, Homo Sapiens
VNIFLCQKW

SEQ ID NO: 379869 - protein, 9 aa, Homo Sapiens
ILNYLYELL

SEQ ID NO: 379870 - protein, 9 aa, Homo Sapiens
IFLGSYHMP

SEQ ID NO: 379871 - protein, 9 aa, Homo Sapiens
YRSESYTWL

SEQ ID NO: 379872 - protein, 9 aa, Homo Sapiens
KDGELSVPS

SEQ ID NO: 379873 - protein, 9 aa, Homo Sapiens
LIKHPEDVD

SEQ ID NO: 379874 - protein, 9 aa, Homo Sapiens
EAAMYLQLP

SEQ ID NO: 379875 - protein, 9 aa, Homo Sapiens
TKLHKVFCE

SEQ ID NO: 379876 - protein, 9 aa, Homo Sapiens
HQIIHTEER

SEQ ID NO: 379877 - protein, 9 aa, Homo Sapiens
EDGKVPQHA

SEQ ID NO: 379878 - protein, 9 aa, Homo Sapiens
RVETSEHFC

SEQ ID NO: 379879 - protein, 9 aa, Homo Sapiens
KVVPGGKCP

SEQ ID NO: 379880 - protein, 9 aa, Homo Sapiens
LFAELDKVM

SEQ ID NO: 379881 - protein, 9 aa, Homo Sapiens
PNPDLVHDD

SEQ ID NO: 379882 - protein, 9 aa, Homo Sapiens
SLKKKQKCE

SEQ ID NO: 379883 - protein, 9 aa, Homo Sapiens
VKYHRCVKL

SEQ ID NO: 379884 - protein, 9 aa, Homo Sapiens
ECVFLHINR

SEQ ID NO: 379885 - protein, 9 aa, Homo Sapiens
QICIPRSLS

SEQ ID NO: 379886 - protein, 9 aa, Homo Sapiens
RHGSGFGRS

SEQ ID NO: 379887 - protein, 9 aa, Homo Sapiens
AREKKALFL

SEQ ID NO: 379888 - protein, 9 aa, Homo Sapiens
RNDCVDPCG

SEQ ID NO: 379889 - protein, 9 aa, Homo Sapiens
GECGKAFRR

SEQ ID NO: 379890 - protein, 9 aa, Homo Sapiens
EESYLCGIS

SEQ ID NO: 379891 - protein, 9 aa, Homo Sapiens
SAITLSYLD

SEQ ID NO: 379892 - protein, 9 aa, Homo Sapiens
DLCETDKLR

SEQ ID NO: 379893 - protein, 9 aa, Homo Sapiens
TKLFHSEYP

SEQ ID NO: 379894 - protein, 9 aa, Homo Sapiens
FWRKMFTSQ

SEQ ID NO: 379895 - protein, 9 aa, Homo Sapiens
ELAQTCIGT

SEQ ID NO: 379896 - protein, 9 aa, Homo Sapiens
RPPEPQAMD

SEQ ID NO: 379897 - protein, 9 aa, Homo Sapiens
VVHGDSIVT

SEQ ID NO: 379898 - protein, 9 aa, Homo Sapiens
IPAEQFENM

SEQ ID NO: 379899 - protein, 9 aa, Homo Sapiens
ANTVEMLVS

SEQ ID NO: 379900 - protein, 9 aa, Homo Sapiens
PYLSAHATA

SEQ ID NO: 379901 - protein, 9 aa, Homo Sapiens
EIFKEMNNV

SEQ ID NO: 379902 - protein, 9 aa, Homo Sapiens
YLTYVTERI

SEQ ID NO: 379903 - protein, 9 aa, Homo Sapiens
REERAGAPL

SEQ ID NO: 379904 - protein, 9 aa, Homo Sapiens
VLSHLEDLF

SEQ ID NO: 379905 - protein, 9 aa, Homo Sapiens
RMLTSASHP

SEQ ID NO: 379906 - protein, 9 aa, Homo Sapiens
IIIFWTPPS

SEQ ID NO: 379907 - protein, 9 aa, Homo Sapiens
EEKVTEMNN

SEQ ID NO: 379908 - protein, 9 aa, Homo Sapiens
NQSMLENFL

SEQ ID NO: 379909 - protein, 9 aa, Homo Sapiens
QIPAVKEQI

SEQ ID NO: 379910 - protein, 9 aa, Homo Sapiens
KALKFYQKL

SEQ ID NO: 379911 - protein, 9 aa, Homo Sapiens
SFLIDELTG

SEQ ID NO: 379912 - protein, 9 aa, Homo Sapiens
DISKKARRI

SEQ ID NO: 379913 - protein, 9 aa, Homo Sapiens
YHHNMTWKT

SEQ ID NO: 379914 - protein, 9 aa, Homo Sapiens
PVLSKHQNV

SEQ ID NO: 379915 - protein, 9 aa, Homo Sapiens
RVNIFLCQK

SEQ ID NO: 379916 - protein, 9 aa, Homo Sapiens
GHTTQTSIA

SEQ ID NO: 379917 - protein, 9 aa, Homo Sapiens
VETSEHFCI

SEQ ID NO: 379918 - protein, 9 aa, Homo Sapiens
KVKVGDSLM

SEQ ID NO: 379919 - protein, 9 aa, Homo Sapiens
VCSDCGQSF

SEQ ID NO: 379920 - protein, 9 aa, Homo Sapiens
ACAVVFDSK

SEQ ID NO: 379921 - protein, 9 aa, Homo Sapiens
PVWYGLRLN

SEQ ID NO: 379922 - protein, 9 aa, Homo Sapiens
FEDAKLVCE

SEQ ID NO: 379923 - protein, 9 aa, Homo Sapiens
PCQLCGKRF

SEQ ID NO: 379924 - protein, 9 aa, Homo Sapiens
LAEVVLQES

SEQ ID NO: 379925 - protein, 9 aa, Homo Sapiens
QPSTTGIWK

SEQ ID NO: 379926 - protein, 9 aa, Homo Sapiens
LLMAEECTT

SEQ ID NO: 379927 - protein, 9 aa, Homo Sapiens
NGASITGTR

SEQ ID NO: 379928 - protein, 9 aa, Homo Sapiens
CWPLRLAWR

SEQ ID NO: 379929 - protein, 9 aa, Homo Sapiens
CTSAASSSL

SEQ ID NO: 379930 - protein, 9 aa, Homo Sapiens
HSERITVKK

SEQ ID NO: 379931 - protein, 9 aa, Homo Sapiens
WIKDQLYLF

SEQ ID NO: 379932 - protein, 9 aa, Homo Sapiens
RGPAQKKPP

SEQ ID NO: 379933 - protein, 9 aa, Homo Sapiens
YVHFTIVTT

SEQ ID NO: 379934 - protein, 9 aa, Homo Sapiens
HLSGKEADK

SEQ ID NO: 379935 - protein, 9 aa, Homo Sapiens
LRSVEWERL

SEQ ID NO: 379936 - protein, 9 aa, Homo Sapiens
VSSLPEINQ

SEQ ID NO: 379937 - protein, 9 aa, Homo Sapiens
KNNYPDPVS

SEQ ID NO: 379938 - protein, 9 aa, Homo Sapiens
GAQCGLGLG

SEQ ID NO: 379939 - protein, 9 aa, Homo Sapiens
GYRGHDHEY

SEQ ID NO: 379940 - protein, 9 aa, Homo Sapiens
QGEAERGPH

SEQ ID NO: 379941 - protein, 9 aa, Homo Sapiens
YLVREAAYK

SEQ ID NO: 379942 - protein, 9 aa, Homo Sapiens
NVEFLSLIN

SEQ ID NO: 379943 - protein, 9 aa, Homo Sapiens
LTILFIFQM

SEQ ID NO: 379944 - protein, 9 aa, Homo Sapiens
RGPGQFFFF

SEQ ID NO: 379945 - protein, 9 aa, Homo Sapiens
TKLGKVYIN

SEQ ID NO: 379946 - protein, 9 aa, Homo Sapiens
ADIRGISSN

SEQ ID NO: 379947 - protein, 9 aa, Homo Sapiens
ASRRREQLI

SEQ ID NO: 379948 - protein, 9 aa, Homo Sapiens
PVIGENCRL

SEQ ID NO: 379949 - protein, 9 aa, Homo Sapiens
KCLEEERQI

SEQ ID NO: 379950 - protein, 9 aa, Homo Sapiens
IAKAFKIIK

SEQ ID NO: 379951 - protein, 9 aa, Homo Sapiens
HDWRKFKLE

SEQ ID NO: 379952 - protein, 9 aa, Homo Sapiens
DLLNTSKVI

SEQ ID NO: 379953 - protein, 9 aa, Homo Sapiens
SVARSWKTS

SEQ ID NO: 379954 - protein, 9 aa, Homo Sapiens
FCMEKLLDP

SEQ ID NO: 379955 - protein, 9 aa, Homo Sapiens
IYVAQEKLI

SEQ ID NO: 379956 - protein, 9 aa, Homo Sapiens
SGPSEGKKS

SEQ ID NO: 379957 - protein, 9 aa, Homo Sapiens
ESPDYLVRE

SEQ ID NO: 379958 - protein, 9 aa, Homo Sapiens
GLAPFPDIM

SEQ ID NO: 379959 - protein, 9 aa, Homo Sapiens
FLRNKLIGK

SEQ ID NO: 379960 - protein, 9 aa, Homo Sapiens
IELSQIKCV

SEQ ID NO: 379961 - protein, 9 aa, Homo Sapiens
GEVRKTEVL

SEQ ID NO: 379962 - protein, 9 aa, Homo Sapiens
GVYIIFSLE

SEQ ID NO: 379963 - protein, 9 aa, Homo Sapiens
DYVVKAVSW

SEQ ID NO: 379964 - protein, 9 aa, Homo Sapiens
GLPVIMGCK

SEQ ID NO: 379965 - protein, 9 aa, Homo Sapiens
ALKFYQKLL

SEQ ID NO: 379966 - protein, 9 aa, Homo Sapiens
GEGPFSNYV

SEQ ID NO: 379967 - protein, 9 aa, Homo Sapiens
RYILDSISA

SEQ ID NO: 379968 - protein, 9 aa, Homo Sapiens
LLEEKVCAL

SEQ ID NO: 379969 - protein, 9 aa, Homo Sapiens
HELIMHKCE

SEQ ID NO: 379970 - protein, 9 aa, Homo Sapiens
HTCFNHLDL

SEQ ID NO: 379971 - protein, 9 aa, Homo Sapiens
ERGPHFPRA

SEQ ID NO: 379972 - protein, 9 aa, Homo Sapiens
WGGEQYEIY

SEQ ID NO: 379973 - protein, 9 aa, Homo Sapiens
SQHKIIHIR

SEQ ID NO: 379974 - protein, 9 aa, Homo Sapiens
SICKQQTNN

SEQ ID NO: 379975 - protein, 9 aa, Homo Sapiens
KLQWSQSRR

SEQ ID NO: 379976 - protein, 9 aa, Homo Sapiens
PHMTEDNKY

SEQ ID NO: 379977 - protein, 9 aa, Homo Sapiens
SAGWKNSIC

SEQ ID NO: 379978 - protein, 9 aa, Homo Sapiens
VGLSRGAVP

SEQ ID NO: 379979 - protein, 9 aa, Homo Sapiens
DLSAVTMEW

SEQ ID NO: 379980 - protein, 9 aa, Homo Sapiens
LQNSAEVLY

SEQ ID NO: 379981 - protein, 9 aa, Homo Sapiens
QSFIRAPDL

SEQ ID NO: 379982 - protein, 9 aa, Homo Sapiens
IKDVRLLNL

SEQ ID NO: 379983 - protein, 9 aa, Homo Sapiens
LSIPAEQFE

SEQ ID NO: 379984 - protein, 9 aa, Homo Sapiens
RRPYGRQPQ

SEQ ID NO: 379985 - protein, 9 aa, Homo Sapiens
FIQGKYYGQ

SEQ ID NO: 379986 - protein, 9 aa, Homo Sapiens
DYFTEVKVD

SEQ ID NO: 379987 - protein, 9 aa, Homo Sapiens
YCNCDADLN

SEQ ID NO: 379988 - protein, 9 aa, Homo Sapiens
QKRQRHAAA

SEQ ID NO: 379989 - protein, 9 aa, Homo Sapiens
DEETAAILN

SEQ ID NO: 379990 - protein, 9 aa, Homo Sapiens
LPLPQLLAQ

SEQ ID NO: 379991 - protein, 9 aa, Homo Sapiens
PIYFTTFVL

SEQ ID NO: 379992 - protein, 9 aa, Homo Sapiens
LDIWRRALA

SEQ ID NO: 379993 - protein, 9 aa, Homo Sapiens
SDGNMDSCF

SEQ ID NO: 379994 - protein, 9 aa, Homo Sapiens
DSLADQAVN

SEQ ID NO: 379995 - protein, 9 aa, Homo Sapiens
MHIRYLYKL

SEQ ID NO: 379996 - protein, 9 aa, Homo Sapiens
KTVIRLPKG

SEQ ID NO: 379997 - protein, 9 aa, Homo Sapiens
LQNLDKELD

SEQ ID NO: 379998 - protein, 9 aa, Homo Sapiens
EKPCSSNTL

SEQ ID NO: 379999 - protein, 9 aa, Homo Sapiens
YGPFGYINN

SEQ ID NO: 380000 - protein, 9 aa, Homo Sapiens
KDLEDGKVP

SEQ ID NO: 380001 - protein, 9 aa, Homo Sapiens
LDIITNETA

SEQ ID NO: 380002 - protein, 9 aa, Homo Sapiens
RRANKAKRE

SEQ ID NO: 380003 - protein, 9 aa, Homo Sapiens
PEKLEEKIQ

SEQ ID NO: 380004 - protein, 9 aa, Homo Sapiens
VLHSFYVLG

SEQ ID NO: 380005 - protein, 9 aa, Homo Sapiens
QLIHKKIID

SEQ ID NO: 380006 - protein, 9 aa, Homo Sapiens
IPHYLGGGP

SEQ ID NO: 380007 - protein, 9 aa, Homo Sapiens
LDELSDALN

SEQ ID NO: 380008 - protein, 9 aa, Homo Sapiens
GINVKKCRH

SEQ ID NO: 380009 - protein, 9 aa, Homo Sapiens
HKTIQAARS

SEQ ID NO: 380010 - protein, 9 aa, Homo Sapiens
KVQIQTQPG

SEQ ID NO: 380011 - protein, 9 aa, Homo Sapiens
QIQIIFFNL

SEQ ID NO: 380012 - protein, 9 aa, Homo Sapiens
SKEQKELFA

SEQ ID NO: 380013 - protein, 9 aa, Homo Sapiens
KDTAFPPLH

SEQ ID NO: 380014 - protein, 9 aa, Homo Sapiens
VQSPSINMS

SEQ ID NO: 380015 - protein, 9 aa, Homo Sapiens
VIALTLFEY

SEQ ID NO: 380016 - protein, 9 aa, Homo Sapiens
IENSKLFEQ

SEQ ID NO: 380017 - protein, 9 aa, Homo Sapiens
FGKTLIIQD

SEQ ID NO: 380018 - protein, 9 aa, Homo Sapiens
RASDTKNQE

SEQ ID NO: 380019 - protein, 9 aa, Homo Sapiens
LLPESSGDN

SEQ ID NO: 380020 - protein, 9 aa, Homo Sapiens
SSLVASKVF

SEQ ID NO: 380021 - protein, 9 aa, Homo Sapiens
LPSCFNYVM

SEQ ID NO: 380022 - protein, 9 aa, Homo Sapiens
TYVMGLFMI

SEQ ID NO: 380023 - protein, 9 aa, Homo Sapiens
GLSRHQADN

SEQ ID NO: 380024 - protein, 9 aa, Homo Sapiens
SIIWYLYLQ

SEQ ID NO: 380025 - protein, 9 aa, Homo Sapiens
WGPEEQLRA

SEQ ID NO: 380026 - protein, 9 aa, Homo Sapiens
GPNTHPSPH

SEQ ID NO: 380027 - protein, 9 aa, Homo Sapiens
FQNPGPQVA

SEQ ID NO: 380028 - protein, 9 aa, Homo Sapiens
EECVTASTN

SEQ ID NO: 380029 - protein, 9 aa, Homo Sapiens
ESKLFLCGR

SEQ ID NO: 380030 - protein, 9 aa, Homo Sapiens
WYVDDLMSV

SEQ ID NO: 380031 - protein, 9 aa, Homo Sapiens
TPQYPTAQP

SEQ ID NO: 380032 - protein, 9 aa, Homo Sapiens
AIIQLPANG

SEQ ID NO: 380033 - protein, 9 aa, Homo Sapiens
IQFTGSGKC

SEQ ID NO: 380034 - protein, 9 aa, Homo Sapiens
SSVTVPNML

SEQ ID NO: 380035 - protein, 9 aa, Homo Sapiens
YSYLTKEWA

SEQ ID NO: 380036 - protein, 9 aa, Homo Sapiens
CILSELWVL

SEQ ID NO: 380037 - protein, 9 aa, Homo Sapiens
RWIFCPFLC

SEQ ID NO: 380038 - protein, 9 aa, Homo Sapiens
RNAQRKDSE

SEQ ID NO: 380039 - protein, 9 aa, Homo Sapiens
LLDPSQNNL

SEQ ID NO: 380040 - protein, 9 aa, Homo Sapiens
LPFDEDCII

SEQ ID NO: 380041 - protein, 9 aa, Homo Sapiens
TLGHTTQTS

SEQ ID NO: 380042 - protein, 9 aa, Homo Sapiens
TKTVGEGQV

SEQ ID NO: 380043 - protein, 9 aa, Homo Sapiens
LLTKTNQIY

SEQ ID NO: 380044 - protein, 9 aa, Homo Sapiens
SSYFSDDEV

SEQ ID NO: 380045 - protein, 9 aa, Homo Sapiens
NMTRVAYLF

SEQ ID NO: 380046 - protein, 9 aa, Homo Sapiens
RPPNRNDLL

SEQ ID NO: 380047 - protein, 9 aa, Homo Sapiens
AFLVSLMPY

SEQ ID NO: 380048 - protein, 9 aa, Homo Sapiens
ISTSPIRYV

SEQ ID NO: 380049 - protein, 9 aa, Homo Sapiens
KLKLKLPRK

SEQ ID NO: 380050 - protein, 9 aa, Homo Sapiens
QRGPAQKKP

SEQ ID NO: 380051 - protein, 9 aa, Homo Sapiens
ESKAADNKI

SEQ ID NO: 380052 - protein, 9 aa, Homo Sapiens
EDAEIQLFV

SEQ ID NO: 380053 - protein, 9 aa, Homo Sapiens
SQHRATINT

SEQ ID NO: 380054 - protein, 9 aa, Homo Sapiens
ICPEMLHVA

SEQ ID NO: 380055 - protein, 9 aa, Homo Sapiens
ALIKHQITH

SEQ ID NO: 380056 - protein, 9 aa, Homo Sapiens
EGKNIESLR

SEQ ID NO: 380057 - protein, 9 aa, Homo Sapiens
NKIVGQLMD

SEQ ID NO: 380058 - protein, 9 aa, Homo Sapiens
IFNLVFTPN

SEQ ID NO: 380059 - protein, 9 aa, Homo Sapiens
SLGQVYKEE

SEQ ID NO: 380060 - protein, 9 aa, Homo Sapiens
EEPVGPESR

SEQ ID NO: 380061 - protein, 9 aa, Homo Sapiens
PPKLHVLVC

SEQ ID NO: 380062 - protein, 9 aa, Homo Sapiens
PALPLALTS

SEQ ID NO: 380063 - protein, 9 aa, Homo Sapiens
RGPNVNCTG

SEQ ID NO: 380064 - protein, 9 aa, Homo Sapiens
LINIDDKEP

SEQ ID NO: 380065 - protein, 9 aa, Homo Sapiens
AHRINNEKS

SEQ ID NO: 380066 - protein, 9 aa, Homo Sapiens
SLFAVNLFV

SEQ ID NO: 380067 - protein, 9 aa, Homo Sapiens
HEITHTGEK

SEQ ID NO: 380068 - protein, 9 aa, Homo Sapiens
EVKYNGGVK

SEQ ID NO: 380069 - protein, 9 aa, Homo Sapiens
SGYIKQKWQ

SEQ ID NO: 380070 - protein, 9 aa, Homo Sapiens
EKLCKREQK

SEQ ID NO: 380071 - protein, 9 aa, Homo Sapiens
WTGGLLHYM

SEQ ID NO: 380072 - protein, 9 aa, Homo Sapiens
FLEGARWDS

SEQ ID NO: 380073 - protein, 9 aa, Homo Sapiens
SKHQNVFNQ

SEQ ID NO: 380074 - protein, 9 aa, Homo Sapiens
ISTSAPTFG

SEQ ID NO: 380075 - protein, 9 aa, Homo Sapiens
LCSRSCNSM

SEQ ID NO: 380076 - protein, 9 aa, Homo Sapiens
FARRQRNSA

SEQ ID NO: 380077 - protein, 9 aa, Homo Sapiens
PETIMCYKN

SEQ ID NO: 380078 - protein, 9 aa, Homo Sapiens
GKTLSKTSH

SEQ ID NO: 380079 - protein, 9 aa, Homo Sapiens
VKVGDSLMV

SEQ ID NO: 380080 - protein, 9 aa, Homo Sapiens
NGCPEFRVR

SEQ ID NO: 380081 - protein, 9 aa, Homo Sapiens
VGPESRAAP

SEQ ID NO: 380082 - protein, 9 aa, Homo Sapiens
DPEKLEEKI

SEQ ID NO: 380083 - protein, 9 aa, Homo Sapiens
FQDWGPEEQ

SEQ ID NO: 380084 - protein, 9 aa, Homo Sapiens
WGITRQEVV

SEQ ID NO: 380085 - protein, 9 aa, Homo Sapiens
KGEGSRAPH

SEQ ID NO: 380086 - protein, 9 aa, Homo Sapiens
LGVVLFCFI

SEQ ID NO: 380087 - protein, 9 aa, Homo Sapiens
GEVPHTLSV

SEQ ID NO: 380088 - protein, 9 aa, Homo Sapiens
AKLVCEDKS

SEQ ID NO: 380089 - protein, 9 aa, Homo Sapiens
SPYSYLTKE

SEQ ID NO: 380090 - protein, 9 aa, Homo Sapiens
PIVITTKPT

SEQ ID NO: 380091 - protein, 9 aa, Homo Sapiens
GGCDLETLI

SEQ ID NO: 380092 - protein, 9 aa, Homo Sapiens
KLFQEIVTA

SEQ ID NO: 380093 - protein, 9 aa, Homo Sapiens
IVFSIEATM

SEQ ID NO: 380094 - protein, 9 aa, Homo Sapiens
AYAELELIK

SEQ ID NO: 380095 - protein, 9 aa, Homo Sapiens
LYACERRIR

SEQ ID NO: 380096 - protein, 9 aa, Homo Sapiens
YEITIHSLH

SEQ ID NO: 380097 - protein, 9 aa, Homo Sapiens
LLLDFVAAD

SEQ ID NO: 380098 - protein, 9 aa, Homo Sapiens
KLEGTVWTK

SEQ ID NO: 380099 - protein, 9 aa, Homo Sapiens
SLENVNKKA

SEQ ID NO: 380100 - protein, 9 aa, Homo Sapiens
LIIHEQIHT

SEQ ID NO: 380101 - protein, 9 aa, Homo Sapiens
PICTSDVDY

SEQ ID NO: 380102 - protein, 9 aa, Homo Sapiens
CELQLPNIN

SEQ ID NO: 380103 - protein, 9 aa, Homo Sapiens
HAEALCVVK

SEQ ID NO: 380104 - protein, 9 aa, Homo Sapiens
SPVIELWEN

SEQ ID NO: 380105 - protein, 9 aa, Homo Sapiens
SLAMLSLGV

SEQ ID NO: 380106 - protein, 9 aa, Homo Sapiens
EKMEDIFAH

SEQ ID NO: 380107 - protein, 9 aa, Homo Sapiens
RFQWILFFI

SEQ ID NO: 380108 - protein, 9 aa, Homo Sapiens
LLMSVEPEE

SEQ ID NO: 380109 - protein, 9 aa, Homo Sapiens
CLFYEGIKV

SEQ ID NO: 380110 - protein, 9 aa, Homo Sapiens
KIIPDRMKA

SEQ ID NO: 380111 - protein, 9 aa, Homo Sapiens
WVVDVNDNP

SEQ ID NO: 380112 - protein, 9 aa, Homo Sapiens
GNCVIYWLV

SEQ ID NO: 380113 - protein, 9 aa, Homo Sapiens
LSLLCPGGS

SEQ ID NO: 380114 - protein, 9 aa, Homo Sapiens
LLYPTEDIN

SEQ ID NO: 380115 - protein, 9 aa, Homo Sapiens
EIQLFVLEI

SEQ ID NO: 380116 - protein, 9 aa, Homo Sapiens
ATFQKKRRN

SEQ ID NO: 380117 - protein, 9 aa, Homo Sapiens
CSGPNTHPS

SEQ ID NO: 380118 - protein, 9 aa, Homo Sapiens
KQNEDDEVP

SEQ ID NO: 380119 - protein, 9 aa, Homo Sapiens
QEEEIDPFN

SEQ ID NO: 380120 - protein, 9 aa, Homo Sapiens
YHMPYEDIR

SEQ ID NO: 380121 - protein, 9 aa, Homo Sapiens
FWRSDDMFT

SEQ ID NO: 380122 - protein, 9 aa, Homo Sapiens
PFFFLRRSL

SEQ ID NO: 380123 - protein, 9 aa, Homo Sapiens
TQLFGEPSR

SEQ ID NO: 380124 - protein, 9 aa, Homo Sapiens
TIELEVICP

SEQ ID NO: 380125 - protein, 9 aa, Homo Sapiens
LVKQNSLYY

SEQ ID NO: 380126 - protein, 9 aa, Homo Sapiens
MRDFLCEAS

SEQ ID NO: 380127 - protein, 9 aa, Homo Sapiens
EDRAKGNIL

SEQ ID NO: 380128 - protein, 9 aa, Homo Sapiens
WAWRNQGAG

SEQ ID NO: 380129 - protein, 9 aa, Homo Sapiens
RLTPPVRGR

SEQ ID NO: 380130 - protein, 9 aa, Homo Sapiens
VNAQELQSE

SEQ ID NO: 380131 - protein, 9 aa, Homo Sapiens
KDDDNVFNS

SEQ ID NO: 380132 - protein, 9 aa, Homo Sapiens
AAVIVGGVI

SEQ ID NO: 380133 - protein, 9 aa, Homo Sapiens
YARNNPTKR

SEQ ID NO: 380134 - protein, 9 aa, Homo Sapiens
TANKNDGYV

SEQ ID NO: 380135 - protein, 9 aa, Homo Sapiens
IQQRMSRPL

SEQ ID NO: 380136 - protein, 9 aa, Homo Sapiens
HKDLLNESI

SEQ ID NO: 380137 - protein, 9 aa, Homo Sapiens
HAKNFLGAS

SEQ ID NO: 380138 - protein, 9 aa, Homo Sapiens
TFVLFMFFI

SEQ ID NO: 380139 - protein, 9 aa, Homo Sapiens
LLRGDNSRK

SEQ ID NO: 380140 - protein, 9 aa, Homo Sapiens
TGDGKCIDQ

SEQ ID NO: 380141 - protein, 9 aa, Homo Sapiens
DLQNLDKEL

SEQ ID NO: 380142 - protein, 9 aa, Homo Sapiens
WEDNTPPLG

SEQ ID NO: 380143 - protein, 9 aa, Homo Sapiens
RNINNKVVV

SEQ ID NO: 380144 - protein, 9 aa, Homo Sapiens
NFFLSQEEG

SEQ ID NO: 380145 - protein, 9 aa, Homo Sapiens
MRNEYLFDR

SEQ ID NO: 380146 - protein, 9 aa, Homo Sapiens
LNIHLFSMA

SEQ ID NO: 380147 - protein, 9 aa, Homo Sapiens
PVQRNVYRD

SEQ ID NO: 380148 - protein, 9 aa, Homo Sapiens
SEPVVHGDS

SEQ ID NO: 380149 - protein, 9 aa, Homo Sapiens
PERLREERA

SEQ ID NO: 380150 - protein, 9 aa, Homo Sapiens
DWQNHKDSR

SEQ ID NO: 380151 - protein, 9 aa, Homo Sapiens
LEVGSDCGF

SEQ ID NO: 380152 - protein, 9 aa, Homo Sapiens
SVLNYFKPY

SEQ ID NO: 380153 - protein, 9 aa, Homo Sapiens
GISTSAPTF

SEQ ID NO: 380154 - protein, 9 aa, Homo Sapiens
LLNTMDNST

SEQ ID NO: 380155 - protein, 9 aa, Homo Sapiens
PAREFLRNK

SEQ ID NO: 380156 - protein, 9 aa, Homo Sapiens
SYVGDHQTL

SEQ ID NO: 380157 - protein, 9 aa, Homo Sapiens
NQHRIIHTG

SEQ ID NO: 380158 - protein, 9 aa, Homo Sapiens
DASNLSTHK

SEQ ID NO: 380159 - protein, 9 aa, Homo Sapiens
EGTVWTKID

SEQ ID NO: 380160 - protein, 9 aa, Homo Sapiens
LLFMAATFS

SEQ ID NO: 380161 - protein, 9 aa, Homo Sapiens
VDNVQGDTW

SEQ ID NO: 380162 - protein, 9 aa, Homo Sapiens
GKDDGESFY

SEQ ID NO: 380163 - protein, 9 aa, Homo Sapiens
KSFYSSNLF

SEQ ID NO: 380164 - protein, 9 aa, Homo Sapiens
RISTSPIRY

SEQ ID NO: 380165 - protein, 9 aa, Homo Sapiens
PYPCQLCGK

SEQ ID NO: 380166 - protein, 9 aa, Homo Sapiens
CQKIIGKNA

SEQ ID NO: 380167 - protein, 9 aa, Homo Sapiens
VLYRSGITS

SEQ ID NO: 380168 - protein, 9 aa, Homo Sapiens
CLAQAWFNT

SEQ ID NO: 380169 - protein, 9 aa, Homo Sapiens
LSDIGSGIQ

SEQ ID NO: 380170 - protein, 9 aa, Homo Sapiens
LMHKDSFPR

SEQ ID NO: 380171 - protein, 9 aa, Homo Sapiens
TCPKCGKGF

SEQ ID NO: 380172 - protein, 9 aa, Homo Sapiens
PGEGFIQVC

SEQ ID NO: 380173 - protein, 9 aa, Homo Sapiens
TRGVCGPGA

SEQ ID NO: 380174 - protein, 9 aa, Homo Sapiens
DCIIEIKPF

SEQ ID NO: 380175 - protein, 9 aa, Homo Sapiens
LNGQEQQMK

SEQ ID NO: 380176 - protein, 9 aa, Homo Sapiens
TLKGHWWKK

SEQ ID NO: 380177 - protein, 9 aa, Homo Sapiens
IMKLSLPES

SEQ ID NO: 380178 - protein, 9 aa, Homo Sapiens
SSEELDQVF

SEQ ID NO: 380179 - protein, 9 aa, Homo Sapiens
ESGSSSYFS

SEQ ID NO: 380180 - protein, 9 aa, Homo Sapiens
EIVGGATQI

SEQ ID NO: 380181 - protein, 9 aa, Homo Sapiens
VSQIICSVK

SEQ ID NO: 380182 - protein, 9 aa, Homo Sapiens
RHTPNISNK

SEQ ID NO: 380183 - protein, 9 aa, Homo Sapiens
LFICKVAQA

SEQ ID NO: 380184 - protein, 9 aa, Homo Sapiens
RFTKETTQN

SEQ ID NO: 380185 - protein, 9 aa, Homo Sapiens
HEVVDGEVR

SEQ ID NO: 380186 - protein, 9 aa, Homo Sapiens
LRQSPASRV

SEQ ID NO: 380187 - protein, 9 aa, Homo Sapiens
LGARRRPWR

SEQ ID NO: 380188 - protein, 9 aa, Homo Sapiens
ASLHSLLSA

SEQ ID NO: 380189 - protein, 9 aa, Homo Sapiens
LVPKMLDKE

SEQ ID NO: 380190 - protein, 9 aa, Homo Sapiens
QIHLGDRPY

SEQ ID NO: 380191 - protein, 9 aa, Homo Sapiens
CFMPGEGHT

SEQ ID NO: 380192 - protein, 9 aa, Homo Sapiens
PWSRKKKII

SEQ ID NO: 380193 - protein, 9 aa, Homo Sapiens
NFPNNMSLS

SEQ ID NO: 380194 - protein, 9 aa, Homo Sapiens
KTQIVPDSS

SEQ ID NO: 380195 - protein, 9 aa, Homo Sapiens
GALGLLASA

SEQ ID NO: 380196 - protein, 9 aa, Homo Sapiens
HLQKTVNKL

SEQ ID NO: 380197 - protein, 9 aa, Homo Sapiens
DSNRLLENV

SEQ ID NO: 380198 - protein, 9 aa, Homo Sapiens
IIDEKLFQL

SEQ ID NO: 380199 - protein, 9 aa, Homo Sapiens
IMKGLTLEK

SEQ ID NO: 380200 - protein, 9 aa, Homo Sapiens
LEAEKKKLQ

SEQ ID NO: 380201 - protein, 9 aa, Homo Sapiens
IQYYNGEDR

SEQ ID NO: 380202 - protein, 9 aa, Homo Sapiens
WFISANVMY

SEQ ID NO: 380203 - protein, 9 aa, Homo Sapiens
RVPSVTLVD

SEQ ID NO: 380204 - protein, 9 aa, Homo Sapiens
APSHMASMG

SEQ ID NO: 380205 - protein, 9 aa, Homo Sapiens
PKIAEENLA

SEQ ID NO: 380206 - protein, 9 aa, Homo Sapiens
HQTKINSYI

SEQ ID NO: 380207 - protein, 9 aa, Homo Sapiens
VSFLHTVIL

SEQ ID NO: 380208 - protein, 9 aa, Homo Sapiens
CSYICDEGK

SEQ ID NO: 380209 - protein, 9 aa, Homo Sapiens
LWHHYKCPG

SEQ ID NO: 380210 - protein, 9 aa, Homo Sapiens
QKKTALKAT

SEQ ID NO: 380211 - protein, 9 aa, Homo Sapiens
AEVTKRKEI

SEQ ID NO: 380212 - protein, 9 aa, Homo Sapiens
IRKQEKRQE

SEQ ID NO: 380213 - protein, 9 aa, Homo Sapiens
MNNSLNYFK

SEQ ID NO: 380214 - protein, 9 aa, Homo Sapiens
PKFKQCKML

SEQ ID NO: 380215 - protein, 9 aa, Homo Sapiens
LHSLLSAAL

SEQ ID NO: 380216 - protein, 9 aa, Homo Sapiens
QTLCIFLRY

SEQ ID NO: 380217 - protein, 9 aa, Homo Sapiens
CLHWFPYCR

SEQ ID NO: 380218 - protein, 9 aa, Homo Sapiens
LEEPVGPES

SEQ ID NO: 380219 - protein, 9 aa, Homo Sapiens
LFVDDFEEL

SEQ ID NO: 380220 - protein, 9 aa, Homo Sapiens
KTPSGEKQV

SEQ ID NO: 380221 - protein, 9 aa, Homo Sapiens
LRDLMEAVF

SEQ ID NO: 380222 - protein, 9 aa, Homo Sapiens
EHGPQTLDN

SEQ ID NO: 380223 - protein, 9 aa, Homo Sapiens
NQVLDSNNF

SEQ ID NO: 380224 - protein, 9 aa, Homo Sapiens
INGINVKKC

SEQ ID NO: 380225 - protein, 9 aa, Homo Sapiens
KRKNNYPDP

SEQ ID NO: 380226 - protein, 9 aa, Homo Sapiens
CFILLFVWS

SEQ ID NO: 380227 - protein, 9 aa, Homo Sapiens
YPFWDKMAT

SEQ ID NO: 380228 - protein, 9 aa, Homo Sapiens
NKLASASAK

SEQ ID NO: 380229 - protein, 9 aa, Homo Sapiens
ENIITHGKK

SEQ ID NO: 380230 - protein, 9 aa, Homo Sapiens
QIYLEGKID

SEQ ID NO: 380231 - protein, 9 aa, Homo Sapiens
TVWELFEEL

SEQ ID NO: 380232 - protein, 9 aa, Homo Sapiens
RVAYLFSGQ

SEQ ID NO: 380233 - protein, 9 aa, Homo Sapiens
NNFHVETKL

SEQ ID NO: 380234 - protein, 9 aa, Homo Sapiens
VIIFEMLVG

SEQ ID NO: 380235 - protein, 9 aa, Homo Sapiens
CTDKDYLYT

SEQ ID NO: 380236 - protein, 9 aa, Homo Sapiens
NYFVIPSES

SEQ ID NO: 380237 - protein, 9 aa, Homo Sapiens
YRGPQDFNY

SEQ ID NO: 380238 - protein, 9 aa, Homo Sapiens
NKNNQVKKD

SEQ ID NO: 380239 - protein, 9 aa, Homo Sapiens
AVYNHTAAN

SEQ ID NO: 380240 - protein, 9 aa, Homo Sapiens
DNQRVEAPA

SEQ ID NO: 380241 - protein, 9 aa, Homo Sapiens
VPLSEHTIH

SEQ ID NO: 380242 - protein, 9 aa, Homo Sapiens
SEPKSGTFP

SEQ ID NO: 380243 - protein, 9 aa, Homo Sapiens
SPSINMSLE

SEQ ID NO: 380244 - protein, 9 aa, Homo Sapiens
TSGYHAKNF

SEQ ID NO: 380245 - protein, 9 aa, Homo Sapiens
SADTHSNGV

SEQ ID NO: 380246 - protein, 9 aa, Homo Sapiens
TSEGFQTFS

SEQ ID NO: 380247 - protein, 9 aa, Homo Sapiens
TSEINQLRG

SEQ ID NO: 380248 - protein, 9 aa, Homo Sapiens
KLEEKIQKL

SEQ ID NO: 380249 - protein, 9 aa, Homo Sapiens
LFDRNRPSF

SEQ ID NO: 380250 - protein, 9 aa, Homo Sapiens
VKGLWDDLV

SEQ ID NO: 380251 - protein, 9 aa, Homo Sapiens
KKIIDVNNI

SEQ ID NO: 380252 - protein, 9 aa, Homo Sapiens
RKNEFLILP

SEQ ID NO: 380253 - protein, 9 aa, Homo Sapiens
QHQRSHNGE

SEQ ID NO: 380254 - protein, 9 aa, Homo Sapiens
EESKAADNK

SEQ ID NO: 380255 - protein, 9 aa, Homo Sapiens
PCSSNTLKG

SEQ ID NO: 380256 - protein, 9 aa, Homo Sapiens
IYFTTFVLF

SEQ ID NO: 380257 - protein, 9 aa, Homo Sapiens
QGITGLCIV

SEQ ID NO: 380258 - protein, 9 aa, Homo Sapiens
LHKTIQAAR

SEQ ID NO: 380259 - protein, 9 aa, Homo Sapiens
REKKALFLK

SEQ ID NO: 380260 - protein, 9 aa, Homo Sapiens
PTFGFGKPE

SEQ ID NO: 380261 - protein, 9 aa, Homo Sapiens
VDISISQLI

SEQ ID NO: 380262 - protein, 9 aa, Homo Sapiens
KQEDKLGFL

SEQ ID NO: 380263 - protein, 9 aa, Homo Sapiens
ESSKLKLKL

SEQ ID NO: 380264 - protein, 9 aa, Homo Sapiens
VAAAVGSQS

SEQ ID NO: 380265 - protein, 9 aa, Homo Sapiens
IYDYENNYW

SEQ ID NO: 380266 - protein, 9 aa, Homo Sapiens
TTDQEQLQE

SEQ ID NO: 380267 - protein, 9 aa, Homo Sapiens
ETKLFHSEY

SEQ ID NO: 380268 - protein, 9 aa, Homo Sapiens
ALQGLAYLY

SEQ ID NO: 380269 - protein, 9 aa, Homo Sapiens
IVHQQIHTG

SEQ ID NO: 380270 - protein, 9 aa, Homo Sapiens
AIPTAINFT

SEQ ID NO: 380271 - protein, 9 aa, Homo Sapiens
EGVQIQIIF

SEQ ID NO: 380272 - protein, 9 aa, Homo Sapiens
KLINDTFED

SEQ ID NO: 380273 - protein, 9 aa, Homo Sapiens
SVRNNFPGE

SEQ ID NO: 380274 - protein, 9 aa, Homo Sapiens
YVNFNLTDF

SEQ ID NO: 380275 - protein, 9 aa, Homo Sapiens
GYNGCGAFS

SEQ ID NO: 380276 - protein, 9 aa, Homo Sapiens
QNRFKHEKI

SEQ ID NO: 380277 - protein, 9 aa, Homo Sapiens
NDRVYIGKI

SEQ ID NO: 380278 - protein, 9 aa, Homo Sapiens
RIRYLEKAE

SEQ ID NO: 380279 - protein, 9 aa, Homo Sapiens
IQYLHENKI

SEQ ID NO: 380280 - protein, 9 aa, Homo Sapiens
QAQLAEDIK

SEQ ID NO: 380281 - protein, 9 aa, Homo Sapiens
EKANMDMCC

SEQ ID NO: 380282 - protein, 9 aa, Homo Sapiens
EKNRTRSTS

SEQ ID NO: 380283 - protein, 9 aa, Homo Sapiens
TAEFVNVEF

SEQ ID NO: 380284 - protein, 9 aa, Homo Sapiens
WEKACVKAH

SEQ ID NO: 380285 - protein, 9 aa, Homo Sapiens
YFKRFYTRY

SEQ ID NO: 380286 - protein, 9 aa, Homo Sapiens
LGRRSSPSP

SEQ ID NO: 380287 - protein, 9 aa, Homo Sapiens
FLDVVYKVI

SEQ ID NO: 380288 - protein, 9 aa, Homo Sapiens
YGTIYYTII

SEQ ID NO: 380289 - protein, 9 aa, Homo Sapiens
MIKLVERLK

SEQ ID NO: 380290 - protein, 9 aa, Homo Sapiens
WQMFLLQYA

SEQ ID NO: 380291 - protein, 9 aa, Homo Sapiens
VRNNFPGEM

SEQ ID NO: 380292 - protein, 9 aa, Homo Sapiens
ITHSVCEEK

SEQ ID NO: 380293 - protein, 9 aa, Homo Sapiens
ALMKLTLEY

SEQ ID NO: 380294 - protein, 9 aa, Homo Sapiens
QNLFAPLLP

SEQ ID NO: 380295 - protein, 9 aa, Homo Sapiens
MNKFFPKGA

SEQ ID NO: 380296 - protein, 9 aa, Homo Sapiens
LQNEKEELV

SEQ ID NO: 380297 - protein, 9 aa, Homo Sapiens
RQPVSVQLL

SEQ ID NO: 380298 - protein, 9 aa, Homo Sapiens
KTAPIKGCK

SEQ ID NO: 380299 - protein, 9 aa, Homo Sapiens
IWFQQKVME

SEQ ID NO: 380300 - protein, 9 aa, Homo Sapiens
YIEANFISN

SEQ ID NO: 380301 - protein, 9 aa, Homo Sapiens
FGERDTSGS

SEQ ID NO: 380302 - protein, 9 aa, Homo Sapiens
KLRDLMEAV

SEQ ID NO: 380303 - protein, 9 aa, Homo Sapiens
KDWQNHKDS

SEQ ID NO: 380304 - protein, 9 aa, Homo Sapiens
AQNLFAPLL

SEQ ID NO: 380305 - protein, 9 aa, Homo Sapiens
ISKNFPNNM

SEQ ID NO: 380306 - protein, 9 aa, Homo Sapiens
WTLVVPLVL

SEQ ID NO: 380307 - protein, 9 aa, Homo Sapiens
EQEADTILK

SEQ ID NO: 380308 - protein, 9 aa, Homo Sapiens
ELIIKHNNQ

SEQ ID NO: 380309 - protein, 9 aa, Homo Sapiens
PPISGSLAL

SEQ ID NO: 380310 - protein, 9 aa, Homo Sapiens
PGQRLQIHN

SEQ ID NO: 380311 - protein, 9 aa, Homo Sapiens
TEMEKGLAK

SEQ ID NO: 380312 - protein, 9 aa, Homo Sapiens
RALTEANKL

SEQ ID NO: 380313 - protein, 9 aa, Homo Sapiens
TGVYDDGLD

SEQ ID NO: 380314 - protein, 9 aa, Homo Sapiens
AWKHNFNSP

SEQ ID NO: 380315 - protein, 9 aa, Homo Sapiens
KFIHINFDV

SEQ ID NO: 380316 - protein, 9 aa, Homo Sapiens
YVGPTDFAP

SEQ ID NO: 380317 - protein, 9 aa, Homo Sapiens
VLQENKQKM

SEQ ID NO: 380318 - protein, 9 aa, Homo Sapiens
VQLNNLNME

SEQ ID NO: 380319 - protein, 9 aa, Homo Sapiens
VYENKLLNL

SEQ ID NO: 380320 - protein, 9 aa, Homo Sapiens
LVNIVPNKP

SEQ ID NO: 380321 - protein, 9 aa, Homo Sapiens
LIIKHNNQF

SEQ ID NO: 380322 - protein, 9 aa, Homo Sapiens
IISSLPLFY

SEQ ID NO: 380323 - protein, 9 aa, Homo Sapiens
VKLESMGEG

SEQ ID NO: 380324 - protein, 9 aa, Homo Sapiens
AVPGSAEAQ

SEQ ID NO: 380325 - protein, 9 aa, Homo Sapiens
GFWRSDDMF

SEQ ID NO: 380326 - protein, 9 aa, Homo Sapiens
KPESVGKAK

SEQ ID NO: 380327 - protein, 9 aa, Homo Sapiens
GGRPLSPLD

SEQ ID NO: 380328 - protein, 9 aa, Homo Sapiens
SGFRKEKAN

SEQ ID NO: 380329 - protein, 9 aa, Homo Sapiens
TVSSQKKTA

SEQ ID NO: 380330 - protein, 9 aa, Homo Sapiens
WNVICITDA

SEQ ID NO: 380331 - protein, 9 aa, Homo Sapiens
ESETQMLSV

SEQ ID NO: 380332 - protein, 9 aa, Homo Sapiens
NLFVGAAGA

SEQ ID NO: 380333 - protein, 9 aa, Homo Sapiens
EESRIYFRE

SEQ ID NO: 380334 - protein, 9 aa, Homo Sapiens
TDKDYLYTH

SEQ ID NO: 380335 - protein, 9 aa, Homo Sapiens
QGSLCSGFI

SEQ ID NO: 380336 - protein, 9 aa, Homo Sapiens
GINSSAKNN

SEQ ID NO: 380337 - protein, 9 aa, Homo Sapiens
ILAVISELN

SEQ ID NO: 380338 - protein, 9 aa, Homo Sapiens
ACTQLFGEP

SEQ ID NO: 380339 - protein, 9 aa, Homo Sapiens
CVLNLWQKN

SEQ ID NO: 380340 - protein, 9 aa, Homo Sapiens
KLLLLDPGE

SEQ ID NO: 380341 - protein, 9 aa, Homo Sapiens
SCLAQAWFN

SEQ ID NO: 380342 - protein, 9 aa, Homo Sapiens
QKEDMEEWI

SEQ ID NO: 380343 - protein, 9 aa, Homo Sapiens
VFCIFATYD

SEQ ID NO: 380344 - protein, 9 aa, Homo Sapiens
QNHKDSRCD

SEQ ID NO: 380345 - protein, 9 aa, Homo Sapiens
SLTGICFTT

SEQ ID NO: 380346 - protein, 9 aa, Homo Sapiens
SAGCEGIGN

SEQ ID NO: 380347 - protein, 9 aa, Homo Sapiens
SNTEKEDRS

SEQ ID NO: 380348 - protein, 9 aa, Homo Sapiens
CDVRCCCAQ

SEQ ID NO: 380349 - protein, 9 aa, Homo Sapiens
SSQKKTALK

SEQ ID NO: 380350 - protein, 9 aa, Homo Sapiens
LAQTCIGTP

SEQ ID NO: 380351 - protein, 9 aa, Homo Sapiens
ELFAELDKV

SEQ ID NO: 380352 - protein, 9 aa, Homo Sapiens
VGSCSRTCG

SEQ ID NO: 380353 - protein, 9 aa, Homo Sapiens
MLENFLERL

SEQ ID NO: 380354 - protein, 9 aa, Homo Sapiens
PSPSPESSS

SEQ ID NO: 380355 - protein, 9 aa, Homo Sapiens
KIMKLSLPE

SEQ ID NO: 380356 - protein, 9 aa, Homo Sapiens
LSPDPQMDL

SEQ ID NO: 380357 - protein, 9 aa, Homo Sapiens
ELGYFTDTN

SEQ ID NO: 380358 - protein, 9 aa, Homo Sapiens
RGPHFPRAS

SEQ ID NO: 380359 - protein, 9 aa, Homo Sapiens
SLSVLHSFY

SEQ ID NO: 380360 - protein, 9 aa, Homo Sapiens
RYRNAQRKD

SEQ ID NO: 380361 - protein, 9 aa, Homo Sapiens
EQFENMKSS

SEQ ID NO: 380362 - protein, 9 aa, Homo Sapiens
NYRNLVLLG

SEQ ID NO: 380363 - protein, 9 aa, Homo Sapiens
SMDICKQED

SEQ ID NO: 380364 - protein, 9 aa, Homo Sapiens
IYLLDGLGP

SEQ ID NO: 380365 - protein, 9 aa, Homo Sapiens
ERLREERAG

SEQ ID NO: 380366 - protein, 9 aa, Homo Sapiens
LLASAGVGS

SEQ ID NO: 380367 - protein, 9 aa, Homo Sapiens
ASVQRSMQE

SEQ ID NO: 380368 - protein, 9 aa, Homo Sapiens
GEEAEVEKA

SEQ ID NO: 380369 - protein, 9 aa, Homo Sapiens
YWGLDHPPL

SEQ ID NO: 380370 - protein, 9 aa, Homo Sapiens
YSLTIYPQH

SEQ ID NO: 380371 - protein, 9 aa, Homo Sapiens
TAIIKVVSQ

SEQ ID NO: 380372 - protein, 9 aa, Homo Sapiens
NINNVVLDE

SEQ ID NO: 380373 - protein, 9 aa, Homo Sapiens
YYKRLLDSG

SEQ ID NO: 380374 - protein, 9 aa, Homo Sapiens
AGCEGIGNF

SEQ ID NO: 380375 - protein, 9 aa, Homo Sapiens
EDVLINIDD

SEQ ID NO: 380376 - protein, 9 aa, Homo Sapiens
SPRPSLSSD

SEQ ID NO: 380377 - protein, 9 aa, Homo Sapiens
IQYNPDDLT

SEQ ID NO: 380378 - protein, 9 aa, Homo Sapiens
WDMYSHYVL

SEQ ID NO: 380379 - protein, 9 aa, Homo Sapiens
EQKELFAEL

SEQ ID NO: 380380 - protein, 9 aa, Homo Sapiens
AKQFICCSA

SEQ ID NO: 380381 - protein, 9 aa, Homo Sapiens
FNRDSTMNV

SEQ ID NO: 380382 - protein, 9 aa, Homo Sapiens
LQNQVLDSN

SEQ ID NO: 380383 - protein, 9 aa, Homo Sapiens
ISSLPLFYS

SEQ ID NO: 380384 - protein, 9 aa, Homo Sapiens
SKLGLSQSC

SEQ ID NO: 380385 - protein, 9 aa, Homo Sapiens
EIPETVRTI

SEQ ID NO: 380386 - protein, 9 aa, Homo Sapiens
HINFDVNGY

SEQ ID NO: 380387 - protein, 9 aa, Homo Sapiens
EAEVEKATV

SEQ ID NO: 380388 - protein, 9 aa, Homo Sapiens
DYTSPETQK

SEQ ID NO: 380389 - protein, 9 aa, Homo Sapiens
TAESVWLPG

SEQ ID NO: 380390 - protein, 9 aa, Homo Sapiens
FMPGEGHTL

SEQ ID NO: 380391 - protein, 9 aa, Homo Sapiens
WHHLNHFLE

SEQ ID NO: 380392 - protein, 9 aa, Homo Sapiens
ITWEHAGRC

SEQ ID NO: 380393 - protein, 9 aa, Homo Sapiens
TVDTRGPFM

SEQ ID NO: 380394 - protein, 9 aa, Homo Sapiens
EHKIIHAGE

SEQ ID NO: 380395 - protein, 9 aa, Homo Sapiens
RRREQLIRE

SEQ ID NO: 380396 - protein, 9 aa, Homo Sapiens
RNINPKPCT

SEQ ID NO: 380397 - protein, 9 aa, Homo Sapiens
PTSWLNGSS

SEQ ID NO: 380398 - protein, 9 aa, Homo Sapiens
CDPEKLEEK

SEQ ID NO: 380399 - protein, 9 aa, Homo Sapiens
IDEKLFQLS

SEQ ID NO: 380400 - protein, 9 aa, Homo Sapiens
CMRQIGWNR

SEQ ID NO: 380401 - protein, 9 aa, Homo Sapiens
LTQNQAFYL

SEQ ID NO: 380402 - protein, 9 aa, Homo Sapiens
ESDKFYVGQ

SEQ ID NO: 380403 - protein, 9 aa, Homo Sapiens
VNYFNQYIN

SEQ ID NO: 380404 - protein, 9 aa, Homo Sapiens
SYHGNVLYG

SEQ ID NO: 380405 - protein, 9 aa, Homo Sapiens
LCLEKLSIS

SEQ ID NO: 380406 - protein, 9 aa, Homo Sapiens
AEMGKPVIG

SEQ ID NO: 380407 - protein, 9 aa, Homo Sapiens
NELFTFFVR

SEQ ID NO: 380408 - protein, 9 aa, Homo Sapiens
EDYIHIKIQ

SEQ ID NO: 380409 - protein, 9 aa, Homo Sapiens
SGPYGTIYY

SEQ ID NO: 380410 - protein, 9 aa, Homo Sapiens
GILKTLFRC

SEQ ID NO: 380411 - protein, 9 aa, Homo Sapiens
TLLKQVHPG

SEQ ID NO: 380412 - protein, 9 aa, Homo Sapiens
GITGLCIVE

SEQ ID NO: 380413 - protein, 9 aa, Homo Sapiens
CCNCPSGGS

SEQ ID NO: 380414 - protein, 9 aa, Homo Sapiens
PGRTYFRRK

SEQ ID NO: 380415 - protein, 9 aa, Homo Sapiens
RPGPPGLSG

SEQ ID NO: 380416 - protein, 9 aa, Homo Sapiens
SNSESEEKV

SEQ ID NO: 380417 - protein, 9 aa, Homo Sapiens
WCQKEMGIQ

SEQ ID NO: 380418 - protein, 9 aa, Homo Sapiens
VNKKAVAFT

SEQ ID NO: 380419 - protein, 9 aa, Homo Sapiens
SNLVQHQII

SEQ ID NO: 380420 - protein, 9 aa, Homo Sapiens
EDNPSICAI

SEQ ID NO: 380421 - protein, 9 aa, Homo Sapiens
EEQLKLNIG

SEQ ID NO: 380422 - protein, 9 aa, Homo Sapiens
LEDLQKKKH

SEQ ID NO: 380423 - protein, 9 aa, Homo Sapiens
QKLVQTASK

SEQ ID NO: 380424 - protein, 9 aa, Homo Sapiens
ESFSQSPPL

SEQ ID NO: 380425 - protein, 9 aa, Homo Sapiens
RSTSVDTGC

SEQ ID NO: 380426 - protein, 9 aa, Homo Sapiens
GKAFRRSSA

SEQ ID NO: 380427 - protein, 9 aa, Homo Sapiens
ILDSISALR

SEQ ID NO: 380428 - protein, 9 aa, Homo Sapiens
LLMLLQQSP

SEQ ID NO: 380429 - protein, 9 aa, Homo Sapiens
IKHPEDVDC

SEQ ID NO: 380430 - protein, 9 aa, Homo Sapiens
NRLVNIVPN

SEQ ID NO: 380431 - protein, 9 aa, Homo Sapiens
VTTIDMMYK

SEQ ID NO: 380432 - protein, 9 aa, Homo Sapiens
YCYRYRCTA

SEQ ID NO: 380433 - protein, 9 aa, Homo Sapiens
VDCLFYEGI

SEQ ID NO: 380434 - protein, 9 aa, Homo Sapiens
KQRLWWYYL

SEQ ID NO: 380435 - protein, 9 aa, Homo Sapiens
VYRDVMLEN

SEQ ID NO: 380436 - protein, 9 aa, Homo Sapiens
KKSHTFDLE

SEQ ID NO: 380437 - protein, 9 aa, Homo Sapiens
LTSNDTFEI

SEQ ID NO: 380438 - protein, 9 aa, Homo Sapiens
DYCSLCSEA

SEQ ID NO: 380439 - protein, 9 aa, Homo Sapiens
IGFVLRREL

SEQ ID NO: 380440 - protein, 9 aa, Homo Sapiens
KFPCTHPPC

SEQ ID NO: 380441 - protein, 9 aa, Homo Sapiens
LCVVKILQN

SEQ ID NO: 380442 - protein, 9 aa, Homo Sapiens
AEKKEEKEN

SEQ ID NO: 380443 - protein, 9 aa, Homo Sapiens
ADTHSNGVS

SEQ ID NO: 380444 - protein, 9 aa, Homo Sapiens
DILTNQKDY

SEQ ID NO: 380445 - protein, 9 aa, Homo Sapiens
GWTPNMSVA

SEQ ID NO: 380446 - protein, 9 aa, Homo Sapiens
QQKNSGFWR

SEQ ID NO: 380447 - protein, 9 aa, Homo Sapiens
FRLRSTSVD

SEQ ID NO: 380448 - protein, 9 aa, Homo Sapiens
QGQSLNYYT

SEQ ID NO: 380449 - protein, 9 aa, Homo Sapiens
QHSEINQSA

SEQ ID NO: 380450 - protein, 9 aa, Homo Sapiens
ASSAWKHNF

SEQ ID NO: 380451 - protein, 9 aa, Homo Sapiens
NTHPSPHPP

SEQ ID NO: 380452 - protein, 9 aa, Homo Sapiens
LEVINLQNE

SEQ ID NO: 380453 - protein, 9 aa, Homo Sapiens
CQIKKKKQL

SEQ ID NO: 380454 - protein, 9 aa, Homo Sapiens
DPEPERLRE

SEQ ID NO: 380455 - protein, 9 aa, Homo Sapiens
KRLRKTRFS

SEQ ID NO: 380456 - protein, 9 aa, Homo Sapiens
GKCDPEKLE

SEQ ID NO: 380457 - protein, 9 aa, Homo Sapiens
YVRSPLLMR

SEQ ID NO: 380458 - protein, 9 aa, Homo Sapiens
IHSFISGVS

SEQ ID NO: 380459 - protein, 9 aa, Homo Sapiens
FNVRMGVGF

SEQ ID NO: 380460 - protein, 9 aa, Homo Sapiens
GGRRAKSRC

SEQ ID NO: 380461 - protein, 9 aa, Homo Sapiens
SKEVIPDSK

SEQ ID NO: 380462 - protein, 9 aa, Homo Sapiens
KYIIKHLIN

SEQ ID NO: 380463 - protein, 9 aa, Homo Sapiens
LNYVKEVDQ

SEQ ID NO: 380464 - protein, 9 aa, Homo Sapiens
ERLHDIELY

SEQ ID NO: 380465 - protein, 9 aa, Homo Sapiens
VHCSYICDE

SEQ ID NO: 380466 - protein, 9 aa, Homo Sapiens
SVEWERLGA

SEQ ID NO: 380467 - protein, 9 aa, Homo Sapiens
ILQNVSSED

SEQ ID NO: 380468 - protein, 9 aa, Homo Sapiens
ICKQQTNNQ

SEQ ID NO: 380469 - protein, 9 aa, Homo Sapiens
FTVTDPQNL

SEQ ID NO: 380470 - protein, 9 aa, Homo Sapiens
NVFGAILFT

SEQ ID NO: 380471 - protein, 9 aa, Homo Sapiens
SLTETTSSP

SEQ ID NO: 380472 - protein, 9 aa, Homo Sapiens
ICGHGECVS

SEQ ID NO: 380473 - protein, 9 aa, Homo Sapiens
ECGKAYNDA

SEQ ID NO: 380474 - protein, 9 aa, Homo Sapiens
GTEDYIHIK

SEQ ID NO: 380475 - protein, 9 aa, Homo Sapiens
VHIGHLYIL

SEQ ID NO: 380476 - protein, 9 aa, Homo Sapiens
IGKAFKEEQ

SEQ ID NO: 380477 - protein, 9 aa, Homo Sapiens
ARHQIIHTG

SEQ ID NO: 380478 - protein, 9 aa, Homo Sapiens
KVGEEQGQD

SEQ ID NO: 380479 - protein, 9 aa, Homo Sapiens
YNFYIRPIL

SEQ ID NO: 380480 - protein, 9 aa, Homo Sapiens
TAEVVYYWT

SEQ ID NO: 380481 - protein, 9 aa, Homo Sapiens
CKREQKQRD

SEQ ID NO: 380482 - protein, 9 aa, Homo Sapiens
IFETDESTQ

SEQ ID NO: 380483 - protein, 9 aa, Homo Sapiens
YIFNRDSTM

SEQ ID NO: 380484 - protein, 9 aa, Homo Sapiens
VIKKLNLQN

SEQ ID NO: 380485 - protein, 9 aa, Homo Sapiens
QLPNINLVN

SEQ ID NO: 380486 - protein, 9 aa, Homo Sapiens
LVKLFNKHK

SEQ ID NO: 380487 - protein, 9 aa, Homo Sapiens
WLLQFIFQT

SEQ ID NO: 380488 - protein, 9 aa, Homo Sapiens
SDCGFLALI

SEQ ID NO: 380489 - protein, 9 aa, Homo Sapiens
RYLGKEGWV

SEQ ID NO: 380490 - protein, 9 aa, Homo Sapiens
ISEKKMATP

SEQ ID NO: 380491 - protein, 9 aa, Homo Sapiens
MEALVKLFN

SEQ ID NO: 380492 - protein, 9 aa, Homo Sapiens
ILNGQEQQM

SEQ ID NO: 380493 - protein, 9 aa, Homo Sapiens
WMVFMCAAV

SEQ ID NO: 380494 - protein, 9 aa, Homo Sapiens
DHKAAVSVL

SEQ ID NO: 380495 - protein, 9 aa, Homo Sapiens
ERDTSGSMW

SEQ ID NO: 380496 - protein, 9 aa, Homo Sapiens
IRLEGMFRA

SEQ ID NO: 380497 - protein, 9 aa, Homo Sapiens
STGEMFTTS

SEQ ID NO: 380498 - protein, 9 aa, Homo Sapiens
SCCFLPRLG

SEQ ID NO: 380499 - protein, 9 aa, Homo Sapiens
QVLYFDAYL

SEQ ID NO: 380500 - protein, 9 aa, Homo Sapiens
FRLKEAFNY

SEQ ID NO: 380501 - protein, 9 aa, Homo Sapiens
YIFNDAEVK

SEQ ID NO: 380502 - protein, 9 aa, Homo Sapiens
EYLSPSSRP

SEQ ID NO: 380503 - protein, 9 aa, Homo Sapiens
EFLILPLPQ

SEQ ID NO: 380504 - protein, 9 aa, Homo Sapiens
PAEQFENMK

SEQ ID NO: 380505 - protein, 9 aa, Homo Sapiens
REVNLPKVT

SEQ ID NO: 380506 - protein, 9 aa, Homo Sapiens
NINNKVVVN

SEQ ID NO: 380507 - protein, 9 aa, Homo Sapiens
YVELETIIL

SEQ ID NO: 380508 - protein, 9 aa, Homo Sapiens
KMATQEVPT

SEQ ID NO: 380509 - protein, 9 aa, Homo Sapiens
VVAEEAYKQ

SEQ ID NO: 380510 - protein, 9 aa, Homo Sapiens
LLYVWTLVV

SEQ ID NO: 380511 - protein, 9 aa, Homo Sapiens
LIFLLAMGA

SEQ ID NO: 380512 - protein, 9 aa, Homo Sapiens
AFSWPSSFR

SEQ ID NO: 380513 - protein, 9 aa, Homo Sapiens
QQSQPVKLD

SEQ ID NO: 380514 - protein, 9 aa, Homo Sapiens
VPATKLNMM

SEQ ID NO: 380515 - protein, 9 aa, Homo Sapiens
HQHCQKYYV

SEQ ID NO: 380516 - protein, 9 aa, Homo Sapiens
PCPEKCAKH

SEQ ID NO: 380517 - protein, 9 aa, Homo Sapiens
ISREQTHLS

SEQ ID NO: 380518 - protein, 9 aa, Homo Sapiens
LFQEIVTAL

SEQ ID NO: 380519 - protein, 9 aa, Homo Sapiens
DLGYAPAIQ

SEQ ID NO: 380520 - protein, 9 aa, Homo Sapiens
ENDIQVVEN

SEQ ID NO: 380521 - protein, 9 aa, Homo Sapiens
SKAADNKIK

SEQ ID NO: 380522 - protein, 9 aa, Homo Sapiens
SSNETFAGL

SEQ ID NO: 380523 - protein, 9 aa, Homo Sapiens
AALLTKTNQ

SEQ ID NO: 380524 - protein, 9 aa, Homo Sapiens
AGSKLCLVE

SEQ ID NO: 380525 - protein, 9 aa, Homo Sapiens
KLVNDSLYD

SEQ ID NO: 380526 - protein, 9 aa, Homo Sapiens
QPCCPCLCP

SEQ ID NO: 380527 - protein, 9 aa, Homo Sapiens
RLQFYMFTW

SEQ ID NO: 380528 - protein, 9 aa, Homo Sapiens
GRHYARTDE

SEQ ID NO: 380529 - protein, 9 aa, Homo Sapiens
RKKLARPAA

SEQ ID NO: 380530 - protein, 9 aa, Homo Sapiens
FQKEAEKLL

SEQ ID NO: 380531 - protein, 9 aa, Homo Sapiens
VFSKLGLSQ

SEQ ID NO: 380532 - protein, 9 aa, Homo Sapiens
LEKVVNAQE

SEQ ID NO: 380533 - protein, 9 aa, Homo Sapiens
VLCLAVAFK

SEQ ID NO: 380534 - protein, 9 aa, Homo Sapiens
TGTTEFWLE

SEQ ID NO: 380535 - protein, 9 aa, Homo Sapiens
RLLDSLWQE

SEQ ID NO: 380536 - protein, 9 aa, Homo Sapiens
PLENDIQVV

SEQ ID NO: 380537 - protein, 9 aa, Homo Sapiens
SLITQERDH

SEQ ID NO: 380538 - protein, 9 aa, Homo Sapiens
FICKVAQAC

SEQ ID NO: 380539 - protein, 9 aa, Homo Sapiens
IKQDYTSPE

SEQ ID NO: 380540 - protein, 9 aa, Homo Sapiens
KVQKLVQTA

SEQ ID NO: 380541 - protein, 9 aa, Homo Sapiens
GRHGSGFGR

SEQ ID NO: 380542 - protein, 9 aa, Homo Sapiens
LKAEISYHI

SEQ ID NO: 380543 - protein, 9 aa, Homo Sapiens
GRAPLQKVE

SEQ ID NO: 380544 - protein, 9 aa, Homo Sapiens
GLEYLHSQR

SEQ ID NO: 380545 - protein, 9 aa, Homo Sapiens
FLSCANYAS

SEQ ID NO: 380546 - protein, 9 aa, Homo Sapiens
SSKTFTSSD

SEQ ID NO: 380547 - protein, 9 aa, Homo Sapiens
QSMLENFLE

SEQ ID NO: 380548 - protein, 9 aa, Homo Sapiens
PHFPRASSE

SEQ ID NO: 380549 - protein, 9 aa, Homo Sapiens
SDIYLNLIN

SEQ ID NO: 380550 - protein, 9 aa, Homo Sapiens
EVPHTLSVF

SEQ ID NO: 380551 - protein, 9 aa, Homo Sapiens
QQAQFIWKK

SEQ ID NO: 380552 - protein, 9 aa, Homo Sapiens
DVNNISIGI

SEQ ID NO: 380553 - protein, 9 aa, Homo Sapiens
STDPNSVFQ

SEQ ID NO: 380554 - protein, 9 aa, Homo Sapiens
LESLRNNDL

SEQ ID NO: 380555 - protein, 9 aa, Homo Sapiens
SNNFKSVKR

SEQ ID NO: 380556 - protein, 9 aa, Homo Sapiens
NHLLWNPDI

SEQ ID NO: 380557 - protein, 9 aa, Homo Sapiens
VTATPQIAK

SEQ ID NO: 380558 - protein, 9 aa, Homo Sapiens
LIRERQQMA

SEQ ID NO: 380559 - protein, 9 aa, Homo Sapiens
ARLFYDISK

SEQ ID NO: 380560 - protein, 9 aa, Homo Sapiens
KEIWLSKNP

SEQ ID NO: 380561 - protein, 9 aa, Homo Sapiens
NVNMPCCKR

SEQ ID NO: 380562 - protein, 9 aa, Homo Sapiens
TNMEVPDTE

SEQ ID NO: 380563 - protein, 9 aa, Homo Sapiens
SPDYLVREA

SEQ ID NO: 380564 - protein, 9 aa, Homo Sapiens
QYYNGEDRA

SEQ ID NO: 380565 - protein, 9 aa, Homo Sapiens
QKNSGFWRS

SEQ ID NO: 380566 - protein, 9 aa, Homo Sapiens
DAELLQIQT

SEQ ID NO: 380567 - protein, 9 aa, Homo Sapiens
GPGRPPFQK

SEQ ID NO: 380568 - protein, 9 aa, Homo Sapiens
IITHGKKYH

SEQ ID NO: 380569 - protein, 9 aa, Homo Sapiens
PPKEIWLSK

SEQ ID NO: 380570 - protein, 9 aa, Homo Sapiens
VSEDKYLEI

SEQ ID NO: 380571 - protein, 9 aa, Homo Sapiens
DGVFMYFEG

SEQ ID NO: 380572 - protein, 9 aa, Homo Sapiens
NEFLILPLP

SEQ ID NO: 380573 - protein, 9 aa, Homo Sapiens
SYHMPYEDI

SEQ ID NO: 380574 - protein, 9 aa, Homo Sapiens
LGHTTQTSI

SEQ ID NO: 380575 - protein, 9 aa, Homo Sapiens
TPNMSVASS

SEQ ID NO: 380576 - protein, 9 aa, Homo Sapiens
DEPLLRPAT

SEQ ID NO: 380577 - protein, 9 aa, Homo Sapiens
RYHPSLITQ

SEQ ID NO: 380578 - protein, 9 aa, Homo Sapiens
KDHLVWQIL

SEQ ID NO: 380579 - protein, 9 aa, Homo Sapiens
TEIRAKGPI

SEQ ID NO: 380580 - protein, 9 aa, Homo Sapiens
SPTSSVVGI

SEQ ID NO: 380581 - protein, 9 aa, Homo Sapiens
FMYFEGYNV

SEQ ID NO: 380582 - protein, 9 aa, Homo Sapiens
ENLAYAELE

SEQ ID NO: 380583 - protein, 9 aa, Homo Sapiens
PQLVDSGTW

SEQ ID NO: 380584 - protein, 9 aa, Homo Sapiens
KNSCLAQAW

SEQ ID NO: 380585 - protein, 9 aa, Homo Sapiens
IMRRFRTEM

SEQ ID NO: 380586 - protein, 9 aa, Homo Sapiens
FDAYPNTLE

SEQ ID NO: 380587 - protein, 9 aa, Homo Sapiens
YNGGVKIPE

SEQ ID NO: 380588 - protein, 9 aa, Homo Sapiens
GRTYFRRKP

SEQ ID NO: 380589 - protein, 9 aa, Homo Sapiens
IGLVASETK

SEQ ID NO: 380590 - protein, 9 aa, Homo Sapiens
IFLCQKWND

SEQ ID NO: 380591 - protein, 9 aa, Homo Sapiens
ETGPPFHLN

SEQ ID NO: 380592 - protein, 9 aa, Homo Sapiens
INPKPCTPR

SEQ ID NO: 380593 - protein, 9 aa, Homo Sapiens
DCLFYEGIK

SEQ ID NO: 380594 - protein, 9 aa, Homo Sapiens
FNTDKNIDK

SEQ ID NO: 380595 - protein, 9 aa, Homo Sapiens
CTKSVGPWK

SEQ ID NO: 380596 - protein, 9 aa, Homo Sapiens
KLGGGVSIV

SEQ ID NO: 380597 - protein, 9 aa, Homo Sapiens
IKCHGRGTC

SEQ ID NO: 380598 - protein, 9 aa, Homo Sapiens
IKCSTSSLL

SEQ ID NO: 380599 - protein, 9 aa, Homo Sapiens
SSRFGKFIH

SEQ ID NO: 380600 - protein, 9 aa, Homo Sapiens
IGCGVRSIT

SEQ ID NO: 380601 - protein, 9 aa, Homo Sapiens
KDLLNESIK

SEQ ID NO: 380602 - protein, 9 aa, Homo Sapiens
TIVSPAYTP

SEQ ID NO: 380603 - protein, 9 aa, Homo Sapiens
EEDTSNEGE

SEQ ID NO: 380604 - protein, 9 aa, Homo Sapiens
PVVHGDSIV

SEQ ID NO: 380605 - protein, 9 aa, Homo Sapiens
ESVVDFSKW

SEQ ID NO: 380606 - protein, 9 aa, Homo Sapiens
LLVTFVAQN

SEQ ID NO: 380607 - protein, 9 aa, Homo Sapiens
HIFWVYRSS

SEQ ID NO: 380608 - protein, 9 aa, Homo Sapiens
RFYTRYSLK

SEQ ID NO: 380609 - protein, 9 aa, Homo Sapiens
PMLDLYSDK

SEQ ID NO: 380610 - protein, 9 aa, Homo Sapiens
ITFYEEVTS

SEQ ID NO: 380611 - protein, 9 aa, Homo Sapiens
LYVLFGVGS

SEQ ID NO: 380612 - protein, 9 aa, Homo Sapiens
LRHTNSAKP

SEQ ID NO: 380613 - protein, 9 aa, Homo Sapiens
LSILSGFSG

SEQ ID NO: 380614 - protein, 9 aa, Homo Sapiens
NLLRGDNSR

SEQ ID NO: 380615 - protein, 9 aa, Homo Sapiens
LSGACTQLF

SEQ ID NO: 380616 - protein, 9 aa, Homo Sapiens
SPAGSKLCL

SEQ ID NO: 380617 - protein, 9 aa, Homo Sapiens
DSLIKLKES

SEQ ID NO: 380618 - protein, 9 aa, Homo Sapiens
VSSCPALYQ

SEQ ID NO: 380619 - protein, 9 aa, Homo Sapiens
ASMTVWELF

SEQ ID NO: 380620 - protein, 9 aa, Homo Sapiens
VRHFQAQLP

SEQ ID NO: 380621 - protein, 9 aa, Homo Sapiens
YEYADFPHM

SEQ ID NO: 380622 - protein, 9 aa, Homo Sapiens
SLVPISHPS

SEQ ID NO: 380623 - protein, 9 aa, Homo Sapiens
HQQYHHNMT

SEQ ID NO: 380624 - protein, 9 aa, Homo Sapiens
ATGDGKCID

SEQ ID NO: 380625 - protein, 9 aa, Homo Sapiens
VGVIIFEML

SEQ ID NO: 380626 - protein, 9 aa, Homo Sapiens
IRISTSIID

SEQ ID NO: 380627 - protein, 9 aa, Homo Sapiens
PVDLCETDK

SEQ ID NO: 380628 - protein, 9 aa, Homo Sapiens
FQKIIPDRM

SEQ ID NO: 380629 - protein, 9 aa, Homo Sapiens
SGFGRSSSS

SEQ ID NO: 380630 - protein, 9 aa, Homo Sapiens
TAGSADTHS

SEQ ID NO: 380631 - protein, 9 aa, Homo Sapiens
SHKSIATVV

SEQ ID NO: 380632 - protein, 9 aa, Homo Sapiens
DYEITIHSL

SEQ ID NO: 380633 - protein, 9 aa, Homo Sapiens
ERFLLLCVH

SEQ ID NO: 380634 - protein, 9 aa, Homo Sapiens
YSCEVCGQS

SEQ ID NO: 380635 - protein, 9 aa, Homo Sapiens
NIHNTYSTD

SEQ ID NO: 380636 - protein, 9 aa, Homo Sapiens
INSFCKILG

SEQ ID NO: 380637 - protein, 9 aa, Homo Sapiens
QICLYCVTV

SEQ ID NO: 380638 - protein, 9 aa, Homo Sapiens
LEVICPEML

SEQ ID NO: 380639 - protein, 9 aa, Homo Sapiens
SMRLGKDTI

SEQ ID NO: 380640 - protein, 9 aa, Homo Sapiens
PDVLKDDFE

SEQ ID NO: 380641 - protein, 9 aa, Homo Sapiens
SCRKKLARP

SEQ ID NO: 380642 - protein, 9 aa, Homo Sapiens
DDLTSNDTF

SEQ ID NO: 380643 - protein, 9 aa, Homo Sapiens
YFADRMKWI

SEQ ID NO: 380644 - protein, 9 aa, Homo Sapiens
EISYHIFYQ

SEQ ID NO: 380645 - protein, 9 aa, Homo Sapiens
PDPQMDLLA

SEQ ID NO: 380646 - protein, 9 aa, Homo Sapiens
CYGQKPEVP

SEQ ID NO: 380647 - protein, 9 aa, Homo Sapiens
LCHKLRYWK

SEQ ID NO: 380648 - protein, 9 aa, Homo Sapiens
WMDADTQIF

SEQ ID NO: 380649 - protein, 9 aa, Homo Sapiens
DIAYIRKAL

SEQ ID NO: 380650 - protein, 9 aa, Homo Sapiens
EEEELQHRI

SEQ ID NO: 380651 - protein, 9 aa, Homo Sapiens
QVTATPQIA

SEQ ID NO: 380652 - protein, 9 aa, Homo Sapiens
DDIAYIRKA

SEQ ID NO: 380653 - protein, 9 aa, Homo Sapiens
HKSIATVVP

SEQ ID NO: 380654 - protein, 9 aa, Homo Sapiens
KYLEIQGIT

SEQ ID NO: 380655 - protein, 9 aa, Homo Sapiens
SDTQTVGAH

SEQ ID NO: 380656 - protein, 9 aa, Homo Sapiens
SQINYLVQT

SEQ ID NO: 380657 - protein, 9 aa, Homo Sapiens
PEQNIKYSF

SEQ ID NO: 380658 - protein, 9 aa, Homo Sapiens
TPRRFLAWG

SEQ ID NO: 380659 - protein, 9 aa, Homo Sapiens
FHQELLVIF

SEQ ID NO: 380660 - protein, 9 aa, Homo Sapiens
NHTHLLLHT

SEQ ID NO: 380661 - protein, 9 aa, Homo Sapiens
QSVVRIMQK

SEQ ID NO: 380662 - protein, 9 aa, Homo Sapiens
IVQKSHNNC

SEQ ID NO: 380663 - protein, 9 aa, Homo Sapiens
SFFAPSWDM

SEQ ID NO: 380664 - protein, 9 aa, Homo Sapiens
RRLLVKKID

SEQ ID NO: 380665 - protein, 9 aa, Homo Sapiens
SSNLIVHKI

SEQ ID NO: 380666 - protein, 9 aa, Homo Sapiens
HPPLTAYHS

SEQ ID NO: 380667 - protein, 9 aa, Homo Sapiens
ESEEKVGIP

SEQ ID NO: 380668 - protein, 9 aa, Homo Sapiens
KKLNLQNAS

SEQ ID NO: 380669 - protein, 9 aa, Homo Sapiens
NESETQMLS

SEQ ID NO: 380670 - protein, 9 aa, Homo Sapiens
RFVEFQVCD

SEQ ID NO: 380671 - protein, 9 aa, Homo Sapiens
SLESPVVYL

SEQ ID NO: 380672 - protein, 9 aa, Homo Sapiens
DSFNKTAPI

SEQ ID NO: 380673 - protein, 9 aa, Homo Sapiens
YEYIRVSSE

SEQ ID NO: 380674 - protein, 9 aa, Homo Sapiens
PASELNLQH

SEQ ID NO: 380675 - protein, 9 aa, Homo Sapiens
KHLITHTGE

SEQ ID NO: 380676 - protein, 9 aa, Homo Sapiens
GGEQYEIYF

SEQ ID NO: 380677 - protein, 9 aa, Homo Sapiens
TRVVTVSQI

SEQ ID NO: 380678 - protein, 9 aa, Homo Sapiens
KGERELCRE

SEQ ID NO: 380679 - protein, 9 aa, Homo Sapiens
DLYSDKNAK

SEQ ID NO: 380680 - protein, 9 aa, Homo Sapiens
CKRLWRLIS

SEQ ID NO: 380681 - protein, 9 aa, Homo Sapiens
AQCGLGLGV

SEQ ID NO: 380682 - protein, 9 aa, Homo Sapiens
NNLNMENDP

SEQ ID NO: 380683 - protein, 9 aa, Homo Sapiens
LNLINDLQA

SEQ ID NO: 380684 - protein, 9 aa, Homo Sapiens
INVFGAILF

SEQ ID NO: 380685 - protein, 9 aa, Homo Sapiens
RWGRQAGGT

SEQ ID NO: 380686 - protein, 9 aa, Homo Sapiens
LGVGSSTKM

SEQ ID NO: 380687 - protein, 9 aa, Homo Sapiens
LEIRETYFQ

SEQ ID NO: 380688 - protein, 9 aa, Homo Sapiens
ANYASIRRW

SEQ ID NO: 380689 - protein, 9 aa, Homo Sapiens
LAWELGKVK

SEQ ID NO: 380690 - protein, 9 aa, Homo Sapiens
VVNAQELQS

SEQ ID NO: 380691 - protein, 9 aa, Homo Sapiens
VKKLNPNLL

SEQ ID NO: 380692 - protein, 9 aa, Homo Sapiens
DIFAHKEME

SEQ ID NO: 380693 - protein, 9 aa, Homo Sapiens
PPGVWSGGS

SEQ ID NO: 380694 - protein, 9 aa, Homo Sapiens
KDTIVFTKN

SEQ ID NO: 380695 - protein, 9 aa, Homo Sapiens
EDKSKIVCV

SEQ ID NO: 380696 - protein, 9 aa, Homo Sapiens
EALQEESKA

SEQ ID NO: 380697 - protein, 9 aa, Homo Sapiens
RNQDKFSSI

SEQ ID NO: 380698 - protein, 9 aa, Homo Sapiens
DNFNQQQKN

SEQ ID NO: 380699 - protein, 9 aa, Homo Sapiens
TLFQRSGDQ

SEQ ID NO: 380700 - protein, 9 aa, Homo Sapiens
FQTDSSPGP

SEQ ID NO: 380701 - protein, 9 aa, Homo Sapiens
RMGVGFISM

SEQ ID NO: 380702 - protein, 9 aa, Homo Sapiens
QILLELDMQ

SEQ ID NO: 380703 - protein, 9 aa, Homo Sapiens
HINSEHIHE

SEQ ID NO: 380704 - protein, 9 aa, Homo Sapiens
HTQTLPLMW

SEQ ID NO: 380705 - protein, 9 aa, Homo Sapiens
GLCHCKSSQ

SEQ ID NO: 380706 - protein, 9 aa, Homo Sapiens
LFYDISKKA

SEQ ID NO: 380707 - protein, 9 aa, Homo Sapiens
KYLKVKLDH

SEQ ID NO: 380708 - protein, 9 aa, Homo Sapiens
TRQPVSVQL

SEQ ID NO: 380709 - protein, 9 aa, Homo Sapiens
ASTNGTCII

SEQ ID NO: 380710 - protein, 9 aa, Homo Sapiens
HSSQKTLHS

SEQ ID NO: 380711 - protein, 9 aa, Homo Sapiens
IIPDRMKAA

SEQ ID NO: 380712 - protein, 9 aa, Homo Sapiens
HAINLYGED

SEQ ID NO: 380713 - protein, 9 aa, Homo Sapiens
IRKARVEDH

SEQ ID NO: 380714 - protein, 9 aa, Homo Sapiens
GFREMSRNL

SEQ ID NO: 380715 - protein, 9 aa, Homo Sapiens
VFTEKQRLW

SEQ ID NO: 380716 - protein, 9 aa, Homo Sapiens
VVFDSKFIE

SEQ ID NO: 380717 - protein, 9 aa, Homo Sapiens
DCGQSFSRY

SEQ ID NO: 380718 - protein, 9 aa, Homo Sapiens
LETLINIIQ

SEQ ID NO: 380719 - protein, 9 aa, Homo Sapiens
YLCGISACT

SEQ ID NO: 380720 - protein, 9 aa, Homo Sapiens
KTVGEGQVL

SEQ ID NO: 380721 - protein, 9 aa, Homo Sapiens
IFCPFLCHL

SEQ ID NO: 380722 - protein, 9 aa, Homo Sapiens
SLNGIYVGS

SEQ ID NO: 380723 - protein, 9 aa, Homo Sapiens
PTVQRKYIQ

SEQ ID NO: 380724 - protein, 9 aa, Homo Sapiens
WNKHDSEEK

SEQ ID NO: 380725 - protein, 9 aa, Homo Sapiens
TLKSHMQTH

SEQ ID NO: 380726 - protein, 9 aa, Homo Sapiens
QNAGIVLGP

SEQ ID NO: 380727 - protein, 9 aa, Homo Sapiens
RNAKFDNKI

SEQ ID NO: 380728 - protein, 9 aa, Homo Sapiens
RHQADNLLM

SEQ ID NO: 380729 - protein, 9 aa, Homo Sapiens
HMFNRMVIY

SEQ ID NO: 380730 - protein, 9 aa, Homo Sapiens
TKTNQIYRI

SEQ ID NO: 380731 - protein, 9 aa, Homo Sapiens
RCSFQARPA

SEQ ID NO: 380732 - protein, 9 aa, Homo Sapiens
PTYQEAPPV

SEQ ID NO: 380733 - protein, 9 aa, Homo Sapiens
EDLFIISKV

SEQ ID NO: 380734 - protein, 9 aa, Homo Sapiens
RVEWGKIWR

SEQ ID NO: 380735 - protein, 9 aa, Homo Sapiens
HDDELEESD

SEQ ID NO: 380736 - protein, 9 aa, Homo Sapiens
LVEDPQLNL

SEQ ID NO: 380737 - protein, 9 aa, Homo Sapiens
YIYFKALWD

SEQ ID NO: 380738 - protein, 9 aa, Homo Sapiens
DGNMDSCFN

SEQ ID NO: 380739 - protein, 9 aa, Homo Sapiens
MLDKEGRLF

SEQ ID NO: 380740 - protein, 9 aa, Homo Sapiens
REKKLKLTD

SEQ ID NO: 380741 - protein, 9 aa, Homo Sapiens
REELDADEY

SEQ ID NO: 380742 - protein, 9 aa, Homo Sapiens
FQARPAPSL

SEQ ID NO: 380743 - protein, 9 aa, Homo Sapiens
EVVYYWTLG

SEQ ID NO: 380744 - protein, 9 aa, Homo Sapiens
FTLEGFPTE

SEQ ID NO: 380745 - protein, 9 aa, Homo Sapiens
DAYTSLGQA

SEQ ID NO: 380746 - protein, 9 aa, Homo Sapiens
ALNRLFDNV

SEQ ID NO: 380747 - protein, 9 aa, Homo Sapiens
VLDAIMQEL

SEQ ID NO: 380748 - protein, 9 aa, Homo Sapiens
LFMAATFSP

SEQ ID NO: 380749 - protein, 9 aa, Homo Sapiens
LTDFYCEKN

SEQ ID NO: 380750 - protein, 9 aa, Homo Sapiens
ACRTLPSAE

SEQ ID NO: 380751 - protein, 9 aa, Homo Sapiens
NVNKKAVAF

SEQ ID NO: 380752 - protein, 9 aa, Homo Sapiens
LVAFDPEGS

SEQ ID NO: 380753 - protein, 9 aa, Homo Sapiens
LLLVPKMLD

SEQ ID NO: 380754 - protein, 9 aa, Homo Sapiens
LTVYKPELI

SEQ ID NO: 380755 - protein, 9 aa, Homo Sapiens
VRLLNLGVL

SEQ ID NO: 380756 - protein, 9 aa, Homo Sapiens
AAIPTRAAS

SEQ ID NO: 380757 - protein, 9 aa, Homo Sapiens
FDINSFCKI

SEQ ID NO: 380758 - protein, 9 aa, Homo Sapiens
FSCHAINLY

SEQ ID NO: 380759 - protein, 9 aa, Homo Sapiens
QIRMATISE

SEQ ID NO: 380760 - protein, 9 aa, Homo Sapiens
ALKTVYVIP

SEQ ID NO: 380761 - protein, 9 aa, Homo Sapiens
GSWTKVGSC

SEQ ID NO: 380762 - protein, 9 aa, Homo Sapiens
ACVDTYVMG

SEQ ID NO: 380763 - protein, 9 aa, Homo Sapiens
VYIGKIYHY

SEQ ID NO: 380764 - protein, 9 aa, Homo Sapiens
HCSYICDEG

SEQ ID NO: 380765 - protein, 9 aa, Homo Sapiens
ELSVPSSNV

SEQ ID NO: 380766 - protein, 9 aa, Homo Sapiens
REFLRNKLI

SEQ ID NO: 380767 - protein, 9 aa, Homo Sapiens
LMARFSEDT

SEQ ID NO: 380768 - protein, 9 aa, Homo Sapiens
SAFEYFSRS

SEQ ID NO: 380769 - protein, 9 aa, Homo Sapiens
HYLGGGPPT

SEQ ID NO: 380770 - protein, 9 aa, Homo Sapiens
SLPIRHIWL

SEQ ID NO: 380771 - protein, 9 aa, Homo Sapiens
SNDNEGNRK

SEQ ID NO: 380772 - protein, 9 aa, Homo Sapiens
VWPNPDLVH

SEQ ID NO: 380773 - protein, 9 aa, Homo Sapiens
KKTVLVGRR

SEQ ID NO: 380774 - protein, 9 aa, Homo Sapiens
MLKNHLQND

SEQ ID NO: 380775 - protein, 9 aa, Homo Sapiens
EPEVQYQII

SEQ ID NO: 380776 - protein, 9 aa, Homo Sapiens
SSPSAITLS

SEQ ID NO: 380777 - protein, 9 aa, Homo Sapiens
AITFIRPSR

SEQ ID NO: 380778 - protein, 9 aa, Homo Sapiens
TSSDKSLTP

SEQ ID NO: 380779 - protein, 9 aa, Homo Sapiens
KNKEMGNSM

SEQ ID NO: 380780 - protein, 9 aa, Homo Sapiens
DVMPFLFDF

SEQ ID NO: 380781 - protein, 9 aa, Homo Sapiens
KHQNLAALV

SEQ ID NO: 380782 - protein, 9 aa, Homo Sapiens
HIHEERKEF

SEQ ID NO: 380783 - protein, 9 aa, Homo Sapiens
VDSIQGEEV

SEQ ID NO: 380784 - protein, 9 aa, Homo Sapiens
HKVFCEITQ

SEQ ID NO: 380785 - protein, 9 aa, Homo Sapiens
PPADTELQA

SEQ ID NO: 380786 - protein, 9 aa, Homo Sapiens
PGEEAEVEK

SEQ ID NO: 380787 - protein, 9 aa, Homo Sapiens
CCKRLWRLI

SEQ ID NO: 380788 - protein, 9 aa, Homo Sapiens
SKGERELCR

SEQ ID NO: 380789 - protein, 9 aa, Homo Sapiens
HTHKLLVME

SEQ ID NO: 380790 - protein, 9 aa, Homo Sapiens
MKHIHPHIN

SEQ ID NO: 380791 - protein, 9 aa, Homo Sapiens
NDKKVRVFT

SEQ ID NO: 380792 - protein, 9 aa, Homo Sapiens
IIGCHAYGD

SEQ ID NO: 380793 - protein, 9 aa, Homo Sapiens
NIFKELTQN

SEQ ID NO: 380794 - protein, 9 aa, Homo Sapiens
SWRWIMLII

SEQ ID NO: 380795 - protein, 9 aa, Homo Sapiens
GTNQEFGVE

SEQ ID NO: 380796 - protein, 9 aa, Homo Sapiens
KRVSPYSYL

SEQ ID NO: 380797 - protein, 9 aa, Homo Sapiens
KYIQIPMSF

SEQ ID NO: 380798 - protein, 9 aa, Homo Sapiens
FNEFLLFIC

SEQ ID NO: 380799 - protein, 9 aa, Homo Sapiens
NNKWYIFND

SEQ ID NO: 380800 - protein, 9 aa, Homo Sapiens
YTGLAIHIQ

SEQ ID NO: 380801 - protein, 9 aa, Homo Sapiens
FPVGYEYAD

SEQ ID NO: 380802 - protein, 9 aa, Homo Sapiens
KSQEESRIY

SEQ ID NO: 380803 - protein, 9 aa, Homo Sapiens
CKTEVNITF

SEQ ID NO: 380804 - protein, 9 aa, Homo Sapiens
NGINVKKCR

SEQ ID NO: 380805 - protein, 9 aa, Homo Sapiens
NHKDSRCDR

SEQ ID NO: 380806 - protein, 9 aa, Homo Sapiens
YYTNGAYGP

SEQ ID NO: 380807 - protein, 9 aa, Homo Sapiens
TKGHKGKNC

SEQ ID NO: 380808 - protein, 9 aa, Homo Sapiens
ANEDTAHGI

SEQ ID NO: 380809 - protein, 9 aa, Homo Sapiens
ADTQIFFSF

SEQ ID NO: 380810 - protein, 9 aa, Homo Sapiens
VETKLFHSE

SEQ ID NO: 380811 - protein, 9 aa, Homo Sapiens
RIQKQFFHS

SEQ ID NO: 380812 - protein, 9 aa, Homo Sapiens
DSTGACPPH

SEQ ID NO: 380813 - protein, 9 aa, Homo Sapiens
DHPDITCGD

SEQ ID NO: 380814 - protein, 9 aa, Homo Sapiens
ATQIPAVKE

SEQ ID NO: 380815 - protein, 9 aa, Homo Sapiens
RAKVCGKIG

SEQ ID NO: 380816 - protein, 9 aa, Homo Sapiens
DTILKDADI

SEQ ID NO: 380817 - protein, 9 aa, Homo Sapiens
QMYTTDQEQ

SEQ ID NO: 380818 - protein, 9 aa, Homo Sapiens
VVPGGKCPV

SEQ ID NO: 380819 - protein, 9 aa, Homo Sapiens
KYSIIMNRC

SEQ ID NO: 380820 - protein, 9 aa, Homo Sapiens
KGVIHDWRK

SEQ ID NO: 380821 - protein, 9 aa, Homo Sapiens
LHAILQNSA

SEQ ID NO: 380822 - protein, 9 aa, Homo Sapiens
VVCLHWFPY

SEQ ID NO: 380823 - protein, 9 aa, Homo Sapiens
QQQKNLGGQ

SEQ ID NO: 380824 - protein, 9 aa, Homo Sapiens
DLYLTYVTE

SEQ ID NO: 380825 - protein, 9 aa, Homo Sapiens
LNKYSVAQQ

SEQ ID NO: 380826 - protein, 9 aa, Homo Sapiens
LKLHAILQN

SEQ ID NO: 380827 - protein, 9 aa, Homo Sapiens
THKLLVMEG

SEQ ID NO: 380828 - protein, 9 aa, Homo Sapiens
GDIIHYIFN

SEQ ID NO: 380829 - protein, 9 aa, Homo Sapiens
IHEERKEFV

SEQ ID NO: 380830 - protein, 9 aa, Homo Sapiens
LCIVELTLP

SEQ ID NO: 380831 - protein, 9 aa, Homo Sapiens
GFNSLSLDK

SEQ ID NO: 380832 - protein, 9 aa, Homo Sapiens
TKPSFTQDH

SEQ ID NO: 380833 - protein, 9 aa, Homo Sapiens
VVPLVLTSR

SEQ ID NO: 380834 - protein, 9 aa, Homo Sapiens
LLRSPIQMK

SEQ ID NO: 380835 - protein, 9 aa, Homo Sapiens
VIHHYIKPS

SEQ ID NO: 380836 - protein, 9 aa, Homo Sapiens
FCFILLFVW

SEQ ID NO: 380837 - protein, 9 aa, Homo Sapiens
YRFLLMARF

SEQ ID NO: 380838 - protein, 9 aa, Homo Sapiens
NLLAENFIF

SEQ ID NO: 380839 - protein, 9 aa, Homo Sapiens
STLIIHEQI

SEQ ID NO: 380840 - protein, 9 aa, Homo Sapiens
QIIKLNCLN

SEQ ID NO: 380841 - protein, 9 aa, Homo Sapiens
WSGGSTDSE

SEQ ID NO: 380842 - protein, 9 aa, Homo Sapiens
KFHDAETDQ

SEQ ID NO: 380843 - protein, 9 aa, Homo Sapiens
LKLKRHLET

SEQ ID NO: 380844 - protein, 9 aa, Homo Sapiens
NFNQQQKNL

SEQ ID NO: 380845 - protein, 9 aa, Homo Sapiens
EELEFEVPC

SEQ ID NO: 380846 - protein, 9 aa, Homo Sapiens
GTLMIPIQD

SEQ ID NO: 380847 - protein, 9 aa, Homo Sapiens
AVNEWGRSG

SEQ ID NO: 380848 - protein, 9 aa, Homo Sapiens
FLLFICKVA

SEQ ID NO: 380849 - protein, 9 aa, Homo Sapiens
NVRMGVGFI

SEQ ID NO: 380850 - protein, 9 aa, Homo Sapiens
TFPTQEEIE

SEQ ID NO: 380851 - protein, 9 aa, Homo Sapiens
GLLCCNCPS

SEQ ID NO: 380852 - protein, 9 aa, Homo Sapiens
DLQDNPWDC

SEQ ID NO: 380853 - protein, 9 aa, Homo Sapiens
LNHLLWNPD

SEQ ID NO: 380854 - protein, 9 aa, Homo Sapiens
TAHGIASED

SEQ ID NO: 380855 - protein, 9 aa, Homo Sapiens
YIHIKIQQR

SEQ ID NO: 380856 - protein, 9 aa, Homo Sapiens
MTLQCTKSV

SEQ ID NO: 380857 - protein, 9 aa, Homo Sapiens
LLRHHIIHS

SEQ ID NO: 380858 - protein, 9 aa, Homo Sapiens
LRKRLRKTR

SEQ ID NO: 380859 - protein, 9 aa, Homo Sapiens
GEGAGTSFL

SEQ ID NO: 380860 - protein, 9 aa, Homo Sapiens
MDQTYCSKM

SEQ ID NO: 380861 - protein, 9 aa, Homo Sapiens
EEERQINKE

SEQ ID NO: 380862 - protein, 9 aa, Homo Sapiens
PINLTKGKS

SEQ ID NO: 380863 - protein, 9 aa, Homo Sapiens
ETSEHFCID

SEQ ID NO: 380864 - protein, 9 aa, Homo Sapiens
NAEESNTGD

SEQ ID NO: 380865 - protein, 9 aa, Homo Sapiens
GTHRGLYTS

SEQ ID NO: 380866 - protein, 9 aa, Homo Sapiens
AVGSQSPEE

SEQ ID NO: 380867 - protein, 9 aa, Homo Sapiens
SKFIESLNC

SEQ ID NO: 380868 - protein, 9 aa, Homo Sapiens
DNKYLIQGK

SEQ ID NO: 380869 - protein, 9 aa, Homo Sapiens
GACRTLPSA

SEQ ID NO: 380870 - protein, 9 aa, Homo Sapiens
NRTLNVSKG

SEQ ID NO: 380871 - protein, 9 aa, Homo Sapiens
RSVEWERLG

SEQ ID NO: 380872 - protein, 9 aa, Homo Sapiens
TKIILDHEK

SEQ ID NO: 380873 - protein, 9 aa, Homo Sapiens
SSSPSAITL

SEQ ID NO: 380874 - protein, 9 aa, Homo Sapiens
ALRNAKFDN

SEQ ID NO: 380875 - protein, 9 aa, Homo Sapiens
PNLKEEGGL

SEQ ID NO: 380876 - protein, 9 aa, Homo Sapiens
GDIQPGVNR

SEQ ID NO: 380877 - protein, 9 aa, Homo Sapiens
LQKLVLPEY

SEQ ID NO: 380878 - protein, 9 aa, Homo Sapiens
ALWDKPFIS

SEQ ID NO: 380879 - protein, 9 aa, Homo Sapiens
SVVGITTQS

SEQ ID NO: 380880 - protein, 9 aa, Homo Sapiens
GQNYKACMR

SEQ ID NO: 380881 - protein, 9 aa, Homo Sapiens
NKLTRKQGD

SEQ ID NO: 380882 - protein, 9 aa, Homo Sapiens
MEEMKKTVI

SEQ ID NO: 380883 - protein, 9 aa, Homo Sapiens
SRVQFQNQG

SEQ ID NO: 380884 - protein, 9 aa, Homo Sapiens
HVGIAWAKT

SEQ ID NO: 380885 - protein, 9 aa, Homo Sapiens
IAANISIGA

SEQ ID NO: 380886 - protein, 9 aa, Homo Sapiens
KNNKWYIFN

SEQ ID NO: 380887 - protein, 9 aa, Homo Sapiens
HHIALDLIS

SEQ ID NO: 380888 - protein, 9 aa, Homo Sapiens
VGNEFITKG

SEQ ID NO: 380889 - protein, 9 aa, Homo Sapiens
GHGECVSGP

SEQ ID NO: 380890 - protein, 9 aa, Homo Sapiens
IVGLEDGKL

SEQ ID NO: 380891 - protein, 9 aa, Homo Sapiens
YSAFGERDT

SEQ ID NO: 380892 - protein, 9 aa, Homo Sapiens
VKQNSLYYF

SEQ ID NO: 380893 - protein, 9 aa, Homo Sapiens
YQEAPPVRE

SEQ ID NO: 380894 - protein, 9 aa, Homo Sapiens
NPSICAITL

SEQ ID NO: 380895 - protein, 9 aa, Homo Sapiens
DSNNLKTKQ

SEQ ID NO: 380896 - protein, 9 aa, Homo Sapiens
LELTFRKLI

SEQ ID NO: 380897 - protein, 9 aa, Homo Sapiens
LTVGKRKQN

SEQ ID NO: 380898 - protein, 9 aa, Homo Sapiens
QTHQIIHTG

SEQ ID NO: 380899 - protein, 9 aa, Homo Sapiens
LLVGVTVMP

SEQ ID NO: 380900 - protein, 9 aa, Homo Sapiens
KCGKGFSKT

SEQ ID NO: 380901 - protein, 9 aa, Homo Sapiens
EKVGIPASL

SEQ ID NO: 380902 - protein, 9 aa, Homo Sapiens
TDFAPGIWL

SEQ ID NO: 380903 - protein, 9 aa, Homo Sapiens
DSNEKMEKK

SEQ ID NO: 380904 - protein, 9 aa, Homo Sapiens
HQQFPFLEM

SEQ ID NO: 380905 - protein, 9 aa, Homo Sapiens
LRGLGDIQP

SEQ ID NO: 380906 - protein, 9 aa, Homo Sapiens
LVCRLKLCD

SEQ ID NO: 380907 - protein, 9 aa, Homo Sapiens
NPTYQEAPP

SEQ ID NO: 380908 - protein, 9 aa, Homo Sapiens
LVMEGQAAT

SEQ ID NO: 380909 - protein, 9 aa, Homo Sapiens
QKERFLLLC

SEQ ID NO: 380910 - protein, 9 aa, Homo Sapiens
KKEGYNLLT

SEQ ID NO: 380911 - protein, 9 aa, Homo Sapiens
LETIILSER

SEQ ID NO: 380912 - protein, 9 aa, Homo Sapiens
RMHLKSEVI

SEQ ID NO: 380913 - protein, 9 aa, Homo Sapiens
MRQIGWNRI

SEQ ID NO: 380914 - protein, 9 aa, Homo Sapiens
LQCTKSVGP

SEQ ID NO: 380915 - protein, 9 aa, Homo Sapiens
FFFFPFFFL

SEQ ID NO: 380916 - protein, 9 aa, Homo Sapiens
TSELFLPVL

SEQ ID NO: 380917 - protein, 9 aa, Homo Sapiens
HNIKEAIKR

SEQ ID NO: 380918 - protein, 9 aa, Homo Sapiens
EVGSDCGFL

SEQ ID NO: 380919 - protein, 9 aa, Homo Sapiens
HQILHRREK

SEQ ID NO: 380920 - protein, 9 aa, Homo Sapiens
GLPLAIQNA

SEQ ID NO: 380921 - protein, 9 aa, Homo Sapiens
QIHNPLYPV

SEQ ID NO: 380922 - protein, 9 aa, Homo Sapiens
VRSCRKKLA

SEQ ID NO: 380923 - protein, 9 aa, Homo Sapiens
ENVDSIQGE

SEQ ID NO: 380924 - protein, 9 aa, Homo Sapiens
GSADTHSNG

SEQ ID NO: 380925 - protein, 9 aa, Homo Sapiens
QLNNLNMEN

SEQ ID NO: 380926 - protein, 9 aa, Homo Sapiens
NPDLVHDDF

SEQ ID NO: 380927 - protein, 9 aa, Homo Sapiens
AIPSIIWYL

SEQ ID NO: 380928 - protein, 9 aa, Homo Sapiens
TDQEQLQEI

SEQ ID NO: 380929 - protein, 9 aa, Homo Sapiens
AYLYSHTMI

SEQ ID NO: 380930 - protein, 9 aa, Homo Sapiens
TYEEQNLVW

SEQ ID NO: 380931 - protein, 9 aa, Homo Sapiens
LADAKIIPS

SEQ ID NO: 380932 - protein, 9 aa, Homo Sapiens
NINLVNDQK

SEQ ID NO: 380933 - protein, 9 aa, Homo Sapiens
HPSLITQER

SEQ ID NO: 380934 - protein, 9 aa, Homo Sapiens
SESSSEDVK

SEQ ID NO: 380935 - protein, 9 aa, Homo Sapiens
CVSGPPDYS

SEQ ID NO: 380936 - protein, 9 aa, Homo Sapiens
SHSRKLILA

SEQ ID NO: 380937 - protein, 9 aa, Homo Sapiens
DDELEESDK

SEQ ID NO: 380938 - protein, 9 aa, Homo Sapiens
LLENVEYNI

SEQ ID NO: 380939 - protein, 9 aa, Homo Sapiens
VHLTQHQRS

SEQ ID NO: 380940 - protein, 9 aa, Homo Sapiens
EEPVRILSK

SEQ ID NO: 380941 - protein, 9 aa, Homo Sapiens
FEYLSPSSR

SEQ ID NO: 380942 - protein, 9 aa, Homo Sapiens
YKCPGMGNS

SEQ ID NO: 380943 - protein, 9 aa, Homo Sapiens
KNRTRSTSY

SEQ ID NO: 380944 - protein, 9 aa, Homo Sapiens
NRARNINNK

SEQ ID NO: 380945 - protein, 9 aa, Homo Sapiens
RVDVPFNLP

SEQ ID NO: 380946 - protein, 9 aa, Homo Sapiens
WFNVRMGVG

SEQ ID NO: 380947 - protein, 9 aa, Homo Sapiens
LSAVTMEWF

SEQ ID NO: 380948 - protein, 9 aa, Homo Sapiens
RHGRAPLQK

SEQ ID NO: 380949 - protein, 9 aa, Homo Sapiens
WPSSFRIHE

SEQ ID NO: 380950 - protein, 9 aa, Homo Sapiens
GILQLRHTN

SEQ ID NO: 380951 - protein, 9 aa, Homo Sapiens
GKIQMSVPV

SEQ ID NO: 380952 - protein, 9 aa, Homo Sapiens
QTKINSYIP

SEQ ID NO: 380953 - protein, 9 aa, Homo Sapiens
TSYWRRWTY

SEQ ID NO: 380954 - protein, 9 aa, Homo Sapiens
TNDGKRESL

SEQ ID NO: 380955 - protein, 9 aa, Homo Sapiens
RWLNNGVPL

SEQ ID NO: 380956 - protein, 9 aa, Homo Sapiens
ATINTYCSL

SEQ ID NO: 380957 - protein, 9 aa, Homo Sapiens
NPLKYSIIM

SEQ ID NO: 380958 - protein, 9 aa, Homo Sapiens
ADHGVSFDS

SEQ ID NO: 380959 - protein, 9 aa, Homo Sapiens
IFQTDSSPG

SEQ ID NO: 380960 - protein, 9 aa, Homo Sapiens
PLLLTYLSF

SEQ ID NO: 380961 - protein, 9 aa, Homo Sapiens
LTQHQRSHN

SEQ ID NO: 380962 - protein, 9 aa, Homo Sapiens
VIWEKLTGE

SEQ ID NO: 380963 - protein, 9 aa, Homo Sapiens
GALFSSFEI

SEQ ID NO: 380964 - protein, 9 aa, Homo Sapiens
WALSFKTGI

SEQ ID NO: 380965 - protein, 9 aa, Homo Sapiens
RHSWKDLFQ

SEQ ID NO: 380966 - protein, 9 aa, Homo Sapiens
RTIQLIKDL

SEQ ID NO: 380967 - protein, 9 aa, Homo Sapiens
RYSLGQVYK

SEQ ID NO: 380968 - protein, 9 aa, Homo Sapiens
ASLFLDVVY

SEQ ID NO: 380969 - protein, 9 aa, Homo Sapiens
QKKKQNNGK

SEQ ID NO: 380970 - protein, 9 aa, Homo Sapiens
DAVTSSGTA

SEQ ID NO: 380971 - protein, 9 aa, Homo Sapiens
SSSPSAAAG

SEQ ID NO: 380972 - protein, 9 aa, Homo Sapiens
VLKKIAKAG

SEQ ID NO: 380973 - protein, 9 aa, Homo Sapiens
IYLHYRSTL

SEQ ID NO: 380974 - protein, 9 aa, Homo Sapiens
VFTPNKPLR

SEQ ID NO: 380975 - protein, 9 aa, Homo Sapiens
RRKKHDYHI

SEQ ID NO: 380976 - protein, 9 aa, Homo Sapiens
FRYHPSLIT

SEQ ID NO: 380977 - protein, 9 aa, Homo Sapiens
FSKWYMDYS

SEQ ID NO: 380978 - protein, 9 aa, Homo Sapiens
DYFQEIRAN

SEQ ID NO: 380979 - protein, 9 aa, Homo Sapiens
RAITFIRPS

SEQ ID NO: 380980 - protein, 9 aa, Homo Sapiens
ADLNEWTND

SEQ ID NO: 380981 - protein, 9 aa, Homo Sapiens
IRYLEKAEV

SEQ ID NO: 380982 - protein, 9 aa, Homo Sapiens
EELWRMQEM

SEQ ID NO: 380983 - protein, 9 aa, Homo Sapiens
SSESKPSSS

SEQ ID NO: 380984 - protein, 9 aa, Homo Sapiens
LQNNNLLSM

SEQ ID NO: 380985 - protein, 9 aa, Homo Sapiens
YACARWFMG

SEQ ID NO: 380986 - protein, 9 aa, Homo Sapiens
YYVPLCIDG

SEQ ID NO: 380987 - protein, 9 aa, Homo Sapiens
ENYRNLVLL

SEQ ID NO: 380988 - protein, 9 aa, Homo Sapiens
FTEKQRLWW

SEQ ID NO: 380989 - protein, 9 aa, Homo Sapiens
ISVIKENSL

SEQ ID NO: 380990 - protein, 9 aa, Homo Sapiens
LVLRIRCRP

SEQ ID NO: 380991 - protein, 9 aa, Homo Sapiens
HYMIQILFT

SEQ ID NO: 380992 - protein, 9 aa, Homo Sapiens
YHRCVKLSS

SEQ ID NO: 380993 - protein, 9 aa, Homo Sapiens
APELTQGIS

SEQ ID NO: 380994 - protein, 9 aa, Homo Sapiens
DGFGIASRV

SEQ ID NO: 380995 - protein, 9 aa, Homo Sapiens
RYIYYGKNS

SEQ ID NO: 380996 - protein, 9 aa, Homo Sapiens
ISGEGAGTS

SEQ ID NO: 380997 - protein, 9 aa, Homo Sapiens
KDFWRKMFT

SEQ ID NO: 380998 - protein, 9 aa, Homo Sapiens
EFLRNKLIG

SEQ ID NO: 380999 - protein, 9 aa, Homo Sapiens
TAPIKGCKI

SEQ ID NO: 381000 - protein, 9 aa, Homo Sapiens
TTDEADPRW

SEQ ID NO: 381001 - protein, 9 aa, Homo Sapiens
TIGGNNNIA

SEQ ID NO: 381002 - protein, 9 aa, Homo Sapiens
LPTSWLNGS

SEQ ID NO: 381003 - protein, 9 aa, Homo Sapiens
LSSVTVPNM

SEQ ID NO: 381004 - protein, 9 aa, Homo Sapiens
LRLLYLSYN

SEQ ID NO: 381005 - protein, 9 aa, Homo Sapiens
GLWDDLVEG

SEQ ID NO: 381006 - protein, 9 aa, Homo Sapiens
MSFQKIIPD

SEQ ID NO: 381007 - protein, 9 aa, Homo Sapiens
DPMLDLYSD

SEQ ID NO: 381008 - protein, 9 aa, Homo Sapiens
YIYDYENNY

SEQ ID NO: 381009 - protein, 9 aa, Homo Sapiens
DDEISTQRM

SEQ ID NO: 381010 - protein, 9 aa, Homo Sapiens
KRPPLRELF

SEQ ID NO: 381011 - protein, 9 aa, Homo Sapiens
LENLQKNIL

SEQ ID NO: 381012 - protein, 9 aa, Homo Sapiens
PHYLGGGPP

SEQ ID NO: 381013 - protein, 9 aa, Homo Sapiens
LRPATQIRT

SEQ ID NO: 381014 - protein, 9 aa, Homo Sapiens
SPRHTPNIS

SEQ ID NO: 381015 - protein, 9 aa, Homo Sapiens
TVISEDYVV

SEQ ID NO: 381016 - protein, 9 aa, Homo Sapiens
QVAKIWFQQ

SEQ ID NO: 381017 - protein, 9 aa, Homo Sapiens
LSLCHPNII

SEQ ID NO: 381018 - protein, 9 aa, Homo Sapiens
SHNNCFPEI

SEQ ID NO: 381019 - protein, 9 aa, Homo Sapiens
KYLIQGKDL

SEQ ID NO: 381020 - protein, 9 aa, Homo Sapiens
HQILHTGVK

SEQ ID NO: 381021 - protein, 9 aa, Homo Sapiens
SSLVTLPGF

SEQ ID NO: 381022 - protein, 9 aa, Homo Sapiens
SRVLQDFQL

SEQ ID NO: 381023 - protein, 9 aa, Homo Sapiens
EADKLLTEK

SEQ ID NO: 381024 - protein, 9 aa, Homo Sapiens
EEWITTLEK

SEQ ID NO: 381025 - protein, 9 aa, Homo Sapiens
NHKTPSGEK

SEQ ID NO: 381026 - protein, 9 aa, Homo Sapiens
CCRSIQIGK

SEQ ID NO: 381027 - protein, 9 aa, Homo Sapiens
QLKAEISYH

SEQ ID NO: 381028 - protein, 9 aa, Homo Sapiens
WRKMFTSQS

SEQ ID NO: 381029 - protein, 9 aa, Homo Sapiens
APFPDIMAD

SEQ ID NO: 381030 - protein, 9 aa, Homo Sapiens
KRYCCNGKA

SEQ ID NO: 381031 - protein, 9 aa, Homo Sapiens
INTRFLSDI

SEQ ID NO: 381032 - protein, 9 aa, Homo Sapiens
HTLSVFRVE

SEQ ID NO: 381033 - protein, 9 aa, Homo Sapiens
DDDTMSKMK

SEQ ID NO: 381034 - protein, 9 aa, Homo Sapiens
IRAFMGVNN

SEQ ID NO: 381035 - protein, 9 aa, Homo Sapiens
CTGSSGYTA

SEQ ID NO: 381036 - protein, 9 aa, Homo Sapiens
RLVNIVPNK

SEQ ID NO: 381037 - protein, 9 aa, Homo Sapiens
SVEPEELGP

SEQ ID NO: 381038 - protein, 9 aa, Homo Sapiens
HFCSSSVSD

SEQ ID NO: 381039 - protein, 9 aa, Homo Sapiens
RKCQKIIGK

SEQ ID NO: 381040 - protein, 9 aa, Homo Sapiens
IFYVLLCFG

SEQ ID NO: 381041 - protein, 9 aa, Homo Sapiens
VEVVHIGHL

SEQ ID NO: 381042 - protein, 9 aa, Homo Sapiens
ALGETSNLP

SEQ ID NO: 381043 - protein, 9 aa, Homo Sapiens
KEKANMDMC

SEQ ID NO: 381044 - protein, 9 aa, Homo Sapiens
CSLSLVLEE

SEQ ID NO: 381045 - protein, 9 aa, Homo Sapiens
EKVCALNKL

SEQ ID NO: 381046 - protein, 9 aa, Homo Sapiens
FRPIKRITW

SEQ ID NO: 381047 - protein, 9 aa, Homo Sapiens
HCLHMFNRM

SEQ ID NO: 381048 - protein, 9 aa, Homo Sapiens
LSNIDIQIP

SEQ ID NO: 381049 - protein, 9 aa, Homo Sapiens
WLSYLKYVF

SEQ ID NO: 381050 - protein, 9 aa, Homo Sapiens
QVQRGPAQK

SEQ ID NO: 381051 - protein, 9 aa, Homo Sapiens
NSCQTTTYK

SEQ ID NO: 381052 - protein, 9 aa, Homo Sapiens
DPYLSAHAT

SEQ ID NO: 381053 - protein, 9 aa, Homo Sapiens
VGSQSPEEC

SEQ ID NO: 381054 - protein, 9 aa, Homo Sapiens
SQSDLGYAP

SEQ ID NO: 381055 - protein, 9 aa, Homo Sapiens
KELLGHPHH

SEQ ID NO: 381056 - protein, 9 aa, Homo Sapiens
NSAGGGGEP

SEQ ID NO: 381057 - protein, 9 aa, Homo Sapiens
WYETVKISI

SEQ ID NO: 381058 - protein, 9 aa, Homo Sapiens
RQTKRIQKQ

SEQ ID NO: 381059 - protein, 9 aa, Homo Sapiens
SRNKRLSIL

SEQ ID NO: 381060 - protein, 9 aa, Homo Sapiens
NSMVSCYAS

SEQ ID NO: 381061 - protein, 9 aa, Homo Sapiens
PSVSSISHI

SEQ ID NO: 381062 - protein, 9 aa, Homo Sapiens
LSQPWPGHA

SEQ ID NO: 381063 - protein, 9 aa, Homo Sapiens
GPSEGKKSH

SEQ ID NO: 381064 - protein, 9 aa, Homo Sapiens
SIMDGSDKG

SEQ ID NO: 381065 - protein, 9 aa, Homo Sapiens
YACERRIRF

SEQ ID NO: 381066 - protein, 9 aa, Homo Sapiens
SAASSSLVP

SEQ ID NO: 381067 - protein, 9 aa, Homo Sapiens
IRERQQMAS

SEQ ID NO: 381068 - protein, 9 aa, Homo Sapiens
ENKQKMDKL

SEQ ID NO: 381069 - protein, 9 aa, Homo Sapiens
VPGSAEAQK

SEQ ID NO: 381070 - protein, 9 aa, Homo Sapiens
FVLRRELGS

SEQ ID NO: 381071 - protein, 9 aa, Homo Sapiens
INTRTGQGV

SEQ ID NO: 381072 - protein, 9 aa, Homo Sapiens
MFRTPLAFV

SEQ ID NO: 381073 - protein, 9 aa, Homo Sapiens
DTSSMLSSL

SEQ ID NO: 381074 - protein, 9 aa, Homo Sapiens
THGKKYHYV

SEQ ID NO: 381075 - protein, 9 aa, Homo Sapiens
AVRGAQCGL

SEQ ID NO: 381076 - protein, 9 aa, Homo Sapiens
SRQHISVIK

SEQ ID NO: 381077 - protein, 9 aa, Homo Sapiens
KNVQDNSLE

SEQ ID NO: 381078 - protein, 9 aa, Homo Sapiens
STQRMWIPQ

SEQ ID NO: 381079 - protein, 9 aa, Homo Sapiens
RIEEEDKLS

SEQ ID NO: 381080 - protein, 9 aa, Homo Sapiens
SNILSLLRL

SEQ ID NO: 381081 - protein, 9 aa, Homo Sapiens
GKYIRPEMP

SEQ ID NO: 381082 - protein, 9 aa, Homo Sapiens
IAQVAKIWF

SEQ ID NO: 381083 - protein, 9 aa, Homo Sapiens
MLSLGVGSS

SEQ ID NO: 381084 - protein, 9 aa, Homo Sapiens
ILPLPQLLA

SEQ ID NO: 381085 - protein, 9 aa, Homo Sapiens
MATPVEVLC

SEQ ID NO: 381086 - protein, 9 aa, Homo Sapiens
SCSSCGTNL

SEQ ID NO: 381087 - protein, 9 aa, Homo Sapiens
IIFFNLETV

SEQ ID NO: 381088 - protein, 9 aa, Homo Sapiens
HTVKQAPSH

SEQ ID NO: 381089 - protein, 9 aa, Homo Sapiens
NKKCQDRSN

SEQ ID NO: 381090 - protein, 9 aa, Homo Sapiens
INNEKSKLS

SEQ ID NO: 381091 - protein, 9 aa, Homo Sapiens
QIHTGEKPC

SEQ ID NO: 381092 - protein, 9 aa, Homo Sapiens
FQSRNDCVD

SEQ ID NO: 381093 - protein, 9 aa, Homo Sapiens
YPGVTTIDM

SEQ ID NO: 381094 - protein, 9 aa, Homo Sapiens
EDERKQWAL

SEQ ID NO: 381095 - protein, 9 aa, Homo Sapiens
LYGKYIRPE

SEQ ID NO: 381096 - protein, 9 aa, Homo Sapiens
VQRGPAQKK

SEQ ID NO: 381097 - protein, 9 aa, Homo Sapiens
CQAIFQTDS

SEQ ID NO: 381098 - protein, 9 aa, Homo Sapiens
MLFHGGSSF

SEQ ID NO: 381099 - protein, 9 aa, Homo Sapiens
IQSIIHQDE

SEQ ID NO: 381100 - protein, 9 aa, Homo Sapiens
EFITKGQTV

SEQ ID NO: 381101 - protein, 9 aa, Homo Sapiens
EIHNFWCEA

SEQ ID NO: 381102 - protein, 9 aa, Homo Sapiens
ERWKIKIIQ

SEQ ID NO: 381103 - protein, 9 aa, Homo Sapiens
MDLLALSQE

SEQ ID NO: 381104 - protein, 9 aa, Homo Sapiens
WSEQQAQFI

SEQ ID NO: 381105 - protein, 9 aa, Homo Sapiens
EEMGNHIED

SEQ ID NO: 381106 - protein, 9 aa, Homo Sapiens
KECSLSLVL

SEQ ID NO: 381107 - protein, 9 aa, Homo Sapiens
SINVYSLSV

SEQ ID NO: 381108 - protein, 9 aa, Homo Sapiens
REEMHIRYL

SEQ ID NO: 381109 - protein, 9 aa, Homo Sapiens
LSLLRLISL

SEQ ID NO: 381110 - protein, 9 aa, Homo Sapiens
QFFFFFFPF

SEQ ID NO: 381111 - protein, 9 aa, Homo Sapiens
CLIIYACAR

SEQ ID NO: 381112 - protein, 9 aa, Homo Sapiens
LKPLKTQIV

SEQ ID NO: 381113 - protein, 9 aa, Homo Sapiens
KEANQSMLE

SEQ ID NO: 381114 - protein, 9 aa, Homo Sapiens
LIGLCHCKS

SEQ ID NO: 381115 - protein, 9 aa, Homo Sapiens
HIWLSFDEG

SEQ ID NO: 381116 - protein, 9 aa, Homo Sapiens
KKGNTTLNY

SEQ ID NO: 381117 - protein, 9 aa, Homo Sapiens
RKTALIGLC

SEQ ID NO: 381118 - protein, 9 aa, Homo Sapiens
STGFPKRSE

SEQ ID NO: 381119 - protein, 9 aa, Homo Sapiens
VPRSSSLES

SEQ ID NO: 381120 - protein, 9 aa, Homo Sapiens
EDNTPPLGP

SEQ ID NO: 381121 - protein, 9 aa, Homo Sapiens
CTNTKGSFR

SEQ ID NO: 381122 - protein, 9 aa, Homo Sapiens
LWGPPGPPG

SEQ ID NO: 381123 - protein, 9 aa, Homo Sapiens
ACCKPVCCA

SEQ ID NO: 381124 - protein, 9 aa, Homo Sapiens
NWNTFLQHS

SEQ ID NO: 381125 - protein, 9 aa, Homo Sapiens
IPQLVDSGT

SEQ ID NO: 381126 - protein, 9 aa, Homo Sapiens
THAAFEGPY

SEQ ID NO: 381127 - protein, 9 aa, Homo Sapiens
SKFHALFLL

SEQ ID NO: 381128 - protein, 9 aa, Homo Sapiens
QNAISSSCS

SEQ ID NO: 381129 - protein, 9 aa, Homo Sapiens
SKPSVNYFI

SEQ ID NO: 381130 - protein, 9 aa, Homo Sapiens
DVEISETQK

SEQ ID NO: 381131 - protein, 9 aa, Homo Sapiens
NLQPGSSDP

SEQ ID NO: 381132 - protein, 9 aa, Homo Sapiens
TQDLGENTF

SEQ ID NO: 381133 - protein, 9 aa, Homo Sapiens
QLHIRKARV

SEQ ID NO: 381134 - protein, 9 aa, Homo Sapiens
KGGNYAVKL

SEQ ID NO: 381135 - protein, 9 aa, Homo Sapiens
AAPGKNKEM

SEQ ID NO: 381136 - protein, 9 aa, Homo Sapiens
SYLNVTHKA

SEQ ID NO: 381137 - protein, 9 aa, Homo Sapiens
TWTHVTLLI

SEQ ID NO: 381138 - protein, 9 aa, Homo Sapiens
DTQTVGAHV

SEQ ID NO: 381139 - protein, 9 aa, Homo Sapiens
LKDVDNILL

SEQ ID NO: 381140 - protein, 9 aa, Homo Sapiens
QQYHHNMTW

SEQ ID NO: 381141 - protein, 9 aa, Homo Sapiens
VLVCLCGCL

SEQ ID NO: 381142 - protein, 9 aa, Homo Sapiens
DINDRLRDS

SEQ ID NO: 381143 - protein, 9 aa, Homo Sapiens
SDEKSETEK

SEQ ID NO: 381144 - protein, 9 aa, Homo Sapiens
HFQAQLPQV

SEQ ID NO: 381145 - protein, 9 aa, Homo Sapiens
NKWYIFNDA

SEQ ID NO: 381146 - protein, 9 aa, Homo Sapiens
APKKFPCTH

SEQ ID NO: 381147 - protein, 9 aa, Homo Sapiens
LTLSPAAIP

SEQ ID NO: 381148 - protein, 9 aa, Homo Sapiens
KNNQVKKDK

SEQ ID NO: 381149 - protein, 9 aa, Homo Sapiens
EEEDTSNEG

SEQ ID NO: 381150 - protein, 9 aa, Homo Sapiens
ISISQLIDE

SEQ ID NO: 381151 - protein, 9 aa, Homo Sapiens
WWKKGAFCT

SEQ ID NO: 381152 - protein, 9 aa, Homo Sapiens
QLHIGDWLV

SEQ ID NO: 381153 - protein, 9 aa, Homo Sapiens
QPVSVQLLQ

SEQ ID NO: 381154 - protein, 9 aa, Homo Sapiens
QFELCHQKD

SEQ ID NO: 381155 - protein, 9 aa, Homo Sapiens
EEFIMLMVR

SEQ ID NO: 381156 - protein, 9 aa, Homo Sapiens
GNTTLNYFV

SEQ ID NO: 381157 - protein, 9 aa, Homo Sapiens
IDSNNLKTK

SEQ ID NO: 381158 - protein, 9 aa, Homo Sapiens
ALYQNEEEE

SEQ ID NO: 381159 - protein, 9 aa, Homo Sapiens
GGIWSVGQI

SEQ ID NO: 381160 - protein, 9 aa, Homo Sapiens
IIQVRAASA

SEQ ID NO: 381161 - protein, 9 aa, Homo Sapiens
KNKDNYSNE

SEQ ID NO: 381162 - protein, 9 aa, Homo Sapiens
FFILGLALM

SEQ ID NO: 381163 - protein, 9 aa, Homo Sapiens
YTYHMDVFH

SEQ ID NO: 381164 - protein, 9 aa, Homo Sapiens
EVSPLENDI

SEQ ID NO: 381165 - protein, 9 aa, Homo Sapiens
EEKITKIDL

SEQ ID NO: 381166 - protein, 9 aa, Homo Sapiens
LQEMLFHGG

SEQ ID NO: 381167 - protein, 9 aa, Homo Sapiens
IWVVGAETA

SEQ ID NO: 381168 - protein, 9 aa, Homo Sapiens
KCPGMGNSH

SEQ ID NO: 381169 - protein, 9 aa, Homo Sapiens
LEGKNKDNY

SEQ ID NO: 381170 - protein, 9 aa, Homo Sapiens
KKTNKQELC

SEQ ID NO: 381171 - protein, 9 aa, Homo Sapiens
SIQIGKILI

SEQ ID NO: 381172 - protein, 9 aa, Homo Sapiens
EYYIYWTDG

SEQ ID NO: 381173 - protein, 9 aa, Homo Sapiens
DNRIHTSTY

SEQ ID NO: 381174 - protein, 9 aa, Homo Sapiens
KNRSWGTLG

SEQ ID NO: 381175 - protein, 9 aa, Homo Sapiens
EELDADEYE

SEQ ID NO: 381176 - protein, 9 aa, Homo Sapiens
GVSFVLGIS

SEQ ID NO: 381177 - protein, 9 aa, Homo Sapiens
LFVPHGYLS

SEQ ID NO: 381178 - protein, 9 aa, Homo Sapiens
GQDDDHRET

SEQ ID NO: 381179 - protein, 9 aa, Homo Sapiens
CFIRLEGMF

SEQ ID NO: 381180 - protein, 9 aa, Homo Sapiens
SGRLTAIKL

SEQ ID NO: 381181 - protein, 9 aa, Homo Sapiens
HRDLAAQNI

SEQ ID NO: 381182 - protein, 9 aa, Homo Sapiens
RFLLLCVHG

SEQ ID NO: 381183 - protein, 9 aa, Homo Sapiens
AIIKVVSQL

SEQ ID NO: 381184 - protein, 9 aa, Homo Sapiens
MNDSNEKME

SEQ ID NO: 381185 - protein, 9 aa, Homo Sapiens
LAEDIKALK

SEQ ID NO: 381186 - protein, 9 aa, Homo Sapiens
ETNNLSPKE

SEQ ID NO: 381187 - protein, 9 aa, Homo Sapiens
KMLDKEGRL

SEQ ID NO: 381188 - protein, 9 aa, Homo Sapiens
NKNSCLAQA

SEQ ID NO: 381189 - protein, 9 aa, Homo Sapiens
SIATVVPGK

SEQ ID NO: 381190 - protein, 9 aa, Homo Sapiens
FKDKFMKCL

SEQ ID NO: 381191 - protein, 9 aa, Homo Sapiens
LTKHLITHT

SEQ ID NO: 381192 - protein, 9 aa, Homo Sapiens
SRTYGFVIT

SEQ ID NO: 381193 - protein, 9 aa, Homo Sapiens
RRPWRCPED

SEQ ID NO: 381194 - protein, 9 aa, Homo Sapiens
MNENNLEKG

SEQ ID NO: 381195 - protein, 9 aa, Homo Sapiens
LTRHKKIHI

SEQ ID NO: 381196 - protein, 9 aa, Homo Sapiens
VRLTWASHE

SEQ ID NO: 381197 - protein, 9 aa, Homo Sapiens
TLIIHEQIH

SEQ ID NO: 381198 - protein, 9 aa, Homo Sapiens
TKEPTVTSA

SEQ ID NO: 381199 - protein, 9 aa, Homo Sapiens
ILGRKIIEL

SEQ ID NO: 381200 - protein, 9 aa, Homo Sapiens
LEILNHSSQ

SEQ ID NO: 381201 - protein, 9 aa, Homo Sapiens
CPQYRSSKF

SEQ ID NO: 381202 - protein, 9 aa, Homo Sapiens
SGLRNHQRT

SEQ ID NO: 381203 - protein, 9 aa, Homo Sapiens
YYMSEFSTV

SEQ ID NO: 381204 - protein, 9 aa, Homo Sapiens
KPEVQLRWT

SEQ ID NO: 381205 - protein, 9 aa, Homo Sapiens
CYKNKWEEP

SEQ ID NO: 381206 - protein, 9 aa, Homo Sapiens
PAPPECVVA

SEQ ID NO: 381207 - protein, 9 aa, Homo Sapiens
ITKIDLSVL

SEQ ID NO: 381208 - protein, 9 aa, Homo Sapiens
HQINHTGEK

SEQ ID NO: 381209 - protein, 9 aa, Homo Sapiens
MMSKTSLGQ

SEQ ID NO: 381210 - protein, 9 aa, Homo Sapiens
RRILIYLAT

SEQ ID NO: 381211 - protein, 9 aa, Homo Sapiens
PGPPGLGGS

SEQ ID NO: 381212 - protein, 9 aa, Homo Sapiens
SCEVCGQSF

SEQ ID NO: 381213 - protein, 9 aa, Homo Sapiens
NFWCEAMKK

SEQ ID NO: 381214 - protein, 9 aa, Homo Sapiens
FLKLHAILQ

SEQ ID NO: 381215 - protein, 9 aa, Homo Sapiens
YFTQNNVTE

SEQ ID NO: 381216 - protein, 9 aa, Homo Sapiens
SKRNELKSC

SEQ ID NO: 381217 - protein, 9 aa, Homo Sapiens
IFHNTLNIH

SEQ ID NO: 381218 - protein, 9 aa, Homo Sapiens
QKRLHQLKM

SEQ ID NO: 381219 - protein, 9 aa, Homo Sapiens
KKTTDEADP

SEQ ID NO: 381220 - protein, 9 aa, Homo Sapiens
PLKLKRHLE

SEQ ID NO: 381221 - protein, 9 aa, Homo Sapiens
NYVKEVDQL

SEQ ID NO: 381222 - protein, 9 aa, Homo Sapiens
PVIELWENK

SEQ ID NO: 381223 - protein, 9 aa, Homo Sapiens
TTADNTSMP

SEQ ID NO: 381224 - protein, 9 aa, Homo Sapiens
KQFICCSAM

SEQ ID NO: 381225 - protein, 9 aa, Homo Sapiens
IIQSIIHQD

SEQ ID NO: 381226 - protein, 9 aa, Homo Sapiens
VVVVDCLFY

SEQ ID NO: 381227 - protein, 9 aa, Homo Sapiens
MEVPDTEGA

SEQ ID NO: 381228 - protein, 9 aa, Homo Sapiens
KKKQKCETQ

SEQ ID NO: 381229 - protein, 9 aa, Homo Sapiens
LACADLLVG

SEQ ID NO: 381230 - protein, 9 aa, Homo Sapiens
ISYCACRLK

SEQ ID NO: 381231 - protein, 9 aa, Homo Sapiens
GNMDSCFNI

SEQ ID NO: 381232 - protein, 9 aa, Homo Sapiens
CTGSGRAIQ

SEQ ID NO: 381233 - protein, 9 aa, Homo Sapiens
GYALGETSN

SEQ ID NO: 381234 - protein, 9 aa, Homo Sapiens
ASSMEVTDH

SEQ ID NO: 381235 - protein, 9 aa, Homo Sapiens
SSNLFLNHK

SEQ ID NO: 381236 - protein, 9 aa, Homo Sapiens
LGQVYKEER

SEQ ID NO: 381237 - protein, 9 aa, Homo Sapiens
DPRAMAGKG

SEQ ID NO: 381238 - protein, 9 aa, Homo Sapiens
CKVAQACYY

SEQ ID NO: 381239 - protein, 9 aa, Homo Sapiens
KIIDVNNIS

SEQ ID NO: 381240 - protein, 9 aa, Homo Sapiens
FFIVLFAYA

SEQ ID NO: 381241 - protein, 9 aa, Homo Sapiens
IQVCYGQKP

SEQ ID NO: 381242 - protein, 9 aa, Homo Sapiens
IVCVLNLWQ

SEQ ID NO: 381243 - protein, 9 aa, Homo Sapiens
IHTFPTQEE

SEQ ID NO: 381244 - protein, 9 aa, Homo Sapiens
RSPVIELWE

SEQ ID NO: 381245 - protein, 9 aa, Homo Sapiens
MATISESNI

SEQ ID NO: 381246 - protein, 9 aa, Homo Sapiens
FEEKNQYNI

SEQ ID NO: 381247 - protein, 9 aa, Homo Sapiens
LWLLQFIFQ

SEQ ID NO: 381248 - protein, 9 aa, Homo Sapiens
RETYFQMLP

SEQ ID NO: 381249 - protein, 9 aa, Homo Sapiens
RVINCREVM

SEQ ID NO: 381250 - protein, 9 aa, Homo Sapiens
ATQIRTKQL

SEQ ID NO: 381251 - protein, 9 aa, Homo Sapiens
NNWMAALIY

SEQ ID NO: 381252 - protein, 9 aa, Homo Sapiens
KGQDGQPQW

SEQ ID NO: 381253 - protein, 9 aa, Homo Sapiens
TTKSKKTKG

SEQ ID NO: 381254 - protein, 9 aa, Homo Sapiens
LMEAVFKFL

SEQ ID NO: 381255 - protein, 9 aa, Homo Sapiens
SCANYASIR

SEQ ID NO: 381256 - protein, 9 aa, Homo Sapiens
SGGQAHKDL

SEQ ID NO: 381257 - protein, 9 aa, Homo Sapiens
LQFELCHQK

SEQ ID NO: 381258 - protein, 9 aa, Homo Sapiens
QMQGPPWTI

SEQ ID NO: 381259 - protein, 9 aa, Homo Sapiens
SCGTNLVLS

SEQ ID NO: 381260 - protein, 9 aa, Homo Sapiens
FQEGSHAFF

SEQ ID NO: 381261 - protein, 9 aa, Homo Sapiens
TGVSFVLGI

SEQ ID NO: 381262 - protein, 9 aa, Homo Sapiens
WRWIMLIIF

SEQ ID NO: 381263 - protein, 9 aa, Homo Sapiens
NFTLWRQSI

SEQ ID NO: 381264 - protein, 9 aa, Homo Sapiens
LNTMDNSTG

SEQ ID NO: 381265 - protein, 9 aa, Homo Sapiens
NEHKIIHAG

SEQ ID NO: 381266 - protein, 9 aa, Homo Sapiens
AVLEILNHS

SEQ ID NO: 381267 - protein, 9 aa, Homo Sapiens
PVQKAASQT

SEQ ID NO: 381268 - protein, 9 aa, Homo Sapiens
TIDVVWGIT

SEQ ID NO: 381269 - protein, 9 aa, Homo Sapiens
HSEINQSAD

SEQ ID NO: 381270 - protein, 9 aa, Homo Sapiens
ETQKADVQA

SEQ ID NO: 381271 - protein, 9 aa, Homo Sapiens
VCLIIYACA

SEQ ID NO: 381272 - protein, 9 aa, Homo Sapiens
LCWPLRLAW

SEQ ID NO: 381273 - protein, 9 aa, Homo Sapiens
RPELCWPLR

SEQ ID NO: 381274 - protein, 9 aa, Homo Sapiens
QNKLAELHA

SEQ ID NO: 381275 - protein, 9 aa, Homo Sapiens
IHRDLAAQN

SEQ ID NO: 381276 - protein, 9 aa, Homo Sapiens
EKSDEKSET

SEQ ID NO: 381277 - protein, 9 aa, Homo Sapiens
KFKQCKMLQ

SEQ ID NO: 381278 - protein, 9 aa, Homo Sapiens
LLYLSYNRI

SEQ ID NO: 381279 - protein, 9 aa, Homo Sapiens
RKVEMMNEN

SEQ ID NO: 381280 - protein, 9 aa, Homo Sapiens
RKIIELEVE

SEQ ID NO: 381281 - protein, 9 aa, Homo Sapiens
GTTEFWLEN

SEQ ID NO: 381282 - protein, 9 aa, Homo Sapiens
LFEQYEVTY

SEQ ID NO: 381283 - protein, 9 aa, Homo Sapiens
GDDKDTAFP

SEQ ID NO: 381284 - protein, 9 aa, Homo Sapiens
AAVNEAGVT

SEQ ID NO: 381285 - protein, 9 aa, Homo Sapiens
LSSSSIIIF

SEQ ID NO: 381286 - protein, 9 aa, Homo Sapiens
VYQEHVRCL

SEQ ID NO: 381287 - protein, 9 aa, Homo Sapiens
EGSHAFFPA

SEQ ID NO: 381288 - protein, 9 aa, Homo Sapiens
QYHGQDDDH

SEQ ID NO: 381289 - protein, 9 aa, Homo Sapiens
GRAIQFTGS

SEQ ID NO: 381290 - protein, 9 aa, Homo Sapiens
TVKISIAIE

SEQ ID NO: 381291 - protein, 9 aa, Homo Sapiens
THATYTYHM

SEQ ID NO: 381292 - protein, 9 aa, Homo Sapiens
TDHIASLEQ

SEQ ID NO: 381293 - protein, 9 aa, Homo Sapiens
CEVGEEEFL

SEQ ID NO: 381294 - protein, 9 aa, Homo Sapiens
STVLIEGKN

SEQ ID NO: 381295 - protein, 9 aa, Homo Sapiens
KQYYEGSDI

SEQ ID NO: 381296 - protein, 9 aa, Homo Sapiens
KNLGGQDIF

SEQ ID NO: 381297 - protein, 9 aa, Homo Sapiens
GRLEGTGQQ

SEQ ID NO: 381298 - protein, 9 aa, Homo Sapiens
MREDLFIIS

SEQ ID NO: 381299 - protein, 9 aa, Homo Sapiens
APMEAAKVQ

SEQ ID NO: 381300 - protein, 9 aa, Homo Sapiens
FGIASRVLQ

SEQ ID NO: 381301 - protein, 9 aa, Homo Sapiens
DEDINTRFL

SEQ ID NO: 381302 - protein, 9 aa, Homo Sapiens
TVILCDKLD

SEQ ID NO: 381303 - protein, 9 aa, Homo Sapiens
QGRAQMGPT

SEQ ID NO: 381304 - protein, 9 aa, Homo Sapiens
PFQIIICSL

SEQ ID NO: 381305 - protein, 9 aa, Homo Sapiens
CVVCIMSGA

SEQ ID NO: 381306 - protein, 9 aa, Homo Sapiens
MPGEGHTLQ

SEQ ID NO: 381307 - protein, 9 aa, Homo Sapiens
KDVDNILLI

SEQ ID NO: 381308 - protein, 9 aa, Homo Sapiens
RAMAGKGYE

SEQ ID NO: 381309 - protein, 9 aa, Homo Sapiens
QPYTCKECG

SEQ ID NO: 381310 - protein, 9 aa, Homo Sapiens
IKPTKNSEE

SEQ ID NO: 381311 - protein, 9 aa, Homo Sapiens
GQPCCPCLC

SEQ ID NO: 381312 - protein, 9 aa, Homo Sapiens
REEKLCKRE

SEQ ID NO: 381313 - protein, 9 aa, Homo Sapiens
REKIMKLSL

SEQ ID NO: 381314 - protein, 9 aa, Homo Sapiens
EEDKLSRVE

SEQ ID NO: 381315 - protein, 9 aa, Homo Sapiens
SFYSSNLFL

SEQ ID NO: 381316 - protein, 9 aa, Homo Sapiens
IFVIILALV

SEQ ID NO: 381317 - protein, 9 aa, Homo Sapiens
CAVVFDSKF

SEQ ID NO: 381318 - protein, 9 aa, Homo Sapiens
IVEVNLNNR

SEQ ID NO: 381319 - protein, 9 aa, Homo Sapiens
GLDELSDAL

SEQ ID NO: 381320 - protein, 9 aa, Homo Sapiens
NNKVVVNQD

SEQ ID NO: 381321 - protein, 9 aa, Homo Sapiens
VGLQNCDDT

SEQ ID NO: 381322 - protein, 9 aa, Homo Sapiens
LWRPQPCCI

SEQ ID NO: 381323 - protein, 9 aa, Homo Sapiens
DYPNKILLA

SEQ ID NO: 381324 - protein, 9 aa, Homo Sapiens
LRDALTQIN

SEQ ID NO: 381325 - protein, 9 aa, Homo Sapiens
DVQQLCEVG

SEQ ID NO: 381326 - protein, 9 aa, Homo Sapiens
SSSVSDDLG

SEQ ID NO: 381327 - protein, 9 aa, Homo Sapiens
STSINVYSL

SEQ ID NO: 381328 - protein, 9 aa, Homo Sapiens
PQEKYPGKM

SEQ ID NO: 381329 - protein, 9 aa, Homo Sapiens
QTILQVQYV

SEQ ID NO: 381330 - protein, 9 aa, Homo Sapiens
EANQSMLEN

SEQ ID NO: 381331 - protein, 9 aa, Homo Sapiens
KKVIHHYIK

SEQ ID NO: 381332 - protein, 9 aa, Homo Sapiens
TETTSSPKE

SEQ ID NO: 381333 - protein, 9 aa, Homo Sapiens
NESSEQGEK

SEQ ID NO: 381334 - protein, 9 aa, Homo Sapiens
YRQAEVEIL

SEQ ID NO: 381335 - protein, 9 aa, Homo Sapiens
FISNSKGQK

SEQ ID NO: 381336 - protein, 9 aa, Homo Sapiens
INRFLEERH

SEQ ID NO: 381337 - protein, 9 aa, Homo Sapiens
LFRCRNEKK

SEQ ID NO: 381338 - protein, 9 aa, Homo Sapiens
PCRDLGFNG

SEQ ID NO: 381339 - protein, 9 aa, Homo Sapiens
KEIPAIPSI

SEQ ID NO: 381340 - protein, 9 aa, Homo Sapiens
KVWHHLNHF

SEQ ID NO: 381341 - protein, 9 aa, Homo Sapiens
DIPEDTTYN

SEQ ID NO: 381342 - protein, 9 aa, Homo Sapiens
NAFPVGYEY

SEQ ID NO: 381343 - protein, 9 aa, Homo Sapiens
IVCSILQIH

SEQ ID NO: 381344 - protein, 9 aa, Homo Sapiens
TPSDTQTVG

SEQ ID NO: 381345 - protein, 9 aa, Homo Sapiens
NFNLTDFYC

SEQ ID NO: 381346 - protein, 9 aa, Homo Sapiens
VGYEYADFP

SEQ ID NO: 381347 - protein, 9 aa, Homo Sapiens
KSDIYLNLI

SEQ ID NO: 381348 - protein, 9 aa, Homo Sapiens
EAVCFMPGE

SEQ ID NO: 381349 - protein, 9 aa, Homo Sapiens
KPKFKQCKM

SEQ ID NO: 381350 - protein, 9 aa, Homo Sapiens
KDNYSNEVF

SEQ ID NO: 381351 - protein, 9 aa, Homo Sapiens
NAGLSISET

SEQ ID NO: 381352 - protein, 9 aa, Homo Sapiens
SSSYFSDDE

SEQ ID NO: 381353 - protein, 9 aa, Homo Sapiens
QINGINVKK

SEQ ID NO: 381354 - protein, 9 aa, Homo Sapiens
FRVDVPFNL

SEQ ID NO: 381355 - protein, 9 aa, Homo Sapiens
AQDQNGTLM

SEQ ID NO: 381356 - protein, 9 aa, Homo Sapiens
DALQLPTSW

SEQ ID NO: 381357 - protein, 9 aa, Homo Sapiens
SDPRAMAGK

SEQ ID NO: 381358 - protein, 9 aa, Homo Sapiens
QQNVASLAW

SEQ ID NO: 381359 - protein, 9 aa, Homo Sapiens
KERFLLLCV

SEQ ID NO: 381360 - protein, 9 aa, Homo Sapiens
SNPRMLTSA

SEQ ID NO: 381361 - protein, 9 aa, Homo Sapiens
TQIPAVKEQ

SEQ ID NO: 381362 - protein, 9 aa, Homo Sapiens
AWNYPKPEY

SEQ ID NO: 381363 - protein, 9 aa, Homo Sapiens
DNLNLENHR

SEQ ID NO: 381364 - protein, 9 aa, Homo Sapiens
DHQTLVHRP

SEQ ID NO: 381365 - protein, 9 aa, Homo Sapiens
GCGVRSITE

SEQ ID NO: 381366 - protein, 9 aa, Homo Sapiens
ILEAKVVEP

SEQ ID NO: 381367 - protein, 9 aa, Homo Sapiens
TGAVRGAQC

SEQ ID NO: 381368 - protein, 9 aa, Homo Sapiens
DSPPNLKEE

SEQ ID NO: 381369 - protein, 9 aa, Homo Sapiens
RFFDYEQFH

SEQ ID NO: 381370 - protein, 9 aa, Homo Sapiens
QLTYEEQNL

SEQ ID NO: 381371 - protein, 9 aa, Homo Sapiens
LSQSCNQAS

SEQ ID NO: 381372 - protein, 9 aa, Homo Sapiens
DDYCSLCSE

SEQ ID NO: 381373 - protein, 9 aa, Homo Sapiens
VLKQKKTTD

SEQ ID NO: 381374 - protein, 9 aa, Homo Sapiens
SLTIYPQHS

SEQ ID NO: 381375 - protein, 9 aa, Homo Sapiens
KTSGSHKPT

SEQ ID NO: 381376 - protein, 9 aa, Homo Sapiens
IWLSFDEGR

SEQ ID NO: 381377 - protein, 9 aa, Homo Sapiens
PKATHQKEL

SEQ ID NO: 381378 - protein, 9 aa, Homo Sapiens
AIPPSSRDL

SEQ ID NO: 381379 - protein, 9 aa, Homo Sapiens
CPKCNLLQE

SEQ ID NO: 381380 - protein, 9 aa, Homo Sapiens
VGSSTKMQI

SEQ ID NO: 381381 - protein, 9 aa, Homo Sapiens
MSGLRNHQR

SEQ ID NO: 381382 - protein, 9 aa, Homo Sapiens
TSTAEVKYN

SEQ ID NO: 381383 - protein, 9 aa, Homo Sapiens
RSEENSEYD

SEQ ID NO: 381384 - protein, 9 aa, Homo Sapiens
DKNFYLNLG

SEQ ID NO: 381385 - protein, 9 aa, Homo Sapiens
LHYFAQNLF

SEQ ID NO: 381386 - protein, 9 aa, Homo Sapiens
NLGGQDIFM

SEQ ID NO: 381387 - protein, 9 aa, Homo Sapiens
HEHLVDSSG

SEQ ID NO: 381388 - protein, 9 aa, Homo Sapiens
GLTLEKNRM

SEQ ID NO: 381389 - protein, 9 aa, Homo Sapiens
VLINIDDKE

SEQ ID NO: 381390 - protein, 9 aa, Homo Sapiens
KKARRIVES

SEQ ID NO: 381391 - protein, 9 aa, Homo Sapiens
LRELFVDDF

SEQ ID NO: 381392 - protein, 9 aa, Homo Sapiens
LVFVNVTDP

SEQ ID NO: 381393 - protein, 9 aa, Homo Sapiens
YYFSDHYTH

SEQ ID NO: 381394 - protein, 9 aa, Homo Sapiens
HLNKYSVAQ

SEQ ID NO: 381395 - protein, 9 aa, Homo Sapiens
ELCLLMAEE

SEQ ID NO: 381396 - protein, 9 aa, Homo Sapiens
SQPWPGHAN

SEQ ID NO: 381397 - protein, 9 aa, Homo Sapiens
ACVKAHNPG

SEQ ID NO: 381398 - protein, 9 aa, Homo Sapiens
GKKSHTFDL

SEQ ID NO: 381399 - protein, 9 aa, Homo Sapiens
LDPGESGKS

SEQ ID NO: 381400 - protein, 9 aa, Homo Sapiens
LQMDLERAK

SEQ ID NO: 381401 - protein, 9 aa, Homo Sapiens
IELYKARVE

SEQ ID NO: 381402 - protein, 9 aa, Homo Sapiens
INDRLRDSY

SEQ ID NO: 381403 - protein, 9 aa, Homo Sapiens
AMASPTAGM

SEQ ID NO: 381404 - protein, 9 aa, Homo Sapiens
DEADPRWIF

SEQ ID NO: 381405 - protein, 9 aa, Homo Sapiens
RLIFLNSIK

SEQ ID NO: 381406 - protein, 9 aa, Homo Sapiens
PLHAAAPAV

SEQ ID NO: 381407 - protein, 9 aa, Homo Sapiens
TLVHRPGMV

SEQ ID NO: 381408 - protein, 9 aa, Homo Sapiens
KALKVQFKR

SEQ ID NO: 381409 - protein, 9 aa, Homo Sapiens
SVPVKNFTG

SEQ ID NO: 381410 - protein, 9 aa, Homo Sapiens
CRQNTLGHT

SEQ ID NO: 381411 - protein, 9 aa, Homo Sapiens
RANKAKREE

SEQ ID NO: 381412 - protein, 9 aa, Homo Sapiens
IMDGSDKGI

SEQ ID NO: 381413 - protein, 9 aa, Homo Sapiens
MSAAGTYVW

SEQ ID NO: 381414 - protein, 9 aa, Homo Sapiens
LDSLWQEGF

SEQ ID NO: 381415 - protein, 9 aa, Homo Sapiens
EDYVNFNLT

SEQ ID NO: 381416 - protein, 9 aa, Homo Sapiens
GVDNVQGDT

SEQ ID NO: 381417 - protein, 9 aa, Homo Sapiens
MLIIFAWGT

SEQ ID NO: 381418 - protein, 9 aa, Homo Sapiens
QWNGRNCLY

SEQ ID NO: 381419 - protein, 9 aa, Homo Sapiens
YTRYSLKSI

SEQ ID NO: 381420 - protein, 9 aa, Homo Sapiens
DKGILAWVT

SEQ ID NO: 381421 - protein, 9 aa, Homo Sapiens
STKNVQDNS

SEQ ID NO: 381422 - protein, 9 aa, Homo Sapiens
YCSLCSEAV

SEQ ID NO: 381423 - protein, 9 aa, Homo Sapiens
ELTQGISNV

SEQ ID NO: 381424 - protein, 9 aa, Homo Sapiens
TEFLSCANY

SEQ ID NO: 381425 - protein, 9 aa, Homo Sapiens
KIIQFGFHK

SEQ ID NO: 381426 - protein, 9 aa, Homo Sapiens
HRGLYTSIQ

SEQ ID NO: 381427 - protein, 9 aa, Homo Sapiens
AYGIAVWGR

SEQ ID NO: 381428 - protein, 9 aa, Homo Sapiens
EEKNQYNID

SEQ ID NO: 381429 - protein, 9 aa, Homo Sapiens
NRLLENVEY

SEQ ID NO: 381430 - protein, 9 aa, Homo Sapiens
SSNAEESNT

SEQ ID NO: 381431 - protein, 9 aa, Homo Sapiens
SESGSSSYF

SEQ ID NO: 381432 - protein, 9 aa, Homo Sapiens
EEEKIRKQE

SEQ ID NO: 381433 - protein, 9 aa, Homo Sapiens
KLNPNLLKT

SEQ ID NO: 381434 - protein, 9 aa, Homo Sapiens
PEVQLRWTR

SEQ ID NO: 381435 - protein, 9 aa, Homo Sapiens
GEARHPQIS

SEQ ID NO: 381436 - protein, 9 aa, Homo Sapiens
THSVCEEKM

SEQ ID NO: 381437 - protein, 9 aa, Homo Sapiens
HSTLIIHEQ

SEQ ID NO: 381438 - protein, 9 aa, Homo Sapiens
KDEELWRMQ

SEQ ID NO: 381439 - protein, 9 aa, Homo Sapiens
ILDHEKEWK

SEQ ID NO: 381440 - protein, 9 aa, Homo Sapiens
TYGFVITFY

SEQ ID NO: 381441 - protein, 9 aa, Homo Sapiens
IMGAPSLEC

SEQ ID NO: 381442 - protein, 9 aa, Homo Sapiens
VVINFEKNR

SEQ ID NO: 381443 - protein, 9 aa, Homo Sapiens
NPVKPMNAM

SEQ ID NO: 381444 - protein, 9 aa, Homo Sapiens
DQNGTLMIP

SEQ ID NO: 381445 - protein, 9 aa, Homo Sapiens
KKEEKENKK

SEQ ID NO: 381446 - protein, 9 aa, Homo Sapiens
LHYMIQILF

SEQ ID NO: 381447 - protein, 9 aa, Homo Sapiens
GKPEVQLRW

SEQ ID NO: 381448 - protein, 9 aa, Homo Sapiens
HMPYEDIRN

SEQ ID NO: 381449 - protein, 9 aa, Homo Sapiens
NHNIKEAIK

SEQ ID NO: 381450 - protein, 9 aa, Homo Sapiens
STLTKHLIT

SEQ ID NO: 381451 - protein, 9 aa, Homo Sapiens
PVAAGGDIK

SEQ ID NO: 381452 - protein, 9 aa, Homo Sapiens
ASAGVGSWL

SEQ ID NO: 381453 - protein, 9 aa, Homo Sapiens
RKQIRLGRK

SEQ ID NO: 381454 - protein, 9 aa, Homo Sapiens
HRLAYAAHA

SEQ ID NO: 381455 - protein, 9 aa, Homo Sapiens
SLIKLKESS

SEQ ID NO: 381456 - protein, 9 aa, Homo Sapiens
FLELVQLNN

SEQ ID NO: 381457 - protein, 9 aa, Homo Sapiens
FDLYLTYVT

SEQ ID NO: 381458 - protein, 9 aa, Homo Sapiens
TEWRFQGLA

SEQ ID NO: 381459 - protein, 9 aa, Homo Sapiens
INDIVKIVN

SEQ ID NO: 381460 - protein, 9 aa, Homo Sapiens
LEKAREKKA

SEQ ID NO: 381461 - protein, 9 aa, Homo Sapiens
PIFRPIKRI

SEQ ID NO: 381462 - protein, 9 aa, Homo Sapiens
QKELFAELD

SEQ ID NO: 381463 - protein, 9 aa, Homo Sapiens
DSSMGGRPL

SEQ ID NO: 381464 - protein, 9 aa, Homo Sapiens
VKAGDKVKV

SEQ ID NO: 381465 - protein, 9 aa, Homo Sapiens
VWHHLNHFL

SEQ ID NO: 381466 - protein, 9 aa, Homo Sapiens
WSVGVIIFE

SEQ ID NO: 381467 - protein, 9 aa, Homo Sapiens
PPDNMNLAN

SEQ ID NO: 381468 - protein, 9 aa, Homo Sapiens
MEHQKEGKE

SEQ ID NO: 381469 - protein, 9 aa, Homo Sapiens
FNMHDSSLV

SEQ ID NO: 381470 - protein, 9 aa, Homo Sapiens
QAIFQTDSS

SEQ ID NO: 381471 - protein, 9 aa, Homo Sapiens
VNHNYTGGE

SEQ ID NO: 381472 - protein, 9 aa, Homo Sapiens
EWERLGATI

SEQ ID NO: 381473 - protein, 9 aa, Homo Sapiens
QMKNAMFNT

SEQ ID NO: 381474 - protein, 9 aa, Homo Sapiens
AAPATPADP

SEQ ID NO: 381475 - protein, 9 aa, Homo Sapiens
ASLACADLL

SEQ ID NO: 381476 - protein, 9 aa, Homo Sapiens
KDYLGDIDS

SEQ ID NO: 381477 - protein, 9 aa, Homo Sapiens
HLVDSSGHS

SEQ ID NO: 381478 - protein, 9 aa, Homo Sapiens
SSVSDDLGC

SEQ ID NO: 381479 - protein, 9 aa, Homo Sapiens
NLVQHQIIH

SEQ ID NO: 381480 - protein, 9 aa, Homo Sapiens
PHINMDGDY

SEQ ID NO: 381481 - protein, 9 aa, Homo Sapiens
WHSVIHSFI

SEQ ID NO: 381482 - protein, 9 aa, Homo Sapiens
IIQDMDGVE

SEQ ID NO: 381483 - protein, 9 aa, Homo Sapiens
GIPFIETST

SEQ ID NO: 381484 - protein, 9 aa, Homo Sapiens
KKTSGSHKP

SEQ ID NO: 381485 - protein, 9 aa, Homo Sapiens
LQKTVNKLP

SEQ ID NO: 381486 - protein, 9 aa, Homo Sapiens
IIPSIVSSP

SEQ ID NO: 381487 - protein, 9 aa, Homo Sapiens
TQHQRSHNG

SEQ ID NO: 381488 - protein, 9 aa, Homo Sapiens
CYVCSDCGQ

SEQ ID NO: 381489 - protein, 9 aa, Homo Sapiens
SEGKKSHTF

SEQ ID NO: 381490 - protein, 9 aa, Homo Sapiens
CSEETFRFK

SEQ ID NO: 381491 - protein, 9 aa, Homo Sapiens
AHISRETFQ

SEQ ID NO: 381492 - protein, 9 aa, Homo Sapiens
QSPEECQRK

SEQ ID NO: 381493 - protein, 9 aa, Homo Sapiens
AELERKKQH

SEQ ID NO: 381494 - protein, 9 aa, Homo Sapiens
LYLFINNNI

SEQ ID NO: 381495 - protein, 9 aa, Homo Sapiens
LDGKKSKLQ

SEQ ID NO: 381496 - protein, 9 aa, Homo Sapiens
NEILTAEEM

SEQ ID NO: 381497 - protein, 9 aa, Homo Sapiens
RLRDALTQI

SEQ ID NO: 381498 - protein, 9 aa, Homo Sapiens
LANNFPAHI

SEQ ID NO: 381499 - protein, 9 aa, Homo Sapiens
VVGITTQSL

SEQ ID NO: 381500 - protein, 9 aa, Homo Sapiens
EDTQAFNIG

SEQ ID NO: 381501 - protein, 9 aa, Homo Sapiens
NNSRFAQDF

SEQ ID NO: 381502 - protein, 9 aa, Homo Sapiens
WNGRNCLYS

SEQ ID NO: 381503 - protein, 9 aa, Homo Sapiens
YVIFNEDCQ

SEQ ID NO: 381504 - protein, 9 aa, Homo Sapiens
THLSEDDSK

SEQ ID NO: 381505 - protein, 9 aa, Homo Sapiens
NESLKPLKL

SEQ ID NO: 381506 - protein, 9 aa, Homo Sapiens
NPSSGQPCC

SEQ ID NO: 381507 - protein, 9 aa, Homo Sapiens
LCDGFSLQL

SEQ ID NO: 381508 - protein, 9 aa, Homo Sapiens
SQSEESYLC

SEQ ID NO: 381509 - protein, 9 aa, Homo Sapiens
LRKLMELRL

SEQ ID NO: 381510 - protein, 9 aa, Homo Sapiens
DSLRVNYFN

SEQ ID NO: 381511 - protein, 9 aa, Homo Sapiens
GCGKNKENA

SEQ ID NO: 381512 - protein, 9 aa, Homo Sapiens
KDNLNLENH

SEQ ID NO: 381513 - protein, 9 aa, Homo Sapiens
HQKELDTLS

SEQ ID NO: 381514 - protein, 9 aa, Homo Sapiens
SSPSAAAGG

SEQ ID NO: 381515 - protein, 9 aa, Homo Sapiens
EIDPFNVDS

SEQ ID NO: 381516 - protein, 9 aa, Homo Sapiens
TIFNCRMEW

SEQ ID NO: 381517 - protein, 9 aa, Homo Sapiens
EEKLPSCFN

SEQ ID NO: 381518 - protein, 9 aa, Homo Sapiens
VGLAPFPDI

SEQ ID NO: 381519 - protein, 9 aa, Homo Sapiens
RRCGLTYLH

SEQ ID NO: 381520 - protein, 9 aa, Homo Sapiens
KLAQDQNGT

SEQ ID NO: 381521 - protein, 9 aa, Homo Sapiens
SSSTSINVY

SEQ ID NO: 381522 - protein, 9 aa, Homo Sapiens
PLKTQIVPD

SEQ ID NO: 381523 - protein, 9 aa, Homo Sapiens
DWWSVGVII

SEQ ID NO: 381524 - protein, 9 aa, Homo Sapiens
PDSGAAPAT

SEQ ID NO: 381525 - protein, 9 aa, Homo Sapiens
LDAFFTLEG

SEQ ID NO: 381526 - protein, 9 aa, Homo Sapiens
CAKHKRFLG

SEQ ID NO: 381527 - protein, 9 aa, Homo Sapiens
KLHAILQNS

SEQ ID NO: 381528 - protein, 9 aa, Homo Sapiens
QTLFQRSGD

SEQ ID NO: 381529 - protein, 9 aa, Homo Sapiens
SIILQNVSS

SEQ ID NO: 381530 - protein, 9 aa, Homo Sapiens
KDAGWYTVA

SEQ ID NO: 381531 - protein, 9 aa, Homo Sapiens
YHGQDDDHR

SEQ ID NO: 381532 - protein, 9 aa, Homo Sapiens
QAFYLPPGH

SEQ ID NO: 381533 - protein, 9 aa, Homo Sapiens
NILEMEIIS

SEQ ID NO: 381534 - protein, 9 aa, Homo Sapiens
ADKMVYNKE

SEQ ID NO: 381535 - protein, 9 aa, Homo Sapiens
EATMKIIAY

SEQ ID NO: 381536 - protein, 9 aa, Homo Sapiens
LKSHMQTHT

SEQ ID NO: 381537 - protein, 9 aa, Homo Sapiens
WYMDYSVGI

SEQ ID NO: 381538 - protein, 9 aa, Homo Sapiens
GSYNNHAWY

SEQ ID NO: 381539 - protein, 9 aa, Homo Sapiens
VNVEFLSLI

SEQ ID NO: 381540 - protein, 9 aa, Homo Sapiens
AFAYTSVLS

SEQ ID NO: 381541 - protein, 9 aa, Homo Sapiens
GRCRCYYGS

SEQ ID NO: 381542 - protein, 9 aa, Homo Sapiens
RRSPVIELW

SEQ ID NO: 381543 - protein, 9 aa, Homo Sapiens
IAKLSDLVS

SEQ ID NO: 381544 - protein, 9 aa, Homo Sapiens
QNNGKKHQK

SEQ ID NO: 381545 - protein, 9 aa, Homo Sapiens
SYSFEYVIF

SEQ ID NO: 381546 - protein, 9 aa, Homo Sapiens
FELCHQKDL

SEQ ID NO: 381547 - protein, 9 aa, Homo Sapiens
LINDTFEDT

SEQ ID NO: 381548 - protein, 9 aa, Homo Sapiens
THAGQSLTE

SEQ ID NO: 381549 - protein, 9 aa, Homo Sapiens
IMADISPIL

SEQ ID NO: 381550 - protein, 9 aa, Homo Sapiens
VYGPFGYIN

SEQ ID NO: 381551 - protein, 9 aa, Homo Sapiens
RTLRTNKLF

SEQ ID NO: 381552 - protein, 9 aa, Homo Sapiens
LLENLQNRF

SEQ ID NO: 381553 - protein, 9 aa, Homo Sapiens
IDINTVAVQ

SEQ ID NO: 381554 - protein, 9 aa, Homo Sapiens
VLMSASNDN

SEQ ID NO: 381555 - protein, 9 aa, Homo Sapiens
GQVYKEERK

SEQ ID NO: 381556 - protein, 9 aa, Homo Sapiens
RWIMLIIFA

SEQ ID NO: 381557 - protein, 9 aa, Homo Sapiens
LDIMRRFRT

SEQ ID NO: 381558 - protein, 9 aa, Homo Sapiens
KNVKAKIQD

SEQ ID NO: 381559 - protein, 9 aa, Homo Sapiens
FQSVKEKIM

SEQ ID NO: 381560 - protein, 9 aa, Homo Sapiens
GMDQTYCSK

SEQ ID NO: 381561 - protein, 9 aa, Homo Sapiens
EASNINNVV

SEQ ID NO: 381562 - protein, 9 aa, Homo Sapiens
LVSLGLTVY

SEQ ID NO: 381563 - protein, 9 aa, Homo Sapiens
YTRDGFDLY

SEQ ID NO: 381564 - protein, 9 aa, Homo Sapiens
HYARTDEIG

SEQ ID NO: 381565 - protein, 9 aa, Homo Sapiens
SMEVTDHIA

SEQ ID NO: 381566 - protein, 9 aa, Homo Sapiens
VINDIVKIV

SEQ ID NO: 381567 - protein, 9 aa, Homo Sapiens
MFFIVLFAY

SEQ ID NO: 381568 - protein, 9 aa, Homo Sapiens
TVAVITLHR

SEQ ID NO: 381569 - protein, 9 aa, Homo Sapiens
SVCEEKMES

SEQ ID NO: 381570 - protein, 9 aa, Homo Sapiens
MLWRPQPCC

SEQ ID NO: 381571 - protein, 9 aa, Homo Sapiens
EINQLRGEL

SEQ ID NO: 381572 - protein, 9 aa, Homo Sapiens
LDHPPLTAY

SEQ ID NO: 381573 - protein, 9 aa, Homo Sapiens
QLFELLNLL

SEQ ID NO: 381574 - protein, 9 aa, Homo Sapiens
KLIGSFQEE

SEQ ID NO: 381575 - protein, 9 aa, Homo Sapiens
RRYSLGQVY

SEQ ID NO: 381576 - protein, 9 aa, Homo Sapiens
PVRILSKYH

SEQ ID NO: 381577 - protein, 9 aa, Homo Sapiens
EEDTQAFNI

SEQ ID NO: 381578 - protein, 9 aa, Homo Sapiens
IFVVAEEAY

SEQ ID NO: 381579 - protein, 9 aa, Homo Sapiens
VASQEERHT

SEQ ID NO: 381580 - protein, 9 aa, Homo Sapiens
YVTLRYGHI

SEQ ID NO: 381581 - protein, 9 aa, Homo Sapiens
SDSSSTSIN

SEQ ID NO: 381582 - protein, 9 aa, Homo Sapiens
GFVLRRELG

SEQ ID NO: 381583 - protein, 9 aa, Homo Sapiens
YLGCQWRKS

SEQ ID NO: 381584 - protein, 9 aa, Homo Sapiens
YGRLLKKTN

SEQ ID NO: 381585 - protein, 9 aa, Homo Sapiens
NRIHTSTYN

SEQ ID NO: 381586 - protein, 9 aa, Homo Sapiens
QRNSAGGGG

SEQ ID NO: 381587 - protein, 9 aa, Homo Sapiens
RDNLQRKMA

SEQ ID NO: 381588 - protein, 9 aa, Homo Sapiens
ILCDKLDFS

SEQ ID NO: 381589 - protein, 9 aa, Homo Sapiens
ELLGHPHHN

SEQ ID NO: 381590 - protein, 9 aa, Homo Sapiens
KTALKATSD

SEQ ID NO: 381591 - protein, 9 aa, Homo Sapiens
YFDAYLEEE

SEQ ID NO: 381592 - protein, 9 aa, Homo Sapiens
VVLFCFILL

SEQ ID NO: 381593 - protein, 9 aa, Homo Sapiens
VTDPQNLLL

SEQ ID NO: 381594 - protein, 9 aa, Homo Sapiens
MDPHIFVVA

SEQ ID NO: 381595 - protein, 9 aa, Homo Sapiens
RTTKSKKTK

SEQ ID NO: 381596 - protein, 9 aa, Homo Sapiens
SNNLKTKQE

SEQ ID NO: 381597 - protein, 9 aa, Homo Sapiens
IDPFNVDSG

SEQ ID NO: 381598 - protein, 9 aa, Homo Sapiens
IIQVVARDD

SEQ ID NO: 381599 - protein, 9 aa, Homo Sapiens
ALTRVSQII

SEQ ID NO: 381600 - protein, 9 aa, Homo Sapiens
VNSVNHNYT

SEQ ID NO: 381601 - protein, 9 aa, Homo Sapiens
KNEFLILPL

SEQ ID NO: 381602 - protein, 9 aa, Homo Sapiens
PPWTIYDFG

SEQ ID NO: 381603 - protein, 9 aa, Homo Sapiens
AKAYEYIRV

SEQ ID NO: 381604 - protein, 9 aa, Homo Sapiens
QNEDDEVPV

SEQ ID NO: 381605 - protein, 9 aa, Homo Sapiens
CCFIRLEGM

SEQ ID NO: 381606 - protein, 9 aa, Homo Sapiens
VYEKESKFI

SEQ ID NO: 381607 - protein, 9 aa, Homo Sapiens
SHTFDLEAM

SEQ ID NO: 381608 - protein, 9 aa, Homo Sapiens
WLPGVVLLN

SEQ ID NO: 381609 - protein, 9 aa, Homo Sapiens
RRFRTEMEK

SEQ ID NO: 381610 - protein, 9 aa, Homo Sapiens
KSELREKKL

SEQ ID NO: 381611 - protein, 9 aa, Homo Sapiens
CQLCGKRFH

SEQ ID NO: 381612 - protein, 9 aa, Homo Sapiens
GGLRLLYLS

SEQ ID NO: 381613 - protein, 9 aa, Homo Sapiens
SWDMYSHYV

SEQ ID NO: 381614 - protein, 9 aa, Homo Sapiens
GRLKALSDT

SEQ ID NO: 381615 - protein, 9 aa, Homo Sapiens
NEDTAHGIA

SEQ ID NO: 381616 - protein, 9 aa, Homo Sapiens
GGVGLPVIM

SEQ ID NO: 381617 - protein, 9 aa, Homo Sapiens
WCPQYRSSK

SEQ ID NO: 381618 - protein, 9 aa, Homo Sapiens
VWGITRQEV

SEQ ID NO: 381619 - protein, 9 aa, Homo Sapiens
MRRFRTEME

SEQ ID NO: 381620 - protein, 9 aa, Homo Sapiens
TNPLREINK

SEQ ID NO: 381621 - protein, 9 aa, Homo Sapiens
TAAILNNSR

SEQ ID NO: 381622 - protein, 9 aa, Homo Sapiens
IDLQDNPWD

SEQ ID NO: 381623 - protein, 9 aa, Homo Sapiens
REAVCFMPG

SEQ ID NO: 381624 - protein, 9 aa, Homo Sapiens
CLLKALHKI

SEQ ID NO: 381625 - protein, 9 aa, Homo Sapiens
GIDPYLSAH

SEQ ID NO: 381626 - protein, 9 aa, Homo Sapiens
YWLVSNQSV

SEQ ID NO: 381627 - protein, 9 aa, Homo Sapiens
LVGRLEGTG

SEQ ID NO: 381628 - protein, 9 aa, Homo Sapiens
FYMFTWTHV

SEQ ID NO: 381629 - protein, 9 aa, Homo Sapiens
YLFSGQAVA

SEQ ID NO: 381630 - protein, 9 aa, Homo Sapiens
NKLFHEIYL

SEQ ID NO: 381631 - protein, 9 aa, Homo Sapiens
SLHSTTMMI

SEQ ID NO: 381632 - protein, 9 aa, Homo Sapiens
FLPVLYRSG

SEQ ID NO: 381633 - protein, 9 aa, Homo Sapiens
CFNHLDLPP

SEQ ID NO: 381634 - protein, 9 aa, Homo Sapiens
AIMQELERK

SEQ ID NO: 381635 - protein, 9 aa, Homo Sapiens
NLLSMIRAH

SEQ ID NO: 381636 - protein, 9 aa, Homo Sapiens
ENEADWFIS

SEQ ID NO: 381637 - protein, 9 aa, Homo Sapiens
TPGPRRKRR

SEQ ID NO: 381638 - protein, 9 aa, Homo Sapiens
GENFEYQLV

SEQ ID NO: 381639 - protein, 9 aa, Homo Sapiens
WQEGFLTDD

SEQ ID NO: 381640 - protein, 9 aa, Homo Sapiens
YLEVRSPEY

SEQ ID NO: 381641 - protein, 9 aa, Homo Sapiens
SPLENDIQV

SEQ ID NO: 381642 - protein, 9 aa, Homo Sapiens
IIHIRENSY

SEQ ID NO: 381643 - protein, 9 aa, Homo Sapiens
ADWFISANV

SEQ ID NO: 381644 - protein, 9 aa, Homo Sapiens
NWGSWTKVG

SEQ ID NO: 381645 - protein, 9 aa, Homo Sapiens
NTDKNIDKY

SEQ ID NO: 381646 - protein, 9 aa, Homo Sapiens
GLKQFFPKS

SEQ ID NO: 381647 - protein, 9 aa, Homo Sapiens
WKSILNYLY

SEQ ID NO: 381648 - protein, 9 aa, Homo Sapiens
RCVKLSSPK

SEQ ID NO: 381649 - protein, 9 aa, Homo Sapiens
PRRFLAWGV

SEQ ID NO: 381650 - protein, 9 aa, Homo Sapiens
YTQAVQNIW

SEQ ID NO: 381651 - protein, 9 aa, Homo Sapiens
LKKTNKQEL

SEQ ID NO: 381652 - protein, 9 aa, Homo Sapiens
KKLQMDLER

SEQ ID NO: 381653 - protein, 9 aa, Homo Sapiens
VNLYYVGGE

SEQ ID NO: 381654 - protein, 9 aa, Homo Sapiens
VFDSKFIET

SEQ ID NO: 381655 - protein, 9 aa, Homo Sapiens
IIRISTSII

SEQ ID NO: 381656 - protein, 9 aa, Homo Sapiens
ESKPSSSSK

SEQ ID NO: 381657 - protein, 9 aa, Homo Sapiens
FARRNQGAE

SEQ ID NO: 381658 - protein, 9 aa, Homo Sapiens
YFQEIRANL

SEQ ID NO: 381659 - protein, 9 aa, Homo Sapiens
AQDNKLILR

SEQ ID NO: 381660 - protein, 9 aa, Homo Sapiens
SVLHSFYVL

SEQ ID NO: 381661 - protein, 9 aa, Homo Sapiens
VFQLKAEIS

SEQ ID NO: 381662 - protein, 9 aa, Homo Sapiens
GRLNSELRN

SEQ ID NO: 381663 - protein, 9 aa, Homo Sapiens
RSSSLESPV

SEQ ID NO: 381664 - protein, 9 aa, Homo Sapiens
CRDLGFNGA

SEQ ID NO: 381665 - protein, 9 aa, Homo Sapiens
ATGLYVLFG

SEQ ID NO: 381666 - protein, 9 aa, Homo Sapiens
SPPADTELQ

SEQ ID NO: 381667 - protein, 9 aa, Homo Sapiens
IWHSVIHSF

SEQ ID NO: 381668 - protein, 9 aa, Homo Sapiens
NLVWKFRYY

SEQ ID NO: 381669 - protein, 9 aa, Homo Sapiens
NTEKEDRSP

SEQ ID NO: 381670 - protein, 9 aa, Homo Sapiens
LHIGDWLVF

SEQ ID NO: 381671 - protein, 9 aa, Homo Sapiens
LECLLKALH

SEQ ID NO: 381672 - protein, 9 aa, Homo Sapiens
GSHEEDNES

SEQ ID NO: 381673 - protein, 9 aa, Homo Sapiens
HFITHQQIH

SEQ ID NO: 381674 - protein, 9 aa, Homo Sapiens
YLRKHMRTH

SEQ ID NO: 381675 - protein, 9 aa, Homo Sapiens
AGGLRLLYL

SEQ ID NO: 381676 - protein, 9 aa, Homo Sapiens
GAGACRTLP

SEQ ID NO: 381677 - protein, 9 aa, Homo Sapiens
TVLNNKLCI

SEQ ID NO: 381678 - protein, 9 aa, Homo Sapiens
KIIQSIIHQ

SEQ ID NO: 381679 - protein, 9 aa, Homo Sapiens
EVEQEADTI

SEQ ID NO: 381680 - protein, 9 aa, Homo Sapiens
SQRRRITYS

SEQ ID NO: 381681 - protein, 9 aa, Homo Sapiens
EEEMEHQKE

SEQ ID NO: 381682 - protein, 9 aa, Homo Sapiens
NYYTNGAYG

SEQ ID NO: 381683 - protein, 9 aa, Homo Sapiens
VIYHDALQN

SEQ ID NO: 381684 - protein, 9 aa, Homo Sapiens
IHKKIIDVN

SEQ ID NO: 381685 - protein, 9 aa, Homo Sapiens
TFQKKRRNK

SEQ ID NO: 381686 - protein, 9 aa, Homo Sapiens
IAEENLAYA

SEQ ID NO: 381687 - protein, 9 aa, Homo Sapiens
TDDDTMSKM

SEQ ID NO: 381688 - protein, 9 aa, Homo Sapiens
LENDIQVVE

SEQ ID NO: 381689 - protein, 9 aa, Homo Sapiens
SLQIYLLDG

SEQ ID NO: 381690 - protein, 9 aa, Homo Sapiens
KSILNYLYE

SEQ ID NO: 381691 - protein, 9 aa, Homo Sapiens
GACPPHTVK

SEQ ID NO: 381692 - protein, 9 aa, Homo Sapiens
HSSHLTRHQ

SEQ ID NO: 381693 - protein, 9 aa, Homo Sapiens
SVEKDQHHI

SEQ ID NO: 381694 - protein, 9 aa, Homo Sapiens
YGTQICPAF

SEQ ID NO: 381695 - protein, 9 aa, Homo Sapiens
ISKKARRIV

SEQ ID NO: 381696 - protein, 9 aa, Homo Sapiens
SKLVYHQIN

SEQ ID NO: 381697 - protein, 9 aa, Homo Sapiens
DPQEKYPGK

SEQ ID NO: 381698 - protein, 9 aa, Homo Sapiens
ILTAEEMDE

SEQ ID NO: 381699 - protein, 9 aa, Homo Sapiens
HTSLPIRHI

SEQ ID NO: 381700 - protein, 9 aa, Homo Sapiens
ACICLISIV

SEQ ID NO: 381701 - protein, 9 aa, Homo Sapiens
QDHKAAVSV

SEQ ID NO: 381702 - protein, 9 aa, Homo Sapiens
NVDSGREFG

SEQ ID NO: 381703 - protein, 9 aa, Homo Sapiens
VPACCKPVC

SEQ ID NO: 381704 - protein, 9 aa, Homo Sapiens
AVPVSPAAD

SEQ ID NO: 381705 - protein, 9 aa, Homo Sapiens
FCTLHVTII

SEQ ID NO: 381706 - protein, 9 aa, Homo Sapiens
MDADTQIFF

SEQ ID NO: 381707 - protein, 9 aa, Homo Sapiens
DHIASLEQR

SEQ ID NO: 381708 - protein, 9 aa, Homo Sapiens
LQHIFWVYR

SEQ ID NO: 381709 - protein, 9 aa, Homo Sapiens
VQDNSLEIC

SEQ ID NO: 381710 - protein, 9 aa, Homo Sapiens
KNKENAKAV

SEQ ID NO: 381711 - protein, 9 aa, Homo Sapiens
NYAVKLVND

SEQ ID NO: 381712 - protein, 9 aa, Homo Sapiens
NLIVHQQIH

SEQ ID NO: 381713 - protein, 9 aa, Homo Sapiens
SPESSSPSA

SEQ ID NO: 381714 - protein, 9 aa, Homo Sapiens
VCEEKMESG

SEQ ID NO: 381715 - protein, 9 aa, Homo Sapiens
ETVKISIAI

SEQ ID NO: 381716 - protein, 9 aa, Homo Sapiens
AVNLFVGAA

SEQ ID NO: 381717 - protein, 9 aa, Homo Sapiens
TQKADVQAP

SEQ ID NO: 381718 - protein, 9 aa, Homo Sapiens
LLGLSFRRP

SEQ ID NO: 381719 - protein, 9 aa, Homo Sapiens
FFFFFFPFF

SEQ ID NO: 381720 - protein, 9 aa, Homo Sapiens
VFGAILFTL

SEQ ID NO: 381721 - protein, 9 aa, Homo Sapiens
VLRALKTVY

SEQ ID NO: 381722 - protein, 9 aa, Homo Sapiens
SVLSHLEDL

SEQ ID NO: 381723 - protein, 9 aa, Homo Sapiens
RKALKFYQK

SEQ ID NO: 381724 - protein, 9 aa, Homo Sapiens
VLNYFKPYL

SEQ ID NO: 381725 - protein, 9 aa, Homo Sapiens
PGPRRKRRR

SEQ ID NO: 381726 - protein, 9 aa, Homo Sapiens
NEKEELVLE

SEQ ID NO: 381727 - protein, 9 aa, Homo Sapiens
PDTLSQPWP

SEQ ID NO: 381728 - protein, 9 aa, Homo Sapiens
VTYYKRLLD

SEQ ID NO: 381729 - protein, 9 aa, Homo Sapiens
VCGQSFIRA

SEQ ID NO: 381730 - protein, 9 aa, Homo Sapiens
LVTNLRLVK

SEQ ID NO: 381731 - protein, 9 aa, Homo Sapiens
KLFDILDHY

SEQ ID NO: 381732 - protein, 9 aa, Homo Sapiens
GQANTVEML

SEQ ID NO: 381733 - protein, 9 aa, Homo Sapiens
KFDNKIMQK

SEQ ID NO: 381734 - protein, 9 aa, Homo Sapiens
FYSSNLFLN

SEQ ID NO: 381735 - protein, 9 aa, Homo Sapiens
STIHVDENG

SEQ ID NO: 381736 - protein, 9 aa, Homo Sapiens
VGFVSEDKY

SEQ ID NO: 381737 - protein, 9 aa, Homo Sapiens
TWEHAGRCR

SEQ ID NO: 381738 - protein, 9 aa, Homo Sapiens
GKFIHINFD

SEQ ID NO: 381739 - protein, 9 aa, Homo Sapiens
DLLVGVTVM

SEQ ID NO: 381740 - protein, 9 aa, Homo Sapiens
NYRIEEEDK

SEQ ID NO: 381741 - protein, 9 aa, Homo Sapiens
IKLKESSAK

SEQ ID NO: 381742 - protein, 9 aa, Homo Sapiens
KALWDKPFI

SEQ ID NO: 381743 - protein, 9 aa, Homo Sapiens
ASSPLTRLT

SEQ ID NO: 381744 - protein, 9 aa, Homo Sapiens
IDLKDVDNI

SEQ ID NO: 381745 - protein, 9 aa, Homo Sapiens
PCNHFTISG

SEQ ID NO: 381746 - protein, 9 aa, Homo Sapiens
ANLPCNHFT

SEQ ID NO: 381747 - protein, 9 aa, Homo Sapiens
QYQNDLSNL

SEQ ID NO: 381748 - protein, 9 aa, Homo Sapiens
YGFVITFYE

SEQ ID NO: 381749 - protein, 9 aa, Homo Sapiens
HRATINTYC

SEQ ID NO: 381750 - protein, 9 aa, Homo Sapiens
CTACPLCHK

SEQ ID NO: 381751 - protein, 9 aa, Homo Sapiens
YFTATPRRF

SEQ ID NO: 381752 - protein, 9 aa, Homo Sapiens
GCQWRKSNM

SEQ ID NO: 381753 - protein, 9 aa, Homo Sapiens
KTLSKTSHL

SEQ ID NO: 381754 - protein, 9 aa, Homo Sapiens
MLDLYSDKN

SEQ ID NO: 381755 - protein, 9 aa, Homo Sapiens
ETENVDSIQ

SEQ ID NO: 381756 - protein, 9 aa, Homo Sapiens
VRKLLKLPN

SEQ ID NO: 381757 - protein, 9 aa, Homo Sapiens
TGEPGQLLE

SEQ ID NO: 381758 - protein, 9 aa, Homo Sapiens
TLVQREEPV

SEQ ID NO: 381759 - protein, 9 aa, Homo Sapiens
HSTTMMIRP

SEQ ID NO: 381760 - protein, 9 aa, Homo Sapiens
LTSASHPQA

SEQ ID NO: 381761 - protein, 9 aa, Homo Sapiens
EFQKEAEKL

SEQ ID NO: 381762 - protein, 9 aa, Homo Sapiens
ETKCGEGMV

SEQ ID NO: 381763 - protein, 9 aa, Homo Sapiens
YAIHTFPTQ

SEQ ID NO: 381764 - protein, 9 aa, Homo Sapiens
PVSVQLLQG

SEQ ID NO: 381765 - protein, 9 aa, Homo Sapiens
YYIYWTDGK

SEQ ID NO: 381766 - protein, 9 aa, Homo Sapiens
LNSSQNYLD

SEQ ID NO: 381767 - protein, 9 aa, Homo Sapiens
QGEVPHTLS

SEQ ID NO: 381768 - protein, 9 aa, Homo Sapiens
VLDSNNFKS

SEQ ID NO: 381769 - protein, 9 aa, Homo Sapiens
TRVEWGKIW

SEQ ID NO: 381770 - protein, 9 aa, Homo Sapiens
GNYAVKLVN

SEQ ID NO: 381771 - protein, 9 aa, Homo Sapiens
PGSHEEDNE

SEQ ID NO: 381772 - protein, 9 aa, Homo Sapiens
GNEFITKGQ

SEQ ID NO: 381773 - protein, 9 aa, Homo Sapiens
ANKLASASA

SEQ ID NO: 381774 - protein, 9 aa, Homo Sapiens
GECVSGPPD

SEQ ID NO: 381775 - protein, 9 aa, Homo Sapiens
PVSKIIQSI

SEQ ID NO: 381776 - protein, 9 aa, Homo Sapiens
GKEADKLLT

SEQ ID NO: 381777 - protein, 9 aa, Homo Sapiens
GTNLVLSHT

SEQ ID NO: 381778 - protein, 9 aa, Homo Sapiens
GTNRWFDTS

SEQ ID NO: 381779 - protein, 9 aa, Homo Sapiens
GVIIFEMLV

SEQ ID NO: 381780 - protein, 9 aa, Homo Sapiens
PATKLNMMS

SEQ ID NO: 381781 - protein, 9 aa, Homo Sapiens
DSSLVASKV

SEQ ID NO: 381782 - protein, 9 aa, Homo Sapiens
IVITTKPTD

SEQ ID NO: 381783 - protein, 9 aa, Homo Sapiens
MTVWELFEE

SEQ ID NO: 381784 - protein, 9 aa, Homo Sapiens
HIALDLISE

SEQ ID NO: 381785 - protein, 9 aa, Homo Sapiens
CALLQGAIK

SEQ ID NO: 381786 - protein, 9 aa, Homo Sapiens
SACTYKELR

SEQ ID NO: 381787 - protein, 9 aa, Homo Sapiens
IGIKKAIAA

SEQ ID NO: 381788 - protein, 9 aa, Homo Sapiens
GVLGARRRP

SEQ ID NO: 381789 - protein, 9 aa, Homo Sapiens
FRKWIFYVL

SEQ ID NO: 381790 - protein, 9 aa, Homo Sapiens
PKVIKSSLF

SEQ ID NO: 381791 - protein, 9 aa, Homo Sapiens
SLKHRLQQN

SEQ ID NO: 381792 - protein, 9 aa, Homo Sapiens
ENGQANTVE

SEQ ID NO: 381793 - protein, 9 aa, Homo Sapiens
TYLSFKVLK

SEQ ID NO: 381794 - protein, 9 aa, Homo Sapiens
NLAEVVLQE

SEQ ID NO: 381795 - protein, 9 aa, Homo Sapiens
PKSGTFPRK

SEQ ID NO: 381796 - protein, 9 aa, Homo Sapiens
YDISKKARR

SEQ ID NO: 381797 - protein, 9 aa, Homo Sapiens
CITGGITSS

SEQ ID NO: 381798 - protein, 9 aa, Homo Sapiens
TLVDPAAIP

SEQ ID NO: 381799 - protein, 9 aa, Homo Sapiens
GSHKPTRKA

SEQ ID NO: 381800 - protein, 9 aa, Homo Sapiens
SEDDEISTQ

SEQ ID NO: 381801 - protein, 9 aa, Homo Sapiens
MHEITHTGE

SEQ ID NO: 381802 - protein, 9 aa, Homo Sapiens
VELLLNHKT

SEQ ID NO: 381803 - protein, 9 aa, Homo Sapiens
LSQHKIIHI

SEQ ID NO: 381804 - protein, 9 aa, Homo Sapiens
PLLKCSSLV

SEQ ID NO: 381805 - protein, 9 aa, Homo Sapiens
IGKGVNLYY

SEQ ID NO: 381806 - protein, 9 aa, Homo Sapiens
KDSFPRFLN

SEQ ID NO: 381807 - protein, 9 aa, Homo Sapiens
PIDCGVDNV

SEQ ID NO: 381808 - protein, 9 aa, Homo Sapiens
LAYLYSHTM

SEQ ID NO: 381809 - protein, 9 aa, Homo Sapiens
MVYNKEMPK

SEQ ID NO: 381810 - protein, 9 aa, Homo Sapiens
LRSLHFLQI

SEQ ID NO: 381811 - protein, 9 aa, Homo Sapiens
KLVCEDKSS

SEQ ID NO: 381812 - protein, 9 aa, Homo Sapiens
QHSSVACPC

SEQ ID NO: 381813 - protein, 9 aa, Homo Sapiens
SETQMLSVV

SEQ ID NO: 381814 - protein, 9 aa, Homo Sapiens
INLSKSPDP

SEQ ID NO: 381815 - protein, 9 aa, Homo Sapiens
DILSEEIRF

SEQ ID NO: 381816 - protein, 9 aa, Homo Sapiens
EQNNLKKEF

SEQ ID NO: 381817 - protein, 9 aa, Homo Sapiens
GQSLNYYTN

SEQ ID NO: 381818 - protein, 9 aa, Homo Sapiens
LLRLISLFT

SEQ ID NO: 381819 - protein, 9 aa, Homo Sapiens
SWPSSFRIH

SEQ ID NO: 381820 - protein, 9 aa, Homo Sapiens
VVLYACERR

SEQ ID NO: 381821 - protein, 9 aa, Homo Sapiens
LIIYACARW

SEQ ID NO: 381822 - protein, 9 aa, Homo Sapiens
PREIASLIW

SEQ ID NO: 381823 - protein, 9 aa, Homo Sapiens
LQQSPTPHG

SEQ ID NO: 381824 - protein, 9 aa, Homo Sapiens
RRSVWRALA

SEQ ID NO: 381825 - protein, 9 aa, Homo Sapiens
RLFLEPTQK

SEQ ID NO: 381826 - protein, 9 aa, Homo Sapiens
HRLSQRRRI

SEQ ID NO: 381827 - protein, 9 aa, Homo Sapiens
PKGEGSRAP

SEQ ID NO: 381828 - protein, 9 aa, Homo Sapiens
EKIRKQEKR

SEQ ID NO: 381829 - protein, 9 aa, Homo Sapiens
STGACPPHT

SEQ ID NO: 381830 - protein, 9 aa, Homo Sapiens
KMFTSQSAA

SEQ ID NO: 381831 - protein, 9 aa, Homo Sapiens
KNNSNWTKI

SEQ ID NO: 381832 - protein, 9 aa, Homo Sapiens
VCYGQKPEV

SEQ ID NO: 381833 - protein, 9 aa, Homo Sapiens
PEPQAMDDP

SEQ ID NO: 381834 - protein, 9 aa, Homo Sapiens
ERGALFSSF

SEQ ID NO: 381835 - protein, 9 aa, Homo Sapiens
QTTIGCGVR

SEQ ID NO: 381836 - protein, 9 aa, Homo Sapiens
MNFKAVLHY

SEQ ID NO: 381837 - protein, 9 aa, Homo Sapiens
GQSFIRAPD

SEQ ID NO: 381838 - protein, 9 aa, Homo Sapiens
NLSISPVSL

SEQ ID NO: 381839 - protein, 9 aa, Homo Sapiens
HINMDGDYI

SEQ ID NO: 381840 - protein, 9 aa, Homo Sapiens
YIHENATFQ

SEQ ID NO: 381841 - protein, 9 aa, Homo Sapiens
GGDDYCSLC

SEQ ID NO: 381842 - protein, 9 aa, Homo Sapiens
EIIHTGERP

SEQ ID NO: 381843 - protein, 9 aa, Homo Sapiens
VYNKEMPKE

SEQ ID NO: 381844 - protein, 9 aa, Homo Sapiens
TDTNELQLE

SEQ ID NO: 381845 - protein, 9 aa, Homo Sapiens
SCKRSRSRS

SEQ ID NO: 381846 - protein, 9 aa, Homo Sapiens
AANISIGAA

SEQ ID NO: 381847 - protein, 9 aa, Homo Sapiens
DNLLRGDNS

SEQ ID NO: 381848 - protein, 9 aa, Homo Sapiens
NREEMHIRY

SEQ ID NO: 381849 - protein, 9 aa, Homo Sapiens
MEDYVNFNL

SEQ ID NO: 381850 - protein, 9 aa, Homo Sapiens
LHSTTMMIR

SEQ ID NO: 381851 - protein, 9 aa, Homo Sapiens
VKLFNKHKT

SEQ ID NO: 381852 - protein, 9 aa, Homo Sapiens
WEFGRETNN

SEQ ID NO: 381853 - protein, 9 aa, Homo Sapiens
GIWKQWHED

SEQ ID NO: 381854 - protein, 9 aa, Homo Sapiens
TTQNNFNNL

SEQ ID NO: 381855 - protein, 9 aa, Homo Sapiens
TKIDLSVLE

SEQ ID NO: 381856 - protein, 9 aa, Homo Sapiens
KPRKQKRQR

SEQ ID NO: 381857 - protein, 9 aa, Homo Sapiens
IPFVGTIPN

SEQ ID NO: 381858 - protein, 9 aa, Homo Sapiens
QPMSATLRK

SEQ ID NO: 381859 - protein, 9 aa, Homo Sapiens
AELLQIQTL

SEQ ID NO: 381860 - protein, 9 aa, Homo Sapiens
TLEYFIQNF

SEQ ID NO: 381861 - protein, 9 aa, Homo Sapiens
DCCRSIQIG

SEQ ID NO: 381862 - protein, 9 aa, Homo Sapiens
AMAHVGSCK

SEQ ID NO: 381863 - protein, 9 aa, Homo Sapiens
FILLFVWSR

SEQ ID NO: 381864 - protein, 9 aa, Homo Sapiens
SQNYLDYFI

SEQ ID NO: 381865 - protein, 9 aa, Homo Sapiens
FNKTAPIKG

SEQ ID NO: 381866 - protein, 9 aa, Homo Sapiens
SHVGIAWAK

SEQ ID NO: 381867 - protein, 9 aa, Homo Sapiens
TLKGQGEKI

SEQ ID NO: 381868 - protein, 9 aa, Homo Sapiens
SPGIEWSNV

SEQ ID NO: 381869 - protein, 9 aa, Homo Sapiens
LKSELREKK

SEQ ID NO: 381870 - protein, 9 aa, Homo Sapiens
ICKVAQACY

SEQ ID NO: 381871 - protein, 9 aa, Homo Sapiens
LGENTFEGD

SEQ ID NO: 381872 - protein, 9 aa, Homo Sapiens
TRSTSYWRR

SEQ ID NO: 381873 - protein, 9 aa, Homo Sapiens
ELNKLHEEL

SEQ ID NO: 381874 - protein, 9 aa, Homo Sapiens
IHVDENGQS

SEQ ID NO: 381875 - protein, 9 aa, Homo Sapiens
KAEISYHIF

SEQ ID NO: 381876 - protein, 9 aa, Homo Sapiens
WDVERGALF

SEQ ID NO: 381877 - protein, 9 aa, Homo Sapiens
AFEGPYAAQ

SEQ ID NO: 381878 - protein, 9 aa, Homo Sapiens
DEELWRMQE

SEQ ID NO: 381879 - protein, 9 aa, Homo Sapiens
TKMFDLRTK

SEQ ID NO: 381880 - protein, 9 aa, Homo Sapiens
NGSPGIEWS

SEQ ID NO: 381881 - protein, 9 aa, Homo Sapiens
VKLDHPDIT

SEQ ID NO: 381882 - protein, 9 aa, Homo Sapiens
NGSFFAPSW

SEQ ID NO: 381883 - protein, 9 aa, Homo Sapiens
FNQQQKNLG

SEQ ID NO: 381884 - protein, 9 aa, Homo Sapiens
YRFLRKITI

SEQ ID NO: 381885 - protein, 9 aa, Homo Sapiens
NNSLNYFKE

SEQ ID NO: 381886 - protein, 9 aa, Homo Sapiens
KKLQTILQV

SEQ ID NO: 381887 - protein, 9 aa, Homo Sapiens
EMKKTVIRL

SEQ ID NO: 381888 - protein, 9 aa, Homo Sapiens
HGDYEITIH

SEQ ID NO: 381889 - protein, 9 aa, Homo Sapiens
NNHAWYFPS

SEQ ID NO: 381890 - protein, 9 aa, Homo Sapiens
AWYRFLLMA

SEQ ID NO: 381891 - protein, 9 aa, Homo Sapiens
RRAKSRCVV

SEQ ID NO: 381892 - protein, 9 aa, Homo Sapiens
FDKQVLYFD

SEQ ID NO: 381893 - protein, 9 aa, Homo Sapiens
TFVAQNRSA

SEQ ID NO: 381894 - protein, 9 aa, Homo Sapiens
ETQMLSVVT

SEQ ID NO: 381895 - protein, 9 aa, Homo Sapiens
YNFRAKVCG

SEQ ID NO: 381896 - protein, 9 aa, Homo Sapiens
YLFINNNIR

SEQ ID NO: 381897 - protein, 9 aa, Homo Sapiens
SVVLCLAVA

SEQ ID NO: 381898 - protein, 9 aa, Homo Sapiens
SGQPCCPCL

SEQ ID NO: 381899 - protein, 9 aa, Homo Sapiens
TLHVTIITD

SEQ ID NO: 381900 - protein, 9 aa, Homo Sapiens
KQSTPSDTQ

SEQ ID NO: 381901 - protein, 9 aa, Homo Sapiens
IQYQNDLSN

SEQ ID NO: 381902 - protein, 9 aa, Homo Sapiens
DIMRRFRTE

SEQ ID NO: 381903 - protein, 9 aa, Homo Sapiens
EMEHQKEGK

SEQ ID NO: 381904 - protein, 9 aa, Homo Sapiens
IYYTIINKL

SEQ ID NO: 381905 - protein, 9 aa, Homo Sapiens
LVLLKIEDE

SEQ ID NO: 381906 - protein, 9 aa, Homo Sapiens
PLTRLTPPV

SEQ ID NO: 381907 - protein, 9 aa, Homo Sapiens
DQHHIALDL

SEQ ID NO: 381908 - protein, 9 aa, Homo Sapiens
PSCSGPNTH

SEQ ID NO: 381909 - protein, 9 aa, Homo Sapiens
SKCGKSFSF

SEQ ID NO: 381910 - protein, 9 aa, Homo Sapiens
YLEKAEVTK

SEQ ID NO: 381911 - protein, 9 aa, Homo Sapiens
HDQKTQPIP

SEQ ID NO: 381912 - protein, 9 aa, Homo Sapiens
PTTADNTSM

SEQ ID NO: 381913 - protein, 9 aa, Homo Sapiens
SLRNNDLNY

SEQ ID NO: 381914 - protein, 9 aa, Homo Sapiens
GQDGQPQWE

SEQ ID NO: 381915 - protein, 9 aa, Homo Sapiens
HNTLNIHLF

SEQ ID NO: 381916 - protein, 9 aa, Homo Sapiens
QPQYSNPPV

SEQ ID NO: 381917 - protein, 9 aa, Homo Sapiens
LYTSIQKTL

SEQ ID NO: 381918 - protein, 9 aa, Homo Sapiens
ICFLLQKLV

SEQ ID NO: 381919 - protein, 9 aa, Homo Sapiens
SNNDFSIIL

SEQ ID NO: 381920 - protein, 9 aa, Homo Sapiens
HQTLVHRPG

SEQ ID NO: 381921 - protein, 9 aa, Homo Sapiens
APGIWLGLE

SEQ ID NO: 381922 - protein, 9 aa, Homo Sapiens
WKDLFQHHP

SEQ ID NO: 381923 - protein, 9 aa, Homo Sapiens
GKMWALSFK

SEQ ID NO: 381924 - protein, 9 aa, Homo Sapiens
NLQHDQKTQ

SEQ ID NO: 381925 - protein, 9 aa, Homo Sapiens
EEEEDTSNE

SEQ ID NO: 381926 - protein, 9 aa, Homo Sapiens
LFETENVDS

SEQ ID NO: 381927 - protein, 9 aa, Homo Sapiens
NTLGHTTQT

SEQ ID NO: 381928 - protein, 9 aa, Homo Sapiens
TGEESLNGI

SEQ ID NO: 381929 - protein, 9 aa, Homo Sapiens
ERSACTYKE

SEQ ID NO: 381930 - protein, 9 aa, Homo Sapiens
RASMNKLTR

SEQ ID NO: 381931 - protein, 9 aa, Homo Sapiens
LQGQSLNYY

SEQ ID NO: 381932 - protein, 9 aa, Homo Sapiens
LQIHNPLYP

SEQ ID NO: 381933 - protein, 9 aa, Homo Sapiens
RMEEMGNHI

SEQ ID NO: 381934 - protein, 9 aa, Homo Sapiens
LFEEKNQYN

SEQ ID NO: 381935 - protein, 9 aa, Homo Sapiens
LYFDAYLEE

SEQ ID NO: 381936 - protein, 9 aa, Homo Sapiens
AAMIKLVER

SEQ ID NO: 381937 - protein, 9 aa, Homo Sapiens
FSQSPPLGR

SEQ ID NO: 381938 - protein, 9 aa, Homo Sapiens
HAGRCRCYY

SEQ ID NO: 381939 - protein, 9 aa, Homo Sapiens
YPNFKDIQY

SEQ ID NO: 381940 - protein, 9 aa, Homo Sapiens
RFRTEMEKG

SEQ ID NO: 381941 - protein, 9 aa, Homo Sapiens
TCDEYFTQN

SEQ ID NO: 381942 - protein, 9 aa, Homo Sapiens
IIFWTPPSK

SEQ ID NO: 381943 - protein, 9 aa, Homo Sapiens
QKTSQKPRE

SEQ ID NO: 381944 - protein, 9 aa, Homo Sapiens
LYQNEEEEE

SEQ ID NO: 381945 - protein, 9 aa, Homo Sapiens
MELAQTCIG

SEQ ID NO: 381946 - protein, 9 aa, Homo Sapiens
VMEGQAATL

SEQ ID NO: 381947 - protein, 9 aa, Homo Sapiens
SLRVNYFNQ

SEQ ID NO: 381948 - protein, 9 aa, Homo Sapiens
RNVYRDVML

SEQ ID NO: 381949 - protein, 9 aa, Homo Sapiens
ARWDAAKVA

SEQ ID NO: 381950 - protein, 9 aa, Homo Sapiens
VNMPCCKRL

SEQ ID NO: 381951 - protein, 9 aa, Homo Sapiens
GSDCGFLAL

SEQ ID NO: 381952 - protein, 9 aa, Homo Sapiens
QHRILILGK

SEQ ID NO: 381953 - protein, 9 aa, Homo Sapiens
ADPRWIFCP

SEQ ID NO: 381954 - protein, 9 aa, Homo Sapiens
SVSCRYLNN

SEQ ID NO: 381955 - protein, 9 aa, Homo Sapiens
LYGRLLKKT

SEQ ID NO: 381956 - protein, 9 aa, Homo Sapiens
ASPAAPGKN

SEQ ID NO: 381957 - protein, 9 aa, Homo Sapiens
FREMSRNLT

SEQ ID NO: 381958 - protein, 9 aa, Homo Sapiens
YRVNIFLCQ

SEQ ID NO: 381959 - protein, 9 aa, Homo Sapiens
EYIKDEQNN

SEQ ID NO: 381960 - protein, 9 aa, Homo Sapiens
CKHVEKYIS

SEQ ID NO: 381961 - protein, 9 aa, Homo Sapiens
KKTALKATS

SEQ ID NO: 381962 - protein, 9 aa, Homo Sapiens
YFISAQKET

SEQ ID NO: 381963 - protein, 9 aa, Homo Sapiens
FLWRGPGQF

SEQ ID NO: 381964 - protein, 9 aa, Homo Sapiens
CGFLALIEG

SEQ ID NO: 381965 - protein, 9 aa, Homo Sapiens
AQMGPTKEP

SEQ ID NO: 381966 - protein, 9 aa, Homo Sapiens
NLNYLDEQE

SEQ ID NO: 381967 - protein, 9 aa, Homo Sapiens
PRMLTSASH

SEQ ID NO: 381968 - protein, 9 aa, Homo Sapiens
GISNVHKKR

SEQ ID NO: 381969 - protein, 9 aa, Homo Sapiens
LVSLMPYHI

SEQ ID NO: 381970 - protein, 9 aa, Homo Sapiens
NDASNLSTH

SEQ ID NO: 381971 - protein, 9 aa, Homo Sapiens
RTLKPLKTQ

SEQ ID NO: 381972 - protein, 9 aa, Homo Sapiens
EGIEKIITM

SEQ ID NO: 381973 - protein, 9 aa, Homo Sapiens
GIISSLPLF

SEQ ID NO: 381974 - protein, 9 aa, Homo Sapiens
VLGRLKALS

SEQ ID NO: 381975 - protein, 9 aa, Homo Sapiens
CHAINLYGE

SEQ ID NO: 381976 - protein, 9 aa, Homo Sapiens
GQEQQMKID

SEQ ID NO: 381977 - protein, 9 aa, Homo Sapiens
PHGHCTNTK

SEQ ID NO: 381978 - protein, 9 aa, Homo Sapiens
RQQNKLAEL

SEQ ID NO: 381979 - protein, 9 aa, Homo Sapiens
FTVDTRGPF

SEQ ID NO: 381980 - protein, 9 aa, Homo Sapiens
LCLLFMAAT

SEQ ID NO: 381981 - protein, 9 aa, Homo Sapiens
AMYLQLPEA

SEQ ID NO: 381982 - protein, 9 aa, Homo Sapiens
SLFQEGSHA

SEQ ID NO: 381983 - protein, 9 aa, Homo Sapiens
SEFSTVSSF

SEQ ID NO: 381984 - protein, 9 aa, Homo Sapiens
IKHQIIHSR

SEQ ID NO: 381985 - protein, 9 aa, Homo Sapiens
FEYYIYWTD

SEQ ID NO: 381986 - protein, 9 aa, Homo Sapiens
KCSSLVTLP

SEQ ID NO: 381987 - protein, 9 aa, Homo Sapiens
DFSIILQNV

SEQ ID NO: 381988 - protein, 9 aa, Homo Sapiens
AEVEILEAK

SEQ ID NO: 381989 - protein, 9 aa, Homo Sapiens
QCKMLQELP

SEQ ID NO: 381990 - protein, 9 aa, Homo Sapiens
QKDLDLAKV

SEQ ID NO: 381991 - protein, 9 aa, Homo Sapiens
TLEGFPTEP

SEQ ID NO: 381992 - protein, 9 aa, Homo Sapiens
LRRELGSID

SEQ ID NO: 381993 - protein, 9 aa, Homo Sapiens
DFTEIRAKG

SEQ ID NO: 381994 - protein, 9 aa, Homo Sapiens
THQQFPFLE

SEQ ID NO: 381995 - protein, 9 aa, Homo Sapiens
MRHSWKDLF

SEQ ID NO: 381996 - protein, 9 aa, Homo Sapiens
LQVQSPSIN

SEQ ID NO: 381997 - protein, 9 aa, Homo Sapiens
LFIISKVWP

SEQ ID NO: 381998 - protein, 9 aa, Homo Sapiens
KPKKTSGSH

SEQ ID NO: 381999 - protein, 9 aa, Homo Sapiens
SSMEVTDHI

SEQ ID NO: 382000 - protein, 9 aa, Homo Sapiens
YQNEEEEEA

SEQ ID NO: 382001 - protein, 9 aa, Homo Sapiens
YGFIQAKQF

SEQ ID NO: 382002 - protein, 9 aa, Homo Sapiens
IDSNRLLEN

SEQ ID NO: 382003 - protein, 9 aa, Homo Sapiens
PKGVIHDWR

SEQ ID NO: 382004 - protein, 9 aa, Homo Sapiens
VYKPELISR

SEQ ID NO: 382005 - protein, 9 aa, Homo Sapiens
EESNTGDEE

SEQ ID NO: 382006 - protein, 9 aa, Homo Sapiens
KGSFRCSCA

SEQ ID NO: 382007 - protein, 9 aa, Homo Sapiens
RCGLTYLHS

SEQ ID NO: 382008 - protein, 9 aa, Homo Sapiens
HPPIFRPIK

SEQ ID NO: 382009 - protein, 9 aa, Homo Sapiens
EAERGPHFP

SEQ ID NO: 382010 - protein, 9 aa, Homo Sapiens
IFLLFMNVY

SEQ ID NO: 382011 - protein, 9 aa, Homo Sapiens
AKLDAFFTL

SEQ ID NO: 382012 - protein, 9 aa, Homo Sapiens
RTEDKNFYL

SEQ ID NO: 382013 - protein, 9 aa, Homo Sapiens
EKITKIDLS

SEQ ID NO: 382014 - protein, 9 aa, Homo Sapiens
EKKMATPVE

SEQ ID NO: 382015 - protein, 9 aa, Homo Sapiens
EKVVNAQEL

SEQ ID NO: 382016 - protein, 9 aa, Homo Sapiens
HQFSTPFQL

SEQ ID NO: 382017 - protein, 9 aa, Homo Sapiens
LGWPMYRNT

SEQ ID NO: 382018 - protein, 9 aa, Homo Sapiens
FNLVFTPNK

SEQ ID NO: 382019 - protein, 9 aa, Homo Sapiens
GDGGYVKDA

SEQ ID NO: 382020 - protein, 9 aa, Homo Sapiens
SDKFYVGQP

SEQ ID NO: 382021 - protein, 9 aa, Homo Sapiens
LGLPLAIQN

SEQ ID NO: 382022 - protein, 9 aa, Homo Sapiens
MGAPSLECA

SEQ ID NO: 382023 - protein, 9 aa, Homo Sapiens
DIWRRALAP

SEQ ID NO: 382024 - protein, 9 aa, Homo Sapiens
TVPNMLLSM

SEQ ID NO: 382025 - protein, 9 aa, Homo Sapiens
RNEYLFDRN

SEQ ID NO: 382026 - protein, 9 aa, Homo Sapiens
YNAFPVGYE

SEQ ID NO: 382027 - protein, 9 aa, Homo Sapiens
ILFTLFAKG

SEQ ID NO: 382028 - protein, 9 aa, Homo Sapiens
STPGPRRKR

SEQ ID NO: 382029 - protein, 9 aa, Homo Sapiens
GCPEFRVRA

SEQ ID NO: 382030 - protein, 9 aa, Homo Sapiens
EAAKVQIQT

SEQ ID NO: 382031 - protein, 9 aa, Homo Sapiens
DLMSQVQTR

SEQ ID NO: 382032 - protein, 9 aa, Homo Sapiens
SFLSLTGIC

SEQ ID NO: 382033 - protein, 9 aa, Homo Sapiens
ALQEESKAA

SEQ ID NO: 382034 - protein, 9 aa, Homo Sapiens
VLGKCRYIY

SEQ ID NO: 382035 - protein, 9 aa, Homo Sapiens
HATYTYHMD

SEQ ID NO: 382036 - protein, 9 aa, Homo Sapiens
CVPACCKPV

SEQ ID NO: 382037 - protein, 9 aa, Homo Sapiens
NLNNRTLNV

SEQ ID NO: 382038 - protein, 9 aa, Homo Sapiens
RPATQIRTK

SEQ ID NO: 382039 - protein, 9 aa, Homo Sapiens
LSHLEDLFA

SEQ ID NO: 382040 - protein, 9 aa, Homo Sapiens
HDAETDQIM

SEQ ID NO: 382041 - protein, 9 aa, Homo Sapiens
FRLMRIFHV

SEQ ID NO: 382042 - protein, 9 aa, Homo Sapiens
KSLFQEGSH

SEQ ID NO: 382043 - protein, 9 aa, Homo Sapiens
KHRLQQNVA

SEQ ID NO: 382044 - protein, 9 aa, Homo Sapiens
AQLAEDIKA

SEQ ID NO: 382045 - protein, 9 aa, Homo Sapiens
AQNILLSEK

SEQ ID NO: 382046 - protein, 9 aa, Homo Sapiens
KLEDPREKQ

SEQ ID NO: 382047 - protein, 9 aa, Homo Sapiens
VPDINMEEN

SEQ ID NO: 382048 - protein, 9 aa, Homo Sapiens
LAYAAHATR

SEQ ID NO: 382049 - protein, 9 aa, Homo Sapiens
IIICSLEGL

SEQ ID NO: 382050 - protein, 9 aa, Homo Sapiens
RSHTCFNHL

SEQ ID NO: 382051 - protein, 9 aa, Homo Sapiens
AESVWLPGV

SEQ ID NO: 382052 - protein, 9 aa, Homo Sapiens
NLLQEVPHE

SEQ ID NO: 382053 - protein, 9 aa, Homo Sapiens
KCLAFQNPG

SEQ ID NO: 382054 - protein, 9 aa, Homo Sapiens
DPQLNLKVI

SEQ ID NO: 382055 - protein, 9 aa, Homo Sapiens
DTTYNKVVF

SEQ ID NO: 382056 - protein, 9 aa, Homo Sapiens
CEVCGQSFI

SEQ ID NO: 382057 - protein, 9 aa, Homo Sapiens
TLLENLQNR

SEQ ID NO: 382058 - protein, 9 aa, Homo Sapiens
VSKEINLRL

SEQ ID NO: 382059 - protein, 9 aa, Homo Sapiens
GQKMSKRKN

SEQ ID NO: 382060 - protein, 9 aa, Homo Sapiens
NLRENKNNQ

SEQ ID NO: 382061 - protein, 9 aa, Homo Sapiens
FLILPLPQL

SEQ ID NO: 382062 - protein, 9 aa, Homo Sapiens
KINTRTGQG

SEQ ID NO: 382063 - protein, 9 aa, Homo Sapiens
ASHSRKLIL

SEQ ID NO: 382064 - protein, 9 aa, Homo Sapiens
TLSQPWPGH

SEQ ID NO: 382065 - protein, 9 aa, Homo Sapiens
SELDQYHGQ

SEQ ID NO: 382066 - protein, 9 aa, Homo Sapiens
SKELMSCHD

SEQ ID NO: 382067 - protein, 9 aa, Homo Sapiens
KTNKQELCP

SEQ ID NO: 382068 - protein, 9 aa, Homo Sapiens
IQDMDGVEP

SEQ ID NO: 382069 - protein, 9 aa, Homo Sapiens
IIGKNAALW

SEQ ID NO: 382070 - protein, 9 aa, Homo Sapiens
LSELWVLSI

SEQ ID NO: 382071 - protein, 9 aa, Homo Sapiens
CSSSVSDDL

SEQ ID NO: 382072 - protein, 9 aa, Homo Sapiens
TEKQMRDFL

SEQ ID NO: 382073 - protein, 9 aa, Homo Sapiens
ESSSPSAAA

SEQ ID NO: 382074 - protein, 9 aa, Homo Sapiens
KLVYHQINH

SEQ ID NO: 382075 - protein, 9 aa, Homo Sapiens
AKASTIFNC

SEQ ID NO: 382076 - protein, 9 aa, Homo Sapiens
IPETVRTIQ

SEQ ID NO: 382077 - protein, 9 aa, Homo Sapiens
PISGSLALG

SEQ ID NO: 382078 - protein, 9 aa, Homo Sapiens
SNEKMEKKR

SEQ ID NO: 382079 - protein, 9 aa, Homo Sapiens
SIIFETDES

SEQ ID NO: 382080 - protein, 9 aa, Homo Sapiens
EDDGLFVPH

SEQ ID NO: 382081 - protein, 9 aa, Homo Sapiens
EERQINKEA

SEQ ID NO: 382082 - protein, 9 aa, Homo Sapiens
KTEVNITFC

SEQ ID NO: 382083 - protein, 9 aa, Homo Sapiens
NFRAKVCGK

SEQ ID NO: 382084 - protein, 9 aa, Homo Sapiens
ELLLNHKTP

SEQ ID NO: 382085 - protein, 9 aa, Homo Sapiens
LKMQLEQEY

SEQ ID NO: 382086 - protein, 9 aa, Homo Sapiens
HDYHIALFG

SEQ ID NO: 382087 - protein, 9 aa, Homo Sapiens
KLMELRLRD

SEQ ID NO: 382088 - protein, 9 aa, Homo Sapiens
NDQPINLTK

SEQ ID NO: 382089 - protein, 9 aa, Homo Sapiens
APVDVGGTN

SEQ ID NO: 382090 - protein, 9 aa, Homo Sapiens
INLQPGSSD

SEQ ID NO: 382091 - protein, 9 aa, Homo Sapiens
GWYTVAAVN

SEQ ID NO: 382092 - protein, 9 aa, Homo Sapiens
VTALVKNRL

SEQ ID NO: 382093 - protein, 9 aa, Homo Sapiens
RGAIARKQI

SEQ ID NO: 382094 - protein, 9 aa, Homo Sapiens
GHFRRILIY

SEQ ID NO: 382095 - protein, 9 aa, Homo Sapiens
ISRETFQQR

SEQ ID NO: 382096 - protein, 9 aa, Homo Sapiens
RTYFRRKPI

SEQ ID NO: 382097 - protein, 9 aa, Homo Sapiens
LKGVNGKYI

SEQ ID NO: 382098 - protein, 9 aa, Homo Sapiens
FIETSTKTR

SEQ ID NO: 382099 - protein, 9 aa, Homo Sapiens
TLSPAAIPT

SEQ ID NO: 382100 - protein, 9 aa, Homo Sapiens
CWYETVKIS

SEQ ID NO: 382101 - protein, 9 aa, Homo Sapiens
SLSPRWGRQ

SEQ ID NO: 382102 - protein, 9 aa, Homo Sapiens
LQDNPWDCT

SEQ ID NO: 382103 - protein, 9 aa, Homo Sapiens
CMEKGNIKW

SEQ ID NO: 382104 - protein, 9 aa, Homo Sapiens
AEALCVVKI

SEQ ID NO: 382105 - protein, 9 aa, Homo Sapiens
SFRLRSTSV

SEQ ID NO: 382106 - protein, 9 aa, Homo Sapiens
RQKALWMVF

SEQ ID NO: 382107 - protein, 9 aa, Homo Sapiens
RIHTSTYNI

SEQ ID NO: 382108 - protein, 9 aa, Homo Sapiens
LRSPIQMKN

SEQ ID NO: 382109 - protein, 9 aa, Homo Sapiens
LSGFPGAKG

SEQ ID NO: 382110 - protein, 9 aa, Homo Sapiens
RLAYAAHAT

SEQ ID NO: 382111 - protein, 9 aa, Homo Sapiens
ARRDNLQRK

SEQ ID NO: 382112 - protein, 9 aa, Homo Sapiens
LKVKLDHPD

SEQ ID NO: 382113 - protein, 9 aa, Homo Sapiens
YLNNSLHVF

SEQ ID NO: 382114 - protein, 9 aa, Homo Sapiens
VLAVKELSW

SEQ ID NO: 382115 - protein, 9 aa, Homo Sapiens
QFTRDFIQD

SEQ ID NO: 382116 - protein, 9 aa, Homo Sapiens
YLYTHTACD

SEQ ID NO: 382117 - protein, 9 aa, Homo Sapiens
EPVGPESRA

SEQ ID NO: 382118 - protein, 9 aa, Homo Sapiens
GQICLYCVT

SEQ ID NO: 382119 - protein, 9 aa, Homo Sapiens
RMFKEADDL

SEQ ID NO: 382120 - protein, 9 aa, Homo Sapiens
ELFVDDFEE

SEQ ID NO: 382121 - protein, 9 aa, Homo Sapiens
HKGNFFLSQ

SEQ ID NO: 382122 - protein, 9 aa, Homo Sapiens
ECVTASTNG

SEQ ID NO: 382123 - protein, 9 aa, Homo Sapiens
TCFNHLDLP

SEQ ID NO: 382124 - protein, 9 aa, Homo Sapiens
NCINLSKSP

SEQ ID NO: 382125 - protein, 9 aa, Homo Sapiens
KSFKDKFMK

SEQ ID NO: 382126 - protein, 9 aa, Homo Sapiens
APAASEGAT

SEQ ID NO: 382127 - protein, 9 aa, Homo Sapiens
DPVQRNVYR

SEQ ID NO: 382128 - protein, 9 aa, Homo Sapiens
PSWDMYSHY

SEQ ID NO: 382129 - protein, 9 aa, Homo Sapiens
REMSRNLTQ

SEQ ID NO: 382130 - protein, 9 aa, Homo Sapiens
KYVFNPIVY

SEQ ID NO: 382131 - protein, 9 aa, Homo Sapiens
NIWVVGAET

SEQ ID NO: 382132 - protein, 9 aa, Homo Sapiens
HNFWCEAMK

SEQ ID NO: 382133 - protein, 9 aa, Homo Sapiens
TKNPDVLKD

SEQ ID NO: 382134 - protein, 9 aa, Homo Sapiens
FYTRYSLKS

SEQ ID NO: 382135 - protein, 9 aa, Homo Sapiens
RNYRKALKF

SEQ ID NO: 382136 - protein, 9 aa, Homo Sapiens
SSHKSIATV

SEQ ID NO: 382137 - protein, 9 aa, Homo Sapiens
RKQSRHRAI

SEQ ID NO: 382138 - protein, 9 aa, Homo Sapiens
QPACCVPAC

SEQ ID NO: 382139 - protein, 9 aa, Homo Sapiens
NAQRKDSEI

SEQ ID NO: 382140 - protein, 9 aa, Homo Sapiens
HCRCSFQAR

SEQ ID NO: 382141 - protein, 9 aa, Homo Sapiens
SQVQTRMQK

SEQ ID NO: 382142 - protein, 9 aa, Homo Sapiens
LYPTEDIND

SEQ ID NO: 382143 - protein, 9 aa, Homo Sapiens
ENELFTFFV

SEQ ID NO: 382144 - protein, 9 aa, Homo Sapiens
RITYSLAKD

SEQ ID NO: 382145 - protein, 9 aa, Homo Sapiens
CETDKLRAA

SEQ ID NO: 382146 - protein, 9 aa, Homo Sapiens
SSNTLKGQG

SEQ ID NO: 382147 - protein, 9 aa, Homo Sapiens
RHGNIADAS

SEQ ID NO: 382148 - protein, 9 aa, Homo Sapiens
GHCTNTKGS

SEQ ID NO: 382149 - protein, 9 aa, Homo Sapiens
LTRLTPPVR

SEQ ID NO: 382150 - protein, 9 aa, Homo Sapiens
TSVDTGCKT

SEQ ID NO: 382151 - protein, 9 aa, Homo Sapiens
TCKPLLKCS

SEQ ID NO: 382152 - protein, 9 aa, Homo Sapiens
NSRYVEMKY

SEQ ID NO: 382153 - protein, 9 aa, Homo Sapiens
VVLQESASN

SEQ ID NO: 382154 - protein, 9 aa, Homo Sapiens
GCILSELWV

SEQ ID NO: 382155 - protein, 9 aa, Homo Sapiens
WKHNFNSPD

SEQ ID NO: 382156 - protein, 9 aa, Homo Sapiens
AFQETREVR

SEQ ID NO: 382157 - protein, 9 aa, Homo Sapiens
NLYYVGGEV

SEQ ID NO: 382158 - protein, 9 aa, Homo Sapiens
DKPRKQKRQ

SEQ ID NO: 382159 - protein, 9 aa, Homo Sapiens
LSQEEGALW

SEQ ID NO: 382160 - protein, 9 aa, Homo Sapiens
VTASTNGTC

SEQ ID NO: 382161 - protein, 9 aa, Homo Sapiens
EECVQKFIK

SEQ ID NO: 382162 - protein, 9 aa, Homo Sapiens
NKQEAKKKA

SEQ ID NO: 382163 - protein, 9 aa, Homo Sapiens
ALFLLFVAC

SEQ ID NO: 382164 - protein, 9 aa, Homo Sapiens
LPQHLKELL

SEQ ID NO: 382165 - protein, 9 aa, Homo Sapiens
YHGSAFEYF

SEQ ID NO: 382166 - protein, 9 aa, Homo Sapiens
LKFHDAETD

SEQ ID NO: 382167 - protein, 9 aa, Homo Sapiens
KCHTLFSTH

SEQ ID NO: 382168 - protein, 9 aa, Homo Sapiens
VVWGITRQE

SEQ ID NO: 382169 - protein, 9 aa, Homo Sapiens
TIFVIILAL

SEQ ID NO: 382170 - protein, 9 aa, Homo Sapiens
IKQKWQMFL

SEQ ID NO: 382171 - protein, 9 aa, Homo Sapiens
LSRAEARWD

SEQ ID NO: 382172 - protein, 9 aa, Homo Sapiens
NNLYATQMN

SEQ ID NO: 382173 - protein, 9 aa, Homo Sapiens
LSWQKRTGL

SEQ ID NO: 382174 - protein, 9 aa, Homo Sapiens
HTFWKEDKA

SEQ ID NO: 382175 - protein, 9 aa, Homo Sapiens
LVLLGLSFR

SEQ ID NO: 382176 - protein, 9 aa, Homo Sapiens
KQKWQMFLL

SEQ ID NO: 382177 - protein, 9 aa, Homo Sapiens
SFQIHEITH

SEQ ID NO: 382178 - protein, 9 aa, Homo Sapiens
YFIQNFSVL

SEQ ID NO: 382179 - protein, 9 aa, Homo Sapiens
KVVNAQELQ

SEQ ID NO: 382180 - protein, 9 aa, Homo Sapiens
QNYLDYFIS

SEQ ID NO: 382181 - protein, 9 aa, Homo Sapiens
HYIFNRDST

SEQ ID NO: 382182 - protein, 9 aa, Homo Sapiens
FNRMVIYFF

SEQ ID NO: 382183 - protein, 9 aa, Homo Sapiens
IIHSGEKPC

SEQ ID NO: 382184 - protein, 9 aa, Homo Sapiens
VSQIIKLNC

SEQ ID NO: 382185 - protein, 9 aa, Homo Sapiens
FQLKAEISY

SEQ ID NO: 382186 - protein, 9 aa, Homo Sapiens
RSCNSMVSC

SEQ ID NO: 382187 - protein, 9 aa, Homo Sapiens
GPPGLSGFP

SEQ ID NO: 382188 - protein, 9 aa, Homo Sapiens
HFLEAHSSS

SEQ ID NO: 382189 - protein, 9 aa, Homo Sapiens
GVPGPPGLG

SEQ ID NO: 382190 - protein, 9 aa, Homo Sapiens
KSNLNYLDE

SEQ ID NO: 382191 - protein, 9 aa, Homo Sapiens
NVTHKAYWQ

SEQ ID NO: 382192 - protein, 9 aa, Homo Sapiens
DTGNHASMI

SEQ ID NO: 382193 - protein, 9 aa, Homo Sapiens
RYFFCMEKG

SEQ ID NO: 382194 - protein, 9 aa, Homo Sapiens
WRMQEMLHK

SEQ ID NO: 382195 - protein, 9 aa, Homo Sapiens
EKEKSDEKS

SEQ ID NO: 382196 - protein, 9 aa, Homo Sapiens
LPRLGRRSS

SEQ ID NO: 382197 - protein, 9 aa, Homo Sapiens
TYFQMLPIS

SEQ ID NO: 382198 - protein, 9 aa, Homo Sapiens
GNLIVHQQI

SEQ ID NO: 382199 - protein, 9 aa, Homo Sapiens
KHQNVFNQP

SEQ ID NO: 382200 - protein, 9 aa, Homo Sapiens
PKSLLALGS

SEQ ID NO: 382201 - protein, 9 aa, Homo Sapiens
CNHFTISGN

SEQ ID NO: 382202 - protein, 9 aa, Homo Sapiens
SLCSGFIKP

SEQ ID NO: 382203 - protein, 9 aa, Homo Sapiens
KEDMEEWIT

SEQ ID NO: 382204 - protein, 9 aa, Homo Sapiens
LLPLFGHIG

SEQ ID NO: 382205 - protein, 9 aa, Homo Sapiens
FNRVDISIS

SEQ ID NO: 382206 - protein, 9 aa, Homo Sapiens
WSVLKQKKT

SEQ ID NO: 382207 - protein, 9 aa, Homo Sapiens
NGIISSLPL

SEQ ID NO: 382208 - protein, 9 aa, Homo Sapiens
IHQFVLLFL

SEQ ID NO: 382209 - protein, 9 aa, Homo Sapiens
LWRMQEMLH

SEQ ID NO: 382210 - protein, 9 aa, Homo Sapiens
KQTAIIKVV

SEQ ID NO: 382211 - protein, 9 aa, Homo Sapiens
GYFTDTNEL

SEQ ID NO: 382212 - protein, 9 aa, Homo Sapiens
GREVYFADR

SEQ ID NO: 382213 - protein, 9 aa, Homo Sapiens
SVWTLPRNG

SEQ ID NO: 382214 - protein, 9 aa, Homo Sapiens
QEESRIYFR

SEQ ID NO: 382215 - protein, 9 aa, Homo Sapiens
QKDIALLKL

SEQ ID NO: 382216 - protein, 9 aa, Homo Sapiens
LVASWYVDD

SEQ ID NO: 382217 - protein, 9 aa, Homo Sapiens
LIKHQIIHS

SEQ ID NO: 382218 - protein, 9 aa, Homo Sapiens
VAKKICELM

SEQ ID NO: 382219 - protein, 9 aa, Homo Sapiens
VKPIIIGCH

SEQ ID NO: 382220 - protein, 9 aa, Homo Sapiens
VIDEAHRIN

SEQ ID NO: 382221 - protein, 9 aa, Homo Sapiens
VFNSNLPSE

SEQ ID NO: 382222 - protein, 9 aa, Homo Sapiens
GLNNCQTEK

SEQ ID NO: 382223 - protein, 9 aa, Homo Sapiens
ILLFVWSRG

SEQ ID NO: 382224 - protein, 9 aa, Homo Sapiens
LYYFSDHYT

SEQ ID NO: 382225 - protein, 9 aa, Homo Sapiens
PIVVCLHWF

SEQ ID NO: 382226 - protein, 9 aa, Homo Sapiens
QNHTGEKPY

SEQ ID NO: 382227 - protein, 9 aa, Homo Sapiens
PESSGDNGQ

SEQ ID NO: 382228 - protein, 9 aa, Homo Sapiens
FCIDGPVIS

SEQ ID NO: 382229 - protein, 9 aa, Homo Sapiens
SNTGDEESK

SEQ ID NO: 382230 - protein, 9 aa, Homo Sapiens
DYREVYQEH

SEQ ID NO: 382231 - protein, 9 aa, Homo Sapiens
TYVWMAPEV

SEQ ID NO: 382232 - protein, 9 aa, Homo Sapiens
PALYQNEEE

SEQ ID NO: 382233 - protein, 9 aa, Homo Sapiens
LPSNTEKED

SEQ ID NO: 382234 - protein, 9 aa, Homo Sapiens
LCPDSPPNL

SEQ ID NO: 382235 - protein, 9 aa, Homo Sapiens
DELEESDKF

SEQ ID NO: 382236 - protein, 9 aa, Homo Sapiens
SLPQHLKEL

SEQ ID NO: 382237 - protein, 9 aa, Homo Sapiens
DFIQDSGVV

SEQ ID NO: 382238 - protein, 9 aa, Homo Sapiens
ACERRIRFW

SEQ ID NO: 382239 - protein, 9 aa, Homo Sapiens
EQLIRERQQ

SEQ ID NO: 382240 - protein, 9 aa, Homo Sapiens
EEELQHRIL

SEQ ID NO: 382241 - protein, 9 aa, Homo Sapiens
GSIGRHYAR

SEQ ID NO: 382242 - protein, 9 aa, Homo Sapiens
DFSKWYMDY

SEQ ID NO: 382243 - protein, 9 aa, Homo Sapiens
LPESSGDNG

SEQ ID NO: 382244 - protein, 9 aa, Homo Sapiens
RSRLEEPVG

SEQ ID NO: 382245 - protein, 9 aa, Homo Sapiens
NTSTDHFNL

SEQ ID NO: 382246 - protein, 9 aa, Homo Sapiens
HSQRILHGD

SEQ ID NO: 382247 - protein, 9 aa, Homo Sapiens
LMKLTLEYF

SEQ ID NO: 382248 - protein, 9 aa, Homo Sapiens
LSEHTIHYV

SEQ ID NO: 382249 - protein, 9 aa, Homo Sapiens
YFFCMEKGN

SEQ ID NO: 382250 - protein, 9 aa, Homo Sapiens
HRLQQNVAS

SEQ ID NO: 382251 - protein, 9 aa, Homo Sapiens
EKQICIPRS

SEQ ID NO: 382252 - protein, 9 aa, Homo Sapiens
HCTNTKGSF

SEQ ID NO: 382253 - protein, 9 aa, Homo Sapiens
CFSGDGGYV

SEQ ID NO: 382254 - protein, 9 aa, Homo Sapiens
YPQLHIRKA

SEQ ID NO: 382255 - protein, 9 aa, Homo Sapiens
PVGYEYADF

SEQ ID NO: 382256 - protein, 9 aa, Homo Sapiens
TLRKRLRKT

SEQ ID NO: 382257 - protein, 9 aa, Homo Sapiens
QSQQSQPVK

SEQ ID NO: 382258 - protein, 9 aa, Homo Sapiens
TGCGKNKEN

SEQ ID NO: 382259 - protein, 9 aa, Homo Sapiens
QQLADHGVS

SEQ ID NO: 382260 - protein, 9 aa, Homo Sapiens
GICFTTSVV

SEQ ID NO: 382261 - protein, 9 aa, Homo Sapiens
KVGDSLMVM

SEQ ID NO: 382262 - protein, 9 aa, Homo Sapiens
TQLLMSVEP

SEQ ID NO: 382263 - protein, 9 aa, Homo Sapiens
PLLWLLQFI

SEQ ID NO: 382264 - protein, 9 aa, Homo Sapiens
FLGSYHMPY

SEQ ID NO: 382265 - protein, 9 aa, Homo Sapiens
LNNSLHVFV

SEQ ID NO: 382266 - protein, 9 aa, Homo Sapiens
NVQDNSLEI

SEQ ID NO: 382267 - protein, 9 aa, Homo Sapiens
CCCAQECSS

SEQ ID NO: 382268 - protein, 9 aa, Homo Sapiens
KNDYWKLSM

SEQ ID NO: 382269 - protein, 9 aa, Homo Sapiens
VSVTYYKRL

SEQ ID NO: 382270 - protein, 9 aa, Homo Sapiens
VHPGMDLSK

SEQ ID NO: 382271 - protein, 9 aa, Homo Sapiens
TFDLQEMLF

SEQ ID NO: 382272 - protein, 9 aa, Homo Sapiens
FDSMRNEYL

SEQ ID NO: 382273 - protein, 9 aa, Homo Sapiens
GQLKHGDFH

SEQ ID NO: 382274 - protein, 9 aa, Homo Sapiens
LHKVFCEIT

SEQ ID NO: 382275 - protein, 9 aa, Homo Sapiens
HFRRILIYL

SEQ ID NO: 382276 - protein, 9 aa, Homo Sapiens
VVRIMQKKY

SEQ ID NO: 382277 - protein, 9 aa, Homo Sapiens
QCNCINLSK

SEQ ID NO: 382278 - protein, 9 aa, Homo Sapiens
KSVGPWKMV

SEQ ID NO: 382279 - protein, 9 aa, Homo Sapiens
MERVSVIFD

SEQ ID NO: 382280 - protein, 9 aa, Homo Sapiens
KAFKIIKDS

SEQ ID NO: 382281 - protein, 9 aa, Homo Sapiens
SHNGEKPFK

SEQ ID NO: 382282 - protein, 9 aa, Homo Sapiens
YAAHATRIP

SEQ ID NO: 382283 - protein, 9 aa, Homo Sapiens
GLTYLHSLS

SEQ ID NO: 382284 - protein, 9 aa, Homo Sapiens
QNSAEVLYQ

SEQ ID NO: 382285 - protein, 9 aa, Homo Sapiens
TTFVLFMFF

SEQ ID NO: 382286 - protein, 9 aa, Homo Sapiens
LLQHINFMK

SEQ ID NO: 382287 - protein, 9 aa, Homo Sapiens
FIESLNCQT

SEQ ID NO: 382288 - protein, 9 aa, Homo Sapiens
GFRKEKANM

SEQ ID NO: 382289 - protein, 9 aa, Homo Sapiens
SDTKNQEGK

SEQ ID NO: 382290 - protein, 9 aa, Homo Sapiens
SEENSEYDF

SEQ ID NO: 382291 - protein, 9 aa, Homo Sapiens
VAKIWFQQK

SEQ ID NO: 382292 - protein, 9 aa, Homo Sapiens
EALQIIISE

SEQ ID NO: 382293 - protein, 9 aa, Homo Sapiens
NNDKKVRVF

SEQ ID NO: 382294 - protein, 9 aa, Homo Sapiens
HVETKLFHS

SEQ ID NO: 382295 - protein, 9 aa, Homo Sapiens
NLYGEDRGL

SEQ ID NO: 382296 - protein, 9 aa, Homo Sapiens
ESLKPLKLK

SEQ ID NO: 382297 - protein, 9 aa, Homo Sapiens
IQHQIIHTE

SEQ ID NO: 382298 - protein, 9 aa, Homo Sapiens
PETQKYVGP

SEQ ID NO: 382299 - protein, 9 aa, Homo Sapiens
FNHSSHLTR

SEQ ID NO: 382300 - protein, 9 aa, Homo Sapiens
ALVLRIRCR

SEQ ID NO: 382301 - protein, 9 aa, Homo Sapiens
TENVDSIQG

SEQ ID NO: 382302 - protein, 9 aa, Homo Sapiens
PGQFFFFFE

SEQ ID NO: 382303 - protein, 9 aa, Homo Sapiens
GKVYINVKM

SEQ ID NO: 382304 - protein, 9 aa, Homo Sapiens
LLALGSSLA

SEQ ID NO: 382305 - protein, 9 aa, Homo Sapiens
NNVVLDEDR

SEQ ID NO: 382306 - protein, 9 aa, Homo Sapiens
QKQFFHSVL

SEQ ID NO: 382307 - protein, 9 aa, Homo Sapiens
GSGIQYLHE

SEQ ID NO: 382308 - protein, 9 aa, Homo Sapiens
LEGTVWTKI

SEQ ID NO: 382309 - protein, 9 aa, Homo Sapiens
CIDGPVISE

SEQ ID NO: 382310 - protein, 9 aa, Homo Sapiens
VVLDAIMQE

SEQ ID NO: 382311 - protein, 9 aa, Homo Sapiens
LGRVEAYLN

SEQ ID NO: 382312 - protein, 9 aa, Homo Sapiens
DWFISANVM

SEQ ID NO: 382313 - protein, 9 aa, Homo Sapiens
LKFDTTPNK

SEQ ID NO: 382314 - protein, 9 aa, Homo Sapiens
GEPPKEIWL

SEQ ID NO: 382315 - protein, 9 aa, Homo Sapiens
KLLPLFGHI

SEQ ID NO: 382316 - protein, 9 aa, Homo Sapiens
NFYIRPILS

SEQ ID NO: 382317 - protein, 9 aa, Homo Sapiens
VGEGPFSNY

SEQ ID NO: 382318 - protein, 9 aa, Homo Sapiens
TVNKLPAGI

SEQ ID NO: 382319 - protein, 9 aa, Homo Sapiens
EDMMNDSNE

SEQ ID NO: 382320 - protein, 9 aa, Homo Sapiens
FVLGISTVN

SEQ ID NO: 382321 - protein, 9 aa, Homo Sapiens
IRGISSNQL

SEQ ID NO: 382322 - protein, 9 aa, Homo Sapiens
KATHQKELD

SEQ ID NO: 382323 - protein, 9 aa, Homo Sapiens
KCHGRGTCN

SEQ ID NO: 382324 - protein, 9 aa, Homo Sapiens
EEKVCALNK

SEQ ID NO: 382325 - protein, 9 aa, Homo Sapiens
TEDINDRLR

SEQ ID NO: 382326 - protein, 9 aa, Homo Sapiens
SQPVKLDPF

SEQ ID NO: 382327 - protein, 9 aa, Homo Sapiens
LYKARVEEL

SEQ ID NO: 382328 - protein, 9 aa, Homo Sapiens
SILEIRETY

SEQ ID NO: 382329 - protein, 9 aa, Homo Sapiens
QTYCSKMEY

SEQ ID NO: 382330 - protein, 9 aa, Homo Sapiens
HTHLLLHTE

SEQ ID NO: 382331 - protein, 9 aa, Homo Sapiens
EARHPQISL

SEQ ID NO: 382332 - protein, 9 aa, Homo Sapiens
MEVTDHIAS

SEQ ID NO: 382333 - protein, 9 aa, Homo Sapiens
SARENINLQ

SEQ ID NO: 382334 - protein, 9 aa, Homo Sapiens
ICIPRSLSV

SEQ ID NO: 382335 - protein, 9 aa, Homo Sapiens
YNGCGAFSY

SEQ ID NO: 382336 - protein, 9 aa, Homo Sapiens
LPIRHIWLS

SEQ ID NO: 382337 - protein, 9 aa, Homo Sapiens
NLTDFYCEK

SEQ ID NO: 382338 - protein, 9 aa, Homo Sapiens
NQYNIDYSH

SEQ ID NO: 382339 - protein, 9 aa, Homo Sapiens
SIIDEKLFQ

SEQ ID NO: 382340 - protein, 9 aa, Homo Sapiens
PFNMEVCKF

SEQ ID NO: 382341 - protein, 9 aa, Homo Sapiens
LIWNKFGSA

SEQ ID NO: 382342 - protein, 9 aa, Homo Sapiens
RPWRCPEDF

SEQ ID NO: 382343 - protein, 9 aa, Homo Sapiens
IFLTLQFVF

SEQ ID NO: 382344 - protein, 9 aa, Homo Sapiens
AAKTGIEVS

SEQ ID NO: 382345 - protein, 9 aa, Homo Sapiens
GECKSFKDK

SEQ ID NO: 382346 - protein, 9 aa, Homo Sapiens
LRLSTYAKL

SEQ ID NO: 382347 - protein, 9 aa, Homo Sapiens
TSIQKTLKF

SEQ ID NO: 382348 - protein, 9 aa, Homo Sapiens
ATYTYHMDV

SEQ ID NO: 382349 - protein, 9 aa, Homo Sapiens
KAASQTLCI

SEQ ID NO: 382350 - protein, 9 aa, Homo Sapiens
DTKTVGEGQ

SEQ ID NO: 382351 - protein, 9 aa, Homo Sapiens
LLAENFIFS

SEQ ID NO: 382352 - protein, 9 aa, Homo Sapiens
CCAQECSSN

SEQ ID NO: 382353 - protein, 9 aa, Homo Sapiens
RSTSYWRRW

SEQ ID NO: 382354 - protein, 9 aa, Homo Sapiens
ICITDAVYN

SEQ ID NO: 382355 - protein, 9 aa, Homo Sapiens
KPTGCLSKI

SEQ ID NO: 382356 - protein, 9 aa, Homo Sapiens
MDSISKNFP

SEQ ID NO: 382357 - protein, 9 aa, Homo Sapiens
QGFIQGKYY

SEQ ID NO: 382358 - protein, 9 aa, Homo Sapiens
QDMDGVEPV

SEQ ID NO: 382359 - protein, 9 aa, Homo Sapiens
EPVRILSKY

SEQ ID NO: 382360 - protein, 9 aa, Homo Sapiens
CNCINLSKS

SEQ ID NO: 382361 - protein, 9 aa, Homo Sapiens
FLFLIKHPE

SEQ ID NO: 382362 - protein, 9 aa, Homo Sapiens
IVGKYGTQI

SEQ ID NO: 382363 - protein, 9 aa, Homo Sapiens
DSKFIETSA

SEQ ID NO: 382364 - protein, 9 aa, Homo Sapiens
GELKLLLLD

SEQ ID NO: 382365 - protein, 9 aa, Homo Sapiens
EAASVQRSM

SEQ ID NO: 382366 - protein, 9 aa, Homo Sapiens
HEITHTINI

SEQ ID NO: 382367 - protein, 9 aa, Homo Sapiens
FTEIRAKGP

SEQ ID NO: 382368 - protein, 9 aa, Homo Sapiens
STAISYVHI

SEQ ID NO: 382369 - protein, 9 aa, Homo Sapiens
PVSPAADHK

SEQ ID NO: 382370 - protein, 9 aa, Homo Sapiens
EGIGNFVEL

SEQ ID NO: 382371 - protein, 9 aa, Homo Sapiens
NSESEEKVG

SEQ ID NO: 382372 - protein, 9 aa, Homo Sapiens
ETFRFKLGG

SEQ ID NO: 382373 - protein, 9 aa, Homo Sapiens
MYLQLPEAD

SEQ ID NO: 382374 - protein, 9 aa, Homo Sapiens
KTSICKQQT

SEQ ID NO: 382375 - protein, 9 aa, Homo Sapiens
VLSKHQNVF

SEQ ID NO: 382376 - protein, 9 aa, Homo Sapiens
HPPCTGVVD

SEQ ID NO: 382377 - protein, 9 aa, Homo Sapiens
IIWSSHKSI

SEQ ID NO: 382378 - protein, 9 aa, Homo Sapiens
NSLGLNNCQ

SEQ ID NO: 382379 - protein, 9 aa, Homo Sapiens
KDTFQGAPL

SEQ ID NO: 382380 - protein, 9 aa, Homo Sapiens
TEVKYNGGV

SEQ ID NO: 382381 - protein, 9 aa, Homo Sapiens
DRVYIGKIY

SEQ ID NO: 382382 - protein, 9 aa, Homo Sapiens
QSPPLGRFA

SEQ ID NO: 382383 - protein, 9 aa, Homo Sapiens
GTRVVTVSQ

SEQ ID NO: 382384 - protein, 9 aa, Homo Sapiens
VKAVGNLIK

SEQ ID NO: 382385 - protein, 9 aa, Homo Sapiens
MTEDNKYLI

SEQ ID NO: 382386 - protein, 9 aa, Homo Sapiens
IIISERSDY

SEQ ID NO: 382387 - protein, 9 aa, Homo Sapiens
MKVDNFKTS

SEQ ID NO: 382388 - protein, 9 aa, Homo Sapiens
RHTNSAKPS

SEQ ID NO: 382389 - protein, 9 aa, Homo Sapiens
MTKMFDLRT

SEQ ID NO: 382390 - protein, 9 aa, Homo Sapiens
LDLYSDKNA

SEQ ID NO: 382391 - protein, 9 aa, Homo Sapiens
IEANFISNS

SEQ ID NO: 382392 - protein, 9 aa, Homo Sapiens
SINMSLESY

SEQ ID NO: 382393 - protein, 9 aa, Homo Sapiens
IHAGQLKHG

SEQ ID NO: 382394 - protein, 9 aa, Homo Sapiens
LSDGNGSPG

SEQ ID NO: 382395 - protein, 9 aa, Homo Sapiens
AALIYLHYR

SEQ ID NO: 382396 - protein, 9 aa, Homo Sapiens
DRDPPKSLL

SEQ ID NO: 382397 - protein, 9 aa, Homo Sapiens
RAVAMKVDN

SEQ ID NO: 382398 - protein, 9 aa, Homo Sapiens
YATITHSVC

SEQ ID NO: 382399 - protein, 9 aa, Homo Sapiens
IWQLGTLIG

SEQ ID NO: 382400 - protein, 9 aa, Homo Sapiens
ENNLEKGLG

SEQ ID NO: 382401 - protein, 9 aa, Homo Sapiens
QDLGENTFE

SEQ ID NO: 382402 - protein, 9 aa, Homo Sapiens
VKKCRHEEV

SEQ ID NO: 382403 - protein, 9 aa, Homo Sapiens
SHMASMGQH

SEQ ID NO: 382404 - protein, 9 aa, Homo Sapiens
LAPGRKYVL

SEQ ID NO: 382405 - protein, 9 aa, Homo Sapiens
NKDDDNVFN

SEQ ID NO: 382406 - protein, 9 aa, Homo Sapiens
LLGLPLAIQ

SEQ ID NO: 382407 - protein, 9 aa, Homo Sapiens
LAVKELSWQ

SEQ ID NO: 382408 - protein, 9 aa, Homo Sapiens
SKNKLELAW

SEQ ID NO: 382409 - protein, 9 aa, Homo Sapiens
TPLAFVQKS

SEQ ID NO: 382410 - protein, 9 aa, Homo Sapiens
GPPWTIYDF

SEQ ID NO: 382411 - protein, 9 aa, Homo Sapiens
GYWLPPPMD

SEQ ID NO: 382412 - protein, 9 aa, Homo Sapiens
SVRVPSVTL

SEQ ID NO: 382413 - protein, 9 aa, Homo Sapiens
IKYASHSRK

SEQ ID NO: 382414 - protein, 9 aa, Homo Sapiens
VVDCLFYEG

SEQ ID NO: 382415 - protein, 9 aa, Homo Sapiens
SSNLMRHRI

SEQ ID NO: 382416 - protein, 9 aa, Homo Sapiens
LALCSRSCN

SEQ ID NO: 382417 - protein, 9 aa, Homo Sapiens
TMPTVQRKY

SEQ ID NO: 382418 - protein, 9 aa, Homo Sapiens
KVVSQLWAF

SEQ ID NO: 382419 - protein, 9 aa, Homo Sapiens
TLECLLKAL

SEQ ID NO: 382420 - protein, 9 aa, Homo Sapiens
TLCPDSPPN

SEQ ID NO: 382421 - protein, 9 aa, Homo Sapiens
GLTAEFVNV

SEQ ID NO: 382422 - protein, 9 aa, Homo Sapiens
QHDQKTQPI

SEQ ID NO: 382423 - protein, 9 aa, Homo Sapiens
QELLVIFWK

SEQ ID NO: 382424 - protein, 9 aa, Homo Sapiens
DCYVELETI

SEQ ID NO: 382425 - protein, 9 aa, Homo Sapiens
DNILLITED

SEQ ID NO: 382426 - protein, 9 aa, Homo Sapiens
GIAVWGRAK

SEQ ID NO: 382427 - protein, 9 aa, Homo Sapiens
SQIICSVKM

SEQ ID NO: 382428 - protein, 9 aa, Homo Sapiens
FFTLEGFPT

SEQ ID NO: 382429 - protein, 9 aa, Homo Sapiens
EAEKKKLQT

SEQ ID NO: 382430 - protein, 9 aa, Homo Sapiens
KTTDEADPR

SEQ ID NO: 382431 - protein, 9 aa, Homo Sapiens
LYSDKNAKL

SEQ ID NO: 382432 - protein, 9 aa, Homo Sapiens
NACYAIHTF

SEQ ID NO: 382433 - protein, 9 aa, Homo Sapiens
LQKVEVPAV

SEQ ID NO: 382434 - protein, 9 aa, Homo Sapiens
CREELDADE

SEQ ID NO: 382435 - protein, 9 aa, Homo Sapiens
FVAQNRSAC

SEQ ID NO: 382436 - protein, 9 aa, Homo Sapiens
IPIVITTKP

SEQ ID NO: 382437 - protein, 9 aa, Homo Sapiens
ATYVIYHDA

SEQ ID NO: 382438 - protein, 9 aa, Homo Sapiens
HISVIKENS

SEQ ID NO: 382439 - protein, 9 aa, Homo Sapiens
HLNHFLEAH

SEQ ID NO: 382440 - protein, 9 aa, Homo Sapiens
ILRGLGDIQ

SEQ ID NO: 382441 - protein, 9 aa, Homo Sapiens
KGSIELSQI

SEQ ID NO: 382442 - protein, 9 aa, Homo Sapiens
EVEILEAKV

SEQ ID NO: 382443 - protein, 9 aa, Homo Sapiens
LEALQIIIS

SEQ ID NO: 382444 - protein, 9 aa, Homo Sapiens
YILDSISAL

SEQ ID NO: 382445 - protein, 9 aa, Homo Sapiens
PNKLVQLNK

SEQ ID NO: 382446 - protein, 9 aa, Homo Sapiens
VGNLIKCST

SEQ ID NO: 382447 - protein, 9 aa, Homo Sapiens
EVKYNKAIN

SEQ ID NO: 382448 - protein, 9 aa, Homo Sapiens
SGYHAKNFL

SEQ ID NO: 382449 - protein, 9 aa, Homo Sapiens
PSPESSSPS

SEQ ID NO: 382450 - protein, 9 aa, Homo Sapiens
RGAQCGLGL

SEQ ID NO: 382451 - protein, 9 aa, Homo Sapiens
FGAILFTLF

SEQ ID NO: 382452 - protein, 9 aa, Homo Sapiens
ASMGQHSSV

SEQ ID NO: 382453 - protein, 9 aa, Homo Sapiens
KMKMGRYWS

SEQ ID NO: 382454 - protein, 9 aa, Homo Sapiens
VEPSDTIKN

SEQ ID NO: 382455 - protein, 9 aa, Homo Sapiens
TQAVQNIWV

SEQ ID NO: 382456 - protein, 9 aa, Homo Sapiens
FNYFVLEQH

SEQ ID NO: 382457 - protein, 9 aa, Homo Sapiens
AGRCRCYYG

SEQ ID NO: 382458 - protein, 9 aa, Homo Sapiens
TVVFDRHGN

SEQ ID NO: 382459 - protein, 9 aa, Homo Sapiens
IEAKASTIF

SEQ ID NO: 382460 - protein, 9 aa, Homo Sapiens
GEAERGPHF

SEQ ID NO: 382461 - protein, 9 aa, Homo Sapiens
HGKIQMSVP

SEQ ID NO: 382462 - protein, 9 aa, Homo Sapiens
PIYSELEDR

SEQ ID NO: 382463 - protein, 9 aa, Homo Sapiens
RVGSIAKLS

SEQ ID NO: 382464 - protein, 9 aa, Homo Sapiens
DYENNYWSM

SEQ ID NO: 382465 - protein, 9 aa, Homo Sapiens
EIYFKVWMC

SEQ ID NO: 382466 - protein, 9 aa, Homo Sapiens
FQGVYIIFS

SEQ ID NO: 382467 - protein, 9 aa, Homo Sapiens
LSGYLEVIR

SEQ ID NO: 382468 - protein, 9 aa, Homo Sapiens
NKLVQLNKL

SEQ ID NO: 382469 - protein, 9 aa, Homo Sapiens
DQYHGQDDD

SEQ ID NO: 382470 - protein, 9 aa, Homo Sapiens
YVIKKLNLQ

SEQ ID NO: 382471 - protein, 9 aa, Homo Sapiens
AEARWDAAK

SEQ ID NO: 382472 - protein, 9 aa, Homo Sapiens
YVDDLMSVL

SEQ ID NO: 382473 - protein, 9 aa, Homo Sapiens
YRASFQDWG

SEQ ID NO: 382474 - protein, 9 aa, Homo Sapiens
KEEDKHSER

SEQ ID NO: 382475 - protein, 9 aa, Homo Sapiens
HNPGVYTRI

SEQ ID NO: 382476 - protein, 9 aa, Homo Sapiens
GTVWTKIDD

SEQ ID NO: 382477 - protein, 9 aa, Homo Sapiens
CQTTTYKLP

SEQ ID NO: 382478 - protein, 9 aa, Homo Sapiens
LEQEKKLQM

SEQ ID NO: 382479 - protein, 9 aa, Homo Sapiens
ELQLPNINL

SEQ ID NO: 382480 - protein, 9 aa, Homo Sapiens
MKLTLEYFI

SEQ ID NO: 382481 - protein, 9 aa, Homo Sapiens
QFVLLFLFW

SEQ ID NO: 382482 - protein, 9 aa, Homo Sapiens
DDSLRVNYF

SEQ ID NO: 382483 - protein, 9 aa, Homo Sapiens
QTFSKKFLQ

SEQ ID NO: 382484 - protein, 9 aa, Homo Sapiens
YKNKWEEPG

SEQ ID NO: 382485 - protein, 9 aa, Homo Sapiens
CDVQLVTNL

SEQ ID NO: 382486 - protein, 9 aa, Homo Sapiens
IEPIMAVEV

SEQ ID NO: 382487 - protein, 9 aa, Homo Sapiens
VGSCKRSRS

SEQ ID NO: 382488 - protein, 9 aa, Homo Sapiens
NVICITDAV

SEQ ID NO: 382489 - protein, 9 aa, Homo Sapiens
MKLSLPESL

SEQ ID NO: 382490 - protein, 9 aa, Homo Sapiens
ISVQGEVPH

SEQ ID NO: 382491 - protein, 9 aa, Homo Sapiens
NNLEKGLGV

SEQ ID NO: 382492 - protein, 9 aa, Homo Sapiens
ECISQRHQT

SEQ ID NO: 382493 - protein, 9 aa, Homo Sapiens
SISSSTSNL

SEQ ID NO: 382494 - protein, 9 aa, Homo Sapiens
LFYEGIKVI

SEQ ID NO: 382495 - protein, 9 aa, Homo Sapiens
IIDVNNISI

SEQ ID NO: 382496 - protein, 9 aa, Homo Sapiens
AKKMDNLLR

SEQ ID NO: 382497 - protein, 9 aa, Homo Sapiens
EINQSASFS

SEQ ID NO: 382498 - protein, 9 aa, Homo Sapiens
RYGHILDRE

SEQ ID NO: 382499 - protein, 9 aa, Homo Sapiens
TYCSKMEYM

SEQ ID NO: 382500 - protein, 9 aa, Homo Sapiens
NDCVDPCGP

SEQ ID NO: 382501 - protein, 9 aa, Homo Sapiens
LACTERPSN

SEQ ID NO: 382502 - protein, 9 aa, Homo Sapiens
VPSSNGIIS

SEQ ID NO: 382503 - protein, 9 aa, Homo Sapiens
AEENLAYAE

SEQ ID NO: 382504 - protein, 9 aa, Homo Sapiens
DKFSSISLS

SEQ ID NO: 382505 - protein, 9 aa, Homo Sapiens
LPGHSVVLC

SEQ ID NO: 382506 - protein, 9 aa, Homo Sapiens
QRHQTKINS

SEQ ID NO: 382507 - protein, 9 aa, Homo Sapiens
KKIHIRENS

SEQ ID NO: 382508 - protein, 9 aa, Homo Sapiens
VGTIPNQLD

SEQ ID NO: 382509 - protein, 9 aa, Homo Sapiens
RPPFQKAQS

SEQ ID NO: 382510 - protein, 9 aa, Homo Sapiens
EKGQDGQPQ

SEQ ID NO: 382511 - protein, 9 aa, Homo Sapiens
TNQEFGVEI

SEQ ID NO: 382512 - protein, 9 aa, Homo Sapiens
RKKQHLAQI

SEQ ID NO: 382513 - protein, 9 aa, Homo Sapiens
VRPHIAGIT

SEQ ID NO: 382514 - protein, 9 aa, Homo Sapiens
SSVEKDQHH

SEQ ID NO: 382515 - protein, 9 aa, Homo Sapiens
EAEKLLPLF

SEQ ID NO: 382516 - protein, 9 aa, Homo Sapiens
IIFVLLLSA

SEQ ID NO: 382517 - protein, 9 aa, Homo Sapiens
NLSKNKLEL

SEQ ID NO: 382518 - protein, 9 aa, Homo Sapiens
PFWDKMATQ

SEQ ID NO: 382519 - protein, 9 aa, Homo Sapiens
HQNVFNQPT

SEQ ID NO: 382520 - protein, 9 aa, Homo Sapiens
SAALLCLLF

SEQ ID NO: 382521 - protein, 9 aa, Homo Sapiens
RQEDKIQEW

SEQ ID NO: 382522 - protein, 9 aa, Homo Sapiens
CPLCHKLRY

SEQ ID NO: 382523 - protein, 9 aa, Homo Sapiens
AEKKLPSNT

SEQ ID NO: 382524 - protein, 9 aa, Homo Sapiens
CSSSKRNEL

SEQ ID NO: 382525 - protein, 9 aa, Homo Sapiens
AGQLKHGDF

SEQ ID NO: 382526 - protein, 9 aa, Homo Sapiens
NKLIGKEVC

SEQ ID NO: 382527 - protein, 9 aa, Homo Sapiens
GVNGKYIIK

SEQ ID NO: 382528 - protein, 9 aa, Homo Sapiens
ENNYWSMSL

SEQ ID NO: 382529 - protein, 9 aa, Homo Sapiens
QSVKEKIMG

SEQ ID NO: 382530 - protein, 9 aa, Homo Sapiens
KLLVMEGQA

SEQ ID NO: 382531 - protein, 9 aa, Homo Sapiens
HVGSCKRSR

SEQ ID NO: 382532 - protein, 9 aa, Homo Sapiens
AGWYTVAAV

SEQ ID NO: 382533 - protein, 9 aa, Homo Sapiens
LWDDLVEGH

SEQ ID NO: 382534 - protein, 9 aa, Homo Sapiens
HKQKTSQKP

SEQ ID NO: 382535 - protein, 9 aa, Homo Sapiens
RYRCTARSQ

SEQ ID NO: 382536 - protein, 9 aa, Homo Sapiens
GCHAYGDQY

SEQ ID NO: 382537 - protein, 9 aa, Homo Sapiens
RLKEAFNYI

SEQ ID NO: 382538 - protein, 9 aa, Homo Sapiens
IYLNLINDL

SEQ ID NO: 382539 - protein, 9 aa, Homo Sapiens
RILRGLGDI

SEQ ID NO: 382540 - protein, 9 aa, Homo Sapiens
QFHQELLVI

SEQ ID NO: 382541 - protein, 9 aa, Homo Sapiens
VSPAADHKG

SEQ ID NO: 382542 - protein, 9 aa, Homo Sapiens
TSLGQAYRE

SEQ ID NO: 382543 - protein, 9 aa, Homo Sapiens
HEEDNESSE

SEQ ID NO: 382544 - protein, 9 aa, Homo Sapiens
YYTIINKLA

SEQ ID NO: 382545 - protein, 9 aa, Homo Sapiens
TKNQEGKVN

SEQ ID NO: 382546 - protein, 9 aa, Homo Sapiens
CHKLRYWKE

SEQ ID NO: 382547 - protein, 9 aa, Homo Sapiens
VLESLRNND

SEQ ID NO: 382548 - protein, 9 aa, Homo Sapiens
ILTNQKDYL

SEQ ID NO: 382549 - protein, 9 aa, Homo Sapiens
RRRPWRCPE

SEQ ID NO: 382550 - protein, 9 aa, Homo Sapiens
LWGHQITHT

SEQ ID NO: 382551 - protein, 9 aa, Homo Sapiens
DDKDTAFPP

SEQ ID NO: 382552 - protein, 9 aa, Homo Sapiens
ASQTLCIFL

SEQ ID NO: 382553 - protein, 9 aa, Homo Sapiens
NKDNYSNEV

SEQ ID NO: 382554 - protein, 9 aa, Homo Sapiens
QKKKHDLRY

SEQ ID NO: 382555 - protein, 9 aa, Homo Sapiens
NTLEDFRVK

SEQ ID NO: 382556 - protein, 9 aa, Homo Sapiens
CSPFTSQDI

SEQ ID NO: 382557 - protein, 9 aa, Homo Sapiens
VGLKQFFPK

SEQ ID NO: 382558 - protein, 9 aa, Homo Sapiens
VEKDQHHIA

SEQ ID NO: 382559 - protein, 9 aa, Homo Sapiens
SSLVPISHP

SEQ ID NO: 382560 - protein, 9 aa, Homo Sapiens
KTFGSGYQL

SEQ ID NO: 382561 - protein, 9 aa, Homo Sapiens
LKQFDAYPN

SEQ ID NO: 382562 - protein, 9 aa, Homo Sapiens
EGTGQQVCW

SEQ ID NO: 382563 - protein, 9 aa, Homo Sapiens
SSSLTRHKI

SEQ ID NO: 382564 - protein, 9 aa, Homo Sapiens
LIKCSTSSL

SEQ ID NO: 382565 - protein, 9 aa, Homo Sapiens
EDPREKQFN

SEQ ID NO: 382566 - protein, 9 aa, Homo Sapiens
SNSFNTDKN

SEQ ID NO: 382567 - protein, 9 aa, Homo Sapiens
QIYTLMHKD

SEQ ID NO: 382568 - protein, 9 aa, Homo Sapiens
NLLKSEGLS

SEQ ID NO: 382569 - protein, 9 aa, Homo Sapiens
WFEPQINAE

SEQ ID NO: 382570 - protein, 9 aa, Homo Sapiens
QPQWEVEGK

SEQ ID NO: 382571 - protein, 9 aa, Homo Sapiens
RKLFQEIVT

SEQ ID NO: 382572 - protein, 9 aa, Homo Sapiens
FGVLGARRR

SEQ ID NO: 382573 - protein, 9 aa, Homo Sapiens
YVKEVDQLR

SEQ ID NO: 382574 - protein, 9 aa, Homo Sapiens
IDPYLSAHA

SEQ ID NO: 382575 - protein, 9 aa, Homo Sapiens
RIGIKKAIA

SEQ ID NO: 382576 - protein, 9 aa, Homo Sapiens
HDSSLVASK

SEQ ID NO: 382577 - protein, 9 aa, Homo Sapiens
FAVLEILNH

SEQ ID NO: 382578 - protein, 9 aa, Homo Sapiens
ERALDIWRR

SEQ ID NO: 382579 - protein, 9 aa, Homo Sapiens
GSRTYGFVI

SEQ ID NO: 382580 - protein, 9 aa, Homo Sapiens
PVYNSLANK

SEQ ID NO: 382581 - protein, 9 aa, Homo Sapiens
YNSLANKYK

SEQ ID NO: 382582 - protein, 9 aa, Homo Sapiens
RPAPPECVV

SEQ ID NO: 382583 - protein, 9 aa, Homo Sapiens
DSSGSIGRH

SEQ ID NO: 382584 - protein, 9 aa, Homo Sapiens
ESRQHISVI

SEQ ID NO: 382585 - protein, 9 aa, Homo Sapiens
ILYAIDWNP

SEQ ID NO: 382586 - protein, 9 aa, Homo Sapiens
PDINMEENL

SEQ ID NO: 382587 - protein, 9 aa, Homo Sapiens
FSNYVELAV

SEQ ID NO: 382588 - protein, 9 aa, Homo Sapiens
FWDKSSYNK

SEQ ID NO: 382589 - protein, 9 aa, Homo Sapiens
LVCEDKSSH

SEQ ID NO: 382590 - protein, 9 aa, Homo Sapiens
QKEGKEQLS

SEQ ID NO: 382591 - protein, 9 aa, Homo Sapiens
IAWNYPKPE

SEQ ID NO: 382592 - protein, 9 aa, Homo Sapiens
EQIHTGEKP

SEQ ID NO: 382593 - protein, 9 aa, Homo Sapiens
LRWTRDGVH

SEQ ID NO: 382594 - protein, 9 aa, Homo Sapiens
HAKKMDNLL

SEQ ID NO: 382595 - protein, 9 aa, Homo Sapiens
NIFLCQKWN

SEQ ID NO: 382596 - protein, 9 aa, Homo Sapiens
TVKQAPSHM

SEQ ID NO: 382597 - protein, 9 aa, Homo Sapiens
DMDPHIFVV

SEQ ID NO: 382598 - protein, 9 aa, Homo Sapiens
FRAYGIAVW

SEQ ID NO: 382599 - protein, 9 aa, Homo Sapiens
NEADWFISA

SEQ ID NO: 382600 - protein, 9 aa, Homo Sapiens
KTSQKPREE

SEQ ID NO: 382601 - protein, 9 aa, Homo Sapiens
YFWCQFADM

SEQ ID NO: 382602 - protein, 9 aa, Homo Sapiens
VLLKIEDEP

SEQ ID NO: 382603 - protein, 9 aa, Homo Sapiens
RNTPVSKRS

SEQ ID NO: 382604 - protein, 9 aa, Homo Sapiens
QYPTAQPLV

SEQ ID NO: 382605 - protein, 9 aa, Homo Sapiens
SEQQAQFIW

SEQ ID NO: 382606 - protein, 9 aa, Homo Sapiens
INVYSLSVD

SEQ ID NO: 382607 - protein, 9 aa, Homo Sapiens
LFAYAQLGY

SEQ ID NO: 382608 - protein, 9 aa, Homo Sapiens
CTHPPCTGV

SEQ ID NO: 382609 - protein, 9 aa, Homo Sapiens
KEEKENKKE

SEQ ID NO: 382610 - protein, 9 aa, Homo Sapiens
RGRSPRPSL

SEQ ID NO: 382611 - protein, 9 aa, Homo Sapiens
TGPPFHLNK

SEQ ID NO: 382612 - protein, 9 aa, Homo Sapiens
SLCHPNIIR

SEQ ID NO: 382613 - protein, 9 aa, Homo Sapiens
LYLTYVTER

SEQ ID NO: 382614 - protein, 9 aa, Homo Sapiens
TLNEHQILH

SEQ ID NO: 382615 - protein, 9 aa, Homo Sapiens
QQIHLGDRP

SEQ ID NO: 382616 - protein, 9 aa, Homo Sapiens
FQCVQMLEW

SEQ ID NO: 382617 - protein, 9 aa, Homo Sapiens
KLNIGKAFK

SEQ ID NO: 382618 - protein, 9 aa, Homo Sapiens
PETVRTIQL

SEQ ID NO: 382619 - protein, 9 aa, Homo Sapiens
NRQSLISFF

SEQ ID NO: 382620 - protein, 9 aa, Homo Sapiens
QTSPIHLAL

SEQ ID NO: 382621 - protein, 9 aa, Homo Sapiens
TDKNIDKYN

SEQ ID NO: 382622 - protein, 9 aa, Homo Sapiens
GFQMQGPPW

SEQ ID NO: 382623 - protein, 9 aa, Homo Sapiens
KKCRHEEVV

SEQ ID NO: 382624 - protein, 9 aa, Homo Sapiens
TNQIYRIFE

SEQ ID NO: 382625 - protein, 9 aa, Homo Sapiens
LENVNKKAV

SEQ ID NO: 382626 - protein, 9 aa, Homo Sapiens
ENVEYNISG

SEQ ID NO: 382627 - protein, 9 aa, Homo Sapiens
PNDGNQSSV

SEQ ID NO: 382628 - protein, 9 aa, Homo Sapiens
NKKMSPNNY

SEQ ID NO: 382629 - protein, 9 aa, Homo Sapiens
WMAPKVIKS

SEQ ID NO: 382630 - protein, 9 aa, Homo Sapiens
HDQQLADHG

SEQ ID NO: 382631 - protein, 9 aa, Homo Sapiens
LPIRSPIKL

SEQ ID NO: 382632 - protein, 9 aa, Homo Sapiens
DQHYYSFDG

SEQ ID NO: 382633 - protein, 9 aa, Homo Sapiens
MWIPQLVDS

SEQ ID NO: 382634 - protein, 9 aa, Homo Sapiens
NLQKNILEM

SEQ ID NO: 382635 - protein, 9 aa, Homo Sapiens
EISETQKAD

SEQ ID NO: 382636 - protein, 9 aa, Homo Sapiens
LNHFLEAHS

SEQ ID NO: 382637 - protein, 9 aa, Homo Sapiens
NFEKNRTRS

SEQ ID NO: 382638 - protein, 9 aa, Homo Sapiens
TSLRSLHFL

SEQ ID NO: 382639 - protein, 9 aa, Homo Sapiens
NISNYHWPS

SEQ ID NO: 382640 - protein, 9 aa, Homo Sapiens
MPCCKRLWR

SEQ ID NO: 382641 - protein, 9 aa, Homo Sapiens
EDYVVKAVS

SEQ ID NO: 382642 - protein, 9 aa, Homo Sapiens
CNCDADLNE

SEQ ID NO: 382643 - protein, 9 aa, Homo Sapiens
IEARYLQQK

SEQ ID NO: 382644 - protein, 9 aa, Homo Sapiens
QFQNQGSEP

SEQ ID NO: 382645 - protein, 9 aa, Homo Sapiens
ELQGQSLNY

SEQ ID NO: 382646 - protein, 9 aa, Homo Sapiens
AEDSTGACP

SEQ ID NO: 382647 - protein, 9 aa, Homo Sapiens
REQLIRERQ

SEQ ID NO: 382648 - protein, 9 aa, Homo Sapiens
FWCQFADME

SEQ ID NO: 382649 - protein, 9 aa, Homo Sapiens
NATFQKKRR

SEQ ID NO: 382650 - protein, 9 aa, Homo Sapiens
DHPPLTAYH

SEQ ID NO: 382651 - protein, 9 aa, Homo Sapiens
TWLLFIFCF

SEQ ID NO: 382652 - protein, 9 aa, Homo Sapiens
EPERLREER

SEQ ID NO: 382653 - protein, 9 aa, Homo Sapiens
SVQGEVPHT

SEQ ID NO: 382654 - protein, 9 aa, Homo Sapiens
NYSAIPPSS

SEQ ID NO: 382655 - protein, 9 aa, Homo Sapiens
QKKTTDEAD

SEQ ID NO: 382656 - protein, 9 aa, Homo Sapiens
LDKELDALQ

SEQ ID NO: 382657 - protein, 9 aa, Homo Sapiens
SSAKNNSNW

SEQ ID NO: 382658 - protein, 9 aa, Homo Sapiens
NLKTKQEER

SEQ ID NO: 382659 - protein, 9 aa, Homo Sapiens
KEFKNDYWK

SEQ ID NO: 382660 - protein, 9 aa, Homo Sapiens
NNSHPVQVG

SEQ ID NO: 382661 - protein, 9 aa, Homo Sapiens
FIDAYTSLG

SEQ ID NO: 382662 - protein, 9 aa, Homo Sapiens
QGYHHEHLV

SEQ ID NO: 382663 - protein, 9 aa, Homo Sapiens
KKDLEDGKV

SEQ ID NO: 382664 - protein, 9 aa, Homo Sapiens
NLQNRFKHE

SEQ ID NO: 382665 - protein, 9 aa, Homo Sapiens
FQNQGSEPK

SEQ ID NO: 382666 - protein, 9 aa, Homo Sapiens
PNTHPSPHP

SEQ ID NO: 382667 - protein, 9 aa, Homo Sapiens
SPAAPGKNK

SEQ ID NO: 382668 - protein, 9 aa, Homo Sapiens
YPNTLEDFR

SEQ ID NO: 382669 - protein, 9 aa, Homo Sapiens
RAYGIAVWG

SEQ ID NO: 382670 - protein, 9 aa, Homo Sapiens
PTGCLSKIM

SEQ ID NO: 382671 - protein, 9 aa, Homo Sapiens
SGEGAGTSF

SEQ ID NO: 382672 - protein, 9 aa, Homo Sapiens
HLSEDDSKR

SEQ ID NO: 382673 - protein, 9 aa, Homo Sapiens
ETDKLRAAF

SEQ ID NO: 382674 - protein, 9 aa, Homo Sapiens
YSREELNLM

SEQ ID NO: 382675 - protein, 9 aa, Homo Sapiens
SGACTQLFG

SEQ ID NO: 382676 - protein, 9 aa, Homo Sapiens
RNLVLLGLS

SEQ ID NO: 382677 - protein, 9 aa, Homo Sapiens
IFKELTQND

SEQ ID NO: 382678 - protein, 9 aa, Homo Sapiens
ASKGERELC

SEQ ID NO: 382679 - protein, 9 aa, Homo Sapiens
ARENINLQP

SEQ ID NO: 382680 - protein, 9 aa, Homo Sapiens
LGKCRYIYY

SEQ ID NO: 382681 - protein, 9 aa, Homo Sapiens
KTGVSFVLG

SEQ ID NO: 382682 - protein, 9 aa, Homo Sapiens
QNESETQML

SEQ ID NO: 382683 - protein, 9 aa, Homo Sapiens
GRNINPKPC

SEQ ID NO: 382684 - protein, 9 aa, Homo Sapiens
PPLRELFVD

SEQ ID NO: 382685 - protein, 9 aa, Homo Sapiens
TIPNQLDPG

SEQ ID NO: 382686 - protein, 9 aa, Homo Sapiens
SYTWLLFIF

SEQ ID NO: 382687 - protein, 9 aa, Homo Sapiens
LAPWAWRNQ

SEQ ID NO: 382688 - protein, 9 aa, Homo Sapiens
SDIGSGIQY

SEQ ID NO: 382689 - protein, 9 aa, Homo Sapiens
EGARWDSEA

SEQ ID NO: 382690 - protein, 9 aa, Homo Sapiens
FKIIKDSEF

SEQ ID NO: 382691 - protein, 9 aa, Homo Sapiens
KPLKLKRHL

SEQ ID NO: 382692 - protein, 9 aa, Homo Sapiens
YMRRPYGRQ

SEQ ID NO: 382693 - protein, 9 aa, Homo Sapiens
ICLYCVTVP

SEQ ID NO: 382694 - protein, 9 aa, Homo Sapiens
IGCHAYGDQ

SEQ ID NO: 382695 - protein, 9 aa, Homo Sapiens
SFVLGISTV

SEQ ID NO: 382696 - protein, 9 aa, Homo Sapiens
IFDRIRKGF

SEQ ID NO: 382697 - protein, 9 aa, Homo Sapiens
PYSCEVCGQ

SEQ ID NO: 382698 - protein, 9 aa, Homo Sapiens
YLNVTHKAY

SEQ ID NO: 382699 - protein, 9 aa, Homo Sapiens
SKLKLKLPR

SEQ ID NO: 382700 - protein, 9 aa, Homo Sapiens
PTQKDIALL

SEQ ID NO: 382701 - protein, 9 aa, Homo Sapiens
RKLLKLPNL

SEQ ID NO: 382702 - protein, 9 aa, Homo Sapiens
ARWDSEAFQ

SEQ ID NO: 382703 - protein, 9 aa, Homo Sapiens
QLVTNLRLV

SEQ ID NO: 382704 - protein, 9 aa, Homo Sapiens
TVIWEKLTG

SEQ ID NO: 382705 - protein, 9 aa, Homo Sapiens
LSTLKSHMQ

SEQ ID NO: 382706 - protein, 9 aa, Homo Sapiens
SYSLTIYPQ

SEQ ID NO: 382707 - protein, 9 aa, Homo Sapiens
IFSLEIRAD

SEQ ID NO: 382708 - protein, 9 aa, Homo Sapiens
DYIHIKIQQ

SEQ ID NO: 382709 - protein, 9 aa, Homo Sapiens
QPTGAVRGA

SEQ ID NO: 382710 - protein, 9 aa, Homo Sapiens
VPPKLHVLV

SEQ ID NO: 382711 - protein, 9 aa, Homo Sapiens
EMGNHIEDL

SEQ ID NO: 382712 - protein, 9 aa, Homo Sapiens
MSASNDNEG

SEQ ID NO: 382713 - protein, 9 aa, Homo Sapiens
NDVEISETQ

SEQ ID NO: 382714 - protein, 9 aa, Homo Sapiens
NNFNNLYGT

SEQ ID NO: 382715 - protein, 9 aa, Homo Sapiens
HTGEESLNG

SEQ ID NO: 382716 - protein, 9 aa, Homo Sapiens
NPNLLKTIE

SEQ ID NO: 382717 - protein, 9 aa, Homo Sapiens
YCACRLKTI

SEQ ID NO: 382718 - protein, 9 aa, Homo Sapiens
RLREERAGA

SEQ ID NO: 382719 - protein, 9 aa, Homo Sapiens
TFLGWAVPG

SEQ ID NO: 382720 - protein, 9 aa, Homo Sapiens
IKRVSPYSY

SEQ ID NO: 382721 - protein, 9 aa, Homo Sapiens
EETAAILNN

SEQ ID NO: 382722 - protein, 9 aa, Homo Sapiens
KNDGYVDMS

SEQ ID NO: 382723 - protein, 9 aa, Homo Sapiens
IIHEQIHTG

SEQ ID NO: 382724 - protein, 9 aa, Homo Sapiens
VECGKAFNH

SEQ ID NO: 382725 - protein, 9 aa, Homo Sapiens
LINIIQGRP

SEQ ID NO: 382726 - protein, 9 aa, Homo Sapiens
ALCVVKILQ

SEQ ID NO: 382727 - protein, 9 aa, Homo Sapiens
KRLKKYPND

SEQ ID NO: 382728 - protein, 9 aa, Homo Sapiens
FGRSSSSGQ

SEQ ID NO: 382729 - protein, 9 aa, Homo Sapiens
IKRITWNTW

SEQ ID NO: 382730 - protein, 9 aa, Homo Sapiens
QGIANEDTA

SEQ ID NO: 382731 - protein, 9 aa, Homo Sapiens
SRQEYAHIS

SEQ ID NO: 382732 - protein, 9 aa, Homo Sapiens
PFNLPEIFF

SEQ ID NO: 382733 - protein, 9 aa, Homo Sapiens
TKPTDDTTV

SEQ ID NO: 382734 - protein, 9 aa, Homo Sapiens
ALLDPSQNN

SEQ ID NO: 382735 - protein, 9 aa, Homo Sapiens
LPEINQSAS

SEQ ID NO: 382736 - protein, 9 aa, Homo Sapiens
CQKWNDPRL

SEQ ID NO: 382737 - protein, 9 aa, Homo Sapiens
IIHTEERYH

SEQ ID NO: 382738 - protein, 9 aa, Homo Sapiens
STSAPTFGF

SEQ ID NO: 382739 - protein, 9 aa, Homo Sapiens
NPFNMEVCK

SEQ ID NO: 382740 - protein, 9 aa, Homo Sapiens
CADLLVGVT

SEQ ID NO: 382741 - protein, 9 aa, Homo Sapiens
MEEMGNHIE

SEQ ID NO: 382742 - protein, 9 aa, Homo Sapiens
TYLIGREVY

SEQ ID NO: 382743 - protein, 9 aa, Homo Sapiens
KHIRSQINY

SEQ ID NO: 382744 - protein, 9 aa, Homo Sapiens
SSALIKHQI

SEQ ID NO: 382745 - protein, 9 aa, Homo Sapiens
IDCGVDNVQ

SEQ ID NO: 382746 - protein, 9 aa, Homo Sapiens
KKSKLQIWD

SEQ ID NO: 382747 - protein, 9 aa, Homo Sapiens
MYFEGYNVE

SEQ ID NO: 382748 - protein, 9 aa, Homo Sapiens
KFIESLNCQ

SEQ ID NO: 382749 - protein, 9 aa, Homo Sapiens
PRSSSLESP

SEQ ID NO: 382750 - protein, 9 aa, Homo Sapiens
LQLPNINLV

SEQ ID NO: 382751 - protein, 9 aa, Homo Sapiens
NLRARYHMK

SEQ ID NO: 382752 - protein, 9 aa, Homo Sapiens
CLAFQNPGP

SEQ ID NO: 382753 - protein, 9 aa, Homo Sapiens
LTRVSQIIC

SEQ ID NO: 382754 - protein, 9 aa, Homo Sapiens
SICAITLGH

SEQ ID NO: 382755 - protein, 9 aa, Homo Sapiens
VINFEKNRT

SEQ ID NO: 382756 - protein, 9 aa, Homo Sapiens
SNSLKKKQK

SEQ ID NO: 382757 - protein, 9 aa, Homo Sapiens
LSISETGST

SEQ ID NO: 382758 - protein, 9 aa, Homo Sapiens
FRKEKANMD

SEQ ID NO: 382759 - protein, 9 aa, Homo Sapiens
PKCNLLQEV

SEQ ID NO: 382760 - protein, 9 aa, Homo Sapiens
KDEALQEES

SEQ ID NO: 382761 - protein, 9 aa, Homo Sapiens
NLQYWGLDH

SEQ ID NO: 382762 - protein, 9 aa, Homo Sapiens
VEQEADTIL

SEQ ID NO: 382763 - protein, 9 aa, Homo Sapiens
VGITTQSLG

SEQ ID NO: 382764 - protein, 9 aa, Homo Sapiens
RNLAEVVLQ

SEQ ID NO: 382765 - protein, 9 aa, Homo Sapiens
QIRLGRKYV

SEQ ID NO: 382766 - protein, 9 aa, Homo Sapiens
LLLDPGESG

SEQ ID NO: 382767 - protein, 9 aa, Homo Sapiens
NLSSSSIII

SEQ ID NO: 382768 - protein, 9 aa, Homo Sapiens
VIHSFISGV

SEQ ID NO: 382769 - protein, 9 aa, Homo Sapiens
ESRPVTGEP

SEQ ID NO: 382770 - protein, 9 aa, Homo Sapiens
EESDKFYVG

SEQ ID NO: 382771 - protein, 9 aa, Homo Sapiens
IALTLFEYY

SEQ ID NO: 382772 - protein, 9 aa, Homo Sapiens
ECGRRFWDK

SEQ ID NO: 382773 - protein, 9 aa, Homo Sapiens
EPPKEIWLS

SEQ ID NO: 382774 - protein, 9 aa, Homo Sapiens
QFRLKEAFN

SEQ ID NO: 382775 - protein, 9 aa, Homo Sapiens
GRPGPPGLS

SEQ ID NO: 382776 - protein, 9 aa, Homo Sapiens
CLVEAAEAH

SEQ ID NO: 382777 - protein, 9 aa, Homo Sapiens
MDSCFNIDM

SEQ ID NO: 382778 - protein, 9 aa, Homo Sapiens
ISLGRQPPS

SEQ ID NO: 382779 - protein, 9 aa, Homo Sapiens
IRETYFQML

SEQ ID NO: 382780 - protein, 9 aa, Homo Sapiens
KELSWQKRT

SEQ ID NO: 382781 - protein, 9 aa, Homo Sapiens
SLYPGVTTI

SEQ ID NO: 382782 - protein, 9 aa, Homo Sapiens
PLKFHDAET

SEQ ID NO: 382783 - protein, 9 aa, Homo Sapiens
VKYNGGVKI

SEQ ID NO: 382784 - protein, 9 aa, Homo Sapiens
ISIAIEEVT

SEQ ID NO: 382785 - protein, 9 aa, Homo Sapiens
EYCQAIFQT

SEQ ID NO: 382786 - protein, 9 aa, Homo Sapiens
ERKQWALAV

SEQ ID NO: 382787 - protein, 9 aa, Homo Sapiens
LTEANKLAS

SEQ ID NO: 382788 - protein, 9 aa, Homo Sapiens
PGKPESKLF

SEQ ID NO: 382789 - protein, 9 aa, Homo Sapiens
VGEEQGQDN

SEQ ID NO: 382790 - protein, 9 aa, Homo Sapiens
DDTMSKMKM

SEQ ID NO: 382791 - protein, 9 aa, Homo Sapiens
DGEVRKTEV

SEQ ID NO: 382792 - protein, 9 aa, Homo Sapiens
EYFIQNFSV

SEQ ID NO: 382793 - protein, 9 aa, Homo Sapiens
LINDLQANS

SEQ ID NO: 382794 - protein, 9 aa, Homo Sapiens
LQENVRKLL

SEQ ID NO: 382795 - protein, 9 aa, Homo Sapiens
TLEPRASDT

SEQ ID NO: 382796 - protein, 9 aa, Homo Sapiens
VCVLNLWQK

SEQ ID NO: 382797 - protein, 9 aa, Homo Sapiens
AVFGVLGAR

SEQ ID NO: 382798 - protein, 9 aa, Homo Sapiens
AWMAPKVIK

SEQ ID NO: 382799 - protein, 9 aa, Homo Sapiens
NKRLSILSG

SEQ ID NO: 382800 - protein, 9 aa, Homo Sapiens
DPGSHEEDN

SEQ ID NO: 382801 - protein, 9 aa, Homo Sapiens
FTPNKPLRS

SEQ ID NO: 382802 - protein, 9 aa, Homo Sapiens
FLIKHPEDV

SEQ ID NO: 382803 - protein, 9 aa, Homo Sapiens
TYTYHMDVF

SEQ ID NO: 382804 - protein, 9 aa, Homo Sapiens
VYFADRMKW

SEQ ID NO: 382805 - protein, 9 aa, Homo Sapiens
SKFIETSAT

SEQ ID NO: 382806 - protein, 9 aa, Homo Sapiens
FRTEMEKGL

SEQ ID NO: 382807 - protein, 9 aa, Homo Sapiens
LLWLLQFIF

SEQ ID NO: 382808 - protein, 9 aa, Homo Sapiens
NPDVLKDDF

SEQ ID NO: 382809 - protein, 9 aa, Homo Sapiens
EFCKKEGYN

SEQ ID NO: 382810 - protein, 9 aa, Homo Sapiens
QNILLSEKN

SEQ ID NO: 382811 - protein, 9 aa, Homo Sapiens
SNLFLNHKR

SEQ ID NO: 382812 - protein, 9 aa, Homo Sapiens
AVWPNPDLV

SEQ ID NO: 382813 - protein, 9 aa, Homo Sapiens
NNDQPINLT

SEQ ID NO: 382814 - protein, 9 aa, Homo Sapiens
LLSGACTQL

SEQ ID NO: 382815 - protein, 9 aa, Homo Sapiens
TTPVWYGLR

SEQ ID NO: 382816 - protein, 9 aa, Homo Sapiens
NFEYQLVAF

SEQ ID NO: 382817 - protein, 9 aa, Homo Sapiens
NAKFDNKIM

SEQ ID NO: 382818 - protein, 9 aa, Homo Sapiens
VCGPGAQGA

SEQ ID NO: 382819 - protein, 9 aa, Homo Sapiens
DRQENDKDN

SEQ ID NO: 382820 - protein, 9 aa, Homo Sapiens
NYLHLEKVV

SEQ ID NO: 382821 - protein, 9 aa, Homo Sapiens
INLQNEKEE

SEQ ID NO: 382822 - protein, 9 aa, Homo Sapiens
YVVKAVSWL

SEQ ID NO: 382823 - protein, 9 aa, Homo Sapiens
CVVKILQNL

SEQ ID NO: 382824 - protein, 9 aa, Homo Sapiens
ARKCQKIIG

SEQ ID NO: 382825 - protein, 9 aa, Homo Sapiens
LFLIKHPED

SEQ ID NO: 382826 - protein, 9 aa, Homo Sapiens
DLLSGYLEV

SEQ ID NO: 382827 - protein, 9 aa, Homo Sapiens
IIQFGFHKK

SEQ ID NO: 382828 - protein, 9 aa, Homo Sapiens
AFDKQVLYF

SEQ ID NO: 382829 - protein, 9 aa, Homo Sapiens
NLIGFVLRR

SEQ ID NO: 382830 - protein, 9 aa, Homo Sapiens
PGGSPAVAA

SEQ ID NO: 382831 - protein, 9 aa, Homo Sapiens
GKKYHYVPH

SEQ ID NO: 382832 - protein, 9 aa, Homo Sapiens
LVGAFFSTA

SEQ ID NO: 382833 - protein, 9 aa, Homo Sapiens
SLHSLLSAA

SEQ ID NO: 382834 - protein, 9 aa, Homo Sapiens
EMLFHGGSS

SEQ ID NO: 382835 - protein, 9 aa, Homo Sapiens
SERTCSLNN

SEQ ID NO: 382836 - protein, 9 aa, Homo Sapiens
RDPPKSLLA

SEQ ID NO: 382837 - protein, 9 aa, Homo Sapiens
VEWGKIWRL

SEQ ID NO: 382838 - protein, 9 aa, Homo Sapiens
AFNYIKQRR

SEQ ID NO: 382839 - protein, 9 aa, Homo Sapiens
TGKQTAIIK

SEQ ID NO: 382840 - protein, 9 aa, Homo Sapiens
SAVVVVDCL

SEQ ID NO: 382841 - protein, 9 aa, Homo Sapiens
KLGLSQSCN

SEQ ID NO: 382842 - protein, 9 aa, Homo Sapiens
YLDEQEGVK

SEQ ID NO: 382843 - protein, 9 aa, Homo Sapiens
SKLQIWDTA

SEQ ID NO: 382844 - protein, 9 aa, Homo Sapiens
NHSSHLTRH

SEQ ID NO: 382845 - protein, 9 aa, Homo Sapiens
DTSNEGENN

SEQ ID NO: 382846 - protein, 9 aa, Homo Sapiens
GPTDFAPGI

SEQ ID NO: 382847 - protein, 9 aa, Homo Sapiens
PRLGRRSSP

SEQ ID NO: 382848 - protein, 9 aa, Homo Sapiens
SQTTIGCGV

SEQ ID NO: 382849 - protein, 9 aa, Homo Sapiens
DGFDLYLTY

SEQ ID NO: 382850 - protein, 9 aa, Homo Sapiens
VNLNNRTLN

SEQ ID NO: 382851 - protein, 9 aa, Homo Sapiens
RHTLFQTCI

SEQ ID NO: 382852 - protein, 9 aa, Homo Sapiens
RKQEKRQEQ

SEQ ID NO: 382853 - protein, 9 aa, Homo Sapiens
RTLKGHWWK

SEQ ID NO: 382854 - protein, 9 aa, Homo Sapiens
THRGLYTSI

SEQ ID NO: 382855 - protein, 9 aa, Homo Sapiens
VERGALFSS

SEQ ID NO: 382856 - protein, 9 aa, Homo Sapiens
ELNLQHDQK

SEQ ID NO: 382857 - protein, 9 aa, Homo Sapiens
RTNKLFHEI

SEQ ID NO: 382858 - protein, 9 aa, Homo Sapiens
TKPALPLAL

SEQ ID NO: 382859 - protein, 9 aa, Homo Sapiens
TTEFWLENE

SEQ ID NO: 382860 - protein, 9 aa, Homo Sapiens
IQIPTGQLT

SEQ ID NO: 382861 - protein, 9 aa, Homo Sapiens
LNNSMELAQ

SEQ ID NO: 382862 - protein, 9 aa, Homo Sapiens
PSCFNYVMH

SEQ ID NO: 382863 - protein, 9 aa, Homo Sapiens
IVVLVQLCQ

SEQ ID NO: 382864 - protein, 9 aa, Homo Sapiens
GKTFGSGYQ

SEQ ID NO: 382865 - protein, 9 aa, Homo Sapiens
CSKMEYMTD

SEQ ID NO: 382866 - protein, 9 aa, Homo Sapiens
PASRVPGPS

SEQ ID NO: 382867 - protein, 9 aa, Homo Sapiens
EILEAKVVE

SEQ ID NO: 382868 - protein, 9 aa, Homo Sapiens
VTMEWFEPQ

SEQ ID NO: 382869 - protein, 9 aa, Homo Sapiens
GYVKDAKMK

SEQ ID NO: 382870 - protein, 9 aa, Homo Sapiens
FKALWDKPF

SEQ ID NO: 382871 - protein, 9 aa, Homo Sapiens
RVKVGNEFI

SEQ ID NO: 382872 - protein, 9 aa, Homo Sapiens
RTGQGVPVV

SEQ ID NO: 382873 - protein, 9 aa, Homo Sapiens
FRKLIGSFQ

SEQ ID NO: 382874 - protein, 9 aa, Homo Sapiens
SVGLQNCDD

SEQ ID NO: 382875 - protein, 9 aa, Homo Sapiens
YLYSHTMIH

SEQ ID NO: 382876 - protein, 9 aa, Homo Sapiens
CPVKKGTNI

SEQ ID NO: 382877 - protein, 9 aa, Homo Sapiens
RGKDDGESF

SEQ ID NO: 382878 - protein, 9 aa, Homo Sapiens
RKQNEDDEV

SEQ ID NO: 382879 - protein, 9 aa, Homo Sapiens
YSHTMIHRD

SEQ ID NO: 382880 - protein, 9 aa, Homo Sapiens
RGVCGPGAQ

SEQ ID NO: 382881 - protein, 9 aa, Homo Sapiens
LGECKSFKD

SEQ ID NO: 382882 - protein, 9 aa, Homo Sapiens
FIQVCYGQK

SEQ ID NO: 382883 - protein, 9 aa, Homo Sapiens
GHHVEESTP

SEQ ID NO: 382884 - protein, 9 aa, Homo Sapiens
FPKRSERTC

SEQ ID NO: 382885 - protein, 9 aa, Homo Sapiens
EDPQLNLKV

SEQ ID NO: 382886 - protein, 9 aa, Homo Sapiens
SATTQISEV

SEQ ID NO: 382887 - protein, 9 aa, Homo Sapiens
CFNYVMHFL

SEQ ID NO: 382888 - protein, 9 aa, Homo Sapiens
ESYLCGISA

SEQ ID NO: 382889 - protein, 9 aa, Homo Sapiens
INYLVQTEE

SEQ ID NO: 382890 - protein, 9 aa, Homo Sapiens
MGVGFISMI

SEQ ID NO: 382891 - protein, 9 aa, Homo Sapiens
LVTFVAQNR

SEQ ID NO: 382892 - protein, 9 aa, Homo Sapiens
MEAAKVQIQ

SEQ ID NO: 382893 - protein, 9 aa, Homo Sapiens
ISEVTAQPP

SEQ ID NO: 382894 - protein, 9 aa, Homo Sapiens
LGYFTDTNE

SEQ ID NO: 382895 - protein, 9 aa, Homo Sapiens
ATPVEVLCK

SEQ ID NO: 382896 - protein, 9 aa, Homo Sapiens
YYGQFGLQR

SEQ ID NO: 382897 - protein, 9 aa, Homo Sapiens
QYHHNMTWK

SEQ ID NO: 382898 - protein, 9 aa, Homo Sapiens
SLKTVAVIT

SEQ ID NO: 382899 - protein, 9 aa, Homo Sapiens
IQIIFFNLE

SEQ ID NO: 382900 - protein, 9 aa, Homo Sapiens
NDWITNMIT

SEQ ID NO: 382901 - protein, 9 aa, Homo Sapiens
VAPLPCWWG

SEQ ID NO: 382902 - protein, 9 aa, Homo Sapiens
SIAKLSDLV

SEQ ID NO: 382903 - protein, 9 aa, Homo Sapiens
FLATGLYVL

SEQ ID NO: 382904 - protein, 9 aa, Homo Sapiens
PVASLFLDV

SEQ ID NO: 382905 - protein, 9 aa, Homo Sapiens
ELWVLSIAS

SEQ ID NO: 382906 - protein, 9 aa, Homo Sapiens
PQLHIGDWL

SEQ ID NO: 382907 - protein, 9 aa, Homo Sapiens
YRPDLIDIN

SEQ ID NO: 382908 - protein, 9 aa, Homo Sapiens
LFFQGVYII

SEQ ID NO: 382909 - protein, 9 aa, Homo Sapiens
VGKRKQNED

SEQ ID NO: 382910 - protein, 9 aa, Homo Sapiens
QFTGSGKCP

SEQ ID NO: 382911 - protein, 9 aa, Homo Sapiens
TFSEDDEIS

SEQ ID NO: 382912 - protein, 9 aa, Homo Sapiens
SLSYLNVTH

SEQ ID NO: 382913 - protein, 9 aa, Homo Sapiens
EIKASKGER

SEQ ID NO: 382914 - protein, 9 aa, Homo Sapiens
IYRASFQDW

SEQ ID NO: 382915 - protein, 9 aa, Homo Sapiens
DYQWAINMN

SEQ ID NO: 382916 - protein, 9 aa, Homo Sapiens
TLPRTIIQV

SEQ ID NO: 382917 - protein, 9 aa, Homo Sapiens
LNPNLLKTI

SEQ ID NO: 382918 - protein, 9 aa, Homo Sapiens
PKKTSGSHK

SEQ ID NO: 382919 - protein, 9 aa, Homo Sapiens
DSWNKHDSE

SEQ ID NO: 382920 - protein, 9 aa, Homo Sapiens
YHVFQSRND

SEQ ID NO: 382921 - protein, 9 aa, Homo Sapiens
DINMEENLD

SEQ ID NO: 382922 - protein, 9 aa, Homo Sapiens
QNQAFYLPP

SEQ ID NO: 382923 - protein, 9 aa, Homo Sapiens
QDQNGTLMI

SEQ ID NO: 382924 - protein, 9 aa, Homo Sapiens
VASMTVWEL

SEQ ID NO: 382925 - protein, 9 aa, Homo Sapiens
ESARENINL

SEQ ID NO: 382926 - protein, 9 aa, Homo Sapiens
QTDSSPGPS

SEQ ID NO: 382927 - protein, 9 aa, Homo Sapiens
YAPAIQGAE

SEQ ID NO: 382928 - protein, 9 aa, Homo Sapiens
EKACVKAHN

SEQ ID NO: 382929 - protein, 9 aa, Homo Sapiens
LSLVLEEPK

SEQ ID NO: 382930 - protein, 9 aa, Homo Sapiens
GLHCRCSFQ

SEQ ID NO: 382931 - protein, 9 aa, Homo Sapiens
AINMNKFFP

SEQ ID NO: 382932 - protein, 9 aa, Homo Sapiens
FWHTINNTI

SEQ ID NO: 382933 - protein, 9 aa, Homo Sapiens
MVHCSYICD

SEQ ID NO: 382934 - protein, 9 aa, Homo Sapiens
VGGATQIPA

SEQ ID NO: 382935 - protein, 9 aa, Homo Sapiens
QRILHGDVK

SEQ ID NO: 382936 - protein, 9 aa, Homo Sapiens
CNCPSGGSQ

SEQ ID NO: 382937 - protein, 9 aa, Homo Sapiens
KKALFLKEK

SEQ ID NO: 382938 - protein, 9 aa, Homo Sapiens
HFTIVTTDH

SEQ ID NO: 382939 - protein, 9 aa, Homo Sapiens
LLVMEGQAA

SEQ ID NO: 382940 - protein, 9 aa, Homo Sapiens
LTLQFVFCI

SEQ ID NO: 382941 - protein, 9 aa, Homo Sapiens
REQVTATPQ

SEQ ID NO: 382942 - protein, 9 aa, Homo Sapiens
RVVTVSQIT

SEQ ID NO: 382943 - protein, 9 aa, Homo Sapiens
TFGSGYQLS

SEQ ID NO: 382944 - protein, 9 aa, Homo Sapiens
AADNQRVEA

SEQ ID NO: 382945 - protein, 9 aa, Homo Sapiens
IGLENELFT

SEQ ID NO: 382946 - protein, 9 aa, Homo Sapiens
PPFQKAQSA

SEQ ID NO: 382947 - protein, 9 aa, Homo Sapiens
QTLVHRPGM

SEQ ID NO: 382948 - protein, 9 aa, Homo Sapiens
PGALVFVNV

SEQ ID NO: 382949 - protein, 9 aa, Homo Sapiens
YIRKALALD

SEQ ID NO: 382950 - protein, 9 aa, Homo Sapiens
THQQIHLGD

SEQ ID NO: 382951 - protein, 9 aa, Homo Sapiens
EANFISNSK

SEQ ID NO: 382952 - protein, 9 aa, Homo Sapiens
VGLPVIMGC

SEQ ID NO: 382953 - protein, 9 aa, Homo Sapiens
VTDHIASLE

SEQ ID NO: 382954 - protein, 9 aa, Homo Sapiens
KTLNEHQIL

SEQ ID NO: 382955 - protein, 9 aa, Homo Sapiens
STSPIRYVR

SEQ ID NO: 382956 - protein, 9 aa, Homo Sapiens
EALVKLFNK

SEQ ID NO: 382957 - protein, 9 aa, Homo Sapiens
LQISRQQNK

SEQ ID NO: 382958 - protein, 9 aa, Homo Sapiens
WPLRLAWRQ

SEQ ID NO: 382959 - protein, 9 aa, Homo Sapiens
CTERPSNNS

SEQ ID NO: 382960 - protein, 9 aa, Homo Sapiens
PFNVDSGRE

SEQ ID NO: 382961 - protein, 9 aa, Homo Sapiens
MAVLTNPVT

SEQ ID NO: 382962 - protein, 9 aa, Homo Sapiens
KQFFPKSLL

SEQ ID NO: 382963 - protein, 9 aa, Homo Sapiens
KLSISSSTS

SEQ ID NO: 382964 - protein, 9 aa, Homo Sapiens
PPGHHVEES

SEQ ID NO: 382965 - protein, 9 aa, Homo Sapiens
HENATFQKK

SEQ ID NO: 382966 - protein, 9 aa, Homo Sapiens
VNHTHLLLH

SEQ ID NO: 382967 - protein, 9 aa, Homo Sapiens
GAVRGAQCG

SEQ ID NO: 382968 - protein, 9 aa, Homo Sapiens
LKGSIELSQ

SEQ ID NO: 382969 - protein, 9 aa, Homo Sapiens
ALVKLFNKH

SEQ ID NO: 382970 - protein, 9 aa, Homo Sapiens
NSNLPSEPV

SEQ ID NO: 382971 - protein, 9 aa, Homo Sapiens
VQQLCEVGE

SEQ ID NO: 382972 - protein, 9 aa, Homo Sapiens
YQIILNGEE

SEQ ID NO: 382973 - protein, 9 aa, Homo Sapiens
CIHRDLAAQ

SEQ ID NO: 382974 - protein, 9 aa, Homo Sapiens
YLGGGPPTT

SEQ ID NO: 382975 - protein, 9 aa, Homo Sapiens
LTEVKYNGG

SEQ ID NO: 382976 - protein, 9 aa, Homo Sapiens
NSGFWRSDD

SEQ ID NO: 382977 - protein, 9 aa, Homo Sapiens
AAAPAVAPL

SEQ ID NO: 382978 - protein, 9 aa, Homo Sapiens
EIDAVTSSG

SEQ ID NO: 382979 - protein, 9 aa, Homo Sapiens
IPTAINFTL

SEQ ID NO: 382980 - protein, 9 aa, Homo Sapiens
GYLEVIRKW

SEQ ID NO: 382981 - protein, 9 aa, Homo Sapiens
AESVLNYFK

SEQ ID NO: 382982 - protein, 9 aa, Homo Sapiens
RLQAVLDII

SEQ ID NO: 382983 - protein, 9 aa, Homo Sapiens
LRALVEDPQ

SEQ ID NO: 382984 - protein, 9 aa, Homo Sapiens
ILVWVVDVN

SEQ ID NO: 382985 - protein, 9 aa, Homo Sapiens
LRKTALIGL

SEQ ID NO: 382986 - protein, 9 aa, Homo Sapiens
GLAMFILNH

SEQ ID NO: 382987 - protein, 9 aa, Homo Sapiens
MTGECRLGE

SEQ ID NO: 382988 - protein, 9 aa, Homo Sapiens
ARKQIRLGR

SEQ ID NO: 382989 - protein, 9 aa, Homo Sapiens
VTEMNNSLN

SEQ ID NO: 382990 - protein, 9 aa, Homo Sapiens
RQGYHHEHL

SEQ ID NO: 382991 - protein, 9 aa, Homo Sapiens
IGSGIQYLH

SEQ ID NO: 382992 - protein, 9 aa, Homo Sapiens
NDGNQSSVW

SEQ ID NO: 382993 - protein, 9 aa, Homo Sapiens
DEDEDDGLF

SEQ ID NO: 382994 - protein, 9 aa, Homo Sapiens
GYHAKNFLG

SEQ ID NO: 382995 - protein, 9 aa, Homo Sapiens
VPIIKLTDY

SEQ ID NO: 382996 - protein, 9 aa, Homo Sapiens
EDINTRFLS

SEQ ID NO: 382997 - protein, 9 aa, Homo Sapiens
GNHIEDLQK

SEQ ID NO: 382998 - protein, 9 aa, Homo Sapiens
VWTLVVPLV

SEQ ID NO: 382999 - protein, 9 aa, Homo Sapiens
YFVLEQHEY

SEQ ID NO: 383000 - protein, 9 aa, Homo Sapiens
ATPADPDSG

SEQ ID NO: 383001 - protein, 9 aa, Homo Sapiens
WKLSMQCKD

SEQ ID NO: 383002 - protein, 9 aa, Homo Sapiens
KLKESSAKL

SEQ ID NO: 383003 - protein, 9 aa, Homo Sapiens
YRYRCTARS

SEQ ID NO: 383004 - protein, 9 aa, Homo Sapiens
ACYAIHTFP

SEQ ID NO: 383005 - protein, 9 aa, Homo Sapiens
GKRRANKAK

SEQ ID NO: 383006 - protein, 9 aa, Homo Sapiens
GKGVNLYYV

SEQ ID NO: 383007 - protein, 9 aa, Homo Sapiens
FTWTHVTLL

SEQ ID NO: 383008 - protein, 9 aa, Homo Sapiens
NNSNWTKIK

SEQ ID NO: 383009 - protein, 9 aa, Homo Sapiens
KLNMMSKTS

SEQ ID NO: 383010 - protein, 9 aa, Homo Sapiens
AKDTFQGAP

SEQ ID NO: 383011 - protein, 9 aa, Homo Sapiens
TGTFDLQEM

SEQ ID NO: 383012 - protein, 9 aa, Homo Sapiens
VRTIQLIKD

SEQ ID NO: 383013 - protein, 9 aa, Homo Sapiens
VERTGKYVH

SEQ ID NO: 383014 - protein, 9 aa, Homo Sapiens
RGISSNQLH

SEQ ID NO: 383015 - protein, 9 aa, Homo Sapiens
GSLYPGVTT

SEQ ID NO: 383016 - protein, 9 aa, Homo Sapiens
LTLEKNRMS

SEQ ID NO: 383017 - protein, 9 aa, Homo Sapiens
ASEEAASVQ

SEQ ID NO: 383018 - protein, 9 aa, Homo Sapiens
RMATISESN

SEQ ID NO: 383019 - protein, 9 aa, Homo Sapiens
VRPPGHHVE

SEQ ID NO: 383020 - protein, 9 aa, Homo Sapiens
TRVGSIAKL

SEQ ID NO: 383021 - protein, 9 aa, Homo Sapiens
QSRNDCVDP

SEQ ID NO: 383022 - protein, 9 aa, Homo Sapiens
GELSVPSSN

SEQ ID NO: 383023 - protein, 9 aa, Homo Sapiens
MGKFIITFS

SEQ ID NO: 383024 - protein, 9 aa, Homo Sapiens
GRPPFQKAQ

SEQ ID NO: 383025 - protein, 9 aa, Homo Sapiens
SAACICLIS

SEQ ID NO: 383026 - protein, 9 aa, Homo Sapiens
YHTFWKEDK

SEQ ID NO: 383027 - protein, 9 aa, Homo Sapiens
QKAAKMYTD

SEQ ID NO: 383028 - protein, 9 aa, Homo Sapiens
WTPNMSVAS

SEQ ID NO: 383029 - protein, 9 aa, Homo Sapiens
VLFGVGSVM

SEQ ID NO: 383030 - protein, 9 aa, Homo Sapiens
VYDDGLDEL

SEQ ID NO: 383031 - protein, 9 aa, Homo Sapiens
AFLMTYKCA

SEQ ID NO: 383032 - protein, 9 aa, Homo Sapiens
SRRLLVKKI

SEQ ID NO: 383033 - protein, 9 aa, Homo Sapiens
HNFNSPDCL

SEQ ID NO: 383034 - protein, 9 aa, Homo Sapiens
YTCPKCGKG

SEQ ID NO: 383035 - protein, 9 aa, Homo Sapiens
KEAIKRYCC

SEQ ID NO: 383036 - protein, 9 aa, Homo Sapiens
SRPVTGEPG

SEQ ID NO: 383037 - protein, 9 aa, Homo Sapiens
VNFNLTDFY

SEQ ID NO: 383038 - protein, 9 aa, Homo Sapiens
YGRHGSGFG

SEQ ID NO: 383039 - protein, 9 aa, Homo Sapiens
SSGQPCCPC

SEQ ID NO: 383040 - protein, 9 aa, Homo Sapiens
YLNKNTYLT

SEQ ID NO: 383041 - protein, 9 aa, Homo Sapiens
WFDTSFNLI

SEQ ID NO: 383042 - protein, 9 aa, Homo Sapiens
ILALVLRIR

SEQ ID NO: 383043 - protein, 9 aa, Homo Sapiens
HSVIHSFIS

SEQ ID NO: 383044 - protein, 9 aa, Homo Sapiens
DWIKDQLYL

SEQ ID NO: 383045 - protein, 9 aa, Homo Sapiens
ASLIWNKFG

SEQ ID NO: 383046 - protein, 9 aa, Homo Sapiens
QSEESYLCG

SEQ ID NO: 383047 - protein, 9 aa, Homo Sapiens
AASQTLCIF

SEQ ID NO: 383048 - protein, 9 aa, Homo Sapiens
AFDQIRMAT

SEQ ID NO: 383049 - protein, 9 aa, Homo Sapiens
WDKPFISSR

SEQ ID NO: 383050 - protein, 9 aa, Homo Sapiens
LAPFPDIMA

SEQ ID NO: 383051 - protein, 9 aa, Homo Sapiens
SELFLPVLY

SEQ ID NO: 383052 - protein, 9 aa, Homo Sapiens
NYVELAVLP

SEQ ID NO: 383053 - protein, 9 aa, Homo Sapiens
KSIIDEKLF

SEQ ID NO: 383054 - protein, 9 aa, Homo Sapiens
FETDESTQS

SEQ ID NO: 383055 - protein, 9 aa, Homo Sapiens
HLWGHQITH

SEQ ID NO: 383056 - protein, 9 aa, Homo Sapiens
NGKYIIKHL

SEQ ID NO: 383057 - protein, 9 aa, Homo Sapiens
HGSGFGRSS

SEQ ID NO: 383058 - protein, 9 aa, Homo Sapiens
AQTCIGTPY

SEQ ID NO: 383059 - protein, 9 aa, Homo Sapiens
LYIEANFIS

SEQ ID NO: 383060 - protein, 9 aa, Homo Sapiens
SYLKYVFNP

SEQ ID NO: 383061 - protein, 9 aa, Homo Sapiens
LYDNNTGKL

SEQ ID NO: 383062 - protein, 9 aa, Homo Sapiens
SQLENLQKN

SEQ ID NO: 383063 - protein, 9 aa, Homo Sapiens
VLLFLFWVC

SEQ ID NO: 383064 - protein, 9 aa, Homo Sapiens
GCKTEVNIT

SEQ ID NO: 383065 - protein, 9 aa, Homo Sapiens
DVGGTNQEF

SEQ ID NO: 383066 - protein, 9 aa, Homo Sapiens
LEKNRMSVS

SEQ ID NO: 383067 - protein, 9 aa, Homo Sapiens
VRILRGLGD

SEQ ID NO: 383068 - protein, 9 aa, Homo Sapiens
VITLHRLRM

SEQ ID NO: 383069 - protein, 9 aa, Homo Sapiens
YIKPSNIVF

SEQ ID NO: 383070 - protein, 9 aa, Homo Sapiens
VTHKAYWQV

SEQ ID NO: 383071 - protein, 9 aa, Homo Sapiens
SYSLHSTTM

SEQ ID NO: 383072 - protein, 9 aa, Homo Sapiens
PVKEANQSM

SEQ ID NO: 383073 - protein, 9 aa, Homo Sapiens
YNLLTIKDE

SEQ ID NO: 383074 - protein, 9 aa, Homo Sapiens
CPKQNAISS

SEQ ID NO: 383075 - protein, 9 aa, Homo Sapiens
GLLHYMIQI

SEQ ID NO: 383076 - protein, 9 aa, Homo Sapiens
SLRRCGLTY

SEQ ID NO: 383077 - protein, 9 aa, Homo Sapiens
AAGTYVWMA

SEQ ID NO: 383078 - protein, 9 aa, Homo Sapiens
FTQCCVNPV

SEQ ID NO: 383079 - protein, 9 aa, Homo Sapiens
LSSEELDQV

SEQ ID NO: 383080 - protein, 9 aa, Homo Sapiens
LLTYLSFKV

SEQ ID NO: 383081 - protein, 9 aa, Homo Sapiens
PLALTSSDP

SEQ ID NO: 383082 - protein, 9 aa, Homo Sapiens
HREVNLPKV

SEQ ID NO: 383083 - protein, 9 aa, Homo Sapiens
MLMVRLTWA

SEQ ID NO: 383084 - protein, 9 aa, Homo Sapiens
SHKHCWCKE

SEQ ID NO: 383085 - protein, 9 aa, Homo Sapiens
VMAVLTNPV

SEQ ID NO: 383086 - protein, 9 aa, Homo Sapiens
TNQKDYLGD

SEQ ID NO: 383087 - protein, 9 aa, Homo Sapiens
LAFQNPGPQ

SEQ ID NO: 383088 - protein, 9 aa, Homo Sapiens
GKDHLVWQI

SEQ ID NO: 383089 - protein, 9 aa, Homo Sapiens
GAELERQHI

SEQ ID NO: 383090 - protein, 9 aa, Homo Sapiens
LALVLRIRC

SEQ ID NO: 383091 - protein, 9 aa, Homo Sapiens
NYHWPSLVQ

SEQ ID NO: 383092 - protein, 9 aa, Homo Sapiens
EAYLNLLKS

SEQ ID NO: 383093 - protein, 9 aa, Homo Sapiens
ITFIRPSRV

SEQ ID NO: 383094 - protein, 9 aa, Homo Sapiens
KSGTFPRKL

SEQ ID NO: 383095 - protein, 9 aa, Homo Sapiens
REIASLIWN

SEQ ID NO: 383096 - protein, 9 aa, Homo Sapiens
VIILIWLLA

SEQ ID NO: 383097 - protein, 9 aa, Homo Sapiens
VRMGVGFIS

SEQ ID NO: 383098 - protein, 9 aa, Homo Sapiens
SFARRQRNS

SEQ ID NO: 383099 - protein, 9 aa, Homo Sapiens
YHPDGVFMY

SEQ ID NO: 383100 - protein, 9 aa, Homo Sapiens
LRVFAFQET

SEQ ID NO: 383101 - protein, 9 aa, Homo Sapiens
SEDYVVKAV

SEQ ID NO: 383102 - protein, 9 aa, Homo Sapiens
VAFDKQVLY

SEQ ID NO: 383103 - protein, 9 aa, Homo Sapiens
AIDWNPATD

SEQ ID NO: 383104 - protein, 9 aa, Homo Sapiens
VQGDTWSLF

SEQ ID NO: 383105 - protein, 9 aa, Homo Sapiens
ARRNQGAEQ

SEQ ID NO: 383106 - protein, 9 aa, Homo Sapiens
CCVPACCKP

SEQ ID NO: 383107 - protein, 9 aa, Homo Sapiens
EDRHIKLYD

SEQ ID NO: 383108 - protein, 9 aa, Homo Sapiens
SSSTGEMFT

SEQ ID NO: 383109 - protein, 9 aa, Homo Sapiens
TRPYPCQLC

SEQ ID NO: 383110 - protein, 9 aa, Homo Sapiens
HGPQTLDNL

SEQ ID NO: 383111 - protein, 9 aa, Homo Sapiens
NNLKTKQEE

SEQ ID NO: 383112 - protein, 9 aa, Homo Sapiens
PNFKDIQYQ

SEQ ID NO: 383113 - protein, 9 aa, Homo Sapiens
SEDVKLESM

SEQ ID NO: 383114 - protein, 9 aa, Homo Sapiens
TFLFLIKHP

SEQ ID NO: 383115 - protein, 9 aa, Homo Sapiens
SRNDCVDPC

SEQ ID NO: 383116 - protein, 9 aa, Homo Sapiens
ESKFIESLN

SEQ ID NO: 383117 - protein, 9 aa, Homo Sapiens
SMIRAHEAQ

SEQ ID NO: 383118 - protein, 9 aa, Homo Sapiens
LQNRFKHEK

SEQ ID NO: 383119 - protein, 9 aa, Homo Sapiens
NNWPWMKLY

SEQ ID NO: 383120 - protein, 9 aa, Homo Sapiens
VIKENSLPK

SEQ ID NO: 383121 - protein, 9 aa, Homo Sapiens
LWMVFMCAA

SEQ ID NO: 383122 - protein, 9 aa, Homo Sapiens
YPTAQPLVQ

SEQ ID NO: 383123 - protein, 9 aa, Homo Sapiens
LQHRILILG

SEQ ID NO: 383124 - protein, 9 aa, Homo Sapiens
TIDMMYKEG

SEQ ID NO: 383125 - protein, 9 aa, Homo Sapiens
KLQTILQVQ

SEQ ID NO: 383126 - protein, 9 aa, Homo Sapiens
FGCILSELW

SEQ ID NO: 383127 - protein, 9 aa, Homo Sapiens
LAMLAATYI

SEQ ID NO: 383128 - protein, 9 aa, Homo Sapiens
LFQTHAAFE

SEQ ID NO: 383129 - protein, 9 aa, Homo Sapiens
RQHSPRHTP

SEQ ID NO: 383130 - protein, 9 aa, Homo Sapiens
AVTMEWFEP

SEQ ID NO: 383131 - protein, 9 aa, Homo Sapiens
EVCGQSFIR

SEQ ID NO: 383132 - protein, 9 aa, Homo Sapiens
VLYGKYIRP

SEQ ID NO: 383133 - protein, 9 aa, Homo Sapiens
GRSGKMWAL

SEQ ID NO: 383134 - protein, 9 aa, Homo Sapiens
LRHGRAPLQ

SEQ ID NO: 383135 - protein, 9 aa, Homo Sapiens
LLHYMIQIL

SEQ ID NO: 383136 - protein, 9 aa, Homo Sapiens
NLFAPLLPV

SEQ ID NO: 383137 - protein, 9 aa, Homo Sapiens
WKQWHEDIT

SEQ ID NO: 383138 - protein, 9 aa, Homo Sapiens
EEIDPFNVD

SEQ ID NO: 383139 - protein, 9 aa, Homo Sapiens
ENVNKKAVA

SEQ ID NO: 383140 - protein, 9 aa, Homo Sapiens
SRALSTANK

SEQ ID NO: 383141 - protein, 9 aa, Homo Sapiens
AQLCLVPLE

SEQ ID NO: 383142 - protein, 9 aa, Homo Sapiens
LLCFGVLYV

SEQ ID NO: 383143 - protein, 9 aa, Homo Sapiens
NIDIQIPTG

SEQ ID NO: 383144 - protein, 9 aa, Homo Sapiens
DAFFTLEGF

SEQ ID NO: 383145 - protein, 9 aa, Homo Sapiens
YVWMAPEVI

SEQ ID NO: 383146 - protein, 9 aa, Homo Sapiens
KLQTKYLGC

SEQ ID NO: 383147 - protein, 9 aa, Homo Sapiens
ECVSGPPDY

SEQ ID NO: 383148 - protein, 9 aa, Homo Sapiens
KLFLCGRGR

SEQ ID NO: 383149 - protein, 9 aa, Homo Sapiens
LWLSYLKYV

SEQ ID NO: 383150 - protein, 9 aa, Homo Sapiens
SLIWNKFGS

SEQ ID NO: 383151 - protein, 9 aa, Homo Sapiens
WTIYDFGFP

SEQ ID NO: 383152 - protein, 9 aa, Homo Sapiens
KQIRLGRKY

SEQ ID NO: 383153 - protein, 9 aa, Homo Sapiens
DNFKTSEIQ

SEQ ID NO: 383154 - protein, 9 aa, Homo Sapiens
IHEITHTGE

SEQ ID NO: 383155 - protein, 9 aa, Homo Sapiens
LRPTICERE

SEQ ID NO: 383156 - protein, 9 aa, Homo Sapiens
NNPYNIFDG

SEQ ID NO: 383157 - protein, 9 aa, Homo Sapiens
KDSEIKMIQ

SEQ ID NO: 383158 - protein, 9 aa, Homo Sapiens
FLEPTQKDI

SEQ ID NO: 383159 - protein, 9 aa, Homo Sapiens
LQYWGLDHP

SEQ ID NO: 383160 - protein, 9 aa, Homo Sapiens
KSIKEVIKR

SEQ ID NO: 383161 - protein, 9 aa, Homo Sapiens
SIPAEQFEN

SEQ ID NO: 383162 - protein, 9 aa, Homo Sapiens
ADTILKDAD

SEQ ID NO: 383163 - protein, 9 aa, Homo Sapiens
EMGKPVIGE

SEQ ID NO: 383164 - protein, 9 aa, Homo Sapiens
DSSSTSINV

SEQ ID NO: 383165 - protein, 9 aa, Homo Sapiens
ADMEKLQCL

SEQ ID NO: 383166 - protein, 9 aa, Homo Sapiens
ALIGLCHCK

SEQ ID NO: 383167 - protein, 9 aa, Homo Sapiens
LYALRFFDY

SEQ ID NO: 383168 - protein, 9 aa, Homo Sapiens
IVSPAYTPN

SEQ ID NO: 383169 - protein, 9 aa, Homo Sapiens
TFTSSDKSL

SEQ ID NO: 383170 - protein, 9 aa, Homo Sapiens
ANQSMLENF

SEQ ID NO: 383171 - protein, 9 aa, Homo Sapiens
TRVSQIICS

SEQ ID NO: 383172 - protein, 9 aa, Homo Sapiens
KPLLKCSSL

SEQ ID NO: 383173 - protein, 9 aa, Homo Sapiens
QEESKAADN

SEQ ID NO: 383174 - protein, 9 aa, Homo Sapiens
FRVRATAKA

SEQ ID NO: 383175 - protein, 9 aa, Homo Sapiens
QYPNFKDIQ

SEQ ID NO: 383176 - protein, 9 aa, Homo Sapiens
VHFTIVTTD

SEQ ID NO: 383177 - protein, 9 aa, Homo Sapiens
NKVVFRKYL

SEQ ID NO: 383178 - protein, 9 aa, Homo Sapiens
YTYYAVWPN

SEQ ID NO: 383179 - protein, 9 aa, Homo Sapiens
KQVLYFDAY

SEQ ID NO: 383180 - protein, 9 aa, Homo Sapiens
TSSESKPSS

SEQ ID NO: 383181 - protein, 9 aa, Homo Sapiens
FIFQMLVLG

SEQ ID NO: 383182 - protein, 9 aa, Homo Sapiens
HIRYLYKLR

SEQ ID NO: 383183 - protein, 9 aa, Homo Sapiens
KHPEDVDCA

SEQ ID NO: 383184 - protein, 9 aa, Homo Sapiens
RATHFLLGV

SEQ ID NO: 383185 - protein, 9 aa, Homo Sapiens
KLVQLNKLF

SEQ ID NO: 383186 - protein, 9 aa, Homo Sapiens
NTFEGDIQE

SEQ ID NO: 383187 - protein, 9 aa, Homo Sapiens
DLQEMLFHG

SEQ ID NO: 383188 - protein, 9 aa, Homo Sapiens
EHIHEERKE

SEQ ID NO: 383189 - protein, 9 aa, Homo Sapiens
EDKLSRVEE

SEQ ID NO: 383190 - protein, 9 aa, Homo Sapiens
DNGQGLVTS

SEQ ID NO: 383191 - protein, 9 aa, Homo Sapiens
DNVQGDTWS

SEQ ID NO: 383192 - protein, 9 aa, Homo Sapiens
LDHPDITCG

SEQ ID NO: 383193 - protein, 9 aa, Homo Sapiens
SNFIQWCQK

SEQ ID NO: 383194 - protein, 9 aa, Homo Sapiens
YDDGLDELS

SEQ ID NO: 383195 - protein, 9 aa, Homo Sapiens
VEAAMYLQL

SEQ ID NO: 383196 - protein, 9 aa, Homo Sapiens
FCMEKGNIK

SEQ ID NO: 383197 - protein, 9 aa, Homo Sapiens
TYQEAPPVR

SEQ ID NO: 383198 - protein, 9 aa, Homo Sapiens
RENINLQPG

SEQ ID NO: 383199 - protein, 9 aa, Homo Sapiens
GDIKKHLML

SEQ ID NO: 383200 - protein, 9 aa, Homo Sapiens
TENVLKKIA

SEQ ID NO: 383201 - protein, 9 aa, Homo Sapiens
LGVLESLRN

SEQ ID NO: 383202 - protein, 9 aa, Homo Sapiens
ERKKQHLAQ

SEQ ID NO: 383203 - protein, 9 aa, Homo Sapiens
NPDDLTSND

SEQ ID NO: 383204 - protein, 9 aa, Homo Sapiens
YHLNYVKEV

SEQ ID NO: 383205 - protein, 9 aa, Homo Sapiens
TPNISNKPK

SEQ ID NO: 383206 - protein, 9 aa, Homo Sapiens
LGNPRADNI

SEQ ID NO: 383207 - protein, 9 aa, Homo Sapiens
QSRHRAIIQ

SEQ ID NO: 383208 - protein, 9 aa, Homo Sapiens
LGKVYINVK

SEQ ID NO: 383209 - protein, 9 aa, Homo Sapiens
LRASMNKLT

SEQ ID NO: 383210 - protein, 9 aa, Homo Sapiens
SGDKKATVD

SEQ ID NO: 383211 - protein, 9 aa, Homo Sapiens
SRTSSCPKQ

SEQ ID NO: 383212 - protein, 9 aa, Homo Sapiens
ASDTKNQEG

SEQ ID NO: 383213 - protein, 9 aa, Homo Sapiens
RPTICEREL

SEQ ID NO: 383214 - protein, 9 aa, Homo Sapiens
RTLNVSKGE

SEQ ID NO: 383215 - protein, 9 aa, Homo Sapiens
VIYWLVSNQ

SEQ ID NO: 383216 - protein, 9 aa, Homo Sapiens
KNQYNIDYS

SEQ ID NO: 383217 - protein, 9 aa, Homo Sapiens
TKETTQNNF

SEQ ID NO: 383218 - protein, 9 aa, Homo Sapiens
GTIGGNNNI

SEQ ID NO: 383219 - protein, 9 aa, Homo Sapiens
HGDFHFTDC

SEQ ID NO: 383220 - protein, 9 aa, Homo Sapiens
SGDIVSPIH

SEQ ID NO: 383221 - protein, 9 aa, Homo Sapiens
VILEKQICI

SEQ ID NO: 383222 - protein, 9 aa, Homo Sapiens
DSATTQISE

SEQ ID NO: 383223 - protein, 9 aa, Homo Sapiens
QIDLQDNPW

SEQ ID NO: 383224 - protein, 9 aa, Homo Sapiens
QMRDFLCEA

SEQ ID NO: 383225 - protein, 9 aa, Homo Sapiens
SSSKRNELK

SEQ ID NO: 383226 - protein, 9 aa, Homo Sapiens
SNLARHQII

SEQ ID NO: 383227 - protein, 9 aa, Homo Sapiens
GQAHKDLLN

SEQ ID NO: 383228 - protein, 9 aa, Homo Sapiens
GIWSVGQII

SEQ ID NO: 383229 - protein, 9 aa, Homo Sapiens
SRVPGPSQS

SEQ ID NO: 383230 - protein, 9 aa, Homo Sapiens
NSSAKNNSN

SEQ ID NO: 383231 - protein, 9 aa, Homo Sapiens
PGGKCPVDG

SEQ ID NO: 383232 - protein, 9 aa, Homo Sapiens
YKACMRTSV

SEQ ID NO: 383233 - protein, 9 aa, Homo Sapiens
WITTLEKRY

SEQ ID NO: 383234 - protein, 9 aa, Homo Sapiens
TVIPLNKRL

SEQ ID NO: 383235 - protein, 9 aa, Homo Sapiens
QEADTILKD

SEQ ID NO: 383236 - protein, 9 aa, Homo Sapiens
ELNSVINDI

SEQ ID NO: 383237 - protein, 9 aa, Homo Sapiens
LAIQNAGIV

SEQ ID NO: 383238 - protein, 9 aa, Homo Sapiens
IMVSSLPEI

SEQ ID NO: 383239 - protein, 9 aa, Homo Sapiens
RWFDTSFNL

SEQ ID NO: 383240 - protein, 9 aa, Homo Sapiens
VVRPPGHHV

SEQ ID NO: 383241 - protein, 9 aa, Homo Sapiens
TANKIALEA

SEQ ID NO: 383242 - protein, 9 aa, Homo Sapiens
MTRVAYLFS

SEQ ID NO: 383243 - protein, 9 aa, Homo Sapiens
NGRNCLYSR

SEQ ID NO: 383244 - protein, 9 aa, Homo Sapiens
QLENLQKNI

SEQ ID NO: 383245 - protein, 9 aa, Homo Sapiens
LCSGFIKPT

SEQ ID NO: 383246 - protein, 9 aa, Homo Sapiens
SEGATAPAT

SEQ ID NO: 383247 - protein, 9 aa, Homo Sapiens
QYQIILNGE

SEQ ID NO: 383248 - protein, 9 aa, Homo Sapiens
KIHIRENSH

SEQ ID NO: 383249 - protein, 9 aa, Homo Sapiens
AEKKKLQTI

SEQ ID NO: 383250 - protein, 9 aa, Homo Sapiens
FFPFFFLRR

SEQ ID NO: 383251 - protein, 9 aa, Homo Sapiens
NSCLAQAWF

SEQ ID NO: 383252 - protein, 9 aa, Homo Sapiens
NSVFQCVQM

SEQ ID NO: 383253 - protein, 9 aa, Homo Sapiens
SKLCLVEAA

SEQ ID NO: 383254 - protein, 9 aa, Homo Sapiens
GKCRYIYYG

SEQ ID NO: 383255 - protein, 9 aa, Homo Sapiens
LPGVVLLNN

SEQ ID NO: 383256 - protein, 9 aa, Homo Sapiens
SQFTRDFIQ

SEQ ID NO: 383257 - protein, 9 aa, Homo Sapiens
IVTALVKNR

SEQ ID NO: 383258 - protein, 9 aa, Homo Sapiens
AGTSFLIDE

SEQ ID NO: 383259 - protein, 9 aa, Homo Sapiens
DKELDALQQ

SEQ ID NO: 383260 - protein, 9 aa, Homo Sapiens
ENKLLNLTV

SEQ ID NO: 383261 - protein, 9 aa, Homo Sapiens
EKECSLSLV

SEQ ID NO: 383262 - protein, 9 aa, Homo Sapiens
FIKIDQAWK

SEQ ID NO: 383263 - protein, 9 aa, Homo Sapiens
AAQNILLSE

SEQ ID NO: 383264 - protein, 9 aa, Homo Sapiens
QEDKLGFLV

SEQ ID NO: 383265 - protein, 9 aa, Homo Sapiens
FLVSLMPYH

SEQ ID NO: 383266 - protein, 9 aa, Homo Sapiens
LTIVSPAYT

SEQ ID NO: 383267 - protein, 9 aa, Homo Sapiens
ETQKYVGPL

SEQ ID NO: 383268 - protein, 9 aa, Homo Sapiens
SYCACRLKT

SEQ ID NO: 383269 - protein, 9 aa, Homo Sapiens
RNKRLSILS

SEQ ID NO: 383270 - protein, 9 aa, Homo Sapiens
PIRHIWLSF

SEQ ID NO: 383271 - protein, 9 aa, Homo Sapiens
VVPASLHSL

SEQ ID NO: 383272 - protein, 9 aa, Homo Sapiens
EDEDEDDGL

SEQ ID NO: 383273 - protein, 9 aa, Homo Sapiens
WDSEAFQLA

SEQ ID NO: 383274 - protein, 9 aa, Homo Sapiens
NHIEDLQKN

SEQ ID NO: 383275 - protein, 9 aa, Homo Sapiens
AREFLRNKL

SEQ ID NO: 383276 - protein, 9 aa, Homo Sapiens
IHNPLYPVT

SEQ ID NO: 383277 - protein, 9 aa, Homo Sapiens
HMSGLRNHQ

SEQ ID NO: 383278 - protein, 9 aa, Homo Sapiens
DKPYTCPKC

SEQ ID NO: 383279 - protein, 9 aa, Homo Sapiens
YERALDIWR

SEQ ID NO: 383280 - protein, 9 aa, Homo Sapiens
GLRLLYLSY

SEQ ID NO: 383281 - protein, 9 aa, Homo Sapiens
FRAKVCGKI

SEQ ID NO: 383282 - protein, 9 aa, Homo Sapiens
INSEHIHEE

SEQ ID NO: 383283 - protein, 9 aa, Homo Sapiens
FWLENEKIH

SEQ ID NO: 383284 - protein, 9 aa, Homo Sapiens
QNLAALVSE

SEQ ID NO: 383285 - protein, 9 aa, Homo Sapiens
VRVPSVTLV

SEQ ID NO: 383286 - protein, 9 aa, Homo Sapiens
PSEPKSGTF

SEQ ID NO: 383287 - protein, 9 aa, Homo Sapiens
KQLFELLNL

SEQ ID NO: 383288 - protein, 9 aa, Homo Sapiens
SLHKTIQAA

SEQ ID NO: 383289 - protein, 9 aa, Homo Sapiens
LAIKYASHS

SEQ ID NO: 383290 - protein, 9 aa, Homo Sapiens
GDRDNNKWS

SEQ ID NO: 383291 - protein, 9 aa, Homo Sapiens
KLYDNNTGK

SEQ ID NO: 383292 - protein, 9 aa, Homo Sapiens
GLYTSIQKT

SEQ ID NO: 383293 - protein, 9 aa, Homo Sapiens
RQINKEALV

SEQ ID NO: 383294 - protein, 9 aa, Homo Sapiens
HTLFQTCIS

SEQ ID NO: 383295 - protein, 9 aa, Homo Sapiens
KLTLEYFIQ

SEQ ID NO: 383296 - protein, 9 aa, Homo Sapiens
QKNLGGQDI

SEQ ID NO: 383297 - protein, 9 aa, Homo Sapiens
KKATVDEVI

SEQ ID NO: 383298 - protein, 9 aa, Homo Sapiens
YIKQKWQMF

SEQ ID NO: 383299 - protein, 9 aa, Homo Sapiens
ISNYHWPSL

SEQ ID NO: 383300 - protein, 9 aa, Homo Sapiens
CQHCYHQFS

SEQ ID NO: 383301 - protein, 9 aa, Homo Sapiens
LSSDSDSDK

SEQ ID NO: 383302 - protein, 9 aa, Homo Sapiens
KAEVTKRKE

SEQ ID NO: 383303 - protein, 9 aa, Homo Sapiens
KHDQQLADH

SEQ ID NO: 383304 - protein, 9 aa, Homo Sapiens
NQNGYRGHD

SEQ ID NO: 383305 - protein, 9 aa, Homo Sapiens
GKDTIVFTK

SEQ ID NO: 383306 - protein, 9 aa, Homo Sapiens
SLNYYTNGA

SEQ ID NO: 383307 - protein, 9 aa, Homo Sapiens
CVKLSSPKS

SEQ ID NO: 383308 - protein, 9 aa, Homo Sapiens
RITTLCLMF

SEQ ID NO: 383309 - protein, 9 aa, Homo Sapiens
PKEIWLSKN

SEQ ID NO: 383310 - protein, 9 aa, Homo Sapiens
LERWKIKII

SEQ ID NO: 383311 - protein, 9 aa, Homo Sapiens
KSKLQIWDT

SEQ ID NO: 383312 - protein, 9 aa, Homo Sapiens
SKVLGRLKA

SEQ ID NO: 383313 - protein, 9 aa, Homo Sapiens
MEKRNYRKA

SEQ ID NO: 383314 - protein, 9 aa, Homo Sapiens
LPVLYRSGI

SEQ ID NO: 383315 - protein, 9 aa, Homo Sapiens
APSRGKDDG

SEQ ID NO: 383316 - protein, 9 aa, Homo Sapiens
SRHRAIIQL

SEQ ID NO: 383317 - protein, 9 aa, Homo Sapiens
VQFQNQGSE

SEQ ID NO: 383318 - protein, 9 aa, Homo Sapiens
LFEYYIYWT

SEQ ID NO: 383319 - protein, 9 aa, Homo Sapiens
CKPLLKCSS

SEQ ID NO: 383320 - protein, 9 aa, Homo Sapiens
NIDYSHFHK

SEQ ID NO: 383321 - protein, 9 aa, Homo Sapiens
EVIPDSKSL

SEQ ID NO: 383322 - protein, 9 aa, Homo Sapiens
YSHIIVGLE

SEQ ID NO: 383323 - protein, 9 aa, Homo Sapiens
SVVDFSKWY

SEQ ID NO: 383324 - protein, 9 aa, Homo Sapiens
LSLSPRWGR

SEQ ID NO: 383325 - protein, 9 aa, Homo Sapiens
TSSCPKQNA

SEQ ID NO: 383326 - protein, 9 aa, Homo Sapiens
LSQLTRHKK

SEQ ID NO: 383327 - protein, 9 aa, Homo Sapiens
SKLFEQYEV

SEQ ID NO: 383328 - protein, 9 aa, Homo Sapiens
KRQHSPRHT

SEQ ID NO: 383329 - protein, 9 aa, Homo Sapiens
YRGHDHEYT

SEQ ID NO: 383330 - protein, 9 aa, Homo Sapiens
FVEFQVCDH

SEQ ID NO: 383331 - protein, 9 aa, Homo Sapiens
TQKDIALLK

SEQ ID NO: 383332 - protein, 9 aa, Homo Sapiens
GDQHYYSFD

SEQ ID NO: 383333 - protein, 9 aa, Homo Sapiens
KELTQNDWI

SEQ ID NO: 383334 - protein, 9 aa, Homo Sapiens
VGSDCGFLA

SEQ ID NO: 383335 - protein, 9 aa, Homo Sapiens
EWRFQGLAP

SEQ ID NO: 383336 - protein, 9 aa, Homo Sapiens
LLVGRLEGT

SEQ ID NO: 383337 - protein, 9 aa, Homo Sapiens
NVLKKIAKA

SEQ ID NO: 383338 - protein, 9 aa, Homo Sapiens
EIRAKGPID

SEQ ID NO: 383339 - protein, 9 aa, Homo Sapiens
RETNNLSPK

SEQ ID NO: 383340 - protein, 9 aa, Homo Sapiens
EVQLRWTRD

SEQ ID NO: 383341 - protein, 9 aa, Homo Sapiens
FPAREFLRN

SEQ ID NO: 383342 - protein, 9 aa, Homo Sapiens
YVWTLVVPL

SEQ ID NO: 383343 - protein, 9 aa, Homo Sapiens
TKIDDTKVF

SEQ ID NO: 383344 - protein, 9 aa, Homo Sapiens
RVPGPSQSF

SEQ ID NO: 383345 - protein, 9 aa, Homo Sapiens
EWFEPQINA

SEQ ID NO: 383346 - protein, 9 aa, Homo Sapiens
PVTGEPGQL

SEQ ID NO: 383347 - protein, 9 aa, Homo Sapiens
GWKNSICHN

SEQ ID NO: 383348 - protein, 9 aa, Homo Sapiens
QIPTGQLTM

SEQ ID NO: 383349 - protein, 9 aa, Homo Sapiens
MRHRIIHTG

SEQ ID NO: 383350 - protein, 9 aa, Homo Sapiens
TQAFNIGAL

SEQ ID NO: 383351 - protein, 9 aa, Homo Sapiens
RGPQDFNYF

SEQ ID NO: 383352 - protein, 9 aa, Homo Sapiens
LVKKIDDAE

SEQ ID NO: 383353 - protein, 9 aa, Homo Sapiens
WVVGAETAF

SEQ ID NO: 383354 - protein, 9 aa, Homo Sapiens
KEQPYTCKE

SEQ ID NO: 383355 - protein, 9 aa, Homo Sapiens
LKGHWWKKG

SEQ ID NO: 383356 - protein, 9 aa, Homo Sapiens
TGNHASMIQ

SEQ ID NO: 383357 - protein, 9 aa, Homo Sapiens
RNNPTKRFR

SEQ ID NO: 383358 - protein, 9 aa, Homo Sapiens
ASFQDWGPE

SEQ ID NO: 383359 - protein, 9 aa, Homo Sapiens
IFNEDCQTS

SEQ ID NO: 383360 - protein, 9 aa, Homo Sapiens
FRTPLAFVQ

SEQ ID NO: 383361 - protein, 9 aa, Homo Sapiens
TPETIMCYK

SEQ ID NO: 383362 - protein, 9 aa, Homo Sapiens
AVMFFIVLF

SEQ ID NO: 383363 - protein, 9 aa, Homo Sapiens
PAQKKPPSS

SEQ ID NO: 383364 - protein, 9 aa, Homo Sapiens
PREKQFNLC

SEQ ID NO: 383365 - protein, 9 aa, Homo Sapiens
MLRPTICER

SEQ ID NO: 383366 - protein, 9 aa, Homo Sapiens
PHTVKQAPS

SEQ ID NO: 383367 - protein, 9 aa, Homo Sapiens
TVYFKRFYT

SEQ ID NO: 383368 - protein, 9 aa, Homo Sapiens
LTENVLKKI

SEQ ID NO: 383369 - protein, 9 aa, Homo Sapiens
RQHISVIKE

SEQ ID NO: 383370 - protein, 9 aa, Homo Sapiens
CIVELTLPR

SEQ ID NO: 383371 - protein, 9 aa, Homo Sapiens
KGVNGKYII

SEQ ID NO: 383372 - protein, 9 aa, Homo Sapiens
SSVACPCHT

SEQ ID NO: 383373 - protein, 9 aa, Homo Sapiens
CINSVAFKF

SEQ ID NO: 383374 - protein, 9 aa, Homo Sapiens
AHATRIPLG

SEQ ID NO: 383375 - protein, 9 aa, Homo Sapiens
RALVEDPQL

SEQ ID NO: 383376 - protein, 9 aa, Homo Sapiens
LTPPVRGRA

SEQ ID NO: 383377 - protein, 9 aa, Homo Sapiens
INDTFEDTE

SEQ ID NO: 383378 - protein, 9 aa, Homo Sapiens
EEGYWLPPP

SEQ ID NO: 383379 - protein, 9 aa, Homo Sapiens
FQTFSKKFL

SEQ ID NO: 383380 - protein, 9 aa, Homo Sapiens
KNKLELAWE

SEQ ID NO: 383381 - protein, 9 aa, Homo Sapiens
CRSIQIGKI

SEQ ID NO: 383382 - protein, 9 aa, Homo Sapiens
QWILFFILG

SEQ ID NO: 383383 - protein, 9 aa, Homo Sapiens
AIKLFDILD

SEQ ID NO: 383384 - protein, 9 aa, Homo Sapiens
KVCELQLPN

SEQ ID NO: 383385 - protein, 9 aa, Homo Sapiens
FGLGGVGLP

SEQ ID NO: 383386 - protein, 9 aa, Homo Sapiens
GNTSTDHFN

SEQ ID NO: 383387 - protein, 9 aa, Homo Sapiens
INNLYATQM

SEQ ID NO: 383388 - protein, 9 aa, Homo Sapiens
PLRFVEFQV

SEQ ID NO: 383389 - protein, 9 aa, Homo Sapiens
YLGDIDSEK

SEQ ID NO: 383390 - protein, 9 aa, Homo Sapiens
SQQKNSGFW

SEQ ID NO: 383391 - protein, 9 aa, Homo Sapiens
INKIVGQLM

SEQ ID NO: 383392 - protein, 9 aa, Homo Sapiens
HGRNLAEVV

SEQ ID NO: 383393 - protein, 9 aa, Homo Sapiens
RICFLLQKL

SEQ ID NO: 383394 - protein, 9 aa, Homo Sapiens
FITHQQIHL

SEQ ID NO: 383395 - protein, 9 aa, Homo Sapiens
GPFSNYVEL

SEQ ID NO: 383396 - protein, 9 aa, Homo Sapiens
WVTPIFKTN

SEQ ID NO: 383397 - protein, 9 aa, Homo Sapiens
FFFFFPFFF

SEQ ID NO: 383398 - protein, 9 aa, Homo Sapiens
DLFQHHPDK

SEQ ID NO: 383399 - protein, 9 aa, Homo Sapiens
GKSFYSSNL

SEQ ID NO: 383400 - protein, 9 aa, Homo Sapiens
RTGKYVHFT

SEQ ID NO: 383401 - protein, 9 aa, Homo Sapiens
CSSNTLKGQ

SEQ ID NO: 383402 - protein, 9 aa, Homo Sapiens
LSTGFPKRS

SEQ ID NO: 383403 - protein, 9 aa, Homo Sapiens
VSIEKEKSD

SEQ ID NO: 383404 - protein, 9 aa, Homo Sapiens
NWMAALIYL

SEQ ID NO: 383405 - protein, 9 aa, Homo Sapiens
KAGDKVKVG

SEQ ID NO: 383406 - protein, 9 aa, Homo Sapiens
LHTEVRWLS

SEQ ID NO: 383407 - protein, 9 aa, Homo Sapiens
KGQDEKDLE

SEQ ID NO: 383408 - protein, 9 aa, Homo Sapiens
SNIQQRMSR

SEQ ID NO: 383409 - protein, 9 aa, Homo Sapiens
SYGRHGSGF

SEQ ID NO: 383410 - protein, 9 aa, Homo Sapiens
PKMLDKEGR

SEQ ID NO: 383411 - protein, 9 aa, Homo Sapiens
DNSLEICKF

SEQ ID NO: 383412 - protein, 9 aa, Homo Sapiens
VKALAFLMT

SEQ ID NO: 383413 - protein, 9 aa, Homo Sapiens
SREELNLMT

SEQ ID NO: 383414 - protein, 9 aa, Homo Sapiens
ALEASFSSS

SEQ ID NO: 383415 - protein, 9 aa, Homo Sapiens
VMLDTYSNL

SEQ ID NO: 383416 - protein, 9 aa, Homo Sapiens
YQLVAFDPE

SEQ ID NO: 383417 - protein, 9 aa, Homo Sapiens
CGAFSYRRY

SEQ ID NO: 383418 - protein, 9 aa, Homo Sapiens
QLKHGDFHF

SEQ ID NO: 383419 - protein, 9 aa, Homo Sapiens
KDKFMKCLH

SEQ ID NO: 383420 - protein, 9 aa, Homo Sapiens
ALTLFEYYI

SEQ ID NO: 383421 - protein, 9 aa, Homo Sapiens
VVLMSASND

SEQ ID NO: 383422 - protein, 9 aa, Homo Sapiens
EFVNVEFLS

SEQ ID NO: 383423 - protein, 9 aa, Homo Sapiens
SQRILHGDV

SEQ ID NO: 383424 - protein, 9 aa, Homo Sapiens
RARRDNLQR

SEQ ID NO: 383425 - protein, 9 aa, Homo Sapiens
LQFIFQTDT

SEQ ID NO: 383426 - protein, 9 aa, Homo Sapiens
LIYLHYRST

SEQ ID NO: 383427 - protein, 9 aa, Homo Sapiens
CRYIYYGKN

SEQ ID NO: 383428 - protein, 9 aa, Homo Sapiens
EKAEVTKRK

SEQ ID NO: 383429 - protein, 9 aa, Homo Sapiens
DLMEAVFKF

SEQ ID NO: 383430 - protein, 9 aa, Homo Sapiens
RLLEEKVCA

SEQ ID NO: 383431 - protein, 9 aa, Homo Sapiens
IFKTNDGKR

SEQ ID NO: 383432 - protein, 9 aa, Homo Sapiens
LVDPAAIPP

SEQ ID NO: 383433 - protein, 9 aa, Homo Sapiens
QLKCLAFQN

SEQ ID NO: 383434 - protein, 9 aa, Homo Sapiens
DKLGFLVAK

SEQ ID NO: 383435 - protein, 9 aa, Homo Sapiens
FFCKIPPLL

SEQ ID NO: 383436 - protein, 9 aa, Homo Sapiens
TLQTRQPVS

SEQ ID NO: 383437 - protein, 9 aa, Homo Sapiens
HISRETFQQ

SEQ ID NO: 383438 - protein, 9 aa, Homo Sapiens
ERTGKYVHF

SEQ ID NO: 383439 - protein, 9 aa, Homo Sapiens
YFSDHYTHF

SEQ ID NO: 383440 - protein, 9 aa, Homo Sapiens
TLCIIEPIM

SEQ ID NO: 383441 - protein, 9 aa, Homo Sapiens
RLKALSDTT

SEQ ID NO: 383442 - protein, 9 aa, Homo Sapiens
QHYYSFDGL

SEQ ID NO: 383443 - protein, 9 aa, Homo Sapiens
EVVDGEVRK

SEQ ID NO: 383444 - protein, 9 aa, Homo Sapiens
ICSLEGLME

SEQ ID NO: 383445 - protein, 9 aa, Homo Sapiens
KIIKDSEFE

SEQ ID NO: 383446 - protein, 9 aa, Homo Sapiens
DFNYFVLEQ

SEQ ID NO: 383447 - protein, 9 aa, Homo Sapiens
EITIHSLHD

SEQ ID NO: 383448 - protein, 9 aa, Homo Sapiens
QKTVNKLPA

SEQ ID NO: 383449 - protein, 9 aa, Homo Sapiens
ITLHRLRMV

SEQ ID NO: 383450 - protein, 9 aa, Homo Sapiens
QRMSRPLMN

SEQ ID NO: 383451 - protein, 9 aa, Homo Sapiens
PAGSKLCLV

SEQ ID NO: 383452 - protein, 9 aa, Homo Sapiens
ADAKIIPSI

SEQ ID NO: 383453 - protein, 9 aa, Homo Sapiens
ATCDEYFTQ

SEQ ID NO: 383454 - protein, 9 aa, Homo Sapiens
KKDGELSVP

SEQ ID NO: 383455 - protein, 9 aa, Homo Sapiens
LSFLSLTGI

SEQ ID NO: 383456 - protein, 9 aa, Homo Sapiens
QKKVKTPIN

SEQ ID NO: 383457 - protein, 9 aa, Homo Sapiens
KLQMDLERA

SEQ ID NO: 383458 - protein, 9 aa, Homo Sapiens
QFADMEKLQ

SEQ ID NO: 383459 - protein, 9 aa, Homo Sapiens
ACTYKELRN

SEQ ID NO: 383460 - protein, 9 aa, Homo Sapiens
LSLPLSLIF

SEQ ID NO: 383461 - protein, 9 aa, Homo Sapiens
FRYFCMEKL

SEQ ID NO: 383462 - protein, 9 aa, Homo Sapiens
GDSIVTETY

SEQ ID NO: 383463 - protein, 9 aa, Homo Sapiens
KITKIDLSV

SEQ ID NO: 383464 - protein, 9 aa, Homo Sapiens
LMAEECTTI

SEQ ID NO: 383465 - protein, 9 aa, Homo Sapiens
TSFLIDELT

SEQ ID NO: 383466 - protein, 9 aa, Homo Sapiens
GICFSGRAG

SEQ ID NO: 383467 - protein, 9 aa, Homo Sapiens
TRYSLKSID

SEQ ID NO: 383468 - protein, 9 aa, Homo Sapiens
NLPCNHFTI

SEQ ID NO: 383469 - protein, 9 aa, Homo Sapiens
RLNSELRNM

SEQ ID NO: 383470 - protein, 9 aa, Homo Sapiens
THFLLGVSM

SEQ ID NO: 383471 - protein, 9 aa, Homo Sapiens
MGKPVIGEN

SEQ ID NO: 383472 - protein, 9 aa, Homo Sapiens
TLVVPLVLT

SEQ ID NO: 383473 - protein, 9 aa, Homo Sapiens
VYHQINHTG

SEQ ID NO: 383474 - protein, 9 aa, Homo Sapiens
AVTSSGTAP

SEQ ID NO: 383475 - protein, 9 aa, Homo Sapiens
NHFTISGNE

SEQ ID NO: 383476 - protein, 9 aa, Homo Sapiens
WQNHKDSRC

SEQ ID NO: 383477 - protein, 9 aa, Homo Sapiens
SHLWGHQIT

SEQ ID NO: 383478 - protein, 9 aa, Homo Sapiens
VRRPMCKSF

SEQ ID NO: 383479 - protein, 9 aa, Homo Sapiens
GLHAESPDY

SEQ ID NO: 383480 - protein, 9 aa, Homo Sapiens
SIPHYLGGG

SEQ ID NO: 383481 - protein, 9 aa, Homo Sapiens
ADNQRVEAP

SEQ ID NO: 383482 - protein, 9 aa, Homo Sapiens
LGQPPGVWS

SEQ ID NO: 383483 - protein, 9 aa, Homo Sapiens
ITTKPTDDT

SEQ ID NO: 383484 - protein, 9 aa, Homo Sapiens
SGISTSAPT

SEQ ID NO: 383485 - protein, 9 aa, Homo Sapiens
ESNTGDEES

SEQ ID NO: 383486 - protein, 9 aa, Homo Sapiens
REYCQAIFQ

SEQ ID NO: 383487 - protein, 9 aa, Homo Sapiens
GSAKHRLNP

SEQ ID NO: 383488 - protein, 9 aa, Homo Sapiens
TCSIPHYLG

SEQ ID NO: 383489 - protein, 9 aa, Homo Sapiens
EADTILKDA

SEQ ID NO: 383490 - protein, 9 aa, Homo Sapiens
KMSKRKNNY

SEQ ID NO: 383491 - protein, 9 aa, Homo Sapiens
KAREKKALF

SEQ ID NO: 383492 - protein, 9 aa, Homo Sapiens
QTAIIKVVS

SEQ ID NO: 383493 - protein, 9 aa, Homo Sapiens
NYFVLEQHE

SEQ ID NO: 383494 - protein, 9 aa, Homo Sapiens
ACPCHTQTL

SEQ ID NO: 383495 - protein, 9 aa, Homo Sapiens
RLSILSGFS

SEQ ID NO: 383496 - protein, 9 aa, Homo Sapiens
FNLIDDISG

SEQ ID NO: 383497 - protein, 9 aa, Homo Sapiens
IGENCRLEV

SEQ ID NO: 383498 - protein, 9 aa, Homo Sapiens
SSKELMSCH

SEQ ID NO: 383499 - protein, 9 aa, Homo Sapiens
CRKHEITHT

SEQ ID NO: 383500 - protein, 9 aa, Homo Sapiens
CVFLHINRF

SEQ ID NO: 383501 - protein, 9 aa, Homo Sapiens
STSSESKPS

SEQ ID NO: 383502 - protein, 9 aa, Homo Sapiens
FLLQKLVLP

SEQ ID NO: 383503 - protein, 9 aa, Homo Sapiens
EIFEDAKLV

SEQ ID NO: 383504 - protein, 9 aa, Homo Sapiens
HIKIQQRNG

SEQ ID NO: 383505 - protein, 9 aa, Homo Sapiens
SVGKAKGEG

SEQ ID NO: 383506 - protein, 9 aa, Homo Sapiens
CPGMGNSHS

SEQ ID NO: 383507 - protein, 9 aa, Homo Sapiens
LKHGDFHFT

SEQ ID NO: 383508 - protein, 9 aa, Homo Sapiens
WSSHKSIAT

SEQ ID NO: 383509 - protein, 9 aa, Homo Sapiens
CVDTYVMGL

SEQ ID NO: 383510 - protein, 9 aa, Homo Sapiens
LPLLAFAYT

SEQ ID NO: 383511 - protein, 9 aa, Homo Sapiens
EDEDDGLFV

SEQ ID NO: 383512 - protein, 9 aa, Homo Sapiens
DTRPYPCQL

SEQ ID NO: 383513 - protein, 9 aa, Homo Sapiens
TYSLAKDTF

SEQ ID NO: 383514 - protein, 9 aa, Homo Sapiens
FHVETKLFH

SEQ ID NO: 383515 - protein, 9 aa, Homo Sapiens
LLSSEELDQ

SEQ ID NO: 383516 - protein, 9 aa, Homo Sapiens
SQKKKQNNG

SEQ ID NO: 383517 - protein, 9 aa, Homo Sapiens
QEMLFHGGS

SEQ ID NO: 383518 - protein, 9 aa, Homo Sapiens
EKPQGNYSA

SEQ ID NO: 383519 - protein, 9 aa, Homo Sapiens
SPIHLALSM

SEQ ID NO: 383520 - protein, 9 aa, Homo Sapiens
SITGTRVVT

SEQ ID NO: 383521 - protein, 9 aa, Homo Sapiens
KQLTYEEQN

SEQ ID NO: 383522 - protein, 9 aa, Homo Sapiens
MAAENGQAN

SEQ ID NO: 383523 - protein, 9 aa, Homo Sapiens
YSLHSTTMM

SEQ ID NO: 383524 - protein, 9 aa, Homo Sapiens
HHYKCPGMG

SEQ ID NO: 383525 - protein, 9 aa, Homo Sapiens
SDTIKNVKA

SEQ ID NO: 383526 - protein, 9 aa, Homo Sapiens
SFTQCCVNP

SEQ ID NO: 383527 - protein, 9 aa, Homo Sapiens
IITMIPTDE

SEQ ID NO: 383528 - protein, 9 aa, Homo Sapiens
LVQLNNLNM

SEQ ID NO: 383529 - protein, 9 aa, Homo Sapiens
LDKEGRLFV

SEQ ID NO: 383530 - protein, 9 aa, Homo Sapiens
QNEKEELVL

SEQ ID NO: 383531 - protein, 9 aa, Homo Sapiens
CYVELETII

SEQ ID NO: 383532 - protein, 9 aa, Homo Sapiens
EYVIFNEDC

SEQ ID NO: 383533 - protein, 9 aa, Homo Sapiens
PLQKVEVPA

SEQ ID NO: 383534 - protein, 9 aa, Homo Sapiens
EVICPEMLH

SEQ ID NO: 383535 - protein, 9 aa, Homo Sapiens
GATAPATPT

SEQ ID NO: 383536 - protein, 9 aa, Homo Sapiens
FRSEENSEY

SEQ ID NO: 383537 - protein, 9 aa, Homo Sapiens
ALWHHYKCP

SEQ ID NO: 383538 - protein, 9 aa, Homo Sapiens
LMEHKIIHT

SEQ ID NO: 383539 - protein, 9 aa, Homo Sapiens
IITFSYGNH

SEQ ID NO: 383540 - protein, 9 aa, Homo Sapiens
KISEKKMAT

SEQ ID NO: 383541 - protein, 9 aa, Homo Sapiens
ADEYEETKK

SEQ ID NO: 383542 - protein, 9 aa, Homo Sapiens
HRILILGKL

SEQ ID NO: 383543 - protein, 9 aa, Homo Sapiens
SLPRNPTYQ

SEQ ID NO: 383544 - protein, 9 aa, Homo Sapiens
DYHGSAFEY

SEQ ID NO: 383545 - protein, 9 aa, Homo Sapiens
PTKEPTVTS

SEQ ID NO: 383546 - protein, 9 aa, Homo Sapiens
ETIKCHTLF

SEQ ID NO: 383547 - protein, 9 aa, Homo Sapiens
KVKTPINKQ

SEQ ID NO: 383548 - protein, 9 aa, Homo Sapiens
ELTQNDWIT

SEQ ID NO: 383549 - protein, 9 aa, Homo Sapiens
LGALGLLAS

SEQ ID NO: 383550 - protein, 9 aa, Homo Sapiens
LEDGKVPQH

SEQ ID NO: 383551 - protein, 9 aa, Homo Sapiens
IHINFDVNG

SEQ ID NO: 383552 - protein, 9 aa, Homo Sapiens
INFTLWRQS

SEQ ID NO: 383553 - protein, 9 aa, Homo Sapiens
PGIEWSNVT

SEQ ID NO: 383554 - protein, 9 aa, Homo Sapiens
IQSGIAYIL

SEQ ID NO: 383555 - protein, 9 aa, Homo Sapiens
PNSVFQCVQ

SEQ ID NO: 383556 - protein, 9 aa, Homo Sapiens
TAISYVHIL

SEQ ID NO: 383557 - protein, 9 aa, Homo Sapiens
ELQHRILIL

SEQ ID NO: 383558 - protein, 9 aa, Homo Sapiens
RHRAIIQLP

SEQ ID NO: 383559 - protein, 9 aa, Homo Sapiens
TQNNVTEIQ

SEQ ID NO: 383560 - protein, 9 aa, Homo Sapiens
FDTSFNLII

SEQ ID NO: 383561 - protein, 9 aa, Homo Sapiens
PFTSQDIQH

SEQ ID NO: 383562 - protein, 9 aa, Homo Sapiens
QSHLSRHQI

SEQ ID NO: 383563 - protein, 9 aa, Homo Sapiens
HDHEYTDHP

SEQ ID NO: 383564 - protein, 9 aa, Homo Sapiens
ADQAVNEWG

SEQ ID NO: 383565 - protein, 9 aa, Homo Sapiens
GVYDDGLDE

SEQ ID NO: 383566 - protein, 9 aa, Homo Sapiens
RRGKAGLWG

SEQ ID NO: 383567 - protein, 9 aa, Homo Sapiens
DGTNRWFDT

SEQ ID NO: 383568 - protein, 9 aa, Homo Sapiens
GRNLAEVVL

SEQ ID NO: 383569 - protein, 9 aa, Homo Sapiens
LLQIQTLFQ

SEQ ID NO: 383570 - protein, 9 aa, Homo Sapiens
SFNTDKNID

SEQ ID NO: 383571 - protein, 9 aa, Homo Sapiens
VFAHLPQGV

SEQ ID NO: 383572 - protein, 9 aa, Homo Sapiens
EKDLEFLKR

SEQ ID NO: 383573 - protein, 9 aa, Homo Sapiens
LMVRLTWAS

SEQ ID NO: 383574 - protein, 9 aa, Homo Sapiens
ATLSNIDIQ

SEQ ID NO: 383575 - protein, 9 aa, Homo Sapiens
TTGIWKQWH

SEQ ID NO: 383576 - protein, 9 aa, Homo Sapiens
MDNLLRGDN

SEQ ID NO: 383577 - protein, 9 aa, Homo Sapiens
DADLNEWTN

SEQ ID NO: 383578 - protein, 9 aa, Homo Sapiens
RSGKMWALS

SEQ ID NO: 383579 - protein, 9 aa, Homo Sapiens
GHQITHTGE

SEQ ID NO: 383580 - protein, 9 aa, Homo Sapiens
RSQINYLVQ

SEQ ID NO: 383581 - protein, 9 aa, Homo Sapiens
KEGWVPASY

SEQ ID NO: 383582 - protein, 9 aa, Homo Sapiens
CKFSLYLER

SEQ ID NO: 383583 - protein, 9 aa, Homo Sapiens
ETFAGLDCP

SEQ ID NO: 383584 - protein, 9 aa, Homo Sapiens
PMEAAKVQI

SEQ ID NO: 383585 - protein, 9 aa, Homo Sapiens
ELSVVTSEI

SEQ ID NO: 383586 - protein, 9 aa, Homo Sapiens
CERRIRFWR

SEQ ID NO: 383587 - protein, 9 aa, Homo Sapiens
PTSGYHAKN

SEQ ID NO: 383588 - protein, 9 aa, Homo Sapiens
RDCCRSIQI

SEQ ID NO: 383589 - protein, 9 aa, Homo Sapiens
MFTSQSAAS

SEQ ID NO: 383590 - protein, 9 aa, Homo Sapiens
FYIRPILSR

SEQ ID NO: 383591 - protein, 9 aa, Homo Sapiens
AFNHSSHLT

SEQ ID NO: 383592 - protein, 9 aa, Homo Sapiens
LGLSQSCNQ

SEQ ID NO: 383593 - protein, 9 aa, Homo Sapiens
DIRGISSNQ

SEQ ID NO: 383594 - protein, 9 aa, Homo Sapiens
GLRNHQRTH

SEQ ID NO: 383595 - protein, 9 aa, Homo Sapiens
PIDILSEEI

SEQ ID NO: 383596 - protein, 9 aa, Homo Sapiens
LFFILGLAL

SEQ ID NO: 383597 - protein, 9 aa, Homo Sapiens
PGMGNSHSG

SEQ ID NO: 383598 - protein, 9 aa, Homo Sapiens
HINFMKTSD

SEQ ID NO: 383599 - protein, 9 aa, Homo Sapiens
PGLGGSPGL

SEQ ID NO: 383600 - protein, 9 aa, Homo Sapiens
PSINMSLES

SEQ ID NO: 383601 - protein, 9 aa, Homo Sapiens
EANKLASAS

SEQ ID NO: 383602 - protein, 9 aa, Homo Sapiens
KTFNWPIYL

SEQ ID NO: 383603 - protein, 9 aa, Homo Sapiens
CANYASIRR

SEQ ID NO: 383604 - protein, 9 aa, Homo Sapiens
SDDLGCRRG

SEQ ID NO: 383605 - protein, 9 aa, Homo Sapiens
WNTFLQHSE

SEQ ID NO: 383606 - protein, 9 aa, Homo Sapiens
GNFFLSQEE

SEQ ID NO: 383607 - protein, 9 aa, Homo Sapiens
GINLVMAVL

SEQ ID NO: 383608 - protein, 9 aa, Homo Sapiens
SPPNLKEEG

SEQ ID NO: 383609 - protein, 9 aa, Homo Sapiens
DQTYCSKME

SEQ ID NO: 383610 - protein, 9 aa, Homo Sapiens
YLHSQRILH

SEQ ID NO: 383611 - protein, 9 aa, Homo Sapiens
FNSNLPSEP

SEQ ID NO: 383612 - protein, 9 aa, Homo Sapiens
QGLAYLYSH

SEQ ID NO: 383613 - protein, 9 aa, Homo Sapiens
NRLFDNVTN

SEQ ID NO: 383614 - protein, 9 aa, Homo Sapiens
EEDNESSEQ

SEQ ID NO: 383615 - protein, 9 aa, Homo Sapiens
HVEESTPMG

SEQ ID NO: 383616 - protein, 9 aa, Homo Sapiens
DSISKNFPN

SEQ ID NO: 383617 - protein, 9 aa, Homo Sapiens
RKHEITHTI

SEQ ID NO: 383618 - protein, 9 aa, Homo Sapiens
YEPEVQYQI

SEQ ID NO: 383619 - protein, 9 aa, Homo Sapiens
FSGDGGYVK

SEQ ID NO: 383620 - protein, 9 aa, Homo Sapiens
AWYFPSEPV

SEQ ID NO: 383621 - protein, 9 aa, Homo Sapiens
ATITHSVCE

SEQ ID NO: 383622 - protein, 9 aa, Homo Sapiens
CSILQIHTS

SEQ ID NO: 383623 - protein, 9 aa, Homo Sapiens
VLVQLCQIK

SEQ ID NO: 383624 - protein, 9 aa, Homo Sapiens
DGRPELCWP

SEQ ID NO: 383625 - protein, 9 aa, Homo Sapiens
HNYTGGEPK

SEQ ID NO: 383626 - protein, 9 aa, Homo Sapiens
GAVPPPPRL

SEQ ID NO: 383627 - protein, 9 aa, Homo Sapiens
EYLHSQRIL

SEQ ID NO: 383628 - protein, 9 aa, Homo Sapiens
NILLITEDL

SEQ ID NO: 383629 - protein, 9 aa, Homo Sapiens
QISEVTAQP

SEQ ID NO: 383630 - protein, 9 aa, Homo Sapiens
PAIPSIIWY

SEQ ID NO: 383631 - protein, 9 aa, Homo Sapiens
TTVIWEKLT

SEQ ID NO: 383632 - protein, 9 aa, Homo Sapiens
LAQDQNGTL

SEQ ID NO: 383633 - protein, 9 aa, Homo Sapiens
ASQEERHTL

SEQ ID NO: 383634 - protein, 9 aa, Homo Sapiens
VPCRDLGFN

SEQ ID NO: 383635 - protein, 9 aa, Homo Sapiens
AAFLVSLMP

SEQ ID NO: 383636 - protein, 9 aa, Homo Sapiens
ILQLRHTNS

SEQ ID NO: 383637 - protein, 9 aa, Homo Sapiens
ALLTKTNQI

SEQ ID NO: 383638 - protein, 9 aa, Homo Sapiens
ANKAKREEK

SEQ ID NO: 383639 - protein, 9 aa, Homo Sapiens
LAIHIQNHT

SEQ ID NO: 383640 - protein, 9 aa, Homo Sapiens
PEPERLREE

SEQ ID NO: 383641 - protein, 9 aa, Homo Sapiens
ETYFQMLPI

SEQ ID NO: 383642 - protein, 9 aa, Homo Sapiens
ILFIKIFII

SEQ ID NO: 383643 - protein, 9 aa, Homo Sapiens
EADWFISAN

SEQ ID NO: 383644 - protein, 9 aa, Homo Sapiens
RVSPYSYLT

SEQ ID NO: 383645 - protein, 9 aa, Homo Sapiens
QWAINMNKF

SEQ ID NO: 383646 - protein, 9 aa, Homo Sapiens
HIEDLQKNV

SEQ ID NO: 383647 - protein, 9 aa, Homo Sapiens
LSIFLGSYH

SEQ ID NO: 383648 - protein, 9 aa, Homo Sapiens
EKLFQLSEM

SEQ ID NO: 383649 - protein, 9 aa, Homo Sapiens
KCDPEKLEE

SEQ ID NO: 383650 - protein, 9 aa, Homo Sapiens
EELQHRILI

SEQ ID NO: 383651 - protein, 9 aa, Homo Sapiens
GTLPRTIIQ

SEQ ID NO: 383652 - protein, 9 aa, Homo Sapiens
FADEDINTR

SEQ ID NO: 383653 - protein, 9 aa, Homo Sapiens
DYLYTHTAC

SEQ ID NO: 383654 - protein, 9 aa, Homo Sapiens
EPKSGTFPR

SEQ ID NO: 383655 - protein, 9 aa, Homo Sapiens
SRLEEPVGP

SEQ ID NO: 383656 - protein, 9 aa, Homo Sapiens
ITGLCIVEL

SEQ ID NO: 383657 - protein, 9 aa, Homo Sapiens
FAGLDCPAA

SEQ ID NO: 383658 - protein, 9 aa, Homo Sapiens
IAVWGRAKA

SEQ ID NO: 383659 - protein, 9 aa, Homo Sapiens
ELFLPVLYR

SEQ ID NO: 383660 - protein, 9 aa, Homo Sapiens
PDDLTSNDT

SEQ ID NO: 383661 - protein, 9 aa, Homo Sapiens
SKRAPTHQQ

SEQ ID NO: 383662 - protein, 9 aa, Homo Sapiens
PNRNDLLNT

SEQ ID NO: 383663 - protein, 9 aa, Homo Sapiens
KIAEENLAY

SEQ ID NO: 383664 - protein, 9 aa, Homo Sapiens
HIGLNQHRI

SEQ ID NO: 383665 - protein, 9 aa, Homo Sapiens
QWSQSRRSV

SEQ ID NO: 383666 - protein, 9 aa, Homo Sapiens
HHIIHSGEK

SEQ ID NO: 383667 - protein, 9 aa, Homo Sapiens
QKELDTLSG

SEQ ID NO: 383668 - protein, 9 aa, Homo Sapiens
VDVGGTNQE

SEQ ID NO: 383669 - protein, 9 aa, Homo Sapiens
FCEITQHQF

SEQ ID NO: 383670 - protein, 9 aa, Homo Sapiens
SRYVEMKYL

SEQ ID NO: 383671 - protein, 9 aa, Homo Sapiens
VHKIIHTGE

SEQ ID NO: 383672 - protein, 9 aa, Homo Sapiens
QKMSKRKNN

SEQ ID NO: 383673 - protein, 9 aa, Homo Sapiens
QLVPDINME

SEQ ID NO: 383674 - protein, 9 aa, Homo Sapiens
LNYFVIPSE

SEQ ID NO: 383675 - protein, 9 aa, Homo Sapiens
NDYWKLSMQ

SEQ ID NO: 383676 - protein, 9 aa, Homo Sapiens
TPINNLYAT

SEQ ID NO: 383677 - protein, 9 aa, Homo Sapiens
SSVARSWKT

SEQ ID NO: 383678 - protein, 9 aa, Homo Sapiens
EGSDIVVAG

SEQ ID NO: 383679 - protein, 9 aa, Homo Sapiens
IKLDFLSGI

SEQ ID NO: 383680 - protein, 9 aa, Homo Sapiens
GKGYETGHH

SEQ ID NO: 383681 - protein, 9 aa, Homo Sapiens
ENKKEPEPN

SEQ ID NO: 383682 - protein, 9 aa, Homo Sapiens
SEEKVGIPA

SEQ ID NO: 383683 - protein, 9 aa, Homo Sapiens
QLVAFDPEG

SEQ ID NO: 383684 - protein, 9 aa, Homo Sapiens
GSLCSGFIK

SEQ ID NO: 383685 - protein, 9 aa, Homo Sapiens
APWAWRNQG

SEQ ID NO: 383686 - protein, 9 aa, Homo Sapiens
VPGGKCPVD

SEQ ID NO: 383687 - protein, 9 aa, Homo Sapiens
DTSFNLIIA

SEQ ID NO: 383688 - protein, 9 aa, Homo Sapiens
IILDHEKEW

SEQ ID NO: 383689 - protein, 9 aa, Homo Sapiens
IISREQTHL

SEQ ID NO: 383690 - protein, 9 aa, Homo Sapiens
HLKELLGHP

SEQ ID NO: 383691 - protein, 9 aa, Homo Sapiens
ATRGVCGPG

SEQ ID NO: 383692 - protein, 9 aa, Homo Sapiens
VIPDSKSLE

SEQ ID NO: 383693 - protein, 9 aa, Homo Sapiens
DPHIFVVAE

SEQ ID NO: 383694 - protein, 9 aa, Homo Sapiens
HFFTVTDPQ

SEQ ID NO: 383695 - protein, 9 aa, Homo Sapiens
LKNHLQNDN

SEQ ID NO: 383696 - protein, 9 aa, Homo Sapiens
NNRTLNVSK

SEQ ID NO: 383697 - protein, 9 aa, Homo Sapiens
VSIMDGSDK

SEQ ID NO: 383698 - protein, 9 aa, Homo Sapiens
EFWLENEKI

SEQ ID NO: 383699 - protein, 9 aa, Homo Sapiens
HGRAPLQKV

SEQ ID NO: 383700 - protein, 9 aa, Homo Sapiens
LFGEPSRHL

SEQ ID NO: 383701 - protein, 9 aa, Homo Sapiens
PVVPASLHS

SEQ ID NO: 383702 - protein, 9 aa, Homo Sapiens
YFAQNLFAP

SEQ ID NO: 383703 - protein, 9 aa, Homo Sapiens
GPQGKKGKK

SEQ ID NO: 383704 - protein, 9 aa, Homo Sapiens
PLKYSIIMN

SEQ ID NO: 383705 - protein, 9 aa, Homo Sapiens
TALIGLCHC

SEQ ID NO: 383706 - protein, 9 aa, Homo Sapiens
KHVEKYISD

SEQ ID NO: 383707 - protein, 9 aa, Homo Sapiens
VRTFLGWAV

SEQ ID NO: 383708 - protein, 9 aa, Homo Sapiens
EGLEYLHSQ

SEQ ID NO: 383709 - protein, 9 aa, Homo Sapiens
YYCNCDADL

SEQ ID NO: 383710 - protein, 9 aa, Homo Sapiens
YRDVMLDTY

SEQ ID NO: 383711 - protein, 9 aa, Homo Sapiens
RHIKLYDNN

SEQ ID NO: 383712 - protein, 9 aa, Homo Sapiens
PFIETSTKT

SEQ ID NO: 383713 - protein, 9 aa, Homo Sapiens
CIECGKTLS

SEQ ID NO: 383714 - protein, 9 aa, Homo Sapiens
RVSVTYYKR

SEQ ID NO: 383715 - protein, 9 aa, Homo Sapiens
EDCIIEIKP

SEQ ID NO: 383716 - protein, 9 aa, Homo Sapiens
DSGRSGKMW

SEQ ID NO: 383717 - protein, 9 aa, Homo Sapiens
PPNRNDLLN

SEQ ID NO: 383718 - protein, 9 aa, Homo Sapiens
LKTVYVIPG

SEQ ID NO: 383719 - protein, 9 aa, Homo Sapiens
TGIWKQWHE

SEQ ID NO: 383720 - protein, 9 aa, Homo Sapiens
LVQTASKEC

SEQ ID NO: 383721 - protein, 9 aa, Homo Sapiens
SGPPDYSCH

SEQ ID NO: 383722 - protein, 9 aa, Homo Sapiens
DPPKSLLAL

SEQ ID NO: 383723 - protein, 9 aa, Homo Sapiens
KESKFIESL

SEQ ID NO: 383724 - protein, 9 aa, Homo Sapiens
SRRSVWRAL

SEQ ID NO: 383725 - protein, 9 aa, Homo Sapiens
RPTYRWLNN

SEQ ID NO: 383726 - protein, 9 aa, Homo Sapiens
YKPELISRL

SEQ ID NO: 383727 - protein, 9 aa, Homo Sapiens
LNKVWTMLM

SEQ ID NO: 383728 - protein, 9 aa, Homo Sapiens
YNIDYSHFH

SEQ ID NO: 383729 - protein, 9 aa, Homo Sapiens
HSDTLECLL

SEQ ID NO: 383730 - protein, 9 aa, Homo Sapiens
SLGLNNCQT

SEQ ID NO: 383731 - protein, 9 aa, Homo Sapiens
LAFLMTYKC

SEQ ID NO: 383732 - protein, 9 aa, Homo Sapiens
GDNGQGLVT

SEQ ID NO: 383733 - protein, 9 aa, Homo Sapiens
DENGQSSES

SEQ ID NO: 383734 - protein, 9 aa, Homo Sapiens
YAVKLVNDS

SEQ ID NO: 383735 - protein, 9 aa, Homo Sapiens
AACICLISI

SEQ ID NO: 383736 - protein, 9 aa, Homo Sapiens
KMWALSFKT

SEQ ID NO: 383737 - protein, 9 aa, Homo Sapiens
RHIGKGVNL

SEQ ID NO: 383738 - protein, 9 aa, Homo Sapiens
EDTAHGIAS

SEQ ID NO: 383739 - protein, 9 aa, Homo Sapiens
QNASSRERR

SEQ ID NO: 383740 - protein, 9 aa, Homo Sapiens
FQIHEITHT

SEQ ID NO: 383741 - protein, 9 aa, Homo Sapiens
SGFPGAKGD

SEQ ID NO: 383742 - protein, 9 aa, Homo Sapiens
MESARENIN

SEQ ID NO: 383743 - protein, 9 aa, Homo Sapiens
QEEGALWHH

SEQ ID NO: 383744 - protein, 9 aa, Homo Sapiens
LIGREVYFA

SEQ ID NO: 383745 - protein, 9 aa, Homo Sapiens
KLLTRMHLK

SEQ ID NO: 383746 - protein, 9 aa, Homo Sapiens
LTNMEVPDT

SEQ ID NO: 383747 - protein, 9 aa, Homo Sapiens
SGPNTHPSP

SEQ ID NO: 383748 - protein, 9 aa, Homo Sapiens
FLNLIGFVL

SEQ ID NO: 383749 - protein, 9 aa, Homo Sapiens
DKDTAFPPL

SEQ ID NO: 383750 - protein, 9 aa, Homo Sapiens
KPESKLFLC

SEQ ID NO: 383751 - protein, 9 aa, Homo Sapiens
KDCGKTFGS

SEQ ID NO: 383752 - protein, 9 aa, Homo Sapiens
RSEEGVWED

SEQ ID NO: 383753 - protein, 9 aa, Homo Sapiens
RKQKRQRHA

SEQ ID NO: 383754 - protein, 9 aa, Homo Sapiens
FFTVTDPQN

SEQ ID NO: 383755 - protein, 9 aa, Homo Sapiens
TTIDMMYKE

SEQ ID NO: 383756 - protein, 9 aa, Homo Sapiens
DLFTSLGLL

SEQ ID NO: 383757 - protein, 9 aa, Homo Sapiens
GSDKGILAW

SEQ ID NO: 383758 - protein, 9 aa, Homo Sapiens
SCFNYVMHF

SEQ ID NO: 383759 - protein, 9 aa, Homo Sapiens
IPFSGKGYA

SEQ ID NO: 383760 - protein, 9 aa, Homo Sapiens
PWPGHANLK

SEQ ID NO: 383761 - protein, 9 aa, Homo Sapiens
IQDIFWHTI

SEQ ID NO: 383762 - protein, 9 aa, Homo Sapiens
AKSLHKTIQ

SEQ ID NO: 383763 - protein, 9 aa, Homo Sapiens
LEDLFARTL

SEQ ID NO: 383764 - protein, 9 aa, Homo Sapiens
KRRANKAKR

SEQ ID NO: 383765 - protein, 9 aa, Homo Sapiens
KAHNPGVYT

SEQ ID NO: 383766 - protein, 9 aa, Homo Sapiens
IKALKVQFK

SEQ ID NO: 383767 - protein, 9 aa, Homo Sapiens
DTKNQEGKV

SEQ ID NO: 383768 - protein, 9 aa, Homo Sapiens
TRLTPPVRG

SEQ ID NO: 383769 - protein, 9 aa, Homo Sapiens
YFSDDEVWV

SEQ ID NO: 383770 - protein, 9 aa, Homo Sapiens
LSCEGDDKD

SEQ ID NO: 383771 - protein, 9 aa, Homo Sapiens
CPEKCAKHK

SEQ ID NO: 383772 - protein, 9 aa, Homo Sapiens
YKNNKWYIF

SEQ ID NO: 383773 - protein, 9 aa, Homo Sapiens
DTHSNGVST

SEQ ID NO: 383774 - protein, 9 aa, Homo Sapiens
DGGEMTVIQ

SEQ ID NO: 383775 - protein, 9 aa, Homo Sapiens
HLDLPPYKS

SEQ ID NO: 383776 - protein, 9 aa, Homo Sapiens
LFCFILLFV

SEQ ID NO: 383777 - protein, 9 aa, Homo Sapiens
SSISHILRN

SEQ ID NO: 383778 - protein, 9 aa, Homo Sapiens
TSAPTFGFG

SEQ ID NO: 383779 - protein, 9 aa, Homo Sapiens
AQEKLINDT

SEQ ID NO: 383780 - protein, 9 aa, Homo Sapiens
FIMLMVRLT

SEQ ID NO: 383781 - protein, 9 aa, Homo Sapiens
TVIRLPKGK

SEQ ID NO: 383782 - protein, 9 aa, Homo Sapiens
KNIHESCMR

SEQ ID NO: 383783 - protein, 9 aa, Homo Sapiens
RRFWDKSSY

SEQ ID NO: 383784 - protein, 9 aa, Homo Sapiens
NTGDEESKA

SEQ ID NO: 383785 - protein, 9 aa, Homo Sapiens
RTYGFVITF

SEQ ID NO: 383786 - protein, 9 aa, Homo Sapiens
MKYLEVRSP

SEQ ID NO: 383787 - protein, 9 aa, Homo Sapiens
SNIDIQIPT

SEQ ID NO: 383788 - protein, 9 aa, Homo Sapiens
YFPSEPVKL

SEQ ID NO: 383789 - protein, 9 aa, Homo Sapiens
CGRRFWDKS

SEQ ID NO: 383790 - protein, 9 aa, Homo Sapiens
IGLNQHRII

SEQ ID NO: 383791 - protein, 9 aa, Homo Sapiens
MEDMMNDSN

SEQ ID NO: 383792 - protein, 9 aa, Homo Sapiens
IGLCHCKSS

SEQ ID NO: 383793 - protein, 9 aa, Homo Sapiens
IHTKEQPYT

SEQ ID NO: 383794 - protein, 9 aa, Homo Sapiens
SIAWNYPKP

SEQ ID NO: 383795 - protein, 9 aa, Homo Sapiens
EGALWHHYK

SEQ ID NO: 383796 - protein, 9 aa, Homo Sapiens
KMSFQKIIP

SEQ ID NO: 383797 - protein, 9 aa, Homo Sapiens
TKTGIDPYL

SEQ ID NO: 383798 - protein, 9 aa, Homo Sapiens
GFIQVCYGQ

SEQ ID NO: 383799 - protein, 9 aa, Homo Sapiens
IFNRDSTMN

SEQ ID NO: 383800 - protein, 9 aa, Homo Sapiens
EYAHISRET

SEQ ID NO: 383801 - protein, 9 aa, Homo Sapiens
LFIPVASLF

SEQ ID NO: 383802 - protein, 9 aa, Homo Sapiens
YILQNQDDR

SEQ ID NO: 383803 - protein, 9 aa, Homo Sapiens
GKSSILVWV

SEQ ID NO: 383804 - protein, 9 aa, Homo Sapiens
DAIMQELER

SEQ ID NO: 383805 - protein, 9 aa, Homo Sapiens
PSSYSLTIY

SEQ ID NO: 383806 - protein, 9 aa, Homo Sapiens
CVTASTNGT

SEQ ID NO: 383807 - protein, 9 aa, Homo Sapiens
EGYNLLTIK

SEQ ID NO: 383808 - protein, 9 aa, Homo Sapiens
IDTKTVGEG

SEQ ID NO: 383809 - protein, 9 aa, Homo Sapiens
TLNIHLFSM

SEQ ID NO: 383810 - protein, 9 aa, Homo Sapiens
ELEESDKFY

SEQ ID NO: 383811 - protein, 9 aa, Homo Sapiens
KSTLTKHLI

SEQ ID NO: 383812 - protein, 9 aa, Homo Sapiens
KISTKNPDV

SEQ ID NO: 383813 - protein, 9 aa, Homo Sapiens
QLKNIQDIF

SEQ ID NO: 383814 - protein, 9 aa, Homo Sapiens
NSKLFEQYE

SEQ ID NO: 383815 - protein, 9 aa, Homo Sapiens
YFKPYLGRI

SEQ ID NO: 383816 - protein, 9 aa, Homo Sapiens
SSPLTRLTP

SEQ ID NO: 383817 - protein, 9 aa, Homo Sapiens
ERVSVTYYK

SEQ ID NO: 383818 - protein, 9 aa, Homo Sapiens
RWDAAKVAL

SEQ ID NO: 383819 - protein, 9 aa, Homo Sapiens
RLHQLKMQL

SEQ ID NO: 383820 - protein, 9 aa, Homo Sapiens
LLSMIRAHE

SEQ ID NO: 383821 - protein, 9 aa, Homo Sapiens
KSCCFLPRL

SEQ ID NO: 383822 - protein, 9 aa, Homo Sapiens
RPPLRELFV

SEQ ID NO: 383823 - protein, 9 aa, Homo Sapiens
TLQFVFCIF

SEQ ID NO: 383824 - protein, 9 aa, Homo Sapiens
EDSLADQAV

SEQ ID NO: 383825 - protein, 9 aa, Homo Sapiens
RYLNNSLHV

SEQ ID NO: 383826 - protein, 9 aa, Homo Sapiens
QNNNLLSMI

SEQ ID NO: 383827 - protein, 9 aa, Homo Sapiens
WERLGATIP

SEQ ID NO: 383828 - protein, 9 aa, Homo Sapiens
IKKLNLQNA

SEQ ID NO: 383829 - protein, 9 aa, Homo Sapiens
GVFVGSAMH

SEQ ID NO: 383830 - protein, 9 aa, Homo Sapiens
TQNDWITNM

SEQ ID NO: 383831 - protein, 9 aa, Homo Sapiens
NKPPLLDRP

SEQ ID NO: 383832 - protein, 9 aa, Homo Sapiens
KYNGGVKIP

SEQ ID NO: 383833 - protein, 9 aa, Homo Sapiens
WRGPGQFFF

SEQ ID NO: 383834 - protein, 9 aa, Homo Sapiens
QMCRHPPRK

SEQ ID NO: 383835 - protein, 9 aa, Homo Sapiens
SLAKDTFQG

SEQ ID NO: 383836 - protein, 9 aa, Homo Sapiens
GWVPASYLK

SEQ ID NO: 383837 - protein, 9 aa, Homo Sapiens
NSLANKYKG

SEQ ID NO: 383838 - protein, 9 aa, Homo Sapiens
LASAGVGSW

SEQ ID NO: 383839 - protein, 9 aa, Homo Sapiens
KIAQVAKIW

SEQ ID NO: 383840 - protein, 9 aa, Homo Sapiens
EKYPGKMSP

SEQ ID NO: 383841 - protein, 9 aa, Homo Sapiens
SSMGGRPLS

SEQ ID NO: 383842 - protein, 9 aa, Homo Sapiens
NQSVVRIMQ

SEQ ID NO: 383843 - protein, 9 aa, Homo Sapiens
HNPLYPVTE

SEQ ID NO: 383844 - protein, 9 aa, Homo Sapiens
KLNKVWTML

SEQ ID NO: 383845 - protein, 9 aa, Homo Sapiens
KEADKLLTE

SEQ ID NO: 383846 - protein, 9 aa, Homo Sapiens
IDDISGNLA

SEQ ID NO: 383847 - protein, 9 aa, Homo Sapiens
RQRNSAGGG

SEQ ID NO: 383848 - protein, 9 aa, Homo Sapiens
KQHLAQIRE

SEQ ID NO: 383849 - protein, 9 aa, Homo Sapiens
NGCGAFSYR

SEQ ID NO: 383850 - protein, 9 aa, Homo Sapiens
AIARKQIRL

SEQ ID NO: 383851 - protein, 9 aa, Homo Sapiens
AANLPCNHF

SEQ ID NO: 383852 - protein, 9 aa, Homo Sapiens
GATYVIYHD

SEQ ID NO: 383853 - protein, 9 aa, Homo Sapiens
IKLELTFRK

SEQ ID NO: 383854 - protein, 9 aa, Homo Sapiens
QNTLGHTTQ

SEQ ID NO: 383855 - protein, 9 aa, Homo Sapiens
YMIQILFTF

SEQ ID NO: 383856 - protein, 9 aa, Homo Sapiens
TSQSAASDT

SEQ ID NO: 383857 - protein, 9 aa, Homo Sapiens
NMPCCKRLW

SEQ ID NO: 383858 - protein, 9 aa, Homo Sapiens
IFAWGTLLF

SEQ ID NO: 383859 - protein, 9 aa, Homo Sapiens
SISQLIDEL

SEQ ID NO: 383860 - protein, 9 aa, Homo Sapiens
VNIVPNKPP

SEQ ID NO: 383861 - protein, 9 aa, Homo Sapiens
NMDSCFNID

SEQ ID NO: 383862 - protein, 9 aa, Homo Sapiens
TLSNIDIQI

SEQ ID NO: 383863 - protein, 9 aa, Homo Sapiens
YLHSLSNCK

SEQ ID NO: 383864 - protein, 9 aa, Homo Sapiens
ASITGTRVV

SEQ ID NO: 383865 - protein, 9 aa, Homo Sapiens
TLRTNKLFH

SEQ ID NO: 383866 - protein, 9 aa, Homo Sapiens
AVFKFLQQE

SEQ ID NO: 383867 - protein, 9 aa, Homo Sapiens
KSLLALGSS

SEQ ID NO: 383868 - protein, 9 aa, Homo Sapiens
ECIECGKTL

SEQ ID NO: 383869 - protein, 9 aa, Homo Sapiens
VWTKIDDTK

SEQ ID NO: 383870 - protein, 9 aa, Homo Sapiens
LEEKVCALN

SEQ ID NO: 383871 - protein, 9 aa, Homo Sapiens
TYFRRKPIK

SEQ ID NO: 383872 - protein, 9 aa, Homo Sapiens
SLGVGSSTK

SEQ ID NO: 383873 - protein, 9 aa, Homo Sapiens
HKKIIDVNN

SEQ ID NO: 383874 - protein, 9 aa, Homo Sapiens
IPLNKRLKK

SEQ ID NO: 383875 - protein, 9 aa, Homo Sapiens
DISFNVYMF

SEQ ID NO: 383876 - protein, 9 aa, Homo Sapiens
MELRLRDAL

SEQ ID NO: 383877 - protein, 9 aa, Homo Sapiens
PKKFPCTHP

SEQ ID NO: 383878 - protein, 9 aa, Homo Sapiens
ILEKQICIP

SEQ ID NO: 383879 - protein, 9 aa, Homo Sapiens
SRNLTQSLA

SEQ ID NO: 383880 - protein, 9 aa, Homo Sapiens
LQGAIKSVK

SEQ ID NO: 383881 - protein, 9 aa, Homo Sapiens
NYFISAQKE

SEQ ID NO: 383882 - protein, 9 aa, Homo Sapiens
QGAIKSVKA

SEQ ID NO: 383883 - protein, 9 aa, Homo Sapiens
PSAITLSYL

SEQ ID NO: 383884 - protein, 9 aa, Homo Sapiens
IYFKVWMCG

SEQ ID NO: 383885 - protein, 9 aa, Homo Sapiens
PVDVGGTNQ

SEQ ID NO: 383886 - protein, 9 aa, Homo Sapiens
CEITQHQFL

SEQ ID NO: 383887 - protein, 9 aa, Homo Sapiens
KGTSIAWNY

SEQ ID NO: 383888 - protein, 9 aa, Homo Sapiens
IEIVGGATQ

SEQ ID NO: 383889 - protein, 9 aa, Homo Sapiens
DGLFVPHGY

SEQ ID NO: 383890 - protein, 9 aa, Homo Sapiens
KSVKAVPQP

SEQ ID NO: 383891 - protein, 9 aa, Homo Sapiens
IFWTPPSKP

SEQ ID NO: 383892 - protein, 9 aa, Homo Sapiens
YMSEFSTVS

SEQ ID NO: 383893 - protein, 9 aa, Homo Sapiens
NLVLLGLSF

SEQ ID NO: 383894 - protein, 9 aa, Homo Sapiens
CRTEDKNFY

SEQ ID NO: 383895 - protein, 9 aa, Homo Sapiens
IRKQSRHRA

SEQ ID NO: 383896 - protein, 9 aa, Homo Sapiens
NVFAHLPQG

SEQ ID NO: 383897 - protein, 9 aa, Homo Sapiens
SRQQNKLAE

SEQ ID NO: 383898 - protein, 9 aa, Homo Sapiens
KALSDTTEE

SEQ ID NO: 383899 - protein, 9 aa, Homo Sapiens
YSLGQVYKE

SEQ ID NO: 383900 - protein, 9 aa, Homo Sapiens
KVIKSSLFS

SEQ ID NO: 383901 - protein, 9 aa, Homo Sapiens
HLEDLFART

SEQ ID NO: 383902 - protein, 9 aa, Homo Sapiens
VEMKYLEVR

SEQ ID NO: 383903 - protein, 9 aa, Homo Sapiens
VSGPPDYSC

SEQ ID NO: 383904 - protein, 9 aa, Homo Sapiens
TNNLSPKEN

SEQ ID NO: 383905 - protein, 9 aa, Homo Sapiens
QEVQQILLE

SEQ ID NO: 383906 - protein, 9 aa, Homo Sapiens
ESVLNYFKP

SEQ ID NO: 383907 - protein, 9 aa, Homo Sapiens
YTDGQWNGR

SEQ ID NO: 383908 - protein, 9 aa, Homo Sapiens
KLDGTTPVW

SEQ ID NO: 383909 - protein, 9 aa, Homo Sapiens
INNVVLDED

SEQ ID NO: 383910 - protein, 9 aa, Homo Sapiens
ESSSEDVKL

SEQ ID NO: 383911 - protein, 9 aa, Homo Sapiens
LSIMPIVVC

SEQ ID NO: 383912 - protein, 9 aa, Homo Sapiens
KGNLIVHQQ

SEQ ID NO: 383913 - protein, 9 aa, Homo Sapiens
ILSEEIRFY

SEQ ID NO: 383914 - protein, 9 aa, Homo Sapiens
VKELSWQKR

SEQ ID NO: 383915 - protein, 9 aa, Homo Sapiens
FTISDGNMD

SEQ ID NO: 383916 - protein, 9 aa, Homo Sapiens
DKDYLYTHT

SEQ ID NO: 383917 - protein, 9 aa, Homo Sapiens
EHQKEGKEQ

SEQ ID NO: 383918 - protein, 9 aa, Homo Sapiens
KGLTLEKNR

SEQ ID NO: 383919 - protein, 9 aa, Homo Sapiens
VLYALRFFD

SEQ ID NO: 383920 - protein, 9 aa, Homo Sapiens
LSLIFLLAM

SEQ ID NO: 383921 - protein, 9 aa, Homo Sapiens
SAELNSVIN

SEQ ID NO: 383922 - protein, 9 aa, Homo Sapiens
QADNLLMGK

SEQ ID NO: 383923 - protein, 9 aa, Homo Sapiens
GKPVIGENC

SEQ ID NO: 383924 - protein, 9 aa, Homo Sapiens
SSKRNELKS

SEQ ID NO: 383925 - protein, 9 aa, Homo Sapiens
RLEGTGQQV

SEQ ID NO: 383926 - protein, 9 aa, Homo Sapiens
IEKIITMIP

SEQ ID NO: 383927 - protein, 9 aa, Homo Sapiens
WTLIIMVFF

SEQ ID NO: 383928 - protein, 9 aa, Homo Sapiens
HSVVLCLAV

SEQ ID NO: 383929 - protein, 9 aa, Homo Sapiens
RPMCKSFSQ

SEQ ID NO: 383930 - protein, 9 aa, Homo Sapiens
TTLNYFVIP

SEQ ID NO: 383931 - protein, 9 aa, Homo Sapiens
PRRILFIKI

SEQ ID NO: 383932 - protein, 9 aa, Homo Sapiens
IILALVLRI

SEQ ID NO: 383933 - protein, 9 aa, Homo Sapiens
DLLYPTEDI

SEQ ID NO: 383934 - protein, 9 aa, Homo Sapiens
ICAITLGHG

SEQ ID NO: 383935 - protein, 9 aa, Homo Sapiens
PACCVPACC

SEQ ID NO: 383936 - protein, 9 aa, Homo Sapiens
KMVYNKEMP

SEQ ID NO: 383937 - protein, 9 aa, Homo Sapiens
LTFRKLIGS

SEQ ID NO: 383938 - protein, 9 aa, Homo Sapiens
CGKTLSKTS

SEQ ID NO: 383939 - protein, 9 aa, Homo Sapiens
RTIELEVIC

SEQ ID NO: 383940 - protein, 9 aa, Homo Sapiens
RQSPASRVP

SEQ ID NO: 383941 - protein, 9 aa, Homo Sapiens
NKHKTKFGL

SEQ ID NO: 383942 - protein, 9 aa, Homo Sapiens
VLFAYAQLG

SEQ ID NO: 383943 - protein, 9 aa, Homo Sapiens
ARQTKRIQK

SEQ ID NO: 383944 - protein, 9 aa, Homo Sapiens
KAAMIKLVE

SEQ ID NO: 383945 - protein, 9 aa, Homo Sapiens
LNLLKSEGL

SEQ ID NO: 383946 - protein, 9 aa, Homo Sapiens
SILQIHTSE

SEQ ID NO: 383947 - protein, 9 aa, Homo Sapiens
LVASETKCG

SEQ ID NO: 383948 - protein, 9 aa, Homo Sapiens
SLSLDKSED

SEQ ID NO: 383949 - protein, 9 aa, Homo Sapiens
PQGNYSAIP

SEQ ID NO: 383950 - protein, 9 aa, Homo Sapiens
EEKMWRQED

SEQ ID NO: 383951 - protein, 9 aa, Homo Sapiens
GKTFNWPIY

SEQ ID NO: 383952 - protein, 9 aa, Homo Sapiens
AGMVTITSG

SEQ ID NO: 383953 - protein, 9 aa, Homo Sapiens
SQIKHQNLA

SEQ ID NO: 383954 - protein, 9 aa, Homo Sapiens
ASSSLVPIS

SEQ ID NO: 383955 - protein, 9 aa, Homo Sapiens
PYGRQPQYS

SEQ ID NO: 383956 - protein, 9 aa, Homo Sapiens
EGKILLTNM

SEQ ID NO: 383957 - protein, 9 aa, Homo Sapiens
HIIVGLEDG

SEQ ID NO: 383958 - protein, 9 aa, Homo Sapiens
QNIKYSFQK

SEQ ID NO: 383959 - protein, 9 aa, Homo Sapiens
HHLNHFLEA

SEQ ID NO: 383960 - protein, 9 aa, Homo Sapiens
ESWKSILNY

SEQ ID NO: 383961 - protein, 9 aa, Homo Sapiens
ATISESNIN

SEQ ID NO: 383962 - protein, 9 aa, Homo Sapiens
QLCGKRFHQ

SEQ ID NO: 383963 - protein, 9 aa, Homo Sapiens
DKLLTEKGK

SEQ ID NO: 383964 - protein, 9 aa, Homo Sapiens
RSHLWGHQI

SEQ ID NO: 383965 - protein, 9 aa, Homo Sapiens
PWCFAVPVS

SEQ ID NO: 383966 - protein, 9 aa, Homo Sapiens
ISYHIFYQI

SEQ ID NO: 383967 - protein, 9 aa, Homo Sapiens
YLHLEKVVN

SEQ ID NO: 383968 - protein, 9 aa, Homo Sapiens
NWSLFAVNL

SEQ ID NO: 383969 - protein, 9 aa, Homo Sapiens
EIKINEARE

SEQ ID NO: 383970 - protein, 9 aa, Homo Sapiens
NASNSLKKK

SEQ ID NO: 383971 - protein, 9 aa, Homo Sapiens
YLPPGHAVC

SEQ ID NO: 383972 - protein, 9 aa, Homo Sapiens
FSDPRAMAG

SEQ ID NO: 383973 - protein, 9 aa, Homo Sapiens
KMWRQEDKI

SEQ ID NO: 383974 - protein, 9 aa, Homo Sapiens
ELDADEYEE

SEQ ID NO: 383975 - protein, 9 aa, Homo Sapiens
KILLTNMEV

SEQ ID NO: 383976 - protein, 9 aa, Homo Sapiens
TGREAVCFM

SEQ ID NO: 383977 - protein, 9 aa, Homo Sapiens
PQVWMDADT

SEQ ID NO: 383978 - protein, 9 aa, Homo Sapiens
IKVVSQLWA

SEQ ID NO: 383979 - protein, 9 aa, Homo Sapiens
DLGENTFEG

SEQ ID NO: 383980 - protein, 9 aa, Homo Sapiens
QIKCVEIVK

SEQ ID NO: 383981 - protein, 9 aa, Homo Sapiens
SGILKTLFR

SEQ ID NO: 383982 - protein, 9 aa, Homo Sapiens
EQKERFLLL

SEQ ID NO: 383983 - protein, 9 aa, Homo Sapiens
VWRALAPWA

SEQ ID NO: 383984 - protein, 9 aa, Homo Sapiens
LAAVIVGGV

SEQ ID NO: 383985 - protein, 9 aa, Homo Sapiens
TDKLRAAFF

SEQ ID NO: 383986 - protein, 9 aa, Homo Sapiens
LDFTEIRAK

SEQ ID NO: 383987 - protein, 9 aa, Homo Sapiens
PLLDYSQRK

SEQ ID NO: 383988 - protein, 9 aa, Homo Sapiens
IIWQRDFPG

SEQ ID NO: 383989 - protein, 9 aa, Homo Sapiens
PEVQYQIIL

SEQ ID NO: 383990 - protein, 9 aa, Homo Sapiens
KHLRASMNK

SEQ ID NO: 383991 - protein, 9 aa, Homo Sapiens
AQPLVQAQQ

SEQ ID NO: 383992 - protein, 9 aa, Homo Sapiens
PSHMASMGQ

SEQ ID NO: 383993 - protein, 9 aa, Homo Sapiens
CGKIGLIEE

SEQ ID NO: 383994 - protein, 9 aa, Homo Sapiens
NKPLRSHIT

SEQ ID NO: 383995 - protein, 9 aa, Homo Sapiens
PQHLKELLG

SEQ ID NO: 383996 - protein, 9 aa, Homo Sapiens
SKMRVLQEN

SEQ ID NO: 383997 - protein, 9 aa, Homo Sapiens
ASKVLGRLK

SEQ ID NO: 383998 - protein, 9 aa, Homo Sapiens
GLLASAGVG

SEQ ID NO: 383999 - protein, 9 aa, Homo Sapiens
KGLWDDLVE

SEQ ID NO: 384000 - protein, 9 aa, Homo Sapiens
PSQNNLYRD

SEQ ID NO: 384001 - protein, 9 aa, Homo Sapiens
LRNNDLNYF

SEQ ID NO: 384002 - protein, 9 aa, Homo Sapiens
RLGKDTIVF

SEQ ID NO: 384003 - protein, 9 aa, Homo Sapiens
NDLLNTSKV

SEQ ID NO: 384004 - protein, 9 aa, Homo Sapiens
LHMFNRMVI

SEQ ID NO: 384005 - protein, 9 aa, Homo Sapiens
EGKKSHTFD

SEQ ID NO: 384006 - protein, 9 aa, Homo Sapiens
NKYSVAQQC

SEQ ID NO: 384007 - protein, 9 aa, Homo Sapiens
NGEDRAKGN

SEQ ID NO: 384008 - protein, 9 aa, Homo Sapiens
VKKIDDAEL

SEQ ID NO: 384009 - protein, 9 aa, Homo Sapiens
SGSSSYFSD

SEQ ID NO: 384010 - protein, 9 aa, Homo Sapiens
DIQIPTGQL

SEQ ID NO: 384011 - protein, 9 aa, Homo Sapiens
PELCWPLRL

SEQ ID NO: 384012 - protein, 9 aa, Homo Sapiens
VSCRYLNNS

SEQ ID NO: 384013 - protein, 9 aa, Homo Sapiens
LYPGVTTID

SEQ ID NO: 384014 - protein, 9 aa, Homo Sapiens
WNYPKPEYF

SEQ ID NO: 384015 - protein, 9 aa, Homo Sapiens
DEEEMEHQK

SEQ ID NO: 384016 - protein, 9 aa, Homo Sapiens
SELNLQHDQ

SEQ ID NO: 384017 - protein, 9 aa, Homo Sapiens
LENVEYNIS

SEQ ID NO: 384018 - protein, 9 aa, Homo Sapiens
EEKENKKEP

SEQ ID NO: 384019 - protein, 9 aa, Homo Sapiens
WGPPGPPGP

SEQ ID NO: 384020 - protein, 9 aa, Homo Sapiens
GSLQIYLLD

SEQ ID NO: 384021 - protein, 9 aa, Homo Sapiens
LEKLSISSS

SEQ ID NO: 384022 - protein, 9 aa, Homo Sapiens
TLQHIFWVY

SEQ ID NO: 384023 - protein, 9 aa, Homo Sapiens
NPLREINKI

SEQ ID NO: 384024 - protein, 9 aa, Homo Sapiens
TGGLLHYMI

SEQ ID NO: 384025 - protein, 9 aa, Homo Sapiens
GSKLCLVEA

SEQ ID NO: 384026 - protein, 9 aa, Homo Sapiens
GTVLNNKLC

SEQ ID NO: 384027 - protein, 9 aa, Homo Sapiens
DNVFNSNLP

SEQ ID NO: 384028 - protein, 9 aa, Homo Sapiens
NSELRNMQD

SEQ ID NO: 384029 - protein, 9 aa, Homo Sapiens
EPVYNSLAN

SEQ ID NO: 384030 - protein, 9 aa, Homo Sapiens
NKKAVAFTS

SEQ ID NO: 384031 - protein, 9 aa, Homo Sapiens
AVVVVDCLF

SEQ ID NO: 384032 - protein, 9 aa, Homo Sapiens
GTYAWMAPK

SEQ ID NO: 384033 - protein, 9 aa, Homo Sapiens
IGQNYKACM

SEQ ID NO: 384034 - protein, 9 aa, Homo Sapiens
ACTERPSNN

SEQ ID NO: 384035 - protein, 9 aa, Homo Sapiens
QHQIIHTEE

SEQ ID NO: 384036 - protein, 9 aa, Homo Sapiens
RKMFTSQSA

SEQ ID NO: 384037 - protein, 9 aa, Homo Sapiens
KQFDAYPNT

SEQ ID NO: 384038 - protein, 9 aa, Homo Sapiens
EEKIRKQEK

SEQ ID NO: 384039 - protein, 9 aa, Homo Sapiens
NGQEQQMKI

SEQ ID NO: 384040 - protein, 9 aa, Homo Sapiens
LLKKTNKQE

SEQ ID NO: 384041 - protein, 9 aa, Homo Sapiens
VQKSHNNCF

SEQ ID NO: 384042 - protein, 9 aa, Homo Sapiens
AVLDIITNE

SEQ ID NO: 384043 - protein, 9 aa, Homo Sapiens
SKRKNNYPD

SEQ ID NO: 384044 - protein, 9 aa, Homo Sapiens
EEEEELQHR

SEQ ID NO: 384045 - protein, 9 aa, Homo Sapiens
SPSAAAGGS

SEQ ID NO: 384046 - protein, 9 aa, Homo Sapiens
INLVMAVLT

SEQ ID NO: 384047 - protein, 9 aa, Homo Sapiens
WILFFILGL

SEQ ID NO: 384048 - protein, 9 aa, Homo Sapiens
LVQREEPVR

SEQ ID NO: 384049 - protein, 9 aa, Homo Sapiens
PGRPPFQKA

SEQ ID NO: 384050 - protein, 9 aa, Homo Sapiens
CNGVSQIIK

SEQ ID NO: 384051 - protein, 9 aa, Homo Sapiens
VEVNLNNRT

SEQ ID NO: 384052 - protein, 9 aa, Homo Sapiens
SGPYILQNQ

SEQ ID NO: 384053 - protein, 9 aa, Homo Sapiens
AICNPLKYS

SEQ ID NO: 384054 - protein, 9 aa, Homo Sapiens
DGNGSPGIE

SEQ ID NO: 384055 - protein, 9 aa, Homo Sapiens
FLFARRNQG

SEQ ID NO: 384056 - protein, 9 aa, Homo Sapiens
MRRPYGRQP

SEQ ID NO: 384057 - protein, 9 aa, Homo Sapiens
ISTQRMWIP

SEQ ID NO: 384058 - protein, 9 aa, Homo Sapiens
QWCQKEMGI

SEQ ID NO: 384059 - protein, 9 aa, Homo Sapiens
DDNAGLSIS

SEQ ID NO: 384060 - protein, 9 aa, Homo Sapiens
HHNMTWKTW

SEQ ID NO: 384061 - protein, 9 aa, Homo Sapiens
FMAATFSPQ

SEQ ID NO: 384062 - protein, 9 aa, Homo Sapiens
PRPTYRWLN

SEQ ID NO: 384063 - protein, 9 aa, Homo Sapiens
YSFEYVIFN

SEQ ID NO: 384064 - protein, 9 aa, Homo Sapiens
EESASFEYL

SEQ ID NO: 384065 - protein, 9 aa, Homo Sapiens
GASITGTRV

SEQ ID NO: 384066 - protein, 9 aa, Homo Sapiens
FLFETENVD

SEQ ID NO: 384067 - protein, 9 aa, Homo Sapiens
TSQKPREER

SEQ ID NO: 384068 - protein, 9 aa, Homo Sapiens
CASGATYVI

SEQ ID NO: 384069 - protein, 9 aa, Homo Sapiens
DTQAFNIGA

SEQ ID NO: 384070 - protein, 9 aa, Homo Sapiens
EHLQKTVNK

SEQ ID NO: 384071 - protein, 9 aa, Homo Sapiens
TPICTSDVD

SEQ ID NO: 384072 - protein, 9 aa, Homo Sapiens
RLEEPVGPE

SEQ ID NO: 384073 - protein, 9 aa, Homo Sapiens
EIYSDTGNH

SEQ ID NO: 384074 - protein, 9 aa, Homo Sapiens
RIMQKKYWK

SEQ ID NO: 384075 - protein, 9 aa, Homo Sapiens
NKLAELHAN

SEQ ID NO: 384076 - protein, 9 aa, Homo Sapiens
EKKALFLKE

SEQ ID NO: 384077 - protein, 9 aa, Homo Sapiens
LQHINFMKT

SEQ ID NO: 384078 - protein, 9 aa, Homo Sapiens
LSKIMSYEL

SEQ ID NO: 384079 - protein, 9 aa, Homo Sapiens
FIAKAFKII

SEQ ID NO: 384080 - protein, 9 aa, Homo Sapiens
QISRQQNKL

SEQ ID NO: 384081 - protein, 9 aa, Homo Sapiens
LNNGVPLSP

SEQ ID NO: 384082 - protein, 9 aa, Homo Sapiens
AKLLTRMHL

SEQ ID NO: 384083 - protein, 9 aa, Homo Sapiens
LQIYTLMHK

SEQ ID NO: 384084 - protein, 9 aa, Homo Sapiens
VCLHWFPYC

SEQ ID NO: 384085 - protein, 9 aa, Homo Sapiens
EINLRLSTY

SEQ ID NO: 384086 - protein, 9 aa, Homo Sapiens
ANKYKGQKG

SEQ ID NO: 384087 - protein, 9 aa, Homo Sapiens
ANESLKPLK

SEQ ID NO: 384088 - protein, 9 aa, Homo Sapiens
EPVVHGDSI

SEQ ID NO: 384089 - protein, 9 aa, Homo Sapiens
LYRSGITST

SEQ ID NO: 384090 - protein, 9 aa, Homo Sapiens
TDIGLVASE

SEQ ID NO: 384091 - protein, 9 aa, Homo Sapiens
IKIIQFGFH

SEQ ID NO: 384092 - protein, 9 aa, Homo Sapiens
YNNDKKVRV

SEQ ID NO: 384093 - protein, 9 aa, Homo Sapiens
SATPGGKDH

SEQ ID NO: 384094 - protein, 9 aa, Homo Sapiens
IQTLFQRSG

SEQ ID NO: 384095 - protein, 9 aa, Homo Sapiens
DVKLESMGE

SEQ ID NO: 384096 - protein, 9 aa, Homo Sapiens
VLLCFGVLY

SEQ ID NO: 384097 - protein, 9 aa, Homo Sapiens
YTWLLFIFC

SEQ ID NO: 384098 - protein, 9 aa, Homo Sapiens
YPKPEYFLG

SEQ ID NO: 384099 - protein, 9 aa, Homo Sapiens
LSELDQYHG

SEQ ID NO: 384100 - protein, 9 aa, Homo Sapiens
ATTQISEVT

SEQ ID NO: 384101 - protein, 9 aa, Homo Sapiens
MSVPVKNFT

SEQ ID NO: 384102 - protein, 9 aa, Homo Sapiens
IRGPLFTVD

SEQ ID NO: 384103 - protein, 9 aa, Homo Sapiens
HRCVKLSSP

SEQ ID NO: 384104 - protein, 9 aa, Homo Sapiens
FKGGNYAVK

SEQ ID NO: 384105 - protein, 9 aa, Homo Sapiens
LAKSLHKTI

SEQ ID NO: 384106 - protein, 9 aa, Homo Sapiens
FLEKGQDGQ

SEQ ID NO: 384107 - protein, 9 aa, Homo Sapiens
EEMHIRYLY

SEQ ID NO: 384108 - protein, 9 aa, Homo Sapiens
YTSPETQKY

SEQ ID NO: 384109 - protein, 9 aa, Homo Sapiens
GRNCLYSRL

SEQ ID NO: 384110 - protein, 9 aa, Homo Sapiens
TIKCHTLFS

SEQ ID NO: 384111 - protein, 9 aa, Homo Sapiens
TADNTSMPT

SEQ ID NO: 384112 - protein, 9 aa, Homo Sapiens
VITFYEEVT

SEQ ID NO: 384113 - protein, 9 aa, Homo Sapiens
SMGGRPLSP

SEQ ID NO: 384114 - protein, 9 aa, Homo Sapiens
KLKLTDIRL

SEQ ID NO: 384115 - protein, 9 aa, Homo Sapiens
GKKSKLQIW

SEQ ID NO: 384116 - protein, 9 aa, Homo Sapiens
AIQFTGSGK

SEQ ID NO: 384117 - protein, 9 aa, Homo Sapiens
HEDRHIKLY

SEQ ID NO: 384118 - protein, 9 aa, Homo Sapiens
LKELLGHPH

SEQ ID NO: 384119 - protein, 9 aa, Homo Sapiens
AAGGDIKKH

SEQ ID NO: 384120 - protein, 9 aa, Homo Sapiens
VGDSLMVMI

SEQ ID NO: 384121 - protein, 9 aa, Homo Sapiens
ISTSIIDLR

SEQ ID NO: 384122 - protein, 9 aa, Homo Sapiens
IYSDTGNHA

SEQ ID NO: 384123 - protein, 9 aa, Homo Sapiens
VLIEGKNIE

SEQ ID NO: 384124 - protein, 9 aa, Homo Sapiens
NSQLQTHQI

SEQ ID NO: 384125 - protein, 9 aa, Homo Sapiens
AEECTTIIC

SEQ ID NO: 384126 - protein, 9 aa, Homo Sapiens
EDKYLEIQG

SEQ ID NO: 384127 - protein, 9 aa, Homo Sapiens
KNIESLRAI

SEQ ID NO: 384128 - protein, 9 aa, Homo Sapiens
GYTEKQMRD

SEQ ID NO: 384129 - protein, 9 aa, Homo Sapiens
QIILNGEEI

SEQ ID NO: 384130 - protein, 9 aa, Homo Sapiens
QNVFNQPTL

SEQ ID NO: 384131 - protein, 9 aa, Homo Sapiens
KCRYIYYGK

SEQ ID NO: 384132 - protein, 9 aa, Homo Sapiens
KKVKTPINK

SEQ ID NO: 384133 - protein, 9 aa, Homo Sapiens
GRPELCWPL

SEQ ID NO: 384134 - protein, 9 aa, Homo Sapiens
INDLQANSL

SEQ ID NO: 384135 - protein, 9 aa, Homo Sapiens
HTVILCDKL

SEQ ID NO: 384136 - protein, 9 aa, Homo Sapiens
SMRNEYLFD

SEQ ID NO: 384137 - protein, 9 aa, Homo Sapiens
LQAVLDIIT

SEQ ID NO: 384138 - protein, 9 aa, Homo Sapiens
YRNLVLLGL

SEQ ID NO: 384139 - protein, 9 aa, Homo Sapiens
AENGQANTV

SEQ ID NO: 384140 - protein, 9 aa, Homo Sapiens
RKTLNEHQI

SEQ ID NO: 384141 - protein, 9 aa, Homo Sapiens
VRKTEVLLK

SEQ ID NO: 384142 - protein, 9 aa, Homo Sapiens
PGVWSGGST

SEQ ID NO: 384143 - protein, 9 aa, Homo Sapiens
HGKKYHYVP

SEQ ID NO: 384144 - protein, 9 aa, Homo Sapiens
AFPVGYEYA

SEQ ID NO: 384145 - protein, 9 aa, Homo Sapiens
ILIWLLASL

SEQ ID NO: 384146 - protein, 9 aa, Homo Sapiens
QLCLVPLET

SEQ ID NO: 384147 - protein, 9 aa, Homo Sapiens
SCTAGSADT

SEQ ID NO: 384148 - protein, 9 aa, Homo Sapiens
KFIKIDQAW

SEQ ID NO: 384149 - protein, 9 aa, Homo Sapiens
WGKIWRLMG

SEQ ID NO: 384150 - protein, 9 aa, Homo Sapiens
IQNHTGEKP

SEQ ID NO: 384151 - protein, 9 aa, Homo Sapiens
CPVDGKVLE

SEQ ID NO: 384152 - protein, 9 aa, Homo Sapiens
GIEVVEVVH

SEQ ID NO: 384153 - protein, 9 aa, Homo Sapiens
TKRIQKQFF

SEQ ID NO: 384154 - protein, 9 aa, Homo Sapiens
LSVPSSNVR

SEQ ID NO: 384155 - protein, 9 aa, Homo Sapiens
LPLLAQLCL

SEQ ID NO: 384156 - protein, 9 aa, Homo Sapiens
FRCRNEKKR

SEQ ID NO: 384157 - protein, 9 aa, Homo Sapiens
DAKIIPSIV

SEQ ID NO: 384158 - protein, 9 aa, Homo Sapiens
NVQGDTWSL

SEQ ID NO: 384159 - protein, 9 aa, Homo Sapiens
FKSIKEVIK

SEQ ID NO: 384160 - protein, 9 aa, Homo Sapiens
GMGNSHSGH

SEQ ID NO: 384161 - protein, 9 aa, Homo Sapiens
HPPRKKTVL

SEQ ID NO: 384162 - protein, 9 aa, Homo Sapiens
DHFNLRARY

SEQ ID NO: 384163 - protein, 9 aa, Homo Sapiens
LNNLNMEND

SEQ ID NO: 384164 - protein, 9 aa, Homo Sapiens
ILWHQGCKT

SEQ ID NO: 384165 - protein, 9 aa, Homo Sapiens
QPVKLDPFG

SEQ ID NO: 384166 - protein, 9 aa, Homo Sapiens
PTEDINDRL

SEQ ID NO: 384167 - protein, 9 aa, Homo Sapiens
PYILQNQDD

SEQ ID NO: 384168 - protein, 9 aa, Homo Sapiens
VPASLHSLL

SEQ ID NO: 384169 - protein, 9 aa, Homo Sapiens
SLDKSEDSL

SEQ ID NO: 384170 - protein, 9 aa, Homo Sapiens
CQKEMGIQE

SEQ ID NO: 384171 - protein, 9 aa, Homo Sapiens
LLLTYLSFK

SEQ ID NO: 384172 - protein, 9 aa, Homo Sapiens
IVLFAYAQL

SEQ ID NO: 384173 - protein, 9 aa, Homo Sapiens
TYYAVWPNP

SEQ ID NO: 384174 - protein, 9 aa, Homo Sapiens
VNEWGRSGK

SEQ ID NO: 384175 - protein, 9 aa, Homo Sapiens
EPLLRPATQ

SEQ ID NO: 384176 - protein, 9 aa, Homo Sapiens
HSRQEYAHI

SEQ ID NO: 384177 - protein, 9 aa, Homo Sapiens
ALSDGNGSP

SEQ ID NO: 384178 - protein, 9 aa, Homo Sapiens
SHMQTHTGE

SEQ ID NO: 384179 - protein, 9 aa, Homo Sapiens
CGQSFIRAP

SEQ ID NO: 384180 - protein, 9 aa, Homo Sapiens
MLLQQSPTP

SEQ ID NO: 384181 - protein, 9 aa, Homo Sapiens
ILSESTPIC

SEQ ID NO: 384182 - protein, 9 aa, Homo Sapiens
WRFQGLAPG

SEQ ID NO: 384183 - protein, 9 aa, Homo Sapiens
ASPPADTEL

SEQ ID NO: 384184 - protein, 9 aa, Homo Sapiens
VWVVDVNDN

SEQ ID NO: 384185 - protein, 9 aa, Homo Sapiens
KALAFLMTY

SEQ ID NO: 384186 - protein, 9 aa, Homo Sapiens
CSGFIKPTK

SEQ ID NO: 384187 - protein, 9 aa, Homo Sapiens
KVTQQDAVC

SEQ ID NO: 384188 - protein, 9 aa, Homo Sapiens
LKLPNLSPL

SEQ ID NO: 384189 - protein, 9 aa, Homo Sapiens
GLSSRVQFQ

SEQ ID NO: 384190 - protein, 9 aa, Homo Sapiens
REVYFADRM

SEQ ID NO: 384191 - protein, 9 aa, Homo Sapiens
YVGDHQTLV

SEQ ID NO: 384192 - protein, 9 aa, Homo Sapiens
GAFFSTAIS

SEQ ID NO: 384193 - protein, 9 aa, Homo Sapiens
LIHKKIIDV

SEQ ID NO: 384194 - protein, 9 aa, Homo Sapiens
MDGSDKGIL

SEQ ID NO: 384195 - protein, 9 aa, Homo Sapiens
AKENEIKIN

SEQ ID NO: 384196 - protein, 9 aa, Homo Sapiens
TIMCYKNKW

SEQ ID NO: 384197 - protein, 9 aa, Homo Sapiens
FFDYEQFHE

SEQ ID NO: 384198 - protein, 9 aa, Homo Sapiens
LLALSQELE

SEQ ID NO: 384199 - protein, 9 aa, Homo Sapiens
QICPAFFLS

SEQ ID NO: 384200 - protein, 9 aa, Homo Sapiens
NYIKQRRSM

SEQ ID NO: 384201 - protein, 9 aa, Homo Sapiens
GPNVNCTGS

SEQ ID NO: 384202 - protein, 9 aa, Homo Sapiens
NLAIKYASH

SEQ ID NO: 384203 - protein, 9 aa, Homo Sapiens
RQNTLGHTT

SEQ ID NO: 384204 - protein, 9 aa, Homo Sapiens
RLFDNVTNK

SEQ ID NO: 384205 - protein, 9 aa, Homo Sapiens
SNQLHRVLK

SEQ ID NO: 384206 - protein, 9 aa, Homo Sapiens
DGKKSKLQI

SEQ ID NO: 384207 - protein, 9 aa, Homo Sapiens
FAQNLFAPL

SEQ ID NO: 384208 - protein, 9 aa, Homo Sapiens
SSQLIQHQI

SEQ ID NO: 384209 - protein, 9 aa, Homo Sapiens
AYLFSGQAV

SEQ ID NO: 384210 - protein, 9 aa, Homo Sapiens
VTAFCTLHV

SEQ ID NO: 384211 - protein, 9 aa, Homo Sapiens
WYRFLLMAR

SEQ ID NO: 384212 - protein, 9 aa, Homo Sapiens
PNKPLRSHI

SEQ ID NO: 384213 - protein, 9 aa, Homo Sapiens
DWEFGRETN

SEQ ID NO: 384214 - protein, 9 aa, Homo Sapiens
LEEEKITKI

SEQ ID NO: 384215 - protein, 9 aa, Homo Sapiens
NNYWSMSLG

SEQ ID NO: 384216 - protein, 9 aa, Homo Sapiens
WKNSICHNL

SEQ ID NO: 384217 - protein, 9 aa, Homo Sapiens
TVGKRKQNE

SEQ ID NO: 384218 - protein, 9 aa, Homo Sapiens
LENEKIHLI

SEQ ID NO: 384219 - protein, 9 aa, Homo Sapiens
NNKWSHMFL

SEQ ID NO: 384220 - protein, 9 aa, Homo Sapiens
ILIYLATGH

SEQ ID NO: 384221 - protein, 9 aa, Homo Sapiens
KAVLHYKHQ

SEQ ID NO: 384222 - protein, 9 aa, Homo Sapiens
LSESTPICT

SEQ ID NO: 384223 - protein, 9 aa, Homo Sapiens
KLKLPRKKS

SEQ ID NO: 384224 - protein, 9 aa, Homo Sapiens
FRMHEITHT

SEQ ID NO: 384225 - protein, 9 aa, Homo Sapiens
EFIMLMVRL

SEQ ID NO: 384226 - protein, 9 aa, Homo Sapiens
GSRAPHSNS

SEQ ID NO: 384227 - protein, 9 aa, Homo Sapiens
KIALEASFS

SEQ ID NO: 384228 - protein, 9 aa, Homo Sapiens
CSSLVTLPG

SEQ ID NO: 384229 - protein, 9 aa, Homo Sapiens
FIISKVWPT

SEQ ID NO: 384230 - protein, 9 aa, Homo Sapiens
PMCKSFSQP

SEQ ID NO: 384231 - protein, 9 aa, Homo Sapiens
IKLYDNNTG

SEQ ID NO: 384232 - protein, 9 aa, Homo Sapiens
GLWLPQLHI

SEQ ID NO: 384233 - protein, 9 aa, Homo Sapiens
GEDRAKGNI

SEQ ID NO: 384234 - protein, 9 aa, Homo Sapiens
YKELRNLAS

SEQ ID NO: 384235 - protein, 9 aa, Homo Sapiens
LHAESPDYL

SEQ ID NO: 384236 - protein, 9 aa, Homo Sapiens
FLLFMNVYI

SEQ ID NO: 384237 - protein, 9 aa, Homo Sapiens
EKSIIDEKL

SEQ ID NO: 384238 - protein, 9 aa, Homo Sapiens
FIKYDISFN

SEQ ID NO: 384239 - protein, 9 aa, Homo Sapiens
SVGQIIWQR

SEQ ID NO: 384240 - protein, 9 aa, Homo Sapiens
SMGQHSSVA

SEQ ID NO: 384241 - protein, 9 aa, Homo Sapiens
GIQYLHENK

SEQ ID NO: 384242 - protein, 9 aa, Homo Sapiens
PIRYVRSPL

SEQ ID NO: 384243 - protein, 9 aa, Homo Sapiens
SQNNLYRDV

SEQ ID NO: 384244 - protein, 9 aa, Homo Sapiens
DGTTPVWYG

SEQ ID NO: 384245 - protein, 9 aa, Homo Sapiens
SIELSQIKC

SEQ ID NO: 384246 - protein, 9 aa, Homo Sapiens
CTYYMSEFS

SEQ ID NO: 384247 - protein, 9 aa, Homo Sapiens
LLKRSQQNK

SEQ ID NO: 384248 - protein, 9 aa, Homo Sapiens
CGVDNVQGD

SEQ ID NO: 384249 - protein, 9 aa, Homo Sapiens
SGRSGKMWA

SEQ ID NO: 384250 - protein, 9 aa, Homo Sapiens
TFGFGKPEV

SEQ ID NO: 384251 - protein, 9 aa, Homo Sapiens
AEVVYYWTL

SEQ ID NO: 384252 - protein, 9 aa, Homo Sapiens
ILDSAETKK

SEQ ID NO: 384253 - protein, 9 aa, Homo Sapiens
TLFRCRNEK

SEQ ID NO: 384254 - protein, 9 aa, Homo Sapiens
AKVQIQTQP

SEQ ID NO: 384255 - protein, 9 aa, Homo Sapiens
LKAAMIKLV

SEQ ID NO: 384256 - protein, 9 aa, Homo Sapiens
TGCTGRMML

SEQ ID NO: 384257 - protein, 9 aa, Homo Sapiens
CTVIPLNKR

SEQ ID NO: 384258 - protein, 9 aa, Homo Sapiens
YENKLLNLT

SEQ ID NO: 384259 - protein, 9 aa, Homo Sapiens
NHLDLPPYK

SEQ ID NO: 384260 - protein, 9 aa, Homo Sapiens
LWHQGCKTE

SEQ ID NO: 384261 - protein, 9 aa, Homo Sapiens
EDKHSERIT

SEQ ID NO: 384262 - protein, 9 aa, Homo Sapiens
YSQRKLYKD

SEQ ID NO: 384263 - protein, 9 aa, Homo Sapiens
QRDSTIHVD

SEQ ID NO: 384264 - protein, 9 aa, Homo Sapiens
KEQKELFAE

SEQ ID NO: 384265 - protein, 9 aa, Homo Sapiens
TGPKGVIHD

SEQ ID NO: 384266 - protein, 9 aa, Homo Sapiens
VFNIDSNNL

SEQ ID NO: 384267 - protein, 9 aa, Homo Sapiens
ALAPWAWRN

SEQ ID NO: 384268 - protein, 9 aa, Homo Sapiens
SSNLMEHKI

SEQ ID NO: 384269 - protein, 9 aa, Homo Sapiens
RDLAAQNIL

SEQ ID NO: 384270 - protein, 9 aa, Homo Sapiens
NLPEIFFFV

SEQ ID NO: 384271 - protein, 9 aa, Homo Sapiens
WTYGFIQAK

SEQ ID NO: 384272 - protein, 9 aa, Homo Sapiens
ECVQKFIKI

SEQ ID NO: 384273 - protein, 9 aa, Homo Sapiens
GISSNQLHR

SEQ ID NO: 384274 - protein, 9 aa, Homo Sapiens
PSSSSKYRP

SEQ ID NO: 384275 - protein, 9 aa, Homo Sapiens
GQDEKDLEF

SEQ ID NO: 384276 - protein, 9 aa, Homo Sapiens
TMDNSTGCT

SEQ ID NO: 384277 - protein, 9 aa, Homo Sapiens
MCRHPPRKK

SEQ ID NO: 384278 - protein, 9 aa, Homo Sapiens
RYVRSPLLM

SEQ ID NO: 384279 - protein, 9 aa, Homo Sapiens
IHTSTYNIL

SEQ ID NO: 384280 - protein, 9 aa, Homo Sapiens
MRLGKDTIV

SEQ ID NO: 384281 - protein, 9 aa, Homo Sapiens
NKILLAYRV

SEQ ID NO: 384282 - protein, 9 aa, Homo Sapiens
TYNILTFLP

SEQ ID NO: 384283 - protein, 9 aa, Homo Sapiens
VGAFFSTAI

SEQ ID NO: 384284 - protein, 9 aa, Homo Sapiens
TFRFKLGGG

SEQ ID NO: 384285 - protein, 9 aa, Homo Sapiens
GEEDTQAFN

SEQ ID NO: 384286 - protein, 9 aa, Homo Sapiens
NLANNFPAH

SEQ ID NO: 384287 - protein, 9 aa, Homo Sapiens
WTLLKQVHP

SEQ ID NO: 384288 - protein, 9 aa, Homo Sapiens
ELSWQKRTG

SEQ ID NO: 384289 - protein, 9 aa, Homo Sapiens
HALFLLFVA

SEQ ID NO: 384290 - protein, 9 aa, Homo Sapiens
SCRYLNNSL

SEQ ID NO: 384291 - protein, 9 aa, Homo Sapiens
IPSIIWYLY

SEQ ID NO: 384292 - protein, 9 aa, Homo Sapiens
EGILQLRHT

SEQ ID NO: 384293 - protein, 9 aa, Homo Sapiens
HKLRYWKEN

SEQ ID NO: 384294 - protein, 9 aa, Homo Sapiens
FNHLDLPPY

SEQ ID NO: 384295 - protein, 9 aa, Homo Sapiens
SKQSTPSDT

SEQ ID NO: 384296 - protein, 9 aa, Homo Sapiens
ACPPHTVKQ

SEQ ID NO: 384297 - protein, 9 aa, Homo Sapiens
TLNYFVIPS

SEQ ID NO: 384298 - protein, 9 aa, Homo Sapiens
LNVTHKAYW

SEQ ID NO: 384299 - protein, 9 aa, Homo Sapiens
LFELLNLLA

SEQ ID NO: 384300 - protein, 9 aa, Homo Sapiens
MPRATHFLL

SEQ ID NO: 384301 - protein, 9 aa, Homo Sapiens
IRMATISES

SEQ ID NO: 384302 - protein, 9 aa, Homo Sapiens
QQFPFLEMK

SEQ ID NO: 384303 - protein, 9 aa, Homo Sapiens
FKTNDGKRE

SEQ ID NO: 384304 - protein, 9 aa, Homo Sapiens
GEPGQLLEL

SEQ ID NO: 384305 - protein, 9 aa, Homo Sapiens
NSLKKKQKC

SEQ ID NO: 384306 - protein, 9 aa, Homo Sapiens
MNVYIEDSY

SEQ ID NO: 384307 - protein, 9 aa, Homo Sapiens
RFLLMARFS

SEQ ID NO: 384308 - protein, 9 aa, Homo Sapiens
TDHFNLRAR

SEQ ID NO: 384309 - protein, 9 aa, Homo Sapiens
LTAIKLFDI

SEQ ID NO: 384310 - protein, 9 aa, Homo Sapiens
GPAQKKPPS

SEQ ID NO: 384311 - protein, 9 aa, Homo Sapiens
EALCVVKIL

SEQ ID NO: 384312 - protein, 9 aa, Homo Sapiens
SRAEARWDA

SEQ ID NO: 384313 - protein, 9 aa, Homo Sapiens
IKYDISFNV

SEQ ID NO: 384314 - protein, 9 aa, Homo Sapiens
LGRLKALSD

SEQ ID NO: 384315 - protein, 9 aa, Homo Sapiens
FFAPSWDMY

SEQ ID NO: 384316 - protein, 9 aa, Homo Sapiens
CYHQFSTPF

SEQ ID NO: 384317 - protein, 9 aa, Homo Sapiens
HGNIADASS

SEQ ID NO: 384318 - protein, 9 aa, Homo Sapiens
AGSADTHSN

SEQ ID NO: 384319 - protein, 9 aa, Homo Sapiens
PDIMADISP

SEQ ID NO: 384320 - protein, 9 aa, Homo Sapiens
KGPSYSLHS

SEQ ID NO: 384321 - protein, 9 aa, Homo Sapiens
ISQLIDELA

SEQ ID NO: 384322 - protein, 9 aa, Homo Sapiens
ALSMMRLYS

SEQ ID NO: 384323 - protein, 9 aa, Homo Sapiens
PSVNYFISA

SEQ ID NO: 384324 - protein, 9 aa, Homo Sapiens
VGSIAKLSD

SEQ ID NO: 384325 - protein, 9 aa, Homo Sapiens
KNKNSCLAQ

SEQ ID NO: 384326 - protein, 9 aa, Homo Sapiens
GKNKDNYSN

SEQ ID NO: 384327 - protein, 9 aa, Homo Sapiens
GPPFHLNKY

SEQ ID NO: 384328 - protein, 9 aa, Homo Sapiens
AIAANISIG

SEQ ID NO: 384329 - protein, 9 aa, Homo Sapiens
YHMDVFHFM

SEQ ID NO: 384330 - protein, 9 aa, Homo Sapiens
EITHTGEKP

SEQ ID NO: 384331 - protein, 9 aa, Homo Sapiens
AAHATRIPL

SEQ ID NO: 384332 - protein, 9 aa, Homo Sapiens
KASTIFNCR

SEQ ID NO: 384333 - protein, 9 aa, Homo Sapiens
EHQILHRRE

SEQ ID NO: 384334 - protein, 9 aa, Homo Sapiens
SSSLVPISH

SEQ ID NO: 384335 - protein, 9 aa, Homo Sapiens
DSSLSVLHS

SEQ ID NO: 384336 - protein, 9 aa, Homo Sapiens
CGQSFSRYV

SEQ ID NO: 384337 - protein, 9 aa, Homo Sapiens
EMSRNLTQS

SEQ ID NO: 384338 - protein, 9 aa, Homo Sapiens
QRLQIHNPL

SEQ ID NO: 384339 - protein, 9 aa, Homo Sapiens
NTLNIHLFS

SEQ ID NO: 384340 - protein, 9 aa, Homo Sapiens
ISETQKADV

SEQ ID NO: 384341 - protein, 9 aa, Homo Sapiens
SILVWVVDV

SEQ ID NO: 384342 - protein, 9 aa, Homo Sapiens
AISNILSLL

SEQ ID NO: 384343 - protein, 9 aa, Homo Sapiens
SKRSMNEPY

SEQ ID NO: 384344 - protein, 9 aa, Homo Sapiens
MSKMKMGRY

SEQ ID NO: 384345 - protein, 9 aa, Homo Sapiens
PGGKDHLVW

SEQ ID NO: 384346 - protein, 9 aa, Homo Sapiens
PLLDKVRPH

SEQ ID NO: 384347 - protein, 9 aa, Homo Sapiens
AATYIALNT

SEQ ID NO: 384348 - protein, 9 aa, Homo Sapiens
KWYMDYSVG

SEQ ID NO: 384349 - protein, 9 aa, Homo Sapiens
KAFRRSSAL

SEQ ID NO: 384350 - protein, 9 aa, Homo Sapiens
GPTSGYHAK

SEQ ID NO: 384351 - protein, 9 aa, Homo Sapiens
CKKEGYNLL

SEQ ID NO: 384352 - protein, 9 aa, Homo Sapiens
VQNIWVVGA

SEQ ID NO: 384353 - protein, 9 aa, Homo Sapiens
EKKLQMDLE

SEQ ID NO: 384354 - protein, 9 aa, Homo Sapiens
KRNELKSCR

SEQ ID NO: 384355 - protein, 9 aa, Homo Sapiens
GKIWRLMGK

SEQ ID NO: 384356 - protein, 9 aa, Homo Sapiens
KAERSACTY

SEQ ID NO: 384357 - protein, 9 aa, Homo Sapiens
EQVTATPQI

SEQ ID NO: 384358 - protein, 9 aa, Homo Sapiens
ELDEQQQKR

SEQ ID NO: 384359 - protein, 9 aa, Homo Sapiens
STPICTSDV

SEQ ID NO: 384360 - protein, 9 aa, Homo Sapiens
EETFRFKLG

SEQ ID NO: 384361 - protein, 9 aa, Homo Sapiens
RLKLCDGFS

SEQ ID NO: 384362 - protein, 9 aa, Homo Sapiens
DCGFLALIE

SEQ ID NO: 384363 - protein, 9 aa, Homo Sapiens
RPCYPFWDK

SEQ ID NO: 384364 - protein, 9 aa, Homo Sapiens
FTQDHKAAV

SEQ ID NO: 384365 - protein, 9 aa, Homo Sapiens
RKLMELRLR

SEQ ID NO: 384366 - protein, 9 aa, Homo Sapiens
GPFSCSSCG

SEQ ID NO: 384367 - protein, 9 aa, Homo Sapiens
YSPGRTYFR

SEQ ID NO: 384368 - protein, 9 aa, Homo Sapiens
QNVASLAWK

SEQ ID NO: 384369 - protein, 9 aa, Homo Sapiens
SVYENKLLN

SEQ ID NO: 384370 - protein, 9 aa, Homo Sapiens
PLLAQLCLV

SEQ ID NO: 384371 - protein, 9 aa, Homo Sapiens
ALFSSFEIQ

SEQ ID NO: 384372 - protein, 9 aa, Homo Sapiens
KSIATVVPG

SEQ ID NO: 384373 - protein, 9 aa, Homo Sapiens
EAKENEIKI

SEQ ID NO: 384374 - protein, 9 aa, Homo Sapiens
FAISNILSL

SEQ ID NO: 384375 - protein, 9 aa, Homo Sapiens
KKKLQTILQ

SEQ ID NO: 384376 - protein, 9 aa, Homo Sapiens
MQELERKHV

SEQ ID NO: 384377 - protein, 9 aa, Homo Sapiens
TRTGQGVPV

SEQ ID NO: 384378 - protein, 9 aa, Homo Sapiens
KEAEKLLPL

SEQ ID NO: 384379 - protein, 9 aa, Homo Sapiens
SPVNTNNQA

SEQ ID NO: 384380 - protein, 9 aa, Homo Sapiens
CTYKELRNL

SEQ ID NO: 384381 - protein, 9 aa, Homo Sapiens
FSIILQNVS

SEQ ID NO: 384382 - protein, 9 aa, Homo Sapiens
PRWGRQAGG

SEQ ID NO: 384383 - protein, 9 aa, Homo Sapiens
TDPQNLLLS

SEQ ID NO: 384384 - protein, 9 aa, Homo Sapiens
DWTKLGKVY

SEQ ID NO: 384385 - protein, 9 aa, Homo Sapiens
LMPYHIQRT

SEQ ID NO: 384386 - protein, 9 aa, Homo Sapiens
NNFPAHIFE

SEQ ID NO: 384387 - protein, 9 aa, Homo Sapiens
IRRNQDKFS

SEQ ID NO: 384388 - protein, 9 aa, Homo Sapiens
PLAFVQKSA

SEQ ID NO: 384389 - protein, 9 aa, Homo Sapiens
QPPGVWSGG

SEQ ID NO: 384390 - protein, 9 aa, Homo Sapiens
NMDMCCAAS

SEQ ID NO: 384391 - protein, 9 aa, Homo Sapiens
LLFICKVAQ

SEQ ID NO: 384392 - protein, 9 aa, Homo Sapiens
LLNLGVLVP

SEQ ID NO: 384393 - protein, 9 aa, Homo Sapiens
NFVELLGGT

SEQ ID NO: 384394 - protein, 9 aa, Homo Sapiens
LQIQTLFQR

SEQ ID NO: 384395 - protein, 9 aa, Homo Sapiens
KRSRLEEPV

SEQ ID NO: 384396 - protein, 9 aa, Homo Sapiens
ELSCEGDDK

SEQ ID NO: 384397 - protein, 9 aa, Homo Sapiens
SSLPEINQS

SEQ ID NO: 384398 - protein, 9 aa, Homo Sapiens
CKIPPLLAL

SEQ ID NO: 384399 - protein, 9 aa, Homo Sapiens
LNNSRFAQD

SEQ ID NO: 384400 - protein, 9 aa, Homo Sapiens
PRITTLCLM

SEQ ID NO: 384401 - protein, 9 aa, Homo Sapiens
LWWYYLLGW

SEQ ID NO: 384402 - protein, 9 aa, Homo Sapiens
QHINFMKTS

SEQ ID NO: 384403 - protein, 9 aa, Homo Sapiens
AVCTIYGDQ

SEQ ID NO: 384404 - protein, 9 aa, Homo Sapiens
MDICKQEDK

SEQ ID NO: 384405 - protein, 9 aa, Homo Sapiens
FVQKSAAQT

SEQ ID NO: 384406 - protein, 9 aa, Homo Sapiens
MNLANNFPA

SEQ ID NO: 384407 - protein, 9 aa, Homo Sapiens
SVVTSEINQ

SEQ ID NO: 384408 - protein, 9 aa, Homo Sapiens
TVIQSGIAY

SEQ ID NO: 384409 - protein, 9 aa, Homo Sapiens
LQKNILEME

SEQ ID NO: 384410 - protein, 9 aa, Homo Sapiens
VSTPGPRRK

SEQ ID NO: 384411 - protein, 9 aa, Homo Sapiens
LTYEEQNLV

SEQ ID NO: 384412 - protein, 9 aa, Homo Sapiens
VAGEIDAVT

SEQ ID NO: 384413 - protein, 9 aa, Homo Sapiens
IQMKNAMFN

SEQ ID NO: 384414 - protein, 9 aa, Homo Sapiens
SNLIVHKII

SEQ ID NO: 384415 - protein, 9 aa, Homo Sapiens
LWLPQLHIG

SEQ ID NO: 384416 - protein, 9 aa, Homo Sapiens
FEEEEELQH

SEQ ID NO: 384417 - protein, 9 aa, Homo Sapiens
SLISFFQKR

SEQ ID NO: 384418 - protein, 9 aa, Homo Sapiens
NMEVPDTEG

SEQ ID NO: 384419 - protein, 9 aa, Homo Sapiens
LYGEDRGLI

SEQ ID NO: 384420 - protein, 9 aa, Homo Sapiens
GQIIWQRDF

SEQ ID NO: 384421 - protein, 9 aa, Homo Sapiens
IFLNSIKSK

SEQ ID NO: 384422 - protein, 9 aa, Homo Sapiens
ESTSSESKP

SEQ ID NO: 384423 - protein, 9 aa, Homo Sapiens
KLTDYFTEV

SEQ ID NO: 384424 - protein, 9 aa, Homo Sapiens
AGKGYETGH

SEQ ID NO: 384425 - protein, 9 aa, Homo Sapiens
CYRYRCTAR

SEQ ID NO: 384426 - protein, 9 aa, Homo Sapiens
QNDNQETAA

SEQ ID NO: 384427 - protein, 9 aa, Homo Sapiens
KHDYHIALF

SEQ ID NO: 384428 - protein, 9 aa, Homo Sapiens
AVRHFQAQL

SEQ ID NO: 384429 - protein, 9 aa, Homo Sapiens
SEHTIHYVL

SEQ ID NO: 384430 - protein, 9 aa, Homo Sapiens
EERHTLFQT

SEQ ID NO: 384431 - protein, 9 aa, Homo Sapiens
IYFREATMK

SEQ ID NO: 384432 - protein, 9 aa, Homo Sapiens
SETQKADVQ

SEQ ID NO: 384433 - protein, 9 aa, Homo Sapiens
GRIPLLLTY

SEQ ID NO: 384434 - protein, 9 aa, Homo Sapiens
NYWSMSLGI

SEQ ID NO: 384435 - protein, 9 aa, Homo Sapiens
GSSGYTALH

SEQ ID NO: 384436 - protein, 9 aa, Homo Sapiens
FEEFIMLMV

SEQ ID NO: 384437 - protein, 9 aa, Homo Sapiens
TYLTVIDKD

SEQ ID NO: 384438 - protein, 9 aa, Homo Sapiens
PCTACPLCH

SEQ ID NO: 384439 - protein, 9 aa, Homo Sapiens
YLATGHREE

SEQ ID NO: 384440 - protein, 9 aa, Homo Sapiens
QHISVIKEN

SEQ ID NO: 384441 - protein, 9 aa, Homo Sapiens
TILFIFQML

SEQ ID NO: 384442 - protein, 9 aa, Homo Sapiens
KENKKEPEP

SEQ ID NO: 384443 - protein, 9 aa, Homo Sapiens
LTLCPDSPP

SEQ ID NO: 384444 - protein, 9 aa, Homo Sapiens
EELNLMTLG

SEQ ID NO: 384445 - protein, 9 aa, Homo Sapiens
WLSLPLSLI

SEQ ID NO: 384446 - protein, 9 aa, Homo Sapiens
FNVDSGREF

SEQ ID NO: 384447 - protein, 9 aa, Homo Sapiens
FLTLQFVFC

SEQ ID NO: 384448 - protein, 9 aa, Homo Sapiens
KVCALNKLV

SEQ ID NO: 384449 - protein, 9 aa, Homo Sapiens
SAIPPSSRD

SEQ ID NO: 384450 - protein, 9 aa, Homo Sapiens
GPPGLGGSP

SEQ ID NO: 384451 - protein, 9 aa, Homo Sapiens
SPTTADNTS

SEQ ID NO: 384452 - protein, 9 aa, Homo Sapiens
QELNKLHEE

SEQ ID NO: 384453 - protein, 9 aa, Homo Sapiens
IAYIRKALA

SEQ ID NO: 384454 - protein, 9 aa, Homo Sapiens
TPQIAKAEQ

SEQ ID NO: 384455 - protein, 9 aa, Homo Sapiens
GDRQENDKD

SEQ ID NO: 384456 - protein, 9 aa, Homo Sapiens
LERQHILQE

SEQ ID NO: 384457 - protein, 9 aa, Homo Sapiens
RITYSDTDS

SEQ ID NO: 384458 - protein, 9 aa, Homo Sapiens
EMFTTSNRI

SEQ ID NO: 384459 - protein, 9 aa, Homo Sapiens
TGLCIVELT

SEQ ID NO: 384460 - protein, 9 aa, Homo Sapiens
HLRASMNKL

SEQ ID NO: 384461 - protein, 9 aa, Homo Sapiens
SGDGGYVKD

SEQ ID NO: 384462 - protein, 9 aa, Homo Sapiens
KQNAISSSC

SEQ ID NO: 384463 - protein, 9 aa, Homo Sapiens
ERTRARRDN

SEQ ID NO: 384464 - protein, 9 aa, Homo Sapiens
PDSPPNLKE

SEQ ID NO: 384465 - protein, 9 aa, Homo Sapiens
TFRKLIGSF

SEQ ID NO: 384466 - protein, 9 aa, Homo Sapiens
KCQKIIGKN

SEQ ID NO: 384467 - protein, 9 aa, Homo Sapiens
ILQIHTSEG

SEQ ID NO: 384468 - protein, 9 aa, Homo Sapiens
AILFTLFAK

SEQ ID NO: 384469 - protein, 9 aa, Homo Sapiens
HSVCEEKME

SEQ ID NO: 384470 - protein, 9 aa, Homo Sapiens
KIDLSVLED

SEQ ID NO: 384471 - protein, 9 aa, Homo Sapiens
SEGFQTFSK

SEQ ID NO: 384472 - protein, 9 aa, Homo Sapiens
MEEWITTLE

SEQ ID NO: 384473 - protein, 9 aa, Homo Sapiens
EKCAKHKRF

SEQ ID NO: 384474 - protein, 9 aa, Homo Sapiens
AGWKNSICH

SEQ ID NO: 384475 - protein, 9 aa, Homo Sapiens
CDADLNEWT

SEQ ID NO: 384476 - protein, 9 aa, Homo Sapiens
LEKAEVTKR

SEQ ID NO: 384477 - protein, 9 aa, Homo Sapiens
NMAAVRHFQ

SEQ ID NO: 384478 - protein, 9 aa, Homo Sapiens
AFEYFSRSL

SEQ ID NO: 384479 - protein, 9 aa, Homo Sapiens
IEATMKIIA

SEQ ID NO: 384480 - protein, 9 aa, Homo Sapiens
SSCPKQNAI

SEQ ID NO: 384481 - protein, 9 aa, Homo Sapiens
IGDWLVFDN

SEQ ID NO: 384482 - protein, 9 aa, Homo Sapiens
RINNEKSKL

SEQ ID NO: 384483 - protein, 9 aa, Homo Sapiens
VFCEITQHQ

SEQ ID NO: 384484 - protein, 9 aa, Homo Sapiens
LGSYHMPYE

SEQ ID NO: 384485 - protein, 9 aa, Homo Sapiens
TAFCTLHVT

SEQ ID NO: 384486 - protein, 9 aa, Homo Sapiens
EYFSRSLPE

SEQ ID NO: 384487 - protein, 9 aa, Homo Sapiens
RDSTIHVDE

SEQ ID NO: 384488 - protein, 9 aa, Homo Sapiens
RVYIGKIYH

SEQ ID NO: 384489 - protein, 9 aa, Homo Sapiens
IILNGEEII

SEQ ID NO: 384490 - protein, 9 aa, Homo Sapiens
NQLDPGTLI

SEQ ID NO: 384491 - protein, 9 aa, Homo Sapiens
LDSHAEALC

SEQ ID NO: 384492 - protein, 9 aa, Homo Sapiens
ALEEEKITK

SEQ ID NO: 384493 - protein, 9 aa, Homo Sapiens
IERICFLLQ

SEQ ID NO: 384494 - protein, 9 aa, Homo Sapiens
DPFNVDSGR

SEQ ID NO: 384495 - protein, 9 aa, Homo Sapiens
KKHDLRYIE

SEQ ID NO: 384496 - protein, 9 aa, Homo Sapiens
GLNQHRIIH

SEQ ID NO: 384497 - protein, 9 aa, Homo Sapiens
IKRYCCNGK

SEQ ID NO: 384498 - protein, 9 aa, Homo Sapiens
PKRPPLREL

SEQ ID NO: 384499 - protein, 9 aa, Homo Sapiens
SKPKKTSGS

SEQ ID NO: 384500 - protein, 9 aa, Homo Sapiens
LFLEPTQKD

SEQ ID NO: 384501 - protein, 9 aa, Homo Sapiens
GRRFWDKSS

SEQ ID NO: 384502 - protein, 9 aa, Homo Sapiens
GYNLLTIKD

SEQ ID NO: 384503 - protein, 9 aa, Homo Sapiens
INLYGEDRG

SEQ ID NO: 384504 - protein, 9 aa, Homo Sapiens
HAAAPAVAP

SEQ ID NO: 384505 - protein, 9 aa, Homo Sapiens
RLQIHNPLY

SEQ ID NO: 384506 - protein, 9 aa, Homo Sapiens
IDLRDKFNE

SEQ ID NO: 384507 - protein, 9 aa, Homo Sapiens
NYLYELLAA

SEQ ID NO: 384508 - protein, 9 aa, Homo Sapiens
KPALPLALT

SEQ ID NO: 384509 - protein, 9 aa, Homo Sapiens
ESTQSIQEL

SEQ ID NO: 384510 - protein, 9 aa, Homo Sapiens
EDDVIDGCP

SEQ ID NO: 384511 - protein, 9 aa, Homo Sapiens
NIRAFMGVN

SEQ ID NO: 384512 - protein, 9 aa, Homo Sapiens
VEISETQKA

SEQ ID NO: 384513 - protein, 9 aa, Homo Sapiens
EPTQKDIAL

SEQ ID NO: 384514 - protein, 9 aa, Homo Sapiens
PRWIFCPFL

SEQ ID NO: 384515 - protein, 9 aa, Homo Sapiens
VYYWTLGKN

SEQ ID NO: 384516 - protein, 9 aa, Homo Sapiens
CDLETLINI

SEQ ID NO: 384517 - protein, 9 aa, Homo Sapiens
VWTLPRNGL

SEQ ID NO: 384518 - protein, 9 aa, Homo Sapiens
AEIQLFVLE

SEQ ID NO: 384519 - protein, 9 aa, Homo Sapiens
VYIEDSYVL

SEQ ID NO: 384520 - protein, 9 aa, Homo Sapiens
QQELVLLKI

SEQ ID NO: 384521 - protein, 9 aa, Homo Sapiens
QEPVRRPMC

SEQ ID NO: 384522 - protein, 9 aa, Homo Sapiens
EKLPSCFNY

SEQ ID NO: 384523 - protein, 9 aa, Homo Sapiens
QDNKLILRL

SEQ ID NO: 384524 - protein, 9 aa, Homo Sapiens
YGSVLDNEI

SEQ ID NO: 384525 - protein, 9 aa, Homo Sapiens
LLSLCHPNI

SEQ ID NO: 384526 - protein, 9 aa, Homo Sapiens
LSQCNCINL

SEQ ID NO: 384527 - protein, 9 aa, Homo Sapiens
SSEDVKLES

SEQ ID NO: 384528 - protein, 9 aa, Homo Sapiens
INHTGEKPY

SEQ ID NO: 384529 - protein, 9 aa, Homo Sapiens
LVPDINMEE

SEQ ID NO: 384530 - protein, 9 aa, Homo Sapiens
GAMAHVGSC

SEQ ID NO: 384531 - protein, 9 aa, Homo Sapiens
EIISFTQCC

SEQ ID NO: 384532 - protein, 9 aa, Homo Sapiens
LVASKVFRS

SEQ ID NO: 384533 - protein, 9 aa, Homo Sapiens
HSWKDLFQH

SEQ ID NO: 384534 - protein, 9 aa, Homo Sapiens
AFGCILSEL

SEQ ID NO: 384535 - protein, 9 aa, Homo Sapiens
HCWCKEGYQ

SEQ ID NO: 384536 - protein, 9 aa, Homo Sapiens
NYFKPYLGR

SEQ ID NO: 384537 - protein, 9 aa, Homo Sapiens
CLLFMAATF

SEQ ID NO: 384538 - protein, 9 aa, Homo Sapiens
AARETKIIL

SEQ ID NO: 384539 - protein, 9 aa, Homo Sapiens
GKYYGQFGL

SEQ ID NO: 384540 - protein, 9 aa, Homo Sapiens
IASLACADL

SEQ ID NO: 384541 - protein, 9 aa, Homo Sapiens
KNTYLTVID

SEQ ID NO: 384542 - protein, 9 aa, Homo Sapiens
SCEGDDKDT

SEQ ID NO: 384543 - protein, 9 aa, Homo Sapiens
KVLGRLKAL

SEQ ID NO: 384544 - protein, 9 aa, Homo Sapiens
VAMKVDNFK

SEQ ID NO: 384545 - protein, 9 aa, Homo Sapiens
VTALNRLFD

SEQ ID NO: 384546 - protein, 9 aa, Homo Sapiens
RYLEKAEVT

SEQ ID NO: 384547 - protein, 9 aa, Homo Sapiens
HLLLHTEVR

SEQ ID NO: 384548 - protein, 9 aa, Homo Sapiens
PQLNLKVIQ

SEQ ID NO: 384549 - protein, 9 aa, Homo Sapiens
KESTKNVQD

SEQ ID NO: 384550 - protein, 9 aa, Homo Sapiens
CTIYGDQHY

SEQ ID NO: 384551 - protein, 9 aa, Homo Sapiens
KLCKREQKQ

SEQ ID NO: 384552 - protein, 9 aa, Homo Sapiens
AYPNTLEDF

SEQ ID NO: 384553 - protein, 9 aa, Homo Sapiens
FNLRARYHM

SEQ ID NO: 384554 - protein, 9 aa, Homo Sapiens
NKENAKAVA

SEQ ID NO: 384555 - protein, 9 aa, Homo Sapiens
FIKIFIIYS

SEQ ID NO: 384556 - protein, 9 aa, Homo Sapiens
LKFKSIKEV

SEQ ID NO: 384557 - protein, 9 aa, Homo Sapiens
TYNKVVFRK

SEQ ID NO: 384558 - protein, 9 aa, Homo Sapiens
EDTSNEGEN

SEQ ID NO: 384559 - protein, 9 aa, Homo Sapiens
SVGVIIFEM

SEQ ID NO: 384560 - protein, 9 aa, Homo Sapiens
FIKCHGRGT

SEQ ID NO: 384561 - protein, 9 aa, Homo Sapiens
NVNCTGSSG

SEQ ID NO: 384562 - protein, 9 aa, Homo Sapiens
DYRQAEVEI

SEQ ID NO: 384563 - protein, 9 aa, Homo Sapiens
YSAIPPSSR

SEQ ID NO: 384564 - protein, 9 aa, Homo Sapiens
CPCHTQTLP

SEQ ID NO: 384565 - protein, 9 aa, Homo Sapiens
SLQKINTRT

SEQ ID NO: 384566 - protein, 9 aa, Homo Sapiens
LSLDKSEDS

SEQ ID NO: 384567 - protein, 9 aa, Homo Sapiens
EYSHIIVGL

SEQ ID NO: 384568 - protein, 9 aa, Homo Sapiens
SKNFPNNMS

SEQ ID NO: 384569 - protein, 9 aa, Homo Sapiens
NEFITKGQT

SEQ ID NO: 384570 - protein, 9 aa, Homo Sapiens
GFADEDINT

SEQ ID NO: 384571 - protein, 9 aa, Homo Sapiens
KMQLEQEYE

SEQ ID NO: 384572 - protein, 9 aa, Homo Sapiens
RRIRFWRFQ

SEQ ID NO: 384573 - protein, 9 aa, Homo Sapiens
AEVEKATVP

SEQ ID NO: 384574 - protein, 9 aa, Homo Sapiens
EESLNGIYV

SEQ ID NO: 384575 - protein, 9 aa, Homo Sapiens
IHPHINMDG

SEQ ID NO: 384576 - protein, 9 aa, Homo Sapiens
VLYACERRI

SEQ ID NO: 384577 - protein, 9 aa, Homo Sapiens
CQKRLHQLK

SEQ ID NO: 384578 - protein, 9 aa, Homo Sapiens
MSQVQTRMQ

SEQ ID NO: 384579 - protein, 9 aa, Homo Sapiens
SVIKENSLP

SEQ ID NO: 384580 - protein, 9 aa, Homo Sapiens
VPFNLPEIF

SEQ ID NO: 384581 - protein, 9 aa, Homo Sapiens
GDDYCSLCS

SEQ ID NO: 384582 - protein, 9 aa, Homo Sapiens
VQLCQIKKK

SEQ ID NO: 384583 - protein, 9 aa, Homo Sapiens
SAEDSTGAC

SEQ ID NO: 384584 - protein, 9 aa, Homo Sapiens
RCRCYYGSD

SEQ ID NO: 384585 - protein, 9 aa, Homo Sapiens
NINPKPCTP

SEQ ID NO: 384586 - protein, 9 aa, Homo Sapiens
ELEVINLQN

SEQ ID NO: 384587 - protein, 9 aa, Homo Sapiens
TDYFTEVKV

SEQ ID NO: 384588 - protein, 9 aa, Homo Sapiens
HLITHTGEK

SEQ ID NO: 384589 - protein, 9 aa, Homo Sapiens
CGPGAQGAQ

SEQ ID NO: 384590 - protein, 9 aa, Homo Sapiens
DSNNFKSVK

SEQ ID NO: 384591 - protein, 9 aa, Homo Sapiens
GITTQSLGV

SEQ ID NO: 384592 - protein, 9 aa, Homo Sapiens
NNREEMHIR

SEQ ID NO: 384593 - protein, 9 aa, Homo Sapiens
LERTRARRD

SEQ ID NO: 384594 - protein, 9 aa, Homo Sapiens
HCPKCNLLQ

SEQ ID NO: 384595 - protein, 9 aa, Homo Sapiens
DISGNLASV

SEQ ID NO: 384596 - protein, 9 aa, Homo Sapiens
GKTGVSFVL

SEQ ID NO: 384597 - protein, 9 aa, Homo Sapiens
FSKLGLSQS

SEQ ID NO: 384598 - protein, 9 aa, Homo Sapiens
YCVTVPKDY

SEQ ID NO: 384599 - protein, 9 aa, Homo Sapiens
KIIWQLGTL

SEQ ID NO: 384600 - protein, 9 aa, Homo Sapiens
SDGNGSPGI

SEQ ID NO: 384601 - protein, 9 aa, Homo Sapiens
TRVAYLFSG

SEQ ID NO: 384602 - protein, 9 aa, Homo Sapiens
IAEMGKPVI

SEQ ID NO: 384603 - protein, 9 aa, Homo Sapiens
EARWDAAKV

SEQ ID NO: 384604 - protein, 9 aa, Homo Sapiens
IYHVFQSRN

SEQ ID NO: 384605 - protein, 9 aa, Homo Sapiens
QTLDNLINP

SEQ ID NO: 384606 - protein, 9 aa, Homo Sapiens
HSFQIHEIT

SEQ ID NO: 384607 - protein, 9 aa, Homo Sapiens
DVRCCCAQE

SEQ ID NO: 384608 - protein, 9 aa, Homo Sapiens
SEINQLRGE

SEQ ID NO: 384609 - protein, 9 aa, Homo Sapiens
RALSTANKN

SEQ ID NO: 384610 - protein, 9 aa, Homo Sapiens
LSPLDKQQR

SEQ ID NO: 384611 - protein, 9 aa, Homo Sapiens
SIVTETYGN

SEQ ID NO: 384612 - protein, 9 aa, Homo Sapiens
ELDQYHGQD

SEQ ID NO: 384613 - protein, 9 aa, Homo Sapiens
RFLELVQLN

SEQ ID NO: 384614 - protein, 9 aa, Homo Sapiens
HYFAQNLFA

SEQ ID NO: 384615 - protein, 9 aa, Homo Sapiens
RACAVVFDS

SEQ ID NO: 384616 - protein, 9 aa, Homo Sapiens
CGTNLVLSH

SEQ ID NO: 384617 - protein, 9 aa, Homo Sapiens
IIELEVENR

SEQ ID NO: 384618 - protein, 9 aa, Homo Sapiens
IMSYELLRK

SEQ ID NO: 384619 - protein, 9 aa, Homo Sapiens
LEDFQNSCQ

SEQ ID NO: 384620 - protein, 9 aa, Homo Sapiens
SDPEPERLR

SEQ ID NO: 384621 - protein, 9 aa, Homo Sapiens
EYQLVAFDP

SEQ ID NO: 384622 - protein, 9 aa, Homo Sapiens
HAGQLKHGD

SEQ ID NO: 384623 - protein, 9 aa, Homo Sapiens
ASELNLQHD

SEQ ID NO: 384624 - protein, 9 aa, Homo Sapiens
VEVSPLEND

SEQ ID NO: 384625 - protein, 9 aa, Homo Sapiens
SPSTIDVVW

SEQ ID NO: 384626 - protein, 9 aa, Homo Sapiens
SVTLVDPAA

SEQ ID NO: 384627 - protein, 9 aa, Homo Sapiens
WPGHANLKP

SEQ ID NO: 384628 - protein, 9 aa, Homo Sapiens
IYGDQHYYS

SEQ ID NO: 384629 - protein, 9 aa, Homo Sapiens
NRTRSTSYW

SEQ ID NO: 384630 - protein, 9 aa, Homo Sapiens
SRPLMNLSH

SEQ ID NO: 384631 - protein, 9 aa, Homo Sapiens
AQNRSACTY

SEQ ID NO: 384632 - protein, 9 aa, Homo Sapiens
DRRSPVIEL

SEQ ID NO: 384633 - protein, 9 aa, Homo Sapiens
VDNFKTSEI

SEQ ID NO: 384634 - protein, 9 aa, Homo Sapiens
HYVLPDGKE

SEQ ID NO: 384635 - protein, 9 aa, Homo Sapiens
GVGSSTKMQ

SEQ ID NO: 384636 - protein, 9 aa, Homo Sapiens
PYTCPKCGK

SEQ ID NO: 384637 - protein, 9 aa, Homo Sapiens
HTPNISNKP

SEQ ID NO: 384638 - protein, 9 aa, Homo Sapiens
KASFLPLLA

SEQ ID NO: 384639 - protein, 9 aa, Homo Sapiens
QIRYILDSI

SEQ ID NO: 384640 - protein, 9 aa, Homo Sapiens
PKCGKGFSK

SEQ ID NO: 384641 - protein, 9 aa, Homo Sapiens
AVCFMPGEG

SEQ ID NO: 384642 - protein, 9 aa, Homo Sapiens
RIPLLLTYL

SEQ ID NO: 384643 - protein, 9 aa, Homo Sapiens
NCPSGGSQG

SEQ ID NO: 384644 - protein, 9 aa, Homo Sapiens
QKVEVPAVR

SEQ ID NO: 384645 - protein, 9 aa, Homo Sapiens
YVPLCIDGN

SEQ ID NO: 384646 - protein, 9 aa, Homo Sapiens
DGGYVKDAK

SEQ ID NO: 384647 - protein, 9 aa, Homo Sapiens
WKTSQRDTS

SEQ ID NO: 384648 - protein, 9 aa, Homo Sapiens
MTNPLREIN

SEQ ID NO: 384649 - protein, 9 aa, Homo Sapiens
SNADKMVYN

SEQ ID NO: 384650 - protein, 9 aa, Homo Sapiens
LDGTTPVWY

SEQ ID NO: 384651 - protein, 9 aa, Homo Sapiens
KNHLQNDNQ

SEQ ID NO: 384652 - protein, 9 aa, Homo Sapiens
VEDGFGIAS

SEQ ID NO: 384653 - protein, 9 aa, Homo Sapiens
VWGRAKALV

SEQ ID NO: 384654 - protein, 9 aa, Homo Sapiens
YIIKHLINI

SEQ ID NO: 384655 - protein, 9 aa, Homo Sapiens
QQILLELDM

SEQ ID NO: 384656 - protein, 9 aa, Homo Sapiens
LTLEYFIQN

SEQ ID NO: 384657 - protein, 9 aa, Homo Sapiens
KIFHNTLNI

SEQ ID NO: 384658 - protein, 9 aa, Homo Sapiens
FNLPEIFFF

SEQ ID NO: 384659 - protein, 9 aa, Homo Sapiens
WLSKNPYLN

SEQ ID NO: 384660 - protein, 9 aa, Homo Sapiens
IILIWLLAS

SEQ ID NO: 384661 - protein, 9 aa, Homo Sapiens
IKCHTLFST

SEQ ID NO: 384662 - protein, 9 aa, Homo Sapiens
TGIDPYLSA

SEQ ID NO: 384663 - protein, 9 aa, Homo Sapiens
SVSSISHIL

SEQ ID NO: 384664 - protein, 9 aa, Homo Sapiens
YFEGYNVEV

SEQ ID NO: 384665 - protein, 9 aa, Homo Sapiens
TEVLAAVIV

SEQ ID NO: 384666 - protein, 9 aa, Homo Sapiens
KNSICHNLS

SEQ ID NO: 384667 - protein, 9 aa, Homo Sapiens
SNYHWPSLV

SEQ ID NO: 384668 - protein, 9 aa, Homo Sapiens
KHRLNPVKP

SEQ ID NO: 384669 - protein, 9 aa, Homo Sapiens
KLAELHANL

SEQ ID NO: 384670 - protein, 9 aa, Homo Sapiens
QSSVWTLPR

SEQ ID NO: 384671 - protein, 9 aa, Homo Sapiens
PLLRPATQI

SEQ ID NO: 384672 - protein, 9 aa, Homo Sapiens
EKEWPLLDY

SEQ ID NO: 384673 - protein, 9 aa, Homo Sapiens
PATPADPDS

SEQ ID NO: 384674 - protein, 9 aa, Homo Sapiens
PSICAITLG

SEQ ID NO: 384675 - protein, 9 aa, Homo Sapiens
DLYGRLLKK

SEQ ID NO: 384676 - protein, 9 aa, Homo Sapiens
MEDAEIQLF

SEQ ID NO: 384677 - protein, 9 aa, Homo Sapiens
LASSNETFA

SEQ ID NO: 384678 - protein, 9 aa, Homo Sapiens
SESKPSSSS

SEQ ID NO: 384679 - protein, 9 aa, Homo Sapiens
MDTSSMLSS

SEQ ID NO: 384680 - protein, 9 aa, Homo Sapiens
MSQYWPILQ

SEQ ID NO: 384681 - protein, 9 aa, Homo Sapiens
LAMLSLGVG

SEQ ID NO: 384682 - protein, 9 aa, Homo Sapiens
LIDDISGNL

SEQ ID NO: 384683 - protein, 9 aa, Homo Sapiens
NIHESCMRQ

SEQ ID NO: 384684 - protein, 9 aa, Homo Sapiens
ILLAYRVCM

SEQ ID NO: 384685 - protein, 9 aa, Homo Sapiens
PSNTEKEDR

SEQ ID NO: 384686 - protein, 9 aa, Homo Sapiens
KECGKAYND

SEQ ID NO: 384687 - protein, 9 aa, Homo Sapiens
PRKKTVLVG

SEQ ID NO: 384688 - protein, 9 aa, Homo Sapiens
RSAPFIKCH

SEQ ID NO: 384689 - protein, 9 aa, Homo Sapiens
EYKQELNKL

SEQ ID NO: 384690 - protein, 9 aa, Homo Sapiens
CQDRSNLSI

SEQ ID NO: 384691 - protein, 9 aa, Homo Sapiens
KKIIWQLGT

SEQ ID NO: 384692 - protein, 9 aa, Homo Sapiens
WALLDPSQN

SEQ ID NO: 384693 - protein, 9 aa, Homo Sapiens
QRKYIQIPM

SEQ ID NO: 384694 - protein, 9 aa, Homo Sapiens
QGAGACRTL

SEQ ID NO: 384695 - protein, 9 aa, Homo Sapiens
LHSQRILHG

SEQ ID NO: 384696 - protein, 9 aa, Homo Sapiens
AGLSISETG

SEQ ID NO: 384697 - protein, 9 aa, Homo Sapiens
SPIRYVRSP

SEQ ID NO: 384698 - protein, 9 aa, Homo Sapiens
SYFSDDEVW

SEQ ID NO: 384699 - protein, 9 aa, Homo Sapiens
WCFAVPVSP

SEQ ID NO: 384700 - protein, 9 aa, Homo Sapiens
PGLSGFPGA

SEQ ID NO: 384701 - protein, 9 aa, Homo Sapiens
VQKFIKIDQ

SEQ ID NO: 384702 - protein, 9 aa, Homo Sapiens
CKSFSQPGL

SEQ ID NO: 384703 - protein, 9 aa, Homo Sapiens
GFLVKHICA

SEQ ID NO: 384704 - protein, 9 aa, Homo Sapiens
DKHKEEDKH

SEQ ID NO: 384705 - protein, 9 aa, Homo Sapiens
PRHTPNISN

SEQ ID NO: 384706 - protein, 9 aa, Homo Sapiens
SRGAVPPPP

SEQ ID NO: 384707 - protein, 9 aa, Homo Sapiens
VEQEVQQIL

SEQ ID NO: 384708 - protein, 9 aa, Homo Sapiens
LHGKIQMSV

SEQ ID NO: 384709 - protein, 9 aa, Homo Sapiens
VYVIPGLKV

SEQ ID NO: 384710 - protein, 9 aa, Homo Sapiens
EEEKITKID

SEQ ID NO: 384711 - protein, 9 aa, Homo Sapiens
NLRLSTYAK

SEQ ID NO: 384712 - protein, 9 aa, Homo Sapiens
NKLCITGGI

SEQ ID NO: 384713 - protein, 9 aa, Homo Sapiens
STTGIWKQW

SEQ ID NO: 384714 - protein, 9 aa, Homo Sapiens
YCRKHEITH

SEQ ID NO: 384715 - protein, 9 aa, Homo Sapiens
LLLHTEVRW

SEQ ID NO: 384716 - protein, 9 aa, Homo Sapiens
YASIRRWQI

SEQ ID NO: 384717 - protein, 9 aa, Homo Sapiens
INMDGDYIN

SEQ ID NO: 384718 - protein, 9 aa, Homo Sapiens
AINFTLWRQ

SEQ ID NO: 384719 - protein, 9 aa, Homo Sapiens
DKMVYNKEM

SEQ ID NO: 384720 - protein, 9 aa, Homo Sapiens
RVSQIICSV

SEQ ID NO: 384721 - protein, 9 aa, Homo Sapiens
EIRETYFQM

SEQ ID NO: 384722 - protein, 9 aa, Homo Sapiens
EKDQHHIAL

SEQ ID NO: 384723 - protein, 9 aa, Homo Sapiens
FDNKIMQKT

SEQ ID NO: 384724 - protein, 9 aa, Homo Sapiens
SDAGRYFFC

SEQ ID NO: 384725 - protein, 9 aa, Homo Sapiens
QLKMQLEQE

SEQ ID NO: 384726 - protein, 9 aa, Homo Sapiens
KPVAAGGDI

SEQ ID NO: 384727 - protein, 9 aa, Homo Sapiens
TQIVPDSSK

SEQ ID NO: 384728 - protein, 9 aa, Homo Sapiens
FTSSDKSLT

SEQ ID NO: 384729 - protein, 9 aa, Homo Sapiens
YPSTSPGFL

SEQ ID NO: 384730 - protein, 9 aa, Homo Sapiens
GKDWQNHKD

SEQ ID NO: 384731 - protein, 9 aa, Homo Sapiens
VNLFVGAAG

SEQ ID NO: 384732 - protein, 9 aa, Homo Sapiens
ARRRPWRCP

SEQ ID NO: 384733 - protein, 9 aa, Homo Sapiens
DNPSICAIT

SEQ ID NO: 384734 - protein, 9 aa, Homo Sapiens
YAVWPNPDL

SEQ ID NO: 384735 - protein, 9 aa, Homo Sapiens
HSLHDFGSS

SEQ ID NO: 384736 - protein, 9 aa, Homo Sapiens
SKEINLRLS

SEQ ID NO: 384737 - protein, 9 aa, Homo Sapiens
EVKALAFLM

SEQ ID NO: 384738 - protein, 9 aa, Homo Sapiens
EFKKDGELS

SEQ ID NO: 384739 - protein, 9 aa, Homo Sapiens
WMAALIYLH

SEQ ID NO: 384740 - protein, 9 aa, Homo Sapiens
FVLLFLFWV

SEQ ID NO: 384741 - protein, 9 aa, Homo Sapiens
TQMLSVVTE

SEQ ID NO: 384742 - protein, 9 aa, Homo Sapiens
HQFVLLFLF

SEQ ID NO: 384743 - protein, 9 aa, Homo Sapiens
NMLLSMQTQ

SEQ ID NO: 384744 - protein, 9 aa, Homo Sapiens
QCVQMLEWF

SEQ ID NO: 384745 - protein, 9 aa, Homo Sapiens
LALSMMRLY

SEQ ID NO: 384746 - protein, 9 aa, Homo Sapiens
PFHLNKYSV

SEQ ID NO: 384747 - protein, 9 aa, Homo Sapiens
GKTLIIQDM

SEQ ID NO: 384748 - protein, 9 aa, Homo Sapiens
GRETNNLSP

SEQ ID NO: 384749 - protein, 9 aa, Homo Sapiens
VYNSLANKY

SEQ ID NO: 384750 - protein, 9 aa, Homo Sapiens
KIIELEVEN

SEQ ID NO: 384751 - protein, 9 aa, Homo Sapiens
SEEGVWEDN

SEQ ID NO: 384752 - protein, 9 aa, Homo Sapiens
FSGKGYALG

SEQ ID NO: 384753 - protein, 9 aa, Homo Sapiens
RFGKFIHIN

SEQ ID NO: 384754 - protein, 9 aa, Homo Sapiens
NYSNEVFPQ

SEQ ID NO: 384755 - protein, 9 aa, Homo Sapiens
FFSTAISYV

SEQ ID NO: 384756 - protein, 9 aa, Homo Sapiens
NMNKFFPKG

SEQ ID NO: 384757 - protein, 9 aa, Homo Sapiens
LQWSQSRRS

SEQ ID NO: 384758 - protein, 9 aa, Homo Sapiens
VGQIIWQRD

SEQ ID NO: 384759 - protein, 9 aa, Homo Sapiens
SNNSHPVQV

SEQ ID NO: 384760 - protein, 9 aa, Homo Sapiens
HYPQLHIRK

SEQ ID NO: 384761 - protein, 9 aa, Homo Sapiens
AFTTSAACI

SEQ ID NO: 384762 - protein, 9 aa, Homo Sapiens
PKKDLEDGK

SEQ ID NO: 384763 - protein, 9 aa, Homo Sapiens
EFEVPCRDL

SEQ ID NO: 384764 - protein, 9 aa, Homo Sapiens
QSPSINMSL

SEQ ID NO: 384765 - protein, 9 aa, Homo Sapiens
CIPRSLSVK

SEQ ID NO: 384766 - protein, 9 aa, Homo Sapiens
LFQEGSHAF

SEQ ID NO: 384767 - protein, 9 aa, Homo Sapiens
QFIWKKMQV

SEQ ID NO: 384768 - protein, 9 aa, Homo Sapiens
YHHEHLVDS

SEQ ID NO: 384769 - protein, 9 aa, Homo Sapiens
LMSASNDNE

SEQ ID NO: 384770 - protein, 9 aa, Homo Sapiens
GDMDPHIFV

SEQ ID NO: 384771 - protein, 9 aa, Homo Sapiens
VQKLVQTAS

SEQ ID NO: 384772 - protein, 9 aa, Homo Sapiens
DLNEWTNDT

SEQ ID NO: 384773 - protein, 9 aa, Homo Sapiens
EVNLNNRTL

SEQ ID NO: 384774 - protein, 9 aa, Homo Sapiens
LLDPVQRNV

SEQ ID NO: 384775 - protein, 9 aa, Homo Sapiens
PCWYETVKI

SEQ ID NO: 384776 - protein, 9 aa, Homo Sapiens
LDAIMQELE

SEQ ID NO: 384777 - protein, 9 aa, Homo Sapiens
HAFFPACYS

SEQ ID NO: 384778 - protein, 9 aa, Homo Sapiens
LLNLLAENF

SEQ ID NO: 384779 - protein, 9 aa, Homo Sapiens
EWPLLDYSQ

SEQ ID NO: 384780 - protein, 9 aa, Homo Sapiens
KTEGINLVM

SEQ ID NO: 384781 - protein, 9 aa, Homo Sapiens
MGKRRANKA

SEQ ID NO: 384782 - protein, 9 aa, Homo Sapiens
KPCSSNTLK

SEQ ID NO: 384783 - protein, 9 aa, Homo Sapiens
LTAEFVNVE

SEQ ID NO: 384784 - protein, 9 aa, Homo Sapiens
MHKDSFPRF

SEQ ID NO: 384785 - protein, 9 aa, Homo Sapiens
FEYVIFNED

SEQ ID NO: 384786 - protein, 9 aa, Homo Sapiens
RTKLHKVFC

SEQ ID NO: 384787 - protein, 9 aa, Homo Sapiens
FLKHIRSQI

SEQ ID NO: 384788 - protein, 9 aa, Homo Sapiens
HDIELYKAR

SEQ ID NO: 384789 - protein, 9 aa, Homo Sapiens
QEKLINDTF

SEQ ID NO: 384790 - protein, 9 aa, Homo Sapiens
YTEKQMRDF

SEQ ID NO: 384791 - protein, 9 aa, Homo Sapiens
KIIQVRAAS

SEQ ID NO: 384792 - protein, 9 aa, Homo Sapiens
ISRQQNKLA

SEQ ID NO: 384793 - protein, 9 aa, Homo Sapiens
STPSDTQTV

SEQ ID NO: 384794 - protein, 9 aa, Homo Sapiens
WWSVGVIIF

SEQ ID NO: 384795 - protein, 9 aa, Homo Sapiens
LDQYHGQDD

SEQ ID NO: 384796 - protein, 9 aa, Homo Sapiens
LLLCVHGDA

SEQ ID NO: 384797 - protein, 9 aa, Homo Sapiens
NDNEGNRKI

SEQ ID NO: 384798 - protein, 9 aa, Homo Sapiens
NDGKRESLL

SEQ ID NO: 384799 - protein, 9 aa, Homo Sapiens
QNIWVVGAE

SEQ ID NO: 384800 - protein, 9 aa, Homo Sapiens
LQNDNQETA

SEQ ID NO: 384801 - protein, 9 aa, Homo Sapiens
QETREVRGS

SEQ ID NO: 384802 - protein, 9 aa, Homo Sapiens
VTHAGQSLT

SEQ ID NO: 384803 - protein, 9 aa, Homo Sapiens
GSCKRSRSR

SEQ ID NO: 384804 - protein, 9 aa, Homo Sapiens
CGKTFGSGY

SEQ ID NO: 384805 - protein, 9 aa, Homo Sapiens
GLENELFTF

SEQ ID NO: 384806 - protein, 9 aa, Homo Sapiens
NKIMQKTNQ

SEQ ID NO: 384807 - protein, 9 aa, Homo Sapiens
IKLFDILDH

SEQ ID NO: 384808 - protein, 9 aa, Homo Sapiens
GDGKCIDQF

SEQ ID NO: 384809 - protein, 9 aa, Homo Sapiens
PRASDTKNQ

SEQ ID NO: 384810 - protein, 9 aa, Homo Sapiens
AEQFENMKS

SEQ ID NO: 384811 - protein, 9 aa, Homo Sapiens
VSSISHILR

SEQ ID NO: 384812 - protein, 9 aa, Homo Sapiens
GSGRAIQFT

SEQ ID NO: 384813 - protein, 9 aa, Homo Sapiens
IICSLEGLM

SEQ ID NO: 384814 - protein, 9 aa, Homo Sapiens
IHYIFNRDS

SEQ ID NO: 384815 - protein, 9 aa, Homo Sapiens
ATMKIIAYG

SEQ ID NO: 384816 - protein, 9 aa, Homo Sapiens
LLLLDPGES

SEQ ID NO: 384817 - protein, 9 aa, Homo Sapiens
MPTVQRKYI

SEQ ID NO: 384818 - protein, 9 aa, Homo Sapiens
RIRFWRFQQ

SEQ ID NO: 384819 - protein, 9 aa, Homo Sapiens
HIFVVAEEA

SEQ ID NO: 384820 - protein, 9 aa, Homo Sapiens
LHCPKCNLL

SEQ ID NO: 384821 - protein, 9 aa, Homo Sapiens
NNCQTEKEK

SEQ ID NO: 384822 - protein, 9 aa, Homo Sapiens
EAIKRYCCN

SEQ ID NO: 384823 - protein, 9 aa, Homo Sapiens
YPPISGSLA

SEQ ID NO: 384824 - protein, 9 aa, Homo Sapiens
SYNFYIRPI

SEQ ID NO: 384825 - protein, 9 aa, Homo Sapiens
KAIAANISI

SEQ ID NO: 384826 - protein, 9 aa, Homo Sapiens
QQKNLGGQD

SEQ ID NO: 384827 - protein, 9 aa, Homo Sapiens
EIPAIPSII

SEQ ID NO: 384828 - protein, 9 aa, Homo Sapiens
ERKREEKLC

SEQ ID NO: 384829 - protein, 9 aa, Homo Sapiens
KENEIKINE

SEQ ID NO: 384830 - protein, 9 aa, Homo Sapiens
LVIFWKLCD

SEQ ID NO: 384831 - protein, 9 aa, Homo Sapiens
HFLFARRNQ

SEQ ID NO: 384832 - protein, 9 aa, Homo Sapiens
DKHSERITV

SEQ ID NO: 384833 - protein, 9 aa, Homo Sapiens
ETAAILNNS

SEQ ID NO: 384834 - protein, 9 aa, Homo Sapiens
YLIQGKDLL

SEQ ID NO: 384835 - protein, 9 aa, Homo Sapiens
FLMTYKCAV

SEQ ID NO: 384836 - protein, 9 aa, Homo Sapiens
QQNKKMSPN

SEQ ID NO: 384837 - protein, 9 aa, Homo Sapiens
FWKKYHTFW

SEQ ID NO: 384838 - protein, 9 aa, Homo Sapiens
HMQTHTGEK

SEQ ID NO: 384839 - protein, 9 aa, Homo Sapiens
VSYVGDHQT

SEQ ID NO: 384840 - protein, 9 aa, Homo Sapiens
LTGICFTTS

SEQ ID NO: 384841 - protein, 9 aa, Homo Sapiens
WTKVGSCSR

SEQ ID NO: 384842 - protein, 9 aa, Homo Sapiens
SSKPKKTSG

SEQ ID NO: 384843 - protein, 9 aa, Homo Sapiens
STGCTGRMM

SEQ ID NO: 384844 - protein, 9 aa, Homo Sapiens
FSSVARSWK

SEQ ID NO: 384845 - protein, 9 aa, Homo Sapiens
EKFDINSFC

SEQ ID NO: 384846 - protein, 9 aa, Homo Sapiens
RQHILQEMR

SEQ ID NO: 384847 - protein, 9 aa, Homo Sapiens
GGIWHSVIH

SEQ ID NO: 384848 - protein, 9 aa, Homo Sapiens
GRQPQYSNP

SEQ ID NO: 384849 - protein, 9 aa, Homo Sapiens
SLVASKVFR

SEQ ID NO: 384850 - protein, 9 aa, Homo Sapiens
DLSVLSMDL

SEQ ID NO: 384851 - protein, 9 aa, Homo Sapiens
KYSFQKVTP

SEQ ID NO: 384852 - protein, 9 aa, Homo Sapiens
EKISEKKMA

SEQ ID NO: 384853 - protein, 9 aa, Homo Sapiens
LIVHKIIHT

SEQ ID NO: 384854 - protein, 9 aa, Homo Sapiens
CYPFWDKMA

SEQ ID NO: 384855 - protein, 9 aa, Homo Sapiens
FLLLCVHGD

SEQ ID NO: 384856 - protein, 9 aa, Homo Sapiens
TICERELCV

SEQ ID NO: 384857 - protein, 9 aa, Homo Sapiens
LKIVQKSHN

SEQ ID NO: 384858 - protein, 9 aa, Homo Sapiens
ILGLALMAD

SEQ ID NO: 384859 - protein, 9 aa, Homo Sapiens
KTKGHKGKN

SEQ ID NO: 384860 - protein, 9 aa, Homo Sapiens
VPASYLKKA

SEQ ID NO: 384861 - protein, 9 aa, Homo Sapiens
RETKIILDH

SEQ ID NO: 384862 - protein, 9 aa, Homo Sapiens
QYWGLDHPP

SEQ ID NO: 384863 - protein, 9 aa, Homo Sapiens
QMSVPVKNF

SEQ ID NO: 384864 - protein, 9 aa, Homo Sapiens
RLHDIELYK

SEQ ID NO: 384865 - protein, 9 aa, Homo Sapiens
LENLQNRFK

SEQ ID NO: 384866 - protein, 9 aa, Homo Sapiens
TYYMSEFST

SEQ ID NO: 384867 - protein, 9 aa, Homo Sapiens
EQPYTCKEC

SEQ ID NO: 384868 - protein, 9 aa, Homo Sapiens
TIVFTKNGE

SEQ ID NO: 384869 - protein, 9 aa, Homo Sapiens
QLADHGVSF

SEQ ID NO: 384870 - protein, 9 aa, Homo Sapiens
QRVEAPADQ

SEQ ID NO: 384871 - protein, 9 aa, Homo Sapiens
FAVPVSPAA

SEQ ID NO: 384872 - protein, 9 aa, Homo Sapiens
KPSSSSKYR

SEQ ID NO: 384873 - protein, 9 aa, Homo Sapiens
STVKDSLIK

SEQ ID NO: 384874 - protein, 9 aa, Homo Sapiens
DQQLADHGV

SEQ ID NO: 384875 - protein, 9 aa, Homo Sapiens
FPCTHPPCT

SEQ ID NO: 384876 - protein, 9 aa, Homo Sapiens
LIVFSIEAT

SEQ ID NO: 384877 - protein, 9 aa, Homo Sapiens
RHFQAQLPQ

SEQ ID NO: 384878 - protein, 9 aa, Homo Sapiens
WSGPYILQN

SEQ ID NO: 384879 - protein, 9 aa, Homo Sapiens
KNRMSVSNV

SEQ ID NO: 384880 - protein, 9 aa, Homo Sapiens
LDYSQRKLY

SEQ ID NO: 384881 - protein, 9 aa, Homo Sapiens
LQTILQVQY

SEQ ID NO: 384882 - protein, 9 aa, Homo Sapiens
TSPIRYVRS

SEQ ID NO: 384883 - protein, 9 aa, Homo Sapiens
ESRIYFREA

SEQ ID NO: 384884 - protein, 9 aa, Homo Sapiens
QDRSNLSIS

SEQ ID NO: 384885 - protein, 9 aa, Homo Sapiens
KDYLYTHTA

SEQ ID NO: 384886 - protein, 9 aa, Homo Sapiens
YVIPGLKVI

SEQ ID NO: 384887 - protein, 9 aa, Homo Sapiens
WETLQHIFW

SEQ ID NO: 384888 - protein, 9 aa, Homo Sapiens
EDTTYNKVV

SEQ ID NO: 384889 - protein, 9 aa, Homo Sapiens
WRSDDMFTF

SEQ ID NO: 384890 - protein, 9 aa, Homo Sapiens
QKQSRRLLV

SEQ ID NO: 384891 - protein, 9 aa, Homo Sapiens
EPGQLLELS

SEQ ID NO: 384892 - protein, 9 aa, Homo Sapiens
LFQLSEMEA

SEQ ID NO: 384893 - protein, 9 aa, Homo Sapiens
QFYDLLSGY

SEQ ID NO: 384894 - protein, 9 aa, Homo Sapiens
HTIHYVLPD

SEQ ID NO: 384895 - protein, 9 aa, Homo Sapiens
NLINDLQAN

SEQ ID NO: 384896 - protein, 9 aa, Homo Sapiens
HLAQIREEK

SEQ ID NO: 384897 - protein, 9 aa, Homo Sapiens
IWKQWHEDI

SEQ ID NO: 384898 - protein, 9 aa, Homo Sapiens
SKIIQSIIH

SEQ ID NO: 384899 - protein, 9 aa, Homo Sapiens
YVIYHDALQ

SEQ ID NO: 384900 - protein, 9 aa, Homo Sapiens
NTMDNSTGC

SEQ ID NO: 384901 - protein, 9 aa, Homo Sapiens
ALLCLLFMA

SEQ ID NO: 384902 - protein, 9 aa, Homo Sapiens
AETIKCHTL

SEQ ID NO: 384903 - protein, 9 aa, Homo Sapiens
ETIILSERK

SEQ ID NO: 384904 - protein, 9 aa, Homo Sapiens
QDNPPDHDP

SEQ ID NO: 384905 - protein, 9 aa, Homo Sapiens
ERAITFIRP

SEQ ID NO: 384906 - protein, 9 aa, Homo Sapiens
MHKCEENTN

SEQ ID NO: 384907 - protein, 9 aa, Homo Sapiens
TGQGVPVVA

SEQ ID NO: 384908 - protein, 9 aa, Homo Sapiens
KQDYTSPET

SEQ ID NO: 384909 - protein, 9 aa, Homo Sapiens
IGKNKNSCL

SEQ ID NO: 384910 - protein, 9 aa, Homo Sapiens
KKTVIRLPK

SEQ ID NO: 384911 - protein, 9 aa, Homo Sapiens
FYLPPGHAV

SEQ ID NO: 384912 - protein, 9 aa, Homo Sapiens
IQGFREMSR

SEQ ID NO: 384913 - protein, 9 aa, Homo Sapiens
KDRDPPKSL

SEQ ID NO: 384914 - protein, 9 aa, Homo Sapiens
IKYSFQKVT

SEQ ID NO: 384915 - protein, 9 aa, Homo Sapiens
IVVLMSASN

SEQ ID NO: 384916 - protein, 9 aa, Homo Sapiens
GVLGKCRYI

SEQ ID NO: 384917 - protein, 9 aa, Homo Sapiens
SILNYLYEL

SEQ ID NO: 384918 - protein, 9 aa, Homo Sapiens
LQNQDDREL

SEQ ID NO: 384919 - protein, 9 aa, Homo Sapiens
LGTLPRTII

SEQ ID NO: 384920 - protein, 9 aa, Homo Sapiens
HSSVACPCH

SEQ ID NO: 384921 - protein, 9 aa, Homo Sapiens
SYCRKHEIT

SEQ ID NO: 384922 - protein, 9 aa, Homo Sapiens
ILLTNMEVP

SEQ ID NO: 384923 - protein, 9 aa, Homo Sapiens
RLRSTSVDT

SEQ ID NO: 384924 - protein, 9 aa, Homo Sapiens
ISNIQQRMS

SEQ ID NO: 384925 - protein, 9 aa, Homo Sapiens
ETVRTIQLI

SEQ ID NO: 384926 - protein, 9 aa, Homo Sapiens
HFNLRARYH

SEQ ID NO: 384927 - protein, 9 aa, Homo Sapiens
REKDEELWR

SEQ ID NO: 384928 - protein, 9 aa, Homo Sapiens
DNLQRKMAE

SEQ ID NO: 384929 - protein, 9 aa, Homo Sapiens
VSSSTGEMF

SEQ ID NO: 384930 - protein, 9 aa, Homo Sapiens
SYLCGISAC

SEQ ID NO: 384931 - protein, 9 aa, Homo Sapiens
DLLALSQEL

SEQ ID NO: 384932 - protein, 9 aa, Homo Sapiens
MAPKVIKSS

SEQ ID NO: 384933 - protein, 9 aa, Homo Sapiens
LCETDKLRA

SEQ ID NO: 384934 - protein, 9 aa, Homo Sapiens
YALGETSNL

SEQ ID NO: 384935 - protein, 9 aa, Homo Sapiens
YVAQEKLIN

SEQ ID NO: 384936 - protein, 9 aa, Homo Sapiens
SSGSIGRHY

SEQ ID NO: 384937 - protein, 9 aa, Homo Sapiens
AYIRKALAL

SEQ ID NO: 384938 - protein, 9 aa, Homo Sapiens
NGKCDPEKL

SEQ ID NO: 384939 - protein, 9 aa, Homo Sapiens
DSGPYGTIY

SEQ ID NO: 384940 - protein, 9 aa, Homo Sapiens
GRAQMGPTK

SEQ ID NO: 384941 - protein, 9 aa, Homo Sapiens
SGTFPRKLW

SEQ ID NO: 384942 - protein, 9 aa, Homo Sapiens
NSNLARHQI

SEQ ID NO: 384943 - protein, 9 aa, Homo Sapiens
PEKYSPGRT

SEQ ID NO: 384944 - protein, 9 aa, Homo Sapiens
WDKSSYNKH

SEQ ID NO: 384945 - protein, 9 aa, Homo Sapiens
HSPRHTPNI

SEQ ID NO: 384946 - protein, 9 aa, Homo Sapiens
DAGRYFFCM

SEQ ID NO: 384947 - protein, 9 aa, Homo Sapiens
QKIIPDRMK

SEQ ID NO: 384948 - protein, 9 aa, Homo Sapiens
EVQQILLEL

SEQ ID NO: 384949 - protein, 9 aa, Homo Sapiens
SDKSLTPLQ

SEQ ID NO: 384950 - protein, 9 aa, Homo Sapiens
RSKFHALFL

SEQ ID NO: 384951 - protein, 9 aa, Homo Sapiens
LEYFIQNFS

SEQ ID NO: 384952 - protein, 9 aa, Homo Sapiens
YLIGREVYF

SEQ ID NO: 384953 - protein, 9 aa, Homo Sapiens
HYKCPGMGN

SEQ ID NO: 384954 - protein, 9 aa, Homo Sapiens
YHPSLITQE

SEQ ID NO: 384955 - protein, 9 aa, Homo Sapiens
HDLRYIEMQ

SEQ ID NO: 384956 - protein, 9 aa, Homo Sapiens
YRWLNNGVP

SEQ ID NO: 384957 - protein, 9 aa, Homo Sapiens
QKIIGKNAA

SEQ ID NO: 384958 - protein, 9 aa, Homo Sapiens
NNSMELAQT

SEQ ID NO: 384959 - protein, 9 aa, Homo Sapiens
NTTLNYFVI

SEQ ID NO: 384960 - protein, 9 aa, Homo Sapiens
QAEVEILEA

SEQ ID NO: 384961 - protein, 9 aa, Homo Sapiens
ALLRSPIQM

SEQ ID NO: 384962 - protein, 9 aa, Homo Sapiens
LPRNPTYQE

SEQ ID NO: 384963 - protein, 9 aa, Homo Sapiens
SKWYMDYSV

SEQ ID NO: 384964 - protein, 9 aa, Homo Sapiens
NRMVIYFFI

SEQ ID NO: 384965 - protein, 9 aa, Homo Sapiens
LQLRHTNSA

SEQ ID NO: 384966 - protein, 9 aa, Homo Sapiens
KTALIGLCH

SEQ ID NO: 384967 - protein, 9 aa, Homo Sapiens
AEKLLPLFG

SEQ ID NO: 384968 - protein, 9 aa, Homo Sapiens
LKKKQKCET

SEQ ID NO: 384969 - protein, 9 aa, Homo Sapiens
NTFLQHSEI

SEQ ID NO: 384970 - protein, 9 aa, Homo Sapiens
EILNHSSQK

SEQ ID NO: 384971 - protein, 9 aa, Homo Sapiens
VNMGKFIIT

SEQ ID NO: 384972 - protein, 9 aa, Homo Sapiens
CLGNPRADN

SEQ ID NO: 384973 - protein, 9 aa, Homo Sapiens
LYYVLAAKT

SEQ ID NO: 384974 - protein, 9 aa, Homo Sapiens
QIGKILIQS

SEQ ID NO: 384975 - protein, 9 aa, Homo Sapiens
QEEEKIRKQ

SEQ ID NO: 384976 - protein, 9 aa, Homo Sapiens
YALRFFDYE

SEQ ID NO: 384977 - protein, 9 aa, Homo Sapiens
GLAIHIQNH

SEQ ID NO: 384978 - protein, 9 aa, Homo Sapiens
KLFQLSEME

SEQ ID NO: 384979 - protein, 9 aa, Homo Sapiens
RTIIQVVAR

SEQ ID NO: 384980 - protein, 9 aa, Homo Sapiens
RMGKRRANK

SEQ ID NO: 384981 - protein, 9 aa, Homo Sapiens
SIIHQDETW

SEQ ID NO: 384982 - protein, 9 aa, Homo Sapiens
HRINNEKSK

SEQ ID NO: 384983 - protein, 9 aa, Homo Sapiens
CFTGNCVIY

SEQ ID NO: 384984 - protein, 9 aa, Homo Sapiens
EFQVCDHYQ

SEQ ID NO: 384985 - protein, 9 aa, Homo Sapiens
IKNVKAKIQ

SEQ ID NO: 384986 - protein, 9 aa, Homo Sapiens
APAIQGAEE

SEQ ID NO: 384987 - protein, 9 aa, Homo Sapiens
DYLVREAAY

SEQ ID NO: 384988 - protein, 9 aa, Homo Sapiens
QKINTRTGQ

SEQ ID NO: 384989 - protein, 9 aa, Homo Sapiens
LYATQMNNA

SEQ ID NO: 384990 - protein, 9 aa, Homo Sapiens
DGKCIDQFV

SEQ ID NO: 384991 - protein, 9 aa, Homo Sapiens
VSDSSSTSI

SEQ ID NO: 384992 - protein, 9 aa, Homo Sapiens
SLHFLFARR

SEQ ID NO: 384993 - protein, 9 aa, Homo Sapiens
NYLDYFISG

SEQ ID NO: 384994 - protein, 9 aa, Homo Sapiens
CSKCGKSFS

SEQ ID NO: 384995 - protein, 9 aa, Homo Sapiens
RYLQQKAAK

SEQ ID NO: 384996 - protein, 9 aa, Homo Sapiens
FPNNMSLSN

SEQ ID NO: 384997 - protein, 9 aa, Homo Sapiens
KKAVAFTSK

SEQ ID NO: 384998 - protein, 9 aa, Homo Sapiens
TYKELRNLA

SEQ ID NO: 384999 - protein, 9 aa, Homo Sapiens
YGCKHVEKY

SEQ ID NO: 385000 - protein, 9 aa, Homo Sapiens
HGNVLYGKY

SEQ ID NO: 385001 - protein, 9 aa, Homo Sapiens
TGEMFTTSN

SEQ ID NO: 385002 - protein, 9 aa, Homo Sapiens
GSSSERSSA

SEQ ID NO: 385003 - protein, 9 aa, Homo Sapiens
WDAAKVALI

SEQ ID NO: 385004 - protein, 9 aa, Homo Sapiens
RVQFQNQGS

SEQ ID NO: 385005 - protein, 9 aa, Homo Sapiens
AAFSVGLQN

SEQ ID NO: 385006 - protein, 9 aa, Homo Sapiens
HILQEMRKR

SEQ ID NO: 385007 - protein, 9 aa, Homo Sapiens
LSQRRRITY

SEQ ID NO: 385008 - protein, 9 aa, Homo Sapiens
IKEAIKRYC

SEQ ID NO: 385009 - protein, 9 aa, Homo Sapiens
WRRALAPDH

SEQ ID NO: 385010 - protein, 9 aa, Homo Sapiens
ERVSVIFDR

SEQ ID NO: 385011 - protein, 9 aa, Homo Sapiens
SIEATMKII

SEQ ID NO: 385012 - protein, 9 aa, Homo Sapiens
AEISYHIFY

SEQ ID NO: 385013 - protein, 9 aa, Homo Sapiens
GPKGVIHDW

SEQ ID NO: 385014 - protein, 9 aa, Homo Sapiens
KQSRHRAII

SEQ ID NO: 385015 - protein, 9 aa, Homo Sapiens
DRAKGNILE

SEQ ID NO: 385016 - protein, 9 aa, Homo Sapiens
IWRRALAPD

SEQ ID NO: 385017 - protein, 9 aa, Homo Sapiens
LHTVILCDK

SEQ ID NO: 385018 - protein, 9 aa, Homo Sapiens
GTFDLQEML

SEQ ID NO: 385019 - protein, 9 aa, Homo Sapiens
KLVQTASKE

SEQ ID NO: 385020 - protein, 9 aa, Homo Sapiens
KKVQKLVQT

SEQ ID NO: 385021 - protein, 9 aa, Homo Sapiens
YLSYNRIQR

SEQ ID NO: 385022 - protein, 9 aa, Homo Sapiens
AVGFVSEDK

SEQ ID NO: 385023 - protein, 9 aa, Homo Sapiens
QRVLDTNYR

SEQ ID NO: 385024 - protein, 9 aa, Homo Sapiens
HQADNLLMG

SEQ ID NO: 385025 - protein, 9 aa, Homo Sapiens
LIEIHNFWC

SEQ ID NO: 385026 - protein, 9 aa, Homo Sapiens
GVNHTHLLL

SEQ ID NO: 385027 - protein, 9 aa, Homo Sapiens
WPNPDLVHD

SEQ ID NO: 385028 - protein, 9 aa, Homo Sapiens
EGDDKDTAF

SEQ ID NO: 385029 - protein, 9 aa, Homo Sapiens
SCQTTTYKL

SEQ ID NO: 385030 - protein, 9 aa, Homo Sapiens
VLDALQLPT

SEQ ID NO: 385031 - protein, 9 aa, Homo Sapiens
SFTQDHKAA

SEQ ID NO: 385032 - protein, 9 aa, Homo Sapiens
SVTAFCTLH

SEQ ID NO: 385033 - protein, 9 aa, Homo Sapiens
SGRAIQFTG

SEQ ID NO: 385034 - protein, 9 aa, Homo Sapiens
ELEVICPEM

SEQ ID NO: 385035 - protein, 9 aa, Homo Sapiens
LEEERQINK

SEQ ID NO: 385036 - protein, 9 aa, Homo Sapiens
QNQDDRELW

SEQ ID NO: 385037 - protein, 9 aa, Homo Sapiens
FNWNTFLQH

SEQ ID NO: 385038 - protein, 9 aa, Homo Sapiens
ADNTSMPTS

SEQ ID NO: 385039 - protein, 9 aa, Homo Sapiens
LRDCCRSIQ

SEQ ID NO: 385040 - protein, 9 aa, Homo Sapiens
PINKQEAKK

SEQ ID NO: 385041 - protein, 9 aa, Homo Sapiens
KKKIIWQLG

SEQ ID NO: 385042 - protein, 9 aa, Homo Sapiens
VQLISVYEN

SEQ ID NO: 385043 - protein, 9 aa, Homo Sapiens
LDSSLSVLH

SEQ ID NO: 385044 - protein, 9 aa, Homo Sapiens
STKTRQRVE

SEQ ID NO: 385045 - protein, 9 aa, Homo Sapiens
PAASEGATA

SEQ ID NO: 385046 - protein, 9 aa, Homo Sapiens
ISDGNMDSC

SEQ ID NO: 385047 - protein, 9 aa, Homo Sapiens
LQIIISERS

SEQ ID NO: 385048 - protein, 9 aa, Homo Sapiens
VIHDWRKFK

SEQ ID NO: 385049 - protein, 9 aa, Homo Sapiens
NVDSIQGEE

SEQ ID NO: 385050 - protein, 9 aa, Homo Sapiens
TKEYSHIIV

SEQ ID NO: 385051 - protein, 9 aa, Homo Sapiens
NIQQRMSRP

SEQ ID NO: 385052 - protein, 9 aa, Homo Sapiens
LAKDTFQGA

SEQ ID NO: 385053 - protein, 9 aa, Homo Sapiens
VTKEYSHII

SEQ ID NO: 385054 - protein, 9 aa, Homo Sapiens
NKMLKNHLQ

SEQ ID NO: 385055 - protein, 9 aa, Homo Sapiens
QLCQIKKKK

SEQ ID NO: 385056 - protein, 9 aa, Homo Sapiens
NNSLHVFVS

SEQ ID NO: 385057 - protein, 9 aa, Homo Sapiens
LEFEVPCRD

SEQ ID NO: 385058 - protein, 9 aa, Homo Sapiens
TASTNGTCI

SEQ ID NO: 385059 - protein, 9 aa, Homo Sapiens
KDVRLLNLG

SEQ ID NO: 385060 - protein, 9 aa, Homo Sapiens
FTTSAACIC

SEQ ID NO: 385061 - protein, 9 aa, Homo Sapiens
SQQSQPVKL

SEQ ID NO: 385062 - protein, 9 aa, Homo Sapiens
WPIYLRKHM

SEQ ID NO: 385063 - protein, 9 aa, Homo Sapiens
LKYILDSWN

SEQ ID NO: 385064 - protein, 9 aa, Homo Sapiens
CHTQTLPLM

SEQ ID NO: 385065 - protein, 9 aa, Homo Sapiens
VLGARRRPW

SEQ ID NO: 385066 - protein, 9 aa, Homo Sapiens
FNMEVCKFS

SEQ ID NO: 385067 - protein, 9 aa, Homo Sapiens
FCKKEGYNL

SEQ ID NO: 385068 - protein, 9 aa, Homo Sapiens
VGSAMHSES

SEQ ID NO: 385069 - protein, 9 aa, Homo Sapiens
IELDGKKSK

SEQ ID NO: 385070 - protein, 9 aa, Homo Sapiens
QIVPDSSKP

SEQ ID NO: 385071 - protein, 9 aa, Homo Sapiens
ATLCIIEPI

SEQ ID NO: 385072 - protein, 9 aa, Homo Sapiens
VPERPPEPQ

SEQ ID NO: 385073 - protein, 9 aa, Homo Sapiens
EGKNKDNYS

SEQ ID NO: 385074 - protein, 9 aa, Homo Sapiens
VARSWKTSQ

SEQ ID NO: 385075 - protein, 9 aa, Homo Sapiens
AILQNSAEV

SEQ ID NO: 385076 - protein, 9 aa, Homo Sapiens
RHREVNLPK

SEQ ID NO: 385077 - protein, 9 aa, Homo Sapiens
ICHNLSLHS

SEQ ID NO: 385078 - protein, 9 aa, Homo Sapiens
INMAAVRHF

SEQ ID NO: 385079 - protein, 9 aa, Homo Sapiens
SPTCSIPHY

SEQ ID NO: 385080 - protein, 9 aa, Homo Sapiens
AFGERDTSG

SEQ ID NO: 385081 - protein, 9 aa, Homo Sapiens
FVGSAMHSE

SEQ ID NO: 385082 - protein, 9 aa, Homo Sapiens
FTGNCVIYW

SEQ ID NO: 385083 - protein, 9 aa, Homo Sapiens
AIHIQNHTG

SEQ ID NO: 385084 - protein, 9 aa, Homo Sapiens
QEQQMKIDR

SEQ ID NO: 385085 - protein, 9 aa, Homo Sapiens
SIFLGSYHM

SEQ ID NO: 385086 - protein, 9 aa, Homo Sapiens
APGKNKEMG

SEQ ID NO: 385087 - protein, 9 aa, Homo Sapiens
LPLRFVEFQ

SEQ ID NO: 385088 - protein, 9 aa, Homo Sapiens
CVKAHNPGV

SEQ ID NO: 385089 - protein, 9 aa, Homo Sapiens
NGIYVGSYS

SEQ ID NO: 385090 - protein, 9 aa, Homo Sapiens
GMVTITSGI

SEQ ID NO: 385091 - protein, 9 aa, Homo Sapiens
MFKEADDLF

SEQ ID NO: 385092 - protein, 9 aa, Homo Sapiens
TSIAWNYPK

SEQ ID NO: 385093 - protein, 9 aa, Homo Sapiens
NRTSEGFQT

SEQ ID NO: 385094 - protein, 9 aa, Homo Sapiens
MSATLRKRL

SEQ ID NO: 385095 - protein, 9 aa, Homo Sapiens
CAQECSSNL

SEQ ID NO: 385096 - protein, 9 aa, Homo Sapiens
ELNLMTLGE

SEQ ID NO: 385097 - protein, 9 aa, Homo Sapiens
EDINDRLRD

SEQ ID NO: 385098 - protein, 9 aa, Homo Sapiens
ALPLALTSS

SEQ ID NO: 385099 - protein, 9 aa, Homo Sapiens
ISGSLALGD

SEQ ID NO: 385100 - protein, 9 aa, Homo Sapiens
LKQVHPGMD

SEQ ID NO: 385101 - protein, 9 aa, Homo Sapiens
KKKSLKRKH

SEQ ID NO: 385102 - protein, 9 aa, Homo Sapiens
MNKLTRKQG

SEQ ID NO: 385103 - protein, 9 aa, Homo Sapiens
AGGDIKKHL

SEQ ID NO: 385104 - protein, 9 aa, Homo Sapiens
NIITHGKKY

SEQ ID NO: 385105 - protein, 9 aa, Homo Sapiens
GRSPRPSLS

SEQ ID NO: 385106 - protein, 9 aa, Homo Sapiens
ILNHLLWNP

SEQ ID NO: 385107 - protein, 9 aa, Homo Sapiens
VEMMNENNL

SEQ ID NO: 385108 - protein, 9 aa, Homo Sapiens
SQSCNQASQ

SEQ ID NO: 385109 - protein, 9 aa, Homo Sapiens
EDAKLVCED

SEQ ID NO: 385110 - protein, 9 aa, Homo Sapiens
SYWRRWTYG

SEQ ID NO: 385111 - protein, 9 aa, Homo Sapiens
SHAEALCVV

SEQ ID NO: 385112 - protein, 9 aa, Homo Sapiens
TGLYVLFGV

SEQ ID NO: 385113 - protein, 9 aa, Homo Sapiens
HGKDWQNHK

SEQ ID NO: 385114 - protein, 9 aa, Homo Sapiens
AKLSDLVSR

SEQ ID NO: 385115 - protein, 9 aa, Homo Sapiens
SLPFDEDCI

SEQ ID NO: 385116 - protein, 9 aa, Homo Sapiens
DSGTWCKLQ

SEQ ID NO: 385117 - protein, 9 aa, Homo Sapiens
VTSEINQLR

SEQ ID NO: 385118 - protein, 9 aa, Homo Sapiens
TTIGCGVRS

SEQ ID NO: 385119 - protein, 9 aa, Homo Sapiens
RATINTYCS

SEQ ID NO: 385120 - protein, 9 aa, Homo Sapiens
GAPGEEAEV

SEQ ID NO: 385121 - protein, 9 aa, Homo Sapiens
HQLKMQLEQ

SEQ ID NO: 385122 - protein, 9 aa, Homo Sapiens
IQDSGVVSL

SEQ ID NO: 385123 - protein, 9 aa, Homo Sapiens
RVRATAKAT

SEQ ID NO: 385124 - protein, 9 aa, Homo Sapiens
APQSEHGPQ

SEQ ID NO: 385125 - protein, 9 aa, Homo Sapiens
QQKAAKMYT

SEQ ID NO: 385126 - protein, 9 aa, Homo Sapiens
TGSGRAIQF

SEQ ID NO: 385127 - protein, 9 aa, Homo Sapiens
IVIILIWLL

SEQ ID NO: 385128 - protein, 9 aa, Homo Sapiens
KPTDDTTVP

SEQ ID NO: 385129 - protein, 9 aa, Homo Sapiens
LNLMTLGEV

SEQ ID NO: 385130 - protein, 9 aa, Homo Sapiens
GTVSSQKKT

SEQ ID NO: 385131 - protein, 9 aa, Homo Sapiens
CPKCGKGFS

SEQ ID NO: 385132 - protein, 9 aa, Homo Sapiens
DTLECLLKA

SEQ ID NO: 385133 - protein, 9 aa, Homo Sapiens
KQAPSHMAS

SEQ ID NO: 385134 - protein, 9 aa, Homo Sapiens
PNVNCTGSS

SEQ ID NO: 385135 - protein, 9 aa, Homo Sapiens
TEGINLVMA

SEQ ID NO: 385136 - protein, 9 aa, Homo Sapiens
TSRTLRTNK

SEQ ID NO: 385137 - protein, 9 aa, Homo Sapiens
EDNESSEQG

SEQ ID NO: 385138 - protein, 9 aa, Homo Sapiens
LTSSSPSAI

SEQ ID NO: 385139 - protein, 9 aa, Homo Sapiens
KLTVGKRKQ

SEQ ID NO: 385140 - protein, 9 aa, Homo Sapiens
SQSPEECQR

SEQ ID NO: 385141 - protein, 9 aa, Homo Sapiens
SDLGYAPAI

SEQ ID NO: 385142 - protein, 9 aa, Homo Sapiens
RGLYTSIQK

SEQ ID NO: 385143 - protein, 9 aa, Homo Sapiens
DFPCPEKCA

SEQ ID NO: 385144 - protein, 9 aa, Homo Sapiens
WEKLTGEPL

SEQ ID NO: 385145 - protein, 9 aa, Homo Sapiens
VSNFIQWCQ

SEQ ID NO: 385146 - protein, 9 aa, Homo Sapiens
RLLENVEYN

SEQ ID NO: 385147 - protein, 9 aa, Homo Sapiens
DAVYNHTAA

SEQ ID NO: 385148 - protein, 9 aa, Homo Sapiens
CPDSPPNLK

SEQ ID NO: 385149 - protein, 9 aa, Homo Sapiens
LWVLSIASA

SEQ ID NO: 385150 - protein, 9 aa, Homo Sapiens
NIKEAIKRY

SEQ ID NO: 385151 - protein, 9 aa, Homo Sapiens
DIFWHTINN

SEQ ID NO: 385152 - protein, 9 aa, Homo Sapiens
SSASGGYIF

SEQ ID NO: 385153 - protein, 9 aa, Homo Sapiens
AINVFGAIL

SEQ ID NO: 385154 - protein, 9 aa, Homo Sapiens
LAGGLRLLY

SEQ ID NO: 385155 - protein, 9 aa, Homo Sapiens
VRATAKATV

SEQ ID NO: 385156 - protein, 9 aa, Homo Sapiens
RKEKANMDM

SEQ ID NO: 385157 - protein, 9 aa, Homo Sapiens
ECVVAVVGA

SEQ ID NO: 385158 - protein, 9 aa, Homo Sapiens
QAVLDIITN

SEQ ID NO: 385159 - protein, 9 aa, Homo Sapiens
TGNCVIYWL

SEQ ID NO: 385160 - protein, 9 aa, Homo Sapiens
RNQGAGACR

SEQ ID NO: 385161 - protein, 9 aa, Homo Sapiens
QCCVNPVIY

SEQ ID NO: 385162 - protein, 9 aa, Homo Sapiens
LTRMHLKSE

SEQ ID NO: 385163 - protein, 9 aa, Homo Sapiens
TTYNKVVFR

SEQ ID NO: 385164 - protein, 9 aa, Homo Sapiens
WRQEDKIQE

SEQ ID NO: 385165 - protein, 9 aa, Homo Sapiens
KACMRTSVS

SEQ ID NO: 385166 - protein, 9 aa, Homo Sapiens
IECGKTLSK

SEQ ID NO: 385167 - protein, 9 aa, Homo Sapiens
RVEAYLNLL

SEQ ID NO: 385168 - protein, 9 aa, Homo Sapiens
KQICIPRSL

SEQ ID NO: 385169 - protein, 9 aa, Homo Sapiens
LNNCQTEKE

SEQ ID NO: 385170 - protein, 9 aa, Homo Sapiens
MEDIFAHKE

SEQ ID NO: 385171 - protein, 9 aa, Homo Sapiens
WAINMNKFF

SEQ ID NO: 385172 - protein, 9 aa, Homo Sapiens
FQNSCQTTT

SEQ ID NO: 385173 - protein, 9 aa, Homo Sapiens
TIQLIKDLA

SEQ ID NO: 385174 - protein, 9 aa, Homo Sapiens
PMSATLRKR

SEQ ID NO: 385175 - protein, 9 aa, Homo Sapiens
GQSRGRKSS

SEQ ID NO: 385176 - protein, 9 aa, Homo Sapiens
GDYEITIHS

SEQ ID NO: 385177 - protein, 9 aa, Homo Sapiens
VKVVPGGKC

SEQ ID NO: 385178 - protein, 9 aa, Homo Sapiens
LKLLLLDPG

SEQ ID NO: 385179 - protein, 9 aa, Homo Sapiens
IYPQHSAVD

SEQ ID NO: 385180 - protein, 9 aa, Homo Sapiens
SDTLECLLK

SEQ ID NO: 385181 - protein, 9 aa, Homo Sapiens
ISNVHKKRV

SEQ ID NO: 385182 - protein, 9 aa, Homo Sapiens
WYIFNDAEV

SEQ ID NO: 385183 - protein, 9 aa, Homo Sapiens
YDLLSGYLE

SEQ ID NO: 385184 - protein, 9 aa, Homo Sapiens
ILDSWNKHD

SEQ ID NO: 385185 - protein, 9 aa, Homo Sapiens
TAPATPTPV

SEQ ID NO: 385186 - protein, 9 aa, Homo Sapiens
CVTVPKDYV

SEQ ID NO: 385187 - protein, 9 aa, Homo Sapiens
CQTEKEKTT

SEQ ID NO: 385188 - protein, 9 aa, Homo Sapiens
ELREKKLKL

SEQ ID NO: 385189 - protein, 9 aa, Homo Sapiens
MVSSLPEIN

SEQ ID NO: 385190 - protein, 9 aa, Homo Sapiens
SDTGNHASM

SEQ ID NO: 385191 - protein, 9 aa, Homo Sapiens
CELMADSEN

SEQ ID NO: 385192 - protein, 9 aa, Homo Sapiens
EEIEASNIN

SEQ ID NO: 385193 - protein, 9 aa, Homo Sapiens
ESCMRQIGW

SEQ ID NO: 385194 - protein, 9 aa, Homo Sapiens
ASMNKLTRK

SEQ ID NO: 385195 - protein, 9 aa, Homo Sapiens
GSFARRQRN

SEQ ID NO: 385196 - protein, 9 aa, Homo Sapiens
IKHNNQFLD

SEQ ID NO: 385197 - protein, 9 aa, Homo Sapiens
MFTTSNRID

SEQ ID NO: 385198 - protein, 9 aa, Homo Sapiens
GEGFIQVCY

SEQ ID NO: 385199 - protein, 9 aa, Homo Sapiens
LALSIPAEQ

SEQ ID NO: 385200 - protein, 9 aa, Homo Sapiens
GGFILGLWT

SEQ ID NO: 385201 - protein, 9 aa, Homo Sapiens
RFKLGGGVS

SEQ ID NO: 385202 - protein, 9 aa, Homo Sapiens
ACCVPACCK

SEQ ID NO: 385203 - protein, 9 aa, Homo Sapiens
KLFHSEYPY

SEQ ID NO: 385204 - protein, 9 aa, Homo Sapiens
LNSIKSKSK

SEQ ID NO: 385205 - protein, 9 aa, Homo Sapiens
FFQGVYIIF

SEQ ID NO: 385206 - protein, 9 aa, Homo Sapiens
PPNLKEEGG

SEQ ID NO: 385207 - protein, 9 aa, Homo Sapiens
AFFTLEGFP

SEQ ID NO: 385208 - protein, 9 aa, Homo Sapiens
IGREVYFAD

SEQ ID NO: 385209 - protein, 9 aa, Homo Sapiens
KRAPTHQQF

SEQ ID NO: 385210 - protein, 9 aa, Homo Sapiens
SEKIIQVRA

SEQ ID NO: 385211 - protein, 9 aa, Homo Sapiens
AECISQRHQ

SEQ ID NO: 385212 - protein, 9 aa, Homo Sapiens
PSEGKKSHT

SEQ ID NO: 385213 - protein, 9 aa, Homo Sapiens
YSLLLDFVA

SEQ ID NO: 385214 - protein, 9 aa, Homo Sapiens
TKGSFRCSC

SEQ ID NO: 385215 - protein, 9 aa, Homo Sapiens
LTYLHSLSN

SEQ ID NO: 385216 - protein, 9 aa, Homo Sapiens
SGATYVIYH

SEQ ID NO: 385217 - protein, 9 aa, Homo Sapiens
SSTSINVYS

SEQ ID NO: 385218 - protein, 9 aa, Homo Sapiens
YSELEDRSR

SEQ ID NO: 385219 - protein, 9 aa, Homo Sapiens
KEWPLLDYS

SEQ ID NO: 385220 - protein, 9 aa, Homo Sapiens
LLDYHLNYV

SEQ ID NO: 385221 - protein, 9 aa, Homo Sapiens
AMLSLGVGS

SEQ ID NO: 385222 - protein, 9 aa, Homo Sapiens
APGEEAEVE

SEQ ID NO: 385223 - protein, 9 aa, Homo Sapiens
ISKVWPTFF

SEQ ID NO: 385224 - protein, 9 aa, Homo Sapiens
HIALFGGSQ

SEQ ID NO: 385225 - protein, 9 aa, Homo Sapiens
SCPALYQNE

SEQ ID NO: 385226 - protein, 9 aa, Homo Sapiens
CIIEPIMAV

SEQ ID NO: 385227 - protein, 9 aa, Homo Sapiens
PGKNKEMGN

SEQ ID NO: 385228 - protein, 9 aa, Homo Sapiens
PFIKCHGRG

SEQ ID NO: 385229 - protein, 9 aa, Homo Sapiens
SGKEADKLL

SEQ ID NO: 385230 - protein, 9 aa, Homo Sapiens
HKIIHIREN

SEQ ID NO: 385231 - protein, 9 aa, Homo Sapiens
ELVQLNNLN

SEQ ID NO: 385232 - protein, 9 aa, Homo Sapiens
REQTHLSED

SEQ ID NO: 385233 - protein, 9 aa, Homo Sapiens
GQWNGRNCL

SEQ ID NO: 385234 - protein, 9 aa, Homo Sapiens
PDYLVREAA

SEQ ID NO: 385235 - protein, 9 aa, Homo Sapiens
FHVLKLARH

SEQ ID NO: 385236 - protein, 9 aa, Homo Sapiens
KCGKSFSFR

SEQ ID NO: 385237 - protein, 9 aa, Homo Sapiens
GPSYSLHST

SEQ ID NO: 385238 - protein, 9 aa, Homo Sapiens
KQNNGKKHQ

SEQ ID NO: 385239 - protein, 9 aa, Homo Sapiens
CVIYWLVSN

SEQ ID NO: 385240 - protein, 9 aa, Homo Sapiens
RYVEMKYLE

SEQ ID NO: 385241 - protein, 9 aa, Homo Sapiens
VSGGQAHKD

SEQ ID NO: 385242 - protein, 9 aa, Homo Sapiens
NFPGEMVVV

SEQ ID NO: 385243 - protein, 9 aa, Homo Sapiens
NCREVMEAF

SEQ ID NO: 385244 - protein, 9 aa, Homo Sapiens
KTNVKKLNP

SEQ ID NO: 385245 - protein, 9 aa, Homo Sapiens
QLRWTRDGV

SEQ ID NO: 385246 - protein, 9 aa, Homo Sapiens
PCCPCLCPD

SEQ ID NO: 385247 - protein, 9 aa, Homo Sapiens
QHILQEMRK

SEQ ID NO: 385248 - protein, 9 aa, Homo Sapiens
TDPGKPESK

SEQ ID NO: 385249 - protein, 9 aa, Homo Sapiens
RKWIFYVLL

SEQ ID NO: 385250 - protein, 9 aa, Homo Sapiens
FIRPSRVHY

SEQ ID NO: 385251 - protein, 9 aa, Homo Sapiens
RADNIHNTY

SEQ ID NO: 385252 - protein, 9 aa, Homo Sapiens
TRARRDNLQ

SEQ ID NO: 385253 - protein, 9 aa, Homo Sapiens
KLNLQNASS

SEQ ID NO: 385254 - protein, 9 aa, Homo Sapiens
KRLSILSGF

SEQ ID NO: 385255 - protein, 9 aa, Homo Sapiens
PIRGPLFTV

SEQ ID NO: 385256 - protein, 9 aa, Homo Sapiens
GTFPRKLWQ

SEQ ID NO: 385257 - protein, 9 aa, Homo Sapiens
HHVEESTPM

SEQ ID NO: 385258 - protein, 9 aa, Homo Sapiens
AFSYRRYSP

SEQ ID NO: 385259 - protein, 9 aa, Homo Sapiens
NIVGKYGTQ

SEQ ID NO: 385260 - protein, 9 aa, Homo Sapiens
NSLYYFSDH

SEQ ID NO: 385261 - protein, 9 aa, Homo Sapiens
FTTFVLFMF

SEQ ID NO: 385262 - protein, 9 aa, Homo Sapiens
VCLCGCLAV

SEQ ID NO: 385263 - protein, 9 aa, Homo Sapiens
NVGISVKGL

SEQ ID NO: 385264 - protein, 9 aa, Homo Sapiens
EDKIQEWEE

SEQ ID NO: 385265 - protein, 9 aa, Homo Sapiens
APFIKCHGR

SEQ ID NO: 385266 - protein, 9 aa, Homo Sapiens
VKASEKIIQ

SEQ ID NO: 385267 - protein, 9 aa, Homo Sapiens
QTHAAFEGP

SEQ ID NO: 385268 - protein, 9 aa, Homo Sapiens
HIAGITAML

SEQ ID NO: 385269 - protein, 9 aa, Homo Sapiens
PIIIGCHAY

SEQ ID NO: 385270 - protein, 9 aa, Homo Sapiens
SPAYTPNWD

SEQ ID NO: 385271 - protein, 9 aa, Homo Sapiens
PTYRWLNNG

SEQ ID NO: 385272 - protein, 9 aa, Homo Sapiens
ELAWELGKV

SEQ ID NO: 385273 - protein, 9 aa, Homo Sapiens
FDSFICCFI

SEQ ID NO: 385274 - protein, 9 aa, Homo Sapiens
EEAEVEKAT

SEQ ID NO: 385275 - protein, 9 aa, Homo Sapiens
TMSKMKMGR

SEQ ID NO: 385276 - protein, 9 aa, Homo Sapiens
ALSTANKND

SEQ ID NO: 385277 - protein, 9 aa, Homo Sapiens
NFKDIQYQN

SEQ ID NO: 385278 - protein, 9 aa, Homo Sapiens
FSWPSSFRI

SEQ ID NO: 385279 - protein, 9 aa, Homo Sapiens
CMRTSVSGN

SEQ ID NO: 385280 - protein, 9 aa, Homo Sapiens
AAVGSQSPE

SEQ ID NO: 385281 - protein, 9 aa, Homo Sapiens
VINLQNEKE

SEQ ID NO: 385282 - protein, 9 aa, Homo Sapiens
CVVAVVGAS

SEQ ID NO: 385283 - protein, 9 aa, Homo Sapiens
EQQMKIDRE

SEQ ID NO: 385284 - protein, 9 aa, Homo Sapiens
KREEKLCKR

SEQ ID NO: 385285 - protein, 9 aa, Homo Sapiens
YSDTGNHAS

SEQ ID NO: 385286 - protein, 9 aa, Homo Sapiens
SQSRRSVWR

SEQ ID NO: 385287 - protein, 9 aa, Homo Sapiens
LPRTIIQVV

SEQ ID NO: 385288 - protein, 9 aa, Homo Sapiens
LNSELRNMQ

SEQ ID NO: 385289 - protein, 9 aa, Homo Sapiens
VAFKFKPRK

SEQ ID NO: 385290 - protein, 9 aa, Homo Sapiens
NLVMAVLTN

SEQ ID NO: 385291 - protein, 9 aa, Homo Sapiens
IQIGKILIQ

SEQ ID NO: 385292 - protein, 9 aa, Homo Sapiens
HRLNPVKPM

SEQ ID NO: 385293 - protein, 9 aa, Homo Sapiens
LRPAPPECV

SEQ ID NO: 385294 - protein, 9 aa, Homo Sapiens
LFIFQMLVL

SEQ ID NO: 385295 - protein, 9 aa, Homo Sapiens
GKAGLWGPP

SEQ ID NO: 385296 - protein, 9 aa, Homo Sapiens
DDLGCRRGD

SEQ ID NO: 385297 - protein, 9 aa, Homo Sapiens
KELMSCHDE

SEQ ID NO: 385298 - protein, 9 aa, Homo Sapiens
VVKKVQKLV

SEQ ID NO: 385299 - protein, 9 aa, Homo Sapiens
RSVWRALAP

SEQ ID NO: 385300 - protein, 9 aa, Homo Sapiens
GNFVELLGG

SEQ ID NO: 385301 - protein, 9 aa, Homo Sapiens
EKYSPGRTY

SEQ ID NO: 385302 - protein, 9 aa, Homo Sapiens
LNKRLKKYP

SEQ ID NO: 385303 - protein, 9 aa, Homo Sapiens
LGCQWRKSN

SEQ ID NO: 385304 - protein, 9 aa, Homo Sapiens
KPQGNYSAI

SEQ ID NO: 385305 - protein, 9 aa, Homo Sapiens
FLHKGNFFL

SEQ ID NO: 385306 - protein, 9 aa, Homo Sapiens
VIFWKLCDF

SEQ ID NO: 385307 - protein, 9 aa, Homo Sapiens
VQLRWTRDG

SEQ ID NO: 385308 - protein, 9 aa, Homo Sapiens
KIIHTREKT

SEQ ID NO: 385309 - protein, 9 aa, Homo Sapiens
SKPSSSSKY

SEQ ID NO: 385310 - protein, 9 aa, Homo Sapiens
LDADEYEET

SEQ ID NO: 385311 - protein, 9 aa, Homo Sapiens
VMFRTPLAF

SEQ ID NO: 385312 - protein, 9 aa, Homo Sapiens
AKFDNKIMQ

SEQ ID NO: 385313 - protein, 9 aa, Homo Sapiens
PNKILLAYR

SEQ ID NO: 385314 - protein, 9 aa, Homo Sapiens
LNEHKIIHA

SEQ ID NO: 385315 - protein, 9 aa, Homo Sapiens
RDNNKWSHM

SEQ ID NO: 385316 - protein, 9 aa, Homo Sapiens
TLFQTCISH

SEQ ID NO: 385317 - protein, 9 aa, Homo Sapiens
IFRPIKRIT

SEQ ID NO: 385318 - protein, 9 aa, Homo Sapiens
GDKKATVDE

SEQ ID NO: 385319 - protein, 9 aa, Homo Sapiens
RGALFSSFE

SEQ ID NO: 385320 - protein, 9 aa, Homo Sapiens
STSPGFLVK

SEQ ID NO: 385321 - protein, 9 aa, Homo Sapiens
NLPKVTQQD

SEQ ID NO: 385322 - protein, 9 aa, Homo Sapiens
PRKQKRQRH

SEQ ID NO: 385323 - protein, 9 aa, Homo Sapiens
LAAKTGIEV

SEQ ID NO: 385324 - protein, 9 aa, Homo Sapiens
ENSKLFEQY

SEQ ID NO: 385325 - protein, 9 aa, Homo Sapiens
CKRSRSRSR

SEQ ID NO: 385326 - protein, 9 aa, Homo Sapiens
SRIRYLEKA

SEQ ID NO: 385327 - protein, 9 aa, Homo Sapiens
HSVSTPGPR

SEQ ID NO: 385328 - protein, 9 aa, Homo Sapiens
HPHINMDGD

SEQ ID NO: 385329 - protein, 9 aa, Homo Sapiens
HIGKGVNLY

SEQ ID NO: 385330 - protein, 9 aa, Homo Sapiens
SPETQKYVG

SEQ ID NO: 385331 - protein, 9 aa, Homo Sapiens
YATQMNNAV

SEQ ID NO: 385332 - protein, 9 aa, Homo Sapiens
YIGKIYHYD

SEQ ID NO: 385333 - protein, 9 aa, Homo Sapiens
REINKIVGQ

SEQ ID NO: 385334 - protein, 9 aa, Homo Sapiens
SGGIWHSVI

SEQ ID NO: 385335 - protein, 9 aa, Homo Sapiens
YYEGSDIVV

SEQ ID NO: 385336 - protein, 9 aa, Homo Sapiens
ESTKNVQDN

SEQ ID NO: 385337 - protein, 9 aa, Homo Sapiens
FRRILIYLA

SEQ ID NO: 385338 - protein, 9 aa, Homo Sapiens
TGCLSKIMS

SEQ ID NO: 385339 - protein, 9 aa, Homo Sapiens
PIKLDFLSG

SEQ ID NO: 385340 - protein, 9 aa, Homo Sapiens
RQEYAHISR

SEQ ID NO: 385341 - protein, 9 aa, Homo Sapiens
QLYLFINNN

SEQ ID NO: 385342 - protein, 9 aa, Homo Sapiens
GIDPQEKYP

SEQ ID NO: 385343 - protein, 9 aa, Homo Sapiens
QYNIDYSHF

SEQ ID NO: 385344 - protein, 9 aa, Homo Sapiens
LIDINTVAV

SEQ ID NO: 385345 - protein, 9 aa, Homo Sapiens
GEHVHQQYH

SEQ ID NO: 385346 - protein, 9 aa, Homo Sapiens
TSPETQKYV

SEQ ID NO: 385347 - protein, 9 aa, Homo Sapiens
FIRLEGMFR

SEQ ID NO: 385348 - protein, 9 aa, Homo Sapiens
DNIHNTYST

SEQ ID NO: 385349 - protein, 9 aa, Homo Sapiens
KELDTLSGK

SEQ ID NO: 385350 - protein, 9 aa, Homo Sapiens
YLFDRNRPS

SEQ ID NO: 385351 - protein, 9 aa, Homo Sapiens
RLGQPPGVW

SEQ ID NO: 385352 - protein, 9 aa, Homo Sapiens
SEEAASVQR

SEQ ID NO: 385353 - protein, 9 aa, Homo Sapiens
RPLSPLDKQ

SEQ ID NO: 385354 - protein, 9 aa, Homo Sapiens
LWRGPGQFF

SEQ ID NO: 385355 - protein, 9 aa, Homo Sapiens
HKLLVMEGQ

SEQ ID NO: 385356 - protein, 9 aa, Homo Sapiens
ILSGFSGSH

SEQ ID NO: 385357 - protein, 9 aa, Homo Sapiens
VMEAFNLLV

SEQ ID NO: 385358 - protein, 9 aa, Homo Sapiens
RQPQYSNPP

SEQ ID NO: 385359 - protein, 9 aa, Homo Sapiens
NVKKCRHEE

SEQ ID NO: 385360 - protein, 9 aa, Homo Sapiens
CGKNKENAK

SEQ ID NO: 385361 - protein, 9 aa, Homo Sapiens
VDFIDAYTS

SEQ ID NO: 385362 - protein, 9 aa, Homo Sapiens
GEESLNGIY

SEQ ID NO: 385363 - protein, 9 aa, Homo Sapiens
HVDENGQSS

SEQ ID NO: 385364 - protein, 9 aa, Homo Sapiens
SQKPREERD

SEQ ID NO: 385365 - protein, 9 aa, Homo Sapiens
FHDAETDQI

SEQ ID NO: 385366 - protein, 9 aa, Homo Sapiens
PQDFNYFVL

SEQ ID NO: 385367 - protein, 9 aa, Homo Sapiens
TTQTSIAQD

SEQ ID NO: 385368 - protein, 9 aa, Homo Sapiens
CQWRKSNMK

SEQ ID NO: 385369 - protein, 9 aa, Homo Sapiens
AHMLPLLAQ

SEQ ID NO: 385370 - protein, 9 aa, Homo Sapiens
PQAMDDPAS

SEQ ID NO: 385371 - protein, 9 aa, Homo Sapiens
QIYLLDGLG

SEQ ID NO: 385372 - protein, 9 aa, Homo Sapiens
ATSLRSLHF

SEQ ID NO: 385373 - protein, 9 aa, Homo Sapiens
LVQLCQIKK

SEQ ID NO: 385374 - protein, 9 aa, Homo Sapiens
SSHFITHQQ

SEQ ID NO: 385375 - protein, 9 aa, Homo Sapiens
LFLPVLYRS

SEQ ID NO: 385376 - protein, 9 aa, Homo Sapiens
EDRSRRKMQ

SEQ ID NO: 385377 - protein, 9 aa, Homo Sapiens
AKNNSNWTK

SEQ ID NO: 385378 - protein, 9 aa, Homo Sapiens
SYSAKAYEY

SEQ ID NO: 385379 - protein, 9 aa, Homo Sapiens
TIHYVLPDG

SEQ ID NO: 385380 - protein, 9 aa, Homo Sapiens
NATHATYTY

SEQ ID NO: 385381 - protein, 9 aa, Homo Sapiens
SPSPESSSP

SEQ ID NO: 385382 - protein, 9 aa, Homo Sapiens
TKVGSCSRT

SEQ ID NO: 385383 - protein, 9 aa, Homo Sapiens
QSRRLLVKK

SEQ ID NO: 385384 - protein, 9 aa, Homo Sapiens
LHFLFARRN

SEQ ID NO: 385385 - protein, 9 aa, Homo Sapiens
CLHMFNRMV

SEQ ID NO: 385386 - protein, 9 aa, Homo Sapiens
TGKYVHFTI

SEQ ID NO: 385387 - protein, 9 aa, Homo Sapiens
IFWHTINNT

SEQ ID NO: 385388 - protein, 9 aa, Homo Sapiens
KISIAIEEV

SEQ ID NO: 385389 - protein, 9 aa, Homo Sapiens
YWRRWTYGF

SEQ ID NO: 385390 - protein, 9 aa, Homo Sapiens
PNINLVNDQ

SEQ ID NO: 385391 - protein, 9 aa, Homo Sapiens
QPINLTKGK

SEQ ID NO: 385392 - protein, 9 aa, Homo Sapiens
VEILEAKVV

SEQ ID NO: 385393 - protein, 9 aa, Homo Sapiens
SQTLCIFLR

SEQ ID NO: 385394 - protein, 9 aa, Homo Sapiens
KYILDSWNK

SEQ ID NO: 385395 - protein, 9 aa, Homo Sapiens
WGRQAGGTQ

SEQ ID NO: 385396 - protein, 9 aa, Homo Sapiens
VLPIYSELE

SEQ ID NO: 385397 - protein, 9 aa, Homo Sapiens
QDFNYFVLE

SEQ ID NO: 385398 - protein, 9 aa, Homo Sapiens
ISGNLASVT

SEQ ID NO: 385399 - protein, 9 aa, Homo Sapiens
EDNKYLIQG

SEQ ID NO: 385400 - protein, 9 aa, Homo Sapiens
TSGQICLYC

SEQ ID NO: 385401 - protein, 9 aa, Homo Sapiens
CQFADMEKL

SEQ ID NO: 385402 - protein, 9 aa, Homo Sapiens
QEIVTALVK

SEQ ID NO: 385403 - protein, 9 aa, Homo Sapiens
RREQLIRER

SEQ ID NO: 385404 - protein, 9 aa, Homo Sapiens
CRDDYFQEI

SEQ ID NO: 385405 - protein, 9 aa, Homo Sapiens
NQSSVWTLP

SEQ ID NO: 385406 - protein, 9 aa, Homo Sapiens
FQWILFFIL

SEQ ID NO: 385407 - protein, 9 aa, Homo Sapiens
SYICDEGKD

SEQ ID NO: 385408 - protein, 9 aa, Homo Sapiens
DQVFSQSVM

SEQ ID NO: 385409 - protein, 9 aa, Homo Sapiens
QLRHTNSAK

SEQ ID NO: 385410 - protein, 9 aa, Homo Sapiens
LGTGCGKNK

SEQ ID NO: 385411 - protein, 9 aa, Homo Sapiens
LSSPKSQLN

SEQ ID NO: 385412 - protein, 9 aa, Homo Sapiens
GFGIASRVL

SEQ ID NO: 385413 - protein, 9 aa, Homo Sapiens
KHCWCKEGY

SEQ ID NO: 385414 - protein, 9 aa, Homo Sapiens
GWAVPGSAE

SEQ ID NO: 385415 - protein, 9 aa, Homo Sapiens
QMDLLALSQ

SEQ ID NO: 385416 - protein, 9 aa, Homo Sapiens
GNNNIAIVG

SEQ ID NO: 385417 - protein, 9 aa, Homo Sapiens
LTDYFTEVK

SEQ ID NO: 385418 - protein, 9 aa, Homo Sapiens
PERPPEPQA

SEQ ID NO: 385419 - protein, 9 aa, Homo Sapiens
GPMLRPTIC

SEQ ID NO: 385420 - protein, 9 aa, Homo Sapiens
ATHQKELDT

SEQ ID NO: 385421 - protein, 9 aa, Homo Sapiens
LAAQNILLS

SEQ ID NO: 385422 - protein, 9 aa, Homo Sapiens
MMNDSNEKM

SEQ ID NO: 385423 - protein, 9 aa, Homo Sapiens
WIMLIIFAW

SEQ ID NO: 385424 - protein, 9 aa, Homo Sapiens
IKKAIAANI

SEQ ID NO: 385425 - protein, 9 aa, Homo Sapiens
MHLKSEVIG

SEQ ID NO: 385426 - protein, 9 aa, Homo Sapiens
SFNMHDSSL

SEQ ID NO: 385427 - protein, 9 aa, Homo Sapiens
DPREKQFNL

SEQ ID NO: 385428 - protein, 9 aa, Homo Sapiens
GFQTFSKKF

SEQ ID NO: 385429 - protein, 9 aa, Homo Sapiens
MHDSSLVAS

SEQ ID NO: 385430 - protein, 9 aa, Homo Sapiens
GSMRLGKDT

SEQ ID NO: 385431 - protein, 9 aa, Homo Sapiens
DQEQLQEIE

SEQ ID NO: 385432 - protein, 9 aa, Homo Sapiens
SSRVQFQNQ

SEQ ID NO: 385433 - protein, 9 aa, Homo Sapiens
QLIRERQQM

SEQ ID NO: 385434 - protein, 9 aa, Homo Sapiens
GGLLHYMIQ

SEQ ID NO: 385435 - protein, 9 aa, Homo Sapiens
AQKKPPSSQ

SEQ ID NO: 385436 - protein, 9 aa, Homo Sapiens
KQEKRQEQE

SEQ ID NO: 385437 - protein, 9 aa, Homo Sapiens
YFTDTNELQ

SEQ ID NO: 385438 - protein, 9 aa, Homo Sapiens
EMTGECRLG

SEQ ID NO: 385439 - protein, 9 aa, Homo Sapiens
VPVSPAADH

SEQ ID NO: 385440 - protein, 9 aa, Homo Sapiens
ALGLLASAG

SEQ ID NO: 385441 - protein, 9 aa, Homo Sapiens
LFHSEYPYK

SEQ ID NO: 385442 - protein, 9 aa, Homo Sapiens
PTCSIPHYL

SEQ ID NO: 385443 - protein, 9 aa, Homo Sapiens
IRPILSRRN

SEQ ID NO: 385444 - protein, 9 aa, Homo Sapiens
PPEPQAMDD

SEQ ID NO: 385445 - protein, 9 aa, Homo Sapiens
SEESYLCGI

SEQ ID NO: 385446 - protein, 9 aa, Homo Sapiens
ITYSDTDSC

SEQ ID NO: 385447 - protein, 9 aa, Homo Sapiens
KCIDQFVYS

SEQ ID NO: 385448 - protein, 9 aa, Homo Sapiens
DVRLLNLGV

SEQ ID NO: 385449 - protein, 9 aa, Homo Sapiens
SHSFQIHEI

SEQ ID NO: 385450 - protein, 9 aa, Homo Sapiens
QFFPKSLLD

SEQ ID NO: 385451 - protein, 9 aa, Homo Sapiens
QSCNQASQR

SEQ ID NO: 385452 - protein, 9 aa, Homo Sapiens
SEETFRFKL

SEQ ID NO: 385453 - protein, 9 aa, Homo Sapiens
FGRETNNLS

SEQ ID NO: 385454 - protein, 9 aa, Homo Sapiens
FMRHSWKDL

SEQ ID NO: 385455 - protein, 9 aa, Homo Sapiens
TKTANKIAL

SEQ ID NO: 385456 - protein, 9 aa, Homo Sapiens
SALIKHQIT

SEQ ID NO: 385457 - protein, 9 aa, Homo Sapiens
SPLTRLTPP

SEQ ID NO: 385458 - protein, 9 aa, Homo Sapiens
SKDLQNLDK

SEQ ID NO: 385459 - protein, 9 aa, Homo Sapiens
KFDINSFCK

SEQ ID NO: 385460 - protein, 9 aa, Homo Sapiens
ICELMADSE

SEQ ID NO: 385461 - protein, 9 aa, Homo Sapiens
VPNKPPLLD

SEQ ID NO: 385462 - protein, 9 aa, Homo Sapiens
CINLSKSPD

SEQ ID NO: 385463 - protein, 9 aa, Homo Sapiens
IQMSVPVKN

SEQ ID NO: 385464 - protein, 9 aa, Homo Sapiens
KLFEQYEVT

SEQ ID NO: 385465 - protein, 9 aa, Homo Sapiens
ESTPICTSD

SEQ ID NO: 385466 - protein, 9 aa, Homo Sapiens
ALQIIISER

SEQ ID NO: 385467 - protein, 9 aa, Homo Sapiens
KYASHSRKL

SEQ ID NO: 385468 - protein, 9 aa, Homo Sapiens
VPGPSQSFC

SEQ ID NO: 385469 - protein, 9 aa, Homo Sapiens
AESPDYLVR

SEQ ID NO: 385470 - protein, 9 aa, Homo Sapiens
ECLLKALHK

SEQ ID NO: 385471 - protein, 9 aa, Homo Sapiens
NSPVNTNNQ

SEQ ID NO: 385472 - protein, 9 aa, Homo Sapiens
VKKVQKLVQ

SEQ ID NO: 385473 - protein, 9 aa, Homo Sapiens
PVPRSSSLE

SEQ ID NO: 385474 - protein, 9 aa, Homo Sapiens
YTVAAVNEA

SEQ ID NO: 385475 - protein, 9 aa, Homo Sapiens
FFLSQEEGA

SEQ ID NO: 385476 - protein, 9 aa, Homo Sapiens
CREVMEAFN

SEQ ID NO: 385477 - protein, 9 aa, Homo Sapiens
PACTDKDYL

SEQ ID NO: 385478 - protein, 9 aa, Homo Sapiens
KSDEKSETE

SEQ ID NO: 385479 - protein, 9 aa, Homo Sapiens
STDHFNLRA

SEQ ID NO: 385480 - protein, 9 aa, Homo Sapiens
TEDNKYLIQ

SEQ ID NO: 385481 - protein, 9 aa, Homo Sapiens
LNNRTLNVS

SEQ ID NO: 385482 - protein, 9 aa, Homo Sapiens
EKKLKLTDI

SEQ ID NO: 385483 - protein, 9 aa, Homo Sapiens
SAMHSESTA

SEQ ID NO: 385484 - protein, 9 aa, Homo Sapiens
RRDNLQRKM

SEQ ID NO: 385485 - protein, 9 aa, Homo Sapiens
EEVEQEADT

SEQ ID NO: 385486 - protein, 9 aa, Homo Sapiens
NQGAGACRT

SEQ ID NO: 385487 - protein, 9 aa, Homo Sapiens
QKWQMFLLQ

SEQ ID NO: 385488 - protein, 9 aa, Homo Sapiens
QLPTSWLNG

SEQ ID NO: 385489 - protein, 9 aa, Homo Sapiens
LKQFFPKSL

SEQ ID NO: 385490 - protein, 9 aa, Homo Sapiens
SVRSKFHAL

SEQ ID NO: 385491 - protein, 9 aa, Homo Sapiens
DTLSQPWPG

SEQ ID NO: 385492 - protein, 9 aa, Homo Sapiens
IPLLLTYLS

SEQ ID NO: 385493 - protein, 9 aa, Homo Sapiens
FAFQETREV

SEQ ID NO: 385494 - protein, 9 aa, Homo Sapiens
VYINVKMGC

SEQ ID NO: 385495 - protein, 9 aa, Homo Sapiens
HDYREVYQE

SEQ ID NO: 385496 - protein, 9 aa, Homo Sapiens
HRAIIQLPA

SEQ ID NO: 385497 - protein, 9 aa, Homo Sapiens
FVVAEEAYK

SEQ ID NO: 385498 - protein, 9 aa, Homo Sapiens
SIGRHYART

SEQ ID NO: 385499 - protein, 9 aa, Homo Sapiens
NINLQPGSS

SEQ ID NO: 385500 - protein, 9 aa, Homo Sapiens
YSFQKVTPR

SEQ ID NO: 385501 - protein, 9 aa, Homo Sapiens
PATVISEDY

SEQ ID NO: 385502 - protein, 9 aa, Homo Sapiens
EQYEIYFKV

SEQ ID NO: 385503 - protein, 9 aa, Homo Sapiens
GSVLDNEIL

SEQ ID NO: 385504 - protein, 9 aa, Homo Sapiens
LGTQDLGEN

SEQ ID NO: 385505 - protein, 9 aa, Homo Sapiens
WLPPPMDCP

SEQ ID NO: 385506 - protein, 9 aa, Homo Sapiens
FAEASEEAA

SEQ ID NO: 385507 - protein, 9 aa, Homo Sapiens
VWMDADTQI

SEQ ID NO: 385508 - protein, 9 aa, Homo Sapiens
GREIKASKG

SEQ ID NO: 385509 - protein, 9 aa, Homo Sapiens
KAYNDASNL

SEQ ID NO: 385510 - protein, 9 aa, Homo Sapiens
VSDQLVPDI

SEQ ID NO: 385511 - protein, 9 aa, Homo Sapiens
KMATPVEVL

SEQ ID NO: 385512 - protein, 9 aa, Homo Sapiens
TQCCVNPVI

SEQ ID NO: 385513 - protein, 9 aa, Homo Sapiens
DQPINLTKG

SEQ ID NO: 385514 - protein, 9 aa, Homo Sapiens
KNMTRVAYL

SEQ ID NO: 385515 - protein, 9 aa, Homo Sapiens
CLTENVLKK

SEQ ID NO: 385516 - protein, 9 aa, Homo Sapiens
SMTVWELFE

SEQ ID NO: 385517 - protein, 9 aa, Homo Sapiens
LPSAEDSTG

SEQ ID NO: 385518 - protein, 9 aa, Homo Sapiens
QAHKDLLNE

SEQ ID NO: 385519 - protein, 9 aa, Homo Sapiens
LLDPAIWFE

SEQ ID NO: 385520 - protein, 9 aa, Homo Sapiens
FQETREVRG

SEQ ID NO: 385521 - protein, 9 aa, Homo Sapiens
VLDIITNET

SEQ ID NO: 385522 - protein, 9 aa, Homo Sapiens
KLDAFFTLE

SEQ ID NO: 385523 - protein, 9 aa, Homo Sapiens
QAVQNIWVV

SEQ ID NO: 385524 - protein, 9 aa, Homo Sapiens
HGSAFEYFS

SEQ ID NO: 385525 - protein, 9 aa, Homo Sapiens
DIQYQNDLS

SEQ ID NO: 385526 - protein, 9 aa, Homo Sapiens
NFHVETKLF

SEQ ID NO: 385527 - protein, 9 aa, Homo Sapiens
KQNSLYYFS

SEQ ID NO: 385528 - protein, 9 aa, Homo Sapiens
SKLFLCGRG

SEQ ID NO: 385529 - protein, 9 aa, Homo Sapiens
GGATQIPAV

SEQ ID NO: 385530 - protein, 9 aa, Homo Sapiens
LNLQNASSR

SEQ ID NO: 385531 - protein, 9 aa, Homo Sapiens
THELIMHKC

SEQ ID NO: 385532 - protein, 9 aa, Homo Sapiens
DLHGKIQMS

SEQ ID NO: 385533 - protein, 9 aa, Homo Sapiens
NLFLNHKRV

SEQ ID NO: 385534 - protein, 9 aa, Homo Sapiens
NLSKSPDPD

SEQ ID NO: 385535 - protein, 9 aa, Homo Sapiens
ITFLFLIKH

SEQ ID NO: 385536 - protein, 9 aa, Homo Sapiens
IQAKQFICC

SEQ ID NO: 385537 - protein, 9 aa, Homo Sapiens
KKICELMAD

SEQ ID NO: 385538 - protein, 9 aa, Homo Sapiens
GFLWRGPGQ

SEQ ID NO: 385539 - protein, 9 aa, Homo Sapiens
PSDTQTVGA

SEQ ID NO: 385540 - protein, 9 aa, Homo Sapiens
FDQIRMATI

SEQ ID NO: 385541 - protein, 9 aa, Homo Sapiens
SIIDLRDKF

SEQ ID NO: 385542 - protein, 9 aa, Homo Sapiens
SQRHQTKIN

SEQ ID NO: 385543 - protein, 9 aa, Homo Sapiens
GNIADASSA

SEQ ID NO: 385544 - protein, 9 aa, Homo Sapiens
DIIHYIFNR

SEQ ID NO: 385545 - protein, 9 aa, Homo Sapiens
RLWWYYLLG

SEQ ID NO: 385546 - protein, 9 aa, Homo Sapiens
RCVVCIMSG

SEQ ID NO: 385547 - protein, 9 aa, Homo Sapiens
LQGLAYLYS

SEQ ID NO: 385548 - protein, 9 aa, Homo Sapiens
PLADAKIIP

SEQ ID NO: 385549 - protein, 9 aa, Homo Sapiens
CSFQARPAP

SEQ ID NO: 385550 - protein, 9 aa, Homo Sapiens
ANISNYHWP

SEQ ID NO: 385551 - protein, 9 aa, Homo Sapiens
IFIEAKAST

SEQ ID NO: 385552 - protein, 9 aa, Homo Sapiens
VKYNKAINV

SEQ ID NO: 385553 - protein, 9 aa, Homo Sapiens
VLFCFILLF

SEQ ID NO: 385554 - protein, 9 aa, Homo Sapiens
CEGIGNFVE

SEQ ID NO: 385555 - protein, 9 aa, Homo Sapiens
AYTPNWDLV

SEQ ID NO: 385556 - protein, 9 aa, Homo Sapiens
GGDIKKHLM

SEQ ID NO: 385557 - protein, 9 aa, Homo Sapiens
QYNPDDLTS

SEQ ID NO: 385558 - protein, 9 aa, Homo Sapiens
VQRNVYRDV

SEQ ID NO: 385559 - protein, 9 aa, Homo Sapiens
LEKFDINSF

SEQ ID NO: 385560 - protein, 9 aa, Homo Sapiens
ILKTLFRCR

SEQ ID NO: 385561 - protein, 9 aa, Homo Sapiens
TGACPPHTV

SEQ ID NO: 385562 - protein, 9 aa, Homo Sapiens
GNVLYGKYI

SEQ ID NO: 385563 - protein, 9 aa, Homo Sapiens
YFSRSLPEL

SEQ ID NO: 385564 - protein, 9 aa, Homo Sapiens
SVQLLQGVF

SEQ ID NO: 385565 - protein, 9 aa, Homo Sapiens
IHLALSMMR

SEQ ID NO: 385566 - protein, 9 aa, Homo Sapiens
ESGDIVSPI

SEQ ID NO: 385567 - protein, 9 aa, Homo Sapiens
GTYVWMAPE

SEQ ID NO: 385568 - protein, 9 aa, Homo Sapiens
VCTIYGDQH

SEQ ID NO: 385569 - protein, 9 aa, Homo Sapiens
LLVPKMLDK

SEQ ID NO: 385570 - protein, 9 aa, Homo Sapiens
TLEKNRMSV

SEQ ID NO: 385571 - protein, 9 aa, Homo Sapiens
VIQYNPDDL

SEQ ID NO: 385572 - protein, 9 aa, Homo Sapiens
ELTFRKLIG

SEQ ID NO: 385573 - protein, 9 aa, Homo Sapiens
KDLEFLKRA

SEQ ID NO: 385574 - protein, 9 aa, Homo Sapiens
QYLHENKII

SEQ ID NO: 385575 - protein, 9 aa, Homo Sapiens
PRSHTCFNH

SEQ ID NO: 385576 - protein, 9 aa, Homo Sapiens
MGVNNWPWM

SEQ ID NO: 385577 - protein, 9 aa, Homo Sapiens
PSTSPGFLV

SEQ ID NO: 385578 - protein, 9 aa, Homo Sapiens
ISVKGLWDD

SEQ ID NO: 385579 - protein, 9 aa, Homo Sapiens
LTKTNQIYR

SEQ ID NO: 385580 - protein, 9 aa, Homo Sapiens
NLTKGKSDK

SEQ ID NO: 385581 - protein, 9 aa, Homo Sapiens
HYIKPSNIV

SEQ ID NO: 385582 - protein, 9 aa, Homo Sapiens
KIILDHEKE

SEQ ID NO: 385583 - protein, 9 aa, Homo Sapiens
TQDHKAAVS

SEQ ID NO: 385584 - protein, 9 aa, Homo Sapiens
AIKSVKAVP

SEQ ID NO: 385585 - protein, 9 aa, Homo Sapiens
QEYAHISRE

SEQ ID NO: 385586 - protein, 9 aa, Homo Sapiens
KFSLYLERE

SEQ ID NO: 385587 - protein, 9 aa, Homo Sapiens
QLQTHQIIH

SEQ ID NO: 385588 - protein, 9 aa, Homo Sapiens
QPLVQAQQW

SEQ ID NO: 385589 - protein, 9 aa, Homo Sapiens
RTEMEKGLA

SEQ ID NO: 385590 - protein, 9 aa, Homo Sapiens
FSSFEIQAW

SEQ ID NO: 385591 - protein, 9 aa, Homo Sapiens
VLRRELGSI

SEQ ID NO: 385592 - protein, 9 aa, Homo Sapiens
ELSQCNCIN

SEQ ID NO: 385593 - protein, 9 aa, Homo Sapiens
QAKQFICCS

SEQ ID NO: 385594 - protein, 9 aa, Homo Sapiens
LDTLSGKLE

SEQ ID NO: 385595 - protein, 9 aa, Homo Sapiens
TALNRLFDN

SEQ ID NO: 385596 - protein, 9 aa, Homo Sapiens
FKKTSICKQ

SEQ ID NO: 385597 - protein, 9 aa, Homo Sapiens
WYGLRLNMD

SEQ ID NO: 385598 - protein, 9 aa, Homo Sapiens
IYWLVSNQS

SEQ ID NO: 385599 - protein, 9 aa, Homo Sapiens
KSRCVVCIM

SEQ ID NO: 385600 - protein, 9 aa, Homo Sapiens
PDGTHELIM

SEQ ID NO: 385601 - protein, 9 aa, Homo Sapiens
CRHPPRKKT

SEQ ID NO: 385602 - protein, 9 aa, Homo Sapiens
VIDTKTVGE

SEQ ID NO: 385603 - protein, 9 aa, Homo Sapiens
PWAWRNQGA

SEQ ID NO: 385604 - protein, 9 aa, Homo Sapiens
RSPIQMKNA

SEQ ID NO: 385605 - protein, 9 aa, Homo Sapiens
QEGSHAFFP

SEQ ID NO: 385606 - protein, 9 aa, Homo Sapiens
TGTRVVTVS

SEQ ID NO: 385607 - protein, 9 aa, Homo Sapiens
LITQERDHT

SEQ ID NO: 385608 - protein, 9 aa, Homo Sapiens
RLSQRRRIT

SEQ ID NO: 385609 - protein, 9 aa, Homo Sapiens
YTTDQEQLQ

SEQ ID NO: 385610 - protein, 9 aa, Homo Sapiens
LDDNAGLSI

SEQ ID NO: 385611 - protein, 9 aa, Homo Sapiens
GPRRKRRRL

SEQ ID NO: 385612 - protein, 9 aa, Homo Sapiens
FVSEDKYLE

SEQ ID NO: 385613 - protein, 9 aa, Homo Sapiens
QANTVEMLV

SEQ ID NO: 385614 - protein, 9 aa, Homo Sapiens
TVYKPELIS

SEQ ID NO: 385615 - protein, 9 aa, Homo Sapiens
ILFFILGLA

SEQ ID NO: 385616 - protein, 9 aa, Homo Sapiens
LKCLAFQNP

SEQ ID NO: 385617 - protein, 9 aa, Homo Sapiens
KLESMGEGL

SEQ ID NO: 385618 - protein, 9 aa, Homo Sapiens
PPVPRSSSL

SEQ ID NO: 385619 - protein, 9 aa, Homo Sapiens
VQLVTNLRL

SEQ ID NO: 385620 - protein, 9 aa, Homo Sapiens
TFWKKYHTF

SEQ ID NO: 385621 - protein, 9 aa, Homo Sapiens
LCKREQKQR

SEQ ID NO: 385622 - protein, 9 aa, Homo Sapiens
KIYHYDIRL

SEQ ID NO: 385623 - protein, 9 aa, Homo Sapiens
VDENGQSSE

SEQ ID NO: 385624 - protein, 9 aa, Homo Sapiens
PPHTVKQAP

SEQ ID NO: 385625 - protein, 9 aa, Homo Sapiens
PWSGPYILQ

SEQ ID NO: 385626 - protein, 9 aa, Homo Sapiens
DEKLFQLSE

SEQ ID NO: 385627 - protein, 9 aa, Homo Sapiens
RMWIPQLVD

SEQ ID NO: 385628 - protein, 9 aa, Homo Sapiens
KDLFQHHPD

SEQ ID NO: 385629 - protein, 9 aa, Homo Sapiens
PKQNAISSS

SEQ ID NO: 385630 - protein, 9 aa, Homo Sapiens
DTIVFTKNG

SEQ ID NO: 385631 - protein, 9 aa, Homo Sapiens
YSNEVFPQG

SEQ ID NO: 385632 - protein, 9 aa, Homo Sapiens
GQHSSVACP

SEQ ID NO: 385633 - protein, 9 aa, Homo Sapiens
ELCWPLRLA

SEQ ID NO: 385634 - protein, 9 aa, Homo Sapiens
SLMPYHIQR

SEQ ID NO: 385635 - protein, 9 aa, Homo Sapiens
LHKGNFFLS

SEQ ID NO: 385636 - protein, 9 aa, Homo Sapiens
HIRKARVED

SEQ ID NO: 385637 - protein, 9 aa, Homo Sapiens
ECREELDAD

SEQ ID NO: 385638 - protein, 9 aa, Homo Sapiens
YASHSRKLI

SEQ ID NO: 385639 - protein, 9 aa, Homo Sapiens
PLRPAPPEC

SEQ ID NO: 385640 - protein, 9 aa, Homo Sapiens
SLFRMHEIT

SEQ ID NO: 385641 - protein, 9 aa, Homo Sapiens
HTSTYNILT

SEQ ID NO: 385642 - protein, 9 aa, Homo Sapiens
GVGLPVIMG

SEQ ID NO: 385643 - protein, 9 aa, Homo Sapiens
LLEDNPSIC

SEQ ID NO: 385644 - protein, 9 aa, Homo Sapiens
LELAWELGK

SEQ ID NO: 385645 - protein, 9 aa, Homo Sapiens
ESYTWLLFI

SEQ ID NO: 385646 - protein, 9 aa, Homo Sapiens
AHVGSCKRS

SEQ ID NO: 385647 - protein, 9 aa, Homo Sapiens
ENLQKNILE

SEQ ID NO: 385648 - protein, 9 aa, Homo Sapiens
VIKDVRLLN

SEQ ID NO: 385649 - protein, 9 aa, Homo Sapiens
LGLLASAGV

SEQ ID NO: 385650 - protein, 9 aa, Homo Sapiens
LVPISHPSA

SEQ ID NO: 385651 - protein, 9 aa, Homo Sapiens
DEDCIIEIK

SEQ ID NO: 385652 - protein, 9 aa, Homo Sapiens
EDSTGACPP

SEQ ID NO: 385653 - protein, 9 aa, Homo Sapiens
SCTYYMSEF

SEQ ID NO: 385654 - protein, 9 aa, Homo Sapiens
LPVQKAASQ

SEQ ID NO: 385655 - protein, 9 aa, Homo Sapiens
AVITLHRLR

SEQ ID NO: 385656 - protein, 9 aa, Homo Sapiens
LTYLSFKVL

SEQ ID NO: 385657 - protein, 9 aa, Homo Sapiens
TNRWFDTSF

SEQ ID NO: 385658 - protein, 9 aa, Homo Sapiens
LNQHRIIHT

SEQ ID NO: 385659 - protein, 9 aa, Homo Sapiens
LEDRSRRKM

SEQ ID NO: 385660 - protein, 9 aa, Homo Sapiens
NMEVCKFSL

SEQ ID NO: 385661 - protein, 9 aa, Homo Sapiens
RGKAGLWGP

SEQ ID NO: 385662 - protein, 9 aa, Homo Sapiens
IIHQDETWI

SEQ ID NO: 385663 - protein, 9 aa, Homo Sapiens
NVYIEDSYV

SEQ ID NO: 385664 - protein, 9 aa, Homo Sapiens
FEGPYAAQR

SEQ ID NO: 385665 - protein, 9 aa, Homo Sapiens
KCAKHKRFL

SEQ ID NO: 385666 - protein, 9 aa, Homo Sapiens
IKSVKAVPQ

SEQ ID NO: 385667 - protein, 9 aa, Homo Sapiens
FKDIQYQND

SEQ ID NO: 385668 - protein, 9 aa, Homo Sapiens
FCSSSVSDD

SEQ ID NO: 385669 - protein, 9 aa, Homo Sapiens
EGREIKASK

SEQ ID NO: 385670 - protein, 9 aa, Homo Sapiens
DKFYVGQPR

SEQ ID NO: 385671 - protein, 9 aa, Homo Sapiens
NYPKPEYFL

SEQ ID NO: 385672 - protein, 9 aa, Homo Sapiens
GKVPQHAGK

SEQ ID NO: 385673 - protein, 9 aa, Homo Sapiens
YANRARNIN

SEQ ID NO: 385674 - protein, 9 aa, Homo Sapiens
RVEAPADQG

SEQ ID NO: 385675 - protein, 9 aa, Homo Sapiens
QPDTLSQPW

SEQ ID NO: 385676 - protein, 9 aa, Homo Sapiens
GVVLFCFIL

SEQ ID NO: 385677 - protein, 9 aa, Homo Sapiens
QINHTGEKP

SEQ ID NO: 385678 - protein, 9 aa, Homo Sapiens
LEGTGQQVC

SEQ ID NO: 385679 - protein, 9 aa, Homo Sapiens
FSVRNNFPG

SEQ ID NO: 385680 - protein, 9 aa, Homo Sapiens
KLDPFGAAP

SEQ ID NO: 385681 - protein, 9 aa, Homo Sapiens
KEGYNLLTI

SEQ ID NO: 385682 - protein, 9 aa, Homo Sapiens
DKDNLNLEN

SEQ ID NO: 385683 - protein, 9 aa, Homo Sapiens
TYHMDVFHF

SEQ ID NO: 385684 - protein, 9 aa, Homo Sapiens
MWRQEDKIQ

SEQ ID NO: 385685 - protein, 9 aa, Homo Sapiens
KGLCLEKLS

SEQ ID NO: 385686 - protein, 9 aa, Homo Sapiens
DEISTQRMW

SEQ ID NO: 385687 - protein, 9 aa, Homo Sapiens
ATHFLLGVS

SEQ ID NO: 385688 - protein, 9 aa, Homo Sapiens
RENKNNQVK

SEQ ID NO: 385689 - protein, 9 aa, Homo Sapiens
LPCNHFTIS

SEQ ID NO: 385690 - protein, 9 aa, Homo Sapiens
KTVYVIPGL

SEQ ID NO: 385691 - protein, 9 aa, Homo Sapiens
LNASNSLKK

SEQ ID NO: 385692 - protein, 9 aa, Homo Sapiens
QWALAVASK

SEQ ID NO: 385693 - protein, 9 aa, Homo Sapiens
QSRGRKSSR

SEQ ID NO: 385694 - protein, 9 aa, Homo Sapiens
FNIGALRNP

SEQ ID NO: 385695 - protein, 9 aa, Homo Sapiens
MSEFSTVSS

SEQ ID NO: 385696 - protein, 9 aa, Homo Sapiens
NLYATQMNN

SEQ ID NO: 385697 - protein, 9 aa, Homo Sapiens
GLGGVGLPV

SEQ ID NO: 385698 - protein, 9 aa, Homo Sapiens
ESSGDNGQG

SEQ ID NO: 385699 - protein, 9 aa, Homo Sapiens
CGLTYLHSL

SEQ ID NO: 385700 - protein, 9 aa, Homo Sapiens
QSLTETTSS

SEQ ID NO: 385701 - protein, 9 aa, Homo Sapiens
GSIELSQIK

SEQ ID NO: 385702 - protein, 9 aa, Homo Sapiens
SASGGYIFY

SEQ ID NO: 385703 - protein, 9 aa, Homo Sapiens
LHQLKMQLE

SEQ ID NO: 385704 - protein, 9 aa, Homo Sapiens
HMDNRQSLI

SEQ ID NO: 385705 - protein, 9 aa, Homo Sapiens
FEKNRTRST

SEQ ID NO: 385706 - protein, 9 aa, Homo Sapiens
HFCIDGPVI

SEQ ID NO: 385707 - protein, 9 aa, Homo Sapiens
WYFPSEPVK

SEQ ID NO: 385708 - protein, 9 aa, Homo Sapiens
FMGVNNWPW

SEQ ID NO: 385709 - protein, 9 aa, Homo Sapiens
KYYGQFGLQ

SEQ ID NO: 385710 - protein, 9 aa, Homo Sapiens
PELIEIHNF

SEQ ID NO: 385711 - protein, 9 aa, Homo Sapiens
SASHPQAIV

SEQ ID NO: 385712 - protein, 9 aa, Homo Sapiens
DKLSRVEEK

SEQ ID NO: 385713 - protein, 9 aa, Homo Sapiens
PDLIDINTV

SEQ ID NO: 385714 - protein, 9 aa, Homo Sapiens
IKHQNLAAL

SEQ ID NO: 385715 - protein, 9 aa, Homo Sapiens
KGTHRGLYT

SEQ ID NO: 385716 - protein, 9 aa, Homo Sapiens
VVDGEVRKT

SEQ ID NO: 385717 - protein, 9 aa, Homo Sapiens
NETFAGLDC

SEQ ID NO: 385718 - protein, 9 aa, Homo Sapiens
RVFAFQETR

SEQ ID NO: 385719 - protein, 9 aa, Homo Sapiens
LDTYSNLVF

SEQ ID NO: 385720 - protein, 9 aa, Homo Sapiens
LSCANYASI

SEQ ID NO: 385721 - protein, 9 aa, Homo Sapiens
PGCEIYSDT

SEQ ID NO: 385722 - protein, 9 aa, Homo Sapiens
QENDKDNLN

SEQ ID NO: 385723 - protein, 9 aa, Homo Sapiens
QHIFWVYRS

SEQ ID NO: 385724 - protein, 9 aa, Homo Sapiens
RQQILAVIS

SEQ ID NO: 385725 - protein, 9 aa, Homo Sapiens
AQFGGDDYC

SEQ ID NO: 385726 - protein, 9 aa, Homo Sapiens
KLLFSVRNN

SEQ ID NO: 385727 - protein, 9 aa, Homo Sapiens
KQIRYILDS

SEQ ID NO: 385728 - protein, 9 aa, Homo Sapiens
NTYLTVIDK

SEQ ID NO: 385729 - protein, 9 aa, Homo Sapiens
TPNKPLRSH

SEQ ID NO: 385730 - protein, 9 aa, Homo Sapiens
LAETIKCHT

SEQ ID NO: 385731 - protein, 9 aa, Homo Sapiens
MFTWTHVTL

SEQ ID NO: 385732 - protein, 9 aa, Homo Sapiens
VSFVLGIST

SEQ ID NO: 385733 - protein, 9 aa, Homo Sapiens
DKSKIVCVL

SEQ ID NO: 385734 - protein, 9 aa, Homo Sapiens
FKRFYTRYS

SEQ ID NO: 385735 - protein, 9 aa, Homo Sapiens
TEMNNSLNY

SEQ ID NO: 385736 - protein, 9 aa, Homo Sapiens
TGFPKRSER

SEQ ID NO: 385737 - protein, 9 aa, Homo Sapiens
NTNNQAVKE

SEQ ID NO: 385738 - protein, 9 aa, Homo Sapiens
FSRLLDSLW

SEQ ID NO: 385739 - protein, 9 aa, Homo Sapiens
GEEQGQDNP

SEQ ID NO: 385740 - protein, 9 aa, Homo Sapiens
SWNKHDSEE

SEQ ID NO: 385741 - protein, 9 aa, Homo Sapiens
VLFMFFILL

SEQ ID NO: 385742 - protein, 9 aa, Homo Sapiens
DGLDELSDA

SEQ ID NO: 385743 - protein, 9 aa, Homo Sapiens
MFNRMVIYF

SEQ ID NO: 385744 - protein, 9 aa, Homo Sapiens
SAPTFGFGK

SEQ ID NO: 385745 - protein, 9 aa, Homo Sapiens
QLFVLEILI

SEQ ID NO: 385746 - protein, 9 aa, Homo Sapiens
ASEKIIQVR

SEQ ID NO: 385747 - protein, 9 aa, Homo Sapiens
IVGERGRLN

SEQ ID NO: 385748 - protein, 9 aa, Homo Sapiens
FDKPRKQKR

SEQ ID NO: 385749 - protein, 9 aa, Homo Sapiens
KSKIVCVLN

SEQ ID NO: 385750 - protein, 9 aa, Homo Sapiens
NPRMLTSAS

SEQ ID NO: 385751 - protein, 9 aa, Homo Sapiens
AVVFDSKFI

SEQ ID NO: 385752 - protein, 9 aa, Homo Sapiens
MLHYFAQNL

SEQ ID NO: 385753 - protein, 9 aa, Homo Sapiens
NEIKINEAR

SEQ ID NO: 385754 - protein, 9 aa, Homo Sapiens
INFMKTSDS

SEQ ID NO: 385755 - protein, 9 aa, Homo Sapiens
SNVEAAMYL

SEQ ID NO: 385756 - protein, 9 aa, Homo Sapiens
HKHCWCKEG

SEQ ID NO: 385757 - protein, 9 aa, Homo Sapiens
NQDKFSSIS

SEQ ID NO: 385758 - protein, 9 aa, Homo Sapiens
NYVMHFLTV

SEQ ID NO: 385759 - protein, 9 aa, Homo Sapiens
QSQSWAQDN

SEQ ID NO: 385760 - protein, 9 aa, Homo Sapiens
GKNIESLRA

SEQ ID NO: 385761 - protein, 9 aa, Homo Sapiens
NNYPDPVSI

SEQ ID NO: 385762 - protein, 9 aa, Homo Sapiens
KVVLDAIMQ

SEQ ID NO: 385763 - protein, 9 aa, Homo Sapiens
GQRLQIHNP

SEQ ID NO: 385764 - protein, 9 aa, Homo Sapiens
SVIFDRIRK

SEQ ID NO: 385765 - protein, 9 aa, Homo Sapiens
RWTYGFIQA

SEQ ID NO: 385766 - protein, 9 aa, Homo Sapiens
EDFQNSCQT

SEQ ID NO: 385767 - protein, 9 aa, Homo Sapiens
MDNRQSLIS

SEQ ID NO: 385768 - protein, 9 aa, Homo Sapiens
MEWFEPQIN

SEQ ID NO: 385769 - protein, 9 aa, Homo Sapiens
SAAGTYVWM

SEQ ID NO: 385770 - protein, 9 aa, Homo Sapiens
PFPDIMADI

SEQ ID NO: 385771 - protein, 9 aa, Homo Sapiens
VDNILLITE

SEQ ID NO: 385772 - protein, 9 aa, Homo Sapiens
LNLLAENFI

SEQ ID NO: 385773 - protein, 9 aa, Homo Sapiens
VPGPPGLGG

SEQ ID NO: 385774 - protein, 9 aa, Homo Sapiens
DAKLVCEDK

SEQ ID NO: 385775 - protein, 9 aa, Homo Sapiens
KETTQNNFN

SEQ ID NO: 385776 - protein, 9 aa, Homo Sapiens
KVGNEFITK

SEQ ID NO: 385777 - protein, 9 aa, Homo Sapiens
TAGMVTITS

SEQ ID NO: 385778 - protein, 9 aa, Homo Sapiens
LREKKLKLT

SEQ ID NO: 385779 - protein, 9 aa, Homo Sapiens
LQIHTSEGR

SEQ ID NO: 385780 - protein, 9 aa, Homo Sapiens
SVWRALAPW

SEQ ID NO: 385781 - protein, 9 aa, Homo Sapiens
LKNIQDIFW

SEQ ID NO: 385782 - protein, 9 aa, Homo Sapiens
KQKKTTDEA

SEQ ID NO: 385783 - protein, 9 aa, Homo Sapiens
CICLISIVL

SEQ ID NO: 385784 - protein, 9 aa, Homo Sapiens
SVQQMYTTD

SEQ ID NO: 385785 - protein, 9 aa, Homo Sapiens
ENATFQKKR

SEQ ID NO: 385786 - protein, 9 aa, Homo Sapiens
REVMEAFNL

SEQ ID NO: 385787 - protein, 9 aa, Homo Sapiens
YLKYVFNPI

SEQ ID NO: 385788 - protein, 9 aa, Homo Sapiens
LLQQSPTPH

SEQ ID NO: 385789 - protein, 9 aa, Homo Sapiens
ARHPQISLG

SEQ ID NO: 385790 - protein, 9 aa, Homo Sapiens
PKLHVLVCL

SEQ ID NO: 385791 - protein, 9 aa, Homo Sapiens
FSPAGSKLC

SEQ ID NO: 385792 - protein, 9 aa, Homo Sapiens
SSCPALYQN

SEQ ID NO: 385793 - protein, 9 aa, Homo Sapiens
HERAITFIR

SEQ ID NO: 385794 - protein, 9 aa, Homo Sapiens
FVLLLSAIV

SEQ ID NO: 385795 - protein, 9 aa, Homo Sapiens
FIWKKMQVP

SEQ ID NO: 385796 - protein, 9 aa, Homo Sapiens
EGFIQVCYG

SEQ ID NO: 385797 - protein, 9 aa, Homo Sapiens
WQRVLDTNY

SEQ ID NO: 385798 - protein, 9 aa, Homo Sapiens
IWSSHKSIA

SEQ ID NO: 385799 - protein, 9 aa, Homo Sapiens
QIIFFNLET

SEQ ID NO: 385800 - protein, 9 aa, Homo Sapiens
TITHSVCEE

SEQ ID NO: 385801 - protein, 9 aa, Homo Sapiens
GCEIYSDTG

SEQ ID NO: 385802 - protein, 9 aa, Homo Sapiens
LRFFDYEQF

SEQ ID NO: 385803 - protein, 9 aa, Homo Sapiens
VAMERVSVI

SEQ ID NO: 385804 - protein, 9 aa, Homo Sapiens
VGYTEKQMR

SEQ ID NO: 385805 - protein, 9 aa, Homo Sapiens
IWNKFGSAD

SEQ ID NO: 385806 - protein, 9 aa, Homo Sapiens
DGTIGGNNN

SEQ ID NO: 385807 - protein, 9 aa, Homo Sapiens
QFICCSAMA

SEQ ID NO: 385808 - protein, 9 aa, Homo Sapiens
VFQCVQMLE

SEQ ID NO: 385809 - protein, 9 aa, Homo Sapiens
DVERGALFS

SEQ ID NO: 385810 - protein, 9 aa, Homo Sapiens
DLEDGKVPQ

SEQ ID NO: 385811 - protein, 9 aa, Homo Sapiens
IFEMLVGQP

SEQ ID NO: 385812 - protein, 9 aa, Homo Sapiens
ASEGATAPA

SEQ ID NO: 385813 - protein, 9 aa, Homo Sapiens
HIIHSGEKP

SEQ ID NO: 385814 - protein, 9 aa, Homo Sapiens
ILKFKSIKE

SEQ ID NO: 385815 - protein, 9 aa, Homo Sapiens
PASLHSLLS

SEQ ID NO: 385816 - protein, 9 aa, Homo Sapiens
LSGFSGSHL

SEQ ID NO: 385817 - protein, 9 aa, Homo Sapiens
KASEKIIQV

SEQ ID NO: 385818 - protein, 9 aa, Homo Sapiens
TYIALNTCI

SEQ ID NO: 385819 - protein, 9 aa, Homo Sapiens
LRFVEFQVC

SEQ ID NO: 385820 - protein, 9 aa, Homo Sapiens
EVLAAVIVG

SEQ ID NO: 385821 - protein, 9 aa, Homo Sapiens
SDKGILAWV

SEQ ID NO: 385822 - protein, 9 aa, Homo Sapiens
VPIDILSEE

SEQ ID NO: 385823 - protein, 9 aa, Homo Sapiens
LYERALDIW

SEQ ID NO: 385824 - protein, 9 aa, Homo Sapiens
LIGLENELF

SEQ ID NO: 385825 - protein, 9 aa, Homo Sapiens
IFWVYRSSF

SEQ ID NO: 385826 - protein, 9 aa, Homo Sapiens
LPFQIIICS

SEQ ID NO: 385827 - protein, 9 aa, Homo Sapiens
EAFQQELVL

SEQ ID NO: 385828 - protein, 9 aa, Homo Sapiens
VFGVLGARR

SEQ ID NO: 385829 - protein, 9 aa, Homo Sapiens
RETTVIWEK

SEQ ID NO: 385830 - protein, 9 aa, Homo Sapiens
HQNLAALVS

SEQ ID NO: 385831 - protein, 9 aa, Homo Sapiens
RSLHFLQIL

SEQ ID NO: 385832 - protein, 9 aa, Homo Sapiens
GACTQLFGE

SEQ ID NO: 385833 - protein, 9 aa, Homo Sapiens
KSHNNCFPE

SEQ ID NO: 385834 - protein, 9 aa, Homo Sapiens
GYIKQKWQM

SEQ ID NO: 385835 - protein, 9 aa, Homo Sapiens
DKSEDSLSD

SEQ ID NO: 385836 - protein, 9 aa, Homo Sapiens
PLCHKLRYW

SEQ ID NO: 385837 - protein, 9 aa, Homo Sapiens
EHAGRCRCY

SEQ ID NO: 385838 - protein, 9 aa, Homo Sapiens
SLEQEKKLQ

SEQ ID NO: 385839 - protein, 9 aa, Homo Sapiens
KLSSPKSQL

SEQ ID NO: 385840 - protein, 9 aa, Homo Sapiens
LCQIKKKKQ

SEQ ID NO: 385841 - protein, 9 aa, Homo Sapiens
PFQKAQSAA

SEQ ID NO: 385842 - protein, 9 aa, Homo Sapiens
ISEDYVVKA

SEQ ID NO: 385843 - protein, 9 aa, Homo Sapiens
YIKDEQNNL

SEQ ID NO: 385844 - protein, 9 aa, Homo Sapiens
KERLHDIEL

SEQ ID NO: 385845 - protein, 9 aa, Homo Sapiens
TLMHKDSFP

SEQ ID NO: 385846 - protein, 9 aa, Homo Sapiens
KTVAVITLH

SEQ ID NO: 385847 - protein, 9 aa, Homo Sapiens
VFQSRNDCV

SEQ ID NO: 385848 - protein, 9 aa, Homo Sapiens
MRIFHVLKL

SEQ ID NO: 385849 - protein, 9 aa, Homo Sapiens
IHSLHDFGS

SEQ ID NO: 385850 - protein, 9 aa, Homo Sapiens
LVVPLVLTS

SEQ ID NO: 385851 - protein, 9 aa, Homo Sapiens
VICITDAVY

SEQ ID NO: 385852 - protein, 9 aa, Homo Sapiens
STSVDTGCK

SEQ ID NO: 385853 - protein, 9 aa, Homo Sapiens
FIPVASLFL

SEQ ID NO: 385854 - protein, 9 aa, Homo Sapiens
MGKNRSWGT

SEQ ID NO: 385855 - protein, 9 aa, Homo Sapiens
GSSSYFSDD

SEQ ID NO: 385856 - protein, 9 aa, Homo Sapiens
NNNLLSMIR

SEQ ID NO: 385857 - protein, 9 aa, Homo Sapiens
GCGAFSYRR

SEQ ID NO: 385858 - protein, 9 aa, Homo Sapiens
RLFYDISKK

SEQ ID NO: 385859 - protein, 9 aa, Homo Sapiens
APPECVVAV

SEQ ID NO: 385860 - protein, 9 aa, Homo Sapiens
FYLNLGLLD

SEQ ID NO: 385861 - protein, 9 aa, Homo Sapiens
FMKTSDSYG

SEQ ID NO: 385862 - protein, 9 aa, Homo Sapiens
SAKAYEYIR

SEQ ID NO: 385863 - protein, 9 aa, Homo Sapiens
STNGTCIIW

SEQ ID NO: 385864 - protein, 9 aa, Homo Sapiens
IAWAKTYAT

SEQ ID NO: 385865 - protein, 9 aa, Homo Sapiens
VIFLLFMNV

SEQ ID NO: 385866 - protein, 9 aa, Homo Sapiens
LRENKNNQV

SEQ ID NO: 385867 - protein, 9 aa, Homo Sapiens
LILPLPQLL

SEQ ID NO: 385868 - protein, 9 aa, Homo Sapiens
FYVTLRYGH

SEQ ID NO: 385869 - protein, 9 aa, Homo Sapiens
MLTSASHPQ

SEQ ID NO: 385870 - protein, 9 aa, Homo Sapiens
FVNVEFLSL

SEQ ID NO: 385871 - protein, 9 aa, Homo Sapiens
VEAPADQGS

SEQ ID NO: 385872 - protein, 9 aa, Homo Sapiens
RDTSGSMWL

SEQ ID NO: 385873 - protein, 9 aa, Homo Sapiens
LPSCTYYMS

SEQ ID NO: 385874 - protein, 9 aa, Homo Sapiens
IFFNLETVQ

SEQ ID NO: 385875 - protein, 9 aa, Homo Sapiens
WGLDHPPLT

SEQ ID NO: 385876 - protein, 9 aa, Homo Sapiens
RKRLRKTRF

SEQ ID NO: 385877 - protein, 9 aa, Homo Sapiens
ALIYLHYRS

SEQ ID NO: 385878 - protein, 9 aa, Homo Sapiens
CRECGRRFW

SEQ ID NO: 385879 - protein, 9 aa, Homo Sapiens
VKLVNDSLY

SEQ ID NO: 385880 - protein, 9 aa, Homo Sapiens
MKKTVIRLP

SEQ ID NO: 385881 - protein, 9 aa, Homo Sapiens
ANILGRKII

SEQ ID NO: 385882 - protein, 9 aa, Homo Sapiens
VRCCCAQEC

SEQ ID NO: 385883 - protein, 9 aa, Homo Sapiens
HSPGSLQIY

SEQ ID NO: 385884 - protein, 9 aa, Homo Sapiens
LLYIEANFI

SEQ ID NO: 385885 - protein, 9 aa, Homo Sapiens
LYLSYNRIQ

SEQ ID NO: 385886 - protein, 9 aa, Homo Sapiens
GDSQHRATI

SEQ ID NO: 385887 - protein, 9 aa, Homo Sapiens
VGEEEFLEI

SEQ ID NO: 385888 - protein, 9 aa, Homo Sapiens
TIIQVVARD

SEQ ID NO: 385889 - protein, 9 aa, Homo Sapiens
LQFVFCIFA

SEQ ID NO: 385890 - protein, 9 aa, Homo Sapiens
TVLLDFTEI

SEQ ID NO: 385891 - protein, 9 aa, Homo Sapiens
TIHVDENGQ

SEQ ID NO: 385892 - protein, 9 aa, Homo Sapiens
HIGDWLVFD

SEQ ID NO: 385893 - protein, 9 aa, Homo Sapiens
PLRELFVDD

SEQ ID NO: 385894 - protein, 9 aa, Homo Sapiens
KRLWRLISY

SEQ ID NO: 385895 - protein, 9 aa, Homo Sapiens
KLCLVEAAE

SEQ ID NO: 385896 - protein, 9 aa, Homo Sapiens
RQAGGTQLT

SEQ ID NO: 385897 - protein, 9 aa, Homo Sapiens
IDEAHRINN

SEQ ID NO: 385898 - protein, 9 aa, Homo Sapiens
KTNQIYRIF

SEQ ID NO: 385899 - protein, 9 aa, Homo Sapiens
QARPAPSLC

SEQ ID NO: 385900 - protein, 9 aa, Homo Sapiens
DPGESGKST

SEQ ID NO: 385901 - protein, 9 aa, Homo Sapiens
PVNVPIDIL

SEQ ID NO: 385902 - protein, 9 aa, Homo Sapiens
VSLMPYHIQ

SEQ ID NO: 385903 - protein, 9 aa, Homo Sapiens
DFWRKMFTS

SEQ ID NO: 385904 - protein, 9 aa, Homo Sapiens
NYASIRRWQ

SEQ ID NO: 385905 - protein, 9 aa, Homo Sapiens
SSSEDVKLE

SEQ ID NO: 385906 - protein, 9 aa, Homo Sapiens
RVSGGQAHK

SEQ ID NO: 385907 - protein, 9 aa, Homo Sapiens
EVYQEHVRC

SEQ ID NO: 385908 - protein, 9 aa, Homo Sapiens
VEFQVCDHY

SEQ ID NO: 385909 - protein, 9 aa, Homo Sapiens
DPSQNNLYR

SEQ ID NO: 385910 - protein, 9 aa, Homo Sapiens
FQKAQSAAC

SEQ ID NO: 385911 - protein, 9 aa, Homo Sapiens
YGIAVWGRA

SEQ ID NO: 385912 - protein, 9 aa, Homo Sapiens
ARNINNKVV

SEQ ID NO: 385913 - protein, 9 aa, Homo Sapiens
KGSQIYLEG

SEQ ID NO: 385914 - protein, 9 aa, Homo Sapiens
KSHMQTHTG

SEQ ID NO: 385915 - protein, 9 aa, Homo Sapiens
RSCRKKLAR

SEQ ID NO: 385916 - protein, 9 aa, Homo Sapiens
CTLHVTIIT

SEQ ID NO: 385917 - protein, 9 aa, Homo Sapiens
QREEPVRIL

SEQ ID NO: 385918 - protein, 9 aa, Homo Sapiens
NGPMLRPTI

SEQ ID NO: 385919 - protein, 9 aa, Homo Sapiens
DNNREEMHI

SEQ ID NO: 385920 - protein, 9 aa, Homo Sapiens
FYDISKKAR

SEQ ID NO: 385921 - protein, 9 aa, Homo Sapiens
LFARTLVPR

SEQ ID NO: 385922 - protein, 9 aa, Homo Sapiens
SHTCFNHLD

SEQ ID NO: 385923 - protein, 9 aa, Homo Sapiens
QHRATINTY

SEQ ID NO: 385924 - protein, 9 aa, Homo Sapiens
GPYGTIYYT

SEQ ID NO: 385925 - protein, 9 aa, Homo Sapiens
TAIKLFDIL

SEQ ID NO: 385926 - protein, 9 aa, Homo Sapiens
RTPINNLYA

SEQ ID NO: 385927 - protein, 9 aa, Homo Sapiens
TGLAIHIQN

SEQ ID NO: 385928 - protein, 9 aa, Homo Sapiens
TSWLNGSSL

SEQ ID NO: 385929 - protein, 9 aa, Homo Sapiens
GAIARKQIR

SEQ ID NO: 385930 - protein, 9 aa, Homo Sapiens
CLRVFAFQE

SEQ ID NO: 385931 - protein, 9 aa, Homo Sapiens
QMDLERAKR

SEQ ID NO: 385932 - protein, 9 aa, Homo Sapiens
NDFSIILQN

SEQ ID NO: 385933 - protein, 9 aa, Homo Sapiens
HINRFLEER

SEQ ID NO: 385934 - protein, 9 aa, Homo Sapiens
LSKNKLELA

SEQ ID NO: 385935 - protein, 9 aa, Homo Sapiens
FLLYIEANF

SEQ ID NO: 385936 - protein, 9 aa, Homo Sapiens
KKLNPNLLK

SEQ ID NO: 385937 - protein, 9 aa, Homo Sapiens
SLACADLLV

SEQ ID NO: 385938 - protein, 9 aa, Homo Sapiens
GRQAGGTQL

SEQ ID NO: 385939 - protein, 9 aa, Homo Sapiens
LHSFYVLGV

SEQ ID NO: 385940 - protein, 9 aa, Homo Sapiens
VRIMQKKYW

SEQ ID NO: 385941 - protein, 9 aa, Homo Sapiens
QKPREERDV

SEQ ID NO: 385942 - protein, 9 aa, Homo Sapiens
SQEESRIYF

SEQ ID NO: 385943 - protein, 9 aa, Homo Sapiens
NNGKKHQKK

SEQ ID NO: 385944 - protein, 9 aa, Homo Sapiens
SVFQCVQML

SEQ ID NO: 385945 - protein, 9 aa, Homo Sapiens
ECKSFKDKF

SEQ ID NO: 385946 - protein, 9 aa, Homo Sapiens
HPQISLGRQ

SEQ ID NO: 385947 - protein, 9 aa, Homo Sapiens
ALTEANKLA

SEQ ID NO: 385948 - protein, 9 aa, Homo Sapiens
LLVIFWKLC

SEQ ID NO: 385949 - protein, 9 aa, Homo Sapiens
KKKQNNGKK

SEQ ID NO: 385950 - protein, 9 aa, Homo Sapiens
QIIHTEERY

SEQ ID NO: 385951 - protein, 9 aa, Homo Sapiens
IFEDAKLVC

SEQ ID NO: 385952 - protein, 9 aa, Homo Sapiens
LERKKQHLA

SEQ ID NO: 385953 - protein, 9 aa, Homo Sapiens
FVGTIPNQL

SEQ ID NO: 385954 - protein, 9 aa, Homo Sapiens
GYEYADFPH

SEQ ID NO: 385955 - protein, 9 aa, Homo Sapiens
SIEKEKSDE

SEQ ID NO: 385956 - protein, 9 aa, Homo Sapiens
KSPRITTLC

SEQ ID NO: 385957 - protein, 9 aa, Homo Sapiens
YTPNWDLVS

SEQ ID NO: 385958 - protein, 9 aa, Homo Sapiens
DIYLNLIND

SEQ ID NO: 385959 - protein, 9 aa, Homo Sapiens
LNNKLCITG

SEQ ID NO: 385960 - protein, 9 aa, Homo Sapiens
WLENEKIHL

SEQ ID NO: 385961 - protein, 9 aa, Homo Sapiens
EIEASNINN

SEQ ID NO: 385962 - protein, 9 aa, Homo Sapiens
NEHQILHRR

SEQ ID NO: 385963 - protein, 9 aa, Homo Sapiens
RFQGLAPGR

SEQ ID NO: 385964 - protein, 9 aa, Homo Sapiens
EKPESVGKA

SEQ ID NO: 385965 - protein, 9 aa, Homo Sapiens
PHIFVVAEE

SEQ ID NO: 385966 - protein, 9 aa, Homo Sapiens
ENDKDNLNL

SEQ ID NO: 385967 - protein, 9 aa, Homo Sapiens
GSIAKLSDL

SEQ ID NO: 385968 - protein, 9 aa, Homo Sapiens
SSIIIFWTP

SEQ ID NO: 385969 - protein, 9 aa, Homo Sapiens
DTNYRFLRK

SEQ ID NO: 385970 - protein, 9 aa, Homo Sapiens
SVACPCHTQ

SEQ ID NO: 385971 - protein, 9 aa, Homo Sapiens
SVKEKIMGA

SEQ ID NO: 385972 - protein, 9 aa, Homo Sapiens
RGLGDIQPG

SEQ ID NO: 385973 - protein, 9 aa, Homo Sapiens
LMRHRIIHT

SEQ ID NO: 385974 - protein, 9 aa, Homo Sapiens
SCSGPNTHP

SEQ ID NO: 385975 - protein, 9 aa, Homo Sapiens
HQKDLDLAK

SEQ ID NO: 385976 - protein, 9 aa, Homo Sapiens
RYFCMEKLL

SEQ ID NO: 385977 - protein, 9 aa, Homo Sapiens
FHNTLNIHL

SEQ ID NO: 385978 - protein, 9 aa, Homo Sapiens
VVFQLKAEI

SEQ ID NO: 385979 - protein, 9 aa, Homo Sapiens
VKQAPSHMA

SEQ ID NO: 385980 - protein, 9 aa, Homo Sapiens
QLVDSGTWC

SEQ ID NO: 385981 - protein, 9 aa, Homo Sapiens
LIGFVLRRE

SEQ ID NO: 385982 - protein, 9 aa, Homo Sapiens
YHPPIFRPI

SEQ ID NO: 385983 - protein, 9 aa, Homo Sapiens
IQLIKDLAR

SEQ ID NO: 385984 - protein, 9 aa, Homo Sapiens
DIGSGIQYL

SEQ ID NO: 385985 - protein, 9 aa, Homo Sapiens
VPHTLSVFR

SEQ ID NO: 385986 - protein, 9 aa, Homo Sapiens
GVTTIDMMY

SEQ ID NO: 385987 - protein, 9 aa, Homo Sapiens
VGKAKGEGK

SEQ ID NO: 385988 - protein, 9 aa, Homo Sapiens
ASNSLKKKQ

SEQ ID NO: 385989 - protein, 9 aa, Homo Sapiens
DAYPNTLED

SEQ ID NO: 385990 - protein, 9 aa, Homo Sapiens
PSAEDSTGA

SEQ ID NO: 385991 - protein, 9 aa, Homo Sapiens
WWYYLLGWG

SEQ ID NO: 385992 - protein, 9 aa, Homo Sapiens
YNDASNLST

SEQ ID NO: 385993 - protein, 9 aa, Homo Sapiens
KLFNKHKTK

SEQ ID NO: 385994 - protein, 9 aa, Homo Sapiens
QFGGDDYCS

SEQ ID NO: 385995 - protein, 9 aa, Homo Sapiens
KKIAKAGRL

SEQ ID NO: 385996 - protein, 9 aa, Homo Sapiens
PESKLFLCG

SEQ ID NO: 385997 - protein, 9 aa, Homo Sapiens
DRSNLSISP

SEQ ID NO: 385998 - protein, 9 aa, Homo Sapiens
VILCDKLDF

SEQ ID NO: 385999 - protein, 9 aa, Homo Sapiens
LSEDDSKRL

SEQ ID NO: 386000 - protein, 9 aa, Homo Sapiens
RRHIGKGVN

SEQ ID NO: 386001 - protein, 9 aa, Homo Sapiens
IMLIIFAWG

SEQ ID NO: 386002 - protein, 9 aa, Homo Sapiens
KYYVPLCID

SEQ ID NO: 386003 - protein, 9 aa, Homo Sapiens
EKLLPLFGH

SEQ ID NO: 386004 - protein, 9 aa, Homo Sapiens
KRNYRKALK

SEQ ID NO: 386005 - protein, 9 aa, Homo Sapiens
GEGSRAPHS

SEQ ID NO: 386006 - protein, 9 aa, Homo Sapiens
VDGEVRKTE

SEQ ID NO: 386007 - protein, 9 aa, Homo Sapiens
FKLGGGVSI

SEQ ID NO: 386008 - protein, 9 aa, Homo Sapiens
SSVWTLPRN

SEQ ID NO: 386009 - protein, 9 aa, Homo Sapiens
EIVTALVKN

SEQ ID NO: 386010 - protein, 9 aa, Homo Sapiens
CEIYSDTGN

SEQ ID NO: 386011 - protein, 9 aa, Homo Sapiens
FLVKHICAI

SEQ ID NO: 386012 - protein, 9 aa, Homo Sapiens
IFNKYNNDK

SEQ ID NO: 386013 - protein, 9 aa, Homo Sapiens
SQQNKKMSP

SEQ ID NO: 386014 - protein, 9 aa, Homo Sapiens
TQISEVTAQ

SEQ ID NO: 386015 - protein, 9 aa, Homo Sapiens
GGLKAAMIK

SEQ ID NO: 386016 - protein, 9 aa, Homo Sapiens
NIADASSAG

SEQ ID NO: 386017 - protein, 9 aa, Homo Sapiens
SLLSAALQA

SEQ ID NO: 386018 - protein, 9 aa, Homo Sapiens
LDGRNINPK

SEQ ID NO: 386019 - protein, 9 aa, Homo Sapiens
EHVHQQYHH

SEQ ID NO: 386020 - protein, 9 aa, Homo Sapiens
PYFTATPRR

SEQ ID NO: 386021 - protein, 9 aa, Homo Sapiens
KDIQYQNDL

SEQ ID NO: 386022 - protein, 9 aa, Homo Sapiens
GVWSGGSTD

SEQ ID NO: 386023 - protein, 9 aa, Homo Sapiens
DRHGNIADA

SEQ ID NO: 386024 - protein, 9 aa, Homo Sapiens
CWCKEGYQG

SEQ ID NO: 386025 - protein, 9 aa, Homo Sapiens
TEKQRLWWY

SEQ ID NO: 386026 - protein, 9 aa, Homo Sapiens
TPIFKTNDG

SEQ ID NO: 386027 - protein, 9 aa, Homo Sapiens
EDDEISTQR

SEQ ID NO: 386028 - protein, 9 aa, Homo Sapiens
SVAFKFKPR

SEQ ID NO: 386029 - protein, 9 aa, Homo Sapiens
LNLQHDQKT

SEQ ID NO: 386030 - protein, 9 aa, Homo Sapiens
VIEAKENEI

SEQ ID NO: 386031 - protein, 9 aa, Homo Sapiens
ETKIILDHE

SEQ ID NO: 386032 - protein, 9 aa, Homo Sapiens
EQTHLSEDD

SEQ ID NO: 386033 - protein, 9 aa, Homo Sapiens
DICKQEDKL

SEQ ID NO: 386034 - protein, 9 aa, Homo Sapiens
GPTKEPTVT

SEQ ID NO: 386035 - protein, 9 aa, Homo Sapiens
DKVKVGDSL

SEQ ID NO: 386036 - protein, 9 aa, Homo Sapiens
ENLQNRFKH

SEQ ID NO: 386037 - protein, 9 aa, Homo Sapiens
KIIHIRENS

SEQ ID NO: 386038 - protein, 9 aa, Homo Sapiens
HWWKKGAFC

SEQ ID NO: 386039 - protein, 9 aa, Homo Sapiens
RRITYSDTD

SEQ ID NO: 386040 - protein, 9 aa, Homo Sapiens
LHVLVCLCG

SEQ ID NO: 386041 - protein, 9 aa, Homo Sapiens
VQREEPVRI

SEQ ID NO: 386042 - protein, 9 aa, Homo Sapiens
GLFVPHGYL

SEQ ID NO: 386043 - protein, 9 aa, Homo Sapiens
RDGFDLYLT

SEQ ID NO: 386044 - protein, 9 aa, Homo Sapiens
QEKYPGKMS

SEQ ID NO: 386045 - protein, 9 aa, Homo Sapiens
EAFNYIKQR

SEQ ID NO: 386046 - protein, 9 aa, Homo Sapiens
IINHFFCKI

SEQ ID NO: 386047 - protein, 9 aa, Homo Sapiens
HAESPDYLV

SEQ ID NO: 386048 - protein, 9 aa, Homo Sapiens
KLCDGFSLQ

SEQ ID NO: 386049 - protein, 9 aa, Homo Sapiens
HENIITHGK

SEQ ID NO: 386050 - protein, 9 aa, Homo Sapiens
QVQTRMQKM

SEQ ID NO: 386051 - protein, 9 aa, Homo Sapiens
EYFTQNNVT

SEQ ID NO: 386052 - protein, 9 aa, Homo Sapiens
IWKKMQVPT

SEQ ID NO: 386053 - protein, 9 aa, Homo Sapiens
PFYPPISGS

SEQ ID NO: 386054 - protein, 9 aa, Homo Sapiens
VLDTNYRFL

SEQ ID NO: 386055 - protein, 9 aa, Homo Sapiens
EPSDTIKNV

SEQ ID NO: 386056 - protein, 9 aa, Homo Sapiens
GAFSYRRYS

SEQ ID NO: 386057 - protein, 9 aa, Homo Sapiens
AVWGRAKAL

SEQ ID NO: 386058 - protein, 9 aa, Homo Sapiens
LSYLNVTHK

SEQ ID NO: 386059 - protein, 9 aa, Homo Sapiens
YCSKMEYMT

SEQ ID NO: 386060 - protein, 9 aa, Homo Sapiens
VLDNEILTA

SEQ ID NO: 386061 - protein, 9 aa, Homo Sapiens
TWCKLQWSQ

SEQ ID NO: 386062 - protein, 9 aa, Homo Sapiens
TFIRPSRVH

SEQ ID NO: 386063 - protein, 9 aa, Homo Sapiens
IYTLMHKDS

SEQ ID NO: 386064 - protein, 9 aa, Homo Sapiens
VLLDFTEIR

SEQ ID NO: 386065 - protein, 9 aa, Homo Sapiens
IDVVWGITR

SEQ ID NO: 386066 - protein, 9 aa, Homo Sapiens
AFKIIKDSE

SEQ ID NO: 386067 - protein, 9 aa, Homo Sapiens
FEYFSRSLP

SEQ ID NO: 386068 - protein, 9 aa, Homo Sapiens
ILEALQIII

SEQ ID NO: 386069 - protein, 9 aa, Homo Sapiens
TDGQWNGRN

SEQ ID NO: 386070 - protein, 9 aa, Homo Sapiens
SPGSLQIYL

SEQ ID NO: 386071 - protein, 9 aa, Homo Sapiens
SMNKLTRKQ

SEQ ID NO: 386072 - protein, 9 aa, Homo Sapiens
VITTKPTDD

SEQ ID NO: 386073 - protein, 9 aa, Homo Sapiens
NQLHRVLKS

SEQ ID NO: 386074 - protein, 9 aa, Homo Sapiens
FHYLTEVKY

SEQ ID NO: 386075 - protein, 9 aa, Homo Sapiens
PPGLGGSPG

SEQ ID NO: 386076 - protein, 9 aa, Homo Sapiens
SRIRAQKKN

SEQ ID NO: 386077 - protein, 9 aa, Homo Sapiens
ILEIRETYF

SEQ ID NO: 386078 - protein, 9 aa, Homo Sapiens
VQQMYTTDQ

SEQ ID NO: 386079 - protein, 9 aa, Homo Sapiens
TNKLFHEIY

SEQ ID NO: 386080 - protein, 9 aa, Homo Sapiens
IIGKNKNSC

SEQ ID NO: 386081 - protein, 9 aa, Homo Sapiens
FPCPEKCAK

SEQ ID NO: 386082 - protein, 9 aa, Homo Sapiens
QLCEVGEEE

SEQ ID NO: 386083 - protein, 9 aa, Homo Sapiens
YHIALFGGS

SEQ ID NO: 386084 - protein, 9 aa, Homo Sapiens
TTKPTDDTT

SEQ ID NO: 386085 - protein, 9 aa, Homo Sapiens
QRKLFQEIV

SEQ ID NO: 386086 - protein, 9 aa, Homo Sapiens
WRNQGAGAC

SEQ ID NO: 386087 - protein, 9 aa, Homo Sapiens
IRPSRVHYY

SEQ ID NO: 386088 - protein, 9 aa, Homo Sapiens
KGILAWVTV

SEQ ID NO: 386089 - protein, 9 aa, Homo Sapiens
LALPFQIII

SEQ ID NO: 386090 - protein, 9 aa, Homo Sapiens
RKNMTRVAY

SEQ ID NO: 386091 - protein, 9 aa, Homo Sapiens
RFWDKSSYN

SEQ ID NO: 386092 - protein, 9 aa, Homo Sapiens
KQSRRLLVK

SEQ ID NO: 386093 - protein, 9 aa, Homo Sapiens
EWDLAKSLH

SEQ ID NO: 386094 - protein, 9 aa, Homo Sapiens
ADLLVGVTV

SEQ ID NO: 386095 - protein, 9 aa, Homo Sapiens
YVKKGSQIY

SEQ ID NO: 386096 - protein, 9 aa, Homo Sapiens
PQSEHGPQT

SEQ ID NO: 386097 - protein, 9 aa, Homo Sapiens
PCTHPPCTG

SEQ ID NO: 386098 - protein, 8 aa, Homo Sapiens
KILVAFLV

SEQ ID NO: 386099 - protein, 9 aa, Homo Sapiens
LKEAFNYIK

SEQ ID NO: 386100 - protein, 9 aa, Homo Sapiens
NKTAPIKGC

SEQ ID NO: 386101 - protein, 9 aa, Homo Sapiens
AVMNFKAVL

SEQ ID NO: 386102 - protein, 9 aa, Homo Sapiens
SLLRLISLF

SEQ ID NO: 386103 - protein, 9 aa, Homo Sapiens
YFCMEKLLD

SEQ ID NO: 386104 - protein, 9 aa, Homo Sapiens
ANSASPPAD

SEQ ID NO: 386105 - protein, 9 aa, Homo Sapiens
SFRVDVPFN

SEQ ID NO: 386106 - protein, 9 aa, Homo Sapiens
NSIKSKSKD

SEQ ID NO: 386107 - protein, 9 aa, Homo Sapiens
KVTEMNNSL

SEQ ID NO: 386108 - protein, 9 aa, Homo Sapiens
PQLHIRKAR

SEQ ID NO: 386109 - protein, 9 aa, Homo Sapiens
NNQAVKERA

SEQ ID NO: 386110 - protein, 9 aa, Homo Sapiens
ASGATYVIY

SEQ ID NO: 386111 - protein, 9 aa, Homo Sapiens
FWDKMATQE

SEQ ID NO: 386112 - protein, 9 aa, Homo Sapiens
MSGYIKQKW

SEQ ID NO: 386113 - protein, 9 aa, Homo Sapiens
GRVEAYLNL

SEQ ID NO: 386114 - protein, 9 aa, Homo Sapiens
IKEVIKRAN

SEQ ID NO: 386115 - protein, 9 aa, Homo Sapiens
SPPLGRFAV

SEQ ID NO: 386116 - protein, 9 aa, Homo Sapiens
QYYEGSDIV

SEQ ID NO: 386117 - protein, 9 aa, Homo Sapiens
MGDDSFNKT

SEQ ID NO: 386118 - protein, 9 aa, Homo Sapiens
ALHLCSPFT

SEQ ID NO: 386119 - protein, 9 aa, Homo Sapiens
WHQGCKTEV

SEQ ID NO: 386120 - protein, 9 aa, Homo Sapiens
LKQKKTTDE

SEQ ID NO: 386121 - protein, 9 aa, Homo Sapiens
KVGIPASLQ

SEQ ID NO: 386122 - protein, 9 aa, Homo Sapiens
AGLDCPAAG

SEQ ID NO: 386123 - protein, 9 aa, Homo Sapiens
SDIVVAGRI

SEQ ID NO: 386124 - protein, 9 aa, Homo Sapiens
GLWTLIIMV

SEQ ID NO: 386125 - protein, 9 aa, Homo Sapiens
INMNKFFPK

SEQ ID NO: 386126 - protein, 9 aa, Homo Sapiens
CSIPHYLGG

SEQ ID NO: 386127 - protein, 9 aa, Homo Sapiens
AAKVQIQTQ

SEQ ID NO: 386128 - protein, 9 aa, Homo Sapiens
ASPTAGMVT

SEQ ID NO: 386129 - protein, 9 aa, Homo Sapiens
NFYLNLGLL

SEQ ID NO: 386130 - protein, 9 aa, Homo Sapiens
DGELSVPSS

SEQ ID NO: 386131 - protein, 9 aa, Homo Sapiens
ATRVGSIAK

SEQ ID NO: 386132 - protein, 9 aa, Homo Sapiens
NNLYRDVMQ

SEQ ID NO: 386133 - protein, 9 aa, Homo Sapiens
FETENVDSI

SEQ ID NO: 386134 - protein, 9 aa, Homo Sapiens
TGQQVCWAS

SEQ ID NO: 386135 - protein, 9 aa, Homo Sapiens
VIFDRIRKG

SEQ ID NO: 386136 - protein, 9 aa, Homo Sapiens
DYHLNYVKE

SEQ ID NO: 386137 - protein, 9 aa, Homo Sapiens
IRECVFLHI

SEQ ID NO: 386138 - protein, 9 aa, Homo Sapiens
TVTDPQNLL

SEQ ID NO: 386139 - protein, 9 aa, Homo Sapiens
VLAAVIVGG

SEQ ID NO: 386140 - protein, 9 aa, Homo Sapiens
SHSQIKHQN

SEQ ID NO: 386141 - protein, 9 aa, Homo Sapiens
WLTILFIFQ

SEQ ID NO: 386142 - protein, 9 aa, Homo Sapiens
DIGLVASET

SEQ ID NO: 386143 - protein, 9 aa, Homo Sapiens
FGKFIHINF

SEQ ID NO: 386144 - protein, 9 aa, Homo Sapiens
FQIIICSLE

SEQ ID NO: 386145 - protein, 9 aa, Homo Sapiens
SNLMEHKII

SEQ ID NO: 386146 - protein, 9 aa, Homo Sapiens
GIANEDTAH

SEQ ID NO: 386147 - protein, 9 aa, Homo Sapiens
FNIDSNNLK

SEQ ID NO: 386148 - protein, 9 aa, Homo Sapiens
QLRALTEAN

SEQ ID NO: 386149 - protein, 9 aa, Homo Sapiens
FSGRLTAIK

SEQ ID NO: 386150 - protein, 9 aa, Homo Sapiens
GCLSKIMSY

SEQ ID NO: 386151 - protein, 9 aa, Homo Sapiens
GSPAVAAAP

SEQ ID NO: 386152 - protein, 9 aa, Homo Sapiens
GLTVYKPEL

SEQ ID NO: 386153 - protein, 9 aa, Homo Sapiens
VDLCETDKL

SEQ ID NO: 386154 - protein, 9 aa, Homo Sapiens
HMLPLLAQL

SEQ ID NO: 386155 - protein, 9 aa, Homo Sapiens
TLRYGHILD

SEQ ID NO: 386156 - protein, 9 aa, Homo Sapiens
DTVLLDFTE

SEQ ID NO: 386157 - protein, 9 aa, Homo Sapiens
KDLQNLDKE

SEQ ID NO: 386158 - protein, 9 aa, Homo Sapiens
SISHILRNK

SEQ ID NO: 386159 - protein, 9 aa, Homo Sapiens
APGQRLQIH

SEQ ID NO: 386160 - protein, 9 aa, Homo Sapiens
DEQNNLKKE

SEQ ID NO: 386161 - protein, 9 aa, Homo Sapiens
ATAPATPTP

SEQ ID NO: 386162 - protein, 9 aa, Homo Sapiens
LDFLSGIQI

SEQ ID NO: 386163 - protein, 9 aa, Homo Sapiens
KQKRQRHAA

SEQ ID NO: 386164 - protein, 9 aa, Homo Sapiens
CRLKLCDGF

SEQ ID NO: 386165 - protein, 9 aa, Homo Sapiens
GRYFFCMEK

SEQ ID NO: 386166 - protein, 9 aa, Homo Sapiens
GALWHHYKC

SEQ ID NO: 386167 - protein, 9 aa, Homo Sapiens
VLEILNHSS

SEQ ID NO: 386168 - protein, 9 aa, Homo Sapiens
LFINNNIRA

SEQ ID NO: 386169 - protein, 9 aa, Homo Sapiens
KRSERTCSL

SEQ ID NO: 386170 - protein, 9 aa, Homo Sapiens
EPVRRPMCK

SEQ ID NO: 386171 - protein, 9 aa, Homo Sapiens
FSPEQNIKY

SEQ ID NO: 386172 - protein, 9 aa, Homo Sapiens
IFQMLVLGV

SEQ ID NO: 386173 - protein, 9 aa, Homo Sapiens
VAICNPLKY

SEQ ID NO: 386174 - protein, 9 aa, Homo Sapiens
RTRSTSYWR

SEQ ID NO: 386175 - protein, 9 aa, Homo Sapiens
TYGFIQAKQ

SEQ ID NO: 386176 - protein, 9 aa, Homo Sapiens
GIEKIITMI

SEQ ID NO: 386177 - protein, 9 aa, Homo Sapiens
EHFCIDGPV

SEQ ID NO: 386178 - protein, 9 aa, Homo Sapiens
TDSATTQIS

SEQ ID NO: 386179 - protein, 9 aa, Homo Sapiens
LKKIAKAGR

SEQ ID NO: 386180 - protein, 9 aa, Homo Sapiens
QKEMGIQEV

SEQ ID NO: 386181 - protein, 9 aa, Homo Sapiens
PPKSLLALG

SEQ ID NO: 386182 - protein, 9 aa, Homo Sapiens
EKMWRQEDK

SEQ ID NO: 386183 - protein, 9 aa, Homo Sapiens
YLQLPEADA

SEQ ID NO: 386184 - protein, 9 aa, Homo Sapiens
IVGGATQIP

SEQ ID NO: 386185 - protein, 9 aa, Homo Sapiens
KMDNLLRGD

SEQ ID NO: 386186 - protein, 9 aa, Homo Sapiens
SQSPPLGRF

SEQ ID NO: 386187 - protein, 9 aa, Homo Sapiens
AVAMKVDNF

SEQ ID NO: 386188 - protein, 9 aa, Homo Sapiens
EWGKIWRLM

SEQ ID NO: 386189 - protein, 9 aa, Homo Sapiens
ERPPEPQAM

SEQ ID NO: 386190 - protein, 9 aa, Homo Sapiens
FEYQLVAFD

SEQ ID NO: 386191 - protein, 9 aa, Homo Sapiens
IARKQIRLG

SEQ ID NO: 386192 - protein, 9 aa, Homo Sapiens
KRIQKQFFH

SEQ ID NO: 386193 - protein, 9 aa, Homo Sapiens
AASEGATAP

SEQ ID NO: 386194 - protein, 9 aa, Homo Sapiens
VRYRNAQRK

SEQ ID NO: 386195 - protein, 9 aa, Homo Sapiens
CKMLQELPD

SEQ ID NO: 386196 - protein, 9 aa, Homo Sapiens
TIHQFVLLF

SEQ ID NO: 386197 - protein, 9 aa, Homo Sapiens
GTSFLIDEL

SEQ ID NO: 386198 - protein, 9 aa, Homo Sapiens
HKTPSGEKQ

SEQ ID NO: 386199 - protein, 9 aa, Homo Sapiens
AMIKLVERL

SEQ ID NO: 386200 - protein, 9 aa, Homo Sapiens
ELLVIFWKL

SEQ ID NO: 386201 - protein, 9 aa, Homo Sapiens
VVTSEINQL

SEQ ID NO: 386202 - protein, 9 aa, Homo Sapiens
GENTFEGDI

SEQ ID NO: 386203 - protein, 9 aa, Homo Sapiens
TVQGITGLC

SEQ ID NO: 386204 - protein, 9 aa, Homo Sapiens
SPFTSQDIQ

SEQ ID NO: 386205 - protein, 9 aa, Homo Sapiens
PNQLDPGTL

SEQ ID NO: 386206 - protein, 9 aa, Homo Sapiens
FNYIKQRRS

SEQ ID NO: 386207 - protein, 9 aa, Homo Sapiens
PTSSVVGIT

SEQ ID NO: 386208 - protein, 9 aa, Homo Sapiens
RNNFPGEMV

SEQ ID NO: 386209 - protein, 9 aa, Homo Sapiens
IELEVENRG

SEQ ID NO: 386210 - protein, 9 aa, Homo Sapiens
DNTSMPTST

SEQ ID NO: 386211 - protein, 9 aa, Homo Sapiens
LQTKYLGCQ

SEQ ID NO: 386212 - protein, 9 aa, Homo Sapiens
SWAQDNKLI

SEQ ID NO: 386213 - protein, 9 aa, Homo Sapiens
EEAASVQRS

SEQ ID NO: 386214 - protein, 9 aa, Homo Sapiens
GPQTLDNLI

SEQ ID NO: 386215 - protein, 9 aa, Homo Sapiens
VRGAQCGLG

SEQ ID NO: 386216 - protein, 9 aa, Homo Sapiens
KTPINKQEA

SEQ ID NO: 386217 - protein, 9 aa, Homo Sapiens
KFKSIKEVI

SEQ ID NO: 386218 - protein, 9 aa, Homo Sapiens
MGQHSSVAC

SEQ ID NO: 386219 - protein, 9 aa, Homo Sapiens
NGQANTVEM

SEQ ID NO: 386220 - protein, 9 aa, Homo Sapiens
FISANVMYK

SEQ ID NO: 386221 - protein, 9 aa, Homo Sapiens
IVHKIIHTG

SEQ ID NO: 386222 - protein, 9 aa, Homo Sapiens
ENEIKINEA

SEQ ID NO: 386223 - protein, 9 aa, Homo Sapiens
KDVGLKQFF

SEQ ID NO: 386224 - protein, 9 aa, Homo Sapiens
VNCTGSSGY

SEQ ID NO: 386225 - protein, 9 aa, Homo Sapiens
EVEKATVPA

SEQ ID NO: 386226 - protein, 9 aa, Homo Sapiens
INMEENLDP

SEQ ID NO: 386227 - protein, 9 aa, Homo Sapiens
RNSAGGGGE

SEQ ID NO: 386228 - protein, 9 aa, Homo Sapiens
NVEYNISGA

SEQ ID NO: 386229 - protein, 9 aa, Homo Sapiens
APATPADPD

SEQ ID NO: 386230 - protein, 9 aa, Homo Sapiens
MLAATYIAL

SEQ ID NO: 386231 - protein, 9 aa, Homo Sapiens
CFLCYFFFL

SEQ ID NO: 386232 - protein, 9 aa, Homo Sapiens
LFIKIFIIY

SEQ ID NO: 386233 - protein, 9 aa, Homo Sapiens
MGWTPNMSV

SEQ ID NO: 386234 - protein, 9 aa, Homo Sapiens
PDCYVELET

SEQ ID NO: 386235 - protein, 9 aa, Homo Sapiens
CQKYYVPLC

SEQ ID NO: 386236 - protein, 9 aa, Homo Sapiens
YEIYFKVWM

SEQ ID NO: 386237 - protein, 9 aa, Homo Sapiens
KLLDPAIWF

SEQ ID NO: 386238 - protein, 9 aa, Homo Sapiens
KKGSQIYLE

SEQ ID NO: 386239 - protein, 9 aa, Homo Sapiens
QNLVWKFRY

SEQ ID NO: 386240 - protein, 9 aa, Homo Sapiens
EQGQDNPPD

SEQ ID NO: 386241 - protein, 9 aa, Homo Sapiens
APKVIKSSL

SEQ ID NO: 386242 - protein, 9 aa, Homo Sapiens
IHDWRKFKL

SEQ ID NO: 386243 - protein, 9 aa, Homo Sapiens
FIKPTKNSE

SEQ ID NO: 386244 - protein, 9 aa, Homo Sapiens
RVDISISQL

SEQ ID NO: 386245 - protein, 9 aa, Homo Sapiens
AHKDLLNES

SEQ ID NO: 386246 - protein, 9 aa, Homo Sapiens
ETTQNNFNN

SEQ ID NO: 386247 - protein, 9 aa, Homo Sapiens
PSKDLQNLD

SEQ ID NO: 386248 - protein, 9 aa, Homo Sapiens
WVPASYLKK

SEQ ID NO: 386249 - protein, 9 aa, Homo Sapiens
SRAPHSNSS

SEQ ID NO: 386250 - protein, 9 aa, Homo Sapiens
SDCGQSFSR

SEQ ID NO: 386251 - protein, 9 aa, Homo Sapiens
DKMATQEVP

SEQ ID NO: 386252 - protein, 9 aa, Homo Sapiens
QKDYLGDID

SEQ ID NO: 386253 - protein, 9 aa, Homo Sapiens
ESVWLPGVV

SEQ ID NO: 386254 - protein, 9 aa, Homo Sapiens
IDIQIPTGQ

SEQ ID NO: 386255 - protein, 9 aa, Homo Sapiens
KEVIPDSKS

SEQ ID NO: 386256 - protein, 9 aa, Homo Sapiens
RSQQNKKMS

SEQ ID NO: 386257 - protein, 9 aa, Homo Sapiens
RHKKIHIRE

SEQ ID NO: 386258 - protein, 9 aa, Homo Sapiens
LEGARWDSE

SEQ ID NO: 386259 - protein, 9 aa, Homo Sapiens
VVLAVKELS

SEQ ID NO: 386260 - protein, 9 aa, Homo Sapiens
ENVRKLLKL

SEQ ID NO: 386261 - protein, 9 aa, Homo Sapiens
HAWYFPSEP

SEQ ID NO: 386262 - protein, 9 aa, Homo Sapiens
FDSKFIETS

SEQ ID NO: 386263 - protein, 9 aa, Homo Sapiens
FTATPRRFL

SEQ ID NO: 386264 - protein, 9 aa, Homo Sapiens
VAVITLHRL

SEQ ID NO: 386265 - protein, 9 aa, Homo Sapiens
ELEFEVPCR

SEQ ID NO: 386266 - protein, 9 aa, Homo Sapiens
CSLCSEAVP

SEQ ID NO: 386267 - protein, 9 aa, Homo Sapiens
TQNNFNNLY

SEQ ID NO: 386268 - protein, 9 aa, Homo Sapiens
RASFQDWGP

SEQ ID NO: 386269 - protein, 9 aa, Homo Sapiens
KLNCLNGIR

SEQ ID NO: 386270 - protein, 9 aa, Homo Sapiens
TTDDDTMSK

SEQ ID NO: 386271 - protein, 9 aa, Homo Sapiens
LSRGAVPPP

SEQ ID NO: 386272 - protein, 9 aa, Homo Sapiens
EVVHIGHLY

SEQ ID NO: 386273 - protein, 9 aa, Homo Sapiens
EEYEKECSL

SEQ ID NO: 386274 - protein, 9 aa, Homo Sapiens
PCHSDTLEC

SEQ ID NO: 386275 - protein, 9 aa, Homo Sapiens
EKIMGAPSL

SEQ ID NO: 386276 - protein, 9 aa, Homo Sapiens
QNNLKKEFL

SEQ ID NO: 386277 - protein, 9 aa, Homo Sapiens
LENELFTFF

SEQ ID NO: 386278 - protein, 9 aa, Homo Sapiens
IFLLAMGAN

SEQ ID NO: 386279 - protein, 9 aa, Homo Sapiens
NSVINDIVK

SEQ ID NO: 386280 - protein, 9 aa, Homo Sapiens
QEERLIFLN

SEQ ID NO: 386281 - protein, 9 aa, Homo Sapiens
AAFTTSAAC

SEQ ID NO: 386282 - protein, 9 aa, Homo Sapiens
DKQVLYFDA

SEQ ID NO: 386283 - protein, 9 aa, Homo Sapiens
TSFNLIIAK

SEQ ID NO: 386284 - protein, 9 aa, Homo Sapiens
EKESKFIES

SEQ ID NO: 386285 - protein, 9 aa, Homo Sapiens
KIIPSIVSS

SEQ ID NO: 386286 - protein, 9 aa, Homo Sapiens
VFDRHGNIA

SEQ ID NO: 386287 - protein, 9 aa, Homo Sapiens
ELLQIQTLF

SEQ ID NO: 386288 - protein, 9 aa, Homo Sapiens
FKEMNNVFA

SEQ ID NO: 386289 - protein, 9 aa, Homo Sapiens
ECRLGEEIK

SEQ ID NO: 386290 - protein, 9 aa, Homo Sapiens
KDNNREEMH

SEQ ID NO: 386291 - protein, 9 aa, Homo Sapiens
MEKLQCLEV

SEQ ID NO: 386292 - protein, 9 aa, Homo Sapiens
NSTGCTGRM

SEQ ID NO: 386293 - protein, 9 aa, Homo Sapiens
CTAGSADTH

SEQ ID NO: 386294 - protein, 9 aa, Homo Sapiens
SCKPKGEGS

SEQ ID NO: 386295 - protein, 9 aa, Homo Sapiens
YTSIQKTLK

SEQ ID NO: 386296 - protein, 9 aa, Homo Sapiens
AQFIWKKMQ

SEQ ID NO: 386297 - protein, 9 aa, Homo Sapiens
SYRRYSPFA

SEQ ID NO: 386298 - protein, 9 aa, Homo Sapiens
FFSCHAINL

SEQ ID NO: 386299 - protein, 9 aa, Homo Sapiens
ITDAVYNHT

SEQ ID NO: 386300 - protein, 9 aa, Homo Sapiens
VQYQIILNG

SEQ ID NO: 386301 - protein, 9 aa, Homo Sapiens
RIRAQKKNN

SEQ ID NO: 386302 - protein, 9 aa, Homo Sapiens
QKADVQAPV

SEQ ID NO: 386303 - protein, 9 aa, Homo Sapiens
LAFAYTSVL

SEQ ID NO: 386304 - protein, 9 aa, Homo Sapiens
LVDSGTWCK

SEQ ID NO: 386305 - protein, 9 aa, Homo Sapiens
HGQDDDHRE

SEQ ID NO: 386306 - protein, 9 aa, Homo Sapiens
EFLSCANYA

SEQ ID NO: 386307 - protein, 9 aa, Homo Sapiens
TIILSERKN

SEQ ID NO: 386308 - protein, 9 aa, Homo Sapiens
DINTRFLSD

SEQ ID NO: 386309 - protein, 9 aa, Homo Sapiens
NPLAPSRGK

SEQ ID NO: 386310 - protein, 9 aa, Homo Sapiens
EVPCRDLGF

SEQ ID NO: 386311 - protein, 9 aa, Homo Sapiens
LNLGVLVPL

SEQ ID NO: 386312 - protein, 9 aa, Homo Sapiens
NLTIVSPAY

SEQ ID NO: 386313 - protein, 9 aa, Homo Sapiens
QMKIDREFA

SEQ ID NO: 386314 - protein, 9 aa, Homo Sapiens
LNLIGFVLR

SEQ ID NO: 386315 - protein, 9 aa, Homo Sapiens
LQIYLLDGL

SEQ ID NO: 386316 - protein, 9 aa, Homo Sapiens
EVMEAFNLL

SEQ ID NO: 386317 - protein, 9 aa, Homo Sapiens
PRADNIHNT

SEQ ID NO: 386318 - protein, 9 aa, Homo Sapiens
KNSGFWRSD

SEQ ID NO: 386319 - protein, 9 aa, Homo Sapiens
QVKASEKII

SEQ ID NO: 386320 - protein, 9 aa, Homo Sapiens
QQLCEVGEE

SEQ ID NO: 386321 - protein, 9 aa, Homo Sapiens
CPCLCPDDP

SEQ ID NO: 386322 - protein, 9 aa, Homo Sapiens
FIFQTDTRI

SEQ ID NO: 386323 - protein, 9 aa, Homo Sapiens
LNEWTNDTG

SEQ ID NO: 386324 - protein, 9 aa, Homo Sapiens
LMLLQQSPT

SEQ ID NO: 386325 - protein, 9 aa, Homo Sapiens
IIVGLEDGK

SEQ ID NO: 386326 - protein, 9 aa, Homo Sapiens
KEKIMGAPS

SEQ ID NO: 386327 - protein, 9 aa, Homo Sapiens
INKEALVSA

SEQ ID NO: 386328 - protein, 9 aa, Homo Sapiens
LPLKFHDAE

SEQ ID NO: 386329 - protein, 9 aa, Homo Sapiens
ILHRREKPY

SEQ ID NO: 386330 - protein, 9 aa, Homo Sapiens
LNPVKPMNA

SEQ ID NO: 386331 - protein, 9 aa, Homo Sapiens
APAVAPLPC

SEQ ID NO: 386332 - protein, 9 aa, Homo Sapiens
ATKLNMMSK

SEQ ID NO: 386333 - protein, 9 aa, Homo Sapiens
HIKLYDNNT

SEQ ID NO: 386334 - protein, 9 aa, Homo Sapiens
TQNQAFYLP

SEQ ID NO: 386335 - protein, 9 aa, Homo Sapiens
EVVEVVHIG

SEQ ID NO: 386336 - protein, 9 aa, Homo Sapiens
LAPSRGKDD

SEQ ID NO: 386337 - protein, 9 aa, Homo Sapiens
QAQFIWKKM

SEQ ID NO: 386338 - protein, 9 aa, Homo Sapiens
RLLYLSYNR

SEQ ID NO: 386339 - protein, 9 aa, Homo Sapiens
GNGSPGIEW

SEQ ID NO: 386340 - protein, 9 aa, Homo Sapiens
RTTKDNILP

SEQ ID NO: 386341 - protein, 9 aa, Homo Sapiens
VALVHVTDW

SEQ ID NO: 386342 - protein, 9 aa, Homo Sapiens
SRSLWCPVG

SEQ ID NO: 386343 - protein, 9 aa, Homo Sapiens
YQILESHGF

SEQ ID NO: 386344 - protein, 9 aa, Homo Sapiens
NEFTFGNKP

SEQ ID NO: 386345 - protein, 9 aa, Homo Sapiens
ELTEPCILH

SEQ ID NO: 386346 - protein, 9 aa, Homo Sapiens
VWKEVRGEW

SEQ ID NO: 386347 - protein, 9 aa, Homo Sapiens
MASEELVCK

SEQ ID NO: 386348 - protein, 9 aa, Homo Sapiens
CPNLLPAPS

SEQ ID NO: 386349 - protein, 9 aa, Homo Sapiens
GRTAPAEVH

SEQ ID NO: 386350 - protein, 9 aa, Homo Sapiens
GGAVNCGTR

SEQ ID NO: 386351 - protein, 9 aa, Homo Sapiens
KEINNMTIP

SEQ ID NO: 386352 - protein, 9 aa, Homo Sapiens
GTLSGDTVG

SEQ ID NO: 386353 - protein, 9 aa, Homo Sapiens
MEGRKIHVL

SEQ ID NO: 386354 - protein, 9 aa, Homo Sapiens
QWLEDRARL

SEQ ID NO: 386355 - protein, 9 aa, Homo Sapiens
SHLGLKPFS

SEQ ID NO: 386356 - protein, 9 aa, Homo Sapiens
WRTSRTRET

SEQ ID NO: 386357 - protein, 9 aa, Homo Sapiens
ILQAIRKTV

SEQ ID NO: 386358 - protein, 9 aa, Homo Sapiens
ERDLQSSDR

SEQ ID NO: 386359 - protein, 9 aa, Homo Sapiens
SLKARGALA

SEQ ID NO: 386360 - protein, 9 aa, Homo Sapiens
TFQRAPLKF

SEQ ID NO: 386361 - protein, 9 aa, Homo Sapiens
RYRTTKDNI

SEQ ID NO: 386362 - protein, 9 aa, Homo Sapiens
ASRTRRARG

SEQ ID NO: 386363 - protein, 9 aa, Homo Sapiens
TVNSKIETE

SEQ ID NO: 386364 - protein, 9 aa, Homo Sapiens
EKETSLWFK

SEQ ID NO: 386365 - protein, 9 aa, Homo Sapiens
AIWVADLLQ

SEQ ID NO: 386366 - protein, 9 aa, Homo Sapiens
DDRGTPWLR

SEQ ID NO: 386367 - protein, 9 aa, Homo Sapiens
TSEGTPGVR

SEQ ID NO: 386368 - protein, 9 aa, Homo Sapiens
STSITRFAF

SEQ ID NO: 386369 - protein, 9 aa, Homo Sapiens
PQDGCNDGS

SEQ ID NO: 386370 - protein, 9 aa, Homo Sapiens
KLLPTLPPT

SEQ ID NO: 386371 - protein, 9 aa, Homo Sapiens
SFLFLFLPG

SEQ ID NO: 386372 - protein, 9 aa, Homo Sapiens
TDLGRPAHS

SEQ ID NO: 386373 - protein, 9 aa, Homo Sapiens
RAEDPPHQP

SEQ ID NO: 386374 - protein, 9 aa, Homo Sapiens
QTRSFLKWT

SEQ ID NO: 386375 - protein, 9 aa, Homo Sapiens
ILPLEQLGR

SEQ ID NO: 386376 - protein, 9 aa, Homo Sapiens
ANQIINNCI

SEQ ID NO: 386377 - protein, 9 aa, Homo Sapiens
ILSYRWLSL

SEQ ID NO: 386378 - protein, 9 aa, Homo Sapiens
AIVVKFFLQ

SEQ ID NO: 386379 - protein, 9 aa, Homo Sapiens
SSTIISTST

SEQ ID NO: 386380 - protein, 9 aa, Homo Sapiens
KSGSGSGLN

SEQ ID NO: 386381 - protein, 9 aa, Homo Sapiens
ALKLVKRML

SEQ ID NO: 386382 - protein, 9 aa, Homo Sapiens
NPRKCSTSS

SEQ ID NO: 386383 - protein, 9 aa, Homo Sapiens
GVNCEEPSR

SEQ ID NO: 386384 - protein, 9 aa, Homo Sapiens
HRRMEPLPP

SEQ ID NO: 386385 - protein, 9 aa, Homo Sapiens
SSLGSLYVE

SEQ ID NO: 386386 - protein, 9 aa, Homo Sapiens
LCATGKNPM

SEQ ID NO: 386387 - protein, 9 aa, Homo Sapiens
HHFLQGFLP

SEQ ID NO: 386388 - protein, 9 aa, Homo Sapiens
NTTTKALLT

SEQ ID NO: 386389 - protein, 9 aa, Homo Sapiens
NTSLSSLAG

SEQ ID NO: 386390 - protein, 9 aa, Homo Sapiens
PGKEGYRGA

SEQ ID NO: 386391 - protein, 9 aa, Homo Sapiens
IKLVVTNMI

SEQ ID NO: 386392 - protein, 9 aa, Homo Sapiens
SNKQNLWQY

SEQ ID NO: 386393 - protein, 9 aa, Homo Sapiens
DVWSVIASP

SEQ ID NO: 386394 - protein, 9 aa, Homo Sapiens
MQELHAFLE

SEQ ID NO: 386395 - protein, 9 aa, Homo Sapiens
RGVGDRGWA

SEQ ID NO: 386396 - protein, 9 aa, Homo Sapiens
GFLTEDKKN

SEQ ID NO: 386397 - protein, 9 aa, Homo Sapiens
FRQNLQGHM

SEQ ID NO: 386398 - protein, 9 aa, Homo Sapiens
GASQTTDAI

SEQ ID NO: 386399 - protein, 9 aa, Homo Sapiens
ASHVDLETV

SEQ ID NO: 386400 - protein, 9 aa, Homo Sapiens
KILFCVDSK

SEQ ID NO: 386401 - protein, 9 aa, Homo Sapiens
NCEEKILNR

SEQ ID NO: 386402 - protein, 9 aa, Homo Sapiens
ISVPCPNLL

SEQ ID NO: 386403 - protein, 9 aa, Homo Sapiens
DMGHGVTYT

SEQ ID NO: 386404 - protein, 9 aa, Homo Sapiens
SSLAATPLA

SEQ ID NO: 386405 - protein, 9 aa, Homo Sapiens
MVSHLVGGH

SEQ ID NO: 386406 - protein, 9 aa, Homo Sapiens
ILAHIWALA

SEQ ID NO: 386407 - protein, 9 aa, Homo Sapiens
APPEACHGP

SEQ ID NO: 386408 - protein, 9 aa, Homo Sapiens
DRPQGPPQG

SEQ ID NO: 386409 - protein, 9 aa, Homo Sapiens
TAEWPGRLC

SEQ ID NO: 386410 - protein, 9 aa, Homo Sapiens
HLRARVLPG

SEQ ID NO: 386411 - protein, 9 aa, Homo Sapiens
MFLRVRTNV

SEQ ID NO: 386412 - protein, 9 aa, Homo Sapiens
HSDSEGPYD

SEQ ID NO: 386413 - protein, 9 aa, Homo Sapiens
GKGEAQCRG

SEQ ID NO: 386414 - protein, 9 aa, Homo Sapiens
TLEGCISVK

SEQ ID NO: 386415 - protein, 9 aa, Homo Sapiens
QPGEKKSQA

SEQ ID NO: 386416 - protein, 9 aa, Homo Sapiens
CEVYQTPAQ

SEQ ID NO: 386417 - protein, 9 aa, Homo Sapiens
GTLGTSNTI

SEQ ID NO: 386418 - protein, 9 aa, Homo Sapiens
DGEIVITDQ

SEQ ID NO: 386419 - protein, 9 aa, Homo Sapiens
REICAGTAF

SEQ ID NO: 386420 - protein, 9 aa, Homo Sapiens
ASLTTGTFA

SEQ ID NO: 386421 - protein, 9 aa, Homo Sapiens
ASLAAVISL

SEQ ID NO: 386422 - protein, 9 aa, Homo Sapiens
YEQQITLFG

SEQ ID NO: 386423 - protein, 9 aa, Homo Sapiens
HFIGLMMYG

SEQ ID NO: 386424 - protein, 9 aa, Homo Sapiens
ENTRHVIWE

SEQ ID NO: 386425 - protein, 9 aa, Homo Sapiens
GLWTPILEP

SEQ ID NO: 386426 - protein, 9 aa, Homo Sapiens
LADGAHVWL

SEQ ID NO: 386427 - protein, 9 aa, Homo Sapiens
KLTRRQSEK

SEQ ID NO: 386428 - protein, 9 aa, Homo Sapiens
LQERGGVAT

SEQ ID NO: 386429 - protein, 9 aa, Homo Sapiens
KQKLVDMKV

SEQ ID NO: 386430 - protein, 9 aa, Homo Sapiens
LMPPPGLRP

SEQ ID NO: 386431 - protein, 9 aa, Homo Sapiens
TKRLCKQCP

SEQ ID NO: 386432 - protein, 9 aa, Homo Sapiens
SRRRYLQWS

SEQ ID NO: 386433 - protein, 9 aa, Homo Sapiens
PRPRCTRSW

SEQ ID NO: 386434 - protein, 9 aa, Homo Sapiens
PSLSLVDKD

SEQ ID NO: 386435 - protein, 9 aa, Homo Sapiens
PGPAAVTAP

SEQ ID NO: 386436 - protein, 9 aa, Homo Sapiens
AEEEKGEAE

SEQ ID NO: 386437 - protein, 9 aa, Homo Sapiens
GASRARRTT

SEQ ID NO: 386438 - protein, 9 aa, Homo Sapiens
YQFIDKDKD

SEQ ID NO: 386439 - protein, 9 aa, Homo Sapiens
LIGHTNCPS

SEQ ID NO: 386440 - protein, 9 aa, Homo Sapiens
SWEPLCATH

SEQ ID NO: 386441 - protein, 9 aa, Homo Sapiens
KGTCKNNCR

SEQ ID NO: 386442 - protein, 9 aa, Homo Sapiens
QVEVYFLWN

SEQ ID NO: 386443 - protein, 9 aa, Homo Sapiens
NRVDIAHSE

SEQ ID NO: 386444 - protein, 9 aa, Homo Sapiens
YFTLCESWL

SEQ ID NO: 386445 - protein, 9 aa, Homo Sapiens
LLTGLPAPG

SEQ ID NO: 386446 - protein, 9 aa, Homo Sapiens
DAPHPLSKF

SEQ ID NO: 386447 - protein, 9 aa, Homo Sapiens
DGWVEEWYN

SEQ ID NO: 386448 - protein, 9 aa, Homo Sapiens
EYYQAVYYY

SEQ ID NO: 386449 - protein, 9 aa, Homo Sapiens
DLVKHQHVH

SEQ ID NO: 386450 - protein, 9 aa, Homo Sapiens
FMAAFYDCL

SEQ ID NO: 386451 - protein, 9 aa, Homo Sapiens
LFDFLSVGP

SEQ ID NO: 386452 - protein, 9 aa, Homo Sapiens
GDGMLDVTI

SEQ ID NO: 386453 - protein, 9 aa, Homo Sapiens
RIYTGEKPF

SEQ ID NO: 386454 - protein, 9 aa, Homo Sapiens
SVVIHKAAT

SEQ ID NO: 386455 - protein, 9 aa, Homo Sapiens
IELRSQTVV

SEQ ID NO: 386456 - protein, 9 aa, Homo Sapiens
IFTSKKDTW

SEQ ID NO: 386457 - protein, 9 aa, Homo Sapiens
GIKKQHSMP

SEQ ID NO: 386458 - protein, 9 aa, Homo Sapiens
RIAKVLENN

SEQ ID NO: 386459 - protein, 9 aa, Homo Sapiens
EGWMDWATS

SEQ ID NO: 386460 - protein, 9 aa, Homo Sapiens
EASQVGGTQ

SEQ ID NO: 386461 - protein, 9 aa, Homo Sapiens
GRQLAIIRD

SEQ ID NO: 386462 - protein, 9 aa, Homo Sapiens
EIPLPEHRS

SEQ ID NO: 386463 - protein, 9 aa, Homo Sapiens
SSICRGNWR

SEQ ID NO: 386464 - protein, 9 aa, Homo Sapiens
AATVNSKIE

SEQ ID NO: 386465 - protein, 9 aa, Homo Sapiens
LTFVLVDEE

SEQ ID NO: 386466 - protein, 9 aa, Homo Sapiens
LCELTEPCI

SEQ ID NO: 386467 - protein, 9 aa, Homo Sapiens
RQRQTRCQV

SEQ ID NO: 386468 - protein, 9 aa, Homo Sapiens
PQCRPTGRP

SEQ ID NO: 386469 - protein, 9 aa, Homo Sapiens
LLQRNLLRL

SEQ ID NO: 386470 - protein, 9 aa, Homo Sapiens
LESFDQKVH

SEQ ID NO: 386471 - protein, 9 aa, Homo Sapiens
QVPHLRARV

SEQ ID NO: 386472 - protein, 9 aa, Homo Sapiens
GHNPRSSIT

SEQ ID NO: 386473 - protein, 9 aa, Homo Sapiens
FGLIPRLPT

SEQ ID NO: 386474 - protein, 9 aa, Homo Sapiens
IELEPPDKT

SEQ ID NO: 386475 - protein, 9 aa, Homo Sapiens
TVAEVSCSH

SEQ ID NO: 386476 - protein, 9 aa, Homo Sapiens
MMVIYRGTL

SEQ ID NO: 386477 - protein, 9 aa, Homo Sapiens
TIISTSTSR

SEQ ID NO: 386478 - protein, 9 aa, Homo Sapiens
SPSPSPLWL

SEQ ID NO: 386479 - protein, 9 aa, Homo Sapiens
CGLEETIAN

SEQ ID NO: 386480 - protein, 9 aa, Homo Sapiens
CCCGLSLCN

SEQ ID NO: 386481 - protein, 9 aa, Homo Sapiens
SGWSGEARD

SEQ ID NO: 386482 - protein, 9 aa, Homo Sapiens
AEIQKHKRL

SEQ ID NO: 386483 - protein, 9 aa, Homo Sapiens
WRQQAPPDP

SEQ ID NO: 386484 - protein, 9 aa, Homo Sapiens
QSKRNLKHL

SEQ ID NO: 386485 - protein, 9 aa, Homo Sapiens
VVRGPPLHT

SEQ ID NO: 386486 - protein, 9 aa, Homo Sapiens
LGIYLCPKN

SEQ ID NO: 386487 - protein, 9 aa, Homo Sapiens
DWCSTVHGA

SEQ ID NO: 386488 - protein, 9 aa, Homo Sapiens
QDIIKVKEE

SEQ ID NO: 386489 - protein, 9 aa, Homo Sapiens
GNPSLSLVD

SEQ ID NO: 386490 - protein, 9 aa, Homo Sapiens
PLQDMIERT

SEQ ID NO: 386491 - protein, 9 aa, Homo Sapiens
LLVSLAMFR

SEQ ID NO: 386492 - protein, 9 aa, Homo Sapiens
SPRRPQPWK

SEQ ID NO: 386493 - protein, 9 aa, Homo Sapiens
SRERGRERE

SEQ ID NO: 386494 - protein, 9 aa, Homo Sapiens
KSEADKNDK

SEQ ID NO: 386495 - protein, 9 aa, Homo Sapiens
APEHIDPPD

SEQ ID NO: 386496 - protein, 9 aa, Homo Sapiens
IIRDDINRR

SEQ ID NO: 386497 - protein, 9 aa, Homo Sapiens
ENKSNSENE

SEQ ID NO: 386498 - protein, 9 aa, Homo Sapiens
ASVVIHKAA

SEQ ID NO: 386499 - protein, 9 aa, Homo Sapiens
GLDEGVSTS

SEQ ID NO: 386500 - protein, 9 aa, Homo Sapiens
RGSGGAPSS

SEQ ID NO: 386501 - protein, 9 aa, Homo Sapiens
IGSSNRIMY

SEQ ID NO: 386502 - protein, 9 aa, Homo Sapiens
FNARRFISW

SEQ ID NO: 386503 - protein, 9 aa, Homo Sapiens
GQEFPPRPT

SEQ ID NO: 386504 - protein, 9 aa, Homo Sapiens
RPWAKNRGS

SEQ ID NO: 386505 - protein, 9 aa, Homo Sapiens
CNHAAGAKT

SEQ ID NO: 386506 - protein, 9 aa, Homo Sapiens
PGGHPEVIY

SEQ ID NO: 386507 - protein, 9 aa, Homo Sapiens
AKMIAGIPT

SEQ ID NO: 386508 - protein, 9 aa, Homo Sapiens
PGSPSRAHL

SEQ ID NO: 386509 - protein, 9 aa, Homo Sapiens
LTTVTLGAR

SEQ ID NO: 386510 - protein, 9 aa, Homo Sapiens
PRLQHHFSV

SEQ ID NO: 386511 - protein, 9 aa, Homo Sapiens
VDNNHCQMS

SEQ ID NO: 386512 - protein, 9 aa, Homo Sapiens
PSRHPPGSP

SEQ ID NO: 386513 - protein, 9 aa, Homo Sapiens
ERTIILVQT

SEQ ID NO: 386514 - protein, 9 aa, Homo Sapiens
TLFTRFACF

SEQ ID NO: 386515 - protein, 9 aa, Homo Sapiens
AASTFGSRS

SEQ ID NO: 386516 - protein, 9 aa, Homo Sapiens
HSVPSTPPW

SEQ ID NO: 386517 - protein, 9 aa, Homo Sapiens
TTASTLRWS

SEQ ID NO: 386518 - protein, 9 aa, Homo Sapiens
LSRVQTQLC

SEQ ID NO: 386519 - protein, 9 aa, Homo Sapiens
RRTDSASST

SEQ ID NO: 386520 - protein, 9 aa, Homo Sapiens
VVCYTLMIL

SEQ ID NO: 386521 - protein, 9 aa, Homo Sapiens
PAGAIHFRR

SEQ ID NO: 386522 - protein, 9 aa, Homo Sapiens
AAQKCHKKK

SEQ ID NO: 386523 - protein, 9 aa, Homo Sapiens
SPLRSPICS

SEQ ID NO: 386524 - protein, 9 aa, Homo Sapiens
VKDLASQLI

SEQ ID NO: 386525 - protein, 9 aa, Homo Sapiens
RSLAGRNKG

SEQ ID NO: 386526 - protein, 9 aa, Homo Sapiens
FGDKGLKKA

SEQ ID NO: 386527 - protein, 9 aa, Homo Sapiens
PTPLLRTWR

SEQ ID NO: 386528 - protein, 9 aa, Homo Sapiens
GGPGQRRCC

SEQ ID NO: 386529 - protein, 9 aa, Homo Sapiens
VEQPTGMMP

SEQ ID NO: 386530 - protein, 9 aa, Homo Sapiens
DILEREKHH

SEQ ID NO: 386531 - protein, 9 aa, Homo Sapiens
GMDAKVYIT

SEQ ID NO: 386532 - protein, 9 aa, Homo Sapiens
REDPAAAQL

SEQ ID NO: 386533 - protein, 9 aa, Homo Sapiens
NTENKFTLT

SEQ ID NO: 386534 - protein, 9 aa, Homo Sapiens
LVPLFIWTP

SEQ ID NO: 386535 - protein, 9 aa, Homo Sapiens
FPQPLTAWG

SEQ ID NO: 386536 - protein, 9 aa, Homo Sapiens
SSTSILSAL

SEQ ID NO: 386537 - protein, 9 aa, Homo Sapiens
LLTLTRKYD

SEQ ID NO: 386538 - protein, 9 aa, Homo Sapiens
GKWLQWPHP

SEQ ID NO: 386539 - protein, 9 aa, Homo Sapiens
EKYLKKQKL

SEQ ID NO: 386540 - protein, 9 aa, Homo Sapiens
LRPCRCCRC

SEQ ID NO: 386541 - protein, 9 aa, Homo Sapiens
SRPTAAYWG

SEQ ID NO: 386542 - protein, 9 aa, Homo Sapiens
TFFCRDRVL

SEQ ID NO: 386543 - protein, 9 aa, Homo Sapiens
AHRRMEPLP

SEQ ID NO: 386544 - protein, 9 aa, Homo Sapiens
AINHNPTPR

SEQ ID NO: 386545 - protein, 9 aa, Homo Sapiens
PWLLTNLSS

SEQ ID NO: 386546 - protein, 9 aa, Homo Sapiens
SICFAVHMR

SEQ ID NO: 386547 - protein, 9 aa, Homo Sapiens
KKDSAVAST

SEQ ID NO: 386548 - protein, 9 aa, Homo Sapiens
IEFQVPKDC

SEQ ID NO: 386549 - protein, 9 aa, Homo Sapiens
KPLQMVLLP

SEQ ID NO: 386550 - protein, 9 aa, Homo Sapiens
TFIGFFSSV

SEQ ID NO: 386551 - protein, 9 aa, Homo Sapiens
LVTTGALGS

SEQ ID NO: 386552 - protein, 9 aa, Homo Sapiens
NNLKNCIYP

SEQ ID NO: 386553 - protein, 9 aa, Homo Sapiens
IKELQKTEE

SEQ ID NO: 386554 - protein, 9 aa, Homo Sapiens
RLTTVSGGT

SEQ ID NO: 386555 - protein, 9 aa, Homo Sapiens
RRYCMERAA

SEQ ID NO: 386556 - protein, 9 aa, Homo Sapiens
YLLFAEAAD

SEQ ID NO: 386557 - protein, 9 aa, Homo Sapiens
KRWSPLTSR

SEQ ID NO: 386558 - protein, 9 aa, Homo Sapiens
DVNRLSDKI

SEQ ID NO: 386559 - protein, 9 aa, Homo Sapiens
KIPESEAEA

SEQ ID NO: 386560 - protein, 9 aa, Homo Sapiens
KSQEKEWAT

SEQ ID NO: 386561 - protein, 9 aa, Homo Sapiens
RGAHGTRGT

SEQ ID NO: 386562 - protein, 9 aa, Homo Sapiens
GLFVAFSVT

SEQ ID NO: 386563 - protein, 9 aa, Homo Sapiens
QLECHSRIH

SEQ ID NO: 386564 - protein, 9 aa, Homo Sapiens
PHSTTARNT

SEQ ID NO: 386565 - protein, 9 aa, Homo Sapiens
TARATSGTA

SEQ ID NO: 386566 - protein, 9 aa, Homo Sapiens
TQLSMSFFI

SEQ ID NO: 386567 - protein, 9 aa, Homo Sapiens
CYNPVTDVW

SEQ ID NO: 386568 - protein, 9 aa, Homo Sapiens
HLAVEACLR

SEQ ID NO: 386569 - protein, 9 aa, Homo Sapiens
TSIRRLQQT

SEQ ID NO: 386570 - protein, 9 aa, Homo Sapiens
ALGSGGATG

SEQ ID NO: 386571 - protein, 9 aa, Homo Sapiens
AHRGLAGPA

SEQ ID NO: 386572 - protein, 9 aa, Homo Sapiens
STNITNGAR

SEQ ID NO: 386573 - protein, 9 aa, Homo Sapiens
KWRSGSSSH

SEQ ID NO: 386574 - protein, 9 aa, Homo Sapiens
LRVIRDEGH

SEQ ID NO: 386575 - protein, 9 aa, Homo Sapiens
GSSQSRGAH

SEQ ID NO: 386576 - protein, 9 aa, Homo Sapiens
LLLANGSLL

SEQ ID NO: 386577 - protein, 9 aa, Homo Sapiens
VCVWSLSFG

SEQ ID NO: 386578 - protein, 9 aa, Homo Sapiens
VRAELQDHL

SEQ ID NO: 386579 - protein, 9 aa, Homo Sapiens
TAAALPTPL

SEQ ID NO: 386580 - protein, 9 aa, Homo Sapiens
ILWLQLSWG

SEQ ID NO: 386581 - protein, 9 aa, Homo Sapiens
TSATHSTTT

SEQ ID NO: 386582 - protein, 9 aa, Homo Sapiens
RMSSSFHVS

SEQ ID NO: 386583 - protein, 9 aa, Homo Sapiens
AARTLEKVD

SEQ ID NO: 386584 - protein, 9 aa, Homo Sapiens
GPNGARETV

SEQ ID NO: 386585 - protein, 9 aa, Homo Sapiens
AFSTSITRF

SEQ ID NO: 386586 - protein, 9 aa, Homo Sapiens
SRCPSLLRR

SEQ ID NO: 386587 - protein, 9 aa, Homo Sapiens
VPNLKRYGY

SEQ ID NO: 386588 - protein, 9 aa, Homo Sapiens
LHQVVEDGQ

SEQ ID NO: 386589 - protein, 9 aa, Homo Sapiens
PEFTPKSDV

SEQ ID NO: 386590 - protein, 9 aa, Homo Sapiens
RMKDPRVLV

SEQ ID NO: 386591 - protein, 9 aa, Homo Sapiens
LSSLAGLSS

SEQ ID NO: 386592 - protein, 9 aa, Homo Sapiens
FKMEKVPID

SEQ ID NO: 386593 - protein, 9 aa, Homo Sapiens
IGACCCGLS

SEQ ID NO: 386594 - protein, 9 aa, Homo Sapiens
ENLALLEKN

SEQ ID NO: 386595 - protein, 9 aa, Homo Sapiens
VEDTTFFPT

SEQ ID NO: 386596 - protein, 9 aa, Homo Sapiens
YHSLVMCLR

SEQ ID NO: 386597 - protein, 9 aa, Homo Sapiens
TLGSLRLNC

SEQ ID NO: 386598 - protein, 9 aa, Homo Sapiens
DIIKVKEEF

SEQ ID NO: 386599 - protein, 9 aa, Homo Sapiens
LWSWCGTSQ

SEQ ID NO: 386600 - protein, 9 aa, Homo Sapiens
GAGGTRGPG

SEQ ID NO: 386601 - protein, 9 aa, Homo Sapiens
PWLRVMIRI

SEQ ID NO: 386602 - protein, 9 aa, Homo Sapiens
HWILMIRWL

SEQ ID NO: 386603 - protein, 9 aa, Homo Sapiens
LWQYFEEAF

SEQ ID NO: 386604 - protein, 9 aa, Homo Sapiens
EEANERYKV

SEQ ID NO: 386605 - protein, 9 aa, Homo Sapiens
GSLRLNCPA

SEQ ID NO: 386606 - protein, 9 aa, Homo Sapiens
KTISHFHYT

SEQ ID NO: 386607 - protein, 9 aa, Homo Sapiens
LGSWGQTDL

SEQ ID NO: 386608 - protein, 9 aa, Homo Sapiens
QHSMPRLRD

SEQ ID NO: 386609 - protein, 9 aa, Homo Sapiens
VSAWDFRLW

SEQ ID NO: 386610 - protein, 9 aa, Homo Sapiens
RSANWNASF

SEQ ID NO: 386611 - protein, 9 aa, Homo Sapiens
LLHLSHGAA

SEQ ID NO: 386612 - protein, 9 aa, Homo Sapiens
LLELSKKKY

SEQ ID NO: 386613 - protein, 9 aa, Homo Sapiens
TFQGLVCLI

SEQ ID NO: 386614 - protein, 9 aa, Homo Sapiens
PASAPTRWQ

SEQ ID NO: 386615 - protein, 9 aa, Homo Sapiens
SSAYSDSWH

SEQ ID NO: 386616 - protein, 9 aa, Homo Sapiens
LDEFLMGGM

SEQ ID NO: 386617 - protein, 9 aa, Homo Sapiens
TTLKLILVM

SEQ ID NO: 386618 - protein, 9 aa, Homo Sapiens
AFSSDPSSS

SEQ ID NO: 386619 - protein, 9 aa, Homo Sapiens
EKPFERDLQ

SEQ ID NO: 386620 - protein, 9 aa, Homo Sapiens
MDHFDRERI

SEQ ID NO: 386621 - protein, 9 aa, Homo Sapiens
ACPWPTGGR

SEQ ID NO: 386622 - protein, 9 aa, Homo Sapiens
QGFLPQAIR

SEQ ID NO: 386623 - protein, 9 aa, Homo Sapiens
LPYFIRPVV

SEQ ID NO: 386624 - protein, 9 aa, Homo Sapiens
SSGALPDSA

SEQ ID NO: 386625 - protein, 9 aa, Homo Sapiens
LTGLALFLS

SEQ ID NO: 386626 - protein, 9 aa, Homo Sapiens
PLWLRLHPG

SEQ ID NO: 386627 - protein, 9 aa, Homo Sapiens
MYIFQNVMV

SEQ ID NO: 386628 - protein, 9 aa, Homo Sapiens
LPALLPATW

SEQ ID NO: 386629 - protein, 9 aa, Homo Sapiens
GFSLKGDTS

SEQ ID NO: 386630 - protein, 9 aa, Homo Sapiens
IDTLLDKAD

SEQ ID NO: 386631 - protein, 9 aa, Homo Sapiens
SVLLLLFLF

SEQ ID NO: 386632 - protein, 9 aa, Homo Sapiens
NSRLSDIFW

SEQ ID NO: 386633 - protein, 9 aa, Homo Sapiens
LTTVSGGTT

SEQ ID NO: 386634 - protein, 9 aa, Homo Sapiens
CLDYLVDPV

SEQ ID NO: 386635 - protein, 9 aa, Homo Sapiens
NEQTRLLSR

SEQ ID NO: 386636 - protein, 9 aa, Homo Sapiens
LVKFLLYKY

SEQ ID NO: 386637 - protein, 9 aa, Homo Sapiens
LFLLVSLAM

SEQ ID NO: 386638 - protein, 9 aa, Homo Sapiens
FNDVTNMLL

SEQ ID NO: 386639 - protein, 9 aa, Homo Sapiens
EGTPGVRAP

SEQ ID NO: 386640 - protein, 9 aa, Homo Sapiens
LDDQIQWPT

SEQ ID NO: 386641 - protein, 9 aa, Homo Sapiens
WSGEARDGS

SEQ ID NO: 386642 - protein, 9 aa, Homo Sapiens
KPHSSHSDI

SEQ ID NO: 386643 - protein, 9 aa, Homo Sapiens
PEDMPAQGS

SEQ ID NO: 386644 - protein, 9 aa, Homo Sapiens
VAGTTGMCH

SEQ ID NO: 386645 - protein, 9 aa, Homo Sapiens
LWQRVMLKE

SEQ ID NO: 386646 - protein, 9 aa, Homo Sapiens
VADARLERD

SEQ ID NO: 386647 - protein, 9 aa, Homo Sapiens
TCEGFPTMI

SEQ ID NO: 386648 - protein, 9 aa, Homo Sapiens
PQHQQRLWE

SEQ ID NO: 386649 - protein, 9 aa, Homo Sapiens
PQDKLEVMF

SEQ ID NO: 386650 - protein, 9 aa, Homo Sapiens
NSSYLGQEV

SEQ ID NO: 386651 - protein, 9 aa, Homo Sapiens
FDSKHLTAA

SEQ ID NO: 386652 - protein, 9 aa, Homo Sapiens
CLQPAEPEL

SEQ ID NO: 386653 - protein, 9 aa, Homo Sapiens
LPLEQLGRG

SEQ ID NO: 386654 - protein, 9 aa, Homo Sapiens
RFPRRVLAR

SEQ ID NO: 386655 - protein, 9 aa, Homo Sapiens
KDLIDFEFC

SEQ ID NO: 386656 - protein, 9 aa, Homo Sapiens
KVLENNQTS

SEQ ID NO: 386657 - protein, 9 aa, Homo Sapiens
VGHAQDAIE

SEQ ID NO: 386658 - protein, 9 aa, Homo Sapiens
LQFQNDPCL

SEQ ID NO: 386659 - protein, 9 aa, Homo Sapiens
WSICFAVHM

SEQ ID NO: 386660 - protein, 9 aa, Homo Sapiens
PSLLRRPPP

SEQ ID NO: 386661 - protein, 9 aa, Homo Sapiens
FCAWPSAIS

SEQ ID NO: 386662 - protein, 9 aa, Homo Sapiens
GTRLTTVSG

SEQ ID NO: 386663 - protein, 9 aa, Homo Sapiens
CVWSLSFGE

SEQ ID NO: 386664 - protein, 9 aa, Homo Sapiens
QNIMRMTAQ

SEQ ID NO: 386665 - protein, 9 aa, Homo Sapiens
QERGGVATP

SEQ ID NO: 386666 - protein, 9 aa, Homo Sapiens
VYENTTTKA

SEQ ID NO: 386667 - protein, 9 aa, Homo Sapiens
NYRTRINKL

SEQ ID NO: 386668 - protein, 9 aa, Homo Sapiens
WRQGGSPVG

SEQ ID NO: 386669 - protein, 9 aa, Homo Sapiens
KREVVDGHT

SEQ ID NO: 386670 - protein, 9 aa, Homo Sapiens
RARGTRGTN

SEQ ID NO: 386671 - protein, 9 aa, Homo Sapiens
TPSWSRCAG

SEQ ID NO: 386672 - protein, 9 aa, Homo Sapiens
GLAGPAGVL

SEQ ID NO: 386673 - protein, 9 aa, Homo Sapiens
KGSPSSRKS

SEQ ID NO: 386674 - protein, 9 aa, Homo Sapiens
VPCLCLEEP

SEQ ID NO: 386675 - protein, 9 aa, Homo Sapiens
KERKSPENH

SEQ ID NO: 386676 - protein, 9 aa, Homo Sapiens
TPSLYPPPG

SEQ ID NO: 386677 - protein, 9 aa, Homo Sapiens
NEQEKKCRL

SEQ ID NO: 386678 - protein, 9 aa, Homo Sapiens
ARTPRASRA

SEQ ID NO: 386679 - protein, 9 aa, Homo Sapiens
SWKPGAREG

SEQ ID NO: 386680 - protein, 9 aa, Homo Sapiens
YGYVNDRMR

SEQ ID NO: 386681 - protein, 9 aa, Homo Sapiens
KNFTVGHQV

SEQ ID NO: 386682 - protein, 9 aa, Homo Sapiens
TARTRGPNG

SEQ ID NO: 386683 - protein, 9 aa, Homo Sapiens
VAAVAAAAV

SEQ ID NO: 386684 - protein, 9 aa, Homo Sapiens
RILLQRNLL

SEQ ID NO: 386685 - protein, 9 aa, Homo Sapiens
GDENVTLDG

SEQ ID NO: 386686 - protein, 9 aa, Homo Sapiens
RAELQDHLG

SEQ ID NO: 386687 - protein, 9 aa, Homo Sapiens
GQRTLVILG

SEQ ID NO: 386688 - protein, 9 aa, Homo Sapiens
GTSQTYFGS

SEQ ID NO: 386689 - protein, 9 aa, Homo Sapiens
GTAPSAVPS

SEQ ID NO: 386690 - protein, 9 aa, Homo Sapiens
YISCHLLTL

SEQ ID NO: 386691 - protein, 9 aa, Homo Sapiens
LPGMGPHVP

SEQ ID NO: 386692 - protein, 9 aa, Homo Sapiens
FLTLTLSDL

SEQ ID NO: 386693 - protein, 9 aa, Homo Sapiens
HSEIFMDEW

SEQ ID NO: 386694 - protein, 9 aa, Homo Sapiens
WNRVDIAHS

SEQ ID NO: 386695 - protein, 9 aa, Homo Sapiens
LLIIDKEAE

SEQ ID NO: 386696 - protein, 9 aa, Homo Sapiens
AWQSGGRRL

SEQ ID NO: 386697 - protein, 9 aa, Homo Sapiens
GTSRTSLTT

SEQ ID NO: 386698 - protein, 9 aa, Homo Sapiens
KPPAGGSPP

SEQ ID NO: 386699 - protein, 9 aa, Homo Sapiens
SASVMYKIG

SEQ ID NO: 386700 - protein, 9 aa, Homo Sapiens
EQDTGLLQE

SEQ ID NO: 386701 - protein, 9 aa, Homo Sapiens
SSITVKLFK

SEQ ID NO: 386702 - protein, 9 aa, Homo Sapiens
KISGRSRKE

SEQ ID NO: 386703 - protein, 9 aa, Homo Sapiens
DKKHLCSRT

SEQ ID NO: 386704 - protein, 9 aa, Homo Sapiens
LYKKKKPKK

SEQ ID NO: 386705 - protein, 9 aa, Homo Sapiens
YLQQHNNLH

SEQ ID NO: 386706 - protein, 9 aa, Homo Sapiens
SAKEITEGV

SEQ ID NO: 386707 - protein, 9 aa, Homo Sapiens
RAPHLQPPS

SEQ ID NO: 386708 - protein, 9 aa, Homo Sapiens
SRWKSGSWH

SEQ ID NO: 386709 - protein, 9 aa, Homo Sapiens
FCVDSKQMN

SEQ ID NO: 386710 - protein, 9 aa, Homo Sapiens
SPVSGLSKG

SEQ ID NO: 386711 - protein, 9 aa, Homo Sapiens
EGCHKKTSQ

SEQ ID NO: 386712 - protein, 9 aa, Homo Sapiens
SSYAAGILA

SEQ ID NO: 386713 - protein, 9 aa, Homo Sapiens
KINNQIIVN

SEQ ID NO: 386714 - protein, 9 aa, Homo Sapiens
LENLAVPSE

SEQ ID NO: 386715 - protein, 9 aa, Homo Sapiens
GEARDGSCK

SEQ ID NO: 386716 - protein, 9 aa, Homo Sapiens
LPRWREAVE

SEQ ID NO: 386717 - protein, 9 aa, Homo Sapiens
KWASRLFAP

SEQ ID NO: 386718 - protein, 9 aa, Homo Sapiens
PGGAPGPLM

SEQ ID NO: 386719 - protein, 9 aa, Homo Sapiens
QDLRKKENE

SEQ ID NO: 386720 - protein, 9 aa, Homo Sapiens
DIWQGGASS

SEQ ID NO: 386721 - protein, 9 aa, Homo Sapiens
SPFVSILRA

SEQ ID NO: 386722 - protein, 9 aa, Homo Sapiens
PAGARAHQS

SEQ ID NO: 386723 - protein, 9 aa, Homo Sapiens
TELQFHNQR

SEQ ID NO: 386724 - protein, 9 aa, Homo Sapiens
PPADPADSG

SEQ ID NO: 386725 - protein, 9 aa, Homo Sapiens
QWLFMGYSM

SEQ ID NO: 386726 - protein, 9 aa, Homo Sapiens
RLAAPWLLE

SEQ ID NO: 386727 - protein, 9 aa, Homo Sapiens
AKNRGSGGA

SEQ ID NO: 386728 - protein, 9 aa, Homo Sapiens
RWMPPESVL

SEQ ID NO: 386729 - protein, 9 aa, Homo Sapiens
CAHILVIDS

SEQ ID NO: 386730 - protein, 9 aa, Homo Sapiens
VVLQWGRCL

SEQ ID NO: 386731 - protein, 9 aa, Homo Sapiens
MLSEVRKGL

SEQ ID NO: 386732 - protein, 9 aa, Homo Sapiens
MKTLRGVWS

SEQ ID NO: 386733 - protein, 9 aa, Homo Sapiens
PTKEKKARK

SEQ ID NO: 386734 - protein, 9 aa, Homo Sapiens
LPLVGIWLP

SEQ ID NO: 386735 - protein, 9 aa, Homo Sapiens
DATLVILKG

SEQ ID NO: 386736 - protein, 9 aa, Homo Sapiens
IRPVVPKRD

SEQ ID NO: 386737 - protein, 9 aa, Homo Sapiens
LSTIVAGST

SEQ ID NO: 386738 - protein, 9 aa, Homo Sapiens
NPGPAQFHA

SEQ ID NO: 386739 - protein, 9 aa, Homo Sapiens
LQVVILKKF

SEQ ID NO: 386740 - protein, 9 aa, Homo Sapiens
EWYNDSVEH

SEQ ID NO: 386741 - protein, 9 aa, Homo Sapiens
PHQPWAHGM

SEQ ID NO: 386742 - protein, 9 aa, Homo Sapiens
YIVEPSIFN

SEQ ID NO: 386743 - protein, 9 aa, Homo Sapiens
LVYLSFAAL

SEQ ID NO: 386744 - protein, 9 aa, Homo Sapiens
PLPLPPHKP

SEQ ID NO: 386745 - protein, 9 aa, Homo Sapiens
SSNPFLHHR

SEQ ID NO: 386746 - protein, 9 aa, Homo Sapiens
VLSTSSFCC

SEQ ID NO: 386747 - protein, 9 aa, Homo Sapiens
NFTVGHQVP

SEQ ID NO: 386748 - protein, 9 aa, Homo Sapiens
PERPQCRPT

SEQ ID NO: 386749 - protein, 9 aa, Homo Sapiens
RCCLCNPGV

SEQ ID NO: 386750 - protein, 9 aa, Homo Sapiens
EYRQFGENR

SEQ ID NO: 386751 - protein, 9 aa, Homo Sapiens
GQAEEEKGE

SEQ ID NO: 386752 - protein, 9 aa, Homo Sapiens
KVEQDTGLL

SEQ ID NO: 386753 - protein, 9 aa, Homo Sapiens
VLAIVQIIR

SEQ ID NO: 386754 - protein, 9 aa, Homo Sapiens
HSERDTRDT

SEQ ID NO: 386755 - protein, 9 aa, Homo Sapiens
GNAYPHWRQ

SEQ ID NO: 386756 - protein, 9 aa, Homo Sapiens
GLPKDLPLH

SEQ ID NO: 386757 - protein, 9 aa, Homo Sapiens
LKGDTSKED

SEQ ID NO: 386758 - protein, 9 aa, Homo Sapiens
VSDKTPMTN

SEQ ID NO: 386759 - protein, 9 aa, Homo Sapiens
NSMSIIGST

SEQ ID NO: 386760 - protein, 9 aa, Homo Sapiens
ARLEESRHL

SEQ ID NO: 386761 - protein, 9 aa, Homo Sapiens
VGDPSPRKK

SEQ ID NO: 386762 - protein, 9 aa, Homo Sapiens
EDTKLKPTK

SEQ ID NO: 386763 - protein, 9 aa, Homo Sapiens
AWNRVDIAH

SEQ ID NO: 386764 - protein, 9 aa, Homo Sapiens
KGTEVPWPE

SEQ ID NO: 386765 - protein, 9 aa, Homo Sapiens
SAVAPSGPG

SEQ ID NO: 386766 - protein, 9 aa, Homo Sapiens
SLPFECSQP

SEQ ID NO: 386767 - protein, 9 aa, Homo Sapiens
FTGELEVLC

SEQ ID NO: 386768 - protein, 9 aa, Homo Sapiens
RSAAAASPR

SEQ ID NO: 386769 - protein, 9 aa, Homo Sapiens
FTSSSSLSF

SEQ ID NO: 386770 - protein, 9 aa, Homo Sapiens
PSSFTRTQT

SEQ ID NO: 386771 - protein, 9 aa, Homo Sapiens
TSRIVLLCK

SEQ ID NO: 386772 - protein, 9 aa, Homo Sapiens
ASDAGCIFM

SEQ ID NO: 386773 - protein, 9 aa, Homo Sapiens
EGKYFTLCE

SEQ ID NO: 386774 - protein, 9 aa, Homo Sapiens
PATPPFGLI

SEQ ID NO: 386775 - protein, 9 aa, Homo Sapiens
EGQSGWSGE

SEQ ID NO: 386776 - protein, 9 aa, Homo Sapiens
WLRVIRDEG

SEQ ID NO: 386777 - protein, 9 aa, Homo Sapiens
AVELPQKNQ

SEQ ID NO: 386778 - protein, 9 aa, Homo Sapiens
ARVAKLIHW

SEQ ID NO: 386779 - protein, 9 aa, Homo Sapiens
PMIYTLHNQ

SEQ ID NO: 386780 - protein, 9 aa, Homo Sapiens
KSQIQALRQ

SEQ ID NO: 386781 - protein, 9 aa, Homo Sapiens
TTFFPTLLP

SEQ ID NO: 386782 - protein, 9 aa, Homo Sapiens
PYLEQFWRI

SEQ ID NO: 386783 - protein, 9 aa, Homo Sapiens
SRADACFVN

SEQ ID NO: 386784 - protein, 9 aa, Homo Sapiens
VPWRAAPAS

SEQ ID NO: 386785 - protein, 9 aa, Homo Sapiens
SQFLAKHHL

SEQ ID NO: 386786 - protein, 9 aa, Homo Sapiens
CLRLRTKLE

SEQ ID NO: 386787 - protein, 9 aa, Homo Sapiens
NERYKVCVT

SEQ ID NO: 386788 - protein, 9 aa, Homo Sapiens
RFRYGGAPR

SEQ ID NO: 386789 - protein, 9 aa, Homo Sapiens
ITAPCNEKC

SEQ ID NO: 386790 - protein, 9 aa, Homo Sapiens
KRKRRSKVK

SEQ ID NO: 386791 - protein, 9 aa, Homo Sapiens
LILQWLEDR

SEQ ID NO: 386792 - protein, 9 aa, Homo Sapiens
PRGSQSALG

SEQ ID NO: 386793 - protein, 9 aa, Homo Sapiens
PHRPQDRRS

SEQ ID NO: 386794 - protein, 9 aa, Homo Sapiens
RSREGQSGW

SEQ ID NO: 386795 - protein, 9 aa, Homo Sapiens
LAQGQPAGH

SEQ ID NO: 386796 - protein, 9 aa, Homo Sapiens
QTDKNPCLY

SEQ ID NO: 386797 - protein, 9 aa, Homo Sapiens
FSQDLGCAH

SEQ ID NO: 386798 - protein, 9 aa, Homo Sapiens
ARLSLSTSV

SEQ ID NO: 386799 - protein, 9 aa, Homo Sapiens
GSRSTNITN

SEQ ID NO: 386800 - protein, 9 aa, Homo Sapiens
CQQDVESLA

SEQ ID NO: 386801 - protein, 8 aa, Homo Sapiens
HHQWLLLA

SEQ ID NO: 386802 - protein, 9 aa, Homo Sapiens
LLWDTPAKC

SEQ ID NO: 386803 - protein, 9 aa, Homo Sapiens
WRVSLYNNN

SEQ ID NO: 386804 - protein, 9 aa, Homo Sapiens
ELQRVLTGP

SEQ ID NO: 386805 - protein, 9 aa, Homo Sapiens
ARSTSNTRS

SEQ ID NO: 386806 - protein, 9 aa, Homo Sapiens
PAQGSSSQL

SEQ ID NO: 386807 - protein, 9 aa, Homo Sapiens
PPGFTSDYC

SEQ ID NO: 386808 - protein, 9 aa, Homo Sapiens
PYPRLDVNR

SEQ ID NO: 386809 - protein, 9 aa, Homo Sapiens
PGQEFPPRP

SEQ ID NO: 386810 - protein, 9 aa, Homo Sapiens
VCLILGIYL

SEQ ID NO: 386811 - protein, 9 aa, Homo Sapiens
GPGWEEASQ

SEQ ID NO: 386812 - protein, 9 aa, Homo Sapiens
FHLPNTYPN

SEQ ID NO: 386813 - protein, 9 aa, Homo Sapiens
DNNHCQMSG

SEQ ID NO: 386814 - protein, 9 aa, Homo Sapiens
AERLDEILQ

SEQ ID NO: 386815 - protein, 9 aa, Homo Sapiens
NRCDQCEET

SEQ ID NO: 386816 - protein, 9 aa, Homo Sapiens
LRPCGSPQI

SEQ ID NO: 386817 - protein, 9 aa, Homo Sapiens
EELQQEEEP

SEQ ID NO: 386818 - protein, 9 aa, Homo Sapiens
EGTRGVGDR

SEQ ID NO: 386819 - protein, 9 aa, Homo Sapiens
RWLSLFDFL

SEQ ID NO: 386820 - protein, 9 aa, Homo Sapiens
ASRSGIKKQ

SEQ ID NO: 386821 - protein, 9 aa, Homo Sapiens
MAPEHIDPP

SEQ ID NO: 386822 - protein, 9 aa, Homo Sapiens
TSARSRTPP

SEQ ID NO: 386823 - protein, 9 aa, Homo Sapiens
LQGSDSVAK

SEQ ID NO: 386824 - protein, 9 aa, Homo Sapiens
HVVFSLIRW

SEQ ID NO: 386825 - protein, 9 aa, Homo Sapiens
DLGCAHILV

SEQ ID NO: 386826 - protein, 9 aa, Homo Sapiens
GEVDYKKIP

SEQ ID NO: 386827 - protein, 9 aa, Homo Sapiens
IVNAGLRSF

SEQ ID NO: 386828 - protein, 9 aa, Homo Sapiens
GLDDRSPQA

SEQ ID NO: 386829 - protein, 9 aa, Homo Sapiens
ASFAIRTRA

SEQ ID NO: 386830 - protein, 9 aa, Homo Sapiens
RGTSRARRT

SEQ ID NO: 386831 - protein, 9 aa, Homo Sapiens
CFPEENFTI

SEQ ID NO: 386832 - protein, 9 aa, Homo Sapiens
LLNVLEGCV

SEQ ID NO: 386833 - protein, 9 aa, Homo Sapiens
HLRMHMRTH

SEQ ID NO: 386834 - protein, 9 aa, Homo Sapiens
PQDSRQVLA

SEQ ID NO: 386835 - protein, 9 aa, Homo Sapiens
TRGPNGARE

SEQ ID NO: 386836 - protein, 9 aa, Homo Sapiens
SATHSTTTI

SEQ ID NO: 386837 - protein, 9 aa, Homo Sapiens
LSWEPIHAN

SEQ ID NO: 386838 - protein, 9 aa, Homo Sapiens
ASPRLQFLF

SEQ ID NO: 386839 - protein, 9 aa, Homo Sapiens
PMADIATLR

SEQ ID NO: 386840 - protein, 9 aa, Homo Sapiens
RSTRFTAVT

SEQ ID NO: 386841 - protein, 9 aa, Homo Sapiens
QVGPLPCVL

SEQ ID NO: 386842 - protein, 9 aa, Homo Sapiens
HIKSIAAAL

SEQ ID NO: 386843 - protein, 9 aa, Homo Sapiens
GVFPTGHSD

SEQ ID NO: 386844 - protein, 9 aa, Homo Sapiens
ENAALIHVI

SEQ ID NO: 386845 - protein, 9 aa, Homo Sapiens
RAAGALGSR

SEQ ID NO: 386846 - protein, 9 aa, Homo Sapiens
PLEQLGRGT

SEQ ID NO: 386847 - protein, 9 aa, Homo Sapiens
ECCSSWLRR

SEQ ID NO: 386848 - protein, 9 aa, Homo Sapiens
CCSLQCLCC

SEQ ID NO: 386849 - protein, 9 aa, Homo Sapiens
GLVGERSYG

SEQ ID NO: 386850 - protein, 9 aa, Homo Sapiens
DEYYQAVYY

SEQ ID NO: 386851 - protein, 9 aa, Homo Sapiens
QERPQSSYA

SEQ ID NO: 386852 - protein, 9 aa, Homo Sapiens
PQGASSIPT

SEQ ID NO: 386853 - protein, 9 aa, Homo Sapiens
PHSHGNPLL

SEQ ID NO: 386854 - protein, 9 aa, Homo Sapiens
PPIHAPTLQ

SEQ ID NO: 386855 - protein, 9 aa, Homo Sapiens
DGFGPGGFP

SEQ ID NO: 386856 - protein, 9 aa, Homo Sapiens
GSMHTVIVQ

SEQ ID NO: 386857 - protein, 9 aa, Homo Sapiens
FFHVLFFTS

SEQ ID NO: 386858 - protein, 9 aa, Homo Sapiens
IKYISCHLL

SEQ ID NO: 386859 - protein, 9 aa, Homo Sapiens
ACTPASGPS

SEQ ID NO: 386860 - protein, 9 aa, Homo Sapiens
LRAKEKELC

SEQ ID NO: 386861 - protein, 9 aa, Homo Sapiens
KRINKPEGK

SEQ ID NO: 386862 - protein, 9 aa, Homo Sapiens
EPSQNDEDN

SEQ ID NO: 386863 - protein, 9 aa, Homo Sapiens
RWQGLTLGA

SEQ ID NO: 386864 - protein, 9 aa, Homo Sapiens
GASGTREAR

SEQ ID NO: 386865 - protein, 9 aa, Homo Sapiens
PGVPKSLVS

SEQ ID NO: 386866 - protein, 9 aa, Homo Sapiens
RKAMTKRSP

SEQ ID NO: 386867 - protein, 9 aa, Homo Sapiens
PWGMEALGS

SEQ ID NO: 386868 - protein, 9 aa, Homo Sapiens
LGNITEPTK

SEQ ID NO: 386869 - protein, 9 aa, Homo Sapiens
DGCDPVHGC

SEQ ID NO: 386870 - protein, 9 aa, Homo Sapiens
RGPNGARET

SEQ ID NO: 386871 - protein, 9 aa, Homo Sapiens
LGDTLTITL

SEQ ID NO: 386872 - protein, 9 aa, Homo Sapiens
HVKIEHDWC

SEQ ID NO: 386873 - protein, 9 aa, Homo Sapiens
RSGKGEAQC

SEQ ID NO: 386874 - protein, 9 aa, Homo Sapiens
GTSNTICAR

SEQ ID NO: 386875 - protein, 9 aa, Homo Sapiens
GFSSFYEQQ

SEQ ID NO: 386876 - protein, 9 aa, Homo Sapiens
HDDTEAAIR

SEQ ID NO: 386877 - protein, 9 aa, Homo Sapiens
KNCKVVFPS

SEQ ID NO: 386878 - protein, 9 aa, Homo Sapiens
RVPIVTVGV

SEQ ID NO: 386879 - protein, 9 aa, Homo Sapiens
GSGFTSSSS

SEQ ID NO: 386880 - protein, 9 aa, Homo Sapiens
LQDTAAALP

SEQ ID NO: 386881 - protein, 9 aa, Homo Sapiens
FVCNGCGKA

SEQ ID NO: 386882 - protein, 9 aa, Homo Sapiens
PEGVALKLV

SEQ ID NO: 386883 - protein, 9 aa, Homo Sapiens
NILGVQKPI

SEQ ID NO: 386884 - protein, 9 aa, Homo Sapiens
TEYEPTEEE

SEQ ID NO: 386885 - protein, 9 aa, Homo Sapiens
GAPRGHFIG

SEQ ID NO: 386886 - protein, 9 aa, Homo Sapiens
RRSPASAPT

SEQ ID NO: 386887 - protein, 9 aa, Homo Sapiens
FFASRTRRA

SEQ ID NO: 386888 - protein, 9 aa, Homo Sapiens
GLFPMHAKG

SEQ ID NO: 386889 - protein, 9 aa, Homo Sapiens
PLCVYSEQA

SEQ ID NO: 386890 - protein, 9 aa, Homo Sapiens
KKRKRRSKV

SEQ ID NO: 386891 - protein, 9 aa, Homo Sapiens
HTTLLKGKG

SEQ ID NO: 386892 - protein, 9 aa, Homo Sapiens
TINPRLQHH

SEQ ID NO: 386893 - protein, 9 aa, Homo Sapiens
AASCSEAPR

SEQ ID NO: 386894 - protein, 9 aa, Homo Sapiens
AHVIFSGSL

SEQ ID NO: 386895 - protein, 9 aa, Homo Sapiens
ICFAVHMRS

SEQ ID NO: 386896 - protein, 9 aa, Homo Sapiens
PAARPQPLS

SEQ ID NO: 386897 - protein, 9 aa, Homo Sapiens
GDRPQGPPQ

SEQ ID NO: 386898 - protein, 9 aa, Homo Sapiens
PYRKAHAEH

SEQ ID NO: 386899 - protein, 9 aa, Homo Sapiens
YMMKILYET

SEQ ID NO: 386900 - protein, 9 aa, Homo Sapiens
LLANGSLLL

SEQ ID NO: 386901 - protein, 9 aa, Homo Sapiens
PQDRRSSNI

SEQ ID NO: 386902 - protein, 9 aa, Homo Sapiens
RLLTIPSAS

SEQ ID NO: 386903 - protein, 9 aa, Homo Sapiens
RTRLGGELE

SEQ ID NO: 386904 - protein, 9 aa, Homo Sapiens
SEEYDVPPW

SEQ ID NO: 386905 - protein, 9 aa, Homo Sapiens
GCIFMEENF

SEQ ID NO: 386906 - protein, 9 aa, Homo Sapiens
CSQPRIFRI

SEQ ID NO: 386907 - protein, 9 aa, Homo Sapiens
NSSPVDSNM

SEQ ID NO: 386908 - protein, 9 aa, Homo Sapiens
RHPNMELCR

SEQ ID NO: 386909 - protein, 9 aa, Homo Sapiens
TNLIVYITQ

SEQ ID NO: 386910 - protein, 9 aa, Homo Sapiens
TPTSARSRT

SEQ ID NO: 386911 - protein, 9 aa, Homo Sapiens
VAFVCSKCG

SEQ ID NO: 386912 - protein, 9 aa, Homo Sapiens
LKPTKRKRK

SEQ ID NO: 386913 - protein, 9 aa, Homo Sapiens
AKIKKKTGS

SEQ ID NO: 386914 - protein, 9 aa, Homo Sapiens
SSSLSIFAS

SEQ ID NO: 386915 - protein, 9 aa, Homo Sapiens
ELWFSTVFP

SEQ ID NO: 386916 - protein, 9 aa, Homo Sapiens
TTCYYPPTS

SEQ ID NO: 386917 - protein, 9 aa, Homo Sapiens
EGMKIEIHF

SEQ ID NO: 386918 - protein, 9 aa, Homo Sapiens
PPPPAQPRP

SEQ ID NO: 386919 - protein, 9 aa, Homo Sapiens
DTCLENLAV

SEQ ID NO: 386920 - protein, 9 aa, Homo Sapiens
CSADLKAIL

SEQ ID NO: 386921 - protein, 9 aa, Homo Sapiens
RGSAWQSGG

SEQ ID NO: 386922 - protein, 9 aa, Homo Sapiens
ARARGKSGL

SEQ ID NO: 386923 - protein, 9 aa, Homo Sapiens
SYGNEATSA

SEQ ID NO: 386924 - protein, 9 aa, Homo Sapiens
DDVSAPRLM

SEQ ID NO: 386925 - protein, 9 aa, Homo Sapiens
SPVGDIPDI

SEQ ID NO: 386926 - protein, 9 aa, Homo Sapiens
DNEDQEADR

SEQ ID NO: 386927 - protein, 9 aa, Homo Sapiens
RVQTQLCLR

SEQ ID NO: 386928 - protein, 9 aa, Homo Sapiens
RDGSCKNSP

SEQ ID NO: 386929 - protein, 9 aa, Homo Sapiens
YLQWSCSVP

SEQ ID NO: 386930 - protein, 9 aa, Homo Sapiens
QWSFLVGDP

SEQ ID NO: 386931 - protein, 9 aa, Homo Sapiens
ILRTLSCTG

SEQ ID NO: 386932 - protein, 9 aa, Homo Sapiens
GSSGSGRAR

SEQ ID NO: 386933 - protein, 9 aa, Homo Sapiens
DLRAEIQHC

SEQ ID NO: 386934 - protein, 9 aa, Homo Sapiens
SCSIIIITF

SEQ ID NO: 386935 - protein, 9 aa, Homo Sapiens
SRVQTQLCL

SEQ ID NO: 386936 - protein, 9 aa, Homo Sapiens
LWNYMKLLL

SEQ ID NO: 386937 - protein, 9 aa, Homo Sapiens
WSCSVPTGD

SEQ ID NO: 386938 - protein, 9 aa, Homo Sapiens
RAPLKFKLA

SEQ ID NO: 386939 - protein, 9 aa, Homo Sapiens
GFPTMITFI

SEQ ID NO: 386940 - protein, 9 aa, Homo Sapiens
VLVDIQYLY

SEQ ID NO: 386941 - protein, 9 aa, Homo Sapiens
KEEGKEQEE

SEQ ID NO: 386942 - protein, 9 aa, Homo Sapiens
HNPRSSITV

SEQ ID NO: 386943 - protein, 9 aa, Homo Sapiens
FFDPNMHEN

SEQ ID NO: 386944 - protein, 9 aa, Homo Sapiens
FHARQPSVR

SEQ ID NO: 386945 - protein, 9 aa, Homo Sapiens
KEENRDLCA

SEQ ID NO: 386946 - protein, 9 aa, Homo Sapiens
TWREEKNVH

SEQ ID NO: 386947 - protein, 9 aa, Homo Sapiens
NRIMYFLEE

SEQ ID NO: 386948 - protein, 9 aa, Homo Sapiens
RSRESHHTS

SEQ ID NO: 386949 - protein, 9 aa, Homo Sapiens
GENKILFCV

SEQ ID NO: 386950 - protein, 9 aa, Homo Sapiens
AWGSGATIL

SEQ ID NO: 386951 - protein, 9 aa, Homo Sapiens
GCGEDVVGG

SEQ ID NO: 386952 - protein, 9 aa, Homo Sapiens
EEEKKDSAV

SEQ ID NO: 386953 - protein, 9 aa, Homo Sapiens
AAVLVFGGP

SEQ ID NO: 386954 - protein, 9 aa, Homo Sapiens
HPNMELCRD

SEQ ID NO: 386955 - protein, 9 aa, Homo Sapiens
DEEGRASQD

SEQ ID NO: 386956 - protein, 9 aa, Homo Sapiens
NMIQVLMSV

SEQ ID NO: 386957 - protein, 9 aa, Homo Sapiens
LIVSAWDFR

SEQ ID NO: 386958 - protein, 9 aa, Homo Sapiens
RLFILRQPP

SEQ ID NO: 386959 - protein, 9 aa, Homo Sapiens
SGGVVDNNH

SEQ ID NO: 386960 - protein, 9 aa, Homo Sapiens
VRRKNVPSR

SEQ ID NO: 386961 - protein, 9 aa, Homo Sapiens
TFGTRSPLT

SEQ ID NO: 386962 - protein, 9 aa, Homo Sapiens
ILEPERTMI

SEQ ID NO: 386963 - protein, 9 aa, Homo Sapiens
LVKTWTQFR

SEQ ID NO: 386964 - protein, 9 aa, Homo Sapiens
PIEAPPPST

SEQ ID NO: 386965 - protein, 9 aa, Homo Sapiens
QSLLQGEGP

SEQ ID NO: 386966 - protein, 9 aa, Homo Sapiens
MSVSAQEFG

SEQ ID NO: 386967 - protein, 9 aa, Homo Sapiens
RCPLPLPPT

SEQ ID NO: 386968 - protein, 9 aa, Homo Sapiens
ATGVFPTGH

SEQ ID NO: 386969 - protein, 9 aa, Homo Sapiens
GHFIGLMMY

SEQ ID NO: 386970 - protein, 9 aa, Homo Sapiens
VSKNSILNP

SEQ ID NO: 386971 - protein, 9 aa, Homo Sapiens
LYCDCISAR

SEQ ID NO: 386972 - protein, 9 aa, Homo Sapiens
ATTAAGASG

SEQ ID NO: 386973 - protein, 9 aa, Homo Sapiens
APPVKAEKL

SEQ ID NO: 386974 - protein, 9 aa, Homo Sapiens
ENPPDCYRY

SEQ ID NO: 386975 - protein, 9 aa, Homo Sapiens
MTIPSKLWG

SEQ ID NO: 386976 - protein, 9 aa, Homo Sapiens
FYEQQITLF

SEQ ID NO: 386977 - protein, 9 aa, Homo Sapiens
SIPTTMNYP

SEQ ID NO: 386978 - protein, 9 aa, Homo Sapiens
PPKRIRSDP

SEQ ID NO: 386979 - protein, 9 aa, Homo Sapiens
SAAAASPRA

SEQ ID NO: 386980 - protein, 9 aa, Homo Sapiens
GLGPPPPGP

SEQ ID NO: 386981 - protein, 9 aa, Homo Sapiens
WREEKNVHR

SEQ ID NO: 386982 - protein, 9 aa, Homo Sapiens
RRAAGALGS

SEQ ID NO: 386983 - protein, 9 aa, Homo Sapiens
DMEKYLKKQ

SEQ ID NO: 386984 - protein, 9 aa, Homo Sapiens
PGLGPPPPG

SEQ ID NO: 386985 - protein, 9 aa, Homo Sapiens
PLYEWSLPI

SEQ ID NO: 386986 - protein, 9 aa, Homo Sapiens
CLDILLPSP

SEQ ID NO: 386987 - protein, 9 aa, Homo Sapiens
EPPKEEQKM

SEQ ID NO: 386988 - protein, 9 aa, Homo Sapiens
AIHFRRERE

SEQ ID NO: 386989 - protein, 9 aa, Homo Sapiens
VESLELEKD

SEQ ID NO: 386990 - protein, 9 aa, Homo Sapiens
PFVCNGCGK

SEQ ID NO: 386991 - protein, 9 aa, Homo Sapiens
QAVDGWVEE

SEQ ID NO: 386992 - protein, 9 aa, Homo Sapiens
TRRDSWPTR

SEQ ID NO: 386993 - protein, 9 aa, Homo Sapiens
TFTLVTRGT

SEQ ID NO: 386994 - protein, 9 aa, Homo Sapiens
RVNSMSIIG

SEQ ID NO: 386995 - protein, 9 aa, Homo Sapiens
SYRHQDKYY

SEQ ID NO: 386996 - protein, 9 aa, Homo Sapiens
QNSSPRNPP

SEQ ID NO: 386997 - protein, 9 aa, Homo Sapiens
EEKKAQTVT

SEQ ID NO: 386998 - protein, 9 aa, Homo Sapiens
FWRIVFWLG

SEQ ID NO: 386999 - protein, 9 aa, Homo Sapiens
WLLITTQIF

SEQ ID NO: 387000 - protein, 9 aa, Homo Sapiens
MMGRVGRPQ

SEQ ID NO: 387001 - protein, 9 aa, Homo Sapiens
ASEELVCKL

SEQ ID NO: 387002 - protein, 9 aa, Homo Sapiens
QIYRRYCME

SEQ ID NO: 387003 - protein, 9 aa, Homo Sapiens
LFPMHAKGP

SEQ ID NO: 387004 - protein, 9 aa, Homo Sapiens
KKDTWSFGV

SEQ ID NO: 387005 - protein, 9 aa, Homo Sapiens
DMIERTIIL

SEQ ID NO: 387006 - protein, 9 aa, Homo Sapiens
GVALKLVKR

SEQ ID NO: 387007 - protein, 9 aa, Homo Sapiens
ILADKPNDQ

SEQ ID NO: 387008 - protein, 9 aa, Homo Sapiens
VTAPPSAPG

SEQ ID NO: 387009 - protein, 9 aa, Homo Sapiens
DLLQAVQHN

SEQ ID NO: 387010 - protein, 9 aa, Homo Sapiens
HSPFVSILR

SEQ ID NO: 387011 - protein, 9 aa, Homo Sapiens
QGLTDLEIG

SEQ ID NO: 387012 - protein, 9 aa, Homo Sapiens
VAERLDEIL

SEQ ID NO: 387013 - protein, 9 aa, Homo Sapiens
TNPGPAQFH

SEQ ID NO: 387014 - protein, 9 aa, Homo Sapiens
YFCIWKGIK

SEQ ID NO: 387015 - protein, 9 aa, Homo Sapiens
SEGTPGVRA

SEQ ID NO: 387016 - protein, 9 aa, Homo Sapiens
QICPMILRT

SEQ ID NO: 387017 - protein, 9 aa, Homo Sapiens
REALVAELA

SEQ ID NO: 387018 - protein, 9 aa, Homo Sapiens
IWVADLLQH

SEQ ID NO: 387019 - protein, 9 aa, Homo Sapiens
SQGVLVKHS

SEQ ID NO: 387020 - protein, 9 aa, Homo Sapiens
QHVISDQDT

SEQ ID NO: 387021 - protein, 9 aa, Homo Sapiens
QDAIELGCD

SEQ ID NO: 387022 - protein, 9 aa, Homo Sapiens
YMVPRARVI

SEQ ID NO: 387023 - protein, 9 aa, Homo Sapiens
HGPDGLLQL

SEQ ID NO: 387024 - protein, 9 aa, Homo Sapiens
HTTTPSSGS

SEQ ID NO: 387025 - protein, 9 aa, Homo Sapiens
TWENPQELK

SEQ ID NO: 387026 - protein, 9 aa, Homo Sapiens
CRSCGVTGP

SEQ ID NO: 387027 - protein, 9 aa, Homo Sapiens
QQYSAFFKP

SEQ ID NO: 387028 - protein, 9 aa, Homo Sapiens
GMGPHVPRQ

SEQ ID NO: 387029 - protein, 9 aa, Homo Sapiens
QMSGTSGKG

SEQ ID NO: 387030 - protein, 9 aa, Homo Sapiens
GGVADARLE

SEQ ID NO: 387031 - protein, 9 aa, Homo Sapiens
GGHPEVIYN

SEQ ID NO: 387032 - protein, 9 aa, Homo Sapiens
ASMDGSMHT

SEQ ID NO: 387033 - protein, 9 aa, Homo Sapiens
ADDELANLN

SEQ ID NO: 387034 - protein, 9 aa, Homo Sapiens
TSKEDIDTA

SEQ ID NO: 387035 - protein, 9 aa, Homo Sapiens
GKKLVKISE

SEQ ID NO: 387036 - protein, 9 aa, Homo Sapiens
RDGGQEYMV

SEQ ID NO: 387037 - protein, 9 aa, Homo Sapiens
NDAEDFEKH

SEQ ID NO: 387038 - protein, 9 aa, Homo Sapiens
PLLGEERET

SEQ ID NO: 387039 - protein, 9 aa, Homo Sapiens
RVHILDSQT

SEQ ID NO: 387040 - protein, 9 aa, Homo Sapiens
ALLPATWCL

SEQ ID NO: 387041 - protein, 9 aa, Homo Sapiens
QRGHMHNSL

SEQ ID NO: 387042 - protein, 9 aa, Homo Sapiens
ATVNSKIET

SEQ ID NO: 387043 - protein, 9 aa, Homo Sapiens
NSSNPFLHH

SEQ ID NO: 387044 - protein, 9 aa, Homo Sapiens
LAQWAPAAS

SEQ ID NO: 387045 - protein, 9 aa, Homo Sapiens
RNITVQKNK

SEQ ID NO: 387046 - protein, 9 aa, Homo Sapiens
WKIVVSNTT

SEQ ID NO: 387047 - protein, 9 aa, Homo Sapiens
NTPDISHIV

SEQ ID NO: 387048 - protein, 9 aa, Homo Sapiens
SSDQSFCLI

SEQ ID NO: 387049 - protein, 9 aa, Homo Sapiens
SFDFFRVLL

SEQ ID NO: 387050 - protein, 9 aa, Homo Sapiens
HCSTTCRTS

SEQ ID NO: 387051 - protein, 9 aa, Homo Sapiens
LPVTSLSSS

SEQ ID NO: 387052 - protein, 9 aa, Homo Sapiens
ELSKKKYFP

SEQ ID NO: 387053 - protein, 9 aa, Homo Sapiens
GDATPLHSV

SEQ ID NO: 387054 - protein, 9 aa, Homo Sapiens
EFNPIVVAS

SEQ ID NO: 387055 - protein, 9 aa, Homo Sapiens
GFTSDYCET

SEQ ID NO: 387056 - protein, 9 aa, Homo Sapiens
FARRAISTF

SEQ ID NO: 387057 - protein, 9 aa, Homo Sapiens
EIQLTMNDS

SEQ ID NO: 387058 - protein, 9 aa, Homo Sapiens
VSQSQLVYQ

SEQ ID NO: 387059 - protein, 9 aa, Homo Sapiens
DNQLLDKNG

SEQ ID NO: 387060 - protein, 9 aa, Homo Sapiens
DKGIIYDTD

SEQ ID NO: 387061 - protein, 9 aa, Homo Sapiens
TSSPTARAT

SEQ ID NO: 387062 - protein, 9 aa, Homo Sapiens
NKALCEHLS

SEQ ID NO: 387063 - protein, 9 aa, Homo Sapiens
TSQSQPHCV

SEQ ID NO: 387064 - protein, 9 aa, Homo Sapiens
AGGDDDDQG

SEQ ID NO: 387065 - protein, 9 aa, Homo Sapiens
VSTVVLARE

SEQ ID NO: 387066 - protein, 9 aa, Homo Sapiens
NETLTELQF

SEQ ID NO: 387067 - protein, 9 aa, Homo Sapiens
AWPASSFAH

SEQ ID NO: 387068 - protein, 9 aa, Homo Sapiens
YECNQCGET

SEQ ID NO: 387069 - protein, 9 aa, Homo Sapiens
KDLDFLTNK

SEQ ID NO: 387070 - protein, 9 aa, Homo Sapiens
VTGFDMIVI

SEQ ID NO: 387071 - protein, 9 aa, Homo Sapiens
AWGLPRLTL

SEQ ID NO: 387072 - protein, 9 aa, Homo Sapiens
AGLDDVSLH

SEQ ID NO: 387073 - protein, 9 aa, Homo Sapiens
VCCLNLRNP

SEQ ID NO: 387074 - protein, 9 aa, Homo Sapiens
TSRTRETLE

SEQ ID NO: 387075 - protein, 9 aa, Homo Sapiens
RNVGLSKCE

SEQ ID NO: 387076 - protein, 9 aa, Homo Sapiens
NLERTTPPR

SEQ ID NO: 387077 - protein, 9 aa, Homo Sapiens
ERDTRDTFS

SEQ ID NO: 387078 - protein, 9 aa, Homo Sapiens
LMQHLILWH

SEQ ID NO: 387079 - protein, 9 aa, Homo Sapiens
QLGSGVIVV

SEQ ID NO: 387080 - protein, 9 aa, Homo Sapiens
VTLTPHIGP

SEQ ID NO: 387081 - protein, 9 aa, Homo Sapiens
GLVPESGSR

SEQ ID NO: 387082 - protein, 9 aa, Homo Sapiens
IFQMLIIEK

SEQ ID NO: 387083 - protein, 9 aa, Homo Sapiens
TWRTSRTRE

SEQ ID NO: 387084 - protein, 9 aa, Homo Sapiens
RFAFSTRLA

SEQ ID NO: 387085 - protein, 9 aa, Homo Sapiens
QLALFYQGP

SEQ ID NO: 387086 - protein, 9 aa, Homo Sapiens
SAPRASAPP

SEQ ID NO: 387087 - protein, 9 aa, Homo Sapiens
KHSESPPAP

SEQ ID NO: 387088 - protein, 9 aa, Homo Sapiens
KEPAQCIEQ

SEQ ID NO: 387089 - protein, 9 aa, Homo Sapiens
SPGVVTDLF

SEQ ID NO: 387090 - protein, 9 aa, Homo Sapiens
VARPSTTRR

SEQ ID NO: 387091 - protein, 9 aa, Homo Sapiens
KCLTSQSQP

SEQ ID NO: 387092 - protein, 9 aa, Homo Sapiens
QIPKYCVPN

SEQ ID NO: 387093 - protein, 9 aa, Homo Sapiens
SPQGPRILL

SEQ ID NO: 387094 - protein, 9 aa, Homo Sapiens
DIPDIYEKD

SEQ ID NO: 387095 - protein, 9 aa, Homo Sapiens
SALFIWPQH

SEQ ID NO: 387096 - protein, 9 aa, Homo Sapiens
ASEIEVHFV

SEQ ID NO: 387097 - protein, 9 aa, Homo Sapiens
HVHTGEKPY

SEQ ID NO: 387098 - protein, 9 aa, Homo Sapiens
CPLPLPPTQ

SEQ ID NO: 387099 - protein, 9 aa, Homo Sapiens
AGGSPPSSP

SEQ ID NO: 387100 - protein, 9 aa, Homo Sapiens
TPPLSTQPP

SEQ ID NO: 387101 - protein, 9 aa, Homo Sapiens
TSSSSLSFL

SEQ ID NO: 387102 - protein, 9 aa, Homo Sapiens
LVGDPSPRK

SEQ ID NO: 387103 - protein, 9 aa, Homo Sapiens
SCSHTNLCL

SEQ ID NO: 387104 - protein, 9 aa, Homo Sapiens
ANSSTSSPG

SEQ ID NO: 387105 - protein, 9 aa, Homo Sapiens
GTSIAFSTS

SEQ ID NO: 387106 - protein, 9 aa, Homo Sapiens
SLSSPPTVI

SEQ ID NO: 387107 - protein, 9 aa, Homo Sapiens
AMLRWLLSS

SEQ ID NO: 387108 - protein, 9 aa, Homo Sapiens
QGDRPQGPP

SEQ ID NO: 387109 - protein, 9 aa, Homo Sapiens
VSKWSTDDV

SEQ ID NO: 387110 - protein, 9 aa, Homo Sapiens
PRASAPAGT

SEQ ID NO: 387111 - protein, 9 aa, Homo Sapiens
ETVTVTAVG

SEQ ID NO: 387112 - protein, 9 aa, Homo Sapiens
RSSPRLRFC

SEQ ID NO: 387113 - protein, 9 aa, Homo Sapiens
GGRHTTTPS

SEQ ID NO: 387114 - protein, 9 aa, Homo Sapiens
GQPGPAAVT

SEQ ID NO: 387115 - protein, 9 aa, Homo Sapiens
GGPEEEEVS

SEQ ID NO: 387116 - protein, 9 aa, Homo Sapiens
GLKREDKSI

SEQ ID NO: 387117 - protein, 9 aa, Homo Sapiens
DSKHLTAAL

SEQ ID NO: 387118 - protein, 9 aa, Homo Sapiens
GAPAGEAEF

SEQ ID NO: 387119 - protein, 9 aa, Homo Sapiens
NPLLRLSLR

SEQ ID NO: 387120 - protein, 9 aa, Homo Sapiens
RMSLTKPLK

SEQ ID NO: 387121 - protein, 9 aa, Homo Sapiens
CLENLAVPS

SEQ ID NO: 387122 - protein, 9 aa, Homo Sapiens
SGSTPPRAP

SEQ ID NO: 387123 - protein, 9 aa, Homo Sapiens
YLFVLLENL

SEQ ID NO: 387124 - protein, 9 aa, Homo Sapiens
DRKARADKG

SEQ ID NO: 387125 - protein, 9 aa, Homo Sapiens
SLGIRAQGT

SEQ ID NO: 387126 - protein, 9 aa, Homo Sapiens
PPPQGDRPQ

SEQ ID NO: 387127 - protein, 9 aa, Homo Sapiens
ENARSPPAA

SEQ ID NO: 387128 - protein, 9 aa, Homo Sapiens
SFFFNFFQF

SEQ ID NO: 387129 - protein, 9 aa, Homo Sapiens
PASPGNRGL

SEQ ID NO: 387130 - protein, 9 aa, Homo Sapiens
CNILRKCKD

SEQ ID NO: 387131 - protein, 9 aa, Homo Sapiens
LRDGDCYWF

SEQ ID NO: 387132 - protein, 9 aa, Homo Sapiens
DLGRPAHSA

SEQ ID NO: 387133 - protein, 9 aa, Homo Sapiens
PTSARSRTP

SEQ ID NO: 387134 - protein, 9 aa, Homo Sapiens
TAEGSVVGV

SEQ ID NO: 387135 - protein, 9 aa, Homo Sapiens
LYYTEFTPL

SEQ ID NO: 387136 - protein, 9 aa, Homo Sapiens
EDGQHVVDG

SEQ ID NO: 387137 - protein, 9 aa, Homo Sapiens
HNNLHMDKK

SEQ ID NO: 387138 - protein, 9 aa, Homo Sapiens
GHMHNSLNY

SEQ ID NO: 387139 - protein, 9 aa, Homo Sapiens
TSKISGWTQ

SEQ ID NO: 387140 - protein, 9 aa, Homo Sapiens
RTRRARGSS

SEQ ID NO: 387141 - protein, 9 aa, Homo Sapiens
RLRSSGKKI

SEQ ID NO: 387142 - protein, 9 aa, Homo Sapiens
MRELFQIDP

SEQ ID NO: 387143 - protein, 9 aa, Homo Sapiens
RRPQPWKRG

SEQ ID NO: 387144 - protein, 9 aa, Homo Sapiens
TRASGPTPV

SEQ ID NO: 387145 - protein, 9 aa, Homo Sapiens
HPLSKFPGG

SEQ ID NO: 387146 - protein, 9 aa, Homo Sapiens
LEISAREEV

SEQ ID NO: 387147 - protein, 9 aa, Homo Sapiens
KTKMLVKFL

SEQ ID NO: 387148 - protein, 9 aa, Homo Sapiens
GSQRPPRQV

SEQ ID NO: 387149 - protein, 9 aa, Homo Sapiens
IGLKREDKS

SEQ ID NO: 387150 - protein, 9 aa, Homo Sapiens
SALPTAVTP

SEQ ID NO: 387151 - protein, 9 aa, Homo Sapiens
PSVARPSTT

SEQ ID NO: 387152 - protein, 9 aa, Homo Sapiens
QWSCSVPTG

SEQ ID NO: 387153 - protein, 9 aa, Homo Sapiens
KRHFTVNMS

SEQ ID NO: 387154 - protein, 9 aa, Homo Sapiens
FERDLQSSD

SEQ ID NO: 387155 - protein, 9 aa, Homo Sapiens
KKKKKIGLF

SEQ ID NO: 387156 - protein, 9 aa, Homo Sapiens
KVSRNTLFT

SEQ ID NO: 387157 - protein, 9 aa, Homo Sapiens
PSFHSHLPE

SEQ ID NO: 387158 - protein, 9 aa, Homo Sapiens
INTEYEPTE

SEQ ID NO: 387159 - protein, 9 aa, Homo Sapiens
PHPAPAEVE

SEQ ID NO: 387160 - protein, 9 aa, Homo Sapiens
LIHEIPLPE

SEQ ID NO: 387161 - protein, 9 aa, Homo Sapiens
SPSRAHLWP

SEQ ID NO: 387162 - protein, 9 aa, Homo Sapiens
QPVRHHPPC

SEQ ID NO: 387163 - protein, 9 aa, Homo Sapiens
TKQQLQNQQ

SEQ ID NO: 387164 - protein, 9 aa, Homo Sapiens
LRLSLRLKW

SEQ ID NO: 387165 - protein, 9 aa, Homo Sapiens
AWDFRLWNK

SEQ ID NO: 387166 - protein, 9 aa, Homo Sapiens
NENCSSSSW

SEQ ID NO: 387167 - protein, 9 aa, Homo Sapiens
FQVCAELDP

SEQ ID NO: 387168 - protein, 9 aa, Homo Sapiens
SAWQSGGRR

SEQ ID NO: 387169 - protein, 9 aa, Homo Sapiens
DCYRYAEDK

SEQ ID NO: 387170 - protein, 9 aa, Homo Sapiens
RTGGTSRTS

SEQ ID NO: 387171 - protein, 9 aa, Homo Sapiens
GAHVWLLPG

SEQ ID NO: 387172 - protein, 9 aa, Homo Sapiens
VTNMIANGK

SEQ ID NO: 387173 - protein, 9 aa, Homo Sapiens
LVQEMERFD

SEQ ID NO: 387174 - protein, 9 aa, Homo Sapiens
ETLTELQFH

SEQ ID NO: 387175 - protein, 9 aa, Homo Sapiens
LMIRWLLCF

SEQ ID NO: 387176 - protein, 9 aa, Homo Sapiens
FSTRLSIST

SEQ ID NO: 387177 - protein, 9 aa, Homo Sapiens
SAVASTEDS

SEQ ID NO: 387178 - protein, 9 aa, Homo Sapiens
RGASKASRA

SEQ ID NO: 387179 - protein, 9 aa, Homo Sapiens
AIWRRIGAT

SEQ ID NO: 387180 - protein, 9 aa, Homo Sapiens
AQSAWCSSW

SEQ ID NO: 387181 - protein, 9 aa, Homo Sapiens
RQRRMDARY

SEQ ID NO: 387182 - protein, 9 aa, Homo Sapiens
VKAEKLRHL

SEQ ID NO: 387183 - protein, 9 aa, Homo Sapiens
MAAFYDCLL

SEQ ID NO: 387184 - protein, 9 aa, Homo Sapiens
LTALLAQGQ

SEQ ID NO: 387185 - protein, 9 aa, Homo Sapiens
TLYASVALF

SEQ ID NO: 387186 - protein, 9 aa, Homo Sapiens
GGGGDATPL

SEQ ID NO: 387187 - protein, 9 aa, Homo Sapiens
CVSWSSPMA

SEQ ID NO: 387188 - protein, 9 aa, Homo Sapiens
FIHYSSLGS

SEQ ID NO: 387189 - protein, 9 aa, Homo Sapiens
QNRMTVTHM

SEQ ID NO: 387190 - protein, 9 aa, Homo Sapiens
QMHSNTPRS

SEQ ID NO: 387191 - protein, 9 aa, Homo Sapiens
EEPIEKPGG

SEQ ID NO: 387192 - protein, 9 aa, Homo Sapiens
TSAAASTFG

SEQ ID NO: 387193 - protein, 9 aa, Homo Sapiens
TATAASARS

SEQ ID NO: 387194 - protein, 9 aa, Homo Sapiens
TAFKMEKVP

SEQ ID NO: 387195 - protein, 9 aa, Homo Sapiens
CWSPLQPRA

SEQ ID NO: 387196 - protein, 9 aa, Homo Sapiens
LFIKLTHLP

SEQ ID NO: 387197 - protein, 9 aa, Homo Sapiens
RVSGLVVDM

SEQ ID NO: 387198 - protein, 9 aa, Homo Sapiens
TLRPWKTSC

SEQ ID NO: 387199 - protein, 9 aa, Homo Sapiens
EFPHPPKRI

SEQ ID NO: 387200 - protein, 9 aa, Homo Sapiens
LWAPAGTGT

SEQ ID NO: 387201 - protein, 9 aa, Homo Sapiens
HGTRRPRWT

SEQ ID NO: 387202 - protein, 9 aa, Homo Sapiens
SLSSSSTGD

SEQ ID NO: 387203 - protein, 9 aa, Homo Sapiens
PLTSRSLWC

SEQ ID NO: 387204 - protein, 9 aa, Homo Sapiens
EYLKNFHLL

SEQ ID NO: 387205 - protein, 9 aa, Homo Sapiens
SARSRTPPS

SEQ ID NO: 387206 - protein, 9 aa, Homo Sapiens
PGGFSKVMG

SEQ ID NO: 387207 - protein, 9 aa, Homo Sapiens
TAPAEVHKA

SEQ ID NO: 387208 - protein, 9 aa, Homo Sapiens
DSSPKKQER

SEQ ID NO: 387209 - protein, 9 aa, Homo Sapiens
KIVLWAAAY

SEQ ID NO: 387210 - protein, 9 aa, Homo Sapiens
GTAACITDL

SEQ ID NO: 387211 - protein, 9 aa, Homo Sapiens
VEVRSVRRM

SEQ ID NO: 387212 - protein, 9 aa, Homo Sapiens
TILKERRLL

SEQ ID NO: 387213 - protein, 9 aa, Homo Sapiens
YFIRPVVPK

SEQ ID NO: 387214 - protein, 9 aa, Homo Sapiens
PESVLYRKF

SEQ ID NO: 387215 - protein, 9 aa, Homo Sapiens
LPVPLLDPV

SEQ ID NO: 387216 - protein, 9 aa, Homo Sapiens
CVHNGLTAL

SEQ ID NO: 387217 - protein, 9 aa, Homo Sapiens
LVLMPPCSC

SEQ ID NO: 387218 - protein, 9 aa, Homo Sapiens
GTRSTRSTR

SEQ ID NO: 387219 - protein, 9 aa, Homo Sapiens
TLTLSDLPV

SEQ ID NO: 387220 - protein, 9 aa, Homo Sapiens
AKCTSDTMF

SEQ ID NO: 387221 - protein, 9 aa, Homo Sapiens
PCPPLEVHL

SEQ ID NO: 387222 - protein, 9 aa, Homo Sapiens
HMHFHYDEV

SEQ ID NO: 387223 - protein, 9 aa, Homo Sapiens
QGLPIGTHA

SEQ ID NO: 387224 - protein, 9 aa, Homo Sapiens
SQNIMATMI

SEQ ID NO: 387225 - protein, 9 aa, Homo Sapiens
VGDVNDNRS

SEQ ID NO: 387226 - protein, 9 aa, Homo Sapiens
SPNPISRAS

SEQ ID NO: 387227 - protein, 9 aa, Homo Sapiens
KKEEVFLIF

SEQ ID NO: 387228 - protein, 9 aa, Homo Sapiens
NPWSDPQDC

SEQ ID NO: 387229 - protein, 9 aa, Homo Sapiens
EINNMTIPS

SEQ ID NO: 387230 - protein, 9 aa, Homo Sapiens
DTALFEIYT

SEQ ID NO: 387231 - protein, 9 aa, Homo Sapiens
PSEKRSRSP

SEQ ID NO: 387232 - protein, 9 aa, Homo Sapiens
GTASQGLPV

SEQ ID NO: 387233 - protein, 9 aa, Homo Sapiens
GWSASCGPT

SEQ ID NO: 387234 - protein, 9 aa, Homo Sapiens
LQVLKKILR

SEQ ID NO: 387235 - protein, 9 aa, Homo Sapiens
EGRGPQTNP

SEQ ID NO: 387236 - protein, 9 aa, Homo Sapiens
FACPWPTGG

SEQ ID NO: 387237 - protein, 9 aa, Homo Sapiens
TMGSDPSLS

SEQ ID NO: 387238 - protein, 9 aa, Homo Sapiens
LAGDIQVGQ

SEQ ID NO: 387239 - protein, 9 aa, Homo Sapiens
SDSSPKKQE

SEQ ID NO: 387240 - protein, 9 aa, Homo Sapiens
SSFTHCRPH

SEQ ID NO: 387241 - protein, 9 aa, Homo Sapiens
SGSPHITNS

SEQ ID NO: 387242 - protein, 9 aa, Homo Sapiens
MIQMKTHSR

SEQ ID NO: 387243 - protein, 9 aa, Homo Sapiens
GESDCCYRE

SEQ ID NO: 387244 - protein, 9 aa, Homo Sapiens
GLLLANGSL

SEQ ID NO: 387245 - protein, 9 aa, Homo Sapiens
EKEVKRKKP

SEQ ID NO: 387246 - protein, 9 aa, Homo Sapiens
GQSGWSGEA

SEQ ID NO: 387247 - protein, 9 aa, Homo Sapiens
TEECMWSQG

SEQ ID NO: 387248 - protein, 9 aa, Homo Sapiens
VQNPAGGSR

SEQ ID NO: 387249 - protein, 9 aa, Homo Sapiens
YYTHPASYS

SEQ ID NO: 387250 - protein, 9 aa, Homo Sapiens
AMKHQSQLR

SEQ ID NO: 387251 - protein, 9 aa, Homo Sapiens
NNLLHAMPS

SEQ ID NO: 387252 - protein, 9 aa, Homo Sapiens
FSHRSLAGR

SEQ ID NO: 387253 - protein, 9 aa, Homo Sapiens
QMAIAATQT

SEQ ID NO: 387254 - protein, 9 aa, Homo Sapiens
PALTVAEVS

SEQ ID NO: 387255 - protein, 9 aa, Homo Sapiens
TENKFTLTD

SEQ ID NO: 387256 - protein, 9 aa, Homo Sapiens
FLKQINSSP

SEQ ID NO: 387257 - protein, 9 aa, Homo Sapiens
HRSLAGRNK

SEQ ID NO: 387258 - protein, 9 aa, Homo Sapiens
TREASLSSL

SEQ ID NO: 387259 - protein, 9 aa, Homo Sapiens
AHLIHRAHH

SEQ ID NO: 387260 - protein, 9 aa, Homo Sapiens
PRLDVNRLS

SEQ ID NO: 387261 - protein, 9 aa, Homo Sapiens
RELINGSLP

SEQ ID NO: 387262 - protein, 9 aa, Homo Sapiens
APATTLTPI

SEQ ID NO: 387263 - protein, 9 aa, Homo Sapiens
TLDDVSAPR

SEQ ID NO: 387264 - protein, 9 aa, Homo Sapiens
EWATEKRVK

SEQ ID NO: 387265 - protein, 9 aa, Homo Sapiens
WCSTVHGAV

SEQ ID NO: 387266 - protein, 9 aa, Homo Sapiens
TKEGGAVNC

SEQ ID NO: 387267 - protein, 9 aa, Homo Sapiens
YQAVYYYTV

SEQ ID NO: 387268 - protein, 9 aa, Homo Sapiens
TAPSAVPSV

SEQ ID NO: 387269 - protein, 9 aa, Homo Sapiens
LRQYMPPEG

SEQ ID NO: 387270 - protein, 9 aa, Homo Sapiens
SRCSNPTSG

SEQ ID NO: 387271 - protein, 9 aa, Homo Sapiens
HLLTKYCGY

SEQ ID NO: 387272 - protein, 9 aa, Homo Sapiens
PFGLIPRLP

SEQ ID NO: 387273 - protein, 9 aa, Homo Sapiens
VQKVTSSLG

SEQ ID NO: 387274 - protein, 9 aa, Homo Sapiens
VTAAGVVKS

SEQ ID NO: 387275 - protein, 9 aa, Homo Sapiens
TSNTRSTIG

SEQ ID NO: 387276 - protein, 9 aa, Homo Sapiens
KKTCSKATF

SEQ ID NO: 387277 - protein, 9 aa, Homo Sapiens
GSGSGLNAW

SEQ ID NO: 387278 - protein, 9 aa, Homo Sapiens
VILKKFSAQ

SEQ ID NO: 387279 - protein, 9 aa, Homo Sapiens
WFLSASVMY

SEQ ID NO: 387280 - protein, 9 aa, Homo Sapiens
PELRCIEFQ

SEQ ID NO: 387281 - protein, 9 aa, Homo Sapiens
ERYKVCVTN

SEQ ID NO: 387282 - protein, 9 aa, Homo Sapiens
TSNTICARE

SEQ ID NO: 387283 - protein, 9 aa, Homo Sapiens
HQGDRKGQI

SEQ ID NO: 387284 - protein, 9 aa, Homo Sapiens
SVSTTCYYP

SEQ ID NO: 387285 - protein, 9 aa, Homo Sapiens
PKFDTTFER

SEQ ID NO: 387286 - protein, 9 aa, Homo Sapiens
ARPAGGPPA

SEQ ID NO: 387287 - protein, 9 aa, Homo Sapiens
KARRHSPFV

SEQ ID NO: 387288 - protein, 9 aa, Homo Sapiens
DILDTAGKE

SEQ ID NO: 387289 - protein, 9 aa, Homo Sapiens
QVGQRTLVI

SEQ ID NO: 387290 - protein, 9 aa, Homo Sapiens
CLCLEEPRK

SEQ ID NO: 387291 - protein, 9 aa, Homo Sapiens
GLRTRPWAK

SEQ ID NO: 387292 - protein, 9 aa, Homo Sapiens
PAHSATGVI

SEQ ID NO: 387293 - protein, 9 aa, Homo Sapiens
FTVNMSKVE

SEQ ID NO: 387294 - protein, 9 aa, Homo Sapiens
QRPPRQVRE

SEQ ID NO: 387295 - protein, 9 aa, Homo Sapiens
SAAKIVLMN

SEQ ID NO: 387296 - protein, 9 aa, Homo Sapiens
QKHKRLEQA

SEQ ID NO: 387297 - protein, 9 aa, Homo Sapiens
FQNDPCLAT

SEQ ID NO: 387298 - protein, 9 aa, Homo Sapiens
TRRARRARG

SEQ ID NO: 387299 - protein, 9 aa, Homo Sapiens
FMKLYHSLV

SEQ ID NO: 387300 - protein, 9 aa, Homo Sapiens
GGSRARCTR

SEQ ID NO: 387301 - protein, 9 aa, Homo Sapiens
KYYQMPSFE

SEQ ID NO: 387302 - protein, 9 aa, Homo Sapiens
AGTALPAVR

SEQ ID NO: 387303 - protein, 9 aa, Homo Sapiens
VTLGTRRAA

SEQ ID NO: 387304 - protein, 9 aa, Homo Sapiens
SVIYDGEVC

SEQ ID NO: 387305 - protein, 9 aa, Homo Sapiens
SRTHSLEVT

SEQ ID NO: 387306 - protein, 9 aa, Homo Sapiens
RDLRAEIQH

SEQ ID NO: 387307 - protein, 9 aa, Homo Sapiens
CELTEPCIL

SEQ ID NO: 387308 - protein, 9 aa, Homo Sapiens
HENKSNSEN

SEQ ID NO: 387309 - protein, 9 aa, Homo Sapiens
PETVPYLKN

SEQ ID NO: 387310 - protein, 9 aa, Homo Sapiens
TREARSTSN

SEQ ID NO: 387311 - protein, 9 aa, Homo Sapiens
ALKQVSPAS

SEQ ID NO: 387312 - protein, 9 aa, Homo Sapiens
ILFQIYQPW

SEQ ID NO: 387313 - protein, 9 aa, Homo Sapiens
GVATPGRPW

SEQ ID NO: 387314 - protein, 9 aa, Homo Sapiens
IGVGNGPTE

SEQ ID NO: 387315 - protein, 9 aa, Homo Sapiens
SDYCETEID

SEQ ID NO: 387316 - protein, 9 aa, Homo Sapiens
QCIEQATVD

SEQ ID NO: 387317 - protein, 9 aa, Homo Sapiens
SFYRKKLSQ

SEQ ID NO: 387318 - protein, 9 aa, Homo Sapiens
ETKSIFASK

SEQ ID NO: 387319 - protein, 9 aa, Homo Sapiens
HLPNTYPNS

SEQ ID NO: 387320 - protein, 9 aa, Homo Sapiens
SGPVYADVV

SEQ ID NO: 387321 - protein, 9 aa, Homo Sapiens
LGLLTECLA

SEQ ID NO: 387322 - protein, 9 aa, Homo Sapiens
TGGTRGASF

SEQ ID NO: 387323 - protein, 9 aa, Homo Sapiens
LKKMSMPAV

SEQ ID NO: 387324 - protein, 9 aa, Homo Sapiens
TSKYHQGDR

SEQ ID NO: 387325 - protein, 9 aa, Homo Sapiens
DMKVHWKTF

SEQ ID NO: 387326 - protein, 9 aa, Homo Sapiens
GKGFVASPG

SEQ ID NO: 387327 - protein, 9 aa, Homo Sapiens
GSLYVELYV

SEQ ID NO: 387328 - protein, 9 aa, Homo Sapiens
DITSKYHQG

SEQ ID NO: 387329 - protein, 9 aa, Homo Sapiens
RMEPLPPRS

SEQ ID NO: 387330 - protein, 9 aa, Homo Sapiens
SIEGSVDEA

SEQ ID NO: 387331 - protein, 9 aa, Homo Sapiens
TKEKKARKK

SEQ ID NO: 387332 - protein, 9 aa, Homo Sapiens
ARVDAHVVL

SEQ ID NO: 387333 - protein, 9 aa, Homo Sapiens
KIAFHIKSI

SEQ ID NO: 387334 - protein, 9 aa, Homo Sapiens
TRDGGQEYM

SEQ ID NO: 387335 - protein, 9 aa, Homo Sapiens
QHNNLHMDK

SEQ ID NO: 387336 - protein, 9 aa, Homo Sapiens
QIYQPWEPL

SEQ ID NO: 387337 - protein, 9 aa, Homo Sapiens
WNASFSLTC

SEQ ID NO: 387338 - protein, 9 aa, Homo Sapiens
GIYLCPKNK

SEQ ID NO: 387339 - protein, 9 aa, Homo Sapiens
QQMDGLFDI

SEQ ID NO: 387340 - protein, 9 aa, Homo Sapiens
ESNSSYLGQ

SEQ ID NO: 387341 - protein, 9 aa, Homo Sapiens
WRRKRWSPL

SEQ ID NO: 387342 - protein, 9 aa, Homo Sapiens
DVMLLDGLA

SEQ ID NO: 387343 - protein, 9 aa, Homo Sapiens
TVLSNHVNE

SEQ ID NO: 387344 - protein, 9 aa, Homo Sapiens
SKWSTDDVS

SEQ ID NO: 387345 - protein, 9 aa, Homo Sapiens
GDHVLALNQ

SEQ ID NO: 387346 - protein, 9 aa, Homo Sapiens
MLSPDRRGS

SEQ ID NO: 387347 - protein, 9 aa, Homo Sapiens
GTNFTRTSS

SEQ ID NO: 387348 - protein, 9 aa, Homo Sapiens
PTSGSTPGS

SEQ ID NO: 387349 - protein, 9 aa, Homo Sapiens
GPPRSRLAA

SEQ ID NO: 387350 - protein, 9 aa, Homo Sapiens
QWPHPDPAG

SEQ ID NO: 387351 - protein, 9 aa, Homo Sapiens
TFGTSLSPF

SEQ ID NO: 387352 - protein, 9 aa, Homo Sapiens
PLPPRSPRC

SEQ ID NO: 387353 - protein, 9 aa, Homo Sapiens
HVISDQDTI

SEQ ID NO: 387354 - protein, 9 aa, Homo Sapiens
GREREKENK

SEQ ID NO: 387355 - protein, 9 aa, Homo Sapiens
TAPTAWTVA

SEQ ID NO: 387356 - protein, 9 aa, Homo Sapiens
PPPTCSPPA

SEQ ID NO: 387357 - protein, 9 aa, Homo Sapiens
LDILDTAGK

SEQ ID NO: 387358 - protein, 9 aa, Homo Sapiens
SSHRCALGA

SEQ ID NO: 387359 - protein, 9 aa, Homo Sapiens
QINSSPVDS

SEQ ID NO: 387360 - protein, 9 aa, Homo Sapiens
MEAHTGRKK

SEQ ID NO: 387361 - protein, 9 aa, Homo Sapiens
TLGARRTVS

SEQ ID NO: 387362 - protein, 9 aa, Homo Sapiens
GHTQQDPGV

SEQ ID NO: 387363 - protein, 9 aa, Homo Sapiens
VISTLGADW

SEQ ID NO: 387364 - protein, 9 aa, Homo Sapiens
AEDPPHQPW

SEQ ID NO: 387365 - protein, 9 aa, Homo Sapiens
SRGPSTPAC

SEQ ID NO: 387366 - protein, 9 aa, Homo Sapiens
NHSKCITEC

SEQ ID NO: 387367 - protein, 9 aa, Homo Sapiens
GPHVPRQLP

SEQ ID NO: 387368 - protein, 9 aa, Homo Sapiens
LLWPQEESP

SEQ ID NO: 387369 - protein, 9 aa, Homo Sapiens
RNPRVCSHC

SEQ ID NO: 387370 - protein, 9 aa, Homo Sapiens
CFAVHMRSR

SEQ ID NO: 387371 - protein, 9 aa, Homo Sapiens
ISVKDHRTS

SEQ ID NO: 387372 - protein, 9 aa, Homo Sapiens
EFPSPFGHL

SEQ ID NO: 387373 - protein, 9 aa, Homo Sapiens
NVGWNIFDF

SEQ ID NO: 387374 - protein, 9 aa, Homo Sapiens
ITSKYHQGD

SEQ ID NO: 387375 - protein, 9 aa, Homo Sapiens
ENRTHPHKE

SEQ ID NO: 387376 - protein, 9 aa, Homo Sapiens
VTPSNVLSM

SEQ ID NO: 387377 - protein, 9 aa, Homo Sapiens
QMDGLFDIL

SEQ ID NO: 387378 - protein, 9 aa, Homo Sapiens
ALFEIYTIV

SEQ ID NO: 387379 - protein, 9 aa, Homo Sapiens
RGARGAKVS

SEQ ID NO: 387380 - protein, 9 aa, Homo Sapiens
SNITEELFL

SEQ ID NO: 387381 - protein, 9 aa, Homo Sapiens
SVLGALGSM

SEQ ID NO: 387382 - protein, 9 aa, Homo Sapiens
SRANGARGT

SEQ ID NO: 387383 - protein, 9 aa, Homo Sapiens
HKAPQLREW

SEQ ID NO: 387384 - protein, 9 aa, Homo Sapiens
LSSLTRQAD

SEQ ID NO: 387385 - protein, 9 aa, Homo Sapiens
RADACFVNC

SEQ ID NO: 387386 - protein, 9 aa, Homo Sapiens
TVSSRGTFG

SEQ ID NO: 387387 - protein, 9 aa, Homo Sapiens
IPSASRPTA

SEQ ID NO: 387388 - protein, 9 aa, Homo Sapiens
HTPLYEWSL

SEQ ID NO: 387389 - protein, 9 aa, Homo Sapiens
DEMDHFDRE

SEQ ID NO: 387390 - protein, 9 aa, Homo Sapiens
TELIHEIPL

SEQ ID NO: 387391 - protein, 9 aa, Homo Sapiens
SWSRCAGRP

SEQ ID NO: 387392 - protein, 9 aa, Homo Sapiens
TESRQHPSV

SEQ ID NO: 387393 - protein, 9 aa, Homo Sapiens
MQERPQSSY

SEQ ID NO: 387394 - protein, 9 aa, Homo Sapiens
FDDIPKCEG

SEQ ID NO: 387395 - protein, 9 aa, Homo Sapiens
ESLLLYTLN

SEQ ID NO: 387396 - protein, 9 aa, Homo Sapiens
GTEVPWPEV

SEQ ID NO: 387397 - protein, 9 aa, Homo Sapiens
ALCEHLSYT

SEQ ID NO: 387398 - protein, 9 aa, Homo Sapiens
ALLLLHLSH

SEQ ID NO: 387399 - protein, 9 aa, Homo Sapiens
AVRPEDGRP

SEQ ID NO: 387400 - protein, 9 aa, Homo Sapiens
LQQHNNLHM

SEQ ID NO: 387401 - protein, 9 aa, Homo Sapiens
INFGKLSLK

SEQ ID NO: 387402 - protein, 9 aa, Homo Sapiens
MADIATLRI

SEQ ID NO: 387403 - protein, 9 aa, Homo Sapiens
QTLGTRQTS

SEQ ID NO: 387404 - protein, 9 aa, Homo Sapiens
VKDHRTSQN

SEQ ID NO: 387405 - protein, 9 aa, Homo Sapiens
EVKEKGHIN

SEQ ID NO: 387406 - protein, 9 aa, Homo Sapiens
FPTMITFIG

SEQ ID NO: 387407 - protein, 9 aa, Homo Sapiens
EIEVHFVTR

SEQ ID NO: 387408 - protein, 9 aa, Homo Sapiens
YNDSVEHRD

SEQ ID NO: 387409 - protein, 9 aa, Homo Sapiens
SRNITVQKN

SEQ ID NO: 387410 - protein, 9 aa, Homo Sapiens
SCNRASSSK

SEQ ID NO: 387411 - protein, 9 aa, Homo Sapiens
SGAQVCVLS

SEQ ID NO: 387412 - protein, 9 aa, Homo Sapiens
FLDSWVHIV

SEQ ID NO: 387413 - protein, 9 aa, Homo Sapiens
QVPMQERPQ

SEQ ID NO: 387414 - protein, 9 aa, Homo Sapiens
KIFVSSADG

SEQ ID NO: 387415 - protein, 9 aa, Homo Sapiens
FNPIVVASG

SEQ ID NO: 387416 - protein, 9 aa, Homo Sapiens
VDIAHSEIF

SEQ ID NO: 387417 - protein, 9 aa, Homo Sapiens
LFAGVNCEE

SEQ ID NO: 387418 - protein, 9 aa, Homo Sapiens
LPENILADK

SEQ ID NO: 387419 - protein, 9 aa, Homo Sapiens
LHDVMLLDG

SEQ ID NO: 387420 - protein, 9 aa, Homo Sapiens
HGNPLLRLS

SEQ ID NO: 387421 - protein, 9 aa, Homo Sapiens
SEKRLKIFV

SEQ ID NO: 387422 - protein, 9 aa, Homo Sapiens
GDAWLLGGL

SEQ ID NO: 387423 - protein, 9 aa, Homo Sapiens
PPKSSASRG

SEQ ID NO: 387424 - protein, 9 aa, Homo Sapiens
YEFNPIVVA

SEQ ID NO: 387425 - protein, 9 aa, Homo Sapiens
YRGTLSGDT

SEQ ID NO: 387426 - protein, 9 aa, Homo Sapiens
TRGTLHTTL

SEQ ID NO: 387427 - protein, 9 aa, Homo Sapiens
VQQTIQWLF

SEQ ID NO: 387428 - protein, 9 aa, Homo Sapiens
PAGSPRPGP

SEQ ID NO: 387429 - protein, 9 aa, Homo Sapiens
RLHDDTEAA

SEQ ID NO: 387430 - protein, 9 aa, Homo Sapiens
SIREDIVCC

SEQ ID NO: 387431 - protein, 9 aa, Homo Sapiens
ESPPAPSMP

SEQ ID NO: 387432 - protein, 9 aa, Homo Sapiens
QARNNAHVI

SEQ ID NO: 387433 - protein, 9 aa, Homo Sapiens
PAIWVADLL

SEQ ID NO: 387434 - protein, 9 aa, Homo Sapiens
RGTRSTRST

SEQ ID NO: 387435 - protein, 9 aa, Homo Sapiens
LLENLAIIL

SEQ ID NO: 387436 - protein, 9 aa, Homo Sapiens
YCEVYQTPA

SEQ ID NO: 387437 - protein, 9 aa, Homo Sapiens
LQVYQILES

SEQ ID NO: 387438 - protein, 9 aa, Homo Sapiens
VTRCFSQVL

SEQ ID NO: 387439 - protein, 9 aa, Homo Sapiens
EVLINNING

SEQ ID NO: 387440 - protein, 9 aa, Homo Sapiens
HVPHTPGTT

SEQ ID NO: 387441 - protein, 9 aa, Homo Sapiens
APSAVPSVA

SEQ ID NO: 387442 - protein, 9 aa, Homo Sapiens
RRDPQDGCN

SEQ ID NO: 387443 - protein, 9 aa, Homo Sapiens
RKLQWKRLG

SEQ ID NO: 387444 - protein, 9 aa, Homo Sapiens
ITKRLCKQC

SEQ ID NO: 387445 - protein, 9 aa, Homo Sapiens
KKENENRKL

SEQ ID NO: 387446 - protein, 9 aa, Homo Sapiens
FIKLTHLPQ

SEQ ID NO: 387447 - protein, 9 aa, Homo Sapiens
LGSLYVELY

SEQ ID NO: 387448 - protein, 9 aa, Homo Sapiens
ILMGYPVPY

SEQ ID NO: 387449 - protein, 9 aa, Homo Sapiens
PQPLTAWGL

SEQ ID NO: 387450 - protein, 9 aa, Homo Sapiens
SRTSLTTIT

SEQ ID NO: 387451 - protein, 9 aa, Homo Sapiens
GSCLLDFAA

SEQ ID NO: 387452 - protein, 9 aa, Homo Sapiens
AVEACLRTH

SEQ ID NO: 387453 - protein, 9 aa, Homo Sapiens
PSRAHLWPT

SEQ ID NO: 387454 - protein, 9 aa, Homo Sapiens
SCNYIQCEL

SEQ ID NO: 387455 - protein, 9 aa, Homo Sapiens
LPLARPPRP

SEQ ID NO: 387456 - protein, 9 aa, Homo Sapiens
YYFITLTTI

SEQ ID NO: 387457 - protein, 9 aa, Homo Sapiens
LCCEEELHR

SEQ ID NO: 387458 - protein, 9 aa, Homo Sapiens
GPGRRGLRT

SEQ ID NO: 387459 - protein, 9 aa, Homo Sapiens
SSFTRTQTS

SEQ ID NO: 387460 - protein, 9 aa, Homo Sapiens
LTRQADHTT

SEQ ID NO: 387461 - protein, 9 aa, Homo Sapiens
FLIQRELLK

SEQ ID NO: 387462 - protein, 9 aa, Homo Sapiens
STVLKASDA

SEQ ID NO: 387463 - protein, 9 aa, Homo Sapiens
AVISLCMYT

SEQ ID NO: 387464 - protein, 9 aa, Homo Sapiens
RKNEELIAL

SEQ ID NO: 387465 - protein, 9 aa, Homo Sapiens
TVGPSGTSR

SEQ ID NO: 387466 - protein, 9 aa, Homo Sapiens
SVAAVAAAA

SEQ ID NO: 387467 - protein, 9 aa, Homo Sapiens
PSIHLDGEN

SEQ ID NO: 387468 - protein, 9 aa, Homo Sapiens
DPTKAWPAS

SEQ ID NO: 387469 - protein, 9 aa, Homo Sapiens
AASVSSCNR

SEQ ID NO: 387470 - protein, 9 aa, Homo Sapiens
GSTPGSGPS

SEQ ID NO: 387471 - protein, 9 aa, Homo Sapiens
ALVAPDRAP

SEQ ID NO: 387472 - protein, 9 aa, Homo Sapiens
LWAAVERFN

SEQ ID NO: 387473 - protein, 9 aa, Homo Sapiens
TKEINNMTI

SEQ ID NO: 387474 - protein, 9 aa, Homo Sapiens
LADQSPGSG

SEQ ID NO: 387475 - protein, 9 aa, Homo Sapiens
SCSEAPRPA

SEQ ID NO: 387476 - protein, 9 aa, Homo Sapiens
QCSLDTKSK

SEQ ID NO: 387477 - protein, 9 aa, Homo Sapiens
WKESTIFQM

SEQ ID NO: 387478 - protein, 9 aa, Homo Sapiens
KEKYDKMCN

SEQ ID NO: 387479 - protein, 9 aa, Homo Sapiens
IRVCGGDTE

SEQ ID NO: 387480 - protein, 9 aa, Homo Sapiens
RGPGSTSST

SEQ ID NO: 387481 - protein, 9 aa, Homo Sapiens
RGLIFGALK

SEQ ID NO: 387482 - protein, 9 aa, Homo Sapiens
HSDHPMIDI

SEQ ID NO: 387483 - protein, 9 aa, Homo Sapiens
LIHRAHHEG

SEQ ID NO: 387484 - protein, 9 aa, Homo Sapiens
KEGCHKKTS

SEQ ID NO: 387485 - protein, 9 aa, Homo Sapiens
KGFFDPNMH

SEQ ID NO: 387486 - protein, 9 aa, Homo Sapiens
PNTEEKSKS

SEQ ID NO: 387487 - protein, 9 aa, Homo Sapiens
RKRDVSVCR

SEQ ID NO: 387488 - protein, 9 aa, Homo Sapiens
REYLKNFHL

SEQ ID NO: 387489 - protein, 9 aa, Homo Sapiens
GMPDLLEGA

SEQ ID NO: 387490 - protein, 9 aa, Homo Sapiens
IKDQLGPSF

SEQ ID NO: 387491 - protein, 9 aa, Homo Sapiens
VSILRAALR

SEQ ID NO: 387492 - protein, 9 aa, Homo Sapiens
AELDPHEDI

SEQ ID NO: 387493 - protein, 9 aa, Homo Sapiens
ASWARPPAL

SEQ ID NO: 387494 - protein, 9 aa, Homo Sapiens
LSSRARGSL

SEQ ID NO: 387495 - protein, 9 aa, Homo Sapiens
GPTSGSTPG

SEQ ID NO: 387496 - protein, 9 aa, Homo Sapiens
VVMSFDRYM

SEQ ID NO: 387497 - protein, 9 aa, Homo Sapiens
MSKVETGLH

SEQ ID NO: 387498 - protein, 9 aa, Homo Sapiens
NITAPCNEK

SEQ ID NO: 387499 - protein, 9 aa, Homo Sapiens
LMGGMSRTP

SEQ ID NO: 387500 - protein, 9 aa, Homo Sapiens
RSRKERKAA

SEQ ID NO: 387501 - protein, 9 aa, Homo Sapiens
RLAVSTRGA

SEQ ID NO: 387502 - protein, 9 aa, Homo Sapiens
WRIVFWLGD

SEQ ID NO: 387503 - protein, 9 aa, Homo Sapiens
KVERCMSVI

SEQ ID NO: 387504 - protein, 9 aa, Homo Sapiens
LATGSSRGT

SEQ ID NO: 387505 - protein, 9 aa, Homo Sapiens
GAGTAACIT

SEQ ID NO: 387506 - protein, 9 aa, Homo Sapiens
YLSEAEASL

SEQ ID NO: 387507 - protein, 9 aa, Homo Sapiens
DACFVNCVE

SEQ ID NO: 387508 - protein, 9 aa, Homo Sapiens
VQGSWEPLC

SEQ ID NO: 387509 - protein, 9 aa, Homo Sapiens
MQSRMDQWM

SEQ ID NO: 387510 - protein, 9 aa, Homo Sapiens
SRQCLLTLT

SEQ ID NO: 387511 - protein, 9 aa, Homo Sapiens
LQMVLLPNT

SEQ ID NO: 387512 - protein, 9 aa, Homo Sapiens
EHKKKHWEK

SEQ ID NO: 387513 - protein, 9 aa, Homo Sapiens
HPPGSPSRA

SEQ ID NO: 387514 - protein, 9 aa, Homo Sapiens
SASFNAPPA

SEQ ID NO: 387515 - protein, 9 aa, Homo Sapiens
SSPVDSNML

SEQ ID NO: 387516 - protein, 9 aa, Homo Sapiens
RPPRPAPAR

SEQ ID NO: 387517 - protein, 9 aa, Homo Sapiens
SNTICARET

SEQ ID NO: 387518 - protein, 9 aa, Homo Sapiens
SACVHNGLT

SEQ ID NO: 387519 - protein, 9 aa, Homo Sapiens
QLLISWRME

SEQ ID NO: 387520 - protein, 9 aa, Homo Sapiens
TQLCLRIQT

SEQ ID NO: 387521 - protein, 9 aa, Homo Sapiens
EVFQNIMRM

SEQ ID NO: 387522 - protein, 9 aa, Homo Sapiens
QRLCHVLVD

SEQ ID NO: 387523 - protein, 9 aa, Homo Sapiens
SPPASTCWP

SEQ ID NO: 387524 - protein, 9 aa, Homo Sapiens
PHTPGTTAE

SEQ ID NO: 387525 - protein, 9 aa, Homo Sapiens
DSRADACFV

SEQ ID NO: 387526 - protein, 9 aa, Homo Sapiens
DFLCPSDTV

SEQ ID NO: 387527 - protein, 9 aa, Homo Sapiens
PKKVTFKAS

SEQ ID NO: 387528 - protein, 9 aa, Homo Sapiens
PTVITSNPL

SEQ ID NO: 387529 - protein, 9 aa, Homo Sapiens
AEARAKLTP

SEQ ID NO: 387530 - protein, 9 aa, Homo Sapiens
NQGYLSEAE

SEQ ID NO: 387531 - protein, 9 aa, Homo Sapiens
LPKIRSFQK

SEQ ID NO: 387532 - protein, 9 aa, Homo Sapiens
QQLLSDLIE

SEQ ID NO: 387533 - protein, 9 aa, Homo Sapiens
IVMGPQDHL

SEQ ID NO: 387534 - protein, 9 aa, Homo Sapiens
NKPDTFCGS

SEQ ID NO: 387535 - protein, 9 aa, Homo Sapiens
TTAATFRGA

SEQ ID NO: 387536 - protein, 9 aa, Homo Sapiens
HTIIHTEDK

SEQ ID NO: 387537 - protein, 9 aa, Homo Sapiens
KKEVPEFTK

SEQ ID NO: 387538 - protein, 9 aa, Homo Sapiens
APASSHVAA

SEQ ID NO: 387539 - protein, 9 aa, Homo Sapiens
KMKKREVVD

SEQ ID NO: 387540 - protein, 9 aa, Homo Sapiens
TRGSFLASR

SEQ ID NO: 387541 - protein, 9 aa, Homo Sapiens
LSGFTGLSI

SEQ ID NO: 387542 - protein, 9 aa, Homo Sapiens
ALAGKASHV

SEQ ID NO: 387543 - protein, 9 aa, Homo Sapiens
DVGLTSALV

SEQ ID NO: 387544 - protein, 9 aa, Homo Sapiens
WDFRLWNKW

SEQ ID NO: 387545 - protein, 9 aa, Homo Sapiens
ENDAEDFEK

SEQ ID NO: 387546 - protein, 9 aa, Homo Sapiens
IFASKVENG

SEQ ID NO: 387547 - protein, 9 aa, Homo Sapiens
EGCISVKDH

SEQ ID NO: 387548 - protein, 9 aa, Homo Sapiens
SIPLLWPQE

SEQ ID NO: 387549 - protein, 9 aa, Homo Sapiens
FLFLFLPGL

SEQ ID NO: 387550 - protein, 9 aa, Homo Sapiens
PEEQAGGPP

SEQ ID NO: 387551 - protein, 9 aa, Homo Sapiens
TDQHRNGVI

SEQ ID NO: 387552 - protein, 9 aa, Homo Sapiens
DPAAAQLFS

SEQ ID NO: 387553 - protein, 9 aa, Homo Sapiens
SKNSILNPV

SEQ ID NO: 387554 - protein, 9 aa, Homo Sapiens
SLPSAPPKM

SEQ ID NO: 387555 - protein, 9 aa, Homo Sapiens
DVWKKVLGE

SEQ ID NO: 387556 - protein, 9 aa, Homo Sapiens
LLQMAIAAT

SEQ ID NO: 387557 - protein, 9 aa, Homo Sapiens
MHSGLTQNI

SEQ ID NO: 387558 - protein, 9 aa, Homo Sapiens
GPSPGTAWS

SEQ ID NO: 387559 - protein, 9 aa, Homo Sapiens
PRLPHPAPA

SEQ ID NO: 387560 - protein, 9 aa, Homo Sapiens
AGVVKSGQS

SEQ ID NO: 387561 - protein, 9 aa, Homo Sapiens
TEHQDLQST

SEQ ID NO: 387562 - protein, 9 aa, Homo Sapiens
VGRPQFDDQ

SEQ ID NO: 387563 - protein, 9 aa, Homo Sapiens
GNLSPGVVT

SEQ ID NO: 387564 - protein, 9 aa, Homo Sapiens
FFCLRGHPS

SEQ ID NO: 387565 - protein, 9 aa, Homo Sapiens
ATGANRADR

SEQ ID NO: 387566 - protein, 9 aa, Homo Sapiens
VSTRGASKA

SEQ ID NO: 387567 - protein, 9 aa, Homo Sapiens
HSKCITECV

SEQ ID NO: 387568 - protein, 9 aa, Homo Sapiens
IWEVMPRTL

SEQ ID NO: 387569 - protein, 9 aa, Homo Sapiens
FVFTYEGLR

SEQ ID NO: 387570 - protein, 9 aa, Homo Sapiens
GVPVALKKS

SEQ ID NO: 387571 - protein, 9 aa, Homo Sapiens
QVPKDCYPE

SEQ ID NO: 387572 - protein, 9 aa, Homo Sapiens
FCLETLNTK

SEQ ID NO: 387573 - protein, 9 aa, Homo Sapiens
LYRNGIMLF

SEQ ID NO: 387574 - protein, 9 aa, Homo Sapiens
FGSRSTNIT

SEQ ID NO: 387575 - protein, 9 aa, Homo Sapiens
HPILPKCLT

SEQ ID NO: 387576 - protein, 9 aa, Homo Sapiens
RSTGCYLCQ

SEQ ID NO: 387577 - protein, 9 aa, Homo Sapiens
PAPSALVLL

SEQ ID NO: 387578 - protein, 9 aa, Homo Sapiens
HQEAAHRGL

SEQ ID NO: 387579 - protein, 9 aa, Homo Sapiens
DTSKEDIDT

SEQ ID NO: 387580 - protein, 9 aa, Homo Sapiens
PASYSENKA

SEQ ID NO: 387581 - protein, 9 aa, Homo Sapiens
PECGRWFSQ

SEQ ID NO: 387582 - protein, 9 aa, Homo Sapiens
ASCQNSSPR

SEQ ID NO: 387583 - protein, 9 aa, Homo Sapiens
QLTMNDSKH

SEQ ID NO: 387584 - protein, 9 aa, Homo Sapiens
DREVEFGSA

SEQ ID NO: 387585 - protein, 9 aa, Homo Sapiens
LIQRELLKT

SEQ ID NO: 387586 - protein, 9 aa, Homo Sapiens
GTRQTSFTG

SEQ ID NO: 387587 - protein, 9 aa, Homo Sapiens
RRCCSPRRP

SEQ ID NO: 387588 - protein, 9 aa, Homo Sapiens
KEEQKMQSR

SEQ ID NO: 387589 - protein, 9 aa, Homo Sapiens
ESLELEKDM

SEQ ID NO: 387590 - protein, 9 aa, Homo Sapiens
AYMQEEERE

SEQ ID NO: 387591 - protein, 9 aa, Homo Sapiens
FFSFLFLFL

SEQ ID NO: 387592 - protein, 9 aa, Homo Sapiens
PWLLEVGSE

SEQ ID NO: 387593 - protein, 9 aa, Homo Sapiens
EVEIGTVVV

SEQ ID NO: 387594 - protein, 9 aa, Homo Sapiens
PDRTLLAPT

SEQ ID NO: 387595 - protein, 9 aa, Homo Sapiens
LLLLHLSHG

SEQ ID NO: 387596 - protein, 9 aa, Homo Sapiens
INNINGRLT

SEQ ID NO: 387597 - protein, 9 aa, Homo Sapiens
MLSKKGLLL

SEQ ID NO: 387598 - protein, 9 aa, Homo Sapiens
LTLTRKYDF

SEQ ID NO: 387599 - protein, 9 aa, Homo Sapiens
YSDSWHVDA

SEQ ID NO: 387600 - protein, 9 aa, Homo Sapiens
FPTGHSDSE

SEQ ID NO: 387601 - protein, 9 aa, Homo Sapiens
DLKKGLQRG

SEQ ID NO: 387602 - protein, 9 aa, Homo Sapiens
SPPTVITSN

SEQ ID NO: 387603 - protein, 9 aa, Homo Sapiens
RFISWLQDV

SEQ ID NO: 387604 - protein, 9 aa, Homo Sapiens
SPHPEETVT

SEQ ID NO: 387605 - protein, 9 aa, Homo Sapiens
PTVHGLLRQ

SEQ ID NO: 387606 - protein, 9 aa, Homo Sapiens
HPDPAGSPR

SEQ ID NO: 387607 - protein, 9 aa, Homo Sapiens
EGGLPSGNP

SEQ ID NO: 387608 - protein, 9 aa, Homo Sapiens
RGSLSSSLS

SEQ ID NO: 387609 - protein, 9 aa, Homo Sapiens
APTLQVVIL

SEQ ID NO: 387610 - protein, 9 aa, Homo Sapiens
KRVCRKSVL

SEQ ID NO: 387611 - protein, 9 aa, Homo Sapiens
GTPWLRVMI

SEQ ID NO: 387612 - protein, 9 aa, Homo Sapiens
SARSPTSSP

SEQ ID NO: 387613 - protein, 9 aa, Homo Sapiens
LRKKMLNGQ

SEQ ID NO: 387614 - protein, 9 aa, Homo Sapiens
NPSRLVRRC

SEQ ID NO: 387615 - protein, 9 aa, Homo Sapiens
DFTGELEVL

SEQ ID NO: 387616 - protein, 9 aa, Homo Sapiens
IVMATKMAT

SEQ ID NO: 387617 - protein, 9 aa, Homo Sapiens
NTGFPFSAI

SEQ ID NO: 387618 - protein, 9 aa, Homo Sapiens
AKDTTSAVS

SEQ ID NO: 387619 - protein, 9 aa, Homo Sapiens
IPNDLKKGL

SEQ ID NO: 387620 - protein, 9 aa, Homo Sapiens
PVDSNMLVR

SEQ ID NO: 387621 - protein, 9 aa, Homo Sapiens
QWPTVHGLL

SEQ ID NO: 387622 - protein, 9 aa, Homo Sapiens
EATSAHYVE

SEQ ID NO: 387623 - protein, 9 aa, Homo Sapiens
KTHSRNITV

SEQ ID NO: 387624 - protein, 9 aa, Homo Sapiens
APEVCAGMI

SEQ ID NO: 387625 - protein, 9 aa, Homo Sapiens
IKRAQGWKR

SEQ ID NO: 387626 - protein, 9 aa, Homo Sapiens
KLKPTKRKR

SEQ ID NO: 387627 - protein, 9 aa, Homo Sapiens
KDTWSFGVL

SEQ ID NO: 387628 - protein, 9 aa, Homo Sapiens
FPRRVLARF

SEQ ID NO: 387629 - protein, 9 aa, Homo Sapiens
LFYQGPGWE

SEQ ID NO: 387630 - protein, 9 aa, Homo Sapiens
GTSFTLSTN

SEQ ID NO: 387631 - protein, 9 aa, Homo Sapiens
KQRAEDPPH

SEQ ID NO: 387632 - protein, 9 aa, Homo Sapiens
NNYRTRINK

SEQ ID NO: 387633 - protein, 9 aa, Homo Sapiens
HRGHTKLEF

SEQ ID NO: 387634 - protein, 9 aa, Homo Sapiens
VIYDMLNDL

SEQ ID NO: 387635 - protein, 9 aa, Homo Sapiens
STKPHSSHS

SEQ ID NO: 387636 - protein, 9 aa, Homo Sapiens
LANTVKPRF

SEQ ID NO: 387637 - protein, 9 aa, Homo Sapiens
VVVEGVHGP

SEQ ID NO: 387638 - protein, 9 aa, Homo Sapiens
KLAPLQVTT

SEQ ID NO: 387639 - protein, 9 aa, Homo Sapiens
DCISARGLI

SEQ ID NO: 387640 - protein, 9 aa, Homo Sapiens
DDVSLHVAP

SEQ ID NO: 387641 - protein, 9 aa, Homo Sapiens
RSTSRTIST

SEQ ID NO: 387642 - protein, 9 aa, Homo Sapiens
IWTNQNTGF

SEQ ID NO: 387643 - protein, 9 aa, Homo Sapiens
VVHVVFSLI

SEQ ID NO: 387644 - protein, 9 aa, Homo Sapiens
MVLGLQFLH

SEQ ID NO: 387645 - protein, 9 aa, Homo Sapiens
NLWCEKLST

SEQ ID NO: 387646 - protein, 9 aa, Homo Sapiens
CHASIVEVL

SEQ ID NO: 387647 - protein, 9 aa, Homo Sapiens
LVRLMGPWH

SEQ ID NO: 387648 - protein, 9 aa, Homo Sapiens
LRQLGKGTE

SEQ ID NO: 387649 - protein, 9 aa, Homo Sapiens
RCLEFNQAM

SEQ ID NO: 387650 - protein, 9 aa, Homo Sapiens
SKVAKIGAC

SEQ ID NO: 387651 - protein, 9 aa, Homo Sapiens
TTSFTRRSF

SEQ ID NO: 387652 - protein, 9 aa, Homo Sapiens
DLEVANDPL

SEQ ID NO: 387653 - protein, 9 aa, Homo Sapiens
CVFKLGLFS

SEQ ID NO: 387654 - protein, 9 aa, Homo Sapiens
VLVDEEQKL

SEQ ID NO: 387655 - protein, 9 aa, Homo Sapiens
LIPADFELR

SEQ ID NO: 387656 - protein, 9 aa, Homo Sapiens
TLFTRRARR

SEQ ID NO: 387657 - protein, 9 aa, Homo Sapiens
GDQIPKYCV

SEQ ID NO: 387658 - protein, 9 aa, Homo Sapiens
AVTPRRSPA

SEQ ID NO: 387659 - protein, 9 aa, Homo Sapiens
AFMKVARMS

SEQ ID NO: 387660 - protein, 9 aa, Homo Sapiens
YKWLKMANL

SEQ ID NO: 387661 - protein, 9 aa, Homo Sapiens
VDDRRSCND

SEQ ID NO: 387662 - protein, 9 aa, Homo Sapiens
QPPHHLVPL

SEQ ID NO: 387663 - protein, 9 aa, Homo Sapiens
CTFVPPPPW

SEQ ID NO: 387664 - protein, 9 aa, Homo Sapiens
GLPSGNPWS

SEQ ID NO: 387665 - protein, 9 aa, Homo Sapiens
VAWLGLWLG

SEQ ID NO: 387666 - protein, 9 aa, Homo Sapiens
LPTLPPTRS

SEQ ID NO: 387667 - protein, 9 aa, Homo Sapiens
GAVNCGTRR

SEQ ID NO: 387668 - protein, 9 aa, Homo Sapiens
ACVQKVTSS

SEQ ID NO: 387669 - protein, 9 aa, Homo Sapiens
DQIQWPTVH

SEQ ID NO: 387670 - protein, 9 aa, Homo Sapiens
EKYDKMCND

SEQ ID NO: 387671 - protein, 9 aa, Homo Sapiens
HMLQGRPGF

SEQ ID NO: 387672 - protein, 9 aa, Homo Sapiens
LMYIFQNVM

SEQ ID NO: 387673 - protein, 9 aa, Homo Sapiens
KEENKQQES

SEQ ID NO: 387674 - protein, 9 aa, Homo Sapiens
TSSSDQSFC

SEQ ID NO: 387675 - protein, 9 aa, Homo Sapiens
SHLQQQCQP

SEQ ID NO: 387676 - protein, 9 aa, Homo Sapiens
LRRPPPPAQ

SEQ ID NO: 387677 - protein, 9 aa, Homo Sapiens
GFLPQAIRH

SEQ ID NO: 387678 - protein, 9 aa, Homo Sapiens
STRVSSRAS

SEQ ID NO: 387679 - protein, 9 aa, Homo Sapiens
TREARRTSG

SEQ ID NO: 387680 - protein, 9 aa, Homo Sapiens
ELRSQTVVT

SEQ ID NO: 387681 - protein, 9 aa, Homo Sapiens
LWHPHHQLT

SEQ ID NO: 387682 - protein, 9 aa, Homo Sapiens
PGAREGSAP

SEQ ID NO: 387683 - protein, 9 aa, Homo Sapiens
RGTLEAREA

SEQ ID NO: 387684 - protein, 9 aa, Homo Sapiens
RRRTWWRTR

SEQ ID NO: 387685 - protein, 9 aa, Homo Sapiens
PGVIKQKVL

SEQ ID NO: 387686 - protein, 9 aa, Homo Sapiens
TGCYLCQPD

SEQ ID NO: 387687 - protein, 9 aa, Homo Sapiens
ERKAMTKRS

SEQ ID NO: 387688 - protein, 9 aa, Homo Sapiens
SKNMDHVKA

SEQ ID NO: 387689 - protein, 9 aa, Homo Sapiens
IHSADKPHK

SEQ ID NO: 387690 - protein, 9 aa, Homo Sapiens
GGAGVVALD

SEQ ID NO: 387691 - protein, 9 aa, Homo Sapiens
HMLSEVRKG

SEQ ID NO: 387692 - protein, 9 aa, Homo Sapiens
SWKCRLNRH

SEQ ID NO: 387693 - protein, 9 aa, Homo Sapiens
PSGTIMDHS

SEQ ID NO: 387694 - protein, 9 aa, Homo Sapiens
AGENIGEKK

SEQ ID NO: 387695 - protein, 9 aa, Homo Sapiens
MTPVPLFSE

SEQ ID NO: 387696 - protein, 9 aa, Homo Sapiens
NKILFCVDS

SEQ ID NO: 387697 - protein, 9 aa, Homo Sapiens
LRKRDVSVC

SEQ ID NO: 387698 - protein, 9 aa, Homo Sapiens
DFNDVTNML

SEQ ID NO: 387699 - protein, 9 aa, Homo Sapiens
VSSRASSTS

SEQ ID NO: 387700 - protein, 9 aa, Homo Sapiens
KQWSFLVGD

SEQ ID NO: 387701 - protein, 9 aa, Homo Sapiens
PSGTSRTRG

SEQ ID NO: 387702 - protein, 9 aa, Homo Sapiens
RFTAVTLGT

SEQ ID NO: 387703 - protein, 9 aa, Homo Sapiens
DCRGRHWRC

SEQ ID NO: 387704 - protein, 9 aa, Homo Sapiens
DPVHGCCQC

SEQ ID NO: 387705 - protein, 9 aa, Homo Sapiens
ATTLTPIPQ

SEQ ID NO: 387706 - protein, 9 aa, Homo Sapiens
ASGPLGTSF

SEQ ID NO: 387707 - protein, 9 aa, Homo Sapiens
APARPAGGP

SEQ ID NO: 387708 - protein, 9 aa, Homo Sapiens
LGNKALCEH

SEQ ID NO: 387709 - protein, 9 aa, Homo Sapiens
ATGSSRGTS

SEQ ID NO: 387710 - protein, 9 aa, Homo Sapiens
GTSRTRGSR

SEQ ID NO: 387711 - protein, 9 aa, Homo Sapiens
INSGETKTI

SEQ ID NO: 387712 - protein, 9 aa, Homo Sapiens
QSHVINQAM

SEQ ID NO: 387713 - protein, 9 aa, Homo Sapiens
VEKPFERDL

SEQ ID NO: 387714 - protein, 9 aa, Homo Sapiens
DGAHVWLLP

SEQ ID NO: 387715 - protein, 9 aa, Homo Sapiens
DHSIILRHL

SEQ ID NO: 387716 - protein, 9 aa, Homo Sapiens
STEHQDLQS

SEQ ID NO: 387717 - protein, 9 aa, Homo Sapiens
RHPSRHPPG

SEQ ID NO: 387718 - protein, 9 aa, Homo Sapiens
DMIAEINFN

SEQ ID NO: 387719 - protein, 9 aa, Homo Sapiens
ESPALKQVS

SEQ ID NO: 387720 - protein, 9 aa, Homo Sapiens
GTVEFILLV

SEQ ID NO: 387721 - protein, 9 aa, Homo Sapiens
SRGTLFTRR

SEQ ID NO: 387722 - protein, 9 aa, Homo Sapiens
YHDGEILFS

SEQ ID NO: 387723 - protein, 9 aa, Homo Sapiens
LGTFRASGP

SEQ ID NO: 387724 - protein, 9 aa, Homo Sapiens
PMILRTLSC

SEQ ID NO: 387725 - protein, 9 aa, Homo Sapiens
KKKEVPEFT

SEQ ID NO: 387726 - protein, 9 aa, Homo Sapiens
RAQGWKRFG

SEQ ID NO: 387727 - protein, 9 aa, Homo Sapiens
PEPMWLARE

SEQ ID NO: 387728 - protein, 9 aa, Homo Sapiens
GRKKRAPHL

SEQ ID NO: 387729 - protein, 9 aa, Homo Sapiens
KTKPLGTVQ

SEQ ID NO: 387730 - protein, 9 aa, Homo Sapiens
DKVREVGFN

SEQ ID NO: 387731 - protein, 9 aa, Homo Sapiens
IAATQTQMP

SEQ ID NO: 387732 - protein, 9 aa, Homo Sapiens
FQKSYKRGG

SEQ ID NO: 387733 - protein, 9 aa, Homo Sapiens
HSRNITVQK

SEQ ID NO: 387734 - protein, 9 aa, Homo Sapiens
TGHSDSEGP

SEQ ID NO: 387735 - protein, 9 aa, Homo Sapiens
PRALMGFSL

SEQ ID NO: 387736 - protein, 9 aa, Homo Sapiens
ERAHRQRVC

SEQ ID NO: 387737 - protein, 9 aa, Homo Sapiens
LIIEKVLKI

SEQ ID NO: 387738 - protein, 9 aa, Homo Sapiens
KHHLLYPGI

SEQ ID NO: 387739 - protein, 9 aa, Homo Sapiens
KQGLGPPAP

SEQ ID NO: 387740 - protein, 9 aa, Homo Sapiens
KFQPSHLKV

SEQ ID NO: 387741 - protein, 9 aa, Homo Sapiens
AGARAHQSS

SEQ ID NO: 387742 - protein, 9 aa, Homo Sapiens
CTTFTRHSL

SEQ ID NO: 387743 - protein, 9 aa, Homo Sapiens
SMVGLSGGQ

SEQ ID NO: 387744 - protein, 9 aa, Homo Sapiens
GDVNDNRSV

SEQ ID NO: 387745 - protein, 9 aa, Homo Sapiens
LTRQATGPI

SEQ ID NO: 387746 - protein, 9 aa, Homo Sapiens
HDVMLLDGL

SEQ ID NO: 387747 - protein, 9 aa, Homo Sapiens
EGGIANYNI

SEQ ID NO: 387748 - protein, 9 aa, Homo Sapiens
VLHTAAWSC

SEQ ID NO: 387749 - protein, 9 aa, Homo Sapiens
KGPEMGSGT

SEQ ID NO: 387750 - protein, 9 aa, Homo Sapiens
FHQSSYLKI

SEQ ID NO: 387751 - protein, 9 aa, Homo Sapiens
DPISPEEQD

SEQ ID NO: 387752 - protein, 9 aa, Homo Sapiens
QKYKRINKP

SEQ ID NO: 387753 - protein, 9 aa, Homo Sapiens
TTQIFSYLG

SEQ ID NO: 387754 - protein, 9 aa, Homo Sapiens
LRSSGKKIA

SEQ ID NO: 387755 - protein, 9 aa, Homo Sapiens
FCIWKGIKS

SEQ ID NO: 387756 - protein, 9 aa, Homo Sapiens
HPENDLDQL

SEQ ID NO: 387757 - protein, 9 aa, Homo Sapiens
SSRCCPPIR

SEQ ID NO: 387758 - protein, 9 aa, Homo Sapiens
PAPYSSGAL

SEQ ID NO: 387759 - protein, 9 aa, Homo Sapiens
LHRGHTKLE

SEQ ID NO: 387760 - protein, 9 aa, Homo Sapiens
TVTLYASVA

SEQ ID NO: 387761 - protein, 9 aa, Homo Sapiens
TLGADWLEL

SEQ ID NO: 387762 - protein, 9 aa, Homo Sapiens
NKGLREGRK

SEQ ID NO: 387763 - protein, 9 aa, Homo Sapiens
PCPNLLPAP

SEQ ID NO: 387764 - protein, 9 aa, Homo Sapiens
AQKLADAIL

SEQ ID NO: 387765 - protein, 9 aa, Homo Sapiens
TSRTSLTTI

SEQ ID NO: 387766 - protein, 9 aa, Homo Sapiens
FSLKGDTSK

SEQ ID NO: 387767 - protein, 9 aa, Homo Sapiens
RDLCASSTM

SEQ ID NO: 387768 - protein, 9 aa, Homo Sapiens
RSPGHPRGS

SEQ ID NO: 387769 - protein, 9 aa, Homo Sapiens
PKSSASRGP

SEQ ID NO: 387770 - protein, 9 aa, Homo Sapiens
LASRANGAR

SEQ ID NO: 387771 - protein, 9 aa, Homo Sapiens
GPEGGLPSG

SEQ ID NO: 387772 - protein, 9 aa, Homo Sapiens
KFILNTENK

SEQ ID NO: 387773 - protein, 9 aa, Homo Sapiens
RLAAASGPC

SEQ ID NO: 387774 - protein, 9 aa, Homo Sapiens
KPSARSPTW

SEQ ID NO: 387775 - protein, 9 aa, Homo Sapiens
PPGLVIYDW

SEQ ID NO: 387776 - protein, 9 aa, Homo Sapiens
ERARPTQTH

SEQ ID NO: 387777 - protein, 9 aa, Homo Sapiens
KEKKARKKP

SEQ ID NO: 387778 - protein, 9 aa, Homo Sapiens
WTSATWGLT

SEQ ID NO: 387779 - protein, 9 aa, Homo Sapiens
SPAPSAGRT

SEQ ID NO: 387780 - protein, 9 aa, Homo Sapiens
SPSSPGLTL

SEQ ID NO: 387781 - protein, 9 aa, Homo Sapiens
FTGTTSFTR

SEQ ID NO: 387782 - protein, 9 aa, Homo Sapiens
AASARSPTS

SEQ ID NO: 387783 - protein, 9 aa, Homo Sapiens
QNILAHIWA

SEQ ID NO: 387784 - protein, 9 aa, Homo Sapiens
LPLPPPVWA

SEQ ID NO: 387785 - protein, 9 aa, Homo Sapiens
QHTTLLKGK

SEQ ID NO: 387786 - protein, 9 aa, Homo Sapiens
DESGAPLWS

SEQ ID NO: 387787 - protein, 9 aa, Homo Sapiens
EAVELPQKN

SEQ ID NO: 387788 - protein, 9 aa, Homo Sapiens
DAFRSHTFR

SEQ ID NO: 387789 - protein, 9 aa, Homo Sapiens
LSISTRVSS

SEQ ID NO: 387790 - protein, 9 aa, Homo Sapiens
LSAGKELVI

SEQ ID NO: 387791 - protein, 9 aa, Homo Sapiens
LKKGAAVDR

SEQ ID NO: 387792 - protein, 9 aa, Homo Sapiens
ARPQPLSSL

SEQ ID NO: 387793 - protein, 9 aa, Homo Sapiens
PDRRGSAWQ

SEQ ID NO: 387794 - protein, 9 aa, Homo Sapiens
PSKKKLKLA

SEQ ID NO: 387795 - protein, 9 aa, Homo Sapiens
NLQGHMLQG

SEQ ID NO: 387796 - protein, 9 aa, Homo Sapiens
LPYLEQFWR

SEQ ID NO: 387797 - protein, 9 aa, Homo Sapiens
HKLESPALK

SEQ ID NO: 387798 - protein, 9 aa, Homo Sapiens
QIPNDLKKG

SEQ ID NO: 387799 - protein, 9 aa, Homo Sapiens
GTGKLSHWV

SEQ ID NO: 387800 - protein, 9 aa, Homo Sapiens
DGIMYAKCL

SEQ ID NO: 387801 - protein, 9 aa, Homo Sapiens
QTPPLSTQP

SEQ ID NO: 387802 - protein, 9 aa, Homo Sapiens
DNGVMPTIG

SEQ ID NO: 387803 - protein, 9 aa, Homo Sapiens
TDTIAVHVV

SEQ ID NO: 387804 - protein, 9 aa, Homo Sapiens
GARRTDSAS

SEQ ID NO: 387805 - protein, 9 aa, Homo Sapiens
VDMKVHWKT

SEQ ID NO: 387806 - protein, 9 aa, Homo Sapiens
DQSIPLLWP

SEQ ID NO: 387807 - protein, 9 aa, Homo Sapiens
FATSEMKVV

SEQ ID NO: 387808 - protein, 9 aa, Homo Sapiens
QADHTTLSS

SEQ ID NO: 387809 - protein, 9 aa, Homo Sapiens
RTSRTRETL

SEQ ID NO: 387810 - protein, 9 aa, Homo Sapiens
VGDVGLGVQ

SEQ ID NO: 387811 - protein, 9 aa, Homo Sapiens
FVAFSVTGF

SEQ ID NO: 387812 - protein, 9 aa, Homo Sapiens
LWPTSAPTR

SEQ ID NO: 387813 - protein, 9 aa, Homo Sapiens
RRYFSNPIS

SEQ ID NO: 387814 - protein, 9 aa, Homo Sapiens
SSMFLRVRT

SEQ ID NO: 387815 - protein, 9 aa, Homo Sapiens
KIEHDWCST

SEQ ID NO: 387816 - protein, 9 aa, Homo Sapiens
QVVRAREAL

SEQ ID NO: 387817 - protein, 9 aa, Homo Sapiens
SSQDVASVS

SEQ ID NO: 387818 - protein, 9 aa, Homo Sapiens
ILKYLLMQH

SEQ ID NO: 387819 - protein, 9 aa, Homo Sapiens
VEEWYNDSV

SEQ ID NO: 387820 - protein, 9 aa, Homo Sapiens
CVQKVTSSL

SEQ ID NO: 387821 - protein, 9 aa, Homo Sapiens
MDSLDIITS

SEQ ID NO: 387822 - protein, 9 aa, Homo Sapiens
KCTSDTMFL

SEQ ID NO: 387823 - protein, 9 aa, Homo Sapiens
SPKGSPSSR

SEQ ID NO: 387824 - protein, 9 aa, Homo Sapiens
PPCDSGGRE

SEQ ID NO: 387825 - protein, 9 aa, Homo Sapiens
MKILYETVD

SEQ ID NO: 387826 - protein, 9 aa, Homo Sapiens
ADVLDFNFD

SEQ ID NO: 387827 - protein, 9 aa, Homo Sapiens
SLNAVGYFC

SEQ ID NO: 387828 - protein, 9 aa, Homo Sapiens
KALCEHLSY

SEQ ID NO: 387829 - protein, 9 aa, Homo Sapiens
YTLNDREIS

SEQ ID NO: 387830 - protein, 9 aa, Homo Sapiens
CHGPLFLSS

SEQ ID NO: 387831 - protein, 9 aa, Homo Sapiens
PGSTSSTII

SEQ ID NO: 387832 - protein, 9 aa, Homo Sapiens
SINSALLVS

SEQ ID NO: 387833 - protein, 9 aa, Homo Sapiens
GASTPARSP

SEQ ID NO: 387834 - protein, 9 aa, Homo Sapiens
PELPENMFQ

SEQ ID NO: 387835 - protein, 9 aa, Homo Sapiens
PPKEEQKMQ

SEQ ID NO: 387836 - protein, 9 aa, Homo Sapiens
HINCPNDCC

SEQ ID NO: 387837 - protein, 9 aa, Homo Sapiens
RRDPNNYRT

SEQ ID NO: 387838 - protein, 9 aa, Homo Sapiens
ESAKEITEG

SEQ ID NO: 387839 - protein, 9 aa, Homo Sapiens
AIFYSACMV

SEQ ID NO: 387840 - protein, 9 aa, Homo Sapiens
RLPALPTSG

SEQ ID NO: 387841 - protein, 9 aa, Homo Sapiens
ERKSPENHA

SEQ ID NO: 387842 - protein, 9 aa, Homo Sapiens
RGGHPQPRP

SEQ ID NO: 387843 - protein, 9 aa, Homo Sapiens
EEVSSGVIP

SEQ ID NO: 387844 - protein, 9 aa, Homo Sapiens
TCLLRAVPW

SEQ ID NO: 387845 - protein, 9 aa, Homo Sapiens
SVLYRKFTT

SEQ ID NO: 387846 - protein, 9 aa, Homo Sapiens
SSPRHPSRH

SEQ ID NO: 387847 - protein, 9 aa, Homo Sapiens
ERTTPPRYR

SEQ ID NO: 387848 - protein, 9 aa, Homo Sapiens
PPGSPSRAH

SEQ ID NO: 387849 - protein, 9 aa, Homo Sapiens
IGEGTRGVG

SEQ ID NO: 387850 - protein, 9 aa, Homo Sapiens
LVVVEGVHG

SEQ ID NO: 387851 - protein, 9 aa, Homo Sapiens
HTGRKKRAP

SEQ ID NO: 387852 - protein, 9 aa, Homo Sapiens
GSLPSFSEI

SEQ ID NO: 387853 - protein, 9 aa, Homo Sapiens
TNGARGSSG

SEQ ID NO: 387854 - protein, 9 aa, Homo Sapiens
PGSSLFPGG

SEQ ID NO: 387855 - protein, 9 aa, Homo Sapiens
QEDTVRRKN

SEQ ID NO: 387856 - protein, 9 aa, Homo Sapiens
QAGARTPRA

SEQ ID NO: 387857 - protein, 9 aa, Homo Sapiens
TIAKEVDKA

SEQ ID NO: 387858 - protein, 9 aa, Homo Sapiens
DFLQAKPEK

SEQ ID NO: 387859 - protein, 9 aa, Homo Sapiens
KKSTKPHSS

SEQ ID NO: 387860 - protein, 9 aa, Homo Sapiens
VPTAGVTAS

SEQ ID NO: 387861 - protein, 9 aa, Homo Sapiens
PVALKKSAD

SEQ ID NO: 387862 - protein, 9 aa, Homo Sapiens
TAKSAEMPT

SEQ ID NO: 387863 - protein, 9 aa, Homo Sapiens
AEIQHCQHL

SEQ ID NO: 387864 - protein, 9 aa, Homo Sapiens
KIRLLAWKE

SEQ ID NO: 387865 - protein, 9 aa, Homo Sapiens
EALCELTEP

SEQ ID NO: 387866 - protein, 9 aa, Homo Sapiens
AGAFLRQGQ

SEQ ID NO: 387867 - protein, 9 aa, Homo Sapiens
FIIIISLLG

SEQ ID NO: 387868 - protein, 9 aa, Homo Sapiens
DKPHKCKEC

SEQ ID NO: 387869 - protein, 9 aa, Homo Sapiens
RQLGKGTEV

SEQ ID NO: 387870 - protein, 9 aa, Homo Sapiens
VGTCMYASP

SEQ ID NO: 387871 - protein, 9 aa, Homo Sapiens
MQHLILWHP

SEQ ID NO: 387872 - protein, 9 aa, Homo Sapiens
VLTGPENVV

SEQ ID NO: 387873 - protein, 9 aa, Homo Sapiens
LNQDFLQAK

SEQ ID NO: 387874 - protein, 9 aa, Homo Sapiens
LDGSQRPPR

SEQ ID NO: 387875 - protein, 9 aa, Homo Sapiens
TEHENKSNS

SEQ ID NO: 387876 - protein, 9 aa, Homo Sapiens
CHVLVDIQY

SEQ ID NO: 387877 - protein, 9 aa, Homo Sapiens
NPDPRVAGL

SEQ ID NO: 387878 - protein, 9 aa, Homo Sapiens
VVTDLFPVL

SEQ ID NO: 387879 - protein, 9 aa, Homo Sapiens
SSWITPELR

SEQ ID NO: 387880 - protein, 9 aa, Homo Sapiens
QSAWCSSWE

SEQ ID NO: 387881 - protein, 9 aa, Homo Sapiens
QRRQFSHRD

SEQ ID NO: 387882 - protein, 9 aa, Homo Sapiens
TSRARRTNG

SEQ ID NO: 387883 - protein, 9 aa, Homo Sapiens
QFVQPAWKI

SEQ ID NO: 387884 - protein, 9 aa, Homo Sapiens
GARGTRSTR

SEQ ID NO: 387885 - protein, 9 aa, Homo Sapiens
IPSTRSANW

SEQ ID NO: 387886 - protein, 9 aa, Homo Sapiens
PPWLSPPPP

SEQ ID NO: 387887 - protein, 9 aa, Homo Sapiens
YLGSYSCKC

SEQ ID NO: 387888 - protein, 9 aa, Homo Sapiens
NEKCNKQMK

SEQ ID NO: 387889 - protein, 9 aa, Homo Sapiens
PSQKRALGL

SEQ ID NO: 387890 - protein, 9 aa, Homo Sapiens
PSPSPLWLR

SEQ ID NO: 387891 - protein, 9 aa, Homo Sapiens
ERHIVSQLL

SEQ ID NO: 387892 - protein, 9 aa, Homo Sapiens
HCRPHWTLS

SEQ ID NO: 387893 - protein, 9 aa, Homo Sapiens
DNHIVIRWL

SEQ ID NO: 387894 - protein, 9 aa, Homo Sapiens
QPSQKRALG

SEQ ID NO: 387895 - protein, 9 aa, Homo Sapiens
LPFECSQPR

SEQ ID NO: 387896 - protein, 9 aa, Homo Sapiens
MTAQARDEQ

SEQ ID NO: 387897 - protein, 9 aa, Homo Sapiens
HVLALNQRH

SEQ ID NO: 387898 - protein, 9 aa, Homo Sapiens
LSFLSSRAR

SEQ ID NO: 387899 - protein, 9 aa, Homo Sapiens
VPHRPQDRR

SEQ ID NO: 387900 - protein, 9 aa, Homo Sapiens
DVASVSSDC

SEQ ID NO: 387901 - protein, 9 aa, Homo Sapiens
CMYASPEQL

SEQ ID NO: 387902 - protein, 9 aa, Homo Sapiens
SHTNLCLKL

SEQ ID NO: 387903 - protein, 9 aa, Homo Sapiens
TTKALLTRV

SEQ ID NO: 387904 - protein, 9 aa, Homo Sapiens
HLTAALENL

SEQ ID NO: 387905 - protein, 9 aa, Homo Sapiens
EEQAGGPPR

SEQ ID NO: 387906 - protein, 9 aa, Homo Sapiens
HRELINGSL

SEQ ID NO: 387907 - protein, 9 aa, Homo Sapiens
SPICSANPT

SEQ ID NO: 387908 - protein, 9 aa, Homo Sapiens
QFIDKDKDN

SEQ ID NO: 387909 - protein, 9 aa, Homo Sapiens
RLIEIKVPS

SEQ ID NO: 387910 - protein, 9 aa, Homo Sapiens
GGSPVGDVG

SEQ ID NO: 387911 - protein, 9 aa, Homo Sapiens
EKKINNQII

SEQ ID NO: 387912 - protein, 9 aa, Homo Sapiens
PVLIIVVCY

SEQ ID NO: 387913 - protein, 9 aa, Homo Sapiens
SSSPGLVLE

SEQ ID NO: 387914 - protein, 9 aa, Homo Sapiens
RGTSGTSRT

SEQ ID NO: 387915 - protein, 9 aa, Homo Sapiens
HGAAAEGPA

SEQ ID NO: 387916 - protein, 9 aa, Homo Sapiens
HVLEEVIRE

SEQ ID NO: 387917 - protein, 9 aa, Homo Sapiens
KQAEKEVKR

SEQ ID NO: 387918 - protein, 9 aa, Homo Sapiens
THSTTTILN

SEQ ID NO: 387919 - protein, 9 aa, Homo Sapiens
DPIKEPEPM

SEQ ID NO: 387920 - protein, 9 aa, Homo Sapiens
SKKKKRKRR

SEQ ID NO: 387921 - protein, 9 aa, Homo Sapiens
IKAILGGDK

SEQ ID NO: 387922 - protein, 9 aa, Homo Sapiens
SANVYKAKC

SEQ ID NO: 387923 - protein, 9 aa, Homo Sapiens
PADSGLQRA

SEQ ID NO: 387924 - protein, 9 aa, Homo Sapiens
GSRATSLTR

SEQ ID NO: 387925 - protein, 9 aa, Homo Sapiens
TWWRTRACT

SEQ ID NO: 387926 - protein, 9 aa, Homo Sapiens
TCTDYLGSY

SEQ ID NO: 387927 - protein, 9 aa, Homo Sapiens
GRSEVSLKH

SEQ ID NO: 387928 - protein, 9 aa, Homo Sapiens
LAKCTSDTM

SEQ ID NO: 387929 - protein, 9 aa, Homo Sapiens
TRGSSQSRG

SEQ ID NO: 387930 - protein, 9 aa, Homo Sapiens
PQLEARGNS

SEQ ID NO: 387931 - protein, 9 aa, Homo Sapiens
EIQHCQHLV

SEQ ID NO: 387932 - protein, 9 aa, Homo Sapiens
VPPWLSPPP

SEQ ID NO: 387933 - protein, 9 aa, Homo Sapiens
RPSTPASPG

SEQ ID NO: 387934 - protein, 9 aa, Homo Sapiens
KNVIQSILQ

SEQ ID NO: 387935 - protein, 9 aa, Homo Sapiens
HYSSLGSLY

SEQ ID NO: 387936 - protein, 9 aa, Homo Sapiens
TLEKVDDRR

SEQ ID NO: 387937 - protein, 9 aa, Homo Sapiens
VGYVHVHVK

SEQ ID NO: 387938 - protein, 9 aa, Homo Sapiens
PRPWRIQSL

SEQ ID NO: 387939 - protein, 9 aa, Homo Sapiens
TTDAIFARR

SEQ ID NO: 387940 - protein, 9 aa, Homo Sapiens
RPPALTVAE

SEQ ID NO: 387941 - protein, 9 aa, Homo Sapiens
GPSRGAGPQ

SEQ ID NO: 387942 - protein, 9 aa, Homo Sapiens
HIRDFIQVF

SEQ ID NO: 387943 - protein, 9 aa, Homo Sapiens
AGSPRPGPR

SEQ ID NO: 387944 - protein, 9 aa, Homo Sapiens
WGQTDLTVL

SEQ ID NO: 387945 - protein, 9 aa, Homo Sapiens
AIIRDDINR

SEQ ID NO: 387946 - protein, 9 aa, Homo Sapiens
KGKMRQLGQ

SEQ ID NO: 387947 - protein, 9 aa, Homo Sapiens
EVCAGMIIL

SEQ ID NO: 387948 - protein, 9 aa, Homo Sapiens
PDCYRYAED

SEQ ID NO: 387949 - protein, 9 aa, Homo Sapiens
RGQPGPAAV

SEQ ID NO: 387950 - protein, 9 aa, Homo Sapiens
SKHLTAALE

SEQ ID NO: 387951 - protein, 9 aa, Homo Sapiens
TLSTIVAGS

SEQ ID NO: 387952 - protein, 9 aa, Homo Sapiens
NSSTSSPGL

SEQ ID NO: 387953 - protein, 9 aa, Homo Sapiens
IERSDEDSY

SEQ ID NO: 387954 - protein, 9 aa, Homo Sapiens
IMLFLILYM

SEQ ID NO: 387955 - protein, 9 aa, Homo Sapiens
GLGLQLALF

SEQ ID NO: 387956 - protein, 9 aa, Homo Sapiens
LSASVMYKI

SEQ ID NO: 387957 - protein, 9 aa, Homo Sapiens
CARETTATR

SEQ ID NO: 387958 - protein, 9 aa, Homo Sapiens
PRPAPRRKS

SEQ ID NO: 387959 - protein, 9 aa, Homo Sapiens
GNITEPTKF

SEQ ID NO: 387960 - protein, 9 aa, Homo Sapiens
AHQIYQFID

SEQ ID NO: 387961 - protein, 9 aa, Homo Sapiens
HAEHQAINT

SEQ ID NO: 387962 - protein, 9 aa, Homo Sapiens
KRGQGLFAV

SEQ ID NO: 387963 - protein, 9 aa, Homo Sapiens
NARRFISWL

SEQ ID NO: 387964 - protein, 9 aa, Homo Sapiens
QSLLSLYSV

SEQ ID NO: 387965 - protein, 9 aa, Homo Sapiens
PDFDYPPEF

SEQ ID NO: 387966 - protein, 9 aa, Homo Sapiens
KAATVFDLP

SEQ ID NO: 387967 - protein, 9 aa, Homo Sapiens
LTVAEVSCS

SEQ ID NO: 387968 - protein, 9 aa, Homo Sapiens
SNHVNEKVE

SEQ ID NO: 387969 - protein, 9 aa, Homo Sapiens
GSSNRIMYF

SEQ ID NO: 387970 - protein, 9 aa, Homo Sapiens
KKYRNVGLS

SEQ ID NO: 387971 - protein, 9 aa, Homo Sapiens
AELALVGPH

SEQ ID NO: 387972 - protein, 9 aa, Homo Sapiens
HQHVHTGEK

SEQ ID NO: 387973 - protein, 9 aa, Homo Sapiens
GLNAWNGFS

SEQ ID NO: 387974 - protein, 9 aa, Homo Sapiens
ALATWPTPP

SEQ ID NO: 387975 - protein, 9 aa, Homo Sapiens
QLAFVHQVN

SEQ ID NO: 387976 - protein, 9 aa, Homo Sapiens
MIKRAQGWK

SEQ ID NO: 387977 - protein, 9 aa, Homo Sapiens
ENINSGETK

SEQ ID NO: 387978 - protein, 9 aa, Homo Sapiens
FDLVTNGCI

SEQ ID NO: 387979 - protein, 9 aa, Homo Sapiens
SRAGGTRLT

SEQ ID NO: 387980 - protein, 9 aa, Homo Sapiens
FVLVDEEQK

SEQ ID NO: 387981 - protein, 9 aa, Homo Sapiens
TKDLIVMGP

SEQ ID NO: 387982 - protein, 9 aa, Homo Sapiens
ALFIWPQHS

SEQ ID NO: 387983 - protein, 9 aa, Homo Sapiens
PLKQRAEDP

SEQ ID NO: 387984 - protein, 9 aa, Homo Sapiens
TFRASGPLG

SEQ ID NO: 387985 - protein, 9 aa, Homo Sapiens
AHTVVFYHD

SEQ ID NO: 387986 - protein, 9 aa, Homo Sapiens
SKKGLLLAN

SEQ ID NO: 387987 - protein, 9 aa, Homo Sapiens
PLSATPVEG

SEQ ID NO: 387988 - protein, 9 aa, Homo Sapiens
LWEIQHMSQ

SEQ ID NO: 387989 - protein, 9 aa, Homo Sapiens
SYLGQEVIL

SEQ ID NO: 387990 - protein, 9 aa, Homo Sapiens
LSKRTPQQV

SEQ ID NO: 387991 - protein, 9 aa, Homo Sapiens
VVDNNHCQM

SEQ ID NO: 387992 - protein, 9 aa, Homo Sapiens
CCQCQAGWM

SEQ ID NO: 387993 - protein, 9 aa, Homo Sapiens
QTGAPRGHF

SEQ ID NO: 387994 - protein, 9 aa, Homo Sapiens
TVTAVGVEK

SEQ ID NO: 387995 - protein, 9 aa, Homo Sapiens
FQGLVCLIL

SEQ ID NO: 387996 - protein, 9 aa, Homo Sapiens
LLLDLPILD

SEQ ID NO: 387997 - protein, 9 aa, Homo Sapiens
ISTFMLGAI

SEQ ID NO: 387998 - protein, 9 aa, Homo Sapiens
VLQWGRCLL

SEQ ID NO: 387999 - protein, 9 aa, Homo Sapiens
HQIYQFIDK

SEQ ID NO: 388000 - protein, 9 aa, Homo Sapiens
DAHVVLEVV

SEQ ID NO: 388001 - protein, 9 aa, Homo Sapiens
ESPNQHQTG

SEQ ID NO: 388002 - protein, 9 aa, Homo Sapiens
QEKKCRLFY

SEQ ID NO: 388003 - protein, 9 aa, Homo Sapiens
SPNQHQTGA

SEQ ID NO: 388004 - protein, 9 aa, Homo Sapiens
GKSKKKKRK

SEQ ID NO: 388005 - protein, 9 aa, Homo Sapiens
TFVPPPPWL

SEQ ID NO: 388006 - protein, 9 aa, Homo Sapiens
TKDNILPFR

SEQ ID NO: 388007 - protein, 9 aa, Homo Sapiens
ALVLAIVQI

SEQ ID NO: 388008 - protein, 9 aa, Homo Sapiens
KPSQLECHS

SEQ ID NO: 388009 - protein, 9 aa, Homo Sapiens
LQPPSRPMT

SEQ ID NO: 388010 - protein, 9 aa, Homo Sapiens
ALGSRGASG

SEQ ID NO: 388011 - protein, 9 aa, Homo Sapiens
EILQTGLVA

SEQ ID NO: 388012 - protein, 9 aa, Homo Sapiens
PQAPLRLWS

SEQ ID NO: 388013 - protein, 9 aa, Homo Sapiens
QGTVMAGTI

SEQ ID NO: 388014 - protein, 9 aa, Homo Sapiens
APSCCAPVP

SEQ ID NO: 388015 - protein, 9 aa, Homo Sapiens
LVGPHARVD

SEQ ID NO: 388016 - protein, 9 aa, Homo Sapiens
TKGPEMGSG

SEQ ID NO: 388017 - protein, 9 aa, Homo Sapiens
SLTHLFLVF

SEQ ID NO: 388018 - protein, 9 aa, Homo Sapiens
PLGTSFTLS

SEQ ID NO: 388019 - protein, 9 aa, Homo Sapiens
RQDDNGVMP

SEQ ID NO: 388020 - protein, 9 aa, Homo Sapiens
TPWLRVMIR

SEQ ID NO: 388021 - protein, 9 aa, Homo Sapiens
WEATSSSEE

SEQ ID NO: 388022 - protein, 9 aa, Homo Sapiens
ANGARGTRS

SEQ ID NO: 388023 - protein, 9 aa, Homo Sapiens
FSHRDIPQG

SEQ ID NO: 388024 - protein, 9 aa, Homo Sapiens
QKLADAILS

SEQ ID NO: 388025 - protein, 9 aa, Homo Sapiens
GLTHGVASF

SEQ ID NO: 388026 - protein, 9 aa, Homo Sapiens
AARPQPLSS

SEQ ID NO: 388027 - protein, 9 aa, Homo Sapiens
VIVVQLAQP

SEQ ID NO: 388028 - protein, 9 aa, Homo Sapiens
DPNFVPVAF

SEQ ID NO: 388029 - protein, 9 aa, Homo Sapiens
SLNTNRARL

SEQ ID NO: 388030 - protein, 9 aa, Homo Sapiens
VIHWTKEIK

SEQ ID NO: 388031 - protein, 9 aa, Homo Sapiens
VLQDPLDRC

SEQ ID NO: 388032 - protein, 9 aa, Homo Sapiens
CHQLGSGVI

SEQ ID NO: 388033 - protein, 9 aa, Homo Sapiens
AVLVFGGPG

SEQ ID NO: 388034 - protein, 9 aa, Homo Sapiens
SILLTYNIS

SEQ ID NO: 388035 - protein, 9 aa, Homo Sapiens
EPQLEARGN

SEQ ID NO: 388036 - protein, 9 aa, Homo Sapiens
RLRTKLEKA

SEQ ID NO: 388037 - protein, 9 aa, Homo Sapiens
FHVLFFTSL

SEQ ID NO: 388038 - protein, 9 aa, Homo Sapiens
GKEEYSAMR

SEQ ID NO: 388039 - protein, 9 aa, Homo Sapiens
SVPTAGVTA

SEQ ID NO: 388040 - protein, 9 aa, Homo Sapiens
QRVLTGPEN

SEQ ID NO: 388041 - protein, 9 aa, Homo Sapiens
RAPLALPAL

SEQ ID NO: 388042 - protein, 9 aa, Homo Sapiens
FIGYMMKIL

SEQ ID NO: 388043 - protein, 9 aa, Homo Sapiens
HFYLTLESF

SEQ ID NO: 388044 - protein, 9 aa, Homo Sapiens
SSIREDIVC

SEQ ID NO: 388045 - protein, 9 aa, Homo Sapiens
EQDEEDDEE

SEQ ID NO: 388046 - protein, 9 aa, Homo Sapiens
FILFGPFLS

SEQ ID NO: 388047 - protein, 9 aa, Homo Sapiens
FLPGLLFSS

SEQ ID NO: 388048 - protein, 9 aa, Homo Sapiens
WHPILPKCL

SEQ ID NO: 388049 - protein, 9 aa, Homo Sapiens
YSLRKKMLN

SEQ ID NO: 388050 - protein, 9 aa, Homo Sapiens
APLQVTTTL

SEQ ID NO: 388051 - protein, 9 aa, Homo Sapiens
SKNSASPHP

SEQ ID NO: 388052 - protein, 9 aa, Homo Sapiens
PPPPWLLTN

SEQ ID NO: 388053 - protein, 9 aa, Homo Sapiens
LQLSWGWSQ

SEQ ID NO: 388054 - protein, 9 aa, Homo Sapiens
KEWATEKRV

SEQ ID NO: 388055 - protein, 9 aa, Homo Sapiens
PDPAGSPRP

SEQ ID NO: 388056 - protein, 9 aa, Homo Sapiens
QRPFFDLLK

SEQ ID NO: 388057 - protein, 9 aa, Homo Sapiens
IMEKKYRNV

SEQ ID NO: 388058 - protein, 9 aa, Homo Sapiens
TALFLHPEP

SEQ ID NO: 388059 - protein, 9 aa, Homo Sapiens
ASALPTAVT

SEQ ID NO: 388060 - protein, 9 aa, Homo Sapiens
GPDPTKAWP

SEQ ID NO: 388061 - protein, 9 aa, Homo Sapiens
MGCLNIPVR

SEQ ID NO: 388062 - protein, 9 aa, Homo Sapiens
RAHLAVEAC

SEQ ID NO: 388063 - protein, 9 aa, Homo Sapiens
PSRRPLGVS

SEQ ID NO: 388064 - protein, 9 aa, Homo Sapiens
ARGTSIAFS

SEQ ID NO: 388065 - protein, 9 aa, Homo Sapiens
YNLSELDIV

SEQ ID NO: 388066 - protein, 9 aa, Homo Sapiens
AVTIFMGHC

SEQ ID NO: 388067 - protein, 9 aa, Homo Sapiens
EVTQRWREL

SEQ ID NO: 388068 - protein, 9 aa, Homo Sapiens
TRFDVNTPL

SEQ ID NO: 388069 - protein, 9 aa, Homo Sapiens
IPRLPTGLY

SEQ ID NO: 388070 - protein, 9 aa, Homo Sapiens
TLRQKSEAD

SEQ ID NO: 388071 - protein, 9 aa, Homo Sapiens
FLLIQSVMA

SEQ ID NO: 388072 - protein, 9 aa, Homo Sapiens
SSGAGLTTV

SEQ ID NO: 388073 - protein, 9 aa, Homo Sapiens
ERQIYRRYC

SEQ ID NO: 388074 - protein, 9 aa, Homo Sapiens
LKLTRRQSE

SEQ ID NO: 388075 - protein, 9 aa, Homo Sapiens
TRQRRMDAR

SEQ ID NO: 388076 - protein, 9 aa, Homo Sapiens
HHEGSACVH

SEQ ID NO: 388077 - protein, 9 aa, Homo Sapiens
TRSANWNAS

SEQ ID NO: 388078 - protein, 9 aa, Homo Sapiens
HTDDFMGCL

SEQ ID NO: 388079 - protein, 9 aa, Homo Sapiens
DAWLLGGLP

SEQ ID NO: 388080 - protein, 9 aa, Homo Sapiens
CAAFFRRKR

SEQ ID NO: 388081 - protein, 9 aa, Homo Sapiens
QYLSLSSPP

SEQ ID NO: 388082 - protein, 9 aa, Homo Sapiens
NRSHQPKSP

SEQ ID NO: 388083 - protein, 9 aa, Homo Sapiens
LAIGEHLLV

SEQ ID NO: 388084 - protein, 9 aa, Homo Sapiens
KHTIIHTED

SEQ ID NO: 388085 - protein, 9 aa, Homo Sapiens
GQTDLTVLG

SEQ ID NO: 388086 - protein, 9 aa, Homo Sapiens
LQPAEPELP

SEQ ID NO: 388087 - protein, 9 aa, Homo Sapiens
PAPARPAGG

SEQ ID NO: 388088 - protein, 9 aa, Homo Sapiens
PVPLLDPVH

SEQ ID NO: 388089 - protein, 9 aa, Homo Sapiens
MIFAPEESE

SEQ ID NO: 388090 - protein, 9 aa, Homo Sapiens
ECRKKAKLR

SEQ ID NO: 388091 - protein, 9 aa, Homo Sapiens
SLRQYMPPE

SEQ ID NO: 388092 - protein, 9 aa, Homo Sapiens
VVHELGVAV

SEQ ID NO: 388093 - protein, 9 aa, Homo Sapiens
TNDGPKPGL

SEQ ID NO: 388094 - protein, 9 aa, Homo Sapiens
GEDVLVHQL

SEQ ID NO: 388095 - protein, 9 aa, Homo Sapiens
AKRLSGFTG

SEQ ID NO: 388096 - protein, 9 aa, Homo Sapiens
FLMGGMSRT

SEQ ID NO: 388097 - protein, 9 aa, Homo Sapiens
FTRSLPFEC

SEQ ID NO: 388098 - protein, 9 aa, Homo Sapiens
PVRLIIQVW

SEQ ID NO: 388099 - protein, 9 aa, Homo Sapiens
VVGGGAGVV

SEQ ID NO: 388100 - protein, 9 aa, Homo Sapiens
LAKHHLLYP

SEQ ID NO: 388101 - protein, 9 aa, Homo Sapiens
ILEALVAPD

SEQ ID NO: 388102 - protein, 9 aa, Homo Sapiens
LTGPENVVC

SEQ ID NO: 388103 - protein, 9 aa, Homo Sapiens
AAVTAAGVV

SEQ ID NO: 388104 - protein, 9 aa, Homo Sapiens
IQMKTHSRN

SEQ ID NO: 388105 - protein, 9 aa, Homo Sapiens
AFFASRTRR

SEQ ID NO: 388106 - protein, 9 aa, Homo Sapiens
QSIPLLWPQ

SEQ ID NO: 388107 - protein, 9 aa, Homo Sapiens
VSPASPPTQ

SEQ ID NO: 388108 - protein, 9 aa, Homo Sapiens
NTRSTIGTF

SEQ ID NO: 388109 - protein, 9 aa, Homo Sapiens
CLSCRAGWS

SEQ ID NO: 388110 - protein, 9 aa, Homo Sapiens
KDLASQLIG

SEQ ID NO: 388111 - protein, 9 aa, Homo Sapiens
GRGPQTNPG

SEQ ID NO: 388112 - protein, 9 aa, Homo Sapiens
ASFNAPPAG

SEQ ID NO: 388113 - protein, 9 aa, Homo Sapiens
VIEPVGNCE

SEQ ID NO: 388114 - protein, 9 aa, Homo Sapiens
PAEVHKARS

SEQ ID NO: 388115 - protein, 9 aa, Homo Sapiens
GGTRGASFA

SEQ ID NO: 388116 - protein, 9 aa, Homo Sapiens
FASRTRRAR

SEQ ID NO: 388117 - protein, 9 aa, Homo Sapiens
KGSLGKDAT

SEQ ID NO: 388118 - protein, 9 aa, Homo Sapiens
CGPTSGSTP

SEQ ID NO: 388119 - protein, 9 aa, Homo Sapiens
LVPESGSRT

SEQ ID NO: 388120 - protein, 9 aa, Homo Sapiens
STIVAGSTV

SEQ ID NO: 388121 - protein, 9 aa, Homo Sapiens
TECLAQLAI

SEQ ID NO: 388122 - protein, 9 aa, Homo Sapiens
WMVPWGMEA

SEQ ID NO: 388123 - protein, 9 aa, Homo Sapiens
LEGDWKTIL

SEQ ID NO: 388124 - protein, 9 aa, Homo Sapiens
VLPHVDFQL

SEQ ID NO: 388125 - protein, 9 aa, Homo Sapiens
SFMKLYHSL

SEQ ID NO: 388126 - protein, 9 aa, Homo Sapiens
HFEVPVLRG

SEQ ID NO: 388127 - protein, 9 aa, Homo Sapiens
ARCTRAPPR

SEQ ID NO: 388128 - protein, 9 aa, Homo Sapiens
NSVKKTAPP

SEQ ID NO: 388129 - protein, 9 aa, Homo Sapiens
MAGTILSGS

SEQ ID NO: 388130 - protein, 9 aa, Homo Sapiens
GQRRCCSPR

SEQ ID NO: 388131 - protein, 9 aa, Homo Sapiens
GPSPARSAA

SEQ ID NO: 388132 - protein, 9 aa, Homo Sapiens
FNVGWNIFD

SEQ ID NO: 388133 - protein, 9 aa, Homo Sapiens
QPWAHGMPD

SEQ ID NO: 388134 - protein, 9 aa, Homo Sapiens
RKHITKRLC

SEQ ID NO: 388135 - protein, 9 aa, Homo Sapiens
TSLASGTSR

SEQ ID NO: 388136 - protein, 9 aa, Homo Sapiens
CTFFCRDRV

SEQ ID NO: 388137 - protein, 9 aa, Homo Sapiens
STNLIVYIT

SEQ ID NO: 388138 - protein, 9 aa, Homo Sapiens
SDSVAKAEK

SEQ ID NO: 388139 - protein, 9 aa, Homo Sapiens
IHCLDILLP

SEQ ID NO: 388140 - protein, 9 aa, Homo Sapiens
ARVFAQRFR

SEQ ID NO: 388141 - protein, 9 aa, Homo Sapiens
ENNQTSWVL

SEQ ID NO: 388142 - protein, 9 aa, Homo Sapiens
RDTFSDSED

SEQ ID NO: 388143 - protein, 9 aa, Homo Sapiens
CSHCPRPHD

SEQ ID NO: 388144 - protein, 9 aa, Homo Sapiens
EETVTVTAV

SEQ ID NO: 388145 - protein, 9 aa, Homo Sapiens
QDVESLADL

SEQ ID NO: 388146 - protein, 9 aa, Homo Sapiens
LLLLLDLPI

SEQ ID NO: 388147 - protein, 9 aa, Homo Sapiens
EFTPKSDVK

SEQ ID NO: 388148 - protein, 9 aa, Homo Sapiens
IKLTHLPQY

SEQ ID NO: 388149 - protein, 9 aa, Homo Sapiens
HVINQAMAE

SEQ ID NO: 388150 - protein, 9 aa, Homo Sapiens
LCLKLWSLL

SEQ ID NO: 388151 - protein, 9 aa, Homo Sapiens
SSRGTSITL

SEQ ID NO: 388152 - protein, 9 aa, Homo Sapiens
VLISIIDIL

SEQ ID NO: 388153 - protein, 9 aa, Homo Sapiens
GWMDWATSK

SEQ ID NO: 388154 - protein, 9 aa, Homo Sapiens
PESSSCNYI

SEQ ID NO: 388155 - protein, 9 aa, Homo Sapiens
MMKILYETV

SEQ ID NO: 388156 - protein, 9 aa, Homo Sapiens
ISTIGLGLA

SEQ ID NO: 388157 - protein, 9 aa, Homo Sapiens
NVMVMILVV

SEQ ID NO: 388158 - protein, 9 aa, Homo Sapiens
LRLELDAMK

SEQ ID NO: 388159 - protein, 9 aa, Homo Sapiens
ASVSSDCFL

SEQ ID NO: 388160 - protein, 9 aa, Homo Sapiens
HSAVRKNST

SEQ ID NO: 388161 - protein, 9 aa, Homo Sapiens
TLSTNSTRE

SEQ ID NO: 388162 - protein, 9 aa, Homo Sapiens
LLVRPSCSM

SEQ ID NO: 388163 - protein, 9 aa, Homo Sapiens
APLALPALL

SEQ ID NO: 388164 - protein, 9 aa, Homo Sapiens
PAGLSHPGL

SEQ ID NO: 388165 - protein, 9 aa, Homo Sapiens
LQELNEKCN

SEQ ID NO: 388166 - protein, 9 aa, Homo Sapiens
EGFPTMITF

SEQ ID NO: 388167 - protein, 9 aa, Homo Sapiens
PLRSPICSA

SEQ ID NO: 388168 - protein, 9 aa, Homo Sapiens
NITVQKNKN

SEQ ID NO: 388169 - protein, 9 aa, Homo Sapiens
LRVSPVRNS

SEQ ID NO: 388170 - protein, 9 aa, Homo Sapiens
GEKTEIQLT

SEQ ID NO: 388171 - protein, 9 aa, Homo Sapiens
LARFVFTYE

SEQ ID NO: 388172 - protein, 9 aa, Homo Sapiens
WLEVSFCQP

SEQ ID NO: 388173 - protein, 9 aa, Homo Sapiens
GEKEKKEEG

SEQ ID NO: 388174 - protein, 9 aa, Homo Sapiens
KLVYANECT

SEQ ID NO: 388175 - protein, 9 aa, Homo Sapiens
SYSENKAFI

SEQ ID NO: 388176 - protein, 9 aa, Homo Sapiens
TDDFMGCLN

SEQ ID NO: 388177 - protein, 9 aa, Homo Sapiens
LQTGLVAYV

SEQ ID NO: 388178 - protein, 9 aa, Homo Sapiens
LALVGPHAR

SEQ ID NO: 388179 - protein, 9 aa, Homo Sapiens
LPIGTHAAL

SEQ ID NO: 388180 - protein, 9 aa, Homo Sapiens
KSGSWHPIL

SEQ ID NO: 388181 - protein, 9 aa, Homo Sapiens
DNLVVVEGV

SEQ ID NO: 388182 - protein, 9 aa, Homo Sapiens
LVDMKVHWK

SEQ ID NO: 388183 - protein, 9 aa, Homo Sapiens
IRILPLEQL

SEQ ID NO: 388184 - protein, 9 aa, Homo Sapiens
VIDFLVLCQ

SEQ ID NO: 388185 - protein, 9 aa, Homo Sapiens
RARGKSGLL

SEQ ID NO: 388186 - protein, 9 aa, Homo Sapiens
HAMPSGVFS

SEQ ID NO: 388187 - protein, 9 aa, Homo Sapiens
SGSGSGLNA

SEQ ID NO: 388188 - protein, 9 aa, Homo Sapiens
RLSISTRVS

SEQ ID NO: 388189 - protein, 9 aa, Homo Sapiens
PIPQSEASM

SEQ ID NO: 388190 - protein, 9 aa, Homo Sapiens
MSFFIGYMM

SEQ ID NO: 388191 - protein, 9 aa, Homo Sapiens
IYRGTLSGD

SEQ ID NO: 388192 - protein, 9 aa, Homo Sapiens
LSTSSFCCC

SEQ ID NO: 388193 - protein, 9 aa, Homo Sapiens
GPWHLCMGL

SEQ ID NO: 388194 - protein, 9 aa, Homo Sapiens
ASFILSYRW

SEQ ID NO: 388195 - protein, 9 aa, Homo Sapiens
NIPVSVCEE

SEQ ID NO: 388196 - protein, 9 aa, Homo Sapiens
FFNFFQFCK

SEQ ID NO: 388197 - protein, 9 aa, Homo Sapiens
SSQSRGAHG

SEQ ID NO: 388198 - protein, 9 aa, Homo Sapiens
GGPPRSRLA

SEQ ID NO: 388199 - protein, 9 aa, Homo Sapiens
NVIQSILQA

SEQ ID NO: 388200 - protein, 9 aa, Homo Sapiens
QAEGSLKKT

SEQ ID NO: 388201 - protein, 9 aa, Homo Sapiens
VSGGTTSSS

SEQ ID NO: 388202 - protein, 9 aa, Homo Sapiens
HSSHSDIEE

SEQ ID NO: 388203 - protein, 9 aa, Homo Sapiens
DTLGDTLTI

SEQ ID NO: 388204 - protein, 9 aa, Homo Sapiens
KTSEGTPGV

SEQ ID NO: 388205 - protein, 9 aa, Homo Sapiens
RGTLFARFT

SEQ ID NO: 388206 - protein, 9 aa, Homo Sapiens
VIRDEGHAI

SEQ ID NO: 388207 - protein, 9 aa, Homo Sapiens
RTRACTPAS

SEQ ID NO: 388208 - protein, 9 aa, Homo Sapiens
QEGRSREGQ

SEQ ID NO: 388209 - protein, 9 aa, Homo Sapiens
FTALVQLPA

SEQ ID NO: 388210 - protein, 9 aa, Homo Sapiens
ENRTNVLPF

SEQ ID NO: 388211 - protein, 9 aa, Homo Sapiens
TLNMIQVLM

SEQ ID NO: 388212 - protein, 9 aa, Homo Sapiens
QCNHAAGAK

SEQ ID NO: 388213 - protein, 9 aa, Homo Sapiens
KKKKIGLFT

SEQ ID NO: 388214 - protein, 9 aa, Homo Sapiens
TFYLQQHNN

SEQ ID NO: 388215 - protein, 9 aa, Homo Sapiens
EGSVVGVTQ

SEQ ID NO: 388216 - protein, 9 aa, Homo Sapiens
LPALPTSGL

SEQ ID NO: 388217 - protein, 9 aa, Homo Sapiens
SSPRLRFCA

SEQ ID NO: 388218 - protein, 9 aa, Homo Sapiens
LENNQTSWV

SEQ ID NO: 388219 - protein, 9 aa, Homo Sapiens
SFGGPDGFG

SEQ ID NO: 388220 - protein, 9 aa, Homo Sapiens
KLILVMLEI

SEQ ID NO: 388221 - protein, 9 aa, Homo Sapiens
FDAFSSDPS

SEQ ID NO: 388222 - protein, 9 aa, Homo Sapiens
SLTTITTLA

SEQ ID NO: 388223 - protein, 9 aa, Homo Sapiens
MFLEKTSKI

SEQ ID NO: 388224 - protein, 9 aa, Homo Sapiens
NPLFFSFLF

SEQ ID NO: 388225 - protein, 9 aa, Homo Sapiens
TDVLHDVML

SEQ ID NO: 388226 - protein, 9 aa, Homo Sapiens
SREKNTNQR

SEQ ID NO: 388227 - protein, 9 aa, Homo Sapiens
KLVDMKVHW

SEQ ID NO: 388228 - protein, 9 aa, Homo Sapiens
EFGAGTGKL

SEQ ID NO: 388229 - protein, 9 aa, Homo Sapiens
PWLSPPPPV

SEQ ID NO: 388230 - protein, 9 aa, Homo Sapiens
MLSILKYLL

SEQ ID NO: 388231 - protein, 9 aa, Homo Sapiens
KENENRKLQ

SEQ ID NO: 388232 - protein, 9 aa, Homo Sapiens
VDRGKLDVG

SEQ ID NO: 388233 - protein, 9 aa, Homo Sapiens
ILTLAKMIA

SEQ ID NO: 388234 - protein, 9 aa, Homo Sapiens
EEGKEQEEE

SEQ ID NO: 388235 - protein, 9 aa, Homo Sapiens
AHRQRVCGL

SEQ ID NO: 388236 - protein, 9 aa, Homo Sapiens
WEIQHMSQA

SEQ ID NO: 388237 - protein, 9 aa, Homo Sapiens
SPARSAAAA

SEQ ID NO: 388238 - protein, 9 aa, Homo Sapiens
EPSSKTKDA

SEQ ID NO: 388239 - protein, 9 aa, Homo Sapiens
HVQRRGTPS

SEQ ID NO: 388240 - protein, 9 aa, Homo Sapiens
EHVLEEVIR

SEQ ID NO: 388241 - protein, 9 aa, Homo Sapiens
PTGFLQVPQ

SEQ ID NO: 388242 - protein, 9 aa, Homo Sapiens
TFIERSDED

SEQ ID NO: 388243 - protein, 9 aa, Homo Sapiens
ASGPSPARS

SEQ ID NO: 388244 - protein, 9 aa, Homo Sapiens
QFGENRTNV

SEQ ID NO: 388245 - protein, 9 aa, Homo Sapiens
LLFEGIKRK

SEQ ID NO: 388246 - protein, 9 aa, Homo Sapiens
VAFSVTGFD

SEQ ID NO: 388247 - protein, 9 aa, Homo Sapiens
AQVGPLPCV

SEQ ID NO: 388248 - protein, 9 aa, Homo Sapiens
LSQKYKRIN

SEQ ID NO: 388249 - protein, 9 aa, Homo Sapiens
LCQFYDEAR

SEQ ID NO: 388250 - protein, 9 aa, Homo Sapiens
FATRCCLCN

SEQ ID NO: 388251 - protein, 9 aa, Homo Sapiens
LKAILSEAS

SEQ ID NO: 388252 - protein, 9 aa, Homo Sapiens
MCCVIIPPG

SEQ ID NO: 388253 - protein, 9 aa, Homo Sapiens
DLFPVLSTS

SEQ ID NO: 388254 - protein, 9 aa, Homo Sapiens
LPGTPKLMG

SEQ ID NO: 388255 - protein, 9 aa, Homo Sapiens
WAPRMGCMK

SEQ ID NO: 388256 - protein, 9 aa, Homo Sapiens
GIKRKKQQK

SEQ ID NO: 388257 - protein, 9 aa, Homo Sapiens
TSLTTGTRW

SEQ ID NO: 388258 - protein, 9 aa, Homo Sapiens
PPGPEGGLP

SEQ ID NO: 388259 - protein, 9 aa, Homo Sapiens
GRLQGGGVA

SEQ ID NO: 388260 - protein, 9 aa, Homo Sapiens
YVFDVESLE

SEQ ID NO: 388261 - protein, 9 aa, Homo Sapiens
SHGFNTEVT

SEQ ID NO: 388262 - protein, 9 aa, Homo Sapiens
RWSPLTSRS

SEQ ID NO: 388263 - protein, 9 aa, Homo Sapiens
AIFARRAIS

SEQ ID NO: 388264 - protein, 9 aa, Homo Sapiens
AAFYDCLLA

SEQ ID NO: 388265 - protein, 9 aa, Homo Sapiens
PQSSYAAGI

SEQ ID NO: 388266 - protein, 9 aa, Homo Sapiens
KHEKDLDFL

SEQ ID NO: 388267 - protein, 9 aa, Homo Sapiens
LSMSFFIGY

SEQ ID NO: 388268 - protein, 9 aa, Homo Sapiens
YGKKLVKIS

SEQ ID NO: 388269 - protein, 9 aa, Homo Sapiens
AALALDVAV

SEQ ID NO: 388270 - protein, 9 aa, Homo Sapiens
RATSGTAPS

SEQ ID NO: 388271 - protein, 9 aa, Homo Sapiens
QLIRYVHDR

SEQ ID NO: 388272 - protein, 9 aa, Homo Sapiens
SPCPEETAM

SEQ ID NO: 388273 - protein, 9 aa, Homo Sapiens
HFSDLDQSF

SEQ ID NO: 388274 - protein, 9 aa, Homo Sapiens
QVRPPPGPP

SEQ ID NO: 388275 - protein, 9 aa, Homo Sapiens
MIYTLHNQE

SEQ ID NO: 388276 - protein, 9 aa, Homo Sapiens
GKQGLGPPA

SEQ ID NO: 388277 - protein, 9 aa, Homo Sapiens
NSTYSHRAS

SEQ ID NO: 388278 - protein, 9 aa, Homo Sapiens
PTPPEMPGS

SEQ ID NO: 388279 - protein, 9 aa, Homo Sapiens
AAGVVKSGQ

SEQ ID NO: 388280 - protein, 9 aa, Homo Sapiens
KAVSNIDTL

SEQ ID NO: 388281 - protein, 9 aa, Homo Sapiens
SEKRSRSPR

SEQ ID NO: 388282 - protein, 9 aa, Homo Sapiens
NLVRLMGPW

SEQ ID NO: 388283 - protein, 9 aa, Homo Sapiens
RMELKPLCV

SEQ ID NO: 388284 - protein, 9 aa, Homo Sapiens
DYLGSYSCK

SEQ ID NO: 388285 - protein, 9 aa, Homo Sapiens
ELMDADVLD

SEQ ID NO: 388286 - protein, 9 aa, Homo Sapiens
MGSGTAEVE

SEQ ID NO: 388287 - protein, 9 aa, Homo Sapiens
KEVDPAIKS

SEQ ID NO: 388288 - protein, 9 aa, Homo Sapiens
LGEDEYYQA

SEQ ID NO: 388289 - protein, 9 aa, Homo Sapiens
CTAGGNVNV

SEQ ID NO: 388290 - protein, 9 aa, Homo Sapiens
TLDEALQRP

SEQ ID NO: 388291 - protein, 9 aa, Homo Sapiens
SCAAFFRRK

SEQ ID NO: 388292 - protein, 9 aa, Homo Sapiens
LGEGSVSTV

SEQ ID NO: 388293 - protein, 9 aa, Homo Sapiens
ATNPTWRRT

SEQ ID NO: 388294 - protein, 9 aa, Homo Sapiens
PSRLVRRCS

SEQ ID NO: 388295 - protein, 9 aa, Homo Sapiens
LAHQIYQFI

SEQ ID NO: 388296 - protein, 9 aa, Homo Sapiens
QAQQHVISD

SEQ ID NO: 388297 - protein, 9 aa, Homo Sapiens
GLQLALFYQ

SEQ ID NO: 388298 - protein, 9 aa, Homo Sapiens
LRSFFRRCR

SEQ ID NO: 388299 - protein, 9 aa, Homo Sapiens
PRKCSTSSL

SEQ ID NO: 388300 - protein, 9 aa, Homo Sapiens
RCPPRWSPC

SEQ ID NO: 388301 - protein, 9 aa, Homo Sapiens
ALDGGPWAL

SEQ ID NO: 388302 - protein, 9 aa, Homo Sapiens
GPRASAPAG

SEQ ID NO: 388303 - protein, 9 aa, Homo Sapiens
KPFPENRTH

SEQ ID NO: 388304 - protein, 9 aa, Homo Sapiens
CDKTLSVSI

SEQ ID NO: 388305 - protein, 9 aa, Homo Sapiens
HVLLARSTS

SEQ ID NO: 388306 - protein, 9 aa, Homo Sapiens
VALKKSADI

SEQ ID NO: 388307 - protein, 9 aa, Homo Sapiens
IETEFLKNL

SEQ ID NO: 388308 - protein, 9 aa, Homo Sapiens
ILESHGFNT

SEQ ID NO: 388309 - protein, 9 aa, Homo Sapiens
EEEARLHDD

SEQ ID NO: 388310 - protein, 9 aa, Homo Sapiens
RTPQQVVAV

SEQ ID NO: 388311 - protein, 9 aa, Homo Sapiens
SLSFLSSRA

SEQ ID NO: 388312 - protein, 9 aa, Homo Sapiens
ATRCCLCNP

SEQ ID NO: 388313 - protein, 9 aa, Homo Sapiens
EFILLVVMS

SEQ ID NO: 388314 - protein, 9 aa, Homo Sapiens
APLGRSAEV

SEQ ID NO: 388315 - protein, 9 aa, Homo Sapiens
HVIWENCHK

SEQ ID NO: 388316 - protein, 9 aa, Homo Sapiens
MHTLLHLEC

SEQ ID NO: 388317 - protein, 9 aa, Homo Sapiens
GRVHILDSQ

SEQ ID NO: 388318 - protein, 9 aa, Homo Sapiens
RETSSTRGT

SEQ ID NO: 388319 - protein, 9 aa, Homo Sapiens
VRGEWRQGG

SEQ ID NO: 388320 - protein, 9 aa, Homo Sapiens
DTAGKEEYS

SEQ ID NO: 388321 - protein, 9 aa, Homo Sapiens
SRARGTSGT

SEQ ID NO: 388322 - protein, 9 aa, Homo Sapiens
FDENDAEDF

SEQ ID NO: 388323 - protein, 9 aa, Homo Sapiens
FLDHSDHPM

SEQ ID NO: 388324 - protein, 9 aa, Homo Sapiens
SLLLYTLND

SEQ ID NO: 388325 - protein, 9 aa, Homo Sapiens
EAREATVTL

SEQ ID NO: 388326 - protein, 9 aa, Homo Sapiens
EWRVSLYNN

SEQ ID NO: 388327 - protein, 9 aa, Homo Sapiens
SGSGLNAWN

SEQ ID NO: 388328 - protein, 9 aa, Homo Sapiens
GSGGAPSSI

SEQ ID NO: 388329 - protein, 9 aa, Homo Sapiens
SDPSSSVFG

SEQ ID NO: 388330 - protein, 9 aa, Homo Sapiens
LGPEGQFVS

SEQ ID NO: 388331 - protein, 9 aa, Homo Sapiens
QRAEDPPHQ

SEQ ID NO: 388332 - protein, 9 aa, Homo Sapiens
CKNNCRKNE

SEQ ID NO: 388333 - protein, 9 aa, Homo Sapiens
CTELIHEIP

SEQ ID NO: 388334 - protein, 9 aa, Homo Sapiens
TKSKLNTSK

SEQ ID NO: 388335 - protein, 9 aa, Homo Sapiens
STPPRAPAP

SEQ ID NO: 388336 - protein, 9 aa, Homo Sapiens
RSPTWCRTG

SEQ ID NO: 388337 - protein, 9 aa, Homo Sapiens
LDEQAQQHV

SEQ ID NO: 388338 - protein, 9 aa, Homo Sapiens
SALAGKASH

SEQ ID NO: 388339 - protein, 9 aa, Homo Sapiens
VKKVEQDTG

SEQ ID NO: 388340 - protein, 9 aa, Homo Sapiens
HLTGIGSDT

SEQ ID NO: 388341 - protein, 9 aa, Homo Sapiens
HEIPLPEHR

SEQ ID NO: 388342 - protein, 9 aa, Homo Sapiens
HEFSCVFAD

SEQ ID NO: 388343 - protein, 9 aa, Homo Sapiens
RTDSARGSG

SEQ ID NO: 388344 - protein, 9 aa, Homo Sapiens
EHMGSCLLD

SEQ ID NO: 388345 - protein, 9 aa, Homo Sapiens
PFECSQPRI

SEQ ID NO: 388346 - protein, 9 aa, Homo Sapiens
TSRFTRGSS

SEQ ID NO: 388347 - protein, 9 aa, Homo Sapiens
TSATWGLTP

SEQ ID NO: 388348 - protein, 9 aa, Homo Sapiens
SISRGARRT

SEQ ID NO: 388349 - protein, 9 aa, Homo Sapiens
SQDGPPGPE

SEQ ID NO: 388350 - protein, 9 aa, Homo Sapiens
VRRMLEEVI

SEQ ID NO: 388351 - protein, 9 aa, Homo Sapiens
EWAEGRGPQ

SEQ ID NO: 388352 - protein, 9 aa, Homo Sapiens
KSYKRGGLF

SEQ ID NO: 388353 - protein, 9 aa, Homo Sapiens
QPHKIHYAA

SEQ ID NO: 388354 - protein, 9 aa, Homo Sapiens
GTSGTSRTR

SEQ ID NO: 388355 - protein, 9 aa, Homo Sapiens
TLTVLSNHV

SEQ ID NO: 388356 - protein, 9 aa, Homo Sapiens
EKELCTWEE

SEQ ID NO: 388357 - protein, 9 aa, Homo Sapiens
GHQEAAHRG

SEQ ID NO: 388358 - protein, 9 aa, Homo Sapiens
SEMKTLKKI

SEQ ID NO: 388359 - protein, 9 aa, Homo Sapiens
PCLYGAYLQ

SEQ ID NO: 388360 - protein, 9 aa, Homo Sapiens
IGEKTEIQL

SEQ ID NO: 388361 - protein, 9 aa, Homo Sapiens
LADKPNDQS

SEQ ID NO: 388362 - protein, 9 aa, Homo Sapiens
HHFSVFVLS

SEQ ID NO: 388363 - protein, 9 aa, Homo Sapiens
KIIRQYVSS

SEQ ID NO: 388364 - protein, 9 aa, Homo Sapiens
VCGGDTECS

SEQ ID NO: 388365 - protein, 9 aa, Homo Sapiens
EESGGVVDN

SEQ ID NO: 388366 - protein, 9 aa, Homo Sapiens
PAGHQEAAH

SEQ ID NO: 388367 - protein, 9 aa, Homo Sapiens
PWAHGMPDL

SEQ ID NO: 388368 - protein, 9 aa, Homo Sapiens
HAAALALDV

SEQ ID NO: 388369 - protein, 9 aa, Homo Sapiens
IIAKKCIYL

SEQ ID NO: 388370 - protein, 9 aa, Homo Sapiens
FWVVPFISD

SEQ ID NO: 388371 - protein, 9 aa, Homo Sapiens
VVRAREALV

SEQ ID NO: 388372 - protein, 9 aa, Homo Sapiens
QAREHGAER

SEQ ID NO: 388373 - protein, 9 aa, Homo Sapiens
IVIRWLWAA

SEQ ID NO: 388374 - protein, 9 aa, Homo Sapiens
TCESDVNPP

SEQ ID NO: 388375 - protein, 9 aa, Homo Sapiens
WEKECEHRV

SEQ ID NO: 388376 - protein, 9 aa, Homo Sapiens
CRPRLSSTN

SEQ ID NO: 388377 - protein, 9 aa, Homo Sapiens
CRFDSKHLT

SEQ ID NO: 388378 - protein, 9 aa, Homo Sapiens
INNQIIVNT

SEQ ID NO: 388379 - protein, 9 aa, Homo Sapiens
AGEQDEEDD

SEQ ID NO: 388380 - protein, 9 aa, Homo Sapiens
WSPPWRRKR

SEQ ID NO: 388381 - protein, 9 aa, Homo Sapiens
GLLFSSFFF

SEQ ID NO: 388382 - protein, 9 aa, Homo Sapiens
LEAREATVT

SEQ ID NO: 388383 - protein, 9 aa, Homo Sapiens
PSGNPWSDP

SEQ ID NO: 388384 - protein, 9 aa, Homo Sapiens
VPESGSRTK

SEQ ID NO: 388385 - protein, 9 aa, Homo Sapiens
QIKGLEWRV

SEQ ID NO: 388386 - protein, 9 aa, Homo Sapiens
HKARSGKGE

SEQ ID NO: 388387 - protein, 9 aa, Homo Sapiens
SDKTPMTNS

SEQ ID NO: 388388 - protein, 9 aa, Homo Sapiens
HLMSFLAMM

SEQ ID NO: 388389 - protein, 9 aa, Homo Sapiens
VGNPRKCST

SEQ ID NO: 388390 - protein, 9 aa, Homo Sapiens
LIIKYISCH

SEQ ID NO: 388391 - protein, 9 aa, Homo Sapiens
PTALPPSKR

SEQ ID NO: 388392 - protein, 9 aa, Homo Sapiens
AGRVALQLK

SEQ ID NO: 388393 - protein, 9 aa, Homo Sapiens
LEWTPPCDS

SEQ ID NO: 388394 - protein, 9 aa, Homo Sapiens
SRTRRARGS

SEQ ID NO: 388395 - protein, 9 aa, Homo Sapiens
KGDTSKEDI

SEQ ID NO: 388396 - protein, 9 aa, Homo Sapiens
MGHCYSCMC

SEQ ID NO: 388397 - protein, 9 aa, Homo Sapiens
EQVEELFSR

SEQ ID NO: 388398 - protein, 9 aa, Homo Sapiens
MCVFKLGLF

SEQ ID NO: 388399 - protein, 9 aa, Homo Sapiens
WCRTGASTR

SEQ ID NO: 388400 - protein, 9 aa, Homo Sapiens
DGSCKNSPG

SEQ ID NO: 388401 - protein, 9 aa, Homo Sapiens
SLFGYPIQQ

SEQ ID NO: 388402 - protein, 9 aa, Homo Sapiens
IKIRLLAWK

SEQ ID NO: 388403 - protein, 9 aa, Homo Sapiens
SDIFWVVPF

SEQ ID NO: 388404 - protein, 9 aa, Homo Sapiens
KKAKLRIFF

SEQ ID NO: 388405 - protein, 9 aa, Homo Sapiens
SIDVKFNGT

SEQ ID NO: 388406 - protein, 9 aa, Homo Sapiens
GQPGVRALG

SEQ ID NO: 388407 - protein, 9 aa, Homo Sapiens
TGGTSRTSL

SEQ ID NO: 388408 - protein, 9 aa, Homo Sapiens
VIIPPGSSH

SEQ ID NO: 388409 - protein, 9 aa, Homo Sapiens
NCRKNEELI

SEQ ID NO: 388410 - protein, 9 aa, Homo Sapiens
PPAGHQEAA

SEQ ID NO: 388411 - protein, 9 aa, Homo Sapiens
IAGSWTSCG

SEQ ID NO: 388412 - protein, 9 aa, Homo Sapiens
QEAAHRGLA

SEQ ID NO: 388413 - protein, 9 aa, Homo Sapiens
IEKARVHRQ

SEQ ID NO: 388414 - protein, 9 aa, Homo Sapiens
IIIISLLGM

SEQ ID NO: 388415 - protein, 9 aa, Homo Sapiens
GFSKVMGSA

SEQ ID NO: 388416 - protein, 9 aa, Homo Sapiens
PLQPTKEKK

SEQ ID NO: 388417 - protein, 9 aa, Homo Sapiens
VALKLVKRM

SEQ ID NO: 388418 - protein, 9 aa, Homo Sapiens
ADPADSGLQ

SEQ ID NO: 388419 - protein, 9 aa, Homo Sapiens
STPGSGPSP

SEQ ID NO: 388420 - protein, 9 aa, Homo Sapiens
SHQDIIKVK

SEQ ID NO: 388421 - protein, 9 aa, Homo Sapiens
GTRWAWGSG

SEQ ID NO: 388422 - protein, 9 aa, Homo Sapiens
LSWGWSQQK

SEQ ID NO: 388423 - protein, 9 aa, Homo Sapiens
NSLLNQDFL

SEQ ID NO: 388424 - protein, 9 aa, Homo Sapiens
PPTALPPSK

SEQ ID NO: 388425 - protein, 9 aa, Homo Sapiens
CGGDTECSG

SEQ ID NO: 388426 - protein, 9 aa, Homo Sapiens
MATMINDSD

SEQ ID NO: 388427 - protein, 9 aa, Homo Sapiens
KCLESAGVE

SEQ ID NO: 388428 - protein, 9 aa, Homo Sapiens
TRGPGSTSS

SEQ ID NO: 388429 - protein, 9 aa, Homo Sapiens
LSGGQRTSW

SEQ ID NO: 388430 - protein, 9 aa, Homo Sapiens
QAPEGGPWR

SEQ ID NO: 388431 - protein, 9 aa, Homo Sapiens
TDSASSTRE

SEQ ID NO: 388432 - protein, 9 aa, Homo Sapiens
WGQLLLLLL

SEQ ID NO: 388433 - protein, 9 aa, Homo Sapiens
PVPTATAAS

SEQ ID NO: 388434 - protein, 9 aa, Homo Sapiens
GLVAGVGLA

SEQ ID NO: 388435 - protein, 9 aa, Homo Sapiens
APTAWTVAW

SEQ ID NO: 388436 - protein, 9 aa, Homo Sapiens
KGFQLKKSQ

SEQ ID NO: 388437 - protein, 9 aa, Homo Sapiens
NQIIVNTVN

SEQ ID NO: 388438 - protein, 9 aa, Homo Sapiens
EFLKNLSWL

SEQ ID NO: 388439 - protein, 9 aa, Homo Sapiens
PSVELADAK

SEQ ID NO: 388440 - protein, 9 aa, Homo Sapiens
GAPPTCSLF

SEQ ID NO: 388441 - protein, 9 aa, Homo Sapiens
VLKIHKSMI

SEQ ID NO: 388442 - protein, 9 aa, Homo Sapiens
AQRFRLQHG

SEQ ID NO: 388443 - protein, 9 aa, Homo Sapiens
SMIQMKTHS

SEQ ID NO: 388444 - protein, 9 aa, Homo Sapiens
IEVHFVTRN

SEQ ID NO: 388445 - protein, 9 aa, Homo Sapiens
GRILLQRNL

SEQ ID NO: 388446 - protein, 9 aa, Homo Sapiens
RKGLWERSP

SEQ ID NO: 388447 - protein, 9 aa, Homo Sapiens
WRAAPASSH

SEQ ID NO: 388448 - protein, 9 aa, Homo Sapiens
SFYEQQITL

SEQ ID NO: 388449 - protein, 9 aa, Homo Sapiens
DIVCCLNLR

SEQ ID NO: 388450 - protein, 9 aa, Homo Sapiens
RRIPGGYSG

SEQ ID NO: 388451 - protein, 9 aa, Homo Sapiens
VAELALVGP

SEQ ID NO: 388452 - protein, 9 aa, Homo Sapiens
HQAINTIVQ

SEQ ID NO: 388453 - protein, 9 aa, Homo Sapiens
PDKTKPLGT

SEQ ID NO: 388454 - protein, 9 aa, Homo Sapiens
VEGVHGPGP

SEQ ID NO: 388455 - protein, 9 aa, Homo Sapiens
TLAKMIAGI

SEQ ID NO: 388456 - protein, 9 aa, Homo Sapiens
MSSSFHVSM

SEQ ID NO: 388457 - protein, 9 aa, Homo Sapiens
CSMCCVIIP

SEQ ID NO: 388458 - protein, 9 aa, Homo Sapiens
SGEKPIYSI

SEQ ID NO: 388459 - protein, 9 aa, Homo Sapiens
SLAFGALVL

SEQ ID NO: 388460 - protein, 9 aa, Homo Sapiens
EITEGVPGQ

SEQ ID NO: 388461 - protein, 9 aa, Homo Sapiens
PCSMCCVII

SEQ ID NO: 388462 - protein, 9 aa, Homo Sapiens
IYSLRKKML

SEQ ID NO: 388463 - protein, 9 aa, Homo Sapiens
RLCHVLVDI

SEQ ID NO: 388464 - protein, 9 aa, Homo Sapiens
KRKKPLQMV

SEQ ID NO: 388465 - protein, 9 aa, Homo Sapiens
LQHQAGMGN

SEQ ID NO: 388466 - protein, 9 aa, Homo Sapiens
INAPFDMIA

SEQ ID NO: 388467 - protein, 9 aa, Homo Sapiens
QLCLRIQTR

SEQ ID NO: 388468 - protein, 9 aa, Homo Sapiens
GIWLPGITH

SEQ ID NO: 388469 - protein, 9 aa, Homo Sapiens
DPQDCRGRH

SEQ ID NO: 388470 - protein, 9 aa, Homo Sapiens
FAPEESEAG

SEQ ID NO: 388471 - protein, 9 aa, Homo Sapiens
IYCRYRGIN

SEQ ID NO: 388472 - protein, 9 aa, Homo Sapiens
FNILKTALK

SEQ ID NO: 388473 - protein, 9 aa, Homo Sapiens
SERDTRDTF

SEQ ID NO: 388474 - protein, 9 aa, Homo Sapiens
DATSPMELA

SEQ ID NO: 388475 - protein, 9 aa, Homo Sapiens
QCRGRPARS

SEQ ID NO: 388476 - protein, 9 aa, Homo Sapiens
VVKSGQSDS

SEQ ID NO: 388477 - protein, 9 aa, Homo Sapiens
VGLVGNIIT

SEQ ID NO: 388478 - protein, 9 aa, Homo Sapiens
ETLESGGAS

SEQ ID NO: 388479 - protein, 9 aa, Homo Sapiens
HPGARRPLR

SEQ ID NO: 388480 - protein, 9 aa, Homo Sapiens
SSASRGPST

SEQ ID NO: 388481 - protein, 9 aa, Homo Sapiens
RQVRCLEFN

SEQ ID NO: 388482 - protein, 9 aa, Homo Sapiens
NVPVLRSSD

SEQ ID NO: 388483 - protein, 9 aa, Homo Sapiens
VVVHELGVA

SEQ ID NO: 388484 - protein, 9 aa, Homo Sapiens
VACGSRDVQ

SEQ ID NO: 388485 - protein, 9 aa, Homo Sapiens
EEPSRGPSC

SEQ ID NO: 388486 - protein, 9 aa, Homo Sapiens
LERDQPCSS

SEQ ID NO: 388487 - protein, 9 aa, Homo Sapiens
FQVQGSWEP

SEQ ID NO: 388488 - protein, 9 aa, Homo Sapiens
SKCITECVR

SEQ ID NO: 388489 - protein, 9 aa, Homo Sapiens
AGARTPRAS

SEQ ID NO: 388490 - protein, 9 aa, Homo Sapiens
GEAEEALKE

SEQ ID NO: 388491 - protein, 9 aa, Homo Sapiens
EVIREGWRW

SEQ ID NO: 388492 - protein, 9 aa, Homo Sapiens
PTAAYWGPR

SEQ ID NO: 388493 - protein, 9 aa, Homo Sapiens
ECDKAFRQR

SEQ ID NO: 388494 - protein, 9 aa, Homo Sapiens
NDLAAYHAP

SEQ ID NO: 388495 - protein, 9 aa, Homo Sapiens
ATCTDYLGS

SEQ ID NO: 388496 - protein, 9 aa, Homo Sapiens
PSPIKWNGR

SEQ ID NO: 388497 - protein, 9 aa, Homo Sapiens
KKKIGLFTR

SEQ ID NO: 388498 - protein, 9 aa, Homo Sapiens
VLQMMGRVG

SEQ ID NO: 388499 - protein, 9 aa, Homo Sapiens
IWKGIKSTG

SEQ ID NO: 388500 - protein, 9 aa, Homo Sapiens
ILVNSQYTA

SEQ ID NO: 388501 - protein, 9 aa, Homo Sapiens
VKITLLHRT

SEQ ID NO: 388502 - protein, 9 aa, Homo Sapiens
QRIYTGEKP

SEQ ID NO: 388503 - protein, 9 aa, Homo Sapiens
GEESGGVVD

SEQ ID NO: 388504 - protein, 9 aa, Homo Sapiens
TILRSPMIY

SEQ ID NO: 388505 - protein, 9 aa, Homo Sapiens
PSLYPPPGG

SEQ ID NO: 388506 - protein, 9 aa, Homo Sapiens
QSEKRSEMA

SEQ ID NO: 388507 - protein, 9 aa, Homo Sapiens
KIQEDRKAR

SEQ ID NO: 388508 - protein, 9 aa, Homo Sapiens
NRARLSLST

SEQ ID NO: 388509 - protein, 9 aa, Homo Sapiens
KESCVQRRY

SEQ ID NO: 388510 - protein, 9 aa, Homo Sapiens
EHQRIYTGE

SEQ ID NO: 388511 - protein, 9 aa, Homo Sapiens
EASLVDQKL

SEQ ID NO: 388512 - protein, 9 aa, Homo Sapiens
GWVEEWYND

SEQ ID NO: 388513 - protein, 9 aa, Homo Sapiens
LGMDVQRGI

SEQ ID NO: 388514 - protein, 9 aa, Homo Sapiens
LLRQLGKGT

SEQ ID NO: 388515 - protein, 9 aa, Homo Sapiens
MPGPPCSIC

SEQ ID NO: 388516 - protein, 9 aa, Homo Sapiens
QDEEDDEEE

SEQ ID NO: 388517 - protein, 9 aa, Homo Sapiens
NDSVEHRDN

SEQ ID NO: 388518 - protein, 9 aa, Homo Sapiens
VLHQSTYQR

SEQ ID NO: 388519 - protein, 9 aa, Homo Sapiens
SPSGSWEIA

SEQ ID NO: 388520 - protein, 9 aa, Homo Sapiens
PENDLDQLV

SEQ ID NO: 388521 - protein, 9 aa, Homo Sapiens
LPENRPLVW

SEQ ID NO: 388522 - protein, 9 aa, Homo Sapiens
QILESHGFN

SEQ ID NO: 388523 - protein, 9 aa, Homo Sapiens
PLAQWAPAA

SEQ ID NO: 388524 - protein, 9 aa, Homo Sapiens
LFLNNNLLH

SEQ ID NO: 388525 - protein, 9 aa, Homo Sapiens
VRPPPGPPC

SEQ ID NO: 388526 - protein, 9 aa, Homo Sapiens
WSPWTPSLS

SEQ ID NO: 388527 - protein, 9 aa, Homo Sapiens
AGTTFTLVT

SEQ ID NO: 388528 - protein, 9 aa, Homo Sapiens
VLVFGGPGF

SEQ ID NO: 388529 - protein, 9 aa, Homo Sapiens
EENKQQESS

SEQ ID NO: 388530 - protein, 9 aa, Homo Sapiens
EIETILANT

SEQ ID NO: 388531 - protein, 9 aa, Homo Sapiens
LLKKCSLYG

SEQ ID NO: 388532 - protein, 9 aa, Homo Sapiens
PRMKDPRVL

SEQ ID NO: 388533 - protein, 9 aa, Homo Sapiens
KAQTVTEKN

SEQ ID NO: 388534 - protein, 9 aa, Homo Sapiens
CQGTYICQV

SEQ ID NO: 388535 - protein, 9 aa, Homo Sapiens
PFLPRALMG

SEQ ID NO: 388536 - protein, 9 aa, Homo Sapiens
YFAINHNPT

SEQ ID NO: 388537 - protein, 9 aa, Homo Sapiens
TALLAQGQP

SEQ ID NO: 388538 - protein, 9 aa, Homo Sapiens
NRMTVTHMW

SEQ ID NO: 388539 - protein, 9 aa, Homo Sapiens
VIGHYYVAV

SEQ ID NO: 388540 - protein, 9 aa, Homo Sapiens
TRLSISTRV

SEQ ID NO: 388541 - protein, 9 aa, Homo Sapiens
TLLHRTQKN

SEQ ID NO: 388542 - protein, 9 aa, Homo Sapiens
LLTTAVEVT

SEQ ID NO: 388543 - protein, 9 aa, Homo Sapiens
IKKQHSMPR

SEQ ID NO: 388544 - protein, 9 aa, Homo Sapiens
VDEVNMPHQ

SEQ ID NO: 388545 - protein, 9 aa, Homo Sapiens
APCPPLEVH

SEQ ID NO: 388546 - protein, 9 aa, Homo Sapiens
IVGPEGVAL

SEQ ID NO: 388547 - protein, 9 aa, Homo Sapiens
LTPSWSRCA

SEQ ID NO: 388548 - protein, 9 aa, Homo Sapiens
TNQNTGFPF

SEQ ID NO: 388549 - protein, 9 aa, Homo Sapiens
GSLAFGALV

SEQ ID NO: 388550 - protein, 9 aa, Homo Sapiens
SSSDQSFCL

SEQ ID NO: 388551 - protein, 9 aa, Homo Sapiens
GNKPDTFCG

SEQ ID NO: 388552 - protein, 9 aa, Homo Sapiens
LLKAFAQAG

SEQ ID NO: 388553 - protein, 9 aa, Homo Sapiens
RCCSPRRPQ

SEQ ID NO: 388554 - protein, 9 aa, Homo Sapiens
YRNGIMLFD

SEQ ID NO: 388555 - protein, 9 aa, Homo Sapiens
VMVMILVVD

SEQ ID NO: 388556 - protein, 9 aa, Homo Sapiens
LVAGVGLAA

SEQ ID NO: 388557 - protein, 9 aa, Homo Sapiens
RKMTNDGPK

SEQ ID NO: 388558 - protein, 9 aa, Homo Sapiens
QVVTDHDIP

SEQ ID NO: 388559 - protein, 9 aa, Homo Sapiens
KRLKIFVSS

SEQ ID NO: 388560 - protein, 9 aa, Homo Sapiens
QPLTAWGLP

SEQ ID NO: 388561 - protein, 9 aa, Homo Sapiens
TILGHVQRR

SEQ ID NO: 388562 - protein, 9 aa, Homo Sapiens
LLAPTHVNH

SEQ ID NO: 388563 - protein, 9 aa, Homo Sapiens
EDEYYQAVY

SEQ ID NO: 388564 - protein, 9 aa, Homo Sapiens
VVEGVHGPG

SEQ ID NO: 388565 - protein, 9 aa, Homo Sapiens
PASGPSPAR

SEQ ID NO: 388566 - protein, 9 aa, Homo Sapiens
VADGALLRG

SEQ ID NO: 388567 - protein, 9 aa, Homo Sapiens
FQRAPLKFK

SEQ ID NO: 388568 - protein, 9 aa, Homo Sapiens
DGASEEPSQ

SEQ ID NO: 388569 - protein, 9 aa, Homo Sapiens
GTLNFGGIG

SEQ ID NO: 388570 - protein, 9 aa, Homo Sapiens
PTRKPPHRT

SEQ ID NO: 388571 - protein, 9 aa, Homo Sapiens
VKNAEPTKR

SEQ ID NO: 388572 - protein, 9 aa, Homo Sapiens
DFLVLCQFY

SEQ ID NO: 388573 - protein, 9 aa, Homo Sapiens
IRQYVSSEG

SEQ ID NO: 388574 - protein, 9 aa, Homo Sapiens
ELQKTEEEN

SEQ ID NO: 388575 - protein, 9 aa, Homo Sapiens
NMLSVAWAD

SEQ ID NO: 388576 - protein, 9 aa, Homo Sapiens
GTMSVSAQE

SEQ ID NO: 388577 - protein, 9 aa, Homo Sapiens
SVKKTAPPE

SEQ ID NO: 388578 - protein, 9 aa, Homo Sapiens
HPEVIYNYV

SEQ ID NO: 388579 - protein, 9 aa, Homo Sapiens
VLENNQTSW

SEQ ID NO: 388580 - protein, 9 aa, Homo Sapiens
TRTLREILP

SEQ ID NO: 388581 - protein, 9 aa, Homo Sapiens
TAPPSAPGS

SEQ ID NO: 388582 - protein, 9 aa, Homo Sapiens
ITPGFPLTM

SEQ ID NO: 388583 - protein, 9 aa, Homo Sapiens
APRASAPPP

SEQ ID NO: 388584 - protein, 9 aa, Homo Sapiens
YDTDGQEAP

SEQ ID NO: 388585 - protein, 9 aa, Homo Sapiens
HTLLHLECE

SEQ ID NO: 388586 - protein, 9 aa, Homo Sapiens
REHGAERLR

SEQ ID NO: 388587 - protein, 9 aa, Homo Sapiens
LMEFNILKT

SEQ ID NO: 388588 - protein, 9 aa, Homo Sapiens
ADRTGGTSR

SEQ ID NO: 388589 - protein, 9 aa, Homo Sapiens
LQRPFFDLL

SEQ ID NO: 388590 - protein, 9 aa, Homo Sapiens
VDYEFNPIV

SEQ ID NO: 388591 - protein, 9 aa, Homo Sapiens
NSTREARRT

SEQ ID NO: 388592 - protein, 9 aa, Homo Sapiens
KVPCLCLEE

SEQ ID NO: 388593 - protein, 9 aa, Homo Sapiens
AHDVIHWTK

SEQ ID NO: 388594 - protein, 9 aa, Homo Sapiens
IETILANTV

SEQ ID NO: 388595 - protein, 9 aa, Homo Sapiens
DDVSEFIQS

SEQ ID NO: 388596 - protein, 9 aa, Homo Sapiens
CITECVRTA

SEQ ID NO: 388597 - protein, 9 aa, Homo Sapiens
AAGTALPAV

SEQ ID NO: 388598 - protein, 9 aa, Homo Sapiens
YNVEHYVDY

SEQ ID NO: 388599 - protein, 9 aa, Homo Sapiens
KSPENHADT

SEQ ID NO: 388600 - protein, 9 aa, Homo Sapiens
TTSAVSIQQ

SEQ ID NO: 388601 - protein, 9 aa, Homo Sapiens
EVDYKKIPE

SEQ ID NO: 388602 - protein, 9 aa, Homo Sapiens
LHLECEKYK

SEQ ID NO: 388603 - protein, 9 aa, Homo Sapiens
DPDKERKSP

SEQ ID NO: 388604 - protein, 9 aa, Homo Sapiens
DPNQWNQET

SEQ ID NO: 388605 - protein, 9 aa, Homo Sapiens
INEDRKPPN

SEQ ID NO: 388606 - protein, 9 aa, Homo Sapiens
GHPRGSQSA

SEQ ID NO: 388607 - protein, 9 aa, Homo Sapiens
LQSLLSLYS

SEQ ID NO: 388608 - protein, 9 aa, Homo Sapiens
GSHRLFILR

SEQ ID NO: 388609 - protein, 9 aa, Homo Sapiens
NFCTFFCRD

SEQ ID NO: 388610 - protein, 9 aa, Homo Sapiens
ALPAVRPED

SEQ ID NO: 388611 - protein, 9 aa, Homo Sapiens
TLQVVILKK

SEQ ID NO: 388612 - protein, 9 aa, Homo Sapiens
TIMDHSIIL

SEQ ID NO: 388613 - protein, 9 aa, Homo Sapiens
EAPPQTPPL

SEQ ID NO: 388614 - protein, 9 aa, Homo Sapiens
TRSTTLARG

SEQ ID NO: 388615 - protein, 9 aa, Homo Sapiens
PDEPIIETE

SEQ ID NO: 388616 - protein, 9 aa, Homo Sapiens
GNVLVCTCY

SEQ ID NO: 388617 - protein, 9 aa, Homo Sapiens
ARRTVSSRG

SEQ ID NO: 388618 - protein, 9 aa, Homo Sapiens
GENRTNVLP

SEQ ID NO: 388619 - protein, 9 aa, Homo Sapiens
PISITNTAT

SEQ ID NO: 388620 - protein, 9 aa, Homo Sapiens
KNPMFLFLF

SEQ ID NO: 388621 - protein, 9 aa, Homo Sapiens
GQPTHCSTT

SEQ ID NO: 388622 - protein, 9 aa, Homo Sapiens
AAAGNPSLS

SEQ ID NO: 388623 - protein, 9 aa, Homo Sapiens
MAFSSCAAF

SEQ ID NO: 388624 - protein, 9 aa, Homo Sapiens
SHPGLRPCG

SEQ ID NO: 388625 - protein, 9 aa, Homo Sapiens
MLFDGPFQP

SEQ ID NO: 388626 - protein, 9 aa, Homo Sapiens
HRCALGAVP

SEQ ID NO: 388627 - protein, 9 aa, Homo Sapiens
EGDAWLLGG

SEQ ID NO: 388628 - protein, 9 aa, Homo Sapiens
IDRYQQSKD

SEQ ID NO: 388629 - protein, 9 aa, Homo Sapiens
KVKITLLHR

SEQ ID NO: 388630 - protein, 9 aa, Homo Sapiens
ALGPISPSS

SEQ ID NO: 388631 - protein, 9 aa, Homo Sapiens
RARRTNGAS

SEQ ID NO: 388632 - protein, 9 aa, Homo Sapiens
TSCGSRWKS

SEQ ID NO: 388633 - protein, 9 aa, Homo Sapiens
TRRARGSSI

SEQ ID NO: 388634 - protein, 9 aa, Homo Sapiens
NDSKHKLES

SEQ ID NO: 388635 - protein, 9 aa, Homo Sapiens
SRTRGTLHT

SEQ ID NO: 388636 - protein, 9 aa, Homo Sapiens
WISVPCPNL

SEQ ID NO: 388637 - protein, 9 aa, Homo Sapiens
VGRQLAIIR

SEQ ID NO: 388638 - protein, 9 aa, Homo Sapiens
QASWARPPA

SEQ ID NO: 388639 - protein, 9 aa, Homo Sapiens
CSSSSWQAQ

SEQ ID NO: 388640 - protein, 9 aa, Homo Sapiens
IVVKFFLQL

SEQ ID NO: 388641 - protein, 9 aa, Homo Sapiens
REEVLHQST

SEQ ID NO: 388642 - protein, 9 aa, Homo Sapiens
RILEQTYIT

SEQ ID NO: 388643 - protein, 9 aa, Homo Sapiens
FVLAPEVCA

SEQ ID NO: 388644 - protein, 9 aa, Homo Sapiens
FSSCAAFFR

SEQ ID NO: 388645 - protein, 9 aa, Homo Sapiens
GSGQASGSG

SEQ ID NO: 388646 - protein, 9 aa, Homo Sapiens
GFNPRLSRV

SEQ ID NO: 388647 - protein, 9 aa, Homo Sapiens
HLPQYYIVV

SEQ ID NO: 388648 - protein, 9 aa, Homo Sapiens
DTWAKVAYT

SEQ ID NO: 388649 - protein, 9 aa, Homo Sapiens
AGWSPSPSP

SEQ ID NO: 388650 - protein, 9 aa, Homo Sapiens
CNQCGETYR

SEQ ID NO: 388651 - protein, 9 aa, Homo Sapiens
PTIPPAWDV

SEQ ID NO: 388652 - protein, 9 aa, Homo Sapiens
DTDFLCPSD

SEQ ID NO: 388653 - protein, 9 aa, Homo Sapiens
RAIFYSACM

SEQ ID NO: 388654 - protein, 9 aa, Homo Sapiens
QDKYYQMPS

SEQ ID NO: 388655 - protein, 9 aa, Homo Sapiens
PAGVLHTAA

SEQ ID NO: 388656 - protein, 9 aa, Homo Sapiens
DMVVSQLAG

SEQ ID NO: 388657 - protein, 9 aa, Homo Sapiens
LRFCAWPSA

SEQ ID NO: 388658 - protein, 9 aa, Homo Sapiens
TPLYEWSLP

SEQ ID NO: 388659 - protein, 9 aa, Homo Sapiens
RGKLDVGNA

SEQ ID NO: 388660 - protein, 9 aa, Homo Sapiens
YLVQQTIQW

SEQ ID NO: 388661 - protein, 9 aa, Homo Sapiens
HVDLETVAL

SEQ ID NO: 388662 - protein, 9 aa, Homo Sapiens
KGEAQCRGR

SEQ ID NO: 388663 - protein, 9 aa, Homo Sapiens
WSWCGTSQT

SEQ ID NO: 388664 - protein, 9 aa, Homo Sapiens
GVTCEGFPT

SEQ ID NO: 388665 - protein, 9 aa, Homo Sapiens
WSPLQPRAR

SEQ ID NO: 388666 - protein, 9 aa, Homo Sapiens
DSAINSIRR

SEQ ID NO: 388667 - protein, 9 aa, Homo Sapiens
KSPLPLKQR

SEQ ID NO: 388668 - protein, 9 aa, Homo Sapiens
GTVVVLRLD

SEQ ID NO: 388669 - protein, 9 aa, Homo Sapiens
TRGVGDRGW

SEQ ID NO: 388670 - protein, 9 aa, Homo Sapiens
LTRKMAIID

SEQ ID NO: 388671 - protein, 9 aa, Homo Sapiens
GQGTVMAGT

SEQ ID NO: 388672 - protein, 9 aa, Homo Sapiens
RDGDCYWFE

SEQ ID NO: 388673 - protein, 9 aa, Homo Sapiens
GLAARNVQL

SEQ ID NO: 388674 - protein, 9 aa, Homo Sapiens
RVFYMNQRV

SEQ ID NO: 388675 - protein, 9 aa, Homo Sapiens
PLSTLSCSD

SEQ ID NO: 388676 - protein, 9 aa, Homo Sapiens
MTLKALVKT

SEQ ID NO: 388677 - protein, 9 aa, Homo Sapiens
SRTISTRGS

SEQ ID NO: 388678 - protein, 9 aa, Homo Sapiens
QLVYQGSIG

SEQ ID NO: 388679 - protein, 9 aa, Homo Sapiens
AQLFSPALL

SEQ ID NO: 388680 - protein, 9 aa, Homo Sapiens
ALDLETCGK

SEQ ID NO: 388681 - protein, 9 aa, Homo Sapiens
SLFDFLSVG

SEQ ID NO: 388682 - protein, 9 aa, Homo Sapiens
TRGASFAIR

SEQ ID NO: 388683 - protein, 9 aa, Homo Sapiens
AAFFRRKRR

SEQ ID NO: 388684 - protein, 9 aa, Homo Sapiens
AYLLFAEAA

SEQ ID NO: 388685 - protein, 9 aa, Homo Sapiens
NFTRTSSRA

SEQ ID NO: 388686 - protein, 9 aa, Homo Sapiens
NTTRTLREI

SEQ ID NO: 388687 - protein, 9 aa, Homo Sapiens
TDLTVLGQP

SEQ ID NO: 388688 - protein, 9 aa, Homo Sapiens
ASHLQQQCQ

SEQ ID NO: 388689 - protein, 9 aa, Homo Sapiens
TYETRQKRD

SEQ ID NO: 388690 - protein, 9 aa, Homo Sapiens
NLLPAPSAL

SEQ ID NO: 388691 - protein, 9 aa, Homo Sapiens
ISCHLLTLI

SEQ ID NO: 388692 - protein, 9 aa, Homo Sapiens
IQVLMSVVH

SEQ ID NO: 388693 - protein, 9 aa, Homo Sapiens
SFRCLAFEC

SEQ ID NO: 388694 - protein, 9 aa, Homo Sapiens
EARDGSCKN

SEQ ID NO: 388695 - protein, 9 aa, Homo Sapiens
NNAHVIFSG

SEQ ID NO: 388696 - protein, 9 aa, Homo Sapiens
GFRFFHVLF

SEQ ID NO: 388697 - protein, 9 aa, Homo Sapiens
LFFVLVNLE

SEQ ID NO: 388698 - protein, 9 aa, Homo Sapiens
TAATTAATF

SEQ ID NO: 388699 - protein, 9 aa, Homo Sapiens
AATVFDLPK

SEQ ID NO: 388700 - protein, 9 aa, Homo Sapiens
VKRKKPLQM

SEQ ID NO: 388701 - protein, 9 aa, Homo Sapiens
KKGLLLANG

SEQ ID NO: 388702 - protein, 9 aa, Homo Sapiens
AGSRGERGP

SEQ ID NO: 388703 - protein, 9 aa, Homo Sapiens
EKFQPSHLK

SEQ ID NO: 388704 - protein, 9 aa, Homo Sapiens
QPRPSTPAS

SEQ ID NO: 388705 - protein, 9 aa, Homo Sapiens
HGDKGIIYD

SEQ ID NO: 388706 - protein, 9 aa, Homo Sapiens
SELDIVENA

SEQ ID NO: 388707 - protein, 9 aa, Homo Sapiens
LIEIKVPSQ

SEQ ID NO: 388708 - protein, 9 aa, Homo Sapiens
HFRREREEE

SEQ ID NO: 388709 - protein, 9 aa, Homo Sapiens
TPASPGNRG

SEQ ID NO: 388710 - protein, 9 aa, Homo Sapiens
CRKNEELIA

SEQ ID NO: 388711 - protein, 9 aa, Homo Sapiens
EPRKGLWER

SEQ ID NO: 388712 - protein, 9 aa, Homo Sapiens
HHPPCWSPL

SEQ ID NO: 388713 - protein, 9 aa, Homo Sapiens
LSIDLCKGD

SEQ ID NO: 388714 - protein, 9 aa, Homo Sapiens
MHNSLNYRE

SEQ ID NO: 388715 - protein, 9 aa, Homo Sapiens
SSGTSRAAG

SEQ ID NO: 388716 - protein, 9 aa, Homo Sapiens
GFFDPNMHE

SEQ ID NO: 388717 - protein, 9 aa, Homo Sapiens
NQFVQPAWK

SEQ ID NO: 388718 - protein, 9 aa, Homo Sapiens
RRTGASTPA

SEQ ID NO: 388719 - protein, 9 aa, Homo Sapiens
LISIIDILV

SEQ ID NO: 388720 - protein, 9 aa, Homo Sapiens
LSLPKIRSF

SEQ ID NO: 388721 - protein, 9 aa, Homo Sapiens
RFYSPSPNP

SEQ ID NO: 388722 - protein, 9 aa, Homo Sapiens
IIVNTVNQK

SEQ ID NO: 388723 - protein, 9 aa, Homo Sapiens
GPAGLVPES

SEQ ID NO: 388724 - protein, 9 aa, Homo Sapiens
EFLMGGMSR

SEQ ID NO: 388725 - protein, 9 aa, Homo Sapiens
NGHGSHRLF

SEQ ID NO: 388726 - protein, 9 aa, Homo Sapiens
HVNEKVEML

SEQ ID NO: 388727 - protein, 9 aa, Homo Sapiens
LVLISIIDI

SEQ ID NO: 388728 - protein, 9 aa, Homo Sapiens
LRLDGSQRP

SEQ ID NO: 388729 - protein, 9 aa, Homo Sapiens
PRQLPGPHD

SEQ ID NO: 388730 - protein, 9 aa, Homo Sapiens
RTSQNHSKC

SEQ ID NO: 388731 - protein, 9 aa, Homo Sapiens
KFLDHSDHP

SEQ ID NO: 388732 - protein, 9 aa, Homo Sapiens
PRVFLVRSR

SEQ ID NO: 388733 - protein, 9 aa, Homo Sapiens
HTRAQQVLF

SEQ ID NO: 388734 - protein, 9 aa, Homo Sapiens
ALQPGEKKS

SEQ ID NO: 388735 - protein, 9 aa, Homo Sapiens
ARRHSPFVS

SEQ ID NO: 388736 - protein, 9 aa, Homo Sapiens
FSWKCRLNR

SEQ ID NO: 388737 - protein, 9 aa, Homo Sapiens
ICLDYLVDP

SEQ ID NO: 388738 - protein, 9 aa, Homo Sapiens
CCSSWLRRI

SEQ ID NO: 388739 - protein, 9 aa, Homo Sapiens
RKKQQKIKN

SEQ ID NO: 388740 - protein, 9 aa, Homo Sapiens
GGAQGPGPT

SEQ ID NO: 388741 - protein, 9 aa, Homo Sapiens
PWRKSGSGS

SEQ ID NO: 388742 - protein, 9 aa, Homo Sapiens
GGATGANRA

SEQ ID NO: 388743 - protein, 9 aa, Homo Sapiens
GDGRHRKLG

SEQ ID NO: 388744 - protein, 9 aa, Homo Sapiens
VMILVVDTK

SEQ ID NO: 388745 - protein, 9 aa, Homo Sapiens
ALICLTPSV

SEQ ID NO: 388746 - protein, 9 aa, Homo Sapiens
DKSKNSASP

SEQ ID NO: 388747 - protein, 9 aa, Homo Sapiens
GSGALFAGV

SEQ ID NO: 388748 - protein, 9 aa, Homo Sapiens
QDTDTIAVH

SEQ ID NO: 388749 - protein, 9 aa, Homo Sapiens
QVTTTLKLI

SEQ ID NO: 388750 - protein, 9 aa, Homo Sapiens
GDKVWVNLI

SEQ ID NO: 388751 - protein, 9 aa, Homo Sapiens
FEIYTIVGT

SEQ ID NO: 388752 - protein, 9 aa, Homo Sapiens
LLSRVQTQL

SEQ ID NO: 388753 - protein, 9 aa, Homo Sapiens
MEAFATRCC

SEQ ID NO: 388754 - protein, 9 aa, Homo Sapiens
GRRGGPGGA

SEQ ID NO: 388755 - protein, 9 aa, Homo Sapiens
WECTELIHE

SEQ ID NO: 388756 - protein, 9 aa, Homo Sapiens
HWTLSPQGP

SEQ ID NO: 388757 - protein, 9 aa, Homo Sapiens
DRTRLGGEL

SEQ ID NO: 388758 - protein, 9 aa, Homo Sapiens
TSRARGSLS

SEQ ID NO: 388759 - protein, 9 aa, Homo Sapiens
RARVLPGGA

SEQ ID NO: 388760 - protein, 9 aa, Homo Sapiens
KLFIKLTHL

SEQ ID NO: 388761 - protein, 9 aa, Homo Sapiens
DRRFQIINT

SEQ ID NO: 388762 - protein, 9 aa, Homo Sapiens
WRSGSSSHL

SEQ ID NO: 388763 - protein, 9 aa, Homo Sapiens
QPFQLAFVH

SEQ ID NO: 388764 - protein, 9 aa, Homo Sapiens
TPEYNVKGS

SEQ ID NO: 388765 - protein, 9 aa, Homo Sapiens
ITVKLFKFS

SEQ ID NO: 388766 - protein, 9 aa, Homo Sapiens
PGHPRGSQS

SEQ ID NO: 388767 - protein, 9 aa, Homo Sapiens
RKRWSPLTS

SEQ ID NO: 388768 - protein, 9 aa, Homo Sapiens
PTVVAWLGL

SEQ ID NO: 388769 - protein, 9 aa, Homo Sapiens
LTIPSASRP

SEQ ID NO: 388770 - protein, 9 aa, Homo Sapiens
PLPPHKPPP

SEQ ID NO: 388771 - protein, 9 aa, Homo Sapiens
GALLRGLGL

SEQ ID NO: 388772 - protein, 9 aa, Homo Sapiens
EQPTGMMPN

SEQ ID NO: 388773 - protein, 9 aa, Homo Sapiens
CKLLRFFIH

SEQ ID NO: 388774 - protein, 9 aa, Homo Sapiens
PRPTTGGPR

SEQ ID NO: 388775 - protein, 9 aa, Homo Sapiens
PENILADKP

SEQ ID NO: 388776 - protein, 9 aa, Homo Sapiens
QTRLLSRDI

SEQ ID NO: 388777 - protein, 9 aa, Homo Sapiens
NYLGGFACP

SEQ ID NO: 388778 - protein, 9 aa, Homo Sapiens
TTVTLGARR

SEQ ID NO: 388779 - protein, 9 aa, Homo Sapiens
GPEEEEVSS

SEQ ID NO: 388780 - protein, 9 aa, Homo Sapiens
PAPPWQPPP

SEQ ID NO: 388781 - protein, 9 aa, Homo Sapiens
AALATWPTP

SEQ ID NO: 388782 - protein, 9 aa, Homo Sapiens
RKKRAPHLQ

SEQ ID NO: 388783 - protein, 9 aa, Homo Sapiens
LKDGRHLQG

SEQ ID NO: 388784 - protein, 9 aa, Homo Sapiens
MQLFLVLII

SEQ ID NO: 388785 - protein, 9 aa, Homo Sapiens
KRSLLGLVE

SEQ ID NO: 388786 - protein, 9 aa, Homo Sapiens
IPEFGSPCP

SEQ ID NO: 388787 - protein, 9 aa, Homo Sapiens
RDFIQVFIY

SEQ ID NO: 388788 - protein, 9 aa, Homo Sapiens
NKFTLTDNH

SEQ ID NO: 388789 - protein, 9 aa, Homo Sapiens
FACFTWRTS

SEQ ID NO: 388790 - protein, 9 aa, Homo Sapiens
GGRRLLTIP

SEQ ID NO: 388791 - protein, 9 aa, Homo Sapiens
ACCCGLSLC

SEQ ID NO: 388792 - protein, 9 aa, Homo Sapiens
KGLEWRVSL

SEQ ID NO: 388793 - protein, 9 aa, Homo Sapiens
GVGHAQDAI

SEQ ID NO: 388794 - protein, 9 aa, Homo Sapiens
NSASPHPEE

SEQ ID NO: 388795 - protein, 9 aa, Homo Sapiens
LVGCEHGGG

SEQ ID NO: 388796 - protein, 9 aa, Homo Sapiens
IPQSEASML

SEQ ID NO: 388797 - protein, 9 aa, Homo Sapiens
RSFFRRCRP

SEQ ID NO: 388798 - protein, 9 aa, Homo Sapiens
TAEDRCMSD

SEQ ID NO: 388799 - protein, 9 aa, Homo Sapiens
GLVCLILGI

SEQ ID NO: 388800 - protein, 9 aa, Homo Sapiens
KTYERLQKN

SEQ ID NO: 388801 - protein, 9 aa, Homo Sapiens
KIMEKKYRN

SEQ ID NO: 388802 - protein, 9 aa, Homo Sapiens
LRTKLEKAL

SEQ ID NO: 388803 - protein, 9 aa, Homo Sapiens
PPHKPPPPG

SEQ ID NO: 388804 - protein, 9 aa, Homo Sapiens
INSIRRHLF

SEQ ID NO: 388805 - protein, 9 aa, Homo Sapiens
DVENTVDTA

SEQ ID NO: 388806 - protein, 9 aa, Homo Sapiens
IVEIGDENV

SEQ ID NO: 388807 - protein, 9 aa, Homo Sapiens
YSIAITWGD

SEQ ID NO: 388808 - protein, 9 aa, Homo Sapiens
EESAKEITE

SEQ ID NO: 388809 - protein, 9 aa, Homo Sapiens
FQPSHLKVD

SEQ ID NO: 388810 - protein, 9 aa, Homo Sapiens
TCWPRTASS

SEQ ID NO: 388811 - protein, 9 aa, Homo Sapiens
KKQERNLNW

SEQ ID NO: 388812 - protein, 9 aa, Homo Sapiens
NWNASFSLT

SEQ ID NO: 388813 - protein, 9 aa, Homo Sapiens
GVWSLEASS

SEQ ID NO: 388814 - protein, 9 aa, Homo Sapiens
TNSTREARR

SEQ ID NO: 388815 - protein, 9 aa, Homo Sapiens
QLSWGWSQQ

SEQ ID NO: 388816 - protein, 9 aa, Homo Sapiens
LKTALKLTR

SEQ ID NO: 388817 - protein, 9 aa, Homo Sapiens
ELVCKLERR

SEQ ID NO: 388818 - protein, 9 aa, Homo Sapiens
VTLRPWKTS

SEQ ID NO: 388819 - protein, 9 aa, Homo Sapiens
VPQAVDGWV

SEQ ID NO: 388820 - protein, 9 aa, Homo Sapiens
GANPWIKFR

SEQ ID NO: 388821 - protein, 9 aa, Homo Sapiens
EDMPAQGSS

SEQ ID NO: 388822 - protein, 9 aa, Homo Sapiens
PSSICRGNW

SEQ ID NO: 388823 - protein, 9 aa, Homo Sapiens
STSRARGSR

SEQ ID NO: 388824 - protein, 9 aa, Homo Sapiens
TFRSRESHH

SEQ ID NO: 388825 - protein, 9 aa, Homo Sapiens
VESIFARST

SEQ ID NO: 388826 - protein, 9 aa, Homo Sapiens
SLVMCLRLR

SEQ ID NO: 388827 - protein, 9 aa, Homo Sapiens
SAPAGTTGR

SEQ ID NO: 388828 - protein, 9 aa, Homo Sapiens
TSITSVTLR

SEQ ID NO: 388829 - protein, 9 aa, Homo Sapiens
TRSLPFECS

SEQ ID NO: 388830 - protein, 9 aa, Homo Sapiens
VVQNERFDA

SEQ ID NO: 388831 - protein, 9 aa, Homo Sapiens
KERVSAQNV

SEQ ID NO: 388832 - protein, 9 aa, Homo Sapiens
GETYRRLWT

SEQ ID NO: 388833 - protein, 9 aa, Homo Sapiens
HPAIWVADL

SEQ ID NO: 388834 - protein, 9 aa, Homo Sapiens
KAKLRIFFL

SEQ ID NO: 388835 - protein, 9 aa, Homo Sapiens
VITSNPLPS

SEQ ID NO: 388836 - protein, 9 aa, Homo Sapiens
RLRIWVPAQ

SEQ ID NO: 388837 - protein, 9 aa, Homo Sapiens
RSEMAFSSC

SEQ ID NO: 388838 - protein, 9 aa, Homo Sapiens
EVFLIFWNI

SEQ ID NO: 388839 - protein, 9 aa, Homo Sapiens
TFTRHSLKA

SEQ ID NO: 388840 - protein, 9 aa, Homo Sapiens
PPVKAEKLR

SEQ ID NO: 388841 - protein, 9 aa, Homo Sapiens
EEEEVSSGV

SEQ ID NO: 388842 - protein, 9 aa, Homo Sapiens
TLGTRQTSF

SEQ ID NO: 388843 - protein, 9 aa, Homo Sapiens
DVLQMMGRV

SEQ ID NO: 388844 - protein, 9 aa, Homo Sapiens
GSTNLIVYI

SEQ ID NO: 388845 - protein, 9 aa, Homo Sapiens
PSVRAGSGA

SEQ ID NO: 388846 - protein, 9 aa, Homo Sapiens
PKLGEREVA

SEQ ID NO: 388847 - protein, 9 aa, Homo Sapiens
LKQRREICA

SEQ ID NO: 388848 - protein, 9 aa, Homo Sapiens
GTCRSCGVT

SEQ ID NO: 388849 - protein, 9 aa, Homo Sapiens
LEPPDKTKP

SEQ ID NO: 388850 - protein, 9 aa, Homo Sapiens
LFSRVPEPV

SEQ ID NO: 388851 - protein, 9 aa, Homo Sapiens
QTDLTVLGQ

SEQ ID NO: 388852 - protein, 9 aa, Homo Sapiens
QGLPVPLLD

SEQ ID NO: 388853 - protein, 9 aa, Homo Sapiens
LGTASEGWS

SEQ ID NO: 388854 - protein, 9 aa, Homo Sapiens
DPPHQPWAH

SEQ ID NO: 388855 - protein, 9 aa, Homo Sapiens
GAFLRQGQL

SEQ ID NO: 388856 - protein, 9 aa, Homo Sapiens
GAAAGNPSL

SEQ ID NO: 388857 - protein, 9 aa, Homo Sapiens
QAPPKSSAS

SEQ ID NO: 388858 - protein, 9 aa, Homo Sapiens
LGEREVALV

SEQ ID NO: 388859 - protein, 9 aa, Homo Sapiens
GEAEFYDPL

SEQ ID NO: 388860 - protein, 9 aa, Homo Sapiens
GLGSRIDLD

SEQ ID NO: 388861 - protein, 9 aa, Homo Sapiens
IEIKVPSQK

SEQ ID NO: 388862 - protein, 9 aa, Homo Sapiens
FSTSITRFA

SEQ ID NO: 388863 - protein, 9 aa, Homo Sapiens
VDSAINSIR

SEQ ID NO: 388864 - protein, 9 aa, Homo Sapiens
TGLPAPGVE

SEQ ID NO: 388865 - protein, 9 aa, Homo Sapiens
SEPRILARD

SEQ ID NO: 388866 - protein, 9 aa, Homo Sapiens
AREEVLHQS

SEQ ID NO: 388867 - protein, 9 aa, Homo Sapiens
IFWVVPFIS

SEQ ID NO: 388868 - protein, 9 aa, Homo Sapiens
KCGKAFSWK

SEQ ID NO: 388869 - protein, 9 aa, Homo Sapiens
VSRDQCQEL

SEQ ID NO: 388870 - protein, 9 aa, Homo Sapiens
EPMWLAREG

SEQ ID NO: 388871 - protein, 9 aa, Homo Sapiens
ETPAGLSHP

SEQ ID NO: 388872 - protein, 9 aa, Homo Sapiens
FGTSLSPFA

SEQ ID NO: 388873 - protein, 9 aa, Homo Sapiens
LYASVALFA

SEQ ID NO: 388874 - protein, 9 aa, Homo Sapiens
TPQPSHSRG

SEQ ID NO: 388875 - protein, 9 aa, Homo Sapiens
TKKRGKSQG

SEQ ID NO: 388876 - protein, 9 aa, Homo Sapiens
KPDNGAIAF

SEQ ID NO: 388877 - protein, 9 aa, Homo Sapiens
ISPHSSPPV

SEQ ID NO: 388878 - protein, 9 aa, Homo Sapiens
LKLVKRMLA

SEQ ID NO: 388879 - protein, 9 aa, Homo Sapiens
ETHEHKKKH

SEQ ID NO: 388880 - protein, 9 aa, Homo Sapiens
HSLVMCLRL

SEQ ID NO: 388881 - protein, 9 aa, Homo Sapiens
AEPTKRPDS

SEQ ID NO: 388882 - protein, 9 aa, Homo Sapiens
KVNFDILER

SEQ ID NO: 388883 - protein, 9 aa, Homo Sapiens
NPRLSRVAH

SEQ ID NO: 388884 - protein, 9 aa, Homo Sapiens
QSRDLLTGL

SEQ ID NO: 388885 - protein, 9 aa, Homo Sapiens
PGCPRDEEW

SEQ ID NO: 388886 - protein, 9 aa, Homo Sapiens
SQVGGTQEV

SEQ ID NO: 388887 - protein, 9 aa, Homo Sapiens
SKIETEFLK

SEQ ID NO: 388888 - protein, 9 aa, Homo Sapiens
EEKNVHRQP

SEQ ID NO: 388889 - protein, 9 aa, Homo Sapiens
GASKASRAG

SEQ ID NO: 388890 - protein, 9 aa, Homo Sapiens
PSSRKSGTS

SEQ ID NO: 388891 - protein, 9 aa, Homo Sapiens
MTSIRRLQQ

SEQ ID NO: 388892 - protein, 9 aa, Homo Sapiens
NLGDRTRLG

SEQ ID NO: 388893 - protein, 9 aa, Homo Sapiens
SRDQCQELG

SEQ ID NO: 388894 - protein, 9 aa, Homo Sapiens
FCQPHKIHY

SEQ ID NO: 388895 - protein, 9 aa, Homo Sapiens
WTEECMWSQ

SEQ ID NO: 388896 - protein, 9 aa, Homo Sapiens
GAQVCVLSA

SEQ ID NO: 388897 - protein, 9 aa, Homo Sapiens
NVSRDQCQE

SEQ ID NO: 388898 - protein, 9 aa, Homo Sapiens
QLHPAIWVA

SEQ ID NO: 388899 - protein, 9 aa, Homo Sapiens
ASPHSTTAR

SEQ ID NO: 388900 - protein, 9 aa, Homo Sapiens
VAGVGLAAS

SEQ ID NO: 388901 - protein, 9 aa, Homo Sapiens
QIQASWARP

SEQ ID NO: 388902 - protein, 9 aa, Homo Sapiens
MAIAATQTQ

SEQ ID NO: 388903 - protein, 9 aa, Homo Sapiens
YRHQDKYYQ

SEQ ID NO: 388904 - protein, 9 aa, Homo Sapiens
LLNNRMVSR

SEQ ID NO: 388905 - protein, 9 aa, Homo Sapiens
IGTFSTRLS

SEQ ID NO: 388906 - protein, 9 aa, Homo Sapiens
QRELLKTLN

SEQ ID NO: 388907 - protein, 9 aa, Homo Sapiens
CSRGTLFAR

SEQ ID NO: 388908 - protein, 9 aa, Homo Sapiens
DSARGSGNT

SEQ ID NO: 388909 - protein, 9 aa, Homo Sapiens
SMSIIGSTN

SEQ ID NO: 388910 - protein, 9 aa, Homo Sapiens
ENMFQVCAE

SEQ ID NO: 388911 - protein, 9 aa, Homo Sapiens
SRRLHHGTR

SEQ ID NO: 388912 - protein, 9 aa, Homo Sapiens
TLTPIPQSE

SEQ ID NO: 388913 - protein, 9 aa, Homo Sapiens
LQRVKEQSH

SEQ ID NO: 388914 - protein, 9 aa, Homo Sapiens
TPSNVLSMA

SEQ ID NO: 388915 - protein, 9 aa, Homo Sapiens
TIVAGSTVG

SEQ ID NO: 388916 - protein, 9 aa, Homo Sapiens
GTCCWAWTA

SEQ ID NO: 388917 - protein, 9 aa, Homo Sapiens
QQLGSWVAT

SEQ ID NO: 388918 - protein, 9 aa, Homo Sapiens
GWRWGWGQL

SEQ ID NO: 388919 - protein, 9 aa, Homo Sapiens
RQEEECRRQ

SEQ ID NO: 388920 - protein, 9 aa, Homo Sapiens
QQHNNLHMD

SEQ ID NO: 388921 - protein, 9 aa, Homo Sapiens
RTQTSFLKA

SEQ ID NO: 388922 - protein, 9 aa, Homo Sapiens
STVFPPTHN

SEQ ID NO: 388923 - protein, 9 aa, Homo Sapiens
TCMYASPEQ

SEQ ID NO: 388924 - protein, 9 aa, Homo Sapiens
IKSIAAALK

SEQ ID NO: 388925 - protein, 9 aa, Homo Sapiens
VTCEGFPTM

SEQ ID NO: 388926 - protein, 9 aa, Homo Sapiens
GLAGDIQVG

SEQ ID NO: 388927 - protein, 9 aa, Homo Sapiens
SNTTRTLRE

SEQ ID NO: 388928 - protein, 9 aa, Homo Sapiens
IFARSTSRA

SEQ ID NO: 388929 - protein, 9 aa, Homo Sapiens
QAVQHNGRI

SEQ ID NO: 388930 - protein, 9 aa, Homo Sapiens
PLKKMSMPA

SEQ ID NO: 388931 - protein, 9 aa, Homo Sapiens
KNPGFAAAV

SEQ ID NO: 388932 - protein, 9 aa, Homo Sapiens
VCDRKDRTV

SEQ ID NO: 388933 - protein, 9 aa, Homo Sapiens
TSLSPFATP

SEQ ID NO: 388934 - protein, 9 aa, Homo Sapiens
TVITSNPLP

SEQ ID NO: 388935 - protein, 9 aa, Homo Sapiens
NRTKREPNK

SEQ ID NO: 388936 - protein, 9 aa, Homo Sapiens
RPQAPPKSS

SEQ ID NO: 388937 - protein, 9 aa, Homo Sapiens
SMVEQPTGM

SEQ ID NO: 388938 - protein, 9 aa, Homo Sapiens
KLESPALKQ

SEQ ID NO: 388939 - protein, 9 aa, Homo Sapiens
LGKGTEVPW

SEQ ID NO: 388940 - protein, 9 aa, Homo Sapiens
LQVTTTLKL

SEQ ID NO: 388941 - protein, 9 aa, Homo Sapiens
GKGIEKARV

SEQ ID NO: 388942 - protein, 9 aa, Homo Sapiens
EMPGSSRRL

SEQ ID NO: 388943 - protein, 9 aa, Homo Sapiens
NINSGETKT

SEQ ID NO: 388944 - protein, 9 aa, Homo Sapiens
QTLKDGRHL

SEQ ID NO: 388945 - protein, 9 aa, Homo Sapiens
TLSPQGPRI

SEQ ID NO: 388946 - protein, 9 aa, Homo Sapiens
ERSPGHPRG

SEQ ID NO: 388947 - protein, 9 aa, Homo Sapiens
VEHRDNLVV

SEQ ID NO: 388948 - protein, 9 aa, Homo Sapiens
EHRVKAAVG

SEQ ID NO: 388949 - protein, 9 aa, Homo Sapiens
PSTTRRDSW

SEQ ID NO: 388950 - protein, 9 aa, Homo Sapiens
RVSAQNVFH

SEQ ID NO: 388951 - protein, 9 aa, Homo Sapiens
KRKKMFLIQ

SEQ ID NO: 388952 - protein, 9 aa, Homo Sapiens
SPDRRGSAW

SEQ ID NO: 388953 - protein, 9 aa, Homo Sapiens
ASGTSRARG

SEQ ID NO: 388954 - protein, 9 aa, Homo Sapiens
HAILEALVA

SEQ ID NO: 388955 - protein, 9 aa, Homo Sapiens
TTKFLDHSD

SEQ ID NO: 388956 - protein, 9 aa, Homo Sapiens
DPRVLVPPI

SEQ ID NO: 388957 - protein, 9 aa, Homo Sapiens
ASQVGGTQE

SEQ ID NO: 388958 - protein, 9 aa, Homo Sapiens
AVDPMADIA

SEQ ID NO: 388959 - protein, 9 aa, Homo Sapiens
IYDMLNDLA

SEQ ID NO: 388960 - protein, 9 aa, Homo Sapiens
PEETVTVTA

SEQ ID NO: 388961 - protein, 9 aa, Homo Sapiens
LGLDEGVST

SEQ ID NO: 388962 - protein, 9 aa, Homo Sapiens
LQVVTDHDI

SEQ ID NO: 388963 - protein, 9 aa, Homo Sapiens
GERSYGMVM

SEQ ID NO: 388964 - protein, 9 aa, Homo Sapiens
HIVPVWILD

SEQ ID NO: 388965 - protein, 9 aa, Homo Sapiens
TWGDTTFQR

SEQ ID NO: 388966 - protein, 9 aa, Homo Sapiens
TWTQFRNYP

SEQ ID NO: 388967 - protein, 9 aa, Homo Sapiens
GGVVDNNHC

SEQ ID NO: 388968 - protein, 9 aa, Homo Sapiens
ALSALFIWP

SEQ ID NO: 388969 - protein, 9 aa, Homo Sapiens
SRGAGPQSG

SEQ ID NO: 388970 - protein, 9 aa, Homo Sapiens
EYNVEHYVD

SEQ ID NO: 388971 - protein, 9 aa, Homo Sapiens
QLGRGTMSV

SEQ ID NO: 388972 - protein, 9 aa, Homo Sapiens
DDRRSCNDC

SEQ ID NO: 388973 - protein, 9 aa, Homo Sapiens
AGSWTSCGS

SEQ ID NO: 388974 - protein, 9 aa, Homo Sapiens
QAPFLPRAL

SEQ ID NO: 388975 - protein, 9 aa, Homo Sapiens
LKGKGIEKA

SEQ ID NO: 388976 - protein, 9 aa, Homo Sapiens
NVFHKFSNS

SEQ ID NO: 388977 - protein, 9 aa, Homo Sapiens
VMGPQDHLT

SEQ ID NO: 388978 - protein, 9 aa, Homo Sapiens
GGYSGPSFS

SEQ ID NO: 388979 - protein, 9 aa, Homo Sapiens
VCATQHQLT

SEQ ID NO: 388980 - protein, 9 aa, Homo Sapiens
GLRPCGSPQ

SEQ ID NO: 388981 - protein, 9 aa, Homo Sapiens
MSPCPEETA

SEQ ID NO: 388982 - protein, 9 aa, Homo Sapiens
VFSFFFCLR

SEQ ID NO: 388983 - protein, 9 aa, Homo Sapiens
LQQLLSDLI

SEQ ID NO: 388984 - protein, 9 aa, Homo Sapiens
GPEGQFVSW

SEQ ID NO: 388985 - protein, 9 aa, Homo Sapiens
SHLVGGHPA

SEQ ID NO: 388986 - protein, 9 aa, Homo Sapiens
RFNARRFIS

SEQ ID NO: 388987 - protein, 9 aa, Homo Sapiens
SGAGGTRGP

SEQ ID NO: 388988 - protein, 9 aa, Homo Sapiens
TCRSCGVTG

SEQ ID NO: 388989 - protein, 9 aa, Homo Sapiens
SLASGTSRA

SEQ ID NO: 388990 - protein, 9 aa, Homo Sapiens
SDEDSYIVF

SEQ ID NO: 388991 - protein, 9 aa, Homo Sapiens
HVITLYNRT

SEQ ID NO: 388992 - protein, 9 aa, Homo Sapiens
SASRPTAAY

SEQ ID NO: 388993 - protein, 9 aa, Homo Sapiens
RMDQWMDKE

SEQ ID NO: 388994 - protein, 9 aa, Homo Sapiens
RLQSLLSLY

SEQ ID NO: 388995 - protein, 9 aa, Homo Sapiens
ATQHQLTPR

SEQ ID NO: 388996 - protein, 9 aa, Homo Sapiens
PKKKKKKIG

SEQ ID NO: 388997 - protein, 9 aa, Homo Sapiens
LAGKASHVD

SEQ ID NO: 388998 - protein, 9 aa, Homo Sapiens
LHPAIWVAD

SEQ ID NO: 388999 - protein, 9 aa, Homo Sapiens
KYFTLCESW

SEQ ID NO: 389000 - protein, 9 aa, Homo Sapiens
WNIKIRLLA

SEQ ID NO: 389001 - protein, 9 aa, Homo Sapiens
FASRTDSAR

SEQ ID NO: 389002 - protein, 9 aa, Homo Sapiens
QPSHLKVDK

SEQ ID NO: 389003 - protein, 9 aa, Homo Sapiens
LPKDLPLHF

SEQ ID NO: 389004 - protein, 9 aa, Homo Sapiens
ANRADRTGG

SEQ ID NO: 389005 - protein, 9 aa, Homo Sapiens
LQPRARQRQ

SEQ ID NO: 389006 - protein, 9 aa, Homo Sapiens
SFSHRSLAG

SEQ ID NO: 389007 - protein, 9 aa, Homo Sapiens
TPARSPTSA

SEQ ID NO: 389008 - protein, 9 aa, Homo Sapiens
CRAGWSPSP

SEQ ID NO: 389009 - protein, 9 aa, Homo Sapiens
AKPPAGGSP

SEQ ID NO: 389010 - protein, 9 aa, Homo Sapiens
SNPLPSFSH

SEQ ID NO: 389011 - protein, 9 aa, Homo Sapiens
RTYLGNVLV

SEQ ID NO: 389012 - protein, 9 aa, Homo Sapiens
NIMRMTAQA

SEQ ID NO: 389013 - protein, 9 aa, Homo Sapiens
SIRRLQQTQ

SEQ ID NO: 389014 - protein, 9 aa, Homo Sapiens
ESIFARSTS

SEQ ID NO: 389015 - protein, 9 aa, Homo Sapiens
HGSHRLFIL

SEQ ID NO: 389016 - protein, 9 aa, Homo Sapiens
PPGLRPCRC

SEQ ID NO: 389017 - protein, 9 aa, Homo Sapiens
DDGIMYAKC

SEQ ID NO: 389018 - protein, 9 aa, Homo Sapiens
ECHASIVEV

SEQ ID NO: 389019 - protein, 9 aa, Homo Sapiens
LKNFTVGHQ

SEQ ID NO: 389020 - protein, 9 aa, Homo Sapiens
SAPCCWRLW

SEQ ID NO: 389021 - protein, 9 aa, Homo Sapiens
QPAWKIVLW

SEQ ID NO: 389022 - protein, 9 aa, Homo Sapiens
IIRFLPMTK

SEQ ID NO: 389023 - protein, 9 aa, Homo Sapiens
LLQLAHLIH

SEQ ID NO: 389024 - protein, 9 aa, Homo Sapiens
GVKSQIQAL

SEQ ID NO: 389025 - protein, 9 aa, Homo Sapiens
RQLAIIRDD

SEQ ID NO: 389026 - protein, 9 aa, Homo Sapiens
PLHHFYLTL

SEQ ID NO: 389027 - protein, 9 aa, Homo Sapiens
LLFSFDVHD

SEQ ID NO: 389028 - protein, 9 aa, Homo Sapiens
TTKDNILPF

SEQ ID NO: 389029 - protein, 9 aa, Homo Sapiens
LLLNNRMVS

SEQ ID NO: 389030 - protein, 9 aa, Homo Sapiens
VGLGVQVLP

SEQ ID NO: 389031 - protein, 9 aa, Homo Sapiens
FVASPGRRD

SEQ ID NO: 389032 - protein, 9 aa, Homo Sapiens
HHLLYPGIV

SEQ ID NO: 389033 - protein, 9 aa, Homo Sapiens
TGPENVVCG

SEQ ID NO: 389034 - protein, 9 aa, Homo Sapiens
LTLTLSDLP

SEQ ID NO: 389035 - protein, 9 aa, Homo Sapiens
NGVMPTIGQ

SEQ ID NO: 389036 - protein, 9 aa, Homo Sapiens
TTFTLVTRG

SEQ ID NO: 389037 - protein, 9 aa, Homo Sapiens
DVNPPVSHY

SEQ ID NO: 389038 - protein, 9 aa, Homo Sapiens
VLWLLITTQ

SEQ ID NO: 389039 - protein, 9 aa, Homo Sapiens
WGWGQLLLL

SEQ ID NO: 389040 - protein, 9 aa, Homo Sapiens
WGQLCLPPR

SEQ ID NO: 389041 - protein, 9 aa, Homo Sapiens
GGPVLVSDP

SEQ ID NO: 389042 - protein, 9 aa, Homo Sapiens
TFTVVQNER

SEQ ID NO: 389043 - protein, 9 aa, Homo Sapiens
TRHPNMELC

SEQ ID NO: 389044 - protein, 9 aa, Homo Sapiens
VQKKEEVFL

SEQ ID NO: 389045 - protein, 9 aa, Homo Sapiens
LHSATMGSD

SEQ ID NO: 389046 - protein, 9 aa, Homo Sapiens
YMKPDNGAI

SEQ ID NO: 389047 - protein, 9 aa, Homo Sapiens
QHLILWHPH

SEQ ID NO: 389048 - protein, 9 aa, Homo Sapiens
LTIGEKTEI

SEQ ID NO: 389049 - protein, 9 aa, Homo Sapiens
LRIWVPAQV

SEQ ID NO: 389050 - protein, 9 aa, Homo Sapiens
ASALHPSLC

SEQ ID NO: 389051 - protein, 9 aa, Homo Sapiens
RCFSQVLSA

SEQ ID NO: 389052 - protein, 9 aa, Homo Sapiens
WITPELRLQ

SEQ ID NO: 389053 - protein, 9 aa, Homo Sapiens
DGRHRKLGL

SEQ ID NO: 389054 - protein, 9 aa, Homo Sapiens
HRLFILRQP

SEQ ID NO: 389055 - protein, 9 aa, Homo Sapiens
VGEGEVAAD

SEQ ID NO: 389056 - protein, 9 aa, Homo Sapiens
KSIFASKVE

SEQ ID NO: 389057 - protein, 9 aa, Homo Sapiens
ALVLLAPAT

SEQ ID NO: 389058 - protein, 9 aa, Homo Sapiens
ACPECDKAF

SEQ ID NO: 389059 - protein, 9 aa, Homo Sapiens
PPPNMTSIR

SEQ ID NO: 389060 - protein, 9 aa, Homo Sapiens
TLPPTRSSP

SEQ ID NO: 389061 - protein, 9 aa, Homo Sapiens
GRPAHSATG

SEQ ID NO: 389062 - protein, 9 aa, Homo Sapiens
VEDTVKNAE

SEQ ID NO: 389063 - protein, 9 aa, Homo Sapiens
WIMLFLILY

SEQ ID NO: 389064 - protein, 9 aa, Homo Sapiens
HQQRLWEIQ

SEQ ID NO: 389065 - protein, 9 aa, Homo Sapiens
KELVIGHYY

SEQ ID NO: 389066 - protein, 9 aa, Homo Sapiens
PPFGLIPRL

SEQ ID NO: 389067 - protein, 9 aa, Homo Sapiens
PVNSSNPFL

SEQ ID NO: 389068 - protein, 9 aa, Homo Sapiens
RTTPPRYRA

SEQ ID NO: 389069 - protein, 9 aa, Homo Sapiens
PAQDTRCTD

SEQ ID NO: 389070 - protein, 9 aa, Homo Sapiens
DPAGSPRPG

SEQ ID NO: 389071 - protein, 9 aa, Homo Sapiens
ADACFVNCV

SEQ ID NO: 389072 - protein, 9 aa, Homo Sapiens
KRHLTGIGS

SEQ ID NO: 389073 - protein, 9 aa, Homo Sapiens
ETYRRLWTL

SEQ ID NO: 389074 - protein, 9 aa, Homo Sapiens
GPAARPQPL

SEQ ID NO: 389075 - protein, 9 aa, Homo Sapiens
YIFQNVMVM

SEQ ID NO: 389076 - protein, 9 aa, Homo Sapiens
WNYMKLLLE

SEQ ID NO: 389077 - protein, 9 aa, Homo Sapiens
SVSIEGSVD

SEQ ID NO: 389078 - protein, 9 aa, Homo Sapiens
VRLRDGDCY

SEQ ID NO: 389079 - protein, 9 aa, Homo Sapiens
TICARETTA

SEQ ID NO: 389080 - protein, 9 aa, Homo Sapiens
TNTATAASA

SEQ ID NO: 389081 - protein, 9 aa, Homo Sapiens
TIFMGHCYS

SEQ ID NO: 389082 - protein, 9 aa, Homo Sapiens
FFRRCRPRL

SEQ ID NO: 389083 - protein, 9 aa, Homo Sapiens
KGKRHLTGI

SEQ ID NO: 389084 - protein, 9 aa, Homo Sapiens
GGGAGVVAL

SEQ ID NO: 389085 - protein, 9 aa, Homo Sapiens
LMGPWHLCM

SEQ ID NO: 389086 - protein, 9 aa, Homo Sapiens
KKVEQDTGL

SEQ ID NO: 389087 - protein, 9 aa, Homo Sapiens
GDAGVGHAQ

SEQ ID NO: 389088 - protein, 9 aa, Homo Sapiens
RARRARGTL

SEQ ID NO: 389089 - protein, 9 aa, Homo Sapiens
RPAPRRKSP

SEQ ID NO: 389090 - protein, 9 aa, Homo Sapiens
PVTPSNVLS

SEQ ID NO: 389091 - protein, 9 aa, Homo Sapiens
TYLFVLLEN

SEQ ID NO: 389092 - protein, 9 aa, Homo Sapiens
LATWPTPPE

SEQ ID NO: 389093 - protein, 9 aa, Homo Sapiens
GSGNTSLSS

SEQ ID NO: 389094 - protein, 9 aa, Homo Sapiens
TAAGASGWS

SEQ ID NO: 389095 - protein, 9 aa, Homo Sapiens
VPLGNLSPG

SEQ ID NO: 389096 - protein, 9 aa, Homo Sapiens
VPLRTPWVG

SEQ ID NO: 389097 - protein, 9 aa, Homo Sapiens
RAGFVLAQS

SEQ ID NO: 389098 - protein, 9 aa, Homo Sapiens
GFLQVPQGL

SEQ ID NO: 389099 - protein, 9 aa, Homo Sapiens
FITASRGGS

SEQ ID NO: 389100 - protein, 9 aa, Homo Sapiens
RRSKVKITL

SEQ ID NO: 389101 - protein, 9 aa, Homo Sapiens
VTRKIIRQY

SEQ ID NO: 389102 - protein, 9 aa, Homo Sapiens
ALTVAEVSC

SEQ ID NO: 389103 - protein, 9 aa, Homo Sapiens
DTTFERARP

SEQ ID NO: 389104 - protein, 9 aa, Homo Sapiens
PLTSRFTRG

SEQ ID NO: 389105 - protein, 9 aa, Homo Sapiens
PENRPLVWS

SEQ ID NO: 389106 - protein, 9 aa, Homo Sapiens
QTPQDSRQV

SEQ ID NO: 389107 - protein, 9 aa, Homo Sapiens
TAVGVEKMT

SEQ ID NO: 389108 - protein, 9 aa, Homo Sapiens
RPHWTLSPQ

SEQ ID NO: 389109 - protein, 9 aa, Homo Sapiens
LPAGAIHFR

SEQ ID NO: 389110 - protein, 9 aa, Homo Sapiens
PPPTIPPAW

SEQ ID NO: 389111 - protein, 9 aa, Homo Sapiens
DLTDRAKVW

SEQ ID NO: 389112 - protein, 9 aa, Homo Sapiens
QIEEPIEKP

SEQ ID NO: 389113 - protein, 9 aa, Homo Sapiens
GQGLFAVLR

SEQ ID NO: 389114 - protein, 9 aa, Homo Sapiens
STPACSCST

SEQ ID NO: 389115 - protein, 9 aa, Homo Sapiens
PLPLKQRAE

SEQ ID NO: 389116 - protein, 9 aa, Homo Sapiens
SRCYEHQRV

SEQ ID NO: 389117 - protein, 9 aa, Homo Sapiens
HRPQDRRSS

SEQ ID NO: 389118 - protein, 9 aa, Homo Sapiens
AHRHYASPE

SEQ ID NO: 389119 - protein, 9 aa, Homo Sapiens
HSRRSQTKW

SEQ ID NO: 389120 - protein, 9 aa, Homo Sapiens
SLFEETKWK

SEQ ID NO: 389121 - protein, 9 aa, Homo Sapiens
AAAEGPAAP

SEQ ID NO: 389122 - protein, 9 aa, Homo Sapiens
RGSLNTNRA

SEQ ID NO: 389123 - protein, 9 aa, Homo Sapiens
IRASPHSTT

SEQ ID NO: 389124 - protein, 9 aa, Homo Sapiens
KNAEPTKRP

SEQ ID NO: 389125 - protein, 9 aa, Homo Sapiens
AFEQVEELF

SEQ ID NO: 389126 - protein, 9 aa, Homo Sapiens
PGASCQNSS

SEQ ID NO: 389127 - protein, 9 aa, Homo Sapiens
PSAPPKMVS

SEQ ID NO: 389128 - protein, 9 aa, Homo Sapiens
DVQTLALTD

SEQ ID NO: 389129 - protein, 9 aa, Homo Sapiens
GPRPAPRRK

SEQ ID NO: 389130 - protein, 9 aa, Homo Sapiens
VNVFHKFSN

SEQ ID NO: 389131 - protein, 9 aa, Homo Sapiens
ITEELFLLV

SEQ ID NO: 389132 - protein, 9 aa, Homo Sapiens
GPPCSICSP

SEQ ID NO: 389133 - protein, 9 aa, Homo Sapiens
RPPCGQPTH

SEQ ID NO: 389134 - protein, 9 aa, Homo Sapiens
QPAGHLHLV

SEQ ID NO: 389135 - protein, 9 aa, Homo Sapiens
SKKDTWSFG

SEQ ID NO: 389136 - protein, 9 aa, Homo Sapiens
ISTFGTSIT

SEQ ID NO: 389137 - protein, 9 aa, Homo Sapiens
SRIIAKKCI

SEQ ID NO: 389138 - protein, 9 aa, Homo Sapiens
ARATSGTAP

SEQ ID NO: 389139 - protein, 9 aa, Homo Sapiens
GTIMDHSII

SEQ ID NO: 389140 - protein, 9 aa, Homo Sapiens
HLTGLALFL

SEQ ID NO: 389141 - protein, 9 aa, Homo Sapiens
TRRPRWTSA

SEQ ID NO: 389142 - protein, 9 aa, Homo Sapiens
GLSYGLLGD

SEQ ID NO: 389143 - protein, 9 aa, Homo Sapiens
KELESEGRV

SEQ ID NO: 389144 - protein, 9 aa, Homo Sapiens
EGNSVSTTC

SEQ ID NO: 389145 - protein, 9 aa, Homo Sapiens
GKQDIMPEV

SEQ ID NO: 389146 - protein, 9 aa, Homo Sapiens
TLKKISGRS

SEQ ID NO: 389147 - protein, 9 aa, Homo Sapiens
LTGQRGRHS

SEQ ID NO: 389148 - protein, 9 aa, Homo Sapiens
TPAPPWQPP

SEQ ID NO: 389149 - protein, 9 aa, Homo Sapiens
RFFHVLFFT

SEQ ID NO: 389150 - protein, 9 aa, Homo Sapiens
SPLAPCPPL

SEQ ID NO: 389151 - protein, 9 aa, Homo Sapiens
PQPRPSTPA

SEQ ID NO: 389152 - protein, 9 aa, Homo Sapiens
DDSSDSSPK

SEQ ID NO: 389153 - protein, 9 aa, Homo Sapiens
DRYQQSKDA

SEQ ID NO: 389154 - protein, 9 aa, Homo Sapiens
ENKQQESSF

SEQ ID NO: 389155 - protein, 9 aa, Homo Sapiens
MESLPENRP

SEQ ID NO: 389156 - protein, 9 aa, Homo Sapiens
LGCAHILVI

SEQ ID NO: 389157 - protein, 9 aa, Homo Sapiens
RVFLVRSRR

SEQ ID NO: 389158 - protein, 9 aa, Homo Sapiens
WLLGGLPKD

SEQ ID NO: 389159 - protein, 9 aa, Homo Sapiens
SFTRRSFGA

SEQ ID NO: 389160 - protein, 9 aa, Homo Sapiens
DWKTTFTVV

SEQ ID NO: 389161 - protein, 9 aa, Homo Sapiens
PHSSPPVGW

SEQ ID NO: 389162 - protein, 9 aa, Homo Sapiens
KLSTVRKRV

SEQ ID NO: 389163 - protein, 9 aa, Homo Sapiens
KNNLTGQRG

SEQ ID NO: 389164 - protein, 9 aa, Homo Sapiens
ALALDVAVQ

SEQ ID NO: 389165 - protein, 9 aa, Homo Sapiens
LNSSQNLFV

SEQ ID NO: 389166 - protein, 9 aa, Homo Sapiens
VEEDVENTV

SEQ ID NO: 389167 - protein, 9 aa, Homo Sapiens
SLKGDTSKE

SEQ ID NO: 389168 - protein, 9 aa, Homo Sapiens
HTAAWSCAP

SEQ ID NO: 389169 - protein, 9 aa, Homo Sapiens
FADNPTSCL

SEQ ID NO: 389170 - protein, 9 aa, Homo Sapiens
NYMKLLLEQ

SEQ ID NO: 389171 - protein, 9 aa, Homo Sapiens
MLIIEKVLK

SEQ ID NO: 389172 - protein, 9 aa, Homo Sapiens
LFTDDSYVQ

SEQ ID NO: 389173 - protein, 9 aa, Homo Sapiens
DKTLSVSIE

SEQ ID NO: 389174 - protein, 9 aa, Homo Sapiens
DLKQRREIC

SEQ ID NO: 389175 - protein, 9 aa, Homo Sapiens
QPPRGWRSR

SEQ ID NO: 389176 - protein, 9 aa, Homo Sapiens
GEVERHIVS

SEQ ID NO: 389177 - protein, 9 aa, Homo Sapiens
SFCQPHKIH

SEQ ID NO: 389178 - protein, 9 aa, Homo Sapiens
SEIEVHFVT

SEQ ID NO: 389179 - protein, 9 aa, Homo Sapiens
LASQLIGRS

SEQ ID NO: 389180 - protein, 9 aa, Homo Sapiens
AFFKPQICP

SEQ ID NO: 389181 - protein, 9 aa, Homo Sapiens
STIGTFSTR

SEQ ID NO: 389182 - protein, 9 aa, Homo Sapiens
DQLGPSFHS

SEQ ID NO: 389183 - protein, 9 aa, Homo Sapiens
AAVYNAARD

SEQ ID NO: 389184 - protein, 9 aa, Homo Sapiens
LGDRTRLGG

SEQ ID NO: 389185 - protein, 9 aa, Homo Sapiens
LFAVLRGRG

SEQ ID NO: 389186 - protein, 9 aa, Homo Sapiens
VLKKAFQAM

SEQ ID NO: 389187 - protein, 9 aa, Homo Sapiens
DQDTDTIAV

SEQ ID NO: 389188 - protein, 9 aa, Homo Sapiens
TTPPIGPSC

SEQ ID NO: 389189 - protein, 9 aa, Homo Sapiens
SAWCSSWEA

SEQ ID NO: 389190 - protein, 9 aa, Homo Sapiens
TTLASRANG

SEQ ID NO: 389191 - protein, 9 aa, Homo Sapiens
SVARPSTTR

SEQ ID NO: 389192 - protein, 9 aa, Homo Sapiens
RKFLDTGLA

SEQ ID NO: 389193 - protein, 9 aa, Homo Sapiens
ILAAGLSYG

SEQ ID NO: 389194 - protein, 9 aa, Homo Sapiens
PTWCRTGAS

SEQ ID NO: 389195 - protein, 9 aa, Homo Sapiens
QGLGPPAPP

SEQ ID NO: 389196 - protein, 9 aa, Homo Sapiens
AYSDSWHVD

SEQ ID NO: 389197 - protein, 9 aa, Homo Sapiens
CEGKQFDSP

SEQ ID NO: 389198 - protein, 9 aa, Homo Sapiens
STRGSSGAG

SEQ ID NO: 389199 - protein, 9 aa, Homo Sapiens
GALGSMVGL

SEQ ID NO: 389200 - protein, 9 aa, Homo Sapiens
EREKHHMLK

SEQ ID NO: 389201 - protein, 9 aa, Homo Sapiens
EGIKRKKQQ

SEQ ID NO: 389202 - protein, 9 aa, Homo Sapiens
FTRHSLKAR

SEQ ID NO: 389203 - protein, 9 aa, Homo Sapiens
TKWKAEQME

SEQ ID NO: 389204 - protein, 9 aa, Homo Sapiens
VSGLSKGER

SEQ ID NO: 389205 - protein, 9 aa, Homo Sapiens
ISSKRTSSF

SEQ ID NO: 389206 - protein, 9 aa, Homo Sapiens
PGSARSASA

SEQ ID NO: 389207 - protein, 9 aa, Homo Sapiens
RAREALVAE

SEQ ID NO: 389208 - protein, 9 aa, Homo Sapiens
LPVDEVNMP

SEQ ID NO: 389209 - protein, 9 aa, Homo Sapiens
TRRSSNKPL

SEQ ID NO: 389210 - protein, 9 aa, Homo Sapiens
VGPLPCVLP

SEQ ID NO: 389211 - protein, 9 aa, Homo Sapiens
SAPGSARSA

SEQ ID NO: 389212 - protein, 9 aa, Homo Sapiens
PVLVSDPIS

SEQ ID NO: 389213 - protein, 9 aa, Homo Sapiens
TATRSTTLA

SEQ ID NO: 389214 - protein, 9 aa, Homo Sapiens
RVLARFYSP

SEQ ID NO: 389215 - protein, 9 aa, Homo Sapiens
RGPSTPACS

SEQ ID NO: 389216 - protein, 9 aa, Homo Sapiens
DPNNYRTRI

SEQ ID NO: 389217 - protein, 9 aa, Homo Sapiens
TPASGPSPA

SEQ ID NO: 389218 - protein, 9 aa, Homo Sapiens
REARRTSGA

SEQ ID NO: 389219 - protein, 9 aa, Homo Sapiens
GYPIQQVAC

SEQ ID NO: 389220 - protein, 9 aa, Homo Sapiens
GRPQDKLEV

SEQ ID NO: 389221 - protein, 9 aa, Homo Sapiens
SRHPFFQLI

SEQ ID NO: 389222 - protein, 9 aa, Homo Sapiens
VQEDCHIPQ

SEQ ID NO: 389223 - protein, 9 aa, Homo Sapiens
LDIITSKVS

SEQ ID NO: 389224 - protein, 9 aa, Homo Sapiens
RDVKKVDAQ

SEQ ID NO: 389225 - protein, 9 aa, Homo Sapiens
EEEPLLGEE

SEQ ID NO: 389226 - protein, 9 aa, Homo Sapiens
TRFACFTWR

SEQ ID NO: 389227 - protein, 9 aa, Homo Sapiens
RTGASTRAS

SEQ ID NO: 389228 - protein, 9 aa, Homo Sapiens
ASPRAAIWR

SEQ ID NO: 389229 - protein, 9 aa, Homo Sapiens
ECGRAFFIS

SEQ ID NO: 389230 - protein, 9 aa, Homo Sapiens
LLRGLGLQL

SEQ ID NO: 389231 - protein, 9 aa, Homo Sapiens
GQKPMARTS

SEQ ID NO: 389232 - protein, 9 aa, Homo Sapiens
RRARGTLEA

SEQ ID NO: 389233 - protein, 9 aa, Homo Sapiens
FFCDAPPLS

SEQ ID NO: 389234 - protein, 9 aa, Homo Sapiens
VDMGHGVTY

SEQ ID NO: 389235 - protein, 9 aa, Homo Sapiens
LTTAVEVTQ

SEQ ID NO: 389236 - protein, 9 aa, Homo Sapiens
SASRGPSTP

SEQ ID NO: 389237 - protein, 9 aa, Homo Sapiens
AGPAGVLHT

SEQ ID NO: 389238 - protein, 9 aa, Homo Sapiens
WKCRLNRHQ

SEQ ID NO: 389239 - protein, 9 aa, Homo Sapiens
TRKYDFHLK

SEQ ID NO: 389240 - protein, 9 aa, Homo Sapiens
TPLVCEGLT

SEQ ID NO: 389241 - protein, 9 aa, Homo Sapiens
TPHIGPKVS

SEQ ID NO: 389242 - protein, 9 aa, Homo Sapiens
VLPGEADLA

SEQ ID NO: 389243 - protein, 9 aa, Homo Sapiens
APTHVNHNI

SEQ ID NO: 389244 - protein, 9 aa, Homo Sapiens
GKMRQLGQA

SEQ ID NO: 389245 - protein, 9 aa, Homo Sapiens
SESPPAPSM

SEQ ID NO: 389246 - protein, 9 aa, Homo Sapiens
ILMIRWLLC

SEQ ID NO: 389247 - protein, 9 aa, Homo Sapiens
DLVTNGCIS

SEQ ID NO: 389248 - protein, 9 aa, Homo Sapiens
APEESEAGN

SEQ ID NO: 389249 - protein, 9 aa, Homo Sapiens
QHQQRLWEI

SEQ ID NO: 389250 - protein, 9 aa, Homo Sapiens
PSQLECHSR

SEQ ID NO: 389251 - protein, 9 aa, Homo Sapiens
SSSSWQAQH

SEQ ID NO: 389252 - protein, 9 aa, Homo Sapiens
WAEGRGPQT

SEQ ID NO: 389253 - protein, 9 aa, Homo Sapiens
CTKKLRSPE

SEQ ID NO: 389254 - protein, 9 aa, Homo Sapiens
FLAKHHLLY

SEQ ID NO: 389255 - protein, 9 aa, Homo Sapiens
ASLSSLTRQ

SEQ ID NO: 389256 - protein, 9 aa, Homo Sapiens
PTYKWLKMA

SEQ ID NO: 389257 - protein, 9 aa, Homo Sapiens
WKTFQGLVC

SEQ ID NO: 389258 - protein, 9 aa, Homo Sapiens
DPIIKLLCV

SEQ ID NO: 389259 - protein, 9 aa, Homo Sapiens
KKLKLAPLQ

SEQ ID NO: 389260 - protein, 9 aa, Homo Sapiens
CMSVIQSGT

SEQ ID NO: 389261 - protein, 9 aa, Homo Sapiens
PEVLQDPLD

SEQ ID NO: 389262 - protein, 9 aa, Homo Sapiens
FPMHAKGPS

SEQ ID NO: 389263 - protein, 9 aa, Homo Sapiens
VRAHAWSQD

SEQ ID NO: 389264 - protein, 9 aa, Homo Sapiens
CLETLNTKQ

SEQ ID NO: 389265 - protein, 9 aa, Homo Sapiens
LIGLKREDK

SEQ ID NO: 389266 - protein, 9 aa, Homo Sapiens
QEEEPLLGE

SEQ ID NO: 389267 - protein, 9 aa, Homo Sapiens
KYLKKQKLV

SEQ ID NO: 389268 - protein, 9 aa, Homo Sapiens
VPAPYSSGA

SEQ ID NO: 389269 - protein, 9 aa, Homo Sapiens
CTSLTTAST

SEQ ID NO: 389270 - protein, 9 aa, Homo Sapiens
SPTWCRTGA

SEQ ID NO: 389271 - protein, 9 aa, Homo Sapiens
RFTRGSSQS

SEQ ID NO: 389272 - protein, 9 aa, Homo Sapiens
PTAATTAAT

SEQ ID NO: 389273 - protein, 9 aa, Homo Sapiens
SQTLGTRQT

SEQ ID NO: 389274 - protein, 9 aa, Homo Sapiens
LESLLLYTL

SEQ ID NO: 389275 - protein, 9 aa, Homo Sapiens
KSRRYFSNP

SEQ ID NO: 389276 - protein, 9 aa, Homo Sapiens
SHHTSLTTG

SEQ ID NO: 389277 - protein, 9 aa, Homo Sapiens
LLLGLLTEC

SEQ ID NO: 389278 - protein, 9 aa, Homo Sapiens
LFLPGLLFS

SEQ ID NO: 389279 - protein, 9 aa, Homo Sapiens
ITQVILMYI

SEQ ID NO: 389280 - protein, 9 aa, Homo Sapiens
LLCKDDPKF

SEQ ID NO: 389281 - protein, 9 aa, Homo Sapiens
SYKEGMKIE

SEQ ID NO: 389282 - protein, 9 aa, Homo Sapiens
TPGRPWPPS

SEQ ID NO: 389283 - protein, 9 aa, Homo Sapiens
GSYSCKCVA

SEQ ID NO: 389284 - protein, 9 aa, Homo Sapiens
LVFSFFFCL

SEQ ID NO: 389285 - protein, 9 aa, Homo Sapiens
AHTGRKKRA

SEQ ID NO: 389286 - protein, 9 aa, Homo Sapiens
PGARRPLRR

SEQ ID NO: 389287 - protein, 9 aa, Homo Sapiens
SRKERKAAG

SEQ ID NO: 389288 - protein, 9 aa, Homo Sapiens
VFLTLTLSD

SEQ ID NO: 389289 - protein, 9 aa, Homo Sapiens
RMRELFQID

SEQ ID NO: 389290 - protein, 9 aa, Homo Sapiens
AYYYYFITL

SEQ ID NO: 389291 - protein, 9 aa, Homo Sapiens
RGGSWPPAL

SEQ ID NO: 389292 - protein, 9 aa, Homo Sapiens
LGSWVATGL

SEQ ID NO: 389293 - protein, 9 aa, Homo Sapiens
ILNPVADIY

SEQ ID NO: 389294 - protein, 9 aa, Homo Sapiens
AKAEKRKPA

SEQ ID NO: 389295 - protein, 9 aa, Homo Sapiens
PLQPRARQR

SEQ ID NO: 389296 - protein, 9 aa, Homo Sapiens
ARAHQSSPW

SEQ ID NO: 389297 - protein, 9 aa, Homo Sapiens
PPCSICSPE

SEQ ID NO: 389298 - protein, 9 aa, Homo Sapiens
GPKLDSRAD

SEQ ID NO: 389299 - protein, 9 aa, Homo Sapiens
QSKRPLGMD

SEQ ID NO: 389300 - protein, 9 aa, Homo Sapiens
KRQEEECRR

SEQ ID NO: 389301 - protein, 9 aa, Homo Sapiens
RMEAHTGRK

SEQ ID NO: 389302 - protein, 9 aa, Homo Sapiens
RCMSDLTCV

SEQ ID NO: 389303 - protein, 9 aa, Homo Sapiens
GKKIAFHIK

SEQ ID NO: 389304 - protein, 9 aa, Homo Sapiens
CVLPHVDFQ

SEQ ID NO: 389305 - protein, 9 aa, Homo Sapiens
EELFLLVSL

SEQ ID NO: 389306 - protein, 9 aa, Homo Sapiens
KDPRVLVPP

SEQ ID NO: 389307 - protein, 9 aa, Homo Sapiens
DRFNARRFI

SEQ ID NO: 389308 - protein, 9 aa, Homo Sapiens
KALQCTAGG

SEQ ID NO: 389309 - protein, 9 aa, Homo Sapiens
REWDPDKAT

SEQ ID NO: 389310 - protein, 9 aa, Homo Sapiens
FCSSYTMRV

SEQ ID NO: 389311 - protein, 9 aa, Homo Sapiens
SKHKLESPA

SEQ ID NO: 389312 - protein, 9 aa, Homo Sapiens
DLTVLGQPG

SEQ ID NO: 389313 - protein, 9 aa, Homo Sapiens
EPLCATHWD

SEQ ID NO: 389314 - protein, 9 aa, Homo Sapiens
PFLSMYLVT

SEQ ID NO: 389315 - protein, 9 aa, Homo Sapiens
GPFLSMYLV

SEQ ID NO: 389316 - protein, 9 aa, Homo Sapiens
TPRSEIATE

SEQ ID NO: 389317 - protein, 9 aa, Homo Sapiens
ARGTLEARE

SEQ ID NO: 389318 - protein, 9 aa, Homo Sapiens
RIMYFLEEP

SEQ ID NO: 389319 - protein, 9 aa, Homo Sapiens
TTILNPQDT

SEQ ID NO: 389320 - protein, 9 aa, Homo Sapiens
TSTSRARGS

SEQ ID NO: 389321 - protein, 9 aa, Homo Sapiens
DIEHRVKAA

SEQ ID NO: 389322 - protein, 9 aa, Homo Sapiens
SIEGRSNVG

SEQ ID NO: 389323 - protein, 9 aa, Homo Sapiens
TLADQSPGS

SEQ ID NO: 389324 - protein, 9 aa, Homo Sapiens
VMFRLYDSD

SEQ ID NO: 389325 - protein, 9 aa, Homo Sapiens
TTLLSFGII

SEQ ID NO: 389326 - protein, 9 aa, Homo Sapiens
GFTMMSLAA

SEQ ID NO: 389327 - protein, 9 aa, Homo Sapiens
DENAALIHV

SEQ ID NO: 389328 - protein, 9 aa, Homo Sapiens
GPPISITNT

SEQ ID NO: 389329 - protein, 9 aa, Homo Sapiens
MKVNFDILE

SEQ ID NO: 389330 - protein, 9 aa, Homo Sapiens
SRRCSVPGE

SEQ ID NO: 389331 - protein, 9 aa, Homo Sapiens
TQTSFLKAL

SEQ ID NO: 389332 - protein, 9 aa, Homo Sapiens
RGTSAAAST

SEQ ID NO: 389333 - protein, 9 aa, Homo Sapiens
LVKHQHVHT

SEQ ID NO: 389334 - protein, 9 aa, Homo Sapiens
QLFSPALLH

SEQ ID NO: 389335 - protein, 9 aa, Homo Sapiens
TTQAPRLLS

SEQ ID NO: 389336 - protein, 9 aa, Homo Sapiens
TRGSSGAGL

SEQ ID NO: 389337 - protein, 9 aa, Homo Sapiens
HARVDAHVV

SEQ ID NO: 389338 - protein, 9 aa, Homo Sapiens
PPKQQFLSS

SEQ ID NO: 389339 - protein, 9 aa, Homo Sapiens
GGASSAKRQ

SEQ ID NO: 389340 - protein, 9 aa, Homo Sapiens
TYSHRASLG

SEQ ID NO: 389341 - protein, 9 aa, Homo Sapiens
SKVETGLHV

SEQ ID NO: 389342 - protein, 9 aa, Homo Sapiens
FTSQNIMAT

SEQ ID NO: 389343 - protein, 9 aa, Homo Sapiens
RTPRASRAL

SEQ ID NO: 389344 - protein, 9 aa, Homo Sapiens
LMLEWTPPC

SEQ ID NO: 389345 - protein, 9 aa, Homo Sapiens
YENTTTKAL

SEQ ID NO: 389346 - protein, 9 aa, Homo Sapiens
SWHVDACPE

SEQ ID NO: 389347 - protein, 9 aa, Homo Sapiens
PLFFSFLFL

SEQ ID NO: 389348 - protein, 9 aa, Homo Sapiens
RVFAQRFRL

SEQ ID NO: 389349 - protein, 9 aa, Homo Sapiens
PALWAPAGT

SEQ ID NO: 389350 - protein, 9 aa, Homo Sapiens
KLKESCVQR

SEQ ID NO: 389351 - protein, 9 aa, Homo Sapiens
DLLLPVDEV

SEQ ID NO: 389352 - protein, 9 aa, Homo Sapiens
AAASGPCHA

SEQ ID NO: 389353 - protein, 9 aa, Homo Sapiens
GCYLCQPDS

SEQ ID NO: 389354 - protein, 9 aa, Homo Sapiens
SITSVTLRP

SEQ ID NO: 389355 - protein, 9 aa, Homo Sapiens
RTSGAGGTR

SEQ ID NO: 389356 - protein, 9 aa, Homo Sapiens
LFIWTPWRK

SEQ ID NO: 389357 - protein, 9 aa, Homo Sapiens
IDLCKGDRL

SEQ ID NO: 389358 - protein, 9 aa, Homo Sapiens
APCCWRLWP

SEQ ID NO: 389359 - protein, 9 aa, Homo Sapiens
MDAAGGDDD

SEQ ID NO: 389360 - protein, 9 aa, Homo Sapiens
CFVEFGAGT

SEQ ID NO: 389361 - protein, 9 aa, Homo Sapiens
KPLRGDPGV

SEQ ID NO: 389362 - protein, 9 aa, Homo Sapiens
ASRARRTTF

SEQ ID NO: 389363 - protein, 9 aa, Homo Sapiens
YYQMPSFEE

SEQ ID NO: 389364 - protein, 9 aa, Homo Sapiens
VVDTKILIL

SEQ ID NO: 389365 - protein, 9 aa, Homo Sapiens
GAAAEGPAA

SEQ ID NO: 389366 - protein, 9 aa, Homo Sapiens
MGLKSWISV

SEQ ID NO: 389367 - protein, 9 aa, Homo Sapiens
PVAFVCSKC

SEQ ID NO: 389368 - protein, 9 aa, Homo Sapiens
GNEATSAHY

SEQ ID NO: 389369 - protein, 9 aa, Homo Sapiens
TTPTSARSR

SEQ ID NO: 389370 - protein, 9 aa, Homo Sapiens
KRLSGFTGL

SEQ ID NO: 389371 - protein, 9 aa, Homo Sapiens
CQPPTALPP

SEQ ID NO: 389372 - protein, 9 aa, Homo Sapiens
RTVSSRGTF

SEQ ID NO: 389373 - protein, 9 aa, Homo Sapiens
IYDGEVCAA

SEQ ID NO: 389374 - protein, 9 aa, Homo Sapiens
AWCSSWEAT

SEQ ID NO: 389375 - protein, 9 aa, Homo Sapiens
AVGILAIGE

SEQ ID NO: 389376 - protein, 9 aa, Homo Sapiens
EEKSKSMKL

SEQ ID NO: 389377 - protein, 9 aa, Homo Sapiens
TPGREPPSP

SEQ ID NO: 389378 - protein, 9 aa, Homo Sapiens
YEWSLPINP

SEQ ID NO: 389379 - protein, 9 aa, Homo Sapiens
DFPYPRLDV

SEQ ID NO: 389380 - protein, 9 aa, Homo Sapiens
SIAFSTSIT

SEQ ID NO: 389381 - protein, 9 aa, Homo Sapiens
VGPHARVDA

SEQ ID NO: 389382 - protein, 9 aa, Homo Sapiens
PNPISRASL

SEQ ID NO: 389383 - protein, 9 aa, Homo Sapiens
ILTHSTVLK

SEQ ID NO: 389384 - protein, 9 aa, Homo Sapiens
QGWKRFGMK

SEQ ID NO: 389385 - protein, 9 aa, Homo Sapiens
ASRARGTRG

SEQ ID NO: 389386 - protein, 9 aa, Homo Sapiens
PSPNPISRA

SEQ ID NO: 389387 - protein, 9 aa, Homo Sapiens
PPANGAPPE

SEQ ID NO: 389388 - protein, 9 aa, Homo Sapiens
RERGREREK

SEQ ID NO: 389389 - protein, 9 aa, Homo Sapiens
CLTSQSQPH

SEQ ID NO: 389390 - protein, 9 aa, Homo Sapiens
TSITRFAFS

SEQ ID NO: 389391 - protein, 9 aa, Homo Sapiens
IPRANASHT

SEQ ID NO: 389392 - protein, 9 aa, Homo Sapiens
FGGPGFTGA

SEQ ID NO: 389393 - protein, 9 aa, Homo Sapiens
DLVATALFL

SEQ ID NO: 389394 - protein, 9 aa, Homo Sapiens
DGDCYWFEN

SEQ ID NO: 389395 - protein, 9 aa, Homo Sapiens
PLGVSPLAP

SEQ ID NO: 389396 - protein, 9 aa, Homo Sapiens
TPVPLFSEQ

SEQ ID NO: 389397 - protein, 9 aa, Homo Sapiens
LNAWNGFSN

SEQ ID NO: 389398 - protein, 9 aa, Homo Sapiens
GKNPMHIFA

SEQ ID NO: 389399 - protein, 9 aa, Homo Sapiens
RTSARRRTW

SEQ ID NO: 389400 - protein, 9 aa, Homo Sapiens
RELLKTLNM

SEQ ID NO: 389401 - protein, 9 aa, Homo Sapiens
RYLTPLVYL

SEQ ID NO: 389402 - protein, 9 aa, Homo Sapiens
FSEQRSGCR

SEQ ID NO: 389403 - protein, 9 aa, Homo Sapiens
SLEASSLQH

SEQ ID NO: 389404 - protein, 9 aa, Homo Sapiens
VHFVTRNKD

SEQ ID NO: 389405 - protein, 9 aa, Homo Sapiens
EPSHQDIIK

SEQ ID NO: 389406 - protein, 9 aa, Homo Sapiens
RGGLFLLQM

SEQ ID NO: 389407 - protein, 9 aa, Homo Sapiens
PFPENRTHP

SEQ ID NO: 389408 - protein, 9 aa, Homo Sapiens
EQRSGCRPF

SEQ ID NO: 389409 - protein, 9 aa, Homo Sapiens
LPGEADLAD

SEQ ID NO: 389410 - protein, 9 aa, Homo Sapiens
PAEPELPEN

SEQ ID NO: 389411 - protein, 9 aa, Homo Sapiens
APPANLGDR

SEQ ID NO: 389412 - protein, 9 aa, Homo Sapiens
AFHQSSYLK

SEQ ID NO: 389413 - protein, 9 aa, Homo Sapiens
VRHHPPCWS

SEQ ID NO: 389414 - protein, 9 aa, Homo Sapiens
VAAAAVAVV

SEQ ID NO: 389415 - protein, 9 aa, Homo Sapiens
RKSRRYFSN

SEQ ID NO: 389416 - protein, 9 aa, Homo Sapiens
LISPHSSPP

SEQ ID NO: 389417 - protein, 9 aa, Homo Sapiens
ELYVCVWSL

SEQ ID NO: 389418 - protein, 9 aa, Homo Sapiens
FSPQPLTGL

SEQ ID NO: 389419 - protein, 9 aa, Homo Sapiens
TTFTSGTLG

SEQ ID NO: 389420 - protein, 9 aa, Homo Sapiens
LVLAIVQII

SEQ ID NO: 389421 - protein, 9 aa, Homo Sapiens
GGTAGVGTT

SEQ ID NO: 389422 - protein, 9 aa, Homo Sapiens
TVEFILLVV

SEQ ID NO: 389423 - protein, 9 aa, Homo Sapiens
VPTGDIWQG

SEQ ID NO: 389424 - protein, 9 aa, Homo Sapiens
RIRSDPDAC

SEQ ID NO: 389425 - protein, 9 aa, Homo Sapiens
RVSSRASST

SEQ ID NO: 389426 - protein, 9 aa, Homo Sapiens
GTFAAFFAS

SEQ ID NO: 389427 - protein, 9 aa, Homo Sapiens
IRDFIQVFI

SEQ ID NO: 389428 - protein, 9 aa, Homo Sapiens
RGLRTRPWA

SEQ ID NO: 389429 - protein, 9 aa, Homo Sapiens
QDTGLLQES

SEQ ID NO: 389430 - protein, 9 aa, Homo Sapiens
TLNFGGIGV

SEQ ID NO: 389431 - protein, 9 aa, Homo Sapiens
GLMMYGLWT

SEQ ID NO: 389432 - protein, 9 aa, Homo Sapiens
GVVKSGQSD

SEQ ID NO: 389433 - protein, 9 aa, Homo Sapiens
WSLEASSLQ

SEQ ID NO: 389434 - protein, 9 aa, Homo Sapiens
THGVASFSL

SEQ ID NO: 389435 - protein, 9 aa, Homo Sapiens
VGGGAGVVA

SEQ ID NO: 389436 - protein, 9 aa, Homo Sapiens
LKRSLRQYM

SEQ ID NO: 389437 - protein, 9 aa, Homo Sapiens
APRLAAPWL

SEQ ID NO: 389438 - protein, 9 aa, Homo Sapiens
PIGPSCVPT

SEQ ID NO: 389439 - protein, 9 aa, Homo Sapiens
LFCLETLNT

SEQ ID NO: 389440 - protein, 9 aa, Homo Sapiens
LLHQVVEDG

SEQ ID NO: 389441 - protein, 9 aa, Homo Sapiens
TAAGVVKSG

SEQ ID NO: 389442 - protein, 9 aa, Homo Sapiens
ILGNKALCE

SEQ ID NO: 389443 - protein, 9 aa, Homo Sapiens
PAGGSRARC

SEQ ID NO: 389444 - protein, 9 aa, Homo Sapiens
PPPPPTKKR

SEQ ID NO: 389445 - protein, 9 aa, Homo Sapiens
TVESIFARS

SEQ ID NO: 389446 - protein, 9 aa, Homo Sapiens
EGKEQEEEE

SEQ ID NO: 389447 - protein, 9 aa, Homo Sapiens
KDAAEIQKH

SEQ ID NO: 389448 - protein, 9 aa, Homo Sapiens
REGSAPIQY

SEQ ID NO: 389449 - protein, 9 aa, Homo Sapiens
TPPSAPRAS

SEQ ID NO: 389450 - protein, 9 aa, Homo Sapiens
HSEPSHQDI

SEQ ID NO: 389451 - protein, 9 aa, Homo Sapiens
KGSVISTLG

SEQ ID NO: 389452 - protein, 9 aa, Homo Sapiens
IQSILQAIR

SEQ ID NO: 389453 - protein, 9 aa, Homo Sapiens
THPASYSEN

SEQ ID NO: 389454 - protein, 9 aa, Homo Sapiens
LIMKVNFDI

SEQ ID NO: 389455 - protein, 9 aa, Homo Sapiens
IRRLQQTQA

SEQ ID NO: 389456 - protein, 9 aa, Homo Sapiens
MRMTAQARD

SEQ ID NO: 389457 - protein, 9 aa, Homo Sapiens
LVAISTFML

SEQ ID NO: 389458 - protein, 9 aa, Homo Sapiens
LGIRAQGTR

SEQ ID NO: 389459 - protein, 9 aa, Homo Sapiens
VLMPPCSCT

SEQ ID NO: 389460 - protein, 9 aa, Homo Sapiens
ICRGNWRTA

SEQ ID NO: 389461 - protein, 9 aa, Homo Sapiens
TQNRMTVTH

SEQ ID NO: 389462 - protein, 9 aa, Homo Sapiens
KNVHRQPVQ

SEQ ID NO: 389463 - protein, 9 aa, Homo Sapiens
APHLQPPSR

SEQ ID NO: 389464 - protein, 9 aa, Homo Sapiens
TGQLHPAIW

SEQ ID NO: 389465 - protein, 9 aa, Homo Sapiens
QAWKCVCKW

SEQ ID NO: 389466 - protein, 9 aa, Homo Sapiens
GSSHACVQK

SEQ ID NO: 389467 - protein, 9 aa, Homo Sapiens
RHGPDGLLQ

SEQ ID NO: 389468 - protein, 9 aa, Homo Sapiens
VGLTSALVA

SEQ ID NO: 389469 - protein, 9 aa, Homo Sapiens
LRLWSWCGT

SEQ ID NO: 389470 - protein, 9 aa, Homo Sapiens
DGDAGVGHA

SEQ ID NO: 389471 - protein, 9 aa, Homo Sapiens
IHKAATVFD

SEQ ID NO: 389472 - protein, 9 aa, Homo Sapiens
GSGGATGAN

SEQ ID NO: 389473 - protein, 9 aa, Homo Sapiens
HWKTFQGLV

SEQ ID NO: 389474 - protein, 9 aa, Homo Sapiens
VAALAPGTS

SEQ ID NO: 389475 - protein, 9 aa, Homo Sapiens
KEEVFLIFW

SEQ ID NO: 389476 - protein, 9 aa, Homo Sapiens
NQWNQETGE

SEQ ID NO: 389477 - protein, 9 aa, Homo Sapiens
VFTDEMDHF

SEQ ID NO: 389478 - protein, 9 aa, Homo Sapiens
RHFPLLWDT

SEQ ID NO: 389479 - protein, 9 aa, Homo Sapiens
TFGNKPDTF

SEQ ID NO: 389480 - protein, 9 aa, Homo Sapiens
ARSAAAASP

SEQ ID NO: 389481 - protein, 9 aa, Homo Sapiens
SVFEADPYK

SEQ ID NO: 389482 - protein, 9 aa, Homo Sapiens
SPIKWNGRM

SEQ ID NO: 389483 - protein, 9 aa, Homo Sapiens
VSPLAPCPP

SEQ ID NO: 389484 - protein, 9 aa, Homo Sapiens
AYWGPRASA

SEQ ID NO: 389485 - protein, 9 aa, Homo Sapiens
ASTAKSAEM

SEQ ID NO: 389486 - protein, 9 aa, Homo Sapiens
FTSDYCETE

SEQ ID NO: 389487 - protein, 9 aa, Homo Sapiens
GLFNHTRAQ

SEQ ID NO: 389488 - protein, 9 aa, Homo Sapiens
SSRGTFGTR

SEQ ID NO: 389489 - protein, 9 aa, Homo Sapiens
ILQGLPIGT

SEQ ID NO: 389490 - protein, 9 aa, Homo Sapiens
KYMVPRARV

SEQ ID NO: 389491 - protein, 9 aa, Homo Sapiens
ENENRKLQL

SEQ ID NO: 389492 - protein, 9 aa, Homo Sapiens
ITEPTKFEK

SEQ ID NO: 389493 - protein, 9 aa, Homo Sapiens
TFERARPTQ

SEQ ID NO: 389494 - protein, 9 aa, Homo Sapiens
VGDRGWAGC

SEQ ID NO: 389495 - protein, 9 aa, Homo Sapiens
SEEEDTKLK

SEQ ID NO: 389496 - protein, 9 aa, Homo Sapiens
VEDGQHVVD

SEQ ID NO: 389497 - protein, 9 aa, Homo Sapiens
ASQDGPPGP

SEQ ID NO: 389498 - protein, 9 aa, Homo Sapiens
TTAVEVTQR

SEQ ID NO: 389499 - protein, 9 aa, Homo Sapiens
TAALENLNK

SEQ ID NO: 389500 - protein, 9 aa, Homo Sapiens
LEVIGFTMM

SEQ ID NO: 389501 - protein, 9 aa, Homo Sapiens
DTRDTFSDS

SEQ ID NO: 389502 - protein, 9 aa, Homo Sapiens
HCYSCMCSP

SEQ ID NO: 389503 - protein, 9 aa, Homo Sapiens
WFSTVFPPT

SEQ ID NO: 389504 - protein, 9 aa, Homo Sapiens
IITAGMAHI

SEQ ID NO: 389505 - protein, 9 aa, Homo Sapiens
RTAPAEVHK

SEQ ID NO: 389506 - protein, 9 aa, Homo Sapiens
PLLWPQEES

SEQ ID NO: 389507 - protein, 9 aa, Homo Sapiens
LQPGEKKSQ

SEQ ID NO: 389508 - protein, 9 aa, Homo Sapiens
GAPSSICRG

SEQ ID NO: 389509 - protein, 9 aa, Homo Sapiens
PPEMPGSSR

SEQ ID NO: 389510 - protein, 9 aa, Homo Sapiens
VSRVLAQPA

SEQ ID NO: 389511 - protein, 9 aa, Homo Sapiens
SCVQRRYSD

SEQ ID NO: 389512 - protein, 9 aa, Homo Sapiens
LAFLKNGRS

SEQ ID NO: 389513 - protein, 9 aa, Homo Sapiens
RTPRGPSEK

SEQ ID NO: 389514 - protein, 9 aa, Homo Sapiens
MPTIGQRVR

SEQ ID NO: 389515 - protein, 9 aa, Homo Sapiens
TVKNAEPTK

SEQ ID NO: 389516 - protein, 9 aa, Homo Sapiens
AGLVPESGS

SEQ ID NO: 389517 - protein, 9 aa, Homo Sapiens
IGYMMKILY

SEQ ID NO: 389518 - protein, 9 aa, Homo Sapiens
VGPSGTSRT

SEQ ID NO: 389519 - protein, 9 aa, Homo Sapiens
ADARLERDQ

SEQ ID NO: 389520 - protein, 9 aa, Homo Sapiens
TVVAWLGLW

SEQ ID NO: 389521 - protein, 9 aa, Homo Sapiens
SRESHHTSL

SEQ ID NO: 389522 - protein, 9 aa, Homo Sapiens
AGKASHVDL

SEQ ID NO: 389523 - protein, 9 aa, Homo Sapiens
LVFKGKRHL

SEQ ID NO: 389524 - protein, 9 aa, Homo Sapiens
KASPRLQFL

SEQ ID NO: 389525 - protein, 9 aa, Homo Sapiens
QSPQGASSI

SEQ ID NO: 389526 - protein, 9 aa, Homo Sapiens
GKYFTLCES

SEQ ID NO: 389527 - protein, 9 aa, Homo Sapiens
PTWRRTGAS

SEQ ID NO: 389528 - protein, 9 aa, Homo Sapiens
DKYSSYPVH

SEQ ID NO: 389529 - protein, 9 aa, Homo Sapiens
CNTENPPDC

SEQ ID NO: 389530 - protein, 9 aa, Homo Sapiens
FSCDECGMR

SEQ ID NO: 389531 - protein, 9 aa, Homo Sapiens
PTKAWPASS

SEQ ID NO: 389532 - protein, 9 aa, Homo Sapiens
GLSGGQRTS

SEQ ID NO: 389533 - protein, 9 aa, Homo Sapiens
RKHSESPPA

SEQ ID NO: 389534 - protein, 9 aa, Homo Sapiens
ADQSPGSGP

SEQ ID NO: 389535 - protein, 9 aa, Homo Sapiens
EKRSEMAFS

SEQ ID NO: 389536 - protein, 9 aa, Homo Sapiens
KQQLQNQQH

SEQ ID NO: 389537 - protein, 9 aa, Homo Sapiens
APGSARSAS

SEQ ID NO: 389538 - protein, 9 aa, Homo Sapiens
MWSQGVLVK

SEQ ID NO: 389539 - protein, 9 aa, Homo Sapiens
LFLSSAVSS

SEQ ID NO: 389540 - protein, 9 aa, Homo Sapiens
SDFNDVTNM

SEQ ID NO: 389541 - protein, 9 aa, Homo Sapiens
IEPVGNCEE

SEQ ID NO: 389542 - protein, 9 aa, Homo Sapiens
TEFHRIGQG

SEQ ID NO: 389543 - protein, 9 aa, Homo Sapiens
ALKRVCRKS

SEQ ID NO: 389544 - protein, 9 aa, Homo Sapiens
SLSSFLIFF

SEQ ID NO: 389545 - protein, 9 aa, Homo Sapiens
LSYGLLGDG

SEQ ID NO: 389546 - protein, 9 aa, Homo Sapiens
FDFFRVLLQ

SEQ ID NO: 389547 - protein, 9 aa, Homo Sapiens
RKGAPAGEA

SEQ ID NO: 389548 - protein, 9 aa, Homo Sapiens
QKRDVIRHI

SEQ ID NO: 389549 - protein, 9 aa, Homo Sapiens
IWVPAQVEG

SEQ ID NO: 389550 - protein, 9 aa, Homo Sapiens
AGILACECP

SEQ ID NO: 389551 - protein, 9 aa, Homo Sapiens
QYVSSEGTE

SEQ ID NO: 389552 - protein, 9 aa, Homo Sapiens
EDPPHQPWA

SEQ ID NO: 389553 - protein, 9 aa, Homo Sapiens
ARGSSISRG

SEQ ID NO: 389554 - protein, 9 aa, Homo Sapiens
DRSPQAPLR

SEQ ID NO: 389555 - protein, 9 aa, Homo Sapiens
QKKEEVFLI

SEQ ID NO: 389556 - protein, 9 aa, Homo Sapiens
FNIQGSFRC

SEQ ID NO: 389557 - protein, 9 aa, Homo Sapiens
SDLTDRAKV

SEQ ID NO: 389558 - protein, 9 aa, Homo Sapiens
SIPVLVNGM

SEQ ID NO: 389559 - protein, 9 aa, Homo Sapiens
ETVESIFAR

SEQ ID NO: 389560 - protein, 9 aa, Homo Sapiens
TTCSRGTLF

SEQ ID NO: 389561 - protein, 9 aa, Homo Sapiens
VLCQFYDEA

SEQ ID NO: 389562 - protein, 9 aa, Homo Sapiens
GGFSKVMGS

SEQ ID NO: 389563 - protein, 9 aa, Homo Sapiens
IPRLPHPAP

SEQ ID NO: 389564 - protein, 9 aa, Homo Sapiens
GSCKNSPGC

SEQ ID NO: 389565 - protein, 9 aa, Homo Sapiens
PFQLAFVHQ

SEQ ID NO: 389566 - protein, 9 aa, Homo Sapiens
SSSTFRSRE

SEQ ID NO: 389567 - protein, 9 aa, Homo Sapiens
CHKKKHEGQ

SEQ ID NO: 389568 - protein, 9 aa, Homo Sapiens
GNCEEKILN

SEQ ID NO: 389569 - protein, 9 aa, Homo Sapiens
VRSITHVNA

SEQ ID NO: 389570 - protein, 9 aa, Homo Sapiens
ARLTTHTLG

SEQ ID NO: 389571 - protein, 9 aa, Homo Sapiens
NDHRDFTGE

SEQ ID NO: 389572 - protein, 9 aa, Homo Sapiens
LDTKGPEMG

SEQ ID NO: 389573 - protein, 9 aa, Homo Sapiens
SPLQPRARQ

SEQ ID NO: 389574 - protein, 9 aa, Homo Sapiens
PAQCIEQAT

SEQ ID NO: 389575 - protein, 9 aa, Homo Sapiens
LLFLFFIPG

SEQ ID NO: 389576 - protein, 9 aa, Homo Sapiens
TFSDSEDID

SEQ ID NO: 389577 - protein, 9 aa, Homo Sapiens
NCKVVFPSR

SEQ ID NO: 389578 - protein, 9 aa, Homo Sapiens
TGFDMIVIG

SEQ ID NO: 389579 - protein, 9 aa, Homo Sapiens
GMDVQRGIG

SEQ ID NO: 389580 - protein, 9 aa, Homo Sapiens
ARLTVTRCF

SEQ ID NO: 389581 - protein, 9 aa, Homo Sapiens
TVVQNERFD

SEQ ID NO: 389582 - protein, 9 aa, Homo Sapiens
SRARGARLT

SEQ ID NO: 389583 - protein, 9 aa, Homo Sapiens
AKHHLLYPG

SEQ ID NO: 389584 - protein, 9 aa, Homo Sapiens
VKHQHVHTG

SEQ ID NO: 389585 - protein, 9 aa, Homo Sapiens
FGYPIQQVA

SEQ ID NO: 389586 - protein, 9 aa, Homo Sapiens
YVQSNCFPG

SEQ ID NO: 389587 - protein, 9 aa, Homo Sapiens
RACTPASGP

SEQ ID NO: 389588 - protein, 9 aa, Homo Sapiens
SDLVKHQHV

SEQ ID NO: 389589 - protein, 9 aa, Homo Sapiens
DNMCVFKLG

SEQ ID NO: 389590 - protein, 9 aa, Homo Sapiens
RSLPFECSQ

SEQ ID NO: 389591 - protein, 9 aa, Homo Sapiens
EKTEIQLTM

SEQ ID NO: 389592 - protein, 9 aa, Homo Sapiens
QRLNFFDTW

SEQ ID NO: 389593 - protein, 9 aa, Homo Sapiens
LARETSLAS

SEQ ID NO: 389594 - protein, 9 aa, Homo Sapiens
GFSNLVRLM

SEQ ID NO: 389595 - protein, 9 aa, Homo Sapiens
WKEVRGEWR

SEQ ID NO: 389596 - protein, 9 aa, Homo Sapiens
PGGPNDYVF

SEQ ID NO: 389597 - protein, 9 aa, Homo Sapiens
LREKVPCLC

SEQ ID NO: 389598 - protein, 9 aa, Homo Sapiens
IIVEKPFER

SEQ ID NO: 389599 - protein, 9 aa, Homo Sapiens
DEALQRPFF

SEQ ID NO: 389600 - protein, 9 aa, Homo Sapiens
TGASTRASG

SEQ ID NO: 389601 - protein, 9 aa, Homo Sapiens
PECDKAFRQ

SEQ ID NO: 389602 - protein, 9 aa, Homo Sapiens
LMSFLAMMG

SEQ ID NO: 389603 - protein, 9 aa, Homo Sapiens
SPSPLWLRL

SEQ ID NO: 389604 - protein, 9 aa, Homo Sapiens
DFGSRCYEH

SEQ ID NO: 389605 - protein, 9 aa, Homo Sapiens
HPQPRPSTP

SEQ ID NO: 389606 - protein, 9 aa, Homo Sapiens
RPWPPSFSA

SEQ ID NO: 389607 - protein, 9 aa, Homo Sapiens
CQAWLSMTP

SEQ ID NO: 389608 - protein, 9 aa, Homo Sapiens
QEADREEDE

SEQ ID NO: 389609 - protein, 9 aa, Homo Sapiens
ICILTLAKM

SEQ ID NO: 389610 - protein, 9 aa, Homo Sapiens
QRREICAGT

SEQ ID NO: 389611 - protein, 9 aa, Homo Sapiens
LDEALQRPF

SEQ ID NO: 389612 - protein, 9 aa, Homo Sapiens
SMSRHPFFQ

SEQ ID NO: 389613 - protein, 9 aa, Homo Sapiens
NSREKRLIE

SEQ ID NO: 389614 - protein, 9 aa, Homo Sapiens
VCNECDKAF

SEQ ID NO: 389615 - protein, 9 aa, Homo Sapiens
GIPRANASH

SEQ ID NO: 389616 - protein, 9 aa, Homo Sapiens
WMPPESVLY

SEQ ID NO: 389617 - protein, 9 aa, Homo Sapiens
SASALPTAV

SEQ ID NO: 389618 - protein, 9 aa, Homo Sapiens
EVYQTPAQD

SEQ ID NO: 389619 - protein, 9 aa, Homo Sapiens
LAAGLSYGL

SEQ ID NO: 389620 - protein, 9 aa, Homo Sapiens
SAEGPQLEN

SEQ ID NO: 389621 - protein, 9 aa, Homo Sapiens
VDAQVGPLP

SEQ ID NO: 389622 - protein, 9 aa, Homo Sapiens
RLTVTRCFS

SEQ ID NO: 389623 - protein, 9 aa, Homo Sapiens
EKEKKEEGK

SEQ ID NO: 389624 - protein, 9 aa, Homo Sapiens
ITVQKNKNT

SEQ ID NO: 389625 - protein, 9 aa, Homo Sapiens
NNQTSWVLS

SEQ ID NO: 389626 - protein, 9 aa, Homo Sapiens
LSSSTFRSR

SEQ ID NO: 389627 - protein, 9 aa, Homo Sapiens
DVLVHQLLL

SEQ ID NO: 389628 - protein, 9 aa, Homo Sapiens
GPCHAAALA

SEQ ID NO: 389629 - protein, 9 aa, Homo Sapiens
KDHLRKHQC

SEQ ID NO: 389630 - protein, 9 aa, Homo Sapiens
TRRMLFPTS

SEQ ID NO: 389631 - protein, 9 aa, Homo Sapiens
GGPWRGQPG

SEQ ID NO: 389632 - protein, 9 aa, Homo Sapiens
AKVSRNTLF

SEQ ID NO: 389633 - protein, 9 aa, Homo Sapiens
NGARGTRST

SEQ ID NO: 389634 - protein, 9 aa, Homo Sapiens
QLGNITEPT

SEQ ID NO: 389635 - protein, 9 aa, Homo Sapiens
TEDHTDDFM

SEQ ID NO: 389636 - protein, 9 aa, Homo Sapiens
KLEFPSPFG

SEQ ID NO: 389637 - protein, 9 aa, Homo Sapiens
GSDSVAKAE

SEQ ID NO: 389638 - protein, 9 aa, Homo Sapiens
YITQVILMY

SEQ ID NO: 389639 - protein, 9 aa, Homo Sapiens
PPNGLILSH

SEQ ID NO: 389640 - protein, 9 aa, Homo Sapiens
NPPSPIKWN

SEQ ID NO: 389641 - protein, 9 aa, Homo Sapiens
TRWQGLTLG

SEQ ID NO: 389642 - protein, 9 aa, Homo Sapiens
RSSDLTDRA

SEQ ID NO: 389643 - protein, 9 aa, Homo Sapiens
CILQGLPIG

SEQ ID NO: 389644 - protein, 9 aa, Homo Sapiens
RQNLQGHML

SEQ ID NO: 389645 - protein, 9 aa, Homo Sapiens
LFLFIIIIS

SEQ ID NO: 389646 - protein, 9 aa, Homo Sapiens
FTLVTRGTS

SEQ ID NO: 389647 - protein, 9 aa, Homo Sapiens
PPASTCWPR

SEQ ID NO: 389648 - protein, 9 aa, Homo Sapiens
VWSLSFGES

SEQ ID NO: 389649 - protein, 9 aa, Homo Sapiens
DRTLLAPTH

SEQ ID NO: 389650 - protein, 9 aa, Homo Sapiens
VSSDCFLTV

SEQ ID NO: 389651 - protein, 9 aa, Homo Sapiens
PPSTAATTA

SEQ ID NO: 389652 - protein, 9 aa, Homo Sapiens
DRRSSNISQ

SEQ ID NO: 389653 - protein, 9 aa, Homo Sapiens
AHGTRGTTF

SEQ ID NO: 389654 - protein, 9 aa, Homo Sapiens
AQYLSLSSP

SEQ ID NO: 389655 - protein, 9 aa, Homo Sapiens
TITEHVPLG

SEQ ID NO: 389656 - protein, 9 aa, Homo Sapiens
HCVASRRRY

SEQ ID NO: 389657 - protein, 9 aa, Homo Sapiens
QPRPWRIQS

SEQ ID NO: 389658 - protein, 9 aa, Homo Sapiens
TNITNGARG

SEQ ID NO: 389659 - protein, 9 aa, Homo Sapiens
LRKHQCNHA

SEQ ID NO: 389660 - protein, 9 aa, Homo Sapiens
HSTVLKASD

SEQ ID NO: 389661 - protein, 9 aa, Homo Sapiens
QQERKAMTK

SEQ ID NO: 389662 - protein, 9 aa, Homo Sapiens
EETKWKAEQ

SEQ ID NO: 389663 - protein, 9 aa, Homo Sapiens
EESRHLWKF

SEQ ID NO: 389664 - protein, 9 aa, Homo Sapiens
TSKKEVDPA

SEQ ID NO: 389665 - protein, 9 aa, Homo Sapiens
CEEKILNRE

SEQ ID NO: 389666 - protein, 9 aa, Homo Sapiens
DQCQELGCC

SEQ ID NO: 389667 - protein, 9 aa, Homo Sapiens
RAALDGGPW

SEQ ID NO: 389668 - protein, 9 aa, Homo Sapiens
ADGASEEPS

SEQ ID NO: 389669 - protein, 9 aa, Homo Sapiens
TLARETSLA

SEQ ID NO: 389670 - protein, 9 aa, Homo Sapiens
DGMLDVTIT

SEQ ID NO: 389671 - protein, 9 aa, Homo Sapiens
CNECDKAFR

SEQ ID NO: 389672 - protein, 9 aa, Homo Sapiens
NFFQFCKKS

SEQ ID NO: 389673 - protein, 9 aa, Homo Sapiens
RQFSHRDIP

SEQ ID NO: 389674 - protein, 9 aa, Homo Sapiens
GPLPCVLPH

SEQ ID NO: 389675 - protein, 9 aa, Homo Sapiens
ILNTENKFT

SEQ ID NO: 389676 - protein, 9 aa, Homo Sapiens
FQMLIIEKV

SEQ ID NO: 389677 - protein, 9 aa, Homo Sapiens
DFMGCLNIP

SEQ ID NO: 389678 - protein, 9 aa, Homo Sapiens
FKSVNHPQH

SEQ ID NO: 389679 - protein, 9 aa, Homo Sapiens
ILAIGEHLL

SEQ ID NO: 389680 - protein, 9 aa, Homo Sapiens
VLLMAVGIL

SEQ ID NO: 389681 - protein, 9 aa, Homo Sapiens
MEKKINNQI

SEQ ID NO: 389682 - protein, 9 aa, Homo Sapiens
GEKPIYSIG

SEQ ID NO: 389683 - protein, 9 aa, Homo Sapiens
FECSQPRIF

SEQ ID NO: 389684 - protein, 9 aa, Homo Sapiens
AEVHKARSG

SEQ ID NO: 389685 - protein, 9 aa, Homo Sapiens
AGLTTVTLG

SEQ ID NO: 389686 - protein, 9 aa, Homo Sapiens
MEYATGVLQ

SEQ ID NO: 389687 - protein, 9 aa, Homo Sapiens
PTQPPRGWR

SEQ ID NO: 389688 - protein, 9 aa, Homo Sapiens
AKTKQQLQN

SEQ ID NO: 389689 - protein, 9 aa, Homo Sapiens
ILMYIFQNV

SEQ ID NO: 389690 - protein, 9 aa, Homo Sapiens
AVLYQWSKS

SEQ ID NO: 389691 - protein, 9 aa, Homo Sapiens
SGTSRAAGT

SEQ ID NO: 389692 - protein, 9 aa, Homo Sapiens
GTLFARFTR

SEQ ID NO: 389693 - protein, 9 aa, Homo Sapiens
NKPEGKPDQ

SEQ ID NO: 389694 - protein, 9 aa, Homo Sapiens
CDTGECYCK

SEQ ID NO: 389695 - protein, 9 aa, Homo Sapiens
KDKSRERGR

SEQ ID NO: 389696 - protein, 9 aa, Homo Sapiens
TSGLGAPPT

SEQ ID NO: 389697 - protein, 9 aa, Homo Sapiens
VPWPEVWKE

SEQ ID NO: 389698 - protein, 9 aa, Homo Sapiens
PANLGDRTR

SEQ ID NO: 389699 - protein, 9 aa, Homo Sapiens
FIERSDEDS

SEQ ID NO: 389700 - protein, 9 aa, Homo Sapiens
KHLTAALEN

SEQ ID NO: 389701 - protein, 9 aa, Homo Sapiens
TAAYWGPRA

SEQ ID NO: 389702 - protein, 9 aa, Homo Sapiens
ERPQCRPTG

SEQ ID NO: 389703 - protein, 9 aa, Homo Sapiens
GRRDEAGGP

SEQ ID NO: 389704 - protein, 9 aa, Homo Sapiens
PECGRAFFI

SEQ ID NO: 389705 - protein, 9 aa, Homo Sapiens
ARARLQARE

SEQ ID NO: 389706 - protein, 9 aa, Homo Sapiens
TEEKSKSMK

SEQ ID NO: 389707 - protein, 9 aa, Homo Sapiens
LDLETCGKQ

SEQ ID NO: 389708 - protein, 9 aa, Homo Sapiens
AKLTPGREP

SEQ ID NO: 389709 - protein, 9 aa, Homo Sapiens
PTAAKPSAR

SEQ ID NO: 389710 - protein, 9 aa, Homo Sapiens
NLGLVGERS

SEQ ID NO: 389711 - protein, 9 aa, Homo Sapiens
SPALKQVSP

SEQ ID NO: 389712 - protein, 9 aa, Homo Sapiens
NPIVVASGI

SEQ ID NO: 389713 - protein, 9 aa, Homo Sapiens
GKASHVDLE

SEQ ID NO: 389714 - protein, 9 aa, Homo Sapiens
FPEENFTIQ

SEQ ID NO: 389715 - protein, 9 aa, Homo Sapiens
VLAPEVCAG

SEQ ID NO: 389716 - protein, 9 aa, Homo Sapiens
QRTFKGNTQ

SEQ ID NO: 389717 - protein, 9 aa, Homo Sapiens
QRRMDARYQ

SEQ ID NO: 389718 - protein, 9 aa, Homo Sapiens
IPESEAEAQ

SEQ ID NO: 389719 - protein, 9 aa, Homo Sapiens
ITEGVPGQE

SEQ ID NO: 389720 - protein, 9 aa, Homo Sapiens
PSGSTPPRA

SEQ ID NO: 389721 - protein, 9 aa, Homo Sapiens
VCKLERRLR

SEQ ID NO: 389722 - protein, 9 aa, Homo Sapiens
GRRLLTIPS

SEQ ID NO: 389723 - protein, 9 aa, Homo Sapiens
TTGGPRSTG

SEQ ID NO: 389724 - protein, 9 aa, Homo Sapiens
SSSSLSFLS

SEQ ID NO: 389725 - protein, 9 aa, Homo Sapiens
DVSFDFFRV

SEQ ID NO: 389726 - protein, 9 aa, Homo Sapiens
PVQIEEPIE

SEQ ID NO: 389727 - protein, 9 aa, Homo Sapiens
SNRHWRQID

SEQ ID NO: 389728 - protein, 9 aa, Homo Sapiens
LSTLLDGKA

SEQ ID NO: 389729 - protein, 9 aa, Homo Sapiens
ASSQTLGTR

SEQ ID NO: 389730 - protein, 9 aa, Homo Sapiens
SVRLEDSCQ

SEQ ID NO: 389731 - protein, 9 aa, Homo Sapiens
ILLQRNLLR

SEQ ID NO: 389732 - protein, 9 aa, Homo Sapiens
IFASRTDSA

SEQ ID NO: 389733 - protein, 9 aa, Homo Sapiens
APLPWMVPW

SEQ ID NO: 389734 - protein, 9 aa, Homo Sapiens
DVSVCRDAP

SEQ ID NO: 389735 - protein, 9 aa, Homo Sapiens
PTAGVTASY

SEQ ID NO: 389736 - protein, 9 aa, Homo Sapiens
HLPKSIPVL

SEQ ID NO: 389737 - protein, 9 aa, Homo Sapiens
YRGINSILP

SEQ ID NO: 389738 - protein, 9 aa, Homo Sapiens
TSRTRGTLH

SEQ ID NO: 389739 - protein, 9 aa, Homo Sapiens
TTLSSNTLR

SEQ ID NO: 389740 - protein, 9 aa, Homo Sapiens
AREATVTLY

SEQ ID NO: 389741 - protein, 9 aa, Homo Sapiens
EAFATRCCL

SEQ ID NO: 389742 - protein, 9 aa, Homo Sapiens
MEVTASSHH

SEQ ID NO: 389743 - protein, 9 aa, Homo Sapiens
TGTTSFTRR

SEQ ID NO: 389744 - protein, 9 aa, Homo Sapiens
WPTGGRHTT

SEQ ID NO: 389745 - protein, 9 aa, Homo Sapiens
YRTTKDNIL

SEQ ID NO: 389746 - protein, 9 aa, Homo Sapiens
VFTYEGLRA

SEQ ID NO: 389747 - protein, 9 aa, Homo Sapiens
LARFYSPSP

SEQ ID NO: 389748 - protein, 9 aa, Homo Sapiens
DPMADIATL

SEQ ID NO: 389749 - protein, 9 aa, Homo Sapiens
FYLTLESFD

SEQ ID NO: 389750 - protein, 9 aa, Homo Sapiens
HFSNKRKCV

SEQ ID NO: 389751 - protein, 9 aa, Homo Sapiens
WEEASQVGG

SEQ ID NO: 389752 - protein, 9 aa, Homo Sapiens
EEKRKMTND

SEQ ID NO: 389753 - protein, 9 aa, Homo Sapiens
KKRYFDEND

SEQ ID NO: 389754 - protein, 9 aa, Homo Sapiens
VSLHVAPRY

SEQ ID NO: 389755 - protein, 9 aa, Homo Sapiens
GHINCPNDC

SEQ ID NO: 389756 - protein, 9 aa, Homo Sapiens
FLPRALMGF

SEQ ID NO: 389757 - protein, 9 aa, Homo Sapiens
DVSLHVAPR

SEQ ID NO: 389758 - protein, 9 aa, Homo Sapiens
YLPENILAD

SEQ ID NO: 389759 - protein, 9 aa, Homo Sapiens
MAASCSEAP

SEQ ID NO: 389760 - protein, 9 aa, Homo Sapiens
EYATGVLQQ

SEQ ID NO: 389761 - protein, 9 aa, Homo Sapiens
SQRAPLALP

SEQ ID NO: 389762 - protein, 9 aa, Homo Sapiens
YLLLPGTPK

SEQ ID NO: 389763 - protein, 9 aa, Homo Sapiens
LVCEGLTHG

SEQ ID NO: 389764 - protein, 9 aa, Homo Sapiens
DRMRELFQI

SEQ ID NO: 389765 - protein, 9 aa, Homo Sapiens
GVRALGKWL

SEQ ID NO: 389766 - protein, 9 aa, Homo Sapiens
GCLQPAEPE

SEQ ID NO: 389767 - protein, 9 aa, Homo Sapiens
RMTAQARDE

SEQ ID NO: 389768 - protein, 9 aa, Homo Sapiens
LPHPAPAEV

SEQ ID NO: 389769 - protein, 9 aa, Homo Sapiens
IREGWRWGW

SEQ ID NO: 389770 - protein, 9 aa, Homo Sapiens
ASRAGGTRL

SEQ ID NO: 389771 - protein, 9 aa, Homo Sapiens
KANQIINNC

SEQ ID NO: 389772 - protein, 9 aa, Homo Sapiens
LSATPVEGS

SEQ ID NO: 389773 - protein, 9 aa, Homo Sapiens
ADITSKYHQ

SEQ ID NO: 389774 - protein, 9 aa, Homo Sapiens
HVDACPESC

SEQ ID NO: 389775 - protein, 9 aa, Homo Sapiens
RRKNVPSRA

SEQ ID NO: 389776 - protein, 9 aa, Homo Sapiens
AMDAAGGDD

SEQ ID NO: 389777 - protein, 9 aa, Homo Sapiens
RGARKTREA

SEQ ID NO: 389778 - protein, 9 aa, Homo Sapiens
AAKPSARSP

SEQ ID NO: 389779 - protein, 9 aa, Homo Sapiens
MHKAPQLRE

SEQ ID NO: 389780 - protein, 9 aa, Homo Sapiens
SGPLGTSFT

SEQ ID NO: 389781 - protein, 9 aa, Homo Sapiens
PRVCSHCPR

SEQ ID NO: 389782 - protein, 9 aa, Homo Sapiens
GSPPSSPRH

SEQ ID NO: 389783 - protein, 9 aa, Homo Sapiens
RATSLTRQA

SEQ ID NO: 389784 - protein, 9 aa, Homo Sapiens
GVIKQKVLR

SEQ ID NO: 389785 - protein, 9 aa, Homo Sapiens
PQQIYPPIH

SEQ ID NO: 389786 - protein, 9 aa, Homo Sapiens
GGVATPGRP

SEQ ID NO: 389787 - protein, 9 aa, Homo Sapiens
YETVDILLN

SEQ ID NO: 389788 - protein, 9 aa, Homo Sapiens
VALFACLTL

SEQ ID NO: 389789 - protein, 9 aa, Homo Sapiens
VMATKMATL

SEQ ID NO: 389790 - protein, 9 aa, Homo Sapiens
CKVVFPSRN

SEQ ID NO: 389791 - protein, 9 aa, Homo Sapiens
QWGRCLLLW

SEQ ID NO: 389792 - protein, 9 aa, Homo Sapiens
CLLDFAASQ

SEQ ID NO: 389793 - protein, 9 aa, Homo Sapiens
ENCHKDVIP

SEQ ID NO: 389794 - protein, 9 aa, Homo Sapiens
FAAFFASRT

SEQ ID NO: 389795 - protein, 9 aa, Homo Sapiens
LILYMLSIL

SEQ ID NO: 389796 - protein, 9 aa, Homo Sapiens
DARSESPNQ

SEQ ID NO: 389797 - protein, 9 aa, Homo Sapiens
LIHWVQKIL

SEQ ID NO: 389798 - protein, 9 aa, Homo Sapiens
SGPTPVPTA

SEQ ID NO: 389799 - protein, 9 aa, Homo Sapiens
PWRRKRWSP

SEQ ID NO: 389800 - protein, 9 aa, Homo Sapiens
LFSQTRLPA

SEQ ID NO: 389801 - protein, 9 aa, Homo Sapiens
ARFTRGARK

SEQ ID NO: 389802 - protein, 9 aa, Homo Sapiens
WCEKLSTVR

SEQ ID NO: 389803 - protein, 9 aa, Homo Sapiens
KMEKVPIDT

SEQ ID NO: 389804 - protein, 9 aa, Homo Sapiens
VHQLLLHQV

SEQ ID NO: 389805 - protein, 9 aa, Homo Sapiens
GNSLSTLLD

SEQ ID NO: 389806 - protein, 9 aa, Homo Sapiens
VEKSINSAL

SEQ ID NO: 389807 - protein, 9 aa, Homo Sapiens
RALMGFSLL

SEQ ID NO: 389808 - protein, 9 aa, Homo Sapiens
PPCSCTFVP

SEQ ID NO: 389809 - protein, 9 aa, Homo Sapiens
ETKTISHFH

SEQ ID NO: 389810 - protein, 9 aa, Homo Sapiens
KCVCKWASR

SEQ ID NO: 389811 - protein, 9 aa, Homo Sapiens
SQAPEGGPW

SEQ ID NO: 389812 - protein, 9 aa, Homo Sapiens
SGAGLTTVT

SEQ ID NO: 389813 - protein, 9 aa, Homo Sapiens
LLTFVLVDE

SEQ ID NO: 389814 - protein, 9 aa, Homo Sapiens
LRARVLPGG

SEQ ID NO: 389815 - protein, 9 aa, Homo Sapiens
GQEYMVKEV

SEQ ID NO: 389816 - protein, 9 aa, Homo Sapiens
RSFQKSYKR

SEQ ID NO: 389817 - protein, 9 aa, Homo Sapiens
PGSFGGPDG

SEQ ID NO: 389818 - protein, 9 aa, Homo Sapiens
QYMPPEGQL

SEQ ID NO: 389819 - protein, 9 aa, Homo Sapiens
RSAEVTKMS

SEQ ID NO: 389820 - protein, 9 aa, Homo Sapiens
VVVLRLDGS

SEQ ID NO: 389821 - protein, 9 aa, Homo Sapiens
ESGSRTKDV

SEQ ID NO: 389822 - protein, 9 aa, Homo Sapiens
VDYKKIPES

SEQ ID NO: 389823 - protein, 9 aa, Homo Sapiens
FRKKKEVPE

SEQ ID NO: 389824 - protein, 9 aa, Homo Sapiens
VLEKILVNL

SEQ ID NO: 389825 - protein, 9 aa, Homo Sapiens
VRHLPKSIP

SEQ ID NO: 389826 - protein, 9 aa, Homo Sapiens
PLVGIWLPG

SEQ ID NO: 389827 - protein, 9 aa, Homo Sapiens
WAGCLQPAE

SEQ ID NO: 389828 - protein, 9 aa, Homo Sapiens
EIAGSWTSC

SEQ ID NO: 389829 - protein, 9 aa, Homo Sapiens
HITNSLIGK

SEQ ID NO: 389830 - protein, 9 aa, Homo Sapiens
QVAIVVKFF

SEQ ID NO: 389831 - protein, 9 aa, Homo Sapiens
RHLQGEQMY

SEQ ID NO: 389832 - protein, 9 aa, Homo Sapiens
APYSSGALP

SEQ ID NO: 389833 - protein, 9 aa, Homo Sapiens
QKCHKKKHE

SEQ ID NO: 389834 - protein, 9 aa, Homo Sapiens
PIGTHAALY

SEQ ID NO: 389835 - protein, 9 aa, Homo Sapiens
WRTAATVNS

SEQ ID NO: 389836 - protein, 9 aa, Homo Sapiens
HPQHTTLLK

SEQ ID NO: 389837 - protein, 9 aa, Homo Sapiens
GRTSARRRT

SEQ ID NO: 389838 - protein, 9 aa, Homo Sapiens
PFERDLQSS

SEQ ID NO: 389839 - protein, 9 aa, Homo Sapiens
NINAPFDMI

SEQ ID NO: 389840 - protein, 9 aa, Homo Sapiens
PEVCAGMII

SEQ ID NO: 389841 - protein, 9 aa, Homo Sapiens
DSCQKLPEK

SEQ ID NO: 389842 - protein, 9 aa, Homo Sapiens
LTPGREPPS

SEQ ID NO: 389843 - protein, 9 aa, Homo Sapiens
TGTRWAWGS

SEQ ID NO: 389844 - protein, 9 aa, Homo Sapiens
CKWASRLFA

SEQ ID NO: 389845 - protein, 9 aa, Homo Sapiens
LDQSFSFHS

SEQ ID NO: 389846 - protein, 9 aa, Homo Sapiens
LFRQNLQGH

SEQ ID NO: 389847 - protein, 9 aa, Homo Sapiens
KEQSHVINQ

SEQ ID NO: 389848 - protein, 9 aa, Homo Sapiens
WSPSPSPLW

SEQ ID NO: 389849 - protein, 9 aa, Homo Sapiens
PFSCDECGM

SEQ ID NO: 389850 - protein, 9 aa, Homo Sapiens
LTVLSNHVN

SEQ ID NO: 389851 - protein, 9 aa, Homo Sapiens
PANGAPPEC

SEQ ID NO: 389852 - protein, 9 aa, Homo Sapiens
RVSLYNNNL

SEQ ID NO: 389853 - protein, 9 aa, Homo Sapiens
VCGLEEQVS

SEQ ID NO: 389854 - protein, 9 aa, Homo Sapiens
ASSLQHQAG

SEQ ID NO: 389855 - protein, 9 aa, Homo Sapiens
RALFTSLAS

SEQ ID NO: 389856 - protein, 9 aa, Homo Sapiens
EPIIETEFH

SEQ ID NO: 389857 - protein, 9 aa, Homo Sapiens
AWSCAPVPA

SEQ ID NO: 389858 - protein, 9 aa, Homo Sapiens
ELWVTASII

SEQ ID NO: 389859 - protein, 9 aa, Homo Sapiens
GPAGSRGER

SEQ ID NO: 389860 - protein, 9 aa, Homo Sapiens
TKLEKALSA

SEQ ID NO: 389861 - protein, 9 aa, Homo Sapiens
KPGAREGSA

SEQ ID NO: 389862 - protein, 9 aa, Homo Sapiens
VTRRMLFPT

SEQ ID NO: 389863 - protein, 9 aa, Homo Sapiens
RPQPWKRGR

SEQ ID NO: 389864 - protein, 9 aa, Homo Sapiens
SRTPPRRVC

SEQ ID NO: 389865 - protein, 9 aa, Homo Sapiens
VLRLDGSQR

SEQ ID NO: 389866 - protein, 9 aa, Homo Sapiens
CSANPTRPS

SEQ ID NO: 389867 - protein, 9 aa, Homo Sapiens
KRKKQQKIK

SEQ ID NO: 389868 - protein, 9 aa, Homo Sapiens
HLPLYADPY

SEQ ID NO: 389869 - protein, 9 aa, Homo Sapiens
SLGSLYVEL

SEQ ID NO: 389870 - protein, 9 aa, Homo Sapiens
MGILLVRPS

SEQ ID NO: 389871 - protein, 9 aa, Homo Sapiens
NFFDTWAKV

SEQ ID NO: 389872 - protein, 9 aa, Homo Sapiens
SVEGNSVST

SEQ ID NO: 389873 - protein, 9 aa, Homo Sapiens
PSSPRHPSR

SEQ ID NO: 389874 - protein, 9 aa, Homo Sapiens
ATLTCESDV

SEQ ID NO: 389875 - protein, 9 aa, Homo Sapiens
PLGSISSSG

SEQ ID NO: 389876 - protein, 9 aa, Homo Sapiens
APPRPRCTR

SEQ ID NO: 389877 - protein, 9 aa, Homo Sapiens
STRLAVSTR

SEQ ID NO: 389878 - protein, 9 aa, Homo Sapiens
GPHDDFVAD

SEQ ID NO: 389879 - protein, 9 aa, Homo Sapiens
SRVLAQPAA

SEQ ID NO: 389880 - protein, 9 aa, Homo Sapiens
WENCHKDVI

SEQ ID NO: 389881 - protein, 9 aa, Homo Sapiens
LDLPILDDQ

SEQ ID NO: 389882 - protein, 9 aa, Homo Sapiens
ENPQELKEK

SEQ ID NO: 389883 - protein, 9 aa, Homo Sapiens
LSTVRKRVS

SEQ ID NO: 389884 - protein, 9 aa, Homo Sapiens
NQIKLHTQS

SEQ ID NO: 389885 - protein, 9 aa, Homo Sapiens
ALLVSTSQR

SEQ ID NO: 389886 - protein, 9 aa, Homo Sapiens
LKKFSAQYL

SEQ ID NO: 389887 - protein, 9 aa, Homo Sapiens
DKNPCLYGA

SEQ ID NO: 389888 - protein, 9 aa, Homo Sapiens
PSAVPSVAR

SEQ ID NO: 389889 - protein, 9 aa, Homo Sapiens
HPSLPLPLP

SEQ ID NO: 389890 - protein, 9 aa, Homo Sapiens
PEVWKEVRG

SEQ ID NO: 389891 - protein, 9 aa, Homo Sapiens
FNGLRTELV

SEQ ID NO: 389892 - protein, 9 aa, Homo Sapiens
STTCYYPPT

SEQ ID NO: 389893 - protein, 9 aa, Homo Sapiens
ITLGSLRLN

SEQ ID NO: 389894 - protein, 9 aa, Homo Sapiens
VRPEDGRPR

SEQ ID NO: 389895 - protein, 9 aa, Homo Sapiens
TLESGGASR

SEQ ID NO: 389896 - protein, 9 aa, Homo Sapiens
TVFPPTHNT

SEQ ID NO: 389897 - protein, 9 aa, Homo Sapiens
KAVGNPRKC

SEQ ID NO: 389898 - protein, 9 aa, Homo Sapiens
ARETTATRS

SEQ ID NO: 389899 - protein, 9 aa, Homo Sapiens
TLLHLECEK

SEQ ID NO: 389900 - protein, 9 aa, Homo Sapiens
TYMDSLDII

SEQ ID NO: 389901 - protein, 9 aa, Homo Sapiens
KTSRILNLQ

SEQ ID NO: 389902 - protein, 9 aa, Homo Sapiens
AQKCHKKKH

SEQ ID NO: 389903 - protein, 9 aa, Homo Sapiens
IYEYRQFGE

SEQ ID NO: 389904 - protein, 9 aa, Homo Sapiens
RARPTQTHM

SEQ ID NO: 389905 - protein, 9 aa, Homo Sapiens
ARFYSPSPN

SEQ ID NO: 389906 - protein, 9 aa, Homo Sapiens
LSSLLQDTA

SEQ ID NO: 389907 - protein, 9 aa, Homo Sapiens
GGVTDVTKI

SEQ ID NO: 389908 - protein, 9 aa, Homo Sapiens
QDSEETVTR

SEQ ID NO: 389909 - protein, 9 aa, Homo Sapiens
KNPDPRVAG

SEQ ID NO: 389910 - protein, 9 aa, Homo Sapiens
LPAALATWP

SEQ ID NO: 389911 - protein, 9 aa, Homo Sapiens
VYQILESHG

SEQ ID NO: 389912 - protein, 9 aa, Homo Sapiens
CKSLFGYPI

SEQ ID NO: 389913 - protein, 9 aa, Homo Sapiens
SAKRQLLIS

SEQ ID NO: 389914 - protein, 9 aa, Homo Sapiens
ILSAEGPQL

SEQ ID NO: 389915 - protein, 9 aa, Homo Sapiens
SLSSLTRQA

SEQ ID NO: 389916 - protein, 9 aa, Homo Sapiens
RTRHPNMEL

SEQ ID NO: 389917 - protein, 9 aa, Homo Sapiens
PAGGPPART

SEQ ID NO: 389918 - protein, 9 aa, Homo Sapiens
STLIKHTII

SEQ ID NO: 389919 - protein, 9 aa, Homo Sapiens
KKLRSPEGC

SEQ ID NO: 389920 - protein, 9 aa, Homo Sapiens
FHTNPLFFS

SEQ ID NO: 389921 - protein, 9 aa, Homo Sapiens
LVLEKILVN

SEQ ID NO: 389922 - protein, 9 aa, Homo Sapiens
MSRHPFFQL

SEQ ID NO: 389923 - protein, 9 aa, Homo Sapiens
ELRCIEFQV

SEQ ID NO: 389924 - protein, 9 aa, Homo Sapiens
QMVLLPNTE

SEQ ID NO: 389925 - protein, 9 aa, Homo Sapiens
IHANPECRY

SEQ ID NO: 389926 - protein, 9 aa, Homo Sapiens
GASFAIRTR

SEQ ID NO: 389927 - protein, 9 aa, Homo Sapiens
RSPPAAVLV

SEQ ID NO: 389928 - protein, 9 aa, Homo Sapiens
DWFLSASVM

SEQ ID NO: 389929 - protein, 9 aa, Homo Sapiens
PLTMIRVNS

SEQ ID NO: 389930 - protein, 9 aa, Homo Sapiens
PSSKTKDAS

SEQ ID NO: 389931 - protein, 9 aa, Homo Sapiens
LFIIIISLL

SEQ ID NO: 389932 - protein, 9 aa, Homo Sapiens
NEVKEKGHI

SEQ ID NO: 389933 - protein, 9 aa, Homo Sapiens
SGASVAAVA

SEQ ID NO: 389934 - protein, 9 aa, Homo Sapiens
RLHHGTRRP

SEQ ID NO: 389935 - protein, 9 aa, Homo Sapiens
RTESRQHPS

SEQ ID NO: 389936 - protein, 9 aa, Homo Sapiens
SSLSIFASR

SEQ ID NO: 389937 - protein, 9 aa, Homo Sapiens
THCRPHWTL

SEQ ID NO: 389938 - protein, 9 aa, Homo Sapiens
AWKESTIFQ

SEQ ID NO: 389939 - protein, 9 aa, Homo Sapiens
VIWENCHKD

SEQ ID NO: 389940 - protein, 9 aa, Homo Sapiens
HRKLGLGLE

SEQ ID NO: 389941 - protein, 9 aa, Homo Sapiens
SARSPTWCR

SEQ ID NO: 389942 - protein, 9 aa, Homo Sapiens
GPDGLLQLA

SEQ ID NO: 389943 - protein, 9 aa, Homo Sapiens
TLTCESDVN

SEQ ID NO: 389944 - protein, 9 aa, Homo Sapiens
FIWPQHSYK

SEQ ID NO: 389945 - protein, 9 aa, Homo Sapiens
GKDATSPME

SEQ ID NO: 389946 - protein, 9 aa, Homo Sapiens
PPTHNTPDI

SEQ ID NO: 389947 - protein, 9 aa, Homo Sapiens
LSPGVVTDL

SEQ ID NO: 389948 - protein, 9 aa, Homo Sapiens
MHAKGPSGV

SEQ ID NO: 389949 - protein, 9 aa, Homo Sapiens
LCTWEEELT

SEQ ID NO: 389950 - protein, 9 aa, Homo Sapiens
QTQMPGPPC

SEQ ID NO: 389951 - protein, 9 aa, Homo Sapiens
KRLCKQCPV

SEQ ID NO: 389952 - protein, 9 aa, Homo Sapiens
NHTRAQQVL

SEQ ID NO: 389953 - protein, 9 aa, Homo Sapiens
PGKSAVPIP

SEQ ID NO: 389954 - protein, 9 aa, Homo Sapiens
WSPLTSRSL

SEQ ID NO: 389955 - protein, 9 aa, Homo Sapiens
KTALKLTRR

SEQ ID NO: 389956 - protein, 9 aa, Homo Sapiens
MRQLGQALS

SEQ ID NO: 389957 - protein, 9 aa, Homo Sapiens
IREDIVCCL

SEQ ID NO: 389958 - protein, 9 aa, Homo Sapiens
RHRKLGLGL

SEQ ID NO: 389959 - protein, 9 aa, Homo Sapiens
SPSSRKSGT

SEQ ID NO: 389960 - protein, 9 aa, Homo Sapiens
SEPSHQDII

SEQ ID NO: 389961 - protein, 9 aa, Homo Sapiens
QGPGWEEAS

SEQ ID NO: 389962 - protein, 9 aa, Homo Sapiens
REELLKKCS

SEQ ID NO: 389963 - protein, 9 aa, Homo Sapiens
IHWTKEIKE

SEQ ID NO: 389964 - protein, 9 aa, Homo Sapiens
EVITPGFPL

SEQ ID NO: 389965 - protein, 9 aa, Homo Sapiens
RLRDGDCYW

SEQ ID NO: 389966 - protein, 9 aa, Homo Sapiens
DKYVNVFHK

SEQ ID NO: 389967 - protein, 9 aa, Homo Sapiens
DAIELGCDE

SEQ ID NO: 389968 - protein, 9 aa, Homo Sapiens
IGLMMYGLW

SEQ ID NO: 389969 - protein, 9 aa, Homo Sapiens
DTDTIAVHV

SEQ ID NO: 389970 - protein, 9 aa, Homo Sapiens
RRSAAKIVL

SEQ ID NO: 389971 - protein, 9 aa, Homo Sapiens
HPASYSENK

SEQ ID NO: 389972 - protein, 9 aa, Homo Sapiens
TDSARGSGN

SEQ ID NO: 389973 - protein, 9 aa, Homo Sapiens
HHFYLTLES

SEQ ID NO: 389974 - protein, 9 aa, Homo Sapiens
HGCCQCQAG

SEQ ID NO: 389975 - protein, 9 aa, Homo Sapiens
GLLTECLAQ

SEQ ID NO: 389976 - protein, 9 aa, Homo Sapiens
LRRLPAALA

SEQ ID NO: 389977 - protein, 9 aa, Homo Sapiens
KELQKTEEE

SEQ ID NO: 389978 - protein, 9 aa, Homo Sapiens
RQGGSPVGD

SEQ ID NO: 389979 - protein, 9 aa, Homo Sapiens
TRKTKMLVK

SEQ ID NO: 389980 - protein, 9 aa, Homo Sapiens
LTSRFTRGS

SEQ ID NO: 389981 - protein, 9 aa, Homo Sapiens
PGLRPCRCC

SEQ ID NO: 389982 - protein, 9 aa, Homo Sapiens
ELQFHNQRH

SEQ ID NO: 389983 - protein, 9 aa, Homo Sapiens
RVLTGPENV

SEQ ID NO: 389984 - protein, 9 aa, Homo Sapiens
YLKNFHLLT

SEQ ID NO: 389985 - protein, 9 aa, Homo Sapiens
EKKDSAVAS

SEQ ID NO: 389986 - protein, 9 aa, Homo Sapiens
GALVLAIVQ

SEQ ID NO: 389987 - protein, 9 aa, Homo Sapiens
KGSFYRKKL

SEQ ID NO: 389988 - protein, 9 aa, Homo Sapiens
DYKKIPESE

SEQ ID NO: 389989 - protein, 9 aa, Homo Sapiens
TRRSFGASR

SEQ ID NO: 389990 - protein, 9 aa, Homo Sapiens
ASHTNFSSH

SEQ ID NO: 389991 - protein, 9 aa, Homo Sapiens
LAFVHQVNR

SEQ ID NO: 389992 - protein, 9 aa, Homo Sapiens
QSSTSILSA

SEQ ID NO: 389993 - protein, 9 aa, Homo Sapiens
TCSKATFGT

SEQ ID NO: 389994 - protein, 9 aa, Homo Sapiens
HHLVPLFIW

SEQ ID NO: 389995 - protein, 9 aa, Homo Sapiens
GARAHQSSP

SEQ ID NO: 389996 - protein, 9 aa, Homo Sapiens
ENWSPPWRR

SEQ ID NO: 389997 - protein, 9 aa, Homo Sapiens
KKAVSNIDT

SEQ ID NO: 389998 - protein, 9 aa, Homo Sapiens
EVVDGHTVS

SEQ ID NO: 389999 - protein, 9 aa, Homo Sapiens
PRCTRSWAP

SEQ ID NO: 390000 - protein, 9 aa, Homo Sapiens
AGTILSGSI

SEQ ID NO: 390001 - protein, 9 aa, Homo Sapiens
KPKKKKKKI

SEQ ID NO: 390002 - protein, 9 aa, Homo Sapiens
PGSSHACVQ

SEQ ID NO: 390003 - protein, 9 aa, Homo Sapiens
VFKGKRHLT

SEQ ID NO: 390004 - protein, 9 aa, Homo Sapiens
SDPISPEEQ

SEQ ID NO: 390005 - protein, 9 aa, Homo Sapiens
ITSVTLRPW

SEQ ID NO: 390006 - protein, 9 aa, Homo Sapiens
AIGEHLLVI

SEQ ID NO: 390007 - protein, 9 aa, Homo Sapiens
RGTLHTTLA

SEQ ID NO: 390008 - protein, 9 aa, Homo Sapiens
IEYNVEHYV

SEQ ID NO: 390009 - protein, 9 aa, Homo Sapiens
LWPQEESPP

SEQ ID NO: 390010 - protein, 9 aa, Homo Sapiens
VKFFLQLQG

SEQ ID NO: 390011 - protein, 9 aa, Homo Sapiens
SPLTSRFTR

SEQ ID NO: 390012 - protein, 9 aa, Homo Sapiens
QSGWSGEAR

SEQ ID NO: 390013 - protein, 9 aa, Homo Sapiens
SNSENEQPA

SEQ ID NO: 390014 - protein, 9 aa, Homo Sapiens
PKLDSRADA

SEQ ID NO: 390015 - protein, 9 aa, Homo Sapiens
PPECCSSWL

SEQ ID NO: 390016 - protein, 9 aa, Homo Sapiens
AASGLLSID

SEQ ID NO: 390017 - protein, 9 aa, Homo Sapiens
ENKFTLTDN

SEQ ID NO: 390018 - protein, 9 aa, Homo Sapiens
EFSCVFADN

SEQ ID NO: 390019 - protein, 9 aa, Homo Sapiens
ARRSAAKIV

SEQ ID NO: 390020 - protein, 9 aa, Homo Sapiens
VSSRGTFGT

SEQ ID NO: 390021 - protein, 9 aa, Homo Sapiens
SSFCCCTQD

SEQ ID NO: 390022 - protein, 9 aa, Homo Sapiens
CCWAWTAPT

SEQ ID NO: 390023 - protein, 9 aa, Homo Sapiens
PKNKLLKTF

SEQ ID NO: 390024 - protein, 9 aa, Homo Sapiens
STRFTAVTL

SEQ ID NO: 390025 - protein, 9 aa, Homo Sapiens
RKTREASLS

SEQ ID NO: 390026 - protein, 9 aa, Homo Sapiens
RPGSTRSTS

SEQ ID NO: 390027 - protein, 9 aa, Homo Sapiens
SCCAPVPSL

SEQ ID NO: 390028 - protein, 9 aa, Homo Sapiens
KLESLLLYT

SEQ ID NO: 390029 - protein, 9 aa, Homo Sapiens
RASGPLGTS

SEQ ID NO: 390030 - protein, 9 aa, Homo Sapiens
RAGRVALQL

SEQ ID NO: 390031 - protein, 9 aa, Homo Sapiens
KRCDNMCVF

SEQ ID NO: 390032 - protein, 9 aa, Homo Sapiens
LGLQLALFY

SEQ ID NO: 390033 - protein, 9 aa, Homo Sapiens
REATVTLYA

SEQ ID NO: 390034 - protein, 9 aa, Homo Sapiens
KAILSEAST

SEQ ID NO: 390035 - protein, 9 aa, Homo Sapiens
LGDKGLKKM

SEQ ID NO: 390036 - protein, 9 aa, Homo Sapiens
AHIFLIQLI

SEQ ID NO: 390037 - protein, 9 aa, Homo Sapiens
ARTPRGPSE

SEQ ID NO: 390038 - protein, 9 aa, Homo Sapiens
FSAPCCWRL

SEQ ID NO: 390039 - protein, 9 aa, Homo Sapiens
TRQADHTTL

SEQ ID NO: 390040 - protein, 9 aa, Homo Sapiens
ERGGVATPG

SEQ ID NO: 390041 - protein, 9 aa, Homo Sapiens
PPGSSHACV

SEQ ID NO: 390042 - protein, 9 aa, Homo Sapiens
PPPPTKKRG

SEQ ID NO: 390043 - protein, 9 aa, Homo Sapiens
VTNGCISII

SEQ ID NO: 390044 - protein, 9 aa, Homo Sapiens
PAWDVCKGA

SEQ ID NO: 390045 - protein, 9 aa, Homo Sapiens
RLSGFTGLS

SEQ ID NO: 390046 - protein, 9 aa, Homo Sapiens
PARQVRCLE

SEQ ID NO: 390047 - protein, 9 aa, Homo Sapiens
WTPPCDSGG

SEQ ID NO: 390048 - protein, 9 aa, Homo Sapiens
LVDEEQKLP

SEQ ID NO: 390049 - protein, 9 aa, Homo Sapiens
PGPGRRGLR

SEQ ID NO: 390050 - protein, 9 aa, Homo Sapiens
LVCLILGIY

SEQ ID NO: 390051 - protein, 9 aa, Homo Sapiens
GLSHPGLRP

SEQ ID NO: 390052 - protein, 9 aa, Homo Sapiens
QEVEIGTVV

SEQ ID NO: 390053 - protein, 9 aa, Homo Sapiens
WLLEVGSER

SEQ ID NO: 390054 - protein, 9 aa, Homo Sapiens
TLRGVWSLE

SEQ ID NO: 390055 - protein, 9 aa, Homo Sapiens
CSICSPEPG

SEQ ID NO: 390056 - protein, 9 aa, Homo Sapiens
VLEVVVVHE

SEQ ID NO: 390057 - protein, 9 aa, Homo Sapiens
SCRAGWSPS

SEQ ID NO: 390058 - protein, 9 aa, Homo Sapiens
SITRFAFST

SEQ ID NO: 390059 - protein, 9 aa, Homo Sapiens
AVPWRAAPA

SEQ ID NO: 390060 - protein, 9 aa, Homo Sapiens
KKKSTKPHS

SEQ ID NO: 390061 - protein, 9 aa, Homo Sapiens
SESPNQHQT

SEQ ID NO: 390062 - protein, 9 aa, Homo Sapiens
CDKAFRQRP

SEQ ID NO: 390063 - protein, 9 aa, Homo Sapiens
SLAAVISLC

SEQ ID NO: 390064 - protein, 9 aa, Homo Sapiens
EELFSRVPE

SEQ ID NO: 390065 - protein, 9 aa, Homo Sapiens
EKCNKQMKT

SEQ ID NO: 390066 - protein, 9 aa, Homo Sapiens
PGPHDDFVA

SEQ ID NO: 390067 - protein, 9 aa, Homo Sapiens
SQSTIKLVV

SEQ ID NO: 390068 - protein, 9 aa, Homo Sapiens
ALVAELALV

SEQ ID NO: 390069 - protein, 9 aa, Homo Sapiens
EGVHGPGPC

SEQ ID NO: 390070 - protein, 9 aa, Homo Sapiens
RTRPWAKNR

SEQ ID NO: 390071 - protein, 9 aa, Homo Sapiens
FKLALKRVC

SEQ ID NO: 390072 - protein, 9 aa, Homo Sapiens
SQSRGAHGT

SEQ ID NO: 390073 - protein, 9 aa, Homo Sapiens
YDMLNDLAA

SEQ ID NO: 390074 - protein, 9 aa, Homo Sapiens
CDHCQQDVE

SEQ ID NO: 390075 - protein, 9 aa, Homo Sapiens
TCVICLDYL

SEQ ID NO: 390076 - protein, 9 aa, Homo Sapiens
LDILLPSPS

SEQ ID NO: 390077 - protein, 9 aa, Homo Sapiens
MIRWLLCFT

SEQ ID NO: 390078 - protein, 9 aa, Homo Sapiens
SPENHADTI

SEQ ID NO: 390079 - protein, 9 aa, Homo Sapiens
PHWRQQAPP

SEQ ID NO: 390080 - protein, 9 aa, Homo Sapiens
DENAMDAAG

SEQ ID NO: 390081 - protein, 9 aa, Homo Sapiens
FLQVPQGLT

SEQ ID NO: 390082 - protein, 9 aa, Homo Sapiens
ACITDLITF

SEQ ID NO: 390083 - protein, 9 aa, Homo Sapiens
KVAKIGACC

SEQ ID NO: 390084 - protein, 9 aa, Homo Sapiens
FNPRLSRVA

SEQ ID NO: 390085 - protein, 9 aa, Homo Sapiens
VRCLEFNQA

SEQ ID NO: 390086 - protein, 9 aa, Homo Sapiens
TQQPQTPQD

SEQ ID NO: 390087 - protein, 9 aa, Homo Sapiens
NNENCSSSS

SEQ ID NO: 390088 - protein, 9 aa, Homo Sapiens
EGSVSTVVL

SEQ ID NO: 390089 - protein, 9 aa, Homo Sapiens
SATWGLTPS

SEQ ID NO: 390090 - protein, 9 aa, Homo Sapiens
LEQTYITLK

SEQ ID NO: 390091 - protein, 9 aa, Homo Sapiens
FTSGTLGTS

SEQ ID NO: 390092 - protein, 9 aa, Homo Sapiens
TDYLGSYSC

SEQ ID NO: 390093 - protein, 9 aa, Homo Sapiens
EVERHIVSQ

SEQ ID NO: 390094 - protein, 9 aa, Homo Sapiens
PTGMMPNGQ

SEQ ID NO: 390095 - protein, 9 aa, Homo Sapiens
DKSRERGRE

SEQ ID NO: 390096 - protein, 9 aa, Homo Sapiens
PPSAPRASA

SEQ ID NO: 390097 - protein, 9 aa, Homo Sapiens
SQLECHSRI

SEQ ID NO: 390098 - protein, 9 aa, Homo Sapiens
RPCRCCRCL

SEQ ID NO: 390099 - protein, 9 aa, Homo Sapiens
LFSSFFFNF

SEQ ID NO: 390100 - protein, 9 aa, Homo Sapiens
PPPSTAATT

SEQ ID NO: 390101 - protein, 9 aa, Homo Sapiens
RTAATVNSK

SEQ ID NO: 390102 - protein, 9 aa, Homo Sapiens
RHYASPEIK

SEQ ID NO: 390103 - protein, 9 aa, Homo Sapiens
ISTRGSFLA

SEQ ID NO: 390104 - protein, 9 aa, Homo Sapiens
SHRSLAGRN

SEQ ID NO: 390105 - protein, 9 aa, Homo Sapiens
CGKQDIMPE

SEQ ID NO: 390106 - protein, 9 aa, Homo Sapiens
TEIISEIRV

SEQ ID NO: 390107 - protein, 9 aa, Homo Sapiens
LSLYSVAVW

SEQ ID NO: 390108 - protein, 9 aa, Homo Sapiens
PWALATLCF

SEQ ID NO: 390109 - protein, 9 aa, Homo Sapiens
ARNVQLVTG

SEQ ID NO: 390110 - protein, 9 aa, Homo Sapiens
VGYFCFTSV

SEQ ID NO: 390111 - protein, 9 aa, Homo Sapiens
FLSSAVSSI

SEQ ID NO: 390112 - protein, 9 aa, Homo Sapiens
SADKPHKCK

SEQ ID NO: 390113 - protein, 9 aa, Homo Sapiens
QTTDAIFAR

SEQ ID NO: 390114 - protein, 9 aa, Homo Sapiens
FRASGPLGT

SEQ ID NO: 390115 - protein, 9 aa, Homo Sapiens
PVHHTIYET

SEQ ID NO: 390116 - protein, 9 aa, Homo Sapiens
FTRGSSQSR

SEQ ID NO: 390117 - protein, 9 aa, Homo Sapiens
SPASPPTQQ

SEQ ID NO: 390118 - protein, 9 aa, Homo Sapiens
HSGLTQNIL

SEQ ID NO: 390119 - protein, 9 aa, Homo Sapiens
AVEVTQRWR

SEQ ID NO: 390120 - protein, 9 aa, Homo Sapiens
LMTLGMTEL

SEQ ID NO: 390121 - protein, 9 aa, Homo Sapiens
RPSTTRRDS

SEQ ID NO: 390122 - protein, 9 aa, Homo Sapiens
GGTRGPGST

SEQ ID NO: 390123 - protein, 9 aa, Homo Sapiens
WTAPTAWTV

SEQ ID NO: 390124 - protein, 9 aa, Homo Sapiens
AKKCIYLQT

SEQ ID NO: 390125 - protein, 9 aa, Homo Sapiens
NGRLTPQAV

SEQ ID NO: 390126 - protein, 9 aa, Homo Sapiens
SRARRTTFT

SEQ ID NO: 390127 - protein, 9 aa, Homo Sapiens
ERQINHTAF

SEQ ID NO: 390128 - protein, 9 aa, Homo Sapiens
EGVSTSSAG

SEQ ID NO: 390129 - protein, 9 aa, Homo Sapiens
MNYNLSELD

SEQ ID NO: 390130 - protein, 9 aa, Homo Sapiens
HFPLLWDTP

SEQ ID NO: 390131 - protein, 9 aa, Homo Sapiens
QELHAFLES

SEQ ID NO: 390132 - protein, 9 aa, Homo Sapiens
WLQWPHPDP

SEQ ID NO: 390133 - protein, 9 aa, Homo Sapiens
RRIGATTPP

SEQ ID NO: 390134 - protein, 9 aa, Homo Sapiens
TIGEKTEIQ

SEQ ID NO: 390135 - protein, 9 aa, Homo Sapiens
KGIKSTGKV

SEQ ID NO: 390136 - protein, 9 aa, Homo Sapiens
PSRCSNPTS

SEQ ID NO: 390137 - protein, 9 aa, Homo Sapiens
PTGLYCFPS

SEQ ID NO: 390138 - protein, 9 aa, Homo Sapiens
WAPTTPTSA

SEQ ID NO: 390139 - protein, 9 aa, Homo Sapiens
PCKSLFGYP

SEQ ID NO: 390140 - protein, 9 aa, Homo Sapiens
RGLAGPAGV

SEQ ID NO: 390141 - protein, 9 aa, Homo Sapiens
VNSMSIIGS

SEQ ID NO: 390142 - protein, 9 aa, Homo Sapiens
RRFRDLDVC

SEQ ID NO: 390143 - protein, 9 aa, Homo Sapiens
FLVGDPSPR

SEQ ID NO: 390144 - protein, 9 aa, Homo Sapiens
DLPLHFDTA

SEQ ID NO: 390145 - protein, 9 aa, Homo Sapiens
ECTNFTTNV

SEQ ID NO: 390146 - protein, 9 aa, Homo Sapiens
MAVGILAIG

SEQ ID NO: 390147 - protein, 9 aa, Homo Sapiens
WERSPGHPR

SEQ ID NO: 390148 - protein, 9 aa, Homo Sapiens
STFRSRESH

SEQ ID NO: 390149 - protein, 9 aa, Homo Sapiens
WLRVMIRIL

SEQ ID NO: 390150 - protein, 9 aa, Homo Sapiens
GASGWSASC

SEQ ID NO: 390151 - protein, 9 aa, Homo Sapiens
PSRGAGPQS

SEQ ID NO: 390152 - protein, 9 aa, Homo Sapiens
VINEDRKPP

SEQ ID NO: 390153 - protein, 9 aa, Homo Sapiens
LIQRLNFFD

SEQ ID NO: 390154 - protein, 9 aa, Homo Sapiens
ELALVGPHA

SEQ ID NO: 390155 - protein, 9 aa, Homo Sapiens
SSAVSSIGC

SEQ ID NO: 390156 - protein, 9 aa, Homo Sapiens
SQLVYQGSI

SEQ ID NO: 390157 - protein, 9 aa, Homo Sapiens
NENRKLQLE

SEQ ID NO: 390158 - protein, 9 aa, Homo Sapiens
IETLRQKSE

SEQ ID NO: 390159 - protein, 9 aa, Homo Sapiens
ASPPTQQPQ

SEQ ID NO: 390160 - protein, 9 aa, Homo Sapiens
VQTLALTDE

SEQ ID NO: 390161 - protein, 9 aa, Homo Sapiens
VWLLPGMGP

SEQ ID NO: 390162 - protein, 9 aa, Homo Sapiens
KFKLALKRV

SEQ ID NO: 390163 - protein, 9 aa, Homo Sapiens
KLGEREVAL

SEQ ID NO: 390164 - protein, 9 aa, Homo Sapiens
GSLSSHRCA

SEQ ID NO: 390165 - protein, 9 aa, Homo Sapiens
KVSKWSTDD

SEQ ID NO: 390166 - protein, 9 aa, Homo Sapiens
INHNPTPRT

SEQ ID NO: 390167 - protein, 9 aa, Homo Sapiens
GNTQKMFSP

SEQ ID NO: 390168 - protein, 9 aa, Homo Sapiens
VEFGAGTGK

SEQ ID NO: 390169 - protein, 9 aa, Homo Sapiens
TSALVATSC

SEQ ID NO: 390170 - protein, 9 aa, Homo Sapiens
QCEETISTI

SEQ ID NO: 390171 - protein, 9 aa, Homo Sapiens
SKRPLGMDV

SEQ ID NO: 390172 - protein, 9 aa, Homo Sapiens
LVVMSFDRY

SEQ ID NO: 390173 - protein, 9 aa, Homo Sapiens
PDPRVAGLE

SEQ ID NO: 390174 - protein, 9 aa, Homo Sapiens
STIGLGLAA

SEQ ID NO: 390175 - protein, 9 aa, Homo Sapiens
LVATALFLH

SEQ ID NO: 390176 - protein, 9 aa, Homo Sapiens
ARGAKVSRN

SEQ ID NO: 390177 - protein, 9 aa, Homo Sapiens
RNGIMLFDG

SEQ ID NO: 390178 - protein, 9 aa, Homo Sapiens
LTTITTLAS

SEQ ID NO: 390179 - protein, 9 aa, Homo Sapiens
LRCIEFQVP

SEQ ID NO: 390180 - protein, 9 aa, Homo Sapiens
GSSLFPGGP

SEQ ID NO: 390181 - protein, 9 aa, Homo Sapiens
RRSSNKPLR

SEQ ID NO: 390182 - protein, 9 aa, Homo Sapiens
SVKSAEKET

SEQ ID NO: 390183 - protein, 9 aa, Homo Sapiens
SWEIAGSWT

SEQ ID NO: 390184 - protein, 9 aa, Homo Sapiens
HEDIEHRVK

SEQ ID NO: 390185 - protein, 9 aa, Homo Sapiens
RARGSLSSS

SEQ ID NO: 390186 - protein, 9 aa, Homo Sapiens
LSLRLKWIM

SEQ ID NO: 390187 - protein, 9 aa, Homo Sapiens
VENIIRFLP

SEQ ID NO: 390188 - protein, 9 aa, Homo Sapiens
TWRRTGAST

SEQ ID NO: 390189 - protein, 9 aa, Homo Sapiens
WKPGAREGS

SEQ ID NO: 390190 - protein, 9 aa, Homo Sapiens
PGFTGATCL

SEQ ID NO: 390191 - protein, 9 aa, Homo Sapiens
MTNDGPKPG

SEQ ID NO: 390192 - protein, 9 aa, Homo Sapiens
HCPRPHDSP

SEQ ID NO: 390193 - protein, 9 aa, Homo Sapiens
LNTENKFTL

SEQ ID NO: 390194 - protein, 9 aa, Homo Sapiens
ECIPTKRRR

SEQ ID NO: 390195 - protein, 9 aa, Homo Sapiens
LIDFEFCSS

SEQ ID NO: 390196 - protein, 9 aa, Homo Sapiens
LAPLQVTTT

SEQ ID NO: 390197 - protein, 9 aa, Homo Sapiens
EVDPAIKST

SEQ ID NO: 390198 - protein, 9 aa, Homo Sapiens
ILDTAGKEE

SEQ ID NO: 390199 - protein, 9 aa, Homo Sapiens
TTFTTCSRG

SEQ ID NO: 390200 - protein, 9 aa, Homo Sapiens
SLDIITSKV

SEQ ID NO: 390201 - protein, 9 aa, Homo Sapiens
MVMLYPELY

SEQ ID NO: 390202 - protein, 9 aa, Homo Sapiens
TRIAKVLEN

SEQ ID NO: 390203 - protein, 9 aa, Homo Sapiens
DFVADGALL

SEQ ID NO: 390204 - protein, 9 aa, Homo Sapiens
TRRQSEKRS

SEQ ID NO: 390205 - protein, 9 aa, Homo Sapiens
SLSIFASRT

SEQ ID NO: 390206 - protein, 9 aa, Homo Sapiens
DTFSDSEDI

SEQ ID NO: 390207 - protein, 9 aa, Homo Sapiens
DTGLAHDSE

SEQ ID NO: 390208 - protein, 9 aa, Homo Sapiens
MVMTSSEHM

SEQ ID NO: 390209 - protein, 9 aa, Homo Sapiens
WGPRASAPA

SEQ ID NO: 390210 - protein, 9 aa, Homo Sapiens
PRLAAPWLL

SEQ ID NO: 390211 - protein, 9 aa, Homo Sapiens
TTTLKLILV

SEQ ID NO: 390212 - protein, 9 aa, Homo Sapiens
NPRSSITVK

SEQ ID NO: 390213 - protein, 9 aa, Homo Sapiens
LIFWNIKIR

SEQ ID NO: 390214 - protein, 9 aa, Homo Sapiens
INNMTIPSK

SEQ ID NO: 390215 - protein, 9 aa, Homo Sapiens
RFDSKHLTA

SEQ ID NO: 390216 - protein, 9 aa, Homo Sapiens
PPDCYRYAE

SEQ ID NO: 390217 - protein, 9 aa, Homo Sapiens
FYSACMVLG

SEQ ID NO: 390218 - protein, 9 aa, Homo Sapiens
TKGFFDPNM

SEQ ID NO: 390219 - protein, 9 aa, Homo Sapiens
IITLYVFLG

SEQ ID NO: 390220 - protein, 9 aa, Homo Sapiens
KPFSCDECG

SEQ ID NO: 390221 - protein, 9 aa, Homo Sapiens
TGELEVLCK

SEQ ID NO: 390222 - protein, 9 aa, Homo Sapiens
DSASSTRET

SEQ ID NO: 390223 - protein, 9 aa, Homo Sapiens
PQTPPLSTQ

SEQ ID NO: 390224 - protein, 9 aa, Homo Sapiens
VPHLRARVL

SEQ ID NO: 390225 - protein, 9 aa, Homo Sapiens
MLNDLAAYH

SEQ ID NO: 390226 - protein, 9 aa, Homo Sapiens
KCNKQMKTL

SEQ ID NO: 390227 - protein, 9 aa, Homo Sapiens
PSNCGLEET

SEQ ID NO: 390228 - protein, 9 aa, Homo Sapiens
TSSEHMETK

SEQ ID NO: 390229 - protein, 9 aa, Homo Sapiens
AVTLGTRRA

SEQ ID NO: 390230 - protein, 9 aa, Homo Sapiens
QKLVDMKVH

SEQ ID NO: 390231 - protein, 9 aa, Homo Sapiens
SSAKRQLLI

SEQ ID NO: 390232 - protein, 9 aa, Homo Sapiens
TVMAGTILS

SEQ ID NO: 390233 - protein, 9 aa, Homo Sapiens
TPGFPLTMI

SEQ ID NO: 390234 - protein, 9 aa, Homo Sapiens
ETLRQKSEA

SEQ ID NO: 390235 - protein, 9 aa, Homo Sapiens
ASVALFACL

SEQ ID NO: 390236 - protein, 9 aa, Homo Sapiens
ARGTRGTNF

SEQ ID NO: 390237 - protein, 9 aa, Homo Sapiens
PRILARDVK

SEQ ID NO: 390238 - protein, 9 aa, Homo Sapiens
SFFFCLRGH

SEQ ID NO: 390239 - protein, 9 aa, Homo Sapiens
EQFWRIVFW

SEQ ID NO: 390240 - protein, 9 aa, Homo Sapiens
LPSAPPKMV

SEQ ID NO: 390241 - protein, 9 aa, Homo Sapiens
QDPGVPKSL

SEQ ID NO: 390242 - protein, 9 aa, Homo Sapiens
AWARAHLAV

SEQ ID NO: 390243 - protein, 9 aa, Homo Sapiens
AQCIEQATV

SEQ ID NO: 390244 - protein, 9 aa, Homo Sapiens
TGALGSGGA

SEQ ID NO: 390245 - protein, 9 aa, Homo Sapiens
ERCMSVIQS

SEQ ID NO: 390246 - protein, 9 aa, Homo Sapiens
RDVSVCRDA

SEQ ID NO: 390247 - protein, 9 aa, Homo Sapiens
CIWKGIKST

SEQ ID NO: 390248 - protein, 9 aa, Homo Sapiens
VVSKNSILN

SEQ ID NO: 390249 - protein, 9 aa, Homo Sapiens
ARSPTSAPT

SEQ ID NO: 390250 - protein, 9 aa, Homo Sapiens
TRGTNFTRT

SEQ ID NO: 390251 - protein, 9 aa, Homo Sapiens
GTAWSPWTP

SEQ ID NO: 390252 - protein, 9 aa, Homo Sapiens
TSKKDTWSF

SEQ ID NO: 390253 - protein, 9 aa, Homo Sapiens
LVYANECTN

SEQ ID NO: 390254 - protein, 9 aa, Homo Sapiens
SPSPVSGLS

SEQ ID NO: 390255 - protein, 9 aa, Homo Sapiens
FHIKSIAAA

SEQ ID NO: 390256 - protein, 9 aa, Homo Sapiens
ECNQCGETY

SEQ ID NO: 390257 - protein, 9 aa, Homo Sapiens
QRHGPDGLL

SEQ ID NO: 390258 - protein, 9 aa, Homo Sapiens
VVFSLIRWK

SEQ ID NO: 390259 - protein, 9 aa, Homo Sapiens
YPPEFYEHA

SEQ ID NO: 390260 - protein, 9 aa, Homo Sapiens
DHLRKHQCN

SEQ ID NO: 390261 - protein, 9 aa, Homo Sapiens
NHVNEKVEM

SEQ ID NO: 390262 - protein, 9 aa, Homo Sapiens
GRGGGPSPG

SEQ ID NO: 390263 - protein, 9 aa, Homo Sapiens
DVKKVDAQS

SEQ ID NO: 390264 - protein, 9 aa, Homo Sapiens
PGMGPHVPR

SEQ ID NO: 390265 - protein, 9 aa, Homo Sapiens
LREHQRIYT

SEQ ID NO: 390266 - protein, 9 aa, Homo Sapiens
WTAEGSVVG

SEQ ID NO: 390267 - protein, 9 aa, Homo Sapiens
CDEGDAWLL

SEQ ID NO: 390268 - protein, 9 aa, Homo Sapiens
PKKQERNLN

SEQ ID NO: 390269 - protein, 9 aa, Homo Sapiens
RLMGPWHLC

SEQ ID NO: 390270 - protein, 9 aa, Homo Sapiens
SNKPLRGDP

SEQ ID NO: 390271 - protein, 9 aa, Homo Sapiens
LEKELDAPP

SEQ ID NO: 390272 - protein, 9 aa, Homo Sapiens
ISSKEQPVV

SEQ ID NO: 390273 - protein, 9 aa, Homo Sapiens
PVPAPYSSG

SEQ ID NO: 390274 - protein, 9 aa, Homo Sapiens
THPHKEILE

SEQ ID NO: 390275 - protein, 9 aa, Homo Sapiens
YGGAPRPSP

SEQ ID NO: 390276 - protein, 9 aa, Homo Sapiens
KGLKKMTLK

SEQ ID NO: 390277 - protein, 9 aa, Homo Sapiens
RQYMPPEGQ

SEQ ID NO: 390278 - protein, 9 aa, Homo Sapiens
LLTYLFVLL

SEQ ID NO: 390279 - protein, 9 aa, Homo Sapiens
EVRRHFGAT

SEQ ID NO: 390280 - protein, 9 aa, Homo Sapiens
LLQDTAAAL

SEQ ID NO: 390281 - protein, 9 aa, Homo Sapiens
GGLPSGNPW

SEQ ID NO: 390282 - protein, 9 aa, Homo Sapiens
SWVATGLTI

SEQ ID NO: 390283 - protein, 9 aa, Homo Sapiens
HTTLARETS

SEQ ID NO: 390284 - protein, 9 aa, Homo Sapiens
SRIVLLCKD

SEQ ID NO: 390285 - protein, 9 aa, Homo Sapiens
HHGTRRPRW

SEQ ID NO: 390286 - protein, 9 aa, Homo Sapiens
DSWHVDACP

SEQ ID NO: 390287 - protein, 9 aa, Homo Sapiens
STRETSSTR

SEQ ID NO: 390288 - protein, 9 aa, Homo Sapiens
DNSLLNQDF

SEQ ID NO: 390289 - protein, 9 aa, Homo Sapiens
MEPLPPRSP

SEQ ID NO: 390290 - protein, 9 aa, Homo Sapiens
NKKRKKMFL

SEQ ID NO: 390291 - protein, 9 aa, Homo Sapiens
KLNYDREVE

SEQ ID NO: 390292 - protein, 9 aa, Homo Sapiens
KTTKFLDHS

SEQ ID NO: 390293 - protein, 9 aa, Homo Sapiens
SGEARDGSC

SEQ ID NO: 390294 - protein, 9 aa, Homo Sapiens
FKIFIFLIC

SEQ ID NO: 390295 - protein, 9 aa, Homo Sapiens
DAALKCQLC

SEQ ID NO: 390296 - protein, 9 aa, Homo Sapiens
NVTLDGTDV

SEQ ID NO: 390297 - protein, 9 aa, Homo Sapiens
VRQMHSNTP

SEQ ID NO: 390298 - protein, 9 aa, Homo Sapiens
ATHSTTTIL

SEQ ID NO: 390299 - protein, 9 aa, Homo Sapiens
CYWFENTRN

SEQ ID NO: 390300 - protein, 9 aa, Homo Sapiens
CDQCEETIS

SEQ ID NO: 390301 - protein, 9 aa, Homo Sapiens
FEIRRLSSM

SEQ ID NO: 390302 - protein, 9 aa, Homo Sapiens
DVKPEMVML

SEQ ID NO: 390303 - protein, 9 aa, Homo Sapiens
QSILQAIRK

SEQ ID NO: 390304 - protein, 9 aa, Homo Sapiens
ISTLGADWL

SEQ ID NO: 390305 - protein, 9 aa, Homo Sapiens
LLKTLNMIQ

SEQ ID NO: 390306 - protein, 9 aa, Homo Sapiens
LGHVQRRGT

SEQ ID NO: 390307 - protein, 9 aa, Homo Sapiens
RKRRSKVKI

SEQ ID NO: 390308 - protein, 9 aa, Homo Sapiens
LTPSVPPIL

SEQ ID NO: 390309 - protein, 9 aa, Homo Sapiens
ISEIRVPIV

SEQ ID NO: 390310 - protein, 9 aa, Homo Sapiens
GGDATPLHS

SEQ ID NO: 390311 - protein, 9 aa, Homo Sapiens
NCPAAVVDD

SEQ ID NO: 390312 - protein, 9 aa, Homo Sapiens
LHTAAWSCA

SEQ ID NO: 390313 - protein, 9 aa, Homo Sapiens
MEKVPIDTS

SEQ ID NO: 390314 - protein, 9 aa, Homo Sapiens
GGAAAGNPS

SEQ ID NO: 390315 - protein, 9 aa, Homo Sapiens
NIPGAGMDA

SEQ ID NO: 390316 - protein, 9 aa, Homo Sapiens
GGTQEVEIG

SEQ ID NO: 390317 - protein, 9 aa, Homo Sapiens
STWENPQEL

SEQ ID NO: 390318 - protein, 9 aa, Homo Sapiens
IFLLIQSVM

SEQ ID NO: 390319 - protein, 9 aa, Homo Sapiens
ARGLIFGAL

SEQ ID NO: 390320 - protein, 9 aa, Homo Sapiens
YPVHHTIYE

SEQ ID NO: 390321 - protein, 9 aa, Homo Sapiens
KAYMQEEER

SEQ ID NO: 390322 - protein, 9 aa, Homo Sapiens
DSSDSSPKK

SEQ ID NO: 390323 - protein, 9 aa, Homo Sapiens
SHRLFILRQ

SEQ ID NO: 390324 - protein, 9 aa, Homo Sapiens
ANMHIRDFI

SEQ ID NO: 390325 - protein, 9 aa, Homo Sapiens
RARGSLNTN

SEQ ID NO: 390326 - protein, 9 aa, Homo Sapiens
KTCSKATFG

SEQ ID NO: 390327 - protein, 9 aa, Homo Sapiens
LAHDVIHWT

SEQ ID NO: 390328 - protein, 9 aa, Homo Sapiens
ETISTIGLG

SEQ ID NO: 390329 - protein, 9 aa, Homo Sapiens
YYFNVGWNI

SEQ ID NO: 390330 - protein, 9 aa, Homo Sapiens
RANASHTNF

SEQ ID NO: 390331 - protein, 9 aa, Homo Sapiens
APPAGHQEA

SEQ ID NO: 390332 - protein, 9 aa, Homo Sapiens
HTNLCLKLW

SEQ ID NO: 390333 - protein, 9 aa, Homo Sapiens
KRTESRQHP

SEQ ID NO: 390334 - protein, 9 aa, Homo Sapiens
GGPGGAPGP

SEQ ID NO: 390335 - protein, 9 aa, Homo Sapiens
NPFLHHRPK

SEQ ID NO: 390336 - protein, 9 aa, Homo Sapiens
KNPCLYGAY

SEQ ID NO: 390337 - protein, 9 aa, Homo Sapiens
NVPDFDYPP

SEQ ID NO: 390338 - protein, 9 aa, Homo Sapiens
ESDVNPPVS

SEQ ID NO: 390339 - protein, 9 aa, Homo Sapiens
MVIYRGTLS

SEQ ID NO: 390340 - protein, 9 aa, Homo Sapiens
SRYLTPLVY

SEQ ID NO: 390341 - protein, 9 aa, Homo Sapiens
RNVTEILCV

SEQ ID NO: 390342 - protein, 9 aa, Homo Sapiens
CVPTAARPS

SEQ ID NO: 390343 - protein, 9 aa, Homo Sapiens
KFSAQYLSL

SEQ ID NO: 390344 - protein, 9 aa, Homo Sapiens
IPGAGMDAK

SEQ ID NO: 390345 - protein, 9 aa, Homo Sapiens
STCWPRTAS

SEQ ID NO: 390346 - protein, 9 aa, Homo Sapiens
PPRAPAPGC

SEQ ID NO: 390347 - protein, 9 aa, Homo Sapiens
QVGPRPAPR

SEQ ID NO: 390348 - protein, 9 aa, Homo Sapiens
STFGSRSTN

SEQ ID NO: 390349 - protein, 9 aa, Homo Sapiens
LCPSDTVMQ

SEQ ID NO: 390350 - protein, 9 aa, Homo Sapiens
CPINNEQTR

SEQ ID NO: 390351 - protein, 9 aa, Homo Sapiens
NTENPPDCY

SEQ ID NO: 390352 - protein, 9 aa, Homo Sapiens
ELVDESGAP

SEQ ID NO: 390353 - protein, 9 aa, Homo Sapiens
PAQFHARQP

SEQ ID NO: 390354 - protein, 9 aa, Homo Sapiens
DNPTSCLKL

SEQ ID NO: 390355 - protein, 9 aa, Homo Sapiens
VVSQLAGTP

SEQ ID NO: 390356 - protein, 9 aa, Homo Sapiens
VDVSFDFFR

SEQ ID NO: 390357 - protein, 9 aa, Homo Sapiens
FDPNMHENL

SEQ ID NO: 390358 - protein, 9 aa, Homo Sapiens
AGLSSSTFR

SEQ ID NO: 390359 - protein, 9 aa, Homo Sapiens
SQDVASVSS

SEQ ID NO: 390360 - protein, 9 aa, Homo Sapiens
FIQVFIYRL

SEQ ID NO: 390361 - protein, 9 aa, Homo Sapiens
RPQSSYAAG

SEQ ID NO: 390362 - protein, 9 aa, Homo Sapiens
HQLTPRLRI

SEQ ID NO: 390363 - protein, 9 aa, Homo Sapiens
DNILPFRVI

SEQ ID NO: 390364 - protein, 9 aa, Homo Sapiens
VIDFGSRCY

SEQ ID NO: 390365 - protein, 9 aa, Homo Sapiens
PTAWTVAWT

SEQ ID NO: 390366 - protein, 9 aa, Homo Sapiens
QSGGRRLLT

SEQ ID NO: 390367 - protein, 9 aa, Homo Sapiens
FEQVEELFS

SEQ ID NO: 390368 - protein, 9 aa, Homo Sapiens
GLEETIANL

SEQ ID NO: 390369 - protein, 9 aa, Homo Sapiens
RTDSASSTR

SEQ ID NO: 390370 - protein, 9 aa, Homo Sapiens
EPEPMWLAR

SEQ ID NO: 390371 - protein, 9 aa, Homo Sapiens
KIHKSMIQM

SEQ ID NO: 390372 - protein, 9 aa, Homo Sapiens
QWKRLGQLQ

SEQ ID NO: 390373 - protein, 9 aa, Homo Sapiens
SVEHRDNLV

SEQ ID NO: 390374 - protein, 9 aa, Homo Sapiens
HLVQVDLPV

SEQ ID NO: 390375 - protein, 9 aa, Homo Sapiens
VKFLLYKYK

SEQ ID NO: 390376 - protein, 9 aa, Homo Sapiens
FLFLPGLLF

SEQ ID NO: 390377 - protein, 9 aa, Homo Sapiens
SRAGQKPMA

SEQ ID NO: 390378 - protein, 9 aa, Homo Sapiens
RVCRKSVLG

SEQ ID NO: 390379 - protein, 9 aa, Homo Sapiens
LVSDPISPE

SEQ ID NO: 390380 - protein, 9 aa, Homo Sapiens
EKPFVCNGC

SEQ ID NO: 390381 - protein, 9 aa, Homo Sapiens
LGSISSSGQ

SEQ ID NO: 390382 - protein, 9 aa, Homo Sapiens
TITTLASRA

SEQ ID NO: 390383 - protein, 9 aa, Homo Sapiens
VHRQPVQIQ

SEQ ID NO: 390384 - protein, 9 aa, Homo Sapiens
GLFLLQMAI

SEQ ID NO: 390385 - protein, 9 aa, Homo Sapiens
KLTPGREPP

SEQ ID NO: 390386 - protein, 9 aa, Homo Sapiens
DHSDHPMID

SEQ ID NO: 390387 - protein, 9 aa, Homo Sapiens
NSQYTAAVF

SEQ ID NO: 390388 - protein, 9 aa, Homo Sapiens
ESEGRVHIL

SEQ ID NO: 390389 - protein, 9 aa, Homo Sapiens
NSLNYREVR

SEQ ID NO: 390390 - protein, 9 aa, Homo Sapiens
SHRDIPQGV

SEQ ID NO: 390391 - protein, 9 aa, Homo Sapiens
SHLPRPTTG

SEQ ID NO: 390392 - protein, 9 aa, Homo Sapiens
EKHHMLKIM

SEQ ID NO: 390393 - protein, 9 aa, Homo Sapiens
LGARRTVSS

SEQ ID NO: 390394 - protein, 9 aa, Homo Sapiens
DDFVADGAL

SEQ ID NO: 390395 - protein, 9 aa, Homo Sapiens
QKNDLTIQL

SEQ ID NO: 390396 - protein, 9 aa, Homo Sapiens
QHHFSVFVL

SEQ ID NO: 390397 - protein, 9 aa, Homo Sapiens
INGRLTPQA

SEQ ID NO: 390398 - protein, 9 aa, Homo Sapiens
SPVGDVGLG

SEQ ID NO: 390399 - protein, 9 aa, Homo Sapiens
GSPRPGPRG

SEQ ID NO: 390400 - protein, 9 aa, Homo Sapiens
QINHTAFRT

SEQ ID NO: 390401 - protein, 9 aa, Homo Sapiens
YGPDPTKAW

SEQ ID NO: 390402 - protein, 9 aa, Homo Sapiens
SHRCALGAV

SEQ ID NO: 390403 - protein, 9 aa, Homo Sapiens
KEGGAVNCG

SEQ ID NO: 390404 - protein, 9 aa, Homo Sapiens
ESEDTCLEN

SEQ ID NO: 390405 - protein, 9 aa, Homo Sapiens
TDRAKVWTS

SEQ ID NO: 390406 - protein, 9 aa, Homo Sapiens
TLLAPTHVN

SEQ ID NO: 390407 - protein, 9 aa, Homo Sapiens
LTAATVRSI

SEQ ID NO: 390408 - protein, 9 aa, Homo Sapiens
ATVDVSFDF

SEQ ID NO: 390409 - protein, 9 aa, Homo Sapiens
ITLDEALQR

SEQ ID NO: 390410 - protein, 9 aa, Homo Sapiens
ALLEKNQSS

SEQ ID NO: 390411 - protein, 9 aa, Homo Sapiens
NIKIRLLAW

SEQ ID NO: 390412 - protein, 9 aa, Homo Sapiens
KYRNVGLSK

SEQ ID NO: 390413 - protein, 9 aa, Homo Sapiens
RRFISWLQD

SEQ ID NO: 390414 - protein, 9 aa, Homo Sapiens
RDPQDGCND

SEQ ID NO: 390415 - protein, 9 aa, Homo Sapiens
QDLGCAHIL

SEQ ID NO: 390416 - protein, 9 aa, Homo Sapiens
RKKKEVPEF

SEQ ID NO: 390417 - protein, 9 aa, Homo Sapiens
PEHIDPPDP

SEQ ID NO: 390418 - protein, 9 aa, Homo Sapiens
AGSGALFAG

SEQ ID NO: 390419 - protein, 9 aa, Homo Sapiens
NLEKELDAP

SEQ ID NO: 390420 - protein, 9 aa, Homo Sapiens
GLLQLAHLI

SEQ ID NO: 390421 - protein, 9 aa, Homo Sapiens
NILADKPND

SEQ ID NO: 390422 - protein, 9 aa, Homo Sapiens
SLSSSLSIF

SEQ ID NO: 390423 - protein, 9 aa, Homo Sapiens
MLFLILYML

SEQ ID NO: 390424 - protein, 9 aa, Homo Sapiens
AGVLHTAAW

SEQ ID NO: 390425 - protein, 9 aa, Homo Sapiens
LPSGNPWSD

SEQ ID NO: 390426 - protein, 9 aa, Homo Sapiens
QLLAHRHYA

SEQ ID NO: 390427 - protein, 9 aa, Homo Sapiens
AGTTGMCHH

SEQ ID NO: 390428 - protein, 9 aa, Homo Sapiens
AVDAQVGPL

SEQ ID NO: 390429 - protein, 9 aa, Homo Sapiens
NGSLLLLSL

SEQ ID NO: 390430 - protein, 9 aa, Homo Sapiens
EGIFTSKKD

SEQ ID NO: 390431 - protein, 9 aa, Homo Sapiens
EEWYNDSVE

SEQ ID NO: 390432 - protein, 9 aa, Homo Sapiens
DVHRLGSTF

SEQ ID NO: 390433 - protein, 9 aa, Homo Sapiens
TSLSSLAGL

SEQ ID NO: 390434 - protein, 9 aa, Homo Sapiens
GHSDSEGPY

SEQ ID NO: 390435 - protein, 9 aa, Homo Sapiens
EGKEENRDL

SEQ ID NO: 390436 - protein, 9 aa, Homo Sapiens
FYGNSLSTL

SEQ ID NO: 390437 - protein, 9 aa, Homo Sapiens
HRGLAGPAG

SEQ ID NO: 390438 - protein, 9 aa, Homo Sapiens
PHLQPPSRP

SEQ ID NO: 390439 - protein, 9 aa, Homo Sapiens
VILGVCATQ

SEQ ID NO: 390440 - protein, 9 aa, Homo Sapiens
EPEEEAPMR

SEQ ID NO: 390441 - protein, 9 aa, Homo Sapiens
LSSSSTGDT

SEQ ID NO: 390442 - protein, 9 aa, Homo Sapiens
GDIWQGGAS

SEQ ID NO: 390443 - protein, 9 aa, Homo Sapiens
QPCGKQDSC

SEQ ID NO: 390444 - protein, 9 aa, Homo Sapiens
WLQSRDLLT

SEQ ID NO: 390445 - protein, 9 aa, Homo Sapiens
RGSSISRGA

SEQ ID NO: 390446 - protein, 9 aa, Homo Sapiens
GWGQLLLLL

SEQ ID NO: 390447 - protein, 9 aa, Homo Sapiens
CILVNSQYT

SEQ ID NO: 390448 - protein, 9 aa, Homo Sapiens
CRTGASTRA

SEQ ID NO: 390449 - protein, 9 aa, Homo Sapiens
RLPAALATW

SEQ ID NO: 390450 - protein, 9 aa, Homo Sapiens
NLIGREMKN

SEQ ID NO: 390451 - protein, 9 aa, Homo Sapiens
EAEARAKLT

SEQ ID NO: 390452 - protein, 9 aa, Homo Sapiens
NITEPTKFE

SEQ ID NO: 390453 - protein, 9 aa, Homo Sapiens
EMHTLLHLE

SEQ ID NO: 390454 - protein, 9 aa, Homo Sapiens
GTSLSPFAT

SEQ ID NO: 390455 - protein, 9 aa, Homo Sapiens
FAARSTRFT

SEQ ID NO: 390456 - protein, 9 aa, Homo Sapiens
KIGACCCGL

SEQ ID NO: 390457 - protein, 9 aa, Homo Sapiens
TCDTDFLCP

SEQ ID NO: 390458 - protein, 9 aa, Homo Sapiens
LDDVSLHVA

SEQ ID NO: 390459 - protein, 9 aa, Homo Sapiens
TTFERARPT

SEQ ID NO: 390460 - protein, 9 aa, Homo Sapiens
TSGTLGTSN

SEQ ID NO: 390461 - protein, 9 aa, Homo Sapiens
MVGLSGGQR

SEQ ID NO: 390462 - protein, 9 aa, Homo Sapiens
VTHMWFDMT

SEQ ID NO: 390463 - protein, 9 aa, Homo Sapiens
ICPMILRTL

SEQ ID NO: 390464 - protein, 9 aa, Homo Sapiens
INKPEGKPD

SEQ ID NO: 390465 - protein, 9 aa, Homo Sapiens
SMSFFIGYM

SEQ ID NO: 390466 - protein, 9 aa, Homo Sapiens
RGASFAIRT

SEQ ID NO: 390467 - protein, 9 aa, Homo Sapiens
SSTRGTSAA

SEQ ID NO: 390468 - protein, 9 aa, Homo Sapiens
LTGSLPDVE

SEQ ID NO: 390469 - protein, 9 aa, Homo Sapiens
YWGPRASAP

SEQ ID NO: 390470 - protein, 9 aa, Homo Sapiens
SHVINQAMA

SEQ ID NO: 390471 - protein, 9 aa, Homo Sapiens
VPVALKKSA

SEQ ID NO: 390472 - protein, 9 aa, Homo Sapiens
VLINNINGR

SEQ ID NO: 390473 - protein, 9 aa, Homo Sapiens
VPIVTVGVN

SEQ ID NO: 390474 - protein, 9 aa, Homo Sapiens
RCCPPIRTP

SEQ ID NO: 390475 - protein, 9 aa, Homo Sapiens
RALGKWLQW

SEQ ID NO: 390476 - protein, 9 aa, Homo Sapiens
TQNILAHIW

SEQ ID NO: 390477 - protein, 9 aa, Homo Sapiens
ETTQAPRLL

SEQ ID NO: 390478 - protein, 9 aa, Homo Sapiens
SNKRKCVRD

SEQ ID NO: 390479 - protein, 9 aa, Homo Sapiens
PEQPAECQS

SEQ ID NO: 390480 - protein, 9 aa, Homo Sapiens
TSGSTPGSG

SEQ ID NO: 390481 - protein, 9 aa, Homo Sapiens
TQPSQKRAL

SEQ ID NO: 390482 - protein, 9 aa, Homo Sapiens
VTLGGLFPM

SEQ ID NO: 390483 - protein, 9 aa, Homo Sapiens
PDPTKAWPA

SEQ ID NO: 390484 - protein, 9 aa, Homo Sapiens
ERTYLGNVL

SEQ ID NO: 390485 - protein, 9 aa, Homo Sapiens
YKRINKPEG

SEQ ID NO: 390486 - protein, 9 aa, Homo Sapiens
MGYPVPYTF

SEQ ID NO: 390487 - protein, 9 aa, Homo Sapiens
VHDRSETLT

SEQ ID NO: 390488 - protein, 9 aa, Homo Sapiens
MVLLPNTEE

SEQ ID NO: 390489 - protein, 9 aa, Homo Sapiens
DQSFSFHSG

SEQ ID NO: 390490 - protein, 9 aa, Homo Sapiens
HTSRVGTCM

SEQ ID NO: 390491 - protein, 9 aa, Homo Sapiens
TFVLVDEEQ

SEQ ID NO: 390492 - protein, 9 aa, Homo Sapiens
RPQDRRSSN

SEQ ID NO: 390493 - protein, 9 aa, Homo Sapiens
SLAATPLAQ

SEQ ID NO: 390494 - protein, 9 aa, Homo Sapiens
PRSPRCPLP

SEQ ID NO: 390495 - protein, 9 aa, Homo Sapiens
LEEERQINH

SEQ ID NO: 390496 - protein, 9 aa, Homo Sapiens
SGPGKSAVP

SEQ ID NO: 390497 - protein, 9 aa, Homo Sapiens
QQLLAHRHY

SEQ ID NO: 390498 - protein, 9 aa, Homo Sapiens
PRHPSRHPP

SEQ ID NO: 390499 - protein, 9 aa, Homo Sapiens
LTLESFDQK

SEQ ID NO: 390500 - protein, 9 aa, Homo Sapiens
VPVAFVCSK

SEQ ID NO: 390501 - protein, 9 aa, Homo Sapiens
LTPLVYLSF

SEQ ID NO: 390502 - protein, 9 aa, Homo Sapiens
EPGTREWDP

SEQ ID NO: 390503 - protein, 9 aa, Homo Sapiens
EFGSAIRGK

SEQ ID NO: 390504 - protein, 9 aa, Homo Sapiens
ANHSGCIKV

SEQ ID NO: 390505 - protein, 9 aa, Homo Sapiens
WVHIVPVWI

SEQ ID NO: 390506 - protein, 9 aa, Homo Sapiens
TLIKHTIIH

SEQ ID NO: 390507 - protein, 9 aa, Homo Sapiens
TIKELQKTE

SEQ ID NO: 390508 - protein, 9 aa, Homo Sapiens
ITTLASRAN

SEQ ID NO: 390509 - protein, 9 aa, Homo Sapiens
SSTSRARGA

SEQ ID NO: 390510 - protein, 9 aa, Homo Sapiens
HGPGPCIGE

SEQ ID NO: 390511 - protein, 9 aa, Homo Sapiens
CLRTHGCSG

SEQ ID NO: 390512 - protein, 9 aa, Homo Sapiens
DHMLSEVRK

SEQ ID NO: 390513 - protein, 9 aa, Homo Sapiens
CGETYRRLW

SEQ ID NO: 390514 - protein, 9 aa, Homo Sapiens
KYKRINKPE

SEQ ID NO: 390515 - protein, 9 aa, Homo Sapiens
QHGAAAEGP

SEQ ID NO: 390516 - protein, 9 aa, Homo Sapiens
QDGEIVITD

SEQ ID NO: 390517 - protein, 9 aa, Homo Sapiens
VPPPPWLLT

SEQ ID NO: 390518 - protein, 9 aa, Homo Sapiens
TFAAFFASR

SEQ ID NO: 390519 - protein, 9 aa, Homo Sapiens
ACVHNGLTA

SEQ ID NO: 390520 - protein, 9 aa, Homo Sapiens
RDQCQELGC

SEQ ID NO: 390521 - protein, 9 aa, Homo Sapiens
CVDGRRGSG

SEQ ID NO: 390522 - protein, 9 aa, Homo Sapiens
KLLKTFIRW

SEQ ID NO: 390523 - protein, 9 aa, Homo Sapiens
LNFFDTWAK

SEQ ID NO: 390524 - protein, 9 aa, Homo Sapiens
GKGTEVPWP

SEQ ID NO: 390525 - protein, 9 aa, Homo Sapiens
GRPWPPSFS

SEQ ID NO: 390526 - protein, 9 aa, Homo Sapiens
RIGATTPPI

SEQ ID NO: 390527 - protein, 9 aa, Homo Sapiens
LPTPLLRTW

SEQ ID NO: 390528 - protein, 9 aa, Homo Sapiens
APRRKSPLP

SEQ ID NO: 390529 - protein, 9 aa, Homo Sapiens
PHKCKECDK

SEQ ID NO: 390530 - protein, 9 aa, Homo Sapiens
LEEVIREGW

SEQ ID NO: 390531 - protein, 9 aa, Homo Sapiens
LNCPAAVVD

SEQ ID NO: 390532 - protein, 9 aa, Homo Sapiens
EKRLIEIKV

SEQ ID NO: 390533 - protein, 9 aa, Homo Sapiens
ARLQAREHG

SEQ ID NO: 390534 - protein, 9 aa, Homo Sapiens
WKRLGQLQP

SEQ ID NO: 390535 - protein, 9 aa, Homo Sapiens
FVADGALLR

SEQ ID NO: 390536 - protein, 9 aa, Homo Sapiens
EGSACVHNG

SEQ ID NO: 390537 - protein, 9 aa, Homo Sapiens
GEAQCRGRP

SEQ ID NO: 390538 - protein, 9 aa, Homo Sapiens
PSAGRTSAR

SEQ ID NO: 390539 - protein, 9 aa, Homo Sapiens
ADKPHKCKE

SEQ ID NO: 390540 - protein, 9 aa, Homo Sapiens
NIITLYVFL

SEQ ID NO: 390541 - protein, 9 aa, Homo Sapiens
LHCPSVPTA

SEQ ID NO: 390542 - protein, 9 aa, Homo Sapiens
FTDEMDHFD

SEQ ID NO: 390543 - protein, 9 aa, Homo Sapiens
STVGPSGTS

SEQ ID NO: 390544 - protein, 9 aa, Homo Sapiens
AVASTEDSS

SEQ ID NO: 390545 - protein, 9 aa, Homo Sapiens
PLLRLSLRL

SEQ ID NO: 390546 - protein, 9 aa, Homo Sapiens
LKNCIYPLS

SEQ ID NO: 390547 - protein, 9 aa, Homo Sapiens
KNTNQRLQQ

SEQ ID NO: 390548 - protein, 9 aa, Homo Sapiens
GWAGCLQPA

SEQ ID NO: 390549 - protein, 9 aa, Homo Sapiens
FFPTLLPLF

SEQ ID NO: 390550 - protein, 9 aa, Homo Sapiens
VITPGFPLT

SEQ ID NO: 390551 - protein, 9 aa, Homo Sapiens
TEPTKFEKL

SEQ ID NO: 390552 - protein, 9 aa, Homo Sapiens
KFDTTFERA

SEQ ID NO: 390553 - protein, 9 aa, Homo Sapiens
DPIEAPPPS

SEQ ID NO: 390554 - protein, 9 aa, Homo Sapiens
PPIGPSCVP

SEQ ID NO: 390555 - protein, 9 aa, Homo Sapiens
SAPTRWQGL

SEQ ID NO: 390556 - protein, 9 aa, Homo Sapiens
RRDEAGGPG

SEQ ID NO: 390557 - protein, 9 aa, Homo Sapiens
QRAPLKFKL

SEQ ID NO: 390558 - protein, 9 aa, Homo Sapiens
VRSVRRMLE

SEQ ID NO: 390559 - protein, 9 aa, Homo Sapiens
HHYVDRLFD

SEQ ID NO: 390560 - protein, 9 aa, Homo Sapiens
IIGSTNLIV

SEQ ID NO: 390561 - protein, 9 aa, Homo Sapiens
PEIVNAGLR

SEQ ID NO: 390562 - protein, 9 aa, Homo Sapiens
VWVNLIGRE

SEQ ID NO: 390563 - protein, 9 aa, Homo Sapiens
AGLSHPGLR

SEQ ID NO: 390564 - protein, 9 aa, Homo Sapiens
KQQESSFSH

SEQ ID NO: 390565 - protein, 9 aa, Homo Sapiens
LVIYDWLHS

SEQ ID NO: 390566 - protein, 9 aa, Homo Sapiens
ATGLVGCEH

SEQ ID NO: 390567 - protein, 9 aa, Homo Sapiens
VWSLEASSL

SEQ ID NO: 390568 - protein, 9 aa, Homo Sapiens
KSNSENEQP

SEQ ID NO: 390569 - protein, 9 aa, Homo Sapiens
VIQSGTQMI

SEQ ID NO: 390570 - protein, 9 aa, Homo Sapiens
EHENKSNSE

SEQ ID NO: 390571 - protein, 9 aa, Homo Sapiens
EQAQQHVIS

SEQ ID NO: 390572 - protein, 9 aa, Homo Sapiens
RRQSEKRSE

SEQ ID NO: 390573 - protein, 9 aa, Homo Sapiens
GGLDDRSPQ

SEQ ID NO: 390574 - protein, 9 aa, Homo Sapiens
RSPTSSPTA

SEQ ID NO: 390575 - protein, 9 aa, Homo Sapiens
RSTIGTFST

SEQ ID NO: 390576 - protein, 9 aa, Homo Sapiens
PVTSLSSSS

SEQ ID NO: 390577 - protein, 9 aa, Homo Sapiens
LILGIYLCP

SEQ ID NO: 390578 - protein, 9 aa, Homo Sapiens
PTSAVRERG

SEQ ID NO: 390579 - protein, 9 aa, Homo Sapiens
HSESPPAPS

SEQ ID NO: 390580 - protein, 9 aa, Homo Sapiens
SAEKETSLW

SEQ ID NO: 390581 - protein, 9 aa, Homo Sapiens
WQYFEEAFE

SEQ ID NO: 390582 - protein, 9 aa, Homo Sapiens
SAQYLSLSS

SEQ ID NO: 390583 - protein, 9 aa, Homo Sapiens
SQYTAAVFK

SEQ ID NO: 390584 - protein, 9 aa, Homo Sapiens
TPDVFTMID

SEQ ID NO: 390585 - protein, 9 aa, Homo Sapiens
IQRELLKTL

SEQ ID NO: 390586 - protein, 9 aa, Homo Sapiens
IDFGSRCYE

SEQ ID NO: 390587 - protein, 9 aa, Homo Sapiens
PGLRPCGSP

SEQ ID NO: 390588 - protein, 9 aa, Homo Sapiens
HMHNSLNYR

SEQ ID NO: 390589 - protein, 9 aa, Homo Sapiens
WARAHLAVE

SEQ ID NO: 390590 - protein, 9 aa, Homo Sapiens
THTLGTFRA

SEQ ID NO: 390591 - protein, 9 aa, Homo Sapiens
APTRWQGLT

SEQ ID NO: 390592 - protein, 9 aa, Homo Sapiens
AGGSRARCT

SEQ ID NO: 390593 - protein, 9 aa, Homo Sapiens
GTRRPRWTS

SEQ ID NO: 390594 - protein, 9 aa, Homo Sapiens
LCPECGRWF

SEQ ID NO: 390595 - protein, 9 aa, Homo Sapiens
LAAASGPCH

SEQ ID NO: 390596 - protein, 9 aa, Homo Sapiens
DEAGGPGQR

SEQ ID NO: 390597 - protein, 9 aa, Homo Sapiens
RGKSGLLFS

SEQ ID NO: 390598 - protein, 9 aa, Homo Sapiens
TGLYCFPSS

SEQ ID NO: 390599 - protein, 9 aa, Homo Sapiens
LINGSLPSF

SEQ ID NO: 390600 - protein, 9 aa, Homo Sapiens
NSPVGDIPD

SEQ ID NO: 390601 - protein, 9 aa, Homo Sapiens
LEIPRLPHP

SEQ ID NO: 390602 - protein, 9 aa, Homo Sapiens
AAVISLCMY

SEQ ID NO: 390603 - protein, 9 aa, Homo Sapiens
VIREGWRWG

SEQ ID NO: 390604 - protein, 9 aa, Homo Sapiens
YRQFGENRT

SEQ ID NO: 390605 - protein, 9 aa, Homo Sapiens
FLSSRARGS

SEQ ID NO: 390606 - protein, 9 aa, Homo Sapiens
VDFQLVLPG

SEQ ID NO: 390607 - protein, 9 aa, Homo Sapiens
KSCSIIIIT

SEQ ID NO: 390608 - protein, 9 aa, Homo Sapiens
VRLMGPWHL

SEQ ID NO: 390609 - protein, 9 aa, Homo Sapiens
GKEGYRGAC

SEQ ID NO: 390610 - protein, 9 aa, Homo Sapiens
LILGNKALC

SEQ ID NO: 390611 - protein, 9 aa, Homo Sapiens
LFEETKWKA

SEQ ID NO: 390612 - protein, 9 aa, Homo Sapiens
DHFDRERIP

SEQ ID NO: 390613 - protein, 9 aa, Homo Sapiens
AIAATQTQM

SEQ ID NO: 390614 - protein, 9 aa, Homo Sapiens
GLWLGMPAW

SEQ ID NO: 390615 - protein, 9 aa, Homo Sapiens
SATPVEGSP

SEQ ID NO: 390616 - protein, 9 aa, Homo Sapiens
QLCLPPRRL

SEQ ID NO: 390617 - protein, 9 aa, Homo Sapiens
TTLLKGKGI

SEQ ID NO: 390618 - protein, 9 aa, Homo Sapiens
GALGSRGAS

SEQ ID NO: 390619 - protein, 9 aa, Homo Sapiens
PQAVPSLPS

SEQ ID NO: 390620 - protein, 9 aa, Homo Sapiens
WSASCGPTS

SEQ ID NO: 390621 - protein, 9 aa, Homo Sapiens
GSWVATGLT

SEQ ID NO: 390622 - protein, 9 aa, Homo Sapiens
KKTSRILNL

SEQ ID NO: 390623 - protein, 9 aa, Homo Sapiens
PVPSLSLVC

SEQ ID NO: 390624 - protein, 9 aa, Homo Sapiens
REDKSILLN

SEQ ID NO: 390625 - protein, 9 aa, Homo Sapiens
FFQFCKKSC

SEQ ID NO: 390626 - protein, 9 aa, Homo Sapiens
RKSGSGSGL

SEQ ID NO: 390627 - protein, 9 aa, Homo Sapiens
PGPEGGLPS

SEQ ID NO: 390628 - protein, 9 aa, Homo Sapiens
PQAPPKSSA

SEQ ID NO: 390629 - protein, 9 aa, Homo Sapiens
FRSHTFRNK

SEQ ID NO: 390630 - protein, 9 aa, Homo Sapiens
AITDDTLGD

SEQ ID NO: 390631 - protein, 9 aa, Homo Sapiens
CTDYLGSYS

SEQ ID NO: 390632 - protein, 9 aa, Homo Sapiens
ASRGPSTPA

SEQ ID NO: 390633 - protein, 9 aa, Homo Sapiens
ARDGSCKNS

SEQ ID NO: 390634 - protein, 9 aa, Homo Sapiens
FRREREEET

SEQ ID NO: 390635 - protein, 9 aa, Homo Sapiens
AVPIPSTRS

SEQ ID NO: 390636 - protein, 9 aa, Homo Sapiens
SHGAAGSSR

SEQ ID NO: 390637 - protein, 9 aa, Homo Sapiens
AFRSHTFRN

SEQ ID NO: 390638 - protein, 9 aa, Homo Sapiens
KIHTGENPY

SEQ ID NO: 390639 - protein, 9 aa, Homo Sapiens
FNETLTELQ

SEQ ID NO: 390640 - protein, 9 aa, Homo Sapiens
PICSANPTR

SEQ ID NO: 390641 - protein, 9 aa, Homo Sapiens
RPYACPECD

SEQ ID NO: 390642 - protein, 9 aa, Homo Sapiens
ECLAQLAIP

SEQ ID NO: 390643 - protein, 9 aa, Homo Sapiens
LTMIRVNSM

SEQ ID NO: 390644 - protein, 9 aa, Homo Sapiens
QGSFRCLAF

SEQ ID NO: 390645 - protein, 9 aa, Homo Sapiens
PPPGLRPCR

SEQ ID NO: 390646 - protein, 9 aa, Homo Sapiens
SSISRGARR

SEQ ID NO: 390647 - protein, 9 aa, Homo Sapiens
LDHSDHPMI

SEQ ID NO: 390648 - protein, 9 aa, Homo Sapiens
MCHHAQGSV

SEQ ID NO: 390649 - protein, 9 aa, Homo Sapiens
PTCSLFPQP

SEQ ID NO: 390650 - protein, 9 aa, Homo Sapiens
LRSFMKLYH

SEQ ID NO: 390651 - protein, 9 aa, Homo Sapiens
TPAQDTRCT

SEQ ID NO: 390652 - protein, 9 aa, Homo Sapiens
CRDRVLLCC

SEQ ID NO: 390653 - protein, 9 aa, Homo Sapiens
SCMCSPEVT

SEQ ID NO: 390654 - protein, 9 aa, Homo Sapiens
LQAREHGAE

SEQ ID NO: 390655 - protein, 9 aa, Homo Sapiens
VISLCMYTL

SEQ ID NO: 390656 - protein, 9 aa, Homo Sapiens
ATPLAQWAP

SEQ ID NO: 390657 - protein, 9 aa, Homo Sapiens
FCLRGHPSA

SEQ ID NO: 390658 - protein, 9 aa, Homo Sapiens
PVENIIRFL

SEQ ID NO: 390659 - protein, 9 aa, Homo Sapiens
VVLEVVVVH

SEQ ID NO: 390660 - protein, 9 aa, Homo Sapiens
TTLTPIPQS

SEQ ID NO: 390661 - protein, 9 aa, Homo Sapiens
SSPGLGSRI

SEQ ID NO: 390662 - protein, 9 aa, Homo Sapiens
NVLEGCVSW

SEQ ID NO: 390663 - protein, 9 aa, Homo Sapiens
LCKQCPVFY

SEQ ID NO: 390664 - protein, 9 aa, Homo Sapiens
YTKVDPNQW

SEQ ID NO: 390665 - protein, 9 aa, Homo Sapiens
ANERYKVCV

SEQ ID NO: 390666 - protein, 9 aa, Homo Sapiens
RPAHSATGV

SEQ ID NO: 390667 - protein, 9 aa, Homo Sapiens
DRRATGLVG

SEQ ID NO: 390668 - protein, 9 aa, Homo Sapiens
LQRVLTGPE

SEQ ID NO: 390669 - protein, 9 aa, Homo Sapiens
CMWSQGVLV

SEQ ID NO: 390670 - protein, 9 aa, Homo Sapiens
TRKPPHRTS

SEQ ID NO: 390671 - protein, 9 aa, Homo Sapiens
KMLSKKGLL

SEQ ID NO: 390672 - protein, 9 aa, Homo Sapiens
ATKMATLHY

SEQ ID NO: 390673 - protein, 9 aa, Homo Sapiens
RCSNPTSGP

SEQ ID NO: 390674 - protein, 9 aa, Homo Sapiens
WKCVCKWAS

SEQ ID NO: 390675 - protein, 9 aa, Homo Sapiens
HTLGTFRAS

SEQ ID NO: 390676 - protein, 9 aa, Homo Sapiens
ILIPRFPRR

SEQ ID NO: 390677 - protein, 9 aa, Homo Sapiens
LQLAHLIHR

SEQ ID NO: 390678 - protein, 9 aa, Homo Sapiens
GSLLLLSLS

SEQ ID NO: 390679 - protein, 9 aa, Homo Sapiens
PGVRALGKW

SEQ ID NO: 390680 - protein, 9 aa, Homo Sapiens
LAGPAGVLH

SEQ ID NO: 390681 - protein, 9 aa, Homo Sapiens
RSTSRARGT

SEQ ID NO: 390682 - protein, 9 aa, Homo Sapiens
HDWCSTVHG

SEQ ID NO: 390683 - protein, 9 aa, Homo Sapiens
QPNLLIIDK

SEQ ID NO: 390684 - protein, 9 aa, Homo Sapiens
GGSWPPALW

SEQ ID NO: 390685 - protein, 9 aa, Homo Sapiens
ATGVLQQLL

SEQ ID NO: 390686 - protein, 9 aa, Homo Sapiens
TPPIGPSCV

SEQ ID NO: 390687 - protein, 9 aa, Homo Sapiens
KVTRKIIRQ

SEQ ID NO: 390688 - protein, 9 aa, Homo Sapiens
LKKCSLYGK

SEQ ID NO: 390689 - protein, 9 aa, Homo Sapiens
LKESCVQRR

SEQ ID NO: 390690 - protein, 9 aa, Homo Sapiens
MAASVSSCN

SEQ ID NO: 390691 - protein, 9 aa, Homo Sapiens
GEREVALVH

SEQ ID NO: 390692 - protein, 9 aa, Homo Sapiens
ANVYKAKCE

SEQ ID NO: 390693 - protein, 9 aa, Homo Sapiens
LLDVGLTSA

SEQ ID NO: 390694 - protein, 9 aa, Homo Sapiens
NETAFSGGG

SEQ ID NO: 390695 - protein, 9 aa, Homo Sapiens
SGNPWSDPQ

SEQ ID NO: 390696 - protein, 9 aa, Homo Sapiens
KTLRGVWSL

SEQ ID NO: 390697 - protein, 9 aa, Homo Sapiens
GYMMKILYE

SEQ ID NO: 390698 - protein, 9 aa, Homo Sapiens
ITLLHRTQK

SEQ ID NO: 390699 - protein, 9 aa, Homo Sapiens
FPANVPVLR

SEQ ID NO: 390700 - protein, 9 aa, Homo Sapiens
LMLSNILGV

SEQ ID NO: 390701 - protein, 9 aa, Homo Sapiens
WKTILKERR

SEQ ID NO: 390702 - protein, 9 aa, Homo Sapiens
GPPPNMTSI

SEQ ID NO: 390703 - protein, 9 aa, Homo Sapiens
RCLLLWPTS

SEQ ID NO: 390704 - protein, 9 aa, Homo Sapiens
RTRGTLHTT

SEQ ID NO: 390705 - protein, 9 aa, Homo Sapiens
EICAGTAFY

SEQ ID NO: 390706 - protein, 9 aa, Homo Sapiens
CECPNPSRL

SEQ ID NO: 390707 - protein, 9 aa, Homo Sapiens
GTLEAREAT

SEQ ID NO: 390708 - protein, 9 aa, Homo Sapiens
SLLQDTAAA

SEQ ID NO: 390709 - protein, 9 aa, Homo Sapiens
HGLLRQLGK

SEQ ID NO: 390710 - protein, 9 aa, Homo Sapiens
NTFRKNPDP

SEQ ID NO: 390711 - protein, 9 aa, Homo Sapiens
FLWNYMKLL

SEQ ID NO: 390712 - protein, 9 aa, Homo Sapiens
EARSTSNTR

SEQ ID NO: 390713 - protein, 9 aa, Homo Sapiens
SVEDTVKNA

SEQ ID NO: 390714 - protein, 9 aa, Homo Sapiens
RTRGPNGAR

SEQ ID NO: 390715 - protein, 9 aa, Homo Sapiens
LGSGVIVVQ

SEQ ID NO: 390716 - protein, 9 aa, Homo Sapiens
RTLLAPTHV

SEQ ID NO: 390717 - protein, 9 aa, Homo Sapiens
MLWAIPEFG

SEQ ID NO: 390718 - protein, 9 aa, Homo Sapiens
IGTHAALYL

SEQ ID NO: 390719 - protein, 9 aa, Homo Sapiens
PSASRPTAA

SEQ ID NO: 390720 - protein, 9 aa, Homo Sapiens
FARFTRGAR

SEQ ID NO: 390721 - protein, 9 aa, Homo Sapiens
FAVLRGRGA

SEQ ID NO: 390722 - protein, 9 aa, Homo Sapiens
LKKQKLVDM

SEQ ID NO: 390723 - protein, 9 aa, Homo Sapiens
QSRMDQWMD

SEQ ID NO: 390724 - protein, 9 aa, Homo Sapiens
ATCLLRAVP

SEQ ID NO: 390725 - protein, 9 aa, Homo Sapiens
DVYVLSEQH

SEQ ID NO: 390726 - protein, 9 aa, Homo Sapiens
KSKNSASPH

SEQ ID NO: 390727 - protein, 9 aa, Homo Sapiens
NSENEQPAS

SEQ ID NO: 390728 - protein, 9 aa, Homo Sapiens
KKFSAQYLS

SEQ ID NO: 390729 - protein, 9 aa, Homo Sapiens
FTSKKDTWS

SEQ ID NO: 390730 - protein, 9 aa, Homo Sapiens
SCQKLPEKT

SEQ ID NO: 390731 - protein, 9 aa, Homo Sapiens
TKLKPTKRK

SEQ ID NO: 390732 - protein, 9 aa, Homo Sapiens
GWSQQKEVE

SEQ ID NO: 390733 - protein, 9 aa, Homo Sapiens
PINNEQTRL

SEQ ID NO: 390734 - protein, 9 aa, Homo Sapiens
GIWEVMPRT

SEQ ID NO: 390735 - protein, 9 aa, Homo Sapiens
LQSKNMDHV

SEQ ID NO: 390736 - protein, 9 aa, Homo Sapiens
RSETLTDSF

SEQ ID NO: 390737 - protein, 9 aa, Homo Sapiens
AYMAPEHID

SEQ ID NO: 390738 - protein, 9 aa, Homo Sapiens
QLVLPGEAD

SEQ ID NO: 390739 - protein, 9 aa, Homo Sapiens
FTVVQNERF

SEQ ID NO: 390740 - protein, 9 aa, Homo Sapiens
IAKVLENNQ

SEQ ID NO: 390741 - protein, 9 aa, Homo Sapiens
VLLVHLWQR

SEQ ID NO: 390742 - protein, 9 aa, Homo Sapiens
SGALFAGVN

SEQ ID NO: 390743 - protein, 9 aa, Homo Sapiens
IYPLSMCIN

SEQ ID NO: 390744 - protein, 9 aa, Homo Sapiens
TNRARLSLS

SEQ ID NO: 390745 - protein, 9 aa, Homo Sapiens
RAQGTRRSS

SEQ ID NO: 390746 - protein, 9 aa, Homo Sapiens
QLAIIRDDI

SEQ ID NO: 390747 - protein, 9 aa, Homo Sapiens
GRGTMSVSA

SEQ ID NO: 390748 - protein, 9 aa, Homo Sapiens
GSRARCTRA

SEQ ID NO: 390749 - protein, 9 aa, Homo Sapiens
ILLVVMSFD

SEQ ID NO: 390750 - protein, 9 aa, Homo Sapiens
WPTRRSTMS

SEQ ID NO: 390751 - protein, 9 aa, Homo Sapiens
IPTKRRRRA

SEQ ID NO: 390752 - protein, 9 aa, Homo Sapiens
KPPHRTSSH

SEQ ID NO: 390753 - protein, 9 aa, Homo Sapiens
GLFAVLRGR

SEQ ID NO: 390754 - protein, 9 aa, Homo Sapiens
APAGTGTAS

SEQ ID NO: 390755 - protein, 9 aa, Homo Sapiens
EKKCRLFYK

SEQ ID NO: 390756 - protein, 9 aa, Homo Sapiens
KHQHVHTGE

SEQ ID NO: 390757 - protein, 9 aa, Homo Sapiens
LVIGHYYVA

SEQ ID NO: 390758 - protein, 9 aa, Homo Sapiens
EHRDNLVVV

SEQ ID NO: 390759 - protein, 9 aa, Homo Sapiens
YFNVGWNIF

SEQ ID NO: 390760 - protein, 9 aa, Homo Sapiens
DVIKKAYMQ

SEQ ID NO: 390761 - protein, 9 aa, Homo Sapiens
TPCKSLFGY

SEQ ID NO: 390762 - protein, 9 aa, Homo Sapiens
SLPENRPLV

SEQ ID NO: 390763 - protein, 9 aa, Homo Sapiens
IGEESGGVV

SEQ ID NO: 390764 - protein, 9 aa, Homo Sapiens
QMIFAPEES

SEQ ID NO: 390765 - protein, 9 aa, Homo Sapiens
SYPVHHTIY

SEQ ID NO: 390766 - protein, 9 aa, Homo Sapiens
SCTTFTRHS

SEQ ID NO: 390767 - protein, 9 aa, Homo Sapiens
AATTAATFR

SEQ ID NO: 390768 - protein, 9 aa, Homo Sapiens
QMKTLRGVW

SEQ ID NO: 390769 - protein, 9 aa, Homo Sapiens
VCNGCGKAF

SEQ ID NO: 390770 - protein, 9 aa, Homo Sapiens
FGTSITSVT

SEQ ID NO: 390771 - protein, 9 aa, Homo Sapiens
EGCVSWSSP

SEQ ID NO: 390772 - protein, 9 aa, Homo Sapiens
IKQKVLREK

SEQ ID NO: 390773 - protein, 9 aa, Homo Sapiens
RPQPLSSLL

SEQ ID NO: 390774 - protein, 9 aa, Homo Sapiens
SFTHCRPHW

SEQ ID NO: 390775 - protein, 9 aa, Homo Sapiens
STFGTSITS

SEQ ID NO: 390776 - protein, 9 aa, Homo Sapiens
VERHIVSQL

SEQ ID NO: 390777 - protein, 9 aa, Homo Sapiens
GLTQNILAH

SEQ ID NO: 390778 - protein, 9 aa, Homo Sapiens
TGTASQGLP

SEQ ID NO: 390779 - protein, 9 aa, Homo Sapiens
HPRGSQSAL

SEQ ID NO: 390780 - protein, 9 aa, Homo Sapiens
SEAEAQVPH

SEQ ID NO: 390781 - protein, 9 aa, Homo Sapiens
PVGDVGLGV

SEQ ID NO: 390782 - protein, 9 aa, Homo Sapiens
PQLENWSPP

SEQ ID NO: 390783 - protein, 9 aa, Homo Sapiens
IICNHMHFH

SEQ ID NO: 390784 - protein, 9 aa, Homo Sapiens
LFEGIKRKK

SEQ ID NO: 390785 - protein, 9 aa, Homo Sapiens
RDPNNYRTR

SEQ ID NO: 390786 - protein, 9 aa, Homo Sapiens
GGASRALFT

SEQ ID NO: 390787 - protein, 9 aa, Homo Sapiens
RYLSLPKIR

SEQ ID NO: 390788 - protein, 9 aa, Homo Sapiens
PRRPQPWKR

SEQ ID NO: 390789 - protein, 9 aa, Homo Sapiens
AGCIFMEEN

SEQ ID NO: 390790 - protein, 9 aa, Homo Sapiens
GTSITLSTI

SEQ ID NO: 390791 - protein, 9 aa, Homo Sapiens
TQHQLTPRL

SEQ ID NO: 390792 - protein, 9 aa, Homo Sapiens
FLIFWNIKI

SEQ ID NO: 390793 - protein, 9 aa, Homo Sapiens
DKMCNDVSV

SEQ ID NO: 390794 - protein, 9 aa, Homo Sapiens
LEQLGRGTM

SEQ ID NO: 390795 - protein, 9 aa, Homo Sapiens
STGCYLCQP

SEQ ID NO: 390796 - protein, 9 aa, Homo Sapiens
PRVFYMNQR

SEQ ID NO: 390797 - protein, 9 aa, Homo Sapiens
KLRIFFLFN

SEQ ID NO: 390798 - protein, 9 aa, Homo Sapiens
TALPAVRPE

SEQ ID NO: 390799 - protein, 9 aa, Homo Sapiens
ALFYQGPGW

SEQ ID NO: 390800 - protein, 9 aa, Homo Sapiens
TTPPRYRAD

SEQ ID NO: 390801 - protein, 9 aa, Homo Sapiens
GRSAEVTKM

SEQ ID NO: 390802 - protein, 9 aa, Homo Sapiens
RNRCFPEEN

SEQ ID NO: 390803 - protein, 9 aa, Homo Sapiens
GEVAADEQG

SEQ ID NO: 390804 - protein, 9 aa, Homo Sapiens
LSALRVSPV

SEQ ID NO: 390805 - protein, 9 aa, Homo Sapiens
PRGGHPQPR

SEQ ID NO: 390806 - protein, 9 aa, Homo Sapiens
VGGTQEVEI

SEQ ID NO: 390807 - protein, 9 aa, Homo Sapiens
KKIPESEAE

SEQ ID NO: 390808 - protein, 9 aa, Homo Sapiens
PEGGPWRGQ

SEQ ID NO: 390809 - protein, 9 aa, Homo Sapiens
RHQDKYYQM

SEQ ID NO: 390810 - protein, 9 aa, Homo Sapiens
HWVQKILAA

SEQ ID NO: 390811 - protein, 9 aa, Homo Sapiens
CITDLITFP

SEQ ID NO: 390812 - protein, 9 aa, Homo Sapiens
GALDLETCG

SEQ ID NO: 390813 - protein, 9 aa, Homo Sapiens
DLMELVFLT

SEQ ID NO: 390814 - protein, 9 aa, Homo Sapiens
GSSISRGAR

SEQ ID NO: 390815 - protein, 9 aa, Homo Sapiens
TRSWAPTTP

SEQ ID NO: 390816 - protein, 9 aa, Homo Sapiens
PAQAGARTP

SEQ ID NO: 390817 - protein, 9 aa, Homo Sapiens
RAEIQHCQH

SEQ ID NO: 390818 - protein, 9 aa, Homo Sapiens
ELCTWEEEL

SEQ ID NO: 390819 - protein, 9 aa, Homo Sapiens
PWRIQSLPL

SEQ ID NO: 390820 - protein, 9 aa, Homo Sapiens
IPKYCVPNY

SEQ ID NO: 390821 - protein, 9 aa, Homo Sapiens
NAEPTKRPD

SEQ ID NO: 390822 - protein, 9 aa, Homo Sapiens
VAEVSCSHT

SEQ ID NO: 390823 - protein, 9 aa, Homo Sapiens
CLRGHPSAF

SEQ ID NO: 390824 - protein, 9 aa, Homo Sapiens
ALGTASEGW

SEQ ID NO: 390825 - protein, 9 aa, Homo Sapiens
VLVRHLPKS

SEQ ID NO: 390826 - protein, 9 aa, Homo Sapiens
ANASHTNFS

SEQ ID NO: 390827 - protein, 9 aa, Homo Sapiens
CCVIIPPGS

SEQ ID NO: 390828 - protein, 9 aa, Homo Sapiens
NHCQMSGTS

SEQ ID NO: 390829 - protein, 9 aa, Homo Sapiens
WVADLLQHI

SEQ ID NO: 390830 - protein, 9 aa, Homo Sapiens
HEGSACVHN

SEQ ID NO: 390831 - protein, 9 aa, Homo Sapiens
LCNILRKCK

SEQ ID NO: 390832 - protein, 9 aa, Homo Sapiens
SASSTRETS

SEQ ID NO: 390833 - protein, 9 aa, Homo Sapiens
YSGAQVCVL

SEQ ID NO: 390834 - protein, 9 aa, Homo Sapiens
LQQQCQPPT

SEQ ID NO: 390835 - protein, 9 aa, Homo Sapiens
LMAVGILAI

SEQ ID NO: 390836 - protein, 9 aa, Homo Sapiens
TRDYIVEPS

SEQ ID NO: 390837 - protein, 9 aa, Homo Sapiens
SPGNRGLPL

SEQ ID NO: 390838 - protein, 9 aa, Homo Sapiens
SLYVELYVC

SEQ ID NO: 390839 - protein, 9 aa, Homo Sapiens
GVIVVQLAQ

SEQ ID NO: 390840 - protein, 9 aa, Homo Sapiens
PRAPAPGCS

SEQ ID NO: 390841 - protein, 9 aa, Homo Sapiens
CDSGGREDL

SEQ ID NO: 390842 - protein, 9 aa, Homo Sapiens
GCHKKTSQL

SEQ ID NO: 390843 - protein, 9 aa, Homo Sapiens
AEPELPENM

SEQ ID NO: 390844 - protein, 9 aa, Homo Sapiens
PQPWKRGRT

SEQ ID NO: 390845 - protein, 9 aa, Homo Sapiens
SLAGLSSST

SEQ ID NO: 390846 - protein, 9 aa, Homo Sapiens
IRIELRSQT

SEQ ID NO: 390847 - protein, 9 aa, Homo Sapiens
ECDKAFRSK

SEQ ID NO: 390848 - protein, 9 aa, Homo Sapiens
RSGTCCWAW

SEQ ID NO: 390849 - protein, 9 aa, Homo Sapiens
GGQEYMVKE

SEQ ID NO: 390850 - protein, 9 aa, Homo Sapiens
GHCYSCMCS

SEQ ID NO: 390851 - protein, 9 aa, Homo Sapiens
EMAFSSCAA

SEQ ID NO: 390852 - protein, 9 aa, Homo Sapiens
RSTTLARGS

SEQ ID NO: 390853 - protein, 9 aa, Homo Sapiens
TNFTRTSSR

SEQ ID NO: 390854 - protein, 9 aa, Homo Sapiens
SEEPSQNDE

SEQ ID NO: 390855 - protein, 9 aa, Homo Sapiens
TGLTIPVGK

SEQ ID NO: 390856 - protein, 9 aa, Homo Sapiens
YDKMCNDVS

SEQ ID NO: 390857 - protein, 9 aa, Homo Sapiens
KKRAPHLQP

SEQ ID NO: 390858 - protein, 9 aa, Homo Sapiens
RHLPKSIPV

SEQ ID NO: 390859 - protein, 9 aa, Homo Sapiens
IQKHKRLEQ

SEQ ID NO: 390860 - protein, 9 aa, Homo Sapiens
PRCPLPLPP

SEQ ID NO: 390861 - protein, 9 aa, Homo Sapiens
YFRSPLPTT

SEQ ID NO: 390862 - protein, 9 aa, Homo Sapiens
RKERKAAGR

SEQ ID NO: 390863 - protein, 9 aa, Homo Sapiens
RHWRQIDRG

SEQ ID NO: 390864 - protein, 9 aa, Homo Sapiens
GEDVVGGGA

SEQ ID NO: 390865 - protein, 9 aa, Homo Sapiens
RSGIKKQHS

SEQ ID NO: 390866 - protein, 9 aa, Homo Sapiens
VTPRRSPAS

SEQ ID NO: 390867 - protein, 9 aa, Homo Sapiens
KKHLCSRTH

SEQ ID NO: 390868 - protein, 9 aa, Homo Sapiens
GPPPQGDRP

SEQ ID NO: 390869 - protein, 9 aa, Homo Sapiens
FDILEREKH

SEQ ID NO: 390870 - protein, 9 aa, Homo Sapiens
EPERTMILI

SEQ ID NO: 390871 - protein, 9 aa, Homo Sapiens
PSARSPTWC

SEQ ID NO: 390872 - protein, 9 aa, Homo Sapiens
PWHLCMGLK

SEQ ID NO: 390873 - protein, 9 aa, Homo Sapiens
ILSALRVSP

SEQ ID NO: 390874 - protein, 9 aa, Homo Sapiens
VKSQIQALR

SEQ ID NO: 390875 - protein, 9 aa, Homo Sapiens
RKSPLPLKQ

SEQ ID NO: 390876 - protein, 9 aa, Homo Sapiens
GNSVSTTCY

SEQ ID NO: 390877 - protein, 9 aa, Homo Sapiens
NTEEKSKSM

SEQ ID NO: 390878 - protein, 9 aa, Homo Sapiens
KRPLGMDVQ

SEQ ID NO: 390879 - protein, 9 aa, Homo Sapiens
EVTDHMLSE

SEQ ID NO: 390880 - protein, 9 aa, Homo Sapiens
IGQQFATSE

SEQ ID NO: 390881 - protein, 9 aa, Homo Sapiens
VTAVGVEKM

SEQ ID NO: 390882 - protein, 9 aa, Homo Sapiens
LRFFIHYSS

SEQ ID NO: 390883 - protein, 9 aa, Homo Sapiens
TLTHFSPQP

SEQ ID NO: 390884 - protein, 9 aa, Homo Sapiens
TAWTVAWTP

SEQ ID NO: 390885 - protein, 9 aa, Homo Sapiens
RNYLGGFAC

SEQ ID NO: 390886 - protein, 9 aa, Homo Sapiens
DAPRLAAPW

SEQ ID NO: 390887 - protein, 9 aa, Homo Sapiens
GHMLQGRPG

SEQ ID NO: 390888 - protein, 9 aa, Homo Sapiens
CVCKWASRL

SEQ ID NO: 390889 - protein, 9 aa, Homo Sapiens
LKQINSSPV

SEQ ID NO: 390890 - protein, 9 aa, Homo Sapiens
ELQQEEEPL

SEQ ID NO: 390891 - protein, 9 aa, Homo Sapiens
GWSPSPSPL

SEQ ID NO: 390892 - protein, 9 aa, Homo Sapiens
GECYCKEGF

SEQ ID NO: 390893 - protein, 9 aa, Homo Sapiens
PPARTPRGP

SEQ ID NO: 390894 - protein, 9 aa, Homo Sapiens
SLLNQDFLQ

SEQ ID NO: 390895 - protein, 9 aa, Homo Sapiens
VFLIFWNIK

SEQ ID NO: 390896 - protein, 9 aa, Homo Sapiens
CSRGARGAK

SEQ ID NO: 390897 - protein, 9 aa, Homo Sapiens
EKPIYSIGG

SEQ ID NO: 390898 - protein, 9 aa, Homo Sapiens
ARNNAHVIF

SEQ ID NO: 390899 - protein, 9 aa, Homo Sapiens
SHVDLETVA

SEQ ID NO: 390900 - protein, 9 aa, Homo Sapiens
GLGAPPTCS

SEQ ID NO: 390901 - protein, 9 aa, Homo Sapiens
VTSSLGIRA

SEQ ID NO: 390902 - protein, 9 aa, Homo Sapiens
LLVHLWQRV

SEQ ID NO: 390903 - protein, 9 aa, Homo Sapiens
EFTPLKKMS

SEQ ID NO: 390904 - protein, 9 aa, Homo Sapiens
CAASERLNR

SEQ ID NO: 390905 - protein, 9 aa, Homo Sapiens
EMERFDNLI

SEQ ID NO: 390906 - protein, 9 aa, Homo Sapiens
LAGLSSSTF

SEQ ID NO: 390907 - protein, 9 aa, Homo Sapiens
LYHSLVMCL

SEQ ID NO: 390908 - protein, 9 aa, Homo Sapiens
PPISITNTA

SEQ ID NO: 390909 - protein, 9 aa, Homo Sapiens
TASSHHYVD

SEQ ID NO: 390910 - protein, 9 aa, Homo Sapiens
SWRMEAHTG

SEQ ID NO: 390911 - protein, 9 aa, Homo Sapiens
GNRGLPLPP

SEQ ID NO: 390912 - protein, 9 aa, Homo Sapiens
IPRFPRRVL

SEQ ID NO: 390913 - protein, 9 aa, Homo Sapiens
LASCSRGAR

SEQ ID NO: 390914 - protein, 9 aa, Homo Sapiens
GPEIVNAGL

SEQ ID NO: 390915 - protein, 9 aa, Homo Sapiens
QFILFGPFL

SEQ ID NO: 390916 - protein, 9 aa, Homo Sapiens
AGLPDEPSS

SEQ ID NO: 390917 - protein, 9 aa, Homo Sapiens
GGTSRTSLT

SEQ ID NO: 390918 - protein, 9 aa, Homo Sapiens
EDVLVHQLL

SEQ ID NO: 390919 - protein, 9 aa, Homo Sapiens
ELIHEIPLP

SEQ ID NO: 390920 - protein, 9 aa, Homo Sapiens
VLLCCPSWS

SEQ ID NO: 390921 - protein, 9 aa, Homo Sapiens
GAHGTRGTT

SEQ ID NO: 390922 - protein, 9 aa, Homo Sapiens
LRIQTRSFL

SEQ ID NO: 390923 - protein, 9 aa, Homo Sapiens
PGVRAPEVA

SEQ ID NO: 390924 - protein, 9 aa, Homo Sapiens
FFVLVNLEV

SEQ ID NO: 390925 - protein, 9 aa, Homo Sapiens
LYVVHVVFS

SEQ ID NO: 390926 - protein, 9 aa, Homo Sapiens
LRKKENENR

SEQ ID NO: 390927 - protein, 9 aa, Homo Sapiens
CGQPTHCST

SEQ ID NO: 390928 - protein, 9 aa, Homo Sapiens
SPQGASSIP

SEQ ID NO: 390929 - protein, 9 aa, Homo Sapiens
VFDDIPKCE

SEQ ID NO: 390930 - protein, 9 aa, Homo Sapiens
EFNILKTAL

SEQ ID NO: 390931 - protein, 9 aa, Homo Sapiens
FNAPPAGHQ

SEQ ID NO: 390932 - protein, 9 aa, Homo Sapiens
EETAMRREV

SEQ ID NO: 390933 - protein, 9 aa, Homo Sapiens
TKFLDHSDH

SEQ ID NO: 390934 - protein, 9 aa, Homo Sapiens
KVLREKVPC

SEQ ID NO: 390935 - protein, 9 aa, Homo Sapiens
RKSPENHAD

SEQ ID NO: 390936 - protein, 9 aa, Homo Sapiens
HPHKEILEF

SEQ ID NO: 390937 - protein, 9 aa, Homo Sapiens
CRKKAKLRI

SEQ ID NO: 390938 - protein, 9 aa, Homo Sapiens
MAVTIFMGH

SEQ ID NO: 390939 - protein, 9 aa, Homo Sapiens
LMEKKINNQ

SEQ ID NO: 390940 - protein, 9 aa, Homo Sapiens
TIVGTILVV

SEQ ID NO: 390941 - protein, 9 aa, Homo Sapiens
SWTSCGSRW

SEQ ID NO: 390942 - protein, 9 aa, Homo Sapiens
KKAQTVTEK

SEQ ID NO: 390943 - protein, 9 aa, Homo Sapiens
SQNHSKCIT

SEQ ID NO: 390944 - protein, 9 aa, Homo Sapiens
REAVELPQK

SEQ ID NO: 390945 - protein, 9 aa, Homo Sapiens
MIERTIILV

SEQ ID NO: 390946 - protein, 9 aa, Homo Sapiens
AVYYYTVTP

SEQ ID NO: 390947 - protein, 9 aa, Homo Sapiens
LHMAASECH

SEQ ID NO: 390948 - protein, 9 aa, Homo Sapiens
HYVFHLPNT

SEQ ID NO: 390949 - protein, 9 aa, Homo Sapiens
ELKRCDNMC

SEQ ID NO: 390950 - protein, 9 aa, Homo Sapiens
LVNLTMKNC

SEQ ID NO: 390951 - protein, 9 aa, Homo Sapiens
PAALATWPT

SEQ ID NO: 390952 - protein, 9 aa, Homo Sapiens
WRIQSLPLC

SEQ ID NO: 390953 - protein, 9 aa, Homo Sapiens
LWTPILEPE

SEQ ID NO: 390954 - protein, 9 aa, Homo Sapiens
ATGKNPMHI

SEQ ID NO: 390955 - protein, 9 aa, Homo Sapiens
IDLNSSQNL

SEQ ID NO: 390956 - protein, 9 aa, Homo Sapiens
GEWRQGGSP

SEQ ID NO: 390957 - protein, 9 aa, Homo Sapiens
SSPKKQERN

SEQ ID NO: 390958 - protein, 9 aa, Homo Sapiens
PTPQPSHSR

SEQ ID NO: 390959 - protein, 9 aa, Homo Sapiens
YKMKKREVV

SEQ ID NO: 390960 - protein, 9 aa, Homo Sapiens
ILILIMKVN

SEQ ID NO: 390961 - protein, 9 aa, Homo Sapiens
SGLVVDMGH

SEQ ID NO: 390962 - protein, 9 aa, Homo Sapiens
STIISTSTS

SEQ ID NO: 390963 - protein, 9 aa, Homo Sapiens
AKIGACCCG

SEQ ID NO: 390964 - protein, 9 aa, Homo Sapiens
TISTIGLGL

SEQ ID NO: 390965 - protein, 9 aa, Homo Sapiens
RYKVCVTNV

SEQ ID NO: 390966 - protein, 9 aa, Homo Sapiens
NIICNHMHF

SEQ ID NO: 390967 - protein, 9 aa, Homo Sapiens
EPESSSCNY

SEQ ID NO: 390968 - protein, 9 aa, Homo Sapiens
ICQVHGPWG

SEQ ID NO: 390969 - protein, 9 aa, Homo Sapiens
GPSGTSRTR

SEQ ID NO: 390970 - protein, 9 aa, Homo Sapiens
PDVHRLGST

SEQ ID NO: 390971 - protein, 9 aa, Homo Sapiens
KDKPVTPSN

SEQ ID NO: 390972 - protein, 9 aa, Homo Sapiens
NMHIRDFIQ

SEQ ID NO: 390973 - protein, 9 aa, Homo Sapiens
AGGPPARTP

SEQ ID NO: 390974 - protein, 9 aa, Homo Sapiens
ESKNQIKLH

SEQ ID NO: 390975 - protein, 9 aa, Homo Sapiens
HLQGEQMYR

SEQ ID NO: 390976 - protein, 9 aa, Homo Sapiens
TRSGTCCWA

SEQ ID NO: 390977 - protein, 9 aa, Homo Sapiens
RMHMRTHNG

SEQ ID NO: 390978 - protein, 9 aa, Homo Sapiens
KPFVCNGCG

SEQ ID NO: 390979 - protein, 9 aa, Homo Sapiens
SPRHPSRHP

SEQ ID NO: 390980 - protein, 9 aa, Homo Sapiens
EEPLLGEER

SEQ ID NO: 390981 - protein, 9 aa, Homo Sapiens
LGQEVILDL

SEQ ID NO: 390982 - protein, 9 aa, Homo Sapiens
ARRTNGASQ

SEQ ID NO: 390983 - protein, 9 aa, Homo Sapiens
HLFKQNLFC

SEQ ID NO: 390984 - protein, 9 aa, Homo Sapiens
VGCEHGGGK

SEQ ID NO: 390985 - protein, 9 aa, Homo Sapiens
PGRPWPPSF

SEQ ID NO: 390986 - protein, 9 aa, Homo Sapiens
TSRAAGTTF

SEQ ID NO: 390987 - protein, 9 aa, Homo Sapiens
LGGLFPMHA

SEQ ID NO: 390988 - protein, 9 aa, Homo Sapiens
LKPPGLVIY

SEQ ID NO: 390989 - protein, 9 aa, Homo Sapiens
EMSDKSKNS

SEQ ID NO: 390990 - protein, 9 aa, Homo Sapiens
FSTLIKHTI

SEQ ID NO: 390991 - protein, 9 aa, Homo Sapiens
EVAADEQGV

SEQ ID NO: 390992 - protein, 9 aa, Homo Sapiens
LSSSLSIFA

SEQ ID NO: 390993 - protein, 9 aa, Homo Sapiens
KIVVSNTTR

SEQ ID NO: 390994 - protein, 9 aa, Homo Sapiens
LVGNIITLY

SEQ ID NO: 390995 - protein, 9 aa, Homo Sapiens
EAQCRGRPA

SEQ ID NO: 390996 - protein, 9 aa, Homo Sapiens
EKGHINCPN

SEQ ID NO: 390997 - protein, 9 aa, Homo Sapiens
GYSGPSFSP

SEQ ID NO: 390998 - protein, 9 aa, Homo Sapiens
TRACTPASG

SEQ ID NO: 390999 - protein, 9 aa, Homo Sapiens
PGQRRCCSP

SEQ ID NO: 391000 - protein, 9 aa, Homo Sapiens
GQQFATSEM

SEQ ID NO: 391001 - protein, 9 aa, Homo Sapiens
NQLLDKNGT

SEQ ID NO: 391002 - protein, 9 aa, Homo Sapiens
LPRALMGFS

SEQ ID NO: 391003 - protein, 9 aa, Homo Sapiens
LTITEHVPL

SEQ ID NO: 391004 - protein, 9 aa, Homo Sapiens
GSFLASRAR

SEQ ID NO: 391005 - protein, 9 aa, Homo Sapiens
VNHPQHTTL

SEQ ID NO: 391006 - protein, 9 aa, Homo Sapiens
VQRRGTPSA

SEQ ID NO: 391007 - protein, 9 aa, Homo Sapiens
LKQVSPASP

SEQ ID NO: 391008 - protein, 9 aa, Homo Sapiens
QERKAMTKR

SEQ ID NO: 391009 - protein, 9 aa, Homo Sapiens
DHRDFTGEL

SEQ ID NO: 391010 - protein, 9 aa, Homo Sapiens
ARAHLAVEA

SEQ ID NO: 391011 - protein, 9 aa, Homo Sapiens
CIHQPCGKQ

SEQ ID NO: 391012 - protein, 9 aa, Homo Sapiens
VDFFEFCDY

SEQ ID NO: 391013 - protein, 9 aa, Homo Sapiens
QPQTPQDSR

SEQ ID NO: 391014 - protein, 9 aa, Homo Sapiens
GKILGEGSV

SEQ ID NO: 391015 - protein, 9 aa, Homo Sapiens
FPGGPNDYV

SEQ ID NO: 391016 - protein, 9 aa, Homo Sapiens
KDGRHLQGE

SEQ ID NO: 391017 - protein, 9 aa, Homo Sapiens
QKRKFSSFL

SEQ ID NO: 391018 - protein, 9 aa, Homo Sapiens
RWREAVELP

SEQ ID NO: 391019 - protein, 9 aa, Homo Sapiens
SVCRDAPAF

SEQ ID NO: 391020 - protein, 9 aa, Homo Sapiens
AMMQELHAF

SEQ ID NO: 391021 - protein, 9 aa, Homo Sapiens
CVASRRRYL

SEQ ID NO: 391022 - protein, 9 aa, Homo Sapiens
CGKAFSWKC

SEQ ID NO: 391023 - protein, 9 aa, Homo Sapiens
DYNVSRDQC

SEQ ID NO: 391024 - protein, 9 aa, Homo Sapiens
EVMFRLYDS

SEQ ID NO: 391025 - protein, 9 aa, Homo Sapiens
AWKIVLWAA

SEQ ID NO: 391026 - protein, 9 aa, Homo Sapiens
GLPVPLLDP

SEQ ID NO: 391027 - protein, 9 aa, Homo Sapiens
NNLHMDKKR

SEQ ID NO: 391028 - protein, 9 aa, Homo Sapiens
ADNQLLDKN

SEQ ID NO: 391029 - protein, 9 aa, Homo Sapiens
GKLGNITAP

SEQ ID NO: 391030 - protein, 9 aa, Homo Sapiens
SALLVSTSQ

SEQ ID NO: 391031 - protein, 9 aa, Homo Sapiens
SQTKWRSGS

SEQ ID NO: 391032 - protein, 9 aa, Homo Sapiens
RLFYKDMLQ

SEQ ID NO: 391033 - protein, 9 aa, Homo Sapiens
GPPGPLGSI

SEQ ID NO: 391034 - protein, 9 aa, Homo Sapiens
SKRTPQQVV

SEQ ID NO: 391035 - protein, 9 aa, Homo Sapiens
ACHGPLFLS

SEQ ID NO: 391036 - protein, 9 aa, Homo Sapiens
SCKNSPGCV

SEQ ID NO: 391037 - protein, 9 aa, Homo Sapiens
PVKPLSATP

SEQ ID NO: 391038 - protein, 9 aa, Homo Sapiens
GPSFHSHLP

SEQ ID NO: 391039 - protein, 9 aa, Homo Sapiens
HLWPTRRSS

SEQ ID NO: 391040 - protein, 9 aa, Homo Sapiens
LEESVGFTA

SEQ ID NO: 391041 - protein, 9 aa, Homo Sapiens
SLTRQADHT

SEQ ID NO: 391042 - protein, 9 aa, Homo Sapiens
RVDIAHSEI

SEQ ID NO: 391043 - protein, 9 aa, Homo Sapiens
ITTPSKKKL

SEQ ID NO: 391044 - protein, 9 aa, Homo Sapiens
NPRLQHHFS

SEQ ID NO: 391045 - protein, 9 aa, Homo Sapiens
STSSNPAST

SEQ ID NO: 391046 - protein, 9 aa, Homo Sapiens
TLHTTLARE

SEQ ID NO: 391047 - protein, 9 aa, Homo Sapiens
NMFQVCAEL

SEQ ID NO: 391048 - protein, 9 aa, Homo Sapiens
MIYGGVAVS

SEQ ID NO: 391049 - protein, 9 aa, Homo Sapiens
AAVTAPPSA

SEQ ID NO: 391050 - protein, 9 aa, Homo Sapiens
GDIPDIYEK

SEQ ID NO: 391051 - protein, 9 aa, Homo Sapiens
PENVVCGRK

SEQ ID NO: 391052 - protein, 9 aa, Homo Sapiens
FFRRKRRSS

SEQ ID NO: 391053 - protein, 9 aa, Homo Sapiens
DTTFFPTLL

SEQ ID NO: 391054 - protein, 9 aa, Homo Sapiens
DRAKVWTSG

SEQ ID NO: 391055 - protein, 9 aa, Homo Sapiens
PRCPPRWSP

SEQ ID NO: 391056 - protein, 9 aa, Homo Sapiens
LHTTLARET

SEQ ID NO: 391057 - protein, 9 aa, Homo Sapiens
LISIYCRYR

SEQ ID NO: 391058 - protein, 9 aa, Homo Sapiens
RSELMDADV

SEQ ID NO: 391059 - protein, 9 aa, Homo Sapiens
NVEHYVDYV

SEQ ID NO: 391060 - protein, 9 aa, Homo Sapiens
PQVEVYFLW

SEQ ID NO: 391061 - protein, 9 aa, Homo Sapiens
PRNPPSPIK

SEQ ID NO: 391062 - protein, 9 aa, Homo Sapiens
GCISVKDHR

SEQ ID NO: 391063 - protein, 9 aa, Homo Sapiens
RTPAPPWQP

SEQ ID NO: 391064 - protein, 9 aa, Homo Sapiens
RRTTFTSGT

SEQ ID NO: 391065 - protein, 9 aa, Homo Sapiens
SRTPPSAPR

SEQ ID NO: 391066 - protein, 9 aa, Homo Sapiens
GDKGLKKMT

SEQ ID NO: 391067 - protein, 9 aa, Homo Sapiens
PDTFCGSPP

SEQ ID NO: 391068 - protein, 9 aa, Homo Sapiens
SLTTGTRWA

SEQ ID NO: 391069 - protein, 9 aa, Homo Sapiens
FSFFFCLRG

SEQ ID NO: 391070 - protein, 9 aa, Homo Sapiens
PWVGYVHVH

SEQ ID NO: 391071 - protein, 9 aa, Homo Sapiens
ASPGNRGLP

SEQ ID NO: 391072 - protein, 9 aa, Homo Sapiens
ALCATGKNP

SEQ ID NO: 391073 - protein, 9 aa, Homo Sapiens
TPRASRALR

SEQ ID NO: 391074 - protein, 9 aa, Homo Sapiens
VSLQERGGV

SEQ ID NO: 391075 - protein, 9 aa, Homo Sapiens
TIQWLFMGY

SEQ ID NO: 391076 - protein, 9 aa, Homo Sapiens
MEKKYRNVG

SEQ ID NO: 391077 - protein, 9 aa, Homo Sapiens
NEDRKPPNG

SEQ ID NO: 391078 - protein, 9 aa, Homo Sapiens
SPPSSPRHP

SEQ ID NO: 391079 - protein, 9 aa, Homo Sapiens
SGPEIVNAG

SEQ ID NO: 391080 - protein, 9 aa, Homo Sapiens
PWPEVWKEV

SEQ ID NO: 391081 - protein, 9 aa, Homo Sapiens
MVKEVLRIE

SEQ ID NO: 391082 - protein, 9 aa, Homo Sapiens
LTSALVATS

SEQ ID NO: 391083 - protein, 9 aa, Homo Sapiens
TLTPHIGPK

SEQ ID NO: 391084 - protein, 9 aa, Homo Sapiens
KNQIKLHTQ

SEQ ID NO: 391085 - protein, 9 aa, Homo Sapiens
KKILRSFMK

SEQ ID NO: 391086 - protein, 9 aa, Homo Sapiens
VPNYVGRPK

SEQ ID NO: 391087 - protein, 9 aa, Homo Sapiens
GSFGGPDGF

SEQ ID NO: 391088 - protein, 9 aa, Homo Sapiens
ALPTSGLGA

SEQ ID NO: 391089 - protein, 9 aa, Homo Sapiens
KPMGILLVR

SEQ ID NO: 391090 - protein, 9 aa, Homo Sapiens
VLLENLAII

SEQ ID NO: 391091 - protein, 9 aa, Homo Sapiens
KKKLKLAPL

SEQ ID NO: 391092 - protein, 9 aa, Homo Sapiens
SVRAGSGAL

SEQ ID NO: 391093 - protein, 9 aa, Homo Sapiens
ESHHTSLTT

SEQ ID NO: 391094 - protein, 9 aa, Homo Sapiens
TRFAFSTRL

SEQ ID NO: 391095 - protein, 9 aa, Homo Sapiens
EFQVPKDCY

SEQ ID NO: 391096 - protein, 9 aa, Homo Sapiens
RETSLASCS

SEQ ID NO: 391097 - protein, 9 aa, Homo Sapiens
VNSQYTAAV

SEQ ID NO: 391098 - protein, 9 aa, Homo Sapiens
GATGANRAD

SEQ ID NO: 391099 - protein, 9 aa, Homo Sapiens
WAWTAPTAW

SEQ ID NO: 391100 - protein, 9 aa, Homo Sapiens
GQALSARTL

SEQ ID NO: 391101 - protein, 9 aa, Homo Sapiens
NKPLRGDPG

SEQ ID NO: 391102 - protein, 9 aa, Homo Sapiens
LPPKQQFLS

SEQ ID NO: 391103 - protein, 9 aa, Homo Sapiens
DIPQGVTRR

SEQ ID NO: 391104 - protein, 9 aa, Homo Sapiens
RYFDENDAE

SEQ ID NO: 391105 - protein, 9 aa, Homo Sapiens
ASTPARSPT

SEQ ID NO: 391106 - protein, 9 aa, Homo Sapiens
CHWNGKKML

SEQ ID NO: 391107 - protein, 9 aa, Homo Sapiens
CEWAEGRGP

SEQ ID NO: 391108 - protein, 9 aa, Homo Sapiens
SRGAHGTRG

SEQ ID NO: 391109 - protein, 9 aa, Homo Sapiens
IRDDINRRY

SEQ ID NO: 391110 - protein, 9 aa, Homo Sapiens
CLKGPSANV

SEQ ID NO: 391111 - protein, 9 aa, Homo Sapiens
NPRVCSHCP

SEQ ID NO: 391112 - protein, 9 aa, Homo Sapiens
TAAKPSARS

SEQ ID NO: 391113 - protein, 9 aa, Homo Sapiens
LKNGRSEVS

SEQ ID NO: 391114 - protein, 9 aa, Homo Sapiens
YRKAHAEHQ

SEQ ID NO: 391115 - protein, 9 aa, Homo Sapiens
PPRPRCTRS

SEQ ID NO: 391116 - protein, 9 aa, Homo Sapiens
DRCMSDLTC

SEQ ID NO: 391117 - protein, 9 aa, Homo Sapiens
TAPPEACHG

SEQ ID NO: 391118 - protein, 9 aa, Homo Sapiens
RWGWGQLLL

SEQ ID NO: 391119 - protein, 9 aa, Homo Sapiens
YHQGDRKGQ

SEQ ID NO: 391120 - protein, 9 aa, Homo Sapiens
PPPAQPRPW

SEQ ID NO: 391121 - protein, 9 aa, Homo Sapiens
EIRVPIVTV

SEQ ID NO: 391122 - protein, 9 aa, Homo Sapiens
HRIHARESL

SEQ ID NO: 391123 - protein, 9 aa, Homo Sapiens
ATLVILKGN

SEQ ID NO: 391124 - protein, 9 aa, Homo Sapiens
YLTLESFDQ

SEQ ID NO: 391125 - protein, 9 aa, Homo Sapiens
DREEDEGTS

SEQ ID NO: 391126 - protein, 9 aa, Homo Sapiens
HFTVNMSKV

SEQ ID NO: 391127 - protein, 9 aa, Homo Sapiens
DTTSAVSIQ

SEQ ID NO: 391128 - protein, 9 aa, Homo Sapiens
TRSSPRLRF

SEQ ID NO: 391129 - protein, 9 aa, Homo Sapiens
LRPGSTRST

SEQ ID NO: 391130 - protein, 9 aa, Homo Sapiens
GTTSSSGTS

SEQ ID NO: 391131 - protein, 9 aa, Homo Sapiens
EDPAAAQLF

SEQ ID NO: 391132 - protein, 9 aa, Homo Sapiens
YCRYRGINS

SEQ ID NO: 391133 - protein, 9 aa, Homo Sapiens
KWIMLFLIL

SEQ ID NO: 391134 - protein, 9 aa, Homo Sapiens
AALAPGTSE

SEQ ID NO: 391135 - protein, 9 aa, Homo Sapiens
PVESSWITP

SEQ ID NO: 391136 - protein, 9 aa, Homo Sapiens
ASARSPTSS

SEQ ID NO: 391137 - protein, 9 aa, Homo Sapiens
NGASQTTDA

SEQ ID NO: 391138 - protein, 9 aa, Homo Sapiens
VVPKRDVER

SEQ ID NO: 391139 - protein, 9 aa, Homo Sapiens
HLSHGAAGS

SEQ ID NO: 391140 - protein, 9 aa, Homo Sapiens
NAGLRSFFE

SEQ ID NO: 391141 - protein, 9 aa, Homo Sapiens
LKIHKSMIQ

SEQ ID NO: 391142 - protein, 9 aa, Homo Sapiens
GAGLTTVTL

SEQ ID NO: 391143 - protein, 9 aa, Homo Sapiens
DSLDIITSK

SEQ ID NO: 391144 - protein, 9 aa, Homo Sapiens
LGSGGATGA

SEQ ID NO: 391145 - protein, 9 aa, Homo Sapiens
YSIGGILLS

SEQ ID NO: 391146 - protein, 9 aa, Homo Sapiens
LQGLPIGTH

SEQ ID NO: 391147 - protein, 9 aa, Homo Sapiens
PLGLFGDKG

SEQ ID NO: 391148 - protein, 9 aa, Homo Sapiens
QAEEEKGEA

SEQ ID NO: 391149 - protein, 9 aa, Homo Sapiens
PATTLTPIP

SEQ ID NO: 391150 - protein, 9 aa, Homo Sapiens
TAARPSATN

SEQ ID NO: 391151 - protein, 9 aa, Homo Sapiens
ILFGPFLSM

SEQ ID NO: 391152 - protein, 9 aa, Homo Sapiens
FLGLSKRTP

SEQ ID NO: 391153 - protein, 9 aa, Homo Sapiens
RGNSTYRCS

SEQ ID NO: 391154 - protein, 9 aa, Homo Sapiens
LFAEAADMG

SEQ ID NO: 391155 - protein, 9 aa, Homo Sapiens
NGIWEVMPR

SEQ ID NO: 391156 - protein, 9 aa, Homo Sapiens
SHHYVDRLF

SEQ ID NO: 391157 - protein, 9 aa, Homo Sapiens
ASAPTRWQG

SEQ ID NO: 391158 - protein, 9 aa, Homo Sapiens
EPIEKPGGI

SEQ ID NO: 391159 - protein, 9 aa, Homo Sapiens
GVVRGPPLH

SEQ ID NO: 391160 - protein, 9 aa, Homo Sapiens
PLFLSSAVS

SEQ ID NO: 391161 - protein, 9 aa, Homo Sapiens
VAKLIHWVQ

SEQ ID NO: 391162 - protein, 9 aa, Homo Sapiens
NHIVIRWLW

SEQ ID NO: 391163 - protein, 9 aa, Homo Sapiens
IVLMNSVFN

SEQ ID NO: 391164 - protein, 9 aa, Homo Sapiens
AVPSLPSAP

SEQ ID NO: 391165 - protein, 9 aa, Homo Sapiens
SPQIQASWA

SEQ ID NO: 391166 - protein, 9 aa, Homo Sapiens
PPRSRLAAA

SEQ ID NO: 391167 - protein, 9 aa, Homo Sapiens
RSLLGLVEE

SEQ ID NO: 391168 - protein, 9 aa, Homo Sapiens
VSSGVIPNL

SEQ ID NO: 391169 - protein, 9 aa, Homo Sapiens
LDLVATALF

SEQ ID NO: 391170 - protein, 9 aa, Homo Sapiens
ADLKAILSE

SEQ ID NO: 391171 - protein, 9 aa, Homo Sapiens
PESEAEAQV

SEQ ID NO: 391172 - protein, 9 aa, Homo Sapiens
YQWSKSLSP

SEQ ID NO: 391173 - protein, 9 aa, Homo Sapiens
KPDTFCGSP

SEQ ID NO: 391174 - protein, 9 aa, Homo Sapiens
HFDTAQGRG

SEQ ID NO: 391175 - protein, 9 aa, Homo Sapiens
MNVPDFDYP

SEQ ID NO: 391176 - protein, 9 aa, Homo Sapiens
FSTVFPPTH

SEQ ID NO: 391177 - protein, 9 aa, Homo Sapiens
LALRQYYFN

SEQ ID NO: 391178 - protein, 9 aa, Homo Sapiens
DVESLADLT

SEQ ID NO: 391179 - protein, 9 aa, Homo Sapiens
TSLASCSRG

SEQ ID NO: 391180 - protein, 9 aa, Homo Sapiens
LHPSLCLFS

SEQ ID NO: 391181 - protein, 9 aa, Homo Sapiens
KDVVLQWGR

SEQ ID NO: 391182 - protein, 9 aa, Homo Sapiens
LVTNGCISI

SEQ ID NO: 391183 - protein, 9 aa, Homo Sapiens
LNLQVLKKI

SEQ ID NO: 391184 - protein, 9 aa, Homo Sapiens
CVGNITSVH

SEQ ID NO: 391185 - protein, 9 aa, Homo Sapiens
VSDPISPEE

SEQ ID NO: 391186 - protein, 9 aa, Homo Sapiens
HRVKAAVGE

SEQ ID NO: 391187 - protein, 9 aa, Homo Sapiens
TQVILMYIF

SEQ ID NO: 391188 - protein, 9 aa, Homo Sapiens
ILARDVKKV

SEQ ID NO: 391189 - protein, 9 aa, Homo Sapiens
AESKNQIKL

SEQ ID NO: 391190 - protein, 9 aa, Homo Sapiens
PHVPRQLPG

SEQ ID NO: 391191 - protein, 9 aa, Homo Sapiens
SSHVAALAP

SEQ ID NO: 391192 - protein, 9 aa, Homo Sapiens
ARGSSGSGR

SEQ ID NO: 391193 - protein, 9 aa, Homo Sapiens
RPPPPAQPR

SEQ ID NO: 391194 - protein, 9 aa, Homo Sapiens
LFPGGPNDY

SEQ ID NO: 391195 - protein, 9 aa, Homo Sapiens
TGDIWQGGA

SEQ ID NO: 391196 - protein, 9 aa, Homo Sapiens
KDAALKCQL

SEQ ID NO: 391197 - protein, 9 aa, Homo Sapiens
MDLRAAVYN

SEQ ID NO: 391198 - protein, 9 aa, Homo Sapiens
LQGFLPQAI

SEQ ID NO: 391199 - protein, 9 aa, Homo Sapiens
LSDFNDVTN

SEQ ID NO: 391200 - protein, 9 aa, Homo Sapiens
VRDRFNARR

SEQ ID NO: 391201 - protein, 9 aa, Homo Sapiens
QQEEEPLLG

SEQ ID NO: 391202 - protein, 9 aa, Homo Sapiens
KQKVLREKV

SEQ ID NO: 391203 - protein, 9 aa, Homo Sapiens
DIAHSEIFM

SEQ ID NO: 391204 - protein, 9 aa, Homo Sapiens
IRYVHDRSE

SEQ ID NO: 391205 - protein, 9 aa, Homo Sapiens
SGSWHPILP

SEQ ID NO: 391206 - protein, 9 aa, Homo Sapiens
DLLEGAASH

SEQ ID NO: 391207 - protein, 9 aa, Homo Sapiens
GGMSRTPPR

SEQ ID NO: 391208 - protein, 9 aa, Homo Sapiens
RRPLGVSPL

SEQ ID NO: 391209 - protein, 9 aa, Homo Sapiens
GARGSSGSG

SEQ ID NO: 391210 - protein, 9 aa, Homo Sapiens
CSIIIITFF

SEQ ID NO: 391211 - protein, 9 aa, Homo Sapiens
KLTGSLPDV

SEQ ID NO: 391212 - protein, 9 aa, Homo Sapiens
DLRKKENEN

SEQ ID NO: 391213 - protein, 9 aa, Homo Sapiens
HLWKFFWEM

SEQ ID NO: 391214 - protein, 9 aa, Homo Sapiens
TAVDPMADI

SEQ ID NO: 391215 - protein, 9 aa, Homo Sapiens
HTLLLNNRM

SEQ ID NO: 391216 - protein, 9 aa, Homo Sapiens
ALVGPHARV

SEQ ID NO: 391217 - protein, 9 aa, Homo Sapiens
EDCHIPQIE

SEQ ID NO: 391218 - protein, 9 aa, Homo Sapiens
HLQQQCQPP

SEQ ID NO: 391219 - protein, 9 aa, Homo Sapiens
VFQNIMRMT

SEQ ID NO: 391220 - protein, 9 aa, Homo Sapiens
VSHFSDLDQ

SEQ ID NO: 391221 - protein, 9 aa, Homo Sapiens
NAYPHWRQQ

SEQ ID NO: 391222 - protein, 9 aa, Homo Sapiens
ILIPADFEL

SEQ ID NO: 391223 - protein, 9 aa, Homo Sapiens
TQMPGPPCS

SEQ ID NO: 391224 - protein, 9 aa, Homo Sapiens
VILMYIFQN

SEQ ID NO: 391225 - protein, 9 aa, Homo Sapiens
FYGYVNDRM

SEQ ID NO: 391226 - protein, 9 aa, Homo Sapiens
TRCFSQVLS

SEQ ID NO: 391227 - protein, 9 aa, Homo Sapiens
KKAYMQEEE

SEQ ID NO: 391228 - protein, 9 aa, Homo Sapiens
LNTNRARLS

SEQ ID NO: 391229 - protein, 9 aa, Homo Sapiens
GLLTFVLVD

SEQ ID NO: 391230 - protein, 9 aa, Homo Sapiens
YQPWEPLHF

SEQ ID NO: 391231 - protein, 9 aa, Homo Sapiens
SAVPIPSTR

SEQ ID NO: 391232 - protein, 9 aa, Homo Sapiens
GAQGPGPTP

SEQ ID NO: 391233 - protein, 9 aa, Homo Sapiens
TLSVSIEGS

SEQ ID NO: 391234 - protein, 9 aa, Homo Sapiens
REKHHMLKI

SEQ ID NO: 391235 - protein, 9 aa, Homo Sapiens
YQMPSFEEI

SEQ ID NO: 391236 - protein, 9 aa, Homo Sapiens
TRAQQVLFM

SEQ ID NO: 391237 - protein, 9 aa, Homo Sapiens
KAEKLRHLQ

SEQ ID NO: 391238 - protein, 9 aa, Homo Sapiens
ARSGKGEAQ

SEQ ID NO: 391239 - protein, 9 aa, Homo Sapiens
EEDTKLKPT

SEQ ID NO: 391240 - protein, 9 aa, Homo Sapiens
NTEYEPTEE

SEQ ID NO: 391241 - protein, 9 aa, Homo Sapiens
SSGKKIAFH

SEQ ID NO: 391242 - protein, 9 aa, Homo Sapiens
PTQQPQTPQ

SEQ ID NO: 391243 - protein, 9 aa, Homo Sapiens
GADWLELTT

SEQ ID NO: 391244 - protein, 9 aa, Homo Sapiens
WGMEALGSW

SEQ ID NO: 391245 - protein, 9 aa, Homo Sapiens
ALVHVTDWI

SEQ ID NO: 391246 - protein, 9 aa, Homo Sapiens
TVTHMWFDM

SEQ ID NO: 391247 - protein, 9 aa, Homo Sapiens
EHDWCSTVH

SEQ ID NO: 391248 - protein, 9 aa, Homo Sapiens
LVAPDRAPF

SEQ ID NO: 391249 - protein, 9 aa, Homo Sapiens
ILTRKMAII

SEQ ID NO: 391250 - protein, 9 aa, Homo Sapiens
STLLDGKAT

SEQ ID NO: 391251 - protein, 9 aa, Homo Sapiens
QPTKEKKAR

SEQ ID NO: 391252 - protein, 9 aa, Homo Sapiens
WERTYLGNV

SEQ ID NO: 391253 - protein, 9 aa, Homo Sapiens
RSCGVTGPN

SEQ ID NO: 391254 - protein, 9 aa, Homo Sapiens
TVATMFCWV

SEQ ID NO: 391255 - protein, 9 aa, Homo Sapiens
VLLCKDDPK

SEQ ID NO: 391256 - protein, 9 aa, Homo Sapiens
KWKAEQMEK

SEQ ID NO: 391257 - protein, 9 aa, Homo Sapiens
ELDAMKHQS

SEQ ID NO: 391258 - protein, 9 aa, Homo Sapiens
ARLHDDTEA

SEQ ID NO: 391259 - protein, 9 aa, Homo Sapiens
VKAAVGEGE

SEQ ID NO: 391260 - protein, 9 aa, Homo Sapiens
FYSPSPNPI

SEQ ID NO: 391261 - protein, 9 aa, Homo Sapiens
PLVCEGLTH

SEQ ID NO: 391262 - protein, 9 aa, Homo Sapiens
LAPTHVNHN

SEQ ID NO: 391263 - protein, 9 aa, Homo Sapiens
GHTKLEFPS

SEQ ID NO: 391264 - protein, 9 aa, Homo Sapiens
DVKIHVSDQ

SEQ ID NO: 391265 - protein, 9 aa, Homo Sapiens
ATQTQMPGP

SEQ ID NO: 391266 - protein, 9 aa, Homo Sapiens
SLTTGTFAA

SEQ ID NO: 391267 - protein, 9 aa, Homo Sapiens
SFAIRTRAA

SEQ ID NO: 391268 - protein, 9 aa, Homo Sapiens
PKYCVPNYV

SEQ ID NO: 391269 - protein, 9 aa, Homo Sapiens
CQMSGTSGK

SEQ ID NO: 391270 - protein, 9 aa, Homo Sapiens
STRGSFLAS

SEQ ID NO: 391271 - protein, 9 aa, Homo Sapiens
GLKKMTLKA

SEQ ID NO: 391272 - protein, 9 aa, Homo Sapiens
LESPALKQV

SEQ ID NO: 391273 - protein, 9 aa, Homo Sapiens
IFQNVMVMI

SEQ ID NO: 391274 - protein, 9 aa, Homo Sapiens
LCHVLVDIQ

SEQ ID NO: 391275 - protein, 9 aa, Homo Sapiens
QVREHVLEE

SEQ ID NO: 391276 - protein, 9 aa, Homo Sapiens
ETMEFPEGT

SEQ ID NO: 391277 - protein, 9 aa, Homo Sapiens
AGKEEYSAM

SEQ ID NO: 391278 - protein, 9 aa, Homo Sapiens
GTSRTRGTL

SEQ ID NO: 391279 - protein, 9 aa, Homo Sapiens
SPLPTTSKC

SEQ ID NO: 391280 - protein, 9 aa, Homo Sapiens
PTKKRGKSQ

SEQ ID NO: 391281 - protein, 9 aa, Homo Sapiens
PEENFTIQG

SEQ ID NO: 391282 - protein, 9 aa, Homo Sapiens
APSAGRTSA

SEQ ID NO: 391283 - protein, 9 aa, Homo Sapiens
ILCVGNITS

SEQ ID NO: 391284 - protein, 9 aa, Homo Sapiens
VCKWASRLF

SEQ ID NO: 391285 - protein, 9 aa, Homo Sapiens
PGTAWSPWT

SEQ ID NO: 391286 - protein, 9 aa, Homo Sapiens
QNLWQYFEE

SEQ ID NO: 391287 - protein, 9 aa, Homo Sapiens
GIIYDTDGQ

SEQ ID NO: 391288 - protein, 9 aa, Homo Sapiens
IVLLCKDDP

SEQ ID NO: 391289 - protein, 9 aa, Homo Sapiens
LESEGRVHI

SEQ ID NO: 391290 - protein, 9 aa, Homo Sapiens
RFFIHYSSL

SEQ ID NO: 391291 - protein, 9 aa, Homo Sapiens
RGHFIGLMM

SEQ ID NO: 391292 - protein, 9 aa, Homo Sapiens
LPLYADPYT

SEQ ID NO: 391293 - protein, 9 aa, Homo Sapiens
RTKLEKALS

SEQ ID NO: 391294 - protein, 9 aa, Homo Sapiens
FGATVATMF

SEQ ID NO: 391295 - protein, 9 aa, Homo Sapiens
TFGDGRHRK

SEQ ID NO: 391296 - protein, 9 aa, Homo Sapiens
ARTRGPNGA

SEQ ID NO: 391297 - protein, 9 aa, Homo Sapiens
SENARSPPA

SEQ ID NO: 391298 - protein, 9 aa, Homo Sapiens
LGVAVDAQV

SEQ ID NO: 391299 - protein, 9 aa, Homo Sapiens
IHKSMIQMK

SEQ ID NO: 391300 - protein, 9 aa, Homo Sapiens
EVKRKKPLQ

SEQ ID NO: 391301 - protein, 9 aa, Homo Sapiens
TLASRANGA

SEQ ID NO: 391302 - protein, 9 aa, Homo Sapiens
LFVPHRPQD

SEQ ID NO: 391303 - protein, 9 aa, Homo Sapiens
EAALICLTP

SEQ ID NO: 391304 - protein, 9 aa, Homo Sapiens
TIPSKLWGF

SEQ ID NO: 391305 - protein, 9 aa, Homo Sapiens
VVLRLDGSQ

SEQ ID NO: 391306 - protein, 9 aa, Homo Sapiens
SPRLQFLFH

SEQ ID NO: 391307 - protein, 9 aa, Homo Sapiens
KRKFLDTGL

SEQ ID NO: 391308 - protein, 9 aa, Homo Sapiens
RPCGSPQIQ

SEQ ID NO: 391309 - protein, 9 aa, Homo Sapiens
DAMKHQSQL

SEQ ID NO: 391310 - protein, 9 aa, Homo Sapiens
AFSSCAAFF

SEQ ID NO: 391311 - protein, 9 aa, Homo Sapiens
MAHIFLIQL

SEQ ID NO: 391312 - protein, 9 aa, Homo Sapiens
GPQLENWSP

SEQ ID NO: 391313 - protein, 9 aa, Homo Sapiens
PPPPGPEGG

SEQ ID NO: 391314 - protein, 9 aa, Homo Sapiens
GGPDGFGPG

SEQ ID NO: 391315 - protein, 9 aa, Homo Sapiens
TELVTYPGI

SEQ ID NO: 391316 - protein, 9 aa, Homo Sapiens
SGTAPSAVP

SEQ ID NO: 391317 - protein, 9 aa, Homo Sapiens
LWAIPEFGS

SEQ ID NO: 391318 - protein, 9 aa, Homo Sapiens
LFGDKGLKK

SEQ ID NO: 391319 - protein, 9 aa, Homo Sapiens
HLAFLKNGR

SEQ ID NO: 391320 - protein, 9 aa, Homo Sapiens
RMINSPVGD

SEQ ID NO: 391321 - protein, 9 aa, Homo Sapiens
PQDCRGRHW

SEQ ID NO: 391322 - protein, 9 aa, Homo Sapiens
KECEHRVAA

SEQ ID NO: 391323 - protein, 9 aa, Homo Sapiens
IAITWGDTT

SEQ ID NO: 391324 - protein, 9 aa, Homo Sapiens
NCEEPSRGP

SEQ ID NO: 391325 - protein, 9 aa, Homo Sapiens
RGEWRQGGS

SEQ ID NO: 391326 - protein, 9 aa, Homo Sapiens
MILRTLSCT

SEQ ID NO: 391327 - protein, 9 aa, Homo Sapiens
AGVGHAQDA

SEQ ID NO: 391328 - protein, 9 aa, Homo Sapiens
IIKYISCHL

SEQ ID NO: 391329 - protein, 9 aa, Homo Sapiens
LSMTPHQHN

SEQ ID NO: 391330 - protein, 9 aa, Homo Sapiens
ETWREEKNV

SEQ ID NO: 391331 - protein, 9 aa, Homo Sapiens
MREDESEVD

SEQ ID NO: 391332 - protein, 9 aa, Homo Sapiens
AKLIHWVQK

SEQ ID NO: 391333 - protein, 9 aa, Homo Sapiens
GVGTTLLSF

SEQ ID NO: 391334 - protein, 9 aa, Homo Sapiens
SFFIGYMMK

SEQ ID NO: 391335 - protein, 9 aa, Homo Sapiens
GIMLFDGPF

SEQ ID NO: 391336 - protein, 9 aa, Homo Sapiens
LPLCLSCRA

SEQ ID NO: 391337 - protein, 9 aa, Homo Sapiens
LAPGTSETP

SEQ ID NO: 391338 - protein, 9 aa, Homo Sapiens
FFLQLQGLV

SEQ ID NO: 391339 - protein, 9 aa, Homo Sapiens
ILGHVQRRG

SEQ ID NO: 391340 - protein, 9 aa, Homo Sapiens
CDCISARGL

SEQ ID NO: 391341 - protein, 9 aa, Homo Sapiens
CQNSSPRNP

SEQ ID NO: 391342 - protein, 9 aa, Homo Sapiens
QLENWSPPW

SEQ ID NO: 391343 - protein, 9 aa, Homo Sapiens
TSFTGTTSF

SEQ ID NO: 391344 - protein, 9 aa, Homo Sapiens
FLEEERQIN

SEQ ID NO: 391345 - protein, 9 aa, Homo Sapiens
TASIIAGQG

SEQ ID NO: 391346 - protein, 9 aa, Homo Sapiens
TNFTTNVSA

SEQ ID NO: 391347 - protein, 9 aa, Homo Sapiens
VRKLQWKRL

SEQ ID NO: 391348 - protein, 9 aa, Homo Sapiens
AHILVIDSG

SEQ ID NO: 391349 - protein, 9 aa, Homo Sapiens
DEFLMGGMS

SEQ ID NO: 391350 - protein, 9 aa, Homo Sapiens
LSLVSRVLA

SEQ ID NO: 391351 - protein, 9 aa, Homo Sapiens
PLRLWSWCG

SEQ ID NO: 391352 - protein, 9 aa, Homo Sapiens
PFVSILRAA

SEQ ID NO: 391353 - protein, 9 aa, Homo Sapiens
RTSLTTITT

SEQ ID NO: 391354 - protein, 9 aa, Homo Sapiens
ARRTTFTSG

SEQ ID NO: 391355 - protein, 9 aa, Homo Sapiens
VPCGKRINF

SEQ ID NO: 391356 - protein, 9 aa, Homo Sapiens
HMETKQNVI

SEQ ID NO: 391357 - protein, 9 aa, Homo Sapiens
HSNTPRSEI

SEQ ID NO: 391358 - protein, 9 aa, Homo Sapiens
RAHLWPTRR

SEQ ID NO: 391359 - protein, 9 aa, Homo Sapiens
LRSPICSAN

SEQ ID NO: 391360 - protein, 9 aa, Homo Sapiens
KILILIMKV

SEQ ID NO: 391361 - protein, 9 aa, Homo Sapiens
ETEFHRIGQ

SEQ ID NO: 391362 - protein, 9 aa, Homo Sapiens
MELKPLCVY

SEQ ID NO: 391363 - protein, 9 aa, Homo Sapiens
VTASIIAGQ

SEQ ID NO: 391364 - protein, 9 aa, Homo Sapiens
MPDLLEGAA

SEQ ID NO: 391365 - protein, 9 aa, Homo Sapiens
NLLRLQSLL

SEQ ID NO: 391366 - protein, 9 aa, Homo Sapiens
PTQSTEHQD

SEQ ID NO: 391367 - protein, 9 aa, Homo Sapiens
TYLGNVLVC

SEQ ID NO: 391368 - protein, 9 aa, Homo Sapiens
GAKVSRNTL

SEQ ID NO: 391369 - protein, 9 aa, Homo Sapiens
CDPVHGCCQ

SEQ ID NO: 391370 - protein, 9 aa, Homo Sapiens
AQYSGAQVC

SEQ ID NO: 391371 - protein, 9 aa, Homo Sapiens
ISLLGMQLF

SEQ ID NO: 391372 - protein, 9 aa, Homo Sapiens
IEKVLKIHK

SEQ ID NO: 391373 - protein, 9 aa, Homo Sapiens
FLSSSPGLV

SEQ ID NO: 391374 - protein, 9 aa, Homo Sapiens
LYGAYLQLR

SEQ ID NO: 391375 - protein, 9 aa, Homo Sapiens
NKLLKTFIR

SEQ ID NO: 391376 - protein, 9 aa, Homo Sapiens
DMPAQGSSS

SEQ ID NO: 391377 - protein, 9 aa, Homo Sapiens
TSLWFKPEE

SEQ ID NO: 391378 - protein, 9 aa, Homo Sapiens
PQGDRPQGP

SEQ ID NO: 391379 - protein, 9 aa, Homo Sapiens
TGLALFLST

SEQ ID NO: 391380 - protein, 9 aa, Homo Sapiens
LEREKHHML

SEQ ID NO: 391381 - protein, 9 aa, Homo Sapiens
TAACITDLI

SEQ ID NO: 391382 - protein, 9 aa, Homo Sapiens
FYQGPGWEE

SEQ ID NO: 391383 - protein, 9 aa, Homo Sapiens
LSVAWADHI

SEQ ID NO: 391384 - protein, 9 aa, Homo Sapiens
IITFFFKIF

SEQ ID NO: 391385 - protein, 9 aa, Homo Sapiens
LQSRDLLTG

SEQ ID NO: 391386 - protein, 9 aa, Homo Sapiens
VLAWARAHL

SEQ ID NO: 391387 - protein, 9 aa, Homo Sapiens
GARTPRASR

SEQ ID NO: 391388 - protein, 9 aa, Homo Sapiens
SLCLFSLSN

SEQ ID NO: 391389 - protein, 9 aa, Homo Sapiens
VNQKKAKIK

SEQ ID NO: 391390 - protein, 9 aa, Homo Sapiens
FFIHYSSLG

SEQ ID NO: 391391 - protein, 9 aa, Homo Sapiens
HKCKECDKA

SEQ ID NO: 391392 - protein, 9 aa, Homo Sapiens
SAVSSIGCK

SEQ ID NO: 391393 - protein, 9 aa, Homo Sapiens
SSDLTDRAK

SEQ ID NO: 391394 - protein, 9 aa, Homo Sapiens
FPVLSTSSF

SEQ ID NO: 391395 - protein, 9 aa, Homo Sapiens
EKTATLSQK

SEQ ID NO: 391396 - protein, 9 aa, Homo Sapiens
MEPRPDVHR

SEQ ID NO: 391397 - protein, 9 aa, Homo Sapiens
RRLLTIPSA

SEQ ID NO: 391398 - protein, 9 aa, Homo Sapiens
TPLLRTWRG

SEQ ID NO: 391399 - protein, 9 aa, Homo Sapiens
SRGARRTDS

SEQ ID NO: 391400 - protein, 9 aa, Homo Sapiens
SWGQTDLTV

SEQ ID NO: 391401 - protein, 9 aa, Homo Sapiens
RDYIVEPSI

SEQ ID NO: 391402 - protein, 9 aa, Homo Sapiens
VLGPSRGAG

SEQ ID NO: 391403 - protein, 9 aa, Homo Sapiens
STLGADWLE

SEQ ID NO: 391404 - protein, 9 aa, Homo Sapiens
NLTGQRGRH

SEQ ID NO: 391405 - protein, 9 aa, Homo Sapiens
YLEQFWRIV

SEQ ID NO: 391406 - protein, 9 aa, Homo Sapiens
EARLHDDTE

SEQ ID NO: 391407 - protein, 9 aa, Homo Sapiens
LGFSLKGDT

SEQ ID NO: 391408 - protein, 9 aa, Homo Sapiens
DLIDFEFCS

SEQ ID NO: 391409 - protein, 9 aa, Homo Sapiens
RLWSWCGTS

SEQ ID NO: 391410 - protein, 9 aa, Homo Sapiens
FFTSQNIMA

SEQ ID NO: 391411 - protein, 9 aa, Homo Sapiens
RIPGGYSGP

SEQ ID NO: 391412 - protein, 9 aa, Homo Sapiens
GTRGTTFTT

SEQ ID NO: 391413 - protein, 9 aa, Homo Sapiens
VTNMLLLKM

SEQ ID NO: 391414 - protein, 9 aa, Homo Sapiens
FCTFFCRDR

SEQ ID NO: 391415 - protein, 9 aa, Homo Sapiens
ISHIVGIHT

SEQ ID NO: 391416 - protein, 9 aa, Homo Sapiens
APEGGPWRG

SEQ ID NO: 391417 - protein, 9 aa, Homo Sapiens
RGHMHNSLN

SEQ ID NO: 391418 - protein, 9 aa, Homo Sapiens
PGSTRSTSR

SEQ ID NO: 391419 - protein, 9 aa, Homo Sapiens
DQEADREED

SEQ ID NO: 391420 - protein, 9 aa, Homo Sapiens
LTGGTRGAS

SEQ ID NO: 391421 - protein, 9 aa, Homo Sapiens
KSMIQMKTH

SEQ ID NO: 391422 - protein, 9 aa, Homo Sapiens
SPLPLKQRA

SEQ ID NO: 391423 - protein, 9 aa, Homo Sapiens
LTECLAQLA

SEQ ID NO: 391424 - protein, 9 aa, Homo Sapiens
AHLAVEACL

SEQ ID NO: 391425 - protein, 9 aa, Homo Sapiens
PWMVPWGME

SEQ ID NO: 391426 - protein, 9 aa, Homo Sapiens
DKSILLNPG

SEQ ID NO: 391427 - protein, 9 aa, Homo Sapiens
TGRTCQAWL

SEQ ID NO: 391428 - protein, 9 aa, Homo Sapiens
PSTRSANWN

SEQ ID NO: 391429 - protein, 9 aa, Homo Sapiens
LLAQGQPAG

SEQ ID NO: 391430 - protein, 9 aa, Homo Sapiens
RPPRQVREH

SEQ ID NO: 391431 - protein, 9 aa, Homo Sapiens
LKWIMLFLI

SEQ ID NO: 391432 - protein, 9 aa, Homo Sapiens
LFYMVRAHA

SEQ ID NO: 391433 - protein, 9 aa, Homo Sapiens
KEPEVLQDP

SEQ ID NO: 391434 - protein, 9 aa, Homo Sapiens
IQWPTVHGL

SEQ ID NO: 391435 - protein, 9 aa, Homo Sapiens
MLDVTITTL

SEQ ID NO: 391436 - protein, 9 aa, Homo Sapiens
YRAGFVLAQ

SEQ ID NO: 391437 - protein, 9 aa, Homo Sapiens
QMMGRVGRP

SEQ ID NO: 391438 - protein, 9 aa, Homo Sapiens
GDKGIIYDT

SEQ ID NO: 391439 - protein, 9 aa, Homo Sapiens
VVFTDEMDH

SEQ ID NO: 391440 - protein, 9 aa, Homo Sapiens
AGALGSRGA

SEQ ID NO: 391441 - protein, 9 aa, Homo Sapiens
SVSSDCFLT

SEQ ID NO: 391442 - protein, 9 aa, Homo Sapiens
FCDAPPLST

SEQ ID NO: 391443 - protein, 9 aa, Homo Sapiens
YAPLGRSAE

SEQ ID NO: 391444 - protein, 9 aa, Homo Sapiens
RVCGGDTEC

SEQ ID NO: 391445 - protein, 9 aa, Homo Sapiens
SPQAPLRLW

SEQ ID NO: 391446 - protein, 9 aa, Homo Sapiens
RPGGHPEVI

SEQ ID NO: 391447 - protein, 9 aa, Homo Sapiens
PTAARPSAT

SEQ ID NO: 391448 - protein, 9 aa, Homo Sapiens
LQDMIERTI

SEQ ID NO: 391449 - protein, 9 aa, Homo Sapiens
TVNQKKAKI

SEQ ID NO: 391450 - protein, 9 aa, Homo Sapiens
MPPESVLYR

SEQ ID NO: 391451 - protein, 9 aa, Homo Sapiens
SSSAVAPSG

SEQ ID NO: 391452 - protein, 9 aa, Homo Sapiens
FTLSTNSTR

SEQ ID NO: 391453 - protein, 9 aa, Homo Sapiens
AAAVVREFE

SEQ ID NO: 391454 - protein, 9 aa, Homo Sapiens
EVEFGSAIR

SEQ ID NO: 391455 - protein, 9 aa, Homo Sapiens
MEGIFTSKK

SEQ ID NO: 391456 - protein, 9 aa, Homo Sapiens
NEMSDKSKN

SEQ ID NO: 391457 - protein, 9 aa, Homo Sapiens
RASAPAGTT

SEQ ID NO: 391458 - protein, 9 aa, Homo Sapiens
WRMEAHTGR

SEQ ID NO: 391459 - protein, 9 aa, Homo Sapiens
MSLFEETKW

SEQ ID NO: 391460 - protein, 9 aa, Homo Sapiens
GGAPGPLME

SEQ ID NO: 391461 - protein, 9 aa, Homo Sapiens
GDVGLGVQV

SEQ ID NO: 391462 - protein, 9 aa, Homo Sapiens
ENIIRFLPM

SEQ ID NO: 391463 - protein, 9 aa, Homo Sapiens
KLYHSLVMC

SEQ ID NO: 391464 - protein, 9 aa, Homo Sapiens
GILAIGEHL

SEQ ID NO: 391465 - protein, 9 aa, Homo Sapiens
KNITLDDVS

SEQ ID NO: 391466 - protein, 9 aa, Homo Sapiens
RRQQERKAM

SEQ ID NO: 391467 - protein, 9 aa, Homo Sapiens
SEIRVPIVT

SEQ ID NO: 391468 - protein, 9 aa, Homo Sapiens
RRPRWTSAT

SEQ ID NO: 391469 - protein, 9 aa, Homo Sapiens
RIIAKKCIY

SEQ ID NO: 391470 - protein, 9 aa, Homo Sapiens
EEEDTKLKP

SEQ ID NO: 391471 - protein, 9 aa, Homo Sapiens
GHVQRRGTP

SEQ ID NO: 391472 - protein, 9 aa, Homo Sapiens
AGVGLAASF

SEQ ID NO: 391473 - protein, 9 aa, Homo Sapiens
TVTRRMLFP

SEQ ID NO: 391474 - protein, 9 aa, Homo Sapiens
SSSRRCSVP

SEQ ID NO: 391475 - protein, 9 aa, Homo Sapiens
TRETSSTRG

SEQ ID NO: 391476 - protein, 9 aa, Homo Sapiens
RKARADKGT

SEQ ID NO: 391477 - protein, 9 aa, Homo Sapiens
EMKALQCTA

SEQ ID NO: 391478 - protein, 9 aa, Homo Sapiens
NASFSLTCT

SEQ ID NO: 391479 - protein, 9 aa, Homo Sapiens
VYIPEDILI

SEQ ID NO: 391480 - protein, 9 aa, Homo Sapiens
LTEDKKNGI

SEQ ID NO: 391481 - protein, 9 aa, Homo Sapiens
IPEDILIPA

SEQ ID NO: 391482 - protein, 9 aa, Homo Sapiens
ECPNPSRLV

SEQ ID NO: 391483 - protein, 9 aa, Homo Sapiens
TVPYLKNFT

SEQ ID NO: 391484 - protein, 9 aa, Homo Sapiens
AAWSCAPVP

SEQ ID NO: 391485 - protein, 9 aa, Homo Sapiens
AEASLVDQK

SEQ ID NO: 391486 - protein, 9 aa, Homo Sapiens
QEPGTREWD

SEQ ID NO: 391487 - protein, 9 aa, Homo Sapiens
VLHDVMLLD

SEQ ID NO: 391488 - protein, 9 aa, Homo Sapiens
EHQAINTIV

SEQ ID NO: 391489 - protein, 9 aa, Homo Sapiens
IHEIPLPEH

SEQ ID NO: 391490 - protein, 9 aa, Homo Sapiens
ENEQEKKCR

SEQ ID NO: 391491 - protein, 9 aa, Homo Sapiens
PPALWAPAG

SEQ ID NO: 391492 - protein, 9 aa, Homo Sapiens
TALVQLPAK

SEQ ID NO: 391493 - protein, 9 aa, Homo Sapiens
KLIHWVQKI

SEQ ID NO: 391494 - protein, 9 aa, Homo Sapiens
TDLITFPLD

SEQ ID NO: 391495 - protein, 9 aa, Homo Sapiens
EVKQPNLLI

SEQ ID NO: 391496 - protein, 9 aa, Homo Sapiens
WLSPPPPVT

SEQ ID NO: 391497 - protein, 9 aa, Homo Sapiens
NAHSQQMDG

SEQ ID NO: 391498 - protein, 9 aa, Homo Sapiens
EDQEADREE

SEQ ID NO: 391499 - protein, 9 aa, Homo Sapiens
HDVSDKTPM

SEQ ID NO: 391500 - protein, 9 aa, Homo Sapiens
RTLVILGVC

SEQ ID NO: 391501 - protein, 9 aa, Homo Sapiens
PPPPPTCSP

SEQ ID NO: 391502 - protein, 9 aa, Homo Sapiens
PVRHHPPCW

SEQ ID NO: 391503 - protein, 9 aa, Homo Sapiens
LDDRSPQAP

SEQ ID NO: 391504 - protein, 9 aa, Homo Sapiens
RKLGLGLEN

SEQ ID NO: 391505 - protein, 9 aa, Homo Sapiens
NTQKMFSPK

SEQ ID NO: 391506 - protein, 9 aa, Homo Sapiens
PAGGSPPSS

SEQ ID NO: 391507 - protein, 9 aa, Homo Sapiens
GSPSSRKSG

SEQ ID NO: 391508 - protein, 9 aa, Homo Sapiens
VGNCEEKIL

SEQ ID NO: 391509 - protein, 9 aa, Homo Sapiens
NINGRLTPQ

SEQ ID NO: 391510 - protein, 9 aa, Homo Sapiens
TRHVIWENC

SEQ ID NO: 391511 - protein, 9 aa, Homo Sapiens
KKINNQIIV

SEQ ID NO: 391512 - protein, 9 aa, Homo Sapiens
THGEVERHI

SEQ ID NO: 391513 - protein, 9 aa, Homo Sapiens
STSSTIIST

SEQ ID NO: 391514 - protein, 9 aa, Homo Sapiens
VEACLRTHG

SEQ ID NO: 391515 - protein, 9 aa, Homo Sapiens
SHTNFSSHT

SEQ ID NO: 391516 - protein, 9 aa, Homo Sapiens
GTSAAASTF

SEQ ID NO: 391517 - protein, 9 aa, Homo Sapiens
LRTQKPKRS

SEQ ID NO: 391518 - protein, 9 aa, Homo Sapiens
SENDHRDFT

SEQ ID NO: 391519 - protein, 9 aa, Homo Sapiens
LSASFNAPP

SEQ ID NO: 391520 - protein, 9 aa, Homo Sapiens
TSRARGTSG

SEQ ID NO: 391521 - protein, 9 aa, Homo Sapiens
VPTATAASA

SEQ ID NO: 391522 - protein, 9 aa, Homo Sapiens
TVTVTAVGV

SEQ ID NO: 391523 - protein, 9 aa, Homo Sapiens
EGEDVLVHQ

SEQ ID NO: 391524 - protein, 9 aa, Homo Sapiens
QNVMVMILV

SEQ ID NO: 391525 - protein, 9 aa, Homo Sapiens
GTSITSVTL

SEQ ID NO: 391526 - protein, 9 aa, Homo Sapiens
NLIPKLTGS

SEQ ID NO: 391527 - protein, 9 aa, Homo Sapiens
WMDWATSKI

SEQ ID NO: 391528 - protein, 9 aa, Homo Sapiens
CISARGLIF

SEQ ID NO: 391529 - protein, 9 aa, Homo Sapiens
ELGVAVDAQ

SEQ ID NO: 391530 - protein, 9 aa, Homo Sapiens
PCVLPHVDF

SEQ ID NO: 391531 - protein, 9 aa, Homo Sapiens
CIFMEENFS

SEQ ID NO: 391532 - protein, 9 aa, Homo Sapiens
ITTQIFSYL

SEQ ID NO: 391533 - protein, 9 aa, Homo Sapiens
RAAVYNAAR

SEQ ID NO: 391534 - protein, 9 aa, Homo Sapiens
VLEEVIREG

SEQ ID NO: 391535 - protein, 9 aa, Homo Sapiens
VQIEEPIEK

SEQ ID NO: 391536 - protein, 9 aa, Homo Sapiens
VDLPVGLAG

SEQ ID NO: 391537 - protein, 9 aa, Homo Sapiens
RRHSPFVSI

SEQ ID NO: 391538 - protein, 9 aa, Homo Sapiens
LPSPSGSWE

SEQ ID NO: 391539 - protein, 9 aa, Homo Sapiens
VCSHCPRPH

SEQ ID NO: 391540 - protein, 9 aa, Homo Sapiens
QKVTSSLGI

SEQ ID NO: 391541 - protein, 9 aa, Homo Sapiens
RNNAHVIFS

SEQ ID NO: 391542 - protein, 9 aa, Homo Sapiens
TCCWAWTAP

SEQ ID NO: 391543 - protein, 9 aa, Homo Sapiens
EPVGNCEEK

SEQ ID NO: 391544 - protein, 9 aa, Homo Sapiens
TEHVPLGNL

SEQ ID NO: 391545 - protein, 9 aa, Homo Sapiens
TRSTRGSSG

SEQ ID NO: 391546 - protein, 9 aa, Homo Sapiens
ATSLTRQAT

SEQ ID NO: 391547 - protein, 9 aa, Homo Sapiens
LGGLPKDLP

SEQ ID NO: 391548 - protein, 9 aa, Homo Sapiens
KRYFDENDA

SEQ ID NO: 391549 - protein, 9 aa, Homo Sapiens
DTKILILIM

SEQ ID NO: 391550 - protein, 9 aa, Homo Sapiens
PEMGSGTAE

SEQ ID NO: 391551 - protein, 9 aa, Homo Sapiens
RGNWRTAAT

SEQ ID NO: 391552 - protein, 9 aa, Homo Sapiens
LCVTPEKIC

SEQ ID NO: 391553 - protein, 9 aa, Homo Sapiens
SGRSRKERK

SEQ ID NO: 391554 - protein, 9 aa, Homo Sapiens
IEEKKAQTV

SEQ ID NO: 391555 - protein, 9 aa, Homo Sapiens
SCTFVPPPP

SEQ ID NO: 391556 - protein, 9 aa, Homo Sapiens
PPTKKRGKS

SEQ ID NO: 391557 - protein, 9 aa, Homo Sapiens
AINSIRRHL

SEQ ID NO: 391558 - protein, 9 aa, Homo Sapiens
FMIKRAQGW

SEQ ID NO: 391559 - protein, 9 aa, Homo Sapiens
YYYYFITLT

SEQ ID NO: 391560 - protein, 9 aa, Homo Sapiens
NAWNGFSNL

SEQ ID NO: 391561 - protein, 9 aa, Homo Sapiens
MATLHYPST

SEQ ID NO: 391562 - protein, 9 aa, Homo Sapiens
VTEILCVGN

SEQ ID NO: 391563 - protein, 9 aa, Homo Sapiens
GSACVHNGL

SEQ ID NO: 391564 - protein, 9 aa, Homo Sapiens
LLVSTSQRI

SEQ ID NO: 391565 - protein, 9 aa, Homo Sapiens
YFSNPISLP

SEQ ID NO: 391566 - protein, 9 aa, Homo Sapiens
CGKRINFGK

SEQ ID NO: 391567 - protein, 9 aa, Homo Sapiens
ASGPCHAAA

SEQ ID NO: 391568 - protein, 9 aa, Homo Sapiens
TTRTLREIL

SEQ ID NO: 391569 - protein, 9 aa, Homo Sapiens
VLLVLMPPC

SEQ ID NO: 391570 - protein, 9 aa, Homo Sapiens
ALPTPLLRT

SEQ ID NO: 391571 - protein, 9 aa, Homo Sapiens
KRGRTAPAE

SEQ ID NO: 391572 - protein, 9 aa, Homo Sapiens
TTGALGSGG

SEQ ID NO: 391573 - protein, 9 aa, Homo Sapiens
SPTSSPTAR

SEQ ID NO: 391574 - protein, 9 aa, Homo Sapiens
DVESLELEK

SEQ ID NO: 391575 - protein, 9 aa, Homo Sapiens
TEFTPLKKM

SEQ ID NO: 391576 - protein, 9 aa, Homo Sapiens
APTAAKPSA

SEQ ID NO: 391577 - protein, 9 aa, Homo Sapiens
PQPLTGLLE

SEQ ID NO: 391578 - protein, 9 aa, Homo Sapiens
IQHCQHLVD

SEQ ID NO: 391579 - protein, 9 aa, Homo Sapiens
LCILQGLPI

SEQ ID NO: 391580 - protein, 9 aa, Homo Sapiens
KQRREICAG

SEQ ID NO: 391581 - protein, 9 aa, Homo Sapiens
VEVYFLWNY

SEQ ID NO: 391582 - protein, 9 aa, Homo Sapiens
VTVTAVGVE

SEQ ID NO: 391583 - protein, 9 aa, Homo Sapiens
NHSGCIKVD

SEQ ID NO: 391584 - protein, 9 aa, Homo Sapiens
QVSPASPPT

SEQ ID NO: 391585 - protein, 9 aa, Homo Sapiens
MKPDNGAIA

SEQ ID NO: 391586 - protein, 9 aa, Homo Sapiens
PVDYEFNPI

SEQ ID NO: 391587 - protein, 9 aa, Homo Sapiens
LAGRNKGLR

SEQ ID NO: 391588 - protein, 9 aa, Homo Sapiens
KDLIVMGPQ

SEQ ID NO: 391589 - protein, 9 aa, Homo Sapiens
RGHTQQDPG

SEQ ID NO: 391590 - protein, 9 aa, Homo Sapiens
KVLDQDTDT

SEQ ID NO: 391591 - protein, 9 aa, Homo Sapiens
VPMQERPQS

SEQ ID NO: 391592 - protein, 9 aa, Homo Sapiens
VIRWLWAAV

SEQ ID NO: 391593 - protein, 9 aa, Homo Sapiens
HVAPRYHLL

SEQ ID NO: 391594 - protein, 9 aa, Homo Sapiens
WCPVGKKKP

SEQ ID NO: 391595 - protein, 9 aa, Homo Sapiens
LARPPRPAP

SEQ ID NO: 391596 - protein, 9 aa, Homo Sapiens
FPLTMIRVN

SEQ ID NO: 391597 - protein, 9 aa, Homo Sapiens
WHVDACPES

SEQ ID NO: 391598 - protein, 9 aa, Homo Sapiens
VPIPSTRSA

SEQ ID NO: 391599 - protein, 9 aa, Homo Sapiens
GQASGSGFT

SEQ ID NO: 391600 - protein, 9 aa, Homo Sapiens
LTMNDSKHK

SEQ ID NO: 391601 - protein, 9 aa, Homo Sapiens
DWKTILKER

SEQ ID NO: 391602 - protein, 9 aa, Homo Sapiens
TSSRASLTT

SEQ ID NO: 391603 - protein, 9 aa, Homo Sapiens
YSCMCSPEV

SEQ ID NO: 391604 - protein, 9 aa, Homo Sapiens
PGNRGLPLP

SEQ ID NO: 391605 - protein, 9 aa, Homo Sapiens
GATVATMFC

SEQ ID NO: 391606 - protein, 9 aa, Homo Sapiens
NSPLRSPIC

SEQ ID NO: 391607 - protein, 9 aa, Homo Sapiens
VMCLRLRTK

SEQ ID NO: 391608 - protein, 9 aa, Homo Sapiens
GEHLLVIFL

SEQ ID NO: 391609 - protein, 9 aa, Homo Sapiens
IHWILMIRW

SEQ ID NO: 391610 - protein, 9 aa, Homo Sapiens
GPEMGSGTA

SEQ ID NO: 391611 - protein, 9 aa, Homo Sapiens
QSRGAHGTR

SEQ ID NO: 391612 - protein, 9 aa, Homo Sapiens
PADPADSGL

SEQ ID NO: 391613 - protein, 9 aa, Homo Sapiens
LLEQQMIFA

SEQ ID NO: 391614 - protein, 9 aa, Homo Sapiens
HLCMGLKSW

SEQ ID NO: 391615 - protein, 9 aa, Homo Sapiens
MVEQPTGMM

SEQ ID NO: 391616 - protein, 9 aa, Homo Sapiens
LEARGNSTY

SEQ ID NO: 391617 - protein, 9 aa, Homo Sapiens
SARGLIFGA

SEQ ID NO: 391618 - protein, 9 aa, Homo Sapiens
ADLADGAHV

SEQ ID NO: 391619 - protein, 9 aa, Homo Sapiens
QRRGTPSAF

SEQ ID NO: 391620 - protein, 9 aa, Homo Sapiens
ITLSTIVAG

SEQ ID NO: 391621 - protein, 9 aa, Homo Sapiens
TCHWNGKKM

SEQ ID NO: 391622 - protein, 9 aa, Homo Sapiens
RVMIRILPL

SEQ ID NO: 391623 - protein, 9 aa, Homo Sapiens
DVTNMLLLK

SEQ ID NO: 391624 - protein, 9 aa, Homo Sapiens
VISDQDTIH

SEQ ID NO: 391625 - protein, 9 aa, Homo Sapiens
GPPCLPLAR

SEQ ID NO: 391626 - protein, 9 aa, Homo Sapiens
KLDSRADAC

SEQ ID NO: 391627 - protein, 9 aa, Homo Sapiens
REARSTSNT

SEQ ID NO: 391628 - protein, 9 aa, Homo Sapiens
TQPPRGWRS

SEQ ID NO: 391629 - protein, 9 aa, Homo Sapiens
LRLRTKLEK

SEQ ID NO: 391630 - protein, 9 aa, Homo Sapiens
QFLAKHHLL

SEQ ID NO: 391631 - protein, 9 aa, Homo Sapiens
GTSRARRTN

SEQ ID NO: 391632 - protein, 9 aa, Homo Sapiens
TTGTRWAWG

SEQ ID NO: 391633 - protein, 9 aa, Homo Sapiens
NFDAFSSDP

SEQ ID NO: 391634 - protein, 9 aa, Homo Sapiens
EADLADGAH

SEQ ID NO: 391635 - protein, 9 aa, Homo Sapiens
QQDPGVPKS

SEQ ID NO: 391636 - protein, 9 aa, Homo Sapiens
DLRAAVYNA

SEQ ID NO: 391637 - protein, 9 aa, Homo Sapiens
LHNQEVKTS

SEQ ID NO: 391638 - protein, 9 aa, Homo Sapiens
STYSHRASL

SEQ ID NO: 391639 - protein, 9 aa, Homo Sapiens
RPRRQPPHH

SEQ ID NO: 391640 - protein, 9 aa, Homo Sapiens
PSHLKVDKE

SEQ ID NO: 391641 - protein, 9 aa, Homo Sapiens
FAEAADMGN

SEQ ID NO: 391642 - protein, 9 aa, Homo Sapiens
TQSTEHQDL

SEQ ID NO: 391643 - protein, 9 aa, Homo Sapiens
PPPPPPTCS

SEQ ID NO: 391644 - protein, 9 aa, Homo Sapiens
TSRARGSRA

SEQ ID NO: 391645 - protein, 9 aa, Homo Sapiens
KHKRLEQAG

SEQ ID NO: 391646 - protein, 9 aa, Homo Sapiens
ETKWKAEQM

SEQ ID NO: 391647 - protein, 9 aa, Homo Sapiens
VSGLVVDMG

SEQ ID NO: 391648 - protein, 9 aa, Homo Sapiens
CRPTGRPLC

SEQ ID NO: 391649 - protein, 9 aa, Homo Sapiens
LQPFQLAFV

SEQ ID NO: 391650 - protein, 9 aa, Homo Sapiens
RYQQSKDAA

SEQ ID NO: 391651 - protein, 9 aa, Homo Sapiens
FIGLMMYGL

SEQ ID NO: 391652 - protein, 9 aa, Homo Sapiens
REKRLIEIK

SEQ ID NO: 391653 - protein, 9 aa, Homo Sapiens
PGLLFSSFF

SEQ ID NO: 391654 - protein, 9 aa, Homo Sapiens
EDDEEEEMD

SEQ ID NO: 391655 - protein, 9 aa, Homo Sapiens
IVSAWDFRL

SEQ ID NO: 391656 - protein, 9 aa, Homo Sapiens
ITRFAFSTR

SEQ ID NO: 391657 - protein, 9 aa, Homo Sapiens
FLKNGRSEV

SEQ ID NO: 391658 - protein, 9 aa, Homo Sapiens
VREVGFNPR

SEQ ID NO: 391659 - protein, 9 aa, Homo Sapiens
EDIEHRVKA

SEQ ID NO: 391660 - protein, 9 aa, Homo Sapiens
MSDKSKNSA

SEQ ID NO: 391661 - protein, 9 aa, Homo Sapiens
RWAWGSGAT

SEQ ID NO: 391662 - protein, 9 aa, Homo Sapiens
CELWVTASI

SEQ ID NO: 391663 - protein, 9 aa, Homo Sapiens
GASFILSYR

SEQ ID NO: 391664 - protein, 9 aa, Homo Sapiens
RKNPDPRVA

SEQ ID NO: 391665 - protein, 9 aa, Homo Sapiens
APPWQPPPP

SEQ ID NO: 391666 - protein, 9 aa, Homo Sapiens
PSGSWEIAG

SEQ ID NO: 391667 - protein, 9 aa, Homo Sapiens
PTRWQGLTL

SEQ ID NO: 391668 - protein, 9 aa, Homo Sapiens
IRTPAPPWQ

SEQ ID NO: 391669 - protein, 9 aa, Homo Sapiens
LSIEGRSNV

SEQ ID NO: 391670 - protein, 9 aa, Homo Sapiens
NTNRARLSL

SEQ ID NO: 391671 - protein, 9 aa, Homo Sapiens
IPRVFYMNQ

SEQ ID NO: 391672 - protein, 9 aa, Homo Sapiens
PSPSGSWEI

SEQ ID NO: 391673 - protein, 9 aa, Homo Sapiens
LRVMIRILP

SEQ ID NO: 391674 - protein, 9 aa, Homo Sapiens
EEKDKPVTP

SEQ ID NO: 391675 - protein, 9 aa, Homo Sapiens
LFKQNLFCL

SEQ ID NO: 391676 - protein, 9 aa, Homo Sapiens
WGSGATILT

SEQ ID NO: 391677 - protein, 9 aa, Homo Sapiens
RPAGGPPAR

SEQ ID NO: 391678 - protein, 9 aa, Homo Sapiens
MFLIQRELL

SEQ ID NO: 391679 - protein, 9 aa, Homo Sapiens
PAECQSLLQ

SEQ ID NO: 391680 - protein, 9 aa, Homo Sapiens
LIVMGPQDH

SEQ ID NO: 391681 - protein, 9 aa, Homo Sapiens
PIKWNGRMR

SEQ ID NO: 391682 - protein, 9 aa, Homo Sapiens
FQIYQPWEP

SEQ ID NO: 391683 - protein, 9 aa, Homo Sapiens
APGPGRRGL

SEQ ID NO: 391684 - protein, 9 aa, Homo Sapiens
RIQSLPLCL

SEQ ID NO: 391685 - protein, 9 aa, Homo Sapiens
THLPQYYIV

SEQ ID NO: 391686 - protein, 9 aa, Homo Sapiens
KRDVSVCRD

SEQ ID NO: 391687 - protein, 9 aa, Homo Sapiens
SATNPTWRR

SEQ ID NO: 391688 - protein, 9 aa, Homo Sapiens
LGCDEGDAW

SEQ ID NO: 391689 - protein, 9 aa, Homo Sapiens
EALVAELAL

SEQ ID NO: 391690 - protein, 9 aa, Homo Sapiens
QTSFLKALG

SEQ ID NO: 391691 - protein, 9 aa, Homo Sapiens
FTYEGLRAL

SEQ ID NO: 391692 - protein, 9 aa, Homo Sapiens
YASVALFAC

SEQ ID NO: 391693 - protein, 9 aa, Homo Sapiens
GHPQPRPST

SEQ ID NO: 391694 - protein, 9 aa, Homo Sapiens
SFGESDCCY

SEQ ID NO: 391695 - protein, 9 aa, Homo Sapiens
TRCCLCNPG

SEQ ID NO: 391696 - protein, 9 aa, Homo Sapiens
KSVNHPQHT

SEQ ID NO: 391697 - protein, 9 aa, Homo Sapiens
SPMIYGGVA

SEQ ID NO: 391698 - protein, 9 aa, Homo Sapiens
EECRRQKER

SEQ ID NO: 391699 - protein, 9 aa, Homo Sapiens
ELFSRVPEP

SEQ ID NO: 391700 - protein, 9 aa, Homo Sapiens
HNQEVKTSM

SEQ ID NO: 391701 - protein, 9 aa, Homo Sapiens
KFLLYKYKM

SEQ ID NO: 391702 - protein, 9 aa, Homo Sapiens
MDWATSKIS

SEQ ID NO: 391703 - protein, 9 aa, Homo Sapiens
PWKRGRTAP

SEQ ID NO: 391704 - protein, 9 aa, Homo Sapiens
SREKRLIEI

SEQ ID NO: 391705 - protein, 9 aa, Homo Sapiens
PHEDIEHRV

SEQ ID NO: 391706 - protein, 9 aa, Homo Sapiens
FFKPQICPM

SEQ ID NO: 391707 - protein, 9 aa, Homo Sapiens
TGASTPARS

SEQ ID NO: 391708 - protein, 9 aa, Homo Sapiens
SIIGSTNLI

SEQ ID NO: 391709 - protein, 9 aa, Homo Sapiens
TIEDLEVAN

SEQ ID NO: 391710 - protein, 9 aa, Homo Sapiens
SWISVPCPN

SEQ ID NO: 391711 - protein, 9 aa, Homo Sapiens
CPNPSRLVR

SEQ ID NO: 391712 - protein, 9 aa, Homo Sapiens
TPWVGYVHV

SEQ ID NO: 391713 - protein, 9 aa, Homo Sapiens
GTLHTTLAR

SEQ ID NO: 391714 - protein, 9 aa, Homo Sapiens
QQDVESLAD

SEQ ID NO: 391715 - protein, 9 aa, Homo Sapiens
FTAVTLGTR

SEQ ID NO: 391716 - protein, 9 aa, Homo Sapiens
EMRKRMSSS

SEQ ID NO: 391717 - protein, 9 aa, Homo Sapiens
CTPASGPSP

SEQ ID NO: 391718 - protein, 9 aa, Homo Sapiens
AQSKRNLKH

SEQ ID NO: 391719 - protein, 9 aa, Homo Sapiens
TPGGVTDVT

SEQ ID NO: 391720 - protein, 9 aa, Homo Sapiens
PILDDQIQW

SEQ ID NO: 391721 - protein, 9 aa, Homo Sapiens
TNLCLKLWS

SEQ ID NO: 391722 - protein, 9 aa, Homo Sapiens
FFIGYMMKI

SEQ ID NO: 391723 - protein, 9 aa, Homo Sapiens
RMDARYQTQ

SEQ ID NO: 391724 - protein, 9 aa, Homo Sapiens
PPLSTLSCS

SEQ ID NO: 391725 - protein, 9 aa, Homo Sapiens
TGGPVLVSD

SEQ ID NO: 391726 - protein, 9 aa, Homo Sapiens
CVYENTTTK

SEQ ID NO: 391727 - protein, 9 aa, Homo Sapiens
SYVQSNCFP

SEQ ID NO: 391728 - protein, 9 aa, Homo Sapiens
VGDIPDIYE

SEQ ID NO: 391729 - protein, 9 aa, Homo Sapiens
FGESDCCYR

SEQ ID NO: 391730 - protein, 9 aa, Homo Sapiens
DGGQEYMVK

SEQ ID NO: 391731 - protein, 9 aa, Homo Sapiens
SSRASLTTG

SEQ ID NO: 391732 - protein, 9 aa, Homo Sapiens
ARMSLTKPL

SEQ ID NO: 391733 - protein, 9 aa, Homo Sapiens
WNGKKMLSL

SEQ ID NO: 391734 - protein, 9 aa, Homo Sapiens
ITFIGFFSS

SEQ ID NO: 391735 - protein, 9 aa, Homo Sapiens
YEYRQFGEN

SEQ ID NO: 391736 - protein, 9 aa, Homo Sapiens
KVLKIHKSM

SEQ ID NO: 391737 - protein, 9 aa, Homo Sapiens
VRGPPLHTR

SEQ ID NO: 391738 - protein, 9 aa, Homo Sapiens
TYEGLRALQ

SEQ ID NO: 391739 - protein, 9 aa, Homo Sapiens
KKKKPKKKK

SEQ ID NO: 391740 - protein, 9 aa, Homo Sapiens
VLAQSAWCS

SEQ ID NO: 391741 - protein, 9 aa, Homo Sapiens
SHVAALAPG

SEQ ID NO: 391742 - protein, 9 aa, Homo Sapiens
YASLAAVIS

SEQ ID NO: 391743 - protein, 9 aa, Homo Sapiens
MLMTLGMTE

SEQ ID NO: 391744 - protein, 9 aa, Homo Sapiens
RARQRQTRC

SEQ ID NO: 391745 - protein, 9 aa, Homo Sapiens
LNFGGIGVG

SEQ ID NO: 391746 - protein, 9 aa, Homo Sapiens
RYGYASVFL

SEQ ID NO: 391747 - protein, 9 aa, Homo Sapiens
TYLPENILA

SEQ ID NO: 391748 - protein, 9 aa, Homo Sapiens
LCKLLRFFI

SEQ ID NO: 391749 - protein, 9 aa, Homo Sapiens
MARTSGSQC

SEQ ID NO: 391750 - protein, 9 aa, Homo Sapiens
NYNISSKEQ

SEQ ID NO: 391751 - protein, 9 aa, Homo Sapiens
MKLYHSLVM

SEQ ID NO: 391752 - protein, 9 aa, Homo Sapiens
RHSPFVSIL

SEQ ID NO: 391753 - protein, 9 aa, Homo Sapiens
LGAILRLQN

SEQ ID NO: 391754 - protein, 9 aa, Homo Sapiens
GRHTTTPSS

SEQ ID NO: 391755 - protein, 9 aa, Homo Sapiens
QSQPHCVAS

SEQ ID NO: 391756 - protein, 9 aa, Homo Sapiens
ISPYDATLV

SEQ ID NO: 391757 - protein, 9 aa, Homo Sapiens
CSPEPGASC

SEQ ID NO: 391758 - protein, 9 aa, Homo Sapiens
MWKPMWVVL

SEQ ID NO: 391759 - protein, 9 aa, Homo Sapiens
QLREHQRIY

SEQ ID NO: 391760 - protein, 9 aa, Homo Sapiens
ALWAPAGTG

SEQ ID NO: 391761 - protein, 9 aa, Homo Sapiens
HQRIYTGEK

SEQ ID NO: 391762 - protein, 9 aa, Homo Sapiens
QQSMVEQPT

SEQ ID NO: 391763 - protein, 9 aa, Homo Sapiens
GALFAGVNC

SEQ ID NO: 391764 - protein, 9 aa, Homo Sapiens
AVPSVARPS

SEQ ID NO: 391765 - protein, 9 aa, Homo Sapiens
VYVLSEQHG

SEQ ID NO: 391766 - protein, 9 aa, Homo Sapiens
IGLGLAARN

SEQ ID NO: 391767 - protein, 9 aa, Homo Sapiens
SPRNPPSPI

SEQ ID NO: 391768 - protein, 9 aa, Homo Sapiens
LPAPSALVL

SEQ ID NO: 391769 - protein, 9 aa, Homo Sapiens
HKEKYDKMC

SEQ ID NO: 391770 - protein, 9 aa, Homo Sapiens
QVGGTQEVE

SEQ ID NO: 391771 - protein, 9 aa, Homo Sapiens
LLLLLLLDL

SEQ ID NO: 391772 - protein, 9 aa, Homo Sapiens
VAVQVVRAR

SEQ ID NO: 391773 - protein, 9 aa, Homo Sapiens
AIRTRAARA

SEQ ID NO: 391774 - protein, 9 aa, Homo Sapiens
MENQCSLDT

SEQ ID NO: 391775 - protein, 9 aa, Homo Sapiens
FMESLPENR

SEQ ID NO: 391776 - protein, 9 aa, Homo Sapiens
MARTAGDTP

SEQ ID NO: 391777 - protein, 9 aa, Homo Sapiens
PLTAWGLPR

SEQ ID NO: 391778 - protein, 9 aa, Homo Sapiens
LDVNRLSDK

SEQ ID NO: 391779 - protein, 9 aa, Homo Sapiens
DVSEFIQSL

SEQ ID NO: 391780 - protein, 9 aa, Homo Sapiens
ASRRRYLQW

SEQ ID NO: 391781 - protein, 9 aa, Homo Sapiens
QHQTGAPRG

SEQ ID NO: 391782 - protein, 9 aa, Homo Sapiens
YDCLLAEVV

SEQ ID NO: 391783 - protein, 9 aa, Homo Sapiens
VSFCQPHKI

SEQ ID NO: 391784 - protein, 9 aa, Homo Sapiens
LRAAVYNAA

SEQ ID NO: 391785 - protein, 9 aa, Homo Sapiens
KGAAVDRGK

SEQ ID NO: 391786 - protein, 9 aa, Homo Sapiens
TSAPTAAKP

SEQ ID NO: 391787 - protein, 9 aa, Homo Sapiens
ITFFFKIFI

SEQ ID NO: 391788 - protein, 9 aa, Homo Sapiens
RQHPSVELA

SEQ ID NO: 391789 - protein, 9 aa, Homo Sapiens
LTYLFVLLE

SEQ ID NO: 391790 - protein, 9 aa, Homo Sapiens
TETEMRKRM

SEQ ID NO: 391791 - protein, 9 aa, Homo Sapiens
LDTGLAHDS

SEQ ID NO: 391792 - protein, 9 aa, Homo Sapiens
IYVFDVESL

SEQ ID NO: 391793 - protein, 9 aa, Homo Sapiens
RPGPRGGHP

SEQ ID NO: 391794 - protein, 9 aa, Homo Sapiens
GTPGVRAPE

SEQ ID NO: 391795 - protein, 9 aa, Homo Sapiens
GQSCIHQPC

SEQ ID NO: 391796 - protein, 9 aa, Homo Sapiens
LLEGAASHL

SEQ ID NO: 391797 - protein, 9 aa, Homo Sapiens
NRCFPEENF

SEQ ID NO: 391798 - protein, 9 aa, Homo Sapiens
FEFCSSYTM

SEQ ID NO: 391799 - protein, 9 aa, Homo Sapiens
PALKQVSPA

SEQ ID NO: 391800 - protein, 9 aa, Homo Sapiens
LFTRRARRA

SEQ ID NO: 391801 - protein, 9 aa, Homo Sapiens
KQHSMPRLR

SEQ ID NO: 391802 - protein, 9 aa, Homo Sapiens
HITKRLCKQ

SEQ ID NO: 391803 - protein, 9 aa, Homo Sapiens
CPPLEVHLH

SEQ ID NO: 391804 - protein, 9 aa, Homo Sapiens
TIPPAWDVC

SEQ ID NO: 391805 - protein, 9 aa, Homo Sapiens
VRRHFGATV

SEQ ID NO: 391806 - protein, 9 aa, Homo Sapiens
SRGARGAKV

SEQ ID NO: 391807 - protein, 9 aa, Homo Sapiens
QIYQFIDKD

SEQ ID NO: 391808 - protein, 9 aa, Homo Sapiens
IVAGSTVGP

SEQ ID NO: 391809 - protein, 9 aa, Homo Sapiens
NQCSLDTKS

SEQ ID NO: 391810 - protein, 9 aa, Homo Sapiens
SGNTSLSSL

SEQ ID NO: 391811 - protein, 9 aa, Homo Sapiens
ATPTRSGTC

SEQ ID NO: 391812 - protein, 9 aa, Homo Sapiens
SFLSSRARG

SEQ ID NO: 391813 - protein, 9 aa, Homo Sapiens
TQILAAGLS

SEQ ID NO: 391814 - protein, 9 aa, Homo Sapiens
FKLKESCVQ

SEQ ID NO: 391815 - protein, 9 aa, Homo Sapiens
KTPMTNSPI

SEQ ID NO: 391816 - protein, 9 aa, Homo Sapiens
RGALATGSS

SEQ ID NO: 391817 - protein, 9 aa, Homo Sapiens
TLYNRTKRE

SEQ ID NO: 391818 - protein, 9 aa, Homo Sapiens
QLPYFIRPV

SEQ ID NO: 391819 - protein, 9 aa, Homo Sapiens
KVVRKLQWK

SEQ ID NO: 391820 - protein, 9 aa, Homo Sapiens
KKQKLVDMK

SEQ ID NO: 391821 - protein, 9 aa, Homo Sapiens
SEVLQVVTD

SEQ ID NO: 391822 - protein, 9 aa, Homo Sapiens
MSRTPPRRV

SEQ ID NO: 391823 - protein, 9 aa, Homo Sapiens
FILLVVMSF

SEQ ID NO: 391824 - protein, 9 aa, Homo Sapiens
PGPLGSISS

SEQ ID NO: 391825 - protein, 9 aa, Homo Sapiens
LIRYVHDRS

SEQ ID NO: 391826 - protein, 9 aa, Homo Sapiens
YAAGILACE

SEQ ID NO: 391827 - protein, 9 aa, Homo Sapiens
ITGLSWEPI

SEQ ID NO: 391828 - protein, 9 aa, Homo Sapiens
SAPSCCAPV

SEQ ID NO: 391829 - protein, 9 aa, Homo Sapiens
WLPGITHIY

SEQ ID NO: 391830 - protein, 9 aa, Homo Sapiens
GQQLLAHRH

SEQ ID NO: 391831 - protein, 9 aa, Homo Sapiens
TSFTRRSFG

SEQ ID NO: 391832 - protein, 9 aa, Homo Sapiens
NECDKAFRS

SEQ ID NO: 391833 - protein, 9 aa, Homo Sapiens
KPGFLQFQN

SEQ ID NO: 391834 - protein, 9 aa, Homo Sapiens
QVVSKNSIL

SEQ ID NO: 391835 - protein, 9 aa, Homo Sapiens
TLYKVPLDY

SEQ ID NO: 391836 - protein, 9 aa, Homo Sapiens
YNIPVSVCE

SEQ ID NO: 391837 - protein, 9 aa, Homo Sapiens
VKGSFYRKK

SEQ ID NO: 391838 - protein, 9 aa, Homo Sapiens
TPSKKKLKL

SEQ ID NO: 391839 - protein, 9 aa, Homo Sapiens
KSIPVLVNG

SEQ ID NO: 391840 - protein, 9 aa, Homo Sapiens
EVALVHVTD

SEQ ID NO: 391841 - protein, 9 aa, Homo Sapiens
EVGFNPRLS

SEQ ID NO: 391842 - protein, 9 aa, Homo Sapiens
RAGGTRLTT

SEQ ID NO: 391843 - protein, 9 aa, Homo Sapiens
LLLLLLDLP

SEQ ID NO: 391844 - protein, 9 aa, Homo Sapiens
FDFLSVGPM

SEQ ID NO: 391845 - protein, 9 aa, Homo Sapiens
EKKYRNVGL

SEQ ID NO: 391846 - protein, 9 aa, Homo Sapiens
PRQDDNGVM

SEQ ID NO: 391847 - protein, 9 aa, Homo Sapiens
CTNFTTNVS

SEQ ID NO: 391848 - protein, 9 aa, Homo Sapiens
NDLDQLVEM

SEQ ID NO: 391849 - protein, 9 aa, Homo Sapiens
ECRRQKERY

SEQ ID NO: 391850 - protein, 9 aa, Homo Sapiens
NTLFTRFAC

SEQ ID NO: 391851 - protein, 9 aa, Homo Sapiens
LGPSRGAGP

SEQ ID NO: 391852 - protein, 9 aa, Homo Sapiens
LCTVFGILM

SEQ ID NO: 391853 - protein, 9 aa, Homo Sapiens
ENSLHSATM

SEQ ID NO: 391854 - protein, 9 aa, Homo Sapiens
VYFLWNYMK

SEQ ID NO: 391855 - protein, 9 aa, Homo Sapiens
SPCSMCCVI

SEQ ID NO: 391856 - protein, 9 aa, Homo Sapiens
RKNVPSRAG

SEQ ID NO: 391857 - protein, 9 aa, Homo Sapiens
VEGNSVSTT

SEQ ID NO: 391858 - protein, 9 aa, Homo Sapiens
TPIPQSEAS

SEQ ID NO: 391859 - protein, 9 aa, Homo Sapiens
RSPICSANP

SEQ ID NO: 391860 - protein, 9 aa, Homo Sapiens
FVEFGAGTG

SEQ ID NO: 391861 - protein, 9 aa, Homo Sapiens
LSLTHLFLV

SEQ ID NO: 391862 - protein, 9 aa, Homo Sapiens
KQPNLLIID

SEQ ID NO: 391863 - protein, 9 aa, Homo Sapiens
HLLSLNAVG

SEQ ID NO: 391864 - protein, 9 aa, Homo Sapiens
QLDREALCE

SEQ ID NO: 391865 - protein, 9 aa, Homo Sapiens
SSEEVIKAI

SEQ ID NO: 391866 - protein, 9 aa, Homo Sapiens
IRAQGTRRS

SEQ ID NO: 391867 - protein, 9 aa, Homo Sapiens
TSNRHWRQI

SEQ ID NO: 391868 - protein, 9 aa, Homo Sapiens
CFTWRTSRT

SEQ ID NO: 391869 - protein, 9 aa, Homo Sapiens
LGPPPPGPE

SEQ ID NO: 391870 - protein, 9 aa, Homo Sapiens
TCFNIQGSF

SEQ ID NO: 391871 - protein, 9 aa, Homo Sapiens
PDGFGPGGF

SEQ ID NO: 391872 - protein, 9 aa, Homo Sapiens
EIGTVVVLR

SEQ ID NO: 391873 - protein, 9 aa, Homo Sapiens
IPSKLWGFF

SEQ ID NO: 391874 - protein, 9 aa, Homo Sapiens
TLVILGVCA

SEQ ID NO: 391875 - protein, 9 aa, Homo Sapiens
ILEQTYITL

SEQ ID NO: 391876 - protein, 9 aa, Homo Sapiens
PVLSTSSFC

SEQ ID NO: 391877 - protein, 9 aa, Homo Sapiens
TNPTWRRTG

SEQ ID NO: 391878 - protein, 9 aa, Homo Sapiens
PRGWRSRCP

SEQ ID NO: 391879 - protein, 9 aa, Homo Sapiens
RLDEILQTG

SEQ ID NO: 391880 - protein, 9 aa, Homo Sapiens
SLQHQAGMG

SEQ ID NO: 391881 - protein, 9 aa, Homo Sapiens
SVIQSGTQM

SEQ ID NO: 391882 - protein, 9 aa, Homo Sapiens
QPHCVASRR

SEQ ID NO: 391883 - protein, 9 aa, Homo Sapiens
LYMKPDNGA

SEQ ID NO: 391884 - protein, 9 aa, Homo Sapiens
TKKLRSPEG

SEQ ID NO: 391885 - protein, 9 aa, Homo Sapiens
EILSAEGPQ

SEQ ID NO: 391886 - protein, 9 aa, Homo Sapiens
AAALPTPLL

SEQ ID NO: 391887 - protein, 9 aa, Homo Sapiens
YMVKEVLRI

SEQ ID NO: 391888 - protein, 9 aa, Homo Sapiens
DKLEVMFRL

SEQ ID NO: 391889 - protein, 9 aa, Homo Sapiens
LLQAVQHNG

SEQ ID NO: 391890 - protein, 9 aa, Homo Sapiens
YPRLDVNRL

SEQ ID NO: 391891 - protein, 9 aa, Homo Sapiens
RVCGLEEQV

SEQ ID NO: 391892 - protein, 9 aa, Homo Sapiens
DLHHFLQGF

SEQ ID NO: 391893 - protein, 9 aa, Homo Sapiens
RAISTFGTS

SEQ ID NO: 391894 - protein, 9 aa, Homo Sapiens
ETVDILLNV

SEQ ID NO: 391895 - protein, 9 aa, Homo Sapiens
LSSFLIFFI

SEQ ID NO: 391896 - protein, 9 aa, Homo Sapiens
FLSASVMYK

SEQ ID NO: 391897 - protein, 9 aa, Homo Sapiens
ARGSRATSL

SEQ ID NO: 391898 - protein, 9 aa, Homo Sapiens
TVRSITHVN

SEQ ID NO: 391899 - protein, 9 aa, Homo Sapiens
LLYVVHVVF

SEQ ID NO: 391900 - protein, 9 aa, Homo Sapiens
FCKKSCSII

SEQ ID NO: 391901 - protein, 9 aa, Homo Sapiens
LIGEGTRGV

SEQ ID NO: 391902 - protein, 9 aa, Homo Sapiens
QEDRKARAD

SEQ ID NO: 391903 - protein, 9 aa, Homo Sapiens
DICILTLAK

SEQ ID NO: 391904 - protein, 9 aa, Homo Sapiens
GDKGLKKAL

SEQ ID NO: 391905 - protein, 9 aa, Homo Sapiens
PTHCSTTCR

SEQ ID NO: 391906 - protein, 9 aa, Homo Sapiens
PRPAPARPA

SEQ ID NO: 391907 - protein, 9 aa, Homo Sapiens
SVGFTALVQ

SEQ ID NO: 391908 - protein, 9 aa, Homo Sapiens
TGAPRGHFI

SEQ ID NO: 391909 - protein, 9 aa, Homo Sapiens
SSHHYVDRL

SEQ ID NO: 391910 - protein, 9 aa, Homo Sapiens
CREYLKNFH

SEQ ID NO: 391911 - protein, 9 aa, Homo Sapiens
ELEPPDKTK

SEQ ID NO: 391912 - protein, 9 aa, Homo Sapiens
YTILRSPMI

SEQ ID NO: 391913 - protein, 9 aa, Homo Sapiens
VANDPLYVP

SEQ ID NO: 391914 - protein, 9 aa, Homo Sapiens
AVKDLASQL

SEQ ID NO: 391915 - protein, 9 aa, Homo Sapiens
GVQKPISLA

SEQ ID NO: 391916 - protein, 9 aa, Homo Sapiens
AQQVLFMMV

SEQ ID NO: 391917 - protein, 9 aa, Homo Sapiens
LTLVTTGAL

SEQ ID NO: 391918 - protein, 9 aa, Homo Sapiens
APAEVHKAR

SEQ ID NO: 391919 - protein, 9 aa, Homo Sapiens
QMPGPPCSI

SEQ ID NO: 391920 - protein, 9 aa, Homo Sapiens
RQIYRRYCM

SEQ ID NO: 391921 - protein, 9 aa, Homo Sapiens
HPSRHPPGS

SEQ ID NO: 391922 - protein, 9 aa, Homo Sapiens
SHIVGIHTD

SEQ ID NO: 391923 - protein, 9 aa, Homo Sapiens
GWRSRCPSL

SEQ ID NO: 391924 - protein, 9 aa, Homo Sapiens
DQCEETIST

SEQ ID NO: 391925 - protein, 9 aa, Homo Sapiens
RPDVHRLGS

SEQ ID NO: 391926 - protein, 9 aa, Homo Sapiens
NTICARETT

SEQ ID NO: 391927 - protein, 9 aa, Homo Sapiens
QSLPLCLSC

SEQ ID NO: 391928 - protein, 9 aa, Homo Sapiens
NRDLCASST

SEQ ID NO: 391929 - protein, 9 aa, Homo Sapiens
FLDTGLAHD

SEQ ID NO: 391930 - protein, 9 aa, Homo Sapiens
VAPDRAPFA

SEQ ID NO: 391931 - protein, 9 aa, Homo Sapiens
RRLHHGTRR

SEQ ID NO: 391932 - protein, 9 aa, Homo Sapiens
CSPRRPQPW

SEQ ID NO: 391933 - protein, 9 aa, Homo Sapiens
FACLTLVTT

SEQ ID NO: 391934 - protein, 9 aa, Homo Sapiens
QLAGTPPGM

SEQ ID NO: 391935 - protein, 9 aa, Homo Sapiens
WPPSFSAPC

SEQ ID NO: 391936 - protein, 9 aa, Homo Sapiens
TLFARFTRG

SEQ ID NO: 391937 - protein, 9 aa, Homo Sapiens
SRQHPSVEL

SEQ ID NO: 391938 - protein, 9 aa, Homo Sapiens
EDHYFRSPL

SEQ ID NO: 391939 - protein, 9 aa, Homo Sapiens
PKRIRSDPD

SEQ ID NO: 391940 - protein, 9 aa, Homo Sapiens
LLLWPTSAP

SEQ ID NO: 391941 - protein, 9 aa, Homo Sapiens
QEFPPRPTS

SEQ ID NO: 391942 - protein, 9 aa, Homo Sapiens
GPVLVSDPI

SEQ ID NO: 391943 - protein, 9 aa, Homo Sapiens
MCSPEVTIH

SEQ ID NO: 391944 - protein, 9 aa, Homo Sapiens
LRPWKTSCT

SEQ ID NO: 391945 - protein, 9 aa, Homo Sapiens
SGTLGTSNT

SEQ ID NO: 391946 - protein, 9 aa, Homo Sapiens
IYTGEKPFK

SEQ ID NO: 391947 - protein, 9 aa, Homo Sapiens
RSKVKITLL

SEQ ID NO: 391948 - protein, 9 aa, Homo Sapiens
FFCRDRVLL

SEQ ID NO: 391949 - protein, 9 aa, Homo Sapiens
VVLGPSRGA

SEQ ID NO: 391950 - protein, 9 aa, Homo Sapiens
VKKRPGGHP

SEQ ID NO: 391951 - protein, 9 aa, Homo Sapiens
AIARAVLSI

SEQ ID NO: 391952 - protein, 9 aa, Homo Sapiens
LDAMKHQSQ

SEQ ID NO: 391953 - protein, 9 aa, Homo Sapiens
KNPMHIFAK

SEQ ID NO: 391954 - protein, 9 aa, Homo Sapiens
IYSIGGILL

SEQ ID NO: 391955 - protein, 9 aa, Homo Sapiens
DGLLVLISI

SEQ ID NO: 391956 - protein, 9 aa, Homo Sapiens
SLHCPSVPT

SEQ ID NO: 391957 - protein, 9 aa, Homo Sapiens
EAPPPSTAA

SEQ ID NO: 391958 - protein, 9 aa, Homo Sapiens
ATARTRGPN

SEQ ID NO: 391959 - protein, 9 aa, Homo Sapiens
SSLGIRAQG

SEQ ID NO: 391960 - protein, 9 aa, Homo Sapiens
PNPSRLVRR

SEQ ID NO: 391961 - protein, 9 aa, Homo Sapiens
ILYETVDIL

SEQ ID NO: 391962 - protein, 9 aa, Homo Sapiens
RKSGVKSQI

SEQ ID NO: 391963 - protein, 9 aa, Homo Sapiens
DSEETVTRR

SEQ ID NO: 391964 - protein, 9 aa, Homo Sapiens
KELCTWEEE

SEQ ID NO: 391965 - protein, 9 aa, Homo Sapiens
PHHLVPLFI

SEQ ID NO: 391966 - protein, 9 aa, Homo Sapiens
AVLAWARAH

SEQ ID NO: 391967 - protein, 9 aa, Homo Sapiens
NSSQNLFVL

SEQ ID NO: 391968 - protein, 9 aa, Homo Sapiens
HIDPPDPTK

SEQ ID NO: 391969 - protein, 9 aa, Homo Sapiens
TPPCDSGGR

SEQ ID NO: 391970 - protein, 9 aa, Homo Sapiens
TIAVHVVRV

SEQ ID NO: 391971 - protein, 9 aa, Homo Sapiens
ESCVQRRYS

SEQ ID NO: 391972 - protein, 9 aa, Homo Sapiens
KESTIFQML

SEQ ID NO: 391973 - protein, 9 aa, Homo Sapiens
AQQHVISDQ

SEQ ID NO: 391974 - protein, 9 aa, Homo Sapiens
KMLSLTHLF

SEQ ID NO: 391975 - protein, 9 aa, Homo Sapiens
PGSGPVYAD

SEQ ID NO: 391976 - protein, 9 aa, Homo Sapiens
PEKFQPSHL

SEQ ID NO: 391977 - protein, 9 aa, Homo Sapiens
YPPIHAPTL

SEQ ID NO: 391978 - protein, 9 aa, Homo Sapiens
SAKPPAGGS

SEQ ID NO: 391979 - protein, 9 aa, Homo Sapiens
FSSFYEQQI

SEQ ID NO: 391980 - protein, 9 aa, Homo Sapiens
CEHRVAAKQ

SEQ ID NO: 391981 - protein, 9 aa, Homo Sapiens
QAPLRLWSW

SEQ ID NO: 391982 - protein, 9 aa, Homo Sapiens
SLLRRPPPP

SEQ ID NO: 391983 - protein, 9 aa, Homo Sapiens
TKAWPASSF

SEQ ID NO: 391984 - protein, 9 aa, Homo Sapiens
GLRPCRCCR

SEQ ID NO: 391985 - protein, 9 aa, Homo Sapiens
LNVLEGCVS

SEQ ID NO: 391986 - protein, 9 aa, Homo Sapiens
DFLSVGPMS

SEQ ID NO: 391987 - protein, 9 aa, Homo Sapiens
LEWRVSLYN

SEQ ID NO: 391988 - protein, 9 aa, Homo Sapiens
LADAILSSN

SEQ ID NO: 391989 - protein, 9 aa, Homo Sapiens
PTTSNRHWR

SEQ ID NO: 391990 - protein, 9 aa, Homo Sapiens
GAPLPWMVP

SEQ ID NO: 391991 - protein, 9 aa, Homo Sapiens
KIRSFQKSY

SEQ ID NO: 391992 - protein, 9 aa, Homo Sapiens
QGGSPVGDV

SEQ ID NO: 391993 - protein, 9 aa, Homo Sapiens
STRFDVNTP

SEQ ID NO: 391994 - protein, 9 aa, Homo Sapiens
TKLEFPSPF

SEQ ID NO: 391995 - protein, 9 aa, Homo Sapiens
EKLESLLLY

SEQ ID NO: 391996 - protein, 9 aa, Homo Sapiens
GALGPISPS

SEQ ID NO: 391997 - protein, 9 aa, Homo Sapiens
QFLISPHSS

SEQ ID NO: 391998 - protein, 9 aa, Homo Sapiens
MFQVCAELD

SEQ ID NO: 391999 - protein, 9 aa, Homo Sapiens
PIYSIGGIL

SEQ ID NO: 392000 - protein, 9 aa, Homo Sapiens
GATILTGGT

SEQ ID NO: 392001 - protein, 9 aa, Homo Sapiens
GQEVILDLI

SEQ ID NO: 392002 - protein, 9 aa, Homo Sapiens
VPVLRSSDK

SEQ ID NO: 392003 - protein, 9 aa, Homo Sapiens
VTLGARRTV

SEQ ID NO: 392004 - protein, 9 aa, Homo Sapiens
LARDVKKVD

SEQ ID NO: 392005 - protein, 9 aa, Homo Sapiens
DGLFDILIK

SEQ ID NO: 392006 - protein, 9 aa, Homo Sapiens
GVVDNNHCQ

SEQ ID NO: 392007 - protein, 9 aa, Homo Sapiens
QSSYAAGIL

SEQ ID NO: 392008 - protein, 9 aa, Homo Sapiens
SESADDELA

SEQ ID NO: 392009 - protein, 9 aa, Homo Sapiens
HKAATVFDL

SEQ ID NO: 392010 - protein, 9 aa, Homo Sapiens
KEEYSAMRD

SEQ ID NO: 392011 - protein, 9 aa, Homo Sapiens
RRFQIINTE

SEQ ID NO: 392012 - protein, 9 aa, Homo Sapiens
GLRGTPGVR

SEQ ID NO: 392013 - protein, 9 aa, Homo Sapiens
EPLLGEERE

SEQ ID NO: 392014 - protein, 9 aa, Homo Sapiens
RGSSGAGLT

SEQ ID NO: 392015 - protein, 9 aa, Homo Sapiens
RTLEGCISV

SEQ ID NO: 392016 - protein, 9 aa, Homo Sapiens
SPLWLRLHP

SEQ ID NO: 392017 - protein, 9 aa, Homo Sapiens
VAGSTVGPS

SEQ ID NO: 392018 - protein, 9 aa, Homo Sapiens
EIVITDQHR

SEQ ID NO: 392019 - protein, 9 aa, Homo Sapiens
ELDAPPANL

SEQ ID NO: 392020 - protein, 9 aa, Homo Sapiens
GGFACPWPT

SEQ ID NO: 392021 - protein, 9 aa, Homo Sapiens
VTDVWSVIA

SEQ ID NO: 392022 - protein, 9 aa, Homo Sapiens
TGGRHTTTP

SEQ ID NO: 392023 - protein, 9 aa, Homo Sapiens
RARGSSISR

SEQ ID NO: 392024 - protein, 9 aa, Homo Sapiens
QGHMLQGRP

SEQ ID NO: 392025 - protein, 9 aa, Homo Sapiens
LASRARGTR

SEQ ID NO: 392026 - protein, 9 aa, Homo Sapiens
DQWMDKETT

SEQ ID NO: 392027 - protein, 9 aa, Homo Sapiens
LPGITHIYS

SEQ ID NO: 392028 - protein, 9 aa, Homo Sapiens
CEEPSRGPS

SEQ ID NO: 392029 - protein, 9 aa, Homo Sapiens
SSNPASTSG

SEQ ID NO: 392030 - protein, 9 aa, Homo Sapiens
IIDILVSMV

SEQ ID NO: 392031 - protein, 9 aa, Homo Sapiens
HQSSYLKIH

SEQ ID NO: 392032 - protein, 9 aa, Homo Sapiens
HNGLTALLA

SEQ ID NO: 392033 - protein, 9 aa, Homo Sapiens
CSLYGKKLV

SEQ ID NO: 392034 - protein, 9 aa, Homo Sapiens
GAPGPLMEQ

SEQ ID NO: 392035 - protein, 9 aa, Homo Sapiens
GEDEYYQAV

SEQ ID NO: 392036 - protein, 9 aa, Homo Sapiens
SSCAAFFRR

SEQ ID NO: 392037 - protein, 9 aa, Homo Sapiens
RARLEESRH

SEQ ID NO: 392038 - protein, 9 aa, Homo Sapiens
TKSIFASKV

SEQ ID NO: 392039 - protein, 9 aa, Homo Sapiens
FEETKWKAE

SEQ ID NO: 392040 - protein, 9 aa, Homo Sapiens
SQRPPRQVR

SEQ ID NO: 392041 - protein, 9 aa, Homo Sapiens
ITPELRLQS

SEQ ID NO: 392042 - protein, 9 aa, Homo Sapiens
KDTTSAVSI

SEQ ID NO: 392043 - protein, 9 aa, Homo Sapiens
PGCSQRAPL

SEQ ID NO: 392044 - protein, 9 aa, Homo Sapiens
ADGALLRGL

SEQ ID NO: 392045 - protein, 9 aa, Homo Sapiens
RKRRSSWSR

SEQ ID NO: 392046 - protein, 9 aa, Homo Sapiens
ENAMDAAGG

SEQ ID NO: 392047 - protein, 9 aa, Homo Sapiens
ATLSQKNDL

SEQ ID NO: 392048 - protein, 9 aa, Homo Sapiens
DRGKLDVGN

SEQ ID NO: 392049 - protein, 9 aa, Homo Sapiens
RQTRCQVRP

SEQ ID NO: 392050 - protein, 9 aa, Homo Sapiens
RGNISTSSN

SEQ ID NO: 392051 - protein, 9 aa, Homo Sapiens
EKARVHRQF

SEQ ID NO: 392052 - protein, 9 aa, Homo Sapiens
EGRVHILDS

SEQ ID NO: 392053 - protein, 9 aa, Homo Sapiens
VPSRAGQKP

SEQ ID NO: 392054 - protein, 9 aa, Homo Sapiens
GYVNDRMRE

SEQ ID NO: 392055 - protein, 9 aa, Homo Sapiens
DRGWAGCLQ

SEQ ID NO: 392056 - protein, 9 aa, Homo Sapiens
LRMHMRTHN

SEQ ID NO: 392057 - protein, 9 aa, Homo Sapiens
TEKEENKQQ

SEQ ID NO: 392058 - protein, 9 aa, Homo Sapiens
IDFEFCSSY

SEQ ID NO: 392059 - protein, 9 aa, Homo Sapiens
VFYMNQRVA

SEQ ID NO: 392060 - protein, 9 aa, Homo Sapiens
EDLEVANDP

SEQ ID NO: 392061 - protein, 9 aa, Homo Sapiens
KYHQGDRKG

SEQ ID NO: 392062 - protein, 9 aa, Homo Sapiens
SSNNSREKR

SEQ ID NO: 392063 - protein, 9 aa, Homo Sapiens
RKSQEKEWA

SEQ ID NO: 392064 - protein, 9 aa, Homo Sapiens
SPPAPSMPR

SEQ ID NO: 392065 - protein, 9 aa, Homo Sapiens
GFAAAVVRE

SEQ ID NO: 392066 - protein, 9 aa, Homo Sapiens
RYLQWSCSV

SEQ ID NO: 392067 - protein, 9 aa, Homo Sapiens
RLFYMVRAH

SEQ ID NO: 392068 - protein, 9 aa, Homo Sapiens
VLGQPGVRA

SEQ ID NO: 392069 - protein, 9 aa, Homo Sapiens
ATSAHYVER

SEQ ID NO: 392070 - protein, 9 aa, Homo Sapiens
LFSEQRSGC

SEQ ID NO: 392071 - protein, 9 aa, Homo Sapiens
DTLYKVPLD

SEQ ID NO: 392072 - protein, 9 aa, Homo Sapiens
YPHWRQQAP

SEQ ID NO: 392073 - protein, 9 aa, Homo Sapiens
RCTRSWAPT

SEQ ID NO: 392074 - protein, 9 aa, Homo Sapiens
RGGVATPGR

SEQ ID NO: 392075 - protein, 9 aa, Homo Sapiens
APTTPTSAR

SEQ ID NO: 392076 - protein, 9 aa, Homo Sapiens
QEVILDLIP

SEQ ID NO: 392077 - protein, 9 aa, Homo Sapiens
QWMDKETTQ

SEQ ID NO: 392078 - protein, 9 aa, Homo Sapiens
AVLSIQSTT

SEQ ID NO: 392079 - protein, 9 aa, Homo Sapiens
TGSLPDVEA

SEQ ID NO: 392080 - protein, 9 aa, Homo Sapiens
WDTPAKCAG

SEQ ID NO: 392081 - protein, 9 aa, Homo Sapiens
GSLNTNRAR

SEQ ID NO: 392082 - protein, 9 aa, Homo Sapiens
AAIWRRIGA

SEQ ID NO: 392083 - protein, 9 aa, Homo Sapiens
TSEMKVVTA

SEQ ID NO: 392084 - protein, 9 aa, Homo Sapiens
KCRLFYKDM

SEQ ID NO: 392085 - protein, 9 aa, Homo Sapiens
EMKTLKKIS

SEQ ID NO: 392086 - protein, 9 aa, Homo Sapiens
ELKPLCVYS

SEQ ID NO: 392087 - protein, 9 aa, Homo Sapiens
NTRHVIWEN

SEQ ID NO: 392088 - protein, 9 aa, Homo Sapiens
ASQGLPVPL

SEQ ID NO: 392089 - protein, 9 aa, Homo Sapiens
LGNITAPCN

SEQ ID NO: 392090 - protein, 9 aa, Homo Sapiens
RDTRDTFSD

SEQ ID NO: 392091 - protein, 9 aa, Homo Sapiens
WPRTASSRC

SEQ ID NO: 392092 - protein, 9 aa, Homo Sapiens
AEKETSLWF

SEQ ID NO: 392093 - protein, 9 aa, Homo Sapiens
IIAGQGPPG

SEQ ID NO: 392094 - protein, 9 aa, Homo Sapiens
RRRYLQWSC

SEQ ID NO: 392095 - protein, 9 aa, Homo Sapiens
RTLEKVDDR

SEQ ID NO: 392096 - protein, 9 aa, Homo Sapiens
PLGRSAEVT

SEQ ID NO: 392097 - protein, 9 aa, Homo Sapiens
AGAIHFRRE

SEQ ID NO: 392098 - protein, 9 aa, Homo Sapiens
IYDTDGQEA

SEQ ID NO: 392099 - protein, 9 aa, Homo Sapiens
SAFFKPQIC

SEQ ID NO: 392100 - protein, 9 aa, Homo Sapiens
FTPLKKMSM

SEQ ID NO: 392101 - protein, 9 aa, Homo Sapiens
VNSSNPFLH

SEQ ID NO: 392102 - protein, 9 aa, Homo Sapiens
PISPSSPGL

SEQ ID NO: 392103 - protein, 9 aa, Homo Sapiens
VEIGDENVT

SEQ ID NO: 392104 - protein, 9 aa, Homo Sapiens
VEVTQRWRE

SEQ ID NO: 392105 - protein, 9 aa, Homo Sapiens
RDRFNARRF

SEQ ID NO: 392106 - protein, 9 aa, Homo Sapiens
RKIIRQYVS

SEQ ID NO: 392107 - protein, 9 aa, Homo Sapiens
ARPSTTRRD

SEQ ID NO: 392108 - protein, 9 aa, Homo Sapiens
LEASSLQHQ

SEQ ID NO: 392109 - protein, 9 aa, Homo Sapiens
SAGKELVIG

SEQ ID NO: 392110 - protein, 9 aa, Homo Sapiens
VNAGLRSFF

SEQ ID NO: 392111 - protein, 9 aa, Homo Sapiens
YEGLRALQS

SEQ ID NO: 392112 - protein, 9 aa, Homo Sapiens
GASCQNSSP

SEQ ID NO: 392113 - protein, 9 aa, Homo Sapiens
TSSLAATPL

SEQ ID NO: 392114 - protein, 9 aa, Homo Sapiens
LQLANHSGC

SEQ ID NO: 392115 - protein, 9 aa, Homo Sapiens
QNHSKCITE

SEQ ID NO: 392116 - protein, 9 aa, Homo Sapiens
ETEMRKRMS

SEQ ID NO: 392117 - protein, 9 aa, Homo Sapiens
QQSKDAALK

SEQ ID NO: 392118 - protein, 9 aa, Homo Sapiens
TVRKRVSPT

SEQ ID NO: 392119 - protein, 9 aa, Homo Sapiens
AFMAAFYDC

SEQ ID NO: 392120 - protein, 9 aa, Homo Sapiens
LERTTPPRY

SEQ ID NO: 392121 - protein, 9 aa, Homo Sapiens
YKRGGLFLL

SEQ ID NO: 392122 - protein, 9 aa, Homo Sapiens
AALYLLGYS

SEQ ID NO: 392123 - protein, 9 aa, Homo Sapiens
SRDLLTGLP

SEQ ID NO: 392124 - protein, 9 aa, Homo Sapiens
QRVMLKEIY

SEQ ID NO: 392125 - protein, 9 aa, Homo Sapiens
YFLEEPIPG

SEQ ID NO: 392126 - protein, 9 aa, Homo Sapiens
AEKEVKRKK

SEQ ID NO: 392127 - protein, 9 aa, Homo Sapiens
RSEVSLKHV

SEQ ID NO: 392128 - protein, 9 aa, Homo Sapiens
HQCNHAAGA

SEQ ID NO: 392129 - protein, 9 aa, Homo Sapiens
KSINSALLV

SEQ ID NO: 392130 - protein, 9 aa, Homo Sapiens
CNRASSSKR

SEQ ID NO: 392131 - protein, 9 aa, Homo Sapiens
LFVAFSVTG

SEQ ID NO: 392132 - protein, 9 aa, Homo Sapiens
GCISIILRF

SEQ ID NO: 392133 - protein, 9 aa, Homo Sapiens
GTSGKGFVA

SEQ ID NO: 392134 - protein, 9 aa, Homo Sapiens
CKNSPGCVD

SEQ ID NO: 392135 - protein, 9 aa, Homo Sapiens
ASYIHYVFH

SEQ ID NO: 392136 - protein, 9 aa, Homo Sapiens
NTPRSEIAT

SEQ ID NO: 392137 - protein, 9 aa, Homo Sapiens
LCLKGPSAN

SEQ ID NO: 392138 - protein, 9 aa, Homo Sapiens
QGPGPTPQP

SEQ ID NO: 392139 - protein, 9 aa, Homo Sapiens
GYASVFLSP

SEQ ID NO: 392140 - protein, 9 aa, Homo Sapiens
SAYSDSWHV

SEQ ID NO: 392141 - protein, 9 aa, Homo Sapiens
LKERRLLQN

SEQ ID NO: 392142 - protein, 9 aa, Homo Sapiens
ECQSLLQGE

SEQ ID NO: 392143 - protein, 9 aa, Homo Sapiens
EATVTLYAS

SEQ ID NO: 392144 - protein, 9 aa, Homo Sapiens
DLAAYHAPE

SEQ ID NO: 392145 - protein, 9 aa, Homo Sapiens
GELVDESGA

SEQ ID NO: 392146 - protein, 9 aa, Homo Sapiens
KARSGKGEA

SEQ ID NO: 392147 - protein, 9 aa, Homo Sapiens
VDIQYLYST

SEQ ID NO: 392148 - protein, 9 aa, Homo Sapiens
EWTPPCDSG

SEQ ID NO: 392149 - protein, 9 aa, Homo Sapiens
KKKPKKKKK

SEQ ID NO: 392150 - protein, 9 aa, Homo Sapiens
CVDSKQMNL

SEQ ID NO: 392151 - protein, 9 aa, Homo Sapiens
PRASRALRS

SEQ ID NO: 392152 - protein, 9 aa, Homo Sapiens
TSGTAPSAV

SEQ ID NO: 392153 - protein, 9 aa, Homo Sapiens
RPPPGPPCL

SEQ ID NO: 392154 - protein, 9 aa, Homo Sapiens
QLGPSFHSH

SEQ ID NO: 392155 - protein, 9 aa, Homo Sapiens
DNLIITIRN

SEQ ID NO: 392156 - protein, 9 aa, Homo Sapiens
AAGNPSLSL

SEQ ID NO: 392157 - protein, 9 aa, Homo Sapiens
SFGASRARR

SEQ ID NO: 392158 - protein, 9 aa, Homo Sapiens
EVWKEVRGE

SEQ ID NO: 392159 - protein, 9 aa, Homo Sapiens
HCLDILLPS

SEQ ID NO: 392160 - protein, 9 aa, Homo Sapiens
RLKIFVSSA

SEQ ID NO: 392161 - protein, 9 aa, Homo Sapiens
TRLPALPTS

SEQ ID NO: 392162 - protein, 9 aa, Homo Sapiens
KCSLYGKKL

SEQ ID NO: 392163 - protein, 9 aa, Homo Sapiens
SGFTSSSSL

SEQ ID NO: 392164 - protein, 9 aa, Homo Sapiens
SSLLQDTAA

SEQ ID NO: 392165 - protein, 9 aa, Homo Sapiens
SPWTPSLSR

SEQ ID NO: 392166 - protein, 9 aa, Homo Sapiens
ETEKEENKQ

SEQ ID NO: 392167 - protein, 9 aa, Homo Sapiens
GGLPKDLPL

SEQ ID NO: 392168 - protein, 9 aa, Homo Sapiens
QAPRLLSRV

SEQ ID NO: 392169 - protein, 9 aa, Homo Sapiens
FAKRLSGFT

SEQ ID NO: 392170 - protein, 9 aa, Homo Sapiens
SEQHGAAAE

SEQ ID NO: 392171 - protein, 9 aa, Homo Sapiens
TQDLRKKEN

SEQ ID NO: 392172 - protein, 9 aa, Homo Sapiens
PSWSRCAGR

SEQ ID NO: 392173 - protein, 9 aa, Homo Sapiens
PHLRARVLP

SEQ ID NO: 392174 - protein, 9 aa, Homo Sapiens
CATQHQLTP

SEQ ID NO: 392175 - protein, 9 aa, Homo Sapiens
TRLTTVSGG

SEQ ID NO: 392176 - protein, 9 aa, Homo Sapiens
SRALFTSLA

SEQ ID NO: 392177 - protein, 9 aa, Homo Sapiens
GCSQRAPLA

SEQ ID NO: 392178 - protein, 9 aa, Homo Sapiens
STRDYIVEP

SEQ ID NO: 392179 - protein, 9 aa, Homo Sapiens
PDLHHFLQG

SEQ ID NO: 392180 - protein, 9 aa, Homo Sapiens
LQCTAGGNV

SEQ ID NO: 392181 - protein, 9 aa, Homo Sapiens
IGATTPPIG

SEQ ID NO: 392182 - protein, 9 aa, Homo Sapiens
RHIVSQLLT

SEQ ID NO: 392183 - protein, 9 aa, Homo Sapiens
KSRIIAKKC

SEQ ID NO: 392184 - protein, 9 aa, Homo Sapiens
EARGNSTYR

SEQ ID NO: 392185 - protein, 9 aa, Homo Sapiens
RWKSGSWHP

SEQ ID NO: 392186 - protein, 9 aa, Homo Sapiens
TFGSRSTNI

SEQ ID NO: 392187 - protein, 9 aa, Homo Sapiens
RGTRGTNFT

SEQ ID NO: 392188 - protein, 9 aa, Homo Sapiens
KAMTKRSPE

SEQ ID NO: 392189 - protein, 9 aa, Homo Sapiens
LKLILVMLE

SEQ ID NO: 392190 - protein, 9 aa, Homo Sapiens
VTAVDPMAD

SEQ ID NO: 392191 - protein, 9 aa, Homo Sapiens
ERLDEILQT

SEQ ID NO: 392192 - protein, 9 aa, Homo Sapiens
FVSILRAAL

SEQ ID NO: 392193 - protein, 9 aa, Homo Sapiens
EPGASCQNS

SEQ ID NO: 392194 - protein, 9 aa, Homo Sapiens
PRARVIRGL

SEQ ID NO: 392195 - protein, 9 aa, Homo Sapiens
MPRTLEGCI

SEQ ID NO: 392196 - protein, 9 aa, Homo Sapiens
TRLECRTRH

SEQ ID NO: 392197 - protein, 9 aa, Homo Sapiens
GSPVGDVGL

SEQ ID NO: 392198 - protein, 9 aa, Homo Sapiens
YCKEGFTGL

SEQ ID NO: 392199 - protein, 9 aa, Homo Sapiens
SECHASIVE

SEQ ID NO: 392200 - protein, 9 aa, Homo Sapiens
GPGSFGGPD

SEQ ID NO: 392201 - protein, 9 aa, Homo Sapiens
HLRKHQCNH

SEQ ID NO: 392202 - protein, 9 aa, Homo Sapiens
LGKWLQWPH

SEQ ID NO: 392203 - protein, 9 aa, Homo Sapiens
QRLWEIQHM

SEQ ID NO: 392204 - protein, 9 aa, Homo Sapiens
RIEYNVEHY

SEQ ID NO: 392205 - protein, 9 aa, Homo Sapiens
LTNLSSSLT

SEQ ID NO: 392206 - protein, 9 aa, Homo Sapiens
QCGETYRRL

SEQ ID NO: 392207 - protein, 9 aa, Homo Sapiens
GSWEPLCAT

SEQ ID NO: 392208 - protein, 9 aa, Homo Sapiens
SAQNVFHTN

SEQ ID NO: 392209 - protein, 9 aa, Homo Sapiens
APSGPGKSA

SEQ ID NO: 392210 - protein, 9 aa, Homo Sapiens
APAPGCSQR

SEQ ID NO: 392211 - protein, 9 aa, Homo Sapiens
VVKFFLQLQ

SEQ ID NO: 392212 - protein, 9 aa, Homo Sapiens
KGPSANVYK

SEQ ID NO: 392213 - protein, 9 aa, Homo Sapiens
LKKISGRSR

SEQ ID NO: 392214 - protein, 9 aa, Homo Sapiens
ITLYNRTKR

SEQ ID NO: 392215 - protein, 9 aa, Homo Sapiens
GPQDHLTGL

SEQ ID NO: 392216 - protein, 9 aa, Homo Sapiens
APVPSLSLV

SEQ ID NO: 392217 - protein, 9 aa, Homo Sapiens
REVTDHMLS

SEQ ID NO: 392218 - protein, 9 aa, Homo Sapiens
TTSNRHWRQ

SEQ ID NO: 392219 - protein, 9 aa, Homo Sapiens
VVEEDVENT

SEQ ID NO: 392220 - protein, 9 aa, Homo Sapiens
IRWMPPESV

SEQ ID NO: 392221 - protein, 9 aa, Homo Sapiens
ATPLHSVLS

SEQ ID NO: 392222 - protein, 9 aa, Homo Sapiens
SGSWEIAGS

SEQ ID NO: 392223 - protein, 9 aa, Homo Sapiens
HYFRSPLPT

SEQ ID NO: 392224 - protein, 9 aa, Homo Sapiens
DTVRRKNVP

SEQ ID NO: 392225 - protein, 9 aa, Homo Sapiens
KVARMSLTK

SEQ ID NO: 392226 - protein, 9 aa, Homo Sapiens
NGCISIILR

SEQ ID NO: 392227 - protein, 9 aa, Homo Sapiens
RKAHAEHQA

SEQ ID NO: 392228 - protein, 9 aa, Homo Sapiens
CCAPVPSLS

SEQ ID NO: 392229 - protein, 9 aa, Homo Sapiens
DTEHENKSN

SEQ ID NO: 392230 - protein, 9 aa, Homo Sapiens
RKKPLQMVL

SEQ ID NO: 392231 - protein, 9 aa, Homo Sapiens
GPTPQPSHS

SEQ ID NO: 392232 - protein, 9 aa, Homo Sapiens
VPSLSLVCT

SEQ ID NO: 392233 - protein, 9 aa, Homo Sapiens
GTAGVGTTL

SEQ ID NO: 392234 - protein, 9 aa, Homo Sapiens
LIQSVMASS

SEQ ID NO: 392235 - protein, 9 aa, Homo Sapiens
NFHLLTKYC

SEQ ID NO: 392236 - protein, 9 aa, Homo Sapiens
EKEENKQQE

SEQ ID NO: 392237 - protein, 9 aa, Homo Sapiens
RTFKGNTQK

SEQ ID NO: 392238 - protein, 9 aa, Homo Sapiens
LAWARAHLA

SEQ ID NO: 392239 - protein, 9 aa, Homo Sapiens
HSGCIKVDW

SEQ ID NO: 392240 - protein, 9 aa, Homo Sapiens
FPGGRGGGR

SEQ ID NO: 392241 - protein, 9 aa, Homo Sapiens
IDKDKDNVA

SEQ ID NO: 392242 - protein, 9 aa, Homo Sapiens
MMEAFATRC

SEQ ID NO: 392243 - protein, 9 aa, Homo Sapiens
MCNDVSVKL

SEQ ID NO: 392244 - protein, 9 aa, Homo Sapiens
NHPQHTTLL

SEQ ID NO: 392245 - protein, 9 aa, Homo Sapiens
LPLPPTQPP

SEQ ID NO: 392246 - protein, 9 aa, Homo Sapiens
RTSGSQCTS

SEQ ID NO: 392247 - protein, 9 aa, Homo Sapiens
LRLHPGARR

SEQ ID NO: 392248 - protein, 9 aa, Homo Sapiens
PMGILLVRP

SEQ ID NO: 392249 - protein, 9 aa, Homo Sapiens
HVVDGDAGV

SEQ ID NO: 392250 - protein, 9 aa, Homo Sapiens
AELQDHLGP

SEQ ID NO: 392251 - protein, 9 aa, Homo Sapiens
LLHAMPSGV

SEQ ID NO: 392252 - protein, 9 aa, Homo Sapiens
DHRTSQNHS

SEQ ID NO: 392253 - protein, 9 aa, Homo Sapiens
GACCCGLSL

SEQ ID NO: 392254 - protein, 9 aa, Homo Sapiens
LPENMFQVC

SEQ ID NO: 392255 - protein, 9 aa, Homo Sapiens
THNTPDISH

SEQ ID NO: 392256 - protein, 9 aa, Homo Sapiens
GQLHPAIWV

SEQ ID NO: 392257 - protein, 9 aa, Homo Sapiens
LGLVGERSY

SEQ ID NO: 392258 - protein, 9 aa, Homo Sapiens
AVQHNGRIP

SEQ ID NO: 392259 - protein, 9 aa, Homo Sapiens
GLVGNIITL

SEQ ID NO: 392260 - protein, 9 aa, Homo Sapiens
CLKLWSLLF

SEQ ID NO: 392261 - protein, 9 aa, Homo Sapiens
RRKRWSPLT

SEQ ID NO: 392262 - protein, 9 aa, Homo Sapiens
LFARFTRGA

SEQ ID NO: 392263 - protein, 9 aa, Homo Sapiens
RNPPSPIKW

SEQ ID NO: 392264 - protein, 9 aa, Homo Sapiens
RPSATNPTW

SEQ ID NO: 392265 - protein, 9 aa, Homo Sapiens
LEETIANLG

SEQ ID NO: 392266 - protein, 9 aa, Homo Sapiens
TSSAGAGAG

SEQ ID NO: 392267 - protein, 9 aa, Homo Sapiens
LHVAPRYHL

SEQ ID NO: 392268 - protein, 9 aa, Homo Sapiens
GVRQMHSNT

SEQ ID NO: 392269 - protein, 9 aa, Homo Sapiens
CQKLPEKTE

SEQ ID NO: 392270 - protein, 9 aa, Homo Sapiens
SKNQIKLHT

SEQ ID NO: 392271 - protein, 9 aa, Homo Sapiens
RILPLEQLG

SEQ ID NO: 392272 - protein, 9 aa, Homo Sapiens
VPSSHLPPQ

SEQ ID NO: 392273 - protein, 9 aa, Homo Sapiens
NGAIAFVLL

SEQ ID NO: 392274 - protein, 9 aa, Homo Sapiens
RPWRIQSLP

SEQ ID NO: 392275 - protein, 9 aa, Homo Sapiens
VTLYASVAL

SEQ ID NO: 392276 - protein, 9 aa, Homo Sapiens
VVLKPPGLV

SEQ ID NO: 392277 - protein, 9 aa, Homo Sapiens
APFDMIAEI

SEQ ID NO: 392278 - protein, 9 aa, Homo Sapiens
GGLFLLQMA

SEQ ID NO: 392279 - protein, 9 aa, Homo Sapiens
LRGDPGVIK

SEQ ID NO: 392280 - protein, 9 aa, Homo Sapiens
NECTNFTTN

SEQ ID NO: 392281 - protein, 9 aa, Homo Sapiens
EEEKDKPVT

SEQ ID NO: 392282 - protein, 9 aa, Homo Sapiens
HVIFSGSLD

SEQ ID NO: 392283 - protein, 9 aa, Homo Sapiens
MSLAALQVG

SEQ ID NO: 392284 - protein, 9 aa, Homo Sapiens
STRGASKAS

SEQ ID NO: 392285 - protein, 9 aa, Homo Sapiens
PSFSAPCCW

SEQ ID NO: 392286 - protein, 9 aa, Homo Sapiens
LSKKKYFPL

SEQ ID NO: 392287 - protein, 9 aa, Homo Sapiens
VCAASERLN

SEQ ID NO: 392288 - protein, 9 aa, Homo Sapiens
KEPEPMWLA

SEQ ID NO: 392289 - protein, 9 aa, Homo Sapiens
NQHQTGAPR

SEQ ID NO: 392290 - protein, 9 aa, Homo Sapiens
PPTRKPPHR

SEQ ID NO: 392291 - protein, 9 aa, Homo Sapiens
SDPDKERKS

SEQ ID NO: 392292 - protein, 9 aa, Homo Sapiens
SGATILTGG

SEQ ID NO: 392293 - protein, 9 aa, Homo Sapiens
PPSGSTPPR

SEQ ID NO: 392294 - protein, 9 aa, Homo Sapiens
FGENRTNVL

SEQ ID NO: 392295 - protein, 9 aa, Homo Sapiens
TPVDFFEFC

SEQ ID NO: 392296 - protein, 9 aa, Homo Sapiens
EAEAQVPHL

SEQ ID NO: 392297 - protein, 9 aa, Homo Sapiens
RLEESRHLW

SEQ ID NO: 392298 - protein, 9 aa, Homo Sapiens
ARPPALTVA

SEQ ID NO: 392299 - protein, 9 aa, Homo Sapiens
RAPAPGCSQ

SEQ ID NO: 392300 - protein, 9 aa, Homo Sapiens
NDNRSVFEA

SEQ ID NO: 392301 - protein, 9 aa, Homo Sapiens
KLSEVLQVV

SEQ ID NO: 392302 - protein, 9 aa, Homo Sapiens
YNISSKEQP

SEQ ID NO: 392303 - protein, 9 aa, Homo Sapiens
VHGCCQCQA

SEQ ID NO: 392304 - protein, 9 aa, Homo Sapiens
KLCNILRKC

SEQ ID NO: 392305 - protein, 9 aa, Homo Sapiens
NSGETKTIS

SEQ ID NO: 392306 - protein, 9 aa, Homo Sapiens
ISLCMYTLF

SEQ ID NO: 392307 - protein, 9 aa, Homo Sapiens
PRPGPRGGH

SEQ ID NO: 392308 - protein, 9 aa, Homo Sapiens
SLTRQATGP

SEQ ID NO: 392309 - protein, 9 aa, Homo Sapiens
RSPLPTTSK

SEQ ID NO: 392310 - protein, 9 aa, Homo Sapiens
RPFFDLLKK

SEQ ID NO: 392311 - protein, 9 aa, Homo Sapiens
MGSCLLDFA

SEQ ID NO: 392312 - protein, 9 aa, Homo Sapiens
VSIEGSVDE

SEQ ID NO: 392313 - protein, 9 aa, Homo Sapiens
ANVISSKRT

SEQ ID NO: 392314 - protein, 9 aa, Homo Sapiens
GHLHLVQVD

SEQ ID NO: 392315 - protein, 9 aa, Homo Sapiens
EFCSSYTMR

SEQ ID NO: 392316 - protein, 9 aa, Homo Sapiens
LASGTSRAR

SEQ ID NO: 392317 - protein, 9 aa, Homo Sapiens
KKEEGKEQE

SEQ ID NO: 392318 - protein, 9 aa, Homo Sapiens
QVLKYMVPR

SEQ ID NO: 392319 - protein, 9 aa, Homo Sapiens
KFPGGRGGG

SEQ ID NO: 392320 - protein, 9 aa, Homo Sapiens
RSHTFRNKL

SEQ ID NO: 392321 - protein, 9 aa, Homo Sapiens
TLGTRRAAG

SEQ ID NO: 392322 - protein, 9 aa, Homo Sapiens
ETAFSGGGG

SEQ ID NO: 392323 - protein, 9 aa, Homo Sapiens
RSTSNTRST

SEQ ID NO: 392324 - protein, 9 aa, Homo Sapiens
APSSFTRTQ

SEQ ID NO: 392325 - protein, 9 aa, Homo Sapiens
PPRGWRSRC

SEQ ID NO: 392326 - protein, 9 aa, Homo Sapiens
HVVLEVVVV

SEQ ID NO: 392327 - protein, 9 aa, Homo Sapiens
NSETKSIFA

SEQ ID NO: 392328 - protein, 9 aa, Homo Sapiens
ALNQRHGPD

SEQ ID NO: 392329 - protein, 9 aa, Homo Sapiens
SSNTLRPGS

SEQ ID NO: 392330 - protein, 9 aa, Homo Sapiens
PPRRLRVTR

SEQ ID NO: 392331 - protein, 9 aa, Homo Sapiens
EVLHQSTYQ

SEQ ID NO: 392332 - protein, 9 aa, Homo Sapiens
AATQTQMPG

SEQ ID NO: 392333 - protein, 9 aa, Homo Sapiens
PKDLPLHFD

SEQ ID NO: 392334 - protein, 9 aa, Homo Sapiens
RAQQVLFMM

SEQ ID NO: 392335 - protein, 9 aa, Homo Sapiens
WKRGRTAPA

SEQ ID NO: 392336 - protein, 9 aa, Homo Sapiens
LAPATPPFG

SEQ ID NO: 392337 - protein, 9 aa, Homo Sapiens
LGTRQTSFT

SEQ ID NO: 392338 - protein, 9 aa, Homo Sapiens
DVNDNRSVF

SEQ ID NO: 392339 - protein, 9 aa, Homo Sapiens
PEEEEVSSG

SEQ ID NO: 392340 - protein, 9 aa, Homo Sapiens
SMDGSMHTV

SEQ ID NO: 392341 - protein, 9 aa, Homo Sapiens
CADNQLLDK

SEQ ID NO: 392342 - protein, 9 aa, Homo Sapiens
PPTCSPPAS

SEQ ID NO: 392343 - protein, 9 aa, Homo Sapiens
ALIHVISKL

SEQ ID NO: 392344 - protein, 9 aa, Homo Sapiens
WAFEQVEEL

SEQ ID NO: 392345 - protein, 9 aa, Homo Sapiens
SWEPIHANP

SEQ ID NO: 392346 - protein, 9 aa, Homo Sapiens
WLLPGMGPH

SEQ ID NO: 392347 - protein, 9 aa, Homo Sapiens
QMLIIEKVL

SEQ ID NO: 392348 - protein, 9 aa, Homo Sapiens
QCYNPVTDV

SEQ ID NO: 392349 - protein, 9 aa, Homo Sapiens
LDDVSAPRL

SEQ ID NO: 392350 - protein, 9 aa, Homo Sapiens
IRWLRVIRD

SEQ ID NO: 392351 - protein, 9 aa, Homo Sapiens
IFMEENFSL

SEQ ID NO: 392352 - protein, 9 aa, Homo Sapiens
STRSANWNA

SEQ ID NO: 392353 - protein, 9 aa, Homo Sapiens
KMQSRMDQW

SEQ ID NO: 392354 - protein, 9 aa, Homo Sapiens
ITECVRTAL

SEQ ID NO: 392355 - protein, 9 aa, Homo Sapiens
HNTPDISHI

SEQ ID NO: 392356 - protein, 9 aa, Homo Sapiens
EVLQVVTDH

SEQ ID NO: 392357 - protein, 9 aa, Homo Sapiens
WLWAAVERF

SEQ ID NO: 392358 - protein, 9 aa, Homo Sapiens
SLCMYTLFL

SEQ ID NO: 392359 - protein, 9 aa, Homo Sapiens
STRASGPTP

SEQ ID NO: 392360 - protein, 9 aa, Homo Sapiens
RKSVLGALG

SEQ ID NO: 392361 - protein, 9 aa, Homo Sapiens
RTWWRTRAC

SEQ ID NO: 392362 - protein, 9 aa, Homo Sapiens
ELVIGHYYV

SEQ ID NO: 392363 - protein, 9 aa, Homo Sapiens
RLERDQPCS

SEQ ID NO: 392364 - protein, 9 aa, Homo Sapiens
ASCGPTSGS

SEQ ID NO: 392365 - protein, 9 aa, Homo Sapiens
KNSILNPVA

SEQ ID NO: 392366 - protein, 9 aa, Homo Sapiens
YDATLVILK

SEQ ID NO: 392367 - protein, 9 aa, Homo Sapiens
RGHTKLEFP

SEQ ID NO: 392368 - protein, 9 aa, Homo Sapiens
CLLWSICFA

SEQ ID NO: 392369 - protein, 9 aa, Homo Sapiens
LLRSFFRRC

SEQ ID NO: 392370 - protein, 9 aa, Homo Sapiens
RHHPPCWSP

SEQ ID NO: 392371 - protein, 9 aa, Homo Sapiens
IPGGYSGPS

SEQ ID NO: 392372 - protein, 9 aa, Homo Sapiens
VRAREALVA

SEQ ID NO: 392373 - protein, 9 aa, Homo Sapiens
PASTCWPRT

SEQ ID NO: 392374 - protein, 9 aa, Homo Sapiens
ETVTRRMLF

SEQ ID NO: 392375 - protein, 9 aa, Homo Sapiens
RQLLISWRM

SEQ ID NO: 392376 - protein, 9 aa, Homo Sapiens
DHCQQDVES

SEQ ID NO: 392377 - protein, 9 aa, Homo Sapiens
LDFLTNKIA

SEQ ID NO: 392378 - protein, 9 aa, Homo Sapiens
IYLCPKNKL

SEQ ID NO: 392379 - protein, 9 aa, Homo Sapiens
YDGEVCAAS

SEQ ID NO: 392380 - protein, 9 aa, Homo Sapiens
TSGKGFVAS

SEQ ID NO: 392381 - protein, 9 aa, Homo Sapiens
AAKQAEKEV

SEQ ID NO: 392382 - protein, 9 aa, Homo Sapiens
GSTSSTIIS

SEQ ID NO: 392383 - protein, 9 aa, Homo Sapiens
LSWRGASFI

SEQ ID NO: 392384 - protein, 9 aa, Homo Sapiens
SAVRKNSTY

SEQ ID NO: 392385 - protein, 9 aa, Homo Sapiens
LSNILGVQK

SEQ ID NO: 392386 - protein, 9 aa, Homo Sapiens
WRKSGSGSG

SEQ ID NO: 392387 - protein, 9 aa, Homo Sapiens
LPPTQPPRG

SEQ ID NO: 392388 - protein, 9 aa, Homo Sapiens
ASECHASIV

SEQ ID NO: 392389 - protein, 9 aa, Homo Sapiens
PGPPCSICS

SEQ ID NO: 392390 - protein, 9 aa, Homo Sapiens
EAAHRGLAG

SEQ ID NO: 392391 - protein, 9 aa, Homo Sapiens
SWPTRRSTM

SEQ ID NO: 392392 - protein, 9 aa, Homo Sapiens
NSFLCFFYL

SEQ ID NO: 392393 - protein, 9 aa, Homo Sapiens
STSRARGAR

SEQ ID NO: 392394 - protein, 9 aa, Homo Sapiens
VRPSCSMSR

SEQ ID NO: 392395 - protein, 9 aa, Homo Sapiens
REVALVHVT

SEQ ID NO: 392396 - protein, 9 aa, Homo Sapiens
LWCEKLSTV

SEQ ID NO: 392397 - protein, 9 aa, Homo Sapiens
GTRRSSNKP

SEQ ID NO: 392398 - protein, 9 aa, Homo Sapiens
STIFQMLII

SEQ ID NO: 392399 - protein, 9 aa, Homo Sapiens
LPLPLPPHK

SEQ ID NO: 392400 - protein, 9 aa, Homo Sapiens
ARRFISWLQ

SEQ ID NO: 392401 - protein, 9 aa, Homo Sapiens
DLADGAHVW

SEQ ID NO: 392402 - protein, 9 aa, Homo Sapiens
PTGRPLCHH

SEQ ID NO: 392403 - protein, 9 aa, Homo Sapiens
TVLKASDAV

SEQ ID NO: 392404 - protein, 9 aa, Homo Sapiens
ATWCLGPAA

SEQ ID NO: 392405 - protein, 9 aa, Homo Sapiens
DTRQRRMDA

SEQ ID NO: 392406 - protein, 9 aa, Homo Sapiens
KASHVDLET

SEQ ID NO: 392407 - protein, 9 aa, Homo Sapiens
TGRKKRAPH

SEQ ID NO: 392408 - protein, 9 aa, Homo Sapiens
ASGPTPVPT

SEQ ID NO: 392409 - protein, 9 aa, Homo Sapiens
CLLRAVPWR

SEQ ID NO: 392410 - protein, 9 aa, Homo Sapiens
TDLFPVLST

SEQ ID NO: 392411 - protein, 9 aa, Homo Sapiens
SVKDHRTSQ

SEQ ID NO: 392412 - protein, 9 aa, Homo Sapiens
ILNLQVLKK

SEQ ID NO: 392413 - protein, 9 aa, Homo Sapiens
ALAPGTSET

SEQ ID NO: 392414 - protein, 9 aa, Homo Sapiens
VGPRPAPRR

SEQ ID NO: 392415 - protein, 9 aa, Homo Sapiens
AAGRLQGGG

SEQ ID NO: 392416 - protein, 9 aa, Homo Sapiens
LAHLIHRAH

SEQ ID NO: 392417 - protein, 9 aa, Homo Sapiens
KNTFRKNPD

SEQ ID NO: 392418 - protein, 9 aa, Homo Sapiens
LDYLVDPVT

SEQ ID NO: 392419 - protein, 9 aa, Homo Sapiens
NCIGQQFAT

SEQ ID NO: 392420 - protein, 9 aa, Homo Sapiens
RVDAHVVLE

SEQ ID NO: 392421 - protein, 9 aa, Homo Sapiens
HLLYPGIVT

SEQ ID NO: 392422 - protein, 9 aa, Homo Sapiens
GDPSPRKKP

SEQ ID NO: 392423 - protein, 9 aa, Homo Sapiens
IHQPCGKQD

SEQ ID NO: 392424 - protein, 9 aa, Homo Sapiens
KRAPHLQPP

SEQ ID NO: 392425 - protein, 9 aa, Homo Sapiens
GSWTSCGSR

SEQ ID NO: 392426 - protein, 9 aa, Homo Sapiens
VLPGGAEES

SEQ ID NO: 392427 - protein, 9 aa, Homo Sapiens
ACGARVFAQ

SEQ ID NO: 392428 - protein, 9 aa, Homo Sapiens
SSSVVEEDV

SEQ ID NO: 392429 - protein, 9 aa, Homo Sapiens
AGTGKLSHW

SEQ ID NO: 392430 - protein, 9 aa, Homo Sapiens
CGLEEQVST

SEQ ID NO: 392431 - protein, 9 aa, Homo Sapiens
PRPRRQPPH

SEQ ID NO: 392432 - protein, 9 aa, Homo Sapiens
SAGRTSARR

SEQ ID NO: 392433 - protein, 9 aa, Homo Sapiens
SVISTLGAD

SEQ ID NO: 392434 - protein, 9 aa, Homo Sapiens
TDLLQAVQH

SEQ ID NO: 392435 - protein, 9 aa, Homo Sapiens
LVKRMLAQQ

SEQ ID NO: 392436 - protein, 9 aa, Homo Sapiens
GALGSGGAT

SEQ ID NO: 392437 - protein, 9 aa, Homo Sapiens
DLDFLTNKI

SEQ ID NO: 392438 - protein, 9 aa, Homo Sapiens
EEDVENTVD

SEQ ID NO: 392439 - protein, 9 aa, Homo Sapiens
SGKGFVASP

SEQ ID NO: 392440 - protein, 9 aa, Homo Sapiens
EADREEDEG

SEQ ID NO: 392441 - protein, 9 aa, Homo Sapiens
VVILKKFSA

SEQ ID NO: 392442 - protein, 9 aa, Homo Sapiens
EEASQVGGT

SEQ ID NO: 392443 - protein, 9 aa, Homo Sapiens
KKKKKKIGL

SEQ ID NO: 392444 - protein, 9 aa, Homo Sapiens
RGSSQSRGA

SEQ ID NO: 392445 - protein, 9 aa, Homo Sapiens
TPRAGRVAL

SEQ ID NO: 392446 - protein, 9 aa, Homo Sapiens
TFQAPFLPR

SEQ ID NO: 392447 - protein, 9 aa, Homo Sapiens
AACITDLIT

SEQ ID NO: 392448 - protein, 9 aa, Homo Sapiens
WEVMPRTLE

SEQ ID NO: 392449 - protein, 9 aa, Homo Sapiens
TGFLQVPQG

SEQ ID NO: 392450 - protein, 9 aa, Homo Sapiens
GIGVGNGPT

SEQ ID NO: 392451 - protein, 9 aa, Homo Sapiens
QVILMYIFQ

SEQ ID NO: 392452 - protein, 9 aa, Homo Sapiens
YMPPEGQLT

SEQ ID NO: 392453 - protein, 9 aa, Homo Sapiens
PMREDESEV

SEQ ID NO: 392454 - protein, 9 aa, Homo Sapiens
KLTHLPQYY

SEQ ID NO: 392455 - protein, 9 aa, Homo Sapiens
ILWHPHHQL

SEQ ID NO: 392456 - protein, 9 aa, Homo Sapiens
KQFLISPHS

SEQ ID NO: 392457 - protein, 9 aa, Homo Sapiens
HRDNLVVVE

SEQ ID NO: 392458 - protein, 9 aa, Homo Sapiens
VVFYHDGEI

SEQ ID NO: 392459 - protein, 9 aa, Homo Sapiens
VLDQDTDTI

SEQ ID NO: 392460 - protein, 9 aa, Homo Sapiens
CAGTAFYID

SEQ ID NO: 392461 - protein, 9 aa, Homo Sapiens
RKAAGRLQG

SEQ ID NO: 392462 - protein, 9 aa, Homo Sapiens
LTCESDVNP

SEQ ID NO: 392463 - protein, 9 aa, Homo Sapiens
QPWKRGRTA

SEQ ID NO: 392464 - protein, 9 aa, Homo Sapiens
AVQVVRARE

SEQ ID NO: 392465 - protein, 9 aa, Homo Sapiens
HMAASECHA

SEQ ID NO: 392466 - protein, 9 aa, Homo Sapiens
LKFKLALKR

SEQ ID NO: 392467 - protein, 9 aa, Homo Sapiens
TRTSSRASL

SEQ ID NO: 392468 - protein, 9 aa, Homo Sapiens
SQSSTSILS

SEQ ID NO: 392469 - protein, 9 aa, Homo Sapiens
INSALLVST

SEQ ID NO: 392470 - protein, 9 aa, Homo Sapiens
APSSICRGN

SEQ ID NO: 392471 - protein, 9 aa, Homo Sapiens
RGSFLASRA

SEQ ID NO: 392472 - protein, 9 aa, Homo Sapiens
DHYFRSPLP

SEQ ID NO: 392473 - protein, 9 aa, Homo Sapiens
METKQNVIS

SEQ ID NO: 392474 - protein, 9 aa, Homo Sapiens
QDCRGRHWR

SEQ ID NO: 392475 - protein, 9 aa, Homo Sapiens
ARSTSRARG

SEQ ID NO: 392476 - protein, 9 aa, Homo Sapiens
APLKFKLAL

SEQ ID NO: 392477 - protein, 9 aa, Homo Sapiens
TASRGGSWP

SEQ ID NO: 392478 - protein, 9 aa, Homo Sapiens
KKKHEGQIC

SEQ ID NO: 392479 - protein, 9 aa, Homo Sapiens
PAAAQLFSP

SEQ ID NO: 392480 - protein, 9 aa, Homo Sapiens
FLCFFYLLY

SEQ ID NO: 392481 - protein, 9 aa, Homo Sapiens
LLRLQSLLS

SEQ ID NO: 392482 - protein, 9 aa, Homo Sapiens
EEAPMREDE

SEQ ID NO: 392483 - protein, 9 aa, Homo Sapiens
SPSRRPLGV

SEQ ID NO: 392484 - protein, 9 aa, Homo Sapiens
KGENKILFC

SEQ ID NO: 392485 - protein, 9 aa, Homo Sapiens
SAINSIRRH

SEQ ID NO: 392486 - protein, 9 aa, Homo Sapiens
LDVCDRKDR

SEQ ID NO: 392487 - protein, 9 aa, Homo Sapiens
RHTTTPSSG

SEQ ID NO: 392488 - protein, 9 aa, Homo Sapiens
LKPLCVYSE

SEQ ID NO: 392489 - protein, 9 aa, Homo Sapiens
PHCVASRRR

SEQ ID NO: 392490 - protein, 9 aa, Homo Sapiens
PVGLAGDIQ

SEQ ID NO: 392491 - protein, 9 aa, Homo Sapiens
PSTAATTAA

SEQ ID NO: 392492 - protein, 9 aa, Homo Sapiens
ITAFKMEKV

SEQ ID NO: 392493 - protein, 9 aa, Homo Sapiens
RSFGASRAR

SEQ ID NO: 392494 - protein, 9 aa, Homo Sapiens
SDLDQSFSF

SEQ ID NO: 392495 - protein, 9 aa, Homo Sapiens
GSLKKTSRI

SEQ ID NO: 392496 - protein, 9 aa, Homo Sapiens
TRAPPRPRC

SEQ ID NO: 392497 - protein, 9 aa, Homo Sapiens
SSRRLHHGT

SEQ ID NO: 392498 - protein, 9 aa, Homo Sapiens
LAVSTRGAS

SEQ ID NO: 392499 - protein, 9 aa, Homo Sapiens
LGPSFHSHL

SEQ ID NO: 392500 - protein, 9 aa, Homo Sapiens
HKKKHWEKE

SEQ ID NO: 392501 - protein, 9 aa, Homo Sapiens
LGVSPLAPC

SEQ ID NO: 392502 - protein, 9 aa, Homo Sapiens
IVEFAKRLS

SEQ ID NO: 392503 - protein, 9 aa, Homo Sapiens
TLHNQEVKT

SEQ ID NO: 392504 - protein, 9 aa, Homo Sapiens
CHSRIHTGE

SEQ ID NO: 392505 - protein, 9 aa, Homo Sapiens
HGMPDLLEG

SEQ ID NO: 392506 - protein, 9 aa, Homo Sapiens
DLDVCDRKD

SEQ ID NO: 392507 - protein, 9 aa, Homo Sapiens
WDPDKATRF

SEQ ID NO: 392508 - protein, 9 aa, Homo Sapiens
SVSSCNRAS

SEQ ID NO: 392509 - protein, 9 aa, Homo Sapiens
FPSAKKTCS

SEQ ID NO: 392510 - protein, 9 aa, Homo Sapiens
CDTDFLCPS

SEQ ID NO: 392511 - protein, 9 aa, Homo Sapiens
ARRTSGAGG

SEQ ID NO: 392512 - protein, 9 aa, Homo Sapiens
TIGTFSTRL

SEQ ID NO: 392513 - protein, 9 aa, Homo Sapiens
MLVKFLLYK

SEQ ID NO: 392514 - protein, 9 aa, Homo Sapiens
FSFLFLFLP

SEQ ID NO: 392515 - protein, 9 aa, Homo Sapiens
RAKEKELCT

SEQ ID NO: 392516 - protein, 9 aa, Homo Sapiens
APATPPFGL

SEQ ID NO: 392517 - protein, 9 aa, Homo Sapiens
SVMASSADA

SEQ ID NO: 392518 - protein, 9 aa, Homo Sapiens
SGPSFSPWQ

SEQ ID NO: 392519 - protein, 9 aa, Homo Sapiens
GTPGGFSKV

SEQ ID NO: 392520 - protein, 9 aa, Homo Sapiens
AKIVLMNSV

SEQ ID NO: 392521 - protein, 9 aa, Homo Sapiens
KDSAVASTE

SEQ ID NO: 392522 - protein, 9 aa, Homo Sapiens
QASSGSPHI

SEQ ID NO: 392523 - protein, 9 aa, Homo Sapiens
QELNEKCNK

SEQ ID NO: 392524 - protein, 9 aa, Homo Sapiens
QPGVRALGK

SEQ ID NO: 392525 - protein, 9 aa, Homo Sapiens
VNFDILERE

SEQ ID NO: 392526 - protein, 9 aa, Homo Sapiens
RRMDARYQT

SEQ ID NO: 392527 - protein, 9 aa, Homo Sapiens
RPMSPSPVS

SEQ ID NO: 392528 - protein, 9 aa, Homo Sapiens
QKHPENDLD

SEQ ID NO: 392529 - protein, 9 aa, Homo Sapiens
YSENKAFIS

SEQ ID NO: 392530 - protein, 9 aa, Homo Sapiens
NARSPPAAV

SEQ ID NO: 392531 - protein, 9 aa, Homo Sapiens
CIGQQFATS

SEQ ID NO: 392532 - protein, 9 aa, Homo Sapiens
CPEETAMRR

SEQ ID NO: 392533 - protein, 9 aa, Homo Sapiens
RHLMSFLAM

SEQ ID NO: 392534 - protein, 9 aa, Homo Sapiens
RGWAGCLQP

SEQ ID NO: 392535 - protein, 9 aa, Homo Sapiens
GVRAPEVAR

SEQ ID NO: 392536 - protein, 9 aa, Homo Sapiens
PGFTSDYCE

SEQ ID NO: 392537 - protein, 9 aa, Homo Sapiens
GKRHLTGIG

SEQ ID NO: 392538 - protein, 9 aa, Homo Sapiens
DEMHTLLHL

SEQ ID NO: 392539 - protein, 9 aa, Homo Sapiens
SLGKDATSP

SEQ ID NO: 392540 - protein, 9 aa, Homo Sapiens
NAHVIFSGS

SEQ ID NO: 392541 - protein, 9 aa, Homo Sapiens
RSRLAAASG

SEQ ID NO: 392542 - protein, 9 aa, Homo Sapiens
EVTASSHHY

SEQ ID NO: 392543 - protein, 9 aa, Homo Sapiens
FPHPPKRIR

SEQ ID NO: 392544 - protein, 9 aa, Homo Sapiens
FLKNLSWLS

SEQ ID NO: 392545 - protein, 9 aa, Homo Sapiens
EQEKKCRLF

SEQ ID NO: 392546 - protein, 9 aa, Homo Sapiens
KVPIDTSDV

SEQ ID NO: 392547 - protein, 9 aa, Homo Sapiens
LGPAARPQP

SEQ ID NO: 392548 - protein, 9 aa, Homo Sapiens
QDGCNDGSV

SEQ ID NO: 392549 - protein, 9 aa, Homo Sapiens
EKHEKDLDF

SEQ ID NO: 392550 - protein, 9 aa, Homo Sapiens
TSAVSIQQT

SEQ ID NO: 392551 - protein, 9 aa, Homo Sapiens
SGNRSTGCY

SEQ ID NO: 392552 - protein, 9 aa, Homo Sapiens
RLDVNRLSD

SEQ ID NO: 392553 - protein, 9 aa, Homo Sapiens
QIQSQSSTS

SEQ ID NO: 392554 - protein, 9 aa, Homo Sapiens
QQQCQPPTA

SEQ ID NO: 392555 - protein, 9 aa, Homo Sapiens
SAEVTKMSC

SEQ ID NO: 392556 - protein, 9 aa, Homo Sapiens
TFRGAHLRG

SEQ ID NO: 392557 - protein, 9 aa, Homo Sapiens
EPEVLQDPL

SEQ ID NO: 392558 - protein, 9 aa, Homo Sapiens
ERKAAGRLQ

SEQ ID NO: 392559 - protein, 9 aa, Homo Sapiens
SKGKMRQLG

SEQ ID NO: 392560 - protein, 9 aa, Homo Sapiens
YAFVMYCHT

SEQ ID NO: 392561 - protein, 9 aa, Homo Sapiens
LVVDMGHGV

SEQ ID NO: 392562 - protein, 9 aa, Homo Sapiens
SDTLYKVPL

SEQ ID NO: 392563 - protein, 9 aa, Homo Sapiens
RHLWKFFWE

SEQ ID NO: 392564 - protein, 9 aa, Homo Sapiens
WEPLHFSKF

SEQ ID NO: 392565 - protein, 9 aa, Homo Sapiens
FFHAYYYYF

SEQ ID NO: 392566 - protein, 9 aa, Homo Sapiens
REKNTNQRL

SEQ ID NO: 392567 - protein, 9 aa, Homo Sapiens
IPWNLERTT

SEQ ID NO: 392568 - protein, 9 aa, Homo Sapiens
LTSRSLWCP

SEQ ID NO: 392569 - protein, 9 aa, Homo Sapiens
LPLPPHKPP

SEQ ID NO: 392570 - protein, 9 aa, Homo Sapiens
VRALGKWLQ

SEQ ID NO: 392571 - protein, 9 aa, Homo Sapiens
QHQLTPRLR

SEQ ID NO: 392572 - protein, 9 aa, Homo Sapiens
LCVGNITSV

SEQ ID NO: 392573 - protein, 9 aa, Homo Sapiens
RFACFTWRT

SEQ ID NO: 392574 - protein, 9 aa, Homo Sapiens
FFFCLRGHP

SEQ ID NO: 392575 - protein, 9 aa, Homo Sapiens
WQRVMLKEI

SEQ ID NO: 392576 - protein, 9 aa, Homo Sapiens
YSPSPNPIS

SEQ ID NO: 392577 - protein, 9 aa, Homo Sapiens
QFHARQPSV

SEQ ID NO: 392578 - protein, 9 aa, Homo Sapiens
LWVTASIIA

SEQ ID NO: 392579 - protein, 9 aa, Homo Sapiens
QRVKEQSHV

SEQ ID NO: 392580 - protein, 9 aa, Homo Sapiens
TVVVLRLDG

SEQ ID NO: 392581 - protein, 9 aa, Homo Sapiens
RGTFGTRSP

SEQ ID NO: 392582 - protein, 9 aa, Homo Sapiens
FDTWAKVAY

SEQ ID NO: 392583 - protein, 9 aa, Homo Sapiens
LTRRQSEKR

SEQ ID NO: 392584 - protein, 9 aa, Homo Sapiens
EEGRASQDG

SEQ ID NO: 392585 - protein, 9 aa, Homo Sapiens
NPLPSFSHR

SEQ ID NO: 392586 - protein, 9 aa, Homo Sapiens
RARGARLTT

SEQ ID NO: 392587 - protein, 9 aa, Homo Sapiens
SDSWHVDAC

SEQ ID NO: 392588 - protein, 9 aa, Homo Sapiens
KWEKECEHR

SEQ ID NO: 392589 - protein, 9 aa, Homo Sapiens
STPARSPTS

SEQ ID NO: 392590 - protein, 9 aa, Homo Sapiens
SLYKKKKPK

SEQ ID NO: 392591 - protein, 9 aa, Homo Sapiens
AWNGFSNLV

SEQ ID NO: 392592 - protein, 9 aa, Homo Sapiens
PGGAEESAK

SEQ ID NO: 392593 - protein, 9 aa, Homo Sapiens
QQIYPPIHA

SEQ ID NO: 392594 - protein, 9 aa, Homo Sapiens
ATMGSDPSL

SEQ ID NO: 392595 - protein, 9 aa, Homo Sapiens
SGCIKVDWQ

SEQ ID NO: 392596 - protein, 9 aa, Homo Sapiens
ARGSGNTSL

SEQ ID NO: 392597 - protein, 9 aa, Homo Sapiens
GRRGLRTRP

SEQ ID NO: 392598 - protein, 9 aa, Homo Sapiens
ISIYCRYRG

SEQ ID NO: 392599 - protein, 9 aa, Homo Sapiens
CRYRGINSI

SEQ ID NO: 392600 - protein, 9 aa, Homo Sapiens
QTQLCLRIQ

SEQ ID NO: 392601 - protein, 9 aa, Homo Sapiens
FRKSGVKSQ

SEQ ID NO: 392602 - protein, 9 aa, Homo Sapiens
GLSWEPIHA

SEQ ID NO: 392603 - protein, 9 aa, Homo Sapiens
RTHPHKEIL

SEQ ID NO: 392604 - protein, 9 aa, Homo Sapiens
GPQTNPGPA

SEQ ID NO: 392605 - protein, 9 aa, Homo Sapiens
TPVEGSPDR

SEQ ID NO: 392606 - protein, 9 aa, Homo Sapiens
WGRCLLLWP

SEQ ID NO: 392607 - protein, 9 aa, Homo Sapiens
WVNLIGREM

SEQ ID NO: 392608 - protein, 9 aa, Homo Sapiens
SWITPELRL

SEQ ID NO: 392609 - protein, 9 aa, Homo Sapiens
AAQLFSPAL

SEQ ID NO: 392610 - protein, 9 aa, Homo Sapiens
LFLILYMLS

SEQ ID NO: 392611 - protein, 9 aa, Homo Sapiens
KLVVTNMIA

SEQ ID NO: 392612 - protein, 9 aa, Homo Sapiens
SCVPTAARP

SEQ ID NO: 392613 - protein, 9 aa, Homo Sapiens
RSSNKPLRG

SEQ ID NO: 392614 - protein, 9 aa, Homo Sapiens
RHLTGIGSD

SEQ ID NO: 392615 - protein, 9 aa, Homo Sapiens
KRKMTNDGP

SEQ ID NO: 392616 - protein, 9 aa, Homo Sapiens
WRWGWGQLL

SEQ ID NO: 392617 - protein, 9 aa, Homo Sapiens
PGNFCTFFC

SEQ ID NO: 392618 - protein, 9 aa, Homo Sapiens
TPQDSRQVL

SEQ ID NO: 392619 - protein, 9 aa, Homo Sapiens
TRGTTFTTC

SEQ ID NO: 392620 - protein, 9 aa, Homo Sapiens
EYNVKGSFY

SEQ ID NO: 392621 - protein, 9 aa, Homo Sapiens
RRPLRRLPA

SEQ ID NO: 392622 - protein, 9 aa, Homo Sapiens
QFHNQRHML

SEQ ID NO: 392623 - protein, 9 aa, Homo Sapiens
SASCGPTSG

SEQ ID NO: 392624 - protein, 9 aa, Homo Sapiens
TRHLMSFLA

SEQ ID NO: 392625 - protein, 9 aa, Homo Sapiens
NGLRTELVT

SEQ ID NO: 392626 - protein, 9 aa, Homo Sapiens
RARGSRATS

SEQ ID NO: 392627 - protein, 9 aa, Homo Sapiens
RFRDLDVCD

SEQ ID NO: 392628 - protein, 9 aa, Homo Sapiens
GQVPMQERP

SEQ ID NO: 392629 - protein, 9 aa, Homo Sapiens
LVMLEIVTE

SEQ ID NO: 392630 - protein, 9 aa, Homo Sapiens
LPHVDFQLV

SEQ ID NO: 392631 - protein, 9 aa, Homo Sapiens
TGTFAAFFA

SEQ ID NO: 392632 - protein, 9 aa, Homo Sapiens
IKVIDFGSR

SEQ ID NO: 392633 - protein, 9 aa, Homo Sapiens
NFVPVAFVC

SEQ ID NO: 392634 - protein, 9 aa, Homo Sapiens
PLQVTTTLK

SEQ ID NO: 392635 - protein, 9 aa, Homo Sapiens
GRAFFISHS

SEQ ID NO: 392636 - protein, 9 aa, Homo Sapiens
KNLIPKLTG

SEQ ID NO: 392637 - protein, 9 aa, Homo Sapiens
KVIDFGSRC

SEQ ID NO: 392638 - protein, 9 aa, Homo Sapiens
REDIVCCLN

SEQ ID NO: 392639 - protein, 9 aa, Homo Sapiens
SRTRGSRGT

SEQ ID NO: 392640 - protein, 9 aa, Homo Sapiens
SFAARSTRF

SEQ ID NO: 392641 - protein, 9 aa, Homo Sapiens
AGEAEFYDP

SEQ ID NO: 392642 - protein, 9 aa, Homo Sapiens
PPSFSAPCC

SEQ ID NO: 392643 - protein, 9 aa, Homo Sapiens
NFDILEREK

SEQ ID NO: 392644 - protein, 9 aa, Homo Sapiens
QPVQIQSQS

SEQ ID NO: 392645 - protein, 9 aa, Homo Sapiens
YNTTQPSQK

SEQ ID NO: 392646 - protein, 9 aa, Homo Sapiens
DESLDLVAT

SEQ ID NO: 392647 - protein, 9 aa, Homo Sapiens
NLKRYGYAS

SEQ ID NO: 392648 - protein, 9 aa, Homo Sapiens
FKGKRHLTG

SEQ ID NO: 392649 - protein, 9 aa, Homo Sapiens
APGCSQRAP

SEQ ID NO: 392650 - protein, 9 aa, Homo Sapiens
GSSGAGLTT

SEQ ID NO: 392651 - protein, 9 aa, Homo Sapiens
SRAHLWPTR

SEQ ID NO: 392652 - protein, 9 aa, Homo Sapiens
SSSLSFLSS

SEQ ID NO: 392653 - protein, 9 aa, Homo Sapiens
PHPLSKFPG

SEQ ID NO: 392654 - protein, 9 aa, Homo Sapiens
YFDENDAED

SEQ ID NO: 392655 - protein, 9 aa, Homo Sapiens
ILIMKVNFD

SEQ ID NO: 392656 - protein, 9 aa, Homo Sapiens
SSCSADLKA

SEQ ID NO: 392657 - protein, 9 aa, Homo Sapiens
YGNSLSTLL

SEQ ID NO: 392658 - protein, 9 aa, Homo Sapiens
SRARRTNGA

SEQ ID NO: 392659 - protein, 9 aa, Homo Sapiens
ELVTYPGII

SEQ ID NO: 392660 - protein, 9 aa, Homo Sapiens
YTSRIVLLC

SEQ ID NO: 392661 - protein, 9 aa, Homo Sapiens
YVCNECDKA

SEQ ID NO: 392662 - protein, 9 aa, Homo Sapiens
IRSFQKSYK

SEQ ID NO: 392663 - protein, 9 aa, Homo Sapiens
PTGDIWQGG

SEQ ID NO: 392664 - protein, 9 aa, Homo Sapiens
EALLSTRFD

SEQ ID NO: 392665 - protein, 9 aa, Homo Sapiens
GPAAVTAPP

SEQ ID NO: 392666 - protein, 9 aa, Homo Sapiens
KWLQWPHPD

SEQ ID NO: 392667 - protein, 9 aa, Homo Sapiens
RCDQCEETI

SEQ ID NO: 392668 - protein, 9 aa, Homo Sapiens
CVFADNPTS

SEQ ID NO: 392669 - protein, 9 aa, Homo Sapiens
ALGKWLQWP

SEQ ID NO: 392670 - protein, 9 aa, Homo Sapiens
CMSDLTCVL

SEQ ID NO: 392671 - protein, 9 aa, Homo Sapiens
KFTLTDNHD

SEQ ID NO: 392672 - protein, 9 aa, Homo Sapiens
FSVTGFDMI

SEQ ID NO: 392673 - protein, 9 aa, Homo Sapiens
GLPIGTHAA

SEQ ID NO: 392674 - protein, 9 aa, Homo Sapiens
DIITSKVSS

SEQ ID NO: 392675 - protein, 9 aa, Homo Sapiens
PPTIPPAWD

SEQ ID NO: 392676 - protein, 9 aa, Homo Sapiens
TSGAGGTRG

SEQ ID NO: 392677 - protein, 9 aa, Homo Sapiens
LPWMVPWGM

SEQ ID NO: 392678 - protein, 9 aa, Homo Sapiens
LRAVPWRAA

SEQ ID NO: 392679 - protein, 9 aa, Homo Sapiens
RTASSRCCP

SEQ ID NO: 392680 - protein, 9 aa, Homo Sapiens
KLWSLLFSQ

SEQ ID NO: 392681 - protein, 9 aa, Homo Sapiens
MIRILPLEQ

SEQ ID NO: 392682 - protein, 9 aa, Homo Sapiens
QKSEADKND

SEQ ID NO: 392683 - protein, 9 aa, Homo Sapiens
APSALVLLA

SEQ ID NO: 392684 - protein, 9 aa, Homo Sapiens
GSTVGPSGT

SEQ ID NO: 392685 - protein, 9 aa, Homo Sapiens
QHNGRIPGV

SEQ ID NO: 392686 - protein, 9 aa, Homo Sapiens
GTSRARGSL

SEQ ID NO: 392687 - protein, 9 aa, Homo Sapiens
DPADSGLQR

SEQ ID NO: 392688 - protein, 9 aa, Homo Sapiens
VMYCHTHEA

SEQ ID NO: 392689 - protein, 9 aa, Homo Sapiens
DSGLQRAEE

SEQ ID NO: 392690 - protein, 9 aa, Homo Sapiens
VLKPPGLVI

SEQ ID NO: 392691 - protein, 9 aa, Homo Sapiens
PGEADLADG

SEQ ID NO: 392692 - protein, 9 aa, Homo Sapiens
ILVMLEIVT

SEQ ID NO: 392693 - protein, 9 aa, Homo Sapiens
SSFLIFFIP

SEQ ID NO: 392694 - protein, 9 aa, Homo Sapiens
CRCPPGFTS

SEQ ID NO: 392695 - protein, 9 aa, Homo Sapiens
MGGMSRTPP

SEQ ID NO: 392696 - protein, 9 aa, Homo Sapiens
KLEVMFRLY

SEQ ID NO: 392697 - protein, 9 aa, Homo Sapiens
LLDKNGTTC

SEQ ID NO: 392698 - protein, 9 aa, Homo Sapiens
QWSKSLSPS

SEQ ID NO: 392699 - protein, 9 aa, Homo Sapiens
RLQGGGVAD

SEQ ID NO: 392700 - protein, 9 aa, Homo Sapiens
LEVVVVHEL

SEQ ID NO: 392701 - protein, 9 aa, Homo Sapiens
HTQQDPGVP

SEQ ID NO: 392702 - protein, 9 aa, Homo Sapiens
FMGCLNIPV

SEQ ID NO: 392703 - protein, 9 aa, Homo Sapiens
HPPCWSPLQ

SEQ ID NO: 392704 - protein, 9 aa, Homo Sapiens
SICRGNWRT

SEQ ID NO: 392705 - protein, 9 aa, Homo Sapiens
ITHVNALTV

SEQ ID NO: 392706 - protein, 9 aa, Homo Sapiens
LQQEEEPLL

SEQ ID NO: 392707 - protein, 9 aa, Homo Sapiens
GKELVIGHY

SEQ ID NO: 392708 - protein, 9 aa, Homo Sapiens
SLSSHRCAL

SEQ ID NO: 392709 - protein, 9 aa, Homo Sapiens
ELHAFLESC

SEQ ID NO: 392710 - protein, 9 aa, Homo Sapiens
TVRRKNVPS

SEQ ID NO: 392711 - protein, 9 aa, Homo Sapiens
RQKRDVIRH

SEQ ID NO: 392712 - protein, 9 aa, Homo Sapiens
VEEANERYK

SEQ ID NO: 392713 - protein, 9 aa, Homo Sapiens
CTVFGILMG

SEQ ID NO: 392714 - protein, 9 aa, Homo Sapiens
TLGMTELTD

SEQ ID NO: 392715 - protein, 9 aa, Homo Sapiens
WTKEIKESL

SEQ ID NO: 392716 - protein, 9 aa, Homo Sapiens
TGMCHHAQG

SEQ ID NO: 392717 - protein, 9 aa, Homo Sapiens
SIQQTPEVI

SEQ ID NO: 392718 - protein, 9 aa, Homo Sapiens
GPPARTPRG

SEQ ID NO: 392719 - protein, 9 aa, Homo Sapiens
SGKGEAQCR

SEQ ID NO: 392720 - protein, 9 aa, Homo Sapiens
GLYCFPSSD

SEQ ID NO: 392721 - protein, 9 aa, Homo Sapiens
AREALVAEL

SEQ ID NO: 392722 - protein, 9 aa, Homo Sapiens
QLQGLVAGV

SEQ ID NO: 392723 - protein, 9 aa, Homo Sapiens
HQPWAHGMP

SEQ ID NO: 392724 - protein, 9 aa, Homo Sapiens
RLNCPAAVV

SEQ ID NO: 392725 - protein, 9 aa, Homo Sapiens
TSILLTYNI

SEQ ID NO: 392726 - protein, 9 aa, Homo Sapiens
KPVTPSNVL

SEQ ID NO: 392727 - protein, 9 aa, Homo Sapiens
AHGMPDLLE

SEQ ID NO: 392728 - protein, 9 aa, Homo Sapiens
RAVPWRAAP

SEQ ID NO: 392729 - protein, 9 aa, Homo Sapiens
TFTSGTLGT

SEQ ID NO: 392730 - protein, 9 aa, Homo Sapiens
KAHAEHQAI

SEQ ID NO: 392731 - protein, 9 aa, Homo Sapiens
DQHRNGVIS

SEQ ID NO: 392732 - protein, 9 aa, Homo Sapiens
YTAAVFKET

SEQ ID NO: 392733 - protein, 9 aa, Homo Sapiens
GKAFHQSSY

SEQ ID NO: 392734 - protein, 9 aa, Homo Sapiens
AVTAAGVVK

SEQ ID NO: 392735 - protein, 9 aa, Homo Sapiens
RPTSAVRER

SEQ ID NO: 392736 - protein, 9 aa, Homo Sapiens
TQTQMPGPP

SEQ ID NO: 392737 - protein, 9 aa, Homo Sapiens
FDTTFERAR

SEQ ID NO: 392738 - protein, 9 aa, Homo Sapiens
SPEKFQPSH

SEQ ID NO: 392739 - protein, 9 aa, Homo Sapiens
RDSWPTRRS

SEQ ID NO: 392740 - protein, 9 aa, Homo Sapiens
SRATSLTRQ

SEQ ID NO: 392741 - protein, 9 aa, Homo Sapiens
TFGTSITSV

SEQ ID NO: 392742 - protein, 9 aa, Homo Sapiens
GDTLTITLR

SEQ ID NO: 392743 - protein, 9 aa, Homo Sapiens
RLPTGLYCF

SEQ ID NO: 392744 - protein, 9 aa, Homo Sapiens
TMNDSKHKL

SEQ ID NO: 392745 - protein, 9 aa, Homo Sapiens
PTSSPTARA

SEQ ID NO: 392746 - protein, 9 aa, Homo Sapiens
EVANDPLYV

SEQ ID NO: 392747 - protein, 9 aa, Homo Sapiens
RRAISTFGT

SEQ ID NO: 392748 - protein, 9 aa, Homo Sapiens
EDKSILLNP

SEQ ID NO: 392749 - protein, 9 aa, Homo Sapiens
PLGNLSPGV

SEQ ID NO: 392750 - protein, 9 aa, Homo Sapiens
QQRLWEIQH

SEQ ID NO: 392751 - protein, 9 aa, Homo Sapiens
LAQSAWCSS

SEQ ID NO: 392752 - protein, 9 aa, Homo Sapiens
HSHGNPLLR

SEQ ID NO: 392753 - protein, 9 aa, Homo Sapiens
ELGCDEGDA

SEQ ID NO: 392754 - protein, 9 aa, Homo Sapiens
AALPTPLLR

SEQ ID NO: 392755 - protein, 9 aa, Homo Sapiens
LLFAEAADM

SEQ ID NO: 392756 - protein, 9 aa, Homo Sapiens
TAGVGTTLL

SEQ ID NO: 392757 - protein, 9 aa, Homo Sapiens
QFATSEMKV

SEQ ID NO: 392758 - protein, 9 aa, Homo Sapiens
FRKNPDPRV

SEQ ID NO: 392759 - protein, 9 aa, Homo Sapiens
EKNTNQRLQ

SEQ ID NO: 392760 - protein, 9 aa, Homo Sapiens
LVFLTLTLS

SEQ ID NO: 392761 - protein, 9 aa, Homo Sapiens
PYECNQCGE

SEQ ID NO: 392762 - protein, 9 aa, Homo Sapiens
HLQPPSRPM

SEQ ID NO: 392763 - protein, 9 aa, Homo Sapiens
QRRCCSPRR

SEQ ID NO: 392764 - protein, 9 aa, Homo Sapiens
ARGNSTYRC

SEQ ID NO: 392765 - protein, 9 aa, Homo Sapiens
TYKWLKMAN

SEQ ID NO: 392766 - protein, 9 aa, Homo Sapiens
RRTSGAGGT

SEQ ID NO: 392767 - protein, 9 aa, Homo Sapiens
VEFGSAIRG

SEQ ID NO: 392768 - protein, 9 aa, Homo Sapiens
PNQHQTGAP

SEQ ID NO: 392769 - protein, 9 aa, Homo Sapiens
FGAGTGKLS

SEQ ID NO: 392770 - protein, 9 aa, Homo Sapiens
KYCVPNYVG

SEQ ID NO: 392771 - protein, 9 aa, Homo Sapiens
AWLSMTPHQ

SEQ ID NO: 392772 - protein, 9 aa, Homo Sapiens
SSGASVAAV

SEQ ID NO: 392773 - protein, 9 aa, Homo Sapiens
QILAAGLSY

SEQ ID NO: 392774 - protein, 9 aa, Homo Sapiens
MPPPGLRPC

SEQ ID NO: 392775 - protein, 9 aa, Homo Sapiens
GTTFTLVTR

SEQ ID NO: 392776 - protein, 9 aa, Homo Sapiens
WRRTGASTP

SEQ ID NO: 392777 - protein, 9 aa, Homo Sapiens
TRSFLKWTL

SEQ ID NO: 392778 - protein, 9 aa, Homo Sapiens
VTTGALGSG

SEQ ID NO: 392779 - protein, 9 aa, Homo Sapiens
YMNQRVAKA

SEQ ID NO: 392780 - protein, 9 aa, Homo Sapiens
TKRRRRAKL

SEQ ID NO: 392781 - protein, 9 aa, Homo Sapiens
RPKPMGILL

SEQ ID NO: 392782 - protein, 9 aa, Homo Sapiens
FTLCESWLR

SEQ ID NO: 392783 - protein, 9 aa, Homo Sapiens
PSALVLLAP

SEQ ID NO: 392784 - protein, 9 aa, Homo Sapiens
DREALCELT

SEQ ID NO: 392785 - protein, 9 aa, Homo Sapiens
QNLQGHMLQ

SEQ ID NO: 392786 - protein, 9 aa, Homo Sapiens
SLSSLAGLS

SEQ ID NO: 392787 - protein, 9 aa, Homo Sapiens
VTFKASPRL

SEQ ID NO: 392788 - protein, 9 aa, Homo Sapiens
LNNRMVSRR

SEQ ID NO: 392789 - protein, 9 aa, Homo Sapiens
QAESKNQIK

SEQ ID NO: 392790 - protein, 9 aa, Homo Sapiens
LKKGLQRGR

SEQ ID NO: 392791 - protein, 9 aa, Homo Sapiens
KALVKTWTQ

SEQ ID NO: 392792 - protein, 9 aa, Homo Sapiens
MPGSSRRLH

SEQ ID NO: 392793 - protein, 9 aa, Homo Sapiens
KNGRSEVSL

SEQ ID NO: 392794 - protein, 9 aa, Homo Sapiens
LTGLPAPGV

SEQ ID NO: 392795 - protein, 9 aa, Homo Sapiens
AGQKPMART

SEQ ID NO: 392796 - protein, 9 aa, Homo Sapiens
YVNVFHKFS

SEQ ID NO: 392797 - protein, 9 aa, Homo Sapiens
FLASRARGT

SEQ ID NO: 392798 - protein, 9 aa, Homo Sapiens
PTLQVVILK

SEQ ID NO: 392799 - protein, 9 aa, Homo Sapiens
TFVNDVRIL

SEQ ID NO: 392800 - protein, 9 aa, Homo Sapiens
EAGGPGQRR

SEQ ID NO: 392801 - protein, 9 aa, Homo Sapiens
ITDDLLLPV

SEQ ID NO: 392802 - protein, 9 aa, Homo Sapiens
IQSLPLCLS

SEQ ID NO: 392803 - protein, 9 aa, Homo Sapiens
RPVVPKRDV

SEQ ID NO: 392804 - protein, 9 aa, Homo Sapiens
MVVSQLAGT

SEQ ID NO: 392805 - protein, 9 aa, Homo Sapiens
RGSQSALGT

SEQ ID NO: 392806 - protein, 9 aa, Homo Sapiens
SPTSAPTAA

SEQ ID NO: 392807 - protein, 9 aa, Homo Sapiens
ADKPNDQSS

SEQ ID NO: 392808 - protein, 9 aa, Homo Sapiens
GFSQDLGCA

SEQ ID NO: 392809 - protein, 9 aa, Homo Sapiens
ATWGLTPSW

SEQ ID NO: 392810 - protein, 9 aa, Homo Sapiens
RQTSFTGTT

SEQ ID NO: 392811 - protein, 9 aa, Homo Sapiens
AQVPHLRAR

SEQ ID NO: 392812 - protein, 9 aa, Homo Sapiens
LLPNTEEKS

SEQ ID NO: 392813 - protein, 9 aa, Homo Sapiens
GGGDATPLH

SEQ ID NO: 392814 - protein, 9 aa, Homo Sapiens
MVPRARVIR

SEQ ID NO: 392815 - protein, 9 aa, Homo Sapiens
RVALQLKLR

SEQ ID NO: 392816 - protein, 9 aa, Homo Sapiens
GSVSTVVLA

SEQ ID NO: 392817 - protein, 9 aa, Homo Sapiens
HYNIPVSVC

SEQ ID NO: 392818 - protein, 9 aa, Homo Sapiens
CLLLWPTSA

SEQ ID NO: 392819 - protein, 9 aa, Homo Sapiens
GAASHLQQQ

SEQ ID NO: 392820 - protein, 9 aa, Homo Sapiens
TPSVPPILT

SEQ ID NO: 392821 - protein, 9 aa, Homo Sapiens
DVAVQVVRA

SEQ ID NO: 392822 - protein, 9 aa, Homo Sapiens
KHQCNHAAG

SEQ ID NO: 392823 - protein, 9 aa, Homo Sapiens
WRQIDRGVT

SEQ ID NO: 392824 - protein, 9 aa, Homo Sapiens
PPTRSSPRL

SEQ ID NO: 392825 - protein, 9 aa, Homo Sapiens
PPPGPEGGL

SEQ ID NO: 392826 - protein, 9 aa, Homo Sapiens
KPKRSLLGL

SEQ ID NO: 392827 - protein, 9 aa, Homo Sapiens
LFFSFLFLF

SEQ ID NO: 392828 - protein, 9 aa, Homo Sapiens
TAAWSCAPV

SEQ ID NO: 392829 - protein, 9 aa, Homo Sapiens
AAASTFGSR

SEQ ID NO: 392830 - protein, 9 aa, Homo Sapiens
ILYMLSILK

SEQ ID NO: 392831 - protein, 9 aa, Homo Sapiens
VSAPRLMVL

SEQ ID NO: 392832 - protein, 9 aa, Homo Sapiens
KSHTLLLNN

SEQ ID NO: 392833 - protein, 9 aa, Homo Sapiens
RDLDVCDRK

SEQ ID NO: 392834 - protein, 9 aa, Homo Sapiens
FGILMGYPV

SEQ ID NO: 392835 - protein, 9 aa, Homo Sapiens
DVIDFLVLC

SEQ ID NO: 392836 - protein, 9 aa, Homo Sapiens
PPAWDVCKG

SEQ ID NO: 392837 - protein, 9 aa, Homo Sapiens
GARETVESI

SEQ ID NO: 392838 - protein, 9 aa, Homo Sapiens
QNDPCLATD

SEQ ID NO: 392839 - protein, 9 aa, Homo Sapiens
DVLDFNFDS

SEQ ID NO: 392840 - protein, 9 aa, Homo Sapiens
WSVLLLLFL

SEQ ID NO: 392841 - protein, 9 aa, Homo Sapiens
LRKSQEKEW

SEQ ID NO: 392842 - protein, 9 aa, Homo Sapiens
SSNKPLRGD

SEQ ID NO: 392843 - protein, 9 aa, Homo Sapiens
SFTGTTSFT

SEQ ID NO: 392844 - protein, 9 aa, Homo Sapiens
HPPKRIRSD

SEQ ID NO: 392845 - protein, 9 aa, Homo Sapiens
GSPHITNSL

SEQ ID NO: 392846 - protein, 9 aa, Homo Sapiens
QGSWEPLCA

SEQ ID NO: 392847 - protein, 9 aa, Homo Sapiens
WRGQPGPAA

SEQ ID NO: 392848 - protein, 9 aa, Homo Sapiens
AGGTRLTTV

SEQ ID NO: 392849 - protein, 9 aa, Homo Sapiens
SLRLKWIML

SEQ ID NO: 392850 - protein, 9 aa, Homo Sapiens
GDDRGTPWL

SEQ ID NO: 392851 - protein, 9 aa, Homo Sapiens
KGEAEEALK

SEQ ID NO: 392852 - protein, 9 aa, Homo Sapiens
FYMNQRVAK

SEQ ID NO: 392853 - protein, 9 aa, Homo Sapiens
HGAAGSSRV

SEQ ID NO: 392854 - protein, 9 aa, Homo Sapiens
FHAYYYYFI

SEQ ID NO: 392855 - protein, 9 aa, Homo Sapiens
LHHFYLTLE

SEQ ID NO: 392856 - protein, 9 aa, Homo Sapiens
RGRHSQGDV

SEQ ID NO: 392857 - protein, 9 aa, Homo Sapiens
AYPHWRQQA

SEQ ID NO: 392858 - protein, 9 aa, Homo Sapiens
AVGEGEVAA

SEQ ID NO: 392859 - protein, 9 aa, Homo Sapiens
LVCKLERRL

SEQ ID NO: 392860 - protein, 9 aa, Homo Sapiens
TEELFLLVS

SEQ ID NO: 392861 - protein, 9 aa, Homo Sapiens
RGSRGTLFT

SEQ ID NO: 392862 - protein, 9 aa, Homo Sapiens
DGLLQLAHL

SEQ ID NO: 392863 - protein, 9 aa, Homo Sapiens
PITYLELLD

SEQ ID NO: 392864 - protein, 9 aa, Homo Sapiens
LQLQGLVAG

SEQ ID NO: 392865 - protein, 9 aa, Homo Sapiens
SSKRTSSFL

SEQ ID NO: 392866 - protein, 9 aa, Homo Sapiens
ARRAISTFG

SEQ ID NO: 392867 - protein, 9 aa, Homo Sapiens
PVVPKRDVE

SEQ ID NO: 392868 - protein, 9 aa, Homo Sapiens
GEKPFVCNG

SEQ ID NO: 392869 - protein, 9 aa, Homo Sapiens
AAAQLFSPA

SEQ ID NO: 392870 - protein, 9 aa, Homo Sapiens
YCHTHEAKR

SEQ ID NO: 392871 - protein, 9 aa, Homo Sapiens
AFSVTGFDM

SEQ ID NO: 392872 - protein, 9 aa, Homo Sapiens
NPPDCYRYA

SEQ ID NO: 392873 - protein, 9 aa, Homo Sapiens
MYCHTHEAK

SEQ ID NO: 392874 - protein, 9 aa, Homo Sapiens
NPWIKFRSV

SEQ ID NO: 392875 - protein, 9 aa, Homo Sapiens
MLGAILRLQ

SEQ ID NO: 392876 - protein, 9 aa, Homo Sapiens
ALMMVIYRG

SEQ ID NO: 392877 - protein, 9 aa, Homo Sapiens
GHAQDAIEL

SEQ ID NO: 392878 - protein, 9 aa, Homo Sapiens
HAYYYYFIT

SEQ ID NO: 392879 - protein, 9 aa, Homo Sapiens
TKVDPNQWN

SEQ ID NO: 392880 - protein, 9 aa, Homo Sapiens
DIIVGPEGV

SEQ ID NO: 392881 - protein, 9 aa, Homo Sapiens
KETWREEKN

SEQ ID NO: 392882 - protein, 9 aa, Homo Sapiens
SDARSESPN

SEQ ID NO: 392883 - protein, 9 aa, Homo Sapiens
FRKHITKRL

SEQ ID NO: 392884 - protein, 9 aa, Homo Sapiens
GFTGATCLL

SEQ ID NO: 392885 - protein, 9 aa, Homo Sapiens
RPSCSMSRH

SEQ ID NO: 392886 - protein, 9 aa, Homo Sapiens
LTGDHVLAL

SEQ ID NO: 392887 - protein, 9 aa, Homo Sapiens
WAVLAWARA

SEQ ID NO: 392888 - protein, 9 aa, Homo Sapiens
LIVYITQVI

SEQ ID NO: 392889 - protein, 9 aa, Homo Sapiens
DMLNDLAAY

SEQ ID NO: 392890 - protein, 9 aa, Homo Sapiens
EQHGAAAEG

SEQ ID NO: 392891 - protein, 9 aa, Homo Sapiens
QYSGAQVCV

SEQ ID NO: 392892 - protein, 9 aa, Homo Sapiens
SCHLLTLII

SEQ ID NO: 392893 - protein, 9 aa, Homo Sapiens
SGQASGSGF

SEQ ID NO: 392894 - protein, 9 aa, Homo Sapiens
SVAKAEKRK

SEQ ID NO: 392895 - protein, 9 aa, Homo Sapiens
RKGFQLKKS

SEQ ID NO: 392896 - protein, 9 aa, Homo Sapiens
ERPQSSYAA

SEQ ID NO: 392897 - protein, 9 aa, Homo Sapiens
VCEGLTHGV

SEQ ID NO: 392898 - protein, 9 aa, Homo Sapiens
WPTVHGLLR

SEQ ID NO: 392899 - protein, 9 aa, Homo Sapiens
SHCPRPHDS

SEQ ID NO: 392900 - protein, 9 aa, Homo Sapiens
AGNPSLSLV

SEQ ID NO: 392901 - protein, 9 aa, Homo Sapiens
ERFDNLIIT

SEQ ID NO: 392902 - protein, 9 aa, Homo Sapiens
CLPLARPPR

SEQ ID NO: 392903 - protein, 9 aa, Homo Sapiens
MNEFQAVVW

SEQ ID NO: 392904 - protein, 9 aa, Homo Sapiens
EDVVGGGAG

SEQ ID NO: 392905 - protein, 9 aa, Homo Sapiens
PSLCLFSLS

SEQ ID NO: 392906 - protein, 9 aa, Homo Sapiens
ARAVLSIQS

SEQ ID NO: 392907 - protein, 9 aa, Homo Sapiens
STTRRDSWP

SEQ ID NO: 392908 - protein, 9 aa, Homo Sapiens
EFTFGNKPD

SEQ ID NO: 392909 - protein, 9 aa, Homo Sapiens
PRLLSRVQT

SEQ ID NO: 392910 - protein, 9 aa, Homo Sapiens
ICARETTAT

SEQ ID NO: 392911 - protein, 9 aa, Homo Sapiens
WVPAQVEGE

SEQ ID NO: 392912 - protein, 9 aa, Homo Sapiens
GNPLLRLSL

SEQ ID NO: 392913 - protein, 9 aa, Homo Sapiens
LDEGVSTSS

SEQ ID NO: 392914 - protein, 9 aa, Homo Sapiens
RTNGASQTT

SEQ ID NO: 392915 - protein, 9 aa, Homo Sapiens
CFNIQGSFR

SEQ ID NO: 392916 - protein, 9 aa, Homo Sapiens
PHITNSLIG

SEQ ID NO: 392917 - protein, 9 aa, Homo Sapiens
TGLVGCEHG

SEQ ID NO: 392918 - protein, 9 aa, Homo Sapiens
GVGDRGWAG

SEQ ID NO: 392919 - protein, 9 aa, Homo Sapiens
PNGARETVE

SEQ ID NO: 392920 - protein, 9 aa, Homo Sapiens
PYVCNECDK

SEQ ID NO: 392921 - protein, 9 aa, Homo Sapiens
PLCTYETRQ

SEQ ID NO: 392922 - protein, 9 aa, Homo Sapiens
STSSFCCCT

SEQ ID NO: 392923 - protein, 9 aa, Homo Sapiens
RKFSSFLSP

SEQ ID NO: 392924 - protein, 9 aa, Homo Sapiens
PGRRDPQDG

SEQ ID NO: 392925 - protein, 9 aa, Homo Sapiens
PQIQASWAR

SEQ ID NO: 392926 - protein, 9 aa, Homo Sapiens
EVDKANQII

SEQ ID NO: 392927 - protein, 9 aa, Homo Sapiens
VELYVCVWS

SEQ ID NO: 392928 - protein, 9 aa, Homo Sapiens
ADGAHVWLL

SEQ ID NO: 392929 - protein, 9 aa, Homo Sapiens
SGFTGLSIA

SEQ ID NO: 392930 - protein, 9 aa, Homo Sapiens
VFAQRFRLQ

SEQ ID NO: 392931 - protein, 9 aa, Homo Sapiens
AGCLQPAEP

SEQ ID NO: 392932 - protein, 9 aa, Homo Sapiens
KPPNGLILS

SEQ ID NO: 392933 - protein, 9 aa, Homo Sapiens
DCCYRERKN

SEQ ID NO: 392934 - protein, 9 aa, Homo Sapiens
VLRGRGARA

SEQ ID NO: 392935 - protein, 9 aa, Homo Sapiens
ATDLGRPAH

SEQ ID NO: 392936 - protein, 9 aa, Homo Sapiens
RGSSGSGRA

SEQ ID NO: 392937 - protein, 9 aa, Homo Sapiens
TLEAREATV

SEQ ID NO: 392938 - protein, 9 aa, Homo Sapiens
HTPGTTAEW

SEQ ID NO: 392939 - protein, 9 aa, Homo Sapiens
IMDHSIILR

SEQ ID NO: 392940 - protein, 9 aa, Homo Sapiens
KMCNDVSVK

SEQ ID NO: 392941 - protein, 9 aa, Homo Sapiens
AARPSATNP

SEQ ID NO: 392942 - protein, 9 aa, Homo Sapiens
INSSPVDSN

SEQ ID NO: 392943 - protein, 9 aa, Homo Sapiens
CSMSRHPFF

SEQ ID NO: 392944 - protein, 9 aa, Homo Sapiens
VFPPTHNTP

SEQ ID NO: 392945 - protein, 9 aa, Homo Sapiens
PAAVTAPPS

SEQ ID NO: 392946 - protein, 9 aa, Homo Sapiens
ESSWITPEL

SEQ ID NO: 392947 - protein, 9 aa, Homo Sapiens
FPVRLIIQV

SEQ ID NO: 392948 - protein, 9 aa, Homo Sapiens
TAGILTRKM

SEQ ID NO: 392949 - protein, 9 aa, Homo Sapiens
TQKPKRSLL

SEQ ID NO: 392950 - protein, 9 aa, Homo Sapiens
EVIYDMLND

SEQ ID NO: 392951 - protein, 9 aa, Homo Sapiens
TDEMDHFDR

SEQ ID NO: 392952 - protein, 9 aa, Homo Sapiens
LGQPGVRAL

SEQ ID NO: 392953 - protein, 9 aa, Homo Sapiens
GMLDVTITT

SEQ ID NO: 392954 - protein, 9 aa, Homo Sapiens
SQSQPHCVA

SEQ ID NO: 392955 - protein, 9 aa, Homo Sapiens
ANDPLYVPD

SEQ ID NO: 392956 - protein, 9 aa, Homo Sapiens
GHPSAFNNL

SEQ ID NO: 392957 - protein, 9 aa, Homo Sapiens
RHVIWENCH

SEQ ID NO: 392958 - protein, 9 aa, Homo Sapiens
RFLPMTKEF

SEQ ID NO: 392959 - protein, 9 aa, Homo Sapiens
RAGQKPMAR

SEQ ID NO: 392960 - protein, 9 aa, Homo Sapiens
FQNVMVMIL

SEQ ID NO: 392961 - protein, 9 aa, Homo Sapiens
CLEEPRKGL

SEQ ID NO: 392962 - protein, 9 aa, Homo Sapiens
ASSGNETAF

SEQ ID NO: 392963 - protein, 9 aa, Homo Sapiens
KKLVKISEI

SEQ ID NO: 392964 - protein, 9 aa, Homo Sapiens
LYTLNDREI

SEQ ID NO: 392965 - protein, 9 aa, Homo Sapiens
EACHGPLFL

SEQ ID NO: 392966 - protein, 9 aa, Homo Sapiens
TLKLILVML

SEQ ID NO: 392967 - protein, 9 aa, Homo Sapiens
EGRKIHVLL

SEQ ID NO: 392968 - protein, 9 aa, Homo Sapiens
PDEPSSKTK

SEQ ID NO: 392969 - protein, 9 aa, Homo Sapiens
FEVPVLRGH

SEQ ID NO: 392970 - protein, 9 aa, Homo Sapiens
SSGSGRARG

SEQ ID NO: 392971 - protein, 9 aa, Homo Sapiens
PTRSGTCCW

SEQ ID NO: 392972 - protein, 9 aa, Homo Sapiens
GTTLLSFGI

SEQ ID NO: 392973 - protein, 9 aa, Homo Sapiens
VKKTAPPEA

SEQ ID NO: 392974 - protein, 9 aa, Homo Sapiens
APWLLEVGS

SEQ ID NO: 392975 - protein, 9 aa, Homo Sapiens
LFYTSRIVL

SEQ ID NO: 392976 - protein, 9 aa, Homo Sapiens
PAPSAGRTS

SEQ ID NO: 392977 - protein, 9 aa, Homo Sapiens
RKNSTYSHR

SEQ ID NO: 392978 - protein, 9 aa, Homo Sapiens
KRRSKVKIT

SEQ ID NO: 392979 - protein, 9 aa, Homo Sapiens
SACMVLGLQ

SEQ ID NO: 392980 - protein, 9 aa, Homo Sapiens
GMAHIFLIQ

SEQ ID NO: 392981 - protein, 9 aa, Homo Sapiens
TPELRLQSD

SEQ ID NO: 392982 - protein, 9 aa, Homo Sapiens
MILIPRFPR

SEQ ID NO: 392983 - protein, 9 aa, Homo Sapiens
LHPPRMKDP

SEQ ID NO: 392984 - protein, 9 aa, Homo Sapiens
ARPSATNPT

SEQ ID NO: 392985 - protein, 9 aa, Homo Sapiens
MIQVLMSVV

SEQ ID NO: 392986 - protein, 9 aa, Homo Sapiens
DPAIKSTAE

SEQ ID NO: 392987 - protein, 9 aa, Homo Sapiens
CLILGIYLC

SEQ ID NO: 392988 - protein, 9 aa, Homo Sapiens
CMGLKSWIS

SEQ ID NO: 392989 - protein, 9 aa, Homo Sapiens
TDDTLGDTL

SEQ ID NO: 392990 - protein, 9 aa, Homo Sapiens
SSQNLFVLG

SEQ ID NO: 392991 - protein, 9 aa, Homo Sapiens
MLRLELDAM

SEQ ID NO: 392992 - protein, 9 aa, Homo Sapiens
GDTPVDFFE

SEQ ID NO: 392993 - protein, 9 aa, Homo Sapiens
NGLTALLAQ

SEQ ID NO: 392994 - protein, 9 aa, Homo Sapiens
WADHIITMD

SEQ ID NO: 392995 - protein, 9 aa, Homo Sapiens
KCITECVRT

SEQ ID NO: 392996 - protein, 9 aa, Homo Sapiens
NLALLEKNQ

SEQ ID NO: 392997 - protein, 9 aa, Homo Sapiens
TSHLPLYAD

SEQ ID NO: 392998 - protein, 9 aa, Homo Sapiens
ETSLASCSR

SEQ ID NO: 392999 - protein, 9 aa, Homo Sapiens
FPYPRLDVN

SEQ ID NO: 393000 - protein, 9 aa, Homo Sapiens
CPSDTVMQK

SEQ ID NO: 393001 - protein, 9 aa, Homo Sapiens
QKKAKIKKK

SEQ ID NO: 393002 - protein, 9 aa, Homo Sapiens
QRQTRCQVR

SEQ ID NO: 393003 - protein, 9 aa, Homo Sapiens
QLQNQQHPK

SEQ ID NO: 393004 - protein, 9 aa, Homo Sapiens
LLRAVPWRA

SEQ ID NO: 393005 - protein, 9 aa, Homo Sapiens
AIPEFGSPC

SEQ ID NO: 393006 - protein, 9 aa, Homo Sapiens
IMRMTAQAR

SEQ ID NO: 393007 - protein, 9 aa, Homo Sapiens
PLCLSCRAG

SEQ ID NO: 393008 - protein, 9 aa, Homo Sapiens
QTSFTGTTS

SEQ ID NO: 393009 - protein, 9 aa, Homo Sapiens
SPEVTIHWI

SEQ ID NO: 393010 - protein, 9 aa, Homo Sapiens
LALNQRHGP

SEQ ID NO: 393011 - protein, 9 aa, Homo Sapiens
ASRANGARG

SEQ ID NO: 393012 - protein, 9 aa, Homo Sapiens
ETSLWFKPE

SEQ ID NO: 393013 - protein, 9 aa, Homo Sapiens
RAFFISHSL

SEQ ID NO: 393014 - protein, 9 aa, Homo Sapiens
PTCSPPAST

SEQ ID NO: 393015 - protein, 9 aa, Homo Sapiens
HQLGSGVIV

SEQ ID NO: 393016 - protein, 9 aa, Homo Sapiens
NTLRPGSTR

SEQ ID NO: 393017 - protein, 9 aa, Homo Sapiens
SLNYREVRE

SEQ ID NO: 393018 - protein, 9 aa, Homo Sapiens
NMTSIRRLQ

SEQ ID NO: 393019 - protein, 9 aa, Homo Sapiens
TNCPSIHLD

SEQ ID NO: 393020 - protein, 9 aa, Homo Sapiens
CRPHWTLSP

SEQ ID NO: 393021 - protein, 9 aa, Homo Sapiens
SRASLTTGT

SEQ ID NO: 393022 - protein, 9 aa, Homo Sapiens
VPYLKNFTV

SEQ ID NO: 393023 - protein, 9 aa, Homo Sapiens
RTRAARASS

SEQ ID NO: 393024 - protein, 9 aa, Homo Sapiens
CPPGFTSDY

SEQ ID NO: 393025 - protein, 9 aa, Homo Sapiens
LSTRFDVNT

SEQ ID NO: 393026 - protein, 9 aa, Homo Sapiens
ANTVKPRFY

SEQ ID NO: 393027 - protein, 9 aa, Homo Sapiens
PVRNLHPPR

SEQ ID NO: 393028 - protein, 9 aa, Homo Sapiens
DKAFRSKSY

SEQ ID NO: 393029 - protein, 9 aa, Homo Sapiens
KLKLAPLQV

SEQ ID NO: 393030 - protein, 9 aa, Homo Sapiens
CHAAALALD

SEQ ID NO: 393031 - protein, 9 aa, Homo Sapiens
EEVLHQSTY

SEQ ID NO: 393032 - protein, 9 aa, Homo Sapiens
GPGKSAVPI

SEQ ID NO: 393033 - protein, 9 aa, Homo Sapiens
KKGSVFNMW

SEQ ID NO: 393034 - protein, 9 aa, Homo Sapiens
SLKKTSRIL

SEQ ID NO: 393035 - protein, 9 aa, Homo Sapiens
FPPTHNTPD

SEQ ID NO: 393036 - protein, 9 aa, Homo Sapiens
CSKATFGTS

SEQ ID NO: 393037 - protein, 9 aa, Homo Sapiens
ECHSRIHTG

SEQ ID NO: 393038 - protein, 9 aa, Homo Sapiens
QFQNDPCLA

SEQ ID NO: 393039 - protein, 9 aa, Homo Sapiens
SRGTLFARF

SEQ ID NO: 393040 - protein, 9 aa, Homo Sapiens
TSSSGTSRA

SEQ ID NO: 393041 - protein, 9 aa, Homo Sapiens
SCTCTWRNW

SEQ ID NO: 393042 - protein, 9 aa, Homo Sapiens
QDTAAALPT

SEQ ID NO: 393043 - protein, 9 aa, Homo Sapiens
EEEVSSGVI

SEQ ID NO: 393044 - protein, 9 aa, Homo Sapiens
LKSKGTCRS

SEQ ID NO: 393045 - protein, 9 aa, Homo Sapiens
LAGTPPGMP

SEQ ID NO: 393046 - protein, 9 aa, Homo Sapiens
LGAPPTCSL

SEQ ID NO: 393047 - protein, 9 aa, Homo Sapiens
CPECDKAFR

SEQ ID NO: 393048 - protein, 9 aa, Homo Sapiens
ALLFEGIKR

SEQ ID NO: 393049 - protein, 9 aa, Homo Sapiens
RSAAKIVLM

SEQ ID NO: 393050 - protein, 9 aa, Homo Sapiens
PRVLVPPIS

SEQ ID NO: 393051 - protein, 9 aa, Homo Sapiens
SLDTKSKLN

SEQ ID NO: 393052 - protein, 9 aa, Homo Sapiens
HAALYLLGY

SEQ ID NO: 393053 - protein, 9 aa, Homo Sapiens
DKGLKKALG

SEQ ID NO: 393054 - protein, 9 aa, Homo Sapiens
SQQMDGLFD

SEQ ID NO: 393055 - protein, 9 aa, Homo Sapiens
PAQVEGEDV

SEQ ID NO: 393056 - protein, 9 aa, Homo Sapiens
SVVEEDVEN

SEQ ID NO: 393057 - protein, 9 aa, Homo Sapiens
NSLSTLLDG

SEQ ID NO: 393058 - protein, 9 aa, Homo Sapiens
LLKSKGTCR

SEQ ID NO: 393059 - protein, 9 aa, Homo Sapiens
QYYFNVGWN

SEQ ID NO: 393060 - protein, 9 aa, Homo Sapiens
GAGTGKLSH

SEQ ID NO: 393061 - protein, 9 aa, Homo Sapiens
KQINSSPVD

SEQ ID NO: 393062 - protein, 9 aa, Homo Sapiens
KEVRGEWRQ

SEQ ID NO: 393063 - protein, 9 aa, Homo Sapiens
EFQVQGSWE

SEQ ID NO: 393064 - protein, 9 aa, Homo Sapiens
LSVSIEGSV

SEQ ID NO: 393065 - protein, 9 aa, Homo Sapiens
LLTYNISNT

SEQ ID NO: 393066 - protein, 9 aa, Homo Sapiens
PNNYRTRIN

SEQ ID NO: 393067 - protein, 9 aa, Homo Sapiens
FGGIGVGNG

SEQ ID NO: 393068 - protein, 9 aa, Homo Sapiens
LKQKHPEND

SEQ ID NO: 393069 - protein, 9 aa, Homo Sapiens
STVRKRVSP

SEQ ID NO: 393070 - protein, 9 aa, Homo Sapiens
TMMSLAALQ

SEQ ID NO: 393071 - protein, 9 aa, Homo Sapiens
QSQLVYQGS

SEQ ID NO: 393072 - protein, 9 aa, Homo Sapiens
GSRGASGTR

SEQ ID NO: 393073 - protein, 9 aa, Homo Sapiens
VIYDWLHSA

SEQ ID NO: 393074 - protein, 9 aa, Homo Sapiens
KVREVGFNP

SEQ ID NO: 393075 - protein, 9 aa, Homo Sapiens
FQGFSSFYE

SEQ ID NO: 393076 - protein, 9 aa, Homo Sapiens
SEMAFSSCA

SEQ ID NO: 393077 - protein, 9 aa, Homo Sapiens
RILNLQVLK

SEQ ID NO: 393078 - protein, 9 aa, Homo Sapiens
TSITLSTIV

SEQ ID NO: 393079 - protein, 9 aa, Homo Sapiens
LLLPVDEVN

SEQ ID NO: 393080 - protein, 9 aa, Homo Sapiens
VTDHMLSEV

SEQ ID NO: 393081 - protein, 9 aa, Homo Sapiens
DELANLNWL

SEQ ID NO: 393082 - protein, 9 aa, Homo Sapiens
DKYYQMPSF

SEQ ID NO: 393083 - protein, 9 aa, Homo Sapiens
SSTSSPGLG

SEQ ID NO: 393084 - protein, 9 aa, Homo Sapiens
GTFSTRLSI

SEQ ID NO: 393085 - protein, 9 aa, Homo Sapiens
TAVTPRRSP

SEQ ID NO: 393086 - protein, 9 aa, Homo Sapiens
LSLFDFLSV

SEQ ID NO: 393087 - protein, 9 aa, Homo Sapiens
NKLFIKLTH

SEQ ID NO: 393088 - protein, 9 aa, Homo Sapiens
SFLAMMGPS

SEQ ID NO: 393089 - protein, 9 aa, Homo Sapiens
TTGTFAAFF

SEQ ID NO: 393090 - protein, 9 aa, Homo Sapiens
LKKAFQAML

SEQ ID NO: 393091 - protein, 9 aa, Homo Sapiens
AFFRRKRRS

SEQ ID NO: 393092 - protein, 9 aa, Homo Sapiens
MRYRTTKDN

SEQ ID NO: 393093 - protein, 9 aa, Homo Sapiens
PAWKIVLWA

SEQ ID NO: 393094 - protein, 9 aa, Homo Sapiens
LDREALCEL

SEQ ID NO: 393095 - protein, 9 aa, Homo Sapiens
SRFTRGSSQ

SEQ ID NO: 393096 - protein, 9 aa, Homo Sapiens
PPGLGPPPP

SEQ ID NO: 393097 - protein, 9 aa, Homo Sapiens
VLSEQHGAA

SEQ ID NO: 393098 - protein, 9 aa, Homo Sapiens
IEEPIEKPG

SEQ ID NO: 393099 - protein, 9 aa, Homo Sapiens
DEGVSTSSA

SEQ ID NO: 393100 - protein, 9 aa, Homo Sapiens
YFITLTTIG

SEQ ID NO: 393101 - protein, 9 aa, Homo Sapiens
KAAVGEGEV

SEQ ID NO: 393102 - protein, 9 aa, Homo Sapiens
LLLHQVVED

SEQ ID NO: 393103 - protein, 9 aa, Homo Sapiens
EDENAMDAA

SEQ ID NO: 393104 - protein, 9 aa, Homo Sapiens
NMHENLTYL

SEQ ID NO: 393105 - protein, 9 aa, Homo Sapiens
RFCAWPSAI

SEQ ID NO: 393106 - protein, 9 aa, Homo Sapiens
RQINHTAFR

SEQ ID NO: 393107 - protein, 9 aa, Homo Sapiens
EKKAQTVTE

SEQ ID NO: 393108 - protein, 9 aa, Homo Sapiens
LESGGASRA

SEQ ID NO: 393109 - protein, 9 aa, Homo Sapiens
RSHQPKSPL

SEQ ID NO: 393110 - protein, 9 aa, Homo Sapiens
ITSNPLPSF

SEQ ID NO: 393111 - protein, 9 aa, Homo Sapiens
DDRSPQAPL

SEQ ID NO: 393112 - protein, 9 aa, Homo Sapiens
KIGLFTRWR

SEQ ID NO: 393113 - protein, 9 aa, Homo Sapiens
IKGQGTVMA

SEQ ID NO: 393114 - protein, 9 aa, Homo Sapiens
GSWHPILPK

SEQ ID NO: 393115 - protein, 9 aa, Homo Sapiens
IINTEYEPT

SEQ ID NO: 393116 - protein, 9 aa, Homo Sapiens
VPIRASPHS

SEQ ID NO: 393117 - protein, 9 aa, Homo Sapiens
TKTISHFHY

SEQ ID NO: 393118 - protein, 9 aa, Homo Sapiens
QLGKGTEVP

SEQ ID NO: 393119 - protein, 9 aa, Homo Sapiens
FFFNFFQFC

SEQ ID NO: 393120 - protein, 9 aa, Homo Sapiens
VISSKRTSS

SEQ ID NO: 393121 - protein, 9 aa, Homo Sapiens
MHENLTYLQ

SEQ ID NO: 393122 - protein, 9 aa, Homo Sapiens
MIRVNSMSI

SEQ ID NO: 393123 - protein, 9 aa, Homo Sapiens
FVLVNLEVT

SEQ ID NO: 393124 - protein, 9 aa, Homo Sapiens
ALLRGLGLQ

SEQ ID NO: 393125 - protein, 9 aa, Homo Sapiens
LPSFSHRSL

SEQ ID NO: 393126 - protein, 9 aa, Homo Sapiens
VSVCEETSL

SEQ ID NO: 393127 - protein, 9 aa, Homo Sapiens
QSTEHQDLQ

SEQ ID NO: 393128 - protein, 9 aa, Homo Sapiens
LFPQPLTAW

SEQ ID NO: 393129 - protein, 9 aa, Homo Sapiens
PEGGLPSGN

SEQ ID NO: 393130 - protein, 9 aa, Homo Sapiens
SPKKQERNL

SEQ ID NO: 393131 - protein, 9 aa, Homo Sapiens
SEAEASLVD

SEQ ID NO: 393132 - protein, 9 aa, Homo Sapiens
NVKGSFYRK

SEQ ID NO: 393133 - protein, 9 aa, Homo Sapiens
KILYETVDI

SEQ ID NO: 393134 - protein, 9 aa, Homo Sapiens
QDVASVSSD

SEQ ID NO: 393135 - protein, 9 aa, Homo Sapiens
VDTKILILI

SEQ ID NO: 393136 - protein, 9 aa, Homo Sapiens
KSGPEIVNA

SEQ ID NO: 393137 - protein, 9 aa, Homo Sapiens
PWQPPPPAP

SEQ ID NO: 393138 - protein, 9 aa, Homo Sapiens
LIPKLTGSL

SEQ ID NO: 393139 - protein, 9 aa, Homo Sapiens
CDKAFRSKS

SEQ ID NO: 393140 - protein, 9 aa, Homo Sapiens
FQAPFLPRA

SEQ ID NO: 393141 - protein, 9 aa, Homo Sapiens
SVAWADHII

SEQ ID NO: 393142 - protein, 9 aa, Homo Sapiens
AAALKRHFT

SEQ ID NO: 393143 - protein, 9 aa, Homo Sapiens
PRQVREHVL

SEQ ID NO: 393144 - protein, 9 aa, Homo Sapiens
HSLKARGAL

SEQ ID NO: 393145 - protein, 9 aa, Homo Sapiens
LIPRFPRRV

SEQ ID NO: 393146 - protein, 9 aa, Homo Sapiens
WSLLFSQTR

SEQ ID NO: 393147 - protein, 9 aa, Homo Sapiens
RLNFFDTWA

SEQ ID NO: 393148 - protein, 9 aa, Homo Sapiens
PPRQVREHV

SEQ ID NO: 393149 - protein, 9 aa, Homo Sapiens
LWCPVGKKK

SEQ ID NO: 393150 - protein, 9 aa, Homo Sapiens
WVVPFISDV

SEQ ID NO: 393151 - protein, 9 aa, Homo Sapiens
LYQWSKSLS

SEQ ID NO: 393152 - protein, 9 aa, Homo Sapiens
VPVWILDNI

SEQ ID NO: 393153 - protein, 9 aa, Homo Sapiens
KLLRFFIHY

SEQ ID NO: 393154 - protein, 9 aa, Homo Sapiens
EEECRRQKE

SEQ ID NO: 393155 - protein, 9 aa, Homo Sapiens
TPGTTAEWP

SEQ ID NO: 393156 - protein, 9 aa, Homo Sapiens
EKEWATEKR

SEQ ID NO: 393157 - protein, 9 aa, Homo Sapiens
RREICAGTA

SEQ ID NO: 393158 - protein, 9 aa, Homo Sapiens
KPLCVYSEQ

SEQ ID NO: 393159 - protein, 9 aa, Homo Sapiens
NDVRILEQT

SEQ ID NO: 393160 - protein, 9 aa, Homo Sapiens
PSCSMSRHP

SEQ ID NO: 393161 - protein, 9 aa, Homo Sapiens
VPDFDYPPE

SEQ ID NO: 393162 - protein, 9 aa, Homo Sapiens
GFNKKRKKM

SEQ ID NO: 393163 - protein, 9 aa, Homo Sapiens
LLSLNAVGY

SEQ ID NO: 393164 - protein, 9 aa, Homo Sapiens
QSPGSGPVY

SEQ ID NO: 393165 - protein, 9 aa, Homo Sapiens
RTMILIPRF

SEQ ID NO: 393166 - protein, 9 aa, Homo Sapiens
WFSTLIKHT

SEQ ID NO: 393167 - protein, 9 aa, Homo Sapiens
ESRQHPSVE

SEQ ID NO: 393168 - protein, 9 aa, Homo Sapiens
CESWLRKDC

SEQ ID NO: 393169 - protein, 9 aa, Homo Sapiens
QASGSGFTS

SEQ ID NO: 393170 - protein, 9 aa, Homo Sapiens
RSTNITNGA

SEQ ID NO: 393171 - protein, 9 aa, Homo Sapiens
PSLPSAPPK

SEQ ID NO: 393172 - protein, 9 aa, Homo Sapiens
VSCSHTNLC

SEQ ID NO: 393173 - protein, 9 aa, Homo Sapiens
SSHACVQKV

SEQ ID NO: 393174 - protein, 9 aa, Homo Sapiens
RGTLFTRRA

SEQ ID NO: 393175 - protein, 9 aa, Homo Sapiens
AQNVFHTNP

SEQ ID NO: 393176 - protein, 9 aa, Homo Sapiens
KRKCVRDCE

SEQ ID NO: 393177 - protein, 9 aa, Homo Sapiens
NSVSTTCYY

SEQ ID NO: 393178 - protein, 9 aa, Homo Sapiens
FLISPHSSP

SEQ ID NO: 393179 - protein, 9 aa, Homo Sapiens
FRFFHVLFF

SEQ ID NO: 393180 - protein, 9 aa, Homo Sapiens
KGFVASPGR

SEQ ID NO: 393181 - protein, 9 aa, Homo Sapiens
FIDKDKDNV

SEQ ID NO: 393182 - protein, 9 aa, Homo Sapiens
TFMLGAILR

SEQ ID NO: 393183 - protein, 9 aa, Homo Sapiens
TEIQLTMND

SEQ ID NO: 393184 - protein, 9 aa, Homo Sapiens
KVPLDYIGH

SEQ ID NO: 393185 - protein, 9 aa, Homo Sapiens
NLLHAMPSG

SEQ ID NO: 393186 - protein, 9 aa, Homo Sapiens
TVLGQPGVR

SEQ ID NO: 393187 - protein, 9 aa, Homo Sapiens
ATFRGAHLR

SEQ ID NO: 393188 - protein, 9 aa, Homo Sapiens
EEKKDSAVA

SEQ ID NO: 393189 - protein, 9 aa, Homo Sapiens
REHQRIYTG

SEQ ID NO: 393190 - protein, 9 aa, Homo Sapiens
SYSCKCVAG

SEQ ID NO: 393191 - protein, 9 aa, Homo Sapiens
VGQRTLVIL

SEQ ID NO: 393192 - protein, 9 aa, Homo Sapiens
AKKTCSKAT

SEQ ID NO: 393193 - protein, 9 aa, Homo Sapiens
HPGSSLFPG

SEQ ID NO: 393194 - protein, 9 aa, Homo Sapiens
PSPLWLRLH

SEQ ID NO: 393195 - protein, 9 aa, Homo Sapiens
MGPHVPRQL

SEQ ID NO: 393196 - protein, 9 aa, Homo Sapiens
KIEEKKAQT

SEQ ID NO: 393197 - protein, 9 aa, Homo Sapiens
LGSRGASGT

SEQ ID NO: 393198 - protein, 9 aa, Homo Sapiens
SLELEKDMH

SEQ ID NO: 393199 - protein, 9 aa, Homo Sapiens
LCMGLKSWI

SEQ ID NO: 393200 - protein, 9 aa, Homo Sapiens
SPRLRFCAW

SEQ ID NO: 393201 - protein, 9 aa, Homo Sapiens
QFVSWIVME

SEQ ID NO: 393202 - protein, 9 aa, Homo Sapiens
ALGSMVGLS

SEQ ID NO: 393203 - protein, 9 aa, Homo Sapiens
LQARNNAHV

SEQ ID NO: 393204 - protein, 9 aa, Homo Sapiens
ASEEEDTKL

SEQ ID NO: 393205 - protein, 9 aa, Homo Sapiens
LALDVAVQV

SEQ ID NO: 393206 - protein, 9 aa, Homo Sapiens
LWSLLFSQT

SEQ ID NO: 393207 - protein, 9 aa, Homo Sapiens
ARLERDQPC

SEQ ID NO: 393208 - protein, 9 aa, Homo Sapiens
APFLPRALM

SEQ ID NO: 393209 - protein, 9 aa, Homo Sapiens
KKNPGFAAA

SEQ ID NO: 393210 - protein, 9 aa, Homo Sapiens
IFVSSADGY

SEQ ID NO: 393211 - protein, 9 aa, Homo Sapiens
LLPAPSALV

SEQ ID NO: 393212 - protein, 9 aa, Homo Sapiens
GCTKKLRSP

SEQ ID NO: 393213 - protein, 9 aa, Homo Sapiens
PVSGLSKGE

SEQ ID NO: 393214 - protein, 9 aa, Homo Sapiens
QPAECQSLL

SEQ ID NO: 393215 - protein, 9 aa, Homo Sapiens
VKKGSVFNM

SEQ ID NO: 393216 - protein, 9 aa, Homo Sapiens
TRSTRSTRG

SEQ ID NO: 393217 - protein, 9 aa, Homo Sapiens
LCLFSLSNP

SEQ ID NO: 393218 - protein, 9 aa, Homo Sapiens
GTTSFTRRS

SEQ ID NO: 393219 - protein, 9 aa, Homo Sapiens
AGFRFFHVL

SEQ ID NO: 393220 - protein, 9 aa, Homo Sapiens
SANWNASFS

SEQ ID NO: 393221 - protein, 9 aa, Homo Sapiens
LALPALLPA

SEQ ID NO: 393222 - protein, 9 aa, Homo Sapiens
PIIKLLCVT

SEQ ID NO: 393223 - protein, 9 aa, Homo Sapiens
AILSSNSEI

SEQ ID NO: 393224 - protein, 9 aa, Homo Sapiens
YSGPSFSPW

SEQ ID NO: 393225 - protein, 9 aa, Homo Sapiens
DPKMLSKKG

SEQ ID NO: 393226 - protein, 9 aa, Homo Sapiens
HKSMIQMKT

SEQ ID NO: 393227 - protein, 9 aa, Homo Sapiens
IGEHLLVIF

SEQ ID NO: 393228 - protein, 9 aa, Homo Sapiens
PSGPGKSAV

SEQ ID NO: 393229 - protein, 9 aa, Homo Sapiens
MGHGVTYTV

SEQ ID NO: 393230 - protein, 9 aa, Homo Sapiens
PWIKFRSVS

SEQ ID NO: 393231 - protein, 9 aa, Homo Sapiens
TGKNPMHIF

SEQ ID NO: 393232 - protein, 9 aa, Homo Sapiens
PPRMKDPRV

SEQ ID NO: 393233 - protein, 9 aa, Homo Sapiens
LINNINGRL

SEQ ID NO: 393234 - protein, 9 aa, Homo Sapiens
MASTAKSAE

SEQ ID NO: 393235 - protein, 9 aa, Homo Sapiens
CQVRPPPGP

SEQ ID NO: 393236 - protein, 9 aa, Homo Sapiens
YPIQQVACG

SEQ ID NO: 393237 - protein, 9 aa, Homo Sapiens
AEFPSAKKT

SEQ ID NO: 393238 - protein, 9 aa, Homo Sapiens
QRNLLRLQS

SEQ ID NO: 393239 - protein, 9 aa, Homo Sapiens
GCDEGDAWL

SEQ ID NO: 393240 - protein, 9 aa, Homo Sapiens
CSLQCLCCE

SEQ ID NO: 393241 - protein, 9 aa, Homo Sapiens
NSALLVSTS

SEQ ID NO: 393242 - protein, 9 aa, Homo Sapiens
GPGGAPGPL

SEQ ID NO: 393243 - protein, 9 aa, Homo Sapiens
RPTAAYWGP

SEQ ID NO: 393244 - protein, 9 aa, Homo Sapiens
PRWREAVEL

SEQ ID NO: 393245 - protein, 9 aa, Homo Sapiens
ATMINDSDY

SEQ ID NO: 393246 - protein, 9 aa, Homo Sapiens
HEHKKKHWE

SEQ ID NO: 393247 - protein, 9 aa, Homo Sapiens
RPTGRPLCH

SEQ ID NO: 393248 - protein, 9 aa, Homo Sapiens
IYQPWEPLH

SEQ ID NO: 393249 - protein, 9 aa, Homo Sapiens
RKIHVLLAR

SEQ ID NO: 393250 - protein, 9 aa, Homo Sapiens
LLIQSVMAS

SEQ ID NO: 393251 - protein, 9 aa, Homo Sapiens
WVEEWYNDS

SEQ ID NO: 393252 - protein, 9 aa, Homo Sapiens
ATLHYPSTT

SEQ ID NO: 393253 - protein, 9 aa, Homo Sapiens
RSSGKKIAF

SEQ ID NO: 393254 - protein, 9 aa, Homo Sapiens
LHLVQVDLP

SEQ ID NO: 393255 - protein, 9 aa, Homo Sapiens
AWKCVCKWA

SEQ ID NO: 393256 - protein, 9 aa, Homo Sapiens
LVQVDLPVG

SEQ ID NO: 393257 - protein, 9 aa, Homo Sapiens
CQHRELING

SEQ ID NO: 393258 - protein, 9 aa, Homo Sapiens
QALKNPMFL

SEQ ID NO: 393259 - protein, 9 aa, Homo Sapiens
LASVVIHKA

SEQ ID NO: 393260 - protein, 9 aa, Homo Sapiens
REEDEGTSS

SEQ ID NO: 393261 - protein, 9 aa, Homo Sapiens
LTHSTVLKA

SEQ ID NO: 393262 - protein, 9 aa, Homo Sapiens
VGDKVWVNL

SEQ ID NO: 393263 - protein, 9 aa, Homo Sapiens
AALDGGPWA

SEQ ID NO: 393264 - protein, 9 aa, Homo Sapiens
RVLAQPAAF

SEQ ID NO: 393265 - protein, 9 aa, Homo Sapiens
ALDVAVQVV

SEQ ID NO: 393266 - protein, 9 aa, Homo Sapiens
PARSPTSAP

SEQ ID NO: 393267 - protein, 9 aa, Homo Sapiens
PCGQPTHCS

SEQ ID NO: 393268 - protein, 9 aa, Homo Sapiens
PAIKSTAEK

SEQ ID NO: 393269 - protein, 9 aa, Homo Sapiens
SSRRCSVPG

SEQ ID NO: 393270 - protein, 9 aa, Homo Sapiens
KRYGYASVF

SEQ ID NO: 393271 - protein, 9 aa, Homo Sapiens
LDAPPANLG

SEQ ID NO: 393272 - protein, 9 aa, Homo Sapiens
ERTMILIPR

SEQ ID NO: 393273 - protein, 9 aa, Homo Sapiens
EQTRLLSRD

SEQ ID NO: 393274 - protein, 9 aa, Homo Sapiens
HCQHLVDQC

SEQ ID NO: 393275 - protein, 9 aa, Homo Sapiens
KLADAILSS

SEQ ID NO: 393276 - protein, 9 aa, Homo Sapiens
EKVLKIHKS

SEQ ID NO: 393277 - protein, 9 aa, Homo Sapiens
APPTCSLFP

SEQ ID NO: 393278 - protein, 9 aa, Homo Sapiens
MQEEERENS

SEQ ID NO: 393279 - protein, 9 aa, Homo Sapiens
KKARKKPAR

SEQ ID NO: 393280 - protein, 9 aa, Homo Sapiens
LFGYPIQQV

SEQ ID NO: 393281 - protein, 9 aa, Homo Sapiens
GMTELTDPH

SEQ ID NO: 393282 - protein, 9 aa, Homo Sapiens
QSCIHQPCG

SEQ ID NO: 393283 - protein, 9 aa, Homo Sapiens
QIINTEYEP

SEQ ID NO: 393284 - protein, 9 aa, Homo Sapiens
LRTPWVGYV

SEQ ID NO: 393285 - protein, 9 aa, Homo Sapiens
KVTFKASPR

SEQ ID NO: 393286 - protein, 9 aa, Homo Sapiens
SLRKKMLNG

SEQ ID NO: 393287 - protein, 9 aa, Homo Sapiens
EAEASLVDQ

SEQ ID NO: 393288 - protein, 9 aa, Homo Sapiens
EETVTRRML

SEQ ID NO: 393289 - protein, 9 aa, Homo Sapiens
KTILKERRL

SEQ ID NO: 393290 - protein, 9 aa, Homo Sapiens
SSLFPGGPN

SEQ ID NO: 393291 - protein, 9 aa, Homo Sapiens
LCVYSEQAE

SEQ ID NO: 393292 - protein, 9 aa, Homo Sapiens
VPSLPSAPP

SEQ ID NO: 393293 - protein, 9 aa, Homo Sapiens
SAFNNLKNC

SEQ ID NO: 393294 - protein, 9 aa, Homo Sapiens
LQWGRCLLL

SEQ ID NO: 393295 - protein, 9 aa, Homo Sapiens
PQPLSSLLQ

SEQ ID NO: 393296 - protein, 9 aa, Homo Sapiens
DEVVTLTPH

SEQ ID NO: 393297 - protein, 9 aa, Homo Sapiens
VNDVRILEQ

SEQ ID NO: 393298 - protein, 9 aa, Homo Sapiens
AAPASSHVA

SEQ ID NO: 393299 - protein, 9 aa, Homo Sapiens
TSLTTITTL

SEQ ID NO: 393300 - protein, 9 aa, Homo Sapiens
YYLVQQTIQ

SEQ ID NO: 393301 - protein, 9 aa, Homo Sapiens
SGPSPAPSA

SEQ ID NO: 393302 - protein, 9 aa, Homo Sapiens
RVSPVRNSP

SEQ ID NO: 393303 - protein, 9 aa, Homo Sapiens
SSDPSSSVF

SEQ ID NO: 393304 - protein, 9 aa, Homo Sapiens
VITDQHRNG

SEQ ID NO: 393305 - protein, 9 aa, Homo Sapiens
SGLGAPPTC

SEQ ID NO: 393306 - protein, 9 aa, Homo Sapiens
LRGVWSLEA

SEQ ID NO: 393307 - protein, 9 aa, Homo Sapiens
GRASQDGPP

SEQ ID NO: 393308 - protein, 9 aa, Homo Sapiens
VIYDGEVCA

SEQ ID NO: 393309 - protein, 9 aa, Homo Sapiens
SWGWSQQKE

SEQ ID NO: 393310 - protein, 9 aa, Homo Sapiens
SNRSHQPKS

SEQ ID NO: 393311 - protein, 9 aa, Homo Sapiens
IGVSQSQLV

SEQ ID NO: 393312 - protein, 9 aa, Homo Sapiens
GARRPLRRL

SEQ ID NO: 393313 - protein, 9 aa, Homo Sapiens
MEKYLKKQK

SEQ ID NO: 393314 - protein, 9 aa, Homo Sapiens
VAVDAQVGP

SEQ ID NO: 393315 - protein, 9 aa, Homo Sapiens
RNVQLVTGW

SEQ ID NO: 393316 - protein, 9 aa, Homo Sapiens
RAMMQELHA

SEQ ID NO: 393317 - protein, 9 aa, Homo Sapiens
QKMQSRMDQ

SEQ ID NO: 393318 - protein, 9 aa, Homo Sapiens
VTASSHHYV

SEQ ID NO: 393319 - protein, 9 aa, Homo Sapiens
MDQWMDKET

SEQ ID NO: 393320 - protein, 9 aa, Homo Sapiens
TNLSSSLTL

SEQ ID NO: 393321 - protein, 9 aa, Homo Sapiens
PLVYLSFAA

SEQ ID NO: 393322 - protein, 9 aa, Homo Sapiens
LEQQMIFAP

SEQ ID NO: 393323 - protein, 9 aa, Homo Sapiens
AALICLTPS

SEQ ID NO: 393324 - protein, 9 aa, Homo Sapiens
ESHGFNTEV

SEQ ID NO: 393325 - protein, 9 aa, Homo Sapiens
CLAQLAIPA

SEQ ID NO: 393326 - protein, 9 aa, Homo Sapiens
VAISTFMLG

SEQ ID NO: 393327 - protein, 9 aa, Homo Sapiens
LLLPGTPKL

SEQ ID NO: 393328 - protein, 9 aa, Homo Sapiens
GLAHDSEEL

SEQ ID NO: 393329 - protein, 9 aa, Homo Sapiens
ASYSENKAF

SEQ ID NO: 393330 - protein, 9 aa, Homo Sapiens
FTCDTDFLC

SEQ ID NO: 393331 - protein, 9 aa, Homo Sapiens
RLQHHFSVF

SEQ ID NO: 393332 - protein, 9 aa, Homo Sapiens
EVVVVHELG

SEQ ID NO: 393333 - protein, 9 aa, Homo Sapiens
DLFTDDSYV

SEQ ID NO: 393334 - protein, 9 aa, Homo Sapiens
LWLRLHPGA

SEQ ID NO: 393335 - protein, 9 aa, Homo Sapiens
PHWTLSPQG

SEQ ID NO: 393336 - protein, 9 aa, Homo Sapiens
LISWRMEAH

SEQ ID NO: 393337 - protein, 9 aa, Homo Sapiens
KPIKDQLGP

SEQ ID NO: 393338 - protein, 9 aa, Homo Sapiens
TRETLESGG

SEQ ID NO: 393339 - protein, 9 aa, Homo Sapiens
LVALSWRGA

SEQ ID NO: 393340 - protein, 9 aa, Homo Sapiens
LAKMIAGIP

SEQ ID NO: 393341 - protein, 9 aa, Homo Sapiens
RSFMKLYHS

SEQ ID NO: 393342 - protein, 9 aa, Homo Sapiens
HHRIHARES

SEQ ID NO: 393343 - protein, 9 aa, Homo Sapiens
VQVDLPVGL

SEQ ID NO: 393344 - protein, 9 aa, Homo Sapiens
KQKHPENDL

SEQ ID NO: 393345 - protein, 9 aa, Homo Sapiens
PWPPSFSAP

SEQ ID NO: 393346 - protein, 9 aa, Homo Sapiens
IYAPLGRSA

SEQ ID NO: 393347 - protein, 9 aa, Homo Sapiens
KRPGGHPEV

SEQ ID NO: 393348 - protein, 9 aa, Homo Sapiens
AKPSARSPT

SEQ ID NO: 393349 - protein, 9 aa, Homo Sapiens
RLCKQCPVF

SEQ ID NO: 393350 - protein, 9 aa, Homo Sapiens
PSFSHRSLA

SEQ ID NO: 393351 - protein, 9 aa, Homo Sapiens
VYQTPAQDT

SEQ ID NO: 393352 - protein, 9 aa, Homo Sapiens
LKAFAQAGA

SEQ ID NO: 393353 - protein, 9 aa, Homo Sapiens
QGGASSAKR

SEQ ID NO: 393354 - protein, 9 aa, Homo Sapiens
HRHYASPEI

SEQ ID NO: 393355 - protein, 9 aa, Homo Sapiens
RGWRSRCPS

SEQ ID NO: 393356 - protein, 9 aa, Homo Sapiens
GPGSTSSTI

SEQ ID NO: 393357 - protein, 9 aa, Homo Sapiens
IAAALKRHF

SEQ ID NO: 393358 - protein, 9 aa, Homo Sapiens
QRGRHSQGD

SEQ ID NO: 393359 - protein, 9 aa, Homo Sapiens
KRIRSDPDA

SEQ ID NO: 393360 - protein, 9 aa, Homo Sapiens
KEKKEEGKE

SEQ ID NO: 393361 - protein, 9 aa, Homo Sapiens
YGYASVFLS

SEQ ID NO: 393362 - protein, 9 aa, Homo Sapiens
TKEGCHKKT

SEQ ID NO: 393363 - protein, 9 aa, Homo Sapiens
AEGRGPQTN

SEQ ID NO: 393364 - protein, 9 aa, Homo Sapiens
SSYLGQEVI

SEQ ID NO: 393365 - protein, 9 aa, Homo Sapiens
RPAPARPAG

SEQ ID NO: 393366 - protein, 9 aa, Homo Sapiens
YRWLSLFDF

SEQ ID NO: 393367 - protein, 9 aa, Homo Sapiens
SSRASSTSR

SEQ ID NO: 393368 - protein, 9 aa, Homo Sapiens
NEAHTVVFY

SEQ ID NO: 393369 - protein, 9 aa, Homo Sapiens
SLQERGGVA

SEQ ID NO: 393370 - protein, 9 aa, Homo Sapiens
AQVEGEDVL

SEQ ID NO: 393371 - protein, 9 aa, Homo Sapiens
CAWPSAISP

SEQ ID NO: 393372 - protein, 9 aa, Homo Sapiens
GGIGVGNGP

SEQ ID NO: 393373 - protein, 9 aa, Homo Sapiens
DDNGVMPTI

SEQ ID NO: 393374 - protein, 9 aa, Homo Sapiens
KLSDFNDVT

SEQ ID NO: 393375 - protein, 9 aa, Homo Sapiens
AFYDCLLAE

SEQ ID NO: 393376 - protein, 9 aa, Homo Sapiens
EAHTVVFYH

SEQ ID NO: 393377 - protein, 9 aa, Homo Sapiens
GFVASPGRR

SEQ ID NO: 393378 - protein, 9 aa, Homo Sapiens
SFLVGDPSP

SEQ ID NO: 393379 - protein, 9 aa, Homo Sapiens
WSFLVGDPS

SEQ ID NO: 393380 - protein, 9 aa, Homo Sapiens
LHFDTAQGR

SEQ ID NO: 393381 - protein, 9 aa, Homo Sapiens
LLGLLTECL

SEQ ID NO: 393382 - protein, 9 aa, Homo Sapiens
CVIIPPGSS

SEQ ID NO: 393383 - protein, 9 aa, Homo Sapiens
PQDHLTGLA

SEQ ID NO: 393384 - protein, 9 aa, Homo Sapiens
RTLESTWEN

SEQ ID NO: 393385 - protein, 9 aa, Homo Sapiens
LKNLSWLSK

SEQ ID NO: 393386 - protein, 9 aa, Homo Sapiens
LKYLLMQHL

SEQ ID NO: 393387 - protein, 9 aa, Homo Sapiens
ASPHPEETV

SEQ ID NO: 393388 - protein, 9 aa, Homo Sapiens
PSRAGQKPM

SEQ ID NO: 393389 - protein, 9 aa, Homo Sapiens
NVISSKRTS

SEQ ID NO: 393390 - protein, 9 aa, Homo Sapiens
LILIMKVNF

SEQ ID NO: 393391 - protein, 9 aa, Homo Sapiens
NCSSSSWQA

SEQ ID NO: 393392 - protein, 9 aa, Homo Sapiens
SMHTVIVQD

SEQ ID NO: 393393 - protein, 9 aa, Homo Sapiens
ASTFGSRST

SEQ ID NO: 393394 - protein, 9 aa, Homo Sapiens
SREGQSGWS

SEQ ID NO: 393395 - protein, 9 aa, Homo Sapiens
GYLSEAEAS

SEQ ID NO: 393396 - protein, 9 aa, Homo Sapiens
HGTRGTTFT

SEQ ID NO: 393397 - protein, 9 aa, Homo Sapiens
CESDVNPPV

SEQ ID NO: 393398 - protein, 9 aa, Homo Sapiens
QGLVCLILG

SEQ ID NO: 393399 - protein, 9 aa, Homo Sapiens
AGERQIYRR

SEQ ID NO: 393400 - protein, 9 aa, Homo Sapiens
IKKAYMQEE

SEQ ID NO: 393401 - protein, 9 aa, Homo Sapiens
RAGSGALFA

SEQ ID NO: 393402 - protein, 9 aa, Homo Sapiens
SSLTRQADH

SEQ ID NO: 393403 - protein, 9 aa, Homo Sapiens
ISPSSPGLT

SEQ ID NO: 393404 - protein, 9 aa, Homo Sapiens
SLLQGEGPS

SEQ ID NO: 393405 - protein, 9 aa, Homo Sapiens
PMARTSGSQ

SEQ ID NO: 393406 - protein, 9 aa, Homo Sapiens
STPASPGNR

SEQ ID NO: 393407 - protein, 9 aa, Homo Sapiens
RRLRVTRHP

SEQ ID NO: 393408 - protein, 9 aa, Homo Sapiens
GASRALFTS

SEQ ID NO: 393409 - protein, 9 aa, Homo Sapiens
LWSICFAVH

SEQ ID NO: 393410 - protein, 9 aa, Homo Sapiens
GTGTASQGL

SEQ ID NO: 393411 - protein, 9 aa, Homo Sapiens
FLAMNYNLS

SEQ ID NO: 393412 - protein, 9 aa, Homo Sapiens
PLKFKLALK

SEQ ID NO: 393413 - protein, 9 aa, Homo Sapiens
SCSVPTGDI

SEQ ID NO: 393414 - protein, 9 aa, Homo Sapiens
IFYSACMVL

SEQ ID NO: 393415 - protein, 9 aa, Homo Sapiens
CIPTKRRRR

SEQ ID NO: 393416 - protein, 9 aa, Homo Sapiens
GEIVITDQH

SEQ ID NO: 393417 - protein, 9 aa, Homo Sapiens
TAWGLPRLT

SEQ ID NO: 393418 - protein, 9 aa, Homo Sapiens
EPLPPRSPR

SEQ ID NO: 393419 - protein, 9 aa, Homo Sapiens
ASSHHYVDR

SEQ ID NO: 393420 - protein, 9 aa, Homo Sapiens
EEPSQNDED

SEQ ID NO: 393421 - protein, 9 aa, Homo Sapiens
DEILQTGLV

SEQ ID NO: 393422 - protein, 9 aa, Homo Sapiens
CEGLTHGVA

SEQ ID NO: 393423 - protein, 9 aa, Homo Sapiens
NLAAKLCNI

SEQ ID NO: 393424 - protein, 9 aa, Homo Sapiens
CIKVDWQRV

SEQ ID NO: 393425 - protein, 9 aa, Homo Sapiens
YLCPKNKLL

SEQ ID NO: 393426 - protein, 9 aa, Homo Sapiens
ICLTPSVPP

SEQ ID NO: 393427 - protein, 9 aa, Homo Sapiens
ALKLTRRQS

SEQ ID NO: 393428 - protein, 9 aa, Homo Sapiens
ARGARLTTH

SEQ ID NO: 393429 - protein, 9 aa, Homo Sapiens
KTEEENADS

SEQ ID NO: 393430 - protein, 9 aa, Homo Sapiens
MMSLAALQV

SEQ ID NO: 393431 - protein, 9 aa, Homo Sapiens
EASSLQHQA

SEQ ID NO: 393432 - protein, 9 aa, Homo Sapiens
KTHGEVERH

SEQ ID NO: 393433 - protein, 9 aa, Homo Sapiens
HACVQKVTS

SEQ ID NO: 393434 - protein, 9 aa, Homo Sapiens
EVKKVEQDT

SEQ ID NO: 393435 - protein, 9 aa, Homo Sapiens
HCQMSGTSG

SEQ ID NO: 393436 - protein, 9 aa, Homo Sapiens
RVGRPQFDD

SEQ ID NO: 393437 - protein, 9 aa, Homo Sapiens
PLPLPPTQP

SEQ ID NO: 393438 - protein, 9 aa, Homo Sapiens
TDVTKIGIP

SEQ ID NO: 393439 - protein, 9 aa, Homo Sapiens
GVSSSEEVI

SEQ ID NO: 393440 - protein, 9 aa, Homo Sapiens
SDAGCIFME

SEQ ID NO: 393441 - protein, 9 aa, Homo Sapiens
RDIPQGVTR

SEQ ID NO: 393442 - protein, 9 aa, Homo Sapiens
MTVTHMWFD

SEQ ID NO: 393443 - protein, 9 aa, Homo Sapiens
KKKRKRRSK

SEQ ID NO: 393444 - protein, 9 aa, Homo Sapiens
LLRNRCFPE

SEQ ID NO: 393445 - protein, 9 aa, Homo Sapiens
SHFSNKRKC

SEQ ID NO: 393446 - protein, 9 aa, Homo Sapiens
CRRQKERYE

SEQ ID NO: 393447 - protein, 9 aa, Homo Sapiens
GIFTSKKDT

SEQ ID NO: 393448 - protein, 9 aa, Homo Sapiens
VPRARVIRG

SEQ ID NO: 393449 - protein, 9 aa, Homo Sapiens
LAIIRDDIN

SEQ ID NO: 393450 - protein, 9 aa, Homo Sapiens
PLSSLLQDT

SEQ ID NO: 393451 - protein, 9 aa, Homo Sapiens
HIVIRWLWA

SEQ ID NO: 393452 - protein, 9 aa, Homo Sapiens
LQWLEDRAR

SEQ ID NO: 393453 - protein, 9 aa, Homo Sapiens
VAADEQGVF

SEQ ID NO: 393454 - protein, 9 aa, Homo Sapiens
ACECPNPSR

SEQ ID NO: 393455 - protein, 9 aa, Homo Sapiens
IIISLLGMQ

SEQ ID NO: 393456 - protein, 9 aa, Homo Sapiens
TAWSPWTPS

SEQ ID NO: 393457 - protein, 9 aa, Homo Sapiens
PKCLTSQSQ

SEQ ID NO: 393458 - protein, 9 aa, Homo Sapiens
HSTTARNTA

SEQ ID NO: 393459 - protein, 9 aa, Homo Sapiens
SVREECIPT

SEQ ID NO: 393460 - protein, 9 aa, Homo Sapiens
GCVSWSSPM

SEQ ID NO: 393461 - protein, 9 aa, Homo Sapiens
LTVTRCFSQ

SEQ ID NO: 393462 - protein, 9 aa, Homo Sapiens
APQAVPSLP

SEQ ID NO: 393463 - protein, 9 aa, Homo Sapiens
SAKKTCSKA

SEQ ID NO: 393464 - protein, 9 aa, Homo Sapiens
RNLHPPRMK

SEQ ID NO: 393465 - protein, 9 aa, Homo Sapiens
TLGTFRASG

SEQ ID NO: 393466 - protein, 9 aa, Homo Sapiens
LGSLRLNCP

SEQ ID NO: 393467 - protein, 9 aa, Homo Sapiens
LLLLDLPIL

SEQ ID NO: 393468 - protein, 9 aa, Homo Sapiens
RARVIRGLD

SEQ ID NO: 393469 - protein, 9 aa, Homo Sapiens
GNIPGAGMD

SEQ ID NO: 393470 - protein, 9 aa, Homo Sapiens
ASTRASGPT

SEQ ID NO: 393471 - protein, 9 aa, Homo Sapiens
IVPVWILDN

SEQ ID NO: 393472 - protein, 9 aa, Homo Sapiens
KRTPQQVVA

SEQ ID NO: 393473 - protein, 9 aa, Homo Sapiens
EKVDDRRSC

SEQ ID NO: 393474 - protein, 9 aa, Homo Sapiens
VFDVESLEL

SEQ ID NO: 393475 - protein, 9 aa, Homo Sapiens
PYLKNFTVG

SEQ ID NO: 393476 - protein, 9 aa, Homo Sapiens
PPPPTCSPP

SEQ ID NO: 393477 - protein, 9 aa, Homo Sapiens
LKQRAEDPP

SEQ ID NO: 393478 - protein, 9 aa, Homo Sapiens
RFVFTYEGL

SEQ ID NO: 393479 - protein, 9 aa, Homo Sapiens
EKGEAEEAL

SEQ ID NO: 393480 - protein, 9 aa, Homo Sapiens
HRDIPQGVT

SEQ ID NO: 393481 - protein, 9 aa, Homo Sapiens
QGGRILLQR

SEQ ID NO: 393482 - protein, 9 aa, Homo Sapiens
ADWFLSASV

SEQ ID NO: 393483 - protein, 9 aa, Homo Sapiens
DKPVTPSNV

SEQ ID NO: 393484 - protein, 9 aa, Homo Sapiens
KEVPEFTKI

SEQ ID NO: 393485 - protein, 9 aa, Homo Sapiens
VDEEQKLPR

SEQ ID NO: 393486 - protein, 9 aa, Homo Sapiens
DCYWFENTR

SEQ ID NO: 393487 - protein, 9 aa, Homo Sapiens
LVAELALVG

SEQ ID NO: 393488 - protein, 9 aa, Homo Sapiens
TLESFDQKV

SEQ ID NO: 393489 - protein, 9 aa, Homo Sapiens
QDFLQAKPE

SEQ ID NO: 393490 - protein, 9 aa, Homo Sapiens
RQQAPPDPA

SEQ ID NO: 393491 - protein, 9 aa, Homo Sapiens
PHVDFQLVL

SEQ ID NO: 393492 - protein, 9 aa, Homo Sapiens
HTSLTTGTR

SEQ ID NO: 393493 - protein, 9 aa, Homo Sapiens
IRVNSMSII

SEQ ID NO: 393494 - protein, 9 aa, Homo Sapiens
SMGGGGDAT

SEQ ID NO: 393495 - protein, 9 aa, Homo Sapiens
LKPFSCDEC

SEQ ID NO: 393496 - protein, 9 aa, Homo Sapiens
NILKTALKL

SEQ ID NO: 393497 - protein, 9 aa, Homo Sapiens
WQSGGRRLL

SEQ ID NO: 393498 - protein, 9 aa, Homo Sapiens
YNISNTNSC

SEQ ID NO: 393499 - protein, 9 aa, Homo Sapiens
RWFSQKASL

SEQ ID NO: 393500 - protein, 9 aa, Homo Sapiens
RTRINKLNS

SEQ ID NO: 393501 - protein, 9 aa, Homo Sapiens
TSIAFSTSI

SEQ ID NO: 393502 - protein, 9 aa, Homo Sapiens
IYRRYCMER

SEQ ID NO: 393503 - protein, 9 aa, Homo Sapiens
FRRKRRSSW

SEQ ID NO: 393504 - protein, 9 aa, Homo Sapiens
SNTRSTIGT

SEQ ID NO: 393505 - protein, 9 aa, Homo Sapiens
SNLVRLMGP

SEQ ID NO: 393506 - protein, 9 aa, Homo Sapiens
GKHTPLYEW

SEQ ID NO: 393507 - protein, 9 aa, Homo Sapiens
GEVCAASER

SEQ ID NO: 393508 - protein, 9 aa, Homo Sapiens
ARSPTWCRT

SEQ ID NO: 393509 - protein, 9 aa, Homo Sapiens
HPEETVTVT

SEQ ID NO: 393510 - protein, 9 aa, Homo Sapiens
NPAGGSRAR

SEQ ID NO: 393511 - protein, 9 aa, Homo Sapiens
WPPALWAPA

SEQ ID NO: 393512 - protein, 9 aa, Homo Sapiens
VMASSADAD

SEQ ID NO: 393513 - protein, 9 aa, Homo Sapiens
ICNHMHFHY

SEQ ID NO: 393514 - protein, 9 aa, Homo Sapiens
PWGSLSSHR

SEQ ID NO: 393515 - protein, 9 aa, Homo Sapiens
GLFGDKGLK

SEQ ID NO: 393516 - protein, 9 aa, Homo Sapiens
TQAPRLLSR

SEQ ID NO: 393517 - protein, 9 aa, Homo Sapiens
PLTIGEKTE

SEQ ID NO: 393518 - protein, 9 aa, Homo Sapiens
AAEGPAAPG

SEQ ID NO: 393519 - protein, 9 aa, Homo Sapiens
PPQQIYPPI

SEQ ID NO: 393520 - protein, 9 aa, Homo Sapiens
KKKHWEKEM

SEQ ID NO: 393521 - protein, 9 aa, Homo Sapiens
KSAVPIPST

SEQ ID NO: 393522 - protein, 9 aa, Homo Sapiens
AGGTRGPGS

SEQ ID NO: 393523 - protein, 9 aa, Homo Sapiens
VWSVIASPF

SEQ ID NO: 393524 - protein, 9 aa, Homo Sapiens
GANRADRTG

SEQ ID NO: 393525 - protein, 9 aa, Homo Sapiens
SKKKYFPLS

SEQ ID NO: 393526 - protein, 9 aa, Homo Sapiens
LSLSSPPTV

SEQ ID NO: 393527 - protein, 9 aa, Homo Sapiens
NISTSSNPA

SEQ ID NO: 393528 - protein, 9 aa, Homo Sapiens
PTSAPTAAK

SEQ ID NO: 393529 - protein, 9 aa, Homo Sapiens
SNIDTLLDK

SEQ ID NO: 393530 - protein, 9 aa, Homo Sapiens
SSKTKDASS

SEQ ID NO: 393531 - protein, 9 aa, Homo Sapiens
PGTPGGFSK

SEQ ID NO: 393532 - protein, 9 aa, Homo Sapiens
LTDRAKVWT

SEQ ID NO: 393533 - protein, 9 aa, Homo Sapiens
ILKTALKLT

SEQ ID NO: 393534 - protein, 9 aa, Homo Sapiens
DFQLVLPGE

SEQ ID NO: 393535 - protein, 9 aa, Homo Sapiens
LSLPLPPKN

SEQ ID NO: 393536 - protein, 9 aa, Homo Sapiens
LEVANDPLY

SEQ ID NO: 393537 - protein, 9 aa, Homo Sapiens
LFLLQMAIA

SEQ ID NO: 393538 - protein, 9 aa, Homo Sapiens
VIHKAATVF

SEQ ID NO: 393539 - protein, 9 aa, Homo Sapiens
LTAWGLPRL

SEQ ID NO: 393540 - protein, 9 aa, Homo Sapiens
GIANYNISS

SEQ ID NO: 393541 - protein, 9 aa, Homo Sapiens
ESTIFQMLI

SEQ ID NO: 393542 - protein, 9 aa, Homo Sapiens
VSTTCYYPP

SEQ ID NO: 393543 - protein, 9 aa, Homo Sapiens
TKREPNKFF

SEQ ID NO: 393544 - protein, 9 aa, Homo Sapiens
LSEVLQVVT

SEQ ID NO: 393545 - protein, 9 aa, Homo Sapiens
ISGRSRKER

SEQ ID NO: 393546 - protein, 9 aa, Homo Sapiens
GSPQIQASW

SEQ ID NO: 393547 - protein, 9 aa, Homo Sapiens
HLMEKKINN

SEQ ID NO: 393548 - protein, 9 aa, Homo Sapiens
SVFNMWKPM

SEQ ID NO: 393549 - protein, 9 aa, Homo Sapiens
MVRAHAWSQ

SEQ ID NO: 393550 - protein, 9 aa, Homo Sapiens
TSSFCCCTQ

SEQ ID NO: 393551 - protein, 9 aa, Homo Sapiens
ARFVFTYEG

SEQ ID NO: 393552 - protein, 9 aa, Homo Sapiens
WCSSWEATS

SEQ ID NO: 393553 - protein, 9 aa, Homo Sapiens
NILRKCKDR

SEQ ID NO: 393554 - protein, 9 aa, Homo Sapiens
SHGNPLLRL

SEQ ID NO: 393555 - protein, 9 aa, Homo Sapiens
RDEEWAPRM

SEQ ID NO: 393556 - protein, 9 aa, Homo Sapiens
PGLGSRIDL

SEQ ID NO: 393557 - protein, 9 aa, Homo Sapiens
AGILTRKMA

SEQ ID NO: 393558 - protein, 9 aa, Homo Sapiens
VHRLGSTFS

SEQ ID NO: 393559 - protein, 9 aa, Homo Sapiens
AQQYSAFFK

SEQ ID NO: 393560 - protein, 9 aa, Homo Sapiens
CRLFYKDML

SEQ ID NO: 393561 - protein, 9 aa, Homo Sapiens
AGMAHIFLI

SEQ ID NO: 393562 - protein, 9 aa, Homo Sapiens
RCTRAPPRP

SEQ ID NO: 393563 - protein, 9 aa, Homo Sapiens
TASSRCCPP

SEQ ID NO: 393564 - protein, 9 aa, Homo Sapiens
RRATGLVGC

SEQ ID NO: 393565 - protein, 9 aa, Homo Sapiens
GVGNGPTEE

SEQ ID NO: 393566 - protein, 9 aa, Homo Sapiens
LELSKKKYF

SEQ ID NO: 393567 - protein, 9 aa, Homo Sapiens
ERSYGMVMK

SEQ ID NO: 393568 - protein, 9 aa, Homo Sapiens
YLLMQHLIL

SEQ ID NO: 393569 - protein, 9 aa, Homo Sapiens
VHQVNRQVF

SEQ ID NO: 393570 - protein, 9 aa, Homo Sapiens
DENVTLDGT

SEQ ID NO: 393571 - protein, 9 aa, Homo Sapiens
KGSVFNMWK

SEQ ID NO: 393572 - protein, 9 aa, Homo Sapiens
KRSEMAFSS

SEQ ID NO: 393573 - protein, 9 aa, Homo Sapiens
PAPGCSQRA

SEQ ID NO: 393574 - protein, 9 aa, Homo Sapiens
RIRVCGGDT

SEQ ID NO: 393575 - protein, 9 aa, Homo Sapiens
PRRVLARFY

SEQ ID NO: 393576 - protein, 9 aa, Homo Sapiens
TRTQTSFLK

SEQ ID NO: 393577 - protein, 9 aa, Homo Sapiens
CQFYDEARQ

SEQ ID NO: 393578 - protein, 9 aa, Homo Sapiens
PPWRRKRWS

SEQ ID NO: 393579 - protein, 9 aa, Homo Sapiens
HRQRVCGLE

SEQ ID NO: 393580 - protein, 9 aa, Homo Sapiens
GDPGVIKQK

SEQ ID NO: 393581 - protein, 9 aa, Homo Sapiens
RANGARGTR

SEQ ID NO: 393582 - protein, 9 aa, Homo Sapiens
SGVIVVQLA

SEQ ID NO: 393583 - protein, 9 aa, Homo Sapiens
PSQNDEDNQ

SEQ ID NO: 393584 - protein, 9 aa, Homo Sapiens
ASAPAGTTG

SEQ ID NO: 393585 - protein, 9 aa, Homo Sapiens
LSHPGLRPC

SEQ ID NO: 393586 - protein, 9 aa, Homo Sapiens
TPRRSPASA

SEQ ID NO: 393587 - protein, 9 aa, Homo Sapiens
SPPAAVLVF

SEQ ID NO: 393588 - protein, 9 aa, Homo Sapiens
NLKNCIYPL

SEQ ID NO: 393589 - protein, 9 aa, Homo Sapiens
HAPTLQVVI

SEQ ID NO: 393590 - protein, 9 aa, Homo Sapiens
QIYPPIHAP

SEQ ID NO: 393591 - protein, 9 aa, Homo Sapiens
SEPEEEAPM

SEQ ID NO: 393592 - protein, 9 aa, Homo Sapiens
HPSAFNNLK

SEQ ID NO: 393593 - protein, 9 aa, Homo Sapiens
QDDNGVMPT

SEQ ID NO: 393594 - protein, 9 aa, Homo Sapiens
PPEACHGPL

SEQ ID NO: 393595 - protein, 9 aa, Homo Sapiens
WKRFGMKNF

SEQ ID NO: 393596 - protein, 9 aa, Homo Sapiens
QNLFCLETL

SEQ ID NO: 393597 - protein, 9 aa, Homo Sapiens
VPLFSEQRS

SEQ ID NO: 393598 - protein, 9 aa, Homo Sapiens
PVHGCCQCQ

SEQ ID NO: 393599 - protein, 9 aa, Homo Sapiens
FRSPLPTTS

SEQ ID NO: 393600 - protein, 9 aa, Homo Sapiens
VCRKSVLGA

SEQ ID NO: 393601 - protein, 9 aa, Homo Sapiens
RGTSIAFST

SEQ ID NO: 393602 - protein, 9 aa, Homo Sapiens
SIFASKVEN

SEQ ID NO: 393603 - protein, 9 aa, Homo Sapiens
IGPSCVPTA

SEQ ID NO: 393604 - protein, 9 aa, Homo Sapiens
TCVYENTTT

SEQ ID NO: 393605 - protein, 9 aa, Homo Sapiens
GWKRFGMKN

SEQ ID NO: 393606 - protein, 9 aa, Homo Sapiens
RAAPASSHV

SEQ ID NO: 393607 - protein, 9 aa, Homo Sapiens
CSRTHSLEV

SEQ ID NO: 393608 - protein, 9 aa, Homo Sapiens
PRPTSAVRE

SEQ ID NO: 393609 - protein, 9 aa, Homo Sapiens
ERGQVPMQE

SEQ ID NO: 393610 - protein, 9 aa, Homo Sapiens
RCALGAVPG

SEQ ID NO: 393611 - protein, 9 aa, Homo Sapiens
GLIPRLPTG

SEQ ID NO: 393612 - protein, 9 aa, Homo Sapiens
HDVIHWTKE

SEQ ID NO: 393613 - protein, 9 aa, Homo Sapiens
ENTTTKALL

SEQ ID NO: 393614 - protein, 9 aa, Homo Sapiens
TRCQVRPPP

SEQ ID NO: 393615 - protein, 9 aa, Homo Sapiens
TRFTAVTLG

SEQ ID NO: 393616 - protein, 9 aa, Homo Sapiens
TAATVRSIT

SEQ ID NO: 393617 - protein, 9 aa, Homo Sapiens
TSARRRTWW

SEQ ID NO: 393618 - protein, 9 aa, Homo Sapiens
LSYTKVDPN

SEQ ID NO: 393619 - protein, 9 aa, Homo Sapiens
WVATGLTIP

SEQ ID NO: 393620 - protein, 9 aa, Homo Sapiens
FAKPSQLEC

SEQ ID NO: 393621 - protein, 9 aa, Homo Sapiens
KYDKMCNDV

SEQ ID NO: 393622 - protein, 9 aa, Homo Sapiens
TASTLRWSW

SEQ ID NO: 393623 - protein, 9 aa, Homo Sapiens
PLQMVLLPN

SEQ ID NO: 393624 - protein, 9 aa, Homo Sapiens
EPPDKTKPL

SEQ ID NO: 393625 - protein, 9 aa, Homo Sapiens
RRYLQWSCS

SEQ ID NO: 393626 - protein, 9 aa, Homo Sapiens
PQTPQDSRQ

SEQ ID NO: 393627 - protein, 9 aa, Homo Sapiens
ALHDVSDKT

SEQ ID NO: 393628 - protein, 9 aa, Homo Sapiens
AGTAACITD

SEQ ID NO: 393629 - protein, 9 aa, Homo Sapiens
CNYIQCELK

SEQ ID NO: 393630 - protein, 9 aa, Homo Sapiens
STFYLQQHN

SEQ ID NO: 393631 - protein, 9 aa, Homo Sapiens
QPRARQRQT

SEQ ID NO: 393632 - protein, 9 aa, Homo Sapiens
KRKFSSFLS

SEQ ID NO: 393633 - protein, 9 aa, Homo Sapiens
TPLVYLSFA

SEQ ID NO: 393634 - protein, 9 aa, Homo Sapiens
DFFRVLLQS

SEQ ID NO: 393635 - protein, 9 aa, Homo Sapiens
KNLSWLSKK

SEQ ID NO: 393636 - protein, 9 aa, Homo Sapiens
VLLLLFLFF

SEQ ID NO: 393637 - protein, 9 aa, Homo Sapiens
PGPTPQPSH

SEQ ID NO: 393638 - protein, 9 aa, Homo Sapiens
LPKCLTSQS

SEQ ID NO: 393639 - protein, 9 aa, Homo Sapiens
AFLKNGRSE

SEQ ID NO: 393640 - protein, 9 aa, Homo Sapiens
RRPQAPPKS

SEQ ID NO: 393641 - protein, 9 aa, Homo Sapiens
FRSRESHHT

SEQ ID NO: 393642 - protein, 9 aa, Homo Sapiens
SASSGNETA

SEQ ID NO: 393643 - protein, 9 aa, Homo Sapiens
PVYIPEDIL

SEQ ID NO: 393644 - protein, 9 aa, Homo Sapiens
KNKLLKTFI

SEQ ID NO: 393645 - protein, 9 aa, Homo Sapiens
FGSPCPISI

SEQ ID NO: 393646 - protein, 9 aa, Homo Sapiens
EDTVKNAEP

SEQ ID NO: 393647 - protein, 9 aa, Homo Sapiens
PLPCVLPHV

SEQ ID NO: 393648 - protein, 9 aa, Homo Sapiens
ERGREREKE

SEQ ID NO: 393649 - protein, 9 aa, Homo Sapiens
PILEPERTM

SEQ ID NO: 393650 - protein, 9 aa, Homo Sapiens
RSPLTSRFT

SEQ ID NO: 393651 - protein, 9 aa, Homo Sapiens
CTWEEELTR

SEQ ID NO: 393652 - protein, 9 aa, Homo Sapiens
NVYKAKCEI

SEQ ID NO: 393653 - protein, 9 aa, Homo Sapiens
RDEAGGPGQ

SEQ ID NO: 393654 - protein, 9 aa, Homo Sapiens
CEETISTIG

SEQ ID NO: 393655 - protein, 9 aa, Homo Sapiens
APPKSSASR

SEQ ID NO: 393656 - protein, 9 aa, Homo Sapiens
EVSCSHTNL

SEQ ID NO: 393657 - protein, 9 aa, Homo Sapiens
PRDEEWAPR

SEQ ID NO: 393658 - protein, 9 aa, Homo Sapiens
SDVKIHVSD

SEQ ID NO: 393659 - protein, 9 aa, Homo Sapiens
LQGHMLQGR

SEQ ID NO: 393660 - protein, 9 aa, Homo Sapiens
ANLGDRTRL

SEQ ID NO: 393661 - protein, 9 aa, Homo Sapiens
GLGLAARNV

SEQ ID NO: 393662 - protein, 9 aa, Homo Sapiens
PRANASHTN

SEQ ID NO: 393663 - protein, 9 aa, Homo Sapiens
FSDLDQSFS

SEQ ID NO: 393664 - protein, 9 aa, Homo Sapiens
LQGLVAGVG

SEQ ID NO: 393665 - protein, 9 aa, Homo Sapiens
LSSAVSSIG

SEQ ID NO: 393666 - protein, 9 aa, Homo Sapiens
RGLGLQLAL

SEQ ID NO: 393667 - protein, 9 aa, Homo Sapiens
LHHFLQGFL

SEQ ID NO: 393668 - protein, 9 aa, Homo Sapiens
GDRGWAGCL

SEQ ID NO: 393669 - protein, 9 aa, Homo Sapiens
CVYSEQAEA

SEQ ID NO: 393670 - protein, 9 aa, Homo Sapiens
KSRERGRER

SEQ ID NO: 393671 - protein, 9 aa, Homo Sapiens
NTNQRLQQR

SEQ ID NO: 393672 - protein, 9 aa, Homo Sapiens
HQGQSCIHQ

SEQ ID NO: 393673 - protein, 9 aa, Homo Sapiens
LAASFAVSS

SEQ ID NO: 393674 - protein, 9 aa, Homo Sapiens
GVSTSSAGA

SEQ ID NO: 393675 - protein, 9 aa, Homo Sapiens
SGRARGTSI

SEQ ID NO: 393676 - protein, 9 aa, Homo Sapiens
PSCCAPVPS

SEQ ID NO: 393677 - protein, 9 aa, Homo Sapiens
SEELVCKLE

SEQ ID NO: 393678 - protein, 9 aa, Homo Sapiens
PAGTGTASQ

SEQ ID NO: 393679 - protein, 9 aa, Homo Sapiens
GTGKLGNIT

SEQ ID NO: 393680 - protein, 9 aa, Homo Sapiens
FTHCRPHWT

SEQ ID NO: 393681 - protein, 9 aa, Homo Sapiens
RRTVSSRGT

SEQ ID NO: 393682 - protein, 9 aa, Homo Sapiens
RLKWIMLFL

SEQ ID NO: 393683 - protein, 9 aa, Homo Sapiens
DAQVGPLPC

SEQ ID NO: 393684 - protein, 9 aa, Homo Sapiens
THFSPQPLT

SEQ ID NO: 393685 - protein, 9 aa, Homo Sapiens
IVINEDRKP

SEQ ID NO: 393686 - protein, 9 aa, Homo Sapiens
EDTCLENLA

SEQ ID NO: 393687 - protein, 9 aa, Homo Sapiens
GLTLGAPLP

SEQ ID NO: 393688 - protein, 9 aa, Homo Sapiens
GPTPVPTAT

SEQ ID NO: 393689 - protein, 9 aa, Homo Sapiens
LEKVDDRRS

SEQ ID NO: 393690 - protein, 9 aa, Homo Sapiens
TLGAPLPWM

SEQ ID NO: 393691 - protein, 9 aa, Homo Sapiens
STAKSAEMP

SEQ ID NO: 393692 - protein, 9 aa, Homo Sapiens
GNPWSDPQD

SEQ ID NO: 393693 - protein, 9 aa, Homo Sapiens
REECIPTKR

SEQ ID NO: 393694 - protein, 9 aa, Homo Sapiens
RVPIRASPH

SEQ ID NO: 393695 - protein, 9 aa, Homo Sapiens
LAQPAAFGR

SEQ ID NO: 393696 - protein, 9 aa, Homo Sapiens
SPQPLTGLL

SEQ ID NO: 393697 - protein, 9 aa, Homo Sapiens
LDKNGTTCT

SEQ ID NO: 393698 - protein, 9 aa, Homo Sapiens
VDAHVVLEV

SEQ ID NO: 393699 - protein, 9 aa, Homo Sapiens
QAGGPPRSR

SEQ ID NO: 393700 - protein, 9 aa, Homo Sapiens
WSQGVLVKH

SEQ ID NO: 393701 - protein, 9 aa, Homo Sapiens
RLHPGARRP

SEQ ID NO: 393702 - protein, 9 aa, Homo Sapiens
QVEGEDVLV

SEQ ID NO: 393703 - protein, 9 aa, Homo Sapiens
NFGGIGVGN

SEQ ID NO: 393704 - protein, 9 aa, Homo Sapiens
QNQQHPKKA

SEQ ID NO: 393705 - protein, 9 aa, Homo Sapiens
RCYEHQRVY

SEQ ID NO: 393706 - protein, 9 aa, Homo Sapiens
GEADLADGA

SEQ ID NO: 393707 - protein, 9 aa, Homo Sapiens
WARPPALTV

SEQ ID NO: 393708 - protein, 9 aa, Homo Sapiens
RTQKPKRSL

SEQ ID NO: 393709 - protein, 9 aa, Homo Sapiens
GQHVVDGDA

SEQ ID NO: 393710 - protein, 9 aa, Homo Sapiens
QCLLTLTRK

SEQ ID NO: 393711 - protein, 9 aa, Homo Sapiens
LCLSCRAGW

SEQ ID NO: 393712 - protein, 9 aa, Homo Sapiens
YRKGAPAGE

SEQ ID NO: 393713 - protein, 9 aa, Homo Sapiens
SQEKEWATE

SEQ ID NO: 393714 - protein, 9 aa, Homo Sapiens
NRSTGCYLC

SEQ ID NO: 393715 - protein, 9 aa, Homo Sapiens
PRGHFIGLM

SEQ ID NO: 393716 - protein, 9 aa, Homo Sapiens
IVEPSIFNT

SEQ ID NO: 393717 - protein, 9 aa, Homo Sapiens
EECMWSQGV

SEQ ID NO: 393718 - protein, 9 aa, Homo Sapiens
DRHYNIPVS

SEQ ID NO: 393719 - protein, 9 aa, Homo Sapiens
HSIILRHLL

SEQ ID NO: 393720 - protein, 9 aa, Homo Sapiens
PTLLPLFIF

SEQ ID NO: 393721 - protein, 9 aa, Homo Sapiens
IYQFIDKDK

SEQ ID NO: 393722 - protein, 9 aa, Homo Sapiens
TCHQLGSGV

SEQ ID NO: 393723 - protein, 9 aa, Homo Sapiens
RSVFEADPY

SEQ ID NO: 393724 - protein, 9 aa, Homo Sapiens
EKELDAPPA

SEQ ID NO: 393725 - protein, 9 aa, Homo Sapiens
GRRDPQDGC

SEQ ID NO: 393726 - protein, 9 aa, Homo Sapiens
TDHMLSEVR

SEQ ID NO: 393727 - protein, 9 aa, Homo Sapiens
ITNGARGSS

SEQ ID NO: 393728 - protein, 9 aa, Homo Sapiens
TPPEMPGSS

SEQ ID NO: 393729 - protein, 9 aa, Homo Sapiens
MHSNTPRSE

SEQ ID NO: 393730 - protein, 9 aa, Homo Sapiens
GSRDVQTLA

SEQ ID NO: 393731 - protein, 9 aa, Homo Sapiens
AVRAELQDH

SEQ ID NO: 393732 - protein, 9 aa, Homo Sapiens
SDPQDCRGR

SEQ ID NO: 393733 - protein, 9 aa, Homo Sapiens
SGPSPARSA

SEQ ID NO: 393734 - protein, 9 aa, Homo Sapiens
EVVTLTPHI

SEQ ID NO: 393735 - protein, 9 aa, Homo Sapiens
ASSGSPHIT

SEQ ID NO: 393736 - protein, 9 aa, Homo Sapiens
LTCVICLDY

SEQ ID NO: 393737 - protein, 9 aa, Homo Sapiens
SSCNRASSS

SEQ ID NO: 393738 - protein, 9 aa, Homo Sapiens
PHDDFVADG

SEQ ID NO: 393739 - protein, 9 aa, Homo Sapiens
LSKKGLLLA

SEQ ID NO: 393740 - protein, 9 aa, Homo Sapiens
VTQRWRELA

SEQ ID NO: 393741 - protein, 9 aa, Homo Sapiens
NWSPPWRRK

SEQ ID NO: 393742 - protein, 9 aa, Homo Sapiens
DSSSRRCSV

SEQ ID NO: 393743 - protein, 9 aa, Homo Sapiens
LTHGVASFS

SEQ ID NO: 393744 - protein, 9 aa, Homo Sapiens
VIPVLIIVV

SEQ ID NO: 393745 - protein, 9 aa, Homo Sapiens
ADEMHTLLH

SEQ ID NO: 393746 - protein, 9 aa, Homo Sapiens
VLLARSTSM

SEQ ID NO: 393747 - protein, 9 aa, Homo Sapiens
KLQWKRLGQ

SEQ ID NO: 393748 - protein, 9 aa, Homo Sapiens
LLLFLFFIP

SEQ ID NO: 393749 - protein, 9 aa, Homo Sapiens
STRSTRGSS

SEQ ID NO: 393750 - protein, 9 aa, Homo Sapiens
NNCRKNEEL

SEQ ID NO: 393751 - protein, 9 aa, Homo Sapiens
LLMAVGILA

SEQ ID NO: 393752 - protein, 9 aa, Homo Sapiens
QVCAELDPH

SEQ ID NO: 393753 - protein, 9 aa, Homo Sapiens
AAKIVLMNS

SEQ ID NO: 393754 - protein, 9 aa, Homo Sapiens
SMKFPVRLI

SEQ ID NO: 393755 - protein, 9 aa, Homo Sapiens
IISEIRVPI

SEQ ID NO: 393756 - protein, 9 aa, Homo Sapiens
ILKKFSAQY

SEQ ID NO: 393757 - protein, 9 aa, Homo Sapiens
MPPEGQLTN

SEQ ID NO: 393758 - protein, 9 aa, Homo Sapiens
SQLAGTPPG

SEQ ID NO: 393759 - protein, 9 aa, Homo Sapiens
LKRHFTVNM

SEQ ID NO: 393760 - protein, 9 aa, Homo Sapiens
HIFLIQLIN

SEQ ID NO: 393761 - protein, 9 aa, Homo Sapiens
KKMTLKALV

SEQ ID NO: 393762 - protein, 9 aa, Homo Sapiens
FLLYMKPDN

SEQ ID NO: 393763 - protein, 9 aa, Homo Sapiens
GVHGPGPCI

SEQ ID NO: 393764 - protein, 9 aa, Homo Sapiens
GRTCQAWLS

SEQ ID NO: 393765 - protein, 9 aa, Homo Sapiens
CTYETRQKR

SEQ ID NO: 393766 - protein, 9 aa, Homo Sapiens
ARTLEKVDD

SEQ ID NO: 393767 - protein, 9 aa, Homo Sapiens
SSLQHQAGM

SEQ ID NO: 393768 - protein, 9 aa, Homo Sapiens
DRTGGTSRT

SEQ ID NO: 393769 - protein, 9 aa, Homo Sapiens
AALKRHFTV

SEQ ID NO: 393770 - protein, 9 aa, Homo Sapiens
FAIRTRAAR

SEQ ID NO: 393771 - protein, 9 aa, Homo Sapiens
STSNTRSTI

SEQ ID NO: 393772 - protein, 9 aa, Homo Sapiens
GPTVVAWLG

SEQ ID NO: 393773 - protein, 9 aa, Homo Sapiens
SRNTLFTRF

SEQ ID NO: 393774 - protein, 9 aa, Homo Sapiens
TPAGLSHPG

SEQ ID NO: 393775 - protein, 9 aa, Homo Sapiens
PGPCIGEES

SEQ ID NO: 393776 - protein, 9 aa, Homo Sapiens
KKNVIQSIL

SEQ ID NO: 393777 - protein, 9 aa, Homo Sapiens
CYSCMCSPE

SEQ ID NO: 393778 - protein, 9 aa, Homo Sapiens
RRMLFPTSA

SEQ ID NO: 393779 - protein, 9 aa, Homo Sapiens
NDRMRELFQ

SEQ ID NO: 393780 - protein, 9 aa, Homo Sapiens
LSELDIVEN

SEQ ID NO: 393781 - protein, 9 aa, Homo Sapiens
TPLAQWAPA

SEQ ID NO: 393782 - protein, 9 aa, Homo Sapiens
LVLPGEADL

SEQ ID NO: 393783 - protein, 9 aa, Homo Sapiens
EHYVDYVER

SEQ ID NO: 393784 - protein, 9 aa, Homo Sapiens
QIIVNTVNQ

SEQ ID NO: 393785 - protein, 9 aa, Homo Sapiens
VDPAIKSTA

SEQ ID NO: 393786 - protein, 9 aa, Homo Sapiens
FHLLTKYCG

SEQ ID NO: 393787 - protein, 9 aa, Homo Sapiens
RWTSATWGL

SEQ ID NO: 393788 - protein, 9 aa, Homo Sapiens
PIKEPEPMW

SEQ ID NO: 393789 - protein, 9 aa, Homo Sapiens
SLFPGGPND

SEQ ID NO: 393790 - protein, 9 aa, Homo Sapiens
TAVEVTQRW

SEQ ID NO: 393791 - protein, 9 aa, Homo Sapiens
LAAKLCNIL

SEQ ID NO: 393792 - protein, 9 aa, Homo Sapiens
YEGKYFTLC

SEQ ID NO: 393793 - protein, 9 aa, Homo Sapiens
LTLAKMIAG

SEQ ID NO: 393794 - protein, 9 aa, Homo Sapiens
TGDHVLALN

SEQ ID NO: 393795 - protein, 9 aa, Homo Sapiens
QFCKKSCSI

SEQ ID NO: 393796 - protein, 9 aa, Homo Sapiens
VSAQNVFHT

SEQ ID NO: 393797 - protein, 9 aa, Homo Sapiens
NRTHPHKEI

SEQ ID NO: 393798 - protein, 9 aa, Homo Sapiens
SGGASRALF

SEQ ID NO: 393799 - protein, 9 aa, Homo Sapiens
IGGILLSIS

SEQ ID NO: 393800 - protein, 9 aa, Homo Sapiens
GLWERSPGH

SEQ ID NO: 393801 - protein, 9 aa, Homo Sapiens
DTPVDFFEF

SEQ ID NO: 393802 - protein, 9 aa, Homo Sapiens
NEATSAHYV

SEQ ID NO: 393803 - protein, 9 aa, Homo Sapiens
PCDSGGRED

SEQ ID NO: 393804 - protein, 9 aa, Homo Sapiens
APLRLWSWC

SEQ ID NO: 393805 - protein, 9 aa, Homo Sapiens
SQCTSLTTA

SEQ ID NO: 393806 - protein, 9 aa, Homo Sapiens
WTPILEPER

SEQ ID NO: 393807 - protein, 9 aa, Homo Sapiens
YARVAKLIH

SEQ ID NO: 393808 - protein, 9 aa, Homo Sapiens
LLFLFIIII

SEQ ID NO: 393809 - protein, 9 aa, Homo Sapiens
KAVKDLASQ

SEQ ID NO: 393810 - protein, 9 aa, Homo Sapiens
LQWSCSVPT

SEQ ID NO: 393811 - protein, 9 aa, Homo Sapiens
IRSDPDACP

SEQ ID NO: 393812 - protein, 9 aa, Homo Sapiens
TRDTFSDSE

SEQ ID NO: 393813 - protein, 9 aa, Homo Sapiens
PDISHIVGI

SEQ ID NO: 393814 - protein, 9 aa, Homo Sapiens
YVLSEQHGA

SEQ ID NO: 393815 - protein, 9 aa, Homo Sapiens
PNMTSIRRL

SEQ ID NO: 393816 - protein, 9 aa, Homo Sapiens
SCSMSRHPF

SEQ ID NO: 393817 - protein, 9 aa, Homo Sapiens
WRGASFILS

SEQ ID NO: 393818 - protein, 9 aa, Homo Sapiens
PAQPRPWRI

SEQ ID NO: 393819 - protein, 9 aa, Homo Sapiens
RSPQAPLRL

SEQ ID NO: 393820 - protein, 9 aa, Homo Sapiens
AKLRIFFLF

SEQ ID NO: 393821 - protein, 9 aa, Homo Sapiens
QLEARGNST

SEQ ID NO: 393822 - protein, 9 aa, Homo Sapiens
QKVLREKVP

SEQ ID NO: 393823 - protein, 9 aa, Homo Sapiens
VLEGCVSWS

SEQ ID NO: 393824 - protein, 9 aa, Homo Sapiens
SGLTQNILA

SEQ ID NO: 393825 - protein, 9 aa, Homo Sapiens
SPSPNPISR

SEQ ID NO: 393826 - protein, 9 aa, Homo Sapiens
KKTTKFLDH

SEQ ID NO: 393827 - protein, 9 aa, Homo Sapiens
SAPTAAKPS

SEQ ID NO: 393828 - protein, 9 aa, Homo Sapiens
ILVVDTKIL

SEQ ID NO: 393829 - protein, 9 aa, Homo Sapiens
STAATTAAG

SEQ ID NO: 393830 - protein, 9 aa, Homo Sapiens
LLLYTLNDR

SEQ ID NO: 393831 - protein, 9 aa, Homo Sapiens
KKISGRSRK

SEQ ID NO: 393832 - protein, 9 aa, Homo Sapiens
PTGHSDSEG

SEQ ID NO: 393833 - protein, 9 aa, Homo Sapiens
RAKLTPGRE

SEQ ID NO: 393834 - protein, 9 aa, Homo Sapiens
SWRGASFIL

SEQ ID NO: 393835 - protein, 9 aa, Homo Sapiens
FEGIKRKKQ

SEQ ID NO: 393836 - protein, 9 aa, Homo Sapiens
YNRTKREPN

SEQ ID NO: 393837 - protein, 9 aa, Homo Sapiens
TPTRSGTCC

SEQ ID NO: 393838 - protein, 9 aa, Homo Sapiens
KVPLRTPWV

SEQ ID NO: 393839 - protein, 9 aa, Homo Sapiens
HHTIYETFE

SEQ ID NO: 393840 - protein, 9 aa, Homo Sapiens
MGRVGRPQF

SEQ ID NO: 393841 - protein, 9 aa, Homo Sapiens
AAHRGLAGP

SEQ ID NO: 393842 - protein, 9 aa, Homo Sapiens
LWFSTVFPP

SEQ ID NO: 393843 - protein, 9 aa, Homo Sapiens
LSDIFWVVP

SEQ ID NO: 393844 - protein, 9 aa, Homo Sapiens
KQVSPASPP

SEQ ID NO: 393845 - protein, 9 aa, Homo Sapiens
SPPWRRKRW

SEQ ID NO: 393846 - protein, 9 aa, Homo Sapiens
QSVMASSAD

SEQ ID NO: 393847 - protein, 9 aa, Homo Sapiens
TEILCVGNI

SEQ ID NO: 393848 - protein, 9 aa, Homo Sapiens
TEDKKNGIW

SEQ ID NO: 393849 - protein, 9 aa, Homo Sapiens
NGFSNLVRL

SEQ ID NO: 393850 - protein, 9 aa, Homo Sapiens
LELDAMKHQ

SEQ ID NO: 393851 - protein, 9 aa, Homo Sapiens
VQKPISLAG

SEQ ID NO: 393852 - protein, 9 aa, Homo Sapiens
VSSCNRASS

SEQ ID NO: 393853 - protein, 9 aa, Homo Sapiens
NSSPRNPPS

SEQ ID NO: 393854 - protein, 9 aa, Homo Sapiens
DAAEIQKHK

SEQ ID NO: 393855 - protein, 9 aa, Homo Sapiens
AEAADMGNL

SEQ ID NO: 393856 - protein, 9 aa, Homo Sapiens
CYCKEGFTG

SEQ ID NO: 393857 - protein, 9 aa, Homo Sapiens
HVPLGNLSP

SEQ ID NO: 393858 - protein, 9 aa, Homo Sapiens
RDFTGELEV

SEQ ID NO: 393859 - protein, 9 aa, Homo Sapiens
FLTDVLHDV

SEQ ID NO: 393860 - protein, 9 aa, Homo Sapiens
KLYRNGIML

SEQ ID NO: 393861 - protein, 9 aa, Homo Sapiens
RPWKTSCTT

SEQ ID NO: 393862 - protein, 9 aa, Homo Sapiens
DVVFTDEMD

SEQ ID NO: 393863 - protein, 9 aa, Homo Sapiens
VMTSSEHME

SEQ ID NO: 393864 - protein, 9 aa, Homo Sapiens
RGTPWLRVM

SEQ ID NO: 393865 - protein, 9 aa, Homo Sapiens
PGTTAEWPG

SEQ ID NO: 393866 - protein, 9 aa, Homo Sapiens
EKLSTVRKR

SEQ ID NO: 393867 - protein, 9 aa, Homo Sapiens
GPSPAPSAG

SEQ ID NO: 393868 - protein, 9 aa, Homo Sapiens
WRTRACTPA

SEQ ID NO: 393869 - protein, 9 aa, Homo Sapiens
YTIVGTILV

SEQ ID NO: 393870 - protein, 9 aa, Homo Sapiens
RRHFGATVA

SEQ ID NO: 393871 - protein, 9 aa, Homo Sapiens
SICVQEDCH

SEQ ID NO: 393872 - protein, 9 aa, Homo Sapiens
PMHAKGPSG

SEQ ID NO: 393873 - protein, 9 aa, Homo Sapiens
TVNMSKVET

SEQ ID NO: 393874 - protein, 9 aa, Homo Sapiens
GARRTVSSR

SEQ ID NO: 393875 - protein, 9 aa, Homo Sapiens
LGRGTMSVS

SEQ ID NO: 393876 - protein, 9 aa, Homo Sapiens
ENILADKPN

SEQ ID NO: 393877 - protein, 9 aa, Homo Sapiens
GTYICQVHG

SEQ ID NO: 393878 - protein, 9 aa, Homo Sapiens
AVDGWVEEW

SEQ ID NO: 393879 - protein, 9 aa, Homo Sapiens
PIHAPTLQV

SEQ ID NO: 393880 - protein, 9 aa, Homo Sapiens
AAVLYQWSK

SEQ ID NO: 393881 - protein, 9 aa, Homo Sapiens
IKHTIIHTE

SEQ ID NO: 393882 - protein, 9 aa, Homo Sapiens
LGADWLELT

SEQ ID NO: 393883 - protein, 9 aa, Homo Sapiens
LLNQDFLQA

SEQ ID NO: 393884 - protein, 9 aa, Homo Sapiens
DTGECYCKE

SEQ ID NO: 393885 - protein, 9 aa, Homo Sapiens
PLRGDPGVI

SEQ ID NO: 393886 - protein, 9 aa, Homo Sapiens
NITEELFLL

SEQ ID NO: 393887 - protein, 9 aa, Homo Sapiens
CEGFPTMIT

SEQ ID NO: 393888 - protein, 9 aa, Homo Sapiens
ACFTWRTSR

SEQ ID NO: 393889 - protein, 9 aa, Homo Sapiens
RCPSLLRRP

SEQ ID NO: 393890 - protein, 9 aa, Homo Sapiens
AAGTTFTLV

SEQ ID NO: 393891 - protein, 9 aa, Homo Sapiens
PCLPLARPP

SEQ ID NO: 393892 - protein, 9 aa, Homo Sapiens
TECVRTALN

SEQ ID NO: 393893 - protein, 9 aa, Homo Sapiens
KTAEDRCMS

SEQ ID NO: 393894 - protein, 9 aa, Homo Sapiens
AECQSLLQG

SEQ ID NO: 393895 - protein, 9 aa, Homo Sapiens
AEGPQLENW

SEQ ID NO: 393896 - protein, 9 aa, Homo Sapiens
KSSASRGPS

SEQ ID NO: 393897 - protein, 9 aa, Homo Sapiens
ELESEGRVH

SEQ ID NO: 393898 - protein, 9 aa, Homo Sapiens
QLFLEEERQ

SEQ ID NO: 393899 - protein, 9 aa, Homo Sapiens
VGLSGGQRT

SEQ ID NO: 393900 - protein, 9 aa, Homo Sapiens
NYDREVEFG

SEQ ID NO: 393901 - protein, 9 aa, Homo Sapiens
CSVPGESPK

SEQ ID NO: 393902 - protein, 9 aa, Homo Sapiens
AARASSQTL

SEQ ID NO: 393903 - protein, 9 aa, Homo Sapiens
DIGVSQSQL

SEQ ID NO: 393904 - protein, 9 aa, Homo Sapiens
PGGVTDVTK

SEQ ID NO: 393905 - protein, 9 aa, Homo Sapiens
PCWSPLQPR

SEQ ID NO: 393906 - protein, 9 aa, Homo Sapiens
LEEPRKGLW

SEQ ID NO: 393907 - protein, 9 aa, Homo Sapiens
NSILNPVAD

SEQ ID NO: 393908 - protein, 9 aa, Homo Sapiens
RSQTKWRSG

SEQ ID NO: 393909 - protein, 9 aa, Homo Sapiens
LPPRRLRVT

SEQ ID NO: 393910 - protein, 9 aa, Homo Sapiens
ALLAQGQPA

SEQ ID NO: 393911 - protein, 9 aa, Homo Sapiens
VGLAGDIQV

SEQ ID NO: 393912 - protein, 9 aa, Homo Sapiens
NISSKEQPV

SEQ ID NO: 393913 - protein, 9 aa, Homo Sapiens
IRVPIVTVG

SEQ ID NO: 393914 - protein, 9 aa, Homo Sapiens
GGTRLTTVS

SEQ ID NO: 393915 - protein, 9 aa, Homo Sapiens
NDVTNMLLL

SEQ ID NO: 393916 - protein, 9 aa, Homo Sapiens
FAQRFRLQH

SEQ ID NO: 393917 - protein, 9 aa, Homo Sapiens
YRTRINKLN

SEQ ID NO: 393918 - protein, 9 aa, Homo Sapiens
KNMDHVKAR

SEQ ID NO: 393919 - protein, 9 aa, Homo Sapiens
EGVALKLVK

SEQ ID NO: 393920 - protein, 9 aa, Homo Sapiens
ALSWKPGAR

SEQ ID NO: 393921 - protein, 9 aa, Homo Sapiens
QSKNMDHVK

SEQ ID NO: 393922 - protein, 9 aa, Homo Sapiens
VPGQEFPPR

SEQ ID NO: 393923 - protein, 9 aa, Homo Sapiens
SSWEATSSS

SEQ ID NO: 393924 - protein, 9 aa, Homo Sapiens
VFLVRSRRP

SEQ ID NO: 393925 - protein, 9 aa, Homo Sapiens
RQCLLTLTR

SEQ ID NO: 393926 - protein, 9 aa, Homo Sapiens
RYGGAPRPS

SEQ ID NO: 393927 - protein, 9 aa, Homo Sapiens
FVRLRDGDC

SEQ ID NO: 393928 - protein, 9 aa, Homo Sapiens
KIVLMNSVF

SEQ ID NO: 393929 - protein, 9 aa, Homo Sapiens
KKKKRKRRS

SEQ ID NO: 393930 - protein, 9 aa, Homo Sapiens
WREAVELPQ

SEQ ID NO: 393931 - protein, 9 aa, Homo Sapiens
LSPDRRGSA

SEQ ID NO: 393932 - protein, 9 aa, Homo Sapiens
LSAEGPQLE

SEQ ID NO: 393933 - protein, 9 aa, Homo Sapiens
GMEALGSWG

SEQ ID NO: 393934 - protein, 9 aa, Homo Sapiens
DHVLALNQR

SEQ ID NO: 393935 - protein, 9 aa, Homo Sapiens
PHPEETVTV

SEQ ID NO: 393936 - protein, 9 aa, Homo Sapiens
ELEESVGFT

SEQ ID NO: 393937 - protein, 9 aa, Homo Sapiens
HWRQQAPPD

SEQ ID NO: 393938 - protein, 9 aa, Homo Sapiens
FGTRSPLTS

SEQ ID NO: 393939 - protein, 9 aa, Homo Sapiens
RLPHPAPAE

SEQ ID NO: 393940 - protein, 9 aa, Homo Sapiens
ALLMPPPGL

SEQ ID NO: 393941 - protein, 9 aa, Homo Sapiens
RNTLFTRFA

SEQ ID NO: 393942 - protein, 9 aa, Homo Sapiens
FGSRCYEHQ

SEQ ID NO: 393943 - protein, 9 aa, Homo Sapiens
QDKLEVMFR

SEQ ID NO: 393944 - protein, 9 aa, Homo Sapiens
LILVMLEIV

SEQ ID NO: 393945 - protein, 9 aa, Homo Sapiens
ILRSPMIYG

SEQ ID NO: 393946 - protein, 9 aa, Homo Sapiens
FYTSRIVLL

SEQ ID NO: 393947 - protein, 9 aa, Homo Sapiens
LQHHFSVFV

SEQ ID NO: 393948 - protein, 9 aa, Homo Sapiens
HTVIVQDKI

SEQ ID NO: 393949 - protein, 9 aa, Homo Sapiens
TGSSRGTSI

SEQ ID NO: 393950 - protein, 9 aa, Homo Sapiens
QDMIERTII

SEQ ID NO: 393951 - protein, 9 aa, Homo Sapiens
GSGPVYADV

SEQ ID NO: 393952 - protein, 9 aa, Homo Sapiens
DTLLDKADR

SEQ ID NO: 393953 - protein, 9 aa, Homo Sapiens
RCPPGFTSD

SEQ ID NO: 393954 - protein, 9 aa, Homo Sapiens
ATTAATFRG

SEQ ID NO: 393955 - protein, 9 aa, Homo Sapiens
AQDAIELGC

SEQ ID NO: 393956 - protein, 9 aa, Homo Sapiens
PASSHVAAL

SEQ ID NO: 393957 - protein, 9 aa, Homo Sapiens
FIRPVVPKR

SEQ ID NO: 393958 - protein, 9 aa, Homo Sapiens
SSSEEVIKA

SEQ ID NO: 393959 - protein, 9 aa, Homo Sapiens
PQHTTLLKG

SEQ ID NO: 393960 - protein, 9 aa, Homo Sapiens
LHAMPSGVF

SEQ ID NO: 393961 - protein, 9 aa, Homo Sapiens
SIFASRTDS

SEQ ID NO: 393962 - protein, 9 aa, Homo Sapiens
ELINGSLPS

SEQ ID NO: 393963 - protein, 9 aa, Homo Sapiens
CVPNYVGRP

SEQ ID NO: 393964 - protein, 9 aa, Homo Sapiens
ELLKTLNMI

SEQ ID NO: 393965 - protein, 9 aa, Homo Sapiens
AQGQPAGHL

SEQ ID NO: 393966 - protein, 9 aa, Homo Sapiens
LKRYGYASV

SEQ ID NO: 393967 - protein, 9 aa, Homo Sapiens
LWLLITTQI

SEQ ID NO: 393968 - protein, 9 aa, Homo Sapiens
SETSHLPLY

SEQ ID NO: 393969 - protein, 9 aa, Homo Sapiens
GTRGVGDRG

SEQ ID NO: 393970 - protein, 9 aa, Homo Sapiens
SITLSTIVA

SEQ ID NO: 393971 - protein, 9 aa, Homo Sapiens
EARRTSGAG

SEQ ID NO: 393972 - protein, 9 aa, Homo Sapiens
WSLPINPAQ

SEQ ID NO: 393973 - protein, 9 aa, Homo Sapiens
HCPSVPTAG

SEQ ID NO: 393974 - protein, 9 aa, Homo Sapiens
LRGLGLQLA

SEQ ID NO: 393975 - protein, 9 aa, Homo Sapiens
GIMYAKCLE

SEQ ID NO: 393976 - protein, 9 aa, Homo Sapiens
FSTRLAVST

SEQ ID NO: 393977 - protein, 9 aa, Homo Sapiens
LALKRVCRK

SEQ ID NO: 393978 - protein, 9 aa, Homo Sapiens
HGPLFLSSA

SEQ ID NO: 393979 - protein, 9 aa, Homo Sapiens
LVNSQYTAA

SEQ ID NO: 393980 - protein, 9 aa, Homo Sapiens
SKLSEVLQV

SEQ ID NO: 393981 - protein, 9 aa, Homo Sapiens
YVKAVGNPR

SEQ ID NO: 393982 - protein, 9 aa, Homo Sapiens
LTSQSQPHC

SEQ ID NO: 393983 - protein, 9 aa, Homo Sapiens
ASSTSRARG

SEQ ID NO: 393984 - protein, 9 aa, Homo Sapiens
HFHYDEVRG

SEQ ID NO: 393985 - protein, 9 aa, Homo Sapiens
ITSKVSSLF

SEQ ID NO: 393986 - protein, 9 aa, Homo Sapiens
GKSGLLFSF

SEQ ID NO: 393987 - protein, 9 aa, Homo Sapiens
YDREVEFGS

SEQ ID NO: 393988 - protein, 9 aa, Homo Sapiens
PVTDVWSVI

SEQ ID NO: 393989 - protein, 9 aa, Homo Sapiens
KKAKIKKKT

SEQ ID NO: 393990 - protein, 9 aa, Homo Sapiens
GWSGEARDG

SEQ ID NO: 393991 - protein, 9 aa, Homo Sapiens
RNKGLREGR

SEQ ID NO: 393992 - protein, 9 aa, Homo Sapiens
VAIVVKFFL

SEQ ID NO: 393993 - protein, 9 aa, Homo Sapiens
WHLCMGLKS

SEQ ID NO: 393994 - protein, 9 aa, Homo Sapiens
WAKNRGSGG

SEQ ID NO: 393995 - protein, 9 aa, Homo Sapiens
DSKHKLESP

SEQ ID NO: 393996 - protein, 9 aa, Homo Sapiens
SIHLDGENV

SEQ ID NO: 393997 - protein, 9 aa, Homo Sapiens
IAKEVDKAN

SEQ ID NO: 393998 - protein, 9 aa, Homo Sapiens
ASVMYKIGD

SEQ ID NO: 393999 - protein, 9 aa, Homo Sapiens
EVCAASERL

SEQ ID NO: 394000 - protein, 9 aa, Homo Sapiens
MKVHWKTFQ

SEQ ID NO: 394001 - protein, 9 aa, Homo Sapiens
PSPVSGLSK

SEQ ID NO: 394002 - protein, 9 aa, Homo Sapiens
FILRQPPGQ

SEQ ID NO: 394003 - protein, 9 aa, Homo Sapiens
SYKRGGLFL

SEQ ID NO: 394004 - protein, 9 aa, Homo Sapiens
SGTSRTRGT

SEQ ID NO: 394005 - protein, 9 aa, Homo Sapiens
SGTSRTRGS

SEQ ID NO: 394006 - protein, 9 aa, Homo Sapiens
AAKLCNILR

SEQ ID NO: 394007 - protein, 9 aa, Homo Sapiens
TSRTISTRG

SEQ ID NO: 394008 - protein, 9 aa, Homo Sapiens
LVILKGNED

SEQ ID NO: 394009 - protein, 9 aa, Homo Sapiens
CRTRHPNME

SEQ ID NO: 394010 - protein, 9 aa, Homo Sapiens
LYGKKLVKI

SEQ ID NO: 394011 - protein, 9 aa, Homo Sapiens
ASGWSASCG

SEQ ID NO: 394012 - protein, 9 aa, Homo Sapiens
PYDATLVIL

SEQ ID NO: 394013 - protein, 9 aa, Homo Sapiens
TSQNHSKCI

SEQ ID NO: 394014 - protein, 9 aa, Homo Sapiens
DLASQLIGR

SEQ ID NO: 394015 - protein, 9 aa, Homo Sapiens
FQFCKKSCS

SEQ ID NO: 394016 - protein, 9 aa, Homo Sapiens
ACMVLGLQF

SEQ ID NO: 394017 - protein, 9 aa, Homo Sapiens
LGVQKPISL

SEQ ID NO: 394018 - protein, 9 aa, Homo Sapiens
SSSWQAQHE

SEQ ID NO: 394019 - protein, 9 aa, Homo Sapiens
EQAGGPPRS

SEQ ID NO: 394020 - protein, 9 aa, Homo Sapiens
QRAPLALPA

SEQ ID NO: 394021 - protein, 9 aa, Homo Sapiens
FCRDRVLLC

SEQ ID NO: 394022 - protein, 9 aa, Homo Sapiens
KVDDRRSCN

SEQ ID NO: 394023 - protein, 9 aa, Homo Sapiens
AFKMEKVPI

SEQ ID NO: 394024 - protein, 9 aa, Homo Sapiens
SDRQTPKKR

SEQ ID NO: 394025 - protein, 9 aa, Homo Sapiens
AVGYFCFTS

SEQ ID NO: 394026 - protein, 9 aa, Homo Sapiens
RLEDSCQKL

SEQ ID NO: 394027 - protein, 9 aa, Homo Sapiens
LGPISPSSP

SEQ ID NO: 394028 - protein, 9 aa, Homo Sapiens
PRARQRQTR

SEQ ID NO: 394029 - protein, 9 aa, Homo Sapiens
SVNHPQHTT

SEQ ID NO: 394030 - protein, 9 aa, Homo Sapiens
LKLAPLQVT

SEQ ID NO: 394031 - protein, 9 aa, Homo Sapiens
GCEWAEGRG

SEQ ID NO: 394032 - protein, 9 aa, Homo Sapiens
TLLSFGIIT

SEQ ID NO: 394033 - protein, 9 aa, Homo Sapiens
ALLSTRFDV

SEQ ID NO: 394034 - protein, 9 aa, Homo Sapiens
LLPGTPKLM

SEQ ID NO: 394035 - protein, 9 aa, Homo Sapiens
NGIMLFDGP

SEQ ID NO: 394036 - protein, 9 aa, Homo Sapiens
KMTLKALVK

SEQ ID NO: 394037 - protein, 9 aa, Homo Sapiens
NQQHPKKAS

SEQ ID NO: 394038 - protein, 9 aa, Homo Sapiens
CSTVHGAVK

SEQ ID NO: 394039 - protein, 9 aa, Homo Sapiens
EAPMREDES

SEQ ID NO: 394040 - protein, 9 aa, Homo Sapiens
EVRGEWRQG

SEQ ID NO: 394041 - protein, 9 aa, Homo Sapiens
PLFSEQRSG

SEQ ID NO: 394042 - protein, 9 aa, Homo Sapiens
VLGPEGQFV

SEQ ID NO: 394043 - protein, 9 aa, Homo Sapiens
QEDCHIPQI

SEQ ID NO: 394044 - protein, 9 aa, Homo Sapiens
LVGGHPAHM

SEQ ID NO: 394045 - protein, 9 aa, Homo Sapiens
HVKAREVLK

SEQ ID NO: 394046 - protein, 9 aa, Homo Sapiens
SADLKAILS

SEQ ID NO: 394047 - protein, 9 aa, Homo Sapiens
KERKAAGRL

SEQ ID NO: 394048 - protein, 9 aa, Homo Sapiens
GVAVDAQVG

SEQ ID NO: 394049 - protein, 9 aa, Homo Sapiens
GSQSALGTA

SEQ ID NO: 394050 - protein, 9 aa, Homo Sapiens
RKKAKLRIF

SEQ ID NO: 394051 - protein, 9 aa, Homo Sapiens
GGPNDYVFS

SEQ ID NO: 394052 - protein, 9 aa, Homo Sapiens
AGDIQVGQR

SEQ ID NO: 394053 - protein, 9 aa, Homo Sapiens
SSGNETAFS

SEQ ID NO: 394054 - protein, 9 aa, Homo Sapiens
RFTRGARKT

SEQ ID NO: 394055 - protein, 9 aa, Homo Sapiens
WLRLHPGAR

SEQ ID NO: 394056 - protein, 9 aa, Homo Sapiens
LTRKYDFHL

SEQ ID NO: 394057 - protein, 9 aa, Homo Sapiens
PSAPRASAP

SEQ ID NO: 394058 - protein, 9 aa, Homo Sapiens
DTKLKPTKR

SEQ ID NO: 394059 - protein, 9 aa, Homo Sapiens
SQKNDLTIQ

SEQ ID NO: 394060 - protein, 9 aa, Homo Sapiens
APPPSTAAT

SEQ ID NO: 394061 - protein, 9 aa, Homo Sapiens
FRRCRPRLS

SEQ ID NO: 394062 - protein, 9 aa, Homo Sapiens
LSQKNDLTI

SEQ ID NO: 394063 - protein, 9 aa, Homo Sapiens
AGGPGQRRC

SEQ ID NO: 394064 - protein, 9 aa, Homo Sapiens
LCSRTHSLE

SEQ ID NO: 394065 - protein, 9 aa, Homo Sapiens
EVIGFTMMS

SEQ ID NO: 394066 - protein, 9 aa, Homo Sapiens
GRWFSQKAS

SEQ ID NO: 394067 - protein, 9 aa, Homo Sapiens
DKVWVNLIG

SEQ ID NO: 394068 - protein, 9 aa, Homo Sapiens
NPGFAAAVV

SEQ ID NO: 394069 - protein, 9 aa, Homo Sapiens
SWLEVSFCQ

SEQ ID NO: 394070 - protein, 9 aa, Homo Sapiens
HQDKYYQMP

SEQ ID NO: 394071 - protein, 9 aa, Homo Sapiens
FKQNLFCLE

SEQ ID NO: 394072 - protein, 9 aa, Homo Sapiens
KSDVKIHVS

SEQ ID NO: 394073 - protein, 9 aa, Homo Sapiens
MHMRTHNGE

SEQ ID NO: 394074 - protein, 9 aa, Homo Sapiens
GVVTDLFPV

SEQ ID NO: 394075 - protein, 9 aa, Homo Sapiens
VVTNMIANG

SEQ ID NO: 394076 - protein, 9 aa, Homo Sapiens
VNDRMRELF

SEQ ID NO: 394077 - protein, 9 aa, Homo Sapiens
KEAALICLT

SEQ ID NO: 394078 - protein, 9 aa, Homo Sapiens
RGTNFTRTS

SEQ ID NO: 394079 - protein, 9 aa, Homo Sapiens
QVYQILESH

SEQ ID NO: 394080 - protein, 9 aa, Homo Sapiens
PTTGGPRST

SEQ ID NO: 394081 - protein, 9 aa, Homo Sapiens
IEAPPPSTA

SEQ ID NO: 394082 - protein, 9 aa, Homo Sapiens
DISHIVGIH

SEQ ID NO: 394083 - protein, 9 aa, Homo Sapiens
DGGPWALAT

SEQ ID NO: 394084 - protein, 9 aa, Homo Sapiens
DRGTPWLRV

SEQ ID NO: 394085 - protein, 9 aa, Homo Sapiens
AGHLHLVQV

SEQ ID NO: 394086 - protein, 9 aa, Homo Sapiens
GLLRQLGKG

SEQ ID NO: 394087 - protein, 9 aa, Homo Sapiens
RKHQCNHAA

SEQ ID NO: 394088 - protein, 9 aa, Homo Sapiens
HVPRQLPGP

SEQ ID NO: 394089 - protein, 9 aa, Homo Sapiens
AEDRCMSDL

SEQ ID NO: 394090 - protein, 9 aa, Homo Sapiens
ECMWSQGVL

SEQ ID NO: 394091 - protein, 9 aa, Homo Sapiens
TIGLGLAAR

SEQ ID NO: 394092 - protein, 9 aa, Homo Sapiens
LQMMGRVGR

SEQ ID NO: 394093 - protein, 9 aa, Homo Sapiens
PSAFNNLKN

SEQ ID NO: 394094 - protein, 9 aa, Homo Sapiens
EELVCKLER

SEQ ID NO: 394095 - protein, 9 aa, Homo Sapiens
HLLTGDHVL

SEQ ID NO: 394096 - protein, 9 aa, Homo Sapiens
REASLSSLT

SEQ ID NO: 394097 - protein, 9 aa, Homo Sapiens
DKTKPLGTV

SEQ ID NO: 394098 - protein, 9 aa, Homo Sapiens
FLTEDKKNG

SEQ ID NO: 394099 - protein, 9 aa, Homo Sapiens
EHRVAAKQL

SEQ ID NO: 394100 - protein, 9 aa, Homo Sapiens
SARSASALP

SEQ ID NO: 394101 - protein, 9 aa, Homo Sapiens
DRSETLTDS

SEQ ID NO: 394102 - protein, 9 aa, Homo Sapiens
EKNVHRQPV

SEQ ID NO: 394103 - protein, 9 aa, Homo Sapiens
QVVEDGQHV

SEQ ID NO: 394104 - protein, 9 aa, Homo Sapiens
FGSAIRGKP

SEQ ID NO: 394105 - protein, 9 aa, Homo Sapiens
LGKDATSPM

SEQ ID NO: 394106 - protein, 9 aa, Homo Sapiens
TDDSYVQSN

SEQ ID NO: 394107 - protein, 9 aa, Homo Sapiens
NILAHIWAL

SEQ ID NO: 394108 - protein, 9 aa, Homo Sapiens
GSFRCLAFE

SEQ ID NO: 394109 - protein, 9 aa, Homo Sapiens
YVELYVCVW

SEQ ID NO: 394110 - protein, 9 aa, Homo Sapiens
PEDILIPAD

SEQ ID NO: 394111 - protein, 9 aa, Homo Sapiens
HVEDTTFFP

SEQ ID NO: 394112 - protein, 9 aa, Homo Sapiens
EVPWPEVWK

SEQ ID NO: 394113 - protein, 9 aa, Homo Sapiens
WQGGASSAK

SEQ ID NO: 394114 - protein, 9 aa, Homo Sapiens
DYIVEPSIF

SEQ ID NO: 394115 - protein, 9 aa, Homo Sapiens
GPSTPACSC

SEQ ID NO: 394116 - protein, 9 aa, Homo Sapiens
AMMGPSPDW

SEQ ID NO: 394117 - protein, 9 aa, Homo Sapiens
TCLENLAVP

SEQ ID NO: 394118 - protein, 9 aa, Homo Sapiens
QCQELGCCF

SEQ ID NO: 394119 - protein, 9 aa, Homo Sapiens
GLLFSFDVH

SEQ ID NO: 394120 - protein, 9 aa, Homo Sapiens
AGGPPRSRL

SEQ ID NO: 394121 - protein, 9 aa, Homo Sapiens
PCSCTFVPP

SEQ ID NO: 394122 - protein, 9 aa, Homo Sapiens
TFRKNPDPR

SEQ ID NO: 394123 - protein, 9 aa, Homo Sapiens
KKGLQRGRL

SEQ ID NO: 394124 - protein, 9 aa, Homo Sapiens
LLTECLAQL

SEQ ID NO: 394125 - protein, 9 aa, Homo Sapiens
ETVPYLKNF

SEQ ID NO: 394126 - protein, 9 aa, Homo Sapiens
LKGPSANVY

SEQ ID NO: 394127 - protein, 9 aa, Homo Sapiens
NLTMKNCKA

SEQ ID NO: 394128 - protein, 9 aa, Homo Sapiens
SGLLSIDLC

SEQ ID NO: 394129 - protein, 9 aa, Homo Sapiens
SICSPEPGA

SEQ ID NO: 394130 - protein, 9 aa, Homo Sapiens
LPATWCLGP

SEQ ID NO: 394131 - protein, 9 aa, Homo Sapiens
ATPGRPWPP

SEQ ID NO: 394132 - protein, 9 aa, Homo Sapiens
GARVFAQRF

SEQ ID NO: 394133 - protein, 9 aa, Homo Sapiens
SLFPQPLTA

SEQ ID NO: 394134 - protein, 9 aa, Homo Sapiens
EGQFVSWIV

SEQ ID NO: 394135 - protein, 9 aa, Homo Sapiens
GVLGPEGQF

SEQ ID NO: 394136 - protein, 9 aa, Homo Sapiens
SKFPGGRGG

SEQ ID NO: 394137 - protein, 9 aa, Homo Sapiens
TGMMPNGQD

SEQ ID NO: 394138 - protein, 9 aa, Homo Sapiens
NNLTGQRGR

SEQ ID NO: 394139 - protein, 9 aa, Homo Sapiens
RQYYFNVGW

SEQ ID NO: 394140 - protein, 9 aa, Homo Sapiens
LLTIPSASR

SEQ ID NO: 394141 - protein, 9 aa, Homo Sapiens
KNSTYSHRA

SEQ ID NO: 394142 - protein, 9 aa, Homo Sapiens
LQEHMGSCL

SEQ ID NO: 394143 - protein, 9 aa, Homo Sapiens
ARRTDSASS

SEQ ID NO: 394144 - protein, 9 aa, Homo Sapiens
ARGTRSTRS

SEQ ID NO: 394145 - protein, 9 aa, Homo Sapiens
AEVTKMSCQ

SEQ ID NO: 394146 - protein, 9 aa, Homo Sapiens
MSVIQSGTQ

SEQ ID NO: 394147 - protein, 9 aa, Homo Sapiens
MEALGSWGQ

SEQ ID NO: 394148 - protein, 9 aa, Homo Sapiens
NLFCLETLN

SEQ ID NO: 394149 - protein, 9 aa, Homo Sapiens
EGPAAPGGG

SEQ ID NO: 394150 - protein, 9 aa, Homo Sapiens
IVNTVNQKK

SEQ ID NO: 394151 - protein, 9 aa, Homo Sapiens
LTHLPQYYI

SEQ ID NO: 394152 - protein, 9 aa, Homo Sapiens
KHHMLKIMQ

SEQ ID NO: 394153 - protein, 9 aa, Homo Sapiens
VPAQVEGED

SEQ ID NO: 394154 - protein, 9 aa, Homo Sapiens
TWSVLLLLF

SEQ ID NO: 394155 - protein, 9 aa, Homo Sapiens
VLVSDPISP

SEQ ID NO: 394156 - protein, 9 aa, Homo Sapiens
LVVDTKILI

SEQ ID NO: 394157 - protein, 9 aa, Homo Sapiens
ARRRTWWRT

SEQ ID NO: 394158 - protein, 9 aa, Homo Sapiens
GNETAFSGG

SEQ ID NO: 394159 - protein, 9 aa, Homo Sapiens
LRPAGARAH

SEQ ID NO: 394160 - protein, 9 aa, Homo Sapiens
PVDFFEFCD

SEQ ID NO: 394161 - protein, 9 aa, Homo Sapiens
SRGASGTRE

SEQ ID NO: 394162 - protein, 9 aa, Homo Sapiens
KEGFTGLDC

SEQ ID NO: 394163 - protein, 9 aa, Homo Sapiens
RGQGLFAVL

SEQ ID NO: 394164 - protein, 9 aa, Homo Sapiens
DKANQIINN

SEQ ID NO: 394165 - protein, 9 aa, Homo Sapiens
TGKLSHWVD

SEQ ID NO: 394166 - protein, 9 aa, Homo Sapiens
SLLFSQTRL

SEQ ID NO: 394167 - protein, 9 aa, Homo Sapiens
AISTFGTSI

SEQ ID NO: 394168 - protein, 9 aa, Homo Sapiens
TMFLEKTSK

SEQ ID NO: 394169 - protein, 9 aa, Homo Sapiens
VDKANQIIN

SEQ ID NO: 394170 - protein, 9 aa, Homo Sapiens
ELPENMFQV

SEQ ID NO: 394171 - protein, 9 aa, Homo Sapiens
LEQFWRIVF

SEQ ID NO: 394172 - protein, 9 aa, Homo Sapiens
PIRTPAPPW

SEQ ID NO: 394173 - protein, 9 aa, Homo Sapiens
MLSLTHLFL

SEQ ID NO: 394174 - protein, 9 aa, Homo Sapiens
FLFRKKKEV

SEQ ID NO: 394175 - protein, 9 aa, Homo Sapiens
FGALGPISP

SEQ ID NO: 394176 - protein, 9 aa, Homo Sapiens
KYLLMQHLI

SEQ ID NO: 394177 - protein, 9 aa, Homo Sapiens
PLSKFPGGR

SEQ ID NO: 394178 - protein, 9 aa, Homo Sapiens
RGLRGTPGV

SEQ ID NO: 394179 - protein, 9 aa, Homo Sapiens
LLPGMGPHV

SEQ ID NO: 394180 - protein, 9 aa, Homo Sapiens
KPMARTSGS

SEQ ID NO: 394181 - protein, 9 aa, Homo Sapiens
NMDHVKARE

SEQ ID NO: 394182 - protein, 9 aa, Homo Sapiens
ARETVESIF

SEQ ID NO: 394183 - protein, 9 aa, Homo Sapiens
ELNEKCNKQ

SEQ ID NO: 394184 - protein, 9 aa, Homo Sapiens
MHTVIVQDK

SEQ ID NO: 394185 - protein, 9 aa, Homo Sapiens
YYTEFTPLK

SEQ ID NO: 394186 - protein, 9 aa, Homo Sapiens
KDHRTSQNH

SEQ ID NO: 394187 - protein, 9 aa, Homo Sapiens
DPHEDIEHR

SEQ ID NO: 394188 - protein, 9 aa, Homo Sapiens
CMCSPEVTI

SEQ ID NO: 394189 - protein, 9 aa, Homo Sapiens
RAHHEGSAC

SEQ ID NO: 394190 - protein, 9 aa, Homo Sapiens
ASTLRWSWP

SEQ ID NO: 394191 - protein, 9 aa, Homo Sapiens
CRGRHWRCL

SEQ ID NO: 394192 - protein, 9 aa, Homo Sapiens
TIYNTTQPS

SEQ ID NO: 394193 - protein, 9 aa, Homo Sapiens
TSDTMFLEK

SEQ ID NO: 394194 - protein, 9 aa, Homo Sapiens
RLWEIQHMS

SEQ ID NO: 394195 - protein, 9 aa, Homo Sapiens
VERCMSVIQ

SEQ ID NO: 394196 - protein, 9 aa, Homo Sapiens
MLSNILGVQ

SEQ ID NO: 394197 - protein, 9 aa, Homo Sapiens
AKEITEGVP

SEQ ID NO: 394198 - protein, 9 aa, Homo Sapiens
SGGTTSSSG

SEQ ID NO: 394199 - protein, 9 aa, Homo Sapiens
VVSNTTRTL

SEQ ID NO: 394200 - protein, 9 aa, Homo Sapiens
VAPSGPGKS

SEQ ID NO: 394201 - protein, 9 aa, Homo Sapiens
TMSVSAQEF

SEQ ID NO: 394202 - protein, 9 aa, Homo Sapiens
LTTHTLGTF

SEQ ID NO: 394203 - protein, 9 aa, Homo Sapiens
LSWKPGARE

SEQ ID NO: 394204 - protein, 9 aa, Homo Sapiens
LSILKYLLM

SEQ ID NO: 394205 - protein, 9 aa, Homo Sapiens
CKKSCSIII

SEQ ID NO: 394206 - protein, 9 aa, Homo Sapiens
QRRYSDFEW

SEQ ID NO: 394207 - protein, 9 aa, Homo Sapiens
DYPPEFYEH

SEQ ID NO: 394208 - protein, 9 aa, Homo Sapiens
GPWALATLC

SEQ ID NO: 394209 - protein, 9 aa, Homo Sapiens
AQCRGRPAR

SEQ ID NO: 394210 - protein, 9 aa, Homo Sapiens
VLGALGSMV

SEQ ID NO: 394211 - protein, 9 aa, Homo Sapiens
SSPRNPPSP

SEQ ID NO: 394212 - protein, 9 aa, Homo Sapiens
LRAEIQHCQ

SEQ ID NO: 394213 - protein, 9 aa, Homo Sapiens
GGPGFTGAT

SEQ ID NO: 394214 - protein, 9 aa, Homo Sapiens
VTIFMGHCY

SEQ ID NO: 394215 - protein, 9 aa, Homo Sapiens
ERSDEDSYI

SEQ ID NO: 394216 - protein, 9 aa, Homo Sapiens
PVQIQSQSS

SEQ ID NO: 394217 - protein, 9 aa, Homo Sapiens
GPGQRRCCS

SEQ ID NO: 394218 - protein, 9 aa, Homo Sapiens
EKKEEGKEQ

SEQ ID NO: 394219 - protein, 9 aa, Homo Sapiens
SARGSGNTS

SEQ ID NO: 394220 - protein, 9 aa, Homo Sapiens
DYEFNPIVV

SEQ ID NO: 394221 - protein, 9 aa, Homo Sapiens
IHWVQKILA

SEQ ID NO: 394222 - protein, 9 aa, Homo Sapiens
GGIANYNIS

SEQ ID NO: 394223 - protein, 9 aa, Homo Sapiens
WEPLCATHW

SEQ ID NO: 394224 - protein, 9 aa, Homo Sapiens
CLGPAARPQ

SEQ ID NO: 394225 - protein, 9 aa, Homo Sapiens
SRVGTCMYA

SEQ ID NO: 394226 - protein, 9 aa, Homo Sapiens
LPRCPPRWS

SEQ ID NO: 394227 - protein, 9 aa, Homo Sapiens
SILSALRVS

SEQ ID NO: 394228 - protein, 9 aa, Homo Sapiens
ASSIPTTMN

SEQ ID NO: 394229 - protein, 9 aa, Homo Sapiens
FSNLVRLMG

SEQ ID NO: 394230 - protein, 9 aa, Homo Sapiens
QAVYYYTVT

SEQ ID NO: 394231 - protein, 9 aa, Homo Sapiens
KITLLHRTQ

SEQ ID NO: 394232 - protein, 9 aa, Homo Sapiens
EQSHVINQA

SEQ ID NO: 394233 - protein, 9 aa, Homo Sapiens
ESSSCNYIQ

SEQ ID NO: 394234 - protein, 9 aa, Homo Sapiens
CLRIQTRSF

SEQ ID NO: 394235 - protein, 9 aa, Homo Sapiens
ELFLLVSLA

SEQ ID NO: 394236 - protein, 9 aa, Homo Sapiens
LQNQQHPKK

SEQ ID NO: 394237 - protein, 9 aa, Homo Sapiens
LAVEACLRT

SEQ ID NO: 394238 - protein, 9 aa, Homo Sapiens
KVIEPVGNC

SEQ ID NO: 394239 - protein, 9 aa, Homo Sapiens
QFWRIVFWL

SEQ ID NO: 394240 - protein, 9 aa, Homo Sapiens
NPTWRRTGA

SEQ ID NO: 394241 - protein, 9 aa, Homo Sapiens
TQIFSYLGL

SEQ ID NO: 394242 - protein, 9 aa, Homo Sapiens
QHVVDGDAG

SEQ ID NO: 394243 - protein, 9 aa, Homo Sapiens
KGIIYDTDG

SEQ ID NO: 394244 - protein, 9 aa, Homo Sapiens
LTTGTRWAW

SEQ ID NO: 394245 - protein, 9 aa, Homo Sapiens
EEEKGEAEE

SEQ ID NO: 394246 - protein, 9 aa, Homo Sapiens
SALGTASEG

SEQ ID NO: 394247 - protein, 9 aa, Homo Sapiens
LKNITLDDV

SEQ ID NO: 394248 - protein, 9 aa, Homo Sapiens
FWNIKIRLL

SEQ ID NO: 394249 - protein, 9 aa, Homo Sapiens
RQKSEADKN

SEQ ID NO: 394250 - protein, 9 aa, Homo Sapiens
TPILEPERT

SEQ ID NO: 394251 - protein, 9 aa, Homo Sapiens
HNSVKKTAP

SEQ ID NO: 394252 - protein, 9 aa, Homo Sapiens
PSAPGSARS

SEQ ID NO: 394253 - protein, 9 aa, Homo Sapiens
AGRNKGLRE

SEQ ID NO: 394254 - protein, 9 aa, Homo Sapiens
RPLGVSPLA

SEQ ID NO: 394255 - protein, 9 aa, Homo Sapiens
DPGVIKQKV

SEQ ID NO: 394256 - protein, 9 aa, Homo Sapiens
KVEEANERY

SEQ ID NO: 394257 - protein, 9 aa, Homo Sapiens
GCCQCQAGW

SEQ ID NO: 394258 - protein, 9 aa, Homo Sapiens
LKTLNMIQV

SEQ ID NO: 394259 - protein, 9 aa, Homo Sapiens
PQEESPPLA

SEQ ID NO: 394260 - protein, 9 aa, Homo Sapiens
RPTTGGPRS

SEQ ID NO: 394261 - protein, 9 aa, Homo Sapiens
GILLVRPSC

SEQ ID NO: 394262 - protein, 9 aa, Homo Sapiens
RRPPPPAQP

SEQ ID NO: 394263 - protein, 9 aa, Homo Sapiens
FLFFIPGVV

SEQ ID NO: 394264 - protein, 9 aa, Homo Sapiens
PRFPRRVLA

SEQ ID NO: 394265 - protein, 9 aa, Homo Sapiens
FERARPTQT

SEQ ID NO: 394266 - protein, 9 aa, Homo Sapiens
STTLARGSG

SEQ ID NO: 394267 - protein, 9 aa, Homo Sapiens
LNMIQVLMS

SEQ ID NO: 394268 - protein, 9 aa, Homo Sapiens
CPSIHLDGE

SEQ ID NO: 394269 - protein, 9 aa, Homo Sapiens
RGDPGVIKQ

SEQ ID NO: 394270 - protein, 9 aa, Homo Sapiens
IISLLGMQL

SEQ ID NO: 394271 - protein, 9 aa, Homo Sapiens
ESTWENPQE

SEQ ID NO: 394272 - protein, 9 aa, Homo Sapiens
LADITSKYH

SEQ ID NO: 394273 - protein, 9 aa, Homo Sapiens
KAFQAMLRW

SEQ ID NO: 394274 - protein, 9 aa, Homo Sapiens
QGTRRSSNK

SEQ ID NO: 394275 - protein, 9 aa, Homo Sapiens
QAWLSMTPH

SEQ ID NO: 394276 - protein, 9 aa, Homo Sapiens
QTRLPALPT

SEQ ID NO: 394277 - protein, 9 aa, Homo Sapiens
ENVTLDGTD

SEQ ID NO: 394278 - protein, 9 aa, Homo Sapiens
GSRWKSGSW

SEQ ID NO: 394279 - protein, 9 aa, Homo Sapiens
INNEQTRLL

SEQ ID NO: 394280 - protein, 9 aa, Homo Sapiens
IGSTNLIVY

SEQ ID NO: 394281 - protein, 9 aa, Homo Sapiens
SFLASRARG

SEQ ID NO: 394282 - protein, 9 aa, Homo Sapiens
ELDPHEDIE

SEQ ID NO: 394283 - protein, 9 aa, Homo Sapiens
CAPVPSLSL

SEQ ID NO: 394284 - protein, 9 aa, Homo Sapiens
FLCPSDTVM

SEQ ID NO: 394285 - protein, 9 aa, Homo Sapiens
KGIEKARVH

SEQ ID NO: 394286 - protein, 9 aa, Homo Sapiens
ITLDDVSAP

SEQ ID NO: 394287 - protein, 9 aa, Homo Sapiens
VNLTMKNCK

SEQ ID NO: 394288 - protein, 9 aa, Homo Sapiens
CPRPHDSPP

SEQ ID NO: 394289 - protein, 9 aa, Homo Sapiens
EIVNAGLRS

SEQ ID NO: 394290 - protein, 9 aa, Homo Sapiens
LEGCISVKD

SEQ ID NO: 394291 - protein, 9 aa, Homo Sapiens
PPCLPLARP

SEQ ID NO: 394292 - protein, 9 aa, Homo Sapiens
QVEELFSRV

SEQ ID NO: 394293 - protein, 9 aa, Homo Sapiens
DAFSSDPSS

SEQ ID NO: 394294 - protein, 9 aa, Homo Sapiens
RARGTLEAR

SEQ ID NO: 394295 - protein, 9 aa, Homo Sapiens
DLPILDDQI

SEQ ID NO: 394296 - protein, 9 aa, Homo Sapiens
FAAAVVREF

SEQ ID NO: 394297 - protein, 9 aa, Homo Sapiens
SIDLCKGDR

SEQ ID NO: 394298 - protein, 9 aa, Homo Sapiens
MGPQDHLTG

SEQ ID NO: 394299 - protein, 9 aa, Homo Sapiens
EAHTGRKKR

SEQ ID NO: 394300 - protein, 9 aa, Homo Sapiens
DTMFLEKTS

SEQ ID NO: 394301 - protein, 9 aa, Homo Sapiens
QQLQNQQHP

SEQ ID NO: 394302 - protein, 9 aa, Homo Sapiens
LLPLGLFGD

SEQ ID NO: 394303 - protein, 9 aa, Homo Sapiens
RTISTRGSF

SEQ ID NO: 394304 - protein, 9 aa, Homo Sapiens
SRARGTRGT

SEQ ID NO: 394305 - protein, 9 aa, Homo Sapiens
GVPKSLVSN

SEQ ID NO: 394306 - protein, 9 aa, Homo Sapiens
PGPAGSRGE

SEQ ID NO: 394307 - protein, 9 aa, Homo Sapiens
MFLFLFYLS

SEQ ID NO: 394308 - protein, 9 aa, Homo Sapiens
CDRKDRTVL

SEQ ID NO: 394309 - protein, 9 aa, Homo Sapiens
VSSSEEVIK

SEQ ID NO: 394310 - protein, 9 aa, Homo Sapiens
FLAMMGPSP

SEQ ID NO: 394311 - protein, 9 aa, Homo Sapiens
CKEGFTGLD

SEQ ID NO: 394312 - protein, 9 aa, Homo Sapiens
GVADARLER

SEQ ID NO: 394313 - protein, 9 aa, Homo Sapiens
PPCWSPLQP

SEQ ID NO: 394314 - protein, 9 aa, Homo Sapiens
VTRGTSRAR

SEQ ID NO: 394315 - protein, 9 aa, Homo Sapiens
MDADVLDFN

SEQ ID NO: 394316 - protein, 9 aa, Homo Sapiens
EGWRWGWGQ

SEQ ID NO: 394317 - protein, 9 aa, Homo Sapiens
RQADHTTLS

SEQ ID NO: 394318 - protein, 9 aa, Homo Sapiens
QEKEWATEK

SEQ ID NO: 394319 - protein, 9 aa, Homo Sapiens
AVGNPRKCS

SEQ ID NO: 394320 - protein, 9 aa, Homo Sapiens
VASVSSDCF

SEQ ID NO: 394321 - protein, 9 aa, Homo Sapiens
LGNLSPGVV

SEQ ID NO: 394322 - protein, 9 aa, Homo Sapiens
ARGTSGTSR

SEQ ID NO: 394323 - protein, 9 aa, Homo Sapiens
WTQFRNYPR

SEQ ID NO: 394324 - protein, 9 aa, Homo Sapiens
DCHIPQIED

SEQ ID NO: 394325 - protein, 9 aa, Homo Sapiens
FSSFFFNFF

SEQ ID NO: 394326 - protein, 9 aa, Homo Sapiens
FTRFACFTW

SEQ ID NO: 394327 - protein, 9 aa, Homo Sapiens
VNTVNQKKA

SEQ ID NO: 394328 - protein, 9 aa, Homo Sapiens
LLAHRHYAS

SEQ ID NO: 394329 - protein, 9 aa, Homo Sapiens
NKQQESSFS

SEQ ID NO: 394330 - protein, 9 aa, Homo Sapiens
IMYAKCLES

SEQ ID NO: 394331 - protein, 9 aa, Homo Sapiens
DVFDDIPKC

SEQ ID NO: 394332 - protein, 9 aa, Homo Sapiens
IYNTTQPSQ

SEQ ID NO: 394333 - protein, 9 aa, Homo Sapiens
ARRPLRRLP

SEQ ID NO: 394334 - protein, 9 aa, Homo Sapiens
RCMSVIQSG

SEQ ID NO: 394335 - protein, 9 aa, Homo Sapiens
RFEEEARLH

SEQ ID NO: 394336 - protein, 9 aa, Homo Sapiens
TTGMCHHAQ

SEQ ID NO: 394337 - protein, 9 aa, Homo Sapiens
REGQSGWSG

SEQ ID NO: 394338 - protein, 9 aa, Homo Sapiens
VRAMMQELH

SEQ ID NO: 394339 - protein, 9 aa, Homo Sapiens
HTNPLFFSF

SEQ ID NO: 394340 - protein, 9 aa, Homo Sapiens
GSGVIVVQL

SEQ ID NO: 394341 - protein, 9 aa, Homo Sapiens
ETSHLPLYA

SEQ ID NO: 394342 - protein, 9 aa, Homo Sapiens
WPASSFAHI

SEQ ID NO: 394343 - protein, 9 aa, Homo Sapiens
AHSATGVII

SEQ ID NO: 394344 - protein, 9 aa, Homo Sapiens
TPRLRIWVP

SEQ ID NO: 394345 - protein, 9 aa, Homo Sapiens
KKAFQAMLR

SEQ ID NO: 394346 - protein, 9 aa, Homo Sapiens
REEKNVHRQ

SEQ ID NO: 394347 - protein, 9 aa, Homo Sapiens
AWPSAISPT

SEQ ID NO: 394348 - protein, 9 aa, Homo Sapiens
MREDPAAAQ

SEQ ID NO: 394349 - protein, 9 aa, Homo Sapiens
ATRSTTLAR

SEQ ID NO: 394350 - protein, 9 aa, Homo Sapiens
LEKILVNLT

SEQ ID NO: 394351 - protein, 9 aa, Homo Sapiens
GTFRASGPL

SEQ ID NO: 394352 - protein, 9 aa, Homo Sapiens
QQMIFAPEE

SEQ ID NO: 394353 - protein, 9 aa, Homo Sapiens
RSPRCPLPL

SEQ ID NO: 394354 - protein, 9 aa, Homo Sapiens
HPSVELADA

SEQ ID NO: 394355 - protein, 9 aa, Homo Sapiens
NGARETVES

SEQ ID NO: 394356 - protein, 9 aa, Homo Sapiens
TPKSDVKIH

SEQ ID NO: 394357 - protein, 9 aa, Homo Sapiens
LVDESGAPL

SEQ ID NO: 394358 - protein, 9 aa, Homo Sapiens
GHTNCPSIH

SEQ ID NO: 394359 - protein, 9 aa, Homo Sapiens
SQKYKRINK

SEQ ID NO: 394360 - protein, 9 aa, Homo Sapiens
GVCATQHQL

SEQ ID NO: 394361 - protein, 9 aa, Homo Sapiens
RARCTRAPP

SEQ ID NO: 394362 - protein, 9 aa, Homo Sapiens
FVLLENLAI

SEQ ID NO: 394363 - protein, 9 aa, Homo Sapiens
VFQGFSSFY

SEQ ID NO: 394364 - protein, 9 aa, Homo Sapiens
KALANVISS

SEQ ID NO: 394365 - protein, 9 aa, Homo Sapiens
KPEMVMLYP

SEQ ID NO: 394366 - protein, 9 aa, Homo Sapiens
TIHWILMIR

SEQ ID NO: 394367 - protein, 9 aa, Homo Sapiens
RREELLKKC

SEQ ID NO: 394368 - protein, 9 aa, Homo Sapiens
GPGFTGATC

SEQ ID NO: 394369 - protein, 9 aa, Homo Sapiens
DVCDRKDRT

SEQ ID NO: 394370 - protein, 9 aa, Homo Sapiens
FVQPAWKIV

SEQ ID NO: 394371 - protein, 9 aa, Homo Sapiens
VAKIGACCC

SEQ ID NO: 394372 - protein, 9 aa, Homo Sapiens
PLHFDTAQG

SEQ ID NO: 394373 - protein, 9 aa, Homo Sapiens
TSRSLWCPV

SEQ ID NO: 394374 - protein, 9 aa, Homo Sapiens
TRGTSAAAS

SEQ ID NO: 394375 - protein, 9 aa, Homo Sapiens
NEDQEADRE

SEQ ID NO: 394376 - protein, 9 aa, Homo Sapiens
LNAVGYFCF

SEQ ID NO: 394377 - protein, 9 aa, Homo Sapiens
QAVRAELQD

SEQ ID NO: 394378 - protein, 9 aa, Homo Sapiens
LALLEKNQS

SEQ ID NO: 394379 - protein, 9 aa, Homo Sapiens
RGGPGGAPG

SEQ ID NO: 394380 - protein, 9 aa, Homo Sapiens
ALRQYYFNV

SEQ ID NO: 394381 - protein, 9 aa, Homo Sapiens
DLQGSDSVA

SEQ ID NO: 394382 - protein, 9 aa, Homo Sapiens
KQAESKNQI

SEQ ID NO: 394383 - protein, 9 aa, Homo Sapiens
GARLTTHTL

SEQ ID NO: 394384 - protein, 9 aa, Homo Sapiens
DDTLGDTLT

SEQ ID NO: 394385 - protein, 9 aa, Homo Sapiens
AATVRSITH

SEQ ID NO: 394386 - protein, 9 aa, Homo Sapiens
HAQDAIELG

SEQ ID NO: 394387 - protein, 9 aa, Homo Sapiens
ISIIDILVS

SEQ ID NO: 394388 - protein, 9 aa, Homo Sapiens
TGKSKKKKR

SEQ ID NO: 394389 - protein, 9 aa, Homo Sapiens
ENLGLVGER

SEQ ID NO: 394390 - protein, 9 aa, Homo Sapiens
RQMHSNTPR

SEQ ID NO: 394391 - protein, 9 aa, Homo Sapiens
ILGEGSVST

SEQ ID NO: 394392 - protein, 9 aa, Homo Sapiens
FGQQLLAHR

SEQ ID NO: 394393 - protein, 9 aa, Homo Sapiens
ETCFNIQGS

SEQ ID NO: 394394 - protein, 9 aa, Homo Sapiens
ATALFLHPE

SEQ ID NO: 394395 - protein, 9 aa, Homo Sapiens
AAGALGSRG

SEQ ID NO: 394396 - protein, 9 aa, Homo Sapiens
TEGVPGQEF

SEQ ID NO: 394397 - protein, 9 aa, Homo Sapiens
LDQDTDTIA

SEQ ID NO: 394398 - protein, 9 aa, Homo Sapiens
RHFGATVAT

SEQ ID NO: 394399 - protein, 9 aa, Homo Sapiens
LRTELVTYP

SEQ ID NO: 394400 - protein, 9 aa, Homo Sapiens
RAHQSSPWP

SEQ ID NO: 394401 - protein, 9 aa, Homo Sapiens
LFLEEERQI

SEQ ID NO: 394402 - protein, 9 aa, Homo Sapiens
LMMYGLWTP

SEQ ID NO: 394403 - protein, 9 aa, Homo Sapiens
GAAVDRGKL

SEQ ID NO: 394404 - protein, 9 aa, Homo Sapiens
ILGIYLCPK

SEQ ID NO: 394405 - protein, 9 aa, Homo Sapiens
RQVREHVLE

SEQ ID NO: 394406 - protein, 9 aa, Homo Sapiens
VDGWVEEWY

SEQ ID NO: 394407 - protein, 9 aa, Homo Sapiens
SPASAPTRW

SEQ ID NO: 394408 - protein, 9 aa, Homo Sapiens
IIYDTDGQE

SEQ ID NO: 394409 - protein, 9 aa, Homo Sapiens
HRTSQNHSK

SEQ ID NO: 394410 - protein, 9 aa, Homo Sapiens
SNRIMYFLE

SEQ ID NO: 394411 - protein, 9 aa, Homo Sapiens
DVRILEQTY

SEQ ID NO: 394412 - protein, 9 aa, Homo Sapiens
KEKGHINCP

SEQ ID NO: 394413 - protein, 9 aa, Homo Sapiens
MMAVTIFMG

SEQ ID NO: 394414 - protein, 9 aa, Homo Sapiens
SQGGRILLQ

SEQ ID NO: 394415 - protein, 9 aa, Homo Sapiens
ILRTQKPKR

SEQ ID NO: 394416 - protein, 9 aa, Homo Sapiens
VGTTLLSFG

SEQ ID NO: 394417 - protein, 9 aa, Homo Sapiens
TWGLTPSWS

SEQ ID NO: 394418 - protein, 9 aa, Homo Sapiens
RARGTSGTS

SEQ ID NO: 394419 - protein, 9 aa, Homo Sapiens
SRARGSLSS

SEQ ID NO: 394420 - protein, 9 aa, Homo Sapiens
IQVFIYRLF

SEQ ID NO: 394421 - protein, 9 aa, Homo Sapiens
LVDIQYLYS

SEQ ID NO: 394422 - protein, 9 aa, Homo Sapiens
IMLFDGPFQ

SEQ ID NO: 394423 - protein, 9 aa, Homo Sapiens
ARRARGTLE

SEQ ID NO: 394424 - protein, 9 aa, Homo Sapiens
STNSTREAR

SEQ ID NO: 394425 - protein, 9 aa, Homo Sapiens
KSGLLFSFD

SEQ ID NO: 394426 - protein, 9 aa, Homo Sapiens
PCGKRINFG

SEQ ID NO: 394427 - protein, 9 aa, Homo Sapiens
MKLSDFNDV

SEQ ID NO: 394428 - protein, 9 aa, Homo Sapiens
EKKARKKPA

SEQ ID NO: 394429 - protein, 9 aa, Homo Sapiens
TSRTRGSRG

SEQ ID NO: 394430 - protein, 9 aa, Homo Sapiens
ARASSQTLG

SEQ ID NO: 394431 - protein, 9 aa, Homo Sapiens
YETRQKRDV

SEQ ID NO: 394432 - protein, 9 aa, Homo Sapiens
KFSTRDYIV

SEQ ID NO: 394433 - protein, 9 aa, Homo Sapiens
KEKELCTWE

SEQ ID NO: 394434 - protein, 9 aa, Homo Sapiens
VMPTIGQRV

SEQ ID NO: 394435 - protein, 9 aa, Homo Sapiens
CRSHLRMHM

SEQ ID NO: 394436 - protein, 9 aa, Homo Sapiens
NKQMKTLRG

SEQ ID NO: 394437 - protein, 9 aa, Homo Sapiens
GWTAEGSVV

SEQ ID NO: 394438 - protein, 9 aa, Homo Sapiens
ISYKEGMKI

SEQ ID NO: 394439 - protein, 9 aa, Homo Sapiens
VSFDFFRVL

SEQ ID NO: 394440 - protein, 9 aa, Homo Sapiens
DLLTGLPAP

SEQ ID NO: 394441 - protein, 9 aa, Homo Sapiens
EVLEALLST

SEQ ID NO: 394442 - protein, 9 aa, Homo Sapiens
LLHLECEKY

SEQ ID NO: 394443 - protein, 9 aa, Homo Sapiens
CPMILRTLS

SEQ ID NO: 394444 - protein, 9 aa, Homo Sapiens
LQGEQMYRR

SEQ ID NO: 394445 - protein, 9 aa, Homo Sapiens
TIPSASRPT

SEQ ID NO: 394446 - protein, 9 aa, Homo Sapiens
CEDRIRVCG

SEQ ID NO: 394447 - protein, 9 aa, Homo Sapiens
AVLSPEDMP

SEQ ID NO: 394448 - protein, 9 aa, Homo Sapiens
WVGYVHVHV

SEQ ID NO: 394449 - protein, 9 aa, Homo Sapiens
SVSFAARST

SEQ ID NO: 394450 - protein, 9 aa, Homo Sapiens
ARGSGQASG

SEQ ID NO: 394451 - protein, 9 aa, Homo Sapiens
IWRRIGATT

SEQ ID NO: 394452 - protein, 9 aa, Homo Sapiens
IIKVKEEFT

SEQ ID NO: 394453 - protein, 9 aa, Homo Sapiens
VVRKLQWKR

SEQ ID NO: 394454 - protein, 9 aa, Homo Sapiens
SPRCPLPLP

SEQ ID NO: 394455 - protein, 9 aa, Homo Sapiens
LVMCLRLRT

SEQ ID NO: 394456 - protein, 9 aa, Homo Sapiens
KTLNMIQVL

SEQ ID NO: 394457 - protein, 9 aa, Homo Sapiens
MERFDNLII

SEQ ID NO: 394458 - protein, 9 aa, Homo Sapiens
SSIPTTMNY

SEQ ID NO: 394459 - protein, 9 aa, Homo Sapiens
MEENFSLKC

SEQ ID NO: 394460 - protein, 9 aa, Homo Sapiens
HRQPVQIQS

SEQ ID NO: 394461 - protein, 9 aa, Homo Sapiens
GPGPTPQPS

SEQ ID NO: 394462 - protein, 9 aa, Homo Sapiens
FTGATCLLR

SEQ ID NO: 394463 - protein, 9 aa, Homo Sapiens
YGAYLQLRE

SEQ ID NO: 394464 - protein, 9 aa, Homo Sapiens
GTREARSTS

SEQ ID NO: 394465 - protein, 9 aa, Homo Sapiens
NNNLLHAMP

SEQ ID NO: 394466 - protein, 9 aa, Homo Sapiens
SQTVVTFSF

SEQ ID NO: 394467 - protein, 9 aa, Homo Sapiens
SPVRNSPCS

SEQ ID NO: 394468 - protein, 9 aa, Homo Sapiens
AHSEIFMDE

SEQ ID NO: 394469 - protein, 9 aa, Homo Sapiens
FLQGFLPQA

SEQ ID NO: 394470 - protein, 9 aa, Homo Sapiens
AKVWTSGQV

SEQ ID NO: 394471 - protein, 9 aa, Homo Sapiens
ENQCSLDTK

SEQ ID NO: 394472 - protein, 9 aa, Homo Sapiens
RCFPEENFT

SEQ ID NO: 394473 - protein, 9 aa, Homo Sapiens
GAGMDAKVY

SEQ ID NO: 394474 - protein, 9 aa, Homo Sapiens
WPQEESPPL

SEQ ID NO: 394475 - protein, 9 aa, Homo Sapiens
TEEENADSD

SEQ ID NO: 394476 - protein, 9 aa, Homo Sapiens
GTTFTTCSR

SEQ ID NO: 394477 - protein, 9 aa, Homo Sapiens
ARTAGDTPD

SEQ ID NO: 394478 - protein, 9 aa, Homo Sapiens
GTRRAAGAL

SEQ ID NO: 394479 - protein, 9 aa, Homo Sapiens
PLLRTWRGL

SEQ ID NO: 394480 - protein, 9 aa, Homo Sapiens
IEQATVDTN

SEQ ID NO: 394481 - protein, 9 aa, Homo Sapiens
NTATAASAA

SEQ ID NO: 394482 - protein, 9 aa, Homo Sapiens
QSKDAALKC

SEQ ID NO: 394483 - protein, 9 aa, Homo Sapiens
QNLFVLGFS

SEQ ID NO: 394484 - protein, 9 aa, Homo Sapiens
MKFPVRLII

SEQ ID NO: 394485 - protein, 9 aa, Homo Sapiens
LANLNWLHE

SEQ ID NO: 394486 - protein, 9 aa, Homo Sapiens
LTHFSPQPL

SEQ ID NO: 394487 - protein, 9 aa, Homo Sapiens
LHDDTEAAI

SEQ ID NO: 394488 - protein, 9 aa, Homo Sapiens
TTAAGASGW

SEQ ID NO: 394489 - protein, 9 aa, Homo Sapiens
RGVVRGPPL

SEQ ID NO: 394490 - protein, 9 aa, Homo Sapiens
MWKTAEDRC

SEQ ID NO: 394491 - protein, 9 aa, Homo Sapiens
RHYNIPVSV

SEQ ID NO: 394492 - protein, 9 aa, Homo Sapiens
EVQNPAGGS

SEQ ID NO: 394493 - protein, 9 aa, Homo Sapiens
VHVVFSLIR

SEQ ID NO: 394494 - protein, 9 aa, Homo Sapiens
RRQPPHHLV

SEQ ID NO: 394495 - protein, 9 aa, Homo Sapiens
SGLNAWNGF

SEQ ID NO: 394496 - protein, 9 aa, Homo Sapiens
VPPADPADS

SEQ ID NO: 394497 - protein, 9 aa, Homo Sapiens
PPTVITSNP

SEQ ID NO: 394498 - protein, 9 aa, Homo Sapiens
PTAVTPRRS

SEQ ID NO: 394499 - protein, 9 aa, Homo Sapiens
AVSIQQTPE

SEQ ID NO: 394500 - protein, 9 aa, Homo Sapiens
AWLGLWLGM

SEQ ID NO: 394501 - protein, 9 aa, Homo Sapiens
VIYRGTLSG

SEQ ID NO: 394502 - protein, 9 aa, Homo Sapiens
IRLLAWKES

SEQ ID NO: 394503 - protein, 9 aa, Homo Sapiens
VITLYNRTK

SEQ ID NO: 394504 - protein, 9 aa, Homo Sapiens
FNIICNHMH

SEQ ID NO: 394505 - protein, 9 aa, Homo Sapiens
SDTMFLEKT

SEQ ID NO: 394506 - protein, 9 aa, Homo Sapiens
PRLRIWVPA

SEQ ID NO: 394507 - protein, 9 aa, Homo Sapiens
MSIIGSTNL

SEQ ID NO: 394508 - protein, 9 aa, Homo Sapiens
TALFEIYTI

SEQ ID NO: 394509 - protein, 9 aa, Homo Sapiens
WSLSFGESD

SEQ ID NO: 394510 - protein, 9 aa, Homo Sapiens
DSWPTRRST

SEQ ID NO: 394511 - protein, 9 aa, Homo Sapiens
RGPSEKRSR

SEQ ID NO: 394512 - protein, 9 aa, Homo Sapiens
LSSMFLRVR

SEQ ID NO: 394513 - protein, 9 aa, Homo Sapiens
VHHTIYETF

SEQ ID NO: 394514 - protein, 9 aa, Homo Sapiens
PENRTHPHK

SEQ ID NO: 394515 - protein, 9 aa, Homo Sapiens
EKVPCLCLE

SEQ ID NO: 394516 - protein, 9 aa, Homo Sapiens
PVDEVNMPH

SEQ ID NO: 394517 - protein, 9 aa, Homo Sapiens
GKEQEEEED

SEQ ID NO: 394518 - protein, 9 aa, Homo Sapiens
KPPGLVIYD

SEQ ID NO: 394519 - protein, 9 aa, Homo Sapiens
PPNMTSIRR

SEQ ID NO: 394520 - protein, 9 aa, Homo Sapiens
GHPEVIYNY

SEQ ID NO: 394521 - protein, 9 aa, Homo Sapiens
TNGASQTTD

SEQ ID NO: 394522 - protein, 9 aa, Homo Sapiens
VRLIIQVWD

SEQ ID NO: 394523 - protein, 9 aa, Homo Sapiens
DGRHLQGEQ

SEQ ID NO: 394524 - protein, 9 aa, Homo Sapiens
AAFMAAFYD

SEQ ID NO: 394525 - protein, 9 aa, Homo Sapiens
NLVVVEGVH

SEQ ID NO: 394526 - protein, 9 aa, Homo Sapiens
DISPYDATL

SEQ ID NO: 394527 - protein, 9 aa, Homo Sapiens
GASSAKRQL

SEQ ID NO: 394528 - protein, 9 aa, Homo Sapiens
SVSHFSDLD

SEQ ID NO: 394529 - protein, 9 aa, Homo Sapiens
PRTLEGCIS

SEQ ID NO: 394530 - protein, 9 aa, Homo Sapiens
LGNVLVCTC

SEQ ID NO: 394531 - protein, 9 aa, Homo Sapiens
GFVLAQSAW

SEQ ID NO: 394532 - protein, 9 aa, Homo Sapiens
SIGGILLSI

SEQ ID NO: 394533 - protein, 9 aa, Homo Sapiens
EELLKKCSL

SEQ ID NO: 394534 - protein, 9 aa, Homo Sapiens
DAAGGDDDD

SEQ ID NO: 394535 - protein, 9 aa, Homo Sapiens
SPGRRDPQD

SEQ ID NO: 394536 - protein, 9 aa, Homo Sapiens
WWRTRACTP

SEQ ID NO: 394537 - protein, 9 aa, Homo Sapiens
SRYLSLPKI

SEQ ID NO: 394538 - protein, 9 aa, Homo Sapiens
NVLVCTCYG

SEQ ID NO: 394539 - protein, 9 aa, Homo Sapiens
FAINHNPTP

SEQ ID NO: 394540 - protein, 9 aa, Homo Sapiens
CNKQMKTLR

SEQ ID NO: 394541 - protein, 9 aa, Homo Sapiens
ASIIAGQGP

SEQ ID NO: 394542 - protein, 9 aa, Homo Sapiens
YDKYVNVFH

SEQ ID NO: 394543 - protein, 9 aa, Homo Sapiens
TTVSGGTTS

SEQ ID NO: 394544 - protein, 9 aa, Homo Sapiens
HDPNFVPVA

SEQ ID NO: 394545 - protein, 9 aa, Homo Sapiens
EALVAPDRA

SEQ ID NO: 394546 - protein, 9 aa, Homo Sapiens
NTVNQKKAK

SEQ ID NO: 394547 - protein, 9 aa, Homo Sapiens
LHAFLESCP

SEQ ID NO: 394548 - protein, 9 aa, Homo Sapiens
AALIHVISK

SEQ ID NO: 394549 - protein, 9 aa, Homo Sapiens
YGLWTPILE

SEQ ID NO: 394550 - protein, 9 aa, Homo Sapiens
KGNTQKMFS

SEQ ID NO: 394551 - protein, 9 aa, Homo Sapiens
WVTASIIAG

SEQ ID NO: 394552 - protein, 9 aa, Homo Sapiens
PNDLKKGLQ

SEQ ID NO: 394553 - protein, 9 aa, Homo Sapiens
LTQILTHST

SEQ ID NO: 394554 - protein, 9 aa, Homo Sapiens
LKNPMFLFL

SEQ ID NO: 394555 - protein, 9 aa, Homo Sapiens
ALVKTWTQF

SEQ ID NO: 394556 - protein, 9 aa, Homo Sapiens
RGARLTTHT

SEQ ID NO: 394557 - protein, 9 aa, Homo Sapiens
VLLPNTEEK

SEQ ID NO: 394558 - protein, 9 aa, Homo Sapiens
AAGILACEC

SEQ ID NO: 394559 - protein, 9 aa, Homo Sapiens
VTDLFPVLS

SEQ ID NO: 394560 - protein, 9 aa, Homo Sapiens
VYITQVILM

SEQ ID NO: 394561 - protein, 9 aa, Homo Sapiens
SSTFRSRES

SEQ ID NO: 394562 - protein, 9 aa, Homo Sapiens
KCEGKQFDS

SEQ ID NO: 394563 - protein, 9 aa, Homo Sapiens
TRWAWGSGA

SEQ ID NO: 394564 - protein, 9 aa, Homo Sapiens
TRGTSRARR

SEQ ID NO: 394565 - protein, 9 aa, Homo Sapiens
EIYTIVGTI

SEQ ID NO: 394566 - protein, 9 aa, Homo Sapiens
QVVILKKFS

SEQ ID NO: 394567 - protein, 9 aa, Homo Sapiens
LCLPPRRLR

SEQ ID NO: 394568 - protein, 9 aa, Homo Sapiens
RAARASSQT

SEQ ID NO: 394569 - protein, 9 aa, Homo Sapiens
EENRDLCAS

SEQ ID NO: 394570 - protein, 9 aa, Homo Sapiens
IITSKVSSL

SEQ ID NO: 394571 - protein, 9 aa, Homo Sapiens
CTSDTMFLE

SEQ ID NO: 394572 - protein, 9 aa, Homo Sapiens
MILVVDTKI

SEQ ID NO: 394573 - protein, 9 aa, Homo Sapiens
PRAAIWRRI

SEQ ID NO: 394574 - protein, 9 aa, Homo Sapiens
ELVFLTLTL

SEQ ID NO: 394575 - protein, 9 aa, Homo Sapiens
GNTSLSSLA

SEQ ID NO: 394576 - protein, 9 aa, Homo Sapiens
PTARATSGT

SEQ ID NO: 394577 - protein, 9 aa, Homo Sapiens
KGHINCPND

SEQ ID NO: 394578 - protein, 9 aa, Homo Sapiens
LEFPSPFGH

SEQ ID NO: 394579 - protein, 9 aa, Homo Sapiens
TTFTRHSLK

SEQ ID NO: 394580 - protein, 9 aa, Homo Sapiens
GFTSSSSLS

SEQ ID NO: 394581 - protein, 9 aa, Homo Sapiens
SLDLVATAL

SEQ ID NO: 394582 - protein, 9 aa, Homo Sapiens
WLSMTPHQH

SEQ ID NO: 394583 - protein, 9 aa, Homo Sapiens
TLKDGRHLQ

SEQ ID NO: 394584 - protein, 9 aa, Homo Sapiens
HIPQIEDAE

SEQ ID NO: 394585 - protein, 9 aa, Homo Sapiens
PHRTSSHLP

SEQ ID NO: 394586 - protein, 9 aa, Homo Sapiens
ESGAPLWSG

SEQ ID NO: 394587 - protein, 9 aa, Homo Sapiens
HQVVEDGQH

SEQ ID NO: 394588 - protein, 9 aa, Homo Sapiens
TQRWRELAE

SEQ ID NO: 394589 - protein, 9 aa, Homo Sapiens
SDCCYRERK

SEQ ID NO: 394590 - protein, 9 aa, Homo Sapiens
DPQDGCNDG

SEQ ID NO: 394591 - protein, 9 aa, Homo Sapiens
WENPQELKE

SEQ ID NO: 394592 - protein, 9 aa, Homo Sapiens
RTRGSRGTL

SEQ ID NO: 394593 - protein, 9 aa, Homo Sapiens
VIKAILGGD

SEQ ID NO: 394594 - protein, 9 aa, Homo Sapiens
AGERGLRGT

SEQ ID NO: 394595 - protein, 9 aa, Homo Sapiens
EEQKMQSRM

SEQ ID NO: 394596 - protein, 9 aa, Homo Sapiens
GKEENRDLC

SEQ ID NO: 394597 - protein, 9 aa, Homo Sapiens
EKELESEGR

SEQ ID NO: 394598 - protein, 9 aa, Homo Sapiens
EPQHQQRLW

SEQ ID NO: 394599 - protein, 9 aa, Homo Sapiens
SVTLRPWKT

SEQ ID NO: 394600 - protein, 9 aa, Homo Sapiens
SLAGRNKGL

SEQ ID NO: 394601 - protein, 9 aa, Homo Sapiens
NGAPPECCS

SEQ ID NO: 394602 - protein, 9 aa, Homo Sapiens
EPRILARDV

SEQ ID NO: 394603 - protein, 9 aa, Homo Sapiens
FIRIELRSQ

SEQ ID NO: 394604 - protein, 9 aa, Homo Sapiens
PRRQPPHHL

SEQ ID NO: 394605 - protein, 9 aa, Homo Sapiens
GVLQQLLSD

SEQ ID NO: 394606 - protein, 9 aa, Homo Sapiens
NRHWRQIDR

SEQ ID NO: 394607 - protein, 9 aa, Homo Sapiens
AVLRGRGAR

SEQ ID NO: 394608 - protein, 9 aa, Homo Sapiens
LTPIPQSEA

SEQ ID NO: 394609 - protein, 9 aa, Homo Sapiens
PCSICSPEP

SEQ ID NO: 394610 - protein, 9 aa, Homo Sapiens
LMELVFLTL

SEQ ID NO: 394611 - protein, 9 aa, Homo Sapiens
RQSEKRSEM

SEQ ID NO: 394612 - protein, 9 aa, Homo Sapiens
TPVPTATAA

SEQ ID NO: 394613 - protein, 9 aa, Homo Sapiens
ASEEPSQND

SEQ ID NO: 394614 - protein, 9 aa, Homo Sapiens
DNINAPFDM

SEQ ID NO: 394615 - protein, 9 aa, Homo Sapiens
CSPEVTIHW

SEQ ID NO: 394616 - protein, 9 aa, Homo Sapiens
EMDHFDRER

SEQ ID NO: 394617 - protein, 9 aa, Homo Sapiens
GGHPQPRPS

SEQ ID NO: 394618 - protein, 9 aa, Homo Sapiens
SNSSYLGQE

SEQ ID NO: 394619 - protein, 9 aa, Homo Sapiens
TRGARKTRE

SEQ ID NO: 394620 - protein, 9 aa, Homo Sapiens
CLYGAYLQL

SEQ ID NO: 394621 - protein, 9 aa, Homo Sapiens
ARVLPGGAE

SEQ ID NO: 394622 - protein, 9 aa, Homo Sapiens
EIGDENVTL

SEQ ID NO: 394623 - protein, 9 aa, Homo Sapiens
ENDHRDFTG

SEQ ID NO: 394624 - protein, 9 aa, Homo Sapiens
AQAGAFLRQ

SEQ ID NO: 394625 - protein, 9 aa, Homo Sapiens
EHQDLQSTS

SEQ ID NO: 394626 - protein, 9 aa, Homo Sapiens
SATMGSDPS

SEQ ID NO: 394627 - protein, 9 aa, Homo Sapiens
SCLLDFAAS

SEQ ID NO: 394628 - protein, 9 aa, Homo Sapiens
HQPCGKQDS

SEQ ID NO: 394629 - protein, 9 aa, Homo Sapiens
NVHRQPVQI

SEQ ID NO: 394630 - protein, 9 aa, Homo Sapiens
GGGAAAGNP

SEQ ID NO: 394631 - protein, 9 aa, Homo Sapiens
GPLGSISSS

SEQ ID NO: 394632 - protein, 9 aa, Homo Sapiens
CRKSVLGAL

SEQ ID NO: 394633 - protein, 9 aa, Homo Sapiens
YKVPLDYIG

SEQ ID NO: 394634 - protein, 9 aa, Homo Sapiens
YMKLLLEQQ

SEQ ID NO: 394635 - protein, 9 aa, Homo Sapiens
ISTSTSRAR

SEQ ID NO: 394636 - protein, 9 aa, Homo Sapiens
AEAQVPHLR

SEQ ID NO: 394637 - protein, 9 aa, Homo Sapiens
HQLLLHQVV

SEQ ID NO: 394638 - protein, 9 aa, Homo Sapiens
RAHRQRVCG

SEQ ID NO: 394639 - protein, 9 aa, Homo Sapiens
CPPIRTPAP

SEQ ID NO: 394640 - protein, 9 aa, Homo Sapiens
WAWGSGATI

SEQ ID NO: 394641 - protein, 9 aa, Homo Sapiens
QGASSIPTT

SEQ ID NO: 394642 - protein, 9 aa, Homo Sapiens
PTHVNHNIY

SEQ ID NO: 394643 - protein, 9 aa, Homo Sapiens
ANMLSVAWA

SEQ ID NO: 394644 - protein, 9 aa, Homo Sapiens
TYICQVHGP

SEQ ID NO: 394645 - protein, 9 aa, Homo Sapiens
KASRAGGTR

SEQ ID NO: 394646 - protein, 9 aa, Homo Sapiens
PWPTGGRHT

SEQ ID NO: 394647 - protein, 9 aa, Homo Sapiens
MDVQRGIGT

SEQ ID NO: 394648 - protein, 9 aa, Homo Sapiens
LTSKKEVDP

SEQ ID NO: 394649 - protein, 9 aa, Homo Sapiens
NGKKMLSLT

SEQ ID NO: 394650 - protein, 9 aa, Homo Sapiens
QAGAFLRQG

SEQ ID NO: 394651 - protein, 9 aa, Homo Sapiens
IFARRAIST

SEQ ID NO: 394652 - protein, 9 aa, Homo Sapiens
TATLSQKND

SEQ ID NO: 394653 - protein, 9 aa, Homo Sapiens
MYASPEQLE

SEQ ID NO: 394654 - protein, 9 aa, Homo Sapiens
NLAVPSECS

SEQ ID NO: 394655 - protein, 9 aa, Homo Sapiens
FYHDGEILF

SEQ ID NO: 394656 - protein, 9 aa, Homo Sapiens
EDRKPPNGL

SEQ ID NO: 394657 - protein, 9 aa, Homo Sapiens
LLPATWCLG

SEQ ID NO: 394658 - protein, 9 aa, Homo Sapiens
GFTALVQLP

SEQ ID NO: 394659 - protein, 9 aa, Homo Sapiens
AKEKELCTW

SEQ ID NO: 394660 - protein, 9 aa, Homo Sapiens
GRSREGQSG

SEQ ID NO: 394661 - protein, 9 aa, Homo Sapiens
SGKKIAFHI

SEQ ID NO: 394662 - protein, 9 aa, Homo Sapiens
ALQCTAGGN

SEQ ID NO: 394663 - protein, 9 aa, Homo Sapiens
SPFATPTRS

SEQ ID NO: 394664 - protein, 9 aa, Homo Sapiens
LGSMVGLSG

SEQ ID NO: 394665 - protein, 9 aa, Homo Sapiens
TAGDTPDVF

SEQ ID NO: 394666 - protein, 9 aa, Homo Sapiens
QGYLSEAEA

SEQ ID NO: 394667 - protein, 9 aa, Homo Sapiens
GPLGTSFTL

SEQ ID NO: 394668 - protein, 9 aa, Homo Sapiens
ENRPLVWSL

SEQ ID NO: 394669 - protein, 9 aa, Homo Sapiens
AMNYNLSEL

SEQ ID NO: 394670 - protein, 9 aa, Homo Sapiens
QPTGMMPNG

SEQ ID NO: 394671 - protein, 9 aa, Homo Sapiens
CCSPRRPQP

SEQ ID NO: 394672 - protein, 9 aa, Homo Sapiens
SPGHPRGSQ

SEQ ID NO: 394673 - protein, 9 aa, Homo Sapiens
PKSIPVLVN

SEQ ID NO: 394674 - protein, 9 aa, Homo Sapiens
NVTEILCVG

SEQ ID NO: 394675 - protein, 9 aa, Homo Sapiens
VSFAARSTR

SEQ ID NO: 394676 - protein, 9 aa, Homo Sapiens
VMNVPDFDY

SEQ ID NO: 394677 - protein, 9 aa, Homo Sapiens
SCVFADNPT

SEQ ID NO: 394678 - protein, 9 aa, Homo Sapiens
NGSLPSFSE

SEQ ID NO: 394679 - protein, 9 aa, Homo Sapiens
TPRGPSEKR

SEQ ID NO: 394680 - protein, 9 aa, Homo Sapiens
IWQGGASSA

SEQ ID NO: 394681 - protein, 9 aa, Homo Sapiens
PESGSRTKD

SEQ ID NO: 394682 - protein, 9 aa, Homo Sapiens
QTKWRSGSS

SEQ ID NO: 394683 - protein, 9 aa, Homo Sapiens
KPFERDLQS

SEQ ID NO: 394684 - protein, 9 aa, Homo Sapiens
LCEHLSYTE

SEQ ID NO: 394685 - protein, 9 aa, Homo Sapiens
YSSGALPDS

SEQ ID NO: 394686 - protein, 9 aa, Homo Sapiens
AFAQAGAFL

SEQ ID NO: 394687 - protein, 9 aa, Homo Sapiens
AWDVCKGAK

SEQ ID NO: 394688 - protein, 9 aa, Homo Sapiens
AKEVDKANQ

SEQ ID NO: 394689 - protein, 9 aa, Homo Sapiens
LVGERSYGM

SEQ ID NO: 394690 - protein, 9 aa, Homo Sapiens
IHVISKLSK

SEQ ID NO: 394691 - protein, 9 aa, Homo Sapiens
FLLVSLAMF

SEQ ID NO: 394692 - protein, 9 aa, Homo Sapiens
LSTLSCSDN

SEQ ID NO: 394693 - protein, 9 aa, Homo Sapiens
NAAKQAEKE

SEQ ID NO: 394694 - protein, 9 aa, Homo Sapiens
KNGIWEVMP

SEQ ID NO: 394695 - protein, 9 aa, Homo Sapiens
GPPPPGPEG

SEQ ID NO: 394696 - protein, 9 aa, Homo Sapiens
LGRPAHSAT

SEQ ID NO: 394697 - protein, 9 aa, Homo Sapiens
GAREGSAPI

SEQ ID NO: 394698 - protein, 9 aa, Homo Sapiens
SCGSRWKSG

SEQ ID NO: 394699 - protein, 9 aa, Homo Sapiens
FMGHCYSCM

SEQ ID NO: 394700 - protein, 9 aa, Homo Sapiens
FDMIAEINF

SEQ ID NO: 394701 - protein, 9 aa, Homo Sapiens
ISITNTATA

SEQ ID NO: 394702 - protein, 9 aa, Homo Sapiens
GDTPDVFTM

SEQ ID NO: 394703 - protein, 9 aa, Homo Sapiens
GTTGMCHHA

SEQ ID NO: 394704 - protein, 9 aa, Homo Sapiens
VTYPGIIVS

SEQ ID NO: 394705 - protein, 9 aa, Homo Sapiens
PSATNPTWR

SEQ ID NO: 394706 - protein, 9 aa, Homo Sapiens
GPWRGQPGP

SEQ ID NO: 394707 - protein, 9 aa, Homo Sapiens
KAFAQAGAF

SEQ ID NO: 394708 - protein, 9 aa, Homo Sapiens
TNNENCSSS

SEQ ID NO: 394709 - protein, 9 aa, Homo Sapiens
DVVLQWGRC

SEQ ID NO: 394710 - protein, 9 aa, Homo Sapiens
ESVGFTALV

SEQ ID NO: 394711 - protein, 9 aa, Homo Sapiens
GSARSASAL

SEQ ID NO: 394712 - protein, 9 aa, Homo Sapiens
HRPKPMGIL

SEQ ID NO: 394713 - protein, 9 aa, Homo Sapiens
PDGLLQLAH

SEQ ID NO: 394714 - protein, 9 aa, Homo Sapiens
ADNPTSCLK

SEQ ID NO: 394715 - protein, 9 aa, Homo Sapiens
VNSKIETEF

SEQ ID NO: 394716 - protein, 9 aa, Homo Sapiens
WPEVWKEVR

SEQ ID NO: 394717 - protein, 9 aa, Homo Sapiens
RFQIINTEY

SEQ ID NO: 394718 - protein, 9 aa, Homo Sapiens
LANGSLLLL

SEQ ID NO: 394719 - protein, 9 aa, Homo Sapiens
TLVILKGNE

SEQ ID NO: 394720 - protein, 9 aa, Homo Sapiens
TTTILNPQD

SEQ ID NO: 394721 - protein, 9 aa, Homo Sapiens
LDTKSKLNT

SEQ ID NO: 394722 - protein, 9 aa, Homo Sapiens
SQPHCVASR

SEQ ID NO: 394723 - protein, 9 aa, Homo Sapiens
PGTSETPAG

SEQ ID NO: 394724 - protein, 9 aa, Homo Sapiens
WTLSPQGPR

SEQ ID NO: 394725 - protein, 9 aa, Homo Sapiens
FSCVFADNP

SEQ ID NO: 394726 - protein, 9 aa, Homo Sapiens
ASSRCCPPI

SEQ ID NO: 394727 - protein, 9 aa, Homo Sapiens
KRSLRQYMP

SEQ ID NO: 394728 - protein, 9 aa, Homo Sapiens
RVKEQSHVI

SEQ ID NO: 394729 - protein, 9 aa, Homo Sapiens
PSTPASPGN

SEQ ID NO: 394730 - protein, 9 aa, Homo Sapiens
KVTSSLGIR

SEQ ID NO: 394731 - protein, 9 aa, Homo Sapiens
LLLHLSHGA

SEQ ID NO: 394732 - protein, 9 aa, Homo Sapiens
DTLTITLRN

SEQ ID NO: 394733 - protein, 9 aa, Homo Sapiens
SDKSKNSAS

SEQ ID NO: 394734 - protein, 9 aa, Homo Sapiens
TRINKLNSI

SEQ ID NO: 394735 - protein, 9 aa, Homo Sapiens
LGLWLGMPA

SEQ ID NO: 394736 - protein, 9 aa, Homo Sapiens
SFILSYRWL

SEQ ID NO: 394737 - protein, 9 aa, Homo Sapiens
TEAPPQTPP

SEQ ID NO: 394738 - protein, 9 aa, Homo Sapiens
QEEECRRQK

SEQ ID NO: 394739 - protein, 9 aa, Homo Sapiens
PTHNTPDIS

SEQ ID NO: 394740 - protein, 9 aa, Homo Sapiens
LIHVISKLS

SEQ ID NO: 394741 - protein, 9 aa, Homo Sapiens
RHPPGSPSR

SEQ ID NO: 394742 - protein, 9 aa, Homo Sapiens
SNPASTSGK

SEQ ID NO: 394743 - protein, 9 aa, Homo Sapiens
VKEQSHVIN

SEQ ID NO: 394744 - protein, 9 aa, Homo Sapiens
YASVFLSPD

SEQ ID NO: 394745 - protein, 9 aa, Homo Sapiens
KKIAFHIKS

SEQ ID NO: 394746 - protein, 9 aa, Homo Sapiens
DAIFARRAI

SEQ ID NO: 394747 - protein, 9 aa, Homo Sapiens
TSDYCETEI

SEQ ID NO: 394748 - protein, 9 aa, Homo Sapiens
PLPWMVPWG

SEQ ID NO: 394749 - protein, 9 aa, Homo Sapiens
SNTLRPGST

SEQ ID NO: 394750 - protein, 9 aa, Homo Sapiens
SFNAPPAGH

SEQ ID NO: 394751 - protein, 9 aa, Homo Sapiens
VLYQWSKSL

SEQ ID NO: 394752 - protein, 9 aa, Homo Sapiens
SLTKPLKEG

SEQ ID NO: 394753 - protein, 9 aa, Homo Sapiens
EKILVNLTM

SEQ ID NO: 394754 - protein, 9 aa, Homo Sapiens
IIVGPEGVA

SEQ ID NO: 394755 - protein, 9 aa, Homo Sapiens
LCLEEPRKG

SEQ ID NO: 394756 - protein, 9 aa, Homo Sapiens
TIHNSVKKT

SEQ ID NO: 394757 - protein, 9 aa, Homo Sapiens
PEMVMLYPE

SEQ ID NO: 394758 - protein, 9 aa, Homo Sapiens
EFHRIGQGG

SEQ ID NO: 394759 - protein, 9 aa, Homo Sapiens
YYQAVYYYT

SEQ ID NO: 394760 - protein, 9 aa, Homo Sapiens
PGFPLTMIR

SEQ ID NO: 394761 - protein, 9 aa, Homo Sapiens
DVSDKTPMT

SEQ ID NO: 394762 - protein, 9 aa, Homo Sapiens
LFIWPQHSY

SEQ ID NO: 394763 - protein, 9 aa, Homo Sapiens
CIEFQVPKD

SEQ ID NO: 394764 - protein, 9 aa, Homo Sapiens
IGHTNCPSI

SEQ ID NO: 394765 - protein, 9 aa, Homo Sapiens
ILQWLEDRA

SEQ ID NO: 394766 - protein, 9 aa, Homo Sapiens
MRKRMSSSF

SEQ ID NO: 394767 - protein, 9 aa, Homo Sapiens
HLIHRAHHE

SEQ ID NO: 394768 - protein, 9 aa, Homo Sapiens
IGHYYVAVG

SEQ ID NO: 394769 - protein, 9 aa, Homo Sapiens
KRQLLISWR

SEQ ID NO: 394770 - protein, 9 aa, Homo Sapiens
IFMGHCYSC

SEQ ID NO: 394771 - protein, 9 aa, Homo Sapiens
TCSLFPQPL

SEQ ID NO: 394772 - protein, 9 aa, Homo Sapiens
SSFFFNFFQ

SEQ ID NO: 394773 - protein, 9 aa, Homo Sapiens
ECCSLQCLC

SEQ ID NO: 394774 - protein, 9 aa, Homo Sapiens
CIGEESGGV

SEQ ID NO: 394775 - protein, 9 aa, Homo Sapiens
SFTLSTNST

SEQ ID NO: 394776 - protein, 9 aa, Homo Sapiens
RPRWTSATW

SEQ ID NO: 394777 - protein, 9 aa, Homo Sapiens
LANVISSKR

SEQ ID NO: 394778 - protein, 9 aa, Homo Sapiens
KPIYSIGGI

SEQ ID NO: 394779 - protein, 9 aa, Homo Sapiens
ATILTGGTR

SEQ ID NO: 394780 - protein, 9 aa, Homo Sapiens
NKRKCVRDC

SEQ ID NO: 394781 - protein, 9 aa, Homo Sapiens
PLDRCYSTP

SEQ ID NO: 394782 - protein, 9 aa, Homo Sapiens
TSETPAGLS

SEQ ID NO: 394783 - protein, 9 aa, Homo Sapiens
LEKALSALF

SEQ ID NO: 394784 - protein, 9 aa, Homo Sapiens
EGLTHGVAS

SEQ ID NO: 394785 - protein, 9 aa, Homo Sapiens
GTPKLMGSQ

SEQ ID NO: 394786 - protein, 9 aa, Homo Sapiens
IERTIILVQ

SEQ ID NO: 394787 - protein, 9 aa, Homo Sapiens
VLVCTCYGG

SEQ ID NO: 394788 - protein, 9 aa, Homo Sapiens
PRAGRVALQ

SEQ ID NO: 394789 - protein, 9 aa, Homo Sapiens
LQVPQGLTD

SEQ ID NO: 394790 - protein, 9 aa, Homo Sapiens
SCSADLKAI

SEQ ID NO: 394791 - protein, 9 aa, Homo Sapiens
GKAFSWKCR

SEQ ID NO: 394792 - protein, 9 aa, Homo Sapiens
LKIFVSSAD

SEQ ID NO: 394793 - protein, 9 aa, Homo Sapiens
TEFLKNLSW

SEQ ID NO: 394794 - protein, 9 aa, Homo Sapiens
MKWEKECEH

SEQ ID NO: 394795 - protein, 9 aa, Homo Sapiens
HSQQMDGLF

SEQ ID NO: 394796 - protein, 9 aa, Homo Sapiens
LLRLSLRLK

SEQ ID NO: 394797 - protein, 9 aa, Homo Sapiens
TLLYVVHVV

SEQ ID NO: 394798 - protein, 9 aa, Homo Sapiens
VMLYPELYK

SEQ ID NO: 394799 - protein, 9 aa, Homo Sapiens
TIFQMLIIE

SEQ ID NO: 394800 - protein, 9 aa, Homo Sapiens
TMIRVNSMS

SEQ ID NO: 394801 - protein, 9 aa, Homo Sapiens
IAFSTSITR

SEQ ID NO: 394802 - protein, 9 aa, Homo Sapiens
QTNPGPAQF

SEQ ID NO: 394803 - protein, 9 aa, Homo Sapiens
TGECYCKEG

SEQ ID NO: 394804 - protein, 9 aa, Homo Sapiens
PPRPAPARP

SEQ ID NO: 394805 - protein, 9 aa, Homo Sapiens
LQDHLGPVT

SEQ ID NO: 394806 - protein, 9 aa, Homo Sapiens
NRADRTGGT

SEQ ID NO: 394807 - protein, 9 aa, Homo Sapiens
KMIAGIPTV

SEQ ID NO: 394808 - protein, 9 aa, Homo Sapiens
VIKQKVLRE

SEQ ID NO: 394809 - protein, 9 aa, Homo Sapiens
QEMERFDNL

SEQ ID NO: 394810 - protein, 9 aa, Homo Sapiens
SSPTARATS

SEQ ID NO: 394811 - protein, 9 aa, Homo Sapiens
ARPPRPAPA

SEQ ID NO: 394812 - protein, 9 aa, Homo Sapiens
VLYRKFTTE

SEQ ID NO: 394813 - protein, 9 aa, Homo Sapiens
PWSDPQDCR

SEQ ID NO: 394814 - protein, 9 aa, Homo Sapiens
GMSRTPPRR

SEQ ID NO: 394815 - protein, 9 aa, Homo Sapiens
QYTAAVFKE

SEQ ID NO: 394816 - protein, 9 aa, Homo Sapiens
PLAPCPPLE

SEQ ID NO: 394817 - protein, 9 aa, Homo Sapiens
RSFLKWTLI

SEQ ID NO: 394818 - protein, 9 aa, Homo Sapiens
SEETVTRRM

SEQ ID NO: 394819 - protein, 9 aa, Homo Sapiens
TAASARSPT

SEQ ID NO: 394820 - protein, 9 aa, Homo Sapiens
IIITFFFKI

SEQ ID NO: 394821 - protein, 9 aa, Homo Sapiens
DIFLGLSKR

SEQ ID NO: 394822 - protein, 9 aa, Homo Sapiens
SKYHQGDRK

SEQ ID NO: 394823 - protein, 9 aa, Homo Sapiens
HLGLKPFSC

SEQ ID NO: 394824 - protein, 9 aa, Homo Sapiens
KVKKRPGGH

SEQ ID NO: 394825 - protein, 9 aa, Homo Sapiens
YMQEEEREN

SEQ ID NO: 394826 - protein, 9 aa, Homo Sapiens
KTFQGLVCL

SEQ ID NO: 394827 - protein, 9 aa, Homo Sapiens
YKEGMKIEI

SEQ ID NO: 394828 - protein, 9 aa, Homo Sapiens
IVEKPFERD

SEQ ID NO: 394829 - protein, 9 aa, Homo Sapiens
ISTRVSSRA

SEQ ID NO: 394830 - protein, 9 aa, Homo Sapiens
FMLGAILRL

SEQ ID NO: 394831 - protein, 9 aa, Homo Sapiens
PQTNPGPAQ

SEQ ID NO: 394832 - protein, 9 aa, Homo Sapiens
TPDISHIVG

SEQ ID NO: 394833 - protein, 9 aa, Homo Sapiens
LNQRHGPDG

SEQ ID NO: 394834 - protein, 9 aa, Homo Sapiens
DFIQVFIYR

SEQ ID NO: 394835 - protein, 9 aa, Homo Sapiens
PGWEEASQV

SEQ ID NO: 394836 - protein, 9 aa, Homo Sapiens
PCPINNEQT

SEQ ID NO: 394837 - protein, 9 aa, Homo Sapiens
NSKIETEFL

SEQ ID NO: 394838 - protein, 9 aa, Homo Sapiens
LGMTELTDP

SEQ ID NO: 394839 - protein, 9 aa, Homo Sapiens
QEHMGSCLL

SEQ ID NO: 394840 - protein, 9 aa, Homo Sapiens
RLLAWKEST

SEQ ID NO: 394841 - protein, 9 aa, Homo Sapiens
TPQQVVAVN

SEQ ID NO: 394842 - protein, 9 aa, Homo Sapiens
SYAAGILAC

SEQ ID NO: 394843 - protein, 9 aa, Homo Sapiens
FTDDSYVQS

SEQ ID NO: 394844 - protein, 9 aa, Homo Sapiens
LTQNILAHI

SEQ ID NO: 394845 - protein, 9 aa, Homo Sapiens
SSFYEQQIT

SEQ ID NO: 394846 - protein, 9 aa, Homo Sapiens
GILTRKMAI

SEQ ID NO: 394847 - protein, 9 aa, Homo Sapiens
VEELFSRVP

SEQ ID NO: 394848 - protein, 9 aa, Homo Sapiens
ESDCCYRER

SEQ ID NO: 394849 - protein, 9 aa, Homo Sapiens
GNFCTFFCR

SEQ ID NO: 394850 - protein, 9 aa, Homo Sapiens
SCQNSSPRN

SEQ ID NO: 394851 - protein, 9 aa, Homo Sapiens
THSLEVTQE

SEQ ID NO: 394852 - protein, 9 aa, Homo Sapiens
EPTKFEKLA

SEQ ID NO: 394853 - protein, 9 aa, Homo Sapiens
ALQRPFFDL

SEQ ID NO: 394854 - protein, 9 aa, Homo Sapiens
FSKVMGSAL

SEQ ID NO: 394855 - protein, 9 aa, Homo Sapiens
TTPSKKKLK

SEQ ID NO: 394856 - protein, 9 aa, Homo Sapiens
ATGLTIPVG

SEQ ID NO: 394857 - protein, 9 aa, Homo Sapiens
ELANLNWLH

SEQ ID NO: 394858 - protein, 9 aa, Homo Sapiens
TLCESWLRK

SEQ ID NO: 394859 - protein, 9 aa, Homo Sapiens
TSCTTFTRH

SEQ ID NO: 394860 - protein, 9 aa, Homo Sapiens
HMGSCLLDF

SEQ ID NO: 394861 - protein, 9 aa, Homo Sapiens
KECRKKAKL

SEQ ID NO: 394862 - protein, 9 aa, Homo Sapiens
SCSRGARGA

SEQ ID NO: 394863 - protein, 9 aa, Homo Sapiens
SVRRMLEEV

SEQ ID NO: 394864 - protein, 9 aa, Homo Sapiens
RGTPSAFDR

SEQ ID NO: 394865 - protein, 9 aa, Homo Sapiens
QIQALRQMN

SEQ ID NO: 394866 - protein, 9 aa, Homo Sapiens
DARYQTQPV

SEQ ID NO: 394867 - protein, 9 aa, Homo Sapiens
VGIWLPGIT

SEQ ID NO: 394868 - protein, 9 aa, Homo Sapiens
ERGLRGTPG

SEQ ID NO: 394869 - protein, 9 aa, Homo Sapiens
GGPSPGTAW

SEQ ID NO: 394870 - protein, 9 aa, Homo Sapiens
FIDLNSSQN

SEQ ID NO: 394871 - protein, 9 aa, Homo Sapiens
TAATFRGAH

SEQ ID NO: 394872 - protein, 9 aa, Homo Sapiens
RAVLSIQST

SEQ ID NO: 394873 - protein, 9 aa, Homo Sapiens
MSLTKPLKE

SEQ ID NO: 394874 - protein, 9 aa, Homo Sapiens
ILRSFMKLY

SEQ ID NO: 394875 - protein, 9 aa, Homo Sapiens
AMTKRSPEA

SEQ ID NO: 394876 - protein, 9 aa, Homo Sapiens
FVIPVLIIV

SEQ ID NO: 394877 - protein, 9 aa, Homo Sapiens
GSWGQTDLT

SEQ ID NO: 394878 - protein, 9 aa, Homo Sapiens
IIETEFHRI

SEQ ID NO: 394879 - protein, 9 aa, Homo Sapiens
FSNKRKCVR

SEQ ID NO: 394880 - protein, 9 aa, Homo Sapiens
TLESTWENP

SEQ ID NO: 394881 - protein, 9 aa, Homo Sapiens
QDHLGPVTA

SEQ ID NO: 394882 - protein, 9 aa, Homo Sapiens
NLIVYITQV

SEQ ID NO: 394883 - protein, 9 aa, Homo Sapiens
DFDYPPEFY

SEQ ID NO: 394884 - protein, 9 aa, Homo Sapiens
LLRRPPPPA

SEQ ID NO: 394885 - protein, 9 aa, Homo Sapiens
FDNLIITIR

SEQ ID NO: 394886 - protein, 9 aa, Homo Sapiens
FLNNNLLHA

SEQ ID NO: 394887 - protein, 9 aa, Homo Sapiens
LGTSNTICA

SEQ ID NO: 394888 - protein, 9 aa, Homo Sapiens
QQHVISDQD

SEQ ID NO: 394889 - protein, 9 aa, Homo Sapiens
SRMDQWMDK

SEQ ID NO: 394890 - protein, 9 aa, Homo Sapiens
IKSTGKVVY

SEQ ID NO: 394891 - protein, 9 aa, Homo Sapiens
ASGTREARS

SEQ ID NO: 394892 - protein, 9 aa, Homo Sapiens
EECIPTKRR

SEQ ID NO: 394893 - protein, 9 aa, Homo Sapiens
SGSGFTSSS

SEQ ID NO: 394894 - protein, 9 aa, Homo Sapiens
AEGPAAPGG

SEQ ID NO: 394895 - protein, 9 aa, Homo Sapiens
RIELRSQTV

SEQ ID NO: 394896 - protein, 9 aa, Homo Sapiens
NPAAVLYQW

SEQ ID NO: 394897 - protein, 9 aa, Homo Sapiens
PATWCLGPA

SEQ ID NO: 394898 - protein, 9 aa, Homo Sapiens
SYTKVDPNQ

SEQ ID NO: 394899 - protein, 9 aa, Homo Sapiens
SPHITNSLI

SEQ ID NO: 394900 - protein, 9 aa, Homo Sapiens
EAYLLFAEA

SEQ ID NO: 394901 - protein, 9 aa, Homo Sapiens
GNWRTAATV

SEQ ID NO: 394902 - protein, 9 aa, Homo Sapiens
RRGGPGGAP

SEQ ID NO: 394903 - protein, 9 aa, Homo Sapiens
GNIITLYVF

SEQ ID NO: 394904 - protein, 9 aa, Homo Sapiens
TLLLNNRMV

SEQ ID NO: 394905 - protein, 9 aa, Homo Sapiens
SNTPRSEIA

SEQ ID NO: 394906 - protein, 9 aa, Homo Sapiens
EKNQSSLLV

SEQ ID NO: 394907 - protein, 9 aa, Homo Sapiens
RETLESGGA

SEQ ID NO: 394908 - protein, 9 aa, Homo Sapiens
AAGGDDDDQ

SEQ ID NO: 394909 - protein, 9 aa, Homo Sapiens
SVVGVTQPR

SEQ ID NO: 394910 - protein, 9 aa, Homo Sapiens
CVQRRYSDF

SEQ ID NO: 394911 - protein, 9 aa, Homo Sapiens
GTALPAVRP

SEQ ID NO: 394912 - protein, 9 aa, Homo Sapiens
ASSTRETSS

SEQ ID NO: 394913 - protein, 9 aa, Homo Sapiens
EVIKAILGG

SEQ ID NO: 394914 - protein, 9 aa, Homo Sapiens
DHTTLSSNT

SEQ ID NO: 394915 - protein, 9 aa, Homo Sapiens
GCDPVHGCC

SEQ ID NO: 394916 - protein, 9 aa, Homo Sapiens
LSPQGPRIL

SEQ ID NO: 394917 - protein, 9 aa, Homo Sapiens
MVPWGMEAL

SEQ ID NO: 394918 - protein, 9 aa, Homo Sapiens
PMSPSPVSG

SEQ ID NO: 394919 - protein, 9 aa, Homo Sapiens
AGFVLAQSA

SEQ ID NO: 394920 - protein, 9 aa, Homo Sapiens
ADREEDEGT

SEQ ID NO: 394921 - protein, 9 aa, Homo Sapiens
KVHWKTFQG

SEQ ID NO: 394922 - protein, 9 aa, Homo Sapiens
PEMPGSSRR

SEQ ID NO: 394923 - protein, 9 aa, Homo Sapiens
VLDFNFDSL

SEQ ID NO: 394924 - protein, 9 aa, Homo Sapiens
LEKNQSSLL

SEQ ID NO: 394925 - protein, 9 aa, Homo Sapiens
EEVFLIFWN

SEQ ID NO: 394926 - protein, 9 aa, Homo Sapiens
SPLTSRSLW

SEQ ID NO: 394927 - protein, 9 aa, Homo Sapiens
PRGPSEKRS

SEQ ID NO: 394928 - protein, 9 aa, Homo Sapiens
ILEREKHHM

SEQ ID NO: 394929 - protein, 9 aa, Homo Sapiens
DPNMHENLT

SEQ ID NO: 394930 - protein, 9 aa, Homo Sapiens
LEDSCQKLP

SEQ ID NO: 394931 - protein, 9 aa, Homo Sapiens
TDDLLLPVD

SEQ ID NO: 394932 - protein, 9 aa, Homo Sapiens
AEESAKEIT

SEQ ID NO: 394933 - protein, 9 aa, Homo Sapiens
DRRGSAWQS

SEQ ID NO: 394934 - protein, 9 aa, Homo Sapiens
LACECPNPS

SEQ ID NO: 394935 - protein, 9 aa, Homo Sapiens
VKSAEKETS

SEQ ID NO: 394936 - protein, 9 aa, Homo Sapiens
LLAWKESTI

SEQ ID NO: 394937 - protein, 9 aa, Homo Sapiens
AGVGTTLLS

SEQ ID NO: 394938 - protein, 9 aa, Homo Sapiens
WQGLTLGAP

SEQ ID NO: 394939 - protein, 9 aa, Homo Sapiens
VALSWRGAS

SEQ ID NO: 394940 - protein, 9 aa, Homo Sapiens
GEGEVAADE

SEQ ID NO: 394941 - protein, 9 aa, Homo Sapiens
EREVALVHV

SEQ ID NO: 394942 - protein, 9 aa, Homo Sapiens
VDGDAGVGH

SEQ ID NO: 394943 - protein, 9 aa, Homo Sapiens
LTVLGQPGV

SEQ ID NO: 394944 - protein, 9 aa, Homo Sapiens
GRLTPQAVK

SEQ ID NO: 394945 - protein, 9 aa, Homo Sapiens
ACGSRDVQT

SEQ ID NO: 394946 - protein, 9 aa, Homo Sapiens
APPLSTLSC

SEQ ID NO: 394947 - protein, 9 aa, Homo Sapiens
MRTHNGERP

SEQ ID NO: 394948 - protein, 9 aa, Homo Sapiens
GQRGRHSQG

SEQ ID NO: 394949 - protein, 9 aa, Homo Sapiens
LETCGKQDI

SEQ ID NO: 394950 - protein, 9 aa, Homo Sapiens
PAVRPEDGR

SEQ ID NO: 394951 - protein, 9 aa, Homo Sapiens
KMATLHYPS

SEQ ID NO: 394952 - protein, 9 aa, Homo Sapiens
RADRTGGTS

SEQ ID NO: 394953 - protein, 9 aa, Homo Sapiens
LHDVSDKTP

SEQ ID NO: 394954 - protein, 9 aa, Homo Sapiens
APAGEAEFY

SEQ ID NO: 394955 - protein, 9 aa, Homo Sapiens
NNMTIPSKL

SEQ ID NO: 394956 - protein, 9 aa, Homo Sapiens
WFSQKASLS

SEQ ID NO: 394957 - protein, 9 aa, Homo Sapiens
MNDSKHKLE

SEQ ID NO: 394958 - protein, 9 aa, Homo Sapiens
FLILYMLSI

SEQ ID NO: 394959 - protein, 9 aa, Homo Sapiens
GGGVADARL

SEQ ID NO: 394960 - protein, 9 aa, Homo Sapiens
LQKTEEENA

SEQ ID NO: 394961 - protein, 9 aa, Homo Sapiens
ITASRGGSW

SEQ ID NO: 394962 - protein, 9 aa, Homo Sapiens
RSDLVKHQH

SEQ ID NO: 394963 - protein, 9 aa, Homo Sapiens
YKKIPESEA

SEQ ID NO: 394964 - protein, 9 aa, Homo Sapiens
SFTRTQTSF

SEQ ID NO: 394965 - protein, 9 aa, Homo Sapiens
SRASSTSRA

SEQ ID NO: 394966 - protein, 9 aa, Homo Sapiens
EEARLHDDT

SEQ ID NO: 394967 - protein, 9 aa, Homo Sapiens
YMVRAHAWS

SEQ ID NO: 394968 - protein, 9 aa, Homo Sapiens
IFLGLSKRT

SEQ ID NO: 394969 - protein, 9 aa, Homo Sapiens
PEGQFVSWI

SEQ ID NO: 394970 - protein, 9 aa, Homo Sapiens
RASMDGSMH

SEQ ID NO: 394971 - protein, 9 aa, Homo Sapiens
SRGERGPQG

SEQ ID NO: 394972 - protein, 9 aa, Homo Sapiens
ATSMKFPVR

SEQ ID NO: 394973 - protein, 9 aa, Homo Sapiens
TPLTIGEKT

SEQ ID NO: 394974 - protein, 9 aa, Homo Sapiens
GDWKTILKE

SEQ ID NO: 394975 - protein, 9 aa, Homo Sapiens
ARSESPNQH

SEQ ID NO: 394976 - protein, 9 aa, Homo Sapiens
QNPAGGSRA

SEQ ID NO: 394977 - protein, 9 aa, Homo Sapiens
LSSPPTVIT

SEQ ID NO: 394978 - protein, 9 aa, Homo Sapiens
IQGSFRCLA

SEQ ID NO: 394979 - protein, 9 aa, Homo Sapiens
CSSWEATSS

SEQ ID NO: 394980 - protein, 9 aa, Homo Sapiens
VGNIITLYV

SEQ ID NO: 394981 - protein, 9 aa, Homo Sapiens
QQEPGTREW

SEQ ID NO: 394982 - protein, 9 aa, Homo Sapiens
SSWQAQHES

SEQ ID NO: 394983 - protein, 9 aa, Homo Sapiens
PPTCSLFPQ

SEQ ID NO: 394984 - protein, 9 aa, Homo Sapiens
NDLKKGLQR

SEQ ID NO: 394985 - protein, 9 aa, Homo Sapiens
TLYVFLGIH

SEQ ID NO: 394986 - protein, 9 aa, Homo Sapiens
PKPMGILLV

SEQ ID NO: 394987 - protein, 9 aa, Homo Sapiens
TSAHYVERD

SEQ ID NO: 394988 - protein, 9 aa, Homo Sapiens
LALFYQGPG

SEQ ID NO: 394989 - protein, 9 aa, Homo Sapiens
GTFGTRSPL

SEQ ID NO: 394990 - protein, 9 aa, Homo Sapiens
KAWPASSFA

SEQ ID NO: 394991 - protein, 9 aa, Homo Sapiens
YRNVGLSKC

SEQ ID NO: 394992 - protein, 9 aa, Homo Sapiens
KHLMEKKIN

SEQ ID NO: 394993 - protein, 9 aa, Homo Sapiens
VRNSPCSMC

SEQ ID NO: 394994 - protein, 9 aa, Homo Sapiens
SIAITWGDT

SEQ ID NO: 394995 - protein, 9 aa, Homo Sapiens
PSTPACSCS

SEQ ID NO: 394996 - protein, 9 aa, Homo Sapiens
ETTATRSTT

SEQ ID NO: 394997 - protein, 9 aa, Homo Sapiens
EGLRALQSY

SEQ ID NO: 394998 - protein, 9 aa, Homo Sapiens
VPQVEVYFL

SEQ ID NO: 394999 - protein, 9 aa, Homo Sapiens
PYACPECDK

SEQ ID NO: 395000 - protein, 9 aa, Homo Sapiens
QSALGTASE

SEQ ID NO: 395001 - protein, 9 aa, Homo Sapiens
EIRRLSSMF

SEQ ID NO: 395002 - protein, 9 aa, Homo Sapiens
MTSSEHMET

SEQ ID NO: 395003 - protein, 9 aa, Homo Sapiens
FTTCSRGTL

SEQ ID NO: 395004 - protein, 9 aa, Homo Sapiens
LLARSTSMP

SEQ ID NO: 395005 - protein, 9 aa, Homo Sapiens
GILACECPN

SEQ ID NO: 395006 - protein, 9 aa, Homo Sapiens
NCPSIHLDG

SEQ ID NO: 395007 - protein, 9 aa, Homo Sapiens
GRVGRPQFD

SEQ ID NO: 395008 - protein, 9 aa, Homo Sapiens
AAVDRGKLD

SEQ ID NO: 395009 - protein, 9 aa, Homo Sapiens
ASGSGFTSS

SEQ ID NO: 395010 - protein, 9 aa, Homo Sapiens
SLHSATMGS

SEQ ID NO: 395011 - protein, 9 aa, Homo Sapiens
LGLSKRTPQ

SEQ ID NO: 395012 - protein, 9 aa, Homo Sapiens
WGDTTFQRA

SEQ ID NO: 395013 - protein, 9 aa, Homo Sapiens
QGTYICQVH

SEQ ID NO: 395014 - protein, 9 aa, Homo Sapiens
GASEEPSQN

SEQ ID NO: 395015 - protein, 9 aa, Homo Sapiens
PPDKTKPLG

SEQ ID NO: 395016 - protein, 9 aa, Homo Sapiens
VGERSYGMV

SEQ ID NO: 395017 - protein, 9 aa, Homo Sapiens
KKNCKVVFP

SEQ ID NO: 395018 - protein, 9 aa, Homo Sapiens
RRGSAWQSG

SEQ ID NO: 395019 - protein, 9 aa, Homo Sapiens
VCAELDPHE

SEQ ID NO: 395020 - protein, 9 aa, Homo Sapiens
PMQERPQSS

SEQ ID NO: 395021 - protein, 9 aa, Homo Sapiens
LELEKDMHY

SEQ ID NO: 395022 - protein, 9 aa, Homo Sapiens
IWLPGITHI

SEQ ID NO: 395023 - protein, 9 aa, Homo Sapiens
WATEKRVKD

SEQ ID NO: 395024 - protein, 9 aa, Homo Sapiens
LYMLSILKY

SEQ ID NO: 395025 - protein, 9 aa, Homo Sapiens
KSAEKETSL

SEQ ID NO: 395026 - protein, 9 aa, Homo Sapiens
DHVKAREVL

SEQ ID NO: 395027 - protein, 9 aa, Homo Sapiens
SPGSGPVYA

SEQ ID NO: 395028 - protein, 9 aa, Homo Sapiens
ADHTTLSSN

SEQ ID NO: 395029 - protein, 9 aa, Homo Sapiens
EEAYLLFAE

SEQ ID NO: 395030 - protein, 9 aa, Homo Sapiens
DIQYLYSTF

SEQ ID NO: 395031 - protein, 9 aa, Homo Sapiens
NASHTNFSS

SEQ ID NO: 395032 - protein, 9 aa, Homo Sapiens
EARAKLTPG

SEQ ID NO: 395033 - protein, 9 aa, Homo Sapiens
LRSPMIYGG

SEQ ID NO: 395034 - protein, 9 aa, Homo Sapiens
NKQNLWQYF

SEQ ID NO: 395035 - protein, 9 aa, Homo Sapiens
SSGSPHITN

SEQ ID NO: 395036 - protein, 9 aa, Homo Sapiens
PAGSRGERG

SEQ ID NO: 395037 - protein, 9 aa, Homo Sapiens
AAGASGWSA

SEQ ID NO: 395038 - protein, 9 aa, Homo Sapiens
FGALVLAIV

SEQ ID NO: 395039 - protein, 9 aa, Homo Sapiens
RGSGNTSLS

SEQ ID NO: 395040 - protein, 9 aa, Homo Sapiens
GSTRSTSRT

SEQ ID NO: 395041 - protein, 9 aa, Homo Sapiens
TIANLGSCN

SEQ ID NO: 395042 - protein, 9 aa, Homo Sapiens
PPVQIEEPI

SEQ ID NO: 395043 - protein, 9 aa, Homo Sapiens
GTLFTRRAR

SEQ ID NO: 395044 - protein, 9 aa, Homo Sapiens
LVTYPGIIV

SEQ ID NO: 395045 - protein, 9 aa, Homo Sapiens
EEEEKKDSA

SEQ ID NO: 395046 - protein, 9 aa, Homo Sapiens
AVDRGKLDV

SEQ ID NO: 395047 - protein, 9 aa, Homo Sapiens
IRWLWAAVE

SEQ ID NO: 395048 - protein, 9 aa, Homo Sapiens
RVDSAINSI

SEQ ID NO: 395049 - protein, 9 aa, Homo Sapiens
AFGALVLAI

SEQ ID NO: 395050 - protein, 9 aa, Homo Sapiens
AHQSSPWPG

SEQ ID NO: 395051 - protein, 9 aa, Homo Sapiens
PPCGQPTHC

SEQ ID NO: 395052 - protein, 9 aa, Homo Sapiens
RGSRATSLT

SEQ ID NO: 395053 - protein, 9 aa, Homo Sapiens
GLPDEPSSK

SEQ ID NO: 395054 - protein, 9 aa, Homo Sapiens
PVPLFSEQR

SEQ ID NO: 395055 - protein, 9 aa, Homo Sapiens
FSNPISLPV

SEQ ID NO: 395056 - protein, 9 aa, Homo Sapiens
NQRHGPDGL

SEQ ID NO: 395057 - protein, 9 aa, Homo Sapiens
EATSSSEES

SEQ ID NO: 395058 - protein, 9 aa, Homo Sapiens
QGQPAGHLH

SEQ ID NO: 395059 - protein, 9 aa, Homo Sapiens
TRVRGDGML

SEQ ID NO: 395060 - protein, 9 aa, Homo Sapiens
QPPSRPMTV

SEQ ID NO: 395061 - protein, 9 aa, Homo Sapiens
TSFTLSTNS

SEQ ID NO: 395062 - protein, 9 aa, Homo Sapiens
ECSQPRIFR

SEQ ID NO: 395063 - protein, 9 aa, Homo Sapiens
SALVLLAPA

SEQ ID NO: 395064 - protein, 9 aa, Homo Sapiens
PTLPPTRSS

SEQ ID NO: 395065 - protein, 9 aa, Homo Sapiens
QLTPRLRIW

SEQ ID NO: 395066 - protein, 9 aa, Homo Sapiens
IVVSNTTRT

SEQ ID NO: 395067 - protein, 9 aa, Homo Sapiens
MELVFLTLT

SEQ ID NO: 395068 - protein, 9 aa, Homo Sapiens
TLSQKNDLT

SEQ ID NO: 395069 - protein, 9 aa, Homo Sapiens
SLASCSRGA

SEQ ID NO: 395070 - protein, 9 aa, Homo Sapiens
NTTQPSQKR

SEQ ID NO: 395071 - protein, 9 aa, Homo Sapiens
RRCRPRLSS

SEQ ID NO: 395072 - protein, 9 aa, Homo Sapiens
NNSREKRLI

SEQ ID NO: 395073 - protein, 9 aa, Homo Sapiens
RKRMSSSFH

SEQ ID NO: 395074 - protein, 9 aa, Homo Sapiens
LKRQEEECR

SEQ ID NO: 395075 - protein, 9 aa, Homo Sapiens
ASKASRAGG

SEQ ID NO: 395076 - protein, 9 aa, Homo Sapiens
SITHVNALT

SEQ ID NO: 395077 - protein, 9 aa, Homo Sapiens
ATWPTPPEM

SEQ ID NO: 395078 - protein, 9 aa, Homo Sapiens
LNNNLLHAM

SEQ ID NO: 395079 - protein, 9 aa, Homo Sapiens
EVSSGVIPN

SEQ ID NO: 395080 - protein, 9 aa, Homo Sapiens
YVFHLPNTY

SEQ ID NO: 395081 - protein, 9 aa, Homo Sapiens
PVPPADPAD

SEQ ID NO: 395082 - protein, 9 aa, Homo Sapiens
SKVMGSALA

SEQ ID NO: 395083 - protein, 9 aa, Homo Sapiens
CPWPTGGRH

SEQ ID NO: 395084 - protein, 9 aa, Homo Sapiens
STSILSALR

SEQ ID NO: 395085 - protein, 9 aa, Homo Sapiens
NARLTVTRC

SEQ ID NO: 395086 - protein, 9 aa, Homo Sapiens
GLLSIDLCK

SEQ ID NO: 395087 - protein, 9 aa, Homo Sapiens
SKGTCRSCG

SEQ ID NO: 395088 - protein, 9 aa, Homo Sapiens
RGTLSGDTV

SEQ ID NO: 395089 - protein, 9 aa, Homo Sapiens
SCGPTSGST

SEQ ID NO: 395090 - protein, 9 aa, Homo Sapiens
GVTDVTKIG

SEQ ID NO: 395091 - protein, 9 aa, Homo Sapiens
SGLLFSFDV

SEQ ID NO: 395092 - protein, 9 aa, Homo Sapiens
RNLLRLQSL

SEQ ID NO: 395093 - protein, 9 aa, Homo Sapiens
RPRCTRSWA

SEQ ID NO: 395094 - protein, 9 aa, Homo Sapiens
KRAQGWKRF

SEQ ID NO: 395095 - protein, 9 aa, Homo Sapiens
LLYMKPDNG

SEQ ID NO: 395096 - protein, 9 aa, Homo Sapiens
PNLKRYGYA

SEQ ID NO: 395097 - protein, 9 aa, Homo Sapiens
WRRIGATTP

SEQ ID NO: 395098 - protein, 9 aa, Homo Sapiens
WLGLWLGMP

SEQ ID NO: 395099 - protein, 9 aa, Homo Sapiens
FLPMTKEFI

SEQ ID NO: 395100 - protein, 9 aa, Homo Sapiens
GSWEIAGSW

SEQ ID NO: 395101 - protein, 9 aa, Homo Sapiens
LAPEVCAGM

SEQ ID NO: 395102 - protein, 9 aa, Homo Sapiens
TLSSNTLRP

SEQ ID NO: 395103 - protein, 9 aa, Homo Sapiens
YSSLGSLYV

SEQ ID NO: 395104 - protein, 9 aa, Homo Sapiens
PSPAPSAGR

SEQ ID NO: 395105 - protein, 9 aa, Homo Sapiens
PTPVPTATA

SEQ ID NO: 395106 - protein, 9 aa, Homo Sapiens
LGTRRAAGA

SEQ ID NO: 395107 - protein, 9 aa, Homo Sapiens
YVDYVERAV

SEQ ID NO: 395108 - protein, 9 aa, Homo Sapiens
KNASEIEVH

SEQ ID NO: 395109 - protein, 9 aa, Homo Sapiens
SLSTSVSFA

SEQ ID NO: 395110 - protein, 9 aa, Homo Sapiens
PPESVLYRK

SEQ ID NO: 395111 - protein, 9 aa, Homo Sapiens
QLLDKNGTT

SEQ ID NO: 395112 - protein, 9 aa, Homo Sapiens
DNRSVFEAD

SEQ ID NO: 395113 - protein, 9 aa, Homo Sapiens
LAHRHYASP

SEQ ID NO: 395114 - protein, 9 aa, Homo Sapiens
QLLLLLLLD

SEQ ID NO: 395115 - protein, 9 aa, Homo Sapiens
PPGPPCLPL

SEQ ID NO: 395116 - protein, 9 aa, Homo Sapiens
APMREDESE

SEQ ID NO: 395117 - protein, 9 aa, Homo Sapiens
LPGGAEESA

SEQ ID NO: 395118 - protein, 9 aa, Homo Sapiens
SEHMETKQN

SEQ ID NO: 395119 - protein, 9 aa, Homo Sapiens
RCRPRLSST

SEQ ID NO: 395120 - protein, 9 aa, Homo Sapiens
QPLTGLLEQ

SEQ ID NO: 395121 - protein, 9 aa, Homo Sapiens
SGPCHAAAL

SEQ ID NO: 395122 - protein, 9 aa, Homo Sapiens
GTQEVEIGT

SEQ ID NO: 395123 - protein, 9 aa, Homo Sapiens
QQFATSEMK

SEQ ID NO: 395124 - protein, 9 aa, Homo Sapiens
IWENCHKDV

SEQ ID NO: 395125 - protein, 9 aa, Homo Sapiens
ECEHRVAAK

SEQ ID NO: 395126 - protein, 9 aa, Homo Sapiens
TGQRGRHSQ

SEQ ID NO: 395127 - protein, 9 aa, Homo Sapiens
NNHCQMSGT

SEQ ID NO: 395128 - protein, 9 aa, Homo Sapiens
TTAEWPGRL

SEQ ID NO: 395129 - protein, 9 aa, Homo Sapiens
YQGPGWEEA

SEQ ID NO: 395130 - protein, 9 aa, Homo Sapiens
THEHKKKHW

SEQ ID NO: 395131 - protein, 9 aa, Homo Sapiens
EVRSVRRML

SEQ ID NO: 395132 - protein, 9 aa, Homo Sapiens
SITVKLFKF

SEQ ID NO: 395133 - protein, 9 aa, Homo Sapiens
DTAAALPTP

SEQ ID NO: 395134 - protein, 9 aa, Homo Sapiens
RILARDVKK

SEQ ID NO: 395135 - protein, 9 aa, Homo Sapiens
CGRWFSQKA

SEQ ID NO: 395136 - protein, 9 aa, Homo Sapiens
IYPPIHAPT

SEQ ID NO: 395137 - protein, 9 aa, Homo Sapiens
EVSFCQPHK

SEQ ID NO: 395138 - protein, 9 aa, Homo Sapiens
KGTCRSCGV

SEQ ID NO: 395139 - protein, 9 aa, Homo Sapiens
RGSGQASGS

SEQ ID NO: 395140 - protein, 9 aa, Homo Sapiens
HWTKEIKES

SEQ ID NO: 395141 - protein, 9 aa, Homo Sapiens
ESGGASRAL

SEQ ID NO: 395142 - protein, 9 aa, Homo Sapiens
ALCELTEPC

SEQ ID NO: 395143 - protein, 9 aa, Homo Sapiens
FPPRPTSAV

SEQ ID NO: 395144 - protein, 9 aa, Homo Sapiens
QPLSSLLQD

SEQ ID NO: 395145 - protein, 9 aa, Homo Sapiens
LQMAIAATQ

SEQ ID NO: 395146 - protein, 9 aa, Homo Sapiens
STDDVSEFI

SEQ ID NO: 395147 - protein, 9 aa, Homo Sapiens
AVAPSGPGK

SEQ ID NO: 395148 - protein, 9 aa, Homo Sapiens
TTFTVVQNE

SEQ ID NO: 395149 - protein, 9 aa, Homo Sapiens
RCSVPGESP

SEQ ID NO: 395150 - protein, 9 aa, Homo Sapiens
GMCHHAQGS

SEQ ID NO: 395151 - protein, 9 aa, Homo Sapiens
TLKALVKTW

SEQ ID NO: 395152 - protein, 9 aa, Homo Sapiens
DGEVCAASE

SEQ ID NO: 395153 - protein, 9 aa, Homo Sapiens
SIFARSTSR

SEQ ID NO: 395154 - protein, 9 aa, Homo Sapiens
ALSWRGASF

SEQ ID NO: 395155 - protein, 9 aa, Homo Sapiens
PGCVDGRRG

SEQ ID NO: 395156 - protein, 9 aa, Homo Sapiens
DLKQKHPEN

SEQ ID NO: 395157 - protein, 9 aa, Homo Sapiens
VPTAARPSA

SEQ ID NO: 395158 - protein, 9 aa, Homo Sapiens
MATKMATLH

SEQ ID NO: 395159 - protein, 9 aa, Homo Sapiens
PSVPTAGVT

SEQ ID NO: 395160 - protein, 9 aa, Homo Sapiens
QGLFAVLRG

SEQ ID NO: 395161 - protein, 9 aa, Homo Sapiens
GEQDEEDDE

SEQ ID NO: 395162 - protein, 9 aa, Homo Sapiens
SQNLFVLGF

SEQ ID NO: 395163 - protein, 9 aa, Homo Sapiens
LMDADVLDF

SEQ ID NO: 395164 - protein, 9 aa, Homo Sapiens
ENCSSSSWQ

SEQ ID NO: 395165 - protein, 9 aa, Homo Sapiens
RGREREKEN

SEQ ID NO: 395166 - protein, 9 aa, Homo Sapiens
LEGCVSWSS

SEQ ID NO: 395167 - protein, 9 aa, Homo Sapiens
LYVELYVCV

SEQ ID NO: 395168 - protein, 9 aa, Homo Sapiens
GRVALQLKL

SEQ ID NO: 395169 - protein, 9 aa, Homo Sapiens
RSPTSAPTA

SEQ ID NO: 395170 - protein, 9 aa, Homo Sapiens
RYRGINSIL

SEQ ID NO: 395171 - protein, 9 aa, Homo Sapiens
GLSKRTPQQ

SEQ ID NO: 395172 - protein, 9 aa, Homo Sapiens
QVACGSRDV

SEQ ID NO: 395173 - protein, 9 aa, Homo Sapiens
LFNHTRAQQ

SEQ ID NO: 395174 - protein, 9 aa, Homo Sapiens
SRARGSRAT

SEQ ID NO: 395175 - protein, 9 aa, Homo Sapiens
LEEKRKMTN

SEQ ID NO: 395176 - protein, 9 aa, Homo Sapiens
KRMSSSFHV

SEQ ID NO: 395177 - protein, 9 aa, Homo Sapiens
AAYMAPEHI

SEQ ID NO: 395178 - protein, 9 aa, Homo Sapiens
FYLQQHNNL

SEQ ID NO: 395179 - protein, 9 aa, Homo Sapiens
ATSKISGWT

SEQ ID NO: 395180 - protein, 9 aa, Homo Sapiens
DGSMHTVIV

SEQ ID NO: 395181 - protein, 9 aa, Homo Sapiens
PLPSFSHRS

SEQ ID NO: 395182 - protein, 9 aa, Homo Sapiens
LLRFFIHYS

SEQ ID NO: 395183 - protein, 9 aa, Homo Sapiens
NPMHIFAKL

SEQ ID NO: 395184 - protein, 9 aa, Homo Sapiens
RPLVWSLAV

SEQ ID NO: 395185 - protein, 9 aa, Homo Sapiens
IHYSSLGSL

SEQ ID NO: 395186 - protein, 9 aa, Homo Sapiens
QCQPPTALP

SEQ ID NO: 395187 - protein, 9 aa, Homo Sapiens
RDEGHAIRN

SEQ ID NO: 395188 - protein, 9 aa, Homo Sapiens
MTLGMTELT

SEQ ID NO: 395189 - protein, 9 aa, Homo Sapiens
NITNGARGS

SEQ ID NO: 395190 - protein, 9 aa, Homo Sapiens
VGFTALVQL

SEQ ID NO: 395191 - protein, 9 aa, Homo Sapiens
HIGPKVSLS

SEQ ID NO: 395192 - protein, 9 aa, Homo Sapiens
ARGSLSSSL

SEQ ID NO: 395193 - protein, 9 aa, Homo Sapiens
PVGDIPDIY

SEQ ID NO: 395194 - protein, 9 aa, Homo Sapiens
SRARCTRAP

SEQ ID NO: 395195 - protein, 9 aa, Homo Sapiens
VSNIDTLLD

SEQ ID NO: 395196 - protein, 9 aa, Homo Sapiens
GSGATILTG

SEQ ID NO: 395197 - protein, 9 aa, Homo Sapiens
TDFLCPSDT

SEQ ID NO: 395198 - protein, 9 aa, Homo Sapiens
PPHHLVPLF

SEQ ID NO: 395199 - protein, 9 aa, Homo Sapiens
SVSTVVLAR

SEQ ID NO: 395200 - protein, 9 aa, Homo Sapiens
LFLFYLSLS

SEQ ID NO: 395201 - protein, 9 aa, Homo Sapiens
DENDAEDFE

SEQ ID NO: 395202 - protein, 9 aa, Homo Sapiens
IQSGTQMIK

SEQ ID NO: 395203 - protein, 9 aa, Homo Sapiens
LPRPTTGGP

SEQ ID NO: 395204 - protein, 9 aa, Homo Sapiens
NMWKPMWVV

SEQ ID NO: 395205 - protein, 9 aa, Homo Sapiens
TLGDTLTIT

SEQ ID NO: 395206 - protein, 9 aa, Homo Sapiens
CILTLAKMI

SEQ ID NO: 395207 - protein, 9 aa, Homo Sapiens
PTKRRRRAK

SEQ ID NO: 395208 - protein, 9 aa, Homo Sapiens
GSLPDVEAL

SEQ ID NO: 395209 - protein, 9 aa, Homo Sapiens
RTEAPPQTP

SEQ ID NO: 395210 - protein, 9 aa, Homo Sapiens
VLALNQRHG

SEQ ID NO: 395211 - protein, 9 aa, Homo Sapiens
TLLKGKGIE

SEQ ID NO: 395212 - protein, 9 aa, Homo Sapiens
MSCTCTWRN

SEQ ID NO: 395213 - protein, 9 aa, Homo Sapiens
PCHAAALAL

SEQ ID NO: 395214 - protein, 9 aa, Homo Sapiens
SQSQLVYQG

SEQ ID NO: 395215 - protein, 9 aa, Homo Sapiens
SRTDSARGS

SEQ ID NO: 395216 - protein, 9 aa, Homo Sapiens
IKLLCVTPE

SEQ ID NO: 395217 - protein, 9 aa, Homo Sapiens
PTKEGGAVN

SEQ ID NO: 395218 - protein, 9 aa, Homo Sapiens
SNNSREKRL

SEQ ID NO: 395219 - protein, 9 aa, Homo Sapiens
AGRTSARRR

SEQ ID NO: 395220 - protein, 9 aa, Homo Sapiens
DVSAPRLMV

SEQ ID NO: 395221 - protein, 9 aa, Homo Sapiens
SSPPTVITS

SEQ ID NO: 395222 - protein, 9 aa, Homo Sapiens
RQLGQALSA

SEQ ID NO: 395223 - protein, 9 aa, Homo Sapiens
LSLNAVGYF

SEQ ID NO: 395224 - protein, 9 aa, Homo Sapiens
HQDLQSTSD

SEQ ID NO: 395225 - protein, 9 aa, Homo Sapiens
VSVCRDAPA

SEQ ID NO: 395226 - protein, 9 aa, Homo Sapiens
ILGVQKPIS

SEQ ID NO: 395227 - protein, 9 aa, Homo Sapiens
LVGIWLPGI

SEQ ID NO: 395228 - protein, 9 aa, Homo Sapiens
WGWSQQKEV

SEQ ID NO: 395229 - protein, 9 aa, Homo Sapiens
VPQGLTDLE

SEQ ID NO: 395230 - protein, 9 aa, Homo Sapiens
LMGYPVPYT

SEQ ID NO: 395231 - protein, 9 aa, Homo Sapiens
TCSPPASTC

SEQ ID NO: 395232 - protein, 9 aa, Homo Sapiens
TMEFPEGTR

SEQ ID NO: 395233 - protein, 9 aa, Homo Sapiens
YTGEKPFKC

SEQ ID NO: 395234 - protein, 9 aa, Homo Sapiens
RRLSSMFLR

SEQ ID NO: 395235 - protein, 9 aa, Homo Sapiens
ARQPSVRAG

SEQ ID NO: 395236 - protein, 9 aa, Homo Sapiens
ISWRMEAHT

SEQ ID NO: 395237 - protein, 9 aa, Homo Sapiens
MPAQGSSSQ

SEQ ID NO: 395238 - protein, 9 aa, Homo Sapiens
VRNLHPPRM

SEQ ID NO: 395239 - protein, 9 aa, Homo Sapiens
RTPWVGYVH

SEQ ID NO: 395240 - protein, 9 aa, Homo Sapiens
SSAVAPSGP

SEQ ID NO: 395241 - protein, 9 aa, Homo Sapiens
FTWRTSRTR

SEQ ID NO: 395242 - protein, 9 aa, Homo Sapiens
RSTRGSSGA

SEQ ID NO: 395243 - protein, 9 aa, Homo Sapiens
KMTNDGPKP

SEQ ID NO: 395244 - protein, 9 aa, Homo Sapiens
VCVLSAPPH

SEQ ID NO: 395245 - protein, 9 aa, Homo Sapiens
PLHMAASEC

SEQ ID NO: 395246 - protein, 9 aa, Homo Sapiens
HQTGAPRGH

SEQ ID NO: 395247 - protein, 9 aa, Homo Sapiens
VLQQLLSDL

SEQ ID NO: 395248 - protein, 9 aa, Homo Sapiens
LDVGLTSAL

SEQ ID NO: 395249 - protein, 9 aa, Homo Sapiens
YNVSRDQCQ

SEQ ID NO: 395250 - protein, 9 aa, Homo Sapiens
LPPRSPRCP

SEQ ID NO: 395251 - protein, 9 aa, Homo Sapiens
GQLLLLLLL

SEQ ID NO: 395252 - protein, 9 aa, Homo Sapiens
IIIITFFFK

SEQ ID NO: 395253 - protein, 9 aa, Homo Sapiens
LRLNCPAAV

SEQ ID NO: 395254 - protein, 9 aa, Homo Sapiens
SVPCPNLLP

SEQ ID NO: 395255 - protein, 9 aa, Homo Sapiens
EWDPDKATR

SEQ ID NO: 395256 - protein, 9 aa, Homo Sapiens
YLGNVLVCT

SEQ ID NO: 395257 - protein, 9 aa, Homo Sapiens
WLLELSKKK

SEQ ID NO: 395258 - protein, 9 aa, Homo Sapiens
SSQTLGTRQ

SEQ ID NO: 395259 - protein, 9 aa, Homo Sapiens
LQCLCCEEE

SEQ ID NO: 395260 - protein, 9 aa, Homo Sapiens
NAPFDMIAE

SEQ ID NO: 395261 - protein, 9 aa, Homo Sapiens
ASVSSCNRA

SEQ ID NO: 395262 - protein, 9 aa, Homo Sapiens
EGSLKKTSR

SEQ ID NO: 395263 - protein, 9 aa, Homo Sapiens
NGARGSSGS

SEQ ID NO: 395264 - protein, 9 aa, Homo Sapiens
AFVMYCHTH

SEQ ID NO: 395265 - protein, 9 aa, Homo Sapiens
ILFCVDSKQ

SEQ ID NO: 395266 - protein, 9 aa, Homo Sapiens
TIIHTEDKP

SEQ ID NO: 395267 - protein, 9 aa, Homo Sapiens
QGLTLGAPL

SEQ ID NO: 395268 - protein, 9 aa, Homo Sapiens
LQLALFYQG

SEQ ID NO: 395269 - protein, 9 aa, Homo Sapiens
RGARRTDSA

SEQ ID NO: 395270 - protein, 9 aa, Homo Sapiens
CSVPTGDIW

SEQ ID NO: 395271 - protein, 9 aa, Homo Sapiens
PGPPGPLGS

SEQ ID NO: 395272 - protein, 9 aa, Homo Sapiens
SYIHYVFHL

SEQ ID NO: 395273 - protein, 9 aa, Homo Sapiens
VKQPNLLII

SEQ ID NO: 395274 - protein, 9 aa, Homo Sapiens
HFVTRNKDV

SEQ ID NO: 395275 - protein, 9 aa, Homo Sapiens
RTGASTPAR

SEQ ID NO: 395276 - protein, 9 aa, Homo Sapiens
FGNKPDTFC

SEQ ID NO: 395277 - protein, 9 aa, Homo Sapiens
PHPPKRIRS

SEQ ID NO: 395278 - protein, 9 aa, Homo Sapiens
LFTRFACFT

SEQ ID NO: 395279 - protein, 9 aa, Homo Sapiens
TIILVQTGQ

SEQ ID NO: 395280 - protein, 9 aa, Homo Sapiens
NQKKAKIKK

SEQ ID NO: 395281 - protein, 9 aa, Homo Sapiens
TSSTRGTSA

SEQ ID NO: 395282 - protein, 9 aa, Homo Sapiens
GGPPARTPR

SEQ ID NO: 395283 - protein, 9 aa, Homo Sapiens
LLAPATPPF

SEQ ID NO: 395284 - protein, 9 aa, Homo Sapiens
KEGMKIEIH

SEQ ID NO: 395285 - protein, 9 aa, Homo Sapiens
NAVGYFCFT

SEQ ID NO: 395286 - protein, 9 aa, Homo Sapiens
EASLSSLTR

SEQ ID NO: 395287 - protein, 9 aa, Homo Sapiens
ADSGLQRAE

SEQ ID NO: 395288 - protein, 9 aa, Homo Sapiens
VVDGHTVSI

SEQ ID NO: 395289 - protein, 9 aa, Homo Sapiens
DSNKQNLWQ

SEQ ID NO: 395290 - protein, 9 aa, Homo Sapiens
GASSIPTTM

SEQ ID NO: 395291 - protein, 9 aa, Homo Sapiens
RRSQTKWRS

SEQ ID NO: 395292 - protein, 9 aa, Homo Sapiens
SKKEVDPAI

SEQ ID NO: 395293 - protein, 9 aa, Homo Sapiens
TENPPDCYR

SEQ ID NO: 395294 - protein, 9 aa, Homo Sapiens
PRPDVHRLG

SEQ ID NO: 395295 - protein, 9 aa, Homo Sapiens
STREARRTS

SEQ ID NO: 395296 - protein, 9 aa, Homo Sapiens
TRGASKASR

SEQ ID NO: 395297 - protein, 9 aa, Homo Sapiens
GARGAKVSR

SEQ ID NO: 395298 - protein, 9 aa, Homo Sapiens
GTVMAGTIL

SEQ ID NO: 395299 - protein, 9 aa, Homo Sapiens
ATPVEGSPD

SEQ ID NO: 395300 - protein, 9 aa, Homo Sapiens
MKVARMSLT

SEQ ID NO: 395301 - protein, 9 aa, Homo Sapiens
TFFFKIFIF

SEQ ID NO: 395302 - protein, 9 aa, Homo Sapiens
LLWPTSAPT

SEQ ID NO: 395303 - protein, 9 aa, Homo Sapiens
RSPASAPTR

SEQ ID NO: 395304 - protein, 9 aa, Homo Sapiens
LRSQTVVTF

SEQ ID NO: 395305 - protein, 9 aa, Homo Sapiens
LFDGPFQPF

SEQ ID NO: 395306 - protein, 9 aa, Homo Sapiens
SRCCPPIRT

SEQ ID NO: 395307 - protein, 9 aa, Homo Sapiens
DTKSKLNTS

SEQ ID NO: 395308 - protein, 9 aa, Homo Sapiens
YLGQEVILD

SEQ ID NO: 395309 - protein, 9 aa, Homo Sapiens
APPQTPPLS

SEQ ID NO: 395310 - protein, 9 aa, Homo Sapiens
VIQSILQAI

SEQ ID NO: 395311 - protein, 9 aa, Homo Sapiens
RKKMFLIQR

SEQ ID NO: 395312 - protein, 9 aa, Homo Sapiens
QDPIEAPPP

SEQ ID NO: 395313 - protein, 9 aa, Homo Sapiens
TVTLGARRT

SEQ ID NO: 395314 - protein, 9 aa, Homo Sapiens
QVHGPWGKA

SEQ ID NO: 395315 - protein, 9 aa, Homo Sapiens
PHIGPKVSL

SEQ ID NO: 395316 - protein, 9 aa, Homo Sapiens
PARSAAAAS

SEQ ID NO: 395317 - protein, 9 aa, Homo Sapiens
KATFGTSLS

SEQ ID NO: 395318 - protein, 9 aa, Homo Sapiens
PFDMIAEIN

SEQ ID NO: 395319 - protein, 9 aa, Homo Sapiens
TAGVTASYG

SEQ ID NO: 395320 - protein, 9 aa, Homo Sapiens
HWNGKKMLS

SEQ ID NO: 395321 - protein, 9 aa, Homo Sapiens
CWAWTAPTA

SEQ ID NO: 395322 - protein, 9 aa, Homo Sapiens
GRKIHVLLA

SEQ ID NO: 395323 - protein, 9 aa, Homo Sapiens
GNSTYRCSY

SEQ ID NO: 395324 - protein, 9 aa, Homo Sapiens
RCIEFQVPK

SEQ ID NO: 395325 - protein, 9 aa, Homo Sapiens
YMDSLDIIT

SEQ ID NO: 395326 - protein, 9 aa, Homo Sapiens
ASPGRRDPQ

SEQ ID NO: 395327 - protein, 9 aa, Homo Sapiens
QQCQPPTAL

SEQ ID NO: 395328 - protein, 9 aa, Homo Sapiens
SGSQCTSLT

SEQ ID NO: 395329 - protein, 9 aa, Homo Sapiens
IPKCEGKQF

SEQ ID NO: 395330 - protein, 9 aa, Homo Sapiens
DLIVMGPQD

SEQ ID NO: 395331 - protein, 9 aa, Homo Sapiens
FILSYRWLS

SEQ ID NO: 395332 - protein, 9 aa, Homo Sapiens
ITDQHRNGV

SEQ ID NO: 395333 - protein, 9 aa, Homo Sapiens
TTSATHSTT

SEQ ID NO: 395334 - protein, 9 aa, Homo Sapiens
TSVTLRPWK

SEQ ID NO: 395335 - protein, 9 aa, Homo Sapiens
IQEDRKARA

SEQ ID NO: 395336 - protein, 9 aa, Homo Sapiens
LHPGARRPL

SEQ ID NO: 395337 - protein, 9 aa, Homo Sapiens
FSTRDYIVE

SEQ ID NO: 395338 - protein, 9 aa, Homo Sapiens
ASGLLSIDL

SEQ ID NO: 395339 - protein, 9 aa, Homo Sapiens
LSNHVNEKV

SEQ ID NO: 395340 - protein, 9 aa, Homo Sapiens
SFFRRCRPR

SEQ ID NO: 395341 - protein, 9 aa, Homo Sapiens
SPRAAIWRR

SEQ ID NO: 395342 - protein, 9 aa, Homo Sapiens
ASRGGSWPP

SEQ ID NO: 395343 - protein, 9 aa, Homo Sapiens
SSSGTSRAA

SEQ ID NO: 395344 - protein, 9 aa, Homo Sapiens
RTRETLESG

SEQ ID NO: 395345 - protein, 9 aa, Homo Sapiens
STTTILNPQ

SEQ ID NO: 395346 - protein, 9 aa, Homo Sapiens
VLVHQLLLH

SEQ ID NO: 395347 - protein, 9 aa, Homo Sapiens
DEGDAWLLG

SEQ ID NO: 395348 - protein, 9 aa, Homo Sapiens
VLAQPAAFG

SEQ ID NO: 395349 - protein, 9 aa, Homo Sapiens
ISRGARRTD

SEQ ID NO: 395350 - protein, 9 aa, Homo Sapiens
RSHLRMHMR

SEQ ID NO: 395351 - protein, 9 aa, Homo Sapiens
SGIKKQHSM

SEQ ID NO: 395352 - protein, 9 aa, Homo Sapiens
GTRGPGSTS

SEQ ID NO: 395353 - protein, 9 aa, Homo Sapiens
GNRSTGCYL

SEQ ID NO: 395354 - protein, 9 aa, Homo Sapiens
PGPAQFHAR

SEQ ID NO: 395355 - protein, 9 aa, Homo Sapiens
LQPTKEKKA

SEQ ID NO: 395356 - protein, 9 aa, Homo Sapiens
RTCQAWLSM

SEQ ID NO: 395357 - protein, 9 aa, Homo Sapiens
IDTRQRRMD

SEQ ID NO: 395358 - protein, 9 aa, Homo Sapiens
RGAKVSRNT

SEQ ID NO: 395359 - protein, 9 aa, Homo Sapiens
WLEDRARLP

SEQ ID NO: 395360 - protein, 9 aa, Homo Sapiens
LPAVRPEDG

SEQ ID NO: 395361 - protein, 9 aa, Homo Sapiens
MYAKCLESA

SEQ ID NO: 395362 - protein, 9 aa, Homo Sapiens
PWRGQPGPA

SEQ ID NO: 395363 - protein, 9 aa, Homo Sapiens
GPSANVYKA

SEQ ID NO: 395364 - protein, 9 aa, Homo Sapiens
SHTLLLNNR

SEQ ID NO: 395365 - protein, 9 aa, Homo Sapiens
IQASWARPP

SEQ ID NO: 395366 - protein, 9 aa, Homo Sapiens
DHTSETSHL

SEQ ID NO: 395367 - protein, 9 aa, Homo Sapiens
RLRFCAWPS

SEQ ID NO: 395368 - protein, 9 aa, Homo Sapiens
DLNSSQNLF

SEQ ID NO: 395369 - protein, 9 aa, Homo Sapiens
FFKIFIFLI

SEQ ID NO: 395370 - protein, 9 aa, Homo Sapiens
RKRKFLDTG

SEQ ID NO: 395371 - protein, 9 aa, Homo Sapiens
GYFCFTSVF

SEQ ID NO: 395372 - protein, 9 aa, Homo Sapiens
VSNTTRTLR

SEQ ID NO: 395373 - protein, 9 aa, Homo Sapiens
CGSRWKSGS

SEQ ID NO: 395374 - protein, 9 aa, Homo Sapiens
GGAEESAKE

SEQ ID NO: 395375 - protein, 9 aa, Homo Sapiens
LSLSTSVSF

SEQ ID NO: 395376 - protein, 9 aa, Homo Sapiens
AQGWKRFGM

SEQ ID NO: 395377 - protein, 9 aa, Homo Sapiens
HPPRMKDPR

SEQ ID NO: 395378 - protein, 9 aa, Homo Sapiens
LEPERTMIL

SEQ ID NO: 395379 - protein, 9 aa, Homo Sapiens
EADWFLSAS

SEQ ID NO: 395380 - protein, 9 aa, Homo Sapiens
SEGRVHILD

SEQ ID NO: 395381 - protein, 9 aa, Homo Sapiens
LCPKNKLLK

SEQ ID NO: 395382 - protein, 9 aa, Homo Sapiens
AASGPCHAA

SEQ ID NO: 395383 - protein, 9 aa, Homo Sapiens
NCIYPLSMC

SEQ ID NO: 395384 - protein, 9 aa, Homo Sapiens
EAKEPAQCI

SEQ ID NO: 395385 - protein, 9 aa, Homo Sapiens
ASCSEAPRP

SEQ ID NO: 395386 - protein, 9 aa, Homo Sapiens
LKRCDNMCV

SEQ ID NO: 395387 - protein, 9 aa, Homo Sapiens
SEKRSEMAF

SEQ ID NO: 395388 - protein, 9 aa, Homo Sapiens
MLEWTPPCD

SEQ ID NO: 395389 - protein, 9 aa, Homo Sapiens
SSRARGSLN

SEQ ID NO: 395390 - protein, 9 aa, Homo Sapiens
IQWLFMGYS

SEQ ID NO: 395391 - protein, 9 aa, Homo Sapiens
VEIGTVVVL

SEQ ID NO: 395392 - protein, 9 aa, Homo Sapiens
GPRGGHPQP

SEQ ID NO: 395393 - protein, 9 aa, Homo Sapiens
IRRLSSMFL

SEQ ID NO: 395394 - protein, 9 aa, Homo Sapiens
GCIKVDWQR

SEQ ID NO: 395395 - protein, 9 aa, Homo Sapiens
YCDCISARG

SEQ ID NO: 395396 - protein, 9 aa, Homo Sapiens
MFFKSVNHP

SEQ ID NO: 395397 - protein, 9 aa, Homo Sapiens
LEGAASHLQ

SEQ ID NO: 395398 - protein, 9 aa, Homo Sapiens
LQWPHPDPA

SEQ ID NO: 395399 - protein, 9 aa, Homo Sapiens
QHRELINGS

SEQ ID NO: 395400 - protein, 9 aa, Homo Sapiens
LVHQLLLHQ

SEQ ID NO: 395401 - protein, 9 aa, Homo Sapiens
ANGSLLLLS

SEQ ID NO: 395402 - protein, 9 aa, Homo Sapiens
SRRYFSNPI

SEQ ID NO: 395403 - protein, 9 aa, Homo Sapiens
PPWLLTNLS

SEQ ID NO: 395404 - protein, 9 aa, Homo Sapiens
GLDDVSLHV

SEQ ID NO: 395405 - protein, 9 aa, Homo Sapiens
GSVFNMWKP

SEQ ID NO: 395406 - protein, 9 aa, Homo Sapiens
FLLQMAIAA

SEQ ID NO: 395407 - protein, 9 aa, Homo Sapiens
LVVTNMIAN

SEQ ID NO: 395408 - protein, 9 aa, Homo Sapiens
AGKELVIGH

SEQ ID NO: 395409 - protein, 9 aa, Homo Sapiens
SWHPILPKC

SEQ ID NO: 395410 - protein, 9 aa, Homo Sapiens
AQDTRCTDR

SEQ ID NO: 395411 - protein, 9 aa, Homo Sapiens
DKAFRQRPT

SEQ ID NO: 395412 - protein, 9 aa, Homo Sapiens
YLILQWLED

SEQ ID NO: 395413 - protein, 9 aa, Homo Sapiens
WAPAGTGTA

SEQ ID NO: 395414 - protein, 9 aa, Homo Sapiens
FVPVAFVCS

SEQ ID NO: 395415 - protein, 9 aa, Homo Sapiens
PNMHENLTY

SEQ ID NO: 395416 - protein, 9 aa, Homo Sapiens
NPCLYGAYL

SEQ ID NO: 395417 - protein, 9 aa, Homo Sapiens
AKVLENNQT

SEQ ID NO: 395418 - protein, 9 aa, Homo Sapiens
SQSALGTAS

SEQ ID NO: 395419 - protein, 9 aa, Homo Sapiens
VQIQSQSST

SEQ ID NO: 395420 - protein, 9 aa, Homo Sapiens
IEHRVKAAV

SEQ ID NO: 395421 - protein, 9 aa, Homo Sapiens
CGEDVVGGG

SEQ ID NO: 395422 - protein, 9 aa, Homo Sapiens
ANFDAFSSD

SEQ ID NO: 395423 - protein, 9 aa, Homo Sapiens
VQPAWKIVL

SEQ ID NO: 395424 - protein, 9 aa, Homo Sapiens
RGQVPMQER

SEQ ID NO: 395425 - protein, 9 aa, Homo Sapiens
KTEIQLTMN

SEQ ID NO: 395426 - protein, 9 aa, Homo Sapiens
SRLSDIFWV

SEQ ID NO: 395427 - protein, 9 aa, Homo Sapiens
LLPVDEVNM

SEQ ID NO: 395428 - protein, 9 aa, Homo Sapiens
FQNIMRMTA

SEQ ID NO: 395429 - protein, 9 aa, Homo Sapiens
LYETVDILL

SEQ ID NO: 395430 - protein, 9 aa, Homo Sapiens
GIEKARVHR

SEQ ID NO: 395431 - protein, 9 aa, Homo Sapiens
FTMMSLAAL

SEQ ID NO: 395432 - protein, 9 aa, Homo Sapiens
HNSLNYREV

SEQ ID NO: 395433 - protein, 9 aa, Homo Sapiens
KIHSADKPH

SEQ ID NO: 395434 - protein, 9 aa, Homo Sapiens
RARLSLSTS

SEQ ID NO: 395435 - protein, 9 aa, Homo Sapiens
LSTNSTREA

SEQ ID NO: 395436 - protein, 9 aa, Homo Sapiens
EGPQLENWS

SEQ ID NO: 395437 - protein, 9 aa, Homo Sapiens
PPAQPRPWR

SEQ ID NO: 395438 - protein, 9 aa, Homo Sapiens
STSRARGTS

SEQ ID NO: 395439 - protein, 9 aa, Homo Sapiens
FQIINTEYE

SEQ ID NO: 395440 - protein, 9 aa, Homo Sapiens
TPGVRAPEV

SEQ ID NO: 395441 - protein, 9 aa, Homo Sapiens
WCLGPAARP

SEQ ID NO: 395442 - protein, 9 aa, Homo Sapiens
LDGGPWALA

SEQ ID NO: 395443 - protein, 9 aa, Homo Sapiens
LFLFFIPGV

SEQ ID NO: 395444 - protein, 9 aa, Homo Sapiens
EYMVKEVLR

SEQ ID NO: 395445 - protein, 9 aa, Homo Sapiens
GVPGQEFPP

SEQ ID NO: 395446 - protein, 9 aa, Homo Sapiens
RDVQTLALT

SEQ ID NO: 395447 - protein, 9 aa, Homo Sapiens
AQGTRRSSN

SEQ ID NO: 395448 - protein, 9 aa, Homo Sapiens
KHKLESPAL

SEQ ID NO: 395449 - protein, 9 aa, Homo Sapiens
HSATGVIIV

SEQ ID NO: 395450 - protein, 9 aa, Homo Sapiens
LLPYLEQFW

SEQ ID NO: 395451 - protein, 9 aa, Homo Sapiens
RPARQVRCL

SEQ ID NO: 395452 - protein, 9 aa, Homo Sapiens
TLVTRGTSR

SEQ ID NO: 395453 - protein, 9 aa, Homo Sapiens
SPYDATLVI

SEQ ID NO: 395454 - protein, 9 aa, Homo Sapiens
KWSTDDVSE

SEQ ID NO: 395455 - protein, 9 aa, Homo Sapiens
PMIISYKEG

SEQ ID NO: 395456 - protein, 9 aa, Homo Sapiens
LTIKELQKT

SEQ ID NO: 395457 - protein, 9 aa, Homo Sapiens
TSSNPASTS

SEQ ID NO: 395458 - protein, 9 aa, Homo Sapiens
RSITHVNAL

SEQ ID NO: 395459 - protein, 9 aa, Homo Sapiens
EDNSLLNQD

SEQ ID NO: 395460 - protein, 9 aa, Homo Sapiens
LICLTPSVP

SEQ ID NO: 395461 - protein, 9 aa, Homo Sapiens
CTRAPPRPR

SEQ ID NO: 395462 - protein, 9 aa, Homo Sapiens
TCGKQDIMP

SEQ ID NO: 395463 - protein, 9 aa, Homo Sapiens
AAVAAAAVA

SEQ ID NO: 395464 - protein, 9 aa, Homo Sapiens
RFLTDVLHD

SEQ ID NO: 395465 - protein, 9 aa, Homo Sapiens
LSEAEASLV

SEQ ID NO: 395466 - protein, 9 aa, Homo Sapiens
EDRCMSDLT

SEQ ID NO: 395467 - protein, 9 aa, Homo Sapiens
MPRVFLVRS

SEQ ID NO: 395468 - protein, 9 aa, Homo Sapiens
GFACPWPTG

SEQ ID NO: 395469 - protein, 9 aa, Homo Sapiens
VEGEDVLVH

SEQ ID NO: 395470 - protein, 9 aa, Homo Sapiens
VEQDTGLLQ

SEQ ID NO: 395471 - protein, 9 aa, Homo Sapiens
ALVATSCSA

SEQ ID NO: 395472 - protein, 9 aa, Homo Sapiens
HYVDYVERA

SEQ ID NO: 395473 - protein, 9 aa, Homo Sapiens
CISVKDHRT

SEQ ID NO: 395474 - protein, 9 aa, Homo Sapiens
EGEVAADEQ

SEQ ID NO: 395475 - protein, 9 aa, Homo Sapiens
QKTEEENAD

SEQ ID NO: 395476 - protein, 9 aa, Homo Sapiens
KSVRLEDSC

SEQ ID NO: 395477 - protein, 9 aa, Homo Sapiens
SVPTGDIWQ

SEQ ID NO: 395478 - protein, 9 aa, Homo Sapiens
ANVPVLRSS

SEQ ID NO: 395479 - protein, 9 aa, Homo Sapiens
MHIRDFIQV

SEQ ID NO: 395480 - protein, 9 aa, Homo Sapiens
PPQGDRPQG

SEQ ID NO: 395481 - protein, 9 aa, Homo Sapiens
NKSNSENEQ

SEQ ID NO: 395482 - protein, 9 aa, Homo Sapiens
CSSYTMRVE

SEQ ID NO: 395483 - protein, 9 aa, Homo Sapiens
DVGLGVQVL

SEQ ID NO: 395484 - protein, 9 aa, Homo Sapiens
AATFRGAHL

SEQ ID NO: 395485 - protein, 9 aa, Homo Sapiens
AGASGWSAS

SEQ ID NO: 395486 - protein, 9 aa, Homo Sapiens
KNCIYPLSM

SEQ ID NO: 395487 - protein, 9 aa, Homo Sapiens
EEWAPRMGC

SEQ ID NO: 395488 - protein, 9 aa, Homo Sapiens
REVVDGHTV

SEQ ID NO: 395489 - protein, 9 aa, Homo Sapiens
CLPPRRLRV

SEQ ID NO: 395490 - protein, 9 aa, Homo Sapiens
GPAGVLHTA

SEQ ID NO: 395491 - protein, 9 aa, Homo Sapiens
PGRRGLRTR

SEQ ID NO: 395492 - protein, 9 aa, Homo Sapiens
PLFIWTPWR

SEQ ID NO: 395493 - protein, 9 aa, Homo Sapiens
DVVGGGAGV

SEQ ID NO: 395494 - protein, 9 aa, Homo Sapiens
MKTLKKISG

SEQ ID NO: 395495 - protein, 9 aa, Homo Sapiens
SLQEHMGSC

SEQ ID NO: 395496 - protein, 9 aa, Homo Sapiens
MSGTSGKGF

SEQ ID NO: 395497 - protein, 9 aa, Homo Sapiens
LCTYETRQK

SEQ ID NO: 395498 - protein, 9 aa, Homo Sapiens
TETHEHKKK

SEQ ID NO: 395499 - protein, 9 aa, Homo Sapiens
ESVLYRKFT

SEQ ID NO: 395500 - protein, 9 aa, Homo Sapiens
VICLDYLVD

SEQ ID NO: 395501 - protein, 9 aa, Homo Sapiens
CPHSHGNPL

SEQ ID NO: 395502 - protein, 9 aa, Homo Sapiens
YANECTNFT

SEQ ID NO: 395503 - protein, 9 aa, Homo Sapiens
TLLDGKATL

SEQ ID NO: 395504 - protein, 9 aa, Homo Sapiens
VKIEHDWCS

SEQ ID NO: 395505 - protein, 9 aa, Homo Sapiens
ILANTVKPR

SEQ ID NO: 395506 - protein, 9 aa, Homo Sapiens
LGLKPFSCD

SEQ ID NO: 395507 - protein, 9 aa, Homo Sapiens
PRTASSRCC

SEQ ID NO: 395508 - protein, 9 aa, Homo Sapiens
AKLCNILRK

SEQ ID NO: 395509 - protein, 9 aa, Homo Sapiens
KQNLWQYFE

SEQ ID NO: 395510 - protein, 9 aa, Homo Sapiens
MASSADADH

SEQ ID NO: 395511 - protein, 9 aa, Homo Sapiens
AEVSCSHTN

SEQ ID NO: 395512 - protein, 9 aa, Homo Sapiens
VSHLVGGHP

SEQ ID NO: 395513 - protein, 9 aa, Homo Sapiens
ITAGMAHIF

SEQ ID NO: 395514 - protein, 9 aa, Homo Sapiens
SRTRETLES

SEQ ID NO: 395515 - protein, 9 aa, Homo Sapiens
VSRNTLFTR

SEQ ID NO: 395516 - protein, 9 aa, Homo Sapiens
LQAVQHNGR

SEQ ID NO: 395517 - protein, 9 aa, Homo Sapiens
DSVAKAEKR

SEQ ID NO: 395518 - protein, 9 aa, Homo Sapiens
AFVHQVNRQ

SEQ ID NO: 395519 - protein, 9 aa, Homo Sapiens
SILNPVADI

SEQ ID NO: 395520 - protein, 9 aa, Homo Sapiens
VLSPEDMPA

SEQ ID NO: 395521 - protein, 9 aa, Homo Sapiens
KHPENDLDQ

SEQ ID NO: 395522 - protein, 9 aa, Homo Sapiens
PLDYIGHVK

SEQ ID NO: 395523 - protein, 9 aa, Homo Sapiens
PRRLRVTRH

SEQ ID NO: 395524 - protein, 9 aa, Homo Sapiens
SWPPALWAP

SEQ ID NO: 395525 - protein, 9 aa, Homo Sapiens
IDFLVLCQF

SEQ ID NO: 395526 - protein, 9 aa, Homo Sapiens
FEEEARLHD

SEQ ID NO: 395527 - protein, 9 aa, Homo Sapiens
PPPWLLTNL

SEQ ID NO: 395528 - protein, 9 aa, Homo Sapiens
RASPHSTTA

SEQ ID NO: 395529 - protein, 9 aa, Homo Sapiens
GEGSVSTVV

SEQ ID NO: 395530 - protein, 9 aa, Homo Sapiens
NLCLKLWSL

SEQ ID NO: 395531 - protein, 9 aa, Homo Sapiens
WEIAGSWTS

SEQ ID NO: 395532 - protein, 9 aa, Homo Sapiens
EPIHANPEC

SEQ ID NO: 395533 - protein, 9 aa, Homo Sapiens
SHLRMHMRT

SEQ ID NO: 395534 - protein, 9 aa, Homo Sapiens
KARADKGTQ

SEQ ID NO: 395535 - protein, 9 aa, Homo Sapiens
EFPANVPVL

SEQ ID NO: 395536 - protein, 9 aa, Homo Sapiens
STSVSFAAR

SEQ ID NO: 395537 - protein, 9 aa, Homo Sapiens
EHIDPPDPT

SEQ ID NO: 395538 - protein, 9 aa, Homo Sapiens
AILSEASTM

SEQ ID NO: 395539 - protein, 9 aa, Homo Sapiens
IRFLPMTKE

SEQ ID NO: 395540 - protein, 9 aa, Homo Sapiens
LFCVDSKQM

SEQ ID NO: 395541 - protein, 9 aa, Homo Sapiens
PEACHGPLF

SEQ ID NO: 395542 - protein, 9 aa, Homo Sapiens
LRLQSLLSL

SEQ ID NO: 395543 - protein, 9 aa, Homo Sapiens
VHIVPVWIL

SEQ ID NO: 395544 - protein, 9 aa, Homo Sapiens
EDILIPADF

SEQ ID NO: 395545 - protein, 9 aa, Homo Sapiens
RETVESIFA

SEQ ID NO: 395546 - protein, 9 aa, Homo Sapiens
IIPPGSSHA

SEQ ID NO: 395547 - protein, 9 aa, Homo Sapiens
QYTILRSPM

SEQ ID NO: 395548 - protein, 9 aa, Homo Sapiens
EIQFILFGP

SEQ ID NO: 395549 - protein, 9 aa, Homo Sapiens
PRSSITVKL

SEQ ID NO: 395550 - protein, 9 aa, Homo Sapiens
FVNDVRILE

SEQ ID NO: 395551 - protein, 9 aa, Homo Sapiens
LSEQHGAAA

SEQ ID NO: 395552 - protein, 9 aa, Homo Sapiens
MKALQCTAG

SEQ ID NO: 395553 - protein, 9 aa, Homo Sapiens
TQRTFKGNT

SEQ ID NO: 395554 - protein, 9 aa, Homo Sapiens
LIKHTIIHT

SEQ ID NO: 395555 - protein, 9 aa, Homo Sapiens
TPMTNSPIL

SEQ ID NO: 395556 - protein, 9 aa, Homo Sapiens
EQSKRPLGM

SEQ ID NO: 395557 - protein, 9 aa, Homo Sapiens
NYIQCELKI

SEQ ID NO: 395558 - protein, 9 aa, Homo Sapiens
ETCGKQDIM

SEQ ID NO: 395559 - protein, 9 aa, Homo Sapiens
IHFRREREE

SEQ ID NO: 395560 - protein, 9 aa, Homo Sapiens
QQTIQWLFM

SEQ ID NO: 395561 - protein, 9 aa, Homo Sapiens
VPWGMEALG

SEQ ID NO: 395562 - protein, 9 aa, Homo Sapiens
TSSPGLGSR

SEQ ID NO: 395563 - protein, 9 aa, Homo Sapiens
GLVGCEHGG

SEQ ID NO: 395564 - protein, 9 aa, Homo Sapiens
RTSSRASLT

SEQ ID NO: 395565 - protein, 9 aa, Homo Sapiens
IPLLWPQEE

SEQ ID NO: 395566 - protein, 9 aa, Homo Sapiens
QLFLVLIIL

SEQ ID NO: 395567 - protein, 9 aa, Homo Sapiens
QGPPPQGDR

SEQ ID NO: 395568 - protein, 9 aa, Homo Sapiens
ASQTTDAIF

SEQ ID NO: 395569 - protein, 9 aa, Homo Sapiens
PKLTGSLPD

SEQ ID NO: 395570 - protein, 9 aa, Homo Sapiens
GSFYRKKLS

SEQ ID NO: 395571 - protein, 9 aa, Homo Sapiens
GSMVGLSGG

SEQ ID NO: 395572 - protein, 9 aa, Homo Sapiens
PTGGRHTTT

SEQ ID NO: 395573 - protein, 9 aa, Homo Sapiens
GRARGTSIA

SEQ ID NO: 395574 - protein, 9 aa, Homo Sapiens
PLLWDTPAK

SEQ ID NO: 395575 - protein, 9 aa, Homo Sapiens
HQDIIKVKE

SEQ ID NO: 395576 - protein, 9 aa, Homo Sapiens
ILLPSPSGS

SEQ ID NO: 395577 - protein, 9 aa, Homo Sapiens
AVSNIDTLL

SEQ ID NO: 395578 - protein, 9 aa, Homo Sapiens
VHELGVAVD

SEQ ID NO: 395579 - protein, 9 aa, Homo Sapiens
LYVCVWSLS

SEQ ID NO: 395580 - protein, 9 aa, Homo Sapiens
RAHAWSQDM

SEQ ID NO: 395581 - protein, 9 aa, Homo Sapiens
KMFLIQREL

SEQ ID NO: 395582 - protein, 9 aa, Homo Sapiens
PVRNSPCSM

SEQ ID NO: 395583 - protein, 9 aa, Homo Sapiens
LGQALSART

SEQ ID NO: 395584 - protein, 9 aa, Homo Sapiens
SLCILQGLP

SEQ ID NO: 395585 - protein, 9 aa, Homo Sapiens
ETRQKRDVI

SEQ ID NO: 395586 - protein, 9 aa, Homo Sapiens
PPTQPPRGW

SEQ ID NO: 395587 - protein, 9 aa, Homo Sapiens
AKCLESAGV

SEQ ID NO: 395588 - protein, 9 aa, Homo Sapiens
GAIHFRRER

SEQ ID NO: 395589 - protein, 9 aa, Homo Sapiens
VHNGLTALL

SEQ ID NO: 395590 - protein, 9 aa, Homo Sapiens
ATTPPIGPS

SEQ ID NO: 395591 - protein, 9 aa, Homo Sapiens
SVPGESPKE

SEQ ID NO: 395592 - protein, 9 aa, Homo Sapiens
TFKASPRLQ

SEQ ID NO: 395593 - protein, 9 aa, Homo Sapiens
HHTSLTTGT

SEQ ID NO: 395594 - protein, 9 aa, Homo Sapiens
KKQAESKNQ

SEQ ID NO: 395595 - protein, 9 aa, Homo Sapiens
DPGVPKSLV

SEQ ID NO: 395596 - protein, 9 aa, Homo Sapiens
SRSGIKKQH

SEQ ID NO: 395597 - protein, 9 aa, Homo Sapiens
YQIKGLEWR

SEQ ID NO: 395598 - protein, 9 aa, Homo Sapiens
GFPLTMIRV

SEQ ID NO: 395599 - protein, 9 aa, Homo Sapiens
NILPFRVIP

SEQ ID NO: 395600 - protein, 9 aa, Homo Sapiens
GSVISTLGA

SEQ ID NO: 395601 - protein, 9 aa, Homo Sapiens
TTTKALLTR

SEQ ID NO: 395602 - protein, 9 aa, Homo Sapiens
NRPLVWSLA

SEQ ID NO: 395603 - protein, 9 aa, Homo Sapiens
LYNRTKREP

SEQ ID NO: 395604 - protein, 9 aa, Homo Sapiens
IHVLLARST

SEQ ID NO: 395605 - protein, 9 aa, Homo Sapiens
SKKKLKLAP

SEQ ID NO: 395606 - protein, 9 aa, Homo Sapiens
EDKKNGIWE

SEQ ID NO: 395607 - protein, 9 aa, Homo Sapiens
DEQAQQHVI

SEQ ID NO: 395608 - protein, 9 aa, Homo Sapiens
LFYKDMLQE

SEQ ID NO: 395609 - protein, 9 aa, Homo Sapiens
LPSGTIMDH

SEQ ID NO: 395610 - protein, 9 aa, Homo Sapiens
GGGPSPGTA

SEQ ID NO: 395611 - protein, 9 aa, Homo Sapiens
RSTRSTRGS

SEQ ID NO: 395612 - protein, 9 aa, Homo Sapiens
DKERKSPEN

SEQ ID NO: 395613 - protein, 9 aa, Homo Sapiens
EQPAECQSL

SEQ ID NO: 395614 - protein, 9 aa, Homo Sapiens
PPHQPWAHG

SEQ ID NO: 395615 - protein, 9 aa, Homo Sapiens
GLKPFSCDE

SEQ ID NO: 395616 - protein, 9 aa, Homo Sapiens
RIQTRSFLK

SEQ ID NO: 395617 - protein, 9 aa, Homo Sapiens
CQASSGSPH

SEQ ID NO: 395618 - protein, 9 aa, Homo Sapiens
PLGMDVQRG

SEQ ID NO: 395619 - protein, 9 aa, Homo Sapiens
TPGVRGPVG

SEQ ID NO: 395620 - protein, 9 aa, Homo Sapiens
ICSPEPGAS

SEQ ID NO: 395621 - protein, 9 aa, Homo Sapiens
LVLCQFYDE

SEQ ID NO: 395622 - protein, 9 aa, Homo Sapiens
SSYPVHHTI

SEQ ID NO: 395623 - protein, 9 aa, Homo Sapiens
IKGLEWRVS

SEQ ID NO: 395624 - protein, 9 aa, Homo Sapiens
REGKEENRD

SEQ ID NO: 395625 - protein, 9 aa, Homo Sapiens
RASSQTLGT

SEQ ID NO: 395626 - protein, 9 aa, Homo Sapiens
GATCLLRAV

SEQ ID NO: 395627 - protein, 9 aa, Homo Sapiens
DSGNRSTGC

SEQ ID NO: 395628 - protein, 9 aa, Homo Sapiens
LENWSPPWR

SEQ ID NO: 395629 - protein, 9 aa, Homo Sapiens
AATTAAGAS

SEQ ID NO: 395630 - protein, 9 aa, Homo Sapiens
AITWGDTTF

SEQ ID NO: 395631 - protein, 9 aa, Homo Sapiens
RSWAPTTPT

SEQ ID NO: 395632 - protein, 9 aa, Homo Sapiens
RGRTAPAEV

SEQ ID NO: 395633 - protein, 9 aa, Homo Sapiens
IANYNISSK

SEQ ID NO: 395634 - protein, 9 aa, Homo Sapiens
LKNFHLLTK

SEQ ID NO: 395635 - protein, 9 aa, Homo Sapiens
KTAPPEACH

SEQ ID NO: 395636 - protein, 9 aa, Homo Sapiens
PAGHLHLVQ

SEQ ID NO: 395637 - protein, 9 aa, Homo Sapiens
GATTPPIGP

SEQ ID NO: 395638 - protein, 9 aa, Homo Sapiens
SFLCFFYLL

SEQ ID NO: 395639 - protein, 9 aa, Homo Sapiens
LSCRAGWSP

SEQ ID NO: 395640 - protein, 9 aa, Homo Sapiens
MSFLAMMGP

SEQ ID NO: 395641 - protein, 9 aa, Homo Sapiens
SAAASTFGS

SEQ ID NO: 395642 - protein, 9 aa, Homo Sapiens
FTRRSFGAS

SEQ ID NO: 395643 - protein, 9 aa, Homo Sapiens
SKTKDASSS

SEQ ID NO: 395644 - protein, 9 aa, Homo Sapiens
YCVPNYVGR

SEQ ID NO: 395645 - protein, 9 aa, Homo Sapiens
SSNRIMYFL

SEQ ID NO: 395646 - protein, 9 aa, Homo Sapiens
PEETAMRRE

SEQ ID NO: 395647 - protein, 9 aa, Homo Sapiens
WLQLSWGWS

SEQ ID NO: 395648 - protein, 9 aa, Homo Sapiens
YGNEATSAH

SEQ ID NO: 395649 - protein, 9 aa, Homo Sapiens
KRLIEIKVP

SEQ ID NO: 395650 - protein, 9 aa, Homo Sapiens
WALATLCFQ

SEQ ID NO: 395651 - protein, 9 aa, Homo Sapiens
LFEIYTIVG

SEQ ID NO: 395652 - protein, 9 aa, Homo Sapiens
SADGASEEP

SEQ ID NO: 395653 - protein, 9 aa, Homo Sapiens
DFEFCSSYT

SEQ ID NO: 395654 - protein, 9 aa, Homo Sapiens
LESHGFNTE

SEQ ID NO: 395655 - protein, 9 aa, Homo Sapiens
QTVTEKNTS

SEQ ID NO: 395656 - protein, 9 aa, Homo Sapiens
LSSNTLRPG

SEQ ID NO: 395657 - protein, 9 aa, Homo Sapiens
LDVAVQVVR

SEQ ID NO: 395658 - protein, 9 aa, Homo Sapiens
VLQVVTDHD

SEQ ID NO: 395659 - protein, 9 aa, Homo Sapiens
LQGGGVADA

SEQ ID NO: 395660 - protein, 9 aa, Homo Sapiens
KKNGIWEVM

SEQ ID NO: 395661 - protein, 9 aa, Homo Sapiens
EEVIREGWR

SEQ ID NO: 395662 - protein, 9 aa, Homo Sapiens
EESVGFTAL

SEQ ID NO: 395663 - protein, 9 aa, Homo Sapiens
AGDTPDVFT

SEQ ID NO: 395664 - protein, 9 aa, Homo Sapiens
LESTWENPQ

SEQ ID NO: 395665 - protein, 9 aa, Homo Sapiens
GPISPSSPG

SEQ ID NO: 395666 - protein, 9 aa, Homo Sapiens
LENLAIILT

SEQ ID NO: 395667 - protein, 9 aa, Homo Sapiens
AFNNLKNCI

SEQ ID NO: 395668 - protein, 9 aa, Homo Sapiens
WEPIHANPE

SEQ ID NO: 395669 - protein, 9 aa, Homo Sapiens
KTLKKISGR

SEQ ID NO: 395670 - protein, 9 aa, Homo Sapiens
VALQLKLRR

SEQ ID NO: 395671 - protein, 9 aa, Homo Sapiens
IISTSTSRA

SEQ ID NO: 395672 - protein, 9 aa, Homo Sapiens
GTTAEWPGR

SEQ ID NO: 395673 - protein, 9 aa, Homo Sapiens
RPQDKLEVM

SEQ ID NO: 395674 - protein, 9 aa, Homo Sapiens
NRMVSRRTF

SEQ ID NO: 395675 - protein, 9 aa, Homo Sapiens
PGEKKSQAS

SEQ ID NO: 395676 - protein, 9 aa, Homo Sapiens
CSPPASTCW

SEQ ID NO: 395677 - protein, 9 aa, Homo Sapiens
FIGFFSSVS

SEQ ID NO: 395678 - protein, 9 aa, Homo Sapiens
DTGLLQESS

SEQ ID NO: 395679 - protein, 9 aa, Homo Sapiens
ANWNASFSL

SEQ ID NO: 395680 - protein, 9 aa, Homo Sapiens
TKMATLHYP

SEQ ID NO: 395681 - protein, 9 aa, Homo Sapiens
SAHRRMEPL

SEQ ID NO: 395682 - protein, 9 aa, Homo Sapiens
EYVKAVGNP

SEQ ID NO: 395683 - protein, 9 aa, Homo Sapiens
PAPRRKSPL

SEQ ID NO: 395684 - protein, 9 aa, Homo Sapiens
DKNGTTCTF

SEQ ID NO: 395685 - protein, 9 aa, Homo Sapiens
FSAQYLSLS

SEQ ID NO: 395686 - protein, 9 aa, Homo Sapiens
RQVAIVVKF

SEQ ID NO: 395687 - protein, 9 aa, Homo Sapiens
PGFAAAVVR

SEQ ID NO: 395688 - protein, 9 aa, Homo Sapiens
IRDEGHAIR

SEQ ID NO: 395689 - protein, 9 aa, Homo Sapiens
THSTVLKAS

SEQ ID NO: 395690 - protein, 9 aa, Homo Sapiens
LFILRQPPG

SEQ ID NO: 395691 - protein, 9 aa, Homo Sapiens
DPSSSVFGS

SEQ ID NO: 395692 - protein, 9 aa, Homo Sapiens
CLESAGVEV

SEQ ID NO: 395693 - protein, 9 aa, Homo Sapiens
ENRDLCASS

SEQ ID NO: 395694 - protein, 9 aa, Homo Sapiens
AAPWLLEVG

SEQ ID NO: 395695 - protein, 9 aa, Homo Sapiens
SNCGLEETI

SEQ ID NO: 395696 - protein, 9 aa, Homo Sapiens
ALPRCPPRW

SEQ ID NO: 395697 - protein, 9 aa, Homo Sapiens
NMCVFKLGL

SEQ ID NO: 395698 - protein, 9 aa, Homo Sapiens
TVTEKNTST

SEQ ID NO: 395699 - protein, 9 aa, Homo Sapiens
GQRGHMHNS

SEQ ID NO: 395700 - protein, 9 aa, Homo Sapiens
ATLLYVVHV

SEQ ID NO: 395701 - protein, 9 aa, Homo Sapiens
RATGLVGCE

SEQ ID NO: 395702 - protein, 9 aa, Homo Sapiens
YTHPASYSE

SEQ ID NO: 395703 - protein, 9 aa, Homo Sapiens
EDRKARADK

SEQ ID NO: 395704 - protein, 9 aa, Homo Sapiens
MGSDPSLSP

SEQ ID NO: 395705 - protein, 9 aa, Homo Sapiens
KIHVLLARS

SEQ ID NO: 395706 - protein, 9 aa, Homo Sapiens
RTRVRGDGM

SEQ ID NO: 395707 - protein, 9 aa, Homo Sapiens
LHHRPKPMG

SEQ ID NO: 395708 - protein, 9 aa, Homo Sapiens
FYDCLLAEV

SEQ ID NO: 395709 - protein, 9 aa, Homo Sapiens
QLGQALSAR

SEQ ID NO: 395710 - protein, 9 aa, Homo Sapiens
GGSPPSSPR

SEQ ID NO: 395711 - protein, 9 aa, Homo Sapiens
GLQARNNAH

SEQ ID NO: 395712 - protein, 9 aa, Homo Sapiens
QKVEEANER

SEQ ID NO: 395713 - protein, 9 aa, Homo Sapiens
YAKCLESAG

SEQ ID NO: 395714 - protein, 9 aa, Homo Sapiens
APPSAPGSA

SEQ ID NO: 395715 - protein, 9 aa, Homo Sapiens
SQTTDAIFA

SEQ ID NO: 395716 - protein, 9 aa, Homo Sapiens
ICSANPTRP

SEQ ID NO: 395717 - protein, 9 aa, Homo Sapiens
FTRGARKTR

SEQ ID NO: 395718 - protein, 9 aa, Homo Sapiens
PWKTSCTTF

SEQ ID NO: 395719 - protein, 9 aa, Homo Sapiens
FTFGNKPDT

SEQ ID NO: 395720 - protein, 9 aa, Homo Sapiens
QCTAGGNVN

SEQ ID NO: 395721 - protein, 9 aa, Homo Sapiens
PWTPSLSRM

SEQ ID NO: 395722 - protein, 9 aa, Homo Sapiens
YTFGDGRHR

SEQ ID NO: 395723 - protein, 9 aa, Homo Sapiens
FLQELNEKC

SEQ ID NO: 395724 - protein, 9 aa, Homo Sapiens
LRGTPGVRG

SEQ ID NO: 395725 - protein, 9 aa, Homo Sapiens
KAKIKKKTG

SEQ ID NO: 395726 - protein, 9 aa, Homo Sapiens
GVGLAASFA

SEQ ID NO: 395727 - protein, 9 aa, Homo Sapiens
HNGRIPGVQ

SEQ ID NO: 395728 - protein, 9 aa, Homo Sapiens
VSPVRNSPC

SEQ ID NO: 395729 - protein, 9 aa, Homo Sapiens
YQQSKDAAL

SEQ ID NO: 395730 - protein, 9 aa, Homo Sapiens
SVALFACLT

SEQ ID NO: 395731 - protein, 9 aa, Homo Sapiens
LHLSHGAAG

SEQ ID NO: 395732 - protein, 9 aa, Homo Sapiens
GDRTRLGGE

SEQ ID NO: 395733 - protein, 9 aa, Homo Sapiens
SGTSGKGFV

SEQ ID NO: 395734 - protein, 9 aa, Homo Sapiens
IEHDWCSTV

SEQ ID NO: 395735 - protein, 9 aa, Homo Sapiens
AAVGEGEVA

SEQ ID NO: 395736 - protein, 9 aa, Homo Sapiens
FMEENFSLK

SEQ ID NO: 395737 - protein, 9 aa, Homo Sapiens
SQDLGCAHI

SEQ ID NO: 395738 - protein, 9 aa, Homo Sapiens
AEGWMDWAT

SEQ ID NO: 395739 - protein, 9 aa, Homo Sapiens
FFDTWAKVA

SEQ ID NO: 395740 - protein, 9 aa, Homo Sapiens
RTTFTSGTL

SEQ ID NO: 395741 - protein, 9 aa, Homo Sapiens
IIEKVLKIH

SEQ ID NO: 395742 - protein, 9 aa, Homo Sapiens
WGLTPSWSR

SEQ ID NO: 395743 - protein, 9 aa, Homo Sapiens
SFSAPCCWR

SEQ ID NO: 395744 - protein, 9 aa, Homo Sapiens
VNDNRSVFE

SEQ ID NO: 395745 - protein, 9 aa, Homo Sapiens
SSGVIPNLT

SEQ ID NO: 395746 - protein, 9 aa, Homo Sapiens
ASVAAVAAA

SEQ ID NO: 395747 - protein, 9 aa, Homo Sapiens
HLPRPTTGG

SEQ ID NO: 395748 - protein, 9 aa, Homo Sapiens
VLSNHVNEK

SEQ ID NO: 395749 - protein, 9 aa, Homo Sapiens
ESRHLWKFF

SEQ ID NO: 395750 - protein, 9 aa, Homo Sapiens
AQPRPWRIQ

SEQ ID NO: 395751 - protein, 9 aa, Homo Sapiens
VQEMERFDN

SEQ ID NO: 395752 - protein, 9 aa, Homo Sapiens
DGEVDYKKI

SEQ ID NO: 395753 - protein, 9 aa, Homo Sapiens
CGRAFFISH

SEQ ID NO: 395754 - protein, 9 aa, Homo Sapiens
CEIWTNQNT

SEQ ID NO: 395755 - protein, 9 aa, Homo Sapiens
CHLLTLIII

SEQ ID NO: 395756 - protein, 9 aa, Homo Sapiens
LLMQHLILW

SEQ ID NO: 395757 - protein, 9 aa, Homo Sapiens
PGTPKLMGS

SEQ ID NO: 395758 - protein, 9 aa, Homo Sapiens
LKKTSRILN

SEQ ID NO: 395759 - protein, 9 aa, Homo Sapiens
TMILIPRFP

SEQ ID NO: 395760 - protein, 9 aa, Homo Sapiens
QYSAFFKPQ

SEQ ID NO: 395761 - protein, 9 aa, Homo Sapiens
KNSASPHPE

SEQ ID NO: 395762 - protein, 9 aa, Homo Sapiens
MKTHSRNIT

SEQ ID NO: 395763 - protein, 9 aa, Homo Sapiens
LLVFSFFFC

SEQ ID NO: 395764 - protein, 9 aa, Homo Sapiens
KYISCHLLT

SEQ ID NO: 395765 - protein, 9 aa, Homo Sapiens
ILLVRPSCS

SEQ ID NO: 395766 - protein, 9 aa, Homo Sapiens
TQILTHSTV

SEQ ID NO: 395767 - protein, 9 aa, Homo Sapiens
PDKERKSPE

SEQ ID NO: 395768 - protein, 9 aa, Homo Sapiens
RQPPHHLVP

SEQ ID NO: 395769 - protein, 9 aa, Homo Sapiens
DARLERDQP

SEQ ID NO: 395770 - protein, 9 aa, Homo Sapiens
SRLVRRCSE

SEQ ID NO: 395771 - protein, 9 aa, Homo Sapiens
GLTPSWSRC

SEQ ID NO: 395772 - protein, 9 aa, Homo Sapiens
VNMSKVETG

SEQ ID NO: 395773 - protein, 9 aa, Homo Sapiens
YLKNFTVGH

SEQ ID NO: 395774 - protein, 9 aa, Homo Sapiens
LLEKNQSSL

SEQ ID NO: 395775 - protein, 9 aa, Homo Sapiens
AHAEHQAIN

SEQ ID NO: 395776 - protein, 9 aa, Homo Sapiens
QSMVEQPTG

SEQ ID NO: 395777 - protein, 9 aa, Homo Sapiens
IYTIVGTIL

SEQ ID NO: 395778 - protein, 9 aa, Homo Sapiens
PQICPMILR

SEQ ID NO: 395779 - protein, 9 aa, Homo Sapiens
PPHRTSSHL

SEQ ID NO: 395780 - protein, 9 aa, Homo Sapiens
QKSYKRGGL

SEQ ID NO: 395781 - protein, 9 aa, Homo Sapiens
LQAWKCVCK

SEQ ID NO: 395782 - protein, 9 aa, Homo Sapiens
TLLNVLEGC

SEQ ID NO: 395783 - protein, 9 aa, Homo Sapiens
KSIAAALKR

SEQ ID NO: 395784 - protein, 9 aa, Homo Sapiens
IAKKCIYLQ

SEQ ID NO: 395785 - protein, 9 aa, Homo Sapiens
GSQCTSLTT

SEQ ID NO: 395786 - protein, 9 aa, Homo Sapiens
GCVDGRRGS

SEQ ID NO: 395787 - protein, 9 aa, Homo Sapiens
LMMVIYRGT

SEQ ID NO: 395788 - protein, 9 aa, Homo Sapiens
VKAVGNPRK

SEQ ID NO: 395789 - protein, 9 aa, Homo Sapiens
RTAGDTPDV

SEQ ID NO: 395790 - protein, 9 aa, Homo Sapiens
YLGGFACPW

SEQ ID NO: 395791 - protein, 9 aa, Homo Sapiens
EKALSALFI

SEQ ID NO: 395792 - protein, 9 aa, Homo Sapiens
PAGEAEFYD

SEQ ID NO: 395793 - protein, 9 aa, Homo Sapiens
GASTRASGP

SEQ ID NO: 395794 - protein, 9 aa, Homo Sapiens
LTYNISNTN

SEQ ID NO: 395795 - protein, 9 aa, Homo Sapiens
SGQAEEEKG

SEQ ID NO: 395796 - protein, 9 aa, Homo Sapiens
KKMFLIQRE

SEQ ID NO: 395797 - protein, 9 aa, Homo Sapiens
QQESSFSHS

SEQ ID NO: 395798 - protein, 9 aa, Homo Sapiens
KTATLSQKN

SEQ ID NO: 395799 - protein, 9 aa, Homo Sapiens
PIPSTRSAN

SEQ ID NO: 395800 - protein, 9 aa, Homo Sapiens
PTKFEKLAE

SEQ ID NO: 395801 - protein, 9 aa, Homo Sapiens
SGGAPSSIC

SEQ ID NO: 395802 - protein, 9 aa, Homo Sapiens
DTIAVHVVR

SEQ ID NO: 395803 - protein, 9 aa, Homo Sapiens
SRILNLQVL

SEQ ID NO: 395804 - protein, 9 aa, Homo Sapiens
TVKLFKFSR

SEQ ID NO: 395805 - protein, 9 aa, Homo Sapiens
QCTSLTTAS

SEQ ID NO: 395806 - protein, 9 aa, Homo Sapiens
VEHYVDYVE

SEQ ID NO: 395807 - protein, 9 aa, Homo Sapiens
RGKSQGGRI

SEQ ID NO: 395808 - protein, 9 aa, Homo Sapiens
PEVTIHWIL

SEQ ID NO: 395809 - protein, 9 aa, Homo Sapiens
TLARGSGQA

SEQ ID NO: 395810 - protein, 9 aa, Homo Sapiens
TEMRKRMSS

SEQ ID NO: 395811 - protein, 9 aa, Homo Sapiens
NNINGRLTP

SEQ ID NO: 395812 - protein, 9 aa, Homo Sapiens
LLPTLPPTR

SEQ ID NO: 395813 - protein, 9 aa, Homo Sapiens
SPVDSNMLV

SEQ ID NO: 395814 - protein, 9 aa, Homo Sapiens
ICVQEDCHI

SEQ ID NO: 395815 - protein, 9 aa, Homo Sapiens
CDNMCVFKL

SEQ ID NO: 395816 - protein, 9 aa, Homo Sapiens
RAAGTTFTL

SEQ ID NO: 395817 - protein, 9 aa, Homo Sapiens
ISARGLIFG

SEQ ID NO: 395818 - protein, 9 aa, Homo Sapiens
SELMDADVL

SEQ ID NO: 395819 - protein, 9 aa, Homo Sapiens
QPGPAAVTA

SEQ ID NO: 395820 - protein, 9 aa, Homo Sapiens
GLLRNRCFP

SEQ ID NO: 395821 - protein, 9 aa, Homo Sapiens
SPEPGASCQ

SEQ ID NO: 395822 - protein, 9 aa, Homo Sapiens
RLLSRVQTQ

SEQ ID NO: 395823 - protein, 9 aa, Homo Sapiens
PEYNVKGSF

SEQ ID NO: 395824 - protein, 9 aa, Homo Sapiens
IFWNIKIRL

SEQ ID NO: 395825 - protein, 9 aa, Homo Sapiens
REVGFNPRL

SEQ ID NO: 395826 - protein, 9 aa, Homo Sapiens
PVGNCEEKI

SEQ ID NO: 395827 - protein, 9 aa, Homo Sapiens
KSSSAVAPS

SEQ ID NO: 395828 - protein, 9 aa, Homo Sapiens
DILIPADFE

SEQ ID NO: 395829 - protein, 9 aa, Homo Sapiens
DKGLKKMTL

SEQ ID NO: 395830 - protein, 9 aa, Homo Sapiens
TRSTIGTFS

SEQ ID NO: 395831 - protein, 9 aa, Homo Sapiens
TTLARETSL

SEQ ID NO: 395832 - protein, 9 aa, Homo Sapiens
SLRLNCPAA

SEQ ID NO: 395833 - protein, 9 aa, Homo Sapiens
SHACVQKVT

SEQ ID NO: 395834 - protein, 9 aa, Homo Sapiens
FQVPKDCYP

SEQ ID NO: 395835 - protein, 9 aa, Homo Sapiens
KFLDTGLAH

SEQ ID NO: 395836 - protein, 9 aa, Homo Sapiens
CSSWLRRIE

SEQ ID NO: 395837 - protein, 9 aa, Homo Sapiens
TLRPGSTRS

SEQ ID NO: 395838 - protein, 9 aa, Homo Sapiens
LLTNLSSSL

SEQ ID NO: 395839 - protein, 9 aa, Homo Sapiens
RGLPLPPPV

SEQ ID NO: 395840 - protein, 9 aa, Homo Sapiens
EHVPLGNLS

SEQ ID NO: 395841 - protein, 9 aa, Homo Sapiens
SRPARQVRC

SEQ ID NO: 395842 - protein, 9 aa, Homo Sapiens
KILRSFMKL

SEQ ID NO: 395843 - protein, 9 aa, Homo Sapiens
SALVATSCS

SEQ ID NO: 395844 - protein, 9 aa, Homo Sapiens
LDSRADACF

SEQ ID NO: 395845 - protein, 9 aa, Homo Sapiens
THCSTTCRT

SEQ ID NO: 395846 - protein, 9 aa, Homo Sapiens
IIKLLCVTP

SEQ ID NO: 395847 - protein, 9 aa, Homo Sapiens
APHPLSKFP

SEQ ID NO: 395848 - protein, 9 aa, Homo Sapiens
PPALTVAEV

SEQ ID NO: 395849 - protein, 9 aa, Homo Sapiens
LDEILQTGL

SEQ ID NO: 395850 - protein, 9 aa, Homo Sapiens
AFQAMLRWL

SEQ ID NO: 395851 - protein, 9 aa, Homo Sapiens
VRKNSTYSH

SEQ ID NO: 395852 - protein, 9 aa, Homo Sapiens
RRKSPLPLK

SEQ ID NO: 395853 - protein, 9 aa, Homo Sapiens
LLGGLPKDL

SEQ ID NO: 395854 - protein, 9 aa, Homo Sapiens
SGSTPGSGP

SEQ ID NO: 395855 - protein, 9 aa, Homo Sapiens
QKPKRSLLG

SEQ ID NO: 395856 - protein, 9 aa, Homo Sapiens
STRLSISTR

SEQ ID NO: 395857 - protein, 9 aa, Homo Sapiens
VESSWITPE

SEQ ID NO: 395858 - protein, 9 aa, Homo Sapiens
DTTFQRAPL

SEQ ID NO: 395859 - protein, 9 aa, Homo Sapiens
PTMITFIGF

SEQ ID NO: 395860 - protein, 9 aa, Homo Sapiens
GDIGVSQSQ

SEQ ID NO: 395861 - protein, 9 aa, Homo Sapiens
AWADHIITM

SEQ ID NO: 395862 - protein, 9 aa, Homo Sapiens
THMWFDMTV

SEQ ID NO: 395863 - protein, 9 aa, Homo Sapiens
RVRGDGMLD

SEQ ID NO: 395864 - protein, 9 aa, Homo Sapiens
FLQFQNDPC

SEQ ID NO: 395865 - protein, 9 aa, Homo Sapiens
ANECTNFTT

SEQ ID NO: 395866 - protein, 9 aa, Homo Sapiens
VLKKILRSF

SEQ ID NO: 395867 - protein, 9 aa, Homo Sapiens
VAWADHIIT

SEQ ID NO: 395868 - protein, 9 aa, Homo Sapiens
NVPSRAGQK

SEQ ID NO: 395869 - protein, 9 aa, Homo Sapiens
RRTNGASQT

SEQ ID NO: 395870 - protein, 9 aa, Homo Sapiens
GYRKGAPAG

SEQ ID NO: 395871 - protein, 9 aa, Homo Sapiens
TCSRGTLFA

SEQ ID NO: 395872 - protein, 9 aa, Homo Sapiens
ESADDELAN

SEQ ID NO: 395873 - protein, 9 aa, Homo Sapiens
PAAVLYQWS

SEQ ID NO: 395874 - protein, 9 aa, Homo Sapiens
TVSGGTTSS

SEQ ID NO: 395875 - protein, 9 aa, Homo Sapiens
LPVGLAGDI

SEQ ID NO: 395876 - protein, 9 aa, Homo Sapiens
AQGPGPTPQ

SEQ ID NO: 395877 - protein, 9 aa, Homo Sapiens
QFSHRDIPQ

SEQ ID NO: 395878 - protein, 9 aa, Homo Sapiens
ERVSAQNVF

SEQ ID NO: 395879 - protein, 9 aa, Homo Sapiens
NNEQTRLLS

SEQ ID NO: 395880 - protein, 9 aa, Homo Sapiens
TVVFYHDGE

SEQ ID NO: 395881 - protein, 9 aa, Homo Sapiens
CVTPEKICA

SEQ ID NO: 395882 - protein, 9 aa, Homo Sapiens
LVILGVCAT

SEQ ID NO: 395883 - protein, 9 aa, Homo Sapiens
MDARYQTQP

SEQ ID NO: 395884 - protein, 9 aa, Homo Sapiens
QTVVTFSFD

SEQ ID NO: 395885 - protein, 9 aa, Homo Sapiens
ILTGGTRGA

SEQ ID NO: 395886 - protein, 9 aa, Homo Sapiens
SDVNPPVSH

SEQ ID NO: 395887 - protein, 9 aa, Homo Sapiens
TDAIFARRA

SEQ ID NO: 395888 - protein, 9 aa, Homo Sapiens
IVITDQHRN

SEQ ID NO: 395889 - protein, 9 aa, Homo Sapiens
RKPPNGLIL

SEQ ID NO: 395890 - protein, 9 aa, Homo Sapiens
VNEKVEMLL

SEQ ID NO: 395891 - protein, 9 aa, Homo Sapiens
AAYWGPRAS

SEQ ID NO: 395892 - protein, 9 aa, Homo Sapiens
AGVNCEEPS

SEQ ID NO: 395893 - protein, 9 aa, Homo Sapiens
KKTAPPEAC

SEQ ID NO: 395894 - protein, 9 aa, Homo Sapiens
TSRVGTCMY

SEQ ID NO: 395895 - protein, 9 aa, Homo Sapiens
SSSCNYIQC

SEQ ID NO: 395896 - protein, 9 aa, Homo Sapiens
CFSQVLSAL

SEQ ID NO: 395897 - protein, 9 aa, Homo Sapiens
KPHKCKECD

SEQ ID NO: 395898 - protein, 9 aa, Homo Sapiens
RSESPNQHQ

SEQ ID NO: 395899 - protein, 9 aa, Homo Sapiens
DKETTQAPR

SEQ ID NO: 395900 - protein, 9 aa, Homo Sapiens
PWRAAPASS

SEQ ID NO: 395901 - protein, 9 aa, Homo Sapiens
NISNTNSCN

SEQ ID NO: 395902 - protein, 9 aa, Homo Sapiens
VPCPNLLPA

SEQ ID NO: 395903 - protein, 9 aa, Homo Sapiens
LKARGALAT

SEQ ID NO: 395904 - protein, 9 aa, Homo Sapiens
QNSETKSIF

SEQ ID NO: 395905 - protein, 9 aa, Homo Sapiens
FAFSTRLAV

SEQ ID NO: 395906 - protein, 9 aa, Homo Sapiens
LSHGAAGSS

SEQ ID NO: 395907 - protein, 9 aa, Homo Sapiens
MAASECHAS

SEQ ID NO: 395908 - protein, 9 aa, Homo Sapiens
QGLVAGVGL

SEQ ID NO: 395909 - protein, 9 aa, Homo Sapiens
HGEVERHIV

SEQ ID NO: 395910 - protein, 9 aa, Homo Sapiens
VKPLSATPV

SEQ ID NO: 395911 - protein, 9 aa, Homo Sapiens
CTRSWAPTT

SEQ ID NO: 395912 - protein, 9 aa, Homo Sapiens
RLELDAMKH

SEQ ID NO: 395913 - protein, 9 aa, Homo Sapiens
ILDDQIQWP

SEQ ID NO: 395914 - protein, 9 aa, Homo Sapiens
HMMAVTIFM

SEQ ID NO: 395915 - protein, 9 aa, Homo Sapiens
HPGLRPCGS

SEQ ID NO: 395916 - protein, 9 aa, Homo Sapiens
PPPVWAVLA

SEQ ID NO: 395917 - protein, 9 aa, Homo Sapiens
VVTAVDPMA

SEQ ID NO: 395918 - protein, 9 aa, Homo Sapiens
IHRAHHEGS

SEQ ID NO: 395919 - protein, 9 aa, Homo Sapiens
AHHEGSACV

SEQ ID NO: 395920 - protein, 9 aa, Homo Sapiens
LRNRCFPEE

SEQ ID NO: 395921 - protein, 9 aa, Homo Sapiens
YACPECDKA

SEQ ID NO: 395922 - protein, 9 aa, Homo Sapiens
LSSHRCALG

SEQ ID NO: 395923 - protein, 9 aa, Homo Sapiens
HLVPLFIWT

SEQ ID NO: 395924 - protein, 9 aa, Homo Sapiens
KLLCVTPEK

SEQ ID NO: 395925 - protein, 9 aa, Homo Sapiens
SLTTASTLR

SEQ ID NO: 395926 - protein, 9 aa, Homo Sapiens
AFATRCCLC

SEQ ID NO: 395927 - protein, 9 aa, Homo Sapiens
PAAVLVFGG

SEQ ID NO: 395928 - protein, 9 aa, Homo Sapiens
WLLTNLSSS

SEQ ID NO: 395929 - protein, 9 aa, Homo Sapiens
FRDLDVCDR

SEQ ID NO: 395930 - protein, 9 aa, Homo Sapiens
IQSQSSTSI

SEQ ID NO: 395931 - protein, 9 aa, Homo Sapiens
ILLTYNISN

SEQ ID NO: 395932 - protein, 9 aa, Homo Sapiens
CQPHKIHYA

SEQ ID NO: 395933 - protein, 9 aa, Homo Sapiens
SRDVQTLAL

SEQ ID NO: 395934 - protein, 9 aa, Homo Sapiens
PLRTPWVGY

SEQ ID NO: 395935 - protein, 9 aa, Homo Sapiens
KDQLGPSFH

SEQ ID NO: 395936 - protein, 9 aa, Homo Sapiens
LVSRVLAQP

SEQ ID NO: 395937 - protein, 9 aa, Homo Sapiens
RQQERKAMT

SEQ ID NO: 395938 - protein, 9 aa, Homo Sapiens
TTFQRAPLK

SEQ ID NO: 395939 - protein, 9 aa, Homo Sapiens
GDTTFQRAP

SEQ ID NO: 395940 - protein, 9 aa, Homo Sapiens
TYNISNTNS

SEQ ID NO: 395941 - protein, 9 aa, Homo Sapiens
YNVKGSFYR

SEQ ID NO: 395942 - protein, 9 aa, Homo Sapiens
CVLSAPPHF

SEQ ID NO: 395943 - protein, 9 aa, Homo Sapiens
DILLPSPSG

SEQ ID NO: 395944 - protein, 9 aa, Homo Sapiens
RTELVTYPG

SEQ ID NO: 395945 - protein, 9 aa, Homo Sapiens
SLSFGESDC

SEQ ID NO: 395946 - protein, 9 aa, Homo Sapiens
INCPNDCCE

SEQ ID NO: 395947 - protein, 9 aa, Homo Sapiens
SQIQALRQM

SEQ ID NO: 395948 - protein, 9 aa, Homo Sapiens
GGAPSSICR

SEQ ID NO: 395949 - protein, 9 aa, Homo Sapiens
TQQDPGVPK

SEQ ID NO: 395950 - protein, 9 aa, Homo Sapiens
FPLLWDTPA

SEQ ID NO: 395951 - protein, 9 aa, Homo Sapiens
YMAPEHIDP

SEQ ID NO: 395952 - protein, 9 aa, Homo Sapiens
SVEVRSVRR

SEQ ID NO: 395953 - protein, 9 aa, Homo Sapiens
QKKQAESKN

SEQ ID NO: 395954 - protein, 9 aa, Homo Sapiens
WCGTSQTYF

SEQ ID NO: 395955 - protein, 9 aa, Homo Sapiens
RASQDGPPG

SEQ ID NO: 395956 - protein, 9 aa, Homo Sapiens
ASSHVAALA

SEQ ID NO: 395957 - protein, 9 aa, Homo Sapiens
CIEQATVDT

SEQ ID NO: 395958 - protein, 9 aa, Homo Sapiens
RPPVQIEEP

SEQ ID NO: 395959 - protein, 9 aa, Homo Sapiens
QQFLSSSPG

SEQ ID NO: 395960 - protein, 9 aa, Homo Sapiens
SETPAGLSH

SEQ ID NO: 395961 - protein, 9 aa, Homo Sapiens
LSSSPGLVL

SEQ ID NO: 395962 - protein, 9 aa, Homo Sapiens
GGTTSSSGT

SEQ ID NO: 395963 - protein, 9 aa, Homo Sapiens
ISTSSNPAS

SEQ ID NO: 395964 - protein, 9 aa, Homo Sapiens
EQKMQSRMD

SEQ ID NO: 395965 - protein, 9 aa, Homo Sapiens
PSPARSAAA

SEQ ID NO: 395966 - protein, 9 aa, Homo Sapiens
QVRCLEFNQ

SEQ ID NO: 395967 - protein, 9 aa, Homo Sapiens
ELISIYCRY

SEQ ID NO: 395968 - protein, 9 aa, Homo Sapiens
VLREKVPCL

SEQ ID NO: 395969 - protein, 9 aa, Homo Sapiens
TEVPWPEVW

SEQ ID NO: 395970 - protein, 9 aa, Homo Sapiens
YYYFITLTT

SEQ ID NO: 395971 - protein, 9 aa, Homo Sapiens
GNITAPCNE

SEQ ID NO: 395972 - protein, 9 aa, Homo Sapiens
ESLPENRPL

SEQ ID NO: 395973 - protein, 9 aa, Homo Sapiens
HTHEAKRAV

SEQ ID NO: 395974 - protein, 9 aa, Homo Sapiens
RGASFILSY

SEQ ID NO: 395975 - protein, 9 aa, Homo Sapiens
TCKNNCRKN

SEQ ID NO: 395976 - protein, 9 aa, Homo Sapiens
LAAVISLCM

SEQ ID NO: 395977 - protein, 9 aa, Homo Sapiens
GRHSQGDVE

SEQ ID NO: 395978 - protein, 9 aa, Homo Sapiens
CAELDPHED

SEQ ID NO: 395979 - protein, 9 aa, Homo Sapiens
CLTLVTTGA

SEQ ID NO: 395980 - protein, 9 aa, Homo Sapiens
TPLKKMSMP

SEQ ID NO: 395981 - protein, 9 aa, Homo Sapiens
KDLPLHFDT

SEQ ID NO: 395982 - protein, 9 aa, Homo Sapiens
LPTAVTPRR

SEQ ID NO: 395983 - protein, 9 aa, Homo Sapiens
WKTAEDRCM

SEQ ID NO: 395984 - protein, 9 aa, Homo Sapiens
DDIPKCEGK

SEQ ID NO: 395985 - protein, 9 aa, Homo Sapiens
DSWVHIVPV

SEQ ID NO: 395986 - protein, 9 aa, Homo Sapiens
TAATTAAGA

SEQ ID NO: 395987 - protein, 9 aa, Homo Sapiens
LDPHEDIEH

SEQ ID NO: 395988 - protein, 9 aa, Homo Sapiens
PHARVDAHV

SEQ ID NO: 395989 - protein, 9 aa, Homo Sapiens
KKEVDPAIK

SEQ ID NO: 395990 - protein, 9 aa, Homo Sapiens
LSQFLAKHH

SEQ ID NO: 395991 - protein, 9 aa, Homo Sapiens
RMLEEVISN

SEQ ID NO: 395992 - protein, 9 aa, Homo Sapiens
GIKSTGKVV

SEQ ID NO: 395993 - protein, 9 aa, Homo Sapiens
RVLLCCPSW

SEQ ID NO: 395994 - protein, 9 aa, Homo Sapiens
TGATCLLRA

SEQ ID NO: 395995 - protein, 9 aa, Homo Sapiens
SPPTQQPQT

SEQ ID NO: 395996 - protein, 9 aa, Homo Sapiens
DRVLLCCPS

SEQ ID NO: 395997 - protein, 9 aa, Homo Sapiens
SGWSASCGP

SEQ ID NO: 395998 - protein, 9 aa, Homo Sapiens
LLPSPSGSW

SEQ ID NO: 395999 - protein, 9 aa, Homo Sapiens
RSQTVVTFS

SEQ ID NO: 396000 - protein, 9 aa, Homo Sapiens
TASQGLPVP

SEQ ID NO: 396001 - protein, 9 aa, Homo Sapiens
VHLWQRVML

SEQ ID NO: 396002 - protein, 9 aa, Homo Sapiens
LGTSFTLST

SEQ ID NO: 396003 - protein, 9 aa, Homo Sapiens
KKPLQMVLL

SEQ ID NO: 396004 - protein, 9 aa, Homo Sapiens
KDENAALIH

SEQ ID NO: 396005 - protein, 9 aa, Homo Sapiens
ALGSWGQTD

SEQ ID NO: 396006 - protein, 9 aa, Homo Sapiens
TSSLGIRAQ

SEQ ID NO: 396007 - protein, 9 aa, Homo Sapiens
SIPWNLERT

SEQ ID NO: 396008 - protein, 9 aa, Homo Sapiens
KMRQLGQAL

SEQ ID NO: 396009 - protein, 9 aa, Homo Sapiens
SLYGKKLVK

SEQ ID NO: 396010 - protein, 9 aa, Homo Sapiens
PGAGMDAKV

SEQ ID NO: 396011 - protein, 9 aa, Homo Sapiens
QGFSSFYEQ

SEQ ID NO: 396012 - protein, 9 aa, Homo Sapiens
RLSSMFLRV

SEQ ID NO: 396013 - protein, 9 aa, Homo Sapiens
HTVVFYHDG

SEQ ID NO: 396014 - protein, 9 aa, Homo Sapiens
KRINFGKLS

SEQ ID NO: 396015 - protein, 9 aa, Homo Sapiens
NPSLSLVDK

SEQ ID NO: 396016 - protein, 9 aa, Homo Sapiens
PASPPTQQP

SEQ ID NO: 396017 - protein, 9 aa, Homo Sapiens
GNPRKCSTS

SEQ ID NO: 396018 - protein, 9 aa, Homo Sapiens
NPMFLFLFY

SEQ ID NO: 396019 - protein, 9 aa, Homo Sapiens
CIYPLSMCI

SEQ ID NO: 396020 - protein, 9 aa, Homo Sapiens
LSKFPGGRG

SEQ ID NO: 396021 - protein, 9 aa, Homo Sapiens
CNHMHFHYD

SEQ ID NO: 396022 - protein, 9 aa, Homo Sapiens
EVMPRTLEG

SEQ ID NO: 396023 - protein, 9 aa, Homo Sapiens
RGTMSVSAQ

SEQ ID NO: 396024 - protein, 9 aa, Homo Sapiens
YVCVWSLSF

SEQ ID NO: 396025 - protein, 9 aa, Homo Sapiens
MDGLFDILI

SEQ ID NO: 396026 - protein, 9 aa, Homo Sapiens
KDNILPFRV

SEQ ID NO: 396027 - protein, 9 aa, Homo Sapiens
TFTTCSRGT

SEQ ID NO: 396028 - protein, 9 aa, Homo Sapiens
RSYGMVMKC

SEQ ID NO: 396029 - protein, 9 aa, Homo Sapiens
DHTDDFMGC

SEQ ID NO: 396030 - protein, 9 aa, Homo Sapiens
LVQQTIQWL

SEQ ID NO: 396031 - protein, 9 aa, Homo Sapiens
HFGATVATM

SEQ ID NO: 396032 - protein, 9 aa, Homo Sapiens
YVVHVVFSL

SEQ ID NO: 396033 - protein, 9 aa, Homo Sapiens
VSIQQTPEV

SEQ ID NO: 396034 - protein, 9 aa, Homo Sapiens
VSTSSAGAG

SEQ ID NO: 396035 - protein, 9 aa, Homo Sapiens
HLKVDKETN

SEQ ID NO: 396036 - protein, 9 aa, Homo Sapiens
AKQAEKEVK

SEQ ID NO: 396037 - protein, 9 aa, Homo Sapiens
AVAAAAVAV

SEQ ID NO: 396038 - protein, 9 aa, Homo Sapiens
PTSGLGAPP

SEQ ID NO: 396039 - protein, 9 aa, Homo Sapiens
MGPWHLCMG

SEQ ID NO: 396040 - protein, 9 aa, Homo Sapiens
FVMYCHTHE

SEQ ID NO: 396041 - protein, 9 aa, Homo Sapiens
KSQGGRILL

SEQ ID NO: 396042 - protein, 9 aa, Homo Sapiens
AFSGGGGPA

SEQ ID NO: 396043 - protein, 9 aa, Homo Sapiens
LPILDDQIQ

SEQ ID NO: 396044 - protein, 9 aa, Homo Sapiens
PKCEGKQFD

SEQ ID NO: 396045 - protein, 9 aa, Homo Sapiens
EEDDEEEEM

SEQ ID NO: 396046 - protein, 9 aa, Homo Sapiens
IEDLEVAND

SEQ ID NO: 396047 - protein, 9 aa, Homo Sapiens
KLVKRMLAQ

SEQ ID NO: 396048 - protein, 9 aa, Homo Sapiens
QGGGVADAR

SEQ ID NO: 396049 - protein, 9 aa, Homo Sapiens
EKDLDFLTN

SEQ ID NO: 396050 - protein, 9 aa, Homo Sapiens
ECRTRHPNM

SEQ ID NO: 396051 - protein, 9 aa, Homo Sapiens
PCLCLEEPR

SEQ ID NO: 396052 - protein, 9 aa, Homo Sapiens
DGALLRGLG

SEQ ID NO: 396053 - protein, 9 aa, Homo Sapiens
EPVDYEFNP

SEQ ID NO: 396054 - protein, 9 aa, Homo Sapiens
AVSTRGASK

SEQ ID NO: 396055 - protein, 9 aa, Homo Sapiens
CATGKNPMH

SEQ ID NO: 396056 - protein, 9 aa, Homo Sapiens
KRGKSQGGR

SEQ ID NO: 396057 - protein, 9 aa, Homo Sapiens
CLTPSVPPI

SEQ ID NO: 396058 - protein, 9 aa, Homo Sapiens
LPPTRSSPR

SEQ ID NO: 396059 - protein, 9 aa, Homo Sapiens
SAVSIQQTP

SEQ ID NO: 396060 - protein, 9 aa, Homo Sapiens
RRLPAALAT

SEQ ID NO: 396061 - protein, 9 aa, Homo Sapiens
DYLVDPVTI

SEQ ID NO: 396062 - protein, 9 aa, Homo Sapiens
TWPTPPEMP

SEQ ID NO: 396063 - protein, 9 aa, Homo Sapiens
LDSWVHIVP

SEQ ID NO: 396064 - protein, 9 aa, Homo Sapiens
RLECRTRHP

SEQ ID NO: 396065 - protein, 9 aa, Homo Sapiens
PPAGGSPPS

SEQ ID NO: 396066 - protein, 9 aa, Homo Sapiens
MEFNILKTA

SEQ ID NO: 396067 - protein, 9 aa, Homo Sapiens
TGVLQQLLS

SEQ ID NO: 396068 - protein, 9 aa, Homo Sapiens
RLQAREHGA

SEQ ID NO: 396069 - protein, 9 aa, Homo Sapiens
EKSINSALL

SEQ ID NO: 396070 - protein, 9 aa, Homo Sapiens
AARSTRFTA

SEQ ID NO: 396071 - protein, 9 aa, Homo Sapiens
FPENRTHPH

SEQ ID NO: 396072 - protein, 9 aa, Homo Sapiens
LKKILRSFM

SEQ ID NO: 396073 - protein, 9 aa, Homo Sapiens
TSLTTASTL

SEQ ID NO: 396074 - protein, 9 aa, Homo Sapiens
TCEDRIRVC

SEQ ID NO: 396075 - protein, 9 aa, Homo Sapiens
HLVGGHPAH

SEQ ID NO: 396076 - protein, 9 aa, Homo Sapiens
ESLDLVATA

SEQ ID NO: 396077 - protein, 9 aa, Homo Sapiens
FMKVARMSL

SEQ ID NO: 396078 - protein, 9 aa, Homo Sapiens
GLSSSTFRS

SEQ ID NO: 396079 - protein, 9 aa, Homo Sapiens
LKRVCRKSV

SEQ ID NO: 396080 - protein, 9 aa, Homo Sapiens
SLPKIRSFQ

SEQ ID NO: 396081 - protein, 9 aa, Homo Sapiens
WATSKISGW

SEQ ID NO: 396082 - protein, 9 aa, Homo Sapiens
LVFGGPGFT

SEQ ID NO: 396083 - protein, 9 aa, Homo Sapiens
LLVVMSFDR

SEQ ID NO: 396084 - protein, 9 aa, Homo Sapiens
VYYTHPASY

SEQ ID NO: 396085 - protein, 9 aa, Homo Sapiens
VSSADGYHL

SEQ ID NO: 396086 - protein, 9 aa, Homo Sapiens
SLSTLLDGK

SEQ ID NO: 396087 - protein, 9 aa, Homo Sapiens
SLSPFATPT

SEQ ID NO: 396088 - protein, 9 aa, Homo Sapiens
TVFGILMGY

SEQ ID NO: 396089 - protein, 9 aa, Homo Sapiens
NEFQAVVWN

SEQ ID NO: 396090 - protein, 9 aa, Homo Sapiens
LFQIYQPWE

SEQ ID NO: 396091 - protein, 9 aa, Homo Sapiens
IQSTTGLQK

SEQ ID NO: 396092 - protein, 9 aa, Homo Sapiens
HKRLEQAGI

SEQ ID NO: 396093 - protein, 9 aa, Homo Sapiens
SQGLPVPLL

SEQ ID NO: 396094 - protein, 9 aa, Homo Sapiens
LTTASTLRW

SEQ ID NO: 396095 - protein, 9 aa, Homo Sapiens
SSPTQSTEH

SEQ ID NO: 396096 - protein, 9 aa, Homo Sapiens
FLFIIIISL

SEQ ID NO: 396097 - protein, 9 aa, Homo Sapiens
QLPGPHDDF

SEQ ID NO: 396098 - protein, 9 aa, Homo Sapiens
HLCSRTHSL

SEQ ID NO: 396099 - protein, 9 aa, Homo Sapiens
FVSWIVMEQ

SEQ ID NO: 396100 - protein, 9 aa, Homo Sapiens
DFFEFCDYN

SEQ ID NO: 396101 - protein, 9 aa, Homo Sapiens
RARLQAREH

SEQ ID NO: 396102 - protein, 9 aa, Homo Sapiens
HFSPQPLTG

SEQ ID NO: 396103 - protein, 9 aa, Homo Sapiens
TRSTSRTIS

SEQ ID NO: 396104 - protein, 9 aa, Homo Sapiens
DTKGPEMGS

SEQ ID NO: 396105 - protein, 9 aa, Homo Sapiens
APCPINNEQ

SEQ ID NO: 396106 - protein, 9 aa, Homo Sapiens
EALQRPFFD

SEQ ID NO: 396107 - protein, 9 aa, Homo Sapiens
NVFHTNPLF

SEQ ID NO: 396108 - protein, 9 aa, Homo Sapiens
NIDTLLDKA

SEQ ID NO: 396109 - protein, 9 aa, Homo Sapiens
SPRPGPRGG

SEQ ID NO: 396110 - protein, 9 aa, Homo Sapiens
APVPAPYSS

SEQ ID NO: 396111 - protein, 9 aa, Homo Sapiens
HQSSPWPGP

SEQ ID NO: 396112 - protein, 9 aa, Homo Sapiens
ACLLWSICF

SEQ ID NO: 396113 - protein, 9 aa, Homo Sapiens
IGTVVVLRL

SEQ ID NO: 396114 - protein, 9 aa, Homo Sapiens
AASECHASI

SEQ ID NO: 396115 - protein, 9 aa, Homo Sapiens
LAFGALVLA

SEQ ID NO: 396116 - protein, 9 aa, Homo Sapiens
PPSSPRHPS

SEQ ID NO: 396117 - protein, 9 aa, Homo Sapiens
ARKTREASL

SEQ ID NO: 396118 - protein, 9 aa, Homo Sapiens
RDNLVVVEG

SEQ ID NO: 396119 - protein, 9 aa, Homo Sapiens
RIIVEKPFE

SEQ ID NO: 396120 - protein, 9 aa, Homo Sapiens
PNLLIIDKE

SEQ ID NO: 396121 - protein, 9 aa, Homo Sapiens
LDTAGKEEY

SEQ ID NO: 396122 - protein, 9 aa, Homo Sapiens
AKPSQLECH

SEQ ID NO: 396123 - protein, 9 aa, Homo Sapiens
KNQSSLLVY

SEQ ID NO: 396124 - protein, 9 aa, Homo Sapiens
EPRPDVHRL

SEQ ID NO: 396125 - protein, 9 aa, Homo Sapiens
TFSTRLSIS

SEQ ID NO: 396126 - protein, 9 aa, Homo Sapiens
ECGRWFSQK

SEQ ID NO: 396127 - protein, 9 aa, Homo Sapiens
VPSVARPST

SEQ ID NO: 396128 - protein, 9 aa, Homo Sapiens
LPLGLFGDK

SEQ ID NO: 396129 - protein, 9 aa, Homo Sapiens
TKPHSSHSD

SEQ ID NO: 396130 - protein, 9 aa, Homo Sapiens
GSVVGVTQP

SEQ ID NO: 396131 - protein, 9 aa, Homo Sapiens
GPSFSPWQG

SEQ ID NO: 396132 - protein, 9 aa, Homo Sapiens
ISNTNSCNV

SEQ ID NO: 396133 - protein, 9 aa, Homo Sapiens
RGGGPSPGT

SEQ ID NO: 396134 - protein, 9 aa, Homo Sapiens
AGRLQGGGV

SEQ ID NO: 396135 - protein, 9 aa, Homo Sapiens
FATPTRSGT

SEQ ID NO: 396136 - protein, 9 aa, Homo Sapiens
PEPGASCQN

SEQ ID NO: 396137 - protein, 9 aa, Homo Sapiens
HRTSSHLPS

SEQ ID NO: 396138 - protein, 9 aa, Homo Sapiens
ALANVISSK

SEQ ID NO: 396139 - protein, 9 aa, Homo Sapiens
AEHQAINTI

SEQ ID NO: 396140 - protein, 9 aa, Homo Sapiens
ILACECPNP

SEQ ID NO: 396141 - protein, 9 aa, Homo Sapiens
VHWKTFQGL

SEQ ID NO: 396142 - protein, 9 aa, Homo Sapiens
FPTLLPLFI

SEQ ID NO: 396143 - protein, 9 aa, Homo Sapiens
DPSPRKKPI

SEQ ID NO: 396144 - protein, 9 aa, Homo Sapiens
PMIYGGVAV

SEQ ID NO: 396145 - protein, 9 aa, Homo Sapiens
DKTPMTNSP

SEQ ID NO: 396146 - protein, 9 aa, Homo Sapiens
LGALGSMVG

SEQ ID NO: 396147 - protein, 9 aa, Homo Sapiens
SARRRTWWR

SEQ ID NO: 396148 - protein, 9 aa, Homo Sapiens
KNRGSGGAP

SEQ ID NO: 396149 - protein, 9 aa, Homo Sapiens
LEESRHLWK

SEQ ID NO: 396150 - protein, 9 aa, Homo Sapiens
LEALVAPDR

SEQ ID NO: 396151 - protein, 9 aa, Homo Sapiens
LLYTLNDRE

SEQ ID NO: 396152 - protein, 9 aa, Homo Sapiens
PLPPPVWAV

SEQ ID NO: 396153 - protein, 9 aa, Homo Sapiens
SKGSLGKDA

SEQ ID NO: 396154 - protein, 9 aa, Homo Sapiens
QLANHSGCI

SEQ ID NO: 396155 - protein, 9 aa, Homo Sapiens
CCPPIRTPA

SEQ ID NO: 396156 - protein, 9 aa, Homo Sapiens
LTTGTFAAF

SEQ ID NO: 396157 - protein, 9 aa, Homo Sapiens
LLSTRFDVN

SEQ ID NO: 396158 - protein, 9 aa, Homo Sapiens
EQLGRGTMS

SEQ ID NO: 396159 - protein, 9 aa, Homo Sapiens
DEEQKLPRT

SEQ ID NO: 396160 - protein, 9 aa, Homo Sapiens
EFGSPCPIS

SEQ ID NO: 396161 - protein, 9 aa, Homo Sapiens
TGANRADRT

SEQ ID NO: 396162 - protein, 9 aa, Homo Sapiens
IKRKKQQKI

SEQ ID NO: 396163 - protein, 9 aa, Homo Sapiens
MCLRLRTKL

SEQ ID NO: 396164 - protein, 9 aa, Homo Sapiens
RPQCRPTGR

SEQ ID NO: 396165 - protein, 9 aa, Homo Sapiens
MHFHYDEVR

SEQ ID NO: 396166 - protein, 9 aa, Homo Sapiens
STRSTSRTI

SEQ ID NO: 396167 - protein, 9 aa, Homo Sapiens
SASPHPEET

SEQ ID NO: 396168 - protein, 9 aa, Homo Sapiens
TRQKRDVIR

SEQ ID NO: 396169 - protein, 9 aa, Homo Sapiens
SKASRAGGT

SEQ ID NO: 396170 - protein, 9 aa, Homo Sapiens
SKVKITLLH

SEQ ID NO: 396171 - protein, 9 aa, Homo Sapiens
PFLHHRPKP

SEQ ID NO: 396172 - protein, 9 aa, Homo Sapiens
AHLWPTRRS

SEQ ID NO: 396173 - protein, 9 aa, Homo Sapiens
CQSLLQGEG

SEQ ID NO: 396174 - protein, 9 aa, Homo Sapiens
WSDPQDCRG

SEQ ID NO: 396175 - protein, 9 aa, Homo Sapiens
AWLLGGLPK

SEQ ID NO: 396176 - protein, 9 aa, Homo Sapiens
RSDEDSYIV

SEQ ID NO: 396177 - protein, 9 aa, Homo Sapiens
VNRLSDKIF

SEQ ID NO: 396178 - protein, 9 aa, Homo Sapiens
SSLAGLSSS

SEQ ID NO: 396179 - protein, 9 aa, Homo Sapiens
SHFSDLDQS

SEQ ID NO: 396180 - protein, 9 aa, Homo Sapiens
RKSRIIAKK

SEQ ID NO: 396181 - protein, 9 aa, Homo Sapiens
TKPLGTVQQ

SEQ ID NO: 396182 - protein, 9 aa, Homo Sapiens
LRGHPSAFN

SEQ ID NO: 396183 - protein, 9 aa, Homo Sapiens
TDKNPCLYG

SEQ ID NO: 396184 - protein, 9 aa, Homo Sapiens
QCRPTGRPL

SEQ ID NO: 396185 - protein, 9 aa, Homo Sapiens
HRDFTGELE

SEQ ID NO: 396186 - protein, 9 aa, Homo Sapiens
PGVVTDLFP

SEQ ID NO: 396187 - protein, 9 aa, Homo Sapiens
KTTFTVVQN

SEQ ID NO: 396188 - protein, 9 aa, Homo Sapiens
SERRPQAPP

SEQ ID NO: 396189 - protein, 9 aa, Homo Sapiens
AAEIQKHKR

SEQ ID NO: 396190 - protein, 9 aa, Homo Sapiens
ETAMRREVV

SEQ ID NO: 396191 - protein, 9 aa, Homo Sapiens
STSTSRARG

SEQ ID NO: 396192 - protein, 9 aa, Homo Sapiens
TSILSALRV

SEQ ID NO: 396193 - protein, 9 aa, Homo Sapiens
TPPFGLIPR

SEQ ID NO: 396194 - protein, 9 aa, Homo Sapiens
YRRYCMERA

SEQ ID NO: 396195 - protein, 9 aa, Homo Sapiens
KKREVVDGH

SEQ ID NO: 396196 - protein, 9 aa, Homo Sapiens
TATAASAAV

SEQ ID NO: 396197 - protein, 9 aa, Homo Sapiens
NFGKLSLKC

SEQ ID NO: 396198 - protein, 9 aa, Homo Sapiens
YSACMVLGL

SEQ ID NO: 396199 - protein, 9 aa, Homo Sapiens
EWRQGGSPV

SEQ ID NO: 396200 - protein, 9 aa, Homo Sapiens
ENLAVPSEC

SEQ ID NO: 396201 - protein, 9 aa, Homo Sapiens
RRSFGASRA

SEQ ID NO: 396202 - protein, 9 aa, Homo Sapiens
FAGVNCEEP

SEQ ID NO: 396203 - protein, 9 aa, Homo Sapiens
YLCPECGRW

SEQ ID NO: 396204 - protein, 9 aa, Homo Sapiens
AISTFMLGA

SEQ ID NO: 396205 - protein, 9 aa, Homo Sapiens
EWAPRMGCM

SEQ ID NO: 396206 - protein, 9 aa, Homo Sapiens
YHDPNFVPV

SEQ ID NO: 396207 - protein, 9 aa, Homo Sapiens
NSPGCVDGR

SEQ ID NO: 396208 - protein, 9 aa, Homo Sapiens
MIISYKEGM

SEQ ID NO: 396209 - protein, 9 aa, Homo Sapiens
VHGPWGKAQ

SEQ ID NO: 396210 - protein, 9 aa, Homo Sapiens
PGSSRRLHH

SEQ ID NO: 396211 - protein, 9 aa, Homo Sapiens
CSQRAPLAL

SEQ ID NO: 396212 - protein, 9 aa, Homo Sapiens
SIPRVFYMN

SEQ ID NO: 396213 - protein, 9 aa, Homo Sapiens
KTKQQLQNQ

SEQ ID NO: 396214 - protein, 9 aa, Homo Sapiens
SLVSRVLAQ

SEQ ID NO: 396215 - protein, 9 aa, Homo Sapiens
AQFHARQPS

SEQ ID NO: 396216 - protein, 9 aa, Homo Sapiens
TGLLQESSR

SEQ ID NO: 396217 - protein, 9 aa, Homo Sapiens
LAAPWLLEV

SEQ ID NO: 396218 - protein, 9 aa, Homo Sapiens
QPSVRAGSG

SEQ ID NO: 396219 - protein, 9 aa, Homo Sapiens
PIEKPGGII

SEQ ID NO: 396220 - protein, 9 aa, Homo Sapiens
MLRWLLSSP

SEQ ID NO: 396221 - protein, 9 aa, Homo Sapiens
KNFHLLTKY

SEQ ID NO: 396222 - protein, 9 aa, Homo Sapiens
NPMIYTLHN

SEQ ID NO: 396223 - protein, 9 aa, Homo Sapiens
KREDKSILL

SEQ ID NO: 396224 - protein, 9 aa, Homo Sapiens
VIGFTMMSL

SEQ ID NO: 396225 - protein, 9 aa, Homo Sapiens
SQKRALGLI

SEQ ID NO: 396226 - protein, 9 aa, Homo Sapiens
WTPWRKSGS

SEQ ID NO: 396227 - protein, 9 aa, Homo Sapiens
PGFLQFQND

SEQ ID NO: 396228 - protein, 9 aa, Homo Sapiens
SIIDILVSM

SEQ ID NO: 396229 - protein, 9 aa, Homo Sapiens
RDLLTGLPA

SEQ ID NO: 396230 - protein, 9 aa, Homo Sapiens
RASGPTPVP

SEQ ID NO: 396231 - protein, 9 aa, Homo Sapiens
SWAPTTPTS

SEQ ID NO: 396232 - protein, 9 aa, Homo Sapiens
SKDAALKCQ

SEQ ID NO: 396233 - protein, 9 aa, Homo Sapiens
HVWLLPGMG

SEQ ID NO: 396234 - protein, 9 aa, Homo Sapiens
VTLTHFSPQ

SEQ ID NO: 396235 - protein, 9 aa, Homo Sapiens
ATVTLYASV

SEQ ID NO: 396236 - protein, 9 aa, Homo Sapiens
TSGTSRTRG

SEQ ID NO: 396237 - protein, 9 aa, Homo Sapiens
GPSCVPTAA

SEQ ID NO: 396238 - protein, 9 aa, Homo Sapiens
IPVLIIVVC

SEQ ID NO: 396239 - protein, 9 aa, Homo Sapiens
CGARVFAQR

SEQ ID NO: 396240 - protein, 9 aa, Homo Sapiens
ALHPSLCLF

SEQ ID NO: 396241 - protein, 9 aa, Homo Sapiens
AMLRLELDA

SEQ ID NO: 396242 - protein, 9 aa, Homo Sapiens
RTIILVQTG

SEQ ID NO: 396243 - protein, 9 aa, Homo Sapiens
GSLSSSLSI

SEQ ID NO: 396244 - protein, 9 aa, Homo Sapiens
LFLFLPGLL

SEQ ID NO: 396245 - protein, 9 aa, Homo Sapiens
GGRILLQRN

SEQ ID NO: 396246 - protein, 9 aa, Homo Sapiens
DLPVGLAGD

SEQ ID NO: 396247 - protein, 9 aa, Homo Sapiens
EAGERQIYR

SEQ ID NO: 396248 - protein, 9 aa, Homo Sapiens
PPRSPRCPL

SEQ ID NO: 396249 - protein, 9 aa, Homo Sapiens
GGLFPMHAK

SEQ ID NO: 396250 - protein, 9 aa, Homo Sapiens
AVTAPPSAP

SEQ ID NO: 396251 - protein, 9 aa, Homo Sapiens
DDLLLPVDE

SEQ ID NO: 396252 - protein, 9 aa, Homo Sapiens
SILKYLLMQ

SEQ ID NO: 396253 - protein, 9 aa, Homo Sapiens
RSLWCPVGK

SEQ ID NO: 396254 - protein, 9 aa, Homo Sapiens
GTSETPAGL

SEQ ID NO: 396255 - protein, 9 aa, Homo Sapiens
EIISEIRVP

SEQ ID NO: 396256 - protein, 9 aa, Homo Sapiens
GDTSKEDID

SEQ ID NO: 396257 - protein, 9 aa, Homo Sapiens
VMIRILPLE

SEQ ID NO: 396258 - protein, 9 aa, Homo Sapiens
YNPVTDVWS

SEQ ID NO: 396259 - protein, 9 aa, Homo Sapiens
QVDLPVGLA

SEQ ID NO: 396260 - protein, 9 aa, Homo Sapiens
PILPKCLTS

SEQ ID NO: 396261 - protein, 9 aa, Homo Sapiens
TSRILNLQV

SEQ ID NO: 396262 - protein, 9 aa, Homo Sapiens
IHAPTLQVV

SEQ ID NO: 396263 - protein, 9 aa, Homo Sapiens
RREREEETP

SEQ ID NO: 396264 - protein, 9 aa, Homo Sapiens
LEVSFCQPH

SEQ ID NO: 396265 - protein, 9 aa, Homo Sapiens
NAALIHVIS

SEQ ID NO: 396266 - protein, 9 aa, Homo Sapiens
NCGLEETIA

SEQ ID NO: 396267 - protein, 9 aa, Homo Sapiens
ATPPFGLIP

SEQ ID NO: 396268 - protein, 9 aa, Homo Sapiens
STLSCSDNY

SEQ ID NO: 396269 - protein, 9 aa, Homo Sapiens
HWRQIDRGV

SEQ ID NO: 396270 - protein, 9 aa, Homo Sapiens
GMKIEIHFD

SEQ ID NO: 396271 - protein, 9 aa, Homo Sapiens
ADAILSSNS

SEQ ID NO: 396272 - protein, 9 aa, Homo Sapiens
PGLVIYDWL

SEQ ID NO: 396273 - protein, 9 aa, Homo Sapiens
LSIPRVFYM

SEQ ID NO: 396274 - protein, 9 aa, Homo Sapiens
ETIANLGSC

SEQ ID NO: 396275 - protein, 9 aa, Homo Sapiens
APGPLMEQM

SEQ ID NO: 396276 - protein, 9 aa, Homo Sapiens
VPLFIWTPW

SEQ ID NO: 396277 - protein, 9 aa, Homo Sapiens
GARKTREAS

SEQ ID NO: 396278 - protein, 9 aa, Homo Sapiens
TRSPLTSRF

SEQ ID NO: 396279 - protein, 9 aa, Homo Sapiens
IIRQYVSSE

SEQ ID NO: 396280 - protein, 9 aa, Homo Sapiens
AAASPRAAI

SEQ ID NO: 396281 - protein, 9 aa, Homo Sapiens
TSGSQCTSL

SEQ ID NO: 396282 - protein, 9 aa, Homo Sapiens
TWCRTGAST

SEQ ID NO: 396283 - protein, 9 aa, Homo Sapiens
LPLHFDTAQ

SEQ ID NO: 396284 - protein, 9 aa, Homo Sapiens
WPTPPEMPG

SEQ ID NO: 396285 - protein, 9 aa, Homo Sapiens
PRPSTPASP

SEQ ID NO: 396286 - protein, 9 aa, Homo Sapiens
GCAHILVID

SEQ ID NO: 396287 - protein, 9 aa, Homo Sapiens
ELTCVICLD

SEQ ID NO: 396288 - protein, 9 aa, Homo Sapiens
IAFHIKSIA

SEQ ID NO: 396289 - protein, 9 aa, Homo Sapiens
CPRDEEWAP

SEQ ID NO: 396290 - protein, 9 aa, Homo Sapiens
QFIDLNSSQ

SEQ ID NO: 396291 - protein, 9 aa, Homo Sapiens
KSKKKKRKR

SEQ ID NO: 396292 - protein, 9 aa, Homo Sapiens
QFLSSSPGL

SEQ ID NO: 396293 - protein, 9 aa, Homo Sapiens
LLSLYSVAV

SEQ ID NO: 396294 - protein, 9 aa, Homo Sapiens
KALSALFIW

SEQ ID NO: 396295 - protein, 9 aa, Homo Sapiens
CPSVPTAGV

SEQ ID NO: 396296 - protein, 9 aa, Homo Sapiens
VSQLAGTPP

SEQ ID NO: 396297 - protein, 9 aa, Homo Sapiens
SLPLPLPPH

SEQ ID NO: 396298 - protein, 9 aa, Homo Sapiens
MSPSPVSGL

SEQ ID NO: 396299 - protein, 9 aa, Homo Sapiens
LCLRIQTRS

SEQ ID NO: 396300 - protein, 9 aa, Homo Sapiens
KPTYKWLKM

SEQ ID NO: 396301 - protein, 9 aa, Homo Sapiens
LNEKCNKQM

SEQ ID NO: 396302 - protein, 9 aa, Homo Sapiens
DIQVGQRTL

SEQ ID NO: 396303 - protein, 9 aa, Homo Sapiens
PNFVPVAFV

SEQ ID NO: 396304 - protein, 9 aa, Homo Sapiens
SSTRETSST

SEQ ID NO: 396305 - protein, 9 aa, Homo Sapiens
TFKGNTQKM

SEQ ID NO: 396306 - protein, 9 aa, Homo Sapiens
IMKVNFDIL

SEQ ID NO: 396307 - protein, 9 aa, Homo Sapiens
RASLTTGTF

SEQ ID NO: 396308 - protein, 9 aa, Homo Sapiens
MYFLEEPIP

SEQ ID NO: 396309 - protein, 9 aa, Homo Sapiens
GVMPTIGQR

SEQ ID NO: 396310 - protein, 9 aa, Homo Sapiens
REHVLEEVI

SEQ ID NO: 396311 - protein, 9 aa, Homo Sapiens
LRIFFLFND

SEQ ID NO: 396312 - protein, 9 aa, Homo Sapiens
CPKNKLLKT

SEQ ID NO: 396313 - protein, 9 aa, Homo Sapiens
ATVRSITHV

SEQ ID NO: 396314 - protein, 9 aa, Homo Sapiens
RRGTPSAFD

SEQ ID NO: 396315 - protein, 9 aa, Homo Sapiens
HTNFSSHTN

SEQ ID NO: 396316 - protein, 9 aa, Homo Sapiens
RGTSITLST

SEQ ID NO: 396317 - protein, 9 aa, Homo Sapiens
CEHLSYTEA

SEQ ID NO: 396318 - protein, 9 aa, Homo Sapiens
ALDTKGPEM

SEQ ID NO: 396319 - protein, 9 aa, Homo Sapiens
RARRTTFTS

SEQ ID NO: 396320 - protein, 9 aa, Homo Sapiens
LLVLISIID

SEQ ID NO: 396321 - protein, 9 aa, Homo Sapiens
TSNPLPSFS

SEQ ID NO: 396322 - protein, 9 aa, Homo Sapiens
LGAPLPWMV

SEQ ID NO: 396323 - protein, 9 aa, Homo Sapiens
TRLAVSTRG

SEQ ID NO: 396324 - protein, 9 aa, Homo Sapiens
FRYGGAPRP

SEQ ID NO: 396325 - protein, 9 aa, Homo Sapiens
ACLTLVTTG

SEQ ID NO: 396326 - protein, 9 aa, Homo Sapiens
GPCIGEESG

SEQ ID NO: 396327 - protein, 9 aa, Homo Sapiens
LTLGAPLPW

SEQ ID NO: 396328 - protein, 9 aa, Homo Sapiens
AATPLAQWA

SEQ ID NO: 396329 - protein, 9 aa, Homo Sapiens
RSVRRMLEE

SEQ ID NO: 396330 - protein, 9 aa, Homo Sapiens
LILWHPHHQ

SEQ ID NO: 396331 - protein, 9 aa, Homo Sapiens
LFPVLSTSS

SEQ ID NO: 396332 - protein, 9 aa, Homo Sapiens
TGVFPTGHS

SEQ ID NO: 396333 - protein, 9 aa, Homo Sapiens
AVRKNSTYS

SEQ ID NO: 396334 - protein, 9 aa, Homo Sapiens
SITNTATAA

SEQ ID NO: 396335 - protein, 9 aa, Homo Sapiens
KSGVKSQIQ

SEQ ID NO: 396336 - protein, 9 aa, Homo Sapiens
PQAVDGWVE

SEQ ID NO: 396337 - protein, 9 aa, Homo Sapiens
VHKARSGKG

SEQ ID NO: 396338 - protein, 9 aa, Homo Sapiens
EVLQDPLDR

SEQ ID NO: 396339 - protein, 9 aa, Homo Sapiens
EKRLKIFVS

SEQ ID NO: 396340 - protein, 9 aa, Homo Sapiens
FSSDPSSSV

SEQ ID NO: 396341 - protein, 9 aa, Homo Sapiens
PFATPTRSG

SEQ ID NO: 396342 - protein, 9 aa, Homo Sapiens
VEFILLVVM

SEQ ID NO: 396343 - protein, 9 aa, Homo Sapiens
SFQKSYKRG

SEQ ID NO: 396344 - protein, 9 aa, Homo Sapiens
WKGIKSTGK

SEQ ID NO: 396345 - protein, 9 aa, Homo Sapiens
LFFGCTKKL

SEQ ID NO: 396346 - protein, 9 aa, Homo Sapiens
HVLVDIQYL

SEQ ID NO: 396347 - protein, 9 aa, Homo Sapiens
FNMWKPMWV

SEQ ID NO: 396348 - protein, 9 aa, Homo Sapiens
ECYCKEGFT

SEQ ID NO: 396349 - protein, 9 aa, Homo Sapiens
GLRTELVTY

SEQ ID NO: 396350 - protein, 9 aa, Homo Sapiens
KARGALATG

SEQ ID NO: 396351 - protein, 9 aa, Homo Sapiens
RWLRVIRDE

SEQ ID NO: 396352 - protein, 9 aa, Homo Sapiens
DTPAKCAGG

SEQ ID NO: 396353 - protein, 9 aa, Homo Sapiens
KFSSFLSPW

SEQ ID NO: 396354 - protein, 9 aa, Homo Sapiens
LVRHLPKSI

SEQ ID NO: 396355 - protein, 9 aa, Homo Sapiens
TLHYPSTTA

SEQ ID NO: 396356 - protein, 9 aa, Homo Sapiens
CLCCEEELH

SEQ ID NO: 396357 - protein, 9 aa, Homo Sapiens
RAPPRPRCT

SEQ ID NO: 396358 - protein, 9 aa, Homo Sapiens
KLEKALSAL

SEQ ID NO: 396359 - protein, 9 aa, Homo Sapiens
VLSIQSTTG

SEQ ID NO: 396360 - protein, 9 aa, Homo Sapiens
MNQRVAKAE

SEQ ID NO: 396361 - protein, 9 aa, Homo Sapiens
GHGSHRLFI

SEQ ID NO: 396362 - protein, 9 aa, Homo Sapiens
FGCTKKLRS

SEQ ID NO: 396363 - protein, 9 aa, Homo Sapiens
LLFSQTRLP

SEQ ID NO: 396364 - protein, 9 aa, Homo Sapiens
FVSSADGYH

SEQ ID NO: 396365 - protein, 9 aa, Homo Sapiens
SVTGFDMIV

SEQ ID NO: 396366 - protein, 9 aa, Homo Sapiens
FGDGRHRKL

SEQ ID NO: 396367 - protein, 9 aa, Homo Sapiens
YVNDRMREL

SEQ ID NO: 396368 - protein, 9 aa, Homo Sapiens
PPAAVLVFG

SEQ ID NO: 396369 - protein, 9 aa, Homo Sapiens
CSCTFVPPP

SEQ ID NO: 396370 - protein, 9 aa, Homo Sapiens
ASSAKRQLL

SEQ ID NO: 396371 - protein, 9 aa, Homo Sapiens
PRLPTGLYC

SEQ ID NO: 396372 - protein, 9 aa, Homo Sapiens
VVDGDAGVG

SEQ ID NO: 396373 - protein, 9 aa, Homo Sapiens
NMSKVETGL

SEQ ID NO: 396374 - protein, 9 aa, Homo Sapiens
GFLQFQNDP

SEQ ID NO: 396375 - protein, 9 aa, Homo Sapiens
EIWTNQNTG

SEQ ID NO: 396376 - protein, 9 aa, Homo Sapiens
IIVVCYTLM

SEQ ID NO: 396377 - protein, 9 aa, Homo Sapiens
AHVVLEVVV

SEQ ID NO: 396378 - protein, 9 aa, Homo Sapiens
AQTVTEKNT

SEQ ID NO: 396379 - protein, 9 aa, Homo Sapiens
QPWEPLHFS

SEQ ID NO: 396380 - protein, 9 aa, Homo Sapiens
KYVNVFHKF

SEQ ID NO: 396381 - protein, 9 aa, Homo Sapiens
FVLAQSAWC

SEQ ID NO: 396382 - protein, 9 aa, Homo Sapiens
EDRIRVCGG

SEQ ID NO: 396383 - protein, 9 aa, Homo Sapiens
IQSVMASSA

SEQ ID NO: 396384 - protein, 9 aa, Homo Sapiens
PRASAPPPP

SEQ ID NO: 396385 - protein, 9 aa, Homo Sapiens
DNGAIAFVL

SEQ ID NO: 396386 - protein, 9 aa, Homo Sapiens
SLYSVAVWP

SEQ ID NO: 396387 - protein, 9 aa, Homo Sapiens
DGTGKLGNI

SEQ ID NO: 396388 - protein, 9 aa, Homo Sapiens
RSSITVKLF

SEQ ID NO: 396389 - protein, 9 aa, Homo Sapiens
TWCLGPAAR

SEQ ID NO: 396390 - protein, 9 aa, Homo Sapiens
TRGSRGTLF

SEQ ID NO: 396391 - protein, 9 aa, Homo Sapiens
SRAAGTTFT

SEQ ID NO: 396392 - protein, 9 aa, Homo Sapiens
CQVHGPWGK

SEQ ID NO: 396393 - protein, 9 aa, Homo Sapiens
WDVCKGAKA

SEQ ID NO: 396394 - protein, 9 aa, Homo Sapiens
RESHHTSLT

SEQ ID NO: 396395 - protein, 9 aa, Homo Sapiens
ETEFLKNLS

SEQ ID NO: 396396 - protein, 9 aa, Homo Sapiens
LITTQIFSY

SEQ ID NO: 396397 - protein, 9 aa, Homo Sapiens
RHFTVNMSK

SEQ ID NO: 396398 - protein, 9 aa, Homo Sapiens
RLKRQEEEC

SEQ ID NO: 396399 - protein, 9 aa, Homo Sapiens
KWLKMANLC

SEQ ID NO: 396400 - protein, 9 aa, Homo Sapiens
HDRSETLTD

SEQ ID NO: 396401 - protein, 9 aa, Homo Sapiens
TAATVNSKI

SEQ ID NO: 396402 - protein, 9 aa, Homo Sapiens
PGITHIYSP

SEQ ID NO: 396403 - protein, 9 aa, Homo Sapiens
DVPPWLSPP

SEQ ID NO: 396404 - protein, 9 aa, Homo Sapiens
IPPGSSHAC

SEQ ID NO: 396405 - protein, 9 aa, Homo Sapiens
MINSPVGDI

SEQ ID NO: 396406 - protein, 9 aa, Homo Sapiens
AKVVRKLQW

SEQ ID NO: 396407 - protein, 9 aa, Homo Sapiens
IQRLNFFDT

SEQ ID NO: 396408 - protein, 9 aa, Homo Sapiens
HIVSQLLTL

SEQ ID NO: 396409 - protein, 9 aa, Homo Sapiens
TRKMAIIDT

SEQ ID NO: 396410 - protein, 9 aa, Homo Sapiens
ARGSLNTNR

SEQ ID NO: 396411 - protein, 9 aa, Homo Sapiens
PRRKSPLPL

SEQ ID NO: 396412 - protein, 9 aa, Homo Sapiens
RVLPGGAEE

SEQ ID NO: 396413 - protein, 9 aa, Homo Sapiens
TEPVDYEFN

SEQ ID NO: 396414 - protein, 9 aa, Homo Sapiens
STIKLVVTN

SEQ ID NO: 396415 - protein, 9 aa, Homo Sapiens
NLQVLKKIL

SEQ ID NO: 396416 - protein, 9 aa, Homo Sapiens
HAFLESCPP

SEQ ID NO: 396417 - protein, 9 aa, Homo Sapiens
NLSPGVVTD

SEQ ID NO: 396418 - protein, 9 aa, Homo Sapiens
GPDGFGPGG

SEQ ID NO: 396419 - protein, 9 aa, Homo Sapiens
EIPRLPHPA

SEQ ID NO: 396420 - protein, 9 aa, Homo Sapiens
SIRWLRVIR

SEQ ID NO: 396421 - protein, 9 aa, Homo Sapiens
TCDHCQQDV

SEQ ID NO: 396422 - protein, 9 aa, Homo Sapiens
AEGSLKKTS

SEQ ID NO: 396423 - protein, 9 aa, Homo Sapiens
TAVTLGTRR

SEQ ID NO: 396424 - protein, 9 aa, Homo Sapiens
HTKLEFPSP

SEQ ID NO: 396425 - protein, 9 aa, Homo Sapiens
IVVCYTLMI

SEQ ID NO: 396426 - protein, 9 aa, Homo Sapiens
KKKNVIQSI

SEQ ID NO: 396427 - protein, 9 aa, Homo Sapiens
SPEDMPAQG

SEQ ID NO: 396428 - protein, 9 aa, Homo Sapiens
NQCGETYRR

SEQ ID NO: 396429 - protein, 9 aa, Homo Sapiens
YATGVLQQL

SEQ ID NO: 396430 - protein, 9 aa, Homo Sapiens
SMFLRVRTN

SEQ ID NO: 396431 - protein, 9 aa, Homo Sapiens
LQDPLDRCY

SEQ ID NO: 396432 - protein, 9 aa, Homo Sapiens
AASPRAAIW

SEQ ID NO: 396433 - protein, 9 aa, Homo Sapiens
AKQFLISPH

SEQ ID NO: 396434 - protein, 9 aa, Homo Sapiens
PDVFTMIDI

SEQ ID NO: 396435 - protein, 9 aa, Homo Sapiens
VREECIPTK

SEQ ID NO: 396436 - protein, 9 aa, Homo Sapiens
PPWQPPPPA

SEQ ID NO: 396437 - protein, 9 aa, Homo Sapiens
QSQSSTSIL

SEQ ID NO: 396438 - protein, 9 aa, Homo Sapiens
DATPLHSVL

SEQ ID NO: 396439 - protein, 9 aa, Homo Sapiens
NPQELKEKE

SEQ ID NO: 396440 - protein, 9 aa, Homo Sapiens
ACDKTLSVS

SEQ ID NO: 396441 - protein, 9 aa, Homo Sapiens
WGDDRGTPW

SEQ ID NO: 396442 - protein, 9 aa, Homo Sapiens
LIIVVCYTL

SEQ ID NO: 396443 - protein, 9 aa, Homo Sapiens
GDCYWFENT

SEQ ID NO: 396444 - protein, 9 aa, Homo Sapiens
KNGTTCTFN

SEQ ID NO: 396445 - protein, 9 aa, Homo Sapiens
PRRSPASAP

SEQ ID NO: 396446 - protein, 9 aa, Homo Sapiens
GNKALCEHL

SEQ ID NO: 396447 - protein, 9 aa, Homo Sapiens
LQFHNQRHM

SEQ ID NO: 396448 - protein, 9 aa, Homo Sapiens
DKKNGIWEV

SEQ ID NO: 396449 - protein, 9 aa, Homo Sapiens
RAKVWTSGQ

SEQ ID NO: 396450 - protein, 9 aa, Homo Sapiens
LPGLLFSSF

SEQ ID NO: 396451 - protein, 9 aa, Homo Sapiens
SPGCVDGRR

SEQ ID NO: 396452 - protein, 9 aa, Homo Sapiens
HLECEKYKS

SEQ ID NO: 396453 - protein, 9 aa, Homo Sapiens
KEITEGVPG

SEQ ID NO: 396454 - protein, 9 aa, Homo Sapiens
CLLTLTRKY

SEQ ID NO: 396455 - protein, 9 aa, Homo Sapiens
ASRTDSARG

SEQ ID NO: 396456 - protein, 9 aa, Homo Sapiens
VDPNQWNQE

SEQ ID NO: 396457 - protein, 9 aa, Homo Sapiens
GNISTSSNP

SEQ ID NO: 396458 - protein, 9 aa, Homo Sapiens
INPRLQHHF

SEQ ID NO: 396459 - protein, 9 aa, Homo Sapiens
VTSLSSSST

SEQ ID NO: 396460 - protein, 9 aa, Homo Sapiens
WAIPEFGSP

SEQ ID NO: 396461 - protein, 9 aa, Homo Sapiens
LAARNVQLV

SEQ ID NO: 396462 - protein, 9 aa, Homo Sapiens
TSETSHLPL

SEQ ID NO: 396463 - protein, 9 aa, Homo Sapiens
TPWRKSGSG

SEQ ID NO: 396464 - protein, 9 aa, Homo Sapiens
EDHTDDFMG

SEQ ID NO: 396465 - protein, 9 aa, Homo Sapiens
PVKAEKLRH

SEQ ID NO: 396466 - protein, 9 aa, Homo Sapiens
QTRCQVRPP

SEQ ID NO: 396467 - protein, 9 aa, Homo Sapiens
LSYRWLSLF

SEQ ID NO: 396468 - protein, 9 aa, Homo Sapiens
EGGPWRGQP

SEQ ID NO: 396469 - protein, 9 aa, Homo Sapiens
TGKLGNITA

SEQ ID NO: 396470 - protein, 9 aa, Homo Sapiens
FNNLKNCIY

SEQ ID NO: 396471 - protein, 9 aa, Homo Sapiens
HKKKHEGQI

SEQ ID NO: 396472 - protein, 9 aa, Homo Sapiens
GLLVLISII

SEQ ID NO: 396473 - protein, 9 aa, Homo Sapiens
HAWSQDMAE

SEQ ID NO: 396474 - protein, 9 aa, Homo Sapiens
STFMLGAIL

SEQ ID NO: 396475 - protein, 9 aa, Homo Sapiens
KMLVKFLLY

SEQ ID NO: 396476 - protein, 9 aa, Homo Sapiens
QAVPSLPSA

SEQ ID NO: 396477 - protein, 9 aa, Homo Sapiens
STSSPGLGS

SEQ ID NO: 396478 - protein, 9 aa, Homo Sapiens
GKSQGGRIL

SEQ ID NO: 396479 - protein, 9 aa, Homo Sapiens
SIYCRYRGI

SEQ ID NO: 396480 - protein, 9 aa, Homo Sapiens
VHGPGPCIG

SEQ ID NO: 396481 - protein, 9 aa, Homo Sapiens
VNLIGREMK

SEQ ID NO: 396482 - protein, 9 aa, Homo Sapiens
LPLKQRAED

SEQ ID NO: 396483 - protein, 9 aa, Homo Sapiens
TNGCISIIL

SEQ ID NO: 396484 - protein, 9 aa, Homo Sapiens
LTPHIGPKV

SEQ ID NO: 396485 - protein, 9 aa, Homo Sapiens
TIKLVVTNM

SEQ ID NO: 396486 - protein, 9 aa, Homo Sapiens
KTLSVSIEG

SEQ ID NO: 396487 - protein, 9 aa, Homo Sapiens
ATSPMELAA

SEQ ID NO: 396488 - protein, 9 aa, Homo Sapiens
RGASGTREA

SEQ ID NO: 396489 - protein, 9 aa, Homo Sapiens
LLTGDHVLA

SEQ ID NO: 396490 - protein, 9 aa, Homo Sapiens
PTAQKLADA

SEQ ID NO: 396491 - protein, 9 aa, Homo Sapiens
GKSAVPIPS

SEQ ID NO: 396492 - protein, 9 aa, Homo Sapiens
PNLLPAPSA

SEQ ID NO: 396493 - protein, 9 aa, Homo Sapiens
ILPKCLTSQ

SEQ ID NO: 396494 - protein, 9 aa, Homo Sapiens
WKTSCTTFT

SEQ ID NO: 396495 - protein, 9 aa, Homo Sapiens
WGNAYPHWR

SEQ ID NO: 396496 - protein, 9 aa, Homo Sapiens
HVAALAPGT

SEQ ID NO: 396497 - protein, 9 aa, Homo Sapiens
HSTTTILNP

SEQ ID NO: 396498 - protein, 9 aa, Homo Sapiens
PVSVCEETS

SEQ ID NO: 396499 - protein, 9 aa, Homo Sapiens
TLTRKYDFH

SEQ ID NO: 396500 - protein, 9 aa, Homo Sapiens
VFPTGHSDS

SEQ ID NO: 396501 - protein, 9 aa, Homo Sapiens
RKMAIIDTR

SEQ ID NO: 396502 - protein, 9 aa, Homo Sapiens
SRGGSWPPA

SEQ ID NO: 396503 - protein, 9 aa, Homo Sapiens
THEAKRAVR

SEQ ID NO: 396504 - protein, 9 aa, Homo Sapiens
CAAYMAPEH

SEQ ID NO: 396505 - protein, 9 aa, Homo Sapiens
PGGYSGPSF

SEQ ID NO: 396506 - protein, 9 aa, Homo Sapiens
LRTRPWAKN

SEQ ID NO: 396507 - protein, 9 aa, Homo Sapiens
LVTRGTSRA

SEQ ID NO: 396508 - protein, 9 aa, Homo Sapiens
TGENPYKCE

SEQ ID NO: 396509 - protein, 9 aa, Homo Sapiens
KLGNITAPC

SEQ ID NO: 396510 - protein, 9 aa, Homo Sapiens
HRVAAKQLE

SEQ ID NO: 396511 - protein, 9 aa, Homo Sapiens
KGQGTVMAG

SEQ ID NO: 396512 - protein, 9 aa, Homo Sapiens
VKEKGHINC

SEQ ID NO: 396513 - protein, 9 aa, Homo Sapiens
DAGCIFMEE

SEQ ID NO: 396514 - protein, 9 aa, Homo Sapiens
RRCSVPGES

SEQ ID NO: 396515 - protein, 9 aa, Homo Sapiens
GSRCYEHQR

SEQ ID NO: 396516 - protein, 9 aa, Homo Sapiens
LSTSVSFAA

SEQ ID NO: 396517 - protein, 9 aa, Homo Sapiens
SPHSTTARN

SEQ ID NO: 396518 - protein, 9 aa, Homo Sapiens
HTSETSHLP

SEQ ID NO: 396519 - protein, 9 aa, Homo Sapiens
RYFSNPISL

SEQ ID NO: 396520 - protein, 9 aa, Homo Sapiens
TSLTRQATG

SEQ ID NO: 396521 - protein, 9 aa, Homo Sapiens
STSSAGAGA

SEQ ID NO: 396522 - protein, 9 aa, Homo Sapiens
GSRGERGPQ

SEQ ID NO: 396523 - protein, 9 aa, Homo Sapiens
AQAGARTPR

SEQ ID NO: 396524 - protein, 9 aa, Homo Sapiens
NAMDAAGGD

SEQ ID NO: 396525 - protein, 9 aa, Homo Sapiens
PVLRSSDKR

SEQ ID NO: 396526 - protein, 9 aa, Homo Sapiens
GCPRDEEWA

SEQ ID NO: 396527 - protein, 9 aa, Homo Sapiens
TQEVEIGTV

SEQ ID NO: 396528 - protein, 9 aa, Homo Sapiens
HLWQRVMLK

SEQ ID NO: 396529 - protein, 9 aa, Homo Sapiens
EVYFLWNYM

SEQ ID NO: 396530 - protein, 9 aa, Homo Sapiens
GSRGTLFTR

SEQ ID NO: 396531 - protein, 9 aa, Homo Sapiens
CLFSLSNPS

SEQ ID NO: 396532 - protein, 9 aa, Homo Sapiens
SPGTAWSPW

SEQ ID NO: 396533 - protein, 9 aa, Homo Sapiens
RKKENENRK

SEQ ID NO: 396534 - protein, 9 aa, Homo Sapiens
PRLRFCAWP

SEQ ID NO: 396535 - protein, 9 aa, Homo Sapiens
SALHPSLCL

SEQ ID NO: 396536 - protein, 9 aa, Homo Sapiens
VATPGRPWP

SEQ ID NO: 396537 - protein, 9 aa, Homo Sapiens
DAPPLSTLS

SEQ ID NO: 396538 - protein, 9 aa, Homo Sapiens
IVCCLNLRN

SEQ ID NO: 396539 - protein, 9 aa, Homo Sapiens
DATSMKFPV

SEQ ID NO: 396540 - protein, 9 aa, Homo Sapiens
ICAGTAFYI

SEQ ID NO: 396541 - protein, 9 aa, Homo Sapiens
TRAARASSQ

SEQ ID NO: 396542 - protein, 9 aa, Homo Sapiens
GSWPPALWA

SEQ ID NO: 396543 - protein, 9 aa, Homo Sapiens
LEVMFRLYD

SEQ ID NO: 396544 - protein, 9 aa, Homo Sapiens
LNPVADIYN

SEQ ID NO: 396545 - protein, 9 aa, Homo Sapiens
IAHSEIFMD

SEQ ID NO: 396546 - protein, 9 aa, Homo Sapiens
LLDLPILDD

SEQ ID NO: 396547 - protein, 9 aa, Homo Sapiens
GRCLLLWPT

SEQ ID NO: 396548 - protein, 9 aa, Homo Sapiens
VLARFYSPS

SEQ ID NO: 396549 - protein, 9 aa, Homo Sapiens
LSFGESDCC

SEQ ID NO: 396550 - protein, 9 aa, Homo Sapiens
TKILILIMK

SEQ ID NO: 396551 - protein, 9 aa, Homo Sapiens
KKCRLFYKD

SEQ ID NO: 396552 - protein, 9 aa, Homo Sapiens
GTRGASFAI

SEQ ID NO: 396553 - protein, 9 aa, Homo Sapiens
TSLSSSSTG

SEQ ID NO: 396554 - protein, 9 aa, Homo Sapiens
GENEQEKKC

SEQ ID NO: 396555 - protein, 9 aa, Homo Sapiens
FAQAGAFLR

SEQ ID NO: 396556 - protein, 9 aa, Homo Sapiens
SCDECGMRF

SEQ ID NO: 396557 - protein, 9 aa, Homo Sapiens
QDLFTDDSY

SEQ ID NO: 396558 - protein, 9 aa, Homo Sapiens
CCNTENPPD

SEQ ID NO: 396559 - protein, 9 aa, Homo Sapiens
LPTSGLGAP

SEQ ID NO: 396560 - protein, 9 aa, Homo Sapiens
QGQSCIHQP

SEQ ID NO: 396561 - protein, 9 aa, Homo Sapiens
PTATAASAR

SEQ ID NO: 396562 - protein, 9 aa, Homo Sapiens
RQYVSSEGT

SEQ ID NO: 396563 - protein, 9 aa, Homo Sapiens
AAALALDVA

SEQ ID NO: 396564 - protein, 9 aa, Homo Sapiens
ARSTRFTAV

SEQ ID NO: 396565 - protein, 9 aa, Homo Sapiens
PWNLERTTP

SEQ ID NO: 396566 - protein, 9 aa, Homo Sapiens
FQAMLRWLL

SEQ ID NO: 396567 - protein, 9 aa, Homo Sapiens
LPNTEEKSK

SEQ ID NO: 396568 - protein, 9 aa, Homo Sapiens
SYGLLGDGI

SEQ ID NO: 396569 - protein, 9 aa, Homo Sapiens
ARAKLTPGR

SEQ ID NO: 396570 - protein, 9 aa, Homo Sapiens
LLKTFIRWT

SEQ ID NO: 396571 - protein, 9 aa, Homo Sapiens
NITLDDVSA

SEQ ID NO: 396572 - protein, 9 aa, Homo Sapiens
LLISWRMEA

SEQ ID NO: 396573 - protein, 9 aa, Homo Sapiens
VENTVDTAS

SEQ ID NO: 396574 - protein, 9 aa, Homo Sapiens
SSLSFLSSR

SEQ ID NO: 396575 - protein, 9 aa, Homo Sapiens
VFADNPTSC

SEQ ID NO: 396576 - protein, 9 aa, Homo Sapiens
RLSLRLKWI

SEQ ID NO: 396577 - protein, 9 aa, Homo Sapiens
DTVKNAEPT

SEQ ID NO: 396578 - protein, 9 aa, Homo Sapiens
MITFIGFFS

SEQ ID NO: 396579 - protein, 9 aa, Homo Sapiens
WMDKETTQA

SEQ ID NO: 396580 - protein, 9 aa, Homo Sapiens
VANMLSVAW

SEQ ID NO: 396581 - protein, 9 aa, Homo Sapiens
MYGLWTPIL

SEQ ID NO: 396582 - protein, 9 aa, Homo Sapiens
EIQKHKRLE

SEQ ID NO: 396583 - protein, 9 aa, Homo Sapiens
GTRGTNFTR

SEQ ID NO: 396584 - protein, 9 aa, Homo Sapiens
NHMHFHYDE

SEQ ID NO: 396585 - protein, 9 aa, Homo Sapiens
GSAWQSGGR

SEQ ID NO: 396586 - protein, 9 aa, Homo Sapiens
EVTIHWILM

SEQ ID NO: 396587 - protein, 9 aa, Homo Sapiens
HMRTHNGER

SEQ ID NO: 396588 - protein, 9 aa, Homo Sapiens
TAQKLADAI

SEQ ID NO: 396589 - protein, 9 aa, Homo Sapiens
HVDFQLVLP

SEQ ID NO: 396590 - protein, 9 aa, Homo Sapiens
TTSSSGTSR

SEQ ID NO: 396591 - protein, 9 aa, Homo Sapiens
MKDPRVLVP

SEQ ID NO: 396592 - protein, 9 aa, Homo Sapiens
GLTTVTLGA

SEQ ID NO: 396593 - protein, 9 aa, Homo Sapiens
KTREASLSS

SEQ ID NO: 396594 - protein, 9 aa, Homo Sapiens
VPLLDPVHQ

SEQ ID NO: 396595 - protein, 9 aa, Homo Sapiens
RKKAVSNID

SEQ ID NO: 396596 - protein, 9 aa, Homo Sapiens
EQQMIFAPE

SEQ ID NO: 396597 - protein, 9 aa, Homo Sapiens
MNPMIYTLH

SEQ ID NO: 396598 - protein, 9 aa, Homo Sapiens
LFRKKKEVP

SEQ ID NO: 396599 - protein, 9 aa, Homo Sapiens
QVLKKILRS

SEQ ID NO: 396600 - protein, 9 aa, Homo Sapiens
VGFNPRLSR

SEQ ID NO: 396601 - protein, 9 aa, Homo Sapiens
RARGTSIAF

SEQ ID NO: 396602 - protein, 9 aa, Homo Sapiens
SEADKNDKS

SEQ ID NO: 396603 - protein, 9 aa, Homo Sapiens
PCPEETAMR

SEQ ID NO: 396604 - protein, 9 aa, Homo Sapiens
TTHTLGTFR

SEQ ID NO: 396605 - protein, 9 aa, Homo Sapiens
SPHSSPPVG

SEQ ID NO: 396606 - protein, 9 aa, Homo Sapiens
VGPEGVALK

SEQ ID NO: 396607 - protein, 9 aa, Homo Sapiens
QRVCGLEEQ

SEQ ID NO: 396608 - protein, 9 aa, Homo Sapiens
GSPSRAHLW

SEQ ID NO: 396609 - protein, 9 aa, Homo Sapiens
VFGALGPIS

SEQ ID NO: 396610 - protein, 9 aa, Homo Sapiens
LNDLAAYHA

SEQ ID NO: 396611 - protein, 9 aa, Homo Sapiens
DFLTNKIAE

SEQ ID NO: 396612 - protein, 9 aa, Homo Sapiens
DAEDFEKHE

SEQ ID NO: 396613 - protein, 9 aa, Homo Sapiens
MDHVKAREV

SEQ ID NO: 396614 - protein, 9 aa, Homo Sapiens
STSRTISTR

SEQ ID NO: 396615 - protein, 9 aa, Homo Sapiens
GPPTRKPPH

SEQ ID NO: 396616 - protein, 9 aa, Homo Sapiens
QNIMATMIN

SEQ ID NO: 396617 - protein, 9 aa, Homo Sapiens
TTLARGSGQ

SEQ ID NO: 396618 - protein, 9 aa, Homo Sapiens
YSAFFKPQI

SEQ ID NO: 396619 - protein, 9 aa, Homo Sapiens
CAPVPAPYS

SEQ ID NO: 396620 - protein, 9 aa, Homo Sapiens
RAGWSPSPS

SEQ ID NO: 396621 - protein, 9 aa, Homo Sapiens
THSRNITVQ

SEQ ID NO: 396622 - protein, 9 aa, Homo Sapiens
KVWVNLIGR

SEQ ID NO: 396623 - protein, 9 aa, Homo Sapiens
WKIVLWAAA

SEQ ID NO: 396624 - protein, 9 aa, Homo Sapiens
VMAGTILSG

SEQ ID NO: 396625 - protein, 9 aa, Homo Sapiens
QNVFHTNPL

SEQ ID NO: 396626 - protein, 9 aa, Homo Sapiens
VLLAPATPP

SEQ ID NO: 396627 - protein, 9 aa, Homo Sapiens
FILNTENKF

SEQ ID NO: 396628 - protein, 9 aa, Homo Sapiens
TGLSWEPIH

SEQ ID NO: 396629 - protein, 9 aa, Homo Sapiens
NRGLPLPPP

SEQ ID NO: 396630 - protein, 9 aa, Homo Sapiens
SQTRLPALP

SEQ ID NO: 396631 - protein, 9 aa, Homo Sapiens
FLHHRPKPM

SEQ ID NO: 396632 - protein, 9 aa, Homo Sapiens
PYSSGALPD

SEQ ID NO: 396633 - protein, 9 aa, Homo Sapiens
FNKKRKKMF

SEQ ID NO: 396634 - protein, 9 aa, Homo Sapiens
HSADKPHKC

SEQ ID NO: 396635 - protein, 9 aa, Homo Sapiens
IHNSVKKTA

SEQ ID NO: 396636 - protein, 9 aa, Homo Sapiens
AREGSAPIQ

SEQ ID NO: 396637 - protein, 9 aa, Homo Sapiens
VPRQLPGPH

SEQ ID NO: 396638 - protein, 9 aa, Homo Sapiens
VVLLVHLWQ

SEQ ID NO: 396639 - protein, 9 aa, Homo Sapiens
IFAPEESEA

SEQ ID NO: 396640 - protein, 9 aa, Homo Sapiens
LALCATGKN

SEQ ID NO: 396641 - protein, 9 aa, Homo Sapiens
NNRMVSRRT

SEQ ID NO: 396642 - protein, 9 aa, Homo Sapiens
TDSNKQNLW

SEQ ID NO: 396643 - protein, 9 aa, Homo Sapiens
DAPPANLGD

SEQ ID NO: 396644 - protein, 9 aa, Homo Sapiens
CDYNVSRDQ

SEQ ID NO: 396645 - protein, 9 aa, Homo Sapiens
SIRRHLFSQ

SEQ ID NO: 396646 - protein, 9 aa, Homo Sapiens
FVPPPPWLL

SEQ ID NO: 396647 - protein, 9 aa, Homo Sapiens
SPTQSTEHQ

SEQ ID NO: 396648 - protein, 9 aa, Homo Sapiens
SSCNYIQCE

SEQ ID NO: 396649 - protein, 9 aa, Homo Sapiens
ARGALATGS

SEQ ID NO: 396650 - protein, 9 aa, Homo Sapiens
PKSDVKIHV

SEQ ID NO: 396651 - protein, 9 aa, Homo Sapiens
SGNETAFSG

SEQ ID NO: 396652 - protein, 9 aa, Homo Sapiens
HSATMGSDP

SEQ ID NO: 396653 - protein, 9 aa, Homo Sapiens
VWAVLAWAR

SEQ ID NO: 396654 - protein, 9 aa, Homo Sapiens
FGGPDGFGP

SEQ ID NO: 396655 - protein, 9 aa, Homo Sapiens
YKKKKPKKK

SEQ ID NO: 396656 - protein, 9 aa, Homo Sapiens
LHHGTRRPR

SEQ ID NO: 396657 - protein, 9 aa, Homo Sapiens
CSLDTKSKL

SEQ ID NO: 396658 - protein, 9 aa, Homo Sapiens
QEYMVKEVL

SEQ ID NO: 396659 - protein, 9 aa, Homo Sapiens
DAILSSNSE

SEQ ID NO: 396660 - protein, 9 aa, Homo Sapiens
IIETLRQKS

SEQ ID NO: 396661 - protein, 9 aa, Homo Sapiens
PPSPIKWNG

SEQ ID NO: 396662 - protein, 9 aa, Homo Sapiens
ALFTSLASG

SEQ ID NO: 396663 - protein, 9 aa, Homo Sapiens
KSWISVPCP

SEQ ID NO: 396664 - protein, 9 aa, Homo Sapiens
DRKPPNGLI

SEQ ID NO: 396665 - protein, 9 aa, Homo Sapiens
EEMKALQCT

SEQ ID NO: 396666 - protein, 9 aa, Homo Sapiens
VRAPEVARG

SEQ ID NO: 396667 - protein, 9 aa, Homo Sapiens
SIIIITFFF

SEQ ID NO: 396668 - protein, 9 aa, Homo Sapiens
ILGVCATQH

SEQ ID NO: 396669 - protein, 9 aa, Homo Sapiens
DYKMKKREV

SEQ ID NO: 396670 - protein, 9 aa, Homo Sapiens
IQVGQRTLV

SEQ ID NO: 396671 - protein, 9 aa, Homo Sapiens
FVPHRPQDR

SEQ ID NO: 396672 - protein, 9 aa, Homo Sapiens
STRGTSAAA

SEQ ID NO: 396673 - protein, 9 aa, Homo Sapiens
VTLDGTDVL

SEQ ID NO: 396674 - protein, 9 aa, Homo Sapiens
AARNVQLVT

SEQ ID NO: 396675 - protein, 9 aa, Homo Sapiens
LLKGKGIEK

SEQ ID NO: 396676 - protein, 9 aa, Homo Sapiens
KYSSYPVHH

SEQ ID NO: 396677 - protein, 9 aa, Homo Sapiens
IGFTMMSLA

SEQ ID NO: 396678 - protein, 9 aa, Homo Sapiens
MVMILVVDT

SEQ ID NO: 396679 - protein, 9 aa, Homo Sapiens
EERQINHTA

SEQ ID NO: 396680 - protein, 9 aa, Homo Sapiens
YPVESSWIT

SEQ ID NO: 396681 - protein, 9 aa, Homo Sapiens
LSALFIWPQ

SEQ ID NO: 396682 - protein, 9 aa, Homo Sapiens
GSTPPRAPA

SEQ ID NO: 396683 - protein, 9 aa, Homo Sapiens
EEPRKGLWE

SEQ ID NO: 396684 - protein, 9 aa, Homo Sapiens
SGTREARST

SEQ ID NO: 396685 - protein, 9 aa, Homo Sapiens
RVCSHCPRP

SEQ ID NO: 396686 - protein, 9 aa, Homo Sapiens
TPGGFSKVM

SEQ ID NO: 396687 - protein, 9 aa, Homo Sapiens
KTWTQFRNY

SEQ ID NO: 396688 - protein, 9 aa, Homo Sapiens
DDQIQWPTV

SEQ ID NO: 396689 - protein, 9 aa, Homo Sapiens
EARARLQAR

SEQ ID NO: 396690 - protein, 9 aa, Homo Sapiens
LGVCATQHQ

SEQ ID NO: 396691 - protein, 9 aa, Homo Sapiens
QVCVLSAPP

SEQ ID NO: 396692 - protein, 9 aa, Homo Sapiens
GLEWRVSLY

SEQ ID NO: 396693 - protein, 9 aa, Homo Sapiens
GTSRAAGTT

SEQ ID NO: 396694 - protein, 9 aa, Homo Sapiens
SGVKSQIQA

SEQ ID NO: 396695 - protein, 9 aa, Homo Sapiens
SGETKTISH

SEQ ID NO: 396696 - protein, 9 aa, Homo Sapiens
THAALYLLG

SEQ ID NO: 396697 - protein, 9 aa, Homo Sapiens
AQWAPAASP

SEQ ID NO: 396698 - protein, 9 aa, Homo Sapiens
VQVVRAREA

SEQ ID NO: 396699 - protein, 9 aa, Homo Sapiens
NGRSEVSLK

SEQ ID NO: 396700 - protein, 9 aa, Homo Sapiens
TQLGNITEP

SEQ ID NO: 396701 - protein, 9 aa, Homo Sapiens
MLVFKGKRH

SEQ ID NO: 396702 - protein, 9 aa, Homo Sapiens
PPTTSNRHW

SEQ ID NO: 396703 - protein, 9 aa, Homo Sapiens
CVQEDCHIP

SEQ ID NO: 396704 - protein, 9 aa, Homo Sapiens
EHMETKQNV

SEQ ID NO: 396705 - protein, 9 aa, Homo Sapiens
MPPCSCTFV

SEQ ID NO: 396706 - protein, 9 aa, Homo Sapiens
IPPAWDVCK

SEQ ID NO: 396707 - protein, 9 aa, Homo Sapiens
RRMEPLPPR

SEQ ID NO: 396708 - protein, 9 aa, Homo Sapiens
PEEEAPMRE

SEQ ID NO: 396709 - protein, 9 aa, Homo Sapiens
EGRSREGQS

SEQ ID NO: 396710 - protein, 9 aa, Homo Sapiens
KAFSWKCRL

SEQ ID NO: 396711 - protein, 9 aa, Homo Sapiens
PCGSPQIQA

SEQ ID NO: 396712 - protein, 9 aa, Homo Sapiens
TFFPTLLPL

SEQ ID NO: 396713 - protein, 9 aa, Homo Sapiens
IQFILFGPF

SEQ ID NO: 396714 - protein, 9 aa, Homo Sapiens
LARGSGQAS

SEQ ID NO: 396715 - protein, 9 aa, Homo Sapiens
PSLYKKKKP

SEQ ID NO: 396716 - protein, 9 aa, Homo Sapiens
TAGMAHIFL

SEQ ID NO: 396717 - protein, 9 aa, Homo Sapiens
ENKILFCVD

SEQ ID NO: 396718 - protein, 9 aa, Homo Sapiens
REKVPCLCL

SEQ ID NO: 396719 - protein, 9 aa, Homo Sapiens
ITLYVFLGI

SEQ ID NO: 396720 - protein, 9 aa, Homo Sapiens
PSLPLPLPP

SEQ ID NO: 396721 - protein, 9 aa, Homo Sapiens
PRSRLAAAS

SEQ ID NO: 396722 - protein, 9 aa, Homo Sapiens
CYFCIWKGI

SEQ ID NO: 396723 - protein, 9 aa, Homo Sapiens
QDHLTGLAL

SEQ ID NO: 396724 - protein, 9 aa, Homo Sapiens
VPHTPGTTA

SEQ ID NO: 396725 - protein, 9 aa, Homo Sapiens
ARQVRCLEF

SEQ ID NO: 396726 - protein, 9 aa, Homo Sapiens
TTQPSQKRA

SEQ ID NO: 396727 - protein, 9 aa, Homo Sapiens
DSAVASTED

SEQ ID NO: 396728 - protein, 9 aa, Homo Sapiens
KETSLWFKP

SEQ ID NO: 396729 - protein, 9 aa, Homo Sapiens
PIIETEFHR

SEQ ID NO: 396730 - protein, 9 aa, Homo Sapiens
GPSEKRSRS

SEQ ID NO: 396731 - protein, 9 aa, Homo Sapiens
VIITAGMAH

SEQ ID NO: 396732 - protein, 9 aa, Homo Sapiens
NLHPPRMKD

SEQ ID NO: 396733 - protein, 9 aa, Homo Sapiens
QDRRSSNIS

SEQ ID NO: 396734 - protein, 9 aa, Homo Sapiens
GVSPLAPCP

SEQ ID NO: 396735 - protein, 9 aa, Homo Sapiens
RLSDIFWVV

SEQ ID NO: 396736 - protein, 9 aa, Homo Sapiens
ENDLDQLVE

SEQ ID NO: 396737 - protein, 9 aa, Homo Sapiens
PRKGLWERS

SEQ ID NO: 396738 - protein, 9 aa, Homo Sapiens
RVAKLIHWV

SEQ ID NO: 396739 - protein, 9 aa, Homo Sapiens
KILGEGSVS

SEQ ID NO: 396740 - protein, 9 aa, Homo Sapiens
PSSHLPPQS

SEQ ID NO: 396741 - protein, 9 aa, Homo Sapiens
CHHAQGSVT

SEQ ID NO: 396742 - protein, 9 aa, Homo Sapiens
RDDINRRYD

SEQ ID NO: 396743 - protein, 9 aa, Homo Sapiens
SCAPVPAPY

SEQ ID NO: 396744 - protein, 9 aa, Homo Sapiens
RGTPGVRGP

SEQ ID NO: 396745 - protein, 9 aa, Homo Sapiens
LVPQAVDGW

SEQ ID NO: 396746 - protein, 9 aa, Homo Sapiens
VCRDAPAFY

SEQ ID NO: 396747 - protein, 9 aa, Homo Sapiens
AASHLQQQC

SEQ ID NO: 396748 - protein, 9 aa, Homo Sapiens
NLWQYFEEA

SEQ ID NO: 396749 - protein, 9 aa, Homo Sapiens
FDYPPEFYE

SEQ ID NO: 396750 - protein, 9 aa, Homo Sapiens
VQTQLCLRI

SEQ ID NO: 396751 - protein, 9 aa, Homo Sapiens
FARSTSRAR

SEQ ID NO: 396752 - protein, 9 aa, Homo Sapiens
SSVVEEDVE

SEQ ID NO: 396753 - protein, 9 aa, Homo Sapiens
GLTALLAQG

SEQ ID NO: 396754 - protein, 9 aa, Homo Sapiens
KAFHQSSYL

SEQ ID NO: 396755 - protein, 9 aa, Homo Sapiens
CEKLSTVRK

SEQ ID NO: 396756 - protein, 9 aa, Homo Sapiens
LANHSGCIK

SEQ ID NO: 396757 - protein, 9 aa, Homo Sapiens
HLLTLIIIL

SEQ ID NO: 396758 - protein, 9 aa, Homo Sapiens
YDVPPWLSP

SEQ ID NO: 396759 - protein, 9 aa, Homo Sapiens
PKQQFLSSS

SEQ ID NO: 396760 - protein, 9 aa, Homo Sapiens
SEEVIKAIL

SEQ ID NO: 396761 - protein, 9 aa, Homo Sapiens
DEPSSKTKD

SEQ ID NO: 396762 - protein, 9 aa, Homo Sapiens
DLETCGKQD

SEQ ID NO: 396763 - protein, 9 aa, Homo Sapiens
CHIPQIEDA

SEQ ID NO: 396764 - protein, 9 aa, Homo Sapiens
ILRKCKDRK

SEQ ID NO: 396765 - protein, 9 aa, Homo Sapiens
QCLCCEEEL

SEQ ID NO: 396766 - protein, 9 aa, Homo Sapiens
YSSYPVHHT

SEQ ID NO: 396767 - protein, 9 aa, Homo Sapiens
ITEHVPLGN

SEQ ID NO: 396768 - protein, 9 aa, Homo Sapiens
VASRRRYLQ

SEQ ID NO: 396769 - protein, 9 aa, Homo Sapiens
SWCGTSQTY

SEQ ID NO: 396770 - protein, 9 aa, Homo Sapiens
DEPIIETEF

SEQ ID NO: 396771 - protein, 9 aa, Homo Sapiens
SIQSTTGLQ

SEQ ID NO: 396772 - protein, 9 aa, Homo Sapiens
NDPLYVPDP

SEQ ID NO: 396773 - protein, 9 aa, Homo Sapiens
VGLAASFAV

SEQ ID NO: 396774 - protein, 9 aa, Homo Sapiens
VVIHKAATV

SEQ ID NO: 396775 - protein, 9 aa, Homo Sapiens
MDHSIILRH

SEQ ID NO: 396776 - protein, 9 aa, Homo Sapiens
ILVNLTMKN

SEQ ID NO: 396777 - protein, 9 aa, Homo Sapiens
KKRGKSQGG

SEQ ID NO: 396778 - protein, 9 aa, Homo Sapiens
QHCQHLVDQ

SEQ ID NO: 396779 - protein, 9 aa, Homo Sapiens
QSTIKLVVT

SEQ ID NO: 396780 - protein, 9 aa, Homo Sapiens
SCIHQPCGK

SEQ ID NO: 396781 - protein, 9 aa, Homo Sapiens
CISIILRFE

SEQ ID NO: 396782 - protein, 9 aa, Homo Sapiens
NASEIEVHF

SEQ ID NO: 396783 - protein, 9 aa, Homo Sapiens
RADKGTQED

SEQ ID NO: 396784 - protein, 9 aa, Homo Sapiens
TSSTIISTS

SEQ ID NO: 396785 - protein, 9 aa, Homo Sapiens
GKKKSTKPH

SEQ ID NO: 396786 - protein, 9 aa, Homo Sapiens
CYLCQPDSP

SEQ ID NO: 396787 - protein, 9 aa, Homo Sapiens
VYANECTNF

SEQ ID NO: 396788 - protein, 9 aa, Homo Sapiens
LSIQSTTGL

SEQ ID NO: 396789 - protein, 9 aa, Homo Sapiens
RKCVRDCEK

SEQ ID NO: 396790 - protein, 9 aa, Homo Sapiens
GCEHGGGKF

SEQ ID NO: 396791 - protein, 9 aa, Homo Sapiens
LPTGLYCFP

SEQ ID NO: 396792 - protein, 9 aa, Homo Sapiens
AFSTRLAVS

SEQ ID NO: 396793 - protein, 9 aa, Homo Sapiens
MTKRSPEAP

SEQ ID NO: 396794 - protein, 9 aa, Homo Sapiens
DDSYVQSNC

SEQ ID NO: 396795 - protein, 9 aa, Homo Sapiens
QDVKPEMVM

SEQ ID NO: 396796 - protein, 9 aa, Homo Sapiens
ATVATMFCW

SEQ ID NO: 396797 - protein, 9 aa, Homo Sapiens
ALKRHFTVN

SEQ ID NO: 396798 - protein, 9 aa, Homo Sapiens
WKTTFTVVQ

SEQ ID NO: 396799 - protein, 9 aa, Homo Sapiens
EANERYKVC

SEQ ID NO: 396800 - protein, 9 aa, Homo Sapiens
LAPCPPLEV

SEQ ID NO: 396801 - protein, 9 aa, Homo Sapiens
PQGLTDLEI

SEQ ID NO: 396802 - protein, 9 aa, Homo Sapiens
LPDEPSSKT

SEQ ID NO: 396803 - protein, 9 aa, Homo Sapiens
PHSSHSDIE

SEQ ID NO: 396804 - protein, 9 aa, Homo Sapiens
GLTSALVAT

SEQ ID NO: 396805 - protein, 9 aa, Homo Sapiens
PLARPPRPA

SEQ ID NO: 396806 - protein, 9 aa, Homo Sapiens
PDMVVSQLA

SEQ ID NO: 396807 - protein, 9 aa, Homo Sapiens
NSIRRHLFS

SEQ ID NO: 396808 - protein, 9 aa, Homo Sapiens
HHRPKPMGI

SEQ ID NO: 396809 - protein, 9 aa, Homo Sapiens
RGVWSLEAS

SEQ ID NO: 396810 - protein, 9 aa, Homo Sapiens
CWPRTASSR

SEQ ID NO: 396811 - protein, 9 aa, Homo Sapiens
YLTPLVYLS

SEQ ID NO: 396812 - protein, 9 aa, Homo Sapiens
GPLFLSSAV

SEQ ID NO: 396813 - protein, 9 aa, Homo Sapiens
SETKSIFAS

SEQ ID NO: 396814 - protein, 9 aa, Homo Sapiens
LIPRLPTGL

SEQ ID NO: 396815 - protein, 9 aa, Homo Sapiens
HCQQDVESL

SEQ ID NO: 396816 - protein, 9 aa, Homo Sapiens
FVHQVNRQV

SEQ ID NO: 396817 - protein, 9 aa, Homo Sapiens
LECHSRIHT

SEQ ID NO: 396818 - protein, 9 aa, Homo Sapiens
LFGPFLSMY

SEQ ID NO: 396819 - protein, 9 aa, Homo Sapiens
FGPFLSMYL

SEQ ID NO: 396820 - protein, 9 aa, Homo Sapiens
IMYFLEEPI

SEQ ID NO: 396821 - protein, 9 aa, Homo Sapiens
RLTTHTLGT

SEQ ID NO: 396822 - protein, 9 aa, Homo Sapiens
NWRTAATVN

SEQ ID NO: 396823 - protein, 9 aa, Homo Sapiens
SGSGRARGT

SEQ ID NO: 396824 - protein, 9 aa, Homo Sapiens
GVSQSQLVY

SEQ ID NO: 396825 - protein, 9 aa, Homo Sapiens
CEFPANVPV

SEQ ID NO: 396826 - protein, 9 aa, Homo Sapiens
EETISTIGL

SEQ ID NO: 396827 - protein, 9 aa, Homo Sapiens
KKVTFKASP

SEQ ID NO: 396828 - protein, 9 aa, Homo Sapiens
RKTKMLVKF

SEQ ID NO: 396829 - protein, 9 aa, Homo Sapiens
ARTSGSQCT

SEQ ID NO: 396830 - protein, 9 aa, Homo Sapiens
PEFGSPCPI

SEQ ID NO: 396831 - protein, 9 aa, Homo Sapiens
VVAWLGLWL

SEQ ID NO: 396832 - protein, 9 aa, Homo Sapiens
RRQFSHRDI

SEQ ID NO: 396833 - protein, 9 aa, Homo Sapiens
YQTPAQDTR

SEQ ID NO: 396834 - protein, 9 aa, Homo Sapiens
ILIVSAWDF

SEQ ID NO: 396835 - protein, 9 aa, Homo Sapiens
FYMVRAHAW

SEQ ID NO: 396836 - protein, 9 aa, Homo Sapiens
RETTATRST

SEQ ID NO: 396837 - protein, 9 aa, Homo Sapiens
DVIHWTKEI

SEQ ID NO: 396838 - protein, 9 aa, Homo Sapiens
LRLKWIMLF

SEQ ID NO: 396839 - protein, 9 aa, Homo Sapiens
EEEAPMRED

SEQ ID NO: 396840 - protein, 9 aa, Homo Sapiens
EKHLMEKKI

SEQ ID NO: 396841 - protein, 9 aa, Homo Sapiens
GPEGVALKL

SEQ ID NO: 396842 - protein, 9 aa, Homo Sapiens
DPLDRCYST

SEQ ID NO: 396843 - protein, 9 aa, Homo Sapiens
NLSELDIVE

SEQ ID NO: 396844 - protein, 9 aa, Homo Sapiens
ALRVSPVRN

SEQ ID NO: 396845 - protein, 9 aa, Homo Sapiens
TKMLVKFLL

SEQ ID NO: 396846 - protein, 9 aa, Homo Sapiens
EMVMLYPEL

SEQ ID NO: 396847 - protein, 9 aa, Homo Sapiens
CMVLGLQFL

SEQ ID NO: 396848 - protein, 9 aa, Homo Sapiens
ARSPPAAVL

SEQ ID NO: 396849 - protein, 9 aa, Homo Sapiens
SRRSQTKWR

SEQ ID NO: 396850 - protein, 9 aa, Homo Sapiens
IGDENVTLD

SEQ ID NO: 396851 - protein, 9 aa, Homo Sapiens
PECCSSWLR

SEQ ID NO: 396852 - protein, 9 aa, Homo Sapiens
EALGSWGQT

SEQ ID NO: 396853 - protein, 9 aa, Homo Sapiens
TILTGGTRG

SEQ ID NO: 396854 - protein, 9 aa, Homo Sapiens
VPIDTSDVE

SEQ ID NO: 396855 - protein, 9 aa, Homo Sapiens
FLFLFYLSL

SEQ ID NO: 396856 - protein, 9 aa, Homo Sapiens
CLEFNQAMD

SEQ ID NO: 396857 - protein, 9 aa, Homo Sapiens
EEKGEAEEA

SEQ ID NO: 396858 - protein, 9 aa, Homo Sapiens
YLSLPKIRS

SEQ ID NO: 396859 - protein, 9 aa, Homo Sapiens
GDIQVGQRT

SEQ ID NO: 396860 - protein, 9 aa, Homo Sapiens
VELPQKNQR

SEQ ID NO: 396861 - protein, 9 aa, Homo Sapiens
INSPVGDIP

SEQ ID NO: 396862 - protein, 9 aa, Homo Sapiens
PGPPCLPLA

SEQ ID NO: 396863 - protein, 9 aa, Homo Sapiens
QNTGFPFSA

SEQ ID NO: 396864 - protein, 9 aa, Homo Sapiens
LGLAARNVQ

SEQ ID NO: 396865 - protein, 9 aa, Homo Sapiens
ESEAEAQVP

SEQ ID NO: 396866 - protein, 9 aa, Homo Sapiens
FSQTRLPAL

SEQ ID NO: 396867 - protein, 9 aa, Homo Sapiens
IRTRAARAS

SEQ ID NO: 396868 - protein, 9 aa, Homo Sapiens
TCQAWLSMT

SEQ ID NO: 396869 - protein, 9 aa, Homo Sapiens
HLHLVQVDL

SEQ ID NO: 396870 - protein, 9 aa, Homo Sapiens
LFTSLASGT

SEQ ID NO: 396871 - protein, 9 aa, Homo Sapiens
MGGGGDATP

SEQ ID NO: 396872 - protein, 9 aa, Homo Sapiens
IQLTMNDSK

SEQ ID NO: 396873 - protein, 9 aa, Homo Sapiens
ARQRQTRCQ

SEQ ID NO: 396874 - protein, 9 aa, Homo Sapiens
LAMMGPSPD

SEQ ID NO: 396875 - protein, 9 aa, Homo Sapiens
MKSGPEIVN

SEQ ID NO: 396876 - protein, 9 aa, Homo Sapiens
QAEKEVKRK

SEQ ID NO: 396877 - protein, 9 aa, Homo Sapiens
CSHTNLCLK

SEQ ID NO: 396878 - protein, 9 aa, Homo Sapiens
CPECGRWFS

SEQ ID NO: 396879 - protein, 9 aa, Homo Sapiens
LPGPHDDFV

SEQ ID NO: 396880 - protein, 9 aa, Homo Sapiens
AHVWLLPGM

SEQ ID NO: 396881 - protein, 9 aa, Homo Sapiens
PTRSSPRLR

SEQ ID NO: 396882 - protein, 9 aa, Homo Sapiens
RQFGENRTN

SEQ ID NO: 396883 - protein, 9 aa, Homo Sapiens
EKECEHRVA

SEQ ID NO: 396884 - protein, 9 aa, Homo Sapiens
IRWLLCFTR

SEQ ID NO: 396885 - protein, 9 aa, Homo Sapiens
SWARPPALT

SEQ ID NO: 396886 - protein, 9 aa, Homo Sapiens
NIIRFLPMT

SEQ ID NO: 396887 - protein, 9 aa, Homo Sapiens
LPCVLPHVD

SEQ ID NO: 396888 - protein, 9 aa, Homo Sapiens
LKSWISVPC

SEQ ID NO: 396889 - protein, 9 aa, Homo Sapiens
VASPGRRDP

SEQ ID NO: 396890 - protein, 9 aa, Homo Sapiens
KKRKKMFLI

SEQ ID NO: 396891 - protein, 9 aa, Homo Sapiens
TDDVSEFIQ

SEQ ID NO: 396892 - protein, 9 aa, Homo Sapiens
TISTRGSFL

SEQ ID NO: 396893 - protein, 9 aa, Homo Sapiens
LRQKSEADK

SEQ ID NO: 396894 - protein, 9 aa, Homo Sapiens
RTHSLEVTQ

SEQ ID NO: 396895 - protein, 9 aa, Homo Sapiens
PVWAVLAWA

SEQ ID NO: 396896 - protein, 9 aa, Homo Sapiens
SILQAIRKT

SEQ ID NO: 396897 - protein, 9 aa, Homo Sapiens
CRDAPAFYE

SEQ ID NO: 396898 - protein, 9 aa, Homo Sapiens
RGTTFTTCS

SEQ ID NO: 396899 - protein, 9 aa, Homo Sapiens
EVHFVTRNK

SEQ ID NO: 396900 - protein, 9 aa, Homo Sapiens
EGVPGQEFP

SEQ ID NO: 396901 - protein, 9 aa, Homo Sapiens
EDVENTVDT

SEQ ID NO: 396902 - protein, 9 aa, Homo Sapiens
SPGLGSRID

SEQ ID NO: 396903 - protein, 9 aa, Homo Sapiens
TMITFIGFF

SEQ ID NO: 396904 - protein, 9 aa, Homo Sapiens
INGSLPSFS

SEQ ID NO: 396905 - protein, 9 aa, Homo Sapiens
RKPPHRTSS

SEQ ID NO: 396906 - protein, 9 aa, Homo Sapiens
DHLGPVTAV

SEQ ID NO: 396907 - protein, 9 aa, Homo Sapiens
LPPPVWAVL

SEQ ID NO: 396908 - protein, 9 aa, Homo Sapiens
EGDWKTILK

SEQ ID NO: 396909 - protein, 9 aa, Homo Sapiens
GLVIYDWLH

SEQ ID NO: 396910 - protein, 9 aa, Homo Sapiens
NRPMSPSPV

SEQ ID NO: 396911 - protein, 9 aa, Homo Sapiens
LYKVPLDYI

SEQ ID NO: 396912 - protein, 9 aa, Homo Sapiens
PSHQDIIKV

SEQ ID NO: 396913 - protein, 9 aa, Homo Sapiens
NIMATMIND

SEQ ID NO: 396914 - protein, 9 aa, Homo Sapiens
PKEEQKMQS

SEQ ID NO: 396915 - protein, 9 aa, Homo Sapiens
GLVVDMGHG

SEQ ID NO: 396916 - protein, 9 aa, Homo Sapiens
GSSRGTSIT

SEQ ID NO: 396917 - protein, 9 aa, Homo Sapiens
NAPPAGHQE

SEQ ID NO: 396918 - protein, 9 aa, Homo Sapiens
VATALFLHP

SEQ ID NO: 396919 - protein, 9 aa, Homo Sapiens
DAGVGHAQD

SEQ ID NO: 396920 - protein, 9 aa, Homo Sapiens
VDVIKKAYM

SEQ ID NO: 396921 - protein, 9 aa, Homo Sapiens
KPLSATPVE

SEQ ID NO: 396922 - protein, 9 aa, Homo Sapiens
LTELQFHNQ

SEQ ID NO: 396923 - protein, 9 aa, Homo Sapiens
VESLADLTD

SEQ ID NO: 396924 - protein, 9 aa, Homo Sapiens
PIHANPECR

SEQ ID NO: 396925 - protein, 9 aa, Homo Sapiens
SSDSSPKKQ

SEQ ID NO: 396926 - protein, 9 aa, Homo Sapiens
VQRRYSDFE

SEQ ID NO: 396927 - protein, 9 aa, Homo Sapiens
RCDNMCVFK

SEQ ID NO: 396928 - protein, 9 aa, Homo Sapiens
RRKRRSSWS

SEQ ID NO: 396929 - protein, 9 aa, Homo Sapiens
ASHLPRPTT

SEQ ID NO: 396930 - protein, 9 aa, Homo Sapiens
LTQNRMTVT

SEQ ID NO: 396931 - protein, 9 aa, Homo Sapiens
SKATFGTSL

SEQ ID NO: 396932 - protein, 9 aa, Homo Sapiens
VFYHDGEIL

SEQ ID NO: 396933 - protein, 9 aa, Homo Sapiens
SLQCLCCEE

SEQ ID NO: 396934 - protein, 9 aa, Homo Sapiens
RTKREPNKF

SEQ ID NO: 396935 - protein, 9 aa, Homo Sapiens
WSTDDVSEF

SEQ ID NO: 396936 - protein, 9 aa, Homo Sapiens
RIWVPAQVE

SEQ ID NO: 396937 - protein, 9 aa, Homo Sapiens
LAMNYNLSE

SEQ ID NO: 396938 - protein, 9 aa, Homo Sapiens
CCLCNPGVF

SEQ ID NO: 396939 - protein, 9 aa, Homo Sapiens
LLCVTPEKI

SEQ ID NO: 396940 - protein, 9 aa, Homo Sapiens
GLFDILIKS

SEQ ID NO: 396941 - protein, 9 aa, Homo Sapiens
SRSTNITNG

SEQ ID NO: 396942 - protein, 9 aa, Homo Sapiens
DIFWVVPFI

SEQ ID NO: 396943 - protein, 9 aa, Homo Sapiens
NQNTGFPFS

SEQ ID NO: 396944 - protein, 9 aa, Homo Sapiens
YMLSILKYL

SEQ ID NO: 396945 - protein, 9 aa, Homo Sapiens
SAWDFRLWN

SEQ ID NO: 396946 - protein, 9 aa, Homo Sapiens
ASCSRGARG

SEQ ID NO: 396947 - protein, 9 aa, Homo Sapiens
HRLGSTFSL

SEQ ID NO: 396948 - protein, 9 aa, Homo Sapiens
FTPKSDVKI

SEQ ID NO: 396949 - protein, 9 aa, Homo Sapiens
VRLEDSCQK

SEQ ID NO: 396950 - protein, 9 aa, Homo Sapiens
TLTELQFHN

SEQ ID NO: 396951 - protein, 9 aa, Homo Sapiens
SGGRRLLTI

SEQ ID NO: 396952 - protein, 9 aa, Homo Sapiens
DGQHVVDGD

SEQ ID NO: 396953 - protein, 9 aa, Homo Sapiens
WKSGSWHPI

SEQ ID NO: 396954 - protein, 9 aa, Homo Sapiens
PWAKNRGSG

SEQ ID NO: 396955 - protein, 9 aa, Homo Sapiens
QRTLVILGV

SEQ ID NO: 396956 - protein, 9 aa, Homo Sapiens
RGRHWRCLR

SEQ ID NO: 396957 - protein, 9 aa, Homo Sapiens
HPSLCLFSL

SEQ ID NO: 396958 - protein, 9 aa, Homo Sapiens
SFFHAYYYY

SEQ ID NO: 396959 - protein, 9 aa, Homo Sapiens
FKGNTQKMF

SEQ ID NO: 396960 - protein, 9 aa, Homo Sapiens
GAEESAKEI

SEQ ID NO: 396961 - protein, 9 aa, Homo Sapiens
LGGFACPWP

SEQ ID NO: 396962 - protein, 9 aa, Homo Sapiens
KKCSLYGKK

SEQ ID NO: 396963 - protein, 9 aa, Homo Sapiens
LFACLTLVT

SEQ ID NO: 396964 - protein, 9 aa, Homo Sapiens
GETKTISHF

SEQ ID NO: 396965 - protein, 9 aa, Homo Sapiens
RIVLLCKDD

SEQ ID NO: 396966 - protein, 9 aa, Homo Sapiens
RQPVQIQSQ

SEQ ID NO: 396967 - protein, 9 aa, Homo Sapiens
NNQIIVNTV

SEQ ID NO: 396968 - protein, 9 aa, Homo Sapiens
LKALVKTWT

SEQ ID NO: 396969 - protein, 9 aa, Homo Sapiens
SRGTSITLS

SEQ ID NO: 396970 - protein, 9 aa, Homo Sapiens
PGPRGGHPQ

SEQ ID NO: 396971 - protein, 9 aa, Homo Sapiens
FFFKIFIFL

SEQ ID NO: 396972 - protein, 9 aa, Homo Sapiens
AALPRCPPR

SEQ ID NO: 396973 - protein, 9 aa, Homo Sapiens
ARSPTSSPT

SEQ ID NO: 396974 - protein, 9 aa, Homo Sapiens
VVEDGQHVV

SEQ ID NO: 396975 - protein, 9 aa, Homo Sapiens
NMTIPSKLW

SEQ ID NO: 396976 - protein, 9 aa, Homo Sapiens
LKREDKSIL

SEQ ID NO: 396977 - protein, 9 aa, Homo Sapiens
ASRPTAAYW

SEQ ID NO: 396978 - protein, 9 aa, Homo Sapiens
PRWTSATWG

SEQ ID NO: 396979 - protein, 9 aa, Homo Sapiens
YVLWLLITT

SEQ ID NO: 396980 - protein, 9 aa, Homo Sapiens
FFGCTKKLR

SEQ ID NO: 396981 - protein, 9 aa, Homo Sapiens
LEALLSTRF

SEQ ID NO: 396982 - protein, 9 aa, Homo Sapiens
SADDELANL

SEQ ID NO: 396983 - protein, 9 aa, Homo Sapiens
SISTRVSSR

SEQ ID NO: 396984 - protein, 9 aa, Homo Sapiens
KSVLGALGS

SEQ ID NO: 396985 - protein, 9 aa, Homo Sapiens
KKQHSMPRL

SEQ ID NO: 396986 - protein, 9 aa, Homo Sapiens
SRHPPGSPS

SEQ ID NO: 396987 - protein, 9 aa, Homo Sapiens
EWSLPINPA

SEQ ID NO: 396988 - protein, 9 aa, Homo Sapiens
SRARGSLNT

SEQ ID NO: 396989 - protein, 9 aa, Homo Sapiens
YTEFTPLKK

SEQ ID NO: 396990 - protein, 9 aa, Homo Sapiens
KGLWERSPG

SEQ ID NO: 396991 - protein, 9 aa, Homo Sapiens
PALPTSGLG

SEQ ID NO: 396992 - protein, 9 aa, Homo Sapiens
GVLHTAAWS

SEQ ID NO: 396993 - protein, 9 aa, Homo Sapiens
RINKPEGKP

SEQ ID NO: 396994 - protein, 9 aa, Homo Sapiens
IWTPWRKSG

SEQ ID NO: 396995 - protein, 9 aa, Homo Sapiens
GQPAGHLHL

SEQ ID NO: 396996 - protein, 9 aa, Homo Sapiens
GASVAAVAA

SEQ ID NO: 396997 - protein, 9 aa, Homo Sapiens
ALKNPMFLF

SEQ ID NO: 396998 - protein, 9 aa, Homo Sapiens
SLWCPVGKK

SEQ ID NO: 396999 - protein, 9 aa, Homo Sapiens
TSMKFPVRL

SEQ ID NO: 397000 - protein, 9 aa, Homo Sapiens
FGASRARRT

SEQ ID NO: 397001 - protein, 9 aa, Homo Sapiens
RYVHDRSET

SEQ ID NO: 397002 - protein, 9 aa, Homo Sapiens
RSRCPSLLR

SEQ ID NO: 397003 - protein, 9 aa, Homo Sapiens
AIELGCDEG

SEQ ID NO: 397004 - protein, 9 aa, Homo Sapiens
KELDAPPAN

SEQ ID NO: 397005 - protein, 9 aa, Homo Sapiens
TQKMFSPKK

SEQ ID NO: 397006 - protein, 9 aa, Homo Sapiens
ANPWIKFRS

SEQ ID NO: 397007 - protein, 9 aa, Homo Sapiens
GTPGVRGPV

SEQ ID NO: 397008 - protein, 9 aa, Homo Sapiens
YLSFAALTP

SEQ ID NO: 397009 - protein, 9 aa, Homo Sapiens
VFHTNPLFF

SEQ ID NO: 397010 - protein, 9 aa, Homo Sapiens
NSTYRCSYQ

SEQ ID NO: 397011 - protein, 9 aa, Homo Sapiens
HLILWHPHH

SEQ ID NO: 397012 - protein, 9 aa, Homo Sapiens
EAGWTAEGS

SEQ ID NO: 397013 - protein, 9 aa, Homo Sapiens
LSIFASRTD

SEQ ID NO: 397014 - protein, 9 aa, Homo Sapiens
ALIGEGTRG

SEQ ID NO: 397015 - protein, 9 aa, Homo Sapiens
VLEALLSTR

SEQ ID NO: 397016 - protein, 9 aa, Homo Sapiens
SAREEVLHQ

SEQ ID NO: 397017 - protein, 9 aa, Homo Sapiens
SGTSRARGS

SEQ ID NO: 397018 - protein, 9 aa, Homo Sapiens
SMCCVIIPP

SEQ ID NO: 397019 - protein, 9 aa, Homo Sapiens
IPVSVCEET

SEQ ID NO: 397020 - protein, 9 aa, Homo Sapiens
FNHTRAQQV

SEQ ID NO: 397021 - protein, 9 aa, Homo Sapiens
VKPEMVMLY

SEQ ID NO: 397022 - protein, 9 aa, Homo Sapiens
NYNLSELDI

SEQ ID NO: 397023 - protein, 9 aa, Homo Sapiens
KGLLLANGS

SEQ ID NO: 397024 - protein, 9 aa, Homo Sapiens
KKRPGGHPE

SEQ ID NO: 397025 - protein, 9 aa, Homo Sapiens
TPLHSVLSN

SEQ ID NO: 397026 - protein, 9 aa, Homo Sapiens
KGKGIEKAR

SEQ ID NO: 397027 - protein, 9 aa, Homo Sapiens
VFGILMGYP

SEQ ID NO: 397028 - protein, 9 aa, Homo Sapiens
RGPQTNPGP

SEQ ID NO: 397029 - protein, 9 aa, Homo Sapiens
PLPPTQPPR

SEQ ID NO: 397030 - protein, 9 aa, Homo Sapiens
LVLLAPATP

SEQ ID NO: 397031 - protein, 9 aa, Homo Sapiens
LNYDREVEF

SEQ ID NO: 397032 - protein, 9 aa, Homo Sapiens
SAVPSVARP

SEQ ID NO: 397033 - protein, 9 aa, Homo Sapiens
GEGTRGVGD

SEQ ID NO: 397034 - protein, 9 aa, Homo Sapiens
QTIQWLFMG

SEQ ID NO: 397035 - protein, 9 aa, Homo Sapiens
ESGGVVDNN

SEQ ID NO: 397036 - protein, 9 aa, Homo Sapiens
AAGLSYGLL

SEQ ID NO: 397037 - protein, 9 aa, Homo Sapiens
VATGLTIPV

SEQ ID NO: 397038 - protein, 9 aa, Homo Sapiens
FQLVLPGEA

SEQ ID NO: 397039 - protein, 9 aa, Homo Sapiens
RPLGMDVQR

SEQ ID NO: 397040 - protein, 9 aa, Homo Sapiens
SSEHMETKQ

SEQ ID NO: 397041 - protein, 9 aa, Homo Sapiens
CSLFPQPLT

SEQ ID NO: 397042 - protein, 9 aa, Homo Sapiens
FDVESLELE

SEQ ID NO: 397043 - protein, 9 aa, Homo Sapiens
RRTWWRTRA

SEQ ID NO: 397044 - protein, 9 aa, Homo Sapiens
TSRARGARL

SEQ ID NO: 397045 - protein, 9 aa, Homo Sapiens
WNGFSNLVR

SEQ ID NO: 397046 - protein, 9 aa, Homo Sapiens
SHQPKSPLL

SEQ ID NO: 397047 - protein, 9 aa, Homo Sapiens
EDSCQKLPE

SEQ ID NO: 397048 - protein, 9 aa, Homo Sapiens
PNQWNQETG

SEQ ID NO: 397049 - protein, 9 aa, Homo Sapiens
LEKHEKDLD

SEQ ID NO: 397050 - protein, 9 aa, Homo Sapiens
GQLCLPPRR

SEQ ID NO: 397051 - protein, 9 aa, Homo Sapiens
LQWKRLGQL

SEQ ID NO: 397052 - protein, 9 aa, Homo Sapiens
KHLCSRTHS

SEQ ID NO: 397053 - protein, 9 aa, Homo Sapiens
LLMPPPGLR

SEQ ID NO: 397054 - protein, 9 aa, Homo Sapiens
LLEIPRLPH

SEQ ID NO: 397055 - protein, 9 aa, Homo Sapiens
RFYGNSLST

SEQ ID NO: 397056 - protein, 9 aa, Homo Sapiens
YLSLSSPPT

SEQ ID NO: 397057 - protein, 9 aa, Homo Sapiens
WTNQNTGFP

SEQ ID NO: 397058 - protein, 9 aa, Homo Sapiens
EDTTFFPTL

SEQ ID NO: 397059 - protein, 9 aa, Homo Sapiens
TLVTTGALG

SEQ ID NO: 397060 - protein, 9 aa, Homo Sapiens
HTNCPSIHL

SEQ ID NO: 397061 - protein, 9 aa, Homo Sapiens
KQNLFCLET

SEQ ID NO: 397062 - protein, 9 aa, Homo Sapiens
PPYLILQWL

SEQ ID NO: 397063 - protein, 9 aa, Homo Sapiens
TVHGLLRQL

SEQ ID NO: 397064 - protein, 9 aa, Homo Sapiens
RAAIWRRIG

SEQ ID NO: 397065 - protein, 9 aa, Homo Sapiens
DEEEEMDQE

SEQ ID NO: 397066 - protein, 9 aa, Homo Sapiens
RGDGMLDVT

SEQ ID NO: 397067 - protein, 9 aa, Homo Sapiens
DCLLAEVVP

SEQ ID NO: 397068 - protein, 9 aa, Homo Sapiens
SHLPLYADP

SEQ ID NO: 397069 - protein, 9 aa, Homo Sapiens
RVIRDEGHA

SEQ ID NO: 397070 - protein, 9 aa, Homo Sapiens
PDNGAIAFV

SEQ ID NO: 397071 - protein, 9 aa, Homo Sapiens
RVGTCMYAS

SEQ ID NO: 397072 - protein, 9 aa, Homo Sapiens
RLSLSTSVS

SEQ ID NO: 397073 - protein, 9 aa, Homo Sapiens
KCHKKKHEG

SEQ ID NO: 397074 - protein, 9 aa, Homo Sapiens
IHYVFHLPN

SEQ ID NO: 397075 - protein, 9 aa, Homo Sapiens
DPDMVVSQL

SEQ ID NO: 397076 - protein, 9 aa, Homo Sapiens
DRIRVCGGD

SEQ ID NO: 397077 - protein, 9 aa, Homo Sapiens
QVQGSWEPL

SEQ ID NO: 397078 - protein, 9 aa, Homo Sapiens
ATFGTSLSP

SEQ ID NO: 397079 - protein, 9 aa, Homo Sapiens
TSQNIMATM

SEQ ID NO: 397080 - protein, 9 aa, Homo Sapiens
SIAAALKRH

SEQ ID NO: 397081 - protein, 9 aa, Homo Sapiens
RPAGARAHQ

SEQ ID NO: 397082 - protein, 9 aa, Homo Sapiens
GPTPRAGRV

SEQ ID NO: 397083 - protein, 9 aa, Homo Sapiens
PPSAPGSAR

SEQ ID NO: 397084 - protein, 9 aa, Homo Sapiens
TRHSLKARG

SEQ ID NO: 397085 - protein, 9 aa, Homo Sapiens
VPLDYIGHV

SEQ ID NO: 397086 - protein, 9 aa, Homo Sapiens
HPVKPLSAT

SEQ ID NO: 397087 - protein, 9 aa, Homo Sapiens
EGAASHLQQ

SEQ ID NO: 397088 - protein, 9 aa, Homo Sapiens
PENMFQVCA

SEQ ID NO: 397089 - protein, 9 aa, Homo Sapiens
KIETEFLKN

SEQ ID NO: 397090 - protein, 9 aa, Homo Sapiens
VKAREVLKI

SEQ ID NO: 397091 - protein, 9 aa, Homo Sapiens
GRHRKLGLG

SEQ ID NO: 397092 - protein, 9 aa, Homo Sapiens
YICQVHGPW

SEQ ID NO: 397093 - protein, 9 aa, Homo Sapiens
ARGKSGLLF

SEQ ID NO: 397094 - protein, 9 aa, Homo Sapiens
DSYVQSNCF

SEQ ID NO: 397095 - protein, 9 aa, Homo Sapiens
LKKMTLKAL

SEQ ID NO: 397096 - protein, 9 aa, Homo Sapiens
ALPTAVTPR

SEQ ID NO: 397097 - protein, 9 aa, Homo Sapiens
EACLRTHGC

SEQ ID NO: 397098 - protein, 9 aa, Homo Sapiens
GPAAPGGGG

SEQ ID NO: 397099 - protein, 9 aa, Homo Sapiens
GALATGSSR

SEQ ID NO: 397100 - protein, 9 aa, Homo Sapiens
KSLFGYPIQ

SEQ ID NO: 397101 - protein, 9 aa, Homo Sapiens
HARQPSVRA

SEQ ID NO: 397102 - protein, 9 aa, Homo Sapiens
SHLKVDKET

SEQ ID NO: 397103 - protein, 9 aa, Homo Sapiens
SRLAAASGP

SEQ ID NO: 397104 - protein, 9 aa, Homo Sapiens
AATVDVSFD

SEQ ID NO: 397105 - protein, 9 aa, Homo Sapiens
SGSRTKDVW

SEQ ID NO: 397106 - protein, 9 aa, Homo Sapiens
LECRTRHPN

SEQ ID NO: 397107 - protein, 9 aa, Homo Sapiens
VTIHWILMI

SEQ ID NO: 397108 - protein, 9 aa, Homo Sapiens
TRVSSRASS

SEQ ID NO: 397109 - protein, 9 aa, Homo Sapiens
AAFFASRTR

SEQ ID NO: 397110 - protein, 9 aa, Homo Sapiens
DCILVNSQY

SEQ ID NO: 397111 - protein, 9 aa, Homo Sapiens
IQTRSFLKW

SEQ ID NO: 397112 - protein, 9 aa, Homo Sapiens
AILEALVAP

SEQ ID NO: 397113 - protein, 9 aa, Homo Sapiens
ITWGDTTFQ

SEQ ID NO: 397114 - protein, 9 aa, Homo Sapiens
PPPTKKRGK

SEQ ID NO: 397115 - protein, 9 aa, Homo Sapiens
RSLRQYMPP

SEQ ID NO: 397116 - protein, 9 aa, Homo Sapiens
QHPSVELAD

SEQ ID NO: 397117 - protein, 9 aa, Homo Sapiens
DLCKGDRLG

SEQ ID NO: 397118 - protein, 9 aa, Homo Sapiens
MLSVAWADH

SEQ ID NO: 397119 - protein, 9 aa, Homo Sapiens
TVTRCFSQV

SEQ ID NO: 397120 - protein, 9 aa, Homo Sapiens
VDPMADIAT

SEQ ID NO: 397121 - protein, 9 aa, Homo Sapiens
CDAPPLSTL

SEQ ID NO: 397122 - protein, 9 aa, Homo Sapiens
TPGSGPSPA

SEQ ID NO: 397123 - protein, 9 aa, Homo Sapiens
GILMGYPVP

SEQ ID NO: 397124 - protein, 9 aa, Homo Sapiens
GTRSPLTSR

SEQ ID NO: 397125 - protein, 9 aa, Homo Sapiens
TAFSGGGGP

SEQ ID NO: 397126 - protein, 9 aa, Homo Sapiens
FFKSVNHPQ

SEQ ID NO: 397127 - protein, 9 aa, Homo Sapiens
NTCVYENTT

SEQ ID NO: 397128 - protein, 9 aa, Homo Sapiens
CHKKTSQLD

SEQ ID NO: 397129 - protein, 9 aa, Homo Sapiens
PKIRSFQKS

SEQ ID NO: 397130 - protein, 9 aa, Homo Sapiens
LLSIDLCKG

SEQ ID NO: 397131 - protein, 9 aa, Homo Sapiens
RPLRRLPAA

SEQ ID NO: 397132 - protein, 9 aa, Homo Sapiens
PMWLAREGI

SEQ ID NO: 397133 - protein, 9 aa, Homo Sapiens
SVMYKIGDL

SEQ ID NO: 397134 - protein, 9 aa, Homo Sapiens
ANLNWLHES

SEQ ID NO: 397135 - protein, 9 aa, Homo Sapiens
PDLLEGAAS

SEQ ID NO: 397136 - protein, 9 aa, Homo Sapiens
CGSRDVQTL

SEQ ID NO: 397137 - protein, 9 aa, Homo Sapiens
CCLNLRNPQ

SEQ ID NO: 397138 - protein, 9 aa, Homo Sapiens
QRTEAPPQT

SEQ ID NO: 397139 - protein, 9 aa, Homo Sapiens
RRGLRTRPW

SEQ ID NO: 397140 - protein, 9 aa, Homo Sapiens
EMGSGTAEV

SEQ ID NO: 397141 - protein, 9 aa, Homo Sapiens
ALFACLTLV

SEQ ID NO: 397142 - protein, 9 aa, Homo Sapiens
TVLIEGKKN

SEQ ID NO: 397143 - protein, 9 aa, Homo Sapiens
QSSQDVASV

SEQ ID NO: 397144 - protein, 9 aa, Homo Sapiens
SFDLVTNGC

SEQ ID NO: 397145 - protein, 9 aa, Homo Sapiens
SHAILEALV

SEQ ID NO: 397146 - protein, 9 aa, Homo Sapiens
KAAGRLQGG

SEQ ID NO: 397147 - protein, 9 aa, Homo Sapiens
KQQFLSSSP

SEQ ID NO: 397148 - protein, 9 aa, Homo Sapiens
KGAPAGEAE

SEQ ID NO: 397149 - protein, 9 aa, Homo Sapiens
GIRAQGTRR

SEQ ID NO: 397150 - protein, 9 aa, Homo Sapiens
EPELPENMF

SEQ ID NO: 397151 - protein, 9 aa, Homo Sapiens
RFDNLIITI

SEQ ID NO: 397152 - protein, 9 aa, Homo Sapiens
QILTHSTVL

SEQ ID NO: 397153 - protein, 9 aa, Homo Sapiens
DRNVTEILC

SEQ ID NO: 397154 - protein, 9 aa, Homo Sapiens
LYEWSLPIN

SEQ ID NO: 397155 - protein, 9 aa, Homo Sapiens
LIIDKEAEQ

SEQ ID NO: 397156 - protein, 9 aa, Homo Sapiens
CPSLLRRPP

SEQ ID NO: 397157 - protein, 9 aa, Homo Sapiens
PPAPSMPRC

SEQ ID NO: 397158 - protein, 9 aa, Homo Sapiens
RWLLCFTRW

SEQ ID NO: 397159 - protein, 9 aa, Homo Sapiens
QGSDSVAKA

SEQ ID NO: 397160 - protein, 9 aa, Homo Sapiens
EACGARVFA

SEQ ID NO: 397161 - protein, 9 aa, Homo Sapiens
QLLLHQVVE

SEQ ID NO: 397162 - protein, 9 aa, Homo Sapiens
TRQTSFTGT

SEQ ID NO: 397163 - protein, 9 aa, Homo Sapiens
DVGDKVWVN

SEQ ID NO: 397164 - protein, 9 aa, Homo Sapiens
AKEPAQCIE

SEQ ID NO: 397165 - protein, 9 aa, Homo Sapiens
PSPGTAWSP

SEQ ID NO: 397166 - protein, 9 aa, Homo Sapiens
KILVNLTMK

SEQ ID NO: 397167 - protein, 9 aa, Homo Sapiens
KLALKRVCR

SEQ ID NO: 397168 - protein, 9 aa, Homo Sapiens
GLAASFAVS

SEQ ID NO: 397169 - protein, 9 aa, Homo Sapiens
RHSLKARGA

SEQ ID NO: 397170 - protein, 9 aa, Homo Sapiens
TTRRDSWPT

SEQ ID NO: 397171 - protein, 9 aa, Homo Sapiens
LMPPCSCTF

SEQ ID NO: 397172 - protein, 9 aa, Homo Sapiens
LKLWSLLFS

SEQ ID NO: 397173 - protein, 9 aa, Homo Sapiens
LVRPSCSMS

SEQ ID NO: 397174 - protein, 9 aa, Homo Sapiens
SRHLWKFFW

SEQ ID NO: 397175 - protein, 9 aa, Homo Sapiens
PTPRAGRVA

SEQ ID NO: 397176 - protein, 9 aa, Homo Sapiens
MMYGLWTPI

SEQ ID NO: 397177 - protein, 9 aa, Homo Sapiens
GKKMLSLTH

SEQ ID NO: 397178 - protein, 9 aa, Homo Sapiens
LLITTQIFS

SEQ ID NO: 397179 - protein, 9 aa, Homo Sapiens
KHITKRLCK

SEQ ID NO: 397180 - protein, 9 aa, Homo Sapiens
SRGTFGTRS

SEQ ID NO: 397181 - protein, 9 aa, Homo Sapiens
RSASALPTA

SEQ ID NO: 397182 - protein, 9 aa, Homo Sapiens
WKAEQMEKK

SEQ ID NO: 397183 - protein, 9 aa, Homo Sapiens
TNPLFFSFL

SEQ ID NO: 397184 - protein, 9 aa, Homo Sapiens
GLPLPPPVW

SEQ ID NO: 397185 - protein, 9 aa, Homo Sapiens
AKRQLLISW

SEQ ID NO: 397186 - protein, 9 aa, Homo Sapiens
KNSPGCVDG

SEQ ID NO: 397187 - protein, 9 aa, Homo Sapiens
KPQICPMIL

SEQ ID NO: 397188 - protein, 9 aa, Homo Sapiens
WELWFSTVF

SEQ ID NO: 397189 - protein, 9 aa, Homo Sapiens
EYDVPPWLS

SEQ ID NO: 397190 - protein, 9 aa, Homo Sapiens
DHLTGLALF

SEQ ID NO: 397191 - protein, 9 aa, Homo Sapiens
SGTCCWAWT

SEQ ID NO: 397192 - protein, 9 aa, Homo Sapiens
DSVEHRDNL

SEQ ID NO: 397193 - protein, 9 aa, Homo Sapiens
VARMSLTKP

SEQ ID NO: 397194 - protein, 9 aa, Homo Sapiens
LVHLWQRVM

SEQ ID NO: 397195 - protein, 9 aa, Homo Sapiens
VEPSIFNTL

SEQ ID NO: 397196 - protein, 9 aa, Homo Sapiens
TVDVSFDFF

SEQ ID NO: 397197 - protein, 9 aa, Homo Sapiens
MIAEINFNI

SEQ ID NO: 397198 - protein, 9 aa, Homo Sapiens
LPMTKEFID

SEQ ID NO: 397199 - protein, 9 aa, Homo Sapiens
ANYNISSKE

SEQ ID NO: 397200 - protein, 9 aa, Homo Sapiens
AFHIKSIAA

SEQ ID NO: 397201 - protein, 9 aa, Homo Sapiens
ALPALLPAT

SEQ ID NO: 397202 - protein, 9 aa, Homo Sapiens
VPGESPKER

SEQ ID NO: 397203 - protein, 9 aa, Homo Sapiens
AEGSVVGVT

SEQ ID NO: 397204 - protein, 9 aa, Homo Sapiens
CCEEELHRQ

SEQ ID NO: 397205 - protein, 9 aa, Homo Sapiens
QLGSWVATG

SEQ ID NO: 397206 - protein, 9 aa, Homo Sapiens
ILQTGLVAY

SEQ ID NO: 397207 - protein, 9 aa, Homo Sapiens
VAKAEKRKP

SEQ ID NO: 397208 - protein, 9 aa, Homo Sapiens
WPHPDPAGS

SEQ ID NO: 397209 - protein, 9 aa, Homo Sapiens
TALKLTRRQ

SEQ ID NO: 397210 - protein, 9 aa, Homo Sapiens
GLALFLSTI

SEQ ID NO: 397211 - protein, 9 aa, Homo Sapiens
KEVDKANQI

SEQ ID NO: 397212 - protein, 9 aa, Homo Sapiens
TRPWAKNRG

SEQ ID NO: 397213 - protein, 9 aa, Homo Sapiens
PHPDPAGSP

SEQ ID NO: 397214 - protein, 9 aa, Homo Sapiens
VRILEQTYI

SEQ ID NO: 397215 - protein, 9 aa, Homo Sapiens
TKWRSGSSS

SEQ ID NO: 397216 - protein, 9 aa, Homo Sapiens
GTREWDPDK

SEQ ID NO: 397217 - protein, 9 aa, Homo Sapiens
ARSASALPT

SEQ ID NO: 397218 - protein, 9 aa, Homo Sapiens
ACLRTHGCS

SEQ ID NO: 397219 - protein, 9 aa, Homo Sapiens
CGSPQIQAS

SEQ ID NO: 397220 - protein, 9 aa, Homo Sapiens
VLMNSVFNE

SEQ ID NO: 397221 - protein, 9 aa, Homo Sapiens
PLRRLPAAL

SEQ ID NO: 397222 - protein, 9 aa, Homo Sapiens
IPKLTGSLP

SEQ ID NO: 397223 - protein, 9 aa, Homo Sapiens
PPQTPPLST

SEQ ID NO: 397224 - protein, 9 aa, Homo Sapiens
PARPAGGPP

SEQ ID NO: 397225 - protein, 9 aa, Homo Sapiens
TDVWSVIAS

SEQ ID NO: 397226 - protein, 9 aa, Homo Sapiens
FTRRARRAR

SEQ ID NO: 397227 - protein, 9 aa, Homo Sapiens
VDESGAPLW

SEQ ID NO: 397228 - protein, 9 aa, Homo Sapiens
NPVTDVWSV

SEQ ID NO: 397229 - protein, 9 aa, Homo Sapiens
PLALPALLP

SEQ ID NO: 397230 - protein, 9 aa, Homo Sapiens
KEVKRKKPL

SEQ ID NO: 397231 - protein, 9 aa, Homo Sapiens
LLSLVSRVL

SEQ ID NO: 397232 - protein, 9 aa, Homo Sapiens
KDATSPMEL

SEQ ID NO: 397233 - protein, 9 aa, Homo Sapiens
WSKSLSPSL

SEQ ID NO: 397234 - protein, 9 aa, Homo Sapiens
PCIGEESGG

SEQ ID NO: 397235 - protein, 9 aa, Homo Sapiens
PIKDQLGPS

SEQ ID NO: 397236 - protein, 9 aa, Homo Sapiens
ALATGSSRG

SEQ ID NO: 397237 - protein, 9 aa, Homo Sapiens
LFVLLENLA

SEQ ID NO: 397238 - protein, 9 aa, Homo Sapiens
DQDVKPEMV

SEQ ID NO: 397239 - protein, 9 aa, Homo Sapiens
IGFFSSVSS

SEQ ID NO: 397240 - protein, 9 aa, Homo Sapiens
FACLLWSIC

SEQ ID NO: 397241 - protein, 9 aa, Homo Sapiens
QLAHLIHRA

SEQ ID NO: 397242 - protein, 9 aa, Homo Sapiens
ARADKGTQE

SEQ ID NO: 397243 - protein, 9 aa, Homo Sapiens
HFLQGFLPQ

SEQ ID NO: 397244 - protein, 9 aa, Homo Sapiens
VVDMGHGVT

SEQ ID NO: 397245 - protein, 9 aa, Homo Sapiens
WNLERTTPP

SEQ ID NO: 397246 - protein, 9 aa, Homo Sapiens
SEDTCLENL

SEQ ID NO: 397247 - protein, 9 aa, Homo Sapiens
NRSVFEADP

SEQ ID NO: 397248 - protein, 9 aa, Homo Sapiens
DQSPGSGPV

SEQ ID NO: 397249 - protein, 9 aa, Homo Sapiens
TAMRREVVK

SEQ ID NO: 397250 - protein, 9 aa, Homo Sapiens
KVDPNQWNQ

SEQ ID NO: 397251 - protein, 9 aa, Homo Sapiens
PERTMILIP

SEQ ID NO: 397252 - protein, 9 aa, Homo Sapiens
VNPPVSHYT

SEQ ID NO: 397253 - protein, 9 aa, Homo Sapiens
SWEATSSSE

SEQ ID NO: 397254 - protein, 9 aa, Homo Sapiens
PKMLSKKGL

SEQ ID NO: 397255 - protein, 9 aa, Homo Sapiens
EEYDVPPWL

SEQ ID NO: 397256 - protein, 9 aa, Homo Sapiens
QPTHCSTTC

SEQ ID NO: 397257 - protein, 9 aa, Homo Sapiens
EKDKPVTPS

SEQ ID NO: 397258 - protein, 9 aa, Homo Sapiens
VVTDHDIPQ

SEQ ID NO: 397259 - protein, 9 aa, Homo Sapiens
AWTAPTAWT

SEQ ID NO: 397260 - protein, 9 aa, Homo Sapiens
QVAGTTGMC

SEQ ID NO: 397261 - protein, 9 aa, Homo Sapiens
VLIIVVCYT

SEQ ID NO: 397262 - protein, 9 aa, Homo Sapiens
LWLQLSWGW

SEQ ID NO: 397263 - protein, 9 aa, Homo Sapiens
DDELANLNW

SEQ ID NO: 397264 - protein, 9 aa, Homo Sapiens
VIKKAYMQE

SEQ ID NO: 397265 - protein, 9 aa, Homo Sapiens
KRGGLFLLQ

SEQ ID NO: 397266 - protein, 9 aa, Homo Sapiens
LPKSIPVLV

SEQ ID NO: 397267 - protein, 9 aa, Homo Sapiens
SLHVAPRYH

SEQ ID NO: 397268 - protein, 9 aa, Homo Sapiens
SEQRSGCRP

SEQ ID NO: 397269 - protein, 9 aa, Homo Sapiens
GLKSWISVP

SEQ ID NO: 397270 - protein, 9 aa, Homo Sapiens
IISYKEGMK

SEQ ID NO: 397271 - protein, 9 aa, Homo Sapiens
TRKIIRQYV

SEQ ID NO: 397272 - protein, 9 aa, Homo Sapiens
RGHPSAFNN

SEQ ID NO: 397273 - protein, 9 aa, Homo Sapiens
LCESWLRKD

SEQ ID NO: 397274 - protein, 9 aa, Homo Sapiens
EDIVCCLNL

SEQ ID NO: 397275 - protein, 9 aa, Homo Sapiens
AFSWKCRLN

SEQ ID NO: 397276 - protein, 9 aa, Homo Sapiens
VHGLLRQLG

SEQ ID NO: 397277 - protein, 9 aa, Homo Sapiens
RVKAAVGEG

SEQ ID NO: 397278 - protein, 9 aa, Homo Sapiens
QDPLDRCYS

SEQ ID NO: 397279 - protein, 9 aa, Homo Sapiens
ALFAGVNCE

SEQ ID NO: 397280 - protein, 9 aa, Homo Sapiens
ITDLITFPL

SEQ ID NO: 397281 - protein, 9 aa, Homo Sapiens
RCQVRPPPG

SEQ ID NO: 397282 - protein, 9 aa, Homo Sapiens
EFPSAKKTC

SEQ ID NO: 397283 - protein, 9 aa, Homo Sapiens
ARETSLASC

SEQ ID NO: 397284 - protein, 9 aa, Homo Sapiens
LTDVLHDVM

SEQ ID NO: 397285 - protein, 9 aa, Homo Sapiens
LAWKESTIF

SEQ ID NO: 397286 - protein, 9 aa, Homo Sapiens
RRDSWPTRR

SEQ ID NO: 397287 - protein, 9 aa, Homo Sapiens
GTCKNNCRK

SEQ ID NO: 397288 - protein, 9 aa, Homo Sapiens
ASTCWPRTA

SEQ ID NO: 397289 - protein, 9 aa, Homo Sapiens
ELLKKCSLY

SEQ ID NO: 397290 - protein, 9 aa, Homo Sapiens
PTTPTSARS

SEQ ID NO: 397291 - protein, 9 aa, Homo Sapiens
AHSQQMDGL

SEQ ID NO: 397292 - protein, 9 aa, Homo Sapiens
PYLILQWLE

SEQ ID NO: 397293 - protein, 9 aa, Homo Sapiens
TTITTLASR

SEQ ID NO: 397294 - protein, 9 aa, Homo Sapiens
WRSRCPSLL

SEQ ID NO: 397295 - protein, 9 aa, Homo Sapiens
GAPPECCSS

SEQ ID NO: 397296 - protein, 9 aa, Homo Sapiens
PWEPLHFSK

SEQ ID NO: 397297 - protein, 9 aa, Homo Sapiens
QREVTDHML

SEQ ID NO: 397298 - protein, 9 aa, Homo Sapiens
TTATRSTTL

SEQ ID NO: 397299 - protein, 9 aa, Homo Sapiens
QPAEPELPE

SEQ ID NO: 397300 - protein, 9 aa, Homo Sapiens
KKMLSLTHL

SEQ ID NO: 397301 - protein, 9 aa, Homo Sapiens
SSDTLYKVP

SEQ ID NO: 397302 - protein, 9 aa, Homo Sapiens
SLPLCLSCR

SEQ ID NO: 397303 - protein, 9 aa, Homo Sapiens
RMAASVSSC

SEQ ID NO: 397304 - protein, 9 aa, Homo Sapiens
VLKYMVPRA

SEQ ID NO: 397305 - protein, 9 aa, Homo Sapiens
EPAQCIEQA

SEQ ID NO: 397306 - protein, 9 aa, Homo Sapiens
LGRSAEVTK

SEQ ID NO: 397307 - protein, 9 aa, Homo Sapiens
FTRTSSRAS

SEQ ID NO: 397308 - protein, 9 aa, Homo Sapiens
PSAKKTCSK

SEQ ID NO: 397309 - protein, 9 aa, Homo Sapiens
SWVHIVPVW

SEQ ID NO: 397310 - protein, 9 aa, Homo Sapiens
VNCEEPSRG

SEQ ID NO: 397311 - protein, 9 aa, Homo Sapiens
QKPMARTSG

SEQ ID NO: 397312 - protein, 9 aa, Homo Sapiens
RQRVCGLEE

SEQ ID NO: 397313 - protein, 9 aa, Homo Sapiens
EAQVPHLRA

SEQ ID NO: 397314 - protein, 9 aa, Homo Sapiens
HTGENPYKY

SEQ ID NO: 397315 - protein, 9 aa, Homo Sapiens
ATSEMKVVT

SEQ ID NO: 397316 - protein, 9 aa, Homo Sapiens
PKRSLLGLV

SEQ ID NO: 397317 - protein, 9 aa, Homo Sapiens
KTSCTTFTR

SEQ ID NO: 397318 - protein, 9 aa, Homo Sapiens
AGLSYGLLG

SEQ ID NO: 397319 - protein, 9 aa, Homo Sapiens
KKSCSIIII

SEQ ID NO: 397320 - protein, 9 aa, Homo Sapiens
HTTLSSNTL

SEQ ID NO: 397321 - protein, 9 aa, Homo Sapiens
SNILGVQKP

SEQ ID NO: 397322 - protein, 9 aa, Homo Sapiens
TLGGLFPMH

SEQ ID NO: 397323 - protein, 9 aa, Homo Sapiens
DVLHDVMLL

SEQ ID NO: 397324 - protein, 9 aa, Homo Sapiens
ATSGTAPSA

SEQ ID NO: 397325 - protein, 9 aa, Homo Sapiens
GSGLNAWNG

SEQ ID NO: 397326 - protein, 9 aa, Homo Sapiens
YIPEDILIP

SEQ ID NO: 397327 - protein, 9 aa, Homo Sapiens
LGSYSCKCV

SEQ ID NO: 397328 - protein, 9 aa, Homo Sapiens
WTSCGSRWK

SEQ ID NO: 397329 - protein, 9 aa, Homo Sapiens
ITDDTLGDT

SEQ ID NO: 397330 - protein, 9 aa, Homo Sapiens
VQHNGRIPG

SEQ ID NO: 397331 - protein, 9 aa, Homo Sapiens
GRSRKERKA

SEQ ID NO: 397332 - protein, 9 aa, Homo Sapiens
YVHDRSETL

SEQ ID NO: 397333 - protein, 9 aa, Homo Sapiens
FQLAFVHQV

SEQ ID NO: 397334 - protein, 9 aa, Homo Sapiens
MDKETTQAP

SEQ ID NO: 397335 - protein, 9 aa, Homo Sapiens
VVTLTPHIG

SEQ ID NO: 397336 - protein, 9 aa, Homo Sapiens
YLKKQKLVD

SEQ ID NO: 397337 - protein, 9 aa, Homo Sapiens
RQPSVRAGS

SEQ ID NO: 397338 - protein, 9 aa, Homo Sapiens
DGSQRPPRQ

SEQ ID NO: 397339 - protein, 9 aa, Homo Sapiens
KKIMEKKYR

SEQ ID NO: 397340 - protein, 9 aa, Homo Sapiens
DWATSKISG

SEQ ID NO: 397341 - protein, 9 aa, Homo Sapiens
IVYITQVIL

SEQ ID NO: 397342 - protein, 9 aa, Homo Sapiens
LWDTPAKCA

SEQ ID NO: 397343 - protein, 9 aa, Homo Sapiens
ARDVKKVDA

SEQ ID NO: 397344 - protein, 9 aa, Homo Sapiens
AAAVTAAGV

SEQ ID NO: 397345 - protein, 9 aa, Homo Sapiens
GGPWALATL

SEQ ID NO: 397346 - protein, 9 aa, Homo Sapiens
APGTSETPA

SEQ ID NO: 397347 - protein, 9 aa, Homo Sapiens
GERQIYRRY

SEQ ID NO: 397348 - protein, 9 aa, Homo Sapiens
GRNKGLREG

SEQ ID NO: 397349 - protein, 9 aa, Homo Sapiens
LWERSPGHP

SEQ ID NO: 397350 - protein, 9 aa, Homo Sapiens
EGRASQDGP

SEQ ID NO: 397351 - protein, 9 aa, Homo Sapiens
NRGSGGAPS

SEQ ID NO: 397352 - protein, 9 aa, Homo Sapiens
ISAREEVLH

SEQ ID NO: 397353 - protein, 9 aa, Homo Sapiens
IETEFHRIG

SEQ ID NO: 397354 - protein, 9 aa, Homo Sapiens
GSSRRLHHG

SEQ ID NO: 397355 - protein, 9 aa, Homo Sapiens
GKRINFGKL

SEQ ID NO: 397356 - protein, 9 aa, Homo Sapiens
SPTARATSG

SEQ ID NO: 397357 - protein, 9 aa, Homo Sapiens
EDTVRRKNV

SEQ ID NO: 397358 - protein, 9 aa, Homo Sapiens
EEVIKAILG

SEQ ID NO: 397359 - protein, 9 aa, Homo Sapiens
PANVPVLRS

SEQ ID NO: 397360 - protein, 9 aa, Homo Sapiens
PPRPTSAVR

SEQ ID NO: 397361 - protein, 9 aa, Homo Sapiens
LLWSICFAV

SEQ ID NO: 397362 - protein, 9 aa, Homo Sapiens
MMQELHAFL

SEQ ID NO: 397363 - protein, 9 aa, Homo Sapiens
HEKDLDFLT

SEQ ID NO: 397364 - protein, 9 aa, Homo Sapiens
VMPRTLEGC

SEQ ID NO: 397365 - protein, 9 aa, Homo Sapiens
VFGGPGFTG

SEQ ID NO: 397366 - protein, 9 aa, Homo Sapiens
GTHAALYLL

SEQ ID NO: 397367 - protein, 9 aa, Homo Sapiens
GQFVSWIVM

SEQ ID NO: 397368 - protein, 9 aa, Homo Sapiens
RRARRARGT

SEQ ID NO: 397369 - protein, 9 aa, Homo Sapiens
KPYVCNECD

SEQ ID NO: 397370 - protein, 9 aa, Homo Sapiens
AGTGTASQG

SEQ ID NO: 397371 - protein, 9 aa, Homo Sapiens
GSLGKDATS

SEQ ID NO: 397372 - protein, 9 aa, Homo Sapiens
EAADMGNLK

SEQ ID NO: 397373 - protein, 9 aa, Homo Sapiens
DQIPKYCVP

SEQ ID NO: 397374 - protein, 9 aa, Homo Sapiens
CVICLDYLV

SEQ ID NO: 397375 - protein, 9 aa, Homo Sapiens
KKGAAVDRG

SEQ ID NO: 397376 - protein, 9 aa, Homo Sapiens
DADVLDFNF

SEQ ID NO: 397377 - protein, 9 aa, Homo Sapiens
PPGPLGSIS

SEQ ID NO: 397378 - protein, 9 aa, Homo Sapiens
QAMLRWLLS

SEQ ID NO: 397379 - protein, 9 aa, Homo Sapiens
EKVPIDTSD

SEQ ID NO: 397380 - protein, 9 aa, Homo Sapiens
CHTHEAKRA

SEQ ID NO: 397381 - protein, 9 aa, Homo Sapiens
QPPTALPPS

SEQ ID NO: 397382 - protein, 9 aa, Homo Sapiens
DLCASSTMP

SEQ ID NO: 397383 - protein, 9 aa, Homo Sapiens
DLKAILSEA

SEQ ID NO: 397384 - protein, 9 aa, Homo Sapiens
IELGCDEGD

SEQ ID NO: 397385 - protein, 9 aa, Homo Sapiens
VVVVHELGV

SEQ ID NO: 397386 - protein, 9 aa, Homo Sapiens
DTDGQEAPI

SEQ ID NO: 397387 - protein, 9 aa, Homo Sapiens
FNFFQFCKK

SEQ ID NO: 397388 - protein, 9 aa, Homo Sapiens
ETSSTRGTS

SEQ ID NO: 397389 - protein, 9 aa, Homo Sapiens
ELQDHLGPV

SEQ ID NO: 397390 - protein, 9 aa, Homo Sapiens
TGNIPGAGM

SEQ ID NO: 397391 - protein, 9 aa, Homo Sapiens
TGLAHDSEE

SEQ ID NO: 397392 - protein, 9 aa, Homo Sapiens
YIHYVFHLP

SEQ ID NO: 397393 - protein, 9 aa, Homo Sapiens
IKEPEPMWL

SEQ ID NO: 397394 - protein, 9 aa, Homo Sapiens
VFHLPNTYP

SEQ ID NO: 397395 - protein, 9 aa, Homo Sapiens
IDPIKEPEP

SEQ ID NO: 397396 - protein, 9 aa, Homo Sapiens
CNDVSVKLK

SEQ ID NO: 397397 - protein, 9 aa, Homo Sapiens
RTPPSAPRA

SEQ ID NO: 397398 - protein, 9 aa, Homo Sapiens
IMATMINDS

SEQ ID NO: 397399 - protein, 9 aa, Homo Sapiens
AREHGAERL

SEQ ID NO: 397400 - protein, 9 aa, Homo Sapiens
APPECCSSW

SEQ ID NO: 397401 - protein, 9 aa, Homo Sapiens
VQNERFDAD

SEQ ID NO: 397402 - protein, 9 aa, Homo Sapiens
ASRALFTSL

SEQ ID NO: 397403 - protein, 9 aa, Homo Sapiens
HELGVAVDA

SEQ ID NO: 397404 - protein, 9 aa, Homo Sapiens
LTPRLRIWV

SEQ ID NO: 397405 - protein, 9 aa, Homo Sapiens
AGMDAKVYI

SEQ ID NO: 397406 - protein, 9 aa, Homo Sapiens
VTTTLKLIL

SEQ ID NO: 397407 - protein, 9 aa, Homo Sapiens
FTRTQTSFL

SEQ ID NO: 397408 - protein, 9 aa, Homo Sapiens
HPAPAEVEG

SEQ ID NO: 397409 - protein, 9 aa, Homo Sapiens
GERGLRGTP

SEQ ID NO: 397410 - protein, 9 aa, Homo Sapiens
SRRPLGVSP

SEQ ID NO: 397411 - protein, 9 aa, Homo Sapiens
RQREVTDHM

SEQ ID NO: 397412 - protein, 9 aa, Homo Sapiens
TKEIKESLM

SEQ ID NO: 397413 - protein, 9 aa, Homo Sapiens
KHTPLYEWS

SEQ ID NO: 397414 - protein, 9 aa, Homo Sapiens
WYNDSVEHR

SEQ ID NO: 397415 - protein, 9 aa, Homo Sapiens
SALRVSPVR

SEQ ID NO: 397416 - protein, 9 aa, Homo Sapiens
QQVLFMMVL

SEQ ID NO: 397417 - protein, 9 aa, Homo Sapiens
PWTEECMWS

SEQ ID NO: 397418 - protein, 9 aa, Homo Sapiens
PSANVYKAK

SEQ ID NO: 397419 - protein, 9 aa, Homo Sapiens
VKTWTQFRN

SEQ ID NO: 397420 - protein, 9 aa, Homo Sapiens
TPAKCAGGR

SEQ ID NO: 397421 - protein, 9 aa, Homo Sapiens
KNNCRKNEE

SEQ ID NO: 397422 - protein, 9 aa, Homo Sapiens
EFPPRPTSA

SEQ ID NO: 397423 - protein, 9 aa, Homo Sapiens
WLSLFDFLS

SEQ ID NO: 397424 - protein, 9 aa, Homo Sapiens
QVPQGLTDL

SEQ ID NO: 397425 - protein, 9 aa, Homo Sapiens
QLSMSFFIG

SEQ ID NO: 397426 - protein, 9 aa, Homo Sapiens
PPVWAVLAW

SEQ ID NO: 397427 - protein, 9 aa, Homo Sapiens
AWSPWTPSL

SEQ ID NO: 397428 - protein, 9 aa, Homo Sapiens
MDAKVYITI

SEQ ID NO: 397429 - protein, 9 aa, Homo Sapiens
RWLWAAVER

SEQ ID NO: 397430 - protein, 9 aa, Homo Sapiens
KARVHRQFL

SEQ ID NO: 397431 - protein, 9 aa, Homo Sapiens
ERRPQAPPK

SEQ ID NO: 397432 - protein, 9 aa, Homo Sapiens
VPEFTPKSD

SEQ ID NO: 397433 - protein, 9 aa, Homo Sapiens
TGFPFSAIH

SEQ ID NO: 397434 - protein, 9 aa, Homo Sapiens
PYFIRPVVP

SEQ ID NO: 397435 - protein, 9 aa, Homo Sapiens
EEERQINHT

SEQ ID NO: 397436 - protein, 9 aa, Homo Sapiens
KETTQAPRL

SEQ ID NO: 397437 - protein, 9 aa, Homo Sapiens
ILKERRLLQ

SEQ ID NO: 397438 - protein, 9 aa, Homo Sapiens
CGTSQTYFG

SEQ ID NO: 397439 - protein, 9 aa, Homo Sapiens
RASSTSRAR

SEQ ID NO: 397440 - protein, 9 aa, Homo Sapiens
DLDQSFSFH

SEQ ID NO: 397441 - protein, 9 aa, Homo Sapiens
LLVLMPPCS

SEQ ID NO: 397442 - protein, 9 aa, Homo Sapiens
PARTPRGPS

SEQ ID NO: 397443 - protein, 9 aa, Homo Sapiens
RMTVTHMWF

SEQ ID NO: 397444 - protein, 9 aa, Homo Sapiens
NSLHSATMG

SEQ ID NO: 397445 - protein, 9 aa, Homo Sapiens
WILMIRWLL

SEQ ID NO: 397446 - protein, 9 aa, Homo Sapiens
EVHKARSGK

SEQ ID NO: 397447 - protein, 9 aa, Homo Sapiens
KQMKTLRGV

SEQ ID NO: 397448 - protein, 9 aa, Homo Sapiens
YQNSETKSI

SEQ ID NO: 397449 - protein, 9 aa, Homo Sapiens
SGTIMDHSI

SEQ ID NO: 397450 - protein, 9 aa, Homo Sapiens
SIIAGQGPP

SEQ ID NO: 397451 - protein, 9 aa, Homo Sapiens
IPTTMNYPL

SEQ ID NO: 397452 - protein, 9 aa, Homo Sapiens
LQRNLLRLQ

SEQ ID NO: 397453 - protein, 9 aa, Homo Sapiens
PIRASPHST

SEQ ID NO: 397454 - protein, 9 aa, Homo Sapiens
VRGDGMLDV

SEQ ID NO: 397455 - protein, 9 aa, Homo Sapiens
GPENVVCGR

SEQ ID NO: 397456 - protein, 9 aa, Homo Sapiens
VPPYLILQW

SEQ ID NO: 397457 - protein, 9 aa, Homo Sapiens
APRGHFIGL

SEQ ID NO: 397458 - protein, 9 aa, Homo Sapiens
AQVCVLSAP

SEQ ID NO: 397459 - protein, 9 aa, Homo Sapiens
KSKGTCRSC

SEQ ID NO: 397460 - protein, 9 aa, Homo Sapiens
QMEPRPDVH

SEQ ID NO: 397461 - protein, 9 aa, Homo Sapiens
LIYSLRKKM

SEQ ID NO: 397462 - protein, 9 aa, Homo Sapiens
GTCMYASPE

SEQ ID NO: 397463 - protein, 9 aa, Homo Sapiens
GPGPCIGEE

SEQ ID NO: 397464 - protein, 9 aa, Homo Sapiens
HSSPPVGWQ

SEQ ID NO: 397465 - protein, 9 aa, Homo Sapiens
VFNMWKPMW

SEQ ID NO: 397466 - protein, 9 aa, Homo Sapiens
GSGPSPAPS

SEQ ID NO: 397467 - protein, 9 aa, Homo Sapiens
KDPIIKLLC

SEQ ID NO: 397468 - protein, 9 aa, Homo Sapiens
ANGAPPECC

SEQ ID NO: 397469 - protein, 9 aa, Homo Sapiens
AVVTAVDPM

SEQ ID NO: 397470 - protein, 9 aa, Homo Sapiens
AHAWSQDMA

SEQ ID NO: 397471 - protein, 9 aa, Homo Sapiens
REVEFGSAI

SEQ ID NO: 397472 - protein, 9 aa, Homo Sapiens
PPIRTPAPP

SEQ ID NO: 397473 - protein, 9 aa, Homo Sapiens
PPANLGDRT

SEQ ID NO: 397474 - protein, 9 aa, Homo Sapiens
KNVPSRAGQ

SEQ ID NO: 397475 - protein, 9 aa, Homo Sapiens
ATAASARSP

SEQ ID NO: 397476 - protein, 9 aa, Homo Sapiens
LLFSSFFFN

SEQ ID NO: 397477 - protein, 9 aa, Homo Sapiens
REALCELTE

SEQ ID NO: 397478 - protein, 9 aa, Homo Sapiens
FLQLQGLVA

SEQ ID NO: 397479 - protein, 9 aa, Homo Sapiens
WGSLSSHRC

SEQ ID NO: 397480 - protein, 9 aa, Homo Sapiens
NQSSLLVYS

SEQ ID NO: 397481 - protein, 9 aa, Homo Sapiens
NQDFLQAKP

SEQ ID NO: 397482 - protein, 9 aa, Homo Sapiens
AAAASPRAA

SEQ ID NO: 397483 - protein, 9 aa, Homo Sapiens
RSPMIYGGV

SEQ ID NO: 397484 - protein, 9 aa, Homo Sapiens
QWAPAASPA

SEQ ID NO: 397485 - protein, 9 aa, Homo Sapiens
CRGNWRTAA

SEQ ID NO: 397486 - protein, 9 aa, Homo Sapiens
KFFLQLQGL

SEQ ID NO: 397487 - protein, 9 aa, Homo Sapiens
FKASPRLQF

SEQ ID NO: 397488 - protein, 9 aa, Homo Sapiens
QTPAQDTRC

SEQ ID NO: 397489 - protein, 9 aa, Homo Sapiens
PGSGPSPAP

SEQ ID NO: 397490 - protein, 9 aa, Homo Sapiens
LSPEDMPAQ

SEQ ID NO: 397491 - protein, 9 aa, Homo Sapiens
RNSPCSMCC

SEQ ID NO: 397492 - protein, 9 aa, Homo Sapiens
AGWTAEGSV

SEQ ID NO: 397493 - protein, 9 aa, Homo Sapiens
VGILAIGEH

SEQ ID NO: 397494 - protein, 9 aa, Homo Sapiens
NSPCSMCCV

SEQ ID NO: 397495 - protein, 9 aa, Homo Sapiens
VRAGSGALF

SEQ ID NO: 397496 - protein, 9 aa, Homo Sapiens
DEEWAPRMG

SEQ ID NO: 397497 - protein, 9 aa, Homo Sapiens
VREHVLEEV

SEQ ID NO: 397498 - protein, 9 aa, Homo Sapiens
CVPCGKRIN

SEQ ID NO: 397499 - protein, 9 aa, Homo Sapiens
EILCVGNIT

SEQ ID NO: 397500 - protein, 9 aa, Homo Sapiens
WSCAPVPAP

SEQ ID NO: 397501 - protein, 9 aa, Homo Sapiens
TAGKEEYSA

SEQ ID NO: 397502 - protein, 9 aa, Homo Sapiens
LRQYYFNVG

SEQ ID NO: 397503 - protein, 9 aa, Homo Sapiens
RRARGSSIS

SEQ ID NO: 397504 - protein, 9 aa, Homo Sapiens
PKGSPSSRK

SEQ ID NO: 397505 - protein, 9 aa, Homo Sapiens
MKKREVVDG

SEQ ID NO: 397506 - protein, 9 aa, Homo Sapiens
EETIANLGS

SEQ ID NO: 397507 - protein, 9 aa, Homo Sapiens
GPHARVDAH

SEQ ID NO: 397508 - protein, 9 aa, Homo Sapiens
RRMLEEVIS

SEQ ID NO: 397509 - protein, 9 aa, Homo Sapiens
EGGAVNCGT

SEQ ID NO: 397510 - protein, 9 aa, Homo Sapiens
DTPDVFTMI

SEQ ID NO: 397511 - protein, 9 aa, Homo Sapiens
LGLFGDKGL

SEQ ID NO: 397512 - protein, 9 aa, Homo Sapiens
LKYMVPRAR

SEQ ID NO: 397513 - protein, 9 aa, Homo Sapiens
TPPRAPAPG

SEQ ID NO: 397514 - protein, 9 aa, Homo Sapiens
LAATPLAQW

SEQ ID NO: 397515 - protein, 9 aa, Homo Sapiens
ECTELIHEI

SEQ ID NO: 397516 - protein, 9 aa, Homo Sapiens
NLLIIDKEA

SEQ ID NO: 397517 - protein, 9 aa, Homo Sapiens
FLVLCQFYD

SEQ ID NO: 397518 - protein, 9 aa, Homo Sapiens
ITNTATAAS

SEQ ID NO: 397519 - protein, 9 aa, Homo Sapiens
FKPQICPMI

SEQ ID NO: 397520 - protein, 9 aa, Homo Sapiens
REGWRWGWG

SEQ ID NO: 397521 - protein, 9 aa, Homo Sapiens
QHVHTGEKP

SEQ ID NO: 397522 - protein, 9 aa, Homo Sapiens
DDFMGCLNI

SEQ ID NO: 397523 - protein, 9 aa, Homo Sapiens
RQLPGPHDD

SEQ ID NO: 397524 - protein, 9 aa, Homo Sapiens
IARAVLSIQ

SEQ ID NO: 397525 - protein, 9 aa, Homo Sapiens
LSPFATPTR

SEQ ID NO: 397526 - protein, 9 aa, Homo Sapiens
FIWTPWRKS

SEQ ID NO: 397527 - protein, 9 aa, Homo Sapiens
YIQCELKIG

SEQ ID NO: 397528 - protein, 9 aa, Homo Sapiens
MNSFLCFFY

SEQ ID NO: 397529 - protein, 9 aa, Homo Sapiens
EKDKSRERG

SEQ ID NO: 397530 - protein, 9 aa, Homo Sapiens
HDDFVADGA

SEQ ID NO: 397531 - protein, 9 aa, Homo Sapiens
GSGRARGTS

SEQ ID NO: 397532 - protein, 9 aa, Homo Sapiens
PPTQQPQTP

SEQ ID NO: 397533 - protein, 9 aa, Homo Sapiens
LPPHKPPPP

SEQ ID NO: 397534 - protein, 9 aa, Homo Sapiens
NPASTSGKS

SEQ ID NO: 397535 - protein, 9 aa, Homo Sapiens
FTINPRLQH

SEQ ID NO: 397536 - protein, 9 aa, Homo Sapiens
HRAHHEGSA

SEQ ID NO: 397537 - protein, 9 aa, Homo Sapiens
PMFLFLFYL

SEQ ID NO: 397538 - protein, 9 aa, Homo Sapiens
PAGLVPESG

SEQ ID NO: 397539 - protein, 9 aa, Homo Sapiens
PPPGPPCLP

SEQ ID NO: 397540 - protein, 9 aa, Homo Sapiens
LTAALENLN

SEQ ID NO: 397541 - protein, 9 aa, Homo Sapiens
RRMELKPLC

SEQ ID NO: 397542 - protein, 9 aa, Homo Sapiens
AGSTVGPSG

SEQ ID NO: 397543 - protein, 9 aa, Homo Sapiens
TRRAAGALG

SEQ ID NO: 397544 - protein, 9 aa, Homo Sapiens
FTSLASGTS

SEQ ID NO: 397545 - protein, 9 aa, Homo Sapiens
SLLSLYSVA

SEQ ID NO: 397546 - protein, 9 aa, Homo Sapiens
TGGPRSTGL

SEQ ID NO: 397547 - protein, 9 aa, Homo Sapiens
VTDVTKIGI

SEQ ID NO: 397548 - protein, 9 aa, Homo Sapiens
EKRKMTNDG

SEQ ID NO: 397549 - protein, 9 aa, Homo Sapiens
GPAQFHARQ

SEQ ID NO: 397550 - protein, 9 aa, Homo Sapiens
RRVLARFYS

SEQ ID NO: 397551 - protein, 9 aa, Homo Sapiens
KFPVRLIIQ

SEQ ID NO: 397552 - protein, 9 aa, Homo Sapiens
GWEEASQVG

SEQ ID NO: 397553 - protein, 9 aa, Homo Sapiens
GRHLQGEQM

SEQ ID NO: 397554 - protein, 9 aa, Homo Sapiens
VYLSFAALT

SEQ ID NO: 397555 - protein, 9 aa, Homo Sapiens
PALLPATWC

SEQ ID NO: 397556 - protein, 9 aa, Homo Sapiens
SNPFLHHRP

SEQ ID NO: 397557 - protein, 9 aa, Homo Sapiens
DDEEEEMDQ

SEQ ID NO: 397558 - protein, 9 aa, Homo Sapiens
IRRHLFSQK

SEQ ID NO: 397559 - protein, 9 aa, Homo Sapiens
QIQWPTVHG

SEQ ID NO: 397560 - protein, 9 aa, Homo Sapiens
DIPKCEGKQ

SEQ ID NO: 397561 - protein, 9 aa, Homo Sapiens
SPDRTLLAP

SEQ ID NO: 397562 - protein, 9 aa, Homo Sapiens
MDGSMHTVI

SEQ ID NO: 397563 - protein, 9 aa, Homo Sapiens
IIDKEAEQS

SEQ ID NO: 397564 - protein, 9 aa, Homo Sapiens
RINFGKLSL

SEQ ID NO: 397565 - protein, 9 aa, Homo Sapiens
SGGATGANR

SEQ ID NO: 397566 - protein, 9 aa, Homo Sapiens
PGTREWDPD

SEQ ID NO: 397567 - protein, 9 aa, Homo Sapiens
SYRWLSLFD

SEQ ID NO: 397568 - protein, 9 aa, Homo Sapiens
TSVSFAARS

SEQ ID NO: 397569 - protein, 9 aa, Homo Sapiens
EISAREEVL

SEQ ID NO: 397570 - protein, 9 aa, Homo Sapiens
WAHGMPDLL

SEQ ID NO: 397571 - protein, 9 aa, Homo Sapiens
YFLWNYMKL

SEQ ID NO: 397572 - protein, 9 aa, Homo Sapiens
TREWDPDKA

SEQ ID NO: 397573 - protein, 9 aa, Homo Sapiens
KKIGLFTRW

SEQ ID NO: 397574 - protein, 9 aa, Homo Sapiens
QQPQTPQDS

SEQ ID NO: 397575 - protein, 9 aa, Homo Sapiens
LLPRWREAV

SEQ ID NO: 397576 - protein, 9 aa, Homo Sapiens
VLRSSDKRK

SEQ ID NO: 397577 - protein, 9 aa, Homo Sapiens
PSCVPTAAR

SEQ ID NO: 397578 - protein, 9 aa, Homo Sapiens
TLGTSNTIC

SEQ ID NO: 397579 - protein, 9 aa, Homo Sapiens
AGHQEAAHR

SEQ ID NO: 397580 - protein, 9 aa, Homo Sapiens
KSTKPHSSH

SEQ ID NO: 397581 - protein, 9 aa, Homo Sapiens
QMKTHSRNI

SEQ ID NO: 397582 - protein, 9 aa, Homo Sapiens
ILKVVILFF

SEQ ID NO: 397583 - protein, 9 aa, Homo Sapiens
QHISLLNRG

SEQ ID NO: 397584 - protein, 9 aa, Homo Sapiens
LYSLNISWE

SEQ ID NO: 397585 - protein, 9 aa, Homo Sapiens
PTASPTPPQ

SEQ ID NO: 397586 - protein, 9 aa, Homo Sapiens
MSYSLFQAS

SEQ ID NO: 397587 - protein, 9 aa, Homo Sapiens
GRESYMSTL

SEQ ID NO: 397588 - protein, 9 aa, Homo Sapiens
KNEFPEDLH

SEQ ID NO: 397589 - protein, 9 aa, Homo Sapiens
NTNLTATMN

SEQ ID NO: 397590 - protein, 9 aa, Homo Sapiens
IPLLLILVF

SEQ ID NO: 397591 - protein, 9 aa, Homo Sapiens
HNQEIQRAL

SEQ ID NO: 397592 - protein, 9 aa, Homo Sapiens
TYTVLIEGK

SEQ ID NO: 397593 - protein, 9 aa, Homo Sapiens
MTQYRDVHH

SEQ ID NO: 397594 - protein, 9 aa, Homo Sapiens
GTYTGIIFL

SEQ ID NO: 397595 - protein, 9 aa, Homo Sapiens
EVEGPENQM

SEQ ID NO: 397596 - protein, 9 aa, Homo Sapiens
ALFPKGSQS

SEQ ID NO: 397597 - protein, 9 aa, Homo Sapiens
GSPDQAPPE

SEQ ID NO: 397598 - protein, 9 aa, Homo Sapiens
VQAERTEKS

SEQ ID NO: 397599 - protein, 9 aa, Homo Sapiens
TLMQHKIIH

SEQ ID NO: 397600 - protein, 9 aa, Homo Sapiens
TDECHCIAV

SEQ ID NO: 397601 - protein, 9 aa, Homo Sapiens
TKDRRLSNK

SEQ ID NO: 397602 - protein, 9 aa, Homo Sapiens
GSLFASDNF

SEQ ID NO: 397603 - protein, 9 aa, Homo Sapiens
KIKKTKVEI

SEQ ID NO: 397604 - protein, 9 aa, Homo Sapiens
CGKAFRQAP

SEQ ID NO: 397605 - protein, 9 aa, Homo Sapiens
FLIFFLYYW

SEQ ID NO: 397606 - protein, 9 aa, Homo Sapiens
RGEGASWSP

SEQ ID NO: 397607 - protein, 9 aa, Homo Sapiens
PFKIISYVL

SEQ ID NO: 397608 - protein, 9 aa, Homo Sapiens
NVHNILQWQ

SEQ ID NO: 397609 - protein, 9 aa, Homo Sapiens
ERGKIEVTI

SEQ ID NO: 397610 - protein, 9 aa, Homo Sapiens
EIEKCLDPD

SEQ ID NO: 397611 - protein, 9 aa, Homo Sapiens
ANQDPVYPS

SEQ ID NO: 397612 - protein, 9 aa, Homo Sapiens
LNNVNIKEG

SEQ ID NO: 397613 - protein, 9 aa, Homo Sapiens
VLEAIGSLV

SEQ ID NO: 397614 - protein, 9 aa, Homo Sapiens
PVNIIRMEE

SEQ ID NO: 397615 - protein, 9 aa, Homo Sapiens
RTSYSEGPA

SEQ ID NO: 397616 - protein, 9 aa, Homo Sapiens
DKVLQDCKA

SEQ ID NO: 397617 - protein, 9 aa, Homo Sapiens
LMIDSHNSK

SEQ ID NO: 397618 - protein, 9 aa, Homo Sapiens
PGLLGKQGE

SEQ ID NO: 397619 - protein, 9 aa, Homo Sapiens
EQIGKIGEG

SEQ ID NO: 397620 - protein, 9 aa, Homo Sapiens
RRPLNDLCK

SEQ ID NO: 397621 - protein, 9 aa, Homo Sapiens
NYTADQIRN

SEQ ID NO: 397622 - protein, 9 aa, Homo Sapiens
FRYIMECPE

SEQ ID NO: 397623 - protein, 9 aa, Homo Sapiens
QVLDSNNFK

SEQ ID NO: 397624 - protein, 9 aa, Homo Sapiens
FQFKSSNKS

SEQ ID NO: 397625 - protein, 9 aa, Homo Sapiens
PLLSKYQSI

SEQ ID NO: 397626 - protein, 9 aa, Homo Sapiens
EPWKEQLFE

SEQ ID NO: 397627 - protein, 9 aa, Homo Sapiens
QENVQGVVI

SEQ ID NO: 397628 - protein, 9 aa, Homo Sapiens
LEKQICIPR

SEQ ID NO: 397629 - protein, 9 aa, Homo Sapiens
TEELKELFA

SEQ ID NO: 397630 - protein, 9 aa, Homo Sapiens
KGGHLRFAS

SEQ ID NO: 397631 - protein, 9 aa, Homo Sapiens
YSELIEADA

SEQ ID NO: 397632 - protein, 9 aa, Homo Sapiens
PGNMSMAFS

SEQ ID NO: 397633 - protein, 9 aa, Homo Sapiens
QNQVLDSNN

SEQ ID NO: 397634 - protein, 9 aa, Homo Sapiens
VFHLKRFSE

SEQ ID NO: 397635 - protein, 9 aa, Homo Sapiens
SVITYVSLI

SEQ ID NO: 397636 - protein, 9 aa, Homo Sapiens
GSRGLAEAT

SEQ ID NO: 397637 - protein, 9 aa, Homo Sapiens
LESSALEQH

SEQ ID NO: 397638 - protein, 9 aa, Homo Sapiens
DKLGPSRDP

SEQ ID NO: 397639 - protein, 9 aa, Homo Sapiens
NVYGYPEGK

SEQ ID NO: 397640 - protein, 9 aa, Homo Sapiens
AEEEFFYGE

SEQ ID NO: 397641 - protein, 9 aa, Homo Sapiens
NNFIYLLTV

SEQ ID NO: 397642 - protein, 9 aa, Homo Sapiens
STLSDSDSG

SEQ ID NO: 397643 - protein, 9 aa, Homo Sapiens
AQAEKHFQY

SEQ ID NO: 397644 - protein, 9 aa, Homo Sapiens
GFDLHGALQ

SEQ ID NO: 397645 - protein, 9 aa, Homo Sapiens
AGEAVSWDS

SEQ ID NO: 397646 - protein, 9 aa, Homo Sapiens
SPSATGQSY

SEQ ID NO: 397647 - protein, 9 aa, Homo Sapiens
AQMGIISPF

SEQ ID NO: 397648 - protein, 9 aa, Homo Sapiens
AQVKNNQHI

SEQ ID NO: 397649 - protein, 9 aa, Homo Sapiens
TIVLDCSFV

SEQ ID NO: 397650 - protein, 9 aa, Homo Sapiens
MLYDWINPT

SEQ ID NO: 397651 - protein, 9 aa, Homo Sapiens
DVDIFYYFW

SEQ ID NO: 397652 - protein, 9 aa, Homo Sapiens
KSALTVHQL

SEQ ID NO: 397653 - protein, 9 aa, Homo Sapiens
VQRVLATED

SEQ ID NO: 397654 - protein, 9 aa, Homo Sapiens
AASYLQMNY

SEQ ID NO: 397655 - protein, 9 aa, Homo Sapiens
KRKRHKQTS

SEQ ID NO: 397656 - protein, 9 aa, Homo Sapiens
DVNKKVKKI

SEQ ID NO: 397657 - protein, 9 aa, Homo Sapiens
WTGSHPWTM

SEQ ID NO: 397658 - protein, 9 aa, Homo Sapiens
EKLNLGDCD

SEQ ID NO: 397659 - protein, 9 aa, Homo Sapiens
KDVSYLYIF

SEQ ID NO: 397660 - protein, 9 aa, Homo Sapiens
IYSELIEAD

SEQ ID NO: 397661 - protein, 9 aa, Homo Sapiens
IDQTECVIC

SEQ ID NO: 397662 - protein, 9 aa, Homo Sapiens
RTRISAVMV

SEQ ID NO: 397663 - protein, 9 aa, Homo Sapiens
DFFYLSDYE

SEQ ID NO: 397664 - protein, 9 aa, Homo Sapiens
ICKKRHRGY

SEQ ID NO: 397665 - protein, 9 aa, Homo Sapiens
MTSKRHFKL

SEQ ID NO: 397666 - protein, 9 aa, Homo Sapiens
IFSCLLRHR

SEQ ID NO: 397667 - protein, 9 aa, Homo Sapiens
GRREHKDKK

SEQ ID NO: 397668 - protein, 9 aa, Homo Sapiens
SYRYPPVNW

SEQ ID NO: 397669 - protein, 9 aa, Homo Sapiens
SAQRLKCQK

SEQ ID NO: 397670 - protein, 9 aa, Homo Sapiens
WLSGLGGCL

SEQ ID NO: 397671 - protein, 9 aa, Homo Sapiens
QKVKAKKTQ

SEQ ID NO: 397672 - protein, 9 aa, Homo Sapiens
LTKYLICFF

SEQ ID NO: 397673 - protein, 9 aa, Homo Sapiens
ILSLLSSEL

SEQ ID NO: 397674 - protein, 9 aa, Homo Sapiens
GGRTVEVQG

SEQ ID NO: 397675 - protein, 9 aa, Homo Sapiens
SWDNIERDM

SEQ ID NO: 397676 - protein, 9 aa, Homo Sapiens
KRKQKRVLK

SEQ ID NO: 397677 - protein, 9 aa, Homo Sapiens
EYLDLRKEK

SEQ ID NO: 397678 - protein, 9 aa, Homo Sapiens
YPEDKLDCV

SEQ ID NO: 397679 - protein, 9 aa, Homo Sapiens
SSIHPECRF

SEQ ID NO: 397680 - protein, 9 aa, Homo Sapiens
CVLKLISLC

SEQ ID NO: 397681 - protein, 9 aa, Homo Sapiens
SKIEGKELL

SEQ ID NO: 397682 - protein, 9 aa, Homo Sapiens
SGCLYNINY

SEQ ID NO: 397683 - protein, 9 aa, Homo Sapiens
TLKDENSKL

SEQ ID NO: 397684 - protein, 9 aa, Homo Sapiens
LNAHSYLKS

SEQ ID NO: 397685 - protein, 9 aa, Homo Sapiens
ASSFRMTEH

SEQ ID NO: 397686 - protein, 9 aa, Homo Sapiens
NDMIEIPLP

SEQ ID NO: 397687 - protein, 9 aa, Homo Sapiens
PHYPYSSLS

SEQ ID NO: 397688 - protein, 9 aa, Homo Sapiens
NDSSCHGRE

SEQ ID NO: 397689 - protein, 9 aa, Homo Sapiens
FANTVGLTN

SEQ ID NO: 397690 - protein, 9 aa, Homo Sapiens
VGMCGDGTN

SEQ ID NO: 397691 - protein, 9 aa, Homo Sapiens
SELQYFEEE

SEQ ID NO: 397692 - protein, 9 aa, Homo Sapiens
ELFAKARAG

SEQ ID NO: 397693 - protein, 9 aa, Homo Sapiens
SVCSSRTAH

SEQ ID NO: 397694 - protein, 9 aa, Homo Sapiens
WENQKVEAT

SEQ ID NO: 397695 - protein, 9 aa, Homo Sapiens
QVIVDHPFL

SEQ ID NO: 397696 - protein, 9 aa, Homo Sapiens
TTTKIAATA

SEQ ID NO: 397697 - protein, 9 aa, Homo Sapiens
GKNIFVLGP

SEQ ID NO: 397698 - protein, 9 aa, Homo Sapiens
LSPYPGLHL

SEQ ID NO: 397699 - protein, 9 aa, Homo Sapiens
HAVDKPFKC

SEQ ID NO: 397700 - protein, 9 aa, Homo Sapiens
PLEENVTRE

SEQ ID NO: 397701 - protein, 9 aa, Homo Sapiens
QVLQLFSSD

SEQ ID NO: 397702 - protein, 9 aa, Homo Sapiens
VLQLFSSDI

SEQ ID NO: 397703 - protein, 9 aa, Homo Sapiens
GQTALIEKN

SEQ ID NO: 397704 - protein, 9 aa, Homo Sapiens
IEELKRCNS

SEQ ID NO: 397705 - protein, 9 aa, Homo Sapiens
KENKSSISQ

SEQ ID NO: 397706 - protein, 9 aa, Homo Sapiens
NYLISTKEE

SEQ ID NO: 397707 - protein, 9 aa, Homo Sapiens
YVPVFPGQQ

SEQ ID NO: 397708 - protein, 9 aa, Homo Sapiens
SIIHAKITY

SEQ ID NO: 397709 - protein, 9 aa, Homo Sapiens
TNTKAYGER

SEQ ID NO: 397710 - protein, 9 aa, Homo Sapiens
NAHSYLKSI

SEQ ID NO: 397711 - protein, 9 aa, Homo Sapiens
GAKTVCYAL

SEQ ID NO: 397712 - protein, 9 aa, Homo Sapiens
IGSRLEKTE

SEQ ID NO: 397713 - protein, 9 aa, Homo Sapiens
RYNPGLNAK

SEQ ID NO: 397714 - protein, 9 aa, Homo Sapiens
QRHNYLHRK

SEQ ID NO: 397715 - protein, 9 aa, Homo Sapiens
DGSEEAIIG

SEQ ID NO: 397716 - protein, 9 aa, Homo Sapiens
SENNGFSLF

SEQ ID NO: 397717 - protein, 9 aa, Homo Sapiens
KDNHVVATG

SEQ ID NO: 397718 - protein, 9 aa, Homo Sapiens
INKKSPFDI

SEQ ID NO: 397719 - protein, 9 aa, Homo Sapiens
EFSENNGFS

SEQ ID NO: 397720 - protein, 9 aa, Homo Sapiens
QALRRTRIS

SEQ ID NO: 397721 - protein, 9 aa, Homo Sapiens
PEALRMVWV

SEQ ID NO: 397722 - protein, 9 aa, Homo Sapiens
EAIHLPQVA

SEQ ID NO: 397723 - protein, 9 aa, Homo Sapiens
MEAMKYHIL

SEQ ID NO: 397724 - protein, 9 aa, Homo Sapiens
SIVKESTEV

SEQ ID NO: 397725 - protein, 9 aa, Homo Sapiens
SQLLSQTFR

SEQ ID NO: 397726 - protein, 9 aa, Homo Sapiens
FRYHEITHT

SEQ ID NO: 397727 - protein, 9 aa, Homo Sapiens
HHKDSEDAE

SEQ ID NO: 397728 - protein, 9 aa, Homo Sapiens
LRYNMLMSP

SEQ ID NO: 397729 - protein, 9 aa, Homo Sapiens
TIAEGQEQI

SEQ ID NO: 397730 - protein, 9 aa, Homo Sapiens
RGNKLHFSS

SEQ ID NO: 397731 - protein, 9 aa, Homo Sapiens
DKLDCVIVV

SEQ ID NO: 397732 - protein, 9 aa, Homo Sapiens
TVHPVFFII

SEQ ID NO: 397733 - protein, 9 aa, Homo Sapiens
TILTEIYHI

SEQ ID NO: 397734 - protein, 9 aa, Homo Sapiens
WMAGGLVAH

SEQ ID NO: 397735 - protein, 9 aa, Homo Sapiens
VSNFVDNVY

SEQ ID NO: 397736 - protein, 9 aa, Homo Sapiens
PYRKHMKKT

SEQ ID NO: 397737 - protein, 9 aa, Homo Sapiens
IIFLVPVPG

SEQ ID NO: 397738 - protein, 9 aa, Homo Sapiens
KNISTINFH

SEQ ID NO: 397739 - protein, 9 aa, Homo Sapiens
LSSWANSNL

SEQ ID NO: 397740 - protein, 9 aa, Homo Sapiens
RNLEPHGQQ

SEQ ID NO: 397741 - protein, 9 aa, Homo Sapiens
HKDSEDAEE

SEQ ID NO: 397742 - protein, 9 aa, Homo Sapiens
EKLKETETV

SEQ ID NO: 397743 - protein, 9 aa, Homo Sapiens
IKFDIVPSP

SEQ ID NO: 397744 - protein, 9 aa, Homo Sapiens
KQIPSSESN

SEQ ID NO: 397745 - protein, 9 aa, Homo Sapiens
HNFAARQGG

SEQ ID NO: 397746 - protein, 9 aa, Homo Sapiens
IENLEKEYK

SEQ ID NO: 397747 - protein, 9 aa, Homo Sapiens
FRELSDLKK

SEQ ID NO: 397748 - protein, 9 aa, Homo Sapiens
KCLTMKENK

SEQ ID NO: 397749 - protein, 9 aa, Homo Sapiens
EESFESIRA

SEQ ID NO: 397750 - protein, 9 aa, Homo Sapiens
SLYCDKVLQ

SEQ ID NO: 397751 - protein, 9 aa, Homo Sapiens
AMHVSDHSG

SEQ ID NO: 397752 - protein, 9 aa, Homo Sapiens
TAETDCQYV

SEQ ID NO: 397753 - protein, 9 aa, Homo Sapiens
VYEKDVELV

SEQ ID NO: 397754 - protein, 9 aa, Homo Sapiens
YFLICSLAI

SEQ ID NO: 397755 - protein, 9 aa, Homo Sapiens
LKLCKKLKA

SEQ ID NO: 397756 - protein, 9 aa, Homo Sapiens
EENYQIEEE

SEQ ID NO: 397757 - protein, 9 aa, Homo Sapiens
EVQSFEKET

SEQ ID NO: 397758 - protein, 9 aa, Homo Sapiens
ELSEGRNSP

SEQ ID NO: 397759 - protein, 9 aa, Homo Sapiens
LTPQQAQQL

SEQ ID NO: 397760 - protein, 9 aa, Homo Sapiens
QVTIQDSQT

SEQ ID NO: 397761 - protein, 9 aa, Homo Sapiens
IQHQIIHSG

SEQ ID NO: 397762 - protein, 9 aa, Homo Sapiens
CKKRHRGYS

SEQ ID NO: 397763 - protein, 9 aa, Homo Sapiens
GCTFKFRFW

SEQ ID NO: 397764 - protein, 9 aa, Homo Sapiens
PHINKKSPF

SEQ ID NO: 397765 - protein, 9 aa, Homo Sapiens
RWRCADARG

SEQ ID NO: 397766 - protein, 9 aa, Homo Sapiens
RHDLDYLSL

SEQ ID NO: 397767 - protein, 9 aa, Homo Sapiens
NMTCDKWTD

SEQ ID NO: 397768 - protein, 9 aa, Homo Sapiens
IGYEGFQQV

SEQ ID NO: 397769 - protein, 9 aa, Homo Sapiens
RHGIESIYQ

SEQ ID NO: 397770 - protein, 9 aa, Homo Sapiens
DTNNEEGSV

SEQ ID NO: 397771 - protein, 9 aa, Homo Sapiens
LCKSVFSIR

SEQ ID NO: 397772 - protein, 9 aa, Homo Sapiens
SVPPETYQQ

SEQ ID NO: 397773 - protein, 9 aa, Homo Sapiens
QIRYGQTKK

SEQ ID NO: 397774 - protein, 9 aa, Homo Sapiens
KIILQLHEL

SEQ ID NO: 397775 - protein, 9 aa, Homo Sapiens
YFWYNFDSW

SEQ ID NO: 397776 - protein, 9 aa, Homo Sapiens
RVPHSVWGC

SEQ ID NO: 397777 - protein, 9 aa, Homo Sapiens
QLMIDSHNS

SEQ ID NO: 397778 - protein, 9 aa, Homo Sapiens
AHQRIHAVD

SEQ ID NO: 397779 - protein, 9 aa, Homo Sapiens
FQSIIHAKI

SEQ ID NO: 397780 - protein, 9 aa, Homo Sapiens
LSFCYKVFR

SEQ ID NO: 397781 - protein, 9 aa, Homo Sapiens
NRRAKDKRL

SEQ ID NO: 397782 - protein, 9 aa, Homo Sapiens
LSSRNTISF

SEQ ID NO: 397783 - protein, 9 aa, Homo Sapiens
EVADRLFSY

SEQ ID NO: 397784 - protein, 9 aa, Homo Sapiens
GFVCDGCLN

SEQ ID NO: 397785 - protein, 9 aa, Homo Sapiens
STIVEYPQT

SEQ ID NO: 397786 - protein, 9 aa, Homo Sapiens
IVLDCSFVA

SEQ ID NO: 397787 - protein, 9 aa, Homo Sapiens
NNFALVPLL

SEQ ID NO: 397788 - protein, 9 aa, Homo Sapiens
DKKENKSFS

SEQ ID NO: 397789 - protein, 9 aa, Homo Sapiens
TVCRFSIRN

SEQ ID NO: 397790 - protein, 9 aa, Homo Sapiens
VGIAMLAKG

SEQ ID NO: 397791 - protein, 9 aa, Homo Sapiens
LEKEYKEKE

SEQ ID NO: 397792 - protein, 9 aa, Homo Sapiens
TQPSEKIWI

SEQ ID NO: 397793 - protein, 9 aa, Homo Sapiens
QKVALWARV

SEQ ID NO: 397794 - protein, 8 aa, Homo Sapiens
ILSYEVIL

SEQ ID NO: 397795 - protein, 9 aa, Homo Sapiens
EANHLLHKS

SEQ ID NO: 397796 - protein, 9 aa, Homo Sapiens
CSNTGSGKS

SEQ ID NO: 397797 - protein, 9 aa, Homo Sapiens
QFLRFNPVR

SEQ ID NO: 397798 - protein, 9 aa, Homo Sapiens
QQVLKIYLE

SEQ ID NO: 397799 - protein, 9 aa, Homo Sapiens
KLISLCYYY

SEQ ID NO: 397800 - protein, 9 aa, Homo Sapiens
LLGKQGEPG

SEQ ID NO: 397801 - protein, 9 aa, Homo Sapiens
SPTPPQSPG

SEQ ID NO: 397802 - protein, 9 aa, Homo Sapiens
KQNSPNRIM

SEQ ID NO: 397803 - protein, 9 aa, Homo Sapiens
IAEGQEQIP

SEQ ID NO: 397804 - protein, 9 aa, Homo Sapiens
SSALEQHKI

SEQ ID NO: 397805 - protein, 9 aa, Homo Sapiens
GRNSPEVSL

SEQ ID NO: 397806 - protein, 9 aa, Homo Sapiens
ASWSPRGVL

SEQ ID NO: 397807 - protein, 9 aa, Homo Sapiens
MSGVCCTGT

SEQ ID NO: 397808 - protein, 9 aa, Homo Sapiens
DMNINKMWI

SEQ ID NO: 397809 - protein, 9 aa, Homo Sapiens
TQKVRPRRW

SEQ ID NO: 397810 - protein, 9 aa, Homo Sapiens
FPEAQNIYY

SEQ ID NO: 397811 - protein, 9 aa, Homo Sapiens
RTHTGEKQY

SEQ ID NO: 397812 - protein, 9 aa, Homo Sapiens
KCQKQANAQ

SEQ ID NO: 397813 - protein, 9 aa, Homo Sapiens
DVFIVVNIV

SEQ ID NO: 397814 - protein, 9 aa, Homo Sapiens
LATEPRENG

SEQ ID NO: 397815 - protein, 9 aa, Homo Sapiens
NEFNSSIAR

SEQ ID NO: 397816 - protein, 9 aa, Homo Sapiens
PNMTPSAVG

SEQ ID NO: 397817 - protein, 9 aa, Homo Sapiens
SVQFESILP

SEQ ID NO: 397818 - protein, 9 aa, Homo Sapiens
DDCEDVRTI

SEQ ID NO: 397819 - protein, 9 aa, Homo Sapiens
VLHCVTFAV

SEQ ID NO: 397820 - protein, 9 aa, Homo Sapiens
LGMGGTRGI

SEQ ID NO: 397821 - protein, 9 aa, Homo Sapiens
TLKKHNIIH

SEQ ID NO: 397822 - protein, 9 aa, Homo Sapiens
FFADEDEIT

SEQ ID NO: 397823 - protein, 9 aa, Homo Sapiens
LNMFRELSD

SEQ ID NO: 397824 - protein, 9 aa, Homo Sapiens
TGEKQYECK

SEQ ID NO: 397825 - protein, 9 aa, Homo Sapiens
QSKGRARTP

SEQ ID NO: 397826 - protein, 9 aa, Homo Sapiens
NQTYNTVTV

SEQ ID NO: 397827 - protein, 9 aa, Homo Sapiens
GHEKSTKLQ

SEQ ID NO: 397828 - protein, 9 aa, Homo Sapiens
MNFINYCES

SEQ ID NO: 397829 - protein, 9 aa, Homo Sapiens
EDTSQNIPL

SEQ ID NO: 397830 - protein, 9 aa, Homo Sapiens
SFKQTNVYS

SEQ ID NO: 397831 - protein, 9 aa, Homo Sapiens
AYSYFWINR

SEQ ID NO: 397832 - protein, 9 aa, Homo Sapiens
GLLGSDDPP

SEQ ID NO: 397833 - protein, 9 aa, Homo Sapiens
EGGQGKRKI

SEQ ID NO: 397834 - protein, 9 aa, Homo Sapiens
LPKKEAPYM

SEQ ID NO: 397835 - protein, 9 aa, Homo Sapiens
LVLNEQWIR

SEQ ID NO: 397836 - protein, 9 aa, Homo Sapiens
STSDYLTQE

SEQ ID NO: 397837 - protein, 9 aa, Homo Sapiens
AFKPLFVDL

SEQ ID NO: 397838 - protein, 9 aa, Homo Sapiens
MVSSYNVLV

SEQ ID NO: 397839 - protein, 9 aa, Homo Sapiens
ATGQSYFRS

SEQ ID NO: 397840 - protein, 9 aa, Homo Sapiens
TEAGLKMLR

SEQ ID NO: 397841 - protein, 9 aa, Homo Sapiens
FSHASEDIS

SEQ ID NO: 397842 - protein, 9 aa, Homo Sapiens
QYHPSKGYW

SEQ ID NO: 397843 - protein, 9 aa, Homo Sapiens
EHLIESTNK

SEQ ID NO: 397844 - protein, 9 aa, Homo Sapiens
MVLGGRTFK

SEQ ID NO: 397845 - protein, 9 aa, Homo Sapiens
QGSLWERLV

SEQ ID NO: 397846 - protein, 9 aa, Homo Sapiens
KIFYPSVTS

SEQ ID NO: 397847 - protein, 9 aa, Homo Sapiens
YIHGVGELM

SEQ ID NO: 397848 - protein, 9 aa, Homo Sapiens
QSQLLRLRG

SEQ ID NO: 397849 - protein, 9 aa, Homo Sapiens
IVYVESMDI

SEQ ID NO: 397850 - protein, 9 aa, Homo Sapiens
QPRENVPKD

SEQ ID NO: 397851 - protein, 9 aa, Homo Sapiens
LIHSIKDKC

SEQ ID NO: 397852 - protein, 9 aa, Homo Sapiens
FTRFWSAVR

SEQ ID NO: 397853 - protein, 9 aa, Homo Sapiens
TRLNIFKLS

SEQ ID NO: 397854 - protein, 9 aa, Homo Sapiens
SLTSYGIEC

SEQ ID NO: 397855 - protein, 9 aa, Homo Sapiens
SKCRVTVMI

SEQ ID NO: 397856 - protein, 9 aa, Homo Sapiens
TASNSWDEH

SEQ ID NO: 397857 - protein, 9 aa, Homo Sapiens
LQAPMYFLI

SEQ ID NO: 397858 - protein, 9 aa, Homo Sapiens
FFLTMDPNN

SEQ ID NO: 397859 - protein, 9 aa, Homo Sapiens
QKGAQLHEA

SEQ ID NO: 397860 - protein, 9 aa, Homo Sapiens
EYPQTKCEY

SEQ ID NO: 397861 - protein, 9 aa, Homo Sapiens
DAMLILETI

SEQ ID NO: 397862 - protein, 9 aa, Homo Sapiens
IVEYPQTKC

SEQ ID NO: 397863 - protein, 9 aa, Homo Sapiens
VLFKHLDYA

SEQ ID NO: 397864 - protein, 9 aa, Homo Sapiens
CDLEISLWG

SEQ ID NO: 397865 - protein, 9 aa, Homo Sapiens
YVSLIYDAF

SEQ ID NO: 397866 - protein, 9 aa, Homo Sapiens
VRDILKVVI

SEQ ID NO: 397867 - protein, 9 aa, Homo Sapiens
SEENESRWR

SEQ ID NO: 397868 - protein, 9 aa, Homo Sapiens
LTGDVEELD

SEQ ID NO: 397869 - protein, 9 aa, Homo Sapiens
PREAMEAVH

SEQ ID NO: 397870 - protein, 9 aa, Homo Sapiens
VLSKPLNAP

SEQ ID NO: 397871 - protein, 9 aa, Homo Sapiens
WWLTKKHTV

SEQ ID NO: 397872 - protein, 9 aa, Homo Sapiens
GVPKILNSK

SEQ ID NO: 397873 - protein, 9 aa, Homo Sapiens
PAQQNVYRD

SEQ ID NO: 397874 - protein, 9 aa, Homo Sapiens
SAVNSHPQH

SEQ ID NO: 397875 - protein, 9 aa, Homo Sapiens
PPHSTTGTV

SEQ ID NO: 397876 - protein, 9 aa, Homo Sapiens
FNWSSRLTQ

SEQ ID NO: 397877 - protein, 9 aa, Homo Sapiens
EIGVILRLS

SEQ ID NO: 397878 - protein, 9 aa, Homo Sapiens
YWVEKLERS

SEQ ID NO: 397879 - protein, 9 aa, Homo Sapiens
NNGNELNRK

SEQ ID NO: 397880 - protein, 9 aa, Homo Sapiens
TSAHYPDAG

SEQ ID NO: 397881 - protein, 9 aa, Homo Sapiens
KEHDHLQNS

SEQ ID NO: 397882 - protein, 9 aa, Homo Sapiens
NVETNTYTV

SEQ ID NO: 397883 - protein, 9 aa, Homo Sapiens
WEATRDLDS

SEQ ID NO: 397884 - protein, 9 aa, Homo Sapiens
KAQEHVFNV

SEQ ID NO: 397885 - protein, 9 aa, Homo Sapiens
VHHLVFPAV

SEQ ID NO: 397886 - protein, 9 aa, Homo Sapiens
ANFMWGLIT

SEQ ID NO: 397887 - protein, 9 aa, Homo Sapiens
KIRDNSILG

SEQ ID NO: 397888 - protein, 9 aa, Homo Sapiens
MKLTDLTKG

SEQ ID NO: 397889 - protein, 9 aa, Homo Sapiens
KCINFRKFS

SEQ ID NO: 397890 - protein, 9 aa, Homo Sapiens
KSHISTLHK

SEQ ID NO: 397891 - protein, 9 aa, Homo Sapiens
YNTRYSSKC

SEQ ID NO: 397892 - protein, 9 aa, Homo Sapiens
QSTDQTLVD

SEQ ID NO: 397893 - protein, 9 aa, Homo Sapiens
EAERNSYCL

SEQ ID NO: 397894 - protein, 9 aa, Homo Sapiens
GMVAKLGNF

SEQ ID NO: 397895 - protein, 9 aa, Homo Sapiens
RHASDFTLW

SEQ ID NO: 397896 - protein, 9 aa, Homo Sapiens
ESTEVHGTI

SEQ ID NO: 397897 - protein, 9 aa, Homo Sapiens
LEENVTRES

SEQ ID NO: 397898 - protein, 9 aa, Homo Sapiens
SQVTLHATT

SEQ ID NO: 397899 - protein, 9 aa, Homo Sapiens
PIKHFPKHA

SEQ ID NO: 397900 - protein, 9 aa, Homo Sapiens
FSFEFLVRL

SEQ ID NO: 397901 - protein, 9 aa, Homo Sapiens
TTYQIDNFA

SEQ ID NO: 397902 - protein, 9 aa, Homo Sapiens
VVNYLTRNR

SEQ ID NO: 397903 - protein, 9 aa, Homo Sapiens
KRHFKLEKH

SEQ ID NO: 397904 - protein, 9 aa, Homo Sapiens
LKLHQTETF

SEQ ID NO: 397905 - protein, 9 aa, Homo Sapiens
EVPAINLAR

SEQ ID NO: 397906 - protein, 9 aa, Homo Sapiens
RGLDTLVTQ

SEQ ID NO: 397907 - protein, 9 aa, Homo Sapiens
GHAVLNKNM

SEQ ID NO: 397908 - protein, 9 aa, Homo Sapiens
ATNLQVNYP

SEQ ID NO: 397909 - protein, 9 aa, Homo Sapiens
GLVAHLLSK

SEQ ID NO: 397910 - protein, 9 aa, Homo Sapiens
INDNNPIFP

SEQ ID NO: 397911 - protein, 9 aa, Homo Sapiens
DIFKREAGN

SEQ ID NO: 397912 - protein, 9 aa, Homo Sapiens
VPGSSRKSN

SEQ ID NO: 397913 - protein, 9 aa, Homo Sapiens
KFDIVPSPN

SEQ ID NO: 397914 - protein, 9 aa, Homo Sapiens
KSSNKSNNG

SEQ ID NO: 397915 - protein, 9 aa, Homo Sapiens
PENLPSLPA

SEQ ID NO: 397916 - protein, 9 aa, Homo Sapiens
PLIYSLHNK

SEQ ID NO: 397917 - protein, 9 aa, Homo Sapiens
GKLLCNYTQ

SEQ ID NO: 397918 - protein, 9 aa, Homo Sapiens
RASSFRMTE

SEQ ID NO: 397919 - protein, 9 aa, Homo Sapiens
VLALEAEIQ

SEQ ID NO: 397920 - protein, 9 aa, Homo Sapiens
HTQPSEKIW

SEQ ID NO: 397921 - protein, 9 aa, Homo Sapiens
KLDELELEN

SEQ ID NO: 397922 - protein, 9 aa, Homo Sapiens
FQLNYLSGD

SEQ ID NO: 397923 - protein, 9 aa, Homo Sapiens
TPGGPIHVQ

SEQ ID NO: 397924 - protein, 9 aa, Homo Sapiens
LEQLKLLCG

SEQ ID NO: 397925 - protein, 9 aa, Homo Sapiens
TSSSSFKLE

SEQ ID NO: 397926 - protein, 9 aa, Homo Sapiens
TVCQLLSAC

SEQ ID NO: 397927 - protein, 9 aa, Homo Sapiens
QGWEYIILL

SEQ ID NO: 397928 - protein, 9 aa, Homo Sapiens
QTFVNVNYC

SEQ ID NO: 397929 - protein, 9 aa, Homo Sapiens
ERGMDTFLF

SEQ ID NO: 397930 - protein, 9 aa, Homo Sapiens
NVILSTKSK

SEQ ID NO: 397931 - protein, 9 aa, Homo Sapiens
VTRESISSK

SEQ ID NO: 397932 - protein, 9 aa, Homo Sapiens
GAYYCTGKV

SEQ ID NO: 397933 - protein, 9 aa, Homo Sapiens
EQNTLEINF

SEQ ID NO: 397934 - protein, 9 aa, Homo Sapiens
PSVVGEFTG

SEQ ID NO: 397935 - protein, 9 aa, Homo Sapiens
GIISVPAVA

SEQ ID NO: 397936 - protein, 9 aa, Homo Sapiens
SSRLQWRRG

SEQ ID NO: 397937 - protein, 9 aa, Homo Sapiens
IIQPVLAQD

SEQ ID NO: 397938 - protein, 9 aa, Homo Sapiens
CSLTNNFNK

SEQ ID NO: 397939 - protein, 9 aa, Homo Sapiens
CRIQVGKIT

SEQ ID NO: 397940 - protein, 9 aa, Homo Sapiens
HSNNIVVVL

SEQ ID NO: 397941 - protein, 9 aa, Homo Sapiens
LQFWAGRIA

SEQ ID NO: 397942 - protein, 9 aa, Homo Sapiens
GKKEKERGK

SEQ ID NO: 397943 - protein, 9 aa, Homo Sapiens
KHYGKINQY

SEQ ID NO: 397944 - protein, 9 aa, Homo Sapiens
VQEDVFIVV

SEQ ID NO: 397945 - protein, 9 aa, Homo Sapiens
SQNTSRKEY

SEQ ID NO: 397946 - protein, 9 aa, Homo Sapiens
HQITHFIDH

SEQ ID NO: 397947 - protein, 9 aa, Homo Sapiens
AINISEANQ

SEQ ID NO: 397948 - protein, 9 aa, Homo Sapiens
KITCTKRVV

SEQ ID NO: 397949 - protein, 9 aa, Homo Sapiens
DSSLENEIV

SEQ ID NO: 397950 - protein, 9 aa, Homo Sapiens
EKIIKECIN

SEQ ID NO: 397951 - protein, 9 aa, Homo Sapiens
KLGNFGIAR

SEQ ID NO: 397952 - protein, 9 aa, Homo Sapiens
KHYKICKLD

SEQ ID NO: 397953 - protein, 9 aa, Homo Sapiens
LREEEKHIK

SEQ ID NO: 397954 - protein, 9 aa, Homo Sapiens
VDRRHTLYH

SEQ ID NO: 397955 - protein, 9 aa, Homo Sapiens
PLIIFLVPV

SEQ ID NO: 397956 - protein, 9 aa, Homo Sapiens
IVTSIKSQE

SEQ ID NO: 397957 - protein, 9 aa, Homo Sapiens
GYLNRTSQK

SEQ ID NO: 397958 - protein, 9 aa, Homo Sapiens
PLHFRKDEL

SEQ ID NO: 397959 - protein, 9 aa, Homo Sapiens
KHMKKTFQL

SEQ ID NO: 397960 - protein, 9 aa, Homo Sapiens
STPPVCCSS

SEQ ID NO: 397961 - protein, 9 aa, Homo Sapiens
CEDVRTIDE

SEQ ID NO: 397962 - protein, 9 aa, Homo Sapiens
HREENISLE

SEQ ID NO: 397963 - protein, 9 aa, Homo Sapiens
CDSMVLGWK

SEQ ID NO: 397964 - protein, 9 aa, Homo Sapiens
EAGTTLGCY

SEQ ID NO: 397965 - protein, 9 aa, Homo Sapiens
NKKSPFDIK

SEQ ID NO: 397966 - protein, 9 aa, Homo Sapiens
LYKSVQNGA

SEQ ID NO: 397967 - protein, 9 aa, Homo Sapiens
LSSFKENED

SEQ ID NO: 397968 - protein, 9 aa, Homo Sapiens
MKYWREHAH

SEQ ID NO: 397969 - protein, 9 aa, Homo Sapiens
VVLEAIGSL

SEQ ID NO: 397970 - protein, 9 aa, Homo Sapiens
QDPVYPSLV

SEQ ID NO: 397971 - protein, 9 aa, Homo Sapiens
LYNINYEDN

SEQ ID NO: 397972 - protein, 9 aa, Homo Sapiens
GTVHPVFFI

SEQ ID NO: 397973 - protein, 9 aa, Homo Sapiens
RRLDIFSCL

SEQ ID NO: 397974 - protein, 9 aa, Homo Sapiens
KINTWRALS

SEQ ID NO: 397975 - protein, 9 aa, Homo Sapiens
EGKLLGTHI

SEQ ID NO: 397976 - protein, 9 aa, Homo Sapiens
ALQAKLQTG

SEQ ID NO: 397977 - protein, 9 aa, Homo Sapiens
NNFHKSTGM

SEQ ID NO: 397978 - protein, 9 aa, Homo Sapiens
AINLARVLD

SEQ ID NO: 397979 - protein, 9 aa, Homo Sapiens
VPLLLSPVS

SEQ ID NO: 397980 - protein, 9 aa, Homo Sapiens
AVADSIPKV

SEQ ID NO: 397981 - protein, 9 aa, Homo Sapiens
GRQLLIQFP

SEQ ID NO: 397982 - protein, 9 aa, Homo Sapiens
GDSPTDSQN

SEQ ID NO: 397983 - protein, 9 aa, Homo Sapiens
LDDSPSCPS

SEQ ID NO: 397984 - protein, 9 aa, Homo Sapiens
GEGASWSPR

SEQ ID NO: 397985 - protein, 9 aa, Homo Sapiens
DRDRKCREE

SEQ ID NO: 397986 - protein, 9 aa, Homo Sapiens
AYPALSLSS

SEQ ID NO: 397987 - protein, 9 aa, Homo Sapiens
CKEKCEGFK

SEQ ID NO: 397988 - protein, 9 aa, Homo Sapiens
LLSSDELSK

SEQ ID NO: 397989 - protein, 9 aa, Homo Sapiens
LENEIVVLK

SEQ ID NO: 397990 - protein, 9 aa, Homo Sapiens
KEVGYLELT

SEQ ID NO: 397991 - protein, 9 aa, Homo Sapiens
EQDFRKRRP

SEQ ID NO: 397992 - protein, 9 aa, Homo Sapiens
SEWCHYKLY

SEQ ID NO: 397993 - protein, 9 aa, Homo Sapiens
CLESFCDSM

SEQ ID NO: 397994 - protein, 9 aa, Homo Sapiens
ISKIEGKEL

SEQ ID NO: 397995 - protein, 9 aa, Homo Sapiens
AATTEKWRF

SEQ ID NO: 397996 - protein, 9 aa, Homo Sapiens
NLTQLTFFF

SEQ ID NO: 397997 - protein, 9 aa, Homo Sapiens
NCEERNHDL

SEQ ID NO: 397998 - protein, 9 aa, Homo Sapiens
STEETPRNI

SEQ ID NO: 397999 - protein, 9 aa, Homo Sapiens
PRKPPMDDK

SEQ ID NO: 398000 - protein, 9 aa, Homo Sapiens
NREQGDNGL

SEQ ID NO: 398001 - protein, 9 aa, Homo Sapiens
VQNMVSFNS

SEQ ID NO: 398002 - protein, 9 aa, Homo Sapiens
VQTRKQICI

SEQ ID NO: 398003 - protein, 9 aa, Homo Sapiens
MSPHTGDAK

SEQ ID NO: 398004 - protein, 9 aa, Homo Sapiens
KYEQIGKIG

SEQ ID NO: 398005 - protein, 9 aa, Homo Sapiens
QMRKIIGKN

SEQ ID NO: 398006 - protein, 9 aa, Homo Sapiens
MECGHLFPP

SEQ ID NO: 398007 - protein, 9 aa, Homo Sapiens
LVVKKLDVE

SEQ ID NO: 398008 - protein, 9 aa, Homo Sapiens
FNLSLTTEQ

SEQ ID NO: 398009 - protein, 9 aa, Homo Sapiens
SDKEGKLLC

SEQ ID NO: 398010 - protein, 9 aa, Homo Sapiens
TLYHGHQAA

SEQ ID NO: 398011 - protein, 9 aa, Homo Sapiens
LYLDLIHQK

SEQ ID NO: 398012 - protein, 9 aa, Homo Sapiens
DTFLFRPHC

SEQ ID NO: 398013 - protein, 9 aa, Homo Sapiens
LLAYNRYGP

SEQ ID NO: 398014 - protein, 9 aa, Homo Sapiens
LFLSLGLQD

SEQ ID NO: 398015 - protein, 9 aa, Homo Sapiens
PPSVFPLSL

SEQ ID NO: 398016 - protein, 9 aa, Homo Sapiens
RTIDEDCSQ

SEQ ID NO: 398017 - protein, 9 aa, Homo Sapiens
QIDNFAQAF

SEQ ID NO: 398018 - protein, 9 aa, Homo Sapiens
VSDYDCDDE

SEQ ID NO: 398019 - protein, 9 aa, Homo Sapiens
AILRLRVLV

SEQ ID NO: 398020 - protein, 9 aa, Homo Sapiens
TDNLSCPSP

SEQ ID NO: 398021 - protein, 9 aa, Homo Sapiens
YLISTKEEP

SEQ ID NO: 398022 - protein, 9 aa, Homo Sapiens
NKTVDLLYS

SEQ ID NO: 398023 - protein, 9 aa, Homo Sapiens
LCIIDPRKG

SEQ ID NO: 398024 - protein, 9 aa, Homo Sapiens
NYDWYNVSD

SEQ ID NO: 398025 - protein, 9 aa, Homo Sapiens
ATMNTTNQQ

SEQ ID NO: 398026 - protein, 9 aa, Homo Sapiens
ASNSWDEHV

SEQ ID NO: 398027 - protein, 9 aa, Homo Sapiens
YLLTVQRET

SEQ ID NO: 398028 - protein, 9 aa, Homo Sapiens
TKKLFDDLG

SEQ ID NO: 398029 - protein, 9 aa, Homo Sapiens
SNFVDNVYG

SEQ ID NO: 398030 - protein, 9 aa, Homo Sapiens
KGAQLHEAN

SEQ ID NO: 398031 - protein, 9 aa, Homo Sapiens
MKYFILTVS

SEQ ID NO: 398032 - protein, 9 aa, Homo Sapiens
RHPSALQLP

SEQ ID NO: 398033 - protein, 9 aa, Homo Sapiens
TFFLTMDPN

SEQ ID NO: 398034 - protein, 9 aa, Homo Sapiens
HIAQTDAED

SEQ ID NO: 398035 - protein, 9 aa, Homo Sapiens
HDHLQNSDR

SEQ ID NO: 398036 - protein, 9 aa, Homo Sapiens
VPNMTPSAV

SEQ ID NO: 398037 - protein, 9 aa, Homo Sapiens
CKDIQHIPS

SEQ ID NO: 398038 - protein, 9 aa, Homo Sapiens
GGEHEGSLQ

SEQ ID NO: 398039 - protein, 9 aa, Homo Sapiens
HHIGTLSVY

SEQ ID NO: 398040 - protein, 9 aa, Homo Sapiens
LSVAQCQLM

SEQ ID NO: 398041 - protein, 9 aa, Homo Sapiens
FHLLELDKV

SEQ ID NO: 398042 - protein, 9 aa, Homo Sapiens
GLLQSGFYD

SEQ ID NO: 398043 - protein, 9 aa, Homo Sapiens
VILSTKSKT

SEQ ID NO: 398044 - protein, 9 aa, Homo Sapiens
TNTVFKVLK

SEQ ID NO: 398045 - protein, 9 aa, Homo Sapiens
ILRICSTEG

SEQ ID NO: 398046 - protein, 9 aa, Homo Sapiens
LKLPYLSKQ

SEQ ID NO: 398047 - protein, 9 aa, Homo Sapiens
TQTALNLTA

SEQ ID NO: 398048 - protein, 9 aa, Homo Sapiens
AVYFLLPEE

SEQ ID NO: 398049 - protein, 9 aa, Homo Sapiens
GCLNKSART

SEQ ID NO: 398050 - protein, 9 aa, Homo Sapiens
VPEVIVYVE

SEQ ID NO: 398051 - protein, 9 aa, Homo Sapiens
HTDKFLIQL

SEQ ID NO: 398052 - protein, 9 aa, Homo Sapiens
LAPETVLLS

SEQ ID NO: 398053 - protein, 9 aa, Homo Sapiens
YSLHNKEVT

SEQ ID NO: 398054 - protein, 9 aa, Homo Sapiens
MPSNKDENG

SEQ ID NO: 398055 - protein, 9 aa, Homo Sapiens
CDKITCTKR

SEQ ID NO: 398056 - protein, 9 aa, Homo Sapiens
KDENGLVVL

SEQ ID NO: 398057 - protein, 9 aa, Homo Sapiens
HLLQDTAFQ

SEQ ID NO: 398058 - protein, 9 aa, Homo Sapiens
SITVELKSE

SEQ ID NO: 398059 - protein, 9 aa, Homo Sapiens
ADVKEDDLL

SEQ ID NO: 398060 - protein, 9 aa, Homo Sapiens
IISQEECSS

SEQ ID NO: 398061 - protein, 9 aa, Homo Sapiens
SALNNELFA

SEQ ID NO: 398062 - protein, 9 aa, Homo Sapiens
KCEGFKLHF

SEQ ID NO: 398063 - protein, 9 aa, Homo Sapiens
DVCAILNRM

SEQ ID NO: 398064 - protein, 9 aa, Homo Sapiens
KSNKFQMLL

SEQ ID NO: 398065 - protein, 9 aa, Homo Sapiens
YLQMNYVVN

SEQ ID NO: 398066 - protein, 9 aa, Homo Sapiens
PSPVEPQGP

SEQ ID NO: 398067 - protein, 9 aa, Homo Sapiens
QFLVAFESQ

SEQ ID NO: 398068 - protein, 9 aa, Homo Sapiens
RHIMDRTPD

SEQ ID NO: 398069 - protein, 9 aa, Homo Sapiens
ATPIYQLQL

SEQ ID NO: 398070 - protein, 9 aa, Homo Sapiens
SADSVQYHH

SEQ ID NO: 398071 - protein, 9 aa, Homo Sapiens
KMTFMRFQM

SEQ ID NO: 398072 - protein, 9 aa, Homo Sapiens
DSPTDSQND

SEQ ID NO: 398073 - protein, 9 aa, Homo Sapiens
LGSVSEDNS

SEQ ID NO: 398074 - protein, 9 aa, Homo Sapiens
LQLERNIET

SEQ ID NO: 398075 - protein, 9 aa, Homo Sapiens
LQFQNPVYD

SEQ ID NO: 398076 - protein, 9 aa, Homo Sapiens
QTDAEDSPP

SEQ ID NO: 398077 - protein, 9 aa, Homo Sapiens
AHIQLKPTV

SEQ ID NO: 398078 - protein, 9 aa, Homo Sapiens
ILQSDYLQG

SEQ ID NO: 398079 - protein, 9 aa, Homo Sapiens
SELIEADAP

SEQ ID NO: 398080 - protein, 9 aa, Homo Sapiens
QSSETRVQD

SEQ ID NO: 398081 - protein, 9 aa, Homo Sapiens
TYECVHLYV

SEQ ID NO: 398082 - protein, 9 aa, Homo Sapiens
RNITVQKNK

SEQ ID NO: 398083 - protein, 9 aa, Homo Sapiens
KIIHTRENI

SEQ ID NO: 398084 - protein, 9 aa, Homo Sapiens
PFLIFFLYY

SEQ ID NO: 398085 - protein, 9 aa, Homo Sapiens
FESNNFIYL

SEQ ID NO: 398086 - protein, 9 aa, Homo Sapiens
QNIEKKKAT

SEQ ID NO: 398087 - protein, 9 aa, Homo Sapiens
DVNSGVYEK

SEQ ID NO: 398088 - protein, 9 aa, Homo Sapiens
SMAFSNLAE

SEQ ID NO: 398089 - protein, 9 aa, Homo Sapiens
LIQMSVVPL

SEQ ID NO: 398090 - protein, 9 aa, Homo Sapiens
RYSSKCRVT

SEQ ID NO: 398091 - protein, 9 aa, Homo Sapiens
INSSLEKLN

SEQ ID NO: 398092 - protein, 9 aa, Homo Sapiens
EVKPLGVMW

SEQ ID NO: 398093 - protein, 9 aa, Homo Sapiens
NKSARTRKE

SEQ ID NO: 398094 - protein, 9 aa, Homo Sapiens
RSPLSNHVQ

SEQ ID NO: 398095 - protein, 9 aa, Homo Sapiens
RKRHKQTSD

SEQ ID NO: 398096 - protein, 9 aa, Homo Sapiens
LRFNPVRGE

SEQ ID NO: 398097 - protein, 9 aa, Homo Sapiens
DVNLPATQL

SEQ ID NO: 398098 - protein, 9 aa, Homo Sapiens
REENISLEE

SEQ ID NO: 398099 - protein, 9 aa, Homo Sapiens
TQTHTGAKP

SEQ ID NO: 398100 - protein, 9 aa, Homo Sapiens
DEAMSYCQY

SEQ ID NO: 398101 - protein, 9 aa, Homo Sapiens
ATNTFLNPQ

SEQ ID NO: 398102 - protein, 9 aa, Homo Sapiens
AANNLNQDN

SEQ ID NO: 398103 - protein, 9 aa, Homo Sapiens
KQGEPGLPG

SEQ ID NO: 398104 - protein, 9 aa, Homo Sapiens
AICYGSGIF

SEQ ID NO: 398105 - protein, 9 aa, Homo Sapiens
SLINYPYKI

SEQ ID NO: 398106 - protein, 9 aa, Homo Sapiens
ALGGRESYM

SEQ ID NO: 398107 - protein, 9 aa, Homo Sapiens
KISLNAHSY

SEQ ID NO: 398108 - protein, 9 aa, Homo Sapiens
KTTSKFSVS

SEQ ID NO: 398109 - protein, 9 aa, Homo Sapiens
CIDLYKSYR

SEQ ID NO: 398110 - protein, 9 aa, Homo Sapiens
TTMECVPVT

SEQ ID NO: 398111 - protein, 9 aa, Homo Sapiens
VLYDVIPEE

SEQ ID NO: 398112 - protein, 9 aa, Homo Sapiens
GLTNEGSDD

SEQ ID NO: 398113 - protein, 9 aa, Homo Sapiens
VKESTEVHG

SEQ ID NO: 398114 - protein, 9 aa, Homo Sapiens
MSSRVHKAV

SEQ ID NO: 398115 - protein, 9 aa, Homo Sapiens
IFQMLIIEK

SEQ ID NO: 398116 - protein, 9 aa, Homo Sapiens
FHADNFLQQ

SEQ ID NO: 398117 - protein, 9 aa, Homo Sapiens
SDLRVGANV

SEQ ID NO: 398118 - protein, 9 aa, Homo Sapiens
SCLATRLNI

SEQ ID NO: 398119 - protein, 9 aa, Homo Sapiens
EVNKHISIA

SEQ ID NO: 398120 - protein, 9 aa, Homo Sapiens
TDSSDKKEN

SEQ ID NO: 398121 - protein, 9 aa, Homo Sapiens
TCWTLGRYA

SEQ ID NO: 398122 - protein, 9 aa, Homo Sapiens
VPPGWGMVS

SEQ ID NO: 398123 - protein, 9 aa, Homo Sapiens
QRKYITKNV

SEQ ID NO: 398124 - protein, 9 aa, Homo Sapiens
KPGNMSMAF

SEQ ID NO: 398125 - protein, 9 aa, Homo Sapiens
LKRDFRNKS

SEQ ID NO: 398126 - protein, 9 aa, Homo Sapiens
IHQKKMSPP

SEQ ID NO: 398127 - protein, 9 aa, Homo Sapiens
ASSACLCPQ

SEQ ID NO: 398128 - protein, 9 aa, Homo Sapiens
TRAGFIENT

SEQ ID NO: 398129 - protein, 9 aa, Homo Sapiens
RRLSNKKKN

SEQ ID NO: 398130 - protein, 9 aa, Homo Sapiens
VLQQKVTAY

SEQ ID NO: 398131 - protein, 9 aa, Homo Sapiens
NPDSVAEVL

SEQ ID NO: 398132 - protein, 9 aa, Homo Sapiens
MHVLEDIAT

SEQ ID NO: 398133 - protein, 9 aa, Homo Sapiens
YIMRVPHSV

SEQ ID NO: 398134 - protein, 9 aa, Homo Sapiens
SSGGATAAA

SEQ ID NO: 398135 - protein, 9 aa, Homo Sapiens
GATGPGAEE

SEQ ID NO: 398136 - protein, 9 aa, Homo Sapiens
TRTSYSEGP

SEQ ID NO: 398137 - protein, 9 aa, Homo Sapiens
EPSQNNWLQ

SEQ ID NO: 398138 - protein, 9 aa, Homo Sapiens
NQNIRTWIN

SEQ ID NO: 398139 - protein, 9 aa, Homo Sapiens
SHNSKDSET

SEQ ID NO: 398140 - protein, 9 aa, Homo Sapiens
LSHLIQHKI

SEQ ID NO: 398141 - protein, 9 aa, Homo Sapiens
MGLIIEIEI

SEQ ID NO: 398142 - protein, 9 aa, Homo Sapiens
FSYFGQDIL

SEQ ID NO: 398143 - protein, 9 aa, Homo Sapiens
RLAWKEVNK

SEQ ID NO: 398144 - protein, 9 aa, Homo Sapiens
QKLHTDDED

SEQ ID NO: 398145 - protein, 9 aa, Homo Sapiens
TSERFKNWK

SEQ ID NO: 398146 - protein, 9 aa, Homo Sapiens
PPSPLQEGE

SEQ ID NO: 398147 - protein, 9 aa, Homo Sapiens
KLDIEKTKL

SEQ ID NO: 398148 - protein, 9 aa, Homo Sapiens
VYGYPEGKD

SEQ ID NO: 398149 - protein, 9 aa, Homo Sapiens
SFKENEDNI

SEQ ID NO: 398150 - protein, 9 aa, Homo Sapiens
TADQIRNKN

SEQ ID NO: 398151 - protein, 9 aa, Homo Sapiens
FLFALYIMR

SEQ ID NO: 398152 - protein, 9 aa, Homo Sapiens
FCVMPRDPS

SEQ ID NO: 398153 - protein, 9 aa, Homo Sapiens
RQLLIQFPW

SEQ ID NO: 398154 - protein, 9 aa, Homo Sapiens
LRRTRISAV

SEQ ID NO: 398155 - protein, 9 aa, Homo Sapiens
SFLQEIKKS

SEQ ID NO: 398156 - protein, 9 aa, Homo Sapiens
MEEVQSFEK

SEQ ID NO: 398157 - protein, 9 aa, Homo Sapiens
KKPHINKPL

SEQ ID NO: 398158 - protein, 9 aa, Homo Sapiens
LGVFVCYFD

SEQ ID NO: 398159 - protein, 9 aa, Homo Sapiens
CVTFAVPKS

SEQ ID NO: 398160 - protein, 9 aa, Homo Sapiens
WVDSTPLPG

SEQ ID NO: 398161 - protein, 9 aa, Homo Sapiens
QKILQSDYL

SEQ ID NO: 398162 - protein, 9 aa, Homo Sapiens
CIGNKNNQR

SEQ ID NO: 398163 - protein, 9 aa, Homo Sapiens
GDILMECGH

SEQ ID NO: 398164 - protein, 9 aa, Homo Sapiens
LGGRTVEVQ

SEQ ID NO: 398165 - protein, 9 aa, Homo Sapiens
TLTAETDCQ

SEQ ID NO: 398166 - protein, 9 aa, Homo Sapiens
QLWEPNTTF

SEQ ID NO: 398167 - protein, 9 aa, Homo Sapiens
LFSTLSQPA

SEQ ID NO: 398168 - protein, 9 aa, Homo Sapiens
KPHINKPLN

SEQ ID NO: 398169 - protein, 9 aa, Homo Sapiens
QEVTIKYLE

SEQ ID NO: 398170 - protein, 9 aa, Homo Sapiens
FDEIFNQFT

SEQ ID NO: 398171 - protein, 9 aa, Homo Sapiens
IIQLSPKKI

SEQ ID NO: 398172 - protein, 9 aa, Homo Sapiens
NSQNKIKQV

SEQ ID NO: 398173 - protein, 9 aa, Homo Sapiens
GKSCGYSVQ

SEQ ID NO: 398174 - protein, 9 aa, Homo Sapiens
ENTLFLFIA

SEQ ID NO: 398175 - protein, 9 aa, Homo Sapiens
RMVTNTIED

SEQ ID NO: 398176 - protein, 9 aa, Homo Sapiens
LRCHVLTSG

SEQ ID NO: 398177 - protein, 9 aa, Homo Sapiens
SGDGEVTVA

SEQ ID NO: 398178 - protein, 9 aa, Homo Sapiens
LEPVLITEA

SEQ ID NO: 398179 - protein, 9 aa, Homo Sapiens
CDKVLQDCK

SEQ ID NO: 398180 - protein, 9 aa, Homo Sapiens
DFTLWKAAK

SEQ ID NO: 398181 - protein, 9 aa, Homo Sapiens
CGHAVLNKN

SEQ ID NO: 398182 - protein, 9 aa, Homo Sapiens
QDMQIKKKQ

SEQ ID NO: 398183 - protein, 9 aa, Homo Sapiens
RHSRTGCTF

SEQ ID NO: 398184 - protein, 9 aa, Homo Sapiens
SGLGGCLGS

SEQ ID NO: 398185 - protein, 9 aa, Homo Sapiens
MASTKKLFD

SEQ ID NO: 398186 - protein, 9 aa, Homo Sapiens
SAFPSECCS

SEQ ID NO: 398187 - protein, 9 aa, Homo Sapiens
PAAYCGVGD

SEQ ID NO: 398188 - protein, 9 aa, Homo Sapiens
DRLFSYFGQ

SEQ ID NO: 398189 - protein, 9 aa, Homo Sapiens
AYVQALVRF

SEQ ID NO: 398190 - protein, 9 aa, Homo Sapiens
SVVGEFTGS

SEQ ID NO: 398191 - protein, 9 aa, Homo Sapiens
ADKLLSHIH

SEQ ID NO: 398192 - protein, 9 aa, Homo Sapiens
FGVPKILNS

SEQ ID NO: 398193 - protein, 9 aa, Homo Sapiens
TFVNVNYCT

SEQ ID NO: 398194 - protein, 9 aa, Homo Sapiens
THGQNNPVG

SEQ ID NO: 398195 - protein, 9 aa, Homo Sapiens
NQLSNCRNH

SEQ ID NO: 398196 - protein, 9 aa, Homo Sapiens
VQPQEPNVT

SEQ ID NO: 398197 - protein, 9 aa, Homo Sapiens
APMYFLICS

SEQ ID NO: 398198 - protein, 9 aa, Homo Sapiens
QPDQSTPSL

SEQ ID NO: 398199 - protein, 9 aa, Homo Sapiens
FLFLIRNRR

SEQ ID NO: 398200 - protein, 9 aa, Homo Sapiens
LGVMWKQHK

SEQ ID NO: 398201 - protein, 9 aa, Homo Sapiens
RLQIRYGQT

SEQ ID NO: 398202 - protein, 9 aa, Homo Sapiens
AEAHNPDSV

SEQ ID NO: 398203 - protein, 9 aa, Homo Sapiens
PFRHDLDYL

SEQ ID NO: 398204 - protein, 9 aa, Homo Sapiens
EPTAAPHPM

SEQ ID NO: 398205 - protein, 9 aa, Homo Sapiens
CSGIISVPA

SEQ ID NO: 398206 - protein, 9 aa, Homo Sapiens
TFAVPKSSS

SEQ ID NO: 398207 - protein, 9 aa, Homo Sapiens
VYVSDNIQI

SEQ ID NO: 398208 - protein, 9 aa, Homo Sapiens
NHFFTESLW

SEQ ID NO: 398209 - protein, 9 aa, Homo Sapiens
GCFLQFYLF

SEQ ID NO: 398210 - protein, 9 aa, Homo Sapiens
RYIMECPEI

SEQ ID NO: 398211 - protein, 9 aa, Homo Sapiens
TNTIEDNFP

SEQ ID NO: 398212 - protein, 9 aa, Homo Sapiens
HAVLNKNMP

SEQ ID NO: 398213 - protein, 9 aa, Homo Sapiens
DNGKRDVDI

SEQ ID NO: 398214 - protein, 9 aa, Homo Sapiens
CEENLRKIQ

SEQ ID NO: 398215 - protein, 9 aa, Homo Sapiens
ATKKHTGKQ

SEQ ID NO: 398216 - protein, 9 aa, Homo Sapiens
NMTPSAVGR

SEQ ID NO: 398217 - protein, 9 aa, Homo Sapiens
VQRQLPGSS

SEQ ID NO: 398218 - protein, 9 aa, Homo Sapiens
AMLILETIT

SEQ ID NO: 398219 - protein, 9 aa, Homo Sapiens
TFLNPQKDG

SEQ ID NO: 398220 - protein, 9 aa, Homo Sapiens
QAPESISDK

SEQ ID NO: 398221 - protein, 9 aa, Homo Sapiens
RKMNMHNIP

SEQ ID NO: 398222 - protein, 9 aa, Homo Sapiens
IFIIILSYV

SEQ ID NO: 398223 - protein, 9 aa, Homo Sapiens
AKLSQILDV

SEQ ID NO: 398224 - protein, 9 aa, Homo Sapiens
ESSALEQHK

SEQ ID NO: 398225 - protein, 9 aa, Homo Sapiens
NKILIKEKV

SEQ ID NO: 398226 - protein, 9 aa, Homo Sapiens
SQELSNITM

SEQ ID NO: 398227 - protein, 9 aa, Homo Sapiens
EIKKLRLRV

SEQ ID NO: 398228 - protein, 9 aa, Homo Sapiens
RSRLIQGES

SEQ ID NO: 398229 - protein, 9 aa, Homo Sapiens
LTQTYQEKV

SEQ ID NO: 398230 - protein, 9 aa, Homo Sapiens
ITHFIDHDR

SEQ ID NO: 398231 - protein, 9 aa, Homo Sapiens
DKYITLDEW

SEQ ID NO: 398232 - protein, 9 aa, Homo Sapiens
TVEVQGPSL

SEQ ID NO: 398233 - protein, 9 aa, Homo Sapiens
SHLTSHKII

SEQ ID NO: 398234 - protein, 9 aa, Homo Sapiens
PLDPLTLEP

SEQ ID NO: 398235 - protein, 9 aa, Homo Sapiens
SAVMVTGDN

SEQ ID NO: 398236 - protein, 9 aa, Homo Sapiens
EWDEMDISS

SEQ ID NO: 398237 - protein, 9 aa, Homo Sapiens
DQSTPSLFD

SEQ ID NO: 398238 - protein, 9 aa, Homo Sapiens
LKATSDKKY

SEQ ID NO: 398239 - protein, 9 aa, Homo Sapiens
KKEEVFLIF

SEQ ID NO: 398240 - protein, 9 aa, Homo Sapiens
LIQHKIIHT

SEQ ID NO: 398241 - protein, 9 aa, Homo Sapiens
LDAVHREEN

SEQ ID NO: 398242 - protein, 9 aa, Homo Sapiens
HASDFTLWK

SEQ ID NO: 398243 - protein, 9 aa, Homo Sapiens
LGLFTSSFP

SEQ ID NO: 398244 - protein, 9 aa, Homo Sapiens
MKGLPKLEK

SEQ ID NO: 398245 - protein, 9 aa, Homo Sapiens
EDVDIFYYF

SEQ ID NO: 398246 - protein, 9 aa, Homo Sapiens
EQQNKLWVG

SEQ ID NO: 398247 - protein, 9 aa, Homo Sapiens
MIQMKTHSR

SEQ ID NO: 398248 - protein, 9 aa, Homo Sapiens
VANNILTDE

SEQ ID NO: 398249 - protein, 9 aa, Homo Sapiens
EAIIGGEEP

SEQ ID NO: 398250 - protein, 9 aa, Homo Sapiens
CWLLAPVSS

SEQ ID NO: 398251 - protein, 9 aa, Homo Sapiens
NVPKDISEE

SEQ ID NO: 398252 - protein, 9 aa, Homo Sapiens
DGTNDCGAL

SEQ ID NO: 398253 - protein, 9 aa, Homo Sapiens
DVIRKDVCA

SEQ ID NO: 398254 - protein, 9 aa, Homo Sapiens
LYRASGNLV

SEQ ID NO: 398255 - protein, 9 aa, Homo Sapiens
STHPLLLDD

SEQ ID NO: 398256 - protein, 9 aa, Homo Sapiens
FEKETGNPL

SEQ ID NO: 398257 - protein, 9 aa, Homo Sapiens
MCGSRSTDN

SEQ ID NO: 398258 - protein, 9 aa, Homo Sapiens
TYSEVDDKL

SEQ ID NO: 398259 - protein, 9 aa, Homo Sapiens
TTKIAATAW

SEQ ID NO: 398260 - protein, 9 aa, Homo Sapiens
LQGIQLFDR

SEQ ID NO: 398261 - protein, 9 aa, Homo Sapiens
LSTIKYHSW

SEQ ID NO: 398262 - protein, 9 aa, Homo Sapiens
KYIDQKLCK

SEQ ID NO: 398263 - protein, 9 aa, Homo Sapiens
KSYQTAKFH

SEQ ID NO: 398264 - protein, 9 aa, Homo Sapiens
MFNPCGYLM

SEQ ID NO: 398265 - protein, 9 aa, Homo Sapiens
PSDILGLLV

SEQ ID NO: 398266 - protein, 9 aa, Homo Sapiens
EIQTLKHKF

SEQ ID NO: 398267 - protein, 9 aa, Homo Sapiens
KKWKSITLS

SEQ ID NO: 398268 - protein, 9 aa, Homo Sapiens
LSLYLVAYR

SEQ ID NO: 398269 - protein, 9 aa, Homo Sapiens
GENLSGIYC

SEQ ID NO: 398270 - protein, 9 aa, Homo Sapiens
ISANPEDAG

SEQ ID NO: 398271 - protein, 9 aa, Homo Sapiens
ARALGEWGK

SEQ ID NO: 398272 - protein, 9 aa, Homo Sapiens
KEGLDISRL

SEQ ID NO: 398273 - protein, 9 aa, Homo Sapiens
GNQFLRFNP

SEQ ID NO: 398274 - protein, 9 aa, Homo Sapiens
GVLKPGTVV

SEQ ID NO: 398275 - protein, 9 aa, Homo Sapiens
FKYLVQLPV

SEQ ID NO: 398276 - protein, 9 aa, Homo Sapiens
WLWLGGGRA

SEQ ID NO: 398277 - protein, 9 aa, Homo Sapiens
SRQGAGYSF

SEQ ID NO: 398278 - protein, 9 aa, Homo Sapiens
HPVFFIIFA

SEQ ID NO: 398279 - protein, 9 aa, Homo Sapiens
STLKKHNII

SEQ ID NO: 398280 - protein, 9 aa, Homo Sapiens
LEPTPGQSP

SEQ ID NO: 398281 - protein, 9 aa, Homo Sapiens
MFWCKFTAS

SEQ ID NO: 398282 - protein, 9 aa, Homo Sapiens
NRRRINGFK

SEQ ID NO: 398283 - protein, 9 aa, Homo Sapiens
LLLQDLFIV

SEQ ID NO: 398284 - protein, 9 aa, Homo Sapiens
KVTAYTQIV

SEQ ID NO: 398285 - protein, 9 aa, Homo Sapiens
EHEGSLQMK

SEQ ID NO: 398286 - protein, 9 aa, Homo Sapiens
KGFKDKLSS

SEQ ID NO: 398287 - protein, 9 aa, Homo Sapiens
NVSEEEEIK

SEQ ID NO: 398288 - protein, 9 aa, Homo Sapiens
AVQRVLATE

SEQ ID NO: 398289 - protein, 9 aa, Homo Sapiens
LGLINNSRF

SEQ ID NO: 398290 - protein, 9 aa, Homo Sapiens
QPTCHNFNQ

SEQ ID NO: 398291 - protein, 9 aa, Homo Sapiens
RLQGQEELL

SEQ ID NO: 398292 - protein, 9 aa, Homo Sapiens
PLKPYPNKP

SEQ ID NO: 398293 - protein, 9 aa, Homo Sapiens
NSNMTCDKW

SEQ ID NO: 398294 - protein, 9 aa, Homo Sapiens
KKDLRSVLF

SEQ ID NO: 398295 - protein, 9 aa, Homo Sapiens
VVLKKIKHE

SEQ ID NO: 398296 - protein, 9 aa, Homo Sapiens
NFIYLLTVQ

SEQ ID NO: 398297 - protein, 9 aa, Homo Sapiens
HISLLNRGQ

SEQ ID NO: 398298 - protein, 9 aa, Homo Sapiens
CYSQNSSLH

SEQ ID NO: 398299 - protein, 9 aa, Homo Sapiens
SPVKARALK

SEQ ID NO: 398300 - protein, 9 aa, Homo Sapiens
FVSELQIYM

SEQ ID NO: 398301 - protein, 9 aa, Homo Sapiens
IAGEDVAIV

SEQ ID NO: 398302 - protein, 9 aa, Homo Sapiens
SCKLCTLKL

SEQ ID NO: 398303 - protein, 9 aa, Homo Sapiens
VATGGVEKA

SEQ ID NO: 398304 - protein, 9 aa, Homo Sapiens
RNSPEVSLL

SEQ ID NO: 398305 - protein, 9 aa, Homo Sapiens
DICQAYFAT

SEQ ID NO: 398306 - protein, 9 aa, Homo Sapiens
IVDHPFLFL

SEQ ID NO: 398307 - protein, 9 aa, Homo Sapiens
TCVLSITAT

SEQ ID NO: 398308 - protein, 9 aa, Homo Sapiens
IIVRNVLLA

SEQ ID NO: 398309 - protein, 9 aa, Homo Sapiens
GLKNILRLH

SEQ ID NO: 398310 - protein, 9 aa, Homo Sapiens
NKHISIAAF

SEQ ID NO: 398311 - protein, 9 aa, Homo Sapiens
DLRSVLFNF

SEQ ID NO: 398312 - protein, 9 aa, Homo Sapiens
GSATNTFLN

SEQ ID NO: 398313 - protein, 9 aa, Homo Sapiens
VSGRHWNNF

SEQ ID NO: 398314 - protein, 9 aa, Homo Sapiens
HAQAEKHFQ

SEQ ID NO: 398315 - protein, 9 aa, Homo Sapiens
LYLHSPAPA

SEQ ID NO: 398316 - protein, 9 aa, Homo Sapiens
YPETFFLLR

SEQ ID NO: 398317 - protein, 9 aa, Homo Sapiens
ANDPTYLRK

SEQ ID NO: 398318 - protein, 9 aa, Homo Sapiens
TGEALYKIL

SEQ ID NO: 398319 - protein, 9 aa, Homo Sapiens
SSGLVNGLQ

SEQ ID NO: 398320 - protein, 9 aa, Homo Sapiens
TEVVMSGVC

SEQ ID NO: 398321 - protein, 9 aa, Homo Sapiens
LNALKTVMN

SEQ ID NO: 398322 - protein, 9 aa, Homo Sapiens
PSLGQFSSS

SEQ ID NO: 398323 - protein, 9 aa, Homo Sapiens
ESLTSYGIE

SEQ ID NO: 398324 - protein, 9 aa, Homo Sapiens
VPTQLSTTM

SEQ ID NO: 398325 - protein, 9 aa, Homo Sapiens
VWSLPSDIL

SEQ ID NO: 398326 - protein, 9 aa, Homo Sapiens
IGHKIYSKI

SEQ ID NO: 398327 - protein, 9 aa, Homo Sapiens
VHLLSSRNT

SEQ ID NO: 398328 - protein, 9 aa, Homo Sapiens
PKVPAGVQK

SEQ ID NO: 398329 - protein, 9 aa, Homo Sapiens
RIADVKEDD

SEQ ID NO: 398330 - protein, 9 aa, Homo Sapiens
LSTHHNIRA

SEQ ID NO: 398331 - protein, 9 aa, Homo Sapiens
FASFSDDGR

SEQ ID NO: 398332 - protein, 9 aa, Homo Sapiens
CLNKSARTR

SEQ ID NO: 398333 - protein, 9 aa, Homo Sapiens
IGYLNRTSQ

SEQ ID NO: 398334 - protein, 9 aa, Homo Sapiens
GHAEHELTE

SEQ ID NO: 398335 - protein, 9 aa, Homo Sapiens
PDFFYLSDY

SEQ ID NO: 398336 - protein, 9 aa, Homo Sapiens
LKLSPKNLA

SEQ ID NO: 398337 - protein, 9 aa, Homo Sapiens
QMNYVVNFC

SEQ ID NO: 398338 - protein, 9 aa, Homo Sapiens
LSPKNLAAP

SEQ ID NO: 398339 - protein, 9 aa, Homo Sapiens
KIWIEIIAL

SEQ ID NO: 398340 - protein, 9 aa, Homo Sapiens
QMFKYILNF

SEQ ID NO: 398341 - protein, 9 aa, Homo Sapiens
DQIVTSIKS

SEQ ID NO: 398342 - protein, 9 aa, Homo Sapiens
LTNNEEILG

SEQ ID NO: 398343 - protein, 9 aa, Homo Sapiens
EIFDVQTRK

SEQ ID NO: 398344 - protein, 9 aa, Homo Sapiens
QSSSPEQQN

SEQ ID NO: 398345 - protein, 9 aa, Homo Sapiens
FHADMAKKE

SEQ ID NO: 398346 - protein, 9 aa, Homo Sapiens
DDDDEDDNL

SEQ ID NO: 398347 - protein, 9 aa, Homo Sapiens
GYMPLLYMQ

SEQ ID NO: 398348 - protein, 9 aa, Homo Sapiens
FCGVHHAFA

SEQ ID NO: 398349 - protein, 9 aa, Homo Sapiens
QCQIEYKQR

SEQ ID NO: 398350 - protein, 9 aa, Homo Sapiens
DTAFQRPQL

SEQ ID NO: 398351 - protein, 9 aa, Homo Sapiens
DRRHTLYHG

SEQ ID NO: 398352 - protein, 9 aa, Homo Sapiens
NFVDLLDIL

SEQ ID NO: 398353 - protein, 9 aa, Homo Sapiens
ILEPVLITE

SEQ ID NO: 398354 - protein, 9 aa, Homo Sapiens
KYPETFFLL

SEQ ID NO: 398355 - protein, 9 aa, Homo Sapiens
MYFLICSLA

SEQ ID NO: 398356 - protein, 9 aa, Homo Sapiens
KLYGDAQMA

SEQ ID NO: 398357 - protein, 9 aa, Homo Sapiens
VPVNIIRME

SEQ ID NO: 398358 - protein, 9 aa, Homo Sapiens
RTGCTFKFR

SEQ ID NO: 398359 - protein, 9 aa, Homo Sapiens
EICTELQNL

SEQ ID NO: 398360 - protein, 9 aa, Homo Sapiens
MQHKIIHTG

SEQ ID NO: 398361 - protein, 9 aa, Homo Sapiens
SRNITVQKN

SEQ ID NO: 398362 - protein, 9 aa, Homo Sapiens
VNQMSFNSM

SEQ ID NO: 398363 - protein, 9 aa, Homo Sapiens
RLNSEKLSL

SEQ ID NO: 398364 - protein, 9 aa, Homo Sapiens
CYGSGIFNY

SEQ ID NO: 398365 - protein, 9 aa, Homo Sapiens
ENKSFSLEE

SEQ ID NO: 398366 - protein, 9 aa, Homo Sapiens
ENLPSLPAI

SEQ ID NO: 398367 - protein, 9 aa, Homo Sapiens
PGTIRGYFC

SEQ ID NO: 398368 - protein, 9 aa, Homo Sapiens
KCKGNLPAE

SEQ ID NO: 398369 - protein, 9 aa, Homo Sapiens
MSWLIFLLI

SEQ ID NO: 398370 - protein, 9 aa, Homo Sapiens
SILRICSTE

SEQ ID NO: 398371 - protein, 9 aa, Homo Sapiens
NKCEASVGF

SEQ ID NO: 398372 - protein, 9 aa, Homo Sapiens
FCLARAFVH

SEQ ID NO: 398373 - protein, 9 aa, Homo Sapiens
TDLTKGWIV

SEQ ID NO: 398374 - protein, 9 aa, Homo Sapiens
DSSFLMSGG

SEQ ID NO: 398375 - protein, 9 aa, Homo Sapiens
KKQNSPNRI

SEQ ID NO: 398376 - protein, 9 aa, Homo Sapiens
AEIKKLRLR

SEQ ID NO: 398377 - protein, 9 aa, Homo Sapiens
YYGLWGRLS

SEQ ID NO: 398378 - protein, 9 aa, Homo Sapiens
IILSYVLSL

SEQ ID NO: 398379 - protein, 9 aa, Homo Sapiens
KLHTDDEDD

SEQ ID NO: 398380 - protein, 9 aa, Homo Sapiens
GGRTFKKFN

SEQ ID NO: 398381 - protein, 9 aa, Homo Sapiens
VNYCTGILG

SEQ ID NO: 398382 - protein, 9 aa, Homo Sapiens
AVHREENIS

SEQ ID NO: 398383 - protein, 9 aa, Homo Sapiens
EALRMVWVA

SEQ ID NO: 398384 - protein, 9 aa, Homo Sapiens
SNFITHQII

SEQ ID NO: 398385 - protein, 9 aa, Homo Sapiens
HTFVPVTDG

SEQ ID NO: 398386 - protein, 9 aa, Homo Sapiens
YVSFASNQQ

SEQ ID NO: 398387 - protein, 9 aa, Homo Sapiens
EPTPGQSPG

SEQ ID NO: 398388 - protein, 9 aa, Homo Sapiens
VYVMDLLLE

SEQ ID NO: 398389 - protein, 9 aa, Homo Sapiens
IISVPAVAM

SEQ ID NO: 398390 - protein, 9 aa, Homo Sapiens
PKDKGDSKD

SEQ ID NO: 398391 - protein, 9 aa, Homo Sapiens
LKTMEVREG

SEQ ID NO: 398392 - protein, 9 aa, Homo Sapiens
KSITLSQRA

SEQ ID NO: 398393 - protein, 9 aa, Homo Sapiens
PPIPFFLDI

SEQ ID NO: 398394 - protein, 9 aa, Homo Sapiens
AHSYLKSIF

SEQ ID NO: 398395 - protein, 9 aa, Homo Sapiens
SPNRIMEEN

SEQ ID NO: 398396 - protein, 9 aa, Homo Sapiens
YLQLQKDIL

SEQ ID NO: 398397 - protein, 9 aa, Homo Sapiens
SACLCPQVD

SEQ ID NO: 398398 - protein, 9 aa, Homo Sapiens
KKIKREEDE

SEQ ID NO: 398399 - protein, 9 aa, Homo Sapiens
VMQSGEAKR

SEQ ID NO: 398400 - protein, 9 aa, Homo Sapiens
EGFQQVLKI

SEQ ID NO: 398401 - protein, 9 aa, Homo Sapiens
SHYFPAFEK

SEQ ID NO: 398402 - protein, 9 aa, Homo Sapiens
VQRLAILKE

SEQ ID NO: 398403 - protein, 9 aa, Homo Sapiens
QYHHLPSRG

SEQ ID NO: 398404 - protein, 9 aa, Homo Sapiens
ISVSELQYF

SEQ ID NO: 398405 - protein, 9 aa, Homo Sapiens
PLNDLCKTT

SEQ ID NO: 398406 - protein, 9 aa, Homo Sapiens
YVSDNIQIE

SEQ ID NO: 398407 - protein, 9 aa, Homo Sapiens
QEIKKSIKG

SEQ ID NO: 398408 - protein, 9 aa, Homo Sapiens
WKESTIFQM

SEQ ID NO: 398409 - protein, 9 aa, Homo Sapiens
TNGSPFFIT

SEQ ID NO: 398410 - protein, 9 aa, Homo Sapiens
LYIMRVPHS

SEQ ID NO: 398411 - protein, 9 aa, Homo Sapiens
QEPNVTDTE

SEQ ID NO: 398412 - protein, 9 aa, Homo Sapiens
FTESLWEAT

SEQ ID NO: 398413 - protein, 9 aa, Homo Sapiens
HIPQDHEML

SEQ ID NO: 398414 - protein, 9 aa, Homo Sapiens
GNHYEDLDL

SEQ ID NO: 398415 - protein, 9 aa, Homo Sapiens
KILFSKELR

SEQ ID NO: 398416 - protein, 9 aa, Homo Sapiens
LKIIHLSDE

SEQ ID NO: 398417 - protein, 9 aa, Homo Sapiens
CHRTTVMTV

SEQ ID NO: 398418 - protein, 9 aa, Homo Sapiens
LKSEMYLEG

SEQ ID NO: 398419 - protein, 9 aa, Homo Sapiens
KYWVEKLER

SEQ ID NO: 398420 - protein, 9 aa, Homo Sapiens
SSSFRYHEI

SEQ ID NO: 398421 - protein, 9 aa, Homo Sapiens
DQGWEYIIL

SEQ ID NO: 398422 - protein, 9 aa, Homo Sapiens
KHEVKPLGV

SEQ ID NO: 398423 - protein, 9 aa, Homo Sapiens
HHNIRAVVT

SEQ ID NO: 398424 - protein, 9 aa, Homo Sapiens
KIRSVSSQR

SEQ ID NO: 398425 - protein, 9 aa, Homo Sapiens
LLFDLMPIT

SEQ ID NO: 398426 - protein, 9 aa, Homo Sapiens
NKYIDQKLC

SEQ ID NO: 398427 - protein, 9 aa, Homo Sapiens
PATPIYQLQ

SEQ ID NO: 398428 - protein, 9 aa, Homo Sapiens
KCLDPDMYS

SEQ ID NO: 398429 - protein, 9 aa, Homo Sapiens
PFRYIMECP

SEQ ID NO: 398430 - protein, 9 aa, Homo Sapiens
SSLHSHQRV

SEQ ID NO: 398431 - protein, 9 aa, Homo Sapiens
SRFPQSTDQ

SEQ ID NO: 398432 - protein, 9 aa, Homo Sapiens
DHPFLFLIR

SEQ ID NO: 398433 - protein, 9 aa, Homo Sapiens
RNLRKQSIE

SEQ ID NO: 398434 - protein, 9 aa, Homo Sapiens
AVSIFSTLT

SEQ ID NO: 398435 - protein, 9 aa, Homo Sapiens
AYTQIVVCL

SEQ ID NO: 398436 - protein, 9 aa, Homo Sapiens
ESYRYPPVN

SEQ ID NO: 398437 - protein, 9 aa, Homo Sapiens
PVLITEASG

SEQ ID NO: 398438 - protein, 9 aa, Homo Sapiens
KQTIVLDCS

SEQ ID NO: 398439 - protein, 9 aa, Homo Sapiens
SPKIRSVSS

SEQ ID NO: 398440 - protein, 9 aa, Homo Sapiens
KLKCHIPPD

SEQ ID NO: 398441 - protein, 9 aa, Homo Sapiens
SDLYLDLIH

SEQ ID NO: 398442 - protein, 9 aa, Homo Sapiens
MFEKNVYVD

SEQ ID NO: 398443 - protein, 9 aa, Homo Sapiens
ISQLFQLNY

SEQ ID NO: 398444 - protein, 9 aa, Homo Sapiens
NWLQTDWIT

SEQ ID NO: 398445 - protein, 9 aa, Homo Sapiens
DSTQMLKKH

SEQ ID NO: 398446 - protein, 9 aa, Homo Sapiens
PDRQTVMIS

SEQ ID NO: 398447 - protein, 9 aa, Homo Sapiens
WVEKLERSL

SEQ ID NO: 398448 - protein, 9 aa, Homo Sapiens
DNSILGSLI

SEQ ID NO: 398449 - protein, 9 aa, Homo Sapiens
VILRLSHPN

SEQ ID NO: 398450 - protein, 9 aa, Homo Sapiens
HLRFASPSG

SEQ ID NO: 398451 - protein, 9 aa, Homo Sapiens
PLEALGLFT

SEQ ID NO: 398452 - protein, 9 aa, Homo Sapiens
QTVMISATW

SEQ ID NO: 398453 - protein, 9 aa, Homo Sapiens
EQPYVFTRH

SEQ ID NO: 398454 - protein, 9 aa, Homo Sapiens
RANLTKHQI

SEQ ID NO: 398455 - protein, 9 aa, Homo Sapiens
LAFVYSPLK

SEQ ID NO: 398456 - protein, 9 aa, Homo Sapiens
SSFLMSGGF

SEQ ID NO: 398457 - protein, 9 aa, Homo Sapiens
DADLGHNAW

SEQ ID NO: 398458 - protein, 9 aa, Homo Sapiens
VYSPLKNAL

SEQ ID NO: 398459 - protein, 9 aa, Homo Sapiens
GSISKKDII

SEQ ID NO: 398460 - protein, 9 aa, Homo Sapiens
IEKNKQKIE

SEQ ID NO: 398461 - protein, 9 aa, Homo Sapiens
SVLYDVIPE

SEQ ID NO: 398462 - protein, 9 aa, Homo Sapiens
QITHFIDHD

SEQ ID NO: 398463 - protein, 9 aa, Homo Sapiens
VAIPEKEKN

SEQ ID NO: 398464 - protein, 9 aa, Homo Sapiens
LKDLKKTNT

SEQ ID NO: 398465 - protein, 9 aa, Homo Sapiens
IQNYDGKVH

SEQ ID NO: 398466 - protein, 9 aa, Homo Sapiens
KESNMEQRV

SEQ ID NO: 398467 - protein, 9 aa, Homo Sapiens
QNRIWDQMQ

SEQ ID NO: 398468 - protein, 9 aa, Homo Sapiens
PNSDGPLGS

SEQ ID NO: 398469 - protein, 9 aa, Homo Sapiens
IILGSTEFF

SEQ ID NO: 398470 - protein, 9 aa, Homo Sapiens
KPLSLHQIT

SEQ ID NO: 398471 - protein, 9 aa, Homo Sapiens
VSEVPKKLV

SEQ ID NO: 398472 - protein, 9 aa, Homo Sapiens
KTNTVFKVL

SEQ ID NO: 398473 - protein, 9 aa, Homo Sapiens
SHCQEAGTT

SEQ ID NO: 398474 - protein, 9 aa, Homo Sapiens
ETTSSSSFK

SEQ ID NO: 398475 - protein, 9 aa, Homo Sapiens
RRAELVELI

SEQ ID NO: 398476 - protein, 9 aa, Homo Sapiens
NAIDKWVAV

SEQ ID NO: 398477 - protein, 9 aa, Homo Sapiens
GSEIIVRNV

SEQ ID NO: 398478 - protein, 9 aa, Homo Sapiens
EMFSSRQGA

SEQ ID NO: 398479 - protein, 9 aa, Homo Sapiens
FFIIFAKII

SEQ ID NO: 398480 - protein, 9 aa, Homo Sapiens
YSYLQKTPV

SEQ ID NO: 398481 - protein, 9 aa, Homo Sapiens
GMCGDGTND

SEQ ID NO: 398482 - protein, 9 aa, Homo Sapiens
WVTVKLDEL

SEQ ID NO: 398483 - protein, 9 aa, Homo Sapiens
HWAAMHVSD

SEQ ID NO: 398484 - protein, 9 aa, Homo Sapiens
ETSTKTRQR

SEQ ID NO: 398485 - protein, 9 aa, Homo Sapiens
KGLPKLEKK

SEQ ID NO: 398486 - protein, 9 aa, Homo Sapiens
VILEKQICI

SEQ ID NO: 398487 - protein, 9 aa, Homo Sapiens
NVLLAGAKV

SEQ ID NO: 398488 - protein, 9 aa, Homo Sapiens
ETETVEAYV

SEQ ID NO: 398489 - protein, 9 aa, Homo Sapiens
YFATPKMIA

SEQ ID NO: 398490 - protein, 9 aa, Homo Sapiens
TLTPQQAQQ

SEQ ID NO: 398491 - protein, 9 aa, Homo Sapiens
PAAKVSEVP

SEQ ID NO: 398492 - protein, 9 aa, Homo Sapiens
HRGYSKAFQ

SEQ ID NO: 398493 - protein, 9 aa, Homo Sapiens
KNWKRITVY

SEQ ID NO: 398494 - protein, 9 aa, Homo Sapiens
SLIYDAFPK

SEQ ID NO: 398495 - protein, 9 aa, Homo Sapiens
RCHVLTSGI

SEQ ID NO: 398496 - protein, 9 aa, Homo Sapiens
HVLTSGIFE

SEQ ID NO: 398497 - protein, 9 aa, Homo Sapiens
NAKKLYGDA

SEQ ID NO: 398498 - protein, 9 aa, Homo Sapiens
IQKMAEYYR

SEQ ID NO: 398499 - protein, 9 aa, Homo Sapiens
FQNRRAKDK

SEQ ID NO: 398500 - protein, 9 aa, Homo Sapiens
KLEKKDFAS

SEQ ID NO: 398501 - protein, 9 aa, Homo Sapiens
PAGLWLSGL

SEQ ID NO: 398502 - protein, 9 aa, Homo Sapiens
SVLCRKLQC

SEQ ID NO: 398503 - protein, 9 aa, Homo Sapiens
RVDQNEAEI

SEQ ID NO: 398504 - protein, 9 aa, Homo Sapiens
LCQLSVLFR

SEQ ID NO: 398505 - protein, 9 aa, Homo Sapiens
RLREEEKHI

SEQ ID NO: 398506 - protein, 9 aa, Homo Sapiens
TGCTFKFRF

SEQ ID NO: 398507 - protein, 9 aa, Homo Sapiens
GLKFGGVIP

SEQ ID NO: 398508 - protein, 9 aa, Homo Sapiens
VCSSRTAHL

SEQ ID NO: 398509 - protein, 9 aa, Homo Sapiens
QALDIPATE

SEQ ID NO: 398510 - protein, 9 aa, Homo Sapiens
LLKNKQARC

SEQ ID NO: 398511 - protein, 9 aa, Homo Sapiens
RSIKCFKTQ

SEQ ID NO: 398512 - protein, 9 aa, Homo Sapiens
RLKLSPKNL

SEQ ID NO: 398513 - protein, 9 aa, Homo Sapiens
VRYHEQIHT

SEQ ID NO: 398514 - protein, 9 aa, Homo Sapiens
SGETPPSPL

SEQ ID NO: 398515 - protein, 9 aa, Homo Sapiens
EEEEIKLFS

SEQ ID NO: 398516 - protein, 9 aa, Homo Sapiens
ENGIHLPGQ

SEQ ID NO: 398517 - protein, 9 aa, Homo Sapiens
QPGDYIIQE

SEQ ID NO: 398518 - protein, 9 aa, Homo Sapiens
KGRKMNMHN

SEQ ID NO: 398519 - protein, 9 aa, Homo Sapiens
DLYLDLIHQ

SEQ ID NO: 398520 - protein, 9 aa, Homo Sapiens
NKRKQKRVL

SEQ ID NO: 398521 - protein, 9 aa, Homo Sapiens
KKEIEKCLD

SEQ ID NO: 398522 - protein, 9 aa, Homo Sapiens
RVAEAHNPD

SEQ ID NO: 398523 - protein, 9 aa, Homo Sapiens
NTLVVKKLD

SEQ ID NO: 398524 - protein, 9 aa, Homo Sapiens
NLMVHQIIH

SEQ ID NO: 398525 - protein, 9 aa, Homo Sapiens
RQFQKVKLR

SEQ ID NO: 398526 - protein, 9 aa, Homo Sapiens
ITQTNNQLS

SEQ ID NO: 398527 - protein, 9 aa, Homo Sapiens
CIFKVARDQ

SEQ ID NO: 398528 - protein, 9 aa, Homo Sapiens
EDAGAERQA

SEQ ID NO: 398529 - protein, 9 aa, Homo Sapiens
MRFQMNEEQ

SEQ ID NO: 398530 - protein, 9 aa, Homo Sapiens
LVNGLQLLC

SEQ ID NO: 398531 - protein, 9 aa, Homo Sapiens
EDNEMVCFL

SEQ ID NO: 398532 - protein, 9 aa, Homo Sapiens
VCDGCLNKS

SEQ ID NO: 398533 - protein, 9 aa, Homo Sapiens
TNSPPDADE

SEQ ID NO: 398534 - protein, 9 aa, Homo Sapiens
LLNMFRELS

SEQ ID NO: 398535 - protein, 9 aa, Homo Sapiens
PWDGEKGFK

SEQ ID NO: 398536 - protein, 9 aa, Homo Sapiens
IFFDVIVYV

SEQ ID NO: 398537 - protein, 9 aa, Homo Sapiens
CSHCQEAGT

SEQ ID NO: 398538 - protein, 9 aa, Homo Sapiens
GWFPLHEVV

SEQ ID NO: 398539 - protein, 9 aa, Homo Sapiens
KVQRHDMRV

SEQ ID NO: 398540 - protein, 9 aa, Homo Sapiens
RCLPLHFRK

SEQ ID NO: 398541 - protein, 9 aa, Homo Sapiens
SYCQYHPSK

SEQ ID NO: 398542 - protein, 9 aa, Homo Sapiens
QFESILPRP

SEQ ID NO: 398543 - protein, 9 aa, Homo Sapiens
WYLLESKGK

SEQ ID NO: 398544 - protein, 9 aa, Homo Sapiens
ERALLSLYL

SEQ ID NO: 398545 - protein, 9 aa, Homo Sapiens
VELNMIATD

SEQ ID NO: 398546 - protein, 9 aa, Homo Sapiens
TVLLYTMTK

SEQ ID NO: 398547 - protein, 9 aa, Homo Sapiens
FTLMFWCKF

SEQ ID NO: 398548 - protein, 9 aa, Homo Sapiens
ECGHLFPPP

SEQ ID NO: 398549 - protein, 9 aa, Homo Sapiens
PFIETSTKT

SEQ ID NO: 398550 - protein, 9 aa, Homo Sapiens
LPGTRVRAM

SEQ ID NO: 398551 - protein, 9 aa, Homo Sapiens
QSTAYEKQC

SEQ ID NO: 398552 - protein, 9 aa, Homo Sapiens
CKLCTLKLS

SEQ ID NO: 398553 - protein, 9 aa, Homo Sapiens
SDYLTQEVA

SEQ ID NO: 398554 - protein, 9 aa, Homo Sapiens
QGLKFGGVI

SEQ ID NO: 398555 - protein, 9 aa, Homo Sapiens
LFSYFGQDI

SEQ ID NO: 398556 - protein, 9 aa, Homo Sapiens
SDQDLLRCH

SEQ ID NO: 398557 - protein, 9 aa, Homo Sapiens
SKDLSISQL

SEQ ID NO: 398558 - protein, 9 aa, Homo Sapiens
VNDNIFASF

SEQ ID NO: 398559 - protein, 9 aa, Homo Sapiens
RARSIYERV

SEQ ID NO: 398560 - protein, 9 aa, Homo Sapiens
CLARAFVHK

SEQ ID NO: 398561 - protein, 9 aa, Homo Sapiens
TERLKKKLL

SEQ ID NO: 398562 - protein, 9 aa, Homo Sapiens
IDRRSSVPP

SEQ ID NO: 398563 - protein, 9 aa, Homo Sapiens
FLQFYLFFS

SEQ ID NO: 398564 - protein, 9 aa, Homo Sapiens
QIYMTQGFR

SEQ ID NO: 398565 - protein, 9 aa, Homo Sapiens
KPTEHGKKT

SEQ ID NO: 398566 - protein, 9 aa, Homo Sapiens
LDKAFNEAH

SEQ ID NO: 398567 - protein, 9 aa, Homo Sapiens
KVMNRRRIN

SEQ ID NO: 398568 - protein, 9 aa, Homo Sapiens
YGDAQMARK

SEQ ID NO: 398569 - protein, 9 aa, Homo Sapiens
PPPPCPSYP

SEQ ID NO: 398570 - protein, 9 aa, Homo Sapiens
TKVEIREPS

SEQ ID NO: 398571 - protein, 9 aa, Homo Sapiens
ETIIYSLEK

SEQ ID NO: 398572 - protein, 9 aa, Homo Sapiens
LCRKLQCGT

SEQ ID NO: 398573 - protein, 9 aa, Homo Sapiens
DPLTLEPTP

SEQ ID NO: 398574 - protein, 9 aa, Homo Sapiens
TFVPVTDGA

SEQ ID NO: 398575 - protein, 9 aa, Homo Sapiens
PHNWMKYFI

SEQ ID NO: 398576 - protein, 9 aa, Homo Sapiens
GTNSPPDAD

SEQ ID NO: 398577 - protein, 9 aa, Homo Sapiens
SKGRARTPI

SEQ ID NO: 398578 - protein, 9 aa, Homo Sapiens
PTSARNGGH

SEQ ID NO: 398579 - protein, 9 aa, Homo Sapiens
NKAYVVCTF

SEQ ID NO: 398580 - protein, 9 aa, Homo Sapiens
SFSDDGRVL

SEQ ID NO: 398581 - protein, 9 aa, Homo Sapiens
DNLCQLSVL

SEQ ID NO: 398582 - protein, 9 aa, Homo Sapiens
KGSTFEEHK

SEQ ID NO: 398583 - protein, 9 aa, Homo Sapiens
NDSKRLILF

SEQ ID NO: 398584 - protein, 9 aa, Homo Sapiens
IIHTRENIY

SEQ ID NO: 398585 - protein, 9 aa, Homo Sapiens
HSPAPALAT

SEQ ID NO: 398586 - protein, 9 aa, Homo Sapiens
YLKSIFSSL

SEQ ID NO: 398587 - protein, 9 aa, Homo Sapiens
KGWFPLHEV

SEQ ID NO: 398588 - protein, 9 aa, Homo Sapiens
GGGRADIGF

SEQ ID NO: 398589 - protein, 9 aa, Homo Sapiens
TSSLTLSSS

SEQ ID NO: 398590 - protein, 9 aa, Homo Sapiens
RHWNNFALV

SEQ ID NO: 398591 - protein, 9 aa, Homo Sapiens
VVPCGKISF

SEQ ID NO: 398592 - protein, 9 aa, Homo Sapiens
VAVDADLGH

SEQ ID NO: 398593 - protein, 9 aa, Homo Sapiens
AQRCLYHDM

SEQ ID NO: 398594 - protein, 9 aa, Homo Sapiens
PSEKIWIEI

SEQ ID NO: 398595 - protein, 9 aa, Homo Sapiens
ICSTEGRSK

SEQ ID NO: 398596 - protein, 9 aa, Homo Sapiens
IHYTGCYVS

SEQ ID NO: 398597 - protein, 9 aa, Homo Sapiens
ADANKAESW

SEQ ID NO: 398598 - protein, 9 aa, Homo Sapiens
GSPFFITTV

SEQ ID NO: 398599 - protein, 9 aa, Homo Sapiens
DDLEISAFP

SEQ ID NO: 398600 - protein, 9 aa, Homo Sapiens
LFASDNFLG

SEQ ID NO: 398601 - protein, 9 aa, Homo Sapiens
YKSVQNGAR

SEQ ID NO: 398602 - protein, 9 aa, Homo Sapiens
KSQSTSDYL

SEQ ID NO: 398603 - protein, 9 aa, Homo Sapiens
LALYKSVQN

SEQ ID NO: 398604 - protein, 9 aa, Homo Sapiens
FESIRAAVK

SEQ ID NO: 398605 - protein, 9 aa, Homo Sapiens
QQYFADANK

SEQ ID NO: 398606 - protein, 9 aa, Homo Sapiens
DCSSTIVEY

SEQ ID NO: 398607 - protein, 9 aa, Homo Sapiens
GPGSLFASD

SEQ ID NO: 398608 - protein, 9 aa, Homo Sapiens
REGKLLGTH

SEQ ID NO: 398609 - protein, 9 aa, Homo Sapiens
QRHDMRVHP

SEQ ID NO: 398610 - protein, 9 aa, Homo Sapiens
NLEKEYKEK

SEQ ID NO: 398611 - protein, 9 aa, Homo Sapiens
DAISWYQNK

SEQ ID NO: 398612 - protein, 9 aa, Homo Sapiens
HSRNITVQK

SEQ ID NO: 398613 - protein, 9 aa, Homo Sapiens
TMKENKSSI

SEQ ID NO: 398614 - protein, 9 aa, Homo Sapiens
EDIYEDRHN

SEQ ID NO: 398615 - protein, 9 aa, Homo Sapiens
KTKELKKKW

SEQ ID NO: 398616 - protein, 9 aa, Homo Sapiens
ESTNKSILK

SEQ ID NO: 398617 - protein, 9 aa, Homo Sapiens
HHLPSRGIT

SEQ ID NO: 398618 - protein, 9 aa, Homo Sapiens
LHCVTFAVP

SEQ ID NO: 398619 - protein, 9 aa, Homo Sapiens
TAYTQIVVC

SEQ ID NO: 398620 - protein, 9 aa, Homo Sapiens
LIIEKVLKI

SEQ ID NO: 398621 - protein, 9 aa, Homo Sapiens
PMDDLFQCV

SEQ ID NO: 398622 - protein, 9 aa, Homo Sapiens
EFAEYIYQW

SEQ ID NO: 398623 - protein, 9 aa, Homo Sapiens
LSEFESYEE

SEQ ID NO: 398624 - protein, 9 aa, Homo Sapiens
NNIISEIQA

SEQ ID NO: 398625 - protein, 9 aa, Homo Sapiens
ICMNDAPTR

SEQ ID NO: 398626 - protein, 9 aa, Homo Sapiens
SQNNSKTAV

SEQ ID NO: 398627 - protein, 9 aa, Homo Sapiens
PVTMSTPQT

SEQ ID NO: 398628 - protein, 9 aa, Homo Sapiens
LAPVSSIHP

SEQ ID NO: 398629 - protein, 9 aa, Homo Sapiens
QFPWFFSFG

SEQ ID NO: 398630 - protein, 9 aa, Homo Sapiens
SRNTISFAV

SEQ ID NO: 398631 - protein, 9 aa, Homo Sapiens
DSNLQNRIW

SEQ ID NO: 398632 - protein, 9 aa, Homo Sapiens
TCKDIQHIP

SEQ ID NO: 398633 - protein, 9 aa, Homo Sapiens
FSKEEVGYF

SEQ ID NO: 398634 - protein, 9 aa, Homo Sapiens
ECGHAVLNK

SEQ ID NO: 398635 - protein, 9 aa, Homo Sapiens
MSSIACWLM

SEQ ID NO: 398636 - protein, 9 aa, Homo Sapiens
IKELEAIGS

SEQ ID NO: 398637 - protein, 9 aa, Homo Sapiens
SLGLQDKIL

SEQ ID NO: 398638 - protein, 9 aa, Homo Sapiens
TTSKFSVSG

SEQ ID NO: 398639 - protein, 9 aa, Homo Sapiens
FDFCEPSFA

SEQ ID NO: 398640 - protein, 9 aa, Homo Sapiens
DLIKHFQKY

SEQ ID NO: 398641 - protein, 9 aa, Homo Sapiens
PSQNNWLQT

SEQ ID NO: 398642 - protein, 9 aa, Homo Sapiens
ALAAYSYFW

SEQ ID NO: 398643 - protein, 9 aa, Homo Sapiens
QRRGQAGAK

SEQ ID NO: 398644 - protein, 9 aa, Homo Sapiens
SSSFKLEMA

SEQ ID NO: 398645 - protein, 9 aa, Homo Sapiens
HSLLGCDKI

SEQ ID NO: 398646 - protein, 9 aa, Homo Sapiens
AATQGASFS

SEQ ID NO: 398647 - protein, 9 aa, Homo Sapiens
SSWANSNLT

SEQ ID NO: 398648 - protein, 9 aa, Homo Sapiens
LYKKPPADA

SEQ ID NO: 398649 - protein, 9 aa, Homo Sapiens
GGGATGPGA

SEQ ID NO: 398650 - protein, 9 aa, Homo Sapiens
QEHLTNNEE

SEQ ID NO: 398651 - protein, 9 aa, Homo Sapiens
KFSMEVNKT

SEQ ID NO: 398652 - protein, 9 aa, Homo Sapiens
TVFFKTLQN

SEQ ID NO: 398653 - protein, 9 aa, Homo Sapiens
LTSYGIECS

SEQ ID NO: 398654 - protein, 9 aa, Homo Sapiens
FEIEIFDVQ

SEQ ID NO: 398655 - protein, 9 aa, Homo Sapiens
PRNVPAAYC

SEQ ID NO: 398656 - protein, 9 aa, Homo Sapiens
QRIHAVDKP

SEQ ID NO: 398657 - protein, 9 aa, Homo Sapiens
EKEYKEKEE

SEQ ID NO: 398658 - protein, 9 aa, Homo Sapiens
QTLLDSTQM

SEQ ID NO: 398659 - protein, 9 aa, Homo Sapiens
KDSEDAEET

SEQ ID NO: 398660 - protein, 9 aa, Homo Sapiens
DGQMFKYIL

SEQ ID NO: 398661 - protein, 9 aa, Homo Sapiens
QKDKKEKSN

SEQ ID NO: 398662 - protein, 9 aa, Homo Sapiens
VPYSELDNG

SEQ ID NO: 398663 - protein, 9 aa, Homo Sapiens
HYGKINQYT

SEQ ID NO: 398664 - protein, 9 aa, Homo Sapiens
VHKSSILIM

SEQ ID NO: 398665 - protein, 9 aa, Homo Sapiens
GQKIAQNNQ

SEQ ID NO: 398666 - protein, 9 aa, Homo Sapiens
ESSQRLAEI

SEQ ID NO: 398667 - protein, 9 aa, Homo Sapiens
FIQEHSEIH

SEQ ID NO: 398668 - protein, 9 aa, Homo Sapiens
VHREENISL

SEQ ID NO: 398669 - protein, 9 aa, Homo Sapiens
TILKIIHLS

SEQ ID NO: 398670 - protein, 9 aa, Homo Sapiens
YSSKCRVTV

SEQ ID NO: 398671 - protein, 9 aa, Homo Sapiens
NVTRESISS

SEQ ID NO: 398672 - protein, 9 aa, Homo Sapiens
DNNSPVLYE

SEQ ID NO: 398673 - protein, 9 aa, Homo Sapiens
PCTVMPGGS

SEQ ID NO: 398674 - protein, 9 aa, Homo Sapiens
DSSDKKENK

SEQ ID NO: 398675 - protein, 9 aa, Homo Sapiens
VLDNILQPM

SEQ ID NO: 398676 - protein, 9 aa, Homo Sapiens
QSVLQFIQE

SEQ ID NO: 398677 - protein, 9 aa, Homo Sapiens
EQLKLLCGE

SEQ ID NO: 398678 - protein, 9 aa, Homo Sapiens
YKKPPADAR

SEQ ID NO: 398679 - protein, 9 aa, Homo Sapiens
EDIRSRLIQ

SEQ ID NO: 398680 - protein, 9 aa, Homo Sapiens
GNGILNMSS

SEQ ID NO: 398681 - protein, 9 aa, Homo Sapiens
VLDCSFVAS

SEQ ID NO: 398682 - protein, 9 aa, Homo Sapiens
KHDKYWVEK

SEQ ID NO: 398683 - protein, 9 aa, Homo Sapiens
NLTAPGTPC

SEQ ID NO: 398684 - protein, 9 aa, Homo Sapiens
RKLVRLKLG

SEQ ID NO: 398685 - protein, 9 aa, Homo Sapiens
FNFILVVMS

SEQ ID NO: 398686 - protein, 9 aa, Homo Sapiens
EEINGNLEG

SEQ ID NO: 398687 - protein, 9 aa, Homo Sapiens
HRFCSDCIA

SEQ ID NO: 398688 - protein, 9 aa, Homo Sapiens
IDGLNREQG

SEQ ID NO: 398689 - protein, 9 aa, Homo Sapiens
IPFIETSTK

SEQ ID NO: 398690 - protein, 9 aa, Homo Sapiens
LQIYMTQGF

SEQ ID NO: 398691 - protein, 9 aa, Homo Sapiens
MTFMRFQMN

SEQ ID NO: 398692 - protein, 9 aa, Homo Sapiens
GLINSENVF

SEQ ID NO: 398693 - protein, 9 aa, Homo Sapiens
FSLLALYKS

SEQ ID NO: 398694 - protein, 9 aa, Homo Sapiens
NTDSQKLNN

SEQ ID NO: 398695 - protein, 9 aa, Homo Sapiens
NSWCRHLKL

SEQ ID NO: 398696 - protein, 9 aa, Homo Sapiens
KQNRTALHL

SEQ ID NO: 398697 - protein, 9 aa, Homo Sapiens
YDNFSEDFG

SEQ ID NO: 398698 - protein, 9 aa, Homo Sapiens
APKGAHHNK

SEQ ID NO: 398699 - protein, 9 aa, Homo Sapiens
TLSQPAGEK

SEQ ID NO: 398700 - protein, 9 aa, Homo Sapiens
SLVDPNNLD

SEQ ID NO: 398701 - protein, 9 aa, Homo Sapiens
HRYRHPSAL

SEQ ID NO: 398702 - protein, 9 aa, Homo Sapiens
KCEECGKAV

SEQ ID NO: 398703 - protein, 9 aa, Homo Sapiens
KQDDLKTLL

SEQ ID NO: 398704 - protein, 9 aa, Homo Sapiens
ARMELFILL

SEQ ID NO: 398705 - protein, 9 aa, Homo Sapiens
SKMATNMFL

SEQ ID NO: 398706 - protein, 9 aa, Homo Sapiens
SFSISLVAN

SEQ ID NO: 398707 - protein, 9 aa, Homo Sapiens
RANAIDKWV

SEQ ID NO: 398708 - protein, 9 aa, Homo Sapiens
DNILQPMIV

SEQ ID NO: 398709 - protein, 9 aa, Homo Sapiens
RYHEQIHTG

SEQ ID NO: 398710 - protein, 9 aa, Homo Sapiens
SIKSQEPAF

SEQ ID NO: 398711 - protein, 9 aa, Homo Sapiens
LPLHFRKDE

SEQ ID NO: 398712 - protein, 9 aa, Homo Sapiens
LNQDNSRPL

SEQ ID NO: 398713 - protein, 9 aa, Homo Sapiens
NQYTPEMIL

SEQ ID NO: 398714 - protein, 9 aa, Homo Sapiens
HSIKDKCPC

SEQ ID NO: 398715 - protein, 9 aa, Homo Sapiens
AVSWDSIFI

SEQ ID NO: 398716 - protein, 9 aa, Homo Sapiens
FFKTLQNHW

SEQ ID NO: 398717 - protein, 9 aa, Homo Sapiens
EDNRRQFRE

SEQ ID NO: 398718 - protein, 9 aa, Homo Sapiens
YTVCRFSIR

SEQ ID NO: 398719 - protein, 9 aa, Homo Sapiens
IVRNVLLAG

SEQ ID NO: 398720 - protein, 9 aa, Homo Sapiens
CKWAINISE

SEQ ID NO: 398721 - protein, 9 aa, Homo Sapiens
PESNTNLTA

SEQ ID NO: 398722 - protein, 9 aa, Homo Sapiens
APLITPLCC

SEQ ID NO: 398723 - protein, 9 aa, Homo Sapiens
QSYFRSTAL

SEQ ID NO: 398724 - protein, 9 aa, Homo Sapiens
NKMRGAGNG

SEQ ID NO: 398725 - protein, 9 aa, Homo Sapiens
ITHSEEKAY

SEQ ID NO: 398726 - protein, 9 aa, Homo Sapiens
RQLALQAKL

SEQ ID NO: 398727 - protein, 9 aa, Homo Sapiens
NEYIKGDFN

SEQ ID NO: 398728 - protein, 9 aa, Homo Sapiens
CRVTVMISI

SEQ ID NO: 398729 - protein, 9 aa, Homo Sapiens
GLYYNISGT

SEQ ID NO: 398730 - protein, 9 aa, Homo Sapiens
SCIKTLFGV

SEQ ID NO: 398731 - protein, 9 aa, Homo Sapiens
CIATKKHTG

SEQ ID NO: 398732 - protein, 9 aa, Homo Sapiens
KRLKTMEVR

SEQ ID NO: 398733 - protein, 9 aa, Homo Sapiens
ELVELIVET

SEQ ID NO: 398734 - protein, 9 aa, Homo Sapiens
TTEQSGIYS

SEQ ID NO: 398735 - protein, 9 aa, Homo Sapiens
LVVKKFDVE

SEQ ID NO: 398736 - protein, 9 aa, Homo Sapiens
YYKQPISRW

SEQ ID NO: 398737 - protein, 9 aa, Homo Sapiens
DKVQQLEEQ

SEQ ID NO: 398738 - protein, 9 aa, Homo Sapiens
QKVEATQPR

SEQ ID NO: 398739 - protein, 9 aa, Homo Sapiens
DQIMMIFYM

SEQ ID NO: 398740 - protein, 9 aa, Homo Sapiens
GWSLSEFES

SEQ ID NO: 398741 - protein, 9 aa, Homo Sapiens
CFKTQPLYV

SEQ ID NO: 398742 - protein, 9 aa, Homo Sapiens
EPKKIKKTK

SEQ ID NO: 398743 - protein, 9 aa, Homo Sapiens
TGGVEKAVR

SEQ ID NO: 398744 - protein, 9 aa, Homo Sapiens
IVDVYLVTL

SEQ ID NO: 398745 - protein, 9 aa, Homo Sapiens
EFNYYGLWG

SEQ ID NO: 398746 - protein, 9 aa, Homo Sapiens
ENNGFSLFD

SEQ ID NO: 398747 - protein, 9 aa, Homo Sapiens
SHNSIYQES

SEQ ID NO: 398748 - protein, 9 aa, Homo Sapiens
VEPQGPFYF

SEQ ID NO: 398749 - protein, 9 aa, Homo Sapiens
LKMLRVPGP

SEQ ID NO: 398750 - protein, 9 aa, Homo Sapiens
QLLIQFPWF

SEQ ID NO: 398751 - protein, 9 aa, Homo Sapiens
HTDDEDDIY

SEQ ID NO: 398752 - protein, 9 aa, Homo Sapiens
LWEATRDLD

SEQ ID NO: 398753 - protein, 9 aa, Homo Sapiens
LPVVTIAWL

SEQ ID NO: 398754 - protein, 9 aa, Homo Sapiens
RSITCWTLG

SEQ ID NO: 398755 - protein, 9 aa, Homo Sapiens
IRSRLIQGE

SEQ ID NO: 398756 - protein, 9 aa, Homo Sapiens
VKKLDVEAI

SEQ ID NO: 398757 - protein, 9 aa, Homo Sapiens
ITCWTLGRY

SEQ ID NO: 398758 - protein, 9 aa, Homo Sapiens
SSSQELSNI

SEQ ID NO: 398759 - protein, 9 aa, Homo Sapiens
NFNSWCRHL

SEQ ID NO: 398760 - protein, 9 aa, Homo Sapiens
KLPPTVLEL

SEQ ID NO: 398761 - protein, 9 aa, Homo Sapiens
KQICIPRSL

SEQ ID NO: 398762 - protein, 9 aa, Homo Sapiens
LQFIQEHSE

SEQ ID NO: 398763 - protein, 9 aa, Homo Sapiens
MFKYILNFL

SEQ ID NO: 398764 - protein, 9 aa, Homo Sapiens
TADKLPEDS

SEQ ID NO: 398765 - protein, 9 aa, Homo Sapiens
AELSRDMNA

SEQ ID NO: 398766 - protein, 9 aa, Homo Sapiens
QISYDTLKD

SEQ ID NO: 398767 - protein, 9 aa, Homo Sapiens
MESLTSYGI

SEQ ID NO: 398768 - protein, 9 aa, Homo Sapiens
DEYQPFKII

SEQ ID NO: 398769 - protein, 9 aa, Homo Sapiens
TYAAAVLFQ

SEQ ID NO: 398770 - protein, 9 aa, Homo Sapiens
LHLKSTLEM

SEQ ID NO: 398771 - protein, 9 aa, Homo Sapiens
NVCFDDLFP

SEQ ID NO: 398772 - protein, 9 aa, Homo Sapiens
NYYGLWGRL

SEQ ID NO: 398773 - protein, 9 aa, Homo Sapiens
QQKVTAYTQ

SEQ ID NO: 398774 - protein, 9 aa, Homo Sapiens
VRNVLLAGA

SEQ ID NO: 398775 - protein, 9 aa, Homo Sapiens
GFTLMFWCK

SEQ ID NO: 398776 - protein, 9 aa, Homo Sapiens
EDDDDEDDN

SEQ ID NO: 398777 - protein, 9 aa, Homo Sapiens
YKYVYSVLY

SEQ ID NO: 398778 - protein, 9 aa, Homo Sapiens
EVREGESCS

SEQ ID NO: 398779 - protein, 9 aa, Homo Sapiens
VDWGNFFLL

SEQ ID NO: 398780 - protein, 9 aa, Homo Sapiens
PTRDDCGWF

SEQ ID NO: 398781 - protein, 9 aa, Homo Sapiens
TCHNFNQFT

SEQ ID NO: 398782 - protein, 9 aa, Homo Sapiens
YEDLDLDTP

SEQ ID NO: 398783 - protein, 9 aa, Homo Sapiens
EQHQDKKLC

SEQ ID NO: 398784 - protein, 9 aa, Homo Sapiens
LTVVAICYG

SEQ ID NO: 398785 - protein, 9 aa, Homo Sapiens
IVVNIVDSM

SEQ ID NO: 398786 - protein, 9 aa, Homo Sapiens
SGSYFALTN

SEQ ID NO: 398787 - protein, 9 aa, Homo Sapiens
HSNKTNTVF

SEQ ID NO: 398788 - protein, 9 aa, Homo Sapiens
GCSGIISVP

SEQ ID NO: 398789 - protein, 9 aa, Homo Sapiens
IIQCRNITY

SEQ ID NO: 398790 - protein, 9 aa, Homo Sapiens
ARVRIWELL

SEQ ID NO: 398791 - protein, 9 aa, Homo Sapiens
YLFSLSLSY

SEQ ID NO: 398792 - protein, 9 aa, Homo Sapiens
ATVGESYRY

SEQ ID NO: 398793 - protein, 9 aa, Homo Sapiens
LSLTTEQSG

SEQ ID NO: 398794 - protein, 9 aa, Homo Sapiens
DLHTELMQT

SEQ ID NO: 398795 - protein, 9 aa, Homo Sapiens
YRYPPVNWA

SEQ ID NO: 398796 - protein, 9 aa, Homo Sapiens
DNIQIETVL

SEQ ID NO: 398797 - protein, 9 aa, Homo Sapiens
RYQTFVNVN

SEQ ID NO: 398798 - protein, 9 aa, Homo Sapiens
TPAAKVSEV

SEQ ID NO: 398799 - protein, 9 aa, Homo Sapiens
KYLVQLPVV

SEQ ID NO: 398800 - protein, 9 aa, Homo Sapiens
APEMFSSRQ

SEQ ID NO: 398801 - protein, 9 aa, Homo Sapiens
ALIHSIKDK

SEQ ID NO: 398802 - protein, 9 aa, Homo Sapiens
AKKLYGDAQ

SEQ ID NO: 398803 - protein, 9 aa, Homo Sapiens
EFAMRHGIE

SEQ ID NO: 398804 - protein, 9 aa, Homo Sapiens
DHLYKELQL

SEQ ID NO: 398805 - protein, 9 aa, Homo Sapiens
QKKDKPDSV

SEQ ID NO: 398806 - protein, 9 aa, Homo Sapiens
LFQLNYLSG

SEQ ID NO: 398807 - protein, 9 aa, Homo Sapiens
LTSACTEHS

SEQ ID NO: 398808 - protein, 9 aa, Homo Sapiens
YQESALYLL

SEQ ID NO: 398809 - protein, 9 aa, Homo Sapiens
GKSQLLMHH

SEQ ID NO: 398810 - protein, 9 aa, Homo Sapiens
LDSNNFKSV

SEQ ID NO: 398811 - protein, 9 aa, Homo Sapiens
QNRLYDAKV

SEQ ID NO: 398812 - protein, 9 aa, Homo Sapiens
LQVNYPAVN

SEQ ID NO: 398813 - protein, 9 aa, Homo Sapiens
LKSEGHEKS

SEQ ID NO: 398814 - protein, 9 aa, Homo Sapiens
MDTFLFRPH

SEQ ID NO: 398815 - protein, 9 aa, Homo Sapiens
EIEIFDVQT

SEQ ID NO: 398816 - protein, 9 aa, Homo Sapiens
KKTNTKAYG

SEQ ID NO: 398817 - protein, 9 aa, Homo Sapiens
IFASFSDDG

SEQ ID NO: 398818 - protein, 9 aa, Homo Sapiens
SNLQNRIWD

SEQ ID NO: 398819 - protein, 9 aa, Homo Sapiens
QTDWITREG

SEQ ID NO: 398820 - protein, 9 aa, Homo Sapiens
PAGVQKLTH

SEQ ID NO: 398821 - protein, 9 aa, Homo Sapiens
LKKTNTKAY

SEQ ID NO: 398822 - protein, 9 aa, Homo Sapiens
TKLKVEPQP

SEQ ID NO: 398823 - protein, 9 aa, Homo Sapiens
QDNLCQLSV

SEQ ID NO: 398824 - protein, 9 aa, Homo Sapiens
NDCLVLNEQ

SEQ ID NO: 398825 - protein, 9 aa, Homo Sapiens
SKLISLNEE

SEQ ID NO: 398826 - protein, 9 aa, Homo Sapiens
LIEADAPKE

SEQ ID NO: 398827 - protein, 9 aa, Homo Sapiens
PSLFDSLKS

SEQ ID NO: 398828 - protein, 9 aa, Homo Sapiens
HTLYHGHQA

SEQ ID NO: 398829 - protein, 9 aa, Homo Sapiens
NPTSARNGG

SEQ ID NO: 398830 - protein, 9 aa, Homo Sapiens
GNKLHFSSS

SEQ ID NO: 398831 - protein, 9 aa, Homo Sapiens
LTKLQDNLC

SEQ ID NO: 398832 - protein, 9 aa, Homo Sapiens
IACWLMVAT

SEQ ID NO: 398833 - protein, 9 aa, Homo Sapiens
NKNNQRAVR

SEQ ID NO: 398834 - protein, 9 aa, Homo Sapiens
LFACPSKAG

SEQ ID NO: 398835 - protein, 9 aa, Homo Sapiens
ERVLDVDYR

SEQ ID NO: 398836 - protein, 9 aa, Homo Sapiens
HNGVPSHSS

SEQ ID NO: 398837 - protein, 9 aa, Homo Sapiens
FTTFNKGKK

SEQ ID NO: 398838 - protein, 9 aa, Homo Sapiens
VADRLFSYF

SEQ ID NO: 398839 - protein, 9 aa, Homo Sapiens
NVMRYIHGV

SEQ ID NO: 398840 - protein, 9 aa, Homo Sapiens
FPPIPFFLD

SEQ ID NO: 398841 - protein, 9 aa, Homo Sapiens
LDSIIAEVE

SEQ ID NO: 398842 - protein, 9 aa, Homo Sapiens
NGTVHPVFF

SEQ ID NO: 398843 - protein, 9 aa, Homo Sapiens
QMSFNSMNW

SEQ ID NO: 398844 - protein, 9 aa, Homo Sapiens
MNDPLYKEN

SEQ ID NO: 398845 - protein, 9 aa, Homo Sapiens
TETVEAYVI

SEQ ID NO: 398846 - protein, 9 aa, Homo Sapiens
GDSKDSKGK

SEQ ID NO: 398847 - protein, 9 aa, Homo Sapiens
LTNQRKYIT

SEQ ID NO: 398848 - protein, 9 aa, Homo Sapiens
IECGHAVLN

SEQ ID NO: 398849 - protein, 9 aa, Homo Sapiens
HKDVSYLYI

SEQ ID NO: 398850 - protein, 9 aa, Homo Sapiens
STDQTLVDK

SEQ ID NO: 398851 - protein, 9 aa, Homo Sapiens
FKLEMAQEG

SEQ ID NO: 398852 - protein, 9 aa, Homo Sapiens
YWWLPESSR

SEQ ID NO: 398853 - protein, 9 aa, Homo Sapiens
RSAFTTYTV

SEQ ID NO: 398854 - protein, 9 aa, Homo Sapiens
DYFEGYSLD

SEQ ID NO: 398855 - protein, 9 aa, Homo Sapiens
SNYLELWDG

SEQ ID NO: 398856 - protein, 9 aa, Homo Sapiens
LVRVLDNIL

SEQ ID NO: 398857 - protein, 9 aa, Homo Sapiens
NDNNPIFPQ

SEQ ID NO: 398858 - protein, 9 aa, Homo Sapiens
KKSKDKKIK

SEQ ID NO: 398859 - protein, 9 aa, Homo Sapiens
FSSPTYECV

SEQ ID NO: 398860 - protein, 9 aa, Homo Sapiens
NVLNLTQLT

SEQ ID NO: 398861 - protein, 9 aa, Homo Sapiens
QQKCEENLR

SEQ ID NO: 398862 - protein, 9 aa, Homo Sapiens
IQEGAVGKK

SEQ ID NO: 398863 - protein, 9 aa, Homo Sapiens
ANPEDAGAE

SEQ ID NO: 398864 - protein, 9 aa, Homo Sapiens
KQTNVYSMA

SEQ ID NO: 398865 - protein, 9 aa, Homo Sapiens
RKPPMDDKS

SEQ ID NO: 398866 - protein, 9 aa, Homo Sapiens
KGFTRFWSA

SEQ ID NO: 398867 - protein, 9 aa, Homo Sapiens
VIAILRLRV

SEQ ID NO: 398868 - protein, 9 aa, Homo Sapiens
YLRPRSLRY

SEQ ID NO: 398869 - protein, 9 aa, Homo Sapiens
FKNISTINF

SEQ ID NO: 398870 - protein, 9 aa, Homo Sapiens
GYLMNGMKS

SEQ ID NO: 398871 - protein, 9 aa, Homo Sapiens
LLILVFYVH

SEQ ID NO: 398872 - protein, 9 aa, Homo Sapiens
RRVNTGEKP

SEQ ID NO: 398873 - protein, 9 aa, Homo Sapiens
ESRFPQSTD

SEQ ID NO: 398874 - protein, 9 aa, Homo Sapiens
VTVKLDELE

SEQ ID NO: 398875 - protein, 9 aa, Homo Sapiens
PPHNWMKYF

SEQ ID NO: 398876 - protein, 9 aa, Homo Sapiens
ITKYLWEQI

SEQ ID NO: 398877 - protein, 9 aa, Homo Sapiens
YLFRQNRLY

SEQ ID NO: 398878 - protein, 9 aa, Homo Sapiens
TEIYHIVSQ

SEQ ID NO: 398879 - protein, 9 aa, Homo Sapiens
KVSYFTHHI

SEQ ID NO: 398880 - protein, 9 aa, Homo Sapiens
IQIETVLPA

SEQ ID NO: 398881 - protein, 9 aa, Homo Sapiens
PVFPGQQLV

SEQ ID NO: 398882 - protein, 9 aa, Homo Sapiens
IQMKTHSRN

SEQ ID NO: 398883 - protein, 9 aa, Homo Sapiens
EDPELAKSC

SEQ ID NO: 398884 - protein, 9 aa, Homo Sapiens
GEHEGSLQM

SEQ ID NO: 398885 - protein, 9 aa, Homo Sapiens
VMAQALDIP

SEQ ID NO: 398886 - protein, 9 aa, Homo Sapiens
VEIKRLHTE

SEQ ID NO: 398887 - protein, 9 aa, Homo Sapiens
DNSNMTCDK

SEQ ID NO: 398888 - protein, 9 aa, Homo Sapiens
EGLDISRLQ

SEQ ID NO: 398889 - protein, 9 aa, Homo Sapiens
LRSPLSNHV

SEQ ID NO: 398890 - protein, 9 aa, Homo Sapiens
LFDSLKSPD

SEQ ID NO: 398891 - protein, 9 aa, Homo Sapiens
DLMPITWIK

SEQ ID NO: 398892 - protein, 9 aa, Homo Sapiens
ARTPISNYI

SEQ ID NO: 398893 - protein, 9 aa, Homo Sapiens
DCIATALRS

SEQ ID NO: 398894 - protein, 9 aa, Homo Sapiens
LNIFKLSKL

SEQ ID NO: 398895 - protein, 9 aa, Homo Sapiens
SKAKLKSME

SEQ ID NO: 398896 - protein, 9 aa, Homo Sapiens
CLQSNCTYS

SEQ ID NO: 398897 - protein, 9 aa, Homo Sapiens
LGSPDQAPP

SEQ ID NO: 398898 - protein, 9 aa, Homo Sapiens
YQRDYSLPF

SEQ ID NO: 398899 - protein, 9 aa, Homo Sapiens
TENRCVLKD

SEQ ID NO: 398900 - protein, 9 aa, Homo Sapiens
YCIKVSYFT

SEQ ID NO: 398901 - protein, 9 aa, Homo Sapiens
LERKQKWEK

SEQ ID NO: 398902 - protein, 9 aa, Homo Sapiens
SYDTLKDEN

SEQ ID NO: 398903 - protein, 9 aa, Homo Sapiens
GSEEAIIGG

SEQ ID NO: 398904 - protein, 9 aa, Homo Sapiens
LHTGDKSYK

SEQ ID NO: 398905 - protein, 9 aa, Homo Sapiens
QAFKRIEDY

SEQ ID NO: 398906 - protein, 9 aa, Homo Sapiens
ITERITNSQ

SEQ ID NO: 398907 - protein, 9 aa, Homo Sapiens
SEKLSLVNT

SEQ ID NO: 398908 - protein, 9 aa, Homo Sapiens
GSDDPPWSW

SEQ ID NO: 398909 - protein, 9 aa, Homo Sapiens
FHNNLLDNN

SEQ ID NO: 398910 - protein, 9 aa, Homo Sapiens
QLALQAKLQ

SEQ ID NO: 398911 - protein, 9 aa, Homo Sapiens
HDLDYLSLR

SEQ ID NO: 398912 - protein, 9 aa, Homo Sapiens
LILETITSL

SEQ ID NO: 398913 - protein, 9 aa, Homo Sapiens
VEGPENQMV

SEQ ID NO: 398914 - protein, 9 aa, Homo Sapiens
GKTDQKEFV

SEQ ID NO: 398915 - protein, 9 aa, Homo Sapiens
YHGHQAALG

SEQ ID NO: 398916 - protein, 9 aa, Homo Sapiens
KDKQNRTAL

SEQ ID NO: 398917 - protein, 9 aa, Homo Sapiens
DDKLDISDN

SEQ ID NO: 398918 - protein, 9 aa, Homo Sapiens
KIHACYTVC

SEQ ID NO: 398919 - protein, 9 aa, Homo Sapiens
TCILWWLTK

SEQ ID NO: 398920 - protein, 9 aa, Homo Sapiens
GLPKLEKKD

SEQ ID NO: 398921 - protein, 9 aa, Homo Sapiens
TLNAKSICC

SEQ ID NO: 398922 - protein, 9 aa, Homo Sapiens
RLFVLTKAS

SEQ ID NO: 398923 - protein, 9 aa, Homo Sapiens
NITVQKNKN

SEQ ID NO: 398924 - protein, 9 aa, Homo Sapiens
PIYQLQLDE

SEQ ID NO: 398925 - protein, 9 aa, Homo Sapiens
HKIYSKIKS

SEQ ID NO: 398926 - protein, 9 aa, Homo Sapiens
LIMPSYWCG

SEQ ID NO: 398927 - protein, 9 aa, Homo Sapiens
LMRKLVRLK

SEQ ID NO: 398928 - protein, 9 aa, Homo Sapiens
KEKKHDKYW

SEQ ID NO: 398929 - protein, 9 aa, Homo Sapiens
KLNNVNIKE

SEQ ID NO: 398930 - protein, 9 aa, Homo Sapiens
IWDQMQTIS

SEQ ID NO: 398931 - protein, 9 aa, Homo Sapiens
RNVLLAGAK

SEQ ID NO: 398932 - protein, 9 aa, Homo Sapiens
LPLHLTAKE

SEQ ID NO: 398933 - protein, 9 aa, Homo Sapiens
NKSFSLEEK

SEQ ID NO: 398934 - protein, 9 aa, Homo Sapiens
HNWMKYFIL

SEQ ID NO: 398935 - protein, 9 aa, Homo Sapiens
KELAQIEEF

SEQ ID NO: 398936 - protein, 9 aa, Homo Sapiens
GPVTMSTPQ

SEQ ID NO: 398937 - protein, 9 aa, Homo Sapiens
FYLFFSLGT

SEQ ID NO: 398938 - protein, 9 aa, Homo Sapiens
FAGLKNILR

SEQ ID NO: 398939 - protein, 9 aa, Homo Sapiens
ITQSAPNFT

SEQ ID NO: 398940 - protein, 9 aa, Homo Sapiens
LENTLFLFI

SEQ ID NO: 398941 - protein, 9 aa, Homo Sapiens
CCCISIDLD

SEQ ID NO: 398942 - protein, 9 aa, Homo Sapiens
PKKIKKTKV

SEQ ID NO: 398943 - protein, 9 aa, Homo Sapiens
SLWEATRDL

SEQ ID NO: 398944 - protein, 9 aa, Homo Sapiens
AIGSRLEKT

SEQ ID NO: 398945 - protein, 9 aa, Homo Sapiens
LVFYVHILS

SEQ ID NO: 398946 - protein, 9 aa, Homo Sapiens
VKPTEHGKK

SEQ ID NO: 398947 - protein, 9 aa, Homo Sapiens
IECSSFQDD

SEQ ID NO: 398948 - protein, 9 aa, Homo Sapiens
RPKGFTRFW

SEQ ID NO: 398949 - protein, 9 aa, Homo Sapiens
KKAKHSING

SEQ ID NO: 398950 - protein, 9 aa, Homo Sapiens
SFPSFVKKL

SEQ ID NO: 398951 - protein, 9 aa, Homo Sapiens
ETVLLSFCY

SEQ ID NO: 398952 - protein, 9 aa, Homo Sapiens
KLTVEENYQ

SEQ ID NO: 398953 - protein, 9 aa, Homo Sapiens
QENKDLLSA

SEQ ID NO: 398954 - protein, 9 aa, Homo Sapiens
GQRRLDIFS

SEQ ID NO: 398955 - protein, 9 aa, Homo Sapiens
FPEDLHTEL

SEQ ID NO: 398956 - protein, 9 aa, Homo Sapiens
VHRIIHTGE

SEQ ID NO: 398957 - protein, 9 aa, Homo Sapiens
KSLVDPNNL

SEQ ID NO: 398958 - protein, 9 aa, Homo Sapiens
MGKEDYDNF

SEQ ID NO: 398959 - protein, 9 aa, Homo Sapiens
QMKTELLVQ

SEQ ID NO: 398960 - protein, 9 aa, Homo Sapiens
VKISKIEGK

SEQ ID NO: 398961 - protein, 9 aa, Homo Sapiens
VQSFEKETG

SEQ ID NO: 398962 - protein, 9 aa, Homo Sapiens
GLHLISLNM

SEQ ID NO: 398963 - protein, 9 aa, Homo Sapiens
FKHLFQQPP

SEQ ID NO: 398964 - protein, 9 aa, Homo Sapiens
PDQAPPEDE

SEQ ID NO: 398965 - protein, 9 aa, Homo Sapiens
LFAYAAQGW

SEQ ID NO: 398966 - protein, 9 aa, Homo Sapiens
NADKLLSHI

SEQ ID NO: 398967 - protein, 9 aa, Homo Sapiens
KITIINKLF

SEQ ID NO: 398968 - protein, 9 aa, Homo Sapiens
WGNFFLLKR

SEQ ID NO: 398969 - protein, 9 aa, Homo Sapiens
LEDEESFES

SEQ ID NO: 398970 - protein, 9 aa, Homo Sapiens
VCLQSNCTY

SEQ ID NO: 398971 - protein, 9 aa, Homo Sapiens
IGNKNNQRA

SEQ ID NO: 398972 - protein, 9 aa, Homo Sapiens
FPTASPTPP

SEQ ID NO: 398973 - protein, 9 aa, Homo Sapiens
EDKLFVETG

SEQ ID NO: 398974 - protein, 9 aa, Homo Sapiens
ILKEFNYYG

SEQ ID NO: 398975 - protein, 9 aa, Homo Sapiens
VDQNEAEIK

SEQ ID NO: 398976 - protein, 9 aa, Homo Sapiens
GGEGPGESD

SEQ ID NO: 398977 - protein, 9 aa, Homo Sapiens
EHGKKTTLA

SEQ ID NO: 398978 - protein, 9 aa, Homo Sapiens
WRVYLRLWT

SEQ ID NO: 398979 - protein, 9 aa, Homo Sapiens
REAMEAVHL

SEQ ID NO: 398980 - protein, 9 aa, Homo Sapiens
GKITIINKL

SEQ ID NO: 398981 - protein, 9 aa, Homo Sapiens
ISQEECSST

SEQ ID NO: 398982 - protein, 9 aa, Homo Sapiens
DGVGNSYIC

SEQ ID NO: 398983 - protein, 9 aa, Homo Sapiens
HEGSLQMKT

SEQ ID NO: 398984 - protein, 9 aa, Homo Sapiens
TSKFSVSGD

SEQ ID NO: 398985 - protein, 9 aa, Homo Sapiens
KFQYLNVAN

SEQ ID NO: 398986 - protein, 9 aa, Homo Sapiens
SPLKPYPNK

SEQ ID NO: 398987 - protein, 9 aa, Homo Sapiens
CLYNINYED

SEQ ID NO: 398988 - protein, 9 aa, Homo Sapiens
KSMETYLKA

SEQ ID NO: 398989 - protein, 9 aa, Homo Sapiens
LRKNPTSAR

SEQ ID NO: 398990 - protein, 9 aa, Homo Sapiens
PTDCGGPFQ

SEQ ID NO: 398991 - protein, 9 aa, Homo Sapiens
PKNLAAPSG

SEQ ID NO: 398992 - protein, 9 aa, Homo Sapiens
KFGGVIPQY

SEQ ID NO: 398993 - protein, 9 aa, Homo Sapiens
NDKYITLDE

SEQ ID NO: 398994 - protein, 9 aa, Homo Sapiens
GFSKAKLKS

SEQ ID NO: 398995 - protein, 9 aa, Homo Sapiens
PLAKNEYIK

SEQ ID NO: 398996 - protein, 9 aa, Homo Sapiens
EKYSYLQKT

SEQ ID NO: 398997 - protein, 9 aa, Homo Sapiens
RIWDQMQTI

SEQ ID NO: 398998 - protein, 9 aa, Homo Sapiens
EKYEQIGKI

SEQ ID NO: 398999 - protein, 9 aa, Homo Sapiens
NMSILINFV

SEQ ID NO: 399000 - protein, 9 aa, Homo Sapiens
LNQYILMAF

SEQ ID NO: 399001 - protein, 9 aa, Homo Sapiens
YTVVRMHVG

SEQ ID NO: 399002 - protein, 9 aa, Homo Sapiens
CGGPFQLWE

SEQ ID NO: 399003 - protein, 9 aa, Homo Sapiens
IQTLKHKFK

SEQ ID NO: 399004 - protein, 9 aa, Homo Sapiens
DDLFPISQV

SEQ ID NO: 399005 - protein, 9 aa, Homo Sapiens
IMLLKNKQA

SEQ ID NO: 399006 - protein, 9 aa, Homo Sapiens
ISKSMGTLD

SEQ ID NO: 399007 - protein, 9 aa, Homo Sapiens
KDKTLCIID

SEQ ID NO: 399008 - protein, 9 aa, Homo Sapiens
PGYPITCTL

SEQ ID NO: 399009 - protein, 9 aa, Homo Sapiens
ESFESIRAA

SEQ ID NO: 399010 - protein, 9 aa, Homo Sapiens
HNKYGSNVH

SEQ ID NO: 399011 - protein, 9 aa, Homo Sapiens
TKTRQRVED

SEQ ID NO: 399012 - protein, 9 aa, Homo Sapiens
TKTVQEKDN

SEQ ID NO: 399013 - protein, 9 aa, Homo Sapiens
AAALAESAD

SEQ ID NO: 399014 - protein, 9 aa, Homo Sapiens
APHINKKSP

SEQ ID NO: 399015 - protein, 9 aa, Homo Sapiens
LAIAGEDVA

SEQ ID NO: 399016 - protein, 9 aa, Homo Sapiens
CYVSATNCK

SEQ ID NO: 399017 - protein, 9 aa, Homo Sapiens
KLNLGDCDL

SEQ ID NO: 399018 - protein, 9 aa, Homo Sapiens
QTECVICMN

SEQ ID NO: 399019 - protein, 9 aa, Homo Sapiens
ESNTNLTAT

SEQ ID NO: 399020 - protein, 9 aa, Homo Sapiens
EGKPLRFCG

SEQ ID NO: 399021 - protein, 9 aa, Homo Sapiens
PDQSTPSLF

SEQ ID NO: 399022 - protein, 9 aa, Homo Sapiens
YFKEHEIIH

SEQ ID NO: 399023 - protein, 9 aa, Homo Sapiens
EKLNNVNIK

SEQ ID NO: 399024 - protein, 9 aa, Homo Sapiens
PLFVDLTLP

SEQ ID NO: 399025 - protein, 9 aa, Homo Sapiens
KAKLKSMET

SEQ ID NO: 399026 - protein, 9 aa, Homo Sapiens
EIIVRNVLL

SEQ ID NO: 399027 - protein, 9 aa, Homo Sapiens
YITLDEWAG

SEQ ID NO: 399028 - protein, 9 aa, Homo Sapiens
IQNERNKFV

SEQ ID NO: 399029 - protein, 9 aa, Homo Sapiens
SSPLKPYPN

SEQ ID NO: 399030 - protein, 9 aa, Homo Sapiens
SGLVNGLQL

SEQ ID NO: 399031 - protein, 9 aa, Homo Sapiens
ASEACVPEV

SEQ ID NO: 399032 - protein, 9 aa, Homo Sapiens
CEGMESPYQ

SEQ ID NO: 399033 - protein, 9 aa, Homo Sapiens
PQALYKVEI

SEQ ID NO: 399034 - protein, 9 aa, Homo Sapiens
AMSYCQYHP

SEQ ID NO: 399035 - protein, 9 aa, Homo Sapiens
CKYWAPHIN

SEQ ID NO: 399036 - protein, 9 aa, Homo Sapiens
KYQVWHHRR

SEQ ID NO: 399037 - protein, 9 aa, Homo Sapiens
GMMLGVCSN

SEQ ID NO: 399038 - protein, 9 aa, Homo Sapiens
LAAYSYFWI

SEQ ID NO: 399039 - protein, 9 aa, Homo Sapiens
NPYTDVCRR

SEQ ID NO: 399040 - protein, 9 aa, Homo Sapiens
VYLVTLVAN

SEQ ID NO: 399041 - protein, 9 aa, Homo Sapiens
SANPEDAGA

SEQ ID NO: 399042 - protein, 9 aa, Homo Sapiens
YEKLKSEGH

SEQ ID NO: 399043 - protein, 9 aa, Homo Sapiens
GVDVGNHYE

SEQ ID NO: 399044 - protein, 9 aa, Homo Sapiens
KKTKVEIRE

SEQ ID NO: 399045 - protein, 9 aa, Homo Sapiens
KGSQSVVPR

SEQ ID NO: 399046 - protein, 9 aa, Homo Sapiens
EDYDNFTKE

SEQ ID NO: 399047 - protein, 9 aa, Homo Sapiens
EPKSAVYFL

SEQ ID NO: 399048 - protein, 9 aa, Homo Sapiens
ENTFKPNEN

SEQ ID NO: 399049 - protein, 9 aa, Homo Sapiens
PLHLTAKEG

SEQ ID NO: 399050 - protein, 9 aa, Homo Sapiens
NNMTKSTSI

SEQ ID NO: 399051 - protein, 9 aa, Homo Sapiens
PKVKAKKAQ

SEQ ID NO: 399052 - protein, 9 aa, Homo Sapiens
YSEVDDKLD

SEQ ID NO: 399053 - protein, 9 aa, Homo Sapiens
DIKEFSENN

SEQ ID NO: 399054 - protein, 9 aa, Homo Sapiens
LSKYQSILI

SEQ ID NO: 399055 - protein, 9 aa, Homo Sapiens
RNVHNILQW

SEQ ID NO: 399056 - protein, 9 aa, Homo Sapiens
VNSGVYEKD

SEQ ID NO: 399057 - protein, 9 aa, Homo Sapiens
RENVPKDIS

SEQ ID NO: 399058 - protein, 9 aa, Homo Sapiens
SFASNQQDE

SEQ ID NO: 399059 - protein, 9 aa, Homo Sapiens
AKVSEVPKK

SEQ ID NO: 399060 - protein, 9 aa, Homo Sapiens
LQLMIDSHN

SEQ ID NO: 399061 - protein, 9 aa, Homo Sapiens
NYCESPKPK

SEQ ID NO: 399062 - protein, 9 aa, Homo Sapiens
CFLQFYLFF

SEQ ID NO: 399063 - protein, 9 aa, Homo Sapiens
NKYGSNVHR

SEQ ID NO: 399064 - protein, 9 aa, Homo Sapiens
SSDELSKAY

SEQ ID NO: 399065 - protein, 9 aa, Homo Sapiens
LDNPEIKIR

SEQ ID NO: 399066 - protein, 9 aa, Homo Sapiens
NGAKVVSCL

SEQ ID NO: 399067 - protein, 9 aa, Homo Sapiens
IKIRLLAWK

SEQ ID NO: 399068 - protein, 9 aa, Homo Sapiens
WAAMHVSDH

SEQ ID NO: 399069 - protein, 9 aa, Homo Sapiens
LGGRTFKKF

SEQ ID NO: 399070 - protein, 9 aa, Homo Sapiens
FISANPEDA

SEQ ID NO: 399071 - protein, 9 aa, Homo Sapiens
LLVLHGAEV

SEQ ID NO: 399072 - protein, 9 aa, Homo Sapiens
PYSSLSSGH

SEQ ID NO: 399073 - protein, 9 aa, Homo Sapiens
ILSYVLSLG

SEQ ID NO: 399074 - protein, 9 aa, Homo Sapiens
WSAVRVSIA

SEQ ID NO: 399075 - protein, 9 aa, Homo Sapiens
LPQVAGVPR

SEQ ID NO: 399076 - protein, 9 aa, Homo Sapiens
YHQQQQQQQ

SEQ ID NO: 399077 - protein, 9 aa, Homo Sapiens
FKDKLSSIP

SEQ ID NO: 399078 - protein, 9 aa, Homo Sapiens
NNFKSVKRK

SEQ ID NO: 399079 - protein, 9 aa, Homo Sapiens
DVKLSFQCP

SEQ ID NO: 399080 - protein, 9 aa, Homo Sapiens
LTNNFNKDR

SEQ ID NO: 399081 - protein, 9 aa, Homo Sapiens
GGPCTVMPG

SEQ ID NO: 399082 - protein, 9 aa, Homo Sapiens
PSFVKKLLI

SEQ ID NO: 399083 - protein, 9 aa, Homo Sapiens
LHTELMQTL

SEQ ID NO: 399084 - protein, 9 aa, Homo Sapiens
NVYRDVMLE

SEQ ID NO: 399085 - protein, 9 aa, Homo Sapiens
HSSRDTAEP

SEQ ID NO: 399086 - protein, 9 aa, Homo Sapiens
STKKLFDDL

SEQ ID NO: 399087 - protein, 9 aa, Homo Sapiens
SDGPLGSRG

SEQ ID NO: 399088 - protein, 9 aa, Homo Sapiens
SMGLIIEIE

SEQ ID NO: 399089 - protein, 9 aa, Homo Sapiens
GIGQRTPFQ

SEQ ID NO: 399090 - protein, 9 aa, Homo Sapiens
IYLLTVQRE

SEQ ID NO: 399091 - protein, 9 aa, Homo Sapiens
WGFHNNLLD

SEQ ID NO: 399092 - protein, 9 aa, Homo Sapiens
AEMRTYAAC

SEQ ID NO: 399093 - protein, 9 aa, Homo Sapiens
AVATKVQRH

SEQ ID NO: 399094 - protein, 9 aa, Homo Sapiens
VKLSFQCPG

SEQ ID NO: 399095 - protein, 9 aa, Homo Sapiens
PFHTSGENE

SEQ ID NO: 399096 - protein, 9 aa, Homo Sapiens
QEPKSAVYF

SEQ ID NO: 399097 - protein, 9 aa, Homo Sapiens
QEGAVGKKM

SEQ ID NO: 399098 - protein, 9 aa, Homo Sapiens
LLIQFPWFF

SEQ ID NO: 399099 - protein, 9 aa, Homo Sapiens
LIEKNKQKI

SEQ ID NO: 399100 - protein, 9 aa, Homo Sapiens
LLAQMGIIS

SEQ ID NO: 399101 - protein, 9 aa, Homo Sapiens
SKERGGVLL

SEQ ID NO: 399102 - protein, 9 aa, Homo Sapiens
VKHWPWIKL

SEQ ID NO: 399103 - protein, 9 aa, Homo Sapiens
VFSSPTYEC

SEQ ID NO: 399104 - protein, 9 aa, Homo Sapiens
PTTAALEKD

SEQ ID NO: 399105 - protein, 9 aa, Homo Sapiens
VAEAHNPDS

SEQ ID NO: 399106 - protein, 9 aa, Homo Sapiens
GVPQPWYFL

SEQ ID NO: 399107 - protein, 9 aa, Homo Sapiens
SDILGLLVP

SEQ ID NO: 399108 - protein, 9 aa, Homo Sapiens
VNGEMSYSL

SEQ ID NO: 399109 - protein, 9 aa, Homo Sapiens
SSFKENEDN

SEQ ID NO: 399110 - protein, 9 aa, Homo Sapiens
SMIQMKTHS

SEQ ID NO: 399111 - protein, 9 aa, Homo Sapiens
LPGYPITCT

SEQ ID NO: 399112 - protein, 9 aa, Homo Sapiens
MMLENLTLI

SEQ ID NO: 399113 - protein, 9 aa, Homo Sapiens
DVAIVASDT

SEQ ID NO: 399114 - protein, 9 aa, Homo Sapiens
CKGGWKCKD

SEQ ID NO: 399115 - protein, 9 aa, Homo Sapiens
MDPNNTGHI

SEQ ID NO: 399116 - protein, 9 aa, Homo Sapiens
TPDDLEISA

SEQ ID NO: 399117 - protein, 9 aa, Homo Sapiens
NYFITHSLK

SEQ ID NO: 399118 - protein, 9 aa, Homo Sapiens
SKRHFKLEK

SEQ ID NO: 399119 - protein, 9 aa, Homo Sapiens
LHSPAPALA

SEQ ID NO: 399120 - protein, 9 aa, Homo Sapiens
HKSGKHVTN

SEQ ID NO: 399121 - protein, 9 aa, Homo Sapiens
KELSVSVQR

SEQ ID NO: 399122 - protein, 9 aa, Homo Sapiens
RRKRSMGLI

SEQ ID NO: 399123 - protein, 9 aa, Homo Sapiens
DGSNYFATD

SEQ ID NO: 399124 - protein, 9 aa, Homo Sapiens
INDLISATK

SEQ ID NO: 399125 - protein, 9 aa, Homo Sapiens
MAQALDIPA

SEQ ID NO: 399126 - protein, 9 aa, Homo Sapiens
DPEDNEMVC

SEQ ID NO: 399127 - protein, 9 aa, Homo Sapiens
FVDNVYGYP

SEQ ID NO: 399128 - protein, 9 aa, Homo Sapiens
SRLFIKALK

SEQ ID NO: 399129 - protein, 9 aa, Homo Sapiens
GEALYKILG

SEQ ID NO: 399130 - protein, 9 aa, Homo Sapiens
TNSNPEHFV

SEQ ID NO: 399131 - protein, 9 aa, Homo Sapiens
MHHRTHTGE

SEQ ID NO: 399132 - protein, 9 aa, Homo Sapiens
VKIILQLHE

SEQ ID NO: 399133 - protein, 9 aa, Homo Sapiens
KERGMDTFL

SEQ ID NO: 399134 - protein, 9 aa, Homo Sapiens
LRLNSEKLS

SEQ ID NO: 399135 - protein, 9 aa, Homo Sapiens
PQWGLVFEN

SEQ ID NO: 399136 - protein, 9 aa, Homo Sapiens
KWLSRQFQK

SEQ ID NO: 399137 - protein, 9 aa, Homo Sapiens
YFSISYEGF

SEQ ID NO: 399138 - protein, 9 aa, Homo Sapiens
IYQENNENK

SEQ ID NO: 399139 - protein, 9 aa, Homo Sapiens
RDAYVQALV

SEQ ID NO: 399140 - protein, 9 aa, Homo Sapiens
EIGYLNRTS

SEQ ID NO: 399141 - protein, 9 aa, Homo Sapiens
GMDTFLFRP

SEQ ID NO: 399142 - protein, 9 aa, Homo Sapiens
PNNTGHICL

SEQ ID NO: 399143 - protein, 9 aa, Homo Sapiens
WCSLTNNFN

SEQ ID NO: 399144 - protein, 9 aa, Homo Sapiens
DTAQNNLYR

SEQ ID NO: 399145 - protein, 9 aa, Homo Sapiens
AEVPNLWSG

SEQ ID NO: 399146 - protein, 9 aa, Homo Sapiens
TAVNSASSF

SEQ ID NO: 399147 - protein, 9 aa, Homo Sapiens
ADEVELNMI

SEQ ID NO: 399148 - protein, 9 aa, Homo Sapiens
AKKHSQKWL

SEQ ID NO: 399149 - protein, 9 aa, Homo Sapiens
TYKQGFSSR

SEQ ID NO: 399150 - protein, 9 aa, Homo Sapiens
AKMTFMRFQ

SEQ ID NO: 399151 - protein, 9 aa, Homo Sapiens
NTPLMRKLV

SEQ ID NO: 399152 - protein, 9 aa, Homo Sapiens
KCEASVGFL

SEQ ID NO: 399153 - protein, 9 aa, Homo Sapiens
VVMSGVCCT

SEQ ID NO: 399154 - protein, 9 aa, Homo Sapiens
LKVNLRNNY

SEQ ID NO: 399155 - protein, 9 aa, Homo Sapiens
DPNYIVMQF

SEQ ID NO: 399156 - protein, 9 aa, Homo Sapiens
NKSSISQIH

SEQ ID NO: 399157 - protein, 9 aa, Homo Sapiens
LIFFLYYWW

SEQ ID NO: 399158 - protein, 9 aa, Homo Sapiens
RFCSDCIAT

SEQ ID NO: 399159 - protein, 9 aa, Homo Sapiens
HKSDTDKDG

SEQ ID NO: 399160 - protein, 9 aa, Homo Sapiens
EKDHEAITK

SEQ ID NO: 399161 - protein, 9 aa, Homo Sapiens
KSKDKKIKR

SEQ ID NO: 399162 - protein, 9 aa, Homo Sapiens
KVKSRKLAL

SEQ ID NO: 399163 - protein, 9 aa, Homo Sapiens
EENVTRESI

SEQ ID NO: 399164 - protein, 9 aa, Homo Sapiens
HGIESIYQA

SEQ ID NO: 399165 - protein, 9 aa, Homo Sapiens
LRYPTEDKV

SEQ ID NO: 399166 - protein, 9 aa, Homo Sapiens
ELPQRHNYL

SEQ ID NO: 399167 - protein, 9 aa, Homo Sapiens
KLSPKNLAA

SEQ ID NO: 399168 - protein, 9 aa, Homo Sapiens
HLCGGTLIS

SEQ ID NO: 399169 - protein, 9 aa, Homo Sapiens
RREHKDKKK

SEQ ID NO: 399170 - protein, 9 aa, Homo Sapiens
AKLGNFGIA

SEQ ID NO: 399171 - protein, 9 aa, Homo Sapiens
TLVVKKLDV

SEQ ID NO: 399172 - protein, 9 aa, Homo Sapiens
YDQAHLSAL

SEQ ID NO: 399173 - protein, 9 aa, Homo Sapiens
GPLGSRGLA

SEQ ID NO: 399174 - protein, 9 aa, Homo Sapiens
FGLINSENV

SEQ ID NO: 399175 - protein, 9 aa, Homo Sapiens
RVAQVLRRM

SEQ ID NO: 399176 - protein, 9 aa, Homo Sapiens
FVYSPLKNA

SEQ ID NO: 399177 - protein, 9 aa, Homo Sapiens
SPGLPGYPI

SEQ ID NO: 399178 - protein, 9 aa, Homo Sapiens
FPENIISQE

SEQ ID NO: 399179 - protein, 9 aa, Homo Sapiens
LSDSDSGQD

SEQ ID NO: 399180 - protein, 9 aa, Homo Sapiens
EPSFATGNC

SEQ ID NO: 399181 - protein, 9 aa, Homo Sapiens
VSSRANAID

SEQ ID NO: 399182 - protein, 9 aa, Homo Sapiens
YLPGLLQSG

SEQ ID NO: 399183 - protein, 9 aa, Homo Sapiens
GLIIEIEIG

SEQ ID NO: 399184 - protein, 9 aa, Homo Sapiens
FIMNFINYC

SEQ ID NO: 399185 - protein, 9 aa, Homo Sapiens
KELYLEELT

SEQ ID NO: 399186 - protein, 9 aa, Homo Sapiens
PTVSITVEL

SEQ ID NO: 399187 - protein, 9 aa, Homo Sapiens
CQEAGTTLG

SEQ ID NO: 399188 - protein, 9 aa, Homo Sapiens
LIEQDFRKR

SEQ ID NO: 399189 - protein, 9 aa, Homo Sapiens
ASSAPATRT

SEQ ID NO: 399190 - protein, 9 aa, Homo Sapiens
TLEINFERI

SEQ ID NO: 399191 - protein, 9 aa, Homo Sapiens
KTKSHYFPA

SEQ ID NO: 399192 - protein, 9 aa, Homo Sapiens
FILAVMAFD

SEQ ID NO: 399193 - protein, 9 aa, Homo Sapiens
FKYILNFLR

SEQ ID NO: 399194 - protein, 9 aa, Homo Sapiens
ATVEDSGAY

SEQ ID NO: 399195 - protein, 9 aa, Homo Sapiens
KVLSKPLNA

SEQ ID NO: 399196 - protein, 9 aa, Homo Sapiens
RFKWFNNGN

SEQ ID NO: 399197 - protein, 9 aa, Homo Sapiens
YVYSVLYDV

SEQ ID NO: 399198 - protein, 9 aa, Homo Sapiens
STVPTCVLS

SEQ ID NO: 399199 - protein, 9 aa, Homo Sapiens
TYTLSDGLH

SEQ ID NO: 399200 - protein, 9 aa, Homo Sapiens
WNPKGPNLS

SEQ ID NO: 399201 - protein, 9 aa, Homo Sapiens
NNFNKDRIW

SEQ ID NO: 399202 - protein, 9 aa, Homo Sapiens
SYSCPSCGQ

SEQ ID NO: 399203 - protein, 9 aa, Homo Sapiens
ITMVEKSSI

SEQ ID NO: 399204 - protein, 9 aa, Homo Sapiens
TFFKAIVGK

SEQ ID NO: 399205 - protein, 9 aa, Homo Sapiens
AQKVKHLDG

SEQ ID NO: 399206 - protein, 9 aa, Homo Sapiens
KIISYVLQH

SEQ ID NO: 399207 - protein, 9 aa, Homo Sapiens
MQIKKKQRQ

SEQ ID NO: 399208 - protein, 9 aa, Homo Sapiens
DLSPEDVFG

SEQ ID NO: 399209 - protein, 9 aa, Homo Sapiens
EDDCEDVRT

SEQ ID NO: 399210 - protein, 9 aa, Homo Sapiens
KCREEEQLL

SEQ ID NO: 399211 - protein, 9 aa, Homo Sapiens
PVYDPEHCP

SEQ ID NO: 399212 - protein, 9 aa, Homo Sapiens
AFHNQEIQR

SEQ ID NO: 399213 - protein, 9 aa, Homo Sapiens
SYCLSWGTE

SEQ ID NO: 399214 - protein, 9 aa, Homo Sapiens
QALEEEKNK

SEQ ID NO: 399215 - protein, 9 aa, Homo Sapiens
KWCSLTNNF

SEQ ID NO: 399216 - protein, 9 aa, Homo Sapiens
SRQMGISGN

SEQ ID NO: 399217 - protein, 9 aa, Homo Sapiens
AKTVCYALC

SEQ ID NO: 399218 - protein, 9 aa, Homo Sapiens
DRKCREEEQ

SEQ ID NO: 399219 - protein, 9 aa, Homo Sapiens
DLFNKAIDM

SEQ ID NO: 399220 - protein, 9 aa, Homo Sapiens
SVLFNFIRN

SEQ ID NO: 399221 - protein, 9 aa, Homo Sapiens
SPLQTPSLG

SEQ ID NO: 399222 - protein, 9 aa, Homo Sapiens
GFAEAIHLP

SEQ ID NO: 399223 - protein, 9 aa, Homo Sapiens
WRCADARGA

SEQ ID NO: 399224 - protein, 9 aa, Homo Sapiens
PLGVMWKQH

SEQ ID NO: 399225 - protein, 9 aa, Homo Sapiens
VLHTLFLSP

SEQ ID NO: 399226 - protein, 9 aa, Homo Sapiens
KLQDNLCQL

SEQ ID NO: 399227 - protein, 9 aa, Homo Sapiens
PKILVFHLK

SEQ ID NO: 399228 - protein, 9 aa, Homo Sapiens
TGQSYFRST

SEQ ID NO: 399229 - protein, 9 aa, Homo Sapiens
IVHSDNWVV

SEQ ID NO: 399230 - protein, 9 aa, Homo Sapiens
HDHAQGLVL

SEQ ID NO: 399231 - protein, 9 aa, Homo Sapiens
LGSDDPPWS

SEQ ID NO: 399232 - protein, 9 aa, Homo Sapiens
VEKLNNVNI

SEQ ID NO: 399233 - protein, 9 aa, Homo Sapiens
YSPLKNALY

SEQ ID NO: 399234 - protein, 9 aa, Homo Sapiens
SHRDTTTKI

SEQ ID NO: 399235 - protein, 9 aa, Homo Sapiens
LMLAIRSIL

SEQ ID NO: 399236 - protein, 9 aa, Homo Sapiens
PLNFKAPFH

SEQ ID NO: 399237 - protein, 9 aa, Homo Sapiens
FKSSNKSNN

SEQ ID NO: 399238 - protein, 9 aa, Homo Sapiens
GSNYFATDL

SEQ ID NO: 399239 - protein, 9 aa, Homo Sapiens
HPLLLDDSP

SEQ ID NO: 399240 - protein, 9 aa, Homo Sapiens
IIHAKITYR

SEQ ID NO: 399241 - protein, 9 aa, Homo Sapiens
TDSQNDMIE

SEQ ID NO: 399242 - protein, 9 aa, Homo Sapiens
LARMELFIL

SEQ ID NO: 399243 - protein, 9 aa, Homo Sapiens
QQKAKELAQ

SEQ ID NO: 399244 - protein, 9 aa, Homo Sapiens
EQQNVLKVL

SEQ ID NO: 399245 - protein, 9 aa, Homo Sapiens
IFNQFTTFN

SEQ ID NO: 399246 - protein, 9 aa, Homo Sapiens
SSCHGREQG

SEQ ID NO: 399247 - protein, 9 aa, Homo Sapiens
NSYCLSWGT

SEQ ID NO: 399248 - protein, 9 aa, Homo Sapiens
KMWFPEAQN

SEQ ID NO: 399249 - protein, 9 aa, Homo Sapiens
PRTTYQIDN

SEQ ID NO: 399250 - protein, 9 aa, Homo Sapiens
SLQMCKWAI

SEQ ID NO: 399251 - protein, 9 aa, Homo Sapiens
AHYPDAGEN

SEQ ID NO: 399252 - protein, 9 aa, Homo Sapiens
RQQNTKLKV

SEQ ID NO: 399253 - protein, 9 aa, Homo Sapiens
QGKRKILFS

SEQ ID NO: 399254 - protein, 9 aa, Homo Sapiens
EEVGYFIQR

SEQ ID NO: 399255 - protein, 9 aa, Homo Sapiens
RESISSKKK

SEQ ID NO: 399256 - protein, 9 aa, Homo Sapiens
SLPSDILGL

SEQ ID NO: 399257 - protein, 9 aa, Homo Sapiens
FKSTLVKII

SEQ ID NO: 399258 - protein, 9 aa, Homo Sapiens
GQRRGQAGA

SEQ ID NO: 399259 - protein, 9 aa, Homo Sapiens
PYPRKKEIE

SEQ ID NO: 399260 - protein, 9 aa, Homo Sapiens
DFLIVDVYL

SEQ ID NO: 399261 - protein, 9 aa, Homo Sapiens
KTVCYALCS

SEQ ID NO: 399262 - protein, 9 aa, Homo Sapiens
EPHGQQPSL

SEQ ID NO: 399263 - protein, 9 aa, Homo Sapiens
RTWKLQTAS

SEQ ID NO: 399264 - protein, 9 aa, Homo Sapiens
LRGPSQAER

SEQ ID NO: 399265 - protein, 9 aa, Homo Sapiens
EDVFIVVNI

SEQ ID NO: 399266 - protein, 9 aa, Homo Sapiens
SLTTEQSGI

SEQ ID NO: 399267 - protein, 9 aa, Homo Sapiens
STINFHSVV

SEQ ID NO: 399268 - protein, 9 aa, Homo Sapiens
FKTLQNHWK

SEQ ID NO: 399269 - protein, 9 aa, Homo Sapiens
SKNISTHGQ

SEQ ID NO: 399270 - protein, 9 aa, Homo Sapiens
SVFPLSLYS

SEQ ID NO: 399271 - protein, 9 aa, Homo Sapiens
SGVYEKDVE

SEQ ID NO: 399272 - protein, 9 aa, Homo Sapiens
PAVPPGWGM

SEQ ID NO: 399273 - protein, 9 aa, Homo Sapiens
QGTYSCVST

SEQ ID NO: 399274 - protein, 9 aa, Homo Sapiens
LNSFSNEEI

SEQ ID NO: 399275 - protein, 9 aa, Homo Sapiens
LNTLVVKKL

SEQ ID NO: 399276 - protein, 9 aa, Homo Sapiens
DPEDTSQNI

SEQ ID NO: 399277 - protein, 9 aa, Homo Sapiens
FDVIVYVMD

SEQ ID NO: 399278 - protein, 9 aa, Homo Sapiens
LNTLVVKKF

SEQ ID NO: 399279 - protein, 9 aa, Homo Sapiens
RRMRIFRIL

SEQ ID NO: 399280 - protein, 9 aa, Homo Sapiens
ASGPVTMST

SEQ ID NO: 399281 - protein, 9 aa, Homo Sapiens
VMPGGSAAV

SEQ ID NO: 399282 - protein, 9 aa, Homo Sapiens
RFPKILVFH

SEQ ID NO: 399283 - protein, 9 aa, Homo Sapiens
EVQAFKRIE

SEQ ID NO: 399284 - protein, 9 aa, Homo Sapiens
YNISGTGFF

SEQ ID NO: 399285 - protein, 9 aa, Homo Sapiens
GPIDHYQIT

SEQ ID NO: 399286 - protein, 9 aa, Homo Sapiens
SQLHDHAQG

SEQ ID NO: 399287 - protein, 9 aa, Homo Sapiens
KINAKRHDG

SEQ ID NO: 399288 - protein, 9 aa, Homo Sapiens
IQRIRWGPR

SEQ ID NO: 399289 - protein, 9 aa, Homo Sapiens
CQNTTLVEG

SEQ ID NO: 399290 - protein, 9 aa, Homo Sapiens
LLPLAKNEY

SEQ ID NO: 399291 - protein, 9 aa, Homo Sapiens
PKGPNLSNC

SEQ ID NO: 399292 - protein, 9 aa, Homo Sapiens
EWVTVKLDE

SEQ ID NO: 399293 - protein, 9 aa, Homo Sapiens
WSLPSDILG

SEQ ID NO: 399294 - protein, 9 aa, Homo Sapiens
PLQIKSSGP

SEQ ID NO: 399295 - protein, 9 aa, Homo Sapiens
CMENGWFPT

SEQ ID NO: 399296 - protein, 9 aa, Homo Sapiens
RYNMLMSPR

SEQ ID NO: 399297 - protein, 9 aa, Homo Sapiens
VTNTIEDNF

SEQ ID NO: 399298 - protein, 9 aa, Homo Sapiens
RKIIRRDLP

SEQ ID NO: 399299 - protein, 9 aa, Homo Sapiens
LEISAFPSE

SEQ ID NO: 399300 - protein, 9 aa, Homo Sapiens
FVDICQAYF

SEQ ID NO: 399301 - protein, 9 aa, Homo Sapiens
LASLSDVCR

SEQ ID NO: 399302 - protein, 9 aa, Homo Sapiens
HDGTNSPPD

SEQ ID NO: 399303 - protein, 9 aa, Homo Sapiens
KTAVNSASS

SEQ ID NO: 399304 - protein, 9 aa, Homo Sapiens
LEMGCTEYI

SEQ ID NO: 399305 - protein, 9 aa, Homo Sapiens
PVSSIHPEC

SEQ ID NO: 399306 - protein, 9 aa, Homo Sapiens
SGTGFFLHH

SEQ ID NO: 399307 - protein, 9 aa, Homo Sapiens
VIVYVESMD

SEQ ID NO: 399308 - protein, 9 aa, Homo Sapiens
KGRREHKDK

SEQ ID NO: 399309 - protein, 9 aa, Homo Sapiens
SRSTDNLSC

SEQ ID NO: 399310 - protein, 9 aa, Homo Sapiens
VYGITPENE

SEQ ID NO: 399311 - protein, 9 aa, Homo Sapiens
IKLFFKIKP

SEQ ID NO: 399312 - protein, 9 aa, Homo Sapiens
QLTHTGEKP

SEQ ID NO: 399313 - protein, 9 aa, Homo Sapiens
VSSPLKLHQ

SEQ ID NO: 399314 - protein, 9 aa, Homo Sapiens
SKEEVGYFI

SEQ ID NO: 399315 - protein, 9 aa, Homo Sapiens
CCYYFAVKT

SEQ ID NO: 399316 - protein, 9 aa, Homo Sapiens
ELFILLCAI

SEQ ID NO: 399317 - protein, 9 aa, Homo Sapiens
MHNIPLHTV

SEQ ID NO: 399318 - protein, 9 aa, Homo Sapiens
EAKMTFMRF

SEQ ID NO: 399319 - protein, 9 aa, Homo Sapiens
KNISTHGQN

SEQ ID NO: 399320 - protein, 9 aa, Homo Sapiens
VDPNNLDTT

SEQ ID NO: 399321 - protein, 9 aa, Homo Sapiens
AIDMNINKM

SEQ ID NO: 399322 - protein, 9 aa, Homo Sapiens
GLPGYPITC

SEQ ID NO: 399323 - protein, 9 aa, Homo Sapiens
LLDSTQMLK

SEQ ID NO: 399324 - protein, 9 aa, Homo Sapiens
RNQKKDKPD

SEQ ID NO: 399325 - protein, 9 aa, Homo Sapiens
QIKSSGPPS

SEQ ID NO: 399326 - protein, 9 aa, Homo Sapiens
LEENDSKKL

SEQ ID NO: 399327 - protein, 9 aa, Homo Sapiens
RHFKLEKHS

SEQ ID NO: 399328 - protein, 9 aa, Homo Sapiens
DPAKQISGK

SEQ ID NO: 399329 - protein, 9 aa, Homo Sapiens
ELRFNGAKV

SEQ ID NO: 399330 - protein, 9 aa, Homo Sapiens
NKCSIILTS

SEQ ID NO: 399331 - protein, 9 aa, Homo Sapiens
VVFILLSSV

SEQ ID NO: 399332 - protein, 9 aa, Homo Sapiens
SDKRLWVLA

SEQ ID NO: 399333 - protein, 9 aa, Homo Sapiens
KVDWGNFFL

SEQ ID NO: 399334 - protein, 9 aa, Homo Sapiens
LEAIGSLVK

SEQ ID NO: 399335 - protein, 9 aa, Homo Sapiens
DNDKYITLD

SEQ ID NO: 399336 - protein, 9 aa, Homo Sapiens
VLRRMRIFR

SEQ ID NO: 399337 - protein, 9 aa, Homo Sapiens
KLSQILDVA

SEQ ID NO: 399338 - protein, 9 aa, Homo Sapiens
YYENSTPPY

SEQ ID NO: 399339 - protein, 9 aa, Homo Sapiens
EESRFPQST

SEQ ID NO: 399340 - protein, 9 aa, Homo Sapiens
FVEKLNNVN

SEQ ID NO: 399341 - protein, 9 aa, Homo Sapiens
YQASAQGIQ

SEQ ID NO: 399342 - protein, 9 aa, Homo Sapiens
FLQLMIDSH

SEQ ID NO: 399343 - protein, 9 aa, Homo Sapiens
KLYPNAQRA

SEQ ID NO: 399344 - protein, 9 aa, Homo Sapiens
LLNALKTVM

SEQ ID NO: 399345 - protein, 9 aa, Homo Sapiens
AMKYHILPE

SEQ ID NO: 399346 - protein, 9 aa, Homo Sapiens
KKPPADARA

SEQ ID NO: 399347 - protein, 9 aa, Homo Sapiens
TLVTQKVRP

SEQ ID NO: 399348 - protein, 9 aa, Homo Sapiens
KHFQYQQLE

SEQ ID NO: 399349 - protein, 9 aa, Homo Sapiens
GRYAHWVVS

SEQ ID NO: 399350 - protein, 9 aa, Homo Sapiens
MRASGPVTM

SEQ ID NO: 399351 - protein, 9 aa, Homo Sapiens
SLENEIVVL

SEQ ID NO: 399352 - protein, 9 aa, Homo Sapiens
ENEIVVLKK

SEQ ID NO: 399353 - protein, 9 aa, Homo Sapiens
KDKGDSKDS

SEQ ID NO: 399354 - protein, 9 aa, Homo Sapiens
KNKQARCQG

SEQ ID NO: 399355 - protein, 9 aa, Homo Sapiens
PGRKFKQYL

SEQ ID NO: 399356 - protein, 9 aa, Homo Sapiens
NHTDKFLIQ

SEQ ID NO: 399357 - protein, 9 aa, Homo Sapiens
PAINLARVL

SEQ ID NO: 399358 - protein, 9 aa, Homo Sapiens
YFLLPEEST

SEQ ID NO: 399359 - protein, 9 aa, Homo Sapiens
DTSQDISFL

SEQ ID NO: 399360 - protein, 9 aa, Homo Sapiens
LYPEDKLDC

SEQ ID NO: 399361 - protein, 9 aa, Homo Sapiens
GRARTPISN

SEQ ID NO: 399362 - protein, 9 aa, Homo Sapiens
LAAPSGQRR

SEQ ID NO: 399363 - protein, 9 aa, Homo Sapiens
LHPFKYLVQ

SEQ ID NO: 399364 - protein, 9 aa, Homo Sapiens
WINDLISAT

SEQ ID NO: 399365 - protein, 9 aa, Homo Sapiens
EQNCEERNH

SEQ ID NO: 399366 - protein, 9 aa, Homo Sapiens
CTVLHTLFL

SEQ ID NO: 399367 - protein, 9 aa, Homo Sapiens
NIYVKNYFR

SEQ ID NO: 399368 - protein, 9 aa, Homo Sapiens
FFDVIVYVM

SEQ ID NO: 399369 - protein, 9 aa, Homo Sapiens
DARKKQFWY

SEQ ID NO: 399370 - protein, 9 aa, Homo Sapiens
LFRMVISNP

SEQ ID NO: 399371 - protein, 9 aa, Homo Sapiens
TILEPVLIT

SEQ ID NO: 399372 - protein, 9 aa, Homo Sapiens
TDSTLVPLL

SEQ ID NO: 399373 - protein, 9 aa, Homo Sapiens
IKALLRTKY

SEQ ID NO: 399374 - protein, 9 aa, Homo Sapiens
DRNQKKDKP

SEQ ID NO: 399375 - protein, 9 aa, Homo Sapiens
GKIEVTIQF

SEQ ID NO: 399376 - protein, 9 aa, Homo Sapiens
YDPAKQISG

SEQ ID NO: 399377 - protein, 9 aa, Homo Sapiens
IIHFLENPF

SEQ ID NO: 399378 - protein, 9 aa, Homo Sapiens
QLLSQTFRG

SEQ ID NO: 399379 - protein, 9 aa, Homo Sapiens
SDKKYSVSN

SEQ ID NO: 399380 - protein, 9 aa, Homo Sapiens
KDKRLKKDA

SEQ ID NO: 399381 - protein, 9 aa, Homo Sapiens
FAHIQLKPT

SEQ ID NO: 399382 - protein, 9 aa, Homo Sapiens
TTAALEKDH

SEQ ID NO: 399383 - protein, 9 aa, Homo Sapiens
ASGSISKKD

SEQ ID NO: 399384 - protein, 9 aa, Homo Sapiens
KEIEKCLDP

SEQ ID NO: 399385 - protein, 9 aa, Homo Sapiens
HQALEEEKN

SEQ ID NO: 399386 - protein, 9 aa, Homo Sapiens
TDELYHHMT

SEQ ID NO: 399387 - protein, 9 aa, Homo Sapiens
LYKILGLHK

SEQ ID NO: 399388 - protein, 9 aa, Homo Sapiens
VQAFKRIED

SEQ ID NO: 399389 - protein, 9 aa, Homo Sapiens
QKAQFLVAF

SEQ ID NO: 399390 - protein, 9 aa, Homo Sapiens
LDVLKPLEH

SEQ ID NO: 399391 - protein, 9 aa, Homo Sapiens
LLNQYILMA

SEQ ID NO: 399392 - protein, 9 aa, Homo Sapiens
GFSSRLGEF

SEQ ID NO: 399393 - protein, 9 aa, Homo Sapiens
LTAETDCQY

SEQ ID NO: 399394 - protein, 9 aa, Homo Sapiens
VCTLTCMQY

SEQ ID NO: 399395 - protein, 9 aa, Homo Sapiens
DIVREKAKQ

SEQ ID NO: 399396 - protein, 9 aa, Homo Sapiens
KEYLDLRKE

SEQ ID NO: 399397 - protein, 9 aa, Homo Sapiens
LEVCLQSNC

SEQ ID NO: 399398 - protein, 9 aa, Homo Sapiens
FASDNFLGI

SEQ ID NO: 399399 - protein, 9 aa, Homo Sapiens
TCWLLAPVS

SEQ ID NO: 399400 - protein, 9 aa, Homo Sapiens
QNTELIQLL

SEQ ID NO: 399401 - protein, 9 aa, Homo Sapiens
DYCHKNNFL

SEQ ID NO: 399402 - protein, 9 aa, Homo Sapiens
EAMKYHILP

SEQ ID NO: 399403 - protein, 9 aa, Homo Sapiens
NQKKDKPDS

SEQ ID NO: 399404 - protein, 9 aa, Homo Sapiens
FSGFGLINS

SEQ ID NO: 399405 - protein, 9 aa, Homo Sapiens
KLNNIISEI

SEQ ID NO: 399406 - protein, 9 aa, Homo Sapiens
LIQFPWFFS

SEQ ID NO: 399407 - protein, 9 aa, Homo Sapiens
YDCDDEIGV

SEQ ID NO: 399408 - protein, 9 aa, Homo Sapiens
CIATALRSG

SEQ ID NO: 399409 - protein, 9 aa, Homo Sapiens
VARRGKNIF

SEQ ID NO: 399410 - protein, 9 aa, Homo Sapiens
QSRNVHNIL

SEQ ID NO: 399411 - protein, 9 aa, Homo Sapiens
VSLINYPYK

SEQ ID NO: 399412 - protein, 9 aa, Homo Sapiens
SSLEKLNLG

SEQ ID NO: 399413 - protein, 9 aa, Homo Sapiens
ICYGSGIFN

SEQ ID NO: 399414 - protein, 9 aa, Homo Sapiens
NISGTGFFL

SEQ ID NO: 399415 - protein, 9 aa, Homo Sapiens
WARVQAERT

SEQ ID NO: 399416 - protein, 9 aa, Homo Sapiens
QYRDVHHLV

SEQ ID NO: 399417 - protein, 9 aa, Homo Sapiens
LWCRNEKKR

SEQ ID NO: 399418 - protein, 9 aa, Homo Sapiens
MWHSEFPKP

SEQ ID NO: 399419 - protein, 9 aa, Homo Sapiens
EDYQKCHRT

SEQ ID NO: 399420 - protein, 9 aa, Homo Sapiens
ETGVLKPGT

SEQ ID NO: 399421 - protein, 9 aa, Homo Sapiens
MEITIINDT

SEQ ID NO: 399422 - protein, 9 aa, Homo Sapiens
YPNAQRAHL

SEQ ID NO: 399423 - protein, 9 aa, Homo Sapiens
VLKRDFRNK

SEQ ID NO: 399424 - protein, 9 aa, Homo Sapiens
FSNEEINGN

SEQ ID NO: 399425 - protein, 9 aa, Homo Sapiens
IKKSIKGVS

SEQ ID NO: 399426 - protein, 9 aa, Homo Sapiens
RKVTSISNK

SEQ ID NO: 399427 - protein, 9 aa, Homo Sapiens
TALIEKNKQ

SEQ ID NO: 399428 - protein, 9 aa, Homo Sapiens
NKRRLPRGF

SEQ ID NO: 399429 - protein, 9 aa, Homo Sapiens
SLHNKEVTR

SEQ ID NO: 399430 - protein, 9 aa, Homo Sapiens
QIHEITHTG

SEQ ID NO: 399431 - protein, 9 aa, Homo Sapiens
CSTVPTCVL

SEQ ID NO: 399432 - protein, 9 aa, Homo Sapiens
NWSSRLTQH

SEQ ID NO: 399433 - protein, 9 aa, Homo Sapiens
PLTLEPTPG

SEQ ID NO: 399434 - protein, 9 aa, Homo Sapiens
QMNKRKRHK

SEQ ID NO: 399435 - protein, 9 aa, Homo Sapiens
WEKECGVTA

SEQ ID NO: 399436 - protein, 9 aa, Homo Sapiens
EFYSLQEQH

SEQ ID NO: 399437 - protein, 9 aa, Homo Sapiens
PLSLYSLNI

SEQ ID NO: 399438 - protein, 9 aa, Homo Sapiens
AIDKWVAVA

SEQ ID NO: 399439 - protein, 9 aa, Homo Sapiens
LEFYCKTKE

SEQ ID NO: 399440 - protein, 9 aa, Homo Sapiens
EYFMKQIND

SEQ ID NO: 399441 - protein, 9 aa, Homo Sapiens
LYHHMTENR

SEQ ID NO: 399442 - protein, 9 aa, Homo Sapiens
LEALGLFTS

SEQ ID NO: 399443 - protein, 9 aa, Homo Sapiens
LARAFVHKS

SEQ ID NO: 399444 - protein, 9 aa, Homo Sapiens
SGSISKKDI

SEQ ID NO: 399445 - protein, 9 aa, Homo Sapiens
RQLGENLSG

SEQ ID NO: 399446 - protein, 9 aa, Homo Sapiens
RIHAVDKPF

SEQ ID NO: 399447 - protein, 9 aa, Homo Sapiens
SIHRRVNTG

SEQ ID NO: 399448 - protein, 9 aa, Homo Sapiens
WNLYWRASS

SEQ ID NO: 399449 - protein, 9 aa, Homo Sapiens
SMGTLDNTF

SEQ ID NO: 399450 - protein, 9 aa, Homo Sapiens
KVKKIIQLS

SEQ ID NO: 399451 - protein, 9 aa, Homo Sapiens
GEKGFKDKL

SEQ ID NO: 399452 - protein, 9 aa, Homo Sapiens
VCQVLFCLN

SEQ ID NO: 399453 - protein, 9 aa, Homo Sapiens
VSELQYFEE

SEQ ID NO: 399454 - protein, 9 aa, Homo Sapiens
DEMDISSKL

SEQ ID NO: 399455 - protein, 9 aa, Homo Sapiens
WNVETNTYT

SEQ ID NO: 399456 - protein, 9 aa, Homo Sapiens
PLNNLSVAQ

SEQ ID NO: 399457 - protein, 9 aa, Homo Sapiens
LLCNYTQNI

SEQ ID NO: 399458 - protein, 9 aa, Homo Sapiens
VKQIGYMIR

SEQ ID NO: 399459 - protein, 9 aa, Homo Sapiens
GKEDYDNFT

SEQ ID NO: 399460 - protein, 9 aa, Homo Sapiens
DNELEYDNF

SEQ ID NO: 399461 - protein, 9 aa, Homo Sapiens
YLYTLDKVC

SEQ ID NO: 399462 - protein, 9 aa, Homo Sapiens
HQITHTRIL

SEQ ID NO: 399463 - protein, 9 aa, Homo Sapiens
IETSTKTRQ

SEQ ID NO: 399464 - protein, 9 aa, Homo Sapiens
GLNNVFDEA

SEQ ID NO: 399465 - protein, 9 aa, Homo Sapiens
VLKIYLEVD

SEQ ID NO: 399466 - protein, 9 aa, Homo Sapiens
NLGDCDLGM

SEQ ID NO: 399467 - protein, 9 aa, Homo Sapiens
SDQGWEYII

SEQ ID NO: 399468 - protein, 9 aa, Homo Sapiens
DSQNDMIEI

SEQ ID NO: 399469 - protein, 9 aa, Homo Sapiens
YQPFKIISY

SEQ ID NO: 399470 - protein, 9 aa, Homo Sapiens
GDKVNLFRM

SEQ ID NO: 399471 - protein, 9 aa, Homo Sapiens
IEWMAGGLV

SEQ ID NO: 399472 - protein, 9 aa, Homo Sapiens
FNQNIRTWI

SEQ ID NO: 399473 - protein, 9 aa, Homo Sapiens
RAKDKRLKK

SEQ ID NO: 399474 - protein, 9 aa, Homo Sapiens
SCKGGWKCK

SEQ ID NO: 399475 - protein, 9 aa, Homo Sapiens
SNVMRYIHG

SEQ ID NO: 399476 - protein, 9 aa, Homo Sapiens
SVSKAAAVM

SEQ ID NO: 399477 - protein, 9 aa, Homo Sapiens
CHTALVLFA

SEQ ID NO: 399478 - protein, 9 aa, Homo Sapiens
SVQRLAILK

SEQ ID NO: 399479 - protein, 9 aa, Homo Sapiens
NFYHQQQQQ

SEQ ID NO: 399480 - protein, 9 aa, Homo Sapiens
KYVYSVLYD

SEQ ID NO: 399481 - protein, 9 aa, Homo Sapiens
TNTYTVLIE

SEQ ID NO: 399482 - protein, 9 aa, Homo Sapiens
RTAHLVIHT

SEQ ID NO: 399483 - protein, 9 aa, Homo Sapiens
FKVRLFVLT

SEQ ID NO: 399484 - protein, 9 aa, Homo Sapiens
LREAVDGVC

SEQ ID NO: 399485 - protein, 9 aa, Homo Sapiens
FGIIGINRT

SEQ ID NO: 399486 - protein, 9 aa, Homo Sapiens
TKHWAAMHV

SEQ ID NO: 399487 - protein, 9 aa, Homo Sapiens
STKTRQRVE

SEQ ID NO: 399488 - protein, 9 aa, Homo Sapiens
TKQKGAQLH

SEQ ID NO: 399489 - protein, 9 aa, Homo Sapiens
PAVLGSPDQ

SEQ ID NO: 399490 - protein, 9 aa, Homo Sapiens
EDWNLYWRA

SEQ ID NO: 399491 - protein, 9 aa, Homo Sapiens
CAILNRMCL

SEQ ID NO: 399492 - protein, 9 aa, Homo Sapiens
HQRIHAVDK

SEQ ID NO: 399493 - protein, 9 aa, Homo Sapiens
SGAINFDNI

SEQ ID NO: 399494 - protein, 9 aa, Homo Sapiens
VVKKLDVEA

SEQ ID NO: 399495 - protein, 9 aa, Homo Sapiens
GLLLHPFKY

SEQ ID NO: 399496 - protein, 9 aa, Homo Sapiens
KNTVKISKI

SEQ ID NO: 399497 - protein, 9 aa, Homo Sapiens
ALLLQDLFI

SEQ ID NO: 399498 - protein, 9 aa, Homo Sapiens
LEELDKAFN

SEQ ID NO: 399499 - protein, 9 aa, Homo Sapiens
SLGGRTVEV

SEQ ID NO: 399500 - protein, 9 aa, Homo Sapiens
KQYECKQCG

SEQ ID NO: 399501 - protein, 9 aa, Homo Sapiens
VMWHSEFPK

SEQ ID NO: 399502 - protein, 9 aa, Homo Sapiens
GPCTVMPGG

SEQ ID NO: 399503 - protein, 9 aa, Homo Sapiens
CILRKNPTS

SEQ ID NO: 399504 - protein, 9 aa, Homo Sapiens
CFIADHMRS

SEQ ID NO: 399505 - protein, 9 aa, Homo Sapiens
TMFNPCGYL

SEQ ID NO: 399506 - protein, 9 aa, Homo Sapiens
YPALSLSSL

SEQ ID NO: 399507 - protein, 9 aa, Homo Sapiens
DGSDENNCV

SEQ ID NO: 399508 - protein, 9 aa, Homo Sapiens
TFMRFQMNE

SEQ ID NO: 399509 - protein, 9 aa, Homo Sapiens
TALVLFAHE

SEQ ID NO: 399510 - protein, 9 aa, Homo Sapiens
QPIIQTAMS

SEQ ID NO: 399511 - protein, 9 aa, Homo Sapiens
DHAQGLVLT

SEQ ID NO: 399512 - protein, 9 aa, Homo Sapiens
MEVREGESC

SEQ ID NO: 399513 - protein, 9 aa, Homo Sapiens
EMEVEGPEN

SEQ ID NO: 399514 - protein, 9 aa, Homo Sapiens
LGQFSSSPI

SEQ ID NO: 399515 - protein, 9 aa, Homo Sapiens
STLMEITII

SEQ ID NO: 399516 - protein, 9 aa, Homo Sapiens
RADIGFAYH

SEQ ID NO: 399517 - protein, 9 aa, Homo Sapiens
SCVSTHSSH

SEQ ID NO: 399518 - protein, 9 aa, Homo Sapiens
HTELMQTLG

SEQ ID NO: 399519 - protein, 9 aa, Homo Sapiens
RPDRQTVMI

SEQ ID NO: 399520 - protein, 9 aa, Homo Sapiens
LHPSLEEEN

SEQ ID NO: 399521 - protein, 9 aa, Homo Sapiens
VTLEKQDDL

SEQ ID NO: 399522 - protein, 9 aa, Homo Sapiens
HASSACLCP

SEQ ID NO: 399523 - protein, 9 aa, Homo Sapiens
AVHLICDPE

SEQ ID NO: 399524 - protein, 9 aa, Homo Sapiens
KMPKDKGDS

SEQ ID NO: 399525 - protein, 9 aa, Homo Sapiens
EKCLDPDMY

SEQ ID NO: 399526 - protein, 9 aa, Homo Sapiens
ILVFYVHIL

SEQ ID NO: 399527 - protein, 9 aa, Homo Sapiens
EGVLQHLYN

SEQ ID NO: 399528 - protein, 9 aa, Homo Sapiens
AEIAQENVQ

SEQ ID NO: 399529 - protein, 9 aa, Homo Sapiens
ANLTNQRKY

SEQ ID NO: 399530 - protein, 9 aa, Homo Sapiens
QRIRWGPRL

SEQ ID NO: 399531 - protein, 9 aa, Homo Sapiens
MPHYPYSSL

SEQ ID NO: 399532 - protein, 9 aa, Homo Sapiens
HHNKYGSNV

SEQ ID NO: 399533 - protein, 9 aa, Homo Sapiens
VAVADSIPK

SEQ ID NO: 399534 - protein, 9 aa, Homo Sapiens
LYDTIQNER

SEQ ID NO: 399535 - protein, 9 aa, Homo Sapiens
ISDKELKLL

SEQ ID NO: 399536 - protein, 9 aa, Homo Sapiens
NALGGRESY

SEQ ID NO: 399537 - protein, 9 aa, Homo Sapiens
YCESPKPKP

SEQ ID NO: 399538 - protein, 9 aa, Homo Sapiens
NTLFLFIAG

SEQ ID NO: 399539 - protein, 9 aa, Homo Sapiens
IIINNNNFH

SEQ ID NO: 399540 - protein, 9 aa, Homo Sapiens
DIYEDRHNG

SEQ ID NO: 399541 - protein, 9 aa, Homo Sapiens
KKTFQLIWE

SEQ ID NO: 399542 - protein, 9 aa, Homo Sapiens
WLVTPKKLR

SEQ ID NO: 399543 - protein, 9 aa, Homo Sapiens
EELIQNYDG

SEQ ID NO: 399544 - protein, 9 aa, Homo Sapiens
LQYFEEEGE

SEQ ID NO: 399545 - protein, 9 aa, Homo Sapiens
QCRIQVGKI

SEQ ID NO: 399546 - protein, 9 aa, Homo Sapiens
VDVYLVTLV

SEQ ID NO: 399547 - protein, 9 aa, Homo Sapiens
ILPEGSLII

SEQ ID NO: 399548 - protein, 9 aa, Homo Sapiens
ASEDISKTF

SEQ ID NO: 399549 - protein, 9 aa, Homo Sapiens
SFATGNCLE

SEQ ID NO: 399550 - protein, 9 aa, Homo Sapiens
GLWLSGLGG

SEQ ID NO: 399551 - protein, 9 aa, Homo Sapiens
EHKKKCKGN

SEQ ID NO: 399552 - protein, 9 aa, Homo Sapiens
ADNFLQQFF

SEQ ID NO: 399553 - protein, 9 aa, Homo Sapiens
VTIQDSQTF

SEQ ID NO: 399554 - protein, 9 aa, Homo Sapiens
TRTKDVDKE

SEQ ID NO: 399555 - protein, 9 aa, Homo Sapiens
QHKIIHTRE

SEQ ID NO: 399556 - protein, 9 aa, Homo Sapiens
WNIKIRLLA

SEQ ID NO: 399557 - protein, 9 aa, Homo Sapiens
SEVPKKLVP

SEQ ID NO: 399558 - protein, 9 aa, Homo Sapiens
LEKDHEAIT

SEQ ID NO: 399559 - protein, 9 aa, Homo Sapiens
VKGLNFPSP

SEQ ID NO: 399560 - protein, 9 aa, Homo Sapiens
ALSVERKHY

SEQ ID NO: 399561 - protein, 9 aa, Homo Sapiens
CKFSLDELQ

SEQ ID NO: 399562 - protein, 9 aa, Homo Sapiens
LFLSPAGII

SEQ ID NO: 399563 - protein, 9 aa, Homo Sapiens
GSSRKSNKR

SEQ ID NO: 399564 - protein, 9 aa, Homo Sapiens
MLLKNKQAR

SEQ ID NO: 399565 - protein, 9 aa, Homo Sapiens
QHSRFILGS

SEQ ID NO: 399566 - protein, 9 aa, Homo Sapiens
ELYRQWTNR

SEQ ID NO: 399567 - protein, 9 aa, Homo Sapiens
TVPTCVLSI

SEQ ID NO: 399568 - protein, 9 aa, Homo Sapiens
EIGVVSDYR

SEQ ID NO: 399569 - protein, 9 aa, Homo Sapiens
HVVSVHKSG

SEQ ID NO: 399570 - protein, 9 aa, Homo Sapiens
SSMMEKYEQ

SEQ ID NO: 399571 - protein, 9 aa, Homo Sapiens
FADANKAES

SEQ ID NO: 399572 - protein, 9 aa, Homo Sapiens
SILKEFNYY

SEQ ID NO: 399573 - protein, 9 aa, Homo Sapiens
LTREAMQNY

SEQ ID NO: 399574 - protein, 9 aa, Homo Sapiens
EKKDLRSVL

SEQ ID NO: 399575 - protein, 9 aa, Homo Sapiens
EHPDLPPVQ

SEQ ID NO: 399576 - protein, 9 aa, Homo Sapiens
KPLEHKKII

SEQ ID NO: 399577 - protein, 9 aa, Homo Sapiens
INDTFSDSP

SEQ ID NO: 399578 - protein, 9 aa, Homo Sapiens
PNVTDTEYS

SEQ ID NO: 399579 - protein, 9 aa, Homo Sapiens
LVKIILQLH

SEQ ID NO: 399580 - protein, 9 aa, Homo Sapiens
CYYYFTIGW

SEQ ID NO: 399581 - protein, 9 aa, Homo Sapiens
QLIVEIIQC

SEQ ID NO: 399582 - protein, 9 aa, Homo Sapiens
SCLSSWANS

SEQ ID NO: 399583 - protein, 9 aa, Homo Sapiens
WFPEAQNIY

SEQ ID NO: 399584 - protein, 9 aa, Homo Sapiens
KGTQPTCHN

SEQ ID NO: 399585 - protein, 9 aa, Homo Sapiens
QKELSVSVQ

SEQ ID NO: 399586 - protein, 9 aa, Homo Sapiens
RISMADVKL

SEQ ID NO: 399587 - protein, 9 aa, Homo Sapiens
ANTPGKGGH

SEQ ID NO: 399588 - protein, 9 aa, Homo Sapiens
PSPLQEGEE

SEQ ID NO: 399589 - protein, 9 aa, Homo Sapiens
INQYTPEMI

SEQ ID NO: 399590 - protein, 9 aa, Homo Sapiens
GRNTNGSPF

SEQ ID NO: 399591 - protein, 9 aa, Homo Sapiens
SNITMVEKS

SEQ ID NO: 399592 - protein, 9 aa, Homo Sapiens
TGLNPHNFA

SEQ ID NO: 399593 - protein, 9 aa, Homo Sapiens
ISAVMVTGD

SEQ ID NO: 399594 - protein, 9 aa, Homo Sapiens
VHGTIQTEK

SEQ ID NO: 399595 - protein, 9 aa, Homo Sapiens
RDLYLDNPE

SEQ ID NO: 399596 - protein, 9 aa, Homo Sapiens
DNWVCLAYF

SEQ ID NO: 399597 - protein, 9 aa, Homo Sapiens
HWEYYKQPI

SEQ ID NO: 399598 - protein, 9 aa, Homo Sapiens
NMSMAFSNL

SEQ ID NO: 399599 - protein, 9 aa, Homo Sapiens
EVVKLLVLH

SEQ ID NO: 399600 - protein, 9 aa, Homo Sapiens
HNPDSVAEV

SEQ ID NO: 399601 - protein, 9 aa, Homo Sapiens
HLDYASIFF

SEQ ID NO: 399602 - protein, 9 aa, Homo Sapiens
KPPADARAL

SEQ ID NO: 399603 - protein, 9 aa, Homo Sapiens
TIINDTFSD

SEQ ID NO: 399604 - protein, 9 aa, Homo Sapiens
WKEVNKHIS

SEQ ID NO: 399605 - protein, 9 aa, Homo Sapiens
AVDADLGHN

SEQ ID NO: 399606 - protein, 9 aa, Homo Sapiens
SAGAGTGAQ

SEQ ID NO: 399607 - protein, 9 aa, Homo Sapiens
EIFILAVMA

SEQ ID NO: 399608 - protein, 9 aa, Homo Sapiens
QVILEKQIC

SEQ ID NO: 399609 - protein, 9 aa, Homo Sapiens
SDELSKAYG

SEQ ID NO: 399610 - protein, 9 aa, Homo Sapiens
CGAWSKSET

SEQ ID NO: 399611 - protein, 9 aa, Homo Sapiens
IKKSLELSN

SEQ ID NO: 399612 - protein, 9 aa, Homo Sapiens
LCEGMESPY

SEQ ID NO: 399613 - protein, 9 aa, Homo Sapiens
PETPAAKVS

SEQ ID NO: 399614 - protein, 9 aa, Homo Sapiens
TQIPQKQDK

SEQ ID NO: 399615 - protein, 9 aa, Homo Sapiens
RPYILKIDS

SEQ ID NO: 399616 - protein, 9 aa, Homo Sapiens
RQNRLYDAK

SEQ ID NO: 399617 - protein, 9 aa, Homo Sapiens
FPFRHDLDY

SEQ ID NO: 399618 - protein, 9 aa, Homo Sapiens
RAPQSGIEG

SEQ ID NO: 399619 - protein, 9 aa, Homo Sapiens
DIPATECEF

SEQ ID NO: 399620 - protein, 9 aa, Homo Sapiens
QLRFISYFS

SEQ ID NO: 399621 - protein, 9 aa, Homo Sapiens
NTEDNRRQF

SEQ ID NO: 399622 - protein, 9 aa, Homo Sapiens
KNNFLHRDI

SEQ ID NO: 399623 - protein, 9 aa, Homo Sapiens
MLIYDPAKQ

SEQ ID NO: 399624 - protein, 9 aa, Homo Sapiens
NNSPVLYER

SEQ ID NO: 399625 - protein, 9 aa, Homo Sapiens
ELAVKGLNF

SEQ ID NO: 399626 - protein, 9 aa, Homo Sapiens
DGCLNKSAR

SEQ ID NO: 399627 - protein, 9 aa, Homo Sapiens
IKHFQKYHL

SEQ ID NO: 399628 - protein, 9 aa, Homo Sapiens
KEKDLFKFI

SEQ ID NO: 399629 - protein, 9 aa, Homo Sapiens
DTDECHCIA

SEQ ID NO: 399630 - protein, 9 aa, Homo Sapiens
SSGSSRLQW

SEQ ID NO: 399631 - protein, 9 aa, Homo Sapiens
SYDLHHKDS

SEQ ID NO: 399632 - protein, 9 aa, Homo Sapiens
QLQLDELSR

SEQ ID NO: 399633 - protein, 9 aa, Homo Sapiens
SALQLPHLG

SEQ ID NO: 399634 - protein, 9 aa, Homo Sapiens
FINYCESPK

SEQ ID NO: 399635 - protein, 9 aa, Homo Sapiens
AAPHPMLKQ

SEQ ID NO: 399636 - protein, 9 aa, Homo Sapiens
AERSYKSHI

SEQ ID NO: 399637 - protein, 9 aa, Homo Sapiens
KAEAEEPEA

SEQ ID NO: 399638 - protein, 9 aa, Homo Sapiens
SASEACVPE

SEQ ID NO: 399639 - protein, 9 aa, Homo Sapiens
LEPHGQQPS

SEQ ID NO: 399640 - protein, 9 aa, Homo Sapiens
ELNMIATDP

SEQ ID NO: 399641 - protein, 9 aa, Homo Sapiens
FWINRRTIG

SEQ ID NO: 399642 - protein, 9 aa, Homo Sapiens
LFKFIEELK

SEQ ID NO: 399643 - protein, 9 aa, Homo Sapiens
EELNNCIRK

SEQ ID NO: 399644 - protein, 9 aa, Homo Sapiens
LSNHQIIHT

SEQ ID NO: 399645 - protein, 9 aa, Homo Sapiens
AQEHVFNVI

SEQ ID NO: 399646 - protein, 9 aa, Homo Sapiens
RGAKTVCYA

SEQ ID NO: 399647 - protein, 9 aa, Homo Sapiens
TYQIDNFAQ

SEQ ID NO: 399648 - protein, 9 aa, Homo Sapiens
AQIEEFKKE

SEQ ID NO: 399649 - protein, 9 aa, Homo Sapiens
FLSLGLQDK

SEQ ID NO: 399650 - protein, 9 aa, Homo Sapiens
FTLWKAAKP

SEQ ID NO: 399651 - protein, 9 aa, Homo Sapiens
LLVQNIGNK

SEQ ID NO: 399652 - protein, 9 aa, Homo Sapiens
GTDPVSLIN

SEQ ID NO: 399653 - protein, 9 aa, Homo Sapiens
INYPYKICD

SEQ ID NO: 399654 - protein, 9 aa, Homo Sapiens
ILGSTEFFL

SEQ ID NO: 399655 - protein, 9 aa, Homo Sapiens
MFVEKLNNV

SEQ ID NO: 399656 - protein, 9 aa, Homo Sapiens
TSTKTRQRV

SEQ ID NO: 399657 - protein, 9 aa, Homo Sapiens
AKSICCCLH

SEQ ID NO: 399658 - protein, 9 aa, Homo Sapiens
DTYSEVDDK

SEQ ID NO: 399659 - protein, 9 aa, Homo Sapiens
KNNQRAVRE

SEQ ID NO: 399660 - protein, 9 aa, Homo Sapiens
PQPEGQCQI

SEQ ID NO: 399661 - protein, 9 aa, Homo Sapiens
DQTECVICM

SEQ ID NO: 399662 - protein, 9 aa, Homo Sapiens
YECVHLYVQ

SEQ ID NO: 399663 - protein, 9 aa, Homo Sapiens
YWRASSFRM

SEQ ID NO: 399664 - protein, 9 aa, Homo Sapiens
KFSVSGDED

SEQ ID NO: 399665 - protein, 9 aa, Homo Sapiens
EVNKTVDKG

SEQ ID NO: 399666 - protein, 9 aa, Homo Sapiens
LQDLFIVLI

SEQ ID NO: 399667 - protein, 9 aa, Homo Sapiens
FGSQENKDL

SEQ ID NO: 399668 - protein, 9 aa, Homo Sapiens
ERNHDLPAT

SEQ ID NO: 399669 - protein, 9 aa, Homo Sapiens
GDAASGSIS

SEQ ID NO: 399670 - protein, 9 aa, Homo Sapiens
YRQFVKQIG

SEQ ID NO: 399671 - protein, 9 aa, Homo Sapiens
IAATWRVYL

SEQ ID NO: 399672 - protein, 9 aa, Homo Sapiens
VSSTPPVCC

SEQ ID NO: 399673 - protein, 9 aa, Homo Sapiens
KSTSVLSGG

SEQ ID NO: 399674 - protein, 9 aa, Homo Sapiens
MLIIEKVLK

SEQ ID NO: 399675 - protein, 9 aa, Homo Sapiens
RENGIHLPG

SEQ ID NO: 399676 - protein, 9 aa, Homo Sapiens
IVCIATKKH

SEQ ID NO: 399677 - protein, 9 aa, Homo Sapiens
VPTCVLSIT

SEQ ID NO: 399678 - protein, 9 aa, Homo Sapiens
LELRFNGAK

SEQ ID NO: 399679 - protein, 9 aa, Homo Sapiens
EEAIIGGEE

SEQ ID NO: 399680 - protein, 9 aa, Homo Sapiens
ANLTKHQIT

SEQ ID NO: 399681 - protein, 9 aa, Homo Sapiens
AAVTLEKQD

SEQ ID NO: 399682 - protein, 9 aa, Homo Sapiens
ANVANDAML

SEQ ID NO: 399683 - protein, 9 aa, Homo Sapiens
INKPLNAFM

SEQ ID NO: 399684 - protein, 9 aa, Homo Sapiens
NSHPQHSDK

SEQ ID NO: 399685 - protein, 9 aa, Homo Sapiens
KLKETETVE

SEQ ID NO: 399686 - protein, 9 aa, Homo Sapiens
KYLWEQIQK

SEQ ID NO: 399687 - protein, 9 aa, Homo Sapiens
IDRDGQMFK

SEQ ID NO: 399688 - protein, 9 aa, Homo Sapiens
TLEPTPGQS

SEQ ID NO: 399689 - protein, 9 aa, Homo Sapiens
STTGEALYK

SEQ ID NO: 399690 - protein, 9 aa, Homo Sapiens
PTEHGKKTT

SEQ ID NO: 399691 - protein, 9 aa, Homo Sapiens
GAGNGILNM

SEQ ID NO: 399692 - protein, 9 aa, Homo Sapiens
LIIQPVLAQ

SEQ ID NO: 399693 - protein, 9 aa, Homo Sapiens
EVDDKLDIS

SEQ ID NO: 399694 - protein, 9 aa, Homo Sapiens
KKWCSLTNN

SEQ ID NO: 399695 - protein, 9 aa, Homo Sapiens
GTYSCVSTH

SEQ ID NO: 399696 - protein, 9 aa, Homo Sapiens
NQRKYITKN

SEQ ID NO: 399697 - protein, 9 aa, Homo Sapiens
LFKCNDIGH

SEQ ID NO: 399698 - protein, 9 aa, Homo Sapiens
ELNNCIRKS

SEQ ID NO: 399699 - protein, 9 aa, Homo Sapiens
KEGKLLCNY

SEQ ID NO: 399700 - protein, 9 aa, Homo Sapiens
ISLWGVKLS

SEQ ID NO: 399701 - protein, 9 aa, Homo Sapiens
PGLPGYPIT

SEQ ID NO: 399702 - protein, 9 aa, Homo Sapiens
YQLQLDELS

SEQ ID NO: 399703 - protein, 9 aa, Homo Sapiens
HIQIHTGHK

SEQ ID NO: 399704 - protein, 9 aa, Homo Sapiens
DFRKRRPRG

SEQ ID NO: 399705 - protein, 9 aa, Homo Sapiens
FKLEKHSAP

SEQ ID NO: 399706 - protein, 9 aa, Homo Sapiens
KYLLMKIKN

SEQ ID NO: 399707 - protein, 9 aa, Homo Sapiens
ENNVCFEWG

SEQ ID NO: 399708 - protein, 9 aa, Homo Sapiens
IPDHPNFTR

SEQ ID NO: 399709 - protein, 9 aa, Homo Sapiens
ADIGFAYHR

SEQ ID NO: 399710 - protein, 9 aa, Homo Sapiens
EGSLIIQPV

SEQ ID NO: 399711 - protein, 9 aa, Homo Sapiens
IYRLKERFQ

SEQ ID NO: 399712 - protein, 9 aa, Homo Sapiens
MFRELSDLK

SEQ ID NO: 399713 - protein, 9 aa, Homo Sapiens
RAGSDLRVG

SEQ ID NO: 399714 - protein, 9 aa, Homo Sapiens
DAYVQALVR

SEQ ID NO: 399715 - protein, 9 aa, Homo Sapiens
CMQYVHTHS

SEQ ID NO: 399716 - protein, 9 aa, Homo Sapiens
KINKPGNMS

SEQ ID NO: 399717 - protein, 9 aa, Homo Sapiens
DARALGEWG

SEQ ID NO: 399718 - protein, 9 aa, Homo Sapiens
QRCLYHDMM

SEQ ID NO: 399719 - protein, 9 aa, Homo Sapiens
GALGETVLH

SEQ ID NO: 399720 - protein, 9 aa, Homo Sapiens
KMNMHNIPL

SEQ ID NO: 399721 - protein, 9 aa, Homo Sapiens
GAHHNKYGS

SEQ ID NO: 399722 - protein, 9 aa, Homo Sapiens
IASILRICS

SEQ ID NO: 399723 - protein, 9 aa, Homo Sapiens
YLLMKIKNQ

SEQ ID NO: 399724 - protein, 9 aa, Homo Sapiens
LICSLAISD

SEQ ID NO: 399725 - protein, 9 aa, Homo Sapiens
EPVLITEAS

SEQ ID NO: 399726 - protein, 9 aa, Homo Sapiens
HPKYLQGSH

SEQ ID NO: 399727 - protein, 9 aa, Homo Sapiens
FRQNRLYDA

SEQ ID NO: 399728 - protein, 9 aa, Homo Sapiens
VVVLEAIGS

SEQ ID NO: 399729 - protein, 9 aa, Homo Sapiens
EEEFFYGEQ

SEQ ID NO: 399730 - protein, 9 aa, Homo Sapiens
QNRRAKDKR

SEQ ID NO: 399731 - protein, 9 aa, Homo Sapiens
YRKHMKKTF

SEQ ID NO: 399732 - protein, 9 aa, Homo Sapiens
NGILNMSSF

SEQ ID NO: 399733 - protein, 9 aa, Homo Sapiens
IPQDHEMLY

SEQ ID NO: 399734 - protein, 9 aa, Homo Sapiens
KADVLEAHK

SEQ ID NO: 399735 - protein, 9 aa, Homo Sapiens
NEIVVLKKI

SEQ ID NO: 399736 - protein, 9 aa, Homo Sapiens
VYSVLYDVI

SEQ ID NO: 399737 - protein, 9 aa, Homo Sapiens
SYFALTNDS

SEQ ID NO: 399738 - protein, 9 aa, Homo Sapiens
VDPLLSKYQ

SEQ ID NO: 399739 - protein, 9 aa, Homo Sapiens
QAANNLNQD

SEQ ID NO: 399740 - protein, 9 aa, Homo Sapiens
AKLYDTIQN

SEQ ID NO: 399741 - protein, 9 aa, Homo Sapiens
IYERVLDVD

SEQ ID NO: 399742 - protein, 9 aa, Homo Sapiens
AGKTDQKEF

SEQ ID NO: 399743 - protein, 9 aa, Homo Sapiens
LIYDAFPKV

SEQ ID NO: 399744 - protein, 9 aa, Homo Sapiens
YHIVSQKQM

SEQ ID NO: 399745 - protein, 9 aa, Homo Sapiens
VILKSTSVL

SEQ ID NO: 399746 - protein, 9 aa, Homo Sapiens
MTLMSSIAC

SEQ ID NO: 399747 - protein, 9 aa, Homo Sapiens
SKRTEHKKI

SEQ ID NO: 399748 - protein, 9 aa, Homo Sapiens
SFEFLVRLF

SEQ ID NO: 399749 - protein, 9 aa, Homo Sapiens
QTNVYSMAL

SEQ ID NO: 399750 - protein, 9 aa, Homo Sapiens
NLCQLSVLF

SEQ ID NO: 399751 - protein, 9 aa, Homo Sapiens
VTTYASAHL

SEQ ID NO: 399752 - protein, 9 aa, Homo Sapiens
FYCKTKELK

SEQ ID NO: 399753 - protein, 9 aa, Homo Sapiens
YGWSLSEFE

SEQ ID NO: 399754 - protein, 9 aa, Homo Sapiens
LWSGDGEVT

SEQ ID NO: 399755 - protein, 9 aa, Homo Sapiens
THVCTLTCM

SEQ ID NO: 399756 - protein, 9 aa, Homo Sapiens
GGVLLAALK

SEQ ID NO: 399757 - protein, 9 aa, Homo Sapiens
AVDKPFKCD

SEQ ID NO: 399758 - protein, 9 aa, Homo Sapiens
SSLRFKWFN

SEQ ID NO: 399759 - protein, 9 aa, Homo Sapiens
QNTKLKVEP

SEQ ID NO: 399760 - protein, 9 aa, Homo Sapiens
ADMAKKETV

SEQ ID NO: 399761 - protein, 9 aa, Homo Sapiens
MLLTCILWW

SEQ ID NO: 399762 - protein, 9 aa, Homo Sapiens
KLLEQESLL

SEQ ID NO: 399763 - protein, 9 aa, Homo Sapiens
SWCRHLKLT

SEQ ID NO: 399764 - protein, 9 aa, Homo Sapiens
YLELWDGVD

SEQ ID NO: 399765 - protein, 9 aa, Homo Sapiens
PSVFPLSLY

SEQ ID NO: 399766 - protein, 9 aa, Homo Sapiens
RDNSILGSL

SEQ ID NO: 399767 - protein, 9 aa, Homo Sapiens
HTLFLSPAG

SEQ ID NO: 399768 - protein, 9 aa, Homo Sapiens
NVTDTEYSE

SEQ ID NO: 399769 - protein, 9 aa, Homo Sapiens
LDSTQMLKK

SEQ ID NO: 399770 - protein, 9 aa, Homo Sapiens
FESHSCNSI

SEQ ID NO: 399771 - protein, 9 aa, Homo Sapiens
CLNFLVVVL

SEQ ID NO: 399772 - protein, 9 aa, Homo Sapiens
IRGYFCIEV

SEQ ID NO: 399773 - protein, 9 aa, Homo Sapiens
ILFSKELRC

SEQ ID NO: 399774 - protein, 9 aa, Homo Sapiens
CNDIGHKIY

SEQ ID NO: 399775 - protein, 9 aa, Homo Sapiens
NKSILKELT

SEQ ID NO: 399776 - protein, 9 aa, Homo Sapiens
SVERKHYIQ

SEQ ID NO: 399777 - protein, 9 aa, Homo Sapiens
SITLSQRAL

SEQ ID NO: 399778 - protein, 9 aa, Homo Sapiens
YVWSLPSDI

SEQ ID NO: 399779 - protein, 9 aa, Homo Sapiens
EFTGSFRIY

SEQ ID NO: 399780 - protein, 9 aa, Homo Sapiens
SYFGQDILD

SEQ ID NO: 399781 - protein, 9 aa, Homo Sapiens
HLFQQPPEM

SEQ ID NO: 399782 - protein, 9 aa, Homo Sapiens
SISDKELKL

SEQ ID NO: 399783 - protein, 9 aa, Homo Sapiens
TVVTFAPVN

SEQ ID NO: 399784 - protein, 9 aa, Homo Sapiens
MGLMLAIRS

SEQ ID NO: 399785 - protein, 9 aa, Homo Sapiens
VMRYIHGVG

SEQ ID NO: 399786 - protein, 9 aa, Homo Sapiens
NKRKRHKQT

SEQ ID NO: 399787 - protein, 9 aa, Homo Sapiens
VELPEADSA

SEQ ID NO: 399788 - protein, 9 aa, Homo Sapiens
YRDVHHLVF

SEQ ID NO: 399789 - protein, 9 aa, Homo Sapiens
VFGIIGINR

SEQ ID NO: 399790 - protein, 9 aa, Homo Sapiens
DKVNLFRMV

SEQ ID NO: 399791 - protein, 9 aa, Homo Sapiens
NTVGLTNEG

SEQ ID NO: 399792 - protein, 9 aa, Homo Sapiens
VTQSEIDLV

SEQ ID NO: 399793 - protein, 9 aa, Homo Sapiens
WTNRIMEEF

SEQ ID NO: 399794 - protein, 9 aa, Homo Sapiens
WKSITLSQR

SEQ ID NO: 399795 - protein, 9 aa, Homo Sapiens
PEVIVYVES

SEQ ID NO: 399796 - protein, 9 aa, Homo Sapiens
YKSSPTQNI

SEQ ID NO: 399797 - protein, 9 aa, Homo Sapiens
RVKQCCCIS

SEQ ID NO: 399798 - protein, 9 aa, Homo Sapiens
GSWNPIYQE

SEQ ID NO: 399799 - protein, 9 aa, Homo Sapiens
FQMRKIIGK

SEQ ID NO: 399800 - protein, 9 aa, Homo Sapiens
QLWVDSTPL

SEQ ID NO: 399801 - protein, 9 aa, Homo Sapiens
ILGSVSEDN

SEQ ID NO: 399802 - protein, 9 aa, Homo Sapiens
DFDLENTLF

SEQ ID NO: 399803 - protein, 9 aa, Homo Sapiens
LHHKDSEDA

SEQ ID NO: 399804 - protein, 9 aa, Homo Sapiens
EDKLDCVIV

SEQ ID NO: 399805 - protein, 9 aa, Homo Sapiens
TVLHTLFLS

SEQ ID NO: 399806 - protein, 9 aa, Homo Sapiens
KLALPHSKS

SEQ ID NO: 399807 - protein, 9 aa, Homo Sapiens
INTWRALSL

SEQ ID NO: 399808 - protein, 9 aa, Homo Sapiens
VHQLTHTGE

SEQ ID NO: 399809 - protein, 9 aa, Homo Sapiens
LFALYIMRV

SEQ ID NO: 399810 - protein, 9 aa, Homo Sapiens
VFPGQQLVT

SEQ ID NO: 399811 - protein, 9 aa, Homo Sapiens
NHYEDLDLD

SEQ ID NO: 399812 - protein, 9 aa, Homo Sapiens
LDRRPLNDL

SEQ ID NO: 399813 - protein, 9 aa, Homo Sapiens
WDKWLSRQF

SEQ ID NO: 399814 - protein, 9 aa, Homo Sapiens
SQNKIKQVK

SEQ ID NO: 399815 - protein, 9 aa, Homo Sapiens
PLLREGKLL

SEQ ID NO: 399816 - protein, 9 aa, Homo Sapiens
PDGTYTGII

SEQ ID NO: 399817 - protein, 9 aa, Homo Sapiens
ELEQYQWDG

SEQ ID NO: 399818 - protein, 9 aa, Homo Sapiens
TDLIKHFQK

SEQ ID NO: 399819 - protein, 9 aa, Homo Sapiens
MALHIAQTD

SEQ ID NO: 399820 - protein, 9 aa, Homo Sapiens
SRFILGSVS

SEQ ID NO: 399821 - protein, 9 aa, Homo Sapiens
QYNEENYGV

SEQ ID NO: 399822 - protein, 9 aa, Homo Sapiens
LMQHKIIHT

SEQ ID NO: 399823 - protein, 9 aa, Homo Sapiens
RTYAACQDA

SEQ ID NO: 399824 - protein, 9 aa, Homo Sapiens
HYPYSSLSS

SEQ ID NO: 399825 - protein, 9 aa, Homo Sapiens
KLKKQRLKL

SEQ ID NO: 399826 - protein, 9 aa, Homo Sapiens
DFGSATNTF

SEQ ID NO: 399827 - protein, 9 aa, Homo Sapiens
PTCHNFNQF

SEQ ID NO: 399828 - protein, 9 aa, Homo Sapiens
LTNEGSDDE

SEQ ID NO: 399829 - protein, 9 aa, Homo Sapiens
QNIGNKNAV

SEQ ID NO: 399830 - protein, 9 aa, Homo Sapiens
EFFYGEQGK

SEQ ID NO: 399831 - protein, 9 aa, Homo Sapiens
IEVVKLLVL

SEQ ID NO: 399832 - protein, 9 aa, Homo Sapiens
KHESEKLKC

SEQ ID NO: 399833 - protein, 9 aa, Homo Sapiens
PEKIIKECI

SEQ ID NO: 399834 - protein, 9 aa, Homo Sapiens
QRGALGETV

SEQ ID NO: 399835 - protein, 9 aa, Homo Sapiens
HKVIYTAEK

SEQ ID NO: 399836 - protein, 9 aa, Homo Sapiens
IVTSLLEYR

SEQ ID NO: 399837 - protein, 9 aa, Homo Sapiens
LQNLEILQI

SEQ ID NO: 399838 - protein, 9 aa, Homo Sapiens
WEYIILLSE

SEQ ID NO: 399839 - protein, 9 aa, Homo Sapiens
LNNCIRKSL

SEQ ID NO: 399840 - protein, 9 aa, Homo Sapiens
GTLDNTFEG

SEQ ID NO: 399841 - protein, 9 aa, Homo Sapiens
SQKLNNIIS

SEQ ID NO: 399842 - protein, 9 aa, Homo Sapiens
RGCSGIISV

SEQ ID NO: 399843 - protein, 9 aa, Homo Sapiens
EKTKSHYFP

SEQ ID NO: 399844 - protein, 9 aa, Homo Sapiens
DSTPLPGTR

SEQ ID NO: 399845 - protein, 9 aa, Homo Sapiens
ARAFVHKSS

SEQ ID NO: 399846 - protein, 9 aa, Homo Sapiens
IEDNFPLGT

SEQ ID NO: 399847 - protein, 9 aa, Homo Sapiens
DKLDISDNS

SEQ ID NO: 399848 - protein, 9 aa, Homo Sapiens
LFILLCAIL

SEQ ID NO: 399849 - protein, 9 aa, Homo Sapiens
FMWGLITQG

SEQ ID NO: 399850 - protein, 9 aa, Homo Sapiens
IKYHSWHIQ

SEQ ID NO: 399851 - protein, 9 aa, Homo Sapiens
YFDYGILQE

SEQ ID NO: 399852 - protein, 9 aa, Homo Sapiens
QNSPNRIME

SEQ ID NO: 399853 - protein, 9 aa, Homo Sapiens
ASAQGIQST

SEQ ID NO: 399854 - protein, 9 aa, Homo Sapiens
TMVMPIVEA

SEQ ID NO: 399855 - protein, 9 aa, Homo Sapiens
DEESFESIR

SEQ ID NO: 399856 - protein, 9 aa, Homo Sapiens
YLVQLPVVT

SEQ ID NO: 399857 - protein, 9 aa, Homo Sapiens
IATKKHTGK

SEQ ID NO: 399858 - protein, 9 aa, Homo Sapiens
IVLKLPYLS

SEQ ID NO: 399859 - protein, 9 aa, Homo Sapiens
EVLKRDFRN

SEQ ID NO: 399860 - protein, 9 aa, Homo Sapiens
HNFNQFTAA

SEQ ID NO: 399861 - protein, 9 aa, Homo Sapiens
KKYSISNKE

SEQ ID NO: 399862 - protein, 9 aa, Homo Sapiens
HVVATGGVE

SEQ ID NO: 399863 - protein, 9 aa, Homo Sapiens
WANSNLTLT

SEQ ID NO: 399864 - protein, 9 aa, Homo Sapiens
DKRLKKDAG

SEQ ID NO: 399865 - protein, 9 aa, Homo Sapiens
SWNPIYQEN

SEQ ID NO: 399866 - protein, 9 aa, Homo Sapiens
DIQIIVLDL

SEQ ID NO: 399867 - protein, 9 aa, Homo Sapiens
NSFSNEEIN

SEQ ID NO: 399868 - protein, 9 aa, Homo Sapiens
RSPKIRSVS

SEQ ID NO: 399869 - protein, 9 aa, Homo Sapiens
AAAAVVRWT

SEQ ID NO: 399870 - protein, 9 aa, Homo Sapiens
PCGKISFAV

SEQ ID NO: 399871 - protein, 9 aa, Homo Sapiens
TRYSSKCRV

SEQ ID NO: 399872 - protein, 9 aa, Homo Sapiens
FYEVKIRDN

SEQ ID NO: 399873 - protein, 9 aa, Homo Sapiens
DSIPKVLAD

SEQ ID NO: 399874 - protein, 9 aa, Homo Sapiens
TSISNKILI

SEQ ID NO: 399875 - protein, 9 aa, Homo Sapiens
SPATPIYQL

SEQ ID NO: 399876 - protein, 9 aa, Homo Sapiens
YRHPSALQL

SEQ ID NO: 399877 - protein, 9 aa, Homo Sapiens
FQYQQLEFG

SEQ ID NO: 399878 - protein, 9 aa, Homo Sapiens
EINFERINT

SEQ ID NO: 399879 - protein, 9 aa, Homo Sapiens
SGPTVCQLL

SEQ ID NO: 399880 - protein, 9 aa, Homo Sapiens
GPYLQFWAG

SEQ ID NO: 399881 - protein, 9 aa, Homo Sapiens
EYDNFSEDF

SEQ ID NO: 399882 - protein, 9 aa, Homo Sapiens
VIRKDVCAI

SEQ ID NO: 399883 - protein, 9 aa, Homo Sapiens
DNIQCGENF

SEQ ID NO: 399884 - protein, 9 aa, Homo Sapiens
TLEKQDDLK

SEQ ID NO: 399885 - protein, 9 aa, Homo Sapiens
GTRREYCKF

SEQ ID NO: 399886 - protein, 9 aa, Homo Sapiens
ESEKLKCHI

SEQ ID NO: 399887 - protein, 9 aa, Homo Sapiens
VRTEIGVIL

SEQ ID NO: 399888 - protein, 9 aa, Homo Sapiens
KYQSILIST

SEQ ID NO: 399889 - protein, 9 aa, Homo Sapiens
VLGSPDQAP

SEQ ID NO: 399890 - protein, 9 aa, Homo Sapiens
LCVLEALNN

SEQ ID NO: 399891 - protein, 9 aa, Homo Sapiens
NRVAKMGLM

SEQ ID NO: 399892 - protein, 9 aa, Homo Sapiens
PSATGQSYF

SEQ ID NO: 399893 - protein, 9 aa, Homo Sapiens
DKSLEEARK

SEQ ID NO: 399894 - protein, 9 aa, Homo Sapiens
DPELAKSCI

SEQ ID NO: 399895 - protein, 9 aa, Homo Sapiens
WGLVFENTR

SEQ ID NO: 399896 - protein, 9 aa, Homo Sapiens
KEEVFLIFW

SEQ ID NO: 399897 - protein, 9 aa, Homo Sapiens
VQKLTHCPD

SEQ ID NO: 399898 - protein, 9 aa, Homo Sapiens
NFKAPFHTS

SEQ ID NO: 399899 - protein, 9 aa, Homo Sapiens
PAYPALSLS

SEQ ID NO: 399900 - protein, 9 aa, Homo Sapiens
QFQSRNVHN

SEQ ID NO: 399901 - protein, 9 aa, Homo Sapiens
EDDYYENST

SEQ ID NO: 399902 - protein, 9 aa, Homo Sapiens
KCEENLRKI

SEQ ID NO: 399903 - protein, 9 aa, Homo Sapiens
LEAEIQTLK

SEQ ID NO: 399904 - protein, 9 aa, Homo Sapiens
NFVDNVYGY

SEQ ID NO: 399905 - protein, 9 aa, Homo Sapiens
DYYENSTPP

SEQ ID NO: 399906 - protein, 9 aa, Homo Sapiens
LHLISLNMN

SEQ ID NO: 399907 - protein, 9 aa, Homo Sapiens
LKNILRLHL

SEQ ID NO: 399908 - protein, 9 aa, Homo Sapiens
QTETTADKL

SEQ ID NO: 399909 - protein, 9 aa, Homo Sapiens
VEDSGAYYC

SEQ ID NO: 399910 - protein, 9 aa, Homo Sapiens
LNEQWIRAK

SEQ ID NO: 399911 - protein, 9 aa, Homo Sapiens
FNSMNWRQL

SEQ ID NO: 399912 - protein, 9 aa, Homo Sapiens
YAPKCINFR

SEQ ID NO: 399913 - protein, 9 aa, Homo Sapiens
HQDKKLCLG

SEQ ID NO: 399914 - protein, 9 aa, Homo Sapiens
HINKKSPFD

SEQ ID NO: 399915 - protein, 9 aa, Homo Sapiens
ATDFCVMPR

SEQ ID NO: 399916 - protein, 9 aa, Homo Sapiens
MLKYQASAQ

SEQ ID NO: 399917 - protein, 9 aa, Homo Sapiens
RFISYFSIS

SEQ ID NO: 399918 - protein, 9 aa, Homo Sapiens
DEATDFCVM

SEQ ID NO: 399919 - protein, 9 aa, Homo Sapiens
RITNSQNKI

SEQ ID NO: 399920 - protein, 9 aa, Homo Sapiens
MGTLDNTFE

SEQ ID NO: 399921 - protein, 9 aa, Homo Sapiens
LYGDAQMAR

SEQ ID NO: 399922 - protein, 9 aa, Homo Sapiens
AHALEHTFV

SEQ ID NO: 399923 - protein, 9 aa, Homo Sapiens
TEHSDQRVV

SEQ ID NO: 399924 - protein, 9 aa, Homo Sapiens
AEKGPHSSR

SEQ ID NO: 399925 - protein, 9 aa, Homo Sapiens
QSIVLKLPY

SEQ ID NO: 399926 - protein, 9 aa, Homo Sapiens
NAKRHDGVC

SEQ ID NO: 399927 - protein, 9 aa, Homo Sapiens
NVANDAMLI

SEQ ID NO: 399928 - protein, 9 aa, Homo Sapiens
GVILRLSHP

SEQ ID NO: 399929 - protein, 9 aa, Homo Sapiens
ESNMEQRVI

SEQ ID NO: 399930 - protein, 9 aa, Homo Sapiens
ISYDLHHKD

SEQ ID NO: 399931 - protein, 9 aa, Homo Sapiens
DPLLSKYQS

SEQ ID NO: 399932 - protein, 9 aa, Homo Sapiens
DRDGQMFKY

SEQ ID NO: 399933 - protein, 9 aa, Homo Sapiens
PKILNSKII

SEQ ID NO: 399934 - protein, 9 aa, Homo Sapiens
RHTLYHGHQ

SEQ ID NO: 399935 - protein, 9 aa, Homo Sapiens
NGSPFFITT

SEQ ID NO: 399936 - protein, 9 aa, Homo Sapiens
MCITYYCIF

SEQ ID NO: 399937 - protein, 9 aa, Homo Sapiens
LHLTAKEGH

SEQ ID NO: 399938 - protein, 9 aa, Homo Sapiens
AANFNSWCR

SEQ ID NO: 399939 - protein, 9 aa, Homo Sapiens
GFQQVLKIY

SEQ ID NO: 399940 - protein, 9 aa, Homo Sapiens
NDRQLALQA

SEQ ID NO: 399941 - protein, 9 aa, Homo Sapiens
QIIHFLENP

SEQ ID NO: 399942 - protein, 9 aa, Homo Sapiens
SSCLSSWAN

SEQ ID NO: 399943 - protein, 9 aa, Homo Sapiens
DDSPSCPSL

SEQ ID NO: 399944 - protein, 9 aa, Homo Sapiens
QAAEKGPHS

SEQ ID NO: 399945 - protein, 9 aa, Homo Sapiens
GVLLAALKK

SEQ ID NO: 399946 - protein, 9 aa, Homo Sapiens
GTFIEELIQ

SEQ ID NO: 399947 - protein, 9 aa, Homo Sapiens
DVCRIDYIS

SEQ ID NO: 399948 - protein, 9 aa, Homo Sapiens
LMEAMKYHI

SEQ ID NO: 399949 - protein, 9 aa, Homo Sapiens
ALTQKGLNN

SEQ ID NO: 399950 - protein, 9 aa, Homo Sapiens
QKKEEVFLI

SEQ ID NO: 399951 - protein, 9 aa, Homo Sapiens
HQIIHFLEN

SEQ ID NO: 399952 - protein, 9 aa, Homo Sapiens
YVESMDIFP

SEQ ID NO: 399953 - protein, 9 aa, Homo Sapiens
RHIQIHTGH

SEQ ID NO: 399954 - protein, 9 aa, Homo Sapiens
NLLDNNEAT

SEQ ID NO: 399955 - protein, 9 aa, Homo Sapiens
AYYCTGKVW

SEQ ID NO: 399956 - protein, 9 aa, Homo Sapiens
KATSDKKYS

SEQ ID NO: 399957 - protein, 9 aa, Homo Sapiens
AIKGTYTLS

SEQ ID NO: 399958 - protein, 9 aa, Homo Sapiens
LSIDGLLNQ

SEQ ID NO: 399959 - protein, 9 aa, Homo Sapiens
KMATNMFLA

SEQ ID NO: 399960 - protein, 9 aa, Homo Sapiens
WGPKLDIEK

SEQ ID NO: 399961 - protein, 9 aa, Homo Sapiens
RKKQFWYLL

SEQ ID NO: 399962 - protein, 9 aa, Homo Sapiens
LQNQVLDSN

SEQ ID NO: 399963 - protein, 9 aa, Homo Sapiens
MRVPHSVWG

SEQ ID NO: 399964 - protein, 9 aa, Homo Sapiens
PLEHKKIIE

SEQ ID NO: 399965 - protein, 9 aa, Homo Sapiens
NLFRMVISN

SEQ ID NO: 399966 - protein, 9 aa, Homo Sapiens
LGKVQNMVS

SEQ ID NO: 399967 - protein, 9 aa, Homo Sapiens
RRINGFKRH

SEQ ID NO: 399968 - protein, 9 aa, Homo Sapiens
FPKILVFHL

SEQ ID NO: 399969 - protein, 9 aa, Homo Sapiens
PFQLWEPNT

SEQ ID NO: 399970 - protein, 9 aa, Homo Sapiens
DLEENDSKK

SEQ ID NO: 399971 - protein, 9 aa, Homo Sapiens
KAKELAQIE

SEQ ID NO: 399972 - protein, 9 aa, Homo Sapiens
SNSKNISTH

SEQ ID NO: 399973 - protein, 9 aa, Homo Sapiens
ILQFQNPVY

SEQ ID NO: 399974 - protein, 9 aa, Homo Sapiens
LINNSRFYN

SEQ ID NO: 399975 - protein, 9 aa, Homo Sapiens
DNRRQFREI

SEQ ID NO: 399976 - protein, 9 aa, Homo Sapiens
HMTENRCVL

SEQ ID NO: 399977 - protein, 9 aa, Homo Sapiens
LGCDKITCT

SEQ ID NO: 399978 - protein, 9 aa, Homo Sapiens
TGSFRIYPL

SEQ ID NO: 399979 - protein, 9 aa, Homo Sapiens
ENTEDNRRQ

SEQ ID NO: 399980 - protein, 9 aa, Homo Sapiens
SSLENEIVV

SEQ ID NO: 399981 - protein, 9 aa, Homo Sapiens
LITEASGTT

SEQ ID NO: 399982 - protein, 9 aa, Homo Sapiens
KLKVEPQPQ

SEQ ID NO: 399983 - protein, 9 aa, Homo Sapiens
KKTTLANEK

SEQ ID NO: 399984 - protein, 9 aa, Homo Sapiens
KKKSKDKKI

SEQ ID NO: 399985 - protein, 9 aa, Homo Sapiens
WELLPLVLM

SEQ ID NO: 399986 - protein, 9 aa, Homo Sapiens
AQVTIQDSQ

SEQ ID NO: 399987 - protein, 9 aa, Homo Sapiens
APVQPSAED

SEQ ID NO: 399988 - protein, 9 aa, Homo Sapiens
TLSTIKYHS

SEQ ID NO: 399989 - protein, 9 aa, Homo Sapiens
LVRLKLGLV

SEQ ID NO: 399990 - protein, 9 aa, Homo Sapiens
KEPLQASEL

SEQ ID NO: 399991 - protein, 9 aa, Homo Sapiens
VRFSLLTAS

SEQ ID NO: 399992 - protein, 9 aa, Homo Sapiens
HLLELDKVH

SEQ ID NO: 399993 - protein, 9 aa, Homo Sapiens
EVEALSVER

SEQ ID NO: 399994 - protein, 9 aa, Homo Sapiens
KDKKKTPSS

SEQ ID NO: 399995 - protein, 9 aa, Homo Sapiens
DCGWFVTPL

SEQ ID NO: 399996 - protein, 9 aa, Homo Sapiens
SHPEPTRTK

SEQ ID NO: 399997 - protein, 9 aa, Homo Sapiens
FHSPSSGLV

SEQ ID NO: 399998 - protein, 9 aa, Homo Sapiens
VNIKKILTD

SEQ ID NO: 399999 - protein, 9 aa, Homo Sapiens
ITVQKNKNT

SEQ ID NO: 400000 - protein, 9 aa, Homo Sapiens
FISYFSISY

SEQ ID NO: 400001 - protein, 9 aa, Homo Sapiens
KQCCCISID

SEQ ID NO: 400002 - protein, 9 aa, Homo Sapiens
RRAGSDLRV

SEQ ID NO: 400003 - protein, 9 aa, Homo Sapiens
HKSSILIMD

SEQ ID NO: 400004 - protein, 9 aa, Homo Sapiens
GTGLNPHNF

SEQ ID NO: 400005 - protein, 9 aa, Homo Sapiens
NTLVVKKFD

SEQ ID NO: 400006 - protein, 9 aa, Homo Sapiens
HVCTLTCMQ

SEQ ID NO: 400007 - protein, 9 aa, Homo Sapiens
KIIHAGEKF

SEQ ID NO: 400008 - protein, 9 aa, Homo Sapiens
KKLYGDAQM

SEQ ID NO: 400009 - protein, 9 aa, Homo Sapiens
TWNEKYSYL

SEQ ID NO: 400010 - protein, 9 aa, Homo Sapiens
GGSPPHSTT

SEQ ID NO: 400011 - protein, 9 aa, Homo Sapiens
HSDNWVVYQ

SEQ ID NO: 400012 - protein, 9 aa, Homo Sapiens
CGVHHAFAK

SEQ ID NO: 400013 - protein, 9 aa, Homo Sapiens
VNSHPQHSD

SEQ ID NO: 400014 - protein, 9 aa, Homo Sapiens
RHDRDRKCR

SEQ ID NO: 400015 - protein, 9 aa, Homo Sapiens
TLTNHKIIH

SEQ ID NO: 400016 - protein, 9 aa, Homo Sapiens
VPKILNSKI

SEQ ID NO: 400017 - protein, 9 aa, Homo Sapiens
PYLSKQTAS

SEQ ID NO: 400018 - protein, 9 aa, Homo Sapiens
QSKVDWGNF

SEQ ID NO: 400019 - protein, 9 aa, Homo Sapiens
IDQCALIHS

SEQ ID NO: 400020 - protein, 9 aa, Homo Sapiens
KVEATQPRR

SEQ ID NO: 400021 - protein, 9 aa, Homo Sapiens
DISKTFEIN

SEQ ID NO: 400022 - protein, 9 aa, Homo Sapiens
HRLHTGDKS

SEQ ID NO: 400023 - protein, 9 aa, Homo Sapiens
TIEDNFPLG

SEQ ID NO: 400024 - protein, 9 aa, Homo Sapiens
TYLNVHTQT

SEQ ID NO: 400025 - protein, 9 aa, Homo Sapiens
HLYKELQLR

SEQ ID NO: 400026 - protein, 9 aa, Homo Sapiens
GPVYSSCKG

SEQ ID NO: 400027 - protein, 9 aa, Homo Sapiens
GESDKVQQL

SEQ ID NO: 400028 - protein, 9 aa, Homo Sapiens
LRSVLFNFI

SEQ ID NO: 400029 - protein, 9 aa, Homo Sapiens
SSPLKLHQT

SEQ ID NO: 400030 - protein, 9 aa, Homo Sapiens
YDVNSGVYE

SEQ ID NO: 400031 - protein, 9 aa, Homo Sapiens
HATEELKEL

SEQ ID NO: 400032 - protein, 9 aa, Homo Sapiens
FQPGDYIIQ

SEQ ID NO: 400033 - protein, 9 aa, Homo Sapiens
QIAATWRVY

SEQ ID NO: 400034 - protein, 9 aa, Homo Sapiens
LTRHIQIHT

SEQ ID NO: 400035 - protein, 9 aa, Homo Sapiens
LALEAEIQT

SEQ ID NO: 400036 - protein, 9 aa, Homo Sapiens
QDNSRPLQE

SEQ ID NO: 400037 - protein, 9 aa, Homo Sapiens
WGAFNPQWV

SEQ ID NO: 400038 - protein, 9 aa, Homo Sapiens
SKVDWGNFF

SEQ ID NO: 400039 - protein, 9 aa, Homo Sapiens
TAALEKDHE

SEQ ID NO: 400040 - protein, 9 aa, Homo Sapiens
IQIHTGHKP

SEQ ID NO: 400041 - protein, 9 aa, Homo Sapiens
LQPRENVPK

SEQ ID NO: 400042 - protein, 9 aa, Homo Sapiens
LRTRFGKHL

SEQ ID NO: 400043 - protein, 9 aa, Homo Sapiens
EMRTYAACQ

SEQ ID NO: 400044 - protein, 9 aa, Homo Sapiens
AGLKMLRVP

SEQ ID NO: 400045 - protein, 9 aa, Homo Sapiens
WYQNKIGAY

SEQ ID NO: 400046 - protein, 9 aa, Homo Sapiens
STLMQHKII

SEQ ID NO: 400047 - protein, 9 aa, Homo Sapiens
NHVVATGGV

SEQ ID NO: 400048 - protein, 9 aa, Homo Sapiens
KDVCAILNR

SEQ ID NO: 400049 - protein, 9 aa, Homo Sapiens
DPNDMFQYN

SEQ ID NO: 400050 - protein, 9 aa, Homo Sapiens
LSSSFSDGF

SEQ ID NO: 400051 - protein, 9 aa, Homo Sapiens
QKLNNIISE

SEQ ID NO: 400052 - protein, 9 aa, Homo Sapiens
KLHFWRKIC

SEQ ID NO: 400053 - protein, 9 aa, Homo Sapiens
MNERALLSL

SEQ ID NO: 400054 - protein, 9 aa, Homo Sapiens
KMLRVPGPA

SEQ ID NO: 400055 - protein, 9 aa, Homo Sapiens
KGMMLGVCS

SEQ ID NO: 400056 - protein, 9 aa, Homo Sapiens
SESYSCPSC

SEQ ID NO: 400057 - protein, 9 aa, Homo Sapiens
NNLYRNVML

SEQ ID NO: 400058 - protein, 9 aa, Homo Sapiens
NKLQKQRED

SEQ ID NO: 400059 - protein, 9 aa, Homo Sapiens
AMRHGIESI

SEQ ID NO: 400060 - protein, 9 aa, Homo Sapiens
RLQWRRGSS

SEQ ID NO: 400061 - protein, 9 aa, Homo Sapiens
ISSSLGGRT

SEQ ID NO: 400062 - protein, 9 aa, Homo Sapiens
DDLLLQYDC

SEQ ID NO: 400063 - protein, 9 aa, Homo Sapiens
KAKMIYSEL

SEQ ID NO: 400064 - protein, 9 aa, Homo Sapiens
DKGDSKDSK

SEQ ID NO: 400065 - protein, 9 aa, Homo Sapiens
VEANHLLHK

SEQ ID NO: 400066 - protein, 9 aa, Homo Sapiens
NGDILMECG

SEQ ID NO: 400067 - protein, 9 aa, Homo Sapiens
DVKEDDLLL

SEQ ID NO: 400068 - protein, 9 aa, Homo Sapiens
LNRTSQKLK

SEQ ID NO: 400069 - protein, 9 aa, Homo Sapiens
MCKWAINIS

SEQ ID NO: 400070 - protein, 9 aa, Homo Sapiens
LLQSGFYDL

SEQ ID NO: 400071 - protein, 9 aa, Homo Sapiens
ATKQKGAQL

SEQ ID NO: 400072 - protein, 9 aa, Homo Sapiens
GFGLINSEN

SEQ ID NO: 400073 - protein, 9 aa, Homo Sapiens
TDPVSLINY

SEQ ID NO: 400074 - protein, 9 aa, Homo Sapiens
YQMNKRKRH

SEQ ID NO: 400075 - protein, 9 aa, Homo Sapiens
HCQEAGTTL

SEQ ID NO: 400076 - protein, 9 aa, Homo Sapiens
CDDEIGVVS

SEQ ID NO: 400077 - protein, 9 aa, Homo Sapiens
KKYLLMKIK

SEQ ID NO: 400078 - protein, 9 aa, Homo Sapiens
VVKTWRQLA

SEQ ID NO: 400079 - protein, 9 aa, Homo Sapiens
AQNIYYQGN

SEQ ID NO: 400080 - protein, 9 aa, Homo Sapiens
WLTKKHTVS

SEQ ID NO: 400081 - protein, 9 aa, Homo Sapiens
KNLEVPVNI

SEQ ID NO: 400082 - protein, 9 aa, Homo Sapiens
VYRVLFKHL

SEQ ID NO: 400083 - protein, 9 aa, Homo Sapiens
KVALWARVQ

SEQ ID NO: 400084 - protein, 9 aa, Homo Sapiens
TLDKVCQPL

SEQ ID NO: 400085 - protein, 9 aa, Homo Sapiens
RLDIFSCLL

SEQ ID NO: 400086 - protein, 9 aa, Homo Sapiens
ILRLHLNSN

SEQ ID NO: 400087 - protein, 9 aa, Homo Sapiens
TYTVVRMHV

SEQ ID NO: 400088 - protein, 9 aa, Homo Sapiens
RIKVENTED

SEQ ID NO: 400089 - protein, 9 aa, Homo Sapiens
TWNPKGPNL

SEQ ID NO: 400090 - protein, 9 aa, Homo Sapiens
NIKKILTDV

SEQ ID NO: 400091 - protein, 9 aa, Homo Sapiens
QIEEFKKEE

SEQ ID NO: 400092 - protein, 9 aa, Homo Sapiens
LPEHKKKCK

SEQ ID NO: 400093 - protein, 9 aa, Homo Sapiens
NPGLNAKLL

SEQ ID NO: 400094 - protein, 9 aa, Homo Sapiens
PVEPQGPFY

SEQ ID NO: 400095 - protein, 9 aa, Homo Sapiens
IQEHSEIHT

SEQ ID NO: 400096 - protein, 9 aa, Homo Sapiens
FHSFQIHEI

SEQ ID NO: 400097 - protein, 9 aa, Homo Sapiens
SDPVMRKML

SEQ ID NO: 400098 - protein, 9 aa, Homo Sapiens
LSKVWLVDA

SEQ ID NO: 400099 - protein, 9 aa, Homo Sapiens
SQSKVDWGN

SEQ ID NO: 400100 - protein, 9 aa, Homo Sapiens
RKKYLLMKI

SEQ ID NO: 400101 - protein, 9 aa, Homo Sapiens
AYDQAHLSA

SEQ ID NO: 400102 - protein, 9 aa, Homo Sapiens
GGPIHVQFV

SEQ ID NO: 400103 - protein, 9 aa, Homo Sapiens
IIGINRTRQ

SEQ ID NO: 400104 - protein, 9 aa, Homo Sapiens
TYLRKNLSI

SEQ ID NO: 400105 - protein, 9 aa, Homo Sapiens
FNSSIARSQ

SEQ ID NO: 400106 - protein, 9 aa, Homo Sapiens
VKIRDNSIL

SEQ ID NO: 400107 - protein, 9 aa, Homo Sapiens
WFPTPRCIR

SEQ ID NO: 400108 - protein, 9 aa, Homo Sapiens
KAKHSINGI

SEQ ID NO: 400109 - protein, 9 aa, Homo Sapiens
LPPTVLELC

SEQ ID NO: 400110 - protein, 9 aa, Homo Sapiens
LLRLRGPSQ

SEQ ID NO: 400111 - protein, 9 aa, Homo Sapiens
AFDPEDTSQ

SEQ ID NO: 400112 - protein, 9 aa, Homo Sapiens
NATVEDSGA

SEQ ID NO: 400113 - protein, 9 aa, Homo Sapiens
LRHDRDRKC

SEQ ID NO: 400114 - protein, 9 aa, Homo Sapiens
SSYVSFASN

SEQ ID NO: 400115 - protein, 9 aa, Homo Sapiens
KNKLSHTKY

SEQ ID NO: 400116 - protein, 9 aa, Homo Sapiens
TVVAICYGS

SEQ ID NO: 400117 - protein, 9 aa, Homo Sapiens
PVLYERSLL

SEQ ID NO: 400118 - protein, 9 aa, Homo Sapiens
VPNLWSGDG

SEQ ID NO: 400119 - protein, 9 aa, Homo Sapiens
TSENEAIKI

SEQ ID NO: 400120 - protein, 9 aa, Homo Sapiens
LSGLGGCLG

SEQ ID NO: 400121 - protein, 9 aa, Homo Sapiens
TRESISSKK

SEQ ID NO: 400122 - protein, 9 aa, Homo Sapiens
GKFLVVFIL

SEQ ID NO: 400123 - protein, 9 aa, Homo Sapiens
SIIAEVEAQ

SEQ ID NO: 400124 - protein, 9 aa, Homo Sapiens
QEQQNVLKV

SEQ ID NO: 400125 - protein, 9 aa, Homo Sapiens
KTAQVTIQD

SEQ ID NO: 400126 - protein, 9 aa, Homo Sapiens
NTYTVLIEG

SEQ ID NO: 400127 - protein, 9 aa, Homo Sapiens
YEVKIRDNS

SEQ ID NO: 400128 - protein, 9 aa, Homo Sapiens
CNIHYTGCY

SEQ ID NO: 400129 - protein, 9 aa, Homo Sapiens
CPSYPERQY

SEQ ID NO: 400130 - protein, 9 aa, Homo Sapiens
SGHTYNPLG

SEQ ID NO: 400131 - protein, 9 aa, Homo Sapiens
TNDCGALKR

SEQ ID NO: 400132 - protein, 9 aa, Homo Sapiens
YNLSPKSYQ

SEQ ID NO: 400133 - protein, 9 aa, Homo Sapiens
KQIECGHAV

SEQ ID NO: 400134 - protein, 9 aa, Homo Sapiens
QSFEKETGN

SEQ ID NO: 400135 - protein, 9 aa, Homo Sapiens
DNFTKELNQ

SEQ ID NO: 400136 - protein, 9 aa, Homo Sapiens
ENEDNIQCG

SEQ ID NO: 400137 - protein, 9 aa, Homo Sapiens
SGAYYCTGK

SEQ ID NO: 400138 - protein, 9 aa, Homo Sapiens
RLIQGESIT

SEQ ID NO: 400139 - protein, 9 aa, Homo Sapiens
YFWINRRTI

SEQ ID NO: 400140 - protein, 9 aa, Homo Sapiens
LKFGGVIPQ

SEQ ID NO: 400141 - protein, 9 aa, Homo Sapiens
LDISRLQGQ

SEQ ID NO: 400142 - protein, 9 aa, Homo Sapiens
KVPAGVQKL

SEQ ID NO: 400143 - protein, 9 aa, Homo Sapiens
FEQNTLEIN

SEQ ID NO: 400144 - protein, 9 aa, Homo Sapiens
CSSTLKKHN

SEQ ID NO: 400145 - protein, 9 aa, Homo Sapiens
IINNNNFHK

SEQ ID NO: 400146 - protein, 9 aa, Homo Sapiens
NALKTVMND

SEQ ID NO: 400147 - protein, 9 aa, Homo Sapiens
LRLLAYNRY

SEQ ID NO: 400148 - protein, 9 aa, Homo Sapiens
EPNVTDTEY

SEQ ID NO: 400149 - protein, 9 aa, Homo Sapiens
SNTGSGKSS

SEQ ID NO: 400150 - protein, 9 aa, Homo Sapiens
SYGIECSSF

SEQ ID NO: 400151 - protein, 9 aa, Homo Sapiens
YFALTNDSK

SEQ ID NO: 400152 - protein, 9 aa, Homo Sapiens
SEGHEKSTK

SEQ ID NO: 400153 - protein, 9 aa, Homo Sapiens
VDENYLIST

SEQ ID NO: 400154 - protein, 9 aa, Homo Sapiens
RMVWVAWLF

SEQ ID NO: 400155 - protein, 9 aa, Homo Sapiens
FLVVFILLS

SEQ ID NO: 400156 - protein, 9 aa, Homo Sapiens
LRPRSLRYP

SEQ ID NO: 400157 - protein, 9 aa, Homo Sapiens
LIVETEAQT

SEQ ID NO: 400158 - protein, 9 aa, Homo Sapiens
INRCLPLHF

SEQ ID NO: 400159 - protein, 9 aa, Homo Sapiens
NESRWRCAD

SEQ ID NO: 400160 - protein, 9 aa, Homo Sapiens
LFNFIRNLL

SEQ ID NO: 400161 - protein, 9 aa, Homo Sapiens
NNIVVVLEA

SEQ ID NO: 400162 - protein, 9 aa, Homo Sapiens
GTQIPQKQD

SEQ ID NO: 400163 - protein, 9 aa, Homo Sapiens
NIPLHTVRQ

SEQ ID NO: 400164 - protein, 9 aa, Homo Sapiens
IIVTCLMII

SEQ ID NO: 400165 - protein, 9 aa, Homo Sapiens
NYLTRNRFF

SEQ ID NO: 400166 - protein, 9 aa, Homo Sapiens
AQRVAEAHN

SEQ ID NO: 400167 - protein, 9 aa, Homo Sapiens
AEVTNIYVK

SEQ ID NO: 400168 - protein, 9 aa, Homo Sapiens
SLRKERGMD

SEQ ID NO: 400169 - protein, 9 aa, Homo Sapiens
GEQGKPEVL

SEQ ID NO: 400170 - protein, 9 aa, Homo Sapiens
ARRGKNIFV

SEQ ID NO: 400171 - protein, 9 aa, Homo Sapiens
VADSIPKVL

SEQ ID NO: 400172 - protein, 9 aa, Homo Sapiens
FFYLSDYER

SEQ ID NO: 400173 - protein, 9 aa, Homo Sapiens
QQNVLKVLT

SEQ ID NO: 400174 - protein, 9 aa, Homo Sapiens
SFNSMNWRQ

SEQ ID NO: 400175 - protein, 9 aa, Homo Sapiens
HLKNTSRGS

SEQ ID NO: 400176 - protein, 9 aa, Homo Sapiens
SINSIIDYI

SEQ ID NO: 400177 - protein, 9 aa, Homo Sapiens
PVKARALKS

SEQ ID NO: 400178 - protein, 9 aa, Homo Sapiens
ARDIQDMQI

SEQ ID NO: 400179 - protein, 9 aa, Homo Sapiens
QNKIGAYDQ

SEQ ID NO: 400180 - protein, 9 aa, Homo Sapiens
PKLDIEKTK

SEQ ID NO: 400181 - protein, 9 aa, Homo Sapiens
ELSKAYGKF

SEQ ID NO: 400182 - protein, 9 aa, Homo Sapiens
KQPISRWIA

SEQ ID NO: 400183 - protein, 9 aa, Homo Sapiens
MISVKINTW

SEQ ID NO: 400184 - protein, 9 aa, Homo Sapiens
RDFRNKSEE

SEQ ID NO: 400185 - protein, 9 aa, Homo Sapiens
LYTLDKVCQ

SEQ ID NO: 400186 - protein, 9 aa, Homo Sapiens
SCVQHLYLH

SEQ ID NO: 400187 - protein, 9 aa, Homo Sapiens
GTTLGCYNK

SEQ ID NO: 400188 - protein, 9 aa, Homo Sapiens
VRGEKEYLD

SEQ ID NO: 400189 - protein, 9 aa, Homo Sapiens
DSNPHSGAI

SEQ ID NO: 400190 - protein, 9 aa, Homo Sapiens
FNNGNELNR

SEQ ID NO: 400191 - protein, 9 aa, Homo Sapiens
ANKRRLPRG

SEQ ID NO: 400192 - protein, 9 aa, Homo Sapiens
EDIKEFSEN

SEQ ID NO: 400193 - protein, 9 aa, Homo Sapiens
PEMFSSRQG

SEQ ID NO: 400194 - protein, 9 aa, Homo Sapiens
RSTDNLSCP

SEQ ID NO: 400195 - protein, 9 aa, Homo Sapiens
FAMRHGIES

SEQ ID NO: 400196 - protein, 9 aa, Homo Sapiens
HGNDPNYIV

SEQ ID NO: 400197 - protein, 9 aa, Homo Sapiens
ILKSTSVLS

SEQ ID NO: 400198 - protein, 9 aa, Homo Sapiens
REKAKQNTE

SEQ ID NO: 400199 - protein, 9 aa, Homo Sapiens
EAGLKMLRV

SEQ ID NO: 400200 - protein, 9 aa, Homo Sapiens
IARSQTNTA

SEQ ID NO: 400201 - protein, 9 aa, Homo Sapiens
PQSGIEGVF

SEQ ID NO: 400202 - protein, 9 aa, Homo Sapiens
YHHMTENRC

SEQ ID NO: 400203 - protein, 9 aa, Homo Sapiens
VFQNESVAG

SEQ ID NO: 400204 - protein, 9 aa, Homo Sapiens
AGRNTNGSP

SEQ ID NO: 400205 - protein, 9 aa, Homo Sapiens
KVVILFFHP

SEQ ID NO: 400206 - protein, 9 aa, Homo Sapiens
IKECINKTL

SEQ ID NO: 400207 - protein, 9 aa, Homo Sapiens
KKSIKGVSE

SEQ ID NO: 400208 - protein, 9 aa, Homo Sapiens
AWKESTIFQ

SEQ ID NO: 400209 - protein, 9 aa, Homo Sapiens
WDSIFILMI

SEQ ID NO: 400210 - protein, 9 aa, Homo Sapiens
MRYIHGVGE

SEQ ID NO: 400211 - protein, 9 aa, Homo Sapiens
NQFTTFNKG

SEQ ID NO: 400212 - protein, 9 aa, Homo Sapiens
KKEAPYMLV

SEQ ID NO: 400213 - protein, 9 aa, Homo Sapiens
LSEENESRW

SEQ ID NO: 400214 - protein, 9 aa, Homo Sapiens
EGFKLHFWR

SEQ ID NO: 400215 - protein, 9 aa, Homo Sapiens
GAVATKVQR

SEQ ID NO: 400216 - protein, 9 aa, Homo Sapiens
IKKLRLRVE

SEQ ID NO: 400217 - protein, 9 aa, Homo Sapiens
QNVYRDVML

SEQ ID NO: 400218 - protein, 9 aa, Homo Sapiens
SKSMGTLDN

SEQ ID NO: 400219 - protein, 9 aa, Homo Sapiens
CGYLMNGMK

SEQ ID NO: 400220 - protein, 9 aa, Homo Sapiens
PRRPYILKI

SEQ ID NO: 400221 - protein, 9 aa, Homo Sapiens
IIYIKHPHL

SEQ ID NO: 400222 - protein, 9 aa, Homo Sapiens
DKYWVEKLE

SEQ ID NO: 400223 - protein, 9 aa, Homo Sapiens
TYYCIFKVA

SEQ ID NO: 400224 - protein, 9 aa, Homo Sapiens
YVRGEKEYL

SEQ ID NO: 400225 - protein, 9 aa, Homo Sapiens
VVTQSEIDL

SEQ ID NO: 400226 - protein, 9 aa, Homo Sapiens
KLCKKLKAE

SEQ ID NO: 400227 - protein, 9 aa, Homo Sapiens
NQDPVYPSL

SEQ ID NO: 400228 - protein, 9 aa, Homo Sapiens
LHTDDEDDI

SEQ ID NO: 400229 - protein, 9 aa, Homo Sapiens
GNMSMAFSN

SEQ ID NO: 400230 - protein, 9 aa, Homo Sapiens
TVMNDPLYK

SEQ ID NO: 400231 - protein, 9 aa, Homo Sapiens
QLVRVLDNI

SEQ ID NO: 400232 - protein, 9 aa, Homo Sapiens
YTAEKPCKC

SEQ ID NO: 400233 - protein, 9 aa, Homo Sapiens
TLDNTFEGH

SEQ ID NO: 400234 - protein, 9 aa, Homo Sapiens
WATYKQGFS

SEQ ID NO: 400235 - protein, 9 aa, Homo Sapiens
LRLKLCKKL

SEQ ID NO: 400236 - protein, 9 aa, Homo Sapiens
PSNKDENGL

SEQ ID NO: 400237 - protein, 9 aa, Homo Sapiens
EDDNLEDES

SEQ ID NO: 400238 - protein, 9 aa, Homo Sapiens
YEDRHNGVP

SEQ ID NO: 400239 - protein, 9 aa, Homo Sapiens
LRKIIRRDL

SEQ ID NO: 400240 - protein, 9 aa, Homo Sapiens
FPGQQLVTQ

SEQ ID NO: 400241 - protein, 9 aa, Homo Sapiens
KLFDDLGDE

SEQ ID NO: 400242 - protein, 9 aa, Homo Sapiens
ILTQTALNL

SEQ ID NO: 400243 - protein, 9 aa, Homo Sapiens
TQPTCHNFN

SEQ ID NO: 400244 - protein, 9 aa, Homo Sapiens
NFFLLKRFN

SEQ ID NO: 400245 - protein, 9 aa, Homo Sapiens
GSGPTVCQL

SEQ ID NO: 400246 - protein, 9 aa, Homo Sapiens
LCIGNKNNQ

SEQ ID NO: 400247 - protein, 9 aa, Homo Sapiens
NIPQREVVN

SEQ ID NO: 400248 - protein, 9 aa, Homo Sapiens
SQEHLTNNE

SEQ ID NO: 400249 - protein, 9 aa, Homo Sapiens
QNFYHQQQQ

SEQ ID NO: 400250 - protein, 9 aa, Homo Sapiens
YLEELTLRE

SEQ ID NO: 400251 - protein, 9 aa, Homo Sapiens
QARRLQIRY

SEQ ID NO: 400252 - protein, 9 aa, Homo Sapiens
VLSTHHNIR

SEQ ID NO: 400253 - protein, 9 aa, Homo Sapiens
FKHLDYASI

SEQ ID NO: 400254 - protein, 9 aa, Homo Sapiens
PSNFKVRLF

SEQ ID NO: 400255 - protein, 9 aa, Homo Sapiens
LLANDPTYL

SEQ ID NO: 400256 - protein, 9 aa, Homo Sapiens
NKRAFKTQC

SEQ ID NO: 400257 - protein, 9 aa, Homo Sapiens
AKHSINGIL

SEQ ID NO: 400258 - protein, 9 aa, Homo Sapiens
GQSYFRSTA

SEQ ID NO: 400259 - protein, 9 aa, Homo Sapiens
QISGKMALN

SEQ ID NO: 400260 - protein, 9 aa, Homo Sapiens
TDSQKLNNI

SEQ ID NO: 400261 - protein, 9 aa, Homo Sapiens
PDPRHNKAY

SEQ ID NO: 400262 - protein, 9 aa, Homo Sapiens
EAQYELIAQ

SEQ ID NO: 400263 - protein, 9 aa, Homo Sapiens
ALTVHQLTH

SEQ ID NO: 400264 - protein, 9 aa, Homo Sapiens
EKEKNKLQK

SEQ ID NO: 400265 - protein, 9 aa, Homo Sapiens
FNSWCRHLK

SEQ ID NO: 400266 - protein, 9 aa, Homo Sapiens
IYSHDGTNS

SEQ ID NO: 400267 - protein, 9 aa, Homo Sapiens
STYLNVHTQ

SEQ ID NO: 400268 - protein, 9 aa, Homo Sapiens
KQDKKPRKI

SEQ ID NO: 400269 - protein, 9 aa, Homo Sapiens
IGLQLLMGN

SEQ ID NO: 400270 - protein, 9 aa, Homo Sapiens
STLVKIILQ

SEQ ID NO: 400271 - protein, 9 aa, Homo Sapiens
SPKNLAAPS

SEQ ID NO: 400272 - protein, 9 aa, Homo Sapiens
YYCIFKVAR

SEQ ID NO: 400273 - protein, 9 aa, Homo Sapiens
KLIEQDFRK

SEQ ID NO: 400274 - protein, 9 aa, Homo Sapiens
EISLWGVKL

SEQ ID NO: 400275 - protein, 9 aa, Homo Sapiens
QFTTFNKGK

SEQ ID NO: 400276 - protein, 9 aa, Homo Sapiens
TLPTVSITV

SEQ ID NO: 400277 - protein, 9 aa, Homo Sapiens
IDNFAQAFG

SEQ ID NO: 400278 - protein, 9 aa, Homo Sapiens
EEQPKKYQV

SEQ ID NO: 400279 - protein, 9 aa, Homo Sapiens
ADVKLSFQC

SEQ ID NO: 400280 - protein, 9 aa, Homo Sapiens
RYIHGVGEL

SEQ ID NO: 400281 - protein, 9 aa, Homo Sapiens
WDNIERDMV

SEQ ID NO: 400282 - protein, 9 aa, Homo Sapiens
AATWRVYLR

SEQ ID NO: 400283 - protein, 9 aa, Homo Sapiens
GVARRGKNI

SEQ ID NO: 400284 - protein, 9 aa, Homo Sapiens
RKKEIELLS

SEQ ID NO: 400285 - protein, 9 aa, Homo Sapiens
TCIDLYKSY

SEQ ID NO: 400286 - protein, 9 aa, Homo Sapiens
WEENHTDKF

SEQ ID NO: 400287 - protein, 9 aa, Homo Sapiens
GIRGNKLHF

SEQ ID NO: 400288 - protein, 9 aa, Homo Sapiens
GLMLAIRSI

SEQ ID NO: 400289 - protein, 9 aa, Homo Sapiens
FDDLFPISQ

SEQ ID NO: 400290 - protein, 9 aa, Homo Sapiens
LPATQLQIA

SEQ ID NO: 400291 - protein, 9 aa, Homo Sapiens
FDLFNKAID

SEQ ID NO: 400292 - protein, 9 aa, Homo Sapiens
QYDQAKLSQ

SEQ ID NO: 400293 - protein, 9 aa, Homo Sapiens
VVRWTGSHP

SEQ ID NO: 400294 - protein, 9 aa, Homo Sapiens
KKIIQLSPK

SEQ ID NO: 400295 - protein, 9 aa, Homo Sapiens
LWEQIQKMA

SEQ ID NO: 400296 - protein, 9 aa, Homo Sapiens
SPLLREGKL

SEQ ID NO: 400297 - protein, 9 aa, Homo Sapiens
IKQTIVLDC

SEQ ID NO: 400298 - protein, 9 aa, Homo Sapiens
HYKICKLDN

SEQ ID NO: 400299 - protein, 9 aa, Homo Sapiens
ALEYFMKQI

SEQ ID NO: 400300 - protein, 9 aa, Homo Sapiens
NDMFQYNEE

SEQ ID NO: 400301 - protein, 9 aa, Homo Sapiens
AVMGGVFIG

SEQ ID NO: 400302 - protein, 9 aa, Homo Sapiens
PLSNHVQRQ

SEQ ID NO: 400303 - protein, 9 aa, Homo Sapiens
ALTSACTEH

SEQ ID NO: 400304 - protein, 9 aa, Homo Sapiens
LFQQPPEMA

SEQ ID NO: 400305 - protein, 9 aa, Homo Sapiens
NNWLQTDWI

SEQ ID NO: 400306 - protein, 9 aa, Homo Sapiens
NLSVAQCQL

SEQ ID NO: 400307 - protein, 9 aa, Homo Sapiens
AAGLLGSDD

SEQ ID NO: 400308 - protein, 9 aa, Homo Sapiens
KMLQLERNI

SEQ ID NO: 400309 - protein, 9 aa, Homo Sapiens
SLEKLNLGD

SEQ ID NO: 400310 - protein, 9 aa, Homo Sapiens
DEDDNLEDE

SEQ ID NO: 400311 - protein, 9 aa, Homo Sapiens
SSRLGEFWL

SEQ ID NO: 400312 - protein, 9 aa, Homo Sapiens
RTPFQIGIK

SEQ ID NO: 400313 - protein, 9 aa, Homo Sapiens
KSAVYFLLP

SEQ ID NO: 400314 - protein, 9 aa, Homo Sapiens
LSNKKKNTQ

SEQ ID NO: 400315 - protein, 9 aa, Homo Sapiens
KNTSRGSAG

SEQ ID NO: 400316 - protein, 9 aa, Homo Sapiens
STHSSHGPQ

SEQ ID NO: 400317 - protein, 9 aa, Homo Sapiens
LPEADSAGA

SEQ ID NO: 400318 - protein, 9 aa, Homo Sapiens
VMRKMLNHL

SEQ ID NO: 400319 - protein, 9 aa, Homo Sapiens
SQRKLKKQR

SEQ ID NO: 400320 - protein, 9 aa, Homo Sapiens
TQLTFFFLI

SEQ ID NO: 400321 - protein, 9 aa, Homo Sapiens
YVHRIIHTG

SEQ ID NO: 400322 - protein, 9 aa, Homo Sapiens
QAPLITPLC

SEQ ID NO: 400323 - protein, 9 aa, Homo Sapiens
TSIKSQEPA

SEQ ID NO: 400324 - protein, 9 aa, Homo Sapiens
KISKIEGKE

SEQ ID NO: 400325 - protein, 9 aa, Homo Sapiens
PEDNEMVCF

SEQ ID NO: 400326 - protein, 9 aa, Homo Sapiens
YKLYPNAQR

SEQ ID NO: 400327 - protein, 9 aa, Homo Sapiens
NAKSICCCL

SEQ ID NO: 400328 - protein, 9 aa, Homo Sapiens
LCYYYFTIG

SEQ ID NO: 400329 - protein, 9 aa, Homo Sapiens
KMGLMLAIR

SEQ ID NO: 400330 - protein, 9 aa, Homo Sapiens
GDYIIQEGA

SEQ ID NO: 400331 - protein, 9 aa, Homo Sapiens
GKAFRQAPH

SEQ ID NO: 400332 - protein, 9 aa, Homo Sapiens
RTILKIIHL

SEQ ID NO: 400333 - protein, 9 aa, Homo Sapiens
YKQGFSSRL

SEQ ID NO: 400334 - protein, 9 aa, Homo Sapiens
AIAGEDVAI

SEQ ID NO: 400335 - protein, 9 aa, Homo Sapiens
IMCITYYCI

SEQ ID NO: 400336 - protein, 9 aa, Homo Sapiens
QGPFYFCRL

SEQ ID NO: 400337 - protein, 9 aa, Homo Sapiens
IEGKELLLY

SEQ ID NO: 400338 - protein, 9 aa, Homo Sapiens
SRNLMVHQI

SEQ ID NO: 400339 - protein, 9 aa, Homo Sapiens
AKITYRELR

SEQ ID NO: 400340 - protein, 9 aa, Homo Sapiens
QIVTSIKSQ

SEQ ID NO: 400341 - protein, 9 aa, Homo Sapiens
KAKKAQKVK

SEQ ID NO: 400342 - protein, 9 aa, Homo Sapiens
EAHKAEAEE

SEQ ID NO: 400343 - protein, 9 aa, Homo Sapiens
SKAAAVMGG

SEQ ID NO: 400344 - protein, 9 aa, Homo Sapiens
GKINQYTPE

SEQ ID NO: 400345 - protein, 9 aa, Homo Sapiens
VSVQRLAIL

SEQ ID NO: 400346 - protein, 9 aa, Homo Sapiens
SRNVHNILQ

SEQ ID NO: 400347 - protein, 9 aa, Homo Sapiens
NRTALHLAS

SEQ ID NO: 400348 - protein, 9 aa, Homo Sapiens
EVELNMIAT

SEQ ID NO: 400349 - protein, 9 aa, Homo Sapiens
EEKLKETET

SEQ ID NO: 400350 - protein, 9 aa, Homo Sapiens
SQKVKAKKT

SEQ ID NO: 400351 - protein, 9 aa, Homo Sapiens
FKEHEIIHT

SEQ ID NO: 400352 - protein, 9 aa, Homo Sapiens
NGVPSHSSR

SEQ ID NO: 400353 - protein, 9 aa, Homo Sapiens
HVEIFILAV

SEQ ID NO: 400354 - protein, 9 aa, Homo Sapiens
DNSRPLQEK

SEQ ID NO: 400355 - protein, 9 aa, Homo Sapiens
KYVRGEKEY

SEQ ID NO: 400356 - protein, 9 aa, Homo Sapiens
QISSQRNCG

SEQ ID NO: 400357 - protein, 9 aa, Homo Sapiens
LDFLIVDVY

SEQ ID NO: 400358 - protein, 9 aa, Homo Sapiens
LKEGLDISR

SEQ ID NO: 400359 - protein, 9 aa, Homo Sapiens
KKGQKIAQN

SEQ ID NO: 400360 - protein, 9 aa, Homo Sapiens
LFPKGSQSV

SEQ ID NO: 400361 - protein, 9 aa, Homo Sapiens
RSPLQTPSL

SEQ ID NO: 400362 - protein, 9 aa, Homo Sapiens
MDISSKLIS

SEQ ID NO: 400363 - protein, 9 aa, Homo Sapiens
WGMVSSYNV

SEQ ID NO: 400364 - protein, 9 aa, Homo Sapiens
STTMECVPV

SEQ ID NO: 400365 - protein, 9 aa, Homo Sapiens
DPRHNKAYV

SEQ ID NO: 400366 - protein, 9 aa, Homo Sapiens
HQLTHTGEK

SEQ ID NO: 400367 - protein, 9 aa, Homo Sapiens
SSQRLAEIQ

SEQ ID NO: 400368 - protein, 9 aa, Homo Sapiens
GSGYDKLGP

SEQ ID NO: 400369 - protein, 9 aa, Homo Sapiens
IMRVPHSVW

SEQ ID NO: 400370 - protein, 9 aa, Homo Sapiens
LSDLEENDS

SEQ ID NO: 400371 - protein, 9 aa, Homo Sapiens
FLNAKKLYG

SEQ ID NO: 400372 - protein, 9 aa, Homo Sapiens
FITHQIIHT

SEQ ID NO: 400373 - protein, 9 aa, Homo Sapiens
RMDEEQKLH

SEQ ID NO: 400374 - protein, 9 aa, Homo Sapiens
SHTKYLKNQ

SEQ ID NO: 400375 - protein, 9 aa, Homo Sapiens
TQSEIDLVQ

SEQ ID NO: 400376 - protein, 9 aa, Homo Sapiens
VTFAVPKSS

SEQ ID NO: 400377 - protein, 9 aa, Homo Sapiens
SSAPATRTS

SEQ ID NO: 400378 - protein, 9 aa, Homo Sapiens
LIIEIEIGD

SEQ ID NO: 400379 - protein, 9 aa, Homo Sapiens
MTPSAVGRE

SEQ ID NO: 400380 - protein, 9 aa, Homo Sapiens
TGVLKPGTV

SEQ ID NO: 400381 - protein, 9 aa, Homo Sapiens
KGLNNVFDE

SEQ ID NO: 400382 - protein, 9 aa, Homo Sapiens
TEVHGTIQT

SEQ ID NO: 400383 - protein, 9 aa, Homo Sapiens
VGEHVVSVH

SEQ ID NO: 400384 - protein, 9 aa, Homo Sapiens
DLIRKMSPH

SEQ ID NO: 400385 - protein, 9 aa, Homo Sapiens
ALVLFAHEL

SEQ ID NO: 400386 - protein, 9 aa, Homo Sapiens
ANFNSWCRH

SEQ ID NO: 400387 - protein, 9 aa, Homo Sapiens
FPSPGKDPT

SEQ ID NO: 400388 - protein, 9 aa, Homo Sapiens
HDRDRKCRE

SEQ ID NO: 400389 - protein, 9 aa, Homo Sapiens
LYYNISGTG

SEQ ID NO: 400390 - protein, 9 aa, Homo Sapiens
TQKKWKSIT

SEQ ID NO: 400391 - protein, 9 aa, Homo Sapiens
TCMENGWFP

SEQ ID NO: 400392 - protein, 9 aa, Homo Sapiens
SLWERLVYG

SEQ ID NO: 400393 - protein, 9 aa, Homo Sapiens
STSALNNEL

SEQ ID NO: 400394 - protein, 9 aa, Homo Sapiens
SRLIQGESI

SEQ ID NO: 400395 - protein, 9 aa, Homo Sapiens
HEITHTGEK

SEQ ID NO: 400396 - protein, 9 aa, Homo Sapiens
AIPPIQLED

SEQ ID NO: 400397 - protein, 9 aa, Homo Sapiens
VDTGVNGEM

SEQ ID NO: 400398 - protein, 9 aa, Homo Sapiens
LTKGWIVWA

SEQ ID NO: 400399 - protein, 9 aa, Homo Sapiens
SDENNCVKK

SEQ ID NO: 400400 - protein, 9 aa, Homo Sapiens
YPQTKCEYM

SEQ ID NO: 400401 - protein, 9 aa, Homo Sapiens
TKELKKKWL

SEQ ID NO: 400402 - protein, 9 aa, Homo Sapiens
CVDGSDENN

SEQ ID NO: 400403 - protein, 9 aa, Homo Sapiens
PEKEKNKLQ

SEQ ID NO: 400404 - protein, 9 aa, Homo Sapiens
NLARVLDLG

SEQ ID NO: 400405 - protein, 9 aa, Homo Sapiens
EINGNLEGE

SEQ ID NO: 400406 - protein, 9 aa, Homo Sapiens
LRLRGPSQA

SEQ ID NO: 400407 - protein, 9 aa, Homo Sapiens
PENQMVFSE

SEQ ID NO: 400408 - protein, 9 aa, Homo Sapiens
NPIYQENNE

SEQ ID NO: 400409 - protein, 9 aa, Homo Sapiens
QNSGNDISW

SEQ ID NO: 400410 - protein, 9 aa, Homo Sapiens
TQGASFSIS

SEQ ID NO: 400411 - protein, 9 aa, Homo Sapiens
ELQIYMTQG

SEQ ID NO: 400412 - protein, 9 aa, Homo Sapiens
ELTLRESLS

SEQ ID NO: 400413 - protein, 9 aa, Homo Sapiens
SSLTLSSSF

SEQ ID NO: 400414 - protein, 9 aa, Homo Sapiens
DMGKEDYDN

SEQ ID NO: 400415 - protein, 9 aa, Homo Sapiens
ATGNCLEIS

SEQ ID NO: 400416 - protein, 9 aa, Homo Sapiens
FSILKEFNY

SEQ ID NO: 400417 - protein, 9 aa, Homo Sapiens
RIWELLPLV

SEQ ID NO: 400418 - protein, 9 aa, Homo Sapiens
KRLTREAMQ

SEQ ID NO: 400419 - protein, 9 aa, Homo Sapiens
TIFQMLIIE

SEQ ID NO: 400420 - protein, 9 aa, Homo Sapiens
NAQRAHLKT

SEQ ID NO: 400421 - protein, 9 aa, Homo Sapiens
APATRTSYS

SEQ ID NO: 400422 - protein, 9 aa, Homo Sapiens
ILVEGFDLH

SEQ ID NO: 400423 - protein, 9 aa, Homo Sapiens
LIFWNIKIR

SEQ ID NO: 400424 - protein, 9 aa, Homo Sapiens
LQFYLFFSL

SEQ ID NO: 400425 - protein, 9 aa, Homo Sapiens
LYIFNWNHC

SEQ ID NO: 400426 - protein, 9 aa, Homo Sapiens
TLGRYAHWV

SEQ ID NO: 400427 - protein, 9 aa, Homo Sapiens
SLYLVAYRV

SEQ ID NO: 400428 - protein, 9 aa, Homo Sapiens
FYGEQGKPE

SEQ ID NO: 400429 - protein, 9 aa, Homo Sapiens
MLVGSISEP

SEQ ID NO: 400430 - protein, 9 aa, Homo Sapiens
LEVPVNIIR

SEQ ID NO: 400431 - protein, 9 aa, Homo Sapiens
LLMHHRTHT

SEQ ID NO: 400432 - protein, 9 aa, Homo Sapiens
ENKRKQKRV

SEQ ID NO: 400433 - protein, 9 aa, Homo Sapiens
MAELSRDMN

SEQ ID NO: 400434 - protein, 9 aa, Homo Sapiens
NLYPEDKLD

SEQ ID NO: 400435 - protein, 9 aa, Homo Sapiens
GMVEIELYR

SEQ ID NO: 400436 - protein, 9 aa, Homo Sapiens
SAVGRERHS

SEQ ID NO: 400437 - protein, 9 aa, Homo Sapiens
YSVSNIPTE

SEQ ID NO: 400438 - protein, 9 aa, Homo Sapiens
QKQDKKPRK

SEQ ID NO: 400439 - protein, 9 aa, Homo Sapiens
SKTFEINQK

SEQ ID NO: 400440 - protein, 9 aa, Homo Sapiens
YSELDNGKR

SEQ ID NO: 400441 - protein, 9 aa, Homo Sapiens
YGKINQYTP

SEQ ID NO: 400442 - protein, 9 aa, Homo Sapiens
TKYLKNQES

SEQ ID NO: 400443 - protein, 9 aa, Homo Sapiens
LATRLNIFK

SEQ ID NO: 400444 - protein, 9 aa, Homo Sapiens
ANNLNQDNS

SEQ ID NO: 400445 - protein, 9 aa, Homo Sapiens
KHSINGILS

SEQ ID NO: 400446 - protein, 9 aa, Homo Sapiens
HYQITFTPS

SEQ ID NO: 400447 - protein, 9 aa, Homo Sapiens
GGGGGATGP

SEQ ID NO: 400448 - protein, 9 aa, Homo Sapiens
VESARVRIW

SEQ ID NO: 400449 - protein, 9 aa, Homo Sapiens
CQPYRSEFY

SEQ ID NO: 400450 - protein, 9 aa, Homo Sapiens
FPRPLIIFL

SEQ ID NO: 400451 - protein, 9 aa, Homo Sapiens
PFAHIQLKP

SEQ ID NO: 400452 - protein, 9 aa, Homo Sapiens
NYVVNFCKT

SEQ ID NO: 400453 - protein, 9 aa, Homo Sapiens
GEHVVSVHK

SEQ ID NO: 400454 - protein, 9 aa, Homo Sapiens
PGIDRRSSV

SEQ ID NO: 400455 - protein, 9 aa, Homo Sapiens
RFPQSTDQT

SEQ ID NO: 400456 - protein, 9 aa, Homo Sapiens
QNRTALHLA

SEQ ID NO: 400457 - protein, 9 aa, Homo Sapiens
LLALYKSVQ

SEQ ID NO: 400458 - protein, 9 aa, Homo Sapiens
ATNMFLAVM

SEQ ID NO: 400459 - protein, 9 aa, Homo Sapiens
PQQAQQLGI

SEQ ID NO: 400460 - protein, 9 aa, Homo Sapiens
NNLLDNNEA

SEQ ID NO: 400461 - protein, 9 aa, Homo Sapiens
KICCSPPNE

SEQ ID NO: 400462 - protein, 9 aa, Homo Sapiens
DLLDDGSNY

SEQ ID NO: 400463 - protein, 9 aa, Homo Sapiens
QNHWKKTTA

SEQ ID NO: 400464 - protein, 9 aa, Homo Sapiens
ANKAESWMR

SEQ ID NO: 400465 - protein, 9 aa, Homo Sapiens
KNKLQKQRE

SEQ ID NO: 400466 - protein, 9 aa, Homo Sapiens
TMECVPVTR

SEQ ID NO: 400467 - protein, 9 aa, Homo Sapiens
MNMHNIPLH

SEQ ID NO: 400468 - protein, 9 aa, Homo Sapiens
GYFCIEVGK

SEQ ID NO: 400469 - protein, 9 aa, Homo Sapiens
VLFCLNFLV

SEQ ID NO: 400470 - protein, 9 aa, Homo Sapiens
VESFKQTNV

SEQ ID NO: 400471 - protein, 9 aa, Homo Sapiens
EALGLFTSS

SEQ ID NO: 400472 - protein, 9 aa, Homo Sapiens
PLMRKLVRL

SEQ ID NO: 400473 - protein, 9 aa, Homo Sapiens
DLHHKDSED

SEQ ID NO: 400474 - protein, 9 aa, Homo Sapiens
SFLMSGGFD

SEQ ID NO: 400475 - protein, 9 aa, Homo Sapiens
ANDCLVLNE

SEQ ID NO: 400476 - protein, 9 aa, Homo Sapiens
MSVFQNESV

SEQ ID NO: 400477 - protein, 9 aa, Homo Sapiens
GSRLEKTEF

SEQ ID NO: 400478 - protein, 9 aa, Homo Sapiens
IQSWDNIER

SEQ ID NO: 400479 - protein, 9 aa, Homo Sapiens
GWDPNDMFQ

SEQ ID NO: 400480 - protein, 9 aa, Homo Sapiens
QRNCGAWSK

SEQ ID NO: 400481 - protein, 9 aa, Homo Sapiens
AGAERQALR

SEQ ID NO: 400482 - protein, 9 aa, Homo Sapiens
DGRVLFFAD

SEQ ID NO: 400483 - protein, 9 aa, Homo Sapiens
NFMWGLITQ

SEQ ID NO: 400484 - protein, 9 aa, Homo Sapiens
VIVDHPFLF

SEQ ID NO: 400485 - protein, 9 aa, Homo Sapiens
PNYIVMQFG

SEQ ID NO: 400486 - protein, 9 aa, Homo Sapiens
LFPISQVRL

SEQ ID NO: 400487 - protein, 9 aa, Homo Sapiens
SPLQEGEEG

SEQ ID NO: 400488 - protein, 9 aa, Homo Sapiens
DLFKFIEEL

SEQ ID NO: 400489 - protein, 9 aa, Homo Sapiens
RSRLFIKAL

SEQ ID NO: 400490 - protein, 9 aa, Homo Sapiens
KLQPRENVP

SEQ ID NO: 400491 - protein, 9 aa, Homo Sapiens
HEMLYDWIN

SEQ ID NO: 400492 - protein, 9 aa, Homo Sapiens
ELKKKWLEQ

SEQ ID NO: 400493 - protein, 9 aa, Homo Sapiens
WSFLYVTVL

SEQ ID NO: 400494 - protein, 9 aa, Homo Sapiens
SQNDMIEIP

SEQ ID NO: 400495 - protein, 9 aa, Homo Sapiens
DYLTQEVAT

SEQ ID NO: 400496 - protein, 9 aa, Homo Sapiens
LKPESGCLY

SEQ ID NO: 400497 - protein, 9 aa, Homo Sapiens
DKTRMAELS

SEQ ID NO: 400498 - protein, 9 aa, Homo Sapiens
MGAAALAES

SEQ ID NO: 400499 - protein, 9 aa, Homo Sapiens
YPNKPPNQK

SEQ ID NO: 400500 - protein, 9 aa, Homo Sapiens
KGLNFPSPG

SEQ ID NO: 400501 - protein, 9 aa, Homo Sapiens
LGTDPVSLI

SEQ ID NO: 400502 - protein, 9 aa, Homo Sapiens
VDNVYGYPE

SEQ ID NO: 400503 - protein, 9 aa, Homo Sapiens
LDTLVTQKV

SEQ ID NO: 400504 - protein, 9 aa, Homo Sapiens
QSSSLIQHW

SEQ ID NO: 400505 - protein, 9 aa, Homo Sapiens
AFRNLRKQS

SEQ ID NO: 400506 - protein, 9 aa, Homo Sapiens
NPYRKHMKK

SEQ ID NO: 400507 - protein, 9 aa, Homo Sapiens
GTHKGDYFY

SEQ ID NO: 400508 - protein, 9 aa, Homo Sapiens
KIHKSMIQM

SEQ ID NO: 400509 - protein, 9 aa, Homo Sapiens
MESPYQTGQ

SEQ ID NO: 400510 - protein, 9 aa, Homo Sapiens
NFPSPGKDP

SEQ ID NO: 400511 - protein, 9 aa, Homo Sapiens
SIKQTIVLD

SEQ ID NO: 400512 - protein, 9 aa, Homo Sapiens
GLARMELFI

SEQ ID NO: 400513 - protein, 9 aa, Homo Sapiens
GGQGKRKIL

SEQ ID NO: 400514 - protein, 9 aa, Homo Sapiens
CKKLKAEKK

SEQ ID NO: 400515 - protein, 9 aa, Homo Sapiens
HLLSSRNTI

SEQ ID NO: 400516 - protein, 9 aa, Homo Sapiens
VRKVTSISN

SEQ ID NO: 400517 - protein, 9 aa, Homo Sapiens
LNAKLLYIP

SEQ ID NO: 400518 - protein, 9 aa, Homo Sapiens
MAQVFFLII

SEQ ID NO: 400519 - protein, 9 aa, Homo Sapiens
DCRELESSQ

SEQ ID NO: 400520 - protein, 9 aa, Homo Sapiens
SLRYPTEDK

SEQ ID NO: 400521 - protein, 9 aa, Homo Sapiens
AFRALLKSE

SEQ ID NO: 400522 - protein, 9 aa, Homo Sapiens
LDNDKYITL

SEQ ID NO: 400523 - protein, 9 aa, Homo Sapiens
NNTGHICLS

SEQ ID NO: 400524 - protein, 9 aa, Homo Sapiens
VLYERSLLA

SEQ ID NO: 400525 - protein, 9 aa, Homo Sapiens
VVAICYGSG

SEQ ID NO: 400526 - protein, 9 aa, Homo Sapiens
PTDLIKHFQ

SEQ ID NO: 400527 - protein, 9 aa, Homo Sapiens
RVLFFADED

SEQ ID NO: 400528 - protein, 9 aa, Homo Sapiens
KKINAKRHD

SEQ ID NO: 400529 - protein, 9 aa, Homo Sapiens
STLNRHQKI

SEQ ID NO: 400530 - protein, 9 aa, Homo Sapiens
NQVLDSNNF

SEQ ID NO: 400531 - protein, 9 aa, Homo Sapiens
ALLKSEFCE

SEQ ID NO: 400532 - protein, 9 aa, Homo Sapiens
AALEKDHEA

SEQ ID NO: 400533 - protein, 9 aa, Homo Sapiens
QSAVAELDH

SEQ ID NO: 400534 - protein, 9 aa, Homo Sapiens
NIKIRLLAW

SEQ ID NO: 400535 - protein, 9 aa, Homo Sapiens
LWTICQNTT

SEQ ID NO: 400536 - protein, 9 aa, Homo Sapiens
LKSLVDPNN

SEQ ID NO: 400537 - protein, 9 aa, Homo Sapiens
QGEPGLPGD

SEQ ID NO: 400538 - protein, 9 aa, Homo Sapiens
EPRTTYQID

SEQ ID NO: 400539 - protein, 9 aa, Homo Sapiens
TREAMQNYL

SEQ ID NO: 400540 - protein, 9 aa, Homo Sapiens
FDEAMSYCQ

SEQ ID NO: 400541 - protein, 9 aa, Homo Sapiens
YLMNGMKSD

SEQ ID NO: 400542 - protein, 9 aa, Homo Sapiens
TPIYQLQLD

SEQ ID NO: 400543 - protein, 9 aa, Homo Sapiens
ALLSLYLVA

SEQ ID NO: 400544 - protein, 9 aa, Homo Sapiens
DNVYGYPEG

SEQ ID NO: 400545 - protein, 9 aa, Homo Sapiens
LVRYHEQIH

SEQ ID NO: 400546 - protein, 9 aa, Homo Sapiens
TVDPLLSKY

SEQ ID NO: 400547 - protein, 9 aa, Homo Sapiens
TDQIMMIFY

SEQ ID NO: 400548 - protein, 9 aa, Homo Sapiens
AEKHFQYQQ

SEQ ID NO: 400549 - protein, 9 aa, Homo Sapiens
NSPVLYERS

SEQ ID NO: 400550 - protein, 9 aa, Homo Sapiens
HLIQHKIIH

SEQ ID NO: 400551 - protein, 9 aa, Homo Sapiens
GPENQMVFS

SEQ ID NO: 400552 - protein, 9 aa, Homo Sapiens
QILVEGFDL

SEQ ID NO: 400553 - protein, 9 aa, Homo Sapiens
HKAVKAIAL

SEQ ID NO: 400554 - protein, 9 aa, Homo Sapiens
SNNIVVVLE

SEQ ID NO: 400555 - protein, 9 aa, Homo Sapiens
EAVDGVCFI

SEQ ID NO: 400556 - protein, 9 aa, Homo Sapiens
RIQVGKITI

SEQ ID NO: 400557 - protein, 9 aa, Homo Sapiens
GPKLDIEKT

SEQ ID NO: 400558 - protein, 9 aa, Homo Sapiens
TLEKIGKGS

SEQ ID NO: 400559 - protein, 9 aa, Homo Sapiens
DVCRRYWNA

SEQ ID NO: 400560 - protein, 9 aa, Homo Sapiens
KLEKHSAPS

SEQ ID NO: 400561 - protein, 9 aa, Homo Sapiens
WLGKVQNMV

SEQ ID NO: 400562 - protein, 9 aa, Homo Sapiens
REQGVISLT

SEQ ID NO: 400563 - protein, 9 aa, Homo Sapiens
SLDNWVCLA

SEQ ID NO: 400564 - protein, 9 aa, Homo Sapiens
TDAEDSPPS

SEQ ID NO: 400565 - protein, 9 aa, Homo Sapiens
TPPDFFYLS

SEQ ID NO: 400566 - protein, 9 aa, Homo Sapiens
LEVSAEIAQ

SEQ ID NO: 400567 - protein, 9 aa, Homo Sapiens
CHPLRYNML

SEQ ID NO: 400568 - protein, 9 aa, Homo Sapiens
EAPLNNLSV

SEQ ID NO: 400569 - protein, 9 aa, Homo Sapiens
PADARALGE

SEQ ID NO: 400570 - protein, 9 aa, Homo Sapiens
SHISTLHKS

SEQ ID NO: 400571 - protein, 9 aa, Homo Sapiens
SIKCFKTQP

SEQ ID NO: 400572 - protein, 9 aa, Homo Sapiens
NSIYQESAL

SEQ ID NO: 400573 - protein, 9 aa, Homo Sapiens
EEKKKPHIN

SEQ ID NO: 400574 - protein, 9 aa, Homo Sapiens
PRLRSRLFI

SEQ ID NO: 400575 - protein, 9 aa, Homo Sapiens
FEGYSLDNW

SEQ ID NO: 400576 - protein, 9 aa, Homo Sapiens
QRVMAQALD

SEQ ID NO: 400577 - protein, 9 aa, Homo Sapiens
RGKIEVTIQ

SEQ ID NO: 400578 - protein, 9 aa, Homo Sapiens
VYSSCKGGW

SEQ ID NO: 400579 - protein, 9 aa, Homo Sapiens
YSKATNADK

SEQ ID NO: 400580 - protein, 9 aa, Homo Sapiens
GDARKKQFW

SEQ ID NO: 400581 - protein, 9 aa, Homo Sapiens
VLFAHELHP

SEQ ID NO: 400582 - protein, 9 aa, Homo Sapiens
EDDLLLQYD

SEQ ID NO: 400583 - protein, 9 aa, Homo Sapiens
IKPLSLHQI

SEQ ID NO: 400584 - protein, 9 aa, Homo Sapiens
ISMADVKLS

SEQ ID NO: 400585 - protein, 9 aa, Homo Sapiens
SSIACWLMV

SEQ ID NO: 400586 - protein, 9 aa, Homo Sapiens
MLILETITS

SEQ ID NO: 400587 - protein, 9 aa, Homo Sapiens
EVTNIYVKN

SEQ ID NO: 400588 - protein, 9 aa, Homo Sapiens
PDFSSGGAT

SEQ ID NO: 400589 - protein, 9 aa, Homo Sapiens
QNNQTVFER

SEQ ID NO: 400590 - protein, 9 aa, Homo Sapiens
AELDHLYKE

SEQ ID NO: 400591 - protein, 9 aa, Homo Sapiens
CLDTAQNNL

SEQ ID NO: 400592 - protein, 9 aa, Homo Sapiens
NTVKISKIE

SEQ ID NO: 400593 - protein, 9 aa, Homo Sapiens
EISAFPSEC

SEQ ID NO: 400594 - protein, 9 aa, Homo Sapiens
TNMFLAVMR

SEQ ID NO: 400595 - protein, 9 aa, Homo Sapiens
FQYLNVANN

SEQ ID NO: 400596 - protein, 9 aa, Homo Sapiens
CINKTLTDK

SEQ ID NO: 400597 - protein, 9 aa, Homo Sapiens
SRKEYFNQT

SEQ ID NO: 400598 - protein, 9 aa, Homo Sapiens
LVVFILLSS

SEQ ID NO: 400599 - protein, 9 aa, Homo Sapiens
RTRFGKHLC

SEQ ID NO: 400600 - protein, 9 aa, Homo Sapiens
IGRQLLIQF

SEQ ID NO: 400601 - protein, 9 aa, Homo Sapiens
MAEVTNIYV

SEQ ID NO: 400602 - protein, 9 aa, Homo Sapiens
IRTWINDLI

SEQ ID NO: 400603 - protein, 9 aa, Homo Sapiens
HVFNVIPEL

SEQ ID NO: 400604 - protein, 9 aa, Homo Sapiens
ILVFHLKRF

SEQ ID NO: 400605 - protein, 9 aa, Homo Sapiens
TNEGSDDEG

SEQ ID NO: 400606 - protein, 9 aa, Homo Sapiens
LYHDMMLEN

SEQ ID NO: 400607 - protein, 9 aa, Homo Sapiens
SLCYYYFTI

SEQ ID NO: 400608 - protein, 9 aa, Homo Sapiens
SSKLISLNE

SEQ ID NO: 400609 - protein, 9 aa, Homo Sapiens
VQRHDMRVH

SEQ ID NO: 400610 - protein, 9 aa, Homo Sapiens
FGKHLCGGT

SEQ ID NO: 400611 - protein, 9 aa, Homo Sapiens
WYAPKCINF

SEQ ID NO: 400612 - protein, 9 aa, Homo Sapiens
YIFNWNHCG

SEQ ID NO: 400613 - protein, 9 aa, Homo Sapiens
GLNPHNFAA

SEQ ID NO: 400614 - protein, 9 aa, Homo Sapiens
LQIRYGQTK

SEQ ID NO: 400615 - protein, 9 aa, Homo Sapiens
KLSNPFRYI

SEQ ID NO: 400616 - protein, 9 aa, Homo Sapiens
TVKISKIEG

SEQ ID NO: 400617 - protein, 9 aa, Homo Sapiens
FILGSVSED

SEQ ID NO: 400618 - protein, 9 aa, Homo Sapiens
LYDVIPEEI

SEQ ID NO: 400619 - protein, 9 aa, Homo Sapiens
ASAALEQLK

SEQ ID NO: 400620 - protein, 9 aa, Homo Sapiens
YEKQCPATS

SEQ ID NO: 400621 - protein, 9 aa, Homo Sapiens
SQAPLITPL

SEQ ID NO: 400622 - protein, 9 aa, Homo Sapiens
LKLISLCYY

SEQ ID NO: 400623 - protein, 9 aa, Homo Sapiens
FIEWMAGGL

SEQ ID NO: 400624 - protein, 9 aa, Homo Sapiens
IQCRNITYK

SEQ ID NO: 400625 - protein, 9 aa, Homo Sapiens
AADLHASSG

SEQ ID NO: 400626 - protein, 9 aa, Homo Sapiens
WCHYKLYFA

SEQ ID NO: 400627 - protein, 9 aa, Homo Sapiens
MEAVHLICD

SEQ ID NO: 400628 - protein, 9 aa, Homo Sapiens
QAYFATPKM

SEQ ID NO: 400629 - protein, 9 aa, Homo Sapiens
FNLWTICQN

SEQ ID NO: 400630 - protein, 9 aa, Homo Sapiens
IDGLLNQYI

SEQ ID NO: 400631 - protein, 9 aa, Homo Sapiens
ARKKQFWYL

SEQ ID NO: 400632 - protein, 9 aa, Homo Sapiens
HKVQPQEPN

SEQ ID NO: 400633 - protein, 9 aa, Homo Sapiens
SQNNWLQTD

SEQ ID NO: 400634 - protein, 9 aa, Homo Sapiens
GNSYICCYY

SEQ ID NO: 400635 - protein, 9 aa, Homo Sapiens
EENHTDKFL

SEQ ID NO: 400636 - protein, 9 aa, Homo Sapiens
LPAIPPIQL

SEQ ID NO: 400637 - protein, 9 aa, Homo Sapiens
EKHIKAEKA

SEQ ID NO: 400638 - protein, 9 aa, Homo Sapiens
EMDISSKLI

SEQ ID NO: 400639 - protein, 9 aa, Homo Sapiens
FYFKEHEII

SEQ ID NO: 400640 - protein, 9 aa, Homo Sapiens
DDNLEDESI

SEQ ID NO: 400641 - protein, 9 aa, Homo Sapiens
NPEDAGAER

SEQ ID NO: 400642 - protein, 9 aa, Homo Sapiens
HTQTHTGAK

SEQ ID NO: 400643 - protein, 9 aa, Homo Sapiens
ASQNNSKTA

SEQ ID NO: 400644 - protein, 9 aa, Homo Sapiens
IAQENVQGV

SEQ ID NO: 400645 - protein, 9 aa, Homo Sapiens
KLSFQCPGR

SEQ ID NO: 400646 - protein, 9 aa, Homo Sapiens
RKRSMGLII

SEQ ID NO: 400647 - protein, 9 aa, Homo Sapiens
YQIDNFAQA

SEQ ID NO: 400648 - protein, 9 aa, Homo Sapiens
GDEPAESPL

SEQ ID NO: 400649 - protein, 9 aa, Homo Sapiens
GLQDKILKK

SEQ ID NO: 400650 - protein, 9 aa, Homo Sapiens
NELFAYAAQ

SEQ ID NO: 400651 - protein, 9 aa, Homo Sapiens
VTFFPFYLQ

SEQ ID NO: 400652 - protein, 9 aa, Homo Sapiens
HLTNNEEIL

SEQ ID NO: 400653 - protein, 9 aa, Homo Sapiens
LKETETVEA

SEQ ID NO: 400654 - protein, 9 aa, Homo Sapiens
FFLDIYLPI

SEQ ID NO: 400655 - protein, 9 aa, Homo Sapiens
SGNNMTKST

SEQ ID NO: 400656 - protein, 9 aa, Homo Sapiens
AAAVLFQMS

SEQ ID NO: 400657 - protein, 9 aa, Homo Sapiens
QGIQLFDRL

SEQ ID NO: 400658 - protein, 9 aa, Homo Sapiens
KAWFDQHQI

SEQ ID NO: 400659 - protein, 9 aa, Homo Sapiens
DVRTIDEDC

SEQ ID NO: 400660 - protein, 9 aa, Homo Sapiens
ENKSSISQI

SEQ ID NO: 400661 - protein, 9 aa, Homo Sapiens
SSETRVQDL

SEQ ID NO: 400662 - protein, 9 aa, Homo Sapiens
LSRQFQKVK

SEQ ID NO: 400663 - protein, 9 aa, Homo Sapiens
DNPEIKIRI

SEQ ID NO: 400664 - protein, 9 aa, Homo Sapiens
CPQVDKGDL

SEQ ID NO: 400665 - protein, 9 aa, Homo Sapiens
MGIISPFSC

SEQ ID NO: 400666 - protein, 9 aa, Homo Sapiens
FEEFKKLIC

SEQ ID NO: 400667 - protein, 9 aa, Homo Sapiens
QSWDNIERD

SEQ ID NO: 400668 - protein, 9 aa, Homo Sapiens
GEMSYSLFQ

SEQ ID NO: 400669 - protein, 9 aa, Homo Sapiens
DIFYYFWYN

SEQ ID NO: 400670 - protein, 9 aa, Homo Sapiens
DKVHELCDN

SEQ ID NO: 400671 - protein, 9 aa, Homo Sapiens
LIPDHPNFT

SEQ ID NO: 400672 - protein, 9 aa, Homo Sapiens
DVYLVTLVA

SEQ ID NO: 400673 - protein, 9 aa, Homo Sapiens
NDIGHKIYS

SEQ ID NO: 400674 - protein, 9 aa, Homo Sapiens
SALFPKGSQ

SEQ ID NO: 400675 - protein, 9 aa, Homo Sapiens
KVWLVDAGF

SEQ ID NO: 400676 - protein, 9 aa, Homo Sapiens
KIIGKNAEI

SEQ ID NO: 400677 - protein, 9 aa, Homo Sapiens
QKAQEHVFN

SEQ ID NO: 400678 - protein, 9 aa, Homo Sapiens
LARSHRDTT

SEQ ID NO: 400679 - protein, 9 aa, Homo Sapiens
IKEFSENNG

SEQ ID NO: 400680 - protein, 9 aa, Homo Sapiens
GSYFALTND

SEQ ID NO: 400681 - protein, 9 aa, Homo Sapiens
QNEAEIKKL

SEQ ID NO: 400682 - protein, 9 aa, Homo Sapiens
TTYQRDYSL

SEQ ID NO: 400683 - protein, 9 aa, Homo Sapiens
CEPSFATGN

SEQ ID NO: 400684 - protein, 9 aa, Homo Sapiens
RSEVPAINL

SEQ ID NO: 400685 - protein, 9 aa, Homo Sapiens
DCEDVRTID

SEQ ID NO: 400686 - protein, 9 aa, Homo Sapiens
KAKRSLKSE

SEQ ID NO: 400687 - protein, 9 aa, Homo Sapiens
VLGGRTFKK

SEQ ID NO: 400688 - protein, 9 aa, Homo Sapiens
QSIIHAKIT

SEQ ID NO: 400689 - protein, 9 aa, Homo Sapiens
VDKQCQEGS

SEQ ID NO: 400690 - protein, 9 aa, Homo Sapiens
SALEQHKIQ

SEQ ID NO: 400691 - protein, 9 aa, Homo Sapiens
VYRDVMLEN

SEQ ID NO: 400692 - protein, 9 aa, Homo Sapiens
APLNNLSVA

SEQ ID NO: 400693 - protein, 9 aa, Homo Sapiens
VDEKWGPKL

SEQ ID NO: 400694 - protein, 9 aa, Homo Sapiens
NSIIDYIST

SEQ ID NO: 400695 - protein, 9 aa, Homo Sapiens
TRDDCGWFV

SEQ ID NO: 400696 - protein, 9 aa, Homo Sapiens
RKILFSKEL

SEQ ID NO: 400697 - protein, 9 aa, Homo Sapiens
EKYSKATNA

SEQ ID NO: 400698 - protein, 9 aa, Homo Sapiens
RFNPVRGEV

SEQ ID NO: 400699 - protein, 9 aa, Homo Sapiens
VCIATKKHT

SEQ ID NO: 400700 - protein, 9 aa, Homo Sapiens
AAAFEEAVQ

SEQ ID NO: 400701 - protein, 9 aa, Homo Sapiens
WAPHINKKS

SEQ ID NO: 400702 - protein, 9 aa, Homo Sapiens
CQAYFATPK

SEQ ID NO: 400703 - protein, 9 aa, Homo Sapiens
EYIILLSEM

SEQ ID NO: 400704 - protein, 9 aa, Homo Sapiens
LHTENRLLK

SEQ ID NO: 400705 - protein, 9 aa, Homo Sapiens
AGVDVGNHY

SEQ ID NO: 400706 - protein, 9 aa, Homo Sapiens
DKKPRKIML

SEQ ID NO: 400707 - protein, 9 aa, Homo Sapiens
KGVLSTHHN

SEQ ID NO: 400708 - protein, 9 aa, Homo Sapiens
YHHLPSRGI

SEQ ID NO: 400709 - protein, 9 aa, Homo Sapiens
PIYQENNEN

SEQ ID NO: 400710 - protein, 9 aa, Homo Sapiens
MQNSGNDIS

SEQ ID NO: 400711 - protein, 9 aa, Homo Sapiens
LAKNEYIKG

SEQ ID NO: 400712 - protein, 9 aa, Homo Sapiens
WVLAVQQVV

SEQ ID NO: 400713 - protein, 9 aa, Homo Sapiens
VNYPAVNSL

SEQ ID NO: 400714 - protein, 9 aa, Homo Sapiens
EQHKIQSQQ

SEQ ID NO: 400715 - protein, 9 aa, Homo Sapiens
TDQKEFVRK

SEQ ID NO: 400716 - protein, 9 aa, Homo Sapiens
NAKLLYIPL

SEQ ID NO: 400717 - protein, 9 aa, Homo Sapiens
DQKLCKSVF

SEQ ID NO: 400718 - protein, 9 aa, Homo Sapiens
AQLHEANQQ

SEQ ID NO: 400719 - protein, 9 aa, Homo Sapiens
DILKVVILF

SEQ ID NO: 400720 - protein, 9 aa, Homo Sapiens
CLMIIYRLK

SEQ ID NO: 400721 - protein, 9 aa, Homo Sapiens
LQSSLSTSI

SEQ ID NO: 400722 - protein, 9 aa, Homo Sapiens
VTIKYLESE

SEQ ID NO: 400723 - protein, 9 aa, Homo Sapiens
PENIISQEE

SEQ ID NO: 400724 - protein, 9 aa, Homo Sapiens
MECVPVTRS

SEQ ID NO: 400725 - protein, 9 aa, Homo Sapiens
GGRIHSKDI

SEQ ID NO: 400726 - protein, 9 aa, Homo Sapiens
PKIRSVSSQ

SEQ ID NO: 400727 - protein, 9 aa, Homo Sapiens
VHIVHSDNW

SEQ ID NO: 400728 - protein, 9 aa, Homo Sapiens
SDCIATALR

SEQ ID NO: 400729 - protein, 9 aa, Homo Sapiens
EKNKTVDLL

SEQ ID NO: 400730 - protein, 9 aa, Homo Sapiens
MPLLYMQFR

SEQ ID NO: 400731 - protein, 9 aa, Homo Sapiens
IRNKNRELE

SEQ ID NO: 400732 - protein, 9 aa, Homo Sapiens
MKKTFQLIW

SEQ ID NO: 400733 - protein, 9 aa, Homo Sapiens
KEVNKHISI

SEQ ID NO: 400734 - protein, 9 aa, Homo Sapiens
KHLDYASIF

SEQ ID NO: 400735 - protein, 9 aa, Homo Sapiens
NNGFSLFDA

SEQ ID NO: 400736 - protein, 9 aa, Homo Sapiens
AQESQSQAI

SEQ ID NO: 400737 - protein, 9 aa, Homo Sapiens
ATALRSGNK

SEQ ID NO: 400738 - protein, 9 aa, Homo Sapiens
SGRTILKII

SEQ ID NO: 400739 - protein, 9 aa, Homo Sapiens
TTLEKIGKG

SEQ ID NO: 400740 - protein, 9 aa, Homo Sapiens
YSSLSSGHV

SEQ ID NO: 400741 - protein, 9 aa, Homo Sapiens
FMKQINDAH

SEQ ID NO: 400742 - protein, 9 aa, Homo Sapiens
SLNKANKRR

SEQ ID NO: 400743 - protein, 9 aa, Homo Sapiens
KAKKEIEKC

SEQ ID NO: 400744 - protein, 9 aa, Homo Sapiens
IEEGVLQHL

SEQ ID NO: 400745 - protein, 9 aa, Homo Sapiens
GNLPLHLTA

SEQ ID NO: 400746 - protein, 9 aa, Homo Sapiens
LVLHGAEVT

SEQ ID NO: 400747 - protein, 9 aa, Homo Sapiens
LTPLKEHPD

SEQ ID NO: 400748 - protein, 9 aa, Homo Sapiens
GIIGINRTR

SEQ ID NO: 400749 - protein, 9 aa, Homo Sapiens
PFFLDIYLP

SEQ ID NO: 400750 - protein, 9 aa, Homo Sapiens
ARHIQRSLS

SEQ ID NO: 400751 - protein, 9 aa, Homo Sapiens
EMLYDWINP

SEQ ID NO: 400752 - protein, 9 aa, Homo Sapiens
SISKKDIIN

SEQ ID NO: 400753 - protein, 9 aa, Homo Sapiens
SQNSSLHSH

SEQ ID NO: 400754 - protein, 9 aa, Homo Sapiens
LAQIEEFKK

SEQ ID NO: 400755 - protein, 9 aa, Homo Sapiens
DTLKDENSK

SEQ ID NO: 400756 - protein, 9 aa, Homo Sapiens
PEHFVLDIN

SEQ ID NO: 400757 - protein, 9 aa, Homo Sapiens
LRKQSIEIS

SEQ ID NO: 400758 - protein, 9 aa, Homo Sapiens
VFTRHVHFL

SEQ ID NO: 400759 - protein, 9 aa, Homo Sapiens
ACLERKQKW

SEQ ID NO: 400760 - protein, 9 aa, Homo Sapiens
LPIPPNGHH

SEQ ID NO: 400761 - protein, 9 aa, Homo Sapiens
VDEFAMRHG

SEQ ID NO: 400762 - protein, 9 aa, Homo Sapiens
SISQLLSQT

SEQ ID NO: 400763 - protein, 9 aa, Homo Sapiens
GVNGEMSYS

SEQ ID NO: 400764 - protein, 9 aa, Homo Sapiens
ISAFPSECC

SEQ ID NO: 400765 - protein, 9 aa, Homo Sapiens
LLSSELEQY

SEQ ID NO: 400766 - protein, 9 aa, Homo Sapiens
RTEHKKIHT

SEQ ID NO: 400767 - protein, 9 aa, Homo Sapiens
HSINGILSE

SEQ ID NO: 400768 - protein, 9 aa, Homo Sapiens
SITCWTLGR

SEQ ID NO: 400769 - protein, 9 aa, Homo Sapiens
IFHADMAKK

SEQ ID NO: 400770 - protein, 9 aa, Homo Sapiens
FKPLFVDLT

SEQ ID NO: 400771 - protein, 9 aa, Homo Sapiens
HTALVLFAH

SEQ ID NO: 400772 - protein, 9 aa, Homo Sapiens
STLTNHKII

SEQ ID NO: 400773 - protein, 9 aa, Homo Sapiens
EKQCPATSK

SEQ ID NO: 400774 - protein, 9 aa, Homo Sapiens
GSTLNRHQK

SEQ ID NO: 400775 - protein, 9 aa, Homo Sapiens
QKAKELAQI

SEQ ID NO: 400776 - protein, 9 aa, Homo Sapiens
NSSLSNHQI

SEQ ID NO: 400777 - protein, 9 aa, Homo Sapiens
GKRKILFSK

SEQ ID NO: 400778 - protein, 9 aa, Homo Sapiens
RPLNDLCKT

SEQ ID NO: 400779 - protein, 9 aa, Homo Sapiens
TDYQARRLQ

SEQ ID NO: 400780 - protein, 9 aa, Homo Sapiens
LHFRKDELK

SEQ ID NO: 400781 - protein, 9 aa, Homo Sapiens
MIKALLRTK

SEQ ID NO: 400782 - protein, 9 aa, Homo Sapiens
LSPKDKILL

SEQ ID NO: 400783 - protein, 9 aa, Homo Sapiens
GSLQMKTEL

SEQ ID NO: 400784 - protein, 9 aa, Homo Sapiens
IKREEDEET

SEQ ID NO: 400785 - protein, 9 aa, Homo Sapiens
SQENKDLLS

SEQ ID NO: 400786 - protein, 9 aa, Homo Sapiens
AVTLEKQDD

SEQ ID NO: 400787 - protein, 9 aa, Homo Sapiens
SWENQKVEA

SEQ ID NO: 400788 - protein, 9 aa, Homo Sapiens
PEGSLIIQP

SEQ ID NO: 400789 - protein, 9 aa, Homo Sapiens
IMDRTPDKL

SEQ ID NO: 400790 - protein, 9 aa, Homo Sapiens
FVKQIGYMI

SEQ ID NO: 400791 - protein, 9 aa, Homo Sapiens
YDKLGPSRD

SEQ ID NO: 400792 - protein, 9 aa, Homo Sapiens
VAMVLKECI

SEQ ID NO: 400793 - protein, 9 aa, Homo Sapiens
WRQLAESFG

SEQ ID NO: 400794 - protein, 9 aa, Homo Sapiens
GAAALAESA

SEQ ID NO: 400795 - protein, 9 aa, Homo Sapiens
SQGPVYSSC

SEQ ID NO: 400796 - protein, 9 aa, Homo Sapiens
AKKEIEKCL

SEQ ID NO: 400797 - protein, 9 aa, Homo Sapiens
FAKLYDTIQ

SEQ ID NO: 400798 - protein, 9 aa, Homo Sapiens
FLIFWNIKI

SEQ ID NO: 400799 - protein, 9 aa, Homo Sapiens
RGVPACSHV

SEQ ID NO: 400800 - protein, 9 aa, Homo Sapiens
EEQKLHTDD

SEQ ID NO: 400801 - protein, 9 aa, Homo Sapiens
TDEDKLFVE

SEQ ID NO: 400802 - protein, 9 aa, Homo Sapiens
SAQVVNYLT

SEQ ID NO: 400803 - protein, 9 aa, Homo Sapiens
SATGQSYFR

SEQ ID NO: 400804 - protein, 9 aa, Homo Sapiens
NILRLHLNS

SEQ ID NO: 400805 - protein, 9 aa, Homo Sapiens
AQVLRRMRI

SEQ ID NO: 400806 - protein, 9 aa, Homo Sapiens
RLLAYNRYG

SEQ ID NO: 400807 - protein, 9 aa, Homo Sapiens
AAMHVSDHS

SEQ ID NO: 400808 - protein, 9 aa, Homo Sapiens
PFKYLVQLP

SEQ ID NO: 400809 - protein, 9 aa, Homo Sapiens
ENQKVEATQ

SEQ ID NO: 400810 - protein, 9 aa, Homo Sapiens
QRAHLKTGG

SEQ ID NO: 400811 - protein, 9 aa, Homo Sapiens
CSASEACVP

SEQ ID NO: 400812 - protein, 9 aa, Homo Sapiens
RNPQKILQS

SEQ ID NO: 400813 - protein, 9 aa, Homo Sapiens
QSEIDLVQI

SEQ ID NO: 400814 - protein, 9 aa, Homo Sapiens
KTLQNHWKK

SEQ ID NO: 400815 - protein, 9 aa, Homo Sapiens
AAYCGVGDD

SEQ ID NO: 400816 - protein, 9 aa, Homo Sapiens
ELDKVHELC

SEQ ID NO: 400817 - protein, 9 aa, Homo Sapiens
QCCCISIDL

SEQ ID NO: 400818 - protein, 9 aa, Homo Sapiens
TDFCVMPRD

SEQ ID NO: 400819 - protein, 9 aa, Homo Sapiens
RRPYILKID

SEQ ID NO: 400820 - protein, 9 aa, Homo Sapiens
VNLFRMVIS

SEQ ID NO: 400821 - protein, 9 aa, Homo Sapiens
EHLTNNEEI

SEQ ID NO: 400822 - protein, 9 aa, Homo Sapiens
MNKRKRHKQ

SEQ ID NO: 400823 - protein, 9 aa, Homo Sapiens
FCLNFLVVV

SEQ ID NO: 400824 - protein, 9 aa, Homo Sapiens
LLAALKKAL

SEQ ID NO: 400825 - protein, 9 aa, Homo Sapiens
SVSELQYFE

SEQ ID NO: 400826 - protein, 9 aa, Homo Sapiens
HSYLKSIFS

SEQ ID NO: 400827 - protein, 9 aa, Homo Sapiens
SLHSHQRVH

SEQ ID NO: 400828 - protein, 9 aa, Homo Sapiens
LGDKVNLFR

SEQ ID NO: 400829 - protein, 9 aa, Homo Sapiens
FLYYWWLPE

SEQ ID NO: 400830 - protein, 9 aa, Homo Sapiens
CLPLHFRKD

SEQ ID NO: 400831 - protein, 9 aa, Homo Sapiens
TLQISYDTL

SEQ ID NO: 400832 - protein, 9 aa, Homo Sapiens
RGYSKAFQD

SEQ ID NO: 400833 - protein, 9 aa, Homo Sapiens
TEHGKKTTL

SEQ ID NO: 400834 - protein, 9 aa, Homo Sapiens
IPFFLDIYL

SEQ ID NO: 400835 - protein, 9 aa, Homo Sapiens
LKIHKSMIQ

SEQ ID NO: 400836 - protein, 9 aa, Homo Sapiens
FFYGEQGKP

SEQ ID NO: 400837 - protein, 9 aa, Homo Sapiens
VNLRNNYFI

SEQ ID NO: 400838 - protein, 9 aa, Homo Sapiens
TPEIIKQIP

SEQ ID NO: 400839 - protein, 9 aa, Homo Sapiens
KIEVTIQFT

SEQ ID NO: 400840 - protein, 9 aa, Homo Sapiens
HKAEAEEPE

SEQ ID NO: 400841 - protein, 9 aa, Homo Sapiens
KCSIILTSH

SEQ ID NO: 400842 - protein, 9 aa, Homo Sapiens
CIFGVPKIL

SEQ ID NO: 400843 - protein, 9 aa, Homo Sapiens
PEDTSQNIP

SEQ ID NO: 400844 - protein, 9 aa, Homo Sapiens
GEFTGSFRI

SEQ ID NO: 400845 - protein, 9 aa, Homo Sapiens
EDIATFFKA

SEQ ID NO: 400846 - protein, 9 aa, Homo Sapiens
NSKNISTHG

SEQ ID NO: 400847 - protein, 9 aa, Homo Sapiens
GRVAQVLRR

SEQ ID NO: 400848 - protein, 9 aa, Homo Sapiens
VEAQYELIA

SEQ ID NO: 400849 - protein, 9 aa, Homo Sapiens
YLESEKSRV

SEQ ID NO: 400850 - protein, 9 aa, Homo Sapiens
IHKSMIQMK

SEQ ID NO: 400851 - protein, 9 aa, Homo Sapiens
PLLYMQFRV

SEQ ID NO: 400852 - protein, 9 aa, Homo Sapiens
MVMQSGEAK

SEQ ID NO: 400853 - protein, 9 aa, Homo Sapiens
SPVEPQGPF

SEQ ID NO: 400854 - protein, 9 aa, Homo Sapiens
YSYFWINRR

SEQ ID NO: 400855 - protein, 9 aa, Homo Sapiens
LIMCITYYC

SEQ ID NO: 400856 - protein, 9 aa, Homo Sapiens
EQVEIKRLH

SEQ ID NO: 400857 - protein, 9 aa, Homo Sapiens
VKTTSKFSV

SEQ ID NO: 400858 - protein, 9 aa, Homo Sapiens
KLSLVNTVC

SEQ ID NO: 400859 - protein, 9 aa, Homo Sapiens
VKIPMIKAL

SEQ ID NO: 400860 - protein, 9 aa, Homo Sapiens
PPLQKDKKE

SEQ ID NO: 400861 - protein, 9 aa, Homo Sapiens
GGATGPGAE

SEQ ID NO: 400862 - protein, 9 aa, Homo Sapiens
QPYRSEFYS

SEQ ID NO: 400863 - protein, 9 aa, Homo Sapiens
YQENNENKM

SEQ ID NO: 400864 - protein, 9 aa, Homo Sapiens
RLVYGITPE

SEQ ID NO: 400865 - protein, 9 aa, Homo Sapiens
PKDKILLLR

SEQ ID NO: 400866 - protein, 9 aa, Homo Sapiens
MSILINFVD

SEQ ID NO: 400867 - protein, 9 aa, Homo Sapiens
MTQEVTIKY

SEQ ID NO: 400868 - protein, 9 aa, Homo Sapiens
VAICYGSGI

SEQ ID NO: 400869 - protein, 9 aa, Homo Sapiens
ADGGGGGAT

SEQ ID NO: 400870 - protein, 9 aa, Homo Sapiens
NEAIKICCS

SEQ ID NO: 400871 - protein, 9 aa, Homo Sapiens
IKVENTEDN

SEQ ID NO: 400872 - protein, 9 aa, Homo Sapiens
SHPQHSDKG

SEQ ID NO: 400873 - protein, 9 aa, Homo Sapiens
NPEHFVLDI

SEQ ID NO: 400874 - protein, 9 aa, Homo Sapiens
FNGAKVVSC

SEQ ID NO: 400875 - protein, 9 aa, Homo Sapiens
PNLSNCTSH

SEQ ID NO: 400876 - protein, 9 aa, Homo Sapiens
LNPHNFAAR

SEQ ID NO: 400877 - protein, 9 aa, Homo Sapiens
LHTRLSGDA

SEQ ID NO: 400878 - protein, 9 aa, Homo Sapiens
MLQLERNIE

SEQ ID NO: 400879 - protein, 9 aa, Homo Sapiens
CQYHPSKGY

SEQ ID NO: 400880 - protein, 9 aa, Homo Sapiens
QYILMAFQN

SEQ ID NO: 400881 - protein, 9 aa, Homo Sapiens
DLTKGWIVW

SEQ ID NO: 400882 - protein, 9 aa, Homo Sapiens
RAGFIENTF

SEQ ID NO: 400883 - protein, 9 aa, Homo Sapiens
FSTLPTVSI

SEQ ID NO: 400884 - protein, 9 aa, Homo Sapiens
TNDSKRLIL

SEQ ID NO: 400885 - protein, 9 aa, Homo Sapiens
IIYAFHNQE

SEQ ID NO: 400886 - protein, 9 aa, Homo Sapiens
RKEFKNIST

SEQ ID NO: 400887 - protein, 9 aa, Homo Sapiens
NLEPHGQQP

SEQ ID NO: 400888 - protein, 9 aa, Homo Sapiens
NLLIQMSVV

SEQ ID NO: 400889 - protein, 9 aa, Homo Sapiens
PGGPIHVQF

SEQ ID NO: 400890 - protein, 9 aa, Homo Sapiens
ISKKPPLQK

SEQ ID NO: 400891 - protein, 9 aa, Homo Sapiens
EILPEGSLI

SEQ ID NO: 400892 - protein, 9 aa, Homo Sapiens
RDRKCREEE

SEQ ID NO: 400893 - protein, 9 aa, Homo Sapiens
WREWLGLIN

SEQ ID NO: 400894 - protein, 9 aa, Homo Sapiens
DEFAMRHGI

SEQ ID NO: 400895 - protein, 9 aa, Homo Sapiens
PYLQFWAGR

SEQ ID NO: 400896 - protein, 9 aa, Homo Sapiens
QWTNRIMEE

SEQ ID NO: 400897 - protein, 9 aa, Homo Sapiens
VAFESQNKE

SEQ ID NO: 400898 - protein, 9 aa, Homo Sapiens
MSEICTELQ

SEQ ID NO: 400899 - protein, 9 aa, Homo Sapiens
AKKAQKVKH

SEQ ID NO: 400900 - protein, 9 aa, Homo Sapiens
KVLKIHKSM

SEQ ID NO: 400901 - protein, 9 aa, Homo Sapiens
PDKLKKELE

SEQ ID NO: 400902 - protein, 9 aa, Homo Sapiens
PRENGIHLP

SEQ ID NO: 400903 - protein, 9 aa, Homo Sapiens
SPWLGKVQN

SEQ ID NO: 400904 - protein, 9 aa, Homo Sapiens
PIDHYQITF

SEQ ID NO: 400905 - protein, 9 aa, Homo Sapiens
WSLSEFESY

SEQ ID NO: 400906 - protein, 9 aa, Homo Sapiens
DELELENQN

SEQ ID NO: 400907 - protein, 9 aa, Homo Sapiens
DNFPLGTVQ

SEQ ID NO: 400908 - protein, 9 aa, Homo Sapiens
KEQLFESYY

SEQ ID NO: 400909 - protein, 9 aa, Homo Sapiens
LKTVMNDPL

SEQ ID NO: 400910 - protein, 9 aa, Homo Sapiens
QNIRTWIND

SEQ ID NO: 400911 - protein, 9 aa, Homo Sapiens
PRSLRYPTE

SEQ ID NO: 400912 - protein, 9 aa, Homo Sapiens
KVQEDVFIV

SEQ ID NO: 400913 - protein, 9 aa, Homo Sapiens
YGIECSSFQ

SEQ ID NO: 400914 - protein, 9 aa, Homo Sapiens
WCKREILKF

SEQ ID NO: 400915 - protein, 9 aa, Homo Sapiens
RVNTGEKPY

SEQ ID NO: 400916 - protein, 9 aa, Homo Sapiens
GEDVAIVAS

SEQ ID NO: 400917 - protein, 9 aa, Homo Sapiens
MLRVPGPAD

SEQ ID NO: 400918 - protein, 9 aa, Homo Sapiens
GRHWNNFAL

SEQ ID NO: 400919 - protein, 9 aa, Homo Sapiens
HADNFLQQF

SEQ ID NO: 400920 - protein, 9 aa, Homo Sapiens
EIIKQIPSS

SEQ ID NO: 400921 - protein, 9 aa, Homo Sapiens
YFADANKAE

SEQ ID NO: 400922 - protein, 9 aa, Homo Sapiens
INYCESPKP

SEQ ID NO: 400923 - protein, 9 aa, Homo Sapiens
TKLQDNLCQ

SEQ ID NO: 400924 - protein, 9 aa, Homo Sapiens
AIHLPQVAG

SEQ ID NO: 400925 - protein, 9 aa, Homo Sapiens
VFVCYFDYG

SEQ ID NO: 400926 - protein, 9 aa, Homo Sapiens
QPKKYQVWH

SEQ ID NO: 400927 - protein, 9 aa, Homo Sapiens
CRRYWNAYM

SEQ ID NO: 400928 - protein, 9 aa, Homo Sapiens
FLKEHDHLQ

SEQ ID NO: 400929 - protein, 9 aa, Homo Sapiens
VREGESCSF

SEQ ID NO: 400930 - protein, 9 aa, Homo Sapiens
VNIIRMEER

SEQ ID NO: 400931 - protein, 9 aa, Homo Sapiens
AISWYQNKI

SEQ ID NO: 400932 - protein, 9 aa, Homo Sapiens
PLGDKVNLF

SEQ ID NO: 400933 - protein, 9 aa, Homo Sapiens
QNNWLQTDW

SEQ ID NO: 400934 - protein, 9 aa, Homo Sapiens
PHGQQPSLR

SEQ ID NO: 400935 - protein, 9 aa, Homo Sapiens
YFGQDILDA

SEQ ID NO: 400936 - protein, 9 aa, Homo Sapiens
VTSISNKIL

SEQ ID NO: 400937 - protein, 9 aa, Homo Sapiens
FQKYHLGLH

SEQ ID NO: 400938 - protein, 9 aa, Homo Sapiens
SPGIDRRSS

SEQ ID NO: 400939 - protein, 9 aa, Homo Sapiens
LNPLIYSLH

SEQ ID NO: 400940 - protein, 9 aa, Homo Sapiens
STDNLSCPS

SEQ ID NO: 400941 - protein, 9 aa, Homo Sapiens
VTCKDIQHI

SEQ ID NO: 400942 - protein, 9 aa, Homo Sapiens
SSNVMRYIH

SEQ ID NO: 400943 - protein, 9 aa, Homo Sapiens
SGCFLQFYL

SEQ ID NO: 400944 - protein, 9 aa, Homo Sapiens
EHKKIIENE

SEQ ID NO: 400945 - protein, 9 aa, Homo Sapiens
LFDRLKLFG

SEQ ID NO: 400946 - protein, 9 aa, Homo Sapiens
LELWDGVDS

SEQ ID NO: 400947 - protein, 9 aa, Homo Sapiens
RKEYFNQTL

SEQ ID NO: 400948 - protein, 9 aa, Homo Sapiens
QYFADANKA

SEQ ID NO: 400949 - protein, 9 aa, Homo Sapiens
KDIQIIVLD

SEQ ID NO: 400950 - protein, 9 aa, Homo Sapiens
LSPKSYQTA

SEQ ID NO: 400951 - protein, 9 aa, Homo Sapiens
VLFNFIRNL

SEQ ID NO: 400952 - protein, 9 aa, Homo Sapiens
FYYFWYNFD

SEQ ID NO: 400953 - protein, 9 aa, Homo Sapiens
NKQARCQGV

SEQ ID NO: 400954 - protein, 9 aa, Homo Sapiens
ERGGVLLAA

SEQ ID NO: 400955 - protein, 9 aa, Homo Sapiens
PESISDKEL

SEQ ID NO: 400956 - protein, 9 aa, Homo Sapiens
ASFPRPLII

SEQ ID NO: 400957 - protein, 9 aa, Homo Sapiens
ILLAQMGII

SEQ ID NO: 400958 - protein, 9 aa, Homo Sapiens
AQGLVLTVL

SEQ ID NO: 400959 - protein, 9 aa, Homo Sapiens
IVRTEIGVI

SEQ ID NO: 400960 - protein, 9 aa, Homo Sapiens
KKVKSRKLA

SEQ ID NO: 400961 - protein, 9 aa, Homo Sapiens
THKGDYFYA

SEQ ID NO: 400962 - protein, 9 aa, Homo Sapiens
YLDLIHQKK

SEQ ID NO: 400963 - protein, 9 aa, Homo Sapiens
RKQKWEKEC

SEQ ID NO: 400964 - protein, 9 aa, Homo Sapiens
HCVTFAVPK

SEQ ID NO: 400965 - protein, 9 aa, Homo Sapiens
PCKNNSTCI

SEQ ID NO: 400966 - protein, 9 aa, Homo Sapiens
YSSCKGGWK

SEQ ID NO: 400967 - protein, 9 aa, Homo Sapiens
KDKKIKREE

SEQ ID NO: 400968 - protein, 9 aa, Homo Sapiens
MSYCQYHPS

SEQ ID NO: 400969 - protein, 9 aa, Homo Sapiens
LMNGMKSDG

SEQ ID NO: 400970 - protein, 9 aa, Homo Sapiens
TSLLEYRKY

SEQ ID NO: 400971 - protein, 9 aa, Homo Sapiens
EYVQQQPII

SEQ ID NO: 400972 - protein, 9 aa, Homo Sapiens
EENKKHKKK

SEQ ID NO: 400973 - protein, 9 aa, Homo Sapiens
RWTGSHPWT

SEQ ID NO: 400974 - protein, 9 aa, Homo Sapiens
LLYLEVMLD

SEQ ID NO: 400975 - protein, 9 aa, Homo Sapiens
LRFNGAKVV

SEQ ID NO: 400976 - protein, 9 aa, Homo Sapiens
LKCHIPPDT

SEQ ID NO: 400977 - protein, 9 aa, Homo Sapiens
PIPPNGHHI

SEQ ID NO: 400978 - protein, 9 aa, Homo Sapiens
MQSVLQFIQ

SEQ ID NO: 400979 - protein, 9 aa, Homo Sapiens
YIYHVMWHS

SEQ ID NO: 400980 - protein, 9 aa, Homo Sapiens
VEENYQIEE

SEQ ID NO: 400981 - protein, 9 aa, Homo Sapiens
RGGVLLAAL

SEQ ID NO: 400982 - protein, 9 aa, Homo Sapiens
YDNNSPVLY

SEQ ID NO: 400983 - protein, 9 aa, Homo Sapiens
ISTHGQNNP

SEQ ID NO: 400984 - protein, 9 aa, Homo Sapiens
RRMVMQSGE

SEQ ID NO: 400985 - protein, 9 aa, Homo Sapiens
FSVCSSRTA

SEQ ID NO: 400986 - protein, 9 aa, Homo Sapiens
TDCGGPFQL

SEQ ID NO: 400987 - protein, 9 aa, Homo Sapiens
IENTFKPNE

SEQ ID NO: 400988 - protein, 9 aa, Homo Sapiens
TRGIIYIKH

SEQ ID NO: 400989 - protein, 9 aa, Homo Sapiens
ERKQKWEKE

SEQ ID NO: 400990 - protein, 9 aa, Homo Sapiens
DQDLLRCHV

SEQ ID NO: 400991 - protein, 9 aa, Homo Sapiens
KKDKPDSVD

SEQ ID NO: 400992 - protein, 9 aa, Homo Sapiens
CHLLQDTAF

SEQ ID NO: 400993 - protein, 9 aa, Homo Sapiens
LDPAQQNVY

SEQ ID NO: 400994 - protein, 9 aa, Homo Sapiens
MAGGLVAHL

SEQ ID NO: 400995 - protein, 9 aa, Homo Sapiens
TEKTAQVTI

SEQ ID NO: 400996 - protein, 9 aa, Homo Sapiens
AASGSISKK

SEQ ID NO: 400997 - protein, 9 aa, Homo Sapiens
LEVMLDNFA

SEQ ID NO: 400998 - protein, 9 aa, Homo Sapiens
ILPERRSMM

SEQ ID NO: 400999 - protein, 9 aa, Homo Sapiens
TLNRHQKIH

SEQ ID NO: 401000 - protein, 9 aa, Homo Sapiens
LGGRIHSKD

SEQ ID NO: 401001 - protein, 9 aa, Homo Sapiens
VERKHYIQE

SEQ ID NO: 401002 - protein, 9 aa, Homo Sapiens
PRSQKEPLQ

SEQ ID NO: 401003 - protein, 9 aa, Homo Sapiens
MLKQVIKPR

SEQ ID NO: 401004 - protein, 9 aa, Homo Sapiens
VHNILQWQP

SEQ ID NO: 401005 - protein, 9 aa, Homo Sapiens
SSHPEPTRT

SEQ ID NO: 401006 - protein, 9 aa, Homo Sapiens
ESHSCNSIL

SEQ ID NO: 401007 - protein, 9 aa, Homo Sapiens
NPHNFAARQ

SEQ ID NO: 401008 - protein, 9 aa, Homo Sapiens
RSLRYPTED

SEQ ID NO: 401009 - protein, 9 aa, Homo Sapiens
DSSCHGREQ

SEQ ID NO: 401010 - protein, 9 aa, Homo Sapiens
ACTEHSDQR

SEQ ID NO: 401011 - protein, 9 aa, Homo Sapiens
NPFAHIQLK

SEQ ID NO: 401012 - protein, 9 aa, Homo Sapiens
WLGLINNSR

SEQ ID NO: 401013 - protein, 9 aa, Homo Sapiens
SRGLAEATE

SEQ ID NO: 401014 - protein, 9 aa, Homo Sapiens
VKARALKSK

SEQ ID NO: 401015 - protein, 9 aa, Homo Sapiens
VHKAVKAIA

SEQ ID NO: 401016 - protein, 9 aa, Homo Sapiens
SHLIQHKII

SEQ ID NO: 401017 - protein, 9 aa, Homo Sapiens
KTWRQLAES

SEQ ID NO: 401018 - protein, 9 aa, Homo Sapiens
EGSSENSAY

SEQ ID NO: 401019 - protein, 9 aa, Homo Sapiens
GEGIEELNN

SEQ ID NO: 401020 - protein, 9 aa, Homo Sapiens
QADVDTTLK

SEQ ID NO: 401021 - protein, 9 aa, Homo Sapiens
FILLCAILQ

SEQ ID NO: 401022 - protein, 9 aa, Homo Sapiens
KKFDVEAIF

SEQ ID NO: 401023 - protein, 9 aa, Homo Sapiens
VLKVLTNKT

SEQ ID NO: 401024 - protein, 9 aa, Homo Sapiens
GQRTPFQIG

SEQ ID NO: 401025 - protein, 9 aa, Homo Sapiens
ENYQIEEEE

SEQ ID NO: 401026 - protein, 9 aa, Homo Sapiens
SLIIQPVLA

SEQ ID NO: 401027 - protein, 9 aa, Homo Sapiens
AEAKMTFMR

SEQ ID NO: 401028 - protein, 9 aa, Homo Sapiens
GRRAGSDLR

SEQ ID NO: 401029 - protein, 9 aa, Homo Sapiens
TNRIMEEFF

SEQ ID NO: 401030 - protein, 9 aa, Homo Sapiens
ENVTRESIS

SEQ ID NO: 401031 - protein, 9 aa, Homo Sapiens
FKVLKPDTT

SEQ ID NO: 401032 - protein, 9 aa, Homo Sapiens
NKPPNQKDV

SEQ ID NO: 401033 - protein, 9 aa, Homo Sapiens
APEKIIKEC

SEQ ID NO: 401034 - protein, 9 aa, Homo Sapiens
PTQNIEKKK

SEQ ID NO: 401035 - protein, 9 aa, Homo Sapiens
HEVVVQPIQ

SEQ ID NO: 401036 - protein, 9 aa, Homo Sapiens
KKEKERGKI

SEQ ID NO: 401037 - protein, 9 aa, Homo Sapiens
SLVRYHEQI

SEQ ID NO: 401038 - protein, 9 aa, Homo Sapiens
DVGIAMLAK

SEQ ID NO: 401039 - protein, 9 aa, Homo Sapiens
TNRQRLNKK

SEQ ID NO: 401040 - protein, 9 aa, Homo Sapiens
PGLHLISLN

SEQ ID NO: 401041 - protein, 9 aa, Homo Sapiens
YLNRTSQKL

SEQ ID NO: 401042 - protein, 9 aa, Homo Sapiens
NFNQFTAAT

SEQ ID NO: 401043 - protein, 9 aa, Homo Sapiens
KVIFIIILS

SEQ ID NO: 401044 - protein, 9 aa, Homo Sapiens
DWNLYWRAS

SEQ ID NO: 401045 - protein, 9 aa, Homo Sapiens
GKISFAVTE

SEQ ID NO: 401046 - protein, 9 aa, Homo Sapiens
YQWRPEYRH

SEQ ID NO: 401047 - protein, 9 aa, Homo Sapiens
VTSIKSQEP

SEQ ID NO: 401048 - protein, 9 aa, Homo Sapiens
KENKSFSLE

SEQ ID NO: 401049 - protein, 9 aa, Homo Sapiens
GIDGLNREQ

SEQ ID NO: 401050 - protein, 9 aa, Homo Sapiens
SNEEINGNL

SEQ ID NO: 401051 - protein, 9 aa, Homo Sapiens
DKELKLLCS

SEQ ID NO: 401052 - protein, 9 aa, Homo Sapiens
LLLILVFYV

SEQ ID NO: 401053 - protein, 9 aa, Homo Sapiens
LHIAQTDAE

SEQ ID NO: 401054 - protein, 9 aa, Homo Sapiens
WFQNRRAKD

SEQ ID NO: 401055 - protein, 9 aa, Homo Sapiens
NSGVYEKDV

SEQ ID NO: 401056 - protein, 9 aa, Homo Sapiens
FKNWKRITV

SEQ ID NO: 401057 - protein, 9 aa, Homo Sapiens
YCKTKELKK

SEQ ID NO: 401058 - protein, 9 aa, Homo Sapiens
YQQLVRVLD

SEQ ID NO: 401059 - protein, 9 aa, Homo Sapiens
PLPGTRVRA

SEQ ID NO: 401060 - protein, 9 aa, Homo Sapiens
ESLWEATRD

SEQ ID NO: 401061 - protein, 9 aa, Homo Sapiens
DSIFILMIL

SEQ ID NO: 401062 - protein, 9 aa, Homo Sapiens
EVVVQPIQQ

SEQ ID NO: 401063 - protein, 9 aa, Homo Sapiens
MWGLITQGV

SEQ ID NO: 401064 - protein, 9 aa, Homo Sapiens
LIKEKTKSH

SEQ ID NO: 401065 - protein, 9 aa, Homo Sapiens
VSVHKSGKH

SEQ ID NO: 401066 - protein, 9 aa, Homo Sapiens
PELLNMFRE

SEQ ID NO: 401067 - protein, 9 aa, Homo Sapiens
ILQITQSAP

SEQ ID NO: 401068 - protein, 9 aa, Homo Sapiens
PNNLDTTPV

SEQ ID NO: 401069 - protein, 9 aa, Homo Sapiens
LGLQDKILK

SEQ ID NO: 401070 - protein, 9 aa, Homo Sapiens
KRHRGYSKA

SEQ ID NO: 401071 - protein, 9 aa, Homo Sapiens
EEIDVTSDY

SEQ ID NO: 401072 - protein, 9 aa, Homo Sapiens
PWLGKVQNM

SEQ ID NO: 401073 - protein, 9 aa, Homo Sapiens
QQNVYRDVM

SEQ ID NO: 401074 - protein, 9 aa, Homo Sapiens
FQIGIKESL

SEQ ID NO: 401075 - protein, 9 aa, Homo Sapiens
CVNIKKILT

SEQ ID NO: 401076 - protein, 9 aa, Homo Sapiens
QNTSRKEYF

SEQ ID NO: 401077 - protein, 9 aa, Homo Sapiens
LFTSSFPDQ

SEQ ID NO: 401078 - protein, 9 aa, Homo Sapiens
PKGAHHNKY

SEQ ID NO: 401079 - protein, 9 aa, Homo Sapiens
GCSAQVVNY

SEQ ID NO: 401080 - protein, 9 aa, Homo Sapiens
YEGFQQVLK

SEQ ID NO: 401081 - protein, 9 aa, Homo Sapiens
NHLLHKSDT

SEQ ID NO: 401082 - protein, 9 aa, Homo Sapiens
PTKFQYLNV

SEQ ID NO: 401083 - protein, 9 aa, Homo Sapiens
LEKLNLGDC

SEQ ID NO: 401084 - protein, 9 aa, Homo Sapiens
SSIARSQTN

SEQ ID NO: 401085 - protein, 9 aa, Homo Sapiens
EQGVISLTL

SEQ ID NO: 401086 - protein, 9 aa, Homo Sapiens
CHGREQGVI

SEQ ID NO: 401087 - protein, 9 aa, Homo Sapiens
HLIESTNKS

SEQ ID NO: 401088 - protein, 9 aa, Homo Sapiens
NTFLNPQKD

SEQ ID NO: 401089 - protein, 9 aa, Homo Sapiens
SAPATRTSY

SEQ ID NO: 401090 - protein, 9 aa, Homo Sapiens
HTGDAKPSF

SEQ ID NO: 401091 - protein, 9 aa, Homo Sapiens
FKIISYVLQ

SEQ ID NO: 401092 - protein, 9 aa, Homo Sapiens
EALYKILGL

SEQ ID NO: 401093 - protein, 9 aa, Homo Sapiens
GTQPTCHNF

SEQ ID NO: 401094 - protein, 9 aa, Homo Sapiens
HLDFDLENT

SEQ ID NO: 401095 - protein, 9 aa, Homo Sapiens
ENISLEELR

SEQ ID NO: 401096 - protein, 9 aa, Homo Sapiens
RNLMVHQII

SEQ ID NO: 401097 - protein, 9 aa, Homo Sapiens
VELIVETEA

SEQ ID NO: 401098 - protein, 9 aa, Homo Sapiens
ALHIAQTDA

SEQ ID NO: 401099 - protein, 9 aa, Homo Sapiens
ATILEPVLI

SEQ ID NO: 401100 - protein, 9 aa, Homo Sapiens
FSLSLSYLL

SEQ ID NO: 401101 - protein, 9 aa, Homo Sapiens
CLDPDMYSL

SEQ ID NO: 401102 - protein, 9 aa, Homo Sapiens
QYQQLEFGS

SEQ ID NO: 401103 - protein, 9 aa, Homo Sapiens
ISGNNMTKS

SEQ ID NO: 401104 - protein, 9 aa, Homo Sapiens
CSTEGRSKA

SEQ ID NO: 401105 - protein, 9 aa, Homo Sapiens
KEDDLLLQY

SEQ ID NO: 401106 - protein, 9 aa, Homo Sapiens
SEFYSLQEQ

SEQ ID NO: 401107 - protein, 9 aa, Homo Sapiens
FQYNEENYG

SEQ ID NO: 401108 - protein, 9 aa, Homo Sapiens
LWERLVYGI

SEQ ID NO: 401109 - protein, 9 aa, Homo Sapiens
PSADSVQYH

SEQ ID NO: 401110 - protein, 9 aa, Homo Sapiens
PNDMFQYNE

SEQ ID NO: 401111 - protein, 9 aa, Homo Sapiens
PGQRRLDIF

SEQ ID NO: 401112 - protein, 9 aa, Homo Sapiens
SNMTCDKWT

SEQ ID NO: 401113 - protein, 9 aa, Homo Sapiens
PVANQDPVY

SEQ ID NO: 401114 - protein, 9 aa, Homo Sapiens
RAQLRFISY

SEQ ID NO: 401115 - protein, 9 aa, Homo Sapiens
LTNDSKRLI

SEQ ID NO: 401116 - protein, 9 aa, Homo Sapiens
VQHLYLHSP

SEQ ID NO: 401117 - protein, 9 aa, Homo Sapiens
IVVVLEAIG

SEQ ID NO: 401118 - protein, 9 aa, Homo Sapiens
TSRGSAGNK

SEQ ID NO: 401119 - protein, 9 aa, Homo Sapiens
DMLKYQASA

SEQ ID NO: 401120 - protein, 9 aa, Homo Sapiens
CVHLYVQMY

SEQ ID NO: 401121 - protein, 9 aa, Homo Sapiens
ALEQLKLLC

SEQ ID NO: 401122 - protein, 9 aa, Homo Sapiens
DHCVDTSQD

SEQ ID NO: 401123 - protein, 9 aa, Homo Sapiens
HQTETFPAY

SEQ ID NO: 401124 - protein, 9 aa, Homo Sapiens
ALQLPHLGF

SEQ ID NO: 401125 - protein, 9 aa, Homo Sapiens
VLKPLEHKK

SEQ ID NO: 401126 - protein, 9 aa, Homo Sapiens
PCPSYPERQ

SEQ ID NO: 401127 - protein, 9 aa, Homo Sapiens
ENEAIKICC

SEQ ID NO: 401128 - protein, 9 aa, Homo Sapiens
YSFMPHYPY

SEQ ID NO: 401129 - protein, 9 aa, Homo Sapiens
TLVVKKFDV

SEQ ID NO: 401130 - protein, 9 aa, Homo Sapiens
LNKSARTRK

SEQ ID NO: 401131 - protein, 9 aa, Homo Sapiens
RKQSQLLRL

SEQ ID NO: 401132 - protein, 9 aa, Homo Sapiens
VTQKVRPRR

SEQ ID NO: 401133 - protein, 9 aa, Homo Sapiens
WFPLHEVVV

SEQ ID NO: 401134 - protein, 9 aa, Homo Sapiens
TFNYDWYNV

SEQ ID NO: 401135 - protein, 9 aa, Homo Sapiens
CKSVFSIRA

SEQ ID NO: 401136 - protein, 9 aa, Homo Sapiens
KTMEVREGE

SEQ ID NO: 401137 - protein, 9 aa, Homo Sapiens
IRASAALEQ

SEQ ID NO: 401138 - protein, 9 aa, Homo Sapiens
GKVQNMVSF

SEQ ID NO: 401139 - protein, 9 aa, Homo Sapiens
QITFTPSSG

SEQ ID NO: 401140 - protein, 9 aa, Homo Sapiens
SKDIFKREA

SEQ ID NO: 401141 - protein, 9 aa, Homo Sapiens
ASFSISLVA

SEQ ID NO: 401142 - protein, 9 aa, Homo Sapiens
VNYLTRNRF

SEQ ID NO: 401143 - protein, 9 aa, Homo Sapiens
LGAVATKVQ

SEQ ID NO: 401144 - protein, 9 aa, Homo Sapiens
QIQEQQNVL

SEQ ID NO: 401145 - protein, 9 aa, Homo Sapiens
WLSRQFQKV

SEQ ID NO: 401146 - protein, 9 aa, Homo Sapiens
ESTIFQMLI

SEQ ID NO: 401147 - protein, 9 aa, Homo Sapiens
CPRGVPACS

SEQ ID NO: 401148 - protein, 9 aa, Homo Sapiens
GVLSTHHNI

SEQ ID NO: 401149 - protein, 9 aa, Homo Sapiens
SVKINTWRA

SEQ ID NO: 401150 - protein, 9 aa, Homo Sapiens
DHEMLYDWI

SEQ ID NO: 401151 - protein, 9 aa, Homo Sapiens
SLSDVCRID

SEQ ID NO: 401152 - protein, 9 aa, Homo Sapiens
IRWGPRLDP

SEQ ID NO: 401153 - protein, 9 aa, Homo Sapiens
KSDPVMRKM

SEQ ID NO: 401154 - protein, 9 aa, Homo Sapiens
YFNLWTICQ

SEQ ID NO: 401155 - protein, 9 aa, Homo Sapiens
ATSDKKYSV

SEQ ID NO: 401156 - protein, 9 aa, Homo Sapiens
QSEWCHYKL

SEQ ID NO: 401157 - protein, 9 aa, Homo Sapiens
LNFPSPGKD

SEQ ID NO: 401158 - protein, 9 aa, Homo Sapiens
CHYKLYFAH

SEQ ID NO: 401159 - protein, 9 aa, Homo Sapiens
RGYFCIEVG

SEQ ID NO: 401160 - protein, 9 aa, Homo Sapiens
RQLAESFGL

SEQ ID NO: 401161 - protein, 9 aa, Homo Sapiens
TINFHSVVE

SEQ ID NO: 401162 - protein, 9 aa, Homo Sapiens
KDLFKFIEE

SEQ ID NO: 401163 - protein, 9 aa, Homo Sapiens
EYIKGDFNL

SEQ ID NO: 401164 - protein, 9 aa, Homo Sapiens
TLVRIVVTQ

SEQ ID NO: 401165 - protein, 9 aa, Homo Sapiens
SSCKGGWKC

SEQ ID NO: 401166 - protein, 9 aa, Homo Sapiens
GFIENTFKP

SEQ ID NO: 401167 - protein, 9 aa, Homo Sapiens
RVWLVTPKK

SEQ ID NO: 401168 - protein, 9 aa, Homo Sapiens
TLSDSDSGQ

SEQ ID NO: 401169 - protein, 9 aa, Homo Sapiens
SAHYPDAGE

SEQ ID NO: 401170 - protein, 9 aa, Homo Sapiens
CQIEYKQRI

SEQ ID NO: 401171 - protein, 9 aa, Homo Sapiens
LKNALYESQ

SEQ ID NO: 401172 - protein, 9 aa, Homo Sapiens
DNLEDESIS

SEQ ID NO: 401173 - protein, 9 aa, Homo Sapiens
DGGSPPHST

SEQ ID NO: 401174 - protein, 9 aa, Homo Sapiens
TDPEDNEMV

SEQ ID NO: 401175 - protein, 9 aa, Homo Sapiens
REVVNVTGL

SEQ ID NO: 401176 - protein, 9 aa, Homo Sapiens
GDAQMARKV

SEQ ID NO: 401177 - protein, 9 aa, Homo Sapiens
DENGLVVLV

SEQ ID NO: 401178 - protein, 9 aa, Homo Sapiens
RHNYLHRKT

SEQ ID NO: 401179 - protein, 9 aa, Homo Sapiens
ASQLHDHAQ

SEQ ID NO: 401180 - protein, 9 aa, Homo Sapiens
LKSTLEMGC

SEQ ID NO: 401181 - protein, 9 aa, Homo Sapiens
LFDLMPITW

SEQ ID NO: 401182 - protein, 9 aa, Homo Sapiens
ELIVETEAQ

SEQ ID NO: 401183 - protein, 9 aa, Homo Sapiens
LQIKSSGPP

SEQ ID NO: 401184 - protein, 9 aa, Homo Sapiens
EEKNKTVDL

SEQ ID NO: 401185 - protein, 9 aa, Homo Sapiens
KLTVHKVIY

SEQ ID NO: 401186 - protein, 9 aa, Homo Sapiens
NVYSMALVL

SEQ ID NO: 401187 - protein, 9 aa, Homo Sapiens
VLEALNNYI

SEQ ID NO: 401188 - protein, 9 aa, Homo Sapiens
EIKKSIKGV

SEQ ID NO: 401189 - protein, 9 aa, Homo Sapiens
AKHESEKLK

SEQ ID NO: 401190 - protein, 9 aa, Homo Sapiens
GSSRLQWRR

SEQ ID NO: 401191 - protein, 9 aa, Homo Sapiens
NSAATTEKW

SEQ ID NO: 401192 - protein, 9 aa, Homo Sapiens
DLDYLSLRT

SEQ ID NO: 401193 - protein, 9 aa, Homo Sapiens
VYPSLVQGR

SEQ ID NO: 401194 - protein, 9 aa, Homo Sapiens
RYPTEDKVL

SEQ ID NO: 401195 - protein, 9 aa, Homo Sapiens
SEACVPEVC

SEQ ID NO: 401196 - protein, 9 aa, Homo Sapiens
VSDNIQIET

SEQ ID NO: 401197 - protein, 9 aa, Homo Sapiens
FSSRQGAGY

SEQ ID NO: 401198 - protein, 9 aa, Homo Sapiens
LKDLSPEDV

SEQ ID NO: 401199 - protein, 9 aa, Homo Sapiens
IAILRLRVL

SEQ ID NO: 401200 - protein, 9 aa, Homo Sapiens
IEKVLKIHK

SEQ ID NO: 401201 - protein, 9 aa, Homo Sapiens
ELAKSCIKT

SEQ ID NO: 401202 - protein, 9 aa, Homo Sapiens
NKKYSISNK

SEQ ID NO: 401203 - protein, 9 aa, Homo Sapiens
VMGGVFIGA

SEQ ID NO: 401204 - protein, 9 aa, Homo Sapiens
GKFGELCHG

SEQ ID NO: 401205 - protein, 9 aa, Homo Sapiens
TVGLTNEGS

SEQ ID NO: 401206 - protein, 9 aa, Homo Sapiens
QRVLATEDR

SEQ ID NO: 401207 - protein, 9 aa, Homo Sapiens
TQYRDVHHL

SEQ ID NO: 401208 - protein, 9 aa, Homo Sapiens
MSVVPLEHG

SEQ ID NO: 401209 - protein, 9 aa, Homo Sapiens
EAEMRTYAA

SEQ ID NO: 401210 - protein, 9 aa, Homo Sapiens
KKDKQNRTA

SEQ ID NO: 401211 - protein, 9 aa, Homo Sapiens
QLFDRLKLF

SEQ ID NO: 401212 - protein, 9 aa, Homo Sapiens
VQQQPIIQT

SEQ ID NO: 401213 - protein, 9 aa, Homo Sapiens
KLHQTETFP

SEQ ID NO: 401214 - protein, 9 aa, Homo Sapiens
LHHMNKDFC

SEQ ID NO: 401215 - protein, 9 aa, Homo Sapiens
ETRVQDLLS

SEQ ID NO: 401216 - protein, 9 aa, Homo Sapiens
HAHKTVLLF

SEQ ID NO: 401217 - protein, 9 aa, Homo Sapiens
LPYDVNSGV

SEQ ID NO: 401218 - protein, 9 aa, Homo Sapiens
DNFSEDFGP

SEQ ID NO: 401219 - protein, 9 aa, Homo Sapiens
VVGEFTGSF

SEQ ID NO: 401220 - protein, 9 aa, Homo Sapiens
QLAESFGLK

SEQ ID NO: 401221 - protein, 9 aa, Homo Sapiens
SGVCCTGTE

SEQ ID NO: 401222 - protein, 9 aa, Homo Sapiens
TNNQLSNCR

SEQ ID NO: 401223 - protein, 9 aa, Homo Sapiens
SERFKNWKR

SEQ ID NO: 401224 - protein, 9 aa, Homo Sapiens
LTLRESLSD

SEQ ID NO: 401225 - protein, 9 aa, Homo Sapiens
ADSPMDDLF

SEQ ID NO: 401226 - protein, 9 aa, Homo Sapiens
QLQKDILEE

SEQ ID NO: 401227 - protein, 9 aa, Homo Sapiens
LRVGANVQF

SEQ ID NO: 401228 - protein, 9 aa, Homo Sapiens
LTLNAKSIC

SEQ ID NO: 401229 - protein, 9 aa, Homo Sapiens
LHATTQAPT

SEQ ID NO: 401230 - protein, 9 aa, Homo Sapiens
LFSSDICRS

SEQ ID NO: 401231 - protein, 9 aa, Homo Sapiens
SEKIWIEII

SEQ ID NO: 401232 - protein, 9 aa, Homo Sapiens
IKKTKVEIR

SEQ ID NO: 401233 - protein, 9 aa, Homo Sapiens
TQGVRCSDC

SEQ ID NO: 401234 - protein, 9 aa, Homo Sapiens
AGGLVAHLL

SEQ ID NO: 401235 - protein, 9 aa, Homo Sapiens
CQVLFCLNF

SEQ ID NO: 401236 - protein, 9 aa, Homo Sapiens
DPEELFTTL

SEQ ID NO: 401237 - protein, 9 aa, Homo Sapiens
KLENCTKMF

SEQ ID NO: 401238 - protein, 9 aa, Homo Sapiens
TPVPEVIVY

SEQ ID NO: 401239 - protein, 9 aa, Homo Sapiens
RALLKSEFC

SEQ ID NO: 401240 - protein, 9 aa, Homo Sapiens
NFTKELNQY

SEQ ID NO: 401241 - protein, 9 aa, Homo Sapiens
IRVLCIGNK

SEQ ID NO: 401242 - protein, 9 aa, Homo Sapiens
LMFWCKFTA

SEQ ID NO: 401243 - protein, 9 aa, Homo Sapiens
ATAAAAPAP

SEQ ID NO: 401244 - protein, 9 aa, Homo Sapiens
KSMIQMKTH

SEQ ID NO: 401245 - protein, 9 aa, Homo Sapiens
QTLKHKFKT

SEQ ID NO: 401246 - protein, 9 aa, Homo Sapiens
QSGIYSCEA

SEQ ID NO: 401247 - protein, 9 aa, Homo Sapiens
YDLHHKDSE

SEQ ID NO: 401248 - protein, 9 aa, Homo Sapiens
KTDQKEFVR

SEQ ID NO: 401249 - protein, 9 aa, Homo Sapiens
SSAQKLFST

SEQ ID NO: 401250 - protein, 9 aa, Homo Sapiens
PEPTRTKDV

SEQ ID NO: 401251 - protein, 9 aa, Homo Sapiens
GSSENSAYR

SEQ ID NO: 401252 - protein, 9 aa, Homo Sapiens
LSLHQITHF

SEQ ID NO: 401253 - protein, 9 aa, Homo Sapiens
ATQGASFSI

SEQ ID NO: 401254 - protein, 9 aa, Homo Sapiens
ACLCPQVDK

SEQ ID NO: 401255 - protein, 9 aa, Homo Sapiens
VFLIFWNIK

SEQ ID NO: 401256 - protein, 9 aa, Homo Sapiens
LDPLTLEPT

SEQ ID NO: 401257 - protein, 9 aa, Homo Sapiens
IIKQIPSSE

SEQ ID NO: 401258 - protein, 9 aa, Homo Sapiens
KEAERNSYC

SEQ ID NO: 401259 - protein, 9 aa, Homo Sapiens
RNTISFAVC

SEQ ID NO: 401260 - protein, 9 aa, Homo Sapiens
GIAMLAKGY

SEQ ID NO: 401261 - protein, 9 aa, Homo Sapiens
SPFFITTVP

SEQ ID NO: 401262 - protein, 9 aa, Homo Sapiens
NYLFRQNRL

SEQ ID NO: 401263 - protein, 9 aa, Homo Sapiens
TKKHTGKQV

SEQ ID NO: 401264 - protein, 9 aa, Homo Sapiens
PQGPFYFCR

SEQ ID NO: 401265 - protein, 9 aa, Homo Sapiens
SVLQFIQEH

SEQ ID NO: 401266 - protein, 9 aa, Homo Sapiens
IKVMNRRRI

SEQ ID NO: 401267 - protein, 9 aa, Homo Sapiens
HFVLDINRK

SEQ ID NO: 401268 - protein, 9 aa, Homo Sapiens
FIKALKGDH

SEQ ID NO: 401269 - protein, 9 aa, Homo Sapiens
GRTVEVQGP

SEQ ID NO: 401270 - protein, 9 aa, Homo Sapiens
LWDGVDSDA

SEQ ID NO: 401271 - protein, 9 aa, Homo Sapiens
SCHGREQGV

SEQ ID NO: 401272 - protein, 9 aa, Homo Sapiens
VEIIQCRNI

SEQ ID NO: 401273 - protein, 9 aa, Homo Sapiens
IPQKQDKKP

SEQ ID NO: 401274 - protein, 9 aa, Homo Sapiens
DGTNSPPDA

SEQ ID NO: 401275 - protein, 9 aa, Homo Sapiens
LQKDILEER

SEQ ID NO: 401276 - protein, 9 aa, Homo Sapiens
ITHTRILFE

SEQ ID NO: 401277 - protein, 9 aa, Homo Sapiens
YLICFFDSS

SEQ ID NO: 401278 - protein, 9 aa, Homo Sapiens
EHTFVPVTD

SEQ ID NO: 401279 - protein, 9 aa, Homo Sapiens
HSDKRLWVL

SEQ ID NO: 401280 - protein, 9 aa, Homo Sapiens
AAAVVRWTG

SEQ ID NO: 401281 - protein, 9 aa, Homo Sapiens
RGSQAPLIT

SEQ ID NO: 401282 - protein, 9 aa, Homo Sapiens
IHRRVNTGE

SEQ ID NO: 401283 - protein, 9 aa, Homo Sapiens
HIMDRTPDK

SEQ ID NO: 401284 - protein, 9 aa, Homo Sapiens
GASFSISLV

SEQ ID NO: 401285 - protein, 9 aa, Homo Sapiens
NWMKYFILT

SEQ ID NO: 401286 - protein, 9 aa, Homo Sapiens
FWYLLESKG

SEQ ID NO: 401287 - protein, 9 aa, Homo Sapiens
FFLYYWWLP

SEQ ID NO: 401288 - protein, 9 aa, Homo Sapiens
LMGNLRNKC

SEQ ID NO: 401289 - protein, 9 aa, Homo Sapiens
ADKLPEDSF

SEQ ID NO: 401290 - protein, 9 aa, Homo Sapiens
PPFYGFLGK

SEQ ID NO: 401291 - protein, 9 aa, Homo Sapiens
VVTIAWLLE

SEQ ID NO: 401292 - protein, 9 aa, Homo Sapiens
SWGPYLQFW

SEQ ID NO: 401293 - protein, 9 aa, Homo Sapiens
RSMGLIIEI

SEQ ID NO: 401294 - protein, 9 aa, Homo Sapiens
QLPLSLKDL

SEQ ID NO: 401295 - protein, 9 aa, Homo Sapiens
RVMAQALDI

SEQ ID NO: 401296 - protein, 9 aa, Homo Sapiens
YTLSDGLHY

SEQ ID NO: 401297 - protein, 9 aa, Homo Sapiens
RKGSTFEEH

SEQ ID NO: 401298 - protein, 9 aa, Homo Sapiens
LHKVKTTSK

SEQ ID NO: 401299 - protein, 9 aa, Homo Sapiens
EPLQASELI

SEQ ID NO: 401300 - protein, 9 aa, Homo Sapiens
PSNSKNIST

SEQ ID NO: 401301 - protein, 9 aa, Homo Sapiens
LLAPVSSIH

SEQ ID NO: 401302 - protein, 9 aa, Homo Sapiens
CHNFNQFTA

SEQ ID NO: 401303 - protein, 9 aa, Homo Sapiens
QTASNSWDE

SEQ ID NO: 401304 - protein, 9 aa, Homo Sapiens
ISVPAVAMH

SEQ ID NO: 401305 - protein, 9 aa, Homo Sapiens
RYHEITHTG

SEQ ID NO: 401306 - protein, 9 aa, Homo Sapiens
WDPNDMFQY

SEQ ID NO: 401307 - protein, 9 aa, Homo Sapiens
RPAGLWLSG

SEQ ID NO: 401308 - protein, 9 aa, Homo Sapiens
KYWREHAHK

SEQ ID NO: 401309 - protein, 9 aa, Homo Sapiens
FGGVIPQYH

SEQ ID NO: 401310 - protein, 9 aa, Homo Sapiens
TYMTLMSSI

SEQ ID NO: 401311 - protein, 9 aa, Homo Sapiens
FQNESVAGI

SEQ ID NO: 401312 - protein, 9 aa, Homo Sapiens
LLIQMSVVP

SEQ ID NO: 401313 - protein, 9 aa, Homo Sapiens
DRQTVMISA

SEQ ID NO: 401314 - protein, 9 aa, Homo Sapiens
KLCKSVFSI

SEQ ID NO: 401315 - protein, 9 aa, Homo Sapiens
IHEITHSEE

SEQ ID NO: 401316 - protein, 9 aa, Homo Sapiens
SPTDSQNDM

SEQ ID NO: 401317 - protein, 9 aa, Homo Sapiens
QTAKFHSRV

SEQ ID NO: 401318 - protein, 9 aa, Homo Sapiens
NVTGLNQSH

SEQ ID NO: 401319 - protein, 9 aa, Homo Sapiens
DKVCQPLYN

SEQ ID NO: 401320 - protein, 9 aa, Homo Sapiens
QDKKPRKIM

SEQ ID NO: 401321 - protein, 9 aa, Homo Sapiens
RVAKMGLML

SEQ ID NO: 401322 - protein, 9 aa, Homo Sapiens
YHEQIHTGE

SEQ ID NO: 401323 - protein, 9 aa, Homo Sapiens
KKLFDDLGD

SEQ ID NO: 401324 - protein, 9 aa, Homo Sapiens
YFRSTALPE

SEQ ID NO: 401325 - protein, 9 aa, Homo Sapiens
SQLFQLNYL

SEQ ID NO: 401326 - protein, 9 aa, Homo Sapiens
HFFTESLWE

SEQ ID NO: 401327 - protein, 9 aa, Homo Sapiens
KEKNKLQKQ

SEQ ID NO: 401328 - protein, 9 aa, Homo Sapiens
KLLNAKHSD

SEQ ID NO: 401329 - protein, 9 aa, Homo Sapiens
LSDVCRIDY

SEQ ID NO: 401330 - protein, 9 aa, Homo Sapiens
VMISATWPH

SEQ ID NO: 401331 - protein, 9 aa, Homo Sapiens
VHPVFFIIF

SEQ ID NO: 401332 - protein, 9 aa, Homo Sapiens
QRKLKKQRL

SEQ ID NO: 401333 - protein, 9 aa, Homo Sapiens
SYQTAKFHS

SEQ ID NO: 401334 - protein, 9 aa, Homo Sapiens
TPLKEHPDL

SEQ ID NO: 401335 - protein, 9 aa, Homo Sapiens
KYLQGSHQA

SEQ ID NO: 401336 - protein, 9 aa, Homo Sapiens
NWDKWLSRQ

SEQ ID NO: 401337 - protein, 9 aa, Homo Sapiens
DYQKCHRTT

SEQ ID NO: 401338 - protein, 9 aa, Homo Sapiens
SPEALRMVW

SEQ ID NO: 401339 - protein, 9 aa, Homo Sapiens
SGIISVPAV

SEQ ID NO: 401340 - protein, 9 aa, Homo Sapiens
RGKNIFVLG

SEQ ID NO: 401341 - protein, 9 aa, Homo Sapiens
SIKGVSEKI

SEQ ID NO: 401342 - protein, 9 aa, Homo Sapiens
LEVQAFKRI

SEQ ID NO: 401343 - protein, 9 aa, Homo Sapiens
AFPTASPTP

SEQ ID NO: 401344 - protein, 9 aa, Homo Sapiens
GSAEIMNLV

SEQ ID NO: 401345 - protein, 9 aa, Homo Sapiens
WAINISEAN

SEQ ID NO: 401346 - protein, 9 aa, Homo Sapiens
LLSPKDKIL

SEQ ID NO: 401347 - protein, 9 aa, Homo Sapiens
EHELTELTA

SEQ ID NO: 401348 - protein, 9 aa, Homo Sapiens
TIIYSLEKN

SEQ ID NO: 401349 - protein, 9 aa, Homo Sapiens
NTMNRSTLS

SEQ ID NO: 401350 - protein, 9 aa, Homo Sapiens
LSISQLLSQ

SEQ ID NO: 401351 - protein, 9 aa, Homo Sapiens
FTTYTVVRM

SEQ ID NO: 401352 - protein, 9 aa, Homo Sapiens
TYNTVTVML

SEQ ID NO: 401353 - protein, 9 aa, Homo Sapiens
GPTVCQLLS

SEQ ID NO: 401354 - protein, 9 aa, Homo Sapiens
KTRMAELSR

SEQ ID NO: 401355 - protein, 9 aa, Homo Sapiens
RTVEVQGPS

SEQ ID NO: 401356 - protein, 9 aa, Homo Sapiens
DSAGAGTGA

SEQ ID NO: 401357 - protein, 9 aa, Homo Sapiens
PISFPSFVK

SEQ ID NO: 401358 - protein, 9 aa, Homo Sapiens
TYNPLGKIF

SEQ ID NO: 401359 - protein, 9 aa, Homo Sapiens
AQALDIPAT

SEQ ID NO: 401360 - protein, 9 aa, Homo Sapiens
QVDENYLIS

SEQ ID NO: 401361 - protein, 9 aa, Homo Sapiens
IYSLEKNPN

SEQ ID NO: 401362 - protein, 9 aa, Homo Sapiens
GGGGATGPG

SEQ ID NO: 401363 - protein, 9 aa, Homo Sapiens
VLEVQLTKY

SEQ ID NO: 401364 - protein, 9 aa, Homo Sapiens
SRTAHLVIH

SEQ ID NO: 401365 - protein, 9 aa, Homo Sapiens
PRYLCEGME

SEQ ID NO: 401366 - protein, 9 aa, Homo Sapiens
LLSFCYKVF

SEQ ID NO: 401367 - protein, 9 aa, Homo Sapiens
LQLQKDILE

SEQ ID NO: 401368 - protein, 9 aa, Homo Sapiens
KRSMGLIIE

SEQ ID NO: 401369 - protein, 9 aa, Homo Sapiens
PGESDKVQQ

SEQ ID NO: 401370 - protein, 9 aa, Homo Sapiens
FALTNDSKR

SEQ ID NO: 401371 - protein, 9 aa, Homo Sapiens
RDIQDMQIK

SEQ ID NO: 401372 - protein, 9 aa, Homo Sapiens
LKEFNYYGL

SEQ ID NO: 401373 - protein, 9 aa, Homo Sapiens
SARVRIWEL

SEQ ID NO: 401374 - protein, 9 aa, Homo Sapiens
WRASSFRMT

SEQ ID NO: 401375 - protein, 9 aa, Homo Sapiens
VGLTNEGSD

SEQ ID NO: 401376 - protein, 9 aa, Homo Sapiens
FLIILGSTE

SEQ ID NO: 401377 - protein, 9 aa, Homo Sapiens
QAKLSQILD

SEQ ID NO: 401378 - protein, 9 aa, Homo Sapiens
KAAAVMGGV

SEQ ID NO: 401379 - protein, 9 aa, Homo Sapiens
KLLGTHISG

SEQ ID NO: 401380 - protein, 9 aa, Homo Sapiens
VKSRKLALP

SEQ ID NO: 401381 - protein, 9 aa, Homo Sapiens
KGTYTLSDG

SEQ ID NO: 401382 - protein, 9 aa, Homo Sapiens
LLRCHVLTS

SEQ ID NO: 401383 - protein, 9 aa, Homo Sapiens
TVFKVLKPD

SEQ ID NO: 401384 - protein, 9 aa, Homo Sapiens
PRENVPKDI

SEQ ID NO: 401385 - protein, 9 aa, Homo Sapiens
LRRMRIFRI

SEQ ID NO: 401386 - protein, 9 aa, Homo Sapiens
EQIPIHKFT

SEQ ID NO: 401387 - protein, 9 aa, Homo Sapiens
LCTLKLSYV

SEQ ID NO: 401388 - protein, 9 aa, Homo Sapiens
GKDRNQKKD

SEQ ID NO: 401389 - protein, 9 aa, Homo Sapiens
QEHVFNVIP

SEQ ID NO: 401390 - protein, 9 aa, Homo Sapiens
HVMWHSEFP

SEQ ID NO: 401391 - protein, 9 aa, Homo Sapiens
IKSSGPPSY

SEQ ID NO: 401392 - protein, 9 aa, Homo Sapiens
CPRAPQSGI

SEQ ID NO: 401393 - protein, 9 aa, Homo Sapiens
YPITCTLDF

SEQ ID NO: 401394 - protein, 9 aa, Homo Sapiens
LEATKQKGA

SEQ ID NO: 401395 - protein, 9 aa, Homo Sapiens
ARSIYERVL

SEQ ID NO: 401396 - protein, 9 aa, Homo Sapiens
KIRLLAWKE

SEQ ID NO: 401397 - protein, 9 aa, Homo Sapiens
ARVQAERTE

SEQ ID NO: 401398 - protein, 9 aa, Homo Sapiens
PKGVLSTHH

SEQ ID NO: 401399 - protein, 9 aa, Homo Sapiens
DTGVNGEMS

SEQ ID NO: 401400 - protein, 9 aa, Homo Sapiens
MGMCGSRST

SEQ ID NO: 401401 - protein, 9 aa, Homo Sapiens
YKICKLDNG

SEQ ID NO: 401402 - protein, 9 aa, Homo Sapiens
STLEMGCTE

SEQ ID NO: 401403 - protein, 9 aa, Homo Sapiens
QREAPLNNL

SEQ ID NO: 401404 - protein, 9 aa, Homo Sapiens
LIVDVYLVT

SEQ ID NO: 401405 - protein, 9 aa, Homo Sapiens
IVEIIQCRN

SEQ ID NO: 401406 - protein, 9 aa, Homo Sapiens
IWIEIIALS

SEQ ID NO: 401407 - protein, 9 aa, Homo Sapiens
DISSKLISL

SEQ ID NO: 401408 - protein, 9 aa, Homo Sapiens
LTAPGTPCG

SEQ ID NO: 401409 - protein, 9 aa, Homo Sapiens
PDHPNFTRA

SEQ ID NO: 401410 - protein, 9 aa, Homo Sapiens
HYPDAGENG

SEQ ID NO: 401411 - protein, 9 aa, Homo Sapiens
SLEEENKKH

SEQ ID NO: 401412 - protein, 9 aa, Homo Sapiens
TDVGIAMLA

SEQ ID NO: 401413 - protein, 9 aa, Homo Sapiens
DGWEIGYLN

SEQ ID NO: 401414 - protein, 9 aa, Homo Sapiens
TGCYVSATN

SEQ ID NO: 401415 - protein, 9 aa, Homo Sapiens
INRTRQVDN

SEQ ID NO: 401416 - protein, 9 aa, Homo Sapiens
FEDVDIFYY

SEQ ID NO: 401417 - protein, 9 aa, Homo Sapiens
HFQKYHLGL

SEQ ID NO: 401418 - protein, 9 aa, Homo Sapiens
PTAAPHPML

SEQ ID NO: 401419 - protein, 9 aa, Homo Sapiens
AQTDAEDSP

SEQ ID NO: 401420 - protein, 9 aa, Homo Sapiens
ECGKAVSIF

SEQ ID NO: 401421 - protein, 9 aa, Homo Sapiens
CTLTCMQYV

SEQ ID NO: 401422 - protein, 9 aa, Homo Sapiens
WRIRKKYLL

SEQ ID NO: 401423 - protein, 9 aa, Homo Sapiens
SAQKLFSTL

SEQ ID NO: 401424 - protein, 9 aa, Homo Sapiens
HSRTGCTFK

SEQ ID NO: 401425 - protein, 9 aa, Homo Sapiens
PLKWYAPKC

SEQ ID NO: 401426 - protein, 9 aa, Homo Sapiens
GLNAKLLYI

SEQ ID NO: 401427 - protein, 9 aa, Homo Sapiens
FPQSTDQTL

SEQ ID NO: 401428 - protein, 9 aa, Homo Sapiens
LSFQCPGRM

SEQ ID NO: 401429 - protein, 9 aa, Homo Sapiens
MTCDKWTDQ

SEQ ID NO: 401430 - protein, 9 aa, Homo Sapiens
DWGNFFLLK

SEQ ID NO: 401431 - protein, 9 aa, Homo Sapiens
VLDVDYRNI

SEQ ID NO: 401432 - protein, 9 aa, Homo Sapiens
LVYGITPEN

SEQ ID NO: 401433 - protein, 9 aa, Homo Sapiens
QLWLWLGGG

SEQ ID NO: 401434 - protein, 9 aa, Homo Sapiens
SDKKENKSF

SEQ ID NO: 401435 - protein, 9 aa, Homo Sapiens
ERLKKKLLE

SEQ ID NO: 401436 - protein, 9 aa, Homo Sapiens
DMMLENLTL

SEQ ID NO: 401437 - protein, 9 aa, Homo Sapiens
EKELSEGRN

SEQ ID NO: 401438 - protein, 9 aa, Homo Sapiens
YLEVMLDNF

SEQ ID NO: 401439 - protein, 9 aa, Homo Sapiens
IIYRLKERF

SEQ ID NO: 401440 - protein, 9 aa, Homo Sapiens
ELAQIEEFK

SEQ ID NO: 401441 - protein, 9 aa, Homo Sapiens
KDVIRKDVC

SEQ ID NO: 401442 - protein, 9 aa, Homo Sapiens
HRRVNTGEK

SEQ ID NO: 401443 - protein, 9 aa, Homo Sapiens
ERGEGASWS

SEQ ID NO: 401444 - protein, 9 aa, Homo Sapiens
KILLVQNIG

SEQ ID NO: 401445 - protein, 9 aa, Homo Sapiens
QESQSQAIL

SEQ ID NO: 401446 - protein, 9 aa, Homo Sapiens
MADVKLSFQ

SEQ ID NO: 401447 - protein, 9 aa, Homo Sapiens
RASGPVTMS

SEQ ID NO: 401448 - protein, 9 aa, Homo Sapiens
EEVQSFEKE

SEQ ID NO: 401449 - protein, 9 aa, Homo Sapiens
KDLKKTNTK

SEQ ID NO: 401450 - protein, 9 aa, Homo Sapiens
ELFTTLEKI

SEQ ID NO: 401451 - protein, 9 aa, Homo Sapiens
ELWDGVDSD

SEQ ID NO: 401452 - protein, 9 aa, Homo Sapiens
EAHNPDSVA

SEQ ID NO: 401453 - protein, 9 aa, Homo Sapiens
GINRTRQVD

SEQ ID NO: 401454 - protein, 9 aa, Homo Sapiens
VGKITIINK

SEQ ID NO: 401455 - protein, 9 aa, Homo Sapiens
EKCEGFKLH

SEQ ID NO: 401456 - protein, 9 aa, Homo Sapiens
KVSSTPPVC

SEQ ID NO: 401457 - protein, 9 aa, Homo Sapiens
REHAHKTVL

SEQ ID NO: 401458 - protein, 9 aa, Homo Sapiens
AHLSALVSM

SEQ ID NO: 401459 - protein, 9 aa, Homo Sapiens
GETPPSPLQ

SEQ ID NO: 401460 - protein, 9 aa, Homo Sapiens
LIRKMSPHT

SEQ ID NO: 401461 - protein, 9 aa, Homo Sapiens
SRKLALPHS

SEQ ID NO: 401462 - protein, 9 aa, Homo Sapiens
GPDQYLISA

SEQ ID NO: 401463 - protein, 9 aa, Homo Sapiens
LPEGSLIIQ

SEQ ID NO: 401464 - protein, 9 aa, Homo Sapiens
FIYLLTVQR

SEQ ID NO: 401465 - protein, 9 aa, Homo Sapiens
KLTDVGIAM

SEQ ID NO: 401466 - protein, 9 aa, Homo Sapiens
PFIMNFINY

SEQ ID NO: 401467 - protein, 9 aa, Homo Sapiens
ALEQHKIQS

SEQ ID NO: 401468 - protein, 9 aa, Homo Sapiens
NLWTICQNT

SEQ ID NO: 401469 - protein, 9 aa, Homo Sapiens
HNGDILMEC

SEQ ID NO: 401470 - protein, 9 aa, Homo Sapiens
EEVQNKCSI

SEQ ID NO: 401471 - protein, 9 aa, Homo Sapiens
DEPAESPLE

SEQ ID NO: 401472 - protein, 9 aa, Homo Sapiens
NVANNILTD

SEQ ID NO: 401473 - protein, 9 aa, Homo Sapiens
LKECIDQML

SEQ ID NO: 401474 - protein, 9 aa, Homo Sapiens
SLHQITHFI

SEQ ID NO: 401475 - protein, 9 aa, Homo Sapiens
GLNFPSPGK

SEQ ID NO: 401476 - protein, 9 aa, Homo Sapiens
SIKFDIVPS

SEQ ID NO: 401477 - protein, 9 aa, Homo Sapiens
SRANAIDKW

SEQ ID NO: 401478 - protein, 9 aa, Homo Sapiens
KINQYTPEM

SEQ ID NO: 401479 - protein, 9 aa, Homo Sapiens
RQRLNKKYS

SEQ ID NO: 401480 - protein, 9 aa, Homo Sapiens
PFYLQNCSM

SEQ ID NO: 401481 - protein, 9 aa, Homo Sapiens
VAELDHLYK

SEQ ID NO: 401482 - protein, 9 aa, Homo Sapiens
PEAQNIYYQ

SEQ ID NO: 401483 - protein, 9 aa, Homo Sapiens
ELQADVDTT

SEQ ID NO: 401484 - protein, 9 aa, Homo Sapiens
VDHPFLFLI

SEQ ID NO: 401485 - protein, 9 aa, Homo Sapiens
DEIGVVSDY

SEQ ID NO: 401486 - protein, 9 aa, Homo Sapiens
QKRVLKSKT

SEQ ID NO: 401487 - protein, 9 aa, Homo Sapiens
LEQESLLLL

SEQ ID NO: 401488 - protein, 9 aa, Homo Sapiens
KGDSKDSKG

SEQ ID NO: 401489 - protein, 9 aa, Homo Sapiens
YQNKIGAYD

SEQ ID NO: 401490 - protein, 9 aa, Homo Sapiens
KKHDKYWVE

SEQ ID NO: 401491 - protein, 9 aa, Homo Sapiens
EILQITQSA

SEQ ID NO: 401492 - protein, 9 aa, Homo Sapiens
SDNWVVYQY

SEQ ID NO: 401493 - protein, 9 aa, Homo Sapiens
LSSDELSKA

SEQ ID NO: 401494 - protein, 9 aa, Homo Sapiens
TTFNKGKKT

SEQ ID NO: 401495 - protein, 9 aa, Homo Sapiens
NYLSGDITI

SEQ ID NO: 401496 - protein, 9 aa, Homo Sapiens
LNPPFYGFL

SEQ ID NO: 401497 - protein, 9 aa, Homo Sapiens
AFNWSSRLT

SEQ ID NO: 401498 - protein, 9 aa, Homo Sapiens
ISQLLSQTF

SEQ ID NO: 401499 - protein, 9 aa, Homo Sapiens
KRSIKCFKT

SEQ ID NO: 401500 - protein, 9 aa, Homo Sapiens
FVKKLLISL

SEQ ID NO: 401501 - protein, 9 aa, Homo Sapiens
PTQLSTTME

SEQ ID NO: 401502 - protein, 9 aa, Homo Sapiens
LYMQFRVDS

SEQ ID NO: 401503 - protein, 9 aa, Homo Sapiens
ISTAEQPYV

SEQ ID NO: 401504 - protein, 9 aa, Homo Sapiens
LFRQNRLYD

SEQ ID NO: 401505 - protein, 9 aa, Homo Sapiens
GLITQGVRC

SEQ ID NO: 401506 - protein, 9 aa, Homo Sapiens
QPEGQCQIE

SEQ ID NO: 401507 - protein, 9 aa, Homo Sapiens
CKNNSTCID

SEQ ID NO: 401508 - protein, 9 aa, Homo Sapiens
DKLFVETGK

SEQ ID NO: 401509 - protein, 9 aa, Homo Sapiens
KDRRLSNKK

SEQ ID NO: 401510 - protein, 9 aa, Homo Sapiens
NMFLAVMRF

SEQ ID NO: 401511 - protein, 9 aa, Homo Sapiens
GIDRRSSVP

SEQ ID NO: 401512 - protein, 9 aa, Homo Sapiens
LNNLSVAQC

SEQ ID NO: 401513 - protein, 9 aa, Homo Sapiens
LGVCSNTGS

SEQ ID NO: 401514 - protein, 9 aa, Homo Sapiens
MEQRVITIS

SEQ ID NO: 401515 - protein, 9 aa, Homo Sapiens
NKKDKQNRT

SEQ ID NO: 401516 - protein, 9 aa, Homo Sapiens
TIKYLESEK

SEQ ID NO: 401517 - protein, 9 aa, Homo Sapiens
LAQMGIISP

SEQ ID NO: 401518 - protein, 9 aa, Homo Sapiens
WRQLWLWLG

SEQ ID NO: 401519 - protein, 9 aa, Homo Sapiens
KFKHLFQQP

SEQ ID NO: 401520 - protein, 9 aa, Homo Sapiens
KRNKKQNSP

SEQ ID NO: 401521 - protein, 9 aa, Homo Sapiens
DFCVMPRDP

SEQ ID NO: 401522 - protein, 9 aa, Homo Sapiens
SPPHSTTGT

SEQ ID NO: 401523 - protein, 9 aa, Homo Sapiens
CKMLQLERN

SEQ ID NO: 401524 - protein, 9 aa, Homo Sapiens
RSGDSNPHS

SEQ ID NO: 401525 - protein, 9 aa, Homo Sapiens
IKVSYFTHH

SEQ ID NO: 401526 - protein, 9 aa, Homo Sapiens
LVFENTRWI

SEQ ID NO: 401527 - protein, 9 aa, Homo Sapiens
NVHTQTHTG

SEQ ID NO: 401528 - protein, 9 aa, Homo Sapiens
QNKIKQVKE

SEQ ID NO: 401529 - protein, 9 aa, Homo Sapiens
VMSGVCCTG

SEQ ID NO: 401530 - protein, 9 aa, Homo Sapiens
FPKGSQSVV

SEQ ID NO: 401531 - protein, 9 aa, Homo Sapiens
DNIFASFSD

SEQ ID NO: 401532 - protein, 9 aa, Homo Sapiens
PPGQRRLDI

SEQ ID NO: 401533 - protein, 9 aa, Homo Sapiens
SWANSNLTL

SEQ ID NO: 401534 - protein, 9 aa, Homo Sapiens
FWNIKIRLL

SEQ ID NO: 401535 - protein, 9 aa, Homo Sapiens
MIIYRLKER

SEQ ID NO: 401536 - protein, 9 aa, Homo Sapiens
PKVLADLGS

SEQ ID NO: 401537 - protein, 9 aa, Homo Sapiens
SYKSHISTL

SEQ ID NO: 401538 - protein, 9 aa, Homo Sapiens
PWYKETTYQ

SEQ ID NO: 401539 - protein, 9 aa, Homo Sapiens
GIQLFDRLK

SEQ ID NO: 401540 - protein, 9 aa, Homo Sapiens
QPSPVEPQG

SEQ ID NO: 401541 - protein, 9 aa, Homo Sapiens
HPSLEEENK

SEQ ID NO: 401542 - protein, 9 aa, Homo Sapiens
NEEGSVAEG

SEQ ID NO: 401543 - protein, 9 aa, Homo Sapiens
PMIKALLRT

SEQ ID NO: 401544 - protein, 9 aa, Homo Sapiens
RTLQISYDT

SEQ ID NO: 401545 - protein, 9 aa, Homo Sapiens
FSIKQTIVL

SEQ ID NO: 401546 - protein, 9 aa, Homo Sapiens
SLLSSELEQ

SEQ ID NO: 401547 - protein, 9 aa, Homo Sapiens
IQMSVVPLE

SEQ ID NO: 401548 - protein, 9 aa, Homo Sapiens
IQVILKSTS

SEQ ID NO: 401549 - protein, 9 aa, Homo Sapiens
GIPFIETST

SEQ ID NO: 401550 - protein, 9 aa, Homo Sapiens
ELDRRPLND

SEQ ID NO: 401551 - protein, 9 aa, Homo Sapiens
TPDKLKKEL

SEQ ID NO: 401552 - protein, 9 aa, Homo Sapiens
PYSELDNGK

SEQ ID NO: 401553 - protein, 9 aa, Homo Sapiens
DFSSGGATA

SEQ ID NO: 401554 - protein, 9 aa, Homo Sapiens
LLQDTAFQR

SEQ ID NO: 401555 - protein, 9 aa, Homo Sapiens
YERVLDVDY

SEQ ID NO: 401556 - protein, 9 aa, Homo Sapiens
ICHPLRYNM

SEQ ID NO: 401557 - protein, 9 aa, Homo Sapiens
QHKIQSQQE

SEQ ID NO: 401558 - protein, 9 aa, Homo Sapiens
INGFKRHKR

SEQ ID NO: 401559 - protein, 9 aa, Homo Sapiens
SGDSNPHSG

SEQ ID NO: 401560 - protein, 9 aa, Homo Sapiens
AEIMNLVLA

SEQ ID NO: 401561 - protein, 9 aa, Homo Sapiens
SMLIEEGVL

SEQ ID NO: 401562 - protein, 9 aa, Homo Sapiens
VLTQTYQEK

SEQ ID NO: 401563 - protein, 9 aa, Homo Sapiens
HRTTVMTVA

SEQ ID NO: 401564 - protein, 9 aa, Homo Sapiens
PQDKIFYPS

SEQ ID NO: 401565 - protein, 9 aa, Homo Sapiens
ALPHSKSCD

SEQ ID NO: 401566 - protein, 9 aa, Homo Sapiens
PPPCPSYPE

SEQ ID NO: 401567 - protein, 9 aa, Homo Sapiens
EEEEEDDYY

SEQ ID NO: 401568 - protein, 9 aa, Homo Sapiens
NTWNEKYSY

SEQ ID NO: 401569 - protein, 9 aa, Homo Sapiens
HLVFPAVGP

SEQ ID NO: 401570 - protein, 9 aa, Homo Sapiens
YLLYALTLP

SEQ ID NO: 401571 - protein, 9 aa, Homo Sapiens
NTLEINFER

SEQ ID NO: 401572 - protein, 9 aa, Homo Sapiens
EENESRWRC

SEQ ID NO: 401573 - protein, 9 aa, Homo Sapiens
KYLESEKSR

SEQ ID NO: 401574 - protein, 9 aa, Homo Sapiens
DVNQMSFNS

SEQ ID NO: 401575 - protein, 9 aa, Homo Sapiens
YYNISGTGF

SEQ ID NO: 401576 - protein, 9 aa, Homo Sapiens
RSIYERVLD

SEQ ID NO: 401577 - protein, 9 aa, Homo Sapiens
MLAIRSILL

SEQ ID NO: 401578 - protein, 9 aa, Homo Sapiens
DIQEKPALK

SEQ ID NO: 401579 - protein, 9 aa, Homo Sapiens
MEVNKTVDK

SEQ ID NO: 401580 - protein, 9 aa, Homo Sapiens
HADMAKKET

SEQ ID NO: 401581 - protein, 9 aa, Homo Sapiens
EKGPHSSRD

SEQ ID NO: 401582 - protein, 9 aa, Homo Sapiens
VEALSVERK

SEQ ID NO: 401583 - protein, 9 aa, Homo Sapiens
FPLSLYSLN

SEQ ID NO: 401584 - protein, 9 aa, Homo Sapiens
SIDGLLNQY

SEQ ID NO: 401585 - protein, 9 aa, Homo Sapiens
YSLEKNPNA

SEQ ID NO: 401586 - protein, 9 aa, Homo Sapiens
IIQEGAVGK

SEQ ID NO: 401587 - protein, 9 aa, Homo Sapiens
TSQNIPLSY

SEQ ID NO: 401588 - protein, 9 aa, Homo Sapiens
MNRRRINGF

SEQ ID NO: 401589 - protein, 9 aa, Homo Sapiens
AERGEGASW

SEQ ID NO: 401590 - protein, 9 aa, Homo Sapiens
PGTVVTFAP

SEQ ID NO: 401591 - protein, 9 aa, Homo Sapiens
NEFPEDLHT

SEQ ID NO: 401592 - protein, 9 aa, Homo Sapiens
RYPPVNWAA

SEQ ID NO: 401593 - protein, 9 aa, Homo Sapiens
NARDIQDMQ

SEQ ID NO: 401594 - protein, 9 aa, Homo Sapiens
NVCFEWGAF

SEQ ID NO: 401595 - protein, 9 aa, Homo Sapiens
LCQPYRSEF

SEQ ID NO: 401596 - protein, 9 aa, Homo Sapiens
LSPEDVFGC

SEQ ID NO: 401597 - protein, 9 aa, Homo Sapiens
HLSALVSME

SEQ ID NO: 401598 - protein, 9 aa, Homo Sapiens
ELYPPPPPC

SEQ ID NO: 401599 - protein, 9 aa, Homo Sapiens
LQDNLCQLS

SEQ ID NO: 401600 - protein, 9 aa, Homo Sapiens
QRLNKKYSI

SEQ ID NO: 401601 - protein, 9 aa, Homo Sapiens
SNTNLTATM

SEQ ID NO: 401602 - protein, 9 aa, Homo Sapiens
SVVLTQTYQ

SEQ ID NO: 401603 - protein, 9 aa, Homo Sapiens
KLPYLSKQT

SEQ ID NO: 401604 - protein, 9 aa, Homo Sapiens
RREYCKFSL

SEQ ID NO: 401605 - protein, 9 aa, Homo Sapiens
QDKILKKLK

SEQ ID NO: 401606 - protein, 9 aa, Homo Sapiens
KWKSITLSQ

SEQ ID NO: 401607 - protein, 9 aa, Homo Sapiens
LWLWLGGGR

SEQ ID NO: 401608 - protein, 9 aa, Homo Sapiens
VDADLGHNA

SEQ ID NO: 401609 - protein, 9 aa, Homo Sapiens
LYDAKVRYK

SEQ ID NO: 401610 - protein, 9 aa, Homo Sapiens
LQLFSSDIC

SEQ ID NO: 401611 - protein, 9 aa, Homo Sapiens
EDGRVLFFA

SEQ ID NO: 401612 - protein, 9 aa, Homo Sapiens
PSLEEENKK

SEQ ID NO: 401613 - protein, 9 aa, Homo Sapiens
SRVFESHSC

SEQ ID NO: 401614 - protein, 9 aa, Homo Sapiens
AAELNTFML

SEQ ID NO: 401615 - protein, 9 aa, Homo Sapiens
QAQVKNNQH

SEQ ID NO: 401616 - protein, 9 aa, Homo Sapiens
KDKLSSIPL

SEQ ID NO: 401617 - protein, 9 aa, Homo Sapiens
VPQPEGQCQ

SEQ ID NO: 401618 - protein, 9 aa, Homo Sapiens
VGLTAFKPL

SEQ ID NO: 401619 - protein, 9 aa, Homo Sapiens
DGLLNQYIL

SEQ ID NO: 401620 - protein, 9 aa, Homo Sapiens
GLTAFKPLF

SEQ ID NO: 401621 - protein, 9 aa, Homo Sapiens
PIHVQFVNR

SEQ ID NO: 401622 - protein, 9 aa, Homo Sapiens
NQMSFNSMN

SEQ ID NO: 401623 - protein, 9 aa, Homo Sapiens
PETFFLLRG

SEQ ID NO: 401624 - protein, 9 aa, Homo Sapiens
RDAISWYQN

SEQ ID NO: 401625 - protein, 9 aa, Homo Sapiens
EFPEDLHTE

SEQ ID NO: 401626 - protein, 9 aa, Homo Sapiens
SPEQQNKLW

SEQ ID NO: 401627 - protein, 9 aa, Homo Sapiens
EEEIKLFSV

SEQ ID NO: 401628 - protein, 9 aa, Homo Sapiens
DKEGKLLCN

SEQ ID NO: 401629 - protein, 9 aa, Homo Sapiens
KESTIFQML

SEQ ID NO: 401630 - protein, 9 aa, Homo Sapiens
SLSLSYLLY

SEQ ID NO: 401631 - protein, 9 aa, Homo Sapiens
SVQYHHLPS

SEQ ID NO: 401632 - protein, 9 aa, Homo Sapiens
LQEGEEGSG

SEQ ID NO: 401633 - protein, 9 aa, Homo Sapiens
HKGDYFYAY

SEQ ID NO: 401634 - protein, 9 aa, Homo Sapiens
EVHLKNTSR

SEQ ID NO: 401635 - protein, 9 aa, Homo Sapiens
FECSVCGKA

SEQ ID NO: 401636 - protein, 9 aa, Homo Sapiens
PHIPQDHEM

SEQ ID NO: 401637 - protein, 9 aa, Homo Sapiens
VCCTGTELS

SEQ ID NO: 401638 - protein, 9 aa, Homo Sapiens
TTCKDKTLC

SEQ ID NO: 401639 - protein, 9 aa, Homo Sapiens
RTFKKFNKV

SEQ ID NO: 401640 - protein, 9 aa, Homo Sapiens
PITWIKPTQ

SEQ ID NO: 401641 - protein, 9 aa, Homo Sapiens
WNEKYSYLQ

SEQ ID NO: 401642 - protein, 9 aa, Homo Sapiens
LNNVFDEAI

SEQ ID NO: 401643 - protein, 9 aa, Homo Sapiens
NLPVVTIAW

SEQ ID NO: 401644 - protein, 9 aa, Homo Sapiens
RNKKQNSPN

SEQ ID NO: 401645 - protein, 9 aa, Homo Sapiens
EYYKQPISR

SEQ ID NO: 401646 - protein, 9 aa, Homo Sapiens
ELTELTATF

SEQ ID NO: 401647 - protein, 9 aa, Homo Sapiens
VNTGEKPYR

SEQ ID NO: 401648 - protein, 9 aa, Homo Sapiens
ERSYKSHIS

SEQ ID NO: 401649 - protein, 9 aa, Homo Sapiens
RKHYIQEDN

SEQ ID NO: 401650 - protein, 9 aa, Homo Sapiens
QNDMIEIPL

SEQ ID NO: 401651 - protein, 9 aa, Homo Sapiens
RVFESHSCN

SEQ ID NO: 401652 - protein, 9 aa, Homo Sapiens
KANKRRLPR

SEQ ID NO: 401653 - protein, 9 aa, Homo Sapiens
KDIQHIPSL

SEQ ID NO: 401654 - protein, 9 aa, Homo Sapiens
LGETVLHIA

SEQ ID NO: 401655 - protein, 9 aa, Homo Sapiens
DDLKTLLAH

SEQ ID NO: 401656 - protein, 9 aa, Homo Sapiens
DYDCDDEIG

SEQ ID NO: 401657 - protein, 9 aa, Homo Sapiens
LRFHLLELD

SEQ ID NO: 401658 - protein, 9 aa, Homo Sapiens
DKILKKLKT

SEQ ID NO: 401659 - protein, 9 aa, Homo Sapiens
AEYIYQWRP

SEQ ID NO: 401660 - protein, 9 aa, Homo Sapiens
LYCDKVLQD

SEQ ID NO: 401661 - protein, 9 aa, Homo Sapiens
QSIEISRRG

SEQ ID NO: 401662 - protein, 9 aa, Homo Sapiens
LVELIVETE

SEQ ID NO: 401663 - protein, 9 aa, Homo Sapiens
KDKILLLRK

SEQ ID NO: 401664 - protein, 9 aa, Homo Sapiens
NKIGAYDQQ

SEQ ID NO: 401665 - protein, 9 aa, Homo Sapiens
AFESQNKEF

SEQ ID NO: 401666 - protein, 9 aa, Homo Sapiens
RDGQMFKYI

SEQ ID NO: 401667 - protein, 9 aa, Homo Sapiens
EAMSYCQYH

SEQ ID NO: 401668 - protein, 9 aa, Homo Sapiens
LSGIYCSLL

SEQ ID NO: 401669 - protein, 9 aa, Homo Sapiens
EYFNQTLTS

SEQ ID NO: 401670 - protein, 9 aa, Homo Sapiens
STLVPLLLS

SEQ ID NO: 401671 - protein, 9 aa, Homo Sapiens
PIIYAFHNQ

SEQ ID NO: 401672 - protein, 9 aa, Homo Sapiens
RVYLRLWTL

SEQ ID NO: 401673 - protein, 9 aa, Homo Sapiens
IQYVPVFPG

SEQ ID NO: 401674 - protein, 9 aa, Homo Sapiens
NNQLSNCRN

SEQ ID NO: 401675 - protein, 9 aa, Homo Sapiens
NKPGNMSMA

SEQ ID NO: 401676 - protein, 9 aa, Homo Sapiens
KRTEHKKIH

SEQ ID NO: 401677 - protein, 9 aa, Homo Sapiens
PLQASELIL

SEQ ID NO: 401678 - protein, 9 aa, Homo Sapiens
LQWRRGSSI

SEQ ID NO: 401679 - protein, 9 aa, Homo Sapiens
GIGRQLLIQ

SEQ ID NO: 401680 - protein, 9 aa, Homo Sapiens
VLWQILVEG

SEQ ID NO: 401681 - protein, 9 aa, Homo Sapiens
NSDGPLGSR

SEQ ID NO: 401682 - protein, 9 aa, Homo Sapiens
QDHEMLYDW

SEQ ID NO: 401683 - protein, 9 aa, Homo Sapiens
RDDCGWFVT

SEQ ID NO: 401684 - protein, 9 aa, Homo Sapiens
YLVTLVANT

SEQ ID NO: 401685 - protein, 9 aa, Homo Sapiens
KEHEIIHTG

SEQ ID NO: 401686 - protein, 9 aa, Homo Sapiens
LADEYQPFK

SEQ ID NO: 401687 - protein, 9 aa, Homo Sapiens
IQHIPSLPP

SEQ ID NO: 401688 - protein, 9 aa, Homo Sapiens
KSNKRAFKT

SEQ ID NO: 401689 - protein, 9 aa, Homo Sapiens
HHMTENRCV

SEQ ID NO: 401690 - protein, 9 aa, Homo Sapiens
VSLIYDAFP

SEQ ID NO: 401691 - protein, 9 aa, Homo Sapiens
APQSGIEGV

SEQ ID NO: 401692 - protein, 9 aa, Homo Sapiens
VPRQLGENL

SEQ ID NO: 401693 - protein, 9 aa, Homo Sapiens
LCGGTLISP

SEQ ID NO: 401694 - protein, 9 aa, Homo Sapiens
ETPRNILRP

SEQ ID NO: 401695 - protein, 9 aa, Homo Sapiens
KFSLDELQE

SEQ ID NO: 401696 - protein, 9 aa, Homo Sapiens
YSVLYDVIP

SEQ ID NO: 401697 - protein, 9 aa, Homo Sapiens
FWCKFTASF

SEQ ID NO: 401698 - protein, 9 aa, Homo Sapiens
GGHLRFASP

SEQ ID NO: 401699 - protein, 9 aa, Homo Sapiens
CRKLQCGTV

SEQ ID NO: 401700 - protein, 9 aa, Homo Sapiens
SSRVHKAVK

SEQ ID NO: 401701 - protein, 9 aa, Homo Sapiens
VGNSYICCY

SEQ ID NO: 401702 - protein, 9 aa, Homo Sapiens
SQRNCGAWS

SEQ ID NO: 401703 - protein, 9 aa, Homo Sapiens
NKKQNSPNR

SEQ ID NO: 401704 - protein, 9 aa, Homo Sapiens
GHHIGTLSV

SEQ ID NO: 401705 - protein, 9 aa, Homo Sapiens
TAEQPYVFT

SEQ ID NO: 401706 - protein, 9 aa, Homo Sapiens
PLLLDDSPS

SEQ ID NO: 401707 - protein, 9 aa, Homo Sapiens
EKLSQDIKK

SEQ ID NO: 401708 - protein, 9 aa, Homo Sapiens
KEYKEKEEK

SEQ ID NO: 401709 - protein, 9 aa, Homo Sapiens
CTHHLDPKS

SEQ ID NO: 401710 - protein, 9 aa, Homo Sapiens
WVAWLFLFS

SEQ ID NO: 401711 - protein, 9 aa, Homo Sapiens
DVLKPLEHK

SEQ ID NO: 401712 - protein, 9 aa, Homo Sapiens
NEMVCFLKV

SEQ ID NO: 401713 - protein, 9 aa, Homo Sapiens
QFWAGRIAS

SEQ ID NO: 401714 - protein, 9 aa, Homo Sapiens
GPHSSRDTA

SEQ ID NO: 401715 - protein, 9 aa, Homo Sapiens
DKKYSVSNI

SEQ ID NO: 401716 - protein, 9 aa, Homo Sapiens
IRRDLPVTR

SEQ ID NO: 401717 - protein, 9 aa, Homo Sapiens
NTISFAVCA

SEQ ID NO: 401718 - protein, 9 aa, Homo Sapiens
CVMPRDPSL

SEQ ID NO: 401719 - protein, 9 aa, Homo Sapiens
GDKSYKCEE

SEQ ID NO: 401720 - protein, 9 aa, Homo Sapiens
ISYFSISYE

SEQ ID NO: 401721 - protein, 9 aa, Homo Sapiens
QLTKYLICF

SEQ ID NO: 401722 - protein, 9 aa, Homo Sapiens
EIAQENVQG

SEQ ID NO: 401723 - protein, 9 aa, Homo Sapiens
NRSTLSDSD

SEQ ID NO: 401724 - protein, 9 aa, Homo Sapiens
PNKPPNQKD

SEQ ID NO: 401725 - protein, 9 aa, Homo Sapiens
VRLPFHADN

SEQ ID NO: 401726 - protein, 9 aa, Homo Sapiens
LGKQGEPGL

SEQ ID NO: 401727 - protein, 9 aa, Homo Sapiens
DHVKHYKIC

SEQ ID NO: 401728 - protein, 9 aa, Homo Sapiens
LSTKARHIQ

SEQ ID NO: 401729 - protein, 9 aa, Homo Sapiens
VQALVRFSL

SEQ ID NO: 401730 - protein, 9 aa, Homo Sapiens
GRVLFFADE

SEQ ID NO: 401731 - protein, 9 aa, Homo Sapiens
ETRAGFIEN

SEQ ID NO: 401732 - protein, 9 aa, Homo Sapiens
ALKTVMNDP

SEQ ID NO: 401733 - protein, 9 aa, Homo Sapiens
LRLRVLVKK

SEQ ID NO: 401734 - protein, 9 aa, Homo Sapiens
LAAFRALLK

SEQ ID NO: 401735 - protein, 9 aa, Homo Sapiens
TEASGHTYN

SEQ ID NO: 401736 - protein, 9 aa, Homo Sapiens
KHVLVKDIQ

SEQ ID NO: 401737 - protein, 9 aa, Homo Sapiens
LQTASNSWD

SEQ ID NO: 401738 - protein, 9 aa, Homo Sapiens
DLLSTAAAQ

SEQ ID NO: 401739 - protein, 9 aa, Homo Sapiens
EELTLRESL

SEQ ID NO: 401740 - protein, 9 aa, Homo Sapiens
RNSYCLSWG

SEQ ID NO: 401741 - protein, 9 aa, Homo Sapiens
VKDNHVVAT

SEQ ID NO: 401742 - protein, 9 aa, Homo Sapiens
FTEYSLRLL

SEQ ID NO: 401743 - protein, 9 aa, Homo Sapiens
SPRKPPMDD

SEQ ID NO: 401744 - protein, 9 aa, Homo Sapiens
RSSVPPETY

SEQ ID NO: 401745 - protein, 9 aa, Homo Sapiens
ALKSKLTQH

SEQ ID NO: 401746 - protein, 9 aa, Homo Sapiens
LFFADEDEI

SEQ ID NO: 401747 - protein, 9 aa, Homo Sapiens
LEGKPLRFC

SEQ ID NO: 401748 - protein, 9 aa, Homo Sapiens
YTIAEGQEQ

SEQ ID NO: 401749 - protein, 9 aa, Homo Sapiens
QKEVHLKNT

SEQ ID NO: 401750 - protein, 9 aa, Homo Sapiens
PPTVLELCI

SEQ ID NO: 401751 - protein, 9 aa, Homo Sapiens
CHQYYLQLQ

SEQ ID NO: 401752 - protein, 9 aa, Homo Sapiens
CSTCHLLQD

SEQ ID NO: 401753 - protein, 9 aa, Homo Sapiens
TPPSPLQEG

SEQ ID NO: 401754 - protein, 9 aa, Homo Sapiens
FCADYRGVC

SEQ ID NO: 401755 - protein, 9 aa, Homo Sapiens
LLWCRNEKK

SEQ ID NO: 401756 - protein, 9 aa, Homo Sapiens
IGQRTPFQI

SEQ ID NO: 401757 - protein, 9 aa, Homo Sapiens
RHNGVPSHS

SEQ ID NO: 401758 - protein, 9 aa, Homo Sapiens
THASSACLC

SEQ ID NO: 401759 - protein, 9 aa, Homo Sapiens
VLVKKWQEV

SEQ ID NO: 401760 - protein, 9 aa, Homo Sapiens
VLDSNNFKS

SEQ ID NO: 401761 - protein, 9 aa, Homo Sapiens
ISLCYYYFT

SEQ ID NO: 401762 - protein, 9 aa, Homo Sapiens
RFILGSVSE

SEQ ID NO: 401763 - protein, 9 aa, Homo Sapiens
INSIIDYIS

SEQ ID NO: 401764 - protein, 9 aa, Homo Sapiens
KSVQNGARA

SEQ ID NO: 401765 - protein, 9 aa, Homo Sapiens
PNDRQLALQ

SEQ ID NO: 401766 - protein, 9 aa, Homo Sapiens
YQIEEEEKL

SEQ ID NO: 401767 - protein, 9 aa, Homo Sapiens
TLRESLSDE

SEQ ID NO: 401768 - protein, 9 aa, Homo Sapiens
IKAPLSKVW

SEQ ID NO: 401769 - protein, 9 aa, Homo Sapiens
LYFCGTHKG

SEQ ID NO: 401770 - protein, 9 aa, Homo Sapiens
NSYICCYYF

SEQ ID NO: 401771 - protein, 9 aa, Homo Sapiens
EDLHTELMQ

SEQ ID NO: 401772 - protein, 9 aa, Homo Sapiens
KHLCGGTLI

SEQ ID NO: 401773 - protein, 9 aa, Homo Sapiens
RVQDLLSTA

SEQ ID NO: 401774 - protein, 9 aa, Homo Sapiens
YERSLLAMQ

SEQ ID NO: 401775 - protein, 9 aa, Homo Sapiens
KLKSEGHEK

SEQ ID NO: 401776 - protein, 9 aa, Homo Sapiens
VCFDDLFPI

SEQ ID NO: 401777 - protein, 9 aa, Homo Sapiens
VANQDPVYP

SEQ ID NO: 401778 - protein, 9 aa, Homo Sapiens
TGVNGEMSY

SEQ ID NO: 401779 - protein, 9 aa, Homo Sapiens
FCGTHKGDY

SEQ ID NO: 401780 - protein, 9 aa, Homo Sapiens
YQITFTPSS

SEQ ID NO: 401781 - protein, 9 aa, Homo Sapiens
DGWEENHTD

SEQ ID NO: 401782 - protein, 9 aa, Homo Sapiens
VCFEWGAFN

SEQ ID NO: 401783 - protein, 9 aa, Homo Sapiens
MSGCRKWCK

SEQ ID NO: 401784 - protein, 9 aa, Homo Sapiens
VHKVIYTAE

SEQ ID NO: 401785 - protein, 9 aa, Homo Sapiens
CVQHLYLHS

SEQ ID NO: 401786 - protein, 9 aa, Homo Sapiens
KNKTVDLLY

SEQ ID NO: 401787 - protein, 9 aa, Homo Sapiens
MSGGFDRTV

SEQ ID NO: 401788 - protein, 9 aa, Homo Sapiens
RLHTGDKSY

SEQ ID NO: 401789 - protein, 9 aa, Homo Sapiens
TTMVMPIVE

SEQ ID NO: 401790 - protein, 9 aa, Homo Sapiens
VRNSAATTE

SEQ ID NO: 401791 - protein, 9 aa, Homo Sapiens
ESKLIEQDF

SEQ ID NO: 401792 - protein, 9 aa, Homo Sapiens
NDVLHCVTF

SEQ ID NO: 401793 - protein, 9 aa, Homo Sapiens
ISESYSCPS

SEQ ID NO: 401794 - protein, 9 aa, Homo Sapiens
HYFPAFEKV

SEQ ID NO: 401795 - protein, 9 aa, Homo Sapiens
RKWCKREIL

SEQ ID NO: 401796 - protein, 9 aa, Homo Sapiens
SNKSNNGTD

SEQ ID NO: 401797 - protein, 9 aa, Homo Sapiens
LNFKAPFHT

SEQ ID NO: 401798 - protein, 9 aa, Homo Sapiens
ELSNITMVE

SEQ ID NO: 401799 - protein, 9 aa, Homo Sapiens
RLFLEPTQK

SEQ ID NO: 401800 - protein, 9 aa, Homo Sapiens
KLQTASNSW

SEQ ID NO: 401801 - protein, 9 aa, Homo Sapiens
CGYSVQFES

SEQ ID NO: 401802 - protein, 9 aa, Homo Sapiens
LLYMQFRVD

SEQ ID NO: 401803 - protein, 9 aa, Homo Sapiens
KIPMIKALL

SEQ ID NO: 401804 - protein, 9 aa, Homo Sapiens
VNVTGLNQS

SEQ ID NO: 401805 - protein, 9 aa, Homo Sapiens
VSLYCDKVL

SEQ ID NO: 401806 - protein, 9 aa, Homo Sapiens
PFRNPQKIL

SEQ ID NO: 401807 - protein, 9 aa, Homo Sapiens
KDLLSASSR

SEQ ID NO: 401808 - protein, 9 aa, Homo Sapiens
DLDNDKYIT

SEQ ID NO: 401809 - protein, 9 aa, Homo Sapiens
ASFSDDGRV

SEQ ID NO: 401810 - protein, 9 aa, Homo Sapiens
CIIINNNNF

SEQ ID NO: 401811 - protein, 9 aa, Homo Sapiens
RHNKAYVVC

SEQ ID NO: 401812 - protein, 9 aa, Homo Sapiens
QKGLNNVFD

SEQ ID NO: 401813 - protein, 9 aa, Homo Sapiens
SELQIYMTQ

SEQ ID NO: 401814 - protein, 9 aa, Homo Sapiens
NEDNIQCGE

SEQ ID NO: 401815 - protein, 9 aa, Homo Sapiens
SRKSNKRAF

SEQ ID NO: 401816 - protein, 9 aa, Homo Sapiens
QYECKQCGK

SEQ ID NO: 401817 - protein, 9 aa, Homo Sapiens
DDDEDDNLE

SEQ ID NO: 401818 - protein, 9 aa, Homo Sapiens
EATKQKGAQ

SEQ ID NO: 401819 - protein, 9 aa, Homo Sapiens
REQGDNGLP

SEQ ID NO: 401820 - protein, 9 aa, Homo Sapiens
LFAKARAGS

SEQ ID NO: 401821 - protein, 9 aa, Homo Sapiens
PLITPLCCA

SEQ ID NO: 401822 - protein, 9 aa, Homo Sapiens
NFILVVMSW

SEQ ID NO: 401823 - protein, 9 aa, Homo Sapiens
RARTPISNY

SEQ ID NO: 401824 - protein, 9 aa, Homo Sapiens
SSTLMQHKI

SEQ ID NO: 401825 - protein, 9 aa, Homo Sapiens
SLPQDKIFY

SEQ ID NO: 401826 - protein, 9 aa, Homo Sapiens
ILDLPDTNN

SEQ ID NO: 401827 - protein, 9 aa, Homo Sapiens
VFESHSCNS

SEQ ID NO: 401828 - protein, 9 aa, Homo Sapiens
KDIFKREAG

SEQ ID NO: 401829 - protein, 9 aa, Homo Sapiens
GKPLRFCGV

SEQ ID NO: 401830 - protein, 9 aa, Homo Sapiens
KVENTEDNR

SEQ ID NO: 401831 - protein, 9 aa, Homo Sapiens
LMIIYRLKE

SEQ ID NO: 401832 - protein, 9 aa, Homo Sapiens
NTVFKVLKP

SEQ ID NO: 401833 - protein, 9 aa, Homo Sapiens
AQVFFLIIL

SEQ ID NO: 401834 - protein, 9 aa, Homo Sapiens
ENLSGIYCS

SEQ ID NO: 401835 - protein, 9 aa, Homo Sapiens
KRHASDFTL

SEQ ID NO: 401836 - protein, 9 aa, Homo Sapiens
VMSWLIFLL

SEQ ID NO: 401837 - protein, 9 aa, Homo Sapiens
GVCSNTGSG

SEQ ID NO: 401838 - protein, 9 aa, Homo Sapiens
AKKWNLPVV

SEQ ID NO: 401839 - protein, 9 aa, Homo Sapiens
NLRNNYFIT

SEQ ID NO: 401840 - protein, 9 aa, Homo Sapiens
AVDGVCFIA

SEQ ID NO: 401841 - protein, 9 aa, Homo Sapiens
LVFHLKRFS

SEQ ID NO: 401842 - protein, 9 aa, Homo Sapiens
FEWGAFNPQ

SEQ ID NO: 401843 - protein, 9 aa, Homo Sapiens
CNSILNQPT

SEQ ID NO: 401844 - protein, 9 aa, Homo Sapiens
MQNFYHQQQ

SEQ ID NO: 401845 - protein, 9 aa, Homo Sapiens
QLWRVPGPD

SEQ ID NO: 401846 - protein, 9 aa, Homo Sapiens
PLQEGEEGS

SEQ ID NO: 401847 - protein, 9 aa, Homo Sapiens
EGKLLCNYT

SEQ ID NO: 401848 - protein, 9 aa, Homo Sapiens
DPTYLRKNL

SEQ ID NO: 401849 - protein, 9 aa, Homo Sapiens
TGPGAEEEQ

SEQ ID NO: 401850 - protein, 9 aa, Homo Sapiens
RNKNRELEE

SEQ ID NO: 401851 - protein, 9 aa, Homo Sapiens
GNDISWNYT

SEQ ID NO: 401852 - protein, 9 aa, Homo Sapiens
KIIQLSPKK

SEQ ID NO: 401853 - protein, 9 aa, Homo Sapiens
EELKELFAK

SEQ ID NO: 401854 - protein, 9 aa, Homo Sapiens
EAVSWDSIF

SEQ ID NO: 401855 - protein, 9 aa, Homo Sapiens
DLEISLWGV

SEQ ID NO: 401856 - protein, 9 aa, Homo Sapiens
KFQMRKIIG

SEQ ID NO: 401857 - protein, 9 aa, Homo Sapiens
TCHLLQDTA

SEQ ID NO: 401858 - protein, 9 aa, Homo Sapiens
GKFSMEVNK

SEQ ID NO: 401859 - protein, 9 aa, Homo Sapiens
IYHIVSQKQ

SEQ ID NO: 401860 - protein, 9 aa, Homo Sapiens
SNMEQRVIT

SEQ ID NO: 401861 - protein, 9 aa, Homo Sapiens
QKLENCTKM

SEQ ID NO: 401862 - protein, 9 aa, Homo Sapiens
REAPLNNLS

SEQ ID NO: 401863 - protein, 9 aa, Homo Sapiens
RMRIFRILK

SEQ ID NO: 401864 - protein, 9 aa, Homo Sapiens
QGAGYSFAV

SEQ ID NO: 401865 - protein, 9 aa, Homo Sapiens
QRTPFQIGI

SEQ ID NO: 401866 - protein, 9 aa, Homo Sapiens
LLDDGSNYF

SEQ ID NO: 401867 - protein, 9 aa, Homo Sapiens
FNPVRGEVP

SEQ ID NO: 401868 - protein, 9 aa, Homo Sapiens
PWYFLIMPS

SEQ ID NO: 401869 - protein, 9 aa, Homo Sapiens
EQIQKMAEY

SEQ ID NO: 401870 - protein, 9 aa, Homo Sapiens
EMVCFLKVQ

SEQ ID NO: 401871 - protein, 9 aa, Homo Sapiens
NLPLHLTAK

SEQ ID NO: 401872 - protein, 9 aa, Homo Sapiens
LNAKKLYGD

SEQ ID NO: 401873 - protein, 9 aa, Homo Sapiens
QIETVLPAE

SEQ ID NO: 401874 - protein, 9 aa, Homo Sapiens
IFLVPVPGR

SEQ ID NO: 401875 - protein, 9 aa, Homo Sapiens
SSKCRVTVM

SEQ ID NO: 401876 - protein, 9 aa, Homo Sapiens
DISRLQGQE

SEQ ID NO: 401877 - protein, 9 aa, Homo Sapiens
KARALKSKL

SEQ ID NO: 401878 - protein, 9 aa, Homo Sapiens
DLEISAFPS

SEQ ID NO: 401879 - protein, 9 aa, Homo Sapiens
IMNLVLAES

SEQ ID NO: 401880 - protein, 9 aa, Homo Sapiens
VCYFDYGIL

SEQ ID NO: 401881 - protein, 9 aa, Homo Sapiens
NTSTTTMVM

SEQ ID NO: 401882 - protein, 9 aa, Homo Sapiens
VSYFTHHIF

SEQ ID NO: 401883 - protein, 9 aa, Homo Sapiens
PYMLVGSIS

SEQ ID NO: 401884 - protein, 9 aa, Homo Sapiens
ATEELKELF

SEQ ID NO: 401885 - protein, 9 aa, Homo Sapiens
IQVGKITII

SEQ ID NO: 401886 - protein, 9 aa, Homo Sapiens
QMLIIEKVL

SEQ ID NO: 401887 - protein, 9 aa, Homo Sapiens
RQWTNRIME

SEQ ID NO: 401888 - protein, 9 aa, Homo Sapiens
LSALVSMEQ

SEQ ID NO: 401889 - protein, 9 aa, Homo Sapiens
EKGFKDKLS

SEQ ID NO: 401890 - protein, 9 aa, Homo Sapiens
KLDVEAIFS

SEQ ID NO: 401891 - protein, 9 aa, Homo Sapiens
YKILGLHKG

SEQ ID NO: 401892 - protein, 9 aa, Homo Sapiens
RLSGDAAAS

SEQ ID NO: 401893 - protein, 9 aa, Homo Sapiens
SLNAHSYLK

SEQ ID NO: 401894 - protein, 9 aa, Homo Sapiens
IIFLEVLES

SEQ ID NO: 401895 - protein, 9 aa, Homo Sapiens
PEHKKKCKG

SEQ ID NO: 401896 - protein, 9 aa, Homo Sapiens
YFILTVSIV

SEQ ID NO: 401897 - protein, 9 aa, Homo Sapiens
WEQIQKMAE

SEQ ID NO: 401898 - protein, 9 aa, Homo Sapiens
LTDVGIAML

SEQ ID NO: 401899 - protein, 9 aa, Homo Sapiens
SNCRNHILE

SEQ ID NO: 401900 - protein, 9 aa, Homo Sapiens
HSTTGTVHV

SEQ ID NO: 401901 - protein, 9 aa, Homo Sapiens
LRRAELVEL

SEQ ID NO: 401902 - protein, 9 aa, Homo Sapiens
LGGGRADIG

SEQ ID NO: 401903 - protein, 9 aa, Homo Sapiens
TTQAPTDKN

SEQ ID NO: 401904 - protein, 9 aa, Homo Sapiens
EITHSEEKA

SEQ ID NO: 401905 - protein, 9 aa, Homo Sapiens
ALRMVWVAW

SEQ ID NO: 401906 - protein, 9 aa, Homo Sapiens
VSLNKANKR

SEQ ID NO: 401907 - protein, 9 aa, Homo Sapiens
SRVHKAVKA

SEQ ID NO: 401908 - protein, 9 aa, Homo Sapiens
LDTDECHCI

SEQ ID NO: 401909 - protein, 9 aa, Homo Sapiens
WSSRLTQHK

SEQ ID NO: 401910 - protein, 9 aa, Homo Sapiens
TVEENYQIE

SEQ ID NO: 401911 - protein, 9 aa, Homo Sapiens
LQDTAFQRP

SEQ ID NO: 401912 - protein, 9 aa, Homo Sapiens
QVLKIYLEV

SEQ ID NO: 401913 - protein, 9 aa, Homo Sapiens
SMEVNKTVD

SEQ ID NO: 401914 - protein, 9 aa, Homo Sapiens
FVHKSSILI

SEQ ID NO: 401915 - protein, 9 aa, Homo Sapiens
FLYVTVLLY

SEQ ID NO: 401916 - protein, 9 aa, Homo Sapiens
SSTIVEYPQ

SEQ ID NO: 401917 - protein, 9 aa, Homo Sapiens
YLTQEVATF

SEQ ID NO: 401918 - protein, 9 aa, Homo Sapiens
DTVRRRMVM

SEQ ID NO: 401919 - protein, 9 aa, Homo Sapiens
VQKKEEVFL

SEQ ID NO: 401920 - protein, 9 aa, Homo Sapiens
WSPRGVLRD

SEQ ID NO: 401921 - protein, 9 aa, Homo Sapiens
LSNHVQRQL

SEQ ID NO: 401922 - protein, 9 aa, Homo Sapiens
KERGGVLLA

SEQ ID NO: 401923 - protein, 9 aa, Homo Sapiens
QQPSLRAAK

SEQ ID NO: 401924 - protein, 9 aa, Homo Sapiens
AFVYSPLKN

SEQ ID NO: 401925 - protein, 9 aa, Homo Sapiens
RMVMQSGEA

SEQ ID NO: 401926 - protein, 9 aa, Homo Sapiens
MLIEEGVLQ

SEQ ID NO: 401927 - protein, 9 aa, Homo Sapiens
STIFQMLII

SEQ ID NO: 401928 - protein, 9 aa, Homo Sapiens
EELFTTLEK

SEQ ID NO: 401929 - protein, 9 aa, Homo Sapiens
ALYIMRVPH

SEQ ID NO: 401930 - protein, 9 aa, Homo Sapiens
AAVLFQMSE

SEQ ID NO: 401931 - protein, 9 aa, Homo Sapiens
MAGKTDQKE

SEQ ID NO: 401932 - protein, 9 aa, Homo Sapiens
ENNCVKKTC

SEQ ID NO: 401933 - protein, 9 aa, Homo Sapiens
RLTREAMQN

SEQ ID NO: 401934 - protein, 9 aa, Homo Sapiens
EAVHLICDP

SEQ ID NO: 401935 - protein, 9 aa, Homo Sapiens
ITQGVRCSD

SEQ ID NO: 401936 - protein, 9 aa, Homo Sapiens
GEQLIVEII

SEQ ID NO: 401937 - protein, 9 aa, Homo Sapiens
HKIQSQQEN

SEQ ID NO: 401938 - protein, 9 aa, Homo Sapiens
LSWGPYLQF

SEQ ID NO: 401939 - protein, 9 aa, Homo Sapiens
FRALLKSEF

SEQ ID NO: 401940 - protein, 9 aa, Homo Sapiens
CVICMNDAP

SEQ ID NO: 401941 - protein, 9 aa, Homo Sapiens
GILKTLLWC

SEQ ID NO: 401942 - protein, 9 aa, Homo Sapiens
FKHYGKINQ

SEQ ID NO: 401943 - protein, 9 aa, Homo Sapiens
ELLNMFREL

SEQ ID NO: 401944 - protein, 9 aa, Homo Sapiens
DFCIFGVPK

SEQ ID NO: 401945 - protein, 9 aa, Homo Sapiens
VKKIIQLSP

SEQ ID NO: 401946 - protein, 9 aa, Homo Sapiens
SQAILQQAR

SEQ ID NO: 401947 - protein, 9 aa, Homo Sapiens
ELEAIGSRL

SEQ ID NO: 401948 - protein, 9 aa, Homo Sapiens
LIQNYDGKV

SEQ ID NO: 401949 - protein, 9 aa, Homo Sapiens
VKQCCCISI

SEQ ID NO: 401950 - protein, 9 aa, Homo Sapiens
KAFRQAPHW

SEQ ID NO: 401951 - protein, 9 aa, Homo Sapiens
QAPMYFLIC

SEQ ID NO: 401952 - protein, 9 aa, Homo Sapiens
HWPWIKLFF

SEQ ID NO: 401953 - protein, 9 aa, Homo Sapiens
EIYHIVSQK

SEQ ID NO: 401954 - protein, 9 aa, Homo Sapiens
ESDKVQQLE

SEQ ID NO: 401955 - protein, 9 aa, Homo Sapiens
MVHQIIHTG

SEQ ID NO: 401956 - protein, 9 aa, Homo Sapiens
KEHPDLPPV

SEQ ID NO: 401957 - protein, 9 aa, Homo Sapiens
YLQNCSMKF

SEQ ID NO: 401958 - protein, 9 aa, Homo Sapiens
LLKMWFPEA

SEQ ID NO: 401959 - protein, 9 aa, Homo Sapiens
TAMAGKTDQ

SEQ ID NO: 401960 - protein, 9 aa, Homo Sapiens
PTCVLSITA

SEQ ID NO: 401961 - protein, 9 aa, Homo Sapiens
KYIYHVMWH

SEQ ID NO: 401962 - protein, 9 aa, Homo Sapiens
GLDTLVTQK

SEQ ID NO: 401963 - protein, 9 aa, Homo Sapiens
DAGAERQAL

SEQ ID NO: 401964 - protein, 9 aa, Homo Sapiens
EIFNQFTTF

SEQ ID NO: 401965 - protein, 9 aa, Homo Sapiens
SFMPHYPYS

SEQ ID NO: 401966 - protein, 9 aa, Homo Sapiens
LSDYERHNA

SEQ ID NO: 401967 - protein, 9 aa, Homo Sapiens
PDDLEISAF

SEQ ID NO: 401968 - protein, 9 aa, Homo Sapiens
NTFMLEKVT

SEQ ID NO: 401969 - protein, 9 aa, Homo Sapiens
CLTMKENKS

SEQ ID NO: 401970 - protein, 9 aa, Homo Sapiens
CLERKQKWE

SEQ ID NO: 401971 - protein, 9 aa, Homo Sapiens
PEHWEYYKQ

SEQ ID NO: 401972 - protein, 9 aa, Homo Sapiens
KFIEELKRC

SEQ ID NO: 401973 - protein, 9 aa, Homo Sapiens
YFMKQINDA

SEQ ID NO: 401974 - protein, 9 aa, Homo Sapiens
HVLVKDIQI

SEQ ID NO: 401975 - protein, 9 aa, Homo Sapiens
PKGSQSVVP

SEQ ID NO: 401976 - protein, 9 aa, Homo Sapiens
GATAAAAPA

SEQ ID NO: 401977 - protein, 9 aa, Homo Sapiens
LKPYPNKPP

SEQ ID NO: 401978 - protein, 9 aa, Homo Sapiens
WDGEKGFKD

SEQ ID NO: 401979 - protein, 9 aa, Homo Sapiens
KYSISNKEN

SEQ ID NO: 401980 - protein, 9 aa, Homo Sapiens
SKVWLVDAG

SEQ ID NO: 401981 - protein, 9 aa, Homo Sapiens
FWSAVRVSI

SEQ ID NO: 401982 - protein, 9 aa, Homo Sapiens
SELEQYQWD

SEQ ID NO: 401983 - protein, 9 aa, Homo Sapiens
SYLYIFNWN

SEQ ID NO: 401984 - protein, 9 aa, Homo Sapiens
MGGTRGIIY

SEQ ID NO: 401985 - protein, 9 aa, Homo Sapiens
KNPTSARNG

SEQ ID NO: 401986 - protein, 9 aa, Homo Sapiens
PHPMLKQVI

SEQ ID NO: 401987 - protein, 9 aa, Homo Sapiens
NTNGSPFFI

SEQ ID NO: 401988 - protein, 9 aa, Homo Sapiens
YTLDKVCQP

SEQ ID NO: 401989 - protein, 9 aa, Homo Sapiens
LGDKTRMAE

SEQ ID NO: 401990 - protein, 9 aa, Homo Sapiens
VDGSDENNC

SEQ ID NO: 401991 - protein, 9 aa, Homo Sapiens
PKSAVYFLL

SEQ ID NO: 401992 - protein, 9 aa, Homo Sapiens
FIEELIQNY

SEQ ID NO: 401993 - protein, 9 aa, Homo Sapiens
NDAMLILET

SEQ ID NO: 401994 - protein, 9 aa, Homo Sapiens
ALRRTRISA

SEQ ID NO: 401995 - protein, 9 aa, Homo Sapiens
DVRLPFHAD

SEQ ID NO: 401996 - protein, 9 aa, Homo Sapiens
CHCIAVQNF

SEQ ID NO: 401997 - protein, 9 aa, Homo Sapiens
YLSDYERHN

SEQ ID NO: 401998 - protein, 9 aa, Homo Sapiens
RIYSHDGTN

SEQ ID NO: 401999 - protein, 9 aa, Homo Sapiens
DIGSGPTVC

SEQ ID NO: 402000 - protein, 9 aa, Homo Sapiens
ALDIPATEC

SEQ ID NO: 402001 - protein, 9 aa, Homo Sapiens
STVRVWLVT

SEQ ID NO: 402002 - protein, 9 aa, Homo Sapiens
QNERNKFVN

SEQ ID NO: 402003 - protein, 9 aa, Homo Sapiens
GAKKHSQKW

SEQ ID NO: 402004 - protein, 9 aa, Homo Sapiens
EWMAGGLVA

SEQ ID NO: 402005 - protein, 9 aa, Homo Sapiens
LRFCGVHHA

SEQ ID NO: 402006 - protein, 9 aa, Homo Sapiens
AKMGLMLAI

SEQ ID NO: 402007 - protein, 9 aa, Homo Sapiens
VVKLLVLHG

SEQ ID NO: 402008 - protein, 9 aa, Homo Sapiens
ICQAYFATP

SEQ ID NO: 402009 - protein, 9 aa, Homo Sapiens
SPLETPGPS

SEQ ID NO: 402010 - protein, 9 aa, Homo Sapiens
CLATRLNIF

SEQ ID NO: 402011 - protein, 9 aa, Homo Sapiens
RNTNGSPFF

SEQ ID NO: 402012 - protein, 9 aa, Homo Sapiens
PVYPSLVQG

SEQ ID NO: 402013 - protein, 9 aa, Homo Sapiens
PQSTDQTLV

SEQ ID NO: 402014 - protein, 9 aa, Homo Sapiens
IATFFKAIV

SEQ ID NO: 402015 - protein, 9 aa, Homo Sapiens
NVESFKQTN

SEQ ID NO: 402016 - protein, 9 aa, Homo Sapiens
PRQLGENLS

SEQ ID NO: 402017 - protein, 9 aa, Homo Sapiens
KQRLKLESL

SEQ ID NO: 402018 - protein, 9 aa, Homo Sapiens
KEVHLKNTS

SEQ ID NO: 402019 - protein, 9 aa, Homo Sapiens
ANTVGLTNE

SEQ ID NO: 402020 - protein, 9 aa, Homo Sapiens
LDTAQNNLY

SEQ ID NO: 402021 - protein, 9 aa, Homo Sapiens
HPSALQLPH

SEQ ID NO: 402022 - protein, 9 aa, Homo Sapiens
KNLAAPSGQ

SEQ ID NO: 402023 - protein, 9 aa, Homo Sapiens
IRKMSPHTG

SEQ ID NO: 402024 - protein, 9 aa, Homo Sapiens
LRFISYFSI

SEQ ID NO: 402025 - protein, 9 aa, Homo Sapiens
CRFSIRNTK

SEQ ID NO: 402026 - protein, 9 aa, Homo Sapiens
TVMPGGSAA

SEQ ID NO: 402027 - protein, 9 aa, Homo Sapiens
VEPWKEQLF

SEQ ID NO: 402028 - protein, 9 aa, Homo Sapiens
TVTEASGHT

SEQ ID NO: 402029 - protein, 9 aa, Homo Sapiens
LITPLCCAA

SEQ ID NO: 402030 - protein, 9 aa, Homo Sapiens
RNNYFITHS

SEQ ID NO: 402031 - protein, 9 aa, Homo Sapiens
WDQMQTISN

SEQ ID NO: 402032 - protein, 9 aa, Homo Sapiens
QNSDRLIEE

SEQ ID NO: 402033 - protein, 9 aa, Homo Sapiens
RQGAGYSFA

SEQ ID NO: 402034 - protein, 9 aa, Homo Sapiens
GTVVTFAPV

SEQ ID NO: 402035 - protein, 9 aa, Homo Sapiens
TVCYALCSL

SEQ ID NO: 402036 - protein, 9 aa, Homo Sapiens
KAPLSKVWL

SEQ ID NO: 402037 - protein, 9 aa, Homo Sapiens
VPAGVQKLT

SEQ ID NO: 402038 - protein, 9 aa, Homo Sapiens
SWLIFLLII

SEQ ID NO: 402039 - protein, 9 aa, Homo Sapiens
EWCHYKLYF

SEQ ID NO: 402040 - protein, 9 aa, Homo Sapiens
KDLRSVLFN

SEQ ID NO: 402041 - protein, 9 aa, Homo Sapiens
SCVNIKKIL

SEQ ID NO: 402042 - protein, 9 aa, Homo Sapiens
GSQAPLITP

SEQ ID NO: 402043 - protein, 9 aa, Homo Sapiens
SDNFLGISS

SEQ ID NO: 402044 - protein, 9 aa, Homo Sapiens
FIETSTKTR

SEQ ID NO: 402045 - protein, 9 aa, Homo Sapiens
GCSASEACV

SEQ ID NO: 402046 - protein, 9 aa, Homo Sapiens
QCQEGSSEN

SEQ ID NO: 402047 - protein, 9 aa, Homo Sapiens
TLEMGCTEY

SEQ ID NO: 402048 - protein, 9 aa, Homo Sapiens
TNKSILKEL

SEQ ID NO: 402049 - protein, 9 aa, Homo Sapiens
LNREQGDNG

SEQ ID NO: 402050 - protein, 9 aa, Homo Sapiens
LSLYSLNIS

SEQ ID NO: 402051 - protein, 9 aa, Homo Sapiens
LFVDLTLPY

SEQ ID NO: 402052 - protein, 9 aa, Homo Sapiens
ELGHAEHEL

SEQ ID NO: 402053 - protein, 9 aa, Homo Sapiens
TRVKQCCCI

SEQ ID NO: 402054 - protein, 9 aa, Homo Sapiens
DQHQIIHFL

SEQ ID NO: 402055 - protein, 9 aa, Homo Sapiens
TSYQLEELD

SEQ ID NO: 402056 - protein, 9 aa, Homo Sapiens
SRTGCTFKF

SEQ ID NO: 402057 - protein, 9 aa, Homo Sapiens
KICKLDNGG

SEQ ID NO: 402058 - protein, 9 aa, Homo Sapiens
AERDLYLDN

SEQ ID NO: 402059 - protein, 9 aa, Homo Sapiens
EKNKQKIEE

SEQ ID NO: 402060 - protein, 9 aa, Homo Sapiens
KKKCKGNLP

SEQ ID NO: 402061 - protein, 9 aa, Homo Sapiens
LDLSHNSIY

SEQ ID NO: 402062 - protein, 9 aa, Homo Sapiens
SKKLKFYLR

SEQ ID NO: 402063 - protein, 9 aa, Homo Sapiens
VDSTPLPGT

SEQ ID NO: 402064 - protein, 9 aa, Homo Sapiens
LPTVSITVE

SEQ ID NO: 402065 - protein, 9 aa, Homo Sapiens
CGDGTNDCG

SEQ ID NO: 402066 - protein, 9 aa, Homo Sapiens
KSINSIIDY

SEQ ID NO: 402067 - protein, 9 aa, Homo Sapiens
VNKHISIAA

SEQ ID NO: 402068 - protein, 9 aa, Homo Sapiens
RKCREEEQL

SEQ ID NO: 402069 - protein, 9 aa, Homo Sapiens
KERGKIEVT

SEQ ID NO: 402070 - protein, 9 aa, Homo Sapiens
PYRSEFYSL

SEQ ID NO: 402071 - protein, 9 aa, Homo Sapiens
ELLSPKDKI

SEQ ID NO: 402072 - protein, 9 aa, Homo Sapiens
AAKVSEVPK

SEQ ID NO: 402073 - protein, 9 aa, Homo Sapiens
YFIQRYQDI

SEQ ID NO: 402074 - protein, 9 aa, Homo Sapiens
IAQTDAEDS

SEQ ID NO: 402075 - protein, 9 aa, Homo Sapiens
LESFCDSMV

SEQ ID NO: 402076 - protein, 9 aa, Homo Sapiens
SSFKLEMAQ

SEQ ID NO: 402077 - protein, 9 aa, Homo Sapiens
NEKYSYLQK

SEQ ID NO: 402078 - protein, 9 aa, Homo Sapiens
IILTSHSME

SEQ ID NO: 402079 - protein, 9 aa, Homo Sapiens
KPMFVEKLN

SEQ ID NO: 402080 - protein, 9 aa, Homo Sapiens
MIFYMIDGQ

SEQ ID NO: 402081 - protein, 9 aa, Homo Sapiens
IDNLYPEDK

SEQ ID NO: 402082 - protein, 9 aa, Homo Sapiens
LEKQDDLKT

SEQ ID NO: 402083 - protein, 9 aa, Homo Sapiens
DYLSLRTRL

SEQ ID NO: 402084 - protein, 9 aa, Homo Sapiens
KAPFHTSGE

SEQ ID NO: 402085 - protein, 9 aa, Homo Sapiens
YVVNFCKTY

SEQ ID NO: 402086 - protein, 9 aa, Homo Sapiens
LGNFGIARV

SEQ ID NO: 402087 - protein, 9 aa, Homo Sapiens
HDKYWVEKL

SEQ ID NO: 402088 - protein, 9 aa, Homo Sapiens
MYKLYPNAQ

SEQ ID NO: 402089 - protein, 9 aa, Homo Sapiens
RGKFLVVFI

SEQ ID NO: 402090 - protein, 9 aa, Homo Sapiens
TSACTEHSD

SEQ ID NO: 402091 - protein, 9 aa, Homo Sapiens
EKEYLDLRK

SEQ ID NO: 402092 - protein, 9 aa, Homo Sapiens
WDEMDISSK

SEQ ID NO: 402093 - protein, 9 aa, Homo Sapiens
NADEVELNM

SEQ ID NO: 402094 - protein, 9 aa, Homo Sapiens
VDTTLKRLH

SEQ ID NO: 402095 - protein, 9 aa, Homo Sapiens
KSEGHEKST

SEQ ID NO: 402096 - protein, 9 aa, Homo Sapiens
SDKSPPSTE

SEQ ID NO: 402097 - protein, 9 aa, Homo Sapiens
NTPGKGGHL

SEQ ID NO: 402098 - protein, 9 aa, Homo Sapiens
QLLRLRGPS

SEQ ID NO: 402099 - protein, 9 aa, Homo Sapiens
EIELYRASG

SEQ ID NO: 402100 - protein, 9 aa, Homo Sapiens
QKKWKSITL

SEQ ID NO: 402101 - protein, 9 aa, Homo Sapiens
PPDFFYLSD

SEQ ID NO: 402102 - protein, 9 aa, Homo Sapiens
KRIEDYIKL

SEQ ID NO: 402103 - protein, 9 aa, Homo Sapiens
LEINFERIN

SEQ ID NO: 402104 - protein, 9 aa, Homo Sapiens
DVLHCVTFA

SEQ ID NO: 402105 - protein, 9 aa, Homo Sapiens
PRAPQSGIE

SEQ ID NO: 402106 - protein, 9 aa, Homo Sapiens
LKLQPRENV

SEQ ID NO: 402107 - protein, 9 aa, Homo Sapiens
PFHADNFLQ

SEQ ID NO: 402108 - protein, 9 aa, Homo Sapiens
ALKTISESY

SEQ ID NO: 402109 - protein, 9 aa, Homo Sapiens
LQLDELSRG

SEQ ID NO: 402110 - protein, 9 aa, Homo Sapiens
KARHIQRSL

SEQ ID NO: 402111 - protein, 9 aa, Homo Sapiens
QSTEETPRN

SEQ ID NO: 402112 - protein, 9 aa, Homo Sapiens
RINGFKRHK

SEQ ID NO: 402113 - protein, 9 aa, Homo Sapiens
DIFSCLLRH

SEQ ID NO: 402114 - protein, 9 aa, Homo Sapiens
LDIYLPISN

SEQ ID NO: 402115 - protein, 9 aa, Homo Sapiens
MRTYAACQD

SEQ ID NO: 402116 - protein, 9 aa, Homo Sapiens
NQQDEAPTQ

SEQ ID NO: 402117 - protein, 9 aa, Homo Sapiens
SSHLTSHKI

SEQ ID NO: 402118 - protein, 9 aa, Homo Sapiens
FGKSQLLMH

SEQ ID NO: 402119 - protein, 9 aa, Homo Sapiens
AILYVHRII

SEQ ID NO: 402120 - protein, 9 aa, Homo Sapiens
SMMEKYEQI

SEQ ID NO: 402121 - protein, 9 aa, Homo Sapiens
WLVDAGFVW

SEQ ID NO: 402122 - protein, 9 aa, Homo Sapiens
KWCKREILK

SEQ ID NO: 402123 - protein, 9 aa, Homo Sapiens
FLVRLFACP

SEQ ID NO: 402124 - protein, 9 aa, Homo Sapiens
RGAGNGILN

SEQ ID NO: 402125 - protein, 9 aa, Homo Sapiens
SFQIHEITH

SEQ ID NO: 402126 - protein, 9 aa, Homo Sapiens
TGEGIEELN

SEQ ID NO: 402127 - protein, 9 aa, Homo Sapiens
EVIVYVESM

SEQ ID NO: 402128 - protein, 9 aa, Homo Sapiens
QQQPIIQTA

SEQ ID NO: 402129 - protein, 9 aa, Homo Sapiens
IIHSGEKPF

SEQ ID NO: 402130 - protein, 9 aa, Homo Sapiens
YAAAVLFQM

SEQ ID NO: 402131 - protein, 9 aa, Homo Sapiens
TGDVEELDI

SEQ ID NO: 402132 - protein, 9 aa, Homo Sapiens
KAIDMNINK

SEQ ID NO: 402133 - protein, 9 aa, Homo Sapiens
VSAQESQSQ

SEQ ID NO: 402134 - protein, 9 aa, Homo Sapiens
LKVLTNKTL

SEQ ID NO: 402135 - protein, 9 aa, Homo Sapiens
SFCYKVFRK

SEQ ID NO: 402136 - protein, 9 aa, Homo Sapiens
RYLCEGMES

SEQ ID NO: 402137 - protein, 9 aa, Homo Sapiens
SLRLLAYNR

SEQ ID NO: 402138 - protein, 9 aa, Homo Sapiens
GCLYNINYE

SEQ ID NO: 402139 - protein, 9 aa, Homo Sapiens
ANVSEEEEI

SEQ ID NO: 402140 - protein, 9 aa, Homo Sapiens
WELLSPKDK

SEQ ID NO: 402141 - protein, 9 aa, Homo Sapiens
QDLLRCHVL

SEQ ID NO: 402142 - protein, 9 aa, Homo Sapiens
TNTFLNPQK

SEQ ID NO: 402143 - protein, 9 aa, Homo Sapiens
SDLEENDSK

SEQ ID NO: 402144 - protein, 9 aa, Homo Sapiens
FPSFVKKLL

SEQ ID NO: 402145 - protein, 9 aa, Homo Sapiens
DGGGGGATG

SEQ ID NO: 402146 - protein, 9 aa, Homo Sapiens
GRTILKIIH

SEQ ID NO: 402147 - protein, 9 aa, Homo Sapiens
CQKQANAQQ

SEQ ID NO: 402148 - protein, 9 aa, Homo Sapiens
LFTTLEKIG

SEQ ID NO: 402149 - protein, 9 aa, Homo Sapiens
GRTFKKFNK

SEQ ID NO: 402150 - protein, 9 aa, Homo Sapiens
NNLSVAQCQ

SEQ ID NO: 402151 - protein, 9 aa, Homo Sapiens
EALRKIIRR

SEQ ID NO: 402152 - protein, 9 aa, Homo Sapiens
KTEKHPKYL

SEQ ID NO: 402153 - protein, 9 aa, Homo Sapiens
QKDIALLKL

SEQ ID NO: 402154 - protein, 9 aa, Homo Sapiens
ATYKQGFSS

SEQ ID NO: 402155 - protein, 9 aa, Homo Sapiens
EWGAFNPQW

SEQ ID NO: 402156 - protein, 9 aa, Homo Sapiens
YLNVANNIL

SEQ ID NO: 402157 - protein, 9 aa, Homo Sapiens
NQMVFSEQA

SEQ ID NO: 402158 - protein, 9 aa, Homo Sapiens
MGCTEYICM

SEQ ID NO: 402159 - protein, 9 aa, Homo Sapiens
FILVVMSWL

SEQ ID NO: 402160 - protein, 9 aa, Homo Sapiens
TYAACQDAL

SEQ ID NO: 402161 - protein, 9 aa, Homo Sapiens
TGKFSMEVN

SEQ ID NO: 402162 - protein, 9 aa, Homo Sapiens
AFTTYTVVR

SEQ ID NO: 402163 - protein, 9 aa, Homo Sapiens
EEEKHIKAE

SEQ ID NO: 402164 - protein, 9 aa, Homo Sapiens
RDILKVVIL

SEQ ID NO: 402165 - protein, 9 aa, Homo Sapiens
SQQQKCEEN

SEQ ID NO: 402166 - protein, 9 aa, Homo Sapiens
LSLLSSELE

SEQ ID NO: 402167 - protein, 9 aa, Homo Sapiens
YVMDLLLEN

SEQ ID NO: 402168 - protein, 9 aa, Homo Sapiens
VCSNTGSGK

SEQ ID NO: 402169 - protein, 9 aa, Homo Sapiens
EHDHLQNSD

SEQ ID NO: 402170 - protein, 9 aa, Homo Sapiens
IKQIPSSES

SEQ ID NO: 402171 - protein, 9 aa, Homo Sapiens
IFYFKEHEI

SEQ ID NO: 402172 - protein, 9 aa, Homo Sapiens
QNYLKERGD

SEQ ID NO: 402173 - protein, 9 aa, Homo Sapiens
FLMSGGFDR

SEQ ID NO: 402174 - protein, 9 aa, Homo Sapiens
GFTRFWSAV

SEQ ID NO: 402175 - protein, 9 aa, Homo Sapiens
QPFKIISYV

SEQ ID NO: 402176 - protein, 9 aa, Homo Sapiens
KKPPLQKDK

SEQ ID NO: 402177 - protein, 9 aa, Homo Sapiens
LLTVQRETL

SEQ ID NO: 402178 - protein, 9 aa, Homo Sapiens
AMAGKTDQK

SEQ ID NO: 402179 - protein, 9 aa, Homo Sapiens
TTALTSACT

SEQ ID NO: 402180 - protein, 9 aa, Homo Sapiens
QLFQLNYLS

SEQ ID NO: 402181 - protein, 9 aa, Homo Sapiens
MLGVCSNTG

SEQ ID NO: 402182 - protein, 9 aa, Homo Sapiens
TPPQSPGLQ

SEQ ID NO: 402183 - protein, 9 aa, Homo Sapiens
NQTETTADK

SEQ ID NO: 402184 - protein, 9 aa, Homo Sapiens
EKHFQYQQL

SEQ ID NO: 402185 - protein, 9 aa, Homo Sapiens
GASWSPRGV

SEQ ID NO: 402186 - protein, 9 aa, Homo Sapiens
EKQICIPRS

SEQ ID NO: 402187 - protein, 9 aa, Homo Sapiens
SRSPKIRSV

SEQ ID NO: 402188 - protein, 9 aa, Homo Sapiens
STQMLKKHK

SEQ ID NO: 402189 - protein, 9 aa, Homo Sapiens
MNRSTLSDS

SEQ ID NO: 402190 - protein, 9 aa, Homo Sapiens
QSNCTYSLS

SEQ ID NO: 402191 - protein, 9 aa, Homo Sapiens
LAESADLGN

SEQ ID NO: 402192 - protein, 9 aa, Homo Sapiens
TYASAHLTS

SEQ ID NO: 402193 - protein, 9 aa, Homo Sapiens
SNHQIIHTG

SEQ ID NO: 402194 - protein, 9 aa, Homo Sapiens
QLEELDKAF

SEQ ID NO: 402195 - protein, 9 aa, Homo Sapiens
QRLKCQKQA

SEQ ID NO: 402196 - protein, 9 aa, Homo Sapiens
ALPEHKKKC

SEQ ID NO: 402197 - protein, 9 aa, Homo Sapiens
LYLEVMLDN

SEQ ID NO: 402198 - protein, 9 aa, Homo Sapiens
DVSYLYIFN

SEQ ID NO: 402199 - protein, 9 aa, Homo Sapiens
QPLEALGLF

SEQ ID NO: 402200 - protein, 9 aa, Homo Sapiens
APFHTSGEN

SEQ ID NO: 402201 - protein, 9 aa, Homo Sapiens
DYGILQEKI

SEQ ID NO: 402202 - protein, 9 aa, Homo Sapiens
YRSEFYSLQ

SEQ ID NO: 402203 - protein, 9 aa, Homo Sapiens
ARYRQFVKQ

SEQ ID NO: 402204 - protein, 9 aa, Homo Sapiens
AKQISGKMA

SEQ ID NO: 402205 - protein, 9 aa, Homo Sapiens
PGLLQSGFY

SEQ ID NO: 402206 - protein, 9 aa, Homo Sapiens
FVDLLDILI

SEQ ID NO: 402207 - protein, 9 aa, Homo Sapiens
TQNIEKKKA

SEQ ID NO: 402208 - protein, 9 aa, Homo Sapiens
MNVKHWPWI

SEQ ID NO: 402209 - protein, 9 aa, Homo Sapiens
DFRFFNNVF

SEQ ID NO: 402210 - protein, 9 aa, Homo Sapiens
RNVPAAYCG

SEQ ID NO: 402211 - protein, 9 aa, Homo Sapiens
GRKRQQNTK

SEQ ID NO: 402212 - protein, 9 aa, Homo Sapiens
VLVKDIQII

SEQ ID NO: 402213 - protein, 9 aa, Homo Sapiens
KETETVEAY

SEQ ID NO: 402214 - protein, 9 aa, Homo Sapiens
QIQYVPVFP

SEQ ID NO: 402215 - protein, 9 aa, Homo Sapiens
IYTSERFKN

SEQ ID NO: 402216 - protein, 9 aa, Homo Sapiens
KSPVKARAL

SEQ ID NO: 402217 - protein, 9 aa, Homo Sapiens
YLELTGPPQ

SEQ ID NO: 402218 - protein, 9 aa, Homo Sapiens
RELESSQRL

SEQ ID NO: 402219 - protein, 9 aa, Homo Sapiens
TMEVREGES

SEQ ID NO: 402220 - protein, 9 aa, Homo Sapiens
NSPEVSLLS

SEQ ID NO: 402221 - protein, 9 aa, Homo Sapiens
IMMIFYMID

SEQ ID NO: 402222 - protein, 9 aa, Homo Sapiens
IDFRFFNNV

SEQ ID NO: 402223 - protein, 9 aa, Homo Sapiens
ENHTDKFLI

SEQ ID NO: 402224 - protein, 9 aa, Homo Sapiens
PIQSWDNIE

SEQ ID NO: 402225 - protein, 9 aa, Homo Sapiens
RIDYISGNP

SEQ ID NO: 402226 - protein, 9 aa, Homo Sapiens
RPRSLRYPT

SEQ ID NO: 402227 - protein, 9 aa, Homo Sapiens
FPFYLQNCS

SEQ ID NO: 402228 - protein, 9 aa, Homo Sapiens
TVLLSFCYK

SEQ ID NO: 402229 - protein, 9 aa, Homo Sapiens
ITWIKPTQK

SEQ ID NO: 402230 - protein, 9 aa, Homo Sapiens
QWPDPRHNK

SEQ ID NO: 402231 - protein, 9 aa, Homo Sapiens
CLNPPFYGF

SEQ ID NO: 402232 - protein, 9 aa, Homo Sapiens
KEFKNISTI

SEQ ID NO: 402233 - protein, 9 aa, Homo Sapiens
NCLNPPFYG

SEQ ID NO: 402234 - protein, 9 aa, Homo Sapiens
SQNIPLSYF

SEQ ID NO: 402235 - protein, 9 aa, Homo Sapiens
ITPLCCAAA

SEQ ID NO: 402236 - protein, 9 aa, Homo Sapiens
DVGNHYEDL

SEQ ID NO: 402237 - protein, 9 aa, Homo Sapiens
LPFHADNFL

SEQ ID NO: 402238 - protein, 9 aa, Homo Sapiens
FRHDLDYLS

SEQ ID NO: 402239 - protein, 9 aa, Homo Sapiens
SPLKNALYE

SEQ ID NO: 402240 - protein, 9 aa, Homo Sapiens
ISWYQNKIG

SEQ ID NO: 402241 - protein, 9 aa, Homo Sapiens
KDEATDFCV

SEQ ID NO: 402242 - protein, 9 aa, Homo Sapiens
SGILKTLLW

SEQ ID NO: 402243 - protein, 9 aa, Homo Sapiens
IKALELRFN

SEQ ID NO: 402244 - protein, 9 aa, Homo Sapiens
VPRYLCEGM

SEQ ID NO: 402245 - protein, 9 aa, Homo Sapiens
DDPPWSWNL

SEQ ID NO: 402246 - protein, 9 aa, Homo Sapiens
QELDRRPLN

SEQ ID NO: 402247 - protein, 9 aa, Homo Sapiens
YMTLMSSIA

SEQ ID NO: 402248 - protein, 9 aa, Homo Sapiens
DHYQITFTP

SEQ ID NO: 402249 - protein, 9 aa, Homo Sapiens
TQMLKKHKE

SEQ ID NO: 402250 - protein, 9 aa, Homo Sapiens
QRRLDIFSC

SEQ ID NO: 402251 - protein, 9 aa, Homo Sapiens
KVVAVDADL

SEQ ID NO: 402252 - protein, 9 aa, Homo Sapiens
TRISAVMVT

SEQ ID NO: 402253 - protein, 9 aa, Homo Sapiens
SFPRPLIIF

SEQ ID NO: 402254 - protein, 9 aa, Homo Sapiens
QKEFVRKKT

SEQ ID NO: 402255 - protein, 9 aa, Homo Sapiens
REYCKFSLD

SEQ ID NO: 402256 - protein, 9 aa, Homo Sapiens
ICTHHLDPK

SEQ ID NO: 402257 - protein, 9 aa, Homo Sapiens
QALKDLKKT

SEQ ID NO: 402258 - protein, 9 aa, Homo Sapiens
EEEEDDYYE

SEQ ID NO: 402259 - protein, 9 aa, Homo Sapiens
QLSTTMECV

SEQ ID NO: 402260 - protein, 9 aa, Homo Sapiens
ICIPRSLSV

SEQ ID NO: 402261 - protein, 9 aa, Homo Sapiens
SATNTFLNP

SEQ ID NO: 402262 - protein, 9 aa, Homo Sapiens
GLVNGLQLL

SEQ ID NO: 402263 - protein, 9 aa, Homo Sapiens
DVQTRKQIC

SEQ ID NO: 402264 - protein, 9 aa, Homo Sapiens
IGGEEPAKE

SEQ ID NO: 402265 - protein, 9 aa, Homo Sapiens
CNYTQNIDT

SEQ ID NO: 402266 - protein, 9 aa, Homo Sapiens
FPLHEVVVQ

SEQ ID NO: 402267 - protein, 9 aa, Homo Sapiens
IRGNKLHFS

SEQ ID NO: 402268 - protein, 9 aa, Homo Sapiens
VHSDNWVVY

SEQ ID NO: 402269 - protein, 9 aa, Homo Sapiens
SSRNTISFA

SEQ ID NO: 402270 - protein, 9 aa, Homo Sapiens
TALNLTAPG

SEQ ID NO: 402271 - protein, 9 aa, Homo Sapiens
LLEQESLLL

SEQ ID NO: 402272 - protein, 9 aa, Homo Sapiens
FKQTNVYSM

SEQ ID NO: 402273 - protein, 9 aa, Homo Sapiens
DDLFQCVNG

SEQ ID NO: 402274 - protein, 9 aa, Homo Sapiens
KTQPLYVIR

SEQ ID NO: 402275 - protein, 9 aa, Homo Sapiens
DKSPPSTEN

SEQ ID NO: 402276 - protein, 9 aa, Homo Sapiens
EMSYSLFQA

SEQ ID NO: 402277 - protein, 9 aa, Homo Sapiens
SVCGKAFRQ

SEQ ID NO: 402278 - protein, 9 aa, Homo Sapiens
CILWWLTKK

SEQ ID NO: 402279 - protein, 9 aa, Homo Sapiens
SNKDENGLV

SEQ ID NO: 402280 - protein, 9 aa, Homo Sapiens
NIIRMEERS

SEQ ID NO: 402281 - protein, 9 aa, Homo Sapiens
ELYHHMTEN

SEQ ID NO: 402282 - protein, 9 aa, Homo Sapiens
VVSVHKSGK

SEQ ID NO: 402283 - protein, 9 aa, Homo Sapiens
KQCPATSKD

SEQ ID NO: 402284 - protein, 9 aa, Homo Sapiens
RRRINGFKR

SEQ ID NO: 402285 - protein, 9 aa, Homo Sapiens
IYQLQLDEL

SEQ ID NO: 402286 - protein, 9 aa, Homo Sapiens
AERNSYCLS

SEQ ID NO: 402287 - protein, 9 aa, Homo Sapiens
KRKILFSKE

SEQ ID NO: 402288 - protein, 9 aa, Homo Sapiens
GGPFQLWEP

SEQ ID NO: 402289 - protein, 9 aa, Homo Sapiens
ADRLFSYFG

SEQ ID NO: 402290 - protein, 9 aa, Homo Sapiens
GEAVSWDSI

SEQ ID NO: 402291 - protein, 9 aa, Homo Sapiens
SSDKKENKS

SEQ ID NO: 402292 - protein, 9 aa, Homo Sapiens
IVREKAKQN

SEQ ID NO: 402293 - protein, 9 aa, Homo Sapiens
FAEAIHLPQ

SEQ ID NO: 402294 - protein, 9 aa, Homo Sapiens
LTQTALNLT

SEQ ID NO: 402295 - protein, 9 aa, Homo Sapiens
RRRMVMQSG

SEQ ID NO: 402296 - protein, 9 aa, Homo Sapiens
LDNTFEGHK

SEQ ID NO: 402297 - protein, 9 aa, Homo Sapiens
TNIYVKNYF

SEQ ID NO: 402298 - protein, 9 aa, Homo Sapiens
NFITHQIIH

SEQ ID NO: 402299 - protein, 9 aa, Homo Sapiens
PISKKPPLQ

SEQ ID NO: 402300 - protein, 9 aa, Homo Sapiens
HIKAEKAEI

SEQ ID NO: 402301 - protein, 9 aa, Homo Sapiens
PQPWYFLIM

SEQ ID NO: 402302 - protein, 9 aa, Homo Sapiens
KFTEYSLRL

SEQ ID NO: 402303 - protein, 9 aa, Homo Sapiens
TGIIFLEVL

SEQ ID NO: 402304 - protein, 9 aa, Homo Sapiens
RKLKKQRLK

SEQ ID NO: 402305 - protein, 9 aa, Homo Sapiens
SINGILSER

SEQ ID NO: 402306 - protein, 9 aa, Homo Sapiens
RVVPCGKIS

SEQ ID NO: 402307 - protein, 9 aa, Homo Sapiens
VFNVIPELE

SEQ ID NO: 402308 - protein, 9 aa, Homo Sapiens
TYQRDYSLP

SEQ ID NO: 402309 - protein, 9 aa, Homo Sapiens
SNQTETTAD

SEQ ID NO: 402310 - protein, 9 aa, Homo Sapiens
KYLKNQESE

SEQ ID NO: 402311 - protein, 9 aa, Homo Sapiens
NLSGIYCSL

SEQ ID NO: 402312 - protein, 9 aa, Homo Sapiens
SPLKLHQTE

SEQ ID NO: 402313 - protein, 9 aa, Homo Sapiens
EEDDYYENS

SEQ ID NO: 402314 - protein, 9 aa, Homo Sapiens
EHNEFNSSI

SEQ ID NO: 402315 - protein, 9 aa, Homo Sapiens
LDYLSLRTR

SEQ ID NO: 402316 - protein, 9 aa, Homo Sapiens
LSDQGWEYI

SEQ ID NO: 402317 - protein, 9 aa, Homo Sapiens
TRMAELSRD

SEQ ID NO: 402318 - protein, 9 aa, Homo Sapiens
DTSQNIPLS

SEQ ID NO: 402319 - protein, 9 aa, Homo Sapiens
ELPEADSAG

SEQ ID NO: 402320 - protein, 9 aa, Homo Sapiens
GRIHSKDIF

SEQ ID NO: 402321 - protein, 9 aa, Homo Sapiens
ATGPGAEEE

SEQ ID NO: 402322 - protein, 9 aa, Homo Sapiens
FNNCLNPPF

SEQ ID NO: 402323 - protein, 9 aa, Homo Sapiens
IRYNPGLNA

SEQ ID NO: 402324 - protein, 9 aa, Homo Sapiens
ELKELFAKA

SEQ ID NO: 402325 - protein, 9 aa, Homo Sapiens
CEERNHDLP

SEQ ID NO: 402326 - protein, 9 aa, Homo Sapiens
NVLKVLTNK

SEQ ID NO: 402327 - protein, 9 aa, Homo Sapiens
VAQVLRRMR

SEQ ID NO: 402328 - protein, 9 aa, Homo Sapiens
HLSQQQKCE

SEQ ID NO: 402329 - protein, 9 aa, Homo Sapiens
LTCILWWLT

SEQ ID NO: 402330 - protein, 9 aa, Homo Sapiens
EEVFLIFWN

SEQ ID NO: 402331 - protein, 9 aa, Homo Sapiens
PTVLELCIL

SEQ ID NO: 402332 - protein, 9 aa, Homo Sapiens
PQDHEMLYD

SEQ ID NO: 402333 - protein, 9 aa, Homo Sapiens
QAKLQTGWS

SEQ ID NO: 402334 - protein, 9 aa, Homo Sapiens
IIGGEEPAK

SEQ ID NO: 402335 - protein, 9 aa, Homo Sapiens
MSFNSMNWR

SEQ ID NO: 402336 - protein, 9 aa, Homo Sapiens
KGAHHNKYG

SEQ ID NO: 402337 - protein, 9 aa, Homo Sapiens
KKENKSFSL

SEQ ID NO: 402338 - protein, 9 aa, Homo Sapiens
SSACLCPQV

SEQ ID NO: 402339 - protein, 9 aa, Homo Sapiens
PPLDPLTLE

SEQ ID NO: 402340 - protein, 9 aa, Homo Sapiens
VLITEASGT

SEQ ID NO: 402341 - protein, 9 aa, Homo Sapiens
NQHSRFILG

SEQ ID NO: 402342 - protein, 9 aa, Homo Sapiens
STAYEKQCP

SEQ ID NO: 402343 - protein, 9 aa, Homo Sapiens
DITCLESFC

SEQ ID NO: 402344 - protein, 9 aa, Homo Sapiens
HASQLHDHA

SEQ ID NO: 402345 - protein, 9 aa, Homo Sapiens
SRSRSPKIR

SEQ ID NO: 402346 - protein, 9 aa, Homo Sapiens
ERTHTGEKQ

SEQ ID NO: 402347 - protein, 9 aa, Homo Sapiens
AGSDLRVGA

SEQ ID NO: 402348 - protein, 9 aa, Homo Sapiens
LSCSTVPTC

SEQ ID NO: 402349 - protein, 9 aa, Homo Sapiens
QASAQGIQS

SEQ ID NO: 402350 - protein, 9 aa, Homo Sapiens
ALVRFSLLT

SEQ ID NO: 402351 - protein, 9 aa, Homo Sapiens
VKNLEVPVN

SEQ ID NO: 402352 - protein, 9 aa, Homo Sapiens
QRLAILKED

SEQ ID NO: 402353 - protein, 9 aa, Homo Sapiens
NKDFCADYR

SEQ ID NO: 402354 - protein, 9 aa, Homo Sapiens
DIGHKIYSK

SEQ ID NO: 402355 - protein, 9 aa, Homo Sapiens
NAEEEFFYG

SEQ ID NO: 402356 - protein, 9 aa, Homo Sapiens
MELFILLCA

SEQ ID NO: 402357 - protein, 9 aa, Homo Sapiens
VGYFIQRYQ

SEQ ID NO: 402358 - protein, 9 aa, Homo Sapiens
AAFRALLKS

SEQ ID NO: 402359 - protein, 9 aa, Homo Sapiens
KKRHRGYSK

SEQ ID NO: 402360 - protein, 9 aa, Homo Sapiens
FYMIDGQGY

SEQ ID NO: 402361 - protein, 9 aa, Homo Sapiens
GLFTSSFPD

SEQ ID NO: 402362 - protein, 9 aa, Homo Sapiens
DSGAYYCTG

SEQ ID NO: 402363 - protein, 9 aa, Homo Sapiens
TVGESYRYP

SEQ ID NO: 402364 - protein, 9 aa, Homo Sapiens
NYFATDLSS

SEQ ID NO: 402365 - protein, 9 aa, Homo Sapiens
KLRLKLCKK

SEQ ID NO: 402366 - protein, 9 aa, Homo Sapiens
HEVKPLGVM

SEQ ID NO: 402367 - protein, 9 aa, Homo Sapiens
FIEELKRCN

SEQ ID NO: 402368 - protein, 9 aa, Homo Sapiens
SSAQRLKCQ

SEQ ID NO: 402369 - protein, 9 aa, Homo Sapiens
VVILFFHPE

SEQ ID NO: 402370 - protein, 9 aa, Homo Sapiens
CLSIHRRVN

SEQ ID NO: 402371 - protein, 9 aa, Homo Sapiens
SHSCNSILN

SEQ ID NO: 402372 - protein, 9 aa, Homo Sapiens
VTEASGHTY

SEQ ID NO: 402373 - protein, 9 aa, Homo Sapiens
ESPLETPGP

SEQ ID NO: 402374 - protein, 9 aa, Homo Sapiens
QNLRSLVRV

SEQ ID NO: 402375 - protein, 9 aa, Homo Sapiens
EGFDLHGAL

SEQ ID NO: 402376 - protein, 9 aa, Homo Sapiens
SDFTLWKAA

SEQ ID NO: 402377 - protein, 9 aa, Homo Sapiens
PSSFQIHEI

SEQ ID NO: 402378 - protein, 9 aa, Homo Sapiens
TVMISATWP

SEQ ID NO: 402379 - protein, 9 aa, Homo Sapiens
EVSAEIAQE

SEQ ID NO: 402380 - protein, 9 aa, Homo Sapiens
QAHLSALVS

SEQ ID NO: 402381 - protein, 9 aa, Homo Sapiens
NNLDTTPVV

SEQ ID NO: 402382 - protein, 9 aa, Homo Sapiens
CSSRTAHLV

SEQ ID NO: 402383 - protein, 9 aa, Homo Sapiens
TVLHIAALY

SEQ ID NO: 402384 - protein, 9 aa, Homo Sapiens
TRFGKHLCG

SEQ ID NO: 402385 - protein, 9 aa, Homo Sapiens
VLKLISLCY

SEQ ID NO: 402386 - protein, 9 aa, Homo Sapiens
QGFSSRLGE

SEQ ID NO: 402387 - protein, 9 aa, Homo Sapiens
QDDLKTLLA

SEQ ID NO: 402388 - protein, 9 aa, Homo Sapiens
YLNVHTQTH

SEQ ID NO: 402389 - protein, 9 aa, Homo Sapiens
SNHVQRQLP

SEQ ID NO: 402390 - protein, 9 aa, Homo Sapiens
KPYPRKKEI

SEQ ID NO: 402391 - protein, 9 aa, Homo Sapiens
SAEIAQENV

SEQ ID NO: 402392 - protein, 9 aa, Homo Sapiens
RIRWGPRLD

SEQ ID NO: 402393 - protein, 9 aa, Homo Sapiens
TIQNERNKF

SEQ ID NO: 402394 - protein, 9 aa, Homo Sapiens
EKERGKIEV

SEQ ID NO: 402395 - protein, 9 aa, Homo Sapiens
RRGKNIFVL

SEQ ID NO: 402396 - protein, 9 aa, Homo Sapiens
TVRNSAATT

SEQ ID NO: 402397 - protein, 9 aa, Homo Sapiens
FQLDTDECH

SEQ ID NO: 402398 - protein, 9 aa, Homo Sapiens
GIEELNNCI

SEQ ID NO: 402399 - protein, 9 aa, Homo Sapiens
INISEANQF

SEQ ID NO: 402400 - protein, 9 aa, Homo Sapiens
PEDLHTELM

SEQ ID NO: 402401 - protein, 9 aa, Homo Sapiens
NEGSDDEGM

SEQ ID NO: 402402 - protein, 9 aa, Homo Sapiens
PVPNMTPSA

SEQ ID NO: 402403 - protein, 9 aa, Homo Sapiens
WPDPRHNKA

SEQ ID NO: 402404 - protein, 9 aa, Homo Sapiens
YFTHHIFLW

SEQ ID NO: 402405 - protein, 9 aa, Homo Sapiens
LLHTRLSGD

SEQ ID NO: 402406 - protein, 9 aa, Homo Sapiens
RRGAKTVCY

SEQ ID NO: 402407 - protein, 9 aa, Homo Sapiens
QIGYMIRMT

SEQ ID NO: 402408 - protein, 9 aa, Homo Sapiens
LSNPFRYIM

SEQ ID NO: 402409 - protein, 9 aa, Homo Sapiens
RIRYNPGLN

SEQ ID NO: 402410 - protein, 9 aa, Homo Sapiens
KIAQNNQTV

SEQ ID NO: 402411 - protein, 9 aa, Homo Sapiens
VEGFDLHGA

SEQ ID NO: 402412 - protein, 9 aa, Homo Sapiens
SNKILIKEK

SEQ ID NO: 402413 - protein, 9 aa, Homo Sapiens
SKYQSILIS

SEQ ID NO: 402414 - protein, 9 aa, Homo Sapiens
AKQNTELIQ

SEQ ID NO: 402415 - protein, 9 aa, Homo Sapiens
PRPLIIFLV

SEQ ID NO: 402416 - protein, 9 aa, Homo Sapiens
ICCYYFAVK

SEQ ID NO: 402417 - protein, 9 aa, Homo Sapiens
HAKITYREL

SEQ ID NO: 402418 - protein, 9 aa, Homo Sapiens
LQASELILD

SEQ ID NO: 402419 - protein, 9 aa, Homo Sapiens
PHNFAARQG

SEQ ID NO: 402420 - protein, 9 aa, Homo Sapiens
TTYTVVRMH

SEQ ID NO: 402421 - protein, 9 aa, Homo Sapiens
GKQGEPGLP

SEQ ID NO: 402422 - protein, 9 aa, Homo Sapiens
NLEVPVNII

SEQ ID NO: 402423 - protein, 9 aa, Homo Sapiens
TSRKEYFNQ

SEQ ID NO: 402424 - protein, 9 aa, Homo Sapiens
IHGNDPNYI

SEQ ID NO: 402425 - protein, 9 aa, Homo Sapiens
AVSNFVDNV

SEQ ID NO: 402426 - protein, 9 aa, Homo Sapiens
LEEENKKHK

SEQ ID NO: 402427 - protein, 9 aa, Homo Sapiens
VWLVDAGFV

SEQ ID NO: 402428 - protein, 9 aa, Homo Sapiens
KRDFRNKSE

SEQ ID NO: 402429 - protein, 9 aa, Homo Sapiens
FQSRNVHNI

SEQ ID NO: 402430 - protein, 9 aa, Homo Sapiens
YLWEQIQKM

SEQ ID NO: 402431 - protein, 9 aa, Homo Sapiens
KESTEVHGT

SEQ ID NO: 402432 - protein, 9 aa, Homo Sapiens
NKKVKKIIQ

SEQ ID NO: 402433 - protein, 9 aa, Homo Sapiens
PIFPQALYK

SEQ ID NO: 402434 - protein, 9 aa, Homo Sapiens
ETVLHIAAL

SEQ ID NO: 402435 - protein, 9 aa, Homo Sapiens
IYAFHNQEI

SEQ ID NO: 402436 - protein, 9 aa, Homo Sapiens
VFKPTRDDC

SEQ ID NO: 402437 - protein, 9 aa, Homo Sapiens
SESKLIEQD

SEQ ID NO: 402438 - protein, 9 aa, Homo Sapiens
LSQILDVAQ

SEQ ID NO: 402439 - protein, 9 aa, Homo Sapiens
ETDEDKLFV

SEQ ID NO: 402440 - protein, 9 aa, Homo Sapiens
TRTWKLQTA

SEQ ID NO: 402441 - protein, 9 aa, Homo Sapiens
LNNIISEIQ

SEQ ID NO: 402442 - protein, 9 aa, Homo Sapiens
VRLFACPSK

SEQ ID NO: 402443 - protein, 9 aa, Homo Sapiens
FVNVNYCTG

SEQ ID NO: 402444 - protein, 9 aa, Homo Sapiens
SPSNFKVRL

SEQ ID NO: 402445 - protein, 9 aa, Homo Sapiens
VKDIQIIVL

SEQ ID NO: 402446 - protein, 9 aa, Homo Sapiens
KMFEKNVYV

SEQ ID NO: 402447 - protein, 9 aa, Homo Sapiens
PTYECVHLY

SEQ ID NO: 402448 - protein, 9 aa, Homo Sapiens
KEKTKSHYF

SEQ ID NO: 402449 - protein, 9 aa, Homo Sapiens
KLAELPAPV

SEQ ID NO: 402450 - protein, 9 aa, Homo Sapiens
IPQREVVNV

SEQ ID NO: 402451 - protein, 9 aa, Homo Sapiens
LPLAKNEYI

SEQ ID NO: 402452 - protein, 9 aa, Homo Sapiens
HIQRSLSTP

SEQ ID NO: 402453 - protein, 9 aa, Homo Sapiens
LSQEHLTNN

SEQ ID NO: 402454 - protein, 9 aa, Homo Sapiens
SLEYGWSLS

SEQ ID NO: 402455 - protein, 9 aa, Homo Sapiens
SLGSWNPIY

SEQ ID NO: 402456 - protein, 9 aa, Homo Sapiens
APPGTIRGY

SEQ ID NO: 402457 - protein, 9 aa, Homo Sapiens
ELPAPVQPS

SEQ ID NO: 402458 - protein, 9 aa, Homo Sapiens
THHNIRAVV

SEQ ID NO: 402459 - protein, 9 aa, Homo Sapiens
PRNILRPTK

SEQ ID NO: 402460 - protein, 9 aa, Homo Sapiens
EGDAASGSI

SEQ ID NO: 402461 - protein, 9 aa, Homo Sapiens
WMKYFILTV

SEQ ID NO: 402462 - protein, 9 aa, Homo Sapiens
LVDPNNLDT

SEQ ID NO: 402463 - protein, 9 aa, Homo Sapiens
QVFFLIILG

SEQ ID NO: 402464 - protein, 9 aa, Homo Sapiens
HNEFNSSIA

SEQ ID NO: 402465 - protein, 9 aa, Homo Sapiens
HPEPTRTKD

SEQ ID NO: 402466 - protein, 9 aa, Homo Sapiens
WLGGGRADI

SEQ ID NO: 402467 - protein, 9 aa, Homo Sapiens
WNLPVVTIA

SEQ ID NO: 402468 - protein, 9 aa, Homo Sapiens
HQKKMSPPL

SEQ ID NO: 402469 - protein, 9 aa, Homo Sapiens
NPPFYGFLG

SEQ ID NO: 402470 - protein, 9 aa, Homo Sapiens
QILDVAQDL

SEQ ID NO: 402471 - protein, 9 aa, Homo Sapiens
HAEHELTEL

SEQ ID NO: 402472 - protein, 9 aa, Homo Sapiens
VEMAEVTNI

SEQ ID NO: 402473 - protein, 9 aa, Homo Sapiens
HPFLFLIRN

SEQ ID NO: 402474 - protein, 9 aa, Homo Sapiens
YEHLIESTN

SEQ ID NO: 402475 - protein, 9 aa, Homo Sapiens
TRYQTFVNV

SEQ ID NO: 402476 - protein, 9 aa, Homo Sapiens
GNKNNQRAV

SEQ ID NO: 402477 - protein, 9 aa, Homo Sapiens
AFRQAPHWK

SEQ ID NO: 402478 - protein, 9 aa, Homo Sapiens
GQAGAKKHS

SEQ ID NO: 402479 - protein, 9 aa, Homo Sapiens
PTYLRKNLS

SEQ ID NO: 402480 - protein, 9 aa, Homo Sapiens
EQIHTGEKP

SEQ ID NO: 402481 - protein, 9 aa, Homo Sapiens
SQLLMHHRT

SEQ ID NO: 402482 - protein, 9 aa, Homo Sapiens
LKPGTVVTF

SEQ ID NO: 402483 - protein, 9 aa, Homo Sapiens
KPLRFCGVH

SEQ ID NO: 402484 - protein, 9 aa, Homo Sapiens
DPNNLDTTP

SEQ ID NO: 402485 - protein, 9 aa, Homo Sapiens
LCNYTQNID

SEQ ID NO: 402486 - protein, 9 aa, Homo Sapiens
NIISQEECS

SEQ ID NO: 402487 - protein, 9 aa, Homo Sapiens
DFCEPSFAT

SEQ ID NO: 402488 - protein, 9 aa, Homo Sapiens
GWEYIILLS

SEQ ID NO: 402489 - protein, 9 aa, Homo Sapiens
AVPPGWGMV

SEQ ID NO: 402490 - protein, 9 aa, Homo Sapiens
GSTVKIPMI

SEQ ID NO: 402491 - protein, 9 aa, Homo Sapiens
HFKLEKHSA

SEQ ID NO: 402492 - protein, 9 aa, Homo Sapiens
RSVLFNFIR

SEQ ID NO: 402493 - protein, 9 aa, Homo Sapiens
IEQDFRKRR

SEQ ID NO: 402494 - protein, 9 aa, Homo Sapiens
LTDLTKGWI

SEQ ID NO: 402495 - protein, 9 aa, Homo Sapiens
LYLDNPEIK

SEQ ID NO: 402496 - protein, 9 aa, Homo Sapiens
EMAEVTNIY

SEQ ID NO: 402497 - protein, 9 aa, Homo Sapiens
NISTHGQNN

SEQ ID NO: 402498 - protein, 9 aa, Homo Sapiens
PMYFLICSL

SEQ ID NO: 402499 - protein, 9 aa, Homo Sapiens
SKATNADKL

SEQ ID NO: 402500 - protein, 9 aa, Homo Sapiens
VRSEVPAIN

SEQ ID NO: 402501 - protein, 9 aa, Homo Sapiens
GISGNNMTK

SEQ ID NO: 402502 - protein, 9 aa, Homo Sapiens
YFATDLSSG

SEQ ID NO: 402503 - protein, 9 aa, Homo Sapiens
PLKEHPDLP

SEQ ID NO: 402504 - protein, 9 aa, Homo Sapiens
PVPEVIVYV

SEQ ID NO: 402505 - protein, 9 aa, Homo Sapiens
RIVVTQSEI

SEQ ID NO: 402506 - protein, 9 aa, Homo Sapiens
STHGQNNPV

SEQ ID NO: 402507 - protein, 9 aa, Homo Sapiens
ILRKNPTSA

SEQ ID NO: 402508 - protein, 9 aa, Homo Sapiens
IFPQALYKV

SEQ ID NO: 402509 - protein, 9 aa, Homo Sapiens
SSLEYGWSL

SEQ ID NO: 402510 - protein, 9 aa, Homo Sapiens
PYPNKPPNQ

SEQ ID NO: 402511 - protein, 9 aa, Homo Sapiens
KLLVLHGAE

SEQ ID NO: 402512 - protein, 9 aa, Homo Sapiens
HKSMIQMKT

SEQ ID NO: 402513 - protein, 9 aa, Homo Sapiens
ITCLESFCD

SEQ ID NO: 402514 - protein, 9 aa, Homo Sapiens
FLIMPSYWC

SEQ ID NO: 402515 - protein, 9 aa, Homo Sapiens
ELQYFEEEG

SEQ ID NO: 402516 - protein, 9 aa, Homo Sapiens
LQDKILKKL

SEQ ID NO: 402517 - protein, 9 aa, Homo Sapiens
YKEKEEKIN

SEQ ID NO: 402518 - protein, 9 aa, Homo Sapiens
PFFITTVPT

SEQ ID NO: 402519 - protein, 9 aa, Homo Sapiens
KEFNYYGLW

SEQ ID NO: 402520 - protein, 9 aa, Homo Sapiens
LLGDKTRMA

SEQ ID NO: 402521 - protein, 9 aa, Homo Sapiens
LDNWVCLAY

SEQ ID NO: 402522 - protein, 9 aa, Homo Sapiens
QQPIIQTAM

SEQ ID NO: 402523 - protein, 9 aa, Homo Sapiens
SPVLYERSL

SEQ ID NO: 402524 - protein, 9 aa, Homo Sapiens
PEQQNKLWV

SEQ ID NO: 402525 - protein, 9 aa, Homo Sapiens
IQLFDRLKL

SEQ ID NO: 402526 - protein, 9 aa, Homo Sapiens
STHHNIRAV

SEQ ID NO: 402527 - protein, 9 aa, Homo Sapiens
EVQLTKYLI

SEQ ID NO: 402528 - protein, 9 aa, Homo Sapiens
LLHKSDTDK

SEQ ID NO: 402529 - protein, 9 aa, Homo Sapiens
AAEKGPHSS

SEQ ID NO: 402530 - protein, 9 aa, Homo Sapiens
NEQWIRAKY

SEQ ID NO: 402531 - protein, 9 aa, Homo Sapiens
KNVCFDDLF

SEQ ID NO: 402532 - protein, 9 aa, Homo Sapiens
KSIKGVSEK

SEQ ID NO: 402533 - protein, 9 aa, Homo Sapiens
TLVPLLLSP

SEQ ID NO: 402534 - protein, 9 aa, Homo Sapiens
PVSLINYPY

SEQ ID NO: 402535 - protein, 9 aa, Homo Sapiens
KHWAAMHVS

SEQ ID NO: 402536 - protein, 9 aa, Homo Sapiens
VFQFKSSNK

SEQ ID NO: 402537 - protein, 9 aa, Homo Sapiens
EVGYFIQRY

SEQ ID NO: 402538 - protein, 9 aa, Homo Sapiens
ASILRICST

SEQ ID NO: 402539 - protein, 9 aa, Homo Sapiens
SNQQDEAPT

SEQ ID NO: 402540 - protein, 9 aa, Homo Sapiens
PIPFFLDIY

SEQ ID NO: 402541 - protein, 9 aa, Homo Sapiens
FCSDCIATA

SEQ ID NO: 402542 - protein, 9 aa, Homo Sapiens
EHWEYYKQP

SEQ ID NO: 402543 - protein, 9 aa, Homo Sapiens
LFNKAIDMN

SEQ ID NO: 402544 - protein, 9 aa, Homo Sapiens
SGSSRLQWR

SEQ ID NO: 402545 - protein, 9 aa, Homo Sapiens
NNPIFPQAL

SEQ ID NO: 402546 - protein, 9 aa, Homo Sapiens
RGMDTFLFR

SEQ ID NO: 402547 - protein, 9 aa, Homo Sapiens
MVEIELYRA

SEQ ID NO: 402548 - protein, 9 aa, Homo Sapiens
YPGLHLISL

SEQ ID NO: 402549 - protein, 9 aa, Homo Sapiens
QRSLSTPNV

SEQ ID NO: 402550 - protein, 9 aa, Homo Sapiens
IQDMQIKKK

SEQ ID NO: 402551 - protein, 9 aa, Homo Sapiens
EKVLKIHKS

SEQ ID NO: 402552 - protein, 9 aa, Homo Sapiens
WLSNTSTTT

SEQ ID NO: 402553 - protein, 9 aa, Homo Sapiens
KSCIKTLFG

SEQ ID NO: 402554 - protein, 9 aa, Homo Sapiens
QNPVYDPEH

SEQ ID NO: 402555 - protein, 9 aa, Homo Sapiens
LNKKYSISN

SEQ ID NO: 402556 - protein, 9 aa, Homo Sapiens
STAEQPYVF

SEQ ID NO: 402557 - protein, 9 aa, Homo Sapiens
HATTQAPTD

SEQ ID NO: 402558 - protein, 9 aa, Homo Sapiens
IRLLAWKES

SEQ ID NO: 402559 - protein, 9 aa, Homo Sapiens
VLDVLKPLE

SEQ ID NO: 402560 - protein, 9 aa, Homo Sapiens
LEDIATFFK

SEQ ID NO: 402561 - protein, 9 aa, Homo Sapiens
VANDAMLIL

SEQ ID NO: 402562 - protein, 9 aa, Homo Sapiens
ACLDPAQQN

SEQ ID NO: 402563 - protein, 9 aa, Homo Sapiens
SKFSVSGDE

SEQ ID NO: 402564 - protein, 9 aa, Homo Sapiens
LVTPKKLRS

SEQ ID NO: 402565 - protein, 9 aa, Homo Sapiens
PKLEKKDFA

SEQ ID NO: 402566 - protein, 9 aa, Homo Sapiens
EHAHKTVLL

SEQ ID NO: 402567 - protein, 9 aa, Homo Sapiens
DLLSASSRI

SEQ ID NO: 402568 - protein, 9 aa, Homo Sapiens
REGESCSFE

SEQ ID NO: 402569 - protein, 9 aa, Homo Sapiens
NPVYDPEHC

SEQ ID NO: 402570 - protein, 9 aa, Homo Sapiens
VKLDELELE

SEQ ID NO: 402571 - protein, 9 aa, Homo Sapiens
HTGEKQYEC

SEQ ID NO: 402572 - protein, 9 aa, Homo Sapiens
WFNNGNELN

SEQ ID NO: 402573 - protein, 9 aa, Homo Sapiens
FTGSFRIYP

SEQ ID NO: 402574 - protein, 9 aa, Homo Sapiens
LHGAEVTCK

SEQ ID NO: 402575 - protein, 9 aa, Homo Sapiens
EKLKCHIPP

SEQ ID NO: 402576 - protein, 9 aa, Homo Sapiens
NNSRFYNYT

SEQ ID NO: 402577 - protein, 9 aa, Homo Sapiens
TTVMTVADQ

SEQ ID NO: 402578 - protein, 9 aa, Homo Sapiens
GVYEKDVEL

SEQ ID NO: 402579 - protein, 9 aa, Homo Sapiens
KRLHTENRL

SEQ ID NO: 402580 - protein, 9 aa, Homo Sapiens
CDKWTDQDD

SEQ ID NO: 402581 - protein, 9 aa, Homo Sapiens
GHTYNPLGK

SEQ ID NO: 402582 - protein, 9 aa, Homo Sapiens
PTQKDIALL

SEQ ID NO: 402583 - protein, 9 aa, Homo Sapiens
TIKYHSWHI

SEQ ID NO: 402584 - protein, 9 aa, Homo Sapiens
HESEKLKCH

SEQ ID NO: 402585 - protein, 9 aa, Homo Sapiens
IVQKAQEHV

SEQ ID NO: 402586 - protein, 9 aa, Homo Sapiens
KHSDKSPPS

SEQ ID NO: 402587 - protein, 9 aa, Homo Sapiens
QPPEMAVQD

SEQ ID NO: 402588 - protein, 9 aa, Homo Sapiens
SAALEQLKL

SEQ ID NO: 402589 - protein, 9 aa, Homo Sapiens
WCRNEKKRH

SEQ ID NO: 402590 - protein, 9 aa, Homo Sapiens
YMSTLLAEG

SEQ ID NO: 402591 - protein, 9 aa, Homo Sapiens
KHQITHTRI

SEQ ID NO: 402592 - protein, 9 aa, Homo Sapiens
FGELCHGCS

SEQ ID NO: 402593 - protein, 9 aa, Homo Sapiens
LIEEGVLQH

SEQ ID NO: 402594 - protein, 9 aa, Homo Sapiens
VLQHLYNIK

SEQ ID NO: 402595 - protein, 9 aa, Homo Sapiens
ICTELQNLR

SEQ ID NO: 402596 - protein, 9 aa, Homo Sapiens
VLLYTMTKS

SEQ ID NO: 402597 - protein, 9 aa, Homo Sapiens
GMGGTRGII

SEQ ID NO: 402598 - protein, 9 aa, Homo Sapiens
NIVVVLEAI

SEQ ID NO: 402599 - protein, 9 aa, Homo Sapiens
ELTRHIQIH

SEQ ID NO: 402600 - protein, 9 aa, Homo Sapiens
SIDQCALIH

SEQ ID NO: 402601 - protein, 9 aa, Homo Sapiens
SQLLRLRGP

SEQ ID NO: 402602 - protein, 9 aa, Homo Sapiens
DLFPISQVR

SEQ ID NO: 402603 - protein, 9 aa, Homo Sapiens
SQGLKFGGV

SEQ ID NO: 402604 - protein, 9 aa, Homo Sapiens
YLSKQTASS

SEQ ID NO: 402605 - protein, 9 aa, Homo Sapiens
TFMLEKVTE

SEQ ID NO: 402606 - protein, 9 aa, Homo Sapiens
IIHAGEKFY

SEQ ID NO: 402607 - protein, 9 aa, Homo Sapiens
NFTRARLNA

SEQ ID NO: 402608 - protein, 9 aa, Homo Sapiens
LNYLSGDIT

SEQ ID NO: 402609 - protein, 9 aa, Homo Sapiens
LFKHYGKIN

SEQ ID NO: 402610 - protein, 9 aa, Homo Sapiens
IEKCLDPDM

SEQ ID NO: 402611 - protein, 9 aa, Homo Sapiens
HLICDPETL

SEQ ID NO: 402612 - protein, 9 aa, Homo Sapiens
HAQGLVLTV

SEQ ID NO: 402613 - protein, 9 aa, Homo Sapiens
KAKHESEKL

SEQ ID NO: 402614 - protein, 9 aa, Homo Sapiens
KNKQKIEED

SEQ ID NO: 402615 - protein, 9 aa, Homo Sapiens
SETRVQDLL

SEQ ID NO: 402616 - protein, 9 aa, Homo Sapiens
NGSAEIMNL

SEQ ID NO: 402617 - protein, 9 aa, Homo Sapiens
MMEKYEQIG

SEQ ID NO: 402618 - protein, 9 aa, Homo Sapiens
NFKVRLFVL

SEQ ID NO: 402619 - protein, 9 aa, Homo Sapiens
ISVKVLSKP

SEQ ID NO: 402620 - protein, 9 aa, Homo Sapiens
FKTQPLYVI

SEQ ID NO: 402621 - protein, 9 aa, Homo Sapiens
LGRYAHWVV

SEQ ID NO: 402622 - protein, 9 aa, Homo Sapiens
VYVESMDIF

SEQ ID NO: 402623 - protein, 9 aa, Homo Sapiens
NKLSHTKYL

SEQ ID NO: 402624 - protein, 9 aa, Homo Sapiens
MISATWPHS

SEQ ID NO: 402625 - protein, 9 aa, Homo Sapiens
VKAKKAQKV

SEQ ID NO: 402626 - protein, 9 aa, Homo Sapiens
RFGKHLCGG

SEQ ID NO: 402627 - protein, 9 aa, Homo Sapiens
LYLEELTLR

SEQ ID NO: 402628 - protein, 9 aa, Homo Sapiens
HYEDLDLDT

SEQ ID NO: 402629 - protein, 9 aa, Homo Sapiens
ILYVHRIIH

SEQ ID NO: 402630 - protein, 9 aa, Homo Sapiens
RGQAGAKKH

SEQ ID NO: 402631 - protein, 9 aa, Homo Sapiens
LWARVQAER

SEQ ID NO: 402632 - protein, 9 aa, Homo Sapiens
RVQAERTEK

SEQ ID NO: 402633 - protein, 9 aa, Homo Sapiens
QCALIHSIK

SEQ ID NO: 402634 - protein, 9 aa, Homo Sapiens
PPGWGMVSS

SEQ ID NO: 402635 - protein, 9 aa, Homo Sapiens
TRLAAELNT

SEQ ID NO: 402636 - protein, 9 aa, Homo Sapiens
WQCLDTAQN

SEQ ID NO: 402637 - protein, 9 aa, Homo Sapiens
GVMWKQHKA

SEQ ID NO: 402638 - protein, 9 aa, Homo Sapiens
SSTLKKHNI

SEQ ID NO: 402639 - protein, 9 aa, Homo Sapiens
VPQPWYFLI

SEQ ID NO: 402640 - protein, 9 aa, Homo Sapiens
GEKEYLDLR

SEQ ID NO: 402641 - protein, 9 aa, Homo Sapiens
YPRKKEIEL

SEQ ID NO: 402642 - protein, 9 aa, Homo Sapiens
RHHRLHTGD

SEQ ID NO: 402643 - protein, 9 aa, Homo Sapiens
YLDLRKEKE

SEQ ID NO: 402644 - protein, 9 aa, Homo Sapiens
INAKRHDGV

SEQ ID NO: 402645 - protein, 9 aa, Homo Sapiens
QKLGETDED

SEQ ID NO: 402646 - protein, 9 aa, Homo Sapiens
TIFGIRGNK

SEQ ID NO: 402647 - protein, 9 aa, Homo Sapiens
FCIFGVPKI

SEQ ID NO: 402648 - protein, 9 aa, Homo Sapiens
GNFFLLKRF

SEQ ID NO: 402649 - protein, 9 aa, Homo Sapiens
KKSLELSNL

SEQ ID NO: 402650 - protein, 9 aa, Homo Sapiens
TPISNYIML

SEQ ID NO: 402651 - protein, 9 aa, Homo Sapiens
LTSAHYPDA

SEQ ID NO: 402652 - protein, 9 aa, Homo Sapiens
WACLDPAQQ

SEQ ID NO: 402653 - protein, 9 aa, Homo Sapiens
CYFDYGILQ

SEQ ID NO: 402654 - protein, 9 aa, Homo Sapiens
QKLTHCPDT

SEQ ID NO: 402655 - protein, 9 aa, Homo Sapiens
LVAHLLSKY

SEQ ID NO: 402656 - protein, 9 aa, Homo Sapiens
TWRQLAESF

SEQ ID NO: 402657 - protein, 9 aa, Homo Sapiens
EATNLQVNY

SEQ ID NO: 402658 - protein, 9 aa, Homo Sapiens
VKEDDLLLQ

SEQ ID NO: 402659 - protein, 9 aa, Homo Sapiens
NRLYDAKVR

SEQ ID NO: 402660 - protein, 9 aa, Homo Sapiens
KSCGYSVQF

SEQ ID NO: 402661 - protein, 9 aa, Homo Sapiens
TFSGFGLIN

SEQ ID NO: 402662 - protein, 9 aa, Homo Sapiens
VDIFYYFWY

SEQ ID NO: 402663 - protein, 9 aa, Homo Sapiens
SDYDCDDEI

SEQ ID NO: 402664 - protein, 9 aa, Homo Sapiens
KEQNCEERN

SEQ ID NO: 402665 - protein, 9 aa, Homo Sapiens
VLLAALKKA

SEQ ID NO: 402666 - protein, 9 aa, Homo Sapiens
ACYTVCRFS

SEQ ID NO: 402667 - protein, 9 aa, Homo Sapiens
QVLRRMRIF

SEQ ID NO: 402668 - protein, 9 aa, Homo Sapiens
QNNSKTAVN

SEQ ID NO: 402669 - protein, 9 aa, Homo Sapiens
EKQYECKQC

SEQ ID NO: 402670 - protein, 9 aa, Homo Sapiens
RGIIYIKHP

SEQ ID NO: 402671 - protein, 9 aa, Homo Sapiens
IAEVEAQYE

SEQ ID NO: 402672 - protein, 9 aa, Homo Sapiens
KKVKKIIQL

SEQ ID NO: 402673 - protein, 9 aa, Homo Sapiens
GSDENNCVK

SEQ ID NO: 402674 - protein, 9 aa, Homo Sapiens
SRLQGQEEL

SEQ ID NO: 402675 - protein, 9 aa, Homo Sapiens
VVLTQTYQE

SEQ ID NO: 402676 - protein, 9 aa, Homo Sapiens
FFTESLWEA

SEQ ID NO: 402677 - protein, 9 aa, Homo Sapiens
VGEFTGSFR

SEQ ID NO: 402678 - protein, 9 aa, Homo Sapiens
RFKNWKRIT

SEQ ID NO: 402679 - protein, 9 aa, Homo Sapiens
RDVHHLVFP

SEQ ID NO: 402680 - protein, 9 aa, Homo Sapiens
VFIVVNIVD

SEQ ID NO: 402681 - protein, 9 aa, Homo Sapiens
GDPAYPALS

SEQ ID NO: 402682 - protein, 9 aa, Homo Sapiens
CQEGSSENS

SEQ ID NO: 402683 - protein, 9 aa, Homo Sapiens
RVCQVLFCL

SEQ ID NO: 402684 - protein, 9 aa, Homo Sapiens
LSQQQKCEE

SEQ ID NO: 402685 - protein, 9 aa, Homo Sapiens
LTLEPTPGQ

SEQ ID NO: 402686 - protein, 9 aa, Homo Sapiens
MTENRCVLK

SEQ ID NO: 402687 - protein, 9 aa, Homo Sapiens
KKLLSSDEL

SEQ ID NO: 402688 - protein, 9 aa, Homo Sapiens
HNIPLHTVR

SEQ ID NO: 402689 - protein, 9 aa, Homo Sapiens
EYQPFKIIS

SEQ ID NO: 402690 - protein, 9 aa, Homo Sapiens
NSNPEHFVL

SEQ ID NO: 402691 - protein, 9 aa, Homo Sapiens
LRHSRTGCT

SEQ ID NO: 402692 - protein, 9 aa, Homo Sapiens
QVDEKWGPK

SEQ ID NO: 402693 - protein, 9 aa, Homo Sapiens
NGRRAGSDL

SEQ ID NO: 402694 - protein, 9 aa, Homo Sapiens
RLKKKLLEQ

SEQ ID NO: 402695 - protein, 9 aa, Homo Sapiens
LYLVAYRVA

SEQ ID NO: 402696 - protein, 9 aa, Homo Sapiens
CGVGDDQLG

SEQ ID NO: 402697 - protein, 9 aa, Homo Sapiens
CMPSNKDEN

SEQ ID NO: 402698 - protein, 9 aa, Homo Sapiens
FKCNDIGHK

SEQ ID NO: 402699 - protein, 9 aa, Homo Sapiens
AEVEAQYEL

SEQ ID NO: 402700 - protein, 9 aa, Homo Sapiens
GYLELTGPP

SEQ ID NO: 402701 - protein, 9 aa, Homo Sapiens
SFVDICQAY

SEQ ID NO: 402702 - protein, 9 aa, Homo Sapiens
QLTFFFLIP

SEQ ID NO: 402703 - protein, 9 aa, Homo Sapiens
KEAKGSGYD

SEQ ID NO: 402704 - protein, 9 aa, Homo Sapiens
TNSQNKIKQ

SEQ ID NO: 402705 - protein, 9 aa, Homo Sapiens
KWAINISEA

SEQ ID NO: 402706 - protein, 9 aa, Homo Sapiens
IVTCLMIIY

SEQ ID NO: 402707 - protein, 9 aa, Homo Sapiens
ESRWRCADA

SEQ ID NO: 402708 - protein, 9 aa, Homo Sapiens
YSQNSSLHS

SEQ ID NO: 402709 - protein, 9 aa, Homo Sapiens
FFLIILGST

SEQ ID NO: 402710 - protein, 9 aa, Homo Sapiens
SFKLEMAQE

SEQ ID NO: 402711 - protein, 9 aa, Homo Sapiens
QFWYLLESK

SEQ ID NO: 402712 - protein, 9 aa, Homo Sapiens
QKEPLQASE

SEQ ID NO: 402713 - protein, 9 aa, Homo Sapiens
EAATQGASF

SEQ ID NO: 402714 - protein, 9 aa, Homo Sapiens
TLCIIDPRK

SEQ ID NO: 402715 - protein, 9 aa, Homo Sapiens
DPVMRKMLN

SEQ ID NO: 402716 - protein, 9 aa, Homo Sapiens
TCDKWTDQD

SEQ ID NO: 402717 - protein, 9 aa, Homo Sapiens
LNDLCKTTI

SEQ ID NO: 402718 - protein, 9 aa, Homo Sapiens
IDVTFFPFY

SEQ ID NO: 402719 - protein, 9 aa, Homo Sapiens
FPLTSAHYP

SEQ ID NO: 402720 - protein, 9 aa, Homo Sapiens
MEEEEEDDY

SEQ ID NO: 402721 - protein, 9 aa, Homo Sapiens
DSVQYHHLP

SEQ ID NO: 402722 - protein, 9 aa, Homo Sapiens
YSVQFESIL

SEQ ID NO: 402723 - protein, 9 aa, Homo Sapiens
NSSLEKLNL

SEQ ID NO: 402724 - protein, 9 aa, Homo Sapiens
YIYQWRPEY

SEQ ID NO: 402725 - protein, 9 aa, Homo Sapiens
YCDKVLQDC

SEQ ID NO: 402726 - protein, 9 aa, Homo Sapiens
KATNADKLL

SEQ ID NO: 402727 - protein, 9 aa, Homo Sapiens
FIVVNIVDS

SEQ ID NO: 402728 - protein, 9 aa, Homo Sapiens
KWNLPVVTI

SEQ ID NO: 402729 - protein, 9 aa, Homo Sapiens
PYILKIDSY

SEQ ID NO: 402730 - protein, 9 aa, Homo Sapiens
LREGKLLGT

SEQ ID NO: 402731 - protein, 9 aa, Homo Sapiens
QNLEILQIT

SEQ ID NO: 402732 - protein, 9 aa, Homo Sapiens
TVHKVIYTA

SEQ ID NO: 402733 - protein, 9 aa, Homo Sapiens
VDKPFKCDE

SEQ ID NO: 402734 - protein, 9 aa, Homo Sapiens
EAIGSRLEK

SEQ ID NO: 402735 - protein, 9 aa, Homo Sapiens
ESFKQTNVY

SEQ ID NO: 402736 - protein, 9 aa, Homo Sapiens
ESARVRIWE

SEQ ID NO: 402737 - protein, 9 aa, Homo Sapiens
FNQFTTFNK

SEQ ID NO: 402738 - protein, 9 aa, Homo Sapiens
GLAAFRALL

SEQ ID NO: 402739 - protein, 9 aa, Homo Sapiens
AIIEEQPKK

SEQ ID NO: 402740 - protein, 9 aa, Homo Sapiens
VRYLYTLDK

SEQ ID NO: 402741 - protein, 9 aa, Homo Sapiens
ADVDTTLKR

SEQ ID NO: 402742 - protein, 9 aa, Homo Sapiens
RPGLLGKQG

SEQ ID NO: 402743 - protein, 9 aa, Homo Sapiens
LEHKKIIEN

SEQ ID NO: 402744 - protein, 9 aa, Homo Sapiens
STCHLLQDT

SEQ ID NO: 402745 - protein, 9 aa, Homo Sapiens
EEYEVLKRD

SEQ ID NO: 402746 - protein, 9 aa, Homo Sapiens
IVKESTEVH

SEQ ID NO: 402747 - protein, 9 aa, Homo Sapiens
EETPEIIKQ

SEQ ID NO: 402748 - protein, 9 aa, Homo Sapiens
LNQHSRFIL

SEQ ID NO: 402749 - protein, 9 aa, Homo Sapiens
RKDVCAILN

SEQ ID NO: 402750 - protein, 9 aa, Homo Sapiens
IDNELEYDN

SEQ ID NO: 402751 - protein, 9 aa, Homo Sapiens
RSSKRTEHK

SEQ ID NO: 402752 - protein, 9 aa, Homo Sapiens
SMPELLNMF

SEQ ID NO: 402753 - protein, 9 aa, Homo Sapiens
SWSPRGVLR

SEQ ID NO: 402754 - protein, 9 aa, Homo Sapiens
NELEYDNFS

SEQ ID NO: 402755 - protein, 9 aa, Homo Sapiens
YLKNQESES

SEQ ID NO: 402756 - protein, 9 aa, Homo Sapiens
IQRSLSTPN

SEQ ID NO: 402757 - protein, 9 aa, Homo Sapiens
KQCQEGSSE

SEQ ID NO: 402758 - protein, 9 aa, Homo Sapiens
GGLVAHLLS

SEQ ID NO: 402759 - protein, 9 aa, Homo Sapiens
LMQSVLQFI

SEQ ID NO: 402760 - protein, 9 aa, Homo Sapiens
PWKEQLFES

SEQ ID NO: 402761 - protein, 9 aa, Homo Sapiens
ELESSQRLA

SEQ ID NO: 402762 - protein, 9 aa, Homo Sapiens
AQKLFSTLS

SEQ ID NO: 402763 - protein, 9 aa, Homo Sapiens
PKGFTRFWS

SEQ ID NO: 402764 - protein, 9 aa, Homo Sapiens
GGATAAAAP

SEQ ID NO: 402765 - protein, 9 aa, Homo Sapiens
RVLVKKWQE

SEQ ID NO: 402766 - protein, 9 aa, Homo Sapiens
YHDMMLENL

SEQ ID NO: 402767 - protein, 9 aa, Homo Sapiens
LDNGKRDVD

SEQ ID NO: 402768 - protein, 9 aa, Homo Sapiens
AGNGILNMS

SEQ ID NO: 402769 - protein, 9 aa, Homo Sapiens
AWFDQHQII

SEQ ID NO: 402770 - protein, 9 aa, Homo Sapiens
KAVKAIALC

SEQ ID NO: 402771 - protein, 9 aa, Homo Sapiens
SSPEQQNKL

SEQ ID NO: 402772 - protein, 9 aa, Homo Sapiens
LTGPPQKPP

SEQ ID NO: 402773 - protein, 9 aa, Homo Sapiens
SRNLEPHGQ

SEQ ID NO: 402774 - protein, 9 aa, Homo Sapiens
KYLICFFDS

SEQ ID NO: 402775 - protein, 9 aa, Homo Sapiens
GKHLCGGTL

SEQ ID NO: 402776 - protein, 9 aa, Homo Sapiens
KWELLSPKD

SEQ ID NO: 402777 - protein, 9 aa, Homo Sapiens
YPAVNSLDH

SEQ ID NO: 402778 - protein, 9 aa, Homo Sapiens
ICCSPPNEL

SEQ ID NO: 402779 - protein, 9 aa, Homo Sapiens
PSAVGRERH

SEQ ID NO: 402780 - protein, 9 aa, Homo Sapiens
CFSLLALYK

SEQ ID NO: 402781 - protein, 9 aa, Homo Sapiens
DDEDDNLED

SEQ ID NO: 402782 - protein, 9 aa, Homo Sapiens
QVVNYLTRN

SEQ ID NO: 402783 - protein, 9 aa, Homo Sapiens
MNKKDKQNR

SEQ ID NO: 402784 - protein, 9 aa, Homo Sapiens
AKRSLKSEM

SEQ ID NO: 402785 - protein, 9 aa, Homo Sapiens
QMCKWAINI

SEQ ID NO: 402786 - protein, 9 aa, Homo Sapiens
AMLAKGYKG

SEQ ID NO: 402787 - protein, 9 aa, Homo Sapiens
VSAEIAQEN

SEQ ID NO: 402788 - protein, 9 aa, Homo Sapiens
CEECGKAVS

SEQ ID NO: 402789 - protein, 9 aa, Homo Sapiens
YHVMWHSEF

SEQ ID NO: 402790 - protein, 9 aa, Homo Sapiens
YTGIIFLEV

SEQ ID NO: 402791 - protein, 9 aa, Homo Sapiens
CTLKLSYVS

SEQ ID NO: 402792 - protein, 9 aa, Homo Sapiens
TVHQLTHTG

SEQ ID NO: 402793 - protein, 9 aa, Homo Sapiens
SHDGTNSPP

SEQ ID NO: 402794 - protein, 9 aa, Homo Sapiens
GVLQHLYNI

SEQ ID NO: 402795 - protein, 9 aa, Homo Sapiens
TIRGYFCIE

SEQ ID NO: 402796 - protein, 9 aa, Homo Sapiens
DFCADYRGV

SEQ ID NO: 402797 - protein, 9 aa, Homo Sapiens
FMRFQMNEE

SEQ ID NO: 402798 - protein, 9 aa, Homo Sapiens
TEPRENGIH

SEQ ID NO: 402799 - protein, 9 aa, Homo Sapiens
SPRSQKEPL

SEQ ID NO: 402800 - protein, 9 aa, Homo Sapiens
WGPRLDPAD

SEQ ID NO: 402801 - protein, 9 aa, Homo Sapiens
ILGLLVPGV

SEQ ID NO: 402802 - protein, 9 aa, Homo Sapiens
DPVYPSLVQ

SEQ ID NO: 402803 - protein, 9 aa, Homo Sapiens
SSRQGAGYS

SEQ ID NO: 402804 - protein, 9 aa, Homo Sapiens
RFHLLELDK

SEQ ID NO: 402805 - protein, 9 aa, Homo Sapiens
ASDFTLWKA

SEQ ID NO: 402806 - protein, 9 aa, Homo Sapiens
YNINYEDNR

SEQ ID NO: 402807 - protein, 9 aa, Homo Sapiens
KVNLFRMVI

SEQ ID NO: 402808 - protein, 9 aa, Homo Sapiens
PGKGGHLRF

SEQ ID NO: 402809 - protein, 9 aa, Homo Sapiens
RLRSRLFIK

SEQ ID NO: 402810 - protein, 9 aa, Homo Sapiens
KEYFNQTLT

SEQ ID NO: 402811 - protein, 9 aa, Homo Sapiens
YCHKNNFLH

SEQ ID NO: 402812 - protein, 9 aa, Homo Sapiens
IKHFPKHAA

SEQ ID NO: 402813 - protein, 9 aa, Homo Sapiens
VPCGKISFA

SEQ ID NO: 402814 - protein, 9 aa, Homo Sapiens
NLQAPMYFL

SEQ ID NO: 402815 - protein, 9 aa, Homo Sapiens
YCLSWGTEN

SEQ ID NO: 402816 - protein, 9 aa, Homo Sapiens
DQAPPEDEG

SEQ ID NO: 402817 - protein, 9 aa, Homo Sapiens
NKTNTVFKV

SEQ ID NO: 402818 - protein, 9 aa, Homo Sapiens
NVRSAFTTY

SEQ ID NO: 402819 - protein, 9 aa, Homo Sapiens
YIKGDFNLT

SEQ ID NO: 402820 - protein, 9 aa, Homo Sapiens
SSSTSSLTL

SEQ ID NO: 402821 - protein, 9 aa, Homo Sapiens
QFVKQIGYM

SEQ ID NO: 402822 - protein, 9 aa, Homo Sapiens
LKNKQARCQ

SEQ ID NO: 402823 - protein, 9 aa, Homo Sapiens
CFEWGAFNP

SEQ ID NO: 402824 - protein, 9 aa, Homo Sapiens
ATRLNIFKL

SEQ ID NO: 402825 - protein, 9 aa, Homo Sapiens
GSLWERLVY

SEQ ID NO: 402826 - protein, 9 aa, Homo Sapiens
QRDYSLPFY

SEQ ID NO: 402827 - protein, 9 aa, Homo Sapiens
FYVHILSAI

SEQ ID NO: 402828 - protein, 9 aa, Homo Sapiens
PYTDVCRRY

SEQ ID NO: 402829 - protein, 9 aa, Homo Sapiens
LDDGSNYFA

SEQ ID NO: 402830 - protein, 9 aa, Homo Sapiens
LNQTYNTVT

SEQ ID NO: 402831 - protein, 9 aa, Homo Sapiens
ATWRVYLRL

SEQ ID NO: 402832 - protein, 9 aa, Homo Sapiens
VFFLIILGS

SEQ ID NO: 402833 - protein, 9 aa, Homo Sapiens
LEQYQWDGN

SEQ ID NO: 402834 - protein, 9 aa, Homo Sapiens
IIASILRIC

SEQ ID NO: 402835 - protein, 9 aa, Homo Sapiens
LIKHFQKYH

SEQ ID NO: 402836 - protein, 9 aa, Homo Sapiens
ADSTVRVWL

SEQ ID NO: 402837 - protein, 9 aa, Homo Sapiens
RVLDVDYRN

SEQ ID NO: 402838 - protein, 9 aa, Homo Sapiens
FHTSGENEK

SEQ ID NO: 402839 - protein, 9 aa, Homo Sapiens
KTISESYSC

SEQ ID NO: 402840 - protein, 9 aa, Homo Sapiens
TTGEALYKI

SEQ ID NO: 402841 - protein, 9 aa, Homo Sapiens
QKLCKSVFS

SEQ ID NO: 402842 - protein, 9 aa, Homo Sapiens
QEQIPIHKF

SEQ ID NO: 402843 - protein, 9 aa, Homo Sapiens
HPQHSDKGN

SEQ ID NO: 402844 - protein, 9 aa, Homo Sapiens
PEADSAGAG

SEQ ID NO: 402845 - protein, 9 aa, Homo Sapiens
STLSQPAGE

SEQ ID NO: 402846 - protein, 9 aa, Homo Sapiens
KDKPDSVDG

SEQ ID NO: 402847 - protein, 9 aa, Homo Sapiens
HQNHQESIK

SEQ ID NO: 402848 - protein, 9 aa, Homo Sapiens
TLLANDPTY

SEQ ID NO: 402849 - protein, 9 aa, Homo Sapiens
IDHYQITFT

SEQ ID NO: 402850 - protein, 9 aa, Homo Sapiens
TEYSLRLLA

SEQ ID NO: 402851 - protein, 9 aa, Homo Sapiens
ETPAAKVSE

SEQ ID NO: 402852 - protein, 9 aa, Homo Sapiens
QLMQNFYHQ

SEQ ID NO: 402853 - protein, 9 aa, Homo Sapiens
AFYEVKIRD

SEQ ID NO: 402854 - protein, 9 aa, Homo Sapiens
TNVYSMALV

SEQ ID NO: 402855 - protein, 9 aa, Homo Sapiens
KQSQLLRLR

SEQ ID NO: 402856 - protein, 9 aa, Homo Sapiens
LVLFAHELH

SEQ ID NO: 402857 - protein, 9 aa, Homo Sapiens
AGLWLSGLG

SEQ ID NO: 402858 - protein, 9 aa, Homo Sapiens
LSHTKYLKN

SEQ ID NO: 402859 - protein, 9 aa, Homo Sapiens
SSKERGGVL

SEQ ID NO: 402860 - protein, 9 aa, Homo Sapiens
DMNKKDKQN

SEQ ID NO: 402861 - protein, 9 aa, Homo Sapiens
FQQVLKIYL

SEQ ID NO: 402862 - protein, 9 aa, Homo Sapiens
NKTVDKGKR

SEQ ID NO: 402863 - protein, 9 aa, Homo Sapiens
EKSNKFQML

SEQ ID NO: 402864 - protein, 9 aa, Homo Sapiens
VSSLQGIQL

SEQ ID NO: 402865 - protein, 9 aa, Homo Sapiens
LYVHRIIHT

SEQ ID NO: 402866 - protein, 9 aa, Homo Sapiens
SNFKVRLFV

SEQ ID NO: 402867 - protein, 9 aa, Homo Sapiens
GDGEVTVAE

SEQ ID NO: 402868 - protein, 9 aa, Homo Sapiens
FDPEDTSQN

SEQ ID NO: 402869 - protein, 9 aa, Homo Sapiens
MKENKSSIS

SEQ ID NO: 402870 - protein, 9 aa, Homo Sapiens
TSSAQRLKC

SEQ ID NO: 402871 - protein, 9 aa, Homo Sapiens
AFYRSSKRT

SEQ ID NO: 402872 - protein, 9 aa, Homo Sapiens
FSSGGATAA

SEQ ID NO: 402873 - protein, 9 aa, Homo Sapiens
KHLFQQPPE

SEQ ID NO: 402874 - protein, 9 aa, Homo Sapiens
LQEIKKSIK

SEQ ID NO: 402875 - protein, 9 aa, Homo Sapiens
TVELPEADS

SEQ ID NO: 402876 - protein, 9 aa, Homo Sapiens
KAESWMREK

SEQ ID NO: 402877 - protein, 9 aa, Homo Sapiens
KSTNNERKS

SEQ ID NO: 402878 - protein, 9 aa, Homo Sapiens
ALGLFTSSF

SEQ ID NO: 402879 - protein, 9 aa, Homo Sapiens
CVLEALNNY

SEQ ID NO: 402880 - protein, 9 aa, Homo Sapiens
WFDQHQIIH

SEQ ID NO: 402881 - protein, 9 aa, Homo Sapiens
ADSVQYHHL

SEQ ID NO: 402882 - protein, 9 aa, Homo Sapiens
LIVEIIQCR

SEQ ID NO: 402883 - protein, 9 aa, Homo Sapiens
PAHTCPRGV

SEQ ID NO: 402884 - protein, 9 aa, Homo Sapiens
HLYLHSPAP

SEQ ID NO: 402885 - protein, 9 aa, Homo Sapiens
NSPNRIMEE

SEQ ID NO: 402886 - protein, 9 aa, Homo Sapiens
NPIFPQALY

SEQ ID NO: 402887 - protein, 9 aa, Homo Sapiens
RKRQQNTKL

SEQ ID NO: 402888 - protein, 9 aa, Homo Sapiens
LYHGHQAAL

SEQ ID NO: 402889 - protein, 9 aa, Homo Sapiens
QLDTDECHC

SEQ ID NO: 402890 - protein, 9 aa, Homo Sapiens
STEVHGTIQ

SEQ ID NO: 402891 - protein, 9 aa, Homo Sapiens
PQHSDKGNE

SEQ ID NO: 402892 - protein, 9 aa, Homo Sapiens
SFRYHEITH

SEQ ID NO: 402893 - protein, 9 aa, Homo Sapiens
VIFIIILSY

SEQ ID NO: 402894 - protein, 9 aa, Homo Sapiens
ENQMVFSEQ

SEQ ID NO: 402895 - protein, 9 aa, Homo Sapiens
NSMNWRQLC

SEQ ID NO: 402896 - protein, 9 aa, Homo Sapiens
QAEKHFQYQ

SEQ ID NO: 402897 - protein, 9 aa, Homo Sapiens
QQPPEMAVQ

SEQ ID NO: 402898 - protein, 9 aa, Homo Sapiens
QPWYFLIMP

SEQ ID NO: 402899 - protein, 9 aa, Homo Sapiens
ALKDLKKTN

SEQ ID NO: 402900 - protein, 9 aa, Homo Sapiens
TEQSGIYSC

SEQ ID NO: 402901 - protein, 9 aa, Homo Sapiens
SSTKHWAAM

SEQ ID NO: 402902 - protein, 9 aa, Homo Sapiens
REAMQNYLK

SEQ ID NO: 402903 - protein, 9 aa, Homo Sapiens
EETPRNILR

SEQ ID NO: 402904 - protein, 9 aa, Homo Sapiens
EKKHDKYWV

SEQ ID NO: 402905 - protein, 9 aa, Homo Sapiens
DCQYVSWRR

SEQ ID NO: 402906 - protein, 9 aa, Homo Sapiens
NNNNFHKST

SEQ ID NO: 402907 - protein, 9 aa, Homo Sapiens
QNKQVDENY

SEQ ID NO: 402908 - protein, 9 aa, Homo Sapiens
LDELELENQ

SEQ ID NO: 402909 - protein, 9 aa, Homo Sapiens
EEPKKIKKT

SEQ ID NO: 402910 - protein, 9 aa, Homo Sapiens
LGSWNPIYQ

SEQ ID NO: 402911 - protein, 9 aa, Homo Sapiens
YLYIFNWNH

SEQ ID NO: 402912 - protein, 9 aa, Homo Sapiens
CTEHSDQRV

SEQ ID NO: 402913 - protein, 9 aa, Homo Sapiens
EVCLQSNCT

SEQ ID NO: 402914 - protein, 9 aa, Homo Sapiens
NTSRKEYFN

SEQ ID NO: 402915 - protein, 9 aa, Homo Sapiens
VTRVKQCCC

SEQ ID NO: 402916 - protein, 9 aa, Homo Sapiens
VLCIGNKNN

SEQ ID NO: 402917 - protein, 9 aa, Homo Sapiens
ITVELKSEP

SEQ ID NO: 402918 - protein, 9 aa, Homo Sapiens
SRWRCADAR

SEQ ID NO: 402919 - protein, 9 aa, Homo Sapiens
TYVSLIYDA

SEQ ID NO: 402920 - protein, 9 aa, Homo Sapiens
STKARHIQR

SEQ ID NO: 402921 - protein, 9 aa, Homo Sapiens
INKPGNMSM

SEQ ID NO: 402922 - protein, 9 aa, Homo Sapiens
LGENLSGIY

SEQ ID NO: 402923 - protein, 9 aa, Homo Sapiens
YNPGLNAKL

SEQ ID NO: 402924 - protein, 9 aa, Homo Sapiens
NLTNQRKYI

SEQ ID NO: 402925 - protein, 9 aa, Homo Sapiens
SSKDLSISQ

SEQ ID NO: 402926 - protein, 9 aa, Homo Sapiens
CSAQVVNYL

SEQ ID NO: 402927 - protein, 9 aa, Homo Sapiens
VSYLYIFNW

SEQ ID NO: 402928 - protein, 9 aa, Homo Sapiens
IQEQQNVLK

SEQ ID NO: 402929 - protein, 9 aa, Homo Sapiens
ILVVMSWLI

SEQ ID NO: 402930 - protein, 9 aa, Homo Sapiens
YIVTSLLEY

SEQ ID NO: 402931 - protein, 9 aa, Homo Sapiens
LNAKSICCC

SEQ ID NO: 402932 - protein, 9 aa, Homo Sapiens
ADPEELFTT

SEQ ID NO: 402933 - protein, 9 aa, Homo Sapiens
KPYPNKPPN

SEQ ID NO: 402934 - protein, 9 aa, Homo Sapiens
TCMQYVHTH

SEQ ID NO: 402935 - protein, 9 aa, Homo Sapiens
VGESYRYPP

SEQ ID NO: 402936 - protein, 9 aa, Homo Sapiens
KKLLEQESL

SEQ ID NO: 402937 - protein, 9 aa, Homo Sapiens
ETPPSPLQE

SEQ ID NO: 402938 - protein, 9 aa, Homo Sapiens
STQKILLVQ

SEQ ID NO: 402939 - protein, 9 aa, Homo Sapiens
QSQAILQQA

SEQ ID NO: 402940 - protein, 9 aa, Homo Sapiens
GGRESYMST

SEQ ID NO: 402941 - protein, 9 aa, Homo Sapiens
REWLGLINN

SEQ ID NO: 402942 - protein, 9 aa, Homo Sapiens
AAKKWNLPV

SEQ ID NO: 402943 - protein, 9 aa, Homo Sapiens
LDKVCQPLY

SEQ ID NO: 402944 - protein, 9 aa, Homo Sapiens
LQSGFYDLL

SEQ ID NO: 402945 - protein, 9 aa, Homo Sapiens
EVPYSELDN

SEQ ID NO: 402946 - protein, 9 aa, Homo Sapiens
NQFLRFNPV

SEQ ID NO: 402947 - protein, 9 aa, Homo Sapiens
RSRSPKIRS

SEQ ID NO: 402948 - protein, 9 aa, Homo Sapiens
GKKTTLANE

SEQ ID NO: 402949 - protein, 9 aa, Homo Sapiens
NVDMLKYQA

SEQ ID NO: 402950 - protein, 9 aa, Homo Sapiens
NKYLPGLLQ

SEQ ID NO: 402951 - protein, 9 aa, Homo Sapiens
NNSKTAVNS

SEQ ID NO: 402952 - protein, 9 aa, Homo Sapiens
ELDNGKRDV

SEQ ID NO: 402953 - protein, 9 aa, Homo Sapiens
EELDKAFNE

SEQ ID NO: 402954 - protein, 9 aa, Homo Sapiens
ARRLQIRYG

SEQ ID NO: 402955 - protein, 9 aa, Homo Sapiens
RYRHPSALQ

SEQ ID NO: 402956 - protein, 9 aa, Homo Sapiens
DLSQEHLTN

SEQ ID NO: 402957 - protein, 9 aa, Homo Sapiens
NGHHIGTLS

SEQ ID NO: 402958 - protein, 9 aa, Homo Sapiens
HTSGENEKG

SEQ ID NO: 402959 - protein, 9 aa, Homo Sapiens
VEELDIQEK

SEQ ID NO: 402960 - protein, 9 aa, Homo Sapiens
RHRGYSKAF

SEQ ID NO: 402961 - protein, 9 aa, Homo Sapiens
DTLVTQKVR

SEQ ID NO: 402962 - protein, 9 aa, Homo Sapiens
PVFFIIFAK

SEQ ID NO: 402963 - protein, 9 aa, Homo Sapiens
KPPMDDKSL

SEQ ID NO: 402964 - protein, 9 aa, Homo Sapiens
FTTLEKIGK

SEQ ID NO: 402965 - protein, 9 aa, Homo Sapiens
CKYIYHVMW

SEQ ID NO: 402966 - protein, 9 aa, Homo Sapiens
QLSNCRNHI

SEQ ID NO: 402967 - protein, 9 aa, Homo Sapiens
AEGQEQIPI

SEQ ID NO: 402968 - protein, 9 aa, Homo Sapiens
RCLYHDMML

SEQ ID NO: 402969 - protein, 9 aa, Homo Sapiens
GWEIGYLNR

SEQ ID NO: 402970 - protein, 9 aa, Homo Sapiens
DKPFKCDEC

SEQ ID NO: 402971 - protein, 9 aa, Homo Sapiens
LRVLVKKWQ

SEQ ID NO: 402972 - protein, 9 aa, Homo Sapiens
PQRHNYLHR

SEQ ID NO: 402973 - protein, 9 aa, Homo Sapiens
ENYLISTKE

SEQ ID NO: 402974 - protein, 9 aa, Homo Sapiens
HVQRQLPGS

SEQ ID NO: 402975 - protein, 9 aa, Homo Sapiens
AHKTVLLFE

SEQ ID NO: 402976 - protein, 9 aa, Homo Sapiens
LFLIRNRRT

SEQ ID NO: 402977 - protein, 9 aa, Homo Sapiens
NISLEELRR

SEQ ID NO: 402978 - protein, 9 aa, Homo Sapiens
ILWWLTKKH

SEQ ID NO: 402979 - protein, 9 aa, Homo Sapiens
GETDEDKLF

SEQ ID NO: 402980 - protein, 9 aa, Homo Sapiens
RIRKKYLLM

SEQ ID NO: 402981 - protein, 9 aa, Homo Sapiens
EIKRLHTEN

SEQ ID NO: 402982 - protein, 9 aa, Homo Sapiens
FFGKSQLLM

SEQ ID NO: 402983 - protein, 9 aa, Homo Sapiens
VLQFIQEHS

SEQ ID NO: 402984 - protein, 9 aa, Homo Sapiens
GSPPHSTTG

SEQ ID NO: 402985 - protein, 9 aa, Homo Sapiens
IHEITHTGE

SEQ ID NO: 402986 - protein, 9 aa, Homo Sapiens
QVNYPAVNS

SEQ ID NO: 402987 - protein, 9 aa, Homo Sapiens
CIKTLFGVL

SEQ ID NO: 402988 - protein, 9 aa, Homo Sapiens
LLNAKHSDK

SEQ ID NO: 402989 - protein, 9 aa, Homo Sapiens
KELEAIGSR

SEQ ID NO: 402990 - protein, 9 aa, Homo Sapiens
PPPPPCPSY

SEQ ID NO: 402991 - protein, 9 aa, Homo Sapiens
KRRESQKVK

SEQ ID NO: 402992 - protein, 9 aa, Homo Sapiens
TRHIQIHTG

SEQ ID NO: 402993 - protein, 9 aa, Homo Sapiens
DFRNKSEEM

SEQ ID NO: 402994 - protein, 9 aa, Homo Sapiens
FLEPTQKDI

SEQ ID NO: 402995 - protein, 9 aa, Homo Sapiens
ALGITLTPQ

SEQ ID NO: 402996 - protein, 9 aa, Homo Sapiens
SKVQEDVFI

SEQ ID NO: 402997 - protein, 9 aa, Homo Sapiens
DYEKLKSEG

SEQ ID NO: 402998 - protein, 9 aa, Homo Sapiens
LNLGDCDLG

SEQ ID NO: 402999 - protein, 9 aa, Homo Sapiens
TLKRLHKAQ

SEQ ID NO: 403000 - protein, 9 aa, Homo Sapiens
DKITCTKRV

SEQ ID NO: 403001 - protein, 9 aa, Homo Sapiens
FLICSLAIS

SEQ ID NO: 403002 - protein, 9 aa, Homo Sapiens
NAERSYKSH

SEQ ID NO: 403003 - protein, 9 aa, Homo Sapiens
LMRASGPVT

SEQ ID NO: 403004 - protein, 9 aa, Homo Sapiens
QLNYLSGDI

SEQ ID NO: 403005 - protein, 9 aa, Homo Sapiens
ERKHYIQED

SEQ ID NO: 403006 - protein, 9 aa, Homo Sapiens
KVSLYCDKV

SEQ ID NO: 403007 - protein, 9 aa, Homo Sapiens
EEKHIKAEK

SEQ ID NO: 403008 - protein, 9 aa, Homo Sapiens
AIKICCSPP

SEQ ID NO: 403009 - protein, 9 aa, Homo Sapiens
CPPAHTCPR

SEQ ID NO: 403010 - protein, 9 aa, Homo Sapiens
QIRNKNREL

SEQ ID NO: 403011 - protein, 9 aa, Homo Sapiens
LLDNNEATD

SEQ ID NO: 403012 - protein, 9 aa, Homo Sapiens
SMADVKLSF

SEQ ID NO: 403013 - protein, 9 aa, Homo Sapiens
LLLDDSPSC

SEQ ID NO: 403014 - protein, 9 aa, Homo Sapiens
CYALCSLSQ

SEQ ID NO: 403015 - protein, 9 aa, Homo Sapiens
HMKKTFQLI

SEQ ID NO: 403016 - protein, 9 aa, Homo Sapiens
YGLAAFRAL

SEQ ID NO: 403017 - protein, 9 aa, Homo Sapiens
IFYMIDGQG

SEQ ID NO: 403018 - protein, 9 aa, Homo Sapiens
RNIMLLKNK

SEQ ID NO: 403019 - protein, 9 aa, Homo Sapiens
KLVRDILKV

SEQ ID NO: 403020 - protein, 9 aa, Homo Sapiens
NYQIEEEEK

SEQ ID NO: 403021 - protein, 9 aa, Homo Sapiens
IYHVMWHSE

SEQ ID NO: 403022 - protein, 9 aa, Homo Sapiens
CREEEQLLQ

SEQ ID NO: 403023 - protein, 9 aa, Homo Sapiens
RSSCLSSWA

SEQ ID NO: 403024 - protein, 9 aa, Homo Sapiens
NLQVNYPAV

SEQ ID NO: 403025 - protein, 9 aa, Homo Sapiens
YVQALVRFS

SEQ ID NO: 403026 - protein, 9 aa, Homo Sapiens
LVRFSLLTA

SEQ ID NO: 403027 - protein, 9 aa, Homo Sapiens
LRMVWVAWL

SEQ ID NO: 403028 - protein, 9 aa, Homo Sapiens
TCKMLQLER

SEQ ID NO: 403029 - protein, 9 aa, Homo Sapiens
PPEMAVQDV

SEQ ID NO: 403030 - protein, 9 aa, Homo Sapiens
WRPAGLWLS

SEQ ID NO: 403031 - protein, 9 aa, Homo Sapiens
LQMKTELLV

SEQ ID NO: 403032 - protein, 9 aa, Homo Sapiens
HELTELTAT

SEQ ID NO: 403033 - protein, 9 aa, Homo Sapiens
ISVSKAAAV

SEQ ID NO: 403034 - protein, 9 aa, Homo Sapiens
EDGSEEAII

SEQ ID NO: 403035 - protein, 9 aa, Homo Sapiens
LMPITWIKP

SEQ ID NO: 403036 - protein, 9 aa, Homo Sapiens
GFKMPKDKG

SEQ ID NO: 403037 - protein, 9 aa, Homo Sapiens
FLVAFESQN

SEQ ID NO: 403038 - protein, 9 aa, Homo Sapiens
TIQDSQTFS

SEQ ID NO: 403039 - protein, 9 aa, Homo Sapiens
EECGKAVSI

SEQ ID NO: 403040 - protein, 9 aa, Homo Sapiens
FLDIYLPIS

SEQ ID NO: 403041 - protein, 9 aa, Homo Sapiens
VPVFPGQQL

SEQ ID NO: 403042 - protein, 9 aa, Homo Sapiens
IYTAEKPCK

SEQ ID NO: 403043 - protein, 9 aa, Homo Sapiens
EKLKSEGHE

SEQ ID NO: 403044 - protein, 9 aa, Homo Sapiens
TPPVCCSSQ

SEQ ID NO: 403045 - protein, 9 aa, Homo Sapiens
MFSSRQGAG

SEQ ID NO: 403046 - protein, 9 aa, Homo Sapiens
SDSDSGQDS

SEQ ID NO: 403047 - protein, 9 aa, Homo Sapiens
LSLKDLSPE

SEQ ID NO: 403048 - protein, 9 aa, Homo Sapiens
LQLLMGNLR

SEQ ID NO: 403049 - protein, 9 aa, Homo Sapiens
VSFASNQQD

SEQ ID NO: 403050 - protein, 9 aa, Homo Sapiens
RTWINDLIS

SEQ ID NO: 403051 - protein, 9 aa, Homo Sapiens
LWWLTKKHT

SEQ ID NO: 403052 - protein, 9 aa, Homo Sapiens
SGGATAAAA

SEQ ID NO: 403053 - protein, 9 aa, Homo Sapiens
SNKTNTVFK

SEQ ID NO: 403054 - protein, 9 aa, Homo Sapiens
LICKKRHRG

SEQ ID NO: 403055 - protein, 9 aa, Homo Sapiens
LEISLWGVK

SEQ ID NO: 403056 - protein, 9 aa, Homo Sapiens
EEFFYGEQG

SEQ ID NO: 403057 - protein, 9 aa, Homo Sapiens
QSVVPRDTP

SEQ ID NO: 403058 - protein, 9 aa, Homo Sapiens
LLLHPFKYL

SEQ ID NO: 403059 - protein, 9 aa, Homo Sapiens
LYWRASSFR

SEQ ID NO: 403060 - protein, 9 aa, Homo Sapiens
APLSKVWLV

SEQ ID NO: 403061 - protein, 9 aa, Homo Sapiens
HQYYLQLQK

SEQ ID NO: 403062 - protein, 9 aa, Homo Sapiens
ETTYQRDYS

SEQ ID NO: 403063 - protein, 9 aa, Homo Sapiens
GVCFIADHM

SEQ ID NO: 403064 - protein, 9 aa, Homo Sapiens
SAQESQSQA

SEQ ID NO: 403065 - protein, 9 aa, Homo Sapiens
LTSHKIIHT

SEQ ID NO: 403066 - protein, 9 aa, Homo Sapiens
GPFQLWEPN

SEQ ID NO: 403067 - protein, 9 aa, Homo Sapiens
LQTPSLGQF

SEQ ID NO: 403068 - protein, 9 aa, Homo Sapiens
YIIQEGAVG

SEQ ID NO: 403069 - protein, 9 aa, Homo Sapiens
SNPHSGAIN

SEQ ID NO: 403070 - protein, 9 aa, Homo Sapiens
FTSSFPDQE

SEQ ID NO: 403071 - protein, 9 aa, Homo Sapiens
LSHNSIYQE

SEQ ID NO: 403072 - protein, 9 aa, Homo Sapiens
APESISDKE

SEQ ID NO: 403073 - protein, 9 aa, Homo Sapiens
GQMFKYILN

SEQ ID NO: 403074 - protein, 9 aa, Homo Sapiens
PYVFTRHVH

SEQ ID NO: 403075 - protein, 9 aa, Homo Sapiens
AHKAEAEEP

SEQ ID NO: 403076 - protein, 9 aa, Homo Sapiens
MPELLNMFR

SEQ ID NO: 403077 - protein, 9 aa, Homo Sapiens
SNPFRYIME

SEQ ID NO: 403078 - protein, 9 aa, Homo Sapiens
NLAAPSGQR

SEQ ID NO: 403079 - protein, 9 aa, Homo Sapiens
SLEKNPNAF

SEQ ID NO: 403080 - protein, 9 aa, Homo Sapiens
PLSLHQITH

SEQ ID NO: 403081 - protein, 9 aa, Homo Sapiens
DIKKSLELS

SEQ ID NO: 403082 - protein, 9 aa, Homo Sapiens
SVISTVTTY

SEQ ID NO: 403083 - protein, 9 aa, Homo Sapiens
GVCCTGTEL

SEQ ID NO: 403084 - protein, 9 aa, Homo Sapiens
RNHDLPATE

SEQ ID NO: 403085 - protein, 9 aa, Homo Sapiens
ITIINKLFF

SEQ ID NO: 403086 - protein, 9 aa, Homo Sapiens
VLNEQWIRA

SEQ ID NO: 403087 - protein, 9 aa, Homo Sapiens
AALEQLKLL

SEQ ID NO: 403088 - protein, 9 aa, Homo Sapiens
IEELNNCIR

SEQ ID NO: 403089 - protein, 9 aa, Homo Sapiens
AAFEEAVQR

SEQ ID NO: 403090 - protein, 9 aa, Homo Sapiens
SCDLEISLW

SEQ ID NO: 403091 - protein, 9 aa, Homo Sapiens
RVLCIGNKN

SEQ ID NO: 403092 - protein, 9 aa, Homo Sapiens
CRHLKLTDK

SEQ ID NO: 403093 - protein, 9 aa, Homo Sapiens
KPLGVMWKQ

SEQ ID NO: 403094 - protein, 9 aa, Homo Sapiens
KKKLLEQES

SEQ ID NO: 403095 - protein, 9 aa, Homo Sapiens
ALAESADLG

SEQ ID NO: 403096 - protein, 9 aa, Homo Sapiens
LPKAKRSLK

SEQ ID NO: 403097 - protein, 9 aa, Homo Sapiens
ASLSDVCRI

SEQ ID NO: 403098 - protein, 9 aa, Homo Sapiens
GYPITCTLD

SEQ ID NO: 403099 - protein, 9 aa, Homo Sapiens
VLCRKLQCG

SEQ ID NO: 403100 - protein, 9 aa, Homo Sapiens
YCGVGDDQL

SEQ ID NO: 403101 - protein, 9 aa, Homo Sapiens
DCGGPFQLW

SEQ ID NO: 403102 - protein, 9 aa, Homo Sapiens
LHTLFLSPA

SEQ ID NO: 403103 - protein, 9 aa, Homo Sapiens
QVTNSNPEH

SEQ ID NO: 403104 - protein, 9 aa, Homo Sapiens
EFKKLICNR

SEQ ID NO: 403105 - protein, 9 aa, Homo Sapiens
YFNNCLNPP

SEQ ID NO: 403106 - protein, 9 aa, Homo Sapiens
DTTTKIAAT

SEQ ID NO: 403107 - protein, 9 aa, Homo Sapiens
HGQQPSLRA

SEQ ID NO: 403108 - protein, 9 aa, Homo Sapiens
ILKIIHLSD

SEQ ID NO: 403109 - protein, 9 aa, Homo Sapiens
DVDTTLKRL

SEQ ID NO: 403110 - protein, 9 aa, Homo Sapiens
LPQRHNYLH

SEQ ID NO: 403111 - protein, 9 aa, Homo Sapiens
PELPQRHNY

SEQ ID NO: 403112 - protein, 9 aa, Homo Sapiens
IYQWRPEYR

SEQ ID NO: 403113 - protein, 9 aa, Homo Sapiens
DHPNFTRAR

SEQ ID NO: 403114 - protein, 9 aa, Homo Sapiens
YMKGLPKLE

SEQ ID NO: 403115 - protein, 9 aa, Homo Sapiens
IVVLKKIKH

SEQ ID NO: 403116 - protein, 9 aa, Homo Sapiens
EGYSLDNWV

SEQ ID NO: 403117 - protein, 9 aa, Homo Sapiens
LRICSTEGR

SEQ ID NO: 403118 - protein, 9 aa, Homo Sapiens
TQKDIALLK

SEQ ID NO: 403119 - protein, 9 aa, Homo Sapiens
SIYERVLDV

SEQ ID NO: 403120 - protein, 9 aa, Homo Sapiens
DLFIVLILV

SEQ ID NO: 403121 - protein, 9 aa, Homo Sapiens
DNFLQQFFM

SEQ ID NO: 403122 - protein, 9 aa, Homo Sapiens
NESVAGIIV

SEQ ID NO: 403123 - protein, 9 aa, Homo Sapiens
GDKTRMAEL

SEQ ID NO: 403124 - protein, 9 aa, Homo Sapiens
FCKYIYHVM

SEQ ID NO: 403125 - protein, 9 aa, Homo Sapiens
AFKRIEDYI

SEQ ID NO: 403126 - protein, 9 aa, Homo Sapiens
LGGRESYMS

SEQ ID NO: 403127 - protein, 9 aa, Homo Sapiens
SNPEHFVLD

SEQ ID NO: 403128 - protein, 9 aa, Homo Sapiens
LLSASSRIG

SEQ ID NO: 403129 - protein, 9 aa, Homo Sapiens
PLLLSPVSG

SEQ ID NO: 403130 - protein, 9 aa, Homo Sapiens
LYERSLLAM

SEQ ID NO: 403131 - protein, 9 aa, Homo Sapiens
SLGQFSSSP

SEQ ID NO: 403132 - protein, 9 aa, Homo Sapiens
ITIINDTFS

SEQ ID NO: 403133 - protein, 9 aa, Homo Sapiens
QIGIKESLW

SEQ ID NO: 403134 - protein, 9 aa, Homo Sapiens
RTTYQIDNF

SEQ ID NO: 403135 - protein, 9 aa, Homo Sapiens
KEWVTVKLD

SEQ ID NO: 403136 - protein, 9 aa, Homo Sapiens
YDTIQNERN

SEQ ID NO: 403137 - protein, 9 aa, Homo Sapiens
RLFIKALKG

SEQ ID NO: 403138 - protein, 9 aa, Homo Sapiens
RLRVLVKKW

SEQ ID NO: 403139 - protein, 9 aa, Homo Sapiens
YFCGTHKGD

SEQ ID NO: 403140 - protein, 9 aa, Homo Sapiens
PTVCQLLSA

SEQ ID NO: 403141 - protein, 9 aa, Homo Sapiens
SACTEHSDQ

SEQ ID NO: 403142 - protein, 9 aa, Homo Sapiens
PELAKSCIK

SEQ ID NO: 403143 - protein, 9 aa, Homo Sapiens
PLKNALYES

SEQ ID NO: 403144 - protein, 9 aa, Homo Sapiens
DIQDMQIKK

SEQ ID NO: 403145 - protein, 9 aa, Homo Sapiens
VVATGGVEK

SEQ ID NO: 403146 - protein, 9 aa, Homo Sapiens
QQEKRRESQ

SEQ ID NO: 403147 - protein, 9 aa, Homo Sapiens
QNIPLSYFL

SEQ ID NO: 403148 - protein, 9 aa, Homo Sapiens
ITYVSLIYD

SEQ ID NO: 403149 - protein, 9 aa, Homo Sapiens
KTETIIYSL

SEQ ID NO: 403150 - protein, 9 aa, Homo Sapiens
RKIIGKNAE

SEQ ID NO: 403151 - protein, 9 aa, Homo Sapiens
QNCEERNHD

SEQ ID NO: 403152 - protein, 9 aa, Homo Sapiens
PTRTKDVDK

SEQ ID NO: 403153 - protein, 9 aa, Homo Sapiens
AGLKNILRL

SEQ ID NO: 403154 - protein, 9 aa, Homo Sapiens
LGSRGLAEA

SEQ ID NO: 403155 - protein, 9 aa, Homo Sapiens
KKQFWYLLE

SEQ ID NO: 403156 - protein, 9 aa, Homo Sapiens
WERLVYGIT

SEQ ID NO: 403157 - protein, 9 aa, Homo Sapiens
LVRDILKVV

SEQ ID NO: 403158 - protein, 9 aa, Homo Sapiens
YWGKFGELC

SEQ ID NO: 403159 - protein, 9 aa, Homo Sapiens
YEVLKRDFR

SEQ ID NO: 403160 - protein, 9 aa, Homo Sapiens
PSYKSSPTQ

SEQ ID NO: 403161 - protein, 9 aa, Homo Sapiens
FMPHYPYSS

SEQ ID NO: 403162 - protein, 9 aa, Homo Sapiens
WEYYKQPIS

SEQ ID NO: 403163 - protein, 9 aa, Homo Sapiens
AHTCPRGVP

SEQ ID NO: 403164 - protein, 9 aa, Homo Sapiens
TQKILLVQN

SEQ ID NO: 403165 - protein, 9 aa, Homo Sapiens
VATKVQRHD

SEQ ID NO: 403166 - protein, 9 aa, Homo Sapiens
GWEENHTDK

SEQ ID NO: 403167 - protein, 9 aa, Homo Sapiens
ESYMSTLLA

SEQ ID NO: 403168 - protein, 9 aa, Homo Sapiens
PINVILSTK

SEQ ID NO: 403169 - protein, 9 aa, Homo Sapiens
DELYHHMTE

SEQ ID NO: 403170 - protein, 9 aa, Homo Sapiens
ALEHTFVPV

SEQ ID NO: 403171 - protein, 9 aa, Homo Sapiens
EKRRESQKV

SEQ ID NO: 403172 - protein, 9 aa, Homo Sapiens
TPLMRKLVR

SEQ ID NO: 403173 - protein, 9 aa, Homo Sapiens
PNGHHIGTL

SEQ ID NO: 403174 - protein, 9 aa, Homo Sapiens
EEEKNKTVD

SEQ ID NO: 403175 - protein, 9 aa, Homo Sapiens
KTKVEIREP

SEQ ID NO: 403176 - protein, 9 aa, Homo Sapiens
KTLCIIDPR

SEQ ID NO: 403177 - protein, 9 aa, Homo Sapiens
FKFIEELKR

SEQ ID NO: 403178 - protein, 9 aa, Homo Sapiens
EKWGPKLDI

SEQ ID NO: 403179 - protein, 9 aa, Homo Sapiens
FQLWEPNTT

SEQ ID NO: 403180 - protein, 9 aa, Homo Sapiens
PAESPLETP

SEQ ID NO: 403181 - protein, 9 aa, Homo Sapiens
CIIDPRKGQ

SEQ ID NO: 403182 - protein, 9 aa, Homo Sapiens
LTVHQLTHT

SEQ ID NO: 403183 - protein, 9 aa, Homo Sapiens
RTTVMTVAD

SEQ ID NO: 403184 - protein, 9 aa, Homo Sapiens
EAVQRVLAT

SEQ ID NO: 403185 - protein, 9 aa, Homo Sapiens
SVSVQRLAI

SEQ ID NO: 403186 - protein, 9 aa, Homo Sapiens
LQNHWKKTT

SEQ ID NO: 403187 - protein, 9 aa, Homo Sapiens
HDQIVTSIK

SEQ ID NO: 403188 - protein, 9 aa, Homo Sapiens
YHSWHIQGC

SEQ ID NO: 403189 - protein, 9 aa, Homo Sapiens
HNNLLDNNE

SEQ ID NO: 403190 - protein, 9 aa, Homo Sapiens
LELTGPPQK

SEQ ID NO: 403191 - protein, 9 aa, Homo Sapiens
EELDIQEKP

SEQ ID NO: 403192 - protein, 9 aa, Homo Sapiens
SNKFQMLLI

SEQ ID NO: 403193 - protein, 9 aa, Homo Sapiens
CITYYCIFK

SEQ ID NO: 403194 - protein, 9 aa, Homo Sapiens
PLLHTRLSG

SEQ ID NO: 403195 - protein, 9 aa, Homo Sapiens
ARALKSKLT

SEQ ID NO: 403196 - protein, 9 aa, Homo Sapiens
TVSITVELK

SEQ ID NO: 403197 - protein, 9 aa, Homo Sapiens
LSVERKHYI

SEQ ID NO: 403198 - protein, 9 aa, Homo Sapiens
VWLVTPKKL

SEQ ID NO: 403199 - protein, 9 aa, Homo Sapiens
SPLEDEESF

SEQ ID NO: 403200 - protein, 9 aa, Homo Sapiens
SQDISFLSS

SEQ ID NO: 403201 - protein, 9 aa, Homo Sapiens
GPNLSNCTS

SEQ ID NO: 403202 - protein, 9 aa, Homo Sapiens
TQLSTTMEC

SEQ ID NO: 403203 - protein, 9 aa, Homo Sapiens
DKLPEDSFL

SEQ ID NO: 403204 - protein, 9 aa, Homo Sapiens
KRHDGVCQR

SEQ ID NO: 403205 - protein, 9 aa, Homo Sapiens
MCGDGTNDC

SEQ ID NO: 403206 - protein, 9 aa, Homo Sapiens
KQISGKMAL

SEQ ID NO: 403207 - protein, 9 aa, Homo Sapiens
TECVICMND

SEQ ID NO: 403208 - protein, 9 aa, Homo Sapiens
IGKNAEILP

SEQ ID NO: 403209 - protein, 9 aa, Homo Sapiens
NGEMSYSLF

SEQ ID NO: 403210 - protein, 9 aa, Homo Sapiens
MEKYEQIGK

SEQ ID NO: 403211 - protein, 9 aa, Homo Sapiens
SKLEVQAFK

SEQ ID NO: 403212 - protein, 9 aa, Homo Sapiens
FNKAIDMNI

SEQ ID NO: 403213 - protein, 9 aa, Homo Sapiens
DENNVCFEW

SEQ ID NO: 403214 - protein, 9 aa, Homo Sapiens
EVFLIFWNI

SEQ ID NO: 403215 - protein, 9 aa, Homo Sapiens
WCRHLKLTD

SEQ ID NO: 403216 - protein, 9 aa, Homo Sapiens
IGTGLNPHN

SEQ ID NO: 403217 - protein, 9 aa, Homo Sapiens
TMAQKLSHL

SEQ ID NO: 403218 - protein, 9 aa, Homo Sapiens
GGTRGIIYI

SEQ ID NO: 403219 - protein, 9 aa, Homo Sapiens
SLLEYRKYQ

SEQ ID NO: 403220 - protein, 9 aa, Homo Sapiens
NYLELWDGV

SEQ ID NO: 403221 - protein, 9 aa, Homo Sapiens
YQSILISTS

SEQ ID NO: 403222 - protein, 9 aa, Homo Sapiens
EVPNLWSGD

SEQ ID NO: 403223 - protein, 9 aa, Homo Sapiens
EEIKLFSVP

SEQ ID NO: 403224 - protein, 9 aa, Homo Sapiens
QKLFSTLSQ

SEQ ID NO: 403225 - protein, 9 aa, Homo Sapiens
YQLEELDKA

SEQ ID NO: 403226 - protein, 9 aa, Homo Sapiens
FAEYIYQWR

SEQ ID NO: 403227 - protein, 9 aa, Homo Sapiens
TLSDGLHYD

SEQ ID NO: 403228 - protein, 9 aa, Homo Sapiens
LAVKGLNFP

SEQ ID NO: 403229 - protein, 9 aa, Homo Sapiens
TFFPFYLQN

SEQ ID NO: 403230 - protein, 9 aa, Homo Sapiens
LLTPLKEHP

SEQ ID NO: 403231 - protein, 9 aa, Homo Sapiens
PKSYQTAKF

SEQ ID NO: 403232 - protein, 9 aa, Homo Sapiens
TFKKFNKVR

SEQ ID NO: 403233 - protein, 9 aa, Homo Sapiens
QTKKINAKR

SEQ ID NO: 403234 - protein, 9 aa, Homo Sapiens
TVRVWLVTP

SEQ ID NO: 403235 - protein, 9 aa, Homo Sapiens
GLQLLMGNL

SEQ ID NO: 403236 - protein, 9 aa, Homo Sapiens
NSTCIDLYK

SEQ ID NO: 403237 - protein, 9 aa, Homo Sapiens
LIESTNKSI

SEQ ID NO: 403238 - protein, 9 aa, Homo Sapiens
HSDKGNEFV

SEQ ID NO: 403239 - protein, 9 aa, Homo Sapiens
QKWEKECGV

SEQ ID NO: 403240 - protein, 9 aa, Homo Sapiens
RVPGPDQYL

SEQ ID NO: 403241 - protein, 9 aa, Homo Sapiens
TALLLQDLF

SEQ ID NO: 403242 - protein, 9 aa, Homo Sapiens
SGCRKWCKR

SEQ ID NO: 403243 - protein, 9 aa, Homo Sapiens
EVPVNIIRM

SEQ ID NO: 403244 - protein, 9 aa, Homo Sapiens
EKSQVLQLF

SEQ ID NO: 403245 - protein, 9 aa, Homo Sapiens
CIDQMLAEG

SEQ ID NO: 403246 - protein, 9 aa, Homo Sapiens
VRRRMVMQS

SEQ ID NO: 403247 - protein, 9 aa, Homo Sapiens
FNYYGLWGR

SEQ ID NO: 403248 - protein, 9 aa, Homo Sapiens
KILGLHKGA

SEQ ID NO: 403249 - protein, 9 aa, Homo Sapiens
ALNLTAPGT

SEQ ID NO: 403250 - protein, 9 aa, Homo Sapiens
LGETDEDKL

SEQ ID NO: 403251 - protein, 9 aa, Homo Sapiens
SVCHTALVL

SEQ ID NO: 403252 - protein, 9 aa, Homo Sapiens
KYHILPERR

SEQ ID NO: 403253 - protein, 9 aa, Homo Sapiens
YFLIMPSYW

SEQ ID NO: 403254 - protein, 9 aa, Homo Sapiens
SQISSQRNC

SEQ ID NO: 403255 - protein, 9 aa, Homo Sapiens
VYFLLPEES

SEQ ID NO: 403256 - protein, 9 aa, Homo Sapiens
LEEEKNKTV

SEQ ID NO: 403257 - protein, 9 aa, Homo Sapiens
DKFLIQLHQ

SEQ ID NO: 403258 - protein, 9 aa, Homo Sapiens
RDSSFLMSG

SEQ ID NO: 403259 - protein, 9 aa, Homo Sapiens
SGNDISWNY

SEQ ID NO: 403260 - protein, 9 aa, Homo Sapiens
IIYSLEKNP

SEQ ID NO: 403261 - protein, 9 aa, Homo Sapiens
IIAEVEAQY

SEQ ID NO: 403262 - protein, 9 aa, Homo Sapiens
YMTQGFRVI

SEQ ID NO: 403263 - protein, 9 aa, Homo Sapiens
HKKKCKGNL

SEQ ID NO: 403264 - protein, 9 aa, Homo Sapiens
SFCDSMVLG

SEQ ID NO: 403265 - protein, 9 aa, Homo Sapiens
TKSHYFPAF

SEQ ID NO: 403266 - protein, 9 aa, Homo Sapiens
GQQPSLRAA

SEQ ID NO: 403267 - protein, 9 aa, Homo Sapiens
NKDLLSASS

SEQ ID NO: 403268 - protein, 9 aa, Homo Sapiens
NDISWNYTL

SEQ ID NO: 403269 - protein, 9 aa, Homo Sapiens
KVRLFVLTK

SEQ ID NO: 403270 - protein, 9 aa, Homo Sapiens
YNTVTVMLK

SEQ ID NO: 403271 - protein, 9 aa, Homo Sapiens
YQARRLQIR

SEQ ID NO: 403272 - protein, 9 aa, Homo Sapiens
SEGRNSPEV

SEQ ID NO: 403273 - protein, 9 aa, Homo Sapiens
KWFNNGNEL

SEQ ID NO: 403274 - protein, 9 aa, Homo Sapiens
DSQKLNNII

SEQ ID NO: 403275 - protein, 9 aa, Homo Sapiens
EVVMSGVCC

SEQ ID NO: 403276 - protein, 9 aa, Homo Sapiens
SEVPAINLA

SEQ ID NO: 403277 - protein, 9 aa, Homo Sapiens
VLHIAALYD

SEQ ID NO: 403278 - protein, 9 aa, Homo Sapiens
IQTAMSSGQ

SEQ ID NO: 403279 - protein, 9 aa, Homo Sapiens
GTIRGYFCI

SEQ ID NO: 403280 - protein, 9 aa, Homo Sapiens
ETPEIIKQI

SEQ ID NO: 403281 - protein, 9 aa, Homo Sapiens
GRPGLLGKQ

SEQ ID NO: 403282 - protein, 9 aa, Homo Sapiens
KRQQNTKLK

SEQ ID NO: 403283 - protein, 9 aa, Homo Sapiens
ETPPDFFYL

SEQ ID NO: 403284 - protein, 9 aa, Homo Sapiens
LSSELEQYQ

SEQ ID NO: 403285 - protein, 9 aa, Homo Sapiens
ERNSYCLSW

SEQ ID NO: 403286 - protein, 9 aa, Homo Sapiens
KTVMNDPLY

SEQ ID NO: 403287 - protein, 9 aa, Homo Sapiens
LRGLDTLVT

SEQ ID NO: 403288 - protein, 9 aa, Homo Sapiens
KTHSRNITV

SEQ ID NO: 403289 - protein, 9 aa, Homo Sapiens
LESSQRLAE

SEQ ID NO: 403290 - protein, 9 aa, Homo Sapiens
RNCGAWSKS

SEQ ID NO: 403291 - protein, 9 aa, Homo Sapiens
LSISVVLTQ

SEQ ID NO: 403292 - protein, 9 aa, Homo Sapiens
SNEALRKII

SEQ ID NO: 403293 - protein, 9 aa, Homo Sapiens
SIYTSERFK

SEQ ID NO: 403294 - protein, 9 aa, Homo Sapiens
GPIHVQFVN

SEQ ID NO: 403295 - protein, 9 aa, Homo Sapiens
HASEDISKT

SEQ ID NO: 403296 - protein, 9 aa, Homo Sapiens
FADEDEITI

SEQ ID NO: 403297 - protein, 9 aa, Homo Sapiens
SPKDKILLL

SEQ ID NO: 403298 - protein, 9 aa, Homo Sapiens
QIHEITHSE

SEQ ID NO: 403299 - protein, 9 aa, Homo Sapiens
NHVQRQLPG

SEQ ID NO: 403300 - protein, 9 aa, Homo Sapiens
AASQGLKFG

SEQ ID NO: 403301 - protein, 9 aa, Homo Sapiens
CGKAVSIFS

SEQ ID NO: 403302 - protein, 9 aa, Homo Sapiens
EDEESFESI

SEQ ID NO: 403303 - protein, 9 aa, Homo Sapiens
QRVITISKS

SEQ ID NO: 403304 - protein, 9 aa, Homo Sapiens
RLDTFNYDW

SEQ ID NO: 403305 - protein, 9 aa, Homo Sapiens
AKDKRLKKD

SEQ ID NO: 403306 - protein, 9 aa, Homo Sapiens
NPIIYAFHN

SEQ ID NO: 403307 - protein, 9 aa, Homo Sapiens
PTPPQSPGL

SEQ ID NO: 403308 - protein, 9 aa, Homo Sapiens
RVTRVKQCC

SEQ ID NO: 403309 - protein, 9 aa, Homo Sapiens
IKGTYTLSD

SEQ ID NO: 403310 - protein, 9 aa, Homo Sapiens
RGEKEYLDL

SEQ ID NO: 403311 - protein, 9 aa, Homo Sapiens
NQYILMAFQ

SEQ ID NO: 403312 - protein, 9 aa, Homo Sapiens
FSDDGRVLI

SEQ ID NO: 403313 - protein, 9 aa, Homo Sapiens
NTIEDNFPL

SEQ ID NO: 403314 - protein, 9 aa, Homo Sapiens
VALWARVQA

SEQ ID NO: 403315 - protein, 9 aa, Homo Sapiens
DRRSSVPPE

SEQ ID NO: 403316 - protein, 9 aa, Homo Sapiens
VQKAQEHVF

SEQ ID NO: 403317 - protein, 9 aa, Homo Sapiens
SFPENIISQ

SEQ ID NO: 403318 - protein, 9 aa, Homo Sapiens
SCSTVPTCV

SEQ ID NO: 403319 - protein, 9 aa, Homo Sapiens
QNSSLHSHQ

SEQ ID NO: 403320 - protein, 9 aa, Homo Sapiens
HIVSQKQMS

SEQ ID NO: 403321 - protein, 9 aa, Homo Sapiens
DNWVVYQYW

SEQ ID NO: 403322 - protein, 9 aa, Homo Sapiens
LQKDKKEKS

SEQ ID NO: 403323 - protein, 9 aa, Homo Sapiens
FLIVDVYLV

SEQ ID NO: 403324 - protein, 9 aa, Homo Sapiens
DIATFFKAI

SEQ ID NO: 403325 - protein, 9 aa, Homo Sapiens
AKHSDKSPP

SEQ ID NO: 403326 - protein, 9 aa, Homo Sapiens
DNFAQAFGS

SEQ ID NO: 403327 - protein, 9 aa, Homo Sapiens
CIKVSYFTH

SEQ ID NO: 403328 - protein, 9 aa, Homo Sapiens
CSTHPLLLD

SEQ ID NO: 403329 - protein, 9 aa, Homo Sapiens
NSKTAVNSA

SEQ ID NO: 403330 - protein, 9 aa, Homo Sapiens
RVHKAVKAI

SEQ ID NO: 403331 - protein, 9 aa, Homo Sapiens
NNEEILGSA

SEQ ID NO: 403332 - protein, 9 aa, Homo Sapiens
QMGISGNNM

SEQ ID NO: 403333 - protein, 9 aa, Homo Sapiens
EACVPEVCV

SEQ ID NO: 403334 - protein, 9 aa, Homo Sapiens
KKKPHINKP

SEQ ID NO: 403335 - protein, 9 aa, Homo Sapiens
SAEIMNLVL

SEQ ID NO: 403336 - protein, 9 aa, Homo Sapiens
RLWVLAVQQ

SEQ ID NO: 403337 - protein, 9 aa, Homo Sapiens
NTGEKPYRC

SEQ ID NO: 403338 - protein, 9 aa, Homo Sapiens
KYSYLQKTP

SEQ ID NO: 403339 - protein, 9 aa, Homo Sapiens
EYRKYQPNI

SEQ ID NO: 403340 - protein, 9 aa, Homo Sapiens
LHQITHFID

SEQ ID NO: 403341 - protein, 9 aa, Homo Sapiens
KQKRVLKSK

SEQ ID NO: 403342 - protein, 9 aa, Homo Sapiens
MMLGVCSNT

SEQ ID NO: 403343 - protein, 9 aa, Homo Sapiens
KYQASAQGI

SEQ ID NO: 403344 - protein, 9 aa, Homo Sapiens
EPIQSWDNI

SEQ ID NO: 403345 - protein, 9 aa, Homo Sapiens
ISSQRNCGA

SEQ ID NO: 403346 - protein, 9 aa, Homo Sapiens
SLKDLSPED

SEQ ID NO: 403347 - protein, 9 aa, Homo Sapiens
FGSATNTFL

SEQ ID NO: 403348 - protein, 9 aa, Homo Sapiens
QVLFCLNFL

SEQ ID NO: 403349 - protein, 9 aa, Homo Sapiens
NTRYSSKCR

SEQ ID NO: 403350 - protein, 9 aa, Homo Sapiens
AKSCIKTLF

SEQ ID NO: 403351 - protein, 9 aa, Homo Sapiens
LVRLFACPS

SEQ ID NO: 403352 - protein, 9 aa, Homo Sapiens
VRIVVTQSE

SEQ ID NO: 403353 - protein, 9 aa, Homo Sapiens
LWLGGGRAD

SEQ ID NO: 403354 - protein, 9 aa, Homo Sapiens
ICKLDNGGY

SEQ ID NO: 403355 - protein, 9 aa, Homo Sapiens
NILRPTKET

SEQ ID NO: 403356 - protein, 9 aa, Homo Sapiens
VQLTKYLIC

SEQ ID NO: 403357 - protein, 9 aa, Homo Sapiens
MTCKMLQLE

SEQ ID NO: 403358 - protein, 9 aa, Homo Sapiens
QDTAFQRPQ

SEQ ID NO: 403359 - protein, 9 aa, Homo Sapiens
VAKMGLMLA

SEQ ID NO: 403360 - protein, 9 aa, Homo Sapiens
QNMVSFNSK

SEQ ID NO: 403361 - protein, 9 aa, Homo Sapiens
VSEEEEIKL

SEQ ID NO: 403362 - protein, 9 aa, Homo Sapiens
NEAEIKKLR

SEQ ID NO: 403363 - protein, 9 aa, Homo Sapiens
DAVHREENI

SEQ ID NO: 403364 - protein, 9 aa, Homo Sapiens
PSFATGNCL

SEQ ID NO: 403365 - protein, 9 aa, Homo Sapiens
KCRVTVMIS

SEQ ID NO: 403366 - protein, 9 aa, Homo Sapiens
SYFSISYEG

SEQ ID NO: 403367 - protein, 9 aa, Homo Sapiens
NRIWDQMQT

SEQ ID NO: 403368 - protein, 9 aa, Homo Sapiens
LPAPVQPSA

SEQ ID NO: 403369 - protein, 9 aa, Homo Sapiens
KIIKECINK

SEQ ID NO: 403370 - protein, 9 aa, Homo Sapiens
KAKQNTELI

SEQ ID NO: 403371 - protein, 9 aa, Homo Sapiens
CEASVGFLD

SEQ ID NO: 403372 - protein, 9 aa, Homo Sapiens
GHLRFASPS

SEQ ID NO: 403373 - protein, 9 aa, Homo Sapiens
GTGFFLHHV

SEQ ID NO: 403374 - protein, 9 aa, Homo Sapiens
TSDYLTQEV

SEQ ID NO: 403375 - protein, 9 aa, Homo Sapiens
NRIMEEFFQ

SEQ ID NO: 403376 - protein, 9 aa, Homo Sapiens
GRKMNMHNI

SEQ ID NO: 403377 - protein, 9 aa, Homo Sapiens
PEGDAASGS

SEQ ID NO: 403378 - protein, 9 aa, Homo Sapiens
LPSDILGLL

SEQ ID NO: 403379 - protein, 9 aa, Homo Sapiens
MPKDKGDSK

SEQ ID NO: 403380 - protein, 9 aa, Homo Sapiens
IHKLRLKLC

SEQ ID NO: 403381 - protein, 9 aa, Homo Sapiens
DLFQCVNGK

SEQ ID NO: 403382 - protein, 9 aa, Homo Sapiens
ALEAEIQTL

SEQ ID NO: 403383 - protein, 9 aa, Homo Sapiens
SPTYECVHL

SEQ ID NO: 403384 - protein, 9 aa, Homo Sapiens
HKIIHTREN

SEQ ID NO: 403385 - protein, 9 aa, Homo Sapiens
PLTSAHYPD

SEQ ID NO: 403386 - protein, 9 aa, Homo Sapiens
GQCQIEYKQ

SEQ ID NO: 403387 - protein, 9 aa, Homo Sapiens
ATNADKLLS

SEQ ID NO: 403388 - protein, 9 aa, Homo Sapiens
AKRHDGVCQ

SEQ ID NO: 403389 - protein, 9 aa, Homo Sapiens
FLQEIKKSI

SEQ ID NO: 403390 - protein, 9 aa, Homo Sapiens
IFYYFWYNF

SEQ ID NO: 403391 - protein, 9 aa, Homo Sapiens
MVSAQESQS

SEQ ID NO: 403392 - protein, 9 aa, Homo Sapiens
KKHNIIHTG

SEQ ID NO: 403393 - protein, 9 aa, Homo Sapiens
TLDEWAGCF

SEQ ID NO: 403394 - protein, 9 aa, Homo Sapiens
WRPEYRHLS

SEQ ID NO: 403395 - protein, 9 aa, Homo Sapiens
LQMNYVVNF

SEQ ID NO: 403396 - protein, 9 aa, Homo Sapiens
VNGLQLLCP

SEQ ID NO: 403397 - protein, 9 aa, Homo Sapiens
LKVVILFFH

SEQ ID NO: 403398 - protein, 9 aa, Homo Sapiens
MQFRVDSVL

SEQ ID NO: 403399 - protein, 9 aa, Homo Sapiens
PEGQCQIEY

SEQ ID NO: 403400 - protein, 9 aa, Homo Sapiens
TSTTTMVMP

SEQ ID NO: 403401 - protein, 9 aa, Homo Sapiens
PLHEVVVQP

SEQ ID NO: 403402 - protein, 9 aa, Homo Sapiens
AYKIKYPET

SEQ ID NO: 403403 - protein, 9 aa, Homo Sapiens
GYDKLGPSR

SEQ ID NO: 403404 - protein, 9 aa, Homo Sapiens
FIENTFKPN

SEQ ID NO: 403405 - protein, 9 aa, Homo Sapiens
EKTAQVTIQ

SEQ ID NO: 403406 - protein, 9 aa, Homo Sapiens
LLYTMTKSS

SEQ ID NO: 403407 - protein, 9 aa, Homo Sapiens
WTLGRYAHW

SEQ ID NO: 403408 - protein, 9 aa, Homo Sapiens
EGMESPYQT

SEQ ID NO: 403409 - protein, 9 aa, Homo Sapiens
RFWSAVRVS

SEQ ID NO: 403410 - protein, 9 aa, Homo Sapiens
LEHTFVPVT

SEQ ID NO: 403411 - protein, 9 aa, Homo Sapiens
SKDKKIKRE

SEQ ID NO: 403412 - protein, 9 aa, Homo Sapiens
QNYDGKVHG

SEQ ID NO: 403413 - protein, 9 aa, Homo Sapiens
DMTSKRHFK

SEQ ID NO: 403414 - protein, 9 aa, Homo Sapiens
LLMGNLRNK

SEQ ID NO: 403415 - protein, 9 aa, Homo Sapiens
KYLPGLLQS

SEQ ID NO: 403416 - protein, 9 aa, Homo Sapiens
IPINVILST

SEQ ID NO: 403417 - protein, 9 aa, Homo Sapiens
SHSDKRLWV

SEQ ID NO: 403418 - protein, 9 aa, Homo Sapiens
LTDSTLVPL

SEQ ID NO: 403419 - protein, 9 aa, Homo Sapiens
GDEIFHADM

SEQ ID NO: 403420 - protein, 9 aa, Homo Sapiens
QSGFYDLLI

SEQ ID NO: 403421 - protein, 9 aa, Homo Sapiens
GSDLRVGAN

SEQ ID NO: 403422 - protein, 9 aa, Homo Sapiens
LVHLLSSRN

SEQ ID NO: 403423 - protein, 9 aa, Homo Sapiens
RHIQRSLST

SEQ ID NO: 403424 - protein, 9 aa, Homo Sapiens
DPAYPALSL

SEQ ID NO: 403425 - protein, 9 aa, Homo Sapiens
PQKILQSDY

SEQ ID NO: 403426 - protein, 9 aa, Homo Sapiens
PATRTSYSE

SEQ ID NO: 403427 - protein, 9 aa, Homo Sapiens
EEEDDYYEN

SEQ ID NO: 403428 - protein, 9 aa, Homo Sapiens
SSTPPVCCS

SEQ ID NO: 403429 - protein, 9 aa, Homo Sapiens
QDFRKRRPR

SEQ ID NO: 403430 - protein, 9 aa, Homo Sapiens
RTMSSRVHK

SEQ ID NO: 403431 - protein, 9 aa, Homo Sapiens
DDKSLEEAR

SEQ ID NO: 403432 - protein, 9 aa, Homo Sapiens
TISESYSCP

SEQ ID NO: 403433 - protein, 9 aa, Homo Sapiens
NLVLAESSP

SEQ ID NO: 403434 - protein, 9 aa, Homo Sapiens
HLPQVAGVP

SEQ ID NO: 403435 - protein, 9 aa, Homo Sapiens
EAEIQTLKH

SEQ ID NO: 403436 - protein, 9 aa, Homo Sapiens
EEENKKHKK

SEQ ID NO: 403437 - protein, 9 aa, Homo Sapiens
QNTLEINFE

SEQ ID NO: 403438 - protein, 9 aa, Homo Sapiens
PKCINFRKF

SEQ ID NO: 403439 - protein, 9 aa, Homo Sapiens
NPQKILQSD

SEQ ID NO: 403440 - protein, 9 aa, Homo Sapiens
LNKANKRRL

SEQ ID NO: 403441 - protein, 9 aa, Homo Sapiens
LSPLLREGK

SEQ ID NO: 403442 - protein, 9 aa, Homo Sapiens
KVLQDCKAE

SEQ ID NO: 403443 - protein, 9 aa, Homo Sapiens
PEAEMRTYA

SEQ ID NO: 403444 - protein, 9 aa, Homo Sapiens
IKICCSPPN

SEQ ID NO: 403445 - protein, 9 aa, Homo Sapiens
FNPCGYLMN

SEQ ID NO: 403446 - protein, 9 aa, Homo Sapiens
NVKHWPWIK

SEQ ID NO: 403447 - protein, 9 aa, Homo Sapiens
LNLTAPGTP

SEQ ID NO: 403448 - protein, 9 aa, Homo Sapiens
FYLSDYERH

SEQ ID NO: 403449 - protein, 9 aa, Homo Sapiens
YRVLFKHLD

SEQ ID NO: 403450 - protein, 9 aa, Homo Sapiens
LDIFSCLLR

SEQ ID NO: 403451 - protein, 9 aa, Homo Sapiens
SSRDTAEPS

SEQ ID NO: 403452 - protein, 9 aa, Homo Sapiens
IILQLHELV

SEQ ID NO: 403453 - protein, 9 aa, Homo Sapiens
EGQEQIPIH

SEQ ID NO: 403454 - protein, 9 aa, Homo Sapiens
EYSLRLLAY

SEQ ID NO: 403455 - protein, 9 aa, Homo Sapiens
DEESRFPQS

SEQ ID NO: 403456 - protein, 9 aa, Homo Sapiens
VRLFVLTKA

SEQ ID NO: 403457 - protein, 9 aa, Homo Sapiens
NISTINFHS

SEQ ID NO: 403458 - protein, 9 aa, Homo Sapiens
TFKFRFWSN

SEQ ID NO: 403459 - protein, 9 aa, Homo Sapiens
ELDHLYKEL

SEQ ID NO: 403460 - protein, 9 aa, Homo Sapiens
LVVMSWLIF

SEQ ID NO: 403461 - protein, 9 aa, Homo Sapiens
EVHGTIQTE

SEQ ID NO: 403462 - protein, 9 aa, Homo Sapiens
AEQPYVFTR

SEQ ID NO: 403463 - protein, 9 aa, Homo Sapiens
LKPLEHKKI

SEQ ID NO: 403464 - protein, 9 aa, Homo Sapiens
NSSLHSHQR

SEQ ID NO: 403465 - protein, 9 aa, Homo Sapiens
KIIRRDLPV

SEQ ID NO: 403466 - protein, 9 aa, Homo Sapiens
DEIFHADMA

SEQ ID NO: 403467 - protein, 9 aa, Homo Sapiens
FQIHEITHT

SEQ ID NO: 403468 - protein, 9 aa, Homo Sapiens
FQIHEITHS

SEQ ID NO: 403469 - protein, 9 aa, Homo Sapiens
IKCFKTQPL

SEQ ID NO: 403470 - protein, 9 aa, Homo Sapiens
RKSQRKLKK

SEQ ID NO: 403471 - protein, 9 aa, Homo Sapiens
KSNFITHQI

SEQ ID NO: 403472 - protein, 9 aa, Homo Sapiens
KEAPYMLVG

SEQ ID NO: 403473 - protein, 9 aa, Homo Sapiens
KNEYIKGDF

SEQ ID NO: 403474 - protein, 9 aa, Homo Sapiens
HGHQAALGL

SEQ ID NO: 403475 - protein, 9 aa, Homo Sapiens
GSQENKDLL

SEQ ID NO: 403476 - protein, 9 aa, Homo Sapiens
PRGVPACSH

SEQ ID NO: 403477 - protein, 9 aa, Homo Sapiens
QGASFSISL

SEQ ID NO: 403478 - protein, 9 aa, Homo Sapiens
LDHLYKELQ

SEQ ID NO: 403479 - protein, 9 aa, Homo Sapiens
KSHYFPAFE

SEQ ID NO: 403480 - protein, 9 aa, Homo Sapiens
RMAELSRDM

SEQ ID NO: 403481 - protein, 9 aa, Homo Sapiens
TIQVILKST

SEQ ID NO: 403482 - protein, 9 aa, Homo Sapiens
SKPLNAPNV

SEQ ID NO: 403483 - protein, 9 aa, Homo Sapiens
FILLSSVDD

SEQ ID NO: 403484 - protein, 9 aa, Homo Sapiens
LVCTVLHTL

SEQ ID NO: 403485 - protein, 9 aa, Homo Sapiens
QYYLQLQKD

SEQ ID NO: 403486 - protein, 9 aa, Homo Sapiens
LAIKGTYTL

SEQ ID NO: 403487 - protein, 9 aa, Homo Sapiens
NCTYSLSSL

SEQ ID NO: 403488 - protein, 9 aa, Homo Sapiens
KIIHLSDET

SEQ ID NO: 403489 - protein, 9 aa, Homo Sapiens
GELCHGCSL

SEQ ID NO: 403490 - protein, 9 aa, Homo Sapiens
GVGNSYICC

SEQ ID NO: 403491 - protein, 9 aa, Homo Sapiens
EVTIKYLES

SEQ ID NO: 403492 - protein, 9 aa, Homo Sapiens
LILLAQMGI

SEQ ID NO: 403493 - protein, 9 aa, Homo Sapiens
KVKAKKAQK

SEQ ID NO: 403494 - protein, 9 aa, Homo Sapiens
AAVVRWTGS

SEQ ID NO: 403495 - protein, 9 aa, Homo Sapiens
FYPSVTSVN

SEQ ID NO: 403496 - protein, 9 aa, Homo Sapiens
GPVHIVHSD

SEQ ID NO: 403497 - protein, 9 aa, Homo Sapiens
KIKYPETFF

SEQ ID NO: 403498 - protein, 9 aa, Homo Sapiens
LALPHSKSC

SEQ ID NO: 403499 - protein, 9 aa, Homo Sapiens
VCCSSQHSV

SEQ ID NO: 403500 - protein, 9 aa, Homo Sapiens
VSHSDKRLW

SEQ ID NO: 403501 - protein, 9 aa, Homo Sapiens
LETPLNQTY

SEQ ID NO: 403502 - protein, 9 aa, Homo Sapiens
VFENTRWII

SEQ ID NO: 403503 - protein, 9 aa, Homo Sapiens
DVIQRIRWG

SEQ ID NO: 403504 - protein, 9 aa, Homo Sapiens
IPKVLADLG

SEQ ID NO: 403505 - protein, 9 aa, Homo Sapiens
CVDTSQDIS

SEQ ID NO: 403506 - protein, 9 aa, Homo Sapiens
DLSHNSIYQ

SEQ ID NO: 403507 - protein, 9 aa, Homo Sapiens
YLHSPAPAL

SEQ ID NO: 403508 - protein, 9 aa, Homo Sapiens
DTFNYDWYN

SEQ ID NO: 403509 - protein, 9 aa, Homo Sapiens
LPPEAEMRT

SEQ ID NO: 403510 - protein, 9 aa, Homo Sapiens
VHLICDPET

SEQ ID NO: 403511 - protein, 9 aa, Homo Sapiens
SPKSYQTAK

SEQ ID NO: 403512 - protein, 9 aa, Homo Sapiens
FEFLVRLFA

SEQ ID NO: 403513 - protein, 9 aa, Homo Sapiens
SIPKVLADL

SEQ ID NO: 403514 - protein, 9 aa, Homo Sapiens
GIISPFSCL

SEQ ID NO: 403515 - protein, 9 aa, Homo Sapiens
LLGCDKITC

SEQ ID NO: 403516 - protein, 9 aa, Homo Sapiens
TRFWSAVRV

SEQ ID NO: 403517 - protein, 9 aa, Homo Sapiens
CEGFKLHFW

SEQ ID NO: 403518 - protein, 9 aa, Homo Sapiens
NKLWVGQLL

SEQ ID NO: 403519 - protein, 9 aa, Homo Sapiens
LVIPINVIL

SEQ ID NO: 403520 - protein, 9 aa, Homo Sapiens
LRIADVKED

SEQ ID NO: 403521 - protein, 9 aa, Homo Sapiens
DNTFEGHKS

SEQ ID NO: 403522 - protein, 9 aa, Homo Sapiens
FVCDGCLNK

SEQ ID NO: 403523 - protein, 9 aa, Homo Sapiens
LINYPYKIC

SEQ ID NO: 403524 - protein, 9 aa, Homo Sapiens
GFHNNLLDN

SEQ ID NO: 403525 - protein, 9 aa, Homo Sapiens
NLYWRASSF

SEQ ID NO: 403526 - protein, 9 aa, Homo Sapiens
AIIGGEEPA

SEQ ID NO: 403527 - protein, 9 aa, Homo Sapiens
QLFSSDICR

SEQ ID NO: 403528 - protein, 9 aa, Homo Sapiens
TLWKAAKPQ

SEQ ID NO: 403529 - protein, 9 aa, Homo Sapiens
CSSTIVEYP

SEQ ID NO: 403530 - protein, 9 aa, Homo Sapiens
EAMQNYLKE

SEQ ID NO: 403531 - protein, 9 aa, Homo Sapiens
SEICTELQN

SEQ ID NO: 403532 - protein, 9 aa, Homo Sapiens
CRKWCKREI

SEQ ID NO: 403533 - protein, 9 aa, Homo Sapiens
KIEGKELLL

SEQ ID NO: 403534 - protein, 9 aa, Homo Sapiens
EHFVLDINR

SEQ ID NO: 403535 - protein, 9 aa, Homo Sapiens
AMQNYLKER

SEQ ID NO: 403536 - protein, 9 aa, Homo Sapiens
VHTQTHTGA

SEQ ID NO: 403537 - protein, 9 aa, Homo Sapiens
WDGVDSDAP

SEQ ID NO: 403538 - protein, 9 aa, Homo Sapiens
FDQHQIIHF

SEQ ID NO: 403539 - protein, 9 aa, Homo Sapiens
IAQNNQTVF

SEQ ID NO: 403540 - protein, 9 aa, Homo Sapiens
LKSMETYLK

SEQ ID NO: 403541 - protein, 9 aa, Homo Sapiens
QREVVNVTG

SEQ ID NO: 403542 - protein, 9 aa, Homo Sapiens
VQNIGNKNA

SEQ ID NO: 403543 - protein, 9 aa, Homo Sapiens
ISYDTLKDE

SEQ ID NO: 403544 - protein, 9 aa, Homo Sapiens
LIQHQIIHS

SEQ ID NO: 403545 - protein, 9 aa, Homo Sapiens
TQTNNQLSN

SEQ ID NO: 403546 - protein, 9 aa, Homo Sapiens
QTIVLDCSF

SEQ ID NO: 403547 - protein, 9 aa, Homo Sapiens
STPSLFDSL

SEQ ID NO: 403548 - protein, 9 aa, Homo Sapiens
LKTLLWCRN

SEQ ID NO: 403549 - protein, 9 aa, Homo Sapiens
NLSPKSYQT

SEQ ID NO: 403550 - protein, 9 aa, Homo Sapiens
EEGVLQHLY

SEQ ID NO: 403551 - protein, 9 aa, Homo Sapiens
GSRSTDNLS

SEQ ID NO: 403552 - protein, 9 aa, Homo Sapiens
YIDQKLCKS

SEQ ID NO: 403553 - protein, 9 aa, Homo Sapiens
EHEIIHTGK

SEQ ID NO: 403554 - protein, 9 aa, Homo Sapiens
DAANFNSWC

SEQ ID NO: 403555 - protein, 9 aa, Homo Sapiens
NLPATQLQI

SEQ ID NO: 403556 - protein, 9 aa, Homo Sapiens
RCNIHYTGC

SEQ ID NO: 403557 - protein, 9 aa, Homo Sapiens
ILLVQNIGN

SEQ ID NO: 403558 - protein, 9 aa, Homo Sapiens
PLKLHQTET

SEQ ID NO: 403559 - protein, 9 aa, Homo Sapiens
QITHTRILF

SEQ ID NO: 403560 - protein, 9 aa, Homo Sapiens
KLFSTLSQP

SEQ ID NO: 403561 - protein, 9 aa, Homo Sapiens
YPYSSLSSG

SEQ ID NO: 403562 - protein, 9 aa, Homo Sapiens
QHQIIHFLE

SEQ ID NO: 403563 - protein, 9 aa, Homo Sapiens
MVAKLGNFG

SEQ ID NO: 403564 - protein, 9 aa, Homo Sapiens
IHVQFVNRK

SEQ ID NO: 403565 - protein, 9 aa, Homo Sapiens
DRQLALQAK

SEQ ID NO: 403566 - protein, 9 aa, Homo Sapiens
AICTHHLDP

SEQ ID NO: 403567 - protein, 9 aa, Homo Sapiens
FVPVTDGAI

SEQ ID NO: 403568 - protein, 9 aa, Homo Sapiens
GFKDKLSSI

SEQ ID NO: 403569 - protein, 9 aa, Homo Sapiens
PSFPENIIS

SEQ ID NO: 403570 - protein, 9 aa, Homo Sapiens
PTDSQNDMI

SEQ ID NO: 403571 - protein, 9 aa, Homo Sapiens
LPSFPENII

SEQ ID NO: 403572 - protein, 9 aa, Homo Sapiens
VKPLGVMWK

SEQ ID NO: 403573 - protein, 9 aa, Homo Sapiens
YICCYYFAV

SEQ ID NO: 403574 - protein, 9 aa, Homo Sapiens
SGPVTMSTP

SEQ ID NO: 403575 - protein, 9 aa, Homo Sapiens
ATQLQIAMG

SEQ ID NO: 403576 - protein, 9 aa, Homo Sapiens
ISATWPHSV

SEQ ID NO: 403577 - protein, 9 aa, Homo Sapiens
PLGSRGLAE

SEQ ID NO: 403578 - protein, 9 aa, Homo Sapiens
PGWGMVSSY

SEQ ID NO: 403579 - protein, 9 aa, Homo Sapiens
LEYGWSLSE

SEQ ID NO: 403580 - protein, 9 aa, Homo Sapiens
KLKSMETYL

SEQ ID NO: 403581 - protein, 9 aa, Homo Sapiens
ASGPIDHYQ

SEQ ID NO: 403582 - protein, 9 aa, Homo Sapiens
HEITHSEEK

SEQ ID NO: 403583 - protein, 9 aa, Homo Sapiens
AHNPDSVAE

SEQ ID NO: 403584 - protein, 9 aa, Homo Sapiens
ILEKQICIP

SEQ ID NO: 403585 - protein, 9 aa, Homo Sapiens
DVEELDIQE

SEQ ID NO: 403586 - protein, 9 aa, Homo Sapiens
GNFGIARVL

SEQ ID NO: 403587 - protein, 9 aa, Homo Sapiens
EQLFESYYG

SEQ ID NO: 403588 - protein, 9 aa, Homo Sapiens
TNADKLLSH

SEQ ID NO: 403589 - protein, 9 aa, Homo Sapiens
EITIINDTF

SEQ ID NO: 403590 - protein, 9 aa, Homo Sapiens
RGALGETVL

SEQ ID NO: 403591 - protein, 9 aa, Homo Sapiens
CKFTASFLL

SEQ ID NO: 403592 - protein, 9 aa, Homo Sapiens
MQNYLKERG

SEQ ID NO: 403593 - protein, 9 aa, Homo Sapiens
WPLKWYAPK

SEQ ID NO: 403594 - protein, 9 aa, Homo Sapiens
VPEKLPPTV

SEQ ID NO: 403595 - protein, 9 aa, Homo Sapiens
GCDKITCTK

SEQ ID NO: 403596 - protein, 9 aa, Homo Sapiens
TFIEELIQN

SEQ ID NO: 403597 - protein, 9 aa, Homo Sapiens
QRRGAKTVC

SEQ ID NO: 403598 - protein, 9 aa, Homo Sapiens
IYMTQGFRV

SEQ ID NO: 403599 - protein, 9 aa, Homo Sapiens
THPLLLDDS

SEQ ID NO: 403600 - protein, 9 aa, Homo Sapiens
AVLGSPDQA

SEQ ID NO: 403601 - protein, 9 aa, Homo Sapiens
MIYSELIEA

SEQ ID NO: 403602 - protein, 9 aa, Homo Sapiens
EGASWSPRG

SEQ ID NO: 403603 - protein, 9 aa, Homo Sapiens
ISRLQGQEE

SEQ ID NO: 403604 - protein, 9 aa, Homo Sapiens
DKRLWVLAV

SEQ ID NO: 403605 - protein, 9 aa, Homo Sapiens
PDTNNEEGS

SEQ ID NO: 403606 - protein, 9 aa, Homo Sapiens
RFNGAKVVS

SEQ ID NO: 403607 - protein, 9 aa, Homo Sapiens
CSMLIEEGV

SEQ ID NO: 403608 - protein, 9 aa, Homo Sapiens
TLQNHWKKT

SEQ ID NO: 403609 - protein, 9 aa, Homo Sapiens
LTCMQYVHT

SEQ ID NO: 403610 - protein, 9 aa, Homo Sapiens
TYSCVSTHS

SEQ ID NO: 403611 - protein, 9 aa, Homo Sapiens
NKSNNGTDV

SEQ ID NO: 403612 - protein, 9 aa, Homo Sapiens
TKDVDKEEA

SEQ ID NO: 403613 - protein, 9 aa, Homo Sapiens
TTEKWRFRL

SEQ ID NO: 403614 - protein, 9 aa, Homo Sapiens
QCLDTAQNN

SEQ ID NO: 403615 - protein, 9 aa, Homo Sapiens
LIDNLYPED

SEQ ID NO: 403616 - protein, 9 aa, Homo Sapiens
FDLMPITWI

SEQ ID NO: 403617 - protein, 9 aa, Homo Sapiens
NGIDGLNRE

SEQ ID NO: 403618 - protein, 9 aa, Homo Sapiens
KSRKLALPH

SEQ ID NO: 403619 - protein, 9 aa, Homo Sapiens
EHSSCKLCT

SEQ ID NO: 403620 - protein, 9 aa, Homo Sapiens
AQRAHLKTG

SEQ ID NO: 403621 - protein, 9 aa, Homo Sapiens
KKLDVEAIF

SEQ ID NO: 403622 - protein, 9 aa, Homo Sapiens
FALIGLQLL

SEQ ID NO: 403623 - protein, 9 aa, Homo Sapiens
NPKGPNLSN

SEQ ID NO: 403624 - protein, 9 aa, Homo Sapiens
CFDDLFPIS

SEQ ID NO: 403625 - protein, 9 aa, Homo Sapiens
LYPNAQRAH

SEQ ID NO: 403626 - protein, 9 aa, Homo Sapiens
AGEDVAIVA

SEQ ID NO: 403627 - protein, 9 aa, Homo Sapiens
PHSTTGTVH

SEQ ID NO: 403628 - protein, 9 aa, Homo Sapiens
ELSVSVQRL

SEQ ID NO: 403629 - protein, 9 aa, Homo Sapiens
NKKKNTQGL

SEQ ID NO: 403630 - protein, 9 aa, Homo Sapiens
KAVSIFSTL

SEQ ID NO: 403631 - protein, 9 aa, Homo Sapiens
KITYRELRL

SEQ ID NO: 403632 - protein, 9 aa, Homo Sapiens
YFNQTLTSN

SEQ ID NO: 403633 - protein, 9 aa, Homo Sapiens
LEPTQKDIA

SEQ ID NO: 403634 - protein, 9 aa, Homo Sapiens
FKAPFHTSG

SEQ ID NO: 403635 - protein, 9 aa, Homo Sapiens
CSIILTSHS

SEQ ID NO: 403636 - protein, 9 aa, Homo Sapiens
VCRFSIRNT

SEQ ID NO: 403637 - protein, 9 aa, Homo Sapiens
SALTVHQLT

SEQ ID NO: 403638 - protein, 9 aa, Homo Sapiens
EKDLFKFIE

SEQ ID NO: 403639 - protein, 9 aa, Homo Sapiens
LLHPFKYLV

SEQ ID NO: 403640 - protein, 9 aa, Homo Sapiens
TNNEEILGS

SEQ ID NO: 403641 - protein, 9 aa, Homo Sapiens
SSKRTEHKK

SEQ ID NO: 403642 - protein, 9 aa, Homo Sapiens
TDKFLIQLH

SEQ ID NO: 403643 - protein, 9 aa, Homo Sapiens
FKRIEDYIK

SEQ ID NO: 403644 - protein, 9 aa, Homo Sapiens
IDLYKSYRC

SEQ ID NO: 403645 - protein, 9 aa, Homo Sapiens
GEKQYECKQ

SEQ ID NO: 403646 - protein, 9 aa, Homo Sapiens
SLSNHQIIH

SEQ ID NO: 403647 - protein, 9 aa, Homo Sapiens
IRDNSILGS

SEQ ID NO: 403648 - protein, 9 aa, Homo Sapiens
RYLYTLDKV

SEQ ID NO: 403649 - protein, 9 aa, Homo Sapiens
QELSNITMV

SEQ ID NO: 403650 - protein, 9 aa, Homo Sapiens
NKLHFSSSY

SEQ ID NO: 403651 - protein, 9 aa, Homo Sapiens
KETTYQRDY

SEQ ID NO: 403652 - protein, 9 aa, Homo Sapiens
STTTMVMPI

SEQ ID NO: 403653 - protein, 9 aa, Homo Sapiens
HNKEVTRAL

SEQ ID NO: 403654 - protein, 9 aa, Homo Sapiens
LALQAKLQT

SEQ ID NO: 403655 - protein, 9 aa, Homo Sapiens
QEAGTTLGC

SEQ ID NO: 403656 - protein, 9 aa, Homo Sapiens
DRRPLNDLC

SEQ ID NO: 403657 - protein, 9 aa, Homo Sapiens
VISTVTTYA

SEQ ID NO: 403658 - protein, 9 aa, Homo Sapiens
CKLDNGGYY

SEQ ID NO: 403659 - protein, 9 aa, Homo Sapiens
LGHNAWLSY

SEQ ID NO: 403660 - protein, 9 aa, Homo Sapiens
PQSRLDTFN

SEQ ID NO: 403661 - protein, 9 aa, Homo Sapiens
VQNKCSIIL

SEQ ID NO: 403662 - protein, 9 aa, Homo Sapiens
ALIEKNKQK

SEQ ID NO: 403663 - protein, 9 aa, Homo Sapiens
EPAESPLET

SEQ ID NO: 403664 - protein, 9 aa, Homo Sapiens
HISTLHKSV

SEQ ID NO: 403665 - protein, 9 aa, Homo Sapiens
NGILSERAS

SEQ ID NO: 403666 - protein, 9 aa, Homo Sapiens
DKILLLRKD

SEQ ID NO: 403667 - protein, 9 aa, Homo Sapiens
GMESPYQTG

SEQ ID NO: 403668 - protein, 9 aa, Homo Sapiens
SSSSFKLEM

SEQ ID NO: 403669 - protein, 9 aa, Homo Sapiens
LSNITMVEK

SEQ ID NO: 403670 - protein, 9 aa, Homo Sapiens
SQKEPLQAS

SEQ ID NO: 403671 - protein, 9 aa, Homo Sapiens
SNLLIQMSV

SEQ ID NO: 403672 - protein, 9 aa, Homo Sapiens
QIPQKQDKK

SEQ ID NO: 403673 - protein, 9 aa, Homo Sapiens
HNIRAVVTG

SEQ ID NO: 403674 - protein, 9 aa, Homo Sapiens
SYFTHHIFL

SEQ ID NO: 403675 - protein, 9 aa, Homo Sapiens
AQNNQTVFE

SEQ ID NO: 403676 - protein, 9 aa, Homo Sapiens
TGFFLHHVG

SEQ ID NO: 403677 - protein, 9 aa, Homo Sapiens
VRWTGSHPW

SEQ ID NO: 403678 - protein, 9 aa, Homo Sapiens
DKWVAVADI

SEQ ID NO: 403679 - protein, 9 aa, Homo Sapiens
NISVKVLSK

SEQ ID NO: 403680 - protein, 9 aa, Homo Sapiens
TWIKPTQKS

SEQ ID NO: 403681 - protein, 9 aa, Homo Sapiens
SPYPGLHLI

SEQ ID NO: 403682 - protein, 9 aa, Homo Sapiens
SQRLAEIQE

SEQ ID NO: 403683 - protein, 9 aa, Homo Sapiens
DKIFYPSVT

SEQ ID NO: 403684 - protein, 9 aa, Homo Sapiens
STIFGIRGN

SEQ ID NO: 403685 - protein, 9 aa, Homo Sapiens
NNFLHRDIK

SEQ ID NO: 403686 - protein, 9 aa, Homo Sapiens
QRVAEAHNP

SEQ ID NO: 403687 - protein, 9 aa, Homo Sapiens
KVYVSDNIQ

SEQ ID NO: 403688 - protein, 9 aa, Homo Sapiens
TPGKGGHLR

SEQ ID NO: 403689 - protein, 9 aa, Homo Sapiens
EKLSLVNTV

SEQ ID NO: 403690 - protein, 9 aa, Homo Sapiens
EKVSLYCDK

SEQ ID NO: 403691 - protein, 9 aa, Homo Sapiens
KCHRTTVMT

SEQ ID NO: 403692 - protein, 9 aa, Homo Sapiens
KRSLKSEMY

SEQ ID NO: 403693 - protein, 9 aa, Homo Sapiens
LWVLAVQQV

SEQ ID NO: 403694 - protein, 9 aa, Homo Sapiens
LHNKEVTRA

SEQ ID NO: 403695 - protein, 9 aa, Homo Sapiens
LVTQKVRPR

SEQ ID NO: 403696 - protein, 9 aa, Homo Sapiens
ISTVTTYAS

SEQ ID NO: 403697 - protein, 9 aa, Homo Sapiens
LELYRQWTN

SEQ ID NO: 403698 - protein, 9 aa, Homo Sapiens
KHPKYLQGS

SEQ ID NO: 403699 - protein, 9 aa, Homo Sapiens
TSYGIECSS

SEQ ID NO: 403700 - protein, 9 aa, Homo Sapiens
ARNIMLLKN

SEQ ID NO: 403701 - protein, 9 aa, Homo Sapiens
YKSHISTLH

SEQ ID NO: 403702 - protein, 9 aa, Homo Sapiens
TEKWRFRLS

SEQ ID NO: 403703 - protein, 9 aa, Homo Sapiens
VEYPQTKCE

SEQ ID NO: 403704 - protein, 9 aa, Homo Sapiens
SNKRAFKTQ

SEQ ID NO: 403705 - protein, 9 aa, Homo Sapiens
KLICNRQSE

SEQ ID NO: 403706 - protein, 9 aa, Homo Sapiens
SQSVVPRDT

SEQ ID NO: 403707 - protein, 9 aa, Homo Sapiens
LEKNPNAFE

SEQ ID NO: 403708 - protein, 9 aa, Homo Sapiens
FKENEDNIQ

SEQ ID NO: 403709 - protein, 9 aa, Homo Sapiens
KELFAKARA

SEQ ID NO: 403710 - protein, 9 aa, Homo Sapiens
RRSSVPPET

SEQ ID NO: 403711 - protein, 9 aa, Homo Sapiens
WSGDGEVTV

SEQ ID NO: 403712 - protein, 9 aa, Homo Sapiens
IHSIKDKCP

SEQ ID NO: 403713 - protein, 9 aa, Homo Sapiens
GESYRYPPV

SEQ ID NO: 403714 - protein, 9 aa, Homo Sapiens
LSQDIKKSL

SEQ ID NO: 403715 - protein, 9 aa, Homo Sapiens
VREKAKQNT

SEQ ID NO: 403716 - protein, 9 aa, Homo Sapiens
LTATMNTTN

SEQ ID NO: 403717 - protein, 9 aa, Homo Sapiens
RRESQKVKA

SEQ ID NO: 403718 - protein, 9 aa, Homo Sapiens
SDELTRHIQ

SEQ ID NO: 403719 - protein, 9 aa, Homo Sapiens
LPDTNNEEG

SEQ ID NO: 403720 - protein, 9 aa, Homo Sapiens
FKLHFWRKI

SEQ ID NO: 403721 - protein, 9 aa, Homo Sapiens
CTSNYLELW

SEQ ID NO: 403722 - protein, 9 aa, Homo Sapiens
KNADEVELN

SEQ ID NO: 403723 - protein, 9 aa, Homo Sapiens
DIRSRLIQG

SEQ ID NO: 403724 - protein, 9 aa, Homo Sapiens
QWRRGSSIP

SEQ ID NO: 403725 - protein, 9 aa, Homo Sapiens
LRKERGMDT

SEQ ID NO: 403726 - protein, 9 aa, Homo Sapiens
EIKLFSVPS

SEQ ID NO: 403727 - protein, 9 aa, Homo Sapiens
MIDSHNSKD

SEQ ID NO: 403728 - protein, 9 aa, Homo Sapiens
DHEAITKVK

SEQ ID NO: 403729 - protein, 9 aa, Homo Sapiens
KQFWYLLES

SEQ ID NO: 403730 - protein, 9 aa, Homo Sapiens
LIILGSTEF

SEQ ID NO: 403731 - protein, 9 aa, Homo Sapiens
RKQKRVLKS

SEQ ID NO: 403732 - protein, 9 aa, Homo Sapiens
YPLQIKSSG

SEQ ID NO: 403733 - protein, 9 aa, Homo Sapiens
MVTNTIEDN

SEQ ID NO: 403734 - protein, 9 aa, Homo Sapiens
ALELRFNGA

SEQ ID NO: 403735 - protein, 9 aa, Homo Sapiens
FRFFNNVFI

SEQ ID NO: 403736 - protein, 9 aa, Homo Sapiens
TLMFWCKFT

SEQ ID NO: 403737 - protein, 9 aa, Homo Sapiens
KVLADLGSL

SEQ ID NO: 403738 - protein, 9 aa, Homo Sapiens
YAFHNQEIQ

SEQ ID NO: 403739 - protein, 9 aa, Homo Sapiens
QPLGDKVNL

SEQ ID NO: 403740 - protein, 9 aa, Homo Sapiens
YLQGSHQAE

SEQ ID NO: 403741 - protein, 9 aa, Homo Sapiens
AIPEKEKNK

SEQ ID NO: 403742 - protein, 9 aa, Homo Sapiens
QKVKHLDGE

SEQ ID NO: 403743 - protein, 9 aa, Homo Sapiens
RICSTEGRS

SEQ ID NO: 403744 - protein, 9 aa, Homo Sapiens
GFKLHFWRK

SEQ ID NO: 403745 - protein, 9 aa, Homo Sapiens
SSRTAHLVI

SEQ ID NO: 403746 - protein, 9 aa, Homo Sapiens
MVLVIPINV

SEQ ID NO: 403747 - protein, 9 aa, Homo Sapiens
VIVYVMDLL

SEQ ID NO: 403748 - protein, 9 aa, Homo Sapiens
YPPPPPCPS

SEQ ID NO: 403749 - protein, 9 aa, Homo Sapiens
IRKDVCAIL

SEQ ID NO: 403750 - protein, 9 aa, Homo Sapiens
EDNIQCGEN

SEQ ID NO: 403751 - protein, 9 aa, Homo Sapiens
APYMLVGSI

SEQ ID NO: 403752 - protein, 9 aa, Homo Sapiens
PFQIGIKES

SEQ ID NO: 403753 - protein, 9 aa, Homo Sapiens
ELDKAFNEA

SEQ ID NO: 403754 - protein, 9 aa, Homo Sapiens
GTYTLSDGL

SEQ ID NO: 403755 - protein, 9 aa, Homo Sapiens
FDVEAIFSK

SEQ ID NO: 403756 - protein, 9 aa, Homo Sapiens
LLAWKESTI

SEQ ID NO: 403757 - protein, 9 aa, Homo Sapiens
VCTVLHTLF

SEQ ID NO: 403758 - protein, 9 aa, Homo Sapiens
PPAHTCPRG

SEQ ID NO: 403759 - protein, 9 aa, Homo Sapiens
IPPNGHHIG

SEQ ID NO: 403760 - protein, 9 aa, Homo Sapiens
LQNRIWDQM

SEQ ID NO: 403761 - protein, 9 aa, Homo Sapiens
ILRLRVLVK

SEQ ID NO: 403762 - protein, 9 aa, Homo Sapiens
RVRIWELLP

SEQ ID NO: 403763 - protein, 9 aa, Homo Sapiens
AFAGLKNIL

SEQ ID NO: 403764 - protein, 9 aa, Homo Sapiens
YSGRTILKI

SEQ ID NO: 403765 - protein, 9 aa, Homo Sapiens
EDNFPLGTV

SEQ ID NO: 403766 - protein, 9 aa, Homo Sapiens
NKPLNAFML

SEQ ID NO: 403767 - protein, 9 aa, Homo Sapiens
AQVVNYLTR

SEQ ID NO: 403768 - protein, 9 aa, Homo Sapiens
MDDLFQCVN

SEQ ID NO: 403769 - protein, 9 aa, Homo Sapiens
SYLLYALTL

SEQ ID NO: 403770 - protein, 9 aa, Homo Sapiens
KLTDLTKGW

SEQ ID NO: 403771 - protein, 9 aa, Homo Sapiens
LHQTETFPA

SEQ ID NO: 403772 - protein, 9 aa, Homo Sapiens
VTNSNPEHF

SEQ ID NO: 403773 - protein, 9 aa, Homo Sapiens
KQNTELIQL

SEQ ID NO: 403774 - protein, 9 aa, Homo Sapiens
INPIIYAFH

SEQ ID NO: 403775 - protein, 9 aa, Homo Sapiens
FCDSMVLGW

SEQ ID NO: 403776 - protein, 9 aa, Homo Sapiens
DILMECGHL

SEQ ID NO: 403777 - protein, 9 aa, Homo Sapiens
LIIFLVPVP

SEQ ID NO: 403778 - protein, 9 aa, Homo Sapiens
IRKKYLLMK

SEQ ID NO: 403779 - protein, 9 aa, Homo Sapiens
YFHKKPYPR

SEQ ID NO: 403780 - protein, 9 aa, Homo Sapiens
GEGPGESDK

SEQ ID NO: 403781 - protein, 9 aa, Homo Sapiens
IADVNLPAT

SEQ ID NO: 403782 - protein, 9 aa, Homo Sapiens
QDISFLSSN

SEQ ID NO: 403783 - protein, 9 aa, Homo Sapiens
LILVFYVHI

SEQ ID NO: 403784 - protein, 9 aa, Homo Sapiens
FATGNCLEI

SEQ ID NO: 403785 - protein, 9 aa, Homo Sapiens
LVQNIGNKN

SEQ ID NO: 403786 - protein, 9 aa, Homo Sapiens
KILQSDYLQ

SEQ ID NO: 403787 - protein, 9 aa, Homo Sapiens
FPKHAADLH

SEQ ID NO: 403788 - protein, 9 aa, Homo Sapiens
NDNIFASFS

SEQ ID NO: 403789 - protein, 9 aa, Homo Sapiens
TGFSKAKLK

SEQ ID NO: 403790 - protein, 9 aa, Homo Sapiens
TTSSSSFKL

SEQ ID NO: 403791 - protein, 9 aa, Homo Sapiens
PGDYIIQEG

SEQ ID NO: 403792 - protein, 9 aa, Homo Sapiens
WGKFGELCH

SEQ ID NO: 403793 - protein, 9 aa, Homo Sapiens
NKQKIEEDV

SEQ ID NO: 403794 - protein, 9 aa, Homo Sapiens
SEEEEIKLF

SEQ ID NO: 403795 - protein, 9 aa, Homo Sapiens
YCIFKVARD

SEQ ID NO: 403796 - protein, 9 aa, Homo Sapiens
SCGYSVQFE

SEQ ID NO: 403797 - protein, 9 aa, Homo Sapiens
MGISGNNMT

SEQ ID NO: 403798 - protein, 9 aa, Homo Sapiens
TSQDISFLS

SEQ ID NO: 403799 - protein, 9 aa, Homo Sapiens
DQIRNKNRE

SEQ ID NO: 403800 - protein, 9 aa, Homo Sapiens
KYILNFLRT

SEQ ID NO: 403801 - protein, 9 aa, Homo Sapiens
HPISFPSFV

SEQ ID NO: 403802 - protein, 9 aa, Homo Sapiens
EKTEKHPKY

SEQ ID NO: 403803 - protein, 9 aa, Homo Sapiens
EAPKGAHHN

SEQ ID NO: 403804 - protein, 9 aa, Homo Sapiens
TFFLLRGNH

SEQ ID NO: 403805 - protein, 9 aa, Homo Sapiens
VQPSAEDSD

SEQ ID NO: 403806 - protein, 9 aa, Homo Sapiens
GMCGSRSTD

SEQ ID NO: 403807 - protein, 9 aa, Homo Sapiens
VLKECIDQM

SEQ ID NO: 403808 - protein, 9 aa, Homo Sapiens
QTNNQLSNC

SEQ ID NO: 403809 - protein, 9 aa, Homo Sapiens
TEDNRRQFR

SEQ ID NO: 403810 - protein, 9 aa, Homo Sapiens
ETDCQYVSW

SEQ ID NO: 403811 - protein, 9 aa, Homo Sapiens
AINRCLPLH

SEQ ID NO: 403812 - protein, 9 aa, Homo Sapiens
RLKCQKQAN

SEQ ID NO: 403813 - protein, 9 aa, Homo Sapiens
GLINNSRFY

SEQ ID NO: 403814 - protein, 9 aa, Homo Sapiens
HYTGCYVSA

SEQ ID NO: 403815 - protein, 9 aa, Homo Sapiens
IDQKLCKSV

SEQ ID NO: 403816 - protein, 9 aa, Homo Sapiens
IDYISTSKQ

SEQ ID NO: 403817 - protein, 9 aa, Homo Sapiens
GCYVSATNC

SEQ ID NO: 403818 - protein, 9 aa, Homo Sapiens
RIHSKDIFK

SEQ ID NO: 403819 - protein, 9 aa, Homo Sapiens
HVKHYKICK

SEQ ID NO: 403820 - protein, 9 aa, Homo Sapiens
FSMEVNKTV

SEQ ID NO: 403821 - protein, 9 aa, Homo Sapiens
PHSGAINFD

SEQ ID NO: 403822 - protein, 9 aa, Homo Sapiens
CQYVSWRRK

SEQ ID NO: 403823 - protein, 9 aa, Homo Sapiens
YIMECPEID

SEQ ID NO: 403824 - protein, 9 aa, Homo Sapiens
RLNKKYSIS

SEQ ID NO: 403825 - protein, 9 aa, Homo Sapiens
SNKKKNTQG

SEQ ID NO: 403826 - protein, 9 aa, Homo Sapiens
EWLGLINNS

SEQ ID NO: 403827 - protein, 9 aa, Homo Sapiens
MLAKGYKGF

SEQ ID NO: 403828 - protein, 9 aa, Homo Sapiens
VAIVASDTR

SEQ ID NO: 403829 - protein, 9 aa, Homo Sapiens
LSSTKHWAA

SEQ ID NO: 403830 - protein, 9 aa, Homo Sapiens
EDVAIVASD

SEQ ID NO: 403831 - protein, 9 aa, Homo Sapiens
NIRTWINDL

SEQ ID NO: 403832 - protein, 9 aa, Homo Sapiens
PQREVVNVT

SEQ ID NO: 403833 - protein, 9 aa, Homo Sapiens
TPSLFDSLK

SEQ ID NO: 403834 - protein, 9 aa, Homo Sapiens
AVLNKNMPF

SEQ ID NO: 403835 - protein, 9 aa, Homo Sapiens
WGVKLSLSG

SEQ ID NO: 403836 - protein, 9 aa, Homo Sapiens
QKVTAYTQI

SEQ ID NO: 403837 - protein, 9 aa, Homo Sapiens
DEEQKLHTD

SEQ ID NO: 403838 - protein, 9 aa, Homo Sapiens
DVLEAHKAE

SEQ ID NO: 403839 - protein, 9 aa, Homo Sapiens
LDFDLENTL

SEQ ID NO: 403840 - protein, 9 aa, Homo Sapiens
TWINDLISA

SEQ ID NO: 403841 - protein, 9 aa, Homo Sapiens
LKEHDHLQN

SEQ ID NO: 403842 - protein, 9 aa, Homo Sapiens
IIQTAMSSG

SEQ ID NO: 403843 - protein, 9 aa, Homo Sapiens
LIGLQLLMG

SEQ ID NO: 403844 - protein, 9 aa, Homo Sapiens
ESYSCPSCG

SEQ ID NO: 403845 - protein, 9 aa, Homo Sapiens
DRTPDKLKK

SEQ ID NO: 403846 - protein, 9 aa, Homo Sapiens
YGEQGKPEV

SEQ ID NO: 403847 - protein, 9 aa, Homo Sapiens
LTKDRRLSN

SEQ ID NO: 403848 - protein, 9 aa, Homo Sapiens
AASSAPATR

SEQ ID NO: 403849 - protein, 9 aa, Homo Sapiens
YCKFSLDEL

SEQ ID NO: 403850 - protein, 9 aa, Homo Sapiens
NPHSGAINF

SEQ ID NO: 403851 - protein, 9 aa, Homo Sapiens
TVKLDELEL

SEQ ID NO: 403852 - protein, 9 aa, Homo Sapiens
KWGPKLDIE

SEQ ID NO: 403853 - protein, 9 aa, Homo Sapiens
HFQYQQLEF

SEQ ID NO: 403854 - protein, 9 aa, Homo Sapiens
YTDVCRRYW

SEQ ID NO: 403855 - protein, 9 aa, Homo Sapiens
FKMPKDKGD

SEQ ID NO: 403856 - protein, 9 aa, Homo Sapiens
CYTVCRFSI

SEQ ID NO: 403857 - protein, 9 aa, Homo Sapiens
RKERGMDTF

SEQ ID NO: 403858 - protein, 9 aa, Homo Sapiens
PKKYQVWHH

SEQ ID NO: 403859 - protein, 9 aa, Homo Sapiens
AMEAVHLIC

SEQ ID NO: 403860 - protein, 9 aa, Homo Sapiens
TYTGIIFLE

SEQ ID NO: 403861 - protein, 9 aa, Homo Sapiens
GMVLGGRTF

SEQ ID NO: 403862 - protein, 9 aa, Homo Sapiens
LVEGFDLHG

SEQ ID NO: 403863 - protein, 9 aa, Homo Sapiens
TSVLSGGPL

SEQ ID NO: 403864 - protein, 9 aa, Homo Sapiens
IFILAVMAF

SEQ ID NO: 403865 - protein, 9 aa, Homo Sapiens
KLLCNYTQN

SEQ ID NO: 403866 - protein, 9 aa, Homo Sapiens
TAAAAPAPP

SEQ ID NO: 403867 - protein, 9 aa, Homo Sapiens
LTLSTIKYH

SEQ ID NO: 403868 - protein, 9 aa, Homo Sapiens
QDKIFYPSV

SEQ ID NO: 403869 - protein, 9 aa, Homo Sapiens
SELDNGKRD

SEQ ID NO: 403870 - protein, 9 aa, Homo Sapiens
VMNRRRING

SEQ ID NO: 403871 - protein, 9 aa, Homo Sapiens
QIMMIFYMI

SEQ ID NO: 403872 - protein, 9 aa, Homo Sapiens
CHVLTSGIF

SEQ ID NO: 403873 - protein, 9 aa, Homo Sapiens
EGGDPAYPA

SEQ ID NO: 403874 - protein, 9 aa, Homo Sapiens
TNNERKSTL

SEQ ID NO: 403875 - protein, 9 aa, Homo Sapiens
GIIYIKHPH

SEQ ID NO: 403876 - protein, 9 aa, Homo Sapiens
VTLHATTQA

SEQ ID NO: 403877 - protein, 9 aa, Homo Sapiens
GFQLDTDEC

SEQ ID NO: 403878 - protein, 9 aa, Homo Sapiens
VNKKVKKII

SEQ ID NO: 403879 - protein, 9 aa, Homo Sapiens
YQTAKFHSR

SEQ ID NO: 403880 - protein, 9 aa, Homo Sapiens
SGLYFCGTH

SEQ ID NO: 403881 - protein, 9 aa, Homo Sapiens
TICQNTTLV

SEQ ID NO: 403882 - protein, 9 aa, Homo Sapiens
PKKEAPYML

SEQ ID NO: 403883 - protein, 9 aa, Homo Sapiens
TCLESFCDS

SEQ ID NO: 403884 - protein, 9 aa, Homo Sapiens
AFPSECCSV

SEQ ID NO: 403885 - protein, 9 aa, Homo Sapiens
NTRWIIEKY

SEQ ID NO: 403886 - protein, 9 aa, Homo Sapiens
NGLVVLVFN

SEQ ID NO: 403887 - protein, 9 aa, Homo Sapiens
HNSKDSETH

SEQ ID NO: 403888 - protein, 9 aa, Homo Sapiens
AGTTLGCYN

SEQ ID NO: 403889 - protein, 9 aa, Homo Sapiens
ELIQNYDGK

SEQ ID NO: 403890 - protein, 9 aa, Homo Sapiens
SSELEQYQW

SEQ ID NO: 403891 - protein, 9 aa, Homo Sapiens
KGSGYDKLG

SEQ ID NO: 403892 - protein, 9 aa, Homo Sapiens
RASAALEQL

SEQ ID NO: 403893 - protein, 9 aa, Homo Sapiens
YTLIPDHPN

SEQ ID NO: 403894 - protein, 9 aa, Homo Sapiens
RLAAELNTF

SEQ ID NO: 403895 - protein, 9 aa, Homo Sapiens
LLLSPVSGV

SEQ ID NO: 403896 - protein, 9 aa, Homo Sapiens
QPQEPNVTD

SEQ ID NO: 403897 - protein, 9 aa, Homo Sapiens
LSYLLYALT

SEQ ID NO: 403898 - protein, 9 aa, Homo Sapiens
AVNSHPQHS

SEQ ID NO: 403899 - protein, 9 aa, Homo Sapiens
NERKSTLTP

SEQ ID NO: 403900 - protein, 9 aa, Homo Sapiens
VKLLVLHGA

SEQ ID NO: 403901 - protein, 9 aa, Homo Sapiens
QEDVFIVVN

SEQ ID NO: 403902 - protein, 9 aa, Homo Sapiens
DPNNTGHIC

SEQ ID NO: 403903 - protein, 9 aa, Homo Sapiens
LTMKENKSS

SEQ ID NO: 403904 - protein, 9 aa, Homo Sapiens
MTMAQKLSH

SEQ ID NO: 403905 - protein, 9 aa, Homo Sapiens
QANDCLVLN

SEQ ID NO: 403906 - protein, 9 aa, Homo Sapiens
YKSDPVMRK

SEQ ID NO: 403907 - protein, 9 aa, Homo Sapiens
GKGGHLRFA

SEQ ID NO: 403908 - protein, 9 aa, Homo Sapiens
NNERKSTLT

SEQ ID NO: 403909 - protein, 9 aa, Homo Sapiens
LTQLTFFFL

SEQ ID NO: 403910 - protein, 9 aa, Homo Sapiens
YDNFTKELN

SEQ ID NO: 403911 - protein, 9 aa, Homo Sapiens
IHACYTVCR

SEQ ID NO: 403912 - protein, 9 aa, Homo Sapiens
KRLWVLAVQ

SEQ ID NO: 403913 - protein, 9 aa, Homo Sapiens
IIRRDLPVT

SEQ ID NO: 403914 - protein, 9 aa, Homo Sapiens
SLQGIQLFD

SEQ ID NO: 403915 - protein, 9 aa, Homo Sapiens
KILNSKIIS

SEQ ID NO: 403916 - protein, 9 aa, Homo Sapiens
TWGFHNNLL

SEQ ID NO: 403917 - protein, 9 aa, Homo Sapiens
DGDEIFHAD

SEQ ID NO: 403918 - protein, 9 aa, Homo Sapiens
SNCTYSLSS

SEQ ID NO: 403919 - protein, 9 aa, Homo Sapiens
LDYCHKNNF

SEQ ID NO: 403920 - protein, 9 aa, Homo Sapiens
LSTTMECVP

SEQ ID NO: 403921 - protein, 9 aa, Homo Sapiens
KMRGAGNGI

SEQ ID NO: 403922 - protein, 9 aa, Homo Sapiens
YCQYHPSKG

SEQ ID NO: 403923 - protein, 9 aa, Homo Sapiens
TAGEAVSWD

SEQ ID NO: 403924 - protein, 9 aa, Homo Sapiens
YGYMPLLYM

SEQ ID NO: 403925 - protein, 9 aa, Homo Sapiens
ISFPSFVKK

SEQ ID NO: 403926 - protein, 9 aa, Homo Sapiens
KFLVVFILL

SEQ ID NO: 403927 - protein, 9 aa, Homo Sapiens
KLEMAQEGF

SEQ ID NO: 403928 - protein, 9 aa, Homo Sapiens
NQDNSRPLQ

SEQ ID NO: 403929 - protein, 9 aa, Homo Sapiens
LETPGPSPA

SEQ ID NO: 403930 - protein, 9 aa, Homo Sapiens
HKDKKKTPS

SEQ ID NO: 403931 - protein, 9 aa, Homo Sapiens
KSMGTLDNT

SEQ ID NO: 403932 - protein, 9 aa, Homo Sapiens
LDCSFVASL

SEQ ID NO: 403933 - protein, 9 aa, Homo Sapiens
AESPLETPG

SEQ ID NO: 403934 - protein, 9 aa, Homo Sapiens
TLMEITIIN

SEQ ID NO: 403935 - protein, 9 aa, Homo Sapiens
QRFPKILVF

SEQ ID NO: 403936 - protein, 9 aa, Homo Sapiens
SDNIQIETV

SEQ ID NO: 403937 - protein, 9 aa, Homo Sapiens
LMSSIACWL

SEQ ID NO: 403938 - protein, 9 aa, Homo Sapiens
PESGCLYNI

SEQ ID NO: 403939 - protein, 9 aa, Homo Sapiens
SPSSGLVNG

SEQ ID NO: 403940 - protein, 9 aa, Homo Sapiens
RQLWLWLGG

SEQ ID NO: 403941 - protein, 9 aa, Homo Sapiens
WTICQNTTL

SEQ ID NO: 403942 - protein, 9 aa, Homo Sapiens
AAAAAVVRW

SEQ ID NO: 403943 - protein, 9 aa, Homo Sapiens
EGSLQMKTE

SEQ ID NO: 403944 - protein, 9 aa, Homo Sapiens
NRQRLNKKY

SEQ ID NO: 403945 - protein, 9 aa, Homo Sapiens
AVNVLNLTQ

SEQ ID NO: 403946 - protein, 9 aa, Homo Sapiens
EQLIVEIIQ

SEQ ID NO: 403947 - protein, 9 aa, Homo Sapiens
VLLAGAKVN

SEQ ID NO: 403948 - protein, 9 aa, Homo Sapiens
STFSGFGLI

SEQ ID NO: 403949 - protein, 9 aa, Homo Sapiens
GTNDCGALK

SEQ ID NO: 403950 - protein, 9 aa, Homo Sapiens
RSTLSDSDS

SEQ ID NO: 403951 - protein, 9 aa, Homo Sapiens
KVQNMVSFN

SEQ ID NO: 403952 - protein, 9 aa, Homo Sapiens
LNVHTQTHT

SEQ ID NO: 403953 - protein, 9 aa, Homo Sapiens
QHQDKKLCL

SEQ ID NO: 403954 - protein, 9 aa, Homo Sapiens
EHVVSVHKS

SEQ ID NO: 403955 - protein, 9 aa, Homo Sapiens
SEVDDKLDI

SEQ ID NO: 403956 - protein, 9 aa, Homo Sapiens
SIILTSHSM

SEQ ID NO: 403957 - protein, 9 aa, Homo Sapiens
NNVFDEAIL

SEQ ID NO: 403958 - protein, 9 aa, Homo Sapiens
ALCVLEALN

SEQ ID NO: 403959 - protein, 9 aa, Homo Sapiens
TMDPNNTGH

SEQ ID NO: 403960 - protein, 9 aa, Homo Sapiens
QTILTEIYH

SEQ ID NO: 403961 - protein, 9 aa, Homo Sapiens
ASDNFLGIS

SEQ ID NO: 403962 - protein, 9 aa, Homo Sapiens
NKSTNNERK

SEQ ID NO: 403963 - protein, 9 aa, Homo Sapiens
VVMSWLIFL

SEQ ID NO: 403964 - protein, 9 aa, Homo Sapiens
ELDIQEKPA

SEQ ID NO: 403965 - protein, 9 aa, Homo Sapiens
CGGPCTVMP

SEQ ID NO: 403966 - protein, 9 aa, Homo Sapiens
PLNQTYNTV

SEQ ID NO: 403967 - protein, 9 aa, Homo Sapiens
STIKYHSWH

SEQ ID NO: 403968 - protein, 9 aa, Homo Sapiens
PPNGHHIGT

SEQ ID NO: 403969 - protein, 9 aa, Homo Sapiens
VCYALCSLS

SEQ ID NO: 403970 - protein, 9 aa, Homo Sapiens
HIVHSDNWV

SEQ ID NO: 403971 - protein, 9 aa, Homo Sapiens
KLTHCPDTP

SEQ ID NO: 403972 - protein, 9 aa, Homo Sapiens
DKKKTPSSP

SEQ ID NO: 403973 - protein, 9 aa, Homo Sapiens
DQGTYSCVS

SEQ ID NO: 403974 - protein, 9 aa, Homo Sapiens
QIQKMAEYY

SEQ ID NO: 403975 - protein, 9 aa, Homo Sapiens
ETPLNQTYN

SEQ ID NO: 403976 - protein, 9 aa, Homo Sapiens
VDLLDILIR

SEQ ID NO: 403977 - protein, 9 aa, Homo Sapiens
GGVIPQYHS

SEQ ID NO: 403978 - protein, 9 aa, Homo Sapiens
TKFQYLNVA

SEQ ID NO: 403979 - protein, 9 aa, Homo Sapiens
SSSLGGRTV

SEQ ID NO: 403980 - protein, 9 aa, Homo Sapiens
NCGAWSKSE

SEQ ID NO: 403981 - protein, 9 aa, Homo Sapiens
LNLTQLTFF

SEQ ID NO: 403982 - protein, 9 aa, Homo Sapiens
LLDDSPSCP

SEQ ID NO: 403983 - protein, 9 aa, Homo Sapiens
YRSSKRTEH

SEQ ID NO: 403984 - protein, 9 aa, Homo Sapiens
YLRKNLSIQ

SEQ ID NO: 403985 - protein, 9 aa, Homo Sapiens
ADLGHNAWL

SEQ ID NO: 403986 - protein, 9 aa, Homo Sapiens
WEIGYLNRT

SEQ ID NO: 403987 - protein, 9 aa, Homo Sapiens
QIHTGHKPF

SEQ ID NO: 403988 - protein, 9 aa, Homo Sapiens
DRRLSNKKK

SEQ ID NO: 403989 - protein, 9 aa, Homo Sapiens
EITHTGEKP

SEQ ID NO: 403990 - protein, 9 aa, Homo Sapiens
VTMASTKKL

SEQ ID NO: 403991 - protein, 9 aa, Homo Sapiens
EHKDKKKTP

SEQ ID NO: 403992 - protein, 9 aa, Homo Sapiens
AKMIYSELI

SEQ ID NO: 403993 - protein, 9 aa, Homo Sapiens
TTYASAHLT

SEQ ID NO: 403994 - protein, 9 aa, Homo Sapiens
VPAINLARV

SEQ ID NO: 403995 - protein, 9 aa, Homo Sapiens
KKIKKTKVE

SEQ ID NO: 403996 - protein, 9 aa, Homo Sapiens
SPFRNPQKI

SEQ ID NO: 403997 - protein, 9 aa, Homo Sapiens
GLCIIINNN

SEQ ID NO: 403998 - protein, 9 aa, Homo Sapiens
CTVMPGGSA

SEQ ID NO: 403999 - protein, 9 aa, Homo Sapiens
LFFSLGTTE

SEQ ID NO: 404000 - protein, 9 aa, Homo Sapiens
PGSSRKSNK

SEQ ID NO: 404001 - protein, 9 aa, Homo Sapiens
NKKHKKKRL

SEQ ID NO: 404002 - protein, 9 aa, Homo Sapiens
VTMSTPQTA

SEQ ID NO: 404003 - protein, 9 aa, Homo Sapiens
DMQIKKKQR

SEQ ID NO: 404004 - protein, 9 aa, Homo Sapiens
RLKTMEVRE

SEQ ID NO: 404005 - protein, 9 aa, Homo Sapiens
HKNNFLHRD

SEQ ID NO: 404006 - protein, 9 aa, Homo Sapiens
RVLDNILQP

SEQ ID NO: 404007 - protein, 9 aa, Homo Sapiens
LKKHNIIHT

SEQ ID NO: 404008 - protein, 9 aa, Homo Sapiens
GTRGIIYIK

SEQ ID NO: 404009 - protein, 9 aa, Homo Sapiens
FVGMCGDGT

SEQ ID NO: 404010 - protein, 9 aa, Homo Sapiens
IHAVDKPFK

SEQ ID NO: 404011 - protein, 9 aa, Homo Sapiens
ARSHRDTTT

SEQ ID NO: 404012 - protein, 9 aa, Homo Sapiens
DYWGKFGEL

SEQ ID NO: 404013 - protein, 9 aa, Homo Sapiens
ISKTFEINQ

SEQ ID NO: 404014 - protein, 9 aa, Homo Sapiens
DLLRCHVLT

SEQ ID NO: 404015 - protein, 9 aa, Homo Sapiens
RTPISNYIM

SEQ ID NO: 404016 - protein, 9 aa, Homo Sapiens
SDDPPWSWN

SEQ ID NO: 404017 - protein, 9 aa, Homo Sapiens
AGMVLGGRT

SEQ ID NO: 404018 - protein, 9 aa, Homo Sapiens
QKCEENLRK

SEQ ID NO: 404019 - protein, 9 aa, Homo Sapiens
ECHCIAVQN

SEQ ID NO: 404020 - protein, 9 aa, Homo Sapiens
KNYMKGLPK

SEQ ID NO: 404021 - protein, 9 aa, Homo Sapiens
EVGYLELTG

SEQ ID NO: 404022 - protein, 9 aa, Homo Sapiens
LTAKEGHLR

SEQ ID NO: 404023 - protein, 9 aa, Homo Sapiens
NVPAAYCGV

SEQ ID NO: 404024 - protein, 9 aa, Homo Sapiens
EGQCQIEYK

SEQ ID NO: 404025 - protein, 9 aa, Homo Sapiens
QAPPEDEGP

SEQ ID NO: 404026 - protein, 9 aa, Homo Sapiens
VKKLLISLC

SEQ ID NO: 404027 - protein, 9 aa, Homo Sapiens
KTFQLIWEK

SEQ ID NO: 404028 - protein, 9 aa, Homo Sapiens
ETNTYTVLI

SEQ ID NO: 404029 - protein, 9 aa, Homo Sapiens
PRGCSGIIS

SEQ ID NO: 404030 - protein, 9 aa, Homo Sapiens
CTFKFRFWS

SEQ ID NO: 404031 - protein, 9 aa, Homo Sapiens
YHILPERRS

SEQ ID NO: 404032 - protein, 9 aa, Homo Sapiens
FGIRGNKLH

SEQ ID NO: 404033 - protein, 9 aa, Homo Sapiens
LKKQRLKLE

SEQ ID NO: 404034 - protein, 9 aa, Homo Sapiens
RAFVHKSSI

SEQ ID NO: 404035 - protein, 9 aa, Homo Sapiens
AGVQKLTHC

SEQ ID NO: 404036 - protein, 9 aa, Homo Sapiens
KLEVQAFKR

SEQ ID NO: 404037 - protein, 9 aa, Homo Sapiens
LINSENVFK

SEQ ID NO: 404038 - protein, 9 aa, Homo Sapiens
SPTQNIEKK

SEQ ID NO: 404039 - protein, 9 aa, Homo Sapiens
WINRRTIGF

SEQ ID NO: 404040 - protein, 9 aa, Homo Sapiens
QQNKLWVGQ

SEQ ID NO: 404041 - protein, 9 aa, Homo Sapiens
SRLAWKEVN

SEQ ID NO: 404042 - protein, 9 aa, Homo Sapiens
KHFQKYHLG

SEQ ID NO: 404043 - protein, 9 aa, Homo Sapiens
QVEIKRLHT

SEQ ID NO: 404044 - protein, 9 aa, Homo Sapiens
SEEAIIGGE

SEQ ID NO: 404045 - protein, 9 aa, Homo Sapiens
EASGHTYNP

SEQ ID NO: 404046 - protein, 9 aa, Homo Sapiens
EDISKTFEI

SEQ ID NO: 404047 - protein, 9 aa, Homo Sapiens
SSPTYECVH

SEQ ID NO: 404048 - protein, 9 aa, Homo Sapiens
IIKECINKT

SEQ ID NO: 404049 - protein, 9 aa, Homo Sapiens
KVAMVLKEC

SEQ ID NO: 404050 - protein, 9 aa, Homo Sapiens
KETGNPLDM

SEQ ID NO: 404051 - protein, 9 aa, Homo Sapiens
LWRVPGPDQ

SEQ ID NO: 404052 - protein, 9 aa, Homo Sapiens
RKQSIEISR

SEQ ID NO: 404053 - protein, 9 aa, Homo Sapiens
WLLAPVSSI

SEQ ID NO: 404054 - protein, 9 aa, Homo Sapiens
NKNRELEEE

SEQ ID NO: 404055 - protein, 9 aa, Homo Sapiens
SSLSNHQII

SEQ ID NO: 404056 - protein, 9 aa, Homo Sapiens
QFQKVKLRC

SEQ ID NO: 404057 - protein, 9 aa, Homo Sapiens
QQLVRVLDN

SEQ ID NO: 404058 - protein, 9 aa, Homo Sapiens
NNNFHKSTG

SEQ ID NO: 404059 - protein, 9 aa, Homo Sapiens
ACVPEVCVL

SEQ ID NO: 404060 - protein, 9 aa, Homo Sapiens
DLSISQLLS

SEQ ID NO: 404061 - protein, 9 aa, Homo Sapiens
HSRFILGSV

SEQ ID NO: 404062 - protein, 9 aa, Homo Sapiens
IHAKITYRE

SEQ ID NO: 404063 - protein, 9 aa, Homo Sapiens
WLSDQGWEY

SEQ ID NO: 404064 - protein, 9 aa, Homo Sapiens
LTTEQSGIY

SEQ ID NO: 404065 - protein, 9 aa, Homo Sapiens
IAMLAKGYK

SEQ ID NO: 404066 - protein, 9 aa, Homo Sapiens
RLNIFKLSK

SEQ ID NO: 404067 - protein, 9 aa, Homo Sapiens
RSQKEPLQA

SEQ ID NO: 404068 - protein, 9 aa, Homo Sapiens
AAAVMGGVF

SEQ ID NO: 404069 - protein, 9 aa, Homo Sapiens
RRLQIRYGQ

SEQ ID NO: 404070 - protein, 9 aa, Homo Sapiens
KLYDTIQNE

SEQ ID NO: 404071 - protein, 9 aa, Homo Sapiens
NPLEENVTR

SEQ ID NO: 404072 - protein, 9 aa, Homo Sapiens
SNNFKSVKR

SEQ ID NO: 404073 - protein, 9 aa, Homo Sapiens
SSTLTNHKI

SEQ ID NO: 404074 - protein, 9 aa, Homo Sapiens
CVLSITATT

SEQ ID NO: 404075 - protein, 9 aa, Homo Sapiens
YLSLRTRLL

SEQ ID NO: 404076 - protein, 9 aa, Homo Sapiens
RVQFQSRNV

SEQ ID NO: 404077 - protein, 9 aa, Homo Sapiens
QHQIIHSGE

SEQ ID NO: 404078 - protein, 9 aa, Homo Sapiens
QIKKKQRQR

SEQ ID NO: 404079 - protein, 9 aa, Homo Sapiens
LFDDLGDEL

SEQ ID NO: 404080 - protein, 9 aa, Homo Sapiens
MKQINDAHH

SEQ ID NO: 404081 - protein, 9 aa, Homo Sapiens
NTFKPNENT

SEQ ID NO: 404082 - protein, 9 aa, Homo Sapiens
TIDEDCSQY

SEQ ID NO: 404083 - protein, 9 aa, Homo Sapiens
ECINKTLTD

SEQ ID NO: 404084 - protein, 9 aa, Homo Sapiens
IGVILRLSH

SEQ ID NO: 404085 - protein, 9 aa, Homo Sapiens
LSNTSTTTM

SEQ ID NO: 404086 - protein, 9 aa, Homo Sapiens
SVFQNESVA

SEQ ID NO: 404087 - protein, 9 aa, Homo Sapiens
WRRGSSIPQ

SEQ ID NO: 404088 - protein, 9 aa, Homo Sapiens
LPLSLKDLS

SEQ ID NO: 404089 - protein, 9 aa, Homo Sapiens
QIGKIGEGS

SEQ ID NO: 404090 - protein, 9 aa, Homo Sapiens
VAKLGNFGI

SEQ ID NO: 404091 - protein, 9 aa, Homo Sapiens
NNELFAYAA

SEQ ID NO: 404092 - protein, 9 aa, Homo Sapiens
QIANLTNQR

SEQ ID NO: 404093 - protein, 9 aa, Homo Sapiens
NYMKGLPKL

SEQ ID NO: 404094 - protein, 9 aa, Homo Sapiens
ITLSQRALQ

SEQ ID NO: 404095 - protein, 9 aa, Homo Sapiens
AMVLKECID

SEQ ID NO: 404096 - protein, 9 aa, Homo Sapiens
VCAILNRMC

SEQ ID NO: 404097 - protein, 9 aa, Homo Sapiens
IKALKGDHR

SEQ ID NO: 404098 - protein, 9 aa, Homo Sapiens
VTVLLYTMT

SEQ ID NO: 404099 - protein, 9 aa, Homo Sapiens
MSRNPFAHI

SEQ ID NO: 404100 - protein, 9 aa, Homo Sapiens
WIEIIALSL

SEQ ID NO: 404101 - protein, 9 aa, Homo Sapiens
SPDQAPPED

SEQ ID NO: 404102 - protein, 9 aa, Homo Sapiens
AYIVTSLLE

SEQ ID NO: 404103 - protein, 9 aa, Homo Sapiens
KEKCEGFKL

SEQ ID NO: 404104 - protein, 9 aa, Homo Sapiens
AKGSGYDKL

SEQ ID NO: 404105 - protein, 9 aa, Homo Sapiens
KCNDIGHKI

SEQ ID NO: 404106 - protein, 9 aa, Homo Sapiens
PVHIVHSDN

SEQ ID NO: 404107 - protein, 9 aa, Homo Sapiens
HNSIYQESA

SEQ ID NO: 404108 - protein, 9 aa, Homo Sapiens
PMDDKSLEE

SEQ ID NO: 404109 - protein, 9 aa, Homo Sapiens
AELVELIVE

SEQ ID NO: 404110 - protein, 9 aa, Homo Sapiens
VCFIADHMR

SEQ ID NO: 404111 - protein, 9 aa, Homo Sapiens
AASVLCRKL

SEQ ID NO: 404112 - protein, 9 aa, Homo Sapiens
HCVDTSQDI

SEQ ID NO: 404113 - protein, 9 aa, Homo Sapiens
YDQAKLSQI

SEQ ID NO: 404114 - protein, 9 aa, Homo Sapiens
NLKSLVDPN

SEQ ID NO: 404115 - protein, 9 aa, Homo Sapiens
DKTLCIIDP

SEQ ID NO: 404116 - protein, 9 aa, Homo Sapiens
LVKDIQIIV

SEQ ID NO: 404117 - protein, 9 aa, Homo Sapiens
TPLNQTYNT

SEQ ID NO: 404118 - protein, 9 aa, Homo Sapiens
RQFVKQIGY

SEQ ID NO: 404119 - protein, 9 aa, Homo Sapiens
PFLFLIRNR

SEQ ID NO: 404120 - protein, 9 aa, Homo Sapiens
VKVLSKPLN

SEQ ID NO: 404121 - protein, 9 aa, Homo Sapiens
EGLDYCHKN

SEQ ID NO: 404122 - protein, 9 aa, Homo Sapiens
QKYHLGLHN

SEQ ID NO: 404123 - protein, 9 aa, Homo Sapiens
HAADLHASS

SEQ ID NO: 404124 - protein, 9 aa, Homo Sapiens
RIKELEAIG

SEQ ID NO: 404125 - protein, 9 aa, Homo Sapiens
FQMLIIEKV

SEQ ID NO: 404126 - protein, 9 aa, Homo Sapiens
VGNHYEDLD

SEQ ID NO: 404127 - protein, 9 aa, Homo Sapiens
MEVEGPENQ

SEQ ID NO: 404128 - protein, 9 aa, Homo Sapiens
TETIIYSLE

SEQ ID NO: 404129 - protein, 9 aa, Homo Sapiens
VLLSFCYKV

SEQ ID NO: 404130 - protein, 9 aa, Homo Sapiens
NLSLTTEQS

SEQ ID NO: 404131 - protein, 9 aa, Homo Sapiens
YFEGYSLDN

SEQ ID NO: 404132 - protein, 9 aa, Homo Sapiens
LYRQWTNRI

SEQ ID NO: 404133 - protein, 9 aa, Homo Sapiens
ADQIRNKNR

SEQ ID NO: 404134 - protein, 9 aa, Homo Sapiens
LEYRKYQPN

SEQ ID NO: 404135 - protein, 9 aa, Homo Sapiens
SYLQKTPVW

SEQ ID NO: 404136 - protein, 9 aa, Homo Sapiens
ILLCAILQH

SEQ ID NO: 404137 - protein, 9 aa, Homo Sapiens
LKKKLLEQE

SEQ ID NO: 404138 - protein, 9 aa, Homo Sapiens
RYRQFVKQI

SEQ ID NO: 404139 - protein, 9 aa, Homo Sapiens
KFTASFLLF

SEQ ID NO: 404140 - protein, 9 aa, Homo Sapiens
RALKSKLTQ

SEQ ID NO: 404141 - protein, 9 aa, Homo Sapiens
LLSSRNTIS

SEQ ID NO: 404142 - protein, 9 aa, Homo Sapiens
LFLEPTQKD

SEQ ID NO: 404143 - protein, 9 aa, Homo Sapiens
FSENNGFSL

SEQ ID NO: 404144 - protein, 9 aa, Homo Sapiens
DGTYTGIIF

SEQ ID NO: 404145 - protein, 9 aa, Homo Sapiens
QVILKSTSV

SEQ ID NO: 404146 - protein, 9 aa, Homo Sapiens
IPMIKALLR

SEQ ID NO: 404147 - protein, 9 aa, Homo Sapiens
KCFKTQPLY

SEQ ID NO: 404148 - protein, 9 aa, Homo Sapiens
LWLSGLGGC

SEQ ID NO: 404149 - protein, 9 aa, Homo Sapiens
REEEKHIKA

SEQ ID NO: 404150 - protein, 9 aa, Homo Sapiens
QIIHGNDPN

SEQ ID NO: 404151 - protein, 9 aa, Homo Sapiens
LQADVDTTL

SEQ ID NO: 404152 - protein, 9 aa, Homo Sapiens
KYWAPHINK

SEQ ID NO: 404153 - protein, 9 aa, Homo Sapiens
NDLCKTTIT

SEQ ID NO: 404154 - protein, 9 aa, Homo Sapiens
NMIATDPDD

SEQ ID NO: 404155 - protein, 9 aa, Homo Sapiens
RLSNKKKNT

SEQ ID NO: 404156 - protein, 9 aa, Homo Sapiens
TSKRHFKLE

SEQ ID NO: 404157 - protein, 9 aa, Homo Sapiens
SHLTVVAIC

SEQ ID NO: 404158 - protein, 9 aa, Homo Sapiens
STPLPGTRV

SEQ ID NO: 404159 - protein, 9 aa, Homo Sapiens
EPTQKDIAL

SEQ ID NO: 404160 - protein, 9 aa, Homo Sapiens
NLEDESISL

SEQ ID NO: 404161 - protein, 9 aa, Homo Sapiens
DYIIQEGAV

SEQ ID NO: 404162 - protein, 9 aa, Homo Sapiens
AHHNKYGSN

SEQ ID NO: 404163 - protein, 9 aa, Homo Sapiens
QAGAKKHSQ

SEQ ID NO: 404164 - protein, 9 aa, Homo Sapiens
NEEINGNLE

SEQ ID NO: 404165 - protein, 9 aa, Homo Sapiens
VVFGIIGIN

SEQ ID NO: 404166 - protein, 9 aa, Homo Sapiens
ALYKSVQNG

SEQ ID NO: 404167 - protein, 9 aa, Homo Sapiens
SQSQAILQQ

SEQ ID NO: 404168 - protein, 9 aa, Homo Sapiens
SYMSTLLAE

SEQ ID NO: 404169 - protein, 9 aa, Homo Sapiens
FNYDWYNVS

SEQ ID NO: 404170 - protein, 9 aa, Homo Sapiens
PDQYLISAY

SEQ ID NO: 404171 - protein, 9 aa, Homo Sapiens
QDKKLCLGI

SEQ ID NO: 404172 - protein, 9 aa, Homo Sapiens
PGLNAKLLY

SEQ ID NO: 404173 - protein, 9 aa, Homo Sapiens
HFPKHAADL

SEQ ID NO: 404174 - protein, 9 aa, Homo Sapiens
AETDCQYVS

SEQ ID NO: 404175 - protein, 9 aa, Homo Sapiens
LLMKIKNQP

SEQ ID NO: 404176 - protein, 9 aa, Homo Sapiens
EKKKPHINK

SEQ ID NO: 404177 - protein, 9 aa, Homo Sapiens
TESLWEATR

SEQ ID NO: 404178 - protein, 9 aa, Homo Sapiens
SAVAELDHL

SEQ ID NO: 404179 - protein, 9 aa, Homo Sapiens
LFCLNFLVV

SEQ ID NO: 404180 - protein, 9 aa, Homo Sapiens
EKFQMRKII

SEQ ID NO: 404181 - protein, 9 aa, Homo Sapiens
PLQKDKKEK

SEQ ID NO: 404182 - protein, 9 aa, Homo Sapiens
LQMCKWAIN

SEQ ID NO: 404183 - protein, 9 aa, Homo Sapiens
WYFLIMPSY

SEQ ID NO: 404184 - protein, 9 aa, Homo Sapiens
KSQRKLKKQ

SEQ ID NO: 404185 - protein, 9 aa, Homo Sapiens
GREQGVISL

SEQ ID NO: 404186 - protein, 9 aa, Homo Sapiens
TKARHIQRS

SEQ ID NO: 404187 - protein, 9 aa, Homo Sapiens
QQQKCEENL

SEQ ID NO: 404188 - protein, 9 aa, Homo Sapiens
TATMNTTNQ

SEQ ID NO: 404189 - protein, 9 aa, Homo Sapiens
EAMEAVHLI

SEQ ID NO: 404190 - protein, 9 aa, Homo Sapiens
ATRTSYSEG

SEQ ID NO: 404191 - protein, 9 aa, Homo Sapiens
IIILSYVLS

SEQ ID NO: 404192 - protein, 9 aa, Homo Sapiens
RPPHNWMKY

SEQ ID NO: 404193 - protein, 9 aa, Homo Sapiens
HILPERRSM

SEQ ID NO: 404194 - protein, 9 aa, Homo Sapiens
LKTISESYS

SEQ ID NO: 404195 - protein, 9 aa, Homo Sapiens
GKLLGTHIS

SEQ ID NO: 404196 - protein, 9 aa, Homo Sapiens
VKINTWRAL

SEQ ID NO: 404197 - protein, 9 aa, Homo Sapiens
EMGCTEYIC

SEQ ID NO: 404198 - protein, 9 aa, Homo Sapiens
ESQKVKAKK

SEQ ID NO: 404199 - protein, 9 aa, Homo Sapiens
YFCIEVGKN

SEQ ID NO: 404200 - protein, 9 aa, Homo Sapiens
QTPSLGQFS

SEQ ID NO: 404201 - protein, 9 aa, Homo Sapiens
INNSRFYNY

SEQ ID NO: 404202 - protein, 9 aa, Homo Sapiens
AFSVCSSRT

SEQ ID NO: 404203 - protein, 9 aa, Homo Sapiens
QNHQESIKF

SEQ ID NO: 404204 - protein, 9 aa, Homo Sapiens
FEDIRSRLI

SEQ ID NO: 404205 - protein, 9 aa, Homo Sapiens
SSGENKRKQ

SEQ ID NO: 404206 - protein, 9 aa, Homo Sapiens
STSVLSGGP

SEQ ID NO: 404207 - protein, 9 aa, Homo Sapiens
DIQHIPSLP

SEQ ID NO: 404208 - protein, 9 aa, Homo Sapiens
KRLREEEKH

SEQ ID NO: 404209 - protein, 9 aa, Homo Sapiens
KVIYTAEKP

SEQ ID NO: 404210 - protein, 9 aa, Homo Sapiens
VDMLKYQAS

SEQ ID NO: 404211 - protein, 9 aa, Homo Sapiens
IATVGESYR

SEQ ID NO: 404212 - protein, 9 aa, Homo Sapiens
LEELTLRES

SEQ ID NO: 404213 - protein, 9 aa, Homo Sapiens
AQENVQGVV

SEQ ID NO: 404214 - protein, 9 aa, Homo Sapiens
SNYFATDLS

SEQ ID NO: 404215 - protein, 9 aa, Homo Sapiens
DNHVVATGG

SEQ ID NO: 404216 - protein, 9 aa, Homo Sapiens
QLHDHAQGL

SEQ ID NO: 404217 - protein, 9 aa, Homo Sapiens
KSSPTQNIE

SEQ ID NO: 404218 - protein, 9 aa, Homo Sapiens
WNPIYQENN

SEQ ID NO: 404219 - protein, 9 aa, Homo Sapiens
NDPNYIVMQ

SEQ ID NO: 404220 - protein, 9 aa, Homo Sapiens
PVYSSCKGG

SEQ ID NO: 404221 - protein, 9 aa, Homo Sapiens
VNKTVDKGK

SEQ ID NO: 404222 - protein, 9 aa, Homo Sapiens
LDIQEKPAL

SEQ ID NO: 404223 - protein, 9 aa, Homo Sapiens
QDLFIVLIL

SEQ ID NO: 404224 - protein, 9 aa, Homo Sapiens
TNQRKYITK

SEQ ID NO: 404225 - protein, 9 aa, Homo Sapiens
KQGFSSRLG

SEQ ID NO: 404226 - protein, 9 aa, Homo Sapiens
TTTMVMPIV

SEQ ID NO: 404227 - protein, 9 aa, Homo Sapiens
TLTCMQYVH

SEQ ID NO: 404228 - protein, 9 aa, Homo Sapiens
LSLVNTVCD

SEQ ID NO: 404229 - protein, 9 aa, Homo Sapiens
PETVLLSFC

SEQ ID NO: 404230 - protein, 9 aa, Homo Sapiens
HTKYLKNQE

SEQ ID NO: 404231 - protein, 9 aa, Homo Sapiens
TQTYQEKVC

SEQ ID NO: 404232 - protein, 9 aa, Homo Sapiens
NFGIARVLN

SEQ ID NO: 404233 - protein, 9 aa, Homo Sapiens
SQILDVAQD

SEQ ID NO: 404234 - protein, 9 aa, Homo Sapiens
DNNPIFPQA

SEQ ID NO: 404235 - protein, 9 aa, Homo Sapiens
LDTFNYDWY

SEQ ID NO: 404236 - protein, 9 aa, Homo Sapiens
LLREGKLLG

SEQ ID NO: 404237 - protein, 9 aa, Homo Sapiens
TPSLGQFSS

SEQ ID NO: 404238 - protein, 9 aa, Homo Sapiens
VKHYKICKL

SEQ ID NO: 404239 - protein, 9 aa, Homo Sapiens
LCHGCSLLM

SEQ ID NO: 404240 - protein, 9 aa, Homo Sapiens
AGLLGSDDP

SEQ ID NO: 404241 - protein, 9 aa, Homo Sapiens
TMSSRVHKA

SEQ ID NO: 404242 - protein, 9 aa, Homo Sapiens
SLLALYKSV

SEQ ID NO: 404243 - protein, 9 aa, Homo Sapiens
LFKHLDYAS

SEQ ID NO: 404244 - protein, 9 aa, Homo Sapiens
HSFQIHEIT

SEQ ID NO: 404245 - protein, 9 aa, Homo Sapiens
TNPYTDVCR

SEQ ID NO: 404246 - protein, 9 aa, Homo Sapiens
NFINYCESP

SEQ ID NO: 404247 - protein, 9 aa, Homo Sapiens
SCNSILNQP

SEQ ID NO: 404248 - protein, 9 aa, Homo Sapiens
NKAIDMNIN

SEQ ID NO: 404249 - protein, 9 aa, Homo Sapiens
TEIGVILRL

SEQ ID NO: 404250 - protein, 9 aa, Homo Sapiens
KKWNLPVVT

SEQ ID NO: 404251 - protein, 9 aa, Homo Sapiens
GQGKRKILF

SEQ ID NO: 404252 - protein, 9 aa, Homo Sapiens
TVLELCILL

SEQ ID NO: 404253 - protein, 9 aa, Homo Sapiens
LQISYDTLK

SEQ ID NO: 404254 - protein, 9 aa, Homo Sapiens
ETFFLLRGN

SEQ ID NO: 404255 - protein, 9 aa, Homo Sapiens
SPGRKFKQY

SEQ ID NO: 404256 - protein, 9 aa, Homo Sapiens
LVRIVVTQS

SEQ ID NO: 404257 - protein, 9 aa, Homo Sapiens
IGSGPTVCQ

SEQ ID NO: 404258 - protein, 9 aa, Homo Sapiens
SIYQESALY

SEQ ID NO: 404259 - protein, 9 aa, Homo Sapiens
KKPYPRKKE

SEQ ID NO: 404260 - protein, 9 aa, Homo Sapiens
VRLKLGLVE

SEQ ID NO: 404261 - protein, 9 aa, Homo Sapiens
IINDTFSDS

SEQ ID NO: 404262 - protein, 9 aa, Homo Sapiens
WIKLFFKIK

SEQ ID NO: 404263 - protein, 9 aa, Homo Sapiens
KISFAVTET

SEQ ID NO: 404264 - protein, 9 aa, Homo Sapiens
IRSVSSQRS

SEQ ID NO: 404265 - protein, 9 aa, Homo Sapiens
PHINKPLNA

SEQ ID NO: 404266 - protein, 9 aa, Homo Sapiens
NNSTCIDLY

SEQ ID NO: 404267 - protein, 9 aa, Homo Sapiens
QSSLSTSIV

SEQ ID NO: 404268 - protein, 9 aa, Homo Sapiens
ELEYDNFSE

SEQ ID NO: 404269 - protein, 9 aa, Homo Sapiens
CNRQSEAAD

SEQ ID NO: 404270 - protein, 9 aa, Homo Sapiens
SLYSLNISW

SEQ ID NO: 404271 - protein, 9 aa, Homo Sapiens
SAFTTYTVV

SEQ ID NO: 404272 - protein, 9 aa, Homo Sapiens
ACGGPCTVM

SEQ ID NO: 404273 - protein, 9 aa, Homo Sapiens
HSCNSILNQ

SEQ ID NO: 404274 - protein, 9 aa, Homo Sapiens
ASYLQMNYV

SEQ ID NO: 404275 - protein, 9 aa, Homo Sapiens
KILVFHLKR

SEQ ID NO: 404276 - protein, 9 aa, Homo Sapiens
FQMSEDKPQ

SEQ ID NO: 404277 - protein, 9 aa, Homo Sapiens
PNFTRARLN

SEQ ID NO: 404278 - protein, 9 aa, Homo Sapiens
AEAIHLPQV

SEQ ID NO: 404279 - protein, 9 aa, Homo Sapiens
SISVVLTQT

SEQ ID NO: 404280 - protein, 9 aa, Homo Sapiens
YDVIPEEIL

SEQ ID NO: 404281 - protein, 9 aa, Homo Sapiens
KDLSISQLL

SEQ ID NO: 404282 - protein, 9 aa, Homo Sapiens
KKHTGKQVA

SEQ ID NO: 404283 - protein, 9 aa, Homo Sapiens
AWKEVNKHI

SEQ ID NO: 404284 - protein, 9 aa, Homo Sapiens
LDIPATECE

SEQ ID NO: 404285 - protein, 9 aa, Homo Sapiens
KELSEGRNS

SEQ ID NO: 404286 - protein, 9 aa, Homo Sapiens
VFFIIFAKI

SEQ ID NO: 404287 - protein, 9 aa, Homo Sapiens
VVAVDADLG

SEQ ID NO: 404288 - protein, 9 aa, Homo Sapiens
KGPHSSRDT

SEQ ID NO: 404289 - protein, 9 aa, Homo Sapiens
SQSTSDYLT

SEQ ID NO: 404290 - protein, 9 aa, Homo Sapiens
ENTRWIIEK

SEQ ID NO: 404291 - protein, 9 aa, Homo Sapiens
IQDSQTFST

SEQ ID NO: 404292 - protein, 9 aa, Homo Sapiens
NLTATMNTT

SEQ ID NO: 404293 - protein, 9 aa, Homo Sapiens
TLHATTQAP

SEQ ID NO: 404294 - protein, 9 aa, Homo Sapiens
HSPSSGLVN

SEQ ID NO: 404295 - protein, 9 aa, Homo Sapiens
YQKCHRTTV

SEQ ID NO: 404296 - protein, 9 aa, Homo Sapiens
AFVHKSSIL

SEQ ID NO: 404297 - protein, 9 aa, Homo Sapiens
DVNKCEASV

SEQ ID NO: 404298 - protein, 9 aa, Homo Sapiens
VICMNDAPT

SEQ ID NO: 404299 - protein, 9 aa, Homo Sapiens
PPGTIRGYF

SEQ ID NO: 404300 - protein, 9 aa, Homo Sapiens
RKSNKRAFK

SEQ ID NO: 404301 - protein, 9 aa, Homo Sapiens
SRNPFAHIQ

SEQ ID NO: 404302 - protein, 9 aa, Homo Sapiens
CTYSLSSLN

SEQ ID NO: 404303 - protein, 9 aa, Homo Sapiens
IMNFINYCE

SEQ ID NO: 404304 - protein, 9 aa, Homo Sapiens
KMSPHTGDA

SEQ ID NO: 404305 - protein, 9 aa, Homo Sapiens
LAEAKMTFM

SEQ ID NO: 404306 - protein, 9 aa, Homo Sapiens
YFEEEGEDL

SEQ ID NO: 404307 - protein, 9 aa, Homo Sapiens
AQFLVAFES

SEQ ID NO: 404308 - protein, 9 aa, Homo Sapiens
PYPLQIKSS

SEQ ID NO: 404309 - protein, 9 aa, Homo Sapiens
GQPSPVEPQ

SEQ ID NO: 404310 - protein, 9 aa, Homo Sapiens
LAAELNTFM

SEQ ID NO: 404311 - protein, 9 aa, Homo Sapiens
DGVCFIADH

SEQ ID NO: 404312 - protein, 9 aa, Homo Sapiens
EEAVQRVLA

SEQ ID NO: 404313 - protein, 9 aa, Homo Sapiens
PLSLKDLSP

SEQ ID NO: 404314 - protein, 9 aa, Homo Sapiens
VNLPATQLQ

SEQ ID NO: 404315 - protein, 9 aa, Homo Sapiens
LIHQKKMSP

SEQ ID NO: 404316 - protein, 9 aa, Homo Sapiens
ENLEKEYKE

SEQ ID NO: 404317 - protein, 9 aa, Homo Sapiens
TAQNNLYRN

SEQ ID NO: 404318 - protein, 9 aa, Homo Sapiens
RESYMSTLL

SEQ ID NO: 404319 - protein, 9 aa, Homo Sapiens
LAYDQAHLS

SEQ ID NO: 404320 - protein, 9 aa, Homo Sapiens
RLFSYFGQD

SEQ ID NO: 404321 - protein, 9 aa, Homo Sapiens
FYCIKVSYF

SEQ ID NO: 404322 - protein, 9 aa, Homo Sapiens
NLSNCTSHW

SEQ ID NO: 404323 - protein, 9 aa, Homo Sapiens
LRRKRSMGL

SEQ ID NO: 404324 - protein, 9 aa, Homo Sapiens
DRHNGVPSH

SEQ ID NO: 404325 - protein, 9 aa, Homo Sapiens
HFTEAGLKM

SEQ ID NO: 404326 - protein, 9 aa, Homo Sapiens
ISTINFHSV

SEQ ID NO: 404327 - protein, 9 aa, Homo Sapiens
SLTNNFNKD

SEQ ID NO: 404328 - protein, 9 aa, Homo Sapiens
DKRHASDFT

SEQ ID NO: 404329 - protein, 9 aa, Homo Sapiens
VCHTALVLF

SEQ ID NO: 404330 - protein, 9 aa, Homo Sapiens
KSSNVMRYI

SEQ ID NO: 404331 - protein, 9 aa, Homo Sapiens
TDVCRRYWN

SEQ ID NO: 404332 - protein, 9 aa, Homo Sapiens
PATQLQIAM

SEQ ID NO: 404333 - protein, 9 aa, Homo Sapiens
GWFPTPRCI

SEQ ID NO: 404334 - protein, 9 aa, Homo Sapiens
GIECSSFQD

SEQ ID NO: 404335 - protein, 9 aa, Homo Sapiens
SSPTQNIEK

SEQ ID NO: 404336 - protein, 9 aa, Homo Sapiens
LQNLRSLVR

SEQ ID NO: 404337 - protein, 9 aa, Homo Sapiens
GDVEELDIQ

SEQ ID NO: 404338 - protein, 9 aa, Homo Sapiens
ELFAYAAQG

SEQ ID NO: 404339 - protein, 9 aa, Homo Sapiens
TASPTPPQS

SEQ ID NO: 404340 - protein, 9 aa, Homo Sapiens
FIIFAKIIT

SEQ ID NO: 404341 - protein, 9 aa, Homo Sapiens
FSSRLGEFW

SEQ ID NO: 404342 - protein, 9 aa, Homo Sapiens
LISVSELQY

SEQ ID NO: 404343 - protein, 9 aa, Homo Sapiens
QYFEEEGED

SEQ ID NO: 404344 - protein, 9 aa, Homo Sapiens
ERLVYGITP

SEQ ID NO: 404345 - protein, 9 aa, Homo Sapiens
RPLIIFLVP

SEQ ID NO: 404346 - protein, 9 aa, Homo Sapiens
GHLDFDLEN

SEQ ID NO: 404347 - protein, 9 aa, Homo Sapiens
ENGLVVLVF

SEQ ID NO: 404348 - protein, 9 aa, Homo Sapiens
QNLYRDVMF

SEQ ID NO: 404349 - protein, 9 aa, Homo Sapiens
KLSHTKYLK

SEQ ID NO: 404350 - protein, 9 aa, Homo Sapiens
IIEKVLKIH

SEQ ID NO: 404351 - protein, 9 aa, Homo Sapiens
LRSRLFIKA

SEQ ID NO: 404352 - protein, 9 aa, Homo Sapiens
NRTSQKLKR

SEQ ID NO: 404353 - protein, 9 aa, Homo Sapiens
LAERDLYLD

SEQ ID NO: 404354 - protein, 9 aa, Homo Sapiens
KPLFVDLTL

SEQ ID NO: 404355 - protein, 9 aa, Homo Sapiens
SQIQYVPVF

SEQ ID NO: 404356 - protein, 9 aa, Homo Sapiens
HTENRLLKQ

SEQ ID NO: 404357 - protein, 9 aa, Homo Sapiens
STNKSILKE

SEQ ID NO: 404358 - protein, 9 aa, Homo Sapiens
SFLYVTVLL

SEQ ID NO: 404359 - protein, 9 aa, Homo Sapiens
VSSIHPECR

SEQ ID NO: 404360 - protein, 9 aa, Homo Sapiens
KEDYDNFTK

SEQ ID NO: 404361 - protein, 9 aa, Homo Sapiens
VRLPYPLQI

SEQ ID NO: 404362 - protein, 9 aa, Homo Sapiens
MSWENQKVE

SEQ ID NO: 404363 - protein, 9 aa, Homo Sapiens
INLARVLDL

SEQ ID NO: 404364 - protein, 9 aa, Homo Sapiens
RTPDKLKKE

SEQ ID NO: 404365 - protein, 9 aa, Homo Sapiens
YKQPISRWI

SEQ ID NO: 404366 - protein, 9 aa, Homo Sapiens
VSELQIYMT

SEQ ID NO: 404367 - protein, 9 aa, Homo Sapiens
MKTHSRNIT

SEQ ID NO: 404368 - protein, 9 aa, Homo Sapiens
VCGKAFRQA

SEQ ID NO: 404369 - protein, 9 aa, Homo Sapiens
IYEDRHNGV

SEQ ID NO: 404370 - protein, 9 aa, Homo Sapiens
SSLSKMATN

SEQ ID NO: 404371 - protein, 9 aa, Homo Sapiens
MDDKSLEEA

SEQ ID NO: 404372 - protein, 9 aa, Homo Sapiens
GSQSVVPRD

SEQ ID NO: 404373 - protein, 9 aa, Homo Sapiens
CIPRSLSVK

SEQ ID NO: 404374 - protein, 9 aa, Homo Sapiens
YMPLLYMQF

SEQ ID NO: 404375 - protein, 9 aa, Homo Sapiens
RVLFKHLDY

SEQ ID NO: 404376 - protein, 9 aa, Homo Sapiens
VNVLNLTQL

SEQ ID NO: 404377 - protein, 9 aa, Homo Sapiens
PEDKLDCVI

SEQ ID NO: 404378 - protein, 9 aa, Homo Sapiens
SLLGCDKIT

SEQ ID NO: 404379 - protein, 9 aa, Homo Sapiens
YVFTRHVHF

SEQ ID NO: 404380 - protein, 9 aa, Homo Sapiens
PFEDIRSRL

SEQ ID NO: 404381 - protein, 9 aa, Homo Sapiens
EPTRTKDVD

SEQ ID NO: 404382 - protein, 9 aa, Homo Sapiens
EGPENQMVF

SEQ ID NO: 404383 - protein, 9 aa, Homo Sapiens
PITCTLDFS

SEQ ID NO: 404384 - protein, 9 aa, Homo Sapiens
GILNMSSFY

SEQ ID NO: 404385 - protein, 9 aa, Homo Sapiens
ATTQAPTDK

SEQ ID NO: 404386 - protein, 9 aa, Homo Sapiens
TSDKKYSVS

SEQ ID NO: 404387 - protein, 9 aa, Homo Sapiens
TTADKLPED

SEQ ID NO: 404388 - protein, 9 aa, Homo Sapiens
AKLKSMETY

SEQ ID NO: 404389 - protein, 9 aa, Homo Sapiens
REHKDKKKT

SEQ ID NO: 404390 - protein, 9 aa, Homo Sapiens
LDNILQPMI

SEQ ID NO: 404391 - protein, 9 aa, Homo Sapiens
EKHPKYLQG

SEQ ID NO: 404392 - protein, 9 aa, Homo Sapiens
DYDNFTKEL

SEQ ID NO: 404393 - protein, 9 aa, Homo Sapiens
RMELFILLC

SEQ ID NO: 404394 - protein, 9 aa, Homo Sapiens
TPQQAQQLG

SEQ ID NO: 404395 - protein, 9 aa, Homo Sapiens
QSTSDYLTQ

SEQ ID NO: 404396 - protein, 9 aa, Homo Sapiens
TKYLICFFD

SEQ ID NO: 404397 - protein, 9 aa, Homo Sapiens
HLLHKSDTD

SEQ ID NO: 404398 - protein, 9 aa, Homo Sapiens
KYITLDEWA

SEQ ID NO: 404399 - protein, 9 aa, Homo Sapiens
EAQNIYYQG

SEQ ID NO: 404400 - protein, 9 aa, Homo Sapiens
LDKVHELCD

SEQ ID NO: 404401 - protein, 9 aa, Homo Sapiens
VITYVSLIY

SEQ ID NO: 404402 - protein, 9 aa, Homo Sapiens
GCRKWCKRE

SEQ ID NO: 404403 - protein, 9 aa, Homo Sapiens
WGLITQGVR

SEQ ID NO: 404404 - protein, 9 aa, Homo Sapiens
KWYAPKCIN

SEQ ID NO: 404405 - protein, 9 aa, Homo Sapiens
RLRGPSQAE

SEQ ID NO: 404406 - protein, 9 aa, Homo Sapiens
RSEFYSLQE

SEQ ID NO: 404407 - protein, 9 aa, Homo Sapiens
ITEASGTTA

SEQ ID NO: 404408 - protein, 9 aa, Homo Sapiens
IFWNIKIRL

SEQ ID NO: 404409 - protein, 9 aa, Homo Sapiens
SGRHWNNFA

SEQ ID NO: 404410 - protein, 9 aa, Homo Sapiens
ASVLCRKLQ

SEQ ID NO: 404411 - protein, 9 aa, Homo Sapiens
LICNRQSEA

SEQ ID NO: 404412 - protein, 9 aa, Homo Sapiens
ILKTLLWCR

SEQ ID NO: 404413 - protein, 9 aa, Homo Sapiens
ALTNDSKRL

SEQ ID NO: 404414 - protein, 9 aa, Homo Sapiens
DILGLLVPG

SEQ ID NO: 404415 - protein, 9 aa, Homo Sapiens
ADVNLPATQ

SEQ ID NO: 404416 - protein, 9 aa, Homo Sapiens
IADVKEDDL

SEQ ID NO: 404417 - protein, 9 aa, Homo Sapiens
KWEKECGVT

SEQ ID NO: 404418 - protein, 9 aa, Homo Sapiens
KEFSENNGF

SEQ ID NO: 404419 - protein, 9 aa, Homo Sapiens
PMLKQVIKP

SEQ ID NO: 404420 - protein, 9 aa, Homo Sapiens
PSSGLVNGL

SEQ ID NO: 404421 - protein, 9 aa, Homo Sapiens
FKDEATDFC

SEQ ID NO: 404422 - protein, 9 aa, Homo Sapiens
SKTAVNSAS

SEQ ID NO: 404423 - protein, 9 aa, Homo Sapiens
ECIDQMLAE

SEQ ID NO: 404424 - protein, 9 aa, Homo Sapiens
DMFQYNEEN

SEQ ID NO: 404425 - protein, 9 aa, Homo Sapiens
VSKAAAVMG

SEQ ID NO: 404426 - protein, 9 aa, Homo Sapiens
VNVNYCTGI

SEQ ID NO: 404427 - protein, 9 aa, Homo Sapiens
NERALLSLY

SEQ ID NO: 404428 - protein, 9 aa, Homo Sapiens
KQKWEKECG

SEQ ID NO: 404429 - protein, 9 aa, Homo Sapiens
KVKTTSKFS

SEQ ID NO: 404430 - protein, 9 aa, Homo Sapiens
KSEMYLEGL

SEQ ID NO: 404431 - protein, 9 aa, Homo Sapiens
SYLKSIFSS

SEQ ID NO: 404432 - protein, 9 aa, Homo Sapiens
KAQKVKHLD

SEQ ID NO: 404433 - protein, 9 aa, Homo Sapiens
SGVARRGKN

SEQ ID NO: 404434 - protein, 9 aa, Homo Sapiens
FSISLVANI

SEQ ID NO: 404435 - protein, 9 aa, Homo Sapiens
IKYLESEKS

SEQ ID NO: 404436 - protein, 9 aa, Homo Sapiens
SVVPLEHGE

SEQ ID NO: 404437 - protein, 9 aa, Homo Sapiens
QTYNTVTVM

SEQ ID NO: 404438 - protein, 9 aa, Homo Sapiens
SRVSGRHWN

SEQ ID NO: 404439 - protein, 9 aa, Homo Sapiens
ENDVLHCVT

SEQ ID NO: 404440 - protein, 9 aa, Homo Sapiens
TKKINAKRH

SEQ ID NO: 404441 - protein, 9 aa, Homo Sapiens
EATDFCVMP

SEQ ID NO: 404442 - protein, 9 aa, Homo Sapiens
GIVCIATKK

SEQ ID NO: 404443 - protein, 9 aa, Homo Sapiens
DHDQIVTSI

SEQ ID NO: 404444 - protein, 9 aa, Homo Sapiens
IVYVMDLLL

SEQ ID NO: 404445 - protein, 9 aa, Homo Sapiens
PLEDEESFE

SEQ ID NO: 404446 - protein, 9 aa, Homo Sapiens
LTMDPNNTG

SEQ ID NO: 404447 - protein, 9 aa, Homo Sapiens
LPKLEKKDF

SEQ ID NO: 404448 - protein, 9 aa, Homo Sapiens
SSVPPETYQ

SEQ ID NO: 404449 - protein, 9 aa, Homo Sapiens
SEGGDPAYP

SEQ ID NO: 404450 - protein, 9 aa, Homo Sapiens
FDYGILQEK

SEQ ID NO: 404451 - protein, 9 aa, Homo Sapiens
SSTSSLTLS

SEQ ID NO: 404452 - protein, 9 aa, Homo Sapiens
NNLNQDNSR

SEQ ID NO: 404453 - protein, 9 aa, Homo Sapiens
EIVVLKKIK

SEQ ID NO: 404454 - protein, 9 aa, Homo Sapiens
SENEAIKIC

SEQ ID NO: 404455 - protein, 9 aa, Homo Sapiens
MLQSSLSTS

SEQ ID NO: 404456 - protein, 9 aa, Homo Sapiens
KDHEAITKV

SEQ ID NO: 404457 - protein, 9 aa, Homo Sapiens
KTNTKAYGE

SEQ ID NO: 404458 - protein, 9 aa, Homo Sapiens
HPFKYLVQL

SEQ ID NO: 404459 - protein, 9 aa, Homo Sapiens
NSPPDADEV

SEQ ID NO: 404460 - protein, 9 aa, Homo Sapiens
HFEQNTLEI

SEQ ID NO: 404461 - protein, 9 aa, Homo Sapiens
FTEAGLKML

SEQ ID NO: 404462 - protein, 9 aa, Homo Sapiens
SGDAAASSS

SEQ ID NO: 404463 - protein, 9 aa, Homo Sapiens
KVSEVPKKL

SEQ ID NO: 404464 - protein, 9 aa, Homo Sapiens
PLSKVWLVD

SEQ ID NO: 404465 - protein, 9 aa, Homo Sapiens
QQNTKLKVE

SEQ ID NO: 404466 - protein, 9 aa, Homo Sapiens
WPWIKLFFK

SEQ ID NO: 404467 - protein, 9 aa, Homo Sapiens
HACYTVCRF

SEQ ID NO: 404468 - protein, 9 aa, Homo Sapiens
LQNSDRLIE

SEQ ID NO: 404469 - protein, 9 aa, Homo Sapiens
MRKIIGKNA

SEQ ID NO: 404470 - protein, 9 aa, Homo Sapiens
DLYLDNPEI

SEQ ID NO: 404471 - protein, 9 aa, Homo Sapiens
VDICQAYFA

SEQ ID NO: 404472 - protein, 9 aa, Homo Sapiens
CTELQNLRS

SEQ ID NO: 404473 - protein, 9 aa, Homo Sapiens
LPYLSKQTA

SEQ ID NO: 404474 - protein, 9 aa, Homo Sapiens
DCDDEIGVV

SEQ ID NO: 404475 - protein, 9 aa, Homo Sapiens
HFEIEIFDV

SEQ ID NO: 404476 - protein, 9 aa, Homo Sapiens
HPNFTRARL

SEQ ID NO: 404477 - protein, 9 aa, Homo Sapiens
FYLQNCSMK

SEQ ID NO: 404478 - protein, 9 aa, Homo Sapiens
TASQNNSKT

SEQ ID NO: 404479 - protein, 9 aa, Homo Sapiens
PVCCSSQHS

SEQ ID NO: 404480 - protein, 9 aa, Homo Sapiens
DNFLGISSQ

SEQ ID NO: 404481 - protein, 9 aa, Homo Sapiens
LANDPTYLR

SEQ ID NO: 404482 - protein, 9 aa, Homo Sapiens
STLPTVSIT

SEQ ID NO: 404483 - protein, 9 aa, Homo Sapiens
QYVPVFPGQ

SEQ ID NO: 404484 - protein, 9 aa, Homo Sapiens
DNLYPEDKL

SEQ ID NO: 404485 - protein, 9 aa, Homo Sapiens
STYLIQHQI

SEQ ID NO: 404486 - protein, 9 aa, Homo Sapiens
EYCKFSLDE

SEQ ID NO: 404487 - protein, 9 aa, Homo Sapiens
WYKETTYQR

SEQ ID NO: 404488 - protein, 9 aa, Homo Sapiens
ELQNLRSLV

SEQ ID NO: 404489 - protein, 9 aa, Homo Sapiens
DLCQPYRSE

SEQ ID NO: 404490 - protein, 9 aa, Homo Sapiens
DLKKTNTKA

SEQ ID NO: 404491 - protein, 9 aa, Homo Sapiens
IWELLPLVL

SEQ ID NO: 404492 - protein, 9 aa, Homo Sapiens
KAVVKTWRQ

SEQ ID NO: 404493 - protein, 9 aa, Homo Sapiens
CLCPQVDKG

SEQ ID NO: 404494 - protein, 9 aa, Homo Sapiens
NHQESIKFD

SEQ ID NO: 404495 - protein, 9 aa, Homo Sapiens
IISPFSCLK

SEQ ID NO: 404496 - protein, 9 aa, Homo Sapiens
LVPLLLSPV

SEQ ID NO: 404497 - protein, 9 aa, Homo Sapiens
NLEILQITQ

SEQ ID NO: 404498 - protein, 9 aa, Homo Sapiens
WREHAHKTV

SEQ ID NO: 404499 - protein, 9 aa, Homo Sapiens
CLDPAQQNV

SEQ ID NO: 404500 - protein, 9 aa, Homo Sapiens
NGWFPTPRC

SEQ ID NO: 404501 - protein, 9 aa, Homo Sapiens
LAWKEVNKH

SEQ ID NO: 404502 - protein, 9 aa, Homo Sapiens
QMSVVPLEH

SEQ ID NO: 404503 - protein, 9 aa, Homo Sapiens
LKYQASAQG

SEQ ID NO: 404504 - protein, 9 aa, Homo Sapiens
SQVLQLFSS

SEQ ID NO: 404505 - protein, 9 aa, Homo Sapiens
QHLYLHSPA

SEQ ID NO: 404506 - protein, 9 aa, Homo Sapiens
FQQPPEMAV

SEQ ID NO: 404507 - protein, 9 aa, Homo Sapiens
KHAADLHAS

SEQ ID NO: 404508 - protein, 9 aa, Homo Sapiens
DLIHQKKMS

SEQ ID NO: 404509 - protein, 9 aa, Homo Sapiens
INGILSERA

SEQ ID NO: 404510 - protein, 9 aa, Homo Sapiens
DDYYENSTP

SEQ ID NO: 404511 - protein, 9 aa, Homo Sapiens
SDKELKLLC

SEQ ID NO: 404512 - protein, 9 aa, Homo Sapiens
TAKEGHLRV

SEQ ID NO: 404513 - protein, 9 aa, Homo Sapiens
VSWDSIFIL

SEQ ID NO: 404514 - protein, 9 aa, Homo Sapiens
SILINFVDL

SEQ ID NO: 404515 - protein, 9 aa, Homo Sapiens
RAELVELIV

SEQ ID NO: 404516 - protein, 9 aa, Homo Sapiens
QMSEDKPQD

SEQ ID NO: 404517 - protein, 9 aa, Homo Sapiens
KHWPWIKLF

SEQ ID NO: 404518 - protein, 9 aa, Homo Sapiens
VKRSIKCFK

SEQ ID NO: 404519 - protein, 9 aa, Homo Sapiens
CCTGTELSL

SEQ ID NO: 404520 - protein, 9 aa, Homo Sapiens
QRLAEIQEL

SEQ ID NO: 404521 - protein, 9 aa, Homo Sapiens
VQSKGRART

SEQ ID NO: 404522 - protein, 9 aa, Homo Sapiens
LQAKLQTGW

SEQ ID NO: 404523 - protein, 9 aa, Homo Sapiens
EAPYMLVGS

SEQ ID NO: 404524 - protein, 9 aa, Homo Sapiens
NTKLKVEPQ

SEQ ID NO: 404525 - protein, 9 aa, Homo Sapiens
KGTRREYCK

SEQ ID NO: 404526 - protein, 9 aa, Homo Sapiens
NNQTVFERN

SEQ ID NO: 404527 - protein, 9 aa, Homo Sapiens
RRGQAGAKK

SEQ ID NO: 404528 - protein, 9 aa, Homo Sapiens
ESGCLYNIN

SEQ ID NO: 404529 - protein, 9 aa, Homo Sapiens
PLETPGPSP

SEQ ID NO: 404530 - protein, 9 aa, Homo Sapiens
SWYQNKIGA

SEQ ID NO: 404531 - protein, 9 aa, Homo Sapiens
KAFNWSSRL

SEQ ID NO: 404532 - protein, 9 aa, Homo Sapiens
PPCPSYPER

SEQ ID NO: 404533 - protein, 9 aa, Homo Sapiens
VFILLSSVD

SEQ ID NO: 404534 - protein, 9 aa, Homo Sapiens
KVNLRNNYF

SEQ ID NO: 404535 - protein, 9 aa, Homo Sapiens
VHLKNTSRG

SEQ ID NO: 404536 - protein, 9 aa, Homo Sapiens
TTLGCYNKG

SEQ ID NO: 404537 - protein, 9 aa, Homo Sapiens
RDTTTKIAA

SEQ ID NO: 404538 - protein, 9 aa, Homo Sapiens
SGPIDHYQI

SEQ ID NO: 404539 - protein, 9 aa, Homo Sapiens
SSRKSNKRA

SEQ ID NO: 404540 - protein, 9 aa, Homo Sapiens
YEQIGKIGE

SEQ ID NO: 404541 - protein, 9 aa, Homo Sapiens
SAILYVHRI

SEQ ID NO: 404542 - protein, 9 aa, Homo Sapiens
FDGDEIFHA

SEQ ID NO: 404543 - protein, 9 aa, Homo Sapiens
DDGSNYFAT

SEQ ID NO: 404544 - protein, 9 aa, Homo Sapiens
LWGVKLSLS

SEQ ID NO: 404545 - protein, 9 aa, Homo Sapiens
TRLSGDAAA

SEQ ID NO: 404546 - protein, 9 aa, Homo Sapiens
NVRYLYTLD

SEQ ID NO: 404547 - protein, 9 aa, Homo Sapiens
TQLQIAMGV

SEQ ID NO: 404548 - protein, 9 aa, Homo Sapiens
FASNQQDEA

SEQ ID NO: 404549 - protein, 9 aa, Homo Sapiens
DSPMDDLFQ

SEQ ID NO: 404550 - protein, 9 aa, Homo Sapiens
MTVFFKTLQ

SEQ ID NO: 404551 - protein, 9 aa, Homo Sapiens
DLPDTNNEE

SEQ ID NO: 404552 - protein, 9 aa, Homo Sapiens
NNVNIKEGS

SEQ ID NO: 404553 - protein, 9 aa, Homo Sapiens
FSKAKLKSM

SEQ ID NO: 404554 - protein, 9 aa, Homo Sapiens
MDEEQKLHT

SEQ ID NO: 404555 - protein, 9 aa, Homo Sapiens
LLSKYQSIL

SEQ ID NO: 404556 - protein, 9 aa, Homo Sapiens
KNILRLHLN

SEQ ID NO: 404557 - protein, 9 aa, Homo Sapiens
HMNKDFCAD

SEQ ID NO: 404558 - protein, 9 aa, Homo Sapiens
DQCALIHSI

SEQ ID NO: 404559 - protein, 9 aa, Homo Sapiens
EKSINSIID

SEQ ID NO: 404560 - protein, 9 aa, Homo Sapiens
KHIKAEKAE

SEQ ID NO: 404561 - protein, 9 aa, Homo Sapiens
DLGHNAWLS

SEQ ID NO: 404562 - protein, 9 aa, Homo Sapiens
NNVCFEWGA

SEQ ID NO: 404563 - protein, 9 aa, Homo Sapiens
NITMVEKSS

SEQ ID NO: 404564 - protein, 9 aa, Homo Sapiens
HLTSHKIIH

SEQ ID NO: 404565 - protein, 9 aa, Homo Sapiens
PVKPTEHGK

SEQ ID NO: 404566 - protein, 9 aa, Homo Sapiens
LMSGGFDRT

SEQ ID NO: 404567 - protein, 9 aa, Homo Sapiens
CWTLGRYAH

SEQ ID NO: 404568 - protein, 9 aa, Homo Sapiens
QFQNPVYDP

SEQ ID NO: 404569 - protein, 9 aa, Homo Sapiens
LTQKGLNNV

SEQ ID NO: 404570 - protein, 9 aa, Homo Sapiens
IELYRASGN

SEQ ID NO: 404571 - protein, 9 aa, Homo Sapiens
QINDAHHGG

SEQ ID NO: 404572 - protein, 9 aa, Homo Sapiens
DCVDGSDEN

SEQ ID NO: 404573 - protein, 9 aa, Homo Sapiens
TLFLSPAGI

SEQ ID NO: 404574 - protein, 9 aa, Homo Sapiens
ITYYCIFKV

SEQ ID NO: 404575 - protein, 9 aa, Homo Sapiens
CLLTPLKEH

SEQ ID NO: 404576 - protein, 9 aa, Homo Sapiens
LMEITIIND

SEQ ID NO: 404577 - protein, 9 aa, Homo Sapiens
RLPFHADNF

SEQ ID NO: 404578 - protein, 9 aa, Homo Sapiens
FARDSSFLM

SEQ ID NO: 404579 - protein, 9 aa, Homo Sapiens
SGYDKLGPS

SEQ ID NO: 404580 - protein, 9 aa, Homo Sapiens
RFPLTSAHY

SEQ ID NO: 404581 - protein, 9 aa, Homo Sapiens
ANHLLHKSD

SEQ ID NO: 404582 - protein, 9 aa, Homo Sapiens
HPMLKQVIK

SEQ ID NO: 404583 - protein, 9 aa, Homo Sapiens
KFDVEAIFS

SEQ ID NO: 404584 - protein, 9 aa, Homo Sapiens
GQAPESISD

SEQ ID NO: 404585 - protein, 9 aa, Homo Sapiens
VYLRLWTLS

SEQ ID NO: 404586 - protein, 9 aa, Homo Sapiens
THHLDPKSP

SEQ ID NO: 404587 - protein, 9 aa, Homo Sapiens
PNAQRAHLK

SEQ ID NO: 404588 - protein, 9 aa, Homo Sapiens
SALTQKGLN

SEQ ID NO: 404589 - protein, 9 aa, Homo Sapiens
GRADIGFAY

SEQ ID NO: 404590 - protein, 9 aa, Homo Sapiens
NGMVAKLGN

SEQ ID NO: 404591 - protein, 9 aa, Homo Sapiens
DAASGSISK

SEQ ID NO: 404592 - protein, 9 aa, Homo Sapiens
QPSEKIWIE

SEQ ID NO: 404593 - protein, 9 aa, Homo Sapiens
CRIDYISGN

SEQ ID NO: 404594 - protein, 9 aa, Homo Sapiens
ILMECGHLF

SEQ ID NO: 404595 - protein, 9 aa, Homo Sapiens
VVKKFDVEA

SEQ ID NO: 404596 - protein, 9 aa, Homo Sapiens
DEIFNQFTT

SEQ ID NO: 404597 - protein, 9 aa, Homo Sapiens
ISNKILIKE

SEQ ID NO: 404598 - protein, 9 aa, Homo Sapiens
FLTMDPNNT

SEQ ID NO: 404599 - protein, 9 aa, Homo Sapiens
QNTTLVEGA

SEQ ID NO: 404600 - protein, 9 aa, Homo Sapiens
SSNKSNNGT

SEQ ID NO: 404601 - protein, 9 aa, Homo Sapiens
SLTLSSSFS

SEQ ID NO: 404602 - protein, 9 aa, Homo Sapiens
RLHTENRLL

SEQ ID NO: 404603 - protein, 9 aa, Homo Sapiens
TEETPRNIL

SEQ ID NO: 404604 - protein, 9 aa, Homo Sapiens
HSSCKLCTL

SEQ ID NO: 404605 - protein, 9 aa, Homo Sapiens
LMECGHLFP

SEQ ID NO: 404606 - protein, 9 aa, Homo Sapiens
KLVRLKLGL

SEQ ID NO: 404607 - protein, 9 aa, Homo Sapiens
DVIVYVMDL

SEQ ID NO: 404608 - protein, 9 aa, Homo Sapiens
AQRLKCQKQ

SEQ ID NO: 404609 - protein, 9 aa, Homo Sapiens
TLLWCRNEK

SEQ ID NO: 404610 - protein, 9 aa, Homo Sapiens
LEHSSCKLC

SEQ ID NO: 404611 - protein, 9 aa, Homo Sapiens
ESIKFDIVP

SEQ ID NO: 404612 - protein, 9 aa, Homo Sapiens
LLSLYLVAY

SEQ ID NO: 404613 - protein, 9 aa, Homo Sapiens
INNNNFHKS

SEQ ID NO: 404614 - protein, 9 aa, Homo Sapiens
LYPPPPPCP

SEQ ID NO: 404615 - protein, 9 aa, Homo Sapiens
DEVELNMIA

SEQ ID NO: 404616 - protein, 9 aa, Homo Sapiens
TSNYLELWD

SEQ ID NO: 404617 - protein, 9 aa, Homo Sapiens
EYGWSLSEF

SEQ ID NO: 404618 - protein, 9 aa, Homo Sapiens
LMQNFYHQQ

SEQ ID NO: 404619 - protein, 9 aa, Homo Sapiens
GLKMLRVPG

SEQ ID NO: 404620 - protein, 9 aa, Homo Sapiens
SIEISRRGN

SEQ ID NO: 404621 - protein, 9 aa, Homo Sapiens
YWAPHINKK

SEQ ID NO: 404622 - protein, 9 aa, Homo Sapiens
TETTADKLP

SEQ ID NO: 404623 - protein, 9 aa, Homo Sapiens
AVVRWTGSH

SEQ ID NO: 404624 - protein, 9 aa, Homo Sapiens
VQFESILPR

SEQ ID NO: 404625 - protein, 9 aa, Homo Sapiens
LPGLLQSGF

SEQ ID NO: 404626 - protein, 9 aa, Homo Sapiens
PFYGFLGKK

SEQ ID NO: 404627 - protein, 9 aa, Homo Sapiens
VPVTDGAIS

SEQ ID NO: 404628 - protein, 9 aa, Homo Sapiens
TERITNSQN

SEQ ID NO: 404629 - protein, 9 aa, Homo Sapiens
LNVANNILT

SEQ ID NO: 404630 - protein, 9 aa, Homo Sapiens
KELKKKWLE

SEQ ID NO: 404631 - protein, 9 aa, Homo Sapiens
ANDAMLILE

SEQ ID NO: 404632 - protein, 9 aa, Homo Sapiens
DISFLSSNK

SEQ ID NO: 404633 - protein, 9 aa, Homo Sapiens
GKAFNWSSR

SEQ ID NO: 404634 - protein, 9 aa, Homo Sapiens
CLSWGTENL

SEQ ID NO: 404635 - protein, 9 aa, Homo Sapiens
RESQKVKAK

SEQ ID NO: 404636 - protein, 9 aa, Homo Sapiens
NLQNRIWDQ

SEQ ID NO: 404637 - protein, 9 aa, Homo Sapiens
SVAGIIVIA

SEQ ID NO: 404638 - protein, 9 aa, Homo Sapiens
VCRIDYISG

SEQ ID NO: 404639 - protein, 9 aa, Homo Sapiens
VLVIPINVI

SEQ ID NO: 404640 - protein, 9 aa, Homo Sapiens
EYIYQWRPE

SEQ ID NO: 404641 - protein, 9 aa, Homo Sapiens
QTNPYTDVC

SEQ ID NO: 404642 - protein, 9 aa, Homo Sapiens
KPESGCLYN

SEQ ID NO: 404643 - protein, 9 aa, Homo Sapiens
WCKFTASFL

SEQ ID NO: 404644 - protein, 9 aa, Homo Sapiens
ISGTGFFLH

SEQ ID NO: 404645 - protein, 9 aa, Homo Sapiens
NQIANLTNQ

SEQ ID NO: 404646 - protein, 9 aa, Homo Sapiens
MNLVLAESS

SEQ ID NO: 404647 - protein, 9 aa, Homo Sapiens
ALYKILGLH

SEQ ID NO: 404648 - protein, 9 aa, Homo Sapiens
YLQKTPVWK

SEQ ID NO: 404649 - protein, 9 aa, Homo Sapiens
AKVIFIIIL

SEQ ID NO: 404650 - protein, 9 aa, Homo Sapiens
ILAIAGEDV

SEQ ID NO: 404651 - protein, 9 aa, Homo Sapiens
SWDSIFILM

SEQ ID NO: 404652 - protein, 9 aa, Homo Sapiens
VSIFSTLTK

SEQ ID NO: 404653 - protein, 9 aa, Homo Sapiens
INDAHHGGW

SEQ ID NO: 404654 - protein, 9 aa, Homo Sapiens
TAQVTIQDS

SEQ ID NO: 404655 - protein, 9 aa, Homo Sapiens
QTALNLTAP

SEQ ID NO: 404656 - protein, 9 aa, Homo Sapiens
QLLMGNLRN

SEQ ID NO: 404657 - protein, 9 aa, Homo Sapiens
KSTLEMGCT

SEQ ID NO: 404658 - protein, 9 aa, Homo Sapiens
ALRLNSEKL

SEQ ID NO: 404659 - protein, 9 aa, Homo Sapiens
SLKSEMYLE

SEQ ID NO: 404660 - protein, 9 aa, Homo Sapiens
HNKAYVVCT

SEQ ID NO: 404661 - protein, 9 aa, Homo Sapiens
RHRYRHPSA

SEQ ID NO: 404662 - protein, 9 aa, Homo Sapiens
GKAVSIFST

SEQ ID NO: 404663 - protein, 9 aa, Homo Sapiens
TTALLLQDL

SEQ ID NO: 404664 - protein, 9 aa, Homo Sapiens
DSTLVPLLL

SEQ ID NO: 404665 - protein, 9 aa, Homo Sapiens
EENISLEEL

SEQ ID NO: 404666 - protein, 9 aa, Homo Sapiens
WFDNSNMTC

SEQ ID NO: 404667 - protein, 9 aa, Homo Sapiens
QHSDKGNEF

SEQ ID NO: 404668 - protein, 9 aa, Homo Sapiens
GWGMVSSYN

SEQ ID NO: 404669 - protein, 9 aa, Homo Sapiens
IVVTQSEID

SEQ ID NO: 404670 - protein, 9 aa, Homo Sapiens
HTYNPLGKI

SEQ ID NO: 404671 - protein, 9 aa, Homo Sapiens
RSYKSHIST

SEQ ID NO: 404672 - protein, 9 aa, Homo Sapiens
SQDIKKSLE

SEQ ID NO: 404673 - protein, 9 aa, Homo Sapiens
MVWVAWLFL

SEQ ID NO: 404674 - protein, 9 aa, Homo Sapiens
PKYLQGSHQ

SEQ ID NO: 404675 - protein, 9 aa, Homo Sapiens
AKELAQIEE

SEQ ID NO: 404676 - protein, 9 aa, Homo Sapiens
VLNLTQLTF

SEQ ID NO: 404677 - protein, 9 aa, Homo Sapiens
KQIGYMIRM

SEQ ID NO: 404678 - protein, 9 aa, Homo Sapiens
EENDSKKLK

SEQ ID NO: 404679 - protein, 9 aa, Homo Sapiens
FIIILSYVL

SEQ ID NO: 404680 - protein, 9 aa, Homo Sapiens
SYFWINRRT

SEQ ID NO: 404681 - protein, 9 aa, Homo Sapiens
VEKSQVLQL

SEQ ID NO: 404682 - protein, 9 aa, Homo Sapiens
SHKIIHTGE

SEQ ID NO: 404683 - protein, 9 aa, Homo Sapiens
ASPTPPQSP

SEQ ID NO: 404684 - protein, 9 aa, Homo Sapiens
SLWGVKLSL

SEQ ID NO: 404685 - protein, 9 aa, Homo Sapiens
MWFPEAQNI

SEQ ID NO: 404686 - protein, 9 aa, Homo Sapiens
STKHWAAMH

SEQ ID NO: 404687 - protein, 9 aa, Homo Sapiens
HKVKTTSKF

SEQ ID NO: 404688 - protein, 9 aa, Homo Sapiens
NPLIYSLHN

SEQ ID NO: 404689 - protein, 9 aa, Homo Sapiens
DSTVRVWLV

SEQ ID NO: 404690 - protein, 9 aa, Homo Sapiens
CCSSQHSVF

SEQ ID NO: 404691 - protein, 9 aa, Homo Sapiens
SSENSAYRW

SEQ ID NO: 404692 - protein, 9 aa, Homo Sapiens
AKCLTMKEN

SEQ ID NO: 404693 - protein, 9 aa, Homo Sapiens
QILQFQNPV

SEQ ID NO: 404694 - protein, 9 aa, Homo Sapiens
YPDGTYTGI

SEQ ID NO: 404695 - protein, 9 aa, Homo Sapiens
QPYVFTRHV

SEQ ID NO: 404696 - protein, 9 aa, Homo Sapiens
IYDPAKQIS

SEQ ID NO: 404697 - protein, 9 aa, Homo Sapiens
EVMLDNFAL

SEQ ID NO: 404698 - protein, 9 aa, Homo Sapiens
LLKSEFCEE

SEQ ID NO: 404699 - protein, 9 aa, Homo Sapiens
FNISVKVLS

SEQ ID NO: 404700 - protein, 9 aa, Homo Sapiens
QVPEKLPPT

SEQ ID NO: 404701 - protein, 9 aa, Homo Sapiens
DENYLISTK

SEQ ID NO: 404702 - protein, 9 aa, Homo Sapiens
YYFWYNFDS

SEQ ID NO: 404703 - protein, 9 aa, Homo Sapiens
PVQPSAEDS

SEQ ID NO: 404704 - protein, 9 aa, Homo Sapiens
LAKSCIKTL

SEQ ID NO: 404705 - protein, 9 aa, Homo Sapiens
LFQCVNGKY

SEQ ID NO: 404706 - protein, 9 aa, Homo Sapiens
LQTDWITRE

SEQ ID NO: 404707 - protein, 9 aa, Homo Sapiens
LSYVLSLGP

SEQ ID NO: 404708 - protein, 9 aa, Homo Sapiens
PSLPAIPPI

SEQ ID NO: 404709 - protein, 9 aa, Homo Sapiens
VQDLLSTAA

SEQ ID NO: 404710 - protein, 9 aa, Homo Sapiens
LLTYKSDPV

SEQ ID NO: 404711 - protein, 9 aa, Homo Sapiens
ALGETVLHI

SEQ ID NO: 404712 - protein, 9 aa, Homo Sapiens
SNNFIYLLT

SEQ ID NO: 404713 - protein, 9 aa, Homo Sapiens
SNTSTTTMV

SEQ ID NO: 404714 - protein, 9 aa, Homo Sapiens
IKYPETFFL

SEQ ID NO: 404715 - protein, 9 aa, Homo Sapiens
FVVFGIIGI

SEQ ID NO: 404716 - protein, 9 aa, Homo Sapiens
SPLSNHVQR

SEQ ID NO: 404717 - protein, 9 aa, Homo Sapiens
TVRRRMVMQ

SEQ ID NO: 404718 - protein, 9 aa, Homo Sapiens
MMIFYMIDG

SEQ ID NO: 404719 - protein, 9 aa, Homo Sapiens
ENIISQEEC

SEQ ID NO: 404720 - protein, 9 aa, Homo Sapiens
NPCGYLMNG

SEQ ID NO: 404721 - protein, 9 aa, Homo Sapiens
STVKIPMIK

SEQ ID NO: 404722 - protein, 9 aa, Homo Sapiens
MSMAFSNLA

SEQ ID NO: 404723 - protein, 9 aa, Homo Sapiens
TRREYCKFS

SEQ ID NO: 404724 - protein, 9 aa, Homo Sapiens
LFSKEEVGY

SEQ ID NO: 404725 - protein, 9 aa, Homo Sapiens
SSLGGRTVE

SEQ ID NO: 404726 - protein, 9 aa, Homo Sapiens
DQKEFVRKK

SEQ ID NO: 404727 - protein, 9 aa, Homo Sapiens
DKQNRTALH

SEQ ID NO: 404728 - protein, 9 aa, Homo Sapiens
AEHELTELT

SEQ ID NO: 404729 - protein, 9 aa, Homo Sapiens
LIYDPAKQI

SEQ ID NO: 404730 - protein, 9 aa, Homo Sapiens
IIDYISTSK

SEQ ID NO: 404731 - protein, 9 aa, Homo Sapiens
EVKIRDNSI

SEQ ID NO: 404732 - protein, 9 aa, Homo Sapiens
TELQNLRSL

SEQ ID NO: 404733 - protein, 9 aa, Homo Sapiens
ELTGPPQKP

SEQ ID NO: 404734 - protein, 9 aa, Homo Sapiens
TAYEKQCPA

SEQ ID NO: 404735 - protein, 9 aa, Homo Sapiens
LFSLSLSYL

SEQ ID NO: 404736 - protein, 9 aa, Homo Sapiens
AVVKTWRQL

SEQ ID NO: 404737 - protein, 9 aa, Homo Sapiens
KYFILTVSI

SEQ ID NO: 404738 - protein, 9 aa, Homo Sapiens
LEVQLTKYL

SEQ ID NO: 404739 - protein, 9 aa, Homo Sapiens
QEETPEIIK

SEQ ID NO: 404740 - protein, 9 aa, Homo Sapiens
YPTEDKVLA

SEQ ID NO: 404741 - protein, 9 aa, Homo Sapiens
VLKIHKSMI

SEQ ID NO: 404742 - protein, 9 aa, Homo Sapiens
KECINKTLT

SEQ ID NO: 404743 - protein, 9 aa, Homo Sapiens
VEIFILAVM

SEQ ID NO: 404744 - protein, 9 aa, Homo Sapiens
KLGETDEDK

SEQ ID NO: 404745 - protein, 9 aa, Homo Sapiens
QGPVYSSCK

SEQ ID NO: 404746 - protein, 9 aa, Homo Sapiens
RLPYPLQIK

SEQ ID NO: 404747 - protein, 9 aa, Homo Sapiens
LITQGVRCS

SEQ ID NO: 404748 - protein, 9 aa, Homo Sapiens
RSLKSEMYL

SEQ ID NO: 404749 - protein, 9 aa, Homo Sapiens
GLDISRLQG

SEQ ID NO: 404750 - protein, 9 aa, Homo Sapiens
NIISEIQAL

SEQ ID NO: 404751 - protein, 9 aa, Homo Sapiens
VLFFADEDE

SEQ ID NO: 404752 - protein, 9 aa, Homo Sapiens
ELYLEELTL

SEQ ID NO: 404753 - protein, 9 aa, Homo Sapiens
EIMNLVLAE

SEQ ID NO: 404754 - protein, 9 aa, Homo Sapiens
ICQNTTLVE

SEQ ID NO: 404755 - protein, 9 aa, Homo Sapiens
LEQHKIQSQ

SEQ ID NO: 404756 - protein, 9 aa, Homo Sapiens
TNNEEGSVA

SEQ ID NO: 404757 - protein, 9 aa, Homo Sapiens
HKLRLKLCK

SEQ ID NO: 404758 - protein, 9 aa, Homo Sapiens
ENGWFPTPR

SEQ ID NO: 404759 - protein, 9 aa, Homo Sapiens
VEIELYRAS

SEQ ID NO: 404760 - protein, 9 aa, Homo Sapiens
IFDVQTRKQ

SEQ ID NO: 404761 - protein, 9 aa, Homo Sapiens
VLAYDQAHL

SEQ ID NO: 404762 - protein, 9 aa, Homo Sapiens
QWGLVFENT

SEQ ID NO: 404763 - protein, 9 aa, Homo Sapiens
AAYSYFWIN

SEQ ID NO: 404764 - protein, 9 aa, Homo Sapiens
PNRIMEENS

SEQ ID NO: 404765 - protein, 9 aa, Homo Sapiens
PNLWSGDGE

SEQ ID NO: 404766 - protein, 9 aa, Homo Sapiens
ANAIDKWVA

SEQ ID NO: 404767 - protein, 9 aa, Homo Sapiens
YASAHLTSQ

SEQ ID NO: 404768 - protein, 9 aa, Homo Sapiens
ISVVLTQTY

SEQ ID NO: 404769 - protein, 9 aa, Homo Sapiens
DAICTHHLD

SEQ ID NO: 404770 - protein, 9 aa, Homo Sapiens
LGHAEHELT

SEQ ID NO: 404771 - protein, 9 aa, Homo Sapiens
KKYSVSNIP

SEQ ID NO: 404772 - protein, 9 aa, Homo Sapiens
NAKHSDKSP

SEQ ID NO: 404773 - protein, 9 aa, Homo Sapiens
AAVMGGVFI

SEQ ID NO: 404774 - protein, 9 aa, Homo Sapiens
NMEQRVITI

SEQ ID NO: 404775 - protein, 9 aa, Homo Sapiens
SYFRSTALP

SEQ ID NO: 404776 - protein, 9 aa, Homo Sapiens
GHKIYSKIK

SEQ ID NO: 404777 - protein, 9 aa, Homo Sapiens
YRVCQVLFC

SEQ ID NO: 404778 - protein, 9 aa, Homo Sapiens
FLTLSTIKY

SEQ ID NO: 404779 - protein, 9 aa, Homo Sapiens
SEDISKTFE

SEQ ID NO: 404780 - protein, 9 aa, Homo Sapiens
FDLENTLFL

SEQ ID NO: 404781 - protein, 9 aa, Homo Sapiens
GDSNPHSGA

SEQ ID NO: 404782 - protein, 9 aa, Homo Sapiens
DANKAESWM

SEQ ID NO: 404783 - protein, 9 aa, Homo Sapiens
IHLPQVAGV

SEQ ID NO: 404784 - protein, 9 aa, Homo Sapiens
LMVHQIIHT

SEQ ID NO: 404785 - protein, 9 aa, Homo Sapiens
APHPMLKQV

SEQ ID NO: 404786 - protein, 9 aa, Homo Sapiens
VDGVCFIAD

SEQ ID NO: 404787 - protein, 9 aa, Homo Sapiens
SEDGRVLFF

SEQ ID NO: 404788 - protein, 9 aa, Homo Sapiens
TLSSSFSDG

SEQ ID NO: 404789 - protein, 9 aa, Homo Sapiens
VHKSGKHVT

SEQ ID NO: 404790 - protein, 9 aa, Homo Sapiens
ESISDKELK

SEQ ID NO: 404791 - protein, 9 aa, Homo Sapiens
NEALRKIIR

SEQ ID NO: 404792 - protein, 9 aa, Homo Sapiens
LLICKKRHR

SEQ ID NO: 404793 - protein, 9 aa, Homo Sapiens
NDSKKLKFY

SEQ ID NO: 404794 - protein, 9 aa, Homo Sapiens
EKNKLQKQR

SEQ ID NO: 404795 - protein, 9 aa, Homo Sapiens
ALWARVQAE

SEQ ID NO: 404796 - protein, 9 aa, Homo Sapiens
RFCGVHHAF

SEQ ID NO: 404797 - protein, 9 aa, Homo Sapiens
HLISLNMNF

SEQ ID NO: 404798 - protein, 9 aa, Homo Sapiens
EAKGSGYDK

SEQ ID NO: 404799 - protein, 9 aa, Homo Sapiens
QNKLWVGQL

SEQ ID NO: 404800 - protein, 9 aa, Homo Sapiens
YRASGNLVI

SEQ ID NO: 404801 - protein, 9 aa, Homo Sapiens
DCLVLNEQW

SEQ ID NO: 404802 - protein, 9 aa, Homo Sapiens
CVPEVCVLE

SEQ ID NO: 404803 - protein, 9 aa, Homo Sapiens
AYCGVGDDQ

SEQ ID NO: 404804 - protein, 9 aa, Homo Sapiens
DEKWGPKLD

SEQ ID NO: 404805 - protein, 9 aa, Homo Sapiens
HGKKTTLAN

SEQ ID NO: 404806 - protein, 9 aa, Homo Sapiens
LDLPDTNNE

SEQ ID NO: 404807 - protein, 9 aa, Homo Sapiens
GGDPAYPAL

SEQ ID NO: 404808 - protein, 9 aa, Homo Sapiens
DLRVGANVQ

SEQ ID NO: 404809 - protein, 9 aa, Homo Sapiens
FALYIMRVP

SEQ ID NO: 404810 - protein, 9 aa, Homo Sapiens
TSHKIIHTG

SEQ ID NO: 404811 - protein, 9 aa, Homo Sapiens
SRQFQKVKL

SEQ ID NO: 404812 - protein, 9 aa, Homo Sapiens
YSLRLLAYN

SEQ ID NO: 404813 - protein, 9 aa, Homo Sapiens
PEELFTTLE

SEQ ID NO: 404814 - protein, 9 aa, Homo Sapiens
LENCTKMFE

SEQ ID NO: 404815 - protein, 9 aa, Homo Sapiens
QTETFPAYR

SEQ ID NO: 404816 - protein, 9 aa, Homo Sapiens
ADVLEAHKA

SEQ ID NO: 404817 - protein, 9 aa, Homo Sapiens
GIIFLEVLE

SEQ ID NO: 404818 - protein, 9 aa, Homo Sapiens
YRQWTNRIM

SEQ ID NO: 404819 - protein, 9 aa, Homo Sapiens
NSSIARSQT

SEQ ID NO: 404820 - protein, 9 aa, Homo Sapiens
VIQRIRWGP

SEQ ID NO: 404821 - protein, 9 aa, Homo Sapiens
SGENKRKQK

SEQ ID NO: 404822 - protein, 9 aa, Homo Sapiens
SSQELSNIT

SEQ ID NO: 404823 - protein, 9 aa, Homo Sapiens
SDVCRIDYI

SEQ ID NO: 404824 - protein, 9 aa, Homo Sapiens
PAFPTASPT

SEQ ID NO: 404825 - protein, 9 aa, Homo Sapiens
AVLFQMSED

SEQ ID NO: 404826 - protein, 9 aa, Homo Sapiens
FHLKRFSES

SEQ ID NO: 404827 - protein, 9 aa, Homo Sapiens
ENCTKMFEK

SEQ ID NO: 404828 - protein, 9 aa, Homo Sapiens
LKSSNVMRY

SEQ ID NO: 404829 - protein, 9 aa, Homo Sapiens
CTKMFEKNV

SEQ ID NO: 404830 - protein, 9 aa, Homo Sapiens
LKEHPDLPP

SEQ ID NO: 404831 - protein, 9 aa, Homo Sapiens
HVSLNKANK

SEQ ID NO: 404832 - protein, 9 aa, Homo Sapiens
QNNLYRNVM

SEQ ID NO: 404833 - protein, 9 aa, Homo Sapiens
KVQPQEPNV

SEQ ID NO: 404834 - protein, 9 aa, Homo Sapiens
ATEPRENGI

SEQ ID NO: 404835 - protein, 9 aa, Homo Sapiens
ISFAVTETL

SEQ ID NO: 404836 - protein, 9 aa, Homo Sapiens
IYQESALYL

SEQ ID NO: 404837 - protein, 9 aa, Homo Sapiens
DELTRHIQI

SEQ ID NO: 404838 - protein, 9 aa, Homo Sapiens
CGSRSTDNL

SEQ ID NO: 404839 - protein, 9 aa, Homo Sapiens
CLVLNEQWI

SEQ ID NO: 404840 - protein, 9 aa, Homo Sapiens
ILKIDSYYY

SEQ ID NO: 404841 - protein, 9 aa, Homo Sapiens
KKAQKVKHL

SEQ ID NO: 404842 - protein, 9 aa, Homo Sapiens
ADSIPKVLA

SEQ ID NO: 404843 - protein, 9 aa, Homo Sapiens
SPHTGDAKP

SEQ ID NO: 404844 - protein, 9 aa, Homo Sapiens
NNYFITHSL

SEQ ID NO: 404845 - protein, 9 aa, Homo Sapiens
DGFAEAIHL

SEQ ID NO: 404846 - protein, 9 aa, Homo Sapiens
TKVQRHDMR

SEQ ID NO: 404847 - protein, 9 aa, Homo Sapiens
MRHGIESIY

SEQ ID NO: 404848 - protein, 9 aa, Homo Sapiens
FYRSSKRTE

SEQ ID NO: 404849 - protein, 9 aa, Homo Sapiens
EGNLPLHLT

SEQ ID NO: 404850 - protein, 9 aa, Homo Sapiens
QEGSSENSA

SEQ ID NO: 404851 - protein, 9 aa, Homo Sapiens
PAIPPIQLE

SEQ ID NO: 404852 - protein, 9 aa, Homo Sapiens
LSLSYLLYA

SEQ ID NO: 404853 - protein, 9 aa, Homo Sapiens
DPVSLINYP

SEQ ID NO: 404854 - protein, 9 aa, Homo Sapiens
KSDTDKDGR

SEQ ID NO: 404855 - protein, 9 aa, Homo Sapiens
HLTVVAICY

SEQ ID NO: 404856 - protein, 9 aa, Homo Sapiens
YSHDGTNSP

SEQ ID NO: 404857 - protein, 9 aa, Homo Sapiens
HINKPLNAF

SEQ ID NO: 404858 - protein, 9 aa, Homo Sapiens
RALLSLYLV

SEQ ID NO: 404859 - protein, 9 aa, Homo Sapiens
LELDKVHEL

SEQ ID NO: 404860 - protein, 9 aa, Homo Sapiens
QLGENLSGI

SEQ ID NO: 404861 - protein, 9 aa, Homo Sapiens
KTWGFHNNL

SEQ ID NO: 404862 - protein, 9 aa, Homo Sapiens
KGRARTPIS

SEQ ID NO: 404863 - protein, 9 aa, Homo Sapiens
TALTSACTE

SEQ ID NO: 404864 - protein, 9 aa, Homo Sapiens
HTCPRGVPA

SEQ ID NO: 404865 - protein, 9 aa, Homo Sapiens
GLLGKQGEP

SEQ ID NO: 404866 - protein, 9 aa, Homo Sapiens
RFFNNVFII

SEQ ID NO: 404867 - protein, 9 aa, Homo Sapiens
NQKVEATQP

SEQ ID NO: 404868 - protein, 9 aa, Homo Sapiens
ENESRWRCA

SEQ ID NO: 404869 - protein, 9 aa, Homo Sapiens
QWRPEYRHL

SEQ ID NO: 404870 - protein, 9 aa, Homo Sapiens
KYSVSNIPT

SEQ ID NO: 404871 - protein, 9 aa, Homo Sapiens
EKETGNPLD

SEQ ID NO: 404872 - protein, 9 aa, Homo Sapiens
QIEEEEKLS

SEQ ID NO: 404873 - protein, 9 aa, Homo Sapiens
IQIIVLDLR

SEQ ID NO: 404874 - protein, 9 aa, Homo Sapiens
QDLLSTAAA

SEQ ID NO: 404875 - protein, 9 aa, Homo Sapiens
MVLKECIDQ

SEQ ID NO: 404876 - protein, 9 aa, Homo Sapiens
PKAKRSLKS

SEQ ID NO: 404877 - protein, 9 aa, Homo Sapiens
FKWFNNGNE

SEQ ID NO: 404878 - protein, 9 aa, Homo Sapiens
STSSLTLSS

SEQ ID NO: 404879 - protein, 9 aa, Homo Sapiens
RSHRDTTTK

SEQ ID NO: 404880 - protein, 9 aa, Homo Sapiens
SGFGLINSE

SEQ ID NO: 404881 - protein, 9 aa, Homo Sapiens
IVDEFAMRH

SEQ ID NO: 404882 - protein, 9 aa, Homo Sapiens
FDTVRRRMV

SEQ ID NO: 404883 - protein, 9 aa, Homo Sapiens
DKWLSRQFQ

SEQ ID NO: 404884 - protein, 9 aa, Homo Sapiens
GKKWCSLTN

SEQ ID NO: 404885 - protein, 9 aa, Homo Sapiens
KKQRLKLES

SEQ ID NO: 404886 - protein, 9 aa, Homo Sapiens
CMNDAPTRG

SEQ ID NO: 404887 - protein, 9 aa, Homo Sapiens
VWVAWLFLF

SEQ ID NO: 404888 - protein, 9 aa, Homo Sapiens
SIDNELEYD

SEQ ID NO: 404889 - protein, 9 aa, Homo Sapiens
VQDGGSPPH

SEQ ID NO: 404890 - protein, 9 aa, Homo Sapiens
EVVNVTGLN

SEQ ID NO: 404891 - protein, 9 aa, Homo Sapiens
KQVDENYLI

SEQ ID NO: 404892 - protein, 9 aa, Homo Sapiens
KAQFLVAFE

SEQ ID NO: 404893 - protein, 9 aa, Homo Sapiens
QKILLVQNI

SEQ ID NO: 404894 - protein, 9 aa, Homo Sapiens
VRSAFTTYT

SEQ ID NO: 404895 - protein, 9 aa, Homo Sapiens
TAFKPLFVD

SEQ ID NO: 404896 - protein, 9 aa, Homo Sapiens
AALAESADL

SEQ ID NO: 404897 - protein, 9 aa, Homo Sapiens
ENVPKDISE

SEQ ID NO: 404898 - protein, 9 aa, Homo Sapiens
KADSPMDDL

SEQ ID NO: 404899 - protein, 9 aa, Homo Sapiens
GENKRKQKR

SEQ ID NO: 404900 - protein, 9 aa, Homo Sapiens
PPVCCSSQH

SEQ ID NO: 404901 - protein, 9 aa, Homo Sapiens
CGKISFAVT

SEQ ID NO: 404902 - protein, 9 aa, Homo Sapiens
YQTFVNVNY

SEQ ID NO: 404903 - protein, 9 aa, Homo Sapiens
HPDLPPVQY

SEQ ID NO: 404904 - protein, 9 aa, Homo Sapiens
KLDISDNSS

SEQ ID NO: 404905 - protein, 9 aa, Homo Sapiens
CQLLSACSH

SEQ ID NO: 404906 - protein, 9 aa, Homo Sapiens
IQHKIIHTR

SEQ ID NO: 404907 - protein, 9 aa, Homo Sapiens
ITLDEWAGC

SEQ ID NO: 404908 - protein, 9 aa, Homo Sapiens
TLMSSIACW

SEQ ID NO: 404909 - protein, 9 aa, Homo Sapiens
QYVSWRRKK

SEQ ID NO: 404910 - protein, 9 aa, Homo Sapiens
AEIQTLKHK

SEQ ID NO: 404911 - protein, 9 aa, Homo Sapiens
IKEKTKSHY

SEQ ID NO: 404912 - protein, 9 aa, Homo Sapiens
STNNERKST

SEQ ID NO: 404913 - protein, 9 aa, Homo Sapiens
ELIEADAPK

SEQ ID NO: 404914 - protein, 9 aa, Homo Sapiens
LKMWFPEAQ

SEQ ID NO: 404915 - protein, 9 aa, Homo Sapiens
RKNPTSARN

SEQ ID NO: 404916 - protein, 9 aa, Homo Sapiens
VDDKLDISD

SEQ ID NO: 404917 - protein, 9 aa, Homo Sapiens
VMNDPLYKE

SEQ ID NO: 404918 - protein, 9 aa, Homo Sapiens
MPGGSAAVT

SEQ ID NO: 404919 - protein, 9 aa, Homo Sapiens
DKSYKCEEC

SEQ ID NO: 404920 - protein, 9 aa, Homo Sapiens
CGHLFPPPT

SEQ ID NO: 404921 - protein, 9 aa, Homo Sapiens
AGFIENTFK

SEQ ID NO: 404922 - protein, 9 aa, Homo Sapiens
ENDSKKLKF

SEQ ID NO: 404923 - protein, 9 aa, Homo Sapiens
ADEYQPFKI

SEQ ID NO: 404924 - protein, 9 aa, Homo Sapiens
IFNWNHCGE

SEQ ID NO: 404925 - protein, 9 aa, Homo Sapiens
SMNWRQLCL

SEQ ID NO: 404926 - protein, 9 aa, Homo Sapiens
KGPNLSNCT

SEQ ID NO: 404927 - protein, 9 aa, Homo Sapiens
VDVGNHYED

SEQ ID NO: 404928 - protein, 9 aa, Homo Sapiens
LISLCYYYF

SEQ ID NO: 404929 - protein, 9 aa, Homo Sapiens
QTHTGAKPY

SEQ ID NO: 404930 - protein, 9 aa, Homo Sapiens
TMALHIAQT

SEQ ID NO: 404931 - protein, 9 aa, Homo Sapiens
YLTRNRFFE

SEQ ID NO: 404932 - protein, 9 aa, Homo Sapiens
VRIWELLPL

SEQ ID NO: 404933 - protein, 9 aa, Homo Sapiens
YPDAGENGL

SEQ ID NO: 404934 - protein, 9 aa, Homo Sapiens
SFESIRAAV

SEQ ID NO: 404935 - protein, 9 aa, Homo Sapiens
IEEQPKKYQ

SEQ ID NO: 404936 - protein, 9 aa, Homo Sapiens
QLLMHHRTH

SEQ ID NO: 404937 - protein, 9 aa, Homo Sapiens
PQEPNVTDT

SEQ ID NO: 404938 - protein, 9 aa, Homo Sapiens
VIYTAEKPC

SEQ ID NO: 404939 - protein, 9 aa, Homo Sapiens
RISAVMVTG

SEQ ID NO: 404940 - protein, 9 aa, Homo Sapiens
GMVSSYNVL

SEQ ID NO: 404941 - protein, 9 aa, Homo Sapiens
PGSLFASDN

SEQ ID NO: 404942 - protein, 9 aa, Homo Sapiens
NSEKLSLVN

SEQ ID NO: 404943 - protein, 9 aa, Homo Sapiens
KNIFVLGPK

SEQ ID NO: 404944 - protein, 9 aa, Homo Sapiens
STCIDLYKS

SEQ ID NO: 404945 - protein, 9 aa, Homo Sapiens
HIQLKPTVT

SEQ ID NO: 404946 - protein, 9 aa, Homo Sapiens
AGAKKHSQK

SEQ ID NO: 404947 - protein, 9 aa, Homo Sapiens
LWQILVEGF

SEQ ID NO: 404948 - protein, 9 aa, Homo Sapiens
LCIIINNNN

SEQ ID NO: 404949 - protein, 9 aa, Homo Sapiens
KRHKQTSDS

SEQ ID NO: 404950 - protein, 9 aa, Homo Sapiens
IIGKNAEIL

SEQ ID NO: 404951 - protein, 9 aa, Homo Sapiens
NIFASFSDD

SEQ ID NO: 404952 - protein, 9 aa, Homo Sapiens
KDFCADYRG

SEQ ID NO: 404953 - protein, 9 aa, Homo Sapiens
EAEIKKLRL

SEQ ID NO: 404954 - protein, 9 aa, Homo Sapiens
APVSSIHPE

SEQ ID NO: 404955 - protein, 9 aa, Homo Sapiens
QSRLDTFNY

SEQ ID NO: 404956 - protein, 9 aa, Homo Sapiens
PLQTPSLGQ

SEQ ID NO: 404957 - protein, 9 aa, Homo Sapiens
LQSNCTYSL

SEQ ID NO: 404958 - protein, 9 aa, Homo Sapiens
NKDENGLVV

SEQ ID NO: 404959 - protein, 9 aa, Homo Sapiens
NIIHTGEKP

SEQ ID NO: 404960 - protein, 9 aa, Homo Sapiens
PCGYLMNGM

SEQ ID NO: 404961 - protein, 9 aa, Homo Sapiens
YTADQIRNK

SEQ ID NO: 404962 - protein, 9 aa, Homo Sapiens
ALSPYPGLH

SEQ ID NO: 404963 - protein, 9 aa, Homo Sapiens
DVHHLVFPA

SEQ ID NO: 404964 - protein, 9 aa, Homo Sapiens
NKANKRRLP

SEQ ID NO: 404965 - protein, 9 aa, Homo Sapiens
PIIQTAMSS

SEQ ID NO: 404966 - protein, 9 aa, Homo Sapiens
IDMNINKMW

SEQ ID NO: 404967 - protein, 9 aa, Homo Sapiens
VKKFDVEAI

SEQ ID NO: 404968 - protein, 9 aa, Homo Sapiens
ITYRELRLL

SEQ ID NO: 404969 - protein, 9 aa, Homo Sapiens
NIQIETVLP

SEQ ID NO: 404970 - protein, 9 aa, Homo Sapiens
HLTAKEGHL

SEQ ID NO: 404971 - protein, 9 aa, Homo Sapiens
DQYLISAYG

SEQ ID NO: 404972 - protein, 9 aa, Homo Sapiens
VCQLLSACS

SEQ ID NO: 404973 - protein, 9 aa, Homo Sapiens
GYEGFQQVL

SEQ ID NO: 404974 - protein, 9 aa, Homo Sapiens
HALEHTFVP

SEQ ID NO: 404975 - protein, 9 aa, Homo Sapiens
DLENTLFLF

SEQ ID NO: 404976 - protein, 9 aa, Homo Sapiens
GVFVCYFDY

SEQ ID NO: 404977 - protein, 9 aa, Homo Sapiens
LFQMSEDKP

SEQ ID NO: 404978 - protein, 9 aa, Homo Sapiens
FLRFNPVRG

SEQ ID NO: 404979 - protein, 9 aa, Homo Sapiens
SLSKMATNM

SEQ ID NO: 404980 - protein, 9 aa, Homo Sapiens
VVFQFKSSN

SEQ ID NO: 404981 - protein, 9 aa, Homo Sapiens
CKDKTLCII

SEQ ID NO: 404982 - protein, 9 aa, Homo Sapiens
DHLQNSDRL

SEQ ID NO: 404983 - protein, 9 aa, Homo Sapiens
RQTVMISAT

SEQ ID NO: 404984 - protein, 9 aa, Homo Sapiens
EDSGAYYCT

SEQ ID NO: 404985 - protein, 9 aa, Homo Sapiens
TNNFNKDRI

SEQ ID NO: 404986 - protein, 9 aa, Homo Sapiens
GLYFCGTHK

SEQ ID NO: 404987 - protein, 9 aa, Homo Sapiens
RRHTLYHGH

SEQ ID NO: 404988 - protein, 9 aa, Homo Sapiens
EVEMAEVTN

SEQ ID NO: 404989 - protein, 9 aa, Homo Sapiens
GETVLHIAA

SEQ ID NO: 404990 - protein, 9 aa, Homo Sapiens
IATALRSGN

SEQ ID NO: 404991 - protein, 9 aa, Homo Sapiens
GPGESDKVQ

SEQ ID NO: 404992 - protein, 9 aa, Homo Sapiens
QITQSAPNF

SEQ ID NO: 404993 - protein, 9 aa, Homo Sapiens
LHDHAQGLV

SEQ ID NO: 404994 - protein, 9 aa, Homo Sapiens
DGEKGFKDK

SEQ ID NO: 404995 - protein, 9 aa, Homo Sapiens
KLSQDIKKS

SEQ ID NO: 404996 - protein, 9 aa, Homo Sapiens
EFNSSIARS

SEQ ID NO: 404997 - protein, 9 aa, Homo Sapiens
KFGELCHGC

SEQ ID NO: 404998 - protein, 9 aa, Homo Sapiens
FDNSNMTCD

SEQ ID NO: 404999 - protein, 9 aa, Homo Sapiens
THSRNITVQ

SEQ ID NO: 405000 - protein, 9 aa, Homo Sapiens
VPGPDQYLI

SEQ ID NO: 405001 - protein, 9 aa, Homo Sapiens
LSDGLHYDE

SEQ ID NO: 405002 - protein, 9 aa, Homo Sapiens
EKEVGYLEL

SEQ ID NO: 405003 - protein, 9 aa, Homo Sapiens
TWRVYLRLW

SEQ ID NO: 405004 - protein, 9 aa, Homo Sapiens
PLRFCGVHH

SEQ ID NO: 405005 - protein, 9 aa, Homo Sapiens
PMFVEKLNN

SEQ ID NO: 405006 - protein, 9 aa, Homo Sapiens
LTAFKPLFV

SEQ ID NO: 405007 - protein, 9 aa, Homo Sapiens
INGNLEGEA

SEQ ID NO: 405008 - protein, 9 aa, Homo Sapiens
WKLQTASNS

SEQ ID NO: 405009 - protein, 9 aa, Homo Sapiens
SRLQWRRGS

SEQ ID NO: 405010 - protein, 9 aa, Homo Sapiens
ELNTFMLEK

SEQ ID NO: 405011 - protein, 9 aa, Homo Sapiens
YLFFSLGTT

SEQ ID NO: 405012 - protein, 9 aa, Homo Sapiens
KVEPWKEQL

SEQ ID NO: 405013 - protein, 9 aa, Homo Sapiens
IANLTNQRK

SEQ ID NO: 405014 - protein, 9 aa, Homo Sapiens
EGIEELNNC

SEQ ID NO: 405015 - protein, 9 aa, Homo Sapiens
FFPFYLQNC

SEQ ID NO: 405016 - protein, 9 aa, Homo Sapiens
LEAIGSRLE

SEQ ID NO: 405017 - protein, 9 aa, Homo Sapiens
LSIHRRVNT

SEQ ID NO: 405018 - protein, 9 aa, Homo Sapiens
EYKEKEEKI

SEQ ID NO: 405019 - protein, 9 aa, Homo Sapiens
TEKHPKYLQ

SEQ ID NO: 405020 - protein, 9 aa, Homo Sapiens
ELCHGCSLL

SEQ ID NO: 405021 - protein, 9 aa, Homo Sapiens
KSQLLMHHR

SEQ ID NO: 405022 - protein, 9 aa, Homo Sapiens
ASNQQDEAP

SEQ ID NO: 405023 - protein, 9 aa, Homo Sapiens
NDPTYLRKN

SEQ ID NO: 405024 - protein, 9 aa, Homo Sapiens
IQFPWFFSF

SEQ ID NO: 405025 - protein, 9 aa, Homo Sapiens
AVAELDHLY

SEQ ID NO: 405026 - protein, 9 aa, Homo Sapiens
LNMIATDPD

SEQ ID NO: 405027 - protein, 9 aa, Homo Sapiens
ALEEEKNKT

SEQ ID NO: 405028 - protein, 9 aa, Homo Sapiens
NYPAVNSLD

SEQ ID NO: 405029 - protein, 9 aa, Homo Sapiens
QNKCSIILT

SEQ ID NO: 405030 - protein, 9 aa, Homo Sapiens
SLQMKTELL

SEQ ID NO: 405031 - protein, 9 aa, Homo Sapiens
FHKKPYPRK

SEQ ID NO: 405032 - protein, 9 aa, Homo Sapiens
VENTEDNRR

SEQ ID NO: 405033 - protein, 9 aa, Homo Sapiens
SHASEDISK

SEQ ID NO: 405034 - protein, 9 aa, Homo Sapiens
TYKSDPVMR

SEQ ID NO: 405035 - protein, 9 aa, Homo Sapiens
HVLEDIATF

SEQ ID NO: 405036 - protein, 9 aa, Homo Sapiens
ISSKLISLN

SEQ ID NO: 405037 - protein, 9 aa, Homo Sapiens
VTCMENGWF

SEQ ID NO: 405038 - protein, 9 aa, Homo Sapiens
VLKPGTVVT

SEQ ID NO: 405039 - protein, 9 aa, Homo Sapiens
YLRLWTLSP

SEQ ID NO: 405040 - protein, 9 aa, Homo Sapiens
FQNPVYDPE

SEQ ID NO: 405041 - protein, 9 aa, Homo Sapiens
QLFESYYGQ

SEQ ID NO: 405042 - protein, 9 aa, Homo Sapiens
IGINRTRQV

SEQ ID NO: 405043 - protein, 9 aa, Homo Sapiens
SYQLEELDK

SEQ ID NO: 405044 - protein, 9 aa, Homo Sapiens
VVVQPIQQI

SEQ ID NO: 405045 - protein, 9 aa, Homo Sapiens
LSLGLQDKI

SEQ ID NO: 405046 - protein, 9 aa, Homo Sapiens
EKKAKHSIN

SEQ ID NO: 405047 - protein, 9 aa, Homo Sapiens
SLPAIPPIQ

SEQ ID NO: 405048 - protein, 9 aa, Homo Sapiens
NMHNIPLHT

SEQ ID NO: 405049 - protein, 9 aa, Homo Sapiens
KPGTVVTFA

SEQ ID NO: 405050 - protein, 9 aa, Homo Sapiens
RKLALPHSK

SEQ ID NO: 405051 - protein, 9 aa, Homo Sapiens
SRLDTFNYD

SEQ ID NO: 405052 - protein, 9 aa, Homo Sapiens
TNLTATMNT

SEQ ID NO: 405053 - protein, 9 aa, Homo Sapiens
HTRLSGDAA

SEQ ID NO: 405054 - protein, 9 aa, Homo Sapiens
LHKSDTDKD

SEQ ID NO: 405055 - protein, 9 aa, Homo Sapiens
YTQKKWKSI

SEQ ID NO: 405056 - protein, 9 aa, Homo Sapiens
SYKSSPTQN

SEQ ID NO: 405057 - protein, 9 aa, Homo Sapiens
VNGSAEIMN

SEQ ID NO: 405058 - protein, 9 aa, Homo Sapiens
VVPLEHGEV

SEQ ID NO: 405059 - protein, 9 aa, Homo Sapiens
ISVKINTWR

SEQ ID NO: 405060 - protein, 9 aa, Homo Sapiens
SLRFKWFNN

SEQ ID NO: 405061 - protein, 9 aa, Homo Sapiens
AYFATPKMI

SEQ ID NO: 405062 - protein, 9 aa, Homo Sapiens
YTQIVVCLL

SEQ ID NO: 405063 - protein, 9 aa, Homo Sapiens
AELPAPVQP

SEQ ID NO: 405064 - protein, 9 aa, Homo Sapiens
DKLKKELEE

SEQ ID NO: 405065 - protein, 9 aa, Homo Sapiens
IYSLHNKEV

SEQ ID NO: 405066 - protein, 9 aa, Homo Sapiens
ETVEAYVIQ

SEQ ID NO: 405067 - protein, 9 aa, Homo Sapiens
YPSVTSVNT

SEQ ID NO: 405068 - protein, 9 aa, Homo Sapiens
LVAFESQNK

SEQ ID NO: 405069 - protein, 9 aa, Homo Sapiens
SFVKKLLIS

SEQ ID NO: 405070 - protein, 9 aa, Homo Sapiens
IIHLSDETN

SEQ ID NO: 405071 - protein, 9 aa, Homo Sapiens
GQEQIPIHK

SEQ ID NO: 405072 - protein, 9 aa, Homo Sapiens
YMLVGSISE

SEQ ID NO: 405073 - protein, 9 aa, Homo Sapiens
YLDNPEIKI

SEQ ID NO: 405074 - protein, 9 aa, Homo Sapiens
QLKLLCGEE

SEQ ID NO: 405075 - protein, 9 aa, Homo Sapiens
DKESNMEQR

SEQ ID NO: 405076 - protein, 9 aa, Homo Sapiens
VYDPEHCPD

SEQ ID NO: 405077 - protein, 9 aa, Homo Sapiens
EFYCKTKEL

SEQ ID NO: 405078 - protein, 9 aa, Homo Sapiens
LKSKLTQHH

SEQ ID NO: 405079 - protein, 9 aa, Homo Sapiens
LEYFMKQIN

SEQ ID NO: 405080 - protein, 9 aa, Homo Sapiens
PSALQLPHL

SEQ ID NO: 405081 - protein, 9 aa, Homo Sapiens
CHKNNFLHR

SEQ ID NO: 405082 - protein, 9 aa, Homo Sapiens
RKHMKKTFQ

SEQ ID NO: 405083 - protein, 9 aa, Homo Sapiens
DYQARRLQI

SEQ ID NO: 405084 - protein, 9 aa, Homo Sapiens
NRCLPLHFR

SEQ ID NO: 405085 - protein, 9 aa, Homo Sapiens
QIPIHKFTT

SEQ ID NO: 405086 - protein, 9 aa, Homo Sapiens
NSGNDISWN

SEQ ID NO: 405087 - protein, 9 aa, Homo Sapiens
RNPFAHIQL

SEQ ID NO: 405088 - protein, 9 aa, Homo Sapiens
CKGNLPAES

SEQ ID NO: 405089 - protein, 9 aa, Homo Sapiens
YLSGDITIL

SEQ ID NO: 405090 - protein, 9 aa, Homo Sapiens
KKYQVWHHR

SEQ ID NO: 405091 - protein, 9 aa, Homo Sapiens
PHTGDAKPS

SEQ ID NO: 405092 - protein, 9 aa, Homo Sapiens
PLRYNMLMS

SEQ ID NO: 405093 - protein, 9 aa, Homo Sapiens
ALHHMNKDF

SEQ ID NO: 405094 - protein, 9 aa, Homo Sapiens
SIACWLMVA

SEQ ID NO: 405095 - protein, 9 aa, Homo Sapiens
EGHEKSTKL

SEQ ID NO: 405096 - protein, 9 aa, Homo Sapiens
LDLIHQKKM

SEQ ID NO: 405097 - protein, 9 aa, Homo Sapiens
ENGIDGLNR

SEQ ID NO: 405098 - protein, 9 aa, Homo Sapiens
WKEQLFESY

SEQ ID NO: 405099 - protein, 9 aa, Homo Sapiens
VTSLLEYRK

SEQ ID NO: 405100 - protein, 9 aa, Homo Sapiens
ASEGGDPAY

SEQ ID NO: 405101 - protein, 9 aa, Homo Sapiens
IMECPEIDC

SEQ ID NO: 405102 - protein, 9 aa, Homo Sapiens
DKKIKREED

SEQ ID NO: 405103 - protein, 9 aa, Homo Sapiens
VQFQSRNVH

SEQ ID NO: 405104 - protein, 9 aa, Homo Sapiens
LCKKLKAEK

SEQ ID NO: 405105 - protein, 9 aa, Homo Sapiens
YYLQLQKDI

SEQ ID NO: 405106 - protein, 9 aa, Homo Sapiens
SKSQSTSDY

SEQ ID NO: 405107 - protein, 9 aa, Homo Sapiens
YTSERFKNW

SEQ ID NO: 405108 - protein, 9 aa, Homo Sapiens
RWGPRLDPA

SEQ ID NO: 405109 - protein, 9 aa, Homo Sapiens
IHSKDIFKR

SEQ ID NO: 405110 - protein, 9 aa, Homo Sapiens
YHEITHTGE

SEQ ID NO: 405111 - protein, 9 aa, Homo Sapiens
ILLSSVDDP

SEQ ID NO: 405112 - protein, 9 aa, Homo Sapiens
TGDKSYKCE

SEQ ID NO: 405113 - protein, 9 aa, Homo Sapiens
RHDGVCQRC

SEQ ID NO: 405114 - protein, 9 aa, Homo Sapiens
SFEKETGNP

SEQ ID NO: 405115 - protein, 9 aa, Homo Sapiens
TQEVTIKYL

SEQ ID NO: 405116 - protein, 9 aa, Homo Sapiens
ERITNSQNK

SEQ ID NO: 405117 - protein, 9 aa, Homo Sapiens
ESVAGIIVI

SEQ ID NO: 405118 - protein, 9 aa, Homo Sapiens
SLFDSLKSP

SEQ ID NO: 405119 - protein, 9 aa, Homo Sapiens
GMQNSGNDI

SEQ ID NO: 405120 - protein, 9 aa, Homo Sapiens
RRTRISAVM

SEQ ID NO: 405121 - protein, 9 aa, Homo Sapiens
SSFQIHEIT

SEQ ID NO: 405122 - protein, 9 aa, Homo Sapiens
RVSGRHWNN

SEQ ID NO: 405123 - protein, 9 aa, Homo Sapiens
MFQYNEENY

SEQ ID NO: 405124 - protein, 9 aa, Homo Sapiens
VETNTYTVL

SEQ ID NO: 405125 - protein, 9 aa, Homo Sapiens
IKRLHTENR

SEQ ID NO: 405126 - protein, 9 aa, Homo Sapiens
KEKERGKIE

SEQ ID NO: 405127 - protein, 9 aa, Homo Sapiens
FCEPSFATG

SEQ ID NO: 405128 - protein, 9 aa, Homo Sapiens
LFESYYGQS

SEQ ID NO: 405129 - protein, 9 aa, Homo Sapiens
QNESVAGII

SEQ ID NO: 405130 - protein, 9 aa, Homo Sapiens
RKMSPHTGD

SEQ ID NO: 405131 - protein, 9 aa, Homo Sapiens
FPTPRCIRV

SEQ ID NO: 405132 - protein, 9 aa, Homo Sapiens
KKLICNRQS

SEQ ID NO: 405133 - protein, 9 aa, Homo Sapiens
LTVEENYQI

SEQ ID NO: 405134 - protein, 9 aa, Homo Sapiens
VRVWLVTPK

SEQ ID NO: 405135 - protein, 9 aa, Homo Sapiens
ALIGLQLLM

SEQ ID NO: 405136 - protein, 9 aa, Homo Sapiens
HSGAINFDN

SEQ ID NO: 405137 - protein, 9 aa, Homo Sapiens
PYPGLHLIS

SEQ ID NO: 405138 - protein, 9 aa, Homo Sapiens
LNAKHSDKS

SEQ ID NO: 405139 - protein, 9 aa, Homo Sapiens
QDIKKSLEL

SEQ ID NO: 405140 - protein, 9 aa, Homo Sapiens
ESFCDSMVL

SEQ ID NO: 405141 - protein, 9 aa, Homo Sapiens
VTAYTQIVV

SEQ ID NO: 405142 - protein, 9 aa, Homo Sapiens
GLNREQGDN

SEQ ID NO: 405143 - protein, 9 aa, Homo Sapiens
KQSIEISRR

SEQ ID NO: 405144 - protein, 9 aa, Homo Sapiens
DIYLPISNP

SEQ ID NO: 405145 - protein, 9 aa, Homo Sapiens
LEYDNFSED

SEQ ID NO: 405146 - protein, 9 aa, Homo Sapiens
WGPYLQFWA

SEQ ID NO: 405147 - protein, 9 aa, Homo Sapiens
QNVLKVLTN

SEQ ID NO: 405148 - protein, 9 aa, Homo Sapiens
YIILLSEMF

SEQ ID NO: 405149 - protein, 9 aa, Homo Sapiens
RVTCKDIQH

SEQ ID NO: 405150 - protein, 9 aa, Homo Sapiens
IIEEQPKKY

SEQ ID NO: 405151 - protein, 9 aa, Homo Sapiens
LWNVETNTY

SEQ ID NO: 405152 - protein, 9 aa, Homo Sapiens
TPFQIGIKE

SEQ ID NO: 405153 - protein, 9 aa, Homo Sapiens
PVVTIAWLL

SEQ ID NO: 405154 - protein, 9 aa, Homo Sapiens
QCPATSKDN

SEQ ID NO: 405155 - protein, 9 aa, Homo Sapiens
KVTSISNKI

SEQ ID NO: 405156 - protein, 9 aa, Homo Sapiens
MNYVVNFCK

SEQ ID NO: 405157 - protein, 9 aa, Homo Sapiens
EAIKICCSP

SEQ ID NO: 405158 - protein, 9 aa, Homo Sapiens
DSIIAEVEA

SEQ ID NO: 405159 - protein, 9 aa, Homo Sapiens
LEILQITQS

SEQ ID NO: 405160 - protein, 9 aa, Homo Sapiens
PEKLPPTVL

SEQ ID NO: 405161 - protein, 9 aa, Homo Sapiens
VLEDIATFF

SEQ ID NO: 405162 - protein, 9 aa, Homo Sapiens
DKPDSVDGQ

SEQ ID NO: 405163 - protein, 9 aa, Homo Sapiens
DNIERDMVI

SEQ ID NO: 405164 - protein, 9 aa, Homo Sapiens
PKHAADLHA

SEQ ID NO: 405165 - protein, 9 aa, Homo Sapiens
SISNKILIK

SEQ ID NO: 405166 - protein, 9 aa, Homo Sapiens
QSTPSLFDS

SEQ ID NO: 405167 - protein, 9 aa, Homo Sapiens
CDGCLNKSA

SEQ ID NO: 405168 - protein, 9 aa, Homo Sapiens
VMDLLLENL

SEQ ID NO: 405169 - protein, 9 aa, Homo Sapiens
CKNVCFDDL

SEQ ID NO: 405170 - protein, 9 aa, Homo Sapiens
CDFGSATNT

SEQ ID NO: 405171 - protein, 9 aa, Homo Sapiens
TWKLQTASN

SEQ ID NO: 405172 - protein, 9 aa, Homo Sapiens
HRDTTTKIA

SEQ ID NO: 405173 - protein, 9 aa, Homo Sapiens
RTEIGVILR

SEQ ID NO: 405174 - protein, 9 aa, Homo Sapiens
KECIDQMLA

SEQ ID NO: 405175 - protein, 9 aa, Homo Sapiens
PEDAGAERQ

SEQ ID NO: 405176 - protein, 9 aa, Homo Sapiens
GIHLPGQRS

SEQ ID NO: 405177 - protein, 9 aa, Homo Sapiens
YSLDNWVCL

SEQ ID NO: 405178 - protein, 9 aa, Homo Sapiens
RNSAATTEK

SEQ ID NO: 405179 - protein, 9 aa, Homo Sapiens
QDGGSPPHS

SEQ ID NO: 405180 - protein, 9 aa, Homo Sapiens
GTTALLLQD

SEQ ID NO: 405181 - protein, 9 aa, Homo Sapiens
ESNNFIYLL

SEQ ID NO: 405182 - protein, 9 aa, Homo Sapiens
TPLPGTRVR

SEQ ID NO: 405183 - protein, 9 aa, Homo Sapiens
IPEKEKNKL

SEQ ID NO: 405184 - protein, 9 aa, Homo Sapiens
APETVLLSF

SEQ ID NO: 405185 - protein, 9 aa, Homo Sapiens
KSTLVKIIL

SEQ ID NO: 405186 - protein, 9 aa, Homo Sapiens
RLKLCKKLK

SEQ ID NO: 405187 - protein, 9 aa, Homo Sapiens
HEQIHTGEK

SEQ ID NO: 405188 - protein, 9 aa, Homo Sapiens
KTLLWCRNE

SEQ ID NO: 405189 - protein, 9 aa, Homo Sapiens
KYHSWHIQG

SEQ ID NO: 405190 - protein, 9 aa, Homo Sapiens
NNCLNPPFY

SEQ ID NO: 405191 - protein, 9 aa, Homo Sapiens
DGPLGSRGL

SEQ ID NO: 405192 - protein, 9 aa, Homo Sapiens
DTTLKRLHK

SEQ ID NO: 405193 - protein, 9 aa, Homo Sapiens
MDVNKCEAS

SEQ ID NO: 405194 - protein, 9 aa, Homo Sapiens
NLTKHQITH

SEQ ID NO: 405195 - protein, 9 aa, Homo Sapiens
TNLQVNYPA

SEQ ID NO: 405196 - protein, 9 aa, Homo Sapiens
VSTHSSHGP

SEQ ID NO: 405197 - protein, 9 aa, Homo Sapiens
TMNRSTLSD

SEQ ID NO: 405198 - protein, 9 aa, Homo Sapiens
GYSVQFESI

SEQ ID NO: 405199 - protein, 9 aa, Homo Sapiens
EKQDDLKTL

SEQ ID NO: 405200 - protein, 9 aa, Homo Sapiens
HYKLYFAHH

SEQ ID NO: 405201 - protein, 9 aa, Homo Sapiens
KGQKIAQNN

SEQ ID NO: 405202 - protein, 9 aa, Homo Sapiens
EERNHDLPA

SEQ ID NO: 405203 - protein, 9 aa, Homo Sapiens
LPRGCSGII

SEQ ID NO: 405204 - protein, 9 aa, Homo Sapiens
EAASVLCRK

SEQ ID NO: 405205 - protein, 9 aa, Homo Sapiens
APLLHTRLS

SEQ ID NO: 405206 - protein, 9 aa, Homo Sapiens
FKPTRDDCG

SEQ ID NO: 405207 - protein, 9 aa, Homo Sapiens
SDKVQQLEE

SEQ ID NO: 405208 - protein, 9 aa, Homo Sapiens
PPMDDKSLE

SEQ ID NO: 405209 - protein, 9 aa, Homo Sapiens
DISWNYTLE

SEQ ID NO: 405210 - protein, 9 aa, Homo Sapiens
YLQFWAGRI

SEQ ID NO: 405211 - protein, 9 aa, Homo Sapiens
LAELPAPVQ

SEQ ID NO: 405212 - protein, 9 aa, Homo Sapiens
TGIVCIATK

SEQ ID NO: 405213 - protein, 9 aa, Homo Sapiens
DECHCIAVQ

SEQ ID NO: 405214 - protein, 9 aa, Homo Sapiens
HIPSLPPST

SEQ ID NO: 405215 - protein, 9 aa, Homo Sapiens
SSFRYHEIT

SEQ ID NO: 405216 - protein, 9 aa, Homo Sapiens
DPAQQNVYR

SEQ ID NO: 405217 - protein, 9 aa, Homo Sapiens
DSHNSKDSE

SEQ ID NO: 405218 - protein, 9 aa, Homo Sapiens
SSRANAIDK

SEQ ID NO: 405219 - protein, 9 aa, Homo Sapiens
RNILRPTKE

SEQ ID NO: 405220 - protein, 9 aa, Homo Sapiens
SSNKSTNNE

SEQ ID NO: 405221 - protein, 9 aa, Homo Sapiens
KAFYRSSKR

SEQ ID NO: 405222 - protein, 9 aa, Homo Sapiens
VRVLDNILQ

SEQ ID NO: 405223 - protein, 9 aa, Homo Sapiens
NLNQDNSRP

SEQ ID NO: 405224 - protein, 9 aa, Homo Sapiens
ETDQIMMIF

SEQ ID NO: 405225 - protein, 9 aa, Homo Sapiens
HNYLHRKTP

SEQ ID NO: 405226 - protein, 9 aa, Homo Sapiens
KIENLEKEY

SEQ ID NO: 405227 - protein, 9 aa, Homo Sapiens
CSDCIATAL

SEQ ID NO: 405228 - protein, 9 aa, Homo Sapiens
TVEDSGAYY

SEQ ID NO: 405229 - protein, 9 aa, Homo Sapiens
ERFKNWKRI

SEQ ID NO: 405230 - protein, 9 aa, Homo Sapiens
TLIPDHPNF

SEQ ID NO: 405231 - protein, 9 aa, Homo Sapiens
SIIDYISTS

SEQ ID NO: 405232 - protein, 9 aa, Homo Sapiens
GYSLDNWVC

SEQ ID NO: 405233 - protein, 9 aa, Homo Sapiens
QGNQFLRFN

SEQ ID NO: 405234 - protein, 9 aa, Homo Sapiens
HQESIKFDI

SEQ ID NO: 405235 - protein, 9 aa, Homo Sapiens
PAPVQPSAE

SEQ ID NO: 405236 - protein, 9 aa, Homo Sapiens
YKETTYQRD

SEQ ID NO: 405237 - protein, 9 aa, Homo Sapiens
SEKLKCHIP

SEQ ID NO: 405238 - protein, 9 aa, Homo Sapiens
LYYWWLPES

SEQ ID NO: 405239 - protein, 9 aa, Homo Sapiens
VNKCEASVG

SEQ ID NO: 405240 - protein, 9 aa, Homo Sapiens
VGYLELTGP

SEQ ID NO: 405241 - protein, 9 aa, Homo Sapiens
DKKLCLGIH

SEQ ID NO: 405242 - protein, 9 aa, Homo Sapiens
DPSVVGEFT

SEQ ID NO: 405243 - protein, 9 aa, Homo Sapiens
IESTNKSIL

SEQ ID NO: 405244 - protein, 9 aa, Homo Sapiens
LNNELFAYA

SEQ ID NO: 405245 - protein, 9 aa, Homo Sapiens
QKCHRTTVM

SEQ ID NO: 405246 - protein, 9 aa, Homo Sapiens
GLLNQYILM

SEQ ID NO: 405247 - protein, 9 aa, Homo Sapiens
KLYFAHHNL

SEQ ID NO: 405248 - protein, 9 aa, Homo Sapiens
IFYPSVTSV

SEQ ID NO: 405249 - protein, 9 aa, Homo Sapiens
LIYSLHNKE

SEQ ID NO: 405250 - protein, 9 aa, Homo Sapiens
LTEIYHIVS

SEQ ID NO: 405251 - protein, 9 aa, Homo Sapiens
EVEAQYELI

SEQ ID NO: 405252 - protein, 9 aa, Homo Sapiens
CKTKELKKK

SEQ ID NO: 405253 - protein, 9 aa, Homo Sapiens
EDVRTIDED

SEQ ID NO: 405254 - protein, 9 aa, Homo Sapiens
MRGAGNGIL

SEQ ID NO: 405255 - protein, 9 aa, Homo Sapiens
SIVLKLPYL

SEQ ID NO: 405256 - protein, 9 aa, Homo Sapiens
HKTVLLFEV

SEQ ID NO: 405257 - protein, 9 aa, Homo Sapiens
SSSPEQQNK

SEQ ID NO: 405258 - protein, 9 aa, Homo Sapiens
MATNMFLAV

SEQ ID NO: 405259 - protein, 9 aa, Homo Sapiens
GVQKLTHCP

SEQ ID NO: 405260 - protein, 9 aa, Homo Sapiens
QVTLHATTQ

SEQ ID NO: 405261 - protein, 9 aa, Homo Sapiens
EADSAGAGT

SEQ ID NO: 405262 - protein, 9 aa, Homo Sapiens
VQYHHLPSR

SEQ ID NO: 405263 - protein, 9 aa, Homo Sapiens
SYVSFASNQ

SEQ ID NO: 405264 - protein, 9 aa, Homo Sapiens
DDEIGVVSD

SEQ ID NO: 405265 - protein, 9 aa, Homo Sapiens
FENTRWIIE

SEQ ID NO: 405266 - protein, 9 aa, Homo Sapiens
NYLHRKTPG

SEQ ID NO: 405267 - protein, 9 aa, Homo Sapiens
AFEEAVQRV

SEQ ID NO: 405268 - protein, 9 aa, Homo Sapiens
DSNNFKSVK

SEQ ID NO: 405269 - protein, 9 aa, Homo Sapiens
VQKAQFLVA

SEQ ID NO: 405270 - protein, 9 aa, Homo Sapiens
YSCVSTHSS

SEQ ID NO: 405271 - protein, 9 aa, Homo Sapiens
QKDILEERM

SEQ ID NO: 405272 - protein, 9 aa, Homo Sapiens
HHLVFPAVG

SEQ ID NO: 405273 - protein, 9 aa, Homo Sapiens
GAQLHEANQ

SEQ ID NO: 405274 - protein, 9 aa, Homo Sapiens
QIECGHAVL

SEQ ID NO: 405275 - protein, 9 aa, Homo Sapiens
PRKKEIELL

SEQ ID NO: 405276 - protein, 9 aa, Homo Sapiens
PVMRKMLNH

SEQ ID NO: 405277 - protein, 9 aa, Homo Sapiens
TCPRGVPAC

SEQ ID NO: 405278 - protein, 9 aa, Homo Sapiens
GLVFENTRW

SEQ ID NO: 405279 - protein, 9 aa, Homo Sapiens
EQPKKYQVW

SEQ ID NO: 405280 - protein, 9 aa, Homo Sapiens
FRNPQKILQ

SEQ ID NO: 405281 - protein, 9 aa, Homo Sapiens
DELSKAYGK

SEQ ID NO: 405282 - protein, 9 aa, Homo Sapiens
LHEVVVQPI

SEQ ID NO: 405283 - protein, 9 aa, Homo Sapiens
VLFQMSEDK

SEQ ID NO: 405284 - protein, 9 aa, Homo Sapiens
ILRLSHPNI

SEQ ID NO: 405285 - protein, 9 aa, Homo Sapiens
KSQVLQLFS

SEQ ID NO: 405286 - protein, 9 aa, Homo Sapiens
SLSYLLYAL

SEQ ID NO: 405287 - protein, 9 aa, Homo Sapiens
KKCKGNLPA

SEQ ID NO: 405288 - protein, 9 aa, Homo Sapiens
MAAGLLGSD

SEQ ID NO: 405289 - protein, 9 aa, Homo Sapiens
RKLQCGTVV

SEQ ID NO: 405290 - protein, 9 aa, Homo Sapiens
YILKIDSYY

SEQ ID NO: 405291 - protein, 9 aa, Homo Sapiens
CLSSWANSN

SEQ ID NO: 405292 - protein, 9 aa, Homo Sapiens
YKIKYPETF

SEQ ID NO: 405293 - protein, 9 aa, Homo Sapiens
DQAHLSALV

SEQ ID NO: 405294 - protein, 9 aa, Homo Sapiens
NYIVMQFGR

SEQ ID NO: 405295 - protein, 9 aa, Homo Sapiens
SPMDDLFQC

SEQ ID NO: 405296 - protein, 9 aa, Homo Sapiens
PQKQDKKPR

SEQ ID NO: 405297 - protein, 9 aa, Homo Sapiens
EDRHNGVPS

SEQ ID NO: 405298 - protein, 9 aa, Homo Sapiens
LKWYAPKCI

SEQ ID NO: 405299 - protein, 9 aa, Homo Sapiens
RGMVEIELY

SEQ ID NO: 405300 - protein, 9 aa, Homo Sapiens
WRVPGPDQY

SEQ ID NO: 405301 - protein, 9 aa, Homo Sapiens
SYLQMNYVV

SEQ ID NO: 405302 - protein, 9 aa, Homo Sapiens
KPPLQKDKK

SEQ ID NO: 405303 - protein, 9 aa, Homo Sapiens
YWREHAHKT

SEQ ID NO: 405304 - protein, 9 aa, Homo Sapiens
FVCYFDYGI

SEQ ID NO: 405305 - protein, 9 aa, Homo Sapiens
KLLSSDELS

SEQ ID NO: 405306 - protein, 9 aa, Homo Sapiens
AVGRERHSC

SEQ ID NO: 405307 - protein, 9 aa, Homo Sapiens
EVQNKCSII

SEQ ID NO: 405308 - protein, 9 aa, Homo Sapiens
RQMGISGNN

SEQ ID NO: 405309 - protein, 9 aa, Homo Sapiens
LRNNYFITH

SEQ ID NO: 405310 - protein, 9 aa, Homo Sapiens
VPKDISEED

SEQ ID NO: 405311 - protein, 9 aa, Homo Sapiens
DNEMVCFLK

SEQ ID NO: 405312 - protein, 9 aa, Homo Sapiens
DKAFNEAHY

SEQ ID NO: 405313 - protein, 9 aa, Homo Sapiens
VCRRYWNAY

SEQ ID NO: 405314 - protein, 9 aa, Homo Sapiens
NPVRGEVPP

SEQ ID NO: 405315 - protein, 9 aa, Homo Sapiens
AKNEYIKGD

SEQ ID NO: 405316 - protein, 9 aa, Homo Sapiens
FQQTLLDST

SEQ ID NO: 405317 - protein, 9 aa, Homo Sapiens
NLPSLPAIP

SEQ ID NO: 405318 - protein, 9 aa, Homo Sapiens
WLQTDWITR

SEQ ID NO: 405319 - protein, 9 aa, Homo Sapiens
LNSEKLSLV

SEQ ID NO: 405320 - protein, 9 aa, Homo Sapiens
AELNTFMLE

SEQ ID NO: 405321 - protein, 9 aa, Homo Sapiens
ATFFKAIVG

SEQ ID NO: 405322 - protein, 9 aa, Homo Sapiens
DENNCVKKT

SEQ ID NO: 405323 - protein, 9 aa, Homo Sapiens
KLQCGTVVS

SEQ ID NO: 405324 - protein, 9 aa, Homo Sapiens
ISLNAHSYL

SEQ ID NO: 405325 - protein, 9 aa, Homo Sapiens
NIHYTGCYV

SEQ ID NO: 405326 - protein, 9 aa, Homo Sapiens
ENKDLLSAS

SEQ ID NO: 405327 - protein, 9 aa, Homo Sapiens
EYEVLKRDF

SEQ ID NO: 405328 - protein, 9 aa, Homo Sapiens
LSGDAAASS

SEQ ID NO: 405329 - protein, 9 aa, Homo Sapiens
SKKPPLQKD

SEQ ID NO: 405330 - protein, 9 aa, Homo Sapiens
LKLPEGHVL

SEQ ID NO: 405331 - protein, 9 aa, Homo Sapiens
KSLELSNLY

SEQ ID NO: 405332 - protein, 9 aa, Homo Sapiens
APKCINFRK

SEQ ID NO: 405333 - protein, 9 aa, Homo Sapiens
SKLIEQDFR

SEQ ID NO: 405334 - protein, 9 aa, Homo Sapiens
ELYRASGNL

SEQ ID NO: 405335 - protein, 9 aa, Homo Sapiens
YGMQNSGND

SEQ ID NO: 405336 - protein, 9 aa, Homo Sapiens
LPYPLQIKS

SEQ ID NO: 405337 - protein, 9 aa, Homo Sapiens
SLFASDNFL

SEQ ID NO: 405338 - protein, 9 aa, Homo Sapiens
RRAKDKRLK

SEQ ID NO: 405339 - protein, 9 aa, Homo Sapiens
RLLAWKEST

SEQ ID NO: 405340 - protein, 9 aa, Homo Sapiens
TSARNGGHE

SEQ ID NO: 405341 - protein, 9 aa, Homo Sapiens
NLRKQSIEI

SEQ ID NO: 405342 - protein, 9 aa, Homo Sapiens
RLYDAKVRY

SEQ ID NO: 405343 - protein, 9 aa, Homo Sapiens
ASTKKLFDD

SEQ ID NO: 405344 - protein, 9 aa, Homo Sapiens
NGIHLPGQR

SEQ ID NO: 405345 - protein, 9 aa, Homo Sapiens
RHKQTSDSD

SEQ ID NO: 405346 - protein, 9 aa, Homo Sapiens
LSNCRNHIL

SEQ ID NO: 405347 - protein, 9 aa, Homo Sapiens
LDVEAIFSK

SEQ ID NO: 405348 - protein, 9 aa, Homo Sapiens
TKYLWEQIQ

SEQ ID NO: 405349 - protein, 9 aa, Homo Sapiens
HHMNKDFCA

SEQ ID NO: 405350 - protein, 9 aa, Homo Sapiens
LTELTATFT

SEQ ID NO: 405351 - protein, 9 aa, Homo Sapiens
TPRNILRPT

SEQ ID NO: 405352 - protein, 9 aa, Homo Sapiens
CLYHDMMLE

SEQ ID NO: 405353 - protein, 9 aa, Homo Sapiens
IEELIQNYD

SEQ ID NO: 405354 - protein, 9 aa, Homo Sapiens
TLVKIILQL

SEQ ID NO: 405355 - protein, 9 aa, Homo Sapiens
VMWKQHKAQ

SEQ ID NO: 405356 - protein, 9 aa, Homo Sapiens
QPISRWIAR

SEQ ID NO: 405357 - protein, 9 aa, Homo Sapiens
LYVTVLLYT

SEQ ID NO: 405358 - protein, 9 aa, Homo Sapiens
KQINDAHHG

SEQ ID NO: 405359 - protein, 9 aa, Homo Sapiens
LSKAYGKFR

SEQ ID NO: 405360 - protein, 9 aa, Homo Sapiens
EKEQNCEER

SEQ ID NO: 405361 - protein, 9 aa, Homo Sapiens
QKIAQNNQT

SEQ ID NO: 405362 - protein, 9 aa, Homo Sapiens
GLDYCHKNN

SEQ ID NO: 405363 - protein, 9 aa, Homo Sapiens
EQKLHTDDE

SEQ ID NO: 405364 - protein, 9 aa, Homo Sapiens
QVGKITIIN

SEQ ID NO: 405365 - protein, 9 aa, Homo Sapiens
ETTADKLPE

SEQ ID NO: 405366 - protein, 9 aa, Homo Sapiens
YVQQQPIIQ

SEQ ID NO: 405367 - protein, 9 aa, Homo Sapiens
NKQVDENYL

SEQ ID NO: 405368 - protein, 9 aa, Homo Sapiens
ITCTLDFSI

SEQ ID NO: 405369 - protein, 9 aa, Homo Sapiens
AYEKQCPAT

SEQ ID NO: 405370 - protein, 9 aa, Homo Sapiens
SEKSINSII

SEQ ID NO: 405371 - protein, 9 aa, Homo Sapiens
GTWNPKGPN

SEQ ID NO: 405372 - protein, 9 aa, Homo Sapiens
PCILRKNPT

SEQ ID NO: 405373 - protein, 9 aa, Homo Sapiens
LKSTSVLSG

SEQ ID NO: 405374 - protein, 9 aa, Homo Sapiens
VFYVHILSA

SEQ ID NO: 405375 - protein, 9 aa, Homo Sapiens
VLHGAEVTC

SEQ ID NO: 405376 - protein, 9 aa, Homo Sapiens
GNDPNYIVM

SEQ ID NO: 405377 - protein, 9 aa, Homo Sapiens
VKTWRQLAE

SEQ ID NO: 405378 - protein, 9 aa, Homo Sapiens
VPEVCVLEV

SEQ ID NO: 405379 - protein, 9 aa, Homo Sapiens
SIARSQTNT

SEQ ID NO: 405380 - protein, 9 aa, Homo Sapiens
AVKGLNFPS

SEQ ID NO: 405381 - protein, 9 aa, Homo Sapiens
EGPGESDKV

SEQ ID NO: 405382 - protein, 9 aa, Homo Sapiens
ILTEIYHIV

SEQ ID NO: 405383 - protein, 9 aa, Homo Sapiens
TLAFVYSPL

SEQ ID NO: 405384 - protein, 9 aa, Homo Sapiens
KMIYSELIE

SEQ ID NO: 405385 - protein, 9 aa, Homo Sapiens
HPLRYNMLM

SEQ ID NO: 405386 - protein, 9 aa, Homo Sapiens
QQTLLDSTQ

SEQ ID NO: 405387 - protein, 9 aa, Homo Sapiens
LFVLTKASL

SEQ ID NO: 405388 - protein, 9 aa, Homo Sapiens
KALELRFNG

SEQ ID NO: 405389 - protein, 9 aa, Homo Sapiens
CDKESNMEQ

SEQ ID NO: 405390 - protein, 9 aa, Homo Sapiens
SAVYFLLPE

SEQ ID NO: 405391 - protein, 9 aa, Homo Sapiens
KHFPKHAAD

SEQ ID NO: 405392 - protein, 9 aa, Homo Sapiens
VAGIIVIAK

SEQ ID NO: 405393 - protein, 9 aa, Homo Sapiens
LLGSDDPPW

SEQ ID NO: 405394 - protein, 9 aa, Homo Sapiens
ASGHTYNPL

SEQ ID NO: 405395 - protein, 9 aa, Homo Sapiens
LSVSVQRLA

SEQ ID NO: 405396 - protein, 9 aa, Homo Sapiens
DSKKLKFYL

SEQ ID NO: 405397 - protein, 9 aa, Homo Sapiens
DQAKLSQIL

SEQ ID NO: 405398 - protein, 9 aa, Homo Sapiens
NTSRGSAGN

SEQ ID NO: 405399 - protein, 9 aa, Homo Sapiens
CVSTHSSHG

SEQ ID NO: 405400 - protein, 9 aa, Homo Sapiens
SSCKLCTLK

SEQ ID NO: 405401 - protein, 9 aa, Homo Sapiens
TAAPHPMLK

SEQ ID NO: 405402 - protein, 9 aa, Homo Sapiens
ERDLYLDNP

SEQ ID NO: 405403 - protein, 9 aa, Homo Sapiens
FEEAVQRVL

SEQ ID NO: 405404 - protein, 9 aa, Homo Sapiens
CGWFVTPLG

SEQ ID NO: 405405 - protein, 9 aa, Homo Sapiens
CRELESSQR

SEQ ID NO: 405406 - protein, 9 aa, Homo Sapiens
SFSNEEING

SEQ ID NO: 405407 - protein, 9 aa, Homo Sapiens
KNNSTCIDL

SEQ ID NO: 405408 - protein, 9 aa, Homo Sapiens
CQLSVLFRK

SEQ ID NO: 405409 - protein, 9 aa, Homo Sapiens
SSVCHTALV

SEQ ID NO: 405410 - protein, 9 aa, Homo Sapiens
GTKTVQEKD

SEQ ID NO: 405411 - protein, 9 aa, Homo Sapiens
HFRKDELKG

SEQ ID NO: 405412 - protein, 9 aa, Homo Sapiens
LRFKWFNNG

SEQ ID NO: 405413 - protein, 9 aa, Homo Sapiens
LIQGESITP

SEQ ID NO: 405414 - protein, 9 aa, Homo Sapiens
HAFAGLKNI

SEQ ID NO: 405415 - protein, 9 aa, Homo Sapiens
AQQNVYRDV

SEQ ID NO: 405416 - protein, 9 aa, Homo Sapiens
REAVDGVCF

SEQ ID NO: 405417 - protein, 9 aa, Homo Sapiens
HKKPYPRKK

SEQ ID NO: 405418 - protein, 9 aa, Homo Sapiens
FKKLICNRQ

SEQ ID NO: 405419 - protein, 9 aa, Homo Sapiens
ISSNKSTNN

SEQ ID NO: 405420 - protein, 9 aa, Homo Sapiens
MENGWFPTP

SEQ ID NO: 405421 - protein, 9 aa, Homo Sapiens
NIERDMVIC

SEQ ID NO: 405422 - protein, 9 aa, Homo Sapiens
CALIHSIKD

SEQ ID NO: 405423 - protein, 9 aa, Homo Sapiens
IDKWVAVAD

SEQ ID NO: 405424 - protein, 9 aa, Homo Sapiens
LMHHRTHTG

SEQ ID NO: 405425 - protein, 9 aa, Homo Sapiens
ASQGLKFGG

SEQ ID NO: 405426 - protein, 9 aa, Homo Sapiens
EQRVITISK

SEQ ID NO: 405427 - protein, 9 aa, Homo Sapiens
KDRNQKKDK

SEQ ID NO: 405428 - protein, 9 aa, Homo Sapiens
SNKSTNNER

SEQ ID NO: 405429 - protein, 9 aa, Homo Sapiens
LTYKSDPVM

SEQ ID NO: 405430 - protein, 9 aa, Homo Sapiens
ESQSQAILQ

SEQ ID NO: 405431 - protein, 9 aa, Homo Sapiens
AQNNLYRNV

SEQ ID NO: 405432 - protein, 9 aa, Homo Sapiens
DQNEAEIKK

SEQ ID NO: 405433 - protein, 9 aa, Homo Sapiens
LLEYRKYQP

SEQ ID NO: 405434 - protein, 9 aa, Homo Sapiens
TVEAYVIQK

SEQ ID NO: 405435 - protein, 9 aa, Homo Sapiens
GDGTNDCGA

SEQ ID NO: 405436 - protein, 9 aa, Homo Sapiens
SYICCYYFA

SEQ ID NO: 405437 - protein, 9 aa, Homo Sapiens
ALEKDHEAI

SEQ ID NO: 405438 - protein, 9 aa, Homo Sapiens
NCTKMFEKN

SEQ ID NO: 405439 - protein, 9 aa, Homo Sapiens
PYDVNSGVY

SEQ ID NO: 405440 - protein, 9 aa, Homo Sapiens
EQSGIYSCE

SEQ ID NO: 405441 - protein, 9 aa, Homo Sapiens
ALNNELFAY

SEQ ID NO: 405442 - protein, 9 aa, Homo Sapiens
VTCLMIIYR

SEQ ID NO: 405443 - protein, 9 aa, Homo Sapiens
IFGIRGNKL

SEQ ID NO: 405444 - protein, 9 aa, Homo Sapiens
MKQIECGHA

SEQ ID NO: 405445 - protein, 9 aa, Homo Sapiens
NLWSGDGEV

SEQ ID NO: 405446 - protein, 9 aa, Homo Sapiens
DEDKLFVET

SEQ ID NO: 405447 - protein, 9 aa, Homo Sapiens
NNCIRKSLD

SEQ ID NO: 405448 - protein, 9 aa, Homo Sapiens
NIFVLGPKY

SEQ ID NO: 405449 - protein, 9 aa, Homo Sapiens
MNKDFCADY

SEQ ID NO: 405450 - protein, 9 aa, Homo Sapiens
RLFACPSKA

SEQ ID NO: 405451 - protein, 9 aa, Homo Sapiens
LAWKESTIF

SEQ ID NO: 405452 - protein, 9 aa, Homo Sapiens
LPQDKIFYP

SEQ ID NO: 405453 - protein, 9 aa, Homo Sapiens
EALSVERKH

SEQ ID NO: 405454 - protein, 9 aa, Homo Sapiens
LLELDKVHE

SEQ ID NO: 405455 - protein, 9 aa, Homo Sapiens
GPRLDPADF

SEQ ID NO: 405456 - protein, 9 aa, Homo Sapiens
TQKGLNNVF

SEQ ID NO: 405457 - protein, 9 aa, Homo Sapiens
KPTRDDCGW

SEQ ID NO: 405458 - protein, 9 aa, Homo Sapiens
LSKMATNMF

SEQ ID NO: 405459 - protein, 9 aa, Homo Sapiens
RTKDVDKEE

SEQ ID NO: 405460 - protein, 9 aa, Homo Sapiens
VFFKTLQNH

SEQ ID NO: 405461 - protein, 9 aa, Homo Sapiens
PGPDQYLIS

SEQ ID NO: 405462 - protein, 9 aa, Homo Sapiens
MKYHILPER

SEQ ID NO: 405463 - protein, 9 aa, Homo Sapiens
AQLRFISYF

SEQ ID NO: 405464 - protein, 9 aa, Homo Sapiens
GWRIRKKYL

SEQ ID NO: 405465 - protein, 9 aa, Homo Sapiens
ENKKHKKKR

SEQ ID NO: 405466 - protein, 9 aa, Homo Sapiens
IKSQEPAFH

SEQ ID NO: 405467 - protein, 9 aa, Homo Sapiens
TVKIPMIKA

SEQ ID NO: 405468 - protein, 9 aa, Homo Sapiens
QTALIEKNK

SEQ ID NO: 405469 - protein, 9 aa, Homo Sapiens
KYSKATNAD

SEQ ID NO: 405470 - protein, 9 aa, Homo Sapiens
TKHQITHTR

SEQ ID NO: 405471 - protein, 9 aa, Homo Sapiens
CGTHKGDYF

SEQ ID NO: 405472 - protein, 9 aa, Homo Sapiens
YVTVLLYTM

SEQ ID NO: 405473 - protein, 9 aa, Homo Sapiens
LNTFMLEKV

SEQ ID NO: 405474 - protein, 9 aa, Homo Sapiens
EKLPPTVLE

SEQ ID NO: 405475 - protein, 9 aa, Homo Sapiens
NNCVKKTCA

SEQ ID NO: 405476 - protein, 9 aa, Homo Sapiens
EFKNISTIN

SEQ ID NO: 405477 - protein, 9 aa, Homo Sapiens
MDRTPDKLK

SEQ ID NO: 405478 - protein, 9 aa, Homo Sapiens
NVNYCTGIL

SEQ ID NO: 405479 - protein, 9 aa, Homo Sapiens
EGRNSPEVS

SEQ ID NO: 405480 - protein, 9 aa, Homo Sapiens
DTIQNERNK

SEQ ID NO: 405481 - protein, 9 aa, Homo Sapiens
PPEAEMRTY

SEQ ID NO: 405482 - protein, 9 aa, Homo Sapiens
WQILVEGFD

SEQ ID NO: 405483 - protein, 9 aa, Homo Sapiens
HLQNSDRLI

SEQ ID NO: 405484 - protein, 9 aa, Homo Sapiens
QMGIISPFS

SEQ ID NO: 405485 - protein, 9 aa, Homo Sapiens
VRTIDEDCS

SEQ ID NO: 405486 - protein, 9 aa, Homo Sapiens
QICIPRSLS

SEQ ID NO: 405487 - protein, 9 aa, Homo Sapiens
FRNLRKQSI

SEQ ID NO: 405488 - protein, 9 aa, Homo Sapiens
FDVQTRKQI

SEQ ID NO: 405489 - protein, 9 aa, Homo Sapiens
HLKSTLEMG

SEQ ID NO: 405490 - protein, 9 aa, Homo Sapiens
EKAKQNTEL

SEQ ID NO: 405491 - protein, 9 aa, Homo Sapiens
LQQKVTAYT

SEQ ID NO: 405492 - protein, 9 aa, Homo Sapiens
LFIKALKGD

SEQ ID NO: 405493 - protein, 9 aa, Homo Sapiens
TVTTYASAH

SEQ ID NO: 405494 - protein, 9 aa, Homo Sapiens
GSLIIQPVL

SEQ ID NO: 405495 - protein, 9 aa, Homo Sapiens
MVCFLKVQI

SEQ ID NO: 405496 - protein, 9 aa, Homo Sapiens
YPSLVQGRI

SEQ ID NO: 405497 - protein, 9 aa, Homo Sapiens
HIGTLSVYG

SEQ ID NO: 405498 - protein, 9 aa, Homo Sapiens
SSLQGIQLF

SEQ ID NO: 405499 - protein, 9 aa, Homo Sapiens
VTNIYVKNY

SEQ ID NO: 405500 - protein, 9 aa, Homo Sapiens
GEPIQSWDN

SEQ ID NO: 405501 - protein, 9 aa, Homo Sapiens
INVILSTKS

SEQ ID NO: 405502 - protein, 9 aa, Homo Sapiens
KIKREEDEE

SEQ ID NO: 405503 - protein, 9 aa, Homo Sapiens
VDTSQDISF

SEQ ID NO: 405504 - protein, 9 aa, Homo Sapiens
QFYLFFSLG

SEQ ID NO: 405505 - protein, 9 aa, Homo Sapiens
GNNMTKSTS

SEQ ID NO: 405506 - protein, 9 aa, Homo Sapiens
HTDPEDNEM

SEQ ID NO: 405507 - protein, 9 aa, Homo Sapiens
STVTTYASA

SEQ ID NO: 405508 - protein, 9 aa, Homo Sapiens
ATKVQRHDM

SEQ ID NO: 405509 - protein, 9 aa, Homo Sapiens
LEAHKAEAE

SEQ ID NO: 405510 - protein, 9 aa, Homo Sapiens
HWNNFALVP

SEQ ID NO: 405511 - protein, 9 aa, Homo Sapiens
DGLNREQGD

SEQ ID NO: 405512 - protein, 9 aa, Homo Sapiens
EQWPDPRHN

SEQ ID NO: 405513 - protein, 9 aa, Homo Sapiens
VFYCIKVSY

SEQ ID NO: 405514 - protein, 9 aa, Homo Sapiens
VPAAYCGVG

SEQ ID NO: 405515 - protein, 9 aa, Homo Sapiens
LKNTSRGSA

SEQ ID NO: 405516 - protein, 9 aa, Homo Sapiens
MRKLVRLKL

SEQ ID NO: 405517 - protein, 9 aa, Homo Sapiens
LWVDSTPLP

SEQ ID NO: 405518 - protein, 9 aa, Homo Sapiens
QALVRFSLL

SEQ ID NO: 405519 - protein, 9 aa, Homo Sapiens
IDSHNSKDS

SEQ ID NO: 405520 - protein, 9 aa, Homo Sapiens
EEFKKLICN

SEQ ID NO: 405521 - protein, 9 aa, Homo Sapiens
INFVDLLDI

SEQ ID NO: 405522 - protein, 9 aa, Homo Sapiens
LTLSSSFSD

SEQ ID NO: 405523 - protein, 9 aa, Homo Sapiens
LKCQKQANA

SEQ ID NO: 405524 - protein, 9 aa, Homo Sapiens
EHVFNVIPE

SEQ ID NO: 405525 - protein, 9 aa, Homo Sapiens
VFKVLKPDT

SEQ ID NO: 405526 - protein, 9 aa, Homo Sapiens
MTQGFRVIA

SEQ ID NO: 405527 - protein, 9 aa, Homo Sapiens
IFGVPKILN

SEQ ID NO: 405528 - protein, 9 aa, Homo Sapiens
VLEAHKAEA

SEQ ID NO: 405529 - protein, 9 aa, Homo Sapiens
KENEDNIQC

SEQ ID NO: 405530 - protein, 9 aa, Homo Sapiens
NNEEGSVAE

SEQ ID NO: 405531 - protein, 9 aa, Homo Sapiens
HDMMLENLT

SEQ ID NO: 405532 - protein, 9 aa, Homo Sapiens
QESIKFDIV

SEQ ID NO: 405533 - protein, 9 aa, Homo Sapiens
NISYDLHHK

SEQ ID NO: 405534 - protein, 9 aa, Homo Sapiens
CFKSTLVKI

SEQ ID NO: 405535 - protein, 9 aa, Homo Sapiens
IIHGNDPNY

SEQ ID NO: 405536 - protein, 9 aa, Homo Sapiens
IFFLYYWWL

SEQ ID NO: 405537 - protein, 9 aa, Homo Sapiens
ALRKIIRRD

SEQ ID NO: 405538 - protein, 9 aa, Homo Sapiens
EFLVRLFAC

SEQ ID NO: 405539 - protein, 9 aa, Homo Sapiens
PLMRASGPV

SEQ ID NO: 405540 - protein, 9 aa, Homo Sapiens
QHIPSLPPS

SEQ ID NO: 405541 - protein, 9 aa, Homo Sapiens
YFITHSLKF

SEQ ID NO: 405542 - protein, 9 aa, Homo Sapiens
TLLDSTQML

SEQ ID NO: 405543 - protein, 9 aa, Homo Sapiens
EIFHADMAK

SEQ ID NO: 405544 - protein, 9 aa, Homo Sapiens
EKIWIEIIA

SEQ ID NO: 405545 - protein, 9 aa, Homo Sapiens
LTVHKVIYT

SEQ ID NO: 405546 - protein, 9 aa, Homo Sapiens
TPLCCAAAA

SEQ ID NO: 405547 - protein, 9 aa, Homo Sapiens
TQAPTDKNS

SEQ ID NO: 405548 - protein, 9 aa, Homo Sapiens
ATGGVEKAV

SEQ ID NO: 405549 - protein, 9 aa, Homo Sapiens
SVKVLSKPL

SEQ ID NO: 405550 - protein, 9 aa, Homo Sapiens
VIPINVILS

SEQ ID NO: 405551 - protein, 9 aa, Homo Sapiens
RSRSRSPKI

SEQ ID NO: 405552 - protein, 9 aa, Homo Sapiens
HKQTSDSDS

SEQ ID NO: 405553 - protein, 9 aa, Homo Sapiens
PPADARALG

SEQ ID NO: 405554 - protein, 9 aa, Homo Sapiens
QYLNVANNI

SEQ ID NO: 405555 - protein, 9 aa, Homo Sapiens
FYHQQQQQQ

SEQ ID NO: 405556 - protein, 9 aa, Homo Sapiens
YDTLKDENS

SEQ ID NO: 405557 - protein, 9 aa, Homo Sapiens
PLLLILVFY

SEQ ID NO: 405558 - protein, 9 aa, Homo Sapiens
KAFSVCSSR

SEQ ID NO: 405559 - protein, 9 aa, Homo Sapiens
KLCTLKLSY

SEQ ID NO: 405560 - protein, 9 aa, Homo Sapiens
YMQFRVDSV

SEQ ID NO: 405561 - protein, 9 aa, Homo Sapiens
HGREQGVIS

SEQ ID NO: 405562 - protein, 9 aa, Homo Sapiens
VQSEWCHYK

SEQ ID NO: 405563 - protein, 9 aa, Homo Sapiens
CPATSKDNF

SEQ ID NO: 405564 - protein, 9 aa, Homo Sapiens
EIIQCRNIT

SEQ ID NO: 405565 - protein, 9 aa, Homo Sapiens
ILINFVDLL

SEQ ID NO: 405566 - protein, 9 aa, Homo Sapiens
VFPLSLYSL

SEQ ID NO: 405567 - protein, 9 aa, Homo Sapiens
GGRADIGFA

SEQ ID NO: 405568 - protein, 9 aa, Homo Sapiens
GRSSCLSSW

SEQ ID NO: 405569 - protein, 9 aa, Homo Sapiens
THTGEKQYE

SEQ ID NO: 405570 - protein, 9 aa, Homo Sapiens
NPFRYIMEC

SEQ ID NO: 405571 - protein, 9 aa, Homo Sapiens
EPRENGIHL

SEQ ID NO: 405572 - protein, 9 aa, Homo Sapiens
ATTEKWRFR

SEQ ID NO: 405573 - protein, 9 aa, Homo Sapiens
MQYVHTHSA

SEQ ID NO: 405574 - protein, 9 aa, Homo Sapiens
TDCQYVSWR

SEQ ID NO: 405575 - protein, 9 aa, Homo Sapiens
TTLKRLHKA

SEQ ID NO: 405576 - protein, 9 aa, Homo Sapiens
LKELFAKAR

SEQ ID NO: 405577 - protein, 9 aa, Homo Sapiens
YLHRKTPGP

SEQ ID NO: 405578 - protein, 9 aa, Homo Sapiens
EEVPYSELD

SEQ ID NO: 405579 - protein, 9 aa, Homo Sapiens
SEIIVRNVL

SEQ ID NO: 405580 - protein, 9 aa, Homo Sapiens
ITNSQNKIK

SEQ ID NO: 405581 - protein, 9 aa, Homo Sapiens
KQKGAQLHE

SEQ ID NO: 405582 - protein, 9 aa, Homo Sapiens
PEIIKQIPS

SEQ ID NO: 405583 - protein, 9 aa, Homo Sapiens
YTGCYVSAT

SEQ ID NO: 405584 - protein, 9 aa, Homo Sapiens
LLQDLFIVL

SEQ ID NO: 405585 - protein, 9 aa, Homo Sapiens
LLTCILWWL

SEQ ID NO: 405586 - protein, 9 aa, Homo Sapiens
GKGRREHKD

SEQ ID NO: 405587 - protein, 9 aa, Homo Sapiens
HSKDIFKRE

SEQ ID NO: 405588 - protein, 9 aa, Homo Sapiens
KSVITYVSL

SEQ ID NO: 405589 - protein, 9 aa, Homo Sapiens
LSKPLNAPN

SEQ ID NO: 405590 - protein, 9 aa, Homo Sapiens
IQLKPTVTN

SEQ ID NO: 405591 - protein, 9 aa, Homo Sapiens
NKAESWMRE

SEQ ID NO: 405592 - protein, 9 aa, Homo Sapiens
FHNQEIQRA

SEQ ID NO: 405593 - protein, 9 aa, Homo Sapiens
SSQRNCGAW

SEQ ID NO: 405594 - protein, 9 aa, Homo Sapiens
QEKRRESQK

SEQ ID NO: 405595 - protein, 9 aa, Homo Sapiens
QQLMQNFYH

SEQ ID NO: 405596 - protein, 9 aa, Homo Sapiens
FPQALYKVE

SEQ ID NO: 405597 - protein, 9 aa, Homo Sapiens
ADARALGEW

SEQ ID NO: 405598 - protein, 9 aa, Homo Sapiens
SLSEFESYE

SEQ ID NO: 405599 - protein, 9 aa, Homo Sapiens
GYFIQRYQD

SEQ ID NO: 405600 - protein, 9 aa, Homo Sapiens
EPQGPFYFC

SEQ ID NO: 405601 - protein, 9 aa, Homo Sapiens
HSDKSPPST

SEQ ID NO: 405602 - protein, 9 aa, Homo Sapiens
VLKLPYLSK

SEQ ID NO: 405603 - protein, 9 aa, Homo Sapiens
QSTFSGFGL

SEQ ID NO: 405604 - protein, 9 aa, Homo Sapiens
YSCPSCGQT

SEQ ID NO: 405605 - protein, 9 aa, Homo Sapiens
FSTLSQPAG

SEQ ID NO: 405606 - protein, 9 aa, Homo Sapiens
YLCEGMESP

SEQ ID NO: 405607 - protein, 9 aa, Homo Sapiens
TCLMIIYRL

SEQ ID NO: 405608 - protein, 9 aa, Homo Sapiens
DVTFFPFYL

SEQ ID NO: 405609 - protein, 9 aa, Homo Sapiens
WNNFALVPL

SEQ ID NO: 405610 - protein, 9 aa, Homo Sapiens
ECVHLYVQM

SEQ ID NO: 405611 - protein, 9 aa, Homo Sapiens
ITCTKRVVY

SEQ ID NO: 405612 - protein, 9 aa, Homo Sapiens
YRVVPCGKI

SEQ ID NO: 405613 - protein, 9 aa, Homo Sapiens
YKLYFAHHN

SEQ ID NO: 405614 - protein, 9 aa, Homo Sapiens
AIGTGLNPH

SEQ ID NO: 405615 - protein, 9 aa, Homo Sapiens
MPITWIKPT

SEQ ID NO: 405616 - protein, 9 aa, Homo Sapiens
TSALNNELF

SEQ ID NO: 405617 - protein, 9 aa, Homo Sapiens
TMASTKKLF

SEQ ID NO: 405618 - protein, 9 aa, Homo Sapiens
ADSAGAGTG

SEQ ID NO: 405619 - protein, 9 aa, Homo Sapiens
GHLSQQQKC

SEQ ID NO: 405620 - protein, 9 aa, Homo Sapiens
YTVLIEGKK

SEQ ID NO: 405621 - protein, 9 aa, Homo Sapiens
NIMLLKNKQ

SEQ ID NO: 405622 - protein, 9 aa, Homo Sapiens
LQITQSAPN

SEQ ID NO: 405623 - protein, 9 aa, Homo Sapiens
PSLVRYHEQ

SEQ ID NO: 405624 - protein, 9 aa, Homo Sapiens
INFERINTV

SEQ ID NO: 405625 - protein, 9 aa, Homo Sapiens
TRVQDLLST

SEQ ID NO: 405626 - protein, 9 aa, Homo Sapiens
NMFRELSDL

SEQ ID NO: 405627 - protein, 9 aa, Homo Sapiens
NMVSFNSKV

SEQ ID NO: 405628 - protein, 9 aa, Homo Sapiens
LINFVDLLD

SEQ ID NO: 405629 - protein, 9 aa, Homo Sapiens
PWIKLFFKI

SEQ ID NO: 405630 - protein, 9 aa, Homo Sapiens
TYLIQHQII

SEQ ID NO: 405631 - protein, 9 aa, Homo Sapiens
VSITVELKS

SEQ ID NO: 405632 - protein, 9 aa, Homo Sapiens
TKMFEKNVY

SEQ ID NO: 405633 - protein, 9 aa, Homo Sapiens
ECVICMNDA

SEQ ID NO: 405634 - protein, 9 aa, Homo Sapiens
PAKQISGKM

SEQ ID NO: 405635 - protein, 9 aa, Homo Sapiens
YYWWLPESS

SEQ ID NO: 405636 - protein, 9 aa, Homo Sapiens
TCKDKTLCI

SEQ ID NO: 405637 - protein, 9 aa, Homo Sapiens
PHSSRDTAE

SEQ ID NO: 405638 - protein, 9 aa, Homo Sapiens
PRHNKAYVV

SEQ ID NO: 405639 - protein, 9 aa, Homo Sapiens
SVHKSGKHV

SEQ ID NO: 405640 - protein, 9 aa, Homo Sapiens
TPSAVGRER

SEQ ID NO: 405641 - protein, 9 aa, Homo Sapiens
ICNRQSEAA

SEQ ID NO: 405642 - protein, 9 aa, Homo Sapiens
SAATTEKWR

SEQ ID NO: 405643 - protein, 9 aa, Homo Sapiens
TIVEYPQTK

SEQ ID NO: 405644 - protein, 9 aa, Homo Sapiens
QFIQEHSEI

SEQ ID NO: 405645 - protein, 9 aa, Homo Sapiens
KEEVGYFIQ

SEQ ID NO: 405646 - protein, 9 aa, Homo Sapiens
DKQCQEGSS

SEQ ID NO: 405647 - protein, 9 aa, Homo Sapiens
IKLFSVPSQ

SEQ ID NO: 405648 - protein, 9 aa, Homo Sapiens
QFKSSNKSN

SEQ ID NO: 405649 - protein, 9 aa, Homo Sapiens
HLSISVVLT

SEQ ID NO: 405650 - protein, 9 aa, Homo Sapiens
ARDSSFLMS

SEQ ID NO: 405651 - protein, 9 aa, Homo Sapiens
KHVSLNKAN

SEQ ID NO: 405652 - protein, 9 aa, Homo Sapiens
IEIFDVQTR

SEQ ID NO: 405653 - protein, 9 aa, Homo Sapiens
KLSWGPYLQ

SEQ ID NO: 405654 - protein, 9 aa, Homo Sapiens
CVYRVLFKH

SEQ ID NO: 405655 - protein, 9 aa, Homo Sapiens
DDCGWFVTP

SEQ ID NO: 405656 - protein, 9 aa, Homo Sapiens
IQEPKSAVY

SEQ ID NO: 405657 - protein, 9 aa, Homo Sapiens
VVNVTGLNQ

SEQ ID NO: 405658 - protein, 9 aa, Homo Sapiens
KDLSPEDVF

SEQ ID NO: 405659 - protein, 9 aa, Homo Sapiens
QMKTHSRNI

SEQ ID NO: 405660 - protein, 9 aa, Homo Sapiens
LCPQVDKGD

SEQ ID NO: 405661 - protein, 9 aa, Homo Sapiens
STGACTANM

SEQ ID NO: 405662 - protein, 9 aa, Homo Sapiens
GGCQYLRCG

SEQ ID NO: 405663 - protein, 9 aa, Homo Sapiens
KKSRSVMMV

SEQ ID NO: 405664 - protein, 9 aa, Homo Sapiens
SISQLLGSM

SEQ ID NO: 405665 - protein, 9 aa, Homo Sapiens
PPVNATGHQ

SEQ ID NO: 405666 - protein, 9 aa, Homo Sapiens
SYSAYISDK

SEQ ID NO: 405667 - protein, 9 aa, Homo Sapiens
RDHYEELKR

SEQ ID NO: 405668 - protein, 9 aa, Homo Sapiens
AEQERLSQM

SEQ ID NO: 405669 - protein, 9 aa, Homo Sapiens
PPRKRFAFF

SEQ ID NO: 405670 - protein, 9 aa, Homo Sapiens
GWAGSGHPE

SEQ ID NO: 405671 - protein, 9 aa, Homo Sapiens
DKRMNNIKP

SEQ ID NO: 405672 - protein, 9 aa, Homo Sapiens
QGRQQHTRE

SEQ ID NO: 405673 - protein, 9 aa, Homo Sapiens
KLLSAGAIR

SEQ ID NO: 405674 - protein, 9 aa, Homo Sapiens
LVSFLKKVG

SEQ ID NO: 405675 - protein, 9 aa, Homo Sapiens
FFLHPQKET

SEQ ID NO: 405676 - protein, 9 aa, Homo Sapiens
IMQVPPSIL

SEQ ID NO: 405677 - protein, 9 aa, Homo Sapiens
VMYRISCLR

SEQ ID NO: 405678 - protein, 9 aa, Homo Sapiens
VNEGGKEVM

SEQ ID NO: 405679 - protein, 9 aa, Homo Sapiens
ELEHLKLEP

SEQ ID NO: 405680 - protein, 9 aa, Homo Sapiens
TAGGDGHAA

SEQ ID NO: 405681 - protein, 9 aa, Homo Sapiens
PNQKVKSLC

SEQ ID NO: 405682 - protein, 9 aa, Homo Sapiens
PTQERSTSL

SEQ ID NO: 405683 - protein, 9 aa, Homo Sapiens
NRQIYPPST

SEQ ID NO: 405684 - protein, 9 aa, Homo Sapiens
EPGQKDLQH

SEQ ID NO: 405685 - protein, 9 aa, Homo Sapiens
AILILLGAF

SEQ ID NO: 405686 - protein, 9 aa, Homo Sapiens
KILVQCAIR

SEQ ID NO: 405687 - protein, 9 aa, Homo Sapiens
PHLELEDDT

SEQ ID NO: 405688 - protein, 9 aa, Homo Sapiens
GGYHRSGKQ

SEQ ID NO: 405689 - protein, 9 aa, Homo Sapiens
VMFEMHELN

SEQ ID NO: 405690 - protein, 9 aa, Homo Sapiens
SAEVELIFL

SEQ ID NO: 405691 - protein, 9 aa, Homo Sapiens
CADQFCRQH

SEQ ID NO: 405692 - protein, 9 aa, Homo Sapiens
AAWPVDRLW

SEQ ID NO: 405693 - protein, 9 aa, Homo Sapiens
ATSLVSLSS

SEQ ID NO: 405694 - protein, 9 aa, Homo Sapiens
PLQCWGRRR

SEQ ID NO: 405695 - protein, 9 aa, Homo Sapiens
APPRTARGV

SEQ ID NO: 405696 - protein, 9 aa, Homo Sapiens
ESQDEPWEE

SEQ ID NO: 405697 - protein, 9 aa, Homo Sapiens
KKIFFQKCI

SEQ ID NO: 405698 - protein, 9 aa, Homo Sapiens
SAAWSTCCC

SEQ ID NO: 405699 - protein, 9 aa, Homo Sapiens
PPPWRAALL

SEQ ID NO: 405700 - protein, 9 aa, Homo Sapiens
FITNMDVFI

SEQ ID NO: 405701 - protein, 9 aa, Homo Sapiens
CQSPFSQLI

SEQ ID NO: 405702 - protein, 9 aa, Homo Sapiens
PENRCQFCE

SEQ ID NO: 405703 - protein, 9 aa, Homo Sapiens
CTLVLDTMA

SEQ ID NO: 405704 - protein, 9 aa, Homo Sapiens
ELLMVPDGW

SEQ ID NO: 405705 - protein, 9 aa, Homo Sapiens
VKWLHLLDQ

SEQ ID NO: 405706 - protein, 9 aa, Homo Sapiens
RNIALQNDS

SEQ ID NO: 405707 - protein, 9 aa, Homo Sapiens
EFSDVNEGG

SEQ ID NO: 405708 - protein, 9 aa, Homo Sapiens
LKKRAVFTK

SEQ ID NO: 405709 - protein, 9 aa, Homo Sapiens
VYNTSTVEG

SEQ ID NO: 405710 - protein, 9 aa, Homo Sapiens
RDWGTMAEE

SEQ ID NO: 405711 - protein, 9 aa, Homo Sapiens
GHPLRSASS

SEQ ID NO: 405712 - protein, 9 aa, Homo Sapiens
PWRPHAGPA

SEQ ID NO: 405713 - protein, 9 aa, Homo Sapiens
EAEDEDEKN

SEQ ID NO: 405714 - protein, 9 aa, Homo Sapiens
ACPVACLAA

SEQ ID NO: 405715 - protein, 9 aa, Homo Sapiens
ACTMPPLLH

SEQ ID NO: 405716 - protein, 9 aa, Homo Sapiens
RHPHRSPPT

SEQ ID NO: 405717 - protein, 9 aa, Homo Sapiens
PDQLMPYFA

SEQ ID NO: 405718 - protein, 9 aa, Homo Sapiens
LGAREGLIV

SEQ ID NO: 405719 - protein, 9 aa, Homo Sapiens
PGPSRAHCP

SEQ ID NO: 405720 - protein, 9 aa, Homo Sapiens
SSSNLGVDD

SEQ ID NO: 405721 - protein, 9 aa, Homo Sapiens
LPLCLKVVK

SEQ ID NO: 405722 - protein, 9 aa, Homo Sapiens
SVRQIYSEH

SEQ ID NO: 405723 - protein, 9 aa, Homo Sapiens
LRVMLEGQA

SEQ ID NO: 405724 - protein, 9 aa, Homo Sapiens
ALLPRAVSG

SEQ ID NO: 405725 - protein, 9 aa, Homo Sapiens
WCFRLSYDI

SEQ ID NO: 405726 - protein, 9 aa, Homo Sapiens
SITVSFVGQ

SEQ ID NO: 405727 - protein, 9 aa, Homo Sapiens
ERCCRCLHF

SEQ ID NO: 405728 - protein, 9 aa, Homo Sapiens
HVQEMQEKL

SEQ ID NO: 405729 - protein, 9 aa, Homo Sapiens
EPSRLGGGR

SEQ ID NO: 405730 - protein, 9 aa, Homo Sapiens
RSLQSMAKP

SEQ ID NO: 405731 - protein, 9 aa, Homo Sapiens
HQAGAAPRA

SEQ ID NO: 405732 - protein, 9 aa, Homo Sapiens
TITTPNKFA

SEQ ID NO: 405733 - protein, 9 aa, Homo Sapiens
SLSTATSTL

SEQ ID NO: 405734 - protein, 9 aa, Homo Sapiens
LDQDDNAPE

SEQ ID NO: 405735 - protein, 9 aa, Homo Sapiens
TKEEDILAS

SEQ ID NO: 405736 - protein, 9 aa, Homo Sapiens
LGQGAGHAA

SEQ ID NO: 405737 - protein, 9 aa, Homo Sapiens
GEWEIVHQP

SEQ ID NO: 405738 - protein, 9 aa, Homo Sapiens
HSLKQVHLV

SEQ ID NO: 405739 - protein, 9 aa, Homo Sapiens
KRRLSQGQR

SEQ ID NO: 405740 - protein, 9 aa, Homo Sapiens
AVVNCFQKA

SEQ ID NO: 405741 - protein, 9 aa, Homo Sapiens
PLVDSPAPA

SEQ ID NO: 405742 - protein, 9 aa, Homo Sapiens
SGGSGGCQY

SEQ ID NO: 405743 - protein, 9 aa, Homo Sapiens
LMNQNPNGE

SEQ ID NO: 405744 - protein, 9 aa, Homo Sapiens
RNLADLCRS

SEQ ID NO: 405745 - protein, 9 aa, Homo Sapiens
QRRYFYPFP

SEQ ID NO: 405746 - protein, 9 aa, Homo Sapiens
LLLVVLAAV

SEQ ID NO: 405747 - protein, 9 aa, Homo Sapiens
MLSLFFAGT

SEQ ID NO: 405748 - protein, 9 aa, Homo Sapiens
FCVIYVHLH

SEQ ID NO: 405749 - protein, 9 aa, Homo Sapiens
SLLDDAKAP

SEQ ID NO: 405750 - protein, 9 aa, Homo Sapiens
EYRVLQDKG

SEQ ID NO: 405751 - protein, 9 aa, Homo Sapiens
SMAPALSCT

SEQ ID NO: 405752 - protein, 9 aa, Homo Sapiens
DDDDSHCSF

SEQ ID NO: 405753 - protein, 9 aa, Homo Sapiens
NVELRGQLL

SEQ ID NO: 405754 - protein, 9 aa, Homo Sapiens
SNNGHLSQD

SEQ ID NO: 405755 - protein, 9 aa, Homo Sapiens
TPVDTPDIP

SEQ ID NO: 405756 - protein, 9 aa, Homo Sapiens
RCSPSATSL

SEQ ID NO: 405757 - protein, 9 aa, Homo Sapiens
HRFSCISRK

SEQ ID NO: 405758 - protein, 9 aa, Homo Sapiens
GEAPGDPIQ

SEQ ID NO: 405759 - protein, 9 aa, Homo Sapiens
GLRASVDAK

SEQ ID NO: 405760 - protein, 9 aa, Homo Sapiens
PAPPLLVLH

SEQ ID NO: 405761 - protein, 9 aa, Homo Sapiens
VRVAITEHA

SEQ ID NO: 405762 - protein, 9 aa, Homo Sapiens
RLLRDFEEC

SEQ ID NO: 405763 - protein, 9 aa, Homo Sapiens
TSWMSSCSK

SEQ ID NO: 405764 - protein, 9 aa, Homo Sapiens
MGCLLLGAL

SEQ ID NO: 405765 - protein, 9 aa, Homo Sapiens
HFTAESYTV

SEQ ID NO: 405766 - protein, 9 aa, Homo Sapiens
LTPSAAWST

SEQ ID NO: 405767 - protein, 9 aa, Homo Sapiens
CRAAGPGTG

SEQ ID NO: 405768 - protein, 9 aa, Homo Sapiens
AVPLGPART

SEQ ID NO: 405769 - protein, 9 aa, Homo Sapiens
LDIKGGDLL

SEQ ID NO: 405770 - protein, 9 aa, Homo Sapiens
FSRLGRYFV

SEQ ID NO: 405771 - protein, 9 aa, Homo Sapiens
LDPTSSSFS

SEQ ID NO: 405772 - protein, 9 aa, Homo Sapiens
YCRALLHKP

SEQ ID NO: 405773 - protein, 9 aa, Homo Sapiens
AARPPQPPP

SEQ ID NO: 405774 - protein, 9 aa, Homo Sapiens
SDEAGVTHT

SEQ ID NO: 405775 - protein, 9 aa, Homo Sapiens
LIMMMNHIL

SEQ ID NO: 405776 - protein, 9 aa, Homo Sapiens
KPRSLQPPS

SEQ ID NO: 405777 - protein, 9 aa, Homo Sapiens
EPLATPRHQ

SEQ ID NO: 405778 - protein, 9 aa, Homo Sapiens
GDTLLHLIP

SEQ ID NO: 405779 - protein, 9 aa, Homo Sapiens
DANVLTPSA

SEQ ID NO: 405780 - protein, 9 aa, Homo Sapiens
SLAAATGTA

SEQ ID NO: 405781 - protein, 9 aa, Homo Sapiens
NPLPEEQPG

SEQ ID NO: 405782 - protein, 9 aa, Homo Sapiens
RVPFLFVVQ

SEQ ID NO: 405783 - protein, 9 aa, Homo Sapiens
CCATRESLS

SEQ ID NO: 405784 - protein, 9 aa, Homo Sapiens
EMKRDREFR

SEQ ID NO: 405785 - protein, 9 aa, Homo Sapiens
SPRSSLPLL

SEQ ID NO: 405786 - protein, 9 aa, Homo Sapiens
GSLVGVPPL

SEQ ID NO: 405787 - protein, 9 aa, Homo Sapiens
GGTVDNNIH

SEQ ID NO: 405788 - protein, 9 aa, Homo Sapiens
CPPTCLAGH

SEQ ID NO: 405789 - protein, 9 aa, Homo Sapiens
LLDEDPLSQ

SEQ ID NO: 405790 - protein, 9 aa, Homo Sapiens
YPSTTLPEE

SEQ ID NO: 405791 - protein, 9 aa, Homo Sapiens
YSDLFHSLK

SEQ ID NO: 405792 - protein, 9 aa, Homo Sapiens
KGKASLTIG

SEQ ID NO: 405793 - protein, 9 aa, Homo Sapiens
CGFGFVYFQ

SEQ ID NO: 405794 - protein, 9 aa, Homo Sapiens
GTSLQEASM

SEQ ID NO: 405795 - protein, 9 aa, Homo Sapiens
AHLAYKLSI

SEQ ID NO: 405796 - protein, 9 aa, Homo Sapiens
TWINDISLG

SEQ ID NO: 405797 - protein, 9 aa, Homo Sapiens
WSACPVACL

SEQ ID NO: 405798 - protein, 9 aa, Homo Sapiens
LVSTEGEVE

SEQ ID NO: 405799 - protein, 9 aa, Homo Sapiens
SWSAGLHNQ

SEQ ID NO: 405800 - protein, 9 aa, Homo Sapiens
MDSAWSLTS

SEQ ID NO: 405801 - protein, 9 aa, Homo Sapiens
CPHILDRLQ

SEQ ID NO: 405802 - protein, 9 aa, Homo Sapiens
LLALESQLR

SEQ ID NO: 405803 - protein, 9 aa, Homo Sapiens
MHDHNHRLH

SEQ ID NO: 405804 - protein, 9 aa, Homo Sapiens
ILKHLQVLD

SEQ ID NO: 405805 - protein, 9 aa, Homo Sapiens
ELAKKQKFR

SEQ ID NO: 405806 - protein, 9 aa, Homo Sapiens
TDLQLTVGR

SEQ ID NO: 405807 - protein, 9 aa, Homo Sapiens
KITIKMNMT

SEQ ID NO: 405808 - protein, 9 aa, Homo Sapiens
LHVWKVTVL

SEQ ID NO: 405809 - protein, 9 aa, Homo Sapiens
FLGDLLAVP

SEQ ID NO: 405810 - protein, 9 aa, Homo Sapiens
PHPEGLHQR

SEQ ID NO: 405811 - protein, 9 aa, Homo Sapiens
AEVREIKRI

SEQ ID NO: 405812 - protein, 9 aa, Homo Sapiens
LHYVPLWKV

SEQ ID NO: 405813 - protein, 9 aa, Homo Sapiens
WEYDHMNGS

SEQ ID NO: 405814 - protein, 9 aa, Homo Sapiens
FYLSNAHPD

SEQ ID NO: 405815 - protein, 9 aa, Homo Sapiens
DGGGSFSTA

SEQ ID NO: 405816 - protein, 9 aa, Homo Sapiens
RSWGQQAHE

SEQ ID NO: 405817 - protein, 9 aa, Homo Sapiens
CCAETAVSV

SEQ ID NO: 405818 - protein, 9 aa, Homo Sapiens
LRLRPHLRG

SEQ ID NO: 405819 - protein, 9 aa, Homo Sapiens
LEAPPVGGR

SEQ ID NO: 405820 - protein, 9 aa, Homo Sapiens
VLFMTMGMQ

SEQ ID NO: 405821 - protein, 9 aa, Homo Sapiens
GNGCTFKIL

SEQ ID NO: 405822 - protein, 9 aa, Homo Sapiens
RGRLQHHLH

SEQ ID NO: 405823 - protein, 9 aa, Homo Sapiens
SHQGMVIAS

SEQ ID NO: 405824 - protein, 9 aa, Homo Sapiens
QMTDMLLTP

SEQ ID NO: 405825 - protein, 9 aa, Homo Sapiens
STVHIMKNR

SEQ ID NO: 405826 - protein, 9 aa, Homo Sapiens
RKRRLSQGQ

SEQ ID NO: 405827 - protein, 9 aa, Homo Sapiens
WAFVPTPCA

SEQ ID NO: 405828 - protein, 9 aa, Homo Sapiens
IATITTLLL

SEQ ID NO: 405829 - protein, 9 aa, Homo Sapiens
IELHPLLIR

SEQ ID NO: 405830 - protein, 9 aa, Homo Sapiens
IHGPAPAPK

SEQ ID NO: 405831 - protein, 9 aa, Homo Sapiens
INTCGCHQT

SEQ ID NO: 405832 - protein, 9 aa, Homo Sapiens
IVHGHYKQS

SEQ ID NO: 405833 - protein, 9 aa, Homo Sapiens
WGPHPPLWS

SEQ ID NO: 405834 - protein, 9 aa, Homo Sapiens
AAASGTAAA

SEQ ID NO: 405835 - protein, 9 aa, Homo Sapiens
EDSHYLHIQ

SEQ ID NO: 405836 - protein, 9 aa, Homo Sapiens
TTQISHSRG

SEQ ID NO: 405837 - protein, 9 aa, Homo Sapiens
KRWLGVSEQ

SEQ ID NO: 405838 - protein, 9 aa, Homo Sapiens
LRVPEEAAQ

SEQ ID NO: 405839 - protein, 9 aa, Homo Sapiens
SMLCMNQLS

SEQ ID NO: 405840 - protein, 9 aa, Homo Sapiens
LPLAGSQMQ

SEQ ID NO: 405841 - protein, 9 aa, Homo Sapiens
EKLVSFLKK

SEQ ID NO: 405842 - protein, 9 aa, Homo Sapiens
LLIVTIIAT

SEQ ID NO: 405843 - protein, 9 aa, Homo Sapiens
ATHYIGDLR

SEQ ID NO: 405844 - protein, 9 aa, Homo Sapiens
GRTRSSGWM

SEQ ID NO: 405845 - protein, 9 aa, Homo Sapiens
CNHVHVSVK

SEQ ID NO: 405846 - protein, 9 aa, Homo Sapiens
RIMGVVGCA

SEQ ID NO: 405847 - protein, 9 aa, Homo Sapiens
PSTGACTAN

SEQ ID NO: 405848 - protein, 9 aa, Homo Sapiens
TAEVNWKVL

SEQ ID NO: 405849 - protein, 9 aa, Homo Sapiens
VWIFFFFAL

SEQ ID NO: 405850 - protein, 9 aa, Homo Sapiens
RKLGPEELD

SEQ ID NO: 405851 - protein, 9 aa, Homo Sapiens
YYGEKNWYL

SEQ ID NO: 405852 - protein, 9 aa, Homo Sapiens
HGCNFNNGG

SEQ ID NO: 405853 - protein, 9 aa, Homo Sapiens
DGRGGSLLG

SEQ ID NO: 405854 - protein, 9 aa, Homo Sapiens
HEHNRVCDL

SEQ ID NO: 405855 - protein, 9 aa, Homo Sapiens
VKDLSSEEV

SEQ ID NO: 405856 - protein, 9 aa, Homo Sapiens
LFITSGITS

SEQ ID NO: 405857 - protein, 9 aa, Homo Sapiens
RLQLFIHCP

SEQ ID NO: 405858 - protein, 9 aa, Homo Sapiens
APLSRSAPT

SEQ ID NO: 405859 - protein, 9 aa, Homo Sapiens
IGASKNSDG

SEQ ID NO: 405860 - protein, 9 aa, Homo Sapiens
ICVPVLRLS

SEQ ID NO: 405861 - protein, 9 aa, Homo Sapiens
VRIERIDGM

SEQ ID NO: 405862 - protein, 9 aa, Homo Sapiens
ISRAESQSC

SEQ ID NO: 405863 - protein, 9 aa, Homo Sapiens
HALQSPCIS

SEQ ID NO: 405864 - protein, 9 aa, Homo Sapiens
GRIEEIQYE

SEQ ID NO: 405865 - protein, 9 aa, Homo Sapiens
EQVHVRLHE

SEQ ID NO: 405866 - protein, 9 aa, Homo Sapiens
GPAVQPPEP

SEQ ID NO: 405867 - protein, 9 aa, Homo Sapiens
QAMIKIKKK

SEQ ID NO: 405868 - protein, 9 aa, Homo Sapiens
FTVFARVLN

SEQ ID NO: 405869 - protein, 9 aa, Homo Sapiens
DRLAVLGQQ

SEQ ID NO: 405870 - protein, 9 aa, Homo Sapiens
EHFPVVEQD

SEQ ID NO: 405871 - protein, 9 aa, Homo Sapiens
STGGIFEPS

SEQ ID NO: 405872 - protein, 9 aa, Homo Sapiens
SSLGSMSPF

SEQ ID NO: 405873 - protein, 9 aa, Homo Sapiens
DKKNMPQVV

SEQ ID NO: 405874 - protein, 9 aa, Homo Sapiens
HTHALQSPC

SEQ ID NO: 405875 - protein, 9 aa, Homo Sapiens
IGHLLDDGC

SEQ ID NO: 405876 - protein, 9 aa, Homo Sapiens
MHAQNLALV

SEQ ID NO: 405877 - protein, 9 aa, Homo Sapiens
PNLVRAHFS

SEQ ID NO: 405878 - protein, 9 aa, Homo Sapiens
MNVSTLELR

SEQ ID NO: 405879 - protein, 9 aa, Homo Sapiens
RGGGPSSSH

SEQ ID NO: 405880 - protein, 9 aa, Homo Sapiens
TETTTWHVT

SEQ ID NO: 405881 - protein, 9 aa, Homo Sapiens
MRAAASGTA

SEQ ID NO: 405882 - protein, 9 aa, Homo Sapiens
MHPLVSAGP

SEQ ID NO: 405883 - protein, 9 aa, Homo Sapiens
LALAQLNDR

SEQ ID NO: 405884 - protein, 9 aa, Homo Sapiens
VPRPRPRCC

SEQ ID NO: 405885 - protein, 9 aa, Homo Sapiens
RCCSLQSWS

SEQ ID NO: 405886 - protein, 9 aa, Homo Sapiens
EGMKRSSTL

SEQ ID NO: 405887 - protein, 9 aa, Homo Sapiens
VAGHDAEGS

SEQ ID NO: 405888 - protein, 9 aa, Homo Sapiens
LTFRIWHNE

SEQ ID NO: 405889 - protein, 9 aa, Homo Sapiens
AKADSTSEG

SEQ ID NO: 405890 - protein, 9 aa, Homo Sapiens
LDLLAVALF

SEQ ID NO: 405891 - protein, 9 aa, Homo Sapiens
GIGVDEKLS

SEQ ID NO: 405892 - protein, 9 aa, Homo Sapiens
VQEPMKRAS

SEQ ID NO: 405893 - protein, 9 aa, Homo Sapiens
AFHIYCLDL

SEQ ID NO: 405894 - protein, 9 aa, Homo Sapiens
SARIPDATR

SEQ ID NO: 405895 - protein, 9 aa, Homo Sapiens
RKDKKKKEM

SEQ ID NO: 405896 - protein, 9 aa, Homo Sapiens
SMESLCVPG

SEQ ID NO: 405897 - protein, 9 aa, Homo Sapiens
STDIGICTT

SEQ ID NO: 405898 - protein, 9 aa, Homo Sapiens
AQSPSPAHI

SEQ ID NO: 405899 - protein, 9 aa, Homo Sapiens
QEERYELPN

SEQ ID NO: 405900 - protein, 9 aa, Homo Sapiens
DLLIAAMEG

SEQ ID NO: 405901 - protein, 9 aa, Homo Sapiens
MNKHLRGGG

SEQ ID NO: 405902 - protein, 9 aa, Homo Sapiens
WSHSNLDTE

SEQ ID NO: 405903 - protein, 9 aa, Homo Sapiens
VKPQGLHDG

SEQ ID NO: 405904 - protein, 9 aa, Homo Sapiens
VYSLCIAEN

SEQ ID NO: 405905 - protein, 9 aa, Homo Sapiens
TDALEYSKC

SEQ ID NO: 405906 - protein, 9 aa, Homo Sapiens
RSMTTLPSW

SEQ ID NO: 405907 - protein, 9 aa, Homo Sapiens
SDVIITQQL

SEQ ID NO: 405908 - protein, 9 aa, Homo Sapiens
GVGSPFPVS

SEQ ID NO: 405909 - protein, 9 aa, Homo Sapiens
PLLKEMKRD

SEQ ID NO: 405910 - protein, 9 aa, Homo Sapiens
CLGRCCCSG

SEQ ID NO: 405911 - protein, 9 aa, Homo Sapiens
RCLPGFGGP

SEQ ID NO: 405912 - protein, 9 aa, Homo Sapiens
LMYPYKAEV

SEQ ID NO: 405913 - protein, 9 aa, Homo Sapiens
RLAVLGQQV

SEQ ID NO: 405914 - protein, 9 aa, Homo Sapiens
AQDLAQSYG

SEQ ID NO: 405915 - protein, 9 aa, Homo Sapiens
EDSSSSPRR

SEQ ID NO: 405916 - protein, 9 aa, Homo Sapiens
PCLEHVVEE

SEQ ID NO: 405917 - protein, 9 aa, Homo Sapiens
CRLRRWGLL

SEQ ID NO: 405918 - protein, 9 aa, Homo Sapiens
MAGRGGAAQ

SEQ ID NO: 405919 - protein, 9 aa, Homo Sapiens
CQKSIIDAH

SEQ ID NO: 405920 - protein, 9 aa, Homo Sapiens
ERKNETFVM

SEQ ID NO: 405921 - protein, 9 aa, Homo Sapiens
RHYDGAVQV

SEQ ID NO: 405922 - protein, 9 aa, Homo Sapiens
ISFWSKCVS

SEQ ID NO: 405923 - protein, 9 aa, Homo Sapiens
YFAMEIFAT

SEQ ID NO: 405924 - protein, 9 aa, Homo Sapiens
EEQARRQEQ

SEQ ID NO: 405925 - protein, 9 aa, Homo Sapiens
YTEVTDAQC

SEQ ID NO: 405926 - protein, 9 aa, Homo Sapiens
REQLWVNSD

SEQ ID NO: 405927 - protein, 9 aa, Homo Sapiens
CKGLNYRYH

SEQ ID NO: 405928 - protein, 9 aa, Homo Sapiens
MRRLHLSEC

SEQ ID NO: 405929 - protein, 9 aa, Homo Sapiens
MDCVCYSTV

SEQ ID NO: 405930 - protein, 9 aa, Homo Sapiens
SPTTAPWVK

SEQ ID NO: 405931 - protein, 9 aa, Homo Sapiens
RPRRRRRGR

SEQ ID NO: 405932 - protein, 9 aa, Homo Sapiens
AGDPTTLEY

SEQ ID NO: 405933 - protein, 9 aa, Homo Sapiens
LRRGRSCVS

SEQ ID NO: 405934 - protein, 9 aa, Homo Sapiens
LEKKCWIIK

SEQ ID NO: 405935 - protein, 9 aa, Homo Sapiens
SLVKREQLM

SEQ ID NO: 405936 - protein, 9 aa, Homo Sapiens
AEGLGAQVR

SEQ ID NO: 405937 - protein, 9 aa, Homo Sapiens
PMEVSASIL

SEQ ID NO: 405938 - protein, 9 aa, Homo Sapiens
DLVVRLHEG

SEQ ID NO: 405939 - protein, 9 aa, Homo Sapiens
WSKCVSSAM

SEQ ID NO: 405940 - protein, 9 aa, Homo Sapiens
IFLSKEKAS

SEQ ID NO: 405941 - protein, 9 aa, Homo Sapiens
QSFWKEPSL

SEQ ID NO: 405942 - protein, 9 aa, Homo Sapiens
SRAQDDGRG

SEQ ID NO: 405943 - protein, 9 aa, Homo Sapiens
GRRRARPGQ

SEQ ID NO: 405944 - protein, 9 aa, Homo Sapiens
LVKQGGRPD

SEQ ID NO: 405945 - protein, 9 aa, Homo Sapiens
SPRRNSQQY

SEQ ID NO: 405946 - protein, 9 aa, Homo Sapiens
KVVAAMPVR

SEQ ID NO: 405947 - protein, 9 aa, Homo Sapiens
AKKGRCYQL

SEQ ID NO: 405948 - protein, 9 aa, Homo Sapiens
GDFMSALLS

SEQ ID NO: 405949 - protein, 9 aa, Homo Sapiens
QPVVDSYSQ

SEQ ID NO: 405950 - protein, 9 aa, Homo Sapiens
KDFSQHAHL

SEQ ID NO: 405951 - protein, 9 aa, Homo Sapiens
RRDRSPLRR

SEQ ID NO: 405952 - protein, 9 aa, Homo Sapiens
SSDEDEFPH

SEQ ID NO: 405953 - protein, 9 aa, Homo Sapiens
KRRKRKGRG

SEQ ID NO: 405954 - protein, 9 aa, Homo Sapiens
LASKVKDTL

SEQ ID NO: 405955 - protein, 9 aa, Homo Sapiens
CSDDFDGVI

SEQ ID NO: 405956 - protein, 9 aa, Homo Sapiens
STDMVSFLL

SEQ ID NO: 405957 - protein, 9 aa, Homo Sapiens
RVVVRESDA

SEQ ID NO: 405958 - protein, 9 aa, Homo Sapiens
RLQAYARRY

SEQ ID NO: 405959 - protein, 9 aa, Homo Sapiens
QLLSAVLLH

SEQ ID NO: 405960 - protein, 9 aa, Homo Sapiens
SGWRSASQP

SEQ ID NO: 405961 - protein, 9 aa, Homo Sapiens
PALLDLPGL

SEQ ID NO: 405962 - protein, 9 aa, Homo Sapiens
LESQLRGER

SEQ ID NO: 405963 - protein, 9 aa, Homo Sapiens
RRGPQILCR

SEQ ID NO: 405964 - protein, 9 aa, Homo Sapiens
TRVHTDIQN

SEQ ID NO: 405965 - protein, 9 aa, Homo Sapiens
FLKIDEYMH

SEQ ID NO: 405966 - protein, 9 aa, Homo Sapiens
VCVMCLVSQ

SEQ ID NO: 405967 - protein, 9 aa, Homo Sapiens
EASFPIDEE

SEQ ID NO: 405968 - protein, 9 aa, Homo Sapiens
PPFFTIDLV

SEQ ID NO: 405969 - protein, 9 aa, Homo Sapiens
VRICLLSHL

SEQ ID NO: 405970 - protein, 9 aa, Homo Sapiens
QLQQRWHMA

SEQ ID NO: 405971 - protein, 9 aa, Homo Sapiens
TYSLVDREV

SEQ ID NO: 405972 - protein, 9 aa, Homo Sapiens
YNQTHLYTC

SEQ ID NO: 405973 - protein, 9 aa, Homo Sapiens
LNIEGMEKG

SEQ ID NO: 405974 - protein, 9 aa, Homo Sapiens
SRGIRLGVH

SEQ ID NO: 405975 - protein, 9 aa, Homo Sapiens
DRHIKLHTR

SEQ ID NO: 405976 - protein, 9 aa, Homo Sapiens
WFQNHRCKM

SEQ ID NO: 405977 - protein, 9 aa, Homo Sapiens
NPRAMKNRS

SEQ ID NO: 405978 - protein, 9 aa, Homo Sapiens
SLKQDGDDQ

SEQ ID NO: 405979 - protein, 9 aa, Homo Sapiens
PSALPSPPS

SEQ ID NO: 405980 - protein, 9 aa, Homo Sapiens
YLLSATKLC

SEQ ID NO: 405981 - protein, 9 aa, Homo Sapiens
FLSGCGQTF

SEQ ID NO: 405982 - protein, 9 aa, Homo Sapiens
ESDTGDHKQ

SEQ ID NO: 405983 - protein, 9 aa, Homo Sapiens
KVGPELLSP

SEQ ID NO: 405984 - protein, 9 aa, Homo Sapiens
LSMLCMNQL

SEQ ID NO: 405985 - protein, 9 aa, Homo Sapiens
LPVGGQGKE

SEQ ID NO: 405986 - protein, 9 aa, Homo Sapiens
DLKKKIAKG

SEQ ID NO: 405987 - protein, 9 aa, Homo Sapiens
LFDVNAIIA

SEQ ID NO: 405988 - protein, 9 aa, Homo Sapiens
FCCFGNFIW

SEQ ID NO: 405989 - protein, 9 aa, Homo Sapiens
PVKNLIVPR

SEQ ID NO: 405990 - protein, 9 aa, Homo Sapiens
ECSINHFQQ

SEQ ID NO: 405991 - protein, 9 aa, Homo Sapiens
LLQSNPQLR

SEQ ID NO: 405992 - protein, 9 aa, Homo Sapiens
TAPWWEFPL

SEQ ID NO: 405993 - protein, 9 aa, Homo Sapiens
GQGRVCTGM

SEQ ID NO: 405994 - protein, 9 aa, Homo Sapiens
RRKRSSQSR

SEQ ID NO: 405995 - protein, 9 aa, Homo Sapiens
TAYDLSVDM

SEQ ID NO: 405996 - protein, 9 aa, Homo Sapiens
LILRDPSEC

SEQ ID NO: 405997 - protein, 9 aa, Homo Sapiens
DIKGGDLLL

SEQ ID NO: 405998 - protein, 9 aa, Homo Sapiens
VAPRGLLCP

SEQ ID NO: 405999 - protein, 9 aa, Homo Sapiens
QTTSGPTAR

SEQ ID NO: 406000 - protein, 9 aa, Homo Sapiens
GMLLPRALP

SEQ ID NO: 406001 - protein, 9 aa, Homo Sapiens
LSSQVIDHG

SEQ ID NO: 406002 - protein, 9 aa, Homo Sapiens
SWSSPLPGR

SEQ ID NO: 406003 - protein, 9 aa, Homo Sapiens
PVMLLSPTC

SEQ ID NO: 406004 - protein, 9 aa, Homo Sapiens
STLELRDSA

SEQ ID NO: 406005 - protein, 9 aa, Homo Sapiens
CRVMCRCCG

SEQ ID NO: 406006 - protein, 9 aa, Homo Sapiens
ACAPISYPC

SEQ ID NO: 406007 - protein, 9 aa, Homo Sapiens
ARGHLVCVM

SEQ ID NO: 406008 - protein, 9 aa, Homo Sapiens
DFSGMAQDC

SEQ ID NO: 406009 - protein, 9 aa, Homo Sapiens
YFCDMGYHV

SEQ ID NO: 406010 - protein, 9 aa, Homo Sapiens
VDFYFIDFQ

SEQ ID NO: 406011 - protein, 9 aa, Homo Sapiens
SCTDSQSVR

SEQ ID NO: 406012 - protein, 9 aa, Homo Sapiens
ATSNTEEII

SEQ ID NO: 406013 - protein, 9 aa, Homo Sapiens
SLFTCLQAW

SEQ ID NO: 406014 - protein, 9 aa, Homo Sapiens
QQLQRMHHQ

SEQ ID NO: 406015 - protein, 9 aa, Homo Sapiens
DQGWAPPAA

SEQ ID NO: 406016 - protein, 9 aa, Homo Sapiens
RSGPQGPPG

SEQ ID NO: 406017 - protein, 9 aa, Homo Sapiens
FGLFPLFYV

SEQ ID NO: 406018 - protein, 9 aa, Homo Sapiens
IRIPRATST

SEQ ID NO: 406019 - protein, 9 aa, Homo Sapiens
KLLNTAVPQ

SEQ ID NO: 406020 - protein, 9 aa, Homo Sapiens
LGGDHYSHL

SEQ ID NO: 406021 - protein, 9 aa, Homo Sapiens
TRVRISPFA

SEQ ID NO: 406022 - protein, 9 aa, Homo Sapiens
EVLMTQQPR

SEQ ID NO: 406023 - protein, 9 aa, Homo Sapiens
REWAICWEL

SEQ ID NO: 406024 - protein, 9 aa, Homo Sapiens
IHNHFSLFS

SEQ ID NO: 406025 - protein, 9 aa, Homo Sapiens
GTSAVPIPG

SEQ ID NO: 406026 - protein, 9 aa, Homo Sapiens
VHIVSRGRT

SEQ ID NO: 406027 - protein, 9 aa, Homo Sapiens
TESATTEDL

SEQ ID NO: 406028 - protein, 9 aa, Homo Sapiens
SGITSSSTS

SEQ ID NO: 406029 - protein, 9 aa, Homo Sapiens
PVSPAAAVP

SEQ ID NO: 406030 - protein, 9 aa, Homo Sapiens
KGQQILMKD

SEQ ID NO: 406031 - protein, 9 aa, Homo Sapiens
ECCCQPGCY

SEQ ID NO: 406032 - protein, 9 aa, Homo Sapiens
SEYFCDMGY

SEQ ID NO: 406033 - protein, 9 aa, Homo Sapiens
LIRTKSVTK

SEQ ID NO: 406034 - protein, 9 aa, Homo Sapiens
PAPITLPWS

SEQ ID NO: 406035 - protein, 9 aa, Homo Sapiens
SSTSILSAL

SEQ ID NO: 406036 - protein, 9 aa, Homo Sapiens
EISFGDAFF

SEQ ID NO: 406037 - protein, 9 aa, Homo Sapiens
EVVGHRHHA

SEQ ID NO: 406038 - protein, 9 aa, Homo Sapiens
LVWIFFFFA

SEQ ID NO: 406039 - protein, 9 aa, Homo Sapiens
FKHYGCAVM

SEQ ID NO: 406040 - protein, 9 aa, Homo Sapiens
ELRKLRENL

SEQ ID NO: 406041 - protein, 9 aa, Homo Sapiens
LPHAPMSVP

SEQ ID NO: 406042 - protein, 9 aa, Homo Sapiens
WSRSWWWRR

SEQ ID NO: 406043 - protein, 9 aa, Homo Sapiens
CLEMNTTKT

SEQ ID NO: 406044 - protein, 9 aa, Homo Sapiens
VDHVVMGTN

SEQ ID NO: 406045 - protein, 9 aa, Homo Sapiens
SPVSIATRS

SEQ ID NO: 406046 - protein, 9 aa, Homo Sapiens
PKPRSLQPP

SEQ ID NO: 406047 - protein, 9 aa, Homo Sapiens
ITIKMNMTL

SEQ ID NO: 406048 - protein, 9 aa, Homo Sapiens
HFVLNDWEA

SEQ ID NO: 406049 - protein, 9 aa, Homo Sapiens
SDLFHSLKQ

SEQ ID NO: 406050 - protein, 9 aa, Homo Sapiens
KGVVGLFKT

SEQ ID NO: 406051 - protein, 9 aa, Homo Sapiens
DPRGGTQSF

SEQ ID NO: 406052 - protein, 9 aa, Homo Sapiens
GSMDCVCYS

SEQ ID NO: 406053 - protein, 9 aa, Homo Sapiens
APPPKVLTN

SEQ ID NO: 406054 - protein, 9 aa, Homo Sapiens
MSVYLFMKW

SEQ ID NO: 406055 - protein, 9 aa, Homo Sapiens
SDTGDHKQI

SEQ ID NO: 406056 - protein, 9 aa, Homo Sapiens
RWSACPVAC

SEQ ID NO: 406057 - protein, 9 aa, Homo Sapiens
AFRRGTEWP

SEQ ID NO: 406058 - protein, 9 aa, Homo Sapiens
LLCRKDGPV

SEQ ID NO: 406059 - protein, 9 aa, Homo Sapiens
TYMEMHYGH

SEQ ID NO: 406060 - protein, 9 aa, Homo Sapiens
RLRMCSGPS

SEQ ID NO: 406061 - protein, 9 aa, Homo Sapiens
QPWVTDFRV

SEQ ID NO: 406062 - protein, 9 aa, Homo Sapiens
RHAAARSQG

SEQ ID NO: 406063 - protein, 9 aa, Homo Sapiens
DLAEVTVAV

SEQ ID NO: 406064 - protein, 9 aa, Homo Sapiens
SDDESIPII

SEQ ID NO: 406065 - protein, 9 aa, Homo Sapiens
HSNLDTEVT

SEQ ID NO: 406066 - protein, 9 aa, Homo Sapiens
QEMKSNTSD

SEQ ID NO: 406067 - protein, 9 aa, Homo Sapiens
GRGPHWRGA

SEQ ID NO: 406068 - protein, 9 aa, Homo Sapiens
SWARSFVRG

SEQ ID NO: 406069 - protein, 9 aa, Homo Sapiens
DLFHSLKQV

SEQ ID NO: 406070 - protein, 9 aa, Homo Sapiens
PPWLRPRRQ

SEQ ID NO: 406071 - protein, 9 aa, Homo Sapiens
SSPGHPLGP

SEQ ID NO: 406072 - protein, 9 aa, Homo Sapiens
ADLQQIIVN

SEQ ID NO: 406073 - protein, 9 aa, Homo Sapiens
VSSSAQAAI

SEQ ID NO: 406074 - protein, 9 aa, Homo Sapiens
IFGPMPNLQ

SEQ ID NO: 406075 - protein, 9 aa, Homo Sapiens
CANLAKSRA

SEQ ID NO: 406076 - protein, 9 aa, Homo Sapiens
ASAAGGDQR

SEQ ID NO: 406077 - protein, 9 aa, Homo Sapiens
LIKSQRKTN

SEQ ID NO: 406078 - protein, 9 aa, Homo Sapiens
VLEVESVEV

SEQ ID NO: 406079 - protein, 9 aa, Homo Sapiens
QDQHRGLRV

SEQ ID NO: 406080 - protein, 9 aa, Homo Sapiens
HCPANGAGW

SEQ ID NO: 406081 - protein, 9 aa, Homo Sapiens
RVLSVNVTD

SEQ ID NO: 406082 - protein, 9 aa, Homo Sapiens
KVDHDERFD

SEQ ID NO: 406083 - protein, 9 aa, Homo Sapiens
ESSFVAPNS

SEQ ID NO: 406084 - protein, 9 aa, Homo Sapiens
DPNPQVPQQ

SEQ ID NO: 406085 - protein, 9 aa, Homo Sapiens
AIPLHSSWV

SEQ ID NO: 406086 - protein, 9 aa, Homo Sapiens
TKIRKRKVT

SEQ ID NO: 406087 - protein, 9 aa, Homo Sapiens
VHFFACPSK

SEQ ID NO: 406088 - protein, 9 aa, Homo Sapiens
YKHTAMVDG

SEQ ID NO: 406089 - protein, 9 aa, Homo Sapiens
CKQLSIRSG

SEQ ID NO: 406090 - protein, 9 aa, Homo Sapiens
RIDLLTFKQ

SEQ ID NO: 406091 - protein, 9 aa, Homo Sapiens
LSTGKKEKL

SEQ ID NO: 406092 - protein, 9 aa, Homo Sapiens
TRTRMGRKR

SEQ ID NO: 406093 - protein, 9 aa, Homo Sapiens
AARRLGTSA

SEQ ID NO: 406094 - protein, 9 aa, Homo Sapiens
CSLQSWSSP

SEQ ID NO: 406095 - protein, 9 aa, Homo Sapiens
GGSYRFSPL

SEQ ID NO: 406096 - protein, 9 aa, Homo Sapiens
SKDLLINVQ

SEQ ID NO: 406097 - protein, 9 aa, Homo Sapiens
VPRWRTRRD

SEQ ID NO: 406098 - protein, 9 aa, Homo Sapiens
LLWMVATLP

SEQ ID NO: 406099 - protein, 9 aa, Homo Sapiens
LYQAIATIT

SEQ ID NO: 406100 - protein, 9 aa, Homo Sapiens
WLLWRQNGG

SEQ ID NO: 406101 - protein, 9 aa, Homo Sapiens
QTLESFLSH

SEQ ID NO: 406102 - protein, 9 aa, Homo Sapiens
CAALNKAAA

SEQ ID NO: 406103 - protein, 9 aa, Homo Sapiens
PLLTDQAPE

SEQ ID NO: 406104 - protein, 9 aa, Homo Sapiens
KIVRSNWNI

SEQ ID NO: 406105 - protein, 9 aa, Homo Sapiens
FDTELTVQI

SEQ ID NO: 406106 - protein, 9 aa, Homo Sapiens
KHGCNFNNG

SEQ ID NO: 406107 - protein, 9 aa, Homo Sapiens
QVTMMTLIR

SEQ ID NO: 406108 - protein, 9 aa, Homo Sapiens
SWLLSKHGR

SEQ ID NO: 406109 - protein, 9 aa, Homo Sapiens
ETPAHTTLL

SEQ ID NO: 406110 - protein, 9 aa, Homo Sapiens
MLSEWFSSR

SEQ ID NO: 406111 - protein, 9 aa, Homo Sapiens
FRCYSDLTK

SEQ ID NO: 406112 - protein, 9 aa, Homo Sapiens
ILTNFLKKL

SEQ ID NO: 406113 - protein, 9 aa, Homo Sapiens
ESVLEPGYV

SEQ ID NO: 406114 - protein, 9 aa, Homo Sapiens
TLQPEPPRM

SEQ ID NO: 406115 - protein, 9 aa, Homo Sapiens
FYLWLIING

SEQ ID NO: 406116 - protein, 9 aa, Homo Sapiens
AEASTGAWT

SEQ ID NO: 406117 - protein, 9 aa, Homo Sapiens
QAGWMGAHC

SEQ ID NO: 406118 - protein, 9 aa, Homo Sapiens
DIEFRKWYS

SEQ ID NO: 406119 - protein, 9 aa, Homo Sapiens
CVMFEMHEL

SEQ ID NO: 406120 - protein, 9 aa, Homo Sapiens
VPRIGHDEI

SEQ ID NO: 406121 - protein, 9 aa, Homo Sapiens
VVAALLILL

SEQ ID NO: 406122 - protein, 9 aa, Homo Sapiens
MQGEKPVWT

SEQ ID NO: 406123 - protein, 9 aa, Homo Sapiens
QPPLSLQQH

SEQ ID NO: 406124 - protein, 9 aa, Homo Sapiens
SSHVRKVNH

SEQ ID NO: 406125 - protein, 9 aa, Homo Sapiens
TDDISDIVE

SEQ ID NO: 406126 - protein, 9 aa, Homo Sapiens
TGMMGGVRP

SEQ ID NO: 406127 - protein, 9 aa, Homo Sapiens
GAEADRWAG

SEQ ID NO: 406128 - protein, 9 aa, Homo Sapiens
FLEELQLCH

SEQ ID NO: 406129 - protein, 9 aa, Homo Sapiens
IHGQAPSTG

SEQ ID NO: 406130 - protein, 9 aa, Homo Sapiens
GRRRQWGSF

SEQ ID NO: 406131 - protein, 9 aa, Homo Sapiens
LHPQKETLL

SEQ ID NO: 406132 - protein, 9 aa, Homo Sapiens
STGKKEKLP

SEQ ID NO: 406133 - protein, 9 aa, Homo Sapiens
EILANMSDN

SEQ ID NO: 406134 - protein, 9 aa, Homo Sapiens
PYLSDGVEW

SEQ ID NO: 406135 - protein, 9 aa, Homo Sapiens
DCRCMPPYP

SEQ ID NO: 406136 - protein, 9 aa, Homo Sapiens
GSNYHKITA

SEQ ID NO: 406137 - protein, 9 aa, Homo Sapiens
LEGTHARSD

SEQ ID NO: 406138 - protein, 9 aa, Homo Sapiens
RGLKGEWGV

SEQ ID NO: 406139 - protein, 9 aa, Homo Sapiens
LTVRHGLAS

SEQ ID NO: 406140 - protein, 9 aa, Homo Sapiens
VIDRMLDHN

SEQ ID NO: 406141 - protein, 9 aa, Homo Sapiens
IPIAGATQF

SEQ ID NO: 406142 - protein, 9 aa, Homo Sapiens
DLDHTACEK

SEQ ID NO: 406143 - protein, 9 aa, Homo Sapiens
KYTYTKQKA

SEQ ID NO: 406144 - protein, 9 aa, Homo Sapiens
GAPRGTDPR

SEQ ID NO: 406145 - protein, 9 aa, Homo Sapiens
GTAIISLVQ

SEQ ID NO: 406146 - protein, 9 aa, Homo Sapiens
TNEAKKGRC

SEQ ID NO: 406147 - protein, 9 aa, Homo Sapiens
SSVISLLDE

SEQ ID NO: 406148 - protein, 9 aa, Homo Sapiens
GHHQHIVST

SEQ ID NO: 406149 - protein, 9 aa, Homo Sapiens
MDKDIQIHK

SEQ ID NO: 406150 - protein, 9 aa, Homo Sapiens
AQPLGAALG

SEQ ID NO: 406151 - protein, 9 aa, Homo Sapiens
TVFDNTNSH

SEQ ID NO: 406152 - protein, 9 aa, Homo Sapiens
VGGSLSSCG

SEQ ID NO: 406153 - protein, 9 aa, Homo Sapiens
ERGPPYRTC

SEQ ID NO: 406154 - protein, 9 aa, Homo Sapiens
EYSKCRTAG

SEQ ID NO: 406155 - protein, 9 aa, Homo Sapiens
LCIAENLVP

SEQ ID NO: 406156 - protein, 9 aa, Homo Sapiens
LPRPPQALF

SEQ ID NO: 406157 - protein, 9 aa, Homo Sapiens
LNMLQESMA

SEQ ID NO: 406158 - protein, 9 aa, Homo Sapiens
VVVPLIVGQ

SEQ ID NO: 406159 - protein, 9 aa, Homo Sapiens
PWGLRRGRS

SEQ ID NO: 406160 - protein, 9 aa, Homo Sapiens
ISMHFAFGN

SEQ ID NO: 406161 - protein, 9 aa, Homo Sapiens
MTAEVQPQC

SEQ ID NO: 406162 - protein, 9 aa, Homo Sapiens
NGEWEIVHQ

SEQ ID NO: 406163 - protein, 9 aa, Homo Sapiens
QGVDVGPIG

SEQ ID NO: 406164 - protein, 9 aa, Homo Sapiens
LGGGRGPSG

SEQ ID NO: 406165 - protein, 9 aa, Homo Sapiens
WFRSCSWDS

SEQ ID NO: 406166 - protein, 9 aa, Homo Sapiens
WVGERCLES

SEQ ID NO: 406167 - protein, 9 aa, Homo Sapiens
GMPPPPPPA

SEQ ID NO: 406168 - protein, 9 aa, Homo Sapiens
AHFLQASYD

SEQ ID NO: 406169 - protein, 9 aa, Homo Sapiens
PRYRFDPRL

SEQ ID NO: 406170 - protein, 9 aa, Homo Sapiens
CTCTTTRWS

SEQ ID NO: 406171 - protein, 9 aa, Homo Sapiens
SEATHRKYY

SEQ ID NO: 406172 - protein, 9 aa, Homo Sapiens
ACDTCYILH

SEQ ID NO: 406173 - protein, 9 aa, Homo Sapiens
AARGAIRKD

SEQ ID NO: 406174 - protein, 9 aa, Homo Sapiens
PDVLEEPDD

SEQ ID NO: 406175 - protein, 9 aa, Homo Sapiens
GISHNLDFA

SEQ ID NO: 406176 - protein, 9 aa, Homo Sapiens
DLLEYQGEP

SEQ ID NO: 406177 - protein, 9 aa, Homo Sapiens
FVSVQTKSA

SEQ ID NO: 406178 - protein, 9 aa, Homo Sapiens
VAQWSLPMS

SEQ ID NO: 406179 - protein, 9 aa, Homo Sapiens
RHHLGTFGF

SEQ ID NO: 406180 - protein, 9 aa, Homo Sapiens
CGLPVHSNK

SEQ ID NO: 406181 - protein, 9 aa, Homo Sapiens
HCPSAHPPP

SEQ ID NO: 406182 - protein, 9 aa, Homo Sapiens
KPTPSPSVN

SEQ ID NO: 406183 - protein, 9 aa, Homo Sapiens
DEDNTHISS

SEQ ID NO: 406184 - protein, 9 aa, Homo Sapiens
LSRGVQSGP

SEQ ID NO: 406185 - protein, 9 aa, Homo Sapiens
YPTSTSQDS

SEQ ID NO: 406186 - protein, 9 aa, Homo Sapiens
QMFIIWNKI

SEQ ID NO: 406187 - protein, 9 aa, Homo Sapiens
HDSTHVIQC

SEQ ID NO: 406188 - protein, 9 aa, Homo Sapiens
RAVFTKLRR

SEQ ID NO: 406189 - protein, 9 aa, Homo Sapiens
SRMVHHTGR

SEQ ID NO: 406190 - protein, 9 aa, Homo Sapiens
RQTLGVTLK

SEQ ID NO: 406191 - protein, 9 aa, Homo Sapiens
KHYGCAVMD

SEQ ID NO: 406192 - protein, 9 aa, Homo Sapiens
ASPSEVVFW

SEQ ID NO: 406193 - protein, 9 aa, Homo Sapiens
ILDNSGYVS

SEQ ID NO: 406194 - protein, 9 aa, Homo Sapiens
TLVLDTMAN

SEQ ID NO: 406195 - protein, 9 aa, Homo Sapiens
EITDNYPHA

SEQ ID NO: 406196 - protein, 9 aa, Homo Sapiens
TRLMAPVGS

SEQ ID NO: 406197 - protein, 9 aa, Homo Sapiens
TSTVEGRGG

SEQ ID NO: 406198 - protein, 9 aa, Homo Sapiens
TYKFEEDII

SEQ ID NO: 406199 - protein, 9 aa, Homo Sapiens
NLEYLVINK

SEQ ID NO: 406200 - protein, 9 aa, Homo Sapiens
GEKPVWTVH

SEQ ID NO: 406201 - protein, 9 aa, Homo Sapiens
LMAPVGSVM

SEQ ID NO: 406202 - protein, 9 aa, Homo Sapiens
VVLCLPCVP

SEQ ID NO: 406203 - protein, 9 aa, Homo Sapiens
VMNQTVCAL

SEQ ID NO: 406204 - protein, 9 aa, Homo Sapiens
VNTYQKMPK

SEQ ID NO: 406205 - protein, 9 aa, Homo Sapiens
RGRARAGVC

SEQ ID NO: 406206 - protein, 9 aa, Homo Sapiens
FLPEDPVLL

SEQ ID NO: 406207 - protein, 9 aa, Homo Sapiens
MQKGIWLND

SEQ ID NO: 406208 - protein, 9 aa, Homo Sapiens
RFCRPSLGT

SEQ ID NO: 406209 - protein, 9 aa, Homo Sapiens
KHHQSDGNE

SEQ ID NO: 406210 - protein, 9 aa, Homo Sapiens
DRHRECVIF

SEQ ID NO: 406211 - protein, 9 aa, Homo Sapiens
CIQALLEQY

SEQ ID NO: 406212 - protein, 9 aa, Homo Sapiens
PTRRPRRRR

SEQ ID NO: 406213 - protein, 9 aa, Homo Sapiens
PGVVVHDLV

SEQ ID NO: 406214 - protein, 9 aa, Homo Sapiens
RVLLKKLQN

SEQ ID NO: 406215 - protein, 9 aa, Homo Sapiens
MSHKICWLI

SEQ ID NO: 406216 - protein, 9 aa, Homo Sapiens
PLIAPVAIR

SEQ ID NO: 406217 - protein, 9 aa, Homo Sapiens
GASKEGSAS

SEQ ID NO: 406218 - protein, 9 aa, Homo Sapiens
YFFFIYSLF

SEQ ID NO: 406219 - protein, 9 aa, Homo Sapiens
SVLGSPDKL

SEQ ID NO: 406220 - protein, 9 aa, Homo Sapiens
VPPGHESFR

SEQ ID NO: 406221 - protein, 9 aa, Homo Sapiens
MSSTLGTDS

SEQ ID NO: 406222 - protein, 9 aa, Homo Sapiens
KTYMEMHYG

SEQ ID NO: 406223 - protein, 9 aa, Homo Sapiens
VLGRLMIQH

SEQ ID NO: 406224 - protein, 9 aa, Homo Sapiens
RIFCLASAT

SEQ ID NO: 406225 - protein, 9 aa, Homo Sapiens
IPGRSGPQG

SEQ ID NO: 406226 - protein, 9 aa, Homo Sapiens
STAPWWEFP

SEQ ID NO: 406227 - protein, 9 aa, Homo Sapiens
RRRGLSRWG

SEQ ID NO: 406228 - protein, 9 aa, Homo Sapiens
QPTAKELLK

SEQ ID NO: 406229 - protein, 9 aa, Homo Sapiens
HRPPAPGSS

SEQ ID NO: 406230 - protein, 9 aa, Homo Sapiens
ERCRPLSTA

SEQ ID NO: 406231 - protein, 9 aa, Homo Sapiens
SISWAVGIL

SEQ ID NO: 406232 - protein, 9 aa, Homo Sapiens
ATPKSLGNV

SEQ ID NO: 406233 - protein, 9 aa, Homo Sapiens
EIIEHPFQV

SEQ ID NO: 406234 - protein, 9 aa, Homo Sapiens
PQVAMLPKL

SEQ ID NO: 406235 - protein, 9 aa, Homo Sapiens
WEIVHQPAR

SEQ ID NO: 406236 - protein, 9 aa, Homo Sapiens
LLLCRVDND

SEQ ID NO: 406237 - protein, 9 aa, Homo Sapiens
ATRDARSSS

SEQ ID NO: 406238 - protein, 9 aa, Homo Sapiens
RKKIGKLLY

SEQ ID NO: 406239 - protein, 9 aa, Homo Sapiens
RAAASGTAA

SEQ ID NO: 406240 - protein, 9 aa, Homo Sapiens
GQISTLVLD

SEQ ID NO: 406241 - protein, 9 aa, Homo Sapiens
AHPQDPNPQ

SEQ ID NO: 406242 - protein, 9 aa, Homo Sapiens
MFDVHRKKE

SEQ ID NO: 406243 - protein, 9 aa, Homo Sapiens
PTWTRCRGH

SEQ ID NO: 406244 - protein, 9 aa, Homo Sapiens
KAGELHTHV

SEQ ID NO: 406245 - protein, 9 aa, Homo Sapiens
FKVWLHLAK

SEQ ID NO: 406246 - protein, 9 aa, Homo Sapiens
NKADLTNKR

SEQ ID NO: 406247 - protein, 9 aa, Homo Sapiens
KQIPDGFLP

SEQ ID NO: 406248 - protein, 9 aa, Homo Sapiens
WDSDEGVLK

SEQ ID NO: 406249 - protein, 9 aa, Homo Sapiens
RVYRDACGR

SEQ ID NO: 406250 - protein, 9 aa, Homo Sapiens
CYFCGMVCS

SEQ ID NO: 406251 - protein, 9 aa, Homo Sapiens
PPPSPCPAP

SEQ ID NO: 406252 - protein, 9 aa, Homo Sapiens
EAVPSSPDD

SEQ ID NO: 406253 - protein, 9 aa, Homo Sapiens
GVDDGYMPM

SEQ ID NO: 406254 - protein, 9 aa, Homo Sapiens
CRPPPVPAP

SEQ ID NO: 406255 - protein, 9 aa, Homo Sapiens
SLQRHEMTH

SEQ ID NO: 406256 - protein, 9 aa, Homo Sapiens
TTEPPPVGA

SEQ ID NO: 406257 - protein, 9 aa, Homo Sapiens
KDKKRVVVS

SEQ ID NO: 406258 - protein, 9 aa, Homo Sapiens
IKGLEGVRE

SEQ ID NO: 406259 - protein, 9 aa, Homo Sapiens
SLAWKICER

SEQ ID NO: 406260 - protein, 9 aa, Homo Sapiens
VPAEILANM

SEQ ID NO: 406261 - protein, 9 aa, Homo Sapiens
RHSFQKQQW

SEQ ID NO: 406262 - protein, 9 aa, Homo Sapiens
QSNQKCIDK

SEQ ID NO: 406263 - protein, 9 aa, Homo Sapiens
ASSHPLVLP

SEQ ID NO: 406264 - protein, 9 aa, Homo Sapiens
PREVHLPQP

SEQ ID NO: 406265 - protein, 9 aa, Homo Sapiens
IPLAFFWLP

SEQ ID NO: 406266 - protein, 9 aa, Homo Sapiens
EQMLHSCRI

SEQ ID NO: 406267 - protein, 9 aa, Homo Sapiens
YGSEGPYGV

SEQ ID NO: 406268 - protein, 9 aa, Homo Sapiens
PDKLGLGQL

SEQ ID NO: 406269 - protein, 9 aa, Homo Sapiens
LDFEAHLAY

SEQ ID NO: 406270 - protein, 9 aa, Homo Sapiens
WRNYEVKLQ

SEQ ID NO: 406271 - protein, 9 aa, Homo Sapiens
MPVTITNTG

SEQ ID NO: 406272 - protein, 9 aa, Homo Sapiens
RLAQDQHRG

SEQ ID NO: 406273 - protein, 9 aa, Homo Sapiens
NSSVKFTSG

SEQ ID NO: 406274 - protein, 9 aa, Homo Sapiens
LALVMGSPF

SEQ ID NO: 406275 - protein, 9 aa, Homo Sapiens
RGAQNMEFL

SEQ ID NO: 406276 - protein, 9 aa, Homo Sapiens
LSTAQKQRK

SEQ ID NO: 406277 - protein, 9 aa, Homo Sapiens
QPSPPWLRP

SEQ ID NO: 406278 - protein, 9 aa, Homo Sapiens
VNITLGDLL

SEQ ID NO: 406279 - protein, 9 aa, Homo Sapiens
PVSESEPGT

SEQ ID NO: 406280 - protein, 9 aa, Homo Sapiens
GDPDAEVGL

SEQ ID NO: 406281 - protein, 9 aa, Homo Sapiens
RGVPMSGPG

SEQ ID NO: 406282 - protein, 9 aa, Homo Sapiens
EPLVDSPAP

SEQ ID NO: 406283 - protein, 9 aa, Homo Sapiens
LAILLPGRA

SEQ ID NO: 406284 - protein, 9 aa, Homo Sapiens
CTWAERREV

SEQ ID NO: 406285 - protein, 9 aa, Homo Sapiens
GIFKMAVTA

SEQ ID NO: 406286 - protein, 9 aa, Homo Sapiens
EGRSPSRND

SEQ ID NO: 406287 - protein, 9 aa, Homo Sapiens
LWLSHRLRL

SEQ ID NO: 406288 - protein, 9 aa, Homo Sapiens
RLDLTSNQL

SEQ ID NO: 406289 - protein, 9 aa, Homo Sapiens
VQNLFEQLV

SEQ ID NO: 406290 - protein, 9 aa, Homo Sapiens
TVDSPGILT

SEQ ID NO: 406291 - protein, 9 aa, Homo Sapiens
EATSPHSPG

SEQ ID NO: 406292 - protein, 9 aa, Homo Sapiens
PPPKMPPPR

SEQ ID NO: 406293 - protein, 9 aa, Homo Sapiens
VESVEVHPF

SEQ ID NO: 406294 - protein, 9 aa, Homo Sapiens
ALVVGAAQG

SEQ ID NO: 406295 - protein, 9 aa, Homo Sapiens
RFALLSLVE

SEQ ID NO: 406296 - protein, 9 aa, Homo Sapiens
SSLVASSQN

SEQ ID NO: 406297 - protein, 9 aa, Homo Sapiens
CPALHLVKP

SEQ ID NO: 406298 - protein, 9 aa, Homo Sapiens
VSAMYSSSY

SEQ ID NO: 406299 - protein, 9 aa, Homo Sapiens
RGRLEISLL

SEQ ID NO: 406300 - protein, 9 aa, Homo Sapiens
CVGRRRQWG

SEQ ID NO: 406301 - protein, 9 aa, Homo Sapiens
PIAGATQFT

SEQ ID NO: 406302 - protein, 9 aa, Homo Sapiens
WAPEPRWRM

SEQ ID NO: 406303 - protein, 9 aa, Homo Sapiens
GVWTGADVP

SEQ ID NO: 406304 - protein, 9 aa, Homo Sapiens
GFLTEDKKN

SEQ ID NO: 406305 - protein, 9 aa, Homo Sapiens
AHFFRISLF

SEQ ID NO: 406306 - protein, 9 aa, Homo Sapiens
TSMGFFFRI

SEQ ID NO: 406307 - protein, 9 aa, Homo Sapiens
EEPGPSTGA

SEQ ID NO: 406308 - protein, 9 aa, Homo Sapiens
RGLNISCLS

SEQ ID NO: 406309 - protein, 9 aa, Homo Sapiens
PFIAHRHIE

SEQ ID NO: 406310 - protein, 9 aa, Homo Sapiens
ALQAGPPGT

SEQ ID NO: 406311 - protein, 9 aa, Homo Sapiens
DLNEGNHTL

SEQ ID NO: 406312 - protein, 9 aa, Homo Sapiens
PSEKTRYDM

SEQ ID NO: 406313 - protein, 9 aa, Homo Sapiens
TARGPRTDR

SEQ ID NO: 406314 - protein, 9 aa, Homo Sapiens
GRSHHGPEL

SEQ ID NO: 406315 - protein, 9 aa, Homo Sapiens
SVASPAQVT

SEQ ID NO: 406316 - protein, 9 aa, Homo Sapiens
IIVNTDLGY

SEQ ID NO: 406317 - protein, 9 aa, Homo Sapiens
PSQLPASSP

SEQ ID NO: 406318 - protein, 9 aa, Homo Sapiens
EETLPACQT

SEQ ID NO: 406319 - protein, 9 aa, Homo Sapiens
LYHLNLKYN

SEQ ID NO: 406320 - protein, 9 aa, Homo Sapiens
GENQAMIKI

SEQ ID NO: 406321 - protein, 9 aa, Homo Sapiens
LQRQIKWDP

SEQ ID NO: 406322 - protein, 9 aa, Homo Sapiens
VEGEKPKAV

SEQ ID NO: 406323 - protein, 9 aa, Homo Sapiens
PFSPIIIGR

SEQ ID NO: 406324 - protein, 9 aa, Homo Sapiens
PPQGNRKMH

SEQ ID NO: 406325 - protein, 9 aa, Homo Sapiens
AIAGDEHKC

SEQ ID NO: 406326 - protein, 9 aa, Homo Sapiens
TNEIVQQMM

SEQ ID NO: 406327 - protein, 9 aa, Homo Sapiens
SHEGRTLVL

SEQ ID NO: 406328 - protein, 9 aa, Homo Sapiens
SHGAGRDEP

SEQ ID NO: 406329 - protein, 9 aa, Homo Sapiens
FHVLPDHTE

SEQ ID NO: 406330 - protein, 9 aa, Homo Sapiens
VWYFPFDIV

SEQ ID NO: 406331 - protein, 9 aa, Homo Sapiens
RRPRRRRRG

SEQ ID NO: 406332 - protein, 9 aa, Homo Sapiens
SRAGRQRSG

SEQ ID NO: 406333 - protein, 9 aa, Homo Sapiens
GCLLSLLDD

SEQ ID NO: 406334 - protein, 9 aa, Homo Sapiens
AFLMPLEFN

SEQ ID NO: 406335 - protein, 9 aa, Homo Sapiens
LLTEETNSF

SEQ ID NO: 406336 - protein, 9 aa, Homo Sapiens
PGPSWTWGR

SEQ ID NO: 406337 - protein, 9 aa, Homo Sapiens
NEEHFGDGD

SEQ ID NO: 406338 - protein, 9 aa, Homo Sapiens
AVWTRVGFL

SEQ ID NO: 406339 - protein, 9 aa, Homo Sapiens
LVLVSDCKV

SEQ ID NO: 406340 - protein, 9 aa, Homo Sapiens
GRTPTTRLM

SEQ ID NO: 406341 - protein, 9 aa, Homo Sapiens
EDNRGYGRS

SEQ ID NO: 406342 - protein, 9 aa, Homo Sapiens
PSRLGGGRR

SEQ ID NO: 406343 - protein, 9 aa, Homo Sapiens
RWAAVTLQA

SEQ ID NO: 406344 - protein, 9 aa, Homo Sapiens
TGTAAILIL

SEQ ID NO: 406345 - protein, 9 aa, Homo Sapiens
AQKSRVSTP

SEQ ID NO: 406346 - protein, 9 aa, Homo Sapiens
HSALHPLSL

SEQ ID NO: 406347 - protein, 9 aa, Homo Sapiens
LLRGRLQHH

SEQ ID NO: 406348 - protein, 9 aa, Homo Sapiens
VEVIQSGQK

SEQ ID NO: 406349 - protein, 9 aa, Homo Sapiens
HKQIYNILS

SEQ ID NO: 406350 - protein, 9 aa, Homo Sapiens
LEGVRENYS

SEQ ID NO: 406351 - protein, 9 aa, Homo Sapiens
DFASETAQV

SEQ ID NO: 406352 - protein, 9 aa, Homo Sapiens
VRENYSRVA

SEQ ID NO: 406353 - protein, 9 aa, Homo Sapiens
RFVAGHDAE

SEQ ID NO: 406354 - protein, 9 aa, Homo Sapiens
SHQACPPTC

SEQ ID NO: 406355 - protein, 9 aa, Homo Sapiens
ANHRAWVTT

SEQ ID NO: 406356 - protein, 9 aa, Homo Sapiens
CTANMPASL

SEQ ID NO: 406357 - protein, 9 aa, Homo Sapiens
RRLHLSECR

SEQ ID NO: 406358 - protein, 9 aa, Homo Sapiens
NCEDAQAIQ

SEQ ID NO: 406359 - protein, 9 aa, Homo Sapiens
GAPHLPLKL

SEQ ID NO: 406360 - protein, 9 aa, Homo Sapiens
SWPMHPLVS

SEQ ID NO: 406361 - protein, 9 aa, Homo Sapiens
LHELIHNHF

SEQ ID NO: 406362 - protein, 9 aa, Homo Sapiens
RGGSLLGRK

SEQ ID NO: 406363 - protein, 9 aa, Homo Sapiens
SQSCQRPPL

SEQ ID NO: 406364 - protein, 9 aa, Homo Sapiens
FGNQWINYI

SEQ ID NO: 406365 - protein, 9 aa, Homo Sapiens
VDPDAHPSP

SEQ ID NO: 406366 - protein, 9 aa, Homo Sapiens
KNRVLMIMI

SEQ ID NO: 406367 - protein, 9 aa, Homo Sapiens
APPGDGYMQ

SEQ ID NO: 406368 - protein, 9 aa, Homo Sapiens
LRQHRQLFE

SEQ ID NO: 406369 - protein, 9 aa, Homo Sapiens
DLDEDDSEE

SEQ ID NO: 406370 - protein, 9 aa, Homo Sapiens
TTPPGRSLP

SEQ ID NO: 406371 - protein, 9 aa, Homo Sapiens
GTIMAKYTY

SEQ ID NO: 406372 - protein, 9 aa, Homo Sapiens
VRYERKNET

SEQ ID NO: 406373 - protein, 9 aa, Homo Sapiens
FNIQGGKAS

SEQ ID NO: 406374 - protein, 9 aa, Homo Sapiens
FIIMPIFLL

SEQ ID NO: 406375 - protein, 9 aa, Homo Sapiens
MTGHGRARP

SEQ ID NO: 406376 - protein, 9 aa, Homo Sapiens
PKTLTSPQA

SEQ ID NO: 406377 - protein, 9 aa, Homo Sapiens
MHPDVLEEP

SEQ ID NO: 406378 - protein, 9 aa, Homo Sapiens
HISLSLSVH

SEQ ID NO: 406379 - protein, 9 aa, Homo Sapiens
SYFYAASSL

SEQ ID NO: 406380 - protein, 9 aa, Homo Sapiens
GVCCEPATC

SEQ ID NO: 406381 - protein, 9 aa, Homo Sapiens
RALGTTSHH

SEQ ID NO: 406382 - protein, 9 aa, Homo Sapiens
ASRAPCRPP

SEQ ID NO: 406383 - protein, 9 aa, Homo Sapiens
KDCPEDFKG

SEQ ID NO: 406384 - protein, 9 aa, Homo Sapiens
CMRAAASGT

SEQ ID NO: 406385 - protein, 9 aa, Homo Sapiens
MLQQPCQLH

SEQ ID NO: 406386 - protein, 9 aa, Homo Sapiens
VVRDTATLS

SEQ ID NO: 406387 - protein, 9 aa, Homo Sapiens
EATAAAPQR

SEQ ID NO: 406388 - protein, 9 aa, Homo Sapiens
MEKCFLLVV

SEQ ID NO: 406389 - protein, 9 aa, Homo Sapiens
RSQGAIISQ

SEQ ID NO: 406390 - protein, 9 aa, Homo Sapiens
LQDFFRKKV

SEQ ID NO: 406391 - protein, 9 aa, Homo Sapiens
THRPYFPVA

SEQ ID NO: 406392 - protein, 9 aa, Homo Sapiens
ETAQVVRDT

SEQ ID NO: 406393 - protein, 9 aa, Homo Sapiens
STATSTLSP

SEQ ID NO: 406394 - protein, 9 aa, Homo Sapiens
VLTNTATTP

SEQ ID NO: 406395 - protein, 9 aa, Homo Sapiens
MYCRHHLGT

SEQ ID NO: 406396 - protein, 9 aa, Homo Sapiens
GEPGQKDLQ

SEQ ID NO: 406397 - protein, 9 aa, Homo Sapiens
GGPRLRVHS

SEQ ID NO: 406398 - protein, 9 aa, Homo Sapiens
ELAVAHRET

SEQ ID NO: 406399 - protein, 9 aa, Homo Sapiens
TAWSQVIDF

SEQ ID NO: 406400 - protein, 9 aa, Homo Sapiens
SIQKEAVWA

SEQ ID NO: 406401 - protein, 9 aa, Homo Sapiens
FASETAQVV

SEQ ID NO: 406402 - protein, 9 aa, Homo Sapiens
GHPVPLHQV

SEQ ID NO: 406403 - protein, 9 aa, Homo Sapiens
YGLSVTKGK

SEQ ID NO: 406404 - protein, 9 aa, Homo Sapiens
GSSSGSPSV

SEQ ID NO: 406405 - protein, 9 aa, Homo Sapiens
GGPPPAGCG

SEQ ID NO: 406406 - protein, 9 aa, Homo Sapiens
RGKVDIHLL

SEQ ID NO: 406407 - protein, 9 aa, Homo Sapiens
AQRGLQYKC

SEQ ID NO: 406408 - protein, 9 aa, Homo Sapiens
RYPHIKDSE

SEQ ID NO: 406409 - protein, 9 aa, Homo Sapiens
PLEPPGPAC

SEQ ID NO: 406410 - protein, 9 aa, Homo Sapiens
CAAVGVGLP

SEQ ID NO: 406411 - protein, 9 aa, Homo Sapiens
PMMSSMACG

SEQ ID NO: 406412 - protein, 9 aa, Homo Sapiens
RGLSRWGPR

SEQ ID NO: 406413 - protein, 9 aa, Homo Sapiens
ISGFSLFFG

SEQ ID NO: 406414 - protein, 9 aa, Homo Sapiens
FVTDDYDIG

SEQ ID NO: 406415 - protein, 9 aa, Homo Sapiens
LGHPGTGTV

SEQ ID NO: 406416 - protein, 9 aa, Homo Sapiens
CSPVYDIRE

SEQ ID NO: 406417 - protein, 9 aa, Homo Sapiens
YLNLRPPAP

SEQ ID NO: 406418 - protein, 9 aa, Homo Sapiens
LFLLVCFLF

SEQ ID NO: 406419 - protein, 9 aa, Homo Sapiens
TMMAKTIKA

SEQ ID NO: 406420 - protein, 9 aa, Homo Sapiens
AEVNWKVLE

SEQ ID NO: 406421 - protein, 9 aa, Homo Sapiens
SACLSTTSQ

SEQ ID NO: 406422 - protein, 9 aa, Homo Sapiens
DSPPALWMA

SEQ ID NO: 406423 - protein, 9 aa, Homo Sapiens
ETQNQFLDE

SEQ ID NO: 406424 - protein, 9 aa, Homo Sapiens
WRGNTQKAM

SEQ ID NO: 406425 - protein, 9 aa, Homo Sapiens
SAQDIVFLA

SEQ ID NO: 406426 - protein, 9 aa, Homo Sapiens
EDNTHISSA

SEQ ID NO: 406427 - protein, 9 aa, Homo Sapiens
LPKLLCRQM

SEQ ID NO: 406428 - protein, 9 aa, Homo Sapiens
TVCPKNAAL

SEQ ID NO: 406429 - protein, 9 aa, Homo Sapiens
EPTQKNLYQ

SEQ ID NO: 406430 - protein, 9 aa, Homo Sapiens
APPYTPRMT

SEQ ID NO: 406431 - protein, 9 aa, Homo Sapiens
STLQQRHPQ

SEQ ID NO: 406432 - protein, 9 aa, Homo Sapiens
GARDSRRWA

SEQ ID NO: 406433 - protein, 9 aa, Homo Sapiens
RGLGASSLS

SEQ ID NO: 406434 - protein, 9 aa, Homo Sapiens
TPLCKHKKK

SEQ ID NO: 406435 - protein, 9 aa, Homo Sapiens
LRLCPHILD

SEQ ID NO: 406436 - protein, 9 aa, Homo Sapiens
VVIGSGGVG

SEQ ID NO: 406437 - protein, 9 aa, Homo Sapiens
PPACTSKAW

SEQ ID NO: 406438 - protein, 9 aa, Homo Sapiens
HYPRGKQVI

SEQ ID NO: 406439 - protein, 9 aa, Homo Sapiens
VHTASQDDR

SEQ ID NO: 406440 - protein, 9 aa, Homo Sapiens
LHSPHPHGD

SEQ ID NO: 406441 - protein, 9 aa, Homo Sapiens
DIFEKYNWP

SEQ ID NO: 406442 - protein, 9 aa, Homo Sapiens
HFDAHGRIE

SEQ ID NO: 406443 - protein, 9 aa, Homo Sapiens
GPELAVRMC

SEQ ID NO: 406444 - protein, 9 aa, Homo Sapiens
EFQVLVRQV

SEQ ID NO: 406445 - protein, 9 aa, Homo Sapiens
EKKCWIIKE

SEQ ID NO: 406446 - protein, 9 aa, Homo Sapiens
GAALGVDAA

SEQ ID NO: 406447 - protein, 9 aa, Homo Sapiens
ASSLVLPVL

SEQ ID NO: 406448 - protein, 9 aa, Homo Sapiens
TFKTRVRIS

SEQ ID NO: 406449 - protein, 9 aa, Homo Sapiens
PSFSVAPQP

SEQ ID NO: 406450 - protein, 9 aa, Homo Sapiens
KTVIELMAS

SEQ ID NO: 406451 - protein, 9 aa, Homo Sapiens
KSTMESGES

SEQ ID NO: 406452 - protein, 9 aa, Homo Sapiens
DGDHGINQP

SEQ ID NO: 406453 - protein, 9 aa, Homo Sapiens
VFTKLRRAA

SEQ ID NO: 406454 - protein, 9 aa, Homo Sapiens
DTKYFRFVV

SEQ ID NO: 406455 - protein, 9 aa, Homo Sapiens
HPQKETLLL

SEQ ID NO: 406456 - protein, 9 aa, Homo Sapiens
QLCRPPTPP

SEQ ID NO: 406457 - protein, 9 aa, Homo Sapiens
PGNNERYCC

SEQ ID NO: 406458 - protein, 9 aa, Homo Sapiens
CRVDNDPPA

SEQ ID NO: 406459 - protein, 9 aa, Homo Sapiens
HLSHYLKDV

SEQ ID NO: 406460 - protein, 9 aa, Homo Sapiens
VTGCLLLVV

SEQ ID NO: 406461 - protein, 9 aa, Homo Sapiens
SQGAIISQY

SEQ ID NO: 406462 - protein, 9 aa, Homo Sapiens
AVTYIDEKW

SEQ ID NO: 406463 - protein, 9 aa, Homo Sapiens
LGLGQLLSA

SEQ ID NO: 406464 - protein, 9 aa, Homo Sapiens
SFMGMQEKK

SEQ ID NO: 406465 - protein, 9 aa, Homo Sapiens
STLDAEVRS

SEQ ID NO: 406466 - protein, 9 aa, Homo Sapiens
APRGTDPRP

SEQ ID NO: 406467 - protein, 9 aa, Homo Sapiens
VPSMINYVL

SEQ ID NO: 406468 - protein, 9 aa, Homo Sapiens
CCCEEPRPR

SEQ ID NO: 406469 - protein, 9 aa, Homo Sapiens
EKGRLGKGS

SEQ ID NO: 406470 - protein, 9 aa, Homo Sapiens
CTTKFGSKH

SEQ ID NO: 406471 - protein, 9 aa, Homo Sapiens
LRFCRPSLG

SEQ ID NO: 406472 - protein, 9 aa, Homo Sapiens
SSWTSPPHP

SEQ ID NO: 406473 - protein, 9 aa, Homo Sapiens
STAWASAMP

SEQ ID NO: 406474 - protein, 9 aa, Homo Sapiens
PNSPSPTAS

SEQ ID NO: 406475 - protein, 9 aa, Homo Sapiens
AHYYPPILR

SEQ ID NO: 406476 - protein, 9 aa, Homo Sapiens
DQTNTTLYI

SEQ ID NO: 406477 - protein, 9 aa, Homo Sapiens
SNLAHHTKA

SEQ ID NO: 406478 - protein, 9 aa, Homo Sapiens
ASTPSTSRE

SEQ ID NO: 406479 - protein, 9 aa, Homo Sapiens
RSLPAGPSA

SEQ ID NO: 406480 - protein, 9 aa, Homo Sapiens
PSSPEVWAL

SEQ ID NO: 406481 - protein, 9 aa, Homo Sapiens
ACNEGHCTA

SEQ ID NO: 406482 - protein, 9 aa, Homo Sapiens
ISTVERAAD

SEQ ID NO: 406483 - protein, 9 aa, Homo Sapiens
KLEEGWGGC

SEQ ID NO: 406484 - protein, 9 aa, Homo Sapiens
IFDENREKQ

SEQ ID NO: 406485 - protein, 9 aa, Homo Sapiens
DVGSLLGNP

SEQ ID NO: 406486 - protein, 9 aa, Homo Sapiens
WTASSWPMH

SEQ ID NO: 406487 - protein, 9 aa, Homo Sapiens
GDRTDIPSV

SEQ ID NO: 406488 - protein, 9 aa, Homo Sapiens
VCRLRRWGL

SEQ ID NO: 406489 - protein, 9 aa, Homo Sapiens
DEKKEEAEN

SEQ ID NO: 406490 - protein, 9 aa, Homo Sapiens
LGDLLTGAA

SEQ ID NO: 406491 - protein, 9 aa, Homo Sapiens
MRARCHLWS

SEQ ID NO: 406492 - protein, 9 aa, Homo Sapiens
RLAGDKVNY

SEQ ID NO: 406493 - protein, 9 aa, Homo Sapiens
FQPTAKELL

SEQ ID NO: 406494 - protein, 9 aa, Homo Sapiens
VSPVRNSPC

SEQ ID NO: 406495 - protein, 9 aa, Homo Sapiens
SHSLAWERT

SEQ ID NO: 406496 - protein, 9 aa, Homo Sapiens
LDGDELMLA

SEQ ID NO: 406497 - protein, 9 aa, Homo Sapiens
LAGDKVNYW

SEQ ID NO: 406498 - protein, 9 aa, Homo Sapiens
RLGRYFVAF

SEQ ID NO: 406499 - protein, 9 aa, Homo Sapiens
SRSRSPKNQ

SEQ ID NO: 406500 - protein, 9 aa, Homo Sapiens
TYRRQASQK

SEQ ID NO: 406501 - protein, 9 aa, Homo Sapiens
EETYVKWLH

SEQ ID NO: 406502 - protein, 9 aa, Homo Sapiens
TLEGCISVK

SEQ ID NO: 406503 - protein, 9 aa, Homo Sapiens
SPCNASIMC

SEQ ID NO: 406504 - protein, 9 aa, Homo Sapiens
DESTDIGIC

SEQ ID NO: 406505 - protein, 9 aa, Homo Sapiens
YSGFGFHST

SEQ ID NO: 406506 - protein, 9 aa, Homo Sapiens
VGSPFPVSA

SEQ ID NO: 406507 - protein, 9 aa, Homo Sapiens
PPSKLSVEI

SEQ ID NO: 406508 - protein, 9 aa, Homo Sapiens
HSASGRRLL

SEQ ID NO: 406509 - protein, 9 aa, Homo Sapiens
VVPRTPSGD

SEQ ID NO: 406510 - protein, 9 aa, Homo Sapiens
FPLGGTTPK

SEQ ID NO: 406511 - protein, 9 aa, Homo Sapiens
EKWDFRTYR

SEQ ID NO: 406512 - protein, 9 aa, Homo Sapiens
VFSSPGALE

SEQ ID NO: 406513 - protein, 9 aa, Homo Sapiens
DNKVRELVT

SEQ ID NO: 406514 - protein, 9 aa, Homo Sapiens
RAHFSPGCP

SEQ ID NO: 406515 - protein, 9 aa, Homo Sapiens
VCQDVRCRR

SEQ ID NO: 406516 - protein, 9 aa, Homo Sapiens
LAHHTKAVN

SEQ ID NO: 406517 - protein, 9 aa, Homo Sapiens
AAQGAGGHM

SEQ ID NO: 406518 - protein, 9 aa, Homo Sapiens
VTYIDEKWD

SEQ ID NO: 406519 - protein, 9 aa, Homo Sapiens
SRAARGAIR

SEQ ID NO: 406520 - protein, 9 aa, Homo Sapiens
SPLMETEMQ

SEQ ID NO: 406521 - protein, 9 aa, Homo Sapiens
PAAPRATPS

SEQ ID NO: 406522 - protein, 9 aa, Homo Sapiens
QAVSLKQDG

SEQ ID NO: 406523 - protein, 9 aa, Homo Sapiens
SASFMQYTV

SEQ ID NO: 406524 - protein, 9 aa, Homo Sapiens
VEGQAALGA

SEQ ID NO: 406525 - protein, 9 aa, Homo Sapiens
RKGQENLKM

SEQ ID NO: 406526 - protein, 9 aa, Homo Sapiens
FSVYCQCRQ

SEQ ID NO: 406527 - protein, 9 aa, Homo Sapiens
PHHFMAIFK

SEQ ID NO: 406528 - protein, 9 aa, Homo Sapiens
FISLFWEKR

SEQ ID NO: 406529 - protein, 9 aa, Homo Sapiens
PRGSQSALG

SEQ ID NO: 406530 - protein, 9 aa, Homo Sapiens
NMDVFIAME

SEQ ID NO: 406531 - protein, 9 aa, Homo Sapiens
FGFVQSSSV

SEQ ID NO: 406532 - protein, 9 aa, Homo Sapiens
LPLAPASSH

SEQ ID NO: 406533 - protein, 9 aa, Homo Sapiens
AQIHGANRV

SEQ ID NO: 406534 - protein, 9 aa, Homo Sapiens
VADLVHSTH

SEQ ID NO: 406535 - protein, 9 aa, Homo Sapiens
ALTHLDLSK

SEQ ID NO: 406536 - protein, 9 aa, Homo Sapiens
EGLIVAVHV

SEQ ID NO: 406537 - protein, 9 aa, Homo Sapiens
YRRDRSPLR

SEQ ID NO: 406538 - protein, 9 aa, Homo Sapiens
DEDQCLIEE

SEQ ID NO: 406539 - protein, 9 aa, Homo Sapiens
QCWGRRRRQ

SEQ ID NO: 406540 - protein, 9 aa, Homo Sapiens
LAVATAATN

SEQ ID NO: 406541 - protein, 9 aa, Homo Sapiens
ISLPPAPLL

SEQ ID NO: 406542 - protein, 9 aa, Homo Sapiens
DPEMGGKLQ

SEQ ID NO: 406543 - protein, 9 aa, Homo Sapiens
CRQMLPTLS

SEQ ID NO: 406544 - protein, 9 aa, Homo Sapiens
DSRMAKRVC

SEQ ID NO: 406545 - protein, 9 aa, Homo Sapiens
IDGRVWGNL

SEQ ID NO: 406546 - protein, 9 aa, Homo Sapiens
HPFLYGLPQ

SEQ ID NO: 406547 - protein, 9 aa, Homo Sapiens
MPSMVVSPF

SEQ ID NO: 406548 - protein, 9 aa, Homo Sapiens
DVVGVRSLW

SEQ ID NO: 406549 - protein, 9 aa, Homo Sapiens
QSRMVHHTG

SEQ ID NO: 406550 - protein, 9 aa, Homo Sapiens
VPMSGPGAG

SEQ ID NO: 406551 - protein, 9 aa, Homo Sapiens
EQRSVAYNG

SEQ ID NO: 406552 - protein, 9 aa, Homo Sapiens
STQLVRQRG

SEQ ID NO: 406553 - protein, 9 aa, Homo Sapiens
SNSHRATSN

SEQ ID NO: 406554 - protein, 9 aa, Homo Sapiens
FRAVDSSAP

SEQ ID NO: 406555 - protein, 9 aa, Homo Sapiens
VTQTADYPN

SEQ ID NO: 406556 - protein, 9 aa, Homo Sapiens
PRVLLKKLQ

SEQ ID NO: 406557 - protein, 9 aa, Homo Sapiens
QQGDDFKGR

SEQ ID NO: 406558 - protein, 9 aa, Homo Sapiens
KGEWGVKGA

SEQ ID NO: 406559 - protein, 9 aa, Homo Sapiens
ERRLRGILE

SEQ ID NO: 406560 - protein, 9 aa, Homo Sapiens
SDDFDGVIV

SEQ ID NO: 406561 - protein, 9 aa, Homo Sapiens
QQPATARSP

SEQ ID NO: 406562 - protein, 9 aa, Homo Sapiens
RQRRRRGLS

SEQ ID NO: 406563 - protein, 9 aa, Homo Sapiens
ITVFLTGFR

SEQ ID NO: 406564 - protein, 9 aa, Homo Sapiens
SGLFDIIGH

SEQ ID NO: 406565 - protein, 9 aa, Homo Sapiens
QSGLFDIIG

SEQ ID NO: 406566 - protein, 9 aa, Homo Sapiens
PPAPPPWRA

SEQ ID NO: 406567 - protein, 9 aa, Homo Sapiens
PRGRPAAEG

SEQ ID NO: 406568 - protein, 9 aa, Homo Sapiens
EFSVAKILH

SEQ ID NO: 406569 - protein, 9 aa, Homo Sapiens
DGIGVDEKL

SEQ ID NO: 406570 - protein, 9 aa, Homo Sapiens
EALMHLLHS

SEQ ID NO: 406571 - protein, 9 aa, Homo Sapiens
PLREDWSVY

SEQ ID NO: 406572 - protein, 9 aa, Homo Sapiens
RQNGGSGRR

SEQ ID NO: 406573 - protein, 9 aa, Homo Sapiens
VFLVRRFCC

SEQ ID NO: 406574 - protein, 9 aa, Homo Sapiens
WAERREVEN

SEQ ID NO: 406575 - protein, 9 aa, Homo Sapiens
CVDSAVTVA

SEQ ID NO: 406576 - protein, 9 aa, Homo Sapiens
LGAIDENTT

SEQ ID NO: 406577 - protein, 9 aa, Homo Sapiens
NPQVPQQEA

SEQ ID NO: 406578 - protein, 9 aa, Homo Sapiens
SVPSSSPTN

SEQ ID NO: 406579 - protein, 9 aa, Homo Sapiens
DFVILASRW

SEQ ID NO: 406580 - protein, 9 aa, Homo Sapiens
ACSITVSFV

SEQ ID NO: 406581 - protein, 9 aa, Homo Sapiens
GRKEQLRCP

SEQ ID NO: 406582 - protein, 9 aa, Homo Sapiens
GSGHPEPHH

SEQ ID NO: 406583 - protein, 9 aa, Homo Sapiens
HQDPGLGGP

SEQ ID NO: 406584 - protein, 9 aa, Homo Sapiens
QDEGVYECH

SEQ ID NO: 406585 - protein, 9 aa, Homo Sapiens
MIYVGCRAT

SEQ ID NO: 406586 - protein, 9 aa, Homo Sapiens
WRMRSSTSP

SEQ ID NO: 406587 - protein, 9 aa, Homo Sapiens
KKEWVKWTK

SEQ ID NO: 406588 - protein, 9 aa, Homo Sapiens
PVKTTDGIG

SEQ ID NO: 406589 - protein, 9 aa, Homo Sapiens
TLGTIHWSC

SEQ ID NO: 406590 - protein, 9 aa, Homo Sapiens
TGESFPIKY

SEQ ID NO: 406591 - protein, 9 aa, Homo Sapiens
EKELFSFFS

SEQ ID NO: 406592 - protein, 9 aa, Homo Sapiens
SLLSTLSQP

SEQ ID NO: 406593 - protein, 9 aa, Homo Sapiens
AISAKPLTQ

SEQ ID NO: 406594 - protein, 9 aa, Homo Sapiens
PQSSVAETY

SEQ ID NO: 406595 - protein, 9 aa, Homo Sapiens
MPGRLFVAV

SEQ ID NO: 406596 - protein, 9 aa, Homo Sapiens
LHRVLLRFC

SEQ ID NO: 406597 - protein, 9 aa, Homo Sapiens
VHRLSATLR

SEQ ID NO: 406598 - protein, 9 aa, Homo Sapiens
LCRQMLPTL

SEQ ID NO: 406599 - protein, 9 aa, Homo Sapiens
RLNPKMQRS

SEQ ID NO: 406600 - protein, 9 aa, Homo Sapiens
FRDLTSEEQ

SEQ ID NO: 406601 - protein, 9 aa, Homo Sapiens
KEILRPRTL

SEQ ID NO: 406602 - protein, 9 aa, Homo Sapiens
TSNQLQKLP

SEQ ID NO: 406603 - protein, 9 aa, Homo Sapiens
ITNEIVQQM

SEQ ID NO: 406604 - protein, 9 aa, Homo Sapiens
VPRTNPVLN

SEQ ID NO: 406605 - protein, 9 aa, Homo Sapiens
QYTVLVAGS

SEQ ID NO: 406606 - protein, 9 aa, Homo Sapiens
VVHLLMEWG

SEQ ID NO: 406607 - protein, 9 aa, Homo Sapiens
RDLTSEEQI

SEQ ID NO: 406608 - protein, 9 aa, Homo Sapiens
LFLGSHPFR

SEQ ID NO: 406609 - protein, 9 aa, Homo Sapiens
EESDSAERL

SEQ ID NO: 406610 - protein, 9 aa, Homo Sapiens
PETAAVAGA

SEQ ID NO: 406611 - protein, 9 aa, Homo Sapiens
ALLHWLSQP

SEQ ID NO: 406612 - protein, 9 aa, Homo Sapiens
MTDMLLTPA

SEQ ID NO: 406613 - protein, 9 aa, Homo Sapiens
CRPPTPPAP

SEQ ID NO: 406614 - protein, 9 aa, Homo Sapiens
VTGTCCLPV

SEQ ID NO: 406615 - protein, 9 aa, Homo Sapiens
ANIFLRPRG

SEQ ID NO: 406616 - protein, 9 aa, Homo Sapiens
SRSPKNQER

SEQ ID NO: 406617 - protein, 9 aa, Homo Sapiens
QDQQQAQER

SEQ ID NO: 406618 - protein, 9 aa, Homo Sapiens
RCMPPYPGN

SEQ ID NO: 406619 - protein, 9 aa, Homo Sapiens
QGAIISQYY

SEQ ID NO: 406620 - protein, 9 aa, Homo Sapiens
SQDLNMDCI

SEQ ID NO: 406621 - protein, 9 aa, Homo Sapiens
TSLKSHQGM

SEQ ID NO: 406622 - protein, 9 aa, Homo Sapiens
QKRLQNRKW

SEQ ID NO: 406623 - protein, 9 aa, Homo Sapiens
SSSHRDLSI

SEQ ID NO: 406624 - protein, 9 aa, Homo Sapiens
SRPCPRTRW

SEQ ID NO: 406625 - protein, 9 aa, Homo Sapiens
EECRRLFVE

SEQ ID NO: 406626 - protein, 9 aa, Homo Sapiens
VSAGPLSSK

SEQ ID NO: 406627 - protein, 9 aa, Homo Sapiens
QLPEVELPK

SEQ ID NO: 406628 - protein, 9 aa, Homo Sapiens
GMQTLESFL

SEQ ID NO: 406629 - protein, 9 aa, Homo Sapiens
KMDLVRRIK

SEQ ID NO: 406630 - protein, 9 aa, Homo Sapiens
FQVELDVQE

SEQ ID NO: 406631 - protein, 9 aa, Homo Sapiens
LCRVDNDPP

SEQ ID NO: 406632 - protein, 9 aa, Homo Sapiens
ALGLGSDLV

SEQ ID NO: 406633 - protein, 9 aa, Homo Sapiens
ECRTFMPPP

SEQ ID NO: 406634 - protein, 9 aa, Homo Sapiens
ELVALVYSL

SEQ ID NO: 406635 - protein, 9 aa, Homo Sapiens
ASSQNWGSL

SEQ ID NO: 406636 - protein, 9 aa, Homo Sapiens
AQCSGPGGG

SEQ ID NO: 406637 - protein, 9 aa, Homo Sapiens
PASACARRC

SEQ ID NO: 406638 - protein, 9 aa, Homo Sapiens
SMPSMVVSP

SEQ ID NO: 406639 - protein, 9 aa, Homo Sapiens
AGSTDKTDP

SEQ ID NO: 406640 - protein, 9 aa, Homo Sapiens
TMGFPVSSG

SEQ ID NO: 406641 - protein, 9 aa, Homo Sapiens
SACPVACLA

SEQ ID NO: 406642 - protein, 9 aa, Homo Sapiens
ALGLCQGAL

SEQ ID NO: 406643 - protein, 9 aa, Homo Sapiens
KSFCKWQKN

SEQ ID NO: 406644 - protein, 9 aa, Homo Sapiens
DWDDYVNIW

SEQ ID NO: 406645 - protein, 9 aa, Homo Sapiens
LTMDGTLHT

SEQ ID NO: 406646 - protein, 9 aa, Homo Sapiens
PATTIGVIG

SEQ ID NO: 406647 - protein, 9 aa, Homo Sapiens
ASLNRYRLG

SEQ ID NO: 406648 - protein, 9 aa, Homo Sapiens
PHGNSTGEK

SEQ ID NO: 406649 - protein, 9 aa, Homo Sapiens
PTEARGRPF

SEQ ID NO: 406650 - protein, 9 aa, Homo Sapiens
LPGPFLHCV

SEQ ID NO: 406651 - protein, 9 aa, Homo Sapiens
YERIDGRVW

SEQ ID NO: 406652 - protein, 9 aa, Homo Sapiens
SNGENAIEE

SEQ ID NO: 406653 - protein, 9 aa, Homo Sapiens
NDDKLYFFR

SEQ ID NO: 406654 - protein, 9 aa, Homo Sapiens
HSDETWSYN

SEQ ID NO: 406655 - protein, 9 aa, Homo Sapiens
KIHYEAPLL

SEQ ID NO: 406656 - protein, 9 aa, Homo Sapiens
YELPNVLEF

SEQ ID NO: 406657 - protein, 9 aa, Homo Sapiens
GGVGAQLMA

SEQ ID NO: 406658 - protein, 9 aa, Homo Sapiens
VHPQRRRPL

SEQ ID NO: 406659 - protein, 9 aa, Homo Sapiens
NCHLAMDID

SEQ ID NO: 406660 - protein, 9 aa, Homo Sapiens
QQAPTITMV

SEQ ID NO: 406661 - protein, 9 aa, Homo Sapiens
GSGSAAPRC

SEQ ID NO: 406662 - protein, 9 aa, Homo Sapiens
AARVKMRTV

SEQ ID NO: 406663 - protein, 9 aa, Homo Sapiens
PPGAPATPR

SEQ ID NO: 406664 - protein, 9 aa, Homo Sapiens
HFSPGCPLR

SEQ ID NO: 406665 - protein, 9 aa, Homo Sapiens
VIAAGPART

SEQ ID NO: 406666 - protein, 9 aa, Homo Sapiens
DMATGCRAC

SEQ ID NO: 406667 - protein, 9 aa, Homo Sapiens
YISDKSIEH

SEQ ID NO: 406668 - protein, 9 aa, Homo Sapiens
GVWMLQQPC

SEQ ID NO: 406669 - protein, 9 aa, Homo Sapiens
PSLGGGRGP

SEQ ID NO: 406670 - protein, 9 aa, Homo Sapiens
KALGPMLSS

SEQ ID NO: 406671 - protein, 9 aa, Homo Sapiens
AHQQPATAR

SEQ ID NO: 406672 - protein, 9 aa, Homo Sapiens
TASFGSFTV

SEQ ID NO: 406673 - protein, 9 aa, Homo Sapiens
TVALLHWLS

SEQ ID NO: 406674 - protein, 9 aa, Homo Sapiens
VEVHPFNQV

SEQ ID NO: 406675 - protein, 9 aa, Homo Sapiens
PPAVPPVLL

SEQ ID NO: 406676 - protein, 9 aa, Homo Sapiens
AHLGITMKA

SEQ ID NO: 406677 - protein, 9 aa, Homo Sapiens
HTMAATAIA

SEQ ID NO: 406678 - protein, 9 aa, Homo Sapiens
TIYNSLLPI

SEQ ID NO: 406679 - protein, 9 aa, Homo Sapiens
RDKRPEGYD

SEQ ID NO: 406680 - protein, 9 aa, Homo Sapiens
EDPPQTSLQ

SEQ ID NO: 406681 - protein, 9 aa, Homo Sapiens
RRQALPVMP

SEQ ID NO: 406682 - protein, 9 aa, Homo Sapiens
ACQPALLDL

SEQ ID NO: 406683 - protein, 9 aa, Homo Sapiens
SPKHGCNFN

SEQ ID NO: 406684 - protein, 9 aa, Homo Sapiens
PRLQWPAST

SEQ ID NO: 406685 - protein, 9 aa, Homo Sapiens
IERTALDGT

SEQ ID NO: 406686 - protein, 9 aa, Homo Sapiens
AQNLALVWA

SEQ ID NO: 406687 - protein, 9 aa, Homo Sapiens
EGGCTQDLP

SEQ ID NO: 406688 - protein, 9 aa, Homo Sapiens
RETCSSSPW

SEQ ID NO: 406689 - protein, 9 aa, Homo Sapiens
TRPQSTCAR

SEQ ID NO: 406690 - protein, 9 aa, Homo Sapiens
PARDGTSYK

SEQ ID NO: 406691 - protein, 9 aa, Homo Sapiens
WSPPRLRMC

SEQ ID NO: 406692 - protein, 9 aa, Homo Sapiens
SWYNYMCNC

SEQ ID NO: 406693 - protein, 9 aa, Homo Sapiens
RDGTSYKLT

SEQ ID NO: 406694 - protein, 9 aa, Homo Sapiens
TCHLRQPAF

SEQ ID NO: 406695 - protein, 9 aa, Homo Sapiens
SSINHFFVT

SEQ ID NO: 406696 - protein, 9 aa, Homo Sapiens
VGCRRCSGL

SEQ ID NO: 406697 - protein, 9 aa, Homo Sapiens
GGGSGGHYP

SEQ ID NO: 406698 - protein, 9 aa, Homo Sapiens
LLVVLTLPI

SEQ ID NO: 406699 - protein, 9 aa, Homo Sapiens
LRFHVLPDH

SEQ ID NO: 406700 - protein, 9 aa, Homo Sapiens
PALDALSQF

SEQ ID NO: 406701 - protein, 9 aa, Homo Sapiens
LAAATGTAA

SEQ ID NO: 406702 - protein, 9 aa, Homo Sapiens
YILPMLPQQ

SEQ ID NO: 406703 - protein, 9 aa, Homo Sapiens
LYYNWLGIV

SEQ ID NO: 406704 - protein, 9 aa, Homo Sapiens
FHSLKQVHL

SEQ ID NO: 406705 - protein, 9 aa, Homo Sapiens
VLHQNAPPV

SEQ ID NO: 406706 - protein, 9 aa, Homo Sapiens
ALMSQCWEL

SEQ ID NO: 406707 - protein, 9 aa, Homo Sapiens
PLSILSCLF

SEQ ID NO: 406708 - protein, 9 aa, Homo Sapiens
GGGHPVPLH

SEQ ID NO: 406709 - protein, 9 aa, Homo Sapiens
QLTLAFYVG

SEQ ID NO: 406710 - protein, 9 aa, Homo Sapiens
DFCVIYVHL

SEQ ID NO: 406711 - protein, 9 aa, Homo Sapiens
CWLSSPYYH

SEQ ID NO: 406712 - protein, 9 aa, Homo Sapiens
GIPMGASGP

SEQ ID NO: 406713 - protein, 9 aa, Homo Sapiens
NMHAQNLAL

SEQ ID NO: 406714 - protein, 9 aa, Homo Sapiens
KNMPQVVYC

SEQ ID NO: 406715 - protein, 9 aa, Homo Sapiens
EQIYQHVHS

SEQ ID NO: 406716 - protein, 9 aa, Homo Sapiens
AVPRGQGIL

SEQ ID NO: 406717 - protein, 9 aa, Homo Sapiens
RAPPRSGRG

SEQ ID NO: 406718 - protein, 9 aa, Homo Sapiens
LTFLCKAGG

SEQ ID NO: 406719 - protein, 9 aa, Homo Sapiens
QFHFLSSQV

SEQ ID NO: 406720 - protein, 9 aa, Homo Sapiens
SPCISTVSK

SEQ ID NO: 406721 - protein, 9 aa, Homo Sapiens
AHERPHPIH

SEQ ID NO: 406722 - protein, 9 aa, Homo Sapiens
VTGESPPAS

SEQ ID NO: 406723 - protein, 9 aa, Homo Sapiens
SRASSGCTR

SEQ ID NO: 406724 - protein, 9 aa, Homo Sapiens
TGLPSQKPK

SEQ ID NO: 406725 - protein, 9 aa, Homo Sapiens
SSYCKLPSL

SEQ ID NO: 406726 - protein, 9 aa, Homo Sapiens
GRVCTGMAR

SEQ ID NO: 406727 - protein, 9 aa, Homo Sapiens
LTLHMKIHT

SEQ ID NO: 406728 - protein, 9 aa, Homo Sapiens
KKKKEMMKL

SEQ ID NO: 406729 - protein, 9 aa, Homo Sapiens
EEPVSPAAA

SEQ ID NO: 406730 - protein, 9 aa, Homo Sapiens
GAQPSPPWL

SEQ ID NO: 406731 - protein, 9 aa, Homo Sapiens
ISVSSSDSF

SEQ ID NO: 406732 - protein, 9 aa, Homo Sapiens
KGIWLNDGH

SEQ ID NO: 406733 - protein, 9 aa, Homo Sapiens
DPTTLEYTV

SEQ ID NO: 406734 - protein, 9 aa, Homo Sapiens
VTVVDGLDE

SEQ ID NO: 406735 - protein, 9 aa, Homo Sapiens
CPDRTYGDM

SEQ ID NO: 406736 - protein, 9 aa, Homo Sapiens
TPRSLFTLR

SEQ ID NO: 406737 - protein, 9 aa, Homo Sapiens
GMLQKFLDD

SEQ ID NO: 406738 - protein, 9 aa, Homo Sapiens
DAIWNELHS

SEQ ID NO: 406739 - protein, 9 aa, Homo Sapiens
EALGYMDDQ

SEQ ID NO: 406740 - protein, 9 aa, Homo Sapiens
HRHLGYELL

SEQ ID NO: 406741 - protein, 9 aa, Homo Sapiens
PGEAAQPLG

SEQ ID NO: 406742 - protein, 9 aa, Homo Sapiens
SFTVHSPIT

SEQ ID NO: 406743 - protein, 9 aa, Homo Sapiens
TLKAGELHT

SEQ ID NO: 406744 - protein, 9 aa, Homo Sapiens
FLIQLKVMK

SEQ ID NO: 406745 - protein, 9 aa, Homo Sapiens
SVTKSVASF

SEQ ID NO: 406746 - protein, 9 aa, Homo Sapiens
QALRPTGPA

SEQ ID NO: 406747 - protein, 9 aa, Homo Sapiens
FSLHEQQCL

SEQ ID NO: 406748 - protein, 9 aa, Homo Sapiens
GTKPCMAPE

SEQ ID NO: 406749 - protein, 9 aa, Homo Sapiens
ARTGLLPGE

SEQ ID NO: 406750 - protein, 9 aa, Homo Sapiens
RHQVLGITV

SEQ ID NO: 406751 - protein, 9 aa, Homo Sapiens
SEQQGEVAL

SEQ ID NO: 406752 - protein, 9 aa, Homo Sapiens
PGAGDQGWA

SEQ ID NO: 406753 - protein, 9 aa, Homo Sapiens
LHWGHTKLA

SEQ ID NO: 406754 - protein, 9 aa, Homo Sapiens
LYTCGTGAF

SEQ ID NO: 406755 - protein, 9 aa, Homo Sapiens
RVIEVSHLG

SEQ ID NO: 406756 - protein, 9 aa, Homo Sapiens
WRPSARIPD

SEQ ID NO: 406757 - protein, 9 aa, Homo Sapiens
SDQLLSCAN

SEQ ID NO: 406758 - protein, 9 aa, Homo Sapiens
PPGPAPWWH

SEQ ID NO: 406759 - protein, 9 aa, Homo Sapiens
MERAFSSQG

SEQ ID NO: 406760 - protein, 9 aa, Homo Sapiens
RRRRKRSSQ

SEQ ID NO: 406761 - protein, 9 aa, Homo Sapiens
KWQKNINMK

SEQ ID NO: 406762 - protein, 9 aa, Homo Sapiens
RRQDCARPS

SEQ ID NO: 406763 - protein, 9 aa, Homo Sapiens
PTVKKIATM

SEQ ID NO: 406764 - protein, 9 aa, Homo Sapiens
LATRDTPRS

SEQ ID NO: 406765 - protein, 9 aa, Homo Sapiens
AVHSALQEE

SEQ ID NO: 406766 - protein, 9 aa, Homo Sapiens
PAVPAAACP

SEQ ID NO: 406767 - protein, 9 aa, Homo Sapiens
LKKKALSSM

SEQ ID NO: 406768 - protein, 9 aa, Homo Sapiens
SHKYDREPQ

SEQ ID NO: 406769 - protein, 9 aa, Homo Sapiens
PQDPNPQVP

SEQ ID NO: 406770 - protein, 9 aa, Homo Sapiens
EPFKVWLHL

SEQ ID NO: 406771 - protein, 9 aa, Homo Sapiens
ENLLKHFLV

SEQ ID NO: 406772 - protein, 9 aa, Homo Sapiens
RVCDTCLNG

SEQ ID NO: 406773 - protein, 9 aa, Homo Sapiens
KQAAEAPAE

SEQ ID NO: 406774 - protein, 9 aa, Homo Sapiens
EPLEDDKAS

SEQ ID NO: 406775 - protein, 9 aa, Homo Sapiens
VKCVDVRKN

SEQ ID NO: 406776 - protein, 9 aa, Homo Sapiens
KHFLVLNPI

SEQ ID NO: 406777 - protein, 9 aa, Homo Sapiens
SGLVKTTNM

SEQ ID NO: 406778 - protein, 9 aa, Homo Sapiens
TKEPRLWAG

SEQ ID NO: 406779 - protein, 9 aa, Homo Sapiens
PAWTCSSGP

SEQ ID NO: 406780 - protein, 9 aa, Homo Sapiens
GLGCLSFPL

SEQ ID NO: 406781 - protein, 9 aa, Homo Sapiens
GASPPRAPI

SEQ ID NO: 406782 - protein, 9 aa, Homo Sapiens
DCTSFSINT

SEQ ID NO: 406783 - protein, 9 aa, Homo Sapiens
GVYWSESVN

SEQ ID NO: 406784 - protein, 9 aa, Homo Sapiens
IDRMLDHNC

SEQ ID NO: 406785 - protein, 9 aa, Homo Sapiens
TASQDDRST

SEQ ID NO: 406786 - protein, 9 aa, Homo Sapiens
VTAGDPTTL

SEQ ID NO: 406787 - protein, 9 aa, Homo Sapiens
PELLSPPKH

SEQ ID NO: 406788 - protein, 9 aa, Homo Sapiens
TWREEKNVH

SEQ ID NO: 406789 - protein, 9 aa, Homo Sapiens
GSRRRCIPL

SEQ ID NO: 406790 - protein, 9 aa, Homo Sapiens
PRGLKGEWG

SEQ ID NO: 406791 - protein, 9 aa, Homo Sapiens
RLLDQLAAQ

SEQ ID NO: 406792 - protein, 9 aa, Homo Sapiens
TGSIISSYK

SEQ ID NO: 406793 - protein, 9 aa, Homo Sapiens
GGSTASSLS

SEQ ID NO: 406794 - protein, 9 aa, Homo Sapiens
GCPLRGGAG

SEQ ID NO: 406795 - protein, 9 aa, Homo Sapiens
RGRSCVSSR

SEQ ID NO: 406796 - protein, 9 aa, Homo Sapiens
KLCQFVILR

SEQ ID NO: 406797 - protein, 9 aa, Homo Sapiens
IKKRFEVLM

SEQ ID NO: 406798 - protein, 9 aa, Homo Sapiens
GVPPLPATT

SEQ ID NO: 406799 - protein, 9 aa, Homo Sapiens
PSCLMDSAW

SEQ ID NO: 406800 - protein, 9 aa, Homo Sapiens
DLKKKALSS

SEQ ID NO: 406801 - protein, 9 aa, Homo Sapiens
NMNQLVSLG

SEQ ID NO: 406802 - protein, 9 aa, Homo Sapiens
RAGALRLRP

SEQ ID NO: 406803 - protein, 9 aa, Homo Sapiens
VQPIWAVPD

SEQ ID NO: 406804 - protein, 9 aa, Homo Sapiens
STAGLSLNE

SEQ ID NO: 406805 - protein, 9 aa, Homo Sapiens
TDGIGVDEK

SEQ ID NO: 406806 - protein, 9 aa, Homo Sapiens
RFAFFPSTW

SEQ ID NO: 406807 - protein, 9 aa, Homo Sapiens
ISPKEIHGS

SEQ ID NO: 406808 - protein, 9 aa, Homo Sapiens
IYIGGVSED

SEQ ID NO: 406809 - protein, 9 aa, Homo Sapiens
KKIAKGTTV

SEQ ID NO: 406810 - protein, 9 aa, Homo Sapiens
PQRCGRTAG

SEQ ID NO: 406811 - protein, 9 aa, Homo Sapiens
LAPLFMYLF

SEQ ID NO: 406812 - protein, 9 aa, Homo Sapiens
MAPALSCTL

SEQ ID NO: 406813 - protein, 9 aa, Homo Sapiens
LDVTQRDTC

SEQ ID NO: 406814 - protein, 9 aa, Homo Sapiens
GPRGGGRPG

SEQ ID NO: 406815 - protein, 9 aa, Homo Sapiens
HEFIHTGKK

SEQ ID NO: 406816 - protein, 9 aa, Homo Sapiens
FWEMGDMGP

SEQ ID NO: 406817 - protein, 9 aa, Homo Sapiens
HTACEKESE

SEQ ID NO: 406818 - protein, 9 aa, Homo Sapiens
LGHRHQSTL

SEQ ID NO: 406819 - protein, 9 aa, Homo Sapiens
MYPYKAEVS

SEQ ID NO: 406820 - protein, 9 aa, Homo Sapiens
PTRRMRTFS

SEQ ID NO: 406821 - protein, 9 aa, Homo Sapiens
GGEDSGGSF

SEQ ID NO: 406822 - protein, 9 aa, Homo Sapiens
TLRCPAVPA

SEQ ID NO: 406823 - protein, 9 aa, Homo Sapiens
LHPFLPPPP

SEQ ID NO: 406824 - protein, 9 aa, Homo Sapiens
GMEKGNCGK

SEQ ID NO: 406825 - protein, 9 aa, Homo Sapiens
VGRAQASGT

SEQ ID NO: 406826 - protein, 9 aa, Homo Sapiens
NQLCHCARV

SEQ ID NO: 406827 - protein, 9 aa, Homo Sapiens
VSTPLASFL

SEQ ID NO: 406828 - protein, 9 aa, Homo Sapiens
SPGAAHQAG

SEQ ID NO: 406829 - protein, 9 aa, Homo Sapiens
HFDIRKAGT

SEQ ID NO: 406830 - protein, 9 aa, Homo Sapiens
GALKKGAGG

SEQ ID NO: 406831 - protein, 9 aa, Homo Sapiens
RVHSQQPCQ

SEQ ID NO: 406832 - protein, 9 aa, Homo Sapiens
VEGVDSTKN

SEQ ID NO: 406833 - protein, 9 aa, Homo Sapiens
LARVLMGNA

SEQ ID NO: 406834 - protein, 9 aa, Homo Sapiens
VRPIQGSCT

SEQ ID NO: 406835 - protein, 9 aa, Homo Sapiens
PRGRRDWGT

SEQ ID NO: 406836 - protein, 9 aa, Homo Sapiens
YALLREEEC

SEQ ID NO: 406837 - protein, 9 aa, Homo Sapiens
SPERGVPMS

SEQ ID NO: 406838 - protein, 9 aa, Homo Sapiens
HTISFWSKC

SEQ ID NO: 406839 - protein, 9 aa, Homo Sapiens
CVSSAMFSE

SEQ ID NO: 406840 - protein, 9 aa, Homo Sapiens
WTCHLRQPA

SEQ ID NO: 406841 - protein, 9 aa, Homo Sapiens
FYFFFIYSL

SEQ ID NO: 406842 - protein, 9 aa, Homo Sapiens
NLAAGPPPN

SEQ ID NO: 406843 - protein, 9 aa, Homo Sapiens
SQGKKPSPV

SEQ ID NO: 406844 - protein, 9 aa, Homo Sapiens
ATWRMRSST

SEQ ID NO: 406845 - protein, 9 aa, Homo Sapiens
LMYGQSYRV

SEQ ID NO: 406846 - protein, 9 aa, Homo Sapiens
IQVTAGDPT

SEQ ID NO: 406847 - protein, 9 aa, Homo Sapiens
WREEKNVHR

SEQ ID NO: 406848 - protein, 9 aa, Homo Sapiens
HITGMSLLG

SEQ ID NO: 406849 - protein, 9 aa, Homo Sapiens
EQIVLLKSS

SEQ ID NO: 406850 - protein, 9 aa, Homo Sapiens
MGTNGQVQP

SEQ ID NO: 406851 - protein, 9 aa, Homo Sapiens
VPMSLACSI

SEQ ID NO: 406852 - protein, 9 aa, Homo Sapiens
SVGGGEDSG

SEQ ID NO: 406853 - protein, 9 aa, Homo Sapiens
GPMWQGMGS

SEQ ID NO: 406854 - protein, 9 aa, Homo Sapiens
ETYQAQLQQ

SEQ ID NO: 406855 - protein, 9 aa, Homo Sapiens
KFGTLGSWP

SEQ ID NO: 406856 - protein, 9 aa, Homo Sapiens
RYQALKRTA

SEQ ID NO: 406857 - protein, 9 aa, Homo Sapiens
YGVCMGPGA

SEQ ID NO: 406858 - protein, 9 aa, Homo Sapiens
DYGLSVTKG

SEQ ID NO: 406859 - protein, 9 aa, Homo Sapiens
PRATLTRPP

SEQ ID NO: 406860 - protein, 9 aa, Homo Sapiens
ILCRLVMTL

SEQ ID NO: 406861 - protein, 9 aa, Homo Sapiens
KFPLKKLMA

SEQ ID NO: 406862 - protein, 9 aa, Homo Sapiens
GWGGQGARD

SEQ ID NO: 406863 - protein, 9 aa, Homo Sapiens
HCAGRRRQD

SEQ ID NO: 406864 - protein, 9 aa, Homo Sapiens
AVGRRGPDG

SEQ ID NO: 406865 - protein, 9 aa, Homo Sapiens
KSTLIDALC

SEQ ID NO: 406866 - protein, 9 aa, Homo Sapiens
YSSSILSIL

SEQ ID NO: 406867 - protein, 9 aa, Homo Sapiens
SRPGQTCQC

SEQ ID NO: 406868 - protein, 9 aa, Homo Sapiens
LATGLHLHR

SEQ ID NO: 406869 - protein, 9 aa, Homo Sapiens
GGGRGTAGG

SEQ ID NO: 406870 - protein, 9 aa, Homo Sapiens
GDFSGMAQD

SEQ ID NO: 406871 - protein, 9 aa, Homo Sapiens
YTPLTMRRN

SEQ ID NO: 406872 - protein, 9 aa, Homo Sapiens
PENEAPQCP

SEQ ID NO: 406873 - protein, 9 aa, Homo Sapiens
LCCKPLCLI

SEQ ID NO: 406874 - protein, 9 aa, Homo Sapiens
ATAGALLFC

SEQ ID NO: 406875 - protein, 9 aa, Homo Sapiens
ANNCPALRI

SEQ ID NO: 406876 - protein, 9 aa, Homo Sapiens
TQTKFAATI

SEQ ID NO: 406877 - protein, 9 aa, Homo Sapiens
PIIYRNLPE

SEQ ID NO: 406878 - protein, 9 aa, Homo Sapiens
HNHFSLFSA

SEQ ID NO: 406879 - protein, 9 aa, Homo Sapiens
GALDVEVSR

SEQ ID NO: 406880 - protein, 9 aa, Homo Sapiens
GSLLGRKEQ

SEQ ID NO: 406881 - protein, 9 aa, Homo Sapiens
GIKISWVCD

SEQ ID NO: 406882 - protein, 9 aa, Homo Sapiens
SLPGPCASL

SEQ ID NO: 406883 - protein, 9 aa, Homo Sapiens
KAIDYMSHP

SEQ ID NO: 406884 - protein, 9 aa, Homo Sapiens
GKFAPFFVP

SEQ ID NO: 406885 - protein, 9 aa, Homo Sapiens
AAPMMSSMA

SEQ ID NO: 406886 - protein, 9 aa, Homo Sapiens
LVHSTHLVF

SEQ ID NO: 406887 - protein, 9 aa, Homo Sapiens
PRGSSSCSA

SEQ ID NO: 406888 - protein, 9 aa, Homo Sapiens
RQIYPPSTC

SEQ ID NO: 406889 - protein, 9 aa, Homo Sapiens
SISRPCPRT

SEQ ID NO: 406890 - protein, 9 aa, Homo Sapiens
FLQPSPQTP

SEQ ID NO: 406891 - protein, 9 aa, Homo Sapiens
GITVFLTGF

SEQ ID NO: 406892 - protein, 9 aa, Homo Sapiens
DNNQGAPAR

SEQ ID NO: 406893 - protein, 9 aa, Homo Sapiens
TRESVPSSS

SEQ ID NO: 406894 - protein, 9 aa, Homo Sapiens
ESAWRRRAA

SEQ ID NO: 406895 - protein, 9 aa, Homo Sapiens
NMTDVSTAF

SEQ ID NO: 406896 - protein, 9 aa, Homo Sapiens
PSLAPGERR

SEQ ID NO: 406897 - protein, 9 aa, Homo Sapiens
RGLHQAVPR

SEQ ID NO: 406898 - protein, 9 aa, Homo Sapiens
NSHFMRLAA

SEQ ID NO: 406899 - protein, 9 aa, Homo Sapiens
SPVVVPTPI

SEQ ID NO: 406900 - protein, 9 aa, Homo Sapiens
NPISPVSIA

SEQ ID NO: 406901 - protein, 9 aa, Homo Sapiens
HPQWAPHSA

SEQ ID NO: 406902 - protein, 9 aa, Homo Sapiens
VHSTHLVFV

SEQ ID NO: 406903 - protein, 9 aa, Homo Sapiens
NLADSTLHG

SEQ ID NO: 406904 - protein, 9 aa, Homo Sapiens
FAHGPHDLC

SEQ ID NO: 406905 - protein, 9 aa, Homo Sapiens
SSSGSPSVL

SEQ ID NO: 406906 - protein, 9 aa, Homo Sapiens
STSTGSRQS

SEQ ID NO: 406907 - protein, 9 aa, Homo Sapiens
YFPFDIVFL

SEQ ID NO: 406908 - protein, 9 aa, Homo Sapiens
LYHPVVMHW

SEQ ID NO: 406909 - protein, 9 aa, Homo Sapiens
TLHVFKMTK

SEQ ID NO: 406910 - protein, 9 aa, Homo Sapiens
ATQSQPHDF

SEQ ID NO: 406911 - protein, 9 aa, Homo Sapiens
TPLLTSIDA

SEQ ID NO: 406912 - protein, 9 aa, Homo Sapiens
NGHLSQDPY

SEQ ID NO: 406913 - protein, 9 aa, Homo Sapiens
LPQPPQHQL

SEQ ID NO: 406914 - protein, 9 aa, Homo Sapiens
IHPQKSYKM

SEQ ID NO: 406915 - protein, 9 aa, Homo Sapiens
ETTGPNRQI

SEQ ID NO: 406916 - protein, 9 aa, Homo Sapiens
LRCRDDPGV

SEQ ID NO: 406917 - protein, 9 aa, Homo Sapiens
QCPSCMPSG

SEQ ID NO: 406918 - protein, 9 aa, Homo Sapiens
QVPRPRPRC

SEQ ID NO: 406919 - protein, 9 aa, Homo Sapiens
LTIYNSLLP

SEQ ID NO: 406920 - protein, 9 aa, Homo Sapiens
AIAVLEYMP

SEQ ID NO: 406921 - protein, 9 aa, Homo Sapiens
HLRGGGLLV

SEQ ID NO: 406922 - protein, 9 aa, Homo Sapiens
NGAGWPCPA

SEQ ID NO: 406923 - protein, 9 aa, Homo Sapiens
WLHLLDQVF

SEQ ID NO: 406924 - protein, 9 aa, Homo Sapiens
FKLISTSTK

SEQ ID NO: 406925 - protein, 9 aa, Homo Sapiens
PKKRERMML

SEQ ID NO: 406926 - protein, 9 aa, Homo Sapiens
RRRKRSSQS

SEQ ID NO: 406927 - protein, 9 aa, Homo Sapiens
VLSLLPVLQ

SEQ ID NO: 406928 - protein, 9 aa, Homo Sapiens
LILADESDH

SEQ ID NO: 406929 - protein, 9 aa, Homo Sapiens
VNVFISSGR

SEQ ID NO: 406930 - protein, 9 aa, Homo Sapiens
IYVGCRATV

SEQ ID NO: 406931 - protein, 9 aa, Homo Sapiens
YYRETYCAC

SEQ ID NO: 406932 - protein, 9 aa, Homo Sapiens
EVAEAAAVV

SEQ ID NO: 406933 - protein, 9 aa, Homo Sapiens
CTLGVMMMM

SEQ ID NO: 406934 - protein, 9 aa, Homo Sapiens
DGSVDALWI

SEQ ID NO: 406935 - protein, 9 aa, Homo Sapiens
VTSFDHMPK

SEQ ID NO: 406936 - protein, 9 aa, Homo Sapiens
TVLHQNAPP

SEQ ID NO: 406937 - protein, 9 aa, Homo Sapiens
LPVLQPPPH

SEQ ID NO: 406938 - protein, 9 aa, Homo Sapiens
GEKNWYLFC

SEQ ID NO: 406939 - protein, 9 aa, Homo Sapiens
KHLRTLEKN

SEQ ID NO: 406940 - protein, 9 aa, Homo Sapiens
LFTCLQAWR

SEQ ID NO: 406941 - protein, 9 aa, Homo Sapiens
SKIPERIQS

SEQ ID NO: 406942 - protein, 9 aa, Homo Sapiens
LPTLSTLQQ

SEQ ID NO: 406943 - protein, 9 aa, Homo Sapiens
SERGPPYRT

SEQ ID NO: 406944 - protein, 9 aa, Homo Sapiens
NIGAPRPKG

SEQ ID NO: 406945 - protein, 9 aa, Homo Sapiens
EYTETQNQF

SEQ ID NO: 406946 - protein, 9 aa, Homo Sapiens
CITEDTPPP

SEQ ID NO: 406947 - protein, 9 aa, Homo Sapiens
LMPDAMCVN

SEQ ID NO: 406948 - protein, 9 aa, Homo Sapiens
NTIDVDHVV

SEQ ID NO: 406949 - protein, 9 aa, Homo Sapiens
LDVKPQGLH

SEQ ID NO: 406950 - protein, 9 aa, Homo Sapiens
YCHPGCYTC

SEQ ID NO: 406951 - protein, 9 aa, Homo Sapiens
WDSALRLWE

SEQ ID NO: 406952 - protein, 9 aa, Homo Sapiens
GPAPWWHPG

SEQ ID NO: 406953 - protein, 9 aa, Homo Sapiens
KLSTVHHCI

SEQ ID NO: 406954 - protein, 9 aa, Homo Sapiens
CSECIDWGG

SEQ ID NO: 406955 - protein, 9 aa, Homo Sapiens
DRKTTSFSS

SEQ ID NO: 406956 - protein, 9 aa, Homo Sapiens
GQGARDSRR

SEQ ID NO: 406957 - protein, 9 aa, Homo Sapiens
RLENDYLKD

SEQ ID NO: 406958 - protein, 9 aa, Homo Sapiens
HVEGEKPKA

SEQ ID NO: 406959 - protein, 9 aa, Homo Sapiens
KNNCKISVD

SEQ ID NO: 406960 - protein, 9 aa, Homo Sapiens
LREDWSVYP

SEQ ID NO: 406961 - protein, 9 aa, Homo Sapiens
REGPVSESE

SEQ ID NO: 406962 - protein, 9 aa, Homo Sapiens
LDHTACEKE

SEQ ID NO: 406963 - protein, 9 aa, Homo Sapiens
AGTCNIYYL

SEQ ID NO: 406964 - protein, 9 aa, Homo Sapiens
PLTQYMPQN

SEQ ID NO: 406965 - protein, 9 aa, Homo Sapiens
TMGCLLLGA

SEQ ID NO: 406966 - protein, 9 aa, Homo Sapiens
APSAGPLYG

SEQ ID NO: 406967 - protein, 9 aa, Homo Sapiens
RAHGYGVCM

SEQ ID NO: 406968 - protein, 9 aa, Homo Sapiens
SYDVPTISR

SEQ ID NO: 406969 - protein, 9 aa, Homo Sapiens
PSPSRRRAP

SEQ ID NO: 406970 - protein, 9 aa, Homo Sapiens
PSLPSRWCQ

SEQ ID NO: 406971 - protein, 9 aa, Homo Sapiens
VAGTSLQEA

SEQ ID NO: 406972 - protein, 9 aa, Homo Sapiens
HPPVFQKKI

SEQ ID NO: 406973 - protein, 9 aa, Homo Sapiens
SRAISHMDV

SEQ ID NO: 406974 - protein, 9 aa, Homo Sapiens
AKTMTAEVQ

SEQ ID NO: 406975 - protein, 9 aa, Homo Sapiens
EVSASILQE

SEQ ID NO: 406976 - protein, 9 aa, Homo Sapiens
PPAVCGEGG

SEQ ID NO: 406977 - protein, 9 aa, Homo Sapiens
DPMEVSASI

SEQ ID NO: 406978 - protein, 9 aa, Homo Sapiens
WEELLKILQ

SEQ ID NO: 406979 - protein, 9 aa, Homo Sapiens
LAPGAQNPA

SEQ ID NO: 406980 - protein, 9 aa, Homo Sapiens
CAVMDKRRN

SEQ ID NO: 406981 - protein, 9 aa, Homo Sapiens
DHNCDTGAF

SEQ ID NO: 406982 - protein, 9 aa, Homo Sapiens
FGQATWCLH

SEQ ID NO: 406983 - protein, 9 aa, Homo Sapiens
RDACGRASS

SEQ ID NO: 406984 - protein, 9 aa, Homo Sapiens
SDQEGNISS

SEQ ID NO: 406985 - protein, 9 aa, Homo Sapiens
QQWVQDPPL

SEQ ID NO: 406986 - protein, 9 aa, Homo Sapiens
GQATWCLHR

SEQ ID NO: 406987 - protein, 9 aa, Homo Sapiens
SPSRSAACG

SEQ ID NO: 406988 - protein, 9 aa, Homo Sapiens
ERMTGHGRA

SEQ ID NO: 406989 - protein, 9 aa, Homo Sapiens
LVWLSKIQR

SEQ ID NO: 406990 - protein, 9 aa, Homo Sapiens
QEVLQNISD

SEQ ID NO: 406991 - protein, 9 aa, Homo Sapiens
EKRRPLDNS

SEQ ID NO: 406992 - protein, 9 aa, Homo Sapiens
DAGHVAAVA

SEQ ID NO: 406993 - protein, 9 aa, Homo Sapiens
GMWEGLAAW

SEQ ID NO: 406994 - protein, 9 aa, Homo Sapiens
DIQFHFLSS

SEQ ID NO: 406995 - protein, 9 aa, Homo Sapiens
VSISWAVGI

SEQ ID NO: 406996 - protein, 9 aa, Homo Sapiens
AEYFEHGVL

SEQ ID NO: 406997 - protein, 9 aa, Homo Sapiens
VILVWLSKI

SEQ ID NO: 406998 - protein, 9 aa, Homo Sapiens
EVNWKVLER

SEQ ID NO: 406999 - protein, 9 aa, Homo Sapiens
RRIRREGIR

SEQ ID NO: 407000 - protein, 9 aa, Homo Sapiens
VTSSLGIRA

SEQ ID NO: 407001 - protein, 9 aa, Homo Sapiens
IWKEMDEYI

SEQ ID NO: 407002 - protein, 9 aa, Homo Sapiens
QQTQAPAVA

SEQ ID NO: 407003 - protein, 9 aa, Homo Sapiens
DGSRWNFVY

SEQ ID NO: 407004 - protein, 9 aa, Homo Sapiens
QEPMKRASK

SEQ ID NO: 407005 - protein, 9 aa, Homo Sapiens
GIPGRSGPQ

SEQ ID NO: 407006 - protein, 9 aa, Homo Sapiens
DEEDEDEGE

SEQ ID NO: 407007 - protein, 9 aa, Homo Sapiens
LAWLPCVAL

SEQ ID NO: 407008 - protein, 9 aa, Homo Sapiens
LSIVILYYR

SEQ ID NO: 407009 - protein, 9 aa, Homo Sapiens
IVNTDLGYE

SEQ ID NO: 407010 - protein, 9 aa, Homo Sapiens
MITYKFEED

SEQ ID NO: 407011 - protein, 9 aa, Homo Sapiens
KWKCTLGVM

SEQ ID NO: 407012 - protein, 9 aa, Homo Sapiens
ARMNDLHNL

SEQ ID NO: 407013 - protein, 9 aa, Homo Sapiens
ARSALPQGR

SEQ ID NO: 407014 - protein, 9 aa, Homo Sapiens
KEEDILASS

SEQ ID NO: 407015 - protein, 9 aa, Homo Sapiens
NSMTDNSDQ

SEQ ID NO: 407016 - protein, 9 aa, Homo Sapiens
RTARVSWGQ

SEQ ID NO: 407017 - protein, 9 aa, Homo Sapiens
CKKRIPDTR

SEQ ID NO: 407018 - protein, 9 aa, Homo Sapiens
KHSESPPAP

SEQ ID NO: 407019 - protein, 9 aa, Homo Sapiens
NDSDDYSPD

SEQ ID NO: 407020 - protein, 9 aa, Homo Sapiens
GISGPVPPD

SEQ ID NO: 407021 - protein, 9 aa, Homo Sapiens
GGASAAGGD

SEQ ID NO: 407022 - protein, 9 aa, Homo Sapiens
LPASACARR

SEQ ID NO: 407023 - protein, 9 aa, Homo Sapiens
ASFMQYTVL

SEQ ID NO: 407024 - protein, 9 aa, Homo Sapiens
LAASSHVPV

SEQ ID NO: 407025 - protein, 9 aa, Homo Sapiens
MGGNRSICL

SEQ ID NO: 407026 - protein, 9 aa, Homo Sapiens
WRLFCWWSW

SEQ ID NO: 407027 - protein, 9 aa, Homo Sapiens
RPGWAALQR

SEQ ID NO: 407028 - protein, 9 aa, Homo Sapiens
SWPDGWAAA

SEQ ID NO: 407029 - protein, 9 aa, Homo Sapiens
PTPPMPMAM

SEQ ID NO: 407030 - protein, 9 aa, Homo Sapiens
GSGEPTPSW

SEQ ID NO: 407031 - protein, 9 aa, Homo Sapiens
AQPKDYANT

SEQ ID NO: 407032 - protein, 9 aa, Homo Sapiens
FAVTTTPDQ

SEQ ID NO: 407033 - protein, 9 aa, Homo Sapiens
EVLFNVMKT

SEQ ID NO: 407034 - protein, 9 aa, Homo Sapiens
TSVVSEETL

SEQ ID NO: 407035 - protein, 9 aa, Homo Sapiens
FIARKLQEK

SEQ ID NO: 407036 - protein, 9 aa, Homo Sapiens
ECYCLNGQE

SEQ ID NO: 407037 - protein, 9 aa, Homo Sapiens
EARAPLESV

SEQ ID NO: 407038 - protein, 9 aa, Homo Sapiens
GEKPLKDKR

SEQ ID NO: 407039 - protein, 9 aa, Homo Sapiens
AMECTPPHL

SEQ ID NO: 407040 - protein, 9 aa, Homo Sapiens
RSSPTDLAF

SEQ ID NO: 407041 - protein, 9 aa, Homo Sapiens
GPLARVHAL

SEQ ID NO: 407042 - protein, 9 aa, Homo Sapiens
IPWMLIDFY

SEQ ID NO: 407043 - protein, 9 aa, Homo Sapiens
TRTAVDNFS

SEQ ID NO: 407044 - protein, 9 aa, Homo Sapiens
NHVHVRVDH

SEQ ID NO: 407045 - protein, 9 aa, Homo Sapiens
KVDIHLLRE

SEQ ID NO: 407046 - protein, 9 aa, Homo Sapiens
KMEIISETD

SEQ ID NO: 407047 - protein, 9 aa, Homo Sapiens
DGVAGPKCP

SEQ ID NO: 407048 - protein, 9 aa, Homo Sapiens
RQCCSGQEL

SEQ ID NO: 407049 - protein, 9 aa, Homo Sapiens
MELVLATAG

SEQ ID NO: 407050 - protein, 9 aa, Homo Sapiens
WTAEGAAGT

SEQ ID NO: 407051 - protein, 9 aa, Homo Sapiens
NSGQVHKDE

SEQ ID NO: 407052 - protein, 9 aa, Homo Sapiens
MQSTLDAEV

SEQ ID NO: 407053 - protein, 9 aa, Homo Sapiens
PSGTGKTVV

SEQ ID NO: 407054 - protein, 9 aa, Homo Sapiens
SAHQQPATA

SEQ ID NO: 407055 - protein, 9 aa, Homo Sapiens
LKMEIKKSQ

SEQ ID NO: 407056 - protein, 9 aa, Homo Sapiens
KTKLKLYHL

SEQ ID NO: 407057 - protein, 9 aa, Homo Sapiens
PHLLQPASL

SEQ ID NO: 407058 - protein, 9 aa, Homo Sapiens
LEHVQEMQE

SEQ ID NO: 407059 - protein, 9 aa, Homo Sapiens
SDESRRDYF

SEQ ID NO: 407060 - protein, 9 aa, Homo Sapiens
VRELEELRL

SEQ ID NO: 407061 - protein, 9 aa, Homo Sapiens
GETVVLQCI

SEQ ID NO: 407062 - protein, 9 aa, Homo Sapiens
TLGKIPNLL

SEQ ID NO: 407063 - protein, 9 aa, Homo Sapiens
VCTLKIMSG

SEQ ID NO: 407064 - protein, 9 aa, Homo Sapiens
HLRNIRVRT

SEQ ID NO: 407065 - protein, 9 aa, Homo Sapiens
FFRVMRGIS

SEQ ID NO: 407066 - protein, 9 aa, Homo Sapiens
SAPRNLVPK

SEQ ID NO: 407067 - protein, 9 aa, Homo Sapiens
QHQLSAPAG

SEQ ID NO: 407068 - protein, 9 aa, Homo Sapiens
IGAVRPDAV

SEQ ID NO: 407069 - protein, 9 aa, Homo Sapiens
EETSLVKVE

SEQ ID NO: 407070 - protein, 9 aa, Homo Sapiens
VHQNMDYCP

SEQ ID NO: 407071 - protein, 9 aa, Homo Sapiens
STMESGEST

SEQ ID NO: 407072 - protein, 9 aa, Homo Sapiens
KNCHLAMDI

SEQ ID NO: 407073 - protein, 9 aa, Homo Sapiens
LSSKKAEMN

SEQ ID NO: 407074 - protein, 9 aa, Homo Sapiens
AKNRVLMIM

SEQ ID NO: 407075 - protein, 9 aa, Homo Sapiens
HFAFGNGCT

SEQ ID NO: 407076 - protein, 9 aa, Homo Sapiens
SPWGDYPLV

SEQ ID NO: 407077 - protein, 9 aa, Homo Sapiens
TPVDFYFID

SEQ ID NO: 407078 - protein, 9 aa, Homo Sapiens
QPIVKKGEE

SEQ ID NO: 407079 - protein, 9 aa, Homo Sapiens
TKAIRTIAH

SEQ ID NO: 407080 - protein, 9 aa, Homo Sapiens
GETLTFLCK

SEQ ID NO: 407081 - protein, 9 aa, Homo Sapiens
HHPWPKSTP

SEQ ID NO: 407082 - protein, 9 aa, Homo Sapiens
DGFALGRGL

SEQ ID NO: 407083 - protein, 9 aa, Homo Sapiens
DVHVWVQDG

SEQ ID NO: 407084 - protein, 9 aa, Homo Sapiens
GRVDRLAVL

SEQ ID NO: 407085 - protein, 9 aa, Homo Sapiens
VRVDHRDAR

SEQ ID NO: 407086 - protein, 9 aa, Homo Sapiens
GPACVPVAE

SEQ ID NO: 407087 - protein, 9 aa, Homo Sapiens
KSDQLLSCA

SEQ ID NO: 407088 - protein, 9 aa, Homo Sapiens
GAGSHLPAA

SEQ ID NO: 407089 - protein, 9 aa, Homo Sapiens
PDLHTGLIK

SEQ ID NO: 407090 - protein, 9 aa, Homo Sapiens
PQPQSRFHR

SEQ ID NO: 407091 - protein, 9 aa, Homo Sapiens
LFFFHLLGG

SEQ ID NO: 407092 - protein, 9 aa, Homo Sapiens
PPKFPQSIY

SEQ ID NO: 407093 - protein, 9 aa, Homo Sapiens
TTIGAHKTL

SEQ ID NO: 407094 - protein, 9 aa, Homo Sapiens
SLGIRAQGT

SEQ ID NO: 407095 - protein, 9 aa, Homo Sapiens
NGQKCTEPL

SEQ ID NO: 407096 - protein, 9 aa, Homo Sapiens
SNYHKITAP

SEQ ID NO: 407097 - protein, 9 aa, Homo Sapiens
FGRFSHLTR

SEQ ID NO: 407098 - protein, 9 aa, Homo Sapiens
VHAARRLGT

SEQ ID NO: 407099 - protein, 9 aa, Homo Sapiens
LSIVRTARG

SEQ ID NO: 407100 - protein, 9 aa, Homo Sapiens
QHIDYVLQE

SEQ ID NO: 407101 - protein, 9 aa, Homo Sapiens
IVKKGEEGG

SEQ ID NO: 407102 - protein, 9 aa, Homo Sapiens
KSLSRKSPS

SEQ ID NO: 407103 - protein, 9 aa, Homo Sapiens
NVLTPSAAW

SEQ ID NO: 407104 - protein, 9 aa, Homo Sapiens
VCEGKGLHW

SEQ ID NO: 407105 - protein, 9 aa, Homo Sapiens
EEDEDEGEE

SEQ ID NO: 407106 - protein, 9 aa, Homo Sapiens
ALWMARRGH

SEQ ID NO: 407107 - protein, 9 aa, Homo Sapiens
TTTPPSPTC

SEQ ID NO: 407108 - protein, 9 aa, Homo Sapiens
SSKHALMVV

SEQ ID NO: 407109 - protein, 9 aa, Homo Sapiens
FRVTFDVEI

SEQ ID NO: 407110 - protein, 9 aa, Homo Sapiens
YRKKIGKLL

SEQ ID NO: 407111 - protein, 9 aa, Homo Sapiens
ALGPMLSSI

SEQ ID NO: 407112 - protein, 9 aa, Homo Sapiens
RPVQLLVQL

SEQ ID NO: 407113 - protein, 9 aa, Homo Sapiens
MKTYSLVDR

SEQ ID NO: 407114 - protein, 9 aa, Homo Sapiens
EKWNNIKRW

SEQ ID NO: 407115 - protein, 9 aa, Homo Sapiens
VAAGMELRD

SEQ ID NO: 407116 - protein, 9 aa, Homo Sapiens
KMCAPVGNG

SEQ ID NO: 407117 - protein, 9 aa, Homo Sapiens
DDPGVGSVL

SEQ ID NO: 407118 - protein, 9 aa, Homo Sapiens
KKGQTQKEK

SEQ ID NO: 407119 - protein, 9 aa, Homo Sapiens
QTQFSLLYN

SEQ ID NO: 407120 - protein, 9 aa, Homo Sapiens
PENYSNAGL

SEQ ID NO: 407121 - protein, 9 aa, Homo Sapiens
QEEVNINCK

SEQ ID NO: 407122 - protein, 9 aa, Homo Sapiens
GDYIRVHKA

SEQ ID NO: 407123 - protein, 9 aa, Homo Sapiens
QHQELEHAG

SEQ ID NO: 407124 - protein, 9 aa, Homo Sapiens
FLKNPKVDR

SEQ ID NO: 407125 - protein, 9 aa, Homo Sapiens
PRSGRGSLR

SEQ ID NO: 407126 - protein, 9 aa, Homo Sapiens
FVSWTPCLD

SEQ ID NO: 407127 - protein, 9 aa, Homo Sapiens
IIISMHFAF

SEQ ID NO: 407128 - protein, 9 aa, Homo Sapiens
GESLRPVMN

SEQ ID NO: 407129 - protein, 9 aa, Homo Sapiens
NYQIPLRVF

SEQ ID NO: 407130 - protein, 9 aa, Homo Sapiens
PISTTLRPP

SEQ ID NO: 407131 - protein, 9 aa, Homo Sapiens
CQYLRCGVK

SEQ ID NO: 407132 - protein, 9 aa, Homo Sapiens
PWPKSTPDA

SEQ ID NO: 407133 - protein, 9 aa, Homo Sapiens
TPDFSRLGR

SEQ ID NO: 407134 - protein, 9 aa, Homo Sapiens
LVESFAVTI

SEQ ID NO: 407135 - protein, 9 aa, Homo Sapiens
SNTNHHKQV

SEQ ID NO: 407136 - protein, 9 aa, Homo Sapiens
GKMKWRKQD

SEQ ID NO: 407137 - protein, 9 aa, Homo Sapiens
NLNMLSLFF

SEQ ID NO: 407138 - protein, 9 aa, Homo Sapiens
SWFGNLVIN

SEQ ID NO: 407139 - protein, 9 aa, Homo Sapiens
LSAPAGACA

SEQ ID NO: 407140 - protein, 9 aa, Homo Sapiens
VKRCLSSFL

SEQ ID NO: 407141 - protein, 9 aa, Homo Sapiens
ALSQFLRKK

SEQ ID NO: 407142 - protein, 9 aa, Homo Sapiens
LSWARMLQE

SEQ ID NO: 407143 - protein, 9 aa, Homo Sapiens
PVYLLSVST

SEQ ID NO: 407144 - protein, 9 aa, Homo Sapiens
QFKDFQQRI

SEQ ID NO: 407145 - protein, 9 aa, Homo Sapiens
LPERMKAGD

SEQ ID NO: 407146 - protein, 9 aa, Homo Sapiens
SEAWDSEGM

SEQ ID NO: 407147 - protein, 9 aa, Homo Sapiens
NLDQDNACV

SEQ ID NO: 407148 - protein, 9 aa, Homo Sapiens
IVTQTADYP

SEQ ID NO: 407149 - protein, 9 aa, Homo Sapiens
RAAKIERTA

SEQ ID NO: 407150 - protein, 9 aa, Homo Sapiens
SEGGKRRRD

SEQ ID NO: 407151 - protein, 9 aa, Homo Sapiens
GASLLLLQL

SEQ ID NO: 407152 - protein, 9 aa, Homo Sapiens
LVKREQLMP

SEQ ID NO: 407153 - protein, 9 aa, Homo Sapiens
SYRVTLELE

SEQ ID NO: 407154 - protein, 9 aa, Homo Sapiens
LPEEQPGGF

SEQ ID NO: 407155 - protein, 9 aa, Homo Sapiens
DLCRGPRLP

SEQ ID NO: 407156 - protein, 9 aa, Homo Sapiens
ILARIQEDH

SEQ ID NO: 407157 - protein, 9 aa, Homo Sapiens
QNSHWPRDV

SEQ ID NO: 407158 - protein, 9 aa, Homo Sapiens
QIYSEHNYC

SEQ ID NO: 407159 - protein, 9 aa, Homo Sapiens
YTFNSMRKS

SEQ ID NO: 407160 - protein, 9 aa, Homo Sapiens
HWLSQPLDG

SEQ ID NO: 407161 - protein, 9 aa, Homo Sapiens
KLRMKKMIG

SEQ ID NO: 407162 - protein, 9 aa, Homo Sapiens
PEFKMLSVH

SEQ ID NO: 407163 - protein, 9 aa, Homo Sapiens
SQKVVAAMP

SEQ ID NO: 407164 - protein, 9 aa, Homo Sapiens
LEVTSEEPA

SEQ ID NO: 407165 - protein, 9 aa, Homo Sapiens
KDLLSMLCM

SEQ ID NO: 407166 - protein, 9 aa, Homo Sapiens
TCISMTTIS

SEQ ID NO: 407167 - protein, 9 aa, Homo Sapiens
KTTSFSSLE

SEQ ID NO: 407168 - protein, 9 aa, Homo Sapiens
TTTCRSCSK

SEQ ID NO: 407169 - protein, 9 aa, Homo Sapiens
MDTRKHHQS

SEQ ID NO: 407170 - protein, 9 aa, Homo Sapiens
FMTMGMQTG

SEQ ID NO: 407171 - protein, 9 aa, Homo Sapiens
LSVDVEGGQ

SEQ ID NO: 407172 - protein, 9 aa, Homo Sapiens
TRLLRRARP

SEQ ID NO: 407173 - protein, 9 aa, Homo Sapiens
EHVVAQGWQ

SEQ ID NO: 407174 - protein, 9 aa, Homo Sapiens
EKQAPAFKY

SEQ ID NO: 407175 - protein, 9 aa, Homo Sapiens
PSPWSPSPR

SEQ ID NO: 407176 - protein, 9 aa, Homo Sapiens
QVLEVESVE

SEQ ID NO: 407177 - protein, 9 aa, Homo Sapiens
DVKAWLENE

SEQ ID NO: 407178 - protein, 9 aa, Homo Sapiens
LGVSQQLSS

SEQ ID NO: 407179 - protein, 9 aa, Homo Sapiens
GILMHRLSD

SEQ ID NO: 407180 - protein, 9 aa, Homo Sapiens
KAMYLPPAP

SEQ ID NO: 407181 - protein, 9 aa, Homo Sapiens
DLPQEQHLR

SEQ ID NO: 407182 - protein, 9 aa, Homo Sapiens
IRSHCSSTV

SEQ ID NO: 407183 - protein, 9 aa, Homo Sapiens
SIPIYFPPE

SEQ ID NO: 407184 - protein, 9 aa, Homo Sapiens
EHRRNDSYT

SEQ ID NO: 407185 - protein, 9 aa, Homo Sapiens
GSCTTIHLH

SEQ ID NO: 407186 - protein, 9 aa, Homo Sapiens
NVPKDTPSS

SEQ ID NO: 407187 - protein, 9 aa, Homo Sapiens
GCEAIVNTG

SEQ ID NO: 407188 - protein, 9 aa, Homo Sapiens
CRGPRLPSQ

SEQ ID NO: 407189 - protein, 9 aa, Homo Sapiens
ASACARRCL

SEQ ID NO: 407190 - protein, 9 aa, Homo Sapiens
YLADDRLYH

SEQ ID NO: 407191 - protein, 9 aa, Homo Sapiens
LKIASVEGQ

SEQ ID NO: 407192 - protein, 9 aa, Homo Sapiens
MVMGIIFMC

SEQ ID NO: 407193 - protein, 9 aa, Homo Sapiens
PFYLEAICL

SEQ ID NO: 407194 - protein, 9 aa, Homo Sapiens
VPDNAFYKN

SEQ ID NO: 407195 - protein, 9 aa, Homo Sapiens
FKKRYVWFS

SEQ ID NO: 407196 - protein, 9 aa, Homo Sapiens
KPANIFLRP

SEQ ID NO: 407197 - protein, 9 aa, Homo Sapiens
GINAIYYYA

SEQ ID NO: 407198 - protein, 9 aa, Homo Sapiens
LRVQSVLLL

SEQ ID NO: 407199 - protein, 9 aa, Homo Sapiens
RSTFRNLQG

SEQ ID NO: 407200 - protein, 9 aa, Homo Sapiens
SPPRLRMCS

SEQ ID NO: 407201 - protein, 9 aa, Homo Sapiens
RLWLLWRQN

SEQ ID NO: 407202 - protein, 9 aa, Homo Sapiens
GRRGPDGVM

SEQ ID NO: 407203 - protein, 9 aa, Homo Sapiens
SCNPVQGVM

SEQ ID NO: 407204 - protein, 9 aa, Homo Sapiens
CYIAMCREK

SEQ ID NO: 407205 - protein, 9 aa, Homo Sapiens
YKALKGLRH

SEQ ID NO: 407206 - protein, 9 aa, Homo Sapiens
CTSHPGGSA

SEQ ID NO: 407207 - protein, 9 aa, Homo Sapiens
QQRPPWRTS

SEQ ID NO: 407208 - protein, 9 aa, Homo Sapiens
VHVRLHELS

SEQ ID NO: 407209 - protein, 9 aa, Homo Sapiens
KAETMGFPV

SEQ ID NO: 407210 - protein, 9 aa, Homo Sapiens
RSPSTNVAL

SEQ ID NO: 407211 - protein, 9 aa, Homo Sapiens
DLSLDLRQL

SEQ ID NO: 407212 - protein, 9 aa, Homo Sapiens
LHRYAGMTL

SEQ ID NO: 407213 - protein, 9 aa, Homo Sapiens
PRDYWYLLA

SEQ ID NO: 407214 - protein, 9 aa, Homo Sapiens
VQIAHFFRI

SEQ ID NO: 407215 - protein, 9 aa, Homo Sapiens
LTVYSLGRS

SEQ ID NO: 407216 - protein, 9 aa, Homo Sapiens
IKWDPQELL

SEQ ID NO: 407217 - protein, 9 aa, Homo Sapiens
LSPRKDAGC

SEQ ID NO: 407218 - protein, 9 aa, Homo Sapiens
GQGAGHAAA

SEQ ID NO: 407219 - protein, 9 aa, Homo Sapiens
YAQGYEGGF

SEQ ID NO: 407220 - protein, 9 aa, Homo Sapiens
EEERHIAEM

SEQ ID NO: 407221 - protein, 9 aa, Homo Sapiens
EEFQVLVRQ

SEQ ID NO: 407222 - protein, 9 aa, Homo Sapiens
SAMPRATWR

SEQ ID NO: 407223 - protein, 9 aa, Homo Sapiens
IQEDHTVIV

SEQ ID NO: 407224 - protein, 9 aa, Homo Sapiens
LLGPRPLPH

SEQ ID NO: 407225 - protein, 9 aa, Homo Sapiens
TKPCMAPEV

SEQ ID NO: 407226 - protein, 9 aa, Homo Sapiens
LSLQWNMMA

SEQ ID NO: 407227 - protein, 9 aa, Homo Sapiens
PPVGAGTGG

SEQ ID NO: 407228 - protein, 9 aa, Homo Sapiens
VIQVATYSD

SEQ ID NO: 407229 - protein, 9 aa, Homo Sapiens
PHQAPLTVR

SEQ ID NO: 407230 - protein, 9 aa, Homo Sapiens
DPPRKCVDS

SEQ ID NO: 407231 - protein, 9 aa, Homo Sapiens
GIRWLQPNA

SEQ ID NO: 407232 - protein, 9 aa, Homo Sapiens
LTPISAFSH

SEQ ID NO: 407233 - protein, 9 aa, Homo Sapiens
KPLCLILAD

SEQ ID NO: 407234 - protein, 9 aa, Homo Sapiens
DEIPILGPV

SEQ ID NO: 407235 - protein, 9 aa, Homo Sapiens
IIDQTNTTL

SEQ ID NO: 407236 - protein, 9 aa, Homo Sapiens
EEEDLETLI

SEQ ID NO: 407237 - protein, 9 aa, Homo Sapiens
PASLRARGN

SEQ ID NO: 407238 - protein, 9 aa, Homo Sapiens
SSRKIRRPL

SEQ ID NO: 407239 - protein, 9 aa, Homo Sapiens
RSGMGQRRM

SEQ ID NO: 407240 - protein, 9 aa, Homo Sapiens
NRYRLGDRV

SEQ ID NO: 407241 - protein, 9 aa, Homo Sapiens
TPPAPRLLP

SEQ ID NO: 407242 - protein, 9 aa, Homo Sapiens
LLILQLLAL

SEQ ID NO: 407243 - protein, 9 aa, Homo Sapiens
TFVAHTAPA

SEQ ID NO: 407244 - protein, 9 aa, Homo Sapiens
DSPAPADAP

SEQ ID NO: 407245 - protein, 9 aa, Homo Sapiens
PCPAPPLLV

SEQ ID NO: 407246 - protein, 9 aa, Homo Sapiens
GNTQKAMCM

SEQ ID NO: 407247 - protein, 9 aa, Homo Sapiens
PSMRTAMIP

SEQ ID NO: 407248 - protein, 9 aa, Homo Sapiens
DHGINQPII

SEQ ID NO: 407249 - protein, 9 aa, Homo Sapiens
PRRVRGVKQ

SEQ ID NO: 407250 - protein, 9 aa, Homo Sapiens
QPSPASACT

SEQ ID NO: 407251 - protein, 9 aa, Homo Sapiens
PPRTARGVT

SEQ ID NO: 407252 - protein, 9 aa, Homo Sapiens
NSRIGKTSC

SEQ ID NO: 407253 - protein, 9 aa, Homo Sapiens
EGQALISDL

SEQ ID NO: 407254 - protein, 9 aa, Homo Sapiens
YFFLIGLPL

SEQ ID NO: 407255 - protein, 9 aa, Homo Sapiens
PGVGPGPHA

SEQ ID NO: 407256 - protein, 9 aa, Homo Sapiens
RSLWVIVKE

SEQ ID NO: 407257 - protein, 9 aa, Homo Sapiens
TPLCTPGVD

SEQ ID NO: 407258 - protein, 9 aa, Homo Sapiens
ILCSCSWLS

SEQ ID NO: 407259 - protein, 9 aa, Homo Sapiens
IQKIEAYME

SEQ ID NO: 407260 - protein, 9 aa, Homo Sapiens
HIAEMGRPI

SEQ ID NO: 407261 - protein, 9 aa, Homo Sapiens
RWNFVYWAA

SEQ ID NO: 407262 - protein, 9 aa, Homo Sapiens
MRITVKKLK

SEQ ID NO: 407263 - protein, 9 aa, Homo Sapiens
AIHAERVTI

SEQ ID NO: 407264 - protein, 9 aa, Homo Sapiens
FLKKLKGKL

SEQ ID NO: 407265 - protein, 9 aa, Homo Sapiens
PSSLLSPCN

SEQ ID NO: 407266 - protein, 9 aa, Homo Sapiens
ISVLHILGT

SEQ ID NO: 407267 - protein, 9 aa, Homo Sapiens
DYWYLLAPR

SEQ ID NO: 407268 - protein, 9 aa, Homo Sapiens
FDKFSCHCV

SEQ ID NO: 407269 - protein, 9 aa, Homo Sapiens
LMGYRKRGS

SEQ ID NO: 407270 - protein, 9 aa, Homo Sapiens
NCPALRILL

SEQ ID NO: 407271 - protein, 9 aa, Homo Sapiens
NCRYLHDLS

SEQ ID NO: 407272 - protein, 9 aa, Homo Sapiens
WEAALRPST

SEQ ID NO: 407273 - protein, 9 aa, Homo Sapiens
VVRESDAGH

SEQ ID NO: 407274 - protein, 9 aa, Homo Sapiens
SQYSTGKTS

SEQ ID NO: 407275 - protein, 9 aa, Homo Sapiens
HIGCTQTMV

SEQ ID NO: 407276 - protein, 9 aa, Homo Sapiens
PGRSLPAGP

SEQ ID NO: 407277 - protein, 9 aa, Homo Sapiens
HQVIVRPVQ

SEQ ID NO: 407278 - protein, 9 aa, Homo Sapiens
STLLLVSYQ

SEQ ID NO: 407279 - protein, 9 aa, Homo Sapiens
LGIQWLQRA

SEQ ID NO: 407280 - protein, 9 aa, Homo Sapiens
WFSGETLSF

SEQ ID NO: 407281 - protein, 9 aa, Homo Sapiens
GQAQDTSGH

SEQ ID NO: 407282 - protein, 9 aa, Homo Sapiens
IPSPKTLTS

SEQ ID NO: 407283 - protein, 9 aa, Homo Sapiens
LLSATKLCQ

SEQ ID NO: 407284 - protein, 9 aa, Homo Sapiens
AVPIPGRTG

SEQ ID NO: 407285 - protein, 9 aa, Homo Sapiens
ATVINYYTR

SEQ ID NO: 407286 - protein, 9 aa, Homo Sapiens
SHGLKSLSR

SEQ ID NO: 407287 - protein, 9 aa, Homo Sapiens
ISNFLRKFP

SEQ ID NO: 407288 - protein, 9 aa, Homo Sapiens
RDDVVLACQ

SEQ ID NO: 407289 - protein, 9 aa, Homo Sapiens
CNIYYLCAP

SEQ ID NO: 407290 - protein, 9 aa, Homo Sapiens
VPRHSSVLA

SEQ ID NO: 407291 - protein, 9 aa, Homo Sapiens
EDHTVIVSP

SEQ ID NO: 407292 - protein, 9 aa, Homo Sapiens
GTSRHISME

SEQ ID NO: 407293 - protein, 9 aa, Homo Sapiens
APWGLRRGR

SEQ ID NO: 407294 - protein, 9 aa, Homo Sapiens
CCSACHSDE

SEQ ID NO: 407295 - protein, 9 aa, Homo Sapiens
AIATITTLL

SEQ ID NO: 407296 - protein, 9 aa, Homo Sapiens
AFLGDLLAV

SEQ ID NO: 407297 - protein, 9 aa, Homo Sapiens
LLDTAGQER

SEQ ID NO: 407298 - protein, 9 aa, Homo Sapiens
WPKSTPDAC

SEQ ID NO: 407299 - protein, 9 aa, Homo Sapiens
FNSMRKSMS

SEQ ID NO: 407300 - protein, 9 aa, Homo Sapiens
GCQYLRCGV

SEQ ID NO: 407301 - protein, 9 aa, Homo Sapiens
TSTRSLPSI

SEQ ID NO: 407302 - protein, 9 aa, Homo Sapiens
IAGATQFTQ

SEQ ID NO: 407303 - protein, 9 aa, Homo Sapiens
QGLVMEAPQ

SEQ ID NO: 407304 - protein, 9 aa, Homo Sapiens
WEKTRWLNS

SEQ ID NO: 407305 - protein, 9 aa, Homo Sapiens
KECSINHFQ

SEQ ID NO: 407306 - protein, 9 aa, Homo Sapiens
ISCNPVQGV

SEQ ID NO: 407307 - protein, 9 aa, Homo Sapiens
SGRRLLPLV

SEQ ID NO: 407308 - protein, 9 aa, Homo Sapiens
LRAARDNKV

SEQ ID NO: 407309 - protein, 9 aa, Homo Sapiens
SLNFLIGHL

SEQ ID NO: 407310 - protein, 9 aa, Homo Sapiens
GWTYGGSGG

SEQ ID NO: 407311 - protein, 9 aa, Homo Sapiens
YQIAYHLAS

SEQ ID NO: 407312 - protein, 9 aa, Homo Sapiens
RAATRRPSR

SEQ ID NO: 407313 - protein, 9 aa, Homo Sapiens
STAFEEGQA

SEQ ID NO: 407314 - protein, 9 aa, Homo Sapiens
EKNQLTRDW

SEQ ID NO: 407315 - protein, 9 aa, Homo Sapiens
HYDGAVQVM

SEQ ID NO: 407316 - protein, 9 aa, Homo Sapiens
LLILLQFFF

SEQ ID NO: 407317 - protein, 9 aa, Homo Sapiens
TMSDLTRND

SEQ ID NO: 407318 - protein, 9 aa, Homo Sapiens
VRLCVPQNH

SEQ ID NO: 407319 - protein, 9 aa, Homo Sapiens
TGSRQSRSP

SEQ ID NO: 407320 - protein, 9 aa, Homo Sapiens
NRKCPPLHP

SEQ ID NO: 407321 - protein, 9 aa, Homo Sapiens
APTITMVRV

SEQ ID NO: 407322 - protein, 9 aa, Homo Sapiens
LGPHGTHSP

SEQ ID NO: 407323 - protein, 9 aa, Homo Sapiens
CPLPGAGDQ

SEQ ID NO: 407324 - protein, 9 aa, Homo Sapiens
GCSVQHLRN

SEQ ID NO: 407325 - protein, 9 aa, Homo Sapiens
HATVCGGQV

SEQ ID NO: 407326 - protein, 9 aa, Homo Sapiens
DSNYQMEMG

SEQ ID NO: 407327 - protein, 9 aa, Homo Sapiens
VWLHLAKDI

SEQ ID NO: 407328 - protein, 9 aa, Homo Sapiens
DPLNLALHR

SEQ ID NO: 407329 - protein, 9 aa, Homo Sapiens
SFFNYRKKI

SEQ ID NO: 407330 - protein, 9 aa, Homo Sapiens
ELHRELPPD

SEQ ID NO: 407331 - protein, 9 aa, Homo Sapiens
VQKVTSSLG

SEQ ID NO: 407332 - protein, 9 aa, Homo Sapiens
WGVKGACGL

SEQ ID NO: 407333 - protein, 9 aa, Homo Sapiens
PKEFLLVSS

SEQ ID NO: 407334 - protein, 9 aa, Homo Sapiens
PSPQTPTSQ

SEQ ID NO: 407335 - protein, 9 aa, Homo Sapiens
QPPPGPSWT

SEQ ID NO: 407336 - protein, 9 aa, Homo Sapiens
NTHISSAGC

SEQ ID NO: 407337 - protein, 9 aa, Homo Sapiens
FDENREKQA

SEQ ID NO: 407338 - protein, 9 aa, Homo Sapiens
VCSRASSSC

SEQ ID NO: 407339 - protein, 9 aa, Homo Sapiens
AATVPGHKS

SEQ ID NO: 407340 - protein, 9 aa, Homo Sapiens
VEVAAGPPM

SEQ ID NO: 407341 - protein, 9 aa, Homo Sapiens
SNFHQSFHQ

SEQ ID NO: 407342 - protein, 9 aa, Homo Sapiens
GAPARMGHR

SEQ ID NO: 407343 - protein, 9 aa, Homo Sapiens
ADGVAGPKC

SEQ ID NO: 407344 - protein, 9 aa, Homo Sapiens
MPGMNMKMK

SEQ ID NO: 407345 - protein, 9 aa, Homo Sapiens
SPTHGGSRP

SEQ ID NO: 407346 - protein, 9 aa, Homo Sapiens
PPKIHYEAP

SEQ ID NO: 407347 - protein, 9 aa, Homo Sapiens
HMASKMVDL

SEQ ID NO: 407348 - protein, 9 aa, Homo Sapiens
LEELQLCHN

SEQ ID NO: 407349 - protein, 9 aa, Homo Sapiens
THATYSNTF

SEQ ID NO: 407350 - protein, 9 aa, Homo Sapiens
SRASTRSRV

SEQ ID NO: 407351 - protein, 9 aa, Homo Sapiens
MLADCNLLP

SEQ ID NO: 407352 - protein, 9 aa, Homo Sapiens
YRQCCSGQE

SEQ ID NO: 407353 - protein, 9 aa, Homo Sapiens
GASAAGGDQ

SEQ ID NO: 407354 - protein, 9 aa, Homo Sapiens
GQLRGRARA

SEQ ID NO: 407355 - protein, 9 aa, Homo Sapiens
SVNVTDYCQ

SEQ ID NO: 407356 - protein, 9 aa, Homo Sapiens
QTAPPAWTC

SEQ ID NO: 407357 - protein, 9 aa, Homo Sapiens
KKIATMMAK

SEQ ID NO: 407358 - protein, 9 aa, Homo Sapiens
PPSPCPAPP

SEQ ID NO: 407359 - protein, 9 aa, Homo Sapiens
VVNVLFRQR

SEQ ID NO: 407360 - protein, 9 aa, Homo Sapiens
RSPTTAPWV

SEQ ID NO: 407361 - protein, 9 aa, Homo Sapiens
VKWTKEELI

SEQ ID NO: 407362 - protein, 9 aa, Homo Sapiens
RKNVLFMTM

SEQ ID NO: 407363 - protein, 9 aa, Homo Sapiens
CLCLEEPRK

SEQ ID NO: 407364 - protein, 9 aa, Homo Sapiens
DSKLLKSNL

SEQ ID NO: 407365 - protein, 9 aa, Homo Sapiens
GGDLLLIGG

SEQ ID NO: 407366 - protein, 9 aa, Homo Sapiens
PIEQEIRLA

SEQ ID NO: 407367 - protein, 9 aa, Homo Sapiens
FKDFQQRIL

SEQ ID NO: 407368 - protein, 9 aa, Homo Sapiens
GACTANMPA

SEQ ID NO: 407369 - protein, 9 aa, Homo Sapiens
GDYKGTMPV

SEQ ID NO: 407370 - protein, 9 aa, Homo Sapiens
WSFVSVGPR

SEQ ID NO: 407371 - protein, 9 aa, Homo Sapiens
ITLSEYFCD

SEQ ID NO: 407372 - protein, 9 aa, Homo Sapiens
LLEHYEQME

SEQ ID NO: 407373 - protein, 9 aa, Homo Sapiens
KIRRPLRGR

SEQ ID NO: 407374 - protein, 9 aa, Homo Sapiens
RIWNCTKEN

SEQ ID NO: 407375 - protein, 9 aa, Homo Sapiens
PRLWLLWRQ

SEQ ID NO: 407376 - protein, 9 aa, Homo Sapiens
LMDFFRNHN

SEQ ID NO: 407377 - protein, 9 aa, Homo Sapiens
SLSQCNLAA

SEQ ID NO: 407378 - protein, 9 aa, Homo Sapiens
GFVSTDFHS

SEQ ID NO: 407379 - protein, 9 aa, Homo Sapiens
GGHYPCSVL

SEQ ID NO: 407380 - protein, 9 aa, Homo Sapiens
YIYWVQWAS

SEQ ID NO: 407381 - protein, 9 aa, Homo Sapiens
ERAKAGYSP

SEQ ID NO: 407382 - protein, 9 aa, Homo Sapiens
NMPASLRAR

SEQ ID NO: 407383 - protein, 9 aa, Homo Sapiens
GDLLTGAAY

SEQ ID NO: 407384 - protein, 9 aa, Homo Sapiens
HPQGPCPPP

SEQ ID NO: 407385 - protein, 9 aa, Homo Sapiens
PEPPRMLGL

SEQ ID NO: 407386 - protein, 9 aa, Homo Sapiens
MEIISETDD

SEQ ID NO: 407387 - protein, 9 aa, Homo Sapiens
KKEEAENQR

SEQ ID NO: 407388 - protein, 9 aa, Homo Sapiens
TTQSARHPA

SEQ ID NO: 407389 - protein, 9 aa, Homo Sapiens
PKSKPTTGH

SEQ ID NO: 407390 - protein, 9 aa, Homo Sapiens
VTLLNCLEG

SEQ ID NO: 407391 - protein, 9 aa, Homo Sapiens
QWAPHSAGL

SEQ ID NO: 407392 - protein, 9 aa, Homo Sapiens
AEHAQQNGL

SEQ ID NO: 407393 - protein, 9 aa, Homo Sapiens
GNNMQLARS

SEQ ID NO: 407394 - protein, 9 aa, Homo Sapiens
WSATAQRRK

SEQ ID NO: 407395 - protein, 9 aa, Homo Sapiens
QNRKWKCTL

SEQ ID NO: 407396 - protein, 9 aa, Homo Sapiens
LWEGNGFVA

SEQ ID NO: 407397 - protein, 9 aa, Homo Sapiens
PTDLAFMMR

SEQ ID NO: 407398 - protein, 9 aa, Homo Sapiens
PFSLQLLDT

SEQ ID NO: 407399 - protein, 9 aa, Homo Sapiens
ITKIYYCSQ

SEQ ID NO: 407400 - protein, 9 aa, Homo Sapiens
SAPQVLAYP

SEQ ID NO: 407401 - protein, 9 aa, Homo Sapiens
IRRPLRGRL

SEQ ID NO: 407402 - protein, 9 aa, Homo Sapiens
NMLQESMAP

SEQ ID NO: 407403 - protein, 9 aa, Homo Sapiens
WTRSQKGKA

SEQ ID NO: 407404 - protein, 9 aa, Homo Sapiens
AVAPVHAAR

SEQ ID NO: 407405 - protein, 9 aa, Homo Sapiens
ARIQEDHTV

SEQ ID NO: 407406 - protein, 9 aa, Homo Sapiens
RMSQQYGDM

SEQ ID NO: 407407 - protein, 9 aa, Homo Sapiens
KKGFCHSAL

SEQ ID NO: 407408 - protein, 9 aa, Homo Sapiens
IVGNLVSYV

SEQ ID NO: 407409 - protein, 9 aa, Homo Sapiens
LGSSCAPPS

SEQ ID NO: 407410 - protein, 9 aa, Homo Sapiens
LGHRVVTCD

SEQ ID NO: 407411 - protein, 9 aa, Homo Sapiens
PSPPSPSRR

SEQ ID NO: 407412 - protein, 9 aa, Homo Sapiens
ILLFLVSRP

SEQ ID NO: 407413 - protein, 9 aa, Homo Sapiens
QIFFRVMRG

SEQ ID NO: 407414 - protein, 9 aa, Homo Sapiens
PKRKLYSAM

SEQ ID NO: 407415 - protein, 9 aa, Homo Sapiens
VKFTSGNTV

SEQ ID NO: 407416 - protein, 9 aa, Homo Sapiens
DGLYHSRFE

SEQ ID NO: 407417 - protein, 9 aa, Homo Sapiens
AWRLFCWWS

SEQ ID NO: 407418 - protein, 9 aa, Homo Sapiens
WLEQMLHSC

SEQ ID NO: 407419 - protein, 9 aa, Homo Sapiens
IPAAAAPPP

SEQ ID NO: 407420 - protein, 9 aa, Homo Sapiens
RRNAEGESV

SEQ ID NO: 407421 - protein, 9 aa, Homo Sapiens
LKDDFEVFF

SEQ ID NO: 407422 - protein, 9 aa, Homo Sapiens
GSRASTHWP

SEQ ID NO: 407423 - protein, 9 aa, Homo Sapiens
WIISDGSVD

SEQ ID NO: 407424 - protein, 9 aa, Homo Sapiens
MTLNELFTR

SEQ ID NO: 407425 - protein, 9 aa, Homo Sapiens
FPQHCAGRR

SEQ ID NO: 407426 - protein, 9 aa, Homo Sapiens
GQRWTWRSW

SEQ ID NO: 407427 - protein, 9 aa, Homo Sapiens
YMSVKCVDV

SEQ ID NO: 407428 - protein, 9 aa, Homo Sapiens
RSLQPPSRQ

SEQ ID NO: 407429 - protein, 9 aa, Homo Sapiens
CWRCWSSSR

SEQ ID NO: 407430 - protein, 9 aa, Homo Sapiens
SQFLRKKAQ

SEQ ID NO: 407431 - protein, 9 aa, Homo Sapiens
SPASHVGGA

SEQ ID NO: 407432 - protein, 9 aa, Homo Sapiens
TSVFGFSFL

SEQ ID NO: 407433 - protein, 9 aa, Homo Sapiens
WNMMASIQS

SEQ ID NO: 407434 - protein, 9 aa, Homo Sapiens
VQFVLGRLM

SEQ ID NO: 407435 - protein, 9 aa, Homo Sapiens
LYGKKAETM

SEQ ID NO: 407436 - protein, 9 aa, Homo Sapiens
GDLLKLIMM

SEQ ID NO: 407437 - protein, 9 aa, Homo Sapiens
CNAAIHKKY

SEQ ID NO: 407438 - protein, 9 aa, Homo Sapiens
YQHVHSATL

SEQ ID NO: 407439 - protein, 9 aa, Homo Sapiens
GPHAVSGCG

SEQ ID NO: 407440 - protein, 9 aa, Homo Sapiens
PGVGSVLGS

SEQ ID NO: 407441 - protein, 9 aa, Homo Sapiens
HVFKMTKRE

SEQ ID NO: 407442 - protein, 9 aa, Homo Sapiens
LASGDRRGN

SEQ ID NO: 407443 - protein, 9 aa, Homo Sapiens
ELPQVWTGP

SEQ ID NO: 407444 - protein, 9 aa, Homo Sapiens
WLSSSGSRR

SEQ ID NO: 407445 - protein, 9 aa, Homo Sapiens
SATMGCLLL

SEQ ID NO: 407446 - protein, 9 aa, Homo Sapiens
YGAAEEGHG

SEQ ID NO: 407447 - protein, 9 aa, Homo Sapiens
AQHTGVGSP

SEQ ID NO: 407448 - protein, 9 aa, Homo Sapiens
QATSPGAAH

SEQ ID NO: 407449 - protein, 9 aa, Homo Sapiens
DQCLIEELR

SEQ ID NO: 407450 - protein, 9 aa, Homo Sapiens
DNDDGGGSF

SEQ ID NO: 407451 - protein, 9 aa, Homo Sapiens
PSYYLPPLP

SEQ ID NO: 407452 - protein, 9 aa, Homo Sapiens
KLLWYYVVF

SEQ ID NO: 407453 - protein, 9 aa, Homo Sapiens
DIPWMLIDF

SEQ ID NO: 407454 - protein, 9 aa, Homo Sapiens
LKGEWGVKG

SEQ ID NO: 407455 - protein, 9 aa, Homo Sapiens
YVGISHNLD

SEQ ID NO: 407456 - protein, 9 aa, Homo Sapiens
VLLDIIQKY

SEQ ID NO: 407457 - protein, 9 aa, Homo Sapiens
PTNQLCHCA

SEQ ID NO: 407458 - protein, 9 aa, Homo Sapiens
VRLHEGVIN

SEQ ID NO: 407459 - protein, 9 aa, Homo Sapiens
SSLRIALHD

SEQ ID NO: 407460 - protein, 9 aa, Homo Sapiens
VVSPFMEEE

SEQ ID NO: 407461 - protein, 9 aa, Homo Sapiens
PLPLSQHPL

SEQ ID NO: 407462 - protein, 9 aa, Homo Sapiens
HSGEMYRFQ

SEQ ID NO: 407463 - protein, 9 aa, Homo Sapiens
PPQQTPLCK

SEQ ID NO: 407464 - protein, 9 aa, Homo Sapiens
DKAEVNAGI

SEQ ID NO: 407465 - protein, 9 aa, Homo Sapiens
CMNQLSPVN

SEQ ID NO: 407466 - protein, 9 aa, Homo Sapiens
LCSLCLQNR

SEQ ID NO: 407467 - protein, 9 aa, Homo Sapiens
MLPTLSTLQ

SEQ ID NO: 407468 - protein, 9 aa, Homo Sapiens
GGSLVGVPP

SEQ ID NO: 407469 - protein, 9 aa, Homo Sapiens
VIALTNIMG

SEQ ID NO: 407470 - protein, 9 aa, Homo Sapiens
YATINTSCH

SEQ ID NO: 407471 - protein, 9 aa, Homo Sapiens
VREQLWVNS

SEQ ID NO: 407472 - protein, 9 aa, Homo Sapiens
IIIANNLWG

SEQ ID NO: 407473 - protein, 9 aa, Homo Sapiens
QGVIWTCQN

SEQ ID NO: 407474 - protein, 9 aa, Homo Sapiens
QPQVPPACQ

SEQ ID NO: 407475 - protein, 9 aa, Homo Sapiens
LTSLVMLML

SEQ ID NO: 407476 - protein, 9 aa, Homo Sapiens
NPAHAFGPA

SEQ ID NO: 407477 - protein, 9 aa, Homo Sapiens
IVGTKPLYM

SEQ ID NO: 407478 - protein, 9 aa, Homo Sapiens
WAGFSPDSS

SEQ ID NO: 407479 - protein, 9 aa, Homo Sapiens
RRWHRSDRM

SEQ ID NO: 407480 - protein, 9 aa, Homo Sapiens
CLRLCPHIL

SEQ ID NO: 407481 - protein, 9 aa, Homo Sapiens
LLPVLQPPP

SEQ ID NO: 407482 - protein, 9 aa, Homo Sapiens
CWTASSWPM

SEQ ID NO: 407483 - protein, 9 aa, Homo Sapiens
GAVRPDAVD

SEQ ID NO: 407484 - protein, 9 aa, Homo Sapiens
RTNPVLNNL

SEQ ID NO: 407485 - protein, 9 aa, Homo Sapiens
ELAEGSECP

SEQ ID NO: 407486 - protein, 9 aa, Homo Sapiens
PLNPDWCLK

SEQ ID NO: 407487 - protein, 9 aa, Homo Sapiens
GSEIPPPAP

SEQ ID NO: 407488 - protein, 9 aa, Homo Sapiens
GGNHTHSRD

SEQ ID NO: 407489 - protein, 9 aa, Homo Sapiens
ALHLVKPRV

SEQ ID NO: 407490 - protein, 9 aa, Homo Sapiens
RVLNENGPG

SEQ ID NO: 407491 - protein, 9 aa, Homo Sapiens
MLDVHADRN

SEQ ID NO: 407492 - protein, 9 aa, Homo Sapiens
GWHWGAAPM

SEQ ID NO: 407493 - protein, 9 aa, Homo Sapiens
VTKIDHLDL

SEQ ID NO: 407494 - protein, 9 aa, Homo Sapiens
LLESAVAAH

SEQ ID NO: 407495 - protein, 9 aa, Homo Sapiens
IRNDFCVIY

SEQ ID NO: 407496 - protein, 9 aa, Homo Sapiens
MRSSTSPAA

SEQ ID NO: 407497 - protein, 9 aa, Homo Sapiens
SDQEKHSSQ

SEQ ID NO: 407498 - protein, 9 aa, Homo Sapiens
NHSKCITEC

SEQ ID NO: 407499 - protein, 9 aa, Homo Sapiens
AGEVRVYLH

SEQ ID NO: 407500 - protein, 9 aa, Homo Sapiens
ATVCGGQVR

SEQ ID NO: 407501 - protein, 9 aa, Homo Sapiens
AACGGRERR

SEQ ID NO: 407502 - protein, 9 aa, Homo Sapiens
VGPRPSPLP

SEQ ID NO: 407503 - protein, 9 aa, Homo Sapiens
STPSMRTAM

SEQ ID NO: 407504 - protein, 9 aa, Homo Sapiens
TCLEMNTTK

SEQ ID NO: 407505 - protein, 9 aa, Homo Sapiens
EEIQYEIFR

SEQ ID NO: 407506 - protein, 9 aa, Homo Sapiens
AVMDKRRNL

SEQ ID NO: 407507 - protein, 9 aa, Homo Sapiens
FQNESCRLY

SEQ ID NO: 407508 - protein, 9 aa, Homo Sapiens
SSLTLHMKI

SEQ ID NO: 407509 - protein, 9 aa, Homo Sapiens
VGHTPMHFT

SEQ ID NO: 407510 - protein, 9 aa, Homo Sapiens
QEGALDVEV

SEQ ID NO: 407511 - protein, 9 aa, Homo Sapiens
TSSLPGGTD

SEQ ID NO: 407512 - protein, 9 aa, Homo Sapiens
FDAHGRIEE

SEQ ID NO: 407513 - protein, 9 aa, Homo Sapiens
ATDPVPAVL

SEQ ID NO: 407514 - protein, 9 aa, Homo Sapiens
QASAPPAPP

SEQ ID NO: 407515 - protein, 9 aa, Homo Sapiens
LEKVSKKDS

SEQ ID NO: 407516 - protein, 9 aa, Homo Sapiens
RRESRFWLA

SEQ ID NO: 407517 - protein, 9 aa, Homo Sapiens
IIRIGTSGE

SEQ ID NO: 407518 - protein, 9 aa, Homo Sapiens
FSVGLHMGF

SEQ ID NO: 407519 - protein, 9 aa, Homo Sapiens
MNHILLKEM

SEQ ID NO: 407520 - protein, 9 aa, Homo Sapiens
TGRTPTTRL

SEQ ID NO: 407521 - protein, 9 aa, Homo Sapiens
CKELQENQD

SEQ ID NO: 407522 - protein, 9 aa, Homo Sapiens
EDEKDEEIV

SEQ ID NO: 407523 - protein, 9 aa, Homo Sapiens
GDELMLADC

SEQ ID NO: 407524 - protein, 9 aa, Homo Sapiens
FLHIQRSGP

SEQ ID NO: 407525 - protein, 9 aa, Homo Sapiens
ELHPLLIRI

SEQ ID NO: 407526 - protein, 9 aa, Homo Sapiens
VPVKNLIVP

SEQ ID NO: 407527 - protein, 9 aa, Homo Sapiens
VWVQDGRVD

SEQ ID NO: 407528 - protein, 9 aa, Homo Sapiens
LPGWGGQGA

SEQ ID NO: 407529 - protein, 9 aa, Homo Sapiens
ELYAVLPNK

SEQ ID NO: 407530 - protein, 9 aa, Homo Sapiens
SGSGSAAPR

SEQ ID NO: 407531 - protein, 9 aa, Homo Sapiens
HQAVPRGQG

SEQ ID NO: 407532 - protein, 9 aa, Homo Sapiens
EDDEEDEDE

SEQ ID NO: 407533 - protein, 9 aa, Homo Sapiens
SSNLGVDDG

SEQ ID NO: 407534 - protein, 9 aa, Homo Sapiens
CVGTWINDI

SEQ ID NO: 407535 - protein, 9 aa, Homo Sapiens
AQPPGPAPW

SEQ ID NO: 407536 - protein, 9 aa, Homo Sapiens
PPPAGCGTP

SEQ ID NO: 407537 - protein, 9 aa, Homo Sapiens
EDGVSAEHA

SEQ ID NO: 407538 - protein, 9 aa, Homo Sapiens
ATFAATGRF

SEQ ID NO: 407539 - protein, 9 aa, Homo Sapiens
CLVFAPAFL

SEQ ID NO: 407540 - protein, 9 aa, Homo Sapiens
RSHRDASPT

SEQ ID NO: 407541 - protein, 9 aa, Homo Sapiens
LHLEPHHVI

SEQ ID NO: 407542 - protein, 9 aa, Homo Sapiens
CSWLSLFYL

SEQ ID NO: 407543 - protein, 9 aa, Homo Sapiens
RSERKWSWM

SEQ ID NO: 407544 - protein, 9 aa, Homo Sapiens
SASLVSEAV

SEQ ID NO: 407545 - protein, 9 aa, Homo Sapiens
GVDVGPIGA

SEQ ID NO: 407546 - protein, 9 aa, Homo Sapiens
YWSESVNKV

SEQ ID NO: 407547 - protein, 9 aa, Homo Sapiens
LGVTKIDHL

SEQ ID NO: 407548 - protein, 9 aa, Homo Sapiens
TETLRDMVD

SEQ ID NO: 407549 - protein, 9 aa, Homo Sapiens
LGQQVLEVE

SEQ ID NO: 407550 - protein, 9 aa, Homo Sapiens
SPRRSPALR

SEQ ID NO: 407551 - protein, 9 aa, Homo Sapiens
YKCKQRGKA

SEQ ID NO: 407552 - protein, 9 aa, Homo Sapiens
QEAALRPMP

SEQ ID NO: 407553 - protein, 9 aa, Homo Sapiens
PSPASACTM

SEQ ID NO: 407554 - protein, 9 aa, Homo Sapiens
DFCPKTGRD

SEQ ID NO: 407555 - protein, 9 aa, Homo Sapiens
WTWGRAPRT

SEQ ID NO: 407556 - protein, 9 aa, Homo Sapiens
PPACTWAER

SEQ ID NO: 407557 - protein, 9 aa, Homo Sapiens
TIIATMLVL

SEQ ID NO: 407558 - protein, 9 aa, Homo Sapiens
QGALQGVFR

SEQ ID NO: 407559 - protein, 9 aa, Homo Sapiens
GRSQGGGRG

SEQ ID NO: 407560 - protein, 9 aa, Homo Sapiens
RRCIPLANL

SEQ ID NO: 407561 - protein, 9 aa, Homo Sapiens
KRQQQEVEE

SEQ ID NO: 407562 - protein, 9 aa, Homo Sapiens
GTPQPVVDS

SEQ ID NO: 407563 - protein, 9 aa, Homo Sapiens
ETHARHQVL

SEQ ID NO: 407564 - protein, 9 aa, Homo Sapiens
RGKTPAHRA

SEQ ID NO: 407565 - protein, 9 aa, Homo Sapiens
LEELRLEND

SEQ ID NO: 407566 - protein, 9 aa, Homo Sapiens
HTIKLTFED

SEQ ID NO: 407567 - protein, 9 aa, Homo Sapiens
FVPRWRTRR

SEQ ID NO: 407568 - protein, 9 aa, Homo Sapiens
AKRVCKDYK

SEQ ID NO: 407569 - protein, 9 aa, Homo Sapiens
TTRTAVDNF

SEQ ID NO: 407570 - protein, 9 aa, Homo Sapiens
PPYTPRMTA

SEQ ID NO: 407571 - protein, 9 aa, Homo Sapiens
RRAAQQARS

SEQ ID NO: 407572 - protein, 9 aa, Homo Sapiens
RWVSWSATA

SEQ ID NO: 407573 - protein, 9 aa, Homo Sapiens
HSLHLLLIC

SEQ ID NO: 407574 - protein, 9 aa, Homo Sapiens
IRSGMGQRR

SEQ ID NO: 407575 - protein, 9 aa, Homo Sapiens
ALQSVSVCQ

SEQ ID NO: 407576 - protein, 9 aa, Homo Sapiens
HIDYVLQEK

SEQ ID NO: 407577 - protein, 9 aa, Homo Sapiens
AHRDDVVLA

SEQ ID NO: 407578 - protein, 9 aa, Homo Sapiens
MPKQLVHIQ

SEQ ID NO: 407579 - protein, 9 aa, Homo Sapiens
PQHCAGRRR

SEQ ID NO: 407580 - protein, 9 aa, Homo Sapiens
KKSQRHPLG

SEQ ID NO: 407581 - protein, 9 aa, Homo Sapiens
YKLVVIGSG

SEQ ID NO: 407582 - protein, 9 aa, Homo Sapiens
AREEPSKEE

SEQ ID NO: 407583 - protein, 9 aa, Homo Sapiens
LAPENRCQF

SEQ ID NO: 407584 - protein, 9 aa, Homo Sapiens
NGESLEMDL

SEQ ID NO: 407585 - protein, 9 aa, Homo Sapiens
SSPTDLAFM

SEQ ID NO: 407586 - protein, 9 aa, Homo Sapiens
HGPVQGHQS

SEQ ID NO: 407587 - protein, 9 aa, Homo Sapiens
NPCSASQQW

SEQ ID NO: 407588 - protein, 9 aa, Homo Sapiens
SPAPITLPW

SEQ ID NO: 407589 - protein, 9 aa, Homo Sapiens
EMEKPAKWT

SEQ ID NO: 407590 - protein, 9 aa, Homo Sapiens
VPILQLVVL

SEQ ID NO: 407591 - protein, 9 aa, Homo Sapiens
RSTGAGPAT

SEQ ID NO: 407592 - protein, 9 aa, Homo Sapiens
RASSGCTRC

SEQ ID NO: 407593 - protein, 9 aa, Homo Sapiens
NRGYGRSQG

SEQ ID NO: 407594 - protein, 9 aa, Homo Sapiens
PVAIRDGEL

SEQ ID NO: 407595 - protein, 9 aa, Homo Sapiens
LMVVLATWT

SEQ ID NO: 407596 - protein, 9 aa, Homo Sapiens
GDHITSVNE

SEQ ID NO: 407597 - protein, 9 aa, Homo Sapiens
VISTVERAA

SEQ ID NO: 407598 - protein, 9 aa, Homo Sapiens
SSLHRAARQ

SEQ ID NO: 407599 - protein, 9 aa, Homo Sapiens
GLLSLTFHP

SEQ ID NO: 407600 - protein, 9 aa, Homo Sapiens
LQMWMDMFP

SEQ ID NO: 407601 - protein, 9 aa, Homo Sapiens
VTKIETSLP

SEQ ID NO: 407602 - protein, 9 aa, Homo Sapiens
PTATRKVPW

SEQ ID NO: 407603 - protein, 9 aa, Homo Sapiens
AVPQEMKSN

SEQ ID NO: 407604 - protein, 9 aa, Homo Sapiens
MSCSLLTQP

SEQ ID NO: 407605 - protein, 9 aa, Homo Sapiens
RYCHPGCYT

SEQ ID NO: 407606 - protein, 9 aa, Homo Sapiens
QLVEITKVL

SEQ ID NO: 407607 - protein, 9 aa, Homo Sapiens
GRERRDRRP

SEQ ID NO: 407608 - protein, 9 aa, Homo Sapiens
RLPQPSGTG

SEQ ID NO: 407609 - protein, 9 aa, Homo Sapiens
PGHPGVGPG

SEQ ID NO: 407610 - protein, 9 aa, Homo Sapiens
ARIGKMKWR

SEQ ID NO: 407611 - protein, 9 aa, Homo Sapiens
DHLINNDHK

SEQ ID NO: 407612 - protein, 9 aa, Homo Sapiens
KCPPLHPET

SEQ ID NO: 407613 - protein, 9 aa, Homo Sapiens
FSSKHALMV

SEQ ID NO: 407614 - protein, 9 aa, Homo Sapiens
ANGAGWPCP

SEQ ID NO: 407615 - protein, 9 aa, Homo Sapiens
DGHAAGGPA

SEQ ID NO: 407616 - protein, 9 aa, Homo Sapiens
QAFSCLRLS

SEQ ID NO: 407617 - protein, 9 aa, Homo Sapiens
LTINSLAQL

SEQ ID NO: 407618 - protein, 9 aa, Homo Sapiens
ESPPAPSMP

SEQ ID NO: 407619 - protein, 9 aa, Homo Sapiens
TPSAAWSTC

SEQ ID NO: 407620 - protein, 9 aa, Homo Sapiens
LWSQGKKPS

SEQ ID NO: 407621 - protein, 9 aa, Homo Sapiens
GDREDDETE

SEQ ID NO: 407622 - protein, 9 aa, Homo Sapiens
MMILTNFLK

SEQ ID NO: 407623 - protein, 9 aa, Homo Sapiens
MYGQSYRVT

SEQ ID NO: 407624 - protein, 9 aa, Homo Sapiens
PLQASSWSR

SEQ ID NO: 407625 - protein, 9 aa, Homo Sapiens
AALGAREGL

SEQ ID NO: 407626 - protein, 9 aa, Homo Sapiens
INLAIVHRF

SEQ ID NO: 407627 - protein, 9 aa, Homo Sapiens
SQPAVPWQK

SEQ ID NO: 407628 - protein, 9 aa, Homo Sapiens
DCPLSRLHL

SEQ ID NO: 407629 - protein, 9 aa, Homo Sapiens
RSPALRARG

SEQ ID NO: 407630 - protein, 9 aa, Homo Sapiens
GRLQHHLHL

SEQ ID NO: 407631 - protein, 9 aa, Homo Sapiens
TTEDLAEVT

SEQ ID NO: 407632 - protein, 9 aa, Homo Sapiens
LPGPCASLL

SEQ ID NO: 407633 - protein, 9 aa, Homo Sapiens
PVATLSPGE

SEQ ID NO: 407634 - protein, 9 aa, Homo Sapiens
HRDRCERSR

SEQ ID NO: 407635 - protein, 9 aa, Homo Sapiens
QSTCARRKV

SEQ ID NO: 407636 - protein, 9 aa, Homo Sapiens
PAVPWQKEE

SEQ ID NO: 407637 - protein, 9 aa, Homo Sapiens
LSRVTFIIT

SEQ ID NO: 407638 - protein, 9 aa, Homo Sapiens
RTISPKKPT

SEQ ID NO: 407639 - protein, 9 aa, Homo Sapiens
AHIAGFLLE

SEQ ID NO: 407640 - protein, 9 aa, Homo Sapiens
GQRLELTQR

SEQ ID NO: 407641 - protein, 9 aa, Homo Sapiens
PERMKAGDL

SEQ ID NO: 407642 - protein, 9 aa, Homo Sapiens
TVRHGLASC

SEQ ID NO: 407643 - protein, 9 aa, Homo Sapiens
LTLPISIQY

SEQ ID NO: 407644 - protein, 9 aa, Homo Sapiens
WQLPGPFLH

SEQ ID NO: 407645 - protein, 9 aa, Homo Sapiens
NGRPTFIPA

SEQ ID NO: 407646 - protein, 9 aa, Homo Sapiens
YTMPWGSGI

SEQ ID NO: 407647 - protein, 9 aa, Homo Sapiens
TEGAVPKLD

SEQ ID NO: 407648 - protein, 9 aa, Homo Sapiens
GGSGGCQYL

SEQ ID NO: 407649 - protein, 9 aa, Homo Sapiens
QRWTWRSWP

SEQ ID NO: 407650 - protein, 9 aa, Homo Sapiens
FKAFAMITY

SEQ ID NO: 407651 - protein, 9 aa, Homo Sapiens
REHQSFWKE

SEQ ID NO: 407652 - protein, 9 aa, Homo Sapiens
KQEDLRVEV

SEQ ID NO: 407653 - protein, 9 aa, Homo Sapiens
PTVALLHWL

SEQ ID NO: 407654 - protein, 9 aa, Homo Sapiens
TGVPQAAPP

SEQ ID NO: 407655 - protein, 9 aa, Homo Sapiens
TQEFRERQA

SEQ ID NO: 407656 - protein, 9 aa, Homo Sapiens
AHRETVTTQ

SEQ ID NO: 407657 - protein, 9 aa, Homo Sapiens
GYQCPAGLV

SEQ ID NO: 407658 - protein, 9 aa, Homo Sapiens
GVSTQDQLS

SEQ ID NO: 407659 - protein, 9 aa, Homo Sapiens
SNSSRDSPQ

SEQ ID NO: 407660 - protein, 9 aa, Homo Sapiens
DIDQLPERM

SEQ ID NO: 407661 - protein, 9 aa, Homo Sapiens
GGGALSSHG

SEQ ID NO: 407662 - protein, 9 aa, Homo Sapiens
RLHLSECRD

SEQ ID NO: 407663 - protein, 9 aa, Homo Sapiens
LSGGQGQDG

SEQ ID NO: 407664 - protein, 9 aa, Homo Sapiens
VYAFLDQLT

SEQ ID NO: 407665 - protein, 9 aa, Homo Sapiens
PAPWWHPGR

SEQ ID NO: 407666 - protein, 9 aa, Homo Sapiens
DKRQVSKEW

SEQ ID NO: 407667 - protein, 9 aa, Homo Sapiens
QPPQRPPLQ

SEQ ID NO: 407668 - protein, 9 aa, Homo Sapiens
VASINLSTI

SEQ ID NO: 407669 - protein, 9 aa, Homo Sapiens
TRGDFVSSD

SEQ ID NO: 407670 - protein, 9 aa, Homo Sapiens
WNLVVSLMS

SEQ ID NO: 407671 - protein, 9 aa, Homo Sapiens
LDGLTPPTL

SEQ ID NO: 407672 - protein, 9 aa, Homo Sapiens
LTNTATTPT

SEQ ID NO: 407673 - protein, 9 aa, Homo Sapiens
IRRGDVPQT

SEQ ID NO: 407674 - protein, 9 aa, Homo Sapiens
YLPPLPPPL

SEQ ID NO: 407675 - protein, 9 aa, Homo Sapiens
YASPYTYVA

SEQ ID NO: 407676 - protein, 9 aa, Homo Sapiens
GFPCPARAG

SEQ ID NO: 407677 - protein, 9 aa, Homo Sapiens
ENTYGNPHN

SEQ ID NO: 407678 - protein, 9 aa, Homo Sapiens
IDEEMIMLQ

SEQ ID NO: 407679 - protein, 9 aa, Homo Sapiens
RNAILCSCS

SEQ ID NO: 407680 - protein, 9 aa, Homo Sapiens
TWRFCRRSG

SEQ ID NO: 407681 - protein, 9 aa, Homo Sapiens
NCQELRLDE

SEQ ID NO: 407682 - protein, 9 aa, Homo Sapiens
LLHCFSLQL

SEQ ID NO: 407683 - protein, 9 aa, Homo Sapiens
GSGMGNFKL

SEQ ID NO: 407684 - protein, 9 aa, Homo Sapiens
LLNTAVPQE

SEQ ID NO: 407685 - protein, 9 aa, Homo Sapiens
LLKEMKRDR

SEQ ID NO: 407686 - protein, 9 aa, Homo Sapiens
GEVLPIPGQ

SEQ ID NO: 407687 - protein, 9 aa, Homo Sapiens
PPRRGSSQG

SEQ ID NO: 407688 - protein, 9 aa, Homo Sapiens
WTCKQKPVS

SEQ ID NO: 407689 - protein, 9 aa, Homo Sapiens
RAVMGALPS

SEQ ID NO: 407690 - protein, 9 aa, Homo Sapiens
ENTHRPYFP

SEQ ID NO: 407691 - protein, 9 aa, Homo Sapiens
STGQLQQRW

SEQ ID NO: 407692 - protein, 9 aa, Homo Sapiens
VMVWMMAGI

SEQ ID NO: 407693 - protein, 9 aa, Homo Sapiens
ILLPGRARD

SEQ ID NO: 407694 - protein, 9 aa, Homo Sapiens
AAPPPLSSP

SEQ ID NO: 407695 - protein, 9 aa, Homo Sapiens
CPQLSASSS

SEQ ID NO: 407696 - protein, 9 aa, Homo Sapiens
DTRVHTDIQ

SEQ ID NO: 407697 - protein, 9 aa, Homo Sapiens
LVPDNAFYK

SEQ ID NO: 407698 - protein, 9 aa, Homo Sapiens
IDYMSHPKE

SEQ ID NO: 407699 - protein, 9 aa, Homo Sapiens
KCSVVDSLD

SEQ ID NO: 407700 - protein, 9 aa, Homo Sapiens
LLECAAVGV

SEQ ID NO: 407701 - protein, 9 aa, Homo Sapiens
NISCLSVQG

SEQ ID NO: 407702 - protein, 9 aa, Homo Sapiens
GIMGKNECM

SEQ ID NO: 407703 - protein, 9 aa, Homo Sapiens
QLPGCLAWL

SEQ ID NO: 407704 - protein, 9 aa, Homo Sapiens
TGVQNPRKK

SEQ ID NO: 407705 - protein, 9 aa, Homo Sapiens
ASGTAAASA

SEQ ID NO: 407706 - protein, 9 aa, Homo Sapiens
ASEQRGCQQ

SEQ ID NO: 407707 - protein, 9 aa, Homo Sapiens
SNTEEIIEG

SEQ ID NO: 407708 - protein, 9 aa, Homo Sapiens
GEKNQLTRD

SEQ ID NO: 407709 - protein, 9 aa, Homo Sapiens
TQSGTKNLH

SEQ ID NO: 407710 - protein, 9 aa, Homo Sapiens
ALHSASGRR

SEQ ID NO: 407711 - protein, 9 aa, Homo Sapiens
LESVRQIYS

SEQ ID NO: 407712 - protein, 9 aa, Homo Sapiens
QEPSRRGPQ

SEQ ID NO: 407713 - protein, 9 aa, Homo Sapiens
IFLKQDIPL

SEQ ID NO: 407714 - protein, 9 aa, Homo Sapiens
YSVIRRQSW

SEQ ID NO: 407715 - protein, 9 aa, Homo Sapiens
LILLQFFFQ

SEQ ID NO: 407716 - protein, 9 aa, Homo Sapiens
SARWCLGRC

SEQ ID NO: 407717 - protein, 9 aa, Homo Sapiens
FDVNAIIAH

SEQ ID NO: 407718 - protein, 9 aa, Homo Sapiens
PDWCLKVSF

SEQ ID NO: 407719 - protein, 9 aa, Homo Sapiens
AGAIRVYAI

SEQ ID NO: 407720 - protein, 9 aa, Homo Sapiens
RVRSIRFVA

SEQ ID NO: 407721 - protein, 9 aa, Homo Sapiens
RLWATEQPC

SEQ ID NO: 407722 - protein, 9 aa, Homo Sapiens
KGRCYQLPQ

SEQ ID NO: 407723 - protein, 9 aa, Homo Sapiens
NHLEYLPIS

SEQ ID NO: 407724 - protein, 9 aa, Homo Sapiens
TGAFRVASR

SEQ ID NO: 407725 - protein, 9 aa, Homo Sapiens
PAGLFLLPG

SEQ ID NO: 407726 - protein, 9 aa, Homo Sapiens
SEKTRYDMS

SEQ ID NO: 407727 - protein, 9 aa, Homo Sapiens
ARGNAGRIR

SEQ ID NO: 407728 - protein, 9 aa, Homo Sapiens
RHLGYELLT

SEQ ID NO: 407729 - protein, 9 aa, Homo Sapiens
VVRLHEGVI

SEQ ID NO: 407730 - protein, 9 aa, Homo Sapiens
FVGGVSTVA

SEQ ID NO: 407731 - protein, 9 aa, Homo Sapiens
TCQQPANTF

SEQ ID NO: 407732 - protein, 9 aa, Homo Sapiens
VVLLAVSWG

SEQ ID NO: 407733 - protein, 9 aa, Homo Sapiens
SLSRAISHM

SEQ ID NO: 407734 - protein, 9 aa, Homo Sapiens
IWKEKLAHG

SEQ ID NO: 407735 - protein, 9 aa, Homo Sapiens
RVGFLACVG

SEQ ID NO: 407736 - protein, 9 aa, Homo Sapiens
LWTEDSGTY

SEQ ID NO: 407737 - protein, 9 aa, Homo Sapiens
SSSSVLGTG

SEQ ID NO: 407738 - protein, 9 aa, Homo Sapiens
MHFTDVDLH

SEQ ID NO: 407739 - protein, 9 aa, Homo Sapiens
EWKHQVMVG

SEQ ID NO: 407740 - protein, 9 aa, Homo Sapiens
APPSSTGAL

SEQ ID NO: 407741 - protein, 9 aa, Homo Sapiens
LLALAQLND

SEQ ID NO: 407742 - protein, 9 aa, Homo Sapiens
ENVELRGQL

SEQ ID NO: 407743 - protein, 9 aa, Homo Sapiens
RQTVSWAAT

SEQ ID NO: 407744 - protein, 9 aa, Homo Sapiens
LKKASSPGH

SEQ ID NO: 407745 - protein, 9 aa, Homo Sapiens
GSGSVVWKK

SEQ ID NO: 407746 - protein, 9 aa, Homo Sapiens
PPVQQWPGP

SEQ ID NO: 407747 - protein, 9 aa, Homo Sapiens
EKPLKDKRA

SEQ ID NO: 407748 - protein, 9 aa, Homo Sapiens
MGPPPAPPI

SEQ ID NO: 407749 - protein, 9 aa, Homo Sapiens
PGPACPIST

SEQ ID NO: 407750 - protein, 9 aa, Homo Sapiens
VSESEPGTQ

SEQ ID NO: 407751 - protein, 9 aa, Homo Sapiens
PVQPSSSVV

SEQ ID NO: 407752 - protein, 9 aa, Homo Sapiens
EQHPNHLGT

SEQ ID NO: 407753 - protein, 9 aa, Homo Sapiens
HRVVTCDTS

SEQ ID NO: 407754 - protein, 9 aa, Homo Sapiens
IQYRLKIDF

SEQ ID NO: 407755 - protein, 9 aa, Homo Sapiens
GVFSNNGHL

SEQ ID NO: 407756 - protein, 9 aa, Homo Sapiens
AVLGQQVLE

SEQ ID NO: 407757 - protein, 9 aa, Homo Sapiens
TNPPSGGGM

SEQ ID NO: 407758 - protein, 9 aa, Homo Sapiens
PNAKVILEL

SEQ ID NO: 407759 - protein, 9 aa, Homo Sapiens
ESPNLPAWT

SEQ ID NO: 407760 - protein, 9 aa, Homo Sapiens
SRAPCRPPP

SEQ ID NO: 407761 - protein, 9 aa, Homo Sapiens
KENWVQMVV

SEQ ID NO: 407762 - protein, 9 aa, Homo Sapiens
QLQELQYHC

SEQ ID NO: 407763 - protein, 9 aa, Homo Sapiens
VDIKPKDEA

SEQ ID NO: 407764 - protein, 9 aa, Homo Sapiens
WGAAPMMSS

SEQ ID NO: 407765 - protein, 9 aa, Homo Sapiens
GRRRQDCAR

SEQ ID NO: 407766 - protein, 9 aa, Homo Sapiens
LSTTSQPGA

SEQ ID NO: 407767 - protein, 9 aa, Homo Sapiens
YGAFGTDTL

SEQ ID NO: 407768 - protein, 9 aa, Homo Sapiens
KEGENCRYL

SEQ ID NO: 407769 - protein, 9 aa, Homo Sapiens
MDGLYHSRF

SEQ ID NO: 407770 - protein, 9 aa, Homo Sapiens
WLENEIATY

SEQ ID NO: 407771 - protein, 9 aa, Homo Sapiens
DVKPQGLHD

SEQ ID NO: 407772 - protein, 9 aa, Homo Sapiens
TCCLPVGGF

SEQ ID NO: 407773 - protein, 9 aa, Homo Sapiens
DTELTVQIV

SEQ ID NO: 407774 - protein, 9 aa, Homo Sapiens
QVPHPGLEL

SEQ ID NO: 407775 - protein, 9 aa, Homo Sapiens
LIPLAFFWL

SEQ ID NO: 407776 - protein, 9 aa, Homo Sapiens
KQMPPVMLK

SEQ ID NO: 407777 - protein, 9 aa, Homo Sapiens
RHRECVIFC

SEQ ID NO: 407778 - protein, 9 aa, Homo Sapiens
VDAARLPLG

SEQ ID NO: 407779 - protein, 9 aa, Homo Sapiens
LPAPPSFSV

SEQ ID NO: 407780 - protein, 9 aa, Homo Sapiens
LRRTAEWSH

SEQ ID NO: 407781 - protein, 9 aa, Homo Sapiens
ARIKGDTMG

SEQ ID NO: 407782 - protein, 9 aa, Homo Sapiens
AVPCYRECN

SEQ ID NO: 407783 - protein, 9 aa, Homo Sapiens
GIWKLYKCN

SEQ ID NO: 407784 - protein, 9 aa, Homo Sapiens
LIVPRIGHD

SEQ ID NO: 407785 - protein, 9 aa, Homo Sapiens
RVRMGTEPH

SEQ ID NO: 407786 - protein, 9 aa, Homo Sapiens
LLDTPFVRL

SEQ ID NO: 407787 - protein, 9 aa, Homo Sapiens
HMLVIFTMS

SEQ ID NO: 407788 - protein, 9 aa, Homo Sapiens
RQPLPIGLQ

SEQ ID NO: 407789 - protein, 9 aa, Homo Sapiens
MMMNHILLK

SEQ ID NO: 407790 - protein, 9 aa, Homo Sapiens
QSPCISTVS

SEQ ID NO: 407791 - protein, 9 aa, Homo Sapiens
LGGEDSGGH

SEQ ID NO: 407792 - protein, 9 aa, Homo Sapiens
PVHHPWPKS

SEQ ID NO: 407793 - protein, 9 aa, Homo Sapiens
NIKPDLIQL

SEQ ID NO: 407794 - protein, 9 aa, Homo Sapiens
YRMLQTQFS

SEQ ID NO: 407795 - protein, 9 aa, Homo Sapiens
LGQLLSAVL

SEQ ID NO: 407796 - protein, 9 aa, Homo Sapiens
HFFVTPQLF

SEQ ID NO: 407797 - protein, 9 aa, Homo Sapiens
EREQWELGP

SEQ ID NO: 407798 - protein, 9 aa, Homo Sapiens
KGRKFYGSE

SEQ ID NO: 407799 - protein, 9 aa, Homo Sapiens
QAGMWEGLA

SEQ ID NO: 407800 - protein, 9 aa, Homo Sapiens
QLLEHYEQM

SEQ ID NO: 407801 - protein, 9 aa, Homo Sapiens
MTILRCARP

SEQ ID NO: 407802 - protein, 9 aa, Homo Sapiens
TLTRPPRTW

SEQ ID NO: 407803 - protein, 9 aa, Homo Sapiens
QGEKPVWTV

SEQ ID NO: 407804 - protein, 9 aa, Homo Sapiens
AGDEHKCSV

SEQ ID NO: 407805 - protein, 9 aa, Homo Sapiens
QTQAPAVAT

SEQ ID NO: 407806 - protein, 9 aa, Homo Sapiens
APPPWRAAL

SEQ ID NO: 407807 - protein, 9 aa, Homo Sapiens
LSATLRGLL

SEQ ID NO: 407808 - protein, 9 aa, Homo Sapiens
GSQGGLGGH

SEQ ID NO: 407809 - protein, 9 aa, Homo Sapiens
AAVASCFGA

SEQ ID NO: 407810 - protein, 9 aa, Homo Sapiens
SLDLDLLAV

SEQ ID NO: 407811 - protein, 9 aa, Homo Sapiens
KAMCMKMGY

SEQ ID NO: 407812 - protein, 9 aa, Homo Sapiens
SSPRRSPAL

SEQ ID NO: 407813 - protein, 9 aa, Homo Sapiens
QDKGASISQ

SEQ ID NO: 407814 - protein, 9 aa, Homo Sapiens
RKNETFVMT

SEQ ID NO: 407815 - protein, 9 aa, Homo Sapiens
AKTRGKVDI

SEQ ID NO: 407816 - protein, 9 aa, Homo Sapiens
PAQPTVPRK

SEQ ID NO: 407817 - protein, 9 aa, Homo Sapiens
VEDDEEDED

SEQ ID NO: 407818 - protein, 9 aa, Homo Sapiens
STLEHRPPA

SEQ ID NO: 407819 - protein, 9 aa, Homo Sapiens
SPFPVSALI

SEQ ID NO: 407820 - protein, 9 aa, Homo Sapiens
CLCSMAVCQ

SEQ ID NO: 407821 - protein, 9 aa, Homo Sapiens
QLLHWCSDD

SEQ ID NO: 407822 - protein, 9 aa, Homo Sapiens
CCLPVGGFA

SEQ ID NO: 407823 - protein, 9 aa, Homo Sapiens
YPHLCSICG

SEQ ID NO: 407824 - protein, 9 aa, Homo Sapiens
WAWHWPLVA

SEQ ID NO: 407825 - protein, 9 aa, Homo Sapiens
GSLSSCGWA

SEQ ID NO: 407826 - protein, 9 aa, Homo Sapiens
RGPPYRTCD

SEQ ID NO: 407827 - protein, 9 aa, Homo Sapiens
VKQVRDLYH

SEQ ID NO: 407828 - protein, 9 aa, Homo Sapiens
GPILCRLVM

SEQ ID NO: 407829 - protein, 9 aa, Homo Sapiens
VFNTETHPL

SEQ ID NO: 407830 - protein, 9 aa, Homo Sapiens
SRPFYLEAI

SEQ ID NO: 407831 - protein, 9 aa, Homo Sapiens
HQVMVGKMQ

SEQ ID NO: 407832 - protein, 9 aa, Homo Sapiens
GHPGVGPGP

SEQ ID NO: 407833 - protein, 9 aa, Homo Sapiens
NTFDQNGMV

SEQ ID NO: 407834 - protein, 9 aa, Homo Sapiens
IWEVMPRTL

SEQ ID NO: 407835 - protein, 9 aa, Homo Sapiens
CHLWSPFGL

SEQ ID NO: 407836 - protein, 9 aa, Homo Sapiens
AMFDVHRKK

SEQ ID NO: 407837 - protein, 9 aa, Homo Sapiens
YIVQDGPPR

SEQ ID NO: 407838 - protein, 9 aa, Homo Sapiens
VDPDMLLSY

SEQ ID NO: 407839 - protein, 9 aa, Homo Sapiens
PVQLLVQLN

SEQ ID NO: 407840 - protein, 9 aa, Homo Sapiens
GRAMSKTLQ

SEQ ID NO: 407841 - protein, 9 aa, Homo Sapiens
SSPLLPAPM

SEQ ID NO: 407842 - protein, 9 aa, Homo Sapiens
CGEGGGSGG

SEQ ID NO: 407843 - protein, 9 aa, Homo Sapiens
RAPCRPPPV

SEQ ID NO: 407844 - protein, 9 aa, Homo Sapiens
HGVLHLHQS

SEQ ID NO: 407845 - protein, 9 aa, Homo Sapiens
HEETAQTIA

SEQ ID NO: 407846 - protein, 9 aa, Homo Sapiens
PGSGPQWDS

SEQ ID NO: 407847 - protein, 9 aa, Homo Sapiens
VDIAKLQHR

SEQ ID NO: 407848 - protein, 9 aa, Homo Sapiens
TDIQNDEKG

SEQ ID NO: 407849 - protein, 9 aa, Homo Sapiens
GDMGPCGPC

SEQ ID NO: 407850 - protein, 9 aa, Homo Sapiens
MGFFFRIFS

SEQ ID NO: 407851 - protein, 9 aa, Homo Sapiens
FMTMTNYDE

SEQ ID NO: 407852 - protein, 9 aa, Homo Sapiens
ASRSTPVDT

SEQ ID NO: 407853 - protein, 9 aa, Homo Sapiens
GLPQRPVRL

SEQ ID NO: 407854 - protein, 9 aa, Homo Sapiens
NIFTDDISD

SEQ ID NO: 407855 - protein, 9 aa, Homo Sapiens
ELFTRFDKL

SEQ ID NO: 407856 - protein, 9 aa, Homo Sapiens
RSLPALKIW

SEQ ID NO: 407857 - protein, 9 aa, Homo Sapiens
TGCCTWAPE

SEQ ID NO: 407858 - protein, 9 aa, Homo Sapiens
MVRVGSCVD

SEQ ID NO: 407859 - protein, 9 aa, Homo Sapiens
KPLEEEEED

SEQ ID NO: 407860 - protein, 9 aa, Homo Sapiens
ADVFLICFP

SEQ ID NO: 407861 - protein, 9 aa, Homo Sapiens
AQLVILKHL

SEQ ID NO: 407862 - protein, 9 aa, Homo Sapiens
MTPTKQACI

SEQ ID NO: 407863 - protein, 9 aa, Homo Sapiens
LLLFISLFW

SEQ ID NO: 407864 - protein, 9 aa, Homo Sapiens
CCCSGNDGR

SEQ ID NO: 407865 - protein, 9 aa, Homo Sapiens
LDNLTYRDL

SEQ ID NO: 407866 - protein, 9 aa, Homo Sapiens
RVMCRCCGG

SEQ ID NO: 407867 - protein, 9 aa, Homo Sapiens
TPFVRLQGN

SEQ ID NO: 407868 - protein, 9 aa, Homo Sapiens
SFGSFTVHS

SEQ ID NO: 407869 - protein, 9 aa, Homo Sapiens
LLVYAFLDQ

SEQ ID NO: 407870 - protein, 9 aa, Homo Sapiens
LCSCSWLSL

SEQ ID NO: 407871 - protein, 9 aa, Homo Sapiens
PQIFFRVMR

SEQ ID NO: 407872 - protein, 9 aa, Homo Sapiens
RYLHDLSGR

SEQ ID NO: 407873 - protein, 9 aa, Homo Sapiens
SPPATATWR

SEQ ID NO: 407874 - protein, 9 aa, Homo Sapiens
AWSGAWTKT

SEQ ID NO: 407875 - protein, 9 aa, Homo Sapiens
VRTWPHSRA

SEQ ID NO: 407876 - protein, 9 aa, Homo Sapiens
GQQILMKDN

SEQ ID NO: 407877 - protein, 9 aa, Homo Sapiens
SLRIALHDC

SEQ ID NO: 407878 - protein, 9 aa, Homo Sapiens
CFKVYANGQ

SEQ ID NO: 407879 - protein, 9 aa, Homo Sapiens
GPCPPPVTP

SEQ ID NO: 407880 - protein, 9 aa, Homo Sapiens
KPILATRDA

SEQ ID NO: 407881 - protein, 9 aa, Homo Sapiens
RHVRSRESE

SEQ ID NO: 407882 - protein, 9 aa, Homo Sapiens
TKYFRFVVS

SEQ ID NO: 407883 - protein, 9 aa, Homo Sapiens
ENLHVLGEA

SEQ ID NO: 407884 - protein, 9 aa, Homo Sapiens
GRGLELALA

SEQ ID NO: 407885 - protein, 9 aa, Homo Sapiens
PKDTPSSAR

SEQ ID NO: 407886 - protein, 9 aa, Homo Sapiens
WRWASFRRE

SEQ ID NO: 407887 - protein, 9 aa, Homo Sapiens
FIRVFKLIY

SEQ ID NO: 407888 - protein, 9 aa, Homo Sapiens
ALCAALNKA

SEQ ID NO: 407889 - protein, 9 aa, Homo Sapiens
AALRPMPVL

SEQ ID NO: 407890 - protein, 9 aa, Homo Sapiens
HSELPVAGG

SEQ ID NO: 407891 - protein, 9 aa, Homo Sapiens
LVRQRGRLE

SEQ ID NO: 407892 - protein, 9 aa, Homo Sapiens
CYTYSMVVA

SEQ ID NO: 407893 - protein, 9 aa, Homo Sapiens
YISSEEFAA

SEQ ID NO: 407894 - protein, 9 aa, Homo Sapiens
ARLPLGQGA

SEQ ID NO: 407895 - protein, 9 aa, Homo Sapiens
LGKDTMSDL

SEQ ID NO: 407896 - protein, 9 aa, Homo Sapiens
IFFFFALCS

SEQ ID NO: 407897 - protein, 9 aa, Homo Sapiens
LDNSVASPA

SEQ ID NO: 407898 - protein, 9 aa, Homo Sapiens
TCFSKAMYL

SEQ ID NO: 407899 - protein, 9 aa, Homo Sapiens
SVTAETTVS

SEQ ID NO: 407900 - protein, 9 aa, Homo Sapiens
TQGDFMSAL

SEQ ID NO: 407901 - protein, 9 aa, Homo Sapiens
DAVSTSSPE

SEQ ID NO: 407902 - protein, 9 aa, Homo Sapiens
SEDLKDHST

SEQ ID NO: 407903 - protein, 9 aa, Homo Sapiens
VLLDVKAWL

SEQ ID NO: 407904 - protein, 9 aa, Homo Sapiens
LDNSGYVSA

SEQ ID NO: 407905 - protein, 9 aa, Homo Sapiens
LALATDQAF

SEQ ID NO: 407906 - protein, 9 aa, Homo Sapiens
FPLQCVGRR

SEQ ID NO: 407907 - protein, 9 aa, Homo Sapiens
QQMMEMEGM

SEQ ID NO: 407908 - protein, 9 aa, Homo Sapiens
RAETHLETT

SEQ ID NO: 407909 - protein, 9 aa, Homo Sapiens
KETIHPQKS

SEQ ID NO: 407910 - protein, 9 aa, Homo Sapiens
EKVGPELLS

SEQ ID NO: 407911 - protein, 9 aa, Homo Sapiens
PNEEHFGDG

SEQ ID NO: 407912 - protein, 9 aa, Homo Sapiens
NADPQAVTT

SEQ ID NO: 407913 - protein, 9 aa, Homo Sapiens
VLQNISDAE

SEQ ID NO: 407914 - protein, 9 aa, Homo Sapiens
PLMETEMQI

SEQ ID NO: 407915 - protein, 9 aa, Homo Sapiens
FLFLLVCFL

SEQ ID NO: 407916 - protein, 9 aa, Homo Sapiens
ISCPFQSPT

SEQ ID NO: 407917 - protein, 9 aa, Homo Sapiens
LIQLKVMKT

SEQ ID NO: 407918 - protein, 9 aa, Homo Sapiens
TVGRAQASG

SEQ ID NO: 407919 - protein, 9 aa, Homo Sapiens
GCVMFEMHE

SEQ ID NO: 407920 - protein, 9 aa, Homo Sapiens
RCLGPHGTH

SEQ ID NO: 407921 - protein, 9 aa, Homo Sapiens
QQIAEEALG

SEQ ID NO: 407922 - protein, 9 aa, Homo Sapiens
NPSFAICGL

SEQ ID NO: 407923 - protein, 9 aa, Homo Sapiens
MRKSMSTVI

SEQ ID NO: 407924 - protein, 9 aa, Homo Sapiens
WLRPRRQAM

SEQ ID NO: 407925 - protein, 9 aa, Homo Sapiens
ELVKIWKEK

SEQ ID NO: 407926 - protein, 9 aa, Homo Sapiens
LDLDLLAVA

SEQ ID NO: 407927 - protein, 9 aa, Homo Sapiens
GPEDLGGVG

SEQ ID NO: 407928 - protein, 9 aa, Homo Sapiens
PHPGLELPV

SEQ ID NO: 407929 - protein, 9 aa, Homo Sapiens
KECGKAFGR

SEQ ID NO: 407930 - protein, 9 aa, Homo Sapiens
FLSNLAHHT

SEQ ID NO: 407931 - protein, 9 aa, Homo Sapiens
HFLVLNPIK

SEQ ID NO: 407932 - protein, 9 aa, Homo Sapiens
LRKMGSYGA

SEQ ID NO: 407933 - protein, 9 aa, Homo Sapiens
EWGVKGACG

SEQ ID NO: 407934 - protein, 9 aa, Homo Sapiens
VDFDKFSCH

SEQ ID NO: 407935 - protein, 9 aa, Homo Sapiens
LPQPSGTGK

SEQ ID NO: 407936 - protein, 9 aa, Homo Sapiens
PIDEEMIML

SEQ ID NO: 407937 - protein, 9 aa, Homo Sapiens
VTAVETSRR

SEQ ID NO: 407938 - protein, 9 aa, Homo Sapiens
LHNQYTENS

SEQ ID NO: 407939 - protein, 9 aa, Homo Sapiens
PARQPSRPT

SEQ ID NO: 407940 - protein, 9 aa, Homo Sapiens
LYAARQASL

SEQ ID NO: 407941 - protein, 9 aa, Homo Sapiens
TYMDSQDHK

SEQ ID NO: 407942 - protein, 9 aa, Homo Sapiens
QGLPIRSHC

SEQ ID NO: 407943 - protein, 9 aa, Homo Sapiens
DAGVFGPED

SEQ ID NO: 407944 - protein, 9 aa, Homo Sapiens
RMKAGDLLK

SEQ ID NO: 407945 - protein, 9 aa, Homo Sapiens
TPLTMRRNS

SEQ ID NO: 407946 - protein, 9 aa, Homo Sapiens
KTLTSPQAS

SEQ ID NO: 407947 - protein, 9 aa, Homo Sapiens
FTTSALLHR

SEQ ID NO: 407948 - protein, 9 aa, Homo Sapiens
DLVHSTHLV

SEQ ID NO: 407949 - protein, 9 aa, Homo Sapiens
KKGAKAREE

SEQ ID NO: 407950 - protein, 9 aa, Homo Sapiens
PLRVPPPSW

SEQ ID NO: 407951 - protein, 9 aa, Homo Sapiens
MVDFWDFAQ

SEQ ID NO: 407952 - protein, 9 aa, Homo Sapiens
VDANVLTPS

SEQ ID NO: 407953 - protein, 9 aa, Homo Sapiens
YLRRHYDGA

SEQ ID NO: 407954 - protein, 9 aa, Homo Sapiens
CRQPLPTQI

SEQ ID NO: 407955 - protein, 9 aa, Homo Sapiens
SAHLIAVTL

SEQ ID NO: 407956 - protein, 9 aa, Homo Sapiens
KIEMKGRKK

SEQ ID NO: 407957 - protein, 9 aa, Homo Sapiens
MHFLTGQGC

SEQ ID NO: 407958 - protein, 9 aa, Homo Sapiens
LVAPRGLLC

SEQ ID NO: 407959 - protein, 9 aa, Homo Sapiens
LLIGDSGGR

SEQ ID NO: 407960 - protein, 9 aa, Homo Sapiens
AGACAPISY

SEQ ID NO: 407961 - protein, 9 aa, Homo Sapiens
AQVYNTSTV

SEQ ID NO: 407962 - protein, 9 aa, Homo Sapiens
IICTISILM

SEQ ID NO: 407963 - protein, 9 aa, Homo Sapiens
NNELLLQNK

SEQ ID NO: 407964 - protein, 9 aa, Homo Sapiens
RAIFQRPHP

SEQ ID NO: 407965 - protein, 9 aa, Homo Sapiens
KSILIHDRS

SEQ ID NO: 407966 - protein, 9 aa, Homo Sapiens
QALLKVCGR

SEQ ID NO: 407967 - protein, 9 aa, Homo Sapiens
RIGDREDDE

SEQ ID NO: 407968 - protein, 9 aa, Homo Sapiens
SLNRYRLGD

SEQ ID NO: 407969 - protein, 9 aa, Homo Sapiens
GGPPSCPRP

SEQ ID NO: 407970 - protein, 9 aa, Homo Sapiens
WARSFVRGQ

SEQ ID NO: 407971 - protein, 9 aa, Homo Sapiens
MKGRKKIKE

SEQ ID NO: 407972 - protein, 9 aa, Homo Sapiens
ICLLGGGHP

SEQ ID NO: 407973 - protein, 9 aa, Homo Sapiens
ALSSWSHLF

SEQ ID NO: 407974 - protein, 9 aa, Homo Sapiens
AAEEGHGGG

SEQ ID NO: 407975 - protein, 9 aa, Homo Sapiens
EAAQPLGAA

SEQ ID NO: 407976 - protein, 9 aa, Homo Sapiens
EGAAGTRCR

SEQ ID NO: 407977 - protein, 9 aa, Homo Sapiens
NGETKKAAA

SEQ ID NO: 407978 - protein, 9 aa, Homo Sapiens
WRAASAVGV

SEQ ID NO: 407979 - protein, 9 aa, Homo Sapiens
RTYGDMATG

SEQ ID NO: 407980 - protein, 9 aa, Homo Sapiens
NGQPLPDVV

SEQ ID NO: 407981 - protein, 9 aa, Homo Sapiens
TFLCKAGGA

SEQ ID NO: 407982 - protein, 9 aa, Homo Sapiens
WPCWGPHPP

SEQ ID NO: 407983 - protein, 9 aa, Homo Sapiens
HVSETPLLG

SEQ ID NO: 407984 - protein, 9 aa, Homo Sapiens
GLIKSQRKT

SEQ ID NO: 407985 - protein, 9 aa, Homo Sapiens
QALDEVIEA

SEQ ID NO: 407986 - protein, 9 aa, Homo Sapiens
DDGRGGSLL

SEQ ID NO: 407987 - protein, 9 aa, Homo Sapiens
HTDYASIPM

SEQ ID NO: 407988 - protein, 9 aa, Homo Sapiens
PRKPGVVVH

SEQ ID NO: 407989 - protein, 9 aa, Homo Sapiens
LGNFLKPRD

SEQ ID NO: 407990 - protein, 9 aa, Homo Sapiens
STGALPTAA

SEQ ID NO: 407991 - protein, 9 aa, Homo Sapiens
IDTKNLYLL

SEQ ID NO: 407992 - protein, 9 aa, Homo Sapiens
LKAPAATSI

SEQ ID NO: 407993 - protein, 9 aa, Homo Sapiens
WMSSCSKRA

SEQ ID NO: 407994 - protein, 9 aa, Homo Sapiens
GLSVTKGKK

SEQ ID NO: 407995 - protein, 9 aa, Homo Sapiens
CSHLAMELL

SEQ ID NO: 407996 - protein, 9 aa, Homo Sapiens
AAAARLLDQ

SEQ ID NO: 407997 - protein, 9 aa, Homo Sapiens
PMLSSISRP

SEQ ID NO: 407998 - protein, 9 aa, Homo Sapiens
LQFRESPWG

SEQ ID NO: 407999 - protein, 9 aa, Homo Sapiens
APGERRWLA

SEQ ID NO: 408000 - protein, 9 aa, Homo Sapiens
QGMPVTITN

SEQ ID NO: 408001 - protein, 9 aa, Homo Sapiens
EEEIWLLHT

SEQ ID NO: 408002 - protein, 9 aa, Homo Sapiens
RLMAPVGSV

SEQ ID NO: 408003 - protein, 9 aa, Homo Sapiens
GGCCIPKEQ

SEQ ID NO: 408004 - protein, 9 aa, Homo Sapiens
SAVGKQSAP

SEQ ID NO: 408005 - protein, 9 aa, Homo Sapiens
PGGPPSCPR

SEQ ID NO: 408006 - protein, 9 aa, Homo Sapiens
YNLGRTDFC

SEQ ID NO: 408007 - protein, 9 aa, Homo Sapiens
VLLHCFSLQ

SEQ ID NO: 408008 - protein, 9 aa, Homo Sapiens
MNQLVSLGK

SEQ ID NO: 408009 - protein, 9 aa, Homo Sapiens
LPTRRMRTF

SEQ ID NO: 408010 - protein, 9 aa, Homo Sapiens
LKVELQSAV

SEQ ID NO: 408011 - protein, 9 aa, Homo Sapiens
RTAGRLESS

SEQ ID NO: 408012 - protein, 9 aa, Homo Sapiens
WQVVQGLEA

SEQ ID NO: 408013 - protein, 9 aa, Homo Sapiens
LFKTKFVGG

SEQ ID NO: 408014 - protein, 9 aa, Homo Sapiens
LEAQISTGG

SEQ ID NO: 408015 - protein, 9 aa, Homo Sapiens
RPSARIPDA

SEQ ID NO: 408016 - protein, 9 aa, Homo Sapiens
YTSKMISRI

SEQ ID NO: 408017 - protein, 9 aa, Homo Sapiens
NPPKFPQSI

SEQ ID NO: 408018 - protein, 9 aa, Homo Sapiens
LTQALWKAF

SEQ ID NO: 408019 - protein, 9 aa, Homo Sapiens
LLAVALFVE

SEQ ID NO: 408020 - protein, 9 aa, Homo Sapiens
AHSGVSTQD

SEQ ID NO: 408021 - protein, 9 aa, Homo Sapiens
VVMHWTTLL

SEQ ID NO: 408022 - protein, 9 aa, Homo Sapiens
SSCVSTPGP

SEQ ID NO: 408023 - protein, 9 aa, Homo Sapiens
RNKMPTWLS

SEQ ID NO: 408024 - protein, 9 aa, Homo Sapiens
PLPGRGASL

SEQ ID NO: 408025 - protein, 9 aa, Homo Sapiens
RTRPRTASA

SEQ ID NO: 408026 - protein, 9 aa, Homo Sapiens
LERLHDVLS

SEQ ID NO: 408027 - protein, 9 aa, Homo Sapiens
AIHIEDLPE

SEQ ID NO: 408028 - protein, 9 aa, Homo Sapiens
SSAPTPGNN

SEQ ID NO: 408029 - protein, 9 aa, Homo Sapiens
TQDSALLYY

SEQ ID NO: 408030 - protein, 9 aa, Homo Sapiens
CEQVHVRLH

SEQ ID NO: 408031 - protein, 9 aa, Homo Sapiens
QKVKSLCWA

SEQ ID NO: 408032 - protein, 9 aa, Homo Sapiens
CVPVLRLSQ

SEQ ID NO: 408033 - protein, 9 aa, Homo Sapiens
DANVLLLFI

SEQ ID NO: 408034 - protein, 9 aa, Homo Sapiens
QSLSLQCCC

SEQ ID NO: 408035 - protein, 9 aa, Homo Sapiens
QAKTQEFRE

SEQ ID NO: 408036 - protein, 9 aa, Homo Sapiens
ARVQAPVLL

SEQ ID NO: 408037 - protein, 9 aa, Homo Sapiens
LLGSMAHPP

SEQ ID NO: 408038 - protein, 9 aa, Homo Sapiens
MVQCLTLDH

SEQ ID NO: 408039 - protein, 9 aa, Homo Sapiens
FDYLTMDGT

SEQ ID NO: 408040 - protein, 9 aa, Homo Sapiens
INNDHKLPP

SEQ ID NO: 408041 - protein, 9 aa, Homo Sapiens
WYTAEDMYR

SEQ ID NO: 408042 - protein, 9 aa, Homo Sapiens
STHTMAATA

SEQ ID NO: 408043 - protein, 9 aa, Homo Sapiens
NLDPTSSSF

SEQ ID NO: 408044 - protein, 9 aa, Homo Sapiens
SGAWTKTMR

SEQ ID NO: 408045 - protein, 9 aa, Homo Sapiens
GQGCLLSLL

SEQ ID NO: 408046 - protein, 9 aa, Homo Sapiens
KAFGRFSHL

SEQ ID NO: 408047 - protein, 9 aa, Homo Sapiens
QLLQPQVPP

SEQ ID NO: 408048 - protein, 9 aa, Homo Sapiens
NMVETIPCR

SEQ ID NO: 408049 - protein, 9 aa, Homo Sapiens
SCWLSSPYY

SEQ ID NO: 408050 - protein, 9 aa, Homo Sapiens
PGPASTAAT

SEQ ID NO: 408051 - protein, 9 aa, Homo Sapiens
LQHSLHLLL

SEQ ID NO: 408052 - protein, 9 aa, Homo Sapiens
MCSWLLSKH

SEQ ID NO: 408053 - protein, 9 aa, Homo Sapiens
VQCGLVQPG

SEQ ID NO: 408054 - protein, 9 aa, Homo Sapiens
ACVQKVTSS

SEQ ID NO: 408055 - protein, 9 aa, Homo Sapiens
RRRAPPRSG

SEQ ID NO: 408056 - protein, 9 aa, Homo Sapiens
ETFVMTQGD

SEQ ID NO: 408057 - protein, 9 aa, Homo Sapiens
EFIPHLELE

SEQ ID NO: 408058 - protein, 9 aa, Homo Sapiens
GRPAAEGLR

SEQ ID NO: 408059 - protein, 9 aa, Homo Sapiens
NNWNSSTQW

SEQ ID NO: 408060 - protein, 9 aa, Homo Sapiens
TAVAVAHIA

SEQ ID NO: 408061 - protein, 9 aa, Homo Sapiens
VLTPSAAWS

SEQ ID NO: 408062 - protein, 9 aa, Homo Sapiens
GIAAFRPDL

SEQ ID NO: 408063 - protein, 9 aa, Homo Sapiens
EADMEWLIK

SEQ ID NO: 408064 - protein, 9 aa, Homo Sapiens
SSFSKWCRP

SEQ ID NO: 408065 - protein, 9 aa, Homo Sapiens
QQNGLDVTQ

SEQ ID NO: 408066 - protein, 9 aa, Homo Sapiens
FRTEATAAA

SEQ ID NO: 408067 - protein, 9 aa, Homo Sapiens
STEVNSPPP

SEQ ID NO: 408068 - protein, 9 aa, Homo Sapiens
RPIFEGHIE

SEQ ID NO: 408069 - protein, 9 aa, Homo Sapiens
AWHDGLDWC

SEQ ID NO: 408070 - protein, 9 aa, Homo Sapiens
AVCGEGGGS

SEQ ID NO: 408071 - protein, 9 aa, Homo Sapiens
TCLQICELE

SEQ ID NO: 408072 - protein, 9 aa, Homo Sapiens
FIYSLFFLS

SEQ ID NO: 408073 - protein, 9 aa, Homo Sapiens
RIERYRLDG

SEQ ID NO: 408074 - protein, 9 aa, Homo Sapiens
LELREEVEK

SEQ ID NO: 408075 - protein, 9 aa, Homo Sapiens
ITCDIKQLD

SEQ ID NO: 408076 - protein, 9 aa, Homo Sapiens
DPVPAVLIP

SEQ ID NO: 408077 - protein, 9 aa, Homo Sapiens
GTGVPQAAP

SEQ ID NO: 408078 - protein, 9 aa, Homo Sapiens
SIPIIYRNL

SEQ ID NO: 408079 - protein, 9 aa, Homo Sapiens
RPGQLRGRA

SEQ ID NO: 408080 - protein, 9 aa, Homo Sapiens
STIKSILIH

SEQ ID NO: 408081 - protein, 9 aa, Homo Sapiens
QPSRPTGRT

SEQ ID NO: 408082 - protein, 9 aa, Homo Sapiens
VGSVMSCSL

SEQ ID NO: 408083 - protein, 9 aa, Homo Sapiens
DEDEKNLQE

SEQ ID NO: 408084 - protein, 9 aa, Homo Sapiens
LSSMMTSGT

SEQ ID NO: 408085 - protein, 9 aa, Homo Sapiens
ARVLMGNAI

SEQ ID NO: 408086 - protein, 9 aa, Homo Sapiens
PPQRPPLQP

SEQ ID NO: 408087 - protein, 9 aa, Homo Sapiens
GLQWVVHLH

SEQ ID NO: 408088 - protein, 9 aa, Homo Sapiens
NMKMKTFMK

SEQ ID NO: 408089 - protein, 9 aa, Homo Sapiens
KKGRCYQLP

SEQ ID NO: 408090 - protein, 9 aa, Homo Sapiens
GAGAAAARA

SEQ ID NO: 408091 - protein, 9 aa, Homo Sapiens
SMDCVCYST

SEQ ID NO: 408092 - protein, 9 aa, Homo Sapiens
SSCYFFLPL

SEQ ID NO: 408093 - protein, 9 aa, Homo Sapiens
TDPDADLYK

SEQ ID NO: 408094 - protein, 9 aa, Homo Sapiens
GPLSSKKAE

SEQ ID NO: 408095 - protein, 9 aa, Homo Sapiens
MDGQVMWWD

SEQ ID NO: 408096 - protein, 9 aa, Homo Sapiens
AWSTCCCTA

SEQ ID NO: 408097 - protein, 9 aa, Homo Sapiens
IIATMLVLA

SEQ ID NO: 408098 - protein, 9 aa, Homo Sapiens
AAGTRCRAS

SEQ ID NO: 408099 - protein, 9 aa, Homo Sapiens
GTRTIIVNT

SEQ ID NO: 408100 - protein, 9 aa, Homo Sapiens
TTKFGSKHF

SEQ ID NO: 408101 - protein, 9 aa, Homo Sapiens
SVPLLPSPS

SEQ ID NO: 408102 - protein, 9 aa, Homo Sapiens
QEEELPQVW

SEQ ID NO: 408103 - protein, 9 aa, Homo Sapiens
GGDHYSHLL

SEQ ID NO: 408104 - protein, 9 aa, Homo Sapiens
GFYYELGVQ

SEQ ID NO: 408105 - protein, 9 aa, Homo Sapiens
IRKALALDK

SEQ ID NO: 408106 - protein, 9 aa, Homo Sapiens
MDPSTAGGC

SEQ ID NO: 408107 - protein, 9 aa, Homo Sapiens
ADIEFRKWY

SEQ ID NO: 408108 - protein, 9 aa, Homo Sapiens
AQLGFNIQG

SEQ ID NO: 408109 - protein, 9 aa, Homo Sapiens
LNRPEISTD

SEQ ID NO: 408110 - protein, 9 aa, Homo Sapiens
LYDLLIAAM

SEQ ID NO: 408111 - protein, 9 aa, Homo Sapiens
MPKVLPGTL

SEQ ID NO: 408112 - protein, 9 aa, Homo Sapiens
HEFTTSALL

SEQ ID NO: 408113 - protein, 9 aa, Homo Sapiens
SNLGVDDGY

SEQ ID NO: 408114 - protein, 9 aa, Homo Sapiens
AQKSNMKLH

SEQ ID NO: 408115 - protein, 9 aa, Homo Sapiens
VERCCRCLH

SEQ ID NO: 408116 - protein, 9 aa, Homo Sapiens
RVSRLNPKM

SEQ ID NO: 408117 - protein, 9 aa, Homo Sapiens
QSTLDAEVR

SEQ ID NO: 408118 - protein, 9 aa, Homo Sapiens
ALCTASMCS

SEQ ID NO: 408119 - protein, 9 aa, Homo Sapiens
LATQSQPHD

SEQ ID NO: 408120 - protein, 9 aa, Homo Sapiens
TVVVPLIVG

SEQ ID NO: 408121 - protein, 9 aa, Homo Sapiens
QDGRVDRLA

SEQ ID NO: 408122 - protein, 9 aa, Homo Sapiens
LPNVLEFTS

SEQ ID NO: 408123 - protein, 9 aa, Homo Sapiens
VTRRRAAVT

SEQ ID NO: 408124 - protein, 9 aa, Homo Sapiens
RHSQEPPAI

SEQ ID NO: 408125 - protein, 9 aa, Homo Sapiens
FLGIAAFRP

SEQ ID NO: 408126 - protein, 9 aa, Homo Sapiens
TALSVRGPG

SEQ ID NO: 408127 - protein, 9 aa, Homo Sapiens
DDNGVWMLQ

SEQ ID NO: 408128 - protein, 9 aa, Homo Sapiens
STPWAIAVL

SEQ ID NO: 408129 - protein, 9 aa, Homo Sapiens
HSHAVFNII

SEQ ID NO: 408130 - protein, 9 aa, Homo Sapiens
ALIEDQGLV

SEQ ID NO: 408131 - protein, 9 aa, Homo Sapiens
QPSPQTPTS

SEQ ID NO: 408132 - protein, 9 aa, Homo Sapiens
ETRVPVPRV

SEQ ID NO: 408133 - protein, 9 aa, Homo Sapiens
FLLVSSSAQ

SEQ ID NO: 408134 - protein, 9 aa, Homo Sapiens
EHNYCRLIL

SEQ ID NO: 408135 - protein, 9 aa, Homo Sapiens
CQCRQPLPT

SEQ ID NO: 408136 - protein, 9 aa, Homo Sapiens
WVISKQTFL

SEQ ID NO: 408137 - protein, 9 aa, Homo Sapiens
LQLVVLDVK

SEQ ID NO: 408138 - protein, 9 aa, Homo Sapiens
VNTTQRPFD

SEQ ID NO: 408139 - protein, 9 aa, Homo Sapiens
DGVMVRVGS

SEQ ID NO: 408140 - protein, 9 aa, Homo Sapiens
YFYPFPNRL

SEQ ID NO: 408141 - protein, 9 aa, Homo Sapiens
FGPEDLGGV

SEQ ID NO: 408142 - protein, 9 aa, Homo Sapiens
NLQELWLYD

SEQ ID NO: 408143 - protein, 9 aa, Homo Sapiens
IFQRPHPLA

SEQ ID NO: 408144 - protein, 9 aa, Homo Sapiens
WKEKLAHGH

SEQ ID NO: 408145 - protein, 9 aa, Homo Sapiens
TSEEPAGLS

SEQ ID NO: 408146 - protein, 9 aa, Homo Sapiens
QWCEELPSQ

SEQ ID NO: 408147 - protein, 9 aa, Homo Sapiens
VSPKHGCNF

SEQ ID NO: 408148 - protein, 9 aa, Homo Sapiens
VRPVQLLVQ

SEQ ID NO: 408149 - protein, 9 aa, Homo Sapiens
TSNTEEIIE

SEQ ID NO: 408150 - protein, 9 aa, Homo Sapiens
PEESRWWLG

SEQ ID NO: 408151 - protein, 9 aa, Homo Sapiens
DLHTGLIKS

SEQ ID NO: 408152 - protein, 9 aa, Homo Sapiens
APNDSLCQG

SEQ ID NO: 408153 - protein, 9 aa, Homo Sapiens
WDGGSPSLW

SEQ ID NO: 408154 - protein, 9 aa, Homo Sapiens
LVNITLGDL

SEQ ID NO: 408155 - protein, 9 aa, Homo Sapiens
WKEPSLLSP

SEQ ID NO: 408156 - protein, 9 aa, Homo Sapiens
PPSCPRPTS

SEQ ID NO: 408157 - protein, 9 aa, Homo Sapiens
PASSPTKCE

SEQ ID NO: 408158 - protein, 9 aa, Homo Sapiens
QMECVGTWI

SEQ ID NO: 408159 - protein, 9 aa, Homo Sapiens
ISQLLGSMA

SEQ ID NO: 408160 - protein, 9 aa, Homo Sapiens
YLSWLDLEF

SEQ ID NO: 408161 - protein, 9 aa, Homo Sapiens
SADEKRYQA

SEQ ID NO: 408162 - protein, 9 aa, Homo Sapiens
GICTTLLVY

SEQ ID NO: 408163 - protein, 9 aa, Homo Sapiens
LGGGLGGKR

SEQ ID NO: 408164 - protein, 9 aa, Homo Sapiens
CPLRGGAGP

SEQ ID NO: 408165 - protein, 9 aa, Homo Sapiens
RTVQKNTKY

SEQ ID NO: 408166 - protein, 9 aa, Homo Sapiens
DLIYLHYVP

SEQ ID NO: 408167 - protein, 9 aa, Homo Sapiens
EEDSNFHQS

SEQ ID NO: 408168 - protein, 9 aa, Homo Sapiens
SLASKVKDT

SEQ ID NO: 408169 - protein, 9 aa, Homo Sapiens
LLHWLSQPL

SEQ ID NO: 408170 - protein, 9 aa, Homo Sapiens
MLQKFLDDL

SEQ ID NO: 408171 - protein, 9 aa, Homo Sapiens
TWQVVQGLE

SEQ ID NO: 408172 - protein, 9 aa, Homo Sapiens
TGGIFEPSI

SEQ ID NO: 408173 - protein, 9 aa, Homo Sapiens
ATWAVSHEG

SEQ ID NO: 408174 - protein, 9 aa, Homo Sapiens
ARMGHRVSR

SEQ ID NO: 408175 - protein, 9 aa, Homo Sapiens
LGNCQSPFS

SEQ ID NO: 408176 - protein, 9 aa, Homo Sapiens
QGLLVVQAP

SEQ ID NO: 408177 - protein, 9 aa, Homo Sapiens
WIWQEWTDA

SEQ ID NO: 408178 - protein, 9 aa, Homo Sapiens
RAGRQRSGP

SEQ ID NO: 408179 - protein, 9 aa, Homo Sapiens
KEDIPWMLI

SEQ ID NO: 408180 - protein, 9 aa, Homo Sapiens
RDSALYLCA

SEQ ID NO: 408181 - protein, 9 aa, Homo Sapiens
DPQGQGRVC

SEQ ID NO: 408182 - protein, 9 aa, Homo Sapiens
RVFGEHRRN

SEQ ID NO: 408183 - protein, 9 aa, Homo Sapiens
EPTPSWRRC

SEQ ID NO: 408184 - protein, 9 aa, Homo Sapiens
QVPPACQPA

SEQ ID NO: 408185 - protein, 9 aa, Homo Sapiens
SRSSMLKSA

SEQ ID NO: 408186 - protein, 9 aa, Homo Sapiens
ALVATSPPA

SEQ ID NO: 408187 - protein, 9 aa, Homo Sapiens
YGDMATGCR

SEQ ID NO: 408188 - protein, 9 aa, Homo Sapiens
LYLFRASDS

SEQ ID NO: 408189 - protein, 9 aa, Homo Sapiens
TTNMLASVA

SEQ ID NO: 408190 - protein, 9 aa, Homo Sapiens
MVPDGWKEP

SEQ ID NO: 408191 - protein, 9 aa, Homo Sapiens
QRHPLGRPP

SEQ ID NO: 408192 - protein, 9 aa, Homo Sapiens
ERLHDVLSS

SEQ ID NO: 408193 - protein, 9 aa, Homo Sapiens
QGAPARMGH

SEQ ID NO: 408194 - protein, 9 aa, Homo Sapiens
ARTCWTASS

SEQ ID NO: 408195 - protein, 9 aa, Homo Sapiens
NFVYWAAHQ

SEQ ID NO: 408196 - protein, 9 aa, Homo Sapiens
RAHEGLPAV

SEQ ID NO: 408197 - protein, 9 aa, Homo Sapiens
QPFIAHRHI

SEQ ID NO: 408198 - protein, 9 aa, Homo Sapiens
CCCTPGPVW

SEQ ID NO: 408199 - protein, 9 aa, Homo Sapiens
IDDTVITTA

SEQ ID NO: 408200 - protein, 9 aa, Homo Sapiens
KIATMMAKT

SEQ ID NO: 408201 - protein, 9 aa, Homo Sapiens
RQISLPLRG

SEQ ID NO: 408202 - protein, 9 aa, Homo Sapiens
VTKSVASFP

SEQ ID NO: 408203 - protein, 9 aa, Homo Sapiens
RRMRITVKK

SEQ ID NO: 408204 - protein, 9 aa, Homo Sapiens
PYSATGAPR

SEQ ID NO: 408205 - protein, 9 aa, Homo Sapiens
QLWVNSDFN

SEQ ID NO: 408206 - protein, 9 aa, Homo Sapiens
DKERYDIMG

SEQ ID NO: 408207 - protein, 9 aa, Homo Sapiens
QDWTCHLRQ

SEQ ID NO: 408208 - protein, 9 aa, Homo Sapiens
GDQRRHAAA

SEQ ID NO: 408209 - protein, 9 aa, Homo Sapiens
EHHCPSAHP

SEQ ID NO: 408210 - protein, 9 aa, Homo Sapiens
RRDRRPGPS

SEQ ID NO: 408211 - protein, 9 aa, Homo Sapiens
LQEEPGPST

SEQ ID NO: 408212 - protein, 9 aa, Homo Sapiens
ESTSTGSRQ

SEQ ID NO: 408213 - protein, 9 aa, Homo Sapiens
KTPGGPPSC

SEQ ID NO: 408214 - protein, 9 aa, Homo Sapiens
LTQYMPQNR

SEQ ID NO: 408215 - protein, 9 aa, Homo Sapiens
STTSQPGAT

SEQ ID NO: 408216 - protein, 9 aa, Homo Sapiens
RRRAAVTIE

SEQ ID NO: 408217 - protein, 9 aa, Homo Sapiens
AKWTCKQKP

SEQ ID NO: 408218 - protein, 9 aa, Homo Sapiens
LEDSSSSPR

SEQ ID NO: 408219 - protein, 9 aa, Homo Sapiens
FISSGRPPS

SEQ ID NO: 408220 - protein, 9 aa, Homo Sapiens
SIFSMMCKE

SEQ ID NO: 408221 - protein, 9 aa, Homo Sapiens
LLRLLSHLR

SEQ ID NO: 408222 - protein, 9 aa, Homo Sapiens
KTRLLRRAR

SEQ ID NO: 408223 - protein, 9 aa, Homo Sapiens
PIPGQETPT

SEQ ID NO: 408224 - protein, 9 aa, Homo Sapiens
TPCLDCVAK

SEQ ID NO: 408225 - protein, 9 aa, Homo Sapiens
GKKKGQTQK

SEQ ID NO: 408226 - protein, 9 aa, Homo Sapiens
NSHPPTTTT

SEQ ID NO: 408227 - protein, 9 aa, Homo Sapiens
YFFRERSAE

SEQ ID NO: 408228 - protein, 9 aa, Homo Sapiens
AHLGLQWVV

SEQ ID NO: 408229 - protein, 9 aa, Homo Sapiens
LFTLRVTKI

SEQ ID NO: 408230 - protein, 9 aa, Homo Sapiens
KISWVCDLD

SEQ ID NO: 408231 - protein, 9 aa, Homo Sapiens
VAEDAFTMD

SEQ ID NO: 408232 - protein, 9 aa, Homo Sapiens
QPTVPRKTL

SEQ ID NO: 408233 - protein, 9 aa, Homo Sapiens
GISISQLLG

SEQ ID NO: 408234 - protein, 9 aa, Homo Sapiens
HVIQCYIQY

SEQ ID NO: 408235 - protein, 9 aa, Homo Sapiens
AICWELLWA

SEQ ID NO: 408236 - protein, 9 aa, Homo Sapiens
KDWDRKRRS

SEQ ID NO: 408237 - protein, 9 aa, Homo Sapiens
QDTSGHRGS

SEQ ID NO: 408238 - protein, 9 aa, Homo Sapiens
QIPLRVFHP

SEQ ID NO: 408239 - protein, 9 aa, Homo Sapiens
MVPEVVTRK

SEQ ID NO: 408240 - protein, 9 aa, Homo Sapiens
CLLASRRTW

SEQ ID NO: 408241 - protein, 9 aa, Homo Sapiens
PLLCRKDGP

SEQ ID NO: 408242 - protein, 9 aa, Homo Sapiens
RSPGHPRGS

SEQ ID NO: 408243 - protein, 9 aa, Homo Sapiens
TTPPSPTCF

SEQ ID NO: 408244 - protein, 9 aa, Homo Sapiens
MEQLTLAFY

SEQ ID NO: 408245 - protein, 9 aa, Homo Sapiens
HATYSNTFY

SEQ ID NO: 408246 - protein, 9 aa, Homo Sapiens
PPGPSWTWG

SEQ ID NO: 408247 - protein, 9 aa, Homo Sapiens
STPTGSCTD

SEQ ID NO: 408248 - protein, 9 aa, Homo Sapiens
IDLYLVPDN

SEQ ID NO: 408249 - protein, 9 aa, Homo Sapiens
LLWYYVVFF

SEQ ID NO: 408250 - protein, 9 aa, Homo Sapiens
ERAGALRLR

SEQ ID NO: 408251 - protein, 9 aa, Homo Sapiens
TKYVCLANK

SEQ ID NO: 408252 - protein, 9 aa, Homo Sapiens
HAGFQMTPT

SEQ ID NO: 408253 - protein, 9 aa, Homo Sapiens
HLTTPSSTA

SEQ ID NO: 408254 - protein, 9 aa, Homo Sapiens
SPSHVPFSS

SEQ ID NO: 408255 - protein, 9 aa, Homo Sapiens
VDVKAQHTG

SEQ ID NO: 408256 - protein, 9 aa, Homo Sapiens
LHSRQYVSG

SEQ ID NO: 408257 - protein, 9 aa, Homo Sapiens
RLSATLRGL

SEQ ID NO: 408258 - protein, 9 aa, Homo Sapiens
IGRILCLIK

SEQ ID NO: 408259 - protein, 9 aa, Homo Sapiens
IMFGSFLLL

SEQ ID NO: 408260 - protein, 9 aa, Homo Sapiens
VRGSPEESR

SEQ ID NO: 408261 - protein, 9 aa, Homo Sapiens
LCFWLLIWL

SEQ ID NO: 408262 - protein, 9 aa, Homo Sapiens
VPPVHHPWP

SEQ ID NO: 408263 - protein, 9 aa, Homo Sapiens
ALLLGPPPG

SEQ ID NO: 408264 - protein, 9 aa, Homo Sapiens
ATRKVPWKR

SEQ ID NO: 408265 - protein, 9 aa, Homo Sapiens
NDVHVWVQD

SEQ ID NO: 408266 - protein, 9 aa, Homo Sapiens
GRIRSASCE

SEQ ID NO: 408267 - protein, 9 aa, Homo Sapiens
GIQLEPLPP

SEQ ID NO: 408268 - protein, 9 aa, Homo Sapiens
TPGKFLLGH

SEQ ID NO: 408269 - protein, 9 aa, Homo Sapiens
LGPRPLPHA

SEQ ID NO: 408270 - protein, 9 aa, Homo Sapiens
HWRGALGFW

SEQ ID NO: 408271 - protein, 9 aa, Homo Sapiens
TINTSCHPA

SEQ ID NO: 408272 - protein, 9 aa, Homo Sapiens
GGGGSWSSA

SEQ ID NO: 408273 - protein, 9 aa, Homo Sapiens
RPNGGPHAL

SEQ ID NO: 408274 - protein, 9 aa, Homo Sapiens
FWRWASFRR

SEQ ID NO: 408275 - protein, 9 aa, Homo Sapiens
RYVWFSGET

SEQ ID NO: 408276 - protein, 9 aa, Homo Sapiens
DREDDETEE

SEQ ID NO: 408277 - protein, 9 aa, Homo Sapiens
EKIIPRSSC

SEQ ID NO: 408278 - protein, 9 aa, Homo Sapiens
IDSDAVSTS

SEQ ID NO: 408279 - protein, 9 aa, Homo Sapiens
AVSNLEEPV

SEQ ID NO: 408280 - protein, 9 aa, Homo Sapiens
VQIQSQSST

SEQ ID NO: 408281 - protein, 9 aa, Homo Sapiens
YTQTTLSSM

SEQ ID NO: 408282 - protein, 9 aa, Homo Sapiens
IVLPLSLQW

SEQ ID NO: 408283 - protein, 9 aa, Homo Sapiens
LLAQTFILL

SEQ ID NO: 408284 - protein, 9 aa, Homo Sapiens
NKDMKGALW

SEQ ID NO: 408285 - protein, 9 aa, Homo Sapiens
HDEIPILGP

SEQ ID NO: 408286 - protein, 9 aa, Homo Sapiens
SHFYNNRYA

SEQ ID NO: 408287 - protein, 9 aa, Homo Sapiens
RHVASGLRT

SEQ ID NO: 408288 - protein, 9 aa, Homo Sapiens
SPLPTRRMR

SEQ ID NO: 408289 - protein, 9 aa, Homo Sapiens
GPGVGLVAE

SEQ ID NO: 408290 - protein, 9 aa, Homo Sapiens
GRQQHTREC

SEQ ID NO: 408291 - protein, 9 aa, Homo Sapiens
ESSLRPRPP

SEQ ID NO: 408292 - protein, 9 aa, Homo Sapiens
ASSPRAIFQ

SEQ ID NO: 408293 - protein, 9 aa, Homo Sapiens
SVLGGGGSG

SEQ ID NO: 408294 - protein, 9 aa, Homo Sapiens
LQAKADSTS

SEQ ID NO: 408295 - protein, 9 aa, Homo Sapiens
METEMQITA

SEQ ID NO: 408296 - protein, 9 aa, Homo Sapiens
HPQRRRPLA

SEQ ID NO: 408297 - protein, 9 aa, Homo Sapiens
TLQAEDMYS

SEQ ID NO: 408298 - protein, 9 aa, Homo Sapiens
LYHEPLEDD

SEQ ID NO: 408299 - protein, 9 aa, Homo Sapiens
NGHILGSKP

SEQ ID NO: 408300 - protein, 9 aa, Homo Sapiens
LLLTCFSKA

SEQ ID NO: 408301 - protein, 9 aa, Homo Sapiens
KCPAGERGS

SEQ ID NO: 408302 - protein, 9 aa, Homo Sapiens
APFLGNFLK

SEQ ID NO: 408303 - protein, 9 aa, Homo Sapiens
RLLSTKGML

SEQ ID NO: 408304 - protein, 9 aa, Homo Sapiens
DWGGKRNTI

SEQ ID NO: 408305 - protein, 9 aa, Homo Sapiens
YRTCDLFDE

SEQ ID NO: 408306 - protein, 9 aa, Homo Sapiens
KKNKENQKE

SEQ ID NO: 408307 - protein, 9 aa, Homo Sapiens
MPYAGGVGA

SEQ ID NO: 408308 - protein, 9 aa, Homo Sapiens
REEGYYYRE

SEQ ID NO: 408309 - protein, 9 aa, Homo Sapiens
NPDRFYQQV

SEQ ID NO: 408310 - protein, 9 aa, Homo Sapiens
LGDEAMEHF

SEQ ID NO: 408311 - protein, 9 aa, Homo Sapiens
PGGHPIVKL

SEQ ID NO: 408312 - protein, 9 aa, Homo Sapiens
NSVASPAQV

SEQ ID NO: 408313 - protein, 9 aa, Homo Sapiens
PPAPGSSCY

SEQ ID NO: 408314 - protein, 9 aa, Homo Sapiens
PEASHLFPP

SEQ ID NO: 408315 - protein, 9 aa, Homo Sapiens
GVNMQYFLT

SEQ ID NO: 408316 - protein, 9 aa, Homo Sapiens
QLVSLGKTN

SEQ ID NO: 408317 - protein, 9 aa, Homo Sapiens
TVTRGETVV

SEQ ID NO: 408318 - protein, 9 aa, Homo Sapiens
AGHSELPVA

SEQ ID NO: 408319 - protein, 9 aa, Homo Sapiens
KSIIDAHAN

SEQ ID NO: 408320 - protein, 9 aa, Homo Sapiens
CVQKVTSSL

SEQ ID NO: 408321 - protein, 9 aa, Homo Sapiens
GHYPCSVLG

SEQ ID NO: 408322 - protein, 9 aa, Homo Sapiens
CLEAEGGLI

SEQ ID NO: 408323 - protein, 9 aa, Homo Sapiens
HAGPAVQPP

SEQ ID NO: 408324 - protein, 9 aa, Homo Sapiens
PEWLREGRT

SEQ ID NO: 408325 - protein, 9 aa, Homo Sapiens
ITTPNKFAT

SEQ ID NO: 408326 - protein, 9 aa, Homo Sapiens
TSESQDEPW

SEQ ID NO: 408327 - protein, 9 aa, Homo Sapiens
LNMLSLFFA

SEQ ID NO: 408328 - protein, 9 aa, Homo Sapiens
KAAAGSTDK

SEQ ID NO: 408329 - protein, 9 aa, Homo Sapiens
CGRAPAQPP

SEQ ID NO: 408330 - protein, 9 aa, Homo Sapiens
ILQLLALGL

SEQ ID NO: 408331 - protein, 9 aa, Homo Sapiens
NIHSGEMYR

SEQ ID NO: 408332 - protein, 9 aa, Homo Sapiens
PQVLAYPFF

SEQ ID NO: 408333 - protein, 9 aa, Homo Sapiens
QSTNNNTKF

SEQ ID NO: 408334 - protein, 9 aa, Homo Sapiens
TTLLLKAPT

SEQ ID NO: 408335 - protein, 9 aa, Homo Sapiens
MHSIFSLLC

SEQ ID NO: 408336 - protein, 9 aa, Homo Sapiens
LKIWEELLK

SEQ ID NO: 408337 - protein, 9 aa, Homo Sapiens
CLAGHRVPG

SEQ ID NO: 408338 - protein, 9 aa, Homo Sapiens
VLVSDCKVS

SEQ ID NO: 408339 - protein, 9 aa, Homo Sapiens
PSCLCSSPG

SEQ ID NO: 408340 - protein, 9 aa, Homo Sapiens
VFNYHLSPW

SEQ ID NO: 408341 - protein, 9 aa, Homo Sapiens
RSKKVSTRK

SEQ ID NO: 408342 - protein, 9 aa, Homo Sapiens
LGRKEQLRC

SEQ ID NO: 408343 - protein, 9 aa, Homo Sapiens
LSPVMLLSP

SEQ ID NO: 408344 - protein, 9 aa, Homo Sapiens
MRAGTCNIY

SEQ ID NO: 408345 - protein, 9 aa, Homo Sapiens
CLPHCSSPS

SEQ ID NO: 408346 - protein, 9 aa, Homo Sapiens
VIIPPGSSH

SEQ ID NO: 408347 - protein, 9 aa, Homo Sapiens
PDGFLPIFM

SEQ ID NO: 408348 - protein, 9 aa, Homo Sapiens
GSPLELEHL

SEQ ID NO: 408349 - protein, 9 aa, Homo Sapiens
TEKEDPVGQ

SEQ ID NO: 408350 - protein, 9 aa, Homo Sapiens
AAGGDQRRH

SEQ ID NO: 408351 - protein, 9 aa, Homo Sapiens
HCVALPDEQ

SEQ ID NO: 408352 - protein, 9 aa, Homo Sapiens
AYCCSACHS

SEQ ID NO: 408353 - protein, 9 aa, Homo Sapiens
PGGSSSGSP

SEQ ID NO: 408354 - protein, 9 aa, Homo Sapiens
TATSCGSRA

SEQ ID NO: 408355 - protein, 9 aa, Homo Sapiens
VKKRKKREK

SEQ ID NO: 408356 - protein, 9 aa, Homo Sapiens
QAVSDEDGV

SEQ ID NO: 408357 - protein, 9 aa, Homo Sapiens
EGSECPGPK

SEQ ID NO: 408358 - protein, 9 aa, Homo Sapiens
SGGRQDLPP

SEQ ID NO: 408359 - protein, 9 aa, Homo Sapiens
PGKFLLGHR

SEQ ID NO: 408360 - protein, 9 aa, Homo Sapiens
ISTGGIIDP

SEQ ID NO: 408361 - protein, 9 aa, Homo Sapiens
GGGPSSSHR

SEQ ID NO: 408362 - protein, 9 aa, Homo Sapiens
PLATWWTSG

SEQ ID NO: 408363 - protein, 9 aa, Homo Sapiens
SHPGGSARI

SEQ ID NO: 408364 - protein, 9 aa, Homo Sapiens
LHNPPSWRE

SEQ ID NO: 408365 - protein, 9 aa, Homo Sapiens
KAREEGYYY

SEQ ID NO: 408366 - protein, 9 aa, Homo Sapiens
SEVVFWMTS

SEQ ID NO: 408367 - protein, 9 aa, Homo Sapiens
ISSSTPSGH

SEQ ID NO: 408368 - protein, 9 aa, Homo Sapiens
RTHGTLGVS

SEQ ID NO: 408369 - protein, 9 aa, Homo Sapiens
LRTPLNIID

SEQ ID NO: 408370 - protein, 9 aa, Homo Sapiens
RHIHHLGDQ

SEQ ID NO: 408371 - protein, 9 aa, Homo Sapiens
GSARIVVSS

SEQ ID NO: 408372 - protein, 9 aa, Homo Sapiens
VALVFAQVR

SEQ ID NO: 408373 - protein, 9 aa, Homo Sapiens
LRPTPPMPM

SEQ ID NO: 408374 - protein, 9 aa, Homo Sapiens
TVTSLGVMV

SEQ ID NO: 408375 - protein, 9 aa, Homo Sapiens
NGKKSITHN

SEQ ID NO: 408376 - protein, 9 aa, Homo Sapiens
PMHPLVSAG

SEQ ID NO: 408377 - protein, 9 aa, Homo Sapiens
QFKHTVLIT

SEQ ID NO: 408378 - protein, 9 aa, Homo Sapiens
KLLYGKKAE

SEQ ID NO: 408379 - protein, 9 aa, Homo Sapiens
ASAVGVTAV

SEQ ID NO: 408380 - protein, 9 aa, Homo Sapiens
YRVTKCVEL

SEQ ID NO: 408381 - protein, 9 aa, Homo Sapiens
NKKNLPEGK

SEQ ID NO: 408382 - protein, 9 aa, Homo Sapiens
IALTNIMGF

SEQ ID NO: 408383 - protein, 9 aa, Homo Sapiens
SFNADKTDV

SEQ ID NO: 408384 - protein, 9 aa, Homo Sapiens
RLTRDKYTY

SEQ ID NO: 408385 - protein, 9 aa, Homo Sapiens
FLLPASACA

SEQ ID NO: 408386 - protein, 9 aa, Homo Sapiens
RAIQLKPNE

SEQ ID NO: 408387 - protein, 9 aa, Homo Sapiens
PVKSFSLGP

SEQ ID NO: 408388 - protein, 9 aa, Homo Sapiens
LKEIMKHDI

SEQ ID NO: 408389 - protein, 9 aa, Homo Sapiens
RCTCTTTRW

SEQ ID NO: 408390 - protein, 9 aa, Homo Sapiens
LVYVVIRIF

SEQ ID NO: 408391 - protein, 9 aa, Homo Sapiens
QYMPQNRQS

SEQ ID NO: 408392 - protein, 9 aa, Homo Sapiens
RGLQIQEKS

SEQ ID NO: 408393 - protein, 9 aa, Homo Sapiens
VVLYSVEEQ

SEQ ID NO: 408394 - protein, 9 aa, Homo Sapiens
LSQCKGLNY

SEQ ID NO: 408395 - protein, 9 aa, Homo Sapiens
HPSFFLHPQ

SEQ ID NO: 408396 - protein, 9 aa, Homo Sapiens
TRLAGDKVN

SEQ ID NO: 408397 - protein, 9 aa, Homo Sapiens
RPLDNSFYV

SEQ ID NO: 408398 - protein, 9 aa, Homo Sapiens
AMKDKCRYQ

SEQ ID NO: 408399 - protein, 9 aa, Homo Sapiens
KNKRPAHHR

SEQ ID NO: 408400 - protein, 9 aa, Homo Sapiens
SSGSRRRCI

SEQ ID NO: 408401 - protein, 9 aa, Homo Sapiens
KVCGRGWQA

SEQ ID NO: 408402 - protein, 9 aa, Homo Sapiens
EVRMLMLLY

SEQ ID NO: 408403 - protein, 9 aa, Homo Sapiens
TMARGRRGL

SEQ ID NO: 408404 - protein, 9 aa, Homo Sapiens
EETAQTIAS

SEQ ID NO: 408405 - protein, 9 aa, Homo Sapiens
DILADSCHL

SEQ ID NO: 408406 - protein, 9 aa, Homo Sapiens
SAAAGVPRT

SEQ ID NO: 408407 - protein, 9 aa, Homo Sapiens
PHHPQRCGR

SEQ ID NO: 408408 - protein, 9 aa, Homo Sapiens
VDVVLKVET

SEQ ID NO: 408409 - protein, 9 aa, Homo Sapiens
PVAGTSLQE

SEQ ID NO: 408410 - protein, 9 aa, Homo Sapiens
KFRPTLPPG

SEQ ID NO: 408411 - protein, 9 aa, Homo Sapiens
TYERMFHWL

SEQ ID NO: 408412 - protein, 9 aa, Homo Sapiens
CVFLVRRFC

SEQ ID NO: 408413 - protein, 9 aa, Homo Sapiens
ILERGQIQL

SEQ ID NO: 408414 - protein, 9 aa, Homo Sapiens
SSCGWAPFS

SEQ ID NO: 408415 - protein, 9 aa, Homo Sapiens
LWKQKKLRM

SEQ ID NO: 408416 - protein, 9 aa, Homo Sapiens
NGAPAPHPA

SEQ ID NO: 408417 - protein, 9 aa, Homo Sapiens
EQSKTEEGP

SEQ ID NO: 408418 - protein, 9 aa, Homo Sapiens
QSPFSQLIC

SEQ ID NO: 408419 - protein, 9 aa, Homo Sapiens
VHGRTRTST

SEQ ID NO: 408420 - protein, 9 aa, Homo Sapiens
ESVEVHPFN

SEQ ID NO: 408421 - protein, 9 aa, Homo Sapiens
FTIDLVTTC

SEQ ID NO: 408422 - protein, 9 aa, Homo Sapiens
GQYPRIERY

SEQ ID NO: 408423 - protein, 9 aa, Homo Sapiens
YHEPLEDDK

SEQ ID NO: 408424 - protein, 9 aa, Homo Sapiens
VCREPLVDS

SEQ ID NO: 408425 - protein, 9 aa, Homo Sapiens
TDDDDSHCS

SEQ ID NO: 408426 - protein, 9 aa, Homo Sapiens
IILFIIMPI

SEQ ID NO: 408427 - protein, 9 aa, Homo Sapiens
KLALCASSQ

SEQ ID NO: 408428 - protein, 9 aa, Homo Sapiens
IFFCMDKDI

SEQ ID NO: 408429 - protein, 9 aa, Homo Sapiens
AVFTKLRRA

SEQ ID NO: 408430 - protein, 9 aa, Homo Sapiens
GVLQAKADS

SEQ ID NO: 408431 - protein, 9 aa, Homo Sapiens
LSSCGCSAP

SEQ ID NO: 408432 - protein, 9 aa, Homo Sapiens
ELSHTLYQH

SEQ ID NO: 408433 - protein, 9 aa, Homo Sapiens
PWTFPRYPG

SEQ ID NO: 408434 - protein, 9 aa, Homo Sapiens
QPLHYTLVM

SEQ ID NO: 408435 - protein, 9 aa, Homo Sapiens
PGTTPPGRS

SEQ ID NO: 408436 - protein, 9 aa, Homo Sapiens
PAHPQDPNP

SEQ ID NO: 408437 - protein, 9 aa, Homo Sapiens
QIGAMLMVI

SEQ ID NO: 408438 - protein, 9 aa, Homo Sapiens
ISRQQYCRA

SEQ ID NO: 408439 - protein, 9 aa, Homo Sapiens
NHFHKIRNR

SEQ ID NO: 408440 - protein, 9 aa, Homo Sapiens
IINPTISCP

SEQ ID NO: 408441 - protein, 9 aa, Homo Sapiens
ISNTNHHKQ

SEQ ID NO: 408442 - protein, 9 aa, Homo Sapiens
DRIITEKAM

SEQ ID NO: 408443 - protein, 9 aa, Homo Sapiens
SKSGFRLRL

SEQ ID NO: 408444 - protein, 9 aa, Homo Sapiens
LPLLIPMYF

SEQ ID NO: 408445 - protein, 9 aa, Homo Sapiens
YLDNLTYRD

SEQ ID NO: 408446 - protein, 9 aa, Homo Sapiens
HLYTCGTGA

SEQ ID NO: 408447 - protein, 9 aa, Homo Sapiens
TSRASKKFI

SEQ ID NO: 408448 - protein, 9 aa, Homo Sapiens
KVDRLEVWL

SEQ ID NO: 408449 - protein, 9 aa, Homo Sapiens
VVPVSILLH

SEQ ID NO: 408450 - protein, 9 aa, Homo Sapiens
SVNGMAAPL

SEQ ID NO: 408451 - protein, 9 aa, Homo Sapiens
DAQCSGPGG

SEQ ID NO: 408452 - protein, 9 aa, Homo Sapiens
FKRYEELEI

SEQ ID NO: 408453 - protein, 9 aa, Homo Sapiens
QDCEETLPA

SEQ ID NO: 408454 - protein, 9 aa, Homo Sapiens
ICAPEKHTI

SEQ ID NO: 408455 - protein, 9 aa, Homo Sapiens
QRGLPGNWE

SEQ ID NO: 408456 - protein, 9 aa, Homo Sapiens
LQLGDAGVF

SEQ ID NO: 408457 - protein, 9 aa, Homo Sapiens
DKQKSTLID

SEQ ID NO: 408458 - protein, 9 aa, Homo Sapiens
QNPATAGAS

SEQ ID NO: 408459 - protein, 9 aa, Homo Sapiens
LFHPMKLQR

SEQ ID NO: 408460 - protein, 9 aa, Homo Sapiens
GAVATVLGL

SEQ ID NO: 408461 - protein, 9 aa, Homo Sapiens
YQIPLRVFH

SEQ ID NO: 408462 - protein, 9 aa, Homo Sapiens
MALAQRKEE

SEQ ID NO: 408463 - protein, 9 aa, Homo Sapiens
KLQKDRHRE

SEQ ID NO: 408464 - protein, 9 aa, Homo Sapiens
ECRDSFKKQ

SEQ ID NO: 408465 - protein, 9 aa, Homo Sapiens
GQRCRCVCL

SEQ ID NO: 408466 - protein, 9 aa, Homo Sapiens
CRALLHKPE

SEQ ID NO: 408467 - protein, 9 aa, Homo Sapiens
RCCRCLHFA

SEQ ID NO: 408468 - protein, 9 aa, Homo Sapiens
SAQDTYMDS

SEQ ID NO: 408469 - protein, 9 aa, Homo Sapiens
SLVSLSSSS

SEQ ID NO: 408470 - protein, 9 aa, Homo Sapiens
HPDVLEEPD

SEQ ID NO: 408471 - protein, 9 aa, Homo Sapiens
TFNKKNLPE

SEQ ID NO: 408472 - protein, 9 aa, Homo Sapiens
VVTGCLLLV

SEQ ID NO: 408473 - protein, 9 aa, Homo Sapiens
RKIRRPLRG

SEQ ID NO: 408474 - protein, 9 aa, Homo Sapiens
LVAPSLNGI

SEQ ID NO: 408475 - protein, 9 aa, Homo Sapiens
SVDAKKDPA

SEQ ID NO: 408476 - protein, 9 aa, Homo Sapiens
NREKQAPAF

SEQ ID NO: 408477 - protein, 9 aa, Homo Sapiens
VYLLCELLS

SEQ ID NO: 408478 - protein, 9 aa, Homo Sapiens
PIYAEDGDH

SEQ ID NO: 408479 - protein, 9 aa, Homo Sapiens
QPPGTPQPV

SEQ ID NO: 408480 - protein, 9 aa, Homo Sapiens
FDIVFLIAG

SEQ ID NO: 408481 - protein, 9 aa, Homo Sapiens
IVPRIGHDE

SEQ ID NO: 408482 - protein, 9 aa, Homo Sapiens
LQPHRRRPS

SEQ ID NO: 408483 - protein, 9 aa, Homo Sapiens
MVETIPCRG

SEQ ID NO: 408484 - protein, 9 aa, Homo Sapiens
GGRGTAGGD

SEQ ID NO: 408485 - protein, 9 aa, Homo Sapiens
QSALCVACC

SEQ ID NO: 408486 - protein, 9 aa, Homo Sapiens
HGTLGVSQQ

SEQ ID NO: 408487 - protein, 9 aa, Homo Sapiens
NSHRATSNT

SEQ ID NO: 408488 - protein, 9 aa, Homo Sapiens
DMSLGLLTK

SEQ ID NO: 408489 - protein, 9 aa, Homo Sapiens
FRRSHCQMS

SEQ ID NO: 408490 - protein, 9 aa, Homo Sapiens
IRTKLTDIQ

SEQ ID NO: 408491 - protein, 9 aa, Homo Sapiens
ESLEMDLDE

SEQ ID NO: 408492 - protein, 9 aa, Homo Sapiens
RLPLGQGAG

SEQ ID NO: 408493 - protein, 9 aa, Homo Sapiens
HMNLADSTL

SEQ ID NO: 408494 - protein, 9 aa, Homo Sapiens
IRCGLDCFK

SEQ ID NO: 408495 - protein, 9 aa, Homo Sapiens
AGCAKDRKD

SEQ ID NO: 408496 - protein, 9 aa, Homo Sapiens
APRGLLCPA

SEQ ID NO: 408497 - protein, 9 aa, Homo Sapiens
RGRGWTACA

SEQ ID NO: 408498 - protein, 9 aa, Homo Sapiens
GNLGETESA

SEQ ID NO: 408499 - protein, 9 aa, Homo Sapiens
LTMRRNSEY

SEQ ID NO: 408500 - protein, 9 aa, Homo Sapiens
WRPTRRPRR

SEQ ID NO: 408501 - protein, 9 aa, Homo Sapiens
HLEILPSGV

SEQ ID NO: 408502 - protein, 9 aa, Homo Sapiens
ENGRGHHHP

SEQ ID NO: 408503 - protein, 9 aa, Homo Sapiens
GKCFIYRQD

SEQ ID NO: 408504 - protein, 9 aa, Homo Sapiens
RVDIAKLQH

SEQ ID NO: 408505 - protein, 9 aa, Homo Sapiens
QLCHCARVC

SEQ ID NO: 408506 - protein, 9 aa, Homo Sapiens
DGYMQADAR

SEQ ID NO: 408507 - protein, 9 aa, Homo Sapiens
AERGVHIVS

SEQ ID NO: 408508 - protein, 9 aa, Homo Sapiens
AAGGGAASR

SEQ ID NO: 408509 - protein, 9 aa, Homo Sapiens
FHGEQLREQ

SEQ ID NO: 408510 - protein, 9 aa, Homo Sapiens
QERWQVTAE

SEQ ID NO: 408511 - protein, 9 aa, Homo Sapiens
QVAVGYRAD

SEQ ID NO: 408512 - protein, 9 aa, Homo Sapiens
TFHIIAITC

SEQ ID NO: 408513 - protein, 9 aa, Homo Sapiens
DVNEGGKEV

SEQ ID NO: 408514 - protein, 9 aa, Homo Sapiens
VACCLLTSL

SEQ ID NO: 408515 - protein, 9 aa, Homo Sapiens
IQSQSSTSI

SEQ ID NO: 408516 - protein, 9 aa, Homo Sapiens
SLKSHQGMV

SEQ ID NO: 408517 - protein, 9 aa, Homo Sapiens
SQRCHRAVM

SEQ ID NO: 408518 - protein, 9 aa, Homo Sapiens
EVWALYPLY

SEQ ID NO: 408519 - protein, 9 aa, Homo Sapiens
RRTWSSLRR

SEQ ID NO: 408520 - protein, 9 aa, Homo Sapiens
LELTQRLSN

SEQ ID NO: 408521 - protein, 9 aa, Homo Sapiens
TSLAALFMS

SEQ ID NO: 408522 - protein, 9 aa, Homo Sapiens
SRGTSWMSS

SEQ ID NO: 408523 - protein, 9 aa, Homo Sapiens
EEGHGGGGS

SEQ ID NO: 408524 - protein, 9 aa, Homo Sapiens
SPVVNVLFR

SEQ ID NO: 408525 - protein, 9 aa, Homo Sapiens
VCWEFVTDD

SEQ ID NO: 408526 - protein, 9 aa, Homo Sapiens
LQDLEKERK

SEQ ID NO: 408527 - protein, 9 aa, Homo Sapiens
KHFIPQMTT

SEQ ID NO: 408528 - protein, 9 aa, Homo Sapiens
RMKKMIGMR

SEQ ID NO: 408529 - protein, 9 aa, Homo Sapiens
VVIRIFCLA

SEQ ID NO: 408530 - protein, 9 aa, Homo Sapiens
AASCLLPPA

SEQ ID NO: 408531 - protein, 9 aa, Homo Sapiens
SSHPSFLQP

SEQ ID NO: 408532 - protein, 9 aa, Homo Sapiens
RRQSWLRPS

SEQ ID NO: 408533 - protein, 9 aa, Homo Sapiens
RAHERPHPI

SEQ ID NO: 408534 - protein, 9 aa, Homo Sapiens
SHRATSNTE

SEQ ID NO: 408535 - protein, 9 aa, Homo Sapiens
EGQAAFWRS

SEQ ID NO: 408536 - protein, 9 aa, Homo Sapiens
RPRPRCCAA

SEQ ID NO: 408537 - protein, 9 aa, Homo Sapiens
PPGDGYMQA

SEQ ID NO: 408538 - protein, 9 aa, Homo Sapiens
SLFEALGYM

SEQ ID NO: 408539 - protein, 9 aa, Homo Sapiens
DGSANHRAW

SEQ ID NO: 408540 - protein, 9 aa, Homo Sapiens
GESVCNACG

SEQ ID NO: 408541 - protein, 9 aa, Homo Sapiens
YEGGFPYLI

SEQ ID NO: 408542 - protein, 9 aa, Homo Sapiens
TEATAAAPQ

SEQ ID NO: 408543 - protein, 9 aa, Homo Sapiens
CLKVVKYPL

SEQ ID NO: 408544 - protein, 9 aa, Homo Sapiens
IPERIQSGL

SEQ ID NO: 408545 - protein, 9 aa, Homo Sapiens
EFTSKDKKR

SEQ ID NO: 408546 - protein, 9 aa, Homo Sapiens
LALPWELFL

SEQ ID NO: 408547 - protein, 9 aa, Homo Sapiens
RRRARPGQL

SEQ ID NO: 408548 - protein, 9 aa, Homo Sapiens
TLRGLLQDH

SEQ ID NO: 408549 - protein, 9 aa, Homo Sapiens
LNALLGKDT

SEQ ID NO: 408550 - protein, 9 aa, Homo Sapiens
DPEAAAAST

SEQ ID NO: 408551 - protein, 9 aa, Homo Sapiens
HCAHLAKQT

SEQ ID NO: 408552 - protein, 9 aa, Homo Sapiens
VLIPTSAAS

SEQ ID NO: 408553 - protein, 9 aa, Homo Sapiens
YGTQEAVIA

SEQ ID NO: 408554 - protein, 9 aa, Homo Sapiens
GAWTAEGAA

SEQ ID NO: 408555 - protein, 9 aa, Homo Sapiens
IEFRKWYST

SEQ ID NO: 408556 - protein, 9 aa, Homo Sapiens
WRHMLVIFT

SEQ ID NO: 408557 - protein, 9 aa, Homo Sapiens
LNNNELLLQ

SEQ ID NO: 408558 - protein, 9 aa, Homo Sapiens
PGKPGAGLA

SEQ ID NO: 408559 - protein, 9 aa, Homo Sapiens
PALRILLCR

SEQ ID NO: 408560 - protein, 9 aa, Homo Sapiens
DSGLDVDVV

SEQ ID NO: 408561 - protein, 9 aa, Homo Sapiens
TPPGRSLPA

SEQ ID NO: 408562 - protein, 9 aa, Homo Sapiens
ASQPRRTSA

SEQ ID NO: 408563 - protein, 9 aa, Homo Sapiens
QHVHSATLA

SEQ ID NO: 408564 - protein, 9 aa, Homo Sapiens
TVAVGCRRC

SEQ ID NO: 408565 - protein, 9 aa, Homo Sapiens
CSGQELVDG

SEQ ID NO: 408566 - protein, 9 aa, Homo Sapiens
GRYFVAFDG

SEQ ID NO: 408567 - protein, 9 aa, Homo Sapiens
TTTSSPRRS

SEQ ID NO: 408568 - protein, 9 aa, Homo Sapiens
PVTGNLHPE

SEQ ID NO: 408569 - protein, 9 aa, Homo Sapiens
HAFGPAVVA

SEQ ID NO: 408570 - protein, 9 aa, Homo Sapiens
AGISFSVKN

SEQ ID NO: 408571 - protein, 9 aa, Homo Sapiens
VALFVEANP

SEQ ID NO: 408572 - protein, 9 aa, Homo Sapiens
ETCSSSPWK

SEQ ID NO: 408573 - protein, 9 aa, Homo Sapiens
GVVGLFKTQ

SEQ ID NO: 408574 - protein, 9 aa, Homo Sapiens
TRTIIVNTD

SEQ ID NO: 408575 - protein, 9 aa, Homo Sapiens
MSLQHLSGP

SEQ ID NO: 408576 - protein, 9 aa, Homo Sapiens
GALLRLLSH

SEQ ID NO: 408577 - protein, 9 aa, Homo Sapiens
PAVPLGPAR

SEQ ID NO: 408578 - protein, 9 aa, Homo Sapiens
GELFTKNLY

SEQ ID NO: 408579 - protein, 9 aa, Homo Sapiens
RRPLAASSS

SEQ ID NO: 408580 - protein, 9 aa, Homo Sapiens
GRGASLSGT

SEQ ID NO: 408581 - protein, 9 aa, Homo Sapiens
ITVSFVGQI

SEQ ID NO: 408582 - protein, 9 aa, Homo Sapiens
SLLSRMPAR

SEQ ID NO: 408583 - protein, 9 aa, Homo Sapiens
LLRFCRPSL

SEQ ID NO: 408584 - protein, 9 aa, Homo Sapiens
SQCNLAAGP

SEQ ID NO: 408585 - protein, 9 aa, Homo Sapiens
GDAGVFGPE

SEQ ID NO: 408586 - protein, 9 aa, Homo Sapiens
MVWMMAGIP

SEQ ID NO: 408587 - protein, 9 aa, Homo Sapiens
AGPHPEGLH

SEQ ID NO: 408588 - protein, 9 aa, Homo Sapiens
VGPELLSPP

SEQ ID NO: 408589 - protein, 9 aa, Homo Sapiens
HQVLGITVL

SEQ ID NO: 408590 - protein, 9 aa, Homo Sapiens
KQRAVSVTL

SEQ ID NO: 408591 - protein, 9 aa, Homo Sapiens
NPAAQDGAR

SEQ ID NO: 408592 - protein, 9 aa, Homo Sapiens
GRLESSLRP

SEQ ID NO: 408593 - protein, 9 aa, Homo Sapiens
EMKGRKKIK

SEQ ID NO: 408594 - protein, 9 aa, Homo Sapiens
KAVAPLVCY

SEQ ID NO: 408595 - protein, 9 aa, Homo Sapiens
ISDGSVDAL

SEQ ID NO: 408596 - protein, 9 aa, Homo Sapiens
NGLDVTQRD

SEQ ID NO: 408597 - protein, 9 aa, Homo Sapiens
SPSLPSRWC

SEQ ID NO: 408598 - protein, 9 aa, Homo Sapiens
PWQKSPGNS

SEQ ID NO: 408599 - protein, 9 aa, Homo Sapiens
GLGGLRSAP

SEQ ID NO: 408600 - protein, 9 aa, Homo Sapiens
THLDLSKNQ

SEQ ID NO: 408601 - protein, 9 aa, Homo Sapiens
HHCIVGCSL

SEQ ID NO: 408602 - protein, 9 aa, Homo Sapiens
ERTALDGTE

SEQ ID NO: 408603 - protein, 9 aa, Homo Sapiens
QRILVATNL

SEQ ID NO: 408604 - protein, 9 aa, Homo Sapiens
TAWASAMPR

SEQ ID NO: 408605 - protein, 9 aa, Homo Sapiens
MTEKNQWCE

SEQ ID NO: 408606 - protein, 9 aa, Homo Sapiens
ELVVTAWDG

SEQ ID NO: 408607 - protein, 9 aa, Homo Sapiens
AGEKEDEKD

SEQ ID NO: 408608 - protein, 9 aa, Homo Sapiens
DFSNNWNSS

SEQ ID NO: 408609 - protein, 9 aa, Homo Sapiens
WQVTAEQSK

SEQ ID NO: 408610 - protein, 9 aa, Homo Sapiens
AAKIERTAL

SEQ ID NO: 408611 - protein, 9 aa, Homo Sapiens
LLINVQQLL

SEQ ID NO: 408612 - protein, 9 aa, Homo Sapiens
EKQISESTK

SEQ ID NO: 408613 - protein, 9 aa, Homo Sapiens
LQENEPTAT

SEQ ID NO: 408614 - protein, 9 aa, Homo Sapiens
QKSIIDAHA

SEQ ID NO: 408615 - protein, 9 aa, Homo Sapiens
KMLMKQQDW

SEQ ID NO: 408616 - protein, 9 aa, Homo Sapiens
WLGGGALSS

SEQ ID NO: 408617 - protein, 9 aa, Homo Sapiens
QWPGPGFTF

SEQ ID NO: 408618 - protein, 9 aa, Homo Sapiens
ADLLPVQEP

SEQ ID NO: 408619 - protein, 9 aa, Homo Sapiens
QQWEKTRWL

SEQ ID NO: 408620 - protein, 9 aa, Homo Sapiens
GMNMKMKTF

SEQ ID NO: 408621 - protein, 9 aa, Homo Sapiens
GDGHAAGGP

SEQ ID NO: 408622 - protein, 9 aa, Homo Sapiens
EATEKKIFF

SEQ ID NO: 408623 - protein, 9 aa, Homo Sapiens
GVINHVHVR

SEQ ID NO: 408624 - protein, 9 aa, Homo Sapiens
NVLFMTMGM

SEQ ID NO: 408625 - protein, 9 aa, Homo Sapiens
WECCMLVGY

SEQ ID NO: 408626 - protein, 9 aa, Homo Sapiens
PRMLGLALP

SEQ ID NO: 408627 - protein, 9 aa, Homo Sapiens
PVSKKDLHD

SEQ ID NO: 408628 - protein, 9 aa, Homo Sapiens
NVSTLELRD

SEQ ID NO: 408629 - protein, 9 aa, Homo Sapiens
TQRLSNRIL

SEQ ID NO: 408630 - protein, 9 aa, Homo Sapiens
WQRRYFYPF

SEQ ID NO: 408631 - protein, 9 aa, Homo Sapiens
VGERCLESL

SEQ ID NO: 408632 - protein, 9 aa, Homo Sapiens
LVNAFLLKM

SEQ ID NO: 408633 - protein, 9 aa, Homo Sapiens
DPDDHGGWG

SEQ ID NO: 408634 - protein, 9 aa, Homo Sapiens
EGLKMSFLP

SEQ ID NO: 408635 - protein, 9 aa, Homo Sapiens
DAADDIVDI

SEQ ID NO: 408636 - protein, 9 aa, Homo Sapiens
AFDRSHRDA

SEQ ID NO: 408637 - protein, 9 aa, Homo Sapiens
GIMVPPVQQ

SEQ ID NO: 408638 - protein, 9 aa, Homo Sapiens
LYKHTAMVD

SEQ ID NO: 408639 - protein, 9 aa, Homo Sapiens
ALSTAQKQR

SEQ ID NO: 408640 - protein, 9 aa, Homo Sapiens
PRPRPRCCA

SEQ ID NO: 408641 - protein, 9 aa, Homo Sapiens
NDASPPSAC

SEQ ID NO: 408642 - protein, 9 aa, Homo Sapiens
YYDRIIDQT

SEQ ID NO: 408643 - protein, 9 aa, Homo Sapiens
ERVLLKAQA

SEQ ID NO: 408644 - protein, 9 aa, Homo Sapiens
RETYCACRA

SEQ ID NO: 408645 - protein, 9 aa, Homo Sapiens
LQLCHNRIR

SEQ ID NO: 408646 - protein, 9 aa, Homo Sapiens
TGDNGQWAQ

SEQ ID NO: 408647 - protein, 9 aa, Homo Sapiens
QQRILVATN

SEQ ID NO: 408648 - protein, 9 aa, Homo Sapiens
LDAKTMTAE

SEQ ID NO: 408649 - protein, 9 aa, Homo Sapiens
DPTSSSFSK

SEQ ID NO: 408650 - protein, 9 aa, Homo Sapiens
CQCRAPWSP

SEQ ID NO: 408651 - protein, 9 aa, Homo Sapiens
NWNSSTQWG

SEQ ID NO: 408652 - protein, 9 aa, Homo Sapiens
MSQQYGDML

SEQ ID NO: 408653 - protein, 9 aa, Homo Sapiens
HGGGGSAAG

SEQ ID NO: 408654 - protein, 9 aa, Homo Sapiens
QCLTLDHRL

SEQ ID NO: 408655 - protein, 9 aa, Homo Sapiens
MPRTLEGCI

SEQ ID NO: 408656 - protein, 9 aa, Homo Sapiens
GALPSTMRS

SEQ ID NO: 408657 - protein, 9 aa, Homo Sapiens
AVSTSSPEK

SEQ ID NO: 408658 - protein, 9 aa, Homo Sapiens
LFSSEATHR

SEQ ID NO: 408659 - protein, 9 aa, Homo Sapiens
ADATFAATG

SEQ ID NO: 408660 - protein, 9 aa, Homo Sapiens
TLIDALCRK

SEQ ID NO: 408661 - protein, 9 aa, Homo Sapiens
LTLTPGGSS

SEQ ID NO: 408662 - protein, 9 aa, Homo Sapiens
STKGMLQKF

SEQ ID NO: 408663 - protein, 9 aa, Homo Sapiens
GPFLHCVAL

SEQ ID NO: 408664 - protein, 9 aa, Homo Sapiens
EEVAAFQKE

SEQ ID NO: 408665 - protein, 9 aa, Homo Sapiens
CPAVPLGPA

SEQ ID NO: 408666 - protein, 9 aa, Homo Sapiens
LGSLAVATA

SEQ ID NO: 408667 - protein, 9 aa, Homo Sapiens
PDSQFVCVE

SEQ ID NO: 408668 - protein, 9 aa, Homo Sapiens
TGACTANMP

SEQ ID NO: 408669 - protein, 9 aa, Homo Sapiens
ASPPSACTR

SEQ ID NO: 408670 - protein, 9 aa, Homo Sapiens
HGYHKMELP

SEQ ID NO: 408671 - protein, 9 aa, Homo Sapiens
LGLQWVVHL

SEQ ID NO: 408672 - protein, 9 aa, Homo Sapiens
RCCCSGNDG

SEQ ID NO: 408673 - protein, 9 aa, Homo Sapiens
HPGMWSSPL

SEQ ID NO: 408674 - protein, 9 aa, Homo Sapiens
HTVLHQNAP

SEQ ID NO: 408675 - protein, 9 aa, Homo Sapiens
TGLIKSQRK

SEQ ID NO: 408676 - protein, 9 aa, Homo Sapiens
LQSWSSPLP

SEQ ID NO: 408677 - protein, 9 aa, Homo Sapiens
LPVRARTAR

SEQ ID NO: 408678 - protein, 9 aa, Homo Sapiens
ISLNSAHFN

SEQ ID NO: 408679 - protein, 9 aa, Homo Sapiens
TALRPGNPT

SEQ ID NO: 408680 - protein, 9 aa, Homo Sapiens
HVHVRVDHR

SEQ ID NO: 408681 - protein, 9 aa, Homo Sapiens
KGEQVFHLA

SEQ ID NO: 408682 - protein, 9 aa, Homo Sapiens
NKLESTACP

SEQ ID NO: 408683 - protein, 9 aa, Homo Sapiens
VNWKVLERR

SEQ ID NO: 408684 - protein, 9 aa, Homo Sapiens
TPLNIIDIL

SEQ ID NO: 408685 - protein, 9 aa, Homo Sapiens
TSGPTARST

SEQ ID NO: 408686 - protein, 9 aa, Homo Sapiens
SDAGHVAAV

SEQ ID NO: 408687 - protein, 9 aa, Homo Sapiens
FTITVCPKN

SEQ ID NO: 408688 - protein, 9 aa, Homo Sapiens
AYVFNTETH

SEQ ID NO: 408689 - protein, 9 aa, Homo Sapiens
QGRLQMWMD

SEQ ID NO: 408690 - protein, 9 aa, Homo Sapiens
GFQASHATV

SEQ ID NO: 408691 - protein, 9 aa, Homo Sapiens
SHVRKVNHF

SEQ ID NO: 408692 - protein, 9 aa, Homo Sapiens
KSSRPISFM

SEQ ID NO: 408693 - protein, 9 aa, Homo Sapiens
EVEVVWTVA

SEQ ID NO: 408694 - protein, 9 aa, Homo Sapiens
RSAACGGRE

SEQ ID NO: 408695 - protein, 9 aa, Homo Sapiens
SVQTKSASL

SEQ ID NO: 408696 - protein, 9 aa, Homo Sapiens
WVQMVVEKF

SEQ ID NO: 408697 - protein, 9 aa, Homo Sapiens
AICGLHYDI

SEQ ID NO: 408698 - protein, 9 aa, Homo Sapiens
DDRLYHRHC

SEQ ID NO: 408699 - protein, 9 aa, Homo Sapiens
STHLVFVKV

SEQ ID NO: 408700 - protein, 9 aa, Homo Sapiens
QVLFSSEAT

SEQ ID NO: 408701 - protein, 9 aa, Homo Sapiens
FLFTFLFLL

SEQ ID NO: 408702 - protein, 9 aa, Homo Sapiens
QELWLYDNH

SEQ ID NO: 408703 - protein, 9 aa, Homo Sapiens
FHVLFFTSL

SEQ ID NO: 408704 - protein, 9 aa, Homo Sapiens
GVTLKSPSC

SEQ ID NO: 408705 - protein, 9 aa, Homo Sapiens
HLAMDIDQL

SEQ ID NO: 408706 - protein, 9 aa, Homo Sapiens
PLLHPQWAP

SEQ ID NO: 408707 - protein, 9 aa, Homo Sapiens
GAGGSTASS

SEQ ID NO: 408708 - protein, 9 aa, Homo Sapiens
TQTADYPNI

SEQ ID NO: 408709 - protein, 9 aa, Homo Sapiens
QFCRQHRFL

SEQ ID NO: 408710 - protein, 9 aa, Homo Sapiens
LHVSAAGAL

SEQ ID NO: 408711 - protein, 9 aa, Homo Sapiens
RGEDPPQTS

SEQ ID NO: 408712 - protein, 9 aa, Homo Sapiens
CVALCTASM

SEQ ID NO: 408713 - protein, 9 aa, Homo Sapiens
LRDFEECRR

SEQ ID NO: 408714 - protein, 9 aa, Homo Sapiens
LYIYWVQWA

SEQ ID NO: 408715 - protein, 9 aa, Homo Sapiens
GGGSGGHSP

SEQ ID NO: 408716 - protein, 9 aa, Homo Sapiens
RQLEARHYS

SEQ ID NO: 408717 - protein, 9 aa, Homo Sapiens
RSWYNYMCN

SEQ ID NO: 408718 - protein, 9 aa, Homo Sapiens
STSSSMGSG

SEQ ID NO: 408719 - protein, 9 aa, Homo Sapiens
YLLQLSKLQ

SEQ ID NO: 408720 - protein, 9 aa, Homo Sapiens
NQEPFKVWL

SEQ ID NO: 408721 - protein, 9 aa, Homo Sapiens
SHSNLDTEV

SEQ ID NO: 408722 - protein, 9 aa, Homo Sapiens
AVSGCGRAP

SEQ ID NO: 408723 - protein, 9 aa, Homo Sapiens
GGGRGPSGS

SEQ ID NO: 408724 - protein, 9 aa, Homo Sapiens
QVLVRQVDR

SEQ ID NO: 408725 - protein, 9 aa, Homo Sapiens
RTIAHYDPA

SEQ ID NO: 408726 - protein, 9 aa, Homo Sapiens
SSLEAPPVG

SEQ ID NO: 408727 - protein, 9 aa, Homo Sapiens
FLGGDHYSH

SEQ ID NO: 408728 - protein, 9 aa, Homo Sapiens
EPGPSTGAC

SEQ ID NO: 408729 - protein, 9 aa, Homo Sapiens
ATCPPPRRG

SEQ ID NO: 408730 - protein, 9 aa, Homo Sapiens
NGLMDLDIK

SEQ ID NO: 408731 - protein, 9 aa, Homo Sapiens
IEQEIRLAQ

SEQ ID NO: 408732 - protein, 9 aa, Homo Sapiens
ATLRCPAVP

SEQ ID NO: 408733 - protein, 9 aa, Homo Sapiens
DEAGVTHTA

SEQ ID NO: 408734 - protein, 9 aa, Homo Sapiens
PVLSSLHRA

SEQ ID NO: 408735 - protein, 9 aa, Homo Sapiens
KKVEIEMDY

SEQ ID NO: 408736 - protein, 9 aa, Homo Sapiens
VSKEWGEKL

SEQ ID NO: 408737 - protein, 9 aa, Homo Sapiens
VLPLSLQWN

SEQ ID NO: 408738 - protein, 9 aa, Homo Sapiens
GTHSPRATA

SEQ ID NO: 408739 - protein, 9 aa, Homo Sapiens
KNETFVMTQ

SEQ ID NO: 408740 - protein, 9 aa, Homo Sapiens
ELRLENDYL

SEQ ID NO: 408741 - protein, 9 aa, Homo Sapiens
HYLHIQSLL

SEQ ID NO: 408742 - protein, 9 aa, Homo Sapiens
MAHVINGGD

SEQ ID NO: 408743 - protein, 9 aa, Homo Sapiens
HRSPTTAPW

SEQ ID NO: 408744 - protein, 9 aa, Homo Sapiens
NMVDLLDPY

SEQ ID NO: 408745 - protein, 9 aa, Homo Sapiens
VTHYHCTHE

SEQ ID NO: 408746 - protein, 9 aa, Homo Sapiens
CPEDFKGIQ

SEQ ID NO: 408747 - protein, 9 aa, Homo Sapiens
PFCADQFCR

SEQ ID NO: 408748 - protein, 9 aa, Homo Sapiens
SLLSPCNAS

SEQ ID NO: 408749 - protein, 9 aa, Homo Sapiens
FFTIGITWI

SEQ ID NO: 408750 - protein, 9 aa, Homo Sapiens
PNLQELWLY

SEQ ID NO: 408751 - protein, 9 aa, Homo Sapiens
SGSVVWKKW

SEQ ID NO: 408752 - protein, 9 aa, Homo Sapiens
VLTLYLWIW

SEQ ID NO: 408753 - protein, 9 aa, Homo Sapiens
TFSISSSTP

SEQ ID NO: 408754 - protein, 9 aa, Homo Sapiens
LQNRYLVIS

SEQ ID NO: 408755 - protein, 9 aa, Homo Sapiens
QMVGGSLSS

SEQ ID NO: 408756 - protein, 9 aa, Homo Sapiens
APETRVPVP

SEQ ID NO: 408757 - protein, 9 aa, Homo Sapiens
LDQLTVSPA

SEQ ID NO: 408758 - protein, 9 aa, Homo Sapiens
RPVATLSPG

SEQ ID NO: 408759 - protein, 9 aa, Homo Sapiens
SSAPFAPSL

SEQ ID NO: 408760 - protein, 9 aa, Homo Sapiens
EDYGLSVTK

SEQ ID NO: 408761 - protein, 9 aa, Homo Sapiens
VQPGIVQCG

SEQ ID NO: 408762 - protein, 9 aa, Homo Sapiens
LLIGGRGQK

SEQ ID NO: 408763 - protein, 9 aa, Homo Sapiens
TAQTIASYG

SEQ ID NO: 408764 - protein, 9 aa, Homo Sapiens
GIMFGSFLL

SEQ ID NO: 408765 - protein, 9 aa, Homo Sapiens
ALVYSLCIA

SEQ ID NO: 408766 - protein, 9 aa, Homo Sapiens
LQAGPPGTV

SEQ ID NO: 408767 - protein, 9 aa, Homo Sapiens
ISDKSIEHQ

SEQ ID NO: 408768 - protein, 9 aa, Homo Sapiens
KQPNAVHPQ

SEQ ID NO: 408769 - protein, 9 aa, Homo Sapiens
AAVAGAWSG

SEQ ID NO: 408770 - protein, 9 aa, Homo Sapiens
PPPPEGAAQ

SEQ ID NO: 408771 - protein, 9 aa, Homo Sapiens
SSCCQQPSC

SEQ ID NO: 408772 - protein, 9 aa, Homo Sapiens
AAWHDGLDW

SEQ ID NO: 408773 - protein, 9 aa, Homo Sapiens
QVTAEQSKA

SEQ ID NO: 408774 - protein, 9 aa, Homo Sapiens
SVRVCRAAG

SEQ ID NO: 408775 - protein, 9 aa, Homo Sapiens
HLLLPGSRG

SEQ ID NO: 408776 - protein, 9 aa, Homo Sapiens
PSRNDKHVM

SEQ ID NO: 408777 - protein, 9 aa, Homo Sapiens
RSCCWATTC

SEQ ID NO: 408778 - protein, 9 aa, Homo Sapiens
ERGNGSNSF

SEQ ID NO: 408779 - protein, 9 aa, Homo Sapiens
GCYGCCGSC

SEQ ID NO: 408780 - protein, 9 aa, Homo Sapiens
ALHELIHNH

SEQ ID NO: 408781 - protein, 9 aa, Homo Sapiens
ALPWELFLI

SEQ ID NO: 408782 - protein, 9 aa, Homo Sapiens
FSVKNKERQ

SEQ ID NO: 408783 - protein, 9 aa, Homo Sapiens
SKRVNEVIV

SEQ ID NO: 408784 - protein, 9 aa, Homo Sapiens
ATLTRPPRT

SEQ ID NO: 408785 - protein, 9 aa, Homo Sapiens
GVIPPAVCG

SEQ ID NO: 408786 - protein, 9 aa, Homo Sapiens
WRRGALPST

SEQ ID NO: 408787 - protein, 9 aa, Homo Sapiens
LSLPPACTW

SEQ ID NO: 408788 - protein, 9 aa, Homo Sapiens
TASLSQRQD

SEQ ID NO: 408789 - protein, 9 aa, Homo Sapiens
REDDETEEG

SEQ ID NO: 408790 - protein, 9 aa, Homo Sapiens
VLLRFCRPS

SEQ ID NO: 408791 - protein, 9 aa, Homo Sapiens
VNLHTRRVD

SEQ ID NO: 408792 - protein, 9 aa, Homo Sapiens
RRCSGLSVS

SEQ ID NO: 408793 - protein, 9 aa, Homo Sapiens
GEQIYQHVH

SEQ ID NO: 408794 - protein, 9 aa, Homo Sapiens
HLGLQWVVH

SEQ ID NO: 408795 - protein, 9 aa, Homo Sapiens
AIIAHVLFA

SEQ ID NO: 408796 - protein, 9 aa, Homo Sapiens
RNLKYKDFL

SEQ ID NO: 408797 - protein, 9 aa, Homo Sapiens
IRDHLLADG

SEQ ID NO: 408798 - protein, 9 aa, Homo Sapiens
VCGEGGGSG

SEQ ID NO: 408799 - protein, 9 aa, Homo Sapiens
NFTSVTQAL

SEQ ID NO: 408800 - protein, 9 aa, Homo Sapiens
VNAGIKLAT

SEQ ID NO: 408801 - protein, 9 aa, Homo Sapiens
QWGSFPQHC

SEQ ID NO: 408802 - protein, 9 aa, Homo Sapiens
SLFWEKRYQ

SEQ ID NO: 408803 - protein, 9 aa, Homo Sapiens
LQLLAASSH

SEQ ID NO: 408804 - protein, 9 aa, Homo Sapiens
SVYLFMKWY

SEQ ID NO: 408805 - protein, 9 aa, Homo Sapiens
TYICGLPDG

SEQ ID NO: 408806 - protein, 9 aa, Homo Sapiens
DRRGNLRIH

SEQ ID NO: 408807 - protein, 9 aa, Homo Sapiens
HSQQPCQSG

SEQ ID NO: 408808 - protein, 9 aa, Homo Sapiens
KEENVILVW

SEQ ID NO: 408809 - protein, 9 aa, Homo Sapiens
SGQVHKDEA

SEQ ID NO: 408810 - protein, 9 aa, Homo Sapiens
SWLRPSDPE

SEQ ID NO: 408811 - protein, 9 aa, Homo Sapiens
MIRRGDVPQ

SEQ ID NO: 408812 - protein, 9 aa, Homo Sapiens
YYVTHLPVG

SEQ ID NO: 408813 - protein, 9 aa, Homo Sapiens
SHPSDHLEI

SEQ ID NO: 408814 - protein, 9 aa, Homo Sapiens
VEVSRPFYL

SEQ ID NO: 408815 - protein, 9 aa, Homo Sapiens
LVKTTNMLA

SEQ ID NO: 408816 - protein, 9 aa, Homo Sapiens
PQEMKSNTS

SEQ ID NO: 408817 - protein, 9 aa, Homo Sapiens
THLALATDQ

SEQ ID NO: 408818 - protein, 9 aa, Homo Sapiens
PALTFRIWH

SEQ ID NO: 408819 - protein, 9 aa, Homo Sapiens
PTSCPPLLE

SEQ ID NO: 408820 - protein, 9 aa, Homo Sapiens
SRMAKRVCK

SEQ ID NO: 408821 - protein, 9 aa, Homo Sapiens
FFIMIPIAG

SEQ ID NO: 408822 - protein, 9 aa, Homo Sapiens
NVFISSGRP

SEQ ID NO: 408823 - protein, 9 aa, Homo Sapiens
GPRLRVHSQ

SEQ ID NO: 408824 - protein, 9 aa, Homo Sapiens
VLGAPVPSN

SEQ ID NO: 408825 - protein, 9 aa, Homo Sapiens
PLASTPPPP

SEQ ID NO: 408826 - protein, 9 aa, Homo Sapiens
KKEIERRKL

SEQ ID NO: 408827 - protein, 9 aa, Homo Sapiens
VSLDLDLLA

SEQ ID NO: 408828 - protein, 9 aa, Homo Sapiens
RVRGRGWTA

SEQ ID NO: 408829 - protein, 9 aa, Homo Sapiens
FQGNNMQLA

SEQ ID NO: 408830 - protein, 9 aa, Homo Sapiens
VKREQLMPH

SEQ ID NO: 408831 - protein, 9 aa, Homo Sapiens
SPPLSRSSM

SEQ ID NO: 408832 - protein, 9 aa, Homo Sapiens
STTLPEELV

SEQ ID NO: 408833 - protein, 9 aa, Homo Sapiens
KLMNQNPNG

SEQ ID NO: 408834 - protein, 9 aa, Homo Sapiens
STISASFMQ

SEQ ID NO: 408835 - protein, 9 aa, Homo Sapiens
TIRLLVGGK

SEQ ID NO: 408836 - protein, 9 aa, Homo Sapiens
LLKSNLSKI

SEQ ID NO: 408837 - protein, 9 aa, Homo Sapiens
GMKDLALFS

SEQ ID NO: 408838 - protein, 9 aa, Homo Sapiens
DLLVSTEGE

SEQ ID NO: 408839 - protein, 9 aa, Homo Sapiens
KTRSAPFSP

SEQ ID NO: 408840 - protein, 9 aa, Homo Sapiens
RCPAVPAAA

SEQ ID NO: 408841 - protein, 9 aa, Homo Sapiens
FLPLAPASS

SEQ ID NO: 408842 - protein, 9 aa, Homo Sapiens
GNIIVITIN

SEQ ID NO: 408843 - protein, 9 aa, Homo Sapiens
EWVKWTKEE

SEQ ID NO: 408844 - protein, 9 aa, Homo Sapiens
SPSPRSSLP

SEQ ID NO: 408845 - protein, 9 aa, Homo Sapiens
TLEHHLSHY

SEQ ID NO: 408846 - protein, 9 aa, Homo Sapiens
RGGQRCRCV

SEQ ID NO: 408847 - protein, 9 aa, Homo Sapiens
SVPPVHHPW

SEQ ID NO: 408848 - protein, 9 aa, Homo Sapiens
LLVYVVIRI

SEQ ID NO: 408849 - protein, 9 aa, Homo Sapiens
ETKKAAAGS

SEQ ID NO: 408850 - protein, 9 aa, Homo Sapiens
PRTTELSTK

SEQ ID NO: 408851 - protein, 9 aa, Homo Sapiens
LAPFLGNFL

SEQ ID NO: 408852 - protein, 9 aa, Homo Sapiens
GQEERYELP

SEQ ID NO: 408853 - protein, 9 aa, Homo Sapiens
THGTLGVSQ

SEQ ID NO: 408854 - protein, 9 aa, Homo Sapiens
GRSCPEPRV

SEQ ID NO: 408855 - protein, 9 aa, Homo Sapiens
LCASSQDEA

SEQ ID NO: 408856 - protein, 9 aa, Homo Sapiens
VHSHGAGRD

SEQ ID NO: 408857 - protein, 9 aa, Homo Sapiens
TDKTDPRGG

SEQ ID NO: 408858 - protein, 9 aa, Homo Sapiens
ASCFGASGQ

SEQ ID NO: 408859 - protein, 9 aa, Homo Sapiens
KAIRTIAHY

SEQ ID NO: 408860 - protein, 9 aa, Homo Sapiens
SALIAILQL

SEQ ID NO: 408861 - protein, 9 aa, Homo Sapiens
WAALQRLTW

SEQ ID NO: 408862 - protein, 9 aa, Homo Sapiens
GYSPLMRQY

SEQ ID NO: 408863 - protein, 9 aa, Homo Sapiens
WSMLLRTVH

SEQ ID NO: 408864 - protein, 9 aa, Homo Sapiens
IPDATRSGS

SEQ ID NO: 408865 - protein, 9 aa, Homo Sapiens
AVPLLTDQA

SEQ ID NO: 408866 - protein, 9 aa, Homo Sapiens
LIEDQGLVV

SEQ ID NO: 408867 - protein, 9 aa, Homo Sapiens
TAGDPTTLE

SEQ ID NO: 408868 - protein, 9 aa, Homo Sapiens
LTSATVLCC

SEQ ID NO: 408869 - protein, 9 aa, Homo Sapiens
TGHQLQTAP

SEQ ID NO: 408870 - protein, 9 aa, Homo Sapiens
ESLKVRGLD

SEQ ID NO: 408871 - protein, 9 aa, Homo Sapiens
AVSVTLFLW

SEQ ID NO: 408872 - protein, 9 aa, Homo Sapiens
QKETLLLNI

SEQ ID NO: 408873 - protein, 9 aa, Homo Sapiens
EDLSWARML

SEQ ID NO: 408874 - protein, 9 aa, Homo Sapiens
KCFLLVVLT

SEQ ID NO: 408875 - protein, 9 aa, Homo Sapiens
DKSIEHQCR

SEQ ID NO: 408876 - protein, 9 aa, Homo Sapiens
DHDLERLHD

SEQ ID NO: 408877 - protein, 9 aa, Homo Sapiens
IQPKLLLTL

SEQ ID NO: 408878 - protein, 9 aa, Homo Sapiens
LRLENDYLK

SEQ ID NO: 408879 - protein, 9 aa, Homo Sapiens
EPGERAGAL

SEQ ID NO: 408880 - protein, 9 aa, Homo Sapiens
SAEHAQQNG

SEQ ID NO: 408881 - protein, 9 aa, Homo Sapiens
APLFMYLFI

SEQ ID NO: 408882 - protein, 9 aa, Homo Sapiens
LEPGYVDSE

SEQ ID NO: 408883 - protein, 9 aa, Homo Sapiens
VLREKVPCL

SEQ ID NO: 408884 - protein, 9 aa, Homo Sapiens
EASTGAWTA

SEQ ID NO: 408885 - protein, 9 aa, Homo Sapiens
GTRCRASRA

SEQ ID NO: 408886 - protein, 9 aa, Homo Sapiens
RGVHIVSRG

SEQ ID NO: 408887 - protein, 9 aa, Homo Sapiens
TCEDSLPPY

SEQ ID NO: 408888 - protein, 9 aa, Homo Sapiens
AARQPSVWC

SEQ ID NO: 408889 - protein, 9 aa, Homo Sapiens
MNVERVLLK

SEQ ID NO: 408890 - protein, 9 aa, Homo Sapiens
ITIFFCMDK

SEQ ID NO: 408891 - protein, 9 aa, Homo Sapiens
PAAYSDLFH

SEQ ID NO: 408892 - protein, 9 aa, Homo Sapiens
MGRKRRKRK

SEQ ID NO: 408893 - protein, 9 aa, Homo Sapiens
AILLPGRAR

SEQ ID NO: 408894 - protein, 9 aa, Homo Sapiens
GQIQLKGIL

SEQ ID NO: 408895 - protein, 9 aa, Homo Sapiens
ADLVHSTHL

SEQ ID NO: 408896 - protein, 9 aa, Homo Sapiens
DSLCQGGNS

SEQ ID NO: 408897 - protein, 9 aa, Homo Sapiens
YSEHNYCRL

SEQ ID NO: 408898 - protein, 9 aa, Homo Sapiens
GSGTSAGTG

SEQ ID NO: 408899 - protein, 9 aa, Homo Sapiens
QQIIVNLTE

SEQ ID NO: 408900 - protein, 9 aa, Homo Sapiens
AMVDGKTIL

SEQ ID NO: 408901 - protein, 9 aa, Homo Sapiens
TTRLMAPVG

SEQ ID NO: 408902 - protein, 9 aa, Homo Sapiens
PAQKSRVST

SEQ ID NO: 408903 - protein, 9 aa, Homo Sapiens
PRQASHQNL

SEQ ID NO: 408904 - protein, 9 aa, Homo Sapiens
CLEYHSCWL

SEQ ID NO: 408905 - protein, 9 aa, Homo Sapiens
PTTLEYTVA

SEQ ID NO: 408906 - protein, 9 aa, Homo Sapiens
FISLPPAPL

SEQ ID NO: 408907 - protein, 9 aa, Homo Sapiens
PPMEPAGVS

SEQ ID NO: 408908 - protein, 9 aa, Homo Sapiens
EDKKNGIWE

SEQ ID NO: 408909 - protein, 9 aa, Homo Sapiens
REGRTALSV

SEQ ID NO: 408910 - protein, 9 aa, Homo Sapiens
YRISCLRDD

SEQ ID NO: 408911 - protein, 9 aa, Homo Sapiens
PCSVGGGED

SEQ ID NO: 408912 - protein, 9 aa, Homo Sapiens
LQRRLSVYW

SEQ ID NO: 408913 - protein, 9 aa, Homo Sapiens
FWQPELFLL

SEQ ID NO: 408914 - protein, 9 aa, Homo Sapiens
WHMASKMVD

SEQ ID NO: 408915 - protein, 9 aa, Homo Sapiens
KSSHCLLTA

SEQ ID NO: 408916 - protein, 9 aa, Homo Sapiens
VMSDLSIPS

SEQ ID NO: 408917 - protein, 9 aa, Homo Sapiens
FECRCLPGF

SEQ ID NO: 408918 - protein, 9 aa, Homo Sapiens
RVPVPRVSL

SEQ ID NO: 408919 - protein, 9 aa, Homo Sapiens
HRRWSETFW

SEQ ID NO: 408920 - protein, 9 aa, Homo Sapiens
WMLLGAASS

SEQ ID NO: 408921 - protein, 9 aa, Homo Sapiens
ACQVEHDGQ

SEQ ID NO: 408922 - protein, 9 aa, Homo Sapiens
TPPPPGAPA

SEQ ID NO: 408923 - protein, 9 aa, Homo Sapiens
RIERIDGMS

SEQ ID NO: 408924 - protein, 9 aa, Homo Sapiens
WPGQFDRPA

SEQ ID NO: 408925 - protein, 9 aa, Homo Sapiens
ANVLTPSAA

SEQ ID NO: 408926 - protein, 9 aa, Homo Sapiens
IWQEWTDAY

SEQ ID NO: 408927 - protein, 9 aa, Homo Sapiens
HCQMSCVNK

SEQ ID NO: 408928 - protein, 9 aa, Homo Sapiens
GLLPGEAAP

SEQ ID NO: 408929 - protein, 9 aa, Homo Sapiens
FFFIYSLFF

SEQ ID NO: 408930 - protein, 9 aa, Homo Sapiens
GGGVGEPRH

SEQ ID NO: 408931 - protein, 9 aa, Homo Sapiens
SRVSTPLAS

SEQ ID NO: 408932 - protein, 9 aa, Homo Sapiens
QQHTRECNG

SEQ ID NO: 408933 - protein, 9 aa, Homo Sapiens
SKSKSGFRL

SEQ ID NO: 408934 - protein, 9 aa, Homo Sapiens
GLLCPALHL

SEQ ID NO: 408935 - protein, 9 aa, Homo Sapiens
VTDFRVGLK

SEQ ID NO: 408936 - protein, 9 aa, Homo Sapiens
GVLGIQWLQ

SEQ ID NO: 408937 - protein, 9 aa, Homo Sapiens
HVCTLKIMS

SEQ ID NO: 408938 - protein, 9 aa, Homo Sapiens
PRLRVHSQQ

SEQ ID NO: 408939 - protein, 9 aa, Homo Sapiens
GNLVINANW

SEQ ID NO: 408940 - protein, 9 aa, Homo Sapiens
QRQDQKPIF

SEQ ID NO: 408941 - protein, 9 aa, Homo Sapiens
SLSQRQDQK

SEQ ID NO: 408942 - protein, 9 aa, Homo Sapiens
PQHQLSAPA

SEQ ID NO: 408943 - protein, 9 aa, Homo Sapiens
ESRLFLMDF

SEQ ID NO: 408944 - protein, 9 aa, Homo Sapiens
FHWLVLRIN

SEQ ID NO: 408945 - protein, 9 aa, Homo Sapiens
YIDEKWDFR

SEQ ID NO: 408946 - protein, 9 aa, Homo Sapiens
VVSSAPFAP

SEQ ID NO: 408947 - protein, 9 aa, Homo Sapiens
AFLAEEATD

SEQ ID NO: 408948 - protein, 9 aa, Homo Sapiens
EKSEGMKSF

SEQ ID NO: 408949 - protein, 9 aa, Homo Sapiens
LSVNVTDYC

SEQ ID NO: 408950 - protein, 9 aa, Homo Sapiens
FPPPLIAPV

SEQ ID NO: 408951 - protein, 9 aa, Homo Sapiens
PEMAVPEVQ

SEQ ID NO: 408952 - protein, 9 aa, Homo Sapiens
AEKYVFVSI

SEQ ID NO: 408953 - protein, 9 aa, Homo Sapiens
RQASHQNLG

SEQ ID NO: 408954 - protein, 9 aa, Homo Sapiens
VVDKERYDI

SEQ ID NO: 408955 - protein, 9 aa, Homo Sapiens
MGGVRPGPC

SEQ ID NO: 408956 - protein, 9 aa, Homo Sapiens
PFFVPMSLA

SEQ ID NO: 408957 - protein, 9 aa, Homo Sapiens
DDLKKKALS

SEQ ID NO: 408958 - protein, 9 aa, Homo Sapiens
LQHHLHLHH

SEQ ID NO: 408959 - protein, 9 aa, Homo Sapiens
LGTGGGFGP

SEQ ID NO: 408960 - protein, 9 aa, Homo Sapiens
PGVFDPRYR

SEQ ID NO: 408961 - protein, 9 aa, Homo Sapiens
LPAPMCNPN

SEQ ID NO: 408962 - protein, 9 aa, Homo Sapiens
NLALHRYAG

SEQ ID NO: 408963 - protein, 9 aa, Homo Sapiens
KNGGGLKRK

SEQ ID NO: 408964 - protein, 9 aa, Homo Sapiens
GSFPLQCVG

SEQ ID NO: 408965 - protein, 9 aa, Homo Sapiens
IAILQLLAA

SEQ ID NO: 408966 - protein, 9 aa, Homo Sapiens
QPAMQALVL

SEQ ID NO: 408967 - protein, 9 aa, Homo Sapiens
PSISRESPW

SEQ ID NO: 408968 - protein, 9 aa, Homo Sapiens
AGGGVGEPR

SEQ ID NO: 408969 - protein, 9 aa, Homo Sapiens
YSLCIAENL

SEQ ID NO: 408970 - protein, 9 aa, Homo Sapiens
PGCYGCCGS

SEQ ID NO: 408971 - protein, 9 aa, Homo Sapiens
SLVESFAVT

SEQ ID NO: 408972 - protein, 9 aa, Homo Sapiens
GRRLPQCGA

SEQ ID NO: 408973 - protein, 9 aa, Homo Sapiens
PKKDDFKMV

SEQ ID NO: 408974 - protein, 9 aa, Homo Sapiens
IMELVLATA

SEQ ID NO: 408975 - protein, 9 aa, Homo Sapiens
DEPWEEEFG

SEQ ID NO: 408976 - protein, 9 aa, Homo Sapiens
LIAVRQVDL

SEQ ID NO: 408977 - protein, 9 aa, Homo Sapiens
SSSTLTSDV

SEQ ID NO: 408978 - protein, 9 aa, Homo Sapiens
PWRAALLGS

SEQ ID NO: 408979 - protein, 9 aa, Homo Sapiens
QMKRWEAES

SEQ ID NO: 408980 - protein, 9 aa, Homo Sapiens
QIFWPCDLI

SEQ ID NO: 408981 - protein, 9 aa, Homo Sapiens
VGLHMGFST

SEQ ID NO: 408982 - protein, 9 aa, Homo Sapiens
RSPKNQERS

SEQ ID NO: 408983 - protein, 9 aa, Homo Sapiens
VSMPSMVVS

SEQ ID NO: 408984 - protein, 9 aa, Homo Sapiens
MVHHTGRFK

SEQ ID NO: 408985 - protein, 9 aa, Homo Sapiens
LPRVRGRGW

SEQ ID NO: 408986 - protein, 9 aa, Homo Sapiens
NLIVPRIGH

SEQ ID NO: 408987 - protein, 9 aa, Homo Sapiens
GAMKDKCRY

SEQ ID NO: 408988 - protein, 9 aa, Homo Sapiens
PRPPEPLEP

SEQ ID NO: 408989 - protein, 9 aa, Homo Sapiens
QPIWAVPDH

SEQ ID NO: 408990 - protein, 9 aa, Homo Sapiens
SAAGGGAAS

SEQ ID NO: 408991 - protein, 9 aa, Homo Sapiens
AAEGLGAQV

SEQ ID NO: 408992 - protein, 9 aa, Homo Sapiens
LQQRWHMAS

SEQ ID NO: 408993 - protein, 9 aa, Homo Sapiens
WETPAHTTL

SEQ ID NO: 408994 - protein, 9 aa, Homo Sapiens
QQTFQQYAL

SEQ ID NO: 408995 - protein, 9 aa, Homo Sapiens
EVVDTYSSS

SEQ ID NO: 408996 - protein, 9 aa, Homo Sapiens
QKIDLLEYQ

SEQ ID NO: 408997 - protein, 9 aa, Homo Sapiens
WYNYMCNCV

SEQ ID NO: 408998 - protein, 9 aa, Homo Sapiens
DASPPSACT

SEQ ID NO: 408999 - protein, 9 aa, Homo Sapiens
LVCRLRRWG

SEQ ID NO: 409000 - protein, 9 aa, Homo Sapiens
GGDQRRHAA

SEQ ID NO: 409001 - protein, 9 aa, Homo Sapiens
NRQILQGVF

SEQ ID NO: 409002 - protein, 9 aa, Homo Sapiens
VASPEASTF

SEQ ID NO: 409003 - protein, 9 aa, Homo Sapiens
LTVGRAQAS

SEQ ID NO: 409004 - protein, 9 aa, Homo Sapiens
VMLEGQAAF

SEQ ID NO: 409005 - protein, 9 aa, Homo Sapiens
SAPFSPIII

SEQ ID NO: 409006 - protein, 9 aa, Homo Sapiens
PERRLRGIL

SEQ ID NO: 409007 - protein, 9 aa, Homo Sapiens
RLITTCEKV

SEQ ID NO: 409008 - protein, 9 aa, Homo Sapiens
ASVTRRCLI

SEQ ID NO: 409009 - protein, 9 aa, Homo Sapiens
RPGKPGAGL

SEQ ID NO: 409010 - protein, 9 aa, Homo Sapiens
PDAHPSPPL

SEQ ID NO: 409011 - protein, 9 aa, Homo Sapiens
LSFNADKTD

SEQ ID NO: 409012 - protein, 9 aa, Homo Sapiens
SPHPHGDGQ

SEQ ID NO: 409013 - protein, 9 aa, Homo Sapiens
LILLGAFIG

SEQ ID NO: 409014 - protein, 9 aa, Homo Sapiens
VLWEGNGFV

SEQ ID NO: 409015 - protein, 9 aa, Homo Sapiens
TGHGRARPT

SEQ ID NO: 409016 - protein, 9 aa, Homo Sapiens
GRPCSSPQC

SEQ ID NO: 409017 - protein, 9 aa, Homo Sapiens
ALGPRGGGR

SEQ ID NO: 409018 - protein, 9 aa, Homo Sapiens
PRKRRLSQG

SEQ ID NO: 409019 - protein, 9 aa, Homo Sapiens
RIRRWHRSD

SEQ ID NO: 409020 - protein, 9 aa, Homo Sapiens
PAAQDGARC

SEQ ID NO: 409021 - protein, 9 aa, Homo Sapiens
CGKDFSQHA

SEQ ID NO: 409022 - protein, 9 aa, Homo Sapiens
AVRSPSTNV

SEQ ID NO: 409023 - protein, 9 aa, Homo Sapiens
GLAQVPREL

SEQ ID NO: 409024 - protein, 9 aa, Homo Sapiens
VAQVYNTST

SEQ ID NO: 409025 - protein, 9 aa, Homo Sapiens
WDMDVFIKE

SEQ ID NO: 409026 - protein, 9 aa, Homo Sapiens
MPSTHTMAA

SEQ ID NO: 409027 - protein, 9 aa, Homo Sapiens
NQLTRDWKA

SEQ ID NO: 409028 - protein, 9 aa, Homo Sapiens
KAAHLGITM

SEQ ID NO: 409029 - protein, 9 aa, Homo Sapiens
VPAPSQLPA

SEQ ID NO: 409030 - protein, 9 aa, Homo Sapiens
KRRRRRKRS

SEQ ID NO: 409031 - protein, 9 aa, Homo Sapiens
RWTWRSWPT

SEQ ID NO: 409032 - protein, 9 aa, Homo Sapiens
HPETEPAGA

SEQ ID NO: 409033 - protein, 9 aa, Homo Sapiens
RVLMIMIAK

SEQ ID NO: 409034 - protein, 9 aa, Homo Sapiens
SGGHYPCSV

SEQ ID NO: 409035 - protein, 9 aa, Homo Sapiens
RGSNYHKIT

SEQ ID NO: 409036 - protein, 9 aa, Homo Sapiens
PLGDTPQPS

SEQ ID NO: 409037 - protein, 9 aa, Homo Sapiens
GPPMREVAE

SEQ ID NO: 409038 - protein, 9 aa, Homo Sapiens
AMDIDQLPE

SEQ ID NO: 409039 - protein, 9 aa, Homo Sapiens
VVHDLVVRL

SEQ ID NO: 409040 - protein, 9 aa, Homo Sapiens
GGAAEGLGA

SEQ ID NO: 409041 - protein, 9 aa, Homo Sapiens
QNTSPLGAE

SEQ ID NO: 409042 - protein, 9 aa, Homo Sapiens
LPGGTDTMS

SEQ ID NO: 409043 - protein, 9 aa, Homo Sapiens
LHQNAPPVP

SEQ ID NO: 409044 - protein, 9 aa, Homo Sapiens
VESFAVTIG

SEQ ID NO: 409045 - protein, 9 aa, Homo Sapiens
AASGTAAAS

SEQ ID NO: 409046 - protein, 9 aa, Homo Sapiens
PLPRASLRA

SEQ ID NO: 409047 - protein, 9 aa, Homo Sapiens
ALTGSQNSH

SEQ ID NO: 409048 - protein, 9 aa, Homo Sapiens
VNGQPLPDV

SEQ ID NO: 409049 - protein, 9 aa, Homo Sapiens
QPLPIGLQK

SEQ ID NO: 409050 - protein, 9 aa, Homo Sapiens
LGPRGGGRP

SEQ ID NO: 409051 - protein, 9 aa, Homo Sapiens
PPPALPSRP

SEQ ID NO: 409052 - protein, 9 aa, Homo Sapiens
ATWSESAWR

SEQ ID NO: 409053 - protein, 9 aa, Homo Sapiens
SGKKLALCA

SEQ ID NO: 409054 - protein, 9 aa, Homo Sapiens
RLFLMDFFR

SEQ ID NO: 409055 - protein, 9 aa, Homo Sapiens
WARMLQEQQ

SEQ ID NO: 409056 - protein, 9 aa, Homo Sapiens
SNIYTGLFL

SEQ ID NO: 409057 - protein, 9 aa, Homo Sapiens
TVRTARVSW

SEQ ID NO: 409058 - protein, 9 aa, Homo Sapiens
LETLRGELH

SEQ ID NO: 409059 - protein, 9 aa, Homo Sapiens
FSSEATHRK

SEQ ID NO: 409060 - protein, 9 aa, Homo Sapiens
ASAPNDSLC

SEQ ID NO: 409061 - protein, 9 aa, Homo Sapiens
DKDIQIHKL

SEQ ID NO: 409062 - protein, 9 aa, Homo Sapiens
IRVDTHDQE

SEQ ID NO: 409063 - protein, 9 aa, Homo Sapiens
VVAAMPVRA

SEQ ID NO: 409064 - protein, 9 aa, Homo Sapiens
DIVKTVIEL

SEQ ID NO: 409065 - protein, 9 aa, Homo Sapiens
GAPRHPHRS

SEQ ID NO: 409066 - protein, 9 aa, Homo Sapiens
MRPDDKYHK

SEQ ID NO: 409067 - protein, 9 aa, Homo Sapiens
TAAASAARA

SEQ ID NO: 409068 - protein, 9 aa, Homo Sapiens
GSGISICPG

SEQ ID NO: 409069 - protein, 9 aa, Homo Sapiens
GAGLAQVPR

SEQ ID NO: 409070 - protein, 9 aa, Homo Sapiens
SSEEVAAFQ

SEQ ID NO: 409071 - protein, 9 aa, Homo Sapiens
GGHSPCSVW

SEQ ID NO: 409072 - protein, 9 aa, Homo Sapiens
GTVDNNIHS

SEQ ID NO: 409073 - protein, 9 aa, Homo Sapiens
IEEIQYEIF

SEQ ID NO: 409074 - protein, 9 aa, Homo Sapiens
DWTCHLRQP

SEQ ID NO: 409075 - protein, 9 aa, Homo Sapiens
SSHYGTPEE

SEQ ID NO: 409076 - protein, 9 aa, Homo Sapiens
TRVIEVSHL

SEQ ID NO: 409077 - protein, 9 aa, Homo Sapiens
LNPHSGTLV

SEQ ID NO: 409078 - protein, 9 aa, Homo Sapiens
CLPLPPRVG

SEQ ID NO: 409079 - protein, 9 aa, Homo Sapiens
EVLPIPGQE

SEQ ID NO: 409080 - protein, 9 aa, Homo Sapiens
SWPGQFDRP

SEQ ID NO: 409081 - protein, 9 aa, Homo Sapiens
RAFSSQGSQ

SEQ ID NO: 409082 - protein, 9 aa, Homo Sapiens
NKEESDSAE

SEQ ID NO: 409083 - protein, 9 aa, Homo Sapiens
ERERAWLRE

SEQ ID NO: 409084 - protein, 9 aa, Homo Sapiens
HWLVLRINK

SEQ ID NO: 409085 - protein, 9 aa, Homo Sapiens
GSREWAICW

SEQ ID NO: 409086 - protein, 9 aa, Homo Sapiens
ARLDLTSNQ

SEQ ID NO: 409087 - protein, 9 aa, Homo Sapiens
GTSVKTNPQ

SEQ ID NO: 409088 - protein, 9 aa, Homo Sapiens
DKFSCHCVI

SEQ ID NO: 409089 - protein, 9 aa, Homo Sapiens
WREESSFVA

SEQ ID NO: 409090 - protein, 9 aa, Homo Sapiens
DMFEDMEKC

SEQ ID NO: 409091 - protein, 9 aa, Homo Sapiens
ARVSWGQRH

SEQ ID NO: 409092 - protein, 9 aa, Homo Sapiens
HPPTTTTSS

SEQ ID NO: 409093 - protein, 9 aa, Homo Sapiens
AFKKRYVWF

SEQ ID NO: 409094 - protein, 9 aa, Homo Sapiens
TCWTASSWP

SEQ ID NO: 409095 - protein, 9 aa, Homo Sapiens
HARHQVLGI

SEQ ID NO: 409096 - protein, 9 aa, Homo Sapiens
YEEKAMRAP

SEQ ID NO: 409097 - protein, 9 aa, Homo Sapiens
VKNSPTTAT

SEQ ID NO: 409098 - protein, 9 aa, Homo Sapiens
RRQEQLLRE

SEQ ID NO: 409099 - protein, 9 aa, Homo Sapiens
MMLCCMLAQ

SEQ ID NO: 409100 - protein, 9 aa, Homo Sapiens
ASPEASTFS

SEQ ID NO: 409101 - protein, 9 aa, Homo Sapiens
AEVLWLIGA

SEQ ID NO: 409102 - protein, 9 aa, Homo Sapiens
LYVVGGHDT

SEQ ID NO: 409103 - protein, 9 aa, Homo Sapiens
CLQAWRLFC

SEQ ID NO: 409104 - protein, 9 aa, Homo Sapiens
HPLGVTKID

SEQ ID NO: 409105 - protein, 9 aa, Homo Sapiens
GTTPPGRSL

SEQ ID NO: 409106 - protein, 9 aa, Homo Sapiens
RWRMLYLCT

SEQ ID NO: 409107 - protein, 9 aa, Homo Sapiens
LDIIQKYFF

SEQ ID NO: 409108 - protein, 9 aa, Homo Sapiens
RRYFYPFPN

SEQ ID NO: 409109 - protein, 9 aa, Homo Sapiens
PEDLEARVV

SEQ ID NO: 409110 - protein, 9 aa, Homo Sapiens
GHDEIPILG

SEQ ID NO: 409111 - protein, 9 aa, Homo Sapiens
HGVAPSTCR

SEQ ID NO: 409112 - protein, 9 aa, Homo Sapiens
SDGSVDALW

SEQ ID NO: 409113 - protein, 9 aa, Homo Sapiens
GHAPLTVLL

SEQ ID NO: 409114 - protein, 9 aa, Homo Sapiens
LSVSVGCVA

SEQ ID NO: 409115 - protein, 9 aa, Homo Sapiens
MFHWLVLRI

SEQ ID NO: 409116 - protein, 9 aa, Homo Sapiens
EPLVLVQLL

SEQ ID NO: 409117 - protein, 9 aa, Homo Sapiens
TDFCPKTGR

SEQ ID NO: 409118 - protein, 9 aa, Homo Sapiens
VQMVVEKFL

SEQ ID NO: 409119 - protein, 9 aa, Homo Sapiens
QDTYMDSQD

SEQ ID NO: 409120 - protein, 9 aa, Homo Sapiens
QSAGVIQNT

SEQ ID NO: 409121 - protein, 9 aa, Homo Sapiens
PFVNTSVLS

SEQ ID NO: 409122 - protein, 9 aa, Homo Sapiens
PFSVGLHMG

SEQ ID NO: 409123 - protein, 9 aa, Homo Sapiens
TVAVSGGGG

SEQ ID NO: 409124 - protein, 9 aa, Homo Sapiens
SLAPFLGNF

SEQ ID NO: 409125 - protein, 9 aa, Homo Sapiens
WHWPLVALQ

SEQ ID NO: 409126 - protein, 9 aa, Homo Sapiens
ERIQAKTQE

SEQ ID NO: 409127 - protein, 9 aa, Homo Sapiens
QIAEEALGG

SEQ ID NO: 409128 - protein, 9 aa, Homo Sapiens
KGTMPVPEG

SEQ ID NO: 409129 - protein, 9 aa, Homo Sapiens
HWCSDDFDG

SEQ ID NO: 409130 - protein, 9 aa, Homo Sapiens
LRKIADENR

SEQ ID NO: 409131 - protein, 9 aa, Homo Sapiens
PLQAKKSQK

SEQ ID NO: 409132 - protein, 9 aa, Homo Sapiens
ARGVTARSP

SEQ ID NO: 409133 - protein, 9 aa, Homo Sapiens
PRKTLKMIR

SEQ ID NO: 409134 - protein, 9 aa, Homo Sapiens
FKIPDFQGQ

SEQ ID NO: 409135 - protein, 9 aa, Homo Sapiens
AGRQRSGPA

SEQ ID NO: 409136 - protein, 9 aa, Homo Sapiens
EHVWVEVVH

SEQ ID NO: 409137 - protein, 9 aa, Homo Sapiens
PARMGHRVS

SEQ ID NO: 409138 - protein, 9 aa, Homo Sapiens
KQSFSKAFG

SEQ ID NO: 409139 - protein, 9 aa, Homo Sapiens
DRAAKIERT

SEQ ID NO: 409140 - protein, 9 aa, Homo Sapiens
ETHLETTQA

SEQ ID NO: 409141 - protein, 9 aa, Homo Sapiens
WLYHPVVMH

SEQ ID NO: 409142 - protein, 9 aa, Homo Sapiens
GEQVFHLAF

SEQ ID NO: 409143 - protein, 9 aa, Homo Sapiens
SLAVATAAT

SEQ ID NO: 409144 - protein, 9 aa, Homo Sapiens
AGAAPRAHE

SEQ ID NO: 409145 - protein, 9 aa, Homo Sapiens
KRSSTLEHR

SEQ ID NO: 409146 - protein, 9 aa, Homo Sapiens
RLQMWMDMF

SEQ ID NO: 409147 - protein, 9 aa, Homo Sapiens
RDKDEHYWT

SEQ ID NO: 409148 - protein, 9 aa, Homo Sapiens
PARWWQLIQ

SEQ ID NO: 409149 - protein, 9 aa, Homo Sapiens
VQDGPPRAL

SEQ ID NO: 409150 - protein, 9 aa, Homo Sapiens
APVGSVMSC

SEQ ID NO: 409151 - protein, 9 aa, Homo Sapiens
WTEDSGTYI

SEQ ID NO: 409152 - protein, 9 aa, Homo Sapiens
RELLHCAHL

SEQ ID NO: 409153 - protein, 9 aa, Homo Sapiens
EGNHTLTLA

SEQ ID NO: 409154 - protein, 9 aa, Homo Sapiens
PKSAKGQTR

SEQ ID NO: 409155 - protein, 9 aa, Homo Sapiens
PRSRAGRQR

SEQ ID NO: 409156 - protein, 9 aa, Homo Sapiens
AVDVLPLVP

SEQ ID NO: 409157 - protein, 9 aa, Homo Sapiens
EMPLGIQTT

SEQ ID NO: 409158 - protein, 9 aa, Homo Sapiens
ARPAPPYTP

SEQ ID NO: 409159 - protein, 9 aa, Homo Sapiens
IGDLRAINN

SEQ ID NO: 409160 - protein, 9 aa, Homo Sapiens
SSHRDLSII

SEQ ID NO: 409161 - protein, 9 aa, Homo Sapiens
ALHGPVQGH

SEQ ID NO: 409162 - protein, 9 aa, Homo Sapiens
MEVSASILQ

SEQ ID NO: 409163 - protein, 9 aa, Homo Sapiens
PLHYTLVMN

SEQ ID NO: 409164 - protein, 9 aa, Homo Sapiens
ALYDLLIAA

SEQ ID NO: 409165 - protein, 9 aa, Homo Sapiens
ASPRKRRLS

SEQ ID NO: 409166 - protein, 9 aa, Homo Sapiens
TIALLEPAG

SEQ ID NO: 409167 - protein, 9 aa, Homo Sapiens
LEKPTPSPS

SEQ ID NO: 409168 - protein, 9 aa, Homo Sapiens
CSSPGTTQS

SEQ ID NO: 409169 - protein, 9 aa, Homo Sapiens
PLSRSSMLK

SEQ ID NO: 409170 - protein, 9 aa, Homo Sapiens
MRHLAIWLF

SEQ ID NO: 409171 - protein, 9 aa, Homo Sapiens
SWLSLFYLW

SEQ ID NO: 409172 - protein, 9 aa, Homo Sapiens
RGCQQREQE

SEQ ID NO: 409173 - protein, 9 aa, Homo Sapiens
QEQSKTEEG

SEQ ID NO: 409174 - protein, 9 aa, Homo Sapiens
SYKETVGLN

SEQ ID NO: 409175 - protein, 9 aa, Homo Sapiens
QGAPGCTLV

SEQ ID NO: 409176 - protein, 9 aa, Homo Sapiens
SLPALKIWE

SEQ ID NO: 409177 - protein, 9 aa, Homo Sapiens
ILLCRPGWS

SEQ ID NO: 409178 - protein, 9 aa, Homo Sapiens
CGHEETAQT

SEQ ID NO: 409179 - protein, 9 aa, Homo Sapiens
RVSLTPATP

SEQ ID NO: 409180 - protein, 9 aa, Homo Sapiens
VILKHLQVL

SEQ ID NO: 409181 - protein, 9 aa, Homo Sapiens
IVSTGQLQQ

SEQ ID NO: 409182 - protein, 9 aa, Homo Sapiens
CLQICELEK

SEQ ID NO: 409183 - protein, 9 aa, Homo Sapiens
WTARICAVG

SEQ ID NO: 409184 - protein, 9 aa, Homo Sapiens
PPWEPKPPA

SEQ ID NO: 409185 - protein, 9 aa, Homo Sapiens
GRSQGAIIS

SEQ ID NO: 409186 - protein, 9 aa, Homo Sapiens
INTDKKEWV

SEQ ID NO: 409187 - protein, 9 aa, Homo Sapiens
AWERTPLVG

SEQ ID NO: 409188 - protein, 9 aa, Homo Sapiens
PACTCISMT

SEQ ID NO: 409189 - protein, 9 aa, Homo Sapiens
TPQPVVDSY

SEQ ID NO: 409190 - protein, 9 aa, Homo Sapiens
VGCVASINL

SEQ ID NO: 409191 - protein, 9 aa, Homo Sapiens
DGPPRALQT

SEQ ID NO: 409192 - protein, 9 aa, Homo Sapiens
YNSSLTLHM

SEQ ID NO: 409193 - protein, 9 aa, Homo Sapiens
CKGFGFMTM

SEQ ID NO: 409194 - protein, 9 aa, Homo Sapiens
GPAVMPPTT

SEQ ID NO: 409195 - protein, 9 aa, Homo Sapiens
TPGGPPSCP

SEQ ID NO: 409196 - protein, 9 aa, Homo Sapiens
KKFPEENHE

SEQ ID NO: 409197 - protein, 9 aa, Homo Sapiens
GATFFVATW

SEQ ID NO: 409198 - protein, 9 aa, Homo Sapiens
NGISQADLL

SEQ ID NO: 409199 - protein, 9 aa, Homo Sapiens
NQVAQCFRL

SEQ ID NO: 409200 - protein, 9 aa, Homo Sapiens
VWVRTTEGM

SEQ ID NO: 409201 - protein, 9 aa, Homo Sapiens
QPPAKKNKE

SEQ ID NO: 409202 - protein, 9 aa, Homo Sapiens
VHEAVPCYR

SEQ ID NO: 409203 - protein, 9 aa, Homo Sapiens
SSKSTEMPS

SEQ ID NO: 409204 - protein, 9 aa, Homo Sapiens
PAEEVVPVS

SEQ ID NO: 409205 - protein, 9 aa, Homo Sapiens
GSCVDSAVT

SEQ ID NO: 409206 - protein, 9 aa, Homo Sapiens
AAGFGTITG

SEQ ID NO: 409207 - protein, 9 aa, Homo Sapiens
QSLFLQGLS

SEQ ID NO: 409208 - protein, 9 aa, Homo Sapiens
NVNQACLEQ

SEQ ID NO: 409209 - protein, 9 aa, Homo Sapiens
HYPCSVLGG

SEQ ID NO: 409210 - protein, 9 aa, Homo Sapiens
IFAWEIRDH

SEQ ID NO: 409211 - protein, 9 aa, Homo Sapiens
LRPRTLQKK

SEQ ID NO: 409212 - protein, 9 aa, Homo Sapiens
AAAAGALTR

SEQ ID NO: 409213 - protein, 9 aa, Homo Sapiens
VLKALQMKR

SEQ ID NO: 409214 - protein, 9 aa, Homo Sapiens
CLNGQEMCA

SEQ ID NO: 409215 - protein, 9 aa, Homo Sapiens
AWASAMPRA

SEQ ID NO: 409216 - protein, 9 aa, Homo Sapiens
VSALIAILQ

SEQ ID NO: 409217 - protein, 9 aa, Homo Sapiens
QLIQSTNNN

SEQ ID NO: 409218 - protein, 9 aa, Homo Sapiens
GIWLNDGHV

SEQ ID NO: 409219 - protein, 9 aa, Homo Sapiens
TRDARSSSR

SEQ ID NO: 409220 - protein, 9 aa, Homo Sapiens
CPSAHPPPP

SEQ ID NO: 409221 - protein, 9 aa, Homo Sapiens
LSPSLPSRW

SEQ ID NO: 409222 - protein, 9 aa, Homo Sapiens
ECRCLPGFG

SEQ ID NO: 409223 - protein, 9 aa, Homo Sapiens
PATTSTGGI

SEQ ID NO: 409224 - protein, 9 aa, Homo Sapiens
MNGRPTFIP

SEQ ID NO: 409225 - protein, 9 aa, Homo Sapiens
WDCRCMPPY

SEQ ID NO: 409226 - protein, 9 aa, Homo Sapiens
WEHLEPTQK

SEQ ID NO: 409227 - protein, 9 aa, Homo Sapiens
PGTDPDADL

SEQ ID NO: 409228 - protein, 9 aa, Homo Sapiens
PLTVLLQEV

SEQ ID NO: 409229 - protein, 9 aa, Homo Sapiens
AELAKKQKF

SEQ ID NO: 409230 - protein, 9 aa, Homo Sapiens
LPGQHLWLS

SEQ ID NO: 409231 - protein, 9 aa, Homo Sapiens
ARILCLTPC

SEQ ID NO: 409232 - protein, 9 aa, Homo Sapiens
RSFRVDIAK

SEQ ID NO: 409233 - protein, 9 aa, Homo Sapiens
VLMYGQSYR

SEQ ID NO: 409234 - protein, 9 aa, Homo Sapiens
GFMDTRKHH

SEQ ID NO: 409235 - protein, 9 aa, Homo Sapiens
EENHEVFKY

SEQ ID NO: 409236 - protein, 9 aa, Homo Sapiens
TQDFFTPNL

SEQ ID NO: 409237 - protein, 9 aa, Homo Sapiens
IFFQKCIYI

SEQ ID NO: 409238 - protein, 9 aa, Homo Sapiens
LPGNWELKL

SEQ ID NO: 409239 - protein, 9 aa, Homo Sapiens
TLGVSQQLS

SEQ ID NO: 409240 - protein, 9 aa, Homo Sapiens
MLGLHFHPR

SEQ ID NO: 409241 - protein, 9 aa, Homo Sapiens
LNGLMDLDI

SEQ ID NO: 409242 - protein, 9 aa, Homo Sapiens
LQSVSVCQD

SEQ ID NO: 409243 - protein, 9 aa, Homo Sapiens
SSRVRHVAS

SEQ ID NO: 409244 - protein, 9 aa, Homo Sapiens
VDMLDVHAD

SEQ ID NO: 409245 - protein, 9 aa, Homo Sapiens
GGPHLLQPA

SEQ ID NO: 409246 - protein, 9 aa, Homo Sapiens
HTCEDSLPP

SEQ ID NO: 409247 - protein, 9 aa, Homo Sapiens
VQQGDDFKG

SEQ ID NO: 409248 - protein, 9 aa, Homo Sapiens
RRQGLVMEA

SEQ ID NO: 409249 - protein, 9 aa, Homo Sapiens
HVMVWMMAG

SEQ ID NO: 409250 - protein, 9 aa, Homo Sapiens
YVFNTETHP

SEQ ID NO: 409251 - protein, 9 aa, Homo Sapiens
VELIFLEES

SEQ ID NO: 409252 - protein, 9 aa, Homo Sapiens
ARRLGTSAR

SEQ ID NO: 409253 - protein, 9 aa, Homo Sapiens
RSSMLKSAL

SEQ ID NO: 409254 - protein, 9 aa, Homo Sapiens
MRLCFWLLI

SEQ ID NO: 409255 - protein, 9 aa, Homo Sapiens
AMCMKMGYE

SEQ ID NO: 409256 - protein, 9 aa, Homo Sapiens
LRPLRVPPP

SEQ ID NO: 409257 - protein, 9 aa, Homo Sapiens
MQRFRTEAT

SEQ ID NO: 409258 - protein, 9 aa, Homo Sapiens
LGGEDSGGS

SEQ ID NO: 409259 - protein, 9 aa, Homo Sapiens
VDGLNGLMD

SEQ ID NO: 409260 - protein, 9 aa, Homo Sapiens
SLLSEPEKT

SEQ ID NO: 409261 - protein, 9 aa, Homo Sapiens
PFLGNFLKP

SEQ ID NO: 409262 - protein, 9 aa, Homo Sapiens
VTDSLTIYN

SEQ ID NO: 409263 - protein, 9 aa, Homo Sapiens
QSSKSTEMP

SEQ ID NO: 409264 - protein, 9 aa, Homo Sapiens
KPRPLALPC

SEQ ID NO: 409265 - protein, 9 aa, Homo Sapiens
VLVAGSLAA

SEQ ID NO: 409266 - protein, 9 aa, Homo Sapiens
DKNAVKFLV

SEQ ID NO: 409267 - protein, 9 aa, Homo Sapiens
PTKKGAKAR

SEQ ID NO: 409268 - protein, 9 aa, Homo Sapiens
QAIHGIWKL

SEQ ID NO: 409269 - protein, 9 aa, Homo Sapiens
VWNCPWKAP

SEQ ID NO: 409270 - protein, 9 aa, Homo Sapiens
TVERAADDP

SEQ ID NO: 409271 - protein, 9 aa, Homo Sapiens
ETLRGELHF

SEQ ID NO: 409272 - protein, 9 aa, Homo Sapiens
RKKREKIIN

SEQ ID NO: 409273 - protein, 9 aa, Homo Sapiens
EPVSPAAAV

SEQ ID NO: 409274 - protein, 9 aa, Homo Sapiens
QRLTWVCRR

SEQ ID NO: 409275 - protein, 9 aa, Homo Sapiens
VLGQQVLEV

SEQ ID NO: 409276 - protein, 9 aa, Homo Sapiens
YQSLFLQGL

SEQ ID NO: 409277 - protein, 9 aa, Homo Sapiens
PQDFVAQPK

SEQ ID NO: 409278 - protein, 9 aa, Homo Sapiens
VHRQPVQIQ

SEQ ID NO: 409279 - protein, 9 aa, Homo Sapiens
HSQLYIYWV

SEQ ID NO: 409280 - protein, 9 aa, Homo Sapiens
GSANHRAWV

SEQ ID NO: 409281 - protein, 9 aa, Homo Sapiens
HPIVKLLGY

SEQ ID NO: 409282 - protein, 9 aa, Homo Sapiens
QCGAGSHLP

SEQ ID NO: 409283 - protein, 9 aa, Homo Sapiens
DSDDYSPDL

SEQ ID NO: 409284 - protein, 9 aa, Homo Sapiens
SQMQGEKPV

SEQ ID NO: 409285 - protein, 9 aa, Homo Sapiens
QDVWMLLGA

SEQ ID NO: 409286 - protein, 9 aa, Homo Sapiens
SHHGPELAV

SEQ ID NO: 409287 - protein, 9 aa, Homo Sapiens
QLDLTLCRA

SEQ ID NO: 409288 - protein, 9 aa, Homo Sapiens
KPPLPTPDG

SEQ ID NO: 409289 - protein, 9 aa, Homo Sapiens
NLLKHFLVL

SEQ ID NO: 409290 - protein, 9 aa, Homo Sapiens
WMARRGHTR

SEQ ID NO: 409291 - protein, 9 aa, Homo Sapiens
LRPTGPAPL

SEQ ID NO: 409292 - protein, 9 aa, Homo Sapiens
KCKQRGKAF

SEQ ID NO: 409293 - protein, 9 aa, Homo Sapiens
CNRSFRVDI

SEQ ID NO: 409294 - protein, 9 aa, Homo Sapiens
NQKVKSLCW

SEQ ID NO: 409295 - protein, 9 aa, Homo Sapiens
QHHLHLHHR

SEQ ID NO: 409296 - protein, 9 aa, Homo Sapiens
IELTAFLMP

SEQ ID NO: 409297 - protein, 9 aa, Homo Sapiens
SFSLLVRHC

SEQ ID NO: 409298 - protein, 9 aa, Homo Sapiens
QEGRYCHPG

SEQ ID NO: 409299 - protein, 9 aa, Homo Sapiens
PHPPSSGFP

SEQ ID NO: 409300 - protein, 9 aa, Homo Sapiens
PDERHVKLT

SEQ ID NO: 409301 - protein, 9 aa, Homo Sapiens
RPSRLWSPP

SEQ ID NO: 409302 - protein, 9 aa, Homo Sapiens
LPPVPLLRG

SEQ ID NO: 409303 - protein, 9 aa, Homo Sapiens
GCVEFFSRP

SEQ ID NO: 409304 - protein, 9 aa, Homo Sapiens
QLYIYWVQW

SEQ ID NO: 409305 - protein, 9 aa, Homo Sapiens
MMGGVRPGP

SEQ ID NO: 409306 - protein, 9 aa, Homo Sapiens
MYTPLTMRR

SEQ ID NO: 409307 - protein, 9 aa, Homo Sapiens
KWCFRLSYD

SEQ ID NO: 409308 - protein, 9 aa, Homo Sapiens
THARHQVLG

SEQ ID NO: 409309 - protein, 9 aa, Homo Sapiens
CKEKRRPLD

SEQ ID NO: 409310 - protein, 9 aa, Homo Sapiens
AGPAGWAGS

SEQ ID NO: 409311 - protein, 9 aa, Homo Sapiens
MLQIRIGST

SEQ ID NO: 409312 - protein, 9 aa, Homo Sapiens
ERQPLPIGL

SEQ ID NO: 409313 - protein, 9 aa, Homo Sapiens
WGGEDSGGH

SEQ ID NO: 409314 - protein, 9 aa, Homo Sapiens
AGTGSRGSR

SEQ ID NO: 409315 - protein, 9 aa, Homo Sapiens
TSALLHRVI

SEQ ID NO: 409316 - protein, 9 aa, Homo Sapiens
PVDCADHWI

SEQ ID NO: 409317 - protein, 9 aa, Homo Sapiens
CCTATSCGS

SEQ ID NO: 409318 - protein, 9 aa, Homo Sapiens
ATFVAHTAP

SEQ ID NO: 409319 - protein, 9 aa, Homo Sapiens
VRISPFASD

SEQ ID NO: 409320 - protein, 9 aa, Homo Sapiens
GHSPCSVLG

SEQ ID NO: 409321 - protein, 9 aa, Homo Sapiens
LGIAAFRPD

SEQ ID NO: 409322 - protein, 9 aa, Homo Sapiens
AAVTIETGC

SEQ ID NO: 409323 - protein, 9 aa, Homo Sapiens
SCLMDSAWS

SEQ ID NO: 409324 - protein, 9 aa, Homo Sapiens
GPTLMRPLR

SEQ ID NO: 409325 - protein, 9 aa, Homo Sapiens
APLDFEAHL

SEQ ID NO: 409326 - protein, 9 aa, Homo Sapiens
LLSAVLLHC

SEQ ID NO: 409327 - protein, 9 aa, Homo Sapiens
NGGSGRRLG

SEQ ID NO: 409328 - protein, 9 aa, Homo Sapiens
RANSGQVHK

SEQ ID NO: 409329 - protein, 9 aa, Homo Sapiens
LWATEQPCA

SEQ ID NO: 409330 - protein, 9 aa, Homo Sapiens
DHNHRLHHH

SEQ ID NO: 409331 - protein, 9 aa, Homo Sapiens
DVSIPIYFP

SEQ ID NO: 409332 - protein, 9 aa, Homo Sapiens
STSPAARPP

SEQ ID NO: 409333 - protein, 9 aa, Homo Sapiens
SQPGATTRP

SEQ ID NO: 409334 - protein, 9 aa, Homo Sapiens
SFLQPSPQT

SEQ ID NO: 409335 - protein, 9 aa, Homo Sapiens
YLWLIINGT

SEQ ID NO: 409336 - protein, 9 aa, Homo Sapiens
IPNDLKKKI

SEQ ID NO: 409337 - protein, 9 aa, Homo Sapiens
HPPPISKSE

SEQ ID NO: 409338 - protein, 9 aa, Homo Sapiens
KFRGGNHTH

SEQ ID NO: 409339 - protein, 9 aa, Homo Sapiens
IDGMSLLVQ

SEQ ID NO: 409340 - protein, 9 aa, Homo Sapiens
PSAPQVLAY

SEQ ID NO: 409341 - protein, 9 aa, Homo Sapiens
RLSPSSWTS

SEQ ID NO: 409342 - protein, 9 aa, Homo Sapiens
TSCGSRAST

SEQ ID NO: 409343 - protein, 9 aa, Homo Sapiens
WKICERVHR

SEQ ID NO: 409344 - protein, 9 aa, Homo Sapiens
TYSNTFYLA

SEQ ID NO: 409345 - protein, 9 aa, Homo Sapiens
VPFLFVVQV

SEQ ID NO: 409346 - protein, 9 aa, Homo Sapiens
GRLQMWMDM

SEQ ID NO: 409347 - protein, 9 aa, Homo Sapiens
ETIGSVWWK

SEQ ID NO: 409348 - protein, 9 aa, Homo Sapiens
QQYGDMLQI

SEQ ID NO: 409349 - protein, 9 aa, Homo Sapiens
VWWKIAKQL

SEQ ID NO: 409350 - protein, 9 aa, Homo Sapiens
SPKTLTSPQ

SEQ ID NO: 409351 - protein, 9 aa, Homo Sapiens
AQQRQRLVE

SEQ ID NO: 409352 - protein, 9 aa, Homo Sapiens
LKWHWKKLP

SEQ ID NO: 409353 - protein, 9 aa, Homo Sapiens
DFSRVFSGK

SEQ ID NO: 409354 - protein, 9 aa, Homo Sapiens
GEQPPCLEA

SEQ ID NO: 409355 - protein, 9 aa, Homo Sapiens
RGVQSGPEG

SEQ ID NO: 409356 - protein, 9 aa, Homo Sapiens
GGSGGHSPC

SEQ ID NO: 409357 - protein, 9 aa, Homo Sapiens
LSSPALLCL

SEQ ID NO: 409358 - protein, 9 aa, Homo Sapiens
WAPFSVGLH

SEQ ID NO: 409359 - protein, 9 aa, Homo Sapiens
QGRVCTGMA

SEQ ID NO: 409360 - protein, 9 aa, Homo Sapiens
SSPLMWGMG

SEQ ID NO: 409361 - protein, 9 aa, Homo Sapiens
DTPASNHCS

SEQ ID NO: 409362 - protein, 9 aa, Homo Sapiens
QSIYQMSVS

SEQ ID NO: 409363 - protein, 9 aa, Homo Sapiens
RKYTSKMIS

SEQ ID NO: 409364 - protein, 9 aa, Homo Sapiens
NVLLLCFFI

SEQ ID NO: 409365 - protein, 9 aa, Homo Sapiens
HQQPATARS

SEQ ID NO: 409366 - protein, 9 aa, Homo Sapiens
PKKWTRSQK

SEQ ID NO: 409367 - protein, 9 aa, Homo Sapiens
WACPACALQ

SEQ ID NO: 409368 - protein, 9 aa, Homo Sapiens
IDSKLLKSN

SEQ ID NO: 409369 - protein, 9 aa, Homo Sapiens
RRNSQQYEV

SEQ ID NO: 409370 - protein, 9 aa, Homo Sapiens
YLEAICLLG

SEQ ID NO: 409371 - protein, 9 aa, Homo Sapiens
PREVYHEET

SEQ ID NO: 409372 - protein, 9 aa, Homo Sapiens
HHTKAVNVV

SEQ ID NO: 409373 - protein, 9 aa, Homo Sapiens
AVWALSNVA

SEQ ID NO: 409374 - protein, 9 aa, Homo Sapiens
RWHRSDRMM

SEQ ID NO: 409375 - protein, 9 aa, Homo Sapiens
ALKAPAATS

SEQ ID NO: 409376 - protein, 9 aa, Homo Sapiens
GKGPVYLLS

SEQ ID NO: 409377 - protein, 9 aa, Homo Sapiens
HTAMVDGKT

SEQ ID NO: 409378 - protein, 9 aa, Homo Sapiens
LLLVSYQEQ

SEQ ID NO: 409379 - protein, 9 aa, Homo Sapiens
FRRGTEWPS

SEQ ID NO: 409380 - protein, 9 aa, Homo Sapiens
TAASTSYYR

SEQ ID NO: 409381 - protein, 9 aa, Homo Sapiens
LKSILSALW

SEQ ID NO: 409382 - protein, 9 aa, Homo Sapiens
CFSTGHGRW

SEQ ID NO: 409383 - protein, 9 aa, Homo Sapiens
NETFVMTQG

SEQ ID NO: 409384 - protein, 9 aa, Homo Sapiens
VAAVAPVHA

SEQ ID NO: 409385 - protein, 9 aa, Homo Sapiens
RSAPTPPTW

SEQ ID NO: 409386 - protein, 9 aa, Homo Sapiens
GWAHSGVST

SEQ ID NO: 409387 - protein, 9 aa, Homo Sapiens
IQIGNSLEN

SEQ ID NO: 409388 - protein, 9 aa, Homo Sapiens
MSLACSITV

SEQ ID NO: 409389 - protein, 9 aa, Homo Sapiens
CRGAQNMEF

SEQ ID NO: 409390 - protein, 9 aa, Homo Sapiens
FICAPEKHT

SEQ ID NO: 409391 - protein, 9 aa, Homo Sapiens
DFLIQLKVM

SEQ ID NO: 409392 - protein, 9 aa, Homo Sapiens
QNGGSGRRL

SEQ ID NO: 409393 - protein, 9 aa, Homo Sapiens
SVYCQCRQP

SEQ ID NO: 409394 - protein, 9 aa, Homo Sapiens
GRILCLIKG

SEQ ID NO: 409395 - protein, 9 aa, Homo Sapiens
QHCAGRRRQ

SEQ ID NO: 409396 - protein, 9 aa, Homo Sapiens
GGKFAPFFV

SEQ ID NO: 409397 - protein, 9 aa, Homo Sapiens
PPCLEAEGG

SEQ ID NO: 409398 - protein, 9 aa, Homo Sapiens
VHIQPFSLD

SEQ ID NO: 409399 - protein, 9 aa, Homo Sapiens
YLSNAHPDN

SEQ ID NO: 409400 - protein, 9 aa, Homo Sapiens
MAEERMTGH

SEQ ID NO: 409401 - protein, 9 aa, Homo Sapiens
MYRISCLRD

SEQ ID NO: 409402 - protein, 9 aa, Homo Sapiens
SENRAFRRG

SEQ ID NO: 409403 - protein, 9 aa, Homo Sapiens
MKRDREFRI

SEQ ID NO: 409404 - protein, 9 aa, Homo Sapiens
LLSLAWKIC

SEQ ID NO: 409405 - protein, 9 aa, Homo Sapiens
LWRQNGGSG

SEQ ID NO: 409406 - protein, 9 aa, Homo Sapiens
TGSSSSAPT

SEQ ID NO: 409407 - protein, 9 aa, Homo Sapiens
SVAPQPGGA

SEQ ID NO: 409408 - protein, 9 aa, Homo Sapiens
QWQRRYFYP

SEQ ID NO: 409409 - protein, 9 aa, Homo Sapiens
RCMRAAASG

SEQ ID NO: 409410 - protein, 9 aa, Homo Sapiens
NGDTLHVFK

SEQ ID NO: 409411 - protein, 9 aa, Homo Sapiens
TGGGFGPVA

SEQ ID NO: 409412 - protein, 9 aa, Homo Sapiens
KVRTKIRKR

SEQ ID NO: 409413 - protein, 9 aa, Homo Sapiens
SLPPACTWA

SEQ ID NO: 409414 - protein, 9 aa, Homo Sapiens
QQARSHFPG

SEQ ID NO: 409415 - protein, 9 aa, Homo Sapiens
KIKEKMILK

SEQ ID NO: 409416 - protein, 9 aa, Homo Sapiens
VLDVSSISH

SEQ ID NO: 409417 - protein, 9 aa, Homo Sapiens
AQVVRDTAT

SEQ ID NO: 409418 - protein, 9 aa, Homo Sapiens
AAHQAGAAP

SEQ ID NO: 409419 - protein, 9 aa, Homo Sapiens
GPRTTELST

SEQ ID NO: 409420 - protein, 9 aa, Homo Sapiens
PETEPAGAP

SEQ ID NO: 409421 - protein, 9 aa, Homo Sapiens
CNEGHAPLT

SEQ ID NO: 409422 - protein, 9 aa, Homo Sapiens
TVVLQCIAG

SEQ ID NO: 409423 - protein, 9 aa, Homo Sapiens
SPLELEHLK

SEQ ID NO: 409424 - protein, 9 aa, Homo Sapiens
EGAMKDKCR

SEQ ID NO: 409425 - protein, 9 aa, Homo Sapiens
RKGLWERSP

SEQ ID NO: 409426 - protein, 9 aa, Homo Sapiens
PSNCQELRL

SEQ ID NO: 409427 - protein, 9 aa, Homo Sapiens
ITIKKRFEV

SEQ ID NO: 409428 - protein, 9 aa, Homo Sapiens
RWRPTRRPR

SEQ ID NO: 409429 - protein, 9 aa, Homo Sapiens
VLATAGALL

SEQ ID NO: 409430 - protein, 9 aa, Homo Sapiens
NDDMTLTSP

SEQ ID NO: 409431 - protein, 9 aa, Homo Sapiens
EVVWTVALL

SEQ ID NO: 409432 - protein, 9 aa, Homo Sapiens
RAAQQARSH

SEQ ID NO: 409433 - protein, 9 aa, Homo Sapiens
GHCMKNHHC

SEQ ID NO: 409434 - protein, 9 aa, Homo Sapiens
GRRGAPGHP

SEQ ID NO: 409435 - protein, 9 aa, Homo Sapiens
ALSPDGDQV

SEQ ID NO: 409436 - protein, 9 aa, Homo Sapiens
ANMPASLRA

SEQ ID NO: 409437 - protein, 9 aa, Homo Sapiens
EEMHFAEVV

SEQ ID NO: 409438 - protein, 9 aa, Homo Sapiens
WWIAMTYER

SEQ ID NO: 409439 - protein, 9 aa, Homo Sapiens
AAVQQGVQR

SEQ ID NO: 409440 - protein, 9 aa, Homo Sapiens
TPPAVPPVL

SEQ ID NO: 409441 - protein, 9 aa, Homo Sapiens
IFSLLCLLG

SEQ ID NO: 409442 - protein, 9 aa, Homo Sapiens
LRGGGLLVL

SEQ ID NO: 409443 - protein, 9 aa, Homo Sapiens
PFQVLSLLP

SEQ ID NO: 409444 - protein, 9 aa, Homo Sapiens
NCCSEDCAA

SEQ ID NO: 409445 - protein, 9 aa, Homo Sapiens
MPLGIQTTG

SEQ ID NO: 409446 - protein, 9 aa, Homo Sapiens
QVHKDEALK

SEQ ID NO: 409447 - protein, 9 aa, Homo Sapiens
KKDSQNCED

SEQ ID NO: 409448 - protein, 9 aa, Homo Sapiens
PCSMCCVII

SEQ ID NO: 409449 - protein, 9 aa, Homo Sapiens
ARQVEFVRI

SEQ ID NO: 409450 - protein, 9 aa, Homo Sapiens
SHVPFSSGQ

SEQ ID NO: 409451 - protein, 9 aa, Homo Sapiens
VEITTYRKL

SEQ ID NO: 409452 - protein, 9 aa, Homo Sapiens
PLPTPDGGP

SEQ ID NO: 409453 - protein, 9 aa, Homo Sapiens
AGEHLPQPP

SEQ ID NO: 409454 - protein, 9 aa, Homo Sapiens
QTTGPVTLR

SEQ ID NO: 409455 - protein, 9 aa, Homo Sapiens
ILPSGCHVL

SEQ ID NO: 409456 - protein, 9 aa, Homo Sapiens
REWPVSMSF

SEQ ID NO: 409457 - protein, 9 aa, Homo Sapiens
RTAQLTSLV

SEQ ID NO: 409458 - protein, 9 aa, Homo Sapiens
LGLCQGALQ

SEQ ID NO: 409459 - protein, 9 aa, Homo Sapiens
SILTQAITG

SEQ ID NO: 409460 - protein, 9 aa, Homo Sapiens
PQLSSPALL

SEQ ID NO: 409461 - protein, 9 aa, Homo Sapiens
ALALDKTEQ

SEQ ID NO: 409462 - protein, 9 aa, Homo Sapiens
VDVEGGQLV

SEQ ID NO: 409463 - protein, 9 aa, Homo Sapiens
EDDGRTVDS

SEQ ID NO: 409464 - protein, 9 aa, Homo Sapiens
PVHATFRAV

SEQ ID NO: 409465 - protein, 9 aa, Homo Sapiens
WMFLRILEQ

SEQ ID NO: 409466 - protein, 9 aa, Homo Sapiens
KDSQNCEDA

SEQ ID NO: 409467 - protein, 9 aa, Homo Sapiens
MSLGLLTKK

SEQ ID NO: 409468 - protein, 9 aa, Homo Sapiens
LVSRRLQAY

SEQ ID NO: 409469 - protein, 9 aa, Homo Sapiens
RHMEIDKNA

SEQ ID NO: 409470 - protein, 9 aa, Homo Sapiens
RLTGSIISS

SEQ ID NO: 409471 - protein, 9 aa, Homo Sapiens
SQCWELNPQ

SEQ ID NO: 409472 - protein, 9 aa, Homo Sapiens
PEPHHTLGD

SEQ ID NO: 409473 - protein, 9 aa, Homo Sapiens
SDFKGPWPL

SEQ ID NO: 409474 - protein, 9 aa, Homo Sapiens
EEYRVLQDK

SEQ ID NO: 409475 - protein, 9 aa, Homo Sapiens
HVHSATLAI

SEQ ID NO: 409476 - protein, 9 aa, Homo Sapiens
WKRLRLHSR

SEQ ID NO: 409477 - protein, 9 aa, Homo Sapiens
LERVLDRDE

SEQ ID NO: 409478 - protein, 9 aa, Homo Sapiens
YYVVFFTSP

SEQ ID NO: 409479 - protein, 9 aa, Homo Sapiens
DSSINHFFV

SEQ ID NO: 409480 - protein, 9 aa, Homo Sapiens
LARIGRILC

SEQ ID NO: 409481 - protein, 9 aa, Homo Sapiens
SPFLSSTEG

SEQ ID NO: 409482 - protein, 9 aa, Homo Sapiens
SPSCLCSSP

SEQ ID NO: 409483 - protein, 9 aa, Homo Sapiens
GLLVLTGVS

SEQ ID NO: 409484 - protein, 9 aa, Homo Sapiens
PWALGTGVP

SEQ ID NO: 409485 - protein, 9 aa, Homo Sapiens
TSVKTNPQC

SEQ ID NO: 409486 - protein, 9 aa, Homo Sapiens
SVTFHIIAI

SEQ ID NO: 409487 - protein, 9 aa, Homo Sapiens
VSAEHAQQN

SEQ ID NO: 409488 - protein, 9 aa, Homo Sapiens
HSFQKQQWE

SEQ ID NO: 409489 - protein, 9 aa, Homo Sapiens
LWLIGAKSK

SEQ ID NO: 409490 - protein, 9 aa, Homo Sapiens
EDIVHNIQA

SEQ ID NO: 409491 - protein, 9 aa, Homo Sapiens
WSRWRPTRR

SEQ ID NO: 409492 - protein, 9 aa, Homo Sapiens
VYLRIYMYV

SEQ ID NO: 409493 - protein, 9 aa, Homo Sapiens
FVNGQPLPD

SEQ ID NO: 409494 - protein, 9 aa, Homo Sapiens
QPNAATGGG

SEQ ID NO: 409495 - protein, 9 aa, Homo Sapiens
AMSKTLQDF

SEQ ID NO: 409496 - protein, 9 aa, Homo Sapiens
RAKNRVLMI

SEQ ID NO: 409497 - protein, 9 aa, Homo Sapiens
TEKYAGIFW

SEQ ID NO: 409498 - protein, 9 aa, Homo Sapiens
GSCTDSQSV

SEQ ID NO: 409499 - protein, 9 aa, Homo Sapiens
AGPKCPAGE

SEQ ID NO: 409500 - protein, 9 aa, Homo Sapiens
PVPGALKAP

SEQ ID NO: 409501 - protein, 9 aa, Homo Sapiens
SPAPADAPR

SEQ ID NO: 409502 - protein, 9 aa, Homo Sapiens
GEPRHCIEF

SEQ ID NO: 409503 - protein, 9 aa, Homo Sapiens
MLGLALPWE

SEQ ID NO: 409504 - protein, 9 aa, Homo Sapiens
PYNIAACPA

SEQ ID NO: 409505 - protein, 9 aa, Homo Sapiens
GSFTVHSPI

SEQ ID NO: 409506 - protein, 9 aa, Homo Sapiens
DGLYALMSQ

SEQ ID NO: 409507 - protein, 9 aa, Homo Sapiens
ERSLQSMAK

SEQ ID NO: 409508 - protein, 9 aa, Homo Sapiens
DRTYGDMAT

SEQ ID NO: 409509 - protein, 9 aa, Homo Sapiens
KQMVGGSLS

SEQ ID NO: 409510 - protein, 9 aa, Homo Sapiens
APDCEASVT

SEQ ID NO: 409511 - protein, 9 aa, Homo Sapiens
LVVRLHEGV

SEQ ID NO: 409512 - protein, 9 aa, Homo Sapiens
KKPRTSFTC

SEQ ID NO: 409513 - protein, 9 aa, Homo Sapiens
GRPNGGPHA

SEQ ID NO: 409514 - protein, 9 aa, Homo Sapiens
IAHVLFALL

SEQ ID NO: 409515 - protein, 9 aa, Homo Sapiens
LQALDEVIE

SEQ ID NO: 409516 - protein, 9 aa, Homo Sapiens
PGMNMKMKT

SEQ ID NO: 409517 - protein, 9 aa, Homo Sapiens
WAVSHEGRT

SEQ ID NO: 409518 - protein, 9 aa, Homo Sapiens
QGGWTYGGS

SEQ ID NO: 409519 - protein, 9 aa, Homo Sapiens
TSYYRRDRS

SEQ ID NO: 409520 - protein, 9 aa, Homo Sapiens
RTALSVRGP

SEQ ID NO: 409521 - protein, 9 aa, Homo Sapiens
PSGDRPLHC

SEQ ID NO: 409522 - protein, 9 aa, Homo Sapiens
LPGTLKGLC

SEQ ID NO: 409523 - protein, 9 aa, Homo Sapiens
LYGSYPPAR

SEQ ID NO: 409524 - protein, 9 aa, Homo Sapiens
TASRGPSPS

SEQ ID NO: 409525 - protein, 9 aa, Homo Sapiens
QLRGRARAG

SEQ ID NO: 409526 - protein, 9 aa, Homo Sapiens
LLKKLQNWN

SEQ ID NO: 409527 - protein, 9 aa, Homo Sapiens
KTAPSLSTA

SEQ ID NO: 409528 - protein, 9 aa, Homo Sapiens
VLQKLQKDR

SEQ ID NO: 409529 - protein, 9 aa, Homo Sapiens
MPPPPPPAP

SEQ ID NO: 409530 - protein, 9 aa, Homo Sapiens
HQSFHQMRS

SEQ ID NO: 409531 - protein, 9 aa, Homo Sapiens
NKRPAHHRR

SEQ ID NO: 409532 - protein, 9 aa, Homo Sapiens
VLGGGGSGG

SEQ ID NO: 409533 - protein, 9 aa, Homo Sapiens
DGVSAEHAQ

SEQ ID NO: 409534 - protein, 9 aa, Homo Sapiens
SINTAWSQV

SEQ ID NO: 409535 - protein, 9 aa, Homo Sapiens
DSDREGPVK

SEQ ID NO: 409536 - protein, 9 aa, Homo Sapiens
ISHSRGIRL

SEQ ID NO: 409537 - protein, 9 aa, Homo Sapiens
TPDQYQASQ

SEQ ID NO: 409538 - protein, 9 aa, Homo Sapiens
TVDNNIHSG

SEQ ID NO: 409539 - protein, 9 aa, Homo Sapiens
ATAAAPQRS

SEQ ID NO: 409540 - protein, 9 aa, Homo Sapiens
STCLVAMEP

SEQ ID NO: 409541 - protein, 9 aa, Homo Sapiens
AQISTGGII

SEQ ID NO: 409542 - protein, 9 aa, Homo Sapiens
TGATGERTK

SEQ ID NO: 409543 - protein, 9 aa, Homo Sapiens
KIQIGNSLE

SEQ ID NO: 409544 - protein, 9 aa, Homo Sapiens
QKSDFSNNW

SEQ ID NO: 409545 - protein, 9 aa, Homo Sapiens
GAFMVCWAP

SEQ ID NO: 409546 - protein, 9 aa, Homo Sapiens
LREQRSVAY

SEQ ID NO: 409547 - protein, 9 aa, Homo Sapiens
GQVGCRKSS

SEQ ID NO: 409548 - protein, 9 aa, Homo Sapiens
PGETHSQQI

SEQ ID NO: 409549 - protein, 9 aa, Homo Sapiens
EVHFVLNDW

SEQ ID NO: 409550 - protein, 9 aa, Homo Sapiens
MSYTRAVDW

SEQ ID NO: 409551 - protein, 9 aa, Homo Sapiens
HYWTYDAYS

SEQ ID NO: 409552 - protein, 9 aa, Homo Sapiens
SWLMTALLP

SEQ ID NO: 409553 - protein, 9 aa, Homo Sapiens
LPHHHHHHQ

SEQ ID NO: 409554 - protein, 9 aa, Homo Sapiens
YKDFLIQLK

SEQ ID NO: 409555 - protein, 9 aa, Homo Sapiens
LVAEGALVG

SEQ ID NO: 409556 - protein, 9 aa, Homo Sapiens
EIYQSLFLQ

SEQ ID NO: 409557 - protein, 9 aa, Homo Sapiens
PPVTPLRVQ

SEQ ID NO: 409558 - protein, 9 aa, Homo Sapiens
SGFFQSLMS

SEQ ID NO: 409559 - protein, 9 aa, Homo Sapiens
PCTSRPGQT

SEQ ID NO: 409560 - protein, 9 aa, Homo Sapiens
KKPTSWMSW

SEQ ID NO: 409561 - protein, 9 aa, Homo Sapiens
PLYGWEQLS

SEQ ID NO: 409562 - protein, 9 aa, Homo Sapiens
GGNRSICLT

SEQ ID NO: 409563 - protein, 9 aa, Homo Sapiens
PMREVAEAA

SEQ ID NO: 409564 - protein, 9 aa, Homo Sapiens
QPMQVMVEP

SEQ ID NO: 409565 - protein, 9 aa, Homo Sapiens
SLSLQCCCH

SEQ ID NO: 409566 - protein, 9 aa, Homo Sapiens
ETNSFVNKL

SEQ ID NO: 409567 - protein, 9 aa, Homo Sapiens
GQVHKDEAL

SEQ ID NO: 409568 - protein, 9 aa, Homo Sapiens
PLMWGMGMR

SEQ ID NO: 409569 - protein, 9 aa, Homo Sapiens
FKYYGTQEA

SEQ ID NO: 409570 - protein, 9 aa, Homo Sapiens
WFSFELVVH

SEQ ID NO: 409571 - protein, 9 aa, Homo Sapiens
KVPREKGRL

SEQ ID NO: 409572 - protein, 9 aa, Homo Sapiens
TFIYSVVCI

SEQ ID NO: 409573 - protein, 9 aa, Homo Sapiens
GLTAEVNWK

SEQ ID NO: 409574 - protein, 9 aa, Homo Sapiens
ATFRAVDSS

SEQ ID NO: 409575 - protein, 9 aa, Homo Sapiens
RRARPGQLR

SEQ ID NO: 409576 - protein, 9 aa, Homo Sapiens
EEGWGGCPA

SEQ ID NO: 409577 - protein, 9 aa, Homo Sapiens
GGSFPLQCV

SEQ ID NO: 409578 - protein, 9 aa, Homo Sapiens
HLDLSKNQI

SEQ ID NO: 409579 - protein, 9 aa, Homo Sapiens
LLKEMKLIE

SEQ ID NO: 409580 - protein, 9 aa, Homo Sapiens
LEQRLQDQQ

SEQ ID NO: 409581 - protein, 9 aa, Homo Sapiens
AYTPSSPSI

SEQ ID NO: 409582 - protein, 9 aa, Homo Sapiens
YPHAIVYPF

SEQ ID NO: 409583 - protein, 9 aa, Homo Sapiens
DIVHNIQAS

SEQ ID NO: 409584 - protein, 9 aa, Homo Sapiens
KAEEQARRQ

SEQ ID NO: 409585 - protein, 9 aa, Homo Sapiens
KLAWELGHR

SEQ ID NO: 409586 - protein, 9 aa, Homo Sapiens
WPASTTVLS

SEQ ID NO: 409587 - protein, 9 aa, Homo Sapiens
ENRAFRRGT

SEQ ID NO: 409588 - protein, 9 aa, Homo Sapiens
PEEHNLYQC

SEQ ID NO: 409589 - protein, 9 aa, Homo Sapiens
NIRKNGETK

SEQ ID NO: 409590 - protein, 9 aa, Homo Sapiens
LNASAPNDS

SEQ ID NO: 409591 - protein, 9 aa, Homo Sapiens
SLRKWRPGA

SEQ ID NO: 409592 - protein, 9 aa, Homo Sapiens
PTLPRCVST

SEQ ID NO: 409593 - protein, 9 aa, Homo Sapiens
FDRSHRDAS

SEQ ID NO: 409594 - protein, 9 aa, Homo Sapiens
PYFAMEIFA

SEQ ID NO: 409595 - protein, 9 aa, Homo Sapiens
DQITNEIVQ

SEQ ID NO: 409596 - protein, 9 aa, Homo Sapiens
FHEALMHLL

SEQ ID NO: 409597 - protein, 9 aa, Homo Sapiens
HLFPPFEES

SEQ ID NO: 409598 - protein, 9 aa, Homo Sapiens
TSYKLTDLR

SEQ ID NO: 409599 - protein, 9 aa, Homo Sapiens
PRSPSPRSS

SEQ ID NO: 409600 - protein, 9 aa, Homo Sapiens
MMMILTNFL

SEQ ID NO: 409601 - protein, 9 aa, Homo Sapiens
AAAPPPAQW

SEQ ID NO: 409602 - protein, 9 aa, Homo Sapiens
SLACSITVS

SEQ ID NO: 409603 - protein, 9 aa, Homo Sapiens
FLSQGGYHR

SEQ ID NO: 409604 - protein, 9 aa, Homo Sapiens
IGDSGGRQD

SEQ ID NO: 409605 - protein, 9 aa, Homo Sapiens
DRSVSRDGG

SEQ ID NO: 409606 - protein, 9 aa, Homo Sapiens
PMHFTDVDL

SEQ ID NO: 409607 - protein, 9 aa, Homo Sapiens
GNSMTDNSD

SEQ ID NO: 409608 - protein, 9 aa, Homo Sapiens
ILEVTSEEP

SEQ ID NO: 409609 - protein, 9 aa, Homo Sapiens
VFVPRWRTR

SEQ ID NO: 409610 - protein, 9 aa, Homo Sapiens
ASAMPRATW

SEQ ID NO: 409611 - protein, 9 aa, Homo Sapiens
SGLQQQTMA

SEQ ID NO: 409612 - protein, 9 aa, Homo Sapiens
RVQSVLLLG

SEQ ID NO: 409613 - protein, 9 aa, Homo Sapiens
ASSPGHPLG

SEQ ID NO: 409614 - protein, 9 aa, Homo Sapiens
GGWRICCSL

SEQ ID NO: 409615 - protein, 9 aa, Homo Sapiens
SGFWEIENK

SEQ ID NO: 409616 - protein, 9 aa, Homo Sapiens
PLFMYLFIG

SEQ ID NO: 409617 - protein, 9 aa, Homo Sapiens
WGNLRQAAI

SEQ ID NO: 409618 - protein, 9 aa, Homo Sapiens
FLMDFFRNH

SEQ ID NO: 409619 - protein, 9 aa, Homo Sapiens
SHCLLTAHL

SEQ ID NO: 409620 - protein, 9 aa, Homo Sapiens
KLIMMMNHI

SEQ ID NO: 409621 - protein, 9 aa, Homo Sapiens
RNDFCVIYV

SEQ ID NO: 409622 - protein, 9 aa, Homo Sapiens
RGPGGAEGL

SEQ ID NO: 409623 - protein, 9 aa, Homo Sapiens
TGALPTAAC

SEQ ID NO: 409624 - protein, 9 aa, Homo Sapiens
LECMDSNEG

SEQ ID NO: 409625 - protein, 9 aa, Homo Sapiens
PVLMSHKIC

SEQ ID NO: 409626 - protein, 9 aa, Homo Sapiens
RWLALVMGS

SEQ ID NO: 409627 - protein, 9 aa, Homo Sapiens
AMLPKLLCR

SEQ ID NO: 409628 - protein, 9 aa, Homo Sapiens
SALCVACCL

SEQ ID NO: 409629 - protein, 9 aa, Homo Sapiens
DVKRQCCRC

SEQ ID NO: 409630 - protein, 9 aa, Homo Sapiens
SSPLLCRKD

SEQ ID NO: 409631 - protein, 9 aa, Homo Sapiens
CGLHYDIQK

SEQ ID NO: 409632 - protein, 9 aa, Homo Sapiens
SSHYPPGGL

SEQ ID NO: 409633 - protein, 9 aa, Homo Sapiens
VAICHPLCH

SEQ ID NO: 409634 - protein, 9 aa, Homo Sapiens
LLKFPEIVT

SEQ ID NO: 409635 - protein, 9 aa, Homo Sapiens
LHRELPPDQ

SEQ ID NO: 409636 - protein, 9 aa, Homo Sapiens
QHRQLFEAG

SEQ ID NO: 409637 - protein, 9 aa, Homo Sapiens
WKPCDNGDP

SEQ ID NO: 409638 - protein, 9 aa, Homo Sapiens
MVVEKFLKR

SEQ ID NO: 409639 - protein, 9 aa, Homo Sapiens
SFFAASSHY

SEQ ID NO: 409640 - protein, 9 aa, Homo Sapiens
DYKGTMPVP

SEQ ID NO: 409641 - protein, 9 aa, Homo Sapiens
YPPILRSAT

SEQ ID NO: 409642 - protein, 9 aa, Homo Sapiens
SSMACGSAE

SEQ ID NO: 409643 - protein, 9 aa, Homo Sapiens
RFGHFTSFN

SEQ ID NO: 409644 - protein, 9 aa, Homo Sapiens
AGRGGAAQP

SEQ ID NO: 409645 - protein, 9 aa, Homo Sapiens
EKSDQLLSC

SEQ ID NO: 409646 - protein, 9 aa, Homo Sapiens
TAGVCQQEG

SEQ ID NO: 409647 - protein, 9 aa, Homo Sapiens
STCSLPCRG

SEQ ID NO: 409648 - protein, 9 aa, Homo Sapiens
ISPLSILSC

SEQ ID NO: 409649 - protein, 9 aa, Homo Sapiens
HSPCSVGGG

SEQ ID NO: 409650 - protein, 9 aa, Homo Sapiens
KCLDESSGG

SEQ ID NO: 409651 - protein, 9 aa, Homo Sapiens
FRKKVEIEM

SEQ ID NO: 409652 - protein, 9 aa, Homo Sapiens
FSSRFLNLE

SEQ ID NO: 409653 - protein, 9 aa, Homo Sapiens
RGCRPMRKT

SEQ ID NO: 409654 - protein, 9 aa, Homo Sapiens
ENSHPPTTT

SEQ ID NO: 409655 - protein, 9 aa, Homo Sapiens
CLDESSGGW

SEQ ID NO: 409656 - protein, 9 aa, Homo Sapiens
QVKNSPTTA

SEQ ID NO: 409657 - protein, 9 aa, Homo Sapiens
TGGGPACVP

SEQ ID NO: 409658 - protein, 9 aa, Homo Sapiens
CAIRKYTSK

SEQ ID NO: 409659 - protein, 9 aa, Homo Sapiens
RAWLRERRQ

SEQ ID NO: 409660 - protein, 9 aa, Homo Sapiens
DHPEEHNLY

SEQ ID NO: 409661 - protein, 9 aa, Homo Sapiens
LPPLPPPLP

SEQ ID NO: 409662 - protein, 9 aa, Homo Sapiens
KGLEGVREN

SEQ ID NO: 409663 - protein, 9 aa, Homo Sapiens
GYEGGFPYL

SEQ ID NO: 409664 - protein, 9 aa, Homo Sapiens
EDIPWMLID

SEQ ID NO: 409665 - protein, 9 aa, Homo Sapiens
TPKSGELRV

SEQ ID NO: 409666 - protein, 9 aa, Homo Sapiens
GGPRRVRGV

SEQ ID NO: 409667 - protein, 9 aa, Homo Sapiens
QELAERGVH

SEQ ID NO: 409668 - protein, 9 aa, Homo Sapiens
EGIRWLQPN

SEQ ID NO: 409669 - protein, 9 aa, Homo Sapiens
SKEGSASER

SEQ ID NO: 409670 - protein, 9 aa, Homo Sapiens
SETGATELH

SEQ ID NO: 409671 - protein, 9 aa, Homo Sapiens
PCYRECNQY

SEQ ID NO: 409672 - protein, 9 aa, Homo Sapiens
CIPLANLSW

SEQ ID NO: 409673 - protein, 9 aa, Homo Sapiens
EEKNVHRQP

SEQ ID NO: 409674 - protein, 9 aa, Homo Sapiens
FLIGHLLDD

SEQ ID NO: 409675 - protein, 9 aa, Homo Sapiens
YSNAGLTRN

SEQ ID NO: 409676 - protein, 9 aa, Homo Sapiens
FFNYRKKIG

SEQ ID NO: 409677 - protein, 9 aa, Homo Sapiens
QPRKMAPTT

SEQ ID NO: 409678 - protein, 9 aa, Homo Sapiens
HTHLLQSNP

SEQ ID NO: 409679 - protein, 9 aa, Homo Sapiens
TDIPSVIAA

SEQ ID NO: 409680 - protein, 9 aa, Homo Sapiens
DFMDLASTA

SEQ ID NO: 409681 - protein, 9 aa, Homo Sapiens
QVQPIWAVP

SEQ ID NO: 409682 - protein, 9 aa, Homo Sapiens
MQVPPSILH

SEQ ID NO: 409683 - protein, 9 aa, Homo Sapiens
PPGPACPIS

SEQ ID NO: 409684 - protein, 9 aa, Homo Sapiens
AAPGGHPIV

SEQ ID NO: 409685 - protein, 9 aa, Homo Sapiens
VDIHLLREE

SEQ ID NO: 409686 - protein, 9 aa, Homo Sapiens
PSQVWTAAT

SEQ ID NO: 409687 - protein, 9 aa, Homo Sapiens
PFPVSALIA

SEQ ID NO: 409688 - protein, 9 aa, Homo Sapiens
EREAISWLK

SEQ ID NO: 409689 - protein, 9 aa, Homo Sapiens
GRYCHPGCY

SEQ ID NO: 409690 - protein, 9 aa, Homo Sapiens
QMTPTKQAC

SEQ ID NO: 409691 - protein, 9 aa, Homo Sapiens
PQTQLQDNK

SEQ ID NO: 409692 - protein, 9 aa, Homo Sapiens
VWTVHRIRM

SEQ ID NO: 409693 - protein, 9 aa, Homo Sapiens
TWRLGLRKM

SEQ ID NO: 409694 - protein, 9 aa, Homo Sapiens
SPCPAPPLL

SEQ ID NO: 409695 - protein, 9 aa, Homo Sapiens
PSRRGPQIL

SEQ ID NO: 409696 - protein, 9 aa, Homo Sapiens
AHRHIELGV

SEQ ID NO: 409697 - protein, 9 aa, Homo Sapiens
TNATGAFRV

SEQ ID NO: 409698 - protein, 9 aa, Homo Sapiens
APAPKMCAP

SEQ ID NO: 409699 - protein, 9 aa, Homo Sapiens
KAEFGNQWI

SEQ ID NO: 409700 - protein, 9 aa, Homo Sapiens
SHPLVLPNK

SEQ ID NO: 409701 - protein, 9 aa, Homo Sapiens
YVLAVKWGR

SEQ ID NO: 409702 - protein, 9 aa, Homo Sapiens
QVAMLPKLL

SEQ ID NO: 409703 - protein, 9 aa, Homo Sapiens
GTRGAQQSC

SEQ ID NO: 409704 - protein, 9 aa, Homo Sapiens
DSNFHQSFH

SEQ ID NO: 409705 - protein, 9 aa, Homo Sapiens
LKPYQCPKC

SEQ ID NO: 409706 - protein, 9 aa, Homo Sapiens
VTTVRTAGC

SEQ ID NO: 409707 - protein, 9 aa, Homo Sapiens
PGQHLWLSH

SEQ ID NO: 409708 - protein, 9 aa, Homo Sapiens
KVPCLCLEE

SEQ ID NO: 409709 - protein, 9 aa, Homo Sapiens
TVPRKTLKM

SEQ ID NO: 409710 - protein, 9 aa, Homo Sapiens
RPVCISEKQ

SEQ ID NO: 409711 - protein, 9 aa, Homo Sapiens
VAALLILLQ

SEQ ID NO: 409712 - protein, 9 aa, Homo Sapiens
PAPAPKMCA

SEQ ID NO: 409713 - protein, 9 aa, Homo Sapiens
ELQSLQCHL

SEQ ID NO: 409714 - protein, 9 aa, Homo Sapiens
SKKNKRPAH

SEQ ID NO: 409715 - protein, 9 aa, Homo Sapiens
RKKDVKRQC

SEQ ID NO: 409716 - protein, 9 aa, Homo Sapiens
HSVEVCLSI

SEQ ID NO: 409717 - protein, 9 aa, Homo Sapiens
TVLQPPKPP

SEQ ID NO: 409718 - protein, 9 aa, Homo Sapiens
CITECVRTA

SEQ ID NO: 409719 - protein, 9 aa, Homo Sapiens
RTAQGLLVV

SEQ ID NO: 409720 - protein, 9 aa, Homo Sapiens
KIQNQKRLQ

SEQ ID NO: 409721 - protein, 9 aa, Homo Sapiens
FSPGCPLRG

SEQ ID NO: 409722 - protein, 9 aa, Homo Sapiens
MGGKLQRRK

SEQ ID NO: 409723 - protein, 9 aa, Homo Sapiens
CALQLLAAT

SEQ ID NO: 409724 - protein, 9 aa, Homo Sapiens
VARVEVAAG

SEQ ID NO: 409725 - protein, 9 aa, Homo Sapiens
GIPFSLQLL

SEQ ID NO: 409726 - protein, 9 aa, Homo Sapiens
QPSSSVVMM

SEQ ID NO: 409727 - protein, 9 aa, Homo Sapiens
PGPPGPEGE

SEQ ID NO: 409728 - protein, 9 aa, Homo Sapiens
RRRKMTTLE

SEQ ID NO: 409729 - protein, 9 aa, Homo Sapiens
PVDTPDIPS

SEQ ID NO: 409730 - protein, 9 aa, Homo Sapiens
VVWEGETLT

SEQ ID NO: 409731 - protein, 9 aa, Homo Sapiens
GHPRGSQSA

SEQ ID NO: 409732 - protein, 9 aa, Homo Sapiens
RPLVREQLW

SEQ ID NO: 409733 - protein, 9 aa, Homo Sapiens
GGLWEPREL

SEQ ID NO: 409734 - protein, 9 aa, Homo Sapiens
NNMQLARSS

SEQ ID NO: 409735 - protein, 9 aa, Homo Sapiens
WLKDRPPLR

SEQ ID NO: 409736 - protein, 9 aa, Homo Sapiens
RRLGGEQRK

SEQ ID NO: 409737 - protein, 9 aa, Homo Sapiens
HQQQQQQMQ

SEQ ID NO: 409738 - protein, 9 aa, Homo Sapiens
VDSEIGTSD

SEQ ID NO: 409739 - protein, 9 aa, Homo Sapiens
EQPGSWGFQ

SEQ ID NO: 409740 - protein, 9 aa, Homo Sapiens
ARKPKVDGH

SEQ ID NO: 409741 - protein, 9 aa, Homo Sapiens
TAPWVKVVF

SEQ ID NO: 409742 - protein, 9 aa, Homo Sapiens
FVAPNSLKG

SEQ ID NO: 409743 - protein, 9 aa, Homo Sapiens
GSPEESRWW

SEQ ID NO: 409744 - protein, 9 aa, Homo Sapiens
LIVGQIVRR

SEQ ID NO: 409745 - protein, 9 aa, Homo Sapiens
MACGSAESS

SEQ ID NO: 409746 - protein, 9 aa, Homo Sapiens
VRGSMHFAL

SEQ ID NO: 409747 - protein, 9 aa, Homo Sapiens
TFTITVCPK

SEQ ID NO: 409748 - protein, 9 aa, Homo Sapiens
TSPTHGGSR

SEQ ID NO: 409749 - protein, 9 aa, Homo Sapiens
ETRDQAFKK

SEQ ID NO: 409750 - protein, 9 aa, Homo Sapiens
KQAPAFKYF

SEQ ID NO: 409751 - protein, 9 aa, Homo Sapiens
LLVPPGHES

SEQ ID NO: 409752 - protein, 9 aa, Homo Sapiens
CLDCAVVNC

SEQ ID NO: 409753 - protein, 9 aa, Homo Sapiens
QKEVTIFLS

SEQ ID NO: 409754 - protein, 9 aa, Homo Sapiens
AVTASSEAL

SEQ ID NO: 409755 - protein, 9 aa, Homo Sapiens
TPKETPIEQ

SEQ ID NO: 409756 - protein, 9 aa, Homo Sapiens
SVLHILGTQ

SEQ ID NO: 409757 - protein, 9 aa, Homo Sapiens
GVFDPRYRF

SEQ ID NO: 409758 - protein, 9 aa, Homo Sapiens
PMLMGPPPA

SEQ ID NO: 409759 - protein, 9 aa, Homo Sapiens
ALGVDAARL

SEQ ID NO: 409760 - protein, 9 aa, Homo Sapiens
SNVNGSKVI

SEQ ID NO: 409761 - protein, 9 aa, Homo Sapiens
FFVPMSLAC

SEQ ID NO: 409762 - protein, 9 aa, Homo Sapiens
QENFSLSQE

SEQ ID NO: 409763 - protein, 9 aa, Homo Sapiens
EDEDEGEED

SEQ ID NO: 409764 - protein, 9 aa, Homo Sapiens
NWDSPSHVP

SEQ ID NO: 409765 - protein, 9 aa, Homo Sapiens
ALDVEVSRP

SEQ ID NO: 409766 - protein, 9 aa, Homo Sapiens
GFTVFARVL

SEQ ID NO: 409767 - protein, 9 aa, Homo Sapiens
LPSNIYTGL

SEQ ID NO: 409768 - protein, 9 aa, Homo Sapiens
ALTFRIWHN

SEQ ID NO: 409769 - protein, 9 aa, Homo Sapiens
SPSLQENEP

SEQ ID NO: 409770 - protein, 9 aa, Homo Sapiens
LPNMNQLVS

SEQ ID NO: 409771 - protein, 9 aa, Homo Sapiens
ALLLSVCPT

SEQ ID NO: 409772 - protein, 9 aa, Homo Sapiens
SLPAPPSFS

SEQ ID NO: 409773 - protein, 9 aa, Homo Sapiens
DGDQVAVGY

SEQ ID NO: 409774 - protein, 9 aa, Homo Sapiens
LEGEGLKMS

SEQ ID NO: 409775 - protein, 9 aa, Homo Sapiens
FHSTQDSAL

SEQ ID NO: 409776 - protein, 9 aa, Homo Sapiens
RRLQAYARR

SEQ ID NO: 409777 - protein, 9 aa, Homo Sapiens
THTHALQSP

SEQ ID NO: 409778 - protein, 9 aa, Homo Sapiens
GEYRMLQTQ

SEQ ID NO: 409779 - protein, 9 aa, Homo Sapiens
VSVCQDVRC

SEQ ID NO: 409780 - protein, 9 aa, Homo Sapiens
PNDLKKKIA

SEQ ID NO: 409781 - protein, 9 aa, Homo Sapiens
SDSAERLQI

SEQ ID NO: 409782 - protein, 9 aa, Homo Sapiens
IGNSLENQS

SEQ ID NO: 409783 - protein, 9 aa, Homo Sapiens
AWDSEGMKR

SEQ ID NO: 409784 - protein, 9 aa, Homo Sapiens
SREWAICWE

SEQ ID NO: 409785 - protein, 9 aa, Homo Sapiens
SEGMKRSST

SEQ ID NO: 409786 - protein, 9 aa, Homo Sapiens
EGEVENGRG

SEQ ID NO: 409787 - protein, 9 aa, Homo Sapiens
NRSFRVDIA

SEQ ID NO: 409788 - protein, 9 aa, Homo Sapiens
SNQKCIDKA

SEQ ID NO: 409789 - protein, 9 aa, Homo Sapiens
QRERVEDVS

SEQ ID NO: 409790 - protein, 9 aa, Homo Sapiens
DPQTQLQDN

SEQ ID NO: 409791 - protein, 9 aa, Homo Sapiens
AAAAPPPAQ

SEQ ID NO: 409792 - protein, 9 aa, Homo Sapiens
IHDRSVSRD

SEQ ID NO: 409793 - protein, 9 aa, Homo Sapiens
ITTYRKLLE

SEQ ID NO: 409794 - protein, 9 aa, Homo Sapiens
ISSYKETVG

SEQ ID NO: 409795 - protein, 9 aa, Homo Sapiens
RLQHHLHLH

SEQ ID NO: 409796 - protein, 9 aa, Homo Sapiens
EQSESVHGR

SEQ ID NO: 409797 - protein, 9 aa, Homo Sapiens
ICGLPDGTE

SEQ ID NO: 409798 - protein, 9 aa, Homo Sapiens
QKFMLYWAN

SEQ ID NO: 409799 - protein, 9 aa, Homo Sapiens
LKPPRRQAL

SEQ ID NO: 409800 - protein, 9 aa, Homo Sapiens
PYASPYTYV

SEQ ID NO: 409801 - protein, 9 aa, Homo Sapiens
KRYVWFSGE

SEQ ID NO: 409802 - protein, 9 aa, Homo Sapiens
VGPLGLRPP

SEQ ID NO: 409803 - protein, 9 aa, Homo Sapiens
HQQLPTFLP

SEQ ID NO: 409804 - protein, 9 aa, Homo Sapiens
GRKRRKRKG

SEQ ID NO: 409805 - protein, 9 aa, Homo Sapiens
TGSQNSHAS

SEQ ID NO: 409806 - protein, 9 aa, Homo Sapiens
QQRWHMASK

SEQ ID NO: 409807 - protein, 9 aa, Homo Sapiens
ERQEVSSVH

SEQ ID NO: 409808 - protein, 9 aa, Homo Sapiens
FLPSHSTLL

SEQ ID NO: 409809 - protein, 9 aa, Homo Sapiens
FRMVIQKDS

SEQ ID NO: 409810 - protein, 9 aa, Homo Sapiens
SSSSASGGE

SEQ ID NO: 409811 - protein, 9 aa, Homo Sapiens
YAVLPNKVD

SEQ ID NO: 409812 - protein, 9 aa, Homo Sapiens
CSVTFHIIA

SEQ ID NO: 409813 - protein, 9 aa, Homo Sapiens
AIHKKYIDK

SEQ ID NO: 409814 - protein, 9 aa, Homo Sapiens
YFEHGVLHL

SEQ ID NO: 409815 - protein, 9 aa, Homo Sapiens
RLRSRSVLR

SEQ ID NO: 409816 - protein, 9 aa, Homo Sapiens
LPDEQTAAL

SEQ ID NO: 409817 - protein, 9 aa, Homo Sapiens
VPRVSLTPA

SEQ ID NO: 409818 - protein, 9 aa, Homo Sapiens
KNIRKNGET

SEQ ID NO: 409819 - protein, 9 aa, Homo Sapiens
LRARGNAGR

SEQ ID NO: 409820 - protein, 9 aa, Homo Sapiens
YEELEINDF

SEQ ID NO: 409821 - protein, 9 aa, Homo Sapiens
DGAGSPAAP

SEQ ID NO: 409822 - protein, 9 aa, Homo Sapiens
RSWWWRRGA

SEQ ID NO: 409823 - protein, 9 aa, Homo Sapiens
PEGIGAHQQ

SEQ ID NO: 409824 - protein, 9 aa, Homo Sapiens
SASQPRRTS

SEQ ID NO: 409825 - protein, 9 aa, Homo Sapiens
IQALLEQYQ

SEQ ID NO: 409826 - protein, 9 aa, Homo Sapiens
KRTVQKNTK

SEQ ID NO: 409827 - protein, 9 aa, Homo Sapiens
LGHLRGGGL

SEQ ID NO: 409828 - protein, 9 aa, Homo Sapiens
SKKAEMNIL

SEQ ID NO: 409829 - protein, 9 aa, Homo Sapiens
LLNCLEGDQ

SEQ ID NO: 409830 - protein, 9 aa, Homo Sapiens
YRLKIDFMD

SEQ ID NO: 409831 - protein, 9 aa, Homo Sapiens
HGIWKLYKC

SEQ ID NO: 409832 - protein, 9 aa, Homo Sapiens
SQSSTSILS

SEQ ID NO: 409833 - protein, 9 aa, Homo Sapiens
RDREFRIIF

SEQ ID NO: 409834 - protein, 9 aa, Homo Sapiens
RSFRRSHCQ

SEQ ID NO: 409835 - protein, 9 aa, Homo Sapiens
HTRECNGPS

SEQ ID NO: 409836 - protein, 9 aa, Homo Sapiens
PAHAFGPAV

SEQ ID NO: 409837 - protein, 9 aa, Homo Sapiens
DSALRLWEG

SEQ ID NO: 409838 - protein, 9 aa, Homo Sapiens
LGLHGTMEK

SEQ ID NO: 409839 - protein, 9 aa, Homo Sapiens
IMIAKNWKI

SEQ ID NO: 409840 - protein, 9 aa, Homo Sapiens
ARGGTTIGE

SEQ ID NO: 409841 - protein, 9 aa, Homo Sapiens
HPNHLGTGG

SEQ ID NO: 409842 - protein, 9 aa, Homo Sapiens
ERSKDKDWD

SEQ ID NO: 409843 - protein, 9 aa, Homo Sapiens
GLHWGHTKL

SEQ ID NO: 409844 - protein, 9 aa, Homo Sapiens
LAPEVLTDM

SEQ ID NO: 409845 - protein, 9 aa, Homo Sapiens
MVSSRMLGL

SEQ ID NO: 409846 - protein, 9 aa, Homo Sapiens
FRISLFLGS

SEQ ID NO: 409847 - protein, 9 aa, Homo Sapiens
AQGAGGHME

SEQ ID NO: 409848 - protein, 9 aa, Homo Sapiens
FKRTVQKNT

SEQ ID NO: 409849 - protein, 9 aa, Homo Sapiens
GITELAVGL

SEQ ID NO: 409850 - protein, 9 aa, Homo Sapiens
SLFLGSHPF

SEQ ID NO: 409851 - protein, 9 aa, Homo Sapiens
LACVGADVL

SEQ ID NO: 409852 - protein, 9 aa, Homo Sapiens
KGIQLEPLP

SEQ ID NO: 409853 - protein, 9 aa, Homo Sapiens
CQNSHWPRD

SEQ ID NO: 409854 - protein, 9 aa, Homo Sapiens
DSNRPASST

SEQ ID NO: 409855 - protein, 9 aa, Homo Sapiens
ISDAESCYL

SEQ ID NO: 409856 - protein, 9 aa, Homo Sapiens
KKESTLKSI

SEQ ID NO: 409857 - protein, 9 aa, Homo Sapiens
GKGLHWGHT

SEQ ID NO: 409858 - protein, 9 aa, Homo Sapiens
YPRIERYRL

SEQ ID NO: 409859 - protein, 9 aa, Homo Sapiens
LAVQGVDPR

SEQ ID NO: 409860 - protein, 9 aa, Homo Sapiens
NDLLKKRAV

SEQ ID NO: 409861 - protein, 9 aa, Homo Sapiens
ISETDDDDS

SEQ ID NO: 409862 - protein, 9 aa, Homo Sapiens
LPVMPLENY

SEQ ID NO: 409863 - protein, 9 aa, Homo Sapiens
GPGTGAEAD

SEQ ID NO: 409864 - protein, 9 aa, Homo Sapiens
FYLEAICLL

SEQ ID NO: 409865 - protein, 9 aa, Homo Sapiens
PRATWRSRA

SEQ ID NO: 409866 - protein, 9 aa, Homo Sapiens
SWDSALRLW

SEQ ID NO: 409867 - protein, 9 aa, Homo Sapiens
AQDQHRGLR

SEQ ID NO: 409868 - protein, 9 aa, Homo Sapiens
PLNVTSTAG

SEQ ID NO: 409869 - protein, 9 aa, Homo Sapiens
GPATWRCCG

SEQ ID NO: 409870 - protein, 9 aa, Homo Sapiens
FCWWSWLMT

SEQ ID NO: 409871 - protein, 9 aa, Homo Sapiens
LSNMSEETV

SEQ ID NO: 409872 - protein, 9 aa, Homo Sapiens
RHHALVVGA

SEQ ID NO: 409873 - protein, 9 aa, Homo Sapiens
ISICPGRFF

SEQ ID NO: 409874 - protein, 9 aa, Homo Sapiens
CSFISSSLG

SEQ ID NO: 409875 - protein, 9 aa, Homo Sapiens
KQEASFPID

SEQ ID NO: 409876 - protein, 9 aa, Homo Sapiens
WKKNDQSCE

SEQ ID NO: 409877 - protein, 9 aa, Homo Sapiens
HFTSFNSST

SEQ ID NO: 409878 - protein, 9 aa, Homo Sapiens
FMPPPGHPP

SEQ ID NO: 409879 - protein, 9 aa, Homo Sapiens
FAMEIFATM

SEQ ID NO: 409880 - protein, 9 aa, Homo Sapiens
HCMKNHHCK

SEQ ID NO: 409881 - protein, 9 aa, Homo Sapiens
GVQSGPEGR

SEQ ID NO: 409882 - protein, 9 aa, Homo Sapiens
DLMCGWNST

SEQ ID NO: 409883 - protein, 9 aa, Homo Sapiens
QESMAPALS

SEQ ID NO: 409884 - protein, 9 aa, Homo Sapiens
GFRFFHVLF

SEQ ID NO: 409885 - protein, 9 aa, Homo Sapiens
ADLCRSQSR

SEQ ID NO: 409886 - protein, 9 aa, Homo Sapiens
LKWRHMLVI

SEQ ID NO: 409887 - protein, 9 aa, Homo Sapiens
LFFVLVNLE

SEQ ID NO: 409888 - protein, 9 aa, Homo Sapiens
PSPDLHTGL

SEQ ID NO: 409889 - protein, 9 aa, Homo Sapiens
WGRRRRQWG

SEQ ID NO: 409890 - protein, 9 aa, Homo Sapiens
VDLKWRHML

SEQ ID NO: 409891 - protein, 9 aa, Homo Sapiens
LLCPALHLV

SEQ ID NO: 409892 - protein, 9 aa, Homo Sapiens
SPSATSLVS

SEQ ID NO: 409893 - protein, 9 aa, Homo Sapiens
GVQVQGMPV

SEQ ID NO: 409894 - protein, 9 aa, Homo Sapiens
VYTFNSMRK

SEQ ID NO: 409895 - protein, 9 aa, Homo Sapiens
LQAKKSQKG

SEQ ID NO: 409896 - protein, 9 aa, Homo Sapiens
KGILMHRLS

SEQ ID NO: 409897 - protein, 9 aa, Homo Sapiens
AGLHNQYTE

SEQ ID NO: 409898 - protein, 9 aa, Homo Sapiens
TLSTLQQRH

SEQ ID NO: 409899 - protein, 9 aa, Homo Sapiens
ALPQGRAPL

SEQ ID NO: 409900 - protein, 9 aa, Homo Sapiens
NWLGIVSVP

SEQ ID NO: 409901 - protein, 9 aa, Homo Sapiens
DGGPRLRVH

SEQ ID NO: 409902 - protein, 9 aa, Homo Sapiens
HGPAPAPKM

SEQ ID NO: 409903 - protein, 9 aa, Homo Sapiens
IRMMLCCML

SEQ ID NO: 409904 - protein, 9 aa, Homo Sapiens
AKKQKFRPT

SEQ ID NO: 409905 - protein, 9 aa, Homo Sapiens
KAEVLWLIG

SEQ ID NO: 409906 - protein, 9 aa, Homo Sapiens
HARSDKLHE

SEQ ID NO: 409907 - protein, 9 aa, Homo Sapiens
NIPAPRPVC

SEQ ID NO: 409908 - protein, 9 aa, Homo Sapiens
SPLLPAPMC

SEQ ID NO: 409909 - protein, 9 aa, Homo Sapiens
VFVNGQPLP

SEQ ID NO: 409910 - protein, 9 aa, Homo Sapiens
LVPPGHESF

SEQ ID NO: 409911 - protein, 9 aa, Homo Sapiens
PRCWRCWSS

SEQ ID NO: 409912 - protein, 9 aa, Homo Sapiens
LSRLHLFPL

SEQ ID NO: 409913 - protein, 9 aa, Homo Sapiens
EVELIFLEE

SEQ ID NO: 409914 - protein, 9 aa, Homo Sapiens
SRRGPQILC

SEQ ID NO: 409915 - protein, 9 aa, Homo Sapiens
ASTAGLSLN

SEQ ID NO: 409916 - protein, 9 aa, Homo Sapiens
LKRKIQKKR

SEQ ID NO: 409917 - protein, 9 aa, Homo Sapiens
MNQNPNGEN

SEQ ID NO: 409918 - protein, 9 aa, Homo Sapiens
ACPALQNPA

SEQ ID NO: 409919 - protein, 9 aa, Homo Sapiens
FSISSSTPS

SEQ ID NO: 409920 - protein, 9 aa, Homo Sapiens
TPSSARPAP

SEQ ID NO: 409921 - protein, 9 aa, Homo Sapiens
CRLYQFHYV

SEQ ID NO: 409922 - protein, 9 aa, Homo Sapiens
SHLLPNQYP

SEQ ID NO: 409923 - protein, 9 aa, Homo Sapiens
AKMNGRPTF

SEQ ID NO: 409924 - protein, 9 aa, Homo Sapiens
VTENLHVLG

SEQ ID NO: 409925 - protein, 9 aa, Homo Sapiens
NQWCEELPS

SEQ ID NO: 409926 - protein, 9 aa, Homo Sapiens
SFEQLEHVQ

SEQ ID NO: 409927 - protein, 9 aa, Homo Sapiens
FLLHQPLPG

SEQ ID NO: 409928 - protein, 9 aa, Homo Sapiens
HGANWVRPD

SEQ ID NO: 409929 - protein, 9 aa, Homo Sapiens
KKTYMEMHY

SEQ ID NO: 409930 - protein, 9 aa, Homo Sapiens
EEPGLLDPA

SEQ ID NO: 409931 - protein, 9 aa, Homo Sapiens
QAIATITTL

SEQ ID NO: 409932 - protein, 9 aa, Homo Sapiens
GTSARVLEE

SEQ ID NO: 409933 - protein, 9 aa, Homo Sapiens
LRQLRTVVA

SEQ ID NO: 409934 - protein, 9 aa, Homo Sapiens
CICTIPKFR

SEQ ID NO: 409935 - protein, 9 aa, Homo Sapiens
PRATSTISA

SEQ ID NO: 409936 - protein, 9 aa, Homo Sapiens
HSTHLVFVK

SEQ ID NO: 409937 - protein, 9 aa, Homo Sapiens
SSSDSFSVL

SEQ ID NO: 409938 - protein, 9 aa, Homo Sapiens
DSTAPWWEF

SEQ ID NO: 409939 - protein, 9 aa, Homo Sapiens
SVSSSDSFS

SEQ ID NO: 409940 - protein, 9 aa, Homo Sapiens
AQIGAMLMV

SEQ ID NO: 409941 - protein, 9 aa, Homo Sapiens
APPPAQWET

SEQ ID NO: 409942 - protein, 9 aa, Homo Sapiens
SINLSTIKS

SEQ ID NO: 409943 - protein, 9 aa, Homo Sapiens
RERSKDKDW

SEQ ID NO: 409944 - protein, 9 aa, Homo Sapiens
TPSLAPGER

SEQ ID NO: 409945 - protein, 9 aa, Homo Sapiens
GSNAVGRRG

SEQ ID NO: 409946 - protein, 9 aa, Homo Sapiens
ARVVPRTPS

SEQ ID NO: 409947 - protein, 9 aa, Homo Sapiens
GDGGEKCIH

SEQ ID NO: 409948 - protein, 9 aa, Homo Sapiens
WHVTTVRTA

SEQ ID NO: 409949 - protein, 9 aa, Homo Sapiens
KKRAVFTKL

SEQ ID NO: 409950 - protein, 9 aa, Homo Sapiens
FRARILCLT

SEQ ID NO: 409951 - protein, 9 aa, Homo Sapiens
NITVFVPRW

SEQ ID NO: 409952 - protein, 9 aa, Homo Sapiens
CHPATLDTA

SEQ ID NO: 409953 - protein, 9 aa, Homo Sapiens
NNQGAPARM

SEQ ID NO: 409954 - protein, 9 aa, Homo Sapiens
SSQKIIFSY

SEQ ID NO: 409955 - protein, 9 aa, Homo Sapiens
CREGRMATL

SEQ ID NO: 409956 - protein, 9 aa, Homo Sapiens
WLEEREQDI

SEQ ID NO: 409957 - protein, 9 aa, Homo Sapiens
YLTMDGTLH

SEQ ID NO: 409958 - protein, 9 aa, Homo Sapiens
ALQPGEKKS

SEQ ID NO: 409959 - protein, 9 aa, Homo Sapiens
ARWCLGRCC

SEQ ID NO: 409960 - protein, 9 aa, Homo Sapiens
AVRPDAVDV

SEQ ID NO: 409961 - protein, 9 aa, Homo Sapiens
QLTVGRAQA

SEQ ID NO: 409962 - protein, 9 aa, Homo Sapiens
LSAMKHSPG

SEQ ID NO: 409963 - protein, 9 aa, Homo Sapiens
VGPGPHAVS

SEQ ID NO: 409964 - protein, 9 aa, Homo Sapiens
PTPAVAQDE

SEQ ID NO: 409965 - protein, 9 aa, Homo Sapiens
QPGSWGFQE

SEQ ID NO: 409966 - protein, 9 aa, Homo Sapiens
YSHLLPNQY

SEQ ID NO: 409967 - protein, 9 aa, Homo Sapiens
TAVVCRSCC

SEQ ID NO: 409968 - protein, 9 aa, Homo Sapiens
VLLQEVEVV

SEQ ID NO: 409969 - protein, 9 aa, Homo Sapiens
DENTTWLYH

SEQ ID NO: 409970 - protein, 9 aa, Homo Sapiens
EESPPVRLC

SEQ ID NO: 409971 - protein, 9 aa, Homo Sapiens
RQAMAMTVR

SEQ ID NO: 409972 - protein, 9 aa, Homo Sapiens
RRSRSARQR

SEQ ID NO: 409973 - protein, 9 aa, Homo Sapiens
GWNPPQGNR

SEQ ID NO: 409974 - protein, 9 aa, Homo Sapiens
NISNFLRKF

SEQ ID NO: 409975 - protein, 9 aa, Homo Sapiens
VVLLQELEH

SEQ ID NO: 409976 - protein, 9 aa, Homo Sapiens
CPQDFVAQP

SEQ ID NO: 409977 - protein, 9 aa, Homo Sapiens
IKIVIMMSS

SEQ ID NO: 409978 - protein, 9 aa, Homo Sapiens
SPTDLAFMM

SEQ ID NO: 409979 - protein, 9 aa, Homo Sapiens
LINNDHKLP

SEQ ID NO: 409980 - protein, 9 aa, Homo Sapiens
RSRSPKNQE

SEQ ID NO: 409981 - protein, 9 aa, Homo Sapiens
KGAKAREEG

SEQ ID NO: 409982 - protein, 9 aa, Homo Sapiens
SPGATLTST

SEQ ID NO: 409983 - protein, 9 aa, Homo Sapiens
QSGPGAPNP

SEQ ID NO: 409984 - protein, 9 aa, Homo Sapiens
PGPCASLLS

SEQ ID NO: 409985 - protein, 9 aa, Homo Sapiens
SCKEKRRPL

SEQ ID NO: 409986 - protein, 9 aa, Homo Sapiens
FLENMGALT

SEQ ID NO: 409987 - protein, 9 aa, Homo Sapiens
NGSNSFRKS

SEQ ID NO: 409988 - protein, 9 aa, Homo Sapiens
TLGHPGTGT

SEQ ID NO: 409989 - protein, 9 aa, Homo Sapiens
HQLSAPAGA

SEQ ID NO: 409990 - protein, 9 aa, Homo Sapiens
GTECFSASM

SEQ ID NO: 409991 - protein, 9 aa, Homo Sapiens
KGDCHIFTR

SEQ ID NO: 409992 - protein, 9 aa, Homo Sapiens
NHHKQVQGG

SEQ ID NO: 409993 - protein, 9 aa, Homo Sapiens
AENMSSKVR

SEQ ID NO: 409994 - protein, 9 aa, Homo Sapiens
LVLPGEAAQ

SEQ ID NO: 409995 - protein, 9 aa, Homo Sapiens
CTKENAEKF

SEQ ID NO: 409996 - protein, 9 aa, Homo Sapiens
VGGFYYELG

SEQ ID NO: 409997 - protein, 9 aa, Homo Sapiens
WQLCALGQH

SEQ ID NO: 409998 - protein, 9 aa, Homo Sapiens
DWLEEREQD

SEQ ID NO: 409999 - protein, 9 aa, Homo Sapiens
FDNTNSHNS

SEQ ID NO: 410000 - protein, 9 aa, Homo Sapiens
QAGPPGTVG

SEQ ID NO: 410001 - protein, 9 aa, Homo Sapiens
LHVLGEAQT

SEQ ID NO: 410002 - protein, 9 aa, Homo Sapiens
EEERERAWL

SEQ ID NO: 410003 - protein, 9 aa, Homo Sapiens
TPAAEYFEH

SEQ ID NO: 410004 - protein, 9 aa, Homo Sapiens
EPPGPACPI

SEQ ID NO: 410005 - protein, 9 aa, Homo Sapiens
VEVDEVACA

SEQ ID NO: 410006 - protein, 9 aa, Homo Sapiens
PWTFSPLME

SEQ ID NO: 410007 - protein, 9 aa, Homo Sapiens
VDSDAIWNE

SEQ ID NO: 410008 - protein, 9 aa, Homo Sapiens
MGPGAQGEY

SEQ ID NO: 410009 - protein, 9 aa, Homo Sapiens
PGHPRGSQS

SEQ ID NO: 410010 - protein, 9 aa, Homo Sapiens
KQFLGNCQS

SEQ ID NO: 410011 - protein, 9 aa, Homo Sapiens
LNGDYKGTM

SEQ ID NO: 410012 - protein, 9 aa, Homo Sapiens
PSAGPLYGW

SEQ ID NO: 410013 - protein, 9 aa, Homo Sapiens
ASVVVLYSV

SEQ ID NO: 410014 - protein, 9 aa, Homo Sapiens
KGSRGLGAS

SEQ ID NO: 410015 - protein, 9 aa, Homo Sapiens
QCWTARICA

SEQ ID NO: 410016 - protein, 9 aa, Homo Sapiens
PPPAPPISL

SEQ ID NO: 410017 - protein, 9 aa, Homo Sapiens
DTELRQHRQ

SEQ ID NO: 410018 - protein, 9 aa, Homo Sapiens
VHVRVDHRD

SEQ ID NO: 410019 - protein, 9 aa, Homo Sapiens
GPWSSEAWD

SEQ ID NO: 410020 - protein, 9 aa, Homo Sapiens
TRPSRRPAT

SEQ ID NO: 410021 - protein, 9 aa, Homo Sapiens
FGAAVDPDM

SEQ ID NO: 410022 - protein, 9 aa, Homo Sapiens
DEGHCMKNH

SEQ ID NO: 410023 - protein, 9 aa, Homo Sapiens
SGRRLGGEQ

SEQ ID NO: 410024 - protein, 9 aa, Homo Sapiens
SVSQKVVAA

SEQ ID NO: 410025 - protein, 9 aa, Homo Sapiens
HRRCWRRRL

SEQ ID NO: 410026 - protein, 9 aa, Homo Sapiens
EKDEEIVSP

SEQ ID NO: 410027 - protein, 9 aa, Homo Sapiens
IMCPLNPAA

SEQ ID NO: 410028 - protein, 9 aa, Homo Sapiens
GENCRYLHD

SEQ ID NO: 410029 - protein, 9 aa, Homo Sapiens
GWKKAPLPS

SEQ ID NO: 410030 - protein, 9 aa, Homo Sapiens
NAGRIRSAS

SEQ ID NO: 410031 - protein, 9 aa, Homo Sapiens
AGVIQNTSP

SEQ ID NO: 410032 - protein, 9 aa, Homo Sapiens
RESPWEAAL

SEQ ID NO: 410033 - protein, 9 aa, Homo Sapiens
ALCNPVVLE

SEQ ID NO: 410034 - protein, 9 aa, Homo Sapiens
KCKELQENQ

SEQ ID NO: 410035 - protein, 9 aa, Homo Sapiens
TPASNHCSR

SEQ ID NO: 410036 - protein, 9 aa, Homo Sapiens
SVTNINVKR

SEQ ID NO: 410037 - protein, 9 aa, Homo Sapiens
PPSACTRPQ

SEQ ID NO: 410038 - protein, 9 aa, Homo Sapiens
PSFLQPSPQ

SEQ ID NO: 410039 - protein, 9 aa, Homo Sapiens
KDLSSEEVA

SEQ ID NO: 410040 - protein, 9 aa, Homo Sapiens
TGPAAPLAP

SEQ ID NO: 410041 - protein, 9 aa, Homo Sapiens
KRYEELEIN

SEQ ID NO: 410042 - protein, 9 aa, Homo Sapiens
PCQSGVQFV

SEQ ID NO: 410043 - protein, 9 aa, Homo Sapiens
CRHHLGTFG

SEQ ID NO: 410044 - protein, 9 aa, Homo Sapiens
VDLLDPYKF

SEQ ID NO: 410045 - protein, 9 aa, Homo Sapiens
VSLKQDGDD

SEQ ID NO: 410046 - protein, 9 aa, Homo Sapiens
RPLSTAWAS

SEQ ID NO: 410047 - protein, 9 aa, Homo Sapiens
VSCLFLRSL

SEQ ID NO: 410048 - protein, 9 aa, Homo Sapiens
VSLTPATPY

SEQ ID NO: 410049 - protein, 9 aa, Homo Sapiens
PSTCSLPCR

SEQ ID NO: 410050 - protein, 9 aa, Homo Sapiens
ADMEWLIKK

SEQ ID NO: 410051 - protein, 9 aa, Homo Sapiens
TSPQASSPR

SEQ ID NO: 410052 - protein, 9 aa, Homo Sapiens
ILSCLFPGL

SEQ ID NO: 410053 - protein, 9 aa, Homo Sapiens
QRNMETRKR

SEQ ID NO: 410054 - protein, 9 aa, Homo Sapiens
TGIMFGSFL

SEQ ID NO: 410055 - protein, 9 aa, Homo Sapiens
EICVKRRRR

SEQ ID NO: 410056 - protein, 9 aa, Homo Sapiens
ITVCPKNAA

SEQ ID NO: 410057 - protein, 9 aa, Homo Sapiens
FPPKIVHGH

SEQ ID NO: 410058 - protein, 9 aa, Homo Sapiens
TVRMLPTYI

SEQ ID NO: 410059 - protein, 9 aa, Homo Sapiens
TAVDTSVAW

SEQ ID NO: 410060 - protein, 9 aa, Homo Sapiens
GTCQQPANT

SEQ ID NO: 410061 - protein, 9 aa, Homo Sapiens
AFKAFSSEQ

SEQ ID NO: 410062 - protein, 9 aa, Homo Sapiens
FALLSLVES

SEQ ID NO: 410063 - protein, 9 aa, Homo Sapiens
LLVVLAAVG

SEQ ID NO: 410064 - protein, 9 aa, Homo Sapiens
SSSSSVLGT

SEQ ID NO: 410065 - protein, 9 aa, Homo Sapiens
VLGIKISWV

SEQ ID NO: 410066 - protein, 9 aa, Homo Sapiens
KIVHGHYKQ

SEQ ID NO: 410067 - protein, 9 aa, Homo Sapiens
CLLGEITYI

SEQ ID NO: 410068 - protein, 9 aa, Homo Sapiens
GLQIQEKST

SEQ ID NO: 410069 - protein, 9 aa, Homo Sapiens
PSTKKEDTL

SEQ ID NO: 410070 - protein, 9 aa, Homo Sapiens
PKEIHGSLG

SEQ ID NO: 410071 - protein, 9 aa, Homo Sapiens
APLAPPALV

SEQ ID NO: 410072 - protein, 9 aa, Homo Sapiens
EKTTPSSLA

SEQ ID NO: 410073 - protein, 9 aa, Homo Sapiens
RQDQSALCV

SEQ ID NO: 410074 - protein, 9 aa, Homo Sapiens
LGMGLVKGY

SEQ ID NO: 410075 - protein, 9 aa, Homo Sapiens
VIRIFCLAS

SEQ ID NO: 410076 - protein, 9 aa, Homo Sapiens
MTTISRATW

SEQ ID NO: 410077 - protein, 9 aa, Homo Sapiens
AGPAVQPPE

SEQ ID NO: 410078 - protein, 9 aa, Homo Sapiens
RVGLKVTVV

SEQ ID NO: 410079 - protein, 9 aa, Homo Sapiens
NTLQALNAY

SEQ ID NO: 410080 - protein, 9 aa, Homo Sapiens
ARMKVTMPC

SEQ ID NO: 410081 - protein, 9 aa, Homo Sapiens
GFSEPLATP

SEQ ID NO: 410082 - protein, 9 aa, Homo Sapiens
SSSGPQERD

SEQ ID NO: 410083 - protein, 9 aa, Homo Sapiens
RTWVPGVLT

SEQ ID NO: 410084 - protein, 9 aa, Homo Sapiens
PAPPISLAS

SEQ ID NO: 410085 - protein, 9 aa, Homo Sapiens
SSSILSILL

SEQ ID NO: 410086 - protein, 9 aa, Homo Sapiens
RWRTRRDPN

SEQ ID NO: 410087 - protein, 9 aa, Homo Sapiens
QWELGPRLE

SEQ ID NO: 410088 - protein, 9 aa, Homo Sapiens
ERPHPIHIG

SEQ ID NO: 410089 - protein, 9 aa, Homo Sapiens
SCPEPRVPR

SEQ ID NO: 410090 - protein, 9 aa, Homo Sapiens
VINANWGEF

SEQ ID NO: 410091 - protein, 9 aa, Homo Sapiens
LQQGAPGCT

SEQ ID NO: 410092 - protein, 9 aa, Homo Sapiens
LLIAAMEGG

SEQ ID NO: 410093 - protein, 9 aa, Homo Sapiens
GGAGPAGWA

SEQ ID NO: 410094 - protein, 9 aa, Homo Sapiens
LLDQLAAQG

SEQ ID NO: 410095 - protein, 9 aa, Homo Sapiens
GVKQPNAVH

SEQ ID NO: 410096 - protein, 9 aa, Homo Sapiens
DFDIRVPFL

SEQ ID NO: 410097 - protein, 9 aa, Homo Sapiens
EELRLENDY

SEQ ID NO: 410098 - protein, 9 aa, Homo Sapiens
RRHAAARSQ

SEQ ID NO: 410099 - protein, 9 aa, Homo Sapiens
NEGNHTLTL

SEQ ID NO: 410100 - protein, 9 aa, Homo Sapiens
LASTAGLSL

SEQ ID NO: 410101 - protein, 9 aa, Homo Sapiens
QALPVMPLE

SEQ ID NO: 410102 - protein, 9 aa, Homo Sapiens
ANNLIFIPS

SEQ ID NO: 410103 - protein, 9 aa, Homo Sapiens
NRWVSWSAT

SEQ ID NO: 410104 - protein, 9 aa, Homo Sapiens
NSFVNKLDP

SEQ ID NO: 410105 - protein, 9 aa, Homo Sapiens
VTAWDGGSP

SEQ ID NO: 410106 - protein, 9 aa, Homo Sapiens
GDLSAMKHS

SEQ ID NO: 410107 - protein, 9 aa, Homo Sapiens
PCCCEEPRP

SEQ ID NO: 410108 - protein, 9 aa, Homo Sapiens
INYYTRWMQ

SEQ ID NO: 410109 - protein, 9 aa, Homo Sapiens
SMACGSAES

SEQ ID NO: 410110 - protein, 9 aa, Homo Sapiens
AVVQALRPT

SEQ ID NO: 410111 - protein, 9 aa, Homo Sapiens
LGNLLEKRA

SEQ ID NO: 410112 - protein, 9 aa, Homo Sapiens
APENRCQFC

SEQ ID NO: 410113 - protein, 9 aa, Homo Sapiens
SLQPPSRQA

SEQ ID NO: 410114 - protein, 9 aa, Homo Sapiens
LCRGPRLPS

SEQ ID NO: 410115 - protein, 9 aa, Homo Sapiens
TSRHISMES

SEQ ID NO: 410116 - protein, 9 aa, Homo Sapiens
AFGRFSHLT

SEQ ID NO: 410117 - protein, 9 aa, Homo Sapiens
RDPEMGGKL

SEQ ID NO: 410118 - protein, 9 aa, Homo Sapiens
HCIVGCSLA

SEQ ID NO: 410119 - protein, 9 aa, Homo Sapiens
DEPWPGPAS

SEQ ID NO: 410120 - protein, 9 aa, Homo Sapiens
LEHHLSHYL

SEQ ID NO: 410121 - protein, 9 aa, Homo Sapiens
LAEVTVAVD

SEQ ID NO: 410122 - protein, 9 aa, Homo Sapiens
ASGADLMCG

SEQ ID NO: 410123 - protein, 9 aa, Homo Sapiens
DPCVEMPLG

SEQ ID NO: 410124 - protein, 9 aa, Homo Sapiens
SCPRPTSSS

SEQ ID NO: 410125 - protein, 9 aa, Homo Sapiens
PGVHPATFV

SEQ ID NO: 410126 - protein, 9 aa, Homo Sapiens
HTVSYLDNL

SEQ ID NO: 410127 - protein, 9 aa, Homo Sapiens
EGMPPMEPA

SEQ ID NO: 410128 - protein, 9 aa, Homo Sapiens
TSHHMSSNL

SEQ ID NO: 410129 - protein, 9 aa, Homo Sapiens
NTDKKEWVK

SEQ ID NO: 410130 - protein, 9 aa, Homo Sapiens
PIKYHDMPD

SEQ ID NO: 410131 - protein, 9 aa, Homo Sapiens
RVLEEMHFA

SEQ ID NO: 410132 - protein, 9 aa, Homo Sapiens
GVQNGAPAP

SEQ ID NO: 410133 - protein, 9 aa, Homo Sapiens
SAVDIKPKD

SEQ ID NO: 410134 - protein, 9 aa, Homo Sapiens
QPPKPPGAS

SEQ ID NO: 410135 - protein, 9 aa, Homo Sapiens
SYEEDSHYL

SEQ ID NO: 410136 - protein, 9 aa, Homo Sapiens
RRPLRGRLG

SEQ ID NO: 410137 - protein, 9 aa, Homo Sapiens
IADENRAYL

SEQ ID NO: 410138 - protein, 9 aa, Homo Sapiens
SVCPTVSQG

SEQ ID NO: 410139 - protein, 9 aa, Homo Sapiens
TTLEYTVAG

SEQ ID NO: 410140 - protein, 9 aa, Homo Sapiens
AMLMVIRLR

SEQ ID NO: 410141 - protein, 9 aa, Homo Sapiens
RLELLLQKC

SEQ ID NO: 410142 - protein, 9 aa, Homo Sapiens
RTQTQTRTR

SEQ ID NO: 410143 - protein, 9 aa, Homo Sapiens
SPSSLLSPC

SEQ ID NO: 410144 - protein, 9 aa, Homo Sapiens
PATCPAVVQ

SEQ ID NO: 410145 - protein, 9 aa, Homo Sapiens
LRVKALKKA

SEQ ID NO: 410146 - protein, 9 aa, Homo Sapiens
SQLICMKHF

SEQ ID NO: 410147 - protein, 9 aa, Homo Sapiens
FNYHLSPWT

SEQ ID NO: 410148 - protein, 9 aa, Homo Sapiens
GPIGIPGRS

SEQ ID NO: 410149 - protein, 9 aa, Homo Sapiens
CVIYVHLHF

SEQ ID NO: 410150 - protein, 9 aa, Homo Sapiens
DLDLLAVAL

SEQ ID NO: 410151 - protein, 9 aa, Homo Sapiens
DRMLDHNCD

SEQ ID NO: 410152 - protein, 9 aa, Homo Sapiens
LPCKVLGHP

SEQ ID NO: 410153 - protein, 9 aa, Homo Sapiens
GQLQQRWHM

SEQ ID NO: 410154 - protein, 9 aa, Homo Sapiens
FTLRVTKIE

SEQ ID NO: 410155 - protein, 9 aa, Homo Sapiens
WLIGAKSKW

SEQ ID NO: 410156 - protein, 9 aa, Homo Sapiens
YAGFLWDVA

SEQ ID NO: 410157 - protein, 9 aa, Homo Sapiens
CPVACLAAC

SEQ ID NO: 410158 - protein, 9 aa, Homo Sapiens
TAGGCPLAS

SEQ ID NO: 410159 - protein, 9 aa, Homo Sapiens
GATTRPSRR

SEQ ID NO: 410160 - protein, 9 aa, Homo Sapiens
FKCKESLET

SEQ ID NO: 410161 - protein, 9 aa, Homo Sapiens
SFPLPRAGA

SEQ ID NO: 410162 - protein, 9 aa, Homo Sapiens
KMKWRKQDE

SEQ ID NO: 410163 - protein, 9 aa, Homo Sapiens
ATKLCQFVI

SEQ ID NO: 410164 - protein, 9 aa, Homo Sapiens
PLALPCRVL

SEQ ID NO: 410165 - protein, 9 aa, Homo Sapiens
AQDTSGHRG

SEQ ID NO: 410166 - protein, 9 aa, Homo Sapiens
LGTASEGWS

SEQ ID NO: 410167 - protein, 9 aa, Homo Sapiens
NFLKPRDLN

SEQ ID NO: 410168 - protein, 9 aa, Homo Sapiens
GGGSPSRSA

SEQ ID NO: 410169 - protein, 9 aa, Homo Sapiens
TRRQGLVME

SEQ ID NO: 410170 - protein, 9 aa, Homo Sapiens
CKQRGKAFI

SEQ ID NO: 410171 - protein, 9 aa, Homo Sapiens
VLPLVPILQ

SEQ ID NO: 410172 - protein, 9 aa, Homo Sapiens
PVFQKKIYI

SEQ ID NO: 410173 - protein, 9 aa, Homo Sapiens
YGGSGGGGG

SEQ ID NO: 410174 - protein, 9 aa, Homo Sapiens
GRGTRPPVL

SEQ ID NO: 410175 - protein, 9 aa, Homo Sapiens
CTRCTCTTT

SEQ ID NO: 410176 - protein, 9 aa, Homo Sapiens
GALEVLSIN

SEQ ID NO: 410177 - protein, 9 aa, Homo Sapiens
TESLKVRGL

SEQ ID NO: 410178 - protein, 9 aa, Homo Sapiens
CARPSPSWF

SEQ ID NO: 410179 - protein, 9 aa, Homo Sapiens
VVQALRPTG

SEQ ID NO: 410180 - protein, 9 aa, Homo Sapiens
RDYHTVLHQ

SEQ ID NO: 410181 - protein, 9 aa, Homo Sapiens
SCSWDSALR

SEQ ID NO: 410182 - protein, 9 aa, Homo Sapiens
TISPKKPTS

SEQ ID NO: 410183 - protein, 9 aa, Homo Sapiens
NQKRLQNRK

SEQ ID NO: 410184 - protein, 9 aa, Homo Sapiens
GRLQRKQKM

SEQ ID NO: 410185 - protein, 9 aa, Homo Sapiens
DCGKDFSQH

SEQ ID NO: 410186 - protein, 9 aa, Homo Sapiens
QSLQCHLAK

SEQ ID NO: 410187 - protein, 9 aa, Homo Sapiens
DVTPTTSSL

SEQ ID NO: 410188 - protein, 9 aa, Homo Sapiens
HNFSDLRNG

SEQ ID NO: 410189 - protein, 9 aa, Homo Sapiens
KDIEETSLV

SEQ ID NO: 410190 - protein, 9 aa, Homo Sapiens
AAVGVGLPA

SEQ ID NO: 410191 - protein, 9 aa, Homo Sapiens
RSPLQPHRR

SEQ ID NO: 410192 - protein, 9 aa, Homo Sapiens
ATTIGVIGN

SEQ ID NO: 410193 - protein, 9 aa, Homo Sapiens
APFSVGLHM

SEQ ID NO: 410194 - protein, 9 aa, Homo Sapiens
GGTQSFSCR

SEQ ID NO: 410195 - protein, 9 aa, Homo Sapiens
AGTATCPPP

SEQ ID NO: 410196 - protein, 9 aa, Homo Sapiens
TRVSVQQTQ

SEQ ID NO: 410197 - protein, 9 aa, Homo Sapiens
RLWMFLRIL

SEQ ID NO: 410198 - protein, 9 aa, Homo Sapiens
PRPGYPGIP

SEQ ID NO: 410199 - protein, 9 aa, Homo Sapiens
AATAEKWCF

SEQ ID NO: 410200 - protein, 9 aa, Homo Sapiens
DDESIPIIY

SEQ ID NO: 410201 - protein, 9 aa, Homo Sapiens
ATAAGRHPG

SEQ ID NO: 410202 - protein, 9 aa, Homo Sapiens
LVHIQPFSL

SEQ ID NO: 410203 - protein, 9 aa, Homo Sapiens
QAGAAPRAH

SEQ ID NO: 410204 - protein, 9 aa, Homo Sapiens
KGGDLLLIG

SEQ ID NO: 410205 - protein, 9 aa, Homo Sapiens
AHHTKAVNV

SEQ ID NO: 410206 - protein, 9 aa, Homo Sapiens
PHSQLYIYW

SEQ ID NO: 410207 - protein, 9 aa, Homo Sapiens
SMCCVIIPP

SEQ ID NO: 410208 - protein, 9 aa, Homo Sapiens
VRAHFSPGC

SEQ ID NO: 410209 - protein, 9 aa, Homo Sapiens
CRRCSGLSV

SEQ ID NO: 410210 - protein, 9 aa, Homo Sapiens
KVTVVDGLD

SEQ ID NO: 410211 - protein, 9 aa, Homo Sapiens
PLSSPLPSK

SEQ ID NO: 410212 - protein, 9 aa, Homo Sapiens
SSRISSSSH

SEQ ID NO: 410213 - protein, 9 aa, Homo Sapiens
KPDVTVYDG

SEQ ID NO: 410214 - protein, 9 aa, Homo Sapiens
TFRNLQGNP

SEQ ID NO: 410215 - protein, 9 aa, Homo Sapiens
ILGYYMLRW

SEQ ID NO: 410216 - protein, 9 aa, Homo Sapiens
KRFAFFPST

SEQ ID NO: 410217 - protein, 9 aa, Homo Sapiens
FDLVCVNVW

SEQ ID NO: 410218 - protein, 9 aa, Homo Sapiens
KSTEMPSEQ

SEQ ID NO: 410219 - protein, 9 aa, Homo Sapiens
STACPSESS

SEQ ID NO: 410220 - protein, 9 aa, Homo Sapiens
STLQAEDMY

SEQ ID NO: 410221 - protein, 9 aa, Homo Sapiens
RRRQDCARP

SEQ ID NO: 410222 - protein, 9 aa, Homo Sapiens
GAAQGVDVG

SEQ ID NO: 410223 - protein, 9 aa, Homo Sapiens
CCVIIPPGS

SEQ ID NO: 410224 - protein, 9 aa, Homo Sapiens
NCFYLSNAH

SEQ ID NO: 410225 - protein, 9 aa, Homo Sapiens
ISCLRDDVV

SEQ ID NO: 410226 - protein, 9 aa, Homo Sapiens
EKHSSQKII

SEQ ID NO: 410227 - protein, 9 aa, Homo Sapiens
QFRESPWGD

SEQ ID NO: 410228 - protein, 9 aa, Homo Sapiens
TGDHKQIYN

SEQ ID NO: 410229 - protein, 9 aa, Homo Sapiens
LGGVFVNGQ

SEQ ID NO: 410230 - protein, 9 aa, Homo Sapiens
SRLPQPSGT

SEQ ID NO: 410231 - protein, 9 aa, Homo Sapiens
HSCRIQKSD

SEQ ID NO: 410232 - protein, 9 aa, Homo Sapiens
TAEKWCFRL

SEQ ID NO: 410233 - protein, 9 aa, Homo Sapiens
CSVVDSLDI

SEQ ID NO: 410234 - protein, 9 aa, Homo Sapiens
GAGDQGWAP

SEQ ID NO: 410235 - protein, 9 aa, Homo Sapiens
DLSWARMLQ

SEQ ID NO: 410236 - protein, 9 aa, Homo Sapiens
FQRPHPLAT

SEQ ID NO: 410237 - protein, 9 aa, Homo Sapiens
RAWVTTRMG

SEQ ID NO: 410238 - protein, 9 aa, Homo Sapiens
SDAADDIVD

SEQ ID NO: 410239 - protein, 9 aa, Homo Sapiens
DNYGYDACV

SEQ ID NO: 410240 - protein, 9 aa, Homo Sapiens
KKKIAKGTT

SEQ ID NO: 410241 - protein, 9 aa, Homo Sapiens
PPKVLTNTA

SEQ ID NO: 410242 - protein, 9 aa, Homo Sapiens
PMRKTAPKA

SEQ ID NO: 410243 - protein, 9 aa, Homo Sapiens
CIDKAEVCL

SEQ ID NO: 410244 - protein, 9 aa, Homo Sapiens
WLGALKKGA

SEQ ID NO: 410245 - protein, 9 aa, Homo Sapiens
GAQNPATAG

SEQ ID NO: 410246 - protein, 9 aa, Homo Sapiens
WRPGASRRW

SEQ ID NO: 410247 - protein, 9 aa, Homo Sapiens
RQDILDNSG

SEQ ID NO: 410248 - protein, 9 aa, Homo Sapiens
LCFFIFFIF

SEQ ID NO: 410249 - protein, 9 aa, Homo Sapiens
EGPLFCRVS

SEQ ID NO: 410250 - protein, 9 aa, Homo Sapiens
GVMVDGVAP

SEQ ID NO: 410251 - protein, 9 aa, Homo Sapiens
GAPGCTLVL

SEQ ID NO: 410252 - protein, 9 aa, Homo Sapiens
NDGRTRSSG

SEQ ID NO: 410253 - protein, 9 aa, Homo Sapiens
RRAKNRVLM

SEQ ID NO: 410254 - protein, 9 aa, Homo Sapiens
TNLLTEETN

SEQ ID NO: 410255 - protein, 9 aa, Homo Sapiens
KDMKGALWK

SEQ ID NO: 410256 - protein, 9 aa, Homo Sapiens
LVQAYTPSS

SEQ ID NO: 410257 - protein, 9 aa, Homo Sapiens
APSQVWTAA

SEQ ID NO: 410258 - protein, 9 aa, Homo Sapiens
SHVGGASAA

SEQ ID NO: 410259 - protein, 9 aa, Homo Sapiens
QIVADLKHA

SEQ ID NO: 410260 - protein, 9 aa, Homo Sapiens
KSVDTIRSS

SEQ ID NO: 410261 - protein, 9 aa, Homo Sapiens
ATTRPSRRP

SEQ ID NO: 410262 - protein, 9 aa, Homo Sapiens
LLVLTGVSL

SEQ ID NO: 410263 - protein, 9 aa, Homo Sapiens
WRLWATEQP

SEQ ID NO: 410264 - protein, 9 aa, Homo Sapiens
HRSTFRNLQ

SEQ ID NO: 410265 - protein, 9 aa, Homo Sapiens
PRRSPALRA

SEQ ID NO: 410266 - protein, 9 aa, Homo Sapiens
LSSTEGAVP

SEQ ID NO: 410267 - protein, 9 aa, Homo Sapiens
ADEKRYQAL

SEQ ID NO: 410268 - protein, 9 aa, Homo Sapiens
TELRDVLPG

SEQ ID NO: 410269 - protein, 9 aa, Homo Sapiens
NYNKNYHFF

SEQ ID NO: 410270 - protein, 9 aa, Homo Sapiens
AWHPLTTSA

SEQ ID NO: 410271 - protein, 9 aa, Homo Sapiens
MAPLSPGAT

SEQ ID NO: 410272 - protein, 9 aa, Homo Sapiens
TNTATTPTA

SEQ ID NO: 410273 - protein, 9 aa, Homo Sapiens
RGGGWAATV

SEQ ID NO: 410274 - protein, 9 aa, Homo Sapiens
NLIVLEIIE

SEQ ID NO: 410275 - protein, 9 aa, Homo Sapiens
SSARPAPPY

SEQ ID NO: 410276 - protein, 9 aa, Homo Sapiens
KIWEELLKI

SEQ ID NO: 410277 - protein, 9 aa, Homo Sapiens
QWVQDPPLQ

SEQ ID NO: 410278 - protein, 9 aa, Homo Sapiens
NDFHGVAPS

SEQ ID NO: 410279 - protein, 9 aa, Homo Sapiens
HFLTGQGCL

SEQ ID NO: 410280 - protein, 9 aa, Homo Sapiens
PGTGAEADR

SEQ ID NO: 410281 - protein, 9 aa, Homo Sapiens
LTIGGWRIC

SEQ ID NO: 410282 - protein, 9 aa, Homo Sapiens
QKSRVSTPL

SEQ ID NO: 410283 - protein, 9 aa, Homo Sapiens
VRVGSCVDS

SEQ ID NO: 410284 - protein, 9 aa, Homo Sapiens
PDQYQASQT

SEQ ID NO: 410285 - protein, 9 aa, Homo Sapiens
ESAQDTYMD

SEQ ID NO: 410286 - protein, 9 aa, Homo Sapiens
GIPDCYYVT

SEQ ID NO: 410287 - protein, 9 aa, Homo Sapiens
EMPSEQVLQ

SEQ ID NO: 410288 - protein, 9 aa, Homo Sapiens
SPGPMWQGM

SEQ ID NO: 410289 - protein, 9 aa, Homo Sapiens
QTFEGNAET

SEQ ID NO: 410290 - protein, 9 aa, Homo Sapiens
EMHELNVLA

SEQ ID NO: 410291 - protein, 9 aa, Homo Sapiens
RDGGWGWRS

SEQ ID NO: 410292 - protein, 9 aa, Homo Sapiens
AVTVAVGCR

SEQ ID NO: 410293 - protein, 9 aa, Homo Sapiens
FVQSSSVSS

SEQ ID NO: 410294 - protein, 9 aa, Homo Sapiens
WRFCRRSGK

SEQ ID NO: 410295 - protein, 9 aa, Homo Sapiens
KVYTFNSMR

SEQ ID NO: 410296 - protein, 9 aa, Homo Sapiens
HLNLKYNLE

SEQ ID NO: 410297 - protein, 9 aa, Homo Sapiens
PEPGEPGQK

SEQ ID NO: 410298 - protein, 9 aa, Homo Sapiens
QHAHLTIHQ

SEQ ID NO: 410299 - protein, 9 aa, Homo Sapiens
AHCHLSCPE

SEQ ID NO: 410300 - protein, 9 aa, Homo Sapiens
LQASYDVPT

SEQ ID NO: 410301 - protein, 9 aa, Homo Sapiens
GLMREWPVS

SEQ ID NO: 410302 - protein, 9 aa, Homo Sapiens
GESTSTGSR

SEQ ID NO: 410303 - protein, 9 aa, Homo Sapiens
RRSPFPRQR

SEQ ID NO: 410304 - protein, 9 aa, Homo Sapiens
GAAAARATA

SEQ ID NO: 410305 - protein, 9 aa, Homo Sapiens
WCITGFLDM

SEQ ID NO: 410306 - protein, 9 aa, Homo Sapiens
IHAERVTIM

SEQ ID NO: 410307 - protein, 9 aa, Homo Sapiens
SFSKWCRPW

SEQ ID NO: 410308 - protein, 9 aa, Homo Sapiens
TPRSERKWS

SEQ ID NO: 410309 - protein, 9 aa, Homo Sapiens
DIRTKLTDI

SEQ ID NO: 410310 - protein, 9 aa, Homo Sapiens
GPHPEGLHQ

SEQ ID NO: 410311 - protein, 9 aa, Homo Sapiens
ALTASGADL

SEQ ID NO: 410312 - protein, 9 aa, Homo Sapiens
VTSTAGTSL

SEQ ID NO: 410313 - protein, 9 aa, Homo Sapiens
PALQSVSVC

SEQ ID NO: 410314 - protein, 9 aa, Homo Sapiens
VLITTRTAV

SEQ ID NO: 410315 - protein, 9 aa, Homo Sapiens
VQLLVYAFL

SEQ ID NO: 410316 - protein, 9 aa, Homo Sapiens
MNLADSTLH

SEQ ID NO: 410317 - protein, 9 aa, Homo Sapiens
DYMSHPKEK

SEQ ID NO: 410318 - protein, 9 aa, Homo Sapiens
FSTSGALCA

SEQ ID NO: 410319 - protein, 9 aa, Homo Sapiens
RPHAGPAVQ

SEQ ID NO: 410320 - protein, 9 aa, Homo Sapiens
MRTSQYTQT

SEQ ID NO: 410321 - protein, 9 aa, Homo Sapiens
ERSPGHPRG

SEQ ID NO: 410322 - protein, 9 aa, Homo Sapiens
LVILKHLQV

SEQ ID NO: 410323 - protein, 9 aa, Homo Sapiens
QWRQPPRER

SEQ ID NO: 410324 - protein, 9 aa, Homo Sapiens
AGMDSNYQM

SEQ ID NO: 410325 - protein, 9 aa, Homo Sapiens
KYNLEANKN

SEQ ID NO: 410326 - protein, 9 aa, Homo Sapiens
FYNNRYAGD

SEQ ID NO: 410327 - protein, 9 aa, Homo Sapiens
KQDGDDQPS

SEQ ID NO: 410328 - protein, 9 aa, Homo Sapiens
VVTAGVCQQ

SEQ ID NO: 410329 - protein, 9 aa, Homo Sapiens
LLREEECVM

SEQ ID NO: 410330 - protein, 9 aa, Homo Sapiens
NLKDDFEVF

SEQ ID NO: 410331 - protein, 9 aa, Homo Sapiens
QRGLQYKCL

SEQ ID NO: 410332 - protein, 9 aa, Homo Sapiens
WKKLPSCPL

SEQ ID NO: 410333 - protein, 9 aa, Homo Sapiens
GIVQCGLVQ

SEQ ID NO: 410334 - protein, 9 aa, Homo Sapiens
RTSRGQAQD

SEQ ID NO: 410335 - protein, 9 aa, Homo Sapiens
CAGRRRQDC

SEQ ID NO: 410336 - protein, 9 aa, Homo Sapiens
TVTAAAAGA

SEQ ID NO: 410337 - protein, 9 aa, Homo Sapiens
TTWHVTTVR

SEQ ID NO: 410338 - protein, 9 aa, Homo Sapiens
SKDKDWDRK

SEQ ID NO: 410339 - protein, 9 aa, Homo Sapiens
ISDLIAVRQ

SEQ ID NO: 410340 - protein, 9 aa, Homo Sapiens
GESFPIKYH

SEQ ID NO: 410341 - protein, 9 aa, Homo Sapiens
EKLNIEGME

SEQ ID NO: 410342 - protein, 9 aa, Homo Sapiens
IRKKAFKAF

SEQ ID NO: 410343 - protein, 9 aa, Homo Sapiens
NFLPEDPVL

SEQ ID NO: 410344 - protein, 9 aa, Homo Sapiens
AIVNTGTSL

SEQ ID NO: 410345 - protein, 9 aa, Homo Sapiens
TSFSSLEPQ

SEQ ID NO: 410346 - protein, 9 aa, Homo Sapiens
KPNEEHFGD

SEQ ID NO: 410347 - protein, 9 aa, Homo Sapiens
RGQIKQKRR

SEQ ID NO: 410348 - protein, 9 aa, Homo Sapiens
SASGGESEG

SEQ ID NO: 410349 - protein, 9 aa, Homo Sapiens
FVSTDFHSM

SEQ ID NO: 410350 - protein, 9 aa, Homo Sapiens
EDLPLCLKV

SEQ ID NO: 410351 - protein, 9 aa, Homo Sapiens
TRSWYNYMC

SEQ ID NO: 410352 - protein, 9 aa, Homo Sapiens
GGSGGHYPC

SEQ ID NO: 410353 - protein, 9 aa, Homo Sapiens
PAGACAPIS

SEQ ID NO: 410354 - protein, 9 aa, Homo Sapiens
SIYQMSVSE

SEQ ID NO: 410355 - protein, 9 aa, Homo Sapiens
MCGWNSTHP

SEQ ID NO: 410356 - protein, 9 aa, Homo Sapiens
QLLGSMAHP

SEQ ID NO: 410357 - protein, 9 aa, Homo Sapiens
LFCLSWILH

SEQ ID NO: 410358 - protein, 9 aa, Homo Sapiens
APHKNTQEN

SEQ ID NO: 410359 - protein, 9 aa, Homo Sapiens
ERIDGMSLL

SEQ ID NO: 410360 - protein, 9 aa, Homo Sapiens
FKMPKQLVH

SEQ ID NO: 410361 - protein, 9 aa, Homo Sapiens
CSICGLPVH

SEQ ID NO: 410362 - protein, 9 aa, Homo Sapiens
SLKQRLNIA

SEQ ID NO: 410363 - protein, 9 aa, Homo Sapiens
PPAILDDTT

SEQ ID NO: 410364 - protein, 9 aa, Homo Sapiens
KKITIKMNM

SEQ ID NO: 410365 - protein, 9 aa, Homo Sapiens
RTCWTASSW

SEQ ID NO: 410366 - protein, 9 aa, Homo Sapiens
TTLSSMMTS

SEQ ID NO: 410367 - protein, 9 aa, Homo Sapiens
DASPTRSSR

SEQ ID NO: 410368 - protein, 9 aa, Homo Sapiens
ALHRYAGMT

SEQ ID NO: 410369 - protein, 9 aa, Homo Sapiens
SPKNQERSP

SEQ ID NO: 410370 - protein, 9 aa, Homo Sapiens
RSHCSSTVT

SEQ ID NO: 410371 - protein, 9 aa, Homo Sapiens
LGRRGCRPM

SEQ ID NO: 410372 - protein, 9 aa, Homo Sapiens
PPVPVLSSL

SEQ ID NO: 410373 - protein, 9 aa, Homo Sapiens
PPTCLAGHR

SEQ ID NO: 410374 - protein, 9 aa, Homo Sapiens
EPQDWTCHL

SEQ ID NO: 410375 - protein, 9 aa, Homo Sapiens
GATLTSTSC

SEQ ID NO: 410376 - protein, 9 aa, Homo Sapiens
GNDGRTRSS

SEQ ID NO: 410377 - protein, 9 aa, Homo Sapiens
EVGLAPGEL

SEQ ID NO: 410378 - protein, 9 aa, Homo Sapiens
LPLRSSGQP

SEQ ID NO: 410379 - protein, 9 aa, Homo Sapiens
MLNMLQESM

SEQ ID NO: 410380 - protein, 9 aa, Homo Sapiens
SSCSARWCL

SEQ ID NO: 410381 - protein, 9 aa, Homo Sapiens
PPGTPQPVV

SEQ ID NO: 410382 - protein, 9 aa, Homo Sapiens
TPQLSSPAL

SEQ ID NO: 410383 - protein, 9 aa, Homo Sapiens
WPDGWAAAA

SEQ ID NO: 410384 - protein, 9 aa, Homo Sapiens
NATGHQLQT

SEQ ID NO: 410385 - protein, 9 aa, Homo Sapiens
LDCVAKLAE

SEQ ID NO: 410386 - protein, 9 aa, Homo Sapiens
EQLRCPQLS

SEQ ID NO: 410387 - protein, 9 aa, Homo Sapiens
RPPAPGSSC

SEQ ID NO: 410388 - protein, 9 aa, Homo Sapiens
PAGPSALPS

SEQ ID NO: 410389 - protein, 9 aa, Homo Sapiens
REEPSKEEG

SEQ ID NO: 410390 - protein, 9 aa, Homo Sapiens
PLATPRHQY

SEQ ID NO: 410391 - protein, 9 aa, Homo Sapiens
DHTVIVSPV

SEQ ID NO: 410392 - protein, 9 aa, Homo Sapiens
QQSNQKCID

SEQ ID NO: 410393 - protein, 9 aa, Homo Sapiens
LQLFIHCPM

SEQ ID NO: 410394 - protein, 9 aa, Homo Sapiens
MQVLFSSEA

SEQ ID NO: 410395 - protein, 9 aa, Homo Sapiens
RTRYIPCTS

SEQ ID NO: 410396 - protein, 9 aa, Homo Sapiens
LLSHLRCRD

SEQ ID NO: 410397 - protein, 9 aa, Homo Sapiens
RPWLEQMLH

SEQ ID NO: 410398 - protein, 9 aa, Homo Sapiens
APGSSSERC

SEQ ID NO: 410399 - protein, 9 aa, Homo Sapiens
ADTPKSGEL

SEQ ID NO: 410400 - protein, 9 aa, Homo Sapiens
VCTGMARSE

SEQ ID NO: 410401 - protein, 9 aa, Homo Sapiens
EKTRYDMSL

SEQ ID NO: 410402 - protein, 9 aa, Homo Sapiens
KCEYCTNRA

SEQ ID NO: 410403 - protein, 9 aa, Homo Sapiens
PASHVGGAS

SEQ ID NO: 410404 - protein, 9 aa, Homo Sapiens
TLTSTSCST

SEQ ID NO: 410405 - protein, 9 aa, Homo Sapiens
ANYTSSLNS

SEQ ID NO: 410406 - protein, 9 aa, Homo Sapiens
LSWLDLEFI

SEQ ID NO: 410407 - protein, 9 aa, Homo Sapiens
LQAEDMYSA

SEQ ID NO: 410408 - protein, 9 aa, Homo Sapiens
TCLQAWRLF

SEQ ID NO: 410409 - protein, 9 aa, Homo Sapiens
ILGYQIAYH

SEQ ID NO: 410410 - protein, 9 aa, Homo Sapiens
PPAPPISLA

SEQ ID NO: 410411 - protein, 9 aa, Homo Sapiens
ELLDTPFVR

SEQ ID NO: 410412 - protein, 9 aa, Homo Sapiens
PLGQGAGHA

SEQ ID NO: 410413 - protein, 9 aa, Homo Sapiens
PPGTTPPGR

SEQ ID NO: 410414 - protein, 9 aa, Homo Sapiens
FSINTAWSQ

SEQ ID NO: 410415 - protein, 9 aa, Homo Sapiens
KTRMFIPAA

SEQ ID NO: 410416 - protein, 9 aa, Homo Sapiens
KGPVYLLSV

SEQ ID NO: 410417 - protein, 9 aa, Homo Sapiens
ASLSGHWDM

SEQ ID NO: 410418 - protein, 9 aa, Homo Sapiens
RPPVLPWCP

SEQ ID NO: 410419 - protein, 9 aa, Homo Sapiens
HEHGHEHGY

SEQ ID NO: 410420 - protein, 9 aa, Homo Sapiens
ICGLPVHSN

SEQ ID NO: 410421 - protein, 9 aa, Homo Sapiens
AEPLLSWAG

SEQ ID NO: 410422 - protein, 9 aa, Homo Sapiens
SMLLRTVHS

SEQ ID NO: 410423 - protein, 9 aa, Homo Sapiens
IPAEFPHWT

SEQ ID NO: 410424 - protein, 9 aa, Homo Sapiens
LSHSHLEKN

SEQ ID NO: 410425 - protein, 9 aa, Homo Sapiens
RGYGKDAAG

SEQ ID NO: 410426 - protein, 9 aa, Homo Sapiens
VIQSGQKLR

SEQ ID NO: 410427 - protein, 9 aa, Homo Sapiens
ADDWWIAMT

SEQ ID NO: 410428 - protein, 9 aa, Homo Sapiens
VPRKTLKMI

SEQ ID NO: 410429 - protein, 9 aa, Homo Sapiens
PAQPPGPAP

SEQ ID NO: 410430 - protein, 9 aa, Homo Sapiens
SILMSAPNF

SEQ ID NO: 410431 - protein, 9 aa, Homo Sapiens
VEILGYYML

SEQ ID NO: 410432 - protein, 9 aa, Homo Sapiens
KRVFGEHRR

SEQ ID NO: 410433 - protein, 9 aa, Homo Sapiens
CCCQPGCYG

SEQ ID NO: 410434 - protein, 9 aa, Homo Sapiens
QYAQGYEGG

SEQ ID NO: 410435 - protein, 9 aa, Homo Sapiens
SIVGTVLLD

SEQ ID NO: 410436 - protein, 9 aa, Homo Sapiens
VTKGKKAKF

SEQ ID NO: 410437 - protein, 9 aa, Homo Sapiens
VASVTRRCL

SEQ ID NO: 410438 - protein, 9 aa, Homo Sapiens
LSKNLIVLE

SEQ ID NO: 410439 - protein, 9 aa, Homo Sapiens
RWLGVSEQQ

SEQ ID NO: 410440 - protein, 9 aa, Homo Sapiens
FMDLASTAG

SEQ ID NO: 410441 - protein, 9 aa, Homo Sapiens
QVLSLLPVL

SEQ ID NO: 410442 - protein, 9 aa, Homo Sapiens
ALLGKDTMS

SEQ ID NO: 410443 - protein, 9 aa, Homo Sapiens
SKLSVEIRS

SEQ ID NO: 410444 - protein, 9 aa, Homo Sapiens
HFNFQGCNF

SEQ ID NO: 410445 - protein, 9 aa, Homo Sapiens
NCPWKAPSG

SEQ ID NO: 410446 - protein, 9 aa, Homo Sapiens
CITGFLDML

SEQ ID NO: 410447 - protein, 9 aa, Homo Sapiens
TAPSLSTAT

SEQ ID NO: 410448 - protein, 9 aa, Homo Sapiens
CMDKDIQIH

SEQ ID NO: 410449 - protein, 9 aa, Homo Sapiens
PLCKHKKKG

SEQ ID NO: 410450 - protein, 9 aa, Homo Sapiens
ARGRPFCAD

SEQ ID NO: 410451 - protein, 9 aa, Homo Sapiens
QNLLSLAWK

SEQ ID NO: 410452 - protein, 9 aa, Homo Sapiens
GLRPPHLPS

SEQ ID NO: 410453 - protein, 9 aa, Homo Sapiens
HSPGVRSPV

SEQ ID NO: 410454 - protein, 9 aa, Homo Sapiens
CVASINLST

SEQ ID NO: 410455 - protein, 9 aa, Homo Sapiens
WWTSGAGGS

SEQ ID NO: 410456 - protein, 9 aa, Homo Sapiens
MLVGYPSTT

SEQ ID NO: 410457 - protein, 9 aa, Homo Sapiens
PSTNVALYV

SEQ ID NO: 410458 - protein, 9 aa, Homo Sapiens
GMSLLGLHG

SEQ ID NO: 410459 - protein, 9 aa, Homo Sapiens
THEQSESVH

SEQ ID NO: 410460 - protein, 9 aa, Homo Sapiens
PCSVLGGED

SEQ ID NO: 410461 - protein, 9 aa, Homo Sapiens
SAHDPDTGE

SEQ ID NO: 410462 - protein, 9 aa, Homo Sapiens
SPDGDQVAV

SEQ ID NO: 410463 - protein, 9 aa, Homo Sapiens
HQHSYHLSG

SEQ ID NO: 410464 - protein, 9 aa, Homo Sapiens
YECHVSDYS

SEQ ID NO: 410465 - protein, 9 aa, Homo Sapiens
DGRPRAVCV

SEQ ID NO: 410466 - protein, 9 aa, Homo Sapiens
SRWKPCDNG

SEQ ID NO: 410467 - protein, 9 aa, Homo Sapiens
RDLPQEQHL

SEQ ID NO: 410468 - protein, 9 aa, Homo Sapiens
EGEKNQLTR

SEQ ID NO: 410469 - protein, 9 aa, Homo Sapiens
HVGHTPMHF

SEQ ID NO: 410470 - protein, 9 aa, Homo Sapiens
MPQEGGGTS

SEQ ID NO: 410471 - protein, 9 aa, Homo Sapiens
ENYQIPLRV

SEQ ID NO: 410472 - protein, 9 aa, Homo Sapiens
NDLLLPGWG

SEQ ID NO: 410473 - protein, 9 aa, Homo Sapiens
QEMCPRDYW

SEQ ID NO: 410474 - protein, 9 aa, Homo Sapiens
PAWPAVLPP

SEQ ID NO: 410475 - protein, 9 aa, Homo Sapiens
PAPGSSCYF

SEQ ID NO: 410476 - protein, 9 aa, Homo Sapiens
SCHLWSPFG

SEQ ID NO: 410477 - protein, 9 aa, Homo Sapiens
FVKKCKTSM

SEQ ID NO: 410478 - protein, 9 aa, Homo Sapiens
FGRKNVLFM

SEQ ID NO: 410479 - protein, 9 aa, Homo Sapiens
PPRSGRGSL

SEQ ID NO: 410480 - protein, 9 aa, Homo Sapiens
WYLSWLDLE

SEQ ID NO: 410481 - protein, 9 aa, Homo Sapiens
VQLNDEALK

SEQ ID NO: 410482 - protein, 9 aa, Homo Sapiens
GLDCFKVYA

SEQ ID NO: 410483 - protein, 9 aa, Homo Sapiens
VIFLESPNL

SEQ ID NO: 410484 - protein, 9 aa, Homo Sapiens
AMQALVLGP

SEQ ID NO: 410485 - protein, 9 aa, Homo Sapiens
FEQLEHVQE

SEQ ID NO: 410486 - protein, 9 aa, Homo Sapiens
FLVTSHYVT

SEQ ID NO: 410487 - protein, 9 aa, Homo Sapiens
PPALPSRPA

SEQ ID NO: 410488 - protein, 9 aa, Homo Sapiens
VSVCRWRGP

SEQ ID NO: 410489 - protein, 9 aa, Homo Sapiens
SPPTSCPPL

SEQ ID NO: 410490 - protein, 9 aa, Homo Sapiens
SLTLHMKIH

SEQ ID NO: 410491 - protein, 9 aa, Homo Sapiens
GAHCHLSCP

SEQ ID NO: 410492 - protein, 9 aa, Homo Sapiens
LSGDTLLHL

SEQ ID NO: 410493 - protein, 9 aa, Homo Sapiens
SSAAAGVPR

SEQ ID NO: 410494 - protein, 9 aa, Homo Sapiens
VSQKEVTIF

SEQ ID NO: 410495 - protein, 9 aa, Homo Sapiens
TEETNSFVN

SEQ ID NO: 410496 - protein, 9 aa, Homo Sapiens
ADKQSGKKC

SEQ ID NO: 410497 - protein, 9 aa, Homo Sapiens
HEYQEQKQR

SEQ ID NO: 410498 - protein, 9 aa, Homo Sapiens
MTMTNYDEA

SEQ ID NO: 410499 - protein, 9 aa, Homo Sapiens
AFFPSTWEL

SEQ ID NO: 410500 - protein, 9 aa, Homo Sapiens
RRAATRRPS

SEQ ID NO: 410501 - protein, 9 aa, Homo Sapiens
AQDEVPASP

SEQ ID NO: 410502 - protein, 9 aa, Homo Sapiens
PHRSPPTSC

SEQ ID NO: 410503 - protein, 9 aa, Homo Sapiens
DSGGSFPLQ

SEQ ID NO: 410504 - protein, 9 aa, Homo Sapiens
MKGALWKVL

SEQ ID NO: 410505 - protein, 9 aa, Homo Sapiens
YITMDELHR

SEQ ID NO: 410506 - protein, 9 aa, Homo Sapiens
GCLLLVVRV

SEQ ID NO: 410507 - protein, 9 aa, Homo Sapiens
DTLLHLIPQ

SEQ ID NO: 410508 - protein, 9 aa, Homo Sapiens
AKGQTRPSL

SEQ ID NO: 410509 - protein, 9 aa, Homo Sapiens
QIWKEMDEY

SEQ ID NO: 410510 - protein, 9 aa, Homo Sapiens
DIDEYKKTY

SEQ ID NO: 410511 - protein, 9 aa, Homo Sapiens
AGAWSGAWT

SEQ ID NO: 410512 - protein, 9 aa, Homo Sapiens
PPEGAAQAQ

SEQ ID NO: 410513 - protein, 9 aa, Homo Sapiens
CVMKESVWE

SEQ ID NO: 410514 - protein, 9 aa, Homo Sapiens
RDYWYLLAP

SEQ ID NO: 410515 - protein, 9 aa, Homo Sapiens
QPGATTRPS

SEQ ID NO: 410516 - protein, 9 aa, Homo Sapiens
YELVVTAWD

SEQ ID NO: 410517 - protein, 9 aa, Homo Sapiens
GDEAMEHFR

SEQ ID NO: 410518 - protein, 9 aa, Homo Sapiens
IVRPVQLLV

SEQ ID NO: 410519 - protein, 9 aa, Homo Sapiens
MKKKKLEKT

SEQ ID NO: 410520 - protein, 9 aa, Homo Sapiens
NLTESCRSC

SEQ ID NO: 410521 - protein, 9 aa, Homo Sapiens
GASRRWRMS

SEQ ID NO: 410522 - protein, 9 aa, Homo Sapiens
KLSPSLPSR

SEQ ID NO: 410523 - protein, 9 aa, Homo Sapiens
QHGHEAVVH

SEQ ID NO: 410524 - protein, 9 aa, Homo Sapiens
PCPAVPLGP

SEQ ID NO: 410525 - protein, 9 aa, Homo Sapiens
KEATPGGAS

SEQ ID NO: 410526 - protein, 9 aa, Homo Sapiens
CTPPHLLKE

SEQ ID NO: 410527 - protein, 9 aa, Homo Sapiens
QIKQKRRPY

SEQ ID NO: 410528 - protein, 9 aa, Homo Sapiens
RQMLPTLST

SEQ ID NO: 410529 - protein, 9 aa, Homo Sapiens
AVHQHSYHL

SEQ ID NO: 410530 - protein, 9 aa, Homo Sapiens
LPQIFFRVM

SEQ ID NO: 410531 - protein, 9 aa, Homo Sapiens
ARDLVNAFL

SEQ ID NO: 410532 - protein, 9 aa, Homo Sapiens
SVIAAGPAR

SEQ ID NO: 410533 - protein, 9 aa, Homo Sapiens
YSTNEAKKG

SEQ ID NO: 410534 - protein, 9 aa, Homo Sapiens
ILILLGAFI

SEQ ID NO: 410535 - protein, 9 aa, Homo Sapiens
HWGHTKLAF

SEQ ID NO: 410536 - protein, 9 aa, Homo Sapiens
LTSEEQIVL

SEQ ID NO: 410537 - protein, 9 aa, Homo Sapiens
FPEENHEVF

SEQ ID NO: 410538 - protein, 9 aa, Homo Sapiens
RPPQPPPAL

SEQ ID NO: 410539 - protein, 9 aa, Homo Sapiens
EDLRVEVTQ

SEQ ID NO: 410540 - protein, 9 aa, Homo Sapiens
GAREGLIVA

SEQ ID NO: 410541 - protein, 9 aa, Homo Sapiens
GPAPETRVP

SEQ ID NO: 410542 - protein, 9 aa, Homo Sapiens
LLLLVVLAA

SEQ ID NO: 410543 - protein, 9 aa, Homo Sapiens
NSLLPIRSS

SEQ ID NO: 410544 - protein, 9 aa, Homo Sapiens
EEQPKKWTR

SEQ ID NO: 410545 - protein, 9 aa, Homo Sapiens
EEKGQQILM

SEQ ID NO: 410546 - protein, 9 aa, Homo Sapiens
NHMVTASAS

SEQ ID NO: 410547 - protein, 9 aa, Homo Sapiens
HTRRVDTVD

SEQ ID NO: 410548 - protein, 9 aa, Homo Sapiens
NLGVDDGYM

SEQ ID NO: 410549 - protein, 9 aa, Homo Sapiens
VRGLGMSLQ

SEQ ID NO: 410550 - protein, 9 aa, Homo Sapiens
NNGQKCTEP

SEQ ID NO: 410551 - protein, 9 aa, Homo Sapiens
MDYTFIRVF

SEQ ID NO: 410552 - protein, 9 aa, Homo Sapiens
WSSPLMWGM

SEQ ID NO: 410553 - protein, 9 aa, Homo Sapiens
LQSPCISTV

SEQ ID NO: 410554 - protein, 9 aa, Homo Sapiens
NGENAIEEQ

SEQ ID NO: 410555 - protein, 9 aa, Homo Sapiens
DSDAVSTSS

SEQ ID NO: 410556 - protein, 9 aa, Homo Sapiens
NHFQQVESR

SEQ ID NO: 410557 - protein, 9 aa, Homo Sapiens
VTTPATETK

SEQ ID NO: 410558 - protein, 9 aa, Homo Sapiens
ERRWLALVM

SEQ ID NO: 410559 - protein, 9 aa, Homo Sapiens
VRLEDYLRE

SEQ ID NO: 410560 - protein, 9 aa, Homo Sapiens
ASHQNLGTP

SEQ ID NO: 410561 - protein, 9 aa, Homo Sapiens
LYFFRERSA

SEQ ID NO: 410562 - protein, 9 aa, Homo Sapiens
SRGQAQDTS

SEQ ID NO: 410563 - protein, 9 aa, Homo Sapiens
IFWPCDLIH

SEQ ID NO: 410564 - protein, 9 aa, Homo Sapiens
GFELLQGSL

SEQ ID NO: 410565 - protein, 9 aa, Homo Sapiens
CGSRASTHW

SEQ ID NO: 410566 - protein, 9 aa, Homo Sapiens
PLLSWAGFS

SEQ ID NO: 410567 - protein, 9 aa, Homo Sapiens
EAALRPSTS

SEQ ID NO: 410568 - protein, 9 aa, Homo Sapiens
QEVVDTYSS

SEQ ID NO: 410569 - protein, 9 aa, Homo Sapiens
LGKIPNLLP

SEQ ID NO: 410570 - protein, 9 aa, Homo Sapiens
QWQLPGPFL

SEQ ID NO: 410571 - protein, 9 aa, Homo Sapiens
GRDQRRGRL

SEQ ID NO: 410572 - protein, 9 aa, Homo Sapiens
DTNDMVDDN

SEQ ID NO: 410573 - protein, 9 aa, Homo Sapiens
FALNPHSGT

SEQ ID NO: 410574 - protein, 9 aa, Homo Sapiens
NFTKLAKNR

SEQ ID NO: 410575 - protein, 9 aa, Homo Sapiens
NGVQVQGMP

SEQ ID NO: 410576 - protein, 9 aa, Homo Sapiens
LPDRKTTSF

SEQ ID NO: 410577 - protein, 9 aa, Homo Sapiens
TAKAPLSRS

SEQ ID NO: 410578 - protein, 9 aa, Homo Sapiens
TLGVMMMMI

SEQ ID NO: 410579 - protein, 9 aa, Homo Sapiens
VMHWTTLLL

SEQ ID NO: 410580 - protein, 9 aa, Homo Sapiens
AAAAARLLD

SEQ ID NO: 410581 - protein, 9 aa, Homo Sapiens
PGCPLRGGA

SEQ ID NO: 410582 - protein, 9 aa, Homo Sapiens
LPATTSTGG

SEQ ID NO: 410583 - protein, 9 aa, Homo Sapiens
FKTRLLRRA

SEQ ID NO: 410584 - protein, 9 aa, Homo Sapiens
DDYSPDLDL

SEQ ID NO: 410585 - protein, 9 aa, Homo Sapiens
FSCISRKCP

SEQ ID NO: 410586 - protein, 9 aa, Homo Sapiens
AFAMITYKF

SEQ ID NO: 410587 - protein, 9 aa, Homo Sapiens
WDSPSHVPF

SEQ ID NO: 410588 - protein, 9 aa, Homo Sapiens
GNFLKPRDL

SEQ ID NO: 410589 - protein, 9 aa, Homo Sapiens
WGEKLALDY

SEQ ID NO: 410590 - protein, 9 aa, Homo Sapiens
TTAPWVKVV

SEQ ID NO: 410591 - protein, 9 aa, Homo Sapiens
SLVGVPPLP

SEQ ID NO: 410592 - protein, 9 aa, Homo Sapiens
IGDREDDET

SEQ ID NO: 410593 - protein, 9 aa, Homo Sapiens
KKEKLPGEL

SEQ ID NO: 410594 - protein, 9 aa, Homo Sapiens
PARTGLLPG

SEQ ID NO: 410595 - protein, 9 aa, Homo Sapiens
FSHQLAGHT

SEQ ID NO: 410596 - protein, 9 aa, Homo Sapiens
LEDDKASQR

SEQ ID NO: 410597 - protein, 9 aa, Homo Sapiens
MVVLATWTI

SEQ ID NO: 410598 - protein, 9 aa, Homo Sapiens
KAFKIPDFQ

SEQ ID NO: 410599 - protein, 9 aa, Homo Sapiens
ITLPWSRSW

SEQ ID NO: 410600 - protein, 9 aa, Homo Sapiens
PALVAPRGL

SEQ ID NO: 410601 - protein, 9 aa, Homo Sapiens
SKCITECVR

SEQ ID NO: 410602 - protein, 9 aa, Homo Sapiens
PHSGTLVTA

SEQ ID NO: 410603 - protein, 9 aa, Homo Sapiens
VSTQDQLSA

SEQ ID NO: 410604 - protein, 9 aa, Homo Sapiens
RISCLRDDV

SEQ ID NO: 410605 - protein, 9 aa, Homo Sapiens
ASVEGQKKA

SEQ ID NO: 410606 - protein, 9 aa, Homo Sapiens
YIVAGIFIA

SEQ ID NO: 410607 - protein, 9 aa, Homo Sapiens
RILVTSFDH

SEQ ID NO: 410608 - protein, 9 aa, Homo Sapiens
KASLTIGGW

SEQ ID NO: 410609 - protein, 9 aa, Homo Sapiens
TGSRGSRRR

SEQ ID NO: 410610 - protein, 9 aa, Homo Sapiens
PQPRLAPER

SEQ ID NO: 410611 - protein, 9 aa, Homo Sapiens
QPKKWTRSQ

SEQ ID NO: 410612 - protein, 9 aa, Homo Sapiens
MTLNPLSSH

SEQ ID NO: 410613 - protein, 9 aa, Homo Sapiens
LVQQGDDFK

SEQ ID NO: 410614 - protein, 9 aa, Homo Sapiens
GVQRLLLVL

SEQ ID NO: 410615 - protein, 9 aa, Homo Sapiens
QNNIFTDDI

SEQ ID NO: 410616 - protein, 9 aa, Homo Sapiens
SAAGGDQRR

SEQ ID NO: 410617 - protein, 9 aa, Homo Sapiens
GPPTAADST

SEQ ID NO: 410618 - protein, 9 aa, Homo Sapiens
FAMITYKFE

SEQ ID NO: 410619 - protein, 9 aa, Homo Sapiens
GRLMRRLVC

SEQ ID NO: 410620 - protein, 9 aa, Homo Sapiens
IISETDDDD

SEQ ID NO: 410621 - protein, 9 aa, Homo Sapiens
AAGGGNPCS

SEQ ID NO: 410622 - protein, 9 aa, Homo Sapiens
HFNKLVVRM

SEQ ID NO: 410623 - protein, 9 aa, Homo Sapiens
LKGKLKNQI

SEQ ID NO: 410624 - protein, 9 aa, Homo Sapiens
PRAVCVGGK

SEQ ID NO: 410625 - protein, 9 aa, Homo Sapiens
HLLQPASLP

SEQ ID NO: 410626 - protein, 9 aa, Homo Sapiens
SASGRRLLP

SEQ ID NO: 410627 - protein, 9 aa, Homo Sapiens
GSPVVNVLF

SEQ ID NO: 410628 - protein, 9 aa, Homo Sapiens
ILLIMVMCY

SEQ ID NO: 410629 - protein, 9 aa, Homo Sapiens
SLATFKTRV

SEQ ID NO: 410630 - protein, 9 aa, Homo Sapiens
LLGGGHPVP

SEQ ID NO: 410631 - protein, 9 aa, Homo Sapiens
PGEARAPLE

SEQ ID NO: 410632 - protein, 9 aa, Homo Sapiens
RAPLESVRQ

SEQ ID NO: 410633 - protein, 9 aa, Homo Sapiens
SGPAVMPPT

SEQ ID NO: 410634 - protein, 9 aa, Homo Sapiens
LETLIAHFQ

SEQ ID NO: 410635 - protein, 9 aa, Homo Sapiens
TSNTFIVNG

SEQ ID NO: 410636 - protein, 9 aa, Homo Sapiens
AWLENEIAT

SEQ ID NO: 410637 - protein, 9 aa, Homo Sapiens
LSQRCHRAV

SEQ ID NO: 410638 - protein, 9 aa, Homo Sapiens
EPPPWQAIW

SEQ ID NO: 410639 - protein, 9 aa, Homo Sapiens
RGPAAPPGG

SEQ ID NO: 410640 - protein, 9 aa, Homo Sapiens
AWTPRKLVG

SEQ ID NO: 410641 - protein, 9 aa, Homo Sapiens
PFQVPHPGL

SEQ ID NO: 410642 - protein, 9 aa, Homo Sapiens
CKDYKYVQC

SEQ ID NO: 410643 - protein, 9 aa, Homo Sapiens
GHQLQTAPP

SEQ ID NO: 410644 - protein, 9 aa, Homo Sapiens
MPPPGHPPR

SEQ ID NO: 410645 - protein, 9 aa, Homo Sapiens
RPDLSIMPP

SEQ ID NO: 410646 - protein, 9 aa, Homo Sapiens
GEARAPLES

SEQ ID NO: 410647 - protein, 9 aa, Homo Sapiens
LVPELYAVL

SEQ ID NO: 410648 - protein, 9 aa, Homo Sapiens
KERYDIMGR

SEQ ID NO: 410649 - protein, 9 aa, Homo Sapiens
DCAVVNCFQ

SEQ ID NO: 410650 - protein, 9 aa, Homo Sapiens
NMSDNAGFC

SEQ ID NO: 410651 - protein, 9 aa, Homo Sapiens
SSCVPRPPQ

SEQ ID NO: 410652 - protein, 9 aa, Homo Sapiens
GTDQWQLPG

SEQ ID NO: 410653 - protein, 9 aa, Homo Sapiens
SALLPRAVS

SEQ ID NO: 410654 - protein, 9 aa, Homo Sapiens
LQQEVLQNI

SEQ ID NO: 410655 - protein, 9 aa, Homo Sapiens
FGKDRKLGP

SEQ ID NO: 410656 - protein, 9 aa, Homo Sapiens
RFGVNSSDI

SEQ ID NO: 410657 - protein, 9 aa, Homo Sapiens
VWPPWEPKP

SEQ ID NO: 410658 - protein, 9 aa, Homo Sapiens
GHHRDRCER

SEQ ID NO: 410659 - protein, 9 aa, Homo Sapiens
IAHLGLQWV

SEQ ID NO: 410660 - protein, 9 aa, Homo Sapiens
ASACTMPPL

SEQ ID NO: 410661 - protein, 9 aa, Homo Sapiens
SLPLRSSGQ

SEQ ID NO: 410662 - protein, 9 aa, Homo Sapiens
NFFFQVELD

SEQ ID NO: 410663 - protein, 9 aa, Homo Sapiens
ALGTGVPQA

SEQ ID NO: 410664 - protein, 9 aa, Homo Sapiens
VLMIMIAKN

SEQ ID NO: 410665 - protein, 9 aa, Homo Sapiens
YFFLPLAPA

SEQ ID NO: 410666 - protein, 9 aa, Homo Sapiens
ECIDWGGKR

SEQ ID NO: 410667 - protein, 9 aa, Homo Sapiens
LPVVLLHKG

SEQ ID NO: 410668 - protein, 9 aa, Homo Sapiens
HNPPSWREE

SEQ ID NO: 410669 - protein, 9 aa, Homo Sapiens
AAAVVMVVR

SEQ ID NO: 410670 - protein, 9 aa, Homo Sapiens
PDFSRLGRY

SEQ ID NO: 410671 - protein, 9 aa, Homo Sapiens
GYDACVVLC

SEQ ID NO: 410672 - protein, 9 aa, Homo Sapiens
QGVFSNNGH

SEQ ID NO: 410673 - protein, 9 aa, Homo Sapiens
DFFRDPLSW

SEQ ID NO: 410674 - protein, 9 aa, Homo Sapiens
YSMVVAPLY

SEQ ID NO: 410675 - protein, 9 aa, Homo Sapiens
WQKSPGNSR

SEQ ID NO: 410676 - protein, 9 aa, Homo Sapiens
KESTLKSIL

SEQ ID NO: 410677 - protein, 9 aa, Homo Sapiens
QHPLQASSW

SEQ ID NO: 410678 - protein, 9 aa, Homo Sapiens
QPEQQAVFF

SEQ ID NO: 410679 - protein, 9 aa, Homo Sapiens
YALVIVCDD

SEQ ID NO: 410680 - protein, 9 aa, Homo Sapiens
IKIQNQKRL

SEQ ID NO: 410681 - protein, 9 aa, Homo Sapiens
LKQFLGNCQ

SEQ ID NO: 410682 - protein, 9 aa, Homo Sapiens
LTSTSCSTM

SEQ ID NO: 410683 - protein, 9 aa, Homo Sapiens
ASGGESEGK

SEQ ID NO: 410684 - protein, 9 aa, Homo Sapiens
GAWSGAWTT

SEQ ID NO: 410685 - protein, 9 aa, Homo Sapiens
GRATGSANV

SEQ ID NO: 410686 - protein, 9 aa, Homo Sapiens
DRRAFILPA

SEQ ID NO: 410687 - protein, 9 aa, Homo Sapiens
PPPGAPATP

SEQ ID NO: 410688 - protein, 9 aa, Homo Sapiens
TSCSTMSCL

SEQ ID NO: 410689 - protein, 9 aa, Homo Sapiens
LGPPPGCGK

SEQ ID NO: 410690 - protein, 9 aa, Homo Sapiens
HHFVPEHHL

SEQ ID NO: 410691 - protein, 9 aa, Homo Sapiens
PPRFGHFTS

SEQ ID NO: 410692 - protein, 9 aa, Homo Sapiens
VYLFMKWYT

SEQ ID NO: 410693 - protein, 9 aa, Homo Sapiens
RIQSGLFDI

SEQ ID NO: 410694 - protein, 9 aa, Homo Sapiens
QSRSPSLQE

SEQ ID NO: 410695 - protein, 9 aa, Homo Sapiens
GHVEVVTLL

SEQ ID NO: 410696 - protein, 9 aa, Homo Sapiens
QNQFLDELM

SEQ ID NO: 410697 - protein, 9 aa, Homo Sapiens
QLPQLQGFL

SEQ ID NO: 410698 - protein, 9 aa, Homo Sapiens
PLFCRVSAL

SEQ ID NO: 410699 - protein, 9 aa, Homo Sapiens
QRLVEGQAA

SEQ ID NO: 410700 - protein, 9 aa, Homo Sapiens
IAKNWKIKI

SEQ ID NO: 410701 - protein, 9 aa, Homo Sapiens
AETAVSVCR

SEQ ID NO: 410702 - protein, 9 aa, Homo Sapiens
EWGEKLALD

SEQ ID NO: 410703 - protein, 9 aa, Homo Sapiens
HLTCAHGHV

SEQ ID NO: 410704 - protein, 9 aa, Homo Sapiens
RSSLRIALH

SEQ ID NO: 410705 - protein, 9 aa, Homo Sapiens
SYYRRDRSP

SEQ ID NO: 410706 - protein, 9 aa, Homo Sapiens
LHTRDKKYH

SEQ ID NO: 410707 - protein, 9 aa, Homo Sapiens
YSDLTKHKR

SEQ ID NO: 410708 - protein, 9 aa, Homo Sapiens
VFTSDMAHV

SEQ ID NO: 410709 - protein, 9 aa, Homo Sapiens
LFEATEKKI

SEQ ID NO: 410710 - protein, 9 aa, Homo Sapiens
VRMGTEPHH

SEQ ID NO: 410711 - protein, 9 aa, Homo Sapiens
TMAATAIAF

SEQ ID NO: 410712 - protein, 9 aa, Homo Sapiens
KQVIEQLGG

SEQ ID NO: 410713 - protein, 9 aa, Homo Sapiens
MQTEFHHVC

SEQ ID NO: 410714 - protein, 9 aa, Homo Sapiens
ACLEQVIAG

SEQ ID NO: 410715 - protein, 9 aa, Homo Sapiens
GPARTGLLP

SEQ ID NO: 410716 - protein, 9 aa, Homo Sapiens
PQPGGAGFQ

SEQ ID NO: 410717 - protein, 9 aa, Homo Sapiens
TGSCTDSQS

SEQ ID NO: 410718 - protein, 9 aa, Homo Sapiens
VVHDGEAEE

SEQ ID NO: 410719 - protein, 9 aa, Homo Sapiens
NQTHLYTCG

SEQ ID NO: 410720 - protein, 9 aa, Homo Sapiens
FPLFYVFTL

SEQ ID NO: 410721 - protein, 9 aa, Homo Sapiens
DGDDQPSET

SEQ ID NO: 410722 - protein, 9 aa, Homo Sapiens
QTCQCRAPW

SEQ ID NO: 410723 - protein, 9 aa, Homo Sapiens
AAGGPAYGA

SEQ ID NO: 410724 - protein, 9 aa, Homo Sapiens
ASGAGAAAA

SEQ ID NO: 410725 - protein, 9 aa, Homo Sapiens
LRHRFSCIS

SEQ ID NO: 410726 - protein, 9 aa, Homo Sapiens
YPLPLSQHP

SEQ ID NO: 410727 - protein, 9 aa, Homo Sapiens
KNSFFIMIP

SEQ ID NO: 410728 - protein, 9 aa, Homo Sapiens
EEWEHLEPT

SEQ ID NO: 410729 - protein, 9 aa, Homo Sapiens
VYWAAHQPW

SEQ ID NO: 410730 - protein, 9 aa, Homo Sapiens
HSSQKIIFS

SEQ ID NO: 410731 - protein, 9 aa, Homo Sapiens
VGPIGAVRP

SEQ ID NO: 410732 - protein, 9 aa, Homo Sapiens
ALRVSPVRN

SEQ ID NO: 410733 - protein, 9 aa, Homo Sapiens
LVATSPPAT

SEQ ID NO: 410734 - protein, 9 aa, Homo Sapiens
SHPSFLQPS

SEQ ID NO: 410735 - protein, 9 aa, Homo Sapiens
GRFALLSLV

SEQ ID NO: 410736 - protein, 9 aa, Homo Sapiens
INPTISCPF

SEQ ID NO: 410737 - protein, 9 aa, Homo Sapiens
SPFNMEGYS

SEQ ID NO: 410738 - protein, 9 aa, Homo Sapiens
HGSLGQVTA

SEQ ID NO: 410739 - protein, 9 aa, Homo Sapiens
CGCSAPWQK

SEQ ID NO: 410740 - protein, 9 aa, Homo Sapiens
FCHSALHPL

SEQ ID NO: 410741 - protein, 9 aa, Homo Sapiens
HPQDPNPQV

SEQ ID NO: 410742 - protein, 9 aa, Homo Sapiens
PPPKPPLPT

SEQ ID NO: 410743 - protein, 9 aa, Homo Sapiens
DRRRAPQHE

SEQ ID NO: 410744 - protein, 9 aa, Homo Sapiens
FTFLFLLVC

SEQ ID NO: 410745 - protein, 9 aa, Homo Sapiens
PTEESPPVR

SEQ ID NO: 410746 - protein, 9 aa, Homo Sapiens
KDVLTVIMR

SEQ ID NO: 410747 - protein, 9 aa, Homo Sapiens
ANPAAVQQG

SEQ ID NO: 410748 - protein, 9 aa, Homo Sapiens
DFKGIQLEP

SEQ ID NO: 410749 - protein, 9 aa, Homo Sapiens
GSSHACVQK

SEQ ID NO: 410750 - protein, 9 aa, Homo Sapiens
LSHRLRLRL

SEQ ID NO: 410751 - protein, 9 aa, Homo Sapiens
RFSCISRKC

SEQ ID NO: 410752 - protein, 9 aa, Homo Sapiens
HYLKDVKQH

SEQ ID NO: 410753 - protein, 9 aa, Homo Sapiens
ISESTKSYL

SEQ ID NO: 410754 - protein, 9 aa, Homo Sapiens
VHAGCQPHR

SEQ ID NO: 410755 - protein, 9 aa, Homo Sapiens
VLDSGFWEI

SEQ ID NO: 410756 - protein, 9 aa, Homo Sapiens
GALCAALNK

SEQ ID NO: 410757 - protein, 9 aa, Homo Sapiens
FVVTDMSPG

SEQ ID NO: 410758 - protein, 9 aa, Homo Sapiens
SSTEGAVPK

SEQ ID NO: 410759 - protein, 9 aa, Homo Sapiens
QMRARCHLW

SEQ ID NO: 410760 - protein, 9 aa, Homo Sapiens
RGLRVMLEG

SEQ ID NO: 410761 - protein, 9 aa, Homo Sapiens
LNGISQADL

SEQ ID NO: 410762 - protein, 9 aa, Homo Sapiens
KQVAVHYTF

SEQ ID NO: 410763 - protein, 9 aa, Homo Sapiens
PGGASGRSC

SEQ ID NO: 410764 - protein, 9 aa, Homo Sapiens
SVEKIIPRS

SEQ ID NO: 410765 - protein, 9 aa, Homo Sapiens
TPENYSNAG

SEQ ID NO: 410766 - protein, 9 aa, Homo Sapiens
KKAELAKKQ

SEQ ID NO: 410767 - protein, 9 aa, Homo Sapiens
DEDPLSQDL

SEQ ID NO: 410768 - protein, 9 aa, Homo Sapiens
VKSASLQPK

SEQ ID NO: 410769 - protein, 9 aa, Homo Sapiens
QSFSKAFGQ

SEQ ID NO: 410770 - protein, 9 aa, Homo Sapiens
TESSQPRGS

SEQ ID NO: 410771 - protein, 9 aa, Homo Sapiens
AVSWGTPNR

SEQ ID NO: 410772 - protein, 9 aa, Homo Sapiens
PGPHAVSGC

SEQ ID NO: 410773 - protein, 9 aa, Homo Sapiens
GEHLPQPPQ

SEQ ID NO: 410774 - protein, 9 aa, Homo Sapiens
SPCSVWGGE

SEQ ID NO: 410775 - protein, 9 aa, Homo Sapiens
TTSFSSLEP

SEQ ID NO: 410776 - protein, 9 aa, Homo Sapiens
GLEQRLQDQ

SEQ ID NO: 410777 - protein, 9 aa, Homo Sapiens
DSPAQLVIL

SEQ ID NO: 410778 - protein, 9 aa, Homo Sapiens
SVCRWRGPG

SEQ ID NO: 410779 - protein, 9 aa, Homo Sapiens
PGHSHFYNN

SEQ ID NO: 410780 - protein, 9 aa, Homo Sapiens
HCARVCRRW

SEQ ID NO: 410781 - protein, 9 aa, Homo Sapiens
CFIYRQDLY

SEQ ID NO: 410782 - protein, 9 aa, Homo Sapiens
TTMVVTSSI

SEQ ID NO: 410783 - protein, 9 aa, Homo Sapiens
NEIVQQMME

SEQ ID NO: 410784 - protein, 9 aa, Homo Sapiens
LLGHLRGGG

SEQ ID NO: 410785 - protein, 9 aa, Homo Sapiens
PSCPHPRNA

SEQ ID NO: 410786 - protein, 9 aa, Homo Sapiens
TSPRRNSQQ

SEQ ID NO: 410787 - protein, 9 aa, Homo Sapiens
MWQGMGSLN

SEQ ID NO: 410788 - protein, 9 aa, Homo Sapiens
SAVTVAVGC

SEQ ID NO: 410789 - protein, 9 aa, Homo Sapiens
RFRTEATAA

SEQ ID NO: 410790 - protein, 9 aa, Homo Sapiens
LGAASSPAW

SEQ ID NO: 410791 - protein, 9 aa, Homo Sapiens
QKCKELQEN

SEQ ID NO: 410792 - protein, 9 aa, Homo Sapiens
LSTKGMLQK

SEQ ID NO: 410793 - protein, 9 aa, Homo Sapiens
TRRSSNKPL

SEQ ID NO: 410794 - protein, 9 aa, Homo Sapiens
PAWTLTSLK

SEQ ID NO: 410795 - protein, 9 aa, Homo Sapiens
ALLSLVESF

SEQ ID NO: 410796 - protein, 9 aa, Homo Sapiens
FEEGQALIS

SEQ ID NO: 410797 - protein, 9 aa, Homo Sapiens
ARCARLSPS

SEQ ID NO: 410798 - protein, 9 aa, Homo Sapiens
SGPSTQLVR

SEQ ID NO: 410799 - protein, 9 aa, Homo Sapiens
EISPKEIHG

SEQ ID NO: 410800 - protein, 9 aa, Homo Sapiens
TDFHSMKVK

SEQ ID NO: 410801 - protein, 9 aa, Homo Sapiens
VVMSDLSIP

SEQ ID NO: 410802 - protein, 9 aa, Homo Sapiens
KINSSVKFT

SEQ ID NO: 410803 - protein, 9 aa, Homo Sapiens
HVEVVTLLL

SEQ ID NO: 410804 - protein, 9 aa, Homo Sapiens
PPAGRGAPR

SEQ ID NO: 410805 - protein, 9 aa, Homo Sapiens
QHLARHQLR

SEQ ID NO: 410806 - protein, 9 aa, Homo Sapiens
QEIRLAQER

SEQ ID NO: 410807 - protein, 9 aa, Homo Sapiens
AGHRVPGRR

SEQ ID NO: 410808 - protein, 9 aa, Homo Sapiens
AKITHVEGE

SEQ ID NO: 410809 - protein, 9 aa, Homo Sapiens
EDPVGQARH

SEQ ID NO: 410810 - protein, 9 aa, Homo Sapiens
VMDKRRNLQ

SEQ ID NO: 410811 - protein, 9 aa, Homo Sapiens
PPAASVGTS

SEQ ID NO: 410812 - protein, 9 aa, Homo Sapiens
VHRIRMMLC

SEQ ID NO: 410813 - protein, 9 aa, Homo Sapiens
YGLPQRPVR

SEQ ID NO: 410814 - protein, 9 aa, Homo Sapiens
ALKRQQQEV

SEQ ID NO: 410815 - protein, 9 aa, Homo Sapiens
PQCPSCMPS

SEQ ID NO: 410816 - protein, 9 aa, Homo Sapiens
VSKKDLHDV

SEQ ID NO: 410817 - protein, 9 aa, Homo Sapiens
LFHSLKQVH

SEQ ID NO: 410818 - protein, 9 aa, Homo Sapiens
ILRPRTLQK

SEQ ID NO: 410819 - protein, 9 aa, Homo Sapiens
PAYGAAEEG

SEQ ID NO: 410820 - protein, 9 aa, Homo Sapiens
AWSQVIDFT

SEQ ID NO: 410821 - protein, 9 aa, Homo Sapiens
GTGKTVVGV

SEQ ID NO: 410822 - protein, 9 aa, Homo Sapiens
PDDHGGWGI

SEQ ID NO: 410823 - protein, 9 aa, Homo Sapiens
GPELLSPPK

SEQ ID NO: 410824 - protein, 9 aa, Homo Sapiens
LIHGQAPST

SEQ ID NO: 410825 - protein, 9 aa, Homo Sapiens
CQVLPTDTW

SEQ ID NO: 410826 - protein, 9 aa, Homo Sapiens
MKLKKITIK

SEQ ID NO: 410827 - protein, 9 aa, Homo Sapiens
VNSSDIPGP

SEQ ID NO: 410828 - protein, 9 aa, Homo Sapiens
LPSLTNPLL

SEQ ID NO: 410829 - protein, 9 aa, Homo Sapiens
TISFWSKCV

SEQ ID NO: 410830 - protein, 9 aa, Homo Sapiens
EECGKCFIY

SEQ ID NO: 410831 - protein, 9 aa, Homo Sapiens
RPPWRTSRG

SEQ ID NO: 410832 - protein, 9 aa, Homo Sapiens
QFLRKKAQI

SEQ ID NO: 410833 - protein, 9 aa, Homo Sapiens
VVTDMSPGG

SEQ ID NO: 410834 - protein, 9 aa, Homo Sapiens
TSLGVMVDG

SEQ ID NO: 410835 - protein, 9 aa, Homo Sapiens
GHLRGGGLL

SEQ ID NO: 410836 - protein, 9 aa, Homo Sapiens
ENYSNAGLT

SEQ ID NO: 410837 - protein, 9 aa, Homo Sapiens
YLSQRCHRA

SEQ ID NO: 410838 - protein, 9 aa, Homo Sapiens
DEKDEEIVS

SEQ ID NO: 410839 - protein, 9 aa, Homo Sapiens
TRDTPRSER

SEQ ID NO: 410840 - protein, 9 aa, Homo Sapiens
YKSQGEAPG

SEQ ID NO: 410841 - protein, 9 aa, Homo Sapiens
SFNSSTLKD

SEQ ID NO: 410842 - protein, 9 aa, Homo Sapiens
TGSGSVVWK

SEQ ID NO: 410843 - protein, 9 aa, Homo Sapiens
SRHEFIHTG

SEQ ID NO: 410844 - protein, 9 aa, Homo Sapiens
EGYDLKDEE

SEQ ID NO: 410845 - protein, 9 aa, Homo Sapiens
LMHRLSDEV

SEQ ID NO: 410846 - protein, 9 aa, Homo Sapiens
VPRCLGPHG

SEQ ID NO: 410847 - protein, 9 aa, Homo Sapiens
TPRHQYYNQ

SEQ ID NO: 410848 - protein, 9 aa, Homo Sapiens
KCVELGIKA

SEQ ID NO: 410849 - protein, 9 aa, Homo Sapiens
KFPEIVTPL

SEQ ID NO: 410850 - protein, 9 aa, Homo Sapiens
ANGDTLHVF

SEQ ID NO: 410851 - protein, 9 aa, Homo Sapiens
GSKPKPLVV

SEQ ID NO: 410852 - protein, 9 aa, Homo Sapiens
WEGNGFVAA

SEQ ID NO: 410853 - protein, 9 aa, Homo Sapiens
STAAPPPLS

SEQ ID NO: 410854 - protein, 9 aa, Homo Sapiens
SLSGHWDMD

SEQ ID NO: 410855 - protein, 9 aa, Homo Sapiens
CFGNFIWLP

SEQ ID NO: 410856 - protein, 9 aa, Homo Sapiens
LIQSNTSTL

SEQ ID NO: 410857 - protein, 9 aa, Homo Sapiens
FEKQVAVHY

SEQ ID NO: 410858 - protein, 9 aa, Homo Sapiens
VYVNYTRTE

SEQ ID NO: 410859 - protein, 9 aa, Homo Sapiens
TFLFLLVCF

SEQ ID NO: 410860 - protein, 9 aa, Homo Sapiens
SPRPPPPLK

SEQ ID NO: 410861 - protein, 9 aa, Homo Sapiens
CHLAKLGSL

SEQ ID NO: 410862 - protein, 9 aa, Homo Sapiens
SESPPAPSM

SEQ ID NO: 410863 - protein, 9 aa, Homo Sapiens
PRSLFTLRV

SEQ ID NO: 410864 - protein, 9 aa, Homo Sapiens
RQALKDAQS

SEQ ID NO: 410865 - protein, 9 aa, Homo Sapiens
NLRPPAPEA

SEQ ID NO: 410866 - protein, 9 aa, Homo Sapiens
CAPTHMGEG

SEQ ID NO: 410867 - protein, 9 aa, Homo Sapiens
SGDLATGDK

SEQ ID NO: 410868 - protein, 9 aa, Homo Sapiens
ENQAMIKIK

SEQ ID NO: 410869 - protein, 9 aa, Homo Sapiens
WSAGLHNQY

SEQ ID NO: 410870 - protein, 9 aa, Homo Sapiens
VWGSPYSPL

SEQ ID NO: 410871 - protein, 9 aa, Homo Sapiens
RPQQALQDD

SEQ ID NO: 410872 - protein, 9 aa, Homo Sapiens
WEEGQKLAP

SEQ ID NO: 410873 - protein, 9 aa, Homo Sapiens
WNNIKRWPL

SEQ ID NO: 410874 - protein, 9 aa, Homo Sapiens
SYPPPPEQP

SEQ ID NO: 410875 - protein, 9 aa, Homo Sapiens
WAATVPGHK

SEQ ID NO: 410876 - protein, 9 aa, Homo Sapiens
RSGKQLNLL

SEQ ID NO: 410877 - protein, 9 aa, Homo Sapiens
VRSLWVIVK

SEQ ID NO: 410878 - protein, 9 aa, Homo Sapiens
MGQRRMRIT

SEQ ID NO: 410879 - protein, 9 aa, Homo Sapiens
DGDELMLAD

SEQ ID NO: 410880 - protein, 9 aa, Homo Sapiens
PKCEYCTNR

SEQ ID NO: 410881 - protein, 9 aa, Homo Sapiens
AAILILLGA

SEQ ID NO: 410882 - protein, 9 aa, Homo Sapiens
ISMESLCVP

SEQ ID NO: 410883 - protein, 9 aa, Homo Sapiens
AEGLRPTPP

SEQ ID NO: 410884 - protein, 9 aa, Homo Sapiens
KHALMVVLA

SEQ ID NO: 410885 - protein, 9 aa, Homo Sapiens
YMDSQDHKS

SEQ ID NO: 410886 - protein, 9 aa, Homo Sapiens
KRAVFTKLR

SEQ ID NO: 410887 - protein, 9 aa, Homo Sapiens
LLKLIMMMN

SEQ ID NO: 410888 - protein, 9 aa, Homo Sapiens
YCSQTHSQL

SEQ ID NO: 410889 - protein, 9 aa, Homo Sapiens
LPIFMPFVN

SEQ ID NO: 410890 - protein, 9 aa, Homo Sapiens
KKEEARQVE

SEQ ID NO: 410891 - protein, 9 aa, Homo Sapiens
LVASQYSTG

SEQ ID NO: 410892 - protein, 9 aa, Homo Sapiens
GMTRNGDLS

SEQ ID NO: 410893 - protein, 9 aa, Homo Sapiens
YHEQSRTDW

SEQ ID NO: 410894 - protein, 9 aa, Homo Sapiens
PGQLRGRAR

SEQ ID NO: 410895 - protein, 9 aa, Homo Sapiens
RKHALEWFE

SEQ ID NO: 410896 - protein, 9 aa, Homo Sapiens
MVRIKELAL

SEQ ID NO: 410897 - protein, 9 aa, Homo Sapiens
NKVHAIPLH

SEQ ID NO: 410898 - protein, 9 aa, Homo Sapiens
TAFLMPLEF

SEQ ID NO: 410899 - protein, 9 aa, Homo Sapiens
YLYLSIVRT

SEQ ID NO: 410900 - protein, 9 aa, Homo Sapiens
RFLHIQRSG

SEQ ID NO: 410901 - protein, 9 aa, Homo Sapiens
IRSASCEPG

SEQ ID NO: 410902 - protein, 9 aa, Homo Sapiens
CGVGHLAVQ

SEQ ID NO: 410903 - protein, 9 aa, Homo Sapiens
QKKIYIGGV

SEQ ID NO: 410904 - protein, 9 aa, Homo Sapiens
VWPCWGPHP

SEQ ID NO: 410905 - protein, 9 aa, Homo Sapiens
RARGNAGRI

SEQ ID NO: 410906 - protein, 9 aa, Homo Sapiens
YSTAPTPSL

SEQ ID NO: 410907 - protein, 9 aa, Homo Sapiens
SSSPWKALG

SEQ ID NO: 410908 - protein, 9 aa, Homo Sapiens
AEVSVAQGT

SEQ ID NO: 410909 - protein, 9 aa, Homo Sapiens
GKLKNQIRS

SEQ ID NO: 410910 - protein, 9 aa, Homo Sapiens
YEVHTASQD

SEQ ID NO: 410911 - protein, 9 aa, Homo Sapiens
AAFGFVQSS

SEQ ID NO: 410912 - protein, 9 aa, Homo Sapiens
PVNATGHQL

SEQ ID NO: 410913 - protein, 9 aa, Homo Sapiens
DEFPHVLSP

SEQ ID NO: 410914 - protein, 9 aa, Homo Sapiens
NRVLMIMIA

SEQ ID NO: 410915 - protein, 9 aa, Homo Sapiens
VVHAGCQPH

SEQ ID NO: 410916 - protein, 9 aa, Homo Sapiens
QVLQTQCRQ

SEQ ID NO: 410917 - protein, 9 aa, Homo Sapiens
IDLLEYQGE

SEQ ID NO: 410918 - protein, 9 aa, Homo Sapiens
AWEIRDHLL

SEQ ID NO: 410919 - protein, 9 aa, Homo Sapiens
ALSSCGCSA

SEQ ID NO: 410920 - protein, 9 aa, Homo Sapiens
LQDDGSQDP

SEQ ID NO: 410921 - protein, 9 aa, Homo Sapiens
GKDFSQHAH

SEQ ID NO: 410922 - protein, 9 aa, Homo Sapiens
AVASCFGAS

SEQ ID NO: 410923 - protein, 9 aa, Homo Sapiens
LEPTQKNLY

SEQ ID NO: 410924 - protein, 9 aa, Homo Sapiens
LLPSPSCPH

SEQ ID NO: 410925 - protein, 9 aa, Homo Sapiens
LPQRPVRLA

SEQ ID NO: 410926 - protein, 9 aa, Homo Sapiens
LSNAHPDNW

SEQ ID NO: 410927 - protein, 9 aa, Homo Sapiens
SQNKGQKQS

SEQ ID NO: 410928 - protein, 9 aa, Homo Sapiens
LRPPAPEAW

SEQ ID NO: 410929 - protein, 9 aa, Homo Sapiens
VFSNNGHLS

SEQ ID NO: 410930 - protein, 9 aa, Homo Sapiens
PSRAHCPAN

SEQ ID NO: 410931 - protein, 9 aa, Homo Sapiens
TTGQYLALI

SEQ ID NO: 410932 - protein, 9 aa, Homo Sapiens
QMWMDMFPK

SEQ ID NO: 410933 - protein, 9 aa, Homo Sapiens
RFFKFCIPR

SEQ ID NO: 410934 - protein, 9 aa, Homo Sapiens
NDHKLPPEY

SEQ ID NO: 410935 - protein, 9 aa, Homo Sapiens
EHKCSVVDS

SEQ ID NO: 410936 - protein, 9 aa, Homo Sapiens
RAVSVTLFL

SEQ ID NO: 410937 - protein, 9 aa, Homo Sapiens
AKKNKENQK

SEQ ID NO: 410938 - protein, 9 aa, Homo Sapiens
IYAEDGDHG

SEQ ID NO: 410939 - protein, 9 aa, Homo Sapiens
LLDDAKAPL

SEQ ID NO: 410940 - protein, 9 aa, Homo Sapiens
SSSCSARWC

SEQ ID NO: 410941 - protein, 9 aa, Homo Sapiens
VTLKSPSCL

SEQ ID NO: 410942 - protein, 9 aa, Homo Sapiens
SGINAIYYY

SEQ ID NO: 410943 - protein, 9 aa, Homo Sapiens
QIAHFFRIS

SEQ ID NO: 410944 - protein, 9 aa, Homo Sapiens
VIRLRGMDL

SEQ ID NO: 410945 - protein, 9 aa, Homo Sapiens
LIAILQLLA

SEQ ID NO: 410946 - protein, 9 aa, Homo Sapiens
DMSYTRAVD

SEQ ID NO: 410947 - protein, 9 aa, Homo Sapiens
TTAIGGGVA

SEQ ID NO: 410948 - protein, 9 aa, Homo Sapiens
RLSDEVGFI

SEQ ID NO: 410949 - protein, 9 aa, Homo Sapiens
VAAMPVRAA

SEQ ID NO: 410950 - protein, 9 aa, Homo Sapiens
VRARTARSA

SEQ ID NO: 410951 - protein, 9 aa, Homo Sapiens
WEQWQIHLC

SEQ ID NO: 410952 - protein, 9 aa, Homo Sapiens
HVRSRESES

SEQ ID NO: 410953 - protein, 9 aa, Homo Sapiens
PAARTRYIP

SEQ ID NO: 410954 - protein, 9 aa, Homo Sapiens
LPQVTRSWY

SEQ ID NO: 410955 - protein, 9 aa, Homo Sapiens
NSFRKSKSK

SEQ ID NO: 410956 - protein, 9 aa, Homo Sapiens
EMMKLMNQN

SEQ ID NO: 410957 - protein, 9 aa, Homo Sapiens
PCPPPVTPL

SEQ ID NO: 410958 - protein, 9 aa, Homo Sapiens
GDPTTLEYT

SEQ ID NO: 410959 - protein, 9 aa, Homo Sapiens
APWQKSPGN

SEQ ID NO: 410960 - protein, 9 aa, Homo Sapiens
IQMYLTTMD

SEQ ID NO: 410961 - protein, 9 aa, Homo Sapiens
PPLSLQQHL

SEQ ID NO: 410962 - protein, 9 aa, Homo Sapiens
RRLSQGQRW

SEQ ID NO: 410963 - protein, 9 aa, Homo Sapiens
TSPPHPALS

SEQ ID NO: 410964 - protein, 9 aa, Homo Sapiens
HHRSPTTAP

SEQ ID NO: 410965 - protein, 9 aa, Homo Sapiens
DPRRSPFPR

SEQ ID NO: 410966 - protein, 9 aa, Homo Sapiens
QWNMMASIQ

SEQ ID NO: 410967 - protein, 9 aa, Homo Sapiens
HAGARLQER

SEQ ID NO: 410968 - protein, 9 aa, Homo Sapiens
AVKSLQALD

SEQ ID NO: 410969 - protein, 9 aa, Homo Sapiens
LTPGGSSSG

SEQ ID NO: 410970 - protein, 9 aa, Homo Sapiens
QTADYPNIQ

SEQ ID NO: 410971 - protein, 9 aa, Homo Sapiens
LSEPEKTLH

SEQ ID NO: 410972 - protein, 9 aa, Homo Sapiens
AVDTSVAWQ

SEQ ID NO: 410973 - protein, 9 aa, Homo Sapiens
GMGQRRMRI

SEQ ID NO: 410974 - protein, 9 aa, Homo Sapiens
LLQRNMETR

SEQ ID NO: 410975 - protein, 9 aa, Homo Sapiens
QIFGPDFCH

SEQ ID NO: 410976 - protein, 9 aa, Homo Sapiens
QGARDSRRW

SEQ ID NO: 410977 - protein, 9 aa, Homo Sapiens
LTSSLPGGT

SEQ ID NO: 410978 - protein, 9 aa, Homo Sapiens
THPGMWSSP

SEQ ID NO: 410979 - protein, 9 aa, Homo Sapiens
PLPGQHLWL

SEQ ID NO: 410980 - protein, 9 aa, Homo Sapiens
KTQEFRERQ

SEQ ID NO: 410981 - protein, 9 aa, Homo Sapiens
QLCHNRIRQ

SEQ ID NO: 410982 - protein, 9 aa, Homo Sapiens
GQLVLLRRQ

SEQ ID NO: 410983 - protein, 9 aa, Homo Sapiens
APLTVLLQE

SEQ ID NO: 410984 - protein, 9 aa, Homo Sapiens
ESELLMVPD

SEQ ID NO: 410985 - protein, 9 aa, Homo Sapiens
PSPPWLRPR

SEQ ID NO: 410986 - protein, 9 aa, Homo Sapiens
RVPSTPWAI

SEQ ID NO: 410987 - protein, 9 aa, Homo Sapiens
LLVNMGGNR

SEQ ID NO: 410988 - protein, 9 aa, Homo Sapiens
ALQNPAPVA

SEQ ID NO: 410989 - protein, 9 aa, Homo Sapiens
REQWELGPR

SEQ ID NO: 410990 - protein, 9 aa, Homo Sapiens
ASTGAWTAE

SEQ ID NO: 410991 - protein, 9 aa, Homo Sapiens
KIKKKIEMK

SEQ ID NO: 410992 - protein, 9 aa, Homo Sapiens
RTLEGCISV

SEQ ID NO: 410993 - protein, 9 aa, Homo Sapiens
YENLSGLQQ

SEQ ID NO: 410994 - protein, 9 aa, Homo Sapiens
HKNTQENFS

SEQ ID NO: 410995 - protein, 9 aa, Homo Sapiens
HLEKNSYSA

SEQ ID NO: 410996 - protein, 9 aa, Homo Sapiens
QLVIERERG

SEQ ID NO: 410997 - protein, 9 aa, Homo Sapiens
SLFFLSSSP

SEQ ID NO: 410998 - protein, 9 aa, Homo Sapiens
TKNLYLLAF

SEQ ID NO: 410999 - protein, 9 aa, Homo Sapiens
GLRRGRSCV

SEQ ID NO: 411000 - protein, 9 aa, Homo Sapiens
LGIFKMAVT

SEQ ID NO: 411001 - protein, 9 aa, Homo Sapiens
PPLPATTST

SEQ ID NO: 411002 - protein, 9 aa, Homo Sapiens
HMDVFVSTP

SEQ ID NO: 411003 - protein, 9 aa, Homo Sapiens
VLRVWVRTT

SEQ ID NO: 411004 - protein, 9 aa, Homo Sapiens
HLGTGGGFG

SEQ ID NO: 411005 - protein, 9 aa, Homo Sapiens
DHLEILPSG

SEQ ID NO: 411006 - protein, 9 aa, Homo Sapiens
SCSTMSCLS

SEQ ID NO: 411007 - protein, 9 aa, Homo Sapiens
VTDAQCSGP

SEQ ID NO: 411008 - protein, 9 aa, Homo Sapiens
DDNAPEILY

SEQ ID NO: 411009 - protein, 9 aa, Homo Sapiens
LVLTGVSLD

SEQ ID NO: 411010 - protein, 9 aa, Homo Sapiens
PHPALSSCG

SEQ ID NO: 411011 - protein, 9 aa, Homo Sapiens
TNIMGFIMN

SEQ ID NO: 411012 - protein, 9 aa, Homo Sapiens
ELWLAVGPQ

SEQ ID NO: 411013 - protein, 9 aa, Homo Sapiens
TEARGRPFC

SEQ ID NO: 411014 - protein, 9 aa, Homo Sapiens
AATPKSLGN

SEQ ID NO: 411015 - protein, 9 aa, Homo Sapiens
QVAVHYTFS

SEQ ID NO: 411016 - protein, 9 aa, Homo Sapiens
VKLDNSQDL

SEQ ID NO: 411017 - protein, 9 aa, Homo Sapiens
ARIPDATRS

SEQ ID NO: 411018 - protein, 9 aa, Homo Sapiens
QQAHEYQEQ

SEQ ID NO: 411019 - protein, 9 aa, Homo Sapiens
QLNDRRAFI

SEQ ID NO: 411020 - protein, 9 aa, Homo Sapiens
FFAASSHYG

SEQ ID NO: 411021 - protein, 9 aa, Homo Sapiens
QSCQRPPLE

SEQ ID NO: 411022 - protein, 9 aa, Homo Sapiens
TKSYPPPPE

SEQ ID NO: 411023 - protein, 9 aa, Homo Sapiens
STPATSLHP

SEQ ID NO: 411024 - protein, 9 aa, Homo Sapiens
KEQLRCPQL

SEQ ID NO: 411025 - protein, 9 aa, Homo Sapiens
RPPQALFCL

SEQ ID NO: 411026 - protein, 9 aa, Homo Sapiens
IFTDDISDI

SEQ ID NO: 411027 - protein, 9 aa, Homo Sapiens
PVRVIHSFK

SEQ ID NO: 411028 - protein, 9 aa, Homo Sapiens
VQKNTKYVC

SEQ ID NO: 411029 - protein, 9 aa, Homo Sapiens
ATYERMFHW

SEQ ID NO: 411030 - protein, 9 aa, Homo Sapiens
SVVCIIGLC

SEQ ID NO: 411031 - protein, 9 aa, Homo Sapiens
AKKSQKGAS

SEQ ID NO: 411032 - protein, 9 aa, Homo Sapiens
VHLLMEWGA

SEQ ID NO: 411033 - protein, 9 aa, Homo Sapiens
ILADSCHLW

SEQ ID NO: 411034 - protein, 9 aa, Homo Sapiens
RPQSTCARR

SEQ ID NO: 411035 - protein, 9 aa, Homo Sapiens
RKRFAFFPS

SEQ ID NO: 411036 - protein, 9 aa, Homo Sapiens
DPSPDLHTG

SEQ ID NO: 411037 - protein, 9 aa, Homo Sapiens
VMGTNGQVQ

SEQ ID NO: 411038 - protein, 9 aa, Homo Sapiens
VGGGEDSGG

SEQ ID NO: 411039 - protein, 9 aa, Homo Sapiens
TDLAFMMRV

SEQ ID NO: 411040 - protein, 9 aa, Homo Sapiens
SPRAVMGAL

SEQ ID NO: 411041 - protein, 9 aa, Homo Sapiens
VQIVADLKH

SEQ ID NO: 411042 - protein, 9 aa, Homo Sapiens
LSATKLCQF

SEQ ID NO: 411043 - protein, 9 aa, Homo Sapiens
PPMREVAEA

SEQ ID NO: 411044 - protein, 9 aa, Homo Sapiens
HHQHIVSTG

SEQ ID NO: 411045 - protein, 9 aa, Homo Sapiens
PVACLAACA

SEQ ID NO: 411046 - protein, 9 aa, Homo Sapiens
ERIQDEDQC

SEQ ID NO: 411047 - protein, 9 aa, Homo Sapiens
EGRTALSVR

SEQ ID NO: 411048 - protein, 9 aa, Homo Sapiens
PFLHCVALP

SEQ ID NO: 411049 - protein, 9 aa, Homo Sapiens
GGPAYGAAE

SEQ ID NO: 411050 - protein, 9 aa, Homo Sapiens
RLKPPRRQA

SEQ ID NO: 411051 - protein, 9 aa, Homo Sapiens
LVCVNVWML

SEQ ID NO: 411052 - protein, 9 aa, Homo Sapiens
ATCPAVVQR

SEQ ID NO: 411053 - protein, 9 aa, Homo Sapiens
GFQMTPTKQ

SEQ ID NO: 411054 - protein, 9 aa, Homo Sapiens
CQPALLDLP

SEQ ID NO: 411055 - protein, 9 aa, Homo Sapiens
SVSTAVDTS

SEQ ID NO: 411056 - protein, 9 aa, Homo Sapiens
RFLNLERVT

SEQ ID NO: 411057 - protein, 9 aa, Homo Sapiens
ETKVRTKIR

SEQ ID NO: 411058 - protein, 9 aa, Homo Sapiens
SLLCLLGEI

SEQ ID NO: 411059 - protein, 9 aa, Homo Sapiens
AATGRFALL

SEQ ID NO: 411060 - protein, 9 aa, Homo Sapiens
SSHCLLTAH

SEQ ID NO: 411061 - protein, 9 aa, Homo Sapiens
NKINHHGRS

SEQ ID NO: 411062 - protein, 9 aa, Homo Sapiens
GCGRAPAQP

SEQ ID NO: 411063 - protein, 9 aa, Homo Sapiens
ERMMLPVRA

SEQ ID NO: 411064 - protein, 9 aa, Homo Sapiens
AAEGLRPTP

SEQ ID NO: 411065 - protein, 9 aa, Homo Sapiens
MYVCHQQLP

SEQ ID NO: 411066 - protein, 9 aa, Homo Sapiens
MHNFSDLRN

SEQ ID NO: 411067 - protein, 9 aa, Homo Sapiens
ASWFAFFCI

SEQ ID NO: 411068 - protein, 9 aa, Homo Sapiens
FPILRGSNY

SEQ ID NO: 411069 - protein, 9 aa, Homo Sapiens
VDRLAVLGQ

SEQ ID NO: 411070 - protein, 9 aa, Homo Sapiens
ISLLHVWKV

SEQ ID NO: 411071 - protein, 9 aa, Homo Sapiens
VPCLEHVVE

SEQ ID NO: 411072 - protein, 9 aa, Homo Sapiens
TMPVPEGCS

SEQ ID NO: 411073 - protein, 9 aa, Homo Sapiens
SRGVQSGPE

SEQ ID NO: 411074 - protein, 9 aa, Homo Sapiens
AAAGSTDKT

SEQ ID NO: 411075 - protein, 9 aa, Homo Sapiens
ILAINHGEN

SEQ ID NO: 411076 - protein, 9 aa, Homo Sapiens
VIGFHSVEV

SEQ ID NO: 411077 - protein, 9 aa, Homo Sapiens
APVAFLAEE

SEQ ID NO: 411078 - protein, 9 aa, Homo Sapiens
CASSQDEAE

SEQ ID NO: 411079 - protein, 9 aa, Homo Sapiens
ESPPVRLCV

SEQ ID NO: 411080 - protein, 9 aa, Homo Sapiens
MGTEPHHFM

SEQ ID NO: 411081 - protein, 9 aa, Homo Sapiens
CDIKQLDHA

SEQ ID NO: 411082 - protein, 9 aa, Homo Sapiens
SLTPATPYS

SEQ ID NO: 411083 - protein, 9 aa, Homo Sapiens
QLFALNPHS

SEQ ID NO: 411084 - protein, 9 aa, Homo Sapiens
TRDKYTYTK

SEQ ID NO: 411085 - protein, 9 aa, Homo Sapiens
LANGDTLHV

SEQ ID NO: 411086 - protein, 9 aa, Homo Sapiens
PQGWRDTVE

SEQ ID NO: 411087 - protein, 9 aa, Homo Sapiens
SSVAETYYQ

SEQ ID NO: 411088 - protein, 9 aa, Homo Sapiens
AEDAFTMDY

SEQ ID NO: 411089 - protein, 9 aa, Homo Sapiens
IWKLYKCND

SEQ ID NO: 411090 - protein, 9 aa, Homo Sapiens
RCKMKRARA

SEQ ID NO: 411091 - protein, 9 aa, Homo Sapiens
VVGRCSQMR

SEQ ID NO: 411092 - protein, 9 aa, Homo Sapiens
WNCTKENAE

SEQ ID NO: 411093 - protein, 9 aa, Homo Sapiens
DKLAFYGIL

SEQ ID NO: 411094 - protein, 9 aa, Homo Sapiens
RHQNNIFTD

SEQ ID NO: 411095 - protein, 9 aa, Homo Sapiens
YPCSVLGGG

SEQ ID NO: 411096 - protein, 9 aa, Homo Sapiens
SKLCGLKRK

SEQ ID NO: 411097 - protein, 9 aa, Homo Sapiens
GPGPDDARK

SEQ ID NO: 411098 - protein, 9 aa, Homo Sapiens
VGGPGVGLV

SEQ ID NO: 411099 - protein, 9 aa, Homo Sapiens
SLPLLRDQD

SEQ ID NO: 411100 - protein, 9 aa, Homo Sapiens
FYYNSSLTL

SEQ ID NO: 411101 - protein, 9 aa, Homo Sapiens
VPGALKAPA

SEQ ID NO: 411102 - protein, 9 aa, Homo Sapiens
FWGYCVQVL

SEQ ID NO: 411103 - protein, 9 aa, Homo Sapiens
LRKWRPGAS

SEQ ID NO: 411104 - protein, 9 aa, Homo Sapiens
AVVVVPINI

SEQ ID NO: 411105 - protein, 9 aa, Homo Sapiens
RQAQDLAQS

SEQ ID NO: 411106 - protein, 9 aa, Homo Sapiens
KQLSIRSGI

SEQ ID NO: 411107 - protein, 9 aa, Homo Sapiens
MVPPVQQWP

SEQ ID NO: 411108 - protein, 9 aa, Homo Sapiens
TDFRVGLKV

SEQ ID NO: 411109 - protein, 9 aa, Homo Sapiens
RLLRGGYIS

SEQ ID NO: 411110 - protein, 9 aa, Homo Sapiens
GGAEGLKTA

SEQ ID NO: 411111 - protein, 9 aa, Homo Sapiens
TFLSEVVGK

SEQ ID NO: 411112 - protein, 9 aa, Homo Sapiens
FAATGRFAL

SEQ ID NO: 411113 - protein, 9 aa, Homo Sapiens
EWLGGGALS

SEQ ID NO: 411114 - protein, 9 aa, Homo Sapiens
RMRITVKKL

SEQ ID NO: 411115 - protein, 9 aa, Homo Sapiens
PCWGPHPPL

SEQ ID NO: 411116 - protein, 9 aa, Homo Sapiens
LHFAVRCVG

SEQ ID NO: 411117 - protein, 9 aa, Homo Sapiens
AGALTRTTS

SEQ ID NO: 411118 - protein, 9 aa, Homo Sapiens
MSPPPEASH

SEQ ID NO: 411119 - protein, 9 aa, Homo Sapiens
EKAMRAPHT

SEQ ID NO: 411120 - protein, 9 aa, Homo Sapiens
PLSQHPLQA

SEQ ID NO: 411121 - protein, 9 aa, Homo Sapiens
FLFFCQKSI

SEQ ID NO: 411122 - protein, 9 aa, Homo Sapiens
EDTPPPACT

SEQ ID NO: 411123 - protein, 9 aa, Homo Sapiens
HTDIQNDEK

SEQ ID NO: 411124 - protein, 9 aa, Homo Sapiens
KSPGNSRSW

SEQ ID NO: 411125 - protein, 9 aa, Homo Sapiens
QQPCQSGVQ

SEQ ID NO: 411126 - protein, 9 aa, Homo Sapiens
RYHHSSLVK

SEQ ID NO: 411127 - protein, 9 aa, Homo Sapiens
VHDGEAEEV

SEQ ID NO: 411128 - protein, 9 aa, Homo Sapiens
GWRDTVEVA

SEQ ID NO: 411129 - protein, 9 aa, Homo Sapiens
FEERQPLPI

SEQ ID NO: 411130 - protein, 9 aa, Homo Sapiens
TVAVDVLPL

SEQ ID NO: 411131 - protein, 9 aa, Homo Sapiens
QHSLHLLLI

SEQ ID NO: 411132 - protein, 9 aa, Homo Sapiens
QKDRHRECV

SEQ ID NO: 411133 - protein, 9 aa, Homo Sapiens
KQGCCCTPG

SEQ ID NO: 411134 - protein, 9 aa, Homo Sapiens
ITDNYPHAI

SEQ ID NO: 411135 - protein, 9 aa, Homo Sapiens
VVHFFACPS

SEQ ID NO: 411136 - protein, 9 aa, Homo Sapiens
GDCHIFTRC

SEQ ID NO: 411137 - protein, 9 aa, Homo Sapiens
THTRVSVQQ

SEQ ID NO: 411138 - protein, 9 aa, Homo Sapiens
SRSWRPSAR

SEQ ID NO: 411139 - protein, 9 aa, Homo Sapiens
VDAKKDPAF

SEQ ID NO: 411140 - protein, 9 aa, Homo Sapiens
AHQQQVTTY

SEQ ID NO: 411141 - protein, 9 aa, Homo Sapiens
TSFSINTAW

SEQ ID NO: 411142 - protein, 9 aa, Homo Sapiens
IEAKSKRVN

SEQ ID NO: 411143 - protein, 9 aa, Homo Sapiens
WEEYRVLQD

SEQ ID NO: 411144 - protein, 9 aa, Homo Sapiens
LAWERTPLV

SEQ ID NO: 411145 - protein, 9 aa, Homo Sapiens
EFKMLSVHN

SEQ ID NO: 411146 - protein, 9 aa, Homo Sapiens
RRSPALRAR

SEQ ID NO: 411147 - protein, 9 aa, Homo Sapiens
VDSAVTVAV

SEQ ID NO: 411148 - protein, 9 aa, Homo Sapiens
KNTQENFSL

SEQ ID NO: 411149 - protein, 9 aa, Homo Sapiens
LTTMDLFHP

SEQ ID NO: 411150 - protein, 9 aa, Homo Sapiens
SENGQTWTR

SEQ ID NO: 411151 - protein, 9 aa, Homo Sapiens
FFLIGLPLL

SEQ ID NO: 411152 - protein, 9 aa, Homo Sapiens
ASHVRHVRS

SEQ ID NO: 411153 - protein, 9 aa, Homo Sapiens
VKNLIVPRI

SEQ ID NO: 411154 - protein, 9 aa, Homo Sapiens
QTEFHHVCT

SEQ ID NO: 411155 - protein, 9 aa, Homo Sapiens
ILTHVHLNV

SEQ ID NO: 411156 - protein, 9 aa, Homo Sapiens
IAYHLASSS

SEQ ID NO: 411157 - protein, 9 aa, Homo Sapiens
WGWRSPKCI

SEQ ID NO: 411158 - protein, 9 aa, Homo Sapiens
GHDEDNTHI

SEQ ID NO: 411159 - protein, 9 aa, Homo Sapiens
CRTFMPPPG

SEQ ID NO: 411160 - protein, 9 aa, Homo Sapiens
AQKIDLLEY

SEQ ID NO: 411161 - protein, 9 aa, Homo Sapiens
DHMPKIRTL

SEQ ID NO: 411162 - protein, 9 aa, Homo Sapiens
WNCPWKAPS

SEQ ID NO: 411163 - protein, 9 aa, Homo Sapiens
LFPLFYVFT

SEQ ID NO: 411164 - protein, 9 aa, Homo Sapiens
AKISNQIFP

SEQ ID NO: 411165 - protein, 9 aa, Homo Sapiens
PEPASGLPW

SEQ ID NO: 411166 - protein, 9 aa, Homo Sapiens
AGRLESSLR

SEQ ID NO: 411167 - protein, 9 aa, Homo Sapiens
ACARTCWTA

SEQ ID NO: 411168 - protein, 9 aa, Homo Sapiens
DQLNALHRE

SEQ ID NO: 411169 - protein, 9 aa, Homo Sapiens
SSPAWPAVL

SEQ ID NO: 411170 - protein, 9 aa, Homo Sapiens
SFWPFGPIL

SEQ ID NO: 411171 - protein, 9 aa, Homo Sapiens
RCSSGSGEP

SEQ ID NO: 411172 - protein, 9 aa, Homo Sapiens
GPMPNLQEL

SEQ ID NO: 411173 - protein, 9 aa, Homo Sapiens
IASVEGQKK

SEQ ID NO: 411174 - protein, 9 aa, Homo Sapiens
HPRAPPRTA

SEQ ID NO: 411175 - protein, 9 aa, Homo Sapiens
DMLQIRIGS

SEQ ID NO: 411176 - protein, 9 aa, Homo Sapiens
LNLNMLSLF

SEQ ID NO: 411177 - protein, 9 aa, Homo Sapiens
SMSPFNMEG

SEQ ID NO: 411178 - protein, 9 aa, Homo Sapiens
KTKFVGGVS

SEQ ID NO: 411179 - protein, 9 aa, Homo Sapiens
WVTTIGAHK

SEQ ID NO: 411180 - protein, 9 aa, Homo Sapiens
EKNLQECLS

SEQ ID NO: 411181 - protein, 9 aa, Homo Sapiens
GRRRRQWGS

SEQ ID NO: 411182 - protein, 9 aa, Homo Sapiens
GKTPAHRAQ

SEQ ID NO: 411183 - protein, 9 aa, Homo Sapiens
QASHATVCG

SEQ ID NO: 411184 - protein, 9 aa, Homo Sapiens
KLQLLLHLE

SEQ ID NO: 411185 - protein, 9 aa, Homo Sapiens
FRVDIAKLQ

SEQ ID NO: 411186 - protein, 9 aa, Homo Sapiens
EGRMATLER

SEQ ID NO: 411187 - protein, 9 aa, Homo Sapiens
RSPSRNDKH

SEQ ID NO: 411188 - protein, 9 aa, Homo Sapiens
PGKPDKSSR

SEQ ID NO: 411189 - protein, 9 aa, Homo Sapiens
PRATPSPWS

SEQ ID NO: 411190 - protein, 9 aa, Homo Sapiens
PSTCRISVA

SEQ ID NO: 411191 - protein, 9 aa, Homo Sapiens
SPSSSSTSM

SEQ ID NO: 411192 - protein, 9 aa, Homo Sapiens
RPGPARQPQ

SEQ ID NO: 411193 - protein, 9 aa, Homo Sapiens
QYFLTIPRL

SEQ ID NO: 411194 - protein, 9 aa, Homo Sapiens
VMKTYSLVD

SEQ ID NO: 411195 - protein, 9 aa, Homo Sapiens
HLLVWPPWE

SEQ ID NO: 411196 - protein, 9 aa, Homo Sapiens
AADSTAPWW

SEQ ID NO: 411197 - protein, 9 aa, Homo Sapiens
KMILKMMMK

SEQ ID NO: 411198 - protein, 9 aa, Homo Sapiens
GPSTGACTA

SEQ ID NO: 411199 - protein, 9 aa, Homo Sapiens
FYAASSLDA

SEQ ID NO: 411200 - protein, 9 aa, Homo Sapiens
TLIQSNTST

SEQ ID NO: 411201 - protein, 9 aa, Homo Sapiens
QMVTHYAVS

SEQ ID NO: 411202 - protein, 9 aa, Homo Sapiens
RVLMYGQSY

SEQ ID NO: 411203 - protein, 9 aa, Homo Sapiens
ELLGAGEHL

SEQ ID NO: 411204 - protein, 9 aa, Homo Sapiens
WASAMPRAT

SEQ ID NO: 411205 - protein, 9 aa, Homo Sapiens
LLRAARDNK

SEQ ID NO: 411206 - protein, 9 aa, Homo Sapiens
DKCRYQQEV

SEQ ID NO: 411207 - protein, 9 aa, Homo Sapiens
LALESQLRG

SEQ ID NO: 411208 - protein, 9 aa, Homo Sapiens
SFCKWQKNI

SEQ ID NO: 411209 - protein, 9 aa, Homo Sapiens
TSSSFSKWC

SEQ ID NO: 411210 - protein, 9 aa, Homo Sapiens
IFFIFGIVG

SEQ ID NO: 411211 - protein, 9 aa, Homo Sapiens
HISMESLCV

SEQ ID NO: 411212 - protein, 9 aa, Homo Sapiens
AIFQRPHPL

SEQ ID NO: 411213 - protein, 9 aa, Homo Sapiens
NRVFGKDRK

SEQ ID NO: 411214 - protein, 9 aa, Homo Sapiens
GLNGLMDLD

SEQ ID NO: 411215 - protein, 9 aa, Homo Sapiens
CHSALHPLS

SEQ ID NO: 411216 - protein, 9 aa, Homo Sapiens
GLTQALWKA

SEQ ID NO: 411217 - protein, 9 aa, Homo Sapiens
AGIKLATEY

SEQ ID NO: 411218 - protein, 9 aa, Homo Sapiens
SVPSLYLFR

SEQ ID NO: 411219 - protein, 9 aa, Homo Sapiens
RAARGAIRK

SEQ ID NO: 411220 - protein, 9 aa, Homo Sapiens
STPLASFLQ

SEQ ID NO: 411221 - protein, 9 aa, Homo Sapiens
DFQGQISFI

SEQ ID NO: 411222 - protein, 9 aa, Homo Sapiens
PQWAPHSAG

SEQ ID NO: 411223 - protein, 9 aa, Homo Sapiens
IAGLLKQFL

SEQ ID NO: 411224 - protein, 9 aa, Homo Sapiens
PSMVVSPFM

SEQ ID NO: 411225 - protein, 9 aa, Homo Sapiens
ILQQFASGL

SEQ ID NO: 411226 - protein, 9 aa, Homo Sapiens
TEGEVENGR

SEQ ID NO: 411227 - protein, 9 aa, Homo Sapiens
GRTVDSPGI

SEQ ID NO: 411228 - protein, 9 aa, Homo Sapiens
KGGIRKDQR

SEQ ID NO: 411229 - protein, 9 aa, Homo Sapiens
IHTGKKHYK

SEQ ID NO: 411230 - protein, 9 aa, Homo Sapiens
GGEDSGGHS

SEQ ID NO: 411231 - protein, 9 aa, Homo Sapiens
SRVGPRRCP

SEQ ID NO: 411232 - protein, 9 aa, Homo Sapiens
PHAVSGCGR

SEQ ID NO: 411233 - protein, 9 aa, Homo Sapiens
KRWEAESKL

SEQ ID NO: 411234 - protein, 9 aa, Homo Sapiens
LSPGEARAP

SEQ ID NO: 411235 - protein, 9 aa, Homo Sapiens
KNVHRQPVQ

SEQ ID NO: 411236 - protein, 9 aa, Homo Sapiens
EDEDEKNLQ

SEQ ID NO: 411237 - protein, 9 aa, Homo Sapiens
NSPTTATST

SEQ ID NO: 411238 - protein, 9 aa, Homo Sapiens
RLVCRLRRW

SEQ ID NO: 411239 - protein, 9 aa, Homo Sapiens
GTPYWMVPE

SEQ ID NO: 411240 - protein, 9 aa, Homo Sapiens
ELVRQTWQV

SEQ ID NO: 411241 - protein, 9 aa, Homo Sapiens
QKGEQVFHL

SEQ ID NO: 411242 - protein, 9 aa, Homo Sapiens
IIVITINYR

SEQ ID NO: 411243 - protein, 9 aa, Homo Sapiens
DGVPGVPGE

SEQ ID NO: 411244 - protein, 9 aa, Homo Sapiens
FQKQQWEKT

SEQ ID NO: 411245 - protein, 9 aa, Homo Sapiens
LAFMMRVPS

SEQ ID NO: 411246 - protein, 9 aa, Homo Sapiens
EILGYYMLR

SEQ ID NO: 411247 - protein, 9 aa, Homo Sapiens
LGVDSDAIW

SEQ ID NO: 411248 - protein, 9 aa, Homo Sapiens
GRAQASGTL

SEQ ID NO: 411249 - protein, 9 aa, Homo Sapiens
FHRSTFRNL

SEQ ID NO: 411250 - protein, 9 aa, Homo Sapiens
RPLALPCRV

SEQ ID NO: 411251 - protein, 9 aa, Homo Sapiens
TRRPSRLWS

SEQ ID NO: 411252 - protein, 9 aa, Homo Sapiens
TIMAKYTYG

SEQ ID NO: 411253 - protein, 9 aa, Homo Sapiens
PSSHSLAWE

SEQ ID NO: 411254 - protein, 9 aa, Homo Sapiens
APHTVSYLD

SEQ ID NO: 411255 - protein, 9 aa, Homo Sapiens
VSILLHSNI

SEQ ID NO: 411256 - protein, 9 aa, Homo Sapiens
PVPRQASHQ

SEQ ID NO: 411257 - protein, 9 aa, Homo Sapiens
YCRHHLGTF

SEQ ID NO: 411258 - protein, 9 aa, Homo Sapiens
QVYNTSTVE

SEQ ID NO: 411259 - protein, 9 aa, Homo Sapiens
LHMKIHTGE

SEQ ID NO: 411260 - protein, 9 aa, Homo Sapiens
QLQPLTGSA

SEQ ID NO: 411261 - protein, 9 aa, Homo Sapiens
PPTLPRCVS

SEQ ID NO: 411262 - protein, 9 aa, Homo Sapiens
VWFSGETLS

SEQ ID NO: 411263 - protein, 9 aa, Homo Sapiens
SKQMPPVML

SEQ ID NO: 411264 - protein, 9 aa, Homo Sapiens
RMFHWLVLR

SEQ ID NO: 411265 - protein, 9 aa, Homo Sapiens
VNVWMLDLT

SEQ ID NO: 411266 - protein, 9 aa, Homo Sapiens
KIGKLLYGK

SEQ ID NO: 411267 - protein, 9 aa, Homo Sapiens
QEELKNHYQ

SEQ ID NO: 411268 - protein, 9 aa, Homo Sapiens
LTSNQLQKL

SEQ ID NO: 411269 - protein, 9 aa, Homo Sapiens
RECYCLNGQ

SEQ ID NO: 411270 - protein, 9 aa, Homo Sapiens
LSVDMLDVH

SEQ ID NO: 411271 - protein, 9 aa, Homo Sapiens
HPGGSARIV

SEQ ID NO: 411272 - protein, 9 aa, Homo Sapiens
EVAAFQKER

SEQ ID NO: 411273 - protein, 9 aa, Homo Sapiens
REKVPCLCL

SEQ ID NO: 411274 - protein, 9 aa, Homo Sapiens
PPPPPTKKG

SEQ ID NO: 411275 - protein, 9 aa, Homo Sapiens
DIPYFAVVV

SEQ ID NO: 411276 - protein, 9 aa, Homo Sapiens
GLLCDSVDI

SEQ ID NO: 411277 - protein, 9 aa, Homo Sapiens
KALALDKTE

SEQ ID NO: 411278 - protein, 9 aa, Homo Sapiens
SKQTFLSEV

SEQ ID NO: 411279 - protein, 9 aa, Homo Sapiens
PSPVPHGNS

SEQ ID NO: 411280 - protein, 9 aa, Homo Sapiens
VHLNVFQDK

SEQ ID NO: 411281 - protein, 9 aa, Homo Sapiens
GYHVMVWMM

SEQ ID NO: 411282 - protein, 9 aa, Homo Sapiens
VMGALPSTA

SEQ ID NO: 411283 - protein, 9 aa, Homo Sapiens
LLQKCKELQ

SEQ ID NO: 411284 - protein, 9 aa, Homo Sapiens
PRKIPLEDG

SEQ ID NO: 411285 - protein, 9 aa, Homo Sapiens
LHPEEALQA

SEQ ID NO: 411286 - protein, 9 aa, Homo Sapiens
PGAPATPRG

SEQ ID NO: 411287 - protein, 9 aa, Homo Sapiens
VGPQQDEMT

SEQ ID NO: 411288 - protein, 9 aa, Homo Sapiens
LVVTAWDGG

SEQ ID NO: 411289 - protein, 9 aa, Homo Sapiens
VVALGLCQG

SEQ ID NO: 411290 - protein, 9 aa, Homo Sapiens
THYHCTHEN

SEQ ID NO: 411291 - protein, 9 aa, Homo Sapiens
TRYIPCTSR

SEQ ID NO: 411292 - protein, 9 aa, Homo Sapiens
TSTAAPPPL

SEQ ID NO: 411293 - protein, 9 aa, Homo Sapiens
CPWTETTTW

SEQ ID NO: 411294 - protein, 9 aa, Homo Sapiens
SATIALLEP

SEQ ID NO: 411295 - protein, 9 aa, Homo Sapiens
VKKIATMMA

SEQ ID NO: 411296 - protein, 9 aa, Homo Sapiens
SPGILTREA

SEQ ID NO: 411297 - protein, 9 aa, Homo Sapiens
IQEAEVSVA

SEQ ID NO: 411298 - protein, 9 aa, Homo Sapiens
DIAYIRKAL

SEQ ID NO: 411299 - protein, 9 aa, Homo Sapiens
PLRGFLLHQ

SEQ ID NO: 411300 - protein, 9 aa, Homo Sapiens
PEWKHQVMV

SEQ ID NO: 411301 - protein, 9 aa, Homo Sapiens
WGTMAEERM

SEQ ID NO: 411302 - protein, 9 aa, Homo Sapiens
LQPGEKKSQ

SEQ ID NO: 411303 - protein, 9 aa, Homo Sapiens
AFFRCSLFT

SEQ ID NO: 411304 - protein, 9 aa, Homo Sapiens
DLLVYVVIR

SEQ ID NO: 411305 - protein, 9 aa, Homo Sapiens
AGFLWDVAA

SEQ ID NO: 411306 - protein, 9 aa, Homo Sapiens
FHPMKLQRK

SEQ ID NO: 411307 - protein, 9 aa, Homo Sapiens
SKPTTGHAP

SEQ ID NO: 411308 - protein, 9 aa, Homo Sapiens
RTLEKNIRK

SEQ ID NO: 411309 - protein, 9 aa, Homo Sapiens
PYPLPLSQH

SEQ ID NO: 411310 - protein, 9 aa, Homo Sapiens
EHLKLEPHE

SEQ ID NO: 411311 - protein, 9 aa, Homo Sapiens
RASKKFIIL

SEQ ID NO: 411312 - protein, 9 aa, Homo Sapiens
PLPHAPMSV

SEQ ID NO: 411313 - protein, 9 aa, Homo Sapiens
EYFFLIGLP

SEQ ID NO: 411314 - protein, 9 aa, Homo Sapiens
STSSRISSS

SEQ ID NO: 411315 - protein, 9 aa, Homo Sapiens
QGSLHVSAA

SEQ ID NO: 411316 - protein, 9 aa, Homo Sapiens
PQRRRPLAA

SEQ ID NO: 411317 - protein, 9 aa, Homo Sapiens
KVWLHLAKD

SEQ ID NO: 411318 - protein, 9 aa, Homo Sapiens
FKGPWPLEE

SEQ ID NO: 411319 - protein, 9 aa, Homo Sapiens
TEEEPGLLD

SEQ ID NO: 411320 - protein, 9 aa, Homo Sapiens
HGTHSPRAT

SEQ ID NO: 411321 - protein, 9 aa, Homo Sapiens
KDTPSSARP

SEQ ID NO: 411322 - protein, 9 aa, Homo Sapiens
PPPSHTCED

SEQ ID NO: 411323 - protein, 9 aa, Homo Sapiens
LQCVGRRRQ

SEQ ID NO: 411324 - protein, 9 aa, Homo Sapiens
LASRRTWSS

SEQ ID NO: 411325 - protein, 9 aa, Homo Sapiens
MNMTLWKQK

SEQ ID NO: 411326 - protein, 9 aa, Homo Sapiens
LGAPVPSNL

SEQ ID NO: 411327 - protein, 9 aa, Homo Sapiens
CHCPNTSAQ

SEQ ID NO: 411328 - protein, 9 aa, Homo Sapiens
VSKKDSQNC

SEQ ID NO: 411329 - protein, 9 aa, Homo Sapiens
IPKEQLRGS

SEQ ID NO: 411330 - protein, 9 aa, Homo Sapiens
KKTRMFIPA

SEQ ID NO: 411331 - protein, 9 aa, Homo Sapiens
TTPDQYSLC

SEQ ID NO: 411332 - protein, 9 aa, Homo Sapiens
QKEQTALYR

SEQ ID NO: 411333 - protein, 9 aa, Homo Sapiens
PAIHIEDLP

SEQ ID NO: 411334 - protein, 9 aa, Homo Sapiens
GHQAPQVAM

SEQ ID NO: 411335 - protein, 9 aa, Homo Sapiens
LQDCDANVL

SEQ ID NO: 411336 - protein, 9 aa, Homo Sapiens
VVWTVALLV

SEQ ID NO: 411337 - protein, 9 aa, Homo Sapiens
RQKKGVAGE

SEQ ID NO: 411338 - protein, 9 aa, Homo Sapiens
CSINHFQQV

SEQ ID NO: 411339 - protein, 9 aa, Homo Sapiens
DNSQDLNMD

SEQ ID NO: 411340 - protein, 9 aa, Homo Sapiens
QNPNGENQA

SEQ ID NO: 411341 - protein, 9 aa, Homo Sapiens
GQAALGARE

SEQ ID NO: 411342 - protein, 9 aa, Homo Sapiens
HPPLWSRWR

SEQ ID NO: 411343 - protein, 9 aa, Homo Sapiens
VKRRRRRKR

SEQ ID NO: 411344 - protein, 9 aa, Homo Sapiens
PPRKCVDSP

SEQ ID NO: 411345 - protein, 9 aa, Homo Sapiens
LIVLEIIEH

SEQ ID NO: 411346 - protein, 9 aa, Homo Sapiens
AAAGVPRTN

SEQ ID NO: 411347 - protein, 9 aa, Homo Sapiens
TEVNSPPPS

SEQ ID NO: 411348 - protein, 9 aa, Homo Sapiens
RRSWGQQAH

SEQ ID NO: 411349 - protein, 9 aa, Homo Sapiens
VDSSAPEDS

SEQ ID NO: 411350 - protein, 9 aa, Homo Sapiens
PPNISAVDI

SEQ ID NO: 411351 - protein, 9 aa, Homo Sapiens
GCCATRESL

SEQ ID NO: 411352 - protein, 9 aa, Homo Sapiens
SKVPGGSRP

SEQ ID NO: 411353 - protein, 9 aa, Homo Sapiens
KKDSGLDVD

SEQ ID NO: 411354 - protein, 9 aa, Homo Sapiens
YRETYCACR

SEQ ID NO: 411355 - protein, 9 aa, Homo Sapiens
RKHSESPPA

SEQ ID NO: 411356 - protein, 9 aa, Homo Sapiens
LGLGSDLVQ

SEQ ID NO: 411357 - protein, 9 aa, Homo Sapiens
KLGPEELDE

SEQ ID NO: 411358 - protein, 9 aa, Homo Sapiens
LLLPGWGGQ

SEQ ID NO: 411359 - protein, 9 aa, Homo Sapiens
YYRVNLHTR

SEQ ID NO: 411360 - protein, 9 aa, Homo Sapiens
AGRDEPWPG

SEQ ID NO: 411361 - protein, 9 aa, Homo Sapiens
ETFHHFVPE

SEQ ID NO: 411362 - protein, 9 aa, Homo Sapiens
MKWYTAEDM

SEQ ID NO: 411363 - protein, 9 aa, Homo Sapiens
LGGGGSGGH

SEQ ID NO: 411364 - protein, 9 aa, Homo Sapiens
CFLLVVLTL

SEQ ID NO: 411365 - protein, 9 aa, Homo Sapiens
HTPMHFTDV

SEQ ID NO: 411366 - protein, 9 aa, Homo Sapiens
REEKNVHRQ

SEQ ID NO: 411367 - protein, 9 aa, Homo Sapiens
SLQLGDAGV

SEQ ID NO: 411368 - protein, 9 aa, Homo Sapiens
CGLKRKWIR

SEQ ID NO: 411369 - protein, 9 aa, Homo Sapiens
LLAVSWGTP

SEQ ID NO: 411370 - protein, 9 aa, Homo Sapiens
SWDCRCMPP

SEQ ID NO: 411371 - protein, 9 aa, Homo Sapiens
CFYLSNAHP

SEQ ID NO: 411372 - protein, 9 aa, Homo Sapiens
GTLGVSQQL

SEQ ID NO: 411373 - protein, 9 aa, Homo Sapiens
PPPLIAPVA

SEQ ID NO: 411374 - protein, 9 aa, Homo Sapiens
PGTPQPVVD

SEQ ID NO: 411375 - protein, 9 aa, Homo Sapiens
HLPHQPPLS

SEQ ID NO: 411376 - protein, 9 aa, Homo Sapiens
MHHQQQQQQ

SEQ ID NO: 411377 - protein, 9 aa, Homo Sapiens
IPDFQGQIS

SEQ ID NO: 411378 - protein, 9 aa, Homo Sapiens
FEALGYMDD

SEQ ID NO: 411379 - protein, 9 aa, Homo Sapiens
RRRRGLSRW

SEQ ID NO: 411380 - protein, 9 aa, Homo Sapiens
AEVELIFLE

SEQ ID NO: 411381 - protein, 9 aa, Homo Sapiens
FLMDGLYHS

SEQ ID NO: 411382 - protein, 9 aa, Homo Sapiens
MPWGSGISI

SEQ ID NO: 411383 - protein, 9 aa, Homo Sapiens
GVIALTNIM

SEQ ID NO: 411384 - protein, 9 aa, Homo Sapiens
VGAFMVCWA

SEQ ID NO: 411385 - protein, 9 aa, Homo Sapiens
QERDGAGSP

SEQ ID NO: 411386 - protein, 9 aa, Homo Sapiens
RSSGWMPGM

SEQ ID NO: 411387 - protein, 9 aa, Homo Sapiens
VTSGAGGST

SEQ ID NO: 411388 - protein, 9 aa, Homo Sapiens
SRTDSPPAL

SEQ ID NO: 411389 - protein, 9 aa, Homo Sapiens
VIMMSSTPN

SEQ ID NO: 411390 - protein, 9 aa, Homo Sapiens
APPRSGRGS

SEQ ID NO: 411391 - protein, 9 aa, Homo Sapiens
AKAREEGYY

SEQ ID NO: 411392 - protein, 9 aa, Homo Sapiens
CAPPSSTGA

SEQ ID NO: 411393 - protein, 9 aa, Homo Sapiens
AMNVERVLL

SEQ ID NO: 411394 - protein, 9 aa, Homo Sapiens
RLGSGWRSA

SEQ ID NO: 411395 - protein, 9 aa, Homo Sapiens
RVKALKKAS

SEQ ID NO: 411396 - protein, 9 aa, Homo Sapiens
GVTKIDHLD

SEQ ID NO: 411397 - protein, 9 aa, Homo Sapiens
ALEWFEQEA

SEQ ID NO: 411398 - protein, 9 aa, Homo Sapiens
QVSKEWGEK

SEQ ID NO: 411399 - protein, 9 aa, Homo Sapiens
THQRIHTGV

SEQ ID NO: 411400 - protein, 9 aa, Homo Sapiens
RTARSALPQ

SEQ ID NO: 411401 - protein, 9 aa, Homo Sapiens
NMTDFWLAG

SEQ ID NO: 411402 - protein, 9 aa, Homo Sapiens
LDVDVVLKV

SEQ ID NO: 411403 - protein, 9 aa, Homo Sapiens
CSSTVTVLL

SEQ ID NO: 411404 - protein, 9 aa, Homo Sapiens
VLPGEAAQP

SEQ ID NO: 411405 - protein, 9 aa, Homo Sapiens
FCGMVCSLI

SEQ ID NO: 411406 - protein, 9 aa, Homo Sapiens
YKLTDLRGV

SEQ ID NO: 411407 - protein, 9 aa, Homo Sapiens
PFMPQRLTG

SEQ ID NO: 411408 - protein, 9 aa, Homo Sapiens
QGKKPSPVP

SEQ ID NO: 411409 - protein, 9 aa, Homo Sapiens
EKDYPTSTS

SEQ ID NO: 411410 - protein, 9 aa, Homo Sapiens
LRENLAGPW

SEQ ID NO: 411411 - protein, 9 aa, Homo Sapiens
ERGHHRDRC

SEQ ID NO: 411412 - protein, 9 aa, Homo Sapiens
ALPSTMRST

SEQ ID NO: 411413 - protein, 9 aa, Homo Sapiens
GTLNSHFMR

SEQ ID NO: 411414 - protein, 9 aa, Homo Sapiens
PACTWAERR

SEQ ID NO: 411415 - protein, 9 aa, Homo Sapiens
SPALLCLTL

SEQ ID NO: 411416 - protein, 9 aa, Homo Sapiens
ACLNDSDDY

SEQ ID NO: 411417 - protein, 9 aa, Homo Sapiens
FIPAAAAPP

SEQ ID NO: 411418 - protein, 9 aa, Homo Sapiens
HSIFSLLCL

SEQ ID NO: 411419 - protein, 9 aa, Homo Sapiens
CNPVQGVMY

SEQ ID NO: 411420 - protein, 9 aa, Homo Sapiens
VRALVAQQR

SEQ ID NO: 411421 - protein, 9 aa, Homo Sapiens
PVVGGPGVG

SEQ ID NO: 411422 - protein, 9 aa, Homo Sapiens
PYKCKQRGK

SEQ ID NO: 411423 - protein, 9 aa, Homo Sapiens
VAQIHGANR

SEQ ID NO: 411424 - protein, 9 aa, Homo Sapiens
SVLRRSRSA

SEQ ID NO: 411425 - protein, 9 aa, Homo Sapiens
YYLSQRCHR

SEQ ID NO: 411426 - protein, 9 aa, Homo Sapiens
ESPPASLKN

SEQ ID NO: 411427 - protein, 9 aa, Homo Sapiens
GVGLVAEGA

SEQ ID NO: 411428 - protein, 9 aa, Homo Sapiens
HVLPDHTEP

SEQ ID NO: 411429 - protein, 9 aa, Homo Sapiens
EDPVLLAFH

SEQ ID NO: 411430 - protein, 9 aa, Homo Sapiens
TSAMNVERV

SEQ ID NO: 411431 - protein, 9 aa, Homo Sapiens
LGVTLKSPS

SEQ ID NO: 411432 - protein, 9 aa, Homo Sapiens
GNFKLISTS

SEQ ID NO: 411433 - protein, 9 aa, Homo Sapiens
SPQLCRPPT

SEQ ID NO: 411434 - protein, 9 aa, Homo Sapiens
TKLAKNRNS

SEQ ID NO: 411435 - protein, 9 aa, Homo Sapiens
ARVYRDACG

SEQ ID NO: 411436 - protein, 9 aa, Homo Sapiens
EKERKRLKE

SEQ ID NO: 411437 - protein, 9 aa, Homo Sapiens
LFCRVSALG

SEQ ID NO: 411438 - protein, 9 aa, Homo Sapiens
VPLLRGRLQ

SEQ ID NO: 411439 - protein, 9 aa, Homo Sapiens
WMVATLPGR

SEQ ID NO: 411440 - protein, 9 aa, Homo Sapiens
LREKVPCLC

SEQ ID NO: 411441 - protein, 9 aa, Homo Sapiens
AIRTIAHYD

SEQ ID NO: 411442 - protein, 9 aa, Homo Sapiens
VAVHVALVF

SEQ ID NO: 411443 - protein, 9 aa, Homo Sapiens
TDQAFCSAL

SEQ ID NO: 411444 - protein, 9 aa, Homo Sapiens
ERAWLRERR

SEQ ID NO: 411445 - protein, 9 aa, Homo Sapiens
PRNTRAGPE

SEQ ID NO: 411446 - protein, 9 aa, Homo Sapiens
ISPVPGALK

SEQ ID NO: 411447 - protein, 9 aa, Homo Sapiens
FNFQGCNFS

SEQ ID NO: 411448 - protein, 9 aa, Homo Sapiens
DAKTMTAEV

SEQ ID NO: 411449 - protein, 9 aa, Homo Sapiens
RFECRCLPG

SEQ ID NO: 411450 - protein, 9 aa, Homo Sapiens
KYPTNATGA

SEQ ID NO: 411451 - protein, 9 aa, Homo Sapiens
FGNLVINAN

SEQ ID NO: 411452 - protein, 9 aa, Homo Sapiens
PEGYDLKDE

SEQ ID NO: 411453 - protein, 9 aa, Homo Sapiens
DPAGMGGTC

SEQ ID NO: 411454 - protein, 9 aa, Homo Sapiens
IPLEDGVPG

SEQ ID NO: 411455 - protein, 9 aa, Homo Sapiens
KDPRFQPTA

SEQ ID NO: 411456 - protein, 9 aa, Homo Sapiens
APCTRLARG

SEQ ID NO: 411457 - protein, 9 aa, Homo Sapiens
WKQKKLRMK

SEQ ID NO: 411458 - protein, 9 aa, Homo Sapiens
PKVDGHVSE

SEQ ID NO: 411459 - protein, 9 aa, Homo Sapiens
FQKCIYINS

SEQ ID NO: 411460 - protein, 9 aa, Homo Sapiens
SPHSPGVRS

SEQ ID NO: 411461 - protein, 9 aa, Homo Sapiens
TGSAGSALA

SEQ ID NO: 411462 - protein, 9 aa, Homo Sapiens
QKMSDAADD

SEQ ID NO: 411463 - protein, 9 aa, Homo Sapiens
LIAVTLYYG

SEQ ID NO: 411464 - protein, 9 aa, Homo Sapiens
PFFTIDLVT

SEQ ID NO: 411465 - protein, 9 aa, Homo Sapiens
AMIKIKKKI

SEQ ID NO: 411466 - protein, 9 aa, Homo Sapiens
TCQNSHWPR

SEQ ID NO: 411467 - protein, 9 aa, Homo Sapiens
TVIMRLQLF

SEQ ID NO: 411468 - protein, 9 aa, Homo Sapiens
RPTPPMPMA

SEQ ID NO: 411469 - protein, 9 aa, Homo Sapiens
QRVELPCKV

SEQ ID NO: 411470 - protein, 9 aa, Homo Sapiens
NETSSHSHA

SEQ ID NO: 411471 - protein, 9 aa, Homo Sapiens
RRGRSCVSS

SEQ ID NO: 411472 - protein, 9 aa, Homo Sapiens
PTPCATSNY

SEQ ID NO: 411473 - protein, 9 aa, Homo Sapiens
LGSWPGQFD

SEQ ID NO: 411474 - protein, 9 aa, Homo Sapiens
FFHVLFFTS

SEQ ID NO: 411475 - protein, 9 aa, Homo Sapiens
SDEDEFPHV

SEQ ID NO: 411476 - protein, 9 aa, Homo Sapiens
KDNVNQACL

SEQ ID NO: 411477 - protein, 9 aa, Homo Sapiens
VAGENTSVS

SEQ ID NO: 411478 - protein, 9 aa, Homo Sapiens
FIYSVVCII

SEQ ID NO: 411479 - protein, 9 aa, Homo Sapiens
NGDLSAMKH

SEQ ID NO: 411480 - protein, 9 aa, Homo Sapiens
LPSPITPHL

SEQ ID NO: 411481 - protein, 9 aa, Homo Sapiens
HLAVQGVDP

SEQ ID NO: 411482 - protein, 9 aa, Homo Sapiens
PAPTQERST

SEQ ID NO: 411483 - protein, 9 aa, Homo Sapiens
LLPASACAR

SEQ ID NO: 411484 - protein, 9 aa, Homo Sapiens
AAGLVGGGR

SEQ ID NO: 411485 - protein, 9 aa, Homo Sapiens
YTVLVAGSL

SEQ ID NO: 411486 - protein, 9 aa, Homo Sapiens
LGTRRQGLV

SEQ ID NO: 411487 - protein, 9 aa, Homo Sapiens
DQREWVTTI

SEQ ID NO: 411488 - protein, 9 aa, Homo Sapiens
KRSSQSRSP

SEQ ID NO: 411489 - protein, 9 aa, Homo Sapiens
SLTSSLPGG

SEQ ID NO: 411490 - protein, 9 aa, Homo Sapiens
SHATVCGGQ

SEQ ID NO: 411491 - protein, 9 aa, Homo Sapiens
PTTGHAPRL

SEQ ID NO: 411492 - protein, 9 aa, Homo Sapiens
RGLQYKCLD

SEQ ID NO: 411493 - protein, 9 aa, Homo Sapiens
CWTARICAV

SEQ ID NO: 411494 - protein, 9 aa, Homo Sapiens
WTTTLGHPG

SEQ ID NO: 411495 - protein, 9 aa, Homo Sapiens
LVLCSLCLQ

SEQ ID NO: 411496 - protein, 9 aa, Homo Sapiens
LDVQELLIL

SEQ ID NO: 411497 - protein, 9 aa, Homo Sapiens
PTSTRSLPS

SEQ ID NO: 411498 - protein, 9 aa, Homo Sapiens
GAIRVYAIL

SEQ ID NO: 411499 - protein, 9 aa, Homo Sapiens
HRAWVTTRM

SEQ ID NO: 411500 - protein, 9 aa, Homo Sapiens
PPTKKGAKA

SEQ ID NO: 411501 - protein, 9 aa, Homo Sapiens
MCPLNPAAQ

SEQ ID NO: 411502 - protein, 9 aa, Homo Sapiens
AYLSGGQGQ

SEQ ID NO: 411503 - protein, 9 aa, Homo Sapiens
GGLLVLTGV

SEQ ID NO: 411504 - protein, 9 aa, Homo Sapiens
PIGAVRPDA

SEQ ID NO: 411505 - protein, 9 aa, Homo Sapiens
DGFLPIFMP

SEQ ID NO: 411506 - protein, 9 aa, Homo Sapiens
MKVTMPCMS

SEQ ID NO: 411507 - protein, 9 aa, Homo Sapiens
WTSPPHPAL

SEQ ID NO: 411508 - protein, 9 aa, Homo Sapiens
ASETAQVVR

SEQ ID NO: 411509 - protein, 9 aa, Homo Sapiens
VSVQQTQAP

SEQ ID NO: 411510 - protein, 9 aa, Homo Sapiens
WLAGLDITD

SEQ ID NO: 411511 - protein, 9 aa, Homo Sapiens
HSESPPAPS

SEQ ID NO: 411512 - protein, 9 aa, Homo Sapiens
AGWPCPAVP

SEQ ID NO: 411513 - protein, 9 aa, Homo Sapiens
TWRSRAQDD

SEQ ID NO: 411514 - protein, 9 aa, Homo Sapiens
IPHLELEDD

SEQ ID NO: 411515 - protein, 9 aa, Homo Sapiens
AGGVGAQLM

SEQ ID NO: 411516 - protein, 9 aa, Homo Sapiens
MVDDNGVWM

SEQ ID NO: 411517 - protein, 9 aa, Homo Sapiens
GSSSSAPTP

SEQ ID NO: 411518 - protein, 9 aa, Homo Sapiens
IQSAEGQQK

SEQ ID NO: 411519 - protein, 9 aa, Homo Sapiens
PLEDDKASQ

SEQ ID NO: 411520 - protein, 9 aa, Homo Sapiens
SLKVRGLDL

SEQ ID NO: 411521 - protein, 9 aa, Homo Sapiens
VIGYHVMVW

SEQ ID NO: 411522 - protein, 9 aa, Homo Sapiens
IRTIAHYDP

SEQ ID NO: 411523 - protein, 9 aa, Homo Sapiens
VAVSGGGGV

SEQ ID NO: 411524 - protein, 9 aa, Homo Sapiens
ILEELSCGC

SEQ ID NO: 411525 - protein, 9 aa, Homo Sapiens
MVDGKTILV

SEQ ID NO: 411526 - protein, 9 aa, Homo Sapiens
EEVVPVSIL

SEQ ID NO: 411527 - protein, 9 aa, Homo Sapiens
HSKCITECV

SEQ ID NO: 411528 - protein, 9 aa, Homo Sapiens
LVTPRLTGS

SEQ ID NO: 411529 - protein, 9 aa, Homo Sapiens
LHSSWVMTC

SEQ ID NO: 411530 - protein, 9 aa, Homo Sapiens
RARGHLVCV

SEQ ID NO: 411531 - protein, 9 aa, Homo Sapiens
GMGLVKGYD

SEQ ID NO: 411532 - protein, 9 aa, Homo Sapiens
HPGAQPSPP

SEQ ID NO: 411533 - protein, 9 aa, Homo Sapiens
HSSHKYDRE

SEQ ID NO: 411534 - protein, 9 aa, Homo Sapiens
VPIPGRTGS

SEQ ID NO: 411535 - protein, 9 aa, Homo Sapiens
MDLDIKGGD

SEQ ID NO: 411536 - protein, 9 aa, Homo Sapiens
PLSWSKTEE

SEQ ID NO: 411537 - protein, 9 aa, Homo Sapiens
QGSQCTKEP

SEQ ID NO: 411538 - protein, 9 aa, Homo Sapiens
PKETPIEQE

SEQ ID NO: 411539 - protein, 9 aa, Homo Sapiens
VSIATRSPA

SEQ ID NO: 411540 - protein, 9 aa, Homo Sapiens
DMWKKNDQS

SEQ ID NO: 411541 - protein, 9 aa, Homo Sapiens
SRRRGSMNN

SEQ ID NO: 411542 - protein, 9 aa, Homo Sapiens
LQLLALGLG

SEQ ID NO: 411543 - protein, 9 aa, Homo Sapiens
DATFAATGR

SEQ ID NO: 411544 - protein, 9 aa, Homo Sapiens
VKTVIELMA

SEQ ID NO: 411545 - protein, 9 aa, Homo Sapiens
KAWLENEIA

SEQ ID NO: 411546 - protein, 9 aa, Homo Sapiens
LHTGLIKSQ

SEQ ID NO: 411547 - protein, 9 aa, Homo Sapiens
EQPPCLEAE

SEQ ID NO: 411548 - protein, 9 aa, Homo Sapiens
WLQPNAATG

SEQ ID NO: 411549 - protein, 9 aa, Homo Sapiens
GRRDWGTMA

SEQ ID NO: 411550 - protein, 9 aa, Homo Sapiens
RTPWALGTG

SEQ ID NO: 411551 - protein, 9 aa, Homo Sapiens
LSNLAHHTK

SEQ ID NO: 411552 - protein, 9 aa, Homo Sapiens
HGINQPIIY

SEQ ID NO: 411553 - protein, 9 aa, Homo Sapiens
SEEDFWRWA

SEQ ID NO: 411554 - protein, 9 aa, Homo Sapiens
LWGRPCSSP

SEQ ID NO: 411555 - protein, 9 aa, Homo Sapiens
WLNDGHVAS

SEQ ID NO: 411556 - protein, 9 aa, Homo Sapiens
KCVSSAMFS

SEQ ID NO: 411557 - protein, 9 aa, Homo Sapiens
AQVRALVAQ

SEQ ID NO: 411558 - protein, 9 aa, Homo Sapiens
KKKTRMFIP

SEQ ID NO: 411559 - protein, 9 aa, Homo Sapiens
AGLEQRLQD

SEQ ID NO: 411560 - protein, 9 aa, Homo Sapiens
EIISETDDD

SEQ ID NO: 411561 - protein, 9 aa, Homo Sapiens
GPSICVFLV

SEQ ID NO: 411562 - protein, 9 aa, Homo Sapiens
LSIPSAATL

SEQ ID NO: 411563 - protein, 9 aa, Homo Sapiens
GVMMMMILT

SEQ ID NO: 411564 - protein, 9 aa, Homo Sapiens
TVATQQDAN

SEQ ID NO: 411565 - protein, 9 aa, Homo Sapiens
VRGQSRARC

SEQ ID NO: 411566 - protein, 9 aa, Homo Sapiens
VEGGQLVLL

SEQ ID NO: 411567 - protein, 9 aa, Homo Sapiens
TMAEERMTG

SEQ ID NO: 411568 - protein, 9 aa, Homo Sapiens
PWSRSWWWR

SEQ ID NO: 411569 - protein, 9 aa, Homo Sapiens
SSLVKREQL

SEQ ID NO: 411570 - protein, 9 aa, Homo Sapiens
IRLLVGGKL

SEQ ID NO: 411571 - protein, 9 aa, Homo Sapiens
PNFQEEDEG

SEQ ID NO: 411572 - protein, 9 aa, Homo Sapiens
RRRRQWGSF

SEQ ID NO: 411573 - protein, 9 aa, Homo Sapiens
NVWMLDLTQ

SEQ ID NO: 411574 - protein, 9 aa, Homo Sapiens
SSYKETVGL

SEQ ID NO: 411575 - protein, 9 aa, Homo Sapiens
EQMVKEITC

SEQ ID NO: 411576 - protein, 9 aa, Homo Sapiens
PKPPPPEGA

SEQ ID NO: 411577 - protein, 9 aa, Homo Sapiens
PPKPPGAST

SEQ ID NO: 411578 - protein, 9 aa, Homo Sapiens
EWALGLQRV

SEQ ID NO: 411579 - protein, 9 aa, Homo Sapiens
IDEYKKTYM

SEQ ID NO: 411580 - protein, 9 aa, Homo Sapiens
RWQVTAEQS

SEQ ID NO: 411581 - protein, 9 aa, Homo Sapiens
EVACAALVR

SEQ ID NO: 411582 - protein, 9 aa, Homo Sapiens
VKPANIFLR

SEQ ID NO: 411583 - protein, 9 aa, Homo Sapiens
RRQAMAMTV

SEQ ID NO: 411584 - protein, 9 aa, Homo Sapiens
LGFTVFARV

SEQ ID NO: 411585 - protein, 9 aa, Homo Sapiens
GSSCYFFLP

SEQ ID NO: 411586 - protein, 9 aa, Homo Sapiens
RRGCRPMRK

SEQ ID NO: 411587 - protein, 9 aa, Homo Sapiens
LAAWPVDRL

SEQ ID NO: 411588 - protein, 9 aa, Homo Sapiens
NGQWAQKCE

SEQ ID NO: 411589 - protein, 9 aa, Homo Sapiens
NNIKRWPLL

SEQ ID NO: 411590 - protein, 9 aa, Homo Sapiens
GFVQSSSVS

SEQ ID NO: 411591 - protein, 9 aa, Homo Sapiens
NKCKGFGFM

SEQ ID NO: 411592 - protein, 9 aa, Homo Sapiens
DPQGWRDTV

SEQ ID NO: 411593 - protein, 9 aa, Homo Sapiens
KSQKGASWF

SEQ ID NO: 411594 - protein, 9 aa, Homo Sapiens
ALPDRKTTS

SEQ ID NO: 411595 - protein, 9 aa, Homo Sapiens
RARCARLSP

SEQ ID NO: 411596 - protein, 9 aa, Homo Sapiens
CKPLCLILA

SEQ ID NO: 411597 - protein, 9 aa, Homo Sapiens
ESVCNACGL

SEQ ID NO: 411598 - protein, 9 aa, Homo Sapiens
RDGRPRAVC

SEQ ID NO: 411599 - protein, 9 aa, Homo Sapiens
LGGGHPVPL

SEQ ID NO: 411600 - protein, 9 aa, Homo Sapiens
CCGGHSPCP

SEQ ID NO: 411601 - protein, 9 aa, Homo Sapiens
ELFLLQAEI

SEQ ID NO: 411602 - protein, 9 aa, Homo Sapiens
QGCSVQHLR

SEQ ID NO: 411603 - protein, 9 aa, Homo Sapiens
RIQKSDFSN

SEQ ID NO: 411604 - protein, 9 aa, Homo Sapiens
SHDNIYEVQ

SEQ ID NO: 411605 - protein, 9 aa, Homo Sapiens
INSSVKFTS

SEQ ID NO: 411606 - protein, 9 aa, Homo Sapiens
ATTGAVATV

SEQ ID NO: 411607 - protein, 9 aa, Homo Sapiens
GERTKEGIS

SEQ ID NO: 411608 - protein, 9 aa, Homo Sapiens
VDLLVSTEG

SEQ ID NO: 411609 - protein, 9 aa, Homo Sapiens
LVLATAGAL

SEQ ID NO: 411610 - protein, 9 aa, Homo Sapiens
SAHFNFQGC

SEQ ID NO: 411611 - protein, 9 aa, Homo Sapiens
EYMHNFSDL

SEQ ID NO: 411612 - protein, 9 aa, Homo Sapiens
FSNNWNSST

SEQ ID NO: 411613 - protein, 9 aa, Homo Sapiens
PGRPNGGPH

SEQ ID NO: 411614 - protein, 9 aa, Homo Sapiens
GNQEPFKVW

SEQ ID NO: 411615 - protein, 9 aa, Homo Sapiens
ALGVGEVVL

SEQ ID NO: 411616 - protein, 9 aa, Homo Sapiens
TCRSCSKTV

SEQ ID NO: 411617 - protein, 9 aa, Homo Sapiens
PSWTWGRAP

SEQ ID NO: 411618 - protein, 9 aa, Homo Sapiens
VAIRDGELI

SEQ ID NO: 411619 - protein, 9 aa, Homo Sapiens
AKLAWELGH

SEQ ID NO: 411620 - protein, 9 aa, Homo Sapiens
TVCGGQVRA

SEQ ID NO: 411621 - protein, 9 aa, Homo Sapiens
YVKLVKQGG

SEQ ID NO: 411622 - protein, 9 aa, Homo Sapiens
IKKIVHSII

SEQ ID NO: 411623 - protein, 9 aa, Homo Sapiens
ERSPDPSPD

SEQ ID NO: 411624 - protein, 9 aa, Homo Sapiens
LGLLCDSVD

SEQ ID NO: 411625 - protein, 9 aa, Homo Sapiens
ESQLRGERE

SEQ ID NO: 411626 - protein, 9 aa, Homo Sapiens
VGKVSLRHP

SEQ ID NO: 411627 - protein, 9 aa, Homo Sapiens
YHLSGSKPK

SEQ ID NO: 411628 - protein, 9 aa, Homo Sapiens
HVWVQDGRV

SEQ ID NO: 411629 - protein, 9 aa, Homo Sapiens
IPNLLPLAG

SEQ ID NO: 411630 - protein, 9 aa, Homo Sapiens
TLTPGGSSS

SEQ ID NO: 411631 - protein, 9 aa, Homo Sapiens
SAMFSENRA

SEQ ID NO: 411632 - protein, 9 aa, Homo Sapiens
LFTKNLYFK

SEQ ID NO: 411633 - protein, 9 aa, Homo Sapiens
KLQTTSNTF

SEQ ID NO: 411634 - protein, 9 aa, Homo Sapiens
GDVPQTVKS

SEQ ID NO: 411635 - protein, 9 aa, Homo Sapiens
HQLLWGRPC

SEQ ID NO: 411636 - protein, 9 aa, Homo Sapiens
SDPDDHGGW

SEQ ID NO: 411637 - protein, 9 aa, Homo Sapiens
CHCVIGKVS

SEQ ID NO: 411638 - protein, 9 aa, Homo Sapiens
PQCGAGSHL

SEQ ID NO: 411639 - protein, 9 aa, Homo Sapiens
NFQEEDEGG

SEQ ID NO: 411640 - protein, 9 aa, Homo Sapiens
DGWAAAAGS

SEQ ID NO: 411641 - protein, 9 aa, Homo Sapiens
RVLHQNLDP

SEQ ID NO: 411642 - protein, 9 aa, Homo Sapiens
SLRATVPRH

SEQ ID NO: 411643 - protein, 9 aa, Homo Sapiens
LKLIMMMNH

SEQ ID NO: 411644 - protein, 9 aa, Homo Sapiens
HCEADINEC

SEQ ID NO: 411645 - protein, 9 aa, Homo Sapiens
CSSLQRHEM

SEQ ID NO: 411646 - protein, 9 aa, Homo Sapiens
PAFDVTPTT

SEQ ID NO: 411647 - protein, 9 aa, Homo Sapiens
IIDAHANEE

SEQ ID NO: 411648 - protein, 9 aa, Homo Sapiens
PCNASIMCP

SEQ ID NO: 411649 - protein, 9 aa, Homo Sapiens
MCKEDLCRK

SEQ ID NO: 411650 - protein, 9 aa, Homo Sapiens
QDDNAPEIL

SEQ ID NO: 411651 - protein, 9 aa, Homo Sapiens
EWPVSMSFP

SEQ ID NO: 411652 - protein, 9 aa, Homo Sapiens
VGAQLMAPL

SEQ ID NO: 411653 - protein, 9 aa, Homo Sapiens
SHRDASPTR

SEQ ID NO: 411654 - protein, 9 aa, Homo Sapiens
HCKRFFKFC

SEQ ID NO: 411655 - protein, 9 aa, Homo Sapiens
APQPGGAGF

SEQ ID NO: 411656 - protein, 9 aa, Homo Sapiens
AAQPQSSVA

SEQ ID NO: 411657 - protein, 9 aa, Homo Sapiens
IVHRFARHV

SEQ ID NO: 411658 - protein, 9 aa, Homo Sapiens
GIFWFWFWH

SEQ ID NO: 411659 - protein, 9 aa, Homo Sapiens
EIPFLLLAI

SEQ ID NO: 411660 - protein, 9 aa, Homo Sapiens
GPSFMGMQE

SEQ ID NO: 411661 - protein, 9 aa, Homo Sapiens
LHPQWAPHS

SEQ ID NO: 411662 - protein, 9 aa, Homo Sapiens
TTGAVATVL

SEQ ID NO: 411663 - protein, 9 aa, Homo Sapiens
DREREYRHC

SEQ ID NO: 411664 - protein, 9 aa, Homo Sapiens
SVKRWLGVS

SEQ ID NO: 411665 - protein, 9 aa, Homo Sapiens
IMPIFLLLD

SEQ ID NO: 411666 - protein, 9 aa, Homo Sapiens
EETPVDFYF

SEQ ID NO: 411667 - protein, 9 aa, Homo Sapiens
SYITKIKLP

SEQ ID NO: 411668 - protein, 9 aa, Homo Sapiens
RLAPERARV

SEQ ID NO: 411669 - protein, 9 aa, Homo Sapiens
LQGQEVALQ

SEQ ID NO: 411670 - protein, 9 aa, Homo Sapiens
VAHTAPAYY

SEQ ID NO: 411671 - protein, 9 aa, Homo Sapiens
CVTLLNCLE

SEQ ID NO: 411672 - protein, 9 aa, Homo Sapiens
DLLDPYKFC

SEQ ID NO: 411673 - protein, 9 aa, Homo Sapiens
LELWVLAPP

SEQ ID NO: 411674 - protein, 9 aa, Homo Sapiens
NTRAGPEPS

SEQ ID NO: 411675 - protein, 9 aa, Homo Sapiens
FFQKCIYIN

SEQ ID NO: 411676 - protein, 9 aa, Homo Sapiens
ILIHDRSVS

SEQ ID NO: 411677 - protein, 9 aa, Homo Sapiens
IIVYLLCEL

SEQ ID NO: 411678 - protein, 9 aa, Homo Sapiens
EQERLSQMP

SEQ ID NO: 411679 - protein, 9 aa, Homo Sapiens
LTAFLMPLE

SEQ ID NO: 411680 - protein, 9 aa, Homo Sapiens
LHPETEPAG

SEQ ID NO: 411681 - protein, 9 aa, Homo Sapiens
YLPIINLAI

SEQ ID NO: 411682 - protein, 9 aa, Homo Sapiens
HTHVSRCQV

SEQ ID NO: 411683 - protein, 9 aa, Homo Sapiens
LFVLDQDDN

SEQ ID NO: 411684 - protein, 9 aa, Homo Sapiens
PPSPSSLLS

SEQ ID NO: 411685 - protein, 9 aa, Homo Sapiens
QFLGNCQSP

SEQ ID NO: 411686 - protein, 9 aa, Homo Sapiens
CSVWGGEDS

SEQ ID NO: 411687 - protein, 9 aa, Homo Sapiens
IFEGHIEIC

SEQ ID NO: 411688 - protein, 9 aa, Homo Sapiens
PSTTLPEEL

SEQ ID NO: 411689 - protein, 9 aa, Homo Sapiens
AGVLGIQWL

SEQ ID NO: 411690 - protein, 9 aa, Homo Sapiens
SHLPAARTR

SEQ ID NO: 411691 - protein, 9 aa, Homo Sapiens
PPLHLMYPY

SEQ ID NO: 411692 - protein, 9 aa, Homo Sapiens
TYIDEKWDF

SEQ ID NO: 411693 - protein, 9 aa, Homo Sapiens
YQLPQLQGF

SEQ ID NO: 411694 - protein, 9 aa, Homo Sapiens
PPSHTCEDS

SEQ ID NO: 411695 - protein, 9 aa, Homo Sapiens
ALVQQGDDF

SEQ ID NO: 411696 - protein, 9 aa, Homo Sapiens
HPSDHLEIL

SEQ ID NO: 411697 - protein, 9 aa, Homo Sapiens
HKTVNSSHY

SEQ ID NO: 411698 - protein, 9 aa, Homo Sapiens
SKKFIILER

SEQ ID NO: 411699 - protein, 9 aa, Homo Sapiens
RFWLALQAG

SEQ ID NO: 411700 - protein, 9 aa, Homo Sapiens
KAMFDVHRK

SEQ ID NO: 411701 - protein, 9 aa, Homo Sapiens
ISYPCCCEE

SEQ ID NO: 411702 - protein, 9 aa, Homo Sapiens
RRKMTTLER

SEQ ID NO: 411703 - protein, 9 aa, Homo Sapiens
PTTQISHSR

SEQ ID NO: 411704 - protein, 9 aa, Homo Sapiens
PSKLSVEIR

SEQ ID NO: 411705 - protein, 9 aa, Homo Sapiens
VRPDAVDVK

SEQ ID NO: 411706 - protein, 9 aa, Homo Sapiens
LSWATHYIG

SEQ ID NO: 411707 - protein, 9 aa, Homo Sapiens
VSRTDLIEL

SEQ ID NO: 411708 - protein, 9 aa, Homo Sapiens
SGGCCIPKE

SEQ ID NO: 411709 - protein, 9 aa, Homo Sapiens
THISSAGCL

SEQ ID NO: 411710 - protein, 9 aa, Homo Sapiens
FLGSHPFRA

SEQ ID NO: 411711 - protein, 9 aa, Homo Sapiens
LWYYVVFFT

SEQ ID NO: 411712 - protein, 9 aa, Homo Sapiens
YSKCRTAGH

SEQ ID NO: 411713 - protein, 9 aa, Homo Sapiens
EFLSNLAHH

SEQ ID NO: 411714 - protein, 9 aa, Homo Sapiens
HLMYPYKAE

SEQ ID NO: 411715 - protein, 9 aa, Homo Sapiens
KEAGEVRVY

SEQ ID NO: 411716 - protein, 9 aa, Homo Sapiens
TVTGTPYQD

SEQ ID NO: 411717 - protein, 9 aa, Homo Sapiens
QVHSTGHHA

SEQ ID NO: 411718 - protein, 9 aa, Homo Sapiens
PARQPQPRS

SEQ ID NO: 411719 - protein, 9 aa, Homo Sapiens
PVLPWCPPR

SEQ ID NO: 411720 - protein, 9 aa, Homo Sapiens
ATRRPSRLW

SEQ ID NO: 411721 - protein, 9 aa, Homo Sapiens
CHLYYNWLG

SEQ ID NO: 411722 - protein, 9 aa, Homo Sapiens
GSLLGNPIP

SEQ ID NO: 411723 - protein, 9 aa, Homo Sapiens
LQPGHSHFY

SEQ ID NO: 411724 - protein, 9 aa, Homo Sapiens
QLTRDWKAS

SEQ ID NO: 411725 - protein, 9 aa, Homo Sapiens
LCHCARVCR

SEQ ID NO: 411726 - protein, 9 aa, Homo Sapiens
RKLEKKCWI

SEQ ID NO: 411727 - protein, 9 aa, Homo Sapiens
EPRKGLWER

SEQ ID NO: 411728 - protein, 9 aa, Homo Sapiens
QPGCYGCCG

SEQ ID NO: 411729 - protein, 9 aa, Homo Sapiens
WRSRAQDDG

SEQ ID NO: 411730 - protein, 9 aa, Homo Sapiens
LQEPSRRGP

SEQ ID NO: 411731 - protein, 9 aa, Homo Sapiens
TISDLWTED

SEQ ID NO: 411732 - protein, 9 aa, Homo Sapiens
GADVLPVVG

SEQ ID NO: 411733 - protein, 9 aa, Homo Sapiens
ESRFWLALQ

SEQ ID NO: 411734 - protein, 9 aa, Homo Sapiens
GVIKQKVLR

SEQ ID NO: 411735 - protein, 9 aa, Homo Sapiens
MHFAEVVGH

SEQ ID NO: 411736 - protein, 9 aa, Homo Sapiens
KKSITHNMT

SEQ ID NO: 411737 - protein, 9 aa, Homo Sapiens
SLCPEPPET

SEQ ID NO: 411738 - protein, 9 aa, Homo Sapiens
LYVLVLLSR

SEQ ID NO: 411739 - protein, 9 aa, Homo Sapiens
TIGKETFHH

SEQ ID NO: 411740 - protein, 9 aa, Homo Sapiens
GRCYQLPQL

SEQ ID NO: 411741 - protein, 9 aa, Homo Sapiens
DKQSGKKCG

SEQ ID NO: 411742 - protein, 9 aa, Homo Sapiens
GGHPVPLHQ

SEQ ID NO: 411743 - protein, 9 aa, Homo Sapiens
SDIDEYKKT

SEQ ID NO: 411744 - protein, 9 aa, Homo Sapiens
PQKETLLLN

SEQ ID NO: 411745 - protein, 9 aa, Homo Sapiens
PVWTVHRIR

SEQ ID NO: 411746 - protein, 9 aa, Homo Sapiens
IQGGKASQL

SEQ ID NO: 411747 - protein, 9 aa, Homo Sapiens
AMITYKFEE

SEQ ID NO: 411748 - protein, 9 aa, Homo Sapiens
KDLLINVQQ

SEQ ID NO: 411749 - protein, 9 aa, Homo Sapiens
TKVLGTPTR

SEQ ID NO: 411750 - protein, 9 aa, Homo Sapiens
LRDVLPGVD

SEQ ID NO: 411751 - protein, 9 aa, Homo Sapiens
RQWGSFPLQ

SEQ ID NO: 411752 - protein, 9 aa, Homo Sapiens
LEEEEEDLG

SEQ ID NO: 411753 - protein, 9 aa, Homo Sapiens
LVGRAVRRK

SEQ ID NO: 411754 - protein, 9 aa, Homo Sapiens
FPCPARAGA

SEQ ID NO: 411755 - protein, 9 aa, Homo Sapiens
PPPQQTPLC

SEQ ID NO: 411756 - protein, 9 aa, Homo Sapiens
ESGESTSTG

SEQ ID NO: 411757 - protein, 9 aa, Homo Sapiens
FHGVAPSTC

SEQ ID NO: 411758 - protein, 9 aa, Homo Sapiens
LNIAVKEKS

SEQ ID NO: 411759 - protein, 9 aa, Homo Sapiens
DYPTSTSQD

SEQ ID NO: 411760 - protein, 9 aa, Homo Sapiens
WLHEHNRVC

SEQ ID NO: 411761 - protein, 9 aa, Homo Sapiens
ELLVNMGGN

SEQ ID NO: 411762 - protein, 9 aa, Homo Sapiens
VERVLLKAQ

SEQ ID NO: 411763 - protein, 9 aa, Homo Sapiens
FMPQRLTGR

SEQ ID NO: 411764 - protein, 9 aa, Homo Sapiens
LKRGQPWVT

SEQ ID NO: 411765 - protein, 9 aa, Homo Sapiens
NYGYDACVV

SEQ ID NO: 411766 - protein, 9 aa, Homo Sapiens
PAEILANMS

SEQ ID NO: 411767 - protein, 9 aa, Homo Sapiens
RAVCVGGKE

SEQ ID NO: 411768 - protein, 9 aa, Homo Sapiens
INVKRCLSS

SEQ ID NO: 411769 - protein, 9 aa, Homo Sapiens
SFVSVGPRP

SEQ ID NO: 411770 - protein, 9 aa, Homo Sapiens
FKAFSSEQW

SEQ ID NO: 411771 - protein, 9 aa, Homo Sapiens
LLCRVDNDP

SEQ ID NO: 411772 - protein, 9 aa, Homo Sapiens
HILLKEMKL

SEQ ID NO: 411773 - protein, 9 aa, Homo Sapiens
KKGEEGGRM

SEQ ID NO: 411774 - protein, 9 aa, Homo Sapiens
PQPRSSDLS

SEQ ID NO: 411775 - protein, 9 aa, Homo Sapiens
KWIISDGSV

SEQ ID NO: 411776 - protein, 9 aa, Homo Sapiens
SWGQQAHEY

SEQ ID NO: 411777 - protein, 9 aa, Homo Sapiens
KEPRLWAGP

SEQ ID NO: 411778 - protein, 9 aa, Homo Sapiens
VTAGVCQQE

SEQ ID NO: 411779 - protein, 9 aa, Homo Sapiens
EFLLVSSSA

SEQ ID NO: 411780 - protein, 9 aa, Homo Sapiens
HLELEDDTS

SEQ ID NO: 411781 - protein, 9 aa, Homo Sapiens
RVRISPFAS

SEQ ID NO: 411782 - protein, 9 aa, Homo Sapiens
RQTLVNTTQ

SEQ ID NO: 411783 - protein, 9 aa, Homo Sapiens
KDEGEDRDG

SEQ ID NO: 411784 - protein, 9 aa, Homo Sapiens
PSATCPWTT

SEQ ID NO: 411785 - protein, 9 aa, Homo Sapiens
LLSAGAIRV

SEQ ID NO: 411786 - protein, 9 aa, Homo Sapiens
GNAGRIRSA

SEQ ID NO: 411787 - protein, 9 aa, Homo Sapiens
MVEPSNEPS

SEQ ID NO: 411788 - protein, 9 aa, Homo Sapiens
KKEEADYGA

SEQ ID NO: 411789 - protein, 9 aa, Homo Sapiens
SPALRARGG

SEQ ID NO: 411790 - protein, 9 aa, Homo Sapiens
ADSTAPWWE

SEQ ID NO: 411791 - protein, 9 aa, Homo Sapiens
TMSGWNPPQ

SEQ ID NO: 411792 - protein, 9 aa, Homo Sapiens
EARVVPRTP

SEQ ID NO: 411793 - protein, 9 aa, Homo Sapiens
EEQPGGFAW

SEQ ID NO: 411794 - protein, 9 aa, Homo Sapiens
DDGRTVDSP

SEQ ID NO: 411795 - protein, 9 aa, Homo Sapiens
TWAVSHEGR

SEQ ID NO: 411796 - protein, 9 aa, Homo Sapiens
WEIRDHLLA

SEQ ID NO: 411797 - protein, 9 aa, Homo Sapiens
TGNLHPEEA

SEQ ID NO: 411798 - protein, 9 aa, Homo Sapiens
ASTHWPSRA

SEQ ID NO: 411799 - protein, 9 aa, Homo Sapiens
SRIIQMYLT

SEQ ID NO: 411800 - protein, 9 aa, Homo Sapiens
NSAHPSFFL

SEQ ID NO: 411801 - protein, 9 aa, Homo Sapiens
EWEIVHQPA

SEQ ID NO: 411802 - protein, 9 aa, Homo Sapiens
EDFWRWASF

SEQ ID NO: 411803 - protein, 9 aa, Homo Sapiens
FHSVEVCLS

SEQ ID NO: 411804 - protein, 9 aa, Homo Sapiens
RADPVRICL

SEQ ID NO: 411805 - protein, 9 aa, Homo Sapiens
DMGPCGPCS

SEQ ID NO: 411806 - protein, 9 aa, Homo Sapiens
AVPGLMREW

SEQ ID NO: 411807 - protein, 9 aa, Homo Sapiens
GQRIEAKSK

SEQ ID NO: 411808 - protein, 9 aa, Homo Sapiens
AHRAQGDSL

SEQ ID NO: 411809 - protein, 9 aa, Homo Sapiens
GHRHQSTLQ

SEQ ID NO: 411810 - protein, 9 aa, Homo Sapiens
TIVMPNIVI

SEQ ID NO: 411811 - protein, 9 aa, Homo Sapiens
DDKLAFYGI

SEQ ID NO: 411812 - protein, 9 aa, Homo Sapiens
EGHAPLTVL

SEQ ID NO: 411813 - protein, 9 aa, Homo Sapiens
AIWQLCALG

SEQ ID NO: 411814 - protein, 9 aa, Homo Sapiens
RQSRSPSLQ

SEQ ID NO: 411815 - protein, 9 aa, Homo Sapiens
LHSCRIQKS

SEQ ID NO: 411816 - protein, 9 aa, Homo Sapiens
APRNKMPTW

SEQ ID NO: 411817 - protein, 9 aa, Homo Sapiens
LLQGPDLSL

SEQ ID NO: 411818 - protein, 9 aa, Homo Sapiens
NINVKRCLS

SEQ ID NO: 411819 - protein, 9 aa, Homo Sapiens
GVFGPEDLG

SEQ ID NO: 411820 - protein, 9 aa, Homo Sapiens
PSNIYTGLF

SEQ ID NO: 411821 - protein, 9 aa, Homo Sapiens
PILQLVVLD

SEQ ID NO: 411822 - protein, 9 aa, Homo Sapiens
WGRAPRTES

SEQ ID NO: 411823 - protein, 9 aa, Homo Sapiens
MVGGSLSSC

SEQ ID NO: 411824 - protein, 9 aa, Homo Sapiens
ILSKNLIVL

SEQ ID NO: 411825 - protein, 9 aa, Homo Sapiens
CEADTLRPP

SEQ ID NO: 411826 - protein, 9 aa, Homo Sapiens
WGSFPQHCA

SEQ ID NO: 411827 - protein, 9 aa, Homo Sapiens
LSRPGWAAL

SEQ ID NO: 411828 - protein, 9 aa, Homo Sapiens
VPKKRERMM

SEQ ID NO: 411829 - protein, 9 aa, Homo Sapiens
HGQGNPGGL

SEQ ID NO: 411830 - protein, 9 aa, Homo Sapiens
AEEQARRQE

SEQ ID NO: 411831 - protein, 9 aa, Homo Sapiens
TPVSSLCPE

SEQ ID NO: 411832 - protein, 9 aa, Homo Sapiens
RVLPALSSW

SEQ ID NO: 411833 - protein, 9 aa, Homo Sapiens
CPARSPRTR

SEQ ID NO: 411834 - protein, 9 aa, Homo Sapiens
KTTNMLASV

SEQ ID NO: 411835 - protein, 9 aa, Homo Sapiens
IISLVQGPG

SEQ ID NO: 411836 - protein, 9 aa, Homo Sapiens
FLLVVLTLP

SEQ ID NO: 411837 - protein, 9 aa, Homo Sapiens
CQEVVDTYS

SEQ ID NO: 411838 - protein, 9 aa, Homo Sapiens
TVRVKTPGG

SEQ ID NO: 411839 - protein, 9 aa, Homo Sapiens
ITNMDVFIA

SEQ ID NO: 411840 - protein, 9 aa, Homo Sapiens
VHKDEALKE

SEQ ID NO: 411841 - protein, 9 aa, Homo Sapiens
GVARVEVAA

SEQ ID NO: 411842 - protein, 9 aa, Homo Sapiens
REFAVTTTP

SEQ ID NO: 411843 - protein, 9 aa, Homo Sapiens
GHVSETPLL

SEQ ID NO: 411844 - protein, 9 aa, Homo Sapiens
HRAQGDSLL

SEQ ID NO: 411845 - protein, 9 aa, Homo Sapiens
CPHPRNAGK

SEQ ID NO: 411846 - protein, 9 aa, Homo Sapiens
PVRICLLSH

SEQ ID NO: 411847 - protein, 9 aa, Homo Sapiens
ERHIAEMGR

SEQ ID NO: 411848 - protein, 9 aa, Homo Sapiens
STPSTSRET

SEQ ID NO: 411849 - protein, 9 aa, Homo Sapiens
WLLHTLTVQ

SEQ ID NO: 411850 - protein, 9 aa, Homo Sapiens
LGSHPFRAR

SEQ ID NO: 411851 - protein, 9 aa, Homo Sapiens
RIGISISQL

SEQ ID NO: 411852 - protein, 9 aa, Homo Sapiens
DLGAYLNLR

SEQ ID NO: 411853 - protein, 9 aa, Homo Sapiens
EIDKNAVKF

SEQ ID NO: 411854 - protein, 9 aa, Homo Sapiens
QELRKLREN

SEQ ID NO: 411855 - protein, 9 aa, Homo Sapiens
ATGTAAILI

SEQ ID NO: 411856 - protein, 9 aa, Homo Sapiens
GETHSQQIA

SEQ ID NO: 411857 - protein, 9 aa, Homo Sapiens
LAQRLPYNI

SEQ ID NO: 411858 - protein, 9 aa, Homo Sapiens
APRTESSQP

SEQ ID NO: 411859 - protein, 9 aa, Homo Sapiens
EDEKNLQEC

SEQ ID NO: 411860 - protein, 9 aa, Homo Sapiens
LRGGYISSE

SEQ ID NO: 411861 - protein, 9 aa, Homo Sapiens
CLLPPAPPQ

SEQ ID NO: 411862 - protein, 9 aa, Homo Sapiens
HQNMDYCPQ

SEQ ID NO: 411863 - protein, 9 aa, Homo Sapiens
HTGSAGSAL

SEQ ID NO: 411864 - protein, 9 aa, Homo Sapiens
PLDWLGHPL

SEQ ID NO: 411865 - protein, 9 aa, Homo Sapiens
KCWIIKENK

SEQ ID NO: 411866 - protein, 9 aa, Homo Sapiens
EKEDPVGQA

SEQ ID NO: 411867 - protein, 9 aa, Homo Sapiens
VRVIHSFKG

SEQ ID NO: 411868 - protein, 9 aa, Homo Sapiens
VAVAHIAGF

SEQ ID NO: 411869 - protein, 9 aa, Homo Sapiens
AVLPNKVDE

SEQ ID NO: 411870 - protein, 9 aa, Homo Sapiens
VYWDSAGAT

SEQ ID NO: 411871 - protein, 9 aa, Homo Sapiens
MTQGRAETH

SEQ ID NO: 411872 - protein, 9 aa, Homo Sapiens
TMPALGDPE

SEQ ID NO: 411873 - protein, 9 aa, Homo Sapiens
PQQDEMTVK

SEQ ID NO: 411874 - protein, 9 aa, Homo Sapiens
SRPAQPTVP

SEQ ID NO: 411875 - protein, 9 aa, Homo Sapiens
VSAAGALLR

SEQ ID NO: 411876 - protein, 9 aa, Homo Sapiens
QVKKRKKRE

SEQ ID NO: 411877 - protein, 9 aa, Homo Sapiens
QLQAICGVG

SEQ ID NO: 411878 - protein, 9 aa, Homo Sapiens
GIKLATEYA

SEQ ID NO: 411879 - protein, 9 aa, Homo Sapiens
MVDGVAPVF

SEQ ID NO: 411880 - protein, 9 aa, Homo Sapiens
AGGHMERAF

SEQ ID NO: 411881 - protein, 9 aa, Homo Sapiens
VATLSPGEA

SEQ ID NO: 411882 - protein, 9 aa, Homo Sapiens
VVDPDAHPS

SEQ ID NO: 411883 - protein, 9 aa, Homo Sapiens
VTPTTSSLV

SEQ ID NO: 411884 - protein, 9 aa, Homo Sapiens
THSQQIAEE

SEQ ID NO: 411885 - protein, 9 aa, Homo Sapiens
ASMCSWLLS

SEQ ID NO: 411886 - protein, 9 aa, Homo Sapiens
PAWHPLTTS

SEQ ID NO: 411887 - protein, 9 aa, Homo Sapiens
LGALKKGAG

SEQ ID NO: 411888 - protein, 9 aa, Homo Sapiens
TLRGELHFD

SEQ ID NO: 411889 - protein, 9 aa, Homo Sapiens
RGTRPPVLP

SEQ ID NO: 411890 - protein, 9 aa, Homo Sapiens
VLFKTKFVG

SEQ ID NO: 411891 - protein, 9 aa, Homo Sapiens
VGEVVLPGQ

SEQ ID NO: 411892 - protein, 9 aa, Homo Sapiens
QVEFVRIGQ

SEQ ID NO: 411893 - protein, 9 aa, Homo Sapiens
TAFLGDLLA

SEQ ID NO: 411894 - protein, 9 aa, Homo Sapiens
FHNEAWSML

SEQ ID NO: 411895 - protein, 9 aa, Homo Sapiens
LSSEEVAAF

SEQ ID NO: 411896 - protein, 9 aa, Homo Sapiens
PQGPCPPPV

SEQ ID NO: 411897 - protein, 9 aa, Homo Sapiens
CLFLRSLVW

SEQ ID NO: 411898 - protein, 9 aa, Homo Sapiens
LVCYLKSND

SEQ ID NO: 411899 - protein, 9 aa, Homo Sapiens
QLFIHCPMV

SEQ ID NO: 411900 - protein, 9 aa, Homo Sapiens
PPRLRMCSG

SEQ ID NO: 411901 - protein, 9 aa, Homo Sapiens
TARSALPQG

SEQ ID NO: 411902 - protein, 9 aa, Homo Sapiens
PGYPGIPMG

SEQ ID NO: 411903 - protein, 9 aa, Homo Sapiens
MPPTTTPPS

SEQ ID NO: 411904 - protein, 9 aa, Homo Sapiens
KMVDLLVST

SEQ ID NO: 411905 - protein, 9 aa, Homo Sapiens
DVTQRDTCV

SEQ ID NO: 411906 - protein, 9 aa, Homo Sapiens
EHFREDEGF

SEQ ID NO: 411907 - protein, 9 aa, Homo Sapiens
ILSVKRWLG

SEQ ID NO: 411908 - protein, 9 aa, Homo Sapiens
AAPRAHEHV

SEQ ID NO: 411909 - protein, 9 aa, Homo Sapiens
NYNPLPEEQ

SEQ ID NO: 411910 - protein, 9 aa, Homo Sapiens
FITSGITSS

SEQ ID NO: 411911 - protein, 9 aa, Homo Sapiens
ELQSAVEQV

SEQ ID NO: 411912 - protein, 9 aa, Homo Sapiens
QKDDIEVHF

SEQ ID NO: 411913 - protein, 9 aa, Homo Sapiens
QNWGSLPLR

SEQ ID NO: 411914 - protein, 9 aa, Homo Sapiens
NHSSGGYEP

SEQ ID NO: 411915 - protein, 9 aa, Homo Sapiens
SPPSPSRRR

SEQ ID NO: 411916 - protein, 9 aa, Homo Sapiens
RPGWKRTQQ

SEQ ID NO: 411917 - protein, 9 aa, Homo Sapiens
VAVHYTFSG

SEQ ID NO: 411918 - protein, 9 aa, Homo Sapiens
SVIANMVET

SEQ ID NO: 411919 - protein, 9 aa, Homo Sapiens
QRHEMTHTG

SEQ ID NO: 411920 - protein, 9 aa, Homo Sapiens
PISPVSIAT

SEQ ID NO: 411921 - protein, 9 aa, Homo Sapiens
ALMVSAHQQ

SEQ ID NO: 411922 - protein, 9 aa, Homo Sapiens
LGDPEAAAA

SEQ ID NO: 411923 - protein, 9 aa, Homo Sapiens
CTQTMVMGI

SEQ ID NO: 411924 - protein, 9 aa, Homo Sapiens
ELSPVMLLS

SEQ ID NO: 411925 - protein, 9 aa, Homo Sapiens
PRVPRCLGP

SEQ ID NO: 411926 - protein, 9 aa, Homo Sapiens
ALKKGAGGR

SEQ ID NO: 411927 - protein, 9 aa, Homo Sapiens
NWVQMVVEK

SEQ ID NO: 411928 - protein, 9 aa, Homo Sapiens
IIDTKNLYL

SEQ ID NO: 411929 - protein, 9 aa, Homo Sapiens
DPVLLAFHK

SEQ ID NO: 411930 - protein, 9 aa, Homo Sapiens
IKQKRRPYH

SEQ ID NO: 411931 - protein, 9 aa, Homo Sapiens
EAGVTHTAA

SEQ ID NO: 411932 - protein, 9 aa, Homo Sapiens
ASLTIGGWR

SEQ ID NO: 411933 - protein, 9 aa, Homo Sapiens
NWVRPDLSI

SEQ ID NO: 411934 - protein, 9 aa, Homo Sapiens
VRVDTNDMV

SEQ ID NO: 411935 - protein, 9 aa, Homo Sapiens
QTEKEDPVG

SEQ ID NO: 411936 - protein, 9 aa, Homo Sapiens
GEWGVKGAC

SEQ ID NO: 411937 - protein, 9 aa, Homo Sapiens
ICGLHYDIQ

SEQ ID NO: 411938 - protein, 9 aa, Homo Sapiens
DKDWDRKRR

SEQ ID NO: 411939 - protein, 9 aa, Homo Sapiens
YRVLQDKGA

SEQ ID NO: 411940 - protein, 9 aa, Homo Sapiens
CSLLTQPSP

SEQ ID NO: 411941 - protein, 9 aa, Homo Sapiens
GHRVSRLNP

SEQ ID NO: 411942 - protein, 9 aa, Homo Sapiens
QATWCLHRY

SEQ ID NO: 411943 - protein, 9 aa, Homo Sapiens
LHGTMEKSE

SEQ ID NO: 411944 - protein, 9 aa, Homo Sapiens
VIVDPQGWR

SEQ ID NO: 411945 - protein, 9 aa, Homo Sapiens
LINVQQLLV

SEQ ID NO: 411946 - protein, 9 aa, Homo Sapiens
LAQHLARHQ

SEQ ID NO: 411947 - protein, 9 aa, Homo Sapiens
IAGMDPAVH

SEQ ID NO: 411948 - protein, 9 aa, Homo Sapiens
TPMHFTDVD

SEQ ID NO: 411949 - protein, 9 aa, Homo Sapiens
LKSPSCLMD

SEQ ID NO: 411950 - protein, 9 aa, Homo Sapiens
IVNLTESCR

SEQ ID NO: 411951 - protein, 9 aa, Homo Sapiens
GPVWPCWGP

SEQ ID NO: 411952 - protein, 9 aa, Homo Sapiens
FNTETHPLP

SEQ ID NO: 411953 - protein, 9 aa, Homo Sapiens
KLLCRQMLP

SEQ ID NO: 411954 - protein, 9 aa, Homo Sapiens
SAMPGRLFV

SEQ ID NO: 411955 - protein, 9 aa, Homo Sapiens
VLEPGYVDS

SEQ ID NO: 411956 - protein, 9 aa, Homo Sapiens
ILCLIKGAK

SEQ ID NO: 411957 - protein, 9 aa, Homo Sapiens
PPPGPSWTW

SEQ ID NO: 411958 - protein, 9 aa, Homo Sapiens
GRKFYGSEG

SEQ ID NO: 411959 - protein, 9 aa, Homo Sapiens
RNTSLAALF

SEQ ID NO: 411960 - protein, 9 aa, Homo Sapiens
NSAHFNFQG

SEQ ID NO: 411961 - protein, 9 aa, Homo Sapiens
VHLHIDVVT

SEQ ID NO: 411962 - protein, 9 aa, Homo Sapiens
PPRPGYPGI

SEQ ID NO: 411963 - protein, 9 aa, Homo Sapiens
ISCLSVQGS

SEQ ID NO: 411964 - protein, 9 aa, Homo Sapiens
PEPRVPRCL

SEQ ID NO: 411965 - protein, 9 aa, Homo Sapiens
ASSWSRLSL

SEQ ID NO: 411966 - protein, 9 aa, Homo Sapiens
PRAMKNRSR

SEQ ID NO: 411967 - protein, 9 aa, Homo Sapiens
DRCALHGPV

SEQ ID NO: 411968 - protein, 9 aa, Homo Sapiens
DKYTYTKQK

SEQ ID NO: 411969 - protein, 9 aa, Homo Sapiens
RGGGLLVLT

SEQ ID NO: 411970 - protein, 9 aa, Homo Sapiens
VELVKIWKE

SEQ ID NO: 411971 - protein, 9 aa, Homo Sapiens
AYSDLFHSL

SEQ ID NO: 411972 - protein, 9 aa, Homo Sapiens
VLLAVSWGT

SEQ ID NO: 411973 - protein, 9 aa, Homo Sapiens
HTTLLLKAP

SEQ ID NO: 411974 - protein, 9 aa, Homo Sapiens
LGVGGFYYE

SEQ ID NO: 411975 - protein, 9 aa, Homo Sapiens
AQDTYMDSQ

SEQ ID NO: 411976 - protein, 9 aa, Homo Sapiens
VSASILQEL

SEQ ID NO: 411977 - protein, 9 aa, Homo Sapiens
PGWGGQGAR

SEQ ID NO: 411978 - protein, 9 aa, Homo Sapiens
GCLPSPITP

SEQ ID NO: 411979 - protein, 9 aa, Homo Sapiens
SWECCMLVG

SEQ ID NO: 411980 - protein, 9 aa, Homo Sapiens
RNIYIVAGI

SEQ ID NO: 411981 - protein, 9 aa, Homo Sapiens
GVIQNTSPL

SEQ ID NO: 411982 - protein, 9 aa, Homo Sapiens
MEHHCPSAH

SEQ ID NO: 411983 - protein, 9 aa, Homo Sapiens
VMMVMADDN

SEQ ID NO: 411984 - protein, 9 aa, Homo Sapiens
CSGPSTQLV

SEQ ID NO: 411985 - protein, 9 aa, Homo Sapiens
LMIDSKLLK

SEQ ID NO: 411986 - protein, 9 aa, Homo Sapiens
AELLGAGEH

SEQ ID NO: 411987 - protein, 9 aa, Homo Sapiens
CSAPWQKSP

SEQ ID NO: 411988 - protein, 9 aa, Homo Sapiens
PKNCSCFKC

SEQ ID NO: 411989 - protein, 9 aa, Homo Sapiens
RDNKVRELV

SEQ ID NO: 411990 - protein, 9 aa, Homo Sapiens
YCQCRQPLP

SEQ ID NO: 411991 - protein, 9 aa, Homo Sapiens
LPPAPLLHE

SEQ ID NO: 411992 - protein, 9 aa, Homo Sapiens
ALQMKRWEA

SEQ ID NO: 411993 - protein, 9 aa, Homo Sapiens
IISSFAFGL

SEQ ID NO: 411994 - protein, 9 aa, Homo Sapiens
IVTIIATML

SEQ ID NO: 411995 - protein, 9 aa, Homo Sapiens
CFNIICDLL

SEQ ID NO: 411996 - protein, 9 aa, Homo Sapiens
VNAIIAHVL

SEQ ID NO: 411997 - protein, 9 aa, Homo Sapiens
HMLMPDAMC

SEQ ID NO: 411998 - protein, 9 aa, Homo Sapiens
VMVVRPVAT

SEQ ID NO: 411999 - protein, 9 aa, Homo Sapiens
NGKKNAVID

SEQ ID NO: 412000 - protein, 9 aa, Homo Sapiens
GLTISVSSS

SEQ ID NO: 412001 - protein, 9 aa, Homo Sapiens
MMKLKKITI

SEQ ID NO: 412002 - protein, 9 aa, Homo Sapiens
CLHFAVRCV

SEQ ID NO: 412003 - protein, 9 aa, Homo Sapiens
PLVSAGPCV

SEQ ID NO: 412004 - protein, 9 aa, Homo Sapiens
SAMECTPPH

SEQ ID NO: 412005 - protein, 9 aa, Homo Sapiens
LPLLHSNVN

SEQ ID NO: 412006 - protein, 9 aa, Homo Sapiens
QIGNSLENQ

SEQ ID NO: 412007 - protein, 9 aa, Homo Sapiens
GSWGFQEVR

SEQ ID NO: 412008 - protein, 9 aa, Homo Sapiens
KLVLHPPPI

SEQ ID NO: 412009 - protein, 9 aa, Homo Sapiens
SVSRDGGWG

SEQ ID NO: 412010 - protein, 9 aa, Homo Sapiens
AMKNRSRIP

SEQ ID NO: 412011 - protein, 9 aa, Homo Sapiens
MTSGTWSGL

SEQ ID NO: 412012 - protein, 9 aa, Homo Sapiens
SAPFAPSLW

SEQ ID NO: 412013 - protein, 9 aa, Homo Sapiens
EPPRVLSVN

SEQ ID NO: 412014 - protein, 9 aa, Homo Sapiens
LVTSFDHMP

SEQ ID NO: 412015 - protein, 9 aa, Homo Sapiens
PLGAALGVD

SEQ ID NO: 412016 - protein, 9 aa, Homo Sapiens
QCNLAAGPP

SEQ ID NO: 412017 - protein, 9 aa, Homo Sapiens
WQIVDAQAV

SEQ ID NO: 412018 - protein, 9 aa, Homo Sapiens
FLLGHRVVT

SEQ ID NO: 412019 - protein, 9 aa, Homo Sapiens
SARIVVSSA

SEQ ID NO: 412020 - protein, 9 aa, Homo Sapiens
KEKAIDYMS

SEQ ID NO: 412021 - protein, 9 aa, Homo Sapiens
SQPPLHLMY

SEQ ID NO: 412022 - protein, 9 aa, Homo Sapiens
PGCTLVLDT

SEQ ID NO: 412023 - protein, 9 aa, Homo Sapiens
EDIRTKLTD

SEQ ID NO: 412024 - protein, 9 aa, Homo Sapiens
QRMHHQQQQ

SEQ ID NO: 412025 - protein, 9 aa, Homo Sapiens
TLIAHFQTL

SEQ ID NO: 412026 - protein, 9 aa, Homo Sapiens
NEKLKVELQ

SEQ ID NO: 412027 - protein, 9 aa, Homo Sapiens
SSGCTRCTC

SEQ ID NO: 412028 - protein, 9 aa, Homo Sapiens
VMPPTTTPP

SEQ ID NO: 412029 - protein, 9 aa, Homo Sapiens
LRDQDLCRG

SEQ ID NO: 412030 - protein, 9 aa, Homo Sapiens
ALVIVCDDF

SEQ ID NO: 412031 - protein, 9 aa, Homo Sapiens
CGRASSEPH

SEQ ID NO: 412032 - protein, 9 aa, Homo Sapiens
AFIGATFFV

SEQ ID NO: 412033 - protein, 9 aa, Homo Sapiens
CHCARVCRR

SEQ ID NO: 412034 - protein, 9 aa, Homo Sapiens
MIQHEQEGA

SEQ ID NO: 412035 - protein, 9 aa, Homo Sapiens
GPHDLCSPV

SEQ ID NO: 412036 - protein, 9 aa, Homo Sapiens
WLIKKREEL

SEQ ID NO: 412037 - protein, 9 aa, Homo Sapiens
HSLSSTGSL

SEQ ID NO: 412038 - protein, 9 aa, Homo Sapiens
TNMLASVAS

SEQ ID NO: 412039 - protein, 9 aa, Homo Sapiens
HGHVEVVTL

SEQ ID NO: 412040 - protein, 9 aa, Homo Sapiens
GRAPAQPPG

SEQ ID NO: 412041 - protein, 9 aa, Homo Sapiens
SSAQDIVFL

SEQ ID NO: 412042 - protein, 9 aa, Homo Sapiens
SAPAGACAP

SEQ ID NO: 412043 - protein, 9 aa, Homo Sapiens
LTVLLQEVE

SEQ ID NO: 412044 - protein, 9 aa, Homo Sapiens
SSSCCQQPS

SEQ ID NO: 412045 - protein, 9 aa, Homo Sapiens
QLVVLDVKP

SEQ ID NO: 412046 - protein, 9 aa, Homo Sapiens
EILRPRTLQ

SEQ ID NO: 412047 - protein, 9 aa, Homo Sapiens
ACDINTEQG

SEQ ID NO: 412048 - protein, 9 aa, Homo Sapiens
APGAQNPAT

SEQ ID NO: 412049 - protein, 9 aa, Homo Sapiens
VPSNCQELR

SEQ ID NO: 412050 - protein, 9 aa, Homo Sapiens
LVRRFCCFG

SEQ ID NO: 412051 - protein, 9 aa, Homo Sapiens
RDPSECVLS

SEQ ID NO: 412052 - protein, 9 aa, Homo Sapiens
KKAPLPSPM

SEQ ID NO: 412053 - protein, 9 aa, Homo Sapiens
ASEGWHWGA

SEQ ID NO: 412054 - protein, 9 aa, Homo Sapiens
EPGEPGQKD

SEQ ID NO: 412055 - protein, 9 aa, Homo Sapiens
QDLCRGPRL

SEQ ID NO: 412056 - protein, 9 aa, Homo Sapiens
HLFPLTHCC

SEQ ID NO: 412057 - protein, 9 aa, Homo Sapiens
CPGPKVCGL

SEQ ID NO: 412058 - protein, 9 aa, Homo Sapiens
SRADPVRIC

SEQ ID NO: 412059 - protein, 9 aa, Homo Sapiens
MAKPKSQAP

SEQ ID NO: 412060 - protein, 9 aa, Homo Sapiens
KEIVLVDDA

SEQ ID NO: 412061 - protein, 9 aa, Homo Sapiens
LVQLNDEAL

SEQ ID NO: 412062 - protein, 9 aa, Homo Sapiens
GQVHSTGHH

SEQ ID NO: 412063 - protein, 9 aa, Homo Sapiens
IVNTGTSLM

SEQ ID NO: 412064 - protein, 9 aa, Homo Sapiens
RICLLSHLN

SEQ ID NO: 412065 - protein, 9 aa, Homo Sapiens
VSTIDDTVI

SEQ ID NO: 412066 - protein, 9 aa, Homo Sapiens
HCNEGHAPL

SEQ ID NO: 412067 - protein, 9 aa, Homo Sapiens
FLWDVAAGM

SEQ ID NO: 412068 - protein, 9 aa, Homo Sapiens
RCQVLPTDT

SEQ ID NO: 412069 - protein, 9 aa, Homo Sapiens
GSVKDVCTT

SEQ ID NO: 412070 - protein, 9 aa, Homo Sapiens
RGGVWTGAD

SEQ ID NO: 412071 - protein, 9 aa, Homo Sapiens
RWKPCDNGD

SEQ ID NO: 412072 - protein, 9 aa, Homo Sapiens
RKDIEETSL

SEQ ID NO: 412073 - protein, 9 aa, Homo Sapiens
GGWAATVPG

SEQ ID NO: 412074 - protein, 9 aa, Homo Sapiens
IKERSLQSM

SEQ ID NO: 412075 - protein, 9 aa, Homo Sapiens
LRCPAVPAA

SEQ ID NO: 412076 - protein, 9 aa, Homo Sapiens
LSYYKSQGE

SEQ ID NO: 412077 - protein, 9 aa, Homo Sapiens
GFLACVGAD

SEQ ID NO: 412078 - protein, 9 aa, Homo Sapiens
NFQEPDISL

SEQ ID NO: 412079 - protein, 9 aa, Homo Sapiens
IVHNIQASE

SEQ ID NO: 412080 - protein, 9 aa, Homo Sapiens
KEVRIWNCT

SEQ ID NO: 412081 - protein, 9 aa, Homo Sapiens
YPFPNRLEW

SEQ ID NO: 412082 - protein, 9 aa, Homo Sapiens
GFGTITGNT

SEQ ID NO: 412083 - protein, 9 aa, Homo Sapiens
SVIRRQSWL

SEQ ID NO: 412084 - protein, 9 aa, Homo Sapiens
PQPSLPGPC

SEQ ID NO: 412085 - protein, 9 aa, Homo Sapiens
AEVTVAVDV

SEQ ID NO: 412086 - protein, 9 aa, Homo Sapiens
LSGCGQTFE

SEQ ID NO: 412087 - protein, 9 aa, Homo Sapiens
FARVLNENG

SEQ ID NO: 412088 - protein, 9 aa, Homo Sapiens
GQTQKEKKA

SEQ ID NO: 412089 - protein, 9 aa, Homo Sapiens
GMGGTCQQP

SEQ ID NO: 412090 - protein, 9 aa, Homo Sapiens
YDREPQRRS

SEQ ID NO: 412091 - protein, 9 aa, Homo Sapiens
RPPENEAPQ

SEQ ID NO: 412092 - protein, 9 aa, Homo Sapiens
WHDGLDWCN

SEQ ID NO: 412093 - protein, 9 aa, Homo Sapiens
AMFSENRAF

SEQ ID NO: 412094 - protein, 9 aa, Homo Sapiens
LDLPGLSDD

SEQ ID NO: 412095 - protein, 9 aa, Homo Sapiens
TPKPRGGGW

SEQ ID NO: 412096 - protein, 9 aa, Homo Sapiens
SKLLKSNLS

SEQ ID NO: 412097 - protein, 9 aa, Homo Sapiens
LCTASMCSW

SEQ ID NO: 412098 - protein, 9 aa, Homo Sapiens
PLGVTKIDH

SEQ ID NO: 412099 - protein, 9 aa, Homo Sapiens
VVDFDKFSC

SEQ ID NO: 412100 - protein, 9 aa, Homo Sapiens
LCCMLAQRL

SEQ ID NO: 412101 - protein, 9 aa, Homo Sapiens
TPCATSNYT

SEQ ID NO: 412102 - protein, 9 aa, Homo Sapiens
SSPWKALGP

SEQ ID NO: 412103 - protein, 9 aa, Homo Sapiens
SSWSHLFPM

SEQ ID NO: 412104 - protein, 9 aa, Homo Sapiens
LGVGEVVLP

SEQ ID NO: 412105 - protein, 9 aa, Homo Sapiens
YVAEKYVFV

SEQ ID NO: 412106 - protein, 9 aa, Homo Sapiens
SSFGLSDEH

SEQ ID NO: 412107 - protein, 9 aa, Homo Sapiens
TWLSSSGSR

SEQ ID NO: 412108 - protein, 9 aa, Homo Sapiens
RGREKAEQE

SEQ ID NO: 412109 - protein, 9 aa, Homo Sapiens
TWRCCGGHS

SEQ ID NO: 412110 - protein, 9 aa, Homo Sapiens
WHRSDRMMR

SEQ ID NO: 412111 - protein, 9 aa, Homo Sapiens
NESCRLYQF

SEQ ID NO: 412112 - protein, 9 aa, Homo Sapiens
LMRRLVCRL

SEQ ID NO: 412113 - protein, 9 aa, Homo Sapiens
CRYLHDLSG

SEQ ID NO: 412114 - protein, 9 aa, Homo Sapiens
QSSTSILSA

SEQ ID NO: 412115 - protein, 9 aa, Homo Sapiens
VRGREKAEQ

SEQ ID NO: 412116 - protein, 9 aa, Homo Sapiens
FLSSTEGAV

SEQ ID NO: 412117 - protein, 9 aa, Homo Sapiens
LRGSNYHKI

SEQ ID NO: 412118 - protein, 9 aa, Homo Sapiens
LLDIIQKYF

SEQ ID NO: 412119 - protein, 9 aa, Homo Sapiens
GQPLPDVVR

SEQ ID NO: 412120 - protein, 9 aa, Homo Sapiens
YVLVLLSRV

SEQ ID NO: 412121 - protein, 9 aa, Homo Sapiens
MNTASLSQR

SEQ ID NO: 412122 - protein, 9 aa, Homo Sapiens
WRRCARATW

SEQ ID NO: 412123 - protein, 9 aa, Homo Sapiens
ARLLDQLAA

SEQ ID NO: 412124 - protein, 9 aa, Homo Sapiens
SRCQVLPTD

SEQ ID NO: 412125 - protein, 9 aa, Homo Sapiens
YGCAVMDKR

SEQ ID NO: 412126 - protein, 9 aa, Homo Sapiens
TGITVFLTG

SEQ ID NO: 412127 - protein, 9 aa, Homo Sapiens
ASHVGGASA

SEQ ID NO: 412128 - protein, 9 aa, Homo Sapiens
GRAETHLET

SEQ ID NO: 412129 - protein, 9 aa, Homo Sapiens
ILKRCLEPE

SEQ ID NO: 412130 - protein, 9 aa, Homo Sapiens
SAERLQISN

SEQ ID NO: 412131 - protein, 9 aa, Homo Sapiens
LTRLLHDYQ

SEQ ID NO: 412132 - protein, 9 aa, Homo Sapiens
PRELQLLNV

SEQ ID NO: 412133 - protein, 9 aa, Homo Sapiens
NAVHPQRRR

SEQ ID NO: 412134 - protein, 9 aa, Homo Sapiens
TFMPPPGHP

SEQ ID NO: 412135 - protein, 9 aa, Homo Sapiens
MTRNGDLSA

SEQ ID NO: 412136 - protein, 9 aa, Homo Sapiens
GLVKGYDSM

SEQ ID NO: 412137 - protein, 9 aa, Homo Sapiens
GYVDSEIGT

SEQ ID NO: 412138 - protein, 9 aa, Homo Sapiens
RTRWSACLS

SEQ ID NO: 412139 - protein, 9 aa, Homo Sapiens
KKKGQTQKE

SEQ ID NO: 412140 - protein, 9 aa, Homo Sapiens
TVAVRSPST

SEQ ID NO: 412141 - protein, 9 aa, Homo Sapiens
LAKNKPNLH

SEQ ID NO: 412142 - protein, 9 aa, Homo Sapiens
PPVLPWCPP

SEQ ID NO: 412143 - protein, 9 aa, Homo Sapiens
NLGRTDFCP

SEQ ID NO: 412144 - protein, 9 aa, Homo Sapiens
SQQIAEEAL

SEQ ID NO: 412145 - protein, 9 aa, Homo Sapiens
KQISESTKS

SEQ ID NO: 412146 - protein, 9 aa, Homo Sapiens
IPIIYRNLP

SEQ ID NO: 412147 - protein, 9 aa, Homo Sapiens
APRPVCISE

SEQ ID NO: 412148 - protein, 9 aa, Homo Sapiens
SPWEAALRP

SEQ ID NO: 412149 - protein, 9 aa, Homo Sapiens
PLTMRRNSE

SEQ ID NO: 412150 - protein, 9 aa, Homo Sapiens
GLCQGALQG

SEQ ID NO: 412151 - protein, 9 aa, Homo Sapiens
TGEYRMLQT

SEQ ID NO: 412152 - protein, 9 aa, Homo Sapiens
TGVGSPFPV

SEQ ID NO: 412153 - protein, 9 aa, Homo Sapiens
ETSLVKVEL

SEQ ID NO: 412154 - protein, 9 aa, Homo Sapiens
QPPLHLMYP

SEQ ID NO: 412155 - protein, 9 aa, Homo Sapiens
MLGVGGFYY

SEQ ID NO: 412156 - protein, 9 aa, Homo Sapiens
ALATLYVLV

SEQ ID NO: 412157 - protein, 9 aa, Homo Sapiens
KLKVELQSA

SEQ ID NO: 412158 - protein, 9 aa, Homo Sapiens
APAGACAPI

SEQ ID NO: 412159 - protein, 9 aa, Homo Sapiens
DFYFIDFQR

SEQ ID NO: 412160 - protein, 9 aa, Homo Sapiens
EIERRKLEK

SEQ ID NO: 412161 - protein, 9 aa, Homo Sapiens
DVSSMSLRS

SEQ ID NO: 412162 - protein, 9 aa, Homo Sapiens
ASYDVPTIS

SEQ ID NO: 412163 - protein, 9 aa, Homo Sapiens
LLYHEPLED

SEQ ID NO: 412164 - protein, 9 aa, Homo Sapiens
PPSSGFPCP

SEQ ID NO: 412165 - protein, 9 aa, Homo Sapiens
RVSAVSGEV

SEQ ID NO: 412166 - protein, 9 aa, Homo Sapiens
RGRPAAEGL

SEQ ID NO: 412167 - protein, 9 aa, Homo Sapiens
FHHFVPEHH

SEQ ID NO: 412168 - protein, 9 aa, Homo Sapiens
CTFRNFTSV

SEQ ID NO: 412169 - protein, 9 aa, Homo Sapiens
PRNKMPTWL

SEQ ID NO: 412170 - protein, 9 aa, Homo Sapiens
PYQDWAAQE

SEQ ID NO: 412171 - protein, 9 aa, Homo Sapiens
GRYPHIKDS

SEQ ID NO: 412172 - protein, 9 aa, Homo Sapiens
RIESKSISA

SEQ ID NO: 412173 - protein, 9 aa, Homo Sapiens
STHWPSRAS

SEQ ID NO: 412174 - protein, 9 aa, Homo Sapiens
EVIQSGQKL

SEQ ID NO: 412175 - protein, 9 aa, Homo Sapiens
NRAIQLKPN

SEQ ID NO: 412176 - protein, 9 aa, Homo Sapiens
TIHPQKSYK

SEQ ID NO: 412177 - protein, 9 aa, Homo Sapiens
SASMDGQVM

SEQ ID NO: 412178 - protein, 9 aa, Homo Sapiens
WINDISLGE

SEQ ID NO: 412179 - protein, 9 aa, Homo Sapiens
AEALPAWHP

SEQ ID NO: 412180 - protein, 9 aa, Homo Sapiens
KDTMSDLTR

SEQ ID NO: 412181 - protein, 9 aa, Homo Sapiens
LLVVQAPAE

SEQ ID NO: 412182 - protein, 9 aa, Homo Sapiens
PIVKKGEEG

SEQ ID NO: 412183 - protein, 9 aa, Homo Sapiens
PCLEAEGGL

SEQ ID NO: 412184 - protein, 9 aa, Homo Sapiens
VLLLGVPQT

SEQ ID NO: 412185 - protein, 9 aa, Homo Sapiens
LLSPCNASI

SEQ ID NO: 412186 - protein, 9 aa, Homo Sapiens
KAMTEMNGH

SEQ ID NO: 412187 - protein, 9 aa, Homo Sapiens
TPNKFATLS

SEQ ID NO: 412188 - protein, 9 aa, Homo Sapiens
GGGGSGGHS

SEQ ID NO: 412189 - protein, 9 aa, Homo Sapiens
MPPLLHPQW

SEQ ID NO: 412190 - protein, 9 aa, Homo Sapiens
QALLEQYQV

SEQ ID NO: 412191 - protein, 9 aa, Homo Sapiens
LVREQLWVN

SEQ ID NO: 412192 - protein, 9 aa, Homo Sapiens
RSQGYLFPH

SEQ ID NO: 412193 - protein, 9 aa, Homo Sapiens
RPAAEGLRP

SEQ ID NO: 412194 - protein, 9 aa, Homo Sapiens
ERCLESLCE

SEQ ID NO: 412195 - protein, 9 aa, Homo Sapiens
CHQTAIIGG

SEQ ID NO: 412196 - protein, 9 aa, Homo Sapiens
GLAVVGVFF

SEQ ID NO: 412197 - protein, 9 aa, Homo Sapiens
IKDVLTVIM

SEQ ID NO: 412198 - protein, 9 aa, Homo Sapiens
REVAEAAAV

SEQ ID NO: 412199 - protein, 9 aa, Homo Sapiens
AAGALLRLL

SEQ ID NO: 412200 - protein, 9 aa, Homo Sapiens
KGKLKNQIR

SEQ ID NO: 412201 - protein, 9 aa, Homo Sapiens
LNMDFWRLW

SEQ ID NO: 412202 - protein, 9 aa, Homo Sapiens
CLTLDHRLN

SEQ ID NO: 412203 - protein, 9 aa, Homo Sapiens
LLVSSSAQA

SEQ ID NO: 412204 - protein, 9 aa, Homo Sapiens
DRLEVWLVE

SEQ ID NO: 412205 - protein, 9 aa, Homo Sapiens
MVRARGSPC

SEQ ID NO: 412206 - protein, 9 aa, Homo Sapiens
IERIDGMSL

SEQ ID NO: 412207 - protein, 9 aa, Homo Sapiens
ATVPRHSSV

SEQ ID NO: 412208 - protein, 9 aa, Homo Sapiens
SLRGDNDDG

SEQ ID NO: 412209 - protein, 9 aa, Homo Sapiens
LPSRWCQPR

SEQ ID NO: 412210 - protein, 9 aa, Homo Sapiens
VAPLYDTLG

SEQ ID NO: 412211 - protein, 9 aa, Homo Sapiens
RMLDHNCDT

SEQ ID NO: 412212 - protein, 9 aa, Homo Sapiens
HTGVGSPFP

SEQ ID NO: 412213 - protein, 9 aa, Homo Sapiens
LMVPDGWKE

SEQ ID NO: 412214 - protein, 9 aa, Homo Sapiens
YVVIRIFCL

SEQ ID NO: 412215 - protein, 9 aa, Homo Sapiens
DHLLADGVC

SEQ ID NO: 412216 - protein, 9 aa, Homo Sapiens
IGAHQQQVT

SEQ ID NO: 412217 - protein, 9 aa, Homo Sapiens
SETDDDDSH

SEQ ID NO: 412218 - protein, 9 aa, Homo Sapiens
HSLAWERTP

SEQ ID NO: 412219 - protein, 9 aa, Homo Sapiens
VQPPEPASG

SEQ ID NO: 412220 - protein, 9 aa, Homo Sapiens
LHYTLVMNQ

SEQ ID NO: 412221 - protein, 9 aa, Homo Sapiens
SSLPGGTDT

SEQ ID NO: 412222 - protein, 9 aa, Homo Sapiens
VFISSGRPP

SEQ ID NO: 412223 - protein, 9 aa, Homo Sapiens
RPSFPAQPP

SEQ ID NO: 412224 - protein, 9 aa, Homo Sapiens
KMAVTASSE

SEQ ID NO: 412225 - protein, 9 aa, Homo Sapiens
GQDVEVDEV

SEQ ID NO: 412226 - protein, 9 aa, Homo Sapiens
WWEFPLGGT

SEQ ID NO: 412227 - protein, 9 aa, Homo Sapiens
KLVSFLKKV

SEQ ID NO: 412228 - protein, 9 aa, Homo Sapiens
LVSEAVPSS

SEQ ID NO: 412229 - protein, 9 aa, Homo Sapiens
CRDDPGVGS

SEQ ID NO: 412230 - protein, 9 aa, Homo Sapiens
LMPYFAMEI

SEQ ID NO: 412231 - protein, 9 aa, Homo Sapiens
LQDNKDPML

SEQ ID NO: 412232 - protein, 9 aa, Homo Sapiens
WFAFFCICT

SEQ ID NO: 412233 - protein, 9 aa, Homo Sapiens
QCVGRRRQW

SEQ ID NO: 412234 - protein, 9 aa, Homo Sapiens
VLDVKPQGL

SEQ ID NO: 412235 - protein, 9 aa, Homo Sapiens
APLQPAFGR

SEQ ID NO: 412236 - protein, 9 aa, Homo Sapiens
GGGGYNHSS

SEQ ID NO: 412237 - protein, 9 aa, Homo Sapiens
QLAAQGAGG

SEQ ID NO: 412238 - protein, 9 aa, Homo Sapiens
RGAQQSCRG

SEQ ID NO: 412239 - protein, 9 aa, Homo Sapiens
NGEVLPIPG

SEQ ID NO: 412240 - protein, 9 aa, Homo Sapiens
EDIKDVLTV

SEQ ID NO: 412241 - protein, 9 aa, Homo Sapiens
ELSTKSMME

SEQ ID NO: 412242 - protein, 9 aa, Homo Sapiens
EGPVKSFSL

SEQ ID NO: 412243 - protein, 9 aa, Homo Sapiens
TTCRSCSKT

SEQ ID NO: 412244 - protein, 9 aa, Homo Sapiens
TAEWSHSNL

SEQ ID NO: 412245 - protein, 9 aa, Homo Sapiens
IERGEDPPQ

SEQ ID NO: 412246 - protein, 9 aa, Homo Sapiens
LRILLCRPG

SEQ ID NO: 412247 - protein, 9 aa, Homo Sapiens
LVVRVDTND

SEQ ID NO: 412248 - protein, 9 aa, Homo Sapiens
AQGTRRSSN

SEQ ID NO: 412249 - protein, 9 aa, Homo Sapiens
WLHLAKDIL

SEQ ID NO: 412250 - protein, 9 aa, Homo Sapiens
PETRVPVPR

SEQ ID NO: 412251 - protein, 9 aa, Homo Sapiens
KMGSYGALA

SEQ ID NO: 412252 - protein, 9 aa, Homo Sapiens
PFSSSSSVL

SEQ ID NO: 412253 - protein, 9 aa, Homo Sapiens
VLGITVLGS

SEQ ID NO: 412254 - protein, 9 aa, Homo Sapiens
ETEPAGAPP

SEQ ID NO: 412255 - protein, 9 aa, Homo Sapiens
PRNAGKLSP

SEQ ID NO: 412256 - protein, 9 aa, Homo Sapiens
ASTSYYRRD

SEQ ID NO: 412257 - protein, 9 aa, Homo Sapiens
AAPRATPSP

SEQ ID NO: 412258 - protein, 9 aa, Homo Sapiens
RPSRACDIN

SEQ ID NO: 412259 - protein, 9 aa, Homo Sapiens
GKRVCWEFV

SEQ ID NO: 412260 - protein, 9 aa, Homo Sapiens
FKMLSVHNI

SEQ ID NO: 412261 - protein, 9 aa, Homo Sapiens
LLGPPPPHQ

SEQ ID NO: 412262 - protein, 9 aa, Homo Sapiens
STLEHHLSH

SEQ ID NO: 412263 - protein, 9 aa, Homo Sapiens
APFFVPMSL

SEQ ID NO: 412264 - protein, 9 aa, Homo Sapiens
IAVLEYMPA

SEQ ID NO: 412265 - protein, 9 aa, Homo Sapiens
QEMQEKLAR

SEQ ID NO: 412266 - protein, 9 aa, Homo Sapiens
VPCLCLEEP

SEQ ID NO: 412267 - protein, 9 aa, Homo Sapiens
QDILDNSGY

SEQ ID NO: 412268 - protein, 9 aa, Homo Sapiens
TPPMPMAMV

SEQ ID NO: 412269 - protein, 9 aa, Homo Sapiens
YEETRGLNI

SEQ ID NO: 412270 - protein, 9 aa, Homo Sapiens
ARASEKSPS

SEQ ID NO: 412271 - protein, 9 aa, Homo Sapiens
LDNKLNVEG

SEQ ID NO: 412272 - protein, 9 aa, Homo Sapiens
MKEDIPWML

SEQ ID NO: 412273 - protein, 9 aa, Homo Sapiens
KENQKEQTA

SEQ ID NO: 412274 - protein, 9 aa, Homo Sapiens
SFSINTAWS

SEQ ID NO: 412275 - protein, 9 aa, Homo Sapiens
NNLQVWNCP

SEQ ID NO: 412276 - protein, 9 aa, Homo Sapiens
PKLLLTLSS

SEQ ID NO: 412277 - protein, 9 aa, Homo Sapiens
TLYAASCLL

SEQ ID NO: 412278 - protein, 9 aa, Homo Sapiens
SVQQTQAPA

SEQ ID NO: 412279 - protein, 9 aa, Homo Sapiens
RREGIRWLQ

SEQ ID NO: 412280 - protein, 9 aa, Homo Sapiens
AANEDIRTK

SEQ ID NO: 412281 - protein, 9 aa, Homo Sapiens
IVLEIIEHP

SEQ ID NO: 412282 - protein, 9 aa, Homo Sapiens
SLQALDEVI

SEQ ID NO: 412283 - protein, 9 aa, Homo Sapiens
LVQKHLTTP

SEQ ID NO: 412284 - protein, 9 aa, Homo Sapiens
GLNISCLSV

SEQ ID NO: 412285 - protein, 9 aa, Homo Sapiens
RDVLPGVDA

SEQ ID NO: 412286 - protein, 9 aa, Homo Sapiens
SHYLKDVKQ

SEQ ID NO: 412287 - protein, 9 aa, Homo Sapiens
ETSMSDHSM

SEQ ID NO: 412288 - protein, 9 aa, Homo Sapiens
DTYSSSILS

SEQ ID NO: 412289 - protein, 9 aa, Homo Sapiens
REFSGSDGG

SEQ ID NO: 412290 - protein, 9 aa, Homo Sapiens
PRRNSQQYE

SEQ ID NO: 412291 - protein, 9 aa, Homo Sapiens
VKQMTDMLL

SEQ ID NO: 412292 - protein, 9 aa, Homo Sapiens
DLTRLLHDY

SEQ ID NO: 412293 - protein, 9 aa, Homo Sapiens
SLVALAFLQ

SEQ ID NO: 412294 - protein, 9 aa, Homo Sapiens
HHPHDQATS

SEQ ID NO: 412295 - protein, 9 aa, Homo Sapiens
GDMATGCRA

SEQ ID NO: 412296 - protein, 9 aa, Homo Sapiens
KEEADYGAF

SEQ ID NO: 412297 - protein, 9 aa, Homo Sapiens
LLGAASSPA

SEQ ID NO: 412298 - protein, 9 aa, Homo Sapiens
YHEETPELG

SEQ ID NO: 412299 - protein, 9 aa, Homo Sapiens
GDGYMQADA

SEQ ID NO: 412300 - protein, 9 aa, Homo Sapiens
WPPWEPKPP

SEQ ID NO: 412301 - protein, 9 aa, Homo Sapiens
IHIEDLPEK

SEQ ID NO: 412302 - protein, 9 aa, Homo Sapiens
TNQLCHCAR

SEQ ID NO: 412303 - protein, 9 aa, Homo Sapiens
RMGRKRRKR

SEQ ID NO: 412304 - protein, 9 aa, Homo Sapiens
ALRKDIEET

SEQ ID NO: 412305 - protein, 9 aa, Homo Sapiens
RTCPQGARM

SEQ ID NO: 412306 - protein, 9 aa, Homo Sapiens
FYPFPNRLE

SEQ ID NO: 412307 - protein, 9 aa, Homo Sapiens
LFMTMGMQT

SEQ ID NO: 412308 - protein, 9 aa, Homo Sapiens
GNSTGEKDQ

SEQ ID NO: 412309 - protein, 9 aa, Homo Sapiens
SPWKALGPM

SEQ ID NO: 412310 - protein, 9 aa, Homo Sapiens
VRRAHEGLP

SEQ ID NO: 412311 - protein, 9 aa, Homo Sapiens
EHLEPTQKN

SEQ ID NO: 412312 - protein, 9 aa, Homo Sapiens
TTGHAPRLW

SEQ ID NO: 412313 - protein, 9 aa, Homo Sapiens
SGFGFHSTQ

SEQ ID NO: 412314 - protein, 9 aa, Homo Sapiens
VIIISMHFA

SEQ ID NO: 412315 - protein, 9 aa, Homo Sapiens
RRAPPRSGR

SEQ ID NO: 412316 - protein, 9 aa, Homo Sapiens
ASLLGPPPR

SEQ ID NO: 412317 - protein, 9 aa, Homo Sapiens
SWWWRRGAL

SEQ ID NO: 412318 - protein, 9 aa, Homo Sapiens
PPRTWVPGV

SEQ ID NO: 412319 - protein, 9 aa, Homo Sapiens
CERAKAGYS

SEQ ID NO: 412320 - protein, 9 aa, Homo Sapiens
SLFLQGLSL

SEQ ID NO: 412321 - protein, 9 aa, Homo Sapiens
TYVKWLHLL

SEQ ID NO: 412322 - protein, 9 aa, Homo Sapiens
HWPLVALQQ

SEQ ID NO: 412323 - protein, 9 aa, Homo Sapiens
NLHPEEALQ

SEQ ID NO: 412324 - protein, 9 aa, Homo Sapiens
AQPPARLPG

SEQ ID NO: 412325 - protein, 9 aa, Homo Sapiens
PAQTPRNTR

SEQ ID NO: 412326 - protein, 9 aa, Homo Sapiens
SICGLPVHS

SEQ ID NO: 412327 - protein, 9 aa, Homo Sapiens
MSPFNMEGY

SEQ ID NO: 412328 - protein, 9 aa, Homo Sapiens
KALTHLDLS

SEQ ID NO: 412329 - protein, 9 aa, Homo Sapiens
AEEATDPVP

SEQ ID NO: 412330 - protein, 9 aa, Homo Sapiens
TDTMSASTE

SEQ ID NO: 412331 - protein, 9 aa, Homo Sapiens
TLLLVSYQE

SEQ ID NO: 412332 - protein, 9 aa, Homo Sapiens
QPRLAPERA

SEQ ID NO: 412333 - protein, 9 aa, Homo Sapiens
VGVTAVETS

SEQ ID NO: 412334 - protein, 9 aa, Homo Sapiens
TMGPRPATA

SEQ ID NO: 412335 - protein, 9 aa, Homo Sapiens
HVWKVTVLR

SEQ ID NO: 412336 - protein, 9 aa, Homo Sapiens
AWKICERVH

SEQ ID NO: 412337 - protein, 9 aa, Homo Sapiens
MEGPLFCRV

SEQ ID NO: 412338 - protein, 9 aa, Homo Sapiens
LENQSILVL

SEQ ID NO: 412339 - protein, 9 aa, Homo Sapiens
EFHHVCTLK

SEQ ID NO: 412340 - protein, 9 aa, Homo Sapiens
PGEKKSQAS

SEQ ID NO: 412341 - protein, 9 aa, Homo Sapiens
LHRQISLPL

SEQ ID NO: 412342 - protein, 9 aa, Homo Sapiens
ESIRVDTHD

SEQ ID NO: 412343 - protein, 9 aa, Homo Sapiens
KKEMMKLMN

SEQ ID NO: 412344 - protein, 9 aa, Homo Sapiens
MTGESFPIK

SEQ ID NO: 412345 - protein, 9 aa, Homo Sapiens
RWRMSTWPS

SEQ ID NO: 412346 - protein, 9 aa, Homo Sapiens
VLPWCPPRT

SEQ ID NO: 412347 - protein, 9 aa, Homo Sapiens
RRDWGTMAE

SEQ ID NO: 412348 - protein, 9 aa, Homo Sapiens
CRCCSLQSW

SEQ ID NO: 412349 - protein, 9 aa, Homo Sapiens
GAYLNLRPP

SEQ ID NO: 412350 - protein, 9 aa, Homo Sapiens
EHPFQVPHP

SEQ ID NO: 412351 - protein, 9 aa, Homo Sapiens
GSDLVQLLL

SEQ ID NO: 412352 - protein, 9 aa, Homo Sapiens
PNPDRFYQQ

SEQ ID NO: 412353 - protein, 9 aa, Homo Sapiens
LIGLPLLIP

SEQ ID NO: 412354 - protein, 9 aa, Homo Sapiens
AAFWRSFCL

SEQ ID NO: 412355 - protein, 9 aa, Homo Sapiens
QARRQEQLL

SEQ ID NO: 412356 - protein, 9 aa, Homo Sapiens
GRHPGAQPS

SEQ ID NO: 412357 - protein, 9 aa, Homo Sapiens
KLEKTTPSS

SEQ ID NO: 412358 - protein, 9 aa, Homo Sapiens
RAPQHESSD

SEQ ID NO: 412359 - protein, 9 aa, Homo Sapiens
RGLTINSLA

SEQ ID NO: 412360 - protein, 9 aa, Homo Sapiens
VETKVRTKI

SEQ ID NO: 412361 - protein, 9 aa, Homo Sapiens
SLSRKSPSH

SEQ ID NO: 412362 - protein, 9 aa, Homo Sapiens
QTSLQLLIP

SEQ ID NO: 412363 - protein, 9 aa, Homo Sapiens
LQQQTMAVK

SEQ ID NO: 412364 - protein, 9 aa, Homo Sapiens
SPPKHTFEV

SEQ ID NO: 412365 - protein, 9 aa, Homo Sapiens
RRHYDGAVQ

SEQ ID NO: 412366 - protein, 9 aa, Homo Sapiens
QWEKTRWLN

SEQ ID NO: 412367 - protein, 9 aa, Homo Sapiens
PATPYSATG

SEQ ID NO: 412368 - protein, 9 aa, Homo Sapiens
PGPARQPQP

SEQ ID NO: 412369 - protein, 9 aa, Homo Sapiens
CTFKILVQC

SEQ ID NO: 412370 - protein, 9 aa, Homo Sapiens
GLYALMSQC

SEQ ID NO: 412371 - protein, 9 aa, Homo Sapiens
EFPHVLSPV

SEQ ID NO: 412372 - protein, 9 aa, Homo Sapiens
EKSTMESGE

SEQ ID NO: 412373 - protein, 9 aa, Homo Sapiens
PRARCARLS

SEQ ID NO: 412374 - protein, 9 aa, Homo Sapiens
QALVQQGDD

SEQ ID NO: 412375 - protein, 9 aa, Homo Sapiens
FYGSEGPYG

SEQ ID NO: 412376 - protein, 9 aa, Homo Sapiens
RSPRTRPRT

SEQ ID NO: 412377 - protein, 9 aa, Homo Sapiens
IEFRPVDCA

SEQ ID NO: 412378 - protein, 9 aa, Homo Sapiens
WREEVQGVR

SEQ ID NO: 412379 - protein, 9 aa, Homo Sapiens
GKRCPPRAP

SEQ ID NO: 412380 - protein, 9 aa, Homo Sapiens
VVAKGTLHH

SEQ ID NO: 412381 - protein, 9 aa, Homo Sapiens
LGPSICVFL

SEQ ID NO: 412382 - protein, 9 aa, Homo Sapiens
WTRGDFVSS

SEQ ID NO: 412383 - protein, 9 aa, Homo Sapiens
LPLSLQWNM

SEQ ID NO: 412384 - protein, 9 aa, Homo Sapiens
TRRPRRRRR

SEQ ID NO: 412385 - protein, 9 aa, Homo Sapiens
LWVLAPPRC

SEQ ID NO: 412386 - protein, 9 aa, Homo Sapiens
PSFMGMQEK

SEQ ID NO: 412387 - protein, 9 aa, Homo Sapiens
GDLLAVPQV

SEQ ID NO: 412388 - protein, 9 aa, Homo Sapiens
QTPRNTRAG

SEQ ID NO: 412389 - protein, 9 aa, Homo Sapiens
VNTDLGYEV

SEQ ID NO: 412390 - protein, 9 aa, Homo Sapiens
GIFEPSIRG

SEQ ID NO: 412391 - protein, 9 aa, Homo Sapiens
RQRSGPATW

SEQ ID NO: 412392 - protein, 9 aa, Homo Sapiens
PGGSARIVV

SEQ ID NO: 412393 - protein, 9 aa, Homo Sapiens
PVWPCWGPH

SEQ ID NO: 412394 - protein, 9 aa, Homo Sapiens
GYQIAYHLA

SEQ ID NO: 412395 - protein, 9 aa, Homo Sapiens
ALVLHHAAG

SEQ ID NO: 412396 - protein, 9 aa, Homo Sapiens
RPPQPWRPH

SEQ ID NO: 412397 - protein, 9 aa, Homo Sapiens
WERSPGHPR

SEQ ID NO: 412398 - protein, 9 aa, Homo Sapiens
DLQLTVGRA

SEQ ID NO: 412399 - protein, 9 aa, Homo Sapiens
SIRIPRATS

SEQ ID NO: 412400 - protein, 9 aa, Homo Sapiens
QNHLLGPRP

SEQ ID NO: 412401 - protein, 9 aa, Homo Sapiens
ELETRDQAF

SEQ ID NO: 412402 - protein, 9 aa, Homo Sapiens
PPALWMARR

SEQ ID NO: 412403 - protein, 9 aa, Homo Sapiens
AEDDLKKKA

SEQ ID NO: 412404 - protein, 9 aa, Homo Sapiens
NLYLLAFKK

SEQ ID NO: 412405 - protein, 9 aa, Homo Sapiens
CVSTPGPAS

SEQ ID NO: 412406 - protein, 9 aa, Homo Sapiens
TVTGESPPA

SEQ ID NO: 412407 - protein, 9 aa, Homo Sapiens
KGPWPLEEV

SEQ ID NO: 412408 - protein, 9 aa, Homo Sapiens
SIISSFAFG

SEQ ID NO: 412409 - protein, 9 aa, Homo Sapiens
LNFLIGHLL

SEQ ID NO: 412410 - protein, 9 aa, Homo Sapiens
RTESSQPRG

SEQ ID NO: 412411 - protein, 9 aa, Homo Sapiens
CAGGGVGEP

SEQ ID NO: 412412 - protein, 9 aa, Homo Sapiens
TRSRVVGRC

SEQ ID NO: 412413 - protein, 9 aa, Homo Sapiens
NCQSPFSQL

SEQ ID NO: 412414 - protein, 9 aa, Homo Sapiens
RIAGMDPAV

SEQ ID NO: 412415 - protein, 9 aa, Homo Sapiens
VRQVDRMEH

SEQ ID NO: 412416 - protein, 9 aa, Homo Sapiens
QIYQHVHSA

SEQ ID NO: 412417 - protein, 9 aa, Homo Sapiens
VEGGCTQDL

SEQ ID NO: 412418 - protein, 9 aa, Homo Sapiens
YRDACGRAS

SEQ ID NO: 412419 - protein, 9 aa, Homo Sapiens
HLRCRDDPG

SEQ ID NO: 412420 - protein, 9 aa, Homo Sapiens
NLSWCCAET

SEQ ID NO: 412421 - protein, 9 aa, Homo Sapiens
QDLNMDCII

SEQ ID NO: 412422 - protein, 9 aa, Homo Sapiens
KWRHMLVIF

SEQ ID NO: 412423 - protein, 9 aa, Homo Sapiens
STQDSALLY

SEQ ID NO: 412424 - protein, 9 aa, Homo Sapiens
NRPASSTKD

SEQ ID NO: 412425 - protein, 9 aa, Homo Sapiens
NPQCHQDHP

SEQ ID NO: 412426 - protein, 9 aa, Homo Sapiens
PACVPVAEA

SEQ ID NO: 412427 - protein, 9 aa, Homo Sapiens
KDKDWDRKR

SEQ ID NO: 412428 - protein, 9 aa, Homo Sapiens
ISKSEIKSI

SEQ ID NO: 412429 - protein, 9 aa, Homo Sapiens
VAPNSLKGS

SEQ ID NO: 412430 - protein, 9 aa, Homo Sapiens
PPAWTCSSG

SEQ ID NO: 412431 - protein, 9 aa, Homo Sapiens
LRSAPGATP

SEQ ID NO: 412432 - protein, 9 aa, Homo Sapiens
TMEKSEGMK

SEQ ID NO: 412433 - protein, 9 aa, Homo Sapiens
FVPMSLACS

SEQ ID NO: 412434 - protein, 9 aa, Homo Sapiens
DLLSMLCMN

SEQ ID NO: 412435 - protein, 9 aa, Homo Sapiens
DLYQAIATI

SEQ ID NO: 412436 - protein, 9 aa, Homo Sapiens
VHQHSYHLS

SEQ ID NO: 412437 - protein, 9 aa, Homo Sapiens
KEITCDIKQ

SEQ ID NO: 412438 - protein, 9 aa, Homo Sapiens
PPSWPDGWA

SEQ ID NO: 412439 - protein, 9 aa, Homo Sapiens
AWAWHWPLV

SEQ ID NO: 412440 - protein, 9 aa, Homo Sapiens
NTETHPLPI

SEQ ID NO: 412441 - protein, 9 aa, Homo Sapiens
ISLKNGVST

SEQ ID NO: 412442 - protein, 9 aa, Homo Sapiens
LIAPVAIRD

SEQ ID NO: 412443 - protein, 9 aa, Homo Sapiens
PQGLHDGGP

SEQ ID NO: 412444 - protein, 9 aa, Homo Sapiens
SCHPATLDT

SEQ ID NO: 412445 - protein, 9 aa, Homo Sapiens
CEKESECEV

SEQ ID NO: 412446 - protein, 9 aa, Homo Sapiens
AIVHRFARH

SEQ ID NO: 412447 - protein, 9 aa, Homo Sapiens
EFIHTGKKH

SEQ ID NO: 412448 - protein, 9 aa, Homo Sapiens
QYKCLDESS

SEQ ID NO: 412449 - protein, 9 aa, Homo Sapiens
GQQAHEYQE

SEQ ID NO: 412450 - protein, 9 aa, Homo Sapiens
SNDVHVWVQ

SEQ ID NO: 412451 - protein, 9 aa, Homo Sapiens
RDCGIRTSV

SEQ ID NO: 412452 - protein, 9 aa, Homo Sapiens
PLYMALAQR

SEQ ID NO: 412453 - protein, 9 aa, Homo Sapiens
EYVKLVKQG

SEQ ID NO: 412454 - protein, 9 aa, Homo Sapiens
RRSSNKPLR

SEQ ID NO: 412455 - protein, 9 aa, Homo Sapiens
SGQRIEAKS

SEQ ID NO: 412456 - protein, 9 aa, Homo Sapiens
QGQDGSPVI

SEQ ID NO: 412457 - protein, 9 aa, Homo Sapiens
VPPLPATTS

SEQ ID NO: 412458 - protein, 9 aa, Homo Sapiens
YDRIIDQTN

SEQ ID NO: 412459 - protein, 9 aa, Homo Sapiens
SPGCPLRGG

SEQ ID NO: 412460 - protein, 9 aa, Homo Sapiens
WERTPLVGK

SEQ ID NO: 412461 - protein, 9 aa, Homo Sapiens
DEYMHNFSD

SEQ ID NO: 412462 - protein, 9 aa, Homo Sapiens
KKSSHCLLT

SEQ ID NO: 412463 - protein, 9 aa, Homo Sapiens
FAATIRLLV

SEQ ID NO: 412464 - protein, 9 aa, Homo Sapiens
MVELVKIWK

SEQ ID NO: 412465 - protein, 9 aa, Homo Sapiens
YEEDSHYLH

SEQ ID NO: 412466 - protein, 9 aa, Homo Sapiens
KMSDAADDI

SEQ ID NO: 412467 - protein, 9 aa, Homo Sapiens
HPLNPDWCL

SEQ ID NO: 412468 - protein, 9 aa, Homo Sapiens
PGVLTWRFC

SEQ ID NO: 412469 - protein, 9 aa, Homo Sapiens
QTHLYTCGT

SEQ ID NO: 412470 - protein, 9 aa, Homo Sapiens
AGGRQKKGV

SEQ ID NO: 412471 - protein, 9 aa, Homo Sapiens
PSSSVVMMV

SEQ ID NO: 412472 - protein, 9 aa, Homo Sapiens
APHPARTQT

SEQ ID NO: 412473 - protein, 9 aa, Homo Sapiens
LATAGALLF

SEQ ID NO: 412474 - protein, 9 aa, Homo Sapiens
ESQEMCPRD

SEQ ID NO: 412475 - protein, 9 aa, Homo Sapiens
HYIGDLRAI

SEQ ID NO: 412476 - protein, 9 aa, Homo Sapiens
LLKQFLGNC

SEQ ID NO: 412477 - protein, 9 aa, Homo Sapiens
SWSRLSLHG

SEQ ID NO: 412478 - protein, 9 aa, Homo Sapiens
RVVPRTPSG

SEQ ID NO: 412479 - protein, 9 aa, Homo Sapiens
VLTREELET

SEQ ID NO: 412480 - protein, 9 aa, Homo Sapiens
VPQTVKSAS

SEQ ID NO: 412481 - protein, 9 aa, Homo Sapiens
SMCITEIDL

SEQ ID NO: 412482 - protein, 9 aa, Homo Sapiens
QIKWDPQEL

SEQ ID NO: 412483 - protein, 9 aa, Homo Sapiens
SSPGALEVL

SEQ ID NO: 412484 - protein, 9 aa, Homo Sapiens
TTLLLILLI

SEQ ID NO: 412485 - protein, 9 aa, Homo Sapiens
QAPQVAMLP

SEQ ID NO: 412486 - protein, 9 aa, Homo Sapiens
RISRAQYNV

SEQ ID NO: 412487 - protein, 9 aa, Homo Sapiens
PQQALQDDG

SEQ ID NO: 412488 - protein, 9 aa, Homo Sapiens
LPQCGAGSH

SEQ ID NO: 412489 - protein, 9 aa, Homo Sapiens
EFNYSGDLA

SEQ ID NO: 412490 - protein, 9 aa, Homo Sapiens
VWKVTVLRV

SEQ ID NO: 412491 - protein, 9 aa, Homo Sapiens
RAPCTRLAR

SEQ ID NO: 412492 - protein, 9 aa, Homo Sapiens
HPLVLPNKL

SEQ ID NO: 412493 - protein, 9 aa, Homo Sapiens
PTQPKQAAE

SEQ ID NO: 412494 - protein, 9 aa, Homo Sapiens
MMTLIRTKS

SEQ ID NO: 412495 - protein, 9 aa, Homo Sapiens
PVSIATRSP

SEQ ID NO: 412496 - protein, 9 aa, Homo Sapiens
EERYELPNV

SEQ ID NO: 412497 - protein, 9 aa, Homo Sapiens
SQLRGEREE

SEQ ID NO: 412498 - protein, 9 aa, Homo Sapiens
LNLRPPAPE

SEQ ID NO: 412499 - protein, 9 aa, Homo Sapiens
GATQFTQSR

SEQ ID NO: 412500 - protein, 9 aa, Homo Sapiens
PAPMCNPNK

SEQ ID NO: 412501 - protein, 9 aa, Homo Sapiens
REGLIVAVH

SEQ ID NO: 412502 - protein, 9 aa, Homo Sapiens
DPLSWSKTE

SEQ ID NO: 412503 - protein, 9 aa, Homo Sapiens
AVHYTFSGW

SEQ ID NO: 412504 - protein, 9 aa, Homo Sapiens
EISLLHVWK

SEQ ID NO: 412505 - protein, 9 aa, Homo Sapiens
GGESEGKRG

SEQ ID NO: 412506 - protein, 9 aa, Homo Sapiens
QLGDEAMEH

SEQ ID NO: 412507 - protein, 9 aa, Homo Sapiens
RSGRGSLRK

SEQ ID NO: 412508 - protein, 9 aa, Homo Sapiens
LALCNPVVL

SEQ ID NO: 412509 - protein, 9 aa, Homo Sapiens
LSPGATLTS

SEQ ID NO: 412510 - protein, 9 aa, Homo Sapiens
NMTLWKQKK

SEQ ID NO: 412511 - protein, 9 aa, Homo Sapiens
GVGHLAVQG

SEQ ID NO: 412512 - protein, 9 aa, Homo Sapiens
VFPLLAGLL

SEQ ID NO: 412513 - protein, 9 aa, Homo Sapiens
LLRLWMFLR

SEQ ID NO: 412514 - protein, 9 aa, Homo Sapiens
RNLYVPNQK

SEQ ID NO: 412515 - protein, 9 aa, Homo Sapiens
HTHTHALQS

SEQ ID NO: 412516 - protein, 9 aa, Homo Sapiens
LKNCVLLNR

SEQ ID NO: 412517 - protein, 9 aa, Homo Sapiens
GLFKTQNAP

SEQ ID NO: 412518 - protein, 9 aa, Homo Sapiens
HHAAGHSEL

SEQ ID NO: 412519 - protein, 9 aa, Homo Sapiens
FSFFSGHRC

SEQ ID NO: 412520 - protein, 9 aa, Homo Sapiens
SSAWAGPHP

SEQ ID NO: 412521 - protein, 9 aa, Homo Sapiens
SGADLMCGW

SEQ ID NO: 412522 - protein, 9 aa, Homo Sapiens
AYPYPLPLS

SEQ ID NO: 412523 - protein, 9 aa, Homo Sapiens
AAGLTAEVN

SEQ ID NO: 412524 - protein, 9 aa, Homo Sapiens
THSPRATAA

SEQ ID NO: 412525 - protein, 9 aa, Homo Sapiens
HDQATSPGA

SEQ ID NO: 412526 - protein, 9 aa, Homo Sapiens
TGTCCLPVG

SEQ ID NO: 412527 - protein, 9 aa, Homo Sapiens
ASASSLVLP

SEQ ID NO: 412528 - protein, 9 aa, Homo Sapiens
PNMNQLVSL

SEQ ID NO: 412529 - protein, 9 aa, Homo Sapiens
ATSPGAAHQ

SEQ ID NO: 412530 - protein, 9 aa, Homo Sapiens
PPVMLKVTR

SEQ ID NO: 412531 - protein, 9 aa, Homo Sapiens
WRSPKCIIH

SEQ ID NO: 412532 - protein, 9 aa, Homo Sapiens
ALRPTGPAP

SEQ ID NO: 412533 - protein, 9 aa, Homo Sapiens
NTNHHKQVQ

SEQ ID NO: 412534 - protein, 9 aa, Homo Sapiens
PPPVGAGTG

SEQ ID NO: 412535 - protein, 9 aa, Homo Sapiens
MGALTASGA

SEQ ID NO: 412536 - protein, 9 aa, Homo Sapiens
ELLILQLLA

SEQ ID NO: 412537 - protein, 9 aa, Homo Sapiens
EQWELGPRL

SEQ ID NO: 412538 - protein, 9 aa, Homo Sapiens
NCTKENAEK

SEQ ID NO: 412539 - protein, 9 aa, Homo Sapiens
QTFRVTFDV

SEQ ID NO: 412540 - protein, 9 aa, Homo Sapiens
SFCLEYHSC

SEQ ID NO: 412541 - protein, 9 aa, Homo Sapiens
EQWSETGAT

SEQ ID NO: 412542 - protein, 9 aa, Homo Sapiens
KACNEGHCT

SEQ ID NO: 412543 - protein, 9 aa, Homo Sapiens
GFWEIENKA

SEQ ID NO: 412544 - protein, 9 aa, Homo Sapiens
ASTPPPPGA

SEQ ID NO: 412545 - protein, 9 aa, Homo Sapiens
QVVYCIHAL

SEQ ID NO: 412546 - protein, 9 aa, Homo Sapiens
LTTPSSTAK

SEQ ID NO: 412547 - protein, 9 aa, Homo Sapiens
RASTRSRVV

SEQ ID NO: 412548 - protein, 9 aa, Homo Sapiens
SYYKSQGEA

SEQ ID NO: 412549 - protein, 9 aa, Homo Sapiens
SWAGFSPDS

SEQ ID NO: 412550 - protein, 9 aa, Homo Sapiens
STEMPSEQV

SEQ ID NO: 412551 - protein, 9 aa, Homo Sapiens
TKLSRVTFI

SEQ ID NO: 412552 - protein, 9 aa, Homo Sapiens
PWTTHLWSR

SEQ ID NO: 412553 - protein, 9 aa, Homo Sapiens
LKNHYQSFG

SEQ ID NO: 412554 - protein, 9 aa, Homo Sapiens
KVLGHPEPD

SEQ ID NO: 412555 - protein, 9 aa, Homo Sapiens
ECMDSNEGP

SEQ ID NO: 412556 - protein, 9 aa, Homo Sapiens
KKLLWYYVV

SEQ ID NO: 412557 - protein, 9 aa, Homo Sapiens
GDPGVIKQK

SEQ ID NO: 412558 - protein, 9 aa, Homo Sapiens
FRNLQGNPM

SEQ ID NO: 412559 - protein, 9 aa, Homo Sapiens
TVFVPRWRT

SEQ ID NO: 412560 - protein, 9 aa, Homo Sapiens
ERVEDVSIP

SEQ ID NO: 412561 - protein, 9 aa, Homo Sapiens
AAAAQPQSS

SEQ ID NO: 412562 - protein, 9 aa, Homo Sapiens
VDGSSDTSS

SEQ ID NO: 412563 - protein, 9 aa, Homo Sapiens
FCRPSLGTG

SEQ ID NO: 412564 - protein, 9 aa, Homo Sapiens
RSKSYELIQ

SEQ ID NO: 412565 - protein, 9 aa, Homo Sapiens
VTRGETVVL

SEQ ID NO: 412566 - protein, 9 aa, Homo Sapiens
WEVEKTACP

SEQ ID NO: 412567 - protein, 9 aa, Homo Sapiens
ILANMSDNA

SEQ ID NO: 412568 - protein, 9 aa, Homo Sapiens
ACHSDETWS

SEQ ID NO: 412569 - protein, 9 aa, Homo Sapiens
GDQVAVGYR

SEQ ID NO: 412570 - protein, 9 aa, Homo Sapiens
DSCHLWSPF

SEQ ID NO: 412571 - protein, 9 aa, Homo Sapiens
LLCLLGEIT

SEQ ID NO: 412572 - protein, 9 aa, Homo Sapiens
LVAQKIDLL

SEQ ID NO: 412573 - protein, 9 aa, Homo Sapiens
HLEPTQKNL

SEQ ID NO: 412574 - protein, 9 aa, Homo Sapiens
SAAPAAREE

SEQ ID NO: 412575 - protein, 9 aa, Homo Sapiens
GRGSLRKWR

SEQ ID NO: 412576 - protein, 9 aa, Homo Sapiens
TYVASDSEY

SEQ ID NO: 412577 - protein, 9 aa, Homo Sapiens
KKLKGKLKN

SEQ ID NO: 412578 - protein, 9 aa, Homo Sapiens
TVQKNTKYV

SEQ ID NO: 412579 - protein, 9 aa, Homo Sapiens
HGLKSLSRK

SEQ ID NO: 412580 - protein, 9 aa, Homo Sapiens
SRTIGRSQG

SEQ ID NO: 412581 - protein, 9 aa, Homo Sapiens
RTRSSGWMP

SEQ ID NO: 412582 - protein, 9 aa, Homo Sapiens
SSTFSISSS

SEQ ID NO: 412583 - protein, 9 aa, Homo Sapiens
LWDVAAGME

SEQ ID NO: 412584 - protein, 9 aa, Homo Sapiens
GNIMQVPPS

SEQ ID NO: 412585 - protein, 9 aa, Homo Sapiens
KITHVEGEK

SEQ ID NO: 412586 - protein, 9 aa, Homo Sapiens
GSMSPFNME

SEQ ID NO: 412587 - protein, 9 aa, Homo Sapiens
GSLRKWRPG

SEQ ID NO: 412588 - protein, 9 aa, Homo Sapiens
LCSFISSSL

SEQ ID NO: 412589 - protein, 9 aa, Homo Sapiens
QQYVKRTWY

SEQ ID NO: 412590 - protein, 9 aa, Homo Sapiens
QVCEKHASQ

SEQ ID NO: 412591 - protein, 9 aa, Homo Sapiens
LQEISFGDA

SEQ ID NO: 412592 - protein, 9 aa, Homo Sapiens
PACQPALLD

SEQ ID NO: 412593 - protein, 9 aa, Homo Sapiens
SSEAWDSEG

SEQ ID NO: 412594 - protein, 9 aa, Homo Sapiens
TLPGSWSMR

SEQ ID NO: 412595 - protein, 9 aa, Homo Sapiens
AGSGTSAGT

SEQ ID NO: 412596 - protein, 9 aa, Homo Sapiens
VDFWDFAQG

SEQ ID NO: 412597 - protein, 9 aa, Homo Sapiens
NIIVITINY

SEQ ID NO: 412598 - protein, 9 aa, Homo Sapiens
RCIPLANLS

SEQ ID NO: 412599 - protein, 9 aa, Homo Sapiens
SSDQEGNIS

SEQ ID NO: 412600 - protein, 9 aa, Homo Sapiens
ILVQAYTPS

SEQ ID NO: 412601 - protein, 9 aa, Homo Sapiens
KPAKWTCKQ

SEQ ID NO: 412602 - protein, 9 aa, Homo Sapiens
NWYLFCLSW

SEQ ID NO: 412603 - protein, 9 aa, Homo Sapiens
QDGARCPSC

SEQ ID NO: 412604 - protein, 9 aa, Homo Sapiens
DGSSDTSSN

SEQ ID NO: 412605 - protein, 9 aa, Homo Sapiens
SLPLRGFLL

SEQ ID NO: 412606 - protein, 9 aa, Homo Sapiens
KRLRLHSRQ

SEQ ID NO: 412607 - protein, 9 aa, Homo Sapiens
KMTGESFPI

SEQ ID NO: 412608 - protein, 9 aa, Homo Sapiens
NAVGRRGPD

SEQ ID NO: 412609 - protein, 9 aa, Homo Sapiens
AEIWDWDLT

SEQ ID NO: 412610 - protein, 9 aa, Homo Sapiens
VWMLDLTQA

SEQ ID NO: 412611 - protein, 9 aa, Homo Sapiens
GQKQSFSKA

SEQ ID NO: 412612 - protein, 9 aa, Homo Sapiens
VEGRSPSRN

SEQ ID NO: 412613 - protein, 9 aa, Homo Sapiens
ETVGLNFFF

SEQ ID NO: 412614 - protein, 9 aa, Homo Sapiens
SCLCSMAVC

SEQ ID NO: 412615 - protein, 9 aa, Homo Sapiens
PPGHESFRL

SEQ ID NO: 412616 - protein, 9 aa, Homo Sapiens
AASTRTHGA

SEQ ID NO: 412617 - protein, 9 aa, Homo Sapiens
LPGAWSGPS

SEQ ID NO: 412618 - protein, 9 aa, Homo Sapiens
HPEEALQAL

SEQ ID NO: 412619 - protein, 9 aa, Homo Sapiens
PQEQHLRVR

SEQ ID NO: 412620 - protein, 9 aa, Homo Sapiens
FDQNGMVGP

SEQ ID NO: 412621 - protein, 9 aa, Homo Sapiens
IPGPAGLPG

SEQ ID NO: 412622 - protein, 9 aa, Homo Sapiens
YGNPHNQNI

SEQ ID NO: 412623 - protein, 9 aa, Homo Sapiens
IYWVQWASK

SEQ ID NO: 412624 - protein, 9 aa, Homo Sapiens
GLHGQSSAQ

SEQ ID NO: 412625 - protein, 9 aa, Homo Sapiens
SINTSPGVV

SEQ ID NO: 412626 - protein, 9 aa, Homo Sapiens
GLRSAPGAT

SEQ ID NO: 412627 - protein, 9 aa, Homo Sapiens
KFYGSEGPY

SEQ ID NO: 412628 - protein, 9 aa, Homo Sapiens
IAAVASCFG

SEQ ID NO: 412629 - protein, 9 aa, Homo Sapiens
MGLVKGYDS

SEQ ID NO: 412630 - protein, 9 aa, Homo Sapiens
DMYVCHQQL

SEQ ID NO: 412631 - protein, 9 aa, Homo Sapiens
FTSDMAHVI

SEQ ID NO: 412632 - protein, 9 aa, Homo Sapiens
GYCVQVLWY

SEQ ID NO: 412633 - protein, 9 aa, Homo Sapiens
NNLHVTALK

SEQ ID NO: 412634 - protein, 9 aa, Homo Sapiens
TFRAVDSSA

SEQ ID NO: 412635 - protein, 9 aa, Homo Sapiens
GSPDKLGLG

SEQ ID NO: 412636 - protein, 9 aa, Homo Sapiens
GQELVDGIL

SEQ ID NO: 412637 - protein, 9 aa, Homo Sapiens
CWGPHPPLW

SEQ ID NO: 412638 - protein, 9 aa, Homo Sapiens
LLEYTETQN

SEQ ID NO: 412639 - protein, 9 aa, Homo Sapiens
YVHLHFKKT

SEQ ID NO: 412640 - protein, 9 aa, Homo Sapiens
GGVGLLGHL

SEQ ID NO: 412641 - protein, 9 aa, Homo Sapiens
KHGRCSSGS

SEQ ID NO: 412642 - protein, 9 aa, Homo Sapiens
RIEAKSKRV

SEQ ID NO: 412643 - protein, 9 aa, Homo Sapiens
KEEEDLETL

SEQ ID NO: 412644 - protein, 9 aa, Homo Sapiens
TGESPPASL

SEQ ID NO: 412645 - protein, 9 aa, Homo Sapiens
HEQSESVHG

SEQ ID NO: 412646 - protein, 9 aa, Homo Sapiens
MENSHPPTT

SEQ ID NO: 412647 - protein, 9 aa, Homo Sapiens
LQAYARRYS

SEQ ID NO: 412648 - protein, 9 aa, Homo Sapiens
QQIMSNGEN

SEQ ID NO: 412649 - protein, 9 aa, Homo Sapiens
MQTLESFLS

SEQ ID NO: 412650 - protein, 9 aa, Homo Sapiens
PSLYLFRAS

SEQ ID NO: 412651 - protein, 9 aa, Homo Sapiens
PGTVGPLGL

SEQ ID NO: 412652 - protein, 9 aa, Homo Sapiens
HRQPVQIQS

SEQ ID NO: 412653 - protein, 9 aa, Homo Sapiens
NNKLAEVKE

SEQ ID NO: 412654 - protein, 9 aa, Homo Sapiens
HPFLPPPPS

SEQ ID NO: 412655 - protein, 9 aa, Homo Sapiens
QSWSSPLPG

SEQ ID NO: 412656 - protein, 9 aa, Homo Sapiens
AQHLQAAVT

SEQ ID NO: 412657 - protein, 9 aa, Homo Sapiens
GPAGWAGSG

SEQ ID NO: 412658 - protein, 9 aa, Homo Sapiens
PDATRSGSG

SEQ ID NO: 412659 - protein, 9 aa, Homo Sapiens
PHAGPAVQP

SEQ ID NO: 412660 - protein, 9 aa, Homo Sapiens
IKMNMTLWK

SEQ ID NO: 412661 - protein, 9 aa, Homo Sapiens
SLDLRQLRT

SEQ ID NO: 412662 - protein, 9 aa, Homo Sapiens
PNLPAWTLT

SEQ ID NO: 412663 - protein, 9 aa, Homo Sapiens
LLQLSKLQP

SEQ ID NO: 412664 - protein, 9 aa, Homo Sapiens
LLQNKRSSF

SEQ ID NO: 412665 - protein, 9 aa, Homo Sapiens
APSTGLPSQ

SEQ ID NO: 412666 - protein, 9 aa, Homo Sapiens
SPSWFRSCS

SEQ ID NO: 412667 - protein, 9 aa, Homo Sapiens
EVVPVSILL

SEQ ID NO: 412668 - protein, 9 aa, Homo Sapiens
DYSPDLDLD

SEQ ID NO: 412669 - protein, 9 aa, Homo Sapiens
MVPCLEHVV

SEQ ID NO: 412670 - protein, 9 aa, Homo Sapiens
NYYGEKNWY

SEQ ID NO: 412671 - protein, 9 aa, Homo Sapiens
NVMRSIHGM

SEQ ID NO: 412672 - protein, 9 aa, Homo Sapiens
EHGYHKMEL

SEQ ID NO: 412673 - protein, 9 aa, Homo Sapiens
RGGGSPSRS

SEQ ID NO: 412674 - protein, 9 aa, Homo Sapiens
PARSPRTRP

SEQ ID NO: 412675 - protein, 9 aa, Homo Sapiens
HISSAGCLG

SEQ ID NO: 412676 - protein, 9 aa, Homo Sapiens
SHTCEDSLP

SEQ ID NO: 412677 - protein, 9 aa, Homo Sapiens
GCAVMDKRR

SEQ ID NO: 412678 - protein, 9 aa, Homo Sapiens
LVQLLEHYE

SEQ ID NO: 412679 - protein, 9 aa, Homo Sapiens
LEIIEHPFQ

SEQ ID NO: 412680 - protein, 9 aa, Homo Sapiens
NGHHSSHKY

SEQ ID NO: 412681 - protein, 9 aa, Homo Sapiens
LEWFEQEAV

SEQ ID NO: 412682 - protein, 9 aa, Homo Sapiens
RAPKVILSW

SEQ ID NO: 412683 - protein, 9 aa, Homo Sapiens
ESVWEQWQI

SEQ ID NO: 412684 - protein, 9 aa, Homo Sapiens
PPFMPQRLT

SEQ ID NO: 412685 - protein, 9 aa, Homo Sapiens
GHGGGGSAA

SEQ ID NO: 412686 - protein, 9 aa, Homo Sapiens
SVWGGEDSG

SEQ ID NO: 412687 - protein, 9 aa, Homo Sapiens
DDIEVHFVL

SEQ ID NO: 412688 - protein, 9 aa, Homo Sapiens
SMCSWLLSK

SEQ ID NO: 412689 - protein, 9 aa, Homo Sapiens
IGSVWWKIA

SEQ ID NO: 412690 - protein, 9 aa, Homo Sapiens
LGDQLQLNQ

SEQ ID NO: 412691 - protein, 9 aa, Homo Sapiens
DLERLHDVL

SEQ ID NO: 412692 - protein, 9 aa, Homo Sapiens
HRDASPTRS

SEQ ID NO: 412693 - protein, 9 aa, Homo Sapiens
EERHIAEMG

SEQ ID NO: 412694 - protein, 9 aa, Homo Sapiens
DIGICTTLL

SEQ ID NO: 412695 - protein, 9 aa, Homo Sapiens
FIIWNKINH

SEQ ID NO: 412696 - protein, 9 aa, Homo Sapiens
GGQLVLLRR

SEQ ID NO: 412697 - protein, 9 aa, Homo Sapiens
PRPRCCAAP

SEQ ID NO: 412698 - protein, 9 aa, Homo Sapiens
PRRQALPVM

SEQ ID NO: 412699 - protein, 9 aa, Homo Sapiens
FFCQKSIID

SEQ ID NO: 412700 - protein, 9 aa, Homo Sapiens
CLICGDHQD

SEQ ID NO: 412701 - protein, 9 aa, Homo Sapiens
HDGLDWCNA

SEQ ID NO: 412702 - protein, 9 aa, Homo Sapiens
AVKWGRNTS

SEQ ID NO: 412703 - protein, 9 aa, Homo Sapiens
EELQLCHNR

SEQ ID NO: 412704 - protein, 9 aa, Homo Sapiens
TTSGPTARS

SEQ ID NO: 412705 - protein, 9 aa, Homo Sapiens
SEHNYCRLI

SEQ ID NO: 412706 - protein, 9 aa, Homo Sapiens
STGAGPATM

SEQ ID NO: 412707 - protein, 9 aa, Homo Sapiens
AVKFLVIGK

SEQ ID NO: 412708 - protein, 9 aa, Homo Sapiens
LNDLLLPGW

SEQ ID NO: 412709 - protein, 9 aa, Homo Sapiens
GAAGTRCRA

SEQ ID NO: 412710 - protein, 9 aa, Homo Sapiens
VTRWYRAPK

SEQ ID NO: 412711 - protein, 9 aa, Homo Sapiens
SIHSAMECT

SEQ ID NO: 412712 - protein, 9 aa, Homo Sapiens
RVWGNLRQA

SEQ ID NO: 412713 - protein, 9 aa, Homo Sapiens
AASEQRGCQ

SEQ ID NO: 412714 - protein, 9 aa, Homo Sapiens
AVAQDEVPA

SEQ ID NO: 412715 - protein, 9 aa, Homo Sapiens
FNDASPPSA

SEQ ID NO: 412716 - protein, 9 aa, Homo Sapiens
PEGEAGVDG

SEQ ID NO: 412717 - protein, 9 aa, Homo Sapiens
VPHGNSTGE

SEQ ID NO: 412718 - protein, 9 aa, Homo Sapiens
LNEICMKEG

SEQ ID NO: 412719 - protein, 9 aa, Homo Sapiens
VMPNIVISV

SEQ ID NO: 412720 - protein, 9 aa, Homo Sapiens
HRATSNTEE

SEQ ID NO: 412721 - protein, 9 aa, Homo Sapiens
GSPFPASTP

SEQ ID NO: 412722 - protein, 9 aa, Homo Sapiens
VSEEDFWRW

SEQ ID NO: 412723 - protein, 9 aa, Homo Sapiens
VTVYDGSWS

SEQ ID NO: 412724 - protein, 9 aa, Homo Sapiens
GTMYCRHHL

SEQ ID NO: 412725 - protein, 9 aa, Homo Sapiens
EVHQNMDYC

SEQ ID NO: 412726 - protein, 9 aa, Homo Sapiens
AGGDQRRHA

SEQ ID NO: 412727 - protein, 9 aa, Homo Sapiens
AGVQNGAPA

SEQ ID NO: 412728 - protein, 9 aa, Homo Sapiens
NPAPVAFLA

SEQ ID NO: 412729 - protein, 9 aa, Homo Sapiens
QASSWSRLS

SEQ ID NO: 412730 - protein, 9 aa, Homo Sapiens
LNVTSTAGT

SEQ ID NO: 412731 - protein, 9 aa, Homo Sapiens
SHPPTTTTS

SEQ ID NO: 412732 - protein, 9 aa, Homo Sapiens
KRERMMLPV

SEQ ID NO: 412733 - protein, 9 aa, Homo Sapiens
ASRGPSPSV

SEQ ID NO: 412734 - protein, 9 aa, Homo Sapiens
GPSSSHRDL

SEQ ID NO: 412735 - protein, 9 aa, Homo Sapiens
KCIDKAEVC

SEQ ID NO: 412736 - protein, 9 aa, Homo Sapiens
KDKKRKDRR

SEQ ID NO: 412737 - protein, 9 aa, Homo Sapiens
SRSAPTPPT

SEQ ID NO: 412738 - protein, 9 aa, Homo Sapiens
PAAPPGGPG

SEQ ID NO: 412739 - protein, 9 aa, Homo Sapiens
GRGWTACAR

SEQ ID NO: 412740 - protein, 9 aa, Homo Sapiens
SGLRTCPQG

SEQ ID NO: 412741 - protein, 9 aa, Homo Sapiens
HRLSATLRG

SEQ ID NO: 412742 - protein, 9 aa, Homo Sapiens
HELFTELNE

SEQ ID NO: 412743 - protein, 9 aa, Homo Sapiens
GCTFKILVQ

SEQ ID NO: 412744 - protein, 9 aa, Homo Sapiens
NLVINANWG

SEQ ID NO: 412745 - protein, 9 aa, Homo Sapiens
SWRRCARAT

SEQ ID NO: 412746 - protein, 9 aa, Homo Sapiens
SAFSHDNIY

SEQ ID NO: 412747 - protein, 9 aa, Homo Sapiens
LQSAVEQVV

SEQ ID NO: 412748 - protein, 9 aa, Homo Sapiens
ENLSGLQQQ

SEQ ID NO: 412749 - protein, 9 aa, Homo Sapiens
ISAPVIFDR

SEQ ID NO: 412750 - protein, 9 aa, Homo Sapiens
KCYLQLAGI

SEQ ID NO: 412751 - protein, 9 aa, Homo Sapiens
PTALPSDPR

SEQ ID NO: 412752 - protein, 9 aa, Homo Sapiens
SEAVPSSPD

SEQ ID NO: 412753 - protein, 9 aa, Homo Sapiens
YQAIATITT

SEQ ID NO: 412754 - protein, 9 aa, Homo Sapiens
RMKVTMPCM

SEQ ID NO: 412755 - protein, 9 aa, Homo Sapiens
QVLWYDIYC

SEQ ID NO: 412756 - protein, 9 aa, Homo Sapiens
RLWEGPVQE

SEQ ID NO: 412757 - protein, 9 aa, Homo Sapiens
QWQHQELEH

SEQ ID NO: 412758 - protein, 9 aa, Homo Sapiens
RKHHQSDGN

SEQ ID NO: 412759 - protein, 9 aa, Homo Sapiens
TPWAIAVLE

SEQ ID NO: 412760 - protein, 9 aa, Homo Sapiens
PSATSLVSL

SEQ ID NO: 412761 - protein, 9 aa, Homo Sapiens
QVTAGDPTT

SEQ ID NO: 412762 - protein, 9 aa, Homo Sapiens
VLGPGLKSQ

SEQ ID NO: 412763 - protein, 9 aa, Homo Sapiens
GPSPSVHPR

SEQ ID NO: 412764 - protein, 9 aa, Homo Sapiens
LATLYVLVL

SEQ ID NO: 412765 - protein, 9 aa, Homo Sapiens
IGAKSKWLA

SEQ ID NO: 412766 - protein, 9 aa, Homo Sapiens
ASVTAETTV

SEQ ID NO: 412767 - protein, 9 aa, Homo Sapiens
WFSSRFLNL

SEQ ID NO: 412768 - protein, 9 aa, Homo Sapiens
IRFVAGHDA

SEQ ID NO: 412769 - protein, 9 aa, Homo Sapiens
KERSLQSMA

SEQ ID NO: 412770 - protein, 9 aa, Homo Sapiens
HGDGQQVLL

SEQ ID NO: 412771 - protein, 9 aa, Homo Sapiens
PAVWTRVGF

SEQ ID NO: 412772 - protein, 9 aa, Homo Sapiens
RSRSVLRRS

SEQ ID NO: 412773 - protein, 9 aa, Homo Sapiens
IHIGCTQTM

SEQ ID NO: 412774 - protein, 9 aa, Homo Sapiens
PCLCLEEPR

SEQ ID NO: 412775 - protein, 9 aa, Homo Sapiens
STHEQSESV

SEQ ID NO: 412776 - protein, 9 aa, Homo Sapiens
TLTSPQASS

SEQ ID NO: 412777 - protein, 9 aa, Homo Sapiens
GQQVLEVES

SEQ ID NO: 412778 - protein, 9 aa, Homo Sapiens
GLGIHMRHL

SEQ ID NO: 412779 - protein, 9 aa, Homo Sapiens
PALLCLTLQ

SEQ ID NO: 412780 - protein, 9 aa, Homo Sapiens
PDDKYHKKQ

SEQ ID NO: 412781 - protein, 9 aa, Homo Sapiens
KNGVSTSSS

SEQ ID NO: 412782 - protein, 9 aa, Homo Sapiens
AAAGALTRT

SEQ ID NO: 412783 - protein, 9 aa, Homo Sapiens
FIPQMTTGK

SEQ ID NO: 412784 - protein, 9 aa, Homo Sapiens
SFVGQISTL

SEQ ID NO: 412785 - protein, 9 aa, Homo Sapiens
GAAHQAGAA

SEQ ID NO: 412786 - protein, 9 aa, Homo Sapiens
PAQWETPAH

SEQ ID NO: 412787 - protein, 9 aa, Homo Sapiens
QPWRPHAGP

SEQ ID NO: 412788 - protein, 9 aa, Homo Sapiens
KPDKSSRPI

SEQ ID NO: 412789 - protein, 9 aa, Homo Sapiens
CCCHVDDWC

SEQ ID NO: 412790 - protein, 9 aa, Homo Sapiens
STLTSDVSS

SEQ ID NO: 412791 - protein, 9 aa, Homo Sapiens
TNVALYVGI

SEQ ID NO: 412792 - protein, 9 aa, Homo Sapiens
GGGSWSSAS

SEQ ID NO: 412793 - protein, 9 aa, Homo Sapiens
ENREKQAPA

SEQ ID NO: 412794 - protein, 9 aa, Homo Sapiens
SPSSGKRCP

SEQ ID NO: 412795 - protein, 9 aa, Homo Sapiens
GGSARIVVS

SEQ ID NO: 412796 - protein, 9 aa, Homo Sapiens
HRQISLPLR

SEQ ID NO: 412797 - protein, 9 aa, Homo Sapiens
RHPGAQPSP

SEQ ID NO: 412798 - protein, 9 aa, Homo Sapiens
TEETYIGSM

SEQ ID NO: 412799 - protein, 9 aa, Homo Sapiens
WLGVSEQQV

SEQ ID NO: 412800 - protein, 9 aa, Homo Sapiens
VVMGTNGQV

SEQ ID NO: 412801 - protein, 9 aa, Homo Sapiens
RPTLPPGNS

SEQ ID NO: 412802 - protein, 9 aa, Homo Sapiens
NASIMCPLN

SEQ ID NO: 412803 - protein, 9 aa, Homo Sapiens
VCQQSNQKC

SEQ ID NO: 412804 - protein, 9 aa, Homo Sapiens
SVDTIRSSV

SEQ ID NO: 412805 - protein, 9 aa, Homo Sapiens
TGTLGTIHW

SEQ ID NO: 412806 - protein, 9 aa, Homo Sapiens
LGSMSPFNM

SEQ ID NO: 412807 - protein, 9 aa, Homo Sapiens
NAVKFLVIG

SEQ ID NO: 412808 - protein, 9 aa, Homo Sapiens
HSHFYNNRY

SEQ ID NO: 412809 - protein, 9 aa, Homo Sapiens
TACPSESSE

SEQ ID NO: 412810 - protein, 9 aa, Homo Sapiens
LEQKFMLYW

SEQ ID NO: 412811 - protein, 9 aa, Homo Sapiens
KHTVLITSR

SEQ ID NO: 412812 - protein, 9 aa, Homo Sapiens
RDHFTAESY

SEQ ID NO: 412813 - protein, 9 aa, Homo Sapiens
LFFCQKSII

SEQ ID NO: 412814 - protein, 9 aa, Homo Sapiens
IPFPRAWAG

SEQ ID NO: 412815 - protein, 9 aa, Homo Sapiens
AVAQVYNTS

SEQ ID NO: 412816 - protein, 9 aa, Homo Sapiens
RAAVTIETG

SEQ ID NO: 412817 - protein, 9 aa, Homo Sapiens
LYPEGIGAH

SEQ ID NO: 412818 - protein, 9 aa, Homo Sapiens
RAPPRTARG

SEQ ID NO: 412819 - protein, 9 aa, Homo Sapiens
QSYRVTLEL

SEQ ID NO: 412820 - protein, 9 aa, Homo Sapiens
APMMSSMAC

SEQ ID NO: 412821 - protein, 9 aa, Homo Sapiens
QRSVAYNGP

SEQ ID NO: 412822 - protein, 9 aa, Homo Sapiens
NTLLAAKKS

SEQ ID NO: 412823 - protein, 9 aa, Homo Sapiens
LADSCHLWS

SEQ ID NO: 412824 - protein, 9 aa, Homo Sapiens
SAVLLHCFS

SEQ ID NO: 412825 - protein, 9 aa, Homo Sapiens
DYLTMDGTL

SEQ ID NO: 412826 - protein, 9 aa, Homo Sapiens
LGYQIAYHL

SEQ ID NO: 412827 - protein, 9 aa, Homo Sapiens
GACRPACTC

SEQ ID NO: 412828 - protein, 9 aa, Homo Sapiens
ATTAIGGGV

SEQ ID NO: 412829 - protein, 9 aa, Homo Sapiens
ASKNSDGDM

SEQ ID NO: 412830 - protein, 9 aa, Homo Sapiens
TLLIVTIIA

SEQ ID NO: 412831 - protein, 9 aa, Homo Sapiens
CSLCLQNRY

SEQ ID NO: 412832 - protein, 9 aa, Homo Sapiens
PTGPAAPLA

SEQ ID NO: 412833 - protein, 9 aa, Homo Sapiens
LWMARRGHT

SEQ ID NO: 412834 - protein, 9 aa, Homo Sapiens
LQDFLYAQQ

SEQ ID NO: 412835 - protein, 9 aa, Homo Sapiens
LHQNLDPTS

SEQ ID NO: 412836 - protein, 9 aa, Homo Sapiens
GFALGRGLE

SEQ ID NO: 412837 - protein, 9 aa, Homo Sapiens
NLGETESAT

SEQ ID NO: 412838 - protein, 9 aa, Homo Sapiens
NNIHSGEMY

SEQ ID NO: 412839 - protein, 9 aa, Homo Sapiens
GAGGHMERA

SEQ ID NO: 412840 - protein, 9 aa, Homo Sapiens
SSGNTLQAL

SEQ ID NO: 412841 - protein, 9 aa, Homo Sapiens
VTEISDESG

SEQ ID NO: 412842 - protein, 9 aa, Homo Sapiens
CDTCYILHG

SEQ ID NO: 412843 - protein, 9 aa, Homo Sapiens
PQPPQHQLS

SEQ ID NO: 412844 - protein, 9 aa, Homo Sapiens
TYGDMATGC

SEQ ID NO: 412845 - protein, 9 aa, Homo Sapiens
YTRWMQKWP

SEQ ID NO: 412846 - protein, 9 aa, Homo Sapiens
DEVACAALV

SEQ ID NO: 412847 - protein, 9 aa, Homo Sapiens
SLTLIQSNT

SEQ ID NO: 412848 - protein, 9 aa, Homo Sapiens
TLRPPAQIP

SEQ ID NO: 412849 - protein, 9 aa, Homo Sapiens
TFYLADEII

SEQ ID NO: 412850 - protein, 9 aa, Homo Sapiens
VEFVRIGQA

SEQ ID NO: 412851 - protein, 9 aa, Homo Sapiens
EIPPPAPAT

SEQ ID NO: 412852 - protein, 9 aa, Homo Sapiens
HDTPASNHC

SEQ ID NO: 412853 - protein, 9 aa, Homo Sapiens
VDNNIHSGE

SEQ ID NO: 412854 - protein, 9 aa, Homo Sapiens
HLLGPDGLS

SEQ ID NO: 412855 - protein, 9 aa, Homo Sapiens
GLQYKCLDE

SEQ ID NO: 412856 - protein, 9 aa, Homo Sapiens
EFQNESCRL

SEQ ID NO: 412857 - protein, 9 aa, Homo Sapiens
QKLQKDRHR

SEQ ID NO: 412858 - protein, 9 aa, Homo Sapiens
KEDPVGQAR

SEQ ID NO: 412859 - protein, 9 aa, Homo Sapiens
QLPTFLPEY

SEQ ID NO: 412860 - protein, 9 aa, Homo Sapiens
SANHRAWVT

SEQ ID NO: 412861 - protein, 9 aa, Homo Sapiens
VEVYRVTKC

SEQ ID NO: 412862 - protein, 9 aa, Homo Sapiens
TQGRAETHL

SEQ ID NO: 412863 - protein, 9 aa, Homo Sapiens
GALKAPAAT

SEQ ID NO: 412864 - protein, 9 aa, Homo Sapiens
SPFQCEWNP

SEQ ID NO: 412865 - protein, 9 aa, Homo Sapiens
RQPSVWCPW

SEQ ID NO: 412866 - protein, 9 aa, Homo Sapiens
KVHAIPLHS

SEQ ID NO: 412867 - protein, 9 aa, Homo Sapiens
NGRGHHHPH

SEQ ID NO: 412868 - protein, 9 aa, Homo Sapiens
RIQEDHTVI

SEQ ID NO: 412869 - protein, 9 aa, Homo Sapiens
IANNLWGCG

SEQ ID NO: 412870 - protein, 9 aa, Homo Sapiens
SPTSNDDMT

SEQ ID NO: 412871 - protein, 9 aa, Homo Sapiens
KALEEKGQQ

SEQ ID NO: 412872 - protein, 9 aa, Homo Sapiens
TVHSPITQG

SEQ ID NO: 412873 - protein, 9 aa, Homo Sapiens
SPDKLGLGQ

SEQ ID NO: 412874 - protein, 9 aa, Homo Sapiens
FLPPPPSPC

SEQ ID NO: 412875 - protein, 9 aa, Homo Sapiens
RVSALGPRG

SEQ ID NO: 412876 - protein, 9 aa, Homo Sapiens
GRPRAVCVG

SEQ ID NO: 412877 - protein, 9 aa, Homo Sapiens
LPPACTWAE

SEQ ID NO: 412878 - protein, 9 aa, Homo Sapiens
FCLEYHSCW

SEQ ID NO: 412879 - protein, 9 aa, Homo Sapiens
KVSKKDSQN

SEQ ID NO: 412880 - protein, 9 aa, Homo Sapiens
YAGIFWFWF

SEQ ID NO: 412881 - protein, 9 aa, Homo Sapiens
VFSGKKPPS

SEQ ID NO: 412882 - protein, 9 aa, Homo Sapiens
DAMCVNSRT

SEQ ID NO: 412883 - protein, 9 aa, Homo Sapiens
LEALATEQQ

SEQ ID NO: 412884 - protein, 9 aa, Homo Sapiens
HVRLHELSP

SEQ ID NO: 412885 - protein, 9 aa, Homo Sapiens
CIDWGGKRN

SEQ ID NO: 412886 - protein, 9 aa, Homo Sapiens
YHCSQTHSQ

SEQ ID NO: 412887 - protein, 9 aa, Homo Sapiens
KENMKVYHL

SEQ ID NO: 412888 - protein, 9 aa, Homo Sapiens
KKKKLEKTT

SEQ ID NO: 412889 - protein, 9 aa, Homo Sapiens
TITVCPKNA

SEQ ID NO: 412890 - protein, 9 aa, Homo Sapiens
VLRLSQRLH

SEQ ID NO: 412891 - protein, 9 aa, Homo Sapiens
SEWFSSRFL

SEQ ID NO: 412892 - protein, 9 aa, Homo Sapiens
LTVSLDFNL

SEQ ID NO: 412893 - protein, 9 aa, Homo Sapiens
PSFFLHPQK

SEQ ID NO: 412894 - protein, 9 aa, Homo Sapiens
WGFQEVRKK

SEQ ID NO: 412895 - protein, 9 aa, Homo Sapiens
IRTSVVSEE

SEQ ID NO: 412896 - protein, 9 aa, Homo Sapiens
LYFKQIRNL

SEQ ID NO: 412897 - protein, 9 aa, Homo Sapiens
LNLALHRYA

SEQ ID NO: 412898 - protein, 9 aa, Homo Sapiens
LLLCFFIFF

SEQ ID NO: 412899 - protein, 9 aa, Homo Sapiens
RPFYLEAIC

SEQ ID NO: 412900 - protein, 9 aa, Homo Sapiens
QLVILKHLQ

SEQ ID NO: 412901 - protein, 9 aa, Homo Sapiens
QCGLVQPGA

SEQ ID NO: 412902 - protein, 9 aa, Homo Sapiens
PSYTDCHGQ

SEQ ID NO: 412903 - protein, 9 aa, Homo Sapiens
LAVSWGTPN

SEQ ID NO: 412904 - protein, 9 aa, Homo Sapiens
PFTAPSTKK

SEQ ID NO: 412905 - protein, 9 aa, Homo Sapiens
GDYLRRHYD

SEQ ID NO: 412906 - protein, 9 aa, Homo Sapiens
SGGPHLLQP

SEQ ID NO: 412907 - protein, 9 aa, Homo Sapiens
AGGGGSWSS

SEQ ID NO: 412908 - protein, 9 aa, Homo Sapiens
EEELPQVWT

SEQ ID NO: 412909 - protein, 9 aa, Homo Sapiens
QGLPDRQIP

SEQ ID NO: 412910 - protein, 9 aa, Homo Sapiens
GLMDLDIKG

SEQ ID NO: 412911 - protein, 9 aa, Homo Sapiens
FKEVRIWNC

SEQ ID NO: 412912 - protein, 9 aa, Homo Sapiens
TTLGHPGTG

SEQ ID NO: 412913 - protein, 9 aa, Homo Sapiens
GYAGFLWDV

SEQ ID NO: 412914 - protein, 9 aa, Homo Sapiens
LWMVATLPG

SEQ ID NO: 412915 - protein, 9 aa, Homo Sapiens
RTDFCPKTG

SEQ ID NO: 412916 - protein, 9 aa, Homo Sapiens
VTQRDTCVG

SEQ ID NO: 412917 - protein, 9 aa, Homo Sapiens
DQRRGRLLG

SEQ ID NO: 412918 - protein, 9 aa, Homo Sapiens
HEGVINHVH

SEQ ID NO: 412919 - protein, 9 aa, Homo Sapiens
AEEGHGGGG

SEQ ID NO: 412920 - protein, 9 aa, Homo Sapiens
VLERVLDRD

SEQ ID NO: 412921 - protein, 9 aa, Homo Sapiens
RSQGGGRGR

SEQ ID NO: 412922 - protein, 9 aa, Homo Sapiens
SSLSSSSRV

SEQ ID NO: 412923 - protein, 9 aa, Homo Sapiens
QPVRVNVKW

SEQ ID NO: 412924 - protein, 9 aa, Homo Sapiens
CVEFFSRPT

SEQ ID NO: 412925 - protein, 9 aa, Homo Sapiens
FAQVRRAHE

SEQ ID NO: 412926 - protein, 9 aa, Homo Sapiens
NNCPALRIL

SEQ ID NO: 412927 - protein, 9 aa, Homo Sapiens
SLFVLDQDD

SEQ ID NO: 412928 - protein, 9 aa, Homo Sapiens
GRCSSGSGE

SEQ ID NO: 412929 - protein, 9 aa, Homo Sapiens
WDRKRRSSR

SEQ ID NO: 412930 - protein, 9 aa, Homo Sapiens
KRPPFFTID

SEQ ID NO: 412931 - protein, 9 aa, Homo Sapiens
TLLNCLEGD

SEQ ID NO: 412932 - protein, 9 aa, Homo Sapiens
TFRIWHNEQ

SEQ ID NO: 412933 - protein, 9 aa, Homo Sapiens
MREYKLVVI

SEQ ID NO: 412934 - protein, 9 aa, Homo Sapiens
LVLHHAAGH

SEQ ID NO: 412935 - protein, 9 aa, Homo Sapiens
TLPACQTLQ

SEQ ID NO: 412936 - protein, 9 aa, Homo Sapiens
VALSDARCK

SEQ ID NO: 412937 - protein, 9 aa, Homo Sapiens
VGQVGCRKS

SEQ ID NO: 412938 - protein, 9 aa, Homo Sapiens
SLPMSSTLG

SEQ ID NO: 412939 - protein, 9 aa, Homo Sapiens
QHESSDRCA

SEQ ID NO: 412940 - protein, 9 aa, Homo Sapiens
VFHNEAWSM

SEQ ID NO: 412941 - protein, 9 aa, Homo Sapiens
GPAPAPKMC

SEQ ID NO: 412942 - protein, 9 aa, Homo Sapiens
LEADMEWLI

SEQ ID NO: 412943 - protein, 9 aa, Homo Sapiens
HHSSHKYDR

SEQ ID NO: 412944 - protein, 9 aa, Homo Sapiens
TTELSTKSM

SEQ ID NO: 412945 - protein, 9 aa, Homo Sapiens
PQAPSAGPL

SEQ ID NO: 412946 - protein, 9 aa, Homo Sapiens
ERMKAGDLL

SEQ ID NO: 412947 - protein, 9 aa, Homo Sapiens
LEQQIWKEM

SEQ ID NO: 412948 - protein, 9 aa, Homo Sapiens
ALLHRVIII

SEQ ID NO: 412949 - protein, 9 aa, Homo Sapiens
PGRSGPQGP

SEQ ID NO: 412950 - protein, 9 aa, Homo Sapiens
HLHVGHTPM

SEQ ID NO: 412951 - protein, 9 aa, Homo Sapiens
SFRVDIAKL

SEQ ID NO: 412952 - protein, 9 aa, Homo Sapiens
QKQQWEKTR

SEQ ID NO: 412953 - protein, 9 aa, Homo Sapiens
WNPCPMDSR

SEQ ID NO: 412954 - protein, 9 aa, Homo Sapiens
GGEKCIHIT

SEQ ID NO: 412955 - protein, 9 aa, Homo Sapiens
LVRHCPRAL

SEQ ID NO: 412956 - protein, 9 aa, Homo Sapiens
AASRLTARL

SEQ ID NO: 412957 - protein, 9 aa, Homo Sapiens
KAVGVIPPA

SEQ ID NO: 412958 - protein, 9 aa, Homo Sapiens
HLKLEPHEG

SEQ ID NO: 412959 - protein, 9 aa, Homo Sapiens
CTKEPRLWA

SEQ ID NO: 412960 - protein, 9 aa, Homo Sapiens
DVEGGQLVL

SEQ ID NO: 412961 - protein, 9 aa, Homo Sapiens
INLSTIKSI

SEQ ID NO: 412962 - protein, 9 aa, Homo Sapiens
IFVSVQTKS

SEQ ID NO: 412963 - protein, 9 aa, Homo Sapiens
VFLGIAAFR

SEQ ID NO: 412964 - protein, 9 aa, Homo Sapiens
YEVKLQLLL

SEQ ID NO: 412965 - protein, 9 aa, Homo Sapiens
LARVQAPVL

SEQ ID NO: 412966 - protein, 9 aa, Homo Sapiens
KRQQIMSNG

SEQ ID NO: 412967 - protein, 9 aa, Homo Sapiens
VKPRVLHQN

SEQ ID NO: 412968 - protein, 9 aa, Homo Sapiens
AVRYERKNE

SEQ ID NO: 412969 - protein, 9 aa, Homo Sapiens
EYKLVVIGS

SEQ ID NO: 412970 - protein, 9 aa, Homo Sapiens
ASYWESTDM

SEQ ID NO: 412971 - protein, 9 aa, Homo Sapiens
ALLRLLSHL

SEQ ID NO: 412972 - protein, 9 aa, Homo Sapiens
HRCKMKRAR

SEQ ID NO: 412973 - protein, 9 aa, Homo Sapiens
GAPAPHPAR

SEQ ID NO: 412974 - protein, 9 aa, Homo Sapiens
MDDQLFVFY

SEQ ID NO: 412975 - protein, 9 aa, Homo Sapiens
HNHRLHHHH

SEQ ID NO: 412976 - protein, 9 aa, Homo Sapiens
PHLPHQPPL

SEQ ID NO: 412977 - protein, 9 aa, Homo Sapiens
SPFPASTPS

SEQ ID NO: 412978 - protein, 9 aa, Homo Sapiens
QSGTKNLHI

SEQ ID NO: 412979 - protein, 9 aa, Homo Sapiens
MFEMHELNV

SEQ ID NO: 412980 - protein, 9 aa, Homo Sapiens
RQVRLEDYL

SEQ ID NO: 412981 - protein, 9 aa, Homo Sapiens
GWMPGMNMK

SEQ ID NO: 412982 - protein, 9 aa, Homo Sapiens
KVTMPCMSS

SEQ ID NO: 412983 - protein, 9 aa, Homo Sapiens
GSANSTLQA

SEQ ID NO: 412984 - protein, 9 aa, Homo Sapiens
NELLLQNKR

SEQ ID NO: 412985 - protein, 9 aa, Homo Sapiens
SFISSSLGV

SEQ ID NO: 412986 - protein, 9 aa, Homo Sapiens
MTDTCGLPS

SEQ ID NO: 412987 - protein, 9 aa, Homo Sapiens
VTMPCMSSG

SEQ ID NO: 412988 - protein, 9 aa, Homo Sapiens
NPKMQRSPG

SEQ ID NO: 412989 - protein, 9 aa, Homo Sapiens
STGAWTAEG

SEQ ID NO: 412990 - protein, 9 aa, Homo Sapiens
QTESLKVRG

SEQ ID NO: 412991 - protein, 9 aa, Homo Sapiens
PLNPAAQDG

SEQ ID NO: 412992 - protein, 9 aa, Homo Sapiens
INAIYYYAD

SEQ ID NO: 412993 - protein, 9 aa, Homo Sapiens
LRKDIEETS

SEQ ID NO: 412994 - protein, 9 aa, Homo Sapiens
VDSFFVIFL

SEQ ID NO: 412995 - protein, 9 aa, Homo Sapiens
GSPFPVSAL

SEQ ID NO: 412996 - protein, 9 aa, Homo Sapiens
DSPQSVFPL

SEQ ID NO: 412997 - protein, 9 aa, Homo Sapiens
SKPKPLVVQ

SEQ ID NO: 412998 - protein, 9 aa, Homo Sapiens
PGWKRTQQR

SEQ ID NO: 412999 - protein, 9 aa, Homo Sapiens
SHKICWLIV

SEQ ID NO: 413000 - protein, 9 aa, Homo Sapiens
DQDDNAPEI

SEQ ID NO: 413001 - protein, 9 aa, Homo Sapiens
LLVQLNDEA

SEQ ID NO: 413002 - protein, 9 aa, Homo Sapiens
FFFFALCSR

SEQ ID NO: 413003 - protein, 9 aa, Homo Sapiens
GGSRPGWKR

SEQ ID NO: 413004 - protein, 9 aa, Homo Sapiens
ECGKCFIYR

SEQ ID NO: 413005 - protein, 9 aa, Homo Sapiens
CHSDETWSY

SEQ ID NO: 413006 - protein, 9 aa, Homo Sapiens
LDHLINNDH

SEQ ID NO: 413007 - protein, 9 aa, Homo Sapiens
IDFMDLAST

SEQ ID NO: 413008 - protein, 9 aa, Homo Sapiens
PPVPAPSQL

SEQ ID NO: 413009 - protein, 9 aa, Homo Sapiens
LLDLPGLSD

SEQ ID NO: 413010 - protein, 9 aa, Homo Sapiens
VIYVHLHFK

SEQ ID NO: 413011 - protein, 9 aa, Homo Sapiens
DGRTVDSPG

SEQ ID NO: 413012 - protein, 9 aa, Homo Sapiens
RKEQLRCPQ

SEQ ID NO: 413013 - protein, 9 aa, Homo Sapiens
LFTRFDKLA

SEQ ID NO: 413014 - protein, 9 aa, Homo Sapiens
GEAAQPLGA

SEQ ID NO: 413015 - protein, 9 aa, Homo Sapiens
RVKTPGGPP

SEQ ID NO: 413016 - protein, 9 aa, Homo Sapiens
SLEMDLDED

SEQ ID NO: 413017 - protein, 9 aa, Homo Sapiens
EALATEQQP

SEQ ID NO: 413018 - protein, 9 aa, Homo Sapiens
SVKCVDVRK

SEQ ID NO: 413019 - protein, 9 aa, Homo Sapiens
FSSQGSQCT

SEQ ID NO: 413020 - protein, 9 aa, Homo Sapiens
RIEEIQYEI

SEQ ID NO: 413021 - protein, 9 aa, Homo Sapiens
PRFRWEVEK

SEQ ID NO: 413022 - protein, 9 aa, Homo Sapiens
MVDLLDPYK

SEQ ID NO: 413023 - protein, 9 aa, Homo Sapiens
CSLFTCLQA

SEQ ID NO: 413024 - protein, 9 aa, Homo Sapiens
QTTSNTFIV

SEQ ID NO: 413025 - protein, 9 aa, Homo Sapiens
DDPRRSPFP

SEQ ID NO: 413026 - protein, 9 aa, Homo Sapiens
SFMQYTVLV

SEQ ID NO: 413027 - protein, 9 aa, Homo Sapiens
SGRSCPEPR

SEQ ID NO: 413028 - protein, 9 aa, Homo Sapiens
NWKVLERRA

SEQ ID NO: 413029 - protein, 9 aa, Homo Sapiens
PWCPPRTPW

SEQ ID NO: 413030 - protein, 9 aa, Homo Sapiens
DPSECVLSD

SEQ ID NO: 413031 - protein, 9 aa, Homo Sapiens
GGRQKKGVA

SEQ ID NO: 413032 - protein, 9 aa, Homo Sapiens
PCTRLARGS

SEQ ID NO: 413033 - protein, 9 aa, Homo Sapiens
LSRAISHMD

SEQ ID NO: 413034 - protein, 9 aa, Homo Sapiens
WPVSMSFPL

SEQ ID NO: 413035 - protein, 9 aa, Homo Sapiens
YYPPILRSA

SEQ ID NO: 413036 - protein, 9 aa, Homo Sapiens
TTKELEEEI

SEQ ID NO: 413037 - protein, 9 aa, Homo Sapiens
AWRRRAATR

SEQ ID NO: 413038 - protein, 9 aa, Homo Sapiens
DTGENGLRT

SEQ ID NO: 413039 - protein, 9 aa, Homo Sapiens
GSRGLGASS

SEQ ID NO: 413040 - protein, 9 aa, Homo Sapiens
LAERGVHIV

SEQ ID NO: 413041 - protein, 9 aa, Homo Sapiens
WGGCPAHPQ

SEQ ID NO: 413042 - protein, 9 aa, Homo Sapiens
PVAFLAEEA

SEQ ID NO: 413043 - protein, 9 aa, Homo Sapiens
KRKDKKRVV

SEQ ID NO: 413044 - protein, 9 aa, Homo Sapiens
LQMECVGTW

SEQ ID NO: 413045 - protein, 9 aa, Homo Sapiens
HDQELFFSM

SEQ ID NO: 413046 - protein, 9 aa, Homo Sapiens
FPVSALIAI

SEQ ID NO: 413047 - protein, 9 aa, Homo Sapiens
ASKDLLINV

SEQ ID NO: 413048 - protein, 9 aa, Homo Sapiens
RTSQYTQTT

SEQ ID NO: 413049 - protein, 9 aa, Homo Sapiens
NWQRIDLLT

SEQ ID NO: 413050 - protein, 9 aa, Homo Sapiens
AEFIPHLEL

SEQ ID NO: 413051 - protein, 9 aa, Homo Sapiens
LEARVVPRT

SEQ ID NO: 413052 - protein, 9 aa, Homo Sapiens
HGAPAPSLG

SEQ ID NO: 413053 - protein, 9 aa, Homo Sapiens
NTSPGVVVD

SEQ ID NO: 413054 - protein, 9 aa, Homo Sapiens
DQHRGLRVM

SEQ ID NO: 413055 - protein, 9 aa, Homo Sapiens
KNLIVPRIG

SEQ ID NO: 413056 - protein, 9 aa, Homo Sapiens
AFSHDNIYE

SEQ ID NO: 413057 - protein, 9 aa, Homo Sapiens
LVQLLLQGP

SEQ ID NO: 413058 - protein, 9 aa, Homo Sapiens
FRHMEIDKN

SEQ ID NO: 413059 - protein, 9 aa, Homo Sapiens
WGMGMRTSQ

SEQ ID NO: 413060 - protein, 9 aa, Homo Sapiens
VMVEPSNEP

SEQ ID NO: 413061 - protein, 9 aa, Homo Sapiens
PGAWSGPSA

SEQ ID NO: 413062 - protein, 9 aa, Homo Sapiens
APPPRGQAP

SEQ ID NO: 413063 - protein, 9 aa, Homo Sapiens
CITAATQDF

SEQ ID NO: 413064 - protein, 9 aa, Homo Sapiens
CTATSCGSR

SEQ ID NO: 413065 - protein, 9 aa, Homo Sapiens
AAARSQGYL

SEQ ID NO: 413066 - protein, 9 aa, Homo Sapiens
HCFSLQLGD

SEQ ID NO: 413067 - protein, 9 aa, Homo Sapiens
LALIEDQGL

SEQ ID NO: 413068 - protein, 9 aa, Homo Sapiens
VVVGAFMVC

SEQ ID NO: 413069 - protein, 9 aa, Homo Sapiens
NEAWSMLLR

SEQ ID NO: 413070 - protein, 9 aa, Homo Sapiens
MLLRTVHSV

SEQ ID NO: 413071 - protein, 9 aa, Homo Sapiens
ILELREEVE

SEQ ID NO: 413072 - protein, 9 aa, Homo Sapiens
RLLLVLPGE

SEQ ID NO: 413073 - protein, 9 aa, Homo Sapiens
ITKIYHCSQ

SEQ ID NO: 413074 - protein, 9 aa, Homo Sapiens
HVEKSASCT

SEQ ID NO: 413075 - protein, 9 aa, Homo Sapiens
PPSSHSLAW

SEQ ID NO: 413076 - protein, 9 aa, Homo Sapiens
QEDLRVEVT

SEQ ID NO: 413077 - protein, 9 aa, Homo Sapiens
VQELLILQL

SEQ ID NO: 413078 - protein, 9 aa, Homo Sapiens
VFVSIPLLI

SEQ ID NO: 413079 - protein, 9 aa, Homo Sapiens
PTTRLMAPV

SEQ ID NO: 413080 - protein, 9 aa, Homo Sapiens
SLAPGERRW

SEQ ID NO: 413081 - protein, 9 aa, Homo Sapiens
MSGEQPPCL

SEQ ID NO: 413082 - protein, 9 aa, Homo Sapiens
DMMLEENEV

SEQ ID NO: 413083 - protein, 9 aa, Homo Sapiens
GKETFHHFV

SEQ ID NO: 413084 - protein, 9 aa, Homo Sapiens
VAVGCRRCS

SEQ ID NO: 413085 - protein, 9 aa, Homo Sapiens
HGEQLREQR

SEQ ID NO: 413086 - protein, 9 aa, Homo Sapiens
CCSGQELVD

SEQ ID NO: 413087 - protein, 9 aa, Homo Sapiens
VNLTESCRS

SEQ ID NO: 413088 - protein, 9 aa, Homo Sapiens
HQQQVTTYL

SEQ ID NO: 413089 - protein, 9 aa, Homo Sapiens
EDQCLIEEL

SEQ ID NO: 413090 - protein, 9 aa, Homo Sapiens
SLVMLMLDG

SEQ ID NO: 413091 - protein, 9 aa, Homo Sapiens
RRPSFPAQP

SEQ ID NO: 413092 - protein, 9 aa, Homo Sapiens
AQPTVPRKT

SEQ ID NO: 413093 - protein, 9 aa, Homo Sapiens
PLGGTTPKP

SEQ ID NO: 413094 - protein, 9 aa, Homo Sapiens
KKAFKAFSS

SEQ ID NO: 413095 - protein, 9 aa, Homo Sapiens
QRAVSVTLF

SEQ ID NO: 413096 - protein, 9 aa, Homo Sapiens
CWGRRRRQW

SEQ ID NO: 413097 - protein, 9 aa, Homo Sapiens
FWLALQAGP

SEQ ID NO: 413098 - protein, 9 aa, Homo Sapiens
GNPIPSEVP

SEQ ID NO: 413099 - protein, 9 aa, Homo Sapiens
YNIAACPAL

SEQ ID NO: 413100 - protein, 9 aa, Homo Sapiens
WYENLSGLQ

SEQ ID NO: 413101 - protein, 9 aa, Homo Sapiens
IAFAHDSTH

SEQ ID NO: 413102 - protein, 9 aa, Homo Sapiens
ASSHYGTPE

SEQ ID NO: 413103 - protein, 9 aa, Homo Sapiens
CHLRQPAFG

SEQ ID NO: 413104 - protein, 9 aa, Homo Sapiens
RRKRKGRGT

SEQ ID NO: 413105 - protein, 9 aa, Homo Sapiens
LRCARPIWY

SEQ ID NO: 413106 - protein, 9 aa, Homo Sapiens
YSAMPGRLF

SEQ ID NO: 413107 - protein, 9 aa, Homo Sapiens
TEMPSEQVL

SEQ ID NO: 413108 - protein, 9 aa, Homo Sapiens
QAYARRYSW

SEQ ID NO: 413109 - protein, 9 aa, Homo Sapiens
TLRDMVDFL

SEQ ID NO: 413110 - protein, 9 aa, Homo Sapiens
AACPLPGAG

SEQ ID NO: 413111 - protein, 9 aa, Homo Sapiens
RASLRATVP

SEQ ID NO: 413112 - protein, 9 aa, Homo Sapiens
GLQSATHPQ

SEQ ID NO: 413113 - protein, 9 aa, Homo Sapiens
LSKHGRCSS

SEQ ID NO: 413114 - protein, 9 aa, Homo Sapiens
AERVTIMPK

SEQ ID NO: 413115 - protein, 9 aa, Homo Sapiens
PFPRQRRRR

SEQ ID NO: 413116 - protein, 9 aa, Homo Sapiens
IYQKLTSAT

SEQ ID NO: 413117 - protein, 9 aa, Homo Sapiens
KALKKASSP

SEQ ID NO: 413118 - protein, 9 aa, Homo Sapiens
QSSSLITHQ

SEQ ID NO: 413119 - protein, 9 aa, Homo Sapiens
RKTTSFSSL

SEQ ID NO: 413120 - protein, 9 aa, Homo Sapiens
MKRASKEVV

SEQ ID NO: 413121 - protein, 9 aa, Homo Sapiens
EGLGNLLEK

SEQ ID NO: 413122 - protein, 9 aa, Homo Sapiens
LLLDCLVFA

SEQ ID NO: 413123 - protein, 9 aa, Homo Sapiens
GGCTQDLPG

SEQ ID NO: 413124 - protein, 9 aa, Homo Sapiens
FVMTQGDFM

SEQ ID NO: 413125 - protein, 9 aa, Homo Sapiens
RKLQTTSNT

SEQ ID NO: 413126 - protein, 9 aa, Homo Sapiens
DESELLMVP

SEQ ID NO: 413127 - protein, 9 aa, Homo Sapiens
ILCLRLLWI

SEQ ID NO: 413128 - protein, 9 aa, Homo Sapiens
DRTDIPSVI

SEQ ID NO: 413129 - protein, 9 aa, Homo Sapiens
QMPPVMLKV

SEQ ID NO: 413130 - protein, 9 aa, Homo Sapiens
QVGCRKSSL

SEQ ID NO: 413131 - protein, 9 aa, Homo Sapiens
ALEEKGQQI

SEQ ID NO: 413132 - protein, 9 aa, Homo Sapiens
LTVIMRLQL

SEQ ID NO: 413133 - protein, 9 aa, Homo Sapiens
EECKEKLVS

SEQ ID NO: 413134 - protein, 9 aa, Homo Sapiens
RTKIRKRKV

SEQ ID NO: 413135 - protein, 9 aa, Homo Sapiens
LLGPPPGCG

SEQ ID NO: 413136 - protein, 9 aa, Homo Sapiens
FEMHELNVL

SEQ ID NO: 413137 - protein, 9 aa, Homo Sapiens
WRCLPHCSS

SEQ ID NO: 413138 - protein, 9 aa, Homo Sapiens
SWLDLEFIC

SEQ ID NO: 413139 - protein, 9 aa, Homo Sapiens
LVALVYSLC

SEQ ID NO: 413140 - protein, 9 aa, Homo Sapiens
NKLAEVKES

SEQ ID NO: 413141 - protein, 9 aa, Homo Sapiens
RMNDLHNLN

SEQ ID NO: 413142 - protein, 9 aa, Homo Sapiens
TGAVATVLG

SEQ ID NO: 413143 - protein, 9 aa, Homo Sapiens
IKLHTRDKK

SEQ ID NO: 413144 - protein, 9 aa, Homo Sapiens
PVVNVLFRQ

SEQ ID NO: 413145 - protein, 9 aa, Homo Sapiens
WAVGILHSV

SEQ ID NO: 413146 - protein, 9 aa, Homo Sapiens
NMGGNRSIC

SEQ ID NO: 413147 - protein, 9 aa, Homo Sapiens
FVSVGPRPS

SEQ ID NO: 413148 - protein, 9 aa, Homo Sapiens
DKKRKDRRA

SEQ ID NO: 413149 - protein, 9 aa, Homo Sapiens
QTVKEFIIF

SEQ ID NO: 413150 - protein, 9 aa, Homo Sapiens
QTALYRGGQ

SEQ ID NO: 413151 - protein, 9 aa, Homo Sapiens
GSRGSRRRG

SEQ ID NO: 413152 - protein, 9 aa, Homo Sapiens
FGLGIFKMA

SEQ ID NO: 413153 - protein, 9 aa, Homo Sapiens
GHSHFYNNR

SEQ ID NO: 413154 - protein, 9 aa, Homo Sapiens
PSWPDGWAA

SEQ ID NO: 413155 - protein, 9 aa, Homo Sapiens
KDSGLDVDV

SEQ ID NO: 413156 - protein, 9 aa, Homo Sapiens
RVGDRGPAA

SEQ ID NO: 413157 - protein, 9 aa, Homo Sapiens
NIYTGLFLF

SEQ ID NO: 413158 - protein, 9 aa, Homo Sapiens
VGLLGHLRG

SEQ ID NO: 413159 - protein, 9 aa, Homo Sapiens
LNGGQHIDY

SEQ ID NO: 413160 - protein, 9 aa, Homo Sapiens
EKKIFFQKC

SEQ ID NO: 413161 - protein, 9 aa, Homo Sapiens
MPVPEGCSP

SEQ ID NO: 413162 - protein, 9 aa, Homo Sapiens
PEGMPPMEP

SEQ ID NO: 413163 - protein, 9 aa, Homo Sapiens
PSDFSRVFS

SEQ ID NO: 413164 - protein, 9 aa, Homo Sapiens
SRGPSPSVH

SEQ ID NO: 413165 - protein, 9 aa, Homo Sapiens
MMLEENEVR

SEQ ID NO: 413166 - protein, 9 aa, Homo Sapiens
RKKEEARQV

SEQ ID NO: 413167 - protein, 9 aa, Homo Sapiens
LLSTKGMLQ

SEQ ID NO: 413168 - protein, 9 aa, Homo Sapiens
ARIGRILCL

SEQ ID NO: 413169 - protein, 9 aa, Homo Sapiens
QQKAFGTCG

SEQ ID NO: 413170 - protein, 9 aa, Homo Sapiens
ALAQLNDRR

SEQ ID NO: 413171 - protein, 9 aa, Homo Sapiens
NTTQRPFDI

SEQ ID NO: 413172 - protein, 9 aa, Homo Sapiens
DFQQRILVA

SEQ ID NO: 413173 - protein, 9 aa, Homo Sapiens
TYSSSILSI

SEQ ID NO: 413174 - protein, 9 aa, Homo Sapiens
VLLSPDERH

SEQ ID NO: 413175 - protein, 9 aa, Homo Sapiens
SCTTIHLHL

SEQ ID NO: 413176 - protein, 9 aa, Homo Sapiens
YNPSFAICG

SEQ ID NO: 413177 - protein, 9 aa, Homo Sapiens
GTDPDADLY

SEQ ID NO: 413178 - protein, 9 aa, Homo Sapiens
EEHNLYQCG

SEQ ID NO: 413179 - protein, 9 aa, Homo Sapiens
PQVPQQEAA

SEQ ID NO: 413180 - protein, 9 aa, Homo Sapiens
KRKKAVIFV

SEQ ID NO: 413181 - protein, 9 aa, Homo Sapiens
PSICVFLVR

SEQ ID NO: 413182 - protein, 9 aa, Homo Sapiens
KVVSEEDFW

SEQ ID NO: 413183 - protein, 9 aa, Homo Sapiens
EREQEEELP

SEQ ID NO: 413184 - protein, 9 aa, Homo Sapiens
SQCTKEPRL

SEQ ID NO: 413185 - protein, 9 aa, Homo Sapiens
VDKILTHVH

SEQ ID NO: 413186 - protein, 9 aa, Homo Sapiens
PSTPWAIAV

SEQ ID NO: 413187 - protein, 9 aa, Homo Sapiens
GARMTVLQP

SEQ ID NO: 413188 - protein, 9 aa, Homo Sapiens
ERRSSPLLC

SEQ ID NO: 413189 - protein, 9 aa, Homo Sapiens
AGDQGWAPP

SEQ ID NO: 413190 - protein, 9 aa, Homo Sapiens
ELDVQELLI

SEQ ID NO: 413191 - protein, 9 aa, Homo Sapiens
KHALEWFEQ

SEQ ID NO: 413192 - protein, 9 aa, Homo Sapiens
TIDDTVITT

SEQ ID NO: 413193 - protein, 9 aa, Homo Sapiens
SATIRNDFC

SEQ ID NO: 413194 - protein, 9 aa, Homo Sapiens
AHDSTHVIQ

SEQ ID NO: 413195 - protein, 9 aa, Homo Sapiens
TSQPGATTR

SEQ ID NO: 413196 - protein, 9 aa, Homo Sapiens
WAGPHPEGL

SEQ ID NO: 413197 - protein, 9 aa, Homo Sapiens
VKSLQALDE

SEQ ID NO: 413198 - protein, 9 aa, Homo Sapiens
DDARKKVPA

SEQ ID NO: 413199 - protein, 9 aa, Homo Sapiens
GLDAYPYPL

SEQ ID NO: 413200 - protein, 9 aa, Homo Sapiens
RQQYCRALL

SEQ ID NO: 413201 - protein, 9 aa, Homo Sapiens
SCGSRASTH

SEQ ID NO: 413202 - protein, 9 aa, Homo Sapiens
SARPAPPYT

SEQ ID NO: 413203 - protein, 9 aa, Homo Sapiens
SLLDEDPLS

SEQ ID NO: 413204 - protein, 9 aa, Homo Sapiens
SPSPTASAF

SEQ ID NO: 413205 - protein, 9 aa, Homo Sapiens
PEENHEVFK

SEQ ID NO: 413206 - protein, 9 aa, Homo Sapiens
GATGERTKE

SEQ ID NO: 413207 - protein, 9 aa, Homo Sapiens
VGNGCAGGG

SEQ ID NO: 413208 - protein, 9 aa, Homo Sapiens
SCLCSSPGT

SEQ ID NO: 413209 - protein, 9 aa, Homo Sapiens
QSAEGQQKA

SEQ ID NO: 413210 - protein, 9 aa, Homo Sapiens
NMKVYHLEL

SEQ ID NO: 413211 - protein, 9 aa, Homo Sapiens
EEFDYLTMD

SEQ ID NO: 413212 - protein, 9 aa, Homo Sapiens
RASTHWPSR

SEQ ID NO: 413213 - protein, 9 aa, Homo Sapiens
AWDGGSPSL

SEQ ID NO: 413214 - protein, 9 aa, Homo Sapiens
GSEGPYGVF

SEQ ID NO: 413215 - protein, 9 aa, Homo Sapiens
HWTTTAIPS

SEQ ID NO: 413216 - protein, 9 aa, Homo Sapiens
WICSQAERQ

SEQ ID NO: 413217 - protein, 9 aa, Homo Sapiens
APKVILSWM

SEQ ID NO: 413218 - protein, 9 aa, Homo Sapiens
LFPHSTHGI

SEQ ID NO: 413219 - protein, 9 aa, Homo Sapiens
KCKESLETC

SEQ ID NO: 413220 - protein, 9 aa, Homo Sapiens
RKAARVKMR

SEQ ID NO: 413221 - protein, 9 aa, Homo Sapiens
SPIIIGRKP

SEQ ID NO: 413222 - protein, 9 aa, Homo Sapiens
QYALLREEE

SEQ ID NO: 413223 - protein, 9 aa, Homo Sapiens
VVGVFFGDR

SEQ ID NO: 413224 - protein, 9 aa, Homo Sapiens
PRIERYRLD

SEQ ID NO: 413225 - protein, 9 aa, Homo Sapiens
RRRPLAASS

SEQ ID NO: 413226 - protein, 9 aa, Homo Sapiens
APTQERSTS

SEQ ID NO: 413227 - protein, 9 aa, Homo Sapiens
KNWYLFCLS

SEQ ID NO: 413228 - protein, 9 aa, Homo Sapiens
LPEDPVLLA

SEQ ID NO: 413229 - protein, 9 aa, Homo Sapiens
ARLSPSSWT

SEQ ID NO: 413230 - protein, 9 aa, Homo Sapiens
WGSFPLQCW

SEQ ID NO: 413231 - protein, 9 aa, Homo Sapiens
TSEEQIVLL

SEQ ID NO: 413232 - protein, 9 aa, Homo Sapiens
FGFMTMTNY

SEQ ID NO: 413233 - protein, 9 aa, Homo Sapiens
RNFTSVTQA

SEQ ID NO: 413234 - protein, 9 aa, Homo Sapiens
DTMSDLTRN

SEQ ID NO: 413235 - protein, 9 aa, Homo Sapiens
KRLSRGVQS

SEQ ID NO: 413236 - protein, 9 aa, Homo Sapiens
LCKHKKKGR

SEQ ID NO: 413237 - protein, 9 aa, Homo Sapiens
PPGSSHACV

SEQ ID NO: 413238 - protein, 9 aa, Homo Sapiens
LEAICLLGG

SEQ ID NO: 413239 - protein, 9 aa, Homo Sapiens
PQMVTHYAV

SEQ ID NO: 413240 - protein, 9 aa, Homo Sapiens
EAALRPMPV

SEQ ID NO: 413241 - protein, 9 aa, Homo Sapiens
ADPQAVTTP

SEQ ID NO: 413242 - protein, 9 aa, Homo Sapiens
GPCASLLST

SEQ ID NO: 413243 - protein, 9 aa, Homo Sapiens
SINHFFVTP

SEQ ID NO: 413244 - protein, 9 aa, Homo Sapiens
KIETSLPKP

SEQ ID NO: 413245 - protein, 9 aa, Homo Sapiens
STFSISSST

SEQ ID NO: 413246 - protein, 9 aa, Homo Sapiens
YIDFRIGDR

SEQ ID NO: 413247 - protein, 9 aa, Homo Sapiens
VKQPNAVHP

SEQ ID NO: 413248 - protein, 9 aa, Homo Sapiens
EVVHDGEAE

SEQ ID NO: 413249 - protein, 9 aa, Homo Sapiens
SDEHISLGQ

SEQ ID NO: 413250 - protein, 9 aa, Homo Sapiens
PLENYQIPL

SEQ ID NO: 413251 - protein, 9 aa, Homo Sapiens
RSPAPITLP

SEQ ID NO: 413252 - protein, 9 aa, Homo Sapiens
GLISVLHIL

SEQ ID NO: 413253 - protein, 9 aa, Homo Sapiens
LHLTEEKQT

SEQ ID NO: 413254 - protein, 9 aa, Homo Sapiens
SEPGTQEVL

SEQ ID NO: 413255 - protein, 9 aa, Homo Sapiens
SVTQALTEW

SEQ ID NO: 413256 - protein, 9 aa, Homo Sapiens
MGFAQKSNM

SEQ ID NO: 413257 - protein, 9 aa, Homo Sapiens
IVTPLLTSI

SEQ ID NO: 413258 - protein, 9 aa, Homo Sapiens
SAPGATPRD

SEQ ID NO: 413259 - protein, 9 aa, Homo Sapiens
LNISCLSVQ

SEQ ID NO: 413260 - protein, 9 aa, Homo Sapiens
GPLYGWEQL

SEQ ID NO: 413261 - protein, 9 aa, Homo Sapiens
ALPSLLSRM

SEQ ID NO: 413262 - protein, 9 aa, Homo Sapiens
GWAPFSVGL

SEQ ID NO: 413263 - protein, 9 aa, Homo Sapiens
QPAVPWQKE

SEQ ID NO: 413264 - protein, 9 aa, Homo Sapiens
SNLQAQRHP

SEQ ID NO: 413265 - protein, 9 aa, Homo Sapiens
QEDHTVIVS

SEQ ID NO: 413266 - protein, 9 aa, Homo Sapiens
QPPPQAPSQ

SEQ ID NO: 413267 - protein, 9 aa, Homo Sapiens
NQKGEQVFH

SEQ ID NO: 413268 - protein, 9 aa, Homo Sapiens
PGSREWAIC

SEQ ID NO: 413269 - protein, 9 aa, Homo Sapiens
GSHLPAART

SEQ ID NO: 413270 - protein, 9 aa, Homo Sapiens
QPLPDVVRQ

SEQ ID NO: 413271 - protein, 9 aa, Homo Sapiens
RRSSPLLCR

SEQ ID NO: 413272 - protein, 9 aa, Homo Sapiens
ELTVQIVAD

SEQ ID NO: 413273 - protein, 9 aa, Homo Sapiens
MINYVLFYV

SEQ ID NO: 413274 - protein, 9 aa, Homo Sapiens
EAAAVVMVV

SEQ ID NO: 413275 - protein, 9 aa, Homo Sapiens
SSKLCGLKR

SEQ ID NO: 413276 - protein, 9 aa, Homo Sapiens
LAGSQMQGE

SEQ ID NO: 413277 - protein, 9 aa, Homo Sapiens
AAGPGTGAE

SEQ ID NO: 413278 - protein, 9 aa, Homo Sapiens
QPGHSHFYN

SEQ ID NO: 413279 - protein, 9 aa, Homo Sapiens
IKKKIEMKG

SEQ ID NO: 413280 - protein, 9 aa, Homo Sapiens
FKKSKKSSH

SEQ ID NO: 413281 - protein, 9 aa, Homo Sapiens
PGCTKEEDI

SEQ ID NO: 413282 - protein, 9 aa, Homo Sapiens
SYLLQLSKL

SEQ ID NO: 413283 - protein, 9 aa, Homo Sapiens
PSSWDCRCM

SEQ ID NO: 413284 - protein, 9 aa, Homo Sapiens
LLAVPQVNM

SEQ ID NO: 413285 - protein, 9 aa, Homo Sapiens
PVPRVSLTP

SEQ ID NO: 413286 - protein, 9 aa, Homo Sapiens
LLQGSLHVS

SEQ ID NO: 413287 - protein, 9 aa, Homo Sapiens
LASRWKPCD

SEQ ID NO: 413288 - protein, 9 aa, Homo Sapiens
FWKEPSLLS

SEQ ID NO: 413289 - protein, 9 aa, Homo Sapiens
KTRVRISPF

SEQ ID NO: 413290 - protein, 9 aa, Homo Sapiens
MDTMMLNVQ

SEQ ID NO: 413291 - protein, 9 aa, Homo Sapiens
VRPCVPGYQ

SEQ ID NO: 413292 - protein, 9 aa, Homo Sapiens
GSRRRGSMN

SEQ ID NO: 413293 - protein, 9 aa, Homo Sapiens
AHGHVEVVT

SEQ ID NO: 413294 - protein, 9 aa, Homo Sapiens
NPHSGTLVT

SEQ ID NO: 413295 - protein, 9 aa, Homo Sapiens
STRKNGGGL

SEQ ID NO: 413296 - protein, 9 aa, Homo Sapiens
REKAEQERL

SEQ ID NO: 413297 - protein, 9 aa, Homo Sapiens
HSGVSTQDQ

SEQ ID NO: 413298 - protein, 9 aa, Homo Sapiens
TASMCSWLL

SEQ ID NO: 413299 - protein, 9 aa, Homo Sapiens
RCLESLCED

SEQ ID NO: 413300 - protein, 9 aa, Homo Sapiens
DLIAVRQVD

SEQ ID NO: 413301 - protein, 9 aa, Homo Sapiens
SGGQGQDGS

SEQ ID NO: 413302 - protein, 9 aa, Homo Sapiens
VGVPPLPAT

SEQ ID NO: 413303 - protein, 9 aa, Homo Sapiens
RVLLRFCRP

SEQ ID NO: 413304 - protein, 9 aa, Homo Sapiens
LSRSSMLKS

SEQ ID NO: 413305 - protein, 9 aa, Homo Sapiens
QPRSPLQPH

SEQ ID NO: 413306 - protein, 9 aa, Homo Sapiens
SQLYIYWVQ

SEQ ID NO: 413307 - protein, 9 aa, Homo Sapiens
HASQQFCYT

SEQ ID NO: 413308 - protein, 9 aa, Homo Sapiens
LVTLLNTEV

SEQ ID NO: 413309 - protein, 9 aa, Homo Sapiens
KHLTTPSST

SEQ ID NO: 413310 - protein, 9 aa, Homo Sapiens
LYLVPDNAF

SEQ ID NO: 413311 - protein, 9 aa, Homo Sapiens
ADTGQECFN

SEQ ID NO: 413312 - protein, 9 aa, Homo Sapiens
QPKSKPTTG

SEQ ID NO: 413313 - protein, 9 aa, Homo Sapiens
SSLRPRPPE

SEQ ID NO: 413314 - protein, 9 aa, Homo Sapiens
IKQKVLREK

SEQ ID NO: 413315 - protein, 9 aa, Homo Sapiens
SGPGAGSGT

SEQ ID NO: 413316 - protein, 9 aa, Homo Sapiens
AETHLETTQ

SEQ ID NO: 413317 - protein, 9 aa, Homo Sapiens
QKKEEADYG

SEQ ID NO: 413318 - protein, 9 aa, Homo Sapiens
WGYCVQVLW

SEQ ID NO: 413319 - protein, 9 aa, Homo Sapiens
QVLSSLEAP

SEQ ID NO: 413320 - protein, 9 aa, Homo Sapiens
AARLLDQLA

SEQ ID NO: 413321 - protein, 9 aa, Homo Sapiens
QEGRSHHGP

SEQ ID NO: 413322 - protein, 9 aa, Homo Sapiens
APQVAMLPK

SEQ ID NO: 413323 - protein, 9 aa, Homo Sapiens
ISSSSHPSF

SEQ ID NO: 413324 - protein, 9 aa, Homo Sapiens
EVRVVVRES

SEQ ID NO: 413325 - protein, 9 aa, Homo Sapiens
NGYYLSQRC

SEQ ID NO: 413326 - protein, 9 aa, Homo Sapiens
GACAPISYP

SEQ ID NO: 413327 - protein, 9 aa, Homo Sapiens
QEVRKKMAL

SEQ ID NO: 413328 - protein, 9 aa, Homo Sapiens
NVTKKKVSQ

SEQ ID NO: 413329 - protein, 9 aa, Homo Sapiens
EHAGARLQE

SEQ ID NO: 413330 - protein, 9 aa, Homo Sapiens
FVILASRWK

SEQ ID NO: 413331 - protein, 9 aa, Homo Sapiens
QYHCSHLAM

SEQ ID NO: 413332 - protein, 9 aa, Homo Sapiens
VTGNLHPEE

SEQ ID NO: 413333 - protein, 9 aa, Homo Sapiens
CPPPVTPLR

SEQ ID NO: 413334 - protein, 9 aa, Homo Sapiens
LQGLSLVGW

SEQ ID NO: 413335 - protein, 9 aa, Homo Sapiens
EVDKILTHV

SEQ ID NO: 413336 - protein, 9 aa, Homo Sapiens
DPDADLYKF

SEQ ID NO: 413337 - protein, 9 aa, Homo Sapiens
YLTTMDLFH

SEQ ID NO: 413338 - protein, 9 aa, Homo Sapiens
LNTAVPQEM

SEQ ID NO: 413339 - protein, 9 aa, Homo Sapiens
ISLSLSVHW

SEQ ID NO: 413340 - protein, 9 aa, Homo Sapiens
QPCQLHGNL

SEQ ID NO: 413341 - protein, 9 aa, Homo Sapiens
REKIINPTI

SEQ ID NO: 413342 - protein, 9 aa, Homo Sapiens
GCTRCTCTT

SEQ ID NO: 413343 - protein, 9 aa, Homo Sapiens
DVFLICFPL

SEQ ID NO: 413344 - protein, 9 aa, Homo Sapiens
LGLSTGKKE

SEQ ID NO: 413345 - protein, 9 aa, Homo Sapiens
PTWLSSSGS

SEQ ID NO: 413346 - protein, 9 aa, Homo Sapiens
SPGTDPDAD

SEQ ID NO: 413347 - protein, 9 aa, Homo Sapiens
AASSHYGTP

SEQ ID NO: 413348 - protein, 9 aa, Homo Sapiens
RQALVQQGD

SEQ ID NO: 413349 - protein, 9 aa, Homo Sapiens
GCPLASTPP

SEQ ID NO: 413350 - protein, 9 aa, Homo Sapiens
KCVDSPMLN

SEQ ID NO: 413351 - protein, 9 aa, Homo Sapiens
TQQRPPWRT

SEQ ID NO: 413352 - protein, 9 aa, Homo Sapiens
TLCRAYEAA

SEQ ID NO: 413353 - protein, 9 aa, Homo Sapiens
VSDEDGVSA

SEQ ID NO: 413354 - protein, 9 aa, Homo Sapiens
PPWRTSRGQ

SEQ ID NO: 413355 - protein, 9 aa, Homo Sapiens
RKIADENRA

SEQ ID NO: 413356 - protein, 9 aa, Homo Sapiens
GTCNIYYLC

SEQ ID NO: 413357 - protein, 9 aa, Homo Sapiens
TMDELHREL

SEQ ID NO: 413358 - protein, 9 aa, Homo Sapiens
ISLFLGSHP

SEQ ID NO: 413359 - protein, 9 aa, Homo Sapiens
RRAPQHESS

SEQ ID NO: 413360 - protein, 9 aa, Homo Sapiens
ECISAYDDK

SEQ ID NO: 413361 - protein, 9 aa, Homo Sapiens
FLACVGADV

SEQ ID NO: 413362 - protein, 9 aa, Homo Sapiens
LLFISLFWE

SEQ ID NO: 413363 - protein, 9 aa, Homo Sapiens
FKILVQCAI

SEQ ID NO: 413364 - protein, 9 aa, Homo Sapiens
FHRRCWRRR

SEQ ID NO: 413365 - protein, 9 aa, Homo Sapiens
AFSSEQWSE

SEQ ID NO: 413366 - protein, 9 aa, Homo Sapiens
ILKMMMKLK

SEQ ID NO: 413367 - protein, 9 aa, Homo Sapiens
RLHELSPPR

SEQ ID NO: 413368 - protein, 9 aa, Homo Sapiens
LSRHEFIHT

SEQ ID NO: 413369 - protein, 9 aa, Homo Sapiens
HEDYGLSVT

SEQ ID NO: 413370 - protein, 9 aa, Homo Sapiens
QGLSLVGWY

SEQ ID NO: 413371 - protein, 9 aa, Homo Sapiens
QNLDPTSSS

SEQ ID NO: 413372 - protein, 9 aa, Homo Sapiens
ISGPVPPDW

SEQ ID NO: 413373 - protein, 9 aa, Homo Sapiens
GIWEVMPRT

SEQ ID NO: 413374 - protein, 9 aa, Homo Sapiens
ARVEVAAGP

SEQ ID NO: 413375 - protein, 9 aa, Homo Sapiens
PGAAGGGNP

SEQ ID NO: 413376 - protein, 9 aa, Homo Sapiens
HTEETYVKW

SEQ ID NO: 413377 - protein, 9 aa, Homo Sapiens
HSFKGRKIS

SEQ ID NO: 413378 - protein, 9 aa, Homo Sapiens
VGFVSTDFH

SEQ ID NO: 413379 - protein, 9 aa, Homo Sapiens
CSARWCLGR

SEQ ID NO: 413380 - protein, 9 aa, Homo Sapiens
QLLAATEQL

SEQ ID NO: 413381 - protein, 9 aa, Homo Sapiens
LSWILHRNA

SEQ ID NO: 413382 - protein, 9 aa, Homo Sapiens
VRPVATLSP

SEQ ID NO: 413383 - protein, 9 aa, Homo Sapiens
DIAKLQHRY

SEQ ID NO: 413384 - protein, 9 aa, Homo Sapiens
LRGRARAGV

SEQ ID NO: 413385 - protein, 9 aa, Homo Sapiens
GTITGNTID

SEQ ID NO: 413386 - protein, 9 aa, Homo Sapiens
QAPLTVRHG

SEQ ID NO: 413387 - protein, 9 aa, Homo Sapiens
HHHDRNLLR

SEQ ID NO: 413388 - protein, 9 aa, Homo Sapiens
EPILNYLRR

SEQ ID NO: 413389 - protein, 9 aa, Homo Sapiens
AVCVGGKES

SEQ ID NO: 413390 - protein, 9 aa, Homo Sapiens
TTIGVIGNF

SEQ ID NO: 413391 - protein, 9 aa, Homo Sapiens
KRPAHHRRW

SEQ ID NO: 413392 - protein, 9 aa, Homo Sapiens
SLSDFKGPW

SEQ ID NO: 413393 - protein, 9 aa, Homo Sapiens
RAQGTRRSS

SEQ ID NO: 413394 - protein, 9 aa, Homo Sapiens
ETYIGSMRP

SEQ ID NO: 413395 - protein, 9 aa, Homo Sapiens
HAPMSVPLL

SEQ ID NO: 413396 - protein, 9 aa, Homo Sapiens
PKKPTSWMS

SEQ ID NO: 413397 - protein, 9 aa, Homo Sapiens
RQTWQVVQG

SEQ ID NO: 413398 - protein, 9 aa, Homo Sapiens
IIAHVLFAL

SEQ ID NO: 413399 - protein, 9 aa, Homo Sapiens
SERCRPLST

SEQ ID NO: 413400 - protein, 9 aa, Homo Sapiens
GHLDQLIYI

SEQ ID NO: 413401 - protein, 9 aa, Homo Sapiens
MVATLPGRL

SEQ ID NO: 413402 - protein, 9 aa, Homo Sapiens
KLHTRDKKY

SEQ ID NO: 413403 - protein, 9 aa, Homo Sapiens
DLPPELLDT

SEQ ID NO: 413404 - protein, 9 aa, Homo Sapiens
HPFNQVAQC

SEQ ID NO: 413405 - protein, 9 aa, Homo Sapiens
HLTEEKQTK

SEQ ID NO: 413406 - protein, 9 aa, Homo Sapiens
YLCTSHPGG

SEQ ID NO: 413407 - protein, 9 aa, Homo Sapiens
LSQGQRWTW

SEQ ID NO: 413408 - protein, 9 aa, Homo Sapiens
LPLGQGAGH

SEQ ID NO: 413409 - protein, 9 aa, Homo Sapiens
NQAMIKIKK

SEQ ID NO: 413410 - protein, 9 aa, Homo Sapiens
AQGLLVVQA

SEQ ID NO: 413411 - protein, 9 aa, Homo Sapiens
SRVFSGKKP

SEQ ID NO: 413412 - protein, 9 aa, Homo Sapiens
LQCCCHVDD

SEQ ID NO: 413413 - protein, 9 aa, Homo Sapiens
LCNPVVLEE

SEQ ID NO: 413414 - protein, 9 aa, Homo Sapiens
EYLPISLGS

SEQ ID NO: 413415 - protein, 9 aa, Homo Sapiens
QDFVAQPKD

SEQ ID NO: 413416 - protein, 9 aa, Homo Sapiens
RITIKKRFE

SEQ ID NO: 413417 - protein, 9 aa, Homo Sapiens
MMKLMNQNP

SEQ ID NO: 413418 - protein, 9 aa, Homo Sapiens
SVMMVMADD

SEQ ID NO: 413419 - protein, 9 aa, Homo Sapiens
IWEELLKIL

SEQ ID NO: 413420 - protein, 9 aa, Homo Sapiens
HIVSRGRTQ

SEQ ID NO: 413421 - protein, 9 aa, Homo Sapiens
HVVLLAVSW

SEQ ID NO: 413422 - protein, 9 aa, Homo Sapiens
LLSMLCMNQ

SEQ ID NO: 413423 - protein, 9 aa, Homo Sapiens
RSQKGKASL

SEQ ID NO: 413424 - protein, 9 aa, Homo Sapiens
LTWVKLPIY

SEQ ID NO: 413425 - protein, 9 aa, Homo Sapiens
VIEVSHLGN

SEQ ID NO: 413426 - protein, 9 aa, Homo Sapiens
SFPLQCWGR

SEQ ID NO: 413427 - protein, 9 aa, Homo Sapiens
TAAPPPLSS

SEQ ID NO: 413428 - protein, 9 aa, Homo Sapiens
QAKKSQKGA

SEQ ID NO: 413429 - protein, 9 aa, Homo Sapiens
YLFRASDSN

SEQ ID NO: 413430 - protein, 9 aa, Homo Sapiens
PSPTASAFG

SEQ ID NO: 413431 - protein, 9 aa, Homo Sapiens
LVASSQNWG

SEQ ID NO: 413432 - protein, 9 aa, Homo Sapiens
VYVVNIIQV

SEQ ID NO: 413433 - protein, 9 aa, Homo Sapiens
ELLQDLEKE

SEQ ID NO: 413434 - protein, 9 aa, Homo Sapiens
LAAQGAGGH

SEQ ID NO: 413435 - protein, 9 aa, Homo Sapiens
GISFSVKNK

SEQ ID NO: 413436 - protein, 9 aa, Homo Sapiens
RTRMGRKRR

SEQ ID NO: 413437 - protein, 9 aa, Homo Sapiens
ARQPSRPTG

SEQ ID NO: 413438 - protein, 9 aa, Homo Sapiens
LLLLQLQQQ

SEQ ID NO: 413439 - protein, 9 aa, Homo Sapiens
KPCMAPEVF

SEQ ID NO: 413440 - protein, 9 aa, Homo Sapiens
DTRKHHQSD

SEQ ID NO: 413441 - protein, 9 aa, Homo Sapiens
TGMSLLGLH

SEQ ID NO: 413442 - protein, 9 aa, Homo Sapiens
SPCSVGGGE

SEQ ID NO: 413443 - protein, 9 aa, Homo Sapiens
GFMTMTNYD

SEQ ID NO: 413444 - protein, 9 aa, Homo Sapiens
VSVGPRPSP

SEQ ID NO: 413445 - protein, 9 aa, Homo Sapiens
NKGQKQSFS

SEQ ID NO: 413446 - protein, 9 aa, Homo Sapiens
IYQSLFLQG

SEQ ID NO: 413447 - protein, 9 aa, Homo Sapiens
SPTRSSRGT

SEQ ID NO: 413448 - protein, 9 aa, Homo Sapiens
APVHAARRL

SEQ ID NO: 413449 - protein, 9 aa, Homo Sapiens
RRLSAEIWD

SEQ ID NO: 413450 - protein, 9 aa, Homo Sapiens
GLNFFFQVE

SEQ ID NO: 413451 - protein, 9 aa, Homo Sapiens
ANMVETIPC

SEQ ID NO: 413452 - protein, 9 aa, Homo Sapiens
HPRGSQSAL

SEQ ID NO: 413453 - protein, 9 aa, Homo Sapiens
EQARRQEQL

SEQ ID NO: 413454 - protein, 9 aa, Homo Sapiens
MDVFIAMEL

SEQ ID NO: 413455 - protein, 9 aa, Homo Sapiens
NSSRDSPQS

SEQ ID NO: 413456 - protein, 9 aa, Homo Sapiens
NHRCKMKRA

SEQ ID NO: 413457 - protein, 9 aa, Homo Sapiens
TFQQYALLR

SEQ ID NO: 413458 - protein, 9 aa, Homo Sapiens
LVLVQLLEH

SEQ ID NO: 413459 - protein, 9 aa, Homo Sapiens
TQTTSGPTA

SEQ ID NO: 413460 - protein, 9 aa, Homo Sapiens
RTVDSPGIL

SEQ ID NO: 413461 - protein, 9 aa, Homo Sapiens
EEGYYYRET

SEQ ID NO: 413462 - protein, 9 aa, Homo Sapiens
GRCSQMRAR

SEQ ID NO: 413463 - protein, 9 aa, Homo Sapiens
RVLQDKGAS

SEQ ID NO: 413464 - protein, 9 aa, Homo Sapiens
LTLYKHTAM

SEQ ID NO: 413465 - protein, 9 aa, Homo Sapiens
QKCTEPLGR

SEQ ID NO: 413466 - protein, 9 aa, Homo Sapiens
YGRSQGGGR

SEQ ID NO: 413467 - protein, 9 aa, Homo Sapiens
PSEVVFWMT

SEQ ID NO: 413468 - protein, 9 aa, Homo Sapiens
ILADESDHE

SEQ ID NO: 413469 - protein, 9 aa, Homo Sapiens
QHPLGSQHI

SEQ ID NO: 413470 - protein, 9 aa, Homo Sapiens
CCMLVGYPS

SEQ ID NO: 413471 - protein, 9 aa, Homo Sapiens
QTIASYGSA

SEQ ID NO: 413472 - protein, 9 aa, Homo Sapiens
YIGDLRAIN

SEQ ID NO: 413473 - protein, 9 aa, Homo Sapiens
LFLSGCGQT

SEQ ID NO: 413474 - protein, 9 aa, Homo Sapiens
ACLSTTSQP

SEQ ID NO: 413475 - protein, 9 aa, Homo Sapiens
STAPTPSLA

SEQ ID NO: 413476 - protein, 9 aa, Homo Sapiens
FIWLPSNIY

SEQ ID NO: 413477 - protein, 9 aa, Homo Sapiens
SQHAHLTIH

SEQ ID NO: 413478 - protein, 9 aa, Homo Sapiens
QRRGRLLGR

SEQ ID NO: 413479 - protein, 9 aa, Homo Sapiens
SSGKRCPPR

SEQ ID NO: 413480 - protein, 9 aa, Homo Sapiens
CAVGLLTVI

SEQ ID NO: 413481 - protein, 9 aa, Homo Sapiens
GSRWNFVYW

SEQ ID NO: 413482 - protein, 9 aa, Homo Sapiens
RQPQPRSSD

SEQ ID NO: 413483 - protein, 9 aa, Homo Sapiens
YAGGVGAQL

SEQ ID NO: 413484 - protein, 9 aa, Homo Sapiens
WPMHPLVSA

SEQ ID NO: 413485 - protein, 9 aa, Homo Sapiens
DLEKERKRL

SEQ ID NO: 413486 - protein, 9 aa, Homo Sapiens
QSVSVCQDV

SEQ ID NO: 413487 - protein, 9 aa, Homo Sapiens
KMISRIIQM

SEQ ID NO: 413488 - protein, 9 aa, Homo Sapiens
WWWRRGALP

SEQ ID NO: 413489 - protein, 9 aa, Homo Sapiens
DLSAMKHSP

SEQ ID NO: 413490 - protein, 9 aa, Homo Sapiens
VFTIICTIS

SEQ ID NO: 413491 - protein, 9 aa, Homo Sapiens
KKALEEKGQ

SEQ ID NO: 413492 - protein, 9 aa, Homo Sapiens
PLAPPALVA

SEQ ID NO: 413493 - protein, 9 aa, Homo Sapiens
VDVRKNHHK

SEQ ID NO: 413494 - protein, 9 aa, Homo Sapiens
SLRARGNAG

SEQ ID NO: 413495 - protein, 9 aa, Homo Sapiens
FEHGVLHLH

SEQ ID NO: 413496 - protein, 9 aa, Homo Sapiens
PAASVGTSA

SEQ ID NO: 413497 - protein, 9 aa, Homo Sapiens
DNYPHAIVY

SEQ ID NO: 413498 - protein, 9 aa, Homo Sapiens
KHLRGGGSP

SEQ ID NO: 413499 - protein, 9 aa, Homo Sapiens
SFPIKYHDM

SEQ ID NO: 413500 - protein, 9 aa, Homo Sapiens
ERWQVTAEQ

SEQ ID NO: 413501 - protein, 9 aa, Homo Sapiens
GSPSRSAAC

SEQ ID NO: 413502 - protein, 9 aa, Homo Sapiens
SARHPAPTQ

SEQ ID NO: 413503 - protein, 9 aa, Homo Sapiens
PAHRAQGDS

SEQ ID NO: 413504 - protein, 9 aa, Homo Sapiens
TELSTKSMM

SEQ ID NO: 413505 - protein, 9 aa, Homo Sapiens
SRILVTSFD

SEQ ID NO: 413506 - protein, 9 aa, Homo Sapiens
NLPEGKRKL

SEQ ID NO: 413507 - protein, 9 aa, Homo Sapiens
WVQDPPLQL

SEQ ID NO: 413508 - protein, 9 aa, Homo Sapiens
WGHTKLAFP

SEQ ID NO: 413509 - protein, 9 aa, Homo Sapiens
PVPAPSQLP

SEQ ID NO: 413510 - protein, 9 aa, Homo Sapiens
SLKETTGPN

SEQ ID NO: 413511 - protein, 9 aa, Homo Sapiens
LVGGGRGTA

SEQ ID NO: 413512 - protein, 9 aa, Homo Sapiens
FGFSEPLAT

SEQ ID NO: 413513 - protein, 9 aa, Homo Sapiens
KNGETKKAA

SEQ ID NO: 413514 - protein, 9 aa, Homo Sapiens
TPWALGTGV

SEQ ID NO: 413515 - protein, 9 aa, Homo Sapiens
RTVETMQST

SEQ ID NO: 413516 - protein, 9 aa, Homo Sapiens
LPSPMQQQL

SEQ ID NO: 413517 - protein, 9 aa, Homo Sapiens
YYENTHRPY

SEQ ID NO: 413518 - protein, 9 aa, Homo Sapiens
SASAHHLLL

SEQ ID NO: 413519 - protein, 9 aa, Homo Sapiens
PGGTDTMSA

SEQ ID NO: 413520 - protein, 9 aa, Homo Sapiens
AYISDKSIE

SEQ ID NO: 413521 - protein, 9 aa, Homo Sapiens
VLAVKWGRN

SEQ ID NO: 413522 - protein, 9 aa, Homo Sapiens
MTVRTARVS

SEQ ID NO: 413523 - protein, 9 aa, Homo Sapiens
PGAQNPATA

SEQ ID NO: 413524 - protein, 9 aa, Homo Sapiens
AMCIVGRLT

SEQ ID NO: 413525 - protein, 9 aa, Homo Sapiens
YYNWLGIVS

SEQ ID NO: 413526 - protein, 9 aa, Homo Sapiens
IHSFKGRKI

SEQ ID NO: 413527 - protein, 9 aa, Homo Sapiens
IQLKPNEEH

SEQ ID NO: 413528 - protein, 9 aa, Homo Sapiens
WAHSGVSTQ

SEQ ID NO: 413529 - protein, 9 aa, Homo Sapiens
VGRRRQWGS

SEQ ID NO: 413530 - protein, 9 aa, Homo Sapiens
QVDRMEHSI

SEQ ID NO: 413531 - protein, 9 aa, Homo Sapiens
RRKLEKKCW

SEQ ID NO: 413532 - protein, 9 aa, Homo Sapiens
GHDTPASNH

SEQ ID NO: 413533 - protein, 9 aa, Homo Sapiens
THDQELFFS

SEQ ID NO: 413534 - protein, 9 aa, Homo Sapiens
IAVSVIANM

SEQ ID NO: 413535 - protein, 9 aa, Homo Sapiens
TQLQHSLHL

SEQ ID NO: 413536 - protein, 9 aa, Homo Sapiens
VLHPPPISK

SEQ ID NO: 413537 - protein, 9 aa, Homo Sapiens
EATPGGASG

SEQ ID NO: 413538 - protein, 9 aa, Homo Sapiens
LSIRIPRAT

SEQ ID NO: 413539 - protein, 9 aa, Homo Sapiens
LRLSQRLHS

SEQ ID NO: 413540 - protein, 9 aa, Homo Sapiens
SVLEPGYVD

SEQ ID NO: 413541 - protein, 9 aa, Homo Sapiens
ALGTASEGW

SEQ ID NO: 413542 - protein, 9 aa, Homo Sapiens
IVDEGHCMK

SEQ ID NO: 413543 - protein, 9 aa, Homo Sapiens
TLVLDVSSI

SEQ ID NO: 413544 - protein, 9 aa, Homo Sapiens
GWRSPKCII

SEQ ID NO: 413545 - protein, 9 aa, Homo Sapiens
QPSVWCPWT

SEQ ID NO: 413546 - protein, 9 aa, Homo Sapiens
PGRPLRSHT

SEQ ID NO: 413547 - protein, 9 aa, Homo Sapiens
KEFLLVSSS

SEQ ID NO: 413548 - protein, 9 aa, Homo Sapiens
KIIDTKNLY

SEQ ID NO: 413549 - protein, 9 aa, Homo Sapiens
SWTPCLDCV

SEQ ID NO: 413550 - protein, 9 aa, Homo Sapiens
FSILTQAIT

SEQ ID NO: 413551 - protein, 9 aa, Homo Sapiens
MTEMNGHIL

SEQ ID NO: 413552 - protein, 9 aa, Homo Sapiens
GAKAREEGY

SEQ ID NO: 413553 - protein, 9 aa, Homo Sapiens
MLPQQLQVA

SEQ ID NO: 413554 - protein, 9 aa, Homo Sapiens
TVKSASLQP

SEQ ID NO: 413555 - protein, 9 aa, Homo Sapiens
TTSEPITGP

SEQ ID NO: 413556 - protein, 9 aa, Homo Sapiens
QWVVHLHID

SEQ ID NO: 413557 - protein, 9 aa, Homo Sapiens
PQAAPPHPP

SEQ ID NO: 413558 - protein, 9 aa, Homo Sapiens
GREKAEQER

SEQ ID NO: 413559 - protein, 9 aa, Homo Sapiens
FSPLPVGGQ

SEQ ID NO: 413560 - protein, 9 aa, Homo Sapiens
THWPSRASS

SEQ ID NO: 413561 - protein, 9 aa, Homo Sapiens
RLYAARQAS

SEQ ID NO: 413562 - protein, 9 aa, Homo Sapiens
DTYMDSQDH

SEQ ID NO: 413563 - protein, 9 aa, Homo Sapiens
VTASSEALL

SEQ ID NO: 413564 - protein, 9 aa, Homo Sapiens
DQWQLPGPF

SEQ ID NO: 413565 - protein, 9 aa, Homo Sapiens
VLPGTLKGL

SEQ ID NO: 413566 - protein, 9 aa, Homo Sapiens
LLPGEAAPS

SEQ ID NO: 413567 - protein, 9 aa, Homo Sapiens
ATTEDLAEV

SEQ ID NO: 413568 - protein, 9 aa, Homo Sapiens
LPAVWTRVG

SEQ ID NO: 413569 - protein, 9 aa, Homo Sapiens
LPQEQHLRV

SEQ ID NO: 413570 - protein, 9 aa, Homo Sapiens
ITITTPNKF

SEQ ID NO: 413571 - protein, 9 aa, Homo Sapiens
QSESVHGRT

SEQ ID NO: 413572 - protein, 9 aa, Homo Sapiens
WTACARTCW

SEQ ID NO: 413573 - protein, 9 aa, Homo Sapiens
HTRVSVQQT

SEQ ID NO: 413574 - protein, 9 aa, Homo Sapiens
YTLVMNQTV

SEQ ID NO: 413575 - protein, 9 aa, Homo Sapiens
GGSLLGRKE

SEQ ID NO: 413576 - protein, 9 aa, Homo Sapiens
LSGLQQQTM

SEQ ID NO: 413577 - protein, 9 aa, Homo Sapiens
PQRLTGRSR

SEQ ID NO: 413578 - protein, 9 aa, Homo Sapiens
KRQCCRCMR

SEQ ID NO: 413579 - protein, 9 aa, Homo Sapiens
LLWSDPDDH

SEQ ID NO: 413580 - protein, 9 aa, Homo Sapiens
LQPKTAPSL

SEQ ID NO: 413581 - protein, 9 aa, Homo Sapiens
GGIFEPSIR

SEQ ID NO: 413582 - protein, 9 aa, Homo Sapiens
PALSSCGCS

SEQ ID NO: 413583 - protein, 9 aa, Homo Sapiens
QPLPGQHLW

SEQ ID NO: 413584 - protein, 9 aa, Homo Sapiens
SCFKCKESL

SEQ ID NO: 413585 - protein, 9 aa, Homo Sapiens
ENVFSSPGA

SEQ ID NO: 413586 - protein, 9 aa, Homo Sapiens
NVFSSPGAL

SEQ ID NO: 413587 - protein, 9 aa, Homo Sapiens
KKLEKTTPS

SEQ ID NO: 413588 - protein, 9 aa, Homo Sapiens
MKLMRCYIA

SEQ ID NO: 413589 - protein, 9 aa, Homo Sapiens
HCRVMCRCC

SEQ ID NO: 413590 - protein, 9 aa, Homo Sapiens
MLLGAASSP

SEQ ID NO: 413591 - protein, 9 aa, Homo Sapiens
VRLQRQIKW

SEQ ID NO: 413592 - protein, 9 aa, Homo Sapiens
VVIVDPQGW

SEQ ID NO: 413593 - protein, 9 aa, Homo Sapiens
PSIQKEAVW

SEQ ID NO: 413594 - protein, 9 aa, Homo Sapiens
GPTTQTTSG

SEQ ID NO: 413595 - protein, 9 aa, Homo Sapiens
CPEPPETGE

SEQ ID NO: 413596 - protein, 9 aa, Homo Sapiens
HTAAKAAGF

SEQ ID NO: 413597 - protein, 9 aa, Homo Sapiens
LEDIVHNIQ

SEQ ID NO: 413598 - protein, 9 aa, Homo Sapiens
QRLLLVLPG

SEQ ID NO: 413599 - protein, 9 aa, Homo Sapiens
LYPPPSHTC

SEQ ID NO: 413600 - protein, 9 aa, Homo Sapiens
PVAGGAAEG

SEQ ID NO: 413601 - protein, 9 aa, Homo Sapiens
NLHVLGEAQ

SEQ ID NO: 413602 - protein, 9 aa, Homo Sapiens
LYGLPQRPV

SEQ ID NO: 413603 - protein, 9 aa, Homo Sapiens
VTKKKVSQK

SEQ ID NO: 413604 - protein, 9 aa, Homo Sapiens
LATLCTQLH

SEQ ID NO: 413605 - protein, 9 aa, Homo Sapiens
WSHPSDHLE

SEQ ID NO: 413606 - protein, 9 aa, Homo Sapiens
VVGLFKTQN

SEQ ID NO: 413607 - protein, 9 aa, Homo Sapiens
SVTKGKKAK

SEQ ID NO: 413608 - protein, 9 aa, Homo Sapiens
PISYPCCCE

SEQ ID NO: 413609 - protein, 9 aa, Homo Sapiens
QELRLDEPP

SEQ ID NO: 413610 - protein, 9 aa, Homo Sapiens
SSSSTSMGF

SEQ ID NO: 413611 - protein, 9 aa, Homo Sapiens
ANWDSPSHV

SEQ ID NO: 413612 - protein, 9 aa, Homo Sapiens
QYCRALLHK

SEQ ID NO: 413613 - protein, 9 aa, Homo Sapiens
GPVQELRKL

SEQ ID NO: 413614 - protein, 9 aa, Homo Sapiens
APQHESSDR

SEQ ID NO: 413615 - protein, 9 aa, Homo Sapiens
PELAVRMCG

SEQ ID NO: 413616 - protein, 9 aa, Homo Sapiens
HFKKTENLE

SEQ ID NO: 413617 - protein, 9 aa, Homo Sapiens
LSTAWASAM

SEQ ID NO: 413618 - protein, 9 aa, Homo Sapiens
TLLHLIPQV

SEQ ID NO: 413619 - protein, 9 aa, Homo Sapiens
PGDGYMQAD

SEQ ID NO: 413620 - protein, 9 aa, Homo Sapiens
SAAGALLRL

SEQ ID NO: 413621 - protein, 9 aa, Homo Sapiens
DYVGISHNL

SEQ ID NO: 413622 - protein, 9 aa, Homo Sapiens
DGLNGLMDL

SEQ ID NO: 413623 - protein, 9 aa, Homo Sapiens
WEFVTDDYD

SEQ ID NO: 413624 - protein, 9 aa, Homo Sapiens
TVQIVADLK

SEQ ID NO: 413625 - protein, 9 aa, Homo Sapiens
ERARVPGTD

SEQ ID NO: 413626 - protein, 9 aa, Homo Sapiens
ILSALRVSP

SEQ ID NO: 413627 - protein, 9 aa, Homo Sapiens
SKAFLPRVR

SEQ ID NO: 413628 - protein, 9 aa, Homo Sapiens
GSAAPRCWR

SEQ ID NO: 413629 - protein, 9 aa, Homo Sapiens
NALANNIVL

SEQ ID NO: 413630 - protein, 9 aa, Homo Sapiens
VSVGCVASI

SEQ ID NO: 413631 - protein, 9 aa, Homo Sapiens
VFERNCCSE

SEQ ID NO: 413632 - protein, 9 aa, Homo Sapiens
PPAQWETPA

SEQ ID NO: 413633 - protein, 9 aa, Homo Sapiens
CRCLPGFGG

SEQ ID NO: 413634 - protein, 9 aa, Homo Sapiens
FSLLVRHCP

SEQ ID NO: 413635 - protein, 9 aa, Homo Sapiens
RGELHFDIR

SEQ ID NO: 413636 - protein, 9 aa, Homo Sapiens
WEGLAAWPV

SEQ ID NO: 413637 - protein, 9 aa, Homo Sapiens
SAWAGPHPE

SEQ ID NO: 413638 - protein, 9 aa, Homo Sapiens
VLLNRPEIS

SEQ ID NO: 413639 - protein, 9 aa, Homo Sapiens
LEKNIRKNG

SEQ ID NO: 413640 - protein, 9 aa, Homo Sapiens
HSRGIRLGV

SEQ ID NO: 413641 - protein, 9 aa, Homo Sapiens
SWLKDRPPL

SEQ ID NO: 413642 - protein, 9 aa, Homo Sapiens
GSHPFRARI

SEQ ID NO: 413643 - protein, 9 aa, Homo Sapiens
WALGTGVPQ

SEQ ID NO: 413644 - protein, 9 aa, Homo Sapiens
LGIQTTGPV

SEQ ID NO: 413645 - protein, 9 aa, Homo Sapiens
EKEKAIDYM

SEQ ID NO: 413646 - protein, 9 aa, Homo Sapiens
VGQISTLVL

SEQ ID NO: 413647 - protein, 9 aa, Homo Sapiens
RFHVLPDHT

SEQ ID NO: 413648 - protein, 9 aa, Homo Sapiens
EEEERHIAE

SEQ ID NO: 413649 - protein, 9 aa, Homo Sapiens
NLEANKNFS

SEQ ID NO: 413650 - protein, 9 aa, Homo Sapiens
SLPTALPSD

SEQ ID NO: 413651 - protein, 9 aa, Homo Sapiens
MNGHILGSK

SEQ ID NO: 413652 - protein, 9 aa, Homo Sapiens
VAKGTLHHH

SEQ ID NO: 413653 - protein, 9 aa, Homo Sapiens
AWVTTRMGN

SEQ ID NO: 413654 - protein, 9 aa, Homo Sapiens
SILSALWNL

SEQ ID NO: 413655 - protein, 9 aa, Homo Sapiens
PGSSCYFFL

SEQ ID NO: 413656 - protein, 9 aa, Homo Sapiens
TKELEEEIT

SEQ ID NO: 413657 - protein, 9 aa, Homo Sapiens
LSALRVSPV

SEQ ID NO: 413658 - protein, 9 aa, Homo Sapiens
GLNRIRRWH

SEQ ID NO: 413659 - protein, 9 aa, Homo Sapiens
DDIAYIRKA

SEQ ID NO: 413660 - protein, 9 aa, Homo Sapiens
YPGLQCLPL

SEQ ID NO: 413661 - protein, 9 aa, Homo Sapiens
AGPSALPSP

SEQ ID NO: 413662 - protein, 9 aa, Homo Sapiens
KSSSSASGG

SEQ ID NO: 413663 - protein, 9 aa, Homo Sapiens
LDVEVSRPF

SEQ ID NO: 413664 - protein, 9 aa, Homo Sapiens
HAAAAARLL

SEQ ID NO: 413665 - protein, 9 aa, Homo Sapiens
GPPSCPRPT

SEQ ID NO: 413666 - protein, 9 aa, Homo Sapiens
RIGPAPGSS

SEQ ID NO: 413667 - protein, 9 aa, Homo Sapiens
SFPAQPPAR

SEQ ID NO: 413668 - protein, 9 aa, Homo Sapiens
VWLSKIQRD

SEQ ID NO: 413669 - protein, 9 aa, Homo Sapiens
TQDQLSALS

SEQ ID NO: 413670 - protein, 9 aa, Homo Sapiens
TTGPVTLRR

SEQ ID NO: 413671 - protein, 9 aa, Homo Sapiens
AVAVAHIAG

SEQ ID NO: 413672 - protein, 9 aa, Homo Sapiens
IQDEDQCLI

SEQ ID NO: 413673 - protein, 9 aa, Homo Sapiens
APLSPGATL

SEQ ID NO: 413674 - protein, 9 aa, Homo Sapiens
AIQLKPNEE

SEQ ID NO: 413675 - protein, 9 aa, Homo Sapiens
GVTHTAAKA

SEQ ID NO: 413676 - protein, 9 aa, Homo Sapiens
PPHPSPHPQ

SEQ ID NO: 413677 - protein, 9 aa, Homo Sapiens
TWSESAWRR

SEQ ID NO: 413678 - protein, 9 aa, Homo Sapiens
CLPGFGGPR

SEQ ID NO: 413679 - protein, 9 aa, Homo Sapiens
REIPFLLLA

SEQ ID NO: 413680 - protein, 9 aa, Homo Sapiens
GASSLSSSS

SEQ ID NO: 413681 - protein, 9 aa, Homo Sapiens
PGEPGQKDL

SEQ ID NO: 413682 - protein, 9 aa, Homo Sapiens
ETTTWHVTT

SEQ ID NO: 413683 - protein, 9 aa, Homo Sapiens
CPPLLEAFP

SEQ ID NO: 413684 - protein, 9 aa, Homo Sapiens
MSGPGAGSG

SEQ ID NO: 413685 - protein, 9 aa, Homo Sapiens
AQLFFFHLL

SEQ ID NO: 413686 - protein, 9 aa, Homo Sapiens
APPFSSSSS

SEQ ID NO: 413687 - protein, 9 aa, Homo Sapiens
CTSFSINTS

SEQ ID NO: 413688 - protein, 9 aa, Homo Sapiens
MKESVWEQW

SEQ ID NO: 413689 - protein, 9 aa, Homo Sapiens
HAIVYPFII

SEQ ID NO: 413690 - protein, 9 aa, Homo Sapiens
LASTPPPPG

SEQ ID NO: 413691 - protein, 9 aa, Homo Sapiens
LAGHRVPGR

SEQ ID NO: 413692 - protein, 9 aa, Homo Sapiens
KLELWVLAP

SEQ ID NO: 413693 - protein, 9 aa, Homo Sapiens
KIYHCSQTH

SEQ ID NO: 413694 - protein, 9 aa, Homo Sapiens
DEMEKPAKW

SEQ ID NO: 413695 - protein, 9 aa, Homo Sapiens
QIAYHLASS

SEQ ID NO: 413696 - protein, 9 aa, Homo Sapiens
FWRLWATEQ

SEQ ID NO: 413697 - protein, 9 aa, Homo Sapiens
KNINMKGDA

SEQ ID NO: 413698 - protein, 9 aa, Homo Sapiens
PAPKMCAPV

SEQ ID NO: 413699 - protein, 9 aa, Homo Sapiens
LGAGEHLPQ

SEQ ID NO: 413700 - protein, 9 aa, Homo Sapiens
VILEVTSEE

SEQ ID NO: 413701 - protein, 9 aa, Homo Sapiens
MPVMYRISC

SEQ ID NO: 413702 - protein, 9 aa, Homo Sapiens
RLHDVLSSN

SEQ ID NO: 413703 - protein, 9 aa, Homo Sapiens
FLDGDELML

SEQ ID NO: 413704 - protein, 9 aa, Homo Sapiens
EGYYYRETY

SEQ ID NO: 413705 - protein, 9 aa, Homo Sapiens
NYCLSYITK

SEQ ID NO: 413706 - protein, 9 aa, Homo Sapiens
YENTHRPYF

SEQ ID NO: 413707 - protein, 9 aa, Homo Sapiens
LPLVPILQL

SEQ ID NO: 413708 - protein, 9 aa, Homo Sapiens
AVLREYKAL

SEQ ID NO: 413709 - protein, 9 aa, Homo Sapiens
ANLSWCCAE

SEQ ID NO: 413710 - protein, 9 aa, Homo Sapiens
AVSVIANMV

SEQ ID NO: 413711 - protein, 9 aa, Homo Sapiens
VPGYQCPAG

SEQ ID NO: 413712 - protein, 9 aa, Homo Sapiens
IISSYKETV

SEQ ID NO: 413713 - protein, 9 aa, Homo Sapiens
SFFVIFLES

SEQ ID NO: 413714 - protein, 9 aa, Homo Sapiens
WQEWTDAYL

SEQ ID NO: 413715 - protein, 9 aa, Homo Sapiens
PPLSRSSML

SEQ ID NO: 413716 - protein, 9 aa, Homo Sapiens
AIDYMSHPK

SEQ ID NO: 413717 - protein, 9 aa, Homo Sapiens
LMCGWNSTH

SEQ ID NO: 413718 - protein, 9 aa, Homo Sapiens
RGKQVIEQL

SEQ ID NO: 413719 - protein, 9 aa, Homo Sapiens
KPLTQYMPQ

SEQ ID NO: 413720 - protein, 9 aa, Homo Sapiens
FPVVEQDKL

SEQ ID NO: 413721 - protein, 9 aa, Homo Sapiens
GCHQTAIIG

SEQ ID NO: 413722 - protein, 9 aa, Homo Sapiens
PPHLPSCHP

SEQ ID NO: 413723 - protein, 9 aa, Homo Sapiens
AAATGTAAI

SEQ ID NO: 413724 - protein, 9 aa, Homo Sapiens
VSRLNPKMQ

SEQ ID NO: 413725 - protein, 9 aa, Homo Sapiens
QKIIFSYVV

SEQ ID NO: 413726 - protein, 9 aa, Homo Sapiens
SDMAHVING

SEQ ID NO: 413727 - protein, 9 aa, Homo Sapiens
PACQTLQSY

SEQ ID NO: 413728 - protein, 9 aa, Homo Sapiens
EVVNTYQKM

SEQ ID NO: 413729 - protein, 9 aa, Homo Sapiens
LFTFLFLLV

SEQ ID NO: 413730 - protein, 9 aa, Homo Sapiens
KHLNGTIMA

SEQ ID NO: 413731 - protein, 9 aa, Homo Sapiens
VWEGETLTF

SEQ ID NO: 413732 - protein, 9 aa, Homo Sapiens
MSVPLLPSP

SEQ ID NO: 413733 - protein, 9 aa, Homo Sapiens
GLELPVVLL

SEQ ID NO: 413734 - protein, 9 aa, Homo Sapiens
AGPCVRTWP

SEQ ID NO: 413735 - protein, 9 aa, Homo Sapiens
PERIQSGLF

SEQ ID NO: 413736 - protein, 9 aa, Homo Sapiens
NIQGGKASQ

SEQ ID NO: 413737 - protein, 9 aa, Homo Sapiens
TRYDMSLGL

SEQ ID NO: 413738 - protein, 9 aa, Homo Sapiens
SQNHSKCIT

SEQ ID NO: 413739 - protein, 9 aa, Homo Sapiens
PQSVFPLLA

SEQ ID NO: 413740 - protein, 9 aa, Homo Sapiens
GDHGINQPI

SEQ ID NO: 413741 - protein, 9 aa, Homo Sapiens
NNGHLSQDP

SEQ ID NO: 413742 - protein, 9 aa, Homo Sapiens
TTWLYHPVV

SEQ ID NO: 413743 - protein, 9 aa, Homo Sapiens
CPKNAALGP

SEQ ID NO: 413744 - protein, 9 aa, Homo Sapiens
AGRIRSASC

SEQ ID NO: 413745 - protein, 9 aa, Homo Sapiens
LSLDLRQLR

SEQ ID NO: 413746 - protein, 9 aa, Homo Sapiens
IMSNGENAI

SEQ ID NO: 413747 - protein, 9 aa, Homo Sapiens
ANTSVFGFS

SEQ ID NO: 413748 - protein, 9 aa, Homo Sapiens
VRKNHHKTK

SEQ ID NO: 413749 - protein, 9 aa, Homo Sapiens
LSSLHRAAR

SEQ ID NO: 413750 - protein, 9 aa, Homo Sapiens
PSRLWSPPR

SEQ ID NO: 413751 - protein, 9 aa, Homo Sapiens
TYGGSGGGG

SEQ ID NO: 413752 - protein, 9 aa, Homo Sapiens
QLEARHYSL

SEQ ID NO: 413753 - protein, 9 aa, Homo Sapiens
ISLNIPAPR

SEQ ID NO: 413754 - protein, 9 aa, Homo Sapiens
PVQGHQSPV

SEQ ID NO: 413755 - protein, 9 aa, Homo Sapiens
VLHQNLDPT

SEQ ID NO: 413756 - protein, 9 aa, Homo Sapiens
CNLKDDFEV

SEQ ID NO: 413757 - protein, 9 aa, Homo Sapiens
GTSAGTGAV

SEQ ID NO: 413758 - protein, 9 aa, Homo Sapiens
NVILVWLSK

SEQ ID NO: 413759 - protein, 9 aa, Homo Sapiens
RRRRRKRSS

SEQ ID NO: 413760 - protein, 9 aa, Homo Sapiens
EAEVSVAQG

SEQ ID NO: 413761 - protein, 9 aa, Homo Sapiens
FPQLFYFFF

SEQ ID NO: 413762 - protein, 9 aa, Homo Sapiens
PDMLLSYPS

SEQ ID NO: 413763 - protein, 9 aa, Homo Sapiens
DVEVSRPFY

SEQ ID NO: 413764 - protein, 9 aa, Homo Sapiens
QSPEATSPH

SEQ ID NO: 413765 - protein, 9 aa, Homo Sapiens
SHKPDQPSL

SEQ ID NO: 413766 - protein, 9 aa, Homo Sapiens
NYITMDELH

SEQ ID NO: 413767 - protein, 9 aa, Homo Sapiens
ETLRDMVDF

SEQ ID NO: 413768 - protein, 9 aa, Homo Sapiens
FHIYCLDLP

SEQ ID NO: 413769 - protein, 9 aa, Homo Sapiens
LAKMNGRPT

SEQ ID NO: 413770 - protein, 9 aa, Homo Sapiens
LTRTTSEPI

SEQ ID NO: 413771 - protein, 9 aa, Homo Sapiens
VQLLEHYEQ

SEQ ID NO: 413772 - protein, 9 aa, Homo Sapiens
PLNLALHRY

SEQ ID NO: 413773 - protein, 9 aa, Homo Sapiens
PPVRLCVPQ

SEQ ID NO: 413774 - protein, 9 aa, Homo Sapiens
LGGLRSAPG

SEQ ID NO: 413775 - protein, 9 aa, Homo Sapiens
PYPGLQCLP

SEQ ID NO: 413776 - protein, 9 aa, Homo Sapiens
RQPSRPTGR

SEQ ID NO: 413777 - protein, 9 aa, Homo Sapiens
VNLSVTTSP

SEQ ID NO: 413778 - protein, 9 aa, Homo Sapiens
LLHWCSDDF

SEQ ID NO: 413779 - protein, 9 aa, Homo Sapiens
AAPHTVSYL

SEQ ID NO: 413780 - protein, 9 aa, Homo Sapiens
DDIVDIREE

SEQ ID NO: 413781 - protein, 9 aa, Homo Sapiens
EIWLLHTLT

SEQ ID NO: 413782 - protein, 9 aa, Homo Sapiens
PCSSPQCSR

SEQ ID NO: 413783 - protein, 9 aa, Homo Sapiens
QGYEGGFPY

SEQ ID NO: 413784 - protein, 9 aa, Homo Sapiens
ESYEEKAMR

SEQ ID NO: 413785 - protein, 9 aa, Homo Sapiens
SCNHVHVSV

SEQ ID NO: 413786 - protein, 9 aa, Homo Sapiens
WRPHAGPAV

SEQ ID NO: 413787 - protein, 9 aa, Homo Sapiens
EVNINCKKR

SEQ ID NO: 413788 - protein, 9 aa, Homo Sapiens
PPPQAPSQV

SEQ ID NO: 413789 - protein, 9 aa, Homo Sapiens
PGHESFRLF

SEQ ID NO: 413790 - protein, 9 aa, Homo Sapiens
EPITGPTTQ

SEQ ID NO: 413791 - protein, 9 aa, Homo Sapiens
RSRVVGRCS

SEQ ID NO: 413792 - protein, 9 aa, Homo Sapiens
QAQVEVIQS

SEQ ID NO: 413793 - protein, 9 aa, Homo Sapiens
GALPSTAAP

SEQ ID NO: 413794 - protein, 9 aa, Homo Sapiens
GCAGGGVGE

SEQ ID NO: 413795 - protein, 9 aa, Homo Sapiens
HHSSLVKRE

SEQ ID NO: 413796 - protein, 9 aa, Homo Sapiens
HQLAGHTDT

SEQ ID NO: 413797 - protein, 9 aa, Homo Sapiens
SHNSEPWAA

SEQ ID NO: 413798 - protein, 9 aa, Homo Sapiens
ALNPHSGTL

SEQ ID NO: 413799 - protein, 9 aa, Homo Sapiens
LGPMLSSIS

SEQ ID NO: 413800 - protein, 9 aa, Homo Sapiens
VHQPARVNV

SEQ ID NO: 413801 - protein, 9 aa, Homo Sapiens
LNPAAQDGA

SEQ ID NO: 413802 - protein, 9 aa, Homo Sapiens
IWTCQNSHW

SEQ ID NO: 413803 - protein, 9 aa, Homo Sapiens
PVRARTARS

SEQ ID NO: 413804 - protein, 9 aa, Homo Sapiens
VPSNLQAQR

SEQ ID NO: 413805 - protein, 9 aa, Homo Sapiens
HEVHQNMDY

SEQ ID NO: 413806 - protein, 9 aa, Homo Sapiens
PGKQGCCCT

SEQ ID NO: 413807 - protein, 9 aa, Homo Sapiens
CQPRSPLQP

SEQ ID NO: 413808 - protein, 9 aa, Homo Sapiens
RDMVDFLKG

SEQ ID NO: 413809 - protein, 9 aa, Homo Sapiens
AAVDPDMLL

SEQ ID NO: 413810 - protein, 9 aa, Homo Sapiens
FEDMEKCFL

SEQ ID NO: 413811 - protein, 9 aa, Homo Sapiens
RALQTSTTR

SEQ ID NO: 413812 - protein, 9 aa, Homo Sapiens
QEVALQAVS

SEQ ID NO: 413813 - protein, 9 aa, Homo Sapiens
MTALLPSAT

SEQ ID NO: 413814 - protein, 9 aa, Homo Sapiens
LSEWFSSRF

SEQ ID NO: 413815 - protein, 9 aa, Homo Sapiens
QLRGEREEH

SEQ ID NO: 413816 - protein, 9 aa, Homo Sapiens
LESAVAAHQ

SEQ ID NO: 413817 - protein, 9 aa, Homo Sapiens
AVDVKAQHT

SEQ ID NO: 413818 - protein, 9 aa, Homo Sapiens
RDKKYHCSE

SEQ ID NO: 413819 - protein, 9 aa, Homo Sapiens
RGLNDLLLP

SEQ ID NO: 413820 - protein, 9 aa, Homo Sapiens
MGAHCHLSC

SEQ ID NO: 413821 - protein, 9 aa, Homo Sapiens
DACGRASSE

SEQ ID NO: 413822 - protein, 9 aa, Homo Sapiens
PLGIQTTGP

SEQ ID NO: 413823 - protein, 9 aa, Homo Sapiens
PQQPFIAHR

SEQ ID NO: 413824 - protein, 9 aa, Homo Sapiens
LENMGALTA

SEQ ID NO: 413825 - protein, 9 aa, Homo Sapiens
IAVTLYYGS

SEQ ID NO: 413826 - protein, 9 aa, Homo Sapiens
FLHPQKETL

SEQ ID NO: 413827 - protein, 9 aa, Homo Sapiens
VRTARGPRT

SEQ ID NO: 413828 - protein, 9 aa, Homo Sapiens
AVVHLLMEW

SEQ ID NO: 413829 - protein, 9 aa, Homo Sapiens
SSVLGTGLC

SEQ ID NO: 413830 - protein, 9 aa, Homo Sapiens
HGYGVCMGP

SEQ ID NO: 413831 - protein, 9 aa, Homo Sapiens
EGLVSRRLQ

SEQ ID NO: 413832 - protein, 9 aa, Homo Sapiens
HHHPHDQAT

SEQ ID NO: 413833 - protein, 9 aa, Homo Sapiens
YLSDGVEWA

SEQ ID NO: 413834 - protein, 9 aa, Homo Sapiens
RCSGLSVSV

SEQ ID NO: 413835 - protein, 9 aa, Homo Sapiens
LLRGGYISS

SEQ ID NO: 413836 - protein, 9 aa, Homo Sapiens
QNAPPVPVL

SEQ ID NO: 413837 - protein, 9 aa, Homo Sapiens
TFITNMDVF

SEQ ID NO: 413838 - protein, 9 aa, Homo Sapiens
LVDSPAPAD

SEQ ID NO: 413839 - protein, 9 aa, Homo Sapiens
GLGGHGQGN

SEQ ID NO: 413840 - protein, 9 aa, Homo Sapiens
VPSSSPTNV

SEQ ID NO: 413841 - protein, 9 aa, Homo Sapiens
SCLRDDVVF

SEQ ID NO: 413842 - protein, 9 aa, Homo Sapiens
PELSPVMLL

SEQ ID NO: 413843 - protein, 9 aa, Homo Sapiens
GCLAWLPCV

SEQ ID NO: 413844 - protein, 9 aa, Homo Sapiens
WSPSPRAVM

SEQ ID NO: 413845 - protein, 9 aa, Homo Sapiens
GQQYVKRTW

SEQ ID NO: 413846 - protein, 9 aa, Homo Sapiens
TKKGAKARE

SEQ ID NO: 413847 - protein, 9 aa, Homo Sapiens
HRAARQPSV

SEQ ID NO: 413848 - protein, 9 aa, Homo Sapiens
KSVRVCRAA

SEQ ID NO: 413849 - protein, 9 aa, Homo Sapiens
PHQPPLSLQ

SEQ ID NO: 413850 - protein, 9 aa, Homo Sapiens
RAADDPRRS

SEQ ID NO: 413851 - protein, 9 aa, Homo Sapiens
VAPVHAARR

SEQ ID NO: 413852 - protein, 9 aa, Homo Sapiens
AGLLKQFLG

SEQ ID NO: 413853 - protein, 9 aa, Homo Sapiens
RGFLLHQPL

SEQ ID NO: 413854 - protein, 9 aa, Homo Sapiens
IDWGGKRNT

SEQ ID NO: 413855 - protein, 9 aa, Homo Sapiens
EKLKVELQS

SEQ ID NO: 413856 - protein, 9 aa, Homo Sapiens
WEPRELQLL

SEQ ID NO: 413857 - protein, 9 aa, Homo Sapiens
CPRTRWSAC

SEQ ID NO: 413858 - protein, 9 aa, Homo Sapiens
AQWETPAHT

SEQ ID NO: 413859 - protein, 9 aa, Homo Sapiens
TPLRVQSVL

SEQ ID NO: 413860 - protein, 9 aa, Homo Sapiens
RGLPGNWEL

SEQ ID NO: 413861 - protein, 9 aa, Homo Sapiens
KRRPYHKRL

SEQ ID NO: 413862 - protein, 9 aa, Homo Sapiens
KKCGFGFVY

SEQ ID NO: 413863 - protein, 9 aa, Homo Sapiens
RAMELAVAH

SEQ ID NO: 413864 - protein, 9 aa, Homo Sapiens
CFWLLIWLL

SEQ ID NO: 413865 - protein, 9 aa, Homo Sapiens
SPPHPALSS

SEQ ID NO: 413866 - protein, 9 aa, Homo Sapiens
ITVFVPRWR

SEQ ID NO: 413867 - protein, 9 aa, Homo Sapiens
QASYDVPTI

SEQ ID NO: 413868 - protein, 9 aa, Homo Sapiens
DPARWWQLI

SEQ ID NO: 413869 - protein, 9 aa, Homo Sapiens
TPTTSSLVA

SEQ ID NO: 413870 - protein, 9 aa, Homo Sapiens
SQPKPPPPE

SEQ ID NO: 413871 - protein, 9 aa, Homo Sapiens
ISDESRRDY

SEQ ID NO: 413872 - protein, 9 aa, Homo Sapiens
LGLTLLRFH

SEQ ID NO: 413873 - protein, 9 aa, Homo Sapiens
FGLSDEHIS

SEQ ID NO: 413874 - protein, 9 aa, Homo Sapiens
EVFFFTIGI

SEQ ID NO: 413875 - protein, 9 aa, Homo Sapiens
PGACRPACT

SEQ ID NO: 413876 - protein, 9 aa, Homo Sapiens
NQKCIDKAE

SEQ ID NO: 413877 - protein, 9 aa, Homo Sapiens
QKFRPTLPP

SEQ ID NO: 413878 - protein, 9 aa, Homo Sapiens
PRGLLCPAL

SEQ ID NO: 413879 - protein, 9 aa, Homo Sapiens
VRQPPPGPS

SEQ ID NO: 413880 - protein, 9 aa, Homo Sapiens
AKPLTQYMP

SEQ ID NO: 413881 - protein, 9 aa, Homo Sapiens
PSPSWFRSC

SEQ ID NO: 413882 - protein, 9 aa, Homo Sapiens
SSMMTSGTW

SEQ ID NO: 413883 - protein, 9 aa, Homo Sapiens
PGYVDSEIG

SEQ ID NO: 413884 - protein, 9 aa, Homo Sapiens
NIYIVAGIF

SEQ ID NO: 413885 - protein, 9 aa, Homo Sapiens
KGESLRPVM

SEQ ID NO: 413886 - protein, 9 aa, Homo Sapiens
HTRDKKYHC

SEQ ID NO: 413887 - protein, 9 aa, Homo Sapiens
RIGKMKWRK

SEQ ID NO: 413888 - protein, 9 aa, Homo Sapiens
ASMDGQVMW

SEQ ID NO: 413889 - protein, 9 aa, Homo Sapiens
SPQSVFPLL

SEQ ID NO: 413890 - protein, 9 aa, Homo Sapiens
LLHVWKVTV

SEQ ID NO: 413891 - protein, 9 aa, Homo Sapiens
LRATVPRHS

SEQ ID NO: 413892 - protein, 9 aa, Homo Sapiens
IGAMLMVIR

SEQ ID NO: 413893 - protein, 9 aa, Homo Sapiens
LEQYQVLEV

SEQ ID NO: 413894 - protein, 9 aa, Homo Sapiens
CSSGPAVMP

SEQ ID NO: 413895 - protein, 9 aa, Homo Sapiens
VTSHYVTTR

SEQ ID NO: 413896 - protein, 9 aa, Homo Sapiens
HPGKQGCCC

SEQ ID NO: 413897 - protein, 9 aa, Homo Sapiens
YLHVQKSTR

SEQ ID NO: 413898 - protein, 9 aa, Homo Sapiens
KTEEGPPGS

SEQ ID NO: 413899 - protein, 9 aa, Homo Sapiens
LNQWCNVVC

SEQ ID NO: 413900 - protein, 9 aa, Homo Sapiens
NFHQSFHQM

SEQ ID NO: 413901 - protein, 9 aa, Homo Sapiens
RNMETRKRK

SEQ ID NO: 413902 - protein, 9 aa, Homo Sapiens
CITEIDLIP

SEQ ID NO: 413903 - protein, 9 aa, Homo Sapiens
CTEPLGRGL

SEQ ID NO: 413904 - protein, 9 aa, Homo Sapiens
SFRRSHCQM

SEQ ID NO: 413905 - protein, 9 aa, Homo Sapiens
VDNNQGAPA

SEQ ID NO: 413906 - protein, 9 aa, Homo Sapiens
LYALMSQCW

SEQ ID NO: 413907 - protein, 9 aa, Homo Sapiens
LEMNTTKTQ

SEQ ID NO: 413908 - protein, 9 aa, Homo Sapiens
TTSQPGATT

SEQ ID NO: 413909 - protein, 9 aa, Homo Sapiens
FSEPLATPR

SEQ ID NO: 413910 - protein, 9 aa, Homo Sapiens
EANPAAVQQ

SEQ ID NO: 413911 - protein, 9 aa, Homo Sapiens
RKKAVIFVS

SEQ ID NO: 413912 - protein, 9 aa, Homo Sapiens
KSILSALWN

SEQ ID NO: 413913 - protein, 9 aa, Homo Sapiens
GFRDLTSEE

SEQ ID NO: 413914 - protein, 9 aa, Homo Sapiens
ADPVRICLL

SEQ ID NO: 413915 - protein, 9 aa, Homo Sapiens
LDCLVFAPA

SEQ ID NO: 413916 - protein, 9 aa, Homo Sapiens
AEGQQKAFG

SEQ ID NO: 413917 - protein, 9 aa, Homo Sapiens
SGLSVSVGC

SEQ ID NO: 413918 - protein, 9 aa, Homo Sapiens
YRKRGSKPK

SEQ ID NO: 413919 - protein, 9 aa, Homo Sapiens
NLKYKDFLI

SEQ ID NO: 413920 - protein, 9 aa, Homo Sapiens
TLFDVNAII

SEQ ID NO: 413921 - protein, 9 aa, Homo Sapiens
LRVRQPPPG

SEQ ID NO: 413922 - protein, 9 aa, Homo Sapiens
QTNTTLYIV

SEQ ID NO: 413923 - protein, 9 aa, Homo Sapiens
ADLMCGWNS

SEQ ID NO: 413924 - protein, 9 aa, Homo Sapiens
PEKWNNIKR

SEQ ID NO: 413925 - protein, 9 aa, Homo Sapiens
HVKLTDFGF

SEQ ID NO: 413926 - protein, 9 aa, Homo Sapiens
PHCSSPSCL

SEQ ID NO: 413927 - protein, 9 aa, Homo Sapiens
PISKSEIKS

SEQ ID NO: 413928 - protein, 9 aa, Homo Sapiens
GVDSDAIWN

SEQ ID NO: 413929 - protein, 9 aa, Homo Sapiens
QSATHPQEG

SEQ ID NO: 413930 - protein, 9 aa, Homo Sapiens
DERHVKLTD

SEQ ID NO: 413931 - protein, 9 aa, Homo Sapiens
LHHHDRNLL

SEQ ID NO: 413932 - protein, 9 aa, Homo Sapiens
WLANGDTLH

SEQ ID NO: 413933 - protein, 9 aa, Homo Sapiens
GQKCTEPLG

SEQ ID NO: 413934 - protein, 9 aa, Homo Sapiens
GASLSGTPP

SEQ ID NO: 413935 - protein, 9 aa, Homo Sapiens
GDGQQVLLP

SEQ ID NO: 413936 - protein, 9 aa, Homo Sapiens
AAPLQPAFG

SEQ ID NO: 413937 - protein, 9 aa, Homo Sapiens
GPVKMSDEA

SEQ ID NO: 413938 - protein, 9 aa, Homo Sapiens
YVTHLPVGV

SEQ ID NO: 413939 - protein, 9 aa, Homo Sapiens
CPRALCHTN

SEQ ID NO: 413940 - protein, 9 aa, Homo Sapiens
AEILANMSD

SEQ ID NO: 413941 - protein, 9 aa, Homo Sapiens
VTVAVDVLP

SEQ ID NO: 413942 - protein, 9 aa, Homo Sapiens
VVRPVATLS

SEQ ID NO: 413943 - protein, 9 aa, Homo Sapiens
LEDGVPGVP

SEQ ID NO: 413944 - protein, 9 aa, Homo Sapiens
RCGRTAGRL

SEQ ID NO: 413945 - protein, 9 aa, Homo Sapiens
AWSGAWTTT

SEQ ID NO: 413946 - protein, 9 aa, Homo Sapiens
QGAGHAAAA

SEQ ID NO: 413947 - protein, 9 aa, Homo Sapiens
VEKSASCTP

SEQ ID NO: 413948 - protein, 9 aa, Homo Sapiens
IEHPFQVPH

SEQ ID NO: 413949 - protein, 9 aa, Homo Sapiens
ISSSLGVSG

SEQ ID NO: 413950 - protein, 9 aa, Homo Sapiens
MNQLSPVNI

SEQ ID NO: 413951 - protein, 9 aa, Homo Sapiens
EPMKRASKE

SEQ ID NO: 413952 - protein, 9 aa, Homo Sapiens
PPPRGQAPE

SEQ ID NO: 413953 - protein, 9 aa, Homo Sapiens
RFSSKHALM

SEQ ID NO: 413954 - protein, 9 aa, Homo Sapiens
RLSIRIPRA

SEQ ID NO: 413955 - protein, 9 aa, Homo Sapiens
HDLERLHDV

SEQ ID NO: 413956 - protein, 9 aa, Homo Sapiens
GPGSGPQWD

SEQ ID NO: 413957 - protein, 9 aa, Homo Sapiens
WYLFCLSWI

SEQ ID NO: 413958 - protein, 9 aa, Homo Sapiens
WVIVKEFQR

SEQ ID NO: 413959 - protein, 9 aa, Homo Sapiens
SEPLATPRH

SEQ ID NO: 413960 - protein, 9 aa, Homo Sapiens
FLGPDSQFV

SEQ ID NO: 413961 - protein, 9 aa, Homo Sapiens
PTASAFGDH

SEQ ID NO: 413962 - protein, 9 aa, Homo Sapiens
PHHHHHHQP

SEQ ID NO: 413963 - protein, 9 aa, Homo Sapiens
SPPALWMAR

SEQ ID NO: 413964 - protein, 9 aa, Homo Sapiens
KKLMADLLP

SEQ ID NO: 413965 - protein, 9 aa, Homo Sapiens
GCISVKDHR

SEQ ID NO: 413966 - protein, 9 aa, Homo Sapiens
LTWRFCRRS

SEQ ID NO: 413967 - protein, 9 aa, Homo Sapiens
DGGWGWRSP

SEQ ID NO: 413968 - protein, 9 aa, Homo Sapiens
ALGSLAVAT

SEQ ID NO: 413969 - protein, 9 aa, Homo Sapiens
VDSPAPADA

SEQ ID NO: 413970 - protein, 9 aa, Homo Sapiens
THVIQCYIQ

SEQ ID NO: 413971 - protein, 9 aa, Homo Sapiens
ATPRHQYYN

SEQ ID NO: 413972 - protein, 9 aa, Homo Sapiens
EKSVSQKVV

SEQ ID NO: 413973 - protein, 9 aa, Homo Sapiens
QQAQVEVIQ

SEQ ID NO: 413974 - protein, 9 aa, Homo Sapiens
IMAKYTYGK

SEQ ID NO: 413975 - protein, 9 aa, Homo Sapiens
DSDAIWNEL

SEQ ID NO: 413976 - protein, 9 aa, Homo Sapiens
ATYSNTFYL

SEQ ID NO: 413977 - protein, 9 aa, Homo Sapiens
WRSASQPRR

SEQ ID NO: 413978 - protein, 9 aa, Homo Sapiens
QPLPTQIHI

SEQ ID NO: 413979 - protein, 9 aa, Homo Sapiens
PSPSVHPRA

SEQ ID NO: 413980 - protein, 9 aa, Homo Sapiens
ALMVVLATW

SEQ ID NO: 413981 - protein, 9 aa, Homo Sapiens
PGAQPSPPW

SEQ ID NO: 413982 - protein, 9 aa, Homo Sapiens
WSGPSATCP

SEQ ID NO: 413983 - protein, 9 aa, Homo Sapiens
DQFCRQHRF

SEQ ID NO: 413984 - protein, 9 aa, Homo Sapiens
AFSILTQAI

SEQ ID NO: 413985 - protein, 9 aa, Homo Sapiens
ISLLDEDPL

SEQ ID NO: 413986 - protein, 9 aa, Homo Sapiens
DLKDEEGRL

SEQ ID NO: 413987 - protein, 9 aa, Homo Sapiens
NKNFSFLMK

SEQ ID NO: 413988 - protein, 9 aa, Homo Sapiens
VEGQKKAFA

SEQ ID NO: 413989 - protein, 9 aa, Homo Sapiens
EVSSVHSLS

SEQ ID NO: 413990 - protein, 9 aa, Homo Sapiens
AVGKQSAPR

SEQ ID NO: 413991 - protein, 9 aa, Homo Sapiens
CAPISYPCC

SEQ ID NO: 413992 - protein, 9 aa, Homo Sapiens
LKFFEENMI

SEQ ID NO: 413993 - protein, 9 aa, Homo Sapiens
LAFKKSKKS

SEQ ID NO: 413994 - protein, 9 aa, Homo Sapiens
RATPSPWSP

SEQ ID NO: 413995 - protein, 9 aa, Homo Sapiens
FGNFIWLPS

SEQ ID NO: 413996 - protein, 9 aa, Homo Sapiens
SINTMPPKI

SEQ ID NO: 413997 - protein, 9 aa, Homo Sapiens
CLVTLLNTE

SEQ ID NO: 413998 - protein, 9 aa, Homo Sapiens
VFIFGFVAN

SEQ ID NO: 413999 - protein, 9 aa, Homo Sapiens
DKDEHYWTY

SEQ ID NO: 414000 - protein, 9 aa, Homo Sapiens
SCQRPPLER

SEQ ID NO: 414001 - protein, 9 aa, Homo Sapiens
LTSWCITGF

SEQ ID NO: 414002 - protein, 9 aa, Homo Sapiens
VANVELTGG

SEQ ID NO: 414003 - protein, 9 aa, Homo Sapiens
GAGGSLVGV

SEQ ID NO: 414004 - protein, 9 aa, Homo Sapiens
HNCDTGAFE

SEQ ID NO: 414005 - protein, 9 aa, Homo Sapiens
PHHTLGDSQ

SEQ ID NO: 414006 - protein, 9 aa, Homo Sapiens
TKGMLQKFL

SEQ ID NO: 414007 - protein, 9 aa, Homo Sapiens
AFMVCWAPI

SEQ ID NO: 414008 - protein, 9 aa, Homo Sapiens
STMSCLSRP

SEQ ID NO: 414009 - protein, 9 aa, Homo Sapiens
SPGGPPPAG

SEQ ID NO: 414010 - protein, 9 aa, Homo Sapiens
SHRLRLRLP

SEQ ID NO: 414011 - protein, 9 aa, Homo Sapiens
QNLFEQLVR

SEQ ID NO: 414012 - protein, 9 aa, Homo Sapiens
QQPFIAHRH

SEQ ID NO: 414013 - protein, 9 aa, Homo Sapiens
VDQLVEITK

SEQ ID NO: 414014 - protein, 9 aa, Homo Sapiens
AWLPCVALC

SEQ ID NO: 414015 - protein, 9 aa, Homo Sapiens
VCYLKSNDT

SEQ ID NO: 414016 - protein, 9 aa, Homo Sapiens
RPSTSSRIS

SEQ ID NO: 414017 - protein, 9 aa, Homo Sapiens
LRMKKMIGM

SEQ ID NO: 414018 - protein, 9 aa, Homo Sapiens
TAVSVCRWR

SEQ ID NO: 414019 - protein, 9 aa, Homo Sapiens
QALKRTAER

SEQ ID NO: 414020 - protein, 9 aa, Homo Sapiens
IYPPSTCSL

SEQ ID NO: 414021 - protein, 9 aa, Homo Sapiens
DLGAIDENT

SEQ ID NO: 414022 - protein, 9 aa, Homo Sapiens
PQLLGPPPP

SEQ ID NO: 414023 - protein, 9 aa, Homo Sapiens
GAEGLKTAT

SEQ ID NO: 414024 - protein, 9 aa, Homo Sapiens
SGFRLRLRS

SEQ ID NO: 414025 - protein, 9 aa, Homo Sapiens
NCFQKANCS

SEQ ID NO: 414026 - protein, 9 aa, Homo Sapiens
DNSVASPAQ

SEQ ID NO: 414027 - protein, 9 aa, Homo Sapiens
DNKLNVEGV

SEQ ID NO: 414028 - protein, 9 aa, Homo Sapiens
TFSPLMETE

SEQ ID NO: 414029 - protein, 9 aa, Homo Sapiens
ELHFDIRKA

SEQ ID NO: 414030 - protein, 9 aa, Homo Sapiens
NIMQVPPSI

SEQ ID NO: 414031 - protein, 9 aa, Homo Sapiens
RLSAEIWDW

SEQ ID NO: 414032 - protein, 9 aa, Homo Sapiens
NKPLRGDPG

SEQ ID NO: 414033 - protein, 9 aa, Homo Sapiens
GQDLNEGNH

SEQ ID NO: 414034 - protein, 9 aa, Homo Sapiens
PPALVAPRG

SEQ ID NO: 414035 - protein, 9 aa, Homo Sapiens
METRKRKLT

SEQ ID NO: 414036 - protein, 9 aa, Homo Sapiens
TFHHFVPEH

SEQ ID NO: 414037 - protein, 9 aa, Homo Sapiens
TGAWTAEGA

SEQ ID NO: 414038 - protein, 9 aa, Homo Sapiens
FLDMLNNFR

SEQ ID NO: 414039 - protein, 9 aa, Homo Sapiens
KNAVIDTSF

SEQ ID NO: 414040 - protein, 9 aa, Homo Sapiens
ELAERGVHI

SEQ ID NO: 414041 - protein, 9 aa, Homo Sapiens
AEAASPRKR

SEQ ID NO: 414042 - protein, 9 aa, Homo Sapiens
ARVLEEMHF

SEQ ID NO: 414043 - protein, 9 aa, Homo Sapiens
LFIHCPMVK

SEQ ID NO: 414044 - protein, 9 aa, Homo Sapiens
GVFFGDRRR

SEQ ID NO: 414045 - protein, 9 aa, Homo Sapiens
MGFSTPATS

SEQ ID NO: 414046 - protein, 9 aa, Homo Sapiens
TPLASFLQQ

SEQ ID NO: 414047 - protein, 9 aa, Homo Sapiens
GPGGAEGLK

SEQ ID NO: 414048 - protein, 9 aa, Homo Sapiens
VIVRPVQLL

SEQ ID NO: 414049 - protein, 9 aa, Homo Sapiens
HLLLICDNL

SEQ ID NO: 414050 - protein, 9 aa, Homo Sapiens
CPRPTSSSH

SEQ ID NO: 414051 - protein, 9 aa, Homo Sapiens
RSIHGMGEL

SEQ ID NO: 414052 - protein, 9 aa, Homo Sapiens
PRALQTSTT

SEQ ID NO: 414053 - protein, 9 aa, Homo Sapiens
CKEDLCRKI

SEQ ID NO: 414054 - protein, 9 aa, Homo Sapiens
WPCDLIHGE

SEQ ID NO: 414055 - protein, 9 aa, Homo Sapiens
LVLGPGLKS

SEQ ID NO: 414056 - protein, 9 aa, Homo Sapiens
THNMTTPNK

SEQ ID NO: 414057 - protein, 9 aa, Homo Sapiens
AHPSPPLGA

SEQ ID NO: 414058 - protein, 9 aa, Homo Sapiens
KNLYFKQIR

SEQ ID NO: 414059 - protein, 9 aa, Homo Sapiens
QKETIHPQK

SEQ ID NO: 414060 - protein, 9 aa, Homo Sapiens
VDTSVAWQK

SEQ ID NO: 414061 - protein, 9 aa, Homo Sapiens
LRGGGSPSR

SEQ ID NO: 414062 - protein, 9 aa, Homo Sapiens
GELHFDIRK

SEQ ID NO: 414063 - protein, 9 aa, Homo Sapiens
TQLHRNFRR

SEQ ID NO: 414064 - protein, 9 aa, Homo Sapiens
GTKNLHIQC

SEQ ID NO: 414065 - protein, 9 aa, Homo Sapiens
GGWTYGGSG

SEQ ID NO: 414066 - protein, 9 aa, Homo Sapiens
RPVSQKEVT

SEQ ID NO: 414067 - protein, 9 aa, Homo Sapiens
GAQQSCRGS

SEQ ID NO: 414068 - protein, 9 aa, Homo Sapiens
QQTPLCKHK

SEQ ID NO: 414069 - protein, 9 aa, Homo Sapiens
GRNTSLAAL

SEQ ID NO: 414070 - protein, 9 aa, Homo Sapiens
WDQLTLSQC

SEQ ID NO: 414071 - protein, 9 aa, Homo Sapiens
PRHPHRSPP

SEQ ID NO: 414072 - protein, 9 aa, Homo Sapiens
GKFLLGHRV

SEQ ID NO: 414073 - protein, 9 aa, Homo Sapiens
GCRRCSGLS

SEQ ID NO: 414074 - protein, 9 aa, Homo Sapiens
AEVNAGIKL

SEQ ID NO: 414075 - protein, 9 aa, Homo Sapiens
QKKLRMKKM

SEQ ID NO: 414076 - protein, 9 aa, Homo Sapiens
KIDLLEYQG

SEQ ID NO: 414077 - protein, 9 aa, Homo Sapiens
LPTPDGGPY

SEQ ID NO: 414078 - protein, 9 aa, Homo Sapiens
PTSNDDMTL

SEQ ID NO: 414079 - protein, 9 aa, Homo Sapiens
GQAPSTGLP

SEQ ID NO: 414080 - protein, 9 aa, Homo Sapiens
AFAHDSTHV

SEQ ID NO: 414081 - protein, 9 aa, Homo Sapiens
SVDVEGGQL

SEQ ID NO: 414082 - protein, 9 aa, Homo Sapiens
QCGRDQRRG

SEQ ID NO: 414083 - protein, 9 aa, Homo Sapiens
ERRKLEKKC

SEQ ID NO: 414084 - protein, 9 aa, Homo Sapiens
ELHTHVSRC

SEQ ID NO: 414085 - protein, 9 aa, Homo Sapiens
DTIRSSVIP

SEQ ID NO: 414086 - protein, 9 aa, Homo Sapiens
CPSCMPSGT

SEQ ID NO: 414087 - protein, 9 aa, Homo Sapiens
IRPVSQKEV

SEQ ID NO: 414088 - protein, 9 aa, Homo Sapiens
PSNTTPEPT

SEQ ID NO: 414089 - protein, 9 aa, Homo Sapiens
GKASLTIGG

SEQ ID NO: 414090 - protein, 9 aa, Homo Sapiens
ASFPIDEEM

SEQ ID NO: 414091 - protein, 9 aa, Homo Sapiens
GAIRKDGLH

SEQ ID NO: 414092 - protein, 9 aa, Homo Sapiens
MPNIVISVV

SEQ ID NO: 414093 - protein, 9 aa, Homo Sapiens
LPGLSDDSP

SEQ ID NO: 414094 - protein, 9 aa, Homo Sapiens
SIQYRLKID

SEQ ID NO: 414095 - protein, 9 aa, Homo Sapiens
HESSDRCAL

SEQ ID NO: 414096 - protein, 9 aa, Homo Sapiens
VPVAEASTG

SEQ ID NO: 414097 - protein, 9 aa, Homo Sapiens
KSGELRVPE

SEQ ID NO: 414098 - protein, 9 aa, Homo Sapiens
VIMRLQLFI

SEQ ID NO: 414099 - protein, 9 aa, Homo Sapiens
DQSSKSTEM

SEQ ID NO: 414100 - protein, 9 aa, Homo Sapiens
VYNVAKACN

SEQ ID NO: 414101 - protein, 9 aa, Homo Sapiens
VDKERYDIM

SEQ ID NO: 414102 - protein, 9 aa, Homo Sapiens
RIQSAEGQQ

SEQ ID NO: 414103 - protein, 9 aa, Homo Sapiens
IALQHHFLV

SEQ ID NO: 414104 - protein, 9 aa, Homo Sapiens
YQMEMGSAL

SEQ ID NO: 414105 - protein, 9 aa, Homo Sapiens
FPAQPPARL

SEQ ID NO: 414106 - protein, 9 aa, Homo Sapiens
AVMPQMVTH

SEQ ID NO: 414107 - protein, 9 aa, Homo Sapiens
VTHTAAKAA

SEQ ID NO: 414108 - protein, 9 aa, Homo Sapiens
MLMVIRLRG

SEQ ID NO: 414109 - protein, 9 aa, Homo Sapiens
ATSCGSRAS

SEQ ID NO: 414110 - protein, 9 aa, Homo Sapiens
PRVLHQNLD

SEQ ID NO: 414111 - protein, 9 aa, Homo Sapiens
TARVSWGQR

SEQ ID NO: 414112 - protein, 9 aa, Homo Sapiens
PSRRRAPPR

SEQ ID NO: 414113 - protein, 9 aa, Homo Sapiens
EVVFWMTSG

SEQ ID NO: 414114 - protein, 9 aa, Homo Sapiens
VCRAAGPGT

SEQ ID NO: 414115 - protein, 9 aa, Homo Sapiens
PLLIRIIDT

SEQ ID NO: 414116 - protein, 9 aa, Homo Sapiens
PSWREEVQG

SEQ ID NO: 414117 - protein, 9 aa, Homo Sapiens
RGGTTIGEV

SEQ ID NO: 414118 - protein, 9 aa, Homo Sapiens
MVSAHQQPA

SEQ ID NO: 414119 - protein, 9 aa, Homo Sapiens
CEKVPVGTN

SEQ ID NO: 414120 - protein, 9 aa, Homo Sapiens
NPAAVQQGV

SEQ ID NO: 414121 - protein, 9 aa, Homo Sapiens
ENVILVWLS

SEQ ID NO: 414122 - protein, 9 aa, Homo Sapiens
KRCLEPERY

SEQ ID NO: 414123 - protein, 9 aa, Homo Sapiens
RRGTEWPST

SEQ ID NO: 414124 - protein, 9 aa, Homo Sapiens
QSLPFAASP

SEQ ID NO: 414125 - protein, 9 aa, Homo Sapiens
PCRVLWRNP

SEQ ID NO: 414126 - protein, 9 aa, Homo Sapiens
YAASSLDAA

SEQ ID NO: 414127 - protein, 9 aa, Homo Sapiens
TAVDNFSTQ

SEQ ID NO: 414128 - protein, 9 aa, Homo Sapiens
TIRNDFCVI

SEQ ID NO: 414129 - protein, 9 aa, Homo Sapiens
CQQEGESRL

SEQ ID NO: 414130 - protein, 9 aa, Homo Sapiens
MEWLIKKRE

SEQ ID NO: 414131 - protein, 9 aa, Homo Sapiens
RGVKQPNAV

SEQ ID NO: 414132 - protein, 9 aa, Homo Sapiens
GCCIPKEQL

SEQ ID NO: 414133 - protein, 9 aa, Homo Sapiens
MTMARGRRG

SEQ ID NO: 414134 - protein, 9 aa, Homo Sapiens
TCDIKQLDH

SEQ ID NO: 414135 - protein, 9 aa, Homo Sapiens
RQALPVMPL

SEQ ID NO: 414136 - protein, 9 aa, Homo Sapiens
SRIGKTSCA

SEQ ID NO: 414137 - protein, 9 aa, Homo Sapiens
CLPVGGFAE

SEQ ID NO: 414138 - protein, 9 aa, Homo Sapiens
MCSGPSTQL

SEQ ID NO: 414139 - protein, 9 aa, Homo Sapiens
HRRNDSYTE

SEQ ID NO: 414140 - protein, 9 aa, Homo Sapiens
TVVDGLDEL

SEQ ID NO: 414141 - protein, 9 aa, Homo Sapiens
SSPRAIFQR

SEQ ID NO: 414142 - protein, 9 aa, Homo Sapiens
HLLADGVCD

SEQ ID NO: 414143 - protein, 9 aa, Homo Sapiens
LTLSQCKGL

SEQ ID NO: 414144 - protein, 9 aa, Homo Sapiens
IPPGSSHAC

SEQ ID NO: 414145 - protein, 9 aa, Homo Sapiens
GSTDKTDPR

SEQ ID NO: 414146 - protein, 9 aa, Homo Sapiens
SLQQHLLVW

SEQ ID NO: 414147 - protein, 9 aa, Homo Sapiens
IIKENKKKN

SEQ ID NO: 414148 - protein, 9 aa, Homo Sapiens
NRIRRWHRS

SEQ ID NO: 414149 - protein, 9 aa, Homo Sapiens
TEKAMFDVH

SEQ ID NO: 414150 - protein, 9 aa, Homo Sapiens
ESLNFLIGH

SEQ ID NO: 414151 - protein, 9 aa, Homo Sapiens
IFEPGERAG

SEQ ID NO: 414152 - protein, 9 aa, Homo Sapiens
KAEQERLSQ

SEQ ID NO: 414153 - protein, 9 aa, Homo Sapiens
RIRSASCEP

SEQ ID NO: 414154 - protein, 9 aa, Homo Sapiens
GYGRSQGGG

SEQ ID NO: 414155 - protein, 9 aa, Homo Sapiens
EDEGEEDSS

SEQ ID NO: 414156 - protein, 9 aa, Homo Sapiens
QPPEPASGL

SEQ ID NO: 414157 - protein, 9 aa, Homo Sapiens
NINCKKRIP

SEQ ID NO: 414158 - protein, 9 aa, Homo Sapiens
PRRQAMAMT

SEQ ID NO: 414159 - protein, 9 aa, Homo Sapiens
ALATRDTPR

SEQ ID NO: 414160 - protein, 9 aa, Homo Sapiens
KTQNAPSPG

SEQ ID NO: 414161 - protein, 9 aa, Homo Sapiens
PRTRWSACL

SEQ ID NO: 414162 - protein, 9 aa, Homo Sapiens
LSAVLLHCF

SEQ ID NO: 414163 - protein, 9 aa, Homo Sapiens
PLRSASSTF

SEQ ID NO: 414164 - protein, 9 aa, Homo Sapiens
TVKEFIIFL

SEQ ID NO: 414165 - protein, 9 aa, Homo Sapiens
RAPETAAVA

SEQ ID NO: 414166 - protein, 9 aa, Homo Sapiens
KAAGFGTIT

SEQ ID NO: 414167 - protein, 9 aa, Homo Sapiens
ARQPQPRSS

SEQ ID NO: 414168 - protein, 9 aa, Homo Sapiens
MQRSPGPMW

SEQ ID NO: 414169 - protein, 9 aa, Homo Sapiens
DEHYWTYDA

SEQ ID NO: 414170 - protein, 9 aa, Homo Sapiens
QCRQLEARH

SEQ ID NO: 414171 - protein, 9 aa, Homo Sapiens
LTPPTLPRC

SEQ ID NO: 414172 - protein, 9 aa, Homo Sapiens
AYDDKLAFY

SEQ ID NO: 414173 - protein, 9 aa, Homo Sapiens
AVVFTEEEP

SEQ ID NO: 414174 - protein, 9 aa, Homo Sapiens
HPIHIGCTQ

SEQ ID NO: 414175 - protein, 9 aa, Homo Sapiens
GRTDFCPKT

SEQ ID NO: 414176 - protein, 9 aa, Homo Sapiens
TCLAGHRVP

SEQ ID NO: 414177 - protein, 9 aa, Homo Sapiens
DNTNSHNSE

SEQ ID NO: 414178 - protein, 9 aa, Homo Sapiens
LVMLMLDGY

SEQ ID NO: 414179 - protein, 9 aa, Homo Sapiens
QVEWENVEL

SEQ ID NO: 414180 - protein, 9 aa, Homo Sapiens
CMNPAHAFG

SEQ ID NO: 414181 - protein, 9 aa, Homo Sapiens
ISDLWTEDS

SEQ ID NO: 414182 - protein, 9 aa, Homo Sapiens
VMEGPLFCR

SEQ ID NO: 414183 - protein, 9 aa, Homo Sapiens
TLLQRNMET

SEQ ID NO: 414184 - protein, 9 aa, Homo Sapiens
QALKDAQSP

SEQ ID NO: 414185 - protein, 9 aa, Homo Sapiens
VRSNWNILN

SEQ ID NO: 414186 - protein, 9 aa, Homo Sapiens
TGQLQQRWH

SEQ ID NO: 414187 - protein, 9 aa, Homo Sapiens
GTGAEADRW

SEQ ID NO: 414188 - protein, 9 aa, Homo Sapiens
EDMEKCFLL

SEQ ID NO: 414189 - protein, 9 aa, Homo Sapiens
NIGRVCDTC

SEQ ID NO: 414190 - protein, 9 aa, Homo Sapiens
RWRCLPHCS

SEQ ID NO: 414191 - protein, 9 aa, Homo Sapiens
DGLDELLRG

SEQ ID NO: 414192 - protein, 9 aa, Homo Sapiens
EQVFHLAFR

SEQ ID NO: 414193 - protein, 9 aa, Homo Sapiens
HVVAQGWQM

SEQ ID NO: 414194 - protein, 9 aa, Homo Sapiens
TFKILVQCA

SEQ ID NO: 414195 - protein, 9 aa, Homo Sapiens
PTPSLAPGE

SEQ ID NO: 414196 - protein, 9 aa, Homo Sapiens
STLVLDVSS

SEQ ID NO: 414197 - protein, 9 aa, Homo Sapiens
VILELREEV

SEQ ID NO: 414198 - protein, 9 aa, Homo Sapiens
LWIWQEWTD

SEQ ID NO: 414199 - protein, 9 aa, Homo Sapiens
HDFFRDPLS

SEQ ID NO: 414200 - protein, 9 aa, Homo Sapiens
ERMFHWLVL

SEQ ID NO: 414201 - protein, 9 aa, Homo Sapiens
FDLDDGRWE

SEQ ID NO: 414202 - protein, 9 aa, Homo Sapiens
GGGWAATVP

SEQ ID NO: 414203 - protein, 9 aa, Homo Sapiens
GGGGSAAGG

SEQ ID NO: 414204 - protein, 9 aa, Homo Sapiens
CTPGPVWPC

SEQ ID NO: 414205 - protein, 9 aa, Homo Sapiens
RPGHLDQLI

SEQ ID NO: 414206 - protein, 9 aa, Homo Sapiens
GQQKAFGTC

SEQ ID NO: 414207 - protein, 9 aa, Homo Sapiens
STDFHSMKV

SEQ ID NO: 414208 - protein, 9 aa, Homo Sapiens
KQKVLREKV

SEQ ID NO: 414209 - protein, 9 aa, Homo Sapiens
CPAPPLLVL

SEQ ID NO: 414210 - protein, 9 aa, Homo Sapiens
ELVLATAGA

SEQ ID NO: 414211 - protein, 9 aa, Homo Sapiens
PGYQCPAGL

SEQ ID NO: 414212 - protein, 9 aa, Homo Sapiens
GTWINDISL

SEQ ID NO: 414213 - protein, 9 aa, Homo Sapiens
APSQLPASS

SEQ ID NO: 414214 - protein, 9 aa, Homo Sapiens
LFGLGIFKM

SEQ ID NO: 414215 - protein, 9 aa, Homo Sapiens
SHQNLNLNM

SEQ ID NO: 414216 - protein, 9 aa, Homo Sapiens
AGSLAAATG

SEQ ID NO: 414217 - protein, 9 aa, Homo Sapiens
FQKAFQLIQ

SEQ ID NO: 414218 - protein, 9 aa, Homo Sapiens
VIQKDSRTA

SEQ ID NO: 414219 - protein, 9 aa, Homo Sapiens
LVSAGPCVR

SEQ ID NO: 414220 - protein, 9 aa, Homo Sapiens
DQEKHSSQK

SEQ ID NO: 414221 - protein, 9 aa, Homo Sapiens
MEMGSALHE

SEQ ID NO: 414222 - protein, 9 aa, Homo Sapiens
RTIIVNTDL

SEQ ID NO: 414223 - protein, 9 aa, Homo Sapiens
RRRGSMNNE

SEQ ID NO: 414224 - protein, 9 aa, Homo Sapiens
MEMHYGHQA

SEQ ID NO: 414225 - protein, 9 aa, Homo Sapiens
GVAPSTCRI

SEQ ID NO: 414226 - protein, 9 aa, Homo Sapiens
GTATCPPPR

SEQ ID NO: 414227 - protein, 9 aa, Homo Sapiens
DIEETSLVK

SEQ ID NO: 414228 - protein, 9 aa, Homo Sapiens
QFVTGTCCL

SEQ ID NO: 414229 - protein, 9 aa, Homo Sapiens
LLGNPIPSE

SEQ ID NO: 414230 - protein, 9 aa, Homo Sapiens
EQKFMLYWA

SEQ ID NO: 414231 - protein, 9 aa, Homo Sapiens
LHDGGPRLR

SEQ ID NO: 414232 - protein, 9 aa, Homo Sapiens
LHFHRSTFR

SEQ ID NO: 414233 - protein, 9 aa, Homo Sapiens
RRSKAFLPR

SEQ ID NO: 414234 - protein, 9 aa, Homo Sapiens
LGRGLELAL

SEQ ID NO: 414235 - protein, 9 aa, Homo Sapiens
DLVQLLLQG

SEQ ID NO: 414236 - protein, 9 aa, Homo Sapiens
SLWVIVKEF

SEQ ID NO: 414237 - protein, 9 aa, Homo Sapiens
QDGDDQPSE

SEQ ID NO: 414238 - protein, 9 aa, Homo Sapiens
LPTALPSDP

SEQ ID NO: 414239 - protein, 9 aa, Homo Sapiens
ALIAILQLL

SEQ ID NO: 414240 - protein, 9 aa, Homo Sapiens
TTGKCIGAI

SEQ ID NO: 414241 - protein, 9 aa, Homo Sapiens
RPGYPGIPM

SEQ ID NO: 414242 - protein, 9 aa, Homo Sapiens
STSYYRRDR

SEQ ID NO: 414243 - protein, 9 aa, Homo Sapiens
AILRPGHLD

SEQ ID NO: 414244 - protein, 9 aa, Homo Sapiens
PYRTCDLFD

SEQ ID NO: 414245 - protein, 9 aa, Homo Sapiens
GFLWDVAAG

SEQ ID NO: 414246 - protein, 9 aa, Homo Sapiens
LKLQLRGKL

SEQ ID NO: 414247 - protein, 9 aa, Homo Sapiens
HILDRLQRG

SEQ ID NO: 414248 - protein, 9 aa, Homo Sapiens
QQIWKEMDE

SEQ ID NO: 414249 - protein, 9 aa, Homo Sapiens
CTASMCSWL

SEQ ID NO: 414250 - protein, 9 aa, Homo Sapiens
LAQVPRELS

SEQ ID NO: 414251 - protein, 9 aa, Homo Sapiens
PRGQAPEDL

SEQ ID NO: 414252 - protein, 9 aa, Homo Sapiens
KKLPSCPLA

SEQ ID NO: 414253 - protein, 9 aa, Homo Sapiens
LDCFKVYAN

SEQ ID NO: 414254 - protein, 9 aa, Homo Sapiens
QQGAPGCTL

SEQ ID NO: 414255 - protein, 9 aa, Homo Sapiens
CMLAQRLPY

SEQ ID NO: 414256 - protein, 9 aa, Homo Sapiens
MGPCGPCSE

SEQ ID NO: 414257 - protein, 9 aa, Homo Sapiens
DHYEELKRI

SEQ ID NO: 414258 - protein, 9 aa, Homo Sapiens
ASGDRRGNL

SEQ ID NO: 414259 - protein, 9 aa, Homo Sapiens
VMNHICANI

SEQ ID NO: 414260 - protein, 9 aa, Homo Sapiens
REIDKRMNN

SEQ ID NO: 414261 - protein, 9 aa, Homo Sapiens
TLRPVSKKD

SEQ ID NO: 414262 - protein, 9 aa, Homo Sapiens
GGGAASRLT

SEQ ID NO: 414263 - protein, 9 aa, Homo Sapiens
SFFLHPQKE

SEQ ID NO: 414264 - protein, 9 aa, Homo Sapiens
CVLSDYTQV

SEQ ID NO: 414265 - protein, 9 aa, Homo Sapiens
WLQEEPGPS

SEQ ID NO: 414266 - protein, 9 aa, Homo Sapiens
KHQGGWTYG

SEQ ID NO: 414267 - protein, 9 aa, Homo Sapiens
NCKISVDFH

SEQ ID NO: 414268 - protein, 9 aa, Homo Sapiens
LDVKAWLEN

SEQ ID NO: 414269 - protein, 9 aa, Homo Sapiens
KPPPPEGAA

SEQ ID NO: 414270 - protein, 9 aa, Homo Sapiens
WFEQEAVAV

SEQ ID NO: 414271 - protein, 9 aa, Homo Sapiens
TSFFAASSH

SEQ ID NO: 414272 - protein, 9 aa, Homo Sapiens
IRKYTSKMI

SEQ ID NO: 414273 - protein, 9 aa, Homo Sapiens
LQDQQQAQE

SEQ ID NO: 414274 - protein, 9 aa, Homo Sapiens
TCAHGHVEV

SEQ ID NO: 414275 - protein, 9 aa, Homo Sapiens
VVPREVYHE

SEQ ID NO: 414276 - protein, 9 aa, Homo Sapiens
TFSHQLAGH

SEQ ID NO: 414277 - protein, 9 aa, Homo Sapiens
PKHGCNFNN

SEQ ID NO: 414278 - protein, 9 aa, Homo Sapiens
KLESTACPS

SEQ ID NO: 414279 - protein, 9 aa, Homo Sapiens
FTKLAKNRN

SEQ ID NO: 414280 - protein, 9 aa, Homo Sapiens
DQATSPGAA

SEQ ID NO: 414281 - protein, 9 aa, Homo Sapiens
HYGHQAPQV

SEQ ID NO: 414282 - protein, 9 aa, Homo Sapiens
VRRRRAAQQ

SEQ ID NO: 414283 - protein, 9 aa, Homo Sapiens
VGEPRHCIE

SEQ ID NO: 414284 - protein, 9 aa, Homo Sapiens
LGRRALGTT

SEQ ID NO: 414285 - protein, 9 aa, Homo Sapiens
ASLQPKTAP

SEQ ID NO: 414286 - protein, 9 aa, Homo Sapiens
WCLGRCCCS

SEQ ID NO: 414287 - protein, 9 aa, Homo Sapiens
GFLLHQPLP

SEQ ID NO: 414288 - protein, 9 aa, Homo Sapiens
AGAPPPRGQ

SEQ ID NO: 414289 - protein, 9 aa, Homo Sapiens
EQQCLKIQG

SEQ ID NO: 414290 - protein, 9 aa, Homo Sapiens
CPTVSQGIL

SEQ ID NO: 414291 - protein, 9 aa, Homo Sapiens
GCLSFPLPR

SEQ ID NO: 414292 - protein, 9 aa, Homo Sapiens
QPVNVFISS

SEQ ID NO: 414293 - protein, 9 aa, Homo Sapiens
FHIIAITCV

SEQ ID NO: 414294 - protein, 9 aa, Homo Sapiens
GVSTSSSMG

SEQ ID NO: 414295 - protein, 9 aa, Homo Sapiens
VTGTPYQDW

SEQ ID NO: 414296 - protein, 9 aa, Homo Sapiens
LLHTLTVQD

SEQ ID NO: 414297 - protein, 9 aa, Homo Sapiens
DRDEERVHH

SEQ ID NO: 414298 - protein, 9 aa, Homo Sapiens
TQTTLSSMM

SEQ ID NO: 414299 - protein, 9 aa, Homo Sapiens
AVPWQKEET

SEQ ID NO: 414300 - protein, 9 aa, Homo Sapiens
EKDEGEDRD

SEQ ID NO: 414301 - protein, 9 aa, Homo Sapiens
DLSIMPPLA

SEQ ID NO: 414302 - protein, 9 aa, Homo Sapiens
VGAAQGVDV

SEQ ID NO: 414303 - protein, 9 aa, Homo Sapiens
ETLTFLCKA

SEQ ID NO: 414304 - protein, 9 aa, Homo Sapiens
IIPPGSSHA

SEQ ID NO: 414305 - protein, 9 aa, Homo Sapiens
SQGRQQHTR

SEQ ID NO: 414306 - protein, 9 aa, Homo Sapiens
TQYMPQNRQ

SEQ ID NO: 414307 - protein, 9 aa, Homo Sapiens
AFEKQVAVH

SEQ ID NO: 414308 - protein, 9 aa, Homo Sapiens
VSVTLFLWF

SEQ ID NO: 414309 - protein, 9 aa, Homo Sapiens
TFVEQGHVR

SEQ ID NO: 414310 - protein, 9 aa, Homo Sapiens
INKDQPTGR

SEQ ID NO: 414311 - protein, 9 aa, Homo Sapiens
KPGAGLAQV

SEQ ID NO: 414312 - protein, 9 aa, Homo Sapiens
KPKPRSLQP

SEQ ID NO: 414313 - protein, 9 aa, Homo Sapiens
MYVKRKTNV

SEQ ID NO: 414314 - protein, 9 aa, Homo Sapiens
SVEGRSPSR

SEQ ID NO: 414315 - protein, 9 aa, Homo Sapiens
GFFQSLMSL

SEQ ID NO: 414316 - protein, 9 aa, Homo Sapiens
TSVTQALTE

SEQ ID NO: 414317 - protein, 9 aa, Homo Sapiens
LMVPCLEHV

SEQ ID NO: 414318 - protein, 9 aa, Homo Sapiens
HSCWLSSPY

SEQ ID NO: 414319 - protein, 9 aa, Homo Sapiens
LPSRSMTTL

SEQ ID NO: 414320 - protein, 9 aa, Homo Sapiens
FKTQNAPSP

SEQ ID NO: 414321 - protein, 9 aa, Homo Sapiens
QSSSVSSVS

SEQ ID NO: 414322 - protein, 9 aa, Homo Sapiens
DLKWRHMLV

SEQ ID NO: 414323 - protein, 9 aa, Homo Sapiens
DEKWDFRTY

SEQ ID NO: 414324 - protein, 9 aa, Homo Sapiens
CSWDSALRL

SEQ ID NO: 414325 - protein, 9 aa, Homo Sapiens
ISLVQGPGI

SEQ ID NO: 414326 - protein, 9 aa, Homo Sapiens
HHPLNPDWC

SEQ ID NO: 414327 - protein, 9 aa, Homo Sapiens
PTPPTWTRC

SEQ ID NO: 414328 - protein, 9 aa, Homo Sapiens
TQSDVIITQ

SEQ ID NO: 414329 - protein, 9 aa, Homo Sapiens
AETHARHQV

SEQ ID NO: 414330 - protein, 9 aa, Homo Sapiens
GETESATTE

SEQ ID NO: 414331 - protein, 9 aa, Homo Sapiens
VAGPKCPAG

SEQ ID NO: 414332 - protein, 9 aa, Homo Sapiens
VHSIISSFA

SEQ ID NO: 414333 - protein, 9 aa, Homo Sapiens
RYDIMGRNQ

SEQ ID NO: 414334 - protein, 9 aa, Homo Sapiens
PHFISLPPA

SEQ ID NO: 414335 - protein, 9 aa, Homo Sapiens
GLLVVQAPA

SEQ ID NO: 414336 - protein, 9 aa, Homo Sapiens
FFRKKVEIE

SEQ ID NO: 414337 - protein, 9 aa, Homo Sapiens
EETYIGSMR

SEQ ID NO: 414338 - protein, 9 aa, Homo Sapiens
SPRLITTCE

SEQ ID NO: 414339 - protein, 9 aa, Homo Sapiens
EEEEFDYLT

SEQ ID NO: 414340 - protein, 9 aa, Homo Sapiens
KPKIVRSNW

SEQ ID NO: 414341 - protein, 9 aa, Homo Sapiens
PFLLLAILL

SEQ ID NO: 414342 - protein, 9 aa, Homo Sapiens
THTMAATAI

SEQ ID NO: 414343 - protein, 9 aa, Homo Sapiens
SWFRSCSWD

SEQ ID NO: 414344 - protein, 9 aa, Homo Sapiens
PVQIAHFFR

SEQ ID NO: 414345 - protein, 9 aa, Homo Sapiens
IVLVDDAST

SEQ ID NO: 414346 - protein, 9 aa, Homo Sapiens
LIPDGVSRT

SEQ ID NO: 414347 - protein, 9 aa, Homo Sapiens
AITEHAEVR

SEQ ID NO: 414348 - protein, 9 aa, Homo Sapiens
ERKWSWMTL

SEQ ID NO: 414349 - protein, 9 aa, Homo Sapiens
KDVKRQCCR

SEQ ID NO: 414350 - protein, 9 aa, Homo Sapiens
DFSQHAHLT

SEQ ID NO: 414351 - protein, 9 aa, Homo Sapiens
QLSGINAIY

SEQ ID NO: 414352 - protein, 9 aa, Homo Sapiens
LVNMGGNRS

SEQ ID NO: 414353 - protein, 9 aa, Homo Sapiens
LAEVKESLA

SEQ ID NO: 414354 - protein, 9 aa, Homo Sapiens
IGKMKWRKQ

SEQ ID NO: 414355 - protein, 9 aa, Homo Sapiens
TCQCRAPWS

SEQ ID NO: 414356 - protein, 9 aa, Homo Sapiens
EKYAGIFWF

SEQ ID NO: 414357 - protein, 9 aa, Homo Sapiens
DSFFVIFLE

SEQ ID NO: 414358 - protein, 9 aa, Homo Sapiens
EQEQSKTEE

SEQ ID NO: 414359 - protein, 9 aa, Homo Sapiens
KCVDVRKNH

SEQ ID NO: 414360 - protein, 9 aa, Homo Sapiens
LQESMAPAL

SEQ ID NO: 414361 - protein, 9 aa, Homo Sapiens
CPWTTHLWS

SEQ ID NO: 414362 - protein, 9 aa, Homo Sapiens
ILRCARPIW

SEQ ID NO: 414363 - protein, 9 aa, Homo Sapiens
PPVPSHKPD

SEQ ID NO: 414364 - protein, 9 aa, Homo Sapiens
GPDSQFVCV

SEQ ID NO: 414365 - protein, 9 aa, Homo Sapiens
RHCIEFRPV

SEQ ID NO: 414366 - protein, 9 aa, Homo Sapiens
RGQGLPDRQ

SEQ ID NO: 414367 - protein, 9 aa, Homo Sapiens
RKALALDKT

SEQ ID NO: 414368 - protein, 9 aa, Homo Sapiens
GGSWSSASG

SEQ ID NO: 414369 - protein, 9 aa, Homo Sapiens
RRRAAQQAR

SEQ ID NO: 414370 - protein, 9 aa, Homo Sapiens
GWCSSLQRH

SEQ ID NO: 414371 - protein, 9 aa, Homo Sapiens
HLASGDRRG

SEQ ID NO: 414372 - protein, 9 aa, Homo Sapiens
SPGACRPAC

SEQ ID NO: 414373 - protein, 9 aa, Homo Sapiens
KGASWFAFF

SEQ ID NO: 414374 - protein, 9 aa, Homo Sapiens
MPGSEIPPP

SEQ ID NO: 414375 - protein, 9 aa, Homo Sapiens
ALSSHGSSW

SEQ ID NO: 414376 - protein, 9 aa, Homo Sapiens
IVHSIISSF

SEQ ID NO: 414377 - protein, 9 aa, Homo Sapiens
EDLEARVVP

SEQ ID NO: 414378 - protein, 9 aa, Homo Sapiens
LVEGGCTQD

SEQ ID NO: 414379 - protein, 9 aa, Homo Sapiens
GPARQPQPR

SEQ ID NO: 414380 - protein, 9 aa, Homo Sapiens
QLPGPFLHC

SEQ ID NO: 414381 - protein, 9 aa, Homo Sapiens
VYWSESVNK

SEQ ID NO: 414382 - protein, 9 aa, Homo Sapiens
GLEGVRENY

SEQ ID NO: 414383 - protein, 9 aa, Homo Sapiens
KSYLLQLSK

SEQ ID NO: 414384 - protein, 9 aa, Homo Sapiens
CWWSWLMTA

SEQ ID NO: 414385 - protein, 9 aa, Homo Sapiens
ILRPGHLDQ

SEQ ID NO: 414386 - protein, 9 aa, Homo Sapiens
EKIINPTIS

SEQ ID NO: 414387 - protein, 9 aa, Homo Sapiens
FSHDNIYEV

SEQ ID NO: 414388 - protein, 9 aa, Homo Sapiens
LQPEPPRML

SEQ ID NO: 414389 - protein, 9 aa, Homo Sapiens
SVAKILHKT

SEQ ID NO: 414390 - protein, 9 aa, Homo Sapiens
RVGSCVDSA

SEQ ID NO: 414391 - protein, 9 aa, Homo Sapiens
AGIMGKNEC

SEQ ID NO: 414392 - protein, 9 aa, Homo Sapiens
AAPPPAQWE

SEQ ID NO: 414393 - protein, 9 aa, Homo Sapiens
AGRGAPRHP

SEQ ID NO: 414394 - protein, 9 aa, Homo Sapiens
NMETRKRKL

SEQ ID NO: 414395 - protein, 9 aa, Homo Sapiens
FRPVDCADH

SEQ ID NO: 414396 - protein, 9 aa, Homo Sapiens
GKIPNLLPL

SEQ ID NO: 414397 - protein, 9 aa, Homo Sapiens
RCARATWSE

SEQ ID NO: 414398 - protein, 9 aa, Homo Sapiens
EGMEKGNCG

SEQ ID NO: 414399 - protein, 9 aa, Homo Sapiens
QAVTTPATE

SEQ ID NO: 414400 - protein, 9 aa, Homo Sapiens
EEEFDYLTM

SEQ ID NO: 414401 - protein, 9 aa, Homo Sapiens
IQELEWALC

SEQ ID NO: 414402 - protein, 9 aa, Homo Sapiens
YLSPFTIVM

SEQ ID NO: 414403 - protein, 9 aa, Homo Sapiens
EFAVTTTPD

SEQ ID NO: 414404 - protein, 9 aa, Homo Sapiens
KRKQRAVSV

SEQ ID NO: 414405 - protein, 9 aa, Homo Sapiens
GYHRSGKQL

SEQ ID NO: 414406 - protein, 9 aa, Homo Sapiens
YMALAQRKE

SEQ ID NO: 414407 - protein, 9 aa, Homo Sapiens
PPPLKSASA

SEQ ID NO: 414408 - protein, 9 aa, Homo Sapiens
PQGARMTVL

SEQ ID NO: 414409 - protein, 9 aa, Homo Sapiens
SGCGQTFEG

SEQ ID NO: 414410 - protein, 9 aa, Homo Sapiens
LFLMDFFRN

SEQ ID NO: 414411 - protein, 9 aa, Homo Sapiens
AISSMVDFW

SEQ ID NO: 414412 - protein, 9 aa, Homo Sapiens
YTRTEDFFK

SEQ ID NO: 414413 - protein, 9 aa, Homo Sapiens
RGNGSNSFR

SEQ ID NO: 414414 - protein, 9 aa, Homo Sapiens
VCEKHASQQ

SEQ ID NO: 414415 - protein, 9 aa, Homo Sapiens
QGQEVALQA

SEQ ID NO: 414416 - protein, 9 aa, Homo Sapiens
ETWREEKNV

SEQ ID NO: 414417 - protein, 9 aa, Homo Sapiens
HEQQCLKIQ

SEQ ID NO: 414418 - protein, 9 aa, Homo Sapiens
VSHEGRTLV

SEQ ID NO: 414419 - protein, 9 aa, Homo Sapiens
SSQQSLPFA

SEQ ID NO: 414420 - protein, 9 aa, Homo Sapiens
LSLQQHLLV

SEQ ID NO: 414421 - protein, 9 aa, Homo Sapiens
LCEGLLYPQ

SEQ ID NO: 414422 - protein, 9 aa, Homo Sapiens
VFFGDRRRA

SEQ ID NO: 414423 - protein, 9 aa, Homo Sapiens
SQKGASWFA

SEQ ID NO: 414424 - protein, 9 aa, Homo Sapiens
TNSFVNKLD

SEQ ID NO: 414425 - protein, 9 aa, Homo Sapiens
NTCGCHQTA

SEQ ID NO: 414426 - protein, 9 aa, Homo Sapiens
LHVTALKRP

SEQ ID NO: 414427 - protein, 9 aa, Homo Sapiens
TCTTTRWSA

SEQ ID NO: 414428 - protein, 9 aa, Homo Sapiens
CRVSALGPR

SEQ ID NO: 414429 - protein, 9 aa, Homo Sapiens
GLPLLIPMY

SEQ ID NO: 414430 - protein, 9 aa, Homo Sapiens
LEQMLHSCR

SEQ ID NO: 414431 - protein, 9 aa, Homo Sapiens
CVRDYHTVL

SEQ ID NO: 414432 - protein, 9 aa, Homo Sapiens
WDDYVNIWW

SEQ ID NO: 414433 - protein, 9 aa, Homo Sapiens
GDHQDLEQP

SEQ ID NO: 414434 - protein, 9 aa, Homo Sapiens
GDLGAIDEN

SEQ ID NO: 414435 - protein, 9 aa, Homo Sapiens
HWTTLLLIL

SEQ ID NO: 414436 - protein, 9 aa, Homo Sapiens
YFVASVVVL

SEQ ID NO: 414437 - protein, 9 aa, Homo Sapiens
IPMGASGPG

SEQ ID NO: 414438 - protein, 9 aa, Homo Sapiens
LWFQGNNMQ

SEQ ID NO: 414439 - protein, 9 aa, Homo Sapiens
PPYRTCDLF

SEQ ID NO: 414440 - protein, 9 aa, Homo Sapiens
DLHNLNLDT

SEQ ID NO: 414441 - protein, 9 aa, Homo Sapiens
ADDIVDIRE

SEQ ID NO: 414442 - protein, 9 aa, Homo Sapiens
APMCNPNKA

SEQ ID NO: 414443 - protein, 9 aa, Homo Sapiens
CPISTTLRP

SEQ ID NO: 414444 - protein, 9 aa, Homo Sapiens
VIQNTSPLG

SEQ ID NO: 414445 - protein, 9 aa, Homo Sapiens
TAGRLESSL

SEQ ID NO: 414446 - protein, 9 aa, Homo Sapiens
ISWVCDLDK

SEQ ID NO: 414447 - protein, 9 aa, Homo Sapiens
QAAFWRSFC

SEQ ID NO: 414448 - protein, 9 aa, Homo Sapiens
DEKNLQECL

SEQ ID NO: 414449 - protein, 9 aa, Homo Sapiens
LVVGAAQGV

SEQ ID NO: 414450 - protein, 9 aa, Homo Sapiens
SRMLGLHFH

SEQ ID NO: 414451 - protein, 9 aa, Homo Sapiens
YDKKNMPQV

SEQ ID NO: 414452 - protein, 9 aa, Homo Sapiens
LENYQIPLR

SEQ ID NO: 414453 - protein, 9 aa, Homo Sapiens
PRPPQALFC

SEQ ID NO: 414454 - protein, 9 aa, Homo Sapiens
DIKPKDEAA

SEQ ID NO: 414455 - protein, 9 aa, Homo Sapiens
GYMQADARG

SEQ ID NO: 414456 - protein, 9 aa, Homo Sapiens
RQIPGPAIC

SEQ ID NO: 414457 - protein, 9 aa, Homo Sapiens
HHDRNLLRG

SEQ ID NO: 414458 - protein, 9 aa, Homo Sapiens
PARDLVNAF

SEQ ID NO: 414459 - protein, 9 aa, Homo Sapiens
TDTWLLEGR

SEQ ID NO: 414460 - protein, 9 aa, Homo Sapiens
RVEDVSIPI

SEQ ID NO: 414461 - protein, 9 aa, Homo Sapiens
LVNLQMEQL

SEQ ID NO: 414462 - protein, 9 aa, Homo Sapiens
DENRAYLMA

SEQ ID NO: 414463 - protein, 9 aa, Homo Sapiens
GLALPWELF

SEQ ID NO: 414464 - protein, 9 aa, Homo Sapiens
NPNGENQAM

SEQ ID NO: 414465 - protein, 9 aa, Homo Sapiens
RDIKQTGIM

SEQ ID NO: 414466 - protein, 9 aa, Homo Sapiens
TTVRTAGCS

SEQ ID NO: 414467 - protein, 9 aa, Homo Sapiens
KPQGLHDGG

SEQ ID NO: 414468 - protein, 9 aa, Homo Sapiens
EGHCMKNHH

SEQ ID NO: 414469 - protein, 9 aa, Homo Sapiens
VSSDKGDCH

SEQ ID NO: 414470 - protein, 9 aa, Homo Sapiens
YTYTKQKAT

SEQ ID NO: 414471 - protein, 9 aa, Homo Sapiens
VYRVTKCVE

SEQ ID NO: 414472 - protein, 9 aa, Homo Sapiens
GHLGMGLVK

SEQ ID NO: 414473 - protein, 9 aa, Homo Sapiens
RSCPEPRVP

SEQ ID NO: 414474 - protein, 9 aa, Homo Sapiens
GAQLGFNIQ

SEQ ID NO: 414475 - protein, 9 aa, Homo Sapiens
LLETRRPIF

SEQ ID NO: 414476 - protein, 9 aa, Homo Sapiens
KKASSPGHP

SEQ ID NO: 414477 - protein, 9 aa, Homo Sapiens
LRTLEKNIR

SEQ ID NO: 414478 - protein, 9 aa, Homo Sapiens
IDQTNTTLY

SEQ ID NO: 414479 - protein, 9 aa, Homo Sapiens
PSQPAVPWQ

SEQ ID NO: 414480 - protein, 9 aa, Homo Sapiens
VLLLFISLF

SEQ ID NO: 414481 - protein, 9 aa, Homo Sapiens
GTKPLYMAL

SEQ ID NO: 414482 - protein, 9 aa, Homo Sapiens
VQGMPVTIT

SEQ ID NO: 414483 - protein, 9 aa, Homo Sapiens
GYDLKDEEG

SEQ ID NO: 414484 - protein, 9 aa, Homo Sapiens
THENCGYKF

SEQ ID NO: 414485 - protein, 9 aa, Homo Sapiens
QAAVTFVEQ

SEQ ID NO: 414486 - protein, 9 aa, Homo Sapiens
QTGIMFGSF

SEQ ID NO: 414487 - protein, 9 aa, Homo Sapiens
EITTYRKLL

SEQ ID NO: 414488 - protein, 9 aa, Homo Sapiens
LHILGTQES

SEQ ID NO: 414489 - protein, 9 aa, Homo Sapiens
AGCGTPGCP

SEQ ID NO: 414490 - protein, 9 aa, Homo Sapiens
VLAPLFMYL

SEQ ID NO: 414491 - protein, 9 aa, Homo Sapiens
MLPTYICGL

SEQ ID NO: 414492 - protein, 9 aa, Homo Sapiens
VSRPLVREQ

SEQ ID NO: 414493 - protein, 9 aa, Homo Sapiens
AFFCICTIP

SEQ ID NO: 414494 - protein, 9 aa, Homo Sapiens
QREFSGSDG

SEQ ID NO: 414495 - protein, 9 aa, Homo Sapiens
FSFLMKKKK

SEQ ID NO: 414496 - protein, 9 aa, Homo Sapiens
KWCRPWLEQ

SEQ ID NO: 414497 - protein, 9 aa, Homo Sapiens
DKDRRLSAE

SEQ ID NO: 414498 - protein, 9 aa, Homo Sapiens
IESKSISAP

SEQ ID NO: 414499 - protein, 9 aa, Homo Sapiens
GGDGHAAGG

SEQ ID NO: 414500 - protein, 9 aa, Homo Sapiens
VLAYPFFWS

SEQ ID NO: 414501 - protein, 9 aa, Homo Sapiens
ENTTWLYHP

SEQ ID NO: 414502 - protein, 9 aa, Homo Sapiens
KAMRAPHTD

SEQ ID NO: 414503 - protein, 9 aa, Homo Sapiens
ESVRQIYSE

SEQ ID NO: 414504 - protein, 9 aa, Homo Sapiens
GPPPAPPIS

SEQ ID NO: 414505 - protein, 9 aa, Homo Sapiens
QLNDEALKE

SEQ ID NO: 414506 - protein, 9 aa, Homo Sapiens
CARATWSES

SEQ ID NO: 414507 - protein, 9 aa, Homo Sapiens
IMIPIAGAT

SEQ ID NO: 414508 - protein, 9 aa, Homo Sapiens
FEATEKKIF

SEQ ID NO: 414509 - protein, 9 aa, Homo Sapiens
TKEGISINC

SEQ ID NO: 414510 - protein, 9 aa, Homo Sapiens
EQEGALDVE

SEQ ID NO: 414511 - protein, 9 aa, Homo Sapiens
HMEIDKNAV

SEQ ID NO: 414512 - protein, 9 aa, Homo Sapiens
WVVHLHIDV

SEQ ID NO: 414513 - protein, 9 aa, Homo Sapiens
QVFHLAFRS

SEQ ID NO: 414514 - protein, 9 aa, Homo Sapiens
LGPDGLSKP

SEQ ID NO: 414515 - protein, 9 aa, Homo Sapiens
SCVALECKE

SEQ ID NO: 414516 - protein, 9 aa, Homo Sapiens
FLPTNQLCH

SEQ ID NO: 414517 - protein, 9 aa, Homo Sapiens
PQVNMTDVS

SEQ ID NO: 414518 - protein, 9 aa, Homo Sapiens
CILLIMVMC

SEQ ID NO: 414519 - protein, 9 aa, Homo Sapiens
HEQEGALDV

SEQ ID NO: 414520 - protein, 9 aa, Homo Sapiens
TATSTESLS

SEQ ID NO: 414521 - protein, 9 aa, Homo Sapiens
NTQKAMCMK

SEQ ID NO: 414522 - protein, 9 aa, Homo Sapiens
LANMSDNAG

SEQ ID NO: 414523 - protein, 9 aa, Homo Sapiens
HAGCQPHRC

SEQ ID NO: 414524 - protein, 9 aa, Homo Sapiens
HHLGTFGFN

SEQ ID NO: 414525 - protein, 9 aa, Homo Sapiens
AVMEGPLFC

SEQ ID NO: 414526 - protein, 9 aa, Homo Sapiens
GSFPLQCWG

SEQ ID NO: 414527 - protein, 9 aa, Homo Sapiens
TTTRWSACP

SEQ ID NO: 414528 - protein, 9 aa, Homo Sapiens
SKHLNGTIM

SEQ ID NO: 414529 - protein, 9 aa, Homo Sapiens
SPTTATSTE

SEQ ID NO: 414530 - protein, 9 aa, Homo Sapiens
AAAARATAS

SEQ ID NO: 414531 - protein, 9 aa, Homo Sapiens
RDSPQSVFP

SEQ ID NO: 414532 - protein, 9 aa, Homo Sapiens
PSSTGALPT

SEQ ID NO: 414533 - protein, 9 aa, Homo Sapiens
QVILEVTSE

SEQ ID NO: 414534 - protein, 9 aa, Homo Sapiens
VLVGCVEFF

SEQ ID NO: 414535 - protein, 9 aa, Homo Sapiens
VRRFCCFGN

SEQ ID NO: 414536 - protein, 9 aa, Homo Sapiens
SAVSGEVWV

SEQ ID NO: 414537 - protein, 9 aa, Homo Sapiens
LPPPPSPCP

SEQ ID NO: 414538 - protein, 9 aa, Homo Sapiens
AIRKDGLHG

SEQ ID NO: 414539 - protein, 9 aa, Homo Sapiens
PEEQPGGFA

SEQ ID NO: 414540 - protein, 9 aa, Homo Sapiens
AISWLKDRP

SEQ ID NO: 414541 - protein, 9 aa, Homo Sapiens
GPVPPDWEC

SEQ ID NO: 414542 - protein, 9 aa, Homo Sapiens
LGGPRRVRG

SEQ ID NO: 414543 - protein, 9 aa, Homo Sapiens
VVPSMINYV

SEQ ID NO: 414544 - protein, 9 aa, Homo Sapiens
KIPNLLPLA

SEQ ID NO: 414545 - protein, 9 aa, Homo Sapiens
CVACCLLTS

SEQ ID NO: 414546 - protein, 9 aa, Homo Sapiens
HLVCVMCLV

SEQ ID NO: 414547 - protein, 9 aa, Homo Sapiens
YLCGKPDVT

SEQ ID NO: 414548 - protein, 9 aa, Homo Sapiens
LGTIHWSCL

SEQ ID NO: 414549 - protein, 9 aa, Homo Sapiens
LPTDTWLLE

SEQ ID NO: 414550 - protein, 9 aa, Homo Sapiens
AEQLHAAWH

SEQ ID NO: 414551 - protein, 9 aa, Homo Sapiens
RMFIPAAAA

SEQ ID NO: 414552 - protein, 9 aa, Homo Sapiens
KGQENLKMD

SEQ ID NO: 414553 - protein, 9 aa, Homo Sapiens
LQVWNCPWK

SEQ ID NO: 414554 - protein, 9 aa, Homo Sapiens
LIVTIIATM

SEQ ID NO: 414555 - protein, 9 aa, Homo Sapiens
VAITEHAEV

SEQ ID NO: 414556 - protein, 9 aa, Homo Sapiens
PAVPPVLLS

SEQ ID NO: 414557 - protein, 9 aa, Homo Sapiens
IITEKAMFD

SEQ ID NO: 414558 - protein, 9 aa, Homo Sapiens
QGNNMQLAR

SEQ ID NO: 414559 - protein, 9 aa, Homo Sapiens
FFLPLAPAS

SEQ ID NO: 414560 - protein, 9 aa, Homo Sapiens
RYFYPFPNR

SEQ ID NO: 414561 - protein, 9 aa, Homo Sapiens
STCRISVAS

SEQ ID NO: 414562 - protein, 9 aa, Homo Sapiens
VHHPWPKST

SEQ ID NO: 414563 - protein, 9 aa, Homo Sapiens
IVYFVASVV

SEQ ID NO: 414564 - protein, 9 aa, Homo Sapiens
TLDAEVRSR

SEQ ID NO: 414565 - protein, 9 aa, Homo Sapiens
QAANEDIRT

SEQ ID NO: 414566 - protein, 9 aa, Homo Sapiens
VVVAKGTLH

SEQ ID NO: 414567 - protein, 9 aa, Homo Sapiens
VAPLVCYLK

SEQ ID NO: 414568 - protein, 9 aa, Homo Sapiens
NSFFIMIPI

SEQ ID NO: 414569 - protein, 9 aa, Homo Sapiens
RCYQLPQLQ

SEQ ID NO: 414570 - protein, 9 aa, Homo Sapiens
QSRCPRVLL

SEQ ID NO: 414571 - protein, 9 aa, Homo Sapiens
AQQSCRGSW

SEQ ID NO: 414572 - protein, 9 aa, Homo Sapiens
DLETLIAHF

SEQ ID NO: 414573 - protein, 9 aa, Homo Sapiens
AATLRCPAV

SEQ ID NO: 414574 - protein, 9 aa, Homo Sapiens
VHNIQASER

SEQ ID NO: 414575 - protein, 9 aa, Homo Sapiens
RQLQAICGV

SEQ ID NO: 414576 - protein, 9 aa, Homo Sapiens
TDPRGGTQS

SEQ ID NO: 414577 - protein, 9 aa, Homo Sapiens
SHFMRLAAE

SEQ ID NO: 414578 - protein, 9 aa, Homo Sapiens
VRVKTPGGP

SEQ ID NO: 414579 - protein, 9 aa, Homo Sapiens
QLFYFFFIY

SEQ ID NO: 414580 - protein, 9 aa, Homo Sapiens
CRPWLEQML

SEQ ID NO: 414581 - protein, 9 aa, Homo Sapiens
AHHLLLPGS

SEQ ID NO: 414582 - protein, 9 aa, Homo Sapiens
QRLTGRSRY

SEQ ID NO: 414583 - protein, 9 aa, Homo Sapiens
TVSYLDNLT

SEQ ID NO: 414584 - protein, 9 aa, Homo Sapiens
QNLNLNMLS

SEQ ID NO: 414585 - protein, 9 aa, Homo Sapiens
LKSLSRKSP

SEQ ID NO: 414586 - protein, 9 aa, Homo Sapiens
STSRETCSS

SEQ ID NO: 414587 - protein, 9 aa, Homo Sapiens
VIELMASEG

SEQ ID NO: 414588 - protein, 9 aa, Homo Sapiens
PTDTWLLEG

SEQ ID NO: 414589 - protein, 9 aa, Homo Sapiens
VQQMMEMEG

SEQ ID NO: 414590 - protein, 9 aa, Homo Sapiens
IQKSDFSNN

SEQ ID NO: 414591 - protein, 9 aa, Homo Sapiens
CSTRPVPTA

SEQ ID NO: 414592 - protein, 9 aa, Homo Sapiens
FTKNLYFKQ

SEQ ID NO: 414593 - protein, 9 aa, Homo Sapiens
KPRTSFTCL

SEQ ID NO: 414594 - protein, 9 aa, Homo Sapiens
SPTASAFGD

SEQ ID NO: 414595 - protein, 9 aa, Homo Sapiens
EDAFTMDYN

SEQ ID NO: 414596 - protein, 9 aa, Homo Sapiens
HQSPVQLLQ

SEQ ID NO: 414597 - protein, 9 aa, Homo Sapiens
CTHTHTHTH

SEQ ID NO: 414598 - protein, 9 aa, Homo Sapiens
EVHTASQDD

SEQ ID NO: 414599 - protein, 9 aa, Homo Sapiens
GTLGSWPGQ

SEQ ID NO: 414600 - protein, 9 aa, Homo Sapiens
IVIMMSSTP

SEQ ID NO: 414601 - protein, 9 aa, Homo Sapiens
YRAPKVILS

SEQ ID NO: 414602 - protein, 9 aa, Homo Sapiens
LLSEPEKTL

SEQ ID NO: 414603 - protein, 9 aa, Homo Sapiens
LKPNEEHFG

SEQ ID NO: 414604 - protein, 9 aa, Homo Sapiens
YRGGQRCRC

SEQ ID NO: 414605 - protein, 9 aa, Homo Sapiens
LGASSLSSS

SEQ ID NO: 414606 - protein, 9 aa, Homo Sapiens
PRTLQKKIE

SEQ ID NO: 414607 - protein, 9 aa, Homo Sapiens
AVGVIPPAV

SEQ ID NO: 414608 - protein, 9 aa, Homo Sapiens
GFVLAPLFM

SEQ ID NO: 414609 - protein, 9 aa, Homo Sapiens
KDDFEVFFF

SEQ ID NO: 414610 - protein, 9 aa, Homo Sapiens
PGDGGEKCI

SEQ ID NO: 414611 - protein, 9 aa, Homo Sapiens
TLSQPPPQA

SEQ ID NO: 414612 - protein, 9 aa, Homo Sapiens
RLILSNMSE

SEQ ID NO: 414613 - protein, 9 aa, Homo Sapiens
FRIWHNEQN

SEQ ID NO: 414614 - protein, 9 aa, Homo Sapiens
HLSQDPYDL

SEQ ID NO: 414615 - protein, 9 aa, Homo Sapiens
RDDPGVGSV

SEQ ID NO: 414616 - protein, 9 aa, Homo Sapiens
HQGMVIASD

SEQ ID NO: 414617 - protein, 9 aa, Homo Sapiens
SCSQYAQGY

SEQ ID NO: 414618 - protein, 9 aa, Homo Sapiens
AFSCLRLSI

SEQ ID NO: 414619 - protein, 9 aa, Homo Sapiens
LQPQVPPAC

SEQ ID NO: 414620 - protein, 9 aa, Homo Sapiens
MVVRPVATL

SEQ ID NO: 414621 - protein, 9 aa, Homo Sapiens
TVLRVWVRT

SEQ ID NO: 414622 - protein, 9 aa, Homo Sapiens
HIAGFLLED

SEQ ID NO: 414623 - protein, 9 aa, Homo Sapiens
SPLPGRGAS

SEQ ID NO: 414624 - protein, 9 aa, Homo Sapiens
RWCLGRCCC

SEQ ID NO: 414625 - protein, 9 aa, Homo Sapiens
FFLPLVFAL

SEQ ID NO: 414626 - protein, 9 aa, Homo Sapiens
QHLAMMERI

SEQ ID NO: 414627 - protein, 9 aa, Homo Sapiens
SSSPTNVSA

SEQ ID NO: 414628 - protein, 9 aa, Homo Sapiens
IHGSLGQVT

SEQ ID NO: 414629 - protein, 9 aa, Homo Sapiens
GLHGTMEKS

SEQ ID NO: 414630 - protein, 9 aa, Homo Sapiens
THVEGEKPK

SEQ ID NO: 414631 - protein, 9 aa, Homo Sapiens
GVRAAAAPL

SEQ ID NO: 414632 - protein, 9 aa, Homo Sapiens
IDVDHVVMG

SEQ ID NO: 414633 - protein, 9 aa, Homo Sapiens
VSWGQRHHP

SEQ ID NO: 414634 - protein, 9 aa, Homo Sapiens
MREWPVSMS

SEQ ID NO: 414635 - protein, 9 aa, Homo Sapiens
VPGLMREWP

SEQ ID NO: 414636 - protein, 9 aa, Homo Sapiens
AQLNDRRAF

SEQ ID NO: 414637 - protein, 9 aa, Homo Sapiens
RTPENYSNA

SEQ ID NO: 414638 - protein, 9 aa, Homo Sapiens
RADTGQECF

SEQ ID NO: 414639 - protein, 9 aa, Homo Sapiens
SMVVAPLYD

SEQ ID NO: 414640 - protein, 9 aa, Homo Sapiens
VGSLFVKKC

SEQ ID NO: 414641 - protein, 9 aa, Homo Sapiens
TPATETKKV

SEQ ID NO: 414642 - protein, 9 aa, Homo Sapiens
GDTLHVFKM

SEQ ID NO: 414643 - protein, 9 aa, Homo Sapiens
DCHGQQYVK

SEQ ID NO: 414644 - protein, 9 aa, Homo Sapiens
QLLVQLNDE

SEQ ID NO: 414645 - protein, 9 aa, Homo Sapiens
KEDEKDEEI

SEQ ID NO: 414646 - protein, 9 aa, Homo Sapiens
RSLTLIQSN

SEQ ID NO: 414647 - protein, 9 aa, Homo Sapiens
HHRRWSETF

SEQ ID NO: 414648 - protein, 9 aa, Homo Sapiens
LAEEATDPV

SEQ ID NO: 414649 - protein, 9 aa, Homo Sapiens
RIQEGRYCH

SEQ ID NO: 414650 - protein, 9 aa, Homo Sapiens
TCFSTGHGR

SEQ ID NO: 414651 - protein, 9 aa, Homo Sapiens
ELVVHFFAC

SEQ ID NO: 414652 - protein, 9 aa, Homo Sapiens
ITELAVGLT

SEQ ID NO: 414653 - protein, 9 aa, Homo Sapiens
GSGGHYPCS

SEQ ID NO: 414654 - protein, 9 aa, Homo Sapiens
QEPSRLGGG

SEQ ID NO: 414655 - protein, 9 aa, Homo Sapiens
VVGGPGVGL

SEQ ID NO: 414656 - protein, 9 aa, Homo Sapiens
DKDNVNQAC

SEQ ID NO: 414657 - protein, 9 aa, Homo Sapiens
FEECRRLFV

SEQ ID NO: 414658 - protein, 9 aa, Homo Sapiens
SAVPLLTDQ

SEQ ID NO: 414659 - protein, 9 aa, Homo Sapiens
GPRATLTRP

SEQ ID NO: 414660 - protein, 9 aa, Homo Sapiens
LGRSSPTDL

SEQ ID NO: 414661 - protein, 9 aa, Homo Sapiens
HRRRPSFPA

SEQ ID NO: 414662 - protein, 9 aa, Homo Sapiens
HKWIISDGS

SEQ ID NO: 414663 - protein, 9 aa, Homo Sapiens
ELEDDTSYF

SEQ ID NO: 414664 - protein, 9 aa, Homo Sapiens
AASSHVPVK

SEQ ID NO: 414665 - protein, 9 aa, Homo Sapiens
GVVVHDLVV

SEQ ID NO: 414666 - protein, 9 aa, Homo Sapiens
SPRKRRLSQ

SEQ ID NO: 414667 - protein, 9 aa, Homo Sapiens
VALSPDGDQ

SEQ ID NO: 414668 - protein, 9 aa, Homo Sapiens
LTHLDLSKN

SEQ ID NO: 414669 - protein, 9 aa, Homo Sapiens
FDHMPKIRT

SEQ ID NO: 414670 - protein, 9 aa, Homo Sapiens
PPSPSRRRA

SEQ ID NO: 414671 - protein, 9 aa, Homo Sapiens
AKSKRVNEV

SEQ ID NO: 414672 - protein, 9 aa, Homo Sapiens
MFSENRAFR

SEQ ID NO: 414673 - protein, 9 aa, Homo Sapiens
VVMVVRPVA

SEQ ID NO: 414674 - protein, 9 aa, Homo Sapiens
GQTFEGNAE

SEQ ID NO: 414675 - protein, 9 aa, Homo Sapiens
TGFLDMLNN

SEQ ID NO: 414676 - protein, 9 aa, Homo Sapiens
PEASTFSTT

SEQ ID NO: 414677 - protein, 9 aa, Homo Sapiens
AWSLTSSLP

SEQ ID NO: 414678 - protein, 9 aa, Homo Sapiens
SQLLGSMAH

SEQ ID NO: 414679 - protein, 9 aa, Homo Sapiens
VLPIPGQET

SEQ ID NO: 414680 - protein, 9 aa, Homo Sapiens
KHTAMVDGK

SEQ ID NO: 414681 - protein, 9 aa, Homo Sapiens
GPPGPEGEA

SEQ ID NO: 414682 - protein, 9 aa, Homo Sapiens
PACTSKAWT

SEQ ID NO: 414683 - protein, 9 aa, Homo Sapiens
VILASRWKP

SEQ ID NO: 414684 - protein, 9 aa, Homo Sapiens
LPGAGDQGW

SEQ ID NO: 414685 - protein, 9 aa, Homo Sapiens
PKVLPGTLK

SEQ ID NO: 414686 - protein, 9 aa, Homo Sapiens
AAHLGITMK

SEQ ID NO: 414687 - protein, 9 aa, Homo Sapiens
KNYYGEKNW

SEQ ID NO: 414688 - protein, 9 aa, Homo Sapiens
NYEVKLQLL

SEQ ID NO: 414689 - protein, 9 aa, Homo Sapiens
HQNAPPVPV

SEQ ID NO: 414690 - protein, 9 aa, Homo Sapiens
NWGSLPLRS

SEQ ID NO: 414691 - protein, 9 aa, Homo Sapiens
DQLMPYFAM

SEQ ID NO: 414692 - protein, 9 aa, Homo Sapiens
SGNKADLTN

SEQ ID NO: 414693 - protein, 9 aa, Homo Sapiens
FLYGLPQRP

SEQ ID NO: 414694 - protein, 9 aa, Homo Sapiens
HVWVEVVHD

SEQ ID NO: 414695 - protein, 9 aa, Homo Sapiens
HEQSRTDWD

SEQ ID NO: 414696 - protein, 9 aa, Homo Sapiens
LGNNALRDI

SEQ ID NO: 414697 - protein, 9 aa, Homo Sapiens
LLTAFLGDL

SEQ ID NO: 414698 - protein, 9 aa, Homo Sapiens
VLRRSRSAR

SEQ ID NO: 414699 - protein, 9 aa, Homo Sapiens
APQCPSCMP

SEQ ID NO: 414700 - protein, 9 aa, Homo Sapiens
MYLFIGTSF

SEQ ID NO: 414701 - protein, 9 aa, Homo Sapiens
SASILQELK

SEQ ID NO: 414702 - protein, 9 aa, Homo Sapiens
LVAQQRQRL

SEQ ID NO: 414703 - protein, 9 aa, Homo Sapiens
WWRPAPSTS

SEQ ID NO: 414704 - protein, 9 aa, Homo Sapiens
PSLQENEPT

SEQ ID NO: 414705 - protein, 9 aa, Homo Sapiens
TGPAQTPRN

SEQ ID NO: 414706 - protein, 9 aa, Homo Sapiens
TRSLPSISR

SEQ ID NO: 414707 - protein, 9 aa, Homo Sapiens
SYLDNLTYR

SEQ ID NO: 414708 - protein, 9 aa, Homo Sapiens
ATLGKIPNL

SEQ ID NO: 414709 - protein, 9 aa, Homo Sapiens
EKPKAVAKN

SEQ ID NO: 414710 - protein, 9 aa, Homo Sapiens
RRGNLRIHE

SEQ ID NO: 414711 - protein, 9 aa, Homo Sapiens
QALQDDGSQ

SEQ ID NO: 414712 - protein, 9 aa, Homo Sapiens
LQLSKLQPQ

SEQ ID NO: 414713 - protein, 9 aa, Homo Sapiens
PQCHQDHPE

SEQ ID NO: 414714 - protein, 9 aa, Homo Sapiens
MTVSMPSMV

SEQ ID NO: 414715 - protein, 9 aa, Homo Sapiens
QHLQAAVTF

SEQ ID NO: 414716 - protein, 9 aa, Homo Sapiens
ELMVPCLEH

SEQ ID NO: 414717 - protein, 9 aa, Homo Sapiens
WELGPRLEE

SEQ ID NO: 414718 - protein, 9 aa, Homo Sapiens
TAAILILLG

SEQ ID NO: 414719 - protein, 9 aa, Homo Sapiens
VRADTGQEC

SEQ ID NO: 414720 - protein, 9 aa, Homo Sapiens
KLEKKCWII

SEQ ID NO: 414721 - protein, 9 aa, Homo Sapiens
SKIQIGNSL

SEQ ID NO: 414722 - protein, 9 aa, Homo Sapiens
VHSTGHHAW

SEQ ID NO: 414723 - protein, 9 aa, Homo Sapiens
SSLATQSQP

SEQ ID NO: 414724 - protein, 9 aa, Homo Sapiens
ALANNIVLL

SEQ ID NO: 414725 - protein, 9 aa, Homo Sapiens
GTSYKLTDL

SEQ ID NO: 414726 - protein, 9 aa, Homo Sapiens
LNDRRAFIL

SEQ ID NO: 414727 - protein, 9 aa, Homo Sapiens
DTPFVRLQG

SEQ ID NO: 414728 - protein, 9 aa, Homo Sapiens
QLSAPAGAC

SEQ ID NO: 414729 - protein, 9 aa, Homo Sapiens
TITMVRVVT

SEQ ID NO: 414730 - protein, 9 aa, Homo Sapiens
RLVEGQAAL

SEQ ID NO: 414731 - protein, 9 aa, Homo Sapiens
RMPARRESR

SEQ ID NO: 414732 - protein, 9 aa, Homo Sapiens
KFLDGDELM

SEQ ID NO: 414733 - protein, 9 aa, Homo Sapiens
PSRTIGRSQ

SEQ ID NO: 414734 - protein, 9 aa, Homo Sapiens
TSFNSSTLK

SEQ ID NO: 414735 - protein, 9 aa, Homo Sapiens
VIHSFKGRK

SEQ ID NO: 414736 - protein, 9 aa, Homo Sapiens
QDDGFQPTI

SEQ ID NO: 414737 - protein, 9 aa, Homo Sapiens
NMGALTASG

SEQ ID NO: 414738 - protein, 9 aa, Homo Sapiens
PSTQLVRQR

SEQ ID NO: 414739 - protein, 9 aa, Homo Sapiens
QYPRIERYR

SEQ ID NO: 414740 - protein, 9 aa, Homo Sapiens
EGMLLPRAL

SEQ ID NO: 414741 - protein, 9 aa, Homo Sapiens
KGKSVDTIR

SEQ ID NO: 414742 - protein, 9 aa, Homo Sapiens
NLQECLSKS

SEQ ID NO: 414743 - protein, 9 aa, Homo Sapiens
TMMLNVQNL

SEQ ID NO: 414744 - protein, 9 aa, Homo Sapiens
CVELGIKAT

SEQ ID NO: 414745 - protein, 9 aa, Homo Sapiens
WSETFWGYC

SEQ ID NO: 414746 - protein, 9 aa, Homo Sapiens
SFGSPTSND

SEQ ID NO: 414747 - protein, 9 aa, Homo Sapiens
EELKNHYQS

SEQ ID NO: 414748 - protein, 9 aa, Homo Sapiens
PLRSHTISF

SEQ ID NO: 414749 - protein, 9 aa, Homo Sapiens
FSTPTGSCT

SEQ ID NO: 414750 - protein, 9 aa, Homo Sapiens
PHAPMSVPL

SEQ ID NO: 414751 - protein, 9 aa, Homo Sapiens
EPPPVGAGT

SEQ ID NO: 414752 - protein, 9 aa, Homo Sapiens
CDMGYHVSM

SEQ ID NO: 414753 - protein, 9 aa, Homo Sapiens
NRTISPKKP

SEQ ID NO: 414754 - protein, 9 aa, Homo Sapiens
DSEGMKRSS

SEQ ID NO: 414755 - protein, 9 aa, Homo Sapiens
DIPSVIAAG

SEQ ID NO: 414756 - protein, 9 aa, Homo Sapiens
IRREGIRWL

SEQ ID NO: 414757 - protein, 9 aa, Homo Sapiens
GGLRSAPGA

SEQ ID NO: 414758 - protein, 9 aa, Homo Sapiens
PATATWRMR

SEQ ID NO: 414759 - protein, 9 aa, Homo Sapiens
SRASKKFII

SEQ ID NO: 414760 - protein, 9 aa, Homo Sapiens
RVLDRDEER

SEQ ID NO: 414761 - protein, 9 aa, Homo Sapiens
VQLFERGYG

SEQ ID NO: 414762 - protein, 9 aa, Homo Sapiens
ILQLVVLDV

SEQ ID NO: 414763 - protein, 9 aa, Homo Sapiens
RERVEDVSI

SEQ ID NO: 414764 - protein, 9 aa, Homo Sapiens
TATRKVPWK

SEQ ID NO: 414765 - protein, 9 aa, Homo Sapiens
GDSGGRQDL

SEQ ID NO: 414766 - protein, 9 aa, Homo Sapiens
APTPSLAPG

SEQ ID NO: 414767 - protein, 9 aa, Homo Sapiens
VALVYSLCI

SEQ ID NO: 414768 - protein, 9 aa, Homo Sapiens
ATEKKIFFQ

SEQ ID NO: 414769 - protein, 9 aa, Homo Sapiens
WDSEGMKRS

SEQ ID NO: 414770 - protein, 9 aa, Homo Sapiens
SVAQWSLPM

SEQ ID NO: 414771 - protein, 9 aa, Homo Sapiens
VMSCSLLTQ

SEQ ID NO: 414772 - protein, 9 aa, Homo Sapiens
KCRTAGHAA

SEQ ID NO: 414773 - protein, 9 aa, Homo Sapiens
EFSFHEALM

SEQ ID NO: 414774 - protein, 9 aa, Homo Sapiens
GENAIEEQI

SEQ ID NO: 414775 - protein, 9 aa, Homo Sapiens
EVNAGIKLA

SEQ ID NO: 414776 - protein, 9 aa, Homo Sapiens
ILHSVSHLA

SEQ ID NO: 414777 - protein, 9 aa, Homo Sapiens
LPRASLRAT

SEQ ID NO: 414778 - protein, 9 aa, Homo Sapiens
WMSWECCML

SEQ ID NO: 414779 - protein, 9 aa, Homo Sapiens
HHGPELAVR

SEQ ID NO: 414780 - protein, 9 aa, Homo Sapiens
MWEGLAAWP

SEQ ID NO: 414781 - protein, 9 aa, Homo Sapiens
VVCVTLLNC

SEQ ID NO: 414782 - protein, 9 aa, Homo Sapiens
MLWFQGNNM

SEQ ID NO: 414783 - protein, 9 aa, Homo Sapiens
GKKEKLPGE

SEQ ID NO: 414784 - protein, 9 aa, Homo Sapiens
PPRVLSVNV

SEQ ID NO: 414785 - protein, 9 aa, Homo Sapiens
PVGSVMSCS

SEQ ID NO: 414786 - protein, 9 aa, Homo Sapiens
PPQAPSQVW

SEQ ID NO: 414787 - protein, 9 aa, Homo Sapiens
LSGGCCIPK

SEQ ID NO: 414788 - protein, 9 aa, Homo Sapiens
LLGPDGLSK

SEQ ID NO: 414789 - protein, 9 aa, Homo Sapiens
VFWMTSGLI

SEQ ID NO: 414790 - protein, 9 aa, Homo Sapiens
RQRWAAVTL

SEQ ID NO: 414791 - protein, 9 aa, Homo Sapiens
GLTLLRFHV

SEQ ID NO: 414792 - protein, 9 aa, Homo Sapiens
PVQEPMKRA

SEQ ID NO: 414793 - protein, 9 aa, Homo Sapiens
CYFFLPLAP

SEQ ID NO: 414794 - protein, 9 aa, Homo Sapiens
RFMTILRCA

SEQ ID NO: 414795 - protein, 9 aa, Homo Sapiens
DPAILRPGH

SEQ ID NO: 414796 - protein, 9 aa, Homo Sapiens
TPGCPRARC

SEQ ID NO: 414797 - protein, 9 aa, Homo Sapiens
QRDTCVGKV

SEQ ID NO: 414798 - protein, 9 aa, Homo Sapiens
RGSSQGCRE

SEQ ID NO: 414799 - protein, 9 aa, Homo Sapiens
HQHIVSTGQ

SEQ ID NO: 414800 - protein, 9 aa, Homo Sapiens
SHTISFWSK

SEQ ID NO: 414801 - protein, 9 aa, Homo Sapiens
GPDGVMVRV

SEQ ID NO: 414802 - protein, 9 aa, Homo Sapiens
VWVEVVHDG

SEQ ID NO: 414803 - protein, 9 aa, Homo Sapiens
ARVHALVLH

SEQ ID NO: 414804 - protein, 9 aa, Homo Sapiens
PQQEAALRP

SEQ ID NO: 414805 - protein, 9 aa, Homo Sapiens
GMPPMEPAG

SEQ ID NO: 414806 - protein, 9 aa, Homo Sapiens
TRQELSHTL

SEQ ID NO: 414807 - protein, 9 aa, Homo Sapiens
QLEGTHARS

SEQ ID NO: 414808 - protein, 9 aa, Homo Sapiens
FMQYTVLVA

SEQ ID NO: 414809 - protein, 9 aa, Homo Sapiens
EHGVLHLHQ

SEQ ID NO: 414810 - protein, 9 aa, Homo Sapiens
KRKDRRAKN

SEQ ID NO: 414811 - protein, 9 aa, Homo Sapiens
SWARMLQEQ

SEQ ID NO: 414812 - protein, 9 aa, Homo Sapiens
VALQAVSDE

SEQ ID NO: 414813 - protein, 9 aa, Homo Sapiens
RYIPCTSRP

SEQ ID NO: 414814 - protein, 9 aa, Homo Sapiens
VSNLEEPVS

SEQ ID NO: 414815 - protein, 9 aa, Homo Sapiens
SPPSPSSLL

SEQ ID NO: 414816 - protein, 9 aa, Homo Sapiens
SWMTLPGSW

SEQ ID NO: 414817 - protein, 9 aa, Homo Sapiens
HEHGYHKME

SEQ ID NO: 414818 - protein, 9 aa, Homo Sapiens
RSAPFSPII

SEQ ID NO: 414819 - protein, 9 aa, Homo Sapiens
RAGLEQRLQ

SEQ ID NO: 414820 - protein, 9 aa, Homo Sapiens
DDEEDEDEG

SEQ ID NO: 414821 - protein, 9 aa, Homo Sapiens
SKEVVGKRK

SEQ ID NO: 414822 - protein, 9 aa, Homo Sapiens
PGPEGEAGV

SEQ ID NO: 414823 - protein, 9 aa, Homo Sapiens
YELIQKIEA

SEQ ID NO: 414824 - protein, 9 aa, Homo Sapiens
MDNLESCVA

SEQ ID NO: 414825 - protein, 9 aa, Homo Sapiens
AIPSPKTLT

SEQ ID NO: 414826 - protein, 9 aa, Homo Sapiens
KTPAHRAQG

SEQ ID NO: 414827 - protein, 9 aa, Homo Sapiens
SWSKTEEAF

SEQ ID NO: 414828 - protein, 9 aa, Homo Sapiens
GTTQSARHP

SEQ ID NO: 414829 - protein, 9 aa, Homo Sapiens
TAQGLLVVQ

SEQ ID NO: 414830 - protein, 9 aa, Homo Sapiens
SPSPRAVMG

SEQ ID NO: 414831 - protein, 9 aa, Homo Sapiens
DLDIKGGDL

SEQ ID NO: 414832 - protein, 9 aa, Homo Sapiens
QRSGPATWR

SEQ ID NO: 414833 - protein, 9 aa, Homo Sapiens
NEIDPPRKC

SEQ ID NO: 414834 - protein, 9 aa, Homo Sapiens
KAARVKMRT

SEQ ID NO: 414835 - protein, 9 aa, Homo Sapiens
LCLRLLWIC

SEQ ID NO: 414836 - protein, 9 aa, Homo Sapiens
SSREHQSFW

SEQ ID NO: 414837 - protein, 9 aa, Homo Sapiens
IFGPDFCHC

SEQ ID NO: 414838 - protein, 9 aa, Homo Sapiens
GNTIDVDHV

SEQ ID NO: 414839 - protein, 9 aa, Homo Sapiens
EVALSDARC

SEQ ID NO: 414840 - protein, 9 aa, Homo Sapiens
PVSSGVLQI

SEQ ID NO: 414841 - protein, 9 aa, Homo Sapiens
SRVVGRCSQ

SEQ ID NO: 414842 - protein, 9 aa, Homo Sapiens
MDSNYQMEM

SEQ ID NO: 414843 - protein, 9 aa, Homo Sapiens
RQDQKPIFN

SEQ ID NO: 414844 - protein, 9 aa, Homo Sapiens
ESTLKSILS

SEQ ID NO: 414845 - protein, 9 aa, Homo Sapiens
HHPLGDTPQ

SEQ ID NO: 414846 - protein, 9 aa, Homo Sapiens
LKRCLEPER

SEQ ID NO: 414847 - protein, 9 aa, Homo Sapiens
NKLFITSGI

SEQ ID NO: 414848 - protein, 9 aa, Homo Sapiens
WVTTRMGNT

SEQ ID NO: 414849 - protein, 9 aa, Homo Sapiens
QGAGGHMER

SEQ ID NO: 414850 - protein, 9 aa, Homo Sapiens
SRMPARRES

SEQ ID NO: 414851 - protein, 9 aa, Homo Sapiens
ESKSISAPV

SEQ ID NO: 414852 - protein, 9 aa, Homo Sapiens
GNPHNQNIS

SEQ ID NO: 414853 - protein, 9 aa, Homo Sapiens
GGGPACVPV

SEQ ID NO: 414854 - protein, 9 aa, Homo Sapiens
KEAVWALSN

SEQ ID NO: 414855 - protein, 9 aa, Homo Sapiens
KISNQIFPR

SEQ ID NO: 414856 - protein, 9 aa, Homo Sapiens
LNRIRRWHR

SEQ ID NO: 414857 - protein, 9 aa, Homo Sapiens
CYRECNQYS

SEQ ID NO: 414858 - protein, 9 aa, Homo Sapiens
RMTARASEK

SEQ ID NO: 414859 - protein, 9 aa, Homo Sapiens
LKNPKVDRL

SEQ ID NO: 414860 - protein, 9 aa, Homo Sapiens
QAAPPHPPS

SEQ ID NO: 414861 - protein, 9 aa, Homo Sapiens
AAGEKEDEK

SEQ ID NO: 414862 - protein, 9 aa, Homo Sapiens
DMDVFIKEE

SEQ ID NO: 414863 - protein, 9 aa, Homo Sapiens
NQQLDLTLC

SEQ ID NO: 414864 - protein, 9 aa, Homo Sapiens
SRNDKHVMS

SEQ ID NO: 414865 - protein, 9 aa, Homo Sapiens
NQACLEQVI

SEQ ID NO: 414866 - protein, 9 aa, Homo Sapiens
LSSLEAPPV

SEQ ID NO: 414867 - protein, 9 aa, Homo Sapiens
VNKVFVDNF

SEQ ID NO: 414868 - protein, 9 aa, Homo Sapiens
DQRGGRMLK

SEQ ID NO: 414869 - protein, 9 aa, Homo Sapiens
IGAHKTLVN

SEQ ID NO: 414870 - protein, 9 aa, Homo Sapiens
VKDVCTTKF

SEQ ID NO: 414871 - protein, 9 aa, Homo Sapiens
SPRTRPRTA

SEQ ID NO: 414872 - protein, 9 aa, Homo Sapiens
TQNAPSPGQ

SEQ ID NO: 414873 - protein, 9 aa, Homo Sapiens
PHDLCSPVY

SEQ ID NO: 414874 - protein, 9 aa, Homo Sapiens
RILEQKFML

SEQ ID NO: 414875 - protein, 9 aa, Homo Sapiens
VPSSPDDSS

SEQ ID NO: 414876 - protein, 9 aa, Homo Sapiens
FMVCWAPIH

SEQ ID NO: 414877 - protein, 9 aa, Homo Sapiens
VMDYTFIRV

SEQ ID NO: 414878 - protein, 9 aa, Homo Sapiens
VAGAWSGAW

SEQ ID NO: 414879 - protein, 9 aa, Homo Sapiens
LRACYHCRV

SEQ ID NO: 414880 - protein, 9 aa, Homo Sapiens
EGLAAWPVD

SEQ ID NO: 414881 - protein, 9 aa, Homo Sapiens
VQELRKLRE

SEQ ID NO: 414882 - protein, 9 aa, Homo Sapiens
PHLPLKLQL

SEQ ID NO: 414883 - protein, 9 aa, Homo Sapiens
ILSALWNLS

SEQ ID NO: 414884 - protein, 9 aa, Homo Sapiens
RERMMLPVR

SEQ ID NO: 414885 - protein, 9 aa, Homo Sapiens
SCCQQPSCQ

SEQ ID NO: 414886 - protein, 9 aa, Homo Sapiens
MAVPEVQLP

SEQ ID NO: 414887 - protein, 9 aa, Homo Sapiens
REQRSVAYN

SEQ ID NO: 414888 - protein, 9 aa, Homo Sapiens
DGRFECRCL

SEQ ID NO: 414889 - protein, 9 aa, Homo Sapiens
GVLGIKISW

SEQ ID NO: 414890 - protein, 9 aa, Homo Sapiens
SRWRPTRRP

SEQ ID NO: 414891 - protein, 9 aa, Homo Sapiens
YMYVKRKTN

SEQ ID NO: 414892 - protein, 9 aa, Homo Sapiens
FQVPHPGLE

SEQ ID NO: 414893 - protein, 9 aa, Homo Sapiens
KKKIQPKLL

SEQ ID NO: 414894 - protein, 9 aa, Homo Sapiens
RESDAGHVA

SEQ ID NO: 414895 - protein, 9 aa, Homo Sapiens
NGVWMLQQP

SEQ ID NO: 414896 - protein, 9 aa, Homo Sapiens
IYYCSQTHS

SEQ ID NO: 414897 - protein, 9 aa, Homo Sapiens
YTGLFLFTF

SEQ ID NO: 414898 - protein, 9 aa, Homo Sapiens
GPAICVPVL

SEQ ID NO: 414899 - protein, 9 aa, Homo Sapiens
MLMPDAMCV

SEQ ID NO: 414900 - protein, 9 aa, Homo Sapiens
FFVLVNLEV

SEQ ID NO: 414901 - protein, 9 aa, Homo Sapiens
LEYLPISLG

SEQ ID NO: 414902 - protein, 9 aa, Homo Sapiens
SPLKLELWV

SEQ ID NO: 414903 - protein, 9 aa, Homo Sapiens
AAVVMVVRP

SEQ ID NO: 414904 - protein, 9 aa, Homo Sapiens
LRNMTDFWL

SEQ ID NO: 414905 - protein, 9 aa, Homo Sapiens
WALYPLYPA

SEQ ID NO: 414906 - protein, 9 aa, Homo Sapiens
FPIKYHDMP

SEQ ID NO: 414907 - protein, 9 aa, Homo Sapiens
YNVLTLTFQ

SEQ ID NO: 414908 - protein, 9 aa, Homo Sapiens
DGVEWALGL

SEQ ID NO: 414909 - protein, 9 aa, Homo Sapiens
CNLAENMSS

SEQ ID NO: 414910 - protein, 9 aa, Homo Sapiens
FSVEKIIPR

SEQ ID NO: 414911 - protein, 9 aa, Homo Sapiens
SRSPSLQEN

SEQ ID NO: 414912 - protein, 9 aa, Homo Sapiens
DNTHISSAG

SEQ ID NO: 414913 - protein, 9 aa, Homo Sapiens
ARATWSESA

SEQ ID NO: 414914 - protein, 9 aa, Homo Sapiens
SSSSNLGVD

SEQ ID NO: 414915 - protein, 9 aa, Homo Sapiens
HYGCAVMDK

SEQ ID NO: 414916 - protein, 9 aa, Homo Sapiens
CLKVSFRVC

SEQ ID NO: 414917 - protein, 9 aa, Homo Sapiens
VRQIYSEHN

SEQ ID NO: 414918 - protein, 9 aa, Homo Sapiens
SLFKTRLLR

SEQ ID NO: 414919 - protein, 9 aa, Homo Sapiens
MCGGPAPET

SEQ ID NO: 414920 - protein, 9 aa, Homo Sapiens
MGFPVSSGV

SEQ ID NO: 414921 - protein, 9 aa, Homo Sapiens
EAIRKKAFK

SEQ ID NO: 414922 - protein, 9 aa, Homo Sapiens
EPATCPAVV

SEQ ID NO: 414923 - protein, 9 aa, Homo Sapiens
LTASGADLM

SEQ ID NO: 414924 - protein, 9 aa, Homo Sapiens
QSCRGSWRY

SEQ ID NO: 414925 - protein, 9 aa, Homo Sapiens
GLVGGGRGT

SEQ ID NO: 414926 - protein, 9 aa, Homo Sapiens
YPYPLPLSQ

SEQ ID NO: 414927 - protein, 9 aa, Homo Sapiens
RKRGSKPKP

SEQ ID NO: 414928 - protein, 9 aa, Homo Sapiens
DRLYHRHCF

SEQ ID NO: 414929 - protein, 9 aa, Homo Sapiens
LQGLQSRMV

SEQ ID NO: 414930 - protein, 9 aa, Homo Sapiens
PSNLQAQRH

SEQ ID NO: 414931 - protein, 9 aa, Homo Sapiens
GDRRRAPQH

SEQ ID NO: 414932 - protein, 9 aa, Homo Sapiens
LQQRHPQGP

SEQ ID NO: 414933 - protein, 9 aa, Homo Sapiens
GVAGPKCPA

SEQ ID NO: 414934 - protein, 9 aa, Homo Sapiens
PRSLQPPSR

SEQ ID NO: 414935 - protein, 9 aa, Homo Sapiens
PAQVTMMTL

SEQ ID NO: 414936 - protein, 9 aa, Homo Sapiens
GLKSLSRKS

SEQ ID NO: 414937 - protein, 9 aa, Homo Sapiens
GRRGCRPMR

SEQ ID NO: 414938 - protein, 9 aa, Homo Sapiens
AWHWPLVAL

SEQ ID NO: 414939 - protein, 9 aa, Homo Sapiens
LKMDLVRRI

SEQ ID NO: 414940 - protein, 9 aa, Homo Sapiens
TYSMVVAPL

SEQ ID NO: 414941 - protein, 9 aa, Homo Sapiens
YHLNLKYNL

SEQ ID NO: 414942 - protein, 9 aa, Homo Sapiens
SACHSDETW

SEQ ID NO: 414943 - protein, 9 aa, Homo Sapiens
QGVQRLLLV

SEQ ID NO: 414944 - protein, 9 aa, Homo Sapiens
KEVLKKFPE

SEQ ID NO: 414945 - protein, 9 aa, Homo Sapiens
CTLKIMSGV

SEQ ID NO: 414946 - protein, 9 aa, Homo Sapiens
HIHHLGDQL

SEQ ID NO: 414947 - protein, 9 aa, Homo Sapiens
PGQKDLQHL

SEQ ID NO: 414948 - protein, 9 aa, Homo Sapiens
RGGYISSEE

SEQ ID NO: 414949 - protein, 9 aa, Homo Sapiens
STSKQMPPV

SEQ ID NO: 414950 - protein, 9 aa, Homo Sapiens
VHKAITAGY

SEQ ID NO: 414951 - protein, 9 aa, Homo Sapiens
YLFEATEKK

SEQ ID NO: 414952 - protein, 9 aa, Homo Sapiens
PTLSTLQQR

SEQ ID NO: 414953 - protein, 9 aa, Homo Sapiens
SPLREDWSV

SEQ ID NO: 414954 - protein, 9 aa, Homo Sapiens
IMCSVTFHI

SEQ ID NO: 414955 - protein, 9 aa, Homo Sapiens
QGSDPARWW

SEQ ID NO: 414956 - protein, 9 aa, Homo Sapiens
DPLQAKKSQ

SEQ ID NO: 414957 - protein, 9 aa, Homo Sapiens
AIDENTTWL

SEQ ID NO: 414958 - protein, 9 aa, Homo Sapiens
FTEEEPGLL

SEQ ID NO: 414959 - protein, 9 aa, Homo Sapiens
NGQEMCALI

SEQ ID NO: 414960 - protein, 9 aa, Homo Sapiens
ALLREEECV

SEQ ID NO: 414961 - protein, 9 aa, Homo Sapiens
LHHHHRLHH

SEQ ID NO: 414962 - protein, 9 aa, Homo Sapiens
PAVMPPTTT

SEQ ID NO: 414963 - protein, 9 aa, Homo Sapiens
RGPQILCRM

SEQ ID NO: 414964 - protein, 9 aa, Homo Sapiens
HEEDSNFHQ

SEQ ID NO: 414965 - protein, 9 aa, Homo Sapiens
DEVPASPAT

SEQ ID NO: 414966 - protein, 9 aa, Homo Sapiens
EARVYRDAC

SEQ ID NO: 414967 - protein, 9 aa, Homo Sapiens
PTSAASLLG

SEQ ID NO: 414968 - protein, 9 aa, Homo Sapiens
PRVLSVNVT

SEQ ID NO: 414969 - protein, 9 aa, Homo Sapiens
IKEKMILKM

SEQ ID NO: 414970 - protein, 9 aa, Homo Sapiens
FLGNCQSPF

SEQ ID NO: 414971 - protein, 9 aa, Homo Sapiens
PGQTCQCRA

SEQ ID NO: 414972 - protein, 9 aa, Homo Sapiens
QPDLIYLHY

SEQ ID NO: 414973 - protein, 9 aa, Homo Sapiens
PAMQALVLG

SEQ ID NO: 414974 - protein, 9 aa, Homo Sapiens
VVQQAPTIT

SEQ ID NO: 414975 - protein, 9 aa, Homo Sapiens
MPPKIHYEA

SEQ ID NO: 414976 - protein, 9 aa, Homo Sapiens
KLQPQPTEA

SEQ ID NO: 414977 - protein, 9 aa, Homo Sapiens
LHFDIRKAG

SEQ ID NO: 414978 - protein, 9 aa, Homo Sapiens
HFHRSTFRN

SEQ ID NO: 414979 - protein, 9 aa, Homo Sapiens
TLLETRRPI

SEQ ID NO: 414980 - protein, 9 aa, Homo Sapiens
AFRPDLIIF

SEQ ID NO: 414981 - protein, 9 aa, Homo Sapiens
RVDHRDARQ

SEQ ID NO: 414982 - protein, 9 aa, Homo Sapiens
PFPASTPST

SEQ ID NO: 414983 - protein, 9 aa, Homo Sapiens
RQWGSFPQH

SEQ ID NO: 414984 - protein, 9 aa, Homo Sapiens
AAQPLGAAL

SEQ ID NO: 414985 - protein, 9 aa, Homo Sapiens
MASKMVDLL

SEQ ID NO: 414986 - protein, 9 aa, Homo Sapiens
FCDANNLIF

SEQ ID NO: 414987 - protein, 9 aa, Homo Sapiens
KRPRLQWPA

SEQ ID NO: 414988 - protein, 9 aa, Homo Sapiens
AGHVAAVAP

SEQ ID NO: 414989 - protein, 9 aa, Homo Sapiens
LILSNMSEE

SEQ ID NO: 414990 - protein, 9 aa, Homo Sapiens
ISAVDIKPK

SEQ ID NO: 414991 - protein, 9 aa, Homo Sapiens
PRKLVGRAV

SEQ ID NO: 414992 - protein, 9 aa, Homo Sapiens
RSIRFVAGH

SEQ ID NO: 414993 - protein, 9 aa, Homo Sapiens
LISTSTKMV

SEQ ID NO: 414994 - protein, 9 aa, Homo Sapiens
LLLQGPDLS

SEQ ID NO: 414995 - protein, 9 aa, Homo Sapiens
RTTELSTKS

SEQ ID NO: 414996 - protein, 9 aa, Homo Sapiens
SVTTSPAPR

SEQ ID NO: 414997 - protein, 9 aa, Homo Sapiens
FLRKFPLKK

SEQ ID NO: 414998 - protein, 9 aa, Homo Sapiens
YWLQFRESP

SEQ ID NO: 414999 - protein, 9 aa, Homo Sapiens
SRRNIALQN

SEQ ID NO: 415000 - protein, 9 aa, Homo Sapiens
GVTAVETSR

SEQ ID NO: 415001 - protein, 9 aa, Homo Sapiens
AGFQMTPTK

SEQ ID NO: 415002 - protein, 9 aa, Homo Sapiens
LQELWLYDN

SEQ ID NO: 415003 - protein, 9 aa, Homo Sapiens
YVFVSIPLL

SEQ ID NO: 415004 - protein, 9 aa, Homo Sapiens
ETPVDFYFI

SEQ ID NO: 415005 - protein, 9 aa, Homo Sapiens
LRVHSQQPC

SEQ ID NO: 415006 - protein, 9 aa, Homo Sapiens
LLEKRASFY

SEQ ID NO: 415007 - protein, 9 aa, Homo Sapiens
TADYPNIQH

SEQ ID NO: 415008 - protein, 9 aa, Homo Sapiens
TMPCMSSGS

SEQ ID NO: 415009 - protein, 9 aa, Homo Sapiens
THYIGDLRA

SEQ ID NO: 415010 - protein, 9 aa, Homo Sapiens
VSAHQQPAT

SEQ ID NO: 415011 - protein, 9 aa, Homo Sapiens
LYLSIVRTA

SEQ ID NO: 415012 - protein, 9 aa, Homo Sapiens
IPLSGGCCI

SEQ ID NO: 415013 - protein, 9 aa, Homo Sapiens
VPARDGTSY

SEQ ID NO: 415014 - protein, 9 aa, Homo Sapiens
KAFLPRVRG

SEQ ID NO: 415015 - protein, 9 aa, Homo Sapiens
VLSSLEAPP

SEQ ID NO: 415016 - protein, 9 aa, Homo Sapiens
REESSFVAP

SEQ ID NO: 415017 - protein, 9 aa, Homo Sapiens
WSLTSSLPG

SEQ ID NO: 415018 - protein, 9 aa, Homo Sapiens
QDPNPQVPQ

SEQ ID NO: 415019 - protein, 9 aa, Homo Sapiens
VSSAMFSEN

SEQ ID NO: 415020 - protein, 9 aa, Homo Sapiens
LTNFLKKLK

SEQ ID NO: 415021 - protein, 9 aa, Homo Sapiens
QLHGNLGET

SEQ ID NO: 415022 - protein, 9 aa, Homo Sapiens
TVYSLGRSS

SEQ ID NO: 415023 - protein, 9 aa, Homo Sapiens
LTCAHGHVE

SEQ ID NO: 415024 - protein, 9 aa, Homo Sapiens
FGSFTVHSP

SEQ ID NO: 415025 - protein, 9 aa, Homo Sapiens
ANSTLQAED

SEQ ID NO: 415026 - protein, 9 aa, Homo Sapiens
IEHQCRAVR

SEQ ID NO: 415027 - protein, 9 aa, Homo Sapiens
YLFCLSWIL

SEQ ID NO: 415028 - protein, 9 aa, Homo Sapiens
AVTFVEQGH

SEQ ID NO: 415029 - protein, 9 aa, Homo Sapiens
NLYVPNQKV

SEQ ID NO: 415030 - protein, 9 aa, Homo Sapiens
VTPRLTGSI

SEQ ID NO: 415031 - protein, 9 aa, Homo Sapiens
GAGEGPLAR

SEQ ID NO: 415032 - protein, 9 aa, Homo Sapiens
TRTEDFFKL

SEQ ID NO: 415033 - protein, 9 aa, Homo Sapiens
GVSAEHAQQ

SEQ ID NO: 415034 - protein, 9 aa, Homo Sapiens
IQFHFLSSQ

SEQ ID NO: 415035 - protein, 9 aa, Homo Sapiens
RRRRKMTTL

SEQ ID NO: 415036 - protein, 9 aa, Homo Sapiens
RHQLREPQL

SEQ ID NO: 415037 - protein, 9 aa, Homo Sapiens
DSPAWAWHW

SEQ ID NO: 415038 - protein, 9 aa, Homo Sapiens
EIREIPFLL

SEQ ID NO: 415039 - protein, 9 aa, Homo Sapiens
DAHGRIEEI

SEQ ID NO: 415040 - protein, 9 aa, Homo Sapiens
TAAPRSRAG

SEQ ID NO: 415041 - protein, 9 aa, Homo Sapiens
QAISSMVDF

SEQ ID NO: 415042 - protein, 9 aa, Homo Sapiens
VPQAAPPHP

SEQ ID NO: 415043 - protein, 9 aa, Homo Sapiens
WAPHSAGLS

SEQ ID NO: 415044 - protein, 9 aa, Homo Sapiens
EDPNAKVIL

SEQ ID NO: 415045 - protein, 9 aa, Homo Sapiens
ELPSVPSLY

SEQ ID NO: 415046 - protein, 9 aa, Homo Sapiens
ALESQLRGE

SEQ ID NO: 415047 - protein, 9 aa, Homo Sapiens
DPVRICLLS

SEQ ID NO: 415048 - protein, 9 aa, Homo Sapiens
WLGTRRQGL

SEQ ID NO: 415049 - protein, 9 aa, Homo Sapiens
LHNLNLDTW

SEQ ID NO: 415050 - protein, 9 aa, Homo Sapiens
GTEPHHFMA

SEQ ID NO: 415051 - protein, 9 aa, Homo Sapiens
GFPVSSGVL

SEQ ID NO: 415052 - protein, 9 aa, Homo Sapiens
SACTRPQST

SEQ ID NO: 415053 - protein, 9 aa, Homo Sapiens
ASVDAKKDP

SEQ ID NO: 415054 - protein, 9 aa, Homo Sapiens
LEKNSYSAY

SEQ ID NO: 415055 - protein, 9 aa, Homo Sapiens
GSWPGQFDR

SEQ ID NO: 415056 - protein, 9 aa, Homo Sapiens
AEAAAVVMV

SEQ ID NO: 415057 - protein, 9 aa, Homo Sapiens
RPHLRGQGL

SEQ ID NO: 415058 - protein, 9 aa, Homo Sapiens
LHTRRVDTV

SEQ ID NO: 415059 - protein, 9 aa, Homo Sapiens
PKIVRSNWN

SEQ ID NO: 415060 - protein, 9 aa, Homo Sapiens
MVVSPFMEE

SEQ ID NO: 415061 - protein, 9 aa, Homo Sapiens
LLPLAGSQM

SEQ ID NO: 415062 - protein, 9 aa, Homo Sapiens
RPPRTWVPG

SEQ ID NO: 415063 - protein, 9 aa, Homo Sapiens
FLQGLQDDG

SEQ ID NO: 415064 - protein, 9 aa, Homo Sapiens
AHFNFQGCN

SEQ ID NO: 415065 - protein, 9 aa, Homo Sapiens
KTTDGIGVD

SEQ ID NO: 415066 - protein, 9 aa, Homo Sapiens
RPGPCSTRP

SEQ ID NO: 415067 - protein, 9 aa, Homo Sapiens
VYFFRMVIQ

SEQ ID NO: 415068 - protein, 9 aa, Homo Sapiens
LPSCHPLPQ

SEQ ID NO: 415069 - protein, 9 aa, Homo Sapiens
VSILQQFAS

SEQ ID NO: 415070 - protein, 9 aa, Homo Sapiens
ADLTNKRAV

SEQ ID NO: 415071 - protein, 9 aa, Homo Sapiens
HPWPKSTPD

SEQ ID NO: 415072 - protein, 9 aa, Homo Sapiens
TTTLGHPGT

SEQ ID NO: 415073 - protein, 9 aa, Homo Sapiens
TPIEQEIRL

SEQ ID NO: 415074 - protein, 9 aa, Homo Sapiens
QECFNIICD

SEQ ID NO: 415075 - protein, 9 aa, Homo Sapiens
GLRAPCTRL

SEQ ID NO: 415076 - protein, 9 aa, Homo Sapiens
SDEVGFINR

SEQ ID NO: 415077 - protein, 9 aa, Homo Sapiens
CEVRMLMLL

SEQ ID NO: 415078 - protein, 9 aa, Homo Sapiens
LYGLGGLRS

SEQ ID NO: 415079 - protein, 9 aa, Homo Sapiens
FYLADEIII

SEQ ID NO: 415080 - protein, 9 aa, Homo Sapiens
MLIFLGPDS

SEQ ID NO: 415081 - protein, 9 aa, Homo Sapiens
CNTLLQRNM

SEQ ID NO: 415082 - protein, 9 aa, Homo Sapiens
GLVSRRLQA

SEQ ID NO: 415083 - protein, 9 aa, Homo Sapiens
FFIYSLFFL

SEQ ID NO: 415084 - protein, 9 aa, Homo Sapiens
RGSQSALGT

SEQ ID NO: 415085 - protein, 9 aa, Homo Sapiens
EVVGKRKTK

SEQ ID NO: 415086 - protein, 9 aa, Homo Sapiens
TIHWSCLEH

SEQ ID NO: 415087 - protein, 9 aa, Homo Sapiens
KEQTALYRG

SEQ ID NO: 415088 - protein, 9 aa, Homo Sapiens
ICGDHQDLE

SEQ ID NO: 415089 - protein, 9 aa, Homo Sapiens
AESAAPAAR

SEQ ID NO: 415090 - protein, 9 aa, Homo Sapiens
HPLQASSWS

SEQ ID NO: 415091 - protein, 9 aa, Homo Sapiens
STSPHHPQR

SEQ ID NO: 415092 - protein, 9 aa, Homo Sapiens
KICRGAQNM

SEQ ID NO: 415093 - protein, 9 aa, Homo Sapiens
KIPERIQSG

SEQ ID NO: 415094 - protein, 9 aa, Homo Sapiens
GDNGQWAQK

SEQ ID NO: 415095 - protein, 9 aa, Homo Sapiens
ILPRPPQAL

SEQ ID NO: 415096 - protein, 9 aa, Homo Sapiens
ESQLEALAT

SEQ ID NO: 415097 - protein, 9 aa, Homo Sapiens
APLESVRQI

SEQ ID NO: 415098 - protein, 9 aa, Homo Sapiens
WLALVMGSP

SEQ ID NO: 415099 - protein, 9 aa, Homo Sapiens
PPHPALSSC

SEQ ID NO: 415100 - protein, 9 aa, Homo Sapiens
RLQWPASTT

SEQ ID NO: 415101 - protein, 9 aa, Homo Sapiens
AGATQFTQS

SEQ ID NO: 415102 - protein, 9 aa, Homo Sapiens
GLHQAVPRG

SEQ ID NO: 415103 - protein, 9 aa, Homo Sapiens
SSSHQACPP

SEQ ID NO: 415104 - protein, 9 aa, Homo Sapiens
LVKPRVLHQ

SEQ ID NO: 415105 - protein, 9 aa, Homo Sapiens
MKQIPDGFL

SEQ ID NO: 415106 - protein, 9 aa, Homo Sapiens
YMHNFSDLR

SEQ ID NO: 415107 - protein, 9 aa, Homo Sapiens
TSWCITGFL

SEQ ID NO: 415108 - protein, 9 aa, Homo Sapiens
RQVDRMEHS

SEQ ID NO: 415109 - protein, 9 aa, Homo Sapiens
SSKGKKKGQ

SEQ ID NO: 415110 - protein, 9 aa, Homo Sapiens
VEVCLSIIA

SEQ ID NO: 415111 - protein, 9 aa, Homo Sapiens
CRSCSKTVT

SEQ ID NO: 415112 - protein, 9 aa, Homo Sapiens
GFCHSALHP

SEQ ID NO: 415113 - protein, 9 aa, Homo Sapiens
PQMTTGKCI

SEQ ID NO: 415114 - protein, 9 aa, Homo Sapiens
GQSSAQDIV

SEQ ID NO: 415115 - protein, 9 aa, Homo Sapiens
QYQVLEVGG

SEQ ID NO: 415116 - protein, 9 aa, Homo Sapiens
ALPAWHPLT

SEQ ID NO: 415117 - protein, 9 aa, Homo Sapiens
LRLSIRIPR

SEQ ID NO: 415118 - protein, 9 aa, Homo Sapiens
YDQEELKNH

SEQ ID NO: 415119 - protein, 9 aa, Homo Sapiens
KLYFFRERS

SEQ ID NO: 415120 - protein, 9 aa, Homo Sapiens
EPEVSLPTA

SEQ ID NO: 415121 - protein, 9 aa, Homo Sapiens
WYDIYCFQP

SEQ ID NO: 415122 - protein, 9 aa, Homo Sapiens
AEREQEEEL

SEQ ID NO: 415123 - protein, 9 aa, Homo Sapiens
SYELIQKIE

SEQ ID NO: 415124 - protein, 9 aa, Homo Sapiens
VNMTDVSTA

SEQ ID NO: 415125 - protein, 9 aa, Homo Sapiens
SESVHGRTR

SEQ ID NO: 415126 - protein, 9 aa, Homo Sapiens
GDQLQLNQH

SEQ ID NO: 415127 - protein, 9 aa, Homo Sapiens
IAKLQHRYQ

SEQ ID NO: 415128 - protein, 9 aa, Homo Sapiens
AQCFRLKRG

SEQ ID NO: 415129 - protein, 9 aa, Homo Sapiens
ELRDVLPGV

SEQ ID NO: 415130 - protein, 9 aa, Homo Sapiens
DTGDHKQIY

SEQ ID NO: 415131 - protein, 9 aa, Homo Sapiens
TLNPLSSHY

SEQ ID NO: 415132 - protein, 9 aa, Homo Sapiens
RIIDQTNTT

SEQ ID NO: 415133 - protein, 9 aa, Homo Sapiens
SCNQQLDLT

SEQ ID NO: 415134 - protein, 9 aa, Homo Sapiens
QTWQVVQGL

SEQ ID NO: 415135 - protein, 9 aa, Homo Sapiens
YNPNFQEED

SEQ ID NO: 415136 - protein, 9 aa, Homo Sapiens
APPAWTCSS

SEQ ID NO: 415137 - protein, 9 aa, Homo Sapiens
RSVMMVMAD

SEQ ID NO: 415138 - protein, 9 aa, Homo Sapiens
CGQTFEGNA

SEQ ID NO: 415139 - protein, 9 aa, Homo Sapiens
GRLGKGSYW

SEQ ID NO: 415140 - protein, 9 aa, Homo Sapiens
LENDYLKDE

SEQ ID NO: 415141 - protein, 9 aa, Homo Sapiens
QRKRRRRKM

SEQ ID NO: 415142 - protein, 9 aa, Homo Sapiens
AWTTTLGHP

SEQ ID NO: 415143 - protein, 9 aa, Homo Sapiens
GIFEPGERA

SEQ ID NO: 415144 - protein, 9 aa, Homo Sapiens
QLSKLQPQP

SEQ ID NO: 415145 - protein, 9 aa, Homo Sapiens
VLVQLLEHY

SEQ ID NO: 415146 - protein, 9 aa, Homo Sapiens
AAARLLDQL

SEQ ID NO: 415147 - protein, 9 aa, Homo Sapiens
ECPGPKVCG

SEQ ID NO: 415148 - protein, 9 aa, Homo Sapiens
AVSDEDGVS

SEQ ID NO: 415149 - protein, 9 aa, Homo Sapiens
CDINTEQGQ

SEQ ID NO: 415150 - protein, 9 aa, Homo Sapiens
TNHHKQVQG

SEQ ID NO: 415151 - protein, 9 aa, Homo Sapiens
KQRLNIAVK

SEQ ID NO: 415152 - protein, 9 aa, Homo Sapiens
LELPVVLLH

SEQ ID NO: 415153 - protein, 9 aa, Homo Sapiens
IAGDEHKCS

SEQ ID NO: 415154 - protein, 9 aa, Homo Sapiens
ITTCEKVPV

SEQ ID NO: 415155 - protein, 9 aa, Homo Sapiens
FSVAPQPGG

SEQ ID NO: 415156 - protein, 9 aa, Homo Sapiens
VGGASAAGG

SEQ ID NO: 415157 - protein, 9 aa, Homo Sapiens
PSGRGGRDH

SEQ ID NO: 415158 - protein, 9 aa, Homo Sapiens
HHCPSAHPP

SEQ ID NO: 415159 - protein, 9 aa, Homo Sapiens
GLTISDLWT

SEQ ID NO: 415160 - protein, 9 aa, Homo Sapiens
KLRENLAGP

SEQ ID NO: 415161 - protein, 9 aa, Homo Sapiens
KLGITELAV

SEQ ID NO: 415162 - protein, 9 aa, Homo Sapiens
QRYLADDRL

SEQ ID NO: 415163 - protein, 9 aa, Homo Sapiens
GLAAWPVDR

SEQ ID NO: 415164 - protein, 9 aa, Homo Sapiens
RLQRGLPGN

SEQ ID NO: 415165 - protein, 9 aa, Homo Sapiens
LSVTKGKKA

SEQ ID NO: 415166 - protein, 9 aa, Homo Sapiens
DAHPSPPLG

SEQ ID NO: 415167 - protein, 9 aa, Homo Sapiens
IAACPALQN

SEQ ID NO: 415168 - protein, 9 aa, Homo Sapiens
PILGPVKMS

SEQ ID NO: 415169 - protein, 9 aa, Homo Sapiens
CPACALQLL

SEQ ID NO: 415170 - protein, 9 aa, Homo Sapiens
KCTEPLGRG

SEQ ID NO: 415171 - protein, 9 aa, Homo Sapiens
LSGNKADLT

SEQ ID NO: 415172 - protein, 9 aa, Homo Sapiens
APTPPTWTR

SEQ ID NO: 415173 - protein, 9 aa, Homo Sapiens
PLHLMYPYK

SEQ ID NO: 415174 - protein, 9 aa, Homo Sapiens
FSKAMYLPP

SEQ ID NO: 415175 - protein, 9 aa, Homo Sapiens
PCRPPPVPA

SEQ ID NO: 415176 - protein, 9 aa, Homo Sapiens
GMDSNYQME

SEQ ID NO: 415177 - protein, 9 aa, Homo Sapiens
ENRAYLMAD

SEQ ID NO: 415178 - protein, 9 aa, Homo Sapiens
SYRFSPLPV

SEQ ID NO: 415179 - protein, 9 aa, Homo Sapiens
GSSSERCRP

SEQ ID NO: 415180 - protein, 9 aa, Homo Sapiens
DPNAKVILE

SEQ ID NO: 415181 - protein, 9 aa, Homo Sapiens
ERGLLSLTF

SEQ ID NO: 415182 - protein, 9 aa, Homo Sapiens
LRSASSTFS

SEQ ID NO: 415183 - protein, 9 aa, Homo Sapiens
VILYYRIYS

SEQ ID NO: 415184 - protein, 9 aa, Homo Sapiens
RKMTTLERR

SEQ ID NO: 415185 - protein, 9 aa, Homo Sapiens
WVSWSATAQ

SEQ ID NO: 415186 - protein, 9 aa, Homo Sapiens
LTHVHLNVF

SEQ ID NO: 415187 - protein, 9 aa, Homo Sapiens
PTGRTPTTR

SEQ ID NO: 415188 - protein, 9 aa, Homo Sapiens
SKTNMHAQN

SEQ ID NO: 415189 - protein, 9 aa, Homo Sapiens
EEAGAGLEA

SEQ ID NO: 415190 - protein, 9 aa, Homo Sapiens
PSTSRETCS

SEQ ID NO: 415191 - protein, 9 aa, Homo Sapiens
GVSQQLSSL

SEQ ID NO: 415192 - protein, 9 aa, Homo Sapiens
SLFYLWLII

SEQ ID NO: 415193 - protein, 9 aa, Homo Sapiens
FWPCDLIHG

SEQ ID NO: 415194 - protein, 9 aa, Homo Sapiens
LLFLSGCGQ

SEQ ID NO: 415195 - protein, 9 aa, Homo Sapiens
FNVMKTYSL

SEQ ID NO: 415196 - protein, 9 aa, Homo Sapiens
VQKETIHPQ

SEQ ID NO: 415197 - protein, 9 aa, Homo Sapiens
KDAGCAKDR

SEQ ID NO: 415198 - protein, 9 aa, Homo Sapiens
ITLGDLLTG

SEQ ID NO: 415199 - protein, 9 aa, Homo Sapiens
PPGASPPRA

SEQ ID NO: 415200 - protein, 9 aa, Homo Sapiens
GQTWTRGDF

SEQ ID NO: 415201 - protein, 9 aa, Homo Sapiens
GLPIRSHCS

SEQ ID NO: 415202 - protein, 9 aa, Homo Sapiens
WVVPREVYH

SEQ ID NO: 415203 - protein, 9 aa, Homo Sapiens
QCSRPGRPK

SEQ ID NO: 415204 - protein, 9 aa, Homo Sapiens
TSQPKSKPT

SEQ ID NO: 415205 - protein, 9 aa, Homo Sapiens
VVAQGWQMA

SEQ ID NO: 415206 - protein, 9 aa, Homo Sapiens
ERLLRGGYI

SEQ ID NO: 415207 - protein, 9 aa, Homo Sapiens
LRLRSRSVL

SEQ ID NO: 415208 - protein, 9 aa, Homo Sapiens
LLMVPDGWK

SEQ ID NO: 415209 - protein, 9 aa, Homo Sapiens
LRSHTISFW

SEQ ID NO: 415210 - protein, 9 aa, Homo Sapiens
KSRSVMMVM

SEQ ID NO: 415211 - protein, 9 aa, Homo Sapiens
WASLVQKHL

SEQ ID NO: 415212 - protein, 9 aa, Homo Sapiens
VGVRSLWVI

SEQ ID NO: 415213 - protein, 9 aa, Homo Sapiens
KNGIWEVMP

SEQ ID NO: 415214 - protein, 9 aa, Homo Sapiens
FLLQAEIRE

SEQ ID NO: 415215 - protein, 9 aa, Homo Sapiens
SLCQGGNST

SEQ ID NO: 415216 - protein, 9 aa, Homo Sapiens
SNTTPEPTP

SEQ ID NO: 415217 - protein, 9 aa, Homo Sapiens
SPYYHHPLN

SEQ ID NO: 415218 - protein, 9 aa, Homo Sapiens
RLLEQERWQ

SEQ ID NO: 415219 - protein, 9 aa, Homo Sapiens
AAHQDQVDI

SEQ ID NO: 415220 - protein, 9 aa, Homo Sapiens
GRRLGGEQR

SEQ ID NO: 415221 - protein, 9 aa, Homo Sapiens
LKIDFMDLA

SEQ ID NO: 415222 - protein, 9 aa, Homo Sapiens
GPCVRTWPH

SEQ ID NO: 415223 - protein, 9 aa, Homo Sapiens
GRCCCSGND

SEQ ID NO: 415224 - protein, 9 aa, Homo Sapiens
EQPGGFAWG

SEQ ID NO: 415225 - protein, 9 aa, Homo Sapiens
RGLQQWVQD

SEQ ID NO: 415226 - protein, 9 aa, Homo Sapiens
QLLDTAGQE

SEQ ID NO: 415227 - protein, 9 aa, Homo Sapiens
WLSFNADKT

SEQ ID NO: 415228 - protein, 9 aa, Homo Sapiens
GHEAVVHLL

SEQ ID NO: 415229 - protein, 9 aa, Homo Sapiens
TAAAPQRSQ

SEQ ID NO: 415230 - protein, 9 aa, Homo Sapiens
NQIFPREVH

SEQ ID NO: 415231 - protein, 9 aa, Homo Sapiens
RGSRRRGSM

SEQ ID NO: 415232 - protein, 9 aa, Homo Sapiens
ANSGQVHKD

SEQ ID NO: 415233 - protein, 9 aa, Homo Sapiens
NSHASLRNI

SEQ ID NO: 415234 - protein, 9 aa, Homo Sapiens
IVKTVIELM

SEQ ID NO: 415235 - protein, 9 aa, Homo Sapiens
KATYERMFH

SEQ ID NO: 415236 - protein, 9 aa, Homo Sapiens
PLVCYLKSN

SEQ ID NO: 415237 - protein, 9 aa, Homo Sapiens
TCNIYYLCA

SEQ ID NO: 415238 - protein, 9 aa, Homo Sapiens
DCEETLPAC

SEQ ID NO: 415239 - protein, 9 aa, Homo Sapiens
VDGLDELLR

SEQ ID NO: 415240 - protein, 9 aa, Homo Sapiens
TKFGSKHFF

SEQ ID NO: 415241 - protein, 9 aa, Homo Sapiens
QVQGMPVTI

SEQ ID NO: 415242 - protein, 9 aa, Homo Sapiens
VQSVLLLGV

SEQ ID NO: 415243 - protein, 9 aa, Homo Sapiens
ATQDFFTPN

SEQ ID NO: 415244 - protein, 9 aa, Homo Sapiens
SSRFLNLER

SEQ ID NO: 415245 - protein, 9 aa, Homo Sapiens
IFIAISLLQ

SEQ ID NO: 415246 - protein, 9 aa, Homo Sapiens
WFWFWHYGN

SEQ ID NO: 415247 - protein, 9 aa, Homo Sapiens
NMDFWRLWA

SEQ ID NO: 415248 - protein, 9 aa, Homo Sapiens
HLCSICGLP

SEQ ID NO: 415249 - protein, 9 aa, Homo Sapiens
IKNNISNFL

SEQ ID NO: 415250 - protein, 9 aa, Homo Sapiens
LDLEDIVHN

SEQ ID NO: 415251 - protein, 9 aa, Homo Sapiens
QPARVNVDP

SEQ ID NO: 415252 - protein, 9 aa, Homo Sapiens
LEHLKLEPH

SEQ ID NO: 415253 - protein, 9 aa, Homo Sapiens
YGEKNWYLF

SEQ ID NO: 415254 - protein, 9 aa, Homo Sapiens
DQSALCVAC

SEQ ID NO: 415255 - protein, 9 aa, Homo Sapiens
PPLWSRWRP

SEQ ID NO: 415256 - protein, 9 aa, Homo Sapiens
FKKTENLEY

SEQ ID NO: 415257 - protein, 9 aa, Homo Sapiens
QKQRKHGEN

SEQ ID NO: 415258 - protein, 9 aa, Homo Sapiens
AEGAAGTRC

SEQ ID NO: 415259 - protein, 9 aa, Homo Sapiens
WHPGRRRAR

SEQ ID NO: 415260 - protein, 9 aa, Homo Sapiens
QMLHSCRIQ

SEQ ID NO: 415261 - protein, 9 aa, Homo Sapiens
LFMYLFIGT

SEQ ID NO: 415262 - protein, 9 aa, Homo Sapiens
HGGSRPMPM

SEQ ID NO: 415263 - protein, 9 aa, Homo Sapiens
DPDTGENGL

SEQ ID NO: 415264 - protein, 9 aa, Homo Sapiens
INTSCHPAT

SEQ ID NO: 415265 - protein, 9 aa, Homo Sapiens
NTSVFGFSF

SEQ ID NO: 415266 - protein, 9 aa, Homo Sapiens
NMPQVVYCI

SEQ ID NO: 415267 - protein, 9 aa, Homo Sapiens
PPTGLAAAA

SEQ ID NO: 415268 - protein, 9 aa, Homo Sapiens
PLAGSQMQG

SEQ ID NO: 415269 - protein, 9 aa, Homo Sapiens
ATVATQQDA

SEQ ID NO: 415270 - protein, 9 aa, Homo Sapiens
GKISQQDVK

SEQ ID NO: 415271 - protein, 9 aa, Homo Sapiens
PAAVQQGVQ

SEQ ID NO: 415272 - protein, 9 aa, Homo Sapiens
CGWAPFSVG

SEQ ID NO: 415273 - protein, 9 aa, Homo Sapiens
TFNSMRKSM

SEQ ID NO: 415274 - protein, 9 aa, Homo Sapiens
ITKIKLPKK

SEQ ID NO: 415275 - protein, 9 aa, Homo Sapiens
SVGLHMGFS

SEQ ID NO: 415276 - protein, 9 aa, Homo Sapiens
DVPSNCQEL

SEQ ID NO: 415277 - protein, 9 aa, Homo Sapiens
PGLMREWPV

SEQ ID NO: 415278 - protein, 9 aa, Homo Sapiens
LQASSWSRL

SEQ ID NO: 415279 - protein, 9 aa, Homo Sapiens
ITGFLDMLN

SEQ ID NO: 415280 - protein, 9 aa, Homo Sapiens
ARLPGAWSG

SEQ ID NO: 415281 - protein, 9 aa, Homo Sapiens
GIQEAEVSV

SEQ ID NO: 415282 - protein, 9 aa, Homo Sapiens
EVTSEEPAG

SEQ ID NO: 415283 - protein, 9 aa, Homo Sapiens
EHHLSHYLK

SEQ ID NO: 415284 - protein, 9 aa, Homo Sapiens
EAPPVGGRV

SEQ ID NO: 415285 - protein, 9 aa, Homo Sapiens
WRTSRGQAQ

SEQ ID NO: 415286 - protein, 9 aa, Homo Sapiens
YSAYISDKS

SEQ ID NO: 415287 - protein, 9 aa, Homo Sapiens
QKVLREKVP

SEQ ID NO: 415288 - protein, 9 aa, Homo Sapiens
GLLGHLRGG

SEQ ID NO: 415289 - protein, 9 aa, Homo Sapiens
KVRGLDLSR

SEQ ID NO: 415290 - protein, 9 aa, Homo Sapiens
TPSTSRETC

SEQ ID NO: 415291 - protein, 9 aa, Homo Sapiens
ASKVKDTLK

SEQ ID NO: 415292 - protein, 9 aa, Homo Sapiens
MARGRRGLV

SEQ ID NO: 415293 - protein, 9 aa, Homo Sapiens
AYLNLRPPA

SEQ ID NO: 415294 - protein, 9 aa, Homo Sapiens
QEQHLRVRS

SEQ ID NO: 415295 - protein, 9 aa, Homo Sapiens
HITSVNEYM

SEQ ID NO: 415296 - protein, 9 aa, Homo Sapiens
RIDGRVWGN

SEQ ID NO: 415297 - protein, 9 aa, Homo Sapiens
LGRYFVAFD

SEQ ID NO: 415298 - protein, 9 aa, Homo Sapiens
SKTEEGPPG

SEQ ID NO: 415299 - protein, 9 aa, Homo Sapiens
LHELSPPRY

SEQ ID NO: 415300 - protein, 9 aa, Homo Sapiens
KGELQSLQC

SEQ ID NO: 415301 - protein, 9 aa, Homo Sapiens
EGNISSSSG

SEQ ID NO: 415302 - protein, 9 aa, Homo Sapiens
KKLRMKKMI

SEQ ID NO: 415303 - protein, 9 aa, Homo Sapiens
SLTFHPNYK

SEQ ID NO: 415304 - protein, 9 aa, Homo Sapiens
VKRQCCRCM

SEQ ID NO: 415305 - protein, 9 aa, Homo Sapiens
LWNLVVSLM

SEQ ID NO: 415306 - protein, 9 aa, Homo Sapiens
LQTAPPAWT

SEQ ID NO: 415307 - protein, 9 aa, Homo Sapiens
SQGGLGGHG

SEQ ID NO: 415308 - protein, 9 aa, Homo Sapiens
AARDNKVRE

SEQ ID NO: 415309 - protein, 9 aa, Homo Sapiens
RQIYSEHNY

SEQ ID NO: 415310 - protein, 9 aa, Homo Sapiens
CYCLNGQEM

SEQ ID NO: 415311 - protein, 9 aa, Homo Sapiens
EYRMLQTQF

SEQ ID NO: 415312 - protein, 9 aa, Homo Sapiens
EENVFSSPG

SEQ ID NO: 415313 - protein, 9 aa, Homo Sapiens
CHAGFQMTP

SEQ ID NO: 415314 - protein, 9 aa, Homo Sapiens
NERYCCSIW

SEQ ID NO: 415315 - protein, 9 aa, Homo Sapiens
WSGAWTKTM

SEQ ID NO: 415316 - protein, 9 aa, Homo Sapiens
LKDAQSPSP

SEQ ID NO: 415317 - protein, 9 aa, Homo Sapiens
ARQVRLEDY

SEQ ID NO: 415318 - protein, 9 aa, Homo Sapiens
CHLAMDIDQ

SEQ ID NO: 415319 - protein, 9 aa, Homo Sapiens
APPALVAPR

SEQ ID NO: 415320 - protein, 9 aa, Homo Sapiens
PPRGQAPED

SEQ ID NO: 415321 - protein, 9 aa, Homo Sapiens
LANNIVLLP

SEQ ID NO: 415322 - protein, 9 aa, Homo Sapiens
GPPYRTCDL

SEQ ID NO: 415323 - protein, 9 aa, Homo Sapiens
PYAGGVGAQ

SEQ ID NO: 415324 - protein, 9 aa, Homo Sapiens
LSCANLAKS

SEQ ID NO: 415325 - protein, 9 aa, Homo Sapiens
IGRSQGAII

SEQ ID NO: 415326 - protein, 9 aa, Homo Sapiens
RVRGLGMSL

SEQ ID NO: 415327 - protein, 9 aa, Homo Sapiens
KSGFRLRLR

SEQ ID NO: 415328 - protein, 9 aa, Homo Sapiens
TRMGRKRRK

SEQ ID NO: 415329 - protein, 9 aa, Homo Sapiens
KGFCHSALH

SEQ ID NO: 415330 - protein, 9 aa, Homo Sapiens
LHREKQKLV

SEQ ID NO: 415331 - protein, 9 aa, Homo Sapiens
NMLASVASL

SEQ ID NO: 415332 - protein, 9 aa, Homo Sapiens
PWWEFPLGG

SEQ ID NO: 415333 - protein, 9 aa, Homo Sapiens
MQYFLTIPR

SEQ ID NO: 415334 - protein, 9 aa, Homo Sapiens
CPRVLLKKL

SEQ ID NO: 415335 - protein, 9 aa, Homo Sapiens
LPTAACPLP

SEQ ID NO: 415336 - protein, 9 aa, Homo Sapiens
GPLFCRVSA

SEQ ID NO: 415337 - protein, 9 aa, Homo Sapiens
LLSPPKHTF

SEQ ID NO: 415338 - protein, 9 aa, Homo Sapiens
RLLPLVRTL

SEQ ID NO: 415339 - protein, 9 aa, Homo Sapiens
VKQEASFPI

SEQ ID NO: 415340 - protein, 9 aa, Homo Sapiens
LSVTTSPAP

SEQ ID NO: 415341 - protein, 9 aa, Homo Sapiens
AEDEDEKNL

SEQ ID NO: 415342 - protein, 9 aa, Homo Sapiens
VRVCRAAGP

SEQ ID NO: 415343 - protein, 9 aa, Homo Sapiens
QTVKSASLQ

SEQ ID NO: 415344 - protein, 9 aa, Homo Sapiens
LTNDKPATT

SEQ ID NO: 415345 - protein, 9 aa, Homo Sapiens
SSPYYHHPL

SEQ ID NO: 415346 - protein, 9 aa, Homo Sapiens
KDAQSPSPA

SEQ ID NO: 415347 - protein, 9 aa, Homo Sapiens
SQPRRTSAS

SEQ ID NO: 415348 - protein, 9 aa, Homo Sapiens
LCTQLHRNF

SEQ ID NO: 415349 - protein, 9 aa, Homo Sapiens
SVGPRPSPL

SEQ ID NO: 415350 - protein, 9 aa, Homo Sapiens
QECSPVVVP

SEQ ID NO: 415351 - protein, 9 aa, Homo Sapiens
TETQNQFLD

SEQ ID NO: 415352 - protein, 9 aa, Homo Sapiens
PQLQPLTGS

SEQ ID NO: 415353 - protein, 9 aa, Homo Sapiens
KCFIYRQDL

SEQ ID NO: 415354 - protein, 9 aa, Homo Sapiens
STASSLSVR

SEQ ID NO: 415355 - protein, 9 aa, Homo Sapiens
HMGFSTPAT

SEQ ID NO: 415356 - protein, 9 aa, Homo Sapiens
ALMHLLHSH

SEQ ID NO: 415357 - protein, 9 aa, Homo Sapiens
DQNGMVGPH

SEQ ID NO: 415358 - protein, 9 aa, Homo Sapiens
NYLRRGQLI

SEQ ID NO: 415359 - protein, 9 aa, Homo Sapiens
FMTILRCAR

SEQ ID NO: 415360 - protein, 9 aa, Homo Sapiens
RVRQPPPGP

SEQ ID NO: 415361 - protein, 9 aa, Homo Sapiens
RILPSGCHV

SEQ ID NO: 415362 - protein, 9 aa, Homo Sapiens
EDGDPDAEV

SEQ ID NO: 415363 - protein, 9 aa, Homo Sapiens
VSTVHIMKN

SEQ ID NO: 415364 - protein, 9 aa, Homo Sapiens
RRFQRDNEV

SEQ ID NO: 415365 - protein, 9 aa, Homo Sapiens
YLPISLGSM

SEQ ID NO: 415366 - protein, 9 aa, Homo Sapiens
ELDAKTMTA

SEQ ID NO: 415367 - protein, 9 aa, Homo Sapiens
LLLVLPGEA

SEQ ID NO: 415368 - protein, 9 aa, Homo Sapiens
PCSVWGGED

SEQ ID NO: 415369 - protein, 9 aa, Homo Sapiens
EELETRDQA

SEQ ID NO: 415370 - protein, 9 aa, Homo Sapiens
EKRRIRREG

SEQ ID NO: 415371 - protein, 9 aa, Homo Sapiens
AAFRPDLII

SEQ ID NO: 415372 - protein, 9 aa, Homo Sapiens
MEIDKNAVK

SEQ ID NO: 415373 - protein, 9 aa, Homo Sapiens
PRAIFQRPH

SEQ ID NO: 415374 - protein, 9 aa, Homo Sapiens
RRAAVTIET

SEQ ID NO: 415375 - protein, 9 aa, Homo Sapiens
LWEGPVQEL

SEQ ID NO: 415376 - protein, 9 aa, Homo Sapiens
WAPPAASVG

SEQ ID NO: 415377 - protein, 9 aa, Homo Sapiens
VEWENVELR

SEQ ID NO: 415378 - protein, 9 aa, Homo Sapiens
NSRQSSLAT

SEQ ID NO: 415379 - protein, 9 aa, Homo Sapiens
FWPFGPILC

SEQ ID NO: 415380 - protein, 9 aa, Homo Sapiens
VGQIVRRYI

SEQ ID NO: 415381 - protein, 9 aa, Homo Sapiens
LTQPSPASA

SEQ ID NO: 415382 - protein, 9 aa, Homo Sapiens
SLLGNPIPS

SEQ ID NO: 415383 - protein, 9 aa, Homo Sapiens
QPCQSGVQF

SEQ ID NO: 415384 - protein, 9 aa, Homo Sapiens
YIDKIIGRC

SEQ ID NO: 415385 - protein, 9 aa, Homo Sapiens
LVEGQAALG

SEQ ID NO: 415386 - protein, 9 aa, Homo Sapiens
HAAGGPAYG

SEQ ID NO: 415387 - protein, 9 aa, Homo Sapiens
TKVRTKIRK

SEQ ID NO: 415388 - protein, 9 aa, Homo Sapiens
EGLNRIRRW

SEQ ID NO: 415389 - protein, 9 aa, Homo Sapiens
LFVEANPAA

SEQ ID NO: 415390 - protein, 9 aa, Homo Sapiens
SKVKDTLKL

SEQ ID NO: 415391 - protein, 9 aa, Homo Sapiens
RAPAQPPGP

SEQ ID NO: 415392 - protein, 9 aa, Homo Sapiens
APPAASVGT

SEQ ID NO: 415393 - protein, 9 aa, Homo Sapiens
VKTNPQCHQ

SEQ ID NO: 415394 - protein, 9 aa, Homo Sapiens
RVQDIFEKY

SEQ ID NO: 415395 - protein, 9 aa, Homo Sapiens
TRLLHDYQE

SEQ ID NO: 415396 - protein, 9 aa, Homo Sapiens
LPASSPTKC

SEQ ID NO: 415397 - protein, 9 aa, Homo Sapiens
MVFCILLIM

SEQ ID NO: 415398 - protein, 9 aa, Homo Sapiens
HQCRAVRYY

SEQ ID NO: 415399 - protein, 9 aa, Homo Sapiens
PDPSPDLHT

SEQ ID NO: 415400 - protein, 9 aa, Homo Sapiens
QVDGSSDTS

SEQ ID NO: 415401 - protein, 9 aa, Homo Sapiens
HYPPGGLPA

SEQ ID NO: 415402 - protein, 9 aa, Homo Sapiens
HTLTLALIW

SEQ ID NO: 415403 - protein, 9 aa, Homo Sapiens
SCCWATTCC

SEQ ID NO: 415404 - protein, 9 aa, Homo Sapiens
YSATIALLE

SEQ ID NO: 415405 - protein, 9 aa, Homo Sapiens
QNPAPVAFL

SEQ ID NO: 415406 - protein, 9 aa, Homo Sapiens
LAPRNKMPT

SEQ ID NO: 415407 - protein, 9 aa, Homo Sapiens
QAPSAGPLY

SEQ ID NO: 415408 - protein, 9 aa, Homo Sapiens
TATCPPPRR

SEQ ID NO: 415409 - protein, 9 aa, Homo Sapiens
VAMLPKLLC

SEQ ID NO: 415410 - protein, 9 aa, Homo Sapiens
ARHQLREPQ

SEQ ID NO: 415411 - protein, 9 aa, Homo Sapiens
YYCSQTHSQ

SEQ ID NO: 415412 - protein, 9 aa, Homo Sapiens
GGGRRGAPG

SEQ ID NO: 415413 - protein, 9 aa, Homo Sapiens
GGRDHFTAE

SEQ ID NO: 415414 - protein, 9 aa, Homo Sapiens
PRDWAFVPT

SEQ ID NO: 415415 - protein, 9 aa, Homo Sapiens
ITTLLLQIG

SEQ ID NO: 415416 - protein, 9 aa, Homo Sapiens
ILNYLRRGQ

SEQ ID NO: 415417 - protein, 9 aa, Homo Sapiens
GAGRDEPWP

SEQ ID NO: 415418 - protein, 9 aa, Homo Sapiens
YLQVILEVT

SEQ ID NO: 415419 - protein, 9 aa, Homo Sapiens
DEAMEHFRE

SEQ ID NO: 415420 - protein, 9 aa, Homo Sapiens
LMSQCWELN

SEQ ID NO: 415421 - protein, 9 aa, Homo Sapiens
VPPVQQWPG

SEQ ID NO: 415422 - protein, 9 aa, Homo Sapiens
KRFEVLMTQ

SEQ ID NO: 415423 - protein, 9 aa, Homo Sapiens
LVINANWGE

SEQ ID NO: 415424 - protein, 9 aa, Homo Sapiens
LFERGYGKD

SEQ ID NO: 415425 - protein, 9 aa, Homo Sapiens
AHGPHDLCS

SEQ ID NO: 415426 - protein, 9 aa, Homo Sapiens
YPTNATGAF

SEQ ID NO: 415427 - protein, 9 aa, Homo Sapiens
WDPQELLHN

SEQ ID NO: 415428 - protein, 9 aa, Homo Sapiens
KIKGLEGVR

SEQ ID NO: 415429 - protein, 9 aa, Homo Sapiens
MCSVTFHII

SEQ ID NO: 415430 - protein, 9 aa, Homo Sapiens
VSWAATPKS

SEQ ID NO: 415431 - protein, 9 aa, Homo Sapiens
TQLFALNPH

SEQ ID NO: 415432 - protein, 9 aa, Homo Sapiens
TFAATGRFA

SEQ ID NO: 415433 - protein, 9 aa, Homo Sapiens
FQMTPTKQA

SEQ ID NO: 415434 - protein, 9 aa, Homo Sapiens
RTPTTRLMA

SEQ ID NO: 415435 - protein, 9 aa, Homo Sapiens
VNTGTSLMV

SEQ ID NO: 415436 - protein, 9 aa, Homo Sapiens
FGFVANMLV

SEQ ID NO: 415437 - protein, 9 aa, Homo Sapiens
LCVSPKHGC

SEQ ID NO: 415438 - protein, 9 aa, Homo Sapiens
PAKWTCKQK

SEQ ID NO: 415439 - protein, 9 aa, Homo Sapiens
PQRPPLQPV

SEQ ID NO: 415440 - protein, 9 aa, Homo Sapiens
YGKPILATR

SEQ ID NO: 415441 - protein, 9 aa, Homo Sapiens
LCHNRIRQL

SEQ ID NO: 415442 - protein, 9 aa, Homo Sapiens
CAPVGNGCA

SEQ ID NO: 415443 - protein, 9 aa, Homo Sapiens
SSNKPLRGD

SEQ ID NO: 415444 - protein, 9 aa, Homo Sapiens
LFCWWSWLM

SEQ ID NO: 415445 - protein, 9 aa, Homo Sapiens
TEQQPGNQA

SEQ ID NO: 415446 - protein, 9 aa, Homo Sapiens
LPAWTLTSL

SEQ ID NO: 415447 - protein, 9 aa, Homo Sapiens
LPPELLDTP

SEQ ID NO: 415448 - protein, 9 aa, Homo Sapiens
SPYSPLRED

SEQ ID NO: 415449 - protein, 9 aa, Homo Sapiens
RPPSPRPPP

SEQ ID NO: 415450 - protein, 9 aa, Homo Sapiens
LAWKICERV

SEQ ID NO: 415451 - protein, 9 aa, Homo Sapiens
PAVQPPEPA

SEQ ID NO: 415452 - protein, 9 aa, Homo Sapiens
GMVCSLIHL

SEQ ID NO: 415453 - protein, 9 aa, Homo Sapiens
VQQTQAPAV

SEQ ID NO: 415454 - protein, 9 aa, Homo Sapiens
KWNNIKRWP

SEQ ID NO: 415455 - protein, 9 aa, Homo Sapiens
ENFSLSQES

SEQ ID NO: 415456 - protein, 9 aa, Homo Sapiens
HMVTASASS

SEQ ID NO: 415457 - protein, 9 aa, Homo Sapiens
SVLHNPPSW

SEQ ID NO: 415458 - protein, 9 aa, Homo Sapiens
IFKAFAMIT

SEQ ID NO: 415459 - protein, 9 aa, Homo Sapiens
VRPDLSIMP

SEQ ID NO: 415460 - protein, 9 aa, Homo Sapiens
KFPQSIYQM

SEQ ID NO: 415461 - protein, 9 aa, Homo Sapiens
LILKRCLEP

SEQ ID NO: 415462 - protein, 9 aa, Homo Sapiens
TPEPTPTPT

SEQ ID NO: 415463 - protein, 9 aa, Homo Sapiens
VEKIIPRSS

SEQ ID NO: 415464 - protein, 9 aa, Homo Sapiens
ATRSGSGSA

SEQ ID NO: 415465 - protein, 9 aa, Homo Sapiens
AGLSLNEEE

SEQ ID NO: 415466 - protein, 9 aa, Homo Sapiens
PTTAPWVKV

SEQ ID NO: 415467 - protein, 9 aa, Homo Sapiens
MYSSSYCKL

SEQ ID NO: 415468 - protein, 9 aa, Homo Sapiens
ILLKEIVLV

SEQ ID NO: 415469 - protein, 9 aa, Homo Sapiens
HHALVVGAA

SEQ ID NO: 415470 - protein, 9 aa, Homo Sapiens
VINYYTRWM

SEQ ID NO: 415471 - protein, 9 aa, Homo Sapiens
AEERMTGHG

SEQ ID NO: 415472 - protein, 9 aa, Homo Sapiens
TKIKGLEGV

SEQ ID NO: 415473 - protein, 9 aa, Homo Sapiens
WGSGISICP

SEQ ID NO: 415474 - protein, 9 aa, Homo Sapiens
VTFDVEIHM

SEQ ID NO: 415475 - protein, 9 aa, Homo Sapiens
SEGWHWGAA

SEQ ID NO: 415476 - protein, 9 aa, Homo Sapiens
VHTDIQNDE

SEQ ID NO: 415477 - protein, 9 aa, Homo Sapiens
VSGGGGVNM

SEQ ID NO: 415478 - protein, 9 aa, Homo Sapiens
TLHMKIHTG

SEQ ID NO: 415479 - protein, 9 aa, Homo Sapiens
MTQGDFMSA

SEQ ID NO: 415480 - protein, 9 aa, Homo Sapiens
FEPSIRGSV

SEQ ID NO: 415481 - protein, 9 aa, Homo Sapiens
GDKVNYWWL

SEQ ID NO: 415482 - protein, 9 aa, Homo Sapiens
ACPLPGAGD

SEQ ID NO: 415483 - protein, 9 aa, Homo Sapiens
PKIHYEAPL

SEQ ID NO: 415484 - protein, 9 aa, Homo Sapiens
RKMGSYGAL

SEQ ID NO: 415485 - protein, 9 aa, Homo Sapiens
LPSPPSPSR

SEQ ID NO: 415486 - protein, 9 aa, Homo Sapiens
FIPHLELED

SEQ ID NO: 415487 - protein, 9 aa, Homo Sapiens
KKQEGPGPD

SEQ ID NO: 415488 - protein, 9 aa, Homo Sapiens
HNQNISSKL

SEQ ID NO: 415489 - protein, 9 aa, Homo Sapiens
PLIVGQIVR

SEQ ID NO: 415490 - protein, 9 aa, Homo Sapiens
KGRLGKGSY

SEQ ID NO: 415491 - protein, 9 aa, Homo Sapiens
RKVNHFHKI

SEQ ID NO: 415492 - protein, 9 aa, Homo Sapiens
NIEGMEKGN

SEQ ID NO: 415493 - protein, 9 aa, Homo Sapiens
CTDSQSVRH

SEQ ID NO: 415494 - protein, 9 aa, Homo Sapiens
QSAPRNLVP

SEQ ID NO: 415495 - protein, 9 aa, Homo Sapiens
TAMIPFPRA

SEQ ID NO: 415496 - protein, 9 aa, Homo Sapiens
RNLKALTHL

SEQ ID NO: 415497 - protein, 9 aa, Homo Sapiens
NEAKKGRCY

SEQ ID NO: 415498 - protein, 9 aa, Homo Sapiens
SGTYLIREQ

SEQ ID NO: 415499 - protein, 9 aa, Homo Sapiens
QKCIDKAEV

SEQ ID NO: 415500 - protein, 9 aa, Homo Sapiens
YHCSHLAME

SEQ ID NO: 415501 - protein, 9 aa, Homo Sapiens
CKEKLVSFL

SEQ ID NO: 415502 - protein, 9 aa, Homo Sapiens
AQTFILLFL

SEQ ID NO: 415503 - protein, 9 aa, Homo Sapiens
LNKDPRFQP

SEQ ID NO: 415504 - protein, 9 aa, Homo Sapiens
NSPPPSPPS

SEQ ID NO: 415505 - protein, 9 aa, Homo Sapiens
NNKLFITSG

SEQ ID NO: 415506 - protein, 9 aa, Homo Sapiens
TENLHVLGE

SEQ ID NO: 415507 - protein, 9 aa, Homo Sapiens
PLCLILADE

SEQ ID NO: 415508 - protein, 9 aa, Homo Sapiens
ILHRNAILC

SEQ ID NO: 415509 - protein, 9 aa, Homo Sapiens
IDIVTEISD

SEQ ID NO: 415510 - protein, 9 aa, Homo Sapiens
VISLLDEDP

SEQ ID NO: 415511 - protein, 9 aa, Homo Sapiens
NTTWLYHPV

SEQ ID NO: 415512 - protein, 9 aa, Homo Sapiens
LSLQCCCHV

SEQ ID NO: 415513 - protein, 9 aa, Homo Sapiens
PPGTVGPLG

SEQ ID NO: 415514 - protein, 9 aa, Homo Sapiens
RCYSDLTKH

SEQ ID NO: 415515 - protein, 9 aa, Homo Sapiens
CVVLCLPCV

SEQ ID NO: 415516 - protein, 9 aa, Homo Sapiens
VLFNVMKTY

SEQ ID NO: 415517 - protein, 9 aa, Homo Sapiens
DFWLAGLDI

SEQ ID NO: 415518 - protein, 9 aa, Homo Sapiens
MEHFREDEG

SEQ ID NO: 415519 - protein, 9 aa, Homo Sapiens
SHGSNAVGR

SEQ ID NO: 415520 - protein, 9 aa, Homo Sapiens
QNGMVGPHP

SEQ ID NO: 415521 - protein, 9 aa, Homo Sapiens
ERAFSSQGS

SEQ ID NO: 415522 - protein, 9 aa, Homo Sapiens
LLPSATLSS

SEQ ID NO: 415523 - protein, 9 aa, Homo Sapiens
VGPLARVQA

SEQ ID NO: 415524 - protein, 9 aa, Homo Sapiens
QGQGRVCTG

SEQ ID NO: 415525 - protein, 9 aa, Homo Sapiens
QNMDYCPQF

SEQ ID NO: 415526 - protein, 9 aa, Homo Sapiens
TRLEKTTKE

SEQ ID NO: 415527 - protein, 9 aa, Homo Sapiens
AMAMTVRTA

SEQ ID NO: 415528 - protein, 9 aa, Homo Sapiens
ERRDRRPGP

SEQ ID NO: 415529 - protein, 9 aa, Homo Sapiens
PGPVWPCWG

SEQ ID NO: 415530 - protein, 9 aa, Homo Sapiens
FQASHATVC

SEQ ID NO: 415531 - protein, 9 aa, Homo Sapiens
YYKSQGEAP

SEQ ID NO: 415532 - protein, 9 aa, Homo Sapiens
SSLGIRAQG

SEQ ID NO: 415533 - protein, 9 aa, Homo Sapiens
CVRTWPHSR

SEQ ID NO: 415534 - protein, 9 aa, Homo Sapiens
EAFPLPRAS

SEQ ID NO: 415535 - protein, 9 aa, Homo Sapiens
HRHQSTLQE

SEQ ID NO: 415536 - protein, 9 aa, Homo Sapiens
KRLQNRKWK

SEQ ID NO: 415537 - protein, 9 aa, Homo Sapiens
GAWSGPSAT

SEQ ID NO: 415538 - protein, 9 aa, Homo Sapiens
FSLRGDNDD

SEQ ID NO: 415539 - protein, 9 aa, Homo Sapiens
EEARQVEFV

SEQ ID NO: 415540 - protein, 9 aa, Homo Sapiens
EGPVSESEP

SEQ ID NO: 415541 - protein, 9 aa, Homo Sapiens
FCDMGYHVS

SEQ ID NO: 415542 - protein, 9 aa, Homo Sapiens
ALGRGLELA

SEQ ID NO: 415543 - protein, 9 aa, Homo Sapiens
AGSHLPAAR

SEQ ID NO: 415544 - protein, 9 aa, Homo Sapiens
TLYKHTAMV

SEQ ID NO: 415545 - protein, 9 aa, Homo Sapiens
VTIGQVHST

SEQ ID NO: 415546 - protein, 9 aa, Homo Sapiens
GYISSEEFA

SEQ ID NO: 415547 - protein, 9 aa, Homo Sapiens
ALLHLEPHH

SEQ ID NO: 415548 - protein, 9 aa, Homo Sapiens
PLSASAHHL

SEQ ID NO: 415549 - protein, 9 aa, Homo Sapiens
ENQKEQTAL

SEQ ID NO: 415550 - protein, 9 aa, Homo Sapiens
QKEATPGGA

SEQ ID NO: 415551 - protein, 9 aa, Homo Sapiens
DPHSQLYIY

SEQ ID NO: 415552 - protein, 9 aa, Homo Sapiens
LRPSTSSRI

SEQ ID NO: 415553 - protein, 9 aa, Homo Sapiens
GSECPGPKV

SEQ ID NO: 415554 - protein, 9 aa, Homo Sapiens
NLYQCGRDQ

SEQ ID NO: 415555 - protein, 9 aa, Homo Sapiens
WMPGMNMKM

SEQ ID NO: 415556 - protein, 9 aa, Homo Sapiens
MVKEITCDI

SEQ ID NO: 415557 - protein, 9 aa, Homo Sapiens
VSTSSPEKE

SEQ ID NO: 415558 - protein, 9 aa, Homo Sapiens
MPYFAMEIF

SEQ ID NO: 415559 - protein, 9 aa, Homo Sapiens
IVQDGPPRA

SEQ ID NO: 415560 - protein, 9 aa, Homo Sapiens
SLLMHPDVL

SEQ ID NO: 415561 - protein, 9 aa, Homo Sapiens
VLHNPPSWR

SEQ ID NO: 415562 - protein, 9 aa, Homo Sapiens
SAGHYLGAA

SEQ ID NO: 415563 - protein, 9 aa, Homo Sapiens
AMAIASLNR

SEQ ID NO: 415564 - protein, 9 aa, Homo Sapiens
FQQRILVAT

SEQ ID NO: 415565 - protein, 9 aa, Homo Sapiens
SPEDLPLCL

SEQ ID NO: 415566 - protein, 9 aa, Homo Sapiens
WWHPGRRRA

SEQ ID NO: 415567 - protein, 9 aa, Homo Sapiens
SPSCPHPRN

SEQ ID NO: 415568 - protein, 9 aa, Homo Sapiens
EGEQIYQHV

SEQ ID NO: 415569 - protein, 9 aa, Homo Sapiens
RQDCARPSP

SEQ ID NO: 415570 - protein, 9 aa, Homo Sapiens
FERGYGKDA

SEQ ID NO: 415571 - protein, 9 aa, Homo Sapiens
QCCCHVDDW

SEQ ID NO: 415572 - protein, 9 aa, Homo Sapiens
HYPVLMSHK

SEQ ID NO: 415573 - protein, 9 aa, Homo Sapiens
IHSGEMYRF

SEQ ID NO: 415574 - protein, 9 aa, Homo Sapiens
RVCKDYKYV

SEQ ID NO: 415575 - protein, 9 aa, Homo Sapiens
ASHATVCGG

SEQ ID NO: 415576 - protein, 9 aa, Homo Sapiens
ENWVQMVVE

SEQ ID NO: 415577 - protein, 9 aa, Homo Sapiens
LSLNEEEIW

SEQ ID NO: 415578 - protein, 9 aa, Homo Sapiens
GRAPLEGML

SEQ ID NO: 415579 - protein, 9 aa, Homo Sapiens
PSTAAPRSR

SEQ ID NO: 415580 - protein, 9 aa, Homo Sapiens
GCTKEEDIL

SEQ ID NO: 415581 - protein, 9 aa, Homo Sapiens
KRKKDVKRQ

SEQ ID NO: 415582 - protein, 9 aa, Homo Sapiens
NKDPRFQPT

SEQ ID NO: 415583 - protein, 9 aa, Homo Sapiens
AKVILELRE

SEQ ID NO: 415584 - protein, 9 aa, Homo Sapiens
LRDIQTGAF

SEQ ID NO: 415585 - protein, 9 aa, Homo Sapiens
FVAHTAPAY

SEQ ID NO: 415586 - protein, 9 aa, Homo Sapiens
TVHHCIVGC

SEQ ID NO: 415587 - protein, 9 aa, Homo Sapiens
RTRLYAARQ

SEQ ID NO: 415588 - protein, 9 aa, Homo Sapiens
GMSLLVQRT

SEQ ID NO: 415589 - protein, 9 aa, Homo Sapiens
SRVRGLGMS

SEQ ID NO: 415590 - protein, 9 aa, Homo Sapiens
QWAQKCELA

SEQ ID NO: 415591 - protein, 9 aa, Homo Sapiens
KWLHLLDQV

SEQ ID NO: 415592 - protein, 9 aa, Homo Sapiens
QRCRCVCLR

SEQ ID NO: 415593 - protein, 9 aa, Homo Sapiens
MDVFIKEEG

SEQ ID NO: 415594 - protein, 9 aa, Homo Sapiens
TAHFLQASY

SEQ ID NO: 415595 - protein, 9 aa, Homo Sapiens
LRPRRQAMA

SEQ ID NO: 415596 - protein, 9 aa, Homo Sapiens
MKQQDWLEE

SEQ ID NO: 415597 - protein, 9 aa, Homo Sapiens
KRFFKFCIP

SEQ ID NO: 415598 - protein, 9 aa, Homo Sapiens
SLLGPPPRN

SEQ ID NO: 415599 - protein, 9 aa, Homo Sapiens
EEGQKLAPE

SEQ ID NO: 415600 - protein, 9 aa, Homo Sapiens
CRPSRACDI

SEQ ID NO: 415601 - protein, 9 aa, Homo Sapiens
PATQAPCMM

SEQ ID NO: 415602 - protein, 9 aa, Homo Sapiens
YAASCLLPP

SEQ ID NO: 415603 - protein, 9 aa, Homo Sapiens
AQSLSQCNL

SEQ ID NO: 415604 - protein, 9 aa, Homo Sapiens
TFIRVFKLI

SEQ ID NO: 415605 - protein, 9 aa, Homo Sapiens
HSTGHHAWA

SEQ ID NO: 415606 - protein, 9 aa, Homo Sapiens
HPSPPLGAP

SEQ ID NO: 415607 - protein, 9 aa, Homo Sapiens
HGGWGISPR

SEQ ID NO: 415608 - protein, 9 aa, Homo Sapiens
HVASGLRTC

SEQ ID NO: 415609 - protein, 9 aa, Homo Sapiens
QQSCRGSWR

SEQ ID NO: 415610 - protein, 9 aa, Homo Sapiens
PKQEDLRVE

SEQ ID NO: 415611 - protein, 9 aa, Homo Sapiens
VFFTSPFVV

SEQ ID NO: 415612 - protein, 9 aa, Homo Sapiens
CLEPERYCL

SEQ ID NO: 415613 - protein, 9 aa, Homo Sapiens
LADDRLYHR

SEQ ID NO: 415614 - protein, 9 aa, Homo Sapiens
GHLSQDPYD

SEQ ID NO: 415615 - protein, 9 aa, Homo Sapiens
TKNLHIQCE

SEQ ID NO: 415616 - protein, 9 aa, Homo Sapiens
QRDNEVNSQ

SEQ ID NO: 415617 - protein, 9 aa, Homo Sapiens
TEPPPVGAG

SEQ ID NO: 415618 - protein, 9 aa, Homo Sapiens
SQKEVTIFL

SEQ ID NO: 415619 - protein, 9 aa, Homo Sapiens
WLREGRTAL

SEQ ID NO: 415620 - protein, 9 aa, Homo Sapiens
KMIRRGDVP

SEQ ID NO: 415621 - protein, 9 aa, Homo Sapiens
FVSIPLLIN

SEQ ID NO: 415622 - protein, 9 aa, Homo Sapiens
ELGLWSQGK

SEQ ID NO: 415623 - protein, 9 aa, Homo Sapiens
AAQQARSHF

SEQ ID NO: 415624 - protein, 9 aa, Homo Sapiens
TSCHPATLD

SEQ ID NO: 415625 - protein, 9 aa, Homo Sapiens
EGVDSTKNR

SEQ ID NO: 415626 - protein, 9 aa, Homo Sapiens
RRPYHKRLL

SEQ ID NO: 415627 - protein, 9 aa, Homo Sapiens
KPRGGGWAA

SEQ ID NO: 415628 - protein, 9 aa, Homo Sapiens
YLFMKWYTA

SEQ ID NO: 415629 - protein, 9 aa, Homo Sapiens
AEGALVGPL

SEQ ID NO: 415630 - protein, 9 aa, Homo Sapiens
LFIIMPIFL

SEQ ID NO: 415631 - protein, 9 aa, Homo Sapiens
TTHLWSRVG

SEQ ID NO: 415632 - protein, 9 aa, Homo Sapiens
RIGHDEIPI

SEQ ID NO: 415633 - protein, 9 aa, Homo Sapiens
RTALDGTER

SEQ ID NO: 415634 - protein, 9 aa, Homo Sapiens
RCLSSFLCT

SEQ ID NO: 415635 - protein, 9 aa, Homo Sapiens
SEEVAAFQK

SEQ ID NO: 415636 - protein, 9 aa, Homo Sapiens
MAQDCSKGI

SEQ ID NO: 415637 - protein, 9 aa, Homo Sapiens
QIMSNGENA

SEQ ID NO: 415638 - protein, 9 aa, Homo Sapiens
GKLGITELA

SEQ ID NO: 415639 - protein, 9 aa, Homo Sapiens
CVAQLFFFH

SEQ ID NO: 415640 - protein, 9 aa, Homo Sapiens
TLNELFTRF

SEQ ID NO: 415641 - protein, 9 aa, Homo Sapiens
EQPAEAERF

SEQ ID NO: 415642 - protein, 9 aa, Homo Sapiens
YPGIPMGAS

SEQ ID NO: 415643 - protein, 9 aa, Homo Sapiens
DARQLQAIC

SEQ ID NO: 415644 - protein, 9 aa, Homo Sapiens
TQFSLLYNE

SEQ ID NO: 415645 - protein, 9 aa, Homo Sapiens
NEGHAPLTV

SEQ ID NO: 415646 - protein, 9 aa, Homo Sapiens
FVDPELSPV

SEQ ID NO: 415647 - protein, 9 aa, Homo Sapiens
TMYCRHHLG

SEQ ID NO: 415648 - protein, 9 aa, Homo Sapiens
RAGLHGQSS

SEQ ID NO: 415649 - protein, 9 aa, Homo Sapiens
QHTRECNGP

SEQ ID NO: 415650 - protein, 9 aa, Homo Sapiens
LSVHNIPHM

SEQ ID NO: 415651 - protein, 9 aa, Homo Sapiens
KMEIKKSQR

SEQ ID NO: 415652 - protein, 9 aa, Homo Sapiens
VARAGVLGI

SEQ ID NO: 415653 - protein, 9 aa, Homo Sapiens
KVNYWWLRH

SEQ ID NO: 415654 - protein, 9 aa, Homo Sapiens
PKQAAEAPA

SEQ ID NO: 415655 - protein, 9 aa, Homo Sapiens
QLRCPQLSA

SEQ ID NO: 415656 - protein, 9 aa, Homo Sapiens
GEVENGRGH

SEQ ID NO: 415657 - protein, 9 aa, Homo Sapiens
LIKRPPFFT

SEQ ID NO: 415658 - protein, 9 aa, Homo Sapiens
FQCEWNPCP

SEQ ID NO: 415659 - protein, 9 aa, Homo Sapiens
PACPISTTL

SEQ ID NO: 415660 - protein, 9 aa, Homo Sapiens
EVRGSPEES

SEQ ID NO: 415661 - protein, 9 aa, Homo Sapiens
AFWRSFCLE

SEQ ID NO: 415662 - protein, 9 aa, Homo Sapiens
FLLWYLSWL

SEQ ID NO: 415663 - protein, 9 aa, Homo Sapiens
WNFVYWAAH

SEQ ID NO: 415664 - protein, 9 aa, Homo Sapiens
SGCGRAPAQ

SEQ ID NO: 415665 - protein, 9 aa, Homo Sapiens
TTAPRRAGE

SEQ ID NO: 415666 - protein, 9 aa, Homo Sapiens
DDKYHKKQA

SEQ ID NO: 415667 - protein, 9 aa, Homo Sapiens
SRRPATGVC

SEQ ID NO: 415668 - protein, 9 aa, Homo Sapiens
QTFQQYALL

SEQ ID NO: 415669 - protein, 9 aa, Homo Sapiens
ARTQTQTRT

SEQ ID NO: 415670 - protein, 9 aa, Homo Sapiens
MRGGGPSSS

SEQ ID NO: 415671 - protein, 9 aa, Homo Sapiens
VDRLEVWLV

SEQ ID NO: 415672 - protein, 9 aa, Homo Sapiens
TSPHHPQRC

SEQ ID NO: 415673 - protein, 9 aa, Homo Sapiens
LQAWRLFCW

SEQ ID NO: 415674 - protein, 9 aa, Homo Sapiens
LEYSKCRTA

SEQ ID NO: 415675 - protein, 9 aa, Homo Sapiens
FIHTGKKHY

SEQ ID NO: 415676 - protein, 9 aa, Homo Sapiens
SMLKSALGP

SEQ ID NO: 415677 - protein, 9 aa, Homo Sapiens
VLVASQYST

SEQ ID NO: 415678 - protein, 9 aa, Homo Sapiens
IEGMEKGNC

SEQ ID NO: 415679 - protein, 9 aa, Homo Sapiens
KISQQDVKN

SEQ ID NO: 415680 - protein, 9 aa, Homo Sapiens
RRALGTTSH

SEQ ID NO: 415681 - protein, 9 aa, Homo Sapiens
ESPWEAALR

SEQ ID NO: 415682 - protein, 9 aa, Homo Sapiens
MPPPCRCCS

SEQ ID NO: 415683 - protein, 9 aa, Homo Sapiens
ELLTAFLGD

SEQ ID NO: 415684 - protein, 9 aa, Homo Sapiens
GGQGARDSR

SEQ ID NO: 415685 - protein, 9 aa, Homo Sapiens
LLSRMPARR

SEQ ID NO: 415686 - protein, 9 aa, Homo Sapiens
RHVETKVRT

SEQ ID NO: 415687 - protein, 9 aa, Homo Sapiens
MPASLRARG

SEQ ID NO: 415688 - protein, 9 aa, Homo Sapiens
KFSCHCVIG

SEQ ID NO: 415689 - protein, 9 aa, Homo Sapiens
GNLVSYVHS

SEQ ID NO: 415690 - protein, 9 aa, Homo Sapiens
GGCPLASTP

SEQ ID NO: 415691 - protein, 9 aa, Homo Sapiens
GRPLRSHTI

SEQ ID NO: 415692 - protein, 9 aa, Homo Sapiens
VQNLLSLAW

SEQ ID NO: 415693 - protein, 9 aa, Homo Sapiens
IDFVVTDMS

SEQ ID NO: 415694 - protein, 9 aa, Homo Sapiens
VNLQMEQLT

SEQ ID NO: 415695 - protein, 9 aa, Homo Sapiens
FAKATVATQ

SEQ ID NO: 415696 - protein, 9 aa, Homo Sapiens
EMNTTKTQS

SEQ ID NO: 415697 - protein, 9 aa, Homo Sapiens
SATLGKIPN

SEQ ID NO: 415698 - protein, 9 aa, Homo Sapiens
VCRWRGPGG

SEQ ID NO: 415699 - protein, 9 aa, Homo Sapiens
QEISFGDAF

SEQ ID NO: 415700 - protein, 9 aa, Homo Sapiens
LKKKIAKGT

SEQ ID NO: 415701 - protein, 9 aa, Homo Sapiens
ARSTGAGPA

SEQ ID NO: 415702 - protein, 9 aa, Homo Sapiens
ILASYGNII

SEQ ID NO: 415703 - protein, 9 aa, Homo Sapiens
SRSTPVDTP

SEQ ID NO: 415704 - protein, 9 aa, Homo Sapiens
ITMVRVVTT

SEQ ID NO: 415705 - protein, 9 aa, Homo Sapiens
LQPPKPPGA

SEQ ID NO: 415706 - protein, 9 aa, Homo Sapiens
VNTRLEKTT

SEQ ID NO: 415707 - protein, 9 aa, Homo Sapiens
AVRMCGGPA

SEQ ID NO: 415708 - protein, 9 aa, Homo Sapiens
EKNVHRQPV

SEQ ID NO: 415709 - protein, 9 aa, Homo Sapiens
TAPPAWTCS

SEQ ID NO: 415710 - protein, 9 aa, Homo Sapiens
SLQPKTAPS

SEQ ID NO: 415711 - protein, 9 aa, Homo Sapiens
FSCLRLSIR

SEQ ID NO: 415712 - protein, 9 aa, Homo Sapiens
IIEHPFQVP

SEQ ID NO: 415713 - protein, 9 aa, Homo Sapiens
GWAALQRLT

SEQ ID NO: 415714 - protein, 9 aa, Homo Sapiens
FQVLVRQVD

SEQ ID NO: 415715 - protein, 9 aa, Homo Sapiens
LFKTRLLRR

SEQ ID NO: 415716 - protein, 9 aa, Homo Sapiens
KMNGRPTFI

SEQ ID NO: 415717 - protein, 9 aa, Homo Sapiens
LIPRSPSPR

SEQ ID NO: 415718 - protein, 9 aa, Homo Sapiens
GADDWWIAM

SEQ ID NO: 415719 - protein, 9 aa, Homo Sapiens
ECNSSKLCG

SEQ ID NO: 415720 - protein, 9 aa, Homo Sapiens
KKRKDRRAK

SEQ ID NO: 415721 - protein, 9 aa, Homo Sapiens
YPQCRLEKL

SEQ ID NO: 415722 - protein, 9 aa, Homo Sapiens
SPPAPSMPR

SEQ ID NO: 415723 - protein, 9 aa, Homo Sapiens
PNISAVDIK

SEQ ID NO: 415724 - protein, 9 aa, Homo Sapiens
RTIGRSQGA

SEQ ID NO: 415725 - protein, 9 aa, Homo Sapiens
HIELHPLLI

SEQ ID NO: 415726 - protein, 9 aa, Homo Sapiens
VGGGRGTAG

SEQ ID NO: 415727 - protein, 9 aa, Homo Sapiens
CAVVNCFQK

SEQ ID NO: 415728 - protein, 9 aa, Homo Sapiens
EYHSCWLSS

SEQ ID NO: 415729 - protein, 9 aa, Homo Sapiens
SPNLPAWTL

SEQ ID NO: 415730 - protein, 9 aa, Homo Sapiens
EPGYVDSEI

SEQ ID NO: 415731 - protein, 9 aa, Homo Sapiens
PNDSLCQGG

SEQ ID NO: 415732 - protein, 9 aa, Homo Sapiens
EVDEVACAA

SEQ ID NO: 415733 - protein, 9 aa, Homo Sapiens
SSCAPPSST

SEQ ID NO: 415734 - protein, 9 aa, Homo Sapiens
AKGLTQALW

SEQ ID NO: 415735 - protein, 9 aa, Homo Sapiens
FEVFFFTIG

SEQ ID NO: 415736 - protein, 9 aa, Homo Sapiens
VPYPGLQCL

SEQ ID NO: 415737 - protein, 9 aa, Homo Sapiens
GGGSAAGGG

SEQ ID NO: 415738 - protein, 9 aa, Homo Sapiens
TELRQHRQL

SEQ ID NO: 415739 - protein, 9 aa, Homo Sapiens
PYSPLREDW

SEQ ID NO: 415740 - protein, 9 aa, Homo Sapiens
SSSYCKLPS

SEQ ID NO: 415741 - protein, 9 aa, Homo Sapiens
GMRTSQYTQ

SEQ ID NO: 415742 - protein, 9 aa, Homo Sapiens
ILVQCAIRK

SEQ ID NO: 415743 - protein, 9 aa, Homo Sapiens
RRGQLIVND

SEQ ID NO: 415744 - protein, 9 aa, Homo Sapiens
QLFFFHLLG

SEQ ID NO: 415745 - protein, 9 aa, Homo Sapiens
SSHVPVKNL

SEQ ID NO: 415746 - protein, 9 aa, Homo Sapiens
MVIRLRGMD

SEQ ID NO: 415747 - protein, 9 aa, Homo Sapiens
RKPGVVVHD

SEQ ID NO: 415748 - protein, 9 aa, Homo Sapiens
VVDSFFVIF

SEQ ID NO: 415749 - protein, 9 aa, Homo Sapiens
CARLSPSSW

SEQ ID NO: 415750 - protein, 9 aa, Homo Sapiens
RSPSPRSSL

SEQ ID NO: 415751 - protein, 9 aa, Homo Sapiens
PTTQTTSGP

SEQ ID NO: 415752 - protein, 9 aa, Homo Sapiens
PRPVCISEK

SEQ ID NO: 415753 - protein, 9 aa, Homo Sapiens
SSSTSMGFF

SEQ ID NO: 415754 - protein, 9 aa, Homo Sapiens
RVDNDPPAQ

SEQ ID NO: 415755 - protein, 9 aa, Homo Sapiens
LGIKISWVC

SEQ ID NO: 415756 - protein, 9 aa, Homo Sapiens
VTPLLTSID

SEQ ID NO: 415757 - protein, 9 aa, Homo Sapiens
TPHLPHQPP

SEQ ID NO: 415758 - protein, 9 aa, Homo Sapiens
NHTHSRDIT

SEQ ID NO: 415759 - protein, 9 aa, Homo Sapiens
NCSSNHTPH

SEQ ID NO: 415760 - protein, 9 aa, Homo Sapiens
EETRGLNIS

SEQ ID NO: 415761 - protein, 9 aa, Homo Sapiens
PKFPQSIYQ

SEQ ID NO: 415762 - protein, 9 aa, Homo Sapiens
VGGHDTPAS

SEQ ID NO: 415763 - protein, 9 aa, Homo Sapiens
IDNGADDWW

SEQ ID NO: 415764 - protein, 9 aa, Homo Sapiens
CVGGKESEV

SEQ ID NO: 415765 - protein, 9 aa, Homo Sapiens
LEFILVQAY

SEQ ID NO: 415766 - protein, 9 aa, Homo Sapiens
VLQTQCRQL

SEQ ID NO: 415767 - protein, 9 aa, Homo Sapiens
ELFTKNLYF

SEQ ID NO: 415768 - protein, 9 aa, Homo Sapiens
PKVLTNTAT

SEQ ID NO: 415769 - protein, 9 aa, Homo Sapiens
SCSKRAAGT

SEQ ID NO: 415770 - protein, 9 aa, Homo Sapiens
SILSCLFPG

SEQ ID NO: 415771 - protein, 9 aa, Homo Sapiens
HSTQDSALL

SEQ ID NO: 415772 - protein, 9 aa, Homo Sapiens
VFALKALVS

SEQ ID NO: 415773 - protein, 9 aa, Homo Sapiens
TAMVDGKTI

SEQ ID NO: 415774 - protein, 9 aa, Homo Sapiens
PGPAICVPV

SEQ ID NO: 415775 - protein, 9 aa, Homo Sapiens
ISSMVDFWD

SEQ ID NO: 415776 - protein, 9 aa, Homo Sapiens
TGHAPRLWL

SEQ ID NO: 415777 - protein, 9 aa, Homo Sapiens
PPARQPSRP

SEQ ID NO: 415778 - protein, 9 aa, Homo Sapiens
DVGPIGAVR

SEQ ID NO: 415779 - protein, 9 aa, Homo Sapiens
KCAFLRTPL

SEQ ID NO: 415780 - protein, 9 aa, Homo Sapiens
RTPSGDRPL

SEQ ID NO: 415781 - protein, 9 aa, Homo Sapiens
RCARPIWYV

SEQ ID NO: 415782 - protein, 9 aa, Homo Sapiens
TEFHHVCTL

SEQ ID NO: 415783 - protein, 9 aa, Homo Sapiens
DNRGYGRSQ

SEQ ID NO: 415784 - protein, 9 aa, Homo Sapiens
KQGCSVQHL

SEQ ID NO: 415785 - protein, 9 aa, Homo Sapiens
ATGLHLHRQ

SEQ ID NO: 415786 - protein, 9 aa, Homo Sapiens
ATGAFRVAS

SEQ ID NO: 415787 - protein, 9 aa, Homo Sapiens
GRAPRTESS

SEQ ID NO: 415788 - protein, 9 aa, Homo Sapiens
GEQRKRRRR

SEQ ID NO: 415789 - protein, 9 aa, Homo Sapiens
TSKDKKRKD

SEQ ID NO: 415790 - protein, 9 aa, Homo Sapiens
SWSHLFPMA

SEQ ID NO: 415791 - protein, 9 aa, Homo Sapiens
KKGVAGENT

SEQ ID NO: 415792 - protein, 9 aa, Homo Sapiens
SSSHPSFLQ

SEQ ID NO: 415793 - protein, 9 aa, Homo Sapiens
LMDLDIKGG

SEQ ID NO: 415794 - protein, 9 aa, Homo Sapiens
VAFLAEEAT

SEQ ID NO: 415795 - protein, 9 aa, Homo Sapiens
ISVDFHVDL

SEQ ID NO: 415796 - protein, 9 aa, Homo Sapiens
LQEVEVVWT

SEQ ID NO: 415797 - protein, 9 aa, Homo Sapiens
FSENRAFRR

SEQ ID NO: 415798 - protein, 9 aa, Homo Sapiens
KIDEYMHNF

SEQ ID NO: 415799 - protein, 9 aa, Homo Sapiens
EIDPPRKCV

SEQ ID NO: 415800 - protein, 9 aa, Homo Sapiens
ASTSSRKIR

SEQ ID NO: 415801 - protein, 9 aa, Homo Sapiens
ARDGTSYKL

SEQ ID NO: 415802 - protein, 9 aa, Homo Sapiens
SQNCEDAQA

SEQ ID NO: 415803 - protein, 9 aa, Homo Sapiens
VDNDPPAQL

SEQ ID NO: 415804 - protein, 9 aa, Homo Sapiens
HQGGWTYGG

SEQ ID NO: 415805 - protein, 9 aa, Homo Sapiens
SISSSTPSG

SEQ ID NO: 415806 - protein, 9 aa, Homo Sapiens
NSPSPTASA

SEQ ID NO: 415807 - protein, 9 aa, Homo Sapiens
AKNWKIKIQ

SEQ ID NO: 415808 - protein, 9 aa, Homo Sapiens
RVELPCKVL

SEQ ID NO: 415809 - protein, 9 aa, Homo Sapiens
LDPLQAKKS

SEQ ID NO: 415810 - protein, 9 aa, Homo Sapiens
KEGAMKDKC

SEQ ID NO: 415811 - protein, 9 aa, Homo Sapiens
SNYQMEMGS

SEQ ID NO: 415812 - protein, 9 aa, Homo Sapiens
MSSCSKRAA

SEQ ID NO: 415813 - protein, 9 aa, Homo Sapiens
SFGDAFFRC

SEQ ID NO: 415814 - protein, 9 aa, Homo Sapiens
HHLGDQLQL

SEQ ID NO: 415815 - protein, 9 aa, Homo Sapiens
EAEALKRQQ

SEQ ID NO: 415816 - protein, 9 aa, Homo Sapiens
VKMSDEAGV

SEQ ID NO: 415817 - protein, 9 aa, Homo Sapiens
LLKTQSDVI

SEQ ID NO: 415818 - protein, 9 aa, Homo Sapiens
QTRPSLQKS

SEQ ID NO: 415819 - protein, 9 aa, Homo Sapiens
SNSFRKSKS

SEQ ID NO: 415820 - protein, 9 aa, Homo Sapiens
SETAQVVRD

SEQ ID NO: 415821 - protein, 9 aa, Homo Sapiens
AYGAAEEGH

SEQ ID NO: 415822 - protein, 9 aa, Homo Sapiens
HTSPTHGGS

SEQ ID NO: 415823 - protein, 9 aa, Homo Sapiens
TNGQVQPIW

SEQ ID NO: 415824 - protein, 9 aa, Homo Sapiens
VSTGQLQQR

SEQ ID NO: 415825 - protein, 9 aa, Homo Sapiens
ELLQGSLHV

SEQ ID NO: 415826 - protein, 9 aa, Homo Sapiens
RAKAGYSPL

SEQ ID NO: 415827 - protein, 9 aa, Homo Sapiens
LQPSPQTPT

SEQ ID NO: 415828 - protein, 9 aa, Homo Sapiens
LSQRQDQKP

SEQ ID NO: 415829 - protein, 9 aa, Homo Sapiens
CVDSPMLNR

SEQ ID NO: 415830 - protein, 9 aa, Homo Sapiens
ENLEYLVIN

SEQ ID NO: 415831 - protein, 9 aa, Homo Sapiens
VVWKKWQLT

SEQ ID NO: 415832 - protein, 9 aa, Homo Sapiens
LSLFVLDQD

SEQ ID NO: 415833 - protein, 9 aa, Homo Sapiens
EGRSHHGPE

SEQ ID NO: 415834 - protein, 9 aa, Homo Sapiens
DTCVGKVSL

SEQ ID NO: 415835 - protein, 9 aa, Homo Sapiens
LPSRPAQPT

SEQ ID NO: 415836 - protein, 9 aa, Homo Sapiens
RMTGHGRAR

SEQ ID NO: 415837 - protein, 9 aa, Homo Sapiens
YQDCEETLP

SEQ ID NO: 415838 - protein, 9 aa, Homo Sapiens
AHWTLPPRH

SEQ ID NO: 415839 - protein, 9 aa, Homo Sapiens
LLIRIIDTP

SEQ ID NO: 415840 - protein, 9 aa, Homo Sapiens
DMVDFLKGQ

SEQ ID NO: 415841 - protein, 9 aa, Homo Sapiens
LLHLEPHHV

SEQ ID NO: 415842 - protein, 9 aa, Homo Sapiens
HCSSPSCLC

SEQ ID NO: 415843 - protein, 9 aa, Homo Sapiens
QNHSKCITE

SEQ ID NO: 415844 - protein, 9 aa, Homo Sapiens
NATGAFRVA

SEQ ID NO: 415845 - protein, 9 aa, Homo Sapiens
ECHKAFRCY

SEQ ID NO: 415846 - protein, 9 aa, Homo Sapiens
VCPARSPRT

SEQ ID NO: 415847 - protein, 9 aa, Homo Sapiens
YPPPPEQPS

SEQ ID NO: 415848 - protein, 9 aa, Homo Sapiens
RHDDTRVHT

SEQ ID NO: 415849 - protein, 9 aa, Homo Sapiens
ELGFTVFAR

SEQ ID NO: 415850 - protein, 9 aa, Homo Sapiens
PIFMPFVNT

SEQ ID NO: 415851 - protein, 9 aa, Homo Sapiens
IDEYMHNFS

SEQ ID NO: 415852 - protein, 9 aa, Homo Sapiens
HAHLTIHQR

SEQ ID NO: 415853 - protein, 9 aa, Homo Sapiens
APEPRWRML

SEQ ID NO: 415854 - protein, 9 aa, Homo Sapiens
RTGATGERT

SEQ ID NO: 415855 - protein, 9 aa, Homo Sapiens
SPPPEASHL

SEQ ID NO: 415856 - protein, 9 aa, Homo Sapiens
MTARASEKS

SEQ ID NO: 415857 - protein, 9 aa, Homo Sapiens
CGGRERRDR

SEQ ID NO: 415858 - protein, 9 aa, Homo Sapiens
TIGRSQGAI

SEQ ID NO: 415859 - protein, 9 aa, Homo Sapiens
GPWPLEEVV

SEQ ID NO: 415860 - protein, 9 aa, Homo Sapiens
THGIFEPGE

SEQ ID NO: 415861 - protein, 9 aa, Homo Sapiens
GLIVAVHVA

SEQ ID NO: 415862 - protein, 9 aa, Homo Sapiens
TEHAEVREI

SEQ ID NO: 415863 - protein, 9 aa, Homo Sapiens
YRFSPLPVG

SEQ ID NO: 415864 - protein, 9 aa, Homo Sapiens
EAIVNTGTS

SEQ ID NO: 415865 - protein, 9 aa, Homo Sapiens
DFRVGLKVT

SEQ ID NO: 415866 - protein, 9 aa, Homo Sapiens
GRQKKGVAG

SEQ ID NO: 415867 - protein, 9 aa, Homo Sapiens
RTARGVTAR

SEQ ID NO: 415868 - protein, 9 aa, Homo Sapiens
RGPRTTELS

SEQ ID NO: 415869 - protein, 9 aa, Homo Sapiens
SRMRAGTCN

SEQ ID NO: 415870 - protein, 9 aa, Homo Sapiens
STTLRPPAQ

SEQ ID NO: 415871 - protein, 9 aa, Homo Sapiens
GTPYQDWAA

SEQ ID NO: 415872 - protein, 9 aa, Homo Sapiens
YRLDGTERV

SEQ ID NO: 415873 - protein, 9 aa, Homo Sapiens
SHTLYQHDA

SEQ ID NO: 415874 - protein, 9 aa, Homo Sapiens
TTRQELSHT

SEQ ID NO: 415875 - protein, 9 aa, Homo Sapiens
AFDVTPTTS

SEQ ID NO: 415876 - protein, 9 aa, Homo Sapiens
DLSSEEVAA

SEQ ID NO: 415877 - protein, 9 aa, Homo Sapiens
MGGQQLSGI

SEQ ID NO: 415878 - protein, 9 aa, Homo Sapiens
NVVCWEFKH

SEQ ID NO: 415879 - protein, 9 aa, Homo Sapiens
HTHTHTHAL

SEQ ID NO: 415880 - protein, 9 aa, Homo Sapiens
LPSATLSST

SEQ ID NO: 415881 - protein, 9 aa, Homo Sapiens
SAEGQQKAF

SEQ ID NO: 415882 - protein, 9 aa, Homo Sapiens
NLAIVHRFA

SEQ ID NO: 415883 - protein, 9 aa, Homo Sapiens
QSKTEEGPP

SEQ ID NO: 415884 - protein, 9 aa, Homo Sapiens
TAPSTKKED

SEQ ID NO: 415885 - protein, 9 aa, Homo Sapiens
PIGIPGRSG

SEQ ID NO: 415886 - protein, 9 aa, Homo Sapiens
PDGVMVRVG

SEQ ID NO: 415887 - protein, 9 aa, Homo Sapiens
WALCAVSTQ

SEQ ID NO: 415888 - protein, 9 aa, Homo Sapiens
APITLPWSR

SEQ ID NO: 415889 - protein, 9 aa, Homo Sapiens
DVLPLVPIL

SEQ ID NO: 415890 - protein, 9 aa, Homo Sapiens
RLGLRKMGS

SEQ ID NO: 415891 - protein, 9 aa, Homo Sapiens
RANGEVLPI

SEQ ID NO: 415892 - protein, 9 aa, Homo Sapiens
SGTKNLHIQ

SEQ ID NO: 415893 - protein, 9 aa, Homo Sapiens
SGMGNFKLI

SEQ ID NO: 415894 - protein, 9 aa, Homo Sapiens
TPPSPTCFS

SEQ ID NO: 415895 - protein, 9 aa, Homo Sapiens
FIMLIFLGP

SEQ ID NO: 415896 - protein, 9 aa, Homo Sapiens
KYAGIFWFW

SEQ ID NO: 415897 - protein, 9 aa, Homo Sapiens
FRSCSWDSA

SEQ ID NO: 415898 - protein, 9 aa, Homo Sapiens
GLKPYQCPK

SEQ ID NO: 415899 - protein, 9 aa, Homo Sapiens
FRCSLFTCL

SEQ ID NO: 415900 - protein, 9 aa, Homo Sapiens
VGTLSGDTL

SEQ ID NO: 415901 - protein, 9 aa, Homo Sapiens
RAFRRGTEW

SEQ ID NO: 415902 - protein, 9 aa, Homo Sapiens
LFLLQAEIR

SEQ ID NO: 415903 - protein, 9 aa, Homo Sapiens
QRLELTQRL

SEQ ID NO: 415904 - protein, 9 aa, Homo Sapiens
MTVVVPLIV

SEQ ID NO: 415905 - protein, 9 aa, Homo Sapiens
LSPFTIVMP

SEQ ID NO: 415906 - protein, 9 aa, Homo Sapiens
TLWLHEHNR

SEQ ID NO: 415907 - protein, 9 aa, Homo Sapiens
SGTSAGTGA

SEQ ID NO: 415908 - protein, 9 aa, Homo Sapiens
GHPEPHHTL

SEQ ID NO: 415909 - protein, 9 aa, Homo Sapiens
LTGMMGGVR

SEQ ID NO: 415910 - protein, 9 aa, Homo Sapiens
LVCVMCLVS

SEQ ID NO: 415911 - protein, 9 aa, Homo Sapiens
VANMLVVLI

SEQ ID NO: 415912 - protein, 9 aa, Homo Sapiens
KSVTKSVAS

SEQ ID NO: 415913 - protein, 9 aa, Homo Sapiens
CHGQQYVKR

SEQ ID NO: 415914 - protein, 9 aa, Homo Sapiens
QILAINHGE

SEQ ID NO: 415915 - protein, 9 aa, Homo Sapiens
RVNVKWEYD

SEQ ID NO: 415916 - protein, 9 aa, Homo Sapiens
LSVYWQIVD

SEQ ID NO: 415917 - protein, 9 aa, Homo Sapiens
LKDKRAGSQ

SEQ ID NO: 415918 - protein, 9 aa, Homo Sapiens
TLELRDSAL

SEQ ID NO: 415919 - protein, 9 aa, Homo Sapiens
LPSCPLATW

SEQ ID NO: 415920 - protein, 9 aa, Homo Sapiens
KVLREKVPC

SEQ ID NO: 415921 - protein, 9 aa, Homo Sapiens
LPSTAAPRS

SEQ ID NO: 415922 - protein, 9 aa, Homo Sapiens
PPVHHPWPK

SEQ ID NO: 415923 - protein, 9 aa, Homo Sapiens
AQPPPVPSH

SEQ ID NO: 415924 - protein, 9 aa, Homo Sapiens
VPCYRECNQ

SEQ ID NO: 415925 - protein, 9 aa, Homo Sapiens
SELPVAGGA

SEQ ID NO: 415926 - protein, 9 aa, Homo Sapiens
SPDLHTGLI

SEQ ID NO: 415927 - protein, 9 aa, Homo Sapiens
AGVTHTAAK

SEQ ID NO: 415928 - protein, 9 aa, Homo Sapiens
HSQQIAEEA

SEQ ID NO: 415929 - protein, 9 aa, Homo Sapiens
RWWQLIQWE

SEQ ID NO: 415930 - protein, 9 aa, Homo Sapiens
CARPIWYVG

SEQ ID NO: 415931 - protein, 9 aa, Homo Sapiens
IRKDQRGGR

SEQ ID NO: 415932 - protein, 9 aa, Homo Sapiens
QDLAQSYGI

SEQ ID NO: 415933 - protein, 9 aa, Homo Sapiens
WTCSSGPAV

SEQ ID NO: 415934 - protein, 9 aa, Homo Sapiens
KSISAPVIF

SEQ ID NO: 415935 - protein, 9 aa, Homo Sapiens
PPEGKLGIT

SEQ ID NO: 415936 - protein, 9 aa, Homo Sapiens
LMDGLYHSR

SEQ ID NO: 415937 - protein, 9 aa, Homo Sapiens
WGRNTSLAA

SEQ ID NO: 415938 - protein, 9 aa, Homo Sapiens
FPFDIVFLI

SEQ ID NO: 415939 - protein, 9 aa, Homo Sapiens
DSLAPFLGN

SEQ ID NO: 415940 - protein, 9 aa, Homo Sapiens
NRQHLAMME

SEQ ID NO: 415941 - protein, 9 aa, Homo Sapiens
AVDNFSTQY

SEQ ID NO: 415942 - protein, 9 aa, Homo Sapiens
PGGAEGLKT

SEQ ID NO: 415943 - protein, 9 aa, Homo Sapiens
QTRTRMGRK

SEQ ID NO: 415944 - protein, 9 aa, Homo Sapiens
MDYCPQFDA

SEQ ID NO: 415945 - protein, 9 aa, Homo Sapiens
QMEMGSALH

SEQ ID NO: 415946 - protein, 9 aa, Homo Sapiens
PMWQGMGSL

SEQ ID NO: 415947 - protein, 9 aa, Homo Sapiens
NHTPHKIIH

SEQ ID NO: 415948 - protein, 9 aa, Homo Sapiens
LLTLSSSVS

SEQ ID NO: 415949 - protein, 9 aa, Homo Sapiens
SWREEVQGV

SEQ ID NO: 415950 - protein, 9 aa, Homo Sapiens
SQGQRWTWR

SEQ ID NO: 415951 - protein, 9 aa, Homo Sapiens
FMRLAAELG

SEQ ID NO: 415952 - protein, 9 aa, Homo Sapiens
SSTLTSDVS

SEQ ID NO: 415953 - protein, 9 aa, Homo Sapiens
RQDLPPVPL

SEQ ID NO: 415954 - protein, 9 aa, Homo Sapiens
GRSPSRNDK

SEQ ID NO: 415955 - protein, 9 aa, Homo Sapiens
IKSQRKTNT

SEQ ID NO: 415956 - protein, 9 aa, Homo Sapiens
YTAVAVAHI

SEQ ID NO: 415957 - protein, 9 aa, Homo Sapiens
YFLTIPRLE

SEQ ID NO: 415958 - protein, 9 aa, Homo Sapiens
ISTLVLDVS

SEQ ID NO: 415959 - protein, 9 aa, Homo Sapiens
CPPPRRGSS

SEQ ID NO: 415960 - protein, 9 aa, Homo Sapiens
RKEEQPKKW

SEQ ID NO: 415961 - protein, 9 aa, Homo Sapiens
EKNWYLFCL

SEQ ID NO: 415962 - protein, 9 aa, Homo Sapiens
NEPTATRKV

SEQ ID NO: 415963 - protein, 9 aa, Homo Sapiens
VQDGRVDRL

SEQ ID NO: 415964 - protein, 9 aa, Homo Sapiens
FDVTPTTSS

SEQ ID NO: 415965 - protein, 9 aa, Homo Sapiens
LLTCFSKAM

SEQ ID NO: 415966 - protein, 9 aa, Homo Sapiens
APGGHPIVK

SEQ ID NO: 415967 - protein, 9 aa, Homo Sapiens
QELEHFNKL

SEQ ID NO: 415968 - protein, 9 aa, Homo Sapiens
LPRAGAGPL

SEQ ID NO: 415969 - protein, 9 aa, Homo Sapiens
AGPLSSKKA

SEQ ID NO: 415970 - protein, 9 aa, Homo Sapiens
GIILTVSLD

SEQ ID NO: 415971 - protein, 9 aa, Homo Sapiens
FTVHSPITQ

SEQ ID NO: 415972 - protein, 9 aa, Homo Sapiens
RGLGMSLQH

SEQ ID NO: 415973 - protein, 9 aa, Homo Sapiens
DPDMLLSYP

SEQ ID NO: 415974 - protein, 9 aa, Homo Sapiens
LCCKQLSIR

SEQ ID NO: 415975 - protein, 9 aa, Homo Sapiens
LRPRGRCKL

SEQ ID NO: 415976 - protein, 9 aa, Homo Sapiens
TIFFCMDKD

SEQ ID NO: 415977 - protein, 9 aa, Homo Sapiens
IGISISQLL

SEQ ID NO: 415978 - protein, 9 aa, Homo Sapiens
DFVAQPKDY

SEQ ID NO: 415979 - protein, 9 aa, Homo Sapiens
THPLPIWTP

SEQ ID NO: 415980 - protein, 9 aa, Homo Sapiens
VSTEGEVEN

SEQ ID NO: 415981 - protein, 9 aa, Homo Sapiens
GHRVVTCDT

SEQ ID NO: 415982 - protein, 9 aa, Homo Sapiens
ALQHHFLVT

SEQ ID NO: 415983 - protein, 9 aa, Homo Sapiens
SGEPTPSWR

SEQ ID NO: 415984 - protein, 9 aa, Homo Sapiens
NSTLQAEDM

SEQ ID NO: 415985 - protein, 9 aa, Homo Sapiens
WTSGAGGSL

SEQ ID NO: 415986 - protein, 9 aa, Homo Sapiens
TLQALNAYK

SEQ ID NO: 415987 - protein, 9 aa, Homo Sapiens
PKGSRGLGA

SEQ ID NO: 415988 - protein, 9 aa, Homo Sapiens
FAEVVGHRH

SEQ ID NO: 415989 - protein, 9 aa, Homo Sapiens
QIQEKSTME

SEQ ID NO: 415990 - protein, 9 aa, Homo Sapiens
AVDIKPKDE

SEQ ID NO: 415991 - protein, 9 aa, Homo Sapiens
DERKDKKKK

SEQ ID NO: 415992 - protein, 9 aa, Homo Sapiens
IGSGGVGKS

SEQ ID NO: 415993 - protein, 9 aa, Homo Sapiens
HVLSPVSEP

SEQ ID NO: 415994 - protein, 9 aa, Homo Sapiens
VGLKVTVVD

SEQ ID NO: 415995 - protein, 9 aa, Homo Sapiens
ACRPACTCI

SEQ ID NO: 415996 - protein, 9 aa, Homo Sapiens
CCTPGPVWP

SEQ ID NO: 415997 - protein, 9 aa, Homo Sapiens
TASAFGDHP

SEQ ID NO: 415998 - protein, 9 aa, Homo Sapiens
IDPPRKCVD

SEQ ID NO: 415999 - protein, 9 aa, Homo Sapiens
LFYALEKDE

SEQ ID NO: 416000 - protein, 9 aa, Homo Sapiens
CSVLGGGGS

SEQ ID NO: 416001 - protein, 9 aa, Homo Sapiens
RSASSTFSI

SEQ ID NO: 416002 - protein, 9 aa, Homo Sapiens
QVIEQLGGK

SEQ ID NO: 416003 - protein, 9 aa, Homo Sapiens
GKMTGESFP

SEQ ID NO: 416004 - protein, 9 aa, Homo Sapiens
LNNKLFITS

SEQ ID NO: 416005 - protein, 9 aa, Homo Sapiens
VGRLTWVKL

SEQ ID NO: 416006 - protein, 9 aa, Homo Sapiens
REELETRDQ

SEQ ID NO: 416007 - protein, 9 aa, Homo Sapiens
LESTACPSE

SEQ ID NO: 416008 - protein, 9 aa, Homo Sapiens
TGKTVVGVP

SEQ ID NO: 416009 - protein, 9 aa, Homo Sapiens
TDYVGISHN

SEQ ID NO: 416010 - protein, 9 aa, Homo Sapiens
LAGIMGKNE

SEQ ID NO: 416011 - protein, 9 aa, Homo Sapiens
QHTGVGSPF

SEQ ID NO: 416012 - protein, 9 aa, Homo Sapiens
PPLLHPQWA

SEQ ID NO: 416013 - protein, 9 aa, Homo Sapiens
LANLSWCCA

SEQ ID NO: 416014 - protein, 9 aa, Homo Sapiens
GYYYRETYC

SEQ ID NO: 416015 - protein, 9 aa, Homo Sapiens
NDDGGGSFS

SEQ ID NO: 416016 - protein, 9 aa, Homo Sapiens
EQSRTDWDD

SEQ ID NO: 416017 - protein, 9 aa, Homo Sapiens
DTPPPACTS

SEQ ID NO: 416018 - protein, 9 aa, Homo Sapiens
QLQQSFPGI

SEQ ID NO: 416019 - protein, 9 aa, Homo Sapiens
EGGKEVMKL

SEQ ID NO: 416020 - protein, 9 aa, Homo Sapiens
RPATGVCPA

SEQ ID NO: 416021 - protein, 9 aa, Homo Sapiens
VLGHPEPDY

SEQ ID NO: 416022 - protein, 9 aa, Homo Sapiens
CRWRGPGGA

SEQ ID NO: 416023 - protein, 9 aa, Homo Sapiens
GDEHKCSVV

SEQ ID NO: 416024 - protein, 9 aa, Homo Sapiens
AVGTLSGDT

SEQ ID NO: 416025 - protein, 9 aa, Homo Sapiens
DWWIAMTYE

SEQ ID NO: 416026 - protein, 9 aa, Homo Sapiens
VFGKDRKLG

SEQ ID NO: 416027 - protein, 9 aa, Homo Sapiens
LGCLSFPLP

SEQ ID NO: 416028 - protein, 9 aa, Homo Sapiens
GAELLGAGE

SEQ ID NO: 416029 - protein, 9 aa, Homo Sapiens
LSTCLVAME

SEQ ID NO: 416030 - protein, 9 aa, Homo Sapiens
PSLNGISQA

SEQ ID NO: 416031 - protein, 9 aa, Homo Sapiens
VRTKIRKRK

SEQ ID NO: 416032 - protein, 9 aa, Homo Sapiens
AEALKRQQQ

SEQ ID NO: 416033 - protein, 9 aa, Homo Sapiens
GLPVHSNKE

SEQ ID NO: 416034 - protein, 9 aa, Homo Sapiens
DAFFRCSLF

SEQ ID NO: 416035 - protein, 9 aa, Homo Sapiens
RAHEHVVAQ

SEQ ID NO: 416036 - protein, 9 aa, Homo Sapiens
RKEFLRQRW

SEQ ID NO: 416037 - protein, 9 aa, Homo Sapiens
GMWSSPLMW

SEQ ID NO: 416038 - protein, 9 aa, Homo Sapiens
RGGAAQPNG

SEQ ID NO: 416039 - protein, 9 aa, Homo Sapiens
NPDWCLKVS

SEQ ID NO: 416040 - protein, 9 aa, Homo Sapiens
WRPAPSTSC

SEQ ID NO: 416041 - protein, 9 aa, Homo Sapiens
ESTACPSES

SEQ ID NO: 416042 - protein, 9 aa, Homo Sapiens
GAHQQQVTT

SEQ ID NO: 416043 - protein, 9 aa, Homo Sapiens
LNPKMQRSP

SEQ ID NO: 416044 - protein, 9 aa, Homo Sapiens
VSSSDSFSV

SEQ ID NO: 416045 - protein, 9 aa, Homo Sapiens
NKKLGLLCD

SEQ ID NO: 416046 - protein, 9 aa, Homo Sapiens
QLLALGLGS

SEQ ID NO: 416047 - protein, 9 aa, Homo Sapiens
LMHPDVLEE

SEQ ID NO: 416048 - protein, 9 aa, Homo Sapiens
DERVVAALL

SEQ ID NO: 416049 - protein, 9 aa, Homo Sapiens
ETLIAHFQT

SEQ ID NO: 416050 - protein, 9 aa, Homo Sapiens
KLSVEIRSL

SEQ ID NO: 416051 - protein, 9 aa, Homo Sapiens
LPIQPEQQA

SEQ ID NO: 416052 - protein, 9 aa, Homo Sapiens
SSLPLLRDQ

SEQ ID NO: 416053 - protein, 9 aa, Homo Sapiens
PPVPLLRGR

SEQ ID NO: 416054 - protein, 9 aa, Homo Sapiens
GLGMSLQHL

SEQ ID NO: 416055 - protein, 9 aa, Homo Sapiens
ATATWRMRS

SEQ ID NO: 416056 - protein, 9 aa, Homo Sapiens
SVFGFSFLL

SEQ ID NO: 416057 - protein, 9 aa, Homo Sapiens
AGFELLQGS

SEQ ID NO: 416058 - protein, 9 aa, Homo Sapiens
RTPGVFDPR

SEQ ID NO: 416059 - protein, 9 aa, Homo Sapiens
LAQDQHRGL

SEQ ID NO: 416060 - protein, 9 aa, Homo Sapiens
NALRDIQTG

SEQ ID NO: 416061 - protein, 9 aa, Homo Sapiens
DHRDARQLQ

SEQ ID NO: 416062 - protein, 9 aa, Homo Sapiens
LAARIKGDT

SEQ ID NO: 416063 - protein, 9 aa, Homo Sapiens
DLVNAFLLK

SEQ ID NO: 416064 - protein, 9 aa, Homo Sapiens
LWICSQAER

SEQ ID NO: 416065 - protein, 9 aa, Homo Sapiens
TAATLRCPA

SEQ ID NO: 416066 - protein, 9 aa, Homo Sapiens
GPSWTWGRA

SEQ ID NO: 416067 - protein, 9 aa, Homo Sapiens
VGISHNLDF

SEQ ID NO: 416068 - protein, 9 aa, Homo Sapiens
SGPQWDSDE

SEQ ID NO: 416069 - protein, 9 aa, Homo Sapiens
RKVPWKRKQ

SEQ ID NO: 416070 - protein, 9 aa, Homo Sapiens
DHRTSQNHS

SEQ ID NO: 416071 - protein, 9 aa, Homo Sapiens
ELEELRLEN

SEQ ID NO: 416072 - protein, 9 aa, Homo Sapiens
ALPCRVLWR

SEQ ID NO: 416073 - protein, 9 aa, Homo Sapiens
TDPVPAVLI

SEQ ID NO: 416074 - protein, 9 aa, Homo Sapiens
EFILVQAYT

SEQ ID NO: 416075 - protein, 9 aa, Homo Sapiens
DLWTEDSGT

SEQ ID NO: 416076 - protein, 9 aa, Homo Sapiens
ADDRLYHRH

SEQ ID NO: 416077 - protein, 9 aa, Homo Sapiens
DYYIVANVE

SEQ ID NO: 416078 - protein, 9 aa, Homo Sapiens
YERMFHWLV

SEQ ID NO: 416079 - protein, 9 aa, Homo Sapiens
RQPPPGPSW

SEQ ID NO: 416080 - protein, 9 aa, Homo Sapiens
MCNPNKAIF

SEQ ID NO: 416081 - protein, 9 aa, Homo Sapiens
KYKDFLIQL

SEQ ID NO: 416082 - protein, 9 aa, Homo Sapiens
RQHRQLFEA

SEQ ID NO: 416083 - protein, 9 aa, Homo Sapiens
QIVLVEGGC

SEQ ID NO: 416084 - protein, 9 aa, Homo Sapiens
EDSGGSFPL

SEQ ID NO: 416085 - protein, 9 aa, Homo Sapiens
ENGVNMQYF

SEQ ID NO: 416086 - protein, 9 aa, Homo Sapiens
AEGLKTATP

SEQ ID NO: 416087 - protein, 9 aa, Homo Sapiens
NTFYLADEI

SEQ ID NO: 416088 - protein, 9 aa, Homo Sapiens
YPVLMSHKI

SEQ ID NO: 416089 - protein, 9 aa, Homo Sapiens
VIANMVETI

SEQ ID NO: 416090 - protein, 9 aa, Homo Sapiens
SDLVQLLLQ

SEQ ID NO: 416091 - protein, 9 aa, Homo Sapiens
LSQFLRKKA

SEQ ID NO: 416092 - protein, 9 aa, Homo Sapiens
YLIREQPAE

SEQ ID NO: 416093 - protein, 9 aa, Homo Sapiens
RQGLVMEAP

SEQ ID NO: 416094 - protein, 9 aa, Homo Sapiens
GRVCDTCLN

SEQ ID NO: 416095 - protein, 9 aa, Homo Sapiens
NSLAQLCVL

SEQ ID NO: 416096 - protein, 9 aa, Homo Sapiens
FTCLQAWRL

SEQ ID NO: 416097 - protein, 9 aa, Homo Sapiens
LGFNIQGGK

SEQ ID NO: 416098 - protein, 9 aa, Homo Sapiens
LWESNRRTD

SEQ ID NO: 416099 - protein, 9 aa, Homo Sapiens
CVPRPPQPW

SEQ ID NO: 416100 - protein, 9 aa, Homo Sapiens
PNRQILQGV

SEQ ID NO: 416101 - protein, 9 aa, Homo Sapiens
WPRSLTLIQ

SEQ ID NO: 416102 - protein, 9 aa, Homo Sapiens
VSEAVPSSP

SEQ ID NO: 416103 - protein, 9 aa, Homo Sapiens
QEKSTMESG

SEQ ID NO: 416104 - protein, 9 aa, Homo Sapiens
LRQRWAAVT

SEQ ID NO: 416105 - protein, 9 aa, Homo Sapiens
GSPGGPPPA

SEQ ID NO: 416106 - protein, 9 aa, Homo Sapiens
QKGKASLTI

SEQ ID NO: 416107 - protein, 9 aa, Homo Sapiens
KDKCRYQQE

SEQ ID NO: 416108 - protein, 9 aa, Homo Sapiens
KVILSWMHY

SEQ ID NO: 416109 - protein, 9 aa, Homo Sapiens
YVIPEPPPR

SEQ ID NO: 416110 - protein, 9 aa, Homo Sapiens
TLQDFLYAQ

SEQ ID NO: 416111 - protein, 9 aa, Homo Sapiens
HVLGEAQTK

SEQ ID NO: 416112 - protein, 9 aa, Homo Sapiens
LPEGKRKLS

SEQ ID NO: 416113 - protein, 9 aa, Homo Sapiens
IRTKSVTKS

SEQ ID NO: 416114 - protein, 9 aa, Homo Sapiens
GTAAILILL

SEQ ID NO: 416115 - protein, 9 aa, Homo Sapiens
HCVMKESVW

SEQ ID NO: 416116 - protein, 9 aa, Homo Sapiens
EFVTDDYDI

SEQ ID NO: 416117 - protein, 9 aa, Homo Sapiens
KEDLTRLLH

SEQ ID NO: 416118 - protein, 9 aa, Homo Sapiens
RMCGGPAPE

SEQ ID NO: 416119 - protein, 9 aa, Homo Sapiens
RSPSLQENE

SEQ ID NO: 416120 - protein, 9 aa, Homo Sapiens
ECFSASMDG

SEQ ID NO: 416121 - protein, 9 aa, Homo Sapiens
PRSERKWSW

SEQ ID NO: 416122 - protein, 9 aa, Homo Sapiens
CHIFTRCIQ

SEQ ID NO: 416123 - protein, 9 aa, Homo Sapiens
PVSSLCPEP

SEQ ID NO: 416124 - protein, 9 aa, Homo Sapiens
LAPERARVP

SEQ ID NO: 416125 - protein, 9 aa, Homo Sapiens
NLVSYVHSS

SEQ ID NO: 416126 - protein, 9 aa, Homo Sapiens
GSSQGCREG

SEQ ID NO: 416127 - protein, 9 aa, Homo Sapiens
MLNGGQHID

SEQ ID NO: 416128 - protein, 9 aa, Homo Sapiens
GLSDEHISL

SEQ ID NO: 416129 - protein, 9 aa, Homo Sapiens
PSPSSLLSP

SEQ ID NO: 416130 - protein, 9 aa, Homo Sapiens
DNGVWMLQQ

SEQ ID NO: 416131 - protein, 9 aa, Homo Sapiens
NVLFRQRSC

SEQ ID NO: 416132 - protein, 9 aa, Homo Sapiens
RGGNHTHSR

SEQ ID NO: 416133 - protein, 9 aa, Homo Sapiens
RPVMNHICA

SEQ ID NO: 416134 - protein, 9 aa, Homo Sapiens
APRLWLLWR

SEQ ID NO: 416135 - protein, 9 aa, Homo Sapiens
LRGDPGVIK

SEQ ID NO: 416136 - protein, 9 aa, Homo Sapiens
FCRPSRACD

SEQ ID NO: 416137 - protein, 9 aa, Homo Sapiens
QAYTPSSPS

SEQ ID NO: 416138 - protein, 9 aa, Homo Sapiens
GEKEDEKDE

SEQ ID NO: 416139 - protein, 9 aa, Homo Sapiens
SRISSSSHP

SEQ ID NO: 416140 - protein, 9 aa, Homo Sapiens
APPVGGRVP

SEQ ID NO: 416141 - protein, 9 aa, Homo Sapiens
HVGGASAAG

SEQ ID NO: 416142 - protein, 9 aa, Homo Sapiens
SPKSTSPHH

SEQ ID NO: 416143 - protein, 9 aa, Homo Sapiens
PPAPRLLPL

SEQ ID NO: 416144 - protein, 9 aa, Homo Sapiens
NLYFKQIRN

SEQ ID NO: 416145 - protein, 9 aa, Homo Sapiens
AEVVGHRHH

SEQ ID NO: 416146 - protein, 9 aa, Homo Sapiens
SPDKTLQFV

SEQ ID NO: 416147 - protein, 9 aa, Homo Sapiens
SVLGGEDSG

SEQ ID NO: 416148 - protein, 9 aa, Homo Sapiens
LPCVALCTA

SEQ ID NO: 416149 - protein, 9 aa, Homo Sapiens
ARHPAPTQE

SEQ ID NO: 416150 - protein, 9 aa, Homo Sapiens
SDLWTEDSG

SEQ ID NO: 416151 - protein, 9 aa, Homo Sapiens
EYKALKGLR

SEQ ID NO: 416152 - protein, 9 aa, Homo Sapiens
MWSSPLMWG

SEQ ID NO: 416153 - protein, 9 aa, Homo Sapiens
AALSAGHYL

SEQ ID NO: 416154 - protein, 9 aa, Homo Sapiens
FGPSFMGMQ

SEQ ID NO: 416155 - protein, 9 aa, Homo Sapiens
QEFRERQAR

SEQ ID NO: 416156 - protein, 9 aa, Homo Sapiens
ATSTLSPQL

SEQ ID NO: 416157 - protein, 9 aa, Homo Sapiens
SLTIGGWRI

SEQ ID NO: 416158 - protein, 9 aa, Homo Sapiens
LPVQEPMKR

SEQ ID NO: 416159 - protein, 9 aa, Homo Sapiens
EALKRQQQE

SEQ ID NO: 416160 - protein, 9 aa, Homo Sapiens
SYCKLPSLS

SEQ ID NO: 416161 - protein, 9 aa, Homo Sapiens
TALDGTERE

SEQ ID NO: 416162 - protein, 9 aa, Homo Sapiens
GLKTATPRS

SEQ ID NO: 416163 - protein, 9 aa, Homo Sapiens
TCCCTATSC

SEQ ID NO: 416164 - protein, 9 aa, Homo Sapiens
LKTATPRSL

SEQ ID NO: 416165 - protein, 9 aa, Homo Sapiens
VRLHELSPP

SEQ ID NO: 416166 - protein, 9 aa, Homo Sapiens
SAPTPPTWT

SEQ ID NO: 416167 - protein, 9 aa, Homo Sapiens
IQNTSPLGA

SEQ ID NO: 416168 - protein, 9 aa, Homo Sapiens
QSYGIPYIE

SEQ ID NO: 416169 - protein, 9 aa, Homo Sapiens
GTRPPVLPW

SEQ ID NO: 416170 - protein, 9 aa, Homo Sapiens
SIMCPLNPA

SEQ ID NO: 416171 - protein, 9 aa, Homo Sapiens
PRCCAAPGM

SEQ ID NO: 416172 - protein, 9 aa, Homo Sapiens
DDFEVFFFT

SEQ ID NO: 416173 - protein, 9 aa, Homo Sapiens
KKLALCASS

SEQ ID NO: 416174 - protein, 9 aa, Homo Sapiens
VRHYPRGKQ

SEQ ID NO: 416175 - protein, 9 aa, Homo Sapiens
SSSAWAGPH

SEQ ID NO: 416176 - protein, 9 aa, Homo Sapiens
DLCGCLLTA

SEQ ID NO: 416177 - protein, 9 aa, Homo Sapiens
AAYSDLFHS

SEQ ID NO: 416178 - protein, 9 aa, Homo Sapiens
EQVEWENVE

SEQ ID NO: 416179 - protein, 9 aa, Homo Sapiens
GKKNAVIDT

SEQ ID NO: 416180 - protein, 9 aa, Homo Sapiens
IMGFIMNLP

SEQ ID NO: 416181 - protein, 9 aa, Homo Sapiens
GCVASINLS

SEQ ID NO: 416182 - protein, 9 aa, Homo Sapiens
RPACTCISM

SEQ ID NO: 416183 - protein, 9 aa, Homo Sapiens
HCPRALCHT

SEQ ID NO: 416184 - protein, 9 aa, Homo Sapiens
RWWRPAPST

SEQ ID NO: 416185 - protein, 9 aa, Homo Sapiens
PGNIGAPRP

SEQ ID NO: 416186 - protein, 9 aa, Homo Sapiens
HPFRARILC

SEQ ID NO: 416187 - protein, 9 aa, Homo Sapiens
IATRSPAPI

SEQ ID NO: 416188 - protein, 9 aa, Homo Sapiens
YGHQAPQVA

SEQ ID NO: 416189 - protein, 9 aa, Homo Sapiens
PPGPEGEAG

SEQ ID NO: 416190 - protein, 9 aa, Homo Sapiens
NKDPMLILR

SEQ ID NO: 416191 - protein, 9 aa, Homo Sapiens
KKIYIGGVS

SEQ ID NO: 416192 - protein, 9 aa, Homo Sapiens
EKAVGVIPP

SEQ ID NO: 416193 - protein, 9 aa, Homo Sapiens
RKGRGTRPP

SEQ ID NO: 416194 - protein, 9 aa, Homo Sapiens
DNQRSAQFK

SEQ ID NO: 416195 - protein, 9 aa, Homo Sapiens
PLARVHALV

SEQ ID NO: 416196 - protein, 9 aa, Homo Sapiens
CCSEDCAAD

SEQ ID NO: 416197 - protein, 9 aa, Homo Sapiens
LPLRGFLLH

SEQ ID NO: 416198 - protein, 9 aa, Homo Sapiens
DNSGYVSAY

SEQ ID NO: 416199 - protein, 9 aa, Homo Sapiens
KEEQPKKWT

SEQ ID NO: 416200 - protein, 9 aa, Homo Sapiens
RGGTQSFSC

SEQ ID NO: 416201 - protein, 9 aa, Homo Sapiens
SRWGPRATL

SEQ ID NO: 416202 - protein, 9 aa, Homo Sapiens
LCRKDGPVV

SEQ ID NO: 416203 - protein, 9 aa, Homo Sapiens
INTSPGVVV

SEQ ID NO: 416204 - protein, 9 aa, Homo Sapiens
AWTLTSLKY

SEQ ID NO: 416205 - protein, 9 aa, Homo Sapiens
ITSVNEYML

SEQ ID NO: 416206 - protein, 9 aa, Homo Sapiens
FQNHRCKMK

SEQ ID NO: 416207 - protein, 9 aa, Homo Sapiens
TTSHHMSSN

SEQ ID NO: 416208 - protein, 9 aa, Homo Sapiens
DQLAAQGAG

SEQ ID NO: 416209 - protein, 9 aa, Homo Sapiens
MPPVMLKVT

SEQ ID NO: 416210 - protein, 9 aa, Homo Sapiens
SRLSLHGAH

SEQ ID NO: 416211 - protein, 9 aa, Homo Sapiens
GNLLEKRAS

SEQ ID NO: 416212 - protein, 9 aa, Homo Sapiens
QTMGPRPAT

SEQ ID NO: 416213 - protein, 9 aa, Homo Sapiens
VVYLRIYMY

SEQ ID NO: 416214 - protein, 9 aa, Homo Sapiens
VPPACQPAL

SEQ ID NO: 416215 - protein, 9 aa, Homo Sapiens
LVSLGKTNE

SEQ ID NO: 416216 - protein, 9 aa, Homo Sapiens
AYPFFWSRA

SEQ ID NO: 416217 - protein, 9 aa, Homo Sapiens
QPATARSPR

SEQ ID NO: 416218 - protein, 9 aa, Homo Sapiens
LPCRVLWRN

SEQ ID NO: 416219 - protein, 9 aa, Homo Sapiens
IKLATEYAA

SEQ ID NO: 416220 - protein, 9 aa, Homo Sapiens
VAAHQDQVD

SEQ ID NO: 416221 - protein, 9 aa, Homo Sapiens
TIGGWRICC

SEQ ID NO: 416222 - protein, 9 aa, Homo Sapiens
HPEGLHQRS

SEQ ID NO: 416223 - protein, 9 aa, Homo Sapiens
YGYDACVVL

SEQ ID NO: 416224 - protein, 9 aa, Homo Sapiens
CISAYDDKL

SEQ ID NO: 416225 - protein, 9 aa, Homo Sapiens
LLTRWKCTL

SEQ ID NO: 416226 - protein, 9 aa, Homo Sapiens
VVCRSCCWA

SEQ ID NO: 416227 - protein, 9 aa, Homo Sapiens
ATITTLLLQ

SEQ ID NO: 416228 - protein, 9 aa, Homo Sapiens
RHVKLTDFG

SEQ ID NO: 416229 - protein, 9 aa, Homo Sapiens
GKSVDTIRS

SEQ ID NO: 416230 - protein, 9 aa, Homo Sapiens
KIQPKLLLT

SEQ ID NO: 416231 - protein, 9 aa, Homo Sapiens
NARIGKMKW

SEQ ID NO: 416232 - protein, 9 aa, Homo Sapiens
PHVLSPVSE

SEQ ID NO: 416233 - protein, 9 aa, Homo Sapiens
SCTPLCTPG

SEQ ID NO: 416234 - protein, 9 aa, Homo Sapiens
ANWVRPDLS

SEQ ID NO: 416235 - protein, 9 aa, Homo Sapiens
PCVEMPLGI

SEQ ID NO: 416236 - protein, 9 aa, Homo Sapiens
LSSLMMTDT

SEQ ID NO: 416237 - protein, 9 aa, Homo Sapiens
VCDTCLNGL

SEQ ID NO: 416238 - protein, 9 aa, Homo Sapiens
LEISLLHVW

SEQ ID NO: 416239 - protein, 9 aa, Homo Sapiens
VPLGPARTG

SEQ ID NO: 416240 - protein, 9 aa, Homo Sapiens
LCMNQLSPV

SEQ ID NO: 416241 - protein, 9 aa, Homo Sapiens
MILKMMMKL

SEQ ID NO: 416242 - protein, 9 aa, Homo Sapiens
KVPWKRKQR

SEQ ID NO: 416243 - protein, 9 aa, Homo Sapiens
ALKDAQSPS

SEQ ID NO: 416244 - protein, 9 aa, Homo Sapiens
DVVTGCLLL

SEQ ID NO: 416245 - protein, 9 aa, Homo Sapiens
VRGRGWTAC

SEQ ID NO: 416246 - protein, 9 aa, Homo Sapiens
GRSLPAGPS

SEQ ID NO: 416247 - protein, 9 aa, Homo Sapiens
SFWKEPSLL

SEQ ID NO: 416248 - protein, 9 aa, Homo Sapiens
SSRRNIALQ

SEQ ID NO: 416249 - protein, 9 aa, Homo Sapiens
KSYELIQKI

SEQ ID NO: 416250 - protein, 9 aa, Homo Sapiens
TYIGSMRPL

SEQ ID NO: 416251 - protein, 9 aa, Homo Sapiens
GCRKSSLLS

SEQ ID NO: 416252 - protein, 9 aa, Homo Sapiens
RLRGILEEL

SEQ ID NO: 416253 - protein, 9 aa, Homo Sapiens
NTGTSLMVG

SEQ ID NO: 416254 - protein, 9 aa, Homo Sapiens
TIASYGSAV

SEQ ID NO: 416255 - protein, 9 aa, Homo Sapiens
SKSTEMPSE

SEQ ID NO: 416256 - protein, 9 aa, Homo Sapiens
PRTESSQPR

SEQ ID NO: 416257 - protein, 9 aa, Homo Sapiens
KAVIFVSVQ

SEQ ID NO: 416258 - protein, 9 aa, Homo Sapiens
NLAHHTKAV

SEQ ID NO: 416259 - protein, 9 aa, Homo Sapiens
APKMCAPVG

SEQ ID NO: 416260 - protein, 9 aa, Homo Sapiens
CSGNDGRTR

SEQ ID NO: 416261 - protein, 9 aa, Homo Sapiens
SGIPDCYYV

SEQ ID NO: 416262 - protein, 9 aa, Homo Sapiens
LLCFFIFFI

SEQ ID NO: 416263 - protein, 9 aa, Homo Sapiens
MPQMVTHYA

SEQ ID NO: 416264 - protein, 9 aa, Homo Sapiens
CTQDLPGVK

SEQ ID NO: 416265 - protein, 9 aa, Homo Sapiens
PQDWTCHLR

SEQ ID NO: 416266 - protein, 9 aa, Homo Sapiens
SSPGTTQSA

SEQ ID NO: 416267 - protein, 9 aa, Homo Sapiens
KSEGMKSFH

SEQ ID NO: 416268 - protein, 9 aa, Homo Sapiens
AICLLGGGH

SEQ ID NO: 416269 - protein, 9 aa, Homo Sapiens
GHAAGGPAY

SEQ ID NO: 416270 - protein, 9 aa, Homo Sapiens
ENCRYLHDL

SEQ ID NO: 416271 - protein, 9 aa, Homo Sapiens
NVTSTAGTS

SEQ ID NO: 416272 - protein, 9 aa, Homo Sapiens
AKAGYSPLM

SEQ ID NO: 416273 - protein, 9 aa, Homo Sapiens
WLGIVSVPA

SEQ ID NO: 416274 - protein, 9 aa, Homo Sapiens
TNDMVDDNG

SEQ ID NO: 416275 - protein, 9 aa, Homo Sapiens
GSGWRSASQ

SEQ ID NO: 416276 - protein, 9 aa, Homo Sapiens
MLQESMAPA

SEQ ID NO: 416277 - protein, 9 aa, Homo Sapiens
PLPTRRMRT

SEQ ID NO: 416278 - protein, 9 aa, Homo Sapiens
HGRCSSGSG

SEQ ID NO: 416279 - protein, 9 aa, Homo Sapiens
SILASYGNI

SEQ ID NO: 416280 - protein, 9 aa, Homo Sapiens
PVNVFISSG

SEQ ID NO: 416281 - protein, 9 aa, Homo Sapiens
PHELFTELN

SEQ ID NO: 416282 - protein, 9 aa, Homo Sapiens
SGTWSGLKS

SEQ ID NO: 416283 - protein, 9 aa, Homo Sapiens
NITLGDLLT

SEQ ID NO: 416284 - protein, 9 aa, Homo Sapiens
VWTGADVPQ

SEQ ID NO: 416285 - protein, 9 aa, Homo Sapiens
KKAAAGSTD

SEQ ID NO: 416286 - protein, 9 aa, Homo Sapiens
EEAIRKKAF

SEQ ID NO: 416287 - protein, 9 aa, Homo Sapiens
ASLLLLQLQ

SEQ ID NO: 416288 - protein, 9 aa, Homo Sapiens
TGKKHYKCE

SEQ ID NO: 416289 - protein, 9 aa, Homo Sapiens
FILLFLVSR

SEQ ID NO: 416290 - protein, 9 aa, Homo Sapiens
LLLVVRVDT

SEQ ID NO: 416291 - protein, 9 aa, Homo Sapiens
VIVCDDFFV

SEQ ID NO: 416292 - protein, 9 aa, Homo Sapiens
DVEVDEVAC

SEQ ID NO: 416293 - protein, 9 aa, Homo Sapiens
TFIPAQMHS

SEQ ID NO: 416294 - protein, 9 aa, Homo Sapiens
HALRHRFSC

SEQ ID NO: 416295 - protein, 9 aa, Homo Sapiens
LEYTETQNQ

SEQ ID NO: 416296 - protein, 9 aa, Homo Sapiens
QTETLRDMV

SEQ ID NO: 416297 - protein, 9 aa, Homo Sapiens
AGTSLQEAS

SEQ ID NO: 416298 - protein, 9 aa, Homo Sapiens
ESAVAAHQD

SEQ ID NO: 416299 - protein, 9 aa, Homo Sapiens
QREWVTTIG

SEQ ID NO: 416300 - protein, 9 aa, Homo Sapiens
FLHCVALPD

SEQ ID NO: 416301 - protein, 9 aa, Homo Sapiens
SRSWWWRRG

SEQ ID NO: 416302 - protein, 9 aa, Homo Sapiens
RFFHVLFFT

SEQ ID NO: 416303 - protein, 9 aa, Homo Sapiens
MPDAMCVNS

SEQ ID NO: 416304 - protein, 9 aa, Homo Sapiens
STHVIQCYI

SEQ ID NO: 416305 - protein, 9 aa, Homo Sapiens
SFRKSKSKS

SEQ ID NO: 416306 - protein, 9 aa, Homo Sapiens
SQAEPTQPK

SEQ ID NO: 416307 - protein, 9 aa, Homo Sapiens
TLPISIQYR

SEQ ID NO: 416308 - protein, 9 aa, Homo Sapiens
GAWSGAWTK

SEQ ID NO: 416309 - protein, 9 aa, Homo Sapiens
ASSHVPVKN

SEQ ID NO: 416310 - protein, 9 aa, Homo Sapiens
LLQGLQSRM

SEQ ID NO: 416311 - protein, 9 aa, Homo Sapiens
GLRPTPPMP

SEQ ID NO: 416312 - protein, 9 aa, Homo Sapiens
GEPQDWTCH

SEQ ID NO: 416313 - protein, 9 aa, Homo Sapiens
DFEVFFFTI

SEQ ID NO: 416314 - protein, 9 aa, Homo Sapiens
TCYILHGSE

SEQ ID NO: 416315 - protein, 9 aa, Homo Sapiens
HDLCSPVYD

SEQ ID NO: 416316 - protein, 9 aa, Homo Sapiens
TPAVAQDEV

SEQ ID NO: 416317 - protein, 9 aa, Homo Sapiens
GEDSGGHSP

SEQ ID NO: 416318 - protein, 9 aa, Homo Sapiens
HYTFSGWRS

SEQ ID NO: 416319 - protein, 9 aa, Homo Sapiens
CWSSSRRWR

SEQ ID NO: 416320 - protein, 9 aa, Homo Sapiens
SKKSSHCLL

SEQ ID NO: 416321 - protein, 9 aa, Homo Sapiens
HLRTLEKNI

SEQ ID NO: 416322 - protein, 9 aa, Homo Sapiens
LFSIFSMMC

SEQ ID NO: 416323 - protein, 9 aa, Homo Sapiens
IPTSTRSLP

SEQ ID NO: 416324 - protein, 9 aa, Homo Sapiens
HDGGPRLRV

SEQ ID NO: 416325 - protein, 9 aa, Homo Sapiens
SGGHSPCSV

SEQ ID NO: 416326 - protein, 9 aa, Homo Sapiens
LWKAFHQND

SEQ ID NO: 416327 - protein, 9 aa, Homo Sapiens
EERIQDEDQ

SEQ ID NO: 416328 - protein, 9 aa, Homo Sapiens
IGAPRPKGA

SEQ ID NO: 416329 - protein, 9 aa, Homo Sapiens
QAALGAREG

SEQ ID NO: 416330 - protein, 9 aa, Homo Sapiens
GEVALSDAR

SEQ ID NO: 416331 - protein, 9 aa, Homo Sapiens
FHQSFHQMR

SEQ ID NO: 416332 - protein, 9 aa, Homo Sapiens
SRSAACGGR

SEQ ID NO: 416333 - protein, 9 aa, Homo Sapiens
RVDTHDQEL

SEQ ID NO: 416334 - protein, 9 aa, Homo Sapiens
TSLQEASMI

SEQ ID NO: 416335 - protein, 9 aa, Homo Sapiens
RCHRAVMAD

SEQ ID NO: 416336 - protein, 9 aa, Homo Sapiens
SPPKEFLLV

SEQ ID NO: 416337 - protein, 9 aa, Homo Sapiens
CYQLPQLQG

SEQ ID NO: 416338 - protein, 9 aa, Homo Sapiens
IVAVHVALV

SEQ ID NO: 416339 - protein, 9 aa, Homo Sapiens
VPRQASHQN

SEQ ID NO: 416340 - protein, 9 aa, Homo Sapiens
AALFMSQCL

SEQ ID NO: 416341 - protein, 9 aa, Homo Sapiens
TMPWGSGIS

SEQ ID NO: 416342 - protein, 9 aa, Homo Sapiens
SHYPPGGLP

SEQ ID NO: 416343 - protein, 9 aa, Homo Sapiens
PELMVPCLE

SEQ ID NO: 416344 - protein, 9 aa, Homo Sapiens
LCDSVDIFK

SEQ ID NO: 416345 - protein, 9 aa, Homo Sapiens
LSWSKTEEA

SEQ ID NO: 416346 - protein, 9 aa, Homo Sapiens
WLQGINKDQ

SEQ ID NO: 416347 - protein, 9 aa, Homo Sapiens
EVTIFLSKE

SEQ ID NO: 416348 - protein, 9 aa, Homo Sapiens
KPMQVLFSS

SEQ ID NO: 416349 - protein, 9 aa, Homo Sapiens
LVVHAGCQP

SEQ ID NO: 416350 - protein, 9 aa, Homo Sapiens
RPAPPYTPR

SEQ ID NO: 416351 - protein, 9 aa, Homo Sapiens
LALQAGPPG

SEQ ID NO: 416352 - protein, 9 aa, Homo Sapiens
YQCPAGLVE

SEQ ID NO: 416353 - protein, 9 aa, Homo Sapiens
SFELVVHFF

SEQ ID NO: 416354 - protein, 9 aa, Homo Sapiens
PQILCRMRS

SEQ ID NO: 416355 - protein, 9 aa, Homo Sapiens
ARPPQPPPA

SEQ ID NO: 416356 - protein, 9 aa, Homo Sapiens
EGCEAIVNT

SEQ ID NO: 416357 - protein, 9 aa, Homo Sapiens
SRSFRRSHC

SEQ ID NO: 416358 - protein, 9 aa, Homo Sapiens
VASPAQVTM

SEQ ID NO: 416359 - protein, 9 aa, Homo Sapiens
GEEQEQSKT

SEQ ID NO: 416360 - protein, 9 aa, Homo Sapiens
VCPKNAALG

SEQ ID NO: 416361 - protein, 9 aa, Homo Sapiens
PLSGGCCIP

SEQ ID NO: 416362 - protein, 9 aa, Homo Sapiens
LAINHGENL

SEQ ID NO: 416363 - protein, 9 aa, Homo Sapiens
HPQEGRSHH

SEQ ID NO: 416364 - protein, 9 aa, Homo Sapiens
KRAAGTATC

SEQ ID NO: 416365 - protein, 9 aa, Homo Sapiens
SVKDHRTSQ

SEQ ID NO: 416366 - protein, 9 aa, Homo Sapiens
DFHSMKVKV
